United States Patent 8,445,666 (RIBONUCLEIC ACID INTERFERENCE MOLECULES) - sequence listing, part 7

SEQ ID NO: 158313 - DNA, 22 bp, Homo sapiens
gacagagtctcactgtgtcatc

SEQ ID NO: 158314 - DNA, 23 bp, Homo sapiens
tgttggtcaggctggtcttgaac

SEQ ID NO: 158315 - DNA, 23 bp, Homo sapiens
tgctcagtgtcttacctcaccta

SEQ ID NO: 158316 - DNA, 23 bp, Homo sapiens
tctcagaacagattctgcacatg

SEQ ID NO: 158317 - DNA, 23 bp, Homo sapiens
gacggagtctctctctgtcaccc

SEQ ID NO: 158318 - DNA, 23 bp, Homo sapiens
cggagtctcactctgtcacccag

SEQ ID NO: 158319 - DNA, 23 bp, Homo sapiens
tacagacacaaaaatgagaggtg

SEQ ID NO: 158320 - DNA, 18 bp, Homo sapiens
agtctcgctctgtcaccc

SEQ ID NO: 158321 - DNA, 23 bp, Homo sapiens
aacaggagagattttcttcattt

SEQ ID NO: 158322 - DNA, 23 bp, Homo sapiens
agagtctcactctgtcacccagg

SEQ ID NO: 158323 - DNA, 20 bp, Homo sapiens
atcctgccttgccagggcca

SEQ ID NO: 158324 - DNA, 23 bp, Homo sapiens
agtgtacactggacattggtatg

SEQ ID NO: 158325 - DNA, 23 bp, Homo sapiens
aggtcatctctctgttgactggg

SEQ ID NO: 158326 - DNA, 23 bp, Homo sapiens
tgagttcattgtagattctggat

SEQ ID NO: 158327 - DNA, 23 bp, Homo sapiens
tgagttcattgtagattctggat

SEQ ID NO: 158328 - DNA, 22 bp, Homo sapiens
ctgaggtaggaggatcatttga

SEQ ID NO: 158329 - DNA, 23 bp, Homo sapiens
tggagagggtagaatgttggatc

SEQ ID NO: 158330 - DNA, 22 bp, Homo sapiens
tctcactctgtctgtcaggctg

SEQ ID NO: 158331 - DNA, 23 bp, Homo sapiens
gacagagtctcgctctgtcaccc

SEQ ID NO: 158332 - DNA, 21 bp, Homo sapiens
ctcacacctgtaatcccagca

SEQ ID NO: 158333 - DNA, 23 bp, Homo sapiens
atatgtgcatatgttaatgtatg

SEQ ID NO: 158334 - DNA, 23 bp, Homo sapiens
tatctcattgtgatttgatttgc

SEQ ID NO: 158335 - DNA, 23 bp, Homo sapiens
ggagtctcacactgtcacccagg

SEQ ID NO: 158336 - DNA, 22 bp, Homo sapiens
attagtagagtatagtaatggt

SEQ ID NO: 158337 - DNA, 23 bp, Homo sapiens
aacgaccatttgcttctggagtg

SEQ ID NO: 158338 - DNA, 21 bp, Homo sapiens
atatctgacatagaaaaagtg

SEQ ID NO: 158339 - DNA, 22 bp, Homo sapiens
tatatgtctgtagttttgatga

SEQ ID NO: 158340 - DNA, 23 bp, Homo sapiens
gcatgcactcacatgtgtgttcg

SEQ ID NO: 158341 - DNA, 22 bp, Homo sapiens
ttgtgagcagtgtgtgtgctca

SEQ ID NO: 158342 - DNA, 23 bp, Homo sapiens
ttgacagaagagcctcagcagtt

SEQ ID NO: 158343 - DNA, 23 bp, Homo sapiens
acagagtctcacactgtcgccca

SEQ ID NO: 158344 - DNA, 23 bp, Homo sapiens
agagtctcactctgtcacccagg

SEQ ID NO: 158345 - DNA, 23 bp, Homo sapiens
cagggtctcgcactgtcgctcag

SEQ ID NO: 158346 - DNA, 23 bp, Homo sapiens
acagtttcccacactttggattt

SEQ ID NO: 158347 - DNA, 21 bp, Homo sapiens
agtggttttaccctatggtag

SEQ ID NO: 158348 - DNA, 23 bp, Homo sapiens
taccacagggtagaaccacggac

SEQ ID NO: 158349 - DNA, 23 bp, Homo sapiens
aatctctctggaagaatacacaa

SEQ ID NO: 158350 - DNA, 23 bp, Homo sapiens
cagatgtgatttggagattatgg

SEQ ID NO: 158351 - DNA, 22 bp, Homo sapiens
ttagattgcatctttgttaata

SEQ ID NO: 158352 - DNA, 23 bp, Homo sapiens
tactctcagggaggttgtagtat

SEQ ID NO: 158353 - DNA, 23 bp, Homo sapiens
tgtgggtgcctgtgtccctggga

SEQ ID NO: 158354 - DNA, 23 bp, Homo sapiens
tggagtctcactctgtcacccag

SEQ ID NO: 158355 - DNA, 23 bp, Homo sapiens
gggtctcactctgtcacccaggc

SEQ ID NO: 158356 - DNA, 23 bp, Homo sapiens
tctcaccctctgtctgtgtccac

SEQ ID NO: 158357 - DNA, 21 bp, Homo sapiens
tgtgtatatatatacatatgt

SEQ ID NO: 158358 - DNA, 22 bp, Homo sapiens
tatgtatatatgtatatatgtg

SEQ ID NO: 158359 - DNA, 21 bp, Homo sapiens
tatatgtatatatacatatgt

SEQ ID NO: 158360 - DNA, 21 bp, Homo sapiens
tgtgtatatatatacatatgt

SEQ ID NO: 158361 - DNA, 21 bp, Homo sapiens
tgtgcgtgtgtgtgtatatgt

SEQ ID NO: 158362 - DNA, 22 bp, Homo sapiens
atgtggtttgataagaagttag

SEQ ID NO: 158363 - DNA, 18 bp, Homo sapiens
tctgggcaacatagtgag

SEQ ID NO: 158364 - DNA, 23 bp, Homo sapiens
tgagttcattgtagattctggat

SEQ ID NO: 158365 - DNA, 23 bp, Homo sapiens
tgagttcattgtagattctggat

SEQ ID NO: 158366 - DNA, 23 bp, Homo sapiens
aggagctcctttcaaacttttta

SEQ ID NO: 158367 - DNA, 23 bp, Homo sapiens
ttgtgagacctactatagtccat

SEQ ID NO: 158368 - DNA, 23 bp, Homo sapiens
aggagcactttaaaatttgtggt

SEQ ID NO: 158369 - DNA, 23 bp, Homo sapiens
gacggagtctgtctctgtctccc

SEQ ID NO: 158370 - DNA, 23 bp, Homo sapiens
gacagagtctcgctctgtcaccc

SEQ ID NO: 158371 - DNA, 21 bp, Homo sapiens
gggccactctctctgtgtctg

SEQ ID NO: 158372 - DNA, 23 bp, Homo sapiens
agagtgaatatatatatgtgtgt

SEQ ID NO: 158373 - DNA, 23 bp, Homo sapiens
cagagtctcactgtgtcatccag

SEQ ID NO: 158374 - DNA, 18 bp, Homo sapiens
cagtggggtgatcttggc

SEQ ID NO: 158375 - DNA, 23 bp, Homo sapiens
taacagccaagagtgctccttga

SEQ ID NO: 158376 - DNA, 20 bp, Homo sapiens
tgcaatggtgtgatcttggc

SEQ ID NO: 158377 - DNA, 23 bp, Homo sapiens
cagtctacagtagtgtgcagtaa

SEQ ID NO: 158378 - DNA, 23 bp, Homo sapiens
gtcacactcactcactggcacac

SEQ ID NO: 158379 - DNA, 23 bp, Homo sapiens
tctcacactgactctcatacttg

SEQ ID NO: 158380 - DNA, 21 bp, Homo sapiens
ttttgacacttgcaatgattt

SEQ ID NO: 158381 - DNA, 23 bp, Homo sapiens
acagagtctcactgtgtcgccca

SEQ ID NO: 158382 - DNA, 23 bp, Homo sapiens
tggagtctcactctgtcacccag

SEQ ID NO: 158383 - DNA, 23 bp, Homo sapiens
tgagttcattgtagattctggat

SEQ ID NO: 158384 - DNA, 23 bp, Homo sapiens
tgagttcattgtagattctggat

SEQ ID NO: 158385 - DNA, 23 bp, Homo sapiens
cctgtctctctctgcctatcagc

SEQ ID NO: 158386 - DNA, 22 bp, Homo sapiens
agtgcctctagagagtcaggac

SEQ ID NO: 158387 - DNA, 23 bp, Homo sapiens
gggtttctctctgtgcctgtgac

SEQ ID NO: 158388 - DNA, 19 bp, Homo sapiens
ggcagggagtttggagtct

SEQ ID NO: 158389 - DNA, 22 bp, Homo sapiens
tgtgtgagcagacactgctgct

SEQ ID NO: 158390 - DNA, 23 bp, Homo sapiens
acagagtctcgctctgtcaccca

SEQ ID NO: 158391 - DNA, 22 bp, Homo sapiens
agagaatgaactatgtcttgaa

SEQ ID NO: 158392 - DNA, 21 bp, Homo sapiens
tgagacagagtctcgctctgt

SEQ ID NO: 158393 - DNA, 23 bp, Homo sapiens
gctgagtgtgagaagacagtgtc

SEQ ID NO: 158394 - DNA, 23 bp, Homo sapiens
ttgagacagggtctcactctgtc

SEQ ID NO: 158395 - DNA, 21 bp, Homo sapiens
tctgagcctgcctgcatgcca

SEQ ID NO: 158396 - DNA, 23 bp, Homo sapiens
agtactgcctggacaggtggtgg

SEQ ID NO: 158397 - DNA, 23 bp, Homo sapiens
tctgtctgtctgtctgtccctgt

SEQ ID NO: 158398 - DNA, 23 bp, Homo sapiens
gaggtggagtctcactctgtcac

SEQ ID NO: 158399 - DNA, 23 bp, Homo sapiens
agagtctcactctgtcacccagg

SEQ ID NO: 158400 - DNA, 23 bp, Homo sapiens
taactgtctgtctcctaataggc

SEQ ID NO: 158401 - DNA, 23 bp, Homo sapiens
tgagttcattgtagattctggat

SEQ ID NO: 158402 - DNA, 23 bp, Homo sapiens
tgagttcattgtagattctggat

SEQ ID NO: 158403 - DNA, 21 bp, Homo sapiens
tgtatatacatgtatatgcat

SEQ ID NO: 158404 - DNA, 23 bp, Homo sapiens
atagaagactggaagtgctttgg

SEQ ID NO: 158405 - DNA, 23 bp, Homo sapiens
tatgtgatgaacattttgactgg

SEQ ID NO: 158406 - DNA, 23 bp, Homo sapiens
acaaggctgtaaagtgatggcac

SEQ ID NO: 158407 - DNA, 22 bp, Homo sapiens
attctgactgactgaataggct

SEQ ID NO: 158408 - DNA, 19 bp, Homo sapiens
tctctgtgtcacattttgg

SEQ ID NO: 158409 - DNA, 23 bp, Homo sapiens
tgatctgcaatcagtgatgtttg

SEQ ID NO: 158410 - DNA, 23 bp, Homo sapiens
tatatatgtatgtgtgcatatat

SEQ ID NO: 158411 - DNA, 22 bp, Homo sapiens
catatactttttgttttctgta

SEQ ID NO: 158412 - DNA, 23 bp, Homo sapiens
atatgtgtatatataagtgtgtg

SEQ ID NO: 158413 - DNA, 23 bp, Homo sapiens
tgagttcattgtagattctggat

SEQ ID NO: 158414 - DNA, 23 bp, Homo sapiens
tgagttcattgtagattctggat

SEQ ID NO: 158415 - DNA, 23 bp, Homo sapiens
acttcctgctggaccttctgtgt

SEQ ID NO: 158416 - DNA, 19 bp, Homo sapiens
tatgtatagatgtatagat

SEQ ID NO: 158417 - DNA, 22 bp, Homo sapiens
tgcatagatatgtatagatatg

SEQ ID NO: 158418 - DNA, 23 bp, Homo sapiens
tgcgtgactgctgtggatcaggt

SEQ ID NO: 158419 - DNA, 22 bp, Homo sapiens
aagatgcatgggaaatgtgtgc

SEQ ID NO: 158420 - DNA, 23 bp, Homo sapiens
cacactcactcactgcctccttt

SEQ ID NO: 158421 - DNA, 23 bp, Homo sapiens
agacagaacactctcaccagact

SEQ ID NO: 158422 - DNA, 23 bp, Homo sapiens
tgtgcgtctgtctgtgtcggtgt

SEQ ID NO: 158423 - DNA, 21 bp, Homo sapiens
tgccaccttttgtatacacct

SEQ ID NO: 158424 - DNA, 23 bp, Homo sapiens
tgagggtgagtgaaatgagtgaa

SEQ ID NO: 158425 - DNA, 23 bp, Homo sapiens
tcaggtctcactctgtcacccag

SEQ ID NO: 158426 - DNA, 23 bp, Homo sapiens
tctctgtgtatgttaaatgagct

SEQ ID NO: 158427 - DNA, 23 bp, Homo sapiens
acactgactctcacaaaggaagt

SEQ ID NO: 158428 - DNA, 21 bp, Homo sapiens
ggagctggaacttaaagtggt

SEQ ID NO: 158429 - DNA, 22 bp, Homo sapiens
ctcctgtagttccagctactca

SEQ ID NO: 158430 - DNA, 23 bp, Homo sapiens
tctctagctctctgtctgcatct

SEQ ID NO: 158431 - DNA, 21 bp, Homo sapiens
ttcactggtttctaagtctct

SEQ ID NO: 158432 - DNA, 21 bp, Homo sapiens
tgtgtgtgtgtgtgtctgtat

SEQ ID NO: 158433 - DNA, 23 bp, Homo sapiens
acgtatatgtatgtgtatagata

SEQ ID NO: 158434 - DNA, 19 bp, Homo sapiens
aagactgtggaatatgtag

SEQ ID NO: 158435 - DNA, 23 bp, Homo sapiens
ctcagatgtcactgtgcaggtga

SEQ ID NO: 158436 - DNA, 23 bp, Homo sapiens
tctctgtgcctcagtctccccat

SEQ ID NO: 158437 - DNA, 23 bp, Homo sapiens
ctgtgtgagctctggctggtcag

SEQ ID NO: 158438 - DNA, 23 bp, Homo sapiens
agccatagtctcactctgtcacc

SEQ ID NO: 158439 - DNA, 19 bp, Homo sapiens
tctatatatatagatatct

SEQ ID NO: 158440 - DNA, 22 bp, Homo sapiens
agggtctcactctgtcactcag

SEQ ID NO: 158441 - DNA, 23 bp, Homo sapiens
acgtctgagaccacagtgtggac

SEQ ID NO: 158442 - DNA, 19 bp, Homo sapiens
ttattgcatgcaaatctat

SEQ ID NO: 158443 - DNA, 20 bp, Homo sapiens
gttggtgaactacagcctgt

SEQ ID NO: 158444 - DNA, 22 bp, Homo sapiens
tcacactcactggttcacataa

SEQ ID NO: 158445 - DNA, 19 bp, Homo sapiens
acacctgtagttccaggtg

SEQ ID NO: 158446 - DNA, 22 bp, Homo sapiens
ttcattcatgttgtagcttata

SEQ ID NO: 158447 - DNA, 23 bp, Homo sapiens
ttccattgtatggatacagcata

SEQ ID NO: 158448 - DNA, 23 bp, Homo sapiens
tgagttcattgtagattctggat

SEQ ID NO: 158449 - DNA, 23 bp, Homo sapiens
tgagttcattgtagattctggat

SEQ ID NO: 158450 - DNA, 22 bp, Homo sapiens
cagactgtttctgtcactgaga

SEQ ID NO: 158451 - DNA, 21 bp, Homo sapiens
tgaatgagcatccagagacag

SEQ ID NO: 158452 - DNA, 23 bp, Homo sapiens
acacagacacacagtctactgtg

SEQ ID NO: 158453 - DNA, 23 bp, Homo sapiens
gcgtgtgtgtgtgtgtctctctc

SEQ ID NO: 158454 - DNA, 22 bp, Homo sapiens
gtgtatatatatgtatgtgtat

SEQ ID NO: 158455 - DNA, 19 bp, Homo sapiens
atttgttttttacctggag

SEQ ID NO: 158456 - DNA, 21 bp, Homo sapiens
tatagctagctagatgaatga

SEQ ID NO: 158457 - DNA, 23 bp, Homo sapiens
tgagttcattgtagattctggat

SEQ ID NO: 158458 - DNA, 23 bp, Homo sapiens
tgagttcattgtagattctggat

SEQ ID NO: 158459 - DNA, 19 bp, Homo sapiens
tgcaacttctgcctcctgg

SEQ ID NO: 158460 - DNA, 23 bp, Homo sapiens
atgtatgtatatgtatatgtgtg

SEQ ID NO: 158461 - DNA, 21 bp, Homo sapiens
tgaaatgtttagaagtttgga

SEQ ID NO: 158462 - DNA, 23 bp, Homo sapiens
tatatgtgtgtgtatatatatgt

SEQ ID NO: 158463 - DNA, 23 bp, Homo sapiens
tatatgtgtgtatatatatgtgt

SEQ ID NO: 158464 - DNA, 23 bp, Homo sapiens
tgtgtgtatatagatgtgtgtgt

SEQ ID NO: 158465 - DNA, 23 bp, Homo sapiens
attattgttttgagacggactgt

SEQ ID NO: 158466 - DNA, 18 bp, Homo sapiens
tctctgagcctcagtgtc

SEQ ID NO: 158467 - DNA, 23 bp, Homo sapiens
gaagtctcactctgtctccccag

SEQ ID NO: 158468 - DNA, 23 bp, Homo sapiens
acagagtctcactctgtcgccca

SEQ ID NO: 158469 - DNA, 20 bp, Homo sapiens
tatgtctacagtttcagcta

SEQ ID NO: 158470 - DNA, 23 bp, Homo sapiens
agtcagagtctcgctctgtcacc

SEQ ID NO: 158471 - DNA, 23 bp, Homo sapiens
tatttgtgcaaatgtatgcattc

SEQ ID NO: 158472 - DNA, 19 bp, Homo sapiens
tatatgtatgtatatgtat

SEQ ID NO: 158473 - DNA, 22 bp, Homo sapiens
tatgtgtgtatatacatatgtg

SEQ ID NO: 158474 - DNA, 21 bp, Homo sapiens
actgtcacagactgagtacta

SEQ ID NO: 158475 - DNA, 23 bp, Homo sapiens
tcactctctctctgtgccaggca

SEQ ID NO: 158476 - DNA, 22 bp, Homo sapiens
tctgagcctcggtgtatttttt

SEQ ID NO: 158477 - DNA, 23 bp, Homo sapiens
ggcggtcagtctgtgtctgtgcc

SEQ ID NO: 158478 - DNA, 22 bp, Homo sapiens
agtgagacagcctctcttttaa

SEQ ID NO: 158479 - DNA, 23 bp, Homo sapiens
tgaccgtgactgtcacttactca

SEQ ID NO: 158480 - DNA, 18 bp, Homo sapiens
agtctcgctctgtcacac

SEQ ID NO: 158481 - DNA, 20 bp, Homo sapiens
agagagaagagagtcagcaa

SEQ ID NO: 158482 - DNA, 23 bp, Homo sapiens
acatatgtgtgtatatgtattta

SEQ ID NO: 158483 - DNA, 23 bp, Homo sapiens
acatatgtgtgtatatgtattta

SEQ ID NO: 158484 - DNA, 23 bp, Homo sapiens
tgactctagagcctgtgctcttc

SEQ ID NO: 158485 - DNA, 23 bp, Homo sapiens
atggtgcaacttcagcttactgt

SEQ ID NO: 158486 - DNA, 21 bp, Homo sapiens
taagtggtagagttgagattt

SEQ ID NO: 158487 - DNA, 23 bp, Homo sapiens
ttgtctcattcctgatgtaggag

SEQ ID NO: 158488 - DNA, 23 bp, Homo sapiens
accattaagaatgatgtaagagc

SEQ ID NO: 158489 - DNA, 23 bp, Homo sapiens
actgagtctcactgtgtcaccca

SEQ ID NO: 158490 - DNA, 22 bp, Homo sapiens
atgtgtctgactgagaaaatgc

SEQ ID NO: 158491 - DNA, 19 bp, Homo sapiens
tcattcgccaatgagtctc

SEQ ID NO: 158492 - DNA, 20 bp, Homo sapiens
tatgtatatgtatacacgta

SEQ ID NO: 158493 - DNA, 20 bp, Homo sapiens
gtacatgtatatgtatacac

SEQ ID NO: 158494 - DNA, 23 bp, Homo sapiens
tgacctgagatgagagtcagctc

SEQ ID NO: 158495 - DNA, 21 bp, Homo sapiens
atgtatatatgtatatgtgtg

SEQ ID NO: 158496 - DNA, 23 bp, Homo sapiens
tgtgtgtataacatatgcttatc

SEQ ID NO: 158497 - DNA, 23 bp, Homo sapiens
cttggtgcatttgatttctctga

SEQ ID NO: 158498 - DNA, 21 bp, Homo sapiens
aagacataggacatggactca

SEQ ID NO: 158499 - DNA, 23 bp, Homo sapiens
tctctgcctgtctgtctctctgg

SEQ ID NO: 158500 - DNA, 21 bp, Homo sapiens
atttcatattatatatgtgtg

SEQ ID NO: 158501 - DNA, 22 bp, Homo sapiens
atagtgcacacaaacatgatgt

SEQ ID NO: 158502 - DNA, 21 bp, Homo sapiens
tgtgtatatatatatatgtgt

SEQ ID NO: 158503 - DNA, 18 bp, Homo sapiens
gtgagatgtgcaaggaga

SEQ ID NO: 158504 - DNA, 23 bp, Homo sapiens
gagcgtctctgtgtgtgtcagtg

SEQ ID NO: 158505 - DNA, 23 bp, Homo sapiens
gcaggatgtgtgtttcgcaggct

SEQ ID NO: 158506 - DNA, 23 bp, Homo sapiens
ccctctctgtctctgtctgtctc

SEQ ID NO: 158507 - DNA, 23 bp, Homo sapiens
taaatgatgcctgtggttcccat

SEQ ID NO: 158508 - DNA, 23 bp, Homo sapiens
gagacagagtctcactctgtcac

SEQ ID NO: 158509 - DNA, 23 bp, Homo sapiens
gacagtctcagtctctcacccag

SEQ ID NO: 158510 - DNA, 23 bp, Homo sapiens
gggggtgtaagtgtgcatatgct

SEQ ID NO: 158511 - DNA, 23 bp, Homo sapiens
tctgtctctctctgtatctccat

SEQ ID NO: 158512 - DNA, 23 bp, Homo sapiens
ttgttgttacagagtctcactct

SEQ ID NO: 158513 - DNA, 23 bp, Homo sapiens
tgtcttgagacaggctctcactc

SEQ ID NO: 158514 - DNA, 23 bp, Homo sapiens
agtggcactgtcacagctcattg

SEQ ID NO: 158515 - DNA, 23 bp, Homo sapiens
agagtctcactctgtctcccagg

SEQ ID NO: 158516 - DNA, 23 bp, Homo sapiens
ctgtgtctgtcactgcgcctgta

SEQ ID NO: 158517 - DNA, 18 bp, Homo sapiens
cactccctcagtctcaca

SEQ ID NO: 158518 - DNA, 20 bp, Homo sapiens
tgacacaagtcagtcagcac

SEQ ID NO: 158519 - DNA, 22 bp, Homo sapiens
ttagacacctttctgaatcact

SEQ ID NO: 158520 - DNA, 23 bp, Homo sapiens
gacactcagaggctcttgttttt

SEQ ID NO: 158521 - DNA, 23 bp, Homo sapiens
tgtgtatatatgtatatatgtgt

SEQ ID NO: 158522 - DNA, 22 bp, Homo sapiens
atgtgtatatatgtatatatgt

SEQ ID NO: 158523 - DNA, 23 bp, Homo sapiens
atatgtgtatatgtgtatatgtg

SEQ ID NO: 158524 - DNA, 22 bp, Homo sapiens
tggaaagtaaagcagtatcaag

SEQ ID NO: 158525 - DNA, 23 bp, Homo sapiens
gagtctcactctgtcaccccagc

SEQ ID NO: 158526 - DNA, 18 bp, Homo sapiens
actcagaggaccgctgtg

SEQ ID NO: 158527 - DNA, 23 bp, Homo sapiens
acagggtctcactctgtcaccca

SEQ ID NO: 158528 - DNA, 23 bp, Homo sapiens
acgtgatggagggtttgttctgt

SEQ ID NO: 158529 - DNA, 22 bp, Homo sapiens
tcacatgatcctgtgtggtaga

SEQ ID NO: 158530 - DNA, 22 bp, Homo sapiens
gcctgtgtctgtctcgctcact

SEQ ID NO: 158531 - DNA, 23 bp, Homo sapiens
gctctctttctctctgtagatgc

SEQ ID NO: 158532 - DNA, 22 bp, Homo sapiens
tgattcacagtctctgtgcctc

SEQ ID NO: 158533 - DNA, 23 bp, Homo sapiens
gactgcctctcagtcactgtgtg

SEQ ID NO: 158534 - DNA, 21 bp, Homo sapiens
tgcctgggtccctggctgact

SEQ ID NO: 158535 - DNA, 21 bp, Homo sapiens
tctcagtgggatgaaggtggg

SEQ ID NO: 158536 - DNA, 21 bp, Homo sapiens
acaaagtgtgtatacatatgt

SEQ ID NO: 158537 - DNA, 23 bp, Homo sapiens
ctgtctgcttgttgcttgtgggc

SEQ ID NO: 158538 - DNA, 23 bp, Homo sapiens
ttgagagatgtgagtgagcaact

SEQ ID NO: 158539 - DNA, 21 bp, Homo sapiens
ttgctgcatttggcttctttg

SEQ ID NO: 158540 - DNA, 23 bp, Homo sapiens
accttctctctcactctctagtg

SEQ ID NO: 158541 - DNA, 21 bp, Homo sapiens
atctcatgttttaacatagag

SEQ ID NO: 158542 - DNA, 23 bp, Homo sapiens
taactgaatttgttcatcttctg

SEQ ID NO: 158543 - DNA, 23 bp, Homo sapiens
ggctcactgggtgtctgagagac

SEQ ID NO: 158544 - DNA, 23 bp, Homo sapiens
tggagtctcactctgtcacccag

SEQ ID NO: 158545 - DNA, 20 bp, Homo sapiens
tagtgctgaaagttttgggt

SEQ ID NO: 158546 - DNA, 23 bp, Homo sapiens
acggtctcactctgtcattcagg

SEQ ID NO: 158547 - DNA, 23 bp, Homo sapiens
atgacagattctgctaacgtgat

SEQ ID NO: 158548 - DNA, 23 bp, Homo sapiens
tgtgtgtgtatatatatgtgtgt

SEQ ID NO: 158549 - DNA, 23 bp, Homo sapiens
atatgtgtgtatatatgtgtgtg

SEQ ID NO: 158550 - DNA, 23 bp, Homo sapiens
ctgtctgtctgtctgtctgccac

SEQ ID NO: 158551 - DNA, 23 bp, Homo sapiens
acagggtctcactttctgtcagc

SEQ ID NO: 158552 - DNA, 23 bp, Homo sapiens
gcgacagactgagactccgtctc

SEQ ID NO: 158553 - DNA, 20 bp, Homo sapiens
tcatgctgcttcttggtcca

SEQ ID NO: 158554 - DNA, 22 bp, Homo sapiens
ctagagacaaaagtgagtgcac

SEQ ID NO: 158555 - DNA, 23 bp, Homo sapiens
tctcactgtgtaatgcgtaatgc

SEQ ID NO: 158556 - DNA, 23 bp, Homo sapiens
tgcctggcagcctctgagcctca

SEQ ID NO: 158557 - DNA, 22 bp, Homo sapiens
gtccggctctctctctgctagg

SEQ ID NO: 158558 - DNA, 20 bp, Homo sapiens
aaaaaaagttgtggcactct

SEQ ID NO: 158559 - DNA, 23 bp, Homo sapiens
tggtgcacctgtagttccagctg

SEQ ID NO: 158560 - DNA, 23 bp, Homo sapiens
tgagttcattgtagattctggat

SEQ ID NO: 158561 - DNA, 23 bp, Homo sapiens
tgagttcattgtagattctggat

SEQ ID NO: 158562 - DNA, 22 bp, Homo sapiens
ctctgcctgtgtctgtctggga

SEQ ID NO: 158563 - DNA, 23 bp, Homo sapiens
tcccacagtcagtgacacggtgg

SEQ ID NO: 158564 - DNA, 20 bp, Homo sapiens
ggcaggcacagaggttgggt

SEQ ID NO: 158565 - DNA, 19 bp, Homo sapiens
tctgtgtttctgacaagcc

SEQ ID NO: 158566 - DNA, 23 bp, Homo sapiens
ctgcctgtctgtctgtctgtggc

SEQ ID NO: 158567 - DNA, 23 bp, Homo sapiens
gagggagtctcactctgtcaccc

SEQ ID NO: 158568 - DNA, 23 bp, Homo sapiens
gtgaaacagcatctccttggggt

SEQ ID NO: 158569 - DNA, 22 bp, Homo sapiens
accctgtctctgcaaaacattt

SEQ ID NO: 158570 - DNA, 23 bp, Homo sapiens
acagagtctcactttgtcactca

SEQ ID NO: 158571 - DNA, 23 bp, Homo sapiens
gtctccatctctctctggttctg

SEQ ID NO: 158572 - DNA, 19 bp, Homo sapiens
tcagtgtatagggagctgc

SEQ ID NO: 158573 - DNA, 23 bp, Homo sapiens
tttgagacggagtctcactctgt

SEQ ID NO: 158574 - DNA, 23 bp, Homo sapiens
acaagtctcgctctgtcacccag

SEQ ID NO: 158575 - DNA, 18 bp, Homo sapiens
tcactgcaagctctgcct

SEQ ID NO: 158576 - DNA, 18 bp, Homo sapiens
ggttgcttttcttggtgt

SEQ ID NO: 158577 - DNA, 23 bp, Homo sapiens
acagtggtgtgtgtgctgagtgt

SEQ ID NO: 158578 - DNA, 23 bp, Homo sapiens
aaactcagtctaaacccctttgt

SEQ ID NO: 158579 - DNA, 23 bp, Homo sapiens
tgacatggtctggctctgtcacc

SEQ ID NO: 158580 - DNA, 22 bp, Homo sapiens
atcatggtcattctctgtctca

SEQ ID NO: 158581 - DNA, 22 bp, Homo sapiens
tgagtcagaatctctctctgtt

SEQ ID NO: 158582 - DNA, 18 bp, Homo sapiens
tgatgatttaatctgtag

SEQ ID NO: 158583 - DNA, 23 bp, Homo sapiens
catgactcactgcagtctcagcc

SEQ ID NO: 158584 - DNA, 22 bp, Homo sapiens
tcccctgttgaatgacgtctgt

SEQ ID NO: 158585 - DNA, 23 bp, Homo sapiens
acaaaatgatgaggttctagtat

SEQ ID NO: 158586 - DNA, 21 bp, Homo sapiens
gagtcagagtctcactcactt

SEQ ID NO: 158587 - DNA, 23 bp, Homo sapiens
gacagagtctcgctctgtggctg

SEQ ID NO: 158588 - DNA, 23 bp, Homo sapiens
tttgatagtggtttcgatttgca

SEQ ID NO: 158589 - DNA, 23 bp, Homo sapiens
ctggcactctctctggctgcctc

SEQ ID NO: 158590 - DNA, 22 bp, Homo sapiens
cagtagtttctgcagagaaact

SEQ ID NO: 158591 - DNA, 23 bp, Homo sapiens
atctcagaagtcactgtgcaggg

SEQ ID NO: 158592 - DNA, 23 bp, Homo sapiens
gcagcttagaggaatagttattc

SEQ ID NO: 158593 - DNA, 23 bp, Homo sapiens
tggtactgtctttatttcatgtt

SEQ ID NO: 158594 - DNA, 23 bp, Homo sapiens
atggtactgtgtatttcttgttt

SEQ ID NO: 158595 - DNA, 23 bp, Homo sapiens
tccataaagctctgctgtgtgag

SEQ ID NO: 158596 - DNA, 18 bp, Homo sapiens
aaggtgatgtagggcagc

SEQ ID NO: 158597 - DNA, 21 bp, Homo sapiens
cacagcctgagttcaccaggt

SEQ ID NO: 158598 - DNA, 20 bp, Homo sapiens
gcctgcgtccctgtatctca

SEQ ID NO: 158599 - DNA, 18 bp, Homo sapiens
aaaggacagctgcctctc

SEQ ID NO: 158600 - DNA, 19 bp, Homo sapiens
agagtagtcagtgaccacc

SEQ ID NO: 158601 - DNA, 23 bp, Homo sapiens
ctctgagcctgtgtctgccactg

SEQ ID NO: 158602 - DNA, 22 bp, Homo sapiens
ctgtctgacgagagtgacctca

SEQ ID NO: 158603 - DNA, 23 bp, Homo sapiens
agatcttcactcaggctcactgg

SEQ ID NO: 158604 - DNA, 22 bp, Homo sapiens
ttgagacagggttctctgtctg

SEQ ID NO: 158605 - DNA, 23 bp, Homo sapiens
tctctctgctgtctctgtgtgtc

SEQ ID NO: 158606 - DNA, 23 bp, Homo sapiens
gctgtctgtgtctgtctgtcctg

SEQ ID NO: 158607 - DNA, 22 bp, Homo sapiens
acgtcttcaaagtttgtccaca

SEQ ID NO: 158608 - DNA, 23 bp, Homo sapiens
ttttgagacagagtctcactctg

SEQ ID NO: 158609 - DNA, 23 bp, Homo sapiens
agacagagtctcgctctgtcacc

SEQ ID NO: 158610 - DNA, 23 bp, Homo sapiens
aaaatactgccttgactgacact

SEQ ID NO: 158611 - DNA, 20 bp, Homo sapiens
tgtctctcaggctctgtggt

SEQ ID NO: 158612 - DNA, 18 bp, Homo sapiens
tgagaccaagtctcgctc

SEQ ID NO: 158613 - DNA, 22 bp, Homo sapiens
atatgtgtatatatatgtgtgt

SEQ ID NO: 158614 - DNA, 23 bp, Homo sapiens
atatgtgtgtatatatatgtgtg

SEQ ID NO: 158615 - DNA, 23 bp, Homo sapiens
ctcattgtggttttgatttgcat

SEQ ID NO: 158616 - DNA, 22 bp, Homo sapiens
tctcagcacccagtgtctgtga

SEQ ID NO: 158617 - DNA, 23 bp, Homo sapiens
tctctctgactcagtctcctcat

SEQ ID NO: 158618 - DNA, 23 bp, Homo sapiens
tagtcacagctgtcactgtcacc

SEQ ID NO: 158619 - DNA, 18 bp, Homo sapiens
acagtgtggccaggtgga

SEQ ID NO: 158620 - DNA, 23 bp, Homo sapiens
tttttgagacgtagtcttgcgtt

SEQ ID NO: 158621 - DNA, 22 bp, Homo sapiens
ggagaggttcgtgtatgttagg

SEQ ID NO: 158622 - DNA, 22 bp, Homo sapiens
gtgttggttttgctgagagtcc

SEQ ID NO: 158623 - DNA, 23 bp, Homo sapiens
caggagactctcacagagtccct

SEQ ID NO: 158624 - DNA, 23 bp, Homo sapiens
tggagtctcactctgtcacccag

SEQ ID NO: 158625 - DNA, 21 bp, Homo sapiens
acggaacaaccaggagtgctg

SEQ ID NO: 158626 - DNA, 22 bp, Homo sapiens
tgacatagtatgtgtgtgtata

SEQ ID NO: 158627 - DNA, 21 bp, Homo sapiens
tctctcacacccatttctctc

SEQ ID NO: 158628 - DNA, 21 bp, Homo sapiens
attgtatttgtagtttgggga

SEQ ID NO: 158629 - DNA, 19 bp, Homo sapiens
tagccaggatggttttgat

SEQ ID NO: 158630 - DNA, 23 bp, Homo sapiens
tgtgtgtctgcctgcctgtctgg

SEQ ID NO: 158631 - DNA, 23 bp, Homo sapiens
aacagtctcgctctgtcgctcag

SEQ ID NO: 158632 - DNA, 19 bp, Homo sapiens
atgagagaagactgagagc

SEQ ID NO: 158633 - DNA, 23 bp, Homo sapiens
cttggctgttcttaggtttttgt

SEQ ID NO: 158634 - DNA, 18 bp, Homo sapiens
tgcatgggagagcccctc

SEQ ID NO: 158635 - DNA, 23 bp, Homo sapiens
tgtccgtctgtcacacgcagagt

SEQ ID NO: 158636 - DNA, 23 bp, Homo sapiens
ggtcagtctgtggctctggcagt

SEQ ID NO: 158637 - DNA, 23 bp, Homo sapiens
aattgtcatcaagctcatggttc

SEQ ID NO: 158638 - DNA, 19 bp, Homo sapiens
aagagaggcatcatccagg

SEQ ID NO: 158639 - DNA, 23 bp, Homo sapiens
gaagcagcatttgaaacccgtgt

SEQ ID NO: 158640 - DNA, 22 bp, Homo sapiens
atagtgggtccaagtattggag

SEQ ID NO: 158641 - DNA, 23 bp, Homo sapiens
tcaagtcacagaaactgcttggg

SEQ ID NO: 158642 - DNA, 23 bp, Homo sapiens
agagtctcactctgtcacccagg

SEQ ID NO: 158643 - DNA, 22 bp, Homo sapiens
agacagagcttcatcatgttgg

SEQ ID NO: 158644 - DNA, 23 bp, Homo sapiens
agagcttgctctcactcactctc

SEQ ID NO: 158645 - DNA, 19 bp, Homo sapiens
acacagtgagaaagcagct

SEQ ID NO: 158646 - DNA, 23 bp, Homo sapiens
tatatatgtaaggtatgcatggg

SEQ ID NO: 158647 - DNA, 23 bp, Homo sapiens
atgcatggatgtctgtgtacatg

SEQ ID NO: 158648 - DNA, 21 bp, Homo sapiens
tctgagtcaccacactggggg

SEQ ID NO: 158649 - DNA, 23 bp, Homo sapiens
gacggagtctcactctgacaccc

SEQ ID NO: 158650 - DNA, 18 bp, Homo sapiens
tggtgagatcttggctca

SEQ ID NO: 158651 - DNA, 23 bp, Homo sapiens
tgcaggtgtgtgtgtgtgtgtca

SEQ ID NO: 158652 - DNA, 23 bp, Homo sapiens
gggtctcactctgtcacccaggc

SEQ ID NO: 158653 - DNA, 21 bp, Homo sapiens
ctgtgaggtcactgtgtgaca

SEQ ID NO: 158654 - DNA, 23 bp, Homo sapiens
ggctttgtctgtctctctgagtc

SEQ ID NO: 158655 - DNA, 20 bp, Homo sapiens
tttgcatggctgtatgtgtg

SEQ ID NO: 158656 - DNA, 23 bp, Homo sapiens
agacggagtctcgctctgtcgct

SEQ ID NO: 158657 - DNA, 23 bp, Homo sapiens
cggagtctcgctctgtcgctcag

SEQ ID NO: 158658 - DNA, 20 bp, Homo sapiens
aggtgttaagaagttaagga

SEQ ID NO: 158659 - DNA, 23 bp, Homo sapiens
tggagtctcactctgtcacccag

SEQ ID NO: 158660 - DNA, 23 bp, Homo sapiens
tcactctcacaggcagcctctct

SEQ ID NO: 158661 - DNA, 19 bp, Homo sapiens
atgtttactattgttggct

SEQ ID NO: 158662 - DNA, 21 bp, Homo sapiens
ttgaggctacagtgagccatg

SEQ ID NO: 158663 - DNA, 23 bp, Homo sapiens
cttcactctctctgagtctccct

SEQ ID NO: 158664 - DNA, 23 bp, Homo sapiens
agctatgtggttcgacttttttt

SEQ ID NO: 158665 - DNA, 23 bp, Homo sapiens
tgagacagggtctcactctgttg

SEQ ID NO: 158666 - DNA, 23 bp, Homo sapiens
tctctgtaactggttttgttctg

SEQ ID NO: 158667 - DNA, 23 bp, Homo sapiens
atctggaaatcattcgataaagt

SEQ ID NO: 158668 - DNA, 22 bp, Homo sapiens
tttgacaggatctcactctgtt

SEQ ID NO: 158669 - DNA, 23 bp, Homo sapiens
agccagccctgtgtctgtgtctc

SEQ ID NO: 158670 - DNA, 23 bp, Homo sapiens
tgagttcattgtagattctggat

SEQ ID NO: 158671 - DNA, 23 bp, Homo sapiens
tgagttcattgtagattctggat

SEQ ID NO: 158672 - DNA, 21 bp, Homo sapiens
tttgagacagagtctcgctct

SEQ ID NO: 158673 - DNA, 23 bp, Homo sapiens
tatgcatatgtatgtgtatgtat

SEQ ID NO: 158674 - DNA, 23 bp, Homo sapiens
tgagatggagtctcactctgtcg

SEQ ID NO: 158675 - DNA, 23 bp, Homo sapiens
tgttgcagcagcatagcctgttc

SEQ ID NO: 158676 - DNA, 23 bp, Homo sapiens
tgtagtctgggtgatgaagtgag

SEQ ID NO: 158677 - DNA, 20 bp, Homo sapiens
agtctcccactgtcacccag

SEQ ID NO: 158678 - DNA, 23 bp, Homo sapiens
aggtaggaggatcacttgagcct

SEQ ID NO: 158679 - DNA, 20 bp, Homo sapiens
tccatgaggagctgagtgtg

SEQ ID NO: 158680 - DNA, 23 bp, Homo sapiens
atactgtatgcatatggattgac

SEQ ID NO: 158681 - DNA, 23 bp, Homo sapiens
ttgagacagtcttgctgtgtcac

SEQ ID NO: 158682 - DNA, 23 bp, Homo sapiens
aattctttatttttatgtgagtg

SEQ ID NO: 158683 - DNA, 23 bp, Homo sapiens
tgagatggagtctcactctgtca

SEQ ID NO: 158684 - DNA, 23 bp, Homo sapiens
ataattatgatcatgatgatgat

SEQ ID NO: 158685 - DNA, 23 bp, Homo sapiens
actgggataatgctgttacctta

SEQ ID NO: 158686 - DNA, 23 bp, Homo sapiens
tgagttcattgtagattctggat

SEQ ID NO: 158687 - DNA, 23 bp, Homo sapiens
tgagttcattgtagattctggat

SEQ ID NO: 158688 - DNA, 22 bp, Homo sapiens
cttctcctgcttcagctacctc

SEQ ID NO: 158689 - DNA, 22 bp, Homo sapiens
atgtagaacatttccatcactg

SEQ ID NO: 158690 - DNA, 23 bp, Homo sapiens
aacagacttcatccagaaaggat

SEQ ID NO: 158691 - DNA, 23 bp, Homo sapiens
gtctctgccactctccctgcctg

SEQ ID NO: 158692 - DNA, 23 bp, Homo sapiens
cttaggattctgtgcctcagttt

SEQ ID NO: 158693 - DNA, 19 bp, Homo sapiens
atagtagtagtatcggcct

SEQ ID NO: 158694 - DNA, 18 bp, Homo sapiens
tgtggtatgtgatgtgtg

SEQ ID NO: 158695 - DNA, 23 bp, Homo sapiens
cagtgtcacggtccctgagtccc

SEQ ID NO: 158696 - DNA, 21 bp, Homo sapiens
aacatgtatacaatacactat

SEQ ID NO: 158697 - DNA, 23 bp, Homo sapiens
atatctgtatatgtatatgtata

SEQ ID NO: 158698 - DNA, 22 bp, Homo sapiens
aatagctgggatcacaggtgca

SEQ ID NO: 158699 - DNA, 20 bp, Homo sapiens
gtttcatcatgtgggccaga

SEQ ID NO: 158700 - DNA, 23 bp, Homo sapiens
tctgcctcagcctcccgagtagc

SEQ ID NO: 158701 - DNA, 23 bp, Homo sapiens
tatgtgtatatatatgtgtgtgt

SEQ ID NO: 158702 - DNA, 23 bp, Homo sapiens
agagtctcactctgtcacccagg

SEQ ID NO: 158703 - DNA, 23 bp, Homo sapiens
gagtctcactctgtcacccaggc

SEQ ID NO: 158704 - DNA, 20 bp, Homo sapiens
ctgtcacactgtcagtgtct

SEQ ID NO: 158705 - DNA, 18 bp, Homo sapiens
atacaagcacatgtagtg

SEQ ID NO: 158706 - DNA, 23 bp, Homo sapiens
gactcacagagcagactgagctc

SEQ ID NO: 158707 - DNA, 21 bp, Homo sapiens
aatcaggatctaaaatgatag

SEQ ID NO: 158708 - DNA, 20 bp, Homo sapiens
gctactctgtcacactcata

SEQ ID NO: 158709 - DNA, 23 bp, Homo sapiens
tgtgtgtatgtgtgtctgtcttt

SEQ ID NO: 158710 - DNA, 23 bp, Homo sapiens
tgagttcattgtagattctggat

SEQ ID NO: 158711 - DNA, 23 bp, Homo sapiens
tgagttcattgtagattctggat

SEQ ID NO: 158712 - DNA, 23 bp, Homo sapiens
acacacatatgtgtgtatatata

SEQ ID NO: 158713 - DNA, 19 bp, Homo sapiens
tacacacatatatatgtgt

SEQ ID NO: 158714 - DNA, 20 bp, Homo sapiens
tagatgcatatatatacata

SEQ ID NO: 158715 - DNA, 23 bp, Homo sapiens
atatgtttgtatatatacgtata

SEQ ID NO: 158716 - DNA, 19 bp, Homo sapiens
tacagtgacatgaacacag

SEQ ID NO: 158717 - DNA, 23 bp, Homo sapiens
tgtatgtgtgtgcttgtgcacag

SEQ ID NO: 158718 - DNA, 18 bp, Homo sapiens
actcaggagattaatcag

SEQ ID NO: 158719 - DNA, 23 bp, Homo sapiens
aaaaataaaagaggtcccagaga

SEQ ID NO: 158720 - DNA, 19 bp, Homo sapiens
aatgggcatggttgtattc

SEQ ID NO: 158721 - DNA, 19 bp, Homo sapiens
tccataggtcatggtttgc

SEQ ID NO: 158722 - DNA, 21 bp, Homo sapiens
actctcacagagtttcttgtc

SEQ ID NO: 158723 - DNA, 23 bp, Homo sapiens
tgagaccgagtctcactctgtca

SEQ ID NO: 158724 - DNA, 23 bp, Homo sapiens
tgtggttttcatttgcatttcct

SEQ ID NO: 158725 - DNA, 23 bp, Homo sapiens
atctcgctctgtcacacaggctg

SEQ ID NO: 158726 - DNA, 23 bp, Homo sapiens
tctgactctgagtctgtgccttt

SEQ ID NO: 158727 - DNA, 20 bp, Homo sapiens
aaggatgaagaaaccgaggt

SEQ ID NO: 158728 - DNA, 21 bp, Homo sapiens
ggacacagtcactggatttgg

SEQ ID NO: 158729 - DNA, 23 bp, Homo sapiens
gatacagtctcactctgtcgccc

SEQ ID NO: 158730 - DNA, 23 bp, Homo sapiens
atcgttggtcatcaagggtttgt

SEQ ID NO: 158731 - DNA, 18 bp, Homo sapiens
gtcactctgtccctctgc

SEQ ID NO: 158732 - DNA, 23 bp, Homo sapiens
gacagagtctcgctctgtcaccc

SEQ ID NO: 158733 - DNA, 21 bp, Homo sapiens
cttctgtctgtgtctctgggg

SEQ ID NO: 158734 - DNA, 21 bp, Homo sapiens
agaatacttcccagaggcaga

SEQ ID NO: 158735 - DNA, 23 bp, Homo sapiens
ctgtgtctgtgtgtcaaacatct

SEQ ID NO: 158736 - DNA, 20 bp, Homo sapiens
tgagccatgatcatgccact

SEQ ID NO: 158737 - DNA, 18 bp, Homo sapiens
attgtataacatatagta

SEQ ID NO: 158738 - DNA, 23 bp, Homo sapiens
tatatagtactatatgttataca

SEQ ID NO: 158739 - DNA, 23 bp, Homo sapiens
ttttagaaagctcatcctggctt

SEQ ID NO: 158740 - DNA, 23 bp, Homo sapiens
ttgtctttcattcttaatgtgat

SEQ ID NO: 158741 - DNA, 23 bp, Homo sapiens
gaattgagaagtaggtaagtatg

SEQ ID NO: 158742 - DNA, 20 bp, Homo sapiens
cagagaagctactctctgag

SEQ ID NO: 158743 - DNA, 23 bp, Homo sapiens
cactgctgtgtctctgtcaccta

SEQ ID NO: 158744 - DNA, 22 bp, Homo sapiens
tatatactgtatatgtatatct

SEQ ID NO: 158745 - DNA, 23 bp, Homo sapiens
agagtctcactctgtcacccagg

SEQ ID NO: 158746 - DNA, 23 bp, Homo sapiens
gagtctcactctgtcacccaggc

SEQ ID NO: 158747 - DNA, 23 bp, Homo sapiens
agctttgctgaatttgttgatca

SEQ ID NO: 158748 - DNA, 23 bp, Homo sapiens
gcagtgagtattgaatttgttct

SEQ ID NO: 158749 - DNA, 23 bp, Homo sapiens
ctcactgcagtctctgtctccca

SEQ ID NO: 158750 - DNA, 20 bp, Homo sapiens
aggctgtctgcagaggatgt

SEQ ID NO: 158751 - DNA, 23 bp, Homo sapiens
gcatatgtgtgcttaagaagtga

SEQ ID NO: 158752 - DNA, 23 bp, Homo sapiens
tatgtgtgtatatatatgtgtgt

SEQ ID NO: 158753 - DNA, 23 bp, Homo sapiens
tgtgtatatatatgtgtgtgtat

SEQ ID NO: 158754 - DNA, 23 bp, Homo sapiens
tatgtgtgtatatatatatgtgt

SEQ ID NO: 158755 - DNA, 21 bp, Homo sapiens
taaaggtcagtttgaaaaaca

SEQ ID NO: 158756 - DNA, 23 bp, Homo sapiens
cataagtgagtttttctttttaa

SEQ ID NO: 158757 - DNA, 23 bp, Homo sapiens
aatggcagccacactgtctgtct

SEQ ID NO: 158758 - DNA, 19 bp, Homo sapiens
gtctccatggatatcactg

SEQ ID NO: 158759 - DNA, 21 bp, Homo sapiens
tctcactgcctcacttactag

SEQ ID NO: 158760 - DNA, 23 bp, Homo sapiens
tggaaaagttgagtttttcttct

SEQ ID NO: 158761 - DNA, 21 bp, Homo sapiens
atgtgtctagagttgctcagc

SEQ ID NO: 158762 - DNA, 23 bp, Homo sapiens
gataccatatgatatgatatgat

SEQ ID NO: 158763 - DNA, 21 bp, Homo sapiens
tgtgagtgtgtgtgtctgtgt

SEQ ID NO: 158764 - DNA, 20 bp, Homo sapiens
tacacacaccaaagcaaata

SEQ ID NO: 158765 - DNA, 18 bp, Homo sapiens
atgcagcatttaaagtca

SEQ ID NO: 158766 - DNA, 23 bp, Homo sapiens
tgtatgtgtatatgtatatgtgt

SEQ ID NO: 158767 - DNA, 23 bp, Homo sapiens
ggtgtgtgtgtgtatatgtatac

SEQ ID NO: 158768 - DNA, 23 bp, Homo sapiens
atgacagtcagcactcacagtgt

SEQ ID NO: 158769 - DNA, 23 bp, Homo sapiens
tgtgtgtgtgtatgcacttgtgt

SEQ ID NO: 158770 - DNA, 23 bp, Homo sapiens
tctctgggtctcagtttccttag

SEQ ID NO: 158771 - DNA, 23 bp, Homo sapiens
gagtctcactctgtcgctcaggc

SEQ ID NO: 158772 - DNA, 22 bp, Homo sapiens
tgagacagagtctcgctctcta

SEQ ID NO: 158773 - DNA, 18 bp, Homo sapiens
acacagacagacaaagtt

SEQ ID NO: 158774 - DNA, 23 bp, Homo sapiens
tcgctctctctcatttgcctttc

SEQ ID NO: 158775 - DNA, 21 bp, Homo sapiens
ttaaaagaattggttatctgg

SEQ ID NO: 158776 - DNA, 22 bp, Homo sapiens
gacagagttttgctcttgtcac

SEQ ID NO: 158777 - DNA, 21 bp, Homo sapiens
ctgggtgacactgagactctg

SEQ ID NO: 158778 - DNA, 22 bp, Homo sapiens
aagaaaagtgaatatgttctct

SEQ ID NO: 158779 - DNA, 21 bp, Homo sapiens
gtgccatctcagctcacttca

SEQ ID NO: 158780 - DNA, 19 bp, Homo sapiens
tatttaaatatgaatgggg

SEQ ID NO: 158781 - DNA, 21 bp, Homo sapiens
atatatatatgtgcaagctac

SEQ ID NO: 158782 - DNA, 23 bp, Homo sapiens
agaatgacaagtgtttttgaaca

SEQ ID NO: 158783 - DNA, 23 bp, Homo sapiens
tatctagcatttctagttctttt

SEQ ID NO: 158784 - DNA, 23 bp, Homo sapiens
gagagcacacaccctgctctcct

SEQ ID NO: 158785 - DNA, 23 bp, Homo sapiens
gagatggagtctcactctgtcac

SEQ ID NO: 158786 - DNA, 20 bp, Homo sapiens
tgtgtgactctggaaagcta

SEQ ID NO: 158787 - DNA, 18 bp, Homo sapiens
tgcctgtttatctagttg

SEQ ID NO: 158788 - DNA, 19 bp, Homo sapiens
atggacttaatactccagg

SEQ ID NO: 158789 - DNA, 19 bp, Homo sapiens
agtgcttatattaatgtat

SEQ ID NO: 158790 - DNA, 19 bp, Homo sapiens
attagtgctacgtacatgt

SEQ ID NO: 158791 - DNA, 23 bp, Homo sapiens
acagagtctcgctctgtcaccca

SEQ ID NO: 158792 - DNA, 23 bp, Homo sapiens
tacagtggcaagatcttggctca

SEQ ID NO: 158793 - DNA, 23 bp, Homo sapiens
tgagttcattgtagattctggat

SEQ ID NO: 158794 - DNA, 23 bp, Homo sapiens
tgagttcattgtagattctggat

SEQ ID NO: 158795 - DNA, 22 bp, Homo sapiens
tacatgtgcacaatgtgcaggt

SEQ ID NO: 158796 - DNA, 19 bp, Homo sapiens
gttttccttttgttatgaa

SEQ ID NO: 158797 - DNA, 19 bp, Homo sapiens
acccacttactctctctga

SEQ ID NO: 158798 - DNA, 23 bp, Homo sapiens
gtcactctgtcagtctgggctct

SEQ ID NO: 158799 - DNA, 23 bp, Homo sapiens
cagaggcagagaaaatgcaactg

SEQ ID NO: 158800 - DNA, 20 bp, Homo sapiens
tttgtatttttttacctttc

SEQ ID NO: 158801 - DNA, 20 bp, Homo sapiens
tgtgtgtatctctgaatcac

SEQ ID NO: 158802 - DNA, 18 bp, Homo sapiens
tcacttctgtcattgctg

SEQ ID NO: 158803 - DNA, 20 bp, Homo sapiens
tataatcagctgcagttttt

SEQ ID NO: 158804 - DNA, 23 bp, Homo sapiens
tggagtctcactctgtcacccag

SEQ ID NO: 158805 - DNA, 20 bp, Homo sapiens
aataatatatgtatttgtgt

SEQ ID NO: 158806 - DNA, 22 bp, Homo sapiens
gtgtatatgtatgtatatatgt

SEQ ID NO: 158807 - DNA, 23 bp, Homo sapiens
aattcagggaagggtgttggaaa

SEQ ID NO: 158808 - DNA, 21 bp, Homo sapiens
atggctgtgttatatgtatgt

SEQ ID NO: 158809 - DNA, 18 bp, Homo sapiens
tgtaaagtggtgcctcat

SEQ ID NO: 158810 - DNA, 23 bp, Homo sapiens
tttgagccagagtctcgctctgt

SEQ ID NO: 158811 - DNA, 23 bp, Homo sapiens
caatgtgtcagtgtttcttgact

SEQ ID NO: 158812 - DNA, 23 bp, Homo sapiens
aatgctgaaagtgttagtttttg

SEQ ID NO: 158813 - DNA, 18 bp, Homo sapiens
acacaaagagatatacag

SEQ ID NO: 158814 - DNA, 23 bp, Homo sapiens
atagtttcagtttttcaagacca

SEQ ID NO: 158815 - DNA, 23 bp, Homo sapiens
aataaagtagaaacagcaaagag

SEQ ID NO: 158816 - DNA, 23 bp, Homo sapiens
aagctgagtgatgagactctgga

SEQ ID NO: 158817 - DNA, 23 bp, Homo sapiens
tgtgtgtctgagtaactagaata

SEQ ID NO: 158818 - DNA, 23 bp, Homo sapiens
tgagatggagtctggctctgtcg

SEQ ID NO: 158819 - DNA, 18 bp, Homo sapiens
ccactccagctcctcctg

SEQ ID NO: 158820 - DNA, 20 bp, Homo sapiens
tgacttggagtgtctcatct

SEQ ID NO: 158821 - DNA, 23 bp, Homo sapiens
tgaaacagagtctcactctgtcg

SEQ ID NO: 158822 - DNA, 21 bp, Homo sapiens
acctctgactcttaagtcttt

SEQ ID NO: 158823 - DNA, 22 bp, Homo sapiens
tgactctgagaggtaagcagga

SEQ ID NO: 158824 - DNA, 23 bp, Homo sapiens
acagagtctctctctgtcgccca

SEQ ID NO: 158825 - DNA, 23 bp, Homo sapiens
gagacgaagtctcactctgtcgc

SEQ ID NO: 158826 - DNA, 23 bp, Homo sapiens
ttttttttgagacggagtcttgc

SEQ ID NO: 158827 - DNA, 23 bp, Homo sapiens
aaggtctctctctgtcacccagg

SEQ ID NO: 158828 - DNA, 22 bp, Homo sapiens
agtctgtgcattagaaaacatt

SEQ ID NO: 158829 - DNA, 19 bp, Homo sapiens
ttttgagacggagtctcac

SEQ ID NO: 158830 - DNA, 20 bp, Homo sapiens
tctcagaaaggcttgattct

SEQ ID NO: 158831 - DNA, 23 bp, Homo sapiens
agacagagtctctttctgtcacc

SEQ ID NO: 158832 - DNA, 23 bp, Homo sapiens
atactgtatgcaaatgttatgtt

SEQ ID NO: 158833 - DNA, 20 bp, Homo sapiens
tcatgacacccacagtcaaa

SEQ ID NO: 158834 - DNA, 20 bp, Homo sapiens
ttctcagacagctgatcagc

SEQ ID NO: 158835 - DNA, 21 bp, Homo sapiens
tctgtctcactgactctctcc

SEQ ID NO: 158836 - DNA, 23 bp, Homo sapiens
ttgagacagggtctctgtcgccc

SEQ ID NO: 158837 - DNA, 23 bp, Homo sapiens
agctggagtctcactctgtcacc

SEQ ID NO: 158838 - DNA, 21 bp, Homo sapiens
gaggcagtgtgattctttatt

SEQ ID NO: 158839 - DNA, 23 bp, Homo sapiens
tttttgagatggaatctctctct

SEQ ID NO: 158840 - DNA, 21 bp, Homo sapiens
aacagtgtgtagtttccagtt

SEQ ID NO: 158841 - DNA, 21 bp, Homo sapiens
cactcagttcatagttagttg

SEQ ID NO: 158842 - DNA, 22 bp, Homo sapiens
tgagaaggagtctcactctgtt

SEQ ID NO: 158843 - DNA, 22 bp, Homo sapiens
tttacagctgagtctgtagata

SEQ ID NO: 158844 - DNA, 23 bp, Homo sapiens
tgccaggcaataaatgaagaatg

SEQ ID NO: 158845 - DNA, 20 bp, Homo sapiens
cagtcaggtagaattcattc

SEQ ID NO: 158846 - DNA, 23 bp, Homo sapiens
acagagtctcactctgtcgccca

SEQ ID NO: 158847 - DNA, 23 bp, Homo sapiens
aagtctgagatcaaggtgtcagc

SEQ ID NO: 158848 - DNA, 23 bp, Homo sapiens
gactgagtctcgctctgtcaccc

SEQ ID NO: 158849 - DNA, 23 bp, Homo sapiens
tctttgtcaatactttttgtttt

SEQ ID NO: 158850 - DNA, 18 bp, Homo sapiens
tatgtgtgtgtatgtata

SEQ ID NO: 158851 - DNA, 19 bp, Homo sapiens
tcagtggctttcatcagat

SEQ ID NO: 158852 - DNA, 21 bp, Homo sapiens
taggacctaatgtgatccgac

SEQ ID NO: 158853 - DNA, 23 bp, Homo sapiens
tttgtgtctctgtgtgatatgtg

SEQ ID NO: 158854 - DNA, 23 bp, Homo sapiens
tatatgtgtataggtatatatgc

SEQ ID NO: 158855 - DNA, 22 bp, Homo sapiens
tccatatgtatactatatacat

SEQ ID NO: 158856 - DNA, 23 bp, Homo sapiens
tgcctgtggttcaaactactcag

SEQ ID NO: 158857 - DNA, 23 bp, Homo sapiens
tgagttcattgtagattctggat

SEQ ID NO: 158858 - DNA, 23 bp, Homo sapiens
tgtgtgtgtgtatatatacagtc

SEQ ID NO: 158859 - DNA, 23 bp, Homo sapiens
tgtcagctttggtattccctgtt

SEQ ID NO: 158860 - DNA, 21 bp, Homo sapiens
agagaagagatttttttctct

SEQ ID NO: 158861 - DNA, 19 bp, Homo sapiens
aaagtcattattttttctt

SEQ ID NO: 158862 - DNA, 20 bp, Homo sapiens
tgtaaatatcctattctcag

SEQ ID NO: 158863 - DNA, 23 bp, Homo sapiens
tggagtctcactctgtcacccag

SEQ ID NO: 158864 - DNA, 22 bp, Homo sapiens
agagagagtgcttaaggagagt

SEQ ID NO: 158865 - DNA, 23 bp, Homo sapiens
taagtaaggaactgagtgctata

SEQ ID NO: 158866 - DNA, 23 bp, Homo sapiens
gtctctgccactcactggctgtg

SEQ ID NO: 158867 - DNA, 21 bp, Homo sapiens
taggaagtaagattctttttt

SEQ ID NO: 158868 - DNA, 19 bp, Homo sapiens
ttgagacagagtcttgctc

SEQ ID NO: 158869 - DNA, 23 bp, Homo sapiens
ccagtgactgagctactcttttt

SEQ ID NO: 158870 - DNA, 23 bp, Homo sapiens
tgagatggagtctcactctgtcg

SEQ ID NO: 158871 - DNA, 23 bp, Homo sapiens
acagagtctcactctgtcgccca

SEQ ID NO: 158872 - DNA, 23 bp, Homo sapiens
tcagggtctcactgtgtcaccca

SEQ ID NO: 158873 - DNA, 23 bp, Homo sapiens
tgagttcattgtagattctggat

SEQ ID NO: 158874 - DNA, 23 bp, Homo sapiens
tgagttcattgtagattctggat

SEQ ID NO: 158875 - DNA, 22 bp, Homo sapiens
tgtgtgtatatatatatgtgtg

SEQ ID NO: 158876 - DNA, 23 bp, Homo sapiens
tatgtgtgtatatatgtgtgtgt

SEQ ID NO: 158877 - DNA, 20 bp, Homo sapiens
acacacacacatatatatat

SEQ ID NO: 158878 - DNA, 23 bp, Homo sapiens
ctcccagagcccctggaactctg

SEQ ID NO: 158879 - DNA, 23 bp, Homo sapiens
tcccagagcccctggaactctgg

SEQ ID NO: 158880 - DNA, 23 bp, Homo sapiens
tcccagagcccctggaactctgg

SEQ ID NO: 158881 - DNA, 23 bp, Homo sapiens
tcccagagcccctggaactctgg

SEQ ID NO: 158882 - DNA, 22 bp, Homo sapiens
gacagagtctccctctgtcacc

SEQ ID NO: 158883 - DNA, 22 bp, Homo sapiens
cttgtcactctgagtgtctgtc

SEQ ID NO: 158884 - DNA, 23 bp, Homo sapiens
gacagagtctcgctctgtcaccc

SEQ ID NO: 158885 - DNA, 23 bp, Homo sapiens
tttggagctggagcctcactctc

SEQ ID NO: 158886 - DNA, 23 bp, Homo sapiens
acgaagtctggctctgttgccca

SEQ ID NO: 158887 - DNA, 22 bp, Homo sapiens
attcctgtagtcccagcagttt

SEQ ID NO: 158888 - DNA, 19 bp, Homo sapiens
agagagtgtgtgtgtgtat

SEQ ID NO: 158889 - DNA, 21 bp, Homo sapiens
tagtagagatgggatttcacc

SEQ ID NO: 158890 - DNA, 23 bp, Homo sapiens
actatactaaggatgattatata

SEQ ID NO: 158891 - DNA, 23 bp, Homo sapiens
acgaagtctggctctgttgccca

SEQ ID NO: 158892 - DNA, 19 bp, Homo sapiens
aaagaagaacaaggtctca

SEQ ID NO: 158893 - DNA, 20 bp, Homo sapiens
tgagcaaatggatgcattca

SEQ ID NO: 158894 - DNA, 20 bp, Homo sapiens
agtctccctctgtcacccag

SEQ ID NO: 158895 - DNA, 19 bp, Homo sapiens
ggaaacatccagcacagaa

SEQ ID NO: 158896 - DNA, 23 bp, Homo sapiens
actgagtctcactctgtcgccca

SEQ ID NO: 158897 - DNA, 22 bp, Homo sapiens
tgaggtaggaggatctcttgaa

SEQ ID NO: 158898 - DNA, 23 bp, Homo sapiens
agatggagtctcgctctgtctcc

SEQ ID NO: 158899 - DNA, 23 bp, Homo sapiens
tgtatagatccttcagtcactcg

SEQ ID NO: 158900 - DNA, 23 bp, Homo sapiens
tggttcctgtggatctagtcacc

SEQ ID NO: 158901 - DNA, 22 bp, Homo sapiens
aagttaatgagcaagtctgtcc

SEQ ID NO: 158902 - DNA, 23 bp, Homo sapiens
gtcacagtgacatccctgtagtc

SEQ ID NO: 158903 - DNA, 22 bp, Homo sapiens
tgaggtaggaggatcatttgag

SEQ ID NO: 158904 - DNA, 23 bp, Homo sapiens
gagacagagtctcgctctgtcac

SEQ ID NO: 158905 - DNA, 23 bp, Homo sapiens
gacagagtctcgctctgtcaccc

SEQ ID NO: 158906 - DNA, 21 bp, Homo sapiens
aataagaaaggataacagatg

SEQ ID NO: 158907 - DNA, 23 bp, Homo sapiens
cggagtctcgctctgtcgctcag

SEQ ID NO: 158908 - DNA, 23 bp, Homo sapiens
acagagtctcactctgtcgccca

SEQ ID NO: 158909 - DNA, 22 bp, Homo sapiens
tttcacagtgtctctttttttt

SEQ ID NO: 158910 - DNA, 23 bp, Homo sapiens
gacagggtctcactctgtggccc

SEQ ID NO: 158911 - DNA, 20 bp, Homo sapiens
ggaccatgagtgatattttt

SEQ ID NO: 158912 - DNA, 23 bp, Homo sapiens
tgagacagtctcgctctgtcacc

SEQ ID NO: 158913 - DNA, 23 bp, Homo sapiens
ttttgagactttggtgtttgttt

SEQ ID NO: 158914 - DNA, 23 bp, Homo sapiens
cttactctgtctcccagactagt

SEQ ID NO: 158915 - DNA, 23 bp, Homo sapiens
tttgagacggagtctcgctctgt

SEQ ID NO: 158916 - DNA, 23 bp, Homo sapiens
gttctgactgtgtgtgcacttgg

SEQ ID NO: 158917 - DNA, 21 bp, Homo sapiens
ttcaccacgttggccaggctg

SEQ ID NO: 158918 - DNA, 21 bp, Homo sapiens
tgagacgaagtctcgctctgt

SEQ ID NO: 158919 - DNA, 19 bp, Homo sapiens
tacaggcatgagccaacgt

SEQ ID NO: 158920 - DNA, 22 bp, Homo sapiens
ttatttatttttgagacagggt

SEQ ID NO: 158921 - DNA, 23 bp, Homo sapiens
agactgagtgtagtggcatgctc

SEQ ID NO: 158922 - DNA, 23 bp, Homo sapiens
agccactgcatccggctgtgaaa

SEQ ID NO: 158923 - DNA, 23 bp, Homo sapiens
aggttccttgtacatgaaaagta

SEQ ID NO: 158924 - DNA, 23 bp, Homo sapiens
agacacaatctcactgtgtcacc

SEQ ID NO: 158925 - DNA, 18 bp, Homo sapiens
caggatctcactctgtca

SEQ ID NO: 158926 - DNA, 22 bp, Homo sapiens
tatagagtcacattctgttagc

SEQ ID NO: 158927 - DNA, 23 bp, Homo sapiens
atgttctaacagtggacaacctg

SEQ ID NO: 158928 - DNA, 23 bp, Homo sapiens
cagggtctcactctgtggctcag

SEQ ID NO: 158929 - DNA, 20 bp, Homo sapiens
agagttgagggcattgacct

SEQ ID NO: 158930 - DNA, 23 bp, Homo sapiens
tgagacggagtctcactctgtcg

SEQ ID NO: 158931 - DNA, 23 bp, Homo sapiens
tggagtctcactctgtcacccag

SEQ ID NO: 158932 - DNA, 23 bp, Homo sapiens
tctacattcccgttagagtgtga

SEQ ID NO: 158933 - DNA, 23 bp, Homo sapiens
tatctcatgaagtttggggtctg

SEQ ID NO: 158934 - DNA, 23 bp, Homo sapiens
gctgagagtgtgagtccctgtct

SEQ ID NO: 158935 - DNA, 22 bp, Homo sapiens
aaacaggagactgaatattctc

SEQ ID NO: 158936 - DNA, 23 bp, Homo sapiens
atcagtggcatgatcttggctca

SEQ ID NO: 158937 - DNA, 22 bp, Homo sapiens
gcattgagtgtttcctaactgt

SEQ ID NO: 158938 - DNA, 23 bp, Homo sapiens
aaagacatgaaactgcatgtcca

SEQ ID NO: 158939 - DNA, 23 bp, Homo sapiens
atatatgtatatatgtatgtgtg

SEQ ID NO: 158940 - DNA, 22 bp, Homo sapiens
tgtatatatgtatatatgtaca

SEQ ID NO: 158941 - DNA, 22 bp, Homo sapiens
atgtgtatatatgtatatatgt

SEQ ID NO: 158942 - DNA, 23 bp, Homo sapiens
tgtatgtgtgtatgtatatgtgt

SEQ ID NO: 158943 - DNA, 20 bp, Homo sapiens
tatgtgtatatatatgtatg

SEQ ID NO: 158944 - DNA, 23 bp, Homo sapiens
gtgtgtgtatgtatatgtgtgtg

SEQ ID NO: 158945 - DNA, 18 bp, Homo sapiens
atacacacacacacatat

SEQ ID NO: 158946 - DNA, 23 bp, Homo sapiens
tgtatacatgcatgtgcgtatgt

SEQ ID NO: 158947 - DNA, 23 bp, Homo sapiens
tgagttcattgtagattctggat

SEQ ID NO: 158948 - DNA, 23 bp, Homo sapiens
tgagttcattgtagattctggat

SEQ ID NO: 158949 - DNA, 23 bp, Homo sapiens
gatatgtatacgtgcatgagagt

SEQ ID NO: 158950 - DNA, 23 bp, Homo sapiens
atgtatgtacatatatgtatgtg

SEQ ID NO: 158951 - DNA, 23 bp, Homo sapiens
tctgtgtctgccacaggaaagct

SEQ ID NO: 158952 - DNA, 23 bp, Homo sapiens
gtgagtagacaaggaggaacctt

SEQ ID NO: 158953 - DNA, 21 bp, Homo sapiens
ttgcacatttacattgctgat

SEQ ID NO: 158954 - DNA, 23 bp, Homo sapiens
aggaagcatgttgtcaaatggtg

SEQ ID NO: 158955 - DNA, 23 bp, Homo sapiens
tgtgtctcaaatctgtttgttct

SEQ ID NO: 158956 - DNA, 19 bp, Homo sapiens
aaaagtttgtttaactttg

SEQ ID NO: 158957 - DNA, 23 bp, Homo sapiens
cattcagaattgtgtaagctgaa

SEQ ID NO: 158958 - DNA, 23 bp, Homo sapiens
tgagttcattgtagattctggat

SEQ ID NO: 158959 - DNA, 23 bp, Homo sapiens
tgagttcattgtagattctggat

SEQ ID NO: 158960 - DNA, 18 bp, Homo sapiens
tgctgattggttttcagt

SEQ ID NO: 158961 - DNA, 22 bp, Homo sapiens
aagtagacaagatggtacatgg

SEQ ID NO: 158962 - DNA, 23 bp, Homo sapiens
ctcccagagcccctggaactctg

SEQ ID NO: 158963 - DNA, 23 bp, Homo sapiens
tcccagagcccctggaactctgg

SEQ ID NO: 158964 - DNA, 23 bp, Homo sapiens
tcccagagcccctggaactctgg

SEQ ID NO: 158965 - DNA, 23 bp, Homo sapiens
tcccagagcccctggaactctgg

SEQ ID NO: 158966 - DNA, 19 bp, Homo sapiens
tgccttatgtatacccctt

SEQ ID NO: 158967 - DNA, 23 bp, Homo sapiens
atgtacatgcttattgtatgtgt

SEQ ID NO: 158968 - DNA, 23 bp, Homo sapiens
gatatactgaaagctattgctgt

SEQ ID NO: 158969 - DNA, 19 bp, Homo sapiens
ttgagttctgactgtgtct

SEQ ID NO: 158970 - DNA, 18 bp, Homo sapiens
ttagctaaaattgcattg

SEQ ID NO: 158971 - DNA, 22 bp, Homo sapiens
ttgttcttaatggtggctgttt

SEQ ID NO: 158972 - DNA, 23 bp, Homo sapiens
atagtcgtactttttgtactcta

SEQ ID NO: 158973 - DNA, 18 bp, Homo sapiens
ataagaagttacacactg

SEQ ID NO: 158974 - DNA, 23 bp, Homo sapiens
gtgtgtctgagtgtgtgtgtttt

SEQ ID NO: 158975 - DNA, 23 bp, Homo sapiens
ttagcatgtttatatatgcatat

SEQ ID NO: 158976 - DNA, 19 bp, Homo sapiens
tatgtgtgtgcgtgtatat

SEQ ID NO: 158977 - DNA, 23 bp, Homo sapiens
aagatgaagtcggccaggtcaga

SEQ ID NO: 158978 - DNA, 23 bp, Homo sapiens
caagagcctcactctgtcactca

SEQ ID NO: 158979 - DNA, 23 bp, Homo sapiens
gtatatagatagcttatatatac

SEQ ID NO: 158980 - DNA, 22 bp, Homo sapiens
tgtgtgtatatatatatgtgtg

SEQ ID NO: 158981 - DNA, 22 bp, Homo sapiens
aatgctatgataaatgtggtgt

SEQ ID NO: 158982 - DNA, 19 bp, Homo sapiens
tgatttgtatgtatatcat

SEQ ID NO: 158983 - DNA, 23 bp, Homo sapiens
tgtatatatatgtgtgtgtgtgt

SEQ ID NO: 158984 - DNA, 19 bp, Homo sapiens
gtctcgctctgtcacccag

SEQ ID NO: 158985 - DNA, 20 bp, Homo sapiens
caggcatccttgtttgtggg

SEQ ID NO: 158986 - DNA, 23 bp, Homo sapiens
ttctctctgtgtccttatgagag

SEQ ID NO: 158987 - DNA, 23 bp, Homo sapiens
cactgctttcacagtcagcacac

SEQ ID NO: 158988 - DNA, 20 bp, Homo sapiens
agtggcatgatgaagggcat

SEQ ID NO: 158989 - DNA, 23 bp, Homo sapiens
acaatcttgttattgttgtcaag

SEQ ID NO: 158990 - DNA, 22 bp, Homo sapiens
ctttggttctctaagtgtatat

SEQ ID NO: 158991 - DNA, 23 bp, Homo sapiens
acattaatgaagttgtacattgt

SEQ ID NO: 158992 - DNA, 23 bp, Homo sapiens
tgtgtgcgtgtacatgcatatgt

SEQ ID NO: 158993 - DNA, 23 bp, Homo sapiens
tctcagagtcttagagctaattg

SEQ ID NO: 158994 - DNA, 22 bp, Homo sapiens
tttttcatggtacggattgtga

SEQ ID NO: 158995 - DNA, 23 bp, Homo sapiens
tatatgctttctttttgtatgtg

SEQ ID NO: 158996 - DNA, 23 bp, Homo sapiens
tgtgtgtatgtatgtatatatgt

SEQ ID NO: 158997 - DNA, 23 bp, Homo sapiens
ctgcctgtgtgtctgcctgctag

SEQ ID NO: 158998 - DNA, 23 bp, Homo sapiens
tgagttcattgtagattctggat

SEQ ID NO: 158999 - DNA, 23 bp, Homo sapiens
tgagttcattgtagattctggat

SEQ ID NO: 159000 - DNA, 18 bp, Homo sapiens
actctatttttttttttg

SEQ ID NO: 159001 - DNA, 22 bp, Homo sapiens
tgtaagttttatttgtgatgag

SEQ ID NO: 159002 - DNA, 22 bp, Homo sapiens
taatgatcagcaactttagagt

SEQ ID NO: 159003 - DNA, 21 bp, Homo sapiens
tatatatctggtgtatatact

SEQ ID NO: 159004 - DNA, 20 bp, Homo sapiens
atatgagtaaattctgttga

SEQ ID NO: 159005 - DNA, 23 bp, Homo sapiens
ttatgtttggttttctaagtgaa

SEQ ID NO: 159006 - DNA, 23 bp, Homo sapiens
atgatagtcttgagcaatgcatt

SEQ ID NO: 159007 - DNA, 19 bp, Homo sapiens
aatgcttccagcttttgcc

SEQ ID NO: 159008 - DNA, 23 bp, Homo sapiens
ttgtgaaaacatcctagagtgca

SEQ ID NO: 159009 - DNA, 23 bp, Homo sapiens
gagacggactctcactctgtcat

SEQ ID NO: 159010 - DNA, 19 bp, Homo sapiens
tgtgtgtatatatatacac

SEQ ID NO: 159011 - DNA, 21 bp, Homo sapiens
tatacacacacatatatatgt

SEQ ID NO: 159012 - DNA, 23 bp, Homo sapiens
agtttgtttttgtctctgcataa

SEQ ID NO: 159013 - DNA, 23 bp, Homo sapiens
tgtcagccaccatgcctgactaa

SEQ ID NO: 159014 - DNA, 21 bp, Homo sapiens
ttcacagtttcttcatctgac

SEQ ID NO: 159015 - DNA, 23 bp, Homo sapiens
gttgaattctatagaagtaaagg

SEQ ID NO: 159016 - DNA, 23 bp, Homo sapiens
atatgtgcttgtatatacacaca

SEQ ID NO: 159017 - DNA, 23 bp, Homo sapiens
tgtgtacttgcatgagtatgata

SEQ ID NO: 159018 - DNA, 19 bp, Homo sapiens
aatatgattgtattgtctg

SEQ ID NO: 159019 - DNA, 21 bp, Homo sapiens
tatgtgtatatatatgtgtgt

SEQ ID NO: 159020 - DNA, 23 bp, Homo sapiens
tatgtgtatatatatgtgtgtat

SEQ ID NO: 159021 - DNA, 21 bp, Homo sapiens
tatgtgtatatatatgtgtgt

SEQ ID NO: 159022 - DNA, 23 bp, Homo sapiens
tatgtgtatatatatgtgtgtat

SEQ ID NO: 159023 - DNA, 21 bp, Homo sapiens
tatgtgtatatatatgtgtgt

SEQ ID NO: 159024 - DNA, 23 bp, Homo sapiens
tatgtgtatatatatgtgtgtat

SEQ ID NO: 159025 - DNA, 21 bp, Homo sapiens
tatgtgtatatatatgtgtgt

SEQ ID NO: 159026 - DNA, 23 bp, Homo sapiens
tatgtgtatatatatgtgtgtat

SEQ ID NO: 159027 - DNA, 23 bp, Homo sapiens
tttgaggcatttgattttgtgga

SEQ ID NO: 159028 - DNA, 23 bp, Homo sapiens
acactatttatatatatgtgtgt

SEQ ID NO: 159029 - DNA, 21 bp, Homo sapiens
tcattcttgggtgtttctcag

SEQ ID NO: 159030 - DNA, 23 bp, Homo sapiens
ctctcttaatctctctccctgtc

SEQ ID NO: 159031 - DNA, 23 bp, Homo sapiens
tttacagaaagattatgatgagt

SEQ ID NO: 159032 - DNA, 22 bp, Homo sapiens
tatgtatgtgtgtggatgtata

SEQ ID NO: 159033 - DNA, 23 bp, Homo sapiens
tgtctgcctgtctgcctgtctgt

SEQ ID NO: 159034 - DNA, 23 bp, Homo sapiens
aacttgatcatggtgcataaggt

SEQ ID NO: 159035 - DNA, 22 bp, Homo sapiens
ataaaggagctataaacatttg

SEQ ID NO: 159036 - DNA, 18 bp, Homo sapiens
gactagatcttgaataat

SEQ ID NO: 159037 - DNA, 19 bp, Homo sapiens
ctgcatatatatatacagt

SEQ ID NO: 159038 - DNA, 23 bp, Homo sapiens
tgagttcattgtagattctggat

SEQ ID NO: 159039 - DNA, 23 bp, Homo sapiens
tgagttcattgtagattctggat

SEQ ID NO: 159040 - DNA, 20 bp, Homo sapiens
tgtgtgtgtgtgtattagct

SEQ ID NO: 159041 - DNA, 21 bp, Homo sapiens
atatgtgtatgtgtgtatatg

SEQ ID NO: 159042 - DNA, 23 bp, Homo sapiens
acacgtatatatgtatgcgtgta

SEQ ID NO: 159043 - DNA, 21 bp, Homo sapiens
tatgtatatatgtatatatgt

SEQ ID NO: 159044 - DNA, 21 bp, Homo sapiens
tgtgtgtatatatatatgtgt

SEQ ID NO: 159045 - DNA, 22 bp, Homo sapiens
atgtgtatatatatgtgtgtgt

SEQ ID NO: 159046 - DNA, 19 bp, Homo sapiens
acatgaaaatcatgaaagg

SEQ ID NO: 159047 - DNA, 23 bp, Homo sapiens
tttagggtagttatgtaatccat

SEQ ID NO: 159048 - DNA, 23 bp, Homo sapiens
ttgtattatactttaagttctag

SEQ ID NO: 159049 - DNA, 23 bp, Homo sapiens
tacatgtgcacaacgtgcaggtt

SEQ ID NO: 159050 - DNA, 22 bp, Homo sapiens
tgtgtatatatgtatatatgtg

SEQ ID NO: 159051 - DNA, 23 bp, Homo sapiens
tatatgtgtgtgtgtatactgat

SEQ ID NO: 159052 - DNA, 19 bp, Homo sapiens
tgacatgcattttctttca

SEQ ID NO: 159053 - DNA, 20 bp, Homo sapiens
acatgagtgtgagcatacag

SEQ ID NO: 159054 - DNA, 18 bp, Homo sapiens
tgtctataaggagatttt

SEQ ID NO: 159055 - DNA, 23 bp, Homo sapiens
tttcagtgagatgtaacctacca

SEQ ID NO: 159056 - DNA, 22 bp, Homo sapiens
ttgttgttgttgctgctgctgt

SEQ ID NO: 159057 - DNA, 21 bp, Homo sapiens
tgtgtgtctgtgtctgtctgt

SEQ ID NO: 159058 - DNA, 20 bp, Homo sapiens
atacacagttttttaaattc

SEQ ID NO: 159059 - DNA, 23 bp, Homo sapiens
tacatgtgcaggatgtgcaggtt

SEQ ID NO: 159060 - DNA, 23 bp, Homo sapiens
tagattggttgagacagggtctt

SEQ ID NO: 159061 - DNA, 20 bp, Homo sapiens
tctgtcacccagtctggagt

SEQ ID NO: 159062 - DNA, 23 bp, Homo sapiens
ttttgatgtggagtctggctctg

SEQ ID NO: 159063 - DNA, 19 bp, Homo sapiens
tgagtcacagtctcactct

SEQ ID NO: 159064 - DNA, 22 bp, Homo sapiens
agttttgatcatagagttaggc

SEQ ID NO: 159065 - DNA, 23 bp, Homo sapiens
ttttgaatggtaaacttggaaat

SEQ ID NO: 159066 - DNA, 18 bp, Homo sapiens
acagagcaagactgatct

SEQ ID NO: 159067 - DNA, 22 bp, Homo sapiens
atgtgtatatatatatgtgtgt

SEQ ID NO: 159068 - DNA, 23 bp, Homo sapiens
tggaggtgcagtgactggaaggg

SEQ ID NO: 159069 - DNA, 23 bp, Homo sapiens
ttctgtttcttgatcttggtgct

SEQ ID NO: 159070 - DNA, 18 bp, Homo sapiens
gtaagactccgtctcaaa

SEQ ID NO: 159071 - DNA, 20 bp, Homo sapiens
aaaaaaagacattttattga

SEQ ID NO: 159072 - DNA, 23 bp, Homo sapiens
tctagatggagtgtcactctgtc

SEQ ID NO: 159073 - DNA, 23 bp, Homo sapiens
ttaatttgttaaagtatgtgtat

SEQ ID NO: 159074 - DNA, 23 bp, Homo sapiens
tgagactctgtctcaaaaaaaac

SEQ ID NO: 159075 - DNA, 21 bp, Homo sapiens
ttgagacagagtgtcttgttc

SEQ ID NO: 159076 - DNA, 23 bp, Homo sapiens
tatgtatgtgtatatgtatatca

SEQ ID NO: 159077 - DNA, 22 bp, Homo sapiens
catgtctgtctgtctgtccctg

SEQ ID NO: 159078 - DNA, 19 bp, Homo sapiens
acacacacatacacacact

SEQ ID NO: 159079 - DNA, 20 bp, Homo sapiens
agtacagtctgaagcctcag

SEQ ID NO: 159080 - DNA, 23 bp, Homo sapiens
tctcacagtcagactgtgatgcc

SEQ ID NO: 159081 - DNA, 23 bp, Homo sapiens
gtgtgtgcttgtgcatgagtgtg

SEQ ID NO: 159082 - DNA, 21 bp, Homo sapiens
atgagtgtgtgcatgtgcatg

SEQ ID NO: 159083 - DNA, 23 bp, Homo sapiens
tgtgtgaggagtgtgtgacgagt

SEQ ID NO: 159084 - DNA, 23 bp, Homo sapiens
cattagtgtgcatatgtctgtgt

SEQ ID NO: 159085 - DNA, 23 bp, Homo sapiens
agtattcagtgcctaggctgtgt

SEQ ID NO: 159086 - DNA, 23 bp, Homo sapiens
agacaatgtgtgtctgtgtcacc

SEQ ID NO: 159087 - DNA, 23 bp, Homo sapiens
tgagataagttctcactctgtca

SEQ ID NO: 159088 - DNA, 23 bp, Homo sapiens
tgtctgtgagtgtctgcgtgtgt

SEQ ID NO: 159089 - DNA, 23 bp, Homo sapiens
atatggatgtgtatgtagtgtgt

SEQ ID NO: 159090 - DNA, 23 bp, Homo sapiens
tatggatgtgtatgtagtatgca

SEQ ID NO: 159091 - DNA, 22 bp, Homo sapiens
atcaatgaggttatgatgtctt

SEQ ID NO: 159092 - DNA, 23 bp, Homo sapiens
gggtctcactctgtcactcaggc

SEQ ID NO: 159093 - DNA, 23 bp, Homo sapiens
agtgcagtagtgtgatcatggct

SEQ ID NO: 159094 - DNA, 22 bp, Homo sapiens
agagttcatgctgttagccact

SEQ ID NO: 159095 - DNA, 23 bp, Homo sapiens
tgattaaaagcaggattatgata

SEQ ID NO: 159096 - DNA, 20 bp, Homo sapiens
tttagagacagagatcttgc

SEQ ID NO: 159097 - DNA, 22 bp, Homo sapiens
caatttgaaatacattttgtca

SEQ ID NO: 159098 - DNA, 20 bp, Homo sapiens
tcactgcaacctctgcttcc

SEQ ID NO: 159099 - DNA, 23 bp, Homo sapiens
ctctgcacacactgtctctctgg

SEQ ID NO: 159100 - DNA, 23 bp, Homo sapiens
gtgtgagtgtcactctctctgct

SEQ ID NO: 159101 - DNA, 22 bp, Homo sapiens
ttttgcagaaatgggggtctca

SEQ ID NO: 159102 - DNA, 19 bp, Homo sapiens
gtgaggctctcttctcttc

SEQ ID NO: 159103 - DNA, 23 bp, Homo sapiens
gagacgaagtctctctcttgtca

SEQ ID NO: 159104 - DNA, 22 bp, Homo sapiens
ttgactgtttcttcttctgtaa

SEQ ID NO: 159105 - DNA, 22 bp, Homo sapiens
ttcagaggattatgaggaccaa

SEQ ID NO: 159106 - DNA, 23 bp, Homo sapiens
tgctaaattctgtgagttcatgt

SEQ ID NO: 159107 - DNA, 21 bp, Homo sapiens
tccctggaattttgttagcag

SEQ ID NO: 159108 - DNA, 22 bp, Homo sapiens
tttggaaggtcattggttcatt

SEQ ID NO: 159109 - DNA, 19 bp, Homo sapiens
ttaaggggtgcctgtattg

SEQ ID NO: 159110 - DNA, 23 bp, Homo sapiens
tatcacagtgcctcttgttcttc

SEQ ID NO: 159111 - DNA, 21 bp, Homo sapiens
tccaggatctcagagctttgg

SEQ ID NO: 159112 - DNA, 23 bp, Homo sapiens
tctttaacataaggtggaggcag

SEQ ID NO: 159113 - DNA, 23 bp, Homo sapiens
tcagatgcaccttgtgcttggtg

SEQ ID NO: 159114 - DNA, 23 bp, Homo sapiens
ctctgtctcactctgtcacccag

SEQ ID NO: 159115 - DNA, 20 bp, Homo sapiens
atatgtatatacatatgtgt

SEQ ID NO: 159116 - DNA, 21 bp, Homo sapiens
tatatacatatagtaacagct

SEQ ID NO: 159117 - DNA, 19 bp, Homo sapiens
caccaattctaatctcacc

SEQ ID NO: 159118 - DNA, 22 bp, Homo sapiens
taacaccaactctaatctcacc

SEQ ID NO: 159119 - DNA, 23 bp, Homo sapiens
tatcttctgcaattcacagggtt

SEQ ID NO: 159120 - DNA, 23 bp, Homo sapiens
ctcagggtctctgtctgtgcctg

SEQ ID NO: 159121 - DNA, 23 bp, Homo sapiens
atgtgtgtatgtgtatacgtgtg

SEQ ID NO: 159122 - DNA, 19 bp, Homo sapiens
tgcgtgtgtgtgtgtgtgt

SEQ ID NO: 159123 - DNA, 23 bp, Homo sapiens
cctggctcactctctggcacagt

SEQ ID NO: 159124 - DNA, 23 bp, Homo sapiens
tacacctgtgtggttatgttgag

SEQ ID NO: 159125 - DNA, 23 bp, Homo sapiens
aaagaggtttagaaaagttcatg

SEQ ID NO: 159126 - DNA, 18 bp, Homo sapiens
acgatgcattatatatct

SEQ ID NO: 159127 - DNA, 21 bp, Homo sapiens
caaaagtgtgtgtgtatatat

SEQ ID NO: 159128 - DNA, 18 bp, Homo sapiens
tacatcacattttcttta

SEQ ID NO: 159129 - DNA, 21 bp, Homo sapiens
tcattctttttaatggatgag

SEQ ID NO: 159130 - DNA, 23 bp, Homo sapiens
atgggtctcactcactctgtcgc

SEQ ID NO: 159131 - DNA, 23 bp, Homo sapiens
tacagatgtgagtaagttgtatc

SEQ ID NO: 159132 - DNA, 23 bp, Homo sapiens
ttctaagtcccaattctccacct

SEQ ID NO: 159133 - DNA, 23 bp, Homo sapiens
tgcgtgtctgggtctgtgtccca

SEQ ID NO: 159134 - DNA, 21 bp, Homo sapiens
tgaggtaggaggatcacttga

SEQ ID NO: 159135 - DNA, 23 bp, Homo sapiens
tgtgtgtgagagtgaaaggagta

SEQ ID NO: 159136 - DNA, 23 bp, Homo sapiens
tgactcatacgagtgggtcagtc

SEQ ID NO: 159137 - DNA, 23 bp, Homo sapiens
ggtctctgacactctggcaatca

SEQ ID NO: 159138 - DNA, 19 bp, Homo sapiens
tatatatatatgcatcctg

SEQ ID NO: 159139 - DNA, 20 bp, Homo sapiens
caccatatatatatatatat

SEQ ID NO: 159140 - DNA, 23 bp, Homo sapiens
tatatgtgtactgtatatgtata

SEQ ID NO: 159141 - DNA, 18 bp, Homo sapiens
aaggaccagtgcaagcag

SEQ ID NO: 159142 - DNA, 21 bp, Homo sapiens
tactaagtttataagtttaca

SEQ ID NO: 159143 - DNA, 23 bp, Homo sapiens
tatgtgtatttgtatatgtaaac

SEQ ID NO: 159144 - DNA, 23 bp, Homo sapiens
tgagttcattgtagattctggat

SEQ ID NO: 159145 - DNA, 23 bp, Homo sapiens
tgagttcattgtagattctggat

SEQ ID NO: 159146 - DNA, 23 bp, Homo sapiens
tctgtgcctgtctcacaattttg

SEQ ID NO: 159147 - DNA, 22 bp, Homo sapiens
atctcaccctgtcacccaggct

SEQ ID NO: 159148 - DNA, 23 bp, Homo sapiens
acagagtctcactctgtcgccca

SEQ ID NO: 159149 - DNA, 23 bp, Homo sapiens
tctgtgtccctgagtccctctgt

SEQ ID NO: 159150 - DNA, 19 bp, Homo sapiens
attgtttatttatttttga

SEQ ID NO: 159151 - DNA, 23 bp, Homo sapiens
taatgtatactagtaatgtgtca

SEQ ID NO: 159152 - DNA, 21 bp, Homo sapiens
ttcttttcctgattattctgt

SEQ ID NO: 159153 - DNA, 23 bp, Homo sapiens
acagagtctcgctctgtcagcca

SEQ ID NO: 159154 - DNA, 23 bp, Homo sapiens
tgacagagtgagaccctgtgtct

SEQ ID NO: 159155 - DNA, 23 bp, Homo sapiens
tatttttttggaggcagagtctc

SEQ ID NO: 159156 - DNA, 19 bp, Homo sapiens
tgacagagcaagactctgt

SEQ ID NO: 159157 - DNA, 23 bp, Homo sapiens
cagggtctcactctgtcacccag

SEQ ID NO: 159158 - DNA, 23 bp, Homo sapiens
tacagtctcactctgtcacccag

SEQ ID NO: 159159 - DNA, 23 bp, Homo sapiens
agagatggaagacttggcatctt

SEQ ID NO: 159160 - DNA, 23 bp, Homo sapiens
tcaggaagtctgcgtctgtctct

SEQ ID NO: 159161 - DNA, 23 bp, Homo sapiens
cactgtctctcactgatctttgg

SEQ ID NO: 159162 - DNA, 18 bp, Homo sapiens
tgagaagtgcctattcag

SEQ ID NO: 159163 - DNA, 23 bp, Homo sapiens
tctgcttggtgtatctggtgctg

SEQ ID NO: 159164 - DNA, 19 bp, Homo sapiens
tggtagagctgggctatga

SEQ ID NO: 159165 - DNA, 23 bp, Homo sapiens
catgatcagagagtgtgcttgag

SEQ ID NO: 159166 - DNA, 22 bp, Homo sapiens
tatttgtgtgtgtttaacatat

SEQ ID NO: 159167 - DNA, 19 bp, Homo sapiens
tgatcctagaattcacaca

SEQ ID NO: 159168 - DNA, 23 bp, Homo sapiens
tggctgaggaagttgtttctctt

SEQ ID NO: 159169 - DNA, 19 bp, Homo sapiens
atgactgcttctttaaatg

SEQ ID NO: 159170 - DNA, 19 bp, Homo sapiens
tgactagatgtatgtatgt

SEQ ID NO: 159171 - DNA, 23 bp, Homo sapiens
tgagtccagacactttctgcttc

SEQ ID NO: 159172 - DNA, 22 bp, Homo sapiens
attttacagataatgtatgtgt

SEQ ID NO: 159173 - DNA, 22 bp, Homo sapiens
tatgtgtgtatatatatatgtg

SEQ ID NO: 159174 - DNA, 21 bp, Homo sapiens
atatatgtatgtatatgtata

SEQ ID NO: 159175 - DNA, 22 bp, Homo sapiens
tttgtgcattgattttgtatcc

SEQ ID NO: 159176 - DNA, 23 bp, Homo sapiens
ttactgaatttgtttatcaattc

SEQ ID NO: 159177 - DNA, 23 bp, Homo sapiens
tctgtctctctggggctgaaatc

SEQ ID NO: 159178 - DNA, 21 bp, Homo sapiens
agagagtgaaaggggaagtgc

SEQ ID NO: 159179 - DNA, 22 bp, Homo sapiens
ttaggtagtcaaaggttagtcc

SEQ ID NO: 159180 - DNA, 23 bp, Homo sapiens
taaggttgcattgataatctttg

SEQ ID NO: 159181 - DNA, 21 bp, Homo sapiens
ttattctgccaaggcaataag

SEQ ID NO: 159182 - DNA, 23 bp, Homo sapiens
tctttgattatctaggagtatga

SEQ ID NO: 159183 - DNA, 18 bp, Homo sapiens
tccatgagatctgatggt

SEQ ID NO: 159184 - DNA, 21 bp, Homo sapiens
agcacctgtgcaagtttgtta

SEQ ID NO: 159185 - DNA, 23 bp, Homo sapiens
tagtgagaggcatagctgaaaca

SEQ ID NO: 159186 - DNA, 23 bp, Homo sapiens
ttgtatgtatgtatgtgtgtgtg

SEQ ID NO: 159187 - DNA, 23 bp, Homo sapiens
taactgagttgaggtttggagca

SEQ ID NO: 159188 - DNA, 23 bp, Homo sapiens
ggaagacaaaggtcactgaggtt

SEQ ID NO: 159189 - DNA, 23 bp, Homo sapiens
ctggagacaagtctcactgtcac

SEQ ID NO: 159190 - DNA, 23 bp, Homo sapiens
ctgtggttttgtcagagatgctt

SEQ ID NO: 159191 - DNA, 23 bp, Homo sapiens
tgaggtagagtctcactctgtcg

SEQ ID NO: 159192 - DNA, 19 bp, Homo sapiens
aggtgttttttgttgtttg

SEQ ID NO: 159193 - DNA, 22 bp, Homo sapiens
tactccatcatcttaggtgtgt

SEQ ID NO: 159194 - DNA, 21 bp, Homo sapiens
taaggttggagagtgatgtca

SEQ ID NO: 159195 - DNA, 23 bp, Homo sapiens
ctctgtgtgtctgcctgtcaaga

SEQ ID NO: 159196 - DNA, 18 bp, Homo sapiens
cttatctttgtttttttt

SEQ ID NO: 159197 - DNA, 19 bp, Homo sapiens
ttgtagtacagctccccaa

SEQ ID NO: 159198 - DNA, 21 bp, Homo sapiens
aggcacaggttgtagtgagcc

SEQ ID NO: 159199 - DNA, 21 bp, Homo sapiens
ctctctctctctctcagcagg

SEQ ID NO: 159200 - DNA, 18 bp, Homo sapiens
gcctgtaatcccagcact

SEQ ID NO: 159201 - DNA, 22 bp, Homo sapiens
gttctgggattacaggcatgag

SEQ ID NO: 159202 - DNA, 23 bp, Homo sapiens
tggttttggattgtaaattagat

SEQ ID NO: 159203 - DNA, 23 bp, Homo sapiens
gctaagatgacaggcatgagcca

SEQ ID NO: 159204 - DNA, 23 bp, Homo sapiens
tagagactgggtcttgtttatgt

SEQ ID NO: 159205 - DNA, 20 bp, Homo sapiens
gagtctggctctgtcacccg

SEQ ID NO: 159206 - DNA, 23 bp, Homo sapiens
tgagagcttggagcttcttaagt

SEQ ID NO: 159207 - DNA, 23 bp, Homo sapiens
tgatctgggagctgaagctgctc

SEQ ID NO: 159208 - DNA, 23 bp, Homo sapiens
ttggtgagaagtgattttctttt

SEQ ID NO: 159209 - DNA, 22 bp, Homo sapiens
aggtggaaaatctgcatttact

SEQ ID NO: 159210 - DNA, 23 bp, Homo sapiens
tgtgagccactgtgtctggcttt

SEQ ID NO: 159211 - DNA, 21 bp, Homo sapiens
cactggcacgattgttgctca

SEQ ID NO: 159212 - DNA, 23 bp, Homo sapiens
tcagtctctgtctttgagatgtc

SEQ ID NO: 159213 - DNA, 23 bp, Homo sapiens
tgatgtgtgtgtgtgtgtgtctg

SEQ ID NO: 159214 - DNA, 23 bp, Homo sapiens
agggacaagagtgaggtctgtga

SEQ ID NO: 159215 - DNA, 23 bp, Homo sapiens
tatctggtgcatatatgtaatat

SEQ ID NO: 159216 - DNA, 23 bp, Homo sapiens
tctgagagtgagtgcttccttaa

SEQ ID NO: 159217 - DNA, 22 bp, Homo sapiens
atggatgctgaaggtggcttca

SEQ ID NO: 159218 - DNA, 23 bp, Homo sapiens
tgggagtgacctttgctggttgt

SEQ ID NO: 159219 - DNA, 23 bp, Homo sapiens
agatggagtctcactctctcacc

SEQ ID NO: 159220 - DNA, 19 bp, Homo sapiens
agggtgtgatctcagctca

SEQ ID NO: 159221 - DNA, 23 bp, Homo sapiens
atctctgcctccaaagttgcatc

SEQ ID NO: 159222 - DNA, 21 bp, Homo sapiens
tgtcacataagaaaacttgta

SEQ ID NO: 159223 - DNA, 18 bp, Homo sapiens
actgtgagagatcatggt

SEQ ID NO: 159224 - DNA, 21 bp, Homo sapiens
tagaagttactgaagagcaga

SEQ ID NO: 159225 - DNA, 22 bp, Homo sapiens
taatggtctggtaattttatct

SEQ ID NO: 159226 - DNA, 23 bp, Homo sapiens
gagtcttcagtgttagttgttgt

SEQ ID NO: 159227 - DNA, 18 bp, Homo sapiens
ttaatggttgatgactga

SEQ ID NO: 159228 - DNA, 23 bp, Homo sapiens
cacactctctgacagcctggctc

SEQ ID NO: 159229 - DNA, 22 bp, Homo sapiens
atccatatatatccatatatgt

SEQ ID NO: 159230 - DNA, 19 bp, Homo sapiens
tcaaataatattccattct

SEQ ID NO: 159231 - DNA, 23 bp, Homo sapiens
agattggttccttatcttgggta

SEQ ID NO: 159232 - DNA, 23 bp, Homo sapiens
cagggtctctctctgccactcaa

SEQ ID NO: 159233 - DNA, 21 bp, Homo sapiens
tgatcttatgtatgtaaagca

SEQ ID NO: 159234 - DNA, 19 bp, Homo sapiens
taatgtcattttattttag

SEQ ID NO: 159235 - DNA, 23 bp, Homo sapiens
tctctctgactcctggtacagat

SEQ ID NO: 159236 - DNA, 21 bp, Homo sapiens
tgtatagcacagagaaaggag

SEQ ID NO: 159237 - DNA, 23 bp, Homo sapiens
tgttagtagttgaaggaggtgtg

SEQ ID NO: 159238 - DNA, 21 bp, Homo sapiens
tatatgatatatatcatatgt

SEQ ID NO: 159239 - DNA, 22 bp, Homo sapiens
atatgtgtatttgtatatatga

SEQ ID NO: 159240 - DNA, 23 bp, Homo sapiens
tgagatggagtctcactctgtcc

SEQ ID NO: 159241 - DNA, 23 bp, Homo sapiens
tgtgtgcgtgtgtgtgcgcgtgt

SEQ ID NO: 159242 - DNA, 19 bp, Homo sapiens
tatgcacgtgtgcgcgtgt

SEQ ID NO: 159243 - DNA, 23 bp, Homo sapiens
tgagacagagtctcgctctgtcg

SEQ ID NO: 159244 - DNA, 23 bp, Homo sapiens
gggtctcactctgtcacccaggc

SEQ ID NO: 159245 - DNA, 23 bp, Homo sapiens
gggtctcactctgtcacccaggc

SEQ ID NO: 159246 - DNA, 23 bp, Homo sapiens
agctcactgggagagttgagctg

SEQ ID NO: 159247 - DNA, 20 bp, Homo sapiens
attctttttacaggatctag

SEQ ID NO: 159248 - DNA, 19 bp, Homo sapiens
agaagtttggattttgttt

SEQ ID NO: 159249 - DNA, 23 bp, Homo sapiens
tgcaaaagttgtgatgttcttgt

SEQ ID NO: 159250 - DNA, 23 bp, Homo sapiens
tgagagagtcttcctctgtcacc

SEQ ID NO: 159251 - DNA, 23 bp, Homo sapiens
tgtcctcatggagctcacggtcg

SEQ ID NO: 159252 - DNA, 21 bp, Homo sapiens
tgtcatgtaattgcaatcata

SEQ ID NO: 159253 - DNA, 22 bp, Homo sapiens
tttatatgaaacctagaaaaga

SEQ ID NO: 159254 - DNA, 20 bp, Homo sapiens
ttcagagtagttgtaccatc

SEQ ID NO: 159255 - DNA, 22 bp, Homo sapiens
tatatcagtgggtatcattttg

SEQ ID NO: 159256 - DNA, 21 bp, Homo sapiens
tctgtggtaattgaatgtagt

SEQ ID NO: 159257 - DNA, 23 bp, Homo sapiens
atgtgtgtctctgtatgtgagat

SEQ ID NO: 159258 - DNA, 19 bp, Homo sapiens
tacagcacactgatgggtc

SEQ ID NO: 159259 - DNA, 23 bp, Homo sapiens
tgagttcattgtagattctggat

SEQ ID NO: 159260 - DNA, 23 bp, Homo sapiens
tgagttcattgtagattctggat

SEQ ID NO: 159261 - DNA, 20 bp, Homo sapiens
gagtagttgcatatttaatt

SEQ ID NO: 159262 - DNA, 23 bp, Homo sapiens
agtcagagtctcgctctgtcacc

SEQ ID NO: 159263 - DNA, 23 bp, Homo sapiens
agaccactgttgagactgttact

SEQ ID NO: 159264 - DNA, 21 bp, Homo sapiens
atgacagaactcatactggag

SEQ ID NO: 159265 - DNA, 18 bp, Homo sapiens
ggtctcactctgtcactc

SEQ ID NO: 159266 - DNA, 23 bp, Homo sapiens
catggtctcactctgtcactcag

SEQ ID NO: 159267 - DNA, 23 bp, Homo sapiens
agagtctcactctgttgcctggg

SEQ ID NO: 159268 - DNA, 22 bp, Homo sapiens
tgttcaccacgtccacaccaac

SEQ ID NO: 159269 - DNA, 23 bp, Homo sapiens
tatcgcactgtggttttgatttg

SEQ ID NO: 159270 - DNA, 23 bp, Homo sapiens
ctctttctgtgtctctgcctggg

SEQ ID NO: 159271 - DNA, 23 bp, Homo sapiens
agagtctcactcactctacagcc

SEQ ID NO: 159272 - DNA, 23 bp, Homo sapiens
aggagtctcactcactctttcgc

SEQ ID NO: 159273 - DNA, 23 bp, Homo sapiens
gagacgtggtctcattatgttgt

SEQ ID NO: 159274 - DNA, 23 bp, Homo sapiens
tctcactctgccactcagtctgc

SEQ ID NO: 159275 - DNA, 20 bp, Homo sapiens
atgtgtgcttgtatctatta

SEQ ID NO: 159276 - DNA, 21 bp, Homo sapiens
aaggttattttgaatctctgt

SEQ ID NO: 159277 - DNA, 22 bp, Homo sapiens
gcatacctgtagttccagctgc

SEQ ID NO: 159278 - DNA, 18 bp, Homo sapiens
agtgagccatgatagcac

SEQ ID NO: 159279 - DNA, 23 bp, Homo sapiens
tgagagacatgagacagaggaca

SEQ ID NO: 159280 - DNA, 21 bp, Homo sapiens
atctgtttaattgttttaatg

SEQ ID NO: 159281 - DNA, 22 bp, Homo sapiens
tcagagctgtagctggagaagg

SEQ ID NO: 159282 - DNA, 22 bp, Homo sapiens
tctgtctgtcagtttgtctctc

SEQ ID NO: 159283 - DNA, 23 bp, Homo sapiens
gtatgtgtgtgtaaatgtaactg

SEQ ID NO: 159284 - DNA, 19 bp, Homo sapiens
tgagttcactgtcattctc

SEQ ID NO: 159285 - DNA, 23 bp, Homo sapiens
tctgcctgacagtccgtgtctct

SEQ ID NO: 159286 - DNA, 23 bp, Homo sapiens
acactcacacagtgtgaccttgc

SEQ ID NO: 159287 - DNA, 18 bp, Homo sapiens
taggacaacaggtgcaca

SEQ ID NO: 159288 - DNA, 21 bp, Homo sapiens
acatgtgcacattgtgcaggt

SEQ ID NO: 159289 - DNA, 23 bp, Homo sapiens
acaaagtatatttataggttagg

SEQ ID NO: 159290 - DNA, 22 bp, Homo sapiens
cacagcacagactcagctgctg

SEQ ID NO: 159291 - DNA, 19 bp, Homo sapiens
tagagagcgatgatagatg

SEQ ID NO: 159292 - DNA, 19 bp, Homo sapiens
tgagatctcactatcttgc

SEQ ID NO: 159293 - DNA, 23 bp, Homo sapiens
tggagtctcactctgtcacccag

SEQ ID NO: 159294 - DNA, 23 bp, Homo sapiens
tttcagtctcagtctgggtttaa

SEQ ID NO: 159295 - DNA, 18 bp, Homo sapiens
tctccctctgtcacccag

SEQ ID NO: 159296 - DNA, 22 bp, Homo sapiens
atggtgtgatcttggctcactg

SEQ ID NO: 159297 - DNA, 22 bp, Homo sapiens
atacacacacacatatatgtgt

SEQ ID NO: 159298 - DNA, 23 bp, Homo sapiens
tgtgtgtatatgtgtgtatgtgt

SEQ ID NO: 159299 - DNA, 22 bp, Homo sapiens
tgagatggagtttcgctcttgt

SEQ ID NO: 159300 - DNA, 22 bp, Homo sapiens
tcagagctgtagctggagaagg

SEQ ID NO: 159301 - DNA, 22 bp, Homo sapiens
tctgtctgtcagtttgtctctc

SEQ ID NO: 159302 - DNA, 19 bp, Homo sapiens
tgagttcactgtcattctc

SEQ ID NO: 159303 - DNA, 23 bp, Homo sapiens
tctgcctgacagtccgtgtctct

SEQ ID NO: 159304 - DNA, 23 bp, Homo sapiens
acactcacacagtgtgaccttgc

SEQ ID NO: 159305 - DNA, 23 bp, Homo sapiens
atgtgtgtgtgtgtatatataca

SEQ ID NO: 159306 - DNA, 23 bp, Homo sapiens
tgagttcattgtagattctggat

SEQ ID NO: 159307 - DNA, 23 bp, Homo sapiens
tgagttcattgtagattctggat

SEQ ID NO: 159308 - DNA, 23 bp, Homo sapiens
agacagagtctcgctctgtcacc

SEQ ID NO: 159309 - DNA, 21 bp, Homo sapiens
ataccagtctgtctctgggtc

SEQ ID NO: 159310 - DNA, 23 bp, Homo sapiens
aacacagtgagacaccatctcta

SEQ ID NO: 159311 - DNA, 23 bp, Homo sapiens
agacagagtctcactctgtcact

SEQ ID NO: 159312 - DNA, 23 bp, Homo sapiens
ctcactcactggctaacgtgcag

SEQ ID NO: 159313 - DNA, 23 bp, Homo sapiens
tgaggaaggtgctgagtctcgtg

SEQ ID NO: 159314 - DNA, 22 bp, Homo sapiens
tgtaccctagagagatagcaga

SEQ ID NO: 159315 - DNA, 23 bp, Homo sapiens
gacagagtctcactctgtccccc

SEQ ID NO: 159316 - DNA, 23 bp, Homo sapiens
aagatacaagatctcattctgtc

SEQ ID NO: 159317 - DNA, 23 bp, Homo sapiens
tgtcttacttctggaagtgattt

SEQ ID NO: 159318 - DNA, 23 bp, Homo sapiens
tgagatggagtctcactctgttg

SEQ ID NO: 159319 - DNA, 23 bp, Homo sapiens
gagatgagagtctcgctctgtca

SEQ ID NO: 159320 - DNA, 23 bp, Homo sapiens
tcgctcgctcgctcgctcgctca

SEQ ID NO: 159321 - DNA, 20 bp, Homo sapiens
tggctgggacttacgtttct

SEQ ID NO: 159322 - DNA, 23 bp, Homo sapiens
tgagatggagtctcactctgtca

SEQ ID NO: 159323 - DNA, 22 bp, Homo sapiens
agcctacatgcagagtctttta

SEQ ID NO: 159324 - DNA, 23 bp, Homo sapiens
tttgagatggagtcttgctctgt

SEQ ID NO: 159325 - DNA, 22 bp, Homo sapiens
aatgaagagaagctggactgtc

SEQ ID NO: 159326 - DNA, 23 bp, Homo sapiens
agatggagtctctctctgtcacc

SEQ ID NO: 159327 - DNA, 23 bp, Homo sapiens
ttgagacggagtctcactctgtc

SEQ ID NO: 159328 - DNA, 21 bp, Homo sapiens
caggaagattctttttttttt

SEQ ID NO: 159329 - DNA, 18 bp, Homo sapiens
actgcaaggactggcaga

SEQ ID NO: 159330 - DNA, 23 bp, Homo sapiens
gtgtgtgtctgtctgtgttctgc

SEQ ID NO: 159331 - DNA, 23 bp, Homo sapiens
gactgagtctcgctctgtcaccc

SEQ ID NO: 159332 - DNA, 23 bp, Homo sapiens
actgagtctcgctctgtcaccca

SEQ ID NO: 159333 - DNA, 23 bp, Homo sapiens
gtgagtgagaccctgtcttgaga

SEQ ID NO: 159334 - DNA, 23 bp, Homo sapiens
tagacagtctcgctctgtctccc

SEQ ID NO: 159335 - DNA, 23 bp, Homo sapiens
ttggagctggagcctcactctgt

SEQ ID NO: 159336 - DNA, 23 bp, Homo sapiens
gtctctgtctcagtctgtctctg

SEQ ID NO: 159337 - DNA, 19 bp, Homo sapiens
ttgagacagagtcttgctc

SEQ ID NO: 159338 - DNA, 21 bp, Homo sapiens
acagagcaagatcttatctca

SEQ ID NO: 159339 - DNA, 23 bp, Homo sapiens
ttgagacagagtcttgctctgtc

SEQ ID NO: 159340 - DNA, 23 bp, Homo sapiens
aaagtctcactctctcacccagg

SEQ ID NO: 159341 - DNA, 23 bp, Homo sapiens
agacagggtctccctctgtcacc

SEQ ID NO: 159342 - DNA, 23 bp, Homo sapiens
tttggagatggagtctcactctg

SEQ ID NO: 159343 - DNA, 18 bp, Homo sapiens
tctaatgaagaaagtggt

SEQ ID NO: 159344 - DNA, 23 bp, Homo sapiens
tcaggctgcctggctgcctctat

SEQ ID NO: 159345 - DNA, 23 bp, Homo sapiens
ttggagctggagcctcactctgt

SEQ ID NO: 159346 - DNA, 23 bp, Homo sapiens
ttggagctggagcctcactctgt

SEQ ID NO: 159347 - DNA, 21 bp, Homo sapiens
tgagacagggtctcgctctgt

SEQ ID NO: 159348 - DNA, 23 bp, Homo sapiens
aaggtctcactctgtcacccagg

SEQ ID NO: 159349 - DNA, 20 bp, Homo sapiens
tgtctctcaggctctgtggt

SEQ ID NO: 159350 - DNA, 23 bp, Homo sapiens
agacagagtctcgctgtgtctac

SEQ ID NO: 159351 - DNA, 20 bp, Homo sapiens
agcacctcctgatccttgag

SEQ ID NO: 159352 - DNA, 23 bp, Homo sapiens
agatggagtctcgctctgtcacc

SEQ ID NO: 159353 - DNA, 23 bp, Homo sapiens
tctgagtgtctctgtgcctcgct

SEQ ID NO: 159354 - DNA, 22 bp, Homo sapiens
agacagggtattgctctgtcac

SEQ ID NO: 159355 - DNA, 23 bp, Homo sapiens
aggttgcagtgagccaaggttgt

SEQ ID NO: 159356 - DNA, 19 bp, Homo sapiens
tattcaatatatgtatatg

SEQ ID NO: 159357 - DNA, 22 bp, Homo sapiens
tgagccaccgtgcctggctgag

SEQ ID NO: 159358 - DNA, 22 bp, Homo sapiens
gagttttgctcttgtcacccag

SEQ ID NO: 159359 - DNA, 20 bp, Homo sapiens
tatgcatatatatacgtata

SEQ ID NO: 159360 - DNA, 21 bp, Homo sapiens
tgtgtgtatatatatacgtgt

SEQ ID NO: 159361 - DNA, 23 bp, Homo sapiens
tatgtgtgcgtatatgtgtgtgt

SEQ ID NO: 159362 - DNA, 23 bp, Homo sapiens
cctgtctgtctctgtctgtgtgt

SEQ ID NO: 159363 - DNA, 23 bp, Homo sapiens
gactgagtctggctctgtcaccc

SEQ ID NO: 159364 - DNA, 23 bp, Homo sapiens
cagggtctcactctgtcacccag

SEQ ID NO: 159365 - DNA, 22 bp, Homo sapiens
agagtctcgctctgtcacccag

SEQ ID NO: 159366 - DNA, 23 bp, Homo sapiens
ctgtctctgtctctgttctatct

SEQ ID NO: 159367 - DNA, 23 bp, Homo sapiens
gtgtgtgtgactatcctgtttgt

SEQ ID NO: 159368 - DNA, 23 bp, Homo sapiens
gggtctcactctgtcacccaggc

SEQ ID NO: 159369 - DNA, 19 bp, Homo sapiens
cgatgtgcagcaggacctg

SEQ ID NO: 159370 - DNA, 23 bp, Homo sapiens
tatatcaggcactccatccggat

SEQ ID NO: 159371 - DNA, 21 bp, Homo sapiens
aagaggtttttgtttgtttat

SEQ ID NO: 159372 - DNA, 20 bp, Homo sapiens
atcccaggagttggaggtta

SEQ ID NO: 159373 - DNA, 23 bp, Homo sapiens
tcagtctctgacagtcagggtcc

SEQ ID NO: 159374 - DNA, 23 bp, Homo sapiens
acatagtggctgtgtcaccttgg

SEQ ID NO: 159375 - DNA, 22 bp, Homo sapiens
ggtcactctgcctctgtgagcc

SEQ ID NO: 159376 - DNA, 23 bp, Homo sapiens
agacagggtctccctctgtcacc

SEQ ID NO: 159377 - DNA, 22 bp, Homo sapiens
tgaggctgcagtgaaccgtgat

SEQ ID NO: 159378 - DNA, 19 bp, Homo sapiens
gggtgagtctatcttgggt

SEQ ID NO: 159379 - DNA, 21 bp, Homo sapiens
tcacggcctctctgcctctgt

SEQ ID NO: 159380 - DNA, 23 bp, Homo sapiens
tggctgtctgtggtctccgaggt

SEQ ID NO: 159381 - DNA, 22 bp, Homo sapiens
agtagtcagggcgagatcatga

SEQ ID NO: 159382 - DNA, 23 bp, Homo sapiens
tgtgtgtgcataatatttctgta

SEQ ID NO: 159383 - DNA, 22 bp, Homo sapiens
ttgagatagagtctcactctgt

SEQ ID NO: 159384 - DNA, 23 bp, Homo sapiens
acagagtctcactctgtcgccca

SEQ ID NO: 159385 - DNA, 23 bp, Homo sapiens
tgctgagtgtctgtgtgtctctg

SEQ ID NO: 159386 - DNA, 23 bp, Homo sapiens
agcgagagcttgtctttacaaaa

SEQ ID NO: 159387 - DNA, 23 bp, Homo sapiens
ttgagacaagagtctcactctgt

SEQ ID NO: 159388 - DNA, 21 bp, Homo sapiens
taggtcagaaatcttggagtc

SEQ ID NO: 159389 - DNA, 20 bp, Homo sapiens
aattccaatctgtcctcaaa

SEQ ID NO: 159390 - DNA, 23 bp, Homo sapiens
actgtctgtctcatatagatgag

SEQ ID NO: 159391 - DNA, 23 bp, Homo sapiens
aaggttgaatagaaatgtgatag

SEQ ID NO: 159392 - DNA, 21 bp, Homo sapiens
agtatatatggtagtgtgtgt

SEQ ID NO: 159393 - DNA, 23 bp, Homo sapiens
tggttgtcatgtgcatttgttct

SEQ ID NO: 159394 - DNA, 23 bp, Homo sapiens
ggaatggtctatggggttgatga

SEQ ID NO: 159395 - DNA, 23 bp, Homo sapiens
tacacattcccatatatatgcac

SEQ ID NO: 159396 - DNA, 18 bp, Homo sapiens
caccatgttggccaggct

SEQ ID NO: 159397 - DNA, 23 bp, Homo sapiens
ttgattgcttttagtggagtatc

SEQ ID NO: 159398 - DNA, 22 bp, Homo sapiens
tgaatgtgtgagtttatgttct

SEQ ID NO: 159399 - DNA, 23 bp, Homo sapiens
tgtatgtgcatttcttttgtttt

SEQ ID NO: 159400 - DNA, 22 bp, Homo sapiens
atcttcacctcttggaacactg

SEQ ID NO: 159401 - DNA, 21 bp, Homo sapiens
acatacacaatatattgtgta

SEQ ID NO: 159402 - DNA, 18 bp, Homo sapiens
acataatatattgtgtat

SEQ ID NO: 159403 - DNA, 23 bp, Homo sapiens
cttaacacagagctctggatatg

SEQ ID NO: 159404 - DNA, 23 bp, Homo sapiens
tgtgtggatttttgtgtggctga

SEQ ID NO: 159405 - DNA, 23 bp, Homo sapiens
tttttgcttcatgaacaaggctg

SEQ ID NO: 159406 - DNA, 20 bp, Homo sapiens
tgtgtgtatatatattctat

SEQ ID NO: 159407 - DNA, 19 bp, Homo sapiens
tatattcaggattgcatat

SEQ ID NO: 159408 - DNA, 22 bp, Homo sapiens
ttccaaagtggctgtactattt

SEQ ID NO: 159409 - DNA, 18 bp, Homo sapiens
ttcatggtgtaaaggatg

SEQ ID NO: 159410 - DNA, 21 bp, Homo sapiens
atgtcactctgcatcttgttt

SEQ ID NO: 159411 - DNA, 23 bp, Homo sapiens
ctgagtctcactctgtcacccac

SEQ ID NO: 159412 - DNA, 23 bp, Homo sapiens
attttagtctctctctctcttca

SEQ ID NO: 159413 - DNA, 22 bp, Homo sapiens
ttgtaagtattttaattagaag

SEQ ID NO: 159414 - DNA, 21 bp, Homo sapiens
aaaggagtctttttgttctgt

SEQ ID NO: 159415 - DNA, 23 bp, Homo sapiens
atgttctagtatttgatggtaaa

SEQ ID NO: 159416 - DNA, 23 bp, Homo sapiens
tctcatgctgtgtctgagtcaca

SEQ ID NO: 159417 - DNA, 23 bp, Homo sapiens
agtgacaagttagtgttgtctga

SEQ ID NO: 159418 - DNA, 22 bp, Homo sapiens
taggctgttcatgtgtgtgtgt

SEQ ID NO: 159419 - DNA, 23 bp, Homo sapiens
ctggagtgtagtggttccctcat

SEQ ID NO: 159420 - DNA, 23 bp, Homo sapiens
cggagtctcactctgtcacccag

SEQ ID NO: 159421 - DNA, 23 bp, Homo sapiens
tttttgagatggattcttgctct

SEQ ID NO: 159422 - DNA, 23 bp, Homo sapiens
atgtgtctgggtgtgtactgggc

SEQ ID NO: 159423 - DNA, 23 bp, Homo sapiens
gcagtgagccaagatggtgccac

SEQ ID NO: 159424 - DNA, 23 bp, Homo sapiens
gggtctcactctgtcacccaggc

SEQ ID NO: 159425 - DNA, 20 bp, Homo sapiens
taaccatatatatccagata

SEQ ID NO: 159426 - DNA, 23 bp, Homo sapiens
gtcaacgagtgagacactggctc

SEQ ID NO: 159427 - DNA, 19 bp, Homo sapiens
tctgtcacccagactggag

SEQ ID NO: 159428 - DNA, 23 bp, Homo sapiens
tgagatggagtctcactctgtcg

SEQ ID NO: 159429 - DNA, 23 bp, Homo sapiens
tcaacctctctgagtctcagttc

SEQ ID NO: 159430 - DNA, 22 bp, Homo sapiens
taactctctcccacccaagtag

SEQ ID NO: 159431 - DNA, 22 bp, Homo sapiens
tttgagatagagttttgctctt

SEQ ID NO: 159432 - DNA, 23 bp, Homo sapiens
agacagaatctcactctgtcacc

SEQ ID NO: 159433 - DNA, 23 bp, Homo sapiens
tatgtgtgtggtatatgtatgta

SEQ ID NO: 159434 - DNA, 18 bp, Homo sapiens
tacgtatgtatgtataca

SEQ ID NO: 159435 - DNA, 19 bp, Homo sapiens
tgaaagaagggtgtgagga

SEQ ID NO: 159436 - DNA, 23 bp, Homo sapiens
tatgtatatatatacgtgtgtat

SEQ ID NO: 159437 - DNA, 22 bp, Homo sapiens
tttcaccatgttggccaggttg

SEQ ID NO: 159438 - DNA, 23 bp, Homo sapiens
atgtatgtatgtatgtatgtatg

SEQ ID NO: 159439 - DNA, 22 bp, Homo sapiens
tgacaagatcgactctgtctca

SEQ ID NO: 159440 - DNA, 23 bp, Homo sapiens
gagtgtgtctctctctgtcgccc

SEQ ID NO: 159441 - DNA, 23 bp, Homo sapiens
tttcggaatttattcttgagtca

SEQ ID NO: 159442 - DNA, 20 bp, Homo sapiens
tgactgtagtcccagctgct

SEQ ID NO: 159443 - DNA, 18 bp, Homo sapiens
agtgagccattactatgc

SEQ ID NO: 159444 - DNA, 23 bp, Homo sapiens
ggtggcagagtgagaccctgtct

SEQ ID NO: 159445 - DNA, 23 bp, Homo sapiens
agacagagtctcgctctgtcacc

SEQ ID NO: 159446 - DNA, 23 bp, Homo sapiens
atctcctggctttgaatccactt

SEQ ID NO: 159447 - DNA, 23 bp, Homo sapiens
agacaagagtctcactctgtcac

SEQ ID NO: 159448 - DNA, 23 bp, Homo sapiens
tgtcattttcttgttcacctgct

SEQ ID NO: 159449 - DNA, 21 bp, Homo sapiens
tttactcaccctctctgtgcc

SEQ ID NO: 159450 - DNA, 20 bp, Homo sapiens
tgcctgaagtcacacagctc

SEQ ID NO: 159451 - DNA, 18 bp, Homo sapiens
ttggaggtcagggagctc

SEQ ID NO: 159452 - DNA, 23 bp, Homo sapiens
tatctgtgtatatatatgtgtat

SEQ ID NO: 159453 - DNA, 23 bp, Homo sapiens
ggctgaggtaggaggatcacttg

SEQ ID NO: 159454 - DNA, 18 bp, Homo sapiens
aggttggtcttgaactct

SEQ ID NO: 159455 - DNA, 22 bp, Homo sapiens
ttgctggttgttcttgagctga

SEQ ID NO: 159456 - DNA, 23 bp, Homo sapiens
tcttgagacggagtcttgctctg

SEQ ID NO: 159457 - DNA, 23 bp, Homo sapiens
agcatggttcactgcctagctgg

SEQ ID NO: 159458 - DNA, 22 bp, Homo sapiens
tttttttgtagagacagggtct

SEQ ID NO: 159459 - DNA, 22 bp, Homo sapiens
agatatgagagctatatatctc

SEQ ID NO: 159460 - DNA, 20 bp, Homo sapiens
cagggactaagtctctctct

SEQ ID NO: 159461 - DNA, 22 bp, Homo sapiens
tgtctctcaggctctgtggctc

SEQ ID NO: 159462 - DNA, 21 bp, Homo sapiens
atagcatttccaggcctatct

SEQ ID NO: 159463 - DNA, 23 bp, Homo sapiens
tttgagatggagttttgctcttg

SEQ ID NO: 159464 - DNA, 23 bp, Homo sapiens
agtcttggagaagctaagtaact

SEQ ID NO: 159465 - DNA, 22 bp, Homo sapiens
tcagctagtaagttctttaata

SEQ ID NO: 159466 - DNA, 23 bp, Homo sapiens
ttctctctgtgtctgtcctcatc

SEQ ID NO: 159467 - DNA, 23 bp, Homo sapiens
aaagaacttatggtgctgctgct

SEQ ID NO: 159468 - DNA, 18 bp, Homo sapiens
gttgtttcttaaaatagg

SEQ ID NO: 159469 - DNA, 19 bp, Homo sapiens
acagagtctcactatgttg

SEQ ID NO: 159470 - DNA, 18 bp, Homo sapiens
tcattgattctaattggt

SEQ ID NO: 159471 - DNA, 19 bp, Homo sapiens
acattgtcttgggaactct

SEQ ID NO: 159472 - DNA, 18 bp, Homo sapiens
agagttctcaggacaatg

SEQ ID NO: 159473 - DNA, 23 bp, Homo sapiens
ttattgaagaagtcaaaggctga

SEQ ID NO: 159474 - DNA, 23 bp, Homo sapiens
acagagtctcccactgtcaccca

SEQ ID NO: 159475 - DNA, 20 bp, Homo sapiens
tgagtttatatgtattactt

SEQ ID NO: 159476 - DNA, 18 bp, Homo sapiens
agagttctcaggacaatg

SEQ ID NO: 159477 - DNA, 23 bp, Homo sapiens
gtctgtctgtccctgtgaccctg

SEQ ID NO: 159478 - DNA, 23 bp, Homo sapiens
cagagtctctctgtccctccatg

SEQ ID NO: 159479 - DNA, 23 bp, Homo sapiens
tgagttcattgtagattctggat

SEQ ID NO: 159480 - DNA, 23 bp, Homo sapiens
tgagttcattgtagattctggat

SEQ ID NO: 159481 - DNA, 23 bp, Homo sapiens
tctctcacactcactgtcttgag

SEQ ID NO: 159482 - DNA, 18 bp, Homo sapiens
tagtgctatctcagctca

SEQ ID NO: 159483 - DNA, 23 bp, Homo sapiens
tgtgattctctgagtaactgtat

SEQ ID NO: 159484 - DNA, 23 bp, Homo sapiens
caaaagcacatgctgtgagttca

SEQ ID NO: 159485 - DNA, 23 bp, Homo sapiens
gaaacagagtctcgttctgtcac

SEQ ID NO: 159486 - DNA, 22 bp, Homo sapiens
aagtcaggagagagagtggtgt

SEQ ID NO: 159487 - DNA, 22 bp, Homo sapiens
actgaaggaggtgttctatttc

SEQ ID NO: 159488 - DNA, 18 bp, Homo sapiens
gtggcaggatcaatagag

SEQ ID NO: 159489 - DNA, 23 bp, Homo sapiens
agagattctgactccaagggttg

SEQ ID NO: 159490 - DNA, 22 bp, Homo sapiens
ttttgagacggagtctcactgt

SEQ ID NO: 159491 - DNA, 18 bp, Homo sapiens
tgcaatggcaagatctca

SEQ ID NO: 159492 - DNA, 23 bp, Homo sapiens
atactgtttgcattgtcacacac

SEQ ID NO: 159493 - DNA, 23 bp, Homo sapiens
tcactcacagtctcatactgtta

SEQ ID NO: 159494 - DNA, 23 bp, Homo sapiens
ttactggcacttcttttgagaca

SEQ ID NO: 159495 - DNA, 23 bp, Homo sapiens
tacatagctctacatggagatgt

SEQ ID NO: 159496 - DNA, 19 bp, Homo sapiens
aggtatattattaagtgaa

SEQ ID NO: 159497 - DNA, 20 bp, Homo sapiens
tatgtacatatacgtgtata

SEQ ID NO: 159498 - DNA, 22 bp, Homo sapiens
ttgagacagtcttgctctgtca

SEQ ID NO: 159499 - DNA, 23 bp, Homo sapiens
cttgtctgtgacagtttttcatt

SEQ ID NO: 159500 - DNA, 23 bp, Homo sapiens
gttttgactattatttaaagtgt

SEQ ID NO: 159501 - DNA, 22 bp, Homo sapiens
tgcctggctccaagtaaggtct

SEQ ID NO: 159502 - DNA, 22 bp, Homo sapiens
tagtgtgtatatgtatatgtgt

SEQ ID NO: 159503 - DNA, 22 bp, Homo sapiens
tagtgtgtatatgtatatgtgt

SEQ ID NO: 159504 - DNA, 23 bp, Homo sapiens
tgagttcattgtagattctggat

SEQ ID NO: 159505 - DNA, 23 bp, Homo sapiens
tgagttcattgtagattctggat

SEQ ID NO: 159506 - DNA, 21 bp, Homo sapiens
atcacagagggagtacaccct

SEQ ID NO: 159507 - DNA, 23 bp, Homo sapiens
tatcacagtgggtgtacactctg

SEQ ID NO: 159508 - DNA, 22 bp, Homo sapiens
tatcacagtgggtgtacaccct

SEQ ID NO: 159509 - DNA, 21 bp, Homo sapiens
tgtgagccagtgatggtggtg

SEQ ID NO: 159510 - DNA, 22 bp, Homo sapiens
cagagcaagacactgtctctgt

SEQ ID NO: 159511 - DNA, 20 bp, Homo sapiens
aggatgagtcgtgttcaaga

SEQ ID NO: 159512 - DNA, 23 bp, Homo sapiens
ttgagacaagagtctcgctctgt

SEQ ID NO: 159513 - DNA, 23 bp, Homo sapiens
cagagtctcgctctgtcacccag

SEQ ID NO: 159514 - DNA, 20 bp, Homo sapiens
tatgcatatatatctataga

SEQ ID NO: 159515 - DNA, 19 bp, Homo sapiens
tatatatagatatgtatac

SEQ ID NO: 159516 - DNA, 23 bp, Homo sapiens
tgacactgcatctgcttctggtg

SEQ ID NO: 159517 - DNA, 23 bp, Homo sapiens
tgacactgcatctgcttctggtg

SEQ ID NO: 159518 - DNA, 23 bp, Homo sapiens
gtgtttacatatagtacatgttc

SEQ ID NO: 159519 - DNA, 23 bp, Homo sapiens
catacatatacatgcagttgtgt

SEQ ID NO: 159520 - DNA, 23 bp, Homo sapiens
gcctgtgacagtctctgtcatat

SEQ ID NO: 159521 - DNA, 23 bp, Homo sapiens
gaaagatagtagaggctctggac

SEQ ID NO: 159522 - DNA, 23 bp, Homo sapiens
gggtgacactggctgttctttct

SEQ ID NO: 159523 - DNA, 23 bp, Homo sapiens
attctcagtggcaatgtagtaac

SEQ ID NO: 159524 - DNA, 23 bp, Homo sapiens
ttgagacagagtcttgctgtgtt

SEQ ID NO: 159525 - DNA, 20 bp, Homo sapiens
gatgaagtcaataatgatgc

SEQ ID NO: 159526 - DNA, 22 bp, Homo sapiens
aaataccatggttttctatctt

SEQ ID NO: 159527 - DNA, 23 bp, Homo sapiens
atgagcagagaatttgttgtttg

SEQ ID NO: 159528 - DNA, 23 bp, Homo sapiens
ttttagtagagacagtttcacca

SEQ ID NO: 159529 - DNA, 23 bp, Homo sapiens
gagacagggtctcgctctgtcac

SEQ ID NO: 159530 - DNA, 19 bp, Homo sapiens
agtctcgctcttgtcatgc

SEQ ID NO: 159531 - DNA, 23 bp, Homo sapiens
ctgtggctctgacactcctgaaa

SEQ ID NO: 159532 - DNA, 20 bp, Homo sapiens
tttgtttccttcagaaattg

SEQ ID NO: 159533 - DNA, 23 bp, Homo sapiens
ccctctctctgcctcagtgtgcc

SEQ ID NO: 159534 - DNA, 22 bp, Homo sapiens
aagtgaggatgacagtggtccc

SEQ ID NO: 159535 - DNA, 19 bp, Homo sapiens
ttgagtgtggcctaagtgt

SEQ ID NO: 159536 - DNA, 23 bp, Homo sapiens
gtgtttccttttggagctgacta

SEQ ID NO: 159537 - DNA, 19 bp, Homo sapiens
agacagagtctcactcttt

SEQ ID NO: 159538 - DNA, 18 bp, Homo sapiens
gagtggagcgatctgtgt

SEQ ID NO: 159539 - DNA, 22 bp, Homo sapiens
tatatacgtgtgtgtgtgtgtg

SEQ ID NO: 159540 - DNA, 18 bp, Homo sapiens
tgggagtgactttggacc

SEQ ID NO: 159541 - DNA, 23 bp, Homo sapiens
gagacagagtctcgttctgtcac

SEQ ID NO: 159542 - DNA, 23 bp, Homo sapiens
gagtctcacactgtcacccaggc

SEQ ID NO: 159543 - DNA, 19 bp, Homo sapiens
taggacctgtgtgaatttg

SEQ ID NO: 159544 - DNA, 22 bp, Homo sapiens
tgagtctccctctgtcacccag

SEQ ID NO: 159545 - DNA, 23 bp, Homo sapiens
tttgagaccgagtctcgctctcg

SEQ ID NO: 159546 - DNA, 23 bp, Homo sapiens
tcctggcactctctgtatctgtc

SEQ ID NO: 159547 - DNA, 18 bp, Homo sapiens
agagttttgaatttcatt

SEQ ID NO: 159548 - DNA, 23 bp, Homo sapiens
taagatggagtctcgctctgtca

SEQ ID NO: 159549 - DNA, 21 bp, Homo sapiens
agtgactgagcaaacagtcct

SEQ ID NO: 159550 - DNA, 23 bp, Homo sapiens
aaacatggtggttaagaactctt

SEQ ID NO: 159551 - DNA, 23 bp, Homo sapiens
tctttctgacagcggtcagtata

SEQ ID NO: 159552 - DNA, 23 bp, Homo sapiens
tctggatctgtcactgtctggca

SEQ ID NO: 159553 - DNA, 20 bp, Homo sapiens
tgtcaggaagtttttttgtt

SEQ ID NO: 159554 - DNA, 18 bp, Homo sapiens
tggctcacaagggggctg

SEQ ID NO: 159555 - DNA, 23 bp, Homo sapiens
tcaaggcctggctctctcacact

SEQ ID NO: 159556 - DNA, 23 bp, Homo sapiens
ctgaggtatgaggatcacttgag

SEQ ID NO: 159557 - DNA, 23 bp, Homo sapiens
aaagagtattcttgtttatctga

SEQ ID NO: 159558 - DNA, 23 bp, Homo sapiens
gacatagtctcactctgtttccc

SEQ ID NO: 159559 - DNA, 23 bp, Homo sapiens
tcatatggttctgtataggaagc

SEQ ID NO: 159560 - DNA, 22 bp, Homo sapiens
tgtcagaagtgagagtggtctt

SEQ ID NO: 159561 - DNA, 20 bp, Homo sapiens
gactgtcctctgactttgtg

SEQ ID NO: 159562 - DNA, 23 bp, Homo sapiens
gggagtctcactctgtcacccag

SEQ ID NO: 159563 - DNA, 23 bp, Homo sapiens
gagacagtctggctctgttgccc

SEQ ID NO: 159564 - DNA, 23 bp, Homo sapiens
gtgacagagtgagtctctgtctc

SEQ ID NO: 159565 - DNA, 20 bp, Homo sapiens
aggatgagtcgtgttcaaga

SEQ ID NO: 159566 - DNA, 21 bp, Homo sapiens
tgagacagagtctcgctctgt

SEQ ID NO: 159567 - DNA, 19 bp, Homo sapiens
tggttttccacttcccaac

SEQ ID NO: 159568 - DNA, 23 bp, Homo sapiens
gtgtttacatatagtacatgttc

SEQ ID NO: 159569 - DNA, 23 bp, Homo sapiens
catacatatacatgcagttgtgt

SEQ ID NO: 159570 - DNA, 23 bp, Homo sapiens
gcctgtgacagtctctgtcatat

SEQ ID NO: 159571 - DNA, 23 bp, Homo sapiens
ggctgaggtaggaggatcacttg

SEQ ID NO: 159572 - DNA, 23 bp, Homo sapiens
aatctctctggaagaatacacaa

SEQ ID NO: 159573 - DNA, 23 bp, Homo sapiens
cgcttgagcctgggagtttgagg

SEQ ID NO: 159574 - DNA, 21 bp, Homo sapiens
agtgactgagcaaacagtcct

SEQ ID NO: 159575 - DNA, 23 bp, Homo sapiens
aaacatggtggttaagaactctt

SEQ ID NO: 159576 - DNA, 23 bp, Homo sapiens
cggagtctcactctgtcacccag

SEQ ID NO: 159577 - DNA, 23 bp, Homo sapiens
cggagtctcactctgtcacccag

SEQ ID NO: 159578 - DNA, 20 bp, Homo sapiens
agacacacatacatattagc

SEQ ID NO: 159579 - DNA, 20 bp, Homo sapiens
atgtatgtagacctaggcat

SEQ ID NO: 159580 - DNA, 23 bp, Homo sapiens
agtctcactctgtcacctaggct

SEQ ID NO: 159581 - DNA, 23 bp, Homo sapiens
ctgtgttcaagtgattctcttga

SEQ ID NO: 159582 - DNA, 23 bp, Homo sapiens
ctcagtctctcaagtagctggga

SEQ ID NO: 159583 - DNA, 21 bp, Homo sapiens
tgtctgtctgctggtcatgtc

SEQ ID NO: 159584 - DNA, 21 bp, Homo sapiens
tgggagagagggaaactggag

SEQ ID NO: 159585 - DNA, 21 bp, Homo sapiens
atgtcacatgagtgtgagcac

SEQ ID NO: 159586 - DNA, 23 bp, Homo sapiens
tggaacatgtagtggagatcctg

SEQ ID NO: 159587 - DNA, 23 bp, Homo sapiens
atcaatagtgtgtacaggcatgc

SEQ ID NO: 159588 - DNA, 20 bp, Homo sapiens
gtatgtatgcatgtgtctgt

SEQ ID NO: 159589 - DNA, 22 bp, Homo sapiens
atgtgtatatacatatgtgtgt

SEQ ID NO: 159590 - DNA, 23 bp, Homo sapiens
atctctttcactgtctctgtcct

SEQ ID NO: 159591 - DNA, 22 bp, Homo sapiens
ttgacacagggtctcactgtgt

SEQ ID NO: 159592 - DNA, 23 bp, Homo sapiens
aatctttgtcttgaaaagatgat

SEQ ID NO: 159593 - DNA, 23 bp, Homo sapiens
tgtgaagaatgtcaatggtagtc

SEQ ID NO: 159594 - DNA, 23 bp, Homo sapiens
tgagtctctctctgtcacccagg

SEQ ID NO: 159595 - DNA, 23 bp, Homo sapiens
gagacggagtctcactctgtcac

SEQ ID NO: 159596 - DNA, 18 bp, Homo sapiens
aagatctagaagttctga

SEQ ID NO: 159597 - DNA, 18 bp, Homo sapiens
attgtgagcttttttttt

SEQ ID NO: 159598 - DNA, 21 bp, Homo sapiens
agacgaagtctcgctctgtcg

SEQ ID NO: 159599 - DNA, 20 bp, Homo sapiens
actcacctgcttgaaacctg

SEQ ID NO: 159600 - DNA, 20 bp, Homo sapiens
atgtgtatatatatatatgt

SEQ ID NO: 159601 - DNA, 23 bp, Homo sapiens
tctctgtctctggatcatgtaag

SEQ ID NO: 159602 - DNA, 18 bp, Homo sapiens
gtggtttgaattactcag

SEQ ID NO: 159603 - DNA, 23 bp, Homo sapiens
aacaaagaatgctttggtttgct

SEQ ID NO: 159604 - DNA, 22 bp, Homo sapiens
ataaagccctttgtttttctgt

SEQ ID NO: 159605 - DNA, 23 bp, Homo sapiens
actgagtctcactctgtcgccca

SEQ ID NO: 159606 - DNA, 21 bp, Homo sapiens
caactgcttggaaatgagaca

SEQ ID NO: 159607 - DNA, 21 bp, Homo sapiens
acacaaagtctcactctgttg

SEQ ID NO: 159608 - DNA, 23 bp, Homo sapiens
tctgtcacagttactcaattctg

SEQ ID NO: 159609 - DNA, 23 bp, Homo sapiens
aaccatagataacagtaattgaa

SEQ ID NO: 159610 - DNA, 21 bp, Homo sapiens
acagtgagctatgattgcagc

SEQ ID NO: 159611 - DNA, 18 bp, Homo sapiens
tgtacgtatgtatgtatg

SEQ ID NO: 159612 - DNA, 23 bp, Homo sapiens
tctgagtctgttactgttatgat

SEQ ID NO: 159613 - DNA, 20 bp, Homo sapiens
aatgctgagtctgggtgttg

SEQ ID NO: 159614 - DNA, 18 bp, Homo sapiens
tttcagtctccagcctgg

SEQ ID NO: 159615 - DNA, 23 bp, Homo sapiens
tgcagtggcatgatcttggctca

SEQ ID NO: 159616 - DNA, 18 bp, Homo sapiens
acaggcatgcatatgtac

SEQ ID NO: 159617 - DNA, 18 bp, Homo sapiens
tgggcaggatgaatgggg

SEQ ID NO: 159618 - DNA, 19 bp, Homo sapiens
agactcaagtgtaatcatt

SEQ ID NO: 159619 - DNA, 23 bp, Homo sapiens
gacagagtctcgctctgtcaccc

SEQ ID NO: 159620 - DNA, 23 bp, Homo sapiens
tgagatggagtctcactctgtca

SEQ ID NO: 159621 - DNA, 19 bp, Homo sapiens
tgactgaggaagggtggta

SEQ ID NO: 159622 - DNA, 23 bp, Homo sapiens
tatgctattgtaaatgatattgt

SEQ ID NO: 159623 - DNA, 23 bp, Homo sapiens
gggtgggtctctgtttctctcca

SEQ ID NO: 159624 - DNA, 18 bp, Homo sapiens
tctctgctctttctgtcc

SEQ ID NO: 159625 - DNA, 23 bp, Homo sapiens
agagtctcactctgtcacccagg

SEQ ID NO: 159626 - DNA, 23 bp, Homo sapiens
gagtctcactctgtcacccaggc

SEQ ID NO: 159627 - DNA, 23 bp, Homo sapiens
tctgactccagagtgtgtgctct

SEQ ID NO: 159628 - DNA, 23 bp, Homo sapiens
gtgtataccctgtgatattattc

SEQ ID NO: 159629 - DNA, 19 bp, Homo sapiens
atcacagtgggtgtacacc

SEQ ID NO: 159630 - DNA, 22 bp, Homo sapiens
gtgagtgtacaccttgtgatat

SEQ ID NO: 159631 - DNA, 23 bp, Homo sapiens
tatcacagtgggtgtacaccatg

SEQ ID NO: 159632 - DNA, 23 bp, Homo sapiens
tgtgtgtacactctgagatatta

SEQ ID NO: 159633 - DNA, 23 bp, Homo sapiens
tatcacagtgggtgtacaccatg

SEQ ID NO: 159634 - DNA, 23 bp, Homo sapiens
atcacagtgggtgtacaacgtgt

SEQ ID NO: 159635 - DNA, 23 bp, Homo sapiens
atcacagtgggtgttcactatgt

SEQ ID NO: 159636 - DNA, 23 bp, Homo sapiens
atgttaacacagtgtgctaactt

SEQ ID NO: 159637 - DNA, 18 bp, Homo sapiens
accctgtgtgttagcact

SEQ ID NO: 159638 - DNA, 20 bp, Homo sapiens
tctctcagttttatgattct

SEQ ID NO: 159639 - DNA, 18 bp, Homo sapiens
gagtagctctgtgtctct

SEQ ID NO: 159640 - DNA, 23 bp, Homo sapiens
cggagcctcactctgtcgctcag

SEQ ID NO: 159641 - DNA, 21 bp, Homo sapiens
tgcttgttgaccagtatttgt

SEQ ID NO: 159642 - DNA, 23 bp, Homo sapiens
ctagagtctcactgtgtcacctg

SEQ ID NO: 159643 - DNA, 23 bp, Homo sapiens
atgtttctcaggctgctttgagc

SEQ ID NO: 159644 - DNA, 23 bp, Homo sapiens
actgagtctcactctgtcgccca

SEQ ID NO: 159645 - DNA, 23 bp, Homo sapiens
acagagtctcagtctgtcaccta

SEQ ID NO: 159646 - DNA, 23 bp, Homo sapiens
tgtgaatcaagtctctgccactc

SEQ ID NO: 159647 - DNA, 19 bp, Homo sapiens
actgcattgaaatcactga

SEQ ID NO: 159648 - DNA, 19 bp, Homo sapiens
agaactaataggatagatg

SEQ ID NO: 159649 - DNA, 20 bp, Homo sapiens
agtagatctagagtgggcat

SEQ ID NO: 159650 - DNA, 23 bp, Homo sapiens
agtgcagcagtgtgaacacttgg

SEQ ID NO: 159651 - DNA, 19 bp, Homo sapiens
gtgagccactgtgcctggc

SEQ ID NO: 159652 - DNA, 22 bp, Homo sapiens
actctgtcacacagattggagt

SEQ ID NO: 159653 - DNA, 23 bp, Homo sapiens
tatgtgtatatatatatgtgtgt

SEQ ID NO: 159654 - DNA, 19 bp, Homo sapiens
tatcctggaacttagagta

SEQ ID NO: 159655 - DNA, 21 bp, Homo sapiens
acatgtgcacaatgtgcaggt

SEQ ID NO: 159656 - DNA, 23 bp, Homo sapiens
tgagttcattgtagattctggat

SEQ ID NO: 159657 - DNA, 23 bp, Homo sapiens
tgagttcattgtagattctggat

SEQ ID NO: 159658 - DNA, 22 bp, Homo sapiens
ttttgctgccagcatgttgaaa

SEQ ID NO: 159659 - DNA, 23 bp, Homo sapiens
tgactcagagtctttctctgtca

SEQ ID NO: 159660 - DNA, 20 bp, Homo sapiens
cacgacacactgactgtctc

SEQ ID NO: 159661 - DNA, 23 bp, Homo sapiens
aagtgccaggcatttgagttaga

SEQ ID NO: 159662 - DNA, 20 bp, Homo sapiens
acaccttcttcctgattcca

SEQ ID NO: 159663 - DNA, 21 bp, Homo sapiens
acagaggctcgctctgtcgct

SEQ ID NO: 159664 - DNA, 21 bp, Homo sapiens
ggcagagtgagactctgtctc

SEQ ID NO: 159665 - DNA, 21 bp, Homo sapiens
tgagacagagtctcgctctgt

SEQ ID NO: 159666 - DNA, 22 bp, Homo sapiens
tagcagctgcaggagcaagtga

SEQ ID NO: 159667 - DNA, 23 bp, Homo sapiens
ttgagagggagttttgcttttgt

SEQ ID NO: 159668 - DNA, 23 bp, Homo sapiens
acagatgccagacacattcttct

SEQ ID NO: 159669 - DNA, 22 bp, Homo sapiens
tcttgagatggagtcttgctct

SEQ ID NO: 159670 - DNA, 23 bp, Homo sapiens
ggtgacagtgagacactgtctca

SEQ ID NO: 159671 - DNA, 23 bp, Homo sapiens
gagacggagtctcactctgtcac

SEQ ID NO: 159672 - DNA, 23 bp, Homo sapiens
ggagtctcactctgtcacccagg

SEQ ID NO: 159673 - DNA, 23 bp, Homo sapiens
ttggctcactgaaacctctgcct

SEQ ID NO: 159674 - DNA, 20 bp, Homo sapiens
aaaactgcagaaactggaga

SEQ ID NO: 159675 - DNA, 23 bp, Homo sapiens
tatgtatgtgtatgtatatatgt

SEQ ID NO: 159676 - DNA, 19 bp, Homo sapiens
tgagatggagtctcactct

SEQ ID NO: 159677 - DNA, 21 bp, Homo sapiens
tttattgttgagtagcattcc

SEQ ID NO: 159678 - DNA, 21 bp, Homo sapiens
tatgtgtgtgtatatatacac

SEQ ID NO: 159679 - DNA, 23 bp, Homo sapiens
tgagttcattgtagattctggat

SEQ ID NO: 159680 - DNA, 23 bp, Homo sapiens
tgagttcattgtagattctggat

SEQ ID NO: 159681 - DNA, 21 bp, Homo sapiens
aatgtgggtgccatttgtgat

SEQ ID NO: 159682 - DNA, 22 bp, Homo sapiens
ttcacatacaaatagaaaatga

SEQ ID NO: 159683 - DNA, 20 bp, Homo sapiens
atagtattgaagttctccgt

SEQ ID NO: 159684 - DNA, 23 bp, Homo sapiens
atctgcttcatctggtctctgtc

SEQ ID NO: 159685 - DNA, 21 bp, Homo sapiens
tatccattagtaatatatatg

SEQ ID NO: 159686 - DNA, 19 bp, Homo sapiens
aatggatatatattgaata

SEQ ID NO: 159687 - DNA, 22 bp, Homo sapiens
ctcagtcactcagagttcttgg

SEQ ID NO: 159688 - DNA, 23 bp, Homo sapiens
tgtgtgtatgtatatatgtatgt

SEQ ID NO: 159689 - DNA, 20 bp, Homo sapiens
gataaatgtatatatgtata

SEQ ID NO: 159690 - DNA, 23 bp, Homo sapiens
tgagttcattgtagattctggat

SEQ ID NO: 159691 - DNA, 23 bp, Homo sapiens
tgagttcattgtagattctggat

SEQ ID NO: 159692 - DNA, 21 bp, Homo sapiens
tgcctgtctcccattgtcgct

SEQ ID NO: 159693 - DNA, 23 bp, Homo sapiens
gatggagtctcactctgtcaccc

SEQ ID NO: 159694 - DNA, 23 bp, Homo sapiens
agtgacagaatgagaccctgtct

SEQ ID NO: 159695 - DNA, 19 bp, Homo sapiens
tttgtggttcaggaaacct

SEQ ID NO: 159696 - DNA, 23 bp, Homo sapiens
gacagagtctcgctctgtcaccc

SEQ ID NO: 159697 - DNA, 20 bp, Homo sapiens
cgtatatatatatgtgtata

SEQ ID NO: 159698 - DNA, 22 bp, Homo sapiens
tatatgtgtgtatatatatacg

SEQ ID NO: 159699 - DNA, 23 bp, Homo sapiens
tgtgtatatatacacgtatacgt

SEQ ID NO: 159700 - DNA, 23 bp, Homo sapiens
taagatggagtctcgctctgtca

SEQ ID NO: 159701 - DNA, 23 bp, Homo sapiens
ggtagagacagtacagagagtgg

SEQ ID NO: 159702 - DNA, 21 bp, Homo sapiens
tgccacgctccctgggtccct

SEQ ID NO: 159703 - DNA, 23 bp, Homo sapiens
actgaattagtattgtattactg

SEQ ID NO: 159704 - DNA, 23 bp, Homo sapiens
tatattgttagattctatttgaa

SEQ ID NO: 159705 - DNA, 23 bp, Homo sapiens
atgaaaaactgaatctcattacc

SEQ ID NO: 159706 - DNA, 21 bp, Homo sapiens
tgataaactgaattctatact

SEQ ID NO: 159707 - DNA, 23 bp, Homo sapiens
agatggagtctcactctgtcatc

SEQ ID NO: 159708 - DNA, 23 bp, Homo sapiens
tacagagactgacttgaggtttt

SEQ ID NO: 159709 - DNA, 23 bp, Homo sapiens
tgagacagagtctcgctctgttg

SEQ ID NO: 159710 - DNA, 22 bp, Homo sapiens
tgtttgggagaacatggtaagt

SEQ ID NO: 159711 - DNA, 21 bp, Homo sapiens
gtgagcctctgtgtcctgata

SEQ ID NO: 159712 - DNA, 19 bp, Homo sapiens
tatttaactttacgttctg

SEQ ID NO: 159713 - DNA, 23 bp, Homo sapiens
cggagtctcgctctgtctcccag

SEQ ID NO: 159714 - DNA, 23 bp, Homo sapiens
tgaagacagagaggactgttcag

SEQ ID NO: 159715 - DNA, 18 bp, Homo sapiens
atgtgtgtgtatatatgt

SEQ ID NO: 159716 - DNA, 19 bp, Homo sapiens
aagcaactatatatcatac

SEQ ID NO: 159717 - DNA, 18 bp, Homo sapiens
ctatatatcatatagttg

SEQ ID NO: 159718 - DNA, 23 bp, Homo sapiens
tctgtgcctcagtgtcttcatcc

SEQ ID NO: 159719 - DNA, 20 bp, Homo sapiens
aatcagggttttgttggcat

SEQ ID NO: 159720 - DNA, 23 bp, Homo sapiens
atgtatatgtatgtatatatgtg

SEQ ID NO: 159721 - DNA, 20 bp, Homo sapiens
cacagctcagtaggtctcag

SEQ ID NO: 159722 - DNA, 23 bp, Homo sapiens
aagagactggaatacttagagca

SEQ ID NO: 159723 - DNA, 18 bp, Homo sapiens
tgcagtgtcgtgatcttg

SEQ ID NO: 159724 - DNA, 23 bp, Homo sapiens
agacagtctcgctctgtcacccg

SEQ ID NO: 159725 - DNA, 23 bp, Homo sapiens
tctgtgcctgagttgctccatct

SEQ ID NO: 159726 - DNA, 23 bp, Homo sapiens
agcaaactgctgtgggtgctgga

SEQ ID NO: 159727 - DNA, 23 bp, Homo sapiens
gtctctccgtgtgtctcacacag

SEQ ID NO: 159728 - DNA, 23 bp, Homo sapiens
ggtgacagagtgagactcagtct

SEQ ID NO: 159729 - DNA, 23 bp, Homo sapiens
agtttttgagacggagtcttgtt

SEQ ID NO: 159730 - DNA, 23 bp, Homo sapiens
agagagatgtgactgtgctcctc

SEQ ID NO: 159731 - DNA, 23 bp, Homo sapiens
acagagtctcactctgtcgccca

SEQ ID NO: 159732 - DNA, 23 bp, Homo sapiens
cctgtgtgtctgtgaccctgtgc

SEQ ID NO: 159733 - DNA, 23 bp, Homo sapiens
tctctctctgtgaccctgggtgc

SEQ ID NO: 159734 - DNA, 20 bp, Homo sapiens
aggatcaggagcaggagaga

SEQ ID NO: 159735 - DNA, 23 bp, Homo sapiens
tggagtctcactctgtggctcag

SEQ ID NO: 159736 - DNA, 19 bp, Homo sapiens
ctcaactcactgtaacctc

SEQ ID NO: 159737 - DNA, 23 bp, Homo sapiens
ctgtgaccctcagtgtaaaccat

SEQ ID NO: 159738 - DNA, 23 bp, Homo sapiens
cggagtctcgctctgtctcccag

SEQ ID NO: 159739 - DNA, 23 bp, Homo sapiens
gtcagcacacagtcagcactcca

SEQ ID NO: 159740 - DNA, 21 bp, Homo sapiens
cacagtgagactctgtctcta

SEQ ID NO: 159741 - DNA, 18 bp, Homo sapiens
aaaagatagggtagctta

SEQ ID NO: 159742 - DNA, 22 bp, Homo sapiens
tgtgtgtgtatgtgtgtctata

SEQ ID NO: 159743 - DNA, 23 bp, Homo sapiens
tatgtctatatatatataggtct

SEQ ID NO: 159744 - DNA, 22 bp, Homo sapiens
atataggtctatattggtctat

SEQ ID NO: 159745 - DNA, 23 bp, Homo sapiens
atatatgtctatatatataggtc

SEQ ID NO: 159746 - DNA, 21 bp, Homo sapiens
tatgtctatatatataggtct

SEQ ID NO: 159747 - DNA, 21 bp, Homo sapiens
atagtctatgtataggcctat

SEQ ID NO: 159748 - DNA, 23 bp, Homo sapiens
gggtctcactctgtcacccaggc

SEQ ID NO: 159749 - DNA, 23 bp, Homo sapiens
tgcagtggcatgatcttggctca

SEQ ID NO: 159750 - DNA, 23 bp, Homo sapiens
gggtctcactctgtcacccaggc

SEQ ID NO: 159751 - DNA, 20 bp, Homo sapiens
tgcagtggcatgatcttggc

SEQ ID NO: 159752 - DNA, 23 bp, Homo sapiens
ttccaggagctcactgtgtgttt

SEQ ID NO: 159753 - DNA, 23 bp, Homo sapiens
gagatggagtttcgttcttgttg

SEQ ID NO: 159754 - DNA, 23 bp, Homo sapiens
ggagactcactctgtcactcagg

SEQ ID NO: 159755 - DNA, 23 bp, Homo sapiens
ttgtggctgcctctgtcactcag

SEQ ID NO: 159756 - DNA, 18 bp, Homo sapiens
aggttatggttactttgt

SEQ ID NO: 159757 - DNA, 20 bp, Homo sapiens
tgagacagagtctggctctc

SEQ ID NO: 159758 - DNA, 23 bp, Homo sapiens
atggaatacagtctgtttttcct

SEQ ID NO: 159759 - DNA, 21 bp, Homo sapiens
attctcacggatctttggtgc

SEQ ID NO: 159760 - DNA, 20 bp, Homo sapiens
ggtctcactctgtcgctcag

SEQ ID NO: 159761 - DNA, 18 bp, Homo sapiens
tgtcatcatggctcattg

SEQ ID NO: 159762 - DNA, 23 bp, Homo sapiens
ggctctgtgcgtgactcattgac

SEQ ID NO: 159763 - DNA, 23 bp, Homo sapiens
actggggctcagatttctctgtc

SEQ ID NO: 159764 - DNA, 23 bp, Homo sapiens
gacagagtttcgctcttgtttga

SEQ ID NO: 159765 - DNA, 23 bp, Homo sapiens
aaacatatgtttttcatatgtgt

SEQ ID NO: 159766 - DNA, 22 bp, Homo sapiens
agtggtagaatgttgtaatgtt

SEQ ID NO: 159767 - DNA, 23 bp, Homo sapiens
accggctgttatacttctttgtg

SEQ ID NO: 159768 - DNA, 23 bp, Homo sapiens
gagagagtctcactctgtcgccc

SEQ ID NO: 159769 - DNA, 23 bp, Homo sapiens
ctgagtctcgctctgtcacccag

SEQ ID NO: 159770 - DNA, 23 bp, Homo sapiens
tactccctcaggtactggagact

SEQ ID NO: 159771 - DNA, 21 bp, Homo sapiens
ggcgtctctctgtccctgtcc

SEQ ID NO: 159772 - DNA, 23 bp, Homo sapiens
acagagtctcactctgtcgccca

SEQ ID NO: 159773 - DNA, 23 bp, Homo sapiens
ggagactcactctgtcactcagg

SEQ ID NO: 159774 - DNA, 19 bp, Homo sapiens
gcctgtagtctcagctgct

SEQ ID NO: 159775 - DNA, 23 bp, Homo sapiens
tcagactcacaagtagctgggat

SEQ ID NO: 159776 - DNA, 20 bp, Homo sapiens
tgtgtatatatgtatatatg

SEQ ID NO: 159777 - DNA, 22 bp, Homo sapiens
tatgtatatatgtatatatgta

SEQ ID NO: 159778 - DNA, 21 bp, Homo sapiens
ggctgagtgagtgcctggctc

SEQ ID NO: 159779 - DNA, 22 bp, Homo sapiens
ggtctcactctgtcacccaggc

SEQ ID NO: 159780 - DNA, 23 bp, Homo sapiens
attcctgtaactgcagctacttg

SEQ ID NO: 159781 - DNA, 22 bp, Homo sapiens
ctgaggtaagaggatcacttga

SEQ ID NO: 159782 - DNA, 23 bp, Homo sapiens
tgactctttttctgtgtccttga

SEQ ID NO: 159783 - DNA, 22 bp, Homo sapiens
cagacacacacaggagagattt

SEQ ID NO: 159784 - DNA, 22 bp, Homo sapiens
aggggctctctctctgccacag

SEQ ID NO: 159785 - DNA, 23 bp, Homo sapiens
atccagttagtcagcaaatcctg

SEQ ID NO: 159786 - DNA, 22 bp, Homo sapiens
catgacacacaatcttttttct

SEQ ID NO: 159787 - DNA, 23 bp, Homo sapiens
tgagacagtcttgctctgtcacc

SEQ ID NO: 159788 - DNA, 18 bp, Homo sapiens
tgcaggagagactctttt

SEQ ID NO: 159789 - DNA, 23 bp, Homo sapiens
agatggagtctcgctctgtcacc

SEQ ID NO: 159790 - DNA, 23 bp, Homo sapiens
gagacagagtctcgctctgtcac

SEQ ID NO: 159791 - DNA, 23 bp, Homo sapiens
ctgtcactctcatacactcagct

SEQ ID NO: 159792 - DNA, 22 bp, Homo sapiens
agtcactgtggtaatgaccggc

SEQ ID NO: 159793 - DNA, 23 bp, Homo sapiens
tcagaggctcactcagtggctgt

SEQ ID NO: 159794 - DNA, 23 bp, Homo sapiens
ttttgagacggtgtcttgctctg

SEQ ID NO: 159795 - DNA, 21 bp, Homo sapiens
tgtgctccaatatgatgtttt

SEQ ID NO: 159796 - DNA, 21 bp, Homo sapiens
aaagcacacagtgagcacaca

SEQ ID NO: 159797 - DNA, 19 bp, Homo sapiens
ccgaggaggcttcattccc

SEQ ID NO: 159798 - DNA, 23 bp, Homo sapiens
tttttgttttgagacggagtctt

SEQ ID NO: 159799 - DNA, 23 bp, Homo sapiens
cctgagtgagtctgtttcttgta

SEQ ID NO: 159800 - DNA, 23 bp, Homo sapiens
tctgtctccttctctcacagcta

SEQ ID NO: 159801 - DNA, 23 bp, Homo sapiens
acctcacactcactcactgccag

SEQ ID NO: 159802 - DNA, 23 bp, Homo sapiens
tgtgtgcctgtgcatctgtgtgc

SEQ ID NO: 159803 - DNA, 23 bp, Homo sapiens
gcctgtgtgtgtgcgtgtctgtg

SEQ ID NO: 159804 - DNA, 19 bp, Homo sapiens
tgtgtgtgcatgtgcatgt

SEQ ID NO: 159805 - DNA, 23 bp, Homo sapiens
tcctcagtctgtctgaatgtgtg

SEQ ID NO: 159806 - DNA, 21 bp, Homo sapiens
actgccctagacactgccaca

SEQ ID NO: 159807 - DNA, 19 bp, Homo sapiens
actctgtcattggctgact

SEQ ID NO: 159808 - DNA, 23 bp, Homo sapiens
tgtcattgtctctgactctgtcg

SEQ ID NO: 159809 - DNA, 23 bp, Homo sapiens
tgtcgttgtctctgactctgtcg

SEQ ID NO: 159810 - DNA, 23 bp, Homo sapiens
cctggctccctctctccatctgt

SEQ ID NO: 159811 - DNA, 22 bp, Homo sapiens
tctgtgtctgtgacttgtctcc

SEQ ID NO: 159812 - DNA, 23 bp, Homo sapiens
agaagtctcactcagtgtcaccc

SEQ ID NO: 159813 - DNA, 21 bp, Homo sapiens
agaggttggaggatcacttga

SEQ ID NO: 159814 - DNA, 22 bp, Homo sapiens
ttttgagatggagacttgctct

SEQ ID NO: 159815 - DNA, 22 bp, Homo sapiens
tttgagacagggtctctctctg

SEQ ID NO: 159816 - DNA, 19 bp, Homo sapiens
gtctccctctgtccctcag

SEQ ID NO: 159817 - DNA, 23 bp, Homo sapiens
agacagagtcttgctctgtcacc

SEQ ID NO: 159818 - DNA, 23 bp, Homo sapiens
cggagtctcgctctgtcgctcag

SEQ ID NO: 159819 - DNA, 23 bp, Homo sapiens
gggttctctctgagtctgtgggg

SEQ ID NO: 159820 - DNA, 23 bp, Homo sapiens
actatgtgtgcatgtggatgtgt

SEQ ID NO: 159821 - DNA, 21 bp, Homo sapiens
aatgtgcatgcgcaagtgtgt

SEQ ID NO: 159822 - DNA, 22 bp, Homo sapiens
gtgtgtgtacatgtggatgtgt

SEQ ID NO: 159823 - DNA, 23 bp, Homo sapiens
gggtctcactctgtcacccaggc

SEQ ID NO: 159824 - DNA, 23 bp, Homo sapiens
tggagtctcactctgtcacccag

SEQ ID NO: 159825 - DNA, 23 bp, Homo sapiens
tttcactctgaggttttcttctg

SEQ ID NO: 159826 - DNA, 23 bp, Homo sapiens
gagacagagtctctctctgtcgc

SEQ ID NO: 159827 - DNA, 21 bp, Homo sapiens
tcaaacaagaagaaggaggaa

SEQ ID NO: 159828 - DNA, 21 bp, Homo sapiens
tctcactctgcttctctgagc

SEQ ID NO: 159829 - DNA, 23 bp, Homo sapiens
aggtctcactctgtcgctctgtc

SEQ ID NO: 159830 - DNA, 21 bp, Homo sapiens
gagtgcagtggcacgatcttg

SEQ ID NO: 159831 - DNA, 23 bp, Homo sapiens
cagagtctcactctgtcgctcag

SEQ ID NO: 159832 - DNA, 18 bp, Homo sapiens
acagtggtgcgatctctg

SEQ ID NO: 159833 - DNA, 23 bp, Homo sapiens
gagtctcactctgtcacccaggc

SEQ ID NO: 159834 - DNA, 23 bp, Homo sapiens
tggagtctcactctgtcacccag

SEQ ID NO: 159835 - DNA, 23 bp, Homo sapiens
gattagaatgtggtgctctctct

SEQ ID NO: 159836 - DNA, 23 bp, Homo sapiens
agtctcacactgtcacccaggct

SEQ ID NO: 159837 - DNA, 23 bp, Homo sapiens
ctctgtcccttcaggaacagttt

SEQ ID NO: 159838 - DNA, 23 bp, Homo sapiens
ggctgaggtaggaggatcacttg

SEQ ID NO: 159839 - DNA, 20 bp, Homo sapiens
tatctctcccagaatggagt

SEQ ID NO: 159840 - DNA, 23 bp, Homo sapiens
agacccagtctcactctgtcacc

SEQ ID NO: 159841 - DNA, 23 bp, Homo sapiens
agactgtgtctcactctgtcgcc

SEQ ID NO: 159842 - DNA, 23 bp, Homo sapiens
gggtctcactctgtcacccagac

SEQ ID NO: 159843 - DNA, 19 bp, Homo sapiens
gcaatggtgtgatcttggc

SEQ ID NO: 159844 - DNA, 22 bp, Homo sapiens
ctccctggctctgtgcctctca

SEQ ID NO: 159845 - DNA, 21 bp, Homo sapiens
cctagttagctgtattcacag

SEQ ID NO: 159846 - DNA, 23 bp, Homo sapiens
tcagcttgtgcatgaggaagtct

SEQ ID NO: 159847 - DNA, 23 bp, Homo sapiens
ttgaagagatgttgatcaaagga

SEQ ID NO: 159848 - DNA, 23 bp, Homo sapiens
agacagagtctcgctctgtcacc

SEQ ID NO: 159849 - DNA, 23 bp, Homo sapiens
ctggctctcactgactgcccgtg

SEQ ID NO: 159850 - DNA, 23 bp, Homo sapiens
agtctgtctctctctaacttgtc

SEQ ID NO: 159851 - DNA, 23 bp, Homo sapiens
tatatgtatgtatgtatgtaagt

SEQ ID NO: 159852 - DNA, 23 bp, Homo sapiens
cagagtctcgctctgtcacccag

SEQ ID NO: 159853 - DNA, 23 bp, Homo sapiens
gatggagtctcactctgtcaccc

SEQ ID NO: 159854 - DNA, 23 bp, Homo sapiens
acagtgtctcactctgtgctcca

SEQ ID NO: 159855 - DNA, 23 bp, Homo sapiens
tgtctctgagcctcagtatccgg

SEQ ID NO: 159856 - DNA, 23 bp, Homo sapiens
acagagtctcactctgtcaccca

SEQ ID NO: 159857 - DNA, 22 bp, Homo sapiens
agtcaccccagtgcttttgtct

SEQ ID NO: 159858 - DNA, 23 bp, Homo sapiens
tgtgggtctgactgccccagctt

SEQ ID NO: 159859 - DNA, 23 bp, Homo sapiens
ctgcttcagcaactgcagctgct

SEQ ID NO: 159860 - DNA, 23 bp, Homo sapiens
agtgtctgggtccctgagagcgt

SEQ ID NO: 159861 - DNA, 18 bp, Homo sapiens
acagggattcaaacactt

SEQ ID NO: 159862 - DNA, 23 bp, Homo sapiens
actatctctgtcacatactaggt

SEQ ID NO: 159863 - DNA, 23 bp, Homo sapiens
cagcagtcagtctcacagcctct

SEQ ID NO: 159864 - DNA, 18 bp, Homo sapiens
agagctgagtcacctgtt

SEQ ID NO: 159865 - DNA, 23 bp, Homo sapiens
gacagagtctcactctgtcaccc

SEQ ID NO: 159866 - DNA, 23 bp, Homo sapiens
agagtctcactctgtcacccagg

SEQ ID NO: 159867 - DNA, 23 bp, Homo sapiens
agaacaattactgcagtcgctgt

SEQ ID NO: 159868 - DNA, 19 bp, Homo sapiens
tcacaggcatacagatgtg

SEQ ID NO: 159869 - DNA, 18 bp, Homo sapiens
atgtgtatatgtatatgt

SEQ ID NO: 159870 - DNA, 23 bp, Homo sapiens
gtatatgtatgtgcatatgtgtg

SEQ ID NO: 159871 - DNA, 23 bp, Homo sapiens
tcactcagtccctgagtgcctat

SEQ ID NO: 159872 - DNA, 18 bp, Homo sapiens
tgtactgtcgaagttgat

SEQ ID NO: 159873 - DNA, 21 bp, Homo sapiens
aatgatggagctgtgattcat

SEQ ID NO: 159874 - DNA, 20 bp, Homo sapiens
tacatctctccttatgtggg

SEQ ID NO: 159875 - DNA, 22 bp, Homo sapiens
ataaggttctagaaggtgagct

SEQ ID NO: 159876 - DNA, 23 bp, Homo sapiens
taactctgtattctttgactgtg

SEQ ID NO: 159877 - DNA, 23 bp, Homo sapiens
tccaacttgaacagtttgggtga

SEQ ID NO: 159878 - DNA, 23 bp, Homo sapiens
gatggagtctcactctgtcaccc

SEQ ID NO: 159879 - DNA, 23 bp, Homo sapiens
agactgcctcagtcccagcttca

SEQ ID NO: 159880 - DNA, 23 bp, Homo sapiens
ttttctcactgtgtctcagtatc

SEQ ID NO: 159881 - DNA, 23 bp, Homo sapiens
cggtctcagtctcagtctctgtg

SEQ ID NO: 159882 - DNA, 22 bp, Homo sapiens
ttaggtggtggtataaaagtgt

SEQ ID NO: 159883 - DNA, 20 bp, Homo sapiens
atgttgtatgattttatgta

SEQ ID NO: 159884 - DNA, 23 bp, Homo sapiens
agcgtgtgtgtgtgtctgtctgt

SEQ ID NO: 159885 - DNA, 22 bp, Homo sapiens
tctcacacagcgttggaattgt

SEQ ID NO: 159886 - DNA, 19 bp, Homo sapiens
tgggagtcagtcacactga

SEQ ID NO: 159887 - DNA, 20 bp, Homo sapiens
atggtccaggatgaagccaa

SEQ ID NO: 159888 - DNA, 23 bp, Homo sapiens
tcagagtctcgcactgtcacccg

SEQ ID NO: 159889 - DNA, 23 bp, Homo sapiens
tgtctctgtgtctgcgtgtctgt

SEQ ID NO: 159890 - DNA, 20 bp, Homo sapiens
tgcccgggactttggacagt

SEQ ID NO: 159891 - DNA, 23 bp, Homo sapiens
ccctcacagcctcactctgtctg

SEQ ID NO: 159892 - DNA, 23 bp, Homo sapiens
tgcctgggtccctctgtgcctaa

SEQ ID NO: 159893 - DNA, 23 bp, Homo sapiens
agtgcgtgcatgggtgcgtgtct

SEQ ID NO: 159894 - DNA, 18 bp, Homo sapiens
tatatacatgtatatgta

SEQ ID NO: 159895 - DNA, 23 bp, Homo sapiens
tatatacatgtatatgtatacat

SEQ ID NO: 159896 - DNA, 22 bp, Homo sapiens
tatacatgtatatgtatacata

SEQ ID NO: 159897 - DNA, 23 bp, Homo sapiens
tatacatgtatatgtatacatgt

SEQ ID NO: 159898 - DNA, 23 bp, Homo sapiens
ttctgcaattgttctatttcact

SEQ ID NO: 159899 - DNA, 23 bp, Homo sapiens
aatctctgtctttatcactgtgc

SEQ ID NO: 159900 - DNA, 23 bp, Homo sapiens
tgcaatcatagctcactgtggcc

SEQ ID NO: 159901 - DNA, 23 bp, Homo sapiens
tgaggtaggaggatcacttgaac

SEQ ID NO: 159902 - DNA, 23 bp, Homo sapiens
tttgagaccaagtctcactctgt

SEQ ID NO: 159903 - DNA, 23 bp, Homo sapiens
actctctgagtgaccttaggcaa

SEQ ID NO: 159904 - DNA, 23 bp, Homo sapiens
tgtgtatatatatatgtgtatgc

SEQ ID NO: 159905 - DNA, 21 bp, Homo sapiens
agtgaggatgagtaagatgtg

SEQ ID NO: 159906 - DNA, 23 bp, Homo sapiens
tcactcactctgtggcactcttc

SEQ ID NO: 159907 - DNA, 20 bp, Homo sapiens
tgtgtgtgtgtgtatattat

SEQ ID NO: 159908 - DNA, 22 bp, Homo sapiens
tgtgtgtacatatatgtgtgtg

SEQ ID NO: 159909 - DNA, 22 bp, Homo sapiens
atgtgtatatatctatatatgt

SEQ ID NO: 159910 - DNA, 23 bp, Homo sapiens
tatatgtgcatgtgtgtgtgtgt

SEQ ID NO: 159911 - DNA, 23 bp, Homo sapiens
tgagtccctgagtgactgtgtgg

SEQ ID NO: 159912 - DNA, 23 bp, Homo sapiens
aggagtgtgaagtgcctgaggac

SEQ ID NO: 159913 - DNA, 19 bp, Homo sapiens
attgatcatcttttggtag

SEQ ID NO: 159914 - DNA, 23 bp, Homo sapiens
tgagatggagtctcactctgtca

SEQ ID NO: 159915 - DNA, 23 bp, Homo sapiens
agtctcacactgtcacccaggct

SEQ ID NO: 159916 - DNA, 23 bp, Homo sapiens
ggttcaggtgtttctcctgcctc

SEQ ID NO: 159917 - DNA, 23 bp, Homo sapiens
ttcaacaggtccacgaagaaccc

SEQ ID NO: 159918 - DNA, 19 bp, Homo sapiens
atgtagatatatatgtgtg

SEQ ID NO: 159919 - DNA, 23 bp, Homo sapiens
agagtctcactctgtcatccagg

SEQ ID NO: 159920 - DNA, 20 bp, Homo sapiens
tgtagtcaccatcttacttt

SEQ ID NO: 159921 - DNA, 19 bp, Homo sapiens
actctgtctcaaaaaatcc

SEQ ID NO: 159922 - DNA, 23 bp, Homo sapiens
aaggcagtagaatgtgaggactc

SEQ ID NO: 159923 - DNA, 19 bp, Homo sapiens
atcaccctgctgcttctgc

SEQ ID NO: 159924 - DNA, 23 bp, Homo sapiens
tctctctcagaggcacagttgtg

SEQ ID NO: 159925 - DNA, 23 bp, Homo sapiens
tctgtctgtctgtctggctggct

SEQ ID NO: 159926 - DNA, 23 bp, Homo sapiens
acacacactcactccctggagag

SEQ ID NO: 159927 - DNA, 22 bp, Homo sapiens
cctttaggagagattttgttgt

SEQ ID NO: 159928 - DNA, 21 bp, Homo sapiens
agcaatctaatgtacttttat

SEQ ID NO: 159929 - DNA, 23 bp, Homo sapiens
aaaagttctgtttttcttgtaga

SEQ ID NO: 159930 - DNA, 23 bp, Homo sapiens
gtctgtctctgtggcttgcatat

SEQ ID NO: 159931 - DNA, 21 bp, Homo sapiens
taagttctaaagtatagtgaa

SEQ ID NO: 159932 - DNA, 21 bp, Homo sapiens
aaaattgtgcaactgctacgg

SEQ ID NO: 159933 - DNA, 23 bp, Homo sapiens
agtctggctctgtctgactgtgg

SEQ ID NO: 159934 - DNA, 23 bp, Homo sapiens
tgagttcattgtagattctggat

SEQ ID NO: 159935 - DNA, 23 bp, Homo sapiens
tgagttcattgtagattctggat

SEQ ID NO: 159936 - DNA, 23 bp, Homo sapiens
acagagtctcgctgtgtcactca

SEQ ID NO: 159937 - DNA, 23 bp, Homo sapiens
taatgtgtatttgttattcacac

SEQ ID NO: 159938 - DNA, 23 bp, Homo sapiens
caggactcactctctcactggct

SEQ ID NO: 159939 - DNA, 23 bp, Homo sapiens
ctcactctgtggctctgtgtacc

SEQ ID NO: 159940 - DNA, 23 bp, Homo sapiens
tcacagatgctcacactgccggt

SEQ ID NO: 159941 - DNA, 23 bp, Homo sapiens
tgagttcattgtagattctggat

SEQ ID NO: 159942 - DNA, 23 bp, Homo sapiens
tgagttcattgtagattctggat

SEQ ID NO: 159943 - DNA, 21 bp, Homo sapiens
agattggatctgttatcagtt

SEQ ID NO: 159944 - DNA, 23 bp, Homo sapiens
gagctaggaactgagatacaaag

SEQ ID NO: 159945 - DNA, 20 bp, Homo sapiens
agaggtttcaagaatggggt

SEQ ID NO: 159946 - DNA, 23 bp, Homo sapiens
ctctgtctgtgtgtctgtctgtg

SEQ ID NO: 159947 - DNA, 21 bp, Homo sapiens
atctgacaggagacagagctc

SEQ ID NO: 159948 - DNA, 23 bp, Homo sapiens
cggagtctcactctgtcacccag

SEQ ID NO: 159949 - DNA, 19 bp, Homo sapiens
ttgaggctacagtgtacca

SEQ ID NO: 159950 - DNA, 23 bp, Homo sapiens
gtgtgtgtatatgtatttatgta

SEQ ID NO: 159951 - DNA, 23 bp, Homo sapiens
gagatgatatctcactgtggttt

SEQ ID NO: 159952 - DNA, 22 bp, Homo sapiens
atacgtatatatacgtgtgtgt

SEQ ID NO: 159953 - DNA, 20 bp, Homo sapiens
tatatacgtatatatacgta

SEQ ID NO: 159954 - DNA, 19 bp, Homo sapiens
tatacgtatatatacgtat

SEQ ID NO: 159955 - DNA, 19 bp, Homo sapiens
tatacgtatatatacgtat

SEQ ID NO: 159956 - DNA, 23 bp, Homo sapiens
tatacgtatatatacgtgtgtgt

SEQ ID NO: 159957 - DNA, 23 bp, Homo sapiens
tatacgtatatatacgtatgtgt

SEQ ID NO: 159958 - DNA, 23 bp, Homo sapiens
tatacgtatatatacgtatgtgt

SEQ ID NO: 159959 - DNA, 23 bp, Homo sapiens
tatacgtatatatacgtatgtgt

SEQ ID NO: 159960 - DNA, 23 bp, Homo sapiens
tatacgtatatatacgtatgtgt

SEQ ID NO: 159961 - DNA, 23 bp, Homo sapiens
caatccgactgaggtaggggtgt

SEQ ID NO: 159962 - DNA, 23 bp, Homo sapiens
tgagttcattgtagattctggat

SEQ ID NO: 159963 - DNA, 23 bp, Homo sapiens
tgagttcattgtagattctggat

SEQ ID NO: 159964 - DNA, 23 bp, Homo sapiens
tattttgtagatatactagaagt

SEQ ID NO: 159965 - DNA, 23 bp, Homo sapiens
ttctgtatatcatgttgcaatga

SEQ ID NO: 159966 - DNA, 22 bp, Homo sapiens
tttctctgtctcagttatttaa

SEQ ID NO: 159967 - DNA, 23 bp, Homo sapiens
tatgagagaggtaaagattatct

SEQ ID NO: 159968 - DNA, 23 bp, Homo sapiens
atatgtgtatatatatgtgtgtg

SEQ ID NO: 159969 - DNA, 20 bp, Homo sapiens
gtataaatatatgtgtgtgt

SEQ ID NO: 159970 - DNA, 23 bp, Homo sapiens
ttttaagttggatatcttgggct

SEQ ID NO: 159971 - DNA, 18 bp, Homo sapiens
ctagtacttggcctggaa

SEQ ID NO: 159972 - DNA, 19 bp, Homo sapiens
cttctctgtgtctgatata

SEQ ID NO: 159973 - DNA, 22 bp, Homo sapiens
tgtgtgtttatatatatgtgta

SEQ ID NO: 159974 - DNA, 20 bp, Homo sapiens
aagtgtatatatatacttgt

SEQ ID NO: 159975 - DNA, 19 bp, Homo sapiens
tgtatatatatacttgtgt

SEQ ID NO: 159976 - DNA, 23 bp, Homo sapiens
aggaagtgtatatatatacttgt

SEQ ID NO: 159977 - DNA, 23 bp, Homo sapiens
aggaagtgtatatatatacttgt

SEQ ID NO: 159978 - DNA, 21 bp, Homo sapiens
tataggaagtatatatatact

SEQ ID NO: 159979 - DNA, 21 bp, Homo sapiens
tataggaagtatatatatact

SEQ ID NO: 159980 - DNA, 22 bp, Homo sapiens
tataggaagtatatatatactt

SEQ ID NO: 159981 - DNA, 21 bp, Homo sapiens
tataggaagtatatatatact

SEQ ID NO: 159982 - DNA, 21 bp, Homo sapiens
tataggaagtatatatatact

SEQ ID NO: 159983 - DNA, 21 bp, Homo sapiens
tatataggaagtatatgtata

SEQ ID NO: 159984 - DNA, 18 bp, Homo sapiens
atataggacgtatatgta

SEQ ID NO: 159985 - DNA, 22 bp, Homo sapiens
tcttttagctctgacactctct

SEQ ID NO: 159986 - DNA, 18 bp, Homo sapiens
ttcagagggtcatagttg

SEQ ID NO: 159987 - DNA, 23 bp, Homo sapiens
tgtctgtgtgcctgtgtcccttc

SEQ ID NO: 159988 - DNA, 23 bp, Homo sapiens
tgttgctgactcccaccctctgt

SEQ ID NO: 159989 - DNA, 22 bp, Homo sapiens
atagggcctggaaatcagcatt

SEQ ID NO: 159990 - DNA, 23 bp, Homo sapiens
ttatatgtgtgcatatatatatg

SEQ ID NO: 159991 - DNA, 23 bp, Homo sapiens
gcctgggtgacacagtgtgactc

SEQ ID NO: 159992 - DNA, 22 bp, Homo sapiens
gactccctctgtgactccttcc

SEQ ID NO: 159993 - DNA, 23 bp, Homo sapiens
tgtgtgtgtgtgtacgtgtgtgt

SEQ ID NO: 159994 - DNA, 23 bp, Homo sapiens
cgtgtgtgcgtgtgtgtgtgcat

SEQ ID NO: 159995 - DNA, 23 bp, Homo sapiens
tccctgtgtgggtccctcggtgg

SEQ ID NO: 159996 - DNA, 23 bp, Homo sapiens
acagagtctcactctgtcgccca

SEQ ID NO: 159997 - DNA, 23 bp, Homo sapiens
gatcctggaatttgtatctattt

SEQ ID NO: 159998 - DNA, 20 bp, Homo sapiens
tgcctgtagtcttagctact

SEQ ID NO: 159999 - DNA, 23 bp, Homo sapiens
ggaagttgaggctacagtgagcc

SEQ ID NO: 160000 - DNA, 23 bp, Homo sapiens
ggagtctctctctgtcacccagc

SEQ ID NO: 160001 - DNA, 22 bp, Homo sapiens
tttttttttcaaggtttcaata

SEQ ID NO: 160002 - DNA, 23 bp, Homo sapiens
tcagacgctgtctgcctgcctcc

SEQ ID NO: 160003 - DNA, 23 bp, Homo sapiens
atatgtgtatatatatatgtgtg

SEQ ID NO: 160004 - DNA, 23 bp, Homo sapiens
agagtctcactctgtcacccagg

SEQ ID NO: 160005 - DNA, 23 bp, Homo sapiens
gacagagtctcgctctgtcaccc

SEQ ID NO: 160006 - DNA, 22 bp, Homo sapiens
tccagagattgcttgttatgat

SEQ ID NO: 160007 - DNA, 23 bp, Homo sapiens
tggagtctcactctgtcacccag

SEQ ID NO: 160008 - DNA, 23 bp, Homo sapiens
agtctcgctctgtcattccaggc

SEQ ID NO: 160009 - DNA, 22 bp, Homo sapiens
tgagatgaaccccacttgatca

SEQ ID NO: 160010 - DNA, 23 bp, Homo sapiens
tgtatgtatatatacatgtatgt

SEQ ID NO: 160011 - DNA, 21 bp, Homo sapiens
tatctgtatgtatatatacat

SEQ ID NO: 160012 - DNA, 20 bp, Homo sapiens
atgtgtatgtatatatgtgt

SEQ ID NO: 160013 - DNA, 23 bp, Homo sapiens
tatgtgtatatatacacgtgtgt

SEQ ID NO: 160014 - DNA, 23 bp, Homo sapiens
tgggactcgctctgttgtgcagg

SEQ ID NO: 160015 - DNA, 23 bp, Homo sapiens
catctctgtgtgtctccgtccaa

SEQ ID NO: 160016 - DNA, 20 bp, Homo sapiens
atggagttgtttgggtgaga

SEQ ID NO: 160017 - DNA, 22 bp, Homo sapiens
actgtctcagtcacaattttgc

SEQ ID NO: 160018 - DNA, 19 bp, Homo sapiens
tcagtgcctactactgtgt

SEQ ID NO: 160019 - DNA, 22 bp, Homo sapiens
tctggaaccgtatagtgatcat

SEQ ID NO: 160020 - DNA, 22 bp, Homo sapiens
tgccagacactttatgtggtga

SEQ ID NO: 160021 - DNA, 23 bp, Homo sapiens
cagtgcctcagtctgacttgtga

SEQ ID NO: 160022 - DNA, 19 bp, Homo sapiens
ctgaaacttctgcctcctg

SEQ ID NO: 160023 - DNA, 23 bp, Homo sapiens
ggagtctcactctgtctcccagg

SEQ ID NO: 160024 - DNA, 23 bp, Homo sapiens
actgactacacacactctctgga

SEQ ID NO: 160025 - DNA, 23 bp, Homo sapiens
gggcctgactctgtccctgtctt

SEQ ID NO: 160026 - DNA, 19 bp, Homo sapiens
aacatacaggaaaagctct

SEQ ID NO: 160027 - DNA, 23 bp, Homo sapiens
agtgaggagtgggtgctgactgt

SEQ ID NO: 160028 - DNA, 18 bp, Homo sapiens
cttgtcagtgtgtatact

SEQ ID NO: 160029 - DNA, 21 bp, Homo sapiens
tgcagaagcaggcctccagct

SEQ ID NO: 160030 - DNA, 23 bp, Homo sapiens
tcactgtgcttattcaccaggtt

SEQ ID NO: 160031 - DNA, 19 bp, Homo sapiens
tctgagccataagggagtg

SEQ ID NO: 160032 - DNA, 23 bp, Homo sapiens
gccacagtccgtgtgtccctgcc

SEQ ID NO: 160033 - DNA, 23 bp, Homo sapiens
acacagtctcactctgtcgccca

SEQ ID NO: 160034 - DNA, 18 bp, Homo sapiens
aacagtggtcagggaagg

SEQ ID NO: 160035 - DNA, 22 bp, Homo sapiens
acttggagccagggtagaagct

SEQ ID NO: 160036 - DNA, 23 bp, Homo sapiens
ccctcactgtctctgtctctctt

SEQ ID NO: 160037 - DNA, 23 bp, Homo sapiens
gcctcagtctctgggtctgtaag

SEQ ID NO: 160038 - DNA, 23 bp, Homo sapiens
ctgtgtctctgcttttgaatgcc

SEQ ID NO: 160039 - DNA, 20 bp, Homo sapiens
ggggaaggcctatgtgtgtg

SEQ ID NO: 160040 - DNA, 19 bp, Homo sapiens
aatgcccttccctcttctc

SEQ ID NO: 160041 - DNA, 23 bp, Homo sapiens
ctgggcctctgtctccctgtgtc

SEQ ID NO: 160042 - DNA, 23 bp, Homo sapiens
gggagtctcactctgtcacccag

SEQ ID NO: 160043 - DNA, 22 bp, Homo sapiens
tgttcactgaggaagcctatga

SEQ ID NO: 160044 - DNA, 23 bp, Homo sapiens
aggttacagggagttattattgc

SEQ ID NO: 160045 - DNA, 19 bp, Homo sapiens
tctgacaggcagaccaaag

SEQ ID NO: 160046 - DNA, 19 bp, Homo sapiens
tcagtgcctactactgtgt

SEQ ID NO: 160047 - DNA, 22 bp, Homo sapiens
tctggaaccgtatagtgatcat

SEQ ID NO: 160048 - DNA, 22 bp, Homo sapiens
tgccagacactttatgtggtga

SEQ ID NO: 160049 - DNA, 22 bp, Homo sapiens
agtctcactctgtcacccaggc

SEQ ID NO: 160050 - DNA, 23 bp, Homo sapiens
gacagagtctcgctctgtcaccc

SEQ ID NO: 160051 - DNA, 23 bp, Homo sapiens
aaggtctcactctgtcacccagg

SEQ ID NO: 160052 - DNA, 19 bp, Homo sapiens
cagtggtgtgaacactgta

SEQ ID NO: 160053 - DNA, 18 bp, Homo sapiens
gtgggaggttgacttgag

SEQ ID NO: 160054 - DNA, 23 bp, Homo sapiens
gggtctcactctgtcacccaggc

SEQ ID NO: 160055 - DNA, 23 bp, Homo sapiens
actgcctcgctgcctccctgaca

SEQ ID NO: 160056 - DNA, 23 bp, Homo sapiens
tggagtctcactctgtcacccag

SEQ ID NO: 160057 - DNA, 18 bp, Homo sapiens
tacagaggtatgatctca

SEQ ID NO: 160058 - DNA, 23 bp, Homo sapiens
acactggatttgaaagaggaagc

SEQ ID NO: 160059 - DNA, 23 bp, Homo sapiens
gtctctctctgtcactcaggctg

SEQ ID NO: 160060 - DNA, 23 bp, Homo sapiens
tcactgtgtgaacatcatgtgca

SEQ ID NO: 160061 - DNA, 23 bp, Homo sapiens
tgagatggagtctcactctgtca

SEQ ID NO: 160062 - DNA, 20 bp, Homo sapiens
tgtatatatgtgtatgtgta

SEQ ID NO: 160063 - DNA, 20 bp, Homo sapiens
acacacacacatatatatat

SEQ ID NO: 160064 - DNA, 23 bp, Homo sapiens
gcagttgtgtgtctgttggatct

SEQ ID NO: 160065 - DNA, 23 bp, Homo sapiens
gagatggagtctcactctgtcac

SEQ ID NO: 160066 - DNA, 23 bp, Homo sapiens
tggagtctcactctgtcacccag

SEQ ID NO: 160067 - DNA, 22 bp, Homo sapiens
ctgtctctgtcacacaggctgg

SEQ ID NO: 160068 - DNA, 23 bp, Homo sapiens
tgtcactgtgtgtgcctgtgctg

SEQ ID NO: 160069 - DNA, 19 bp, Homo sapiens
ttctgtgcctctgtgggtc

SEQ ID NO: 160070 - DNA, 19 bp, Homo sapiens
tcagtgcctactactgtgt

SEQ ID NO: 160071 - DNA, 22 bp, Homo sapiens
tctggaaccgtatagtgatcat

SEQ ID NO: 160072 - DNA, 22 bp, Homo sapiens
tgccagacactttatgtggtga

SEQ ID NO: 160073 - DNA, 23 bp, Homo sapiens
attgtgtgtatttgtggtgtacc

SEQ ID NO: 160074 - DNA, 21 bp, Homo sapiens
acctgggggcaggtaatgtct

SEQ ID NO: 160075 - DNA, 23 bp, Homo sapiens
gacagagtctcgctctgtcaccc

SEQ ID NO: 160076 - DNA, 23 bp, Homo sapiens
acagagtctcgctctgtcaccca

SEQ ID NO: 160077 - DNA, 23 bp, Homo sapiens
ttatgtatgtatatacgaaactg

SEQ ID NO: 160078 - DNA, 23 bp, Homo sapiens
tccgttttctctcactctctcag

SEQ ID NO: 160079 - DNA, 23 bp, Homo sapiens
ctcaccacagactctctctctcc

SEQ ID NO: 160080 - DNA, 21 bp, Homo sapiens
ctctgtggctcactgcctgag

SEQ ID NO: 160081 - DNA, 23 bp, Homo sapiens
aagacacattgcagtgggtggaa

SEQ ID NO: 160082 - DNA, 22 bp, Homo sapiens
tctctctctctgtcctgtgttc

SEQ ID NO: 160083 - DNA, 23 bp, Homo sapiens
agtctgaccagactggggactca

SEQ ID NO: 160084 - DNA, 23 bp, Homo sapiens
agccactgtgcttggctggtttt

SEQ ID NO: 160085 - DNA, 19 bp, Homo sapiens
actctcgctctgtcacccg

SEQ ID NO: 160086 - DNA, 23 bp, Homo sapiens
tgtggaggcaggttgtatataat

SEQ ID NO: 160087 - DNA, 23 bp, Homo sapiens
tgagttcattgtagattctggat

SEQ ID NO: 160088 - DNA, 23 bp, Homo sapiens
tgagttcattgtagattctggat

SEQ ID NO: 160089 - DNA, 18 bp, Homo sapiens
tgcttttttttgttgttt

SEQ ID NO: 160090 - DNA, 23 bp, Homo sapiens
aagacacattgcagtgggtggaa

SEQ ID NO: 160091 - DNA, 22 bp, Homo sapiens
tgtgtgtgtgtatcatagatct

SEQ ID NO: 160092 - DNA, 20 bp, Homo sapiens
tatataggtagatctagata

SEQ ID NO: 160093 - DNA, 23 bp, Homo sapiens
tgagttcattgtagattctggat

SEQ ID NO: 160094 - DNA, 23 bp, Homo sapiens
tgagttcattgtagattctggat

SEQ ID NO: 160095 - DNA, 23 bp, Homo sapiens
tgagttcattgtagattctggat

SEQ ID NO: 160096 - DNA, 23 bp, Homo sapiens
tgagttcattgtagattctggat

SEQ ID NO: 160097 - DNA, 23 bp, Homo sapiens
cactatgtctttttctaaatctc

SEQ ID NO: 160098 - DNA, 23 bp, Homo sapiens
tagggtctcactctgtctcccag

SEQ ID NO: 160099 - DNA, 18 bp, Homo sapiens
tggcagacactgcctctc

SEQ ID NO: 160100 - DNA, 23 bp, Homo sapiens
aaatggcatgtttagaagtgtgt

SEQ ID NO: 160101 - DNA, 23 bp, Homo sapiens
agagggaatctcactctgtctcc

SEQ ID NO: 160102 - DNA, 23 bp, Homo sapiens
acaatgtgaggtgatggatgtgt

SEQ ID NO: 160103 - DNA, 22 bp, Homo sapiens
tcaaatcatcatattgtacact

SEQ ID NO: 160104 - DNA, 21 bp, Homo sapiens
tgtcactagaatgtgagctct

SEQ ID NO: 160105 - DNA, 20 bp, Homo sapiens
tgagggcaagggttttgcct

SEQ ID NO: 160106 - DNA, 23 bp, Homo sapiens
ggagtctcactctgtcactcagg

SEQ ID NO: 160107 - DNA, 23 bp, Homo sapiens
tagagtctcgctctgtcactcag

SEQ ID NO: 160108 - DNA, 23 bp, Homo sapiens
actgagtctcactctgtcaccca

SEQ ID NO: 160109 - DNA, 22 bp, Homo sapiens
ctgactggttagcctgagtcac

SEQ ID NO: 160110 - DNA, 23 bp, Homo sapiens
acagaagcaagttgaaattgtac

SEQ ID NO: 160111 - DNA, 22 bp, Homo sapiens
gacagggtctcactgtgtctcc

SEQ ID NO: 160112 - DNA, 18 bp, Homo sapiens
tctccgtcagcttggcct

SEQ ID NO: 160113 - DNA, 22 bp, Homo sapiens
tatttcagtagagatggggttt

SEQ ID NO: 160114 - DNA, 18 bp, Homo sapiens
tgcaacttctgcctcctg

SEQ ID NO: 160115 - DNA, 18 bp, Homo sapiens
cactgggatttttttgtt

SEQ ID NO: 160116 - DNA, 21 bp, Homo sapiens
tgctagacttgtgattttggt

SEQ ID NO: 160117 - DNA, 22 bp, Homo sapiens
tatgatacatgtatacatgtat

SEQ ID NO: 160118 - DNA, 20 bp, Homo sapiens
tatgtgtatatatatatatg

SEQ ID NO: 160119 - DNA, 23 bp, Homo sapiens
tggcttgagcctgggagagctga

SEQ ID NO: 160120 - DNA, 22 bp, Homo sapiens
agagtctcgctctgtcacccag

SEQ ID NO: 160121 - DNA, 20 bp, Homo sapiens
tgtgtgaagacagtcagctg

SEQ ID NO: 160122 - DNA, 22 bp, Homo sapiens
ttttcctcacttctgtgttcct

SEQ ID NO: 160123 - DNA, 23 bp, Homo sapiens
gcgtctcactctgtcacccaggc

SEQ ID NO: 160124 - DNA, 23 bp, Homo sapiens
agatggtgtctcgctctgtcacc

SEQ ID NO: 160125 - DNA, 22 bp, Homo sapiens
acacacacacctatgtatgtat

SEQ ID NO: 160126 - DNA, 23 bp, Homo sapiens
tgtggttgacagaagtttggctg

SEQ ID NO: 160127 - DNA, 22 bp, Homo sapiens
acactcagctacttgttacaac

SEQ ID NO: 160128 - DNA, 20 bp, Homo sapiens
ttgaatctgtagatcacttt

SEQ ID NO: 160129 - DNA, 23 bp, Homo sapiens
tcccacttattgactacatgtgc

SEQ ID NO: 160130 - DNA, 23 bp, Homo sapiens
acagacacatatatacactgtat

SEQ ID NO: 160131 - DNA, 19 bp, Homo sapiens
aactgagagctattttttt

SEQ ID NO: 160132 - DNA, 23 bp, Homo sapiens
tttgagacggagttttgctcctg

SEQ ID NO: 160133 - DNA, 22 bp, Homo sapiens
agagggcagtcagagcacagag

SEQ ID NO: 160134 - DNA, 22 bp, Homo sapiens
aaagctgcttgcttttattgtg

SEQ ID NO: 160135 - DNA, 21 bp, Homo sapiens
gtatgtatatgtatatacata

SEQ ID NO: 160136 - DNA, 23 bp, Homo sapiens
tctctctctccgtgtgtgtgtac

SEQ ID NO: 160137 - DNA, 18 bp, Homo sapiens
tgtattttacttgagatt

SEQ ID NO: 160138 - DNA, 23 bp, Homo sapiens
tgagttcattgtagattctggat

SEQ ID NO: 160139 - DNA, 23 bp, Homo sapiens
tgagttcattgtagattctggat

SEQ ID NO: 160140 - DNA, 23 bp, Homo sapiens
gaaagggagtctcgctctgtctc

SEQ ID NO: 160141 - DNA, 23 bp, Homo sapiens
tctgctctgtgcaaatgcttgta

SEQ ID NO: 160142 - DNA, 23 bp, Homo sapiens
gactgagtctcgctctgtcaccc

SEQ ID NO: 160143 - DNA, 21 bp, Homo sapiens
aactggcctacaaagtcccag

SEQ ID NO: 160144 - DNA, 22 bp, Homo sapiens
actggtagaaggttcttttcta

SEQ ID NO: 160145 - DNA, 23 bp, Homo sapiens
acagagtctcactctgtcgccca

SEQ ID NO: 160146 - DNA, 23 bp, Homo sapiens
tatatacacgtatacatgtatac

SEQ ID NO: 160147 - DNA, 23 bp, Homo sapiens
gtgtctctctctcaatgaacttt

SEQ ID NO: 160148 - DNA, 19 bp, Homo sapiens
tctgaagtgtgggtggaca

SEQ ID NO: 160149 - DNA, 23 bp, Homo sapiens
atggagtctcactctgtcaccca

SEQ ID NO: 160150 - DNA, 23 bp, Homo sapiens
tggagtctcactctgtcacccag

SEQ ID NO: 160151 - DNA, 21 bp, Homo sapiens
taggggttttctaggtatatg

SEQ ID NO: 160152 - DNA, 23 bp, Homo sapiens
tctatccattttcatactgctat

SEQ ID NO: 160153 - DNA, 21 bp, Homo sapiens
ttctgaatctccattgtctat

SEQ ID NO: 160154 - DNA, 23 bp, Homo sapiens
cttgacagaacagagtctgaggt

SEQ ID NO: 160155 - DNA, 23 bp, Homo sapiens
tgcctctgtgcttgattgaggga

SEQ ID NO: 160156 - DNA, 23 bp, Homo sapiens
tgaacacggttttctgtttttgt

SEQ ID NO: 160157 - DNA, 23 bp, Homo sapiens
aggtttcactggatccctcagtg

SEQ ID NO: 160158 - DNA, 21 bp, Homo sapiens
ctgagttttctctctgagggc

SEQ ID NO: 160159 - DNA, 23 bp, Homo sapiens
tctgtcagtgtgactttatttgg

SEQ ID NO: 160160 - DNA, 18 bp, Homo sapiens
ttaggtcattctagagca

SEQ ID NO: 160161 - DNA, 23 bp, Homo sapiens
tgagttcattgtagattctggat

SEQ ID NO: 160162 - DNA, 23 bp, Homo sapiens
tgagttcattgtagattctggat

SEQ ID NO: 160163 - DNA, 23 bp, Homo sapiens
gggttctctctctgtcactttgt

SEQ ID NO: 160164 - DNA, 19 bp, Homo sapiens
atatgtgtgtgtatatatg

SEQ ID NO: 160165 - DNA, 23 bp, Homo sapiens
caagaccttctgctttgtggtgg

SEQ ID NO: 160166 - DNA, 23 bp, Homo sapiens
gactgagtctcgctctgtcaccc

SEQ ID NO: 160167 - DNA, 23 bp, Homo sapiens
tggctgtctccctgcctcagtga

SEQ ID NO: 160168 - DNA, 23 bp, Homo sapiens
tggctgtctctctgacttcctgg

SEQ ID NO: 160169 - DNA, 23 bp, Homo sapiens
ttcaggcagacagaggaacagct

SEQ ID NO: 160170 - DNA, 23 bp, Homo sapiens
tcccagagcccctggaactctgg

SEQ ID NO: 160171 - DNA, 20 bp, Homo sapiens
taggcagtgacactgagaca

SEQ ID NO: 160172 - DNA, 23 bp, Homo sapiens
actctccctcactctgttacttg

SEQ ID NO: 160173 - DNA, 23 bp, Homo sapiens
tgtctttggtattcttgcagtgt

SEQ ID NO: 160174 - DNA, 21 bp, Homo sapiens
aacctgcagaagaaactgctt

SEQ ID NO: 160175 - DNA, 18 bp, Homo sapiens
acacaggctcactgacac

SEQ ID NO: 160176 - DNA, 23 bp, Homo sapiens
gagcctcactcactgtcagagca

SEQ ID NO: 160177 - DNA, 18 bp, Homo sapiens
tgcacacagcctgtcatg

SEQ ID NO: 160178 - DNA, 18 bp, Homo sapiens
cagaggcaaaatctcagg

SEQ ID NO: 160179 - DNA, 23 bp, Homo sapiens
atgtatgtatgcatgtgtgtgtg

SEQ ID NO: 160180 - DNA, 22 bp, Homo sapiens
gtgtgtatatatgtgtgtgtgt

SEQ ID NO: 160181 - DNA, 23 bp, Homo sapiens
ttctgtgaagaaagtcaacagta

SEQ ID NO: 160182 - DNA, 23 bp, Homo sapiens
tgtcactgactctgtgaactttg

SEQ ID NO: 160183 - DNA, 23 bp, Homo sapiens
tctccctcccactctgtgtcctg

SEQ ID NO: 160184 - DNA, 23 bp, Homo sapiens
cacagagtgaagagagtcagtgt

SEQ ID NO: 160185 - DNA, 20 bp, Homo sapiens
tttctgtttttctttatgtt

SEQ ID NO: 160186 - DNA, 18 bp, Homo sapiens
tcactgcaagctctgcct

SEQ ID NO: 160187 - DNA, 23 bp, Homo sapiens
tgagacaagagtctctctctgtc

SEQ ID NO: 160188 - DNA, 23 bp, Homo sapiens
tctttgagacggagttttgcttt

SEQ ID NO: 160189 - DNA, 23 bp, Homo sapiens
agagtgcctggcacactgtatgc

SEQ ID NO: 160190 - DNA, 23 bp, Homo sapiens
tggtgcatgcctatagtctcagc

SEQ ID NO: 160191 - DNA, 21 bp, Homo sapiens
tgaggtaggaggatcacttga

SEQ ID NO: 160192 - DNA, 20 bp, Homo sapiens
tgtctgtaatctctgcagtt

SEQ ID NO: 160193 - DNA, 23 bp, Homo sapiens
tggagtctctctctgtcacccag

SEQ ID NO: 160194 - DNA, 18 bp, Homo sapiens
taatccaaagagagcaga

SEQ ID NO: 160195 - DNA, 22 bp, Homo sapiens
tgtgagtgtgggtcttctataa

SEQ ID NO: 160196 - DNA, 23 bp, Homo sapiens
agagatgggttttcatcatgttg

SEQ ID NO: 160197 - DNA, 22 bp, Homo sapiens
tgagccagagtctcactctgtc

SEQ ID NO: 160198 - DNA, 23 bp, Homo sapiens
agtgtctcactctgtcacctagg

SEQ ID NO: 160199 - DNA, 23 bp, Homo sapiens
tatatgtactatgtatatgtgta

SEQ ID NO: 160200 - DNA, 18 bp, Homo sapiens
gagtctcactctgtcacc

SEQ ID NO: 160201 - DNA, 18 bp, Homo sapiens
agtctcgctctgtcaccc

SEQ ID NO: 160202 - DNA, 22 bp, Homo sapiens
tgactcctctgtgtctcagctt

SEQ ID NO: 160203 - DNA, 23 bp, Homo sapiens
tgtctgtgtagaaagtagaagac

SEQ ID NO: 160204 - DNA, 23 bp, Homo sapiens
aatatgtgagctatagattggat

SEQ ID NO: 160205 - DNA, 23 bp, Homo sapiens
cacagtgtctccctgagtcccag

SEQ ID NO: 160206 - DNA, 23 bp, Homo sapiens
ggtctcactctgtctccctggct

SEQ ID NO: 160207 - DNA, 23 bp, Homo sapiens
tctgccactgagtctctgagtgg

SEQ ID NO: 160208 - DNA, 23 bp, Homo sapiens
actgtggctggctggctgattga

SEQ ID NO: 160209 - DNA, 19 bp, Homo sapiens
acagtgactggtatgcact

SEQ ID NO: 160210 - DNA, 23 bp, Homo sapiens
ctgtgtctttgtgtctctggaac

SEQ ID NO: 160211 - DNA, 19 bp, Homo sapiens
tcgctgactgactcacact

SEQ ID NO: 160212 - DNA, 20 bp, Homo sapiens
agtctcgctctgtcgctcag

SEQ ID NO: 160213 - DNA, 22 bp, Homo sapiens
gggtctctctctgtctcccagg

SEQ ID NO: 160214 - DNA, 21 bp, Homo sapiens
atgtgaggctttatgacttgt

SEQ ID NO: 160215 - DNA, 22 bp, Homo sapiens
gacagagtcacggagtctcact

SEQ ID NO: 160216 - DNA, 22 bp, Homo sapiens
tatatgtgtgtatatatatgtg

SEQ ID NO: 160217 - DNA, 23 bp, Homo sapiens
tatatgtgtgtatatatatgtgt

SEQ ID NO: 160218 - DNA, 23 bp, Homo sapiens
tatatgtgtgtatatatatgtgt

SEQ ID NO: 160219 - DNA, 21 bp, Homo sapiens
tgtgtgtatatatatgtgtat

SEQ ID NO: 160220 - DNA, 23 bp, Homo sapiens
ttttttgacacagtctcattctg

SEQ ID NO: 160221 - DNA, 19 bp, Homo sapiens
tctatcccttcttggctgt

SEQ ID NO: 160222 - DNA, 23 bp, Homo sapiens
gactgagtctcgctctgtcaccc

SEQ ID NO: 160223 - DNA, 23 bp, Homo sapiens
gagtcggagtctctctctgtcgc

SEQ ID NO: 160224 - DNA, 23 bp, Homo sapiens
tgacagagagagaccctgtctca

SEQ ID NO: 160225 - DNA, 23 bp, Homo sapiens
tttgagacagagtctcgctctgt

SEQ ID NO: 160226 - DNA, 23 bp, Homo sapiens
acagagtctcactctgtcgccca

SEQ ID NO: 160227 - DNA, 21 bp, Homo sapiens
ttgagcagttacagcatgctg

SEQ ID NO: 160228 - DNA, 22 bp, Homo sapiens
tctccatgccttagttttctca

SEQ ID NO: 160229 - DNA, 23 bp, Homo sapiens
cttagactgagtctcactctgtc

SEQ ID NO: 160230 - DNA, 23 bp, Homo sapiens
gacagagtctcgctctgtcaccc

SEQ ID NO: 160231 - DNA, 19 bp, Homo sapiens
gacagactgtgtctgtgtt

SEQ ID NO: 160232 - DNA, 23 bp, Homo sapiens
acacggagtctcactctgtctcc

SEQ ID NO: 160233 - DNA, 23 bp, Homo sapiens
actgtgtgataagagtctgtgca

SEQ ID NO: 160234 - DNA, 23 bp, Homo sapiens
agatagagtctcactctgtcagc

SEQ ID NO: 160235 - DNA, 23 bp, Homo sapiens
agttgacactggctgttgatatt

SEQ ID NO: 160236 - DNA, 18 bp, Homo sapiens
agcatattatatatgtat

SEQ ID NO: 160237 - DNA, 21 bp, Homo sapiens
agactagcctggacaacatgg

SEQ ID NO: 160238 - DNA, 21 bp, Homo sapiens
tgagtctgtctcaatttattc

SEQ ID NO: 160239 - DNA, 23 bp, Homo sapiens
catcactggctggctctgtgtct

SEQ ID NO: 160240 - DNA, 23 bp, Homo sapiens
gactccctcgctgtcacagatct

SEQ ID NO: 160241 - DNA, 22 bp, Homo sapiens
tgtgagactagtttggagtttg

SEQ ID NO: 160242 - DNA, 19 bp, Homo sapiens
tctgccagtttttcttcag

SEQ ID NO: 160243 - DNA, 22 bp, Homo sapiens
ttcacaacaaatttcacagtgg

SEQ ID NO: 160244 - DNA, 23 bp, Homo sapiens
tgttcctggctctctctctggga

SEQ ID NO: 160245 - DNA, 23 bp, Homo sapiens
cacactttctgtctgtttctgga

SEQ ID NO: 160246 - DNA, 22 bp, Homo sapiens
ttctgcacagagtcctgtgatg

SEQ ID NO: 160247 - DNA, 23 bp, Homo sapiens
actgtctctgggtctctcagccg

SEQ ID NO: 160248 - DNA, 23 bp, Homo sapiens
gagacagtctcgctctgtcgctc

SEQ ID NO: 160249 - DNA, 21 bp, Homo sapiens
cagtggcatgatctcagctta

SEQ ID NO: 160250 - DNA, 22 bp, Homo sapiens
tgtgtgggtatatattacctat

SEQ ID NO: 160251 - DNA, 23 bp, Homo sapiens
tgagccagaagagtgtgtgcact

SEQ ID NO: 160252 - DNA, 23 bp, Homo sapiens
tgtatgtgtgcgtgtgtgtgtgt

SEQ ID NO: 160253 - DNA, 23 bp, Homo sapiens
ctttcttcttgttggccagctct

SEQ ID NO: 160254 - DNA, 23 bp, Homo sapiens
tgagttcattgtagattctggat

SEQ ID NO: 160255 - DNA, 23 bp, Homo sapiens
tgagttcattgtagattctggat

SEQ ID NO: 160256 - DNA, 21 bp, Homo sapiens
tgtctgcctgcctggttgcct

SEQ ID NO: 160257 - DNA, 23 bp, Homo sapiens
tttcagaggattgttttgtggga

SEQ ID NO: 160258 - DNA, 23 bp, Homo sapiens
tctcgctctgtggccgagactga

SEQ ID NO: 160259 - DNA, 23 bp, Homo sapiens
agaagacactgtgcagactctgg

SEQ ID NO: 160260 - DNA, 23 bp, Homo sapiens
gggagagtagtcaggtcattgga

SEQ ID NO: 160261 - DNA, 23 bp, Homo sapiens
agggttctgagcagatcttcctg

SEQ ID NO: 160262 - DNA, 22 bp, Homo sapiens
agtacagtggtatgatctcagc

SEQ ID NO: 160263 - DNA, 23 bp, Homo sapiens
aatacagagaagagactgaggtg

SEQ ID NO: 160264 - DNA, 19 bp, Homo sapiens
tcagtctcacagaagttat

SEQ ID NO: 160265 - DNA, 23 bp, Homo sapiens
ttaacactggaattgaaggcaat

SEQ ID NO: 160266 - DNA, 23 bp, Homo sapiens
tgtcactcactcactgccagggt

SEQ ID NO: 160267 - DNA, 22 bp, Homo sapiens
gtcacagcctcacttctcccac

SEQ ID NO: 160268 - DNA, 23 bp, Homo sapiens
tgtctgcctgtctgcctgtgtgt

SEQ ID NO: 160269 - DNA, 23 bp, Homo sapiens
cagggtctcactctgtcacccag

SEQ ID NO: 160270 - DNA, 23 bp, Homo sapiens
tggagtctcactctgtcacccag

SEQ ID NO: 160271 - DNA, 21 bp, Homo sapiens
atatacacacatatatatgtg

SEQ ID NO: 160272 - DNA, 23 bp, Homo sapiens
tgagttcattgtagattctggat

SEQ ID NO: 160273 - DNA, 23 bp, Homo sapiens
tgagttcattgtagattctggat

SEQ ID NO: 160274 - DNA, 23 bp, Homo sapiens
gagtctcactctgtctcccaggc

SEQ ID NO: 160275 - DNA, 23 bp, Homo sapiens
gtgctcagttgtctgtctgtgtt

SEQ ID NO: 160276 - DNA, 18 bp, Homo sapiens
tctcgctctgtcacccag

SEQ ID NO: 160277 - DNA, 23 bp, Homo sapiens
agatagaacagggtgagcactca

SEQ ID NO: 160278 - DNA, 23 bp, Homo sapiens
tgagcttcctcctgatccagtct

SEQ ID NO: 160279 - DNA, 23 bp, Homo sapiens
tggcagtaggacaagtctgtgtg

SEQ ID NO: 160280 - DNA, 23 bp, Homo sapiens
atttgctctgtacagagaatggg

SEQ ID NO: 160281 - DNA, 23 bp, Homo sapiens
tctaattgtagttctcatagcaa

SEQ ID NO: 160282 - DNA, 23 bp, Homo sapiens
tgggagacttctcattttgttct

SEQ ID NO: 160283 - DNA, 23 bp, Homo sapiens
gacagagtctcgctctgtcaccc

SEQ ID NO: 160284 - DNA, 23 bp, Homo sapiens
gacagagtctcgctctgtcaccc

SEQ ID NO: 160285 - DNA, 22 bp, Homo sapiens
atatgtatatatacgtatatgt

SEQ ID NO: 160286 - DNA, 23 bp, Homo sapiens
gagtgtctgtgtgactgtggctg

SEQ ID NO: 160287 - DNA, 23 bp, Homo sapiens
tccaagtttgtctactgtgtctc

SEQ ID NO: 160288 - DNA, 23 bp, Homo sapiens
agggtctcactgtgtcacccagg

SEQ ID NO: 160289 - DNA, 21 bp, Homo sapiens
tctgtgtgtgtgtgtgtatat

SEQ ID NO: 160290 - DNA, 23 bp, Homo sapiens
atacacacacacatacatatgtg

SEQ ID NO: 160291 - DNA, 22 bp, Homo sapiens
gtctcactctgtcacctaggct

SEQ ID NO: 160292 - DNA, 23 bp, Homo sapiens
ccagagagcctgctcactacgag

SEQ ID NO: 160293 - DNA, 23 bp, Homo sapiens
agggtctcactcactctgttgcc

SEQ ID NO: 160294 - DNA, 23 bp, Homo sapiens
gactgtgactcactctctgcagt

SEQ ID NO: 160295 - DNA, 23 bp, Homo sapiens
gggtctcattagtgtatctgaag

SEQ ID NO: 160296 - DNA, 21 bp, Homo sapiens
acagcatgaccctgtctcaaa

SEQ ID NO: 160297 - DNA, 23 bp, Homo sapiens
tgagacagtgtctcgctctgtca

SEQ ID NO: 160298 - DNA, 22 bp, Homo sapiens
ctcactgaaagctctgcctcac

SEQ ID NO: 160299 - DNA, 19 bp, Homo sapiens
aaaccacatgagcaggact

SEQ ID NO: 160300 - DNA, 23 bp, Homo sapiens
ctgtgactgcctctctggaaatc

SEQ ID NO: 160301 - DNA, 19 bp, Homo sapiens
agtgtagagcgtgtgctat

SEQ ID NO: 160302 - DNA, 21 bp, Homo sapiens
ccagactgaactgcctgccca

SEQ ID NO: 160303 - DNA, 22 bp, Homo sapiens
tgaggtactaggttgaagcatt

SEQ ID NO: 160304 - DNA, 18 bp, Homo sapiens
ctccttctgaatctgcct

SEQ ID NO: 160305 - DNA, 23 bp, Homo sapiens
agaacagctgggacagtttccct

SEQ ID NO: 160306 - DNA, 23 bp, Homo sapiens
acagaacacacccagcttagttc

SEQ ID NO: 160307 - DNA, 23 bp, Homo sapiens
tgagtcggagtctcactctgtca

SEQ ID NO: 160308 - DNA, 23 bp, Homo sapiens
gagtcggagtctcactctgtcat

SEQ ID NO: 160309 - DNA, 23 bp, Homo sapiens
tttacggagacactcactctcag

SEQ ID NO: 160310 - DNA, 18 bp, Homo sapiens
atgactgcctccttactt

SEQ ID NO: 160311 - DNA, 23 bp, Homo sapiens
gacacacagatgaggaaactgag

SEQ ID NO: 160312 - DNA, 23 bp, Homo sapiens
tttctctgtgcctcagttacctc

SEQ ID NO: 160313 - DNA, 23 bp, Homo sapiens
tgacagaagtgagggagctttgc

SEQ ID NO: 160314 - DNA, 23 bp, Homo sapiens
gtgcctgcctgtagtttcagcta

SEQ ID NO: 160315 - DNA, 18 bp, Homo sapiens
aagtaaggtagtaaggag

SEQ ID NO: 160316 - DNA, 23 bp, Homo sapiens
ctctgggacactctctgtgttgt

SEQ ID NO: 160317 - DNA, 23 bp, Homo sapiens
tgtctctctcactctcgctctca

SEQ ID NO: 160318 - DNA, 23 bp, Homo sapiens
ttctgtgtctgtgtatctgtctg

SEQ ID NO: 160319 - DNA, 23 bp, Homo sapiens
tataatggaaatgaatctcaaag

SEQ ID NO: 160320 - DNA, 23 bp, Homo sapiens
atttggtctctcagaatccaggt

SEQ ID NO: 160321 - DNA, 23 bp, Homo sapiens
gactgagtctcgctctgtcaccc

SEQ ID NO: 160322 - DNA, 23 bp, Homo sapiens
cagagtctcactctgtcgctcag

SEQ ID NO: 160323 - DNA, 23 bp, Homo sapiens
agatacagagtctcgctctgttg

SEQ ID NO: 160324 - DNA, 23 bp, Homo sapiens
ctgtctctgtgtgtatgcctggc

SEQ ID NO: 160325 - DNA, 23 bp, Homo sapiens
tgtcactctggctctctaacaga

SEQ ID NO: 160326 - DNA, 23 bp, Homo sapiens
gtgtccctgtgtcgctgtgtcgg

SEQ ID NO: 160327 - DNA, 23 bp, Homo sapiens
tggagtctcactctgtcacccag

SEQ ID NO: 160328 - DNA, 20 bp, Homo sapiens
agacaagtgagtgagcacta

SEQ ID NO: 160329 - DNA, 21 bp, Homo sapiens
aagagcttgtgattacactgc

SEQ ID NO: 160330 - DNA, 23 bp, Homo sapiens
tgatttcacaggctgagatcagg

SEQ ID NO: 160331 - DNA, 23 bp, Homo sapiens
agaaacaacatgattctagtttt

SEQ ID NO: 160332 - DNA, 20 bp, Homo sapiens
caaacctgtagtcccagcta

SEQ ID NO: 160333 - DNA, 18 bp, Homo sapiens
tctgcatgtctaacatac

SEQ ID NO: 160334 - DNA, 23 bp, Homo sapiens
ttatagtagtagacaagcaaact

SEQ ID NO: 160335 - DNA, 20 bp, Homo sapiens
ttctctgtttttgattggtt

SEQ ID NO: 160336 - DNA, 22 bp, Homo sapiens
aaaagaactctggagattggtt

SEQ ID NO: 160337 - DNA, 21 bp, Homo sapiens
ttgcctctcacactgaatgtg

SEQ ID NO: 160338 - DNA, 23 bp, Homo sapiens
caactctctgactctgagtccta

SEQ ID NO: 160339 - DNA, 23 bp, Homo sapiens
gatggagtctcgctctgtctccc

SEQ ID NO: 160340 - DNA, 21 bp, Homo sapiens
tctctggatgcaagaatggag

SEQ ID NO: 160341 - DNA, 23 bp, Homo sapiens
actgtcactgcatcacttgagtc

SEQ ID NO: 160342 - DNA, 21 bp, Homo sapiens
tgcttcttgttgttgagatag

SEQ ID NO: 160343 - DNA, 21 bp, Homo sapiens
gctctgtctctcagagtggag

SEQ ID NO: 160344 - DNA, 21 bp, Homo sapiens
tgtctccatatatatacatat

SEQ ID NO: 160345 - DNA, 21 bp, Homo sapiens
tgtctccatatatatacatat

SEQ ID NO: 160346 - DNA, 19 bp, Homo sapiens
aatgtacttcattttgttt

SEQ ID NO: 160347 - DNA, 18 bp, Homo sapiens
tcccgagtagctgggatt

SEQ ID NO: 160348 - DNA, 23 bp, Homo sapiens
tgagacactgtacccagacaaat

SEQ ID NO: 160349 - DNA, 20 bp, Homo sapiens
tgagacagagtctcgctctg

SEQ ID NO: 160350 - DNA, 23 bp, Homo sapiens
tgtgcctgtctctgaggctcagc

SEQ ID NO: 160351 - DNA, 23 bp, Homo sapiens
gactgagtctcgctctctcaccc

SEQ ID NO: 160352 - DNA, 19 bp, Homo sapiens
agagtgacaccctatctca

SEQ ID NO: 160353 - DNA, 21 bp, Homo sapiens
tgagacagagtctcgctctgt

SEQ ID NO: 160354 - DNA, 23 bp, Homo sapiens
cggagtctcactctgtcacccag

SEQ ID NO: 160355 - DNA, 23 bp, Homo sapiens
gatctgtcagtctgtttctctgg

SEQ ID NO: 160356 - DNA, 21 bp, Homo sapiens
atgtatacacatatacgtgta

SEQ ID NO: 160357 - DNA, 23 bp, Homo sapiens
atatgtgtatatgtatatatgtg

SEQ ID NO: 160358 - DNA, 23 bp, Homo sapiens
tatatgtgtatatatgtatacat

SEQ ID NO: 160359 - DNA, 23 bp, Homo sapiens
actgctcacactcattctctgcc

SEQ ID NO: 160360 - DNA, 23 bp, Homo sapiens
gtacttgtctgagcaagtctgtc

SEQ ID NO: 160361 - DNA, 23 bp, Homo sapiens
tttcgagacggagtctcgctctg

SEQ ID NO: 160362 - DNA, 19 bp, Homo sapiens
tgagtgtggagacagacgc

SEQ ID NO: 160363 - DNA, 23 bp, Homo sapiens
ctctctcccaagtagctgggact

SEQ ID NO: 160364 - DNA, 23 bp, Homo sapiens
tggagtctcactctgtcacccag

SEQ ID NO: 160365 - DNA, 19 bp, Homo sapiens
ttgagaccgagtctcgctc

SEQ ID NO: 160366 - DNA, 23 bp, Homo sapiens
tgtgtgtgtctctgatgtgtgtg

SEQ ID NO: 160367 - DNA, 18 bp, Homo sapiens
agatatctatagatacat

SEQ ID NO: 160368 - DNA, 23 bp, Homo sapiens
tgagttcattgtagattctggat

SEQ ID NO: 160369 - DNA, 23 bp, Homo sapiens
tgagttcattgtagattctggat

SEQ ID NO: 160370 - DNA, 23 bp, Homo sapiens
gacagagtgagatcctgtctttt

SEQ ID NO: 160371 - DNA, 23 bp, Homo sapiens
agagtctcactctgtcacccagg

SEQ ID NO: 160372 - DNA, 19 bp, Homo sapiens
tatctcaaggataatgtgt

SEQ ID NO: 160373 - DNA, 23 bp, Homo sapiens
tatgttcaggctcagtgggacag

SEQ ID NO: 160374 - DNA, 21 bp, Homo sapiens
tgtatacatgtatatatgcac

SEQ ID NO: 160375 - DNA, 19 bp, Homo sapiens
tatacgtatatatgtatac

SEQ ID NO: 160376 - DNA, 23 bp, Homo sapiens
tatacacgtatatatatgtgtgt

SEQ ID NO: 160377 - DNA, 21 bp, Homo sapiens
ttatgtatatatatgtgtgtg

SEQ ID NO: 160378 - DNA, 22 bp, Homo sapiens
ttagagcatgcatgtttcagag

SEQ ID NO: 160379 - DNA, 23 bp, Homo sapiens
ttaccgtgtgccagatatgactg

SEQ ID NO: 160380 - DNA, 23 bp, Homo sapiens
aagagtccagtttttctagttca

SEQ ID NO: 160381 - DNA, 21 bp, Homo sapiens
attttaaatgtgtggagcctg

SEQ ID NO: 160382 - DNA, 19 bp, Homo sapiens
atgcacatgaaagagatgt

SEQ ID NO: 160383 - DNA, 23 bp, Homo sapiens
acagagtctcgctctgtcactca

SEQ ID NO: 160384 - DNA, 23 bp, Homo sapiens
tatgtgtatatatacgtatatat

SEQ ID NO: 160385 - DNA, 19 bp, Homo sapiens
tccatagtttatatggtgt

SEQ ID NO: 160386 - DNA, 23 bp, Homo sapiens
tgagttcattgtagattctggat

SEQ ID NO: 160387 - DNA, 23 bp, Homo sapiens
tgagttcattgtagattctggat

SEQ ID NO: 160388 - DNA, 23 bp, Homo sapiens
actctgtgcatatatatggaatg

SEQ ID NO: 160389 - DNA, 23 bp, Homo sapiens
gtgtatacatatgtatgtgtact

SEQ ID NO: 160390 - DNA, 22 bp, Homo sapiens
atatggtatatatgcaattcta

SEQ ID NO: 160391 - DNA, 23 bp, Homo sapiens
ttttggtagagatggggtttcac

SEQ ID NO: 160392 - DNA, 21 bp, Homo sapiens
ttatggtgtttttccaaatca

SEQ ID NO: 160393 - DNA, 22 bp, Homo sapiens
tagtggagttgctggatcatgt

SEQ ID NO: 160394 - DNA, 19 bp, Homo sapiens
tatgtgtgtgtgtgtatat

SEQ ID NO: 160395 - DNA, 21 bp, Homo sapiens
atatatgtatatatatgtgtg

SEQ ID NO: 160396 - DNA, 22 bp, Homo sapiens
acgtgcacaacgtgcaggttta

SEQ ID NO: 160397 - DNA, 23 bp, Homo sapiens
tatgtgccatgttggtgtgctgc

SEQ ID NO: 160398 - DNA, 23 bp, Homo sapiens
atgatgatgatgatgatgatgat

SEQ ID NO: 160399 - DNA, 23 bp, Homo sapiens
atgatgatgatgatgatgatgat

SEQ ID NO: 160400 - DNA, 22 bp, Homo sapiens
atgatgatgatgatgatgatga

SEQ ID NO: 160401 - DNA, 19 bp, Homo sapiens
atctcttgcttctctcagt

SEQ ID NO: 160402 - DNA, 23 bp, Homo sapiens
tcctagtctactgaatttcatat

SEQ ID NO: 160403 - DNA, 23 bp, Homo sapiens
cagggtttcactctgtcactcag

SEQ ID NO: 160404 - DNA, 23 bp, Homo sapiens
aaaagagcctgaagtgcagctta

SEQ ID NO: 160405 - DNA, 22 bp, Homo sapiens
ttagaatgtggttgatgtcagt

SEQ ID NO: 160406 - DNA, 22 bp, Homo sapiens
tgtgtgtatatgtatgtgtata

SEQ ID NO: 160407 - DNA, 23 bp, Homo sapiens
gtgtgtgtctgtctctccctggg

SEQ ID NO: 160408 - DNA, 21 bp, Homo sapiens
tatggaaaacttgctgaaact

SEQ ID NO: 160409 - DNA, 23 bp, Homo sapiens
tatctgtgagatatctcacaggt

SEQ ID NO: 160410 - DNA, 20 bp, Homo sapiens
tgaccttttcaatatatgac

SEQ ID NO: 160411 - DNA, 23 bp, Homo sapiens
tttgagacggagtctcactctgt

SEQ ID NO: 160412 - DNA, 23 bp, Homo sapiens
atagctaggttcagagttttgat

SEQ ID NO: 160413 - DNA, 21 bp, Homo sapiens
tagagtagagacggagcagtg

SEQ ID NO: 160414 - DNA, 23 bp, Homo sapiens
tcctttgtgtcttctgaggtgct

SEQ ID NO: 160415 - DNA, 23 bp, Homo sapiens
gtctcactctgtgtcccaggctg

SEQ ID NO: 160416 - DNA, 23 bp, Homo sapiens
agggtctctctctgagtgtgggt

SEQ ID NO: 160417 - DNA, 22 bp, Homo sapiens
ctgacagcctgcattgttctgc

SEQ ID NO: 160418 - DNA, 23 bp, Homo sapiens
agactcagtgtctttgatgtctg

SEQ ID NO: 160419 - DNA, 18 bp, Homo sapiens
caggcaccctgtttccca

SEQ ID NO: 160420 - DNA, 23 bp, Homo sapiens
gattgacttctgcttatggaaaa

SEQ ID NO: 160421 - DNA, 23 bp, Homo sapiens
gactgcactgtctgtctgtccgt

SEQ ID NO: 160422 - DNA, 23 bp, Homo sapiens
acaagagctcagtttgcaggaag

SEQ ID NO: 160423 - DNA, 21 bp, Homo sapiens
atgtgtatacatatagatgta

SEQ ID NO: 160424 - DNA, 22 bp, Homo sapiens
atatatgtgtatacgtatagat

SEQ ID NO: 160425 - DNA, 18 bp, Homo sapiens
tgtgtgtatatatgtgtg

SEQ ID NO: 160426 - DNA, 22 bp, Homo sapiens
atctttatatatatgtctgtgt

SEQ ID NO: 160427 - DNA, 23 bp, Homo sapiens
cggagtctcgctcgctctgtctc

SEQ ID NO: 160428 - DNA, 22 bp, Homo sapiens
ttatgaagaaggtattatagtt

SEQ ID NO: 160429 - DNA, 23 bp, Homo sapiens
agacagactctcgctctgtggcc

SEQ ID NO: 160430 - DNA, 23 bp, Homo sapiens
cggagtctcactctgtcacccag

SEQ ID NO: 160431 - DNA, 23 bp, Homo sapiens
tggagtctcactctgtcacccag

SEQ ID NO: 160432 - DNA, 22 bp, Homo sapiens
actctgtcacccaatctagagt

SEQ ID NO: 160433 - DNA, 23 bp, Homo sapiens
agggtctcactctgtcactcagg

SEQ ID NO: 160434 - DNA, 23 bp, Homo sapiens
tcaaagacgtaatagtgtatatg

SEQ ID NO: 160435 - DNA, 19 bp, Homo sapiens
tattcacactttttgtttt

SEQ ID NO: 160436 - DNA, 23 bp, Homo sapiens
gacagagtctccctctgtcaccc

SEQ ID NO: 160437 - DNA, 22 bp, Homo sapiens
tagcttatcagactgatgttga

SEQ ID NO: 160438 - DNA, 22 bp, Homo sapiens
ggctgtctgacattttggtatc

SEQ ID NO: 160439 - DNA, 23 bp, Homo sapiens
tggagtctcactctgtcacttag

SEQ ID NO: 160440 - DNA, 23 bp, Homo sapiens
tcctacagcaactgcatgtcttt

SEQ ID NO: 160441 - DNA, 23 bp, Homo sapiens
tccgtgtctgactcagtctgatg

SEQ ID NO: 160442 - DNA, 23 bp, Homo sapiens
cagctctcttacactgtctgtct

SEQ ID NO: 160443 - DNA, 21 bp, Homo sapiens
tgtggtagaaggctgtttact

SEQ ID NO: 160444 - DNA, 23 bp, Homo sapiens
tatgtatatgtatatgtgtgtgt

SEQ ID NO: 160445 - DNA, 23 bp, Homo sapiens
tacacacacacacatatacatat

SEQ ID NO: 160446 - DNA, 22 bp, Homo sapiens
tataagcagttattgtattact

SEQ ID NO: 160447 - DNA, 22 bp, Homo sapiens
taaagtctatatatatatgtgt

SEQ ID NO: 160448 - DNA, 20 bp, Homo sapiens
ttgagatggagtctctctct

SEQ ID NO: 160449 - DNA, 23 bp, Homo sapiens
tgtgtcagtggaaatctgaagta

SEQ ID NO: 160450 - DNA, 23 bp, Homo sapiens
agagtctcactctgtcacccagg

SEQ ID NO: 160451 - DNA, 23 bp, Homo sapiens
tgagttcattgtagattctggat

SEQ ID NO: 160452 - DNA, 23 bp, Homo sapiens
tgagttcattgtagattctggat

SEQ ID NO: 160453 - DNA, 23 bp, Homo sapiens
gctgaggtaggaggatcacttga

SEQ ID NO: 160454 - DNA, 23 bp, Homo sapiens
tatcttaccttttgtattctaag

SEQ ID NO: 160455 - DNA, 23 bp, Homo sapiens
ttttttgatatctagctgtttct

SEQ ID NO: 160456 - DNA, 23 bp, Homo sapiens
agaaggtttagaaaactgtgtgt

SEQ ID NO: 160457 - DNA, 23 bp, Homo sapiens
tctcacacacacacacagaagtt

SEQ ID NO: 160458 - DNA, 20 bp, Homo sapiens
agtcctttgtattctctgag

SEQ ID NO: 160459 - DNA, 18 bp, Homo sapiens
tctcgctctgtctcccag

SEQ ID NO: 160460 - DNA, 18 bp, Homo sapiens
tgagtagctgtctctctg

SEQ ID NO: 160461 - DNA, 23 bp, Homo sapiens
tgtttgactctgtgtctctgtgg

SEQ ID NO: 160462 - DNA, 22 bp, Homo sapiens
cacaggctgttacacagttagc

SEQ ID NO: 160463 - DNA, 21 bp, Homo sapiens
cacactcacacactctttctt

SEQ ID NO: 160464 - DNA, 23 bp, Homo sapiens
ggagtctcactctgtctcccagg

SEQ ID NO: 160465 - DNA, 23 bp, Homo sapiens
cagtgcagatcaaatgtttagat

SEQ ID NO: 160466 - DNA, 23 bp, Homo sapiens
gggtctgtctctgtcacccaggc

SEQ ID NO: 160467 - DNA, 21 bp, Homo sapiens
tgtgaagaaactcaatggtag

SEQ ID NO: 160468 - DNA, 23 bp, Homo sapiens
aaactatttcaggtagtgcactg

SEQ ID NO: 160469 - DNA, 23 bp, Homo sapiens
ggagtctcactctgtcactcagg

SEQ ID NO: 160470 - DNA, 23 bp, Homo sapiens
tatttcacagtgaaaataaggag

SEQ ID NO: 160471 - DNA, 23 bp, Homo sapiens
acaggtagctagtgattaccata

SEQ ID NO: 160472 - DNA, 22 bp, Homo sapiens
agagtgagaccttatctttaaa

SEQ ID NO: 160473 - DNA, 23 bp, Homo sapiens
tttgagactgagtctcactctgt

SEQ ID NO: 160474 - DNA, 23 bp, Homo sapiens
agggtctcactctgtcacccagg

SEQ ID NO: 160475 - DNA, 22 bp, Homo sapiens
agtgtgggtcgctccctctgtg

SEQ ID NO: 160476 - DNA, 22 bp, Homo sapiens
acagaggcaccctgtcttcttt

SEQ ID NO: 160477 - DNA, 23 bp, Homo sapiens
gagacagagtctccctctgtcac

SEQ ID NO: 160478 - DNA, 23 bp, Homo sapiens
tacgtgtatatgtatatatgtgt

SEQ ID NO: 160479 - DNA, 23 bp, Homo sapiens
cttctgactctgcctccctgtct

SEQ ID NO: 160480 - DNA, 23 bp, Homo sapiens
aagtcacagaacagacaggggtc

SEQ ID NO: 160481 - DNA, 23 bp, Homo sapiens
agtctgactgtgtgagttctccc

SEQ ID NO: 160482 - DNA, 19 bp, Homo sapiens
gacagccacacagtctcat

SEQ ID NO: 160483 - DNA, 23 bp, Homo sapiens
gattttgagaaatgtgtcaggtc

SEQ ID NO: 160484 - DNA, 20 bp, Homo sapiens
ttgggaagctgatgtagaga

SEQ ID NO: 160485 - DNA, 23 bp, Homo sapiens
ggagtctcactctgtcacccagg

SEQ ID NO: 160486 - DNA, 21 bp, Homo sapiens
ggtatctaaagttagcctgta

SEQ ID NO: 160487 - DNA, 18 bp, Homo sapiens
gacttcaatatgctgtat

SEQ ID NO: 160488 - DNA, 23 bp, Homo sapiens
agacagagtctcgctctgtcacc

SEQ ID NO: 160489 - DNA, 23 bp, Homo sapiens
tcactcgctgtgacagtcccaga

SEQ ID NO: 160490 - DNA, 23 bp, Homo sapiens
tttgtgtgtgaattaattctcct

SEQ ID NO: 160491 - DNA, 23 bp, Homo sapiens
acacacaacatatatatgtgtgt

SEQ ID NO: 160492 - DNA, 20 bp, Homo sapiens
atgtatgtgtgtatgtacat

SEQ ID NO: 160493 - DNA, 23 bp, Homo sapiens
tgcttctaggttgtaaaatttag

SEQ ID NO: 160494 - DNA, 23 bp, Homo sapiens
aattgtggaagtaattgttgtgt

SEQ ID NO: 160495 - DNA, 23 bp, Homo sapiens
gacagagtctcgctctgtcaccc

SEQ ID NO: 160496 - DNA, 23 bp, Homo sapiens
tctcagaagtgagagaagagcct

SEQ ID NO: 160497 - DNA, 23 bp, Homo sapiens
atggagtctcactctgtcaccca

SEQ ID NO: 160498 - DNA, 23 bp, Homo sapiens
ggagtctcactctgtctcctagg

SEQ ID NO: 160499 - DNA, 18 bp, Homo sapiens
tacagtggtgtgatctct

SEQ ID NO: 160500 - DNA, 23 bp, Homo sapiens
tgagttcattgtagattctggat

SEQ ID NO: 160501 - DNA, 23 bp, Homo sapiens
tgagttcattgtagattctggat

SEQ ID NO: 160502 - DNA, 21 bp, Homo sapiens
cttctgtgtctctgttgtacc

SEQ ID NO: 160503 - DNA, 23 bp, Homo sapiens
tatgtgtgtgtatatgtatatat

SEQ ID NO: 160504 - DNA, 22 bp, Homo sapiens
acactgtcacagcttagcagct

SEQ ID NO: 160505 - DNA, 20 bp, Homo sapiens
tcacacatgattcaggtgtc

SEQ ID NO: 160506 - DNA, 23 bp, Homo sapiens
tgtgcgtgtgtctgtctgtccat

SEQ ID NO: 160507 - DNA, 23 bp, Homo sapiens
cttaacagccacatcttgagtga

SEQ ID NO: 160508 - DNA, 23 bp, Homo sapiens
gacagagtctcgctctgtcaccc

SEQ ID NO: 160509 - DNA, 18 bp, Homo sapiens
ctgtgtgtgtgtgtgtga

SEQ ID NO: 160510 - DNA, 23 bp, Homo sapiens
tgcctgggtcccactttggcggc

SEQ ID NO: 160511 - DNA, 20 bp, Homo sapiens
tgaggtagtggtttgtttgt

SEQ ID NO: 160512 - DNA, 23 bp, Homo sapiens
tttgagacagggtctcactctgt

SEQ ID NO: 160513 - DNA, 23 bp, Homo sapiens
cccagtgactcaagaggctgagg

SEQ ID NO: 160514 - DNA, 23 bp, Homo sapiens
tgcctgcctgtgtccctgtctaa

SEQ ID NO: 160515 - DNA, 23 bp, Homo sapiens
gagatggagtctcactctgtcac

SEQ ID NO: 160516 - DNA, 19 bp, Homo sapiens
tctgtgtctgagtccctcc

SEQ ID NO: 160517 - DNA, 23 bp, Homo sapiens
tggagtctcactcactttgtcac

SEQ ID NO: 160518 - DNA, 23 bp, Homo sapiens
actatatgtatatgtatatatgt

SEQ ID NO: 160519 - DNA, 23 bp, Homo sapiens
ttagcatgtttttctgtcactct

SEQ ID NO: 160520 - DNA, 20 bp, Homo sapiens
agacagagtctcactatgtt

SEQ ID NO: 160521 - DNA, 23 bp, Homo sapiens
cggagtctcgctctgtcgctcag

SEQ ID NO: 160522 - DNA, 23 bp, Homo sapiens
caagttgatgccactgctgtctg

SEQ ID NO: 160523 - DNA, 23 bp, Homo sapiens
ggctcagtagtcagctcaatgct

SEQ ID NO: 160524 - DNA, 21 bp, Homo sapiens
ttctgctgtgtgcccaccctg

SEQ ID NO: 160525 - DNA, 23 bp, Homo sapiens
tcggtctcaggctcttctgtggc

SEQ ID NO: 160526 - DNA, 18 bp, Homo sapiens
aacgaagtccacactcac

SEQ ID NO: 160527 - DNA, 19 bp, Homo sapiens
cttgagataagattctgaa

SEQ ID NO: 160528 - DNA, 23 bp, Homo sapiens
ttttgcttaagtagctgtgtgat

SEQ ID NO: 160529 - DNA, 23 bp, Homo sapiens
tcatccttgtcattttcatgttg

SEQ ID NO: 160530 - DNA, 18 bp, Homo sapiens
tatgaaacggaagaatcg

SEQ ID NO: 160531 - DNA, 18 bp, Homo sapiens
ttcacagagcctaacatg

SEQ ID NO: 160532 - DNA, 23 bp, Homo sapiens
tctcactctgtcactcaggctgg

SEQ ID NO: 160533 - DNA, 19 bp, Homo sapiens
agtgagctataatcatgtc

SEQ ID NO: 160534 - DNA, 22 bp, Homo sapiens
acagttgggagtctgagacctg

SEQ ID NO: 160535 - DNA, 21 bp, Homo sapiens
tgtgtatatatatgtgtgtgt

SEQ ID NO: 160536 - DNA, 23 bp, Homo sapiens
gggtctcactctgtcacccaggc

SEQ ID NO: 160537 - DNA, 23 bp, Homo sapiens
tggaacactcactcactcatgta

SEQ ID NO: 160538 - DNA, 23 bp, Homo sapiens
tgagttcattgtagattctggat

SEQ ID NO: 160539 - DNA, 23 bp, Homo sapiens
tgagttcattgtagattctggat

SEQ ID NO: 160540 - DNA, 23 bp, Homo sapiens
tgagatcaaggtgtcagcctggt

SEQ ID NO: 160541 - DNA, 23 bp, Homo sapiens
attttcattccatttgatttgca

SEQ ID NO: 160542 - DNA, 23 bp, Homo sapiens
tctcatctggttcccataggtaa

SEQ ID NO: 160543 - DNA, 21 bp, Homo sapiens
tgtgtatatatatatatgtgt

SEQ ID NO: 160544 - DNA, 18 bp, Homo sapiens
ctatatatatatgtgtgt

SEQ ID NO: 160545 - DNA, 23 bp, Homo sapiens
tgtctgtgtgtgtgagcgcgtgt

SEQ ID NO: 160546 - DNA, 19 bp, Homo sapiens
atattagatgttgctgaca

SEQ ID NO: 160547 - DNA, 23 bp, Homo sapiens
tatgtgtctagttttgtggttct

SEQ ID NO: 160548 - DNA, 21 bp, Homo sapiens
atatgtgtatatatatgtgtg

SEQ ID NO: 160549 - DNA, 23 bp, Homo sapiens
tgagttcattgtagattctggat

SEQ ID NO: 160550 - DNA, 23 bp, Homo sapiens
tgagttcattgtagattctggat

SEQ ID NO: 160551 - DNA, 21 bp, Homo sapiens
aacttacagtggatcactttt

SEQ ID NO: 160552 - DNA, 21 bp, Homo sapiens
tatgtgtatatacatatgtgt

SEQ ID NO: 160553 - DNA, 22 bp, Homo sapiens
tatgtgtatatacatatatgtg

SEQ ID NO: 160554 - DNA, 22 bp, Homo sapiens
tatgtgtatatacatatatgtg

SEQ ID NO: 160555 - DNA, 22 bp, Homo sapiens
tatgtgtatatacatatatgtg

SEQ ID NO: 160556 - DNA, 21 bp, Homo sapiens
tatgtgtatatacatatgtgt

SEQ ID NO: 160557 - DNA, 22 bp, Homo sapiens
tatgtgtatatacatatatgtg

SEQ ID NO: 160558 - DNA, 22 bp, Homo sapiens
tatgtgtatatacatatatgtg

SEQ ID NO: 160559 - DNA, 22 bp, Homo sapiens
tatgtgtatatacatatatgtg

SEQ ID NO: 160560 - DNA, 22 bp, Homo sapiens
tatgtgtatatacatatatgtg

SEQ ID NO: 160561 - DNA, 22 bp, Homo sapiens
tatgtgtatatacatatatgtg

SEQ ID NO: 160562 - DNA, 22 bp, Homo sapiens
tatgtgtatatacatatatgtg

SEQ ID NO: 160563 - DNA, 22 bp, Homo sapiens
tatgtgtatatacatatatgtg

SEQ ID NO: 160564 - DNA, 19 bp, Homo sapiens
gtgtatatacatatatgtg

SEQ ID NO: 160565 - DNA, 23 bp, Homo sapiens
tacatgtgtgtatgtatatatgt

SEQ ID NO: 160566 - DNA, 21 bp, Homo sapiens
atgtgtatatacatatgtgta

SEQ ID NO: 160567 - DNA, 20 bp, Homo sapiens
gtacacatgtgtatatgtat

SEQ ID NO: 160568 - DNA, 18 bp, Homo sapiens
agaactacatatatgtat

SEQ ID NO: 160569 - DNA, 22 bp, Homo sapiens
agagtctcgctctgtcacccag

SEQ ID NO: 160570 - DNA, 20 bp, Homo sapiens
tgtgtagtatgtgtgtatgt

SEQ ID NO: 160571 - DNA, 19 bp, Homo sapiens
tctatgtatatatctatgt

SEQ ID NO: 160572 - DNA, 20 bp, Homo sapiens
atgatgagtgaaatacatca

SEQ ID NO: 160573 - DNA, 21 bp, Homo sapiens
gtgtgtatatatatatgtgca

SEQ ID NO: 160574 - DNA, 23 bp, Homo sapiens
gggtgcaatgttgtttgcatagg

SEQ ID NO: 160575 - DNA, 23 bp, Homo sapiens
tctctctctctttcttttgagac

SEQ ID NO: 160576 - DNA, 23 bp, Homo sapiens
acagtctcactctgtcatccagc

SEQ ID NO: 160577 - DNA, 23 bp, Homo sapiens
atatgtatatatgtatatatgtg

SEQ ID NO: 160578 - DNA, 23 bp, Homo sapiens
tatatgtatgaatatatacgtat

SEQ ID NO: 160579 - DNA, 21 bp, Homo sapiens
gtctcgctctgtcactcaggc

SEQ ID NO: 160580 - DNA, 23 bp, Homo sapiens
gagtctctgtctctcactccatc

SEQ ID NO: 160581 - DNA, 23 bp, Homo sapiens
tgggtctctgcctcagtgtctcc

SEQ ID NO: 160582 - DNA, 23 bp, Homo sapiens
aatcttggttgccagtcagcctg

SEQ ID NO: 160583 - DNA, 21 bp, Homo sapiens
agggacatgatgctgctggct

SEQ ID NO: 160584 - DNA, 19 bp, Homo sapiens
attggatatatataggata

SEQ ID NO: 160585 - DNA, 23 bp, Homo sapiens
tctgctcttggtccaagcactct

SEQ ID NO: 160586 - DNA, 23 bp, Homo sapiens
tgtatgcatgtatgtttgtatga

SEQ ID NO: 160587 - DNA, 22 bp, Homo sapiens
tatttacatgcacgtgtgcatg

SEQ ID NO: 160588 - DNA, 22 bp, Homo sapiens
tggtgggatgtatagttgtatg

SEQ ID NO: 160589 - DNA, 23 bp, Homo sapiens
atgtgtacatgtatagtgggatg

SEQ ID NO: 160590 - DNA, 23 bp, Homo sapiens
tgagatggactctcactctgtcg

SEQ ID NO: 160591 - DNA, 23 bp, Homo sapiens
agaccctctgtgtgtcatttagg

SEQ ID NO: 160592 - DNA, 23 bp, Homo sapiens
tgaataactaacttgtattgtgt

SEQ ID NO: 160593 - DNA, 20 bp, Homo sapiens
ggcagggtccctgcatgcca

SEQ ID NO: 160594 - DNA, 22 bp, Homo sapiens
gactctctctgactctgcccca

SEQ ID NO: 160595 - DNA, 23 bp, Homo sapiens
cggagtctcactctgtcacccag

SEQ ID NO: 160596 - DNA, 23 bp, Homo sapiens
tgagacagagtctcgctctgtca

SEQ ID NO: 160597 - DNA, 21 bp, Homo sapiens
tttctctctggctcactgacg

SEQ ID NO: 160598 - DNA, 18 bp, Homo sapiens
gcgctccctgtctcccag

SEQ ID NO: 160599 - DNA, 23 bp, Homo sapiens
gggtctgactagagggtctgcac

SEQ ID NO: 160600 - DNA, 19 bp, Homo sapiens
agaatagagaaaaagaaat

SEQ ID NO: 160601 - DNA, 23 bp, Homo sapiens
tgtagtggcatgatcttggctca

SEQ ID NO: 160602 - DNA, 21 bp, Homo sapiens
cccaaagtgctgggattgcag

SEQ ID NO: 160603 - DNA, 23 bp, Homo sapiens
ccagactgtctctgtctgcatga

SEQ ID NO: 160604 - DNA, 23 bp, Homo sapiens
tgcaactttactgaatgtgttga

SEQ ID NO: 160605 - DNA, 23 bp, Homo sapiens
tctctgtatgtctctatctgcta

SEQ ID NO: 160606 - DNA, 18 bp, Homo sapiens
aatggtgtgatcatagct

SEQ ID NO: 160607 - DNA, 23 bp, Homo sapiens
gggtctcactctgtcacttaggc

SEQ ID NO: 160608 - DNA, 18 bp, Homo sapiens
cagtggtgtgatcatagc

SEQ ID NO: 160609 - DNA, 23 bp, Homo sapiens
agctcactcagtctctcatagcc

SEQ ID NO: 160610 - DNA, 21 bp, Homo sapiens
acggtgtgatctctgctcact

SEQ ID NO: 160611 - DNA, 23 bp, Homo sapiens
gggtctcactctgtcactcaggc

SEQ ID NO: 160612 - DNA, 23 bp, Homo sapiens
atcctatgcctctctctctcttt

SEQ ID NO: 160613 - DNA, 21 bp, Homo sapiens
tgaggtagtaggatcatctga

SEQ ID NO: 160614 - DNA, 21 bp, Homo sapiens
tgagtctcacactgtcgccca

SEQ ID NO: 160615 - DNA, 18 bp, Homo sapiens
acagtggtgcgatctcag

SEQ ID NO: 160616 - DNA, 23 bp, Homo sapiens
gactgagtctcgctctgtcaccc

SEQ ID NO: 160617 - DNA, 23 bp, Homo sapiens
acacacacacatatatatgtgtg

SEQ ID NO: 160618 - DNA, 23 bp, Homo sapiens
tacacgtatatatatgtgtgtgt

SEQ ID NO: 160619 - DNA, 19 bp, Homo sapiens
cagagaacagagagagctg

SEQ ID NO: 160620 - DNA, 23 bp, Homo sapiens
acagtgaaccgaaatcatgccgt

SEQ ID NO: 160621 - DNA, 21 bp, Homo sapiens
atttggagaagagaggcactg

SEQ ID NO: 160622 - DNA, 23 bp, Homo sapiens
tcacttgctctctgagtgtcact

SEQ ID NO: 160623 - DNA, 23 bp, Homo sapiens
aggctgcctggctccctgggtcc

SEQ ID NO: 160624 - DNA, 23 bp, Homo sapiens
tggaacgctttgatgactgctgg

SEQ ID NO: 160625 - DNA, 23 bp, Homo sapiens
atggatctctgtatctttctctc

SEQ ID NO: 160626 - DNA, 23 bp, Homo sapiens
actgagagacaagagtgggaact

SEQ ID NO: 160627 - DNA, 22 bp, Homo sapiens
ctctcgctcacacaccccttgc

SEQ ID NO: 160628 - DNA, 22 bp, Homo sapiens
tcactgaaacctgtgcatcctg

SEQ ID NO: 160629 - DNA, 23 bp, Homo sapiens
tttctgagcaaattgcttgttta

SEQ ID NO: 160630 - DNA, 19 bp, Homo sapiens
cagcactgtgaccacacag

SEQ ID NO: 160631 - DNA, 23 bp, Homo sapiens
tgtgtgtgtatatatatatgaaa

SEQ ID NO: 160632 - DNA, 22 bp, Homo sapiens
tagtgcaatcacagctcacagc

SEQ ID NO: 160633 - DNA, 21 bp, Homo sapiens
tgcatatatatgtaaatctat

SEQ ID NO: 160634 - DNA, 20 bp, Homo sapiens
tatctatatatacatatctc

SEQ ID NO: 160635 - DNA, 23 bp, Homo sapiens
agagaggactgacagtggtctaa

SEQ ID NO: 160636 - DNA, 23 bp, Homo sapiens
tggagtctcactctgtcacccag

SEQ ID NO: 160637 - DNA, 23 bp, Homo sapiens
gaggctgagaaaagaatagctga

SEQ ID NO: 160638 - DNA, 23 bp, Homo sapiens
ttagagtcagggtctcactctgt

SEQ ID NO: 160639 - DNA, 23 bp, Homo sapiens
tgtctgtagtctcagctattcag

SEQ ID NO: 160640 - DNA, 23 bp, Homo sapiens
gagtttgagattcttaggagaat

SEQ ID NO: 160641 - DNA, 21 bp, Homo sapiens
atctgtgtacacattgtgtgc

SEQ ID NO: 160642 - DNA, 20 bp, Homo sapiens
atgtatgtgtccacgtgtat

SEQ ID NO: 160643 - DNA, 21 bp, Homo sapiens
actctctcgctgactcctacc

SEQ ID NO: 160644 - DNA, 23 bp, Homo sapiens
tgctgagtgtgtatatgtgtgtg

SEQ ID NO: 160645 - DNA, 18 bp, Homo sapiens
actggatgcagagcacct

SEQ ID NO: 160646 - DNA, 23 bp, Homo sapiens
cccagagtgtctctgacactccc

SEQ ID NO: 160647 - DNA, 21 bp, Homo sapiens
ctgtctgtctctctatccctg

SEQ ID NO: 160648 - DNA, 22 bp, Homo sapiens
tctgtctggatttcaacaggct

SEQ ID NO: 160649 - DNA, 23 bp, Homo sapiens
tgtctctgagtctcaaatcttct

SEQ ID NO: 160650 - DNA, 23 bp, Homo sapiens
acagctcactgctgtctctgtct

SEQ ID NO: 160651 - DNA, 23 bp, Homo sapiens
tatgcgtgtgtgcctgtgtgtgt

SEQ ID NO: 160652 - DNA, 20 bp, Homo sapiens
attgtagttcccctcgaagc

SEQ ID NO: 160653 - DNA, 22 bp, Homo sapiens
aatgaatatctgtatatgtgtg

SEQ ID NO: 160654 - DNA, 23 bp, Homo sapiens
ctgatataaatatatgtatatgt

SEQ ID NO: 160655 - DNA, 23 bp, Homo sapiens
tgttgaaagaactgaaagtggtc

SEQ ID NO: 160656 - DNA, 23 bp, Homo sapiens
agatggagtctcgctctgtctcc

SEQ ID NO: 160657 - DNA, 23 bp, Homo sapiens
gtagacactgtgaggtgtgggtg

SEQ ID NO: 160658 - DNA, 23 bp, Homo sapiens
cactggctctgtctctctgccaa

SEQ ID NO: 160659 - DNA, 23 bp, Homo sapiens
gatggactctcgctctgtcaccc

SEQ ID NO: 160660 - DNA, 23 bp, Homo sapiens
gcactgtcagggtgtgggagggg

SEQ ID NO: 160661 - DNA, 19 bp, Homo sapiens
ccctgatctgacagaggac

SEQ ID NO: 160662 - DNA, 23 bp, Homo sapiens
acagagtctcactctgtcgccca

SEQ ID NO: 160663 - DNA, 23 bp, Homo sapiens
ggagtctcactctgtctcccagg

SEQ ID NO: 160664 - DNA, 23 bp, Homo sapiens
agaagaaagagagctctgggagg

SEQ ID NO: 160665 - DNA, 23 bp, Homo sapiens
tgagacagtctcgctctgtcacc

SEQ ID NO: 160666 - DNA, 23 bp, Homo sapiens
cccactctgtctgcaagctacag

SEQ ID NO: 160667 - DNA, 23 bp, Homo sapiens
cggagtctcactctgtcacccag

SEQ ID NO: 160668 - DNA, 23 bp, Homo sapiens
aggttcacatactgtaattgtgt

SEQ ID NO: 160669 - DNA, 23 bp, Homo sapiens
tgagatggagtctcacactgtca

SEQ ID NO: 160670 - DNA, 19 bp, Homo sapiens
tcacctataggtaaggaga

SEQ ID NO: 160671 - DNA, 23 bp, Homo sapiens
ctccgtctgtctgtccctgggtt

SEQ ID NO: 160672 - DNA, 23 bp, Homo sapiens
tggagtctcactctgtcacccag

SEQ ID NO: 160673 - DNA, 23 bp, Homo sapiens
agcctctggctctgtgtggctgt

SEQ ID NO: 160674 - DNA, 23 bp, Homo sapiens
agatggagtctcactctgtcacc

SEQ ID NO: 160675 - DNA, 23 bp, Homo sapiens
cagaacactgagtgcacacacgg

SEQ ID NO: 160676 - DNA, 19 bp, Homo sapiens
cagagtgcagagtgaggac

SEQ ID NO: 160677 - DNA, 23 bp, Homo sapiens
ttacagactgtatactttgtaca

SEQ ID NO: 160678 - DNA, 22 bp, Homo sapiens
gccagagagtagagagttagct

SEQ ID NO: 160679 - DNA, 23 bp, Homo sapiens
tctgagtgcctctgtgcctgccc

SEQ ID NO: 160680 - DNA, 18 bp, Homo sapiens
cacggactctcacggaca

SEQ ID NO: 160681 - DNA, 20 bp, Homo sapiens
acagtgagcacacactccac

SEQ ID NO: 160682 - DNA, 23 bp, Homo sapiens
acaggagagtgtgagtgaagggc

SEQ ID NO: 160683 - DNA, 18 bp, Homo sapiens
gacagacatgctatgtct

SEQ ID NO: 160684 - DNA, 23 bp, Homo sapiens
ggagctctctctgtgcctgtggc

SEQ ID NO: 160685 - DNA, 23 bp, Homo sapiens
gagtggctccctccgtgtgtgcg

SEQ ID NO: 160686 - DNA, 23 bp, Homo sapiens
tcccagcctgcctggctgcctgg

SEQ ID NO: 160687 - DNA, 23 bp, Homo sapiens
agccactgtggatatgatctgaa

SEQ ID NO: 160688 - DNA, 23 bp, Homo sapiens
ggagtctcacactgtcacccagg

SEQ ID NO: 160689 - DNA, 23 bp, Homo sapiens
ggcctctctctgcctctgtccgg

SEQ ID NO: 160690 - DNA, 23 bp, Homo sapiens
ctgcttctgtgtctctgtgggtg

SEQ ID NO: 160691 - DNA, 21 bp, Homo sapiens
acagtgagacctcgtctcttt

SEQ ID NO: 160692 - DNA, 23 bp, Homo sapiens
ttgagacggagtctcactctgtc

SEQ ID NO: 160693 - DNA, 23 bp, Homo sapiens
gacagagtctcgctctctcaccc

SEQ ID NO: 160694 - DNA, 23 bp, Homo sapiens
tctgtccgtccgtctgtccacag

SEQ ID NO: 160695 - DNA, 23 bp, Homo sapiens
cctgtctgtctctctgagttgac

SEQ ID NO: 160696 - DNA, 23 bp, Homo sapiens
gtcactgcaacagcttctgcctc

SEQ ID NO: 160697 - DNA, 22 bp, Homo sapiens
tagatagatctagatagatata

SEQ ID NO: 160698 - DNA, 22 bp, Homo sapiens
agaggaagccagtgtgagtgag

SEQ ID NO: 160699 - DNA, 22 bp, Homo sapiens
cattcacacagagctttgggaa

SEQ ID NO: 160700 - DNA, 22 bp, Homo sapiens
gagacagtctggctctgtagcc

SEQ ID NO: 160701 - DNA, 23 bp, Homo sapiens
tgtttctctcttggtagagttgg

SEQ ID NO: 160702 - DNA, 23 bp, Homo sapiens
gagacagagtttcgctcttgttg

SEQ ID NO: 160703 - DNA, 23 bp, Homo sapiens
ccactgtttctagaagtctcttt

SEQ ID NO: 160704 - DNA, 18 bp, Homo sapiens
taatctagtggatatgat

SEQ ID NO: 160705 - DNA, 23 bp, Homo sapiens
tcagtctctctgtctccagagag

SEQ ID NO: 160706 - DNA, 23 bp, Homo sapiens
tcacaccctgtctgccttccacc

SEQ ID NO: 160707 - DNA, 23 bp, Homo sapiens
ctcagagaagatactgtggtgga

SEQ ID NO: 160708 - DNA, 23 bp, Homo sapiens
ttgcattcttttgaatttctgat

SEQ ID NO: 160709 - DNA, 23 bp, Homo sapiens
gacagagtctcgctctgtcaccc

SEQ ID NO: 160710 - DNA, 23 bp, Homo sapiens
tgagacggagtctcgctgtgtct

SEQ ID NO: 160711 - DNA, 23 bp, Homo sapiens
actgagtcccgcagacttggctg

SEQ ID NO: 160712 - DNA, 19 bp, Homo sapiens
ctctcgctctgtcacccag

SEQ ID NO: 160713 - DNA, 23 bp, Homo sapiens
tgtgtgtatatatatgtgtgtgt

SEQ ID NO: 160714 - DNA, 23 bp, Homo sapiens
ggcctgagtgtctgtgtgcattc

SEQ ID NO: 160715 - DNA, 23 bp, Homo sapiens
cacatctgtgtgtgtgtgtacat

SEQ ID NO: 160716 - DNA, 22 bp, Homo sapiens
ccctgcctgtgttcctgccgtt

SEQ ID NO: 160717 - DNA, 23 bp, Homo sapiens
tccagcatcagtgattttgttga

SEQ ID NO: 160718 - DNA, 20 bp, Homo sapiens
gccagtgactgggtgagcag

SEQ ID NO: 160719 - DNA, 23 bp, Homo sapiens
actgactctctgtgtgtagggaa

SEQ ID NO: 160720 - DNA, 23 bp, Homo sapiens
gtgactctctgtgaccctgagca

SEQ ID NO: 160721 - DNA, 23 bp, Homo sapiens
agagtctcactctgtcacccagg

SEQ ID NO: 160722 - DNA, 20 bp, Homo sapiens
ggtctgtgatgaggctgagg

SEQ ID NO: 160723 - DNA, 21 bp, Homo sapiens
ttgagacagagtctcgctctg

SEQ ID NO: 160724 - DNA, 18 bp, Homo sapiens
ttttgagagggagtcttg

SEQ ID NO: 160725 - DNA, 23 bp, Homo sapiens
agtaacctttcgctgctattcat

SEQ ID NO: 160726 - DNA, 23 bp, Homo sapiens
aatgtttagacaatgtgttgtag

SEQ ID NO: 160727 - DNA, 23 bp, Homo sapiens
acagagctcagactggctgtgtg

SEQ ID NO: 160728 - DNA, 22 bp, Homo sapiens
tgagacagagtctcgctctgtc

SEQ ID NO: 160729 - DNA, 21 bp, Homo sapiens
tgagacagagtctcgctctct

SEQ ID NO: 160730 - DNA, 23 bp, Homo sapiens
gacagagtctcgctctgtcaccc

SEQ ID NO: 160731 - DNA, 21 bp, Homo sapiens
tcacaggctctgtctttgcga

SEQ ID NO: 160732 - DNA, 23 bp, Homo sapiens
tgtgatcttggcttattgcaaat

SEQ ID NO: 160733 - DNA, 23 bp, Homo sapiens
acagagtctcactctgtcgccca

SEQ ID NO: 160734 - DNA, 23 bp, Homo sapiens
tgagatggagtcccactctgtca

SEQ ID NO: 160735 - DNA, 21 bp, Homo sapiens
agacagaagaaagattggaag

SEQ ID NO: 160736 - DNA, 18 bp, Homo sapiens
cagtctgtgtctgtctga

SEQ ID NO: 160737 - DNA, 23 bp, Homo sapiens
atgagtgtgcctgtgagtgtgcc

SEQ ID NO: 160738 - DNA, 19 bp, Homo sapiens
cattagtggtcagtctgca

SEQ ID NO: 160739 - DNA, 23 bp, Homo sapiens
tctctgtctctgtgggtctgcct

SEQ ID NO: 160740 - DNA, 23 bp, Homo sapiens
tgtgcatccatgtgtgtctgtgt

SEQ ID NO: 160741 - DNA, 23 bp, Homo sapiens
atgtaggtgtatgtgtgcatcca

SEQ ID NO: 160742 - DNA, 22 bp, Homo sapiens
tctcagccagtgtctctctctc

SEQ ID NO: 160743 - DNA, 18 bp, Homo sapiens
ttcgtcttgagggactct

SEQ ID NO: 160744 - DNA, 23 bp, Homo sapiens
cgagtctcactctgtctcccagg

SEQ ID NO: 160745 - DNA, 19 bp, Homo sapiens
aggttgcagtgagccgaga

SEQ ID NO: 160746 - DNA, 21 bp, Homo sapiens
gggtgacactgtgagactctg

SEQ ID NO: 160747 - DNA, 23 bp, Homo sapiens
ggttctgtcactgactgactggt

SEQ ID NO: 160748 - DNA, 23 bp, Homo sapiens
tcactgcgtgtcactgtgcctct

SEQ ID NO: 160749 - DNA, 23 bp, Homo sapiens
acagggactgcatgtcttgtgag

SEQ ID NO: 160750 - DNA, 23 bp, Homo sapiens
acagggctgtgtgtgtgtgtgtg

SEQ ID NO: 160751 - DNA, 22 bp, Homo sapiens
cagacacacaaacctgtggctg

SEQ ID NO: 160752 - DNA, 20 bp, Homo sapiens
aaactccaactcaatggact

SEQ ID NO: 160753 - DNA, 23 bp, Homo sapiens
tttgagatggagtcttgctctgt

SEQ ID NO: 160754 - DNA, 22 bp, Homo sapiens
tgcctctgtctctttgttctgt

SEQ ID NO: 160755 - DNA, 18 bp, Homo sapiens
tagtgagaccctgtctct

SEQ ID NO: 160756 - DNA, 23 bp, Homo sapiens
ttttgagacggagtcttactctg

SEQ ID NO: 160757 - DNA, 22 bp, Homo sapiens
aacagagtctccctctgtcgcc

SEQ ID NO: 160758 - DNA, 21 bp, Homo sapiens
ttgagtcagtgactgttgttt

SEQ ID NO: 160759 - DNA, 23 bp, Homo sapiens
atagactctgacttcttgctgtg

SEQ ID NO: 160760 - DNA, 23 bp, Homo sapiens
ctgtctcgcaagcatgtgtctct

SEQ ID NO: 160761 - DNA, 21 bp, Homo sapiens
ggttcattcactacctgttct

SEQ ID NO: 160762 - DNA, 21 bp, Homo sapiens
tgtgtgtgtatatatatgtgt

SEQ ID NO: 160763 - DNA, 23 bp, Homo sapiens
atgtgtatgtatatgtatatgtg

SEQ ID NO: 160764 - DNA, 23 bp, Homo sapiens
ctccctctgtggttccagcttgt

SEQ ID NO: 160765 - DNA, 22 bp, Homo sapiens
acagtagtctgcagtaatgtat

SEQ ID NO: 160766 - DNA, 19 bp, Homo sapiens
ttctgtgttgctgttgcca

SEQ ID NO: 160767 - DNA, 21 bp, Homo sapiens
tgagagaagtgtgtgtgcata

SEQ ID NO: 160768 - DNA, 23 bp, Homo sapiens
gtgtgcatgtttctatgtgtgtg

SEQ ID NO: 160769 - DNA, 23 bp, Homo sapiens
tgagacagagtctggctgtgttg

SEQ ID NO: 160770 - DNA, 23 bp, Homo sapiens
tgagatggagtctcgctctgtca

SEQ ID NO: 160771 - DNA, 23 bp, Homo sapiens
agagtctcactctgtcacccagg

SEQ ID NO: 160772 - DNA, 20 bp, Homo sapiens
tctgatgcagactgtgctgt

SEQ ID NO: 160773 - DNA, 18 bp, Homo sapiens
tggcagagaccatccctc

SEQ ID NO: 160774 - DNA, 23 bp, Homo sapiens
tgtgtcaatcactgtcagcttca

SEQ ID NO: 160775 - DNA, 23 bp, Homo sapiens
tttgagacggagtctggctctgt

SEQ ID NO: 160776 - DNA, 20 bp, Homo sapiens
actcagcctctctgtgcctc

SEQ ID NO: 160777 - DNA, 22 bp, Homo sapiens
gggagtgtcagagacactctgg

SEQ ID NO: 160778 - DNA, 18 bp, Homo sapiens
atccaggtgctctgcatc

SEQ ID NO: 160779 - DNA, 22 bp, Homo sapiens
agttccagcgttgagtgggcga

SEQ ID NO: 160780 - DNA, 23 bp, Homo sapiens
tcgtacctgctgtgataaagatg

SEQ ID NO: 160781 - DNA, 19 bp, Homo sapiens
tgtaggagtttgatgattc

SEQ ID NO: 160782 - DNA, 23 bp, Homo sapiens
ttatatctgctatggtgatctgt

SEQ ID NO: 160783 - DNA, 23 bp, Homo sapiens
tttgagacggagtctggctctgt

SEQ ID NO: 160784 - DNA, 21 bp, Homo sapiens
tttgagacagagtctcactct

SEQ ID NO: 160785 - DNA, 23 bp, Homo sapiens
cgctgtgtgcctatctctagtta

SEQ ID NO: 160786 - DNA, 21 bp, Homo sapiens
aagagcctctcacagactctg

SEQ ID NO: 160787 - DNA, 23 bp, Homo sapiens
tgagatggagtctcactctgtcg

SEQ ID NO: 160788 - DNA, 23 bp, Homo sapiens
gagtctcactctgtcacccaggc

SEQ ID NO: 160789 - DNA, 19 bp, Homo sapiens
caagacttggctatttgtt

SEQ ID NO: 160790 - DNA, 23 bp, Homo sapiens
tgttttgaggtggagtctcgctc

SEQ ID NO: 160791 - DNA, 23 bp, Homo sapiens
tctctgcgtctgtctgtctgcat

SEQ ID NO: 160792 - DNA, 21 bp, Homo sapiens
tttgagatggagtcttgctct

SEQ ID NO: 160793 - DNA, 22 bp, Homo sapiens
aaagtaaggaagagtcaaccca

SEQ ID NO: 160794 - DNA, 21 bp, Homo sapiens
ctggtcttgaactcgtggtct

SEQ ID NO: 160795 - DNA, 23 bp, Homo sapiens
gagacagagtctcactccgtcac

SEQ ID NO: 160796 - DNA, 22 bp, Homo sapiens
aaagtcctagtccttttctaaa

SEQ ID NO: 160797 - DNA, 23 bp, Homo sapiens
aggcagagtctggctgtgttgtg

SEQ ID NO: 160798 - DNA, 19 bp, Homo sapiens
tttgagacggagttttgct

SEQ ID NO: 160799 - DNA, 20 bp, Homo sapiens
tgtatatatatatatgtgta

SEQ ID NO: 160800 - DNA, 19 bp, Homo sapiens
atatgtatgtatatatata

SEQ ID NO: 160801 - DNA, 22 bp, Homo sapiens
gacagagtgaaaccctgtctct

SEQ ID NO: 160802 - DNA, 23 bp, Homo sapiens
agatggagtctcactgtgtcacc

SEQ ID NO: 160803 - DNA, 19 bp, Homo sapiens
tcagatcactgcaagctct

SEQ ID NO: 160804 - DNA, 23 bp, Homo sapiens
tgtgtgactggcttccttcactc

SEQ ID NO: 160805 - DNA, 23 bp, Homo sapiens
agacagagtctcactctgtcgct

SEQ ID NO: 160806 - DNA, 19 bp, Homo sapiens
ctgaggctctgagagggcc

SEQ ID NO: 160807 - DNA, 21 bp, Homo sapiens
tgtgtcagaaaaaacatgtga

SEQ ID NO: 160808 - DNA, 23 bp, Homo sapiens
tttcatgagtgcaactccctgtg

SEQ ID NO: 160809 - DNA, 23 bp, Homo sapiens
gagtgctgagtgagaacagaagg

SEQ ID NO: 160810 - DNA, 21 bp, Homo sapiens
tatacacacatatatatgtgt

SEQ ID NO: 160811 - DNA, 23 bp, Homo sapiens
agatggagtctcgctctgtcacc

SEQ ID NO: 160812 - DNA, 21 bp, Homo sapiens
gagtctcgctctgtccctcag

SEQ ID NO: 160813 - DNA, 23 bp, Homo sapiens
aagtgctagattacaggtgtcag

SEQ ID NO: 160814 - DNA, 19 bp, Homo sapiens
cagagtctcactcacccag

SEQ ID NO: 160815 - DNA, 23 bp, Homo sapiens
acagtgtctcactctgtctctca

SEQ ID NO: 160816 - DNA, 20 bp, Homo sapiens
tcactgcaacctctttctcc

SEQ ID NO: 160817 - DNA, 23 bp, Homo sapiens
tcccactgtccctcactggctcg

SEQ ID NO: 160818 - DNA, 21 bp, Homo sapiens
agagactcagcaaagggagag

SEQ ID NO: 160819 - DNA, 23 bp, Homo sapiens
ttctaagtggctgggaatctttt

SEQ ID NO: 160820 - DNA, 22 bp, Homo sapiens
acgcgcatctctgtgagcatgg

SEQ ID NO: 160821 - DNA, 23 bp, Homo sapiens
ggaactctgtctctcatggatgt

SEQ ID NO: 160822 - DNA, 23 bp, Homo sapiens
agcacagccaggtttgaagtgag

SEQ ID NO: 160823 - DNA, 23 bp, Homo sapiens
ttctgtattcactcattttctag

SEQ ID NO: 160824 - DNA, 23 bp, Homo sapiens
acagagtctcactctgtcgccca

SEQ ID NO: 160825 - DNA, 21 bp, Homo sapiens
caatgtccgcttcctgctcct

SEQ ID NO: 160826 - DNA, 21 bp, Homo sapiens
tgaggtggaaggatctattga

SEQ ID NO: 160827 - DNA, 23 bp, Homo sapiens
cagtgtctcactctgtctgccac

SEQ ID NO: 160828 - DNA, 23 bp, Homo sapiens
tattgctggatttgatttgctaa

SEQ ID NO: 160829 - DNA, 20 bp, Homo sapiens
aaagcctctgtcatggaaat

SEQ ID NO: 160830 - DNA, 23 bp, Homo sapiens
ttttctgaggcagagtctcgctc

SEQ ID NO: 160831 - DNA, 18 bp, Homo sapiens
cacccagtcttcatagca

SEQ ID NO: 160832 - DNA, 18 bp, Homo sapiens
tctgggccaagatagaag

SEQ ID NO: 160833 - DNA, 23 bp, Homo sapiens
cagactcactcactcactcttct

SEQ ID NO: 160834 - DNA, 23 bp, Homo sapiens
gaatgtggctggtttctcactct

SEQ ID NO: 160835 - DNA, 23 bp, Homo sapiens
tccctctccaccagcagctccat

SEQ ID NO: 160836 - DNA, 23 bp, Homo sapiens
agttgacttgtgtcacactcatc

SEQ ID NO: 160837 - DNA, 20 bp, Homo sapiens
ctgaccctccatctctctgt

SEQ ID NO: 160838 - DNA, 19 bp, Homo sapiens
agtgcagggactgtcagct

SEQ ID NO: 160839 - DNA, 18 bp, Homo sapiens
tatgtatatgtatatgtt

SEQ ID NO: 160840 - DNA, 19 bp, Homo sapiens
atatgtatatatgtatatg

SEQ ID NO: 160841 - DNA, 19 bp, Homo sapiens
taattacgttgaatattta

SEQ ID NO: 160842 - DNA, 22 bp, Homo sapiens
ttgagaccaggtcttgctctgt

SEQ ID NO: 160843 - DNA, 23 bp, Homo sapiens
gcttctgtctctctgtccgtgag

SEQ ID NO: 160844 - DNA, 23 bp, Homo sapiens
tgagatggagtctcactctgtcg

SEQ ID NO: 160845 - DNA, 19 bp, Homo sapiens
gagtctccctctgtggctc

SEQ ID NO: 160846 - DNA, 23 bp, Homo sapiens
tgcagaatcccatttctcagtgt

SEQ ID NO: 160847 - DNA, 23 bp, Homo sapiens
atatgacagaagtgagacaagac

SEQ ID NO: 160848 - DNA, 23 bp, Homo sapiens
tacatcactcactttcacaactg

SEQ ID NO: 160849 - DNA, 23 bp, Homo sapiens
tgacagagcgagatcctgtctca

SEQ ID NO: 160850 - DNA, 23 bp, Homo sapiens
tgagacagagtctcgctctgtgg

SEQ ID NO: 160851 - DNA, 18 bp, Homo sapiens
tctctctctcattcatat

SEQ ID NO: 160852 - DNA, 20 bp, Homo sapiens
gtctcgctctgtcactcaag

SEQ ID NO: 160853 - DNA, 19 bp, Homo sapiens
tgcagtggcatgatcttgg

SEQ ID NO: 160854 - DNA, 18 bp, Homo sapiens
tgtgcatacatttgggtg

SEQ ID NO: 160855 - DNA, 23 bp, Homo sapiens
gtatgtatatgtatgtgtatgta

SEQ ID NO: 160856 - DNA, 23 bp, Homo sapiens
actgagtctcgctctgtcaccca

SEQ ID NO: 160857 - DNA, 23 bp, Homo sapiens
gacagagtctcactgtgtcaccc

SEQ ID NO: 160858 - DNA, 21 bp, Homo sapiens
agtctcgctccgtcactctgt

SEQ ID NO: 160859 - DNA, 19 bp, Homo sapiens
gtgccatggtgtgatatcg

SEQ ID NO: 160860 - DNA, 22 bp, Homo sapiens
acactcactctcccagtgtcta

SEQ ID NO: 160861 - DNA, 20 bp, Homo sapiens
tcctgctccagcagcacctg

SEQ ID NO: 160862 - DNA, 23 bp, Homo sapiens
ctgtgtctcacacagtgtgaagt

SEQ ID NO: 160863 - DNA, 23 bp, Homo sapiens
ctgtgtgtctgtgagtggctctc

SEQ ID NO: 160864 - DNA, 21 bp, Homo sapiens
agtgagcgttaatgttctgta

SEQ ID NO: 160865 - DNA, 22 bp, Homo sapiens
tggagtctcgctctgtcaccca

SEQ ID NO: 160866 - DNA, 23 bp, Homo sapiens
agactctcactctgtcacccagg

SEQ ID NO: 160867 - DNA, 23 bp, Homo sapiens
acctacagtcccagctactcagg

SEQ ID NO: 160868 - DNA, 22 bp, Homo sapiens
aaggctgtgcctctctccctct

SEQ ID NO: 160869 - DNA, 19 bp, Homo sapiens
gaacaattcacagtctagt

SEQ ID NO: 160870 - DNA, 23 bp, Homo sapiens
atatacctattatatgtatacat

SEQ ID NO: 160871 - DNA, 23 bp, Homo sapiens
ctctctgcctgactctgaattca

SEQ ID NO: 160872 - DNA, 23 bp, Homo sapiens
aaatcctgcagctgacattcaat

SEQ ID NO: 160873 - DNA, 18 bp, Homo sapiens
attttttcttagaaaagg

SEQ ID NO: 160874 - DNA, 23 bp, Homo sapiens
ccaagagattgtgaaacttgctg

SEQ ID NO: 160875 - DNA, 22 bp, Homo sapiens
gggagagtagaaagatcataag

SEQ ID NO: 160876 - DNA, 20 bp, Homo sapiens
ggtggtggtggtggtggttg

SEQ ID NO: 160877 - DNA, 23 bp, Homo sapiens
ccattagttatcagtagcatttc

SEQ ID NO: 160878 - DNA, 22 bp, Homo sapiens
tcagtagatccaagtctcgggg

SEQ ID NO: 160879 - DNA, 23 bp, Homo sapiens
tgtaaccattttaaatctctatc

SEQ ID NO: 160880 - DNA, 23 bp, Homo sapiens
attctgtgaagaaagttagtggt

SEQ ID NO: 160881 - DNA, 21 bp, Homo sapiens
tgtgtatatatgtatatatgt

SEQ ID NO: 160882 - DNA, 23 bp, Homo sapiens
tttttttttaagttgctgtatga

SEQ ID NO: 160883 - DNA, 23 bp, Homo sapiens
tgtatatatgtatgcatatgtgt

SEQ ID NO: 160884 - DNA, 22 bp, Homo sapiens
atatgcacatgtatacatatgt

SEQ ID NO: 160885 - DNA, 19 bp, Homo sapiens
ctctctctctgtatataca

SEQ ID NO: 160886 - DNA, 21 bp, Homo sapiens
tcactctttttctgtcacact

SEQ ID NO: 160887 - DNA, 23 bp, Homo sapiens
gtatatatgtgtgtgtgtgtaca

SEQ ID NO: 160888 - DNA, 21 bp, Homo sapiens
tatgtgtgtatatatatgtgt

SEQ ID NO: 160889 - DNA, 21 bp, Homo sapiens
tatttggatattttgaaaggg

SEQ ID NO: 160890 - DNA, 23 bp, Homo sapiens
acctgttgctcacactgtctcac

SEQ ID NO: 160891 - DNA, 23 bp, Homo sapiens
tggagtctcactctgtcacccag

SEQ ID NO: 160892 - DNA, 23 bp, Homo sapiens
agtgtgttgaatgaatgagattt

SEQ ID NO: 160893 - DNA, 23 bp, Homo sapiens
acacacacatatatatactgtga

SEQ ID NO: 160894 - DNA, 23 bp, Homo sapiens
tttatatatatgtgcaggtgtgt

SEQ ID NO: 160895 - DNA, 19 bp, Homo sapiens
gtgtggtatgtgtgagata

SEQ ID NO: 160896 - DNA, 23 bp, Homo sapiens
tgagttcattgtagattctggat

SEQ ID NO: 160897 - DNA, 23 bp, Homo sapiens
tgagttcattgtagattctggat

SEQ ID NO: 160898 - DNA, 20 bp, Homo sapiens
tgagcttttgttttagagaa

SEQ ID NO: 160899 - DNA, 20 bp, Homo sapiens
atacgtatatatatatgtgt

SEQ ID NO: 160900 - DNA, 23 bp, Homo sapiens
tcacagtctgacttgttctgttc

SEQ ID NO: 160901 - DNA, 23 bp, Homo sapiens
cagaataaacagattctgatctg

SEQ ID NO: 160902 - DNA, 20 bp, Homo sapiens
gtctgcctctctgcctattt

SEQ ID NO: 160903 - DNA, 23 bp, Homo sapiens
tacacacacgtgtgtgtgcacat

SEQ ID NO: 160904 - DNA, 20 bp, Homo sapiens
tttcagcttttaaattctgg

SEQ ID NO: 160905 - DNA, 23 bp, Homo sapiens
acacacacgtatgtatatgtata

SEQ ID NO: 160906 - DNA, 23 bp, Homo sapiens
tttaagagattatctgcatgaga

SEQ ID NO: 160907 - DNA, 23 bp, Homo sapiens
taaatgtctatagtgatactgta

SEQ ID NO: 160908 - DNA, 21 bp, Homo sapiens
tggagtctcgctcagtcaccc

SEQ ID NO: 160909 - DNA, 20 bp, Homo sapiens
acaatggcacttaatgtcct

SEQ ID NO: 160910 - DNA, 18 bp, Homo sapiens
tgttcttttatctatcta

SEQ ID NO: 160911 - DNA, 21 bp, Homo sapiens
tttgtgtgggtacatagtagg

SEQ ID NO: 160912 - DNA, 22 bp, Homo sapiens
ttgttagatagagataacggaa

SEQ ID NO: 160913 - DNA, 23 bp, Homo sapiens
tgagtctcactctgtcacccagg

SEQ ID NO: 160914 - DNA, 22 bp, Homo sapiens
aaagacagggaaggatttcaat

SEQ ID NO: 160915 - DNA, 18 bp, Homo sapiens
tggatatatatatggata

SEQ ID NO: 160916 - DNA, 20 bp, Homo sapiens
aaactgaagtcagtccacaa

SEQ ID NO: 160917 - DNA, 21 bp, Homo sapiens
atatatgtgtgtatatatacg

SEQ ID NO: 160918 - DNA, 23 bp, Homo sapiens
tatgtgtatatatatatgtgtgt

SEQ ID NO: 160919 - DNA, 21 bp, Homo sapiens
tatgtgtatatatatgtgtgt

SEQ ID NO: 160920 - DNA, 22 bp, Homo sapiens
gattcttcagtgcttatgatga

SEQ ID NO: 160921 - DNA, 23 bp, Homo sapiens
cagttccttgtatagtctggata

SEQ ID NO: 160922 - DNA, 18 bp, Homo sapiens
ccttgtaggatgaatagt

SEQ ID NO: 160923 - DNA, 23 bp, Homo sapiens
ctttcatgtatatttctttactt

SEQ ID NO: 160924 - DNA, 22 bp, Homo sapiens
tctcaagtagttgggactacag

SEQ ID NO: 160925 - DNA, 23 bp, Homo sapiens
tgagttcattgtagattctggat

SEQ ID NO: 160926 - DNA, 23 bp, Homo sapiens
tgagttcattgtagattctggat

SEQ ID NO: 160927 - DNA, 23 bp, Homo sapiens
ggagtctccctctgtcaccctgg

SEQ ID NO: 160928 - DNA, 23 bp, Homo sapiens
tgtccctttttattggtgtggta

SEQ ID NO: 160929 - DNA, 23 bp, Homo sapiens
gttctttttgcctaggattgtct

SEQ ID NO: 160930 - DNA, 23 bp, Homo sapiens
tctaattctatgaagaaagtcaa

SEQ ID NO: 160931 - DNA, 22 bp, Homo sapiens
tgtgtgtgtgtatatatccata

SEQ ID NO: 160932 - DNA, 23 bp, Homo sapiens
tatatgtgcaggatgtgcaggtt

SEQ ID NO: 160933 - DNA, 18 bp, Homo sapiens
tatgtatatatgtgtgta

SEQ ID NO: 160934 - DNA, 23 bp, Homo sapiens
tatgtgtatatatgcatgtgtgt

SEQ ID NO: 160935 - DNA, 21 bp, Homo sapiens
atatatgcatatatgtgtgta

SEQ ID NO: 160936 - DNA, 23 bp, Homo sapiens
gtatatatgcatatatgtgtgta

SEQ ID NO: 160937 - DNA, 20 bp, Homo sapiens
ggtatatatgcatgtgtgta

SEQ ID NO: 160938 - DNA, 23 bp, Homo sapiens
gcctgtggctctcagtttctctg

SEQ ID NO: 160939 - DNA, 23 bp, Homo sapiens
cggagtctcactctgtcacccag

SEQ ID NO: 160940 - DNA, 23 bp, Homo sapiens
gagtctcactctgtcacccaggc

SEQ ID NO: 160941 - DNA, 18 bp, Homo sapiens
ctagagtgaagtggcatg

SEQ ID NO: 160942 - DNA, 21 bp, Homo sapiens
actctgtagattgctttgggt

SEQ ID NO: 160943 - DNA, 20 bp, Homo sapiens
agacagagttgctctattgc

SEQ ID NO: 160944 - DNA, 23 bp, Homo sapiens
gtccctgcgtccctgcgtccctc

SEQ ID NO: 160945 - DNA, 18 bp, Homo sapiens
tatattgttaatgaagtt

SEQ ID NO: 160946 - DNA, 23 bp, Homo sapiens
tagcacctagtcctttgctaaca

SEQ ID NO: 160947 - DNA, 23 bp, Homo sapiens
tttgagacagggtcttgttgtgt

SEQ ID NO: 160948 - DNA, 21 bp, Homo sapiens
tataggagattatgtttaact

SEQ ID NO: 160949 - DNA, 22 bp, Homo sapiens
aaagtgagaccctgtctttttt

SEQ ID NO: 160950 - DNA, 21 bp, Homo sapiens
tgtgtatatatatatatgtac

SEQ ID NO: 160951 - DNA, 22 bp, Homo sapiens
tatgtgtatatatgtgtgtgtg

SEQ ID NO: 160952 - DNA, 23 bp, Homo sapiens
catatgtcactgattcaataggc

SEQ ID NO: 160953 - DNA, 22 bp, Homo sapiens
atatgtatgtagatataggtat

SEQ ID NO: 160954 - DNA, 22 bp, Homo sapiens
atacatctacatatatatagat

SEQ ID NO: 160955 - DNA, 20 bp, Homo sapiens
taacagctagtgccacagga

SEQ ID NO: 160956 - DNA, 23 bp, Homo sapiens
agagatgggttctcactctgtca

SEQ ID NO: 160957 - DNA, 22 bp, Homo sapiens
tttgacagggtctcactctgtc

SEQ ID NO: 160958 - DNA, 23 bp, Homo sapiens
ggtggtctctcactcagtgtggc

SEQ ID NO: 160959 - DNA, 21 bp, Homo sapiens
gtgagccactgtgcctggcag

SEQ ID NO: 160960 - DNA, 18 bp, Homo sapiens
gcaatggtgtgatcttgg

SEQ ID NO: 160961 - DNA, 23 bp, Homo sapiens
tgggacggagtctcactctgtgg

SEQ ID NO: 160962 - DNA, 23 bp, Homo sapiens
attcaagatggagtcgctctggt

SEQ ID NO: 160963 - DNA, 21 bp, Homo sapiens
tgacacactgagtaactgggc

SEQ ID NO: 160964 - DNA, 21 bp, Homo sapiens
ctgggccactctgtccctgtg

SEQ ID NO: 160965 - DNA, 21 bp, Homo sapiens
tatatgtatatatgcgtatgt

SEQ ID NO: 160966 - DNA, 23 bp, Homo sapiens
tggctggctgtgtcccactgttg

SEQ ID NO: 160967 - DNA, 18 bp, Homo sapiens
atgagtccagctgtttcc

SEQ ID NO: 160968 - DNA, 23 bp, Homo sapiens
tgacacactgagtgaatgaggca

SEQ ID NO: 160969 - DNA, 21 bp, Homo sapiens
tgaggtaggaggatcacttga

SEQ ID NO: 160970 - DNA, 20 bp, Homo sapiens
agaggagtgtggggacttgt

SEQ ID NO: 160971 - DNA, 22 bp, Homo sapiens
taagctcacgcactgagtcact

SEQ ID NO: 160972 - DNA, 23 bp, Homo sapiens
tttgagacggtgtctcactccgt

SEQ ID NO: 160973 - DNA, 23 bp, Homo sapiens
ggtgctttgtgggttctctctct

SEQ ID NO: 160974 - DNA, 23 bp, Homo sapiens
tttgaatgtaattgaatttgagt

SEQ ID NO: 160975 - DNA, 23 bp, Homo sapiens
tgttctttttgcttaggattgtc

SEQ ID NO: 160976 - DNA, 21 bp, Homo sapiens
taattctgtgaagaaagtcag

SEQ ID NO: 160977 - DNA, 23 bp, Homo sapiens
catgttgatgtggaacatgaatc

SEQ ID NO: 160978 - DNA, 23 bp, Homo sapiens
gatgagtctcgcactgtctccca

SEQ ID NO: 160979 - DNA, 20 bp, Homo sapiens
tagcttgatggggatagcat

SEQ ID NO: 160980 - DNA, 23 bp, Homo sapiens
gagtctcactctgtcacccaggc

SEQ ID NO: 160981 - DNA, 23 bp, Homo sapiens
acagagtctcgctctgtcaccca

SEQ ID NO: 160982 - DNA, 23 bp, Homo sapiens
gtgtgtgtgagcatatgcatgtg

SEQ ID NO: 160983 - DNA, 23 bp, Homo sapiens
gtgtgtgagtgtctgcgtgtgag

SEQ ID NO: 160984 - DNA, 18 bp, Homo sapiens
atgtatttttttgttgtt

SEQ ID NO: 160985 - DNA, 19 bp, Homo sapiens
aacatccaggtcacccaga

SEQ ID NO: 160986 - DNA, 20 bp, Homo sapiens
ggaacaggtggtgtttggtt

SEQ ID NO: 160987 - DNA, 20 bp, Homo sapiens
tgctggtaagtaattgggtg

SEQ ID NO: 160988 - DNA, 23 bp, Homo sapiens
actcccagtctctctataagcag

SEQ ID NO: 160989 - DNA, 19 bp, Homo sapiens
aggcagtcagaaagaattt

SEQ ID NO: 160990 - DNA, 23 bp, Homo sapiens
tgactctgccagtctgtgtctct

SEQ ID NO: 160991 - DNA, 23 bp, Homo sapiens
cagtgtctcactctgtcacccag

SEQ ID NO: 160992 - DNA, 18 bp, Homo sapiens
gcaagatggagtcagtta

SEQ ID NO: 160993 - DNA, 23 bp, Homo sapiens
aaagaagtggataatgaaggctt

SEQ ID NO: 160994 - DNA, 23 bp, Homo sapiens
ttggagcatttgtttattttctt

SEQ ID NO: 160995 - DNA, 23 bp, Homo sapiens
actgagtttctctctgttgctca

SEQ ID NO: 160996 - DNA, 23 bp, Homo sapiens
ttttttgaggcacagtctcgctc

SEQ ID NO: 160997 - DNA, 23 bp, Homo sapiens
agatagtctcgctctgtcgctca

SEQ ID NO: 160998 - DNA, 19 bp, Homo sapiens
tcactgcaagctctgtctc

SEQ ID NO: 160999 - DNA, 21 bp, Homo sapiens
agaaactaggtgaaactgaga

SEQ ID NO: 161000 - DNA, 20 bp, Homo sapiens
tggctgaagtagtgtttgtc

SEQ ID NO: 161001 - DNA, 22 bp, Homo sapiens
gtgagaagtacacctgagccag

SEQ ID NO: 161002 - DNA, 23 bp, Homo sapiens
tgttctttttgcttaggattgtc

SEQ ID NO: 161003 - DNA, 22 bp, Homo sapiens
acacgcgtgtgtgtgtgtgtgt

SEQ ID NO: 161004 - DNA, 23 bp, Homo sapiens
tgagttcattgtagattctggat

SEQ ID NO: 161005 - DNA, 23 bp, Homo sapiens
tgagttcattgtagattctggat

SEQ ID NO: 161006 - DNA, 23 bp, Homo sapiens
gggtctctctctgtcacccaggc

SEQ ID NO: 161007 - DNA, 23 bp, Homo sapiens
tggagtctcactctgtcacccag

SEQ ID NO: 161008 - DNA, 20 bp, Homo sapiens
agtcagagtctcactttgtc

SEQ ID NO: 161009 - DNA, 19 bp, Homo sapiens
aggcagagaggcttgctca

SEQ ID NO: 161010 - DNA, 23 bp, Homo sapiens
gtgtgtgcctgagtgccagccac

SEQ ID NO: 161011 - DNA, 23 bp, Homo sapiens
cagtggctgtgactctggctctt

SEQ ID NO: 161012 - DNA, 21 bp, Homo sapiens
acacacctgtagtcccaggta

SEQ ID NO: 161013 - DNA, 23 bp, Homo sapiens
tatgtatgtacatatagatatgt

SEQ ID NO: 161014 - DNA, 23 bp, Homo sapiens
ttctgtgcctgtgtctggggctc

SEQ ID NO: 161015 - DNA, 19 bp, Homo sapiens
tgtgaagtgactgagctga

SEQ ID NO: 161016 - DNA, 23 bp, Homo sapiens
atggagtctcgctctgtggctca

SEQ ID NO: 161017 - DNA, 22 bp, Homo sapiens
agaagagttctcactctgtcac

SEQ ID NO: 161018 - DNA, 19 bp, Homo sapiens
agacagctgagagaggaca

SEQ ID NO: 161019 - DNA, 23 bp, Homo sapiens
gaacatacaacttggtgagaaac

SEQ ID NO: 161020 - DNA, 23 bp, Homo sapiens
tgagatgaagtctcgctctgtca

SEQ ID NO: 161021 - DNA, 23 bp, Homo sapiens
atggcagtcccttaggtttcaga

SEQ ID NO: 161022 - DNA, 20 bp, Homo sapiens
cagagttgagagagagcaca

SEQ ID NO: 161023 - DNA, 20 bp, Homo sapiens
gagactgaatctcactctgt

SEQ ID NO: 161024 - DNA, 22 bp, Homo sapiens
agtgtcacactgggtctcacag

SEQ ID NO: 161025 - DNA, 23 bp, Homo sapiens
gattctgtctggtagagacatat

SEQ ID NO: 161026 - DNA, 23 bp, Homo sapiens
ggtctcactctgtcacccaggct

SEQ ID NO: 161027 - DNA, 18 bp, Homo sapiens
gtggttagtgtgagtgag

SEQ ID NO: 161028 - DNA, 23 bp, Homo sapiens
agacagacagtttgtgtgtgtgt

SEQ ID NO: 161029 - DNA, 21 bp, Homo sapiens
tatgtacatattatatgtgta

SEQ ID NO: 161030 - DNA, 22 bp, Homo sapiens
ttttcactgtgaaataatatac

SEQ ID NO: 161031 - DNA, 20 bp, Homo sapiens
tatatatctgatgatgaagg

SEQ ID NO: 161032 - DNA, 23 bp, Homo sapiens
atacacatatatatagtgtgtgt

SEQ ID NO: 161033 - DNA, 22 bp, Homo sapiens
atatagatatatatagtgtgtg

SEQ ID NO: 161034 - DNA, 23 bp, Homo sapiens
tggagtacagtggcacaatcatg

SEQ ID NO: 161035 - DNA, 23 bp, Homo sapiens
tggagtctcactctgtcacccag

SEQ ID NO: 161036 - DNA, 21 bp, Homo sapiens
agtatgttgtgtaagctgtgt

SEQ ID NO: 161037 - DNA, 21 bp, Homo sapiens
gggtctcactctgtcgctcag

SEQ ID NO: 161038 - DNA, 22 bp, Homo sapiens
tgagctttttggatctatggtt

SEQ ID NO: 161039 - DNA, 23 bp, Homo sapiens
gagtctcactctgtcacccaggc

SEQ ID NO: 161040 - DNA, 23 bp, Homo sapiens
gagtctcgctctgtcgcccagtg

SEQ ID NO: 161041 - DNA, 23 bp, Homo sapiens
ttcacactctgcctctctgcctg

SEQ ID NO: 161042 - DNA, 22 bp, Homo sapiens
tgagagtgaagtgagtgtccag

SEQ ID NO: 161043 - DNA, 23 bp, Homo sapiens
gagagggtccctgtctgcctgaa

SEQ ID NO: 161044 - DNA, 23 bp, Homo sapiens
cgctcactctctctgtaaattct

SEQ ID NO: 161045 - DNA, 21 bp, Homo sapiens
agtggatttacctattatatc

SEQ ID NO: 161046 - DNA, 23 bp, Homo sapiens
aaagacacaatagtgaatgactt

SEQ ID NO: 161047 - DNA, 23 bp, Homo sapiens
tgtggtagaatgttgtaaattgt

SEQ ID NO: 161048 - DNA, 23 bp, Homo sapiens
gggtctcactctgtcacccaggc

SEQ ID NO: 161049 - DNA, 23 bp, Homo sapiens
agtctcactctgtcacccaggct

SEQ ID NO: 161050 - DNA, 18 bp, Homo sapiens
tatgtgtgtgcatatata

SEQ ID NO: 161051 - DNA, 19 bp, Homo sapiens
tatacttcagatttccact

SEQ ID NO: 161052 - DNA, 22 bp, Homo sapiens
ttttgagatggaatctcactct

SEQ ID NO: 161053 - DNA, 19 bp, Homo sapiens
aagatcaaggcactgcact

SEQ ID NO: 161054 - DNA, 23 bp, Homo sapiens
agatggagtctcactgtgtcacc

SEQ ID NO: 161055 - DNA, 19 bp, Homo sapiens
agtgcagtgtctcaatctt

SEQ ID NO: 161056 - DNA, 23 bp, Homo sapiens
tatgtatatgtatatgtgtgtgt

SEQ ID NO: 161057 - DNA, 23 bp, Homo sapiens
tacacacacacacatatacatat

SEQ ID NO: 161058 - DNA, 23 bp, Homo sapiens
gaggagagacagtgtgtcagtca

SEQ ID NO: 161059 - DNA, 22 bp, Homo sapiens
taggagcaaaagaaatgcctaa

SEQ ID NO: 161060 - DNA, 22 bp, Homo sapiens
tgagtcttactctgtcacccag

SEQ ID NO: 161061 - DNA, 23 bp, Homo sapiens
ttcactggctctgcatctcgtct

SEQ ID NO: 161062 - DNA, 19 bp, Homo sapiens
tgaggtagaaggatcacct

SEQ ID NO: 161063 - DNA, 23 bp, Homo sapiens
acagggtctggctctgtttctgt

SEQ ID NO: 161064 - DNA, 22 bp, Homo sapiens
tttgagacagggtctccctctg

SEQ ID NO: 161065 - DNA, 23 bp, Homo sapiens
acagggtctcactctgtcaccca

SEQ ID NO: 161066 - DNA, 22 bp, Homo sapiens
tttgactaaggtgttttttgtt

SEQ ID NO: 161067 - DNA, 22 bp, Homo sapiens
atgtgtgtatatatatatgtgt

SEQ ID NO: 161068 - DNA, 19 bp, Homo sapiens
aaatgtttattttaaaagg

SEQ ID NO: 161069 - DNA, 18 bp, Homo sapiens
tgaattttatgggatgtg

SEQ ID NO: 161070 - DNA, 19 bp, Homo sapiens
gagtctcactctgtcacct

SEQ ID NO: 161071 - DNA, 23 bp, Homo sapiens
tccgtgtctgactcagtctgatg

SEQ ID NO: 161072 - DNA, 20 bp, Homo sapiens
tgagacagggtctccctctg

SEQ ID NO: 161073 - DNA, 19 bp, Homo sapiens
tcaaagacataatagtatg

SEQ ID NO: 161074 - DNA, 18 bp, Homo sapiens
tgtcaaagacatagtagt

SEQ ID NO: 161075 - DNA, 23 bp, Homo sapiens
tcaaagacgtaatagtgtatatg

SEQ ID NO: 161076 - DNA, 19 bp, Homo sapiens
tattcacactttttgtttt

SEQ ID NO: 161077 - DNA, 23 bp, Homo sapiens
ccgagtctcactcactctgttgc

SEQ ID NO: 161078 - DNA, 19 bp, Homo sapiens
gtggcacgatcttggctca

SEQ ID NO: 161079 - DNA, 22 bp, Homo sapiens
ggttagtactctgcctccagga

SEQ ID NO: 161080 - DNA, 21 bp, Homo sapiens
agagcattattattcttgtgt

SEQ ID NO: 161081 - DNA, 23 bp, Homo sapiens
aagttcagtttttaaattcagta

SEQ ID NO: 161082 - DNA, 23 bp, Homo sapiens
aatttgcaactagatagaggaat

SEQ ID NO: 161083 - DNA, 22 bp, Homo sapiens
ctgaggtaggaggatcatttga

SEQ ID NO: 161084 - DNA, 18 bp, Homo sapiens
agagaagagatactgaac

SEQ ID NO: 161085 - DNA, 23 bp, Homo sapiens
aggcagtctcactctgtcaccca

SEQ ID NO: 161086 - DNA, 20 bp, Homo sapiens
tgtcagatgagacagagggc

SEQ ID NO: 161087 - DNA, 23 bp, Homo sapiens
aagttgtctagtcattttgttga

SEQ ID NO: 161088 - DNA, 22 bp, Homo sapiens
aagatacaaagctgtggccggg

SEQ ID NO: 161089 - DNA, 20 bp, Homo sapiens
tgcctgtaatcccagcactg

SEQ ID NO: 161090 - DNA, 23 bp, Homo sapiens
agtgcaagcctgtagtcccagct

SEQ ID NO: 161091 - DNA, 19 bp, Homo sapiens
atagtgagacctcatctct

SEQ ID NO: 161092 - DNA, 23 bp, Homo sapiens
gagtctcactgtgtctcccaggc

SEQ ID NO: 161093 - DNA, 23 bp, Homo sapiens
ccaacatgatgaaactctgtctc

SEQ ID NO: 161094 - DNA, 23 bp, Homo sapiens
cggagtctcactctgtcacccag

SEQ ID NO: 161095 - DNA, 19 bp, Homo sapiens
caacatagtgagacctcat

SEQ ID NO: 161096 - DNA, 23 bp, Homo sapiens
tgagacagagtctggctctgttg

SEQ ID NO: 161097 - DNA, 22 bp, Homo sapiens
agagtctcgctctgtcacccag

SEQ ID NO: 161098 - DNA, 21 bp, Homo sapiens
tgagacagagtctcgctctgt

SEQ ID NO: 161099 - DNA, 23 bp, Homo sapiens
ttaacttctcaatttgtatatgt

SEQ ID NO: 161100 - DNA, 22 bp, Homo sapiens
ttttcaccatctgtattcttct

SEQ ID NO: 161101 - DNA, 23 bp, Homo sapiens
acagagtctcactctgtcgccca

SEQ ID NO: 161102 - DNA, 23 bp, Homo sapiens
cttgtctgtgttactcctatgca

SEQ ID NO: 161103 - DNA, 19 bp, Homo sapiens
ttatgctaggaatatatgg

SEQ ID NO: 161104 - DNA, 20 bp, Homo sapiens
cagacagacagtgcagtcac

SEQ ID NO: 161105 - DNA, 21 bp, Homo sapiens
cataaagtagaaagcactact

SEQ ID NO: 161106 - DNA, 23 bp, Homo sapiens
tgtagtgtttcctactttatgga

SEQ ID NO: 161107 - DNA, 23 bp, Homo sapiens
ctttctgtctgtctgtccctgtg

SEQ ID NO: 161108 - DNA, 23 bp, Homo sapiens
tatgactctgtaggtctctgcaa

SEQ ID NO: 161109 - DNA, 23 bp, Homo sapiens
tgcctgggtcagtgtctctcttc

SEQ ID NO: 161110 - DNA, 23 bp, Homo sapiens
ctgtgcatgcatgtgtgtgtgta

SEQ ID NO: 161111 - DNA, 23 bp, Homo sapiens
agcaagagagagagagaaagtgg

SEQ ID NO: 161112 - DNA, 22 bp, Homo sapiens
ctcagagtgatcccttctgttt

SEQ ID NO: 161113 - DNA, 23 bp, Homo sapiens
gacagagtctctcgctctgttgc

SEQ ID NO: 161114 - DNA, 20 bp, Homo sapiens
tttcgagatggagtctcact

SEQ ID NO: 161115 - DNA, 23 bp, Homo sapiens
agtctgtctctgtcacccaggct

SEQ ID NO: 161116 - DNA, 23 bp, Homo sapiens
agagtctctctctgtcactcagc

SEQ ID NO: 161117 - DNA, 23 bp, Homo sapiens
tgcaatggtgtgatcttggctct

SEQ ID NO: 161118 - DNA, 18 bp, Homo sapiens
ttgtctcactttgcgggt

SEQ ID NO: 161119 - DNA, 23 bp, Homo sapiens
tgtgtgcgtgtgtgcgtgcgtgt

SEQ ID NO: 161120 - DNA, 20 bp, Homo sapiens
atatctatttttatatatgt

SEQ ID NO: 161121 - DNA, 21 bp, Homo sapiens
tgtcagaaacgccattcttct

SEQ ID NO: 161122 - DNA, 23 bp, Homo sapiens
ttttgttcagtgtggtttttatt

SEQ ID NO: 161123 - DNA, 18 bp, Homo sapiens
aacaaataaattgagact

SEQ ID NO: 161124 - DNA, 23 bp, Homo sapiens
ctctctggctctttctcagactg

SEQ ID NO: 161125 - DNA, 20 bp, Homo sapiens
agtagctgggactacggtca

SEQ ID NO: 161126 - DNA, 22 bp, Homo sapiens
gagtctcgctgtctcccaggct

SEQ ID NO: 161127 - DNA, 19 bp, Homo sapiens
agagaaaatagaaagcagt

SEQ ID NO: 161128 - DNA, 21 bp, Homo sapiens
tttctcaggggaaatgtggga

SEQ ID NO: 161129 - DNA, 23 bp, Homo sapiens
gaagtctgcagatttcataggcc

SEQ ID NO: 161130 - DNA, 23 bp, Homo sapiens
aagagtacagtttttgctcttga

SEQ ID NO: 161131 - DNA, 23 bp, Homo sapiens
tctctcagttttcgggattgttg

SEQ ID NO: 161132 - DNA, 23 bp, Homo sapiens
taaaactaattgtgttgactgtt

SEQ ID NO: 161133 - DNA, 22 bp, Homo sapiens
ttacaggaagatatgtatatgt

SEQ ID NO: 161134 - DNA, 21 bp, Homo sapiens
tctcagaggctgttgttttga

SEQ ID NO: 161135 - DNA, 22 bp, Homo sapiens
atgtctaatgaatttcagcact

SEQ ID NO: 161136 - DNA, 23 bp, Homo sapiens
gctaacgcttgagtatttgatgt

SEQ ID NO: 161137 - DNA, 23 bp, Homo sapiens
tgagttcattgtagattctggat

SEQ ID NO: 161138 - DNA, 23 bp, Homo sapiens
tgagttcattgtagattctggat

SEQ ID NO: 161139 - DNA, 23 bp, Homo sapiens
tgtgagatatctcacagatacat

SEQ ID NO: 161140 - DNA, 23 bp, Homo sapiens
tgtgtctatatgtatatctctct

SEQ ID NO: 161141 - DNA, 23 bp, Homo sapiens
tccagcttagcttgtacttctcc

SEQ ID NO: 161142 - DNA, 23 bp, Homo sapiens
gtctcaccaacatttgctgtctt

SEQ ID NO: 161143 - DNA, 21 bp, Homo sapiens
tgtatacttacatatgtgtat

SEQ ID NO: 161144 - DNA, 18 bp, Homo sapiens
tttcttattcacaaccca

SEQ ID NO: 161145 - DNA, 23 bp, Homo sapiens
agagagaagagtgtttgcaccaa

SEQ ID NO: 161146 - DNA, 23 bp, Homo sapiens
catcagacaggcaatgctctcca

SEQ ID NO: 161147 - DNA, 23 bp, Homo sapiens
tgttttaccaattctttacatgt

SEQ ID NO: 161148 - DNA, 22 bp, Homo sapiens
tctgagacactccgtctgtgac

SEQ ID NO: 161149 - DNA, 23 bp, Homo sapiens
tgtgcctggctgcctgaatctaa

SEQ ID NO: 161150 - DNA, 23 bp, Homo sapiens
tgagttcattgtagattctggat

SEQ ID NO: 161151 - DNA, 23 bp, Homo sapiens
tgagttcattgtagattctggat

SEQ ID NO: 161152 - DNA, 23 bp, Homo sapiens
agagtctcactctgtctcccagg

SEQ ID NO: 161153 - DNA, 21 bp, Homo sapiens
ctgactcattttgctcctctg

SEQ ID NO: 161154 - DNA, 23 bp, Homo sapiens
acagactctcgctctgtcaccca

SEQ ID NO: 161155 - DNA, 23 bp, Homo sapiens
tgtatgtgttgtgtatatgtata

SEQ ID NO: 161156 - DNA, 18 bp, Homo sapiens
tgtttgttggaatgtagg

SEQ ID NO: 161157 - DNA, 23 bp, Homo sapiens
cattagtgtgaaaggagttgcag

SEQ ID NO: 161158 - DNA, 22 bp, Homo sapiens
agtctcgctctgtcgcaggctg

SEQ ID NO: 161159 - DNA, 23 bp, Homo sapiens
atgacaatgccacatgtatatat

SEQ ID NO: 161160 - DNA, 18 bp, Homo sapiens
tatgtttgtatgtgtgta

SEQ ID NO: 161161 - DNA, 18 bp, Homo sapiens
tatatatgacattgtctt

SEQ ID NO: 161162 - DNA, 18 bp, Homo sapiens
gctcaagctggaggactg

SEQ ID NO: 161163 - DNA, 23 bp, Homo sapiens
caaactctgtgtctcaatttccc

SEQ ID NO: 161164 - DNA, 22 bp, Homo sapiens
tccatctgtgacaataagtcag

SEQ ID NO: 161165 - DNA, 22 bp, Homo sapiens
taattctgtgaagaatgtccgt

SEQ ID NO: 161166 - DNA, 19 bp, Homo sapiens
atgtgcacgttgtgcacat

SEQ ID NO: 161167 - DNA, 23 bp, Homo sapiens
gtagctctcttctgtcaacctga

SEQ ID NO: 161168 - DNA, 22 bp, Homo sapiens
aatacatacatattgaatgtat

SEQ ID NO: 161169 - DNA, 23 bp, Homo sapiens
taaaaagctgtaatacatgtgta

SEQ ID NO: 161170 - DNA, 19 bp, Homo sapiens
tatgcatatatatacatat

SEQ ID NO: 161171 - DNA, 23 bp, Homo sapiens
ctccataatatggatgtactaca

SEQ ID NO: 161172 - DNA, 21 bp, Homo sapiens
atatgcatatatagatataga

SEQ ID NO: 161173 - DNA, 23 bp, Homo sapiens
actagtatttcattgtgtatcta

SEQ ID NO: 161174 - DNA, 23 bp, Homo sapiens
tctggggctgtgtctttgcctct

SEQ ID NO: 161175 - DNA, 21 bp, Homo sapiens
ttatacttttttacctatggt

SEQ ID NO: 161176 - DNA, 20 bp, Homo sapiens
aatgcatatgtatatatatg

SEQ ID NO: 161177 - DNA, 18 bp, Homo sapiens
aaatatgtatatgtatac

SEQ ID NO: 161178 - DNA, 21 bp, Homo sapiens
taagagctttgttattaaata

SEQ ID NO: 161179 - DNA, 23 bp, Homo sapiens
gttttgagatgaagccttactct

SEQ ID NO: 161180 - DNA, 23 bp, Homo sapiens
aaagtgacacgttttcattttta

SEQ ID NO: 161181 - DNA, 22 bp, Homo sapiens
atattccatcctgtgtgtgtgt

SEQ ID NO: 161182 - DNA, 23 bp, Homo sapiens
gtgtatagaagaactactgcttt

SEQ ID NO: 161183 - DNA, 23 bp, Homo sapiens
tcacagatgagtgtatgcattct

SEQ ID NO: 161184 - DNA, 19 bp, Homo sapiens
atattagattcatttctga

SEQ ID NO: 161185 - DNA, 23 bp, Homo sapiens
atgataccgtttgaattgtcaaa

SEQ ID NO: 161186 - DNA, 21 bp, Homo sapiens
taaatggatgttaatattgct

SEQ ID NO: 161187 - DNA, 23 bp, Homo sapiens
tgtgtatatatatatgtgtgtgt

SEQ ID NO: 161188 - DNA, 18 bp, Homo sapiens
attagattctcaaaaggt

SEQ ID NO: 161189 - DNA, 23 bp, Homo sapiens
atagggtttacattcctatgaga

SEQ ID NO: 161190 - DNA, 22 bp, Homo sapiens
tgatatatcttcattttgtaca

SEQ ID NO: 161191 - DNA, 23 bp, Homo sapiens
tgtatgtgtgtatatatgtgtgt

SEQ ID NO: 161192 - DNA, 23 bp, Homo sapiens
agtcagaggttcttggttttaat

SEQ ID NO: 161193 - DNA, 23 bp, Homo sapiens
agagtctcactctgtcacccagg

SEQ ID NO: 161194 - DNA, 23 bp, Homo sapiens
gagtctcactctgtcacccaggc

SEQ ID NO: 161195 - DNA, 20 bp, Homo sapiens
agacagcaggaatttctttg

SEQ ID NO: 161196 - DNA, 23 bp, Homo sapiens
ttttaagatcattttgttgttaa

SEQ ID NO: 161197 - DNA, 23 bp, Homo sapiens
tgagttcattgtagattctggat

SEQ ID NO: 161198 - DNA, 23 bp, Homo sapiens
tgagttcattgtagattctggat

SEQ ID NO: 161199 - DNA, 23 bp, Homo sapiens
gagatggagtctcgctctgtcac

SEQ ID NO: 161200 - DNA, 18 bp, Homo sapiens
tgagcaagatgttatact

SEQ ID NO: 161201 - DNA, 22 bp, Homo sapiens
tttcaccctgtgctatctagga

SEQ ID NO: 161202 - DNA, 23 bp, Homo sapiens
tgagttgtgtaattgtttcatta

SEQ ID NO: 161203 - DNA, 23 bp, Homo sapiens
tgaaatgaaatgaagtttgtatg

SEQ ID NO: 161204 - DNA, 18 bp, Homo sapiens
tttctggttgcttgttgt

SEQ ID NO: 161205 - DNA, 23 bp, Homo sapiens
tggagtctcactctgtcacccag

SEQ ID NO: 161206 - DNA, 23 bp, Homo sapiens
gtaagaacttaatgagctctcat

SEQ ID NO: 161207 - DNA, 20 bp, Homo sapiens
atgctgactggatgttctgt

SEQ ID NO: 161208 - DNA, 22 bp, Homo sapiens
atgtgcatatatacatatgtgt

SEQ ID NO: 161209 - DNA, 22 bp, Homo sapiens
atatcactatatgtatatcact

SEQ ID NO: 161210 - DNA, 21 bp, Homo sapiens
atatcactatatatatatcac

SEQ ID NO: 161211 - DNA, 20 bp, Homo sapiens
ttttggtcctgagtaactga

SEQ ID NO: 161212 - DNA, 19 bp, Homo sapiens
aacagtctggttaatttgt

SEQ ID NO: 161213 - DNA, 22 bp, Homo sapiens
tattagtgtgagggagtcttat

SEQ ID NO: 161214 - DNA, 21 bp, Homo sapiens
tgagccaggtttcatgagcaa

SEQ ID NO: 161215 - DNA, 23 bp, Homo sapiens
cctcagaccctgtgcctgaccca

SEQ ID NO: 161216 - DNA, 23 bp, Homo sapiens
tacatgtgcacaacgtgcaggtt

SEQ ID NO: 161217 - DNA, 20 bp, Homo sapiens
tggcatgatatctgagttga

SEQ ID NO: 161218 - DNA, 22 bp, Homo sapiens
ttttgagagggagtcttactct

SEQ ID NO: 161219 - DNA, 22 bp, Homo sapiens
gtgagaactgtgccaggacagt

SEQ ID NO: 161220 - DNA, 23 bp, Homo sapiens
gtccctctgtctggctctgtcgt

SEQ ID NO: 161221 - DNA, 22 bp, Homo sapiens
gtcagggtcactgggtcactga

SEQ ID NO: 161222 - DNA, 23 bp, Homo sapiens
gacagagtctcgctctgtcaccc

SEQ ID NO: 161223 - DNA, 23 bp, Homo sapiens
agcctctgtgtgcctcagtgtct

SEQ ID NO: 161224 - DNA, 23 bp, Homo sapiens
gaatgaatgcaaagcttttggca

SEQ ID NO: 161225 - DNA, 19 bp, Homo sapiens
aatgagtgtagttagcacc

SEQ ID NO: 161226 - DNA, 23 bp, Homo sapiens
acagagtctcactctgtcgccca

SEQ ID NO: 161227 - DNA, 23 bp, Homo sapiens
acatgtatgtgtgcatgtgtgta

SEQ ID NO: 161228 - DNA, 22 bp, Homo sapiens
tgtgtatatgtagacataccta

SEQ ID NO: 161229 - DNA, 23 bp, Homo sapiens
gcggtgtctgtgtgcctagctcc

SEQ ID NO: 161230 - DNA, 23 bp, Homo sapiens
ctcacactgtggttcttgtatcc

SEQ ID NO: 161231 - DNA, 23 bp, Homo sapiens
tgtatctatatctatctgtatct

SEQ ID NO: 161232 - DNA, 21 bp, Homo sapiens
agtctcagtctgtcaaccagg

SEQ ID NO: 161233 - DNA, 22 bp, Homo sapiens
tatttatttggaggcagagtct

SEQ ID NO: 161234 - DNA, 21 bp, Homo sapiens
gctctgtcacccagactggag

SEQ ID NO: 161235 - DNA, 22 bp, Homo sapiens
tcttagcccacactcactctct

SEQ ID NO: 161236 - DNA, 21 bp, Homo sapiens
tcccaccctccctgaatccca

SEQ ID NO: 161237 - DNA, 23 bp, Homo sapiens
gggtctcactctgtcacccaggc

SEQ ID NO: 161238 - DNA, 22 bp, Homo sapiens
tgtggtggactctgtgttgtgt

SEQ ID NO: 161239 - DNA, 23 bp, Homo sapiens
tgtgtgtatatatgtatgtgtgt

SEQ ID NO: 161240 - DNA, 23 bp, Homo sapiens
tataatagtgttgtaccaattag

SEQ ID NO: 161241 - DNA, 22 bp, Homo sapiens
ctcttaagttatcgtgatctgg

SEQ ID NO: 161242 - DNA, 23 bp, Homo sapiens
gagacggagtctcacactgtcac

SEQ ID NO: 161243 - DNA, 19 bp, Homo sapiens
attggatgggcatggtggc

SEQ ID NO: 161244 - DNA, 19 bp, Homo sapiens
taaagtgcagcaagaataa

SEQ ID NO: 161245 - DNA, 21 bp, Homo sapiens
atgtgagaagatagtcaggtg

SEQ ID NO: 161246 - DNA, 23 bp, Homo sapiens
acggagtctcactctgttgccag

SEQ ID NO: 161247 - DNA, 23 bp, Homo sapiens
ctgtgtctcagtgtctgagatcc

SEQ ID NO: 161248 - DNA, 21 bp, Homo sapiens
atatgtgtatatatgtatgtg

SEQ ID NO: 161249 - DNA, 23 bp, Homo sapiens
ttaggtagtttcatgttgttggg

SEQ ID NO: 161250 - DNA, 22 bp, Homo sapiens
agaagatctgtctgtcttctgt

SEQ ID NO: 161251 - DNA, 23 bp, Homo sapiens
taccctgtagatccgaatttgtg

SEQ ID NO: 161252 - DNA, 23 bp, Homo sapiens
tatctaggggaatatgtagttga

SEQ ID NO: 161253 - DNA, 19 bp, Homo sapiens
tgagggccagaatgactgc

SEQ ID NO: 161254 - DNA, 23 bp, Homo sapiens
gttgactgtgtcctttgatggag

SEQ ID NO: 161255 - DNA, 23 bp, Homo sapiens
tttgagacggagtctcactctgt

SEQ ID NO: 161256 - DNA, 23 bp, Homo sapiens
gcgaagcagtgggagtggagaag

SEQ ID NO: 161257 - DNA, 23 bp, Homo sapiens
acatttccctctgagcctctgtc

SEQ ID NO: 161258 - DNA, 22 bp, Homo sapiens
aatgaccatgcattacttctgt

SEQ ID NO: 161259 - DNA, 22 bp, Homo sapiens
ttaagcacattcacattgtgcc

SEQ ID NO: 161260 - DNA, 21 bp, Homo sapiens
tctcactctgtcacccaggct

SEQ ID NO: 161261 - DNA, 22 bp, Homo sapiens
aaagtgctgggattacatgcgt

SEQ ID NO: 161262 - DNA, 22 bp, Homo sapiens
ttgatgcagagtctcactctgt

SEQ ID NO: 161263 - DNA, 23 bp, Homo sapiens
cggaggctcacactgtctcccag

SEQ ID NO: 161264 - DNA, 23 bp, Homo sapiens
agtcagtgcatgacagaacttgg

SEQ ID NO: 161265 - DNA, 22 bp, Homo sapiens
ttatggtctgtgtgtttgctca

SEQ ID NO: 161266 - DNA, 20 bp, Homo sapiens
agccacactgactatggggt

SEQ ID NO: 161267 - DNA, 23 bp, Homo sapiens
ttcctcaccttccttttgagtcg

SEQ ID NO: 161268 - DNA, 18 bp, Homo sapiens
tctcactcagtcgcccag

SEQ ID NO: 161269 - DNA, 19 bp, Homo sapiens
tcacagctctctcactgtc

SEQ ID NO: 161270 - DNA, 21 bp, Homo sapiens
agatgtggtctcgctctgttg

SEQ ID NO: 161271 - DNA, 21 bp, Homo sapiens
aaaaaagaagttgataaacag

SEQ ID NO: 161272 - DNA, 21 bp, Homo sapiens
tctcaccctgtcacccaggct

SEQ ID NO: 161273 - DNA, 23 bp, Homo sapiens
tatatgagctatagattggatag

SEQ ID NO: 161274 - DNA, 22 bp, Homo sapiens
tacaagtggttttggttacatg

SEQ ID NO: 161275 - DNA, 23 bp, Homo sapiens
tggagtctcactctgtcacccag

SEQ ID NO: 161276 - DNA, 23 bp, Homo sapiens
atctcactctgtcacactggctg

SEQ ID NO: 161277 - DNA, 21 bp, Homo sapiens
atcacagctcactgtggcctt

SEQ ID NO: 161278 - DNA, 23 bp, Homo sapiens
atgatgatgatgatgatgatgat

SEQ ID NO: 161279 - DNA, 23 bp, Homo sapiens
tttgctttatgtaaatatgtatg

SEQ ID NO: 161280 - DNA, 19 bp, Homo sapiens
tctggaagcatgtatacta

SEQ ID NO: 161281 - DNA, 19 bp, Homo sapiens
tagtgctggggtttgtttc

SEQ ID NO: 161282 - DNA, 19 bp, Homo sapiens
gagactgagtctctctttg

SEQ ID NO: 161283 - DNA, 23 bp, Homo sapiens
tggagtctcactctgtcacccag

SEQ ID NO: 161284 - DNA, 20 bp, Homo sapiens
ttttgagatggagtctcact

SEQ ID NO: 161285 - DNA, 20 bp, Homo sapiens
acagtggcatgatctcggct

SEQ ID NO: 161286 - DNA, 23 bp, Homo sapiens
gatgatgatgatgatgatgatga

SEQ ID NO: 161287 - DNA, 23 bp, Homo sapiens
acagtagagtgtcaggaatcaaa

SEQ ID NO: 161288 - DNA, 23 bp, Homo sapiens
tggagtctcactctgtcacccag

SEQ ID NO: 161289 - DNA, 20 bp, Homo sapiens
ttttgagatggagtctcact

SEQ ID NO: 161290 - DNA, 20 bp, Homo sapiens
acagtggcatgatctcggct

SEQ ID NO: 161291 - DNA, 23 bp, Homo sapiens
gagtcggagtctcactctgtcat

SEQ ID NO: 161292 - DNA, 22 bp, Homo sapiens
agtatgagtttagatacacagt

SEQ ID NO: 161293 - DNA, 19 bp, Homo sapiens
taatttgtatttgtagcag

SEQ ID NO: 161294 - DNA, 23 bp, Homo sapiens
ttaagatggagtcttgctcttgt

SEQ ID NO: 161295 - DNA, 23 bp, Homo sapiens
tgtactattcttttcatggactt

SEQ ID NO: 161296 - DNA, 20 bp, Homo sapiens
taagagatggagtcttactg

SEQ ID NO: 161297 - DNA, 20 bp, Homo sapiens
aggcactcagtagggagtga

SEQ ID NO: 161298 - DNA, 23 bp, Homo sapiens
tgacacagaagaaggatcagaga

SEQ ID NO: 161299 - DNA, 22 bp, Homo sapiens
tgagaacatggtgaaaccctgt

SEQ ID NO: 161300 - DNA, 23 bp, Homo sapiens
agtccctctctgtctcttattcc

SEQ ID NO: 161301 - DNA, 18 bp, Homo sapiens
cctctctgtgtctcagga

SEQ ID NO: 161302 - DNA, 22 bp, Homo sapiens
aaggacttgcagattccccttt

SEQ ID NO: 161303 - DNA, 23 bp, Homo sapiens
gagacatgagtctgtgtcttttt

SEQ ID NO: 161304 - DNA, 20 bp, Homo sapiens
tgagacgtagtctcgctctg

SEQ ID NO: 161305 - DNA, 23 bp, Homo sapiens
tgtctctctgtttctctcatccc

SEQ ID NO: 161306 - DNA, 22 bp, Homo sapiens
tattgaaatggagtctcgctct

SEQ ID NO: 161307 - DNA, 22 bp, Homo sapiens
ttgagacggagtctcactctgt

SEQ ID NO: 161308 - DNA, 19 bp, Homo sapiens
agtctcacactgtcaccca

SEQ ID NO: 161309 - DNA, 23 bp, Homo sapiens
tcagaggcttagttttctgtggt

SEQ ID NO: 161310 - DNA, 20 bp, Homo sapiens
taaggcagcagaacttcagt

SEQ ID NO: 161311 - DNA, 19 bp, Homo sapiens
ggaacgtggtgctgcggtt

SEQ ID NO: 161312 - DNA, 20 bp, Homo sapiens
atgtgtgtatgtatatgttc

SEQ ID NO: 161313 - DNA, 23 bp, Homo sapiens
gtgtcagtctgtgtgtatgtaca

SEQ ID NO: 161314 - DNA, 23 bp, Homo sapiens
gagacagagtctccctctgtcat

SEQ ID NO: 161315 - DNA, 19 bp, Homo sapiens
agggtaggtgaagggaatg

SEQ ID NO: 161316 - DNA, 23 bp, Homo sapiens
gctgctgtatttgtctctctcca

SEQ ID NO: 161317 - DNA, 23 bp, Homo sapiens
tgtctagtagaccttgacttttt

SEQ ID NO: 161318 - DNA, 20 bp, Homo sapiens
ttttgtagagatgggggtct

SEQ ID NO: 161319 - DNA, 23 bp, Homo sapiens
tatagctcaggcactatagtgtg

SEQ ID NO: 161320 - DNA, 23 bp, Homo sapiens
gacagagtctccctctgtcaccc

SEQ ID NO: 161321 - DNA, 20 bp, Homo sapiens
tcacagtgaattttgactcc

SEQ ID NO: 161322 - DNA, 20 bp, Homo sapiens
tcacagatgtcagtgaggat

SEQ ID NO: 161323 - DNA, 23 bp, Homo sapiens
aaaatgtgtgtgcgtgtgtgtgc

SEQ ID NO: 161324 - DNA, 21 bp, Homo sapiens
tttgtacttgcttgtatacat

SEQ ID NO: 161325 - DNA, 23 bp, Homo sapiens
tgagacagagtctcgctctgtcg

SEQ ID NO: 161326 - DNA, 22 bp, Homo sapiens
aagctggtcctgaactctgagt

SEQ ID NO: 161327 - DNA, 23 bp, Homo sapiens
aaggtctcactctgtcacccagg

SEQ ID NO: 161328 - DNA, 21 bp, Homo sapiens
tgagcaacatagtgagaccct

SEQ ID NO: 161329 - DNA, 23 bp, Homo sapiens
tgagacagagtctcgctctgtcg

SEQ ID NO: 161330 - DNA, 23 bp, Homo sapiens
ctctgaccctcactcacagcttt

SEQ ID NO: 161331 - DNA, 23 bp, Homo sapiens
gttgaggatgcagtgagttgtga

SEQ ID NO: 161332 - DNA, 23 bp, Homo sapiens
gagacagtgtctcactctgtcac

SEQ ID NO: 161333 - DNA, 19 bp, Homo sapiens
agactccgtctcaaaaaag

SEQ ID NO: 161334 - DNA, 23 bp, Homo sapiens
agacaaagtctcgctctgtcacc

SEQ ID NO: 161335 - DNA, 23 bp, Homo sapiens
gctgtggctgtggctgtgttcag

SEQ ID NO: 161336 - DNA, 23 bp, Homo sapiens
agataagagtcttgttctgccac

SEQ ID NO: 161337 - DNA, 21 bp, Homo sapiens
cagaagaagcagaagccactc

SEQ ID NO: 161338 - DNA, 23 bp, Homo sapiens
tgagacagagtctcggctctgtt

SEQ ID NO: 161339 - DNA, 23 bp, Homo sapiens
cggagtctcactctgtcacccag

SEQ ID NO: 161340 - DNA, 23 bp, Homo sapiens
gtctgtcagtctgtccctgcctg

SEQ ID NO: 161341 - DNA, 20 bp, Homo sapiens
agcttcagacaaagtatcct

SEQ ID NO: 161342 - DNA, 23 bp, Homo sapiens
gaaagatgacagtgtgcagtctc

SEQ ID NO: 161343 - DNA, 23 bp, Homo sapiens
ggagtctcactctgtcacccagg

SEQ ID NO: 161344 - DNA, 23 bp, Homo sapiens
tctcattgtggttttcatttgca

SEQ ID NO: 161345 - DNA, 23 bp, Homo sapiens
gtgttgatccttttgaaatcagt

SEQ ID NO: 161346 - DNA, 18 bp, Homo sapiens
ttgcttttgtttttgttt

SEQ ID NO: 161347 - DNA, 23 bp, Homo sapiens
tttgagacaggtctcactctgtc

SEQ ID NO: 161348 - DNA, 21 bp, Homo sapiens
taatgagaccctgtctttaca

SEQ ID NO: 161349 - DNA, 22 bp, Homo sapiens
tgagatggagtctcactctgtc

SEQ ID NO: 161350 - DNA, 22 bp, Homo sapiens
atatacacacatatatatgtgt

SEQ ID NO: 161351 - DNA, 23 bp, Homo sapiens
tatatatatctactggttgtcag

SEQ ID NO: 161352 - DNA, 23 bp, Homo sapiens
ggagtctcactctgtcacccagg

SEQ ID NO: 161353 - DNA, 18 bp, Homo sapiens
gggtgagaccgttccaca

SEQ ID NO: 161354 - DNA, 23 bp, Homo sapiens
tgagtctgtcctctgtttctgtg

SEQ ID NO: 161355 - DNA, 23 bp, Homo sapiens
ggagacagtcacatctgtggtgc

SEQ ID NO: 161356 - DNA, 19 bp, Homo sapiens
ctgtgctcactctctctct

SEQ ID NO: 161357 - DNA, 23 bp, Homo sapiens
ggtctctggctctgtgtgtcgca

SEQ ID NO: 161358 - DNA, 18 bp, Homo sapiens
gtgagccactgtgcctgg

SEQ ID NO: 161359 - DNA, 22 bp, Homo sapiens
ttgagacatggtcttactctgt

SEQ ID NO: 161360 - DNA, 22 bp, Homo sapiens
atactgagactccgtctctact

SEQ ID NO: 161361 - DNA, 23 bp, Homo sapiens
agacagggtctcgctctgtcacc

SEQ ID NO: 161362 - DNA, 23 bp, Homo sapiens
tggagtctcactctgtcacccag

SEQ ID NO: 161363 - DNA, 23 bp, Homo sapiens
cactgccttagagagactttaag

SEQ ID NO: 161364 - DNA, 23 bp, Homo sapiens
gacagagtctcgctctgtcaccc

SEQ ID NO: 161365 - DNA, 21 bp, Homo sapiens
ttcaagtgattctcctgcctc

SEQ ID NO: 161366 - DNA, 23 bp, Homo sapiens
tctgtgcctgtgtctcagccttg

SEQ ID NO: 161367 - DNA, 19 bp, Homo sapiens
tgccaattgaacagttatt

SEQ ID NO: 161368 - DNA, 22 bp, Homo sapiens
tggagactctgtcacccaggct

SEQ ID NO: 161369 - DNA, 23 bp, Homo sapiens
catcactgtctgtgagtctggca

SEQ ID NO: 161370 - DNA, 23 bp, Homo sapiens
aagtctcactgtcacccaggctg

SEQ ID NO: 161371 - DNA, 23 bp, Homo sapiens
accaagtctcactctgtcaccca

SEQ ID NO: 161372 - DNA, 23 bp, Homo sapiens
atgtctgtggtttagtgttactt

SEQ ID NO: 161373 - DNA, 20 bp, Homo sapiens
agactgaagagagacagtgc

SEQ ID NO: 161374 - DNA, 23 bp, Homo sapiens
aaggcagagaacagagttggtga

SEQ ID NO: 161375 - DNA, 23 bp, Homo sapiens
acagagtctcgctctgtcaccca

SEQ ID NO: 161376 - DNA, 18 bp, Homo sapiens
agtagcgtgatcttggct

SEQ ID NO: 161377 - DNA, 21 bp, Homo sapiens
attgcactttagcctgggcaa

SEQ ID NO: 161378 - DNA, 23 bp, Homo sapiens
tgtatgtgtgcgtgtgtgtgtgt

SEQ ID NO: 161379 - DNA, 20 bp, Homo sapiens
tctgtgttttactgtctgct

SEQ ID NO: 161380 - DNA, 20 bp, Homo sapiens
tagaagttggaggttttgta

SEQ ID NO: 161381 - DNA, 21 bp, Homo sapiens
agccactggcttctagatgag

SEQ ID NO: 161382 - DNA, 22 bp, Homo sapiens
acattctagtggatcatggtat

SEQ ID NO: 161383 - DNA, 22 bp, Homo sapiens
tattgagatggagtctcactct

SEQ ID NO: 161384 - DNA, 22 bp, Homo sapiens
tctgtccctgtcactgtccctg

SEQ ID NO: 161385 - DNA, 23 bp, Homo sapiens
ctttctcactgttgaaagtaggt

SEQ ID NO: 161386 - DNA, 23 bp, Homo sapiens
ttcactaattgtttttgtttttg

SEQ ID NO: 161387 - DNA, 23 bp, Homo sapiens
ccagtgtgcgtgtgtgtccccga

SEQ ID NO: 161388 - DNA, 23 bp, Homo sapiens
accctcactcagtctgtttgttg

SEQ ID NO: 161389 - DNA, 23 bp, Homo sapiens
tgagttttacagtttggtatttt

SEQ ID NO: 161390 - DNA, 23 bp, Homo sapiens
tgacagacaagactgtggaggct

SEQ ID NO: 161391 - DNA, 23 bp, Homo sapiens
tgagatggagtctctctctgtcg

SEQ ID NO: 161392 - DNA, 20 bp, Homo sapiens
tttgagacggagtctccctc

SEQ ID NO: 161393 - DNA, 23 bp, Homo sapiens
tattccctgtggttctcttctga

SEQ ID NO: 161394 - DNA, 23 bp, Homo sapiens
agagaaaaatttcaattctctac

SEQ ID NO: 161395 - DNA, 23 bp, Homo sapiens
tgagatgaagtttcactctgtca

SEQ ID NO: 161396 - DNA, 23 bp, Homo sapiens
cctccctttcttttcttttgaca

SEQ ID NO: 161397 - DNA, 21 bp, Homo sapiens
acagatctctgacaagagtga

SEQ ID NO: 161398 - DNA, 21 bp, Homo sapiens
aatcctgatgaaaacatgatg

SEQ ID NO: 161399 - DNA, 18 bp, Homo sapiens
tgtatacatacatgtatg

SEQ ID NO: 161400 - DNA, 18 bp, Homo sapiens
atgagttcatgccagtac

SEQ ID NO: 161401 - DNA, 23 bp, Homo sapiens
atatcacagccactttactgaat

SEQ ID NO: 161402 - DNA, 20 bp, Homo sapiens
agagaactcacattcctgaa

SEQ ID NO: 161403 - DNA, 23 bp, Homo sapiens
tggagtctcactctgtcacccag

SEQ ID NO: 161404 - DNA, 23 bp, Homo sapiens
aaaagactgtagagagcacagtg

SEQ ID NO: 161405 - DNA, 23 bp, Homo sapiens
tttgagacggagtttcactcttg

SEQ ID NO: 161406 - DNA, 23 bp, Homo sapiens
attgcttgaactcagagggcaga

SEQ ID NO: 161407 - DNA, 22 bp, Homo sapiens
gcactgcccctgctggtggtag

SEQ ID NO: 161408 - DNA, 23 bp, Homo sapiens
tccctctgactttctctctcctt

SEQ ID NO: 161409 - DNA, 23 bp, Homo sapiens
tttgagacagagtctcgctctgt

SEQ ID NO: 161410 - DNA, 23 bp, Homo sapiens
tttgagatggagtcttgctcttg

SEQ ID NO: 161411 - DNA, 23 bp, Homo sapiens
taccaaaagttaggaaatgaagt

SEQ ID NO: 161412 - DNA, 23 bp, Homo sapiens
tgagacagggtctcactctgttg

SEQ ID NO: 161413 - DNA, 23 bp, Homo sapiens
ggagtctcactctgtcacctagg

SEQ ID NO: 161414 - DNA, 20 bp, Homo sapiens
agggacacttgtatgctctt

SEQ ID NO: 161415 - DNA, 19 bp, Homo sapiens
tgagatggagtctctctct

SEQ ID NO: 161416 - DNA, 23 bp, Homo sapiens
tgtctccctgtctgtttccctgg

SEQ ID NO: 161417 - DNA, 23 bp, Homo sapiens
cccctctctgtccctgacaggga

SEQ ID NO: 161418 - DNA, 21 bp, Homo sapiens
aggtcagttgtgtggctcctg

SEQ ID NO: 161419 - DNA, 23 bp, Homo sapiens
agagtctcactcactctgttgcc

SEQ ID NO: 161420 - DNA, 23 bp, Homo sapiens
gacagagtctcgctctgtcaccc

SEQ ID NO: 161421 - DNA, 19 bp, Homo sapiens
ctgcattttttttgtttgt

SEQ ID NO: 161422 - DNA, 23 bp, Homo sapiens
gccagagtctcgctctgtcaccc

SEQ ID NO: 161423 - DNA, 22 bp, Homo sapiens
tcaaagtgctgagagattacag

SEQ ID NO: 161424 - DNA, 22 bp, Homo sapiens
gactgagtttctgtctctctgg

SEQ ID NO: 161425 - DNA, 18 bp, Homo sapiens
ggtagatgcagtgagctt

SEQ ID NO: 161426 - DNA, 23 bp, Homo sapiens
agatggagtctcgctctgtcacc

SEQ ID NO: 161427 - DNA, 22 bp, Homo sapiens
tcagacagaaagggattctttt

SEQ ID NO: 161428 - DNA, 23 bp, Homo sapiens
tgagatggagtctcgctctgtca

SEQ ID NO: 161429 - DNA, 21 bp, Homo sapiens
tgagacggagtctcgctctgt

SEQ ID NO: 161430 - DNA, 23 bp, Homo sapiens
tgtctctcactgtgagtgggcac

SEQ ID NO: 161431 - DNA, 23 bp, Homo sapiens
tctgtgactgtggtgttttgagg

SEQ ID NO: 161432 - DNA, 18 bp, Homo sapiens
attttcattccttattta

SEQ ID NO: 161433 - DNA, 23 bp, Homo sapiens
gtgggggagacagagccagagtg

SEQ ID NO: 161434 - DNA, 23 bp, Homo sapiens
ttcactgccacattcacacattt

SEQ ID NO: 161435 - DNA, 23 bp, Homo sapiens
gggtctcactctgtcacccaggc

SEQ ID NO: 161436 - DNA, 23 bp, Homo sapiens
tctgcctgacagtccgtgtctct

SEQ ID NO: 161437 - DNA, 23 bp, Homo sapiens
ccgagtctccctctgtcacccag

SEQ ID NO: 161438 - DNA, 23 bp, Homo sapiens
ttgctgtctgcatgtgcatatgt

SEQ ID NO: 161439 - DNA, 18 bp, Homo sapiens
gagtctcactctgtcacc

SEQ ID NO: 161440 - DNA, 18 bp, Homo sapiens
agtctcgctctgtcaccc

SEQ ID NO: 161441 - DNA, 22 bp, Homo sapiens
tgactcctctgtgtctcagctt

SEQ ID NO: 161442 - DNA, 23 bp, Homo sapiens
ggagtctcactctgtctcccagg

SEQ ID NO: 161443 - DNA, 18 bp, Homo sapiens
ttgttgtccagttgggtt

SEQ ID NO: 161444 - DNA, 23 bp, Homo sapiens
agacagaatctctctctgtcccc

SEQ ID NO: 161445 - DNA, 23 bp, Homo sapiens
agggtctcactctgtcgctcagg

SEQ ID NO: 161446 - DNA, 19 bp, Homo sapiens
gagcaagagcctgtctctg

SEQ ID NO: 161447 - DNA, 23 bp, Homo sapiens
aaacagggtcttactctgtcact

SEQ ID NO: 161448 - DNA, 18 bp, Homo sapiens
aatgtgctagttttgtct

SEQ ID NO: 161449 - DNA, 23 bp, Homo sapiens
tagctgagactacaaggtgtgca

SEQ ID NO: 161450 - DNA, 23 bp, Homo sapiens
tctagtcttaggatgtttaagga

SEQ ID NO: 161451 - DNA, 20 bp, Homo sapiens
tgaggtaggaggatcacttg

SEQ ID NO: 161452 - DNA, 23 bp, Homo sapiens
tcccagtgaagttgaatgttttt

SEQ ID NO: 161453 - DNA, 23 bp, Homo sapiens
acagggtctcgctctgtgactca

SEQ ID NO: 161454 - DNA, 19 bp, Homo sapiens
attggggtagtgtaggcat

SEQ ID NO: 161455 - DNA, 19 bp, Homo sapiens
gtgccttgtgctatgcttg

SEQ ID NO: 161456 - DNA, 19 bp, Homo sapiens
agcctgagaggtcaaggct

SEQ ID NO: 161457 - DNA, 23 bp, Homo sapiens
tctgtcactgtcacttcaaacgc

SEQ ID NO: 161458 - DNA, 23 bp, Homo sapiens
cagtctgtctgtctgtccatatt

SEQ ID NO: 161459 - DNA, 23 bp, Homo sapiens
cagtgagcctagatcgtgccact

SEQ ID NO: 161460 - DNA, 23 bp, Homo sapiens
gttcttcccaaagaaatgaggtt

SEQ ID NO: 161461 - DNA, 18 bp, Homo sapiens
tttggcaggcatttacat

SEQ ID NO: 161462 - DNA, 23 bp, Homo sapiens
tctggctgtgcctctcactataa

SEQ ID NO: 161463 - DNA, 18 bp, Homo sapiens
agtgaaactctgtctgaa

SEQ ID NO: 161464 - DNA, 23 bp, Homo sapiens
tgagatggagctttactcttgtt

SEQ ID NO: 161465 - DNA, 18 bp, Homo sapiens
gagtctcactctgtcacc

SEQ ID NO: 161466 - DNA, 19 bp, Homo sapiens
agactctcgcactgtcacc

SEQ ID NO: 161467 - DNA, 19 bp, Homo sapiens
agactctcgcactgtcacc

SEQ ID NO: 161468 - DNA, 23 bp, Homo sapiens
cagggtctcactctgtcacccag

SEQ ID NO: 161469 - DNA, 23 bp, Homo sapiens
tacagtggtgtgatcataggtca

SEQ ID NO: 161470 - DNA, 21 bp, Homo sapiens
aggcaagaactgaggctgctg

SEQ ID NO: 161471 - DNA, 23 bp, Homo sapiens
agactcagtcttgctctgtctcc

SEQ ID NO: 161472 - DNA, 21 bp, Homo sapiens
ttactgtggaagaggaagtag

SEQ ID NO: 161473 - DNA, 23 bp, Homo sapiens
gagcctctctctctggcagtgat

SEQ ID NO: 161474 - DNA, 23 bp, Homo sapiens
gattagacagtgaagacaatgtg

SEQ ID NO: 161475 - DNA, 21 bp, Homo sapiens
atgtgtatatatatatgtgta

SEQ ID NO: 161476 - DNA, 18 bp, Homo sapiens
tgtgtatatatatacaca

SEQ ID NO: 161477 - DNA, 23 bp, Homo sapiens
tgagttcattgtagattctggat

SEQ ID NO: 161478 - DNA, 23 bp, Homo sapiens
tgagttcattgtagattctggat

SEQ ID NO: 161479 - DNA, 21 bp, Homo sapiens
tatgtgtgtgtattatatgtg

SEQ ID NO: 161480 - DNA, 22 bp, Homo sapiens
acacacatatatacacacacgt

SEQ ID NO: 161481 - DNA, 23 bp, Homo sapiens
attgagtgtgtatttattaagta

SEQ ID NO: 161482 - DNA, 23 bp, Homo sapiens
acatttatgatgatgatgatgat

SEQ ID NO: 161483 - DNA, 20 bp, Homo sapiens
ggttggatttgaggcagtgt

SEQ ID NO: 161484 - DNA, 23 bp, Homo sapiens
tattctgtcaattactgagtgaa

SEQ ID NO: 161485 - DNA, 21 bp, Homo sapiens
tagttttgagagttttgcttt

SEQ ID NO: 161486 - DNA, 18 bp, Homo sapiens
tacctggctgtgaccctc

SEQ ID NO: 161487 - DNA, 23 bp, Homo sapiens
gtcactcacactgactcattagc

SEQ ID NO: 161488 - DNA, 23 bp, Homo sapiens
acagagagagatctggcatgcag

SEQ ID NO: 161489 - DNA, 23 bp, Homo sapiens
tgtctggctgtgagtctgtggtg

SEQ ID NO: 161490 - DNA, 23 bp, Homo sapiens
tgtgtacatgcttgtgtgtgtgt

SEQ ID NO: 161491 - DNA, 23 bp, Homo sapiens
tacaggtagtaggttgcgtagtt

SEQ ID NO: 161492 - DNA, 23 bp, Homo sapiens
aattatatgacctgctgctacct

SEQ ID NO: 161493 - DNA, 18 bp, Homo sapiens
tgagtcagggtggtggtg

SEQ ID NO: 161494 - DNA, 23 bp, Homo sapiens
ttttgagtcggagtcttactctg

SEQ ID NO: 161495 - DNA, 22 bp, Homo sapiens
tgtgtgtatatctgtgtgtata

SEQ ID NO: 161496 - DNA, 20 bp, Homo sapiens
tgcatatggtgatattttag

SEQ ID NO: 161497 - DNA, 22 bp, Homo sapiens
tagagttcactcctgattggta

SEQ ID NO: 161498 - DNA, 20 bp, Homo sapiens
ctaagatcctctgcatgaac

SEQ ID NO: 161499 - DNA, 23 bp, Homo sapiens
acagtggctgagtggctggctgt

SEQ ID NO: 161500 - DNA, 23 bp, Homo sapiens
acctgcttggttttagagtgtgg

SEQ ID NO: 161501 - DNA, 23 bp, Homo sapiens
tacaaggttgttgaaggtgtgaa

SEQ ID NO: 161502 - DNA, 23 bp, Homo sapiens
gtgtgtgtgcatgtgtctgcctg

SEQ ID NO: 161503 - DNA, 23 bp, Homo sapiens
agtgcaagaccctctctctctct

SEQ ID NO: 161504 - DNA, 23 bp, Homo sapiens
gacagagtctcgctctgtcaccc

SEQ ID NO: 161505 - DNA, 23 bp, Homo sapiens
ccctaatgacttaggtctttgtc

SEQ ID NO: 161506 - DNA, 21 bp, Homo sapiens
cagagtctcactctgtcaccc

SEQ ID NO: 161507 - DNA, 23 bp, Homo sapiens
tgatcagtgaagacactgtggtg

SEQ ID NO: 161508 - DNA, 23 bp, Homo sapiens
acaggctgtctccctgcctgact

SEQ ID NO: 161509 - DNA, 19 bp, Homo sapiens
aatactattgtaaatggtt

SEQ ID NO: 161510 - DNA, 19 bp, Homo sapiens
tccaaccgtttatatagtg

SEQ ID NO: 161511 - DNA, 23 bp, Homo sapiens
tcactctgcttcaagcacactga

SEQ ID NO: 161512 - DNA, 21 bp, Homo sapiens
tccaccaggatctcaaggctg

SEQ ID NO: 161513 - DNA, 23 bp, Homo sapiens
tgagttcattgtagattctggat

SEQ ID NO: 161514 - DNA, 23 bp, Homo sapiens
tgagttcattgtagattctggat

SEQ ID NO: 161515 - DNA, 21 bp, Homo sapiens
tcacattggaaaaacagcttg

SEQ ID NO: 161516 - DNA, 22 bp, Homo sapiens
aaacaactgttttagatgattt

SEQ ID NO: 161517 - DNA, 21 bp, Homo sapiens
ttttgaggtggagtcttgctc

SEQ ID NO: 161518 - DNA, 20 bp, Homo sapiens
agagtcaactgactgagctc

SEQ ID NO: 161519 - DNA, 22 bp, Homo sapiens
aacagagttagatgttgtctct

SEQ ID NO: 161520 - DNA, 22 bp, Homo sapiens
tgtgtgtatatatatatgtgtg

SEQ ID NO: 161521 - DNA, 20 bp, Homo sapiens
agataagaatagaagaaagg

SEQ ID NO: 161522 - DNA, 23 bp, Homo sapiens
tgagaaagaatctcactctctcc

SEQ ID NO: 161523 - DNA, 23 bp, Homo sapiens
caacataagcagcacttgaactg

SEQ ID NO: 161524 - DNA, 23 bp, Homo sapiens
tgtgtgtatatatatgtgtgtga

SEQ ID NO: 161525 - DNA, 20 bp, Homo sapiens
tgacacagcctctctctgag

SEQ ID NO: 161526 - DNA, 23 bp, Homo sapiens
gagtctcactctgtcacccaggc

SEQ ID NO: 161527 - DNA, 19 bp, Homo sapiens
tgcctgtaatcccagcagt

SEQ ID NO: 161528 - DNA, 21 bp, Homo sapiens
ataacctggataaggctttca

SEQ ID NO: 161529 - DNA, 18 bp, Homo sapiens
ttaagctgttactcagtt

SEQ ID NO: 161530 - DNA, 23 bp, Homo sapiens
aaaactgcttttgttcatgtcag

SEQ ID NO: 161531 - DNA, 23 bp, Homo sapiens
tatactgaaagttacgtgaatgt

SEQ ID NO: 161532 - DNA, 23 bp, Homo sapiens
tgagacagtctcgctctgttgca

SEQ ID NO: 161533 - DNA, 23 bp, Homo sapiens
aggaaggtactgtctgattcact

SEQ ID NO: 161534 - DNA, 22 bp, Homo sapiens
ttttgcagagatgggggtctca

SEQ ID NO: 161535 - DNA, 23 bp, Homo sapiens
ttctggagctctctctgcacagt

SEQ ID NO: 161536 - DNA, 23 bp, Homo sapiens
ctgtgacagcttcttgatttgtc

SEQ ID NO: 161537 - DNA, 19 bp, Homo sapiens
gtggggcagtgtgtgcctg

SEQ ID NO: 161538 - DNA, 23 bp, Homo sapiens
atggcctcactcagtccctcagt

SEQ ID NO: 161539 - DNA, 23 bp, Homo sapiens
aggatgtgcttgctttagtctct

SEQ ID NO: 161540 - DNA, 23 bp, Homo sapiens
aagtcagaaagacattcacttac

SEQ ID NO: 161541 - DNA, 22 bp, Homo sapiens
tttttgagatggagtctcactc

SEQ ID NO: 161542 - DNA, 21 bp, Homo sapiens
aatacctactttaaagtatgt

SEQ ID NO: 161543 - DNA, 23 bp, Homo sapiens
agtatacatccttgagtgaaggt

SEQ ID NO: 161544 - DNA, 23 bp, Homo sapiens
tctgtcacccagactagagtgta

SEQ ID NO: 161545 - DNA, 19 bp, Homo sapiens
ttttacttcttctgatact

SEQ ID NO: 161546 - DNA, 23 bp, Homo sapiens
tcactctgtcacccaggctaagt

SEQ ID NO: 161547 - DNA, 19 bp, Homo sapiens
aagagagagcctgaggtca

SEQ ID NO: 161548 - DNA, 19 bp, Homo sapiens
tgcctgtaatcccagcagt

SEQ ID NO: 161549 - DNA, 23 bp, Homo sapiens
cgcacgcactcactctcaaaggc

SEQ ID NO: 161550 - DNA, 23 bp, Homo sapiens
gagatggagtctcactctgtgtc

SEQ ID NO: 161551 - DNA, 23 bp, Homo sapiens
agacagtctcactctgtcaccca

SEQ ID NO: 161552 - DNA, 22 bp, Homo sapiens
tgactcctctgtgtctcagctt

SEQ ID NO: 161553 - DNA, 23 bp, Homo sapiens
tgtgcatgtgtgcgtgtgtgtgc

SEQ ID NO: 161554 - DNA, 23 bp, Homo sapiens
tgcatgatagatcatgctgagac

SEQ ID NO: 161555 - DNA, 23 bp, Homo sapiens
tgcagtttcaggatcttttgtga

SEQ ID NO: 161556 - DNA, 23 bp, Homo sapiens
tgaagttgattctctctcatttt

SEQ ID NO: 161557 - DNA, 23 bp, Homo sapiens
atgcaaggacctctctcacatgt

SEQ ID NO: 161558 - DNA, 22 bp, Homo sapiens
tgtcactgattgactttagagt

SEQ ID NO: 161559 - DNA, 20 bp, Homo sapiens
gttaggaagcaagactgagg

SEQ ID NO: 161560 - DNA, 23 bp, Homo sapiens
ttatagaactaggtctcgtggaa

SEQ ID NO: 161561 - DNA, 20 bp, Homo sapiens
tttttagatggagtcttgct

SEQ ID NO: 161562 - DNA, 23 bp, Homo sapiens
gactgagtctccctctgtcaccc

SEQ ID NO: 161563 - DNA, 20 bp, Homo sapiens
aacagtagacagggtggaga

SEQ ID NO: 161564 - DNA, 23 bp, Homo sapiens
agttgtgtgccaccatgcttggc

SEQ ID NO: 161565 - DNA, 23 bp, Homo sapiens
gatggagtctcactctgtcaccc

SEQ ID NO: 161566 - DNA, 23 bp, Homo sapiens
cagggtctcactctgtcacccag

SEQ ID NO: 161567 - DNA, 22 bp, Homo sapiens
tatcactcaggctgaagtgtag

SEQ ID NO: 161568 - DNA, 23 bp, Homo sapiens
gatgaagtcttgtgttgttgtcc

SEQ ID NO: 161569 - DNA, 18 bp, Homo sapiens
tgcaattttatagtttta

SEQ ID NO: 161570 - DNA, 20 bp, Homo sapiens
aaatcattgatattttgcca

SEQ ID NO: 161571 - DNA, 23 bp, Homo sapiens
tggagtctctcactctgtcgccc

SEQ ID NO: 161572 - DNA, 21 bp, Homo sapiens
tgtcagtgactgccttccagg

SEQ ID NO: 161573 - DNA, 23 bp, Homo sapiens
gacagagtctcgctctgtcaccc

SEQ ID NO: 161574 - DNA, 20 bp, Homo sapiens
tgcatatatatatacactgt

SEQ ID NO: 161575 - DNA, 23 bp, Homo sapiens
tacactgtgcatatatatacgta

SEQ ID NO: 161576 - DNA, 23 bp, Homo sapiens
tactgtgcatatatatagtgtat

SEQ ID NO: 161577 - DNA, 22 bp, Homo sapiens
tatactgtgtatctatatatgt

SEQ ID NO: 161578 - DNA, 21 bp, Homo sapiens
tatactgtgtatatatatact

SEQ ID NO: 161579 - DNA, 23 bp, Homo sapiens
tgagcagagattgagatcctgct

SEQ ID NO: 161580 - DNA, 23 bp, Homo sapiens
gactccatctcactgactctgtt

SEQ ID NO: 161581 - DNA, 20 bp, Homo sapiens
aattggttcaggacctttgt

SEQ ID NO: 161582 - DNA, 20 bp, Homo sapiens
cagcctcccaaagtgctggg

SEQ ID NO: 161583 - DNA, 20 bp, Homo sapiens
ttacaggcatgagccatggt

SEQ ID NO: 161584 - DNA, 22 bp, Homo sapiens
tgtagttgcatgtgaagctgag

SEQ ID NO: 161585 - DNA, 23 bp, Homo sapiens
tgaggtagaaggatcacttgagc

SEQ ID NO: 161586 - DNA, 23 bp, Homo sapiens
atggaatgagttataggtgtcag

SEQ ID NO: 161587 - DNA, 23 bp, Homo sapiens
ggaacatggagtctcactctgtc

SEQ ID NO: 161588 - DNA, 18 bp, Homo sapiens
aaagtgctgggattacag

SEQ ID NO: 161589 - DNA, 23 bp, Homo sapiens
ttctctgggtctgtctgcctgtc

SEQ ID NO: 161590 - DNA, 23 bp, Homo sapiens
atcatcatatactgtaagtttgc

SEQ ID NO: 161591 - DNA, 23 bp, Homo sapiens
ctacagtatagatgatgtactag

SEQ ID NO: 161592 - DNA, 23 bp, Homo sapiens
agatggagtctcgctctgtcacc

SEQ ID NO: 161593 - DNA, 19 bp, Homo sapiens
tgactcaggctaaccagtc

SEQ ID NO: 161594 - DNA, 19 bp, Homo sapiens
aggcaccagccatcatgcc

SEQ ID NO: 161595 - DNA, 21 bp, Homo sapiens
cccactcagtcactgcctcag

SEQ ID NO: 161596 - DNA, 23 bp, Homo sapiens
tctctgtgcctcactttccgcat

SEQ ID NO: 161597 - DNA, 23 bp, Homo sapiens
cagcctggctctgtccctgcctg

SEQ ID NO: 161598 - DNA, 21 bp, Homo sapiens
acagagccacaagagaaaggg

SEQ ID NO: 161599 - DNA, 23 bp, Homo sapiens
ctgtccgtctgtcagtccgtcag

SEQ ID NO: 161600 - DNA, 23 bp, Homo sapiens
tatgggagtggtagaacattctt

SEQ ID NO: 161601 - DNA, 23 bp, Homo sapiens
gctagtatgtagtggaaccagga

SEQ ID NO: 161602 - DNA, 23 bp, Homo sapiens
ccctctctgtctcacttccttct

SEQ ID NO: 161603 - DNA, 21 bp, Homo sapiens
tctgactgagtccctccctcc

SEQ ID NO: 161604 - DNA, 18 bp, Homo sapiens
agtagaaggagccctgga

SEQ ID NO: 161605 - DNA, 23 bp, Homo sapiens
tatagtgtattgttataattgct

SEQ ID NO: 161606 - DNA, 22 bp, Homo sapiens
tctgtgcctggctctctctcaa

SEQ ID NO: 161607 - DNA, 23 bp, Homo sapiens
tcacagacagggtcttgttttgt

SEQ ID NO: 161608 - DNA, 19 bp, Homo sapiens
tctgtctcccagagcagag

SEQ ID NO: 161609 - DNA, 19 bp, Homo sapiens
ttatcagaatttgttttag

SEQ ID NO: 161610 - DNA, 21 bp, Homo sapiens
ttgtatctgacaaagtcagag

SEQ ID NO: 161611 - DNA, 19 bp, Homo sapiens
attctctgggttgtttctt

SEQ ID NO: 161612 - DNA, 21 bp, Homo sapiens
tgtgaacattttgaaatgaca

SEQ ID NO: 161613 - DNA, 21 bp, Homo sapiens
agtctcactcactctttcgcc

SEQ ID NO: 161614 - DNA, 21 bp, Homo sapiens
tcagtgaaaatgctttgtgat

SEQ ID NO: 161615 - DNA, 23 bp, Homo sapiens
tcatctcagagagttaaagtttt

SEQ ID NO: 161616 - DNA, 18 bp, Homo sapiens
taaacaagtacacctgca

SEQ ID NO: 161617 - DNA, 22 bp, Homo sapiens
tctatctagatataggtagatg

SEQ ID NO: 161618 - DNA, 21 bp, Homo sapiens
agtggtacttggatgtaaaat

SEQ ID NO: 161619 - DNA, 23 bp, Homo sapiens
agaacagagttgttgcttggtaa

SEQ ID NO: 161620 - DNA, 18 bp, Homo sapiens
gtgagactctgtctccaa

SEQ ID NO: 161621 - DNA, 20 bp, Homo sapiens
aaagtgctaggattacagga

SEQ ID NO: 161622 - DNA, 21 bp, Homo sapiens
tgagttaaatttttctttaga

SEQ ID NO: 161623 - DNA, 20 bp, Homo sapiens
tatatgtatgtaatatagac

SEQ ID NO: 161624 - DNA, 22 bp, Homo sapiens
tggtgacagtggctgtcatggg

SEQ ID NO: 161625 - DNA, 20 bp, Homo sapiens
tgagggagagtctcgctctg

SEQ ID NO: 161626 - DNA, 23 bp, Homo sapiens
tgagtctgtgtatgtgtgtgtgt

SEQ ID NO: 161627 - DNA, 21 bp, Homo sapiens
tggcagtgtggagccctgaaa

SEQ ID NO: 161628 - DNA, 23 bp, Homo sapiens
tatgagacaggtctggctctgtc

SEQ ID NO: 161629 - DNA, 23 bp, Homo sapiens
agagtctcacactgtcatccagg

SEQ ID NO: 161630 - DNA, 23 bp, Homo sapiens
ctgtcagtcagtccctcggtcgc

SEQ ID NO: 161631 - DNA, 23 bp, Homo sapiens
cagtgcctcagtctgacttgtga

SEQ ID NO: 161632 - DNA, 19 bp, Homo sapiens
tcactcactgggctttcgg

SEQ ID NO: 161633 - DNA, 23 bp, Homo sapiens
acggagtctcactctgtctcccc

SEQ ID NO: 161634 - DNA, 23 bp, Homo sapiens
tggcagactccctcagtctctag

SEQ ID NO: 161635 - DNA, 22 bp, Homo sapiens
tgttcactgaggaagcctatga

SEQ ID NO: 161636 - DNA, 22 bp, Homo sapiens
tttttagtagagatggggtttc

SEQ ID NO: 161637 - DNA, 22 bp, Homo sapiens
acacagagggataaccatgtga

SEQ ID NO: 161638 - DNA, 21 bp, Homo sapiens
ttctcttttttttttgagaca

SEQ ID NO: 161639 - DNA, 19 bp, Homo sapiens
acactagatgttagttctt

SEQ ID NO: 161640 - DNA, 22 bp, Homo sapiens
tgtctgtctctgtccaaattct

SEQ ID NO: 161641 - DNA, 22 bp, Homo sapiens
ttgagatggagtcttgctatgt

SEQ ID NO: 161642 - DNA, 23 bp, Homo sapiens
attttggtaatctatgtctaact

SEQ ID NO: 161643 - DNA, 23 bp, Homo sapiens
acagagtctcgctctgtcaccca

SEQ ID NO: 161644 - DNA, 23 bp, Homo sapiens
cgacagagtgaaactccttctca

SEQ ID NO: 161645 - DNA, 23 bp, Homo sapiens
acagggtctcactctgtccctca

SEQ ID NO: 161646 - DNA, 23 bp, Homo sapiens
acagagtctcactctgtcgccca

SEQ ID NO: 161647 - DNA, 23 bp, Homo sapiens
ctctgagcctcagtctcacttct

SEQ ID NO: 161648 - DNA, 21 bp, Homo sapiens
tgtgcgcctgtacttccagct

SEQ ID NO: 161649 - DNA, 19 bp, Homo sapiens
cagtggtgtgaacactgta

SEQ ID NO: 161650 - DNA, 18 bp, Homo sapiens
gtgggaggttgacttgag

SEQ ID NO: 161651 - DNA, 19 bp, Homo sapiens
cagtggtgtgaacactgta

SEQ ID NO: 161652 - DNA, 18 bp, Homo sapiens
gtgggaggttgacttgag

SEQ ID NO: 161653 - DNA, 18 bp, Homo sapiens
agagatcagacacagccc

SEQ ID NO: 161654 - DNA, 21 bp, Homo sapiens
ttcaggtaaaattaaagtctc

SEQ ID NO: 161655 - DNA, 23 bp, Homo sapiens
tgttagagtatttttgttttctt

SEQ ID NO: 161656 - DNA, 23 bp, Homo sapiens
atatgtgtatatatatatgtgtg

SEQ ID NO: 161657 - DNA, 18 bp, Homo sapiens
cttgaggcagtgacagaa

SEQ ID NO: 161658 - DNA, 23 bp, Homo sapiens
ttttgagacggagtcttgctctg

SEQ ID NO: 161659 - DNA, 22 bp, Homo sapiens
tccagagattgcttgttatgat

SEQ ID NO: 161660 - DNA, 19 bp, Homo sapiens
tcagtgcctactactgtgt

SEQ ID NO: 161661 - DNA, 22 bp, Homo sapiens
tctggaaccgtatagtgatcat

SEQ ID NO: 161662 - DNA, 22 bp, Homo sapiens
tgccagacactttatgtggtga

SEQ ID NO: 161663 - DNA, 22 bp, Homo sapiens
agtctcactctgtcacccaggc

SEQ ID NO: 161664 - DNA, 21 bp, Homo sapiens
tgcaggtgctcatggtgctga

SEQ ID NO: 161665 - DNA, 19 bp, Homo sapiens
cacagcacagaggcagcag

SEQ ID NO: 161666 - DNA, 23 bp, Homo sapiens
gagtctctctcactgtcgctcag

SEQ ID NO: 161667 - DNA, 23 bp, Homo sapiens
tgtcagcctcagtctccctctgg

SEQ ID NO: 161668 - DNA, 21 bp, Homo sapiens
cttccaggaattgatatgaaa

SEQ ID NO: 161669 - DNA, 21 bp, Homo sapiens
ttttagatggagttttgctct

SEQ ID NO: 161670 - DNA, 23 bp, Homo sapiens
gtcactgtctcactctgttcttt

SEQ ID NO: 161671 - DNA, 23 bp, Homo sapiens
tgtctctctccctctgtgccacg

SEQ ID NO: 161672 - DNA, 23 bp, Homo sapiens
tagcacagcctgctttgttctgg

SEQ ID NO: 161673 - DNA, 23 bp, Homo sapiens
cactgctttgattctctcagtca

SEQ ID NO: 161674 - DNA, 19 bp, Homo sapiens
agaactgtggatttgtctt

SEQ ID NO: 161675 - DNA, 22 bp, Homo sapiens
tgtctctcccagtctcagggcc

SEQ ID NO: 161676 - DNA, 23 bp, Homo sapiens
tgagatggagcctcactctgtca

SEQ ID NO: 161677 - DNA, 20 bp, Homo sapiens
tgggacagacactgtgactg

SEQ ID NO: 161678 - DNA, 23 bp, Homo sapiens
ccctcagggtctctctgtgagcc

SEQ ID NO: 161679 - DNA, 23 bp, Homo sapiens
agagtcagctcacagggtcttca

SEQ ID NO: 161680 - DNA, 20 bp, Homo sapiens
ctgttcaagtctatctatct

SEQ ID NO: 161681 - DNA, 23 bp, Homo sapiens
gagagtggatatagattctgatt

SEQ ID NO: 161682 - DNA, 22 bp, Homo sapiens
tcgtgtcccgttttcaacagac

SEQ ID NO: 161683 - DNA, 23 bp, Homo sapiens
ggagtctcgctctgtgccaggct

SEQ ID NO: 161684 - DNA, 23 bp, Homo sapiens
tgctttcgtgatcaaagccagct

SEQ ID NO: 161685 - DNA, 23 bp, Homo sapiens
actgactggctgtgtgactgcgt

SEQ ID NO: 161686 - DNA, 23 bp, Homo sapiens
actgagtctcgctctgtcgctca

SEQ ID NO: 161687 - DNA, 22 bp, Homo sapiens
ggattacaagcatgagacactg

SEQ ID NO: 161688 - DNA, 23 bp, Homo sapiens
gtcagtcaggcactgtctctctg

SEQ ID NO: 161689 - DNA, 22 bp, Homo sapiens
tgttcactgaggaagcctatga

SEQ ID NO: 161690 - DNA, 23 bp, Homo sapiens
cggagtctcgctctgtctcccag

SEQ ID NO: 161691 - DNA, 23 bp, Homo sapiens
tgttttatttttgaaatgggagc

SEQ ID NO: 161692 - DNA, 19 bp, Homo sapiens
tgacaggcagctttttttt

SEQ ID NO: 161693 - DNA, 23 bp, Homo sapiens
tgagacagagtcttgctctgtca

SEQ ID NO: 161694 - DNA, 23 bp, Homo sapiens
gggtctcactctgtcacccaggc

SEQ ID NO: 161695 - DNA, 23 bp, Homo sapiens
tggagtctcactctgtcacccag

SEQ ID NO: 161696 - DNA, 23 bp, Homo sapiens
ttgagacggggtctcactctgtc

SEQ ID NO: 161697 - DNA, 23 bp, Homo sapiens
tttagtagagatactaaatgtta

SEQ ID NO: 161698 - DNA, 22 bp, Homo sapiens
taaaaggaaccaagactctttg

SEQ ID NO: 161699 - DNA, 23 bp, Homo sapiens
tgagacacagtctcactctgttg

SEQ ID NO: 161700 - DNA, 18 bp, Homo sapiens
tgcagcggtgtgatcctg

SEQ ID NO: 161701 - DNA, 18 bp, Homo sapiens
tatgaacaaagccaaaac

SEQ ID NO: 161702 - DNA, 23 bp, Homo sapiens
tagaactgtgaggaaatgagttt

SEQ ID NO: 161703 - DNA, 23 bp, Homo sapiens
acatgctgaggctctcttcagga

SEQ ID NO: 161704 - DNA, 19 bp, Homo sapiens
gaggtggtaaatgttggag

SEQ ID NO: 161705 - DNA, 23 bp, Homo sapiens
caagagtgagagaacagtgtggg

SEQ ID NO: 161706 - DNA, 19 bp, Homo sapiens
cgctctctctttgccacac

SEQ ID NO: 161707 - DNA, 23 bp, Homo sapiens
tcccagagccagaatatgcagac

SEQ ID NO: 161708 - DNA, 22 bp, Homo sapiens
atgtgtgtatgtatgtgtgtgc

SEQ ID NO: 161709 - DNA, 23 bp, Homo sapiens
ggagtctctcgctctgtcgctca

SEQ ID NO: 161710 - DNA, 21 bp, Homo sapiens
atgtgtgtgcctatacattat

SEQ ID NO: 161711 - DNA, 21 bp, Homo sapiens
aatatgtatgtgtaatgcatt

SEQ ID NO: 161712 - DNA, 23 bp, Homo sapiens
ggagccatagtctcactctgtcg

SEQ ID NO: 161713 - DNA, 22 bp, Homo sapiens
taaaagttgtatagtttagatt

SEQ ID NO: 161714 - DNA, 21 bp, Homo sapiens
tatgtgtatatatatatatgt

SEQ ID NO: 161715 - DNA, 21 bp, Homo sapiens
taatatgtatatttggattca

SEQ ID NO: 161716 - DNA, 23 bp, Homo sapiens
ctgccaatgcaaaaggtgtgttt

SEQ ID NO: 161717 - DNA, 23 bp, Homo sapiens
tgaccatatgtatgcatgtatgt

SEQ ID NO: 161718 - DNA, 23 bp, Homo sapiens
agaagagagacagcacacagtgt

SEQ ID NO: 161719 - DNA, 23 bp, Homo sapiens
tgatatggtttggctctgtgtcc

SEQ ID NO: 161720 - DNA, 22 bp, Homo sapiens
tcactgcactctctgcctcctg

SEQ ID NO: 161721 - DNA, 23 bp, Homo sapiens
tgtgtgtgtatttctatatagca

SEQ ID NO: 161722 - DNA, 23 bp, Homo sapiens
tgtgtgtgtatttctatatagca

SEQ ID NO: 161723 - DNA, 21 bp, Homo sapiens
gctgctctctgtgtgtgactc

SEQ ID NO: 161724 - DNA, 23 bp, Homo sapiens
ctgatgagtgagaggacatgtga

SEQ ID NO: 161725 - DNA, 23 bp, Homo sapiens
aggggctggcattgttctatttc

SEQ ID NO: 161726 - DNA, 23 bp, Homo sapiens
tgcagtgagccaagatcatgcca

SEQ ID NO: 161727 - DNA, 22 bp, Homo sapiens
taggcaccccttttcatctgta

SEQ ID NO: 161728 - DNA, 23 bp, Homo sapiens
gaagaactgtgactctgtctctc

SEQ ID NO: 161729 - DNA, 21 bp, Homo sapiens
aacaaaggttgggaaagattt

SEQ ID NO: 161730 - DNA, 18 bp, Homo sapiens
ttttgagacggagtctca

SEQ ID NO: 161731 - DNA, 20 bp, Homo sapiens
tatacgtcctatatatatac

SEQ ID NO: 161732 - DNA, 23 bp, Homo sapiens
tttttttgagagggagtcttgca

SEQ ID NO: 161733 - DNA, 23 bp, Homo sapiens
ctcaccctgtcactgtctttaaa

SEQ ID NO: 161734 - DNA, 23 bp, Homo sapiens
tggaattagtttagcctgtgtgg

SEQ ID NO: 161735 - DNA, 23 bp, Homo sapiens
ttaacagtgtgatctaaccttgt

SEQ ID NO: 161736 - DNA, 22 bp, Homo sapiens
ttgtttcagttttaaatgtgtt

SEQ ID NO: 161737 - DNA, 23 bp, Homo sapiens
agctactgtgtatatttcttttt

SEQ ID NO: 161738 - DNA, 23 bp, Homo sapiens
ttcgtagagatggggtttcaccg

SEQ ID NO: 161739 - DNA, 23 bp, Homo sapiens
accatgtttgtcagactgatctc

SEQ ID NO: 161740 - DNA, 20 bp, Homo sapiens
tcatttcttgcatgtatagt

SEQ ID NO: 161741 - DNA, 20 bp, Homo sapiens
tattctatgaatttattggt

SEQ ID NO: 161742 - DNA, 23 bp, Homo sapiens
cacagtgagaagacagtgggtca

SEQ ID NO: 161743 - DNA, 23 bp, Homo sapiens
tgagacagagtctcgctgtgtcg

SEQ ID NO: 161744 - DNA, 23 bp, Homo sapiens
tgtctgtgtgtctacgtgtgtgt

SEQ ID NO: 161745 - DNA, 23 bp, Homo sapiens
tttgagacagagtctcttgatgg

SEQ ID NO: 161746 - DNA, 20 bp, Homo sapiens
tcagtctctctctgttaaaa

SEQ ID NO: 161747 - DNA, 22 bp, Homo sapiens
tggatgctaatgagttgactga

SEQ ID NO: 161748 - DNA, 23 bp, Homo sapiens
tggagtctcactctgtcacccag

SEQ ID NO: 161749 - DNA, 23 bp, Homo sapiens
taagatttaattgaccatagcca

SEQ ID NO: 161750 - DNA, 19 bp, Homo sapiens
taaggttgaattttttttt

SEQ ID NO: 161751 - DNA, 23 bp, Homo sapiens
tgagatggagtttcactcttgtt

SEQ ID NO: 161752 - DNA, 20 bp, Homo sapiens
tttctggaaaaagaatgcag

SEQ ID NO: 161753 - DNA, 23 bp, Homo sapiens
tgattctacatgatggtgagttg

SEQ ID NO: 161754 - DNA, 23 bp, Homo sapiens
ttgagaagagattgattgttttt

SEQ ID NO: 161755 - DNA, 23 bp, Homo sapiens
tgagatgcagtctgactctgtca

SEQ ID NO: 161756 - DNA, 21 bp, Homo sapiens
tgtgtatatatatatgtatgt

SEQ ID NO: 161757 - DNA, 23 bp, Homo sapiens
tctctgcctcagtgtctctgggt

SEQ ID NO: 161758 - DNA, 22 bp, Homo sapiens
tgtgagaagagtctgtgcccac

SEQ ID NO: 161759 - DNA, 23 bp, Homo sapiens
tgtctctgaagaaaggaggaaaa

SEQ ID NO: 161760 - DNA, 23 bp, Homo sapiens
tgttagtttttctttttccagac

SEQ ID NO: 161761 - DNA, 23 bp, Homo sapiens
tacatgcctgaagctgatctaag

SEQ ID NO: 161762 - DNA, 23 bp, Homo sapiens
ctttgagacggagtctcactcta

SEQ ID NO: 161763 - DNA, 18 bp, Homo sapiens
acgagagaaatatatgtg

SEQ ID NO: 161764 - DNA, 23 bp, Homo sapiens
ggggtctcactctgtcacccagg

SEQ ID NO: 161765 - DNA, 23 bp, Homo sapiens
aatgtgcatatatatgcaaatgt

SEQ ID NO: 161766 - DNA, 23 bp, Homo sapiens
gtctgtctcagtgtctctcatgc

SEQ ID NO: 161767 - DNA, 20 bp, Homo sapiens
acttggcagttctacctcta

SEQ ID NO: 161768 - DNA, 23 bp, Homo sapiens
ctgactcagtgtgtgtgtgtgct

SEQ ID NO: 161769 - DNA, 23 bp, Homo sapiens
gaggcaagagtctcactctgtcc

SEQ ID NO: 161770 - DNA, 20 bp, Homo sapiens
agacttgaaggtaggaaggt

SEQ ID NO: 161771 - DNA, 23 bp, Homo sapiens
gtgtgtgtatatatatatgtgtg

SEQ ID NO: 161772 - DNA, 23 bp, Homo sapiens
catgtatgcatgtatatacatat

SEQ ID NO: 161773 - DNA, 19 bp, Homo sapiens
gagagagagagagggagct

SEQ ID NO: 161774 - DNA, 22 bp, Homo sapiens
taagtgtatccgtaaagtctgt

SEQ ID NO: 161775 - DNA, 23 bp, Homo sapiens
tgtcacatttgaatactccttgc

SEQ ID NO: 161776 - DNA, 23 bp, Homo sapiens
cagtacagagagttcccatgtct

SEQ ID NO: 161777 - DNA, 22 bp, Homo sapiens
tcaggctgggagtcttagatca

SEQ ID NO: 161778 - DNA, 19 bp, Homo sapiens
tcactgatgatagacagca

SEQ ID NO: 161779 - DNA, 23 bp, Homo sapiens
tgacagcctctctctctgagtct

SEQ ID NO: 161780 - DNA, 23 bp, Homo sapiens
ctgggtgacagagtgacactctc

SEQ ID NO: 161781 - DNA, 23 bp, Homo sapiens
tgagttcattgtagattctggat

SEQ ID NO: 161782 - DNA, 23 bp, Homo sapiens
acagagtctcgctctgtcaccca

SEQ ID NO: 161783 - DNA, 23 bp, Homo sapiens
tggtgtctcactctgtcacccag

SEQ ID NO: 161784 - DNA, 19 bp, Homo sapiens
ggagtctcgctctgtcacc

SEQ ID NO: 161785 - DNA, 23 bp, Homo sapiens
tttcacacactctgtcattttgc

SEQ ID NO: 161786 - DNA, 23 bp, Homo sapiens
aagtgacacacagtactggaagc

SEQ ID NO: 161787 - DNA, 23 bp, Homo sapiens
acagagtctcactctgtcgccca

SEQ ID NO: 161788 - DNA, 23 bp, Homo sapiens
cggaggctctgtcgctgtgtccc

SEQ ID NO: 161789 - DNA, 21 bp, Homo sapiens
attctggtaagagagtagcca

SEQ ID NO: 161790 - DNA, 23 bp, Homo sapiens
tcagtctgtcactcagaatgctg

SEQ ID NO: 161791 - DNA, 23 bp, Homo sapiens
ctatcagtggttgagagaaggat

SEQ ID NO: 161792 - DNA, 20 bp, Homo sapiens
tatgtgtgtgtgtgtgtgtg

SEQ ID NO: 161793 - DNA, 23 bp, Homo sapiens
tttgcttttattttgctttgaga

SEQ ID NO: 161794 - DNA, 23 bp, Homo sapiens
atctcaggtactttgttatagag

SEQ ID NO: 161795 - DNA, 23 bp, Homo sapiens
tttgagacaaatctcgctctgtc

SEQ ID NO: 161796 - DNA, 19 bp, Homo sapiens
tttgagagttgaaagtgag

SEQ ID NO: 161797 - DNA, 23 bp, Homo sapiens
ccactgtctctctgtctggctgg

SEQ ID NO: 161798 - DNA, 23 bp, Homo sapiens
agggtgactcacacgctcagagg

SEQ ID NO: 161799 - DNA, 23 bp, Homo sapiens
tgatgtctcgctctgtcgctcac

SEQ ID NO: 161800 - DNA, 19 bp, Homo sapiens
acagctgcctgacactgcc

SEQ ID NO: 161801 - DNA, 18 bp, Homo sapiens
tgaggttggtggatctct

SEQ ID NO: 161802 - DNA, 23 bp, Homo sapiens
cagagctagattctgtctcaaaa

SEQ ID NO: 161803 - DNA, 23 bp, Homo sapiens
ttagatggagtcccactctgtca

SEQ ID NO: 161804 - DNA, 18 bp, Homo sapiens
tatgtatacatatacatg

SEQ ID NO: 161805 - DNA, 22 bp, Homo sapiens
atatatatgtatatgtatacat

SEQ ID NO: 161806 - DNA, 23 bp, Homo sapiens
aaagtgctaggattacaggtgtg

SEQ ID NO: 161807 - DNA, 19 bp, Homo sapiens
tgagattataggtatgagt

SEQ ID NO: 161808 - DNA, 23 bp, Homo sapiens
atgcagtctcactctgtcaccca

SEQ ID NO: 161809 - DNA, 23 bp, Homo sapiens
tgagatggagtctcgctctgttg

SEQ ID NO: 161810 - DNA, 23 bp, Homo sapiens
cgcatcccctagggcattggtgt

SEQ ID NO: 161811 - DNA, 22 bp, Homo sapiens
ccactgccccaggtgctgctgg

SEQ ID NO: 161812 - DNA, 23 bp, Homo sapiens
atctgtgcgtgtgtgtgcgcgtg

SEQ ID NO: 161813 - DNA, 23 bp, Homo sapiens
gtgtgcgtgtgtgtgatgtggat

SEQ ID NO: 161814 - DNA, 21 bp, Homo sapiens
tctctgggtctgtctccctcc

SEQ ID NO: 161815 - DNA, 23 bp, Homo sapiens
tatgtgtatacacacacacacac

SEQ ID NO: 161816 - DNA, 22 bp, Homo sapiens
tagcagcacagaaatattggca

SEQ ID NO: 161817 - DNA, 23 bp, Homo sapiens
tctgggactcacagtccttcacc

SEQ ID NO: 161818 - DNA, 18 bp, Homo sapiens
gaacacacataggagacg

SEQ ID NO: 161819 - DNA, 23 bp, Homo sapiens
ctgtctgcctgtctgtctctctg

SEQ ID NO: 161820 - DNA, 23 bp, Homo sapiens
tgagatggagtctcactctgtca

SEQ ID NO: 161821 - DNA, 19 bp, Homo sapiens
tgtctgaatcactctctcc

SEQ ID NO: 161822 - DNA, 23 bp, Homo sapiens
tgtgtgccactgtgcctggctaa

SEQ ID NO: 161823 - DNA, 22 bp, Homo sapiens
atttttagtagagacggggttt

SEQ ID NO: 161824 - DNA, 19 bp, Homo sapiens
accatgttggccagctgct

SEQ ID NO: 161825 - DNA, 23 bp, Homo sapiens
atgtgtgtgatgtgagtgtgcag

SEQ ID NO: 161826 - DNA, 23 bp, Homo sapiens
tgtctgtgtctgtgagggagtga

SEQ ID NO: 161827 - DNA, 23 bp, Homo sapiens
gtcactgtgtctgtgtcccccag

SEQ ID NO: 161828 - DNA, 23 bp, Homo sapiens
ctgtgtctgtatctgtgtctcta

SEQ ID NO: 161829 - DNA, 18 bp, Homo sapiens
tttgtgctccaaagtgat

SEQ ID NO: 161830 - DNA, 23 bp, Homo sapiens
tttgctcaagaacgctttatcag

SEQ ID NO: 161831 - DNA, 23 bp, Homo sapiens
tgtgcatgtctctgtgcctgtgt

SEQ ID NO: 161832 - DNA, 23 bp, Homo sapiens
tagacagggtcttgttctgtcac

SEQ ID NO: 161833 - DNA, 22 bp, Homo sapiens
tgagtctcattctgtcactcac

SEQ ID NO: 161834 - DNA, 23 bp, Homo sapiens
ccggctctctctctgctaggaga

SEQ ID NO: 161835 - DNA, 23 bp, Homo sapiens
tctttctcacttgagggtgattt

SEQ ID NO: 161836 - DNA, 23 bp, Homo sapiens
tgagactgagtcttgctctgtca

SEQ ID NO: 161837 - DNA, 18 bp, Homo sapiens
atgtggattttttttttt

SEQ ID NO: 161838 - DNA, 18 bp, Homo sapiens
tgagagagtcccactctt

SEQ ID NO: 161839 - DNA, 18 bp, Homo sapiens
acaagtgatggaagtctg

SEQ ID NO: 161840 - DNA, 20 bp, Homo sapiens
agccagacaccttcagattt

SEQ ID NO: 161841 - DNA, 21 bp, Homo sapiens
atgaagtctcaatatgttgcc

SEQ ID NO: 161842 - DNA, 20 bp, Homo sapiens
tacccagtgaggtatgcagg

SEQ ID NO: 161843 - DNA, 23 bp, Homo sapiens
ttgagacagagtttttgctctgt

SEQ ID NO: 161844 - DNA, 23 bp, Homo sapiens
ctggctgtctctgtcccagtctc

SEQ ID NO: 161845 - DNA, 22 bp, Homo sapiens
tctctgtctctctctcgacaga

SEQ ID NO: 161846 - DNA, 18 bp, Homo sapiens
gtatatatatatgtgtgt

SEQ ID NO: 161847 - DNA, 23 bp, Homo sapiens
tatgtgtatatatatatgtgtgt

SEQ ID NO: 161848 - DNA, 21 bp, Homo sapiens
atgtatgtgtgtatatgcatg

SEQ ID NO: 161849 - DNA, 23 bp, Homo sapiens
cggagtctcactctgtcacccag

SEQ ID NO: 161850 - DNA, 23 bp, Homo sapiens
gagtctcactctgtcacccaggc

SEQ ID NO: 161851 - DNA, 22 bp, Homo sapiens
tttggcacagcctgttgtctcc

SEQ ID NO: 161852 - DNA, 23 bp, Homo sapiens
actcaggcacactcactcctact

SEQ ID NO: 161853 - DNA, 23 bp, Homo sapiens
aagtctcactgtgtcactcaggt

SEQ ID NO: 161854 - DNA, 18 bp, Homo sapiens
cagccagagtgtgaggcc

SEQ ID NO: 161855 - DNA, 23 bp, Homo sapiens
tgagacggagtctcactctgtca

SEQ ID NO: 161856 - DNA, 23 bp, Homo sapiens
tcagagaggttcttgtatgtatg

SEQ ID NO: 161857 - DNA, 18 bp, Homo sapiens
ttttgagacggagtctca

SEQ ID NO: 161858 - DNA, 23 bp, Homo sapiens
tttgagacggagtcttgctctct

SEQ ID NO: 161859 - DNA, 23 bp, Homo sapiens
cagatcatcatagcaaaagttga

SEQ ID NO: 161860 - DNA, 23 bp, Homo sapiens
ttggagtctcactctgtcaccca

SEQ ID NO: 161861 - DNA, 22 bp, Homo sapiens
aagaggttgaaggtaggattga

SEQ ID NO: 161862 - DNA, 23 bp, Homo sapiens
ctgtctctgtctccctccattcc

SEQ ID NO: 161863 - DNA, 23 bp, Homo sapiens
agaaggagtctcactctgtcacc

SEQ ID NO: 161864 - DNA, 19 bp, Homo sapiens
tgagatggagtctcactct

SEQ ID NO: 161865 - DNA, 23 bp, Homo sapiens
gagtctcactctgtcacccaggc

SEQ ID NO: 161866 - DNA, 19 bp, Homo sapiens
tacagtggtgtgatttctg

SEQ ID NO: 161867 - DNA, 23 bp, Homo sapiens
tccgtctgagactctgtctcaaa

SEQ ID NO: 161868 - DNA, 18 bp, Homo sapiens
aggtagtctctaaagact

SEQ ID NO: 161869 - DNA, 23 bp, Homo sapiens
ctaacagcttcatgaagtagggc

SEQ ID NO: 161870 - DNA, 23 bp, Homo sapiens
tacatgtgcacaatgtgcaggtt

SEQ ID NO: 161871 - DNA, 23 bp, Homo sapiens
actccgtctcaaaaaaaagtgaa

SEQ ID NO: 161872 - DNA, 23 bp, Homo sapiens
gagacagagtctcgctctgtccc

SEQ ID NO: 161873 - DNA, 18 bp, Homo sapiens
tcactgaactgagtgatc

SEQ ID NO: 161874 - DNA, 23 bp, Homo sapiens
tgagatggagtctcactctgtcg

SEQ ID NO: 161875 - DNA, 23 bp, Homo sapiens
tatatgtgcatgtgtgtgtgtgt

SEQ ID NO: 161876 - DNA, 23 bp, Homo sapiens
gagacggtgtctcgctctgtcgc

SEQ ID NO: 161877 - DNA, 22 bp, Homo sapiens
tcgtcctgaggtaaacttgagt

SEQ ID NO: 161878 - DNA, 23 bp, Homo sapiens
gacagagtctcgctctgtcaccc

SEQ ID NO: 161879 - DNA, 23 bp, Homo sapiens
agctttgactctgactctctcct

SEQ ID NO: 161880 - DNA, 23 bp, Homo sapiens
gacagagtctcgctctgtcaccc

SEQ ID NO: 161881 - DNA, 21 bp, Homo sapiens
taaagtgtggaaactttgatg

SEQ ID NO: 161882 - DNA, 23 bp, Homo sapiens
gacagagtctcgctctgtcaccc

SEQ ID NO: 161883 - DNA, 23 bp, Homo sapiens
cggagtctcgctctgtcgctcag

SEQ ID NO: 161884 - DNA, 23 bp, Homo sapiens
acagagtctcgctctgtctccca

SEQ ID NO: 161885 - DNA, 23 bp, Homo sapiens
gtcagactaatgtgtttctaaat

SEQ ID NO: 161886 - DNA, 23 bp, Homo sapiens
tttcagacacagtcttgctctat

SEQ ID NO: 161887 - DNA, 20 bp, Homo sapiens
aagcacctcaaagtctagaa

SEQ ID NO: 161888 - DNA, 23 bp, Homo sapiens
agtaacagtctccagtcacggcc

SEQ ID NO: 161889 - DNA, 22 bp, Homo sapiens
taacagtctacagccatggtcg

SEQ ID NO: 161890 - DNA, 21 bp, Homo sapiens
ggaggctgtcaagattgtgcc

SEQ ID NO: 161891 - DNA, 23 bp, Homo sapiens
gacagagtctcgctctgtcaccc

SEQ ID NO: 161892 - DNA, 23 bp, Homo sapiens
gagactgtgtctcactctgtcgc

SEQ ID NO: 161893 - DNA, 22 bp, Homo sapiens
atccctctttatctaattgcca

SEQ ID NO: 161894 - DNA, 19 bp, Homo sapiens
gtctccctcagtcgctcag

SEQ ID NO: 161895 - DNA, 23 bp, Homo sapiens
cggagtctcgctctgtcgctcag

SEQ ID NO: 161896 - DNA, 23 bp, Homo sapiens
ttgacacagggtctcactctgtc

SEQ ID NO: 161897 - DNA, 22 bp, Homo sapiens
tgagccgcagtagttcttcagt

SEQ ID NO: 161898 - DNA, 23 bp, Homo sapiens
aagctgccagttgaagaactgtt

SEQ ID NO: 161899 - DNA, 23 bp, Homo sapiens
actgtagagagtcagctcaggtg

SEQ ID NO: 161900 - DNA, 23 bp, Homo sapiens
actgtacagagtcagctcaggtg

SEQ ID NO: 161901 - DNA, 23 bp, Homo sapiens
actgtacagagtcagctcaggtg

SEQ ID NO: 161902 - DNA, 23 bp, Homo sapiens
actgtagagagtcagctcaggtg

SEQ ID NO: 161903 - DNA, 23 bp, Homo sapiens
ctgtacagagtcagctcaggtgg

SEQ ID NO: 161904 - DNA, 23 bp, Homo sapiens
tgtctgcctcggtctctgaagtc

SEQ ID NO: 161905 - DNA, 22 bp, Homo sapiens
tgacagagtgagactctctctc

SEQ ID NO: 161906 - DNA, 23 bp, Homo sapiens
taacattgaggtatttatttatt

SEQ ID NO: 161907 - DNA, 23 bp, Homo sapiens
agactgagtctcgctctgttacc

SEQ ID NO: 161908 - DNA, 23 bp, Homo sapiens
tgggagacttctcattttgttct

SEQ ID NO: 161909 - DNA, 23 bp, Homo sapiens
tttttgttgttgagacggagtct

SEQ ID NO: 161910 - DNA, 22 bp, Homo sapiens
ttttgagatggagtcttgctct

SEQ ID NO: 161911 - DNA, 23 bp, Homo sapiens
aacagcatgagggaaatggctct

SEQ ID NO: 161912 - DNA, 21 bp, Homo sapiens
ttttgagagggagtcttgctc

SEQ ID NO: 161913 - DNA, 22 bp, Homo sapiens
tttttcttgagacagggtctca

SEQ ID NO: 161914 - DNA, 23 bp, Homo sapiens
tgagatggagtctcactgtgtca

SEQ ID NO: 161915 - DNA, 23 bp, Homo sapiens
aatatgcctgggataaaaatctg

SEQ ID NO: 161916 - DNA, 23 bp, Homo sapiens
tcaactcactgcaacctctgtct

SEQ ID NO: 161917 - DNA, 22 bp, Homo sapiens
tgcctttgatgtctgtctccag

SEQ ID NO: 161918 - DNA, 22 bp, Homo sapiens
gtgggcctgagttacctgagag

SEQ ID NO: 161919 - DNA, 21 bp, Homo sapiens
tgagacagagtctcgctctgt

SEQ ID NO: 161920 - DNA, 19 bp, Homo sapiens
ttgttagattttgtatcgg

SEQ ID NO: 161921 - DNA, 18 bp, Homo sapiens
tgagttggagtctggctc

SEQ ID NO: 161922 - DNA, 22 bp, Homo sapiens
acatgtgcacaatgtgcaggtt

SEQ ID NO: 161923 - DNA, 22 bp, Homo sapiens
aaaaaagtaaagtaggtattac

SEQ ID NO: 161924 - DNA, 20 bp, Homo sapiens
tctcactctgtcacctaggc

SEQ ID NO: 161925 - DNA, 23 bp, Homo sapiens
ctgtgagtgtgagagcatgtggt

SEQ ID NO: 161926 - DNA, 23 bp, Homo sapiens
attcataaggtggagaatagctt

SEQ ID NO: 161927 - DNA, 22 bp, Homo sapiens
tgagatggagtttcactcttgt

SEQ ID NO: 161928 - DNA, 23 bp, Homo sapiens
ttgtttcatgaaaaccgagactt

SEQ ID NO: 161929 - DNA, 23 bp, Homo sapiens
cagagtctcactctgtcaccccg

SEQ ID NO: 161930 - DNA, 23 bp, Homo sapiens
tgagatactgcaacaggatgtgt

SEQ ID NO: 161931 - DNA, 20 bp, Homo sapiens
ttgtaaatccatcagctact

SEQ ID NO: 161932 - DNA, 20 bp, Homo sapiens
ttttgctcttgagccccagt

SEQ ID NO: 161933 - DNA, 22 bp, Homo sapiens
gtaggaggatcactttagcttt

SEQ ID NO: 161934 - DNA, 23 bp, Homo sapiens
acacagtctcactctgtcacctg

SEQ ID NO: 161935 - DNA, 21 bp, Homo sapiens
ttcaagtgattctcctgcctc

SEQ ID NO: 161936 - DNA, 19 bp, Homo sapiens
actgtagtgtgtatgtgta

SEQ ID NO: 161937 - DNA, 23 bp, Homo sapiens
tatgtgtgtgtatatgtatacat

SEQ ID NO: 161938 - DNA, 21 bp, Homo sapiens
tatatgcatatatttacacat

SEQ ID NO: 161939 - DNA, 23 bp, Homo sapiens
tacatgtgtatatgtatatatgt

SEQ ID NO: 161940 - DNA, 23 bp, Homo sapiens
acatgtgtatatgtatatatgta

SEQ ID NO: 161941 - DNA, 23 bp, Homo sapiens
tcccactcttttactgtgaactt

SEQ ID NO: 161942 - DNA, 23 bp, Homo sapiens
ctgtctcactgtgtccctcacat

SEQ ID NO: 161943 - DNA, 23 bp, Homo sapiens
tgagttcattgtagattctggat

SEQ ID NO: 161944 - DNA, 23 bp, Homo sapiens
tgagttcattgtagattctggat

SEQ ID NO: 161945 - DNA, 22 bp, Homo sapiens
atgtatatgtgcatgtgtatgt

SEQ ID NO: 161946 - DNA, 23 bp, Homo sapiens
tacagtgagatctttggtgatac

SEQ ID NO: 161947 - DNA, 23 bp, Homo sapiens
agtctggtattccaactctctag

SEQ ID NO: 161948 - DNA, 23 bp, Homo sapiens
tatgtgtatatgtatgtgtgtgt

SEQ ID NO: 161949 - DNA, 23 bp, Homo sapiens
acatatatatacacacacataca

SEQ ID NO: 161950 - DNA, 23 bp, Homo sapiens
tacatctatatgtagtatgtatg

SEQ ID NO: 161951 - DNA, 21 bp, Homo sapiens
atatactacatctatatgtag

SEQ ID NO: 161952 - DNA, 18 bp, Homo sapiens
tgctacatataggggttg

SEQ ID NO: 161953 - DNA, 19 bp, Homo sapiens
tatacacatgtatatgtag

SEQ ID NO: 161954 - DNA, 18 bp, Homo sapiens
tgtataacatatgtgtat

SEQ ID NO: 161955 - DNA, 23 bp, Homo sapiens
tatatgtatgtatatatgtgtgt

SEQ ID NO: 161956 - DNA, 19 bp, Homo sapiens
atatatgtgtgtatatgta

SEQ ID NO: 161957 - DNA, 23 bp, Homo sapiens
atatgcatgtgtgtatatgtata

SEQ ID NO: 161958 - DNA, 23 bp, Homo sapiens
ttctcacagtcacttatctcctt

SEQ ID NO: 161959 - DNA, 23 bp, Homo sapiens
tgagttcattgtagattctggat

SEQ ID NO: 161960 - DNA, 23 bp, Homo sapiens
tgagttcattgtagattctggat

SEQ ID NO: 161961 - DNA, 23 bp, Homo sapiens
atatgtttagatatcgaatgtat

SEQ ID NO: 161962 - DNA, 23 bp, Homo sapiens
tctctctgactctaaagtctgtg

SEQ ID NO: 161963 - DNA, 21 bp, Homo sapiens
acagagtctcactccctcacc

SEQ ID NO: 161964 - DNA, 22 bp, Homo sapiens
gggaagcttatgaaccagaggt

SEQ ID NO: 161965 - DNA, 22 bp, Homo sapiens
tgtcagagtttgttattttgtg

SEQ ID NO: 161966 - DNA, 23 bp, Homo sapiens
gggtctcactctgtcacccaggc

SEQ ID NO: 161967 - DNA, 23 bp, Homo sapiens
gactgagtctcgctctgtcaccc

SEQ ID NO: 161968 - DNA, 23 bp, Homo sapiens
atacgtatataagcttatacaca

SEQ ID NO: 161969 - DNA, 23 bp, Homo sapiens
ggatatgagtggaaatgatgtgg

SEQ ID NO: 161970 - DNA, 19 bp, Homo sapiens
tgagtggtatgttgtctca

SEQ ID NO: 161971 - DNA, 23 bp, Homo sapiens
gtctccctgcctccctgtctcat

SEQ ID NO: 161972 - DNA, 19 bp, Homo sapiens
tctctagaactaaaaaggc

SEQ ID NO: 161973 - DNA, 21 bp, Homo sapiens
ttttgagacaagagtctcact

SEQ ID NO: 161974 - DNA, 23 bp, Homo sapiens
ggagtctcactctgtcacccagg

SEQ ID NO: 161975 - DNA, 19 bp, Homo sapiens
aaagtgctgggattacagg

SEQ ID NO: 161976 - DNA, 23 bp, Homo sapiens
agtcaaaatctatgtgcagagtg

SEQ ID NO: 161977 - DNA, 22 bp, Homo sapiens
tttgatggagttgtttttttct

SEQ ID NO: 161978 - DNA, 23 bp, Homo sapiens
gggtctcactctgtcacccaggc

SEQ ID NO: 161979 - DNA, 23 bp, Homo sapiens
ttgagacggagtctcactctgtc

SEQ ID NO: 161980 - DNA, 23 bp, Homo sapiens
tgatgactagtgatgttgatcat

SEQ ID NO: 161981 - DNA, 20 bp, Homo sapiens
tggaagtggcaatttgttca

SEQ ID NO: 161982 - DNA, 20 bp, Homo sapiens
aatgtggttgatgtttcctt

SEQ ID NO: 161983 - DNA, 23 bp, Homo sapiens
attttctttccaactgtagtcat

SEQ ID NO: 161984 - DNA, 23 bp, Homo sapiens
actgagattacatattcagcagt

SEQ ID NO: 161985 - DNA, 23 bp, Homo sapiens
tttatttctgtttttaatgcttt

SEQ ID NO: 161986 - DNA, 21 bp, Homo sapiens
agttattggtgttagtataga

SEQ ID NO: 161987 - DNA, 20 bp, Homo sapiens
gttgattttgtaccctgaaa

SEQ ID NO: 161988 - DNA, 23 bp, Homo sapiens
tgagttcattgtagattctggat

SEQ ID NO: 161989 - DNA, 23 bp, Homo sapiens
tgagttcattgtagattctggat

SEQ ID NO: 161990 - DNA, 23 bp, Homo sapiens
gacagagtctcgctctgtcaccc

SEQ ID NO: 161991 - DNA, 23 bp, Homo sapiens
tgtcagaagagtgagtgctcttg

SEQ ID NO: 161992 - DNA, 23 bp, Homo sapiens
tgttactccatctccaactccac

SEQ ID NO: 161993 - DNA, 23 bp, Homo sapiens
tgagttcattgtagattctggat

SEQ ID NO: 161994 - DNA, 23 bp, Homo sapiens
tgagttcattgtagattctggat

SEQ ID NO: 161995 - DNA, 23 bp, Homo sapiens
tgttgttgcttgtccttgagaat

SEQ ID NO: 161996 - DNA, 23 bp, Homo sapiens
ctgtgccagtgcctggagctgtc

SEQ ID NO: 161997 - DNA, 18 bp, Homo sapiens
atgactatatatatatga

SEQ ID NO: 161998 - DNA, 23 bp, Homo sapiens
atgtgtgtgtatatatgtgtgtg

SEQ ID NO: 161999 - DNA, 23 bp, Homo sapiens
tgagttcattgtagattctggat

SEQ ID NO: 162000 - DNA, 23 bp, Homo sapiens
tgagttcattgtagattctggat

SEQ ID NO: 162001 - DNA, 23 bp, Homo sapiens
ctcactctgtcacccagactaga

SEQ ID NO: 162002 - DNA, 22 bp, Homo sapiens
ttactgaatttgtttatgagat

SEQ ID NO: 162003 - DNA, 22 bp, Homo sapiens
atgagtctttagggttttctaa

SEQ ID NO: 162004 - DNA, 23 bp, Homo sapiens
tgtgaagaaggtgcctgcttctc

SEQ ID NO: 162005 - DNA, 22 bp, Homo sapiens
actgagacacctggttttcctc

SEQ ID NO: 162006 - DNA, 23 bp, Homo sapiens
tgagagatcacacagtgctcagc

SEQ ID NO: 162007 - DNA, 23 bp, Homo sapiens
gacagagtctcgctctgtcaccc

SEQ ID NO: 162008 - DNA, 23 bp, Homo sapiens
tttgcaaatcacatgcttatctg

SEQ ID NO: 162009 - DNA, 23 bp, Homo sapiens
aggaaagaagaatgtgatcagca

SEQ ID NO: 162010 - DNA, 23 bp, Homo sapiens
atatttgtagcagagtatgtgat

SEQ ID NO: 162011 - DNA, 21 bp, Homo sapiens
tgtgtctatatgtatgtgtgt

SEQ ID NO: 162012 - DNA, 23 bp, Homo sapiens
aaacacacacacagatagatgtg

SEQ ID NO: 162013 - DNA, 21 bp, Homo sapiens
agaccaggctgactgtgtgac

SEQ ID NO: 162014 - DNA, 23 bp, Homo sapiens
gggcctgtgtctgtgtgtgagtg

SEQ ID NO: 162015 - DNA, 20 bp, Homo sapiens
cagagtctcactctgtcact

SEQ ID NO: 162016 - DNA, 21 bp, Homo sapiens
tcactctgtcactcaggctgg

SEQ ID NO: 162017 - DNA, 19 bp, Homo sapiens
cacacacactcagatgact

SEQ ID NO: 162018 - DNA, 18 bp, Homo sapiens
attggagcagtggggcac

SEQ ID NO: 162019 - DNA, 23 bp, Homo sapiens
ttctgtacatatgtttatgtgtg

SEQ ID NO: 162020 - DNA, 21 bp, Homo sapiens
tctgagactctctttgcctct

SEQ ID NO: 162021 - DNA, 23 bp, Homo sapiens
tgagttcattgtagattctggat

SEQ ID NO: 162022 - DNA, 23 bp, Homo sapiens
tgagttcattgtagattctggat

SEQ ID NO: 162023 - DNA, 23 bp, Homo sapiens
catctgtcagtctgtctccctgt

SEQ ID NO: 162024 - DNA, 22 bp, Homo sapiens
agaacagtgctctatgtgcgtt

SEQ ID NO: 162025 - DNA, 23 bp, Homo sapiens
agtactgtgtgttttccaaattg

SEQ ID NO: 162026 - DNA, 20 bp, Homo sapiens
tatatgtgtgtgtatgtata

SEQ ID NO: 162027 - DNA, 23 bp, Homo sapiens
cggagtctcactctgtcacccag

SEQ ID NO: 162028 - DNA, 23 bp, Homo sapiens
gagtctcactctgtcacccaggc

SEQ ID NO: 162029 - DNA, 21 bp, Homo sapiens
aatgtgctactatttgtgtga

SEQ ID NO: 162030 - DNA, 23 bp, Homo sapiens
ggctgggtgactccctggctctc

SEQ ID NO: 162031 - DNA, 20 bp, Homo sapiens
tcagagtagagagaggtcag

SEQ ID NO: 162032 - DNA, 23 bp, Homo sapiens
tgagttcattgtagattctggat

SEQ ID NO: 162033 - DNA, 23 bp, Homo sapiens
tgagttcattgtagattctggat

SEQ ID NO: 162034 - DNA, 19 bp, Homo sapiens
tctgaatatatatattcgt

SEQ ID NO: 162035 - DNA, 22 bp, Homo sapiens
tccccgaaataaattcagttta

SEQ ID NO: 162036 - DNA, 20 bp, Homo sapiens
agtctgaagagagtcaggag

SEQ ID NO: 162037 - DNA, 23 bp, Homo sapiens
gacagagtctcgctctgtcaccc

SEQ ID NO: 162038 - DNA, 23 bp, Homo sapiens
ctctgtcactgaggctagattgc

SEQ ID NO: 162039 - DNA, 23 bp, Homo sapiens
gacagagtctcgctctgtcaccc

SEQ ID NO: 162040 - DNA, 21 bp, Homo sapiens
tgaggtaggaggatctgttga

SEQ ID NO: 162041 - DNA, 21 bp, Homo sapiens
aagacaaccgtaaaagatggg

SEQ ID NO: 162042 - DNA, 23 bp, Homo sapiens
ttcatggttgtaggatgaaaact

SEQ ID NO: 162043 - DNA, 22 bp, Homo sapiens
aaaactgtaaatggaatcctgt

SEQ ID NO: 162044 - DNA, 21 bp, Homo sapiens
gtcagtgtcagaggtgtttga

SEQ ID NO: 162045 - DNA, 23 bp, Homo sapiens
gtctctgagtggtgagtgaccag

SEQ ID NO: 162046 - DNA, 23 bp, Homo sapiens
ttgctgtgaagggagtagctatt

SEQ ID NO: 162047 - DNA, 19 bp, Homo sapiens
tccttctcacaggtaaaaa

SEQ ID NO: 162048 - DNA, 22 bp, Homo sapiens
tgcccgtgaccattcatgctca

SEQ ID NO: 162049 - DNA, 23 bp, Homo sapiens
tacagtactctgcaagctgtttc

SEQ ID NO: 162050 - DNA, 23 bp, Homo sapiens
cctgtgtctgtctctcagttctg

SEQ ID NO: 162051 - DNA, 23 bp, Homo sapiens
ctgaggatgttgtttgttttgat

SEQ ID NO: 162052 - DNA, 20 bp, Homo sapiens
ctagccagtgttattagctg

SEQ ID NO: 162053 - DNA, 18 bp, Homo sapiens
atgacactagtatcaccc

SEQ ID NO: 162054 - DNA, 22 bp, Homo sapiens
tggctcagttctgcagcttctg

SEQ ID NO: 162055 - DNA, 23 bp, Homo sapiens
cagctgcacagatgagagtgtgg

SEQ ID NO: 162056 - DNA, 23 bp, Homo sapiens
ctggctctgacactcagtccttt

SEQ ID NO: 162057 - DNA, 23 bp, Homo sapiens
tgagttcattgtagattctggat

SEQ ID NO: 162058 - DNA, 23 bp, Homo sapiens
tgagttcattgtagattctggat

SEQ ID NO: 162059 - DNA, 23 bp, Homo sapiens
gatggagtctcactcagtcaccc

SEQ ID NO: 162060 - DNA, 23 bp, Homo sapiens
taaatgcttattgtatagacact

SEQ ID NO: 162061 - DNA, 23 bp, Homo sapiens
acagggtctcactctgtcaccca

SEQ ID NO: 162062 - DNA, 20 bp, Homo sapiens
agtgcagcggtgtgatcatg

SEQ ID NO: 162063 - DNA, 23 bp, Homo sapiens
gacagagtctcgctctgtcaccc

SEQ ID NO: 162064 - DNA, 23 bp, Homo sapiens
tcagtagtgatattcttcttgag

SEQ ID NO: 162065 - DNA, 23 bp, Homo sapiens
aagaagtcgaattagcagaatgc

SEQ ID NO: 162066 - DNA, 20 bp, Homo sapiens
agtctcgctctgtcgctcag

SEQ ID NO: 162067 - DNA, 23 bp, Homo sapiens
atttgtattctgtaaccattgga

SEQ ID NO: 162068 - DNA, 23 bp, Homo sapiens
ttaggtccatttgatctgtgttg

SEQ ID NO: 162069 - DNA, 19 bp, Homo sapiens
atagtactagctgtaaatg

SEQ ID NO: 162070 - DNA, 23 bp, Homo sapiens
gcaaagtcactctgagatatatc

SEQ ID NO: 162071 - DNA, 18 bp, Homo sapiens
tcctagctactcaggagg

SEQ ID NO: 162072 - DNA, 19 bp, Homo sapiens
tgaggtaggaggatcactt

SEQ ID NO: 162073 - DNA, 23 bp, Homo sapiens
agatgactgtagtttgcatgcag

SEQ ID NO: 162074 - DNA, 21 bp, Homo sapiens
actcagcctctcagtctctgt

SEQ ID NO: 162075 - DNA, 23 bp, Homo sapiens
tgagtgtcagcatattatctcac

SEQ ID NO: 162076 - DNA, 23 bp, Homo sapiens
atggagtctcactctgtcaccta

SEQ ID NO: 162077 - DNA, 23 bp, Homo sapiens
ggagtctcactctgtcacctagg

SEQ ID NO: 162078 - DNA, 22 bp, Homo sapiens
atctgtcgagatgattctgtgg

SEQ ID NO: 162079 - DNA, 23 bp, Homo sapiens
cagagttctgttttcttgttggt

SEQ ID NO: 162080 - DNA, 23 bp, Homo sapiens
acatgatctcactctgtcactca

SEQ ID NO: 162081 - DNA, 18 bp, Homo sapiens
tgtaatcatggctcactg

SEQ ID NO: 162082 - DNA, 18 bp, Homo sapiens
tccatgcagtatgtgctt

SEQ ID NO: 162083 - DNA, 20 bp, Homo sapiens
aagatgccacagactgggcg

SEQ ID NO: 162084 - DNA, 19 bp, Homo sapiens
tccaggtgcgcacagagta

SEQ ID NO: 162085 - DNA, 18 bp, Homo sapiens
acacagggaggagacatt

SEQ ID NO: 162086 - DNA, 18 bp, Homo sapiens
tgggctagaagattcttt

SEQ ID NO: 162087 - DNA, 23 bp, Homo sapiens
tgagagggagtctcgctctgttg

SEQ ID NO: 162088 - DNA, 23 bp, Homo sapiens
tatatacacgtatatatatgtat

SEQ ID NO: 162089 - DNA, 18 bp, Homo sapiens
acgtatatatatatgtgt

SEQ ID NO: 162090 - DNA, 23 bp, Homo sapiens
aaatggtcttcacaggaggtgta

SEQ ID NO: 162091 - DNA, 23 bp, Homo sapiens
tggctctgtctctgagtcaccct

SEQ ID NO: 162092 - DNA, 23 bp, Homo sapiens
ctgtctgtctgtctgtctgtctg

SEQ ID NO: 162093 - DNA, 23 bp, Homo sapiens
tcacacacgcatgtccctctctc

SEQ ID NO: 162094 - DNA, 23 bp, Homo sapiens
caaggtctcactctgtccctcag

SEQ ID NO: 162095 - DNA, 23 bp, Homo sapiens
tcaagtgcattttttgatctact

SEQ ID NO: 162096 - DNA, 23 bp, Homo sapiens
tgagatggactctcgctctgtcg

SEQ ID NO: 162097 - DNA, 20 bp, Homo sapiens
tggtgaagcctcgcactctc

SEQ ID NO: 162098 - DNA, 21 bp, Homo sapiens
tgtgtgttaatgtgtgtaagt

SEQ ID NO: 162099 - DNA, 18 bp, Homo sapiens
acttcagcccctggtctc

SEQ ID NO: 162100 - DNA, 22 bp, Homo sapiens
agtgtcagcatctgcttgtggt

SEQ ID NO: 162101 - DNA, 23 bp, Homo sapiens
tgagttcattgtagattctggat

SEQ ID NO: 162102 - DNA, 23 bp, Homo sapiens
tgagttcattgtagattctggat

SEQ ID NO: 162103 - DNA, 23 bp, Homo sapiens
aatgttttttagttattgatctg

SEQ ID NO: 162104 - DNA, 20 bp, Homo sapiens
tccatatacacttgggaaga

SEQ ID NO: 162105 - DNA, 23 bp, Homo sapiens
ttttttccattgttatgtagagt

SEQ ID NO: 162106 - DNA, 23 bp, Homo sapiens
tgagttcattgtagattctggat

SEQ ID NO: 162107 - DNA, 23 bp, Homo sapiens
tgagttcattgtagattctggat

SEQ ID NO: 162108 - DNA, 23 bp, Homo sapiens
agtgattgtccctcacataggat

SEQ ID NO: 162109 - DNA, 23 bp, Homo sapiens
tctgagtgtttgtctctcacata

SEQ ID NO: 162110 - DNA, 23 bp, Homo sapiens
tcagaagtgtttttgttttaaag

SEQ ID NO: 162111 - DNA, 21 bp, Homo sapiens
aggaaaagcttcaattgagat

SEQ ID NO: 162112 - DNA, 23 bp, Homo sapiens
cggagtctcactctgtcacccag

SEQ ID NO: 162113 - DNA, 23 bp, Homo sapiens
gagtctcactctgtcacccaggc

SEQ ID NO: 162114 - DNA, 21 bp, Homo sapiens
atatagcatgtctatacttat

SEQ ID NO: 162115 - DNA, 19 bp, Homo sapiens
atacataatgtatatgtat

SEQ ID NO: 162116 - DNA, 23 bp, Homo sapiens
taacagtcagtacagcttggctt

SEQ ID NO: 162117 - DNA, 21 bp, Homo sapiens
acttgtaaacttcttcttctt

SEQ ID NO: 162118 - DNA, 23 bp, Homo sapiens
cagagtctcactctgtcccccag

SEQ ID NO: 162119 - DNA, 22 bp, Homo sapiens
tctctctcattctctgtggttt

SEQ ID NO: 162120 - DNA, 23 bp, Homo sapiens
aaatgtatgtgtgcatacgaatg

SEQ ID NO: 162121 - DNA, 22 bp, Homo sapiens
tgagtgcctgtaatcccagcta

SEQ ID NO: 162122 - DNA, 23 bp, Homo sapiens
ctcactctatgtctgtgtgtagc

SEQ ID NO: 162123 - DNA, 23 bp, Homo sapiens
acatacatatgtatacatgtatg

SEQ ID NO: 162124 - DNA, 23 bp, Homo sapiens
atacatacatatgtatacatatg

SEQ ID NO: 162125 - DNA, 21 bp, Homo sapiens
tctgagacacactcttctggg

SEQ ID NO: 162126 - DNA, 23 bp, Homo sapiens
gtgcaaggatgacatgcagattt

SEQ ID NO: 162127 - DNA, 21 bp, Homo sapiens
acatccttggaaaggttgtct

SEQ ID NO: 162128 - DNA, 21 bp, Homo sapiens
atttttactttttgtagtcat

SEQ ID NO: 162129 - DNA, 23 bp, Homo sapiens
gagtctctcactctgtcacccag

SEQ ID NO: 162130 - DNA, 21 bp, Homo sapiens
agtgacagtgacagtctcagc

SEQ ID NO: 162131 - DNA, 18 bp, Homo sapiens
actctgtgtttaaaactt

SEQ ID NO: 162132 - DNA, 23 bp, Homo sapiens
ttgagacagagtctcgctgtgtc

SEQ ID NO: 162133 - DNA, 20 bp, Homo sapiens
gcagagtgagcacagacagc

SEQ ID NO: 162134 - DNA, 23 bp, Homo sapiens
gacagagtctcgctctgtcaccc

SEQ ID NO: 162135 - DNA, 20 bp, Homo sapiens
tgtccttttttttgagacag

SEQ ID NO: 162136 - DNA, 23 bp, Homo sapiens
tgagacagggtctccctctgtca

SEQ ID NO: 162137 - DNA, 22 bp, Homo sapiens
tggcaccaggtgaaatgagaga

SEQ ID NO: 162138 - DNA, 20 bp, Homo sapiens
tacagagttgagagtcagga

SEQ ID NO: 162139 - DNA, 19 bp, Homo sapiens
tggctgcctgcttccctct

SEQ ID NO: 162140 - DNA, 23 bp, Homo sapiens
tcttcagagtattagttgtgctc

SEQ ID NO: 162141 - DNA, 23 bp, Homo sapiens
gtcacttacacagtctctttgaa

SEQ ID NO: 162142 - DNA, 22 bp, Homo sapiens
tttttgcatagaaattttttct

SEQ ID NO: 162143 - DNA, 23 bp, Homo sapiens
cactgtctttctctgacacacac

SEQ ID NO: 162144 - DNA, 23 bp, Homo sapiens
tgagatggagtctcactctgtca

SEQ ID NO: 162145 - DNA, 22 bp, Homo sapiens
tgtgactgctaaggcttgtctt

SEQ ID NO: 162146 - DNA, 23 bp, Homo sapiens
acagggtctcgctctgtcactca

SEQ ID NO: 162147 - DNA, 23 bp, Homo sapiens
ggagtctcactctgtcactcagg

SEQ ID NO: 162148 - DNA, 23 bp, Homo sapiens
tgagttcattgtagattctggat

SEQ ID NO: 162149 - DNA, 23 bp, Homo sapiens
tgagttcattgtagattctggat

SEQ ID NO: 162150 - DNA, 23 bp, Homo sapiens
tctctgtgtgtctgtccttatca

SEQ ID NO: 162151 - DNA, 20 bp, Homo sapiens
ttcttattggacggcctctg

SEQ ID NO: 162152 - DNA, 22 bp, Homo sapiens
attctagtgttaaaggtgctgt

SEQ ID NO: 162153 - DNA, 22 bp, Homo sapiens
aaagagcttggattttggcatc

SEQ ID NO: 162154 - DNA, 18 bp, Homo sapiens
tgtttgggtccaagtgct

SEQ ID NO: 162155 - DNA, 20 bp, Homo sapiens
cgtatatatatatgtgtata

SEQ ID NO: 162156 - DNA, 21 bp, Homo sapiens
tgagtcattatctctctgcca

SEQ ID NO: 162157 - DNA, 23 bp, Homo sapiens
cagtgacagtacagtctgagctc

SEQ ID NO: 162158 - DNA, 23 bp, Homo sapiens
tatacaaatctatacatatgtat

SEQ ID NO: 162159 - DNA, 21 bp, Homo sapiens
caattcttctgttccagttgg

SEQ ID NO: 162160 - DNA, 22 bp, Homo sapiens
tcaactggctgctatagatgtc

SEQ ID NO: 162161 - DNA, 20 bp, Homo sapiens
ggcttgctgaggctctgcag

SEQ ID NO: 162162 - DNA, 23 bp, Homo sapiens
ttcacttcttgctctctctctct

SEQ ID NO: 162163 - DNA, 18 bp, Homo sapiens
accctgagacctgaggag

SEQ ID NO: 162164 - DNA, 19 bp, Homo sapiens
tctcagaaaaaaagaacta

SEQ ID NO: 162165 - DNA, 23 bp, Homo sapiens
agtgacaggctgactctcttatt

SEQ ID NO: 162166 - DNA, 20 bp, Homo sapiens
agctgccaaatgtaggccta

SEQ ID NO: 162167 - DNA, 22 bp, Homo sapiens
tttactgtatttgtaaatctca

SEQ ID NO: 162168 - DNA, 23 bp, Homo sapiens
tgagttcattgtagattctggat

SEQ ID NO: 162169 - DNA, 23 bp, Homo sapiens
tgagttcattgtagattctggat

SEQ ID NO: 162170 - DNA, 23 bp, Homo sapiens
gattttatcctcttctaccccaa

SEQ ID NO: 162171 - DNA, 22 bp, Homo sapiens
agaggtagttggaagaattgga

SEQ ID NO: 162172 - DNA, 21 bp, Homo sapiens
aggctggctagaaaggtgctg

SEQ ID NO: 162173 - DNA, 23 bp, Homo sapiens
attgctagtatatcctattgtat

SEQ ID NO: 162174 - DNA, 23 bp, Homo sapiens
acgttgagtagacattttaaagt

SEQ ID NO: 162175 - DNA, 23 bp, Homo sapiens
taagagaagaaagattgctcttc

SEQ ID NO: 162176 - DNA, 23 bp, Homo sapiens
tgagttcattgtagattctggat

SEQ ID NO: 162177 - DNA, 23 bp, Homo sapiens
tgagttcattgtagattctggat

SEQ ID NO: 162178 - DNA, 23 bp, Homo sapiens
gcctgaggtatgaggatgtcttg

SEQ ID NO: 162179 - DNA, 23 bp, Homo sapiens
cgtacaggactgtagtcgagctg

SEQ ID NO: 162180 - DNA, 18 bp, Homo sapiens
aggcaatttaaaggttac

SEQ ID NO: 162181 - DNA, 22 bp, Homo sapiens
tgtctgactttgggtaagactc

SEQ ID NO: 162182 - DNA, 23 bp, Homo sapiens
agtgtgtctccctctctatactg

SEQ ID NO: 162183 - DNA, 23 bp, Homo sapiens
atatgcatgtgtatagatatgtc

SEQ ID NO: 162184 - DNA, 19 bp, Homo sapiens
atgtatttatacatgtatg

SEQ ID NO: 162185 - DNA, 23 bp, Homo sapiens
tgagttcattgtagattctggat

SEQ ID NO: 162186 - DNA, 23 bp, Homo sapiens
tgagttcattgtagattctggat

SEQ ID NO: 162187 - DNA, 22 bp, Homo sapiens
acgtgtgcatgcatgtttgtgt

SEQ ID NO: 162188 - DNA, 22 bp, Homo sapiens
tgagagataaagctatttcttt

SEQ ID NO: 162189 - DNA, 23 bp, Homo sapiens
ttatctagatcagtgtgtagtct

SEQ ID NO: 162190 - DNA, 21 bp, Homo sapiens
tgagattagaacttttgtccc

SEQ ID NO: 162191 - DNA, 23 bp, Homo sapiens
tgattctgtctgttggttttctg

SEQ ID NO: 162192 - DNA, 23 bp, Homo sapiens
tgagttcattgtagattctggat

SEQ ID NO: 162193 - DNA, 23 bp, Homo sapiens
tgagttcattgtagattctggat

SEQ ID NO: 162194 - DNA, 23 bp, Homo sapiens
ttccccctcagtctctctctcct

SEQ ID NO: 162195 - DNA, 23 bp, Homo sapiens
acttacagagtaaactggaggga

SEQ ID NO: 162196 - DNA, 20 bp, Homo sapiens
ataagctgggatttgacttt

SEQ ID NO: 162197 - DNA, 22 bp, Homo sapiens
gtttatgagtctataggttctg

SEQ ID NO: 162198 - DNA, 21 bp, Homo sapiens
tggctgcctgacagagtgaga

SEQ ID NO: 162199 - DNA, 22 bp, Homo sapiens
actctcactctgtcataccggt

SEQ ID NO: 162200 - DNA, 19 bp, Homo sapiens
cgctgtcttcatactacca

SEQ ID NO: 162201 - DNA, 21 bp, Homo sapiens
atacacacatgtatatgtgta

SEQ ID NO: 162202 - DNA, 22 bp, Homo sapiens
atatacacacatgtatatgtgt

SEQ ID NO: 162203 - DNA, 21 bp, Homo sapiens
tatacacgcatgtatatgtgt

SEQ ID NO: 162204 - DNA, 23 bp, Homo sapiens
gaaggtctcactctgtcacccag

SEQ ID NO: 162205 - DNA, 21 bp, Homo sapiens
atgtatgtatgcgtgtgtata

SEQ ID NO: 162206 - DNA, 21 bp, Homo sapiens
ataggtatatatatgtgtatg

SEQ ID NO: 162207 - DNA, 23 bp, Homo sapiens
aaatagagtgattttgaaaatgt

SEQ ID NO: 162208 - DNA, 22 bp, Homo sapiens
atgtgcatatatatatgtgggt

SEQ ID NO: 162209 - DNA, 19 bp, Homo sapiens
acttgtggtgaatgcgtct

SEQ ID NO: 162210 - DNA, 23 bp, Homo sapiens
gtgtgtgtgtgtgtatacacata

SEQ ID NO: 162211 - DNA, 23 bp, Homo sapiens
ggtcactgggcacagtgtgtgca

SEQ ID NO: 162212 - DNA, 23 bp, Homo sapiens
ctgtctctctctatgtatatgtg

SEQ ID NO: 162213 - DNA, 22 bp, Homo sapiens
tacctggtgagatattttgggg

SEQ ID NO: 162214 - DNA, 20 bp, Homo sapiens
tctctatctctgtgtccaaa

SEQ ID NO: 162215 - DNA, 21 bp, Homo sapiens
tttttacttgatgggcaggtg

SEQ ID NO: 162216 - DNA, 23 bp, Homo sapiens
ctgtctctttcactctctagctg

SEQ ID NO: 162217 - DNA, 20 bp, Homo sapiens
ccgtgtgaagagatcaccaa

SEQ ID NO: 162218 - DNA, 23 bp, Homo sapiens
aattcttaatatgtatttgagaa

SEQ ID NO: 162219 - DNA, 23 bp, Homo sapiens
gccagtctcgctctgtcacccag

SEQ ID NO: 162220 - DNA, 23 bp, Homo sapiens
gacagagtctcgctctgtcaccc

SEQ ID NO: 162221 - DNA, 23 bp, Homo sapiens
acagagtctcgctctgtcaccca

SEQ ID NO: 162222 - DNA, 19 bp, Homo sapiens
tcataggagattcttaatc

SEQ ID NO: 162223 - DNA, 23 bp, Homo sapiens
tgagttcattgtagattctggat

SEQ ID NO: 162224 - DNA, 23 bp, Homo sapiens
tgagttcattgtagattctggat

SEQ ID NO: 162225 - DNA, 18 bp, Homo sapiens
tgtctccatccccatctg

SEQ ID NO: 162226 - DNA, 22 bp, Homo sapiens
gagtgtggatgagtagagcttt

SEQ ID NO: 162227 - DNA, 18 bp, Homo sapiens
tgtgatgacaggcagcag

SEQ ID NO: 162228 - DNA, 23 bp, Homo sapiens
tgagttcattgtagattctggat

SEQ ID NO: 162229 - DNA, 23 bp, Homo sapiens
tgagttcattgtagattctggat

SEQ ID NO: 162230 - DNA, 21 bp, Homo sapiens
gtacacagtgtgtcatgttat

SEQ ID NO: 162231 - DNA, 23 bp, Homo sapiens
tatgacatgtaaattctgtctct

SEQ ID NO: 162232 - DNA, 19 bp, Homo sapiens
agaggtattttatagttct

SEQ ID NO: 162233 - DNA, 23 bp, Homo sapiens
taagtgtgccattgtaataagtt

SEQ ID NO: 162234 - DNA, 23 bp, Homo sapiens
tcatttctctggttaactttttc

SEQ ID NO: 162235 - DNA, 19 bp, Homo sapiens
tgtgtgtgtgtgtgtgtat

SEQ ID NO: 162236 - DNA, 18 bp, Homo sapiens
tttaagtgtcacatacta

SEQ ID NO: 162237 - DNA, 23 bp, Homo sapiens
atatgtgcatgtgtatagtatat

SEQ ID NO: 162238 - DNA, 21 bp, Homo sapiens
ttaatctcttttgtatttcag

SEQ ID NO: 162239 - DNA, 23 bp, Homo sapiens
tatctagtgacagtgtatctata

SEQ ID NO: 162240 - DNA, 22 bp, Homo sapiens
tatactctatatgtatctatat

SEQ ID NO: 162241 - DNA, 18 bp, Homo sapiens
atacagagagatatacct

SEQ ID NO: 162242 - DNA, 23 bp, Homo sapiens
tatatgtgtgcatatgcatatat

SEQ ID NO: 162243 - DNA, 23 bp, Homo sapiens
atcaggaagtacagctaactgga

SEQ ID NO: 162244 - DNA, 23 bp, Homo sapiens
tataaagctagaaaaggaatata

SEQ ID NO: 162245 - DNA, 23 bp, Homo sapiens
atgtgtgtgtgtgtgatataaca

SEQ ID NO: 162246 - DNA, 23 bp, Homo sapiens
tttttgagacaggttctctctct

SEQ ID NO: 162247 - DNA, 23 bp, Homo sapiens
aatgaccaacttgatatgaagaa

SEQ ID NO: 162248 - DNA, 23 bp, Homo sapiens
ttactgcttctacatctgaatgt

SEQ ID NO: 162249 - DNA, 23 bp, Homo sapiens
atactggatcatactgtctgtga

SEQ ID NO: 162250 - DNA, 23 bp, Homo sapiens
aattctagattctcgatccaggt

SEQ ID NO: 162251 - DNA, 19 bp, Homo sapiens
accacctgcatggctttgg

SEQ ID NO: 162252 - DNA, 23 bp, Homo sapiens
tctgagcctcagtctctgtgcat

SEQ ID NO: 162253 - DNA, 23 bp, Homo sapiens
acagacagaacagtgtgtggaga

SEQ ID NO: 162254 - DNA, 23 bp, Homo sapiens
tgagatggagtctcactctgtca

SEQ ID NO: 162255 - DNA, 20 bp, Homo sapiens
ctcacactggctgtcactgt

SEQ ID NO: 162256 - DNA, 23 bp, Homo sapiens
gtgaggctgcctgtgtgggtgtc

SEQ ID NO: 162257 - DNA, 22 bp, Homo sapiens
tagacacaggatgagtttctcc

SEQ ID NO: 162258 - DNA, 23 bp, Homo sapiens
tgagttcattgtagattctggat

SEQ ID NO: 162259 - DNA, 23 bp, Homo sapiens
tgagttcattgtagattctggat

SEQ ID NO: 162260 - DNA, 23 bp, Homo sapiens
attctgtgaagaaagtccttggt

SEQ ID NO: 162261 - DNA, 18 bp, Homo sapiens
agtgtgggattatagtga

SEQ ID NO: 162262 - DNA, 23 bp, Homo sapiens
tatgtgtatatatatgtgtgtgt

SEQ ID NO: 162263 - DNA, 23 bp, Homo sapiens
tctggctgcgtgggtttttctgg

SEQ ID NO: 162264 - DNA, 23 bp, Homo sapiens
tttctgtgaggtagatttgtcac

SEQ ID NO: 162265 - DNA, 23 bp, Homo sapiens
gacagtctcgctctgtcacccag

SEQ ID NO: 162266 - DNA, 23 bp, Homo sapiens
acagcttccgtgtgtcactgcct

SEQ ID NO: 162267 - DNA, 22 bp, Homo sapiens
tctgggagtgtctcacttctgt

SEQ ID NO: 162268 - DNA, 18 bp, Homo sapiens
cctagatggtggagagga

SEQ ID NO: 162269 - DNA, 23 bp, Homo sapiens
tgtgcgtgtgtgtatgctgtatg

SEQ ID NO: 162270 - DNA, 23 bp, Homo sapiens
tggctgcctgggtccctctctgc

SEQ ID NO: 162271 - DNA, 19 bp, Homo sapiens
acagaagcagagggtgtgt

SEQ ID NO: 162272 - DNA, 23 bp, Homo sapiens
ctctctgtctgtgtatgtgtaaa

SEQ ID NO: 162273 - DNA, 23 bp, Homo sapiens
tgtgtggatgaccttctcatggc

SEQ ID NO: 162274 - DNA, 23 bp, Homo sapiens
gtctcactgacagcccttgacca

SEQ ID NO: 162275 - DNA, 23 bp, Homo sapiens
tctgtgacactctaacttagggc

SEQ ID NO: 162276 - DNA, 23 bp, Homo sapiens
gtttaggtgtctgctaggtttct

SEQ ID NO: 162277 - DNA, 22 bp, Homo sapiens
aaaaagctagttttgcattgca

SEQ ID NO: 162278 - DNA, 22 bp, Homo sapiens
tgagatcaaggtgtatgcaggt

SEQ ID NO: 162279 - DNA, 18 bp, Homo sapiens
atttctcttcttagcttg

SEQ ID NO: 162280 - DNA, 23 bp, Homo sapiens
tctgttttggttccatatgaaat

SEQ ID NO: 162281 - DNA, 20 bp, Homo sapiens
gtctcacactgtcactaagg

SEQ ID NO: 162282 - DNA, 20 bp, Homo sapiens
attgagtgagtatttgctgc

SEQ ID NO: 162283 - DNA, 20 bp, Homo sapiens
tatgagctgaaaagtaaagg

SEQ ID NO: 162284 - DNA, 21 bp, Homo sapiens
attctgttttaagctatttga

SEQ ID NO: 162285 - DNA, 22 bp, Homo sapiens
tttcacagtggctgaactaatt

SEQ ID NO: 162286 - DNA, 21 bp, Homo sapiens
cagtgagctatgtgggtcaga

SEQ ID NO: 162287 - DNA, 23 bp, Homo sapiens
acacggtctgtctctcaaaattg

SEQ ID NO: 162288 - DNA, 23 bp, Homo sapiens
tttgggtatatatatgtatgtat

SEQ ID NO: 162289 - DNA, 23 bp, Homo sapiens
gatgctactgtatttggatttta

SEQ ID NO: 162290 - DNA, 23 bp, Homo sapiens
agtttactgctgggttaagattg

SEQ ID NO: 162291 - DNA, 22 bp, Homo sapiens
aaattttgtgtgtgtgtatata

SEQ ID NO: 162292 - DNA, 19 bp, Homo sapiens
agtctcattctgtcactca

SEQ ID NO: 162293 - DNA, 21 bp, Homo sapiens
tgagatccaacaagatcacag

SEQ ID NO: 162294 - DNA, 23 bp, Homo sapiens
tctgacagtggttgacttggctt

SEQ ID NO: 162295 - DNA, 21 bp, Homo sapiens
tgtgtatatatatgtgtgtgt

SEQ ID NO: 162296 - DNA, 19 bp, Homo sapiens
gtgtgtatatagattttca

SEQ ID NO: 162297 - DNA, 19 bp, Homo sapiens
atatatatgcttatgtgtg

SEQ ID NO: 162298 - DNA, 23 bp, Homo sapiens
atgtatagtatacatgtgcttca

SEQ ID NO: 162299 - DNA, 20 bp, Homo sapiens
atgtatttgtgtatacgtac

SEQ ID NO: 162300 - DNA, 22 bp, Homo sapiens
tatgtgtatgtatatgtatatg

SEQ ID NO: 162301 - DNA, 21 bp, Homo sapiens
tgaggtaggaggatcacttga

SEQ ID NO: 162302 - DNA, 20 bp, Homo sapiens
agaggtgaagagatcactga

SEQ ID NO: 162303 - DNA, 23 bp, Homo sapiens
aattcagattttttttatctctg

SEQ ID NO: 162304 - DNA, 21 bp, Homo sapiens
atgtttatttcttaaagtgag

SEQ ID NO: 162305 - DNA, 20 bp, Homo sapiens
taaggatgataaaaagggtg

SEQ ID NO: 162306 - DNA, 19 bp, Homo sapiens
agtctctttctctgttata

SEQ ID NO: 162307 - DNA, 18 bp, Homo sapiens
gcagctatttgaatgtga

SEQ ID NO: 162308 - DNA, 22 bp, Homo sapiens
tatatactatatctgtatgtgt

SEQ ID NO: 162309 - DNA, 21 bp, Homo sapiens
tatatagtatatgtatactat

SEQ ID NO: 162310 - DNA, 23 bp, Homo sapiens
tttactgagggtgtgtatagtat

SEQ ID NO: 162311 - DNA, 21 bp, Homo sapiens
aattctgtgtgttgtacgcat

SEQ ID NO: 162312 - DNA, 23 bp, Homo sapiens
gacagtctcactctgtggctcag

SEQ ID NO: 162313 - DNA, 22 bp, Homo sapiens
atttgactagagagagaatgtg

SEQ ID NO: 162314 - DNA, 23 bp, Homo sapiens
agttcacataccaactgtagaga

SEQ ID NO: 162315 - DNA, 21 bp, Homo sapiens
ttaataggtcattgtctagtt

SEQ ID NO: 162316 - DNA, 23 bp, Homo sapiens
catgtatgtaaatgtatatgtgt

SEQ ID NO: 162317 - DNA, 22 bp, Homo sapiens
tatctgtatatatatatgtgtg

SEQ ID NO: 162318 - DNA, 23 bp, Homo sapiens
atagatatgtgtgtatgtgtatg

SEQ ID NO: 162319 - DNA, 23 bp, Homo sapiens
tcactaactcagtgtgtctgtgg

SEQ ID NO: 162320 - DNA, 23 bp, Homo sapiens
cttcagactttttgtgtgacatt

SEQ ID NO: 162321 - DNA, 23 bp, Homo sapiens
agagagagagatgggatttggaa

SEQ ID NO: 162322 - DNA, 20 bp, Homo sapiens
attgctttagttgctattac

SEQ ID NO: 162323 - DNA, 23 bp, Homo sapiens
gcttttgagaggagagagagctg

SEQ ID NO: 162324 - DNA, 22 bp, Homo sapiens
attcaggtgattttctttttga

SEQ ID NO: 162325 - DNA, 23 bp, Homo sapiens
ttttgtctcaatttgttcctctg

SEQ ID NO: 162326 - DNA, 19 bp, Homo sapiens
cactgtttatctgttatgt

SEQ ID NO: 162327 - DNA, 22 bp, Homo sapiens
ccacttgttgaattttgctgta

SEQ ID NO: 162328 - DNA, 23 bp, Homo sapiens
taaataagtggaggtatatgcca

SEQ ID NO: 162329 - DNA, 23 bp, Homo sapiens
taaggtatacaatatgatgttgt

SEQ ID NO: 162330 - DNA, 23 bp, Homo sapiens
tctctcactgtcacttctaagcc

SEQ ID NO: 162331 - DNA, 21 bp, Homo sapiens
tagaaatggagctggaactta

SEQ ID NO: 162332 - DNA, 23 bp, Homo sapiens
atatatggatatctatagatatc

SEQ ID NO: 162333 - DNA, 21 bp, Homo sapiens
atacacacacatatatgtgtg

SEQ ID NO: 162334 - DNA, 23 bp, Homo sapiens
gtgtgtatatatgtgtgtgcatg

SEQ ID NO: 162335 - DNA, 20 bp, Homo sapiens
tatcctatactatatatgtg

SEQ ID NO: 162336 - DNA, 22 bp, Homo sapiens
tcattgtgttgttagctgattg

SEQ ID NO: 162337 - DNA, 23 bp, Homo sapiens
tggaactattattcagctcccag

SEQ ID NO: 162338 - DNA, 23 bp, Homo sapiens
aattatgatgatgatgatgatga

SEQ ID NO: 162339 - DNA, 23 bp, Homo sapiens
ctgactttctcactgtctcttct

SEQ ID NO: 162340 - DNA, 22 bp, Homo sapiens
acctttgctgcacattaagatt

SEQ ID NO: 162341 - DNA, 18 bp, Homo sapiens
ggctctctctcaggctga

SEQ ID NO: 162342 - DNA, 20 bp, Homo sapiens
aagtgctaggattacaggca

SEQ ID NO: 162343 - DNA, 20 bp, Homo sapiens
gtatatattcatgtgtgtgt

SEQ ID NO: 162344 - DNA, 20 bp, Homo sapiens
tatatgtgtgggtgtataca

SEQ ID NO: 162345 - DNA, 23 bp, Homo sapiens
tcactctatttctctggccttca

SEQ ID NO: 162346 - DNA, 20 bp, Homo sapiens
aaggtcctagacagatctgt

SEQ ID NO: 162347 - DNA, 23 bp, Homo sapiens
gagtctctctcactcactctgtc

SEQ ID NO: 162348 - DNA, 18 bp, Homo sapiens
tgaaagctcactctctct

SEQ ID NO: 162349 - DNA, 18 bp, Homo sapiens
tgactatatgaattattg

SEQ ID NO: 162350 - DNA, 22 bp, Homo sapiens
atagggtctctcactctgtcgt

SEQ ID NO: 162351 - DNA, 19 bp, Homo sapiens
tgtagtaacacaatcacaa

SEQ ID NO: 162352 - DNA, 23 bp, Homo sapiens
tgagtctcactctgtcacccagg

SEQ ID NO: 162353 - DNA, 23 bp, Homo sapiens
cactcctctcttagtctcagtct

SEQ ID NO: 162354 - DNA, 23 bp, Homo sapiens
agagacaccatctcatagagctg

SEQ ID NO: 162355 - DNA, 23 bp, Homo sapiens
ctgatgagctttttgactttgaa

SEQ ID NO: 162356 - DNA, 23 bp, Homo sapiens
aaagtgattttatttttctgtgt

SEQ ID NO: 162357 - DNA, 23 bp, Homo sapiens
taaaccttggaaatcttcatgga

SEQ ID NO: 162358 - DNA, 20 bp, Homo sapiens
gggaagagtgtgtctattct

SEQ ID NO: 162359 - DNA, 23 bp, Homo sapiens
acagtagaatgacttttcctctt

SEQ ID NO: 162360 - DNA, 23 bp, Homo sapiens
tcacacctgtaatctcagcactt

SEQ ID NO: 162361 - DNA, 19 bp, Homo sapiens
tggtctagtcttggatgca

SEQ ID NO: 162362 - DNA, 22 bp, Homo sapiens
cagcagtgactctgagtctctg

SEQ ID NO: 162363 - DNA, 20 bp, Homo sapiens
tatatacatatgtatagctg

SEQ ID NO: 162364 - DNA, 21 bp, Homo sapiens
tatttctccctttcttctgtg

SEQ ID NO: 162365 - DNA, 23 bp, Homo sapiens
agctacagtagtaagcagagtgg

SEQ ID NO: 162366 - DNA, 19 bp, Homo sapiens
ttatgcctgtaatcccagc

SEQ ID NO: 162367 - DNA, 23 bp, Homo sapiens
aaatgaatcctgtgactgaggag

SEQ ID NO: 162368 - DNA, 21 bp, Homo sapiens
tatagatacatatatgtgtgt

SEQ ID NO: 162369 - DNA, 19 bp, Homo sapiens
atatatgtgtgcatatata

SEQ ID NO: 162370 - DNA, 18 bp, Homo sapiens
ccctgtctctggtggatg

SEQ ID NO: 162371 - DNA, 18 bp, Homo sapiens
ctcactctgtcacccagg

SEQ ID NO: 162372 - DNA, 23 bp, Homo sapiens
tcactgcatctgtggctgcatct

SEQ ID NO: 162373 - DNA, 23 bp, Homo sapiens
tgaaggaagtggatgctttggga

SEQ ID NO: 162374 - DNA, 23 bp, Homo sapiens
ctgtctactgccacctctttcag

SEQ ID NO: 162375 - DNA, 23 bp, Homo sapiens
aacatgaccttggatatgtttct

SEQ ID NO: 162376 - DNA, 18 bp, Homo sapiens
tcagagacagttccatct

SEQ ID NO: 162377 - DNA, 22 bp, Homo sapiens
actctgtcacccacactagagt

SEQ ID NO: 162378 - DNA, 23 bp, Homo sapiens
aaataatgactttgtaattctgt

SEQ ID NO: 162379 - DNA, 22 bp, Homo sapiens
aggaagtagagggatagaggtg

SEQ ID NO: 162380 - DNA, 23 bp, Homo sapiens
agcactcacactgtctctctcct

SEQ ID NO: 162381 - DNA, 23 bp, Homo sapiens
tcagtgagcagagactcagctgt

SEQ ID NO: 162382 - DNA, 23 bp, Homo sapiens
tgagttcattgtagattctggat

SEQ ID NO: 162383 - DNA, 23 bp, Homo sapiens
tgagttcattgtagattctggat

SEQ ID NO: 162384 - DNA, 18 bp, Homo sapiens
gtgatgtgattttgaact

SEQ ID NO: 162385 - DNA, 23 bp, Homo sapiens
gagactgagtctggtttaatttt

SEQ ID NO: 162386 - DNA, 23 bp, Homo sapiens
cagagtctcactctgacatccag

SEQ ID NO: 162387 - DNA, 20 bp, Homo sapiens
gtgtatatatttgtgtgcat

SEQ ID NO: 162388 - DNA, 19 bp, Homo sapiens
atatatgtatatgtgtaca

SEQ ID NO: 162389 - DNA, 23 bp, Homo sapiens
ccaggtctcactctatcactcag

SEQ ID NO: 162390 - DNA, 19 bp, Homo sapiens
agagctgtctggttctgaa

SEQ ID NO: 162391 - DNA, 20 bp, Homo sapiens
tatgtatatatatgtgtatg

SEQ ID NO: 162392 - DNA, 23 bp, Homo sapiens
ttttttagttccatatgaaattt

SEQ ID NO: 162393 - DNA, 22 bp, Homo sapiens
aatttcgactttatcgtgtagt

SEQ ID NO: 162394 - DNA, 23 bp, Homo sapiens
tcggagtctcgctctgtcaccct

SEQ ID NO: 162395 - DNA, 23 bp, Homo sapiens
acagtgagaagatggctatgtct

SEQ ID NO: 162396 - DNA, 23 bp, Homo sapiens
tttttcactccagactctgggag

SEQ ID NO: 162397 - DNA, 23 bp, Homo sapiens
gctaatgcatttgtaaacctctc

SEQ ID NO: 162398 - DNA, 21 bp, Homo sapiens
tcacttcagcctctgacttct

SEQ ID NO: 162399 - DNA, 19 bp, Homo sapiens
tgagaaagccaggtactgg

SEQ ID NO: 162400 - DNA, 23 bp, Homo sapiens
acttcactgaatttgttattcag

SEQ ID NO: 162401 - DNA, 21 bp, Homo sapiens
ccctgattctcaggaggaatt

SEQ ID NO: 162402 - DNA, 22 bp, Homo sapiens
tataggtagaatatataactat

SEQ ID NO: 162403 - DNA, 23 bp, Homo sapiens
atatctttatatctatgtgtctg

SEQ ID NO: 162404 - DNA, 23 bp, Homo sapiens
ttgatgctttttctcttgctgtt

SEQ ID NO: 162405 - DNA, 19 bp, Homo sapiens
tatggatatatatacatat

SEQ ID NO: 162406 - DNA, 18 bp, Homo sapiens
tatgtgtatatatacgta

SEQ ID NO: 162407 - DNA, 20 bp, Homo sapiens
atatgttatatattttatgt

SEQ ID NO: 162408 - DNA, 23 bp, Homo sapiens
tgagttcattgtagattctggat

SEQ ID NO: 162409 - DNA, 23 bp, Homo sapiens
tgagttcattgtagattctggat

SEQ ID NO: 162410 - DNA, 23 bp, Homo sapiens
tatgtgcatgtatatatatgtgt

SEQ ID NO: 162411 - DNA, 23 bp, Homo sapiens
atatgtgtatatgtatatatgtg

SEQ ID NO: 162412 - DNA, 23 bp, Homo sapiens
tcacacattatatatgtgtgtgt

SEQ ID NO: 162413 - DNA, 23 bp, Homo sapiens
acacacatacgtaatggcgcagt

SEQ ID NO: 162414 - DNA, 22 bp, Homo sapiens
atttatgtgaatttcttggcct

SEQ ID NO: 162415 - DNA, 20 bp, Homo sapiens
agtgaggagagagaggtcag

SEQ ID NO: 162416 - DNA, 23 bp, Homo sapiens
aagaggcactctggttgcagtct

SEQ ID NO: 162417 - DNA, 19 bp, Homo sapiens
tggagcttcttagtttttt

SEQ ID NO: 162418 - DNA, 23 bp, Homo sapiens
tgtcagaagtgagggtggtcttg

SEQ ID NO: 162419 - DNA, 21 bp, Homo sapiens
tttcccactctgtgtgattcc

SEQ ID NO: 162420 - DNA, 23 bp, Homo sapiens
agggtggctgactgttttgtgga

SEQ ID NO: 162421 - DNA, 22 bp, Homo sapiens
ttactcagccaccattcatcac

SEQ ID NO: 162422 - DNA, 23 bp, Homo sapiens
attgtgtgtgtatatcgtgtgtg

SEQ ID NO: 162423 - DNA, 23 bp, Homo sapiens
tgtgatgcatgtgtgtgtgtgtg

SEQ ID NO: 162424 - DNA, 23 bp, Homo sapiens
atacacacacacatatagttggc

SEQ ID NO: 162425 - DNA, 23 bp, Homo sapiens
taaaaaagacattttctacatgt

SEQ ID NO: 162426 - DNA, 21 bp, Homo sapiens
tagtgtgtggtaatgtcctgg

SEQ ID NO: 162427 - DNA, 22 bp, Homo sapiens
attcactcaccactcactcact

SEQ ID NO: 162428 - DNA, 23 bp, Homo sapiens
tgagttcattgtagattctggat

SEQ ID NO: 162429 - DNA, 23 bp, Homo sapiens
tgagttcattgtagattctggat

SEQ ID NO: 162430 - DNA, 23 bp, Homo sapiens
agagtctcactctgtcacccagg

SEQ ID NO: 162431 - DNA, 23 bp, Homo sapiens
cactggaagagagaattttgaat

SEQ ID NO: 162432 - DNA, 23 bp, Homo sapiens
tgagacagagtctcgctctgtca

SEQ ID NO: 162433 - DNA, 23 bp, Homo sapiens
tgaaagggtctggaaggtttctc

SEQ ID NO: 162434 - DNA, 23 bp, Homo sapiens
ttcaagtgattctcctgcctcag

SEQ ID NO: 162435 - DNA, 18 bp, Homo sapiens
tcactgcaacctctgcct

SEQ ID NO: 162436 - DNA, 19 bp, Homo sapiens
ttagaaggtattagtaggg

SEQ ID NO: 162437 - DNA, 23 bp, Homo sapiens
tctcagtgtcacttcatgttatg

SEQ ID NO: 162438 - DNA, 23 bp, Homo sapiens
ttcagtgaagaaagccaatggta

SEQ ID NO: 162439 - DNA, 23 bp, Homo sapiens
tcagtgtggctcagtgtttccca

SEQ ID NO: 162440 - DNA, 20 bp, Homo sapiens
atgtgtatatgcatgtgtgt

SEQ ID NO: 162441 - DNA, 22 bp, Homo sapiens
atatgtgtatatgcatatgtgt

SEQ ID NO: 162442 - DNA, 23 bp, Homo sapiens
atgtgtatgtatgtatatatgtg

SEQ ID NO: 162443 - DNA, 23 bp, Homo sapiens
taacaagaatatgtaatgtcatt

SEQ ID NO: 162444 - DNA, 23 bp, Homo sapiens
accttaagtgttgttgctgttga

SEQ ID NO: 162445 - DNA, 22 bp, Homo sapiens
tgtctgagtagtttctgagcac

SEQ ID NO: 162446 - DNA, 23 bp, Homo sapiens
agagtctcactctgtcacccagg

SEQ ID NO: 162447 - DNA, 23 bp, Homo sapiens
taacagttcttggtggagtcttt

SEQ ID NO: 162448 - DNA, 19 bp, Homo sapiens
tatctctgttgatgctttc

SEQ ID NO: 162449 - DNA, 23 bp, Homo sapiens
acagagcacactgagatcagtga

SEQ ID NO: 162450 - DNA, 20 bp, Homo sapiens
tatgtgtgtatacagtgtgt

SEQ ID NO: 162451 - DNA, 20 bp, Homo sapiens
ttctctgctcatgcctgagt

SEQ ID NO: 162452 - DNA, 23 bp, Homo sapiens
ttttttgagacagagtctccctc

SEQ ID NO: 162453 - DNA, 23 bp, Homo sapiens
gagatagagtctccctctgtcac

SEQ ID NO: 162454 - DNA, 21 bp, Homo sapiens
tgtatcaaggtgactgtgaag

SEQ ID NO: 162455 - DNA, 23 bp, Homo sapiens
agagtctcactctgtctcccagg

SEQ ID NO: 162456 - DNA, 21 bp, Homo sapiens
tgaatgctgctggtttggaga

SEQ ID NO: 162457 - DNA, 21 bp, Homo sapiens
tgtagcaagttttgttcagtt

SEQ ID NO: 162458 - DNA, 23 bp, Homo sapiens
actttttgttgcacatgctctgt

SEQ ID NO: 162459 - DNA, 21 bp, Homo sapiens
tcagagtccgtctgttccctg

SEQ ID NO: 162460 - DNA, 23 bp, Homo sapiens
tggagtgtgacaatggtgtttgt

SEQ ID NO: 162461 - DNA, 23 bp, Homo sapiens
taaatagctactgctaggcaatc

SEQ ID NO: 162462 - DNA, 22 bp, Homo sapiens
tgcttccagctcagtgaggaca

SEQ ID NO: 162463 - DNA, 23 bp, Homo sapiens
tatgtgtatatatgtatatatgt

SEQ ID NO: 162464 - DNA, 23 bp, Homo sapiens
tgacagagtgaggccctgtctca

SEQ ID NO: 162465 - DNA, 23 bp, Homo sapiens
tttgcaacggagtctcactctgt

SEQ ID NO: 162466 - DNA, 23 bp, Homo sapiens
acttcagtgtatggaatagatct

SEQ ID NO: 162467 - DNA, 21 bp, Homo sapiens
attcagctactgaagatgtga

SEQ ID NO: 162468 - DNA, 21 bp, Homo sapiens
atatgtgtgtatatatgtaca

SEQ ID NO: 162469 - DNA, 23 bp, Homo sapiens
tatatacacacacatatatatat

SEQ ID NO: 162470 - DNA, 23 bp, Homo sapiens
tggagtctcactctgtcacccag

SEQ ID NO: 162471 - DNA, 22 bp, Homo sapiens
agaatgtagtggcaggttttgt

SEQ ID NO: 162472 - DNA, 23 bp, Homo sapiens
tgagttcattgtagattctggat

SEQ ID NO: 162473 - DNA, 23 bp, Homo sapiens
tgagttcattgtagattctggat

SEQ ID NO: 162474 - DNA, 21 bp, Homo sapiens
tttgagacagagtctccctct

SEQ ID NO: 162475 - DNA, 23 bp, Homo sapiens
tggagtctcactctgtcactgag

SEQ ID NO: 162476 - DNA, 23 bp, Homo sapiens
tgagacagagtttctctctgtca

SEQ ID NO: 162477 - DNA, 23 bp, Homo sapiens
tgcccaaagaaaagtctgacctg

SEQ ID NO: 162478 - DNA, 23 bp, Homo sapiens
tgagttcattgtagattctggat

SEQ ID NO: 162479 - DNA, 23 bp, Homo sapiens
tgagttcattgtagattctggat

SEQ ID NO: 162480 - DNA, 23 bp, Homo sapiens
tgagttcattgtagattctggat

SEQ ID NO: 162481 - DNA, 23 bp, Homo sapiens
tgagttcattgtagattctggat

SEQ ID NO: 162482 - DNA, 23 bp, Homo sapiens
gatttctctctctgtggctttgc

SEQ ID NO: 162483 - DNA, 21 bp, Homo sapiens
cagttgaggaacatttgggtt

SEQ ID NO: 162484 - DNA, 23 bp, Homo sapiens
tgagttcattgtagattctggat

SEQ ID NO: 162485 - DNA, 23 bp, Homo sapiens
tgagttcattgtagattctggat

SEQ ID NO: 162486 - DNA, 23 bp, Homo sapiens
agtctctcactctgtctccaagg

SEQ ID NO: 162487 - DNA, 22 bp, Homo sapiens
tagcttcgaaatcttgtgaatt

SEQ ID NO: 162488 - DNA, 23 bp, Homo sapiens
agttacatcagtttccaatttta

SEQ ID NO: 162489 - DNA, 22 bp, Homo sapiens
atatacatatgtgtgtgtgtgt

SEQ ID NO: 162490 - DNA, 22 bp, Homo sapiens
acacacacacaggtatttatgt

SEQ ID NO: 162491 - DNA, 23 bp, Homo sapiens
tgtatatatgtatatgtgtgtgc

SEQ ID NO: 162492 - DNA, 20 bp, Homo sapiens
tatatagcttaatgaagaca

SEQ ID NO: 162493 - DNA, 22 bp, Homo sapiens
ccctgtagaggaggcagtgaca

SEQ ID NO: 162494 - DNA, 23 bp, Homo sapiens
gtagatggttgatatgatttgga

SEQ ID NO: 162495 - DNA, 23 bp, Homo sapiens
caaatctcatgttgaattctaat

SEQ ID NO: 162496 - DNA, 23 bp, Homo sapiens
acagagtctcactctgtcgccca

SEQ ID NO: 162497 - DNA, 19 bp, Homo sapiens
tagtgtatttcagtatttc

SEQ ID NO: 162498 - DNA, 22 bp, Homo sapiens
ttatgactgaataatattgcat

SEQ ID NO: 162499 - DNA, 23 bp, Homo sapiens
tatataccacattttgtttttgt

SEQ ID NO: 162500 - DNA, 23 bp, Homo sapiens
tgagttcattgtagattctggat

SEQ ID NO: 162501 - DNA, 23 bp, Homo sapiens
tgagttcattgtagattctggat

SEQ ID NO: 162502 - DNA, 23 bp, Homo sapiens
tgattctgtttcttctttttggt

SEQ ID NO: 162503 - DNA, 21 bp, Homo sapiens
aaacacagtttcactctgtca

SEQ ID NO: 162504 - DNA, 21 bp, Homo sapiens
ttatcattgttttacattatg

SEQ ID NO: 162505 - DNA, 22 bp, Homo sapiens
gagcctccctctgtccgtccgt

SEQ ID NO: 162506 - DNA, 21 bp, Homo sapiens
tggcgtgatcttggcttactg

SEQ ID NO: 162507 - DNA, 22 bp, Homo sapiens
tctgtgtgtatctgtgtcctat

SEQ ID NO: 162508 - DNA, 20 bp, Homo sapiens
tgagtgatgtgtgcctgcac

SEQ ID NO: 162509 - DNA, 23 bp, Homo sapiens
agagtctcactctgtcacccagg

SEQ ID NO: 162510 - DNA, 23 bp, Homo sapiens
gagtctcactctgtcacccaggc

SEQ ID NO: 162511 - DNA, 23 bp, Homo sapiens
actcactcattcactcacttgct

SEQ ID NO: 162512 - DNA, 19 bp, Homo sapiens
gcagcagagtgagtcctga

SEQ ID NO: 162513 - DNA, 22 bp, Homo sapiens
gctgtcagtgacattcagactc

SEQ ID NO: 162514 - DNA, 23 bp, Homo sapiens
tttttaggtagaattctaaagaa

SEQ ID NO: 162515 - DNA, 23 bp, Homo sapiens
taggtgtgtgtatatgtatatgt

SEQ ID NO: 162516 - DNA, 23 bp, Homo sapiens
tgtatctgtatatatataggtgt

SEQ ID NO: 162517 - DNA, 20 bp, Homo sapiens
gactctttctctctcacttt

SEQ ID NO: 162518 - DNA, 20 bp, Homo sapiens
aagaggtgagagtcagggaa

SEQ ID NO: 162519 - DNA, 20 bp, Homo sapiens
tatatctcagaacttgatgt

SEQ ID NO: 162520 - DNA, 22 bp, Homo sapiens
ctatgtgcttgtgcctatctat

SEQ ID NO: 162521 - DNA, 22 bp, Homo sapiens
acagagaagagactgaacagaa

SEQ ID NO: 162522 - DNA, 18 bp, Homo sapiens
ttcagtggtcctggaatc

SEQ ID NO: 162523 - DNA, 23 bp, Homo sapiens
tttgtacttgtgccactctgtga

SEQ ID NO: 162524 - DNA, 23 bp, Homo sapiens
tgagttcattgtagattctggat

SEQ ID NO: 162525 - DNA, 23 bp, Homo sapiens
tgagttcattgtagattctggat

SEQ ID NO: 162526 - DNA, 21 bp, Homo sapiens
gctgtctagtgtttctcttca

SEQ ID NO: 162527 - DNA, 22 bp, Homo sapiens
aaccactagttggagtgtttgt

SEQ ID NO: 162528 - DNA, 23 bp, Homo sapiens
tcactgtatatatatactgtatg

SEQ ID NO: 162529 - DNA, 22 bp, Homo sapiens
ttgttgtttgaagctgaggaag

SEQ ID NO: 162530 - DNA, 23 bp, Homo sapiens
gagtctcactctgtcacccaggc

SEQ ID NO: 162531 - DNA, 23 bp, Homo sapiens
atagtagttcatagcagtctcta

SEQ ID NO: 162532 - DNA, 20 bp, Homo sapiens
tgattctttgaatttttgta

SEQ ID NO: 162533 - DNA, 23 bp, Homo sapiens
aggagtctcactctgtcacccag

SEQ ID NO: 162534 - DNA, 22 bp, Homo sapiens
atgcatctacatgtgtgtgtgt

SEQ ID NO: 162535 - DNA, 20 bp, Homo sapiens
tactgtagtgttatagtatt

SEQ ID NO: 162536 - DNA, 23 bp, Homo sapiens
tctcacactatctgtgtcctttt

SEQ ID NO: 162537 - DNA, 23 bp, Homo sapiens
tgcagatatgtgagcaaacctat

SEQ ID NO: 162538 - DNA, 19 bp, Homo sapiens
tattctgactgttcaggga

SEQ ID NO: 162539 - DNA, 20 bp, Homo sapiens
agtgggtatagttaatctga

SEQ ID NO: 162540 - DNA, 22 bp, Homo sapiens
attgtgcatctcatatgtatat

SEQ ID NO: 162541 - DNA, 23 bp, Homo sapiens
atgcccaattgtgtggcctgttt

SEQ ID NO: 162542 - DNA, 20 bp, Homo sapiens
cagctaacatttactgtact

SEQ ID NO: 162543 - DNA, 22 bp, Homo sapiens
actgtctgagtaaggtaacgct

SEQ ID NO: 162544 - DNA, 23 bp, Homo sapiens
tgagttcattgtagattctggat

SEQ ID NO: 162545 - DNA, 23 bp, Homo sapiens
tgagttcattgtagattctggat

SEQ ID NO: 162546 - DNA, 21 bp, Homo sapiens
gagtagtggtagaaacttgtt

SEQ ID NO: 162547 - DNA, 22 bp, Homo sapiens
tcacagctttgttctctggctc

SEQ ID NO: 162548 - DNA, 20 bp, Homo sapiens
aaatgtttcgttctatgtgt

SEQ ID NO: 162549 - DNA, 20 bp, Homo sapiens
ggcaatcagtagttgaagga

SEQ ID NO: 162550 - DNA, 23 bp, Homo sapiens
cctgcgtcactgagtgactgtga

SEQ ID NO: 162551 - DNA, 23 bp, Homo sapiens
aagatccttaggtaatcagattt

SEQ ID NO: 162552 - DNA, 23 bp, Homo sapiens
agatacatatagtgtgtgtatat

SEQ ID NO: 162553 - DNA, 22 bp, Homo sapiens
atagtgtgtgtatatatacaca

SEQ ID NO: 162554 - DNA, 18 bp, Homo sapiens
tatacacacactatatgt

SEQ ID NO: 162555 - DNA, 23 bp, Homo sapiens
tatgtatgtatgtatgtgtgtgt

SEQ ID NO: 162556 - DNA, 23 bp, Homo sapiens
tgagatcaaggtgttagcagatt

SEQ ID NO: 162557 - DNA, 23 bp, Homo sapiens
tgctgctggatttcatttgctag

SEQ ID NO: 162558 - DNA, 20 bp, Homo sapiens
actgttttgtgttttatgct

SEQ ID NO: 162559 - DNA, 23 bp, Homo sapiens
tgtatgtatgtgtatatgtatac

SEQ ID NO: 162560 - DNA, 18 bp, Homo sapiens
tttcattttctttgtgat

SEQ ID NO: 162561 - DNA, 23 bp, Homo sapiens
tgagttcattgtagattctggat

SEQ ID NO: 162562 - DNA, 23 bp, Homo sapiens
tgagttcattgtagattctggat

SEQ ID NO: 162563 - DNA, 23 bp, Homo sapiens
aggaattcttgtctatttgttgc

SEQ ID NO: 162564 - DNA, 21 bp, Homo sapiens
gtactatgttgaatagaagtg

SEQ ID NO: 162565 - DNA, 23 bp, Homo sapiens
gtgtatatgtgtatatatgtgta

SEQ ID NO: 162566 - DNA, 19 bp, Homo sapiens
tatgtgtatatgtgtacat

SEQ ID NO: 162567 - DNA, 23 bp, Homo sapiens
tgagttcattgtagattctggat

SEQ ID NO: 162568 - DNA, 23 bp, Homo sapiens
tgagttcattgtagattctggat

SEQ ID NO: 162569 - DNA, 19 bp, Homo sapiens
tcaagaatcagctgtggct

SEQ ID NO: 162570 - DNA, 23 bp, Homo sapiens
atatgtgtgtgtatgtatgcatt

SEQ ID NO: 162571 - DNA, 22 bp, Homo sapiens
agaagaaccacagtgacagata

SEQ ID NO: 162572 - DNA, 23 bp, Homo sapiens
accatctgtgtctgtgtctcacc

SEQ ID NO: 162573 - DNA, 23 bp, Homo sapiens
atatgtgtatatatatgtgtgta

SEQ ID NO: 162574 - DNA, 22 bp, Homo sapiens
ttttccttttaaatgaaaagtt

SEQ ID NO: 162575 - DNA, 23 bp, Homo sapiens
tagatttttgattttgaagaact

SEQ ID NO: 162576 - DNA, 23 bp, Homo sapiens
cttcatgacaggagatcgaggtg

SEQ ID NO: 162577 - DNA, 21 bp, Homo sapiens
cctcaccctctcacagagact

SEQ ID NO: 162578 - DNA, 23 bp, Homo sapiens
aaacttgtaattggcagttctgt

SEQ ID NO: 162579 - DNA, 23 bp, Homo sapiens
tcttttgtcagcttttgatggag

SEQ ID NO: 162580 - DNA, 23 bp, Homo sapiens
cctctctgtgtgtgtgtccgtgt

SEQ ID NO: 162581 - DNA, 23 bp, Homo sapiens
tcagatagatatggaatgtcaag

SEQ ID NO: 162582 - DNA, 23 bp, Homo sapiens
atgtatatatgtatacatatacg

SEQ ID NO: 162583 - DNA, 21 bp, Homo sapiens
tacatgtatatatgtatacat

SEQ ID NO: 162584 - DNA, 22 bp, Homo sapiens
taacttctgattttgatgattg

SEQ ID NO: 162585 - DNA, 23 bp, Homo sapiens
catatgtatatatgtattacgta

SEQ ID NO: 162586 - DNA, 19 bp, Homo sapiens
tatatgtattacgtataca

SEQ ID NO: 162587 - DNA, 23 bp, Homo sapiens
tctctgtcagtctctctggtgga

SEQ ID NO: 162588 - DNA, 23 bp, Homo sapiens
agagtctcactctgtcacccagg

SEQ ID NO: 162589 - DNA, 20 bp, Homo sapiens
tgaggtgatatattcataac

SEQ ID NO: 162590 - DNA, 23 bp, Homo sapiens
aaacaatggatttctatgcttgt

SEQ ID NO: 162591 - DNA, 23 bp, Homo sapiens
atatatgtcttagaagtttcaaa

SEQ ID NO: 162592 - DNA, 23 bp, Homo sapiens
tgagttcattgtagattctggat

SEQ ID NO: 162593 - DNA, 23 bp, Homo sapiens
tgagttcattgtagattctggat

SEQ ID NO: 162594 - DNA, 23 bp, Homo sapiens
agagaatgcacctgtttttgttc

SEQ ID NO: 162595 - DNA, 23 bp, Homo sapiens
tggaagagtagagtttgagttct

SEQ ID NO: 162596 - DNA, 23 bp, Homo sapiens
tgaggaaacccaagacagactgc

SEQ ID NO: 162597 - DNA, 23 bp, Homo sapiens
tgagttcattgtagattctggat

SEQ ID NO: 162598 - DNA, 23 bp, Homo sapiens
tgagttcattgtagattctggat

SEQ ID NO: 162599 - DNA, 23 bp, Homo sapiens
tggctcactgtaacctctgcctc

SEQ ID NO: 162600 - DNA, 23 bp, Homo sapiens
tgagttcattgtagattctggat

SEQ ID NO: 162601 - DNA, 23 bp, Homo sapiens
tgagttcattgtagattctggat

SEQ ID NO: 162602 - DNA, 23 bp, Homo sapiens
tgagttcattgtagattctggat

SEQ ID NO: 162603 - DNA, 23 bp, Homo sapiens
tgagttcattgtagattctggat

SEQ ID NO: 162604 - DNA, 23 bp, Homo sapiens
tgacttgtgactctttctggtgc

SEQ ID NO: 162605 - DNA, 23 bp, Homo sapiens
aagcatctgactttgtatttgtg

SEQ ID NO: 162606 - DNA, 19 bp, Homo sapiens
atgtacacacacatatgtc

SEQ ID NO: 162607 - DNA, 23 bp, Homo sapiens
ttggagcttctccatcaggaaca

SEQ ID NO: 162608 - DNA, 23 bp, Homo sapiens
aagacctctctctatcactcaca

SEQ ID NO: 162609 - DNA, 22 bp, Homo sapiens
gaaataggacaggctttgtacc

SEQ ID NO: 162610 - DNA, 23 bp, Homo sapiens
agagtgctgagagtgagctgagt

SEQ ID NO: 162611 - DNA, 23 bp, Homo sapiens
ctactgtactgtggccattggtt

SEQ ID NO: 162612 - DNA, 21 bp, Homo sapiens
tgtggccagagaagatgtgtc

SEQ ID NO: 162613 - DNA, 23 bp, Homo sapiens
tgagttcattgtagattctggat

SEQ ID NO: 162614 - DNA, 23 bp, Homo sapiens
tgagttcattgtagattctggat

SEQ ID NO: 162615 - DNA, 20 bp, Homo sapiens
aagacagcagtgtgaccact

SEQ ID NO: 162616 - DNA, 23 bp, Homo sapiens
acagaggtcactgtgctcactct

SEQ ID NO: 162617 - DNA, 23 bp, Homo sapiens
atacagcttcccttaggtgtggg

SEQ ID NO: 162618 - DNA, 23 bp, Homo sapiens
tctgtataatctatgtcttgctt

SEQ ID NO: 162619 - DNA, 22 bp, Homo sapiens
catttgttttctcacagtccca

SEQ ID NO: 162620 - DNA, 23 bp, Homo sapiens
taagtctgagatcaaggtgtcag

SEQ ID NO: 162621 - DNA, 23 bp, Homo sapiens
tatgtgtatatatatttgtgtgt

SEQ ID NO: 162622 - DNA, 23 bp, Homo sapiens
ttgtatatgtatgtgtatatttg

SEQ ID NO: 162623 - DNA, 20 bp, Homo sapiens
atacacacattggtgtatat

SEQ ID NO: 162624 - DNA, 23 bp, Homo sapiens
atttgtatacatatatgtgtgtg

SEQ ID NO: 162625 - DNA, 23 bp, Homo sapiens
tgagttcattgtagattctggat

SEQ ID NO: 162626 - DNA, 23 bp, Homo sapiens
tgagttcattgtagattctggat

SEQ ID NO: 162627 - DNA, 23 bp, Homo sapiens
actcaatgtatctgagagtcaat

SEQ ID NO: 162628 - DNA, 20 bp, Homo sapiens
gagaggtcttaaaagcagta

SEQ ID NO: 162629 - DNA, 23 bp, Homo sapiens
atgtctcttctcagtgtgagagc

SEQ ID NO: 162630 - DNA, 18 bp, Homo sapiens
ctcctaagaaaagagagt

SEQ ID NO: 162631 - DNA, 22 bp, Homo sapiens
tgtcagaagtgagagtggtctt

SEQ ID NO: 162632 - DNA, 23 bp, Homo sapiens
tgagttcattgtagattctggat

SEQ ID NO: 162633 - DNA, 23 bp, Homo sapiens
caggctcactcagagactgagat

SEQ ID NO: 162634 - DNA, 21 bp, Homo sapiens
acgtatgtttttatgtctctt

SEQ ID NO: 162635 - DNA, 23 bp, Homo sapiens
agaattgctgagtctcatagtac

SEQ ID NO: 162636 - DNA, 23 bp, Homo sapiens
cagaacatagtgcaggctctgtc

SEQ ID NO: 162637 - DNA, 20 bp, Homo sapiens
ctctgggtgagtcagtgagt

SEQ ID NO: 162638 - DNA, 20 bp, Homo sapiens
gagtctgactgagtcactgc

SEQ ID NO: 162639 - DNA, 23 bp, Homo sapiens
ctctgtgtcagtgttgacaagtc

SEQ ID NO: 162640 - DNA, 18 bp, Homo sapiens
tcttttttagattacatc

SEQ ID NO: 162641 - DNA, 19 bp, Homo sapiens
tagcacggaggtttgatgc

SEQ ID NO: 162642 - DNA, 23 bp, Homo sapiens
ggtgtgtagtaggttgtttcgtc

SEQ ID NO: 162643 - DNA, 21 bp, Homo sapiens
tttggattgaagtgtctgggg

SEQ ID NO: 162644 - DNA, 23 bp, Homo sapiens
gtgtgtgtgcatgtgcatttgta

SEQ ID NO: 162645 - DNA, 23 bp, Homo sapiens
gtcactcagtctctctgagggtc

SEQ ID NO: 162646 - DNA, 22 bp, Homo sapiens
acagagatgacagtgaggtgag

SEQ ID NO: 162647 - DNA, 19 bp, Homo sapiens
ctcagaagagagggtgcag

SEQ ID NO: 162648 - DNA, 23 bp, Homo sapiens
tcagtgggtcaatgtgggacatc

SEQ ID NO: 162649 - DNA, 21 bp, Homo sapiens
tgtgagctggcccatctctgt

SEQ ID NO: 162650 - DNA, 23 bp, Homo sapiens
cctgtgtgtccgtgtctctgtgg

SEQ ID NO: 162651 - DNA, 22 bp, Homo sapiens
attctcgtaggaatcgtttctg

SEQ ID NO: 162652 - DNA, 23 bp, Homo sapiens
tatgtgtgtgtgcatgtgtatgt

SEQ ID NO: 162653 - DNA, 23 bp, Homo sapiens
gttatagtgaagttagagaggtc

SEQ ID NO: 162654 - DNA, 23 bp, Homo sapiens
tgactctctcacattaattagac

SEQ ID NO: 162655 - DNA, 18 bp, Homo sapiens
atgcctgtagttccagct

SEQ ID NO: 162656 - DNA, 21 bp, Homo sapiens
taagactgcagtgagctgtga

SEQ ID NO: 162657 - DNA, 20 bp, Homo sapiens
acacatatgtatatgtgtgt

SEQ ID NO: 162658 - DNA, 23 bp, Homo sapiens
ggagtctcactctgtcacctagg

SEQ ID NO: 162659 - DNA, 19 bp, Homo sapiens
gtccccgtcactgtccctc

SEQ ID NO: 162660 - DNA, 23 bp, Homo sapiens
tgcgtgtctgcctgcgtgtgtgc

SEQ ID NO: 162661 - DNA, 23 bp, Homo sapiens
tgtgcctgcgtgtgtgcctgcgt

SEQ ID NO: 162662 - DNA, 23 bp, Homo sapiens
tgtgcctgcgtgtgtacctgcgt

SEQ ID NO: 162663 - DNA, 23 bp, Homo sapiens
ctgtctctgtcagggagaggagt

SEQ ID NO: 162664 - DNA, 23 bp, Homo sapiens
actctctctgtgggtcacttccc

SEQ ID NO: 162665 - DNA, 23 bp, Homo sapiens
tctatatttatgaataccggtag

SEQ ID NO: 162666 - DNA, 21 bp, Homo sapiens
tgtgtggacactgtcagcctc

SEQ ID NO: 162667 - DNA, 23 bp, Homo sapiens
aggttcactgtttgagttgaaat

SEQ ID NO: 162668 - DNA, 20 bp, Homo sapiens
ttgacacaagaggctgagct

SEQ ID NO: 162669 - DNA, 23 bp, Homo sapiens
tcatacagaacaaagaatgcagt

SEQ ID NO: 162670 - DNA, 23 bp, Homo sapiens
ctgagtctcactctgtgacccag

SEQ ID NO: 162671 - DNA, 23 bp, Homo sapiens
aacagatgagatgttgatgttgt

SEQ ID NO: 162672 - DNA, 20 bp, Homo sapiens
tgtctgggtcgctgtatggg

SEQ ID NO: 162673 - DNA, 23 bp, Homo sapiens
tatgtgagtatatgtatatataa

SEQ ID NO: 162674 - DNA, 23 bp, Homo sapiens
tctctgcctgtgtctcacttagc

SEQ ID NO: 162675 - DNA, 23 bp, Homo sapiens
tatctatatgtatctatatgtat

SEQ ID NO: 162676 - DNA, 23 bp, Homo sapiens
tatacatatgtatacatatgtat

SEQ ID NO: 162677 - DNA, 22 bp, Homo sapiens
tatatgtgcatgtatacgtgta

SEQ ID NO: 162678 - DNA, 23 bp, Homo sapiens
tgtgtgtctgcatgtgtgtgtat

SEQ ID NO: 162679 - DNA, 23 bp, Homo sapiens
tttatgtgtggttcattttggtt

SEQ ID NO: 162680 - DNA, 20 bp, Homo sapiens
ttttgataatgctgtcctgg

SEQ ID NO: 162681 - DNA, 23 bp, Homo sapiens
tgtgtctctgtgtaagtgcacat

SEQ ID NO: 162682 - DNA, 21 bp, Homo sapiens
tgtgcatgtgcatatgtgtgc

SEQ ID NO: 162683 - DNA, 22 bp, Homo sapiens
atgtgtgcctgtgtgcgtgtgt

SEQ ID NO: 162684 - DNA, 23 bp, Homo sapiens
atgtctgtggctccctctgtgtc

SEQ ID NO: 162685 - DNA, 21 bp, Homo sapiens
tcaggtgctgtttgactcaca

SEQ ID NO: 162686 - DNA, 23 bp, Homo sapiens
atgtcacagtgtctgaagctgga

SEQ ID NO: 162687 - DNA, 23 bp, Homo sapiens
tgtgtgtgcaagtgcatgtgtgt

SEQ ID NO: 162688 - DNA, 21 bp, Homo sapiens
taagggtgtcgctgatctgag

SEQ ID NO: 162689 - DNA, 22 bp, Homo sapiens
gtctcaccctctcagagcttcc

SEQ ID NO: 162690 - DNA, 23 bp, Homo sapiens
tgtgtctctgtcagagctcttgg

SEQ ID NO: 162691 - DNA, 23 bp, Homo sapiens
ttttttggttccatatgaaattt

SEQ ID NO: 162692 - DNA, 21 bp, Homo sapiens
gtcacctgtgtctctgtgtcc

SEQ ID NO: 162693 - DNA, 20 bp, Homo sapiens
agggactgtgttatcctggt

SEQ ID NO: 162694 - DNA, 23 bp, Homo sapiens
tctgacacagtgtctgaatgatt

SEQ ID NO: 162695 - DNA, 18 bp, Homo sapiens
aagaaacttaagagcaca

SEQ ID NO: 162696 - DNA, 23 bp, Homo sapiens
caatctcactctccctgtctgtc

SEQ ID NO: 162697 - DNA, 23 bp, Homo sapiens
attgtgtgaaatcagtgtgagca

SEQ ID NO: 162698 - DNA, 23 bp, Homo sapiens
attgtgtgaaatcagtgtgagca

SEQ ID NO: 162699 - DNA, 23 bp, Homo sapiens
gtcagtctcgctctgtcacccag

SEQ ID NO: 162700 - DNA, 22 bp, Homo sapiens
gggacagagaccagagagtgcc

SEQ ID NO: 162701 - DNA, 23 bp, Homo sapiens
cagtgaaagaactgagtgagcag

SEQ ID NO: 162702 - DNA, 18 bp, Homo sapiens
tcacggaaggttagttcg

SEQ ID NO: 162703 - DNA, 23 bp, Homo sapiens
ggtgtgtggatgtgtgtaacgtg

SEQ ID NO: 162704 - DNA, 23 bp, Homo sapiens
gacagtctcgctctgtctcccag

SEQ ID NO: 162705 - DNA, 22 bp, Homo sapiens
tgaggtctgggtgctgaggtct

SEQ ID NO: 162706 - DNA, 23 bp, Homo sapiens
tctcttcttgctgcagtacgagg

SEQ ID NO: 162707 - DNA, 19 bp, Homo sapiens
ctctgagtgtgactggcgc

SEQ ID NO: 162708 - DNA, 23 bp, Homo sapiens
agctctggctctgacagcggcag

SEQ ID NO: 162709 - DNA, 23 bp, Homo sapiens
tactctgtctctttctaactcct

SEQ ID NO: 162710 - DNA, 23 bp, Homo sapiens
acaggtgacacactcacagggtc

SEQ ID NO: 162711 - DNA, 19 bp, Homo sapiens
tccctagagataggctatc

SEQ ID NO: 162712 - DNA, 23 bp, Homo sapiens
gagacggagtctcgctctgcctc

SEQ ID NO: 162713 - DNA, 23 bp, Homo sapiens
tttgaaacggagtctcactctgt

SEQ ID NO: 162714 - DNA, 21 bp, Homo sapiens
acaagcggctctcagagggag

SEQ ID NO: 162715 - DNA, 23 bp, Homo sapiens
ttgaacctcaaactctgtgagtc

SEQ ID NO: 162716 - DNA, 23 bp, Homo sapiens
tgggtctctcacttttctcacac

SEQ ID NO: 162717 - DNA, 18 bp, Homo sapiens
tcagatgcttgtgtggcc

SEQ ID NO: 162718 - DNA, 23 bp, Homo sapiens
tgagttcattgtagattctggat

SEQ ID NO: 162719 - DNA, 23 bp, Homo sapiens
tgagttcattgtagattctggat

SEQ ID NO: 162720 - DNA, 23 bp, Homo sapiens
ccctggctgcctctgaggctcag

SEQ ID NO: 162721 - DNA, 21 bp, Homo sapiens
tgcaacacttctgattttcaa

SEQ ID NO: 162722 - DNA, 21 bp, Homo sapiens
tatgtgtgtagtgtgtacgtg

SEQ ID NO: 162723 - DNA, 19 bp, Homo sapiens
ttctattatgctgtgaatc

SEQ ID NO: 162724 - DNA, 23 bp, Homo sapiens
tctgaggctctctgactttgcac

SEQ ID NO: 162725 - DNA, 23 bp, Homo sapiens
tctgaggctctctgactttgcac

SEQ ID NO: 162726 - DNA, 23 bp, Homo sapiens
catgacacaggcaggtttgacaa

SEQ ID NO: 162727 - DNA, 23 bp, Homo sapiens
agaaatgtgcctggacaaaaagc

SEQ ID NO: 162728 - DNA, 22 bp, Homo sapiens
acaggttgtgtgtgtatatata

SEQ ID NO: 162729 - DNA, 18 bp, Homo sapiens
aagggtgtgtgtgtgtgt

SEQ ID NO: 162730 - DNA, 21 bp, Homo sapiens
taatttctagtgaattccatt

SEQ ID NO: 162731 - DNA, 23 bp, Homo sapiens
atatgtatatatacatatgtgta

SEQ ID NO: 162732 - DNA, 22 bp, Homo sapiens
tatatgtatatatacatatgtg

SEQ ID NO: 162733 - DNA, 22 bp, Homo sapiens
atatgtatatatgcatatgtat

SEQ ID NO: 162734 - DNA, 21 bp, Homo sapiens
aaaatgcacaaaatgctgatg

SEQ ID NO: 162735 - DNA, 18 bp, Homo sapiens
aaggatgcttagggtatg

SEQ ID NO: 162736 - DNA, 23 bp, Homo sapiens
tgcctggctctgtccctctccct

SEQ ID NO: 162737 - DNA, 23 bp, Homo sapiens
tacatgtgctgaacgtgcaggtt

SEQ ID NO: 162738 - DNA, 23 bp, Homo sapiens
agagtctcactcactctgttgcc

SEQ ID NO: 162739 - DNA, 23 bp, Homo sapiens
tctgtcctgatttgtgtctctct

SEQ ID NO: 162740 - DNA, 23 bp, Homo sapiens
atatatacatatgtatacatatg

SEQ ID NO: 162741 - DNA, 23 bp, Homo sapiens
atatatgcatatatacatataga

SEQ ID NO: 162742 - DNA, 23 bp, Homo sapiens
atatgtgtatatgtatatgtatg

SEQ ID NO: 162743 - DNA, 22 bp, Homo sapiens
atgtatatatgtatatgtatgt

SEQ ID NO: 162744 - DNA, 23 bp, Homo sapiens
tatgtatgtatgtatatatgtat

SEQ ID NO: 162745 - DNA, 20 bp, Homo sapiens
tatatgtatatatgtataca

SEQ ID NO: 162746 - DNA, 23 bp, Homo sapiens
cacactctgaggaaatactgttg

SEQ ID NO: 162747 - DNA, 19 bp, Homo sapiens
gcacctctctctctgcctc

SEQ ID NO: 162748 - DNA, 23 bp, Homo sapiens
agactctgtgtctgtcttttttg

SEQ ID NO: 162749 - DNA, 21 bp, Homo sapiens
tagatagatagatagatagat

SEQ ID NO: 162750 - DNA, 23 bp, Homo sapiens
tgagatggagtctcgctctgttg

SEQ ID NO: 162751 - DNA, 20 bp, Homo sapiens
tctcagctcatagtaacctc

SEQ ID NO: 162752 - DNA, 20 bp, Homo sapiens
taagtgctatttgaattagt

SEQ ID NO: 162753 - DNA, 20 bp, Homo sapiens
tctctgcgtgtatatgtata

SEQ ID NO: 162754 - DNA, 23 bp, Homo sapiens
aggagtaagaggctgcagtgtgc

SEQ ID NO: 162755 - DNA, 20 bp, Homo sapiens
tagttagtacaggtacagat

SEQ ID NO: 162756 - DNA, 20 bp, Homo sapiens
aagacacaatggattgtgta

SEQ ID NO: 162757 - DNA, 23 bp, Homo sapiens
agacagtgtctccctctgttgcc

SEQ ID NO: 162758 - DNA, 23 bp, Homo sapiens
agacagttcacagacagctctgc

SEQ ID NO: 162759 - DNA, 23 bp, Homo sapiens
cagtactgtgtatgttgtactgt

SEQ ID NO: 162760 - DNA, 22 bp, Homo sapiens
tgcctgtggttccagctactca

SEQ ID NO: 162761 - DNA, 22 bp, Homo sapiens
aataatagagtttatgatgaag

SEQ ID NO: 162762 - DNA, 19 bp, Homo sapiens
gtctcgctctgtcgctcag

SEQ ID NO: 162763 - DNA, 18 bp, Homo sapiens
ctcgctcacacacacact

SEQ ID NO: 162764 - DNA, 23 bp, Homo sapiens
tctcatggaaagatgtgtgcaca

SEQ ID NO: 162765 - DNA, 23 bp, Homo sapiens
caattgtgtagatgtataactgt

SEQ ID NO: 162766 - DNA, 22 bp, Homo sapiens
acatcacactttggaaatcact

SEQ ID NO: 162767 - DNA, 22 bp, Homo sapiens
aagctgcaaatgtaagcatttt

SEQ ID NO: 162768 - DNA, 21 bp, Homo sapiens
aacacagatgtgtgtctgtga

SEQ ID NO: 162769 - DNA, 23 bp, Homo sapiens
atctcagtacagagtgtggagat

SEQ ID NO: 162770 - DNA, 20 bp, Homo sapiens
cagaggctcagaattgggtc

SEQ ID NO: 162771 - DNA, 23 bp, Homo sapiens
agagtctcaccctgtcacccagg

SEQ ID NO: 162772 - DNA, 23 bp, Homo sapiens
atctgagacagtgtttcactctg

SEQ ID NO: 162773 - DNA, 21 bp, Homo sapiens
tgcctgccaccatgcctggct

SEQ ID NO: 162774 - DNA, 20 bp, Homo sapiens
tatgcatatttattcatact

SEQ ID NO: 162775 - DNA, 23 bp, Homo sapiens
tctgtcacccagactgaagtaca

SEQ ID NO: 162776 - DNA, 22 bp, Homo sapiens
acaaaacaggtgtgcattcctt

SEQ ID NO: 162777 - DNA, 23 bp, Homo sapiens
ttcaagtccacctgctgctgaaa

SEQ ID NO: 162778 - DNA, 23 bp, Homo sapiens
tgagtttctctcagtaaaccctg

SEQ ID NO: 162779 - DNA, 22 bp, Homo sapiens
ttgtttttcattctaaactcaa

SEQ ID NO: 162780 - DNA, 23 bp, Homo sapiens
atttacttatgtatatgtatatg

SEQ ID NO: 162781 - DNA, 23 bp, Homo sapiens
tatttgtgtgttgcatttgaaat

SEQ ID NO: 162782 - DNA, 23 bp, Homo sapiens
tctctgcctccgtgtgtgcacag

SEQ ID NO: 162783 - DNA, 23 bp, Homo sapiens
cctctgtgtatgtctgtgtctat

SEQ ID NO: 162784 - DNA, 23 bp, Homo sapiens
tttgtccctgtgtgtctctgtgt

SEQ ID NO: 162785 - DNA, 22 bp, Homo sapiens
tggagtctcactcactctgtcg

SEQ ID NO: 162786 - DNA, 21 bp, Homo sapiens
aatatatgcatatgttacaaa

SEQ ID NO: 162787 - DNA, 23 bp, Homo sapiens
tttgtgcttcccagtttttctgc

SEQ ID NO: 162788 - DNA, 22 bp, Homo sapiens
tgtgaccttccttgtctctgtg

SEQ ID NO: 162789 - DNA, 18 bp, Homo sapiens
agagagcacagagaggcc

SEQ ID NO: 162790 - DNA, 19 bp, Homo sapiens
tggtttcttgtgaagctgc

SEQ ID NO: 162791 - DNA, 23 bp, Homo sapiens
cggagtctcactctgtcacccag

SEQ ID NO: 162792 - DNA, 23 bp, Homo sapiens
tgtacacatatgaacacatatgt

SEQ ID NO: 162793 - DNA, 20 bp, Homo sapiens
tgtgcttttaagaatacagt

SEQ ID NO: 162794 - DNA, 23 bp, Homo sapiens
aacacagagagtctgggaaggtt

SEQ ID NO: 162795 - DNA, 21 bp, Homo sapiens
aaaagcatgattattggattg

SEQ ID NO: 162796 - DNA, 23 bp, Homo sapiens
tcttcaagccttagtgtgagatg

SEQ ID NO: 162797 - DNA, 23 bp, Homo sapiens
tcattgagactcattgggctagt

SEQ ID NO: 162798 - DNA, 23 bp, Homo sapiens
cacccatgcaatagttagcaata

SEQ ID NO: 162799 - DNA, 21 bp, Homo sapiens
tatgtgcacatgtgtgtctgt

SEQ ID NO: 162800 - DNA, 21 bp, Homo sapiens
ataagagtaactacataacag

SEQ ID NO: 162801 - DNA, 20 bp, Homo sapiens
tatttaagtcatattcttct

SEQ ID NO: 162802 - DNA, 23 bp, Homo sapiens
tcttggaatgaatggaacagtga

SEQ ID NO: 162803 - DNA, 21 bp, Homo sapiens
tatgtgtatatgtatgtgtgt

SEQ ID NO: 162804 - DNA, 23 bp, Homo sapiens
gtgtgtatatgtgtgtatatgtg

SEQ ID NO: 162805 - DNA, 23 bp, Homo sapiens
atgtgtgtatatatatgtgtgtg

SEQ ID NO: 162806 - DNA, 22 bp, Homo sapiens
tatatgtgtgtatatatgtgtg

SEQ ID NO: 162807 - DNA, 23 bp, Homo sapiens
taaaggcagtaatagtattgtgt

SEQ ID NO: 162808 - DNA, 23 bp, Homo sapiens
aacccagagtgtctgtctcagtc

SEQ ID NO: 162809 - DNA, 23 bp, Homo sapiens
tatacgtatatatacatatgtat

SEQ ID NO: 162810 - DNA, 22 bp, Homo sapiens
tctttctgcatctggatagtat

SEQ ID NO: 162811 - DNA, 21 bp, Homo sapiens
aaattgtgtgattttcatttc

SEQ ID NO: 162812 - DNA, 21 bp, Homo sapiens
aaagagagggataaagaagcc

SEQ ID NO: 162813 - DNA, 22 bp, Homo sapiens
ttttgcatatttatgttcattg

SEQ ID NO: 162814 - DNA, 23 bp, Homo sapiens
ctaaatcacaatctgaaatagcc

SEQ ID NO: 162815 - DNA, 23 bp, Homo sapiens
tctatctacctatgtgtgtgtgt

SEQ ID NO: 162816 - DNA, 20 bp, Homo sapiens
agatgatatatataggtgat

SEQ ID NO: 162817 - DNA, 23 bp, Homo sapiens
atatatgtatgcatatgtatgta

SEQ ID NO: 162818 - DNA, 23 bp, Homo sapiens
ttgcaagtagtggaatcctaaat

SEQ ID NO: 162819 - DNA, 23 bp, Homo sapiens
tgagttcattgtagattctggat

SEQ ID NO: 162820 - DNA, 23 bp, Homo sapiens
tgagttcattgtagattctggat

SEQ ID NO: 162821 - DNA, 22 bp, Homo sapiens
taacaatgcctggatttcatat

SEQ ID NO: 162822 - DNA, 23 bp, Homo sapiens
tcttagagtctcactctttcacc

SEQ ID NO: 162823 - DNA, 22 bp, Homo sapiens
tatgtctatatttatatgtgta

SEQ ID NO: 162824 - DNA, 23 bp, Homo sapiens
tatctctgaggtatgcatgtatg

SEQ ID NO: 162825 - DNA, 19 bp, Homo sapiens
tatgtgtgtgtatatctat

SEQ ID NO: 162826 - DNA, 23 bp, Homo sapiens
tgaaagcaagaatgatcttgaag

SEQ ID NO: 162827 - DNA, 23 bp, Homo sapiens
tttttgtacttcttaaactcagt

SEQ ID NO: 162828 - DNA, 21 bp, Homo sapiens
aactgaattcaagaagtacaa

SEQ ID NO: 162829 - DNA, 21 bp, Homo sapiens
tagataactgagctcattagt

SEQ ID NO: 162830 - DNA, 21 bp, Homo sapiens
tttgtctatagttagcataga

SEQ ID NO: 162831 - DNA, 19 bp, Homo sapiens
atatatgtttatgtgtatg

SEQ ID NO: 162832 - DNA, 23 bp, Homo sapiens
tatactatatgtgtgtgtgtgta

SEQ ID NO: 162833 - DNA, 22 bp, Homo sapiens
acacacacacactattactagt

SEQ ID NO: 162834 - DNA, 20 bp, Homo sapiens
atacgttgttgttgttgttg

SEQ ID NO: 162835 - DNA, 23 bp, Homo sapiens
tgttcctctgtattctttatgtc

SEQ ID NO: 162836 - DNA, 20 bp, Homo sapiens
atatgtatatatgtatatgt

SEQ ID NO: 162837 - DNA, 19 bp, Homo sapiens
tatacacacacacacatat

SEQ ID NO: 162838 - DNA, 21 bp, Homo sapiens
tatatgtatgtatatatgtgt

SEQ ID NO: 162839 - DNA, 22 bp, Homo sapiens
tatgtatctatatatgtatgtg

SEQ ID NO: 162840 - DNA, 23 bp, Homo sapiens
ttttttggttccatatgaaattt

SEQ ID NO: 162841 - DNA, 23 bp, Homo sapiens
agttttctctctctgtctgccgc

SEQ ID NO: 162842 - DNA, 21 bp, Homo sapiens
gaggacacagagagaagatgg

SEQ ID NO: 162843 - DNA, 22 bp, Homo sapiens
aacaatgtatttttattgagca

SEQ ID NO: 162844 - DNA, 23 bp, Homo sapiens
tcttagtgctttatatttgtatt

SEQ ID NO: 162845 - DNA, 23 bp, Homo sapiens
tttatctggctcccaaacctgtg

SEQ ID NO: 162846 - DNA, 23 bp, Homo sapiens
taaagtaaggatatgatttgtat

SEQ ID NO: 162847 - DNA, 23 bp, Homo sapiens
atgtatgtatacatgtatatgtg

SEQ ID NO: 162848 - DNA, 18 bp, Homo sapiens
gacagagccatatttctc

SEQ ID NO: 162849 - DNA, 20 bp, Homo sapiens
tgccacttcaaggagcacag

SEQ ID NO: 162850 - DNA, 23 bp, Homo sapiens
ctggctgtctcactccctctcta

SEQ ID NO: 162851 - DNA, 23 bp, Homo sapiens
tgagttcattgtagattctggat

SEQ ID NO: 162852 - DNA, 23 bp, Homo sapiens
tgagttcattgtagattctggat

SEQ ID NO: 162853 - DNA, 23 bp, Homo sapiens
tctctgactagtttgctcaacag

SEQ ID NO: 162854 - DNA, 23 bp, Homo sapiens
tgtagatgtatgtatatagagac

SEQ ID NO: 162855 - DNA, 23 bp, Homo sapiens
tgagttcattgtagattctggat

SEQ ID NO: 162856 - DNA, 23 bp, Homo sapiens
tgagttcattgtagattctggat

SEQ ID NO: 162857 - DNA, 23 bp, Homo sapiens
agaatcagcagatgggaggtgga

SEQ ID NO: 162858 - DNA, 23 bp, Homo sapiens
ttctgcactatttctacttctga

SEQ ID NO: 162859 - DNA, 21 bp, Homo sapiens
atataatgacgtattgttgtg

SEQ ID NO: 162860 - DNA, 23 bp, Homo sapiens
gacagagtctcgctctgtcaccc

SEQ ID NO: 162861 - DNA, 22 bp, Homo sapiens
tcacagtctctgggtgtctttt

SEQ ID NO: 162862 - DNA, 18 bp, Homo sapiens
agagatggaacactgagg

SEQ ID NO: 162863 - DNA, 22 bp, Homo sapiens
tgagatggagtctctctctgtc

SEQ ID NO: 162864 - DNA, 21 bp, Homo sapiens
tgaactttttctccaagagct

SEQ ID NO: 162865 - DNA, 23 bp, Homo sapiens
atgtgtgtgtatatatatgtgta

SEQ ID NO: 162866 - DNA, 21 bp, Homo sapiens
tcacgtacttggatcttaagt

SEQ ID NO: 162867 - DNA, 21 bp, Homo sapiens
aaggctgaggttctcaaatac

SEQ ID NO: 162868 - DNA, 23 bp, Homo sapiens
atttatttctgttagtggattgc

SEQ ID NO: 162869 - DNA, 22 bp, Homo sapiens
aaaatttcagattttgatgttc

SEQ ID NO: 162870 - DNA, 19 bp, Homo sapiens
aaggggcacaatttttgag

SEQ ID NO: 162871 - DNA, 20 bp, Homo sapiens
ttatgtataatatacttatg

SEQ ID NO: 162872 - DNA, 18 bp, Homo sapiens
tatcagtgtatatattca

SEQ ID NO: 162873 - DNA, 21 bp, Homo sapiens
taaagaagtattgcagcagga

SEQ ID NO: 162874 - DNA, 22 bp, Homo sapiens
agctctctgctgtagctgtctg

SEQ ID NO: 162875 - DNA, 18 bp, Homo sapiens
atgtgcacctgttctccc

SEQ ID NO: 162876 - DNA, 22 bp, Homo sapiens
aataacattttttaaatgtcag

SEQ ID NO: 162877 - DNA, 23 bp, Homo sapiens
tacagaaatgctattgacttttt

SEQ ID NO: 162878 - DNA, 23 bp, Homo sapiens
tgtacgtaaactgttacttttct

SEQ ID NO: 162879 - DNA, 20 bp, Homo sapiens
tatgtgtatatacgtgtgtg

SEQ ID NO: 162880 - DNA, 23 bp, Homo sapiens
tatgtgcatgtatatatgtatgt

SEQ ID NO: 162881 - DNA, 23 bp, Homo sapiens
atggagtctcactctgtcaccaa

SEQ ID NO: 162882 - DNA, 23 bp, Homo sapiens
tctagacagttaacacagaggac

SEQ ID NO: 162883 - DNA, 23 bp, Homo sapiens
tctgtgtgtctgaatagtgatag

SEQ ID NO: 162884 - DNA, 23 bp, Homo sapiens
tctatgacctagatgtttacttc

SEQ ID NO: 162885 - DNA, 21 bp, Homo sapiens
attcacagtgcctgatgtgtt

SEQ ID NO: 162886 - DNA, 20 bp, Homo sapiens
agtgtgattgcatttggaga

SEQ ID NO: 162887 - DNA, 20 bp, Homo sapiens
attctgagacggagtctcgc

SEQ ID NO: 162888 - DNA, 23 bp, Homo sapiens
atgtgtgtctgtgtgtatacaca

SEQ ID NO: 162889 - DNA, 23 bp, Homo sapiens
tacatgtgcaggatgtgcaggtt

SEQ ID NO: 162890 - DNA, 18 bp, Homo sapiens
tatttctagtagaggcgg

SEQ ID NO: 162891 - DNA, 23 bp, Homo sapiens
tttaaattgtaagatgttcagat

SEQ ID NO: 162892 - DNA, 23 bp, Homo sapiens
tgagttcattgtagattctggat

SEQ ID NO: 162893 - DNA, 23 bp, Homo sapiens
tgagttcattgtagattctggat

SEQ ID NO: 162894 - DNA, 23 bp, Homo sapiens
tatgtgtgtgtatatgtatatat

SEQ ID NO: 162895 - DNA, 23 bp, Homo sapiens
tatatacgtgtatatgtacatgt

SEQ ID NO: 162896 - DNA, 18 bp, Homo sapiens
tttagtaaagatgaagaa

SEQ ID NO: 162897 - DNA, 21 bp, Homo sapiens
tatccaagtttcacagtcact

SEQ ID NO: 162898 - DNA, 18 bp, Homo sapiens
atacataatttggtaagg

SEQ ID NO: 162899 - DNA, 19 bp, Homo sapiens
tctcgctatatattgtaat

SEQ ID NO: 162900 - DNA, 23 bp, Homo sapiens
tgcatatgtatatatgtttatgt

SEQ ID NO: 162901 - DNA, 23 bp, Homo sapiens
atcagacattggtagttgttagt

SEQ ID NO: 162902 - DNA, 18 bp, Homo sapiens
agacagctgaaaatgttg

SEQ ID NO: 162903 - DNA, 21 bp, Homo sapiens
ttggtggatattaaatgtgaa

SEQ ID NO: 162904 - DNA, 22 bp, Homo sapiens
ttgagctcttcctgctgccaga

SEQ ID NO: 162905 - DNA, 19 bp, Homo sapiens
tatggtaatttatgatgtt

SEQ ID NO: 162906 - DNA, 23 bp, Homo sapiens
agatgattgtgccctgtggatgt

SEQ ID NO: 162907 - DNA, 22 bp, Homo sapiens
ttgcaggagacatatgtatact

SEQ ID NO: 162908 - DNA, 22 bp, Homo sapiens
atctggattttaattgtgcatt

SEQ ID NO: 162909 - DNA, 23 bp, Homo sapiens
tgtatttttctttgctaaatttg

SEQ ID NO: 162910 - DNA, 20 bp, Homo sapiens
cactcaaaatgactgtgaac

SEQ ID NO: 162911 - DNA, 21 bp, Homo sapiens
ttcacagtcattttgagtgtg

SEQ ID NO: 162912 - DNA, 23 bp, Homo sapiens
ctcaagtagagtctgtctcctca

SEQ ID NO: 162913 - DNA, 20 bp, Homo sapiens
tgtgtatatatatgtgtgtg

SEQ ID NO: 162914 - DNA, 20 bp, Homo sapiens
acacacacacatactatata

SEQ ID NO: 162915 - DNA, 21 bp, Homo sapiens
ttatatgtacataatatatgt

SEQ ID NO: 162916 - DNA, 23 bp, Homo sapiens
aaatggctccttttgatatgaaa

SEQ ID NO: 162917 - DNA, 23 bp, Homo sapiens
taagagctcctttatctcaaatt

SEQ ID NO: 162918 - DNA, 23 bp, Homo sapiens
acggagtctcactctgtcaccca

SEQ ID NO: 162919 - DNA, 19 bp, Homo sapiens
ccagagtgcagatgtgtga

SEQ ID NO: 162920 - DNA, 22 bp, Homo sapiens
aaagtgatatagaagcagttat

SEQ ID NO: 162921 - DNA, 21 bp, Homo sapiens
tctcactctgtcaccaaggct

SEQ ID NO: 162922 - DNA, 18 bp, Homo sapiens
ggttcaagtgactctcct

SEQ ID NO: 162923 - DNA, 23 bp, Homo sapiens
aagtctcactctgtcacccaggc

SEQ ID NO: 162924 - DNA, 23 bp, Homo sapiens
tgcagtggcatgatcttggctca

SEQ ID NO: 162925 - DNA, 20 bp, Homo sapiens
acacacacacatatatatgt

SEQ ID NO: 162926 - DNA, 21 bp, Homo sapiens
tatgtacatatatatacatgt

SEQ ID NO: 162927 - DNA, 23 bp, Homo sapiens
gttttctacttgagctggtcaag

SEQ ID NO: 162928 - DNA, 18 bp, Homo sapiens
gcatatatatatatgtgt

SEQ ID NO: 162929 - DNA, 23 bp, Homo sapiens
atatatgcatgtatgtgtgtgtg

SEQ ID NO: 162930 - DNA, 23 bp, Homo sapiens
gtttttcagtgaatttgttcaag

SEQ ID NO: 162931 - DNA, 23 bp, Homo sapiens
cggagtctcgctctgtctcccag

SEQ ID NO: 162932 - DNA, 23 bp, Homo sapiens
tattactgtatggtattctgctg

SEQ ID NO: 162933 - DNA, 22 bp, Homo sapiens
cagcctttggatgcttcagtca

SEQ ID NO: 162934 - DNA, 23 bp, Homo sapiens
tacatgtggaaataatatgaaaa

SEQ ID NO: 162935 - DNA, 23 bp, Homo sapiens
agaatgcaatttttacagctatc

SEQ ID NO: 162936 - DNA, 22 bp, Homo sapiens
agtgatgttgagcacctcttca

SEQ ID NO: 162937 - DNA, 22 bp, Homo sapiens
atatatgtatatgtacatatgt

SEQ ID NO: 162938 - DNA, 22 bp, Homo sapiens
agagggaagaaggctggtcact

SEQ ID NO: 162939 - DNA, 21 bp, Homo sapiens
agtggcatgaagtaagtggat

SEQ ID NO: 162940 - DNA, 23 bp, Homo sapiens
tttttgagatggagtttcgctct

SEQ ID NO: 162941 - DNA, 18 bp, Homo sapiens
atctctgaacaatgagag

SEQ ID NO: 162942 - DNA, 19 bp, Homo sapiens
agtgcaaagaggtgtgtgt

SEQ ID NO: 162943 - DNA, 23 bp, Homo sapiens
tacttagtcacaatgtataatcc

SEQ ID NO: 162944 - DNA, 23 bp, Homo sapiens
gatttcatttgtgaatatgttgt

SEQ ID NO: 162945 - DNA, 23 bp, Homo sapiens
tgagttcattgtagattctggat

SEQ ID NO: 162946 - DNA, 23 bp, Homo sapiens
tgagttcattgtagattctggat

SEQ ID NO: 162947 - DNA, 21 bp, Homo sapiens
aattggttgatgaacaaagca

SEQ ID NO: 162948 - DNA, 22 bp, Homo sapiens
aatctggtctctgtctatcgag

SEQ ID NO: 162949 - DNA, 23 bp, Homo sapiens
acatacatgcacatcaagttctg

SEQ ID NO: 162950 - DNA, 23 bp, Homo sapiens
atctcaaaacttgatatgtgtag

SEQ ID NO: 162951 - DNA, 22 bp, Homo sapiens
agaagtttaaatcattagctgt

SEQ ID NO: 162952 - DNA, 23 bp, Homo sapiens
aatacaaatgattatgtattggg

SEQ ID NO: 162953 - DNA, 23 bp, Homo sapiens
taaaaatcagttgcatatcttta

SEQ ID NO: 162954 - DNA, 23 bp, Homo sapiens
tgagacaagggtgtcgctgtgtt

SEQ ID NO: 162955 - DNA, 18 bp, Homo sapiens
gtaatctttgtttattta

SEQ ID NO: 162956 - DNA, 23 bp, Homo sapiens
tgaggaacaaaagagtactcatt

SEQ ID NO: 162957 - DNA, 21 bp, Homo sapiens
caaatttgtctgggtccaaga

SEQ ID NO: 162958 - DNA, 23 bp, Homo sapiens
ttgttcttctgaatgactgtggg

SEQ ID NO: 162959 - DNA, 22 bp, Homo sapiens
ttctgtggttgttggatagagt

SEQ ID NO: 162960 - DNA, 23 bp, Homo sapiens
tgagttcattgtagattctggat

SEQ ID NO: 162961 - DNA, 23 bp, Homo sapiens
tgagttcattgtagattctggat

SEQ ID NO: 162962 - DNA, 19 bp, Homo sapiens
tgtgtgtgtgtatgtgtgt

SEQ ID NO: 162963 - DNA, 21 bp, Homo sapiens
atataccacatattctttatc

SEQ ID NO: 162964 - DNA, 23 bp, Homo sapiens
tgtgtgtgtgcatatatatacat

SEQ ID NO: 162965 - DNA, 23 bp, Homo sapiens
tgcatatatatacacacacatat

SEQ ID NO: 162966 - DNA, 20 bp, Homo sapiens
tgagacagaatctcactctg

SEQ ID NO: 162967 - DNA, 23 bp, Homo sapiens
acatctgtgttcatgagattggc

SEQ ID NO: 162968 - DNA, 23 bp, Homo sapiens
tgagttcattgtagattctggat

SEQ ID NO: 162969 - DNA, 23 bp, Homo sapiens
tgagttcattgtagattctggat

SEQ ID NO: 162970 - DNA, 23 bp, Homo sapiens
ttttttgcatttattcctgaaat

SEQ ID NO: 162971 - DNA, 23 bp, Homo sapiens
atctgtcccagaatttgagagag

SEQ ID NO: 162972 - DNA, 23 bp, Homo sapiens
agctcactgtaacctctgcctcc

SEQ ID NO: 162973 - DNA, 21 bp, Homo sapiens
acccctttatttaggaatctg

SEQ ID NO: 162974 - DNA, 23 bp, Homo sapiens
tgagttcattgtagattctggat

SEQ ID NO: 162975 - DNA, 23 bp, Homo sapiens
tgagttcattgtagattctggat

SEQ ID NO: 162976 - DNA, 23 bp, Homo sapiens
ttgagacggagtctcactctgtc

SEQ ID NO: 162977 - DNA, 19 bp, Homo sapiens
tcttgcctgtagtcccagc

SEQ ID NO: 162978 - DNA, 23 bp, Homo sapiens
ttcgatgtggtagatgttacttt

SEQ ID NO: 162979 - DNA, 21 bp, Homo sapiens
atatgccacatgaagaataca

SEQ ID NO: 162980 - DNA, 18 bp, Homo sapiens
ttgagaaatatgtcttca

SEQ ID NO: 162981 - DNA, 23 bp, Homo sapiens
attgtttgatttctgtttccttt

SEQ ID NO: 162982 - DNA, 23 bp, Homo sapiens
tggagcagagaggataatatgtc

SEQ ID NO: 162983 - DNA, 23 bp, Homo sapiens
atcccagaggttttgataagttg

SEQ ID NO: 162984 - DNA, 23 bp, Homo sapiens
tttcatcctgattttgtttttga

SEQ ID NO: 162985 - DNA, 23 bp, Homo sapiens
atataaatgctctatgtgtgtgt

SEQ ID NO: 162986 - DNA, 23 bp, Homo sapiens
gattacagatgtgagccaccaca

SEQ ID NO: 162987 - DNA, 23 bp, Homo sapiens
atctggatcacaaactggttctt

SEQ ID NO: 162988 - DNA, 23 bp, Homo sapiens
atgatgatgatgatgatgatgat

SEQ ID NO: 162989 - DNA, 23 bp, Homo sapiens
atgatgatgatgatgatgatgat

SEQ ID NO: 162990 - DNA, 22 bp, Homo sapiens
atgatgatgatgatgatgatga

SEQ ID NO: 162991 - DNA, 23 bp, Homo sapiens
aagtcatgagaaactgttggtgc

SEQ ID NO: 162992 - DNA, 23 bp, Homo sapiens
ataatgtgtgtatatgtagttta

SEQ ID NO: 162993 - DNA, 23 bp, Homo sapiens
tctccctctgtgtcacactgtgc

SEQ ID NO: 162994 - DNA, 23 bp, Homo sapiens
gaacttttcatgtagattttata

SEQ ID NO: 162995 - DNA, 21 bp, Homo sapiens
tttgagacagagttttctctg

SEQ ID NO: 162996 - DNA, 23 bp, Homo sapiens
acacaatgttgcttctcatagag

SEQ ID NO: 162997 - DNA, 23 bp, Homo sapiens
gggtctcactctgtcactcaggc

SEQ ID NO: 162998 - DNA, 22 bp, Homo sapiens
cagtggtgtgatcatagctcat

SEQ ID NO: 162999 - DNA, 23 bp, Homo sapiens
ctggctcactcagcctctgggtc

SEQ ID NO: 163000 - DNA, 23 bp, Homo sapiens
tggctcactacaacctccacatc

SEQ ID NO: 163001 - DNA, 19 bp, Homo sapiens
tatacacacacatatatac

SEQ ID NO: 163002 - DNA, 23 bp, Homo sapiens
tatgtgtgtatatatatgtgtgt

SEQ ID NO: 163003 - DNA, 20 bp, Homo sapiens
atatattcaggatatgtata

SEQ ID NO: 163004 - DNA, 23 bp, Homo sapiens
tgtgtgtgtatatatatgtgtgt

SEQ ID NO: 163005 - DNA, 23 bp, Homo sapiens
tggagtctcactctgtcacccag

SEQ ID NO: 163006 - DNA, 23 bp, Homo sapiens
agcctgtgcaacaagagtgaaac

SEQ ID NO: 163007 - DNA, 23 bp, Homo sapiens
tttgagacggagtctcattctgt

SEQ ID NO: 163008 - DNA, 23 bp, Homo sapiens
cagcttcagagatgaatctgaac

SEQ ID NO: 163009 - DNA, 23 bp, Homo sapiens
agagaagtctggtagattcgaga

SEQ ID NO: 163010 - DNA, 21 bp, Homo sapiens
aagaacaaggagagcttggag

SEQ ID NO: 163011 - DNA, 21 bp, Homo sapiens
tttcactgtcacaattttctc

SEQ ID NO: 163012 - DNA, 23 bp, Homo sapiens
actgtgtgtgtgaccgtgccaca

SEQ ID NO: 163013 - DNA, 23 bp, Homo sapiens
tttcattttgatgctgaatcata

SEQ ID NO: 163014 - DNA, 23 bp, Homo sapiens
gggtgacacagtgagactctgtc

SEQ ID NO: 163015 - DNA, 23 bp, Homo sapiens
tctgacatgtaactggagagaat

SEQ ID NO: 163016 - DNA, 18 bp, Homo sapiens
tggtactttgctccagtt

SEQ ID NO: 163017 - DNA, 18 bp, Homo sapiens
tctcgctctgtcacccag

SEQ ID NO: 163018 - DNA, 22 bp, Homo sapiens
tggcgtgatcttggctcactct

SEQ ID NO: 163019 - DNA, 23 bp, Homo sapiens
atatcatctgtatttgttgtttt

SEQ ID NO: 163020 - DNA, 23 bp, Homo sapiens
gacggggtctcactctgccaccc

SEQ ID NO: 163021 - DNA, 23 bp, Homo sapiens
tgagttcattgtagattctggat

SEQ ID NO: 163022 - DNA, 23 bp, Homo sapiens
tgagttcattgtagattctggat

SEQ ID NO: 163023 - DNA, 23 bp, Homo sapiens
ggctcacacctgtaatcccagca

SEQ ID NO: 163024 - DNA, 21 bp, Homo sapiens
ctcacacctgtaatcccagca

SEQ ID NO: 163025 - DNA, 20 bp, Homo sapiens
agaggaaaagggaaagttca

SEQ ID NO: 163026 - DNA, 23 bp, Homo sapiens
tggagtctcactctgtcacccag

SEQ ID NO: 163027 - DNA, 23 bp, Homo sapiens
atacacacacacatatatatatc

SEQ ID NO: 163028 - DNA, 22 bp, Homo sapiens
agataatgaactgaaacaaaag

SEQ ID NO: 163029 - DNA, 23 bp, Homo sapiens
atctttggtattgtagctgttga

SEQ ID NO: 163030 - DNA, 22 bp, Homo sapiens
atatatcttgtatatatatgtt

SEQ ID NO: 163031 - DNA, 23 bp, Homo sapiens
tatacacaatatatgtatgtgtg

SEQ ID NO: 163032 - DNA, 20 bp, Homo sapiens
tactgtgtgtgtgtgtgcat

SEQ ID NO: 163033 - DNA, 23 bp, Homo sapiens
acacagggccatggttatgagtg

SEQ ID NO: 163034 - DNA, 23 bp, Homo sapiens
tgagttcattgtagattctggat

SEQ ID NO: 163035 - DNA, 23 bp, Homo sapiens
tgagttcattgtagattctggat

SEQ ID NO: 163036 - DNA, 23 bp, Homo sapiens
tgtggctgtgcatctgcatgttt

SEQ ID NO: 163037 - DNA, 21 bp, Homo sapiens
tgggtagaactcaggatgcag

SEQ ID NO: 163038 - DNA, 21 bp, Homo sapiens
tttgaggcggagactcaccat

SEQ ID NO: 163039 - DNA, 23 bp, Homo sapiens
atggagtctcactctgtcaccca

SEQ ID NO: 163040 - DNA, 22 bp, Homo sapiens
tatatctacatatatgctgtgc

SEQ ID NO: 163041 - DNA, 22 bp, Homo sapiens
atatatgtatatatgctgtgca

SEQ ID NO: 163042 - DNA, 19 bp, Homo sapiens
gcctgtagtctcagctgct

SEQ ID NO: 163043 - DNA, 23 bp, Homo sapiens
ttcctgggtttgaattgggtcat

SEQ ID NO: 163044 - DNA, 23 bp, Homo sapiens
catgtgcttatctgtgcatatat

SEQ ID NO: 163045 - DNA, 23 bp, Homo sapiens
gtctgtgtgtgtctgtgtctctg

SEQ ID NO: 163046 - DNA, 23 bp, Homo sapiens
ttgaggcagagtttcactcttgt

SEQ ID NO: 163047 - DNA, 20 bp, Homo sapiens
acgtatatacacatatgtat

SEQ ID NO: 163048 - DNA, 18 bp, Homo sapiens
tatgtatatatacaggtg

SEQ ID NO: 163049 - DNA, 23 bp, Homo sapiens
agacatgtgtgtttcttgttctt

SEQ ID NO: 163050 - DNA, 21 bp, Homo sapiens
atatgtttatgtatatatgtg

SEQ ID NO: 163051 - DNA, 18 bp, Homo sapiens
atagacagataaatagat

SEQ ID NO: 163052 - DNA, 23 bp, Homo sapiens
tatgtacatcatatatgtatgtg

SEQ ID NO: 163053 - DNA, 19 bp, Homo sapiens
aagattaacactttgttat

SEQ ID NO: 163054 - DNA, 23 bp, Homo sapiens
tgcaggaatagtgaaaatgttga

SEQ ID NO: 163055 - DNA, 21 bp, Homo sapiens
gagtagttagatatttatgga

SEQ ID NO: 163056 - DNA, 21 bp, Homo sapiens
gacatagtatctggttgtgtt

SEQ ID NO: 163057 - DNA, 23 bp, Homo sapiens
tacaagagtctcactctgtcacc

SEQ ID NO: 163058 - DNA, 23 bp, Homo sapiens
gtggtgtgatgttggctcattgc

SEQ ID NO: 163059 - DNA, 20 bp, Homo sapiens
acagcctgtagctgttttgt

SEQ ID NO: 163060 - DNA, 23 bp, Homo sapiens
taaaagacagtatagcaagtgtg

SEQ ID NO: 163061 - DNA, 23 bp, Homo sapiens
tatattcttcttcatatcctcag

SEQ ID NO: 163062 - DNA, 21 bp, Homo sapiens
tagaagtggaaacagtgtatc

SEQ ID NO: 163063 - DNA, 22 bp, Homo sapiens
tgtgtgtctgtgtgtatagtta

SEQ ID NO: 163064 - DNA, 23 bp, Homo sapiens
attgtaggtggacaagcaggaga

SEQ ID NO: 163065 - DNA, 23 bp, Homo sapiens
tggttacacaggtatgtgtttga

SEQ ID NO: 163066 - DNA, 23 bp, Homo sapiens
atatgtgtgcatatgtatatcct

SEQ ID NO: 163067 - DNA, 23 bp, Homo sapiens
tgagttcattgtagattctggat

SEQ ID NO: 163068 - DNA, 23 bp, Homo sapiens
tgagttcattgtagattctggat

SEQ ID NO: 163069 - DNA, 23 bp, Homo sapiens
agcaaatgtttcctaatgaagac

SEQ ID NO: 163070 - DNA, 22 bp, Homo sapiens
actttgcttcttaaatgcacag

SEQ ID NO: 163071 - DNA, 21 bp, Homo sapiens
tgtgtattgactctgatttca

SEQ ID NO: 163072 - DNA, 23 bp, Homo sapiens
tgagtctgaagacagtttcgcct

SEQ ID NO: 163073 - DNA, 23 bp, Homo sapiens
tgagttcattgtagattctggat

SEQ ID NO: 163074 - DNA, 23 bp, Homo sapiens
tgagttcattgtagattctggat

SEQ ID NO: 163075 - DNA, 22 bp, Homo sapiens
aatatctatggttctattttca

SEQ ID NO: 163076 - DNA, 20 bp, Homo sapiens
agcggtgcatgtttctggtg

SEQ ID NO: 163077 - DNA, 21 bp, Homo sapiens
tcagcagagaagggaggtgaa

SEQ ID NO: 163078 - DNA, 23 bp, Homo sapiens
gtcactctcagtgtggctgagtc

SEQ ID NO: 163079 - DNA, 21 bp, Homo sapiens
ttaataccagcagcctgggac

SEQ ID NO: 163080 - DNA, 23 bp, Homo sapiens
tacatgtgcacattgtgcaggtt

SEQ ID NO: 163081 - DNA, 23 bp, Homo sapiens
atatatatttgtggagagtaacg

SEQ ID NO: 163082 - DNA, 23 bp, Homo sapiens
aagtgctactaagaagttggaat

SEQ ID NO: 163083 - DNA, 23 bp, Homo sapiens
tcagtagagacaaagtcttgcca

SEQ ID NO: 163084 - DNA, 23 bp, Homo sapiens
tgtgcctgtcaccctcacttgac

SEQ ID NO: 163085 - DNA, 23 bp, Homo sapiens
ttacatctatgagcatgtataca

SEQ ID NO: 163086 - DNA, 22 bp, Homo sapiens
aatactaacttagggaatgttc

SEQ ID NO: 163087 - DNA, 23 bp, Homo sapiens
ctgactgcattacttaatgagaa

SEQ ID NO: 163088 - DNA, 21 bp, Homo sapiens
tgggaagaagtgaactatgtt

SEQ ID NO: 163089 - DNA, 23 bp, Homo sapiens
tgtgtgtgtgcatgtgcatgagt

SEQ ID NO: 163090 - DNA, 23 bp, Homo sapiens
ttttgtgagagcatatgttttta

SEQ ID NO: 163091 - DNA, 20 bp, Homo sapiens
tgtgtatatgtatatatata

SEQ ID NO: 163092 - DNA, 18 bp, Homo sapiens
tagcacatagacatacac

SEQ ID NO: 163093 - DNA, 18 bp, Homo sapiens
tgcaacttctgcctcctg

SEQ ID NO: 163094 - DNA, 22 bp, Homo sapiens
atacatctatctgtgtgtgtat

SEQ ID NO: 163095 - DNA, 19 bp, Homo sapiens
tatacacatacatatctgt

SEQ ID NO: 163096 - DNA, 20 bp, Homo sapiens
tcctggacttttctatgttg

SEQ ID NO: 163097 - DNA, 23 bp, Homo sapiens
attatacacggaaccctatttgt

SEQ ID NO: 163098 - DNA, 22 bp, Homo sapiens
actgctaaacaagctactctct

SEQ ID NO: 163099 - DNA, 23 bp, Homo sapiens
agacagcatctctctctgtcatg

SEQ ID NO: 163100 - DNA, 23 bp, Homo sapiens
tgtatacatggaagaatggtctg

SEQ ID NO: 163101 - DNA, 23 bp, Homo sapiens
ttcacagaccttttcaaaacttt

SEQ ID NO: 163102 - DNA, 19 bp, Homo sapiens
tggcagggagtaagggtgg

SEQ ID NO: 163103 - DNA, 21 bp, Homo sapiens
ttccctctgacctcatctgcc

SEQ ID NO: 163104 - DNA, 23 bp, Homo sapiens
catcacttcacagtcaacagaca

SEQ ID NO: 163105 - DNA, 23 bp, Homo sapiens
tgagttcattgtagattctggat

SEQ ID NO: 163106 - DNA, 23 bp, Homo sapiens
tgagttcattgtagattctggat

SEQ ID NO: 163107 - DNA, 23 bp, Homo sapiens
agcagtgtttatgttgttgtggt

SEQ ID NO: 163108 - DNA, 22 bp, Homo sapiens
cacagagctatgtgtgtgtata

SEQ ID NO: 163109 - DNA, 23 bp, Homo sapiens
tggatgtgaaaatgatatgtgtg

SEQ ID NO: 163110 - DNA, 19 bp, Homo sapiens
ttatgtatacatatacaag

SEQ ID NO: 163111 - DNA, 19 bp, Homo sapiens
aatatgtatgtatatatgt

SEQ ID NO: 163112 - DNA, 18 bp, Homo sapiens
cttgactggattgaagga

SEQ ID NO: 163113 - DNA, 23 bp, Homo sapiens
gggtctgtctctgtcacccaggc

SEQ ID NO: 163114 - DNA, 20 bp, Homo sapiens
tacatgtatgtatatatgta

SEQ ID NO: 163115 - DNA, 20 bp, Homo sapiens
tatgtatatatacatgtatg

SEQ ID NO: 163116 - DNA, 22 bp, Homo sapiens
tatacatgtatgtatgtatata

SEQ ID NO: 163117 - DNA, 19 bp, Homo sapiens
tatgtatgtatatatgtgt

SEQ ID NO: 163118 - DNA, 21 bp, Homo sapiens
tatatgtatgtatatatgtgt

SEQ ID NO: 163119 - DNA, 22 bp, Homo sapiens
tatgtgtatatatatgtatgtg

SEQ ID NO: 163120 - DNA, 23 bp, Homo sapiens
tgagacggggtctcactctgcca

SEQ ID NO: 163121 - DNA, 21 bp, Homo sapiens
gtgcctctgtctctgtctgta

SEQ ID NO: 163122 - DNA, 23 bp, Homo sapiens
gggtctcactctgtcacccaggc

SEQ ID NO: 163123 - DNA, 22 bp, Homo sapiens
atgagataggtctttctttctt

SEQ ID NO: 163124 - DNA, 23 bp, Homo sapiens
tgagatggagcctcactctgtca

SEQ ID NO: 163125 - DNA, 23 bp, Homo sapiens
tatgtgtatatatatatgtgtgt

SEQ ID NO: 163126 - DNA, 22 bp, Homo sapiens
caggagttcaaggttacagtga

SEQ ID NO: 163127 - DNA, 23 bp, Homo sapiens
taggtgtgtgtgtgtatatgtat

SEQ ID NO: 163128 - DNA, 22 bp, Homo sapiens
taacagattgcttttgaacaat

SEQ ID NO: 163129 - DNA, 20 bp, Homo sapiens
attctcagcaatgggatgtg

SEQ ID NO: 163130 - DNA, 23 bp, Homo sapiens
ttgcatttttatgcactctgagt

SEQ ID NO: 163131 - DNA, 23 bp, Homo sapiens
tgagttcattgtagattctggat

SEQ ID NO: 163132 - DNA, 23 bp, Homo sapiens
tgagttcattgtagattctggat

SEQ ID NO: 163133 - DNA, 19 bp, Homo sapiens
tacttctgtgagataactg

SEQ ID NO: 163134 - DNA, 23 bp, Homo sapiens
gttcacactctctctgagttaag

SEQ ID NO: 163135 - DNA, 23 bp, Homo sapiens
gaattcagagtgaacaagctagc

SEQ ID NO: 163136 - DNA, 23 bp, Homo sapiens
gttgagcagttattttgttgatg

SEQ ID NO: 163137 - DNA, 23 bp, Homo sapiens
gcctcggtctctcactctgcctt

SEQ ID NO: 163138 - DNA, 21 bp, Homo sapiens
aggcaagaagtgagttgctgc

SEQ ID NO: 163139 - DNA, 23 bp, Homo sapiens
tatctttagtagagacagggttt

SEQ ID NO: 163140 - DNA, 23 bp, Homo sapiens
tgagacagggtatcgctctgtta

SEQ ID NO: 163141 - DNA, 23 bp, Homo sapiens
cactctccctgcctgtgaagcgg

SEQ ID NO: 163142 - DNA, 23 bp, Homo sapiens
taagtctcacccactcagtttag

SEQ ID NO: 163143 - DNA, 23 bp, Homo sapiens
tcagctagagtaggagttccttt

SEQ ID NO: 163144 - DNA, 22 bp, Homo sapiens
agacagggtctctctctgttac

SEQ ID NO: 163145 - DNA, 23 bp, Homo sapiens
tacagtgatcacacaagctgatg

SEQ ID NO: 163146 - DNA, 23 bp, Homo sapiens
atgtatcaatgtgttgatcaatg

SEQ ID NO: 163147 - DNA, 23 bp, Homo sapiens
gagtctcactctgtcacccaggc

SEQ ID NO: 163148 - DNA, 22 bp, Homo sapiens
acatgtgcacaatgtgcaggtt

SEQ ID NO: 163149 - DNA, 23 bp, Homo sapiens
tacatgtgcacaatgtgcaggtt

SEQ ID NO: 163150 - DNA, 23 bp, Homo sapiens
ttctcacagtctttaggcctctg

SEQ ID NO: 163151 - DNA, 23 bp, Homo sapiens
tctgtgcctgactctctgggatg

SEQ ID NO: 163152 - DNA, 18 bp, Homo sapiens
tcggctcactacaacctc

SEQ ID NO: 163153 - DNA, 23 bp, Homo sapiens
agtctgtctgtctgacaaggaac

SEQ ID NO: 163154 - DNA, 23 bp, Homo sapiens
tgtgtgtctcagtgtctgcctgc

SEQ ID NO: 163155 - DNA, 23 bp, Homo sapiens
gccagagaaaacagagtctgcac

SEQ ID NO: 163156 - DNA, 19 bp, Homo sapiens
atgtatgtgtgataaactt

SEQ ID NO: 163157 - DNA, 23 bp, Homo sapiens
agagtctcactctgtcacccagg

SEQ ID NO: 163158 - DNA, 23 bp, Homo sapiens
taggcacaggtagaagtttctgg

SEQ ID NO: 163159 - DNA, 23 bp, Homo sapiens
tgagttcattgtagattctggat

SEQ ID NO: 163160 - DNA, 23 bp, Homo sapiens
tgagttcattgtagattctggat

SEQ ID NO: 163161 - DNA, 19 bp, Homo sapiens
aagagactgaagagactgg

SEQ ID NO: 163162 - DNA, 23 bp, Homo sapiens
agtttagaggctgcagtgagcta

SEQ ID NO: 163163 - DNA, 19 bp, Homo sapiens
tgctggtctgagacgggca

SEQ ID NO: 163164 - DNA, 23 bp, Homo sapiens
ccctccctgtctctctggctctc

SEQ ID NO: 163165 - DNA, 21 bp, Homo sapiens
ctgtggctgtgacagacaccc

SEQ ID NO: 163166 - DNA, 20 bp, Homo sapiens
tcacctgtgcgtgcacacag

SEQ ID NO: 163167 - DNA, 23 bp, Homo sapiens
tatttgtctctctatatcctctg

SEQ ID NO: 163168 - DNA, 23 bp, Homo sapiens
ttatgctacttttgtacagcaat

SEQ ID NO: 163169 - DNA, 23 bp, Homo sapiens
ctcactatctctctgactttatc

SEQ ID NO: 163170 - DNA, 19 bp, Homo sapiens
agacatgtgcgacttttgt

SEQ ID NO: 163171 - DNA, 23 bp, Homo sapiens
ttagagacagggtctcactgtgt

SEQ ID NO: 163172 - DNA, 23 bp, Homo sapiens
tgagttcattgtagattctggat

SEQ ID NO: 163173 - DNA, 23 bp, Homo sapiens
tgagttcattgtagattctggat

SEQ ID NO: 163174 - DNA, 23 bp, Homo sapiens
actagtgacaggcagagaagggg

SEQ ID NO: 163175 - DNA, 22 bp, Homo sapiens
tgcagttctctgcagtttggtt

SEQ ID NO: 163176 - DNA, 22 bp, Homo sapiens
tagcatgtgtatatgtaagtat

SEQ ID NO: 163177 - DNA, 23 bp, Homo sapiens
tgatttctagtgaagctgaacat

SEQ ID NO: 163178 - DNA, 23 bp, Homo sapiens
aattatgttgatgttcttagctt

SEQ ID NO: 163179 - DNA, 23 bp, Homo sapiens
caggctgtctgtctgtctgtcta

SEQ ID NO: 163180 - DNA, 23 bp, Homo sapiens
ccctcagactgagtggtttgcag

SEQ ID NO: 163181 - DNA, 23 bp, Homo sapiens
ttgttgagcagtatttatgcttt

SEQ ID NO: 163182 - DNA, 23 bp, Homo sapiens
agaactctgtctggtaatgaggc

SEQ ID NO: 163183 - DNA, 20 bp, Homo sapiens
gtcgggcactgtggctcact

SEQ ID NO: 163184 - DNA, 20 bp, Homo sapiens
attggtagaacaaggataaa

SEQ ID NO: 163185 - DNA, 22 bp, Homo sapiens
gggtctctctctgagtggctgg

SEQ ID NO: 163186 - DNA, 18 bp, Homo sapiens
gcaccggctcatttctga

SEQ ID NO: 163187 - DNA, 23 bp, Homo sapiens
aatgcatggaattgtgtatttgc

SEQ ID NO: 163188 - DNA, 23 bp, Homo sapiens
gaaatagcactttctccatgttg

SEQ ID NO: 163189 - DNA, 21 bp, Homo sapiens
atatatgtacatatacgtacg

SEQ ID NO: 163190 - DNA, 23 bp, Homo sapiens
tatgtatgtatatgtacatgtat

SEQ ID NO: 163191 - DNA, 23 bp, Homo sapiens
tctgtctatctctctgtatactt

SEQ ID NO: 163192 - DNA, 23 bp, Homo sapiens
tcactgtttttctctgtcaccat

SEQ ID NO: 163193 - DNA, 23 bp, Homo sapiens
aattgtgtagtgaaaactgtgta

SEQ ID NO: 163194 - DNA, 23 bp, Homo sapiens
tggagtctcactctgtcacccag

SEQ ID NO: 163195 - DNA, 22 bp, Homo sapiens
atctttgcttttcttggtatga

SEQ ID NO: 163196 - DNA, 23 bp, Homo sapiens
tatttattgatatgagtctggag

SEQ ID NO: 163197 - DNA, 23 bp, Homo sapiens
aatggaagacataagtcatagtg

SEQ ID NO: 163198 - DNA, 19 bp, Homo sapiens
atcactttgaaagttcaag

SEQ ID NO: 163199 - DNA, 23 bp, Homo sapiens
ccgagtctcactctgtcacccag

SEQ ID NO: 163200 - DNA, 23 bp, Homo sapiens
ttagactggatctttattgagtt

SEQ ID NO: 163201 - DNA, 21 bp, Homo sapiens
aaatgcaagtaatttcttttt

SEQ ID NO: 163202 - DNA, 23 bp, Homo sapiens
gacagagtctcgctctgtcaccc

SEQ ID NO: 163203 - DNA, 23 bp, Homo sapiens
acagagtctcgctctgtcaccca

SEQ ID NO: 163204 - DNA, 23 bp, Homo sapiens
atgtgtatatatgtatatgtgtg

SEQ ID NO: 163205 - DNA, 23 bp, Homo sapiens
tatttgagaggtggttttggacc

SEQ ID NO: 163206 - DNA, 23 bp, Homo sapiens
tctagacacacaatctgcatgac

SEQ ID NO: 163207 - DNA, 23 bp, Homo sapiens
tatacaactggatgaactagata

SEQ ID NO: 163208 - DNA, 23 bp, Homo sapiens
gtatgtatatatgtatatgtgtg

SEQ ID NO: 163209 - DNA, 22 bp, Homo sapiens
atatatgtatatgtatgtatat

SEQ ID NO: 163210 - DNA, 23 bp, Homo sapiens
ggagtctcactctgtcacccagg

SEQ ID NO: 163211 - DNA, 23 bp, Homo sapiens
cctgtgcctcagtccctccctct

SEQ ID NO: 163212 - DNA, 18 bp, Homo sapiens
aggtatatatttttatgt

SEQ ID NO: 163213 - DNA, 19 bp, Homo sapiens
cttaccttccagctctctg

SEQ ID NO: 163214 - DNA, 23 bp, Homo sapiens
tggcttcattttcctaggtctaa

SEQ ID NO: 163215 - DNA, 23 bp, Homo sapiens
attgacactgctttacttttgtc

SEQ ID NO: 163216 - DNA, 23 bp, Homo sapiens
tctgtctggatatctaggtgttt

SEQ ID NO: 163217 - DNA, 21 bp, Homo sapiens
tacatcctctgaaatctaggc

SEQ ID NO: 163218 - DNA, 19 bp, Homo sapiens
agagtctctatctcactga

SEQ ID NO: 163219 - DNA, 21 bp, Homo sapiens
tttgagagggagtctcactct

SEQ ID NO: 163220 - DNA, 21 bp, Homo sapiens
tgtgatcatgagggtacaggg

SEQ ID NO: 163221 - DNA, 23 bp, Homo sapiens
atctgagtctatttgtctctctt

SEQ ID NO: 163222 - DNA, 23 bp, Homo sapiens
tccaatagacatgagagtgcaga

SEQ ID NO: 163223 - DNA, 20 bp, Homo sapiens
tgggatactgatagtttttt

SEQ ID NO: 163224 - DNA, 23 bp, Homo sapiens
tccataattgatatgatattaca

SEQ ID NO: 163225 - DNA, 23 bp, Homo sapiens
tgagtcagagtctcgctctgtcg

SEQ ID NO: 163226 - DNA, 23 bp, Homo sapiens
atatatatcagctgtgtgtgtgt

SEQ ID NO: 163227 - DNA, 19 bp, Homo sapiens
gagaataaattgagccctg

SEQ ID NO: 163228 - DNA, 23 bp, Homo sapiens
tgagatgtagttgaaagctaaat

SEQ ID NO: 163229 - DNA, 23 bp, Homo sapiens
tgagttcattgtagattctggat

SEQ ID NO: 163230 - DNA, 23 bp, Homo sapiens
tgagttcattgtagattctggat

SEQ ID NO: 163231 - DNA, 23 bp, Homo sapiens
taagtagagcatgttcaagtgaa

SEQ ID NO: 163232 - DNA, 23 bp, Homo sapiens
acacacacattcacatatatgga

SEQ ID NO: 163233 - DNA, 23 bp, Homo sapiens
atatatgtatatatatatgtgta

SEQ ID NO: 163234 - DNA, 21 bp, Homo sapiens
atatatgtatatatatatgtg

SEQ ID NO: 163235 - DNA, 20 bp, Homo sapiens
aatttctgtgtttattttga

SEQ ID NO: 163236 - DNA, 23 bp, Homo sapiens
tatctatctatatctgtatctat

SEQ ID NO: 163237 - DNA, 23 bp, Homo sapiens
tgagttcattgtagattctggat

SEQ ID NO: 163238 - DNA, 23 bp, Homo sapiens
tgagttcattgtagattctggat

SEQ ID NO: 163239 - DNA, 23 bp, Homo sapiens
cctatgatctataaatatggtgt

SEQ ID NO: 163240 - DNA, 23 bp, Homo sapiens
atatgatctataaatatggtgta

SEQ ID NO: 163241 - DNA, 23 bp, Homo sapiens
gaagacagccagctatgaagaag

SEQ ID NO: 163242 - DNA, 23 bp, Homo sapiens
tgagttcattgtagattctggat

SEQ ID NO: 163243 - DNA, 23 bp, Homo sapiens
tgagttcattgtagattctggat

SEQ ID NO: 163244 - DNA, 18 bp, Homo sapiens
tcccatatatatgtgtgt

SEQ ID NO: 163245 - DNA, 23 bp, Homo sapiens
agacaaggtctcactctgtcacc

SEQ ID NO: 163246 - DNA, 23 bp, Homo sapiens
tgactctgtgtcatacaggatat

SEQ ID NO: 163247 - DNA, 20 bp, Homo sapiens
tctccttcctttcagaaatg

SEQ ID NO: 163248 - DNA, 23 bp, Homo sapiens
agtttctagtagaagattcttta

SEQ ID NO: 163249 - DNA, 23 bp, Homo sapiens
atgagaataatttgaggagattt

SEQ ID NO: 163250 - DNA, 21 bp, Homo sapiens
gagactacatagaaactgatg

SEQ ID NO: 163251 - DNA, 23 bp, Homo sapiens
ttttatgtttcttaaaataggta

SEQ ID NO: 163252 - DNA, 23 bp, Homo sapiens
tgtgtgtatatatatgtgtgtgt

SEQ ID NO: 163253 - DNA, 22 bp, Homo sapiens
aaggatgctaatgatactgaac

SEQ ID NO: 163254 - DNA, 22 bp, Homo sapiens
ttaaagctcaattagtagttgt

SEQ ID NO: 163255 - DNA, 23 bp, Homo sapiens
gacagtctccctctgtcacccag

SEQ ID NO: 163256 - DNA, 23 bp, Homo sapiens
aagttgagcatattttcatatgt

SEQ ID NO: 163257 - DNA, 23 bp, Homo sapiens
agaattgtctgttcatgtcctta

SEQ ID NO: 163258 - DNA, 21 bp, Homo sapiens
atgtatgtgtgtatgtgtatg

SEQ ID NO: 163259 - DNA, 23 bp, Homo sapiens
tatatgtgcatatatatatatgt

SEQ ID NO: 163260 - DNA, 23 bp, Homo sapiens
tgcttgtttaaaatgctgattct

SEQ ID NO: 163261 - DNA, 23 bp, Homo sapiens
tgtaatgatgatgaaaatgatgt

SEQ ID NO: 163262 - DNA, 22 bp, Homo sapiens
aagaaaaagagcctcaatttat

SEQ ID NO: 163263 - DNA, 20 bp, Homo sapiens
aagtgctttatttttgagga

SEQ ID NO: 163264 - DNA, 22 bp, Homo sapiens
attgtatatatgtatgtataca

SEQ ID NO: 163265 - DNA, 23 bp, Homo sapiens
tatacacaatatgtatatatgta

SEQ ID NO: 163266 - DNA, 19 bp, Homo sapiens
agtagaggtgtatagatat

SEQ ID NO: 163267 - DNA, 23 bp, Homo sapiens
aattcagattatgaacatcaggt

SEQ ID NO: 163268 - DNA, 20 bp, Homo sapiens
atgtgtgtatatatgtatac

SEQ ID NO: 163269 - DNA, 23 bp, Homo sapiens
atgcatacatatacaaatgtgta

SEQ ID NO: 163270 - DNA, 23 bp, Homo sapiens
tatgtatatatgtatgtatatgt

SEQ ID NO: 163271 - DNA, 23 bp, Homo sapiens
tgttttgcactttttcttgtaag

SEQ ID NO: 163272 - DNA, 23 bp, Homo sapiens
tttatgaggagaatgccagtgac

SEQ ID NO: 163273 - DNA, 23 bp, Homo sapiens
tcagtcagaacagagtgtgctgt

SEQ ID NO: 163274 - DNA, 21 bp, Homo sapiens
tatgccatatttttcaattca

SEQ ID NO: 163275 - DNA, 19 bp, Homo sapiens
tgtatgtatgtatttttct

SEQ ID NO: 163276 - DNA, 23 bp, Homo sapiens
gtcagagtctcactctgtcgccc

SEQ ID NO: 163277 - DNA, 22 bp, Homo sapiens
tgagttctgaatctgtcagggg

SEQ ID NO: 163278 - DNA, 23 bp, Homo sapiens
tcattgtggttttgatttgcatg

SEQ ID NO: 163279 - DNA, 23 bp, Homo sapiens
aaactttgctgaatttgtttatc

SEQ ID NO: 163280 - DNA, 23 bp, Homo sapiens
tgaccttgcctgtctttttccct

SEQ ID NO: 163281 - DNA, 23 bp, Homo sapiens
taactgaatatatatgtatgtgt

SEQ ID NO: 163282 - DNA, 21 bp, Homo sapiens
atatgttatatatcataagtt

SEQ ID NO: 163283 - DNA, 22 bp, Homo sapiens
caatatgttatatatcgtatgt

SEQ ID NO: 163284 - DNA, 21 bp, Homo sapiens
atatattgtatgttatatagt

SEQ ID NO: 163285 - DNA, 23 bp, Homo sapiens
aatatgttatatatcatatgtta

SEQ ID NO: 163286 - DNA, 23 bp, Homo sapiens
tgagttcattgtagattctggat

SEQ ID NO: 163287 - DNA, 23 bp, Homo sapiens
tgagttcattgtagattctggat

SEQ ID NO: 163288 - DNA, 23 bp, Homo sapiens
tggagtgacagtatgagtaatac

SEQ ID NO: 163289 - DNA, 22 bp, Homo sapiens
tggacagtcaggagtctacagt

SEQ ID NO: 163290 - DNA, 21 bp, Homo sapiens
ttgagtgaactgattgagcag

SEQ ID NO: 163291 - DNA, 21 bp, Homo sapiens
gaagtcttgtgatttttatca

SEQ ID NO: 163292 - DNA, 23 bp, Homo sapiens
tctcagtgtggctgactcagaat

SEQ ID NO: 163293 - DNA, 23 bp, Homo sapiens
cttatttcttcttgagtcagcgt

SEQ ID NO: 163294 - DNA, 23 bp, Homo sapiens
tttgaattgtcatgctaaacagg

SEQ ID NO: 163295 - DNA, 21 bp, Homo sapiens
tggcctgttttcttgtattcc

SEQ ID NO: 163296 - DNA, 18 bp, Homo sapiens
attttgttatagttcatg

SEQ ID NO: 163297 - DNA, 21 bp, Homo sapiens
cctgaaaagagaatttgttct

SEQ ID NO: 163298 - DNA, 23 bp, Homo sapiens
ttcagcatactaattgtattctt

SEQ ID NO: 163299 - DNA, 23 bp, Homo sapiens
tgtgtatatatgatgtatatata

SEQ ID NO: 163300 - DNA, 23 bp, Homo sapiens
tgaagacagagtttctgtctgtg

SEQ ID NO: 163301 - DNA, 23 bp, Homo sapiens
tatgtgtatatatatatgtgtgt

SEQ ID NO: 163302 - DNA, 23 bp, Homo sapiens
cacacacacacatttatatgtgt

SEQ ID NO: 163303 - DNA, 23 bp, Homo sapiens
tgagttcattgtagattctggat

SEQ ID NO: 163304 - DNA, 23 bp, Homo sapiens
tgagttcattgtagattctggat

SEQ ID NO: 163305 - DNA, 23 bp, Homo sapiens
agagacagagcaagcaagtgtgc

SEQ ID NO: 163306 - DNA, 23 bp, Homo sapiens
tgtgtgtatatatatgtgtgtgt

SEQ ID NO: 163307 - DNA, 23 bp, Homo sapiens
atgtgtgtatatatatgtgtgta

SEQ ID NO: 163308 - DNA, 23 bp, Homo sapiens
tgagctaatatatatatgtgtgt

SEQ ID NO: 163309 - DNA, 23 bp, Homo sapiens
gtaagataatgaatgcttttcat

SEQ ID NO: 163310 - DNA, 18 bp, Homo sapiens
cacacacatacatatatg

SEQ ID NO: 163311 - DNA, 23 bp, Homo sapiens
tatgtgtatatatatatgtgtgt

SEQ ID NO: 163312 - DNA, 23 bp, Homo sapiens
tgagttcattgtagattctggat

SEQ ID NO: 163313 - DNA, 23 bp, Homo sapiens
tgagttcattgtagattctggat

SEQ ID NO: 163314 - DNA, 23 bp, Homo sapiens
gaaacaactttggaaatcagtct

SEQ ID NO: 163315 - DNA, 21 bp, Homo sapiens
tcgtttgtgttgatttgcttg

SEQ ID NO: 163316 - DNA, 23 bp, Homo sapiens
gaactgattagtagttatggcaa

SEQ ID NO: 163317 - DNA, 23 bp, Homo sapiens
tctaattatcagtttgatgttgt

SEQ ID NO: 163318 - DNA, 18 bp, Homo sapiens
agagaagtgagtatgtag

SEQ ID NO: 163319 - DNA, 21 bp, Homo sapiens
atgtgtatatatatatgtgtg

SEQ ID NO: 163320 - DNA, 18 bp, Homo sapiens
agggggagtttattgagt

SEQ ID NO: 163321 - DNA, 23 bp, Homo sapiens
atgtgtgtgtatgtatgtatata

SEQ ID NO: 163322 - DNA, 21 bp, Homo sapiens
tatgtgcatctatatacatat

SEQ ID NO: 163323 - DNA, 22 bp, Homo sapiens
tgtatatacacacacataaaca

SEQ ID NO: 163324 - DNA, 20 bp, Homo sapiens
ttttcagcagtttatcatat

SEQ ID NO: 163325 - DNA, 23 bp, Homo sapiens
tcatactgagaatttgttgagct

SEQ ID NO: 163326 - DNA, 23 bp, Homo sapiens
ttttggagacacagcaaaaagta

SEQ ID NO: 163327 - DNA, 23 bp, Homo sapiens
aaagtgaaaccttgttgagagag

SEQ ID NO: 163328 - DNA, 21 bp, Homo sapiens
agggagtctcgctctgttgcc

SEQ ID NO: 163329 - DNA, 19 bp, Homo sapiens
tataatgtatacatgcata

SEQ ID NO: 163330 - DNA, 23 bp, Homo sapiens
taaacatatgtatagaaatgtat

SEQ ID NO: 163331 - DNA, 23 bp, Homo sapiens
tatatgcatgtatatgtatggat

SEQ ID NO: 163332 - DNA, 23 bp, Homo sapiens
tataatgcatagatatcatgtgt

SEQ ID NO: 163333 - DNA, 21 bp, Homo sapiens
tatctgtgtatgtatatgtgt

SEQ ID NO: 163334 - DNA, 23 bp, Homo sapiens
tgagttcattgtagattctggat

SEQ ID NO: 163335 - DNA, 23 bp, Homo sapiens
tgagttcattgtagattctggat

SEQ ID NO: 163336 - DNA, 23 bp, Homo sapiens
tgagttcattgtagattctggat

SEQ ID NO: 163337 - DNA, 23 bp, Homo sapiens
tgagttcattgtagattctggat

SEQ ID NO: 163338 - DNA, 23 bp, Homo sapiens
tgactggtagtgatttgctcttc

SEQ ID NO: 163339 - DNA, 23 bp, Homo sapiens
tgcatgtgtgaactctgtggggt

SEQ ID NO: 163340 - DNA, 22 bp, Homo sapiens
tgagttctgtgtgtgtgtctgt

SEQ ID NO: 163341 - DNA, 23 bp, Homo sapiens
agggtctctcactggctgtatcc

SEQ ID NO: 163342 - DNA, 22 bp, Homo sapiens
aagcagagaagtgacatgaagg

SEQ ID NO: 163343 - DNA, 20 bp, Homo sapiens
tcgtatattaaaccagactg

SEQ ID NO: 163344 - DNA, 22 bp, Homo sapiens
tgcctgaacatcctaacgtgtg

SEQ ID NO: 163345 - DNA, 18 bp, Homo sapiens
gtttgtatgtatgtgtgt

SEQ ID NO: 163346 - DNA, 23 bp, Homo sapiens
tgagatggagtctcactctgtcg

SEQ ID NO: 163347 - DNA, 23 bp, Homo sapiens
tctgtgtccctgtctctcagcct

SEQ ID NO: 163348 - DNA, 20 bp, Homo sapiens
actgtctcattctgactgct

SEQ ID NO: 163349 - DNA, 22 bp, Homo sapiens
tggacacagaggacagtcagga

SEQ ID NO: 163350 - DNA, 23 bp, Homo sapiens
tgagttcattgtagattctggat

SEQ ID NO: 163351 - DNA, 23 bp, Homo sapiens
tgagttcattgtagattctggat

SEQ ID NO: 163352 - DNA, 23 bp, Homo sapiens
tgagttcattgtagattctggat

SEQ ID NO: 163353 - DNA, 23 bp, Homo sapiens
tgagttcattgtagattctggat

SEQ ID NO: 163354 - DNA, 23 bp, Homo sapiens
agaatgcgactggaattgcactg

SEQ ID NO: 163355 - DNA, 21 bp, Homo sapiens
agacaaggtctatccctgttg

SEQ ID NO: 163356 - DNA, 23 bp, Homo sapiens
taagactgtgtgtccctaagtac

SEQ ID NO: 163357 - DNA, 21 bp, Homo sapiens
tggaaggatcacttgtggcca

SEQ ID NO: 163358 - DNA, 22 bp, Homo sapiens
acttgtacaacaggtaagcaca

SEQ ID NO: 163359 - DNA, 18 bp, Homo sapiens
ttactataagttttaggg

SEQ ID NO: 163360 - DNA, 21 bp, Homo sapiens
acatgtgcacaatgtgcaggt

SEQ ID NO: 163361 - DNA, 23 bp, Homo sapiens
ctcacactggctattatctttgt

SEQ ID NO: 163362 - DNA, 21 bp, Homo sapiens
ttggctgttcatgtcctttgc

SEQ ID NO: 163363 - DNA, 23 bp, Homo sapiens
agagtctcactctgtcacccagg

SEQ ID NO: 163364 - DNA, 23 bp, Homo sapiens
acagagtctcactctgtcgccca

SEQ ID NO: 163365 - DNA, 20 bp, Homo sapiens
tctcagaagagtgtgggcac

SEQ ID NO: 163366 - DNA, 22 bp, Homo sapiens
tcgtgtcttgtgttgcagccgg

SEQ ID NO: 163367 - DNA, 23 bp, Homo sapiens
cggagtctcgctctgtcgctcag

SEQ ID NO: 163368 - DNA, 23 bp, Homo sapiens
gagtctcacactgtcaccgaggc

SEQ ID NO: 163369 - DNA, 22 bp, Homo sapiens
tttagctctctgtctctagtca

SEQ ID NO: 163370 - DNA, 22 bp, Homo sapiens
tatatgactagagagtatgatg

SEQ ID NO: 163371 - DNA, 23 bp, Homo sapiens
tctgagtctcactctgtcaccca

SEQ ID NO: 163372 - DNA, 22 bp, Homo sapiens
tatatacaacctattgtagtct

SEQ ID NO: 163373 - DNA, 21 bp, Homo sapiens
aatcttaattcacttggggag

SEQ ID NO: 163374 - DNA, 23 bp, Homo sapiens
tgaaagtccatgatgtggtgcta

SEQ ID NO: 163375 - DNA, 20 bp, Homo sapiens
aacatgtatgtattaatgta

SEQ ID NO: 163376 - DNA, 21 bp, Homo sapiens
aaactcaggcttagagaagtg

SEQ ID NO: 163377 - DNA, 20 bp, Homo sapiens
taaggacttatttttgttga

SEQ ID NO: 163378 - DNA, 22 bp, Homo sapiens
tctccaattcaaagctgtttga

SEQ ID NO: 163379 - DNA, 23 bp, Homo sapiens
cacacacacatatgttgtatatg

SEQ ID NO: 163380 - DNA, 18 bp, Homo sapiens
tatgtgtgtgtgtgtaca

SEQ ID NO: 163381 - DNA, 22 bp, Homo sapiens
aaacagagtagagtgagagctg

SEQ ID NO: 163382 - DNA, 23 bp, Homo sapiens
tgagatggagtctcactctgtcg

SEQ ID NO: 163383 - DNA, 22 bp, Homo sapiens
ttatgcatgtttacatatatgt

SEQ ID NO: 163384 - DNA, 23 bp, Homo sapiens
ttgttgaggtaattatttgatgt

SEQ ID NO: 163385 - DNA, 21 bp, Homo sapiens
tatatctatatatatactgta

SEQ ID NO: 163386 - DNA, 23 bp, Homo sapiens
tggagtctcactctgtcacccag

SEQ ID NO: 163387 - DNA, 21 bp, Homo sapiens
atgacaaatactgaaggtgag

SEQ ID NO: 163388 - DNA, 19 bp, Homo sapiens
tgtgtgtgtgtgtgtgtat

SEQ ID NO: 163389 - DNA, 22 bp, Homo sapiens
tatcaggtacttgactttttag

SEQ ID NO: 163390 - DNA, 19 bp, Homo sapiens
tttgagagggaggattagg

SEQ ID NO: 163391 - DNA, 23 bp, Homo sapiens
ctgactcactcactcacaattga

SEQ ID NO: 163392 - DNA, 23 bp, Homo sapiens
ggctgagtctcgctctgtcaccc

SEQ ID NO: 163393 - DNA, 23 bp, Homo sapiens
tggaagcacattttgaagaggga

SEQ ID NO: 163394 - DNA, 21 bp, Homo sapiens
tgctattgtttgaacagagag

SEQ ID NO: 163395 - DNA, 21 bp, Homo sapiens
tcaatgcattttcattgaact

SEQ ID NO: 163396 - DNA, 23 bp, Homo sapiens
tacaagtcaaatgaatttgatga

SEQ ID NO: 163397 - DNA, 23 bp, Homo sapiens
atatatgtgtgcttgtgtgtgta

SEQ ID NO: 163398 - DNA, 23 bp, Homo sapiens
aggtgtgtatgtatatatgtgtg

SEQ ID NO: 163399 - DNA, 23 bp, Homo sapiens
atcagtgcaatgttgtatgctat

SEQ ID NO: 163400 - DNA, 23 bp, Homo sapiens
gttcttgaatgaatggatgaatg

SEQ ID NO: 163401 - DNA, 22 bp, Homo sapiens
gtcatgacagcaattcttcatt

SEQ ID NO: 163402 - DNA, 23 bp, Homo sapiens
gagaagggttgaagttgttctga

SEQ ID NO: 163403 - DNA, 23 bp, Homo sapiens
ggttcactgtctctctgagagct

SEQ ID NO: 163404 - DNA, 23 bp, Homo sapiens
atgattggagaagactccctgtg

SEQ ID NO: 163405 - DNA, 23 bp, Homo sapiens
gctctctcaccgtctctaagcct

SEQ ID NO: 163406 - DNA, 23 bp, Homo sapiens
aatatatggatttctatatgtat

SEQ ID NO: 163407 - DNA, 23 bp, Homo sapiens
acagtgtctcactctgtcatcca

SEQ ID NO: 163408 - DNA, 20 bp, Homo sapiens
agggagtggaaatattgagg

SEQ ID NO: 163409 - DNA, 23 bp, Homo sapiens
tcattccagcttctcaatgtgga

SEQ ID NO: 163410 - DNA, 20 bp, Homo sapiens
tttgtgaagattcagtgcac

SEQ ID NO: 163411 - DNA, 23 bp, Homo sapiens
ttgtgtgtattcatttggatgac

SEQ ID NO: 163412 - DNA, 23 bp, Homo sapiens
tcccagagcccctggaactctgg

SEQ ID NO: 163413 - DNA, 23 bp, Homo sapiens
tctgtccctgtctgttggctgcg

SEQ ID NO: 163414 - DNA, 23 bp, Homo sapiens
agagaacagacagaccacaggat

SEQ ID NO: 163415 - DNA, 18 bp, Homo sapiens
agacatagtatcactctg

SEQ ID NO: 163416 - DNA, 23 bp, Homo sapiens
acagagtctcgcactgtcaccca

SEQ ID NO: 163417 - DNA, 20 bp, Homo sapiens
agagaagagagtctgcagag

SEQ ID NO: 163418 - DNA, 23 bp, Homo sapiens
agtaatttttagttcctcatttg

SEQ ID NO: 163419 - DNA, 23 bp, Homo sapiens
cactctgtgagatttcctgggag

SEQ ID NO: 163420 - DNA, 18 bp, Homo sapiens
acaactatgactaccaca

SEQ ID NO: 163421 - DNA, 23 bp, Homo sapiens
tgtaaagtgaatttcttgtagac

SEQ ID NO: 163422 - DNA, 20 bp, Homo sapiens
tatactctgtgtgtgtatat

SEQ ID NO: 163423 - DNA, 23 bp, Homo sapiens
aagttcctagacaggattttttg

SEQ ID NO: 163424 - DNA, 21 bp, Homo sapiens
actgtgtatatatatatgtgt

SEQ ID NO: 163425 - DNA, 21 bp, Homo sapiens
actgtgtatatatataagtgt

SEQ ID NO: 163426 - DNA, 22 bp, Homo sapiens
actgtgtatatatatatatgtg

SEQ ID NO: 163427 - DNA, 23 bp, Homo sapiens
acactgtgtatatatatatgtgt

SEQ ID NO: 163428 - DNA, 23 bp, Homo sapiens
aatgtgtatatatatatgtgtgt

SEQ ID NO: 163429 - DNA, 22 bp, Homo sapiens
tatggaagttgcttgtttagtt

SEQ ID NO: 163430 - DNA, 23 bp, Homo sapiens
tgtcaacttttagttaacttatt

SEQ ID NO: 163431 - DNA, 20 bp, Homo sapiens
aatatctgtcccatatttgg

SEQ ID NO: 163432 - DNA, 21 bp, Homo sapiens
agaggtatatatattgtgtgt

SEQ ID NO: 163433 - DNA, 22 bp, Homo sapiens
tgtttcacacacaatatatatg

SEQ ID NO: 163434 - DNA, 23 bp, Homo sapiens
aataatctggttatatttttgag

SEQ ID NO: 163435 - DNA, 21 bp, Homo sapiens
atttgcatatgtgtatatgtt

SEQ ID NO: 163436 - DNA, 20 bp, Homo sapiens
tatgtgtatatactgcatgt

SEQ ID NO: 163437 - DNA, 19 bp, Homo sapiens
tatgcatatatacatatat

SEQ ID NO: 163438 - DNA, 23 bp, Homo sapiens
atatgaatgtatgtataactgtg

SEQ ID NO: 163439 - DNA, 21 bp, Homo sapiens
tatatatgtgtatgtatatct

SEQ ID NO: 163440 - DNA, 23 bp, Homo sapiens
tcatgtcattttgttgttcactg

SEQ ID NO: 163441 - DNA, 22 bp, Homo sapiens
tattagaaagtggtaatgaaca

SEQ ID NO: 163442 - DNA, 22 bp, Homo sapiens
gacggagtctctcgctctgtcg

SEQ ID NO: 163443 - DNA, 23 bp, Homo sapiens
ttttggctgcaatagtatttgaa

SEQ ID NO: 163444 - DNA, 22 bp, Homo sapiens
tattttgagcatgaaaatgata

SEQ ID NO: 163445 - DNA, 20 bp, Homo sapiens
atatgtgtatatgtatatat

SEQ ID NO: 163446 - DNA, 20 bp, Homo sapiens
atatgtgtgtatatatatgt

SEQ ID NO: 163447 - DNA, 23 bp, Homo sapiens
tggagtctcactctgtcacccag

SEQ ID NO: 163448 - DNA, 23 bp, Homo sapiens
tctctcactgtcataattgtctc

SEQ ID NO: 163449 - DNA, 20 bp, Homo sapiens
atatgtatacatacatacac

SEQ ID NO: 163450 - DNA, 23 bp, Homo sapiens
ctctgtgattctgtctctataat

SEQ ID NO: 163451 - DNA, 21 bp, Homo sapiens
atatatgtatatatatgtgtg

SEQ ID NO: 163452 - DNA, 23 bp, Homo sapiens
taagtatctagtaagcatctagt

SEQ ID NO: 163453 - DNA, 23 bp, Homo sapiens
tctgtctggttgttgtttctatt

SEQ ID NO: 163454 - DNA, 23 bp, Homo sapiens
tgagagggagtctcactctgtcg

SEQ ID NO: 163455 - DNA, 21 bp, Homo sapiens
taaaggagtttttatatatgt

SEQ ID NO: 163456 - DNA, 22 bp, Homo sapiens
atctgcattataagctgtatga

SEQ ID NO: 163457 - DNA, 23 bp, Homo sapiens
gtgtgtctgtgtctctgtatgca

SEQ ID NO: 163458 - DNA, 22 bp, Homo sapiens
agttgaggtctgtggttctgta

SEQ ID NO: 163459 - DNA, 19 bp, Homo sapiens
cacgtatttatatatgtgt

SEQ ID NO: 163460 - DNA, 23 bp, Homo sapiens
ttctgcattccaggttttgaact

SEQ ID NO: 163461 - DNA, 23 bp, Homo sapiens
agtcaagtttatggaagtagaat

SEQ ID NO: 163462 - DNA, 23 bp, Homo sapiens
tttgctccttttgaaatctgttt

SEQ ID NO: 163463 - DNA, 23 bp, Homo sapiens
tgagttcattgtagattctggat

SEQ ID NO: 163464 - DNA, 23 bp, Homo sapiens
tgagttcattgtagattctggat

SEQ ID NO: 163465 - DNA, 23 bp, Homo sapiens
tgagttcattgtagattctggat

SEQ ID NO: 163466 - DNA, 23 bp, Homo sapiens
tgagttcattgtagattctggat

SEQ ID NO: 163467 - DNA, 22 bp, Homo sapiens
gtgtgtatgtatgtatctgtct

SEQ ID NO: 163468 - DNA, 23 bp, Homo sapiens
tgagttcattgtagattctggat

SEQ ID NO: 163469 - DNA, 23 bp, Homo sapiens
tgagttcattgtagattctggat

SEQ ID NO: 163470 - DNA, 23 bp, Homo sapiens
tctctctctatatatatatgtgt

SEQ ID NO: 163471 - DNA, 23 bp, Homo sapiens
tatgtgatgtactctaagcattt

SEQ ID NO: 163472 - DNA, 23 bp, Homo sapiens
tttgcttcttgactgcatgacta

SEQ ID NO: 163473 - DNA, 20 bp, Homo sapiens
tatagttcaaagcagaatct

SEQ ID NO: 163474 - DNA, 23 bp, Homo sapiens
ttttgctcatgggaatgttctct

SEQ ID NO: 163475 - DNA, 23 bp, Homo sapiens
tccctgacctaatgaaagcaaat

SEQ ID NO: 163476 - DNA, 22 bp, Homo sapiens
tgctcatgggaatgttctctgc

SEQ ID NO: 163477 - DNA, 23 bp, Homo sapiens
tccctgacctaatgaaagcaaat

SEQ ID NO: 163478 - DNA, 18 bp, Homo sapiens
tggttaaaaattgtgtat

SEQ ID NO: 163479 - DNA, 21 bp, Homo sapiens
accatgtagtctcagctacct

SEQ ID NO: 163480 - DNA, 20 bp, Homo sapiens
aagtcagaggattgcttgag

SEQ ID NO: 163481 - DNA, 21 bp, Homo sapiens
ttttttctttttgtgatggag

SEQ ID NO: 163482 - DNA, 23 bp, Homo sapiens
aataaagaagttcatggtgagtt

SEQ ID NO: 163483 - DNA, 22 bp, Homo sapiens
ttttactagatgctagaggatg

SEQ ID NO: 163484 - DNA, 18 bp, Homo sapiens
agaaagatacatgtatat

SEQ ID NO: 163485 - DNA, 23 bp, Homo sapiens
caccactacatccagatactttt

SEQ ID NO: 163486 - DNA, 18 bp, Homo sapiens
cacacagttttggatgtc

SEQ ID NO: 163487 - DNA, 23 bp, Homo sapiens
acatgtgtttttgaagctgttga

SEQ ID NO: 163488 - DNA, 23 bp, Homo sapiens
atatatatgtgtatgtgtatctg

SEQ ID NO: 163489 - DNA, 21 bp, Homo sapiens
gtgtatatatatatgtgtgtg

SEQ ID NO: 163490 - DNA, 23 bp, Homo sapiens
gtgtgtgcatgtgtgtctgcgtg

SEQ ID NO: 163491 - DNA, 23 bp, Homo sapiens
tgagttcattgtagattctggat

SEQ ID NO: 163492 - DNA, 23 bp, Homo sapiens
tgagttcattgtagattctggat

SEQ ID NO: 163493 - DNA, 23 bp, Homo sapiens
atatgtgtctatatatatgtgtg

SEQ ID NO: 163494 - DNA, 23 bp, Homo sapiens
aaagatttcacagagtttttgca

SEQ ID NO: 163495 - DNA, 20 bp, Homo sapiens
atgtgtataaatttacatgt

SEQ ID NO: 163496 - DNA, 18 bp, Homo sapiens
aatttacatgcacataaa

SEQ ID NO: 163497 - DNA, 23 bp, Homo sapiens
caagagtgtggctggtctatgtg

SEQ ID NO: 163498 - DNA, 23 bp, Homo sapiens
ctggcacacactggcactctctg

SEQ ID NO: 163499 - DNA, 23 bp, Homo sapiens
agagaactgtgttacctgatgta

SEQ ID NO: 163500 - DNA, 23 bp, Homo sapiens
tttaactgggggctgatcatgta

SEQ ID NO: 163501 - DNA, 23 bp, Homo sapiens
cacatataggatatataatgtat

SEQ ID NO: 163502 - DNA, 21 bp, Homo sapiens
tgacagctgagagattggagt

SEQ ID NO: 163503 - DNA, 20 bp, Homo sapiens
aaatgtatgtaaatatatgt

SEQ ID NO: 163504 - DNA, 22 bp, Homo sapiens
ggtgcatgcttgtagtcccagc

SEQ ID NO: 163505 - DNA, 21 bp, Homo sapiens
tgaggtagaaggatcacttga

SEQ ID NO: 163506 - DNA, 23 bp, Homo sapiens
ctgagtctcgctctgtcacccag

SEQ ID NO: 163507 - DNA, 23 bp, Homo sapiens
tttgagacggagtctcactctgt

SEQ ID NO: 163508 - DNA, 23 bp, Homo sapiens
agttaacttggtcagtgtctttt

SEQ ID NO: 163509 - DNA, 20 bp, Homo sapiens
atgacagaagaatgaaaggt

SEQ ID NO: 163510 - DNA, 23 bp, Homo sapiens
tctctctgcctcactgcctccat

SEQ ID NO: 163511 - DNA, 20 bp, Homo sapiens
tcccttccaggcacatatct

SEQ ID NO: 163512 - DNA, 23 bp, Homo sapiens
agatggagtctcactctgtcacc

SEQ ID NO: 163513 - DNA, 23 bp, Homo sapiens
tgtgtgactctgtgtgtatacac

SEQ ID NO: 163514 - DNA, 21 bp, Homo sapiens
tctcactctgacacccaggct

SEQ ID NO: 163515 - DNA, 18 bp, Homo sapiens
ttttttgtttttgttttt

SEQ ID NO: 163516 - DNA, 21 bp, Homo sapiens
aagtgctgggattacaggcgt

SEQ ID NO: 163517 - DNA, 19 bp, Homo sapiens
ataattcttgttttacatg

SEQ ID NO: 163518 - DNA, 23 bp, Homo sapiens
actggctctctgattcttggctt

SEQ ID NO: 163519 - DNA, 23 bp, Homo sapiens
cggagtctcactctgtcacccag

SEQ ID NO: 163520 - DNA, 18 bp, Homo sapiens
agaacaatatcttagtga

SEQ ID NO: 163521 - DNA, 23 bp, Homo sapiens
tgagttcattgtagattctggat

SEQ ID NO: 163522 - DNA, 23 bp, Homo sapiens
tgagttcattgtagattctggat

SEQ ID NO: 163523 - DNA, 23 bp, Homo sapiens
tgttcactcactcactcattcat

SEQ ID NO: 163524 - DNA, 23 bp, Homo sapiens
tggagtctcactctgtcacccag

SEQ ID NO: 163525 - DNA, 21 bp, Homo sapiens
tgtctgtagtcttagctactt

SEQ ID NO: 163526 - DNA, 23 bp, Homo sapiens
acagtagccatgatcatgccact

SEQ ID NO: 163527 - DNA, 23 bp, Homo sapiens
tatgtatacatatgtatgtataa

SEQ ID NO: 163528 - DNA, 23 bp, Homo sapiens
acatacatgtatacatatgtatg

SEQ ID NO: 163529 - DNA, 20 bp, Homo sapiens
atgacattaatattaaatgt

SEQ ID NO: 163530 - DNA, 18 bp, Homo sapiens
agagaactcagggacttg

SEQ ID NO: 163531 - DNA, 22 bp, Homo sapiens
gaggtcatcatgtatgctatat

SEQ ID NO: 163532 - DNA, 23 bp, Homo sapiens
acatacttctttatgtacccata

SEQ ID NO: 163533 - DNA, 21 bp, Homo sapiens
tggaatgtaaagaagtatgta

SEQ ID NO: 163534 - DNA, 23 bp, Homo sapiens
tttggtccccttcaaccagctgt

SEQ ID NO: 163535 - DNA, 20 bp, Homo sapiens
ccttttgtgaccaaacctca

SEQ ID NO: 163536 - DNA, 22 bp, Homo sapiens
aatgtagtaagtactttcattg

SEQ ID NO: 163537 - DNA, 21 bp, Homo sapiens
ttgagggtgtgcttatgagca

SEQ ID NO: 163538 - DNA, 23 bp, Homo sapiens
tttgagacggagtctcgctctgt

SEQ ID NO: 163539 - DNA, 23 bp, Homo sapiens
tggtagatcttgctctgttactc

SEQ ID NO: 163540 - DNA, 20 bp, Homo sapiens
tgagatgaagtctcactctg

SEQ ID NO: 163541 - DNA, 23 bp, Homo sapiens
gggtctcactctgtcacccaggc

SEQ ID NO: 163542 - DNA, 23 bp, Homo sapiens
tgagacggagtctcgctctgtca

SEQ ID NO: 163543 - DNA, 23 bp, Homo sapiens
acagagtctcactctgtcgccca

SEQ ID NO: 163544 - DNA, 23 bp, Homo sapiens
ttctttagtttctgataaggttt

SEQ ID NO: 163545 - DNA, 20 bp, Homo sapiens
tttgagacttctgtcgccca

SEQ ID NO: 163546 - DNA, 22 bp, Homo sapiens
atacacacaagtatacatatgt

SEQ ID NO: 163547 - DNA, 23 bp, Homo sapiens
atatatatacatatgtgtgtgtg

SEQ ID NO: 163548 - DNA, 23 bp, Homo sapiens
gacatgtgcatatgtgtgtctat

SEQ ID NO: 163549 - DNA, 22 bp, Homo sapiens
acatatacattatgtatatgta

SEQ ID NO: 163550 - DNA, 23 bp, Homo sapiens
ggagtctctctctgtcacacagg

SEQ ID NO: 163551 - DNA, 22 bp, Homo sapiens
tcttttgaatcctatgtgaggg

SEQ ID NO: 163552 - DNA, 18 bp, Homo sapiens
gtgtatgtatatacacgt

SEQ ID NO: 163553 - DNA, 23 bp, Homo sapiens
tatacatatgtgtatgtatatgt

SEQ ID NO: 163554 - DNA, 20 bp, Homo sapiens
tagtcactgtgctttcctgt

SEQ ID NO: 163555 - DNA, 23 bp, Homo sapiens
atcactcacagagataatctgtt

SEQ ID NO: 163556 - DNA, 20 bp, Homo sapiens
tttaattttgtttttctgag

SEQ ID NO: 163557 - DNA, 19 bp, Homo sapiens
atatgtatatatgtatatc

SEQ ID NO: 163558 - DNA, 23 bp, Homo sapiens
tagctgagatatgagtgagaaat

SEQ ID NO: 163559 - DNA, 18 bp, Homo sapiens
aagtgttagattctttgg

SEQ ID NO: 163560 - DNA, 20 bp, Homo sapiens
aacctccaccttctggttca

SEQ ID NO: 163561 - DNA, 21 bp, Homo sapiens
acagcaagaggttagtggtag

SEQ ID NO: 163562 - DNA, 23 bp, Homo sapiens
atagtccctgacctccagctgct

SEQ ID NO: 163563 - DNA, 23 bp, Homo sapiens
tgagatggaatttcactcttcct

SEQ ID NO: 163564 - DNA, 21 bp, Homo sapiens
cagtggtatgatctcagctca

SEQ ID NO: 163565 - DNA, 22 bp, Homo sapiens
tgacaagttcataatcgctaag

SEQ ID NO: 163566 - DNA, 21 bp, Homo sapiens
atacacacagctttccatctt

SEQ ID NO: 163567 - DNA, 18 bp, Homo sapiens
aaatgagtgtaattttga

SEQ ID NO: 163568 - DNA, 20 bp, Homo sapiens
ttaatgtttttaaacaccgg

SEQ ID NO: 163569 - DNA, 22 bp, Homo sapiens
tgcagtggctcacttctgtaat

SEQ ID NO: 163570 - DNA, 23 bp, Homo sapiens
tggagtctcactctgtcacccag

SEQ ID NO: 163571 - DNA, 22 bp, Homo sapiens
tttgcaggtttaagtgctgttt

SEQ ID NO: 163572 - DNA, 20 bp, Homo sapiens
agactatgtgaaaatcttgt

SEQ ID NO: 163573 - DNA, 18 bp, Homo sapiens
gggagagtgtgtgagcgt

SEQ ID NO: 163574 - DNA, 23 bp, Homo sapiens
tctgtctgcctcgttcactctct

SEQ ID NO: 163575 - DNA, 23 bp, Homo sapiens
ttgagacagagtcttgctctgtc

SEQ ID NO: 163576 - DNA, 23 bp, Homo sapiens
actgtgtctccttaggctcctct

SEQ ID NO: 163577 - DNA, 18 bp, Homo sapiens
tgaggaataacaatcagg

SEQ ID NO: 163578 - DNA, 19 bp, Homo sapiens
gggtgatgagaatgagcac

SEQ ID NO: 163579 - DNA, 23 bp, Homo sapiens
acactggaagatgttttaagtat

SEQ ID NO: 163580 - DNA, 21 bp, Homo sapiens
ttccacagtgcctaagttctc

SEQ ID NO: 163581 - DNA, 18 bp, Homo sapiens
gctgtggcttcaggctgt

SEQ ID NO: 163582 - DNA, 23 bp, Homo sapiens
atctgtgcaaatgtattgtaatt

SEQ ID NO: 163583 - DNA, 23 bp, Homo sapiens
tgactttgaaggtctcaaggtct

SEQ ID NO: 163584 - DNA, 23 bp, Homo sapiens
accgagtctctcactctgtcgcc

SEQ ID NO: 163585 - DNA, 23 bp, Homo sapiens
tttaatgatgatgatgatgatga

SEQ ID NO: 163586 - DNA, 23 bp, Homo sapiens
ttcatccttgcaattctatttct

SEQ ID NO: 163587 - DNA, 23 bp, Homo sapiens
tgaaggcagtggtagatcagagt

SEQ ID NO: 163588 - DNA, 23 bp, Homo sapiens
tgagacggagtctcgctctgtca

SEQ ID NO: 163589 - DNA, 23 bp, Homo sapiens
agacaatgtctggctctgttgcc

SEQ ID NO: 163590 - DNA, 22 bp, Homo sapiens
tgtctatatatgtctatgtatt

SEQ ID NO: 163591 - DNA, 22 bp, Homo sapiens
acagagtctcactgtgtcgccc

SEQ ID NO: 163592 - DNA, 21 bp, Homo sapiens
tgtgtatatatatgtgtgtgt

SEQ ID NO: 163593 - DNA, 23 bp, Homo sapiens
gggtctcactctgtcacccaggc

SEQ ID NO: 163594 - DNA, 23 bp, Homo sapiens
tgagacgaagtctcactctgtca

SEQ ID NO: 163595 - DNA, 23 bp, Homo sapiens
atttttttgtagagtcagggttt

SEQ ID NO: 163596 - DNA, 23 bp, Homo sapiens
cggagtctcactctgtcacccag

SEQ ID NO: 163597 - DNA, 22 bp, Homo sapiens
tagcatgtttgcttaagactga

SEQ ID NO: 163598 - DNA, 22 bp, Homo sapiens
tcagaggtacatgtgcaggttt

SEQ ID NO: 163599 - DNA, 23 bp, Homo sapiens
ttttgtctgttgttatcttctgt

SEQ ID NO: 163600 - DNA, 23 bp, Homo sapiens
atagtacctagatagtcgttgtg

SEQ ID NO: 163601 - DNA, 23 bp, Homo sapiens
agaagtgtgtgaggaaagctggt

SEQ ID NO: 163602 - DNA, 23 bp, Homo sapiens
ttatggtctatacacacacacac

SEQ ID NO: 163603 - DNA, 22 bp, Homo sapiens
ttattgctcccttgtgtgttgg

SEQ ID NO: 163604 - DNA, 21 bp, Homo sapiens
tgtggtgacatttactaaagt

SEQ ID NO: 163605 - DNA, 19 bp, Homo sapiens
agtatttgtttgtgtctag

SEQ ID NO: 163606 - DNA, 23 bp, Homo sapiens
gtgcagattttctaagcttatga

SEQ ID NO: 163607 - DNA, 23 bp, Homo sapiens
agggtgagaggataactcgttgt

SEQ ID NO: 163608 - DNA, 23 bp, Homo sapiens
gactcagtgactcattctaaagg

SEQ ID NO: 163609 - DNA, 23 bp, Homo sapiens
tatgtgtgagaagaaagtgtcca

SEQ ID NO: 163610 - DNA, 23 bp, Homo sapiens
tatgtatagtgcattgactgctt

SEQ ID NO: 163611 - DNA, 22 bp, Homo sapiens
agttgtattgtgaagtagtagg

SEQ ID NO: 163612 - DNA, 20 bp, Homo sapiens
atgtgtgtgtgtgtgtttat

SEQ ID NO: 163613 - DNA, 23 bp, Homo sapiens
aagttctgtctctgcatgttcat

SEQ ID NO: 163614 - DNA, 23 bp, Homo sapiens
gacagagtctcgctctgtcttcc

SEQ ID NO: 163615 - DNA, 23 bp, Homo sapiens
tgacagatgagagtgagtgcttg

SEQ ID NO: 163616 - DNA, 19 bp, Homo sapiens
tcagcatctagacagggct

SEQ ID NO: 163617 - DNA, 21 bp, Homo sapiens
acctgtccatatctgttgttg

SEQ ID NO: 163618 - DNA, 21 bp, Homo sapiens
ttttttggttccatatgaaat

SEQ ID NO: 163619 - DNA, 18 bp, Homo sapiens
tcaattccaaattgaatg

SEQ ID NO: 163620 - DNA, 20 bp, Homo sapiens
gtgtgtgtgtgtgtgcgtgt

SEQ ID NO: 163621 - DNA, 18 bp, Homo sapiens
accatcttctggcatgag

SEQ ID NO: 163622 - DNA, 20 bp, Homo sapiens
taaccctgtgttttatctca

SEQ ID NO: 163623 - DNA, 18 bp, Homo sapiens
cagtgaaaagggaactga

SEQ ID NO: 163624 - DNA, 22 bp, Homo sapiens
tgagttcaaaagcattcaagtt

SEQ ID NO: 163625 - DNA, 23 bp, Homo sapiens
tggctctgactgggtctctccgt

SEQ ID NO: 163626 - DNA, 23 bp, Homo sapiens
tctgtgtctgactcttctcccaa

SEQ ID NO: 163627 - DNA, 18 bp, Homo sapiens
agggtgtagaggcaggag

SEQ ID NO: 163628 - DNA, 23 bp, Homo sapiens
ttcagttacagaaagctgtgtgt

SEQ ID NO: 163629 - DNA, 23 bp, Homo sapiens
tgacatggagtctcactctgtca

SEQ ID NO: 163630 - DNA, 23 bp, Homo sapiens
ggctacagtgagccattatcgtg

SEQ ID NO: 163631 - DNA, 22 bp, Homo sapiens
agtgtggtctaccagcagctca

SEQ ID NO: 163632 - DNA, 23 bp, Homo sapiens
gactgagtctcgctctgtctccc

SEQ ID NO: 163633 - DNA, 23 bp, Homo sapiens
tttgagacggagtctcacgctct

SEQ ID NO: 163634 - DNA, 18 bp, Homo sapiens
tgactgaatctatgcagt

SEQ ID NO: 163635 - DNA, 22 bp, Homo sapiens
tatatatgtgtgtgtgtgtata

SEQ ID NO: 163636 - DNA, 21 bp, Homo sapiens
tatagatttaaatacgtatgt

SEQ ID NO: 163637 - DNA, 23 bp, Homo sapiens
ggagtctcactcactctgtcgct

SEQ ID NO: 163638 - DNA, 23 bp, Homo sapiens
tgagacagagtctcgctctgtca

SEQ ID NO: 163639 - DNA, 23 bp, Homo sapiens
gtccagtgtcactatctgtcacc

SEQ ID NO: 163640 - DNA, 23 bp, Homo sapiens
acacatcaagtctttttcatctt

SEQ ID NO: 163641 - DNA, 22 bp, Homo sapiens
ttacacaaagccagttcttttt

SEQ ID NO: 163642 - DNA, 22 bp, Homo sapiens
gagaaacaagagggaggagctg

SEQ ID NO: 163643 - DNA, 23 bp, Homo sapiens
agtttagaaatgctgttcatccc

SEQ ID NO: 163644 - DNA, 23 bp, Homo sapiens
tccttgtccctcactctgtggga

SEQ ID NO: 163645 - DNA, 18 bp, Homo sapiens
tggttgggtttactgagt

SEQ ID NO: 163646 - DNA, 23 bp, Homo sapiens
atatgtgtatatatatatgtgtg

SEQ ID NO: 163647 - DNA, 22 bp, Homo sapiens
atatgtatatatatatatgtgt

SEQ ID NO: 163648 - DNA, 23 bp, Homo sapiens
tcactgtattttagaagcagata

SEQ ID NO: 163649 - DNA, 23 bp, Homo sapiens
tcacaggtctacagatgaatgga

SEQ ID NO: 163650 - DNA, 23 bp, Homo sapiens
tgagttcattgtagattctggat

SEQ ID NO: 163651 - DNA, 23 bp, Homo sapiens
tgagttcattgtagattctggat

SEQ ID NO: 163652 - DNA, 23 bp, Homo sapiens
ttgacagggtctctctctggctg

SEQ ID NO: 163653 - DNA, 23 bp, Homo sapiens
cagtggtgtgatcatagttcagt

SEQ ID NO: 163654 - DNA, 23 bp, Homo sapiens
agcgtgtgtgtgtgtgtatgtat

SEQ ID NO: 163655 - DNA, 23 bp, Homo sapiens
atgcatatgtgtgtgtttgggtt

SEQ ID NO: 163656 - DNA, 23 bp, Homo sapiens
ttcattactagagattttgtaca

SEQ ID NO: 163657 - DNA, 23 bp, Homo sapiens
tctctgacagtcagacttcatgg

SEQ ID NO: 163658 - DNA, 23 bp, Homo sapiens
cagagtgagactctgtctttttt

SEQ ID NO: 163659 - DNA, 23 bp, Homo sapiens
cggagtctcactctgtcacccag

SEQ ID NO: 163660 - DNA, 20 bp, Homo sapiens
agtctcgctctgtcacccag

SEQ ID NO: 163661 - DNA, 23 bp, Homo sapiens
cggagtctcactctgtcacccag

SEQ ID NO: 163662 - DNA, 21 bp, Homo sapiens
acatgtgcacaatgtgcaggt

SEQ ID NO: 163663 - DNA, 23 bp, Homo sapiens
atgtgtgtgcctgtgtgcgcgcg

SEQ ID NO: 163664 - DNA, 23 bp, Homo sapiens
tgtgttatttatgtggtagacat

SEQ ID NO: 163665 - DNA, 21 bp, Homo sapiens
atagagtctggaatatataca

SEQ ID NO: 163666 - DNA, 18 bp, Homo sapiens
tatgttggtgcaaaagca

SEQ ID NO: 163667 - DNA, 23 bp, Homo sapiens
gaacagtcacactgtgtgacact

SEQ ID NO: 163668 - DNA, 23 bp, Homo sapiens
tattcattgtttatctgaaattc

SEQ ID NO: 163669 - DNA, 23 bp, Homo sapiens
ccgagtctgtctgtgtcacccag

SEQ ID NO: 163670 - DNA, 18 bp, Homo sapiens
agtgccatgatcctggct

SEQ ID NO: 163671 - DNA, 23 bp, Homo sapiens
taagtgcatggatttatacctgg

SEQ ID NO: 163672 - DNA, 22 bp, Homo sapiens
tatctgctatatatatatgtgt

SEQ ID NO: 163673 - DNA, 23 bp, Homo sapiens
tggctctgagtgtcacccttatt

SEQ ID NO: 163674 - DNA, 23 bp, Homo sapiens
tgtccaatgtgtatgagtttcca

SEQ ID NO: 163675 - DNA, 21 bp, Homo sapiens
acatatgtctgcatgagcatg

SEQ ID NO: 163676 - DNA, 23 bp, Homo sapiens
atgattgtatatgtgcgtgtgca

SEQ ID NO: 163677 - DNA, 23 bp, Homo sapiens
tttgcatgtgaatatgtatatat

SEQ ID NO: 163678 - DNA, 23 bp, Homo sapiens
cagtccaatgttgtttgctgttt

SEQ ID NO: 163679 - DNA, 18 bp, Homo sapiens
ttctatttttgtaaactc

SEQ ID NO: 163680 - DNA, 23 bp, Homo sapiens
ttctgccaggttttgatatcaga

SEQ ID NO: 163681 - DNA, 22 bp, Homo sapiens
tatactatatatatatatgtgt

SEQ ID NO: 163682 - DNA, 23 bp, Homo sapiens
ttttatggttctatatgaatttt

SEQ ID NO: 163683 - DNA, 23 bp, Homo sapiens
tgagttcattgtagattctggat

SEQ ID NO: 163684 - DNA, 23 bp, Homo sapiens
tgagttcattgtagattctggat

SEQ ID NO: 163685 - DNA, 22 bp, Homo sapiens
ctgtgagtctcatgttggggct

SEQ ID NO: 163686 - DNA, 19 bp, Homo sapiens
tacattgtaattttggtct

SEQ ID NO: 163687 - DNA, 23 bp, Homo sapiens
caatgtgtgtgtgcatgtgcatg

SEQ ID NO: 163688 - DNA, 18 bp, Homo sapiens
tcctcttatattcagaaa

SEQ ID NO: 163689 - DNA, 23 bp, Homo sapiens
tgagttcattgtagattctggat

SEQ ID NO: 163690 - DNA, 23 bp, Homo sapiens
tgagttcattgtagattctggat

SEQ ID NO: 163691 - DNA, 22 bp, Homo sapiens
tctggttcttttgtctttccat

SEQ ID NO: 163692 - DNA, 22 bp, Homo sapiens
aggattttgattgggattgcat

SEQ ID NO: 163693 - DNA, 23 bp, Homo sapiens
agggtctcactctgtctcctagg

SEQ ID NO: 163694 - DNA, 22 bp, Homo sapiens
ctgtgtcttactctgtcaccca

SEQ ID NO: 163695 - DNA, 23 bp, Homo sapiens
tgagttcattgtagattctggat

SEQ ID NO: 163696 - DNA, 23 bp, Homo sapiens
tgagttcattgtagattctggat

SEQ ID NO: 163697 - DNA, 20 bp, Homo sapiens
tctgcatgtatgtatatatg

SEQ ID NO: 163698 - DNA, 23 bp, Homo sapiens
tgtgtgtgtgtgtgtgtgcatat

SEQ ID NO: 163699 - DNA, 21 bp, Homo sapiens
tacacgtatatatatatatgt

SEQ ID NO: 163700 - DNA, 23 bp, Homo sapiens
gttgtcatcaagatgcattggtc

SEQ ID NO: 163701 - DNA, 21 bp, Homo sapiens
ataattgtagattaacatgta

SEQ ID NO: 163702 - DNA, 23 bp, Homo sapiens
tgagttcattgtagattctggat

SEQ ID NO: 163703 - DNA, 23 bp, Homo sapiens
tgagttcattgtagattctggat

SEQ ID NO: 163704 - DNA, 18 bp, Homo sapiens
agccaagtctctgccaga

SEQ ID NO: 163705 - DNA, 22 bp, Homo sapiens
cggtgtctcactctgtcgccca

SEQ ID NO: 163706 - DNA, 19 bp, Homo sapiens
agagtctctcactatcacc

SEQ ID NO: 163707 - DNA, 19 bp, Homo sapiens
ttctatttcaaaaactgtg

SEQ ID NO: 163708 - DNA, 23 bp, Homo sapiens
gtgtgtatatatgtatgtgtgtg

SEQ ID NO: 163709 - DNA, 19 bp, Homo sapiens
caggaggctgaggtaggag

SEQ ID NO: 163710 - DNA, 21 bp, Homo sapiens
tgccactctccctgtttggga

SEQ ID NO: 163711 - DNA, 21 bp, Homo sapiens
ttttgctcttgtcacccagac

SEQ ID NO: 163712 - DNA, 23 bp, Homo sapiens
gagtctcactgtgacacccaggc

SEQ ID NO: 163713 - DNA, 21 bp, Homo sapiens
atgtgtgtgtatatatatgtg

SEQ ID NO: 163714 - DNA, 20 bp, Homo sapiens
tgtgtatatatgtatatatg

SEQ ID NO: 163715 - DNA, 18 bp, Homo sapiens
tatgtgtgtatgtgtgta

SEQ ID NO: 163716 - DNA, 22 bp, Homo sapiens
atacacacacacatatatatgt

SEQ ID NO: 163717 - DNA, 21 bp, Homo sapiens
gtggcagacagattttttttt

SEQ ID NO: 163718 - DNA, 23 bp, Homo sapiens
tttgagacggagtctccctctgt

SEQ ID NO: 163719 - DNA, 21 bp, Homo sapiens
ttgtatttgttcagtttgtgt

SEQ ID NO: 163720 - DNA, 21 bp, Homo sapiens
atgtgtgtgtatatgtatatg

SEQ ID NO: 163721 - DNA, 23 bp, Homo sapiens
tgagttcattgtagattctggat

SEQ ID NO: 163722 - DNA, 23 bp, Homo sapiens
tgagttcattgtagattctggat

SEQ ID NO: 163723 - DNA, 20 bp, Homo sapiens
tctcactagactatctctag

SEQ ID NO: 163724 - DNA, 23 bp, Homo sapiens
atacatttactatatgtgtgtgt

SEQ ID NO: 163725 - DNA, 22 bp, Homo sapiens
ttaggtcctaaatgagaggtaa

SEQ ID NO: 163726 - DNA, 23 bp, Homo sapiens
gtatatgtgtatatgtatgtgtg

SEQ ID NO: 163727 - DNA, 20 bp, Homo sapiens
tgtgtatatgtatatgtgta

SEQ ID NO: 163728 - DNA, 18 bp, Homo sapiens
tacacacacatacatata

SEQ ID NO: 163729 - DNA, 19 bp, Homo sapiens
tgaggtaagaggatcacta

SEQ ID NO: 163730 - DNA, 23 bp, Homo sapiens
tgagttcattgtagattctggat

SEQ ID NO: 163731 - DNA, 23 bp, Homo sapiens
tgagttcattgtagattctggat

SEQ ID NO: 163732 - DNA, 23 bp, Homo sapiens
gatttcatcttgggtttgctgag

SEQ ID NO: 163733 - DNA, 22 bp, Homo sapiens
tctgactgtcctgtaggtccag

SEQ ID NO: 163734 - DNA, 23 bp, Homo sapiens
atatacacacacatatatatatg

SEQ ID NO: 163735 - DNA, 20 bp, Homo sapiens
atgtgtgtgtatatatatac

SEQ ID NO: 163736 - DNA, 21 bp, Homo sapiens
atgtgcagttaaatagaatgt

SEQ ID NO: 163737 - DNA, 23 bp, Homo sapiens
gggactctcgctctgtcacccag

SEQ ID NO: 163738 - DNA, 23 bp, Homo sapiens
tcccagtagtgtgattggtgttt

SEQ ID NO: 163739 - DNA, 21 bp, Homo sapiens
acacagtcttgctctgtcacc

SEQ ID NO: 163740 - DNA, 23 bp, Homo sapiens
ggagtctcactctgtcacccagg

SEQ ID NO: 163741 - DNA, 23 bp, Homo sapiens
acacaccattacaaataatggtg

SEQ ID NO: 163742 - DNA, 19 bp, Homo sapiens
tgttacaggctgagcacag

SEQ ID NO: 163743 - DNA, 23 bp, Homo sapiens
tgagttcattgtagattctggat

SEQ ID NO: 163744 - DNA, 23 bp, Homo sapiens
tgagttcattgtagattctggat

SEQ ID NO: 163745 - DNA, 23 bp, Homo sapiens
cagacagagtctcactctgtggc

SEQ ID NO: 163746 - DNA, 21 bp, Homo sapiens
atggagtctcgctttgttgtc

SEQ ID NO: 163747 - DNA, 19 bp, Homo sapiens
ctgcttgtgacacagtgtc

SEQ ID NO: 163748 - DNA, 23 bp, Homo sapiens
ttgagatggagtttcactcttgt

SEQ ID NO: 163749 - DNA, 23 bp, Homo sapiens
tttctaagtttttctaaccatga

SEQ ID NO: 163750 - DNA, 20 bp, Homo sapiens
tgcagtgatacaattctctg

SEQ ID NO: 163751 - DNA, 23 bp, Homo sapiens
cttgagacagggtctcactctgt

SEQ ID NO: 163752 - DNA, 23 bp, Homo sapiens
gggtctcactctgtcacccaggc

SEQ ID NO: 163753 - DNA, 23 bp, Homo sapiens
gggtctcactctgtcacccaggc

SEQ ID NO: 163754 - DNA, 23 bp, Homo sapiens
gggtctcactctgtcacccaggc

SEQ ID NO: 163755 - DNA, 23 bp, Homo sapiens
gacagagtctcgctctgtcaccc

SEQ ID NO: 163756 - DNA, 18 bp, Homo sapiens
ggtcataggctaagttct

SEQ ID NO: 163757 - DNA, 21 bp, Homo sapiens
tgtccctcacacacaccctca

SEQ ID NO: 163758 - DNA, 23 bp, Homo sapiens
gagggagtctcgctctgtcaccc

SEQ ID NO: 163759 - DNA, 21 bp, Homo sapiens
gtccctctcactcactctggt

SEQ ID NO: 163760 - DNA, 23 bp, Homo sapiens
acacagtctcgctgtcacccagg

SEQ ID NO: 163761 - DNA, 22 bp, Homo sapiens
acactgacagggtgtacttttt

SEQ ID NO: 163762 - DNA, 23 bp, Homo sapiens
agacagagtctctctgtcacata

SEQ ID NO: 163763 - DNA, 23 bp, Homo sapiens
gtgacagagtgagactctgtctc

SEQ ID NO: 163764 - DNA, 19 bp, Homo sapiens
atctctccctgtctctctc

SEQ ID NO: 163765 - DNA, 23 bp, Homo sapiens
gcctctctgtgtctctgtttccc

SEQ ID NO: 163766 - DNA, 18 bp, Homo sapiens
tctcactcagtcatccag

SEQ ID NO: 163767 - DNA, 22 bp, Homo sapiens
agagaagaaatgaagctcattg

SEQ ID NO: 163768 - DNA, 20 bp, Homo sapiens
tgagacagagtctcgctctg

SEQ ID NO: 163769 - DNA, 23 bp, Homo sapiens
gacagagtctcgctctgtcaccc

SEQ ID NO: 163770 - DNA, 23 bp, Homo sapiens
ggagtctcactctgtcactcagg

SEQ ID NO: 163771 - DNA, 23 bp, Homo sapiens
tcaccatctctctctctgtccca

SEQ ID NO: 163772 - DNA, 22 bp, Homo sapiens
tgtgcctggtgtcctcattcga

SEQ ID NO: 163773 - DNA, 23 bp, Homo sapiens
gctcacacactcactcgctcagc

SEQ ID NO: 163774 - DNA, 23 bp, Homo sapiens
accctgtgactctgtttctccgt

SEQ ID NO: 163775 - DNA, 23 bp, Homo sapiens
agtcctcctctccctctgactca

SEQ ID NO: 163776 - DNA, 21 bp, Homo sapiens
tgtgacagtgtctctgccctt

SEQ ID NO: 163777 - DNA, 22 bp, Homo sapiens
agagagcagagacagcacagtg

SEQ ID NO: 163778 - DNA, 22 bp, Homo sapiens
attcacacaaatgggattgcac

SEQ ID NO: 163779 - DNA, 23 bp, Homo sapiens
tgtcggtgtctgtgtgtctcttg

SEQ ID NO: 163780 - DNA, 23 bp, Homo sapiens
atgtcagacaactgagacagctc

SEQ ID NO: 163781 - DNA, 23 bp, Homo sapiens
ctgggtgggtgagtccctctctg

SEQ ID NO: 163782 - DNA, 22 bp, Homo sapiens
actcacagtcactctctaaggc

SEQ ID NO: 163783 - DNA, 23 bp, Homo sapiens
gcgtctctcactgagtgtgacac

SEQ ID NO: 163784 - DNA, 23 bp, Homo sapiens
catgaggctgtgtctctgtctgt

SEQ ID NO: 163785 - DNA, 22 bp, Homo sapiens
agacagggtctcactctgtcac

SEQ ID NO: 163786 - DNA, 22 bp, Homo sapiens
aaagtgctgggattacagatgt

SEQ ID NO: 163787 - DNA, 21 bp, Homo sapiens
tttatacttcattttttgttg

SEQ ID NO: 163788 - DNA, 23 bp, Homo sapiens
acagagtctcactctgtcgccca

SEQ ID NO: 163789 - DNA, 23 bp, Homo sapiens
gatggagtctcactctgtctccc

SEQ ID NO: 163790 - DNA, 21 bp, Homo sapiens
gtctcactctgtcgccctgct

SEQ ID NO: 163791 - DNA, 23 bp, Homo sapiens
tggagtctcactctgtcacccag

SEQ ID NO: 163792 - DNA, 23 bp, Homo sapiens
tgagacagagtctcactctgtcg

SEQ ID NO: 163793 - DNA, 23 bp, Homo sapiens
aaggtctggctctgtcacccaca

SEQ ID NO: 163794 - DNA, 23 bp, Homo sapiens
agtacagagaagagtgagtggag

SEQ ID NO: 163795 - DNA, 23 bp, Homo sapiens
ctctctgaatctgtgtctgaggt

SEQ ID NO: 163796 - DNA, 23 bp, Homo sapiens
tggagtctcactctgtcacccag

SEQ ID NO: 163797 - DNA, 23 bp, Homo sapiens
tgaggtggagtctcactctgtca

SEQ ID NO: 163798 - DNA, 23 bp, Homo sapiens
tatgtgtatatatatgtatgtgt

SEQ ID NO: 163799 - DNA, 23 bp, Homo sapiens
tcggagtctcgctctgtcaccca

SEQ ID NO: 163800 - DNA, 23 bp, Homo sapiens
tgtgtgtccttgagccagcagct

SEQ ID NO: 163801 - DNA, 23 bp, Homo sapiens
tctctctctctggaaaacgaggc

SEQ ID NO: 163802 - DNA, 21 bp, Homo sapiens
acgtgtgtatgtgtgtgtgtg

SEQ ID NO: 163803 - DNA, 23 bp, Homo sapiens
tgagacagggtctcactctgttg

SEQ ID NO: 163804 - DNA, 22 bp, Homo sapiens
tatgtgactctgtgtgtgcctg

SEQ ID NO: 163805 - DNA, 22 bp, Homo sapiens
tctctgtaggtcgtagtgtgtg

SEQ ID NO: 163806 - DNA, 23 bp, Homo sapiens
gtgtgcatgtgtgtgtatgtaaa

SEQ ID NO: 163807 - DNA, 23 bp, Homo sapiens
tctctgagcctcagtctctctct

SEQ ID NO: 163808 - DNA, 23 bp, Homo sapiens
ctcagtctgtgggactcagtggc

SEQ ID NO: 163809 - DNA, 19 bp, Homo sapiens
aaatgctgggattacaggc

SEQ ID NO: 163810 - DNA, 21 bp, Homo sapiens
tgagtctcattctgtcaccca

SEQ ID NO: 163811 - DNA, 18 bp, Homo sapiens
agtgcagtggcacgactt

SEQ ID NO: 163812 - DNA, 22 bp, Homo sapiens
tgagtctcactttgtcactcag

SEQ ID NO: 163813 - DNA, 19 bp, Homo sapiens
attcactttatatattgtt

SEQ ID NO: 163814 - DNA, 19 bp, Homo sapiens
tgtcttactctgtgtctct

SEQ ID NO: 163815 - DNA, 21 bp, Homo sapiens
tgaggtaggaggatctcttga

SEQ ID NO: 163816 - DNA, 23 bp, Homo sapiens
caggtgcacagtgacagtcactc

SEQ ID NO: 163817 - DNA, 23 bp, Homo sapiens
gacagtttttgatgttctcttag

SEQ ID NO: 163818 - DNA, 23 bp, Homo sapiens
ttttgtgcctggagtctctcact

SEQ ID NO: 163819 - DNA, 23 bp, Homo sapiens
tctgtgtgactgttctagaacgg

SEQ ID NO: 163820 - DNA, 20 bp, Homo sapiens
tgagttcagtgagtctgtgc

SEQ ID NO: 163821 - DNA, 23 bp, Homo sapiens
acaggaaggacagtgtctctgag

SEQ ID NO: 163822 - DNA, 23 bp, Homo sapiens
gaccctgcctgcctgcctgcctg

SEQ ID NO: 163823 - DNA, 23 bp, Homo sapiens
gtgggtctgtctctgtgtccaga

SEQ ID NO: 163824 - DNA, 19 bp, Homo sapiens
agtgcaagcatatgcatgt

SEQ ID NO: 163825 - DNA, 23 bp, Homo sapiens
ccgagtctcgctctgtctcccag

SEQ ID NO: 163826 - DNA, 23 bp, Homo sapiens
gacggagtctcgctctgtcgctc

SEQ ID NO: 163827 - DNA, 23 bp, Homo sapiens
gagacggagtctcactgtgtcac

SEQ ID NO: 163828 - DNA, 23 bp, Homo sapiens
ctcccagagcccctggaactctg

SEQ ID NO: 163829 - DNA, 23 bp, Homo sapiens
tcccagagcccctggaactctgg

SEQ ID NO: 163830 - DNA, 23 bp, Homo sapiens
tcccagagcccctggaactctgg

SEQ ID NO: 163831 - DNA, 23 bp, Homo sapiens
tcccagagcccctggaactctgg

SEQ ID NO: 163832 - DNA, 18 bp, Homo sapiens
tcactgcagcctctctct

SEQ ID NO: 163833 - DNA, 20 bp, Homo sapiens
agtctcgctctgtcgctcag

SEQ ID NO: 163834 - DNA, 20 bp, Homo sapiens
cccaggctctctgactgact

SEQ ID NO: 163835 - DNA, 22 bp, Homo sapiens
ctgaggtagaagaatcacttga

SEQ ID NO: 163836 - DNA, 23 bp, Homo sapiens
cggtgtgtctcagtctctccttt

SEQ ID NO: 163837 - DNA, 23 bp, Homo sapiens
tcacccacacagtcacactcagc

SEQ ID NO: 163838 - DNA, 22 bp, Homo sapiens
gtgtgcatatatatgtgtgtgt

SEQ ID NO: 163839 - DNA, 22 bp, Homo sapiens
acaccaagtcatagtccttctg

SEQ ID NO: 163840 - DNA, 20 bp, Homo sapiens
tatgtgtctgtgtgtgtctg

SEQ ID NO: 163841 - DNA, 23 bp, Homo sapiens
gacagagtctcgctctgtcaccc

SEQ ID NO: 163842 - DNA, 20 bp, Homo sapiens
ttgagacagggtctcactct

SEQ ID NO: 163843 - DNA, 23 bp, Homo sapiens
agtccctgagtccctgggtccct

SEQ ID NO: 163844 - DNA, 23 bp, Homo sapiens
tccctgagtccctgagtccctga

SEQ ID NO: 163845 - DNA, 23 bp, Homo sapiens
gtccctgagtgtctgagtccctg

SEQ ID NO: 163846 - DNA, 23 bp, Homo sapiens
tgactgtgtgtgtgtggctgtgt

SEQ ID NO: 163847 - DNA, 22 bp, Homo sapiens
caccgtgtctgacactttgggc

SEQ ID NO: 163848 - DNA, 23 bp, Homo sapiens
atatgtgtgtatatatatatgtg

SEQ ID NO: 163849 - DNA, 21 bp, Homo sapiens
tttacagtagtaagagagcac

SEQ ID NO: 163850 - DNA, 23 bp, Homo sapiens
tgtaaatgtgcgtgcatatgtgg

SEQ ID NO: 163851 - DNA, 23 bp, Homo sapiens
atctgtgtgcatgtgcatgtggt

SEQ ID NO: 163852 - DNA, 23 bp, Homo sapiens
caggctctatgagaaagaggatc

SEQ ID NO: 163853 - DNA, 23 bp, Homo sapiens
tccggtcatgtgggcattgctgt

SEQ ID NO: 163854 - DNA, 21 bp, Homo sapiens
tgactctgatgactctaggaa

SEQ ID NO: 163855 - DNA, 19 bp, Homo sapiens
tgagatggagtctcactct

SEQ ID NO: 163856 - DNA, 22 bp, Homo sapiens
acggagtctcgctctgtctgcc

SEQ ID NO: 163857 - DNA, 23 bp, Homo sapiens
gacagtgtctcactctgttgctc

SEQ ID NO: 163858 - DNA, 20 bp, Homo sapiens
acagtggtgtgatcgcagct

SEQ ID NO: 163859 - DNA, 23 bp, Homo sapiens
agtctcactcactctgacgctca

SEQ ID NO: 163860 - DNA, 23 bp, Homo sapiens
cagggtctcactctgtctcccag

SEQ ID NO: 163861 - DNA, 23 bp, Homo sapiens
acctcagtctccctgtctgtaaa

SEQ ID NO: 163862 - DNA, 23 bp, Homo sapiens
tcattgcacttggtgttcacagt

SEQ ID NO: 163863 - DNA, 23 bp, Homo sapiens
acacagtagacactcagttcaac

SEQ ID NO: 163864 - DNA, 23 bp, Homo sapiens
agatggagtctcactctgtcacc

SEQ ID NO: 163865 - DNA, 19 bp, Homo sapiens
catgcctgtagttccagct

SEQ ID NO: 163866 - DNA, 22 bp, Homo sapiens
tgaggcggagtttcactcttgt

SEQ ID NO: 163867 - DNA, 23 bp, Homo sapiens
gtctgggtgagtcactgcctgag

SEQ ID NO: 163868 - DNA, 21 bp, Homo sapiens
atgccagtcccaccactgtgt

SEQ ID NO: 163869 - DNA, 23 bp, Homo sapiens
tagggtctcactctgtcgcacag

SEQ ID NO: 163870 - DNA, 23 bp, Homo sapiens
gtccctctgtgacacagataccc

SEQ ID NO: 163871 - DNA, 23 bp, Homo sapiens
agagtctcactctgtcacccagg

SEQ ID NO: 163872 - DNA, 18 bp, Homo sapiens
tgacacacagtctcactc

SEQ ID NO: 163873 - DNA, 22 bp, Homo sapiens
cagccctcgctcactctctgcg

SEQ ID NO: 163874 - DNA, 21 bp, Homo sapiens
aaagtgctgggattacaggca

SEQ ID NO: 163875 - DNA, 23 bp, Homo sapiens
atttttgtgtttttctagtagag

SEQ ID NO: 163876 - DNA, 21 bp, Homo sapiens
tggtaagttcttggcagaaga

SEQ ID NO: 163877 - DNA, 20 bp, Homo sapiens
tacctggctgggtgattttt

SEQ ID NO: 163878 - DNA, 23 bp, Homo sapiens
caacatagtgactctctgtctct

SEQ ID NO: 163879 - DNA, 23 bp, Homo sapiens
tgagttcattgtagattctggat

SEQ ID NO: 163880 - DNA, 23 bp, Homo sapiens
tgagttcattgtagattctggat

SEQ ID NO: 163881 - DNA, 18 bp, Homo sapiens
tgagatggagtctcactc

SEQ ID NO: 163882 - DNA, 22 bp, Homo sapiens
agagtctcgctctgtcacccag

SEQ ID NO: 163883 - DNA, 19 bp, Homo sapiens
aggctctctatcctctttc

SEQ ID NO: 163884 - DNA, 23 bp, Homo sapiens
agagacacaggacagagagctga

SEQ ID NO: 163885 - DNA, 23 bp, Homo sapiens
aggttgagtgatgaaagcaggca

SEQ ID NO: 163886 - DNA, 20 bp, Homo sapiens
tggagtgtttcttagttctt

SEQ ID NO: 163887 - DNA, 23 bp, Homo sapiens
tgaatagatgttaggataggtgt

SEQ ID NO: 163888 - DNA, 23 bp, Homo sapiens
gagactgagtctcgctctctcac

SEQ ID NO: 163889 - DNA, 21 bp, Homo sapiens
tggcacgatctcagcttacct

SEQ ID NO: 163890 - DNA, 23 bp, Homo sapiens
gacagagtctcgctctgtcaccc

SEQ ID NO: 163891 - DNA, 23 bp, Homo sapiens
tttatacatctgtctctctgtct

SEQ ID NO: 163892 - DNA, 20 bp, Homo sapiens
tgagacagagtctcgctctg

SEQ ID NO: 163893 - DNA, 18 bp, Homo sapiens
tgtgcaacatagtgagac

SEQ ID NO: 163894 - DNA, 23 bp, Homo sapiens
acagaggctcgctctgtcgctca

SEQ ID NO: 163895 - DNA, 23 bp, Homo sapiens
gacagagtctcactctgtcaccc

SEQ ID NO: 163896 - DNA, 19 bp, Homo sapiens
tttgaaacagagtctctct

SEQ ID NO: 163897 - DNA, 23 bp, Homo sapiens
gacactctgtgtgtgtgaggggg

SEQ ID NO: 163898 - DNA, 21 bp, Homo sapiens
tatgtgtatatatatgtgtgt

SEQ ID NO: 163899 - DNA, 21 bp, Homo sapiens
tatgtgtatatatatgtgtgt

SEQ ID NO: 163900 - DNA, 23 bp, Homo sapiens
tatgtgtatatatacatatgtgt

SEQ ID NO: 163901 - DNA, 22 bp, Homo sapiens
agtctcgctctgtcactcaggc

SEQ ID NO: 163902 - DNA, 21 bp, Homo sapiens
agccttgttcttgctttcctg

SEQ ID NO: 163903 - DNA, 23 bp, Homo sapiens
caagtctcactctgtcacacagg

SEQ ID NO: 163904 - DNA, 23 bp, Homo sapiens
tgtgactgtctctgtgtgtggcc

SEQ ID NO: 163905 - DNA, 21 bp, Homo sapiens
tgaggtaggaggatcaattga

SEQ ID NO: 163906 - DNA, 18 bp, Homo sapiens
aagagcaacacatatttt

SEQ ID NO: 163907 - DNA, 22 bp, Homo sapiens
ttgagatgctgtctcactcttt

SEQ ID NO: 163908 - DNA, 23 bp, Homo sapiens
gtatgtatgtatgtatgtatgaa

SEQ ID NO: 163909 - DNA, 23 bp, Homo sapiens
tttgagacggagtctcactctgt

SEQ ID NO: 163910 - DNA, 18 bp, Homo sapiens
tgagacagagtctcactc

SEQ ID NO: 163911 - DNA, 23 bp, Homo sapiens
tgtgtgtatgtatatatatatgt

SEQ ID NO: 163912 - DNA, 21 bp, Homo sapiens
tgagacagtgtctcactctgt

SEQ ID NO: 163913 - DNA, 23 bp, Homo sapiens
tcaacacagcaatctctgttaac

SEQ ID NO: 163914 - DNA, 23 bp, Homo sapiens
tggagtctcactctgtcacccag

SEQ ID NO: 163915 - DNA, 18 bp, Homo sapiens
acagtggtgcgatctcag

SEQ ID NO: 163916 - DNA, 23 bp, Homo sapiens
gactgaatctctgtgtctttgag

SEQ ID NO: 163917 - DNA, 21 bp, Homo sapiens
gagagggagtctcactctgtt

SEQ ID NO: 163918 - DNA, 22 bp, Homo sapiens
tgactcactgcaactccatttc

SEQ ID NO: 163919 - DNA, 23 bp, Homo sapiens
acagagtctctctctgtcaccca

SEQ ID NO: 163920 - DNA, 23 bp, Homo sapiens
gacagagtctcgctctgtcaccc

SEQ ID NO: 163921 - DNA, 23 bp, Homo sapiens
cggagtctcactctgtcacccag

SEQ ID NO: 163922 - DNA, 23 bp, Homo sapiens
tggagtctcactctgtcacccag

SEQ ID NO: 163923 - DNA, 20 bp, Homo sapiens
agtctcgctctgtcgctcag

SEQ ID NO: 163924 - DNA, 23 bp, Homo sapiens
caaggtctcactctgtcacccag

SEQ ID NO: 163925 - DNA, 23 bp, Homo sapiens
tctctgaggctcactttcctcat

SEQ ID NO: 163926 - DNA, 21 bp, Homo sapiens
tgagacagtcttactctgttg

SEQ ID NO: 163927 - DNA, 23 bp, Homo sapiens
tatgtgtgtatatacctatgtgt

SEQ ID NO: 163928 - DNA, 23 bp, Homo sapiens
tatgtgtatatatacctatgtgt

SEQ ID NO: 163929 - DNA, 23 bp, Homo sapiens
tatgtgtatatatacctatgtgt

SEQ ID NO: 163930 - DNA, 23 bp, Homo sapiens
tatgtgtatatatacctatgtgt

SEQ ID NO: 163931 - DNA, 23 bp, Homo sapiens
tatgtgtatatatacctatgtgt

SEQ ID NO: 163932 - DNA, 23 bp, Homo sapiens
tatgtgtatatatacctatgtgt

SEQ ID NO: 163933 - DNA, 23 bp, Homo sapiens
tatgtgtatatatacctatgtgt

SEQ ID NO: 163934 - DNA, 22 bp, Homo sapiens
atgtgtatatatacctatgtgt

SEQ ID NO: 163935 - DNA, 23 bp, Homo sapiens
tatgtgtatatatacctatgtgt

SEQ ID NO: 163936 - DNA, 23 bp, Homo sapiens
tatgtgtatatatacctatgtgt

SEQ ID NO: 163937 - DNA, 23 bp, Homo sapiens
tatgtgtatatatacctatgtgt

SEQ ID NO: 163938 - DNA, 23 bp, Homo sapiens
tatgtgtatatatacctatgtgt

SEQ ID NO: 163939 - DNA, 23 bp, Homo sapiens
tatgtgtatatatacctatgcgt

SEQ ID NO: 163940 - DNA, 23 bp, Homo sapiens
tatgcgtatatatacatatgcgt

SEQ ID NO: 163941 - DNA, 23 bp, Homo sapiens
tatgtgtgtatgtacatgtgtat

SEQ ID NO: 163942 - DNA, 23 bp, Homo sapiens
tatatgtatatatacatatgtgt

SEQ ID NO: 163943 - DNA, 23 bp, Homo sapiens
atatgtatatatgtatatatgtg

SEQ ID NO: 163944 - DNA, 21 bp, Homo sapiens
atatgtgtgtatgtatatgtg

SEQ ID NO: 163945 - DNA, 23 bp, Homo sapiens
tgagcctccctcactgagtccct

SEQ ID NO: 163946 - DNA, 18 bp, Homo sapiens
tcagtcgttccagttact

SEQ ID NO: 163947 - DNA, 23 bp, Homo sapiens
aaagaactcacactggagagaaa

SEQ ID NO: 163948 - DNA, 23 bp, Homo sapiens
tcttggggtataaaatgagtgtc

SEQ ID NO: 163949 - DNA, 19 bp, Homo sapiens
actctgtctcaaaaaaaag

SEQ ID NO: 163950 - DNA, 23 bp, Homo sapiens
gttctaggtccttactgtctctc

SEQ ID NO: 163951 - DNA, 23 bp, Homo sapiens
tgagacaagagtctcacactctg

SEQ ID NO: 163952 - DNA, 21 bp, Homo sapiens
cttcagtagttctaagtactt

SEQ ID NO: 163953 - DNA, 23 bp, Homo sapiens
ggaagaactcacactggagagaa

SEQ ID NO: 163954 - DNA, 23 bp, Homo sapiens
tggatcatatagtagctctattt

SEQ ID NO: 163955 - DNA, 23 bp, Homo sapiens
cggagtctcactctgtcacccag

SEQ ID NO: 163956 - DNA, 23 bp, Homo sapiens
tgaggtagaaggatctgttgagc

SEQ ID NO: 163957 - DNA, 23 bp, Homo sapiens
tcggctcactgcaacctctgtct

SEQ ID NO: 163958 - DNA, 22 bp, Homo sapiens
tggtgatgtgtacctgtagtcc

SEQ ID NO: 163959 - DNA, 23 bp, Homo sapiens
gacagagtctcgctctgtcaccc

SEQ ID NO: 163960 - DNA, 23 bp, Homo sapiens
acagtcttactctgtcacgcagg

SEQ ID NO: 163961 - DNA, 23 bp, Homo sapiens
gacagtgtctcactctgtcgccc

SEQ ID NO: 163962 - DNA, 23 bp, Homo sapiens
tgaagtctcactctgtcacccag

SEQ ID NO: 163963 - DNA, 22 bp, Homo sapiens
ttgacacacatttaggttgttt

SEQ ID NO: 163964 - DNA, 18 bp, Homo sapiens
tgcaatgaacatgggagt

SEQ ID NO: 163965 - DNA, 23 bp, Homo sapiens
gtaacagtgtgacattagagttt

SEQ ID NO: 163966 - DNA, 23 bp, Homo sapiens
tgagacccagtctcgctctgtca

SEQ ID NO: 163967 - DNA, 23 bp, Homo sapiens
tgaggtggagtctcactctgtca

SEQ ID NO: 163968 - DNA, 20 bp, Homo sapiens
gtgccactgtgcctggccca

SEQ ID NO: 163969 - DNA, 22 bp, Homo sapiens
ttgagacaaggtcttgctgtgt

SEQ ID NO: 163970 - DNA, 23 bp, Homo sapiens
gtctgggtctgtctctgactctg

SEQ ID NO: 163971 - DNA, 23 bp, Homo sapiens
actgagtttcactctgtcaccca

SEQ ID NO: 163972 - DNA, 23 bp, Homo sapiens
tcactcacgctgtcacccaggct

SEQ ID NO: 163973 - DNA, 23 bp, Homo sapiens
tcggattactgcagcctccgtct

SEQ ID NO: 163974 - DNA, 23 bp, Homo sapiens
agactctcactcggtcgctcagg

SEQ ID NO: 163975 - DNA, 22 bp, Homo sapiens
agtgacaggctggagtgtcgct

SEQ ID NO: 163976 - DNA, 23 bp, Homo sapiens
gacagagtctcgctctgtcaccc

SEQ ID NO: 163977 - DNA, 23 bp, Homo sapiens
gagtgtgtgtctgtgtttccctg

SEQ ID NO: 163978 - DNA, 19 bp, Homo sapiens
ctgtgcgtctgtgtgtgtc

SEQ ID NO: 163979 - DNA, 23 bp, Homo sapiens
tattgtctgggtctctatgggga

SEQ ID NO: 163980 - DNA, 22 bp, Homo sapiens
tgtgagtgatgaggctgagcac

SEQ ID NO: 163981 - DNA, 23 bp, Homo sapiens
gatggagtctctctctgtcaccc

SEQ ID NO: 163982 - DNA, 23 bp, Homo sapiens
acagagtctcactctgtcgccca

SEQ ID NO: 163983 - DNA, 21 bp, Homo sapiens
gacagggtctcactctgtcac

SEQ ID NO: 163984 - DNA, 18 bp, Homo sapiens
gttctacttcctgtctct

SEQ ID NO: 163985 - DNA, 20 bp, Homo sapiens
agccagtgagctttcctttt

SEQ ID NO: 163986 - DNA, 18 bp, Homo sapiens
atgtgtatatatatatgt

SEQ ID NO: 163987 - DNA, 22 bp, Homo sapiens
atatgctatgttatgtagtaag

SEQ ID NO: 163988 - DNA, 22 bp, Homo sapiens
cactctgtgtcctgcaagagct

SEQ ID NO: 163989 - DNA, 23 bp, Homo sapiens
ttcaccttgagcatgtcacagga

SEQ ID NO: 163990 - DNA, 23 bp, Homo sapiens
acagtctcactctgtcacccagg

SEQ ID NO: 163991 - DNA, 23 bp, Homo sapiens
gtgagagtctcgctctgtcaccc

SEQ ID NO: 163992 - DNA, 18 bp, Homo sapiens
tgaccttggctcactaca

SEQ ID NO: 163993 - DNA, 23 bp, Homo sapiens
agcctcagtttctctgtctgtta

SEQ ID NO: 163994 - DNA, 23 bp, Homo sapiens
tccctctcagtgtgaattcagga

SEQ ID NO: 163995 - DNA, 23 bp, Homo sapiens
accgagtctcgctctgtcaccca

SEQ ID NO: 163996 - DNA, 23 bp, Homo sapiens
aacattcaacctgtcggtgagtt

SEQ ID NO: 163997 - DNA, 22 bp, Homo sapiens
accatcgaccgttgagtggacc

SEQ ID NO: 163998 - DNA, 23 bp, Homo sapiens
acattcattgttgtcggtgggtt

SEQ ID NO: 163999 - DNA, 21 bp, Homo sapiens
atgaatgtcactgtggctggg

SEQ ID NO: 164000 - DNA, 21 bp, Homo sapiens
tacacgtatatatatgtgtat

SEQ ID NO: 164001 - DNA, 23 bp, Homo sapiens
tgtgtgcctctgtgtctcggcca

SEQ ID NO: 164002 - DNA, 20 bp, Homo sapiens
agctcagggtcagatcttgt

SEQ ID NO: 164003 - DNA, 23 bp, Homo sapiens
gacggagtctcactctgtcgctg

SEQ ID NO: 164004 - DNA, 18 bp, Homo sapiens
aggcatgagaattccttt

SEQ ID NO: 164005 - DNA, 23 bp, Homo sapiens
gagacggagtctcactctgtcac

SEQ ID NO: 164006 - DNA, 23 bp, Homo sapiens
cagtctcactgtgtcacccaggc

SEQ ID NO: 164007 - DNA, 23 bp, Homo sapiens
acagagtctcactctgtcgccca

SEQ ID NO: 164008 - DNA, 22 bp, Homo sapiens
caggagttttgagtctgcagtg

SEQ ID NO: 164009 - DNA, 23 bp, Homo sapiens
tgagaggtgacagtgtgctggca

SEQ ID NO: 164010 - DNA, 23 bp, Homo sapiens
tgagagaatctcactctgtcacc

SEQ ID NO: 164011 - DNA, 23 bp, Homo sapiens
tgagacagagtctcactctgtca

SEQ ID NO: 164012 - DNA, 22 bp, Homo sapiens
tgactgcctgactattctgaat

SEQ ID NO: 164013 - DNA, 23 bp, Homo sapiens
tggagtctcactctgtcacccag

SEQ ID NO: 164014 - DNA, 20 bp, Homo sapiens
tgtctgggtcctaatctcct

SEQ ID NO: 164015 - DNA, 23 bp, Homo sapiens
gagtctcactctgtcaccctggc

SEQ ID NO: 164016 - DNA, 23 bp, Homo sapiens
tttgagacagagtcttgttctgt

SEQ ID NO: 164017 - DNA, 22 bp, Homo sapiens
gtctcttcttatgctagggtgt

SEQ ID NO: 164018 - DNA, 20 bp, Homo sapiens
tgaagttgtgggggtggtct

SEQ ID NO: 164019 - DNA, 19 bp, Homo sapiens
tcagtgctcatcagtaaat

SEQ ID NO: 164020 - DNA, 23 bp, Homo sapiens
ttagaagcagcagtgatagaact

SEQ ID NO: 164021 - DNA, 23 bp, Homo sapiens
cggagtctcactctgtcacccag

SEQ ID NO: 164022 - DNA, 22 bp, Homo sapiens
tgtgtctgtgtagaaagaggta

SEQ ID NO: 164023 - DNA, 23 bp, Homo sapiens
ctgcctctctctgagcctcagtt

SEQ ID NO: 164024 - DNA, 23 bp, Homo sapiens
ctgagtttcaagagagtgagcag

SEQ ID NO: 164025 - DNA, 23 bp, Homo sapiens
gtccgtctgtctgtctatgatct

SEQ ID NO: 164026 - DNA, 23 bp, Homo sapiens
ctgtctgagatgagtcagtgctg

SEQ ID NO: 164027 - DNA, 19 bp, Homo sapiens
aggctatgctacaagtctc

SEQ ID NO: 164028 - DNA, 23 bp, Homo sapiens
gggtctcactctgtcacccaggc

SEQ ID NO: 164029 - DNA, 23 bp, Homo sapiens
gtctgggtcactgagtgagaccc

SEQ ID NO: 164030 - DNA, 23 bp, Homo sapiens
ccgagtctccctctgtcacccag

SEQ ID NO: 164031 - DNA, 23 bp, Homo sapiens
tttgacagggtcttactctgtgg

SEQ ID NO: 164032 - DNA, 23 bp, Homo sapiens
gggagtctcactctgtcacccag

SEQ ID NO: 164033 - DNA, 20 bp, Homo sapiens
tcagagtgtactgaggtgac

SEQ ID NO: 164034 - DNA, 23 bp, Homo sapiens
cacagtcagcatccaggtgtgac

SEQ ID NO: 164035 - DNA, 23 bp, Homo sapiens
tccctctcagcctctctcttcta

SEQ ID NO: 164036 - DNA, 22 bp, Homo sapiens
tgtctgtagtcttagctactca

SEQ ID NO: 164037 - DNA, 23 bp, Homo sapiens
cagagtctcactctgtcacccag

SEQ ID NO: 164038 - DNA, 23 bp, Homo sapiens
gtctcactgtgtcactcaggctg

SEQ ID NO: 164039 - DNA, 18 bp, Homo sapiens
tgagatggagtctcactc

SEQ ID NO: 164040 - DNA, 23 bp, Homo sapiens
gacagagtctcgctctgtcaccc

SEQ ID NO: 164041 - DNA, 21 bp, Homo sapiens
tctgaccctgagtcactccca

SEQ ID NO: 164042 - DNA, 22 bp, Homo sapiens
aaacagagtttctctctgtctc

SEQ ID NO: 164043 - DNA, 18 bp, Homo sapiens
aaagtgaaactctgtctc

SEQ ID NO: 164044 - DNA, 23 bp, Homo sapiens
agggtctcactctgtcacccagg

SEQ ID NO: 164045 - DNA, 23 bp, Homo sapiens
gagacagtctcactctgtcgccc

SEQ ID NO: 164046 - DNA, 19 bp, Homo sapiens
tgagacagagtctcactct

SEQ ID NO: 164047 - DNA, 23 bp, Homo sapiens
acagagtctccctctgtcaccca

SEQ ID NO: 164048 - DNA, 23 bp, Homo sapiens
gctgtctccctgcctgtttgcca

SEQ ID NO: 164049 - DNA, 23 bp, Homo sapiens
tctgagtcagagtctcgctctgt

SEQ ID NO: 164050 - DNA, 23 bp, Homo sapiens
ttcccagtggcactaacaggtaa

SEQ ID NO: 164051 - DNA, 21 bp, Homo sapiens
gctcacacagcctctgtggct

SEQ ID NO: 164052 - DNA, 23 bp, Homo sapiens
tgagacaagggtctctgtctcag

SEQ ID NO: 164053 - DNA, 23 bp, Homo sapiens
gacagagtctccctctgtcaccc

SEQ ID NO: 164054 - DNA, 23 bp, Homo sapiens
gacagagtctcgctctgtcaccc

SEQ ID NO: 164055 - DNA, 23 bp, Homo sapiens
cggagtctcactctgtcacccag

SEQ ID NO: 164056 - DNA, 21 bp, Homo sapiens
tctctcagtgtctctgtctgt

SEQ ID NO: 164057 - DNA, 23 bp, Homo sapiens
tccctgcgtccgtgtgtccgtcc

SEQ ID NO: 164058 - DNA, 19 bp, Homo sapiens
agagaggggtattgagcgt

SEQ ID NO: 164059 - DNA, 23 bp, Homo sapiens
tgagactgagtctcacactgtcg

SEQ ID NO: 164060 - DNA, 23 bp, Homo sapiens
cggagtctcactctgtcacccag

SEQ ID NO: 164061 - DNA, 19 bp, Homo sapiens
atattttctttttcttttc

SEQ ID NO: 164062 - DNA, 23 bp, Homo sapiens
agagtctcactctgtcatctagg

SEQ ID NO: 164063 - DNA, 23 bp, Homo sapiens
ttttgtttgtttttgagacagag

SEQ ID NO: 164064 - DNA, 23 bp, Homo sapiens
acagagtctcgctctgtcaccca

SEQ ID NO: 164065 - DNA, 23 bp, Homo sapiens
tgtgagcctgtctgtctcggtca

SEQ ID NO: 164066 - DNA, 23 bp, Homo sapiens
agagtctcactctgtcacccagg

SEQ ID NO: 164067 - DNA, 23 bp, Homo sapiens
tgagtctcactctgtcatccagc

SEQ ID NO: 164068 - DNA, 20 bp, Homo sapiens
cattgtactccagcctgggt

SEQ ID NO: 164069 - DNA, 23 bp, Homo sapiens
ttttgagacagggtctcattctg

SEQ ID NO: 164070 - DNA, 23 bp, Homo sapiens
agagtctcactctgtcacccagg

SEQ ID NO: 164071 - DNA, 23 bp, Homo sapiens
gtctctgtgtgtctctgagtgtc

SEQ ID NO: 164072 - DNA, 23 bp, Homo sapiens
cggctcactcagtctctttgggc

SEQ ID NO: 164073 - DNA, 23 bp, Homo sapiens
ctctgtggctggctctctgagta

SEQ ID NO: 164074 - DNA, 23 bp, Homo sapiens
gagtctcactctgtctccgaggc

SEQ ID NO: 164075 - DNA, 18 bp, Homo sapiens
tgcaacatctgcctccag

SEQ ID NO: 164076 - DNA, 23 bp, Homo sapiens
cggagtctcgctctgtctcccag

SEQ ID NO: 164077 - DNA, 23 bp, Homo sapiens
tatagaatctcattatgttgttc

SEQ ID NO: 164078 - DNA, 23 bp, Homo sapiens
aaagaaaccaggagttggcaatt

SEQ ID NO: 164079 - DNA, 22 bp, Homo sapiens
tatgtatatatatatatgtgtg

SEQ ID NO: 164080 - DNA, 23 bp, Homo sapiens
atatctatatctatatatgttta

SEQ ID NO: 164081 - DNA, 21 bp, Homo sapiens
tgtattttgtatacataagta

SEQ ID NO: 164082 - DNA, 23 bp, Homo sapiens
tatgtgtttgtcttcctatgtat

SEQ ID NO: 164083 - DNA, 18 bp, Homo sapiens
tatatctagatatgtcaa

SEQ ID NO: 164084 - DNA, 19 bp, Homo sapiens
agctggggtcccacaggca

SEQ ID NO: 164085 - DNA, 23 bp, Homo sapiens
ggcagagcttgtagtgagctgaa

SEQ ID NO: 164086 - DNA, 22 bp, Homo sapiens
gtgtagcaatgactgggtctgt

SEQ ID NO: 164087 - DNA, 18 bp, Homo sapiens
tgcaaaataatagaattt

SEQ ID NO: 164088 - DNA, 21 bp, Homo sapiens
aacagagaagtatctgtgcag

SEQ ID NO: 164089 - DNA, 18 bp, Homo sapiens
tttctagttgacataaca

SEQ ID NO: 164090 - DNA, 23 bp, Homo sapiens
tttttggttccatatgaaattta

SEQ ID NO: 164091 - DNA, 23 bp, Homo sapiens
gtcagtgggtctctccctgtgtg

SEQ ID NO: 164092 - DNA, 19 bp, Homo sapiens
tatggatatatatggatat

SEQ ID NO: 164093 - DNA, 21 bp, Homo sapiens
aatgtgtatatatatatgata

SEQ ID NO: 164094 - DNA, 21 bp, Homo sapiens
tttgcatatatatatgataat

SEQ ID NO: 164095 - DNA, 21 bp, Homo sapiens
tagactgtcactctttacttt

SEQ ID NO: 164096 - DNA, 23 bp, Homo sapiens
aatcagttgtatgcactttgcaa

SEQ ID NO: 164097 - DNA, 22 bp, Homo sapiens
agaggagctgctaactagaata

SEQ ID NO: 164098 - DNA, 23 bp, Homo sapiens
acagagtctcgctctgtcaccca

SEQ ID NO: 164099 - DNA, 18 bp, Homo sapiens
tgtgtgaggaaatgttac

SEQ ID NO: 164100 - DNA, 23 bp, Homo sapiens
ctcccagagcccctggaactctg

SEQ ID NO: 164101 - DNA, 23 bp, Homo sapiens
tcccagagcccctggaactctgg

SEQ ID NO: 164102 - DNA, 23 bp, Homo sapiens
tcccagagcccctggaactctgg

SEQ ID NO: 164103 - DNA, 23 bp, Homo sapiens
tcccagagcccctggaactctgg

SEQ ID NO: 164104 - DNA, 23 bp, Homo sapiens
gagtctcactctgtgtcccaggc

SEQ ID NO: 164105 - DNA, 23 bp, Homo sapiens
cattgttctgtgattccagatct

SEQ ID NO: 164106 - DNA, 23 bp, Homo sapiens
ctgaaaacttagagaaaaggagt

SEQ ID NO: 164107 - DNA, 21 bp, Homo sapiens
tctgtgtagaaagaagtagac

SEQ ID NO: 164108 - DNA, 23 bp, Homo sapiens
ggctcaagtctggaaattgattg

SEQ ID NO: 164109 - DNA, 22 bp, Homo sapiens
tatatgtatatatatgtgtgtg

SEQ ID NO: 164110 - DNA, 22 bp, Homo sapiens
gtatgtatatacgtatgtatac

SEQ ID NO: 164111 - DNA, 23 bp, Homo sapiens
tctttctgtccctctctccatcg

SEQ ID NO: 164112 - DNA, 23 bp, Homo sapiens
tgagatggagtctcactctgtca

SEQ ID NO: 164113 - DNA, 22 bp, Homo sapiens
aagtgggtggctgtgttcaatg

SEQ ID NO: 164114 - DNA, 19 bp, Homo sapiens
tacttgtttcatataatga

SEQ ID NO: 164115 - DNA, 21 bp, Homo sapiens
tcagtagaattagtaccagtt

SEQ ID NO: 164116 - DNA, 23 bp, Homo sapiens
taacaatgtatttgtatttctga

SEQ ID NO: 164117 - DNA, 23 bp, Homo sapiens
aatgctaaaacattgtcatgtgc

SEQ ID NO: 164118 - DNA, 23 bp, Homo sapiens
cattattgtcattaagttgaaga

SEQ ID NO: 164119 - DNA, 22 bp, Homo sapiens
aatgctcattaaggagcagatt

SEQ ID NO: 164120 - DNA, 23 bp, Homo sapiens
cagtgtacatggcaaagtaatca

SEQ ID NO: 164121 - DNA, 19 bp, Homo sapiens
aattgtgctaggtaaggag

SEQ ID NO: 164122 - DNA, 23 bp, Homo sapiens
agtctctttcactgtgatatgtc

SEQ ID NO: 164123 - DNA, 21 bp, Homo sapiens
atttctcagaaactgctttgt

SEQ ID NO: 164124 - DNA, 23 bp, Homo sapiens
aaactgcttcatgatgtgtgcat

SEQ ID NO: 164125 - DNA, 19 bp, Homo sapiens
agcagctttggaacagtgt

SEQ ID NO: 164126 - DNA, 18 bp, Homo sapiens
tgagaaactgctttgtga

SEQ ID NO: 164127 - DNA, 23 bp, Homo sapiens
tcacagctcagtcacagtcacta

SEQ ID NO: 164128 - DNA, 23 bp, Homo sapiens
gcaagactgagaactgacatgga

SEQ ID NO: 164129 - DNA, 23 bp, Homo sapiens
gcacacagtcaccacacttgctg

SEQ ID NO: 164130 - DNA, 23 bp, Homo sapiens
gcctctgtcagtcagtttgttct

SEQ ID NO: 164131 - DNA, 23 bp, Homo sapiens
ggcagtgacactctggctcagtg

SEQ ID NO: 164132 - DNA, 22 bp, Homo sapiens
taactctcagaggtcatcagga

SEQ ID NO: 164133 - DNA, 23 bp, Homo sapiens
tcaccctcacactctgtgtctta

SEQ ID NO: 164134 - DNA, 23 bp, Homo sapiens
atatgtatatatgtatatgtatg

SEQ ID NO: 164135 - DNA, 23 bp, Homo sapiens
atatgtgtatatgtatatgtatg

SEQ ID NO: 164136 - DNA, 23 bp, Homo sapiens
atatgtgtatatgtatatgtatg

SEQ ID NO: 164137 - DNA, 23 bp, Homo sapiens
atatgtgtatatgtatatgtatg

SEQ ID NO: 164138 - DNA, 23 bp, Homo sapiens
atatgtgtatatgtatatgtatg

SEQ ID NO: 164139 - DNA, 23 bp, Homo sapiens
atatgtgtatatgtatatgtatg

SEQ ID NO: 164140 - DNA, 23 bp, Homo sapiens
tatagtgtatatgtatatgtatg

SEQ ID NO: 164141 - DNA, 23 bp, Homo sapiens
tatagtgtatatgtatatgtatg

SEQ ID NO: 164142 - DNA, 23 bp, Homo sapiens
tatagtgtatatgtatatgtatg

SEQ ID NO: 164143 - DNA, 23 bp, Homo sapiens
tatgtgtatatgtatatgtatgt

SEQ ID NO: 164144 - DNA, 21 bp, Homo sapiens
acagcttttgctttgttattc

SEQ ID NO: 164145 - DNA, 20 bp, Homo sapiens
tataatcaagcatttcagct

SEQ ID NO: 164146 - DNA, 23 bp, Homo sapiens
tgtctgactgtcttagagctggg

SEQ ID NO: 164147 - DNA, 21 bp, Homo sapiens
tgtgtatatatatatatgtgt

SEQ ID NO: 164148 - DNA, 23 bp, Homo sapiens
tctgactctgactctctgaggcg

SEQ ID NO: 164149 - DNA, 23 bp, Homo sapiens
tgtgtgtgtatctgtgtgtgtct

SEQ ID NO: 164150 - DNA, 23 bp, Homo sapiens
tcacagtcactcagggccagtct

SEQ ID NO: 164151 - DNA, 22 bp, Homo sapiens
tggatgggtggctggatgaatg

SEQ ID NO: 164152 - DNA, 23 bp, Homo sapiens
tgagttcattgtagattctggat

SEQ ID NO: 164153 - DNA, 23 bp, Homo sapiens
tgagttcattgtagattctggat

SEQ ID NO: 164154 - DNA, 23 bp, Homo sapiens
tgtctgcctcagtcccagacact

SEQ ID NO: 164155 - DNA, 22 bp, Homo sapiens
tctgagtgcatcctgaaagcgt

SEQ ID NO: 164156 - DNA, 23 bp, Homo sapiens
atagtgatgatggtggtgatatt

SEQ ID NO: 164157 - DNA, 23 bp, Homo sapiens
atgacgacgatgatgatggtgat

SEQ ID NO: 164158 - DNA, 23 bp, Homo sapiens
tgagttcattgtagattctggat

SEQ ID NO: 164159 - DNA, 23 bp, Homo sapiens
tgagttcattgtagattctggat

SEQ ID NO: 164160 - DNA, 23 bp, Homo sapiens
ttcttggtgctgtctctgtgttt

SEQ ID NO: 164161 - DNA, 19 bp, Homo sapiens
ttgagacatcatagattgc

SEQ ID NO: 164162 - DNA, 23 bp, Homo sapiens
gtctgtctctgtgctttccatgt

SEQ ID NO: 164163 - DNA, 21 bp, Homo sapiens
ctgtgccagtcagtctctctc

SEQ ID NO: 164164 - DNA, 22 bp, Homo sapiens
gaagctgtcagtctgtggctct

SEQ ID NO: 164165 - DNA, 21 bp, Homo sapiens
tatgtgtatatcaatatatgt

SEQ ID NO: 164166 - DNA, 20 bp, Homo sapiens
ggaactcactcactctgtcc

SEQ ID NO: 164167 - DNA, 20 bp, Homo sapiens
tctctcttgttcccactctc

SEQ ID NO: 164168 - DNA, 23 bp, Homo sapiens
aattactgtggtaatcaaggtta

SEQ ID NO: 164169 - DNA, 18 bp, Homo sapiens
catcatatatatacatgt

SEQ ID NO: 164170 - DNA, 23 bp, Homo sapiens
cgctctctgcttcattaaactgc

SEQ ID NO: 164171 - DNA, 21 bp, Homo sapiens
atgagaggatgcatctaagag

SEQ ID NO: 164172 - DNA, 23 bp, Homo sapiens
agacagaagacagagtgttcatc

SEQ ID NO: 164173 - DNA, 23 bp, Homo sapiens
agtgtctcttgcagttttctctt

SEQ ID NO: 164174 - DNA, 18 bp, Homo sapiens
tacattatgtttgtgtac

SEQ ID NO: 164175 - DNA, 23 bp, Homo sapiens
tgagatggagtctctctctgtcg

SEQ ID NO: 164176 - DNA, 23 bp, Homo sapiens
gcaagagcaagtagataggacta

SEQ ID NO: 164177 - DNA, 21 bp, Homo sapiens
tgtatatgaaatgtttagtgt

SEQ ID NO: 164178 - DNA, 21 bp, Homo sapiens
tgtgtccctcagactgtccca

SEQ ID NO: 164179 - DNA, 22 bp, Homo sapiens
tgacacactcacagtcactagt

SEQ ID NO: 164180 - DNA, 23 bp, Homo sapiens
tcatctagacgttgcataaggta

SEQ ID NO: 164181 - DNA, 21 bp, Homo sapiens
atatatgtgtgtacatgatgg

SEQ ID NO: 164182 - DNA, 23 bp, Homo sapiens
tggagtctcactctgtcacccag

SEQ ID NO: 164183 - DNA, 23 bp, Homo sapiens
tgcctgtgtctgtgcctcagtgc

SEQ ID NO: 164184 - DNA, 20 bp, Homo sapiens
tctgtgtgtgtatttgtgtg

SEQ ID NO: 164185 - DNA, 22 bp, Homo sapiens
catgtgactgtgtttcctgacc

SEQ ID NO: 164186 - DNA, 20 bp, Homo sapiens
tgtgtgtagagtgtgtgctc

SEQ ID NO: 164187 - DNA, 23 bp, Homo sapiens
gagacagagtctcactctgtcat

SEQ ID NO: 164188 - DNA, 23 bp, Homo sapiens
tgtagtctcactctgtcacccag

SEQ ID NO: 164189 - DNA, 21 bp, Homo sapiens
tgcattgagccatgattgtgc

SEQ ID NO: 164190 - DNA, 23 bp, Homo sapiens
tacatggttgtatacatttgtca

SEQ ID NO: 164191 - DNA, 18 bp, Homo sapiens
attatgcctcaataagtt

SEQ ID NO: 164192 - DNA, 23 bp, Homo sapiens
aatggagtctcactcagtctgtc

SEQ ID NO: 164193 - DNA, 23 bp, Homo sapiens
taagaaggacagcctcacttctg

SEQ ID NO: 164194 - DNA, 23 bp, Homo sapiens
tggagtctcactctgtcacccag

SEQ ID NO: 164195 - DNA, 22 bp, Homo sapiens
ttccgagtagctgggattacag

SEQ ID NO: 164196 - DNA, 20 bp, Homo sapiens
agtacaggggatttagttgt

SEQ ID NO: 164197 - DNA, 23 bp, Homo sapiens
aaaagtgtgttttagttcttgag

SEQ ID NO: 164198 - DNA, 21 bp, Homo sapiens
tttgaggaaatatattgattt

SEQ ID NO: 164199 - DNA, 22 bp, Homo sapiens
ctgcctctgtctctgcctctgt

SEQ ID NO: 164200 - DNA, 22 bp, Homo sapiens
ttttagaggatgacatttcaac

SEQ ID NO: 164201 - DNA, 19 bp, Homo sapiens
tttattcagtatgattttg

SEQ ID NO: 164202 - DNA, 22 bp, Homo sapiens
aggtgaggatacttgtgtgcca

SEQ ID NO: 164203 - DNA, 23 bp, Homo sapiens
tatgtgcatgtatatatacacat

SEQ ID NO: 164204 - DNA, 22 bp, Homo sapiens
agtatgtgcatatatatacatg

SEQ ID NO: 164205 - DNA, 23 bp, Homo sapiens
taggatatgctgggttagtggtc

SEQ ID NO: 164206 - DNA, 23 bp, Homo sapiens
tgtgtcactgtaagttacctgtg

SEQ ID NO: 164207 - DNA, 23 bp, Homo sapiens
gtgggtccctctctctgtggctc

SEQ ID NO: 164208 - DNA, 19 bp, Homo sapiens
agcagagctggcttctcac

SEQ ID NO: 164209 - DNA, 20 bp, Homo sapiens
tctgtcgctgactttgcctt

SEQ ID NO: 164210 - DNA, 23 bp, Homo sapiens
tctctgtgactgtatctgctctt

SEQ ID NO: 164211 - DNA, 23 bp, Homo sapiens
tggagtctcactctgtcacccag

SEQ ID NO: 164212 - DNA, 23 bp, Homo sapiens
actgttgtccttattttatcttt

SEQ ID NO: 164213 - DNA, 21 bp, Homo sapiens
gtgtgcctctggtttcagctt

SEQ ID NO: 164214 - DNA, 23 bp, Homo sapiens
ggctgaggtaggaggatcacttg

SEQ ID NO: 164215 - DNA, 22 bp, Homo sapiens
tggcttactcctgtaattccag

SEQ ID NO: 164216 - DNA, 23 bp, Homo sapiens
tattgctgtacttggaatggact

SEQ ID NO: 164217 - DNA, 22 bp, Homo sapiens
atgccctgagcttttctagaga

SEQ ID NO: 164218 - DNA, 23 bp, Homo sapiens
agagtctcactctgtcacccagg

SEQ ID NO: 164219 - DNA, 23 bp, Homo sapiens
agatggagtctcactctgtcacc

SEQ ID NO: 164220 - DNA, 23 bp, Homo sapiens
cggagtctcgctctgtcgctcag

SEQ ID NO: 164221 - DNA, 23 bp, Homo sapiens
gacagagtctcgctctgtcaccc

SEQ ID NO: 164222 - DNA, 22 bp, Homo sapiens
acagtctctctatctttgtgct

SEQ ID NO: 164223 - DNA, 23 bp, Homo sapiens
ttgttgactatttgtatttgtga

SEQ ID NO: 164224 - DNA, 22 bp, Homo sapiens
tctcactctgtcactcaggctg

SEQ ID NO: 164225 - DNA, 23 bp, Homo sapiens
agacagagtctcactctgtcatc

SEQ ID NO: 164226 - DNA, 23 bp, Homo sapiens
tgagtctcactctgtcacccagg

SEQ ID NO: 164227 - DNA, 23 bp, Homo sapiens
tccgtctgtccatccatctgtct

SEQ ID NO: 164228 - DNA, 19 bp, Homo sapiens
gagctggagacattattct

SEQ ID NO: 164229 - DNA, 22 bp, Homo sapiens
tttgtttttgttttgggacaga

SEQ ID NO: 164230 - DNA, 23 bp, Homo sapiens
gagtcttgctctgtccccaggct

SEQ ID NO: 164231 - DNA, 21 bp, Homo sapiens
tcactgcagtctgtgtctccc

SEQ ID NO: 164232 - DNA, 23 bp, Homo sapiens
tctgtcactgtctctcatcaccc

SEQ ID NO: 164233 - DNA, 23 bp, Homo sapiens
tgagggtctctctgtctctgaat

SEQ ID NO: 164234 - DNA, 22 bp, Homo sapiens
tctgcgtctcggtctccctctc

SEQ ID NO: 164235 - DNA, 23 bp, Homo sapiens
aggcagaggttgcagtgagttga

SEQ ID NO: 164236 - DNA, 21 bp, Homo sapiens
acagaagtgagccaccacact

SEQ ID NO: 164237 - DNA, 23 bp, Homo sapiens
cctgctgtctctctgtccctcgg

SEQ ID NO: 164238 - DNA, 23 bp, Homo sapiens
agacagagtctcactctgtcacc

SEQ ID NO: 164239 - DNA, 21 bp, Homo sapiens
gatctctgaaaaccatgggct

SEQ ID NO: 164240 - DNA, 22 bp, Homo sapiens
tgacaacatatctatgactggg

SEQ ID NO: 164241 - DNA, 23 bp, Homo sapiens
acaaggtctcgctctgtcactca

SEQ ID NO: 164242 - DNA, 23 bp, Homo sapiens
tctctctgcctcagtgtcttcct

SEQ ID NO: 164243 - DNA, 23 bp, Homo sapiens
agagtctcactctgtcacccagg

SEQ ID NO: 164244 - DNA, 23 bp, Homo sapiens
gagtctcactctgtcacccaggc

SEQ ID NO: 164245 - DNA, 23 bp, Homo sapiens
agactgtgcctcactcagtcact

SEQ ID NO: 164246 - DNA, 19 bp, Homo sapiens
aagtgcctgtgaaagcatg

SEQ ID NO: 164247 - DNA, 22 bp, Homo sapiens
tgagatggagtctcactctgtc

SEQ ID NO: 164248 - DNA, 22 bp, Homo sapiens
gtagtctcagctattcaggagg

SEQ ID NO: 164249 - DNA, 18 bp, Homo sapiens
agtgagctatgattgcac

SEQ ID NO: 164250 - DNA, 21 bp, Homo sapiens
gcatagtattccattgtgtgt

SEQ ID NO: 164251 - DNA, 20 bp, Homo sapiens
tatacctacacacacaatgg

SEQ ID NO: 164252 - DNA, 22 bp, Homo sapiens
tcagaagagactcagcacattc

SEQ ID NO: 164253 - DNA, 20 bp, Homo sapiens
agggagtgaggacagctggt

SEQ ID NO: 164254 - DNA, 23 bp, Homo sapiens
tctgactctgacagtcttcacaa

SEQ ID NO: 164255 - DNA, 23 bp, Homo sapiens
tgagatggagtctctctcagtca

SEQ ID NO: 164256 - DNA, 23 bp, Homo sapiens
tttgtgtctggttcgagtgactg

SEQ ID NO: 164257 - DNA, 21 bp, Homo sapiens
ggtgtgtctctctgtgtgtct

SEQ ID NO: 164258 - DNA, 18 bp, Homo sapiens
cagtggtatgatctcagc

SEQ ID NO: 164259 - DNA, 23 bp, Homo sapiens
tggctcacacctgtaatcccagc

SEQ ID NO: 164260 - DNA, 23 bp, Homo sapiens
tgagacagagtctcgctctgtca

SEQ ID NO: 164261 - DNA, 23 bp, Homo sapiens
agatggagtctcactctgtcacc

SEQ ID NO: 164262 - DNA, 22 bp, Homo sapiens
gtctaggaatgtgtgtgtgtgt

SEQ ID NO: 164263 - DNA, 23 bp, Homo sapiens
atgaacatctacttcagcatgtg

SEQ ID NO: 164264 - DNA, 23 bp, Homo sapiens
tggcagaagtcagcgtgctcaga

SEQ ID NO: 164265 - DNA, 23 bp, Homo sapiens
agatggagtctcactctgtcacc

SEQ ID NO: 164266 - DNA, 19 bp, Homo sapiens
tctcactctgtcacccagg

SEQ ID NO: 164267 - DNA, 21 bp, Homo sapiens
gattggattatgagcttggag

SEQ ID NO: 164268 - DNA, 23 bp, Homo sapiens
agcttttataatgccactgtaca

SEQ ID NO: 164269 - DNA, 22 bp, Homo sapiens
tggctagtgattttgaacatct

SEQ ID NO: 164270 - DNA, 18 bp, Homo sapiens
agatgggagaaatacagc

SEQ ID NO: 164271 - DNA, 18 bp, Homo sapiens
tcactgtttttctgtctc

SEQ ID NO: 164272 - DNA, 21 bp, Homo sapiens
cactacacccagctctgctta

SEQ ID NO: 164273 - DNA, 23 bp, Homo sapiens
cggagtctcactctgtcacccag

SEQ ID NO: 164274 - DNA, 23 bp, Homo sapiens
gagtctcactctgtcacccaggc

SEQ ID NO: 164275 - DNA, 21 bp, Homo sapiens
tgagtacatgacctaaggatg

SEQ ID NO: 164276 - DNA, 22 bp, Homo sapiens
tgtctccatccttgtgtgtctg

SEQ ID NO: 164277 - DNA, 23 bp, Homo sapiens
tctgcctcagtttcctaatgtgt

SEQ ID NO: 164278 - DNA, 23 bp, Homo sapiens
tggagtctcactctgtcacccag

SEQ ID NO: 164279 - DNA, 23 bp, Homo sapiens
catctgtgtccctgtctgtcacc

SEQ ID NO: 164280 - DNA, 23 bp, Homo sapiens
cggagtctcactctgtcacccag

SEQ ID NO: 164281 - DNA, 23 bp, Homo sapiens
gagtctcactctgtcacccaggc

SEQ ID NO: 164282 - DNA, 23 bp, Homo sapiens
tgggtctgtgcctctgcgcctcc

SEQ ID NO: 164283 - DNA, 18 bp, Homo sapiens
agggagtgtgttccctgc

SEQ ID NO: 164284 - DNA, 21 bp, Homo sapiens
tctctgtgtcagtcaccccta

SEQ ID NO: 164285 - DNA, 23 bp, Homo sapiens
tcatgtctctctgtcaccaggtt

SEQ ID NO: 164286 - DNA, 23 bp, Homo sapiens
gtgtgtgtgtgcgtgtcagtgtg

SEQ ID NO: 164287 - DNA, 23 bp, Homo sapiens
tctctatgtgacactcactctgg

SEQ ID NO: 164288 - DNA, 22 bp, Homo sapiens
catgaccacctgctggtgtctg

SEQ ID NO: 164289 - DNA, 23 bp, Homo sapiens
agtccctctctcactgggtggcc

SEQ ID NO: 164290 - DNA, 23 bp, Homo sapiens
gtctcactctctctctcactcag

SEQ ID NO: 164291 - DNA, 21 bp, Homo sapiens
tgcaatggtatgatctcagct

SEQ ID NO: 164292 - DNA, 23 bp, Homo sapiens
gagtctcactctgtcacccaggc

SEQ ID NO: 164293 - DNA, 23 bp, Homo sapiens
ctgtgcctctctcagaactgtgc

SEQ ID NO: 164294 - DNA, 23 bp, Homo sapiens
tctgggtgtgtccctgtgtgtgt

SEQ ID NO: 164295 - DNA, 23 bp, Homo sapiens
gtatgtgtgtagaggctacaacc

SEQ ID NO: 164296 - DNA, 23 bp, Homo sapiens
tctgcctgtccctcggtctgtca

SEQ ID NO: 164297 - DNA, 23 bp, Homo sapiens
tgagtgctaggaaggctgtgtgt

SEQ ID NO: 164298 - DNA, 21 bp, Homo sapiens
agacagggtctctctctgtca

SEQ ID NO: 164299 - DNA, 23 bp, Homo sapiens
cacatgtctcactgtagcctcga

SEQ ID NO: 164300 - DNA, 21 bp, Homo sapiens
tctctgtgtcacattctggta

SEQ ID NO: 164301 - DNA, 23 bp, Homo sapiens
tgatctctggtgttactattgtg

SEQ ID NO: 164302 - DNA, 20 bp, Homo sapiens
agactaaactgggtgtggtg

SEQ ID NO: 164303 - DNA, 23 bp, Homo sapiens
tagagtctcactctgtctcccag

SEQ ID NO: 164304 - DNA, 23 bp, Homo sapiens
actctgacagcccctctctgtgt

SEQ ID NO: 164305 - DNA, 21 bp, Homo sapiens
cggagtttgagtgtggtctgt

SEQ ID NO: 164306 - DNA, 22 bp, Homo sapiens
gctgactccctcgctctctgtg

SEQ ID NO: 164307 - DNA, 23 bp, Homo sapiens
acttagtgccctgcctttctctc

SEQ ID NO: 164308 - DNA, 18 bp, Homo sapiens
ccagatgtcactgcacct

SEQ ID NO: 164309 - DNA, 23 bp, Homo sapiens
acaagtcattttcattttctcac

SEQ ID NO: 164310 - DNA, 23 bp, Homo sapiens
tgagttcattgtagattctggat

SEQ ID NO: 164311 - DNA, 23 bp, Homo sapiens
tgagttcattgtagattctggat

SEQ ID NO: 164312 - DNA, 23 bp, Homo sapiens
gtatatgtgtatatatgtatatg

SEQ ID NO: 164313 - DNA, 23 bp, Homo sapiens
ctgacaggaagccagaagtctct

SEQ ID NO: 164314 - DNA, 23 bp, Homo sapiens
gtgcctctgtgtgtccctccgtc

SEQ ID NO: 164315 - DNA, 22 bp, Homo sapiens
tgcctgacaggaagccagaagt

SEQ ID NO: 164316 - DNA, 23 bp, Homo sapiens
acaagtcattttcattttctcac

SEQ ID NO: 164317 - DNA, 23 bp, Homo sapiens
aagacacaggaccagcagtcata

SEQ ID NO: 164318 - DNA, 22 bp, Homo sapiens
tgactggagaatgtgagctcta

SEQ ID NO: 164319 - DNA, 20 bp, Homo sapiens
gtatatatgtatatgtgtgt

SEQ ID NO: 164320 - DNA, 22 bp, Homo sapiens
actgtctcagtcataattttgc

SEQ ID NO: 164321 - DNA, 21 bp, Homo sapiens
tccgtgtgaagagaccaccaa

SEQ ID NO: 164322 - DNA, 23 bp, Homo sapiens
gtgagcaacatggttgtttattt

SEQ ID NO: 164323 - DNA, 23 bp, Homo sapiens
gtgagcaacatggttgtttattt

SEQ ID NO: 164324 - DNA, 20 bp, Homo sapiens
ttctgaatccttggttaagg

SEQ ID NO: 164325 - DNA, 23 bp, Homo sapiens
gtcaggcagactctgtccctcag

SEQ ID NO: 164326 - DNA, 23 bp, Homo sapiens
agagtctctgtgtgtctgggcct

SEQ ID NO: 164327 - DNA, 23 bp, Homo sapiens
ctgacttctctcactctgtccta

SEQ ID NO: 164328 - DNA, 23 bp, Homo sapiens
gacagagtctcgctctgtcaccc

SEQ ID NO: 164329 - DNA, 23 bp, Homo sapiens
cactgtcacgttctctgtctgta

SEQ ID NO: 164330 - DNA, 21 bp, Homo sapiens
ctctgcctctgactcaccttg

SEQ ID NO: 164331 - DNA, 23 bp, Homo sapiens
tgagttcattgtagattctggat

SEQ ID NO: 164332 - DNA, 23 bp, Homo sapiens
tgagttcattgtagattctggat

SEQ ID NO: 164333 - DNA, 23 bp, Homo sapiens
cagtctgtctgtccctgtcctga

SEQ ID NO: 164334 - DNA, 23 bp, Homo sapiens
actgagtctccctctgtctccca

SEQ ID NO: 164335 - DNA, 23 bp, Homo sapiens
agtgaatctctgtctgtctgtct

SEQ ID NO: 164336 - DNA, 19 bp, Homo sapiens
tcacagtgctttgggaggc

SEQ ID NO: 164337 - DNA, 23 bp, Homo sapiens
tgaatgtttgtctctctgtcatt

SEQ ID NO: 164338 - DNA, 18 bp, Homo sapiens
aacagagaggctcaaaga

SEQ ID NO: 164339 - DNA, 22 bp, Homo sapiens
tctctcagtttctgtctctgag

SEQ ID NO: 164340 - DNA, 22 bp, Homo sapiens
gtttggctctctgagtctctct

SEQ ID NO: 164341 - DNA, 23 bp, Homo sapiens
agagtctcactctgtcacccagg

SEQ ID NO: 164342 - DNA, 20 bp, Homo sapiens
aacctgctgtgtgagatctg

SEQ ID NO: 164343 - DNA, 23 bp, Homo sapiens
gtgtctctctcagcctcagtttc

SEQ ID NO: 164344 - DNA, 23 bp, Homo sapiens
actgagtctcgctctgtcaccca

SEQ ID NO: 164345 - DNA, 18 bp, Homo sapiens
agcagggttgattgagcc

SEQ ID NO: 164346 - DNA, 22 bp, Homo sapiens
tgcagtgagtcttgattgcacc

SEQ ID NO: 164347 - DNA, 21 bp, Homo sapiens
agacaagagtctcactctgtt

SEQ ID NO: 164348 - DNA, 18 bp, Homo sapiens
tgaggtaggaggatcact

SEQ ID NO: 164349 - DNA, 23 bp, Homo sapiens
tctctctctgtcacagaggctgg

SEQ ID NO: 164350 - DNA, 18 bp, Homo sapiens
tctcgctctgtcacccag

SEQ ID NO: 164351 - DNA, 23 bp, Homo sapiens
gagacagtgtctcactctgtcac

SEQ ID NO: 164352 - DNA, 23 bp, Homo sapiens
aggatcacttgagtccaggaggt

SEQ ID NO: 164353 - DNA, 19 bp, Homo sapiens
tcagttgtgtgggtgcaga

SEQ ID NO: 164354 - DNA, 18 bp, Homo sapiens
agtggaatgttgtgaggg

SEQ ID NO: 164355 - DNA, 20 bp, Homo sapiens
cagagtctctctgtgtcacc

SEQ ID NO: 164356 - DNA, 20 bp, Homo sapiens
tttttagtagagaaggggtt

SEQ ID NO: 164357 - DNA, 23 bp, Homo sapiens
agagtctcactctgtcacccagg

SEQ ID NO: 164358 - DNA, 23 bp, Homo sapiens
tctcccagtctctgtccctccct

SEQ ID NO: 164359 - DNA, 23 bp, Homo sapiens
gttgagtctcactctgtcaccca

SEQ ID NO: 164360 - DNA, 23 bp, Homo sapiens
gagacagagtctcactctgtcac

SEQ ID NO: 164361 - DNA, 23 bp, Homo sapiens
ctatgtgtgtctctgtgagtccg

SEQ ID NO: 164362 - DNA, 23 bp, Homo sapiens
gagtctcactctgtcacccaggc

SEQ ID NO: 164363 - DNA, 18 bp, Homo sapiens
tacacagtggtgcgatct

SEQ ID NO: 164364 - DNA, 20 bp, Homo sapiens
aaaatgttgctgctgctgtt

SEQ ID NO: 164365 - DNA, 22 bp, Homo sapiens
tttggtatttttagtagagaca

SEQ ID NO: 164366 - DNA, 23 bp, Homo sapiens
ttgtgtatgtgcatgtatatgtg

SEQ ID NO: 164367 - DNA, 23 bp, Homo sapiens
tgagttcattgtagattctggat

SEQ ID NO: 164368 - DNA, 23 bp, Homo sapiens
tgagttcattgtagattctggat

SEQ ID NO: 164369 - DNA, 18 bp, Homo sapiens
tgtctctgggtgtatcca

SEQ ID NO: 164370 - DNA, 20 bp, Homo sapiens
gcttcagacctgatgggagt

SEQ ID NO: 164371 - DNA, 23 bp, Homo sapiens
tgaggctctcagactcactgggt

SEQ ID NO: 164372 - DNA, 23 bp, Homo sapiens
tctgttctgtctcagttactaga

SEQ ID NO: 164373 - DNA, 23 bp, Homo sapiens
tgagtgtacatgtgtctgtggta

SEQ ID NO: 164374 - DNA, 23 bp, Homo sapiens
tgcctgcgtgcctggatccgagt

SEQ ID NO: 164375 - DNA, 23 bp, Homo sapiens
tcagtatggttgtgtgtgcctgt

SEQ ID NO: 164376 - DNA, 20 bp, Homo sapiens
tgaggtaggaggatcacttg

SEQ ID NO: 164377 - DNA, 23 bp, Homo sapiens
tctctctctctctggaaataacc

SEQ ID NO: 164378 - DNA, 23 bp, Homo sapiens
agatggagtctcactctgtcacc

SEQ ID NO: 164379 - DNA, 20 bp, Homo sapiens
agtctcgctctgtcacccag

SEQ ID NO: 164380 - DNA, 23 bp, Homo sapiens
atgtcctgagtgtccagacagcg

SEQ ID NO: 164381 - DNA, 23 bp, Homo sapiens
ttttttggagagggagtctcact

SEQ ID NO: 164382 - DNA, 23 bp, Homo sapiens
gagacggagtctcgctctgtctg

SEQ ID NO: 164383 - DNA, 23 bp, Homo sapiens
atagagacagggtttcttcatgt

SEQ ID NO: 164384 - DNA, 23 bp, Homo sapiens
gacagagtctcgctctgtcaccc

SEQ ID NO: 164385 - DNA, 23 bp, Homo sapiens
cggagtctcactctgtcacccag

SEQ ID NO: 164386 - DNA, 23 bp, Homo sapiens
gacagtctcactctgtcccccag

SEQ ID NO: 164387 - DNA, 18 bp, Homo sapiens
cagtggtgtgatagctca

SEQ ID NO: 164388 - DNA, 23 bp, Homo sapiens
tgcagagagaaggtacagaggac

SEQ ID NO: 164389 - DNA, 23 bp, Homo sapiens
cagggtctcactctgtcacccag

SEQ ID NO: 164390 - DNA, 23 bp, Homo sapiens
gcagtctcactctgtcacccagg

SEQ ID NO: 164391 - DNA, 21 bp, Homo sapiens
tccgtctcagaaaaaaaaaac

SEQ ID NO: 164392 - DNA, 21 bp, Homo sapiens
tctccctgagtctgtctctct

SEQ ID NO: 164393 - DNA, 22 bp, Homo sapiens
tctctgagcctcagtctcccca

SEQ ID NO: 164394 - DNA, 18 bp, Homo sapiens
atacacacacgtgtacat

SEQ ID NO: 164395 - DNA, 23 bp, Homo sapiens
tatatgtgtatgtgtatatatgt

SEQ ID NO: 164396 - DNA, 20 bp, Homo sapiens
agtcagagtcagattttttt

SEQ ID NO: 164397 - DNA, 23 bp, Homo sapiens
atggagtctcactctgtcaccca

SEQ ID NO: 164398 - DNA, 23 bp, Homo sapiens
tggtaggatctcagctcattaca

SEQ ID NO: 164399 - DNA, 23 bp, Homo sapiens
tgtgttgagagtcttgacttggg

SEQ ID NO: 164400 - DNA, 19 bp, Homo sapiens
tggcacggtctcagctcac

SEQ ID NO: 164401 - DNA, 23 bp, Homo sapiens
atcacttgagcctgagagcttaa

SEQ ID NO: 164402 - DNA, 23 bp, Homo sapiens
tgcatgtctcattactgtagcac

SEQ ID NO: 164403 - DNA, 18 bp, Homo sapiens
cttgatttcctttccttg

SEQ ID NO: 164404 - DNA, 22 bp, Homo sapiens
tgagctgctgatgagctggtca

SEQ ID NO: 164405 - DNA, 22 bp, Homo sapiens
agggaagtgagtgtggacagag

SEQ ID NO: 164406 - DNA, 21 bp, Homo sapiens
tctcactctgtcacccaggct

SEQ ID NO: 164407 - DNA, 23 bp, Homo sapiens
agtgtgtgtcagtgcctcagtcc

SEQ ID NO: 164408 - DNA, 23 bp, Homo sapiens
agtgtgtcagtgtgtgagtctct

SEQ ID NO: 164409 - DNA, 22 bp, Homo sapiens
agtgctagaattacaggtgtga

SEQ ID NO: 164410 - DNA, 23 bp, Homo sapiens
cggagtctcgctctgtctcccag

SEQ ID NO: 164411 - DNA, 19 bp, Homo sapiens
attaggtatgtatacattt

SEQ ID NO: 164412 - DNA, 23 bp, Homo sapiens
gagagagggtctcactctgtcac

SEQ ID NO: 164413 - DNA, 19 bp, Homo sapiens
cagagaagacagagagcag

SEQ ID NO: 164414 - DNA, 23 bp, Homo sapiens
cctggctctgtgtttggctcttt

SEQ ID NO: 164415 - DNA, 23 bp, Homo sapiens
ctctgcctgcctctgtgggtgtg

SEQ ID NO: 164416 - DNA, 19 bp, Homo sapiens
tacaggagcatgaacacgc

SEQ ID NO: 164417 - DNA, 23 bp, Homo sapiens
gggtctcactctgtcacccaggc

SEQ ID NO: 164418 - DNA, 23 bp, Homo sapiens
atacacgtgtatatatatgtgtg

SEQ ID NO: 164419 - DNA, 23 bp, Homo sapiens
tgagtccgagtctcgctctgtca

SEQ ID NO: 164420 - DNA, 23 bp, Homo sapiens
agaagactctttctctgtcagat

SEQ ID NO: 164421 - DNA, 23 bp, Homo sapiens
gcctgggtccctgcctggcacag

SEQ ID NO: 164422 - DNA, 23 bp, Homo sapiens
tggactctcactctgtcacccag

SEQ ID NO: 164423 - DNA, 23 bp, Homo sapiens
cggagtctcgctctgtctcccag

SEQ ID NO: 164424 - DNA, 23 bp, Homo sapiens
gacagagtctctctctgtcatcc

SEQ ID NO: 164425 - DNA, 23 bp, Homo sapiens
tgtgagctggcttgtgtctggtt

SEQ ID NO: 164426 - DNA, 22 bp, Homo sapiens
gagaggatagttactgcagtgc

SEQ ID NO: 164427 - DNA, 23 bp, Homo sapiens
cctctctcagtctctgtccctct

SEQ ID NO: 164428 - DNA, 19 bp, Homo sapiens
ttttgagacggagtctcac

SEQ ID NO: 164429 - DNA, 21 bp, Homo sapiens
tggagtctcactctgtctccc

SEQ ID NO: 164430 - DNA, 23 bp, Homo sapiens
tggctgtctgtccctctcgctgg

SEQ ID NO: 164431 - DNA, 23 bp, Homo sapiens
tatctgtgtgtgtaatgtgatct

SEQ ID NO: 164432 - DNA, 23 bp, Homo sapiens
agagagaatagagacaccacaga

SEQ ID NO: 164433 - DNA, 22 bp, Homo sapiens
cagtgtccctcagtgggtgact

SEQ ID NO: 164434 - DNA, 23 bp, Homo sapiens
atgtgtgtatatatatgtgtgta

SEQ ID NO: 164435 - DNA, 23 bp, Homo sapiens
tacgcatacatgcacgtgtgtgt

SEQ ID NO: 164436 - DNA, 22 bp, Homo sapiens
atatgtatatatacgtgtgtgt

SEQ ID NO: 164437 - DNA, 21 bp, Homo sapiens
tgtgtatatatacatgtgtgt

SEQ ID NO: 164438 - DNA, 21 bp, Homo sapiens
atatacgtgtgtatatgtatg

SEQ ID NO: 164439 - DNA, 18 bp, Homo sapiens
tatatacatgtatgtgtg

SEQ ID NO: 164440 - DNA, 23 bp, Homo sapiens
actcgggtcttgtatcggaactg

SEQ ID NO: 164441 - DNA, 23 bp, Homo sapiens
agtggtgtgatctcagctcaatg

SEQ ID NO: 164442 - DNA, 23 bp, Homo sapiens
tctcggtctctgtctcacctgtg

SEQ ID NO: 164443 - DNA, 23 bp, Homo sapiens
ctctgtgtctctctgtctctcct

SEQ ID NO: 164444 - DNA, 23 bp, Homo sapiens
ctgtgtctgtctctctctgtcat

SEQ ID NO: 164445 - DNA, 23 bp, Homo sapiens
gatggagtctctctctgtcaccc

SEQ ID NO: 164446 - DNA, 21 bp, Homo sapiens
gtctggctctgtctctgtgtg

SEQ ID NO: 164447 - DNA, 23 bp, Homo sapiens
atgatgatgatgatgatgatgat

SEQ ID NO: 164448 - DNA, 23 bp, Homo sapiens
tgtgacagttaatttgatgtgtc

SEQ ID NO: 164449 - DNA, 23 bp, Homo sapiens
gactgagtctcgctctgtcgctc

SEQ ID NO: 164450 - DNA, 20 bp, Homo sapiens
ctcttacaaattgaatttgt

SEQ ID NO: 164451 - DNA, 23 bp, Homo sapiens
tgagttcattgtagattctggat

SEQ ID NO: 164452 - DNA, 23 bp, Homo sapiens
tgagttcattgtagattctggat

SEQ ID NO: 164453 - DNA, 22 bp, Homo sapiens
cacccgtagaaccgaccttgcg

SEQ ID NO: 164454 - DNA, 23 bp, Homo sapiens
ctcgtgtctgtgggtccgtgtcg

SEQ ID NO: 164455 - DNA, 23 bp, Homo sapiens
tgaggtaggaggttgtatagttg

SEQ ID NO: 164456 - DNA, 23 bp, Homo sapiens
tccctgagaccctttaacctgtg

SEQ ID NO: 164457 - DNA, 21 bp, Homo sapiens
gggtctcactctgtcacccag

SEQ ID NO: 164458 - DNA, 23 bp, Homo sapiens
tctctctctgtgactctttctag

SEQ ID NO: 164459 - DNA, 23 bp, Homo sapiens
atgtgtatatatgtatatatgtg

SEQ ID NO: 164460 - DNA, 21 bp, Homo sapiens
aggtggtgtgacagatgatgt

SEQ ID NO: 164461 - DNA, 22 bp, Homo sapiens
tgagatagagtctcactctgtc

SEQ ID NO: 164462 - DNA, 22 bp, Homo sapiens
agtacagtagcatgatcttggc

SEQ ID NO: 164463 - DNA, 19 bp, Homo sapiens
gggaagcagcaggagccga

SEQ ID NO: 164464 - DNA, 21 bp, Homo sapiens
gacagtctctgtgtcgcccag

SEQ ID NO: 164465 - DNA, 20 bp, Homo sapiens
agtctccctctgtcacccag

SEQ ID NO: 164466 - DNA, 18 bp, Homo sapiens
cattggcttatatgtctg

SEQ ID NO: 164467 - DNA, 22 bp, Homo sapiens
ttttgatgaaggtagcttagta

SEQ ID NO: 164468 - DNA, 23 bp, Homo sapiens
aggcagaggttgcagtgagtcaa

SEQ ID NO: 164469 - DNA, 18 bp, Homo sapiens
tgcctgacaggctcactc

SEQ ID NO: 164470 - DNA, 23 bp, Homo sapiens
tcgctctgtggcttagttctgga

SEQ ID NO: 164471 - DNA, 23 bp, Homo sapiens
tctgtctcaggttttctactgct

SEQ ID NO: 164472 - DNA, 21 bp, Homo sapiens
tgtctcaggttttctactgct

SEQ ID NO: 164473 - DNA, 23 bp, Homo sapiens
acgatcacaagagggtttggagt

SEQ ID NO: 164474 - DNA, 23 bp, Homo sapiens
tgtctcaggttttctactgctct

SEQ ID NO: 164475 - DNA, 21 bp, Homo sapiens
tgtctcaggttttctactgct

SEQ ID NO: 164476 - DNA, 18 bp, Homo sapiens
tgagcctgtagtcccagc

SEQ ID NO: 164477 - DNA, 23 bp, Homo sapiens
gacagagtttggacatgttgctc

SEQ ID NO: 164478 - DNA, 22 bp, Homo sapiens
tcagcactttgaaaatgttgcc

SEQ ID NO: 164479 - DNA, 19 bp, Homo sapiens
gcaatggtgtgatcatggc

SEQ ID NO: 164480 - DNA, 23 bp, Homo sapiens
tggagtctcggtctgtcactcag

SEQ ID NO: 164481 - DNA, 20 bp, Homo sapiens
accacctatctttagtcttt

SEQ ID NO: 164482 - DNA, 19 bp, Homo sapiens
tgtgaggcttttaagagtg

SEQ ID NO: 164483 - DNA, 23 bp, Homo sapiens
cggagtctcgctctgtcgctcag

SEQ ID NO: 164484 - DNA, 23 bp, Homo sapiens
tggagtctcgctctgtctcccag

SEQ ID NO: 164485 - DNA, 23 bp, Homo sapiens
tcccaaagtgctggaattacagg

SEQ ID NO: 164486 - DNA, 22 bp, Homo sapiens
aaagtctctctctctcacccag

SEQ ID NO: 164487 - DNA, 22 bp, Homo sapiens
tatatacacacacagatatata

SEQ ID NO: 164488 - DNA, 23 bp, Homo sapiens
aatgtgtgtgtatatatatatgt

SEQ ID NO: 164489 - DNA, 23 bp, Homo sapiens
tttttgagatggagtctcactct

SEQ ID NO: 164490 - DNA, 23 bp, Homo sapiens
gaggcagactctcactctgtcgc

SEQ ID NO: 164491 - DNA, 23 bp, Homo sapiens
tctctcacgctctgtgtctcgga

SEQ ID NO: 164492 - DNA, 22 bp, Homo sapiens
ggtctgtcttggagtagttcca

SEQ ID NO: 164493 - DNA, 23 bp, Homo sapiens
ttctgtgtatatatatgtgtgta

SEQ ID NO: 164494 - DNA, 23 bp, Homo sapiens
atatcaaaaaatatatgtgtgtg

SEQ ID NO: 164495 - DNA, 23 bp, Homo sapiens
gtcttccactctcagtctaatct

SEQ ID NO: 164496 - DNA, 19 bp, Homo sapiens
aagaagtggggcagcaagt

SEQ ID NO: 164497 - DNA, 23 bp, Homo sapiens
tgagttcattgtagattctggat

SEQ ID NO: 164498 - DNA, 23 bp, Homo sapiens
tgagttcattgtagattctggat

SEQ ID NO: 164499 - DNA, 21 bp, Homo sapiens
tggtcctgcacctgctccttg

SEQ ID NO: 164500 - DNA, 21 bp, Homo sapiens
cagagaggacacagagagcac

SEQ ID NO: 164501 - DNA, 23 bp, Homo sapiens
cacaccctgtgtgtctctttgtc

SEQ ID NO: 164502 - DNA, 22 bp, Homo sapiens
tatgtggcaaataaatgtgttt

SEQ ID NO: 164503 - DNA, 23 bp, Homo sapiens
tcagaggtacatgtgcaggtttg

SEQ ID NO: 164504 - DNA, 23 bp, Homo sapiens
tctgcctgtctcagtggctcacg

SEQ ID NO: 164505 - DNA, 23 bp, Homo sapiens
ttttgagacggagtctcacactg

SEQ ID NO: 164506 - DNA, 23 bp, Homo sapiens
cgatctccactgactgcaacctc

SEQ ID NO: 164507 - DNA, 23 bp, Homo sapiens
cggagtctcgctctgtcaccctg

SEQ ID NO: 164508 - DNA, 22 bp, Homo sapiens
tcatgactcactatagccttga

SEQ ID NO: 164509 - DNA, 23 bp, Homo sapiens
agagtctcactctgtgtcccagg

SEQ ID NO: 164510 - DNA, 23 bp, Homo sapiens
cggagtctcgctctgtctcccag

SEQ ID NO: 164511 - DNA, 19 bp, Homo sapiens
aggcggtgaacatgatgat

SEQ ID NO: 164512 - DNA, 23 bp, Homo sapiens
atgatgatgatgatggtggtggt

SEQ ID NO: 164513 - DNA, 23 bp, Homo sapiens
tgatgattatcatgatgatgatg

SEQ ID NO: 164514 - DNA, 23 bp, Homo sapiens
actctctctctgtttctcaggaa

SEQ ID NO: 164515 - DNA, 21 bp, Homo sapiens
tgcagtggaatgatcttagct

SEQ ID NO: 164516 - DNA, 23 bp, Homo sapiens
atgtatatgtgtatgtatatgta

SEQ ID NO: 164517 - DNA, 23 bp, Homo sapiens
cggagtctcgctctgtctcccag

SEQ ID NO: 164518 - DNA, 23 bp, Homo sapiens
tgaacagagtttttgttgttgga

SEQ ID NO: 164519 - DNA, 23 bp, Homo sapiens
gactgagtctcgctctgtctccc

SEQ ID NO: 164520 - DNA, 23 bp, Homo sapiens
acagttctgaaattcatgttgag

SEQ ID NO: 164521 - DNA, 23 bp, Homo sapiens
agacatcagttagggaaagttca

SEQ ID NO: 164522 - DNA, 23 bp, Homo sapiens
cctctgtgacattgttgatgagc

SEQ ID NO: 164523 - DNA, 22 bp, Homo sapiens
cctgacactgagaagtgagaat

SEQ ID NO: 164524 - DNA, 22 bp, Homo sapiens
acccagacacctttcatccact

SEQ ID NO: 164525 - DNA, 23 bp, Homo sapiens
tgagagacagagtctcgctctca

SEQ ID NO: 164526 - DNA, 23 bp, Homo sapiens
aatactgaattcactgtcagtca

SEQ ID NO: 164527 - DNA, 23 bp, Homo sapiens
agacggagtctcactctgtcacc

SEQ ID NO: 164528 - DNA, 23 bp, Homo sapiens
cggagtctcactctgtcacccag

SEQ ID NO: 164529 - DNA, 22 bp, Homo sapiens
ttgtttttttgagacggagtct

SEQ ID NO: 164530 - DNA, 18 bp, Homo sapiens
ataaggacacacacccgt

SEQ ID NO: 164531 - DNA, 21 bp, Homo sapiens
agacaggtctcactctgtcac

SEQ ID NO: 164532 - DNA, 23 bp, Homo sapiens
atatacttatatatgctatgtat

SEQ ID NO: 164533 - DNA, 20 bp, Homo sapiens
atatgtatgttatatatact

SEQ ID NO: 164534 - DNA, 22 bp, Homo sapiens
ttatatgtatgttatatatgct

SEQ ID NO: 164535 - DNA, 23 bp, Homo sapiens
tgagttcattgtagattctggat

SEQ ID NO: 164536 - DNA, 23 bp, Homo sapiens
tgagttcattgtagattctggat

SEQ ID NO: 164537 - DNA, 22 bp, Homo sapiens
tattcagtcagagattgaactg

SEQ ID NO: 164538 - DNA, 23 bp, Homo sapiens
taagagtgcattgaatctgtaga

SEQ ID NO: 164539 - DNA, 22 bp, Homo sapiens
tacagtggtctggacattggct

SEQ ID NO: 164540 - DNA, 23 bp, Homo sapiens
caatctcagctcattgcaacctc

SEQ ID NO: 164541 - DNA, 23 bp, Homo sapiens
actgagttgcattacaaaacttt

SEQ ID NO: 164542 - DNA, 19 bp, Homo sapiens
ttttctttcttttttttgg

SEQ ID NO: 164543 - DNA, 23 bp, Homo sapiens
gactgagtctcactctgtccccc

SEQ ID NO: 164544 - DNA, 23 bp, Homo sapiens
ggaaaggttttacactttgctcc

SEQ ID NO: 164545 - DNA, 21 bp, Homo sapiens
caggctccttgactagtggct

SEQ ID NO: 164546 - DNA, 23 bp, Homo sapiens
ggaactggacaacctactgtgtg

SEQ ID NO: 164547 - DNA, 18 bp, Homo sapiens
tgtgtgtatgtgtgatct

SEQ ID NO: 164548 - DNA, 21 bp, Homo sapiens
gtctgaacaaagacgatgatg

SEQ ID NO: 164549 - DNA, 23 bp, Homo sapiens
gagacgtagtctcactctgtcac

SEQ ID NO: 164550 - DNA, 21 bp, Homo sapiens
tctgcctctcactgactgtgc

SEQ ID NO: 164551 - DNA, 23 bp, Homo sapiens
tgagatggagtctggctctgtcg

SEQ ID NO: 164552 - DNA, 20 bp, Homo sapiens
agtagctgggatcacaggcg

SEQ ID NO: 164553 - DNA, 23 bp, Homo sapiens
ggagtctcactcactctgttgtc

SEQ ID NO: 164554 - DNA, 23 bp, Homo sapiens
tgacatggagtctcactctgtcg

SEQ ID NO: 164555 - DNA, 21 bp, Homo sapiens
ttttgtatgtatatatgtatg

SEQ ID NO: 164556 - DNA, 21 bp, Homo sapiens
tatgtgtgcatgtgtttaagt

SEQ ID NO: 164557 - DNA, 23 bp, Homo sapiens
tatgacactttactcataaatat

SEQ ID NO: 164558 - DNA, 21 bp, Homo sapiens
atatgtatacattatggaatg

SEQ ID NO: 164559 - DNA, 21 bp, Homo sapiens
gtagtcagtatagagttgcca

SEQ ID NO: 164560 - DNA, 23 bp, Homo sapiens
agggtgtgatagtccctgattcc

SEQ ID NO: 164561 - DNA, 23 bp, Homo sapiens
ctgttcaatgctgaaagtggggt

SEQ ID NO: 164562 - DNA, 23 bp, Homo sapiens
tgagacggagtctcgctctgtca

SEQ ID NO: 164563 - DNA, 18 bp, Homo sapiens
atgaatatccaggtataa

SEQ ID NO: 164564 - DNA, 23 bp, Homo sapiens
ctcactctgtgggtctgtccctg

SEQ ID NO: 164565 - DNA, 22 bp, Homo sapiens
gaagagacagaagagagggtgc

SEQ ID NO: 164566 - DNA, 23 bp, Homo sapiens
tctgtgtgtgtctgtgtcctcat

SEQ ID NO: 164567 - DNA, 19 bp, Homo sapiens
tgtgtatatatatatgtat

SEQ ID NO: 164568 - DNA, 21 bp, Homo sapiens
tgtgtatatatgtatatatgt

SEQ ID NO: 164569 - DNA, 23 bp, Homo sapiens
gggtctcactctgtcacccaggc

SEQ ID NO: 164570 - DNA, 18 bp, Homo sapiens
agtagtgcgatcacagct

SEQ ID NO: 164571 - DNA, 23 bp, Homo sapiens
tatttctatgtatatttgtgtgt

SEQ ID NO: 164572 - DNA, 22 bp, Homo sapiens
tcccagctactcaagaggctga

SEQ ID NO: 164573 - DNA, 23 bp, Homo sapiens
agagtctcactctgtcacccagg

SEQ ID NO: 164574 - DNA, 21 bp, Homo sapiens
ttacaggcatgagccatggtg

SEQ ID NO: 164575 - DNA, 23 bp, Homo sapiens
ataacacaggctgggtacagtgg

SEQ ID NO: 164576 - DNA, 21 bp, Homo sapiens
tctggaaaacctcctcagcct

SEQ ID NO: 164577 - DNA, 23 bp, Homo sapiens
agacagagtctcactctgtcatc

SEQ ID NO: 164578 - DNA, 23 bp, Homo sapiens
tgatggtactgttctgattcttt

SEQ ID NO: 164579 - DNA, 22 bp, Homo sapiens
tggagtctcactctgtcatcaa

SEQ ID NO: 164580 - DNA, 23 bp, Homo sapiens
gtgcctgagttttgtgggactca

SEQ ID NO: 164581 - DNA, 22 bp, Homo sapiens
tgggtcttgtgggactcacaca

SEQ ID NO: 164582 - DNA, 22 bp, Homo sapiens
gtcttgtgggacacacacacac

SEQ ID NO: 164583 - DNA, 22 bp, Homo sapiens
tgcctgagttttgtgggactca

SEQ ID NO: 164584 - DNA, 18 bp, Homo sapiens
tcggtgtgagtacgcgtg

SEQ ID NO: 164585 - DNA, 19 bp, Homo sapiens
tgtgtgtgtgcacgtgcat

SEQ ID NO: 164586 - DNA, 22 bp, Homo sapiens
ttatattcaatatgtgtatgac

SEQ ID NO: 164587 - DNA, 18 bp, Homo sapiens
ctgtggatatgtgtatat

SEQ ID NO: 164588 - DNA, 23 bp, Homo sapiens
tgcatgtatgtatatatgtatac

SEQ ID NO: 164589 - DNA, 23 bp, Homo sapiens
gggtgtgtctctgtgtgtgtcta

SEQ ID NO: 164590 - DNA, 19 bp, Homo sapiens
agacacatatgccacgact

SEQ ID NO: 164591 - DNA, 23 bp, Homo sapiens
gagtctctgtggctctgtgcctg

SEQ ID NO: 164592 - DNA, 23 bp, Homo sapiens
gccagactccgtctcaaaaacaa

SEQ ID NO: 164593 - DNA, 18 bp, Homo sapiens
gagtctcgctctgtcacc

SEQ ID NO: 164594 - DNA, 23 bp, Homo sapiens
cagagtctcactctgtggcccag

SEQ ID NO: 164595 - DNA, 23 bp, Homo sapiens
acagagtctcactctgtcgccca

SEQ ID NO: 164596 - DNA, 23 bp, Homo sapiens
cgagtctcactctgtcattcagg

SEQ ID NO: 164597 - DNA, 23 bp, Homo sapiens
tgtgtgtgtatatatacgtgtat

SEQ ID NO: 164598 - DNA, 20 bp, Homo sapiens
agaacaagaagaaaatttgt

SEQ ID NO: 164599 - DNA, 23 bp, Homo sapiens
tgagttcattgtagattctggat

SEQ ID NO: 164600 - DNA, 23 bp, Homo sapiens
tgagttcattgtagattctggat

SEQ ID NO: 164601 - DNA, 23 bp, Homo sapiens
cattgtggttttgatttgcattt

SEQ ID NO: 164602 - DNA, 23 bp, Homo sapiens
tggtgctcacactgtcactgact

SEQ ID NO: 164603 - DNA, 18 bp, Homo sapiens
aagaaacatgagcatggg

SEQ ID NO: 164604 - DNA, 19 bp, Homo sapiens
tagctgtaatttccattgt

SEQ ID NO: 164605 - DNA, 20 bp, Homo sapiens
aagtggttatttaatttgca

SEQ ID NO: 164606 - DNA, 19 bp, Homo sapiens
tagctgtaatttccattgt

SEQ ID NO: 164607 - DNA, 20 bp, Homo sapiens
aagtggttatttaatttgca

SEQ ID NO: 164608 - DNA, 22 bp, Homo sapiens
acagagtgagactccttctcaa

SEQ ID NO: 164609 - DNA, 23 bp, Homo sapiens
tgagacagagtctcgctctgtcg

SEQ ID NO: 164610 - DNA, 23 bp, Homo sapiens
atgtgtatatatgtatatgtgtg

SEQ ID NO: 164611 - DNA, 21 bp, Homo sapiens
atgtgtgtgtgtatatatatg

SEQ ID NO: 164612 - DNA, 21 bp, Homo sapiens
tctctcagcctcactcccttc

SEQ ID NO: 164613 - DNA, 20 bp, Homo sapiens
aagagactgtaaaggcgtga

SEQ ID NO: 164614 - DNA, 23 bp, Homo sapiens
gagacagactctcgctctgtcgc

SEQ ID NO: 164615 - DNA, 23 bp, Homo sapiens
agtcagggtctcgctctgtcacc

SEQ ID NO: 164616 - DNA, 21 bp, Homo sapiens
agagttgactcatcattggag

SEQ ID NO: 164617 - DNA, 20 bp, Homo sapiens
cagggtgagactctctctct

SEQ ID NO: 164618 - DNA, 23 bp, Homo sapiens
acaggatctctcactgtcaccca

SEQ ID NO: 164619 - DNA, 23 bp, Homo sapiens
tgagtgtcagcctcctacagatg

SEQ ID NO: 164620 - DNA, 23 bp, Homo sapiens
tgacttctcaaagtggtggtgtg

SEQ ID NO: 164621 - DNA, 20 bp, Homo sapiens
tgagacagagtctccctctg

SEQ ID NO: 164622 - DNA, 18 bp, Homo sapiens
tccctcacactctcaccc

SEQ ID NO: 164623 - DNA, 23 bp, Homo sapiens
ttttgagacggagtcttgctctg

SEQ ID NO: 164624 - DNA, 21 bp, Homo sapiens
aatagctgggattacaggcgc

SEQ ID NO: 164625 - DNA, 19 bp, Homo sapiens
atgcatatatacatgtatg

SEQ ID NO: 164626 - DNA, 23 bp, Homo sapiens
atctctgtgtctctcagtgatcc

SEQ ID NO: 164627 - DNA, 23 bp, Homo sapiens
atttttctctgtgtctctcagcg

SEQ ID NO: 164628 - DNA, 23 bp, Homo sapiens
catgtctgtctgtctgagtgtct

SEQ ID NO: 164629 - DNA, 23 bp, Homo sapiens
atgtgagcctcagaatccagtct

SEQ ID NO: 164630 - DNA, 22 bp, Homo sapiens
tatgagcctcagaatccagtct

SEQ ID NO: 164631 - DNA, 23 bp, Homo sapiens
gatttctctctgtgcctctcagt

SEQ ID NO: 164632 - DNA, 23 bp, Homo sapiens
atgtgagcctcagaatccagtct

SEQ ID NO: 164633 - DNA, 23 bp, Homo sapiens
acattcatgttgctgcaaaggac

SEQ ID NO: 164634 - DNA, 23 bp, Homo sapiens
taccttcttcacgccgatctgag

SEQ ID NO: 164635 - DNA, 23 bp, Homo sapiens
aagactagtgaatgtgttgatgt

SEQ ID NO: 164636 - DNA, 22 bp, Homo sapiens
ataagcactatatgtatacaca

SEQ ID NO: 164637 - DNA, 23 bp, Homo sapiens
taaatcagtatttgtttttatga

SEQ ID NO: 164638 - DNA, 23 bp, Homo sapiens
cgtttggttgaagagagtgtgca

SEQ ID NO: 164639 - DNA, 20 bp, Homo sapiens
agaccccaggaattcaaggc

SEQ ID NO: 164640 - DNA, 23 bp, Homo sapiens
ctctgtgcctcagtttcccctgt

SEQ ID NO: 164641 - DNA, 22 bp, Homo sapiens
tttttagatggagtctggctct

SEQ ID NO: 164642 - DNA, 23 bp, Homo sapiens
tatgtgtgtgtatatatgtatat

SEQ ID NO: 164643 - DNA, 22 bp, Homo sapiens
atatgtgtatatgtatagatgt

SEQ ID NO: 164644 - DNA, 23 bp, Homo sapiens
tgggaggctctgtttctctctct

SEQ ID NO: 164645 - DNA, 23 bp, Homo sapiens
gagacggagtctggctctgtccc

SEQ ID NO: 164646 - DNA, 20 bp, Homo sapiens
ttccagttgagagccactgt

SEQ ID NO: 164647 - DNA, 23 bp, Homo sapiens
aaagtgggaacagtcactctctc

SEQ ID NO: 164648 - DNA, 21 bp, Homo sapiens
attggtctttgtggtccctgg

SEQ ID NO: 164649 - DNA, 21 bp, Homo sapiens
ggagtctcactctgtctccta

SEQ ID NO: 164650 - DNA, 23 bp, Homo sapiens
aggctgtgactctgtctccccct

SEQ ID NO: 164651 - DNA, 23 bp, Homo sapiens
ggagtcagagtttgcagtgacct

SEQ ID NO: 164652 - DNA, 23 bp, Homo sapiens
cgacagagtgactgagactctct

SEQ ID NO: 164653 - DNA, 20 bp, Homo sapiens
atgtctcataaaaagctgtg

SEQ ID NO: 164654 - DNA, 23 bp, Homo sapiens
atacacacacgtatatatatgtg

SEQ ID NO: 164655 - DNA, 22 bp, Homo sapiens
tatatgtgtgtgtatatgtgtg

SEQ ID NO: 164656 - DNA, 23 bp, Homo sapiens
ttagtcacacagactcacaggga

SEQ ID NO: 164657 - DNA, 23 bp, Homo sapiens
tcacatgaagctacagagactgt

SEQ ID NO: 164658 - DNA, 21 bp, Homo sapiens
tggtgagcttctctagttggc

SEQ ID NO: 164659 - DNA, 22 bp, Homo sapiens
tatgtgtatatgtatatatgta

SEQ ID NO: 164660 - DNA, 22 bp, Homo sapiens
agggtccttcatgatgcacgga

SEQ ID NO: 164661 - DNA, 23 bp, Homo sapiens
tgcctgtgaccttagctactcag

SEQ ID NO: 164662 - DNA, 23 bp, Homo sapiens
tggagtctcgctctgtctcccag

SEQ ID NO: 164663 - DNA, 23 bp, Homo sapiens
ctgtgcgtctctcagcctccctc

SEQ ID NO: 164664 - DNA, 20 bp, Homo sapiens
tatgcaaacatatatgtgtg

SEQ ID NO: 164665 - DNA, 19 bp, Homo sapiens
atctctatagatctatgtc

SEQ ID NO: 164666 - DNA, 23 bp, Homo sapiens
agtcactgtgtttctgactccaa

SEQ ID NO: 164667 - DNA, 23 bp, Homo sapiens
ttttgttgtttttgttgagacag

SEQ ID NO: 164668 - DNA, 22 bp, Homo sapiens
tctgtgcgtgtgactgtggcac

SEQ ID NO: 164669 - DNA, 23 bp, Homo sapiens
tggagtctcactctgtcacccag

SEQ ID NO: 164670 - DNA, 21 bp, Homo sapiens
taagaagtaccttggctactt

SEQ ID NO: 164671 - DNA, 21 bp, Homo sapiens
tcaaacagagtctcactctgt

SEQ ID NO: 164672 - DNA, 23 bp, Homo sapiens
tggagtctcactctgtcacccag

SEQ ID NO: 164673 - DNA, 21 bp, Homo sapiens
tctgagtttcctcagtgttta

SEQ ID NO: 164674 - DNA, 23 bp, Homo sapiens
tgagtcagagtctcactctgttg

SEQ ID NO: 164675 - DNA, 22 bp, Homo sapiens
tttaagagttaagagtggcggt

SEQ ID NO: 164676 - DNA, 23 bp, Homo sapiens
agatggagtctcactctgtctcc

SEQ ID NO: 164677 - DNA, 23 bp, Homo sapiens
atgagtcaagtcactgtcctctg

SEQ ID NO: 164678 - DNA, 23 bp, Homo sapiens
atgagtcaagtcactgtcctctg

SEQ ID NO: 164679 - DNA, 23 bp, Homo sapiens
gcttctgtcagtctgactcagcg

SEQ ID NO: 164680 - DNA, 23 bp, Homo sapiens
caaggtcagaattgtgactgaag

SEQ ID NO: 164681 - DNA, 23 bp, Homo sapiens
gcatttgtaaggtttctctccaa

SEQ ID NO: 164682 - DNA, 23 bp, Homo sapiens
tgagatggagtctcgctctgtca

SEQ ID NO: 164683 - DNA, 19 bp, Homo sapiens
tgagatggagtctcactct

SEQ ID NO: 164684 - DNA, 23 bp, Homo sapiens
tgaaactgagtctcgctctgtct

SEQ ID NO: 164685 - DNA, 23 bp, Homo sapiens
aagctggagtacaaatggcaaga

SEQ ID NO: 164686 - DNA, 23 bp, Homo sapiens
tttgctcttcttgggatagtgag

SEQ ID NO: 164687 - DNA, 21 bp, Homo sapiens
ttttgagacggagtctctctc

SEQ ID NO: 164688 - DNA, 23 bp, Homo sapiens
acagagtctcgctcgctctgtcg

SEQ ID NO: 164689 - DNA, 23 bp, Homo sapiens
acaagagtctcactctgacttcc

SEQ ID NO: 164690 - DNA, 23 bp, Homo sapiens
tttctgtggaagtcagttgttag

SEQ ID NO: 164691 - DNA, 23 bp, Homo sapiens
ggagtctcactctgtcacccagg

SEQ ID NO: 164692 - DNA, 23 bp, Homo sapiens
tctgtgtgtgaagttcctcctgt

SEQ ID NO: 164693 - DNA, 23 bp, Homo sapiens
tgtggtagtgtgtgcctgtggtc

SEQ ID NO: 164694 - DNA, 21 bp, Homo sapiens
tctcagggtgtactttcgctt

SEQ ID NO: 164695 - DNA, 23 bp, Homo sapiens
gaccctcacacagtcagagctca

SEQ ID NO: 164696 - DNA, 23 bp, Homo sapiens
gcacacacacactgtctggcttt

SEQ ID NO: 164697 - DNA, 20 bp, Homo sapiens
gacactgatgagtttgccat

SEQ ID NO: 164698 - DNA, 22 bp, Homo sapiens
gagagaagtgagtcagagcaga

SEQ ID NO: 164699 - DNA, 23 bp, Homo sapiens
acccagactgcctgagttcagaa

SEQ ID NO: 164700 - DNA, 20 bp, Homo sapiens
tctttggctgtacagtgtgg

SEQ ID NO: 164701 - DNA, 23 bp, Homo sapiens
gtttgtctgtgtctctctgtgtg

SEQ ID NO: 164702 - DNA, 23 bp, Homo sapiens
ttttgagtcggagtcttgctctg

SEQ ID NO: 164703 - DNA, 22 bp, Homo sapiens
tgacagtgaccggtttgtgtat

SEQ ID NO: 164704 - DNA, 21 bp, Homo sapiens
tactctggcttttttttgttt

SEQ ID NO: 164705 - DNA, 23 bp, Homo sapiens
gggtctcactctgtcacccaggc

SEQ ID NO: 164706 - DNA, 18 bp, Homo sapiens
tgtgacctggcttctctc

SEQ ID NO: 164707 - DNA, 21 bp, Homo sapiens
attatagatgtgtctggccca

SEQ ID NO: 164708 - DNA, 19 bp, Homo sapiens
tcactgcaacctagacttc

SEQ ID NO: 164709 - DNA, 23 bp, Homo sapiens
agagtctcactctgtcacccagg

SEQ ID NO: 164710 - DNA, 23 bp, Homo sapiens
gagtctcactctgtcacccaggc

SEQ ID NO: 164711 - DNA, 23 bp, Homo sapiens
atatatgagtatatgtatatgag

SEQ ID NO: 164712 - DNA, 23 bp, Homo sapiens
agacggagtctcgctctgtctcc

SEQ ID NO: 164713 - DNA, 21 bp, Homo sapiens
gagtatagtagcacgagctct

SEQ ID NO: 164714 - DNA, 18 bp, Homo sapiens
caaataaaaactctaatg

SEQ ID NO: 164715 - DNA, 23 bp, Homo sapiens
atgtgtgtatatgtatatgtgtg

SEQ ID NO: 164716 - DNA, 23 bp, Homo sapiens
acacacaatcattgtatgtgtgt

SEQ ID NO: 164717 - DNA, 22 bp, Homo sapiens
atgtgtgtgcatgtatatattt

SEQ ID NO: 164718 - DNA, 23 bp, Homo sapiens
cctctctgtgtctcagttacccc

SEQ ID NO: 164719 - DNA, 23 bp, Homo sapiens
tctcccaacccttgtaccagtgc

SEQ ID NO: 164720 - DNA, 22 bp, Homo sapiens
ccctcagtctctgcctctgttt

SEQ ID NO: 164721 - DNA, 23 bp, Homo sapiens
gggactctgactctgtgtgaggg

SEQ ID NO: 164722 - DNA, 20 bp, Homo sapiens
tatgtgtgtatatacatatg

SEQ ID NO: 164723 - DNA, 21 bp, Homo sapiens
catgattctgaggacagaggg

SEQ ID NO: 164724 - DNA, 22 bp, Homo sapiens
tgcctgtgacagatttctgttt

SEQ ID NO: 164725 - DNA, 18 bp, Homo sapiens
tcacacctcaggctccag

SEQ ID NO: 164726 - DNA, 23 bp, Homo sapiens
gtccctgtttttctggttccctg

SEQ ID NO: 164727 - DNA, 23 bp, Homo sapiens
catgtgtgtatatgtgaatgtgt

SEQ ID NO: 164728 - DNA, 22 bp, Homo sapiens
ctctagctctgtgtgtgtgttt

SEQ ID NO: 164729 - DNA, 23 bp, Homo sapiens
tgagacagagtctcgctctgtcg

SEQ ID NO: 164730 - DNA, 20 bp, Homo sapiens
caaagtgctgggattacagg

SEQ ID NO: 164731 - DNA, 23 bp, Homo sapiens
ccactctcagtccctgtgttagg

SEQ ID NO: 164732 - DNA, 23 bp, Homo sapiens
tagtggctggtgtgtgcgtgtga

SEQ ID NO: 164733 - DNA, 23 bp, Homo sapiens
gagacagtgtctcactgtgtctt

SEQ ID NO: 164734 - DNA, 23 bp, Homo sapiens
cacacactgacacactctgttgt

SEQ ID NO: 164735 - DNA, 23 bp, Homo sapiens
tcattggttttcaagctgttttc

SEQ ID NO: 164736 - DNA, 23 bp, Homo sapiens
gttttgtttgaattccattctgt

SEQ ID NO: 164737 - DNA, 23 bp, Homo sapiens
gtgacagagagaggcacagttca

SEQ ID NO: 164738 - DNA, 22 bp, Homo sapiens
agagtctcgctctgtcacccag

SEQ ID NO: 164739 - DNA, 23 bp, Homo sapiens
tgagatggagtctcactctgtca

SEQ ID NO: 164740 - DNA, 23 bp, Homo sapiens
agacacagtctcactctgtcgcc

SEQ ID NO: 164741 - DNA, 18 bp, Homo sapiens
caacacctcaggctcctc

SEQ ID NO: 164742 - DNA, 20 bp, Homo sapiens
agagactctgtctcaaaaac

SEQ ID NO: 164743 - DNA, 20 bp, Homo sapiens
tttgagacggagtctcgctc

SEQ ID NO: 164744 - DNA, 18 bp, Homo sapiens
acgcttgtaatctcagca

SEQ ID NO: 164745 - DNA, 23 bp, Homo sapiens
tcacagccaccctgtgaggcagg

SEQ ID NO: 164746 - DNA, 23 bp, Homo sapiens
actgcaatgcacttcatctcctg

SEQ ID NO: 164747 - DNA, 18 bp, Homo sapiens
tgaggacagggcctggtt

SEQ ID NO: 164748 - DNA, 23 bp, Homo sapiens
actgcacgtcagtcactgtgtgt

SEQ ID NO: 164749 - DNA, 23 bp, Homo sapiens
ctctctctgtgtccccctcacat

SEQ ID NO: 164750 - DNA, 22 bp, Homo sapiens
tggctctgtctctctccctctg

SEQ ID NO: 164751 - DNA, 22 bp, Homo sapiens
tgagatggagtgtcgctcttgt

SEQ ID NO: 164752 - DNA, 23 bp, Homo sapiens
gacagagtctcgctctgtcaccc

SEQ ID NO: 164753 - DNA, 22 bp, Homo sapiens
tttgtcctctgcctccaggtct

SEQ ID NO: 164754 - DNA, 21 bp, Homo sapiens
agctcactgcaacctctgact

SEQ ID NO: 164755 - DNA, 22 bp, Homo sapiens
tattacactctagcctgggcaa

SEQ ID NO: 164756 - DNA, 20 bp, Homo sapiens
ggagtctcgctctgtcaccc

SEQ ID NO: 164757 - DNA, 22 bp, Homo sapiens
aagtatctttgttgatggcatt

SEQ ID NO: 164758 - DNA, 23 bp, Homo sapiens
tgggtgacagagccagactcttt

SEQ ID NO: 164759 - DNA, 23 bp, Homo sapiens
tttgtcaccaggctagagtgctg

SEQ ID NO: 164760 - DNA, 20 bp, Homo sapiens
tgtgtccctgaatgcctctg

SEQ ID NO: 164761 - DNA, 23 bp, Homo sapiens
agatctccattatgtttcatgtt

SEQ ID NO: 164762 - DNA, 21 bp, Homo sapiens
tgtgtatatacatgtgtgtat

SEQ ID NO: 164763 - DNA, 21 bp, Homo sapiens
atatgtgtatatatatgtgtg

SEQ ID NO: 164764 - DNA, 23 bp, Homo sapiens
tcacctcctctctctgtgtcacc

SEQ ID NO: 164765 - DNA, 22 bp, Homo sapiens
actgcaagagataacaaatgat

SEQ ID NO: 164766 - DNA, 22 bp, Homo sapiens
gtctcagcctgtcacccaggct

SEQ ID NO: 164767 - DNA, 23 bp, Homo sapiens
tcacactgattcgggtctctctc

SEQ ID NO: 164768 - DNA, 20 bp, Homo sapiens
tgaggtaggaggatcacttg

SEQ ID NO: 164769 - DNA, 19 bp, Homo sapiens
acactcctgtaagagtcac

SEQ ID NO: 164770 - DNA, 23 bp, Homo sapiens
acaggatctcactctctcgctca

SEQ ID NO: 164771 - DNA, 23 bp, Homo sapiens
tgtctctcagcttctcctattgc

SEQ ID NO: 164772 - DNA, 23 bp, Homo sapiens
tgagacactgcacacagcctcat

SEQ ID NO: 164773 - DNA, 22 bp, Homo sapiens
gtgtcagaagagtctgtgcaca

SEQ ID NO: 164774 - DNA, 22 bp, Homo sapiens
aacacagtgagatcccatctct

SEQ ID NO: 164775 - DNA, 23 bp, Homo sapiens
gacagggtctcactctgtcaccc

SEQ ID NO: 164776 - DNA, 23 bp, Homo sapiens
agacagggtctccctctgtcact

SEQ ID NO: 164777 - DNA, 23 bp, Homo sapiens
taggagagtggaatagatgttga

SEQ ID NO: 164778 - DNA, 23 bp, Homo sapiens
tctctctctgtccatctctgttt

SEQ ID NO: 164779 - DNA, 23 bp, Homo sapiens
aggcagtgagttaggtagagaat

SEQ ID NO: 164780 - DNA, 20 bp, Homo sapiens
aaggaggggtcagtggggct

SEQ ID NO: 164781 - DNA, 23 bp, Homo sapiens
tgagtgtccgtctgtctgtccat

SEQ ID NO: 164782 - DNA, 23 bp, Homo sapiens
tatgctctttttgtaaatgaaag

SEQ ID NO: 164783 - DNA, 23 bp, Homo sapiens
tttttcctttttttgcataaaat

SEQ ID NO: 164784 - DNA, 23 bp, Homo sapiens
tactaagcagagtattctgtacc

SEQ ID NO: 164785 - DNA, 19 bp, Homo sapiens
catctctgtcactgctctt

SEQ ID NO: 164786 - DNA, 22 bp, Homo sapiens
acacagcgtgctcagcagctga

SEQ ID NO: 164787 - DNA, 20 bp, Homo sapiens
ttttccattttttttgagat

SEQ ID NO: 164788 - DNA, 21 bp, Homo sapiens
actctgtctcactatctcgac

SEQ ID NO: 164789 - DNA, 23 bp, Homo sapiens
agcggtagtgaagatgaagcaga

SEQ ID NO: 164790 - DNA, 23 bp, Homo sapiens
ttgctatatgaccttaggcaagt

SEQ ID NO: 164791 - DNA, 20 bp, Homo sapiens
aatgcagtggcgcaatcatg

SEQ ID NO: 164792 - DNA, 22 bp, Homo sapiens
aaagctaggctagaacaggcac

SEQ ID NO: 164793 - DNA, 23 bp, Homo sapiens
agtagcacgagctctgtctcctg

SEQ ID NO: 164794 - DNA, 23 bp, Homo sapiens
gcaaagcacacggcctgcagaga

SEQ ID NO: 164795 - DNA, 19 bp, Homo sapiens
tgagatggtgtctcgctct

SEQ ID NO: 164796 - DNA, 23 bp, Homo sapiens
actgcctctctctggccttcagt

SEQ ID NO: 164797 - DNA, 23 bp, Homo sapiens
tcagtctggctctctgacccggt

SEQ ID NO: 164798 - DNA, 22 bp, Homo sapiens
tgagcaacaaagtgagacccct

SEQ ID NO: 164799 - DNA, 23 bp, Homo sapiens
gggacggagtctcgctctgtctc

SEQ ID NO: 164800 - DNA, 23 bp, Homo sapiens
agacggagtctcactctgtcacc

SEQ ID NO: 164801 - DNA, 21 bp, Homo sapiens
tgcaggggagtgatcttggct

SEQ ID NO: 164802 - DNA, 22 bp, Homo sapiens
tggcactgcaccgctatgtcag

SEQ ID NO: 164803 - DNA, 20 bp, Homo sapiens
tgacaggagagtgtgtgcag

SEQ ID NO: 164804 - DNA, 21 bp, Homo sapiens
tgagacagaatctcactctgt

SEQ ID NO: 164805 - DNA, 22 bp, Homo sapiens
atcacaccaagctaatctttat

SEQ ID NO: 164806 - DNA, 18 bp, Homo sapiens
cacctgtagtcccagctg

SEQ ID NO: 164807 - DNA, 23 bp, Homo sapiens
ggagtctcgctctgtctcccagg

SEQ ID NO: 164808 - DNA, 23 bp, Homo sapiens
gtgcctctgtccctctgtgctca

SEQ ID NO: 164809 - DNA, 23 bp, Homo sapiens
tgagacagagtctggctctgtcg

SEQ ID NO: 164810 - DNA, 23 bp, Homo sapiens
tggtgtctcactttgatgttcag

SEQ ID NO: 164811 - DNA, 23 bp, Homo sapiens
tggctctgtctctgtctgtgtcc

SEQ ID NO: 164812 - DNA, 23 bp, Homo sapiens
cctcagtctctctctctctgggt

SEQ ID NO: 164813 - DNA, 18 bp, Homo sapiens
gagtctcgctctgtcacc

SEQ ID NO: 164814 - DNA, 21 bp, Homo sapiens
gactctgtgtgtgtgtgtttg

SEQ ID NO: 164815 - DNA, 23 bp, Homo sapiens
ggagtctcactctgtcacccagg

SEQ ID NO: 164816 - DNA, 23 bp, Homo sapiens
tatatatacacacacatatacgt

SEQ ID NO: 164817 - DNA, 21 bp, Homo sapiens
tctctcaggctgtctcagtgg

SEQ ID NO: 164818 - DNA, 19 bp, Homo sapiens
gtatgaactgctgcacctg

SEQ ID NO: 164819 - DNA, 19 bp, Homo sapiens
tttcttttagtttttgatc

SEQ ID NO: 164820 - DNA, 22 bp, Homo sapiens
aatggcttctaaagaaatgagt

SEQ ID NO: 164821 - DNA, 23 bp, Homo sapiens
attagcagtagttgcttttcagt

SEQ ID NO: 164822 - DNA, 23 bp, Homo sapiens
agtgaatctctgtctgtctgtct

SEQ ID NO: 164823 - DNA, 18 bp, Homo sapiens
ttgtgtaggactttgtat

SEQ ID NO: 164824 - DNA, 23 bp, Homo sapiens
cggagtctcgctctgtcaccctg

SEQ ID NO: 164825 - DNA, 23 bp, Homo sapiens
tataggtttcaaatgatatgaaa

SEQ ID NO: 164826 - DNA, 19 bp, Homo sapiens
ttgactgaagagagagagg

SEQ ID NO: 164827 - DNA, 20 bp, Homo sapiens
aattctccacttagtggacc

SEQ ID NO: 164828 - DNA, 20 bp, Homo sapiens
ctggagtgcatgtttcttgt

SEQ ID NO: 164829 - DNA, 19 bp, Homo sapiens
gacagaggtggtgcagctg

SEQ ID NO: 164830 - DNA, 19 bp, Homo sapiens
tcagtctctgtctccgttt

SEQ ID NO: 164831 - DNA, 23 bp, Homo sapiens
ttgagacaagagtctcgctctgt

SEQ ID NO: 164832 - DNA, 23 bp, Homo sapiens
gacccaaactctctctcactgtg

SEQ ID NO: 164833 - DNA, 23 bp, Homo sapiens
ggagtctcactctgtcacccagg

SEQ ID NO: 164834 - DNA, 23 bp, Homo sapiens
caaggggcttagtgtctatagag

SEQ ID NO: 164835 - DNA, 23 bp, Homo sapiens
gacagagtctcactctgtcaccc

SEQ ID NO: 164836 - DNA, 23 bp, Homo sapiens
acctgtcaccagacagtgaccac

SEQ ID NO: 164837 - DNA, 23 bp, Homo sapiens
agactgagtctcattctgtcacc

SEQ ID NO: 164838 - DNA, 23 bp, Homo sapiens
actgaggctctctctgagccaaa

SEQ ID NO: 164839 - DNA, 20 bp, Homo sapiens
tgtgtgtgtgtgtgtatata

SEQ ID NO: 164840 - DNA, 19 bp, Homo sapiens
cagtctcgctctgtcaccc

SEQ ID NO: 164841 - DNA, 21 bp, Homo sapiens
tttttttgagacggagtgttg

SEQ ID NO: 164842 - DNA, 23 bp, Homo sapiens
cctgcctgtcactcactgggtcc

SEQ ID NO: 164843 - DNA, 23 bp, Homo sapiens
gacagagtctcgctctgtcaccc

SEQ ID NO: 164844 - DNA, 23 bp, Homo sapiens
gtcaggcagactctgtccctcag

SEQ ID NO: 164845 - DNA, 23 bp, Homo sapiens
gagtctctgtgtgtctgggcctc

SEQ ID NO: 164846 - DNA, 18 bp, Homo sapiens
taatgaatataagtatgt

SEQ ID NO: 164847 - DNA, 18 bp, Homo sapiens
tgggcatttagtgcagga

SEQ ID NO: 164848 - DNA, 23 bp, Homo sapiens
tctctcagtgtctcagttgtggc

SEQ ID NO: 164849 - DNA, 23 bp, Homo sapiens
aggtctgagatcaaggtgtcagc

SEQ ID NO: 164850 - DNA, 22 bp, Homo sapiens
tcactgcctgtctgagtctgtg

SEQ ID NO: 164851 - DNA, 23 bp, Homo sapiens
tctgcctgtgtcactcactgcgt

SEQ ID NO: 164852 - DNA, 23 bp, Homo sapiens
aggtctgagatcaaggtgtcagc

SEQ ID NO: 164853 - DNA, 22 bp, Homo sapiens
tcactgcctgtctgagtctgtg

SEQ ID NO: 164854 - DNA, 23 bp, Homo sapiens
tctagatctctttgtatgtctgt

SEQ ID NO: 164855 - DNA, 22 bp, Homo sapiens
ggaggttgaggttgcagtgatc

SEQ ID NO: 164856 - DNA, 23 bp, Homo sapiens
gtgactgtgtgtgtctctttgtg

SEQ ID NO: 164857 - DNA, 23 bp, Homo sapiens
agcagtctatagactcatttttc

SEQ ID NO: 164858 - DNA, 23 bp, Homo sapiens
tgagacagagtctggctctgttg

SEQ ID NO: 164859 - DNA, 20 bp, Homo sapiens
tgacactagagacagagggc

SEQ ID NO: 164860 - DNA, 23 bp, Homo sapiens
tgagacggcgtctcgctctgtct

SEQ ID NO: 164861 - DNA, 23 bp, Homo sapiens
tgagacagggtctctgtcaccca

SEQ ID NO: 164862 - DNA, 22 bp, Homo sapiens
gtgctttgaacttttttttgtt

SEQ ID NO: 164863 - DNA, 23 bp, Homo sapiens
aaaactctgagcatagagtgtcc

SEQ ID NO: 164864 - DNA, 20 bp, Homo sapiens
ctggactgatgtgacttggt

SEQ ID NO: 164865 - DNA, 21 bp, Homo sapiens
tccctctgttcccatctgtga

SEQ ID NO: 164866 - DNA, 23 bp, Homo sapiens
tgagatggagtctcactctgtcg

SEQ ID NO: 164867 - DNA, 23 bp, Homo sapiens
gctgtgtatagatgaatgggcat

SEQ ID NO: 164868 - DNA, 23 bp, Homo sapiens
ttgagacagagtcttgctctgtc

SEQ ID NO: 164869 - DNA, 21 bp, Homo sapiens
ctgtttcttgcggtctgtctc

SEQ ID NO: 164870 - DNA, 23 bp, Homo sapiens
acagtgactggtagagaacaagc

SEQ ID NO: 164871 - DNA, 23 bp, Homo sapiens
atatgtatatgtatatgtgtgta

SEQ ID NO: 164872 - DNA, 22 bp, Homo sapiens
gcttctctttctctgtgcaatc

SEQ ID NO: 164873 - DNA, 19 bp, Homo sapiens
agagtcctcctcacaatgc

SEQ ID NO: 164874 - DNA, 23 bp, Homo sapiens
tggtgacactggagagagaggac

SEQ ID NO: 164875 - DNA, 23 bp, Homo sapiens
tcagccaccctgtgtgtctgcaa

SEQ ID NO: 164876 - DNA, 23 bp, Homo sapiens
tacatgtgtgaagttggtgtgct

SEQ ID NO: 164877 - DNA, 23 bp, Homo sapiens
tgagttcattgtagattctggat

SEQ ID NO: 164878 - DNA, 23 bp, Homo sapiens
tgagttcattgtagattctggat

SEQ ID NO: 164879 - DNA, 23 bp, Homo sapiens
agtctctgtgagtgtctgagcga

SEQ ID NO: 164880 - DNA, 23 bp, Homo sapiens
ttgagacagagtctcgctctgtc

SEQ ID NO: 164881 - DNA, 23 bp, Homo sapiens
actgaatctgtctgtgtgcctgg

SEQ ID NO: 164882 - DNA, 18 bp, Homo sapiens
tgagagggtggtgagcag

SEQ ID NO: 164883 - DNA, 21 bp, Homo sapiens
tcacatgcactcacactcatt

SEQ ID NO: 164884 - DNA, 23 bp, Homo sapiens
aggaagtctcactctgttgccca

SEQ ID NO: 164885 - DNA, 23 bp, Homo sapiens
agaaagagcttttgtttatgtta

SEQ ID NO: 164886 - DNA, 19 bp, Homo sapiens
atagatttgaccttatggg

SEQ ID NO: 164887 - DNA, 23 bp, Homo sapiens
gtggaaggatcactagaggccag

SEQ ID NO: 164888 - DNA, 23 bp, Homo sapiens
aatagtccatcaacataccactg

SEQ ID NO: 164889 - DNA, 23 bp, Homo sapiens
aaggagtctcactctgtcaccca

SEQ ID NO: 164890 - DNA, 18 bp, Homo sapiens
cagtggtaagattttggc

SEQ ID NO: 164891 - DNA, 22 bp, Homo sapiens
tctctgggtctgtctgtgcatg

SEQ ID NO: 164892 - DNA, 23 bp, Homo sapiens
gacagagtctcgctctgtcaccc

SEQ ID NO: 164893 - DNA, 23 bp, Homo sapiens
acagagtctcgctctgtcaccca

SEQ ID NO: 164894 - DNA, 23 bp, Homo sapiens
acagagtctcgctctgtcacccc

SEQ ID NO: 164895 - DNA, 23 bp, Homo sapiens
actctgtcacccagactagagtg

SEQ ID NO: 164896 - DNA, 23 bp, Homo sapiens
acagaggaagattctgtctcaaa

SEQ ID NO: 164897 - DNA, 22 bp, Homo sapiens
tctgagacagagtctcactctg

SEQ ID NO: 164898 - DNA, 23 bp, Homo sapiens
ggctcagtctgtccgtctgtcca

SEQ ID NO: 164899 - DNA, 22 bp, Homo sapiens
tcactgtaacctctacctcctg

SEQ ID NO: 164900 - DNA, 23 bp, Homo sapiens
caggatctcactctgtcactcag

SEQ ID NO: 164901 - DNA, 19 bp, Homo sapiens
ttatcattgcctggtgttg

SEQ ID NO: 164902 - DNA, 22 bp, Homo sapiens
agatagagtcttgctttgttgc

SEQ ID NO: 164903 - DNA, 19 bp, Homo sapiens
tgactgttgacagtggcca

SEQ ID NO: 164904 - DNA, 19 bp, Homo sapiens
ggtccacgtcttgcagctg

SEQ ID NO: 164905 - DNA, 19 bp, Homo sapiens
gagagagagagagttctga

SEQ ID NO: 164906 - DNA, 23 bp, Homo sapiens
tgtgtatatatacgtatatgtgt

SEQ ID NO: 164907 - DNA, 23 bp, Homo sapiens
tatgtgtgtatatatatgtgtgt

SEQ ID NO: 164908 - DNA, 21 bp, Homo sapiens
tctcttctacttgctgcttat

SEQ ID NO: 164909 - DNA, 23 bp, Homo sapiens
tttttcttttgagacggagtctt

SEQ ID NO: 164910 - DNA, 23 bp, Homo sapiens
atgggcagaggttgcagtgagag

SEQ ID NO: 164911 - DNA, 19 bp, Homo sapiens
tgagatggagtctcgctct

SEQ ID NO: 164912 - DNA, 20 bp, Homo sapiens
aggactttggcttttgtcac

SEQ ID NO: 164913 - DNA, 18 bp, Homo sapiens
tatatatgtatttgtgtg

SEQ ID NO: 164914 - DNA, 23 bp, Homo sapiens
ttttggtttttaaaagcagtatg

SEQ ID NO: 164915 - DNA, 19 bp, Homo sapiens
atggagtttcgcttttgtg

SEQ ID NO: 164916 - DNA, 23 bp, Homo sapiens
tgagttcattgtagattctggat

SEQ ID NO: 164917 - DNA, 23 bp, Homo sapiens
tgagttcattgtagattctggat

SEQ ID NO: 164918 - DNA, 23 bp, Homo sapiens
ttattggtcttacacattattgg

SEQ ID NO: 164919 - DNA, 22 bp, Homo sapiens
tttctcacccagactagagtgc

SEQ ID NO: 164920 - DNA, 23 bp, Homo sapiens
atttgtggaagtagagctggtag

SEQ ID NO: 164921 - DNA, 22 bp, Homo sapiens
actgtatttcctggtgaattag

SEQ ID NO: 164922 - DNA, 23 bp, Homo sapiens
tgtttgtgtgtacttatgagatc

SEQ ID NO: 164923 - DNA, 23 bp, Homo sapiens
tgtggttgtgactgagtctgttt

SEQ ID NO: 164924 - DNA, 21 bp, Homo sapiens
tctctctgtctcccagcccaa

SEQ ID NO: 164925 - DNA, 20 bp, Homo sapiens
tgggagaagagggtgagcag

SEQ ID NO: 164926 - DNA, 23 bp, Homo sapiens
ggattgtcttggctatgcaggct

SEQ ID NO: 164927 - DNA, 18 bp, Homo sapiens
tgtctgccactctgccag

SEQ ID NO: 164928 - DNA, 23 bp, Homo sapiens
acagtctcactctgtcactcagg

SEQ ID NO: 164929 - DNA, 18 bp, Homo sapiens
tacaggcatgagccactg

SEQ ID NO: 164930 - DNA, 23 bp, Homo sapiens
gagtctcactctgtcacccaggc

SEQ ID NO: 164931 - DNA, 22 bp, Homo sapiens
acggagtctcgctctgtcaccc

SEQ ID NO: 164932 - DNA, 23 bp, Homo sapiens
gagaaggagtctcactctgtcac

SEQ ID NO: 164933 - DNA, 23 bp, Homo sapiens
gagacagagtctcgctctgttgc

SEQ ID NO: 164934 - DNA, 23 bp, Homo sapiens
ccaaaagacaagagtgtgagccc

SEQ ID NO: 164935 - DNA, 23 bp, Homo sapiens
tctctcccactgtgtgtgctgtg

SEQ ID NO: 164936 - DNA, 23 bp, Homo sapiens
gggtctcactctgtcacccaggc

SEQ ID NO: 164937 - DNA, 23 bp, Homo sapiens
acagtctcactctgtcacccagg

SEQ ID NO: 164938 - DNA, 22 bp, Homo sapiens
agtgcagcggtgtgaccttggc

SEQ ID NO: 164939 - DNA, 23 bp, Homo sapiens
tctgatctctgctgatatgtgag

SEQ ID NO: 164940 - DNA, 23 bp, Homo sapiens
gacagagtctcgctctgtcaccc

SEQ ID NO: 164941 - DNA, 23 bp, Homo sapiens
cggagtctcactcactcttttgc

SEQ ID NO: 164942 - DNA, 23 bp, Homo sapiens
caaggtctcactctgtcacccac

SEQ ID NO: 164943 - DNA, 20 bp, Homo sapiens
tgcagtggcatgatcttggc

SEQ ID NO: 164944 - DNA, 23 bp, Homo sapiens
tgacagagtgagactctgtctca

SEQ ID NO: 164945 - DNA, 19 bp, Homo sapiens
ttagaggcaggtcttcctg

SEQ ID NO: 164946 - DNA, 23 bp, Homo sapiens
cctgctgtctctctgtccctcgg

SEQ ID NO: 164947 - DNA, 23 bp, Homo sapiens
atatgtatatgtgtatatgtgtg

SEQ ID NO: 164948 - DNA, 21 bp, Homo sapiens
acagagtctggctctgtcacc

SEQ ID NO: 164949 - DNA, 23 bp, Homo sapiens
cggagtctcgctctgtctcccag

SEQ ID NO: 164950 - DNA, 23 bp, Homo sapiens
atgtgtatatatgtatatgtgtg

SEQ ID NO: 164951 - DNA, 23 bp, Homo sapiens
acatgtatgtgtgtgtgtatatg

SEQ ID NO: 164952 - DNA, 23 bp, Homo sapiens
atatgtatacatgtatatgtgtg

SEQ ID NO: 164953 - DNA, 23 bp, Homo sapiens
tatatgtatatgtgtatatgtat

SEQ ID NO: 164954 - DNA, 23 bp, Homo sapiens
tatgtgcatgtgtatatgtgtgt

SEQ ID NO: 164955 - DNA, 18 bp, Homo sapiens
catgtgtgtatatatgta

SEQ ID NO: 164956 - DNA, 23 bp, Homo sapiens
atgtgtatatatgtatatgtgta

SEQ ID NO: 164957 - DNA, 22 bp, Homo sapiens
tgtgtgtatatatgtatatgtg

SEQ ID NO: 164958 - DNA, 21 bp, Homo sapiens
tgtatacatgtatatgtgtgt

SEQ ID NO: 164959 - DNA, 18 bp, Homo sapiens
atatatatgtatatgtgt

SEQ ID NO: 164960 - DNA, 22 bp, Homo sapiens
tatgcgtatatatgtacatgtg

SEQ ID NO: 164961 - DNA, 23 bp, Homo sapiens
atatgtatatatgtatatgtgtg

SEQ ID NO: 164962 - DNA, 20 bp, Homo sapiens
tatgtgtatatatgtatatg

SEQ ID NO: 164963 - DNA, 21 bp, Homo sapiens
atgtatatatgtatatgtgtg

SEQ ID NO: 164964 - DNA, 23 bp, Homo sapiens
tctgagtgagaaatgggaggtgc

SEQ ID NO: 164965 - DNA, 23 bp, Homo sapiens
gagacagtctccctctgtcaccc

SEQ ID NO: 164966 - DNA, 23 bp, Homo sapiens
gagtcacactctgtcacccaggc

SEQ ID NO: 164967 - DNA, 18 bp, Homo sapiens
agctggagtatagtggct

SEQ ID NO: 164968 - DNA, 19 bp, Homo sapiens
ctctttgtgtgtctgcgtc

SEQ ID NO: 164969 - DNA, 23 bp, Homo sapiens
acacagaagagagtgaagtcaag

SEQ ID NO: 164970 - DNA, 23 bp, Homo sapiens
ccagtgtctgtgtgtctgtctcc

SEQ ID NO: 164971 - DNA, 23 bp, Homo sapiens
cggagtctcgctgtctcccaggc

SEQ ID NO: 164972 - DNA, 23 bp, Homo sapiens
catgtgcttgtgtgtgcctgtgt

SEQ ID NO: 164973 - DNA, 23 bp, Homo sapiens
ccgagtctcactgtgtcacccag

SEQ ID NO: 164974 - DNA, 23 bp, Homo sapiens
cggagtctcactctgtcacccag

SEQ ID NO: 164975 - DNA, 22 bp, Homo sapiens
ctctgtgcctctgtttctgcct

SEQ ID NO: 164976 - DNA, 23 bp, Homo sapiens
gagtctcactctgtcacccaggc

SEQ ID NO: 164977 - DNA, 23 bp, Homo sapiens
cggagtctcactgtgtcacccag

SEQ ID NO: 164978 - DNA, 18 bp, Homo sapiens
cagtggcatgattttggc

SEQ ID NO: 164979 - DNA, 23 bp, Homo sapiens
tgagttcattgtagattctggat

SEQ ID NO: 164980 - DNA, 23 bp, Homo sapiens
tgagttcattgtagattctggat

SEQ ID NO: 164981 - DNA, 23 bp, Homo sapiens
tgagcctccgtgtctggctaagg

SEQ ID NO: 164982 - DNA, 19 bp, Homo sapiens
aaactggtaatctatttat

SEQ ID NO: 164983 - DNA, 23 bp, Homo sapiens
gctttcacttgtgtttctgattt

SEQ ID NO: 164984 - DNA, 23 bp, Homo sapiens
gtctcgctctgtcgctctgtcac

SEQ ID NO: 164985 - DNA, 23 bp, Homo sapiens
ttgtgtctgagtcactccctgag

SEQ ID NO: 164986 - DNA, 21 bp, Homo sapiens
aatgactcagatacaagtttg

SEQ ID NO: 164987 - DNA, 22 bp, Homo sapiens
tgtaatgatggagtttcgctat

SEQ ID NO: 164988 - DNA, 18 bp, Homo sapiens
ttttgggtcattttgatg

SEQ ID NO: 164989 - DNA, 23 bp, Homo sapiens
agactgcagtgagctatgctggt

SEQ ID NO: 164990 - DNA, 22 bp, Homo sapiens
ttacagacataagccactgcac

SEQ ID NO: 164991 - DNA, 18 bp, Homo sapiens
gtgtgtgtgtgtgttggg

SEQ ID NO: 164992 - DNA, 18 bp, Homo sapiens
gtgtgtgtgtgtgttggg

SEQ ID NO: 164993 - DNA, 18 bp, Homo sapiens
agtgcgtgtctgtgtgcc

SEQ ID NO: 164994 - DNA, 18 bp, Homo sapiens
gtgtgtgtgtgtgttggg

SEQ ID NO: 164995 - DNA, 18 bp, Homo sapiens
gtgtgtgtgtgtgttggg

SEQ ID NO: 164996 - DNA, 18 bp, Homo sapiens
agtgcgtgtctgtgtgcc

SEQ ID NO: 164997 - DNA, 23 bp, Homo sapiens
ttgttgactatttgtatttgtga

SEQ ID NO: 164998 - DNA, 21 bp, Homo sapiens
tgggttacatgagattttgat

SEQ ID NO: 164999 - DNA, 23 bp, Homo sapiens
tttttgtggtagccactgaaatg

SEQ ID NO: 165000 - DNA, 23 bp, Homo sapiens
agactgagagaggagatggtgaa

SEQ ID NO: 165001 - DNA, 23 bp, Homo sapiens
tcataggttttgaagatgttttg

SEQ ID NO: 165002 - DNA, 22 bp, Homo sapiens
taaataacagtgcagcctggca

SEQ ID NO: 165003 - DNA, 23 bp, Homo sapiens
gagacagagtctcgctgtgtcac

SEQ ID NO: 165004 - DNA, 23 bp, Homo sapiens
tcagtactcagatacctgttggt

SEQ ID NO: 165005 - DNA, 21 bp, Homo sapiens
ctcactggaatagaaattctg

SEQ ID NO: 165006 - DNA, 23 bp, Homo sapiens
gacagtctcgctctgtcacccac

SEQ ID NO: 165007 - DNA, 18 bp, Homo sapiens
tatatagtattacataag

SEQ ID NO: 165008 - DNA, 23 bp, Homo sapiens
tgagtcggagtctcactctgtcc

SEQ ID NO: 165009 - DNA, 23 bp, Homo sapiens
tccctgtgactgtcacttctgcc

SEQ ID NO: 165010 - DNA, 22 bp, Homo sapiens
agagaaacaagaggcagtgatg

SEQ ID NO: 165011 - DNA, 22 bp, Homo sapiens
tggagtctcactctctgtcacc

SEQ ID NO: 165012 - DNA, 23 bp, Homo sapiens
agagtctcactctgtcacccagg

SEQ ID NO: 165013 - DNA, 23 bp, Homo sapiens
gagacggagtctcactctgtcac

SEQ ID NO: 165014 - DNA, 22 bp, Homo sapiens
gagctgactctctctgtgcctg

SEQ ID NO: 165015 - DNA, 23 bp, Homo sapiens
acagtctcgcagtctccctctgt

SEQ ID NO: 165016 - DNA, 22 bp, Homo sapiens
cagtgtctgcatttggtcctgg

SEQ ID NO: 165017 - DNA, 23 bp, Homo sapiens
tgtgtgtgtatatatatacgtgt

SEQ ID NO: 165018 - DNA, 22 bp, Homo sapiens
tctctctctgtcactccacact

SEQ ID NO: 165019 - DNA, 18 bp, Homo sapiens
ctgagcctgtgagggtgg

SEQ ID NO: 165020 - DNA, 23 bp, Homo sapiens
acagggtctcactctgtggccct

SEQ ID NO: 165021 - DNA, 23 bp, Homo sapiens
tggagtctcactctgtcacccag

SEQ ID NO: 165022 - DNA, 20 bp, Homo sapiens
ttgctggagaggaaatgagt

SEQ ID NO: 165023 - DNA, 22 bp, Homo sapiens
cattgaattgtgtttttgttca

SEQ ID NO: 165024 - DNA, 20 bp, Homo sapiens
ttgactgaagagactgtcca

SEQ ID NO: 165025 - DNA, 23 bp, Homo sapiens
gtaaatgttcttggtgcctttgt

SEQ ID NO: 165026 - DNA, 23 bp, Homo sapiens
tgactctgtttctctgggaggga

SEQ ID NO: 165027 - DNA, 23 bp, Homo sapiens
gggtctcactctgtcacacccag

SEQ ID NO: 165028 - DNA, 23 bp, Homo sapiens
agtgcagtgacacgatcttgtct

SEQ ID NO: 165029 - DNA, 23 bp, Homo sapiens
gttacccaggctggtatcgaact

SEQ ID NO: 165030 - DNA, 23 bp, Homo sapiens
tatgtgtgtgtgtacatgtgtgt

SEQ ID NO: 165031 - DNA, 19 bp, Homo sapiens
atataccatgcatatatat

SEQ ID NO: 165032 - DNA, 23 bp, Homo sapiens
aaggagtctcactctgtcaccca

SEQ ID NO: 165033 - DNA, 22 bp, Homo sapiens
gacagagtgagactctgtctca

SEQ ID NO: 165034 - DNA, 23 bp, Homo sapiens
agaatctgtatggtaacattgca

SEQ ID NO: 165035 - DNA, 23 bp, Homo sapiens
aaactacaacagaatctgtatgg

SEQ ID NO: 165036 - DNA, 22 bp, Homo sapiens
agagtctcactctgtcacccag

SEQ ID NO: 165037 - DNA, 23 bp, Homo sapiens
agtgcagtgggatgactttgact

SEQ ID NO: 165038 - DNA, 18 bp, Homo sapiens
gaacaagtgatagcctgg

SEQ ID NO: 165039 - DNA, 23 bp, Homo sapiens
ctgtctgtctgtccctcccacag

SEQ ID NO: 165040 - DNA, 23 bp, Homo sapiens
agagacaggatctcactttgtct

SEQ ID NO: 165041 - DNA, 23 bp, Homo sapiens
ctcagcgtctctcagggacagtg

SEQ ID NO: 165042 - DNA, 23 bp, Homo sapiens
ttgagacaagagtctcgctctgt

SEQ ID NO: 165043 - DNA, 21 bp, Homo sapiens
tggagtctcactctgtctccc

SEQ ID NO: 165044 - DNA, 23 bp, Homo sapiens
tgagacagagtctcgctctgtcg

SEQ ID NO: 165045 - DNA, 20 bp, Homo sapiens
tctcactgtgttgcctgggc

SEQ ID NO: 165046 - DNA, 23 bp, Homo sapiens
tattcattttgaggctgggtctt

SEQ ID NO: 165047 - DNA, 23 bp, Homo sapiens
tgagacagaatctcactctgtcg

SEQ ID NO: 165048 - DNA, 18 bp, Homo sapiens
aacagagtgtgatcttgt

SEQ ID NO: 165049 - DNA, 22 bp, Homo sapiens
tgagacagtctcgttctgtcac

SEQ ID NO: 165050 - DNA, 23 bp, Homo sapiens
attgattttgtattctgcaactt

SEQ ID NO: 165051 - DNA, 23 bp, Homo sapiens
tcagatctaagagtcgtttggtg

SEQ ID NO: 165052 - DNA, 23 bp, Homo sapiens
atgtctaaatatatgtatgtcta

SEQ ID NO: 165053 - DNA, 23 bp, Homo sapiens
tatatgtctaaatatatgtatgt

SEQ ID NO: 165054 - DNA, 19 bp, Homo sapiens
tcagaaagggcgttctttt

SEQ ID NO: 165055 - DNA, 23 bp, Homo sapiens
tatatgtatatatgtatatgtgt

SEQ ID NO: 165056 - DNA, 23 bp, Homo sapiens
actgtcacagtctctctaatgcc

SEQ ID NO: 165057 - DNA, 21 bp, Homo sapiens
tctggaaaactttggaaagaa

SEQ ID NO: 165058 - DNA, 21 bp, Homo sapiens
tgacacgctggtttgatgtgg

SEQ ID NO: 165059 - DNA, 23 bp, Homo sapiens
aagactctgtctcaaatatgtgt

SEQ ID NO: 165060 - DNA, 23 bp, Homo sapiens
agactgagtctcgctctgtcacc

SEQ ID NO: 165061 - DNA, 21 bp, Homo sapiens
gtggaaggatcagttgaggcc

SEQ ID NO: 165062 - DNA, 20 bp, Homo sapiens
tctgttgaaaaagtacagaa

SEQ ID NO: 165063 - DNA, 23 bp, Homo sapiens
tgttttctctgcttctctagggt

SEQ ID NO: 165064 - DNA, 23 bp, Homo sapiens
ttgaagcaggttaccttttgcct

SEQ ID NO: 165065 - DNA, 18 bp, Homo sapiens
acagagtgagacttcatc

SEQ ID NO: 165066 - DNA, 23 bp, Homo sapiens
tgagtcaaggtctggctctgttg

SEQ ID NO: 165067 - DNA, 23 bp, Homo sapiens
tatagtatgttattgcatagtat

SEQ ID NO: 165068 - DNA, 23 bp, Homo sapiens
cagggactctctcacattctgtc

SEQ ID NO: 165069 - DNA, 21 bp, Homo sapiens
gtctcactttgtcactcaggc

SEQ ID NO: 165070 - DNA, 23 bp, Homo sapiens
ttctccatcagcatgtgctgctt

SEQ ID NO: 165071 - DNA, 23 bp, Homo sapiens
atatggtttgtatacgtgtatgt

SEQ ID NO: 165072 - DNA, 22 bp, Homo sapiens
tgggtgagtggtaatgggagtg

SEQ ID NO: 165073 - DNA, 23 bp, Homo sapiens
tgatcaaagaacagactgagaag

SEQ ID NO: 165074 - DNA, 20 bp, Homo sapiens
tgaatagtatgaaatgagaa

SEQ ID NO: 165075 - DNA, 21 bp, Homo sapiens
attcttctgattttgatgttt

SEQ ID NO: 165076 - DNA, 18 bp, Homo sapiens
ttaagattgtgatttttc

SEQ ID NO: 165077 - DNA, 23 bp, Homo sapiens
tgagttcattgtagattctggat

SEQ ID NO: 165078 - DNA, 23 bp, Homo sapiens
tgagttcattgtagattctggat

SEQ ID NO: 165079 - DNA, 23 bp, Homo sapiens
caatctctttcaggtttgggtgt

SEQ ID NO: 165080 - DNA, 20 bp, Homo sapiens
tatcatccgagaggctctgt

SEQ ID NO: 165081 - DNA, 22 bp, Homo sapiens
gggagtcactcagtgcctgagg

SEQ ID NO: 165082 - DNA, 23 bp, Homo sapiens
tacacgtatatatatagtgtatg

SEQ ID NO: 165083 - DNA, 21 bp, Homo sapiens
tatattgtacatatacatata

SEQ ID NO: 165084 - DNA, 23 bp, Homo sapiens
atatctatgaatttgtatatgta

SEQ ID NO: 165085 - DNA, 23 bp, Homo sapiens
tttgctgagttttgctatggcag

SEQ ID NO: 165086 - DNA, 23 bp, Homo sapiens
ttctgcttcctcatcactttttt

SEQ ID NO: 165087 - DNA, 23 bp, Homo sapiens
gtctcacacacagtctggatgga

SEQ ID NO: 165088 - DNA, 18 bp, Homo sapiens
gagtcaaggaagtgtcct

SEQ ID NO: 165089 - DNA, 23 bp, Homo sapiens
cctccctggctgcctgtgtccca

SEQ ID NO: 165090 - DNA, 19 bp, Homo sapiens
gtctcagcaagtcatgtgg

SEQ ID NO: 165091 - DNA, 20 bp, Homo sapiens
catacaatatagattgctgt

SEQ ID NO: 165092 - DNA, 23 bp, Homo sapiens
aaacttgtcacacattcaggatg

SEQ ID NO: 165093 - DNA, 23 bp, Homo sapiens
gaatacacaactctgtctgtaca

SEQ ID NO: 165094 - DNA, 23 bp, Homo sapiens
agtatcacagtcttgctatctcc

SEQ ID NO: 165095 - DNA, 23 bp, Homo sapiens
gggtctcactctcactctgttgc

SEQ ID NO: 165096 - DNA, 18 bp, Homo sapiens
tgcagtggcgtgatcttg

SEQ ID NO: 165097 - DNA, 22 bp, Homo sapiens
actgtgcctgtgtcactgtgag

SEQ ID NO: 165098 - DNA, 18 bp, Homo sapiens
atagcagcgactcagtca

SEQ ID NO: 165099 - DNA, 23 bp, Homo sapiens
acctctctgtctctgaggctcag

SEQ ID NO: 165100 - DNA, 23 bp, Homo sapiens
cagtgtctcactctgtcgctcag

SEQ ID NO: 165101 - DNA, 23 bp, Homo sapiens
atatacgtatatatatatgtgtg

SEQ ID NO: 165102 - DNA, 20 bp, Homo sapiens
tcgcaagtgtgcacatgtgt

SEQ ID NO: 165103 - DNA, 23 bp, Homo sapiens
gatggagtctcactctgtcaccc

SEQ ID NO: 165104 - DNA, 21 bp, Homo sapiens
tctgtccctctcagtggccct

SEQ ID NO: 165105 - DNA, 23 bp, Homo sapiens
tgagttcattgtagattctggat

SEQ ID NO: 165106 - DNA, 23 bp, Homo sapiens
tgagttcattgtagattctggat

SEQ ID NO: 165107 - DNA, 18 bp, Homo sapiens
ctgagaccacctggttgt

SEQ ID NO: 165108 - DNA, 23 bp, Homo sapiens
tccctgtcccagagggtgtccct

SEQ ID NO: 165109 - DNA, 23 bp, Homo sapiens
tgtgtgtttctctgagtccgcgt

SEQ ID NO: 165110 - DNA, 21 bp, Homo sapiens
tctctgttgtgtgtgaccact

SEQ ID NO: 165111 - DNA, 18 bp, Homo sapiens
gtgtgtgtgtgtatacac

SEQ ID NO: 165112 - DNA, 23 bp, Homo sapiens
tgcgtgtgtgtatatatatgtgt

SEQ ID NO: 165113 - DNA, 23 bp, Homo sapiens
gaactttgtttttcataaagggt

SEQ ID NO: 165114 - DNA, 23 bp, Homo sapiens
tgagttcattgtagattctggat

SEQ ID NO: 165115 - DNA, 23 bp, Homo sapiens
tgagttcattgtagattctggat

SEQ ID NO: 165116 - DNA, 23 bp, Homo sapiens
caccctggctgtgtgggccatgt

SEQ ID NO: 165117 - DNA, 23 bp, Homo sapiens
ggagactctcactctgattcata

SEQ ID NO: 165118 - DNA, 23 bp, Homo sapiens
acaatctatactgtccaatgcta

SEQ ID NO: 165119 - DNA, 21 bp, Homo sapiens
agtgtgcgtgtgtgtgtgctt

SEQ ID NO: 165120 - DNA, 21 bp, Homo sapiens
tgaggagtttagactcttgca

SEQ ID NO: 165121 - DNA, 23 bp, Homo sapiens
gtctgtctctccctcatagcagt

SEQ ID NO: 165122 - DNA, 23 bp, Homo sapiens
acacacacctatatacatatgtg

SEQ ID NO: 165123 - DNA, 23 bp, Homo sapiens
atacatgtatattggtgtgagtg

SEQ ID NO: 165124 - DNA, 21 bp, Homo sapiens
tatgtatgtatatatgtgtga

SEQ ID NO: 165125 - DNA, 19 bp, Homo sapiens
agtcattagagtatctcac

SEQ ID NO: 165126 - DNA, 21 bp, Homo sapiens
gatgttctctgaatttcttga

SEQ ID NO: 165127 - DNA, 21 bp, Homo sapiens
cagtggcatgatcttggctca

SEQ ID NO: 165128 - DNA, 23 bp, Homo sapiens
actgtgtctctgtgtttctgggc

SEQ ID NO: 165129 - DNA, 23 bp, Homo sapiens
gtatgtgtatgtgtgtgtgcgtg

SEQ ID NO: 165130 - DNA, 23 bp, Homo sapiens
tgcatctgcatgtgcatgtgtgt

SEQ ID NO: 165131 - DNA, 18 bp, Homo sapiens
agtttttgaatatctaac

SEQ ID NO: 165132 - DNA, 22 bp, Homo sapiens
acactctgagatgtggctgcga

SEQ ID NO: 165133 - DNA, 23 bp, Homo sapiens
aatgactcgtgttcatttccatc

SEQ ID NO: 165134 - DNA, 21 bp, Homo sapiens
ctcactgaagtgtctgaccag

SEQ ID NO: 165135 - DNA, 23 bp, Homo sapiens
tgagttcattgtagattctggat

SEQ ID NO: 165136 - DNA, 23 bp, Homo sapiens
tgagttcattgtagattctggat

SEQ ID NO: 165137 - DNA, 23 bp, Homo sapiens
cctcactgtctgtctgtctgttt

SEQ ID NO: 165138 - DNA, 23 bp, Homo sapiens
tgagtccatggtgtgtgtgtgtg

SEQ ID NO: 165139 - DNA, 20 bp, Homo sapiens
accttgagttaccatcatgt

SEQ ID NO: 165140 - DNA, 19 bp, Homo sapiens
agttattatatatgtacat

SEQ ID NO: 165141 - DNA, 20 bp, Homo sapiens
tcactcatggtttggctctc

SEQ ID NO: 165142 - DNA, 22 bp, Homo sapiens
aaaactgctttatgaaaagaaa

SEQ ID NO: 165143 - DNA, 19 bp, Homo sapiens
acatgtgcacaatgtgcag

SEQ ID NO: 165144 - DNA, 23 bp, Homo sapiens
tgtgtgtgtgtctcacattaggg

SEQ ID NO: 165145 - DNA, 23 bp, Homo sapiens
aatgtaaaagtattcccttttca

SEQ ID NO: 165146 - DNA, 19 bp, Homo sapiens
aaagaaaaagaaaaagaga

SEQ ID NO: 165147 - DNA, 23 bp, Homo sapiens
agagtctcactctgtctcccagg

SEQ ID NO: 165148 - DNA, 23 bp, Homo sapiens
tatgtcacactgtcacaatgacc

SEQ ID NO: 165149 - DNA, 23 bp, Homo sapiens
aaagcagaggcaggagagtaaca

SEQ ID NO: 165150 - DNA, 22 bp, Homo sapiens
tctgagactctgtgactgagaa

SEQ ID NO: 165151 - DNA, 20 bp, Homo sapiens
tttgtggtaccatataaatt

SEQ ID NO: 165152 - DNA, 23 bp, Homo sapiens
tggaagctgctttgttcagggct

SEQ ID NO: 165153 - DNA, 22 bp, Homo sapiens
gtcagtttcttcatttctgata

SEQ ID NO: 165154 - DNA, 23 bp, Homo sapiens
ccaggtggtgattttcttgtaca

SEQ ID NO: 165155 - DNA, 23 bp, Homo sapiens
tatgtctgtgaaagaattagggc

SEQ ID NO: 165156 - DNA, 22 bp, Homo sapiens
tattctatagaagatctttaag

SEQ ID NO: 165157 - DNA, 23 bp, Homo sapiens
gtatgtgtgtgtgcatgtgtgtg

SEQ ID NO: 165158 - DNA, 21 bp, Homo sapiens
ctctcgctctgtcactcaggc

SEQ ID NO: 165159 - DNA, 22 bp, Homo sapiens
tagaactagaatattgatttag

SEQ ID NO: 165160 - DNA, 23 bp, Homo sapiens
gctgtgacactctctgtgccacc

SEQ ID NO: 165161 - DNA, 23 bp, Homo sapiens
tgaactgtgtcagtttgtgaaat

SEQ ID NO: 165162 - DNA, 23 bp, Homo sapiens
tacatgagtgtttttgttttgtt

SEQ ID NO: 165163 - DNA, 18 bp, Homo sapiens
gacagagtctcgctctgt

SEQ ID NO: 165164 - DNA, 22 bp, Homo sapiens
tgtcaacgtgtgaaattcagga

SEQ ID NO: 165165 - DNA, 23 bp, Homo sapiens
acaatgtgcagagtctgtgtctg

SEQ ID NO: 165166 - DNA, 23 bp, Homo sapiens
cagctgagagatatcacagaggc

SEQ ID NO: 165167 - DNA, 20 bp, Homo sapiens
gaatggatctctgggtgtct

SEQ ID NO: 165168 - DNA, 22 bp, Homo sapiens
tgagatctcattttctttttgt

SEQ ID NO: 165169 - DNA, 18 bp, Homo sapiens
tgactcacttctgtgccc

SEQ ID NO: 165170 - DNA, 23 bp, Homo sapiens
tggaatgatgattgtctgcagct

SEQ ID NO: 165171 - DNA, 23 bp, Homo sapiens
gagtctcactctgtgtcccaggc

SEQ ID NO: 165172 - DNA, 19 bp, Homo sapiens
tgtgtgtgtatatatatac

SEQ ID NO: 165173 - DNA, 23 bp, Homo sapiens
atgtgtgtatatatatgtgtgtg

SEQ ID NO: 165174 - DNA, 21 bp, Homo sapiens
tgatgtgatgcttttctctct

SEQ ID NO: 165175 - DNA, 18 bp, Homo sapiens
ggagtctcactcagtcac

SEQ ID NO: 165176 - DNA, 23 bp, Homo sapiens
tcattggtagcttcatggggatg

SEQ ID NO: 165177 - DNA, 23 bp, Homo sapiens
agaatcatcctgagtcttctctg

SEQ ID NO: 165178 - DNA, 23 bp, Homo sapiens
gctgtgacactctctgtgccacc

SEQ ID NO: 165179 - DNA, 23 bp, Homo sapiens
gatatgtcacaattgtctatgtg

SEQ ID NO: 165180 - DNA, 23 bp, Homo sapiens
tgtcagaagagacacatcactag

SEQ ID NO: 165181 - DNA, 19 bp, Homo sapiens
tatccatatatatccatat

SEQ ID NO: 165182 - DNA, 20 bp, Homo sapiens
tccgtgtgtgtatatatata

SEQ ID NO: 165183 - DNA, 23 bp, Homo sapiens
taatttagttgtaaggctattct

SEQ ID NO: 165184 - DNA, 20 bp, Homo sapiens
ctctgtcacccagaatggag

SEQ ID NO: 165185 - DNA, 22 bp, Homo sapiens
ttgtaggatttctttccagtat

SEQ ID NO: 165186 - DNA, 23 bp, Homo sapiens
ttgaatgtaatcaagtaaggcag

SEQ ID NO: 165187 - DNA, 20 bp, Homo sapiens
acaagagtgaaacctcatgt

SEQ ID NO: 165188 - DNA, 23 bp, Homo sapiens
gatggagtctcgctctgtcaccc

SEQ ID NO: 165189 - DNA, 23 bp, Homo sapiens
taatgtctgagttttttattttc

SEQ ID NO: 165190 - DNA, 22 bp, Homo sapiens
agtatataactgtccatctggt

SEQ ID NO: 165191 - DNA, 21 bp, Homo sapiens
ggaactctctgtgttgagtaa

SEQ ID NO: 165192 - DNA, 19 bp, Homo sapiens
atgtgagcagataatgatg

SEQ ID NO: 165193 - DNA, 23 bp, Homo sapiens
atgtaacagcatctgcttccggt

SEQ ID NO: 165194 - DNA, 23 bp, Homo sapiens
tgagacagagttttgctcttgtc

SEQ ID NO: 165195 - DNA, 23 bp, Homo sapiens
gtgtaacagcatctgcttctggt

SEQ ID NO: 165196 - DNA, 23 bp, Homo sapiens
agcctctgtggctctgtgtcctg

SEQ ID NO: 165197 - DNA, 21 bp, Homo sapiens
tccacagctaagatgctggga

SEQ ID NO: 165198 - DNA, 18 bp, Homo sapiens
tgttttactaccaattat

SEQ ID NO: 165199 - DNA, 23 bp, Homo sapiens
tgagttcattgtagattctggat

SEQ ID NO: 165200 - DNA, 23 bp, Homo sapiens
tgagttcattgtagattctggat

SEQ ID NO: 165201 - DNA, 22 bp, Homo sapiens
tggtaggcacttgtaatctttt

SEQ ID NO: 165202 - DNA, 23 bp, Homo sapiens
tacatgtgcacaatgtgcaggtt

SEQ ID NO: 165203 - DNA, 23 bp, Homo sapiens
tatatgtatatgtacatatatgt

SEQ ID NO: 165204 - DNA, 20 bp, Homo sapiens
atgtaaatattaatgtatac

SEQ ID NO: 165205 - DNA, 23 bp, Homo sapiens
ttagacacgattttattctgttt

SEQ ID NO: 165206 - DNA, 22 bp, Homo sapiens
agcaagtactgtatctgcagaa

SEQ ID NO: 165207 - DNA, 23 bp, Homo sapiens
cacacttctgagtgtgacacgcc

SEQ ID NO: 165208 - DNA, 23 bp, Homo sapiens
tgatttcatccaacactcattca

SEQ ID NO: 165209 - DNA, 22 bp, Homo sapiens
tatttgcatggttttgatggtt

SEQ ID NO: 165210 - DNA, 23 bp, Homo sapiens
atgtgacatcagtttttgttgta

SEQ ID NO: 165211 - DNA, 23 bp, Homo sapiens
gactgagtctcgctctgtcaccc

SEQ ID NO: 165212 - DNA, 23 bp, Homo sapiens
gagtctcacactgtcacccaggc

SEQ ID NO: 165213 - DNA, 23 bp, Homo sapiens
tctggctctgtgtgacacactcg

SEQ ID NO: 165214 - DNA, 23 bp, Homo sapiens
ttgagacagggtctcactctgtc

SEQ ID NO: 165215 - DNA, 23 bp, Homo sapiens
tgagacaggattttgctctgtca

SEQ ID NO: 165216 - DNA, 23 bp, Homo sapiens
ctgagccactgtgtctggctgga

SEQ ID NO: 165217 - DNA, 23 bp, Homo sapiens
ttaagagatagcatctctagggc

SEQ ID NO: 165218 - DNA, 23 bp, Homo sapiens
tgagaaggagtctcactgtgttg

SEQ ID NO: 165219 - DNA, 23 bp, Homo sapiens
actgtgtctgtctgtctcttcta

SEQ ID NO: 165220 - DNA, 20 bp, Homo sapiens
agggtctcactctgacgctc

SEQ ID NO: 165221 - DNA, 22 bp, Homo sapiens
cctgtagtcccagctactctgg

SEQ ID NO: 165222 - DNA, 23 bp, Homo sapiens
acaggatctcactctgtgtcacc

SEQ ID NO: 165223 - DNA, 23 bp, Homo sapiens
agagacagtgctgtgtgtgcaca

SEQ ID NO: 165224 - DNA, 21 bp, Homo sapiens
atggaccacaaggcactctct

SEQ ID NO: 165225 - DNA, 23 bp, Homo sapiens
tggagtctcactctgtcacccag

SEQ ID NO: 165226 - DNA, 23 bp, Homo sapiens
acagagtctcgctctgtcaccca

SEQ ID NO: 165227 - DNA, 18 bp, Homo sapiens
acacacacacgtttgtat

SEQ ID NO: 165228 - DNA, 21 bp, Homo sapiens
tggagtctggctctgtcactc

SEQ ID NO: 165229 - DNA, 23 bp, Homo sapiens
ttttgagacagagtctcgctctg

SEQ ID NO: 165230 - DNA, 23 bp, Homo sapiens
agagtctcactctgtcacccagg

SEQ ID NO: 165231 - DNA, 23 bp, Homo sapiens
actgtctgagatgttcctgacag

SEQ ID NO: 165232 - DNA, 19 bp, Homo sapiens
ttttgagacggagtctcac

SEQ ID NO: 165233 - DNA, 22 bp, Homo sapiens
agtctcgctctgtcactcaggc

SEQ ID NO: 165234 - DNA, 18 bp, Homo sapiens
tggtgtgcatctgtagtc

SEQ ID NO: 165235 - DNA, 21 bp, Homo sapiens
tgcaatgagctaggactgtgc

SEQ ID NO: 165236 - DNA, 23 bp, Homo sapiens
tgagacggagtctcactctgtcg

SEQ ID NO: 165237 - DNA, 22 bp, Homo sapiens
tttgagacggagtctcgctctg

SEQ ID NO: 165238 - DNA, 18 bp, Homo sapiens
aggtagactaaaatcttt

SEQ ID NO: 165239 - DNA, 23 bp, Homo sapiens
tgagacagagtctcgctctgtcg

SEQ ID NO: 165240 - DNA, 23 bp, Homo sapiens
tctagccctgctagtttctggtg

SEQ ID NO: 165241 - DNA, 23 bp, Homo sapiens
gggagggtctcactctgtgtccc

SEQ ID NO: 165242 - DNA, 23 bp, Homo sapiens
tgtgtgcgtatatgtgtgtgtgt

SEQ ID NO: 165243 - DNA, 23 bp, Homo sapiens
aaatgagctgggtgtgctgcatg

SEQ ID NO: 165244 - DNA, 18 bp, Homo sapiens
tcagcctgagacagagac

SEQ ID NO: 165245 - DNA, 22 bp, Homo sapiens
tagctgggactacaagtgcaca

SEQ ID NO: 165246 - DNA, 23 bp, Homo sapiens
atgtctccgtgagtctgtgcctc

SEQ ID NO: 165247 - DNA, 23 bp, Homo sapiens
tggctctcagtctctgccttgcc

SEQ ID NO: 165248 - DNA, 23 bp, Homo sapiens
gacagagtctcgctctgtcaccc

SEQ ID NO: 165249 - DNA, 23 bp, Homo sapiens
gcccacagtccctctgactcggg

SEQ ID NO: 165250 - DNA, 22 bp, Homo sapiens
cacaaagaaaactgcaaatgcc

SEQ ID NO: 165251 - DNA, 20 bp, Homo sapiens
taatgtaatatattatatgt

SEQ ID NO: 165252 - DNA, 23 bp, Homo sapiens
cctctcactgtctgtctggctcc

SEQ ID NO: 165253 - DNA, 21 bp, Homo sapiens
agactggctggcaatgtggct

SEQ ID NO: 165254 - DNA, 21 bp, Homo sapiens
tgaggtaggaggatcgattga

SEQ ID NO: 165255 - DNA, 19 bp, Homo sapiens
acagagtctcactctccca

SEQ ID NO: 165256 - DNA, 19 bp, Homo sapiens
tgagactctgtctctgcaa

SEQ ID NO: 165257 - DNA, 23 bp, Homo sapiens
gttgagatcaaatgaaaagtgaa

SEQ ID NO: 165258 - DNA, 23 bp, Homo sapiens
ttttgagacacagcctcgctctg

SEQ ID NO: 165259 - DNA, 18 bp, Homo sapiens
tttagagacagggtctca

SEQ ID NO: 165260 - DNA, 23 bp, Homo sapiens
tggagtctcactctgtctcccag

SEQ ID NO: 165261 - DNA, 22 bp, Homo sapiens
ttgacacagagtttcactctgt

SEQ ID NO: 165262 - DNA, 23 bp, Homo sapiens
agatggagtctcactctgtcgct

SEQ ID NO: 165263 - DNA, 22 bp, Homo sapiens
tgtgtatatatacgtgtgtgta

SEQ ID NO: 165264 - DNA, 23 bp, Homo sapiens
atgtgtgtatatatacgtgtgtg

SEQ ID NO: 165265 - DNA, 23 bp, Homo sapiens
actacaggtgtgagtcattgtgc

SEQ ID NO: 165266 - DNA, 23 bp, Homo sapiens
tgagatggagtctcactctgtcc

SEQ ID NO: 165267 - DNA, 23 bp, Homo sapiens
tgttacagcatctccatggggta

SEQ ID NO: 165268 - DNA, 18 bp, Homo sapiens
tttgtttttgtttttttg

SEQ ID NO: 165269 - DNA, 19 bp, Homo sapiens
acagtcctgttggtggccc

SEQ ID NO: 165270 - DNA, 21 bp, Homo sapiens
cttgagactgggaggttgagg

SEQ ID NO: 165271 - DNA, 23 bp, Homo sapiens
aagagaatggatttgatcttttt

SEQ ID NO: 165272 - DNA, 20 bp, Homo sapiens
tgtgcatatatatggatatg

SEQ ID NO: 165273 - DNA, 19 bp, Homo sapiens
tgtgtacatgtgtgttcat

SEQ ID NO: 165274 - DNA, 23 bp, Homo sapiens
gttggtgtgtcggagcctcgctg

SEQ ID NO: 165275 - DNA, 23 bp, Homo sapiens
ctctctcctgccttcactgcctc

SEQ ID NO: 165276 - DNA, 23 bp, Homo sapiens
ttttgagacggagtcttgctctg

SEQ ID NO: 165277 - DNA, 23 bp, Homo sapiens
gagacagagtctcactctgtcac

SEQ ID NO: 165278 - DNA, 23 bp, Homo sapiens
tatacgtatatatgtatatgtgt

SEQ ID NO: 165279 - DNA, 23 bp, Homo sapiens
tatgtgtatatatgtgtgtgtat

SEQ ID NO: 165280 - DNA, 23 bp, Homo sapiens
ctcagagcctcagtttttgctct

SEQ ID NO: 165281 - DNA, 21 bp, Homo sapiens
aatgggagtgagtgttgagag

SEQ ID NO: 165282 - DNA, 23 bp, Homo sapiens
ggagacaggttcttgttttgtca

SEQ ID NO: 165283 - DNA, 23 bp, Homo sapiens
atgatgatgatgatgatgatgat

SEQ ID NO: 165284 - DNA, 19 bp, Homo sapiens
tttcaatggacacggtggg

SEQ ID NO: 165285 - DNA, 23 bp, Homo sapiens
gtctctgtgtgtatttgtctgtt

SEQ ID NO: 165286 - DNA, 23 bp, Homo sapiens
gacacaaggtcttgctctgttgt

SEQ ID NO: 165287 - DNA, 22 bp, Homo sapiens
gtatgtggaagacttgtgcatt

SEQ ID NO: 165288 - DNA, 23 bp, Homo sapiens
tgtctctgtcactcacagagggc

SEQ ID NO: 165289 - DNA, 23 bp, Homo sapiens
atgagagtgggagacctgccact

SEQ ID NO: 165290 - DNA, 23 bp, Homo sapiens
gatggagtctggctctgtcaccc

SEQ ID NO: 165291 - DNA, 23 bp, Homo sapiens
aaaccctatgttgtagccacagc

SEQ ID NO: 165292 - DNA, 23 bp, Homo sapiens
gtccatcactaactgaaggcagt

SEQ ID NO: 165293 - DNA, 22 bp, Homo sapiens
gacaggctctcactctgttgct

SEQ ID NO: 165294 - DNA, 23 bp, Homo sapiens
tcagagtctcactctgtcgccca

SEQ ID NO: 165295 - DNA, 23 bp, Homo sapiens
agtgacaacacagagaccacatg

SEQ ID NO: 165296 - DNA, 23 bp, Homo sapiens
agagtggcaggagagtctgtgca

SEQ ID NO: 165297 - DNA, 19 bp, Homo sapiens
ccaagtagctgggactaca

SEQ ID NO: 165298 - DNA, 23 bp, Homo sapiens
acacacactcaatgtggctccca

SEQ ID NO: 165299 - DNA, 23 bp, Homo sapiens
tggagtctcactctgtcacccag

SEQ ID NO: 165300 - DNA, 22 bp, Homo sapiens
atacacacacatatatatatgt

SEQ ID NO: 165301 - DNA, 19 bp, Homo sapiens
atatgtgtgtatatatatg

SEQ ID NO: 165302 - DNA, 20 bp, Homo sapiens
atgtgtatatatatacatgt

SEQ ID NO: 165303 - DNA, 23 bp, Homo sapiens
atgaatatgagcaaaacattgaa

SEQ ID NO: 165304 - DNA, 23 bp, Homo sapiens
tttgtttcttattcatttggatt

SEQ ID NO: 165305 - DNA, 21 bp, Homo sapiens
tcagagaagagagtttggaga

SEQ ID NO: 165306 - DNA, 19 bp, Homo sapiens
tgtttctggatactcaatt

SEQ ID NO: 165307 - DNA, 19 bp, Homo sapiens
attaggagtcaatgaaatg

SEQ ID NO: 165308 - DNA, 22 bp, Homo sapiens
attaggagtcaatgaaatgtgt

SEQ ID NO: 165309 - DNA, 21 bp, Homo sapiens
tgtgtgggtggaagtggggca

SEQ ID NO: 165310 - DNA, 23 bp, Homo sapiens
ccctgactgcctctctggctgac

SEQ ID NO: 165311 - DNA, 20 bp, Homo sapiens
tacacacatattatatatgt

SEQ ID NO: 165312 - DNA, 21 bp, Homo sapiens
atacacacatgtatatatgta

SEQ ID NO: 165313 - DNA, 23 bp, Homo sapiens
atatgtgtatatatatatctcac

SEQ ID NO: 165314 - DNA, 18 bp, Homo sapiens
acactagtgattttgtag

SEQ ID NO: 165315 - DNA, 23 bp, Homo sapiens
ttgtaagtgagcagacagaggcc

SEQ ID NO: 165316 - DNA, 23 bp, Homo sapiens
tctgtctgtctctttgttaactg

SEQ ID NO: 165317 - DNA, 23 bp, Homo sapiens
tacgaggacgtgtgtctgtagct

SEQ ID NO: 165318 - DNA, 23 bp, Homo sapiens
ctgcctgtctgtctgcctgtctg

SEQ ID NO: 165319 - DNA, 23 bp, Homo sapiens
ctgtgggtgtcactctgggtaga

SEQ ID NO: 165320 - DNA, 23 bp, Homo sapiens
ttgagacaggttctcactctgtc

SEQ ID NO: 165321 - DNA, 22 bp, Homo sapiens
cctagagtctcatgagtgcgcg

SEQ ID NO: 165322 - DNA, 23 bp, Homo sapiens
acacacacacagagtcatttagg

SEQ ID NO: 165323 - DNA, 23 bp, Homo sapiens
gacagagtctcgctctgtcaccc

SEQ ID NO: 165324 - DNA, 19 bp, Homo sapiens
tgagatggagtctcgctct

SEQ ID NO: 165325 - DNA, 23 bp, Homo sapiens
tttgagacggagtctcgctctgt

SEQ ID NO: 165326 - DNA, 19 bp, Homo sapiens
tgtgatatatatgttatct

SEQ ID NO: 165327 - DNA, 23 bp, Homo sapiens
tttagatagcatatctatgtgat

SEQ ID NO: 165328 - DNA, 23 bp, Homo sapiens
accaagtctcgctctgtcaccca

SEQ ID NO: 165329 - DNA, 20 bp, Homo sapiens
tggtgtgatcttggctcact

SEQ ID NO: 165330 - DNA, 23 bp, Homo sapiens
tgtatgtatagatgtacatcaag

SEQ ID NO: 165331 - DNA, 22 bp, Homo sapiens
agtgagccatgaacatgccact

SEQ ID NO: 165332 - DNA, 23 bp, Homo sapiens
tgagtctcactctgtcacccagg

SEQ ID NO: 165333 - DNA, 23 bp, Homo sapiens
actgagtctcactctgtcgccca

SEQ ID NO: 165334 - DNA, 18 bp, Homo sapiens
acagtggtgtgatctcag

SEQ ID NO: 165335 - DNA, 23 bp, Homo sapiens
ctctctctgcctgtgatcctagc

SEQ ID NO: 165336 - DNA, 23 bp, Homo sapiens
tgagacagagtctggctctgtcg

SEQ ID NO: 165337 - DNA, 23 bp, Homo sapiens
agatggagtctcactctgtcacc

SEQ ID NO: 165338 - DNA, 23 bp, Homo sapiens
cagatgtctgtctgtctgtctgc

SEQ ID NO: 165339 - DNA, 21 bp, Homo sapiens
gagacagtctggctctgttgc

SEQ ID NO: 165340 - DNA, 23 bp, Homo sapiens
tctcatcctgtcactctgtcatt

SEQ ID NO: 165341 - DNA, 18 bp, Homo sapiens
attgaaggagtggaggag

SEQ ID NO: 165342 - DNA, 23 bp, Homo sapiens
agacaagagtctcactctgtggc

SEQ ID NO: 165343 - DNA, 23 bp, Homo sapiens
gacacagagtctcgctctgtcac

SEQ ID NO: 165344 - DNA, 18 bp, Homo sapiens
attaaatatgaatatgta

SEQ ID NO: 165345 - DNA, 18 bp, Homo sapiens
cacctgtagttccagcta

SEQ ID NO: 165346 - DNA, 22 bp, Homo sapiens
atcacattgccagggatttcca

SEQ ID NO: 165347 - DNA, 20 bp, Homo sapiens
tagctgcttgtgagcagggt

SEQ ID NO: 165348 - DNA, 23 bp, Homo sapiens
gttcacagtggctaagttccgcc

SEQ ID NO: 165349 - DNA, 18 bp, Homo sapiens
gtgcctactgagctgaaa

SEQ ID NO: 165350 - DNA, 22 bp, Homo sapiens
tggctcagttcagcaggaacag

SEQ ID NO: 165351 - DNA, 23 bp, Homo sapiens
gtgagtgtggagggatgtgtact

SEQ ID NO: 165352 - DNA, 23 bp, Homo sapiens
cccaaagtgtgaggattacaggt

SEQ ID NO: 165353 - DNA, 22 bp, Homo sapiens
cagagtctcactcagtcgccca

SEQ ID NO: 165354 - DNA, 22 bp, Homo sapiens
cagagtctcactcagtcgccca

SEQ ID NO: 165355 - DNA, 23 bp, Homo sapiens
agtcggagtctcactgtcactca

SEQ ID NO: 165356 - DNA, 22 bp, Homo sapiens
tcactacaccctctgcctccca

SEQ ID NO: 165357 - DNA, 23 bp, Homo sapiens
gtgagccactgtgcctggctctt

SEQ ID NO: 165358 - DNA, 19 bp, Homo sapiens
gagagggtctcactctgtt

SEQ ID NO: 165359 - DNA, 21 bp, Homo sapiens
ttggtcgttcttgtagtctca

SEQ ID NO: 165360 - DNA, 23 bp, Homo sapiens
ctgacactgactgactgactgac

SEQ ID NO: 165361 - DNA, 22 bp, Homo sapiens
tctctctctgtctcccaggctg

SEQ ID NO: 165362 - DNA, 23 bp, Homo sapiens
tgagatggagtctcactctgttg

SEQ ID NO: 165363 - DNA, 23 bp, Homo sapiens
ttacatgagccactgcacccagc

SEQ ID NO: 165364 - DNA, 18 bp, Homo sapiens
gagcaagactctgtctca

SEQ ID NO: 165365 - DNA, 23 bp, Homo sapiens
gagacggagtctctctgtgtcgc

SEQ ID NO: 165366 - DNA, 23 bp, Homo sapiens
ctgagacagagtctcgttctgtc

SEQ ID NO: 165367 - DNA, 23 bp, Homo sapiens
tctgagtttacagatgagagcca

SEQ ID NO: 165368 - DNA, 22 bp, Homo sapiens
taaagatgtctgattttgttgt

SEQ ID NO: 165369 - DNA, 22 bp, Homo sapiens
tctgttctgtgtctgtcttctt

SEQ ID NO: 165370 - DNA, 21 bp, Homo sapiens
tgaggtaggaggatctcttga

SEQ ID NO: 165371 - DNA, 22 bp, Homo sapiens
aactaggttctcaggtggaaaa

SEQ ID NO: 165372 - DNA, 20 bp, Homo sapiens
ggcgacagactgagactctg

SEQ ID NO: 165373 - DNA, 23 bp, Homo sapiens
acagagtcacgctctgtcaccca

SEQ ID NO: 165374 - DNA, 23 bp, Homo sapiens
tgtgtatatatatgtgtatgtat

SEQ ID NO: 165375 - DNA, 23 bp, Homo sapiens
tgtacacgcacacacacatatgt

SEQ ID NO: 165376 - DNA, 22 bp, Homo sapiens
tgtgtgtatatatatgtatgtg

SEQ ID NO: 165377 - DNA, 22 bp, Homo sapiens
cagacacagtcactgttgcagc

SEQ ID NO: 165378 - DNA, 23 bp, Homo sapiens
tgaggctcagtctcgcactgtca

SEQ ID NO: 165379 - DNA, 23 bp, Homo sapiens
tgtgtgtccctggctggcagtct

SEQ ID NO: 165380 - DNA, 23 bp, Homo sapiens
tgacaggggtttgtgtgtctgga

SEQ ID NO: 165381 - DNA, 23 bp, Homo sapiens
tgagacggagtctcgctctgtca

SEQ ID NO: 165382 - DNA, 20 bp, Homo sapiens
atttgagacagagtctcact

SEQ ID NO: 165383 - DNA, 23 bp, Homo sapiens
gacagagtctcgctctgtcaccc

SEQ ID NO: 165384 - DNA, 22 bp, Homo sapiens
ttaaggctgggaatctgatgag

SEQ ID NO: 165385 - DNA, 21 bp, Homo sapiens
ttgggtagcagagactgaaga

SEQ ID NO: 165386 - DNA, 21 bp, Homo sapiens
ttgggtagcagagactgaaga

SEQ ID NO: 165387 - DNA, 23 bp, Homo sapiens
tactttctctgtctgtgaatttg

SEQ ID NO: 165388 - DNA, 23 bp, Homo sapiens
ttcatagagagagagatatgtgg

SEQ ID NO: 165389 - DNA, 21 bp, Homo sapiens
aaagaactcacactggagaga

SEQ ID NO: 165390 - DNA, 23 bp, Homo sapiens
catagtgagactccatctcttat

SEQ ID NO: 165391 - DNA, 22 bp, Homo sapiens
tgagatggagtttcactcttgt

SEQ ID NO: 165392 - DNA, 19 bp, Homo sapiens
gtctcgctctgtcacccag

SEQ ID NO: 165393 - DNA, 18 bp, Homo sapiens
aacccagaagctcccttt

SEQ ID NO: 165394 - DNA, 23 bp, Homo sapiens
tttgagacggagtctggctgtgt

SEQ ID NO: 165395 - DNA, 23 bp, Homo sapiens
tgcatagtttagaagtttgtggt

SEQ ID NO: 165396 - DNA, 23 bp, Homo sapiens
tatgcttctgctattgatctcta

SEQ ID NO: 165397 - DNA, 23 bp, Homo sapiens
cagagtctcactctgtcatccag

SEQ ID NO: 165398 - DNA, 23 bp, Homo sapiens
tgagacagagtctcgctctgtca

SEQ ID NO: 165399 - DNA, 23 bp, Homo sapiens
tagccactcaatgccctattgtc

SEQ ID NO: 165400 - DNA, 23 bp, Homo sapiens
agacagagtctctctctgtcgcc

SEQ ID NO: 165401 - DNA, 21 bp, Homo sapiens
tgagacagagtctcgcactgt

SEQ ID NO: 165402 - DNA, 21 bp, Homo sapiens
tttgagatggagtcttgctct

SEQ ID NO: 165403 - DNA, 23 bp, Homo sapiens
tggggtctcactctgtcacccag

SEQ ID NO: 165404 - DNA, 23 bp, Homo sapiens
ccctctctgggcctcagtttccc

SEQ ID NO: 165405 - DNA, 22 bp, Homo sapiens
tgtctctgagactcactttcct

SEQ ID NO: 165406 - DNA, 20 bp, Homo sapiens
ggagagtctcactctgtctc

SEQ ID NO: 165407 - DNA, 23 bp, Homo sapiens
cggactctcactctgtcgctcag

SEQ ID NO: 165408 - DNA, 23 bp, Homo sapiens
tctgtcttttactgtgtgacctt

SEQ ID NO: 165409 - DNA, 23 bp, Homo sapiens
tgagacaaagtctcgctctgtcg

SEQ ID NO: 165410 - DNA, 18 bp, Homo sapiens
agcctgagaccccatctc

SEQ ID NO: 165411 - DNA, 20 bp, Homo sapiens
gagttttgctcttgttgccc

SEQ ID NO: 165412 - DNA, 23 bp, Homo sapiens
tatgtgtgtgtgtatatgcatgt

SEQ ID NO: 165413 - DNA, 23 bp, Homo sapiens
tatgtgtctatatattcatgtgt

SEQ ID NO: 165414 - DNA, 23 bp, Homo sapiens
tatgtgtgtgtatatatgtgtgt

SEQ ID NO: 165415 - DNA, 18 bp, Homo sapiens
gctgccctccatgatgct

SEQ ID NO: 165416 - DNA, 23 bp, Homo sapiens
acagtctcgctctgtctgcccag

SEQ ID NO: 165417 - DNA, 21 bp, Homo sapiens
ttttgaggcagagtctcgctc

SEQ ID NO: 165418 - DNA, 23 bp, Homo sapiens
actgtaattcttttgtgcatgtt

SEQ ID NO: 165419 - DNA, 21 bp, Homo sapiens
attatttgtagagatgggttg

SEQ ID NO: 165420 - DNA, 23 bp, Homo sapiens
cggagtctcactctgtcacccag

SEQ ID NO: 165421 - DNA, 23 bp, Homo sapiens
aggctgtagtgagtgagctgtga

SEQ ID NO: 165422 - DNA, 23 bp, Homo sapiens
tctgagtctctctctgttcatcc

SEQ ID NO: 165423 - DNA, 23 bp, Homo sapiens
atgtatgtatatatgtgtgtgta

SEQ ID NO: 165424 - DNA, 22 bp, Homo sapiens
ttttgtacagatgggggtctca

SEQ ID NO: 165425 - DNA, 23 bp, Homo sapiens
ttggagacagagtctcgctctgt

SEQ ID NO: 165426 - DNA, 23 bp, Homo sapiens
ctctctgtgtctgtctgtctcta

SEQ ID NO: 165427 - DNA, 22 bp, Homo sapiens
acagtctcactctgtcgcccag

SEQ ID NO: 165428 - DNA, 23 bp, Homo sapiens
agataagatcagccccagcttgg

SEQ ID NO: 165429 - DNA, 23 bp, Homo sapiens
ttctgagacgtagtctcgctctg

SEQ ID NO: 165430 - DNA, 23 bp, Homo sapiens
ttttctgcatattattagttgga

SEQ ID NO: 165431 - DNA, 18 bp, Homo sapiens
tacgtgtatatatacacg

SEQ ID NO: 165432 - DNA, 23 bp, Homo sapiens
tgagatggagtctcgctctgtca

SEQ ID NO: 165433 - DNA, 18 bp, Homo sapiens
gccgactctctgtctctg

SEQ ID NO: 165434 - DNA, 21 bp, Homo sapiens
tgaggttggaggatcacttga

SEQ ID NO: 165435 - DNA, 23 bp, Homo sapiens
agacagagtcttgctctgtcacc

SEQ ID NO: 165436 - DNA, 21 bp, Homo sapiens
ttgttcttgttttgagacagt

SEQ ID NO: 165437 - DNA, 23 bp, Homo sapiens
ggagtctccctctgtcactcagg

SEQ ID NO: 165438 - DNA, 19 bp, Homo sapiens
taaaaattattctggagag

SEQ ID NO: 165439 - DNA, 18 bp, Homo sapiens
aggtgatcacctggctca

SEQ ID NO: 165440 - DNA, 23 bp, Homo sapiens
tgtctgtgtgactgtcatgcagg

SEQ ID NO: 165441 - DNA, 23 bp, Homo sapiens
tgtctgtgtgattgtcagggaga

SEQ ID NO: 165442 - DNA, 18 bp, Homo sapiens
cttcattgtttttttgtt

SEQ ID NO: 165443 - DNA, 21 bp, Homo sapiens
tgcctgggtccctgttttcct

SEQ ID NO: 165444 - DNA, 23 bp, Homo sapiens
tccagagtagttgggggacagga

SEQ ID NO: 165445 - DNA, 23 bp, Homo sapiens
ctgagactacagactcacctaac

SEQ ID NO: 165446 - DNA, 22 bp, Homo sapiens
tataatgtatgttatatatgat

SEQ ID NO: 165447 - DNA, 23 bp, Homo sapiens
taatgcatacattgtatttgtta

SEQ ID NO: 165448 - DNA, 23 bp, Homo sapiens
tgactgtgtctctctctctgtcc

SEQ ID NO: 165449 - DNA, 23 bp, Homo sapiens
tgactgtgtctctctctctgtcc

SEQ ID NO: 165450 - DNA, 23 bp, Homo sapiens
tgactgtgtctctctctctgtcc

SEQ ID NO: 165451 - DNA, 23 bp, Homo sapiens
tgactgtgtctctctctctgtcc

SEQ ID NO: 165452 - DNA, 23 bp, Homo sapiens
tgtttctctcattccaacgtctg

SEQ ID NO: 165453 - DNA, 23 bp, Homo sapiens
gagatggagtctcgctctgtcac

SEQ ID NO: 165454 - DNA, 23 bp, Homo sapiens
tgagactctgtgtctgtctcagt

SEQ ID NO: 165455 - DNA, 23 bp, Homo sapiens
agattgagtcttactctgtcacc

SEQ ID NO: 165456 - DNA, 20 bp, Homo sapiens
tgagccaccatgcctgcatt

SEQ ID NO: 165457 - DNA, 23 bp, Homo sapiens
cggagtctcactctgtcacccag

SEQ ID NO: 165458 - DNA, 23 bp, Homo sapiens
gagtctcactctgtcacccaggc

SEQ ID NO: 165459 - DNA, 23 bp, Homo sapiens
agacagagggagactgtcttatt

SEQ ID NO: 165460 - DNA, 23 bp, Homo sapiens
tgagatggagtctcactctgtcg

SEQ ID NO: 165461 - DNA, 23 bp, Homo sapiens
ccctgtagtcctagctactctct

SEQ ID NO: 165462 - DNA, 20 bp, Homo sapiens
agccactgtgcccggcctca

SEQ ID NO: 165463 - DNA, 22 bp, Homo sapiens
aaaagagtgaattgtgtacaag

SEQ ID NO: 165464 - DNA, 22 bp, Homo sapiens
tgacaagagtgagattctgtgt

SEQ ID NO: 165465 - DNA, 19 bp, Homo sapiens
agacatggtctttctctgt

SEQ ID NO: 165466 - DNA, 23 bp, Homo sapiens
acagagtctcgctgtgtcactca

SEQ ID NO: 165467 - DNA, 18 bp, Homo sapiens
tggcaagatctcggctta

SEQ ID NO: 165468 - DNA, 23 bp, Homo sapiens
gagacagagtctcactctgttac

SEQ ID NO: 165469 - DNA, 23 bp, Homo sapiens
aactgtagtcccagctattcgag

SEQ ID NO: 165470 - DNA, 23 bp, Homo sapiens
tgtgtgtgtatctgtgtgtgtaa

SEQ ID NO: 165471 - DNA, 23 bp, Homo sapiens
acagagtgtgttgacagcaggaa

SEQ ID NO: 165472 - DNA, 18 bp, Homo sapiens
gggtctcactctgtcacc

SEQ ID NO: 165473 - DNA, 19 bp, Homo sapiens
ctctgacaccctgtcaccc

SEQ ID NO: 165474 - DNA, 21 bp, Homo sapiens
tcagtctggatgtgttgagtc

SEQ ID NO: 165475 - DNA, 23 bp, Homo sapiens
ttttgagacggagtctcactctg

SEQ ID NO: 165476 - DNA, 23 bp, Homo sapiens
ctgaggtaacaggatcacttgag

SEQ ID NO: 165477 - DNA, 23 bp, Homo sapiens
catagcaagactctgtctctaca

SEQ ID NO: 165478 - DNA, 23 bp, Homo sapiens
acagagtctcactctgtcgccca

SEQ ID NO: 165479 - DNA, 22 bp, Homo sapiens
tctcactctgtctcccaggctg

SEQ ID NO: 165480 - DNA, 20 bp, Homo sapiens
tatgtatatatgtatatatg

SEQ ID NO: 165481 - DNA, 20 bp, Homo sapiens
tatgtatatatgtatatatg

SEQ ID NO: 165482 - DNA, 20 bp, Homo sapiens
ttgacatggagtctcactct

SEQ ID NO: 165483 - DNA, 23 bp, Homo sapiens
aggtctcactctgtcacctaggc

SEQ ID NO: 165484 - DNA, 18 bp, Homo sapiens
tctcgctctgtcacccag

SEQ ID NO: 165485 - DNA, 20 bp, Homo sapiens
aggtgctacatagttttgtt

SEQ ID NO: 165486 - DNA, 23 bp, Homo sapiens
ggagtctcactctgtcacccagg

SEQ ID NO: 165487 - DNA, 20 bp, Homo sapiens
tccatgtgtgttctgcatga

SEQ ID NO: 165488 - DNA, 23 bp, Homo sapiens
ggagtctcactctgacacccagg

SEQ ID NO: 165489 - DNA, 23 bp, Homo sapiens
acaggtctgaagagtgtctatcc

SEQ ID NO: 165490 - DNA, 23 bp, Homo sapiens
cagtctcagtctgtcacccaggc

SEQ ID NO: 165491 - DNA, 19 bp, Homo sapiens
tccttgtaagagacacaca

SEQ ID NO: 165492 - DNA, 23 bp, Homo sapiens
caatccaaggatgcatgtgaaat

SEQ ID NO: 165493 - DNA, 23 bp, Homo sapiens
ttgagacagactctcactctgtt

SEQ ID NO: 165494 - DNA, 23 bp, Homo sapiens
cagtgagtccatctcaaaagtaa

SEQ ID NO: 165495 - DNA, 23 bp, Homo sapiens
agagtctcactctgtcacccagg

SEQ ID NO: 165496 - DNA, 23 bp, Homo sapiens
agagtctcactctgtcacccagg

SEQ ID NO: 165497 - DNA, 23 bp, Homo sapiens
tgagacagagtcttgctctgtca

SEQ ID NO: 165498 - DNA, 23 bp, Homo sapiens
agacaggatctctctctctctca

SEQ ID NO: 165499 - DNA, 22 bp, Homo sapiens
tgtctcagcattagctaagcct

SEQ ID NO: 165500 - DNA, 23 bp, Homo sapiens
agtcagtgtctcgctctgtcacc

SEQ ID NO: 165501 - DNA, 20 bp, Homo sapiens
cagtggtgtgatcagagctc

SEQ ID NO: 165502 - DNA, 22 bp, Homo sapiens
ataaatcttgttgacccaggga

SEQ ID NO: 165503 - DNA, 21 bp, Homo sapiens
ttgagagggagtctcgctctg

SEQ ID NO: 165504 - DNA, 23 bp, Homo sapiens
tgagacacagtctcactctgttg

SEQ ID NO: 165505 - DNA, 20 bp, Homo sapiens
tgacagtagagtgtgtggcc

SEQ ID NO: 165506 - DNA, 19 bp, Homo sapiens
tcacacctcacccaggtca

SEQ ID NO: 165507 - DNA, 23 bp, Homo sapiens
ttttgagacggagtctcactcag

SEQ ID NO: 165508 - DNA, 22 bp, Homo sapiens
agtcaagaacagtgggagctct

SEQ ID NO: 165509 - DNA, 19 bp, Homo sapiens
tcactgattctcacacact

SEQ ID NO: 165510 - DNA, 23 bp, Homo sapiens
tgagacggagtctcactctgtcc

SEQ ID NO: 165511 - DNA, 23 bp, Homo sapiens
gtgtctgtgtgtgtgtcagtgtc

SEQ ID NO: 165512 - DNA, 21 bp, Homo sapiens
tgagacagagtctcgctctgt

SEQ ID NO: 165513 - DNA, 23 bp, Homo sapiens
caagtctgtgtgtgtctctgtgt

SEQ ID NO: 165514 - DNA, 23 bp, Homo sapiens
gtgtaagccattactcccggcca

SEQ ID NO: 165515 - DNA, 23 bp, Homo sapiens
aaaaaagaagttgaaaatgcatt

SEQ ID NO: 165516 - DNA, 22 bp, Homo sapiens
tggcagagtgaaactttctttt

SEQ ID NO: 165517 - DNA, 23 bp, Homo sapiens
agacagagtctcactctgtcgcc

SEQ ID NO: 165518 - DNA, 23 bp, Homo sapiens
tgacactgtggctcacacctata

SEQ ID NO: 165519 - DNA, 20 bp, Homo sapiens
agtgctgtttttgtagttca

SEQ ID NO: 165520 - DNA, 23 bp, Homo sapiens
aagagcttcagatttagtaaaac

SEQ ID NO: 165521 - DNA, 23 bp, Homo sapiens
gagacagagtctcgctctgtcac

SEQ ID NO: 165522 - DNA, 23 bp, Homo sapiens
gtctgtgtctctgtgtgactgac

SEQ ID NO: 165523 - DNA, 22 bp, Homo sapiens
aggctctgtgccttcctcgttg

SEQ ID NO: 165524 - DNA, 21 bp, Homo sapiens
acactgttccagggaatgtct

SEQ ID NO: 165525 - DNA, 23 bp, Homo sapiens
tgagacggagtctcgctctgtca

SEQ ID NO: 165526 - DNA, 22 bp, Homo sapiens
taactgagtcagacactgttct

SEQ ID NO: 165527 - DNA, 23 bp, Homo sapiens
ttttgagaccgagtctcactctg

SEQ ID NO: 165528 - DNA, 18 bp, Homo sapiens
tctcgctctgtcacccag

SEQ ID NO: 165529 - DNA, 20 bp, Homo sapiens
taagagtcatgtgaggggct

SEQ ID NO: 165530 - DNA, 23 bp, Homo sapiens
acagagtgagactccatctcatc

SEQ ID NO: 165531 - DNA, 23 bp, Homo sapiens
gagacggagtctcactgtcaccc

SEQ ID NO: 165532 - DNA, 22 bp, Homo sapiens
tcctgagacagagtctcgctct

SEQ ID NO: 165533 - DNA, 18 bp, Homo sapiens
tgaatatatattcacata

SEQ ID NO: 165534 - DNA, 22 bp, Homo sapiens
tgcctcagtttctctgtctgta

SEQ ID NO: 165535 - DNA, 23 bp, Homo sapiens
tataagtatatatgtatatgtgt

SEQ ID NO: 165536 - DNA, 23 bp, Homo sapiens
atgtgtatatatgtatatgtatg

SEQ ID NO: 165537 - DNA, 23 bp, Homo sapiens
tgtgcgtctatctctgtctccgt

SEQ ID NO: 165538 - DNA, 21 bp, Homo sapiens
tgagacagagtctcgctctgt

SEQ ID NO: 165539 - DNA, 20 bp, Homo sapiens
tgagacaacaggcatgcacc

SEQ ID NO: 165540 - DNA, 23 bp, Homo sapiens
ggcagtgaacagactttctggag

SEQ ID NO: 165541 - DNA, 21 bp, Homo sapiens
agacagtctcattctgtcacc

SEQ ID NO: 165542 - DNA, 23 bp, Homo sapiens
gggtctctctctgtcactcaggc

SEQ ID NO: 165543 - DNA, 23 bp, Homo sapiens
ctttttgagacggagtctcactc

SEQ ID NO: 165544 - DNA, 23 bp, Homo sapiens
tagacagtctcgctctgtcaccc

SEQ ID NO: 165545 - DNA, 18 bp, Homo sapiens
agtctccctctgtcaccc

SEQ ID NO: 165546 - DNA, 23 bp, Homo sapiens
tgtctggctgtgtctgtgtgtct

SEQ ID NO: 165547 - DNA, 18 bp, Homo sapiens
gtgaaccactgtgcctgg

SEQ ID NO: 165548 - DNA, 20 bp, Homo sapiens
ggagtctcgctctgtcaccc

SEQ ID NO: 165549 - DNA, 23 bp, Homo sapiens
tgagatggagtctcgctctgtca

SEQ ID NO: 165550 - DNA, 23 bp, Homo sapiens
gagatggagtctctctctgtcgc

SEQ ID NO: 165551 - DNA, 23 bp, Homo sapiens
caaggtctcactctgtcgctcag

SEQ ID NO: 165552 - DNA, 22 bp, Homo sapiens
agagtgcagtggcaggatcttg

SEQ ID NO: 165553 - DNA, 23 bp, Homo sapiens
gctcaccctctgtgcctcggttt

SEQ ID NO: 165554 - DNA, 23 bp, Homo sapiens
aatagacagataaataaagtgag

SEQ ID NO: 165555 - DNA, 19 bp, Homo sapiens
ttacttttgagtcagagtc

SEQ ID NO: 165556 - DNA, 23 bp, Homo sapiens
tgggtctcactctgtctcccagg

SEQ ID NO: 165557 - DNA, 23 bp, Homo sapiens
tgagatggagtcgctctgtctcc

SEQ ID NO: 165558 - DNA, 23 bp, Homo sapiens
cggagtctcgctgtctcccaggc

SEQ ID NO: 165559 - DNA, 23 bp, Homo sapiens
tttgagacagagtcttgttctgt

SEQ ID NO: 165560 - DNA, 23 bp, Homo sapiens
catagtgacaccctgtctttaca

SEQ ID NO: 165561 - DNA, 23 bp, Homo sapiens
cggagtctccctctgtctcccat

SEQ ID NO: 165562 - DNA, 19 bp, Homo sapiens
tgagacagagtctcactct

SEQ ID NO: 165563 - DNA, 23 bp, Homo sapiens
tgagacggagtctcgctctgtct

SEQ ID NO: 165564 - DNA, 23 bp, Homo sapiens
ctgggcctgtcactccctctgta

SEQ ID NO: 165565 - DNA, 23 bp, Homo sapiens
agagtctcactctgtcacccagg

SEQ ID NO: 165566 - DNA, 23 bp, Homo sapiens
cagagtctcgctctgtcacccag

SEQ ID NO: 165567 - DNA, 23 bp, Homo sapiens
tcacacccactctcttgtttctt

SEQ ID NO: 165568 - DNA, 23 bp, Homo sapiens
ctgggtgagagagcgagactcca

SEQ ID NO: 165569 - DNA, 23 bp, Homo sapiens
gagacggagtctcactctgtcac

SEQ ID NO: 165570 - DNA, 23 bp, Homo sapiens
gagagccactggagcacctttct

SEQ ID NO: 165571 - DNA, 23 bp, Homo sapiens
cggagtctcgctgtctcccaggc

SEQ ID NO: 165572 - DNA, 19 bp, Homo sapiens
acacctgtagttccagctg

SEQ ID NO: 165573 - DNA, 22 bp, Homo sapiens
gctgaggtaggaggatcacttg

SEQ ID NO: 165574 - DNA, 20 bp, Homo sapiens
agtctcgctctgtcgctcag

SEQ ID NO: 165575 - DNA, 21 bp, Homo sapiens
tgtgtgtctatgtatttatgt

SEQ ID NO: 165576 - DNA, 21 bp, Homo sapiens
attgcaggtggatatgtatgt

SEQ ID NO: 165577 - DNA, 18 bp, Homo sapiens
agatagttacttatatgg

SEQ ID NO: 165578 - DNA, 23 bp, Homo sapiens
tgagatggagtctctctctgtcg

SEQ ID NO: 165579 - DNA, 23 bp, Homo sapiens
acggagtctcactctgtcaccca

SEQ ID NO: 165580 - DNA, 23 bp, Homo sapiens
cggagtctcactctgtcacccag

SEQ ID NO: 165581 - DNA, 23 bp, Homo sapiens
gagtctcactctgtcacccaggc

SEQ ID NO: 165582 - DNA, 23 bp, Homo sapiens
gacagagtctcgctctgtcaccc

SEQ ID NO: 165583 - DNA, 18 bp, Homo sapiens
tgagacagagtcttgctc

SEQ ID NO: 165584 - DNA, 19 bp, Homo sapiens
tgctgggctggaaggagct

SEQ ID NO: 165585 - DNA, 21 bp, Homo sapiens
gtcacactcagtgagagacgc

SEQ ID NO: 165586 - DNA, 23 bp, Homo sapiens
tgagatggagtctcactctgtcg

SEQ ID NO: 165587 - DNA, 23 bp, Homo sapiens
tctgagacagtcttcttgctctg

SEQ ID NO: 165588 - DNA, 22 bp, Homo sapiens
tgcctgcctgcgtgtttggcgg

SEQ ID NO: 165589 - DNA, 23 bp, Homo sapiens
cagcttctctgtgtgtgtgtgtc

SEQ ID NO: 165590 - DNA, 23 bp, Homo sapiens
gagatggagtctcgctctgtcac

SEQ ID NO: 165591 - DNA, 21 bp, Homo sapiens
tcagacactgcacctggctgc

SEQ ID NO: 165592 - DNA, 23 bp, Homo sapiens
tgtgtgcctgtctgtgtctgtcg

SEQ ID NO: 165593 - DNA, 23 bp, Homo sapiens
tgagatggagtctcactctgtcg

SEQ ID NO: 165594 - DNA, 23 bp, Homo sapiens
tgcgtgtctgcgtgtctgcgtgg

SEQ ID NO: 165595 - DNA, 23 bp, Homo sapiens
gaggacccactgtgtctgtccgt

SEQ ID NO: 165596 - DNA, 23 bp, Homo sapiens
acagagtctcactctgtcgccca

SEQ ID NO: 165597 - DNA, 23 bp, Homo sapiens
tgtccgtcggtctgtgggtcagt

SEQ ID NO: 165598 - DNA, 22 bp, Homo sapiens
ttttgagatggtgtctcgctct

SEQ ID NO: 165599 - DNA, 23 bp, Homo sapiens
cggagtctcactctgtcacccag

SEQ ID NO: 165600 - DNA, 23 bp, Homo sapiens
gagtctcactctgtcacccaggc

SEQ ID NO: 165601 - DNA, 23 bp, Homo sapiens
tgagacagtctcattctgtcacc

SEQ ID NO: 165602 - DNA, 23 bp, Homo sapiens
tttagatggagtctcactctgtc

SEQ ID NO: 165603 - DNA, 23 bp, Homo sapiens
gagacagtctctcgctctgtcgc

SEQ ID NO: 165604 - DNA, 22 bp, Homo sapiens
ctgggtaacatgagaccctctg

SEQ ID NO: 165605 - DNA, 22 bp, Homo sapiens
tctcgctctgtcacccaggctg

SEQ ID NO: 165606 - DNA, 18 bp, Homo sapiens
caagacccagtctcttaa

SEQ ID NO: 165607 - DNA, 22 bp, Homo sapiens
tttgagacagagtctcgctctg

SEQ ID NO: 165608 - DNA, 19 bp, Homo sapiens
tgtgtgtatatacacgttt

SEQ ID NO: 165609 - DNA, 19 bp, Homo sapiens
tgtgtatatatatttgtgt

SEQ ID NO: 165610 - DNA, 23 bp, Homo sapiens
ctatcactgacactctgggtggc

SEQ ID NO: 165611 - DNA, 23 bp, Homo sapiens
caccagcaccagcacagagatag

SEQ ID NO: 165612 - DNA, 22 bp, Homo sapiens
tttgagatggagtcttgctgta

SEQ ID NO: 165613 - DNA, 23 bp, Homo sapiens
tgacccacagtctctccagtcac

SEQ ID NO: 165614 - DNA, 23 bp, Homo sapiens
gtgacccacagtctctccagtca

SEQ ID NO: 165615 - DNA, 23 bp, Homo sapiens
tgacccacagtctctccagtcac

SEQ ID NO: 165616 - DNA, 21 bp, Homo sapiens
tgggtgtcccacagtccctcc

SEQ ID NO: 165617 - DNA, 23 bp, Homo sapiens
tgacccacagtctctccagtcac

SEQ ID NO: 165618 - DNA, 23 bp, Homo sapiens
aaagagtctcactgtgtcgccca

SEQ ID NO: 165619 - DNA, 23 bp, Homo sapiens
tgacatggtctggctctgtcacc

SEQ ID NO: 165620 - DNA, 22 bp, Homo sapiens
atcatggtcattctctgtctca

SEQ ID NO: 165621 - DNA, 20 bp, Homo sapiens
tatgtgtatatatatacaca

SEQ ID NO: 165622 - DNA, 23 bp, Homo sapiens
acacagtcagtctctgtctcttc

SEQ ID NO: 165623 - DNA, 23 bp, Homo sapiens
gaatagctggtagaaagtattga

SEQ ID NO: 165624 - DNA, 23 bp, Homo sapiens
gtatgtatgtatgtatatatgtg

SEQ ID NO: 165625 - DNA, 23 bp, Homo sapiens
tttgcataatacagagtactaga

SEQ ID NO: 165626 - DNA, 18 bp, Homo sapiens
tatactttaagttctagg

SEQ ID NO: 165627 - DNA, 23 bp, Homo sapiens
tacatgtgcacaatgtgcaggtt

SEQ ID NO: 165628 - DNA, 23 bp, Homo sapiens
gtctgtttctagagaaacccagt

SEQ ID NO: 165629 - DNA, 21 bp, Homo sapiens
cagagggttcaagagactgga

SEQ ID NO: 165630 - DNA, 19 bp, Homo sapiens
tcaccctctctgagcctca

SEQ ID NO: 165631 - DNA, 23 bp, Homo sapiens
gggtctcactctgtcacccaggc

SEQ ID NO: 165632 - DNA, 23 bp, Homo sapiens
agagtctcactctgtcacccagg

SEQ ID NO: 165633 - DNA, 23 bp, Homo sapiens
gagtctcactctgtcacccaggc

SEQ ID NO: 165634 - DNA, 23 bp, Homo sapiens
agggtctcactctgtcacccagg

SEQ ID NO: 165635 - DNA, 23 bp, Homo sapiens
gagtctcactctgtcacccaggc

SEQ ID NO: 165636 - DNA, 19 bp, Homo sapiens
ccgtggaacagtgcctggc

SEQ ID NO: 165637 - DNA, 23 bp, Homo sapiens
gtcactgactgtcacagccatga

SEQ ID NO: 165638 - DNA, 23 bp, Homo sapiens
tctgactctctgagactctttcc

SEQ ID NO: 165639 - DNA, 23 bp, Homo sapiens
tctctctgtctgtctgcctgtct

SEQ ID NO: 165640 - DNA, 23 bp, Homo sapiens
actccctgtctgtgtctccagtg

SEQ ID NO: 165641 - DNA, 23 bp, Homo sapiens
atgcgtgtctctcagtcggtcag

SEQ ID NO: 165642 - DNA, 23 bp, Homo sapiens
tgtgacagtgtggtaagctggtt

SEQ ID NO: 165643 - DNA, 22 bp, Homo sapiens
tttgagacagggtctgctctgt

SEQ ID NO: 165644 - DNA, 22 bp, Homo sapiens
acagaagtgacagaagtccaag

SEQ ID NO: 165645 - DNA, 22 bp, Homo sapiens
gattcagtgtcatgtttggagg

SEQ ID NO: 165646 - DNA, 23 bp, Homo sapiens
taatagtgtcagctaaagttcag

SEQ ID NO: 165647 - DNA, 22 bp, Homo sapiens
cagggactgtgtctgtctcatt

SEQ ID NO: 165648 - DNA, 23 bp, Homo sapiens
tagagtgactgcatgtgcttgtg

SEQ ID NO: 165649 - DNA, 23 bp, Homo sapiens
agagtctcactctgtcacccagg

SEQ ID NO: 165650 - DNA, 23 bp, Homo sapiens
gagtctcactctgtcacccaggc

SEQ ID NO: 165651 - DNA, 23 bp, Homo sapiens
tgtgtgtgtgtgtgcttctgcat

SEQ ID NO: 165652 - DNA, 21 bp, Homo sapiens
gcctctcctgactgtgcagat

SEQ ID NO: 165653 - DNA, 22 bp, Homo sapiens
aatgtccttgatcacatgatcc

SEQ ID NO: 165654 - DNA, 23 bp, Homo sapiens
ctgtcaggctgtctctcagctca

SEQ ID NO: 165655 - DNA, 23 bp, Homo sapiens
tatatgtgtatacatatatgtgt

SEQ ID NO: 165656 - DNA, 23 bp, Homo sapiens
atatgtgtatacatatatgtgta

SEQ ID NO: 165657 - DNA, 23 bp, Homo sapiens
atatgtgtatatatatatgtgta

SEQ ID NO: 165658 - DNA, 23 bp, Homo sapiens
atatatgtgtatatatatgtgtg

SEQ ID NO: 165659 - DNA, 18 bp, Homo sapiens
agggtgtttgcagcttgt

SEQ ID NO: 165660 - DNA, 23 bp, Homo sapiens
tcagtgcttcagtgaacatcctt

SEQ ID NO: 165661 - DNA, 22 bp, Homo sapiens
taaagaccattcagtgatgggt

SEQ ID NO: 165662 - DNA, 23 bp, Homo sapiens
tgtcttggtgtaggtctctttga

SEQ ID NO: 165663 - DNA, 19 bp, Homo sapiens
tgagcttcttggatgttta

SEQ ID NO: 165664 - DNA, 22 bp, Homo sapiens
taggtggcttccaagttcctgc

SEQ ID NO: 165665 - DNA, 23 bp, Homo sapiens
gacagagtctcgctctgtcaccc

SEQ ID NO: 165666 - DNA, 23 bp, Homo sapiens
tgttcagctgactttcctccctg

SEQ ID NO: 165667 - DNA, 22 bp, Homo sapiens
tgtagagactgagcagacaagg

SEQ ID NO: 165668 - DNA, 23 bp, Homo sapiens
tctgagacagtgtctcactctga

SEQ ID NO: 165669 - DNA, 23 bp, Homo sapiens
gacagtctcactctgtcacccag

SEQ ID NO: 165670 - DNA, 23 bp, Homo sapiens
tgacctgactttctgtgtgtctg

SEQ ID NO: 165671 - DNA, 18 bp, Homo sapiens
tcaggcactctctctctc

SEQ ID NO: 165672 - DNA, 23 bp, Homo sapiens
tctcactaactctgtgaccttag

SEQ ID NO: 165673 - DNA, 23 bp, Homo sapiens
tttctctccctctctggctcact

SEQ ID NO: 165674 - DNA, 18 bp, Homo sapiens
tgagactccatctcaaac

SEQ ID NO: 165675 - DNA, 18 bp, Homo sapiens
tgagactgagtctcactc

SEQ ID NO: 165676 - DNA, 23 bp, Homo sapiens
ttggagacagggtctcactctgt

SEQ ID NO: 165677 - DNA, 18 bp, Homo sapiens
cgggagtatagtctgcag

SEQ ID NO: 165678 - DNA, 20 bp, Homo sapiens
aggctgtagctagtttagat

SEQ ID NO: 165679 - DNA, 23 bp, Homo sapiens
tgtgctttcagcttctttacagt

SEQ ID NO: 165680 - DNA, 23 bp, Homo sapiens
agcagcattgtacagggctatga

SEQ ID NO: 165681 - DNA, 23 bp, Homo sapiens
tcaaagtgtgtgcacagagtgag

SEQ ID NO: 165682 - DNA, 22 bp, Homo sapiens
aagacacagaaaacagaagtca

SEQ ID NO: 165683 - DNA, 23 bp, Homo sapiens
tgagacagtctcactctgtcacc

SEQ ID NO: 165684 - DNA, 21 bp, Homo sapiens
atggaagttgcatgtttagtt

SEQ ID NO: 165685 - DNA, 23 bp, Homo sapiens
attctgagtttacttcttctggg

SEQ ID NO: 165686 - DNA, 20 bp, Homo sapiens
tgccagaagacagtgagggc

SEQ ID NO: 165687 - DNA, 21 bp, Homo sapiens
tcggagcatgcttcattctgc

SEQ ID NO: 165688 - DNA, 22 bp, Homo sapiens
aacaggatatatatgtgtgtgt

SEQ ID NO: 165689 - DNA, 23 bp, Homo sapiens
cctgttgggtctgggtctgtttc

SEQ ID NO: 165690 - DNA, 23 bp, Homo sapiens
tttggtgatgatgatgatgatga

SEQ ID NO: 165691 - DNA, 23 bp, Homo sapiens
cagtactgtgttgaaagcagtag

SEQ ID NO: 165692 - DNA, 23 bp, Homo sapiens
gtctttttctcactctaaaggga

SEQ ID NO: 165693 - DNA, 22 bp, Homo sapiens
tttgttctttttgcttaggatt

SEQ ID NO: 165694 - DNA, 23 bp, Homo sapiens
ttctgtgaagaaagtcaatggta

SEQ ID NO: 165695 - DNA, 22 bp, Homo sapiens
gtatacatatgcgtgtgtgtat

SEQ ID NO: 165696 - DNA, 22 bp, Homo sapiens
tatgtatgtatgcatgtgtgtg

SEQ ID NO: 165697 - DNA, 19 bp, Homo sapiens
ctttgttgtctccctccag

SEQ ID NO: 165698 - DNA, 21 bp, Homo sapiens
tgactctctgtttctgaatta

SEQ ID NO: 165699 - DNA, 23 bp, Homo sapiens
ccctgactctctctgcctgggtg

SEQ ID NO: 165700 - DNA, 23 bp, Homo sapiens
gggtctcactctgtcactccagc

SEQ ID NO: 165701 - DNA, 21 bp, Homo sapiens
tggaagagtaaaaagccaaga

SEQ ID NO: 165702 - DNA, 22 bp, Homo sapiens
tagtgtgtgcttgtcgtctggc

SEQ ID NO: 165703 - DNA, 20 bp, Homo sapiens
gcatgaagtgagactccaga

SEQ ID NO: 165704 - DNA, 22 bp, Homo sapiens
attctttcgtctcagtctgtga

SEQ ID NO: 165705 - DNA, 23 bp, Homo sapiens
tttttgccacttgtacttttttc

SEQ ID NO: 165706 - DNA, 23 bp, Homo sapiens
gaatttgacagagattatgttat

SEQ ID NO: 165707 - DNA, 23 bp, Homo sapiens
atagtctcactctgtcacccagg

SEQ ID NO: 165708 - DNA, 23 bp, Homo sapiens
tgagtctcactctgtcatccagg

SEQ ID NO: 165709 - DNA, 23 bp, Homo sapiens
gggtctcactctgtcactcaggc

SEQ ID NO: 165710 - DNA, 23 bp, Homo sapiens
ctgaggttgccaaagaagcaggg

SEQ ID NO: 165711 - DNA, 23 bp, Homo sapiens
gcctcacactctgttacactgag

SEQ ID NO: 165712 - DNA, 23 bp, Homo sapiens
ttcagcatcaccatgtcattgca

SEQ ID NO: 165713 - DNA, 20 bp, Homo sapiens
agagttggctttgttaacca

SEQ ID NO: 165714 - DNA, 21 bp, Homo sapiens
atttcagtgcctgctttgagc

SEQ ID NO: 165715 - DNA, 21 bp, Homo sapiens
tgtgtatgtatatatctgtgt

SEQ ID NO: 165716 - DNA, 20 bp, Homo sapiens
tatacagtatatatactagt

SEQ ID NO: 165717 - DNA, 23 bp, Homo sapiens
tgagaatgaatggagatgtatct

SEQ ID NO: 165718 - DNA, 22 bp, Homo sapiens
ttaaagctacagtatagcaatg

SEQ ID NO: 165719 - DNA, 23 bp, Homo sapiens
ttatgtcattttatatatgtgtg

SEQ ID NO: 165720 - DNA, 19 bp, Homo sapiens
tgtatacatgtatatgtat

SEQ ID NO: 165721 - DNA, 23 bp, Homo sapiens
gtgtatattgatgtgtatgtata

SEQ ID NO: 165722 - DNA, 21 bp, Homo sapiens
atacacctacatatacataga

SEQ ID NO: 165723 - DNA, 23 bp, Homo sapiens
tacactctcatatatatgtatgt

SEQ ID NO: 165724 - DNA, 23 bp, Homo sapiens
tgagttcattgtagattctggat

SEQ ID NO: 165725 - DNA, 23 bp, Homo sapiens
tgagttcattgtagattctggat

SEQ ID NO: 165726 - DNA, 22 bp, Homo sapiens
tcaatgtggttttgatttgcat

SEQ ID NO: 165727 - DNA, 23 bp, Homo sapiens
tttactgaatttgtttatcagat

SEQ ID NO: 165728 - DNA, 19 bp, Homo sapiens
ataggttgttacaaagcac

SEQ ID NO: 165729 - DNA, 20 bp, Homo sapiens
tgagacagagtctcgctctg

SEQ ID NO: 165730 - DNA, 23 bp, Homo sapiens
tgtgtcactcgctctctccctct

SEQ ID NO: 165731 - DNA, 23 bp, Homo sapiens
tagaaatctcatttacaacatga

SEQ ID NO: 165732 - DNA, 23 bp, Homo sapiens
tgagttcattgtagattctggat

SEQ ID NO: 165733 - DNA, 23 bp, Homo sapiens
tgagttcattgtagattctggat

SEQ ID NO: 165734 - DNA, 21 bp, Homo sapiens
aaaagaagagtctgagctaac

SEQ ID NO: 165735 - DNA, 19 bp, Homo sapiens
tgtttgttcagattcttgt

SEQ ID NO: 165736 - DNA, 23 bp, Homo sapiens
acagcctcactctgaattaggct

SEQ ID NO: 165737 - DNA, 21 bp, Homo sapiens
tatatgtatatatacatatgt

SEQ ID NO: 165738 - DNA, 20 bp, Homo sapiens
acagcttatacttagaagaa

SEQ ID NO: 165739 - DNA, 23 bp, Homo sapiens
ttgagatggtctctcgctctgtc

SEQ ID NO: 165740 - DNA, 23 bp, Homo sapiens
tctgtatctcactgtcattgctg

SEQ ID NO: 165741 - DNA, 23 bp, Homo sapiens
aatgctcatggttgattactgag

SEQ ID NO: 165742 - DNA, 23 bp, Homo sapiens
ttttgttcatttttattgctaag

SEQ ID NO: 165743 - DNA, 23 bp, Homo sapiens
agacagagtctcactctttgtca

SEQ ID NO: 165744 - DNA, 23 bp, Homo sapiens
tgtgcatttgtatatatatatgt

SEQ ID NO: 165745 - DNA, 19 bp, Homo sapiens
ttatatgtatgtatacaca

SEQ ID NO: 165746 - DNA, 19 bp, Homo sapiens
acacagtatgtatatttca

SEQ ID NO: 165747 - DNA, 23 bp, Homo sapiens
ttaaggctctggatgaattctgt

SEQ ID NO: 165748 - DNA, 18 bp, Homo sapiens
acgtatatgtatgtgtat

SEQ ID NO: 165749 - DNA, 23 bp, Homo sapiens
ctttgtgagttgtattgttaagg

SEQ ID NO: 165750 - DNA, 23 bp, Homo sapiens
tcatactgaatagaaaagctgaa

SEQ ID NO: 165751 - DNA, 23 bp, Homo sapiens
cttgagtctgcaagatgtgtgtg

SEQ ID NO: 165752 - DNA, 22 bp, Homo sapiens
aaaggctccctctgtgcctctg

SEQ ID NO: 165753 - DNA, 23 bp, Homo sapiens
gtgagtgtgtctgttagtgggtg

SEQ ID NO: 165754 - DNA, 22 bp, Homo sapiens
ttctgtgaagaaggtcaatggt

SEQ ID NO: 165755 - DNA, 23 bp, Homo sapiens
aataagcatgcagagaggagaca

SEQ ID NO: 165756 - DNA, 23 bp, Homo sapiens
aagactagtgattatgtatattt

SEQ ID NO: 165757 - DNA, 23 bp, Homo sapiens
tagtgctatgtgccaggcactct

SEQ ID NO: 165758 - DNA, 22 bp, Homo sapiens
tgtgctcaacttgcaagtttgt

SEQ ID NO: 165759 - DNA, 21 bp, Homo sapiens
tactagcttgtgactttctgt

SEQ ID NO: 165760 - DNA, 23 bp, Homo sapiens
actctagcagccaggaagatctt

SEQ ID NO: 165761 - DNA, 23 bp, Homo sapiens
atgaagatttccaggtcagtgtg

SEQ ID NO: 165762 - DNA, 23 bp, Homo sapiens
tgagttcattgtagattctggat

SEQ ID NO: 165763 - DNA, 23 bp, Homo sapiens
tgagttcattgtagattctggat

SEQ ID NO: 165764 - DNA, 22 bp, Homo sapiens
tggttctgggattgttttggct

SEQ ID NO: 165765 - DNA, 23 bp, Homo sapiens
tgagttcattgtagattctggat

SEQ ID NO: 165766 - DNA, 23 bp, Homo sapiens
tgagttcattgtagattctggat

SEQ ID NO: 165767 - DNA, 21 bp, Homo sapiens
tgggttgaatatggaaatgtc

SEQ ID NO: 165768 - DNA, 23 bp, Homo sapiens
cactcactcacaggtaatgaagc

SEQ ID NO: 165769 - DNA, 23 bp, Homo sapiens
cagtctcactctgtcacccaggc

SEQ ID NO: 165770 - DNA, 23 bp, Homo sapiens
gtgtgtgtgtgtctgtgtatgtg

SEQ ID NO: 165771 - DNA, 18 bp, Homo sapiens
acactcaatttgtcatac

SEQ ID NO: 165772 - DNA, 21 bp, Homo sapiens
tgtggtaggaggatgaattga

SEQ ID NO: 165773 - DNA, 23 bp, Homo sapiens
tctgtgaagaaagtcagtggtag

SEQ ID NO: 165774 - DNA, 23 bp, Homo sapiens
aatataacatgctaaagttttat

SEQ ID NO: 165775 - DNA, 23 bp, Homo sapiens
tctgacttcactttcactcacat

SEQ ID NO: 165776 - DNA, 23 bp, Homo sapiens
tcaaggagctttttggttgttta

SEQ ID NO: 165777 - DNA, 20 bp, Homo sapiens
cgtctcactctgtcaccgag

SEQ ID NO: 165778 - DNA, 23 bp, Homo sapiens
tatgagagtcaggactcatggtt

SEQ ID NO: 165779 - DNA, 23 bp, Homo sapiens
tgtccagtgaatactcagatcac

SEQ ID NO: 165780 - DNA, 23 bp, Homo sapiens
ctcactctctctgtgttcattct

SEQ ID NO: 165781 - DNA, 23 bp, Homo sapiens
ttagtctgtggtcaagttgtgat

SEQ ID NO: 165782 - DNA, 22 bp, Homo sapiens
tatgtgtatatgtatatgcata

SEQ ID NO: 165783 - DNA, 23 bp, Homo sapiens
tgagttcattgtagattctggat

SEQ ID NO: 165784 - DNA, 23 bp, Homo sapiens
tgagttcattgtagattctggat

SEQ ID NO: 165785 - DNA, 22 bp, Homo sapiens
gcctctctgtgcctcagtttcc

SEQ ID NO: 165786 - DNA, 18 bp, Homo sapiens
tctctgtagtaaagttta

SEQ ID NO: 165787 - DNA, 18 bp, Homo sapiens
agcggcactagcagcagt

SEQ ID NO: 165788 - DNA, 23 bp, Homo sapiens
ctctcactctgtcacgcaggctg

SEQ ID NO: 165789 - DNA, 23 bp, Homo sapiens
gacacggtcagtgggtcagtggt

SEQ ID NO: 165790 - DNA, 22 bp, Homo sapiens
ctcatgagcttgtggatataga

SEQ ID NO: 165791 - DNA, 23 bp, Homo sapiens
ggaccagcacatttgagtcagtg

SEQ ID NO: 165792 - DNA, 23 bp, Homo sapiens
tgaaagaacagactgagcagaac

SEQ ID NO: 165793 - DNA, 20 bp, Homo sapiens
ttcctgattgctattcttct

SEQ ID NO: 165794 - DNA, 19 bp, Homo sapiens
aggagtttgagattgcagt

SEQ ID NO: 165795 - DNA, 23 bp, Homo sapiens
agcatgcatgtgtgtgtgaaagc

SEQ ID NO: 165796 - DNA, 22 bp, Homo sapiens
tgtatgtcagcatgtggatgtg

SEQ ID NO: 165797 - DNA, 22 bp, Homo sapiens
atatatacacatatacatgtat

SEQ ID NO: 165798 - DNA, 20 bp, Homo sapiens
tgtgtatatatatacacata

SEQ ID NO: 165799 - DNA, 21 bp, Homo sapiens
ttgtaccagactttgtggatt

SEQ ID NO: 165800 - DNA, 22 bp, Homo sapiens
gttaatattgctatgtgtgaat

SEQ ID NO: 165801 - DNA, 22 bp, Homo sapiens
tcacacacatatacatatgtgt

SEQ ID NO: 165802 - DNA, 23 bp, Homo sapiens
gagacggagtctcactctgtctc

SEQ ID NO: 165803 - DNA, 23 bp, Homo sapiens
tgagacagagtctcactctgtcg

SEQ ID NO: 165804 - DNA, 19 bp, Homo sapiens
atgtatatatacgtgtatg

SEQ ID NO: 165805 - DNA, 20 bp, Homo sapiens
acacacgtatatatacgtgt

SEQ ID NO: 165806 - DNA, 23 bp, Homo sapiens
atatgtatatgtgtgtgtatatg

SEQ ID NO: 165807 - DNA, 23 bp, Homo sapiens
gcatctgtgtgtcctagtgcttc

SEQ ID NO: 165808 - DNA, 23 bp, Homo sapiens
tgcctctcccacagaaatgccaa

SEQ ID NO: 165809 - DNA, 23 bp, Homo sapiens
attataacctaccctgtgttcct

SEQ ID NO: 165810 - DNA, 23 bp, Homo sapiens
tgtacagaatcaatgcagtttca

SEQ ID NO: 165811 - DNA, 23 bp, Homo sapiens
aggagtctcactctgtcacccag

SEQ ID NO: 165812 - DNA, 22 bp, Homo sapiens
tgtcaagtatacttttcaaaag

SEQ ID NO: 165813 - DNA, 23 bp, Homo sapiens
ctgtctatcactctcttagatgt

SEQ ID NO: 165814 - DNA, 21 bp, Homo sapiens
tgtgtatatatgtatatatgt

SEQ ID NO: 165815 - DNA, 23 bp, Homo sapiens
tgagttcattgtagattctggat

SEQ ID NO: 165816 - DNA, 23 bp, Homo sapiens
tgagttcattgtagattctggat

SEQ ID NO: 165817 - DNA, 23 bp, Homo sapiens
actgagtctgtcattgagcatca

SEQ ID NO: 165818 - DNA, 23 bp, Homo sapiens
gactagagagagctctcaggctg

SEQ ID NO: 165819 - DNA, 23 bp, Homo sapiens
ctcttcctcactcacagtcagcc

SEQ ID NO: 165820 - DNA, 23 bp, Homo sapiens
tctgtcactgtctctcatcaccc

SEQ ID NO: 165821 - DNA, 23 bp, Homo sapiens
ctggtctagttgcaggaaaacca

SEQ ID NO: 165822 - DNA, 21 bp, Homo sapiens
atactgtgtatatatgaacag

SEQ ID NO: 165823 - DNA, 23 bp, Homo sapiens
tggagtctcactctgtcacccag

SEQ ID NO: 165824 - DNA, 23 bp, Homo sapiens
accgagtctcgctctgtcaccca

SEQ ID NO: 165825 - DNA, 21 bp, Homo sapiens
taaaggtatttgtgttaacgt

SEQ ID NO: 165826 - DNA, 23 bp, Homo sapiens
agttggctctggaaggacttagg

SEQ ID NO: 165827 - DNA, 23 bp, Homo sapiens
tatatgtatatatacatatgtgt

SEQ ID NO: 165828 - DNA, 22 bp, Homo sapiens
tccagctggtaagagtgagtga

SEQ ID NO: 165829 - DNA, 23 bp, Homo sapiens
acagtctctctctgtaatttacc

SEQ ID NO: 165830 - DNA, 23 bp, Homo sapiens
taacacaccgagttattcatagt

SEQ ID NO: 165831 - DNA, 23 bp, Homo sapiens
agttttcagtgcaagtcttgggt

SEQ ID NO: 165832 - DNA, 18 bp, Homo sapiens
aaggacctgctgctgctg

SEQ ID NO: 165833 - DNA, 23 bp, Homo sapiens
acagagtctcgctctgtcgctca

SEQ ID NO: 165834 - DNA, 22 bp, Homo sapiens
ttgtgtgagtgtcactgtcact

SEQ ID NO: 165835 - DNA, 23 bp, Homo sapiens
agtgtcacagactctttcttatt

SEQ ID NO: 165836 - DNA, 18 bp, Homo sapiens
gaggtcagtaactatctg

SEQ ID NO: 165837 - DNA, 18 bp, Homo sapiens
ttggcctgagtgaaatct

SEQ ID NO: 165838 - DNA, 23 bp, Homo sapiens
tactatgttgaataggagcagta

SEQ ID NO: 165839 - DNA, 22 bp, Homo sapiens
tcacctctctctgtctctatcc

SEQ ID NO: 165840 - DNA, 22 bp, Homo sapiens
agagcaaattggtttctgatca

SEQ ID NO: 165841 - DNA, 21 bp, Homo sapiens
ttaatggttaataactctggt

SEQ ID NO: 165842 - DNA, 23 bp, Homo sapiens
tgagacggtgtctcgctctgtca

SEQ ID NO: 165843 - DNA, 23 bp, Homo sapiens
tgagttcattgtagattctggat

SEQ ID NO: 165844 - DNA, 23 bp, Homo sapiens
tgagttcattgtagattctggat

SEQ ID NO: 165845 - DNA, 23 bp, Homo sapiens
attgggatgtcatagcaattaga

SEQ ID NO: 165846 - DNA, 23 bp, Homo sapiens
agtgcaagtagtggcttcagagt

SEQ ID NO: 165847 - DNA, 23 bp, Homo sapiens
ctcactctctgtctctgaatgct

SEQ ID NO: 165848 - DNA, 23 bp, Homo sapiens
cagctttctcactctgtggctca

SEQ ID NO: 165849 - DNA, 23 bp, Homo sapiens
tcagtaagcgtgacttgacagcc

SEQ ID NO: 165850 - DNA, 23 bp, Homo sapiens
atatgtgtatatgtatatgtata

SEQ ID NO: 165851 - DNA, 23 bp, Homo sapiens
gtaattgaggctggcaaacatct

SEQ ID NO: 165852 - DNA, 22 bp, Homo sapiens
tctcacactcacattaggtaca

SEQ ID NO: 165853 - DNA, 23 bp, Homo sapiens
tgagttcattgtagattctggat

SEQ ID NO: 165854 - DNA, 23 bp, Homo sapiens
tgagttcattgtagattctggat

SEQ ID NO: 165855 - DNA, 20 bp, Homo sapiens
gaagaaacttaagtcttgtc

SEQ ID NO: 165856 - DNA, 23 bp, Homo sapiens
taatttttagctggaggatgtga

SEQ ID NO: 165857 - DNA, 20 bp, Homo sapiens
atatacacacgtatacatat

SEQ ID NO: 165858 - DNA, 20 bp, Homo sapiens
atgtgcacaacgtgcaggtt

SEQ ID NO: 165859 - DNA, 23 bp, Homo sapiens
acatgtgcaatgttggtgtgctg

SEQ ID NO: 165860 - DNA, 22 bp, Homo sapiens
tcacaccctgtttctctgctcc

SEQ ID NO: 165861 - DNA, 20 bp, Homo sapiens
tagctccttctgctttcttt

SEQ ID NO: 165862 - DNA, 23 bp, Homo sapiens
agggggacacagtcttgctctgt

SEQ ID NO: 165863 - DNA, 23 bp, Homo sapiens
atgtgtgtatgtaatgtgatgtg

SEQ ID NO: 165864 - DNA, 23 bp, Homo sapiens
cctgtctgtctgacactaaggcc

SEQ ID NO: 165865 - DNA, 22 bp, Homo sapiens
tgtgtatatatgtgtgagtgta

SEQ ID NO: 165866 - DNA, 23 bp, Homo sapiens
acttgtgtgtgtatatatatgtg

SEQ ID NO: 165867 - DNA, 19 bp, Homo sapiens
tatgagtgtatatatagtg

SEQ ID NO: 165868 - DNA, 23 bp, Homo sapiens
tgtatagtgtgtgtatttgtgtg

SEQ ID NO: 165869 - DNA, 23 bp, Homo sapiens
gatggagtctcactctgtcaccc

SEQ ID NO: 165870 - DNA, 23 bp, Homo sapiens
tggagtctcactctgtcacccag

SEQ ID NO: 165871 - DNA, 21 bp, Homo sapiens
tgggcttttggtttcttgtca

SEQ ID NO: 165872 - DNA, 23 bp, Homo sapiens
agccacagtgaacacagaaagca

SEQ ID NO: 165873 - DNA, 23 bp, Homo sapiens
tcagtgcctgcctccctgtgagc

SEQ ID NO: 165874 - DNA, 19 bp, Homo sapiens
accctcattacacaggtga

SEQ ID NO: 165875 - DNA, 19 bp, Homo sapiens
aaagagacttgaggctttg

SEQ ID NO: 165876 - DNA, 23 bp, Homo sapiens
ggagtctcactctgtcacccagc

SEQ ID NO: 165877 - DNA, 21 bp, Homo sapiens
ttttgagacggagtctcacac

SEQ ID NO: 165878 - DNA, 23 bp, Homo sapiens
cagagtctcactctgtcacccac

SEQ ID NO: 165879 - DNA, 21 bp, Homo sapiens
agaaggagttgctcactctgt

SEQ ID NO: 165880 - DNA, 19 bp, Homo sapiens
agagacaacaggcacccct

SEQ ID NO: 165881 - DNA, 23 bp, Homo sapiens
aggtcagaagtgtgagaccagtg

SEQ ID NO: 165882 - DNA, 23 bp, Homo sapiens
agacagggtctcactgtgttgcc

SEQ ID NO: 165883 - DNA, 23 bp, Homo sapiens
tatacatatgtatacatgtgtat

SEQ ID NO: 165884 - DNA, 23 bp, Homo sapiens
tatatacacatgtatacatgtgt

SEQ ID NO: 165885 - DNA, 23 bp, Homo sapiens
cctcaccctctgtgtgtctccct

SEQ ID NO: 165886 - DNA, 22 bp, Homo sapiens
agtcttcatcttgtccatcaat

SEQ ID NO: 165887 - DNA, 21 bp, Homo sapiens
cagcctgggtgacagagcgag

SEQ ID NO: 165888 - DNA, 23 bp, Homo sapiens
tatatgtgtatatgtatgtgtat

SEQ ID NO: 165889 - DNA, 23 bp, Homo sapiens
gcctccctctgtgtctctattcc

SEQ ID NO: 165890 - DNA, 18 bp, Homo sapiens
tgcctagtcatgtaatct

SEQ ID NO: 165891 - DNA, 23 bp, Homo sapiens
actctgtctgtgtccctgacagg

SEQ ID NO: 165892 - DNA, 22 bp, Homo sapiens
atgtctgcagtcctagcatttt

SEQ ID NO: 165893 - DNA, 23 bp, Homo sapiens
atattgtctttgtgctgccagct

SEQ ID NO: 165894 - DNA, 23 bp, Homo sapiens
gtaagtgagaagatgctcaggag

SEQ ID NO: 165895 - DNA, 22 bp, Homo sapiens
tgaaatctggttctagttctgc

SEQ ID NO: 165896 - DNA, 23 bp, Homo sapiens
ccatccgtgcctgtgtgtgtctg

SEQ ID NO: 165897 - DNA, 19 bp, Homo sapiens
tgtgtgtgtgtgtgtgtat

SEQ ID NO: 165898 - DNA, 22 bp, Homo sapiens
tctcttttagggcattctatat

SEQ ID NO: 165899 - DNA, 23 bp, Homo sapiens
caggcacctatagtctcagctac

SEQ ID NO: 165900 - DNA, 22 bp, Homo sapiens
tgagagagagtctcactctgtc

SEQ ID NO: 165901 - DNA, 20 bp, Homo sapiens
tcactctgttactcacgcct

SEQ ID NO: 165902 - DNA, 22 bp, Homo sapiens
agcgaagtaaggttttttttgt

SEQ ID NO: 165903 - DNA, 23 bp, Homo sapiens
gtgtctctgtgtgtctctacgtg

SEQ ID NO: 165904 - DNA, 18 bp, Homo sapiens
agggatttgcacagatag

SEQ ID NO: 165905 - DNA, 23 bp, Homo sapiens
tctgtaatcccagctcttagaga

SEQ ID NO: 165906 - DNA, 22 bp, Homo sapiens
gtggaaggatcacttgaagcca

SEQ ID NO: 165907 - DNA, 19 bp, Homo sapiens
ttacaggcatgagccactg

SEQ ID NO: 165908 - DNA, 21 bp, Homo sapiens
tttcagtgtctggtaattctg

SEQ ID NO: 165909 - DNA, 22 bp, Homo sapiens
tgcagtctctgtctgtctgcct

SEQ ID NO: 165910 - DNA, 23 bp, Homo sapiens
acattctctctctggttttggtg

SEQ ID NO: 165911 - DNA, 23 bp, Homo sapiens
tctgagcatctctaagacaattg

SEQ ID NO: 165912 - DNA, 19 bp, Homo sapiens
tatatttgtctagtaggtc

SEQ ID NO: 165913 - DNA, 23 bp, Homo sapiens
gagtctctctctgtcacccaggc

SEQ ID NO: 165914 - DNA, 23 bp, Homo sapiens
agtcacactgtctctctcccaca

SEQ ID NO: 165915 - DNA, 23 bp, Homo sapiens
tctgtcactatggtatttctgtg

SEQ ID NO: 165916 - DNA, 19 bp, Homo sapiens
aaagggagcctagaagctc

SEQ ID NO: 165917 - DNA, 23 bp, Homo sapiens
gacagagtctcgctctgtcaccc

SEQ ID NO: 165918 - DNA, 18 bp, Homo sapiens
tcagcctcactctctatc

SEQ ID NO: 165919 - DNA, 21 bp, Homo sapiens
tgaggttggaggatcatttga

SEQ ID NO: 165920 - DNA, 22 bp, Homo sapiens
tgaggtaaaaggatcatttgag

SEQ ID NO: 165921 - DNA, 22 bp, Homo sapiens
tgtgtatatatgtatatatgtg

SEQ ID NO: 165922 - DNA, 20 bp, Homo sapiens
tatgtatatatgtatatgta

SEQ ID NO: 165923 - DNA, 23 bp, Homo sapiens
atatgtgtatatgtatatatgtt

SEQ ID NO: 165924 - DNA, 23 bp, Homo sapiens
gcacaggcagatttgactgtctt

SEQ ID NO: 165925 - DNA, 23 bp, Homo sapiens
tgcctcgcagcctgtttagcact

SEQ ID NO: 165926 - DNA, 23 bp, Homo sapiens
agtcagagactcgctctgtcacc

SEQ ID NO: 165927 - DNA, 21 bp, Homo sapiens
aggagctaggactacaggcac

SEQ ID NO: 165928 - DNA, 21 bp, Homo sapiens
aattttttactttttgtagag

SEQ ID NO: 165929 - DNA, 23 bp, Homo sapiens
cggagtctcactctgtcacccag

SEQ ID NO: 165930 - DNA, 23 bp, Homo sapiens
gagtctcactctgtcacccaggc

SEQ ID NO: 165931 - DNA, 20 bp, Homo sapiens
agtctctcactctgtcgcca

SEQ ID NO: 165932 - DNA, 23 bp, Homo sapiens
tagaattgtgtgtatatatgtat

SEQ ID NO: 165933 - DNA, 23 bp, Homo sapiens
ctcactgtctatagagtttttgt

SEQ ID NO: 165934 - DNA, 23 bp, Homo sapiens
tgagacggagtctcactctgtca

SEQ ID NO: 165935 - DNA, 19 bp, Homo sapiens
gggcgacacagtgagactc

SEQ ID NO: 165936 - DNA, 20 bp, Homo sapiens
tgtgtatatatgcatgtgtg

SEQ ID NO: 165937 - DNA, 23 bp, Homo sapiens
tgagctcactggcaggaaaggga

SEQ ID NO: 165938 - DNA, 23 bp, Homo sapiens
tgtgtctgtctgtctgtctatca

SEQ ID NO: 165939 - DNA, 21 bp, Homo sapiens
tcacaagtcactgaatgttgt

SEQ ID NO: 165940 - DNA, 23 bp, Homo sapiens
ggtttcagtctcatctttgctgc

SEQ ID NO: 165941 - DNA, 23 bp, Homo sapiens
tctgcctgtgtctgtcattgttg

SEQ ID NO: 165942 - DNA, 21 bp, Homo sapiens
tgcctgggtccctgtattggt

SEQ ID NO: 165943 - DNA, 23 bp, Homo sapiens
tcactctgtcactgaggctggag

SEQ ID NO: 165944 - DNA, 23 bp, Homo sapiens
gagtctctcactctgtcacccag

SEQ ID NO: 165945 - DNA, 23 bp, Homo sapiens
tggtctcactctgtcacccaggc

SEQ ID NO: 165946 - DNA, 18 bp, Homo sapiens
tgcagtagtgaaatcata

SEQ ID NO: 165947 - DNA, 23 bp, Homo sapiens
gacagagtctcgctctgtcaccc

SEQ ID NO: 165948 - DNA, 23 bp, Homo sapiens
tggagtctcactctgtcacccag

SEQ ID NO: 165949 - DNA, 23 bp, Homo sapiens
acagactctcactctgttgtcca

SEQ ID NO: 165950 - DNA, 23 bp, Homo sapiens
ctgtctgtgtgtctgtctcggtg

SEQ ID NO: 165951 - DNA, 20 bp, Homo sapiens
cactctctgtcactctcatg

SEQ ID NO: 165952 - DNA, 23 bp, Homo sapiens
gacctctgtttctgtgtctgtga

SEQ ID NO: 165953 - DNA, 22 bp, Homo sapiens
tattagagggttttaagcagga

SEQ ID NO: 165954 - DNA, 18 bp, Homo sapiens
ctggggctgtgttggaag

SEQ ID NO: 165955 - DNA, 22 bp, Homo sapiens
ctctccctctcactccctgtgc

SEQ ID NO: 165956 - DNA, 23 bp, Homo sapiens
tctgagtctcagtttcttcacct

SEQ ID NO: 165957 - DNA, 23 bp, Homo sapiens
gtcatcatgaccatgagatgaag

SEQ ID NO: 165958 - DNA, 22 bp, Homo sapiens
gccactgttttctctgtctgct

SEQ ID NO: 165959 - DNA, 19 bp, Homo sapiens
ctgcccctctgtcccctgc

SEQ ID NO: 165960 - DNA, 23 bp, Homo sapiens
ggagtctcactctgtcactcagg

SEQ ID NO: 165961 - DNA, 23 bp, Homo sapiens
gacagagtctcgctctgtcaccc

SEQ ID NO: 165962 - DNA, 21 bp, Homo sapiens
tgagtctcaatctgtcaccca

SEQ ID NO: 165963 - DNA, 23 bp, Homo sapiens
aagagtgagatcagacttggaaa

SEQ ID NO: 165964 - DNA, 23 bp, Homo sapiens
ctgtgtgtgtgtgtgtgttactt

SEQ ID NO: 165965 - DNA, 23 bp, Homo sapiens
gaggctcccactgtgtgttagtt

SEQ ID NO: 165966 - DNA, 23 bp, Homo sapiens
tgagttcattgtagattctggat

SEQ ID NO: 165967 - DNA, 23 bp, Homo sapiens
tgagttcattgtagattctggat

SEQ ID NO: 165968 - DNA, 22 bp, Homo sapiens
aagtgcaaaaagaagtcattga

SEQ ID NO: 165969 - DNA, 23 bp, Homo sapiens
agtctcaggtagttctttatagc

SEQ ID NO: 165970 - DNA, 20 bp, Homo sapiens
ctgactcaatctctcagtca

SEQ ID NO: 165971 - DNA, 23 bp, Homo sapiens
tgagttcattgtagattctggat

SEQ ID NO: 165972 - DNA, 23 bp, Homo sapiens
tgagttcattgtagattctggat

SEQ ID NO: 165973 - DNA, 21 bp, Homo sapiens
aactagttgatgccatcttta

SEQ ID NO: 165974 - DNA, 23 bp, Homo sapiens
tctgtccctgagtccctggctga

SEQ ID NO: 165975 - DNA, 23 bp, Homo sapiens
ttcactgtggtaatgatttacct

SEQ ID NO: 165976 - DNA, 23 bp, Homo sapiens
tctgactttcagaatcttctggt

SEQ ID NO: 165977 - DNA, 23 bp, Homo sapiens
tggagtctcactctgtcacccag

SEQ ID NO: 165978 - DNA, 23 bp, Homo sapiens
tctgtctgtctgtctgtctgtct

SEQ ID NO: 165979 - DNA, 21 bp, Homo sapiens
tctctatttttgtatatgttt

SEQ ID NO: 165980 - DNA, 23 bp, Homo sapiens
tctactctcttagttttagttac

SEQ ID NO: 165981 - DNA, 23 bp, Homo sapiens
agagcagacagaaatgggatctg

SEQ ID NO: 165982 - DNA, 21 bp, Homo sapiens
tctcagcctggaatgttctcc

SEQ ID NO: 165983 - DNA, 23 bp, Homo sapiens
agtgaccctgagaggcaggtatg

SEQ ID NO: 165984 - DNA, 23 bp, Homo sapiens
ctggcactgtgtctctctgtgtg

SEQ ID NO: 165985 - DNA, 18 bp, Homo sapiens
aaagcatgataaatccag

SEQ ID NO: 165986 - DNA, 23 bp, Homo sapiens
accctgtgaattgacaagaagtt

SEQ ID NO: 165987 - DNA, 21 bp, Homo sapiens
ttccctgccagacagaaggga

SEQ ID NO: 165988 - DNA, 23 bp, Homo sapiens
agagtgagacaagtgagagacgt

SEQ ID NO: 165989 - DNA, 22 bp, Homo sapiens
ttcatctcagcattgctctcga

SEQ ID NO: 165990 - DNA, 23 bp, Homo sapiens
agacagagtctcgctctgtcacc

SEQ ID NO: 165991 - DNA, 23 bp, Homo sapiens
gacagagtctcgctctgtcaccc

SEQ ID NO: 165992 - DNA, 23 bp, Homo sapiens
aatctcagatccaaatttcctca

SEQ ID NO: 165993 - DNA, 23 bp, Homo sapiens
gacagagtctcgctctgtcaccc

SEQ ID NO: 165994 - DNA, 23 bp, Homo sapiens
tgagttcattgtagattctggat

SEQ ID NO: 165995 - DNA, 23 bp, Homo sapiens
tgagttcattgtagattctggat

SEQ ID NO: 165996 - DNA, 19 bp, Homo sapiens
gaggttggaggatggtttg

SEQ ID NO: 165997 - DNA, 23 bp, Homo sapiens
atctttgtgcatttggaatgaaa

SEQ ID NO: 165998 - DNA, 23 bp, Homo sapiens
gggagtgcaaggaagttcctctg

SEQ ID NO: 165999 - DNA, 22 bp, Homo sapiens
ctctccctatctgtctgtctct

SEQ ID NO: 166000 - DNA, 23 bp, Homo sapiens
tactaacagccactgagaggctc

SEQ ID NO: 166001 - DNA, 23 bp, Homo sapiens
tgtgctcatgtgtgcgtgtgcat

SEQ ID NO: 166002 - DNA, 23 bp, Homo sapiens
tgagttcattgtagattctggat

SEQ ID NO: 166003 - DNA, 23 bp, Homo sapiens
agggactccctctgtcgcacaga

SEQ ID NO: 166004 - DNA, 19 bp, Homo sapiens
gtctcgctctgtcacccac

SEQ ID NO: 166005 - DNA, 23 bp, Homo sapiens
taaagacagggtctcactgtgtt

SEQ ID NO: 166006 - DNA, 23 bp, Homo sapiens
ggctgaggtaggaggatcacttg

SEQ ID NO: 166007 - DNA, 23 bp, Homo sapiens
tgacagagtgagactccatctca

SEQ ID NO: 166008 - DNA, 22 bp, Homo sapiens
agagtctcattctgtcactgag

SEQ ID NO: 166009 - DNA, 23 bp, Homo sapiens
acagagtctcactctgtcgccca

SEQ ID NO: 166010 - DNA, 23 bp, Homo sapiens
ctcttgactctctgacaggtgtt

SEQ ID NO: 166011 - DNA, 23 bp, Homo sapiens
tgtgtctctctgagttaatggtg

SEQ ID NO: 166012 - DNA, 18 bp, Homo sapiens
agccttgtttgtctcact

SEQ ID NO: 166013 - DNA, 23 bp, Homo sapiens
cagcctgtctccctcactgacac

SEQ ID NO: 166014 - DNA, 20 bp, Homo sapiens
ggctggctccctgtaagcct

SEQ ID NO: 166015 - DNA, 23 bp, Homo sapiens
acagagtctggctgtgtcactca

SEQ ID NO: 166016 - DNA, 23 bp, Homo sapiens
tttggttctcagtttggacattg

SEQ ID NO: 166017 - DNA, 23 bp, Homo sapiens
taacagtccctccaaaccaggtt

SEQ ID NO: 166018 - DNA, 23 bp, Homo sapiens
cactctgtcactccattgcctat

SEQ ID NO: 166019 - DNA, 20 bp, Homo sapiens
tgctacatggtagtgtagtt

SEQ ID NO: 166020 - DNA, 22 bp, Homo sapiens
tatatagcatatattatgtgta

SEQ ID NO: 166021 - DNA, 23 bp, Homo sapiens
tgccaggcactctctctgagcct

SEQ ID NO: 166022 - DNA, 23 bp, Homo sapiens
aaatttgtatatgtatatctgtg

SEQ ID NO: 166023 - DNA, 23 bp, Homo sapiens
atatatatggtttacaaaactat

SEQ ID NO: 166024 - DNA, 21 bp, Homo sapiens
tatgtgtatatacatacagat

SEQ ID NO: 166025 - DNA, 23 bp, Homo sapiens
gagtgtgtgtgtgtgtctgtctc

SEQ ID NO: 166026 - DNA, 19 bp, Homo sapiens
attgagacctgagttctca

SEQ ID NO: 166027 - DNA, 23 bp, Homo sapiens
tctgtcactgtgagactctgggc

SEQ ID NO: 166028 - DNA, 21 bp, Homo sapiens
tgagaaatgtggttcctcctc

SEQ ID NO: 166029 - DNA, 23 bp, Homo sapiens
caaggtctcactctgtcacccag

SEQ ID NO: 166030 - DNA, 23 bp, Homo sapiens
tctctctctccctggctgcatcc

SEQ ID NO: 166031 - DNA, 21 bp, Homo sapiens
tgagtcccagagggcctggct

SEQ ID NO: 166032 - DNA, 23 bp, Homo sapiens
aacccctctgagcttgcctctgg

SEQ ID NO: 166033 - DNA, 23 bp, Homo sapiens
tgagtgtgcatgacgatctgata

SEQ ID NO: 166034 - DNA, 21 bp, Homo sapiens
agtggttttcgaggtgcgaca

SEQ ID NO: 166035 - DNA, 19 bp, Homo sapiens
gcaggagggttgattgagc

SEQ ID NO: 166036 - DNA, 23 bp, Homo sapiens
gctgtagtgaactttgattgccc

SEQ ID NO: 166037 - DNA, 18 bp, Homo sapiens
ataaagacccaagtcatt

SEQ ID NO: 166038 - DNA, 23 bp, Homo sapiens
accatctgtcccagtttgctggg

SEQ ID NO: 166039 - DNA, 23 bp, Homo sapiens
ttggggaccatatgtatacattt

SEQ ID NO: 166040 - DNA, 23 bp, Homo sapiens
atgtaactatatatgtataggta

SEQ ID NO: 166041 - DNA, 19 bp, Homo sapiens
ctgtcagggaaaattctgt

SEQ ID NO: 166042 - DNA, 21 bp, Homo sapiens
tgcagcttctcactcacactc

SEQ ID NO: 166043 - DNA, 23 bp, Homo sapiens
tgagacagagtctcgctctgtca

SEQ ID NO: 166044 - DNA, 23 bp, Homo sapiens
acagagtctcgctctgtcaccca

SEQ ID NO: 166045 - DNA, 20 bp, Homo sapiens
aaagtgctgaggttacaggt

SEQ ID NO: 166046 - DNA, 23 bp, Homo sapiens
gtctcgctctgtcgctctgtcgc

SEQ ID NO: 166047 - DNA, 23 bp, Homo sapiens
tgagagagtctcgctgtgttgct

SEQ ID NO: 166048 - DNA, 23 bp, Homo sapiens
tgagttcattgtagattctggat

SEQ ID NO: 166049 - DNA, 23 bp, Homo sapiens
tgagttcattgtagattctggat

SEQ ID NO: 166050 - DNA, 23 bp, Homo sapiens
tgggtctgtcactcactccgtga

SEQ ID NO: 166051 - DNA, 23 bp, Homo sapiens
ctgcttttcacagtgggtgttct

SEQ ID NO: 166052 - DNA, 20 bp, Homo sapiens
aagaggaggaaaaacaagcc

SEQ ID NO: 166053 - DNA, 21 bp, Homo sapiens
cctctctgtctgtgtgtccag

SEQ ID NO: 166054 - DNA, 19 bp, Homo sapiens
ctcagcctctgcctctctc

SEQ ID NO: 166055 - DNA, 23 bp, Homo sapiens
atgagtgtgtctgtgtgagtgtg

SEQ ID NO: 166056 - DNA, 22 bp, Homo sapiens
ctctgcctctctgcctgactgc

SEQ ID NO: 166057 - DNA, 23 bp, Homo sapiens
tgcgtgtgtcagtgtgtgtgcaa

SEQ ID NO: 166058 - DNA, 23 bp, Homo sapiens
tctgtgtgtgtgtgcctccctcc

SEQ ID NO: 166059 - DNA, 23 bp, Homo sapiens
tgtatttgtatttcttccacttg

SEQ ID NO: 166060 - DNA, 21 bp, Homo sapiens
tgattctacattatggtgagt

SEQ ID NO: 166061 - DNA, 23 bp, Homo sapiens
atacaacaaatgtaatgtgtttg

SEQ ID NO: 166062 - DNA, 23 bp, Homo sapiens
gacaccttcactgtctgtcttca

SEQ ID NO: 166063 - DNA, 23 bp, Homo sapiens
tgagggagagagcttttgtctgt

SEQ ID NO: 166064 - DNA, 21 bp, Homo sapiens
tgttatttaagaatgctgttt

SEQ ID NO: 166065 - DNA, 21 bp, Homo sapiens
cttaaaattgaatgcatttgt

SEQ ID NO: 166066 - DNA, 23 bp, Homo sapiens
tgctctctgtgaaagatggaagc

SEQ ID NO: 166067 - DNA, 20 bp, Homo sapiens
agcctggttttgaactcttg

SEQ ID NO: 166068 - DNA, 23 bp, Homo sapiens
ctcagagctagagcatgagcatg

SEQ ID NO: 166069 - DNA, 23 bp, Homo sapiens
ttgccagtgtggctcagatgcag

SEQ ID NO: 166070 - DNA, 22 bp, Homo sapiens
ccactgactgtgtgactctggc

SEQ ID NO: 166071 - DNA, 23 bp, Homo sapiens
tcactctgtcacccaaactggag

SEQ ID NO: 166072 - DNA, 23 bp, Homo sapiens
cggagtctcgctctgtctcccag

SEQ ID NO: 166073 - DNA, 23 bp, Homo sapiens
acagagtctcgctctgtcaccca

SEQ ID NO: 166074 - DNA, 20 bp, Homo sapiens
atacacacagtatatgtata

SEQ ID NO: 166075 - DNA, 18 bp, Homo sapiens
atatgtttcatatatatg

SEQ ID NO: 166076 - DNA, 23 bp, Homo sapiens
agatggagtctcactctgtcacc

SEQ ID NO: 166077 - DNA, 23 bp, Homo sapiens
tgagactgagtctcgctcagtca

SEQ ID NO: 166078 - DNA, 23 bp, Homo sapiens
gggtctcactctgtcacccaggc

SEQ ID NO: 166079 - DNA, 23 bp, Homo sapiens
gctctgtcagtctgtccatgggt

SEQ ID NO: 166080 - DNA, 20 bp, Homo sapiens
caaacaggtttttatgtgaa

SEQ ID NO: 166081 - DNA, 23 bp, Homo sapiens
ttccttactctcaagagagagct

SEQ ID NO: 166082 - DNA, 23 bp, Homo sapiens
tgtgtgtgtgtgtgcgcgtgcag

SEQ ID NO: 166083 - DNA, 23 bp, Homo sapiens
ttcactgtatgtatttgtatgca

SEQ ID NO: 166084 - DNA, 22 bp, Homo sapiens
ggctgaggtaggaggatcactt

SEQ ID NO: 166085 - DNA, 23 bp, Homo sapiens
cgctgagcctcagtttccccttt

SEQ ID NO: 166086 - DNA, 18 bp, Homo sapiens
aagtgctgggattacagg

SEQ ID NO: 166087 - DNA, 21 bp, Homo sapiens
tctctctggcttttctgctgt

SEQ ID NO: 166088 - DNA, 23 bp, Homo sapiens
catggagtctcactctgtccctc

SEQ ID NO: 166089 - DNA, 20 bp, Homo sapiens
tcattcaacagagagaggtg

SEQ ID NO: 166090 - DNA, 22 bp, Homo sapiens
aaagagagagaagtcactgtga

SEQ ID NO: 166091 - DNA, 23 bp, Homo sapiens
tctgagtcactgtgtggctagag

SEQ ID NO: 166092 - DNA, 23 bp, Homo sapiens
cggagtctcactctgtcacccag

SEQ ID NO: 166093 - DNA, 18 bp, Homo sapiens
atgagagtctatttattg

SEQ ID NO: 166094 - DNA, 23 bp, Homo sapiens
acagagtctcgctctgtcaccca

SEQ ID NO: 166095 - DNA, 19 bp, Homo sapiens
aggagcctcatgaggactt

SEQ ID NO: 166096 - DNA, 19 bp, Homo sapiens
cacacctctctgtgtctca

SEQ ID NO: 166097 - DNA, 21 bp, Homo sapiens
aatcaaaccatggtagtggct

SEQ ID NO: 166098 - DNA, 19 bp, Homo sapiens
tatgcacctgtagtccaag

SEQ ID NO: 166099 - DNA, 21 bp, Homo sapiens
tgtggccctataagtactgtt

SEQ ID NO: 166100 - DNA, 21 bp, Homo sapiens
agaattttgctcttgttgccc

SEQ ID NO: 166101 - DNA, 18 bp, Homo sapiens
tcatttcagcatgttcta

SEQ ID NO: 166102 - DNA, 22 bp, Homo sapiens
acacccgcacacatatatctgt

SEQ ID NO: 166103 - DNA, 22 bp, Homo sapiens
atatatgtgtgcaggtgtatgt

SEQ ID NO: 166104 - DNA, 19 bp, Homo sapiens
gtgtgtgcgtgcatgcgtg

SEQ ID NO: 166105 - DNA, 23 bp, Homo sapiens
tgtctctcttccagtctgtctgt

SEQ ID NO: 166106 - DNA, 18 bp, Homo sapiens
tcacagtcaccaagctgt

SEQ ID NO: 166107 - DNA, 23 bp, Homo sapiens
tgtgtatatatgtatatatgtat

SEQ ID NO: 166108 - DNA, 23 bp, Homo sapiens
actgagtctcgctctgtcgctca

SEQ ID NO: 166109 - DNA, 23 bp, Homo sapiens
ctgagactgagtctcactctctt

SEQ ID NO: 166110 - DNA, 23 bp, Homo sapiens
caatgtgagtctctgactctcag

SEQ ID NO: 166111 - DNA, 23 bp, Homo sapiens
tgactctgtgaatttgtagttgt

SEQ ID NO: 166112 - DNA, 22 bp, Homo sapiens
tggcacagtggcttatacctgt

SEQ ID NO: 166113 - DNA, 21 bp, Homo sapiens
tccattgttggacacttagat

SEQ ID NO: 166114 - DNA, 23 bp, Homo sapiens
tgaatagtgctgcaataaacatg

SEQ ID NO: 166115 - DNA, 23 bp, Homo sapiens
tgagttcattgtagattctggat

SEQ ID NO: 166116 - DNA, 23 bp, Homo sapiens
tgagttcattgtagattctggat

SEQ ID NO: 166117 - DNA, 21 bp, Homo sapiens
tatgtgcctctcatcctggct

SEQ ID NO: 166118 - DNA, 19 bp, Homo sapiens
cttttcaatactaatgaat

SEQ ID NO: 166119 - DNA, 20 bp, Homo sapiens
tgagacagagtctcgctctg

SEQ ID NO: 166120 - DNA, 23 bp, Homo sapiens
gacagagtctcgctctgtcaccc

SEQ ID NO: 166121 - DNA, 23 bp, Homo sapiens
acagagtctcgctctgtcaccca

SEQ ID NO: 166122 - DNA, 23 bp, Homo sapiens
tctctcactctcttttatatatg

SEQ ID NO: 166123 - DNA, 23 bp, Homo sapiens
tgagttcattgtagattctggat

SEQ ID NO: 166124 - DNA, 23 bp, Homo sapiens
tgagttcattgtagattctggat

SEQ ID NO: 166125 - DNA, 18 bp, Homo sapiens
atatctctcctatatatg

SEQ ID NO: 166126 - DNA, 21 bp, Homo sapiens
atatgggagatatacatatgt

SEQ ID NO: 166127 - DNA, 23 bp, Homo sapiens
atgcctgtacatgtttaagtgtg

SEQ ID NO: 166128 - DNA, 23 bp, Homo sapiens
tgagttcattgtagattctggat

SEQ ID NO: 166129 - DNA, 23 bp, Homo sapiens
tgagttcattgtagattctggat

SEQ ID NO: 166130 - DNA, 23 bp, Homo sapiens
acagagtctcactctgtcgccca

SEQ ID NO: 166131 - DNA, 23 bp, Homo sapiens
tatatgcatgtatatatatgtat

SEQ ID NO: 166132 - DNA, 22 bp, Homo sapiens
tatatgtacatatgtgtatgta

SEQ ID NO: 166133 - DNA, 23 bp, Homo sapiens
tgtaggctgaattttgctgtttg

SEQ ID NO: 166134 - DNA, 22 bp, Homo sapiens
tatgtatatatgtatgtataca

SEQ ID NO: 166135 - DNA, 23 bp, Homo sapiens
ggagtctcactctgtcacccagg

SEQ ID NO: 166136 - DNA, 23 bp, Homo sapiens
ctgtttctctcagctcttgagtc

SEQ ID NO: 166137 - DNA, 18 bp, Homo sapiens
gtggcgcagtctcagctc

SEQ ID NO: 166138 - DNA, 21 bp, Homo sapiens
tctccgagatggagtcttgct

SEQ ID NO: 166139 - DNA, 23 bp, Homo sapiens
actgtgactctgactgttttgcc

SEQ ID NO: 166140 - DNA, 23 bp, Homo sapiens
cacctcaccaagtctcagtctga

SEQ ID NO: 166141 - DNA, 20 bp, Homo sapiens
gagaggaggcctgttccacc

SEQ ID NO: 166142 - DNA, 22 bp, Homo sapiens
acacagtgcagaggagtctgaa

SEQ ID NO: 166143 - DNA, 21 bp, Homo sapiens
tgtctctgtgtgtgtttttcc

SEQ ID NO: 166144 - DNA, 18 bp, Homo sapiens
tatggctcgatccaggtg

SEQ ID NO: 166145 - DNA, 23 bp, Homo sapiens
agtcagtctctgtctctgcctct

SEQ ID NO: 166146 - DNA, 23 bp, Homo sapiens
tgacagatgacagagtggagacg

SEQ ID NO: 166147 - DNA, 23 bp, Homo sapiens
cgtcactcactgccacacttcag

SEQ ID NO: 166148 - DNA, 23 bp, Homo sapiens
agtctcactctgtcacccagact

SEQ ID NO: 166149 - DNA, 20 bp, Homo sapiens
tcacagagatcggcaggcag

SEQ ID NO: 166150 - DNA, 23 bp, Homo sapiens
tctctgcctctgtctgtgcatgg

SEQ ID NO: 166151 - DNA, 23 bp, Homo sapiens
tcactctcactgtcttttctgag

SEQ ID NO: 166152 - DNA, 22 bp, Homo sapiens
aagagagtgaagtgggtttgca

SEQ ID NO: 166153 - DNA, 21 bp, Homo sapiens
tatatatatactatgtgtgtg

SEQ ID NO: 166154 - DNA, 23 bp, Homo sapiens
ctgactctgtctcagaatggtgt

SEQ ID NO: 166155 - DNA, 23 bp, Homo sapiens
gctcattttcatcttctgggtga

SEQ ID NO: 166156 - DNA, 23 bp, Homo sapiens
aaagggactggatgaatactgag

SEQ ID NO: 166157 - DNA, 18 bp, Homo sapiens
gagtctcactctgtcacc

SEQ ID NO: 166158 - DNA, 19 bp, Homo sapiens
tggcacagtctcagctcac

SEQ ID NO: 166159 - DNA, 22 bp, Homo sapiens
cagtcagtgactgactggtgag

SEQ ID NO: 166160 - DNA, 21 bp, Homo sapiens
ctaaacaggcagttgatttca

SEQ ID NO: 166161 - DNA, 23 bp, Homo sapiens
atgtgtatatatatatctgtata

SEQ ID NO: 166162 - DNA, 23 bp, Homo sapiens
tatataactgtatatatataact

SEQ ID NO: 166163 - DNA, 23 bp, Homo sapiens
tatgaggtactacatgtaatgtt

SEQ ID NO: 166164 - DNA, 22 bp, Homo sapiens
acccagaacacagtgtggactc

SEQ ID NO: 166165 - DNA, 21 bp, Homo sapiens
ctggttaaatatattgtgtag

SEQ ID NO: 166166 - DNA, 23 bp, Homo sapiens
tgtctgtccctctgtccctcatt

SEQ ID NO: 166167 - DNA, 22 bp, Homo sapiens
ctctccctctctctgggcctct

SEQ ID NO: 166168 - DNA, 22 bp, Homo sapiens
actgtctgaccctctgtcttct

SEQ ID NO: 166169 - DNA, 23 bp, Homo sapiens
atgtgacattgtttttgtgtgcg

SEQ ID NO: 166170 - DNA, 23 bp, Homo sapiens
tgtcagagtcactctgtccttcc

SEQ ID NO: 166171 - DNA, 23 bp, Homo sapiens
cactctcacacactttcctgcat

SEQ ID NO: 166172 - DNA, 23 bp, Homo sapiens
tgagtgaactgagtgtgctgaga

SEQ ID NO: 166173 - DNA, 23 bp, Homo sapiens
cctgactcagtgcctcagtgcct

SEQ ID NO: 166174 - DNA, 23 bp, Homo sapiens
caggacagtgtctcactctgtcg

SEQ ID NO: 166175 - DNA, 23 bp, Homo sapiens
tttgtgcatatatatatgtgtgt

SEQ ID NO: 166176 - DNA, 22 bp, Homo sapiens
ttacaggtttcttttactgtgt

SEQ ID NO: 166177 - DNA, 23 bp, Homo sapiens
aagatatagatagagataatgta

SEQ ID NO: 166178 - DNA, 22 bp, Homo sapiens
ctctgcctctctgagccttggt

SEQ ID NO: 166179 - DNA, 23 bp, Homo sapiens
gagctcagtgaggacagacacca

SEQ ID NO: 166180 - DNA, 18 bp, Homo sapiens
caaattgtggcagtaatg

SEQ ID NO: 166181 - DNA, 23 bp, Homo sapiens
agtttttggatatgttttgaaaa

SEQ ID NO: 166182 - DNA, 23 bp, Homo sapiens
atgtgtatatatatgtgtatgta

SEQ ID NO: 166183 - DNA, 23 bp, Homo sapiens
atgtgtgtatatatgtgtatgta

SEQ ID NO: 166184 - DNA, 23 bp, Homo sapiens
tcactctccgtctcattaccctg

SEQ ID NO: 166185 - DNA, 23 bp, Homo sapiens
tatatgtctatatgtatatgtat

SEQ ID NO: 166186 - DNA, 18 bp, Homo sapiens
cctggcttgtctgcccct

SEQ ID NO: 166187 - DNA, 23 bp, Homo sapiens
atatgtgtatatatgtatgtgtg

SEQ ID NO: 166188 - DNA, 18 bp, Homo sapiens
agacatagaaataatatg

SEQ ID NO: 166189 - DNA, 19 bp, Homo sapiens
tgacaggagtgacagagga

SEQ ID NO: 166190 - DNA, 23 bp, Homo sapiens
tgtgttttgaaaagattcattat

SEQ ID NO: 166191 - DNA, 23 bp, Homo sapiens
accagactgaagggtctcaggac

SEQ ID NO: 166192 - DNA, 22 bp, Homo sapiens
ggcttcttctatgctgtcgcag

SEQ ID NO: 166193 - DNA, 22 bp, Homo sapiens
aagatgtaaattctggaacctg

SEQ ID NO: 166194 - DNA, 23 bp, Homo sapiens
tgagttcattgtagattctggat

SEQ ID NO: 166195 - DNA, 23 bp, Homo sapiens
acacacgccacacactgagtctg

SEQ ID NO: 166196 - DNA, 21 bp, Homo sapiens
cttcagtgggtccctctgggg

SEQ ID NO: 166197 - DNA, 23 bp, Homo sapiens
gtttgcagagagaacccagtgag

SEQ ID NO: 166198 - DNA, 20 bp, Homo sapiens
acaaggtgcactgtgtctca

SEQ ID NO: 166199 - DNA, 18 bp, Homo sapiens
aggacatcagtcccacta

SEQ ID NO: 166200 - DNA, 23 bp, Homo sapiens
tctaactcactctggatgggaac

SEQ ID NO: 166201 - DNA, 23 bp, Homo sapiens
ggcagtcacagtgtctgagagag

SEQ ID NO: 166202 - DNA, 22 bp, Homo sapiens
actgtctctgagttagttgtaa

SEQ ID NO: 166203 - DNA, 21 bp, Homo sapiens
tttctctgcagagcatcgctt

SEQ ID NO: 166204 - DNA, 23 bp, Homo sapiens
gtgtctgtgacagagttccttgt

SEQ ID NO: 166205 - DNA, 21 bp, Homo sapiens
tgtgcctctgtgaaaatgcag

SEQ ID NO: 166206 - DNA, 20 bp, Homo sapiens
cacacgcacactcacaccgt

SEQ ID NO: 166207 - DNA, 23 bp, Homo sapiens
ccagtgtgcgtgtgtgtgtgcca

SEQ ID NO: 166208 - DNA, 23 bp, Homo sapiens
tggaatgtaaagaagtatgtatc

SEQ ID NO: 166209 - DNA, 23 bp, Homo sapiens
gacagagtctcgctctgtcaccc

SEQ ID NO: 166210 - DNA, 23 bp, Homo sapiens
gtgtcctctgtctgtctctgcgg

SEQ ID NO: 166211 - DNA, 23 bp, Homo sapiens
cttttgtctcactgtctgtccgt

SEQ ID NO: 166212 - DNA, 20 bp, Homo sapiens
aatgtcttccagctgctggt

SEQ ID NO: 166213 - DNA, 23 bp, Homo sapiens
tctgcatctgtgcctctctctcg

SEQ ID NO: 166214 - DNA, 23 bp, Homo sapiens
taaggcacgcggtgaatgccaag

SEQ ID NO: 166215 - DNA, 23 bp, Homo sapiens
gacagagtctcgctctgtcaccc

SEQ ID NO: 166216 - DNA, 18 bp, Homo sapiens
caggctccctgactgcca

SEQ ID NO: 166217 - DNA, 23 bp, Homo sapiens
atatatgtacgtgtgtgtgtgtg

SEQ ID NO: 166218 - DNA, 23 bp, Homo sapiens
tgtgtgtgcgtgtctgcatgcat

SEQ ID NO: 166219 - DNA, 23 bp, Homo sapiens
gtgtgcgtgtctgagtgggtcag

SEQ ID NO: 166220 - DNA, 23 bp, Homo sapiens
gactgagtctcgctctgtcaccc

SEQ ID NO: 166221 - DNA, 20 bp, Homo sapiens
tgtttttttgtttttgagac

SEQ ID NO: 166222 - DNA, 23 bp, Homo sapiens
tgtgagtgcatgtttatacgcgt

SEQ ID NO: 166223 - DNA, 20 bp, Homo sapiens
tctctgtgtatgtgtatgac

SEQ ID NO: 166224 - DNA, 23 bp, Homo sapiens
ctgagtctgactctgtcacccag

SEQ ID NO: 166225 - DNA, 23 bp, Homo sapiens
gacagggtctcactctgtcaccc

SEQ ID NO: 166226 - DNA, 22 bp, Homo sapiens
tctcaccgtctctgcctccctg

SEQ ID NO: 166227 - DNA, 23 bp, Homo sapiens
aggctctgtgagactctgtgaga

SEQ ID NO: 166228 - DNA, 22 bp, Homo sapiens
atcatggtcattctctgtctca

SEQ ID NO: 166229 - DNA, 21 bp, Homo sapiens
tctcactctgtgacccaggct

SEQ ID NO: 166230 - DNA, 23 bp, Homo sapiens
caatctactctctgactgtggct

SEQ ID NO: 166231 - DNA, 23 bp, Homo sapiens
agcctctgtggctctgtcacagc

SEQ ID NO: 166232 - DNA, 23 bp, Homo sapiens
tgaagtcagacaggacaagttga

SEQ ID NO: 166233 - DNA, 18 bp, Homo sapiens
tggtgtgatcttggctca

SEQ ID NO: 166234 - DNA, 22 bp, Homo sapiens
tgtgtgcgtgagtcacaggctg

SEQ ID NO: 166235 - DNA, 23 bp, Homo sapiens
gtgattcaacctggacggtgtgt

SEQ ID NO: 166236 - DNA, 22 bp, Homo sapiens
gtttgtacatgtgcgtgcatgt

SEQ ID NO: 166237 - DNA, 21 bp, Homo sapiens
ttctgtggcttattgatggca

SEQ ID NO: 166238 - DNA, 18 bp, Homo sapiens
tgtgtgtgtgtatatata

SEQ ID NO: 166239 - DNA, 23 bp, Homo sapiens
agagtctcactctgtcacccagg

SEQ ID NO: 166240 - DNA, 23 bp, Homo sapiens
gtccgtctgtctctctggccctg

SEQ ID NO: 166241 - DNA, 23 bp, Homo sapiens
tgtgtctgtgtgtatatgcatgt

SEQ ID NO: 166242 - DNA, 23 bp, Homo sapiens
agagagagcagagggtccacaga

SEQ ID NO: 166243 - DNA, 22 bp, Homo sapiens
tggctgggtccctgcatgtcct

SEQ ID NO: 166244 - DNA, 23 bp, Homo sapiens
tgtctgagtctgtctatgttggg

SEQ ID NO: 166245 - DNA, 22 bp, Homo sapiens
taagaacattcactgtttggat

SEQ ID NO: 166246 - DNA, 23 bp, Homo sapiens
tcacatgcactggatgacttcac

SEQ ID NO: 166247 - DNA, 22 bp, Homo sapiens
caccgtgtgtgtcactgtctct

SEQ ID NO: 166248 - DNA, 23 bp, Homo sapiens
tcagaggtctgagtggacagtgc

SEQ ID NO: 166249 - DNA, 23 bp, Homo sapiens
gggcctcactctgtcactcaggc

SEQ ID NO: 166250 - DNA, 23 bp, Homo sapiens
ttgctctctatttcttatcatag

SEQ ID NO: 166251 - DNA, 19 bp, Homo sapiens
tgcatgtgtgtatagtgtg

SEQ ID NO: 166252 - DNA, 21 bp, Homo sapiens
tttgctgcctctccttgtctt

SEQ ID NO: 166253 - DNA, 18 bp, Homo sapiens
ctgtctgtctgtctctct

SEQ ID NO: 166254 - DNA, 22 bp, Homo sapiens
aagtctgagatcaaggtgtgtg

SEQ ID NO: 166255 - DNA, 23 bp, Homo sapiens
atatgtgtgtgctgtgtgtggac

SEQ ID NO: 166256 - DNA, 18 bp, Homo sapiens
atatgcatatatacatgt

SEQ ID NO: 166257 - DNA, 22 bp, Homo sapiens
ggacagtgacacacacagaggc

SEQ ID NO: 166258 - DNA, 23 bp, Homo sapiens
tttttagaggagcaggtggtgtt

SEQ ID NO: 166259 - DNA, 22 bp, Homo sapiens
ctgtctctctggctggctcagt

SEQ ID NO: 166260 - DNA, 21 bp, Homo sapiens
aggagcagctcaaagagaagt

SEQ ID NO: 166261 - DNA, 23 bp, Homo sapiens
gatatgagatcatcctgtatcct

SEQ ID NO: 166262 - DNA, 23 bp, Homo sapiens
cctctcacagtgtctccctctgg

SEQ ID NO: 166263 - DNA, 22 bp, Homo sapiens
gcatgtgtgcatgtgtgtgcat

SEQ ID NO: 166264 - DNA, 23 bp, Homo sapiens
tatgtatgcatgtgtgtgcatgt

SEQ ID NO: 166265 - DNA, 23 bp, Homo sapiens
actgtctgagtctgtgttttcta

SEQ ID NO: 166266 - DNA, 21 bp, Homo sapiens
aatgcatagttctgtggcatt

SEQ ID NO: 166267 - DNA, 23 bp, Homo sapiens
gacagagtctcgctctgtcaccc

SEQ ID NO: 166268 - DNA, 23 bp, Homo sapiens
ctgcttttcatttggatttcagg

SEQ ID NO: 166269 - DNA, 23 bp, Homo sapiens
ccttgagagaagattgagtgcag

SEQ ID NO: 166270 - DNA, 23 bp, Homo sapiens
gccatcactcactcgctctgtga

SEQ ID NO: 166271 - DNA, 21 bp, Homo sapiens
atacacacacctatatatggt

SEQ ID NO: 166272 - DNA, 22 bp, Homo sapiens
gtatgtatgtatgtatgtatgt

SEQ ID NO: 166273 - DNA, 23 bp, Homo sapiens
atgaattctcactctgtcaccca

SEQ ID NO: 166274 - DNA, 23 bp, Homo sapiens
tatgtgtgtaacatacataatag

SEQ ID NO: 166275 - DNA, 22 bp, Homo sapiens
attacatattatttctatgtct

SEQ ID NO: 166276 - DNA, 19 bp, Homo sapiens
ggattgcattgatgtttgg

SEQ ID NO: 166277 - DNA, 22 bp, Homo sapiens
agtcagtgagttctttagtcct

SEQ ID NO: 166278 - DNA, 23 bp, Homo sapiens
tctgaagaaacagttcagggtat

SEQ ID NO: 166279 - DNA, 23 bp, Homo sapiens
gtgtgtgtatacatagttgtatg

SEQ ID NO: 166280 - DNA, 22 bp, Homo sapiens
tgtgtatacatagaattgtgta

SEQ ID NO: 166281 - DNA, 22 bp, Homo sapiens
tatatgcatatatatagtgtat

SEQ ID NO: 166282 - DNA, 22 bp, Homo sapiens
tttaggatgctgctgaattgat

SEQ ID NO: 166283 - DNA, 21 bp, Homo sapiens
tatgtgtatattatatgtgta

SEQ ID NO: 166284 - DNA, 23 bp, Homo sapiens
ggtctctcagtgactcaatggcc

SEQ ID NO: 166285 - DNA, 22 bp, Homo sapiens
ttccctggctccctgtcaggca

SEQ ID NO: 166286 - DNA, 18 bp, Homo sapiens
tgagacaggattgccatc

SEQ ID NO: 166287 - DNA, 23 bp, Homo sapiens
atatgtatatatctatatgtgta

SEQ ID NO: 166288 - DNA, 23 bp, Homo sapiens
tacatatatgtagatgtgggcat

SEQ ID NO: 166289 - DNA, 23 bp, Homo sapiens
agaagagagtgttgacagtggat

SEQ ID NO: 166290 - DNA, 23 bp, Homo sapiens
ttagtctctctttctgtcaccaa

SEQ ID NO: 166291 - DNA, 23 bp, Homo sapiens
gctttagtgtctcataaataggg

SEQ ID NO: 166292 - DNA, 23 bp, Homo sapiens
gggtcagtctgtctgtctttgtc

SEQ ID NO: 166293 - DNA, 23 bp, Homo sapiens
atagcctcctgaagaaaacacat

SEQ ID NO: 166294 - DNA, 21 bp, Homo sapiens
gtttgtgagactttttcattt

SEQ ID NO: 166295 - DNA, 23 bp, Homo sapiens
tgcacagctgcatgattatggcc

SEQ ID NO: 166296 - DNA, 23 bp, Homo sapiens
agatgaggtctcgctctgttgtc

SEQ ID NO: 166297 - DNA, 23 bp, Homo sapiens
atatgtggtatatatagagagag

SEQ ID NO: 166298 - DNA, 21 bp, Homo sapiens
agggccccccctcaatcctgt

SEQ ID NO: 166299 - DNA, 18 bp, Homo sapiens
tcagagggttgggtggag

SEQ ID NO: 166300 - DNA, 21 bp, Homo sapiens
acactgcgtgagtcagcggct

SEQ ID NO: 166301 - DNA, 23 bp, Homo sapiens
aactcttggtccacagaaactgt

SEQ ID NO: 166302 - DNA, 19 bp, Homo sapiens
cagcatttgatttcccaca

SEQ ID NO: 166303 - DNA, 23 bp, Homo sapiens
tgcttaatgtggtttcagttggg

SEQ ID NO: 166304 - DNA, 23 bp, Homo sapiens
tcagtctgtgtttgctgaagagt

SEQ ID NO: 166305 - DNA, 23 bp, Homo sapiens
actgagtctcactctgtcgccca

SEQ ID NO: 166306 - DNA, 23 bp, Homo sapiens
cccttcactccgtctctcagccc

SEQ ID NO: 166307 - DNA, 23 bp, Homo sapiens
ctggttcttggctatggctcagg

SEQ ID NO: 166308 - DNA, 23 bp, Homo sapiens
cacactgagttcagagtctgcag

SEQ ID NO: 166309 - DNA, 23 bp, Homo sapiens
gtatatctctatgtatatgatat

SEQ ID NO: 166310 - DNA, 23 bp, Homo sapiens
tatatgcatatatattgataatg

SEQ ID NO: 166311 - DNA, 23 bp, Homo sapiens
tgtgtgtgcataggcattgtggg

SEQ ID NO: 166312 - DNA, 23 bp, Homo sapiens
gcaagtgtgtggatatgcatgtg

SEQ ID NO: 166313 - DNA, 22 bp, Homo sapiens
cagagtctcgcactgtctccca

SEQ ID NO: 166314 - DNA, 21 bp, Homo sapiens
tctcagaagctgtgtgccttc

SEQ ID NO: 166315 - DNA, 23 bp, Homo sapiens
tcacagagtgcaggagagtttct

SEQ ID NO: 166316 - DNA, 23 bp, Homo sapiens
cgtgtcaccgagtcttcctgcct

SEQ ID NO: 166317 - DNA, 23 bp, Homo sapiens
ccagttctactgagtatagctga

SEQ ID NO: 166318 - DNA, 23 bp, Homo sapiens
accctctctgagcctcagtttcc

SEQ ID NO: 166319 - DNA, 22 bp, Homo sapiens
tggatatgtgtatctatgcaca

SEQ ID NO: 166320 - DNA, 22 bp, Homo sapiens
tatcagtgtgtgtgtgtgtgtc

SEQ ID NO: 166321 - DNA, 23 bp, Homo sapiens
acagggtctcgctctgtcactca

SEQ ID NO: 166322 - DNA, 20 bp, Homo sapiens
aacactatatatatatatga

SEQ ID NO: 166323 - DNA, 23 bp, Homo sapiens
cgctgtctctgtctctctgccgg

SEQ ID NO: 166324 - DNA, 23 bp, Homo sapiens
tccgtttctgcatctgcaagtgg

SEQ ID NO: 166325 - DNA, 22 bp, Homo sapiens
gtgacagtttctcacactttcc

SEQ ID NO: 166326 - DNA, 23 bp, Homo sapiens
tgagatggattctcactctgtca

SEQ ID NO: 166327 - DNA, 20 bp, Homo sapiens
tgtaatctcagcactttgga

SEQ ID NO: 166328 - DNA, 23 bp, Homo sapiens
tgaggtcagaagtttgagaccac

SEQ ID NO: 166329 - DNA, 23 bp, Homo sapiens
actgagtctcactctgtcgccca

SEQ ID NO: 166330 - DNA, 20 bp, Homo sapiens
agtaattgtagtttaaatag

SEQ ID NO: 166331 - DNA, 23 bp, Homo sapiens
gacagagtctcgctctgtcaccc

SEQ ID NO: 166332 - DNA, 23 bp, Homo sapiens
acagagtctcgctctgtcaccca

SEQ ID NO: 166333 - DNA, 20 bp, Homo sapiens
tatatgtctatatatagatg

SEQ ID NO: 166334 - DNA, 22 bp, Homo sapiens
atatggatgttatatccatata

SEQ ID NO: 166335 - DNA, 23 bp, Homo sapiens
tgagagagattagagagtgttca

SEQ ID NO: 166336 - DNA, 23 bp, Homo sapiens
tgagttcattgtagattctggat

SEQ ID NO: 166337 - DNA, 23 bp, Homo sapiens
tgagttcattgtagattctggat

SEQ ID NO: 166338 - DNA, 23 bp, Homo sapiens
ttagcaagattatcaaatgccca

SEQ ID NO: 166339 - DNA, 23 bp, Homo sapiens
atgtgtatatatgtatatgtgtg

SEQ ID NO: 166340 - DNA, 23 bp, Homo sapiens
ttaaaatgcagtttctgattcag

SEQ ID NO: 166341 - DNA, 22 bp, Homo sapiens
attctctctgtctaactcattt

SEQ ID NO: 166342 - DNA, 22 bp, Homo sapiens
tatgtatatatgtatatgtgtg

SEQ ID NO: 166343 - DNA, 22 bp, Homo sapiens
tatatacgtgtatatacgtata

SEQ ID NO: 166344 - DNA, 20 bp, Homo sapiens
acacgtatatatgtgtatac

SEQ ID NO: 166345 - DNA, 23 bp, Homo sapiens
tatagtatactatgctatactat

SEQ ID NO: 166346 - DNA, 18 bp, Homo sapiens
tgcaatggtgagatctct

SEQ ID NO: 166347 - DNA, 23 bp, Homo sapiens
ctgtgtctctgtgttattgctcc

SEQ ID NO: 166348 - DNA, 23 bp, Homo sapiens
agtctgattccatgctcaactaa

SEQ ID NO: 166349 - DNA, 23 bp, Homo sapiens
tgtgtgcacatgtgtgcgtgtgt

SEQ ID NO: 166350 - DNA, 23 bp, Homo sapiens
tgtatgtgtgcatgtgcatgtgt

SEQ ID NO: 166351 - DNA, 21 bp, Homo sapiens
actggttttattggaggttga

SEQ ID NO: 166352 - DNA, 22 bp, Homo sapiens
aatacagtgaatggatgttgtt

SEQ ID NO: 166353 - DNA, 22 bp, Homo sapiens
tactcagaatttattttactgt

SEQ ID NO: 166354 - DNA, 20 bp, Homo sapiens
agatatatgagtttgacaag

SEQ ID NO: 166355 - DNA, 23 bp, Homo sapiens
tgtgtatacatatgtttgtgtat

SEQ ID NO: 166356 - DNA, 19 bp, Homo sapiens
acatatatatacatgcata

SEQ ID NO: 166357 - DNA, 23 bp, Homo sapiens
tgccattcttttacatttcagca

SEQ ID NO: 166358 - DNA, 22 bp, Homo sapiens
aaaatggtattatagatgttgt

SEQ ID NO: 166359 - DNA, 18 bp, Homo sapiens
taatgaaacaaagtaaaa

SEQ ID NO: 166360 - DNA, 23 bp, Homo sapiens
cgaacacacacactctgacagcg

SEQ ID NO: 166361 - DNA, 23 bp, Homo sapiens
tacacacacacatattatagtgt

SEQ ID NO: 166362 - DNA, 21 bp, Homo sapiens
aaactccatctcaaagcaaca

SEQ ID NO: 166363 - DNA, 20 bp, Homo sapiens
tggttgattgaattttttga

SEQ ID NO: 166364 - DNA, 19 bp, Homo sapiens
tacattatgtatacatgta

SEQ ID NO: 166365 - DNA, 21 bp, Homo sapiens
tgcaatgtgtgtatatgttgt

SEQ ID NO: 166366 - DNA, 23 bp, Homo sapiens
tatggcacatgtaaaattcagta

SEQ ID NO: 166367 - DNA, 21 bp, Homo sapiens
tctttcattttataactgtca

SEQ ID NO: 166368 - DNA, 23 bp, Homo sapiens
ttgatctacaaatgctgtgtgag

SEQ ID NO: 166369 - DNA, 23 bp, Homo sapiens
gaatgcgtgtgttgactttctgt

SEQ ID NO: 166370 - DNA, 18 bp, Homo sapiens
tggatatatatacacaca

SEQ ID NO: 166371 - DNA, 19 bp, Homo sapiens
atggatatatatacatata

SEQ ID NO: 166372 - DNA, 23 bp, Homo sapiens
agctagtgagccatagaatcagg

SEQ ID NO: 166373 - DNA, 20 bp, Homo sapiens
tcatatgtatcatatatatc

SEQ ID NO: 166374 - DNA, 18 bp, Homo sapiens
accttgggtaacttgtct

SEQ ID NO: 166375 - DNA, 23 bp, Homo sapiens
cagggtctctctctgtcacccag

SEQ ID NO: 166376 - DNA, 23 bp, Homo sapiens
acagagtctccctctgtctccca

SEQ ID NO: 166377 - DNA, 22 bp, Homo sapiens
ttttgagacggagtctcactgt

SEQ ID NO: 166378 - DNA, 23 bp, Homo sapiens
ttgagacggagttttgctcttgt

SEQ ID NO: 166379 - DNA, 23 bp, Homo sapiens
agaacaagaccaactcaatggaa

SEQ ID NO: 166380 - DNA, 23 bp, Homo sapiens
cagagtctcactctgtctcccag

SEQ ID NO: 166381 - DNA, 19 bp, Homo sapiens
agtgtgtgaaggctactgt

SEQ ID NO: 166382 - DNA, 23 bp, Homo sapiens
aagattctgcatttctttttttt

SEQ ID NO: 166383 - DNA, 23 bp, Homo sapiens
ttcttgactcaggttatctggct

SEQ ID NO: 166384 - DNA, 23 bp, Homo sapiens
tgagttcattgtagattctggat

SEQ ID NO: 166385 - DNA, 23 bp, Homo sapiens
tgagttcattgtagattctggat

SEQ ID NO: 166386 - DNA, 21 bp, Homo sapiens
cttgactcactgcaagctctg

SEQ ID NO: 166387 - DNA, 21 bp, Homo sapiens
tgaggtagagtcttactctgt

SEQ ID NO: 166388 - DNA, 23 bp, Homo sapiens
tagacactgagctgtcagtggag

SEQ ID NO: 166389 - DNA, 22 bp, Homo sapiens
tctgtgagtgatatgcgagagg

SEQ ID NO: 166390 - DNA, 23 bp, Homo sapiens
aatctggaattcactcactcaca

SEQ ID NO: 166391 - DNA, 23 bp, Homo sapiens
tttgtatttcagttgggaagagt

SEQ ID NO: 166392 - DNA, 23 bp, Homo sapiens
tgagaacagctgctcatttgctg

SEQ ID NO: 166393 - DNA, 23 bp, Homo sapiens
tatacacacacatatatatgtgt

SEQ ID NO: 166394 - DNA, 23 bp, Homo sapiens
tgtctgtcagaaaatgtgcttag

SEQ ID NO: 166395 - DNA, 22 bp, Homo sapiens
taagagtcagatggcactgagc

SEQ ID NO: 166396 - DNA, 20 bp, Homo sapiens
cacacacatatgtatatgta

SEQ ID NO: 166397 - DNA, 23 bp, Homo sapiens
tctgcttctgtgatattgtgatc

SEQ ID NO: 166398 - DNA, 23 bp, Homo sapiens
atgtgtgtgtgtatatgtgtgaa

SEQ ID NO: 166399 - DNA, 23 bp, Homo sapiens
aagagagagagagttcatcctgg

SEQ ID NO: 166400 - DNA, 23 bp, Homo sapiens
gacagagtctcgctctgtcaccc

SEQ ID NO: 166401 - DNA, 23 bp, Homo sapiens
atcactgcaattgaaaagaatca

SEQ ID NO: 166402 - DNA, 23 bp, Homo sapiens
agagtctcactctgtcacccagg

SEQ ID NO: 166403 - DNA, 23 bp, Homo sapiens
gtcagagtctcactctgtcaccc

SEQ ID NO: 166404 - DNA, 20 bp, Homo sapiens
agtctcgctctgtcgctcag

SEQ ID NO: 166405 - DNA, 21 bp, Homo sapiens
atatgcatatttataatatgt

SEQ ID NO: 166406 - DNA, 18 bp, Homo sapiens
acaggtgtgagtcacgac

SEQ ID NO: 166407 - DNA, 22 bp, Homo sapiens
aggggctcactctgtcacccag

SEQ ID NO: 166408 - DNA, 23 bp, Homo sapiens
gagacggattctcactctgtcac

SEQ ID NO: 166409 - DNA, 19 bp, Homo sapiens
ttgtggatgatttgttatg

SEQ ID NO: 166410 - DNA, 21 bp, Homo sapiens
tggagtctctctctgtcaccc

SEQ ID NO: 166411 - DNA, 23 bp, Homo sapiens
tggagtctcactctgtcacccag

SEQ ID NO: 166412 - DNA, 23 bp, Homo sapiens
acacagaactgtgtgaggacaag

SEQ ID NO: 166413 - DNA, 23 bp, Homo sapiens
cggagtctcactgtgtcactgag

SEQ ID NO: 166414 - DNA, 23 bp, Homo sapiens
tgtgcctggctgtctctgaggct

SEQ ID NO: 166415 - DNA, 23 bp, Homo sapiens
aatgaacatctggggctgctgtt

SEQ ID NO: 166416 - DNA, 23 bp, Homo sapiens
gactgagtctcgctctgtcaccc

SEQ ID NO: 166417 - DNA, 23 bp, Homo sapiens
agagtgagccctgtctctctctc

SEQ ID NO: 166418 - DNA, 20 bp, Homo sapiens
acagacatcacagacaagga

SEQ ID NO: 166419 - DNA, 20 bp, Homo sapiens
tgaggcagagtctcgctctg

SEQ ID NO: 166420 - DNA, 23 bp, Homo sapiens
tgggtctcactcactctgtcacc

SEQ ID NO: 166421 - DNA, 23 bp, Homo sapiens
gcctctgtgtcagtcactgccag

SEQ ID NO: 166422 - DNA, 23 bp, Homo sapiens
tttggagtgaggcaatggtgtga

SEQ ID NO: 166423 - DNA, 21 bp, Homo sapiens
tgagatggagtctcactctgt

SEQ ID NO: 166424 - DNA, 18 bp, Homo sapiens
ttcagagaaggctgtgag

SEQ ID NO: 166425 - DNA, 23 bp, Homo sapiens
tgatttgcatcttttatattgtc

SEQ ID NO: 166426 - DNA, 23 bp, Homo sapiens
catatatatagtgtgtgtgtgta

SEQ ID NO: 166427 - DNA, 20 bp, Homo sapiens
tacagtatatatatacagta

SEQ ID NO: 166428 - DNA, 23 bp, Homo sapiens
atatactgtgtgtatatatagtg

SEQ ID NO: 166429 - DNA, 23 bp, Homo sapiens
ccctctgtccctccgtctcagtg

SEQ ID NO: 166430 - DNA, 21 bp, Homo sapiens
acacaggaaaatgtatacatc

SEQ ID NO: 166431 - DNA, 18 bp, Homo sapiens
gtggtaagggtcagtgag

SEQ ID NO: 166432 - DNA, 23 bp, Homo sapiens
ctgcgtggctctctgcctctctg

SEQ ID NO: 166433 - DNA, 23 bp, Homo sapiens
cacagcctctgtgcctgggactc

SEQ ID NO: 166434 - DNA, 23 bp, Homo sapiens
ttgaggtggagtctcactctgtt

SEQ ID NO: 166435 - DNA, 23 bp, Homo sapiens
cagggtctcactctgtctcccag

SEQ ID NO: 166436 - DNA, 23 bp, Homo sapiens
gtgacagagtctgtctgtcataa

SEQ ID NO: 166437 - DNA, 22 bp, Homo sapiens
agtctcacagtctgagttgctg

SEQ ID NO: 166438 - DNA, 20 bp, Homo sapiens
taagtggtcaccctggagct

SEQ ID NO: 166439 - DNA, 22 bp, Homo sapiens
gctcactcgctcactcagtcat

SEQ ID NO: 166440 - DNA, 22 bp, Homo sapiens
tcactctctgtgtgaccttggg

SEQ ID NO: 166441 - DNA, 21 bp, Homo sapiens
gtggaaggatcacttgaaccc

SEQ ID NO: 166442 - DNA, 23 bp, Homo sapiens
atgatgtttcactggaaattatt

SEQ ID NO: 166443 - DNA, 23 bp, Homo sapiens
agactctgaatctcttacagtgt

SEQ ID NO: 166444 - DNA, 23 bp, Homo sapiens
ctcattgtggttttgatttgcat

SEQ ID NO: 166445 - DNA, 22 bp, Homo sapiens
catgtgtatgtcttcttttgag

SEQ ID NO: 166446 - DNA, 23 bp, Homo sapiens
agtctcacagtctcactctgtcc

SEQ ID NO: 166447 - DNA, 23 bp, Homo sapiens
ggagtctcactctgtcacccagg

SEQ ID NO: 166448 - DNA, 20 bp, Homo sapiens
tgccagcgactgtgatcctt

SEQ ID NO: 166449 - DNA, 23 bp, Homo sapiens
tgagatggagtctcactctgtcg

SEQ ID NO: 166450 - DNA, 23 bp, Homo sapiens
ggtctcactgtattgtccagatt

SEQ ID NO: 166451 - DNA, 20 bp, Homo sapiens
ctgggctagagatttctggt

SEQ ID NO: 166452 - DNA, 23 bp, Homo sapiens
tcacattgtgctaaggcacgtgt

SEQ ID NO: 166453 - DNA, 23 bp, Homo sapiens
tttctggatcaggatctgttgag

SEQ ID NO: 166454 - DNA, 23 bp, Homo sapiens
acacagctactagattttttttt

SEQ ID NO: 166455 - DNA, 23 bp, Homo sapiens
ttttggagacagagtctcactct

SEQ ID NO: 166456 - DNA, 18 bp, Homo sapiens
tgtttgttcatgtcattg

SEQ ID NO: 166457 - DNA, 23 bp, Homo sapiens
tcgatgtgaacctgcagcagtga

SEQ ID NO: 166458 - DNA, 23 bp, Homo sapiens
gtcagtctctggctctgccactc

SEQ ID NO: 166459 - DNA, 23 bp, Homo sapiens
accaagtctcactctatcactca

SEQ ID NO: 166460 - DNA, 22 bp, Homo sapiens
tttcaccatgttgtccaggctg

SEQ ID NO: 166461 - DNA, 23 bp, Homo sapiens
ctcagtctctctgtctctccatg

SEQ ID NO: 166462 - DNA, 18 bp, Homo sapiens
tcattcattcatgttgta

SEQ ID NO: 166463 - DNA, 19 bp, Homo sapiens
aaagtcttaagacttgccc

SEQ ID NO: 166464 - DNA, 19 bp, Homo sapiens
tctgtcggactgagctgtc

SEQ ID NO: 166465 - DNA, 23 bp, Homo sapiens
cggagtctcactctgtcacccag

SEQ ID NO: 166466 - DNA, 23 bp, Homo sapiens
gagtctcactctgtcacccaggc

SEQ ID NO: 166467 - DNA, 23 bp, Homo sapiens
tgtctctcagttcctctgttctc

SEQ ID NO: 166468 - DNA, 19 bp, Homo sapiens
tgtgtgggtgtgggagagt

SEQ ID NO: 166469 - DNA, 21 bp, Homo sapiens
cctctctgtctgtgtgtccag

SEQ ID NO: 166470 - DNA, 20 bp, Homo sapiens
tttatatacttttcatatac

SEQ ID NO: 166471 - DNA, 23 bp, Homo sapiens
tcagtgtcactgaggattcttgg

SEQ ID NO: 166472 - DNA, 20 bp, Homo sapiens
ttttttctagagacatggtc

SEQ ID NO: 166473 - DNA, 23 bp, Homo sapiens
gatgacagacagtgtagtttggt

SEQ ID NO: 166474 - DNA, 21 bp, Homo sapiens
cagggtctctctctgtcgccc

SEQ ID NO: 166475 - DNA, 21 bp, Homo sapiens
agacggagtctcactctgtcg

SEQ ID NO: 166476 - DNA, 23 bp, Homo sapiens
atatactgagtatatgtatatgg

SEQ ID NO: 166477 - DNA, 18 bp, Homo sapiens
tgatgtatgtgacattga

SEQ ID NO: 166478 - DNA, 23 bp, Homo sapiens
ttagtcactgtatatctatttca

SEQ ID NO: 166479 - DNA, 21 bp, Homo sapiens
tgagccatcatgtctggcctg

SEQ ID NO: 166480 - DNA, 21 bp, Homo sapiens
attagctgggtgtggtggctc

SEQ ID NO: 166481 - DNA, 19 bp, Homo sapiens
acccagaatttgaagctga

SEQ ID NO: 166482 - DNA, 20 bp, Homo sapiens
tgagaggagacagtcatcag

SEQ ID NO: 166483 - DNA, 23 bp, Homo sapiens
aatctgcttttctagctatttga

SEQ ID NO: 166484 - DNA, 23 bp, Homo sapiens
taggcagtctctctgtgtggctg

SEQ ID NO: 166485 - DNA, 23 bp, Homo sapiens
tatctatgtgtatatatgtgtgt

SEQ ID NO: 166486 - DNA, 22 bp, Homo sapiens
atatgtgtatatatgtatgtgt

SEQ ID NO: 166487 - DNA, 19 bp, Homo sapiens
tcaccagctgtaagatctc

SEQ ID NO: 166488 - DNA, 23 bp, Homo sapiens
gtctctctgtctcagtcttggga

SEQ ID NO: 166489 - DNA, 23 bp, Homo sapiens
tgtttctctctttatcaacacgt

SEQ ID NO: 166490 - DNA, 23 bp, Homo sapiens
agcacacagtggatcctgagttt

SEQ ID NO: 166491 - DNA, 20 bp, Homo sapiens
tctgggtccaaatttctcct

SEQ ID NO: 166492 - DNA, 23 bp, Homo sapiens
atactgcatttggggctgtatct

SEQ ID NO: 166493 - DNA, 23 bp, Homo sapiens
agggtctcactctgtcacccagg

SEQ ID NO: 166494 - DNA, 23 bp, Homo sapiens
tggagtctcactctgtcacccag

SEQ ID NO: 166495 - DNA, 23 bp, Homo sapiens
tgacagcctccgactctgccagt

SEQ ID NO: 166496 - DNA, 22 bp, Homo sapiens
tatctcttctttgtggttccag

SEQ ID NO: 166497 - DNA, 22 bp, Homo sapiens
ggctttgaggtgaggaactgct

SEQ ID NO: 166498 - DNA, 22 bp, Homo sapiens
cagctcagactttctctgtgtc

SEQ ID NO: 166499 - DNA, 23 bp, Homo sapiens
atatatgagatatagatggggtt

SEQ ID NO: 166500 - DNA, 23 bp, Homo sapiens
tggagtctcactctgtcacccag

SEQ ID NO: 166501 - DNA, 23 bp, Homo sapiens
agctcccagagtgataatgcagt

SEQ ID NO: 166502 - DNA, 23 bp, Homo sapiens
atctgggacaaggtctcactcta

SEQ ID NO: 166503 - DNA, 23 bp, Homo sapiens
tgtgtatatatatatctgtatgt

SEQ ID NO: 166504 - DNA, 22 bp, Homo sapiens
tatatgcatatatatacagata

SEQ ID NO: 166505 - DNA, 19 bp, Homo sapiens
ataactatatatagttttg

SEQ ID NO: 166506 - DNA, 23 bp, Homo sapiens
acagagtctcgctctgtgaccca

SEQ ID NO: 166507 - DNA, 23 bp, Homo sapiens
gagagtctctctgtctcagttct

SEQ ID NO: 166508 - DNA, 23 bp, Homo sapiens
gggttcattgtaccattgtatga

SEQ ID NO: 166509 - DNA, 23 bp, Homo sapiens
atatgtgtatatgtatgtgtgtg

SEQ ID NO: 166510 - DNA, 22 bp, Homo sapiens
tatataccacatatacatatga

SEQ ID NO: 166511 - DNA, 23 bp, Homo sapiens
taatgtcaggtttttttgtgtgc

SEQ ID NO: 166512 - DNA, 18 bp, Homo sapiens
tttttgtttttgtttttg

SEQ ID NO: 166513 - DNA, 22 bp, Homo sapiens
atttgaacttggacaccagctg

SEQ ID NO: 166514 - DNA, 23 bp, Homo sapiens
aggctctctgggtctgagtcctg

SEQ ID NO: 166515 - DNA, 18 bp, Homo sapiens
aagaccactgactctaga

SEQ ID NO: 166516 - DNA, 21 bp, Homo sapiens
tctctgcctcagtttctccat

SEQ ID NO: 166517 - DNA, 19 bp, Homo sapiens
tcagttagattgctgtaac

SEQ ID NO: 166518 - DNA, 23 bp, Homo sapiens
aaattcctttgcttcatgttctt

SEQ ID NO: 166519 - DNA, 23 bp, Homo sapiens
cactgctttctttctctctgtga

SEQ ID NO: 166520 - DNA, 23 bp, Homo sapiens
ttattctgtatatcaaattgata

SEQ ID NO: 166521 - DNA, 21 bp, Homo sapiens
tttgagatggagttttgccct

SEQ ID NO: 166522 - DNA, 18 bp, Homo sapiens
ttttttttttttggttgg

SEQ ID NO: 166523 - DNA, 23 bp, Homo sapiens
atcagaggctggcaaaacatggc

SEQ ID NO: 166524 - DNA, 22 bp, Homo sapiens
tgcactctccctctcctgctgg

SEQ ID NO: 166525 - DNA, 23 bp, Homo sapiens
aatggtgatttctgagatgttgg

SEQ ID NO: 166526 - DNA, 23 bp, Homo sapiens
ttaagaatttgatgatcttggtg

SEQ ID NO: 166527 - DNA, 22 bp, Homo sapiens
tatggtagtactatgtattgtt

SEQ ID NO: 166528 - DNA, 21 bp, Homo sapiens
agaatgagactctatcttttt

SEQ ID NO: 166529 - DNA, 19 bp, Homo sapiens
tgagatggagtctcactct

SEQ ID NO: 166530 - DNA, 23 bp, Homo sapiens
actgtgacagaatacgaagctgt

SEQ ID NO: 166531 - DNA, 23 bp, Homo sapiens
tgagatggagtctcgctctgtcg

SEQ ID NO: 166532 - DNA, 23 bp, Homo sapiens
accacactcgggctgtgtgtgtg

SEQ ID NO: 166533 - DNA, 19 bp, Homo sapiens
gtctcgctctgtcacccag

SEQ ID NO: 166534 - DNA, 23 bp, Homo sapiens
gacagagtctcgctctgtcaccc

SEQ ID NO: 166535 - DNA, 23 bp, Homo sapiens
agaagctagaggaagaattgaac

SEQ ID NO: 166536 - DNA, 22 bp, Homo sapiens
ttttgagaccaagtcttgctct

SEQ ID NO: 166537 - DNA, 23 bp, Homo sapiens
cactctgtgatgaagaccaggac

SEQ ID NO: 166538 - DNA, 19 bp, Homo sapiens
tgactaagtctcgctctgt

SEQ ID NO: 166539 - DNA, 23 bp, Homo sapiens
agagtctcactctgtcacccagg

SEQ ID NO: 166540 - DNA, 23 bp, Homo sapiens
gagtctcactctgtcacccaggc

SEQ ID NO: 166541 - DNA, 23 bp, Homo sapiens
tgagtctcactctgtcatcaggc

SEQ ID NO: 166542 - DNA, 22 bp, Homo sapiens
tttggaataggatgttgtggca

SEQ ID NO: 166543 - DNA, 22 bp, Homo sapiens
tctgtgattatctgtctctcag

SEQ ID NO: 166544 - DNA, 21 bp, Homo sapiens
tgaggttgatggatctcttga

SEQ ID NO: 166545 - DNA, 23 bp, Homo sapiens
tctgggtccctgagtgcctctct

SEQ ID NO: 166546 - DNA, 20 bp, Homo sapiens
tgaggtaggaggatcacttg

SEQ ID NO: 166547 - DNA, 23 bp, Homo sapiens
tgagacggtgtctcgctctgttg

SEQ ID NO: 166548 - DNA, 18 bp, Homo sapiens
tcacccctggtcgtgtgg

SEQ ID NO: 166549 - DNA, 23 bp, Homo sapiens
tccaccatgtggaagtgatctga

SEQ ID NO: 166550 - DNA, 23 bp, Homo sapiens
ggagtctcactctgtcacccagg

SEQ ID NO: 166551 - DNA, 22 bp, Homo sapiens
ttgaggttgcagtgagccatga

SEQ ID NO: 166552 - DNA, 23 bp, Homo sapiens
tacatgtgcagaacgtgcaggtt

SEQ ID NO: 166553 - DNA, 23 bp, Homo sapiens
tgagagcatcaggattccctttg

SEQ ID NO: 166554 - DNA, 23 bp, Homo sapiens
aggtagatagataaatagatatg

SEQ ID NO: 166555 - DNA, 23 bp, Homo sapiens
atcttgttgtcttgctttgtatt

SEQ ID NO: 166556 - DNA, 22 bp, Homo sapiens
tgaggtagaatattgtatttca

SEQ ID NO: 166557 - DNA, 21 bp, Homo sapiens
ttactattatcagcatgagga

SEQ ID NO: 166558 - DNA, 23 bp, Homo sapiens
agactctttgttgatctgtgaat

SEQ ID NO: 166559 - DNA, 23 bp, Homo sapiens
attactctgcaactattttgcat

SEQ ID NO: 166560 - DNA, 23 bp, Homo sapiens
aataggagcagtctgtattttca

SEQ ID NO: 166561 - DNA, 23 bp, Homo sapiens
tttgagtacagagtcagatgaga

SEQ ID NO: 166562 - DNA, 21 bp, Homo sapiens
tgtatctcccactgggtgtct

SEQ ID NO: 166563 - DNA, 22 bp, Homo sapiens
agtctcactttgtcactctgtt

SEQ ID NO: 166564 - DNA, 20 bp, Homo sapiens
agagagacaagtgcgatgca

SEQ ID NO: 166565 - DNA, 22 bp, Homo sapiens
ttctgaaaattgtatgcagcaa

SEQ ID NO: 166566 - DNA, 22 bp, Homo sapiens
tgtgtatgtatagatgtatgta

SEQ ID NO: 166567 - DNA, 21 bp, Homo sapiens
tccctcggtccctgttagcct

SEQ ID NO: 166568 - DNA, 23 bp, Homo sapiens
tctctgaccctcagtctcagcct

SEQ ID NO: 166569 - DNA, 23 bp, Homo sapiens
acacagagtagagagttcgtgat

SEQ ID NO: 166570 - DNA, 23 bp, Homo sapiens
ctgaactcccttttctccaagtt

SEQ ID NO: 166571 - DNA, 23 bp, Homo sapiens
agtgagaccctgtctccctgtct

SEQ ID NO: 166572 - DNA, 23 bp, Homo sapiens
tgagacagtgtcactctgttgcc

SEQ ID NO: 166573 - DNA, 23 bp, Homo sapiens
atcactcacaggtatggcagaag

SEQ ID NO: 166574 - DNA, 22 bp, Homo sapiens
tgagacagcctcactccctgtg

SEQ ID NO: 166575 - DNA, 19 bp, Homo sapiens
tctgaatctggaggctatg

SEQ ID NO: 166576 - DNA, 23 bp, Homo sapiens
ggtagcagtagatgctggctagt

SEQ ID NO: 166577 - DNA, 23 bp, Homo sapiens
gtgcctgtctctctgtggctctc

SEQ ID NO: 166578 - DNA, 23 bp, Homo sapiens
caagtctgactgtgtctgagcca

SEQ ID NO: 166579 - DNA, 23 bp, Homo sapiens
atagcattgcaaatcagactgag

SEQ ID NO: 166580 - DNA, 23 bp, Homo sapiens
tgagttcattgtagattctggat

SEQ ID NO: 166581 - DNA, 23 bp, Homo sapiens
tgagttcattgtagattctggat

SEQ ID NO: 166582 - DNA, 19 bp, Homo sapiens
tagctgagattacaggcag

SEQ ID NO: 166583 - DNA, 22 bp, Homo sapiens
tcagcagttgtttatgccttca

SEQ ID NO: 166584 - DNA, 23 bp, Homo sapiens
tattctgaggatataatatgatg

SEQ ID NO: 166585 - DNA, 23 bp, Homo sapiens
tgagttcattgtagattctggat

SEQ ID NO: 166586 - DNA, 23 bp, Homo sapiens
tgagttcattgtagattctggat

SEQ ID NO: 166587 - DNA, 23 bp, Homo sapiens
tattgtgattgtgtatatgtgaa

SEQ ID NO: 166588 - DNA, 18 bp, Homo sapiens
atattgttgataggttct

SEQ ID NO: 166589 - DNA, 23 bp, Homo sapiens
atgtgtcagatataatgatgctt

SEQ ID NO: 166590 - DNA, 22 bp, Homo sapiens
atagtgaccaagtctttctagt

SEQ ID NO: 166591 - DNA, 23 bp, Homo sapiens
agatggagtctcactctgtcacc

SEQ ID NO: 166592 - DNA, 23 bp, Homo sapiens
tgtgtgtacatgtgtatgtgtgt

SEQ ID NO: 166593 - DNA, 22 bp, Homo sapiens
tctcacagacagaaattacagt

SEQ ID NO: 166594 - DNA, 20 bp, Homo sapiens
tttagggttttctacatata

SEQ ID NO: 166595 - DNA, 22 bp, Homo sapiens
agacaaggtctcgctgtgttga

SEQ ID NO: 166596 - DNA, 20 bp, Homo sapiens
ttgtaagatgttaacatgtg

SEQ ID NO: 166597 - DNA, 23 bp, Homo sapiens
aactgggcaacaaagtgagaccc

SEQ ID NO: 166598 - DNA, 23 bp, Homo sapiens
ttgagatggagttttgctcttgt

SEQ ID NO: 166599 - DNA, 23 bp, Homo sapiens
atattgggtctctctctgtcact

SEQ ID NO: 166600 - DNA, 23 bp, Homo sapiens
tggctctctcactctctgcttgc

SEQ ID NO: 166601 - DNA, 22 bp, Homo sapiens
acccacagagggtcaattgtac

SEQ ID NO: 166602 - DNA, 23 bp, Homo sapiens
ttgagatggagttttgctcttgt

SEQ ID NO: 166603 - DNA, 21 bp, Homo sapiens
cagtggcatgatcttggctca

SEQ ID NO: 166604 - DNA, 19 bp, Homo sapiens
agagtctcactctgtcacc

SEQ ID NO: 166605 - DNA, 21 bp, Homo sapiens
tgtgtgcgtgtgtgtgtatat

SEQ ID NO: 166606 - DNA, 19 bp, Homo sapiens
tatgtatatatataggtgt

SEQ ID NO: 166607 - DNA, 23 bp, Homo sapiens
acagagtctcactctgtcgccca

SEQ ID NO: 166608 - DNA, 22 bp, Homo sapiens
tttgggatgatctgattttttc

SEQ ID NO: 166609 - DNA, 23 bp, Homo sapiens
agagatgagatcttgttctgttg

SEQ ID NO: 166610 - DNA, 19 bp, Homo sapiens
atctcataggaaatgttca

SEQ ID NO: 166611 - DNA, 23 bp, Homo sapiens
aattctgtgaagagtctcaggac

SEQ ID NO: 166612 - DNA, 18 bp, Homo sapiens
atacaggagagacaggtg

SEQ ID NO: 166613 - DNA, 18 bp, Homo sapiens
acttgtcaccctctcttg

SEQ ID NO: 166614 - DNA, 23 bp, Homo sapiens
ggacgagctgctattcagtgtca

SEQ ID NO: 166615 - DNA, 23 bp, Homo sapiens
tttgagttgtttccaccttttga

SEQ ID NO: 166616 - DNA, 18 bp, Homo sapiens
acaagatctcactctgtc

SEQ ID NO: 166617 - DNA, 22 bp, Homo sapiens
caggatctcactctgtcaccca

SEQ ID NO: 166618 - DNA, 20 bp, Homo sapiens
aagcatcctaatgtttgcat

SEQ ID NO: 166619 - DNA, 23 bp, Homo sapiens
tggagtctgactctgtcacccag

SEQ ID NO: 166620 - DNA, 23 bp, Homo sapiens
ctgtgacaaagagaaaggggact

SEQ ID NO: 166621 - DNA, 20 bp, Homo sapiens
tctgtcacacagattggagt

SEQ ID NO: 166622 - DNA, 21 bp, Homo sapiens
ttttggtcaaacacagtctca

SEQ ID NO: 166623 - DNA, 23 bp, Homo sapiens
tgcctcccagtctggctgcctgg

SEQ ID NO: 166624 - DNA, 23 bp, Homo sapiens
ttctgagacaaagtattgctctg

SEQ ID NO: 166625 - DNA, 18 bp, Homo sapiens
agtcagttgtcagtcagg

SEQ ID NO: 166626 - DNA, 23 bp, Homo sapiens
acaaagaaatttatatgtgcata

SEQ ID NO: 166627 - DNA, 23 bp, Homo sapiens
tgagatggagtctcgctctgttg

SEQ ID NO: 166628 - DNA, 22 bp, Homo sapiens
tatatgtatatatatatgtgtg

SEQ ID NO: 166629 - DNA, 23 bp, Homo sapiens
gactgattgtcactctgtcaccc

SEQ ID NO: 166630 - DNA, 23 bp, Homo sapiens
cagcggtgtgatcttggctcact

SEQ ID NO: 166631 - DNA, 20 bp, Homo sapiens
ttctggaagaattggaaagt

SEQ ID NO: 166632 - DNA, 23 bp, Homo sapiens
tagatactgtgtgctgactttgt

SEQ ID NO: 166633 - DNA, 23 bp, Homo sapiens
agtacagatggtcaggctgcctt

SEQ ID NO: 166634 - DNA, 22 bp, Homo sapiens
gcagtgggatttctttgttttt

SEQ ID NO: 166635 - DNA, 23 bp, Homo sapiens
tctgtcacccagactagagtgta

SEQ ID NO: 166636 - DNA, 21 bp, Homo sapiens
ctcacagaggtaagtcacctg

SEQ ID NO: 166637 - DNA, 23 bp, Homo sapiens
gatggagtctcgctctgtcaccc

SEQ ID NO: 166638 - DNA, 23 bp, Homo sapiens
atatgtgtgtatgcatgtgtatg

SEQ ID NO: 166639 - DNA, 23 bp, Homo sapiens
atatgtgtgtatgtatatgtgtg

SEQ ID NO: 166640 - DNA, 23 bp, Homo sapiens
tttacaacactgtgtgcagtctg

SEQ ID NO: 166641 - DNA, 23 bp, Homo sapiens
atggggtttcaccatgttgccca

SEQ ID NO: 166642 - DNA, 23 bp, Homo sapiens
gacagagtctcgctctgtcaccc

SEQ ID NO: 166643 - DNA, 23 bp, Homo sapiens
tggagtctcactctgtcacccag

SEQ ID NO: 166644 - DNA, 18 bp, Homo sapiens
acagtggtgtgatctcag

SEQ ID NO: 166645 - DNA, 18 bp, Homo sapiens
agatagatactattctgg

SEQ ID NO: 166646 - DNA, 20 bp, Homo sapiens
tgtatattcatgtatatgta

SEQ ID NO: 166647 - DNA, 23 bp, Homo sapiens
atctcgtctcactgcaagctctg

SEQ ID NO: 166648 - DNA, 23 bp, Homo sapiens
cacatactgttttagcatgtgtt

SEQ ID NO: 166649 - DNA, 20 bp, Homo sapiens
tgaggtaggaggatcacttg

SEQ ID NO: 166650 - DNA, 23 bp, Homo sapiens
tatgtcaatgctaatgttgtctg

SEQ ID NO: 166651 - DNA, 23 bp, Homo sapiens
cttcattttgcttctgagactgg

SEQ ID NO: 166652 - DNA, 23 bp, Homo sapiens
agaagacagtcaaatctgcctgt

SEQ ID NO: 166653 - DNA, 23 bp, Homo sapiens
gtagatatatgtatatatgtaca

SEQ ID NO: 166654 - DNA, 22 bp, Homo sapiens
ttgagaagtgagtcagctgacg

SEQ ID NO: 166655 - DNA, 23 bp, Homo sapiens
tccttctttaacccggtgtctga

SEQ ID NO: 166656 - DNA, 23 bp, Homo sapiens
ctctgtttgactctctctgtgtg

SEQ ID NO: 166657 - DNA, 21 bp, Homo sapiens
tgaggtaggaggatcacttga

SEQ ID NO: 166658 - DNA, 22 bp, Homo sapiens
agggtctcacactgtcacccag

SEQ ID NO: 166659 - DNA, 20 bp, Homo sapiens
tgtgtatatatgtatatgta

SEQ ID NO: 166660 - DNA, 22 bp, Homo sapiens
ctgtccccgtcactgcctgcct

SEQ ID NO: 166661 - DNA, 23 bp, Homo sapiens
ttttatgcacacttagtttttct

SEQ ID NO: 166662 - DNA, 23 bp, Homo sapiens
tttctgagacagagtctcactct

SEQ ID NO: 166663 - DNA, 23 bp, Homo sapiens
ctcactgtgttgtctaagctgtg

SEQ ID NO: 166664 - DNA, 22 bp, Homo sapiens
acagagtctcgctctgtcaccc

SEQ ID NO: 166665 - DNA, 23 bp, Homo sapiens
ctttgagatggagtctcactctg

SEQ ID NO: 166666 - DNA, 23 bp, Homo sapiens
ccacttgtgtgcctgagaacctg

SEQ ID NO: 166667 - DNA, 19 bp, Homo sapiens
tttctgcttcaccacgact

SEQ ID NO: 166668 - DNA, 22 bp, Homo sapiens
acatggcttaaaatttgaaact

SEQ ID NO: 166669 - DNA, 19 bp, Homo sapiens
tgtggctgagtgcgcctgt

SEQ ID NO: 166670 - DNA, 23 bp, Homo sapiens
tatccctctgtcactctgtcgcc

SEQ ID NO: 166671 - DNA, 22 bp, Homo sapiens
tgagacagagtattgctctgtc

SEQ ID NO: 166672 - DNA, 19 bp, Homo sapiens
ggcgtgatcttagctcact

SEQ ID NO: 166673 - DNA, 21 bp, Homo sapiens
acagagcaagactctgtctca

SEQ ID NO: 166674 - DNA, 23 bp, Homo sapiens
ttttgagacagggtatcactctg

SEQ ID NO: 166675 - DNA, 23 bp, Homo sapiens
ttagttttgtttactttagtaga

SEQ ID NO: 166676 - DNA, 23 bp, Homo sapiens
ggtcggtgggtctctccctgtgt

SEQ ID NO: 166677 - DNA, 20 bp, Homo sapiens
tggcaccgtggctttcttct

SEQ ID NO: 166678 - DNA, 23 bp, Homo sapiens
atgacagcatcaaagatcttgga

SEQ ID NO: 166679 - DNA, 21 bp, Homo sapiens
aaagagagtgaacacacaggc

SEQ ID NO: 166680 - DNA, 23 bp, Homo sapiens
ttaacagaggaaataatctccta

SEQ ID NO: 166681 - DNA, 23 bp, Homo sapiens
acagagtctcactctgtcgccca

SEQ ID NO: 166682 - DNA, 19 bp, Homo sapiens
tctctcctgcctacacaga

SEQ ID NO: 166683 - DNA, 23 bp, Homo sapiens
tttgaggcagtcttgctctgtca

SEQ ID NO: 166684 - DNA, 23 bp, Homo sapiens
ttgagcatcaggcagtgtctaag

SEQ ID NO: 166685 - DNA, 22 bp, Homo sapiens
agaggggcagggaaagagctgt

SEQ ID NO: 166686 - DNA, 21 bp, Homo sapiens
ctctcacaccttctcacagtg

SEQ ID NO: 166687 - DNA, 23 bp, Homo sapiens
gatggagtctcactctgtcaccc

SEQ ID NO: 166688 - DNA, 23 bp, Homo sapiens
tgactctcaggctatgtcccctc

SEQ ID NO: 166689 - DNA, 23 bp, Homo sapiens
cctcagtcacacactcaggcatc

SEQ ID NO: 166690 - DNA, 23 bp, Homo sapiens
cggagtctcactctgtcacccag

SEQ ID NO: 166691 - DNA, 21 bp, Homo sapiens
ataagaaaactaggtcaggtt

SEQ ID NO: 166692 - DNA, 23 bp, Homo sapiens
tgtaagtcgtggtccatctgtat

SEQ ID NO: 166693 - DNA, 23 bp, Homo sapiens
gacatggtcttgctctgtcaccc

SEQ ID NO: 166694 - DNA, 23 bp, Homo sapiens
gggtgacagagtgagactctctc

SEQ ID NO: 166695 - DNA, 23 bp, Homo sapiens
tcttactgtcacccaatgtggag

SEQ ID NO: 166696 - DNA, 23 bp, Homo sapiens
agagtctcactctgtcacccagg

SEQ ID NO: 166697 - DNA, 18 bp, Homo sapiens
tgcaacatctgcctcctg

SEQ ID NO: 166698 - DNA, 22 bp, Homo sapiens
cactgtgcccaacctgcagctg

SEQ ID NO: 166699 - DNA, 23 bp, Homo sapiens
gtgcttgtatgtatatatgagag

SEQ ID NO: 166700 - DNA, 23 bp, Homo sapiens
gacagagtctctgtcacccatgc

SEQ ID NO: 166701 - DNA, 22 bp, Homo sapiens
cacacagcgagtgagtgttgga

SEQ ID NO: 166702 - DNA, 23 bp, Homo sapiens
agatggagtctcactctgtcacc

SEQ ID NO: 166703 - DNA, 23 bp, Homo sapiens
gacaaggtctcactctgtcaccc

SEQ ID NO: 166704 - DNA, 23 bp, Homo sapiens
agtctcactctgtcacccaggct

SEQ ID NO: 166705 - DNA, 23 bp, Homo sapiens
tcttgtgtctggaattggtgggt

SEQ ID NO: 166706 - DNA, 23 bp, Homo sapiens
tggctctctctgtccctctgggt

SEQ ID NO: 166707 - DNA, 23 bp, Homo sapiens
atgtagtcactggtgacagtggg

SEQ ID NO: 166708 - DNA, 22 bp, Homo sapiens
gctactctgtgcctcagtttcc

SEQ ID NO: 166709 - DNA, 18 bp, Homo sapiens
tcacagaccacactgagg

SEQ ID NO: 166710 - DNA, 22 bp, Homo sapiens
actgagtctctctctgtcgccc

SEQ ID NO: 166711 - DNA, 19 bp, Homo sapiens
gacactgaagtcccaggtg

SEQ ID NO: 166712 - DNA, 23 bp, Homo sapiens
tatacctagactatctatattta

SEQ ID NO: 166713 - DNA, 22 bp, Homo sapiens
ttagatgtgcatattgtgttta

SEQ ID NO: 166714 - DNA, 23 bp, Homo sapiens
aggatagaactgtggtttggcgc

SEQ ID NO: 166715 - DNA, 23 bp, Homo sapiens
gtggctctgtcagactgactgtg

SEQ ID NO: 166716 - DNA, 23 bp, Homo sapiens
gagagcctcactggctgagtgag

SEQ ID NO: 166717 - DNA, 23 bp, Homo sapiens
tctgtgtcattctgtctgcccct

SEQ ID NO: 166718 - DNA, 23 bp, Homo sapiens
tgagatggagtctcactctgtca

SEQ ID NO: 166719 - DNA, 23 bp, Homo sapiens
tctcactcttccagtctcattct

SEQ ID NO: 166720 - DNA, 20 bp, Homo sapiens
tggcagcctgggagaatgac

SEQ ID NO: 166721 - DNA, 23 bp, Homo sapiens
agtctcaccctgtcacccaggct

SEQ ID NO: 166722 - DNA, 23 bp, Homo sapiens
ggtctacttggtggactgtctgt

SEQ ID NO: 166723 - DNA, 20 bp, Homo sapiens
ttgtctgtgtcttggatgct

SEQ ID NO: 166724 - DNA, 23 bp, Homo sapiens
tagtctgcctgtctgtctgtgtc

SEQ ID NO: 166725 - DNA, 23 bp, Homo sapiens
ggtctgcttggtagtctgtctgt

SEQ ID NO: 166726 - DNA, 23 bp, Homo sapiens
ctgactcacggtctgagtcccag

SEQ ID NO: 166727 - DNA, 22 bp, Homo sapiens
aggaggtcccttctctggaggt

SEQ ID NO: 166728 - DNA, 20 bp, Homo sapiens
ttttgtatttttagtagaaa

SEQ ID NO: 166729 - DNA, 19 bp, Homo sapiens
aatgtcaccctttaagtac

SEQ ID NO: 166730 - DNA, 21 bp, Homo sapiens
tatgtgtatatatattcaaat

SEQ ID NO: 166731 - DNA, 21 bp, Homo sapiens
tatgtgtatatatattcaaat

SEQ ID NO: 166732 - DNA, 22 bp, Homo sapiens
ttccagagggaagaagagggga

SEQ ID NO: 166733 - DNA, 23 bp, Homo sapiens
tgagttcattgtagattctggat

SEQ ID NO: 166734 - DNA, 23 bp, Homo sapiens
tgagttcattgtagattctggat

SEQ ID NO: 166735 - DNA, 23 bp, Homo sapiens
tatatctgtatacatagtgtatc

SEQ ID NO: 166736 - DNA, 23 bp, Homo sapiens
aggtcagaagtgtgagaccagtg

SEQ ID NO: 166737 - DNA, 23 bp, Homo sapiens
ttatctctttttgttttcagttt

SEQ ID NO: 166738 - DNA, 23 bp, Homo sapiens
acagagtctcactctgtcgccca

SEQ ID NO: 166739 - DNA, 23 bp, Homo sapiens
ttcccttttgttaggattttgat

SEQ ID NO: 166740 - DNA, 23 bp, Homo sapiens
cagacagagtctcactctcttga

SEQ ID NO: 166741 - DNA, 23 bp, Homo sapiens
tgagacagagtctcgctgtgtgg

SEQ ID NO: 166742 - DNA, 23 bp, Homo sapiens
cctctctctctcactctgttcct

SEQ ID NO: 166743 - DNA, 23 bp, Homo sapiens
tttgagacggtgtctcagtctgt

SEQ ID NO: 166744 - DNA, 23 bp, Homo sapiens
tgagttcattgtagattctggat

SEQ ID NO: 166745 - DNA, 23 bp, Homo sapiens
tgagttcattgtagattctggat

SEQ ID NO: 166746 - DNA, 23 bp, Homo sapiens
tctgtctctgtgtctaaatgtcc

SEQ ID NO: 166747 - DNA, 22 bp, Homo sapiens
ggtctctctgtcactcaggctg

SEQ ID NO: 166748 - DNA, 23 bp, Homo sapiens
tctttttgcttaggattttcttg

SEQ ID NO: 166749 - DNA, 23 bp, Homo sapiens
tgtgaagaaagtcagtggtagtt

SEQ ID NO: 166750 - DNA, 19 bp, Homo sapiens
cagagacaagagtttcctg

SEQ ID NO: 166751 - DNA, 23 bp, Homo sapiens
acagaggagagagtggactgtgg

SEQ ID NO: 166752 - DNA, 23 bp, Homo sapiens
ctgagtctcactctgtcacccag

SEQ ID NO: 166753 - DNA, 21 bp, Homo sapiens
tgaggctgcagtgagtcaaga

SEQ ID NO: 166754 - DNA, 23 bp, Homo sapiens
tagattcctcaggaaatgttcac

SEQ ID NO: 166755 - DNA, 23 bp, Homo sapiens
gctgagttgttacatactgataa

SEQ ID NO: 166756 - DNA, 19 bp, Homo sapiens
tgggtgggtcccagtatgc

SEQ ID NO: 166757 - DNA, 23 bp, Homo sapiens
aagattcagtagtcagagtggac

SEQ ID NO: 166758 - DNA, 23 bp, Homo sapiens
ttgatgatgtgtctgtttttcta

SEQ ID NO: 166759 - DNA, 23 bp, Homo sapiens
agaactgtctctgttaatgtctg

SEQ ID NO: 166760 - DNA, 20 bp, Homo sapiens
acactggagagagtgtgcac

SEQ ID NO: 166761 - DNA, 23 bp, Homo sapiens
tgtgtctgtgtgtggtcatgtga

SEQ ID NO: 166762 - DNA, 18 bp, Homo sapiens
gctggagatacagaggga

SEQ ID NO: 166763 - DNA, 23 bp, Homo sapiens
tgaagtgagtttggaatggtttt

SEQ ID NO: 166764 - DNA, 22 bp, Homo sapiens
tttacatcaaagtgattttgta

SEQ ID NO: 166765 - DNA, 23 bp, Homo sapiens
tcagtgctattctctgtctgtca

SEQ ID NO: 166766 - DNA, 21 bp, Homo sapiens
tatatatatatgtatatgtgt

SEQ ID NO: 166767 - DNA, 23 bp, Homo sapiens
tgtatgtatatattctaatgtca

SEQ ID NO: 166768 - DNA, 19 bp, Homo sapiens
tgcctccttgtgtttaatc

SEQ ID NO: 166769 - DNA, 23 bp, Homo sapiens
tttggattgttcactggtagtgc

SEQ ID NO: 166770 - DNA, 23 bp, Homo sapiens
tgtttgtgtgtatatatatctga

SEQ ID NO: 166771 - DNA, 22 bp, Homo sapiens
tgtgatggtgaaaaatgagatt

SEQ ID NO: 166772 - DNA, 21 bp, Homo sapiens
tggcagccagcctcattccca

SEQ ID NO: 166773 - DNA, 18 bp, Homo sapiens
agtgtacttagatgcaca

SEQ ID NO: 166774 - DNA, 20 bp, Homo sapiens
tgccttggtttaggtgtcat

SEQ ID NO: 166775 - DNA, 23 bp, Homo sapiens
acagtctgtctctgtgcctcagt

SEQ ID NO: 166776 - DNA, 23 bp, Homo sapiens
gtctcccactgtgtgtatctctc

SEQ ID NO: 166777 - DNA, 23 bp, Homo sapiens
tgagactgaagactgaatgctga

SEQ ID NO: 166778 - DNA, 20 bp, Homo sapiens
tgacatcatgggcaagagga

SEQ ID NO: 166779 - DNA, 20 bp, Homo sapiens
atactcacacgtatacatat

SEQ ID NO: 166780 - DNA, 23 bp, Homo sapiens
tgagttcattgtagattctggat

SEQ ID NO: 166781 - DNA, 23 bp, Homo sapiens
tgagttcattgtagattctggat

SEQ ID NO: 166782 - DNA, 23 bp, Homo sapiens
tgagttcattgtagattctggat

SEQ ID NO: 166783 - DNA, 23 bp, Homo sapiens
tgagttcattgtagattctggat

SEQ ID NO: 166784 - DNA, 23 bp, Homo sapiens
agagtctcactcactctgtcgcc

SEQ ID NO: 166785 - DNA, 23 bp, Homo sapiens
tttgcctctggttctacatgctt

SEQ ID NO: 166786 - DNA, 23 bp, Homo sapiens
cacactgtgagtcgctcagtccc

SEQ ID NO: 166787 - DNA, 22 bp, Homo sapiens
agagtctcgctctgtcacccag

SEQ ID NO: 166788 - DNA, 23 bp, Homo sapiens
agctgtgtgacattggagagtca

SEQ ID NO: 166789 - DNA, 18 bp, Homo sapiens
tgaggtaggaggatcact

SEQ ID NO: 166790 - DNA, 23 bp, Homo sapiens
tcctgtctccctctcagcctctg

SEQ ID NO: 166791 - DNA, 23 bp, Homo sapiens
ctgcctgctctacctgcaggtgg

SEQ ID NO: 166792 - DNA, 21 bp, Homo sapiens
aaagtacaattgctggatcat

SEQ ID NO: 166793 - DNA, 23 bp, Homo sapiens
tgtgtctgtctgtctgtctacct

SEQ ID NO: 166794 - DNA, 23 bp, Homo sapiens
tatatctgtgcatgagcatgtgc

SEQ ID NO: 166795 - DNA, 23 bp, Homo sapiens
tcttggttgaatggtttacagta

SEQ ID NO: 166796 - DNA, 23 bp, Homo sapiens
ataatgtgcataaaattacaagg

SEQ ID NO: 166797 - DNA, 23 bp, Homo sapiens
cagtcagtgactgacaggagttg

SEQ ID NO: 166798 - DNA, 23 bp, Homo sapiens
catttctgagtcactctgagcca

SEQ ID NO: 166799 - DNA, 20 bp, Homo sapiens
ttagaccaactgcatgtggt

SEQ ID NO: 166800 - DNA, 20 bp, Homo sapiens
tgccagtacatagtaggagt

SEQ ID NO: 166801 - DNA, 23 bp, Homo sapiens
tctgtctctgtccatcttttgtg

SEQ ID NO: 166802 - DNA, 23 bp, Homo sapiens
tttttgtctgttacttttatccc

SEQ ID NO: 166803 - DNA, 23 bp, Homo sapiens
tgtgtatctgtgtgtatctgatg

SEQ ID NO: 166804 - DNA, 23 bp, Homo sapiens
tgactgcctcactcactggcatt

SEQ ID NO: 166805 - DNA, 20 bp, Homo sapiens
taaacaggtctttttcctct

SEQ ID NO: 166806 - DNA, 23 bp, Homo sapiens
acattaccaaattgtatcaagat

SEQ ID NO: 166807 - DNA, 21 bp, Homo sapiens
gcatgtgcaggatgtggaggt

SEQ ID NO: 166808 - DNA, 23 bp, Homo sapiens
agtgtagagagagaggtttggat

SEQ ID NO: 166809 - DNA, 23 bp, Homo sapiens
gtatatatgtatatgtataggta

SEQ ID NO: 166810 - DNA, 23 bp, Homo sapiens
tttatgtttttctagctgtaaga

SEQ ID NO: 166811 - DNA, 20 bp, Homo sapiens
tatgtcatcatcaaagaggg

SEQ ID NO: 166812 - DNA, 22 bp, Homo sapiens
aatgtgcatgactttggaatga

SEQ ID NO: 166813 - DNA, 20 bp, Homo sapiens
aaatcaggctgctgtctgcg

SEQ ID NO: 166814 - DNA, 18 bp, Homo sapiens
agacagcactcactgggc

SEQ ID NO: 166815 - DNA, 23 bp, Homo sapiens
gagaagtggtgtttctgtacttt

SEQ ID NO: 166816 - DNA, 23 bp, Homo sapiens
ttatgtggttgcaattttacatg

SEQ ID NO: 166817 - DNA, 23 bp, Homo sapiens
cttcagacttttctgttttgttt

SEQ ID NO: 166818 - DNA, 23 bp, Homo sapiens
agagcagagaagatagagtgcag

SEQ ID NO: 166819 - DNA, 23 bp, Homo sapiens
aatctctgaaagtaaatgtgacc

SEQ ID NO: 166820 - DNA, 21 bp, Homo sapiens
tgtgttgttccatgtctgtct

SEQ ID NO: 166821 - DNA, 21 bp, Homo sapiens
atatagatacatatctatacg

SEQ ID NO: 166822 - DNA, 19 bp, Homo sapiens
acagacacacatatgcacg

SEQ ID NO: 166823 - DNA, 23 bp, Homo sapiens
atatgtgtaaatatatgtatgta

SEQ ID NO: 166824 - DNA, 18 bp, Homo sapiens
atcacggttcactgcagc

SEQ ID NO: 166825 - DNA, 23 bp, Homo sapiens
gcagagacttgaaggttctgagt

SEQ ID NO: 166826 - DNA, 19 bp, Homo sapiens
tgtacatatattctgaata

SEQ ID NO: 166827 - DNA, 19 bp, Homo sapiens
tgattagaaggatgtgatt

SEQ ID NO: 166828 - DNA, 23 bp, Homo sapiens
tgtgcatgtgtgtgtgtgtgtgt

SEQ ID NO: 166829 - DNA, 21 bp, Homo sapiens
tgtgaggaaggtttcagattt

SEQ ID NO: 166830 - DNA, 22 bp, Homo sapiens
aagacttctgttatagctgtgt

SEQ ID NO: 166831 - DNA, 18 bp, Homo sapiens
ttggggaagaagaaaaga

SEQ ID NO: 166832 - DNA, 19 bp, Homo sapiens
tgtatatatatataggtgt

SEQ ID NO: 166833 - DNA, 23 bp, Homo sapiens
gagtagtttgattatgatatgcc

SEQ ID NO: 166834 - DNA, 23 bp, Homo sapiens
catatatgtgtatgttacatttt

SEQ ID NO: 166835 - DNA, 23 bp, Homo sapiens
atatatgcacatatacgtgtata

SEQ ID NO: 166836 - DNA, 20 bp, Homo sapiens
acagcattttgactcagatg

SEQ ID NO: 166837 - DNA, 23 bp, Homo sapiens
agaacttgttgtttgtttatttg

SEQ ID NO: 166838 - DNA, 21 bp, Homo sapiens
agacagtctttctcagtcacc

SEQ ID NO: 166839 - DNA, 21 bp, Homo sapiens
tctctctctgtgtctgtggcc

SEQ ID NO: 166840 - DNA, 20 bp, Homo sapiens
tggttttgttttgttttttg

SEQ ID NO: 166841 - DNA, 23 bp, Homo sapiens
acatgtgtgttcattttccacag

SEQ ID NO: 166842 - DNA, 23 bp, Homo sapiens
agagacatggtctggctctgttg

SEQ ID NO: 166843 - DNA, 20 bp, Homo sapiens
cagtgtaaaagtgttccctt

SEQ ID NO: 166844 - DNA, 18 bp, Homo sapiens
ggaactcatgagaaaaga

SEQ ID NO: 166845 - DNA, 23 bp, Homo sapiens
tatatatgtactttttcatatat

SEQ ID NO: 166846 - DNA, 23 bp, Homo sapiens
tctctctgtcacccatgattgta

SEQ ID NO: 166847 - DNA, 23 bp, Homo sapiens
tgagttcattgtagattctggat

SEQ ID NO: 166848 - DNA, 23 bp, Homo sapiens
tgagttcattgtagattctggat

SEQ ID NO: 166849 - DNA, 23 bp, Homo sapiens
tttgagacagaatcttgttctgt

SEQ ID NO: 166850 - DNA, 21 bp, Homo sapiens
ttttgagacggagtcttgctc

SEQ ID NO: 166851 - DNA, 19 bp, Homo sapiens
tctagatgcagcactccag

SEQ ID NO: 166852 - DNA, 23 bp, Homo sapiens
cagagtctcactctgtcgcccag

SEQ ID NO: 166853 - DNA, 23 bp, Homo sapiens
acacacttgagtttgtccacctg

SEQ ID NO: 166854 - DNA, 18 bp, Homo sapiens
atgagacaccatgatctt

SEQ ID NO: 166855 - DNA, 19 bp, Homo sapiens
aatgaatgtaaataaaggt

SEQ ID NO: 166856 - DNA, 23 bp, Homo sapiens
cagtgtctcactctgtcacccag

SEQ ID NO: 166857 - DNA, 23 bp, Homo sapiens
acagagtctcgctctgtcaccca

SEQ ID NO: 166858 - DNA, 23 bp, Homo sapiens
gagagggagtctcgctctgtctc

SEQ ID NO: 166859 - DNA, 21 bp, Homo sapiens
tgagtgctgtgtgttactgtt

SEQ ID NO: 166860 - DNA, 23 bp, Homo sapiens
gagaaagacagtggatgctttca

SEQ ID NO: 166861 - DNA, 23 bp, Homo sapiens
gactggcagatgtttgagctaca

SEQ ID NO: 166862 - DNA, 23 bp, Homo sapiens
cccactctcactgtgtgaccaga

SEQ ID NO: 166863 - DNA, 19 bp, Homo sapiens
atatgtgtgtgtatatgta

SEQ ID NO: 166864 - DNA, 23 bp, Homo sapiens
aaagtcattcaggagcaggttgt

SEQ ID NO: 166865 - DNA, 23 bp, Homo sapiens
gtatggttttgagtgattttctt

SEQ ID NO: 166866 - DNA, 23 bp, Homo sapiens
aacagcaattatgtagttttttt

SEQ ID NO: 166867 - DNA, 23 bp, Homo sapiens
tttagaactatatgaatatatgt

SEQ ID NO: 166868 - DNA, 18 bp, Homo sapiens
aaaaatgtacatgtactt

SEQ ID NO: 166869 - DNA, 23 bp, Homo sapiens
tatgtgtacatatatgtgtgtgt

SEQ ID NO: 166870 - DNA, 23 bp, Homo sapiens
atatgtgtatatgcatgtgtctg

SEQ ID NO: 166871 - DNA, 23 bp, Homo sapiens
tgagttcattgtagattctggat

SEQ ID NO: 166872 - DNA, 23 bp, Homo sapiens
tgagttcattgtagattctggat

SEQ ID NO: 166873 - DNA, 23 bp, Homo sapiens
tgtgtctgtgtcagctttatcgt

SEQ ID NO: 166874 - DNA, 23 bp, Homo sapiens
agagtctcactctgtcacccagg

SEQ ID NO: 166875 - DNA, 23 bp, Homo sapiens
aatcatgtggaaaacgtggtgct

SEQ ID NO: 166876 - DNA, 19 bp, Homo sapiens
aaagttagaattatatagt

SEQ ID NO: 166877 - DNA, 22 bp, Homo sapiens
tataagctatgtaagttaactg

SEQ ID NO: 166878 - DNA, 23 bp, Homo sapiens
gctgcctctgtgagtgtctgtcc

SEQ ID NO: 166879 - DNA, 20 bp, Homo sapiens
ttccttctttcctttagaga

SEQ ID NO: 166880 - DNA, 21 bp, Homo sapiens
acagcagcttctgttagggat

SEQ ID NO: 166881 - DNA, 23 bp, Homo sapiens
cggagtctcgctctgtctcccag

SEQ ID NO: 166882 - DNA, 23 bp, Homo sapiens
aagtgaaatgaatttgatgaaga

SEQ ID NO: 166883 - DNA, 23 bp, Homo sapiens
ataatgactgtatatcttctttt

SEQ ID NO: 166884 - DNA, 22 bp, Homo sapiens
taagcactttcactttgagagg

SEQ ID NO: 166885 - DNA, 20 bp, Homo sapiens
tgtgtatagatatacatgta

SEQ ID NO: 166886 - DNA, 20 bp, Homo sapiens
atatatatagtaggtatgtg

SEQ ID NO: 166887 - DNA, 23 bp, Homo sapiens
tgagttcattgtagattctggat

SEQ ID NO: 166888 - DNA, 23 bp, Homo sapiens
tgagttcattgtagattctggat

SEQ ID NO: 166889 - DNA, 20 bp, Homo sapiens
ttttgagatggagtctcact

SEQ ID NO: 166890 - DNA, 22 bp, Homo sapiens
agtaacaggaagaggaagagaa

SEQ ID NO: 166891 - DNA, 23 bp, Homo sapiens
tctctgtctcactgtcagcctgg

SEQ ID NO: 166892 - DNA, 23 bp, Homo sapiens
agattcagcttcactttgctatg

SEQ ID NO: 166893 - DNA, 23 bp, Homo sapiens
actctatctccaatacactgact

SEQ ID NO: 166894 - DNA, 23 bp, Homo sapiens
atatgtgtgcatatatatagtct

SEQ ID NO: 166895 - DNA, 23 bp, Homo sapiens
atagaagactatatgcatataca

SEQ ID NO: 166896 - DNA, 23 bp, Homo sapiens
aatctgggtggtaaacatatgaa

SEQ ID NO: 166897 - DNA, 23 bp, Homo sapiens
ttgaccaaagagagctgcagcaa

SEQ ID NO: 166898 - DNA, 23 bp, Homo sapiens
tggagatcttgaatttgttgcca

SEQ ID NO: 166899 - DNA, 19 bp, Homo sapiens
tgtgtatatatatctctct

SEQ ID NO: 166900 - DNA, 22 bp, Homo sapiens
tatttggtacaaggacttaatt

SEQ ID NO: 166901 - DNA, 23 bp, Homo sapiens
actttgcttctaaaatgtgtaca

SEQ ID NO: 166902 - DNA, 23 bp, Homo sapiens
tagagtacatcttacagagggtc

SEQ ID NO: 166903 - DNA, 23 bp, Homo sapiens
tgacctccaaactgtctgtgtgt

SEQ ID NO: 166904 - DNA, 22 bp, Homo sapiens
aaagagagaatggcattcaagt

SEQ ID NO: 166905 - DNA, 23 bp, Homo sapiens
taaatgggtgagttacagatgtg

SEQ ID NO: 166906 - DNA, 23 bp, Homo sapiens
gactttactgaatttgtttatta

SEQ ID NO: 166907 - DNA, 22 bp, Homo sapiens
atgtatttctcacatttctgga

SEQ ID NO: 166908 - DNA, 20 bp, Homo sapiens
agaccgggtccgtttctggt

SEQ ID NO: 166909 - DNA, 23 bp, Homo sapiens
tgcagacagaccagagactccag

SEQ ID NO: 166910 - DNA, 19 bp, Homo sapiens
caatgttctgaggctggag

SEQ ID NO: 166911 - DNA, 23 bp, Homo sapiens
agaggttgaaggttgttttttaa

SEQ ID NO: 166912 - DNA, 21 bp, Homo sapiens
tacagaagacattttctcctt

SEQ ID NO: 166913 - DNA, 20 bp, Homo sapiens
tctgtgttttactgtctgct

SEQ ID NO: 166914 - DNA, 22 bp, Homo sapiens
agcctgtggtagaagtttctct

SEQ ID NO: 166915 - DNA, 22 bp, Homo sapiens
tatgcgtgtgtgtgtgtatata

SEQ ID NO: 166916 - DNA, 23 bp, Homo sapiens
atgtatgtatatgtatgcatgtg

SEQ ID NO: 166917 - DNA, 21 bp, Homo sapiens
ttgcaggtgatttttgtttgt

SEQ ID NO: 166918 - DNA, 23 bp, Homo sapiens
agcttctagattctataaatgta

SEQ ID NO: 166919 - DNA, 19 bp, Homo sapiens
atatgtatattatatattg

SEQ ID NO: 166920 - DNA, 23 bp, Homo sapiens
taacttctatttcaaaggtgata

SEQ ID NO: 166921 - DNA, 23 bp, Homo sapiens
tacctggagactctcagactctc

SEQ ID NO: 166922 - DNA, 22 bp, Homo sapiens
tgcaaaggacgtgattttgttc

SEQ ID NO: 166923 - DNA, 23 bp, Homo sapiens
gtgtatatgtatatgtgtgtgtc

SEQ ID NO: 166924 - DNA, 23 bp, Homo sapiens
tgagttcattgtagattctggat

SEQ ID NO: 166925 - DNA, 23 bp, Homo sapiens
tgagttcattgtagattctggat

SEQ ID NO: 166926 - DNA, 23 bp, Homo sapiens
atatgttaggtttacttactgta

SEQ ID NO: 166927 - DNA, 21 bp, Homo sapiens
gtaccacttgttgaaaagact

SEQ ID NO: 166928 - DNA, 22 bp, Homo sapiens
cataggtttgagcactgaaagt

SEQ ID NO: 166929 - DNA, 22 bp, Homo sapiens
ctcaggctcagtcactctgtgt

SEQ ID NO: 166930 - DNA, 19 bp, Homo sapiens
acgggatatagattttcag

SEQ ID NO: 166931 - DNA, 23 bp, Homo sapiens
tctgactttctgtgtctgactcc

SEQ ID NO: 166932 - DNA, 23 bp, Homo sapiens
tgttgagagaacatacagagggc

SEQ ID NO: 166933 - DNA, 23 bp, Homo sapiens
tttgagtgtgttcttccaggact

SEQ ID NO: 166934 - DNA, 22 bp, Homo sapiens
tgccatgttgtaagggagctca

SEQ ID NO: 166935 - DNA, 23 bp, Homo sapiens
aggacaagagtgaaatcagttgc

SEQ ID NO: 166936 - DNA, 22 bp, Homo sapiens
gggggtgactctgtgcctgtgc

SEQ ID NO: 166937 - DNA, 23 bp, Homo sapiens
gactctctgcctctgtggtagct

SEQ ID NO: 166938 - DNA, 23 bp, Homo sapiens
tatgtatatatgtatgtgtgtgt

SEQ ID NO: 166939 - DNA, 19 bp, Homo sapiens
attctgcttgaatatatat

SEQ ID NO: 166940 - DNA, 18 bp, Homo sapiens
attctgcttgaatatata

SEQ ID NO: 166941 - DNA, 19 bp, Homo sapiens
attctgcttgaatatatat

SEQ ID NO: 166942 - DNA, 18 bp, Homo sapiens
attctgcttgaatatata

SEQ ID NO: 166943 - DNA, 23 bp, Homo sapiens
accgagtctcactctctgtaacc

SEQ ID NO: 166944 - DNA, 23 bp, Homo sapiens
atatgtatatgtgtgtatatgta

SEQ ID NO: 166945 - DNA, 23 bp, Homo sapiens
gatggagtcactctgtcgctcag

SEQ ID NO: 166946 - DNA, 22 bp, Homo sapiens
atacacacacacgtatatatgt

SEQ ID NO: 166947 - DNA, 18 bp, Homo sapiens
caggataaactttcagtt

SEQ ID NO: 166948 - DNA, 21 bp, Homo sapiens
ttcagatgaagtttcactctg

SEQ ID NO: 166949 - DNA, 23 bp, Homo sapiens
gatcactgtgtattgtgtattgt

SEQ ID NO: 166950 - DNA, 22 bp, Homo sapiens
tataggtctttggactatcata

SEQ ID NO: 166951 - DNA, 21 bp, Homo sapiens
gatagatcaggaccctgtctt

SEQ ID NO: 166952 - DNA, 21 bp, Homo sapiens
tgatacagagtctcgctctgt

SEQ ID NO: 166953 - DNA, 23 bp, Homo sapiens
atatctaggttcactaaggggat

SEQ ID NO: 166954 - DNA, 18 bp, Homo sapiens
aggggacagagtttctct

SEQ ID NO: 166955 - DNA, 23 bp, Homo sapiens
agacagagtctccctctgtcacc

SEQ ID NO: 166956 - DNA, 22 bp, Homo sapiens
tccatcagttaatcaatggatg

SEQ ID NO: 166957 - DNA, 20 bp, Homo sapiens
ttcatcagttaatgaatgga

SEQ ID NO: 166958 - DNA, 20 bp, Homo sapiens
tatgctaatatatatgtaca

SEQ ID NO: 166959 - DNA, 23 bp, Homo sapiens
attactgtatatgtatataacac

SEQ ID NO: 166960 - DNA, 20 bp, Homo sapiens
tatctgtgttcaccttggct

SEQ ID NO: 166961 - DNA, 23 bp, Homo sapiens
tatgtgtatatatatatatgtgt

SEQ ID NO: 166962 - DNA, 18 bp, Homo sapiens
tatactttaagttttagg

SEQ ID NO: 166963 - DNA, 21 bp, Homo sapiens
aagtgaggtttggtaatgtgt

SEQ ID NO: 166964 - DNA, 23 bp, Homo sapiens
tatgtgtgtccataggtatcttt

SEQ ID NO: 166965 - DNA, 23 bp, Homo sapiens
aagagagtcctattgttaacact

SEQ ID NO: 166966 - DNA, 23 bp, Homo sapiens
tcagtgcatctctgaacctattc

SEQ ID NO: 166967 - DNA, 23 bp, Homo sapiens
aaagcttctgtacagcaggaaga

SEQ ID NO: 166968 - DNA, 23 bp, Homo sapiens
gaaagaggtaatgaattggaggg

SEQ ID NO: 166969 - DNA, 23 bp, Homo sapiens
ttttctgcttctaaaacttgggt

SEQ ID NO: 166970 - DNA, 21 bp, Homo sapiens
ttgaggaatttgaggtagagg

SEQ ID NO: 166971 - DNA, 18 bp, Homo sapiens
ttctgtattacctgcagt

SEQ ID NO: 166972 - DNA, 23 bp, Homo sapiens
gacagagtctcactctgtcactc

SEQ ID NO: 166973 - DNA, 23 bp, Homo sapiens
tatttgattttatacatatgtgt

SEQ ID NO: 166974 - DNA, 23 bp, Homo sapiens
tgagagagatctgcagattggtt

SEQ ID NO: 166975 - DNA, 23 bp, Homo sapiens
tggcagagagattatgtttcggg

SEQ ID NO: 166976 - DNA, 23 bp, Homo sapiens
gatatctatgtatatgtaggtgt

SEQ ID NO: 166977 - DNA, 23 bp, Homo sapiens
tgtttgtgtgcatatgtgtatgt

SEQ ID NO: 166978 - DNA, 22 bp, Homo sapiens
agagatatgtttttcctgagcc

SEQ ID NO: 166979 - DNA, 21 bp, Homo sapiens
attctgcatctgcatgtcttt

SEQ ID NO: 166980 - DNA, 22 bp, Homo sapiens
tctttgtcggttccatatgatt

SEQ ID NO: 166981 - DNA, 23 bp, Homo sapiens
tgggtcaagaaagtgagctgaag

SEQ ID NO: 166982 - DNA, 19 bp, Homo sapiens
taatactgagcgtcaactt

SEQ ID NO: 166983 - DNA, 23 bp, Homo sapiens
gccatagcatttgtaaactgtca

SEQ ID NO: 166984 - DNA, 18 bp, Homo sapiens
aaaagttcatcgagtggg

SEQ ID NO: 166985 - DNA, 19 bp, Homo sapiens
gttacacttcagcagctgg

SEQ ID NO: 166986 - DNA, 23 bp, Homo sapiens
attcagtaaatctgtctctctct

SEQ ID NO: 166987 - DNA, 20 bp, Homo sapiens
tctcactctgttacctaagc

SEQ ID NO: 166988 - DNA, 23 bp, Homo sapiens
atgaggcaggtaatcctatcagt

SEQ ID NO: 166989 - DNA, 23 bp, Homo sapiens
tcagacacagagagtagtaaagt

SEQ ID NO: 166990 - DNA, 23 bp, Homo sapiens
gacagagtctcgctctgtcaccc

SEQ ID NO: 166991 - DNA, 23 bp, Homo sapiens
cagtctgtcacccagtctggagt

SEQ ID NO: 166992 - DNA, 23 bp, Homo sapiens
gtagccatcctaatgagtgtgaa

SEQ ID NO: 166993 - DNA, 23 bp, Homo sapiens
tttgagaccttgagaaaagagaa

SEQ ID NO: 166994 - DNA, 23 bp, Homo sapiens
tctgtgaagaaagtcaatagtag

SEQ ID NO: 166995 - DNA, 23 bp, Homo sapiens
actcactgcctctgagcctcggt

SEQ ID NO: 166996 - DNA, 23 bp, Homo sapiens
tggagtctcactctgtcacccag

SEQ ID NO: 166997 - DNA, 21 bp, Homo sapiens
agcaggactttgtggttttag

SEQ ID NO: 166998 - DNA, 19 bp, Homo sapiens
agacacacacactcctctt

SEQ ID NO: 166999 - DNA, 23 bp, Homo sapiens
aacaagtagatcttgagctcctg

SEQ ID NO: 167000 - DNA, 22 bp, Homo sapiens
catcattgagtatgatttaact

SEQ ID NO: 167001 - DNA, 21 bp, Homo sapiens
aggtagtgcagcgggtgcaca

SEQ ID NO: 167002 - DNA, 22 bp, Homo sapiens
tttcactcactgggtatgatgc

SEQ ID NO: 167003 - DNA, 23 bp, Homo sapiens
tgtgtgtgtatgtgtgtccagtc

SEQ ID NO: 167004 - DNA, 20 bp, Homo sapiens
tctgtgttttactgtctgct

SEQ ID NO: 167005 - DNA, 23 bp, Homo sapiens
tccctctctgactcagccctttc

SEQ ID NO: 167006 - DNA, 23 bp, Homo sapiens
aacagtggagtcagagcacagag

SEQ ID NO: 167007 - DNA, 22 bp, Homo sapiens
tgactagtctgaattgagatgt

SEQ ID NO: 167008 - DNA, 22 bp, Homo sapiens
taaacagaaaggaaatgatgaa

SEQ ID NO: 167009 - DNA, 23 bp, Homo sapiens
tgttgagacagagtctcgttctg

SEQ ID NO: 167010 - DNA, 21 bp, Homo sapiens
tgagacagagtctcgctctgt

SEQ ID NO: 167011 - DNA, 23 bp, Homo sapiens
ctcagagataagactgaagtata

SEQ ID NO: 167012 - DNA, 23 bp, Homo sapiens
ttgtccatgcctgtagtcccagc

SEQ ID NO: 167013 - DNA, 18 bp, Homo sapiens
tgaggtagaaggatcact

SEQ ID NO: 167014 - DNA, 21 bp, Homo sapiens
tgagggtaactcagtctttct

SEQ ID NO: 167015 - DNA, 23 bp, Homo sapiens
acaaagtatttgtttctgaattc

SEQ ID NO: 167016 - DNA, 21 bp, Homo sapiens
agagaccgagtctcgctctgt

SEQ ID NO: 167017 - DNA, 19 bp, Homo sapiens
acataaatatgaattcata

SEQ ID NO: 167018 - DNA, 22 bp, Homo sapiens
aatggccctgcttgaatccagt

SEQ ID NO: 167019 - DNA, 23 bp, Homo sapiens
accacagtctctgtctcccaggc

SEQ ID NO: 167020 - DNA, 23 bp, Homo sapiens
atgtgtctgtagatccagctact

SEQ ID NO: 167021 - DNA, 18 bp, Homo sapiens
tttttcttttttttcgtt

SEQ ID NO: 167022 - DNA, 21 bp, Homo sapiens
acccactctcagtcagttctc

SEQ ID NO: 167023 - DNA, 18 bp, Homo sapiens
ttgaatgagaagtggtat

SEQ ID NO: 167024 - DNA, 23 bp, Homo sapiens
ttttagagatggggtctctctct

SEQ ID NO: 167025 - DNA, 20 bp, Homo sapiens
ttcagtaaatatataaaagt

SEQ ID NO: 167026 - DNA, 19 bp, Homo sapiens
catgtttgatcagctttgt

SEQ ID NO: 167027 - DNA, 23 bp, Homo sapiens
cggagtctcactctgtcacccag

SEQ ID NO: 167028 - DNA, 23 bp, Homo sapiens
tttgagacggagtctcgctctgt

SEQ ID NO: 167029 - DNA, 19 bp, Homo sapiens
tgtgtgtgtctatatatgc

SEQ ID NO: 167030 - DNA, 18 bp, Homo sapiens
tatacagacacacataca

SEQ ID NO: 167031 - DNA, 19 bp, Homo sapiens
aaatggactgtgctgatgg

SEQ ID NO: 167032 - DNA, 21 bp, Homo sapiens
aggcagagtgggatggagctg

SEQ ID NO: 167033 - DNA, 23 bp, Homo sapiens
agtcagggtctcgctctgtcacc

SEQ ID NO: 167034 - DNA, 23 bp, Homo sapiens
gacagagtctcgctctgtcaccc

SEQ ID NO: 167035 - DNA, 23 bp, Homo sapiens
ttgagacggagtctcactctgtc

SEQ ID NO: 167036 - DNA, 23 bp, Homo sapiens
tggagtctcactctgtcacccag

SEQ ID NO: 167037 - DNA, 23 bp, Homo sapiens
caaggtctcactctgtcacccag

SEQ ID NO: 167038 - DNA, 23 bp, Homo sapiens
gtccctcactctgtgtatatgtg

SEQ ID NO: 167039 - DNA, 23 bp, Homo sapiens
tgtggctggtatggatggtgtgg

SEQ ID NO: 167040 - DNA, 19 bp, Homo sapiens
tgtacaattctatggttta

SEQ ID NO: 167041 - DNA, 23 bp, Homo sapiens
tcagaagactgtctcagcctctg

SEQ ID NO: 167042 - DNA, 23 bp, Homo sapiens
cagagtctcactctgtcacccag

SEQ ID NO: 167043 - DNA, 23 bp, Homo sapiens
tgagttcattgtagattctggat

SEQ ID NO: 167044 - DNA, 23 bp, Homo sapiens
tgagttcattgtagattctggat

SEQ ID NO: 167045 - DNA, 23 bp, Homo sapiens
tcccagagcccctggaactctgg

SEQ ID NO: 167046 - DNA, 18 bp, Homo sapiens
agagaagtttgacatctc

SEQ ID NO: 167047 - DNA, 19 bp, Homo sapiens
actgcaacctctgcttcct

SEQ ID NO: 167048 - DNA, 23 bp, Homo sapiens
tcagccagtctctgcctctctct

SEQ ID NO: 167049 - DNA, 18 bp, Homo sapiens
atatgagcttcttgaaac

SEQ ID NO: 167050 - DNA, 23 bp, Homo sapiens
gggtgtgaacactgtctgcacac

SEQ ID NO: 167051 - DNA, 20 bp, Homo sapiens
tttgtgggtacatagtaggt

SEQ ID NO: 167052 - DNA, 19 bp, Homo sapiens
gagaagtccggactctgct

SEQ ID NO: 167053 - DNA, 23 bp, Homo sapiens
cggtcagtctctgggtgtctcct

SEQ ID NO: 167054 - DNA, 21 bp, Homo sapiens
tctctcactttacgatgtctt

SEQ ID NO: 167055 - DNA, 21 bp, Homo sapiens
ttttgagacggagtgttactc

SEQ ID NO: 167056 - DNA, 21 bp, Homo sapiens
tggatcctgtactgcagaggg

SEQ ID NO: 167057 - DNA, 20 bp, Homo sapiens
ggtagagttgacaatttttt

SEQ ID NO: 167058 - DNA, 23 bp, Homo sapiens
tgagatggagtctcgctctgtca

SEQ ID NO: 167059 - DNA, 21 bp, Homo sapiens
attatgtatatatatatgtac

SEQ ID NO: 167060 - DNA, 20 bp, Homo sapiens
tatatgcacacaatggaata

SEQ ID NO: 167061 - DNA, 23 bp, Homo sapiens
tgagttcattgtagattctggat

SEQ ID NO: 167062 - DNA, 23 bp, Homo sapiens
tgagttcattgtagattctggat

SEQ ID NO: 167063 - DNA, 23 bp, Homo sapiens
tgagttcattgtagattctggat

SEQ ID NO: 167064 - DNA, 23 bp, Homo sapiens
tgagttcattgtagattctggat

SEQ ID NO: 167065 - DNA, 23 bp, Homo sapiens
tgtgtgtgtatgtgtatgcatgc

SEQ ID NO: 167066 - DNA, 20 bp, Homo sapiens
ttacagacatgagccaccgc

SEQ ID NO: 167067 - DNA, 21 bp, Homo sapiens
ttattgagcgctctcattttg

SEQ ID NO: 167068 - DNA, 23 bp, Homo sapiens
tcactggtctgtgtttctctgtg

SEQ ID NO: 167069 - DNA, 23 bp, Homo sapiens
tatggattggttaactagggatt

SEQ ID NO: 167070 - DNA, 23 bp, Homo sapiens
tgagttcattgtagattctggat

SEQ ID NO: 167071 - DNA, 23 bp, Homo sapiens
tgagttcattgtagattctggat

SEQ ID NO: 167072 - DNA, 23 bp, Homo sapiens
ggagtctctctctgtcacacagg

SEQ ID NO: 167073 - DNA, 23 bp, Homo sapiens
gtcttttgaatcctatgtgaggg

SEQ ID NO: 167074 - DNA, 18 bp, Homo sapiens
gtgtatgtatatacacgt

SEQ ID NO: 167075 - DNA, 23 bp, Homo sapiens
tatacatatgtgtatgtatatgt

SEQ ID NO: 167076 - DNA, 22 bp, Homo sapiens
taatatgtatgttataatacat

SEQ ID NO: 167077 - DNA, 21 bp, Homo sapiens
atatgtataatacatatacat

SEQ ID NO: 167078 - DNA, 21 bp, Homo sapiens
taaagaaaagtttgtagaatg

SEQ ID NO: 167079 - DNA, 20 bp, Homo sapiens
aacctccaccttctggttca

SEQ ID NO: 167080 - DNA, 21 bp, Homo sapiens
acagcaagaggttagtggtag

SEQ ID NO: 167081 - DNA, 23 bp, Homo sapiens
tgagtttaagttcaggctctgtg

SEQ ID NO: 167082 - DNA, 23 bp, Homo sapiens
tgagagagagactctcgctctgt

SEQ ID NO: 167083 - DNA, 20 bp, Homo sapiens
tgtgtgccataaagatgaat

SEQ ID NO: 167084 - DNA, 23 bp, Homo sapiens
tttgttgtttttgcttaggattg

SEQ ID NO: 167085 - DNA, 22 bp, Homo sapiens
ttggtccaagatggacacttga

SEQ ID NO: 167086 - DNA, 22 bp, Homo sapiens
tgttgagtactatgctgattac

SEQ ID NO: 167087 - DNA, 20 bp, Homo sapiens
ttagtatggggaatgaattt

SEQ ID NO: 167088 - DNA, 23 bp, Homo sapiens
tttgtgtatatgtatatgtgtgt

SEQ ID NO: 167089 - DNA, 23 bp, Homo sapiens
ggacacagagaagaatctgagca

SEQ ID NO: 167090 - DNA, 23 bp, Homo sapiens
cattagatcataccttgttagtc

SEQ ID NO: 167091 - DNA, 19 bp, Homo sapiens
atcatggctcactgccgct

SEQ ID NO: 167092 - DNA, 23 bp, Homo sapiens
ttgagagtagagactgaggtttc

SEQ ID NO: 167093 - DNA, 23 bp, Homo sapiens
ttattcagctatacttttgatga

SEQ ID NO: 167094 - DNA, 22 bp, Homo sapiens
tagtcaggattatttttgtcct

SEQ ID NO: 167095 - DNA, 23 bp, Homo sapiens
gagtctcactctgtcaccctggc

SEQ ID NO: 167096 - DNA, 19 bp, Homo sapiens
tggtgtccttgtaagaaga

SEQ ID NO: 167097 - DNA, 22 bp, Homo sapiens
ttctgtgaagaaagccaatggt

SEQ ID NO: 167098 - DNA, 22 bp, Homo sapiens
tcatttatttgcaaaacaaggg

SEQ ID NO: 167099 - DNA, 20 bp, Homo sapiens
agatatcactattatacttg

SEQ ID NO: 167100 - DNA, 23 bp, Homo sapiens
gtatatgctaggtgtgtgtgtgt

SEQ ID NO: 167101 - DNA, 23 bp, Homo sapiens
tatatgttaggtgcatatatgta

SEQ ID NO: 167102 - DNA, 22 bp, Homo sapiens
aacccgtagatccgatcttgtg

SEQ ID NO: 167103 - DNA, 23 bp, Homo sapiens
tctgtgtcagtgtggtaatctga

SEQ ID NO: 167104 - DNA, 22 bp, Homo sapiens
tgaggtagtaggttgtatggtt

SEQ ID NO: 167105 - DNA, 23 bp, Homo sapiens
tcagtggatgagtagtggatgat

SEQ ID NO: 167106 - DNA, 23 bp, Homo sapiens
tccctgagaccctaacttgtgag

SEQ ID NO: 167107 - DNA, 22 bp, Homo sapiens
tgtgaggtaaaggtcaagttct

SEQ ID NO: 167108 - DNA, 23 bp, Homo sapiens
ttcccatttgttatgatgttggc

SEQ ID NO: 167109 - DNA, 18 bp, Homo sapiens
tatacatatgtatgtgta

SEQ ID NO: 167110 - DNA, 21 bp, Homo sapiens
atatacagtgtatatgtatat

SEQ ID NO: 167111 - DNA, 23 bp, Homo sapiens
catatatatactgtatatgtata

SEQ ID NO: 167112 - DNA, 23 bp, Homo sapiens
cggagtctcgctctgtctcccag

SEQ ID NO: 167113 - DNA, 23 bp, Homo sapiens
actttgggattgtagtctgagac

SEQ ID NO: 167114 - DNA, 23 bp, Homo sapiens
ggagtctcactctgtcacccagg

SEQ ID NO: 167115 - DNA, 21 bp, Homo sapiens
tgaggtaggaggatcacttga

SEQ ID NO: 167116 - DNA, 23 bp, Homo sapiens
gagtctcacactgtcacccaggc

SEQ ID NO: 167117 - DNA, 22 bp, Homo sapiens
ctgaggctgctttcatgagctg

SEQ ID NO: 167118 - DNA, 22 bp, Homo sapiens
agtcagtagagagtgagatcta

SEQ ID NO: 167119 - DNA, 23 bp, Homo sapiens
acatctgactgtatactgctagt

SEQ ID NO: 167120 - DNA, 22 bp, Homo sapiens
atacacacatatgtgtatgcat

SEQ ID NO: 167121 - DNA, 18 bp, Homo sapiens
tatgtatgtatatgtata

SEQ ID NO: 167122 - DNA, 23 bp, Homo sapiens
ttttgaggaagatatagctagga

SEQ ID NO: 167123 - DNA, 22 bp, Homo sapiens
agagacagaagagccaccgcag

SEQ ID NO: 167124 - DNA, 22 bp, Homo sapiens
tgtgtatatatgtatatgtgtg

SEQ ID NO: 167125 - DNA, 23 bp, Homo sapiens
tatatatacattgtatatgtgta

SEQ ID NO: 167126 - DNA, 19 bp, Homo sapiens
atatatgtattgtacctat

SEQ ID NO: 167127 - DNA, 23 bp, Homo sapiens
acggtgtctcgctctgtcgctca

SEQ ID NO: 167128 - DNA, 20 bp, Homo sapiens
taaggaatgaagggaagtgt

SEQ ID NO: 167129 - DNA, 21 bp, Homo sapiens
atcctgtcacctaaatgagtg

SEQ ID NO: 167130 - DNA, 19 bp, Homo sapiens
gtgtgtgtgtgtatatatg

SEQ ID NO: 167131 - DNA, 23 bp, Homo sapiens
tctcacgctctgtctctcttaat

SEQ ID NO: 167132 - DNA, 23 bp, Homo sapiens
tttgtgcatatatattgaatgtg

SEQ ID NO: 167133 - DNA, 23 bp, Homo sapiens
tctgccatctcttcacggacctg

SEQ ID NO: 167134 - DNA, 23 bp, Homo sapiens
tttgttagagatggtattagata

SEQ ID NO: 167135 - DNA, 23 bp, Homo sapiens
tgtctctctatatgtctatatgt

SEQ ID NO: 167136 - DNA, 22 bp, Homo sapiens
atatgtctatatatatatgtct

SEQ ID NO: 167137 - DNA, 22 bp, Homo sapiens
atatgtctatatatatatgtct

SEQ ID NO: 167138 - DNA, 22 bp, Homo sapiens
atatgtctatatatatatgtct

SEQ ID NO: 167139 - DNA, 22 bp, Homo sapiens
atatgtctatatatatatgtct

SEQ ID NO: 167140 - DNA, 22 bp, Homo sapiens
atatgtctatatatatatgtct

SEQ ID NO: 167141 - DNA, 22 bp, Homo sapiens
atatgtctatatatatatgtct

SEQ ID NO: 167142 - DNA, 23 bp, Homo sapiens
tggagtctcactctgtcacccag

SEQ ID NO: 167143 - DNA, 23 bp, Homo sapiens
tttgagacagagtctcgctctgt

SEQ ID NO: 167144 - DNA, 21 bp, Homo sapiens
tcttcatagagggcagtgttt

SEQ ID NO: 167145 - DNA, 23 bp, Homo sapiens
tattgttatgactggagtgagga

SEQ ID NO: 167146 - DNA, 21 bp, Homo sapiens
tgtatatatatatgtgtgtgt

SEQ ID NO: 167147 - DNA, 21 bp, Homo sapiens
aatggagttgtttgggtcaga

SEQ ID NO: 167148 - DNA, 23 bp, Homo sapiens
cactgtctcagtcacaattttgc

SEQ ID NO: 167149 - DNA, 22 bp, Homo sapiens
aggagagagacattcctgaaag

SEQ ID NO: 167150 - DNA, 23 bp, Homo sapiens
actattcaagcttcactcttcct

SEQ ID NO: 167151 - DNA, 23 bp, Homo sapiens
cggagtctcgctctgtctcccag

SEQ ID NO: 167152 - DNA, 23 bp, Homo sapiens
atatgtgtatatgtgtgtgtgag

SEQ ID NO: 167153 - DNA, 21 bp, Homo sapiens
atatgtaaatgtgtacacatg

SEQ ID NO: 167154 - DNA, 18 bp, Homo sapiens
ttactggatcatatggga

SEQ ID NO: 167155 - DNA, 18 bp, Homo sapiens
tacctagatatttttatc

SEQ ID NO: 167156 - DNA, 23 bp, Homo sapiens
tgagatggagtctcactctgtca

SEQ ID NO: 167157 - DNA, 23 bp, Homo sapiens
tgagttcattgtagattctggat

SEQ ID NO: 167158 - DNA, 23 bp, Homo sapiens
tgagttcattgtagattctggat

SEQ ID NO: 167159 - DNA, 23 bp, Homo sapiens
tatgtatatgtatatgtgtatat

SEQ ID NO: 167160 - DNA, 20 bp, Homo sapiens
atataggtgcatatatgtac

SEQ ID NO: 167161 - DNA, 22 bp, Homo sapiens
atatatgtacatatacatatgt

SEQ ID NO: 167162 - DNA, 23 bp, Homo sapiens
tgtgtctctgtgtttatatatac

SEQ ID NO: 167163 - DNA, 21 bp, Homo sapiens
atatatgtatatgtatacctg

SEQ ID NO: 167164 - DNA, 23 bp, Homo sapiens
ggcaagacttagtgctgtgttgg

SEQ ID NO: 167165 - DNA, 22 bp, Homo sapiens
ttcggtccctctctctgacaga

SEQ ID NO: 167166 - DNA, 18 bp, Homo sapiens
tgtctgtctattgtgagt

SEQ ID NO: 167167 - DNA, 21 bp, Homo sapiens
tactcacaatagacagacatg

SEQ ID NO: 167168 - DNA, 21 bp, Homo sapiens
tttctggttttacttaaaggt

SEQ ID NO: 167169 - DNA, 23 bp, Homo sapiens
tctgtgtatatatatttgtgtgt

SEQ ID NO: 167170 - DNA, 21 bp, Homo sapiens
tcactgccagtttgagttctg

SEQ ID NO: 167171 - DNA, 23 bp, Homo sapiens
tattagtgacatatacatgtgat

SEQ ID NO: 167172 - DNA, 23 bp, Homo sapiens
tctattagtgttactggaaggac

SEQ ID NO: 167173 - DNA, 18 bp, Homo sapiens
tgcaacttctgcctcctg

SEQ ID NO: 167174 - DNA, 23 bp, Homo sapiens
tacatgtatatgtatacgtatac

SEQ ID NO: 167175 - DNA, 22 bp, Homo sapiens
atacacacatatatatatgtgt

SEQ ID NO: 167176 - DNA, 23 bp, Homo sapiens
atacacacacatatatatatgtg

SEQ ID NO: 167177 - DNA, 23 bp, Homo sapiens
aatgtggaaactctctctctctc

SEQ ID NO: 167178 - DNA, 18 bp, Homo sapiens
aaaagattgtattgtctg

SEQ ID NO: 167179 - DNA, 23 bp, Homo sapiens
gagacagagtctcactctgtcgc

SEQ ID NO: 167180 - DNA, 22 bp, Homo sapiens
atgaactatatgtgcattttta

SEQ ID NO: 167181 - DNA, 18 bp, Homo sapiens
tgcatactatagatgcat

SEQ ID NO: 167182 - DNA, 23 bp, Homo sapiens
tgagatggactctcactctgtca

SEQ ID NO: 167183 - DNA, 23 bp, Homo sapiens
tttcacagtggtttggattttca

SEQ ID NO: 167184 - DNA, 20 bp, Homo sapiens
cactggctggacattctcgt

SEQ ID NO: 167185 - DNA, 19 bp, Homo sapiens
ttataggaagtatatatat

SEQ ID NO: 167186 - DNA, 23 bp, Homo sapiens
aagtctcactctgtcacccaggc

SEQ ID NO: 167187 - DNA, 21 bp, Homo sapiens
tacctcaaaatgtttgtgtgt

SEQ ID NO: 167188 - DNA, 23 bp, Homo sapiens
taatgtgtgtctgtatttggtgt

SEQ ID NO: 167189 - DNA, 22 bp, Homo sapiens
acatatgtgtattatttatgtg

SEQ ID NO: 167190 - DNA, 22 bp, Homo sapiens
tgtgtatatgtgtatatatgtg

SEQ ID NO: 167191 - DNA, 23 bp, Homo sapiens
tatatgtgtatatctttatgtgt

SEQ ID NO: 167192 - DNA, 23 bp, Homo sapiens
tgtattgatatatgtgtgtatag

SEQ ID NO: 167193 - DNA, 19 bp, Homo sapiens
atgtccttcttcacatggt

SEQ ID NO: 167194 - DNA, 22 bp, Homo sapiens
atgatagattatatatgtgcat

SEQ ID NO: 167195 - DNA, 23 bp, Homo sapiens
aatgcatgtatataattgcatat

SEQ ID NO: 167196 - DNA, 23 bp, Homo sapiens
gctttggtgattggagatagtga

SEQ ID NO: 167197 - DNA, 23 bp, Homo sapiens
aattttgtacttcagtttctctt

SEQ ID NO: 167198 - DNA, 20 bp, Homo sapiens
tatactaatagatctttggt

SEQ ID NO: 167199 - DNA, 23 bp, Homo sapiens
actttctctgtctggtttgcaac

SEQ ID NO: 167200 - DNA, 21 bp, Homo sapiens
aggtgtgctttattgttgatt

SEQ ID NO: 167201 - DNA, 22 bp, Homo sapiens
tgaatgtgctagtatgtatttt

SEQ ID NO: 167202 - DNA, 23 bp, Homo sapiens
ggatgagagttgagtgtctgcag

SEQ ID NO: 167203 - DNA, 23 bp, Homo sapiens
aagaaagagctcaggttttatga

SEQ ID NO: 167204 - DNA, 23 bp, Homo sapiens
tgagttcattgtagattctggat

SEQ ID NO: 167205 - DNA, 23 bp, Homo sapiens
tgagttcattgtagattctggat

SEQ ID NO: 167206 - DNA, 20 bp, Homo sapiens
tctcatggtttttcctctgt

SEQ ID NO: 167207 - DNA, 23 bp, Homo sapiens
tgtgtgtgtgtatatatatacgt

SEQ ID NO: 167208 - DNA, 21 bp, Homo sapiens
aagtcactctttcaaaataca

SEQ ID NO: 167209 - DNA, 23 bp, Homo sapiens
cagatgagtgagtgcattggatc

SEQ ID NO: 167210 - DNA, 23 bp, Homo sapiens
ttgtctgttggtctcatagccta

SEQ ID NO: 167211 - DNA, 23 bp, Homo sapiens
atcatgagctagatgttaggttg

SEQ ID NO: 167212 - DNA, 23 bp, Homo sapiens
tttcagtgggtcttcattttcta

SEQ ID NO: 167213 - DNA, 21 bp, Homo sapiens
tattttgttcatcatggagtt

SEQ ID NO: 167214 - DNA, 20 bp, Homo sapiens
agtctcgctctgtcgctcag

SEQ ID NO: 167215 - DNA, 23 bp, Homo sapiens
atgttagttgttttaggttcttt

SEQ ID NO: 167216 - DNA, 23 bp, Homo sapiens
ttttcacagtggctgaactaatt

SEQ ID NO: 167217 - DNA, 23 bp, Homo sapiens
atttggttgaagatgtttgtcat

SEQ ID NO: 167218 - DNA, 23 bp, Homo sapiens
gagacagagtcgcactctgtcac

SEQ ID NO: 167219 - DNA, 19 bp, Homo sapiens
tgaaatcttgcttctgtga

SEQ ID NO: 167220 - DNA, 22 bp, Homo sapiens
cattttatatatatgtgcaatg

SEQ ID NO: 167221 - DNA, 23 bp, Homo sapiens
aaagtggaagtgattgctttgag

SEQ ID NO: 167222 - DNA, 23 bp, Homo sapiens
acagagtctcgctctgtctccca

SEQ ID NO: 167223 - DNA, 23 bp, Homo sapiens
tggtgtctcactctgtcacccag

SEQ ID NO: 167224 - DNA, 18 bp, Homo sapiens
acagtggtgtgatctcag

SEQ ID NO: 167225 - DNA, 23 bp, Homo sapiens
gagtctcgctctgtcacccagac

SEQ ID NO: 167226 - DNA, 22 bp, Homo sapiens
tcctggaaaatctctggtgtag

SEQ ID NO: 167227 - DNA, 18 bp, Homo sapiens
ggaagcatccagctgtga

SEQ ID NO: 167228 - DNA, 23 bp, Homo sapiens
tgtgtatgtgtgtatatatatac

SEQ ID NO: 167229 - DNA, 23 bp, Homo sapiens
agagggagtctcactctgtcacc

SEQ ID NO: 167230 - DNA, 23 bp, Homo sapiens
taaagtttctgtacttaggtttg

SEQ ID NO: 167231 - DNA, 23 bp, Homo sapiens
gtgtgcctgtgtgtttctctcat

SEQ ID NO: 167232 - DNA, 20 bp, Homo sapiens
atgtgtgtatttgtgtataa

SEQ ID NO: 167233 - DNA, 23 bp, Homo sapiens
tcctcagtctctctgtctctcct

SEQ ID NO: 167234 - DNA, 22 bp, Homo sapiens
tagacagccttgagagcttaat

SEQ ID NO: 167235 - DNA, 23 bp, Homo sapiens
acagagtctcactctgtcgccca

SEQ ID NO: 167236 - DNA, 23 bp, Homo sapiens
tatacactaattgttagtgtgtg

SEQ ID NO: 167237 - DNA, 23 bp, Homo sapiens
atacactaattgttaatgtgtgt

SEQ ID NO: 167238 - DNA, 23 bp, Homo sapiens
atatctgtaaatctatatatatg

SEQ ID NO: 167239 - DNA, 19 bp, Homo sapiens
acactgatgagtcactgct

SEQ ID NO: 167240 - DNA, 21 bp, Homo sapiens
tgattcctgactctctgagtg

SEQ ID NO: 167241 - DNA, 23 bp, Homo sapiens
gcatctgcttttgataagtactt

SEQ ID NO: 167242 - DNA, 23 bp, Homo sapiens
cggagtctcactctgtcacccag

SEQ ID NO: 167243 - DNA, 23 bp, Homo sapiens
gagtctcactctgtcacccaggc

SEQ ID NO: 167244 - DNA, 22 bp, Homo sapiens
tattcttacagcataagatgcc

SEQ ID NO: 167245 - DNA, 23 bp, Homo sapiens
tgagggtgagtctgtctctctca

SEQ ID NO: 167246 - DNA, 23 bp, Homo sapiens
cagggtctcactctgtcacccag

SEQ ID NO: 167247 - DNA, 23 bp, Homo sapiens
tttgtagagacaaggtgtcactg

SEQ ID NO: 167248 - DNA, 22 bp, Homo sapiens
gggtctcactctgtcactcagg

SEQ ID NO: 167249 - DNA, 20 bp, Homo sapiens
gtacatatatatacacatac

SEQ ID NO: 167250 - DNA, 23 bp, Homo sapiens
tcaaatgctattctgatttttca

SEQ ID NO: 167251 - DNA, 19 bp, Homo sapiens
ctgactgtagatagatagc

SEQ ID NO: 167252 - DNA, 22 bp, Homo sapiens
gactgagtctcactctctcccc

SEQ ID NO: 167253 - DNA, 22 bp, Homo sapiens
tataagtggatatgatttcttt

SEQ ID NO: 167254 - DNA, 18 bp, Homo sapiens
agatactaattttaagtg

SEQ ID NO: 167255 - DNA, 23 bp, Homo sapiens
tttgttcttcttcttctagtggt

SEQ ID NO: 167256 - DNA, 23 bp, Homo sapiens
tccaaaagtgattttgatgtgca

SEQ ID NO: 167257 - DNA, 18 bp, Homo sapiens
tatatagtatgttgtaaa

SEQ ID NO: 167258 - DNA, 21 bp, Homo sapiens
taaggaattaaatactgtagt

SEQ ID NO: 167259 - DNA, 23 bp, Homo sapiens
aggctttgctcttccagagtttg

SEQ ID NO: 167260 - DNA, 22 bp, Homo sapiens
tcacacacaacacactcagtcc

SEQ ID NO: 167261 - DNA, 19 bp, Homo sapiens
accgtgacctccacctcct

SEQ ID NO: 167262 - DNA, 20 bp, Homo sapiens
tgtatctgcatgtgcatatg

SEQ ID NO: 167263 - DNA, 21 bp, Homo sapiens
tctcactcagtcactcaggct

SEQ ID NO: 167264 - DNA, 22 bp, Homo sapiens
aagcttcaacttgatgagctca

SEQ ID NO: 167265 - DNA, 23 bp, Homo sapiens
gcaaagcatttgtctctctctgt

SEQ ID NO: 167266 - DNA, 23 bp, Homo sapiens
tgactctcggtctcacatccagg

SEQ ID NO: 167267 - DNA, 23 bp, Homo sapiens
ctgttgatgccactgtgtggata

SEQ ID NO: 167268 - DNA, 22 bp, Homo sapiens
tatctggcaggttctgtcctct

SEQ ID NO: 167269 - DNA, 22 bp, Homo sapiens
catagctcttgagtcccaggga

SEQ ID NO: 167270 - DNA, 21 bp, Homo sapiens
caagagaaaataatttcatgt

SEQ ID NO: 167271 - DNA, 23 bp, Homo sapiens
atattttagcatatatagatgtg

SEQ ID NO: 167272 - DNA, 20 bp, Homo sapiens
agtctcgctctgtcgctcag

SEQ ID NO: 167273 - DNA, 23 bp, Homo sapiens
accatatcagagggaatgcagag

SEQ ID NO: 167274 - DNA, 23 bp, Homo sapiens
gaagagtaatgatgatgatgttg

SEQ ID NO: 167275 - DNA, 23 bp, Homo sapiens
attgtgcatatattatgcatgag

SEQ ID NO: 167276 - DNA, 23 bp, Homo sapiens
ttatatgtatatgcgtatgtgtg

SEQ ID NO: 167277 - DNA, 23 bp, Homo sapiens
agaggacaagttctggtgctctc

SEQ ID NO: 167278 - DNA, 23 bp, Homo sapiens
tgtgaccgtctctgtctcctaca

SEQ ID NO: 167279 - DNA, 22 bp, Homo sapiens
ctgagaactgagattttcttgt

SEQ ID NO: 167280 - DNA, 22 bp, Homo sapiens
ctctgtcactctctccctgtcc

SEQ ID NO: 167281 - DNA, 21 bp, Homo sapiens
tacacctggatctcaaagcat

SEQ ID NO: 167282 - DNA, 19 bp, Homo sapiens
actgcctctgtctcacaga

SEQ ID NO: 167283 - DNA, 20 bp, Homo sapiens
agagcctgtgaatgtgacct

SEQ ID NO: 167284 - DNA, 23 bp, Homo sapiens
tgagttcattgtagattctggat

SEQ ID NO: 167285 - DNA, 23 bp, Homo sapiens
tgagttcattgtagattctggat

SEQ ID NO: 167286 - DNA, 23 bp, Homo sapiens
agagtctcactctgtcacccagg

SEQ ID NO: 167287 - DNA, 23 bp, Homo sapiens
gagtctcactctgtcacccaggc

SEQ ID NO: 167288 - DNA, 23 bp, Homo sapiens
tttctgcatattttttcttgatt

SEQ ID NO: 167289 - DNA, 23 bp, Homo sapiens
actcagcccctttgtcactcaca

SEQ ID NO: 167290 - DNA, 22 bp, Homo sapiens
tgagcaaggagagagagactgt

SEQ ID NO: 167291 - DNA, 22 bp, Homo sapiens
ctgtctcagtcacaattttgca

SEQ ID NO: 167292 - DNA, 23 bp, Homo sapiens
gcacttgtactctgtcagtttct

SEQ ID NO: 167293 - DNA, 23 bp, Homo sapiens
tggagtctcactctgtcacccag

SEQ ID NO: 167294 - DNA, 23 bp, Homo sapiens
ccctctgtgggtctgtgtgtcca

SEQ ID NO: 167295 - DNA, 23 bp, Homo sapiens
tgcctttctgtgactctctcttt

SEQ ID NO: 167296 - DNA, 23 bp, Homo sapiens
aaataaaaacaggaggatgctgt

SEQ ID NO: 167297 - DNA, 23 bp, Homo sapiens
gggtctctctctgtcacccaggc

SEQ ID NO: 167298 - DNA, 23 bp, Homo sapiens
tcacacattgaaggttcataagt

SEQ ID NO: 167299 - DNA, 23 bp, Homo sapiens
gtgtgaacatctttgtcactcac

SEQ ID NO: 167300 - DNA, 23 bp, Homo sapiens
agacatgatcttaacaattcagt

SEQ ID NO: 167301 - DNA, 23 bp, Homo sapiens
cactcagtcagtctgtgctgttt

SEQ ID NO: 167302 - DNA, 18 bp, Homo sapiens
tctgctgattttagttct

SEQ ID NO: 167303 - DNA, 23 bp, Homo sapiens
tattgtctgatgtttgctccttc

SEQ ID NO: 167304 - DNA, 23 bp, Homo sapiens
tattttcttgtacagaagcagga

SEQ ID NO: 167305 - DNA, 22 bp, Homo sapiens
tctctatatatctatatatgta

SEQ ID NO: 167306 - DNA, 19 bp, Homo sapiens
tagagacactttcactttg

SEQ ID NO: 167307 - DNA, 23 bp, Homo sapiens
tgaggtcttgttttgttgtctag

SEQ ID NO: 167308 - DNA, 23 bp, Homo sapiens
acagttcagtctttgatgatgtg

SEQ ID NO: 167309 - DNA, 22 bp, Homo sapiens
gcaggtgcatagagtcttggct

SEQ ID NO: 167310 - DNA, 23 bp, Homo sapiens
ccgagtctctctgtgtctggcag

SEQ ID NO: 167311 - DNA, 23 bp, Homo sapiens
tccctgcctctctcccagcctct

SEQ ID NO: 167312 - DNA, 23 bp, Homo sapiens
tgagttcattgtagattctggat

SEQ ID NO: 167313 - DNA, 23 bp, Homo sapiens
tgagttcattgtagattctggat

SEQ ID NO: 167314 - DNA, 23 bp, Homo sapiens
gttcctcctcacactctcagtgc

SEQ ID NO: 167315 - DNA, 18 bp, Homo sapiens
agagcttttgaaaaggac

SEQ ID NO: 167316 - DNA, 23 bp, Homo sapiens
tcactgtctgtcacactacttcc

SEQ ID NO: 167317 - DNA, 22 bp, Homo sapiens
agacagtctgcctgtctgtagg

SEQ ID NO: 167318 - DNA, 21 bp, Homo sapiens
agtgtgctgacagtgtacaca

SEQ ID NO: 167319 - DNA, 23 bp, Homo sapiens
tgagttcattgtagattctggat

SEQ ID NO: 167320 - DNA, 23 bp, Homo sapiens
tgagttcattgtagattctggat

SEQ ID NO: 167321 - DNA, 21 bp, Homo sapiens
gtggtgtgagagcagagtccg

SEQ ID NO: 167322 - DNA, 23 bp, Homo sapiens
tattgtcttgttttgatggttgg

SEQ ID NO: 167323 - DNA, 21 bp, Homo sapiens
tgcaagttctgcctcctgggt

SEQ ID NO: 167324 - DNA, 23 bp, Homo sapiens
ttgagaccgagtctcactctgtc

SEQ ID NO: 167325 - DNA, 23 bp, Homo sapiens
gggtctcactctgtcacccaggc

SEQ ID NO: 167326 - DNA, 21 bp, Homo sapiens
ttgctgatggagtattctctt

SEQ ID NO: 167327 - DNA, 20 bp, Homo sapiens
tgtgagccactgtgcctggc

SEQ ID NO: 167328 - DNA, 23 bp, Homo sapiens
gtgagactctgtttctacaaagg

SEQ ID NO: 167329 - DNA, 23 bp, Homo sapiens
tgtgtgtgtgagtgcgtgtgtgt

SEQ ID NO: 167330 - DNA, 23 bp, Homo sapiens
tctgtgtgtgcctgtctgtgtcc

SEQ ID NO: 167331 - DNA, 22 bp, Homo sapiens
tgcatgtatatatatgctgtgt

SEQ ID NO: 167332 - DNA, 23 bp, Homo sapiens
tgtgtaaatttgcatgtgtgtgt

SEQ ID NO: 167333 - DNA, 18 bp, Homo sapiens
acagctttctcaaagtca

SEQ ID NO: 167334 - DNA, 23 bp, Homo sapiens
aaaagtctcaggttttctctttt

SEQ ID NO: 167335 - DNA, 22 bp, Homo sapiens
tggctggggttttccatggatt

SEQ ID NO: 167336 - DNA, 21 bp, Homo sapiens
tgccaggctgcctccatgcca

SEQ ID NO: 167337 - DNA, 23 bp, Homo sapiens
cgctgggtctgagtttctgctgt

SEQ ID NO: 167338 - DNA, 23 bp, Homo sapiens
gacagagtctcgctctgtcaccc

SEQ ID NO: 167339 - DNA, 18 bp, Homo sapiens
accattatatatatgtct

SEQ ID NO: 167340 - DNA, 23 bp, Homo sapiens
taaggatagtaatgtcagtgcgt

SEQ ID NO: 167341 - DNA, 23 bp, Homo sapiens
tgtgagtctgtgtgtgcctgtgt

SEQ ID NO: 167342 - DNA, 23 bp, Homo sapiens
atactggatgtgctggtgcctta

SEQ ID NO: 167343 - DNA, 21 bp, Homo sapiens
tgaggaagaaatttctattgt

SEQ ID NO: 167344 - DNA, 23 bp, Homo sapiens
tttactagtgaatttcttgaatt

SEQ ID NO: 167345 - DNA, 22 bp, Homo sapiens
aaaggcaggctttaatttcact

SEQ ID NO: 167346 - DNA, 23 bp, Homo sapiens
aggagagagagaaaggtctttga

SEQ ID NO: 167347 - DNA, 23 bp, Homo sapiens
tcaccctcactcggtccctcagt

SEQ ID NO: 167348 - DNA, 23 bp, Homo sapiens
gacactcactgcctgtgtctgct

SEQ ID NO: 167349 - DNA, 23 bp, Homo sapiens
accttaagtgagtcatctgatct

SEQ ID NO: 167350 - DNA, 23 bp, Homo sapiens
aatgtgtgtgccatatgtgtggc

SEQ ID NO: 167351 - DNA, 18 bp, Homo sapiens
gtcctgtgtgctgtttgc

SEQ ID NO: 167352 - DNA, 22 bp, Homo sapiens
tcacaaggtgctcagtgggaga

SEQ ID NO: 167353 - DNA, 23 bp, Homo sapiens
ctgtggccctggttctgttccca

SEQ ID NO: 167354 - DNA, 23 bp, Homo sapiens
acttcttctctctgtttctccac

SEQ ID NO: 167355 - DNA, 23 bp, Homo sapiens
acacagtgagaagacagtgatca

SEQ ID NO: 167356 - DNA, 20 bp, Homo sapiens
ctgtgactgtgacagctggc

SEQ ID NO: 167357 - DNA, 19 bp, Homo sapiens
tcacagctattttgagggt

SEQ ID NO: 167358 - DNA, 23 bp, Homo sapiens
ataaagagtgctgaggctgggta

SEQ ID NO: 167359 - DNA, 23 bp, Homo sapiens
tatgtgtatgtatacatgtatag

SEQ ID NO: 167360 - DNA, 23 bp, Homo sapiens
ccccgcactgtgtctctgtccct

SEQ ID NO: 167361 - DNA, 23 bp, Homo sapiens
accactgacagcacagtgtgtgt

SEQ ID NO: 167362 - DNA, 21 bp, Homo sapiens
tcacactcagacactggctca

SEQ ID NO: 167363 - DNA, 23 bp, Homo sapiens
tatcacatgcaggtttgttatgt

SEQ ID NO: 167364 - DNA, 18 bp, Homo sapiens
tatcacagtgggtgtaca

SEQ ID NO: 167365 - DNA, 23 bp, Homo sapiens
tgccactgaccccctctctgtgt

SEQ ID NO: 167366 - DNA, 23 bp, Homo sapiens
tcgctgtctcagacagagcctca

SEQ ID NO: 167367 - DNA, 22 bp, Homo sapiens
tcggtgttctggtatggtcttc

SEQ ID NO: 167368 - DNA, 18 bp, Homo sapiens
cagtcttcagcctggctc

SEQ ID NO: 167369 - DNA, 22 bp, Homo sapiens
cggtctctctctgggtggctgt

SEQ ID NO: 167370 - DNA, 19 bp, Homo sapiens
gtctcgctctgtcacccag

SEQ ID NO: 167371 - DNA, 23 bp, Homo sapiens
aggtggttctgggttttctctgt

SEQ ID NO: 167372 - DNA, 19 bp, Homo sapiens
tgcctaggtgatgggatgg

SEQ ID NO: 167373 - DNA, 23 bp, Homo sapiens
tgagccatgatcataccattgca

SEQ ID NO: 167374 - DNA, 23 bp, Homo sapiens
tgagatggagtctccctctctca

SEQ ID NO: 167375 - DNA, 19 bp, Homo sapiens
cactgtctctgagtggctg

SEQ ID NO: 167376 - DNA, 23 bp, Homo sapiens
gacacagtcttctccctgtgtcc

SEQ ID NO: 167377 - DNA, 23 bp, Homo sapiens
ctcactctcagggcctgagtagc

SEQ ID NO: 167378 - DNA, 23 bp, Homo sapiens
actctgtctgcatgtctcttcct

SEQ ID NO: 167379 - DNA, 23 bp, Homo sapiens
ttctgagtgcaattcatgaactg

SEQ ID NO: 167380 - DNA, 23 bp, Homo sapiens
tgtctgtgcatccgtgtgtctgt

SEQ ID NO: 167381 - DNA, 21 bp, Homo sapiens
tgattgtgtatgcatgtgagc

SEQ ID NO: 167382 - DNA, 21 bp, Homo sapiens
atgtgacacatgtaagcatgt

SEQ ID NO: 167383 - DNA, 23 bp, Homo sapiens
taaagttagaagaaaggctgctg

SEQ ID NO: 167384 - DNA, 23 bp, Homo sapiens
cacagggtcagtgtctgagtgtg

SEQ ID NO: 167385 - DNA, 23 bp, Homo sapiens
tccctgtgagtgtgtgtgtgtcc

SEQ ID NO: 167386 - DNA, 23 bp, Homo sapiens
gtgtgtgcatgtgtatgtgctgt

SEQ ID NO: 167387 - DNA, 23 bp, Homo sapiens
ctgtttggaaatgaagctgtaca

SEQ ID NO: 167388 - DNA, 18 bp, Homo sapiens
tgtggatttatctatttg

SEQ ID NO: 167389 - DNA, 23 bp, Homo sapiens
taagctctttattaggtgtgtga

SEQ ID NO: 167390 - DNA, 23 bp, Homo sapiens
tggacagaggcactgattgttct

SEQ ID NO: 167391 - DNA, 23 bp, Homo sapiens
cactgggcccactctgtgtcact

SEQ ID NO: 167392 - DNA, 20 bp, Homo sapiens
tgtcacacacactgtcagcc

SEQ ID NO: 167393 - DNA, 22 bp, Homo sapiens
cccgtccctcagtgtctctgtg

SEQ ID NO: 167394 - DNA, 19 bp, Homo sapiens
ttctggacgtggatgttcc

SEQ ID NO: 167395 - DNA, 23 bp, Homo sapiens
tccctcagtgtctgtgtggacag

SEQ ID NO: 167396 - DNA, 23 bp, Homo sapiens
agtccgtccctcagtcactctgt

SEQ ID NO: 167397 - DNA, 23 bp, Homo sapiens
gcctgagtccgtccctcagtgtc

SEQ ID NO: 167398 - DNA, 23 bp, Homo sapiens
cccgtccctcagtgtctgtgtgg

SEQ ID NO: 167399 - DNA, 23 bp, Homo sapiens
tggctccctctgtgcctgtgtgt

SEQ ID NO: 167400 - DNA, 23 bp, Homo sapiens
attggcacagccacttttgtttg

SEQ ID NO: 167401 - DNA, 23 bp, Homo sapiens
acaacattcaacagactgagtgc

SEQ ID NO: 167402 - DNA, 23 bp, Homo sapiens
taatggtagtgttgtgtatatga

SEQ ID NO: 167403 - DNA, 23 bp, Homo sapiens
atatttgtccaaatgcattcatt

SEQ ID NO: 167404 - DNA, 23 bp, Homo sapiens
cggagtctcactctgtcacccag

SEQ ID NO: 167405 - DNA, 18 bp, Homo sapiens
acaagactctgactcaag

SEQ ID NO: 167406 - DNA, 23 bp, Homo sapiens
tctgtgtcaccctctctgccagg

SEQ ID NO: 167407 - DNA, 23 bp, Homo sapiens
acagcacagggcgtgcagactgc

SEQ ID NO: 167408 - DNA, 23 bp, Homo sapiens
tcggtgggtctctccctgtgtgc

SEQ ID NO: 167409 - DNA, 23 bp, Homo sapiens
tatctgtcaggtacatttgatcc

SEQ ID NO: 167410 - DNA, 23 bp, Homo sapiens
agggaagattagttggttccttt

SEQ ID NO: 167411 - DNA, 22 bp, Homo sapiens
tgtgtgggtgtgtatgtgcatg

SEQ ID NO: 167412 - DNA, 21 bp, Homo sapiens
tctcacccactcactgggcgt

SEQ ID NO: 167413 - DNA, 23 bp, Homo sapiens
cacactccctgtctctccctcaa

SEQ ID NO: 167414 - DNA, 21 bp, Homo sapiens
agcctgtgcctctcttcattg

SEQ ID NO: 167415 - DNA, 20 bp, Homo sapiens
agtctctgcttccccactgg

SEQ ID NO: 167416 - DNA, 23 bp, Homo sapiens
tttgagacggagtctcactcagt

SEQ ID NO: 167417 - DNA, 23 bp, Homo sapiens
tgtgtgtgtgtccatatggagtg

SEQ ID NO: 167418 - DNA, 19 bp, Homo sapiens
aagagctaaaataaaaaaa

SEQ ID NO: 167419 - DNA, 20 bp, Homo sapiens
tcatttttaaaatctctctc

SEQ ID NO: 167420 - DNA, 21 bp, Homo sapiens
atgagaagagagagaggtcag

SEQ ID NO: 167421 - DNA, 20 bp, Homo sapiens
ctgagtccttgtggagctcg

SEQ ID NO: 167422 - DNA, 23 bp, Homo sapiens
tgtcacgctcagtgcctggctca

SEQ ID NO: 167423 - DNA, 23 bp, Homo sapiens
acagagtctcactctgtcgccca

SEQ ID NO: 167424 - DNA, 23 bp, Homo sapiens
agatagagtctggctctgttgcc

SEQ ID NO: 167425 - DNA, 19 bp, Homo sapiens
aaggtgctttcactggggg

SEQ ID NO: 167426 - DNA, 23 bp, Homo sapiens
tctctgtgtgtctgtctgcgagt

SEQ ID NO: 167427 - DNA, 23 bp, Homo sapiens
tgactgagtctcgctctgtcacc

SEQ ID NO: 167428 - DNA, 21 bp, Homo sapiens
gactctcactcagtcggtgtg

SEQ ID NO: 167429 - DNA, 23 bp, Homo sapiens
gttgaagtggccctgctgcttga

SEQ ID NO: 167430 - DNA, 22 bp, Homo sapiens
tctgtctcccagactagagtgc

SEQ ID NO: 167431 - DNA, 23 bp, Homo sapiens
tgagatggagtctcactctgtcg

SEQ ID NO: 167432 - DNA, 22 bp, Homo sapiens
ggctgtccctctgtgtgtgtgt

SEQ ID NO: 167433 - DNA, 23 bp, Homo sapiens
gagtgtgtgtgcctgtgcatccg

SEQ ID NO: 167434 - DNA, 23 bp, Homo sapiens
gcatccctgtgtgcgtgtgtgtg

SEQ ID NO: 167435 - DNA, 23 bp, Homo sapiens
tgtctgactcactggctgaggtg

SEQ ID NO: 167436 - DNA, 21 bp, Homo sapiens
gctgtccctctgtgtgtgtct

SEQ ID NO: 167437 - DNA, 23 bp, Homo sapiens
gtgagtcagtgtgtgggtgcgtc

SEQ ID NO: 167438 - DNA, 23 bp, Homo sapiens
ctactaaaatctgtatttgtttt

SEQ ID NO: 167439 - DNA, 23 bp, Homo sapiens
actccagcctgtctgtctctctc

SEQ ID NO: 167440 - DNA, 21 bp, Homo sapiens
atacgttaagttcctcttaac

SEQ ID NO: 167441 - DNA, 20 bp, Homo sapiens
tgaaatgtagtgtggatgga

SEQ ID NO: 167442 - DNA, 20 bp, Homo sapiens
ttaagagcatcttctgaaga

SEQ ID NO: 167443 - DNA, 23 bp, Homo sapiens
ttcgaagaagcatgcttttgttg

SEQ ID NO: 167444 - DNA, 23 bp, Homo sapiens
cagatgtgtgtcagtcatggtgc

SEQ ID NO: 167445 - DNA, 19 bp, Homo sapiens
tcagagagactagatggca

SEQ ID NO: 167446 - DNA, 23 bp, Homo sapiens
tgtcagactctctgtaaaagacc

SEQ ID NO: 167447 - DNA, 23 bp, Homo sapiens
gcgggtctctgtgtgactgtgtc

SEQ ID NO: 167448 - DNA, 23 bp, Homo sapiens
gtgtgagagtgtgcatgtgcatg

SEQ ID NO: 167449 - DNA, 19 bp, Homo sapiens
tagtcctagcactttggga

SEQ ID NO: 167450 - DNA, 23 bp, Homo sapiens
gactgcctgagttcagttccaga

SEQ ID NO: 167451 - DNA, 20 bp, Homo sapiens
tgtgcctgtgtgtgccgtgt

SEQ ID NO: 167452 - DNA, 22 bp, Homo sapiens
tgtgtgcgtgtgtgtatatgtg

SEQ ID NO: 167453 - DNA, 19 bp, Homo sapiens
tttgttttagttttgagat

SEQ ID NO: 167454 - DNA, 23 bp, Homo sapiens
ctgtgtgtgtctgtgtcctcatt

SEQ ID NO: 167455 - DNA, 23 bp, Homo sapiens
taaggacagcaagtcgttggatt

SEQ ID NO: 167456 - DNA, 22 bp, Homo sapiens
tgcacacaccatgtgcacacag

SEQ ID NO: 167457 - DNA, 18 bp, Homo sapiens
tgtggctgtgtgtgtctc

SEQ ID NO: 167458 - DNA, 23 bp, Homo sapiens
agagtctcactctgtcacccagg

SEQ ID NO: 167459 - DNA, 22 bp, Homo sapiens
tgaaaacttccgacactctctc

SEQ ID NO: 167460 - DNA, 20 bp, Homo sapiens
gaggggctgtgtgtccctgt

SEQ ID NO: 167461 - DNA, 18 bp, Homo sapiens
gtgtccctgtgagggggg

SEQ ID NO: 167462 - DNA, 23 bp, Homo sapiens
actctgtatctcactctctgtgc

SEQ ID NO: 167463 - DNA, 23 bp, Homo sapiens
tctctcccaggctccctgtgtga

SEQ ID NO: 167464 - DNA, 23 bp, Homo sapiens
ggctgtctgtctcgctgtgtcct

SEQ ID NO: 167465 - DNA, 21 bp, Homo sapiens
gatctagtttgctgatatttt

SEQ ID NO: 167466 - DNA, 23 bp, Homo sapiens
acatggctgtgtttttatgtatt

SEQ ID NO: 167467 - DNA, 20 bp, Homo sapiens
cagaccatctcacagcgggt

SEQ ID NO: 167468 - DNA, 21 bp, Homo sapiens
tgtatgtatgtatgtatgtac

SEQ ID NO: 167469 - DNA, 23 bp, Homo sapiens
tgtatgtatgtatgtatgtactt

SEQ ID NO: 167470 - DNA, 23 bp, Homo sapiens
gagtggctcagtcactggaaggt

SEQ ID NO: 167471 - DNA, 22 bp, Homo sapiens
aggaaaaaaatgatgtcttcac

SEQ ID NO: 167472 - DNA, 23 bp, Homo sapiens
acagtgacagcagacactgaaca

SEQ ID NO: 167473 - DNA, 21 bp, Homo sapiens
cagggtcactctcactctctg

SEQ ID NO: 167474 - DNA, 20 bp, Homo sapiens
tgtgtatatatgtatatatg

SEQ ID NO: 167475 - DNA, 23 bp, Homo sapiens
tgtgtatatatatatatgtgaag

SEQ ID NO: 167476 - DNA, 22 bp, Homo sapiens
aatgagcaaaattattttgtaa

SEQ ID NO: 167477 - DNA, 23 bp, Homo sapiens
attttgctcattttcattcctta

SEQ ID NO: 167478 - DNA, 23 bp, Homo sapiens
gtgtgtgtgtggagtgtgtgctg

SEQ ID NO: 167479 - DNA, 23 bp, Homo sapiens
gatttacttcaaaacaatccatt

SEQ ID NO: 167480 - DNA, 23 bp, Homo sapiens
tgagtgactcaagaggctgaggt

SEQ ID NO: 167481 - DNA, 18 bp, Homo sapiens
tgtgtgaggctatgaaca

SEQ ID NO: 167482 - DNA, 23 bp, Homo sapiens
tgagggctcactctgtgactctg

SEQ ID NO: 167483 - DNA, 23 bp, Homo sapiens
ctctttctctctgtgtgcatgtg

SEQ ID NO: 167484 - DNA, 22 bp, Homo sapiens
atgtgtatatatatgtgtgtgt

SEQ ID NO: 167485 - DNA, 21 bp, Homo sapiens
ggtgtgagtctgtccctctca

SEQ ID NO: 167486 - DNA, 21 bp, Homo sapiens
tgaggtagaaggatcacttga

SEQ ID NO: 167487 - DNA, 19 bp, Homo sapiens
gtgagagaacagagtgggc

SEQ ID NO: 167488 - DNA, 23 bp, Homo sapiens
ctagtcttgtgtatttcttcata

SEQ ID NO: 167489 - DNA, 22 bp, Homo sapiens
ttcattctttttcatatggcta

SEQ ID NO: 167490 - DNA, 23 bp, Homo sapiens
tccgctcactgcaagctctgtct

SEQ ID NO: 167491 - DNA, 18 bp, Homo sapiens
ttcaatgagttttgggaa

SEQ ID NO: 167492 - DNA, 21 bp, Homo sapiens
aaatacacactggaaaatttc

SEQ ID NO: 167493 - DNA, 23 bp, Homo sapiens
cagtgtgtctgactctctccttt

SEQ ID NO: 167494 - DNA, 22 bp, Homo sapiens
tgacatgattgtgtgtatgtaa

SEQ ID NO: 167495 - DNA, 23 bp, Homo sapiens
tgtagatatgtatatatgtgtga

SEQ ID NO: 167496 - DNA, 23 bp, Homo sapiens
cagagtctcactctgtcgcccag

SEQ ID NO: 167497 - DNA, 22 bp, Homo sapiens
atgtgctgccagtgctggaagt

SEQ ID NO: 167498 - DNA, 21 bp, Homo sapiens
aaggttctaggtcttatattt

SEQ ID NO: 167499 - DNA, 23 bp, Homo sapiens
cctctgtggctctgcctctgttt

SEQ ID NO: 167500 - DNA, 23 bp, Homo sapiens
agtgaatcagcaagagcatgtcc

SEQ ID NO: 167501 - DNA, 22 bp, Homo sapiens
atgtatatatgtacatgtgcat

SEQ ID NO: 167502 - DNA, 23 bp, Homo sapiens
acatatgtgtatatgtacatgtg

SEQ ID NO: 167503 - DNA, 18 bp, Homo sapiens
gggcctgtctgtgcctct

SEQ ID NO: 167504 - DNA, 22 bp, Homo sapiens
aaacccactgcaattcctctga

SEQ ID NO: 167505 - DNA, 23 bp, Homo sapiens
tataaggatgtattgaaaacaag

SEQ ID NO: 167506 - DNA, 23 bp, Homo sapiens
tttctagtggttttcttatggtt

SEQ ID NO: 167507 - DNA, 21 bp, Homo sapiens
aagaactccagtttgctgtaa

SEQ ID NO: 167508 - DNA, 23 bp, Homo sapiens
tgttcattgctatggaaaagtct

SEQ ID NO: 167509 - DNA, 23 bp, Homo sapiens
tgcctgggtgtgtgtgtccgtgt

SEQ ID NO: 167510 - DNA, 21 bp, Homo sapiens
tgtgtccctgcctgcctccca

SEQ ID NO: 167511 - DNA, 23 bp, Homo sapiens
gagttgacagtctagggtaggga

SEQ ID NO: 167512 - DNA, 19 bp, Homo sapiens
tgcctgtcagccttctaag

SEQ ID NO: 167513 - DNA, 19 bp, Homo sapiens
agggagccttagaggcttg

SEQ ID NO: 167514 - DNA, 20 bp, Homo sapiens
tgagatggagtctcgctctt

SEQ ID NO: 167515 - DNA, 23 bp, Homo sapiens
tccctgtcactctcactggggct

SEQ ID NO: 167516 - DNA, 23 bp, Homo sapiens
ctcagaacagtcacggatcacag

SEQ ID NO: 167517 - DNA, 23 bp, Homo sapiens
tgacttctgacacattctgccag

SEQ ID NO: 167518 - DNA, 23 bp, Homo sapiens
tgtcagttctgtgtctgtgacgg

SEQ ID NO: 167519 - DNA, 23 bp, Homo sapiens
tgtttctcactgtctttgttgtc

SEQ ID NO: 167520 - DNA, 23 bp, Homo sapiens
tgtagttggagacagaacttgaa

SEQ ID NO: 167521 - DNA, 23 bp, Homo sapiens
tctctctgtctctatctctcaat

SEQ ID NO: 167522 - DNA, 23 bp, Homo sapiens
aatgtccttgatgtgcttctaaa

SEQ ID NO: 167523 - DNA, 23 bp, Homo sapiens
agagtctcactatgtcactcagg

SEQ ID NO: 167524 - DNA, 23 bp, Homo sapiens
acagagtgagaccctgtcttttt

SEQ ID NO: 167525 - DNA, 22 bp, Homo sapiens
tgagacagagtctcactctgtc

SEQ ID NO: 167526 - DNA, 23 bp, Homo sapiens
tgaatccatgcttctctgtgagg

SEQ ID NO: 167527 - DNA, 23 bp, Homo sapiens
tccattgctcaggctggatggag

SEQ ID NO: 167528 - DNA, 22 bp, Homo sapiens
ttgatatcttttgaagcacaag

SEQ ID NO: 167529 - DNA, 23 bp, Homo sapiens
tgagacagaatctcactctgtgg

SEQ ID NO: 167530 - DNA, 23 bp, Homo sapiens
cggagtctcgctctgtcgctcag

SEQ ID NO: 167531 - DNA, 23 bp, Homo sapiens
tgagttcattgtagattctggat

SEQ ID NO: 167532 - DNA, 23 bp, Homo sapiens
tgagttcattgtagattctggat

SEQ ID NO: 167533 - DNA, 23 bp, Homo sapiens
agagacagagcatttgttcacag

SEQ ID NO: 167534 - DNA, 23 bp, Homo sapiens
gtgtgtgtgtatatatatatgta

SEQ ID NO: 167535 - DNA, 23 bp, Homo sapiens
gtgcttttcaaactttttgtttt

SEQ ID NO: 167536 - DNA, 23 bp, Homo sapiens
agactctcactcactctgttgcc

SEQ ID NO: 167537 - DNA, 21 bp, Homo sapiens
atatatacacacacacacata

SEQ ID NO: 167538 - DNA, 23 bp, Homo sapiens
tctcactcactcagtgctcaatg

SEQ ID NO: 167539 - DNA, 23 bp, Homo sapiens
tgagatggaagtctcgctctgtg

SEQ ID NO: 167540 - DNA, 22 bp, Homo sapiens
tcacatcctcactcagtcagtc

SEQ ID NO: 167541 - DNA, 23 bp, Homo sapiens
tttttgagacggagtcttgctct

SEQ ID NO: 167542 - DNA, 20 bp, Homo sapiens
tttgaggcagagtctcgctc

SEQ ID NO: 167543 - DNA, 23 bp, Homo sapiens
ctgagcatctgtgtatgtcttct

SEQ ID NO: 167544 - DNA, 23 bp, Homo sapiens
tagtttccttttggtacagtttg

SEQ ID NO: 167545 - DNA, 22 bp, Homo sapiens
gagagtcccagaagctgtcttt

SEQ ID NO: 167546 - DNA, 19 bp, Homo sapiens
aaagcacgtgtggggctct

SEQ ID NO: 167547 - DNA, 20 bp, Homo sapiens
atggaaccattggaaaggat

SEQ ID NO: 167548 - DNA, 23 bp, Homo sapiens
tctctctgtggctgtgtctcaag

SEQ ID NO: 167549 - DNA, 23 bp, Homo sapiens
tattgtgttgctgtctgtctcat

SEQ ID NO: 167550 - DNA, 21 bp, Homo sapiens
tatgtacatatatatagtata

SEQ ID NO: 167551 - DNA, 23 bp, Homo sapiens
agttttctgtagagacagggtcc

SEQ ID NO: 167552 - DNA, 22 bp, Homo sapiens
tggaggcagaggttgctgtgag

SEQ ID NO: 167553 - DNA, 19 bp, Homo sapiens
ttcatcttcatcatgttca

SEQ ID NO: 167554 - DNA, 23 bp, Homo sapiens
tttagatggtgtcttgctctgtc

SEQ ID NO: 167555 - DNA, 20 bp, Homo sapiens
ggaatcctggaggtcaggta

SEQ ID NO: 167556 - DNA, 23 bp, Homo sapiens
atgtgcacaacgtgcaggtttgt

SEQ ID NO: 167557 - DNA, 18 bp, Homo sapiens
taaaaatatgctatgtgt

SEQ ID NO: 167558 - DNA, 23 bp, Homo sapiens
aacccactcactggctgtgtgac

SEQ ID NO: 167559 - DNA, 23 bp, Homo sapiens
agagtctcactctgtcacccagg

SEQ ID NO: 167560 - DNA, 23 bp, Homo sapiens
aggtgtgaatatgtacatatgtg

SEQ ID NO: 167561 - DNA, 23 bp, Homo sapiens
tgtgtgtgtctgtatcctaatct

SEQ ID NO: 167562 - DNA, 23 bp, Homo sapiens
ctgagaaacagattggtgtgcag

SEQ ID NO: 167563 - DNA, 23 bp, Homo sapiens
tgactcagactgactcagacttt

SEQ ID NO: 167564 - DNA, 18 bp, Homo sapiens
agtcaccctcactgtcac

SEQ ID NO: 167565 - DNA, 23 bp, Homo sapiens
agagaatgtatatgtatatatgt

SEQ ID NO: 167566 - DNA, 23 bp, Homo sapiens
acacacagcatcatcacttgggt

SEQ ID NO: 167567 - DNA, 22 bp, Homo sapiens
agtctcaccctgtcacccaggc

SEQ ID NO: 167568 - DNA, 21 bp, Homo sapiens
tcacactctccctgtgtccta

SEQ ID NO: 167569 - DNA, 23 bp, Homo sapiens
tgtgtgtgtcactgtgtgcctgt

SEQ ID NO: 167570 - DNA, 22 bp, Homo sapiens
aacaaggtgctgttctgctggc

SEQ ID NO: 167571 - DNA, 23 bp, Homo sapiens
gcctcactgtgtccctctgatgg

SEQ ID NO: 167572 - DNA, 19 bp, Homo sapiens
tttgtagagttgggggtct

SEQ ID NO: 167573 - DNA, 23 bp, Homo sapiens
acagacagatctgaatagcatcc

SEQ ID NO: 167574 - DNA, 23 bp, Homo sapiens
tgtctccctgtctctgtgggagg

SEQ ID NO: 167575 - DNA, 23 bp, Homo sapiens
gggtctcactctgtcacccaggc

SEQ ID NO: 167576 - DNA, 19 bp, Homo sapiens
tggcagggtgtgttggttc

SEQ ID NO: 167577 - DNA, 21 bp, Homo sapiens
tgaggtaggaggatcacttga

SEQ ID NO: 167578 - DNA, 23 bp, Homo sapiens
cggagtctcgctctgtctcccag

SEQ ID NO: 167579 - DNA, 22 bp, Homo sapiens
gcagtgagccatgatcgtgcca

SEQ ID NO: 167580 - DNA, 23 bp, Homo sapiens
gagagagagagaggccctgagac

SEQ ID NO: 167581 - DNA, 23 bp, Homo sapiens
gggagggtctgtctgcctctcag

SEQ ID NO: 167582 - DNA, 23 bp, Homo sapiens
cttctcactttgagaaaaccctc

SEQ ID NO: 167583 - DNA, 23 bp, Homo sapiens
tcagagagagagagaattggctt

SEQ ID NO: 167584 - DNA, 23 bp, Homo sapiens
gagtctgtgtctgtgtctcatct

SEQ ID NO: 167585 - DNA, 23 bp, Homo sapiens
gcttgtgtctgtgtctgtgggag

SEQ ID NO: 167586 - DNA, 23 bp, Homo sapiens
atctgacaggagacagagctcag

SEQ ID NO: 167587 - DNA, 23 bp, Homo sapiens
aatttcgtgtgagattatcctgt

SEQ ID NO: 167588 - DNA, 23 bp, Homo sapiens
ggctttgggagtgtttctataga

SEQ ID NO: 167589 - DNA, 23 bp, Homo sapiens
ttcaatgttacaaaaggatgact

SEQ ID NO: 167590 - DNA, 21 bp, Homo sapiens
tctcactctgtcacccaggct

SEQ ID NO: 167591 - DNA, 23 bp, Homo sapiens
tgagttcattgtagattctggat

SEQ ID NO: 167592 - DNA, 23 bp, Homo sapiens
tgagttcattgtagattctggat

SEQ ID NO: 167593 - DNA, 23 bp, Homo sapiens
taagaaaggtaacgcaaagttga

SEQ ID NO: 167594 - DNA, 23 bp, Homo sapiens
tacactctggctgtgtctggccc

SEQ ID NO: 167595 - DNA, 23 bp, Homo sapiens
gggatgctaaactaacagctttg

SEQ ID NO: 167596 - DNA, 23 bp, Homo sapiens
cacagaactgagtgagcatggaa

SEQ ID NO: 167597 - DNA, 23 bp, Homo sapiens
acaggaggtatatagatcaaggt

SEQ ID NO: 167598 - DNA, 23 bp, Homo sapiens
cactccctctgcctctcactcta

SEQ ID NO: 167599 - DNA, 23 bp, Homo sapiens
tgagatgtgtctcactctgtcgc

SEQ ID NO: 167600 - DNA, 23 bp, Homo sapiens
acgctcaacatcctcctgtgagt

SEQ ID NO: 167601 - DNA, 23 bp, Homo sapiens
gagggagactctcactaagtatt

SEQ ID NO: 167602 - DNA, 22 bp, Homo sapiens
tttgagacggagtctcgctctg

SEQ ID NO: 167603 - DNA, 20 bp, Homo sapiens
cctgtaatcacagcactttg

SEQ ID NO: 167604 - DNA, 21 bp, Homo sapiens
tgaggtaggaggatcacttga

SEQ ID NO: 167605 - DNA, 23 bp, Homo sapiens
ttgtgagtgcttgttgtgtgtct

SEQ ID NO: 167606 - DNA, 23 bp, Homo sapiens
aatcaggttctctgtttcttccc

SEQ ID NO: 167607 - DNA, 23 bp, Homo sapiens
tgaggtaggtggatcacttgagg

SEQ ID NO: 167608 - DNA, 23 bp, Homo sapiens
atatgaatatatatatgtgtgaa

SEQ ID NO: 167609 - DNA, 22 bp, Homo sapiens
tatgcacttgtacaccagttga

SEQ ID NO: 167610 - DNA, 23 bp, Homo sapiens
cactgtctgggtgtttagcttgt

SEQ ID NO: 167611 - DNA, 23 bp, Homo sapiens
ttatgtgtggtacttttatggtt

SEQ ID NO: 167612 - DNA, 23 bp, Homo sapiens
actggtcccatgtgtcgctctga

SEQ ID NO: 167613 - DNA, 23 bp, Homo sapiens
tggagtctcactctgtcacccag

SEQ ID NO: 167614 - DNA, 23 bp, Homo sapiens
tatatgtgtgtgtatgtatatat

SEQ ID NO: 167615 - DNA, 19 bp, Homo sapiens
tgactttttttttctttcc

SEQ ID NO: 167616 - DNA, 22 bp, Homo sapiens
tgaaggaagtagaagtgatttc

SEQ ID NO: 167617 - DNA, 23 bp, Homo sapiens
tgtatatatggatatgtatgtgt

SEQ ID NO: 167618 - DNA, 23 bp, Homo sapiens
aaagggtctgtgtgtgttaatga

SEQ ID NO: 167619 - DNA, 20 bp, Homo sapiens
tatatgttcgtatatattcg

SEQ ID NO: 167620 - DNA, 23 bp, Homo sapiens
aatgtgtctttatttgctgtgtg

SEQ ID NO: 167621 - DNA, 22 bp, Homo sapiens
agtgtcgagacagtggacacac

SEQ ID NO: 167622 - DNA, 19 bp, Homo sapiens
gaatgaattgaagtttaga

SEQ ID NO: 167623 - DNA, 23 bp, Homo sapiens
tcacttcatttcgttcccgttgt

SEQ ID NO: 167624 - DNA, 18 bp, Homo sapiens
tacatatatatacacata

SEQ ID NO: 167625 - DNA, 22 bp, Homo sapiens
cagcagcacttgctcttttcac

SEQ ID NO: 167626 - DNA, 23 bp, Homo sapiens
gagatgaggaactgcctccgctt

SEQ ID NO: 167627 - DNA, 20 bp, Homo sapiens
gtctcgctctgtcacccagg

SEQ ID NO: 167628 - DNA, 22 bp, Homo sapiens
tttcacactgcctaggatcatg

SEQ ID NO: 167629 - DNA, 22 bp, Homo sapiens
gagtatctccaaactctggagc

SEQ ID NO: 167630 - DNA, 23 bp, Homo sapiens
ggaagagagaaaagtgtgtgcag

SEQ ID NO: 167631 - DNA, 23 bp, Homo sapiens
tctgtgcattacacttttctcag

SEQ ID NO: 167632 - DNA, 23 bp, Homo sapiens
gatgagtctcgctctgtcagccg

SEQ ID NO: 167633 - DNA, 23 bp, Homo sapiens
attattgttcttcaggatggatt

SEQ ID NO: 167634 - DNA, 23 bp, Homo sapiens
tctgtatttgttcttgactcaga

SEQ ID NO: 167635 - DNA, 23 bp, Homo sapiens
atatgtatatatgtatatgtgtg

SEQ ID NO: 167636 - DNA, 23 bp, Homo sapiens
tgtgtatatatgatggagtatat

SEQ ID NO: 167637 - DNA, 21 bp, Homo sapiens
tatgaggatgatttgacttgc

SEQ ID NO: 167638 - DNA, 23 bp, Homo sapiens
atacctgtgtagacagtgagcac

SEQ ID NO: 167639 - DNA, 21 bp, Homo sapiens
aatctcattatcattctcgga

SEQ ID NO: 167640 - DNA, 18 bp, Homo sapiens
tcacttagggatagtaat

SEQ ID NO: 167641 - DNA, 22 bp, Homo sapiens
tgagatgattttgtatggctca

SEQ ID NO: 167642 - DNA, 23 bp, Homo sapiens
tgagacagtgtctctctctgttg

SEQ ID NO: 167643 - DNA, 21 bp, Homo sapiens
ttcaggtactatgttgaatag

SEQ ID NO: 167644 - DNA, 18 bp, Homo sapiens
atgtgtatatatatacgt

SEQ ID NO: 167645 - DNA, 23 bp, Homo sapiens
atatatgcacatatatatgtata

SEQ ID NO: 167646 - DNA, 20 bp, Homo sapiens
tagaaagttttgaagtttgg

SEQ ID NO: 167647 - DNA, 23 bp, Homo sapiens
gtttttcatagtggttgtactaa

SEQ ID NO: 167648 - DNA, 23 bp, Homo sapiens
tacttggatcttttgtttgcctt

SEQ ID NO: 167649 - DNA, 23 bp, Homo sapiens
atttctgattcattcttgatggt

SEQ ID NO: 167650 - DNA, 23 bp, Homo sapiens
tctttctctctctgaaattctcc

SEQ ID NO: 167651 - DNA, 23 bp, Homo sapiens
agattatgagtagaatggtcaaa

SEQ ID NO: 167652 - DNA, 21 bp, Homo sapiens
gaggcttctgacctgttacca

SEQ ID NO: 167653 - DNA, 18 bp, Homo sapiens
aggtcctgggtataagca

SEQ ID NO: 167654 - DNA, 23 bp, Homo sapiens
gtttgcagctcaaaatgatgaga

SEQ ID NO: 167655 - DNA, 23 bp, Homo sapiens
atctcattatttagatggctgtt

SEQ ID NO: 167656 - DNA, 23 bp, Homo sapiens
tgtatgtgtatgtgtgtgtatat

SEQ ID NO: 167657 - DNA, 23 bp, Homo sapiens
agaaatgtgtgtgtgtatgtgtg

SEQ ID NO: 167658 - DNA, 23 bp, Homo sapiens
atcaaagatgtatatgcgtatat

SEQ ID NO: 167659 - DNA, 23 bp, Homo sapiens
atctttatcaaagatttacgtgt

SEQ ID NO: 167660 - DNA, 21 bp, Homo sapiens
tatcaaagatatacatgtgta

SEQ ID NO: 167661 - DNA, 23 bp, Homo sapiens
taatttgtatagttggtgtatgt

SEQ ID NO: 167662 - DNA, 23 bp, Homo sapiens
tgagttcattgtagattctggat

SEQ ID NO: 167663 - DNA, 23 bp, Homo sapiens
tgagttcattgtagattctggat

SEQ ID NO: 167664 - DNA, 23 bp, Homo sapiens
tgaaatgtgaaattgatgttgag

SEQ ID NO: 167665 - DNA, 20 bp, Homo sapiens
tgtgtgtgtataaacacagt

SEQ ID NO: 167666 - DNA, 20 bp, Homo sapiens
atatgtgtatacatgcatac

SEQ ID NO: 167667 - DNA, 23 bp, Homo sapiens
cacactgtctcacagcctgtatg

SEQ ID NO: 167668 - DNA, 23 bp, Homo sapiens
atgcttaatgtttgttgtttatg

SEQ ID NO: 167669 - DNA, 23 bp, Homo sapiens
tttttctgaatgatattcatggc

SEQ ID NO: 167670 - DNA, 23 bp, Homo sapiens
agcatgtctgaatagcatcctct

SEQ ID NO: 167671 - DNA, 19 bp, Homo sapiens
tctctctctctctggggca

SEQ ID NO: 167672 - DNA, 23 bp, Homo sapiens
atggagtctcactctgtcaccca

SEQ ID NO: 167673 - DNA, 20 bp, Homo sapiens
tgcttgtgtgtgtatgtatg

SEQ ID NO: 167674 - DNA, 23 bp, Homo sapiens
tctcacagagttaaaatgatgtg

SEQ ID NO: 167675 - DNA, 20 bp, Homo sapiens
agcttgtaacattgtgtaca

SEQ ID NO: 167676 - DNA, 23 bp, Homo sapiens
tacatgtgcacattgtgcaggtt

SEQ ID NO: 167677 - DNA, 23 bp, Homo sapiens
aatgagcaacttgattgtataga

SEQ ID NO: 167678 - DNA, 23 bp, Homo sapiens
ttttctaattatctaactgtaag

SEQ ID NO: 167679 - DNA, 22 bp, Homo sapiens
agtctctgtatttctctgttaa

SEQ ID NO: 167680 - DNA, 19 bp, Homo sapiens
atgtatatatgtatgcgca

SEQ ID NO: 167681 - DNA, 23 bp, Homo sapiens
aaagatggataagcactgtttct

SEQ ID NO: 167682 - DNA, 23 bp, Homo sapiens
tgagttcattgtagattctggat

SEQ ID NO: 167683 - DNA, 23 bp, Homo sapiens
tgagttcattgtagattctggat

SEQ ID NO: 167684 - DNA, 23 bp, Homo sapiens
tgagacattgtcatctggctctg

SEQ ID NO: 167685 - DNA, 18 bp, Homo sapiens
agtaaaatgactgtctta

SEQ ID NO: 167686 - DNA, 23 bp, Homo sapiens
aaattgctatttgtggatgcaaa

SEQ ID NO: 167687 - DNA, 23 bp, Homo sapiens
ttagtgaatctcagtgtgtttat

SEQ ID NO: 167688 - DNA, 19 bp, Homo sapiens
tttatagattatgtttttg

SEQ ID NO: 167689 - DNA, 21 bp, Homo sapiens
tttttgtgggctatagatgtc

SEQ ID NO: 167690 - DNA, 20 bp, Homo sapiens
agtggcattcttcacttcag

SEQ ID NO: 167691 - DNA, 19 bp, Homo sapiens
ttgagtgtctgtggctttt

SEQ ID NO: 167692 - DNA, 23 bp, Homo sapiens
tatacatctatatctatatttgt

SEQ ID NO: 167693 - DNA, 23 bp, Homo sapiens
agagctttctctttcactctctc

SEQ ID NO: 167694 - DNA, 23 bp, Homo sapiens
aaaagcagtgtgaggacacagtg

SEQ ID NO: 167695 - DNA, 19 bp, Homo sapiens
agactactcattagcttgg

SEQ ID NO: 167696 - DNA, 23 bp, Homo sapiens
aagaacatgacctgtatgtctgc

SEQ ID NO: 167697 - DNA, 22 bp, Homo sapiens
agagcatagtgaaaggggtttc

SEQ ID NO: 167698 - DNA, 19 bp, Homo sapiens
tgcttctaatttcaaatta

SEQ ID NO: 167699 - DNA, 23 bp, Homo sapiens
gagagagagagaagttgagatat

SEQ ID NO: 167700 - DNA, 22 bp, Homo sapiens
agacttcttggtgataggcaga

SEQ ID NO: 167701 - DNA, 22 bp, Homo sapiens
ttttttgatggagtgttgctct

SEQ ID NO: 167702 - DNA, 23 bp, Homo sapiens
tgataatttgttatatagcaatg

SEQ ID NO: 167703 - DNA, 23 bp, Homo sapiens
ttttttggttccatatgaaattt

SEQ ID NO: 167704 - DNA, 23 bp, Homo sapiens
atgtgtgtgtgtgcatgtgtgtg

SEQ ID NO: 167705 - DNA, 19 bp, Homo sapiens
ctgagttctctatctctgt

SEQ ID NO: 167706 - DNA, 23 bp, Homo sapiens
gactgagactcgctctgtcaccc

SEQ ID NO: 167707 - DNA, 23 bp, Homo sapiens
tacatgtgcacaatgtgcaggtt

SEQ ID NO: 167708 - DNA, 18 bp, Homo sapiens
actccctcctgtttgctg

SEQ ID NO: 167709 - DNA, 22 bp, Homo sapiens
agatctaggcagaaatgttgag

SEQ ID NO: 167710 - DNA, 22 bp, Homo sapiens
tgtgcatatatatttttatgtg

SEQ ID NO: 167711 - DNA, 19 bp, Homo sapiens
ttgccatttttttcctctg

SEQ ID NO: 167712 - DNA, 23 bp, Homo sapiens
ccactgtgtgtgtgtgtgtgtgt

SEQ ID NO: 167713 - DNA, 23 bp, Homo sapiens
tttttcatattattgttaagacg

SEQ ID NO: 167714 - DNA, 23 bp, Homo sapiens
atgtaaaacccaaaacttttaga

SEQ ID NO: 167715 - DNA, 21 bp, Homo sapiens
tatggctttttatatatttca

SEQ ID NO: 167716 - DNA, 22 bp, Homo sapiens
ttatctttagctgatgatgttc

SEQ ID NO: 167717 - DNA, 21 bp, Homo sapiens
ttttgagacagagtctcactc

SEQ ID NO: 167718 - DNA, 19 bp, Homo sapiens
agtgacatgatcttggctt

SEQ ID NO: 167719 - DNA, 21 bp, Homo sapiens
tctgtcacgcaggctatgatc

SEQ ID NO: 167720 - DNA, 23 bp, Homo sapiens
ttgtgtgtatatatatgtgtgtg

SEQ ID NO: 167721 - DNA, 21 bp, Homo sapiens
tatatgcatatgtatacatat

SEQ ID NO: 167722 - DNA, 23 bp, Homo sapiens
tatgtgtatatatacatatgtat

SEQ ID NO: 167723 - DNA, 19 bp, Homo sapiens
tgacagtgtgtttaatacc

SEQ ID NO: 167724 - DNA, 23 bp, Homo sapiens
ctttgatttttgaggtcatgttt

SEQ ID NO: 167725 - DNA, 20 bp, Homo sapiens
atagatataggtatagaagt

SEQ ID NO: 167726 - DNA, 22 bp, Homo sapiens
atatgtatgtatgtatgtgtgt

SEQ ID NO: 167727 - DNA, 23 bp, Homo sapiens
acagagtctcgctctgtcgctca

SEQ ID NO: 167728 - DNA, 20 bp, Homo sapiens
tctttatatctttttgtact

SEQ ID NO: 167729 - DNA, 23 bp, Homo sapiens
atagtcagtcttgaaaagttgta

SEQ ID NO: 167730 - DNA, 20 bp, Homo sapiens
taagagtcagagattttttt

SEQ ID NO: 167731 - DNA, 22 bp, Homo sapiens
agattgagtctcgctctgtcgc

SEQ ID NO: 167732 - DNA, 21 bp, Homo sapiens
tctcactctgtcactcaggct

SEQ ID NO: 167733 - DNA, 21 bp, Homo sapiens
tgacattgcatttctaggggt

SEQ ID NO: 167734 - DNA, 23 bp, Homo sapiens
atatatgtatatatatgtgtgtg

SEQ ID NO: 167735 - DNA, 22 bp, Homo sapiens
tgtgtgcatatttattcatatt

SEQ ID NO: 167736 - DNA, 23 bp, Homo sapiens
tatcacagtaaatctgggtgcat

SEQ ID NO: 167737 - DNA, 23 bp, Homo sapiens
atatatgtgtatatcatatacag

SEQ ID NO: 167738 - DNA, 23 bp, Homo sapiens
cggagtctctctgtgtctcccag

SEQ ID NO: 167739 - DNA, 23 bp, Homo sapiens
tgactgtctcaaacaaatcacgt

SEQ ID NO: 167740 - DNA, 23 bp, Homo sapiens
tgtgaaaagatcttacaatgttc

SEQ ID NO: 167741 - DNA, 22 bp, Homo sapiens
tgtgacagggtctggctctgtt

SEQ ID NO: 167742 - DNA, 23 bp, Homo sapiens
aaacggagtctcactctgtcgcc

SEQ ID NO: 167743 - DNA, 21 bp, Homo sapiens
tacacacacacacatatacct

SEQ ID NO: 167744 - DNA, 23 bp, Homo sapiens
tcacatgatagttttattttcat

SEQ ID NO: 167745 - DNA, 20 bp, Homo sapiens
tatatatgtatatgtgtatg

SEQ ID NO: 167746 - DNA, 23 bp, Homo sapiens
aatgcatctatagtatgcatttt

SEQ ID NO: 167747 - DNA, 20 bp, Homo sapiens
aaaaatgcacatatagttca

SEQ ID NO: 167748 - DNA, 22 bp, Homo sapiens
tgtcatctgaatttctacttgt

SEQ ID NO: 167749 - DNA, 21 bp, Homo sapiens
tatacacatatgtatatgtgt

SEQ ID NO: 167750 - DNA, 23 bp, Homo sapiens
catctatgtgtgtgtgtgtgtgt

SEQ ID NO: 167751 - DNA, 22 bp, Homo sapiens
atacacacatatatatatgtgt

SEQ ID NO: 167752 - DNA, 23 bp, Homo sapiens
atacacacacatatatatatgtg

SEQ ID NO: 167753 - DNA, 23 bp, Homo sapiens
atgtatgtgtatatgtatatgta

SEQ ID NO: 167754 - DNA, 23 bp, Homo sapiens
tatgtatacgtatacatatacat

SEQ ID NO: 167755 - DNA, 19 bp, Homo sapiens
acataatttgtataaatgt

SEQ ID NO: 167756 - DNA, 23 bp, Homo sapiens
atcacacagtgacaattggttgt

SEQ ID NO: 167757 - DNA, 23 bp, Homo sapiens
tgactctggttctagttatgctt

SEQ ID NO: 167758 - DNA, 22 bp, Homo sapiens
tttcactcactttgatattttg

SEQ ID NO: 167759 - DNA, 23 bp, Homo sapiens
atatgtgtgtgtatatatgtgta

SEQ ID NO: 167760 - DNA, 22 bp, Homo sapiens
tatgtatctttatatatctgtt

SEQ ID NO: 167761 - DNA, 23 bp, Homo sapiens
tgggtgtgtgtctgcatatatat

SEQ ID NO: 167762 - DNA, 23 bp, Homo sapiens
atatgcacacactcctgagtgtg

SEQ ID NO: 167763 - DNA, 23 bp, Homo sapiens
acacctggatatatgtgtgtgtg

SEQ ID NO: 167764 - DNA, 22 bp, Homo sapiens
aaatgatttaacaggagccatc

SEQ ID NO: 167765 - DNA, 23 bp, Homo sapiens
atatgtatatatgtatatgtatg

SEQ ID NO: 167766 - DNA, 19 bp, Homo sapiens
tatatatatgtagcaaatg

SEQ ID NO: 167767 - DNA, 21 bp, Homo sapiens
agaagtgtctgttcttgtcct

SEQ ID NO: 167768 - DNA, 18 bp, Homo sapiens
gtacatacatataaagta

SEQ ID NO: 167769 - DNA, 23 bp, Homo sapiens
tgattgacagatgatgagaagcc

SEQ ID NO: 167770 - DNA, 23 bp, Homo sapiens
atgaggcaagatatgtctgtctt

SEQ ID NO: 167771 - DNA, 18 bp, Homo sapiens
tgtttcaaaaggtttgtc

SEQ ID NO: 167772 - DNA, 20 bp, Homo sapiens
tctatatatatatatgtgta

SEQ ID NO: 167773 - DNA, 23 bp, Homo sapiens
tatgtgtgtatatatatgtgtgt

SEQ ID NO: 167774 - DNA, 18 bp, Homo sapiens
tgcctggctgtgcacagt

SEQ ID NO: 167775 - DNA, 21 bp, Homo sapiens
atatatatttgtatatgtgtg

SEQ ID NO: 167776 - DNA, 22 bp, Homo sapiens
gtatgtatgtatgtatgtatgt

SEQ ID NO: 167777 - DNA, 23 bp, Homo sapiens
aaaaggaagcaaaacatcccatt

SEQ ID NO: 167778 - DNA, 19 bp, Homo sapiens
ctgagcgggtgattggtgt

SEQ ID NO: 167779 - DNA, 22 bp, Homo sapiens
attttagagtatgtactatgtg

SEQ ID NO: 167780 - DNA, 23 bp, Homo sapiens
atatgtggatctggatctggatg

SEQ ID NO: 167781 - DNA, 20 bp, Homo sapiens
tggatatcacatatgtatcg

SEQ ID NO: 167782 - DNA, 23 bp, Homo sapiens
tgtggcactttctttctctcttg

SEQ ID NO: 167783 - DNA, 23 bp, Homo sapiens
tatttgtgtgagttttggcagtc

SEQ ID NO: 167784 - DNA, 23 bp, Homo sapiens
tttcattctttaagtattgaaaa

SEQ ID NO: 167785 - DNA, 23 bp, Homo sapiens
gaactcactttttgaagagtgta

SEQ ID NO: 167786 - DNA, 23 bp, Homo sapiens
ttgctctgtctctgtgtgtatac

SEQ ID NO: 167787 - DNA, 23 bp, Homo sapiens
tattcctagaatatatatgtgta

SEQ ID NO: 167788 - DNA, 23 bp, Homo sapiens
atattcctagaatatatatgtgt

SEQ ID NO: 167789 - DNA, 23 bp, Homo sapiens
ggctcagtgtagactagcttgag

SEQ ID NO: 167790 - DNA, 18 bp, Homo sapiens
atatgtgcttgtcaaatg

SEQ ID NO: 167791 - DNA, 20 bp, Homo sapiens
atatgtattatattataggt

SEQ ID NO: 167792 - DNA, 23 bp, Homo sapiens
tctcaatgtgactcactcagaga

SEQ ID NO: 167793 - DNA, 23 bp, Homo sapiens
agaactggaacaagagaagatgc

SEQ ID NO: 167794 - DNA, 23 bp, Homo sapiens
ttgagatggagtttctctcttct

SEQ ID NO: 167795 - DNA, 22 bp, Homo sapiens
ttttagatggagttttgctctt

SEQ ID NO: 167796 - DNA, 23 bp, Homo sapiens
tttcatgttcagcacgtgcacgc

SEQ ID NO: 167797 - DNA, 23 bp, Homo sapiens
gcgtgtgtgtgtgtgactgtgtg

SEQ ID NO: 167798 - DNA, 22 bp, Homo sapiens
tgtgtcagtctgaaaatggtcc

SEQ ID NO: 167799 - DNA, 21 bp, Homo sapiens
tttctgcttgccatttacgag

SEQ ID NO: 167800 - DNA, 23 bp, Homo sapiens
tctctctcggactctttcttctc

SEQ ID NO: 167801 - DNA, 23 bp, Homo sapiens
acatgctgctctgtctgtctgag

SEQ ID NO: 167802 - DNA, 22 bp, Homo sapiens
tcaggctgcctctgtgcctgta

SEQ ID NO: 167803 - DNA, 23 bp, Homo sapiens
tcagactaggttatctgactgtt

SEQ ID NO: 167804 - DNA, 23 bp, Homo sapiens
atatgtgtgtatgtatatgtgtg

SEQ ID NO: 167805 - DNA, 23 bp, Homo sapiens
aaggtcttatgttgctcaggatg

SEQ ID NO: 167806 - DNA, 23 bp, Homo sapiens
taacatcttccctttcttctcat

SEQ ID NO: 167807 - DNA, 21 bp, Homo sapiens
ataagaggagacagtgcagaa

SEQ ID NO: 167808 - DNA, 23 bp, Homo sapiens
tgagttcattgtagattctggat

SEQ ID NO: 167809 - DNA, 23 bp, Homo sapiens
tgagttcattgtagattctggat

SEQ ID NO: 167810 - DNA, 23 bp, Homo sapiens
ttttgctatgtttcccagactgg

SEQ ID NO: 167811 - DNA, 23 bp, Homo sapiens
tcaggctgtgaatccatctggtt

SEQ ID NO: 167812 - DNA, 23 bp, Homo sapiens
gaacttggtttgctagtatgctg

SEQ ID NO: 167813 - DNA, 23 bp, Homo sapiens
ttctttttgaatagaagcacatt

SEQ ID NO: 167814 - DNA, 23 bp, Homo sapiens
tatcattttgaaggtgatttggt

SEQ ID NO: 167815 - DNA, 19 bp, Homo sapiens
tgtcactatgatgttagct

SEQ ID NO: 167816 - DNA, 23 bp, Homo sapiens
ctcggtgactcagtgtaggcttc

SEQ ID NO: 167817 - DNA, 23 bp, Homo sapiens
ttctctgtcttcaacctcagttt

SEQ ID NO: 167818 - DNA, 23 bp, Homo sapiens
ttctggagttctgattcatttca

SEQ ID NO: 167819 - DNA, 18 bp, Homo sapiens
tacacacatatatatgtg

SEQ ID NO: 167820 - DNA, 23 bp, Homo sapiens
tatacacacacgtatatatgtgt

SEQ ID NO: 167821 - DNA, 20 bp, Homo sapiens
tctgcttctaagtgggtctc

SEQ ID NO: 167822 - DNA, 21 bp, Homo sapiens
tttttctttttgtgttagcta

SEQ ID NO: 167823 - DNA, 22 bp, Homo sapiens
tccaagtggaaatgcatctggt

SEQ ID NO: 167824 - DNA, 20 bp, Homo sapiens
tatgtacatatagatgtata

SEQ ID NO: 167825 - DNA, 23 bp, Homo sapiens
tcacttttgttgttgaaaaagga

SEQ ID NO: 167826 - DNA, 23 bp, Homo sapiens
tgagttcattgtagattctggat

SEQ ID NO: 167827 - DNA, 23 bp, Homo sapiens
tgagttcattgtagattctggat

SEQ ID NO: 167828 - DNA, 19 bp, Homo sapiens
atactgtatatgtatatat

SEQ ID NO: 167829 - DNA, 23 bp, Homo sapiens
gaaagactgtcacgttatgtgga

SEQ ID NO: 167830 - DNA, 22 bp, Homo sapiens
atataccttggaaaaatttgtt

SEQ ID NO: 167831 - DNA, 20 bp, Homo sapiens
agctagaaggttgtacagtt

SEQ ID NO: 167832 - DNA, 23 bp, Homo sapiens
acataatcatgtgtttttcatca

SEQ ID NO: 167833 - DNA, 20 bp, Homo sapiens
aagccaacttgattgtggtg

SEQ ID NO: 167834 - DNA, 23 bp, Homo sapiens
taaagcatatcaatgatatgata

SEQ ID NO: 167835 - DNA, 23 bp, Homo sapiens
atatgtgtatatatgtgtgtgtg

SEQ ID NO: 167836 - DNA, 23 bp, Homo sapiens
tggaatactgattttgctgttga

SEQ ID NO: 167837 - DNA, 23 bp, Homo sapiens
actctgactctcatgcctttctc

SEQ ID NO: 167838 - DNA, 23 bp, Homo sapiens
tgtgattagagtggatgtacttg

SEQ ID NO: 167839 - DNA, 23 bp, Homo sapiens
ttgtgacatgatggtattcaggg

SEQ ID NO: 167840 - DNA, 23 bp, Homo sapiens
tgagtcactgtatgccacaggtt

SEQ ID NO: 167841 - DNA, 21 bp, Homo sapiens
gtgagaccctgtctcaaacac

SEQ ID NO: 167842 - DNA, 22 bp, Homo sapiens
tgagtgtgtggtttagcacagg

SEQ ID NO: 167843 - DNA, 23 bp, Homo sapiens
tgagttcattgtagattctggat

SEQ ID NO: 167844 - DNA, 23 bp, Homo sapiens
tgagttcattgtagattctggat

SEQ ID NO: 167845 - DNA, 21 bp, Homo sapiens
tgtgaagaaagtcattggtag

SEQ ID NO: 167846 - DNA, 21 bp, Homo sapiens
tgtgaagaaagtcattggtag

SEQ ID NO: 167847 - DNA, 21 bp, Homo sapiens
tgtgaagaaagtcattggtag

SEQ ID NO: 167848 - DNA, 19 bp, Homo sapiens
tgaattcaaaatgttaatg

SEQ ID NO: 167849 - DNA, 20 bp, Homo sapiens
atttgactttcacgtgcagt

SEQ ID NO: 167850 - DNA, 23 bp, Homo sapiens
atatgagaagaagctaatgggta

SEQ ID NO: 167851 - DNA, 22 bp, Homo sapiens
actctagaagatcatgtactca

SEQ ID NO: 167852 - DNA, 23 bp, Homo sapiens
aagtctctctcattctctctctg

SEQ ID NO: 167853 - DNA, 21 bp, Homo sapiens
tatgtcaatttttcatttagc

SEQ ID NO: 167854 - DNA, 23 bp, Homo sapiens
tgtgtgtgtatatatatgtgtgt

SEQ ID NO: 167855 - DNA, 23 bp, Homo sapiens
tgtctctctctgtgtgtccaaac

SEQ ID NO: 167856 - DNA, 23 bp, Homo sapiens
ttcctgcctgcctgcctgcctgc

SEQ ID NO: 167857 - DNA, 18 bp, Homo sapiens
tgctatgttacccagtct

SEQ ID NO: 167858 - DNA, 23 bp, Homo sapiens
tgagatggactctcgctctgtcg

SEQ ID NO: 167859 - DNA, 23 bp, Homo sapiens
agctgaggcagtgtcagggcatg

SEQ ID NO: 167860 - DNA, 23 bp, Homo sapiens
atttgtcagggattcaaagcact

SEQ ID NO: 167861 - DNA, 22 bp, Homo sapiens
tggaatccaggtgaatgtgaag

SEQ ID NO: 167862 - DNA, 22 bp, Homo sapiens
tttgttctctggctcctcgagg

SEQ ID NO: 167863 - DNA, 23 bp, Homo sapiens
atttgtgttgatactgatcacta

SEQ ID NO: 167864 - DNA, 23 bp, Homo sapiens
cggagcctccctggtagcctgtg

SEQ ID NO: 167865 - DNA, 21 bp, Homo sapiens
tgaatctcggaggaaatggtg

SEQ ID NO: 167866 - DNA, 19 bp, Homo sapiens
tatacatatgtctatgcat

SEQ ID NO: 167867 - DNA, 23 bp, Homo sapiens
tatttcattgtgtgtgtgtgtgt

SEQ ID NO: 167868 - DNA, 19 bp, Homo sapiens
gagacagtctcactctgtc

SEQ ID NO: 167869 - DNA, 22 bp, Homo sapiens
ttttctgagaaaatctttcttt

SEQ ID NO: 167870 - DNA, 23 bp, Homo sapiens
agtgccatttgaaatctgtatgt

SEQ ID NO: 167871 - DNA, 20 bp, Homo sapiens
tctttttttgttgtttttga

SEQ ID NO: 167872 - DNA, 23 bp, Homo sapiens
tcagaagtgtttttgttttaaag

SEQ ID NO: 167873 - DNA, 21 bp, Homo sapiens
aggaaaagcttcaattgagat

SEQ ID NO: 167874 - DNA, 23 bp, Homo sapiens
agagagttgagagagtcatcaga

SEQ ID NO: 167875 - DNA, 19 bp, Homo sapiens
tgagaagctgtccacctct

SEQ ID NO: 167876 - DNA, 19 bp, Homo sapiens
aaaggcctttgtctaggtg

SEQ ID NO: 167877 - DNA, 21 bp, Homo sapiens
tctctccctgtcacccaggct

SEQ ID NO: 167878 - DNA, 19 bp, Homo sapiens
agactgatgacagtgagga

SEQ ID NO: 167879 - DNA, 23 bp, Homo sapiens
aaaatgctttagtttcagttata

SEQ ID NO: 167880 - DNA, 23 bp, Homo sapiens
tatgtgtgtgtatatgcaggtat

SEQ ID NO: 167881 - DNA, 23 bp, Homo sapiens
aacctctaatatatatgtgtgta

SEQ ID NO: 167882 - DNA, 23 bp, Homo sapiens
tatacatatattatatatgtata

SEQ ID NO: 167883 - DNA, 21 bp, Homo sapiens
atatgtgtatatatattagac

SEQ ID NO: 167884 - DNA, 23 bp, Homo sapiens
tgaagtatttcattgataatact

SEQ ID NO: 167885 - DNA, 23 bp, Homo sapiens
gttatcactagaatgcttaagaa

SEQ ID NO: 167886 - DNA, 22 bp, Homo sapiens
gcttatgcctgtaatcccaaca

SEQ ID NO: 167887 - DNA, 21 bp, Homo sapiens
tgaggtaggaggatcacttga

SEQ ID NO: 167888 - DNA, 21 bp, Homo sapiens
cacccggtccagagacagcag

SEQ ID NO: 167889 - DNA, 22 bp, Homo sapiens
tgcttgccattctaactggtgt

SEQ ID NO: 167890 - DNA, 22 bp, Homo sapiens
tatgtgtatatatatatgtgtg

SEQ ID NO: 167891 - DNA, 19 bp, Homo sapiens
agaacacacctgctgggtt

SEQ ID NO: 167892 - DNA, 23 bp, Homo sapiens
tggagtctcactctgtcacccag

SEQ ID NO: 167893 - DNA, 21 bp, Homo sapiens
tttaaaagtcaggtagagtga

SEQ ID NO: 167894 - DNA, 22 bp, Homo sapiens
actagtcagtgcctcagtgggg

SEQ ID NO: 167895 - DNA, 19 bp, Homo sapiens
ttcagaggctttcagattt

SEQ ID NO: 167896 - DNA, 22 bp, Homo sapiens
gtgacagagtgagaccctgtat

SEQ ID NO: 167897 - DNA, 23 bp, Homo sapiens
tgagacagtctcgctctgtctcc

SEQ ID NO: 167898 - DNA, 23 bp, Homo sapiens
tcactctgtcacccagactggag

SEQ ID NO: 167899 - DNA, 22 bp, Homo sapiens
tcacctaggagcttgtttacag

SEQ ID NO: 167900 - DNA, 23 bp, Homo sapiens
tgagacagtgtctcactctgtcg

SEQ ID NO: 167901 - DNA, 23 bp, Homo sapiens
catgtctctttttcttattgtga

SEQ ID NO: 167902 - DNA, 23 bp, Homo sapiens
ctcactccgtcactgtcacccag

SEQ ID NO: 167903 - DNA, 23 bp, Homo sapiens
tggtactgctagtgctgggtgaa

SEQ ID NO: 167904 - DNA, 23 bp, Homo sapiens
aattattagaagtacagccaggc

SEQ ID NO: 167905 - DNA, 22 bp, Homo sapiens
ctcactctgtgtgaccctgtgg

SEQ ID NO: 167906 - DNA, 23 bp, Homo sapiens
tgagatggagtctcactctgtta

SEQ ID NO: 167907 - DNA, 23 bp, Homo sapiens
tctttccacacactctgacgctg

SEQ ID NO: 167908 - DNA, 23 bp, Homo sapiens
tataatctgtatcatatatattg

SEQ ID NO: 167909 - DNA, 23 bp, Homo sapiens
tcccaggcacagtccctgactcg

SEQ ID NO: 167910 - DNA, 21 bp, Homo sapiens
tgaggtaggaggatcacttga

SEQ ID NO: 167911 - DNA, 23 bp, Homo sapiens
ttactcattgtgactggttgtcc

SEQ ID NO: 167912 - DNA, 23 bp, Homo sapiens
tgggtggctgtgttcaatgggtg

SEQ ID NO: 167913 - DNA, 19 bp, Homo sapiens
gtctcgctctgtcacccag

SEQ ID NO: 167914 - DNA, 18 bp, Homo sapiens
tggcaagatctcggctta

SEQ ID NO: 167915 - DNA, 23 bp, Homo sapiens
gagtctcactctgtcactgaggc

SEQ ID NO: 167916 - DNA, 22 bp, Homo sapiens
tctgtgactggtttatttcact

SEQ ID NO: 167917 - DNA, 23 bp, Homo sapiens
cacagtctcactctgtcacccac

SEQ ID NO: 167918 - DNA, 23 bp, Homo sapiens
cagtgggactgggtctggtacca

SEQ ID NO: 167919 - DNA, 22 bp, Homo sapiens
gtgtgcctgtgtgtgcccatgc

SEQ ID NO: 167920 - DNA, 23 bp, Homo sapiens
gtctgtcctacaggatgaggctt

SEQ ID NO: 167921 - DNA, 23 bp, Homo sapiens
aactgtcctgagtgaccagacac

SEQ ID NO: 167922 - DNA, 21 bp, Homo sapiens
cagcctctgcttcgagtgctc

SEQ ID NO: 167923 - DNA, 18 bp, Homo sapiens
tggagagaaaggcagttc

SEQ ID NO: 167924 - DNA, 23 bp, Homo sapiens
tggagtctcactctgtcacccag

SEQ ID NO: 167925 - DNA, 23 bp, Homo sapiens
tctgtgtgtccctgagtgagtgg

SEQ ID NO: 167926 - DNA, 20 bp, Homo sapiens
tctctcttagtattggggca

SEQ ID NO: 167927 - DNA, 23 bp, Homo sapiens
gtccctccctctgttagagctgt

SEQ ID NO: 167928 - DNA, 23 bp, Homo sapiens
tatgtctgtgtgtgtgtgtacta

SEQ ID NO: 167929 - DNA, 23 bp, Homo sapiens
tgagacagactctcgctctgtcg

SEQ ID NO: 167930 - DNA, 23 bp, Homo sapiens
gctgagtctctgtggctgtggca

SEQ ID NO: 167931 - DNA, 23 bp, Homo sapiens
tgagacagggagagtagggtgtg

SEQ ID NO: 167932 - DNA, 23 bp, Homo sapiens
cacagtctgtctctgtgcctcag

SEQ ID NO: 167933 - DNA, 23 bp, Homo sapiens
agtatctcactctgtcacccaag

SEQ ID NO: 167934 - DNA, 18 bp, Homo sapiens
cagtggcatgatattggc

SEQ ID NO: 167935 - DNA, 23 bp, Homo sapiens
tctgtctgtctgtctgcctgtct

SEQ ID NO: 167936 - DNA, 23 bp, Homo sapiens
gacagagtctcgctctgtcaccc

SEQ ID NO: 167937 - DNA, 19 bp, Homo sapiens
tgttcttgtcttttgtcca

SEQ ID NO: 167938 - DNA, 23 bp, Homo sapiens
ttgagacaaggtcttgctgtgtc

SEQ ID NO: 167939 - DNA, 23 bp, Homo sapiens
gtctgtgtctgtgaattatgtgt

SEQ ID NO: 167940 - DNA, 23 bp, Homo sapiens
actgagtctcactctgtcgccca

SEQ ID NO: 167941 - DNA, 22 bp, Homo sapiens
acagagcaaaactcttgtctct

SEQ ID NO: 167942 - DNA, 20 bp, Homo sapiens
acagagtctcttgctctgtc

SEQ ID NO: 167943 - DNA, 22 bp, Homo sapiens
gattacaggcatgagccaccgt

SEQ ID NO: 167944 - DNA, 23 bp, Homo sapiens
cggagtctcactctgtcacccag

SEQ ID NO: 167945 - DNA, 23 bp, Homo sapiens
gagtctcactctgtcacccaggc

SEQ ID NO: 167946 - DNA, 22 bp, Homo sapiens
actgagcctcactctttgcctc

SEQ ID NO: 167947 - DNA, 23 bp, Homo sapiens
gacagagtctcgctctgtcaccc

SEQ ID NO: 167948 - DNA, 19 bp, Homo sapiens
tgcaatggtgtgatctctg

SEQ ID NO: 167949 - DNA, 21 bp, Homo sapiens
tgaggtaggaggatcacttga

SEQ ID NO: 167950 - DNA, 19 bp, Homo sapiens
cacagtgagactccgtctc

SEQ ID NO: 167951 - DNA, 23 bp, Homo sapiens
acaaggtctcactctgtcaccca

SEQ ID NO: 167952 - DNA, 20 bp, Homo sapiens
atagaagtcagttctagggc

SEQ ID NO: 167953 - DNA, 23 bp, Homo sapiens
ctcagggtctcactcagtctccc

SEQ ID NO: 167954 - DNA, 19 bp, Homo sapiens
tttttagtagagatggggt

SEQ ID NO: 167955 - DNA, 20 bp, Homo sapiens
gtcagggtgagtgctgggtt

SEQ ID NO: 167956 - DNA, 21 bp, Homo sapiens
cacttgtgagtcactgacact

SEQ ID NO: 167957 - DNA, 23 bp, Homo sapiens
gtttactctgtgtggcaatcagg

SEQ ID NO: 167958 - DNA, 23 bp, Homo sapiens
tgagacagactctcgctctgtcg

SEQ ID NO: 167959 - DNA, 23 bp, Homo sapiens
gctgagtctctgtggctgtggca

SEQ ID NO: 167960 - DNA, 23 bp, Homo sapiens
tgagacagggagagtagggtgtg

SEQ ID NO: 167961 - DNA, 23 bp, Homo sapiens
tttgagacggactctcactctgt

SEQ ID NO: 167962 - DNA, 22 bp, Homo sapiens
ccgacactctttccctgttgca

SEQ ID NO: 167963 - DNA, 22 bp, Homo sapiens
cagtgcaatgatgaaagggcat

SEQ ID NO: 167964 - DNA, 20 bp, Homo sapiens
actcaggctgaagtgcaatg

SEQ ID NO: 167965 - DNA, 23 bp, Homo sapiens
tgtggcgctgtcactgcctcact

SEQ ID NO: 167966 - DNA, 22 bp, Homo sapiens
gtgatcgcatttgctgagggtg

SEQ ID NO: 167967 - DNA, 23 bp, Homo sapiens
ggctgaggctttgctgtgtgtcg

SEQ ID NO: 167968 - DNA, 23 bp, Homo sapiens
ctgtcacactgaatccttagcct

SEQ ID NO: 167969 - DNA, 23 bp, Homo sapiens
tgtggcgctgtcactgcctcact

SEQ ID NO: 167970 - DNA, 22 bp, Homo sapiens
ggtgtctctctctttctctgag

SEQ ID NO: 167971 - DNA, 20 bp, Homo sapiens
ttcagtgacgcaattatggc

SEQ ID NO: 167972 - DNA, 23 bp, Homo sapiens
gtgtctcactctgtcacccaagc

SEQ ID NO: 167973 - DNA, 18 bp, Homo sapiens
cagtggcatgatattggc

SEQ ID NO: 167974 - DNA, 23 bp, Homo sapiens
acagtctgtctctgtgcctcagt

SEQ ID NO: 167975 - DNA, 23 bp, Homo sapiens
cacagtctgtctctgtgcctcag

SEQ ID NO: 167976 - DNA, 23 bp, Homo sapiens
acaatgtctcagagactgttcca

SEQ ID NO: 167977 - DNA, 23 bp, Homo sapiens
cactgtgtgtgagtgtgtgtgca

SEQ ID NO: 167978 - DNA, 23 bp, Homo sapiens
actggggtctctgtctctctcat

SEQ ID NO: 167979 - DNA, 23 bp, Homo sapiens
tatatactgtttctggttgggac

SEQ ID NO: 167980 - DNA, 23 bp, Homo sapiens
atgtgagaacagactggcagctc

SEQ ID NO: 167981 - DNA, 23 bp, Homo sapiens
tgtccgtctgtctgtctctttgc

SEQ ID NO: 167982 - DNA, 19 bp, Homo sapiens
tcacagctctgactgtcag

SEQ ID NO: 167983 - DNA, 22 bp, Homo sapiens
atcaattactcggtctttttct

SEQ ID NO: 167984 - DNA, 23 bp, Homo sapiens
ggtgtctcactctgtcacccaag

SEQ ID NO: 167985 - DNA, 18 bp, Homo sapiens
cagtggaatgatattggc

SEQ ID NO: 167986 - DNA, 20 bp, Homo sapiens
tgtgttgtagggagtttact

SEQ ID NO: 167987 - DNA, 23 bp, Homo sapiens
gaggtagaaggatcacttgagtc

SEQ ID NO: 167988 - DNA, 20 bp, Homo sapiens
tggggctgtgtgaccttggg

SEQ ID NO: 167989 - DNA, 23 bp, Homo sapiens
tgcctctctgggtctctgagccc

SEQ ID NO: 167990 - DNA, 21 bp, Homo sapiens
gtgtggatccttgtgtccatg

SEQ ID NO: 167991 - DNA, 22 bp, Homo sapiens
agcacagatgttcttgtctttg

SEQ ID NO: 167992 - DNA, 23 bp, Homo sapiens
agacaggtctcactctgtcaccc

SEQ ID NO: 167993 - DNA, 23 bp, Homo sapiens
tcacagccagtgtcccagagatg

SEQ ID NO: 167994 - DNA, 23 bp, Homo sapiens
gagcctcactgtccctgtcgctg

SEQ ID NO: 167995 - DNA, 23 bp, Homo sapiens
ggagtctcactctgtctcacagg

SEQ ID NO: 167996 - DNA, 23 bp, Homo sapiens
agagtctcactctgtcacccagg

SEQ ID NO: 167997 - DNA, 23 bp, Homo sapiens
gagtctcactctgtcacccaggc

SEQ ID NO: 167998 - DNA, 23 bp, Homo sapiens
aatcagtgtttggtagaattcac

SEQ ID NO: 167999 - DNA, 18 bp, Homo sapiens
acagctgcccactgaggg

SEQ ID NO: 168000 - DNA, 22 bp, Homo sapiens
tcacagacaccctgtctgagaa

SEQ ID NO: 168001 - DNA, 21 bp, Homo sapiens
tccttgatcaaaaaggattaa

SEQ ID NO: 168002 - DNA, 23 bp, Homo sapiens
gggtctcactctgtcacccaggc

SEQ ID NO: 168003 - DNA, 20 bp, Homo sapiens
tgagccaagatcatgccact

SEQ ID NO: 168004 - DNA, 20 bp, Homo sapiens
tgtgttgtagggagtttact

SEQ ID NO: 168005 - DNA, 23 bp, Homo sapiens
tccgtccgtcagtccgtccgtcc

SEQ ID NO: 168006 - DNA, 19 bp, Homo sapiens
tctcactcactctgggact

SEQ ID NO: 168007 - DNA, 23 bp, Homo sapiens
ctctgggtgtgtcagtgagtgag

SEQ ID NO: 168008 - DNA, 23 bp, Homo sapiens
acagtctgtctctgtgcctcagt

SEQ ID NO: 168009 - DNA, 20 bp, Homo sapiens
tgtgttgtagggagtttact

SEQ ID NO: 168010 - DNA, 23 bp, Homo sapiens
ccactctgtctcactccagatcc

SEQ ID NO: 168011 - DNA, 19 bp, Homo sapiens
atttctgccacattctgtt

SEQ ID NO: 168012 - DNA, 23 bp, Homo sapiens
cacagagtggctgtgggtcattt

SEQ ID NO: 168013 - DNA, 23 bp, Homo sapiens
tttgagacggagtctcactgtgt

SEQ ID NO: 168014 - DNA, 23 bp, Homo sapiens
gaatggtagttctttgttaagtt

SEQ ID NO: 168015 - DNA, 23 bp, Homo sapiens
atgtatatatgggtgtgtgtatg

SEQ ID NO: 168016 - DNA, 18 bp, Homo sapiens
acatgtatatgcatatat

SEQ ID NO: 168017 - DNA, 21 bp, Homo sapiens
agcctgggtccctgaatgact

SEQ ID NO: 168018 - DNA, 23 bp, Homo sapiens
gacacgctctcgctctgtcaccc

SEQ ID NO: 168019 - DNA, 23 bp, Homo sapiens
gggtctcactctctcacccaggc

SEQ ID NO: 168020 - DNA, 23 bp, Homo sapiens
actctcagtgcctctgttttgtc

SEQ ID NO: 168021 - DNA, 23 bp, Homo sapiens
tatttctctctctcgctctcatt

SEQ ID NO: 168022 - DNA, 23 bp, Homo sapiens
gggtctctctctgtcacccaggc

SEQ ID NO: 168023 - DNA, 23 bp, Homo sapiens
tatatatacataggaaaagtgtg

SEQ ID NO: 168024 - DNA, 19 bp, Homo sapiens
atgcaaggtctggcagggt

SEQ ID NO: 168025 - DNA, 23 bp, Homo sapiens
tagtcactgagcataggctgtct

SEQ ID NO: 168026 - DNA, 22 bp, Homo sapiens
ggctgactgactgtggctgtct

SEQ ID NO: 168027 - DNA, 23 bp, Homo sapiens
tgagcaggtcactgagtctctct

SEQ ID NO: 168028 - DNA, 23 bp, Homo sapiens
aacaccaggtttatggttcctaa

SEQ ID NO: 168029 - DNA, 23 bp, Homo sapiens
agtcacactgtgactttgctcag

SEQ ID NO: 168030 - DNA, 23 bp, Homo sapiens
agcacctgtacctgtggctgtca

SEQ ID NO: 168031 - DNA, 23 bp, Homo sapiens
ctctctgacactcagtttcttca

SEQ ID NO: 168032 - DNA, 23 bp, Homo sapiens
aaggtctcactctgtctcccagg

SEQ ID NO: 168033 - DNA, 20 bp, Homo sapiens
gagagtatatgtaatgatct

SEQ ID NO: 168034 - DNA, 23 bp, Homo sapiens
tctgcatgtctgtcagcctctgt

SEQ ID NO: 168035 - DNA, 23 bp, Homo sapiens
ctgatgtcaggaaatgtttagaa

SEQ ID NO: 168036 - DNA, 18 bp, Homo sapiens
atgtgcatatatattata

SEQ ID NO: 168037 - DNA, 23 bp, Homo sapiens
gctgtaaagtgcttagaaagttc

SEQ ID NO: 168038 - DNA, 22 bp, Homo sapiens
agacagccagacatatgtgtgt

SEQ ID NO: 168039 - DNA, 23 bp, Homo sapiens
gtgtatatctgtatctctatctt

SEQ ID NO: 168040 - DNA, 23 bp, Homo sapiens
cactgacacactctcctaccgga

SEQ ID NO: 168041 - DNA, 22 bp, Homo sapiens
tgcctgtagttccagttacctg

SEQ ID NO: 168042 - DNA, 20 bp, Homo sapiens
gtgtcacggagacatctggg

SEQ ID NO: 168043 - DNA, 23 bp, Homo sapiens
tcagcctctgggtctctgagaca

SEQ ID NO: 168044 - DNA, 23 bp, Homo sapiens
tccatctctccctttgtaggttc

SEQ ID NO: 168045 - DNA, 23 bp, Homo sapiens
acagaatctcactctgtcaccca

SEQ ID NO: 168046 - DNA, 23 bp, Homo sapiens
tggctctcactgcctggctctcc

SEQ ID NO: 168047 - DNA, 19 bp, Homo sapiens
tgcttaagatggtggctga

SEQ ID NO: 168048 - DNA, 23 bp, Homo sapiens
tgggtccctgagtgactatagtg

SEQ ID NO: 168049 - DNA, 23 bp, Homo sapiens
cggagtctcactctgtcacccag

SEQ ID NO: 168050 - DNA, 23 bp, Homo sapiens
gagtctcactctgtcacccaggc

SEQ ID NO: 168051 - DNA, 21 bp, Homo sapiens
tatacatagctacatattact

SEQ ID NO: 168052 - DNA, 23 bp, Homo sapiens
tatagtcacatatacaaatgtgt

SEQ ID NO: 168053 - DNA, 22 bp, Homo sapiens
gtttatgtgagttaacctattc

SEQ ID NO: 168054 - DNA, 23 bp, Homo sapiens
tccatgtcttctgatttttttca

SEQ ID NO: 168055 - DNA, 19 bp, Homo sapiens
tgggagccagtgaggacag

SEQ ID NO: 168056 - DNA, 23 bp, Homo sapiens
aggagtctcactctgtcacccag

SEQ ID NO: 168057 - DNA, 19 bp, Homo sapiens
agtgcagcagtgtaatctc

SEQ ID NO: 168058 - DNA, 23 bp, Homo sapiens
gtgtgtgagagagacagacagaa

SEQ ID NO: 168059 - DNA, 23 bp, Homo sapiens
tctctgcatcactccctgcctac

SEQ ID NO: 168060 - DNA, 23 bp, Homo sapiens
ctcactctgtcacccagactgga

SEQ ID NO: 168061 - DNA, 18 bp, Homo sapiens
tctcagggatgttaggat

SEQ ID NO: 168062 - DNA, 23 bp, Homo sapiens
ctgacactctgaccctgtgcctg

SEQ ID NO: 168063 - DNA, 20 bp, Homo sapiens
aagcagctcaccctgcagaa

SEQ ID NO: 168064 - DNA, 23 bp, Homo sapiens
gacatggagtctcactctgtgac

SEQ ID NO: 168065 - DNA, 23 bp, Homo sapiens
gacagagtctcgctctgtcaccc

SEQ ID NO: 168066 - DNA, 21 bp, Homo sapiens
tgaggtaggaggatcacttga

SEQ ID NO: 168067 - DNA, 18 bp, Homo sapiens
atgcatattatatacaac

SEQ ID NO: 168068 - DNA, 23 bp, Homo sapiens
ttgtgagacaagagtctcactct

SEQ ID NO: 168069 - DNA, 23 bp, Homo sapiens
gggtctcactctgtcacccaggc

SEQ ID NO: 168070 - DNA, 23 bp, Homo sapiens
acagagtctcactctgtcgccca

SEQ ID NO: 168071 - DNA, 23 bp, Homo sapiens
cagctgtcttttgactgtgggat

SEQ ID NO: 168072 - DNA, 23 bp, Homo sapiens
ttgaacacttgtcattttcttga

SEQ ID NO: 168073 - DNA, 23 bp, Homo sapiens
tccctgacttgactgtgtgctct

SEQ ID NO: 168074 - DNA, 23 bp, Homo sapiens
tccctccctccctcagacacaac

SEQ ID NO: 168075 - DNA, 19 bp, Homo sapiens
tataccatgttatctcatt

SEQ ID NO: 168076 - DNA, 20 bp, Homo sapiens
atatatctatatatgtatac

SEQ ID NO: 168077 - DNA, 23 bp, Homo sapiens
tgcagtggcttgatcatggctca

SEQ ID NO: 168078 - DNA, 23 bp, Homo sapiens
gacagtctcactgtcacccaggc

SEQ ID NO: 168079 - DNA, 23 bp, Homo sapiens
tatatgtgtatatgtatatatgt

SEQ ID NO: 168080 - DNA, 23 bp, Homo sapiens
agatggaatctcactctgtcact

SEQ ID NO: 168081 - DNA, 23 bp, Homo sapiens
ttatgagtcaaacatgttgagct

SEQ ID NO: 168082 - DNA, 23 bp, Homo sapiens
tccatttctgactctctcactta

SEQ ID NO: 168083 - DNA, 23 bp, Homo sapiens
tctcactgtgtctgggtggaaat

SEQ ID NO: 168084 - DNA, 23 bp, Homo sapiens
tcctggataacaagggagagtca

SEQ ID NO: 168085 - DNA, 21 bp, Homo sapiens
tgcctggctcgtaaagaagtg

SEQ ID NO: 168086 - DNA, 23 bp, Homo sapiens
ctgtctttgactctgtggatctg

SEQ ID NO: 168087 - DNA, 22 bp, Homo sapiens
ctcactgtcaagtctaacagat

SEQ ID NO: 168088 - DNA, 21 bp, Homo sapiens
tctgcctctctctatcagtct

SEQ ID NO: 168089 - DNA, 23 bp, Homo sapiens
acttgacagtcagcagtctgagg

SEQ ID NO: 168090 - DNA, 23 bp, Homo sapiens
ggcagtgttgagactaggtgctg

SEQ ID NO: 168091 - DNA, 23 bp, Homo sapiens
ctgggtgacacagtgagactctg

SEQ ID NO: 168092 - DNA, 22 bp, Homo sapiens
agttatgcctgcatatgtgtgt

SEQ ID NO: 168093 - DNA, 23 bp, Homo sapiens
agggtctcactctgtcacccagg

SEQ ID NO: 168094 - DNA, 23 bp, Homo sapiens
tatacacacacacatatatagta

SEQ ID NO: 168095 - DNA, 23 bp, Homo sapiens
atgtgtttatatatacatgtgtg

SEQ ID NO: 168096 - DNA, 21 bp, Homo sapiens
catatgtgaggctggagatgt

SEQ ID NO: 168097 - DNA, 19 bp, Homo sapiens
catactccatgaaaagtct

SEQ ID NO: 168098 - DNA, 23 bp, Homo sapiens
ctctggctctgtctgtctgttgg

SEQ ID NO: 168099 - DNA, 23 bp, Homo sapiens
aggagtcagaaggcagtaggata

SEQ ID NO: 168100 - DNA, 23 bp, Homo sapiens
ggctgaggtaggaggatcacttg

SEQ ID NO: 168101 - DNA, 23 bp, Homo sapiens
gggtctcactctgtcacccaggc

SEQ ID NO: 168102 - DNA, 23 bp, Homo sapiens
ggagtctcgctctgtcaccctgg

SEQ ID NO: 168103 - DNA, 22 bp, Homo sapiens
gtatgtatatgtatgtgtatat

SEQ ID NO: 168104 - DNA, 23 bp, Homo sapiens
tgtacacatgtatgtatatgtgt

SEQ ID NO: 168105 - DNA, 23 bp, Homo sapiens
tgtctgtctgtctgtcttagtag

SEQ ID NO: 168106 - DNA, 23 bp, Homo sapiens
tgagttcattgtagattctggat

SEQ ID NO: 168107 - DNA, 23 bp, Homo sapiens
tgagttcattgtagattctggat

SEQ ID NO: 168108 - DNA, 23 bp, Homo sapiens
tgagttcattgtagattctggat

SEQ ID NO: 168109 - DNA, 23 bp, Homo sapiens
tgagttcattgtagattctggat

SEQ ID NO: 168110 - DNA, 23 bp, Homo sapiens
gatcactgctctttgtttatccc

SEQ ID NO: 168111 - DNA, 22 bp, Homo sapiens
tctgatggttttacaaagagga

SEQ ID NO: 168112 - DNA, 23 bp, Homo sapiens
gactgacagcttctgcttatgga

SEQ ID NO: 168113 - DNA, 23 bp, Homo sapiens
agagtctcactctgtcacccagg

SEQ ID NO: 168114 - DNA, 23 bp, Homo sapiens
tatggatatatatacatatatgt

SEQ ID NO: 168115 - DNA, 18 bp, Homo sapiens
atgtgtgtatatatacgt

SEQ ID NO: 168116 - DNA, 18 bp, Homo sapiens
atctctgagcctctctct

SEQ ID NO: 168117 - DNA, 23 bp, Homo sapiens
cggagtctcgctctgtctcccag

SEQ ID NO: 168118 - DNA, 23 bp, Homo sapiens
gttgagacccacagtttgaaaag

SEQ ID NO: 168119 - DNA, 22 bp, Homo sapiens
tcagtctgtctccataactcgt

SEQ ID NO: 168120 - DNA, 21 bp, Homo sapiens
ttttctgtcttgtaggtttga

SEQ ID NO: 168121 - DNA, 23 bp, Homo sapiens
gccggagtctcgctctgtctctc

SEQ ID NO: 168122 - DNA, 18 bp, Homo sapiens
gcctcagtgactggatgg

SEQ ID NO: 168123 - DNA, 23 bp, Homo sapiens
gccagagtctcgctctgtcaccc

SEQ ID NO: 168124 - DNA, 20 bp, Homo sapiens
tggagtctcactctgtcacc

SEQ ID NO: 168125 - DNA, 23 bp, Homo sapiens
tccagggtagaaagaaagagaca

SEQ ID NO: 168126 - DNA, 23 bp, Homo sapiens
actcaaagagcaatggctgtact

SEQ ID NO: 168127 - DNA, 23 bp, Homo sapiens
atgtgtgtatatgtatgtgtgtg

SEQ ID NO: 168128 - DNA, 21 bp, Homo sapiens
atatatatagatggatagaga

SEQ ID NO: 168129 - DNA, 23 bp, Homo sapiens
gggtgtctgtctgtctgtctgca

SEQ ID NO: 168130 - DNA, 18 bp, Homo sapiens
tctagatgttgcttgaag

SEQ ID NO: 168131 - DNA, 21 bp, Homo sapiens
taaactctatatagaggggct

SEQ ID NO: 168132 - DNA, 23 bp, Homo sapiens
gctgtctggctgtctctctctgt

SEQ ID NO: 168133 - DNA, 23 bp, Homo sapiens
attcacagcaggaggtggtggtg

SEQ ID NO: 168134 - DNA, 23 bp, Homo sapiens
tggagtctcactctgtcacccag

SEQ ID NO: 168135 - DNA, 23 bp, Homo sapiens
ggagtctcactctgtcacccaag

SEQ ID NO: 168136 - DNA, 18 bp, Homo sapiens
gatttgatttccagggtt

SEQ ID NO: 168137 - DNA, 23 bp, Homo sapiens
gacagactctgtgactgcctcat

SEQ ID NO: 168138 - DNA, 23 bp, Homo sapiens
tatgtgtacatatgtttgtgtgg

SEQ ID NO: 168139 - DNA, 23 bp, Homo sapiens
gtgtatgtgtgcatgtgcttgtg

SEQ ID NO: 168140 - DNA, 23 bp, Homo sapiens
gcagtgtatgcatgtatatgtgt

SEQ ID NO: 168141 - DNA, 23 bp, Homo sapiens
tgtgtccgtgtgtgcctgcatct

SEQ ID NO: 168142 - DNA, 19 bp, Homo sapiens
agagccaaactgtatcttt

SEQ ID NO: 168143 - DNA, 21 bp, Homo sapiens
tgagatggagtctcactctgt

SEQ ID NO: 168144 - DNA, 19 bp, Homo sapiens
cggagaccagctggtccac

SEQ ID NO: 168145 - DNA, 18 bp, Homo sapiens
tctctttctctggctgat

SEQ ID NO: 168146 - DNA, 23 bp, Homo sapiens
ctcactctctcatgctgtcccac

SEQ ID NO: 168147 - DNA, 22 bp, Homo sapiens
cattgcactccagcctgggaga

SEQ ID NO: 168148 - DNA, 23 bp, Homo sapiens
ctgcctgcctgtctgcctgtttg

SEQ ID NO: 168149 - DNA, 22 bp, Homo sapiens
gctgagatctctctctgcctcc

SEQ ID NO: 168150 - DNA, 23 bp, Homo sapiens
ggctccctgtgtgagtgagtgca

SEQ ID NO: 168151 - DNA, 23 bp, Homo sapiens
tgtggctggctccctgggtgccc

SEQ ID NO: 168152 - DNA, 20 bp, Homo sapiens
ctgtgggtctctcagtttct

SEQ ID NO: 168153 - DNA, 23 bp, Homo sapiens
accctctctggctgagtgacctg

SEQ ID NO: 168154 - DNA, 19 bp, Homo sapiens
gtctcactctgtcacccag

SEQ ID NO: 168155 - DNA, 22 bp, Homo sapiens
tgcagactggcatagttctgga

SEQ ID NO: 168156 - DNA, 23 bp, Homo sapiens
gagacacagtctcgctctgtcac

SEQ ID NO: 168157 - DNA, 21 bp, Homo sapiens
atgcaggcggtgaatgcgtag

SEQ ID NO: 168158 - DNA, 23 bp, Homo sapiens
tccctcactgagtcacttgatcc

SEQ ID NO: 168159 - DNA, 20 bp, Homo sapiens
tacagatgtgaaattgttgt

SEQ ID NO: 168160 - DNA, 23 bp, Homo sapiens
ttaaggcaggtaaagtattcaat

SEQ ID NO: 168161 - DNA, 21 bp, Homo sapiens
tgactcccacagcccctccct

SEQ ID NO: 168162 - DNA, 23 bp, Homo sapiens
gacaagagtctcactctctggcc

SEQ ID NO: 168163 - DNA, 23 bp, Homo sapiens
ctctctcacactcttatcccaag

SEQ ID NO: 168164 - DNA, 19 bp, Homo sapiens
agggaagaagatggcgatg

SEQ ID NO: 168165 - DNA, 18 bp, Homo sapiens
actgcctgcgtgcctgaa

SEQ ID NO: 168166 - DNA, 23 bp, Homo sapiens
tctgtttctatgtgtctctgaat

SEQ ID NO: 168167 - DNA, 23 bp, Homo sapiens
ctgagtctcactctgtcatccag

SEQ ID NO: 168168 - DNA, 23 bp, Homo sapiens
agtctcaggctccctgtctgtaa

SEQ ID NO: 168169 - DNA, 21 bp, Homo sapiens
tgggtctggctgttctctctg

SEQ ID NO: 168170 - DNA, 23 bp, Homo sapiens
ctgggagaccatcagcttctggt

SEQ ID NO: 168171 - DNA, 23 bp, Homo sapiens
ctgtctccttctctcactgggtc

SEQ ID NO: 168172 - DNA, 21 bp, Homo sapiens
actgcagtgagctatgattgt

SEQ ID NO: 168173 - DNA, 23 bp, Homo sapiens
actcttggttcttatttgcaaag

SEQ ID NO: 168174 - DNA, 23 bp, Homo sapiens
gagtctcactctgtcacccaggc

SEQ ID NO: 168175 - DNA, 18 bp, Homo sapiens
tgagacagagtctcactc

SEQ ID NO: 168176 - DNA, 23 bp, Homo sapiens
agagtctcactctgtcacctaga

SEQ ID NO: 168177 - DNA, 21 bp, Homo sapiens
gggtacagtggtgtgatctca

SEQ ID NO: 168178 - DNA, 23 bp, Homo sapiens
gtgaactgaatttgttaaagtga

SEQ ID NO: 168179 - DNA, 22 bp, Homo sapiens
tgagtctcactctgtcgcacag

SEQ ID NO: 168180 - DNA, 23 bp, Homo sapiens
tatccagaggtagaatatacata

SEQ ID NO: 168181 - DNA, 21 bp, Homo sapiens
tgtgtgtgtatatgtgtgtat

SEQ ID NO: 168182 - DNA, 23 bp, Homo sapiens
aatctcagtcctgattctgtctc

SEQ ID NO: 168183 - DNA, 23 bp, Homo sapiens
agagagaatagactgggcacagt

SEQ ID NO: 168184 - DNA, 21 bp, Homo sapiens
tgaaactgctttcccacctgt

SEQ ID NO: 168185 - DNA, 23 bp, Homo sapiens
gcctccctgtctgcctgagcagt

SEQ ID NO: 168186 - DNA, 23 bp, Homo sapiens
tgtctgtgtctgtgtctgtgtct

SEQ ID NO: 168187 - DNA, 18 bp, Homo sapiens
tcaggaggcagagagcag

SEQ ID NO: 168188 - DNA, 23 bp, Homo sapiens
agaccgagtctcactctgtcacc

SEQ ID NO: 168189 - DNA, 23 bp, Homo sapiens
cggagtctcgctctgtcacccgg

SEQ ID NO: 168190 - DNA, 23 bp, Homo sapiens
tgtgtctctgtgactgccatgtt

SEQ ID NO: 168191 - DNA, 23 bp, Homo sapiens
ggtgcattgtagttgcattgcat

SEQ ID NO: 168192 - DNA, 23 bp, Homo sapiens
gggtccctctctctggcactgtg

SEQ ID NO: 168193 - DNA, 22 bp, Homo sapiens
tgtctcacactcatagtcccag

SEQ ID NO: 168194 - DNA, 22 bp, Homo sapiens
agacagagcgaattctatctca

SEQ ID NO: 168195 - DNA, 22 bp, Homo sapiens
atggagtctcactctgtcaccc

SEQ ID NO: 168196 - DNA, 23 bp, Homo sapiens
gacacagagtctcactctgtcac

SEQ ID NO: 168197 - DNA, 23 bp, Homo sapiens
gacagagtctcgctctgtcaccc

SEQ ID NO: 168198 - DNA, 23 bp, Homo sapiens
ggagtctcactctgtcacccagg

SEQ ID NO: 168199 - DNA, 18 bp, Homo sapiens
ctgtccctctctcagtgg

SEQ ID NO: 168200 - DNA, 22 bp, Homo sapiens
ctgggtcagtcactggcactct

SEQ ID NO: 168201 - DNA, 23 bp, Homo sapiens
gagtctcactctgtcacccaggc

SEQ ID NO: 168202 - DNA, 18 bp, Homo sapiens
agtcctggagtctctctc

SEQ ID NO: 168203 - DNA, 23 bp, Homo sapiens
tgacactgtctgtgtgtggctca

SEQ ID NO: 168204 - DNA, 23 bp, Homo sapiens
aagagagttgaagaacctctgga

SEQ ID NO: 168205 - DNA, 23 bp, Homo sapiens
tatgtgtgtatatatatgtgtgt

SEQ ID NO: 168206 - DNA, 23 bp, Homo sapiens
acagccacactcacgccctgtct

SEQ ID NO: 168207 - DNA, 21 bp, Homo sapiens
gcctgtcactctcagtcactc

SEQ ID NO: 168208 - DNA, 22 bp, Homo sapiens
gctgtgtgtctgtctgtgtcca

SEQ ID NO: 168209 - DNA, 23 bp, Homo sapiens
ctgtgtgtctgtctgtgtccacc

SEQ ID NO: 168210 - DNA, 23 bp, Homo sapiens
agagtctcactctgtcacccagg

SEQ ID NO: 168211 - DNA, 21 bp, Homo sapiens
gggtctctctctgtggctcag

SEQ ID NO: 168212 - DNA, 23 bp, Homo sapiens
gtcggtgggtctctccctgtgtg

SEQ ID NO: 168213 - DNA, 22 bp, Homo sapiens
aagagaagtgaaagaaagctga

SEQ ID NO: 168214 - DNA, 21 bp, Homo sapiens
ctcagcctctgtgtggctctg

SEQ ID NO: 168215 - DNA, 23 bp, Homo sapiens
tgtgtgtctctgtgtccaaatgt

SEQ ID NO: 168216 - DNA, 23 bp, Homo sapiens
ggacgtggtcatgttggattaga

SEQ ID NO: 168217 - DNA, 23 bp, Homo sapiens
atgtatgtatatgtgtatgtgtg

SEQ ID NO: 168218 - DNA, 21 bp, Homo sapiens
gtatctgtagtcccagctact

SEQ ID NO: 168219 - DNA, 18 bp, Homo sapiens
tgaggttgcagtgagcca

SEQ ID NO: 168220 - DNA, 23 bp, Homo sapiens
tctccctctctgagccttagttg

SEQ ID NO: 168221 - DNA, 22 bp, Homo sapiens
ttgagtctcactctgtcaccca

SEQ ID NO: 168222 - DNA, 23 bp, Homo sapiens
gagcctgggtccctccatccgtc

SEQ ID NO: 168223 - DNA, 21 bp, Homo sapiens
ttgagtggagacagagatgag

SEQ ID NO: 168224 - DNA, 18 bp, Homo sapiens
tttcagctggcatttgta

SEQ ID NO: 168225 - DNA, 23 bp, Homo sapiens
tggaaggtcactgagcgaggaca

SEQ ID NO: 168226 - DNA, 23 bp, Homo sapiens
tgtgtcactgcgactcagtctcc

SEQ ID NO: 168227 - DNA, 23 bp, Homo sapiens
agcctctgtgagtctcaggtccc

SEQ ID NO: 168228 - DNA, 22 bp, Homo sapiens
tgagctccttctgtatgccact

SEQ ID NO: 168229 - DNA, 22 bp, Homo sapiens
tgtgccagtagtctcagctgct

SEQ ID NO: 168230 - DNA, 23 bp, Homo sapiens
ttttcacagttaaacttttctaa

SEQ ID NO: 168231 - DNA, 23 bp, Homo sapiens
ctctgtgtgagtcagaccccctc

SEQ ID NO: 168232 - DNA, 23 bp, Homo sapiens
ccgtctgtctgcctcacttgctc

SEQ ID NO: 168233 - DNA, 22 bp, Homo sapiens
tgaggtagtaggttgtatagtt

SEQ ID NO: 168234 - DNA, 23 bp, Homo sapiens
acaatctactgtctttcctgaag

SEQ ID NO: 168235 - DNA, 23 bp, Homo sapiens
ctcttgactcagtttgttcttgt

SEQ ID NO: 168236 - DNA, 23 bp, Homo sapiens
gtgatctgactgcctgtgtacac

SEQ ID NO: 168237 - DNA, 23 bp, Homo sapiens
acactgtgaacagcaccatcact

SEQ ID NO: 168238 - DNA, 23 bp, Homo sapiens
ggagtctcactctgtctcccagg

SEQ ID NO: 168239 - DNA, 23 bp, Homo sapiens
ggacagaagtgactgtgttgatc

SEQ ID NO: 168240 - DNA, 23 bp, Homo sapiens
tttgagacggactctcactctgt

SEQ ID NO: 168241 - DNA, 23 bp, Homo sapiens
agagtctcactctgtcacccagg

SEQ ID NO: 168242 - DNA, 23 bp, Homo sapiens
agcctctgtctctgtgtttgagc

SEQ ID NO: 168243 - DNA, 18 bp, Homo sapiens
tagacagtggtagttaac

SEQ ID NO: 168244 - DNA, 23 bp, Homo sapiens
acagcgtctcagtctgtctcacc

SEQ ID NO: 168245 - DNA, 18 bp, Homo sapiens
cacatgaaggtgttcacc

SEQ ID NO: 168246 - DNA, 21 bp, Homo sapiens
tgtgtgcttatgtatatatct

SEQ ID NO: 168247 - DNA, 23 bp, Homo sapiens
tctgagtctcactttcctcacct

SEQ ID NO: 168248 - DNA, 23 bp, Homo sapiens
acagggtctctgtcgctctgtcg

SEQ ID NO: 168249 - DNA, 23 bp, Homo sapiens
ctgagctctctctctgtgtggct

SEQ ID NO: 168250 - DNA, 19 bp, Homo sapiens
cacagaccacagtgagctg

SEQ ID NO: 168251 - DNA, 19 bp, Homo sapiens
cagggactcacagccactc

SEQ ID NO: 168252 - DNA, 20 bp, Homo sapiens
tgtgcagaaccatcactgtt

SEQ ID NO: 168253 - DNA, 23 bp, Homo sapiens
gctgtgtctgtgcatatgagtgt

SEQ ID NO: 168254 - DNA, 23 bp, Homo sapiens
tatgtgcattatgtttggggtgt

SEQ ID NO: 168255 - DNA, 23 bp, Homo sapiens
tgagagagcacacacagcccctc

SEQ ID NO: 168256 - DNA, 23 bp, Homo sapiens
tatggatgtatgtatatatgtgt

SEQ ID NO: 168257 - DNA, 23 bp, Homo sapiens
cacatgtttatgtatgtttatac

SEQ ID NO: 168258 - DNA, 19 bp, Homo sapiens
ttatacttcttgaagttca

SEQ ID NO: 168259 - DNA, 20 bp, Homo sapiens
tgagcttcttggatgtttag

SEQ ID NO: 168260 - DNA, 23 bp, Homo sapiens
gctgtgtgcatgtgtgtgtgcgt

SEQ ID NO: 168261 - DNA, 23 bp, Homo sapiens
tgacagagcatcaggatctgcaa

SEQ ID NO: 168262 - DNA, 21 bp, Homo sapiens
agggtggaagcctgttgctac

SEQ ID NO: 168263 - DNA, 23 bp, Homo sapiens
aaggttgtctgcttctcaacctg

SEQ ID NO: 168264 - DNA, 23 bp, Homo sapiens
aaggtctcactctgtcacccagg

SEQ ID NO: 168265 - DNA, 23 bp, Homo sapiens
cagctgactctgtctctatcacc

SEQ ID NO: 168266 - DNA, 21 bp, Homo sapiens
ctatagatacgtgtttgtgag

SEQ ID NO: 168267 - DNA, 23 bp, Homo sapiens
gtgtgtgcctgtgtgtgtgcctg

SEQ ID NO: 168268 - DNA, 23 bp, Homo sapiens
gggcgtccctctgtgcctgtctg

SEQ ID NO: 168269 - DNA, 20 bp, Homo sapiens
atctgtgtatatgtatatat

SEQ ID NO: 168270 - DNA, 23 bp, Homo sapiens
tgagttcattgtagattctggat

SEQ ID NO: 168271 - DNA, 23 bp, Homo sapiens
tgagttcattgtagattctggat

SEQ ID NO: 168272 - DNA, 23 bp, Homo sapiens
agtgtaactgcatctccaggtcc

SEQ ID NO: 168273 - DNA, 18 bp, Homo sapiens
tggagtgagtgtatgcag

SEQ ID NO: 168274 - DNA, 23 bp, Homo sapiens
tgagatgcagtctcactctgtca

SEQ ID NO: 168275 - DNA, 23 bp, Homo sapiens
ctcagtcacattgtgttttcctt

SEQ ID NO: 168276 - DNA, 22 bp, Homo sapiens
ctctccgtgtgtctgtgcgtga

SEQ ID NO: 168277 - DNA, 20 bp, Homo sapiens
gcatgagctaaccgagcagc

SEQ ID NO: 168278 - DNA, 20 bp, Homo sapiens
agacaggaagaagatcagtg

SEQ ID NO: 168279 - DNA, 22 bp, Homo sapiens
gccagcctgcctgtgagcctct

SEQ ID NO: 168280 - DNA, 23 bp, Homo sapiens
gacagagtctcgctctgtcaccc

SEQ ID NO: 168281 - DNA, 23 bp, Homo sapiens
cggagtctcgctctgtcactcag

SEQ ID NO: 168282 - DNA, 23 bp, Homo sapiens
ctacacagtggcactgttcgtat

SEQ ID NO: 168283 - DNA, 23 bp, Homo sapiens
agacagtctcactctgtcgccca

SEQ ID NO: 168284 - DNA, 22 bp, Homo sapiens
gagtctcactctgtcaaccagg

SEQ ID NO: 168285 - DNA, 23 bp, Homo sapiens
ctctgttctgtgtgggtcagggt

SEQ ID NO: 168286 - DNA, 18 bp, Homo sapiens
gtggctgtgagaggctct

SEQ ID NO: 168287 - DNA, 21 bp, Homo sapiens
actctcagtgacacacttggg

SEQ ID NO: 168288 - DNA, 21 bp, Homo sapiens
tgagccactgtgcctggctgt

SEQ ID NO: 168289 - DNA, 23 bp, Homo sapiens
tgagtctgactctgtcgctcagg

SEQ ID NO: 168290 - DNA, 20 bp, Homo sapiens
tgtgcccaaggtggtcagag

SEQ ID NO: 168291 - DNA, 23 bp, Homo sapiens
gacagagtctcgctctgtcgccc

SEQ ID NO: 168292 - DNA, 23 bp, Homo sapiens
aggctgaggtaggaggatcactt

SEQ ID NO: 168293 - DNA, 20 bp, Homo sapiens
tcactccgtgtctgtgtgtc

SEQ ID NO: 168294 - DNA, 23 bp, Homo sapiens
gggggacgtctctgacagtcact

SEQ ID NO: 168295 - DNA, 23 bp, Homo sapiens
caggctgcctctctgcctgttac

SEQ ID NO: 168296 - DNA, 20 bp, Homo sapiens
tgtcacagagcaagtcttgt

SEQ ID NO: 168297 - DNA, 20 bp, Homo sapiens
tgtcacagagcaagtcttgt

SEQ ID NO: 168298 - DNA, 22 bp, Homo sapiens
gtgtacctcactctgtgtgtct

SEQ ID NO: 168299 - DNA, 23 bp, Homo sapiens
tgacagatcagtgtctcatgagg

SEQ ID NO: 168300 - DNA, 23 bp, Homo sapiens
tcctggttcactgatcagtgtct

SEQ ID NO: 168301 - DNA, 23 bp, Homo sapiens
tcactgatcagtgtctggtgagg

SEQ ID NO: 168302 - DNA, 21 bp, Homo sapiens
ttcacagatcagtgtctggtg

SEQ ID NO: 168303 - DNA, 23 bp, Homo sapiens
actgagtctcgctctgtcatcca

SEQ ID NO: 168304 - DNA, 23 bp, Homo sapiens
ttgaactcagtctctgtgacata

SEQ ID NO: 168305 - DNA, 23 bp, Homo sapiens
acactctgaccctcagactccag

SEQ ID NO: 168306 - DNA, 23 bp, Homo sapiens
gggctgtctctgtctctgtccct

SEQ ID NO: 168307 - DNA, 21 bp, Homo sapiens
atcggtgtgtgcatgtgtgtg

SEQ ID NO: 168308 - DNA, 22 bp, Homo sapiens
ctctcactgactccatggggaa

SEQ ID NO: 168309 - DNA, 18 bp, Homo sapiens
tatctgtgtatacacatg

SEQ ID NO: 168310 - DNA, 21 bp, Homo sapiens
atacacagatatgtatacgta

SEQ ID NO: 168311 - DNA, 23 bp, Homo sapiens
atatgtgtatatgtatgtatatg

SEQ ID NO: 168312 - DNA, 23 bp, Homo sapiens
cagacacagctcatcttttcttt

SEQ ID NO: 168313 - DNA, 20 bp, Homo sapiens
atgtgtgtatatatgtgtgt

SEQ ID NO: 168314 - DNA, 20 bp, Homo sapiens
atatatgtgtgtatatatgt

SEQ ID NO: 168315 - DNA, 23 bp, Homo sapiens
gcctgtgtctctcactccgtgcc

SEQ ID NO: 168316 - DNA, 23 bp, Homo sapiens
ggagtgtgactgtgtgtgtgtgg

SEQ ID NO: 168317 - DNA, 23 bp, Homo sapiens
gagtcacacacacatactacagt

SEQ ID NO: 168318 - DNA, 23 bp, Homo sapiens
gattgcttgaactcactgggcag

SEQ ID NO: 168319 - DNA, 19 bp, Homo sapiens
gtcagttctgagttcgttt

SEQ ID NO: 168320 - DNA, 23 bp, Homo sapiens
tgtgtggctctctgaggctgtca

SEQ ID NO: 168321 - DNA, 19 bp, Homo sapiens
actctcccacactgttaca

SEQ ID NO: 168322 - DNA, 18 bp, Homo sapiens
tcagcaatattctgtttc

SEQ ID NO: 168323 - DNA, 22 bp, Homo sapiens
tgagacagagtcttgctctgtc

SEQ ID NO: 168324 - DNA, 23 bp, Homo sapiens
tctgactcacacactggctttgc

SEQ ID NO: 168325 - DNA, 23 bp, Homo sapiens
gtttttttctagatgtgatggga

SEQ ID NO: 168326 - DNA, 21 bp, Homo sapiens
ttttgagacggaatctcgctg

SEQ ID NO: 168327 - DNA, 23 bp, Homo sapiens
tgagacagaaatgactgcagaca

SEQ ID NO: 168328 - DNA, 21 bp, Homo sapiens
taagtctgtcattttctctct

SEQ ID NO: 168329 - DNA, 23 bp, Homo sapiens
ctcactatctgacagttctggag

SEQ ID NO: 168330 - DNA, 23 bp, Homo sapiens
cggagtctcgctctgtctcccag

SEQ ID NO: 168331 - DNA, 23 bp, Homo sapiens
tatgacaagagatacaggtctag

SEQ ID NO: 168332 - DNA, 23 bp, Homo sapiens
aagaagcacttagttaaattgga

SEQ ID NO: 168333 - DNA, 23 bp, Homo sapiens
ttctgtgtatatatattccgtat

SEQ ID NO: 168334 - DNA, 21 bp, Homo sapiens
actgcactgttctctcgatct

SEQ ID NO: 168335 - DNA, 21 bp, Homo sapiens
atatgtatatatgtatatgtg

SEQ ID NO: 168336 - DNA, 18 bp, Homo sapiens
acatatatatgtatatgt

SEQ ID NO: 168337 - DNA, 18 bp, Homo sapiens
atatatatgtatatgtgt

SEQ ID NO: 168338 - DNA, 20 bp, Homo sapiens
acatatatatgtatatgtgt

SEQ ID NO: 168339 - DNA, 18 bp, Homo sapiens
acatatatatgtatatgt

SEQ ID NO: 168340 - DNA, 19 bp, Homo sapiens
catatatatgtatatgtgt

SEQ ID NO: 168341 - DNA, 23 bp, Homo sapiens
tggcagcgtgcttttctggaact

SEQ ID NO: 168342 - DNA, 23 bp, Homo sapiens
agacagtcttgctctgtctccca

SEQ ID NO: 168343 - DNA, 23 bp, Homo sapiens
tgtgtctgagtgtgtcttatggc

SEQ ID NO: 168344 - DNA, 19 bp, Homo sapiens
aatgtattttttataagga

SEQ ID NO: 168345 - DNA, 18 bp, Homo sapiens
ttgagacatggtcttgtt

SEQ ID NO: 168346 - DNA, 23 bp, Homo sapiens
tggagtctcactctgtcacccag

SEQ ID NO: 168347 - DNA, 22 bp, Homo sapiens
tgagatggagtttcgctcttgt

SEQ ID NO: 168348 - DNA, 23 bp, Homo sapiens
gtgatgtactagattgtttagtg

SEQ ID NO: 168349 - DNA, 23 bp, Homo sapiens
aactgcaacctctggtccaggag

SEQ ID NO: 168350 - DNA, 22 bp, Homo sapiens
agtaggttgtatagttatcttc

SEQ ID NO: 168351 - DNA, 23 bp, Homo sapiens
agggggagacaaaatgatctctc

SEQ ID NO: 168352 - DNA, 23 bp, Homo sapiens
acagaaaagtgattatgttcttg

SEQ ID NO: 168353 - DNA, 18 bp, Homo sapiens
tgtgtgtatatatatgtg

SEQ ID NO: 168354 - DNA, 23 bp, Homo sapiens
tctctgcctgagtctcatgtctc

SEQ ID NO: 168355 - DNA, 22 bp, Homo sapiens
ttccaagtagaacagcctgtct

SEQ ID NO: 168356 - DNA, 21 bp, Homo sapiens
aagaggagctgggagagcaga

SEQ ID NO: 168357 - DNA, 21 bp, Homo sapiens
atagtccatagaatttgaaat

SEQ ID NO: 168358 - DNA, 23 bp, Homo sapiens
ttttgagacacagtctcgctctg

SEQ ID NO: 168359 - DNA, 23 bp, Homo sapiens
caccactctgtcactctgtcacc

SEQ ID NO: 168360 - DNA, 23 bp, Homo sapiens
tggtgtgatcttggctcactgtg

SEQ ID NO: 168361 - DNA, 18 bp, Homo sapiens
tcactgcaacctctctct

SEQ ID NO: 168362 - DNA, 23 bp, Homo sapiens
caactctgcctctgtcactgctc

SEQ ID NO: 168363 - DNA, 20 bp, Homo sapiens
cactcagtgagtcaccgcca

SEQ ID NO: 168364 - DNA, 18 bp, Homo sapiens
tgtcatggagtgggaggc

SEQ ID NO: 168365 - DNA, 19 bp, Homo sapiens
tcagctctgtctctctgag

SEQ ID NO: 168366 - DNA, 23 bp, Homo sapiens
agatggagtctcactctgtcacc

SEQ ID NO: 168367 - DNA, 23 bp, Homo sapiens
acagcccctgtgtctctgtctct

SEQ ID NO: 168368 - DNA, 23 bp, Homo sapiens
tctgtgcctcagtggctccctct

SEQ ID NO: 168369 - DNA, 21 bp, Homo sapiens
cttctcactcactgtcagccg

SEQ ID NO: 168370 - DNA, 23 bp, Homo sapiens
tgtctgactctgtgggaccctca

SEQ ID NO: 168371 - DNA, 21 bp, Homo sapiens
atcaaggcactggcagatgtg

SEQ ID NO: 168372 - DNA, 23 bp, Homo sapiens
tgatctctcctacctctttcact

SEQ ID NO: 168373 - DNA, 23 bp, Homo sapiens
tttctcaccctctctcagggcct

SEQ ID NO: 168374 - DNA, 23 bp, Homo sapiens
aacaaatgtaaagatgcagtact

SEQ ID NO: 168375 - DNA, 23 bp, Homo sapiens
tagtctcgctctgtcaccaggct

SEQ ID NO: 168376 - DNA, 20 bp, Homo sapiens
tgtctgaacacagagctcag

SEQ ID NO: 168377 - DNA, 23 bp, Homo sapiens
tatgtgcatatgtatgtgaatgt

SEQ ID NO: 168378 - DNA, 23 bp, Homo sapiens
tgtgagtacatgcatgtgtgtgt

SEQ ID NO: 168379 - DNA, 23 bp, Homo sapiens
ctctctgtcactgtcactataga

SEQ ID NO: 168380 - DNA, 23 bp, Homo sapiens
tcatacagtggtagtcttttgtg

SEQ ID NO: 168381 - DNA, 23 bp, Homo sapiens
agggtctcactctgtcacccagg

SEQ ID NO: 168382 - DNA, 21 bp, Homo sapiens
tggtgtgatcttggctcactg

SEQ ID NO: 168383 - DNA, 23 bp, Homo sapiens
gggtctcactctgtcacccaggc

SEQ ID NO: 168384 - DNA, 23 bp, Homo sapiens
gggtctcactctgtcacccaggc

SEQ ID NO: 168385 - DNA, 23 bp, Homo sapiens
tggagtctcactctgtcacccag

SEQ ID NO: 168386 - DNA, 23 bp, Homo sapiens
ttgagatggagtcttgctctgtc

SEQ ID NO: 168387 - DNA, 23 bp, Homo sapiens
agacagagtctgtctctgtcacc

SEQ ID NO: 168388 - DNA, 23 bp, Homo sapiens
tgtgtatatatgtatatatgtgt

SEQ ID NO: 168389 - DNA, 23 bp, Homo sapiens
atatgtgtgtatatatatatgtg

SEQ ID NO: 168390 - DNA, 22 bp, Homo sapiens
acacagtcactcacatgtgttg

SEQ ID NO: 168391 - DNA, 23 bp, Homo sapiens
ggagtctcactctgtcacccagg

SEQ ID NO: 168392 - DNA, 22 bp, Homo sapiens
ttttgagatggagtctcactct

SEQ ID NO: 168393 - DNA, 23 bp, Homo sapiens
gacggagtctcactctgacaccc

SEQ ID NO: 168394 - DNA, 23 bp, Homo sapiens
accttttctgtatgtgaaaaggc

SEQ ID NO: 168395 - DNA, 20 bp, Homo sapiens
ccttctcctcgtcctcctcc

SEQ ID NO: 168396 - DNA, 23 bp, Homo sapiens
tgtgtgtgtcagtatggtgagat

SEQ ID NO: 168397 - DNA, 19 bp, Homo sapiens
ttagacaagggttattgat

SEQ ID NO: 168398 - DNA, 23 bp, Homo sapiens
ttgtttgcttttccatagtgatt

SEQ ID NO: 168399 - DNA, 23 bp, Homo sapiens
gtgttgtctggttcccactgtca

SEQ ID NO: 168400 - DNA, 22 bp, Homo sapiens
tggcagcctgcctcccagcctg

SEQ ID NO: 168401 - DNA, 23 bp, Homo sapiens
gagacagagtctcgctctgtcac

SEQ ID NO: 168402 - DNA, 21 bp, Homo sapiens
tgagacagagtctggctctgt

SEQ ID NO: 168403 - DNA, 20 bp, Homo sapiens
gccaggctccctgtttccct

SEQ ID NO: 168404 - DNA, 18 bp, Homo sapiens
agtggtggcctgtccttg

SEQ ID NO: 168405 - DNA, 20 bp, Homo sapiens
gccaggctccctgtttccct

SEQ ID NO: 168406 - DNA, 19 bp, Homo sapiens
ttgagacagagtcttgctc

SEQ ID NO: 168407 - DNA, 23 bp, Homo sapiens
gagtgtgagacactgcacttggc

SEQ ID NO: 168408 - DNA, 23 bp, Homo sapiens
acagagtctcactctgtcgccca

SEQ ID NO: 168409 - DNA, 23 bp, Homo sapiens
tgaatctcactgtggctgtgcca

SEQ ID NO: 168410 - DNA, 23 bp, Homo sapiens
tctctgtgtgcctctgttttctc

SEQ ID NO: 168411 - DNA, 23 bp, Homo sapiens
tgagatgtaaactggaaaccaca

SEQ ID NO: 168412 - DNA, 23 bp, Homo sapiens
tgagatggagtctcactctgtcg

SEQ ID NO: 168413 - DNA, 19 bp, Homo sapiens
tctctgacagtgtcagagc

SEQ ID NO: 168414 - DNA, 23 bp, Homo sapiens
cggagtctcactctgtcacccag

SEQ ID NO: 168415 - DNA, 23 bp, Homo sapiens
aggctctgtggctctgtccatgg

SEQ ID NO: 168416 - DNA, 20 bp, Homo sapiens
tattgctctgtcacccaggt

SEQ ID NO: 168417 - DNA, 23 bp, Homo sapiens
agacagagtctcactctgtcgcc

SEQ ID NO: 168418 - DNA, 23 bp, Homo sapiens
acagagtctcactctgtcgccca

SEQ ID NO: 168419 - DNA, 22 bp, Homo sapiens
tgtctcaacaacaaaaagggtg

SEQ ID NO: 168420 - DNA, 20 bp, Homo sapiens
tgagatggagtttcactctt

SEQ ID NO: 168421 - DNA, 23 bp, Homo sapiens
agagtctcactctgtcacccagg

SEQ ID NO: 168422 - DNA, 19 bp, Homo sapiens
tccttgttccactgcaacc

SEQ ID NO: 168423 - DNA, 19 bp, Homo sapiens
agttttgtgaccctccctt

SEQ ID NO: 168424 - DNA, 22 bp, Homo sapiens
atgggtctggaagatgtgtgtg

SEQ ID NO: 168425 - DNA, 23 bp, Homo sapiens
tctgcctctcaaagtattcggat

SEQ ID NO: 168426 - DNA, 23 bp, Homo sapiens
agatggagtctcactctgtcacc

SEQ ID NO: 168427 - DNA, 23 bp, Homo sapiens
cgagatggagtctcactctgtca

SEQ ID NO: 168428 - DNA, 23 bp, Homo sapiens
agggtctcactctgtcacccagg

SEQ ID NO: 168429 - DNA, 20 bp, Homo sapiens
tgagactacaggcttgcacc

SEQ ID NO: 168430 - DNA, 18 bp, Homo sapiens
ttgcctgtggttccagct

SEQ ID NO: 168431 - DNA, 21 bp, Homo sapiens
tgaggtaggaggatcacttga

SEQ ID NO: 168432 - DNA, 20 bp, Homo sapiens
catgaaagaggtttgggagt

SEQ ID NO: 168433 - DNA, 23 bp, Homo sapiens
tggagtctcactctgtcacccag

SEQ ID NO: 168434 - DNA, 20 bp, Homo sapiens
tttcggacatctacaataga

SEQ ID NO: 168435 - DNA, 23 bp, Homo sapiens
gtttttgttgatgaagttggcaa

SEQ ID NO: 168436 - DNA, 19 bp, Homo sapiens
tgagagacagatgaagggg

SEQ ID NO: 168437 - DNA, 18 bp, Homo sapiens
acgtgtatatatatatgt

SEQ ID NO: 168438 - DNA, 23 bp, Homo sapiens
gagacagagtcttgctctgtcac

SEQ ID NO: 168439 - DNA, 23 bp, Homo sapiens
cgtgtctcactctgtcgctcagg

SEQ ID NO: 168440 - DNA, 23 bp, Homo sapiens
agttaagagacagggtcttgatt

SEQ ID NO: 168441 - DNA, 21 bp, Homo sapiens
tttagcagagcacctgccctt

SEQ ID NO: 168442 - DNA, 23 bp, Homo sapiens
gacagtctcactctgtcacccag

SEQ ID NO: 168443 - DNA, 20 bp, Homo sapiens
tctcggctcactgcaacctc

SEQ ID NO: 168444 - DNA, 23 bp, Homo sapiens
acagggtgtcactctgtttccca

SEQ ID NO: 168445 - DNA, 23 bp, Homo sapiens
cacacagtctctctgggtgtcta

SEQ ID NO: 168446 - DNA, 21 bp, Homo sapiens
ttcgattcacagggtgcctta

SEQ ID NO: 168447 - DNA, 22 bp, Homo sapiens
taaatgagagtagactcaaggt

SEQ ID NO: 168448 - DNA, 20 bp, Homo sapiens
tttttagtagagatggggtc

SEQ ID NO: 168449 - DNA, 20 bp, Homo sapiens
atatgtatgtttatatatgt

SEQ ID NO: 168450 - DNA, 23 bp, Homo sapiens
ctagaatctcttgtttttcaggt

SEQ ID NO: 168451 - DNA, 23 bp, Homo sapiens
tgagatggagtctcgctctgtca

SEQ ID NO: 168452 - DNA, 21 bp, Homo sapiens
tacactttaacattacatgta

SEQ ID NO: 168453 - DNA, 23 bp, Homo sapiens
tgagttcattgtagattctggat

SEQ ID NO: 168454 - DNA, 23 bp, Homo sapiens
tgagttcattgtagattctggat

SEQ ID NO: 168455 - DNA, 23 bp, Homo sapiens
agacagagtctcgctctgtcacc

SEQ ID NO: 168456 - DNA, 23 bp, Homo sapiens
tctgtctatgtgtgtgtgtatac

SEQ ID NO: 168457 - DNA, 23 bp, Homo sapiens
tcacagaacaaacagagctgtga

SEQ ID NO: 168458 - DNA, 23 bp, Homo sapiens
tgtgtgcctgtgagcagggttcc

SEQ ID NO: 168459 - DNA, 23 bp, Homo sapiens
tgagtgtcactgcaagggctttt

SEQ ID NO: 168460 - DNA, 23 bp, Homo sapiens
ttgagatgggagtcttactctgt

SEQ ID NO: 168461 - DNA, 21 bp, Homo sapiens
agcttctgctactggttcctt

SEQ ID NO: 168462 - DNA, 23 bp, Homo sapiens
aggagtcagaagacagtgagcac

SEQ ID NO: 168463 - DNA, 23 bp, Homo sapiens
accatgtctctctctctctctcg

SEQ ID NO: 168464 - DNA, 23 bp, Homo sapiens
cctcagtcactctctctggcact

SEQ ID NO: 168465 - DNA, 23 bp, Homo sapiens
taactgagactggcttttaagtc

SEQ ID NO: 168466 - DNA, 23 bp, Homo sapiens
cccaggctcccactctgacacat

SEQ ID NO: 168467 - DNA, 23 bp, Homo sapiens
ggagtctcactctgtctcccagg

SEQ ID NO: 168468 - DNA, 23 bp, Homo sapiens
tggcactgtgtggctgagatcgg

SEQ ID NO: 168469 - DNA, 21 bp, Homo sapiens
ctgcgggtgtctctgggtgag

SEQ ID NO: 168470 - DNA, 22 bp, Homo sapiens
agagtctcgctctgtcacccag

SEQ ID NO: 168471 - DNA, 23 bp, Homo sapiens
acagagtctcgctctgtcagcca

SEQ ID NO: 168472 - DNA, 23 bp, Homo sapiens
tttgcatctcttctcatctgctt

SEQ ID NO: 168473 - DNA, 23 bp, Homo sapiens
actgagtctctcgctctcttgtc

SEQ ID NO: 168474 - DNA, 21 bp, Homo sapiens
ttgcagtggcatgatctcggc

SEQ ID NO: 168475 - DNA, 18 bp, Homo sapiens
tgagacagagtctcactc

SEQ ID NO: 168476 - DNA, 23 bp, Homo sapiens
agaggcagactctcagtctgttg

SEQ ID NO: 168477 - DNA, 21 bp, Homo sapiens
tatatgtatatgtatatgtgt

SEQ ID NO: 168478 - DNA, 20 bp, Homo sapiens
tatatgtgtatataacgtgt

SEQ ID NO: 168479 - DNA, 18 bp, Homo sapiens
tttttggtggagtctggg

SEQ ID NO: 168480 - DNA, 23 bp, Homo sapiens
acagagtgactgttttagctgaa

SEQ ID NO: 168481 - DNA, 23 bp, Homo sapiens
aagcacaacttgaattgacttgt

SEQ ID NO: 168482 - DNA, 19 bp, Homo sapiens
tctctcactgacactcccc

SEQ ID NO: 168483 - DNA, 23 bp, Homo sapiens
gacagggtctcactgtcgctcag

SEQ ID NO: 168484 - DNA, 19 bp, Homo sapiens
actctgtcatactgcttcc

SEQ ID NO: 168485 - DNA, 20 bp, Homo sapiens
tgacagtgtggtaaggaggt

SEQ ID NO: 168486 - DNA, 23 bp, Homo sapiens
tgtgtgcatgtgtatgtgtgtac

SEQ ID NO: 168487 - DNA, 23 bp, Homo sapiens
tccatctctagcgcagtctctct

SEQ ID NO: 168488 - DNA, 23 bp, Homo sapiens
gactgagtctcgctctgtcaccc

SEQ ID NO: 168489 - DNA, 19 bp, Homo sapiens
acagagtctcgctctgtca

SEQ ID NO: 168490 - DNA, 23 bp, Homo sapiens
cggagtctcactctgtcacccag

SEQ ID NO: 168491 - DNA, 23 bp, Homo sapiens
agacggagtctcactctgtcacc

SEQ ID NO: 168492 - DNA, 23 bp, Homo sapiens
agatggagtctcgctctgtcacc

SEQ ID NO: 168493 - DNA, 23 bp, Homo sapiens
ctctgtcactccctctctgctgg

SEQ ID NO: 168494 - DNA, 23 bp, Homo sapiens
cacgtctgtgagtgtctgtgtgg

SEQ ID NO: 168495 - DNA, 22 bp, Homo sapiens
gtgtgcgtgtgtgtgtggacat

SEQ ID NO: 168496 - DNA, 22 bp, Homo sapiens
gctctctgtctgtacacacaca

SEQ ID NO: 168497 - DNA, 23 bp, Homo sapiens
ttggagggaagggagctgatgtg

SEQ ID NO: 168498 - DNA, 23 bp, Homo sapiens
tgtcagtgggtctgtctgcctct

SEQ ID NO: 168499 - DNA, 18 bp, Homo sapiens
ctcactctcactgaccat

SEQ ID NO: 168500 - DNA, 23 bp, Homo sapiens
aaccagggtgcagtgggtgtttc

SEQ ID NO: 168501 - DNA, 23 bp, Homo sapiens
tcagctgtctctgtgtctgggtc

SEQ ID NO: 168502 - DNA, 23 bp, Homo sapiens
cacagtcggtgcacagtcactgt

SEQ ID NO: 168503 - DNA, 23 bp, Homo sapiens
ttgtaagttctagcagtgcatca

SEQ ID NO: 168504 - DNA, 23 bp, Homo sapiens
tccctctgtgggtcacagcaatg

SEQ ID NO: 168505 - DNA, 23 bp, Homo sapiens
tcactctacagtgtgagctccct

SEQ ID NO: 168506 - DNA, 23 bp, Homo sapiens
agactctcactctgtcacccagg

SEQ ID NO: 168507 - DNA, 23 bp, Homo sapiens
gggtctcactctgtcacccaggc

SEQ ID NO: 168508 - DNA, 18 bp, Homo sapiens
acagtggtgtgatctcag

SEQ ID NO: 168509 - DNA, 23 bp, Homo sapiens
cctctctgagcctcagtctcttc

SEQ ID NO: 168510 - DNA, 23 bp, Homo sapiens
ctctgcctgtcagtgccagtcac

SEQ ID NO: 168511 - DNA, 20 bp, Homo sapiens
caccctctgtctgcctcaca

SEQ ID NO: 168512 - DNA, 22 bp, Homo sapiens
aagtgactggatctcatggggc

SEQ ID NO: 168513 - DNA, 23 bp, Homo sapiens
tgagttcattgtagattctggat

SEQ ID NO: 168514 - DNA, 23 bp, Homo sapiens
tgagttcattgtagattctggat

SEQ ID NO: 168515 - DNA, 20 bp, Homo sapiens
tgggatggtgtaggaggctt

SEQ ID NO: 168516 - DNA, 23 bp, Homo sapiens
tgtatatatatgtacgtgtgtgt

SEQ ID NO: 168517 - DNA, 19 bp, Homo sapiens
tgtatatatatgtacgtgt

SEQ ID NO: 168518 - DNA, 19 bp, Homo sapiens
tatatatgtacgtgtgtat

SEQ ID NO: 168519 - DNA, 23 bp, Homo sapiens
atatacacacacatatacaggta

SEQ ID NO: 168520 - DNA, 23 bp, Homo sapiens
ctatttcagacaggtatgaatct

SEQ ID NO: 168521 - DNA, 23 bp, Homo sapiens
cgggctgggtttgttcatgtgcc

SEQ ID NO: 168522 - DNA, 23 bp, Homo sapiens
tacagaaagaccatctggatttg

SEQ ID NO: 168523 - DNA, 21 bp, Homo sapiens
agtgcttgctgtgattattgt

SEQ ID NO: 168524 - DNA, 22 bp, Homo sapiens
aattctgaggtagaatgtgcct

SEQ ID NO: 168525 - DNA, 20 bp, Homo sapiens
ctactttgctttttgtgttt

SEQ ID NO: 168526 - DNA, 23 bp, Homo sapiens
accattggtaaaggaaaaagtgt

SEQ ID NO: 168527 - DNA, 23 bp, Homo sapiens
tgactgcctgactgcctgcctgc

SEQ ID NO: 168528 - DNA, 21 bp, Homo sapiens
tgtgagactctgtctctggaa

SEQ ID NO: 168529 - DNA, 19 bp, Homo sapiens
tgcaacttctgccttctgg

SEQ ID NO: 168530 - DNA, 18 bp, Homo sapiens
tgaggtaggaggatcact

SEQ ID NO: 168531 - DNA, 21 bp, Homo sapiens
tctgacccactcactcactct

SEQ ID NO: 168532 - DNA, 23 bp, Homo sapiens
acagcatggtgtcagtgtgcaga

SEQ ID NO: 168533 - DNA, 19 bp, Homo sapiens
agacagagtctcactcttt

SEQ ID NO: 168534 - DNA, 23 bp, Homo sapiens
tctctgtgcctcagtttccccct

SEQ ID NO: 168535 - DNA, 23 bp, Homo sapiens
ctgtctctgatgactgtgtgctc

SEQ ID NO: 168536 - DNA, 18 bp, Homo sapiens
aacagatgtgtgtgtgta

SEQ ID NO: 168537 - DNA, 23 bp, Homo sapiens
tttgaggaagttcttgactttac

SEQ ID NO: 168538 - DNA, 23 bp, Homo sapiens
tgtgtgtgtatatatatatgtgt

SEQ ID NO: 168539 - DNA, 20 bp, Homo sapiens
tcactggcacaaatccagga

SEQ ID NO: 168540 - DNA, 23 bp, Homo sapiens
tctgtgtgtctgtctgaaatctt

SEQ ID NO: 168541 - DNA, 23 bp, Homo sapiens
agtctgtagggttttctatatac

SEQ ID NO: 168542 - DNA, 23 bp, Homo sapiens
ggactctgtgactgactgggtgg

SEQ ID NO: 168543 - DNA, 20 bp, Homo sapiens
taagcatatatgtatgtaag

SEQ ID NO: 168544 - DNA, 22 bp, Homo sapiens
aaattgtgtggtgtaggtatgt

SEQ ID NO: 168545 - DNA, 20 bp, Homo sapiens
tgcatgtatgtatgtatata

SEQ ID NO: 168546 - DNA, 21 bp, Homo sapiens
atatatgtatgcatgtgtttg

SEQ ID NO: 168547 - DNA, 18 bp, Homo sapiens
ttgtgtatatgtatatat

SEQ ID NO: 168548 - DNA, 21 bp, Homo sapiens
ttgtgtgtgtatatatatgtg

SEQ ID NO: 168549 - DNA, 19 bp, Homo sapiens
taaatgtatatctatatgt

SEQ ID NO: 168550 - DNA, 22 bp, Homo sapiens
atatgtgtatatatatatatgt

SEQ ID NO: 168551 - DNA, 22 bp, Homo sapiens
gtatgtatgtatgtatgtattt

SEQ ID NO: 168552 - DNA, 19 bp, Homo sapiens
tcacagcctggttcctttc

SEQ ID NO: 168553 - DNA, 21 bp, Homo sapiens
tttgagatggagccttgctct

SEQ ID NO: 168554 - DNA, 23 bp, Homo sapiens
gttgatcaagctcctactgtgtg

SEQ ID NO: 168555 - DNA, 20 bp, Homo sapiens
tcgttccctctctctgtcac

SEQ ID NO: 168556 - DNA, 20 bp, Homo sapiens
actgttatgggttgaattct

SEQ ID NO: 168557 - DNA, 19 bp, Homo sapiens
aggtagtaattagcatgct

SEQ ID NO: 168558 - DNA, 23 bp, Homo sapiens
ttctttctctgggtgagtcagtg

SEQ ID NO: 168559 - DNA, 23 bp, Homo sapiens
ttttttggttccatatgaaattt

SEQ ID NO: 168560 - DNA, 22 bp, Homo sapiens
tctgcaaattcttaatcactgt

SEQ ID NO: 168561 - DNA, 22 bp, Homo sapiens
ttattgtggttttgatatgcat

SEQ ID NO: 168562 - DNA, 23 bp, Homo sapiens
tgtgactctctctttgtattcac

SEQ ID NO: 168563 - DNA, 19 bp, Homo sapiens
atgtgagatgtatacacac

SEQ ID NO: 168564 - DNA, 22 bp, Homo sapiens
tccaagacaattgtttttgttg

SEQ ID NO: 168565 - DNA, 23 bp, Homo sapiens
ttgagtcagagtctcactgtgtc

SEQ ID NO: 168566 - DNA, 22 bp, Homo sapiens
cctcagtgtctttgtctgtcaa

SEQ ID NO: 168567 - DNA, 23 bp, Homo sapiens
gttctgtctgtctctcagcccaa

SEQ ID NO: 168568 - DNA, 19 bp, Homo sapiens
tgagcatagatggaagcac

SEQ ID NO: 168569 - DNA, 18 bp, Homo sapiens
tgaggaatgacattggtg

SEQ ID NO: 168570 - DNA, 23 bp, Homo sapiens
agatggagtctcgctctgtcacc

SEQ ID NO: 168571 - DNA, 22 bp, Homo sapiens
ggagtctcactctgtcgctggg

SEQ ID NO: 168572 - DNA, 21 bp, Homo sapiens
tgagatggagtctcactctgt

SEQ ID NO: 168573 - DNA, 20 bp, Homo sapiens
agagcagaaggaagagagag

SEQ ID NO: 168574 - DNA, 23 bp, Homo sapiens
ccctcactgggtccctgtctgtg

SEQ ID NO: 168575 - DNA, 18 bp, Homo sapiens
tttgagtgaggttttttt

SEQ ID NO: 168576 - DNA, 23 bp, Homo sapiens
taactgctacttcaaaatggtct

SEQ ID NO: 168577 - DNA, 23 bp, Homo sapiens
agtcttgctctgtctcccagact

SEQ ID NO: 168578 - DNA, 23 bp, Homo sapiens
gtcctcagtaatgttgctgattc

SEQ ID NO: 168579 - DNA, 23 bp, Homo sapiens
gtctgtctgtctgtctgtctgtg

SEQ ID NO: 168580 - DNA, 20 bp, Homo sapiens
tatagatatatatgtataca

SEQ ID NO: 168581 - DNA, 23 bp, Homo sapiens
ttctcacttgtctcagagtcacc

SEQ ID NO: 168582 - DNA, 23 bp, Homo sapiens
tgcatcaggatatagtttctgtt

SEQ ID NO: 168583 - DNA, 23 bp, Homo sapiens
tgtgtgcatgtgtgtgtgtgtat

SEQ ID NO: 168584 - DNA, 23 bp, Homo sapiens
tcagttcactgcaacctctgcct

SEQ ID NO: 168585 - DNA, 23 bp, Homo sapiens
ccaagtctcgctctgtcacccag

SEQ ID NO: 168586 - DNA, 23 bp, Homo sapiens
tgagagggagtctcgctctgtca

SEQ ID NO: 168587 - DNA, 23 bp, Homo sapiens
tgtaacttggttatgaaatgtta

SEQ ID NO: 168588 - DNA, 18 bp, Homo sapiens
cagtggcatgataatgtc

SEQ ID NO: 168589 - DNA, 22 bp, Homo sapiens
gttgcagtgagctgacagcgcg

SEQ ID NO: 168590 - DNA, 23 bp, Homo sapiens
agtctcactctgtccctctggct

SEQ ID NO: 168591 - DNA, 22 bp, Homo sapiens
gacaggctctcactctgtcatc

SEQ ID NO: 168592 - DNA, 20 bp, Homo sapiens
cgtctgtcttaggtgctcca

SEQ ID NO: 168593 - DNA, 20 bp, Homo sapiens
ctcagaacacacagtggaca

SEQ ID NO: 168594 - DNA, 23 bp, Homo sapiens
agcaggacagtctctatagtgac

SEQ ID NO: 168595 - DNA, 23 bp, Homo sapiens
tgtctgtgtggaagggagtagac

SEQ ID NO: 168596 - DNA, 22 bp, Homo sapiens
acggagtctcgctctgtcaccc

SEQ ID NO: 168597 - DNA, 23 bp, Homo sapiens
tgagtctcactctgtcacccagg

SEQ ID NO: 168598 - DNA, 20 bp, Homo sapiens
agtctcgctctgtcgctcag

SEQ ID NO: 168599 - DNA, 23 bp, Homo sapiens
agggtctctctctgtcactcagg

SEQ ID NO: 168600 - DNA, 23 bp, Homo sapiens
tgccggtcagatttttctcttct

SEQ ID NO: 168601 - DNA, 23 bp, Homo sapiens
tcactgtaatagtctgtgtgtgt

SEQ ID NO: 168602 - DNA, 23 bp, Homo sapiens
agagcacacaactgtgagtggac

SEQ ID NO: 168603 - DNA, 20 bp, Homo sapiens
tgattctagaggctgagctc

SEQ ID NO: 168604 - DNA, 23 bp, Homo sapiens
tgtgtgtctgtgtctgtatgtgt

SEQ ID NO: 168605 - DNA, 23 bp, Homo sapiens
gacagagtctcccactgtcaccc

SEQ ID NO: 168606 - DNA, 23 bp, Homo sapiens
tgttcaactggttgccttaggtg

SEQ ID NO: 168607 - DNA, 18 bp, Homo sapiens
tgagaaaaaaatgaggtg

SEQ ID NO: 168608 - DNA, 23 bp, Homo sapiens
agacagagtctcactctttcacc

SEQ ID NO: 168609 - DNA, 18 bp, Homo sapiens
agaagttacccagcagtg

SEQ ID NO: 168610 - DNA, 23 bp, Homo sapiens
agagtctcactctgtctcccagg

SEQ ID NO: 168611 - DNA, 20 bp, Homo sapiens
tgtgacagtggtatgcaggt

SEQ ID NO: 168612 - DNA, 23 bp, Homo sapiens
ctgatgtcactgatgtctgcaag

SEQ ID NO: 168613 - DNA, 19 bp, Homo sapiens
gaaaagagttcacacagca

SEQ ID NO: 168614 - DNA, 21 bp, Homo sapiens
tatgtgtgtatatatgtatac

SEQ ID NO: 168615 - DNA, 23 bp, Homo sapiens
tatatgtatacatatatatgtgt

SEQ ID NO: 168616 - DNA, 21 bp, Homo sapiens
cagtgcctctctgtccctgtc

SEQ ID NO: 168617 - DNA, 21 bp, Homo sapiens
tgcctgcctgtgttcccagct

SEQ ID NO: 168618 - DNA, 23 bp, Homo sapiens
ctgtagctgtctctcacactctt

SEQ ID NO: 168619 - DNA, 22 bp, Homo sapiens
gctgagggtgataacactgtct

SEQ ID NO: 168620 - DNA, 23 bp, Homo sapiens
gcctgtctccctgtgagcgtgtg

SEQ ID NO: 168621 - DNA, 18 bp, Homo sapiens
caggagagacttagtcga

SEQ ID NO: 168622 - DNA, 23 bp, Homo sapiens
aatggagtctcgctctgtctccc

SEQ ID NO: 168623 - DNA, 23 bp, Homo sapiens
gtgcctgtgtgtgtctctgccac

SEQ ID NO: 168624 - DNA, 20 bp, Homo sapiens
acagtgtctggcacagatta

SEQ ID NO: 168625 - DNA, 23 bp, Homo sapiens
tacatagtatttgttatgtgcca

SEQ ID NO: 168626 - DNA, 23 bp, Homo sapiens
tatatgtatgtatatatgtgtgt

SEQ ID NO: 168627 - DNA, 23 bp, Homo sapiens
tatgtgtgtatatgtatatatgt

SEQ ID NO: 168628 - DNA, 21 bp, Homo sapiens
ttcgtagagatgggtctcaac

SEQ ID NO: 168629 - DNA, 19 bp, Homo sapiens
tgtgtgtgtgtaggcaggg

SEQ ID NO: 168630 - DNA, 23 bp, Homo sapiens
tttctgtctgtctctctcacaca

SEQ ID NO: 168631 - DNA, 22 bp, Homo sapiens
agtaagtggttgtcaaatgctt

SEQ ID NO: 168632 - DNA, 23 bp, Homo sapiens
ttttgagacggagtcttgctctg

SEQ ID NO: 168633 - DNA, 22 bp, Homo sapiens
tgagacagggtcttgctctgtt

SEQ ID NO: 168634 - DNA, 22 bp, Homo sapiens
tgagacagagtctccctctgtt

SEQ ID NO: 168635 - DNA, 20 bp, Homo sapiens
atatgactttatttatatga

SEQ ID NO: 168636 - DNA, 22 bp, Homo sapiens
gcaaatctatagagacagaaaa

SEQ ID NO: 168637 - DNA, 23 bp, Homo sapiens
cggagtctcactctgtcacccag

SEQ ID NO: 168638 - DNA, 23 bp, Homo sapiens
cggtctcactctgtcacccaggc

SEQ ID NO: 168639 - DNA, 23 bp, Homo sapiens
ctgtccgtctgtctgtctctact

SEQ ID NO: 168640 - DNA, 21 bp, Homo sapiens
cactccctctgtggctgggtg

SEQ ID NO: 168641 - DNA, 23 bp, Homo sapiens
agatggagtctcgctctgtctcc

SEQ ID NO: 168642 - DNA, 22 bp, Homo sapiens
acagagtcttgctctgtctccc

SEQ ID NO: 168643 - DNA, 21 bp, Homo sapiens
tatatgcatatatatacatgt

SEQ ID NO: 168644 - DNA, 23 bp, Homo sapiens
atcacacagaactgagtgagatg

SEQ ID NO: 168645 - DNA, 23 bp, Homo sapiens
tttgagacagggtcttgctgtgt

SEQ ID NO: 168646 - DNA, 23 bp, Homo sapiens
tttgagacagagtttcactcttg

SEQ ID NO: 168647 - DNA, 23 bp, Homo sapiens
aggatcacttgagtctaggaggt

SEQ ID NO: 168648 - DNA, 23 bp, Homo sapiens
tgagatggagtttcactctgtca

SEQ ID NO: 168649 - DNA, 23 bp, Homo sapiens
tgtgagccactgtgcctgccttc

SEQ ID NO: 168650 - DNA, 21 bp, Homo sapiens
tgcagtgacacaatccttttt

SEQ ID NO: 168651 - DNA, 19 bp, Homo sapiens
tttgagacggagtctcgct

SEQ ID NO: 168652 - DNA, 23 bp, Homo sapiens
tgagttcattgtagattctggat

SEQ ID NO: 168653 - DNA, 23 bp, Homo sapiens
tgagttcattgtagattctggat

SEQ ID NO: 168654 - DNA, 23 bp, Homo sapiens
tggtgtgtacctgcagtttagct

SEQ ID NO: 168655 - DNA, 21 bp, Homo sapiens
tgaggtaggaggatcacttga

SEQ ID NO: 168656 - DNA, 23 bp, Homo sapiens
acacatgcatttgtatatgtgac

SEQ ID NO: 168657 - DNA, 22 bp, Homo sapiens
tgtatatagctatgtatactat

SEQ ID NO: 168658 - DNA, 23 bp, Homo sapiens
tagctatacatatctatgtgtag

SEQ ID NO: 168659 - DNA, 21 bp, Homo sapiens
gacactggctgagttctgccc

SEQ ID NO: 168660 - DNA, 21 bp, Homo sapiens
gcatagtataccatggtgtat

SEQ ID NO: 168661 - DNA, 23 bp, Homo sapiens
attccatatctttgctattgtga

SEQ ID NO: 168662 - DNA, 23 bp, Homo sapiens
tctctgtgtgcctgagtggctgc

SEQ ID NO: 168663 - DNA, 23 bp, Homo sapiens
tgtcacagagactgttctaggaa

SEQ ID NO: 168664 - DNA, 23 bp, Homo sapiens
agaggagtaggactggtggtgat

SEQ ID NO: 168665 - DNA, 18 bp, Homo sapiens
tatctccttgcattttta

SEQ ID NO: 168666 - DNA, 20 bp, Homo sapiens
tgaacaaattttgaattggt

SEQ ID NO: 168667 - DNA, 23 bp, Homo sapiens
tttttttggttaagatgaggttt

SEQ ID NO: 168668 - DNA, 23 bp, Homo sapiens
tatacatatgtatacctatagat

SEQ ID NO: 168669 - DNA, 23 bp, Homo sapiens
agtgtctgtgtgtgtgtcagggg

SEQ ID NO: 168670 - DNA, 23 bp, Homo sapiens
agagtctcactctgtcacccagg

SEQ ID NO: 168671 - DNA, 22 bp, Homo sapiens
gcgtgtgtgtgtgtgtgtgtat

SEQ ID NO: 168672 - DNA, 23 bp, Homo sapiens
tgaggtaggaggatgacttgagg

SEQ ID NO: 168673 - DNA, 23 bp, Homo sapiens
ctcagtctccctgtctgttaaat

SEQ ID NO: 168674 - DNA, 23 bp, Homo sapiens
tctcactgtgtctgtgagggtat

SEQ ID NO: 168675 - DNA, 23 bp, Homo sapiens
tatgtatctgtgcatatgtttgt

SEQ ID NO: 168676 - DNA, 20 bp, Homo sapiens
atagtttttctaaaggcgag

SEQ ID NO: 168677 - DNA, 20 bp, Homo sapiens
agttgcttttaaaaactgta

SEQ ID NO: 168678 - DNA, 19 bp, Homo sapiens
tgtctcttactgtctcttt

SEQ ID NO: 168679 - DNA, 21 bp, Homo sapiens
atatgtatatatatacgtgtg

SEQ ID NO: 168680 - DNA, 21 bp, Homo sapiens
atatgtatatatatacgtgtg

SEQ ID NO: 168681 - DNA, 21 bp, Homo sapiens
atatgtatatatatacgtgtg

SEQ ID NO: 168682 - DNA, 21 bp, Homo sapiens
atatgtatatatatacgtgtg

SEQ ID NO: 168683 - DNA, 21 bp, Homo sapiens
tatgtatatatatacgtgtgt

SEQ ID NO: 168684 - DNA, 18 bp, Homo sapiens
atacatacacacatatgt

SEQ ID NO: 168685 - DNA, 23 bp, Homo sapiens
gatggagtctcactctgtcaccc

SEQ ID NO: 168686 - DNA, 22 bp, Homo sapiens
agagagaacagagtgcacaagg

SEQ ID NO: 168687 - DNA, 23 bp, Homo sapiens
gtctctgtgggtgtctctgggcc

SEQ ID NO: 168688 - DNA, 23 bp, Homo sapiens
tgagttcattgtagattctggat

SEQ ID NO: 168689 - DNA, 23 bp, Homo sapiens
tgagttcattgtagattctggat

SEQ ID NO: 168690 - DNA, 20 bp, Homo sapiens
tttgcttcttgattctgact

SEQ ID NO: 168691 - DNA, 23 bp, Homo sapiens
tatgtatatatatgtatgtgtgt

SEQ ID NO: 168692 - DNA, 22 bp, Homo sapiens
tatgtgtgtatatatctgtgtg

SEQ ID NO: 168693 - DNA, 23 bp, Homo sapiens
atggagtctcactgtctcaccca

SEQ ID NO: 168694 - DNA, 23 bp, Homo sapiens
tgctcagtgacaaaaatgacagt

SEQ ID NO: 168695 - DNA, 23 bp, Homo sapiens
tgggactgaattgattttgatgt

SEQ ID NO: 168696 - DNA, 23 bp, Homo sapiens
caacagactctgtctctggctct

SEQ ID NO: 168697 - DNA, 23 bp, Homo sapiens
tgtgtgtgtgcaaatgcatgtgt

SEQ ID NO: 168698 - DNA, 19 bp, Homo sapiens
tgtgtgcatgcatgtgtgt

SEQ ID NO: 168699 - DNA, 23 bp, Homo sapiens
tatgtgtatatgtaaaactgtgt

SEQ ID NO: 168700 - DNA, 21 bp, Homo sapiens
tttgtgtatatatgtatatgt

SEQ ID NO: 168701 - DNA, 21 bp, Homo sapiens
gtgcatatgtgtatatgtata

SEQ ID NO: 168702 - DNA, 21 bp, Homo sapiens
tgaggtaggaggatcacttga

SEQ ID NO: 168703 - DNA, 23 bp, Homo sapiens
gagagtctcgctctgtcacccag

SEQ ID NO: 168704 - DNA, 23 bp, Homo sapiens
gtgacaggcactgtgtctgccac

SEQ ID NO: 168705 - DNA, 18 bp, Homo sapiens
tgcctgtcctcatggagc

SEQ ID NO: 168706 - DNA, 19 bp, Homo sapiens
ttactgtccagtctccagg

SEQ ID NO: 168707 - DNA, 23 bp, Homo sapiens
actgtgtcactgtcaatcagggg

SEQ ID NO: 168708 - DNA, 23 bp, Homo sapiens
gtgtttcagcttctccatctgca

SEQ ID NO: 168709 - DNA, 23 bp, Homo sapiens
agacagagtctcattctgtcacc

SEQ ID NO: 168710 - DNA, 23 bp, Homo sapiens
gcatgactgtagttccagctact

SEQ ID NO: 168711 - DNA, 19 bp, Homo sapiens
aatatatcctgctttagaa

SEQ ID NO: 168712 - DNA, 20 bp, Homo sapiens
tttcctaattttgccaatgt

SEQ ID NO: 168713 - DNA, 23 bp, Homo sapiens
tgcatatatgtatatatgttgca

SEQ ID NO: 168714 - DNA, 21 bp, Homo sapiens
tctgccactcactcactgtgc

SEQ ID NO: 168715 - DNA, 20 bp, Homo sapiens
tgagacagagtctcgctctg

SEQ ID NO: 168716 - DNA, 18 bp, Homo sapiens
ctgtgcctctgtctgtct

SEQ ID NO: 168717 - DNA, 21 bp, Homo sapiens
tgagatggagtctcactctgt

SEQ ID NO: 168718 - DNA, 18 bp, Homo sapiens
tttgagatggagtcttgc

SEQ ID NO: 168719 - DNA, 20 bp, Homo sapiens
tgtcttgtgagaacagaggc

SEQ ID NO: 168720 - DNA, 23 bp, Homo sapiens
tttcagaagaaaacaaaaagttc

SEQ ID NO: 168721 - DNA, 21 bp, Homo sapiens
tttttgagatggagtctcact

SEQ ID NO: 168722 - DNA, 22 bp, Homo sapiens
acaagactctgtctcagaaaac

SEQ ID NO: 168723 - DNA, 19 bp, Homo sapiens
tttgagatggagtcttgct

SEQ ID NO: 168724 - DNA, 23 bp, Homo sapiens
ggctagagaggacactgaggcca

SEQ ID NO: 168725 - DNA, 23 bp, Homo sapiens
tctcactctgtcacccaggcttg

SEQ ID NO: 168726 - DNA, 22 bp, Homo sapiens
gagagtggattagtagctttca

SEQ ID NO: 168727 - DNA, 23 bp, Homo sapiens
acagtctgtctctgtgcctcagt

SEQ ID NO: 168728 - DNA, 23 bp, Homo sapiens
tgagttcattgtagattctggat

SEQ ID NO: 168729 - DNA, 23 bp, Homo sapiens
tgagttcattgtagattctggat

SEQ ID NO: 168730 - DNA, 23 bp, Homo sapiens
ggagtctcactctgtcactcagg

SEQ ID NO: 168731 - DNA, 22 bp, Homo sapiens
tagctagattacaaatgtgtgc

SEQ ID NO: 168732 - DNA, 23 bp, Homo sapiens
ctgtgtgtgtcacccagtcttgc

SEQ ID NO: 168733 - DNA, 23 bp, Homo sapiens
gtctgtttccatgtgatatcaaa

SEQ ID NO: 168734 - DNA, 22 bp, Homo sapiens
tctgtatatatgtatatatgtg

SEQ ID NO: 168735 - DNA, 23 bp, Homo sapiens
atatgtatgtatatatatgtgtg

SEQ ID NO: 168736 - DNA, 21 bp, Homo sapiens
tatgcatatatgtatatatgt

SEQ ID NO: 168737 - DNA, 22 bp, Homo sapiens
tcaccacagtctctctcacttg

SEQ ID NO: 168738 - DNA, 23 bp, Homo sapiens
tctgcctggctctctctctctgt

SEQ ID NO: 168739 - DNA, 23 bp, Homo sapiens
gagactgtgtctcgctctgtcgc

SEQ ID NO: 168740 - DNA, 23 bp, Homo sapiens
tccagcacctgttgtttcctgac

SEQ ID NO: 168741 - DNA, 21 bp, Homo sapiens
acatgtgcacaatgtgcaggt

SEQ ID NO: 168742 - DNA, 23 bp, Homo sapiens
cttgtctcactgcaagctctgcc

SEQ ID NO: 168743 - DNA, 23 bp, Homo sapiens
cactgcgtcactccctgtgctga

SEQ ID NO: 168744 - DNA, 23 bp, Homo sapiens
tgtggctagtccctgtctctctg

SEQ ID NO: 168745 - DNA, 22 bp, Homo sapiens
ttttcagacggagtcttgctgt

SEQ ID NO: 168746 - DNA, 23 bp, Homo sapiens
tcagtgtgagacaaaggaccctg

SEQ ID NO: 168747 - DNA, 23 bp, Homo sapiens
agtccctgactccctgtctccag

SEQ ID NO: 168748 - DNA, 21 bp, Homo sapiens
tgccaccctctctctgtgtca

SEQ ID NO: 168749 - DNA, 20 bp, Homo sapiens
attatagatgaaagagtaca

SEQ ID NO: 168750 - DNA, 21 bp, Homo sapiens
tgccaccctctctctgtgtca

SEQ ID NO: 168751 - DNA, 23 bp, Homo sapiens
tgagatggagtctcactctgtta

SEQ ID NO: 168752 - DNA, 23 bp, Homo sapiens
ccgagtctcactctgtcacccag

SEQ ID NO: 168753 - DNA, 23 bp, Homo sapiens
attctttgtgtgcatgtgtgtgg

SEQ ID NO: 168754 - DNA, 23 bp, Homo sapiens
acgcactctgagtcatttgagag

SEQ ID NO: 168755 - DNA, 23 bp, Homo sapiens
tttgagacagttacactattgtt

SEQ ID NO: 168756 - DNA, 20 bp, Homo sapiens
atagaagtcagttctagggc

SEQ ID NO: 168757 - DNA, 23 bp, Homo sapiens
ctcagggtctcactcagtctccc

SEQ ID NO: 168758 - DNA, 19 bp, Homo sapiens
tttttagtagagatggggt

SEQ ID NO: 168759 - DNA, 20 bp, Homo sapiens
gtcagggtgagtgctgggtt

SEQ ID NO: 168760 - DNA, 23 bp, Homo sapiens
agacgagagagggctttcttttt

SEQ ID NO: 168761 - DNA, 23 bp, Homo sapiens
tgagacagggagagtagggtgtg

SEQ ID NO: 168762 - DNA, 21 bp, Homo sapiens
acatcagagagatcagtcagg

SEQ ID NO: 168763 - DNA, 23 bp, Homo sapiens
acagtctgtctctgtgcctcagt

SEQ ID NO: 168764 - DNA, 23 bp, Homo sapiens
cacagtctgtctctgtgcctcag

SEQ ID NO: 168765 - DNA, 23 bp, Homo sapiens
agtatctcactctgtcacccaag

SEQ ID NO: 168766 - DNA, 18 bp, Homo sapiens
cagtggcatgatattggc

SEQ ID NO: 168767 - DNA, 22 bp, Homo sapiens
taatgtatcatatatattgtat

SEQ ID NO: 168768 - DNA, 22 bp, Homo sapiens
taatctgtatcatatatattgt

SEQ ID NO: 168769 - DNA, 22 bp, Homo sapiens
taatctgtatcatatatattgt

SEQ ID NO: 168770 - DNA, 22 bp, Homo sapiens
taatctgtatcatatatattgt

SEQ ID NO: 168771 - DNA, 23 bp, Homo sapiens
agacgctctgactctgtctggcc

SEQ ID NO: 168772 - DNA, 18 bp, Homo sapiens
ttttttctacatctgatt

SEQ ID NO: 168773 - DNA, 20 bp, Homo sapiens
gctgtctcactcagtagtga

SEQ ID NO: 168774 - DNA, 23 bp, Homo sapiens
tttgactcaagttttgtttttgt

SEQ ID NO: 168775 - DNA, 19 bp, Homo sapiens
aaactaattttggttggct

SEQ ID NO: 168776 - DNA, 23 bp, Homo sapiens
tgagatggagtctcgctctgtca

SEQ ID NO: 168777 - DNA, 23 bp, Homo sapiens
gacagagtctccctctgtcaccc

SEQ ID NO: 168778 - DNA, 23 bp, Homo sapiens
tgagatggagtctctctctgtcg

SEQ ID NO: 168779 - DNA, 18 bp, Homo sapiens
tcaggatccttttgtggg

SEQ ID NO: 168780 - DNA, 23 bp, Homo sapiens
tgtgtctgtgcttatgcatctgt

SEQ ID NO: 168781 - DNA, 19 bp, Homo sapiens
tatgcatctgtgtgtctct

SEQ ID NO: 168782 - DNA, 23 bp, Homo sapiens
tataatctgtatcatatatattg

SEQ ID NO: 168783 - DNA, 20 bp, Homo sapiens
atagaagtcagttctagggc

SEQ ID NO: 168784 - DNA, 23 bp, Homo sapiens
ctcagggtctcactcagtctccc

SEQ ID NO: 168785 - DNA, 19 bp, Homo sapiens
tttttagtagagatggggt

SEQ ID NO: 168786 - DNA, 20 bp, Homo sapiens
gtcagggtgagtgctgggtt

SEQ ID NO: 168787 - DNA, 23 bp, Homo sapiens
tgctgtgtgaagattgagaggag

SEQ ID NO: 168788 - DNA, 23 bp, Homo sapiens
acagtctgtctctgtgcctcagt

SEQ ID NO: 168789 - DNA, 23 bp, Homo sapiens
cacagtctgtctctgtgcctcag

SEQ ID NO: 168790 - DNA, 23 bp, Homo sapiens
agtatctcactctgtcacccaag

SEQ ID NO: 168791 - DNA, 18 bp, Homo sapiens
cagtggcatgatattggc

SEQ ID NO: 168792 - DNA, 23 bp, Homo sapiens
gagacggagtctcactctgtcac

SEQ ID NO: 168793 - DNA, 23 bp, Homo sapiens
gtgtgcatgtgtgtgtgtgagca

SEQ ID NO: 168794 - DNA, 22 bp, Homo sapiens
ttttagatggagttttgctctt

SEQ ID NO: 168795 - DNA, 21 bp, Homo sapiens
atttcctgtctgcagatgtgc

SEQ ID NO: 168796 - DNA, 23 bp, Homo sapiens
tgagccactgtgcctggctgtgt

SEQ ID NO: 168797 - DNA, 18 bp, Homo sapiens
gttttcttgtcaaaatgc

SEQ ID NO: 168798 - DNA, 20 bp, Homo sapiens
tttgagtcaggtttggtagt

SEQ ID NO: 168799 - DNA, 22 bp, Homo sapiens
cttaagttttacttctggaact

SEQ ID NO: 168800 - DNA, 21 bp, Homo sapiens
ttcaccatgttgaccaggctg

SEQ ID NO: 168801 - DNA, 22 bp, Homo sapiens
agtgtctggcagtggttgagtt

SEQ ID NO: 168802 - DNA, 23 bp, Homo sapiens
ggcctgtctctgtctctgttgag

SEQ ID NO: 168803 - DNA, 23 bp, Homo sapiens
tgacagagtgagaccctgtctca

SEQ ID NO: 168804 - DNA, 18 bp, Homo sapiens
tgagttggagtctcactg

SEQ ID NO: 168805 - DNA, 23 bp, Homo sapiens
tcacagcctccctcactgccttc

SEQ ID NO: 168806 - DNA, 21 bp, Homo sapiens
ttgctgcatggcttttgtgtg

SEQ ID NO: 168807 - DNA, 21 bp, Homo sapiens
acatcagagagatcagtcagg

SEQ ID NO: 168808 - DNA, 23 bp, Homo sapiens
cacagtctgtctctgtgcctcag

SEQ ID NO: 168809 - DNA, 23 bp, Homo sapiens
agtatctcactctgtcacccaag

SEQ ID NO: 168810 - DNA, 18 bp, Homo sapiens
cagtggcatgatattggc

SEQ ID NO: 168811 - DNA, 22 bp, Homo sapiens
taatgtatcatatatattgtat

SEQ ID NO: 168812 - DNA, 22 bp, Homo sapiens
taatctgtatcatatatattgt

SEQ ID NO: 168813 - DNA, 22 bp, Homo sapiens
taatctgtatcatatatattgt

SEQ ID NO: 168814 - DNA, 22 bp, Homo sapiens
taatctgtatcatatatattgt

SEQ ID NO: 168815 - DNA, 19 bp, Homo sapiens
ataatctatatcatatagt

SEQ ID NO: 168816 - DNA, 23 bp, Homo sapiens
tctgtctgtctgtctgcctgtct

SEQ ID NO: 168817 - DNA, 23 bp, Homo sapiens
gacagagtctcgctctgtcaccc

SEQ ID NO: 168818 - DNA, 23 bp, Homo sapiens
acagagatgtcagagcccacaga

SEQ ID NO: 168819 - DNA, 19 bp, Homo sapiens
tgtgagccactgtgcctgg

SEQ ID NO: 168820 - DNA, 20 bp, Homo sapiens
ctgtaagtcctatagtctgt

SEQ ID NO: 168821 - DNA, 23 bp, Homo sapiens
tataccttgtacacgtagcctaa

SEQ ID NO: 168822 - DNA, 23 bp, Homo sapiens
attttaggtgtgactgtcaccac

SEQ ID NO: 168823 - DNA, 23 bp, Homo sapiens
tctgtgtgtctttatgattctgg

SEQ ID NO: 168824 - DNA, 23 bp, Homo sapiens
aatttcactctgagctcacaggg

SEQ ID NO: 168825 - DNA, 22 bp, Homo sapiens
accaccaccacatagtgaacta

SEQ ID NO: 168826 - DNA, 23 bp, Homo sapiens
aaacagaatggagatcagtgggt

SEQ ID NO: 168827 - DNA, 22 bp, Homo sapiens
tttgagacagagtctcgctctg

SEQ ID NO: 168828 - DNA, 18 bp, Homo sapiens
atgtacatacatgtatat

SEQ ID NO: 168829 - DNA, 21 bp, Homo sapiens
agtcaagagagagatgcaact

SEQ ID NO: 168830 - DNA, 23 bp, Homo sapiens
cagtgtgtgtgtctttgagtgtg

SEQ ID NO: 168831 - DNA, 18 bp, Homo sapiens
gagttgtatagtatgtaa

SEQ ID NO: 168832 - DNA, 23 bp, Homo sapiens
agacaaggtcttgctctgtcact

SEQ ID NO: 168833 - DNA, 23 bp, Homo sapiens
atgggtgaattatatggtttgtg

SEQ ID NO: 168834 - DNA, 23 bp, Homo sapiens
tggagtctcactctgtcacccag

SEQ ID NO: 168835 - DNA, 22 bp, Homo sapiens
tgtgaggtcttttctccgtctc

SEQ ID NO: 168836 - DNA, 23 bp, Homo sapiens
cagagtctcactctgtcacccag

SEQ ID NO: 168837 - DNA, 20 bp, Homo sapiens
tgagatcttggttcactgaa

SEQ ID NO: 168838 - DNA, 21 bp, Homo sapiens
tcacagaagtcagtgaggagt

SEQ ID NO: 168839 - DNA, 23 bp, Homo sapiens
tctcttgaagatggcatacagtt

SEQ ID NO: 168840 - DNA, 19 bp, Homo sapiens
tgtgaagaaagtcaatggt

SEQ ID NO: 168841 - DNA, 22 bp, Homo sapiens
aatggcatgatcttggcttagt

SEQ ID NO: 168842 - DNA, 23 bp, Homo sapiens
cactcagtgtctgaattcatttt

SEQ ID NO: 168843 - DNA, 23 bp, Homo sapiens
ggctggctggctggctggcagtg

SEQ ID NO: 168844 - DNA, 21 bp, Homo sapiens
tggctggctggctggctggct

SEQ ID NO: 168845 - DNA, 23 bp, Homo sapiens
cgcaggctggctggttgggtggc

SEQ ID NO: 168846 - DNA, 23 bp, Homo sapiens
gtctggctggctgtctggctggc

SEQ ID NO: 168847 - DNA, 23 bp, Homo sapiens
tgagacagtctcgctctgtcacc

SEQ ID NO: 168848 - DNA, 23 bp, Homo sapiens
tgagttcattgtagattctggat

SEQ ID NO: 168849 - DNA, 23 bp, Homo sapiens
tgagttcattgtagattctggat

SEQ ID NO: 168850 - DNA, 23 bp, Homo sapiens
tgagttcattgtagattctggat

SEQ ID NO: 168851 - DNA, 23 bp, Homo sapiens
tgagttcattgtagattctggat

SEQ ID NO: 168852 - DNA, 18 bp, Homo sapiens
aatgtggaagttatattt

SEQ ID NO: 168853 - DNA, 21 bp, Homo sapiens
cagtgttctgaaaccctttgg

SEQ ID NO: 168854 - DNA, 23 bp, Homo sapiens
tgtttgtcactcattaaggattc

SEQ ID NO: 168855 - DNA, 23 bp, Homo sapiens
tggatagatgctagtttatagtc

SEQ ID NO: 168856 - DNA, 23 bp, Homo sapiens
gagtctcacactgtcacccaggc

SEQ ID NO: 168857 - DNA, 19 bp, Homo sapiens
tgagacagagtctccctgt

SEQ ID NO: 168858 - DNA, 23 bp, Homo sapiens
tatgtccttttaaaagtactttg

SEQ ID NO: 168859 - DNA, 22 bp, Homo sapiens
tacatgtgcacaatgtgcaggt

SEQ ID NO: 168860 - DNA, 20 bp, Homo sapiens
attgagcacattcattttgc

SEQ ID NO: 168861 - DNA, 21 bp, Homo sapiens
tttactgccacgtttagagga

SEQ ID NO: 168862 - DNA, 23 bp, Homo sapiens
catatatgtatatatgtatatgt

SEQ ID NO: 168863 - DNA, 22 bp, Homo sapiens
agagtctgcattgggtctaggt

SEQ ID NO: 168864 - DNA, 23 bp, Homo sapiens
tgtgcaacctttagagtctgcat

SEQ ID NO: 168865 - DNA, 22 bp, Homo sapiens
agagtctgcattgggtctaggt

SEQ ID NO: 168866 - DNA, 22 bp, Homo sapiens
tatgtgtatatatatatatgtg

SEQ ID NO: 168867 - DNA, 23 bp, Homo sapiens
tttgagacggagtctcgctctgt

SEQ ID NO: 168868 - DNA, 19 bp, Homo sapiens
atgagagctgagcgtggga

SEQ ID NO: 168869 - DNA, 23 bp, Homo sapiens
tccatttttattctacttgtttt

SEQ ID NO: 168870 - DNA, 23 bp, Homo sapiens
tccatttttattctacttgtttt

SEQ ID NO: 168871 - DNA, 23 bp, Homo sapiens
gacagagtctcgctctgtcaccc

SEQ ID NO: 168872 - DNA, 23 bp, Homo sapiens
gagatgagtctctctgtgtcgcc

SEQ ID NO: 168873 - DNA, 23 bp, Homo sapiens
actgagtctcactctgtcgccca

SEQ ID NO: 168874 - DNA, 23 bp, Homo sapiens
atgtctctctctgtgttgggagc

SEQ ID NO: 168875 - DNA, 23 bp, Homo sapiens
atgtttctgcatgtctgtgcatg

SEQ ID NO: 168876 - DNA, 20 bp, Homo sapiens
tgtgagtggcattcatgtgt

SEQ ID NO: 168877 - DNA, 23 bp, Homo sapiens
atatgtgtatatgtatatatgtg

SEQ ID NO: 168878 - DNA, 23 bp, Homo sapiens
atatgtgtgtatatatagtgtgt

SEQ ID NO: 168879 - DNA, 23 bp, Homo sapiens
atgtgcatctatgtgtgtgtgta

SEQ ID NO: 168880 - DNA, 23 bp, Homo sapiens
atgtgtatatatgtatatatgtg

SEQ ID NO: 168881 - DNA, 22 bp, Homo sapiens
tatgtgtgtatatatagtgtat

SEQ ID NO: 168882 - DNA, 23 bp, Homo sapiens
tatgtgcatctatgtgtgtgtgt

SEQ ID NO: 168883 - DNA, 23 bp, Homo sapiens
atatgtgtatatgtatatatgtg

SEQ ID NO: 168884 - DNA, 23 bp, Homo sapiens
atatgtgtgtatatatagtgtgt

SEQ ID NO: 168885 - DNA, 23 bp, Homo sapiens
atgtgcatctatgtgtgtgtaca

SEQ ID NO: 168886 - DNA, 22 bp, Homo sapiens
tatatgcatatatatagtgtat

SEQ ID NO: 168887 - DNA, 23 bp, Homo sapiens
ttgtgtgtatgtgtatatagtgt

SEQ ID NO: 168888 - DNA, 23 bp, Homo sapiens
atgtgtatatatgtatatatgtg

SEQ ID NO: 168889 - DNA, 19 bp, Homo sapiens
tgtatgtgtgtatatatgt

SEQ ID NO: 168890 - DNA, 20 bp, Homo sapiens
tgtatatatgtatatatgtg

SEQ ID NO: 168891 - DNA, 23 bp, Homo sapiens
ctgtgtatatatgtatatctgtg

SEQ ID NO: 168892 - DNA, 21 bp, Homo sapiens
atatatgtacatatgtatgta

SEQ ID NO: 168893 - DNA, 23 bp, Homo sapiens
acagtgtctcactctgtcaccca

SEQ ID NO: 168894 - DNA, 23 bp, Homo sapiens
tctgtgtctgtgtcttccctgct

SEQ ID NO: 168895 - DNA, 18 bp, Homo sapiens
tatcatggtattgattgc

SEQ ID NO: 168896 - DNA, 23 bp, Homo sapiens
attgagtgtgtattgagtgtgta

SEQ ID NO: 168897 - DNA, 19 bp, Homo sapiens
acatatgtatgtttttata

SEQ ID NO: 168898 - DNA, 23 bp, Homo sapiens
atatagtgtatatgtaaaataca

SEQ ID NO: 168899 - DNA, 23 bp, Homo sapiens
accgagtctcgctctgtcaccca

SEQ ID NO: 168900 - DNA, 23 bp, Homo sapiens
gacagagtctccctctgtcaccc

SEQ ID NO: 168901 - DNA, 23 bp, Homo sapiens
atatgtgtatatgtatacatata

SEQ ID NO: 168902 - DNA, 22 bp, Homo sapiens
atatatacatgtatatgtgtgt

SEQ ID NO: 168903 - DNA, 21 bp, Homo sapiens
tatacgtatatatacatatgt

SEQ ID NO: 168904 - DNA, 23 bp, Homo sapiens
tggagtctcactctgtcacccag

SEQ ID NO: 168905 - DNA, 23 bp, Homo sapiens
acagagtctcactctgtcaccca

SEQ ID NO: 168906 - DNA, 23 bp, Homo sapiens
agagtctcactctgtcacccagg

SEQ ID NO: 168907 - DNA, 20 bp, Homo sapiens
atatgtatatatgtatatga

SEQ ID NO: 168908 - DNA, 23 bp, Homo sapiens
tatatgtatatatgtatatgtgt

SEQ ID NO: 168909 - DNA, 22 bp, Homo sapiens
tatatgtatagatgtatatgtg

SEQ ID NO: 168910 - DNA, 18 bp, Homo sapiens
tgagacagagtccctgtg

SEQ ID NO: 168911 - DNA, 22 bp, Homo sapiens
atgttaatcttgatggtgaagg

SEQ ID NO: 168912 - DNA, 23 bp, Homo sapiens
tagtggatggagtatgtggtagg

SEQ ID NO: 168913 - DNA, 23 bp, Homo sapiens
tgtctctctgtccatctctctct

SEQ ID NO: 168914 - DNA, 23 bp, Homo sapiens
acatagacagctatagataaatg

SEQ ID NO: 168915 - DNA, 21 bp, Homo sapiens
atgtatacatatattgtatat

SEQ ID NO: 168916 - DNA, 18 bp, Homo sapiens
tatacatatacacgtgta

SEQ ID NO: 168917 - DNA, 23 bp, Homo sapiens
atatgtatgtgtatatatgtatg

SEQ ID NO: 168918 - DNA, 18 bp, Homo sapiens
tgtatatatgtacacgta

SEQ ID NO: 168919 - DNA, 21 bp, Homo sapiens
tatgtatatgtatatgtgtgt

SEQ ID NO: 168920 - DNA, 23 bp, Homo sapiens
tatgtgtgtgcatatgtatgtgt

SEQ ID NO: 168921 - DNA, 21 bp, Homo sapiens
tgtgtgaatatgtatgtgtgt

SEQ ID NO: 168922 - DNA, 23 bp, Homo sapiens
gagactgagtctcgctctgtcac

SEQ ID NO: 168923 - DNA, 23 bp, Homo sapiens
gactgagtctcgctctgtcaccc

SEQ ID NO: 168924 - DNA, 23 bp, Homo sapiens
actgagtctcgctctgtcaccca

SEQ ID NO: 168925 - DNA, 22 bp, Homo sapiens
aggctggctgcgtctctcactg

SEQ ID NO: 168926 - DNA, 23 bp, Homo sapiens
tcagatgagtgtgtgcttactgt

SEQ ID NO: 168927 - DNA, 21 bp, Homo sapiens
agtgtaatgcccatgttcatg

SEQ ID NO: 168928 - DNA, 23 bp, Homo sapiens
tggtgctctcagactgactgtct

SEQ ID NO: 168929 - DNA, 19 bp, Homo sapiens
agacagagaccctgtctct

SEQ ID NO: 168930 - DNA, 21 bp, Homo sapiens
ttttgagacggagtctcactc

SEQ ID NO: 168931 - DNA, 20 bp, Homo sapiens
agatgtttatgtatctttat

SEQ ID NO: 168932 - DNA, 23 bp, Homo sapiens
agtctgagatcaaggtgtgagca

SEQ ID NO: 168933 - DNA, 23 bp, Homo sapiens
tcctgaagcctctctccttggct

SEQ ID NO: 168934 - DNA, 21 bp, Homo sapiens
atgtgtatatatacacatgtg

SEQ ID NO: 168935 - DNA, 21 bp, Homo sapiens
tgacagagcgagacactgtct

SEQ ID NO: 168936 - DNA, 23 bp, Homo sapiens
cggagtctctctctgtcacccag

SEQ ID NO: 168937 - DNA, 23 bp, Homo sapiens
aattcatccatgtttctgtctct

SEQ ID NO: 168938 - DNA, 23 bp, Homo sapiens
gctcagtgggtctctctttccct

SEQ ID NO: 168939 - DNA, 18 bp, Homo sapiens
tgaggctatactggtgga

SEQ ID NO: 168940 - DNA, 23 bp, Homo sapiens
catttcactgtctgactcagtgc

SEQ ID NO: 168941 - DNA, 22 bp, Homo sapiens
tatgtctcagtaaatgttgact

SEQ ID NO: 168942 - DNA, 23 bp, Homo sapiens
acatatgtatatgtttatatgtg

SEQ ID NO: 168943 - DNA, 23 bp, Homo sapiens
tgtgtgtatagatacctgtgtgt

SEQ ID NO: 168944 - DNA, 23 bp, Homo sapiens
tgagttcattgtagattctggat

SEQ ID NO: 168945 - DNA, 23 bp, Homo sapiens
tgagttcattgtagattctggat

SEQ ID NO: 168946 - DNA, 23 bp, Homo sapiens
agtctcactctgtcacccaggct

SEQ ID NO: 168947 - DNA, 19 bp, Homo sapiens
tgactggggtgatcttgac

SEQ ID NO: 168948 - DNA, 23 bp, Homo sapiens
tcagatgactatatgattatatg

SEQ ID NO: 168949 - DNA, 22 bp, Homo sapiens
agtcaaagtctcactccgtcac

SEQ ID NO: 168950 - DNA, 22 bp, Homo sapiens
acacatatatatactatgtgta

SEQ ID NO: 168951 - DNA, 23 bp, Homo sapiens
tatgtatgtatatgtatatgtat

SEQ ID NO: 168952 - DNA, 23 bp, Homo sapiens
tatgtatgtgtgtatatgtatac

SEQ ID NO: 168953 - DNA, 20 bp, Homo sapiens
tatatagtatatgtatgtgt

SEQ ID NO: 168954 - DNA, 22 bp, Homo sapiens
tggatacatttgtatatatgtg

SEQ ID NO: 168955 - DNA, 19 bp, Homo sapiens
aatctgtatatatatatgt

SEQ ID NO: 168956 - DNA, 20 bp, Homo sapiens
aactatacagattgtgtata

SEQ ID NO: 168957 - DNA, 22 bp, Homo sapiens
acagtcatgagctactgtgtcc

SEQ ID NO: 168958 - DNA, 23 bp, Homo sapiens
atagttgagctactgtaatcctt

SEQ ID NO: 168959 - DNA, 23 bp, Homo sapiens
tatataaaacgtacataatgtat

SEQ ID NO: 168960 - DNA, 23 bp, Homo sapiens
tacatgtgaatatgtatatgtgt

SEQ ID NO: 168961 - DNA, 23 bp, Homo sapiens
atatgtataatacatgtatatga

SEQ ID NO: 168962 - DNA, 23 bp, Homo sapiens
tcttactcagtctctgtgttcta

SEQ ID NO: 168963 - DNA, 21 bp, Homo sapiens
ataggtagatagatataaagt

SEQ ID NO: 168964 - DNA, 23 bp, Homo sapiens
ggaacacttctgaatttgtagtg

SEQ ID NO: 168965 - DNA, 22 bp, Homo sapiens
tataaatatgtatgtgtacatg

SEQ ID NO: 168966 - DNA, 23 bp, Homo sapiens
tttatatgtgtatgtatttctat

SEQ ID NO: 168967 - DNA, 20 bp, Homo sapiens
tatcatttcaataggttatg

SEQ ID NO: 168968 - DNA, 23 bp, Homo sapiens
agtgaggttccttgtcatcttct

SEQ ID NO: 168969 - DNA, 23 bp, Homo sapiens
tctgagacaggatctcactctgt

SEQ ID NO: 168970 - DNA, 21 bp, Homo sapiens
aatgaggtttcaccatgttgg

SEQ ID NO: 168971 - DNA, 22 bp, Homo sapiens
tatctgtatatatgtatgtgtg

SEQ ID NO: 168972 - DNA, 23 bp, Homo sapiens
tatgtctatgtatgtgtaaatgt

SEQ ID NO: 168973 - DNA, 23 bp, Homo sapiens
gggtctcactctgtcacccaggc

SEQ ID NO: 168974 - DNA, 23 bp, Homo sapiens
tgagttcattgtagattctggat

SEQ ID NO: 168975 - DNA, 23 bp, Homo sapiens
tgagttcattgtagattctggat

SEQ ID NO: 168976 - DNA, 23 bp, Homo sapiens
tgagttcattgtagattctggat

SEQ ID NO: 168977 - DNA, 23 bp, Homo sapiens
tgagttcattgtagattctggat

SEQ ID NO: 168978 - DNA, 23 bp, Homo sapiens
tagtccatgtacaagagttctta

SEQ ID NO: 168979 - DNA, 23 bp, Homo sapiens
tctgatcacactgagctctctgc

SEQ ID NO: 168980 - DNA, 23 bp, Homo sapiens
tgtgtgtgtatatatatatgtgt

SEQ ID NO: 168981 - DNA, 18 bp, Homo sapiens
tacacgtatatatgtata

SEQ ID NO: 168982 - DNA, 23 bp, Homo sapiens
acggagtctcgctctgtcgctca

SEQ ID NO: 168983 - DNA, 23 bp, Homo sapiens
cggagtctcgctctgtcgctcag

SEQ ID NO: 168984 - DNA, 23 bp, Homo sapiens
tttggttgtagaaagtctgtatt

SEQ ID NO: 168985 - DNA, 23 bp, Homo sapiens
agtctcactctgtcaactaggcc

SEQ ID NO: 168986 - DNA, 23 bp, Homo sapiens
tctccatgagaaataagaagtat

SEQ ID NO: 168987 - DNA, 23 bp, Homo sapiens
tctcagaggatttttgtttggct

SEQ ID NO: 168988 - DNA, 23 bp, Homo sapiens
tgagttcattgtagattctggat

SEQ ID NO: 168989 - DNA, 23 bp, Homo sapiens
tgagttcattgtagattctggat

SEQ ID NO: 168990 - DNA, 18 bp, Homo sapiens
acgtatgtatatatgtgt

SEQ ID NO: 168991 - DNA, 21 bp, Homo sapiens
tgaggtaggaggatcacttga

SEQ ID NO: 168992 - DNA, 23 bp, Homo sapiens
ctatgtatagtagaattttgtat

SEQ ID NO: 168993 - DNA, 23 bp, Homo sapiens
ttatgatacatttagaaaagacc

SEQ ID NO: 168994 - DNA, 22 bp, Homo sapiens
ttgggttgaaggatgtaaagta

SEQ ID NO: 168995 - DNA, 23 bp, Homo sapiens
tgcctctctctctgagtgtccta

SEQ ID NO: 168996 - DNA, 20 bp, Homo sapiens
atacgtatatatgtaaacgt

SEQ ID NO: 168997 - DNA, 21 bp, Homo sapiens
atatatgtatgtatatatacg

SEQ ID NO: 168998 - DNA, 22 bp, Homo sapiens
gacaaaggtgatgctgggcaca

SEQ ID NO: 168999 - DNA, 23 bp, Homo sapiens
tgtgtgtgtgtatatatacgtat

SEQ ID NO: 169000 - DNA, 23 bp, Homo sapiens
tttttctcagtgctgatggtcac

SEQ ID NO: 169001 - DNA, 23 bp, Homo sapiens
atgtgtgtatatatatgtgtgtg

SEQ ID NO: 169002 - DNA, 19 bp, Homo sapiens
taagtggtactataaggta

SEQ ID NO: 169003 - DNA, 22 bp, Homo sapiens
tatgggcaggatatctatacat

SEQ ID NO: 169004 - DNA, 22 bp, Homo sapiens
taattgtatctatatctatgtc

SEQ ID NO: 169005 - DNA, 23 bp, Homo sapiens
gtctggctctgtgtgtgggaagt

SEQ ID NO: 169006 - DNA, 20 bp, Homo sapiens
tgccttcctccctcaaagcg

SEQ ID NO: 169007 - DNA, 23 bp, Homo sapiens
tttacattgaaatcatttgttat

SEQ ID NO: 169008 - DNA, 21 bp, Homo sapiens
tgtgaagaaagtcaatggtag

SEQ ID NO: 169009 - DNA, 18 bp, Homo sapiens
agtaacatactgagactc

SEQ ID NO: 169010 - DNA, 23 bp, Homo sapiens
agatggagtctcactctgtcacc

SEQ ID NO: 169011 - DNA, 23 bp, Homo sapiens
gtgcagtggctttgttgaggagc

SEQ ID NO: 169012 - DNA, 23 bp, Homo sapiens
tctgtgtgtgtgcgtggctctct

SEQ ID NO: 169013 - DNA, 23 bp, Homo sapiens
tacggtagtgattttcttgtgtt

SEQ ID NO: 169014 - DNA, 20 bp, Homo sapiens
agaattgatttgcagctcat

SEQ ID NO: 169015 - DNA, 20 bp, Homo sapiens
tctgtgtggcatgtgggtga

SEQ ID NO: 169016 - DNA, 23 bp, Homo sapiens
ctcaccctcagtccctctcagag

SEQ ID NO: 169017 - DNA, 23 bp, Homo sapiens
attgttttttaatgcaatttctg

SEQ ID NO: 169018 - DNA, 23 bp, Homo sapiens
tcaggttgttggtagaattcatt

SEQ ID NO: 169019 - DNA, 19 bp, Homo sapiens
tatgagagtctaatgccgc

SEQ ID NO: 169020 - DNA, 23 bp, Homo sapiens
cttctagtagtatgttgaataga

SEQ ID NO: 169021 - DNA, 19 bp, Homo sapiens
gtgtgtgtgtgtgtataca

SEQ ID NO: 169022 - DNA, 23 bp, Homo sapiens
gtatatatatgtattgtatatgt

SEQ ID NO: 169023 - DNA, 20 bp, Homo sapiens
tatatgtatatgtatacata

SEQ ID NO: 169024 - DNA, 18 bp, Homo sapiens
tggcactcctggaagtga

SEQ ID NO: 169025 - DNA, 23 bp, Homo sapiens
tggaacactttgttgttaccaag

SEQ ID NO: 169026 - DNA, 23 bp, Homo sapiens
tgtgtgtgtataacatatgcata

SEQ ID NO: 169027 - DNA, 22 bp, Homo sapiens
tgcacaccggtagtcctagcca

SEQ ID NO: 169028 - DNA, 23 bp, Homo sapiens
tgagttcattgtagattctggat

SEQ ID NO: 169029 - DNA, 23 bp, Homo sapiens
tgagttcattgtagattctggat

SEQ ID NO: 169030 - DNA, 23 bp, Homo sapiens
tcagcttgagctactcacagaga

SEQ ID NO: 169031 - DNA, 23 bp, Homo sapiens
aagaatgtggttaagaattggat

SEQ ID NO: 169032 - DNA, 23 bp, Homo sapiens
agagagaagaatgagagctgagt

SEQ ID NO: 169033 - DNA, 22 bp, Homo sapiens
tcattacaaggtaaaagtaaag

SEQ ID NO: 169034 - DNA, 22 bp, Homo sapiens
tacagtggtatgatctctgttc

SEQ ID NO: 169035 - DNA, 20 bp, Homo sapiens
ctcagaggagagtgagctct

SEQ ID NO: 169036 - DNA, 23 bp, Homo sapiens
tgagtgatgacagtctgcatttc

SEQ ID NO: 169037 - DNA, 23 bp, Homo sapiens
tgtctgtgtcactctctccatag

SEQ ID NO: 169038 - DNA, 20 bp, Homo sapiens
tgggtgcagtctgacatcag

SEQ ID NO: 169039 - DNA, 23 bp, Homo sapiens
acagatgagtgttagcacatggt

SEQ ID NO: 169040 - DNA, 21 bp, Homo sapiens
aagcaccagttttattaagcc

SEQ ID NO: 169041 - DNA, 21 bp, Homo sapiens
atactagactgtgactcagac

SEQ ID NO: 169042 - DNA, 22 bp, Homo sapiens
tttcacagcctggtatagaagg

SEQ ID NO: 169043 - DNA, 23 bp, Homo sapiens
tgagttcattgtagattctggat

SEQ ID NO: 169044 - DNA, 23 bp, Homo sapiens
tgagttcattgtagattctggat

SEQ ID NO: 169045 - DNA, 19 bp, Homo sapiens
taagttgatgaggcactat

SEQ ID NO: 169046 - DNA, 18 bp, Homo sapiens
attatgctacattatttt

SEQ ID NO: 169047 - DNA, 22 bp, Homo sapiens
ctagactcaggcagttctttat

SEQ ID NO: 169048 - DNA, 21 bp, Homo sapiens
tgagtatattgaatgatgctg

SEQ ID NO: 169049 - DNA, 23 bp, Homo sapiens
cagaagacaagttattatcttct

SEQ ID NO: 169050 - DNA, 20 bp, Homo sapiens
gtatactagcaaaacagtga

SEQ ID NO: 169051 - DNA, 19 bp, Homo sapiens
tctgtaccaccttgggact

SEQ ID NO: 169052 - DNA, 23 bp, Homo sapiens
tgtagatgtgattaagttaagga

SEQ ID NO: 169053 - DNA, 23 bp, Homo sapiens
tgagttcattgtagattctggat

SEQ ID NO: 169054 - DNA, 23 bp, Homo sapiens
tgagttcattgtagattctggat

SEQ ID NO: 169055 - DNA, 23 bp, Homo sapiens
ctgtcattcactggatgtgttat

SEQ ID NO: 169056 - DNA, 23 bp, Homo sapiens
taatggctatgctagtctacact

SEQ ID NO: 169057 - DNA, 22 bp, Homo sapiens
gatttctttcctgagagagcta

SEQ ID NO: 169058 - DNA, 20 bp, Homo sapiens
atatgtatatgtatatatgt

SEQ ID NO: 169059 - DNA, 20 bp, Homo sapiens
caaaatgtaactgtgactct

SEQ ID NO: 169060 - DNA, 23 bp, Homo sapiens
ttctgtgaagaaagtcattggta

SEQ ID NO: 169061 - DNA, 23 bp, Homo sapiens
gggtctgtctcgctctgtctccc

SEQ ID NO: 169062 - DNA, 19 bp, Homo sapiens
tggagtgtggtgatcttgg

SEQ ID NO: 169063 - DNA, 23 bp, Homo sapiens
gggtctcactctgtcacccaggc

SEQ ID NO: 169064 - DNA, 22 bp, Homo sapiens
tatgtgtctgtgtctgtgtgtc

SEQ ID NO: 169065 - DNA, 20 bp, Homo sapiens
acgtagttgtacaggaggga

SEQ ID NO: 169066 - DNA, 23 bp, Homo sapiens
actgagtctcactctgtcgccca

SEQ ID NO: 169067 - DNA, 19 bp, Homo sapiens
atgcatatgtatgtgtata

SEQ ID NO: 169068 - DNA, 23 bp, Homo sapiens
atgcctgtatatgtatatgtgtg

SEQ ID NO: 169069 - DNA, 23 bp, Homo sapiens
tatatgcatgtacatgtatatac

SEQ ID NO: 169070 - DNA, 20 bp, Homo sapiens
gtgtgtgtatatatatacgt

SEQ ID NO: 169071 - DNA, 22 bp, Homo sapiens
taaaaatgctttagaatttttt

SEQ ID NO: 169072 - DNA, 23 bp, Homo sapiens
atcatgagagtagatgttggaga

SEQ ID NO: 169073 - DNA, 21 bp, Homo sapiens
tcattttattttgctttgtga

SEQ ID NO: 169074 - DNA, 23 bp, Homo sapiens
atctgtgtatttgtatttgtgtc

SEQ ID NO: 169075 - DNA, 23 bp, Homo sapiens
agtttagcatttgttttgggatt

SEQ ID NO: 169076 - DNA, 23 bp, Homo sapiens
ttaaggaagtaatactatgaata

SEQ ID NO: 169077 - DNA, 22 bp, Homo sapiens
tttttagaagttccactgcagg

SEQ ID NO: 169078 - DNA, 23 bp, Homo sapiens
tacatatgtttgagaggtgacag

SEQ ID NO: 169079 - DNA, 23 bp, Homo sapiens
atatgtgtgtatgtatatgtgtg

SEQ ID NO: 169080 - DNA, 19 bp, Homo sapiens
atgcaaatataggtattca

SEQ ID NO: 169081 - DNA, 23 bp, Homo sapiens
tgtgtgtgtatgcactatatgta

SEQ ID NO: 169082 - DNA, 23 bp, Homo sapiens
tgagttcattgtagattctggat

SEQ ID NO: 169083 - DNA, 23 bp, Homo sapiens
tgagttcattgtagattctggat

SEQ ID NO: 169084 - DNA, 22 bp, Homo sapiens
tggctggcagggtgtttgccta

SEQ ID NO: 169085 - DNA, 20 bp, Homo sapiens
tcagagaagggagagtgcac

SEQ ID NO: 169086 - DNA, 23 bp, Homo sapiens
tgagttcattgtagattctggat

SEQ ID NO: 169087 - DNA, 23 bp, Homo sapiens
tgagttcattgtagattctggat

SEQ ID NO: 169088 - DNA, 19 bp, Homo sapiens
atacacacaagaatgaagg

SEQ ID NO: 169089 - DNA, 19 bp, Homo sapiens
aggtaggacaatgcatgga

SEQ ID NO: 169090 - DNA, 23 bp, Homo sapiens
ttcttctctgtgtgtctgtctgg

SEQ ID NO: 169091 - DNA, 23 bp, Homo sapiens
agggtctgtctctgtcacccacg

SEQ ID NO: 169092 - DNA, 18 bp, Homo sapiens
cagtggcacgatcatagc

SEQ ID NO: 169093 - DNA, 23 bp, Homo sapiens
tcactttctcagactggatggat

SEQ ID NO: 169094 - DNA, 23 bp, Homo sapiens
ccgagtctgttttctgcttggtc

SEQ ID NO: 169095 - DNA, 23 bp, Homo sapiens
tgacagttcagagagatcaagat

SEQ ID NO: 169096 - DNA, 20 bp, Homo sapiens
aataagtgtaggggcatgga

SEQ ID NO: 169097 - DNA, 23 bp, Homo sapiens
ggtacagcaactagatgtgagac

SEQ ID NO: 169098 - DNA, 20 bp, Homo sapiens
aatctgccttttcaacacgt

SEQ ID NO: 169099 - DNA, 23 bp, Homo sapiens
tcagacagaaatgagtgtgcacc

SEQ ID NO: 169100 - DNA, 23 bp, Homo sapiens
aggaggactgtttgttttgttga

SEQ ID NO: 169101 - DNA, 22 bp, Homo sapiens
taccaccattacatatgtgtgt

SEQ ID NO: 169102 - DNA, 19 bp, Homo sapiens
atgtgtacacatatatatg

SEQ ID NO: 169103 - DNA, 23 bp, Homo sapiens
acgctctcactgtcaccttggct

SEQ ID NO: 169104 - DNA, 20 bp, Homo sapiens
ttgtgtaaagtaaatgaagt

SEQ ID NO: 169105 - DNA, 23 bp, Homo sapiens
ttttgagacagggtctctgtctg

SEQ ID NO: 169106 - DNA, 23 bp, Homo sapiens
aaagtgtgactgatatacgtgtg

SEQ ID NO: 169107 - DNA, 23 bp, Homo sapiens
tatgcatgtgtttatatgtgtat

SEQ ID NO: 169108 - DNA, 23 bp, Homo sapiens
acagatacatgcatatatgttta

SEQ ID NO: 169109 - DNA, 23 bp, Homo sapiens
gagtctctctcactctgtcaccc

SEQ ID NO: 169110 - DNA, 21 bp, Homo sapiens
gagtctcgctctgtctcccaa

SEQ ID NO: 169111 - DNA, 19 bp, Homo sapiens
tatctgtttttatatttgt

SEQ ID NO: 169112 - DNA, 23 bp, Homo sapiens
gacagagtctcgctctgtcaccc

SEQ ID NO: 169113 - DNA, 21 bp, Homo sapiens
gtctgttgtgtggctccagaa

SEQ ID NO: 169114 - DNA, 21 bp, Homo sapiens
tctcactctgtcacccaggct

SEQ ID NO: 169115 - DNA, 20 bp, Homo sapiens
tgacacagcacacacactgc

SEQ ID NO: 169116 - DNA, 20 bp, Homo sapiens
agcttgacaacctggttttt

SEQ ID NO: 169117 - DNA, 23 bp, Homo sapiens
tgagttcattgtagattctggat

SEQ ID NO: 169118 - DNA, 23 bp, Homo sapiens
tgagttcattgtagattctggat

SEQ ID NO: 169119 - DNA, 23 bp, Homo sapiens
tgagttcattgtagattctggat

SEQ ID NO: 169120 - DNA, 23 bp, Homo sapiens
tgagttcattgtagattctggat

SEQ ID NO: 169121 - DNA, 23 bp, Homo sapiens
ctaacagactgtctcacacaggg

SEQ ID NO: 169122 - DNA, 21 bp, Homo sapiens
tgaggtaggaggatcacttga

SEQ ID NO: 169123 - DNA, 21 bp, Homo sapiens
tctcacagtgtctgtggctca

SEQ ID NO: 169124 - DNA, 23 bp, Homo sapiens
tctcactgtggttttaatttgca

SEQ ID NO: 169125 - DNA, 23 bp, Homo sapiens
agacagatctgagtgtgttcagt

SEQ ID NO: 169126 - DNA, 23 bp, Homo sapiens
gggtgagactctgagatgtgcag

SEQ ID NO: 169127 - DNA, 23 bp, Homo sapiens
aaagactctctccttggcatatg

SEQ ID NO: 169128 - DNA, 19 bp, Homo sapiens
ctgaagaagtggcagcaaa

SEQ ID NO: 169129 - DNA, 23 bp, Homo sapiens
tgaggtaggaggatcacttgagg

SEQ ID NO: 169130 - DNA, 23 bp, Homo sapiens
acacctatatatatgtatatgtg

SEQ ID NO: 169131 - DNA, 22 bp, Homo sapiens
tatatgtatatatgtatatgtg

SEQ ID NO: 169132 - DNA, 20 bp, Homo sapiens
taaatgtgtgtgtgtatatg

SEQ ID NO: 169133 - DNA, 23 bp, Homo sapiens
cccagtgagagtacggtttgtct

SEQ ID NO: 169134 - DNA, 23 bp, Homo sapiens
aaggcttgtgactttgttgtttc

SEQ ID NO: 169135 - DNA, 23 bp, Homo sapiens
tttctctgactgagtggctgtgg

SEQ ID NO: 169136 - DNA, 21 bp, Homo sapiens
gtgagagttttcttgcagagg

SEQ ID NO: 169137 - DNA, 23 bp, Homo sapiens
tttcagacagtttgtgcagttgg

SEQ ID NO: 169138 - DNA, 23 bp, Homo sapiens
acagagaacacagagtggggata

SEQ ID NO: 169139 - DNA, 23 bp, Homo sapiens
agtctcagcatcttcatctgtga

SEQ ID NO: 169140 - DNA, 23 bp, Homo sapiens
tgagacggagtctcgctctgtct

SEQ ID NO: 169141 - DNA, 23 bp, Homo sapiens
gatggagtctcactctgtcaccc

SEQ ID NO: 169142 - DNA, 22 bp, Homo sapiens
ttctccaccaacatgagggagg

SEQ ID NO: 169143 - DNA, 21 bp, Homo sapiens
tcacacagtgaaaatcaagag

SEQ ID NO: 169144 - DNA, 23 bp, Homo sapiens
aagtaaggaagaaagtgtgaggt

SEQ ID NO: 169145 - DNA, 23 bp, Homo sapiens
gagacagtctcactgtcacccag

SEQ ID NO: 169146 - DNA, 21 bp, Homo sapiens
atatacacacatatatatgtg

SEQ ID NO: 169147 - DNA, 23 bp, Homo sapiens
atgtgtatatatatgtatgtgtg

SEQ ID NO: 169148 - DNA, 23 bp, Homo sapiens
gggtctcactctgtcactcaggc

SEQ ID NO: 169149 - DNA, 21 bp, Homo sapiens
cactcacagtctgagactgag

SEQ ID NO: 169150 - DNA, 20 bp, Homo sapiens
ttgcagtgaactgagatcat

SEQ ID NO: 169151 - DNA, 20 bp, Homo sapiens
ttggccactctgataggtgt

SEQ ID NO: 169152 - DNA, 23 bp, Homo sapiens
gacagagtctcgctctgtcaccc

SEQ ID NO: 169153 - DNA, 20 bp, Homo sapiens
aaatgacttgtgtttctgtt

SEQ ID NO: 169154 - DNA, 20 bp, Homo sapiens
tttgttttactgatgtttgt

SEQ ID NO: 169155 - DNA, 23 bp, Homo sapiens
gatggagtctcactctgtcaccc

SEQ ID NO: 169156 - DNA, 23 bp, Homo sapiens
gactgagtctcgctctgtcaccc

SEQ ID NO: 169157 - DNA, 23 bp, Homo sapiens
tattgtgtgtgtgttaaacatat

SEQ ID NO: 169158 - DNA, 20 bp, Homo sapiens
caggtttgagaatgaaatct

SEQ ID NO: 169159 - DNA, 23 bp, Homo sapiens
tgtgagcatcagtaactgcaagt

SEQ ID NO: 169160 - DNA, 23 bp, Homo sapiens
tgcaaagttgagtgtgaacacta

SEQ ID NO: 169161 - DNA, 23 bp, Homo sapiens
tctgtggttgttggatggaatgt

SEQ ID NO: 169162 - DNA, 20 bp, Homo sapiens
actatgtggagttgcctgtg

SEQ ID NO: 169163 - DNA, 23 bp, Homo sapiens
cacacacagacacgtacacatgt

SEQ ID NO: 169164 - DNA, 23 bp, Homo sapiens
gacttgagattttctagtttaga

SEQ ID NO: 169165 - DNA, 22 bp, Homo sapiens
atgaacctatattcatgtttat

SEQ ID NO: 169166 - DNA, 18 bp, Homo sapiens
ttttttgttgtacacagt

SEQ ID NO: 169167 - DNA, 20 bp, Homo sapiens
aatgtttaatgttgatgaag

SEQ ID NO: 169168 - DNA, 23 bp, Homo sapiens
tattctctgtagatttgaacacc

SEQ ID NO: 169169 - DNA, 22 bp, Homo sapiens
tgtatatgtgtgtatatgtata

SEQ ID NO: 169170 - DNA, 22 bp, Homo sapiens
tatgtgtgtatatatatgtgtg

SEQ ID NO: 169171 - DNA, 20 bp, Homo sapiens
gggattacaggcatgagcca

SEQ ID NO: 169172 - DNA, 18 bp, Homo sapiens
gttgtgtctttgatcttg

SEQ ID NO: 169173 - DNA, 23 bp, Homo sapiens
tgagttcattgtagattctggat

SEQ ID NO: 169174 - DNA, 23 bp, Homo sapiens
tgagttcattgtagattctggat

SEQ ID NO: 169175 - DNA, 23 bp, Homo sapiens
tgagttcattgtagattctggat

SEQ ID NO: 169176 - DNA, 23 bp, Homo sapiens
tgagttcattgtagattctggat

SEQ ID NO: 169177 - DNA, 22 bp, Homo sapiens
attaaagaagtggtagtcaata

SEQ ID NO: 169178 - DNA, 23 bp, Homo sapiens
acgagttattgtatatctattca

SEQ ID NO: 169179 - DNA, 23 bp, Homo sapiens
acttgtagccaaagtctttccaa

SEQ ID NO: 169180 - DNA, 23 bp, Homo sapiens
ttttctcataaagctattgtctg

SEQ ID NO: 169181 - DNA, 23 bp, Homo sapiens
tgagttcattgtagattctggat

SEQ ID NO: 169182 - DNA, 23 bp, Homo sapiens
tgagttcattgtagattctggat

SEQ ID NO: 169183 - DNA, 23 bp, Homo sapiens
atgagtatatatatatgtgtgtg

SEQ ID NO: 169184 - DNA, 23 bp, Homo sapiens
tataatgcatatatatatgtgtg

SEQ ID NO: 169185 - DNA, 22 bp, Homo sapiens
tcagtctctctctctgccttat

SEQ ID NO: 169186 - DNA, 23 bp, Homo sapiens
ttctgaggaggcaagaatggagg

SEQ ID NO: 169187 - DNA, 23 bp, Homo sapiens
actctagatctataagttttatt

SEQ ID NO: 169188 - DNA, 23 bp, Homo sapiens
tatgtatacatgtatatgtgtgt

SEQ ID NO: 169189 - DNA, 23 bp, Homo sapiens
tacaaagtcagtggtgaagaaca

SEQ ID NO: 169190 - DNA, 23 bp, Homo sapiens
tgagttcattgtagattctggat

SEQ ID NO: 169191 - DNA, 23 bp, Homo sapiens
tgagttcattgtagattctggat

SEQ ID NO: 169192 - DNA, 22 bp, Homo sapiens
atatgtgtatatgtatatgtca

SEQ ID NO: 169193 - DNA, 19 bp, Homo sapiens
tgtatatgtacatatatac

SEQ ID NO: 169194 - DNA, 23 bp, Homo sapiens
ggagtctcactctgtcactcagg

SEQ ID NO: 169195 - DNA, 23 bp, Homo sapiens
tagggttaatattgttatgtgtg

SEQ ID NO: 169196 - DNA, 21 bp, Homo sapiens
agtgaagtgaatttcttgact

SEQ ID NO: 169197 - DNA, 19 bp, Homo sapiens
tagagagttcaatccattt

SEQ ID NO: 169198 - DNA, 20 bp, Homo sapiens
tctctgtgtcacattttggc

SEQ ID NO: 169199 - DNA, 21 bp, Homo sapiens
atctgctatcagtgatattag

SEQ ID NO: 169200 - DNA, 19 bp, Homo sapiens
agtctcgctcagtcactca

SEQ ID NO: 169201 - DNA, 23 bp, Homo sapiens
tcatctgtctctgtgtctccggc

SEQ ID NO: 169202 - DNA, 22 bp, Homo sapiens
gtgcctctgactctgtccccaa

SEQ ID NO: 169203 - DNA, 23 bp, Homo sapiens
aatagctaatattgcaattgtag

SEQ ID NO: 169204 - DNA, 20 bp, Homo sapiens
ctctgggtgagtcagtgagt

SEQ ID NO: 169205 - DNA, 23 bp, Homo sapiens
actttactgtgcactactgtagt

SEQ ID NO: 169206 - DNA, 22 bp, Homo sapiens
tggacatcatgctcaagtcgtg

SEQ ID NO: 169207 - DNA, 23 bp, Homo sapiens
tcagactcaagtactatcttcaa

SEQ ID NO: 169208 - DNA, 23 bp, Homo sapiens
gagcctcactctgtcactcaggc

SEQ ID NO: 169209 - DNA, 23 bp, Homo sapiens
aatcatggctcactgtaaccttg

SEQ ID NO: 169210 - DNA, 23 bp, Homo sapiens
cattttcacgaatccttatgtgg

SEQ ID NO: 169211 - DNA, 23 bp, Homo sapiens
aatttttgaatttgttatggagt

SEQ ID NO: 169212 - DNA, 23 bp, Homo sapiens
ttcagttgagtgtgatgtgtctg

SEQ ID NO: 169213 - DNA, 23 bp, Homo sapiens
aaacactgaagtgagtcagaaga

SEQ ID NO: 169214 - DNA, 23 bp, Homo sapiens
tggagtctcactctgtcacccag

SEQ ID NO: 169215 - DNA, 18 bp, Homo sapiens
taagtggctgttattttt

SEQ ID NO: 169216 - DNA, 22 bp, Homo sapiens
aacagtgttgtcagtggtgtga

SEQ ID NO: 169217 - DNA, 23 bp, Homo sapiens
tcactgtctgattatcatcactc

SEQ ID NO: 169218 - DNA, 21 bp, Homo sapiens
tgaggcaggcggtgtaatgtg

SEQ ID NO: 169219 - DNA, 23 bp, Homo sapiens
tgagacacagtctcgctgtgttg

SEQ ID NO: 169220 - DNA, 23 bp, Homo sapiens
tgtatacatgtatgcatatatgt

SEQ ID NO: 169221 - DNA, 23 bp, Homo sapiens
tatatgtgtatacatgcatacac

SEQ ID NO: 169222 - DNA, 22 bp, Homo sapiens
tgtatacatctatgtatatatg

SEQ ID NO: 169223 - DNA, 23 bp, Homo sapiens
tgtgtatatatacacgtgtgtat

SEQ ID NO: 169224 - DNA, 23 bp, Homo sapiens
gacagtgtctccctctgtcaccc

SEQ ID NO: 169225 - DNA, 23 bp, Homo sapiens
cagagtctcactctgtcacccag

SEQ ID NO: 169226 - DNA, 23 bp, Homo sapiens
actcccagagcccctggaactct

SEQ ID NO: 169227 - DNA, 23 bp, Homo sapiens
tcccagagcccctggaactctgg

SEQ ID NO: 169228 - DNA, 20 bp, Homo sapiens
tctgtcacccaggatagatg

SEQ ID NO: 169229 - DNA, 20 bp, Homo sapiens
atatacacacacgtatatat

SEQ ID NO: 169230 - DNA, 23 bp, Homo sapiens
gcttctgcaagtccaagtgactg

SEQ ID NO: 169231 - DNA, 19 bp, Homo sapiens
acgtatatatatgtgtgta

SEQ ID NO: 169232 - DNA, 23 bp, Homo sapiens
tgagttcattgtagattctggat

SEQ ID NO: 169233 - DNA, 23 bp, Homo sapiens
tgagttcattgtagattctggat

SEQ ID NO: 169234 - DNA, 23 bp, Homo sapiens
acagagtctcactctgtcgccca

SEQ ID NO: 169235 - DNA, 23 bp, Homo sapiens
tgagttcattgtagattctggat

SEQ ID NO: 169236 - DNA, 23 bp, Homo sapiens
tgagttcattgtagattctggat

SEQ ID NO: 169237 - DNA, 19 bp, Homo sapiens
aggagaggaatagagagtg

SEQ ID NO: 169238 - DNA, 23 bp, Homo sapiens
tggagtctcactctgtcacccag

SEQ ID NO: 169239 - DNA, 23 bp, Homo sapiens
atatgtgtgtgatatacatgtat

SEQ ID NO: 169240 - DNA, 20 bp, Homo sapiens
tagggagaggatggcatttc

SEQ ID NO: 169241 - DNA, 23 bp, Homo sapiens
ctctctgtgtgtatctgtgtgct

SEQ ID NO: 169242 - DNA, 20 bp, Homo sapiens
acatagtatgtatatatatt

SEQ ID NO: 169243 - DNA, 19 bp, Homo sapiens
tacacacacacatatatgt

SEQ ID NO: 169244 - DNA, 22 bp, Homo sapiens
atacatgtatatgcacatatgt

SEQ ID NO: 169245 - DNA, 23 bp, Homo sapiens
tgtatgtatatatgcatatgtgt

SEQ ID NO: 169246 - DNA, 23 bp, Homo sapiens
tgctttgtttagatgtaaggaga

SEQ ID NO: 169247 - DNA, 18 bp, Homo sapiens
aagacagtatacaaacgg

SEQ ID NO: 169248 - DNA, 19 bp, Homo sapiens
aaaggacacagactgtagt

SEQ ID NO: 169249 - DNA, 22 bp, Homo sapiens
gaatagtttgcaaatatttctt

SEQ ID NO: 169250 - DNA, 23 bp, Homo sapiens
tggatgaatagtttgcaaatatt

SEQ ID NO: 169251 - DNA, 20 bp, Homo sapiens
attcatagtgaagcattgag

SEQ ID NO: 169252 - DNA, 23 bp, Homo sapiens
aagttttgtcagtgtctctcagt

SEQ ID NO: 169253 - DNA, 23 bp, Homo sapiens
tggagtctcactctgtcacccag

SEQ ID NO: 169254 - DNA, 23 bp, Homo sapiens
aactttgctgaaattgttgatca

SEQ ID NO: 169255 - DNA, 21 bp, Homo sapiens
tgtggatttgtttatctgttc

SEQ ID NO: 169256 - DNA, 23 bp, Homo sapiens
atgtgtgtatatatatgtgtgtg

SEQ ID NO: 169257 - DNA, 23 bp, Homo sapiens
atatatgtatatgtatatgtatg

SEQ ID NO: 169258 - DNA, 19 bp, Homo sapiens
tatgtatatgtatatgtat

SEQ ID NO: 169259 - DNA, 19 bp, Homo sapiens
tgtgtatatctatatatgt

SEQ ID NO: 169260 - DNA, 23 bp, Homo sapiens
aggctgagaagtgatatagaagt

SEQ ID NO: 169261 - DNA, 20 bp, Homo sapiens
aataactacagaattggttt

SEQ ID NO: 169262 - DNA, 18 bp, Homo sapiens
atatgtatatatgtacat

SEQ ID NO: 169263 - DNA, 20 bp, Homo sapiens
tatgtgtatatatgtacatg

SEQ ID NO: 169264 - DNA, 23 bp, Homo sapiens
aagttagtccaactggatctgaa

SEQ ID NO: 169265 - DNA, 23 bp, Homo sapiens
aatctcagaggtttttagtagag

SEQ ID NO: 169266 - DNA, 23 bp, Homo sapiens
agactgcgtgctctaactctggg

SEQ ID NO: 169267 - DNA, 23 bp, Homo sapiens
tgagttcattgtagattctggat

SEQ ID NO: 169268 - DNA, 23 bp, Homo sapiens
tgagttcattgtagattctggat

SEQ ID NO: 169269 - DNA, 19 bp, Homo sapiens
tgagacagagtctcactct

SEQ ID NO: 169270 - DNA, 21 bp, Homo sapiens
tgtgtatatatgtatgtgtat

SEQ ID NO: 169271 - DNA, 20 bp, Homo sapiens
cagagcaataaacctgtcat

SEQ ID NO: 169272 - DNA, 22 bp, Homo sapiens
aaacagtgagtaaagagtcagt

SEQ ID NO: 169273 - DNA, 23 bp, Homo sapiens
gatatccaggtgtagatttctct

SEQ ID NO: 169274 - DNA, 20 bp, Homo sapiens
tctcaagtcttttctgtgaa

SEQ ID NO: 169275 - DNA, 20 bp, Homo sapiens
attatactttaagttctagg

SEQ ID NO: 169276 - DNA, 20 bp, Homo sapiens
tattgtcattgtttaggggt

SEQ ID NO: 169277 - DNA, 18 bp, Homo sapiens
tatacacatatactatat

SEQ ID NO: 169278 - DNA, 22 bp, Homo sapiens
tgtctcagtttctctctccaga

SEQ ID NO: 169279 - DNA, 23 bp, Homo sapiens
gtatcagagcatgttctttatgc

SEQ ID NO: 169280 - DNA, 18 bp, Homo sapiens
gagtctctttctcactcc

SEQ ID NO: 169281 - DNA, 18 bp, Homo sapiens
ctctgtgcatgggctgac

SEQ ID NO: 169282 - DNA, 23 bp, Homo sapiens
ttgtgttttccttggctgctctt

SEQ ID NO: 169283 - DNA, 23 bp, Homo sapiens
ttttaacagagtaaaagatgaga

SEQ ID NO: 169284 - DNA, 20 bp, Homo sapiens
attgtgtttgtgtatgtgag

SEQ ID NO: 169285 - DNA, 23 bp, Homo sapiens
tatatacatgcatacatatacat

SEQ ID NO: 169286 - DNA, 23 bp, Homo sapiens
caaatctgtcagcagagagtggg

SEQ ID NO: 169287 - DNA, 23 bp, Homo sapiens
tcactctgtggatgtacaatgct

SEQ ID NO: 169288 - DNA, 23 bp, Homo sapiens
tatgtgtgtatatatatacacat

SEQ ID NO: 169289 - DNA, 19 bp, Homo sapiens
tgtgtgtgtatatatatac

SEQ ID NO: 169290 - DNA, 23 bp, Homo sapiens
tatgtgtgtgtgtatatatacac

SEQ ID NO: 169291 - DNA, 23 bp, Homo sapiens
gtggagtctctctctgtcaccca

SEQ ID NO: 169292 - DNA, 19 bp, Homo sapiens
tggtctatcttgaagaatg

SEQ ID NO: 169293 - DNA, 23 bp, Homo sapiens
attctgcagctgttagatgggat

SEQ ID NO: 169294 - DNA, 23 bp, Homo sapiens
gctgccagttggagatgagtctg

SEQ ID NO: 169295 - DNA, 23 bp, Homo sapiens
agttgacagtgaggttacttgct

SEQ ID NO: 169296 - DNA, 23 bp, Homo sapiens
agcaagaggaaccagactgtgca

SEQ ID NO: 169297 - DNA, 23 bp, Homo sapiens
tctaaacaaccatcagtgtctgg

SEQ ID NO: 169298 - DNA, 22 bp, Homo sapiens
tcactcagacactgatacgtga

SEQ ID NO: 169299 - DNA, 19 bp, Homo sapiens
tctccttcagatttactca

SEQ ID NO: 169300 - DNA, 23 bp, Homo sapiens
gagagaagagaagcagctgaggt

SEQ ID NO: 169301 - DNA, 23 bp, Homo sapiens
ctctcaccctgtctttcaacagt

SEQ ID NO: 169302 - DNA, 22 bp, Homo sapiens
actgccccacatttagttttta

SEQ ID NO: 169303 - DNA, 22 bp, Homo sapiens
tttgtagtctaactgctaaggt

SEQ ID NO: 169304 - DNA, 21 bp, Homo sapiens
tctcaactcccttcattctgg

SEQ ID NO: 169305 - DNA, 23 bp, Homo sapiens
catctgtgtctgtgactgagcag

SEQ ID NO: 169306 - DNA, 23 bp, Homo sapiens
tgtcacacacactctgctcactg

SEQ ID NO: 169307 - DNA, 23 bp, Homo sapiens
aatagcagaactgactgagctct

SEQ ID NO: 169308 - DNA, 23 bp, Homo sapiens
tctctctggctgtctctcgggtc

SEQ ID NO: 169309 - DNA, 23 bp, Homo sapiens
gtggagtctcactctgtcaccca

SEQ ID NO: 169310 - DNA, 20 bp, Homo sapiens
gagctgtcacagctgagtgt

SEQ ID NO: 169311 - DNA, 19 bp, Homo sapiens
atatgtgtatatatatatg

SEQ ID NO: 169312 - DNA, 20 bp, Homo sapiens
tatatagtatatgtgtatag

SEQ ID NO: 169313 - DNA, 23 bp, Homo sapiens
acaaggtctcactctgtcactca

SEQ ID NO: 169314 - DNA, 23 bp, Homo sapiens
atgtgcatatgtatatttgtgtg

SEQ ID NO: 169315 - DNA, 23 bp, Homo sapiens
tgtatgtgtcgatgtgcatgtgt

SEQ ID NO: 169316 - DNA, 23 bp, Homo sapiens
cggagtctcactctgtcacccag

SEQ ID NO: 169317 - DNA, 23 bp, Homo sapiens
gagtctcactctgtcacccaggc

SEQ ID NO: 169318 - DNA, 23 bp, Homo sapiens
agctcactgttgtcactgtccag

SEQ ID NO: 169319 - DNA, 21 bp, Homo sapiens
acagtgcctttagttttgttt

SEQ ID NO: 169320 - DNA, 23 bp, Homo sapiens
cacagtgatgagacttcatctct

SEQ ID NO: 169321 - DNA, 21 bp, Homo sapiens
tgagatggagtctcactctgt

SEQ ID NO: 169322 - DNA, 23 bp, Homo sapiens
actggaggcacagacagtagtga

SEQ ID NO: 169323 - DNA, 19 bp, Homo sapiens
tctgatctcagtgtgtcag

SEQ ID NO: 169324 - DNA, 21 bp, Homo sapiens
tatgtatatatgtatatgtgt

SEQ ID NO: 169325 - DNA, 19 bp, Homo sapiens
tgtgtatatatatgtgtgt

SEQ ID NO: 169326 - DNA, 21 bp, Homo sapiens
taaaacagacagggtttcacc

SEQ ID NO: 169327 - DNA, 18 bp, Homo sapiens
ttcaccatgttggccagg

SEQ ID NO: 169328 - DNA, 18 bp, Homo sapiens
cagtggcacagtctcagc

SEQ ID NO: 169329 - DNA, 23 bp, Homo sapiens
catatacatgtgtatatgtatat

SEQ ID NO: 169330 - DNA, 23 bp, Homo sapiens
tatgtgtgtatatgtatatatgt

SEQ ID NO: 169331 - DNA, 20 bp, Homo sapiens
tctcgctgtcactcaggctg

SEQ ID NO: 169332 - DNA, 19 bp, Homo sapiens
tgcattgtaaggaagtatg

SEQ ID NO: 169333 - DNA, 23 bp, Homo sapiens
gggggtgtctctgtgcctgtctg

SEQ ID NO: 169334 - DNA, 23 bp, Homo sapiens
tgagttcattgtagattctggat

SEQ ID NO: 169335 - DNA, 23 bp, Homo sapiens
tgagttcattgtagattctggat

SEQ ID NO: 169336 - DNA, 21 bp, Homo sapiens
tgtttgacatctgctgcaatg

SEQ ID NO: 169337 - DNA, 23 bp, Homo sapiens
gcaatgtaaagaacgatgatttc

SEQ ID NO: 169338 - DNA, 23 bp, Homo sapiens
gggtctcactctgtcacccaggc

SEQ ID NO: 169339 - DNA, 23 bp, Homo sapiens
gtatatatgtatatgtatgtgaa

SEQ ID NO: 169340 - DNA, 20 bp, Homo sapiens
tatatgtatatgtatgtgta

SEQ ID NO: 169341 - DNA, 21 bp, Homo sapiens
aaagaggatgtttagttttgt

SEQ ID NO: 169342 - DNA, 20 bp, Homo sapiens
aaactctcttctaaagtggc

SEQ ID NO: 169343 - DNA, 23 bp, Homo sapiens
atgtatatgtatatatgtgtgtg

SEQ ID NO: 169344 - DNA, 23 bp, Homo sapiens
tgagttcattgtagattctggat

SEQ ID NO: 169345 - DNA, 23 bp, Homo sapiens
tgagttcattgtagattctggat

SEQ ID NO: 169346 - DNA, 23 bp, Homo sapiens
atacagaatgtgtatgtgtgtgt

SEQ ID NO: 169347 - DNA, 23 bp, Homo sapiens
tttttggttccatatgaaattta

SEQ ID NO: 169348 - DNA, 23 bp, Homo sapiens
aactgtgtcccagagattctggt

SEQ ID NO: 169349 - DNA, 23 bp, Homo sapiens
ctcttctggcttgtagggtttct

SEQ ID NO: 169350 - DNA, 21 bp, Homo sapiens
tgagacagtgtctcactctgt

SEQ ID NO: 169351 - DNA, 19 bp, Homo sapiens
tatcagtcactgcctccct

SEQ ID NO: 169352 - DNA, 22 bp, Homo sapiens
atttgtatgtcttagaaatgtc

SEQ ID NO: 169353 - DNA, 23 bp, Homo sapiens
tgagttcattgtagattctggat

SEQ ID NO: 169354 - DNA, 23 bp, Homo sapiens
tgagttcattgtagattctggat

SEQ ID NO: 169355 - DNA, 19 bp, Homo sapiens
gaatgatttcaacttttcg

SEQ ID NO: 169356 - DNA, 23 bp, Homo sapiens
tgagttcattgtagattctggat

SEQ ID NO: 169357 - DNA, 23 bp, Homo sapiens
tgagttcattgtagattctggat

SEQ ID NO: 169358 - DNA, 22 bp, Homo sapiens
atctagctcttattgtattggg

SEQ ID NO: 169359 - DNA, 23 bp, Homo sapiens
ttggaatgtaaggaactaaaagg

SEQ ID NO: 169360 - DNA, 18 bp, Homo sapiens
atatacttcataggtgta

SEQ ID NO: 169361 - DNA, 23 bp, Homo sapiens
tctgtgaagaaagtcaatggtag

SEQ ID NO: 169362 - DNA, 21 bp, Homo sapiens
ttactgcatcctctgcctcct

SEQ ID NO: 169363 - DNA, 23 bp, Homo sapiens
tggagtctcactctgtcacccag

SEQ ID NO: 169364 - DNA, 18 bp, Homo sapiens
acagtggtgcgatctcag

SEQ ID NO: 169365 - DNA, 23 bp, Homo sapiens
tggtacaaacacagctgactgca

SEQ ID NO: 169366 - DNA, 23 bp, Homo sapiens
tgtgcatgtgtgtatatatgtgt

SEQ ID NO: 169367 - DNA, 20 bp, Homo sapiens
tatgtgctttatatatctgg

SEQ ID NO: 169368 - DNA, 23 bp, Homo sapiens
tctggttttctttccccactgta

SEQ ID NO: 169369 - DNA, 23 bp, Homo sapiens
acactgtaggtggaaatgtgggt

SEQ ID NO: 169370 - DNA, 22 bp, Homo sapiens
aatgtgcatatatatacatata

SEQ ID NO: 169371 - DNA, 21 bp, Homo sapiens
tatatatgacctgcatgatgt

SEQ ID NO: 169372 - DNA, 23 bp, Homo sapiens
tgtgtgcatgtgtgtgtgtgtat

SEQ ID NO: 169373 - DNA, 23 bp, Homo sapiens
gtctcactgtgtcactcaggctg

SEQ ID NO: 169374 - DNA, 23 bp, Homo sapiens
agacagagtctcactctgtcgcc

SEQ ID NO: 169375 - DNA, 23 bp, Homo sapiens
acagagtctcactctgtcgccca

SEQ ID NO: 169376 - DNA, 23 bp, Homo sapiens
gaggtctcactctgtcacccagg

SEQ ID NO: 169377 - DNA, 23 bp, Homo sapiens
gtcaggatgaaatcagagtcttc

SEQ ID NO: 169378 - DNA, 23 bp, Homo sapiens
attaattttcactatgctcttga

SEQ ID NO: 169379 - DNA, 22 bp, Homo sapiens
tatgtatgtatgtatgtatgta

SEQ ID NO: 169380 - DNA, 18 bp, Homo sapiens
tacacacatgtgtgtgtg

SEQ ID NO: 169381 - DNA, 18 bp, Homo sapiens
gtgttttattgtctgttc

SEQ ID NO: 169382 - DNA, 23 bp, Homo sapiens
tgagatggagtctcactctgtca

SEQ ID NO: 169383 - DNA, 18 bp, Homo sapiens
gtggcgagatcttggctc

SEQ ID NO: 169384 - DNA, 23 bp, Homo sapiens
atatgtatatatgtatatgtata

SEQ ID NO: 169385 - DNA, 23 bp, Homo sapiens
tgtatacatgtatgtatatatgt

SEQ ID NO: 169386 - DNA, 23 bp, Homo sapiens
tggagtctcactctgtcacccag

SEQ ID NO: 169387 - DNA, 23 bp, Homo sapiens
cggagtctcactctgtcacccag

SEQ ID NO: 169388 - DNA, 19 bp, Homo sapiens
tgcctgttatctcagcacc

SEQ ID NO: 169389 - DNA, 21 bp, Homo sapiens
tgaggtaggtggatcacttga

SEQ ID NO: 169390 - DNA, 21 bp, Homo sapiens
gcagttatctgggtcgaccac

SEQ ID NO: 169391 - DNA, 23 bp, Homo sapiens
tgagttcattgtagattctggat

SEQ ID NO: 169392 - DNA, 23 bp, Homo sapiens
tgagttcattgtagattctggat

SEQ ID NO: 169393 - DNA, 22 bp, Homo sapiens
cagaggactgtgtgtgcagacg

SEQ ID NO: 169394 - DNA, 19 bp, Homo sapiens
tggagaattacagtcagct

SEQ ID NO: 169395 - DNA, 18 bp, Homo sapiens
atacatatgtatatgtat

SEQ ID NO: 169396 - DNA, 23 bp, Homo sapiens
tgagactcactctgtcacccagg

SEQ ID NO: 169397 - DNA, 22 bp, Homo sapiens
cgtcatcttcctgagggtcgct

SEQ ID NO: 169398 - DNA, 23 bp, Homo sapiens
gagacagagtctcactctgtcgc

SEQ ID NO: 169399 - DNA, 20 bp, Homo sapiens
tagagtgcagtgtctcggct

SEQ ID NO: 169400 - DNA, 23 bp, Homo sapiens
tgagttcattgtagattctggat

SEQ ID NO: 169401 - DNA, 23 bp, Homo sapiens
tgagttcattgtagattctggat

SEQ ID NO: 169402 - DNA, 23 bp, Homo sapiens
agacagtgtctggctctgtcacc

SEQ ID NO: 169403 - DNA, 23 bp, Homo sapiens
tgagttcattgtagattctggat

SEQ ID NO: 169404 - DNA, 23 bp, Homo sapiens
tgagttcattgtagattctggat

SEQ ID NO: 169405 - DNA, 23 bp, Homo sapiens
tcacgctgtctctcttgccatct

SEQ ID NO: 169406 - DNA, 23 bp, Homo sapiens
tttgtcacactctgtcatgaccc

SEQ ID NO: 169407 - DNA, 23 bp, Homo sapiens
acagggtctcactctgtctccca

SEQ ID NO: 169408 - DNA, 23 bp, Homo sapiens
gacagaatctcactctgtctccc

SEQ ID NO: 169409 - DNA, 21 bp, Homo sapiens
catacctgtaatcccagcctt

SEQ ID NO: 169410 - DNA, 23 bp, Homo sapiens
tggagtctcactctgtcatttag

SEQ ID NO: 169411 - DNA, 23 bp, Homo sapiens
tcttcaagaggatcagagggcaa

SEQ ID NO: 169412 - DNA, 23 bp, Homo sapiens
accgagtctcgctctgtcaccca

SEQ ID NO: 169413 - DNA, 23 bp, Homo sapiens
gtcaaggtctcactctgtcaccc

SEQ ID NO: 169414 - DNA, 23 bp, Homo sapiens
gtctcgctctgtcacccacactg

SEQ ID NO: 169415 - DNA, 20 bp, Homo sapiens
gtctcgctctgtcacccagg

SEQ ID NO: 169416 - DNA, 23 bp, Homo sapiens
gagcctctcagaccctgagtttc

SEQ ID NO: 169417 - DNA, 18 bp, Homo sapiens
tatgtgtatatatacgta

SEQ ID NO: 169418 - DNA, 19 bp, Homo sapiens
tatgtgtatatatatacgt

SEQ ID NO: 169419 - DNA, 21 bp, Homo sapiens
ggagtctcagaaacctgtgcg

SEQ ID NO: 169420 - DNA, 23 bp, Homo sapiens
tgtgtctgtgggtctctgtcatc

SEQ ID NO: 169421 - DNA, 23 bp, Homo sapiens
agacggtgtctcgctctgtcacc

SEQ ID NO: 169422 - DNA, 23 bp, Homo sapiens
tgagataatctctcactctgtcg

SEQ ID NO: 169423 - DNA, 23 bp, Homo sapiens
cggagtctcactctgtcacccag

SEQ ID NO: 169424 - DNA, 23 bp, Homo sapiens
gagtctcactctgtcacccaggc

SEQ ID NO: 169425 - DNA, 23 bp, Homo sapiens
agactctgacacacaatgggcta

SEQ ID NO: 169426 - DNA, 23 bp, Homo sapiens
tctcagagaggagagagtgggct

SEQ ID NO: 169427 - DNA, 23 bp, Homo sapiens
cggagtctcactctgtcacccag

SEQ ID NO: 169428 - DNA, 23 bp, Homo sapiens
gagtctcactctgtcacccaggc

SEQ ID NO: 169429 - DNA, 23 bp, Homo sapiens
atatgcatgtaagtttatttcaa

SEQ ID NO: 169430 - DNA, 23 bp, Homo sapiens
tataaaacatcatgttgtacacc

SEQ ID NO: 169431 - DNA, 23 bp, Homo sapiens
tgtgctagcagtgtcagaagagg

SEQ ID NO: 169432 - DNA, 23 bp, Homo sapiens
acacatgtgtgtctgtatatgta

SEQ ID NO: 169433 - DNA, 23 bp, Homo sapiens
tgcctgactccttctctctgtgt

SEQ ID NO: 169434 - DNA, 23 bp, Homo sapiens
cactcagaggagagtgagcacat

SEQ ID NO: 169435 - DNA, 23 bp, Homo sapiens
agaggctctctgtgtggctcaga

SEQ ID NO: 169436 - DNA, 23 bp, Homo sapiens
gtttttgtcataggaagacagtc

SEQ ID NO: 169437 - DNA, 23 bp, Homo sapiens
atataagaggattactttccata

SEQ ID NO: 169438 - DNA, 19 bp, Homo sapiens
taaaagtttgagaagtacc

SEQ ID NO: 169439 - DNA, 23 bp, Homo sapiens
aaacaacaggtgctggagaggat

SEQ ID NO: 169440 - DNA, 19 bp, Homo sapiens
ttgcacctttgtctctctc

SEQ ID NO: 169441 - DNA, 22 bp, Homo sapiens
tgaaatgaagtttgaatgcggt

SEQ ID NO: 169442 - DNA, 21 bp, Homo sapiens
acactagctatcctttactga

SEQ ID NO: 169443 - DNA, 23 bp, Homo sapiens
tttctcacacagtatattgggag

SEQ ID NO: 169444 - DNA, 23 bp, Homo sapiens
tgagttcattgtagattctggat

SEQ ID NO: 169445 - DNA, 23 bp, Homo sapiens
tgagttcattgtagattctggat

SEQ ID NO: 169446 - DNA, 23 bp, Homo sapiens
tgagttcattgtagattctggat

SEQ ID NO: 169447 - DNA, 23 bp, Homo sapiens
tgagttcattgtagattctggat

SEQ ID NO: 169448 - DNA, 21 bp, Homo sapiens
gtagcttgatgagaatagcat

SEQ ID NO: 169449 - DNA, 23 bp, Homo sapiens
gctcactgtgagtcactgtgacc

SEQ ID NO: 169450 - DNA, 23 bp, Homo sapiens
atatatcctgattttcttgtaca

SEQ ID NO: 169451 - DNA, 23 bp, Homo sapiens
tgagttcattgtagattctggat

SEQ ID NO: 169452 - DNA, 23 bp, Homo sapiens
tgagttcattgtagattctggat

SEQ ID NO: 169453 - DNA, 23 bp, Homo sapiens
atatatcctgattttcttgtaca

SEQ ID NO: 169454 - DNA, 23 bp, Homo sapiens
gcttctctcttctgtgtgtctgt

SEQ ID NO: 169455 - DNA, 23 bp, Homo sapiens
atgtgtatatatatgtgtgtgta

SEQ ID NO: 169456 - DNA, 19 bp, Homo sapiens
tgtatatatgtatgtgtgt

SEQ ID NO: 169457 - DNA, 23 bp, Homo sapiens
ctctgtctctgtttcagatgtcc

SEQ ID NO: 169458 - DNA, 22 bp, Homo sapiens
taggttcatgtagtttggttca

SEQ ID NO: 169459 - DNA, 23 bp, Homo sapiens
gttaaggtctccctctctgtcac

SEQ ID NO: 169460 - DNA, 23 bp, Homo sapiens
tgagacagagtctcactctgtca

SEQ ID NO: 169461 - DNA, 23 bp, Homo sapiens
agtctcgctctgtcacccaccca

SEQ ID NO: 169462 - DNA, 23 bp, Homo sapiens
tctgtgtctgtgtgtgccagcct

SEQ ID NO: 169463 - DNA, 23 bp, Homo sapiens
gtgtctgtgtgtgtgtgaccatc

SEQ ID NO: 169464 - DNA, 21 bp, Homo sapiens
tgtctacaataagtaaagtac

SEQ ID NO: 169465 - DNA, 23 bp, Homo sapiens
gaggctgcagtgaaccatgattg

SEQ ID NO: 169466 - DNA, 23 bp, Homo sapiens
agctcacagaacaaagagaccag

SEQ ID NO: 169467 - DNA, 23 bp, Homo sapiens
tagactctggattttttttctga

SEQ ID NO: 169468 - DNA, 23 bp, Homo sapiens
aagtagtaagttgtatagttatc

SEQ ID NO: 169469 - DNA, 18 bp, Homo sapiens
atgacagaagatagtctt

SEQ ID NO: 169470 - DNA, 23 bp, Homo sapiens
tgagttcattgtagattctggat

SEQ ID NO: 169471 - DNA, 23 bp, Homo sapiens
tgagttcattgtagattctggat

SEQ ID NO: 169472 - DNA, 23 bp, Homo sapiens
aagtggagtctcactctgtcacc

SEQ ID NO: 169473 - DNA, 23 bp, Homo sapiens
gtctcactcactcagtgctcaat

SEQ ID NO: 169474 - DNA, 23 bp, Homo sapiens
gacagagtctcgctctgtcaccc

SEQ ID NO: 169475 - DNA, 19 bp, Homo sapiens
tgagacagagtctcgctct

SEQ ID NO: 169476 - DNA, 23 bp, Homo sapiens
aatcctcctgctgccttggtgtc

SEQ ID NO: 169477 - DNA, 23 bp, Homo sapiens
agacggagtctggctctgtcact

SEQ ID NO: 169478 - DNA, 20 bp, Homo sapiens
atgtgtgtatatatgtgtgt

SEQ ID NO: 169479 - DNA, 19 bp, Homo sapiens
atacacacatatatacaca

SEQ ID NO: 169480 - DNA, 23 bp, Homo sapiens
tgagttcattgtagattctggat

SEQ ID NO: 169481 - DNA, 23 bp, Homo sapiens
tgagttcattgtagattctggat

SEQ ID NO: 169482 - DNA, 18 bp, Homo sapiens
agtatacacatgtatagt

SEQ ID NO: 169483 - DNA, 22 bp, Homo sapiens
gggtctcagtctgtctcccagt

SEQ ID NO: 169484 - DNA, 20 bp, Homo sapiens
ttttggatagtattgatgta

SEQ ID NO: 169485 - DNA, 23 bp, Homo sapiens
tctgtagtgactgtgatgatctg

SEQ ID NO: 169486 - DNA, 23 bp, Homo sapiens
tgagttcattgtagattctggat

SEQ ID NO: 169487 - DNA, 23 bp, Homo sapiens
tgagttcattgtagattctggat

SEQ ID NO: 169488 - DNA, 22 bp, Homo sapiens
gtgtgtccaggagacagacaga

SEQ ID NO: 169489 - DNA, 23 bp, Homo sapiens
tgtctgtgtgtctgtctgtctcc

SEQ ID NO: 169490 - DNA, 23 bp, Homo sapiens
aacctgtatgtaatactacttgt

SEQ ID NO: 169491 - DNA, 22 bp, Homo sapiens
atgtatgtatatatgtatgtgt

SEQ ID NO: 169492 - DNA, 21 bp, Homo sapiens
tatatgtatgtatatacgtat

SEQ ID NO: 169493 - DNA, 19 bp, Homo sapiens
tatgagaagagagtcacca

SEQ ID NO: 169494 - DNA, 23 bp, Homo sapiens
atggtagatgtactgacagcttg

SEQ ID NO: 169495 - DNA, 23 bp, Homo sapiens
tggtagttgcatgtttagttttc

SEQ ID NO: 169496 - DNA, 23 bp, Homo sapiens
aatgtggtagatatatgcacgat

SEQ ID NO: 169497 - DNA, 19 bp, Homo sapiens
atatcgtgcatatatctac

SEQ ID NO: 169498 - DNA, 23 bp, Homo sapiens
ctctcaatcactgtcaaactgtg

SEQ ID NO: 169499 - DNA, 20 bp, Homo sapiens
tacacatatgtgtgtgtaca

SEQ ID NO: 169500 - DNA, 23 bp, Homo sapiens
atgtgtgtctctgtatgtgagat

SEQ ID NO: 169501 - DNA, 21 bp, Homo sapiens
acagcacactgatgggtcttg

SEQ ID NO: 169502 - DNA, 23 bp, Homo sapiens
cagtacagagagtgatcacagac

SEQ ID NO: 169503 - DNA, 21 bp, Homo sapiens
tgtatatatatatatctgtac

SEQ ID NO: 169504 - DNA, 22 bp, Homo sapiens
tttcactagatatgctattctg

SEQ ID NO: 169505 - DNA, 23 bp, Homo sapiens
agagtctctctgtctcttctgag

SEQ ID NO: 169506 - DNA, 23 bp, Homo sapiens
tgggagtggagtgacacaagaac

SEQ ID NO: 169507 - DNA, 23 bp, Homo sapiens
aagaagaagatggccaataacct

SEQ ID NO: 169508 - DNA, 22 bp, Homo sapiens
cagttgtggtactttgttatgt

SEQ ID NO: 169509 - DNA, 23 bp, Homo sapiens
tccacactgtttcaccattgagt

SEQ ID NO: 169510 - DNA, 21 bp, Homo sapiens
tagtctgagagaatgttatga

SEQ ID NO: 169511 - DNA, 23 bp, Homo sapiens
tatttgacttctgattatgtaat

SEQ ID NO: 169512 - DNA, 21 bp, Homo sapiens
tataacaatatatgtataaca

SEQ ID NO: 169513 - DNA, 22 bp, Homo sapiens
ttcccactgggagctctgtctc

SEQ ID NO: 169514 - DNA, 21 bp, Homo sapiens
tgattttttttctcttaggat

SEQ ID NO: 169515 - DNA, 23 bp, Homo sapiens
taattgtgattttgtaattgaga

SEQ ID NO: 169516 - DNA, 21 bp, Homo sapiens
aaaatcacaattacttttgca

SEQ ID NO: 169517 - DNA, 23 bp, Homo sapiens
tctcagtcacaccctctcaacag

SEQ ID NO: 169518 - DNA, 20 bp, Homo sapiens
cattgagtctgatgttagct

SEQ ID NO: 169519 - DNA, 22 bp, Homo sapiens
tatatcactatatatatatcag

SEQ ID NO: 169520 - DNA, 23 bp, Homo sapiens
tgagttcattgtagattctggat

SEQ ID NO: 169521 - DNA, 23 bp, Homo sapiens
tgagttcattgtagattctggat

SEQ ID NO: 169522 - DNA, 21 bp, Homo sapiens
ttcaagtcccttgtaagttgg

SEQ ID NO: 169523 - DNA, 19 bp, Homo sapiens
ttcactcatgatttggctc

SEQ ID NO: 169524 - DNA, 23 bp, Homo sapiens
tatatgtgtatatatatgtgtgt

SEQ ID NO: 169525 - DNA, 23 bp, Homo sapiens
tccaactttactgaatttgttga

SEQ ID NO: 169526 - DNA, 23 bp, Homo sapiens
cttcgaagttgttggtgtatagg

SEQ ID NO: 169527 - DNA, 23 bp, Homo sapiens
tgagttcattgtagattctggat

SEQ ID NO: 169528 - DNA, 23 bp, Homo sapiens
tgagttcattgtagattctggat

SEQ ID NO: 169529 - DNA, 21 bp, Homo sapiens
ctctggcactcaggcactcag

SEQ ID NO: 169530 - DNA, 23 bp, Homo sapiens
ccagtgtgcgtgtctcacccact

SEQ ID NO: 169531 - DNA, 21 bp, Homo sapiens
accctggctgcctgtttccga

SEQ ID NO: 169532 - DNA, 23 bp, Homo sapiens
aacaatgtttttgtatagtctgc

SEQ ID NO: 169533 - DNA, 23 bp, Homo sapiens
acgcagagttacaactttcactt

SEQ ID NO: 169534 - DNA, 22 bp, Homo sapiens
ttttacaggatctgcaagtggt

SEQ ID NO: 169535 - DNA, 23 bp, Homo sapiens
tgagttcattgtagattctggat

SEQ ID NO: 169536 - DNA, 23 bp, Homo sapiens
tgagttcattgtagattctggat

SEQ ID NO: 169537 - DNA, 23 bp, Homo sapiens
tgtgttctgccatgattgtaagt

SEQ ID NO: 169538 - DNA, 18 bp, Homo sapiens
tcaagttgtagtactgtt

SEQ ID NO: 169539 - DNA, 21 bp, Homo sapiens
tttcacagtggctgaactaat

SEQ ID NO: 169540 - DNA, 20 bp, Homo sapiens
attatgtggtttatttggag

SEQ ID NO: 169541 - DNA, 23 bp, Homo sapiens
tctcaatttgttcttgaaacagt

SEQ ID NO: 169542 - DNA, 23 bp, Homo sapiens
acagagtctcgctctgtggctca

SEQ ID NO: 169543 - DNA, 23 bp, Homo sapiens
atcatggagtttttgtacttcat

SEQ ID NO: 169544 - DNA, 23 bp, Homo sapiens
tgagttcattgtagattctggat

SEQ ID NO: 169545 - DNA, 23 bp, Homo sapiens
tgagttcattgtagattctggat

SEQ ID NO: 169546 - DNA, 23 bp, Homo sapiens
acatgtacacatatgtgtatatg

SEQ ID NO: 169547 - DNA, 23 bp, Homo sapiens
acatatgtgtatgtttatatatg

SEQ ID NO: 169548 - DNA, 20 bp, Homo sapiens
tatgtgtatgtatgtacata

SEQ ID NO: 169549 - DNA, 23 bp, Homo sapiens
tctgtgcctgtgtgcctgtctat

SEQ ID NO: 169550 - DNA, 19 bp, Homo sapiens
agctacaatggagcaggga

SEQ ID NO: 169551 - DNA, 23 bp, Homo sapiens
tgagttcattgtagattctggat

SEQ ID NO: 169552 - DNA, 23 bp, Homo sapiens
tgagttcattgtagattctggat

SEQ ID NO: 169553 - DNA, 18 bp, Homo sapiens
tcccagctattcagaagg

SEQ ID NO: 169554 - DNA, 20 bp, Homo sapiens
taggatgttgaggctgcagt

SEQ ID NO: 169555 - DNA, 23 bp, Homo sapiens
tgagttcattgtagattctggat

SEQ ID NO: 169556 - DNA, 23 bp, Homo sapiens
tgagttcattgtagattctggat

SEQ ID NO: 169557 - DNA, 23 bp, Homo sapiens
tgagttcattgtagattctggat

SEQ ID NO: 169558 - DNA, 23 bp, Homo sapiens
tgagttcattgtagattctggat

SEQ ID NO: 169559 - DNA, 23 bp, Homo sapiens
atagtcatgtatatgtatactat

SEQ ID NO: 169560 - DNA, 23 bp, Homo sapiens
tgagttcattgtagattctggat

SEQ ID NO: 169561 - DNA, 23 bp, Homo sapiens
tgagttcattgtagattctggat

SEQ ID NO: 169562 - DNA, 19 bp, Homo sapiens
gtgagagatagtgatctag

SEQ ID NO: 169563 - DNA, 23 bp, Homo sapiens
ttttttggttccatatgaaattt

SEQ ID NO: 169564 - DNA, 22 bp, Homo sapiens
tattgcactatacatagcatgt

SEQ ID NO: 169565 - DNA, 23 bp, Homo sapiens
tatgtatgtatgtatatatgtgt

SEQ ID NO: 169566 - DNA, 23 bp, Homo sapiens
tattagctggttattttgttcat

SEQ ID NO: 169567 - DNA, 23 bp, Homo sapiens
tgagttcattgtagattctggat

SEQ ID NO: 169568 - DNA, 23 bp, Homo sapiens
tgagttcattgtagattctggat

SEQ ID NO: 169569 - DNA, 23 bp, Homo sapiens
tgagttcattgtagattctggat

SEQ ID NO: 169570 - DNA, 23 bp, Homo sapiens
tgagttcattgtagattctggat

SEQ ID NO: 169571 - DNA, 22 bp, Homo sapiens
ttggaagatcaaataggcaaga

SEQ ID NO: 169572 - DNA, 23 bp, Homo sapiens
tttttctgtttgttataaaatgt

SEQ ID NO: 169573 - DNA, 21 bp, Homo sapiens
atattgtaagttatggcacac

SEQ ID NO: 169574 - DNA, 23 bp, Homo sapiens
tgtgacagcttcttgatctgtcc

SEQ ID NO: 169575 - DNA, 21 bp, Homo sapiens
tatatgtatatgtatacatat

SEQ ID NO: 169576 - DNA, 21 bp, Homo sapiens
tatatgtatatgtatacatat

SEQ ID NO: 169577 - DNA, 23 bp, Homo sapiens
tatgtatatatatacatatgtgt

SEQ ID NO: 169578 - DNA, 23 bp, Homo sapiens
tatgtatatatatacatatgtgt

SEQ ID NO: 169579 - DNA, 23 bp, Homo sapiens
tatgtatatatatacatatgtgt

SEQ ID NO: 169580 - DNA, 20 bp, Homo sapiens
ttaggattgtctgctatgtg

SEQ ID NO: 169581 - DNA, 23 bp, Homo sapiens
gtgtacagagcatgggtacagtg

SEQ ID NO: 169582 - DNA, 23 bp, Homo sapiens
gactcacactctgcctctgagac

SEQ ID NO: 169583 - DNA, 23 bp, Homo sapiens
tgagttcattgtagattctggat

SEQ ID NO: 169584 - DNA, 23 bp, Homo sapiens
tgagttcattgtagattctggat

SEQ ID NO: 169585 - DNA, 23 bp, Homo sapiens
acgctccgtgtatttgacaagct

SEQ ID NO: 169586 - DNA, 23 bp, Homo sapiens
agtgtcagtttgtcaaatacccc

SEQ ID NO: 169587 - DNA, 19 bp, Homo sapiens
tatgcgtatatatacgtat

SEQ ID NO: 169588 - DNA, 19 bp, Homo sapiens
tatgcgtatatatacgtat

SEQ ID NO: 169589 - DNA, 19 bp, Homo sapiens
tatgcgtatatatacgtat

SEQ ID NO: 169590 - DNA, 22 bp, Homo sapiens
tgtgtatatatgtatatatgca

SEQ ID NO: 169591 - DNA, 23 bp, Homo sapiens
atatatgtatatatgtatacatg

SEQ ID NO: 169592 - DNA, 23 bp, Homo sapiens
tgagttcattgtagattctggat

SEQ ID NO: 169593 - DNA, 23 bp, Homo sapiens
tgagttcattgtagattctggat

SEQ ID NO: 169594 - DNA, 23 bp, Homo sapiens
tgagttcattgtagattctggat

SEQ ID NO: 169595 - DNA, 23 bp, Homo sapiens
tgagttcattgtagattctggat

SEQ ID NO: 169596 - DNA, 23 bp, Homo sapiens
tacacgtatatgtgtatacgtat

SEQ ID NO: 169597 - DNA, 23 bp, Homo sapiens
tatgtgtgtatatatgtgtatgc

SEQ ID NO: 169598 - DNA, 23 bp, Homo sapiens
tatgtgtgtatatatatgtgtgt

SEQ ID NO: 169599 - DNA, 23 bp, Homo sapiens
tatgtgtatatgtgtatatgtgt

SEQ ID NO: 169600 - DNA, 23 bp, Homo sapiens
tcttttttggttccatatgaaat

SEQ ID NO: 169601 - DNA, 23 bp, Homo sapiens
tgagttcattgtagattctggat

SEQ ID NO: 169602 - DNA, 21 bp, Homo sapiens
ggaaagttttgcagaaaggtg

SEQ ID NO: 169603 - DNA, 19 bp, Homo sapiens
taccattgaatactagtca

SEQ ID NO: 169604 - DNA, 20 bp, Homo sapiens
gatgttcttcttgtggagta

SEQ ID NO: 169605 - DNA, 22 bp, Homo sapiens
atgttggcctttttagtgagga

SEQ ID NO: 169606 - DNA, 18 bp, Homo sapiens
ttgagtatatatctagga

SEQ ID NO: 169607 - DNA, 23 bp, Homo sapiens
tgagttcattgtagattctggat

SEQ ID NO: 169608 - DNA, 23 bp, Homo sapiens
tgagttcattgtagattctggat

SEQ ID NO: 169609 - DNA, 22 bp, Homo sapiens
tatgtatgtatgtgtgtgtgta

SEQ ID NO: 169610 - DNA, 23 bp, Homo sapiens
tgagttcattgtagattctggat

SEQ ID NO: 169611 - DNA, 23 bp, Homo sapiens
tgagttcattgtagattctggat

SEQ ID NO: 169612 - DNA, 23 bp, Homo sapiens
tgagttcattgtagattctggat

SEQ ID NO: 169613 - DNA, 23 bp, Homo sapiens
tgagttcattgtagattctggat

SEQ ID NO: 169614 - DNA, 22 bp, Homo sapiens
ggtatacttaggattatcttgg

SEQ ID NO: 169615 - DNA, 18 bp, Homo sapiens
tgtgaagaaagtcaatgg

SEQ ID NO: 169616 - DNA, 23 bp, Homo sapiens
ttgaaatgtgattttcttcattt

SEQ ID NO: 169617 - DNA, 19 bp, Homo sapiens
taggttcatcttgtgccca

SEQ ID NO: 169618 - DNA, 23 bp, Homo sapiens
cactggctgagttctgctccatg

SEQ ID NO: 169619 - DNA, 19 bp, Homo sapiens
gagatctgagtcattggtg

SEQ ID NO: 169620 - DNA, 23 bp, Homo sapiens
tctcactgtcaccaattgctctg

SEQ ID NO: 169621 - DNA, 23 bp, Homo sapiens
cttgtagtgtagttttcagcttg

SEQ ID NO: 169622 - DNA, 23 bp, Homo sapiens
atctcagctcattacagtctcag

SEQ ID NO: 169623 - DNA, 23 bp, Homo sapiens
tatatctatctttatgtatatct

SEQ ID NO: 169624 - DNA, 23 bp, Homo sapiens
caggtggagaaatcaagcagctg

SEQ ID NO: 169625 - DNA, 23 bp, Homo sapiens
tgtgctagcctccctgcttgcct

SEQ ID NO: 169626 - DNA, 23 bp, Homo sapiens
tagtcagagatctgtgggagctc

SEQ ID NO: 169627 - DNA, 21 bp, Homo sapiens
tctctctgtggcatctacccg

SEQ ID NO: 169628 - DNA, 23 bp, Homo sapiens
taagggtggatgagtaggggcta

SEQ ID NO: 169629 - DNA, 23 bp, Homo sapiens
tgcctctgtctgcctgtgtcccc

SEQ ID NO: 169630 - DNA, 23 bp, Homo sapiens
gacagagtctcgctctgtcaccc

SEQ ID NO: 169631 - DNA, 23 bp, Homo sapiens
agatagggtctcactctgtcact

SEQ ID NO: 169632 - DNA, 23 bp, Homo sapiens
gcctctctgagcctcagttgtct

SEQ ID NO: 169633 - DNA, 23 bp, Homo sapiens
taactcactggtaatctgtttat

SEQ ID NO: 169634 - DNA, 23 bp, Homo sapiens
acacaatcactcacagcttccct

SEQ ID NO: 169635 - DNA, 23 bp, Homo sapiens
gtttctgcatgtttattgtcagt

SEQ ID NO: 169636 - DNA, 19 bp, Homo sapiens
tttatctgtgtacttggtg

SEQ ID NO: 169637 - DNA, 21 bp, Homo sapiens
ggagagataggttgtagtgag

SEQ ID NO: 169638 - DNA, 23 bp, Homo sapiens
tgagttcattgtagattctggat

SEQ ID NO: 169639 - DNA, 23 bp, Homo sapiens
tgagttcattgtagattctggat

SEQ ID NO: 169640 - DNA, 23 bp, Homo sapiens
tgagttcattgtagattctggat

SEQ ID NO: 169641 - DNA, 23 bp, Homo sapiens
tgagttcattgtagattctggat

SEQ ID NO: 169642 - DNA, 19 bp, Homo sapiens
atgtatatatatgtgtgtg

SEQ ID NO: 169643 - DNA, 23 bp, Homo sapiens
tatgtgtgtatatatgtgtgtgt

SEQ ID NO: 169644 - DNA, 20 bp, Homo sapiens
tatgtgtgtatatatgtgtg

SEQ ID NO: 169645 - DNA, 21 bp, Homo sapiens
cttgagtctgagaggttgagg

SEQ ID NO: 169646 - DNA, 22 bp, Homo sapiens
tttgactgcttgttataagttc

SEQ ID NO: 169647 - DNA, 23 bp, Homo sapiens
ggagtctcactcactctgtcacc

SEQ ID NO: 169648 - DNA, 23 bp, Homo sapiens
agaatggagcccaaactggtgct

SEQ ID NO: 169649 - DNA, 23 bp, Homo sapiens
aatatagacatattctatatcca

SEQ ID NO: 169650 - DNA, 23 bp, Homo sapiens
atagagacatattctatatccat

SEQ ID NO: 169651 - DNA, 19 bp, Homo sapiens
tatgtatatgcatatgtgt

SEQ ID NO: 169652 - DNA, 20 bp, Homo sapiens
aggttaccagttgttactca

SEQ ID NO: 169653 - DNA, 23 bp, Homo sapiens
catatggtaattgcatgtttagt

SEQ ID NO: 169654 - DNA, 20 bp, Homo sapiens
gtggctctgacagggtctct

SEQ ID NO: 169655 - DNA, 23 bp, Homo sapiens
ccttctgcacacagagcagcctg

SEQ ID NO: 169656 - DNA, 19 bp, Homo sapiens
attgcactccagcctggga

SEQ ID NO: 169657 - DNA, 23 bp, Homo sapiens
acagtctcactctgtcacccagg

SEQ ID NO: 169658 - DNA, 23 bp, Homo sapiens
tgtggtccaagagtacacttggt

SEQ ID NO: 169659 - DNA, 23 bp, Homo sapiens
cacttcattctagagagagagct

SEQ ID NO: 169660 - DNA, 23 bp, Homo sapiens
tgagttcattgtagattctggat

SEQ ID NO: 169661 - DNA, 23 bp, Homo sapiens
tgagttcattgtagattctggat

SEQ ID NO: 169662 - DNA, 23 bp, Homo sapiens
aagtgtcagtacagagggagtct

SEQ ID NO: 169663 - DNA, 19 bp, Homo sapiens
tgtgtgtgtgtatgtgtgt

SEQ ID NO: 169664 - DNA, 23 bp, Homo sapiens
tgtgacagcttcttgatctgtcc

SEQ ID NO: 169665 - DNA, 23 bp, Homo sapiens
ctctgtgtcagtctgaatgccct

SEQ ID NO: 169666 - DNA, 19 bp, Homo sapiens
tggactcacagggggatta

SEQ ID NO: 169667 - DNA, 23 bp, Homo sapiens
tcccagagcccctggaactctgg

SEQ ID NO: 169668 - DNA, 22 bp, Homo sapiens
catatgtgtatatgtatatatg

SEQ ID NO: 169669 - DNA, 20 bp, Homo sapiens
tatatgtgtatacatgtata

SEQ ID NO: 169670 - DNA, 20 bp, Homo sapiens
tctggtacaaggtagtatag

SEQ ID NO: 169671 - DNA, 23 bp, Homo sapiens
agaactgtgaggttaagttgttt

SEQ ID NO: 169672 - DNA, 23 bp, Homo sapiens
gacagagtctcactctgtcgccc

SEQ ID NO: 169673 - DNA, 23 bp, Homo sapiens
acagagtctcactctgtcgccca

SEQ ID NO: 169674 - DNA, 20 bp, Homo sapiens
agagaggagagactgaggag

SEQ ID NO: 169675 - DNA, 23 bp, Homo sapiens
tgagttcattgtagattctggat

SEQ ID NO: 169676 - DNA, 23 bp, Homo sapiens
tgagttcattgtagattctggat

SEQ ID NO: 169677 - DNA, 23 bp, Homo sapiens
tatgtttatgtgtgtgtatatat

SEQ ID NO: 169678 - DNA, 23 bp, Homo sapiens
tgagttcattgtagattctggat

SEQ ID NO: 169679 - DNA, 23 bp, Homo sapiens
tgagttcattgtagattctggat

SEQ ID NO: 169680 - DNA, 23 bp, Homo sapiens
accctgtacagtgtgagctctct

SEQ ID NO: 169681 - DNA, 23 bp, Homo sapiens
tgagttcattgtagattctggat

SEQ ID NO: 169682 - DNA, 23 bp, Homo sapiens
tgagttcattgtagattctggat

SEQ ID NO: 169683 - DNA, 23 bp, Homo sapiens
tgtatgctgtgtctgaaaggtct

SEQ ID NO: 169684 - DNA, 21 bp, Homo sapiens
taaaatctaatgcagctgtgg

SEQ ID NO: 169685 - DNA, 23 bp, Homo sapiens
tgaaatcaagatagactgtcact

SEQ ID NO: 169686 - DNA, 23 bp, Homo sapiens
tcagaggaacgttctgtggctca

SEQ ID NO: 169687 - DNA, 23 bp, Homo sapiens
tgagttcattgtagattctggat

SEQ ID NO: 169688 - DNA, 23 bp, Homo sapiens
tgagttcattgtagattctggat

SEQ ID NO: 169689 - DNA, 23 bp, Homo sapiens
atttgagtctggatttttcaatg

SEQ ID NO: 169690 - DNA, 23 bp, Homo sapiens
tgagttcatcctgagtcctactc

SEQ ID NO: 169691 - DNA, 23 bp, Homo sapiens
tgagttcattgtagattctggat

SEQ ID NO: 169692 - DNA, 23 bp, Homo sapiens
tgagttcattgtagattctggat

SEQ ID NO: 169693 - DNA, 23 bp, Homo sapiens
tacatatgtatacacacacacac

SEQ ID NO: 169694 - DNA, 23 bp, Homo sapiens
aggtattttattctctttgtagc

SEQ ID NO: 169695 - DNA, 23 bp, Homo sapiens
tgagttcattgtagattctggat

SEQ ID NO: 169696 - DNA, 23 bp, Homo sapiens
tgagttcattgtagattctggat

SEQ ID NO: 169697 - DNA, 18 bp, Homo sapiens
atacatatatatatggtg

SEQ ID NO: 169698 - DNA, 23 bp, Homo sapiens
aaaaagaagtttgaacaagaagt

SEQ ID NO: 169699 - DNA, 18 bp, Homo sapiens
ttgtgatttttgcacatt

SEQ ID NO: 169700 - DNA, 23 bp, Homo sapiens
tggagtctcactctgtcacccag

SEQ ID NO: 169701 - DNA, 23 bp, Homo sapiens
tgagttcattgtagattctggat

SEQ ID NO: 169702 - DNA, 23 bp, Homo sapiens
tgagttcattgtagattctggat

SEQ ID NO: 169703 - DNA, 23 bp, Homo sapiens
tctccattagttcagttgtttta

SEQ ID NO: 169704 - DNA, 18 bp, Homo sapiens
tgaggagattgttttctg

SEQ ID NO: 169705 - DNA, 22 bp, Homo sapiens
atcacacgcagctaatttttgt

SEQ ID NO: 169706 - DNA, 20 bp, Homo sapiens
atgtgagatgtgtgtgtgta

SEQ ID NO: 169707 - DNA, 23 bp, Homo sapiens
tgagttcattgtagattctggat

SEQ ID NO: 169708 - DNA, 23 bp, Homo sapiens
tgagttcattgtagattctggat

SEQ ID NO: 169709 - DNA, 23 bp, Homo sapiens
gtttgtgtatgtgtatacgtatg

SEQ ID NO: 169710 - DNA, 23 bp, Homo sapiens
tgtgcatatgtttagatgtatgt

SEQ ID NO: 169711 - DNA, 23 bp, Homo sapiens
tatgcatatatatacatgtgtgt

SEQ ID NO: 169712 - DNA, 23 bp, Homo sapiens
tatgcatatatatacatgtgtgt

SEQ ID NO: 169713 - DNA, 23 bp, Homo sapiens
agatgagtctggctatgttgttc

SEQ ID NO: 169714 - DNA, 23 bp, Homo sapiens
gacagtgtcactctgtcacccag

SEQ ID NO: 169715 - DNA, 23 bp, Homo sapiens
tttcctggttttataagttgttt

SEQ ID NO: 169716 - DNA, 23 bp, Homo sapiens
tatttgctcttcttcctgaatca

SEQ ID NO: 169717 - DNA, 23 bp, Homo sapiens
tgagttcattgtagattctggat

SEQ ID NO: 169718 - DNA, 23 bp, Homo sapiens
tgagttcattgtagattctggat

SEQ ID NO: 169719 - DNA, 23 bp, Homo sapiens
tgagttcattgtagattctggat

SEQ ID NO: 169720 - DNA, 23 bp, Homo sapiens
tgagttcattgtagattctggat

SEQ ID NO: 169721 - DNA, 18 bp, Homo sapiens
tcattgggtgtaaactat

SEQ ID NO: 169722 - DNA, 23 bp, Homo sapiens
agctgattcaactcactgtccag

SEQ ID NO: 169723 - DNA, 21 bp, Homo sapiens
tgtatatatatacgtgtgtat

SEQ ID NO: 169724 - DNA, 23 bp, Homo sapiens
tatctatctgttgtgggaagtca

SEQ ID NO: 169725 - DNA, 23 bp, Homo sapiens
tacagactatatatgtgtgtgtg

SEQ ID NO: 169726 - DNA, 23 bp, Homo sapiens
tgagttcattgtagattctggat

SEQ ID NO: 169727 - DNA, 23 bp, Homo sapiens
tgagttcattgtagattctggat

SEQ ID NO: 169728 - DNA, 23 bp, Homo sapiens
tgagttcattgtagattctggat

SEQ ID NO: 169729 - DNA, 23 bp, Homo sapiens
tgagttcattgtagattctggat

SEQ ID NO: 169730 - DNA, 21 bp, Homo sapiens
tgtgaagaaagtcattggtag

SEQ ID NO: 169731 - DNA, 23 bp, Homo sapiens
atatatgtatatgtatatgtgtg

SEQ ID NO: 169732 - DNA, 19 bp, Homo sapiens
cacaggagagagtgagctt

SEQ ID NO: 169733 - DNA, 23 bp, Homo sapiens
taaaagtctgtgatagaattgtg

SEQ ID NO: 169734 - DNA, 23 bp, Homo sapiens
tctcactcactcacccttttccc

SEQ ID NO: 169735 - DNA, 23 bp, Homo sapiens
agagtctcactctgtcacccagg

SEQ ID NO: 169736 - DNA, 21 bp, Homo sapiens
actgcatatgttttcatggct

SEQ ID NO: 169737 - DNA, 23 bp, Homo sapiens
aggcagaagagactgagctcctc

SEQ ID NO: 169738 - DNA, 23 bp, Homo sapiens
ctgggagcatgtgtgaagtcctt

SEQ ID NO: 169739 - DNA, 22 bp, Homo sapiens
tctcctggatgatatcctgaaa

SEQ ID NO: 169740 - DNA, 23 bp, Homo sapiens
tctctctgtctctttcaggtact

SEQ ID NO: 169741 - DNA, 22 bp, Homo sapiens
gtgtgggagtctcagtctctgt

SEQ ID NO: 169742 - DNA, 23 bp, Homo sapiens
cacacacgcacatatatatgtgt

SEQ ID NO: 169743 - DNA, 22 bp, Homo sapiens
ttttaagttctctgagaaatct

SEQ ID NO: 169744 - DNA, 22 bp, Homo sapiens
tttcacagtggctgaagtaatt

SEQ ID NO: 169745 - DNA, 23 bp, Homo sapiens
tatgactctgccagttttttggt

SEQ ID NO: 169746 - DNA, 23 bp, Homo sapiens
tgagttcattgtagattctggat

SEQ ID NO: 169747 - DNA, 23 bp, Homo sapiens
tgagttcattgtagattctggat

SEQ ID NO: 169748 - DNA, 22 bp, Homo sapiens
tatgtgtgtgtgtgtatataga

SEQ ID NO: 169749 - DNA, 21 bp, Homo sapiens
tcactgtggttttgatatata

SEQ ID NO: 169750 - DNA, 20 bp, Homo sapiens
atactgagctttcttcatat

SEQ ID NO: 169751 - DNA, 23 bp, Homo sapiens
ggtttctcactcactgtttccct

SEQ ID NO: 169752 - DNA, 22 bp, Homo sapiens
taccagctagtacaacttctaa

SEQ ID NO: 169753 - DNA, 21 bp, Homo sapiens
aaagatcatttaatttgtaat

SEQ ID NO: 169754 - DNA, 23 bp, Homo sapiens
tgagttcattgtagattctggat

SEQ ID NO: 169755 - DNA, 23 bp, Homo sapiens
tgagttcattgtagattctggat

SEQ ID NO: 169756 - DNA, 23 bp, Homo sapiens
tgagttcattgtagattctggat

SEQ ID NO: 169757 - DNA, 23 bp, Homo sapiens
tgagttcattgtagattctggat

SEQ ID NO: 169758 - DNA, 21 bp, Homo sapiens
tacactttagtttttgtgtat

SEQ ID NO: 169759 - DNA, 23 bp, Homo sapiens
atggatatacagttgtatcagta

SEQ ID NO: 169760 - DNA, 23 bp, Homo sapiens
tggagtctcactctgtcacccag

SEQ ID NO: 169761 - DNA, 23 bp, Homo sapiens
tgagttcattgtagattctggat

SEQ ID NO: 169762 - DNA, 23 bp, Homo sapiens
tgagttcattgtagattctggat

SEQ ID NO: 169763 - DNA, 21 bp, Homo sapiens
tacagccattggataaaatgt

SEQ ID NO: 169764 - DNA, 21 bp, Homo sapiens
ttaacagttttttgggtagac

SEQ ID NO: 169765 - DNA, 23 bp, Homo sapiens
atgtgtgtatatatatatgtgtg

SEQ ID NO: 169766 - DNA, 22 bp, Homo sapiens
tctccgggagtgaaattgctgg

SEQ ID NO: 169767 - DNA, 23 bp, Homo sapiens
atgtacatctatatgtttatgtg

SEQ ID NO: 169768 - DNA, 23 bp, Homo sapiens
catatatatatagtatgtgtgta

SEQ ID NO: 169769 - DNA, 23 bp, Homo sapiens
tgacacagtgtggtaatgatgct

SEQ ID NO: 169770 - DNA, 23 bp, Homo sapiens
tgagttcattgtagattctggat

SEQ ID NO: 169771 - DNA, 23 bp, Homo sapiens
tgagttcattgtagattctggat

SEQ ID NO: 169772 - DNA, 23 bp, Homo sapiens
tgtttacatttttgaggagccac

SEQ ID NO: 169773 - DNA, 23 bp, Homo sapiens
tctcccagtctctgtgagaggat

SEQ ID NO: 169774 - DNA, 23 bp, Homo sapiens
tcactttctcagtcacaattttg

SEQ ID NO: 169775 - DNA, 23 bp, Homo sapiens
tctcactctgtttctctgactag

SEQ ID NO: 169776 - DNA, 23 bp, Homo sapiens
tgagttcattgtagattctggat

SEQ ID NO: 169777 - DNA, 23 bp, Homo sapiens
tgagttcattgtagattctggat

SEQ ID NO: 169778 - DNA, 23 bp, Homo sapiens
tgagttcattgtagattctggat

SEQ ID NO: 169779 - DNA, 23 bp, Homo sapiens
tgagttcattgtagattctggat

SEQ ID NO: 169780 - DNA, 22 bp, Homo sapiens
tctgttaagtccatttgttgta

SEQ ID NO: 169781 - DNA, 22 bp, Homo sapiens
ttagagaaggtggtttcctctg

SEQ ID NO: 169782 - DNA, 23 bp, Homo sapiens
tgagttcattgtagattctggat

SEQ ID NO: 169783 - DNA, 22 bp, Homo sapiens
aatagctctatttgaaaagcat

SEQ ID NO: 169784 - DNA, 21 bp, Homo sapiens
atgacgctgcttcttttgtgg

SEQ ID NO: 169785 - DNA, 22 bp, Homo sapiens
atatggaacatatatatggata

SEQ ID NO: 169786 - DNA, 23 bp, Homo sapiens
atttgagggtcaatattgatgta

SEQ ID NO: 169787 - DNA, 23 bp, Homo sapiens
gttcacagaaaattgattccaga

SEQ ID NO: 169788 - DNA, 23 bp, Homo sapiens
gtgtgtgtgtgtgtatgcgtata

SEQ ID NO: 169789 - DNA, 23 bp, Homo sapiens
aaattgaggtttcagtgctcctt

SEQ ID NO: 169790 - DNA, 21 bp, Homo sapiens
aatggctttgggagtactctt

SEQ ID NO: 169791 - DNA, 23 bp, Homo sapiens
atatgtatatatatatgtgtgta

SEQ ID NO: 169792 - DNA, 23 bp, Homo sapiens
tatatgtgtatatatatatgtgt

SEQ ID NO: 169793 - DNA, 23 bp, Homo sapiens
atatgtatatatatatgtgtata

SEQ ID NO: 169794 - DNA, 23 bp, Homo sapiens
tgagttcattgtagattctggat

SEQ ID NO: 169795 - DNA, 23 bp, Homo sapiens
tgagttcattgtagattctggat

SEQ ID NO: 169796 - DNA, 23 bp, Homo sapiens
tatgtatgcatgtgtgtgtatat

SEQ ID NO: 169797 - DNA, 20 bp, Homo sapiens
cacacacacacatatatcac

SEQ ID NO: 169798 - DNA, 23 bp, Homo sapiens
ttcttctttttgctgagaattgt

SEQ ID NO: 169799 - DNA, 23 bp, Homo sapiens
atatgtatatgtgtatgtgtgtg

SEQ ID NO: 169800 - DNA, 23 bp, Homo sapiens
tctcagtaagtgaatttctctct

SEQ ID NO: 169801 - DNA, 18 bp, Homo sapiens
tgtctgtagccctagcta

SEQ ID NO: 169802 - DNA, 22 bp, Homo sapiens
ttgatttcacaggctcacttca

SEQ ID NO: 169803 - DNA, 23 bp, Homo sapiens
tgcacacatgtacgtgtgtgtgt

SEQ ID NO: 169804 - DNA, 23 bp, Homo sapiens
ctctactactcattttggtgatg

SEQ ID NO: 169805 - DNA, 23 bp, Homo sapiens
gagtctcactctgtcacccaggc

SEQ ID NO: 169806 - DNA, 23 bp, Homo sapiens
atgcctgtaattccagctctttg

SEQ ID NO: 169807 - DNA, 23 bp, Homo sapiens
atatatgtgtatatatatgtgtg

SEQ ID NO: 169808 - DNA, 23 bp, Homo sapiens
tctctctgtcaagtgatcatagg

SEQ ID NO: 169809 - DNA, 23 bp, Homo sapiens
aatgtttgagtggtgagagagag

SEQ ID NO: 169810 - DNA, 19 bp, Homo sapiens
tatacgtatatatgtatac

SEQ ID NO: 169811 - DNA, 23 bp, Homo sapiens
atgcttacactgcgtctattgag

SEQ ID NO: 169812 - DNA, 23 bp, Homo sapiens
gtttttaattctgtttatgtggt

SEQ ID NO: 169813 - DNA, 20 bp, Homo sapiens
gagtcacaggagttgagaga

SEQ ID NO: 169814 - DNA, 23 bp, Homo sapiens
atgtttaactcttgttcttcttg

SEQ ID NO: 169815 - DNA, 20 bp, Homo sapiens
atgtgtatatatatacgtgt

SEQ ID NO: 169816 - DNA, 23 bp, Homo sapiens
aaatctgaggattttttttctat

SEQ ID NO: 169817 - DNA, 23 bp, Homo sapiens
tgtgaagaatatcattggaattt

SEQ ID NO: 169818 - DNA, 23 bp, Homo sapiens
tggattgttcagaacctcaatga

SEQ ID NO: 169819 - DNA, 23 bp, Homo sapiens
tgagttcattgtagattctggat

SEQ ID NO: 169820 - DNA, 23 bp, Homo sapiens
tgagttcattgtagattctggat

SEQ ID NO: 169821 - DNA, 23 bp, Homo sapiens
gtgtgaggttgtacacagtgtat

SEQ ID NO: 169822 - DNA, 19 bp, Homo sapiens
aggtcttgatctgattgta

SEQ ID NO: 169823 - DNA, 23 bp, Homo sapiens
ttctttggttacaaatctgtaca

SEQ ID NO: 169824 - DNA, 22 bp, Homo sapiens
tctgtctgtctgagtgggagct

SEQ ID NO: 169825 - DNA, 23 bp, Homo sapiens
atcactcactgcctctcttgggt

SEQ ID NO: 169826 - DNA, 23 bp, Homo sapiens
ctcccagagcccctggaactctg

SEQ ID NO: 169827 - DNA, 23 bp, Homo sapiens
tcccagagcccctggaactctgg

SEQ ID NO: 169828 - DNA, 23 bp, Homo sapiens
tcccagagcccctggaactctgg

SEQ ID NO: 169829 - DNA, 23 bp, Homo sapiens
tcccagagcccctggaactctgg

SEQ ID NO: 169830 - DNA, 23 bp, Homo sapiens
ttacatatgtgtatgtgtctata

SEQ ID NO: 169831 - DNA, 23 bp, Homo sapiens
ccgagtctcgctctgtctccctg

SEQ ID NO: 169832 - DNA, 21 bp, Homo sapiens
tgtgtgtatatgtatatatgt

SEQ ID NO: 169833 - DNA, 21 bp, Homo sapiens
acttgttttttattttacatg

SEQ ID NO: 169834 - DNA, 23 bp, Homo sapiens
tctgtcactctcttttctgagcc

SEQ ID NO: 169835 - DNA, 23 bp, Homo sapiens
tcctgtgggtctcagtctctcta

SEQ ID NO: 169836 - DNA, 23 bp, Homo sapiens
cataaactgtcaggattagaaag

SEQ ID NO: 169837 - DNA, 22 bp, Homo sapiens
atctgactccctcagtttatag

SEQ ID NO: 169838 - DNA, 23 bp, Homo sapiens
aagagtgtagagcttccagggat

SEQ ID NO: 169839 - DNA, 21 bp, Homo sapiens
tggaatctatagaagtttaga

SEQ ID NO: 169840 - DNA, 22 bp, Homo sapiens
tctctgttgagagtgagctcaa

SEQ ID NO: 169841 - DNA, 23 bp, Homo sapiens
ttcatcatcatggaaggagaaaa

SEQ ID NO: 169842 - DNA, 22 bp, Homo sapiens
tatgtatgtatatatatgtatg

SEQ ID NO: 169843 - DNA, 23 bp, Homo sapiens
tatatatgtatgtatgtatatgt

SEQ ID NO: 169844 - DNA, 22 bp, Homo sapiens
tgtatatatgtatgtatgcata

SEQ ID NO: 169845 - DNA, 22 bp, Homo sapiens
tgatatcttagatatattctgt

SEQ ID NO: 169846 - DNA, 19 bp, Homo sapiens
gtgtcatgtgcctgtggtc

SEQ ID NO: 169847 - DNA, 23 bp, Homo sapiens
gctgaggtaggaggatcacttga

SEQ ID NO: 169848 - DNA, 18 bp, Homo sapiens
tgattttgtatcctgaaa

SEQ ID NO: 169849 - DNA, 23 bp, Homo sapiens
tttcagtgcaatgttgaatagag

SEQ ID NO: 169850 - DNA, 23 bp, Homo sapiens
aacatcaaaaagaagacttagca

SEQ ID NO: 169851 - DNA, 21 bp, Homo sapiens
atgataagtatttttgatgtt

SEQ ID NO: 169852 - DNA, 22 bp, Homo sapiens
atgagaacttatttacttgttt

SEQ ID NO: 169853 - DNA, 20 bp, Homo sapiens
ttgtactaatagatatgctc

SEQ ID NO: 169854 - DNA, 19 bp, Homo sapiens
tatctattaggattacttt

SEQ ID NO: 169855 - DNA, 20 bp, Homo sapiens
acacacataggcatacatat

SEQ ID NO: 169856 - DNA, 21 bp, Homo sapiens
tggatgaggatcggctttgat

SEQ ID NO: 169857 - DNA, 23 bp, Homo sapiens
ttacagtcgaatgtactgtggca

SEQ ID NO: 169858 - DNA, 20 bp, Homo sapiens
atagtggattctgtaactgt

SEQ ID NO: 169859 - DNA, 23 bp, Homo sapiens
cactgactggctctgagtttccc

SEQ ID NO: 169860 - DNA, 22 bp, Homo sapiens
tatgtgtatatatatgtgtgta

SEQ ID NO: 169861 - DNA, 22 bp, Homo sapiens
tgtgtatatatgtgtgtgtata

SEQ ID NO: 169862 - DNA, 23 bp, Homo sapiens
ttgcatccgtgtgtgtatgtgtg

SEQ ID NO: 169863 - DNA, 23 bp, Homo sapiens
tgagttcattgtagattctggat

SEQ ID NO: 169864 - DNA, 23 bp, Homo sapiens
agatgaaagatgacagggaccag

SEQ ID NO: 169865 - DNA, 23 bp, Homo sapiens
tgagttcattgtagattctggat

SEQ ID NO: 169866 - DNA, 23 bp, Homo sapiens
tgagttcattgtagattctggat

SEQ ID NO: 169867 - DNA, 23 bp, Homo sapiens
tgagttcattgtagattctggat

SEQ ID NO: 169868 - DNA, 23 bp, Homo sapiens
tgagttcattgtagattctggat

SEQ ID NO: 169869 - DNA, 21 bp, Homo sapiens
tgtatgtgtgcatgtgtgtgt

SEQ ID NO: 169870 - DNA, 22 bp, Homo sapiens
atctgtgtatatattagtatgt

SEQ ID NO: 169871 - DNA, 22 bp, Homo sapiens
tcgtattctgtgaattgctata

SEQ ID NO: 169872 - DNA, 23 bp, Homo sapiens
atgactgattttgtaattctcac

SEQ ID NO: 169873 - DNA, 20 bp, Homo sapiens
aagcaagatgaagttggtta

SEQ ID NO: 169874 - DNA, 22 bp, Homo sapiens
actgtctcagttacaattttgc

SEQ ID NO: 169875 - DNA, 19 bp, Homo sapiens
tgctagtttcaatgtcagt

SEQ ID NO: 169876 - DNA, 23 bp, Homo sapiens
tatctttcagcagcttgtttcag

SEQ ID NO: 169877 - DNA, 22 bp, Homo sapiens
aacagacagaagtaagtctgct

SEQ ID NO: 169878 - DNA, 23 bp, Homo sapiens
ctgaattcattcagataagtgga

SEQ ID NO: 169879 - DNA, 19 bp, Homo sapiens
ttgatttttaacaaacgtt

SEQ ID NO: 169880 - DNA, 19 bp, Homo sapiens
tgtctgatgagtgtttgct

SEQ ID NO: 169881 - DNA, 21 bp, Homo sapiens
aggctcagaacttaccatgtt

SEQ ID NO: 169882 - DNA, 19 bp, Homo sapiens
gttacagctggtacagctg

SEQ ID NO: 169883 - DNA, 23 bp, Homo sapiens
tttcagaaggttgtgaaccagta

SEQ ID NO: 169884 - DNA, 22 bp, Homo sapiens
tgaggtacttggtttatatgtt

SEQ ID NO: 169885 - DNA, 23 bp, Homo sapiens
tgagttcattgtagattctggat

SEQ ID NO: 169886 - DNA, 23 bp, Homo sapiens
tgagttcattgtagattctggat

SEQ ID NO: 169887 - DNA, 23 bp, Homo sapiens
cttgactctgtgtcacttctggg

SEQ ID NO: 169888 - DNA, 23 bp, Homo sapiens
tgagttcattgtagattctggat

SEQ ID NO: 169889 - DNA, 23 bp, Homo sapiens
tgagttcattgtagattctggat

SEQ ID NO: 169890 - DNA, 23 bp, Homo sapiens
aggttcacatttatactacatcc

SEQ ID NO: 169891 - DNA, 23 bp, Homo sapiens
ttcaatgtaaagtagtctgaaat

SEQ ID NO: 169892 - DNA, 22 bp, Homo sapiens
gtctctcactctcttctgagcc

SEQ ID NO: 169893 - DNA, 23 bp, Homo sapiens
ttttggttccatatgaattctaa

SEQ ID NO: 169894 - DNA, 23 bp, Homo sapiens
ctctgttaagaatgtcaatggta

SEQ ID NO: 169895 - DNA, 23 bp, Homo sapiens
agtagggcacagattgtagattg

SEQ ID NO: 169896 - DNA, 20 bp, Homo sapiens
taagaactagtttgagatga

SEQ ID NO: 169897 - DNA, 22 bp, Homo sapiens
tggtctgccttgtatgacagct

SEQ ID NO: 169898 - DNA, 21 bp, Homo sapiens
tcatagcttctgtaccagtgg

SEQ ID NO: 169899 - DNA, 23 bp, Homo sapiens
ttatctatttataatgatgacta

SEQ ID NO: 169900 - DNA, 23 bp, Homo sapiens
tgagttcattgtagattctggat

SEQ ID NO: 169901 - DNA, 23 bp, Homo sapiens
tgagttcattgtagattctggat

SEQ ID NO: 169902 - DNA, 20 bp, Homo sapiens
tgactgaagagagtggacag

SEQ ID NO: 169903 - DNA, 23 bp, Homo sapiens
cggagtctcactctgtcacccag

SEQ ID NO: 169904 - DNA, 23 bp, Homo sapiens
gagtctcactctgtcacccaggc

SEQ ID NO: 169905 - DNA, 22 bp, Homo sapiens
tatgtacaatatgtacatatgt

SEQ ID NO: 169906 - DNA, 23 bp, Homo sapiens
tgagttcattgtagattctggat

SEQ ID NO: 169907 - DNA, 23 bp, Homo sapiens
tgagttcattgtagattctggat

SEQ ID NO: 169908 - DNA, 23 bp, Homo sapiens
atatgtgtgtgtatatatatgcg

SEQ ID NO: 169909 - DNA, 22 bp, Homo sapiens
tgtgtatatatgtatatgtgta

SEQ ID NO: 169910 - DNA, 23 bp, Homo sapiens
atatgtgtgtatacgtatgtgtg

SEQ ID NO: 169911 - DNA, 22 bp, Homo sapiens
atgtgcatatatatatgtgtgt

SEQ ID NO: 169912 - DNA, 23 bp, Homo sapiens
tgagttcattgtagattctggat

SEQ ID NO: 169913 - DNA, 23 bp, Homo sapiens
tgagttcattgtagattctggat

SEQ ID NO: 169914 - DNA, 23 bp, Homo sapiens
cggagtctcactctgtcacccag

SEQ ID NO: 169915 - DNA, 21 bp, Homo sapiens
agtgtgtgtgtgtatatatcc

SEQ ID NO: 169916 - DNA, 20 bp, Homo sapiens
gaggcagtctcactctgtca

SEQ ID NO: 169917 - DNA, 22 bp, Homo sapiens
gttcaagtggttctcctgcctc

SEQ ID NO: 169918 - DNA, 23 bp, Homo sapiens
actgattcactgactctctggga

SEQ ID NO: 169919 - DNA, 20 bp, Homo sapiens
atatatgtgtgtgtgtgtat

SEQ ID NO: 169920 - DNA, 23 bp, Homo sapiens
attctctctctatgaaaactgat

SEQ ID NO: 169921 - DNA, 23 bp, Homo sapiens
gactgtctctgtctgacctcttg

SEQ ID NO: 169922 - DNA, 23 bp, Homo sapiens
gaatctgcatttcccagattatg

SEQ ID NO: 169923 - DNA, 22 bp, Homo sapiens
tctttatttgtttatgtattgc

SEQ ID NO: 169924 - DNA, 23 bp, Homo sapiens
tgagttcattgtagattctggat

SEQ ID NO: 169925 - DNA, 23 bp, Homo sapiens
tgagttcattgtagattctggat

SEQ ID NO: 169926 - DNA, 21 bp, Homo sapiens
atacacacatatatacacata

SEQ ID NO: 169927 - DNA, 23 bp, Homo sapiens
atatgtatgtatgtatatctgtg

SEQ ID NO: 169928 - DNA, 23 bp, Homo sapiens
tgagttcattgtagattctggat

SEQ ID NO: 169929 - DNA, 23 bp, Homo sapiens
tgagttcattgtagattctggat

SEQ ID NO: 169930 - DNA, 22 bp, Homo sapiens
gacagagtctctctctgtcgcc

SEQ ID NO: 169931 - DNA, 23 bp, Homo sapiens
ggagtctcactctgtcacccagg

SEQ ID NO: 169932 - DNA, 18 bp, Homo sapiens
atcccagctattcaggag

SEQ ID NO: 169933 - DNA, 19 bp, Homo sapiens
gtggaaggatcacttgagg

SEQ ID NO: 169934 - DNA, 23 bp, Homo sapiens
tattgctcagtgctgtagctgtc

SEQ ID NO: 169935 - DNA, 23 bp, Homo sapiens
tctcagtgagatgggagtgagga

SEQ ID NO: 169936 - DNA, 23 bp, Homo sapiens
tgagttcattgtagattctggat

SEQ ID NO: 169937 - DNA, 23 bp, Homo sapiens
tgagttcattgtagattctggat

SEQ ID NO: 169938 - DNA, 18 bp, Homo sapiens
ccttcatgccaaagctgt

SEQ ID NO: 169939 - DNA, 23 bp, Homo sapiens
actgttagtcactctcttatact

SEQ ID NO: 169940 - DNA, 23 bp, Homo sapiens
gtacagtgtgggagtgaaagggc

SEQ ID NO: 169941 - DNA, 23 bp, Homo sapiens
gtaactctctgcttgatcttact

SEQ ID NO: 169942 - DNA, 19 bp, Homo sapiens
aatgtctgttatttctgcc

SEQ ID NO: 169943 - DNA, 23 bp, Homo sapiens
tgagacagagtctccctctgtca

SEQ ID NO: 169944 - DNA, 23 bp, Homo sapiens
tatgtttgtttttgtaccagtaa

SEQ ID NO: 169945 - DNA, 23 bp, Homo sapiens
caactcaccttgtctctctcttt

SEQ ID NO: 169946 - DNA, 23 bp, Homo sapiens
tctcattgtgcttttgatttgca

SEQ ID NO: 169947 - DNA, 23 bp, Homo sapiens
agaatgtctgtgagagtacactg

SEQ ID NO: 169948 - DNA, 23 bp, Homo sapiens
tcctcactggctctctctcaggt

SEQ ID NO: 169949 - DNA, 23 bp, Homo sapiens
tatgtatgtatgtgtctgtgtgt

SEQ ID NO: 169950 - DNA, 23 bp, Homo sapiens
tgctatgaatagatgttttgctt

SEQ ID NO: 169951 - DNA, 18 bp, Homo sapiens
tattattggaggattagt

SEQ ID NO: 169952 - DNA, 23 bp, Homo sapiens
tgagttcattgtagattctggat

SEQ ID NO: 169953 - DNA, 23 bp, Homo sapiens
tgagttcattgtagattctggat

SEQ ID NO: 169954 - DNA, 22 bp, Homo sapiens
gtatttttgtttgggtccagga

SEQ ID NO: 169955 - DNA, 18 bp, Homo sapiens
gatagagcttgtgcagag

SEQ ID NO: 169956 - DNA, 23 bp, Homo sapiens
ttacagcttgtttttttgagaga

SEQ ID NO: 169957 - DNA, 23 bp, Homo sapiens
aacatttgagtttttatactggt

SEQ ID NO: 169958 - DNA, 23 bp, Homo sapiens
atggagtctcactctgtcaccca

SEQ ID NO: 169959 - DNA, 23 bp, Homo sapiens
tggagtctcactctgtcacccag

SEQ ID NO: 169960 - DNA, 23 bp, Homo sapiens
tgtgtgtgtggtagaaacactta

SEQ ID NO: 169961 - DNA, 21 bp, Homo sapiens
ttaactatagtcaccatgctg

SEQ ID NO: 169962 - DNA, 21 bp, Homo sapiens
tctcactctgtcacccaggct

SEQ ID NO: 169963 - DNA, 23 bp, Homo sapiens
caggatctctcactctgtcaccc

SEQ ID NO: 169964 - DNA, 23 bp, Homo sapiens
tgagttcattgtagattctggat

SEQ ID NO: 169965 - DNA, 23 bp, Homo sapiens
tgagttcattgtagattctggat

SEQ ID NO: 169966 - DNA, 21 bp, Homo sapiens
tgaaacagggtttccgtctgt

SEQ ID NO: 169967 - DNA, 23 bp, Homo sapiens
caatgtatagtagtgtgtgtaca

SEQ ID NO: 169968 - DNA, 22 bp, Homo sapiens
tgtgcatgtctctatcacatct

SEQ ID NO: 169969 - DNA, 19 bp, Homo sapiens
aggttgttgatttctaatt

SEQ ID NO: 169970 - DNA, 23 bp, Homo sapiens
cctctgcatatatacacacgtaa

SEQ ID NO: 169971 - DNA, 23 bp, Homo sapiens
gaactggagttgctgcagtttca

SEQ ID NO: 169972 - DNA, 23 bp, Homo sapiens
agaagacagatgtgtgactgcag

SEQ ID NO: 169973 - DNA, 22 bp, Homo sapiens
attgactgtgctagcattctcc

SEQ ID NO: 169974 - DNA, 22 bp, Homo sapiens
tagggacagtatttggtacaca

SEQ ID NO: 169975 - DNA, 21 bp, Homo sapiens
tatctgactggctaacttggc

SEQ ID NO: 169976 - DNA, 23 bp, Homo sapiens
aatgagagcagcaggtatcatgg

SEQ ID NO: 169977 - DNA, 23 bp, Homo sapiens
tctctctcagcctcagtatggag

SEQ ID NO: 169978 - DNA, 21 bp, Homo sapiens
acatgtgcacaatgtgcaggt

SEQ ID NO: 169979 - DNA, 23 bp, Homo sapiens
tgagttcattgtagattctggat

SEQ ID NO: 169980 - DNA, 23 bp, Homo sapiens
tgagttcattgtagattctggat

SEQ ID NO: 169981 - DNA, 23 bp, Homo sapiens
agtctcgctctctcgctctgtct

SEQ ID NO: 169982 - DNA, 23 bp, Homo sapiens
acgctctgagtgagtggcagcca

SEQ ID NO: 169983 - DNA, 18 bp, Homo sapiens
tgacttctaaggtggttg

SEQ ID NO: 169984 - DNA, 22 bp, Homo sapiens
tatatagatctatagatatcta

SEQ ID NO: 169985 - DNA, 21 bp, Homo sapiens
atgagtataaggcttcctttt

SEQ ID NO: 169986 - DNA, 23 bp, Homo sapiens
tatgtgtatctttagatgcagtg

SEQ ID NO: 169987 - DNA, 20 bp, Homo sapiens
acagcgggatgattgcaggt

SEQ ID NO: 169988 - DNA, 18 bp, Homo sapiens
acacacacacacatatat

SEQ ID NO: 169989 - DNA, 23 bp, Homo sapiens
actagtgtctgagagcttgtaga

SEQ ID NO: 169990 - DNA, 23 bp, Homo sapiens
agactgaagattgtgtgcttgct

SEQ ID NO: 169991 - DNA, 20 bp, Homo sapiens
actcactcttacacttactc

SEQ ID NO: 169992 - DNA, 23 bp, Homo sapiens
tgagttcattgtagattctggat

SEQ ID NO: 169993 - DNA, 23 bp, Homo sapiens
tgagttcattgtagattctggat

SEQ ID NO: 169994 - DNA, 23 bp, Homo sapiens
atttcagcttttgttttctaaac

SEQ ID NO: 169995 - DNA, 22 bp, Homo sapiens
aaaacataatgacctgcaattg

SEQ ID NO: 169996 - DNA, 22 bp, Homo sapiens
atgtgtgagaagtggttttctt

SEQ ID NO: 169997 - DNA, 23 bp, Homo sapiens
tgtgtgtgtatatatgtgcgtgt

SEQ ID NO: 169998 - DNA, 22 bp, Homo sapiens
atatgtgtatatatatatgtgc

SEQ ID NO: 169999 - DNA, 18 bp, Homo sapiens
gaagttggttgaattgaa

SEQ ID NO: 170000 - DNA, 23 bp, Homo sapiens
ggctgaggtaggaggatcacttg

SEQ ID NO: 170001 - DNA, 23 bp, Homo sapiens
taatcatccctgtctctctgaca

SEQ ID NO: 170002 - DNA, 18 bp, Homo sapiens
tagcaaagagacatttca

SEQ ID NO: 170003 - DNA, 23 bp, Homo sapiens
tgagactactattctgtgtaata

SEQ ID NO: 170004 - DNA, 23 bp, Homo sapiens
aataacagttattgttttactga

SEQ ID NO: 170005 - DNA, 23 bp, Homo sapiens
ctggctgactgactgactggctg

SEQ ID NO: 170006 - DNA, 22 bp, Homo sapiens
tatgagtgagaacacacggtgt

SEQ ID NO: 170007 - DNA, 19 bp, Homo sapiens
tcacttgctgtgtgagttg

SEQ ID NO: 170008 - DNA, 22 bp, Homo sapiens
aactctctgtgcctcagtggga

SEQ ID NO: 170009 - DNA, 23 bp, Homo sapiens
tgagttcattgtagattctggat

SEQ ID NO: 170010 - DNA, 23 bp, Homo sapiens
tgagttcattgtagattctggat

SEQ ID NO: 170011 - DNA, 20 bp, Homo sapiens
ataagtaataaatattagct

SEQ ID NO: 170012 - DNA, 22 bp, Homo sapiens
ttacctttgttcactctagctc

SEQ ID NO: 170013 - DNA, 23 bp, Homo sapiens
tgagttcattgtagattctggat

SEQ ID NO: 170014 - DNA, 23 bp, Homo sapiens
tgagttcattgtagattctggat

SEQ ID NO: 170015 - DNA, 23 bp, Homo sapiens
cggagtctcactctgtcacccag

SEQ ID NO: 170016 - DNA, 20 bp, Homo sapiens
tatgcatatatatgcagata

SEQ ID NO: 170017 - DNA, 19 bp, Homo sapiens
gagttctcactctgtcacc

SEQ ID NO: 170018 - DNA, 22 bp, Homo sapiens
tgtaagagttctgattttattc

SEQ ID NO: 170019 - DNA, 23 bp, Homo sapiens
tgtgtgtgtatatatgtatgtgt

SEQ ID NO: 170020 - DNA, 22 bp, Homo sapiens
tttgtctctccttttctagaat

SEQ ID NO: 170021 - DNA, 20 bp, Homo sapiens
aaacagaagatagaaagcag

SEQ ID NO: 170022 - DNA, 23 bp, Homo sapiens
gctgaggaagtttgttgtttact

SEQ ID NO: 170023 - DNA, 23 bp, Homo sapiens
agaggatagtgacagagaaggct

SEQ ID NO: 170024 - DNA, 23 bp, Homo sapiens
ctggtctgtgactgactctgtgg

SEQ ID NO: 170025 - DNA, 21 bp, Homo sapiens
ctgtcctcagtgtgtctgtct

SEQ ID NO: 170026 - DNA, 23 bp, Homo sapiens
ttttctatagatgtcaattgtat

SEQ ID NO: 170027 - DNA, 23 bp, Homo sapiens
tgagttcattgtagattctggat

SEQ ID NO: 170028 - DNA, 23 bp, Homo sapiens
tgagttcattgtagattctggat

SEQ ID NO: 170029 - DNA, 18 bp, Homo sapiens
tcacgtatatatgttttc

SEQ ID NO: 170030 - DNA, 23 bp, Homo sapiens
tatatgtgaatatgtatatatga

SEQ ID NO: 170031 - DNA, 19 bp, Homo sapiens
tactcctctgagagcagag

SEQ ID NO: 170032 - DNA, 22 bp, Homo sapiens
tttgctgtttcattagtccaag

SEQ ID NO: 170033 - DNA, 22 bp, Homo sapiens
ttttgattgttacactgacatg

SEQ ID NO: 170034 - DNA, 19 bp, Homo sapiens
aaactagacccttttctct

SEQ ID NO: 170035 - DNA, 23 bp, Homo sapiens
gctacagaggaaagttgtgtgga

SEQ ID NO: 170036 - DNA, 23 bp, Homo sapiens
ttgacacatgtcaatgtggaaca

SEQ ID NO: 170037 - DNA, 19 bp, Homo sapiens
atacctagagctaaggatg

SEQ ID NO: 170038 - DNA, 22 bp, Homo sapiens
agtaaagtttttgttctagtga

SEQ ID NO: 170039 - DNA, 21 bp, Homo sapiens
tgaccttggacataccagttt

SEQ ID NO: 170040 - DNA, 23 bp, Homo sapiens
cggagtctcgctctgtcgctcag

SEQ ID NO: 170041 - DNA, 23 bp, Homo sapiens
tggagtctcactctgtcacccag

SEQ ID NO: 170042 - DNA, 19 bp, Homo sapiens
tggtgtcatcgtattctgc

SEQ ID NO: 170043 - DNA, 22 bp, Homo sapiens
tttcctttgagtctgatttcac

SEQ ID NO: 170044 - DNA, 22 bp, Homo sapiens
acagtcaaagtaacaatttagg

SEQ ID NO: 170045 - DNA, 23 bp, Homo sapiens
tgagttcattgtagattctggat

SEQ ID NO: 170046 - DNA, 23 bp, Homo sapiens
tgagttcattgtagattctggat

SEQ ID NO: 170047 - DNA, 21 bp, Homo sapiens
tgacttgagactttttttttc

SEQ ID NO: 170048 - DNA, 22 bp, Homo sapiens
cagaagtcattctgcaaagctt

SEQ ID NO: 170049 - DNA, 23 bp, Homo sapiens
agacttgagacagattgtggttg

SEQ ID NO: 170050 - DNA, 23 bp, Homo sapiens
tgagttcattgtagattctggat

SEQ ID NO: 170051 - DNA, 23 bp, Homo sapiens
tgagttcattgtagattctggat

SEQ ID NO: 170052 - DNA, 23 bp, Homo sapiens
cagagctgagagagagaacactt

SEQ ID NO: 170053 - DNA, 22 bp, Homo sapiens
atatgtggaatatatatgtata

SEQ ID NO: 170054 - DNA, 21 bp, Homo sapiens
tatgtgtatatatatgtgtgt

SEQ ID NO: 170055 - DNA, 18 bp, Homo sapiens
ggctcatacccataatcc

SEQ ID NO: 170056 - DNA, 23 bp, Homo sapiens
gggtctcactctgtcacccaggc

SEQ ID NO: 170057 - DNA, 20 bp, Homo sapiens
aatcagcctggctaacatgg

SEQ ID NO: 170058 - DNA, 23 bp, Homo sapiens
tgagttcattgtagattctggat

SEQ ID NO: 170059 - DNA, 23 bp, Homo sapiens
tgagttcattgtagattctggat

SEQ ID NO: 170060 - DNA, 18 bp, Homo sapiens
agagttcagcctgagcac

SEQ ID NO: 170061 - DNA, 23 bp, Homo sapiens
atatgtgtgtatatatatgtgtg

SEQ ID NO: 170062 - DNA, 22 bp, Homo sapiens
tgatttgtatttctctgatgat

SEQ ID NO: 170063 - DNA, 20 bp, Homo sapiens
ttgagaaatgtctattcaga

SEQ ID NO: 170064 - DNA, 22 bp, Homo sapiens
acttttgaattaatgctgaaat

SEQ ID NO: 170065 - DNA, 23 bp, Homo sapiens
tgattggttttgaaatgtgagga

SEQ ID NO: 170066 - DNA, 20 bp, Homo sapiens
aatctggaaatatttttatc

SEQ ID NO: 170067 - DNA, 23 bp, Homo sapiens
aattgtgggtgcataataggtgt

SEQ ID NO: 170068 - DNA, 21 bp, Homo sapiens
tatatatgggttacattagat

SEQ ID NO: 170069 - DNA, 18 bp, Homo sapiens
tatgtctcttaagcttgg

SEQ ID NO: 170070 - DNA, 23 bp, Homo sapiens
tcacattatagttttgatttgta

SEQ ID NO: 170071 - DNA, 23 bp, Homo sapiens
tcttggctatttgtatatctttc

SEQ ID NO: 170072 - DNA, 22 bp, Homo sapiens
tatatacacatatacgtatgtg

SEQ ID NO: 170073 - DNA, 20 bp, Homo sapiens
tgtatatatgtatatgtgta

SEQ ID NO: 170074 - DNA, 19 bp, Homo sapiens
atctaatcactccctggga

SEQ ID NO: 170075 - DNA, 23 bp, Homo sapiens
aaacatgttacagagtagaattg

SEQ ID NO: 170076 - DNA, 22 bp, Homo sapiens
tctgtccctctgtccctgggtg

SEQ ID NO: 170077 - DNA, 20 bp, Homo sapiens
agttgctggagttcctgcag

SEQ ID NO: 170078 - DNA, 23 bp, Homo sapiens
gtctctgtgactgagaggtgttt

SEQ ID NO: 170079 - DNA, 23 bp, Homo sapiens
tatacagaagaatgaaaccagat

SEQ ID NO: 170080 - DNA, 23 bp, Homo sapiens
aagtgacaaattttgttgctcaa

SEQ ID NO: 170081 - DNA, 23 bp, Homo sapiens
tgagttcattgtagattctggat

SEQ ID NO: 170082 - DNA, 23 bp, Homo sapiens
tgagttcattgtagattctggat

SEQ ID NO: 170083 - DNA, 22 bp, Homo sapiens
tgaggtaggaggatcatttgat

SEQ ID NO: 170084 - DNA, 22 bp, Homo sapiens
tgagtgagaccctgtcttcaga

SEQ ID NO: 170085 - DNA, 23 bp, Homo sapiens
aattcacagtgtagttaatgagg

SEQ ID NO: 170086 - DNA, 23 bp, Homo sapiens
tgtgtgtgtatgtgtctgtgtgt

SEQ ID NO: 170087 - DNA, 23 bp, Homo sapiens
gggtcacacagtctctgtcccag

SEQ ID NO: 170088 - DNA, 23 bp, Homo sapiens
gtttactagaagagactgagcac

SEQ ID NO: 170089 - DNA, 23 bp, Homo sapiens
tattagtgtctagatcttgcttt

SEQ ID NO: 170090 - DNA, 22 bp, Homo sapiens
atatacacacatatatatgtgt

SEQ ID NO: 170091 - DNA, 23 bp, Homo sapiens
gataccttttgatttgagatgtg

SEQ ID NO: 170092 - DNA, 23 bp, Homo sapiens
gagtctcactctgtcacccaggc

SEQ ID NO: 170093 - DNA, 21 bp, Homo sapiens
tatatgtatgtatatatatgt

SEQ ID NO: 170094 - DNA, 23 bp, Homo sapiens
taaatgtatgtatatatgtgtgt

SEQ ID NO: 170095 - DNA, 23 bp, Homo sapiens
gttttagtgactggttaagaacc

SEQ ID NO: 170096 - DNA, 20 bp, Homo sapiens
ttaagttcataatgattaca

SEQ ID NO: 170097 - DNA, 22 bp, Homo sapiens
tatagtagttgcatgtttagtt

SEQ ID NO: 170098 - DNA, 23 bp, Homo sapiens
tgagttcattgtagattctggat

SEQ ID NO: 170099 - DNA, 23 bp, Homo sapiens
tgagttcattgtagattctggat

SEQ ID NO: 170100 - DNA, 21 bp, Homo sapiens
tgcatataaaatgtatataca

SEQ ID NO: 170101 - DNA, 23 bp, Homo sapiens
acagagtctcgcactgtcaccca

SEQ ID NO: 170102 - DNA, 21 bp, Homo sapiens
aaggttcatccatgttgtagc

SEQ ID NO: 170103 - DNA, 19 bp, Homo sapiens
agtgagccatgattgcacc

SEQ ID NO: 170104 - DNA, 22 bp, Homo sapiens
tctgtgtcgtgtgtgtgtgtat

SEQ ID NO: 170105 - DNA, 23 bp, Homo sapiens
cactcactgcctctctaaatccc

SEQ ID NO: 170106 - DNA, 21 bp, Homo sapiens
ttgtgttttgtcactgttcca

SEQ ID NO: 170107 - DNA, 20 bp, Homo sapiens
aagccagttactctttcacc

SEQ ID NO: 170108 - DNA, 23 bp, Homo sapiens
atatatggtgatcaaatctgtaa

SEQ ID NO: 170109 - DNA, 18 bp, Homo sapiens
aagatatcaagtatttag

SEQ ID NO: 170110 - DNA, 21 bp, Homo sapiens
gatgattagtgattttgaaca

SEQ ID NO: 170111 - DNA, 23 bp, Homo sapiens
tattagtatgttttctttggaga

SEQ ID NO: 170112 - DNA, 23 bp, Homo sapiens
cggagtctcactctgtcacccag

SEQ ID NO: 170113 - DNA, 23 bp, Homo sapiens
agtcagaaaccagagtgcagagg

SEQ ID NO: 170114 - DNA, 22 bp, Homo sapiens
cacactcactctctgtccagtt

SEQ ID NO: 170115 - DNA, 22 bp, Homo sapiens
gtgtatatatgtatatatgtgt

SEQ ID NO: 170116 - DNA, 22 bp, Homo sapiens
ttgagacagagtctcactctgt

SEQ ID NO: 170117 - DNA, 22 bp, Homo sapiens
actgagtatatatacatgtatg

SEQ ID NO: 170118 - DNA, 19 bp, Homo sapiens
tgtatatgtgtatgtgtgt

SEQ ID NO: 170119 - DNA, 22 bp, Homo sapiens
acctccaactgcaatggcaatc

SEQ ID NO: 170120 - DNA, 23 bp, Homo sapiens
tggagtctcactctgtcacccag

SEQ ID NO: 170121 - DNA, 22 bp, Homo sapiens
tgtcatcttcctgagagatgga

SEQ ID NO: 170122 - DNA, 23 bp, Homo sapiens
tcagctactggtactttattctg

SEQ ID NO: 170123 - DNA, 23 bp, Homo sapiens
tcatgatccttgtagttttgtgt

SEQ ID NO: 170124 - DNA, 20 bp, Homo sapiens
acagagcaagactctgtctc

SEQ ID NO: 170125 - DNA, 21 bp, Homo sapiens
tggagtcaagaatgtgagctc

SEQ ID NO: 170126 - DNA, 23 bp, Homo sapiens
tacagatgtctttttgaagttat

SEQ ID NO: 170127 - DNA, 23 bp, Homo sapiens
tgagttcattgtagattctggat

SEQ ID NO: 170128 - DNA, 23 bp, Homo sapiens
tgagttcattgtagattctggat

SEQ ID NO: 170129 - DNA, 23 bp, Homo sapiens
aatcagtttggctaacatgtttg

SEQ ID NO: 170130 - DNA, 22 bp, Homo sapiens
tgactagattgatttgttagat

SEQ ID NO: 170131 - DNA, 23 bp, Homo sapiens
gtcggtgactgtgtgcctgtgtt

SEQ ID NO: 170132 - DNA, 23 bp, Homo sapiens
tagtctatttgttgttctagttg

SEQ ID NO: 170133 - DNA, 22 bp, Homo sapiens
ttccaagtaagagatcatatca

SEQ ID NO: 170134 - DNA, 23 bp, Homo sapiens
tgtgtgtatatatatatgtgtgt

SEQ ID NO: 170135 - DNA, 23 bp, Homo sapiens
tatgtgtgtatatgtatgtgcat

SEQ ID NO: 170136 - DNA, 23 bp, Homo sapiens
tcagtggtaataaatacatttgt

SEQ ID NO: 170137 - DNA, 21 bp, Homo sapiens
atagtggggattcactctcag

SEQ ID NO: 170138 - DNA, 23 bp, Homo sapiens
taattctggaaatcaaaatgtgt

SEQ ID NO: 170139 - DNA, 23 bp, Homo sapiens
agaacatgtgatgtttgtctttc

SEQ ID NO: 170140 - DNA, 23 bp, Homo sapiens
tgcatatgtgtatatatatatgt

SEQ ID NO: 170141 - DNA, 23 bp, Homo sapiens
ttgagacagggtctctctctgtc

SEQ ID NO: 170142 - DNA, 23 bp, Homo sapiens
agtctcactctgtcacccaggct

SEQ ID NO: 170143 - DNA, 23 bp, Homo sapiens
tatattaatagatgttgatatcc

SEQ ID NO: 170144 - DNA, 19 bp, Homo sapiens
ccagcatatctagtcattt

SEQ ID NO: 170145 - DNA, 22 bp, Homo sapiens
atttttgtttttgaagcagggt

SEQ ID NO: 170146 - DNA, 22 bp, Homo sapiens
ctgatgaaattgattgtaaagt

SEQ ID NO: 170147 - DNA, 21 bp, Homo sapiens
tgagagctacactgaattttc

SEQ ID NO: 170148 - DNA, 21 bp, Homo sapiens
taatttctatgtatatcttta

SEQ ID NO: 170149 - DNA, 23 bp, Homo sapiens
tgaagtggctatgttgtctgggg

SEQ ID NO: 170150 - DNA, 23 bp, Homo sapiens
tgttgtcatgcaccaggaaaatt

SEQ ID NO: 170151 - DNA, 23 bp, Homo sapiens
tggagtctcactctgtcacccag

SEQ ID NO: 170152 - DNA, 22 bp, Homo sapiens
tctcaactcactgcaagctctg

SEQ ID NO: 170153 - DNA, 23 bp, Homo sapiens
gtccctgacttctgatgttgatg

SEQ ID NO: 170154 - DNA, 21 bp, Homo sapiens
agacaagtatgttacatattt

SEQ ID NO: 170155 - DNA, 22 bp, Homo sapiens
ttatatcaatttctttatgtct

SEQ ID NO: 170156 - DNA, 23 bp, Homo sapiens
tggagtctcactctgtcacccag

SEQ ID NO: 170157 - DNA, 23 bp, Homo sapiens
ttgtacttttggcttggtattgt

SEQ ID NO: 170158 - DNA, 22 bp, Homo sapiens
tttaaagtagtttttctagttc

SEQ ID NO: 170159 - DNA, 23 bp, Homo sapiens
tgagttcattgtagattctggat

SEQ ID NO: 170160 - DNA, 23 bp, Homo sapiens
tgagttcattgtagattctggat

SEQ ID NO: 170161 - DNA, 23 bp, Homo sapiens
tgagttcattgtagattctggat

SEQ ID NO: 170162 - DNA, 23 bp, Homo sapiens
tgagttcattgtagattctggat

SEQ ID NO: 170163 - DNA, 23 bp, Homo sapiens
tgtgtgtatatatgtatgtatat

SEQ ID NO: 170164 - DNA, 22 bp, Homo sapiens
ttatggcactttttcttattta

SEQ ID NO: 170165 - DNA, 20 bp, Homo sapiens
attgtgaatgggagttcact

SEQ ID NO: 170166 - DNA, 23 bp, Homo sapiens
tccaggtaattattagtctctct

SEQ ID NO: 170167 - DNA, 23 bp, Homo sapiens
tatggcattataatctcatgtga

SEQ ID NO: 170168 - DNA, 23 bp, Homo sapiens
tgagttcattgtagattctggat

SEQ ID NO: 170169 - DNA, 23 bp, Homo sapiens
tgagttcattgtagattctggat

SEQ ID NO: 170170 - DNA, 23 bp, Homo sapiens
tggaattctgatgcaaatggaat

SEQ ID NO: 170171 - DNA, 23 bp, Homo sapiens
tatatatctggaaagctttttca

SEQ ID NO: 170172 - DNA, 23 bp, Homo sapiens
tctataatctgtttttcttagtg

SEQ ID NO: 170173 - DNA, 23 bp, Homo sapiens
tgataagaatgataaaatagcct

SEQ ID NO: 170174 - DNA, 22 bp, Homo sapiens
tatagctatagtatggtgatag

SEQ ID NO: 170175 - DNA, 23 bp, Homo sapiens
aaactgtgctatgtgtgtgtgtg

SEQ ID NO: 170176 - DNA, 21 bp, Homo sapiens
agagtagtaaagagatcctag

SEQ ID NO: 170177 - DNA, 19 bp, Homo sapiens
tttgttctatacttatgaa

SEQ ID NO: 170178 - DNA, 21 bp, Homo sapiens
tctttgtatttgaataccctt

SEQ ID NO: 170179 - DNA, 21 bp, Homo sapiens
tgtgcatatatatacacatac

SEQ ID NO: 170180 - DNA, 20 bp, Homo sapiens
tgtgtgtatatatatgtgtg

SEQ ID NO: 170181 - DNA, 23 bp, Homo sapiens
agaaagactagtgacttaggtgt

SEQ ID NO: 170182 - DNA, 23 bp, Homo sapiens
gtgtgtgtctgcctgtctgtttc

SEQ ID NO: 170183 - DNA, 22 bp, Homo sapiens
atatgtgtatatatatgtgtgt

SEQ ID NO: 170184 - DNA, 23 bp, Homo sapiens
tatatgtgtatatatatgtgtgt

SEQ ID NO: 170185 - DNA, 23 bp, Homo sapiens
tatatgtgtatatatatgtgtgt

SEQ ID NO: 170186 - DNA, 20 bp, Homo sapiens
atacacacatgtgtgtatat

SEQ ID NO: 170187 - DNA, 23 bp, Homo sapiens
tgagttcattgtagattctggat

SEQ ID NO: 170188 - DNA, 23 bp, Homo sapiens
tgagttcattgtagattctggat

SEQ ID NO: 170189 - DNA, 23 bp, Homo sapiens
atgagagaattcaccttgtgaca

SEQ ID NO: 170190 - DNA, 23 bp, Homo sapiens
tatacaaatctggagtttggaag

SEQ ID NO: 170191 - DNA, 18 bp, Homo sapiens
aatgctagtttctttcag

SEQ ID NO: 170192 - DNA, 23 bp, Homo sapiens
tcactaagtcactgactcccaga

SEQ ID NO: 170193 - DNA, 22 bp, Homo sapiens
caatggtagcttgatagggata

SEQ ID NO: 170194 - DNA, 22 bp, Homo sapiens
atatgtgtatatgtatatgtgt

SEQ ID NO: 170195 - DNA, 19 bp, Homo sapiens
tatgtatatatgtatatgt

SEQ ID NO: 170196 - DNA, 21 bp, Homo sapiens
tatatgtatatatgtatatgt

SEQ ID NO: 170197 - DNA, 23 bp, Homo sapiens
catgtctctgtgtcacatgttgg

SEQ ID NO: 170198 - DNA, 20 bp, Homo sapiens
ttattattatatctgttacg

SEQ ID NO: 170199 - DNA, 23 bp, Homo sapiens
ctcccactgtgactgcaggcttt

SEQ ID NO: 170200 - DNA, 23 bp, Homo sapiens
ctcagcctcagtctgtggctggc

SEQ ID NO: 170201 - DNA, 21 bp, Homo sapiens
ctgagtggttagttgtgtggg

SEQ ID NO: 170202 - DNA, 19 bp, Homo sapiens
tcttgactgtttatcttga

SEQ ID NO: 170203 - DNA, 23 bp, Homo sapiens
gtgtctcactgtgccagtgtagt

SEQ ID NO: 170204 - DNA, 23 bp, Homo sapiens
tcccagcatctagagctgtccat

SEQ ID NO: 170205 - DNA, 23 bp, Homo sapiens
ctggctgtctgcctggctgtctg

SEQ ID NO: 170206 - DNA, 23 bp, Homo sapiens
cggagtctcgctctgtctcccag

SEQ ID NO: 170207 - DNA, 21 bp, Homo sapiens
aggttcagggactgttgttat

SEQ ID NO: 170208 - DNA, 23 bp, Homo sapiens
tgagttcattgtagattctggat

SEQ ID NO: 170209 - DNA, 23 bp, Homo sapiens
tgagttcattgtagattctggat

SEQ ID NO: 170210 - DNA, 21 bp, Homo sapiens
aggacagaagagactgtggtc

SEQ ID NO: 170211 - DNA, 19 bp, Homo sapiens
gattttcctcctactcctg

SEQ ID NO: 170212 - DNA, 23 bp, Homo sapiens
tgagttcattgtagattctggat

SEQ ID NO: 170213 - DNA, 23 bp, Homo sapiens
tgagttcattgtagattctggat

SEQ ID NO: 170214 - DNA, 22 bp, Homo sapiens
atatatgtatatgtatacggaa

SEQ ID NO: 170215 - DNA, 23 bp, Homo sapiens
tgagttcattgtagattctggat

SEQ ID NO: 170216 - DNA, 23 bp, Homo sapiens
tgagttcattgtagattctggat

SEQ ID NO: 170217 - DNA, 23 bp, Homo sapiens
agagatgaagaaactgtgtctca

SEQ ID NO: 170218 - DNA, 23 bp, Homo sapiens
tcagaggagaaagtgagcacagc

SEQ ID NO: 170219 - DNA, 18 bp, Homo sapiens
atacacatacatacatgt

SEQ ID NO: 170220 - DNA, 22 bp, Homo sapiens
tatacgtatgtttatatacgta

SEQ ID NO: 170221 - DNA, 20 bp, Homo sapiens
atatgtgtgtatatatacgt

SEQ ID NO: 170222 - DNA, 19 bp, Homo sapiens
tgtgtatatatatacgtat

SEQ ID NO: 170223 - DNA, 23 bp, Homo sapiens
tgagttcattgtagattctggat

SEQ ID NO: 170224 - DNA, 23 bp, Homo sapiens
tgagttcattgtagattctggat

SEQ ID NO: 170225 - DNA, 22 bp, Homo sapiens
agttctttttttctttatctga

SEQ ID NO: 170226 - DNA, 20 bp, Homo sapiens
atctgtgtgtgtatgtgtat

SEQ ID NO: 170227 - DNA, 19 bp, Homo sapiens
tgtatcactgtgtatactg

SEQ ID NO: 170228 - DNA, 23 bp, Homo sapiens
gtgtgtgtgtatatacatatgtg

SEQ ID NO: 170229 - DNA, 23 bp, Homo sapiens
atatgtgtatatatatatgtgtg

SEQ ID NO: 170230 - DNA, 22 bp, Homo sapiens
ttttgagacggagtctctctct

SEQ ID NO: 170231 - DNA, 23 bp, Homo sapiens
caggctctcactctgtcgcccag

SEQ ID NO: 170232 - DNA, 23 bp, Homo sapiens
tgagttcattgtagattctggat

SEQ ID NO: 170233 - DNA, 23 bp, Homo sapiens
tgagttcattgtagattctggat

SEQ ID NO: 170234 - DNA, 19 bp, Homo sapiens
tgacctcattttaatatga

SEQ ID NO: 170235 - DNA, 21 bp, Homo sapiens
tacatgtatgtatatatacgt

SEQ ID NO: 170236 - DNA, 18 bp, Homo sapiens
tatgctatgtacagtgta

SEQ ID NO: 170237 - DNA, 18 bp, Homo sapiens
atagtgtatatatgatat

SEQ ID NO: 170238 - DNA, 20 bp, Homo sapiens
aaactatcaggaagttcatt

SEQ ID NO: 170239 - DNA, 23 bp, Homo sapiens
atgaggctgaggtaggaggatca

SEQ ID NO: 170240 - DNA, 22 bp, Homo sapiens
aaagtcagtggtagcttgatgg

SEQ ID NO: 170241 - DNA, 23 bp, Homo sapiens
tggtgaggaagttgcatgtatac

SEQ ID NO: 170242 - DNA, 22 bp, Homo sapiens
tatgtatctatgtatttatgta

SEQ ID NO: 170243 - DNA, 21 bp, Homo sapiens
tgtctctgggatttagttgcc

SEQ ID NO: 170244 - DNA, 23 bp, Homo sapiens
gggtctcactctgtcacccaggc

SEQ ID NO: 170245 - DNA, 23 bp, Homo sapiens
tgtcattgacatgtgaaactgat

SEQ ID NO: 170246 - DNA, 21 bp, Homo sapiens
tgcatgtatacatatgtgtat

SEQ ID NO: 170247 - DNA, 22 bp, Homo sapiens
agtgaatacacaatgtggtatt

SEQ ID NO: 170248 - DNA, 23 bp, Homo sapiens
cataccataagtgtttttgttgt

SEQ ID NO: 170249 - DNA, 23 bp, Homo sapiens
attcaggctctcgctctgtcacc

SEQ ID NO: 170250 - DNA, 22 bp, Homo sapiens
acagggtctctcagtgtcaccc

SEQ ID NO: 170251 - DNA, 18 bp, Homo sapiens
cagtggcatgatcatgtc

SEQ ID NO: 170252 - DNA, 23 bp, Homo sapiens
acagactctggctctgtctccca

SEQ ID NO: 170253 - DNA, 18 bp, Homo sapiens
cagtggcagaatctcagc

SEQ ID NO: 170254 - DNA, 23 bp, Homo sapiens
ccaagtctctctgtctcagttct

SEQ ID NO: 170255 - DNA, 21 bp, Homo sapiens
tagacagtctccctctgtcac

SEQ ID NO: 170256 - DNA, 20 bp, Homo sapiens
tcactgcaacctctgcctct

SEQ ID NO: 170257 - DNA, 23 bp, Homo sapiens
tgactacagtgtattgacttgtt

SEQ ID NO: 170258 - DNA, 23 bp, Homo sapiens
acagagtctcactctgtcgccca

SEQ ID NO: 170259 - DNA, 19 bp, Homo sapiens
tcactgtaacctctgcctc

SEQ ID NO: 170260 - DNA, 23 bp, Homo sapiens
tgagacagagtttgagttctctc

SEQ ID NO: 170261 - DNA, 22 bp, Homo sapiens
acggagtctcgctctgtcactc

SEQ ID NO: 170262 - DNA, 23 bp, Homo sapiens
tttctttgaggtatacttttctc

SEQ ID NO: 170263 - DNA, 23 bp, Homo sapiens
gggtctcactctgtcacccaggc

SEQ ID NO: 170264 - DNA, 23 bp, Homo sapiens
gtatgtatatatgtgtgtgtgtg

SEQ ID NO: 170265 - DNA, 20 bp, Homo sapiens
tatatgcatatatacatatg

SEQ ID NO: 170266 - DNA, 23 bp, Homo sapiens
gtttttctgaggcaaaatgaagg

SEQ ID NO: 170267 - DNA, 23 bp, Homo sapiens
tggggttgctgtgagaattgagt

SEQ ID NO: 170268 - DNA, 23 bp, Homo sapiens
gggattacaggcatgagccactg

SEQ ID NO: 170269 - DNA, 22 bp, Homo sapiens
gtggcctgctagtatctttttt

SEQ ID NO: 170270 - DNA, 23 bp, Homo sapiens
tgtgtgtgtgtatatgcatgtat

SEQ ID NO: 170271 - DNA, 23 bp, Homo sapiens
agacactcttcttctaatctttc

SEQ ID NO: 170272 - DNA, 23 bp, Homo sapiens
agacatggtctcgctctgtcact

SEQ ID NO: 170273 - DNA, 21 bp, Homo sapiens
cattggcatgatcatggctca

SEQ ID NO: 170274 - DNA, 20 bp, Homo sapiens
ttttttgttgttcattttcc

SEQ ID NO: 170275 - DNA, 19 bp, Homo sapiens
gagagcaaagttcacaggc

SEQ ID NO: 170276 - DNA, 21 bp, Homo sapiens
agaggattcttctgtgggctt

SEQ ID NO: 170277 - DNA, 23 bp, Homo sapiens
gaaagtgtgtgtgtgcatgtata

SEQ ID NO: 170278 - DNA, 23 bp, Homo sapiens
acacacacacacattaaaatctc

SEQ ID NO: 170279 - DNA, 23 bp, Homo sapiens
acatgttttgtttggatagctta

SEQ ID NO: 170280 - DNA, 23 bp, Homo sapiens
ttaggcaagatatgtactcacta

SEQ ID NO: 170281 - DNA, 23 bp, Homo sapiens
tttgacagagtctcattctgcta

SEQ ID NO: 170282 - DNA, 23 bp, Homo sapiens
cggagtctcgctctgtctcccag

SEQ ID NO: 170283 - DNA, 23 bp, Homo sapiens
caagacagaacaatgtcaggtga

SEQ ID NO: 170284 - DNA, 23 bp, Homo sapiens
tgagttcattgtagattctggat

SEQ ID NO: 170285 - DNA, 23 bp, Homo sapiens
tgagttcattgtagattctggat

SEQ ID NO: 170286 - DNA, 21 bp, Homo sapiens
agcagtgtgagaatggaataa

SEQ ID NO: 170287 - DNA, 23 bp, Homo sapiens
tggagtctcactctgtcacccag

SEQ ID NO: 170288 - DNA, 23 bp, Homo sapiens
ctgcttgtctctcacactgtctc

SEQ ID NO: 170289 - DNA, 20 bp, Homo sapiens
atacacacacacatatatat

SEQ ID NO: 170290 - DNA, 23 bp, Homo sapiens
tgtgtatatatgtatatgtagta

SEQ ID NO: 170291 - DNA, 23 bp, Homo sapiens
cgagtctcactctctgtcgctgg

SEQ ID NO: 170292 - DNA, 23 bp, Homo sapiens
acactcccaccaacagtgtacaa

SEQ ID NO: 170293 - DNA, 22 bp, Homo sapiens
acagaggtaggaaatgcatgca

SEQ ID NO: 170294 - DNA, 22 bp, Homo sapiens
tatctcagtggttctcaactga

SEQ ID NO: 170295 - DNA, 23 bp, Homo sapiens
tgagttcattgtagattctggat

SEQ ID NO: 170296 - DNA, 23 bp, Homo sapiens
tgagttcattgtagattctggat

SEQ ID NO: 170297 - DNA, 22 bp, Homo sapiens
atgtatgtatgcatgtgtgtag

SEQ ID NO: 170298 - DNA, 23 bp, Homo sapiens
tgagttcattgtagattctggat

SEQ ID NO: 170299 - DNA, 23 bp, Homo sapiens
tgagttcattgtagattctggat

SEQ ID NO: 170300 - DNA, 20 bp, Homo sapiens
gatgatgaggcggtggtcct

SEQ ID NO: 170301 - DNA, 18 bp, Homo sapiens
taagagtgatgtgcctag

SEQ ID NO: 170302 - DNA, 23 bp, Homo sapiens
tatatgtatgtgagcatttatgt

SEQ ID NO: 170303 - DNA, 21 bp, Homo sapiens
tttactgaatttgtttatcag

SEQ ID NO: 170304 - DNA, 18 bp, Homo sapiens
ttatactttaagttctag

SEQ ID NO: 170305 - DNA, 22 bp, Homo sapiens
ttgattattttgatttcagtgg

SEQ ID NO: 170306 - DNA, 23 bp, Homo sapiens
tatgacaatgcatataaaaagat

SEQ ID NO: 170307 - DNA, 22 bp, Homo sapiens
tcttctgattttcattttctgt

SEQ ID NO: 170308 - DNA, 23 bp, Homo sapiens
tgagttcattgtagattctggat

SEQ ID NO: 170309 - DNA, 23 bp, Homo sapiens
tgagttcattgtagattctggat

SEQ ID NO: 170310 - DNA, 23 bp, Homo sapiens
atgatgatgatgatgatgatgat

SEQ ID NO: 170311 - DNA, 22 bp, Homo sapiens
atgatgatgatgatgatgatga

SEQ ID NO: 170312 - DNA, 23 bp, Homo sapiens
tgtgctttacatatgtgtgtgta

SEQ ID NO: 170313 - DNA, 21 bp, Homo sapiens
atatgaatatataggtatatg

SEQ ID NO: 170314 - DNA, 18 bp, Homo sapiens
tccatatatatacacata

SEQ ID NO: 170315 - DNA, 23 bp, Homo sapiens
gtctcactcagcctctctagcca

SEQ ID NO: 170316 - DNA, 21 bp, Homo sapiens
gtgtggaatatatatctgaat

SEQ ID NO: 170317 - DNA, 23 bp, Homo sapiens
agagttgaatagttgagacagag

SEQ ID NO: 170318 - DNA, 23 bp, Homo sapiens
tggagtctcactctgtcacccag

SEQ ID NO: 170319 - DNA, 23 bp, Homo sapiens
catgtagcatgaatagtactcta

SEQ ID NO: 170320 - DNA, 22 bp, Homo sapiens
gaagtaggtgcttaggaagtga

SEQ ID NO: 170321 - DNA, 23 bp, Homo sapiens
tgagttcattgtagattctggat

SEQ ID NO: 170322 - DNA, 23 bp, Homo sapiens
tgagttcattgtagattctggat

SEQ ID NO: 170323 - DNA, 18 bp, Homo sapiens
tttgtttgtttttttgat

SEQ ID NO: 170324 - DNA, 21 bp, Homo sapiens
tatgtctatatatatatgtgt

SEQ ID NO: 170325 - DNA, 22 bp, Homo sapiens
tgtgtgtatatatatatatgtg

SEQ ID NO: 170326 - DNA, 23 bp, Homo sapiens
catgtagcatgaatagtactcta

SEQ ID NO: 170327 - DNA, 18 bp, Homo sapiens
tcagagccatcatgggtg

SEQ ID NO: 170328 - DNA, 23 bp, Homo sapiens
tttcggatccatatgaattctag

SEQ ID NO: 170329 - DNA, 20 bp, Homo sapiens
agagagaagtgagagtgcgg

SEQ ID NO: 170330 - DNA, 22 bp, Homo sapiens
tgagaacaaagtgaggagagag

SEQ ID NO: 170331 - DNA, 23 bp, Homo sapiens
aatttctgctacttttttgaata

SEQ ID NO: 170332 - DNA, 23 bp, Homo sapiens
tgagttcattgtagattctggat

SEQ ID NO: 170333 - DNA, 23 bp, Homo sapiens
tgagttcattgtagattctggat

SEQ ID NO: 170334 - DNA, 23 bp, Homo sapiens
catacacacacatatatgtgtgt

SEQ ID NO: 170335 - DNA, 23 bp, Homo sapiens
atatgtgtatgtatacatgtgtc

SEQ ID NO: 170336 - DNA, 18 bp, Homo sapiens
atagtctcttaaagcttt

SEQ ID NO: 170337 - DNA, 23 bp, Homo sapiens
atacacataggtatacttatata

SEQ ID NO: 170338 - DNA, 23 bp, Homo sapiens
tttacatttggaacagtttggaa

SEQ ID NO: 170339 - DNA, 23 bp, Homo sapiens
tgtatacatataagtgtgtgtgt

SEQ ID NO: 170340 - DNA, 23 bp, Homo sapiens
tatgtgtatatgtatatatgtgt

SEQ ID NO: 170341 - DNA, 23 bp, Homo sapiens
taagtctcatgagagctgattgt

SEQ ID NO: 170342 - DNA, 23 bp, Homo sapiens
atagatatgcatatgtatagata

SEQ ID NO: 170343 - DNA, 22 bp, Homo sapiens
tgagatttgagtgtggacacag

SEQ ID NO: 170344 - DNA, 23 bp, Homo sapiens
tatatgctcaacatctagtacag

SEQ ID NO: 170345 - DNA, 23 bp, Homo sapiens
tccaagaatgaatagatgtatga

SEQ ID NO: 170346 - DNA, 19 bp, Homo sapiens
aagactgttttggctatgt

SEQ ID NO: 170347 - DNA, 23 bp, Homo sapiens
atgtgtgtatgtctgtatatgta

SEQ ID NO: 170348 - DNA, 22 bp, Homo sapiens
aattttcactgaattagttgaa

SEQ ID NO: 170349 - DNA, 21 bp, Homo sapiens
tgtcttgttccagttactggg

SEQ ID NO: 170350 - DNA, 23 bp, Homo sapiens
taattctgtgaagaaagtcactg

SEQ ID NO: 170351 - DNA, 23 bp, Homo sapiens
tatcagtatgtgtgtgtgtatat

SEQ ID NO: 170352 - DNA, 19 bp, Homo sapiens
tgcctgggagaaacgttgc

SEQ ID NO: 170353 - DNA, 23 bp, Homo sapiens
tctgagagtatacactgtgctgt

SEQ ID NO: 170354 - DNA, 23 bp, Homo sapiens
tatgtcagtgttgagagtaggag

SEQ ID NO: 170355 - DNA, 21 bp, Homo sapiens
tgattcatgttgaaggcttct

SEQ ID NO: 170356 - DNA, 21 bp, Homo sapiens
acacatatatataagtgtgta

SEQ ID NO: 170357 - DNA, 21 bp, Homo sapiens
tatatgcatatatatgcatat

SEQ ID NO: 170358 - DNA, 23 bp, Homo sapiens
tatgtgtgtatatatatgtgtgt

SEQ ID NO: 170359 - DNA, 22 bp, Homo sapiens
tgtggttgcatgtatctttgaa

SEQ ID NO: 170360 - DNA, 23 bp, Homo sapiens
tgagttcattgtagattctggat

SEQ ID NO: 170361 - DNA, 23 bp, Homo sapiens
tgagttcattgtagattctggat

SEQ ID NO: 170362 - DNA, 19 bp, Homo sapiens
tgagctctattgtgggtca

SEQ ID NO: 170363 - DNA, 23 bp, Homo sapiens
tagtccagaatgtgctggttcaa

SEQ ID NO: 170364 - DNA, 23 bp, Homo sapiens
ttgagacagccttaaatcagtgc

SEQ ID NO: 170365 - DNA, 23 bp, Homo sapiens
tgcatgtgtgtatttgatggcat

SEQ ID NO: 170366 - DNA, 23 bp, Homo sapiens
tctgtgtgtgtgtgtatgtgcgt

SEQ ID NO: 170367 - DNA, 18 bp, Homo sapiens
tttgttctctgggtcctc

SEQ ID NO: 170368 - DNA, 23 bp, Homo sapiens
cactgtatattctgaatgtgttt

SEQ ID NO: 170369 - DNA, 21 bp, Homo sapiens
aaacacacccagaaagacacg

SEQ ID NO: 170370 - DNA, 23 bp, Homo sapiens
tgagttcattgtagattctggat

SEQ ID NO: 170371 - DNA, 23 bp, Homo sapiens
tgagttcattgtagattctggat

SEQ ID NO: 170372 - DNA, 19 bp, Homo sapiens
acacatacatatatatgtg

SEQ ID NO: 170373 - DNA, 20 bp, Homo sapiens
tacacatacatatatatgtg

SEQ ID NO: 170374 - DNA, 19 bp, Homo sapiens
tgtgtgtatatatgtgtgt

SEQ ID NO: 170375 - DNA, 23 bp, Homo sapiens
tgtatacatacacgtgtgtgtgt

SEQ ID NO: 170376 - DNA, 20 bp, Homo sapiens
atatgtaagtatatatacgt

SEQ ID NO: 170377 - DNA, 23 bp, Homo sapiens
cagagtctcactctctcactcag

SEQ ID NO: 170378 - DNA, 23 bp, Homo sapiens
tgagttcattgtagattctggat

SEQ ID NO: 170379 - DNA, 23 bp, Homo sapiens
tgagttcattgtagattctggat

SEQ ID NO: 170380 - DNA, 23 bp, Homo sapiens
tgattgccactgtctgcagtagg

SEQ ID NO: 170381 - DNA, 23 bp, Homo sapiens
tgattgccactgtctgcagtagg

SEQ ID NO: 170382 - DNA, 19 bp, Homo sapiens
atatgtgtatatatatacg

SEQ ID NO: 170383 - DNA, 22 bp, Homo sapiens
tctctggctcagagtatgccag

SEQ ID NO: 170384 - DNA, 23 bp, Homo sapiens
atgtgtatatatgtatatgtgtg

SEQ ID NO: 170385 - DNA, 22 bp, Homo sapiens
tgtatatatgtatatatgtgtg

SEQ ID NO: 170386 - DNA, 23 bp, Homo sapiens
tatatacatgtatacacacatat

SEQ ID NO: 170387 - DNA, 21 bp, Homo sapiens
tatacacacacatatacatat

SEQ ID NO: 170388 - DNA, 20 bp, Homo sapiens
atatgtattatacataagtg

SEQ ID NO: 170389 - DNA, 22 bp, Homo sapiens
ttaatgtatataatgaatcctt

SEQ ID NO: 170390 - DNA, 23 bp, Homo sapiens
atatgtgtgtgtatatgtatata

SEQ ID NO: 170391 - DNA, 22 bp, Homo sapiens
tttggtgccatatgaaatctaa

SEQ ID NO: 170392 - DNA, 23 bp, Homo sapiens
tctgtccctctgtggctgtgttg

SEQ ID NO: 170393 - DNA, 23 bp, Homo sapiens
gggtctcactctgtcacccaggc

SEQ ID NO: 170394 - DNA, 23 bp, Homo sapiens
tagactgaagagccagcagtgag

SEQ ID NO: 170395 - DNA, 23 bp, Homo sapiens
tgtcaggttgtgattctggaagt

SEQ ID NO: 170396 - DNA, 23 bp, Homo sapiens
agttagagaacacagagtgtact

SEQ ID NO: 170397 - DNA, 23 bp, Homo sapiens
tgagttcattgtagattctggat

SEQ ID NO: 170398 - DNA, 23 bp, Homo sapiens
tgagttcattgtagattctggat

SEQ ID NO: 170399 - DNA, 21 bp, Homo sapiens
ttgcatgagagagagctcttg

SEQ ID NO: 170400 - DNA, 23 bp, Homo sapiens
accatacatctctcactgtcacc

SEQ ID NO: 170401 - DNA, 23 bp, Homo sapiens
agctgtcaaactctgtgcctgag

SEQ ID NO: 170402 - DNA, 23 bp, Homo sapiens
tgagttcattgtagattctggat

SEQ ID NO: 170403 - DNA, 23 bp, Homo sapiens
tgagttcattgtagattctggat

SEQ ID NO: 170404 - DNA, 23 bp, Homo sapiens
ttctgtgaagaaagtcaatggta

SEQ ID NO: 170405 - DNA, 23 bp, Homo sapiens
tgagttcattgtagattctggat

SEQ ID NO: 170406 - DNA, 23 bp, Homo sapiens
tgagttcattgtagattctggat

SEQ ID NO: 170407 - DNA, 23 bp, Homo sapiens
tgaggtattttgttgaatgacca

SEQ ID NO: 170408 - DNA, 23 bp, Homo sapiens
tgagttcattgtagattctggat

SEQ ID NO: 170409 - DNA, 23 bp, Homo sapiens
tgagttcattgtagattctggat

SEQ ID NO: 170410 - DNA, 18 bp, Homo sapiens
tatttagttcttttggtg

SEQ ID NO: 170411 - DNA, 23 bp, Homo sapiens
tggactgtctgcatctcttgcag

SEQ ID NO: 170412 - DNA, 23 bp, Homo sapiens
tgtgtatgtgtatatgtatgtat

SEQ ID NO: 170413 - DNA, 19 bp, Homo sapiens
agcaggtgtattcatggat

SEQ ID NO: 170414 - DNA, 23 bp, Homo sapiens
tatctatgtgtatatgtatatgt

SEQ ID NO: 170415 - DNA, 23 bp, Homo sapiens
tctctctctgcctgagtgctgcc

SEQ ID NO: 170416 - DNA, 21 bp, Homo sapiens
tctgagggagatgtagtgcat

SEQ ID NO: 170417 - DNA, 23 bp, Homo sapiens
tgagttcattgtagattctggat

SEQ ID NO: 170418 - DNA, 23 bp, Homo sapiens
tgagttcattgtagattctggat

SEQ ID NO: 170419 - DNA, 23 bp, Homo sapiens
ctcagtacatcctgcaggagttg

SEQ ID NO: 170420 - DNA, 19 bp, Homo sapiens
ttttagagatctgggggcc

SEQ ID NO: 170421 - DNA, 23 bp, Homo sapiens
tctctctgtgtgtatatgcatgt

SEQ ID NO: 170422 - DNA, 23 bp, Homo sapiens
cactgtctctgcctctctggctg

SEQ ID NO: 170423 - DNA, 22 bp, Homo sapiens
agagcataattagatttgagaa

SEQ ID NO: 170424 - DNA, 23 bp, Homo sapiens
ccctgatgagtgagctgcatttt

SEQ ID NO: 170425 - DNA, 23 bp, Homo sapiens
ttttgagacggactctctctgtc

SEQ ID NO: 170426 - DNA, 23 bp, Homo sapiens
tttgcagatgacatgatcatgta

SEQ ID NO: 170427 - DNA, 21 bp, Homo sapiens
aatctcactctgtcgctcagg

SEQ ID NO: 170428 - DNA, 22 bp, Homo sapiens
agagtctcgctctgtcacccag

SEQ ID NO: 170429 - DNA, 23 bp, Homo sapiens
acagagtctcactctgtcgccca

SEQ ID NO: 170430 - DNA, 23 bp, Homo sapiens
atatgtgtatatgtgtatatgtg

SEQ ID NO: 170431 - DNA, 23 bp, Homo sapiens
tatatgtgtatatatatgtgtgt

SEQ ID NO: 170432 - DNA, 22 bp, Homo sapiens
gtgtctctgtgtcactgcgtct

SEQ ID NO: 170433 - DNA, 23 bp, Homo sapiens
gttttcttcatgtttcttgaact

SEQ ID NO: 170434 - DNA, 19 bp, Homo sapiens
tatatgcacatatatatgt

SEQ ID NO: 170435 - DNA, 23 bp, Homo sapiens
ttattaccataagtgattgttag

SEQ ID NO: 170436 - DNA, 23 bp, Homo sapiens
tgcatgatggtgcctgactttag

SEQ ID NO: 170437 - DNA, 23 bp, Homo sapiens
tttgtacatatacatacgtgtat

SEQ ID NO: 170438 - DNA, 23 bp, Homo sapiens
agtgctctgtctgtatatgtgtg

SEQ ID NO: 170439 - DNA, 23 bp, Homo sapiens
ttctaccctctgcttctgtgagt

SEQ ID NO: 170440 - DNA, 20 bp, Homo sapiens
agtctcgctctgtcgctcag

SEQ ID NO: 170441 - DNA, 23 bp, Homo sapiens
tgagttcattgtagattctggat

SEQ ID NO: 170442 - DNA, 23 bp, Homo sapiens
tgagttcattgtagattctggat

SEQ ID NO: 170443 - DNA, 19 bp, Homo sapiens
tgtgagaagagagccagca

SEQ ID NO: 170444 - DNA, 19 bp, Homo sapiens
gtggcgtgatcttggctca

SEQ ID NO: 170445 - DNA, 21 bp, Homo sapiens
ctctctccctgtgaaatcttc

SEQ ID NO: 170446 - DNA, 23 bp, Homo sapiens
tgtgattcttttagttgtcttga

SEQ ID NO: 170447 - DNA, 22 bp, Homo sapiens
attaagaaatttaggataggaa

SEQ ID NO: 170448 - DNA, 18 bp, Homo sapiens
ctgccgattgtgtctgct

SEQ ID NO: 170449 - DNA, 23 bp, Homo sapiens
tgtgtgtctgtgtcctaatgtcc

SEQ ID NO: 170450 - DNA, 22 bp, Homo sapiens
tgactagagggattcctggaac

SEQ ID NO: 170451 - DNA, 21 bp, Homo sapiens
cagtctcactctgtcaccctg

SEQ ID NO: 170452 - DNA, 23 bp, Homo sapiens
atatgtatatgtatatgtatatc

SEQ ID NO: 170453 - DNA, 21 bp, Homo sapiens
tctgtatttgtatctgtgtgt

SEQ ID NO: 170454 - DNA, 23 bp, Homo sapiens
gacagagtctcgctctgtcaccc

SEQ ID NO: 170455 - DNA, 23 bp, Homo sapiens
acagagtctcgctctgtcaccca

SEQ ID NO: 170456 - DNA, 21 bp, Homo sapiens
ttgagctttaaatgctgagtg

SEQ ID NO: 170457 - DNA, 23 bp, Homo sapiens
aaactcactgtctccgtggctct

SEQ ID NO: 170458 - DNA, 23 bp, Homo sapiens
tgagttcattgtagattctggat

SEQ ID NO: 170459 - DNA, 23 bp, Homo sapiens
tgagttcattgtagattctggat

SEQ ID NO: 170460 - DNA, 23 bp, Homo sapiens
atctgctctctgggtctctgagt

SEQ ID NO: 170461 - DNA, 21 bp, Homo sapiens
aaacacacagcaactaaatgc

SEQ ID NO: 170462 - DNA, 23 bp, Homo sapiens
ctccctgtctgtgtgtccctggc

SEQ ID NO: 170463 - DNA, 23 bp, Homo sapiens
cggagtctcactctgtcacccag

SEQ ID NO: 170464 - DNA, 23 bp, Homo sapiens
accgagtctcactctgtcaccca

SEQ ID NO: 170465 - DNA, 23 bp, Homo sapiens
acacagagaagagtcacagcagg

SEQ ID NO: 170466 - DNA, 18 bp, Homo sapiens
cacagagggtggacgtgc

SEQ ID NO: 170467 - DNA, 23 bp, Homo sapiens
ttcacactctgtgacttagagcg

SEQ ID NO: 170468 - DNA, 23 bp, Homo sapiens
tctgagacagatgagtcttgctc

SEQ ID NO: 170469 - DNA, 21 bp, Homo sapiens
tgactcccacacaccgtctct

SEQ ID NO: 170470 - DNA, 23 bp, Homo sapiens
ggcagaagacactgagttctcag

SEQ ID NO: 170471 - DNA, 20 bp, Homo sapiens
gacagttatccctttctagt

SEQ ID NO: 170472 - DNA, 23 bp, Homo sapiens
gactgagtctcgctgtgtcaccc

SEQ ID NO: 170473 - DNA, 19 bp, Homo sapiens
catgtatatatgaatacct

SEQ ID NO: 170474 - DNA, 23 bp, Homo sapiens
atgtatgtatatgtatatgtata

SEQ ID NO: 170475 - DNA, 21 bp, Homo sapiens
atgtgcatatattatatatgt

SEQ ID NO: 170476 - DNA, 18 bp, Homo sapiens
atgtgcatatatttatat

SEQ ID NO: 170477 - DNA, 20 bp, Homo sapiens
atatgtatttatagttatgt

SEQ ID NO: 170478 - DNA, 22 bp, Homo sapiens
taaactgtatgcatatattgac

SEQ ID NO: 170479 - DNA, 23 bp, Homo sapiens
tgagttcattgtagattctggat

SEQ ID NO: 170480 - DNA, 23 bp, Homo sapiens
tgagttcattgtagattctggat

SEQ ID NO: 170481 - DNA, 22 bp, Homo sapiens
tgacagagtcaggtttgtttta

SEQ ID NO: 170482 - DNA, 23 bp, Homo sapiens
aagttttggaaatagctagtagt

SEQ ID NO: 170483 - DNA, 23 bp, Homo sapiens
tttgagacggagtctcgctctgt

SEQ ID NO: 170484 - DNA, 22 bp, Homo sapiens
tatatatcagcatgtatatata

SEQ ID NO: 170485 - DNA, 23 bp, Homo sapiens
tgagttcattgtagattctggat

SEQ ID NO: 170486 - DNA, 23 bp, Homo sapiens
tgagttcattgtagattctggat

SEQ ID NO: 170487 - DNA, 21 bp, Homo sapiens
acactttcactttctcttttg

SEQ ID NO: 170488 - DNA, 20 bp, Homo sapiens
ttagtagagatggggtttca

SEQ ID NO: 170489 - DNA, 21 bp, Homo sapiens
atactttaagttttagggtac

SEQ ID NO: 170490 - DNA, 23 bp, Homo sapiens
tgagttcattgtagattctggat

SEQ ID NO: 170491 - DNA, 23 bp, Homo sapiens
tgagttcattgtagattctggat

SEQ ID NO: 170492 - DNA, 19 bp, Homo sapiens
catgtatatatgaatacct

SEQ ID NO: 170493 - DNA, 23 bp, Homo sapiens
atgtatgtatatgtatatgtata

SEQ ID NO: 170494 - DNA, 21 bp, Homo sapiens
atgtgcatatattatatatgt

SEQ ID NO: 170495 - DNA, 18 bp, Homo sapiens
atgtgcatatatttatat

SEQ ID NO: 170496 - DNA, 20 bp, Homo sapiens
atatgtatttatagttatgt

SEQ ID NO: 170497 - DNA, 19 bp, Homo sapiens
gtgaattgtatagtagtga

SEQ ID NO: 170498 - DNA, 18 bp, Homo sapiens
taatgtggtggctctgga

SEQ ID NO: 170499 - DNA, 23 bp, Homo sapiens
tgagttcattgtagattctggat

SEQ ID NO: 170500 - DNA, 23 bp, Homo sapiens
tgagttcattgtagattctggat

SEQ ID NO: 170501 - DNA, 23 bp, Homo sapiens
tagactctcagtaatacttgttg

SEQ ID NO: 170502 - DNA, 23 bp, Homo sapiens
ctctcactcagtccctcccttaa

SEQ ID NO: 170503 - DNA, 23 bp, Homo sapiens
tcagccactgactctgtcctagg

SEQ ID NO: 170504 - DNA, 20 bp, Homo sapiens
tcttcctgtcagtgtacttg

SEQ ID NO: 170505 - DNA, 21 bp, Homo sapiens
atgttggcacatgatggctgt

SEQ ID NO: 170506 - DNA, 18 bp, Homo sapiens
tgaagtggtgcacctgta

SEQ ID NO: 170507 - DNA, 23 bp, Homo sapiens
gctgaggtaggaggatcacttga

SEQ ID NO: 170508 - DNA, 21 bp, Homo sapiens
atgttggcacatgatggctgt

SEQ ID NO: 170509 - DNA, 18 bp, Homo sapiens
tgaagtggtgcacctgta

SEQ ID NO: 170510 - DNA, 23 bp, Homo sapiens
gctgaggtaggaggatcacttga

SEQ ID NO: 170511 - DNA, 21 bp, Homo sapiens
atgttggcacatgatggctgt

SEQ ID NO: 170512 - DNA, 18 bp, Homo sapiens
tgaagtggtgcacctgta

SEQ ID NO: 170513 - DNA, 23 bp, Homo sapiens
gctgaggtaggaggatcacttga

SEQ ID NO: 170514 - DNA, 21 bp, Homo sapiens
agacactctgcctgtgccagt

SEQ ID NO: 170515 - DNA, 23 bp, Homo sapiens
ctgtcactgtctctgttattcca

SEQ ID NO: 170516 - DNA, 21 bp, Homo sapiens
tctctcactctgtcacccggt

SEQ ID NO: 170517 - DNA, 23 bp, Homo sapiens
cagggtctcactctgtcagccag

SEQ ID NO: 170518 - DNA, 23 bp, Homo sapiens
gggtctcactctgtcacccaggc

SEQ ID NO: 170519 - DNA, 23 bp, Homo sapiens
agggtctcactctgtctcccagg

SEQ ID NO: 170520 - DNA, 23 bp, Homo sapiens
cactgtctgtctgtccgtctgtg

SEQ ID NO: 170521 - DNA, 23 bp, Homo sapiens
gtgtgtctcagtggctgtgagct

SEQ ID NO: 170522 - DNA, 23 bp, Homo sapiens
tgtgtgtatatatgtgtgtgtgt

SEQ ID NO: 170523 - DNA, 23 bp, Homo sapiens
ggggctcactcagtctgtgtcca

SEQ ID NO: 170524 - DNA, 23 bp, Homo sapiens
gtgtgtgacactgtgagtgtgtc

SEQ ID NO: 170525 - DNA, 23 bp, Homo sapiens
atcagagaggactgagagaggtc

SEQ ID NO: 170526 - DNA, 23 bp, Homo sapiens
ctgagtgacatgtatgtggagag

SEQ ID NO: 170527 - DNA, 23 bp, Homo sapiens
agagagtactgagtgaggtcatg

SEQ ID NO: 170528 - DNA, 21 bp, Homo sapiens
aaatagacatgtgcgtgcaca

SEQ ID NO: 170529 - DNA, 23 bp, Homo sapiens
atgaattggtgctgatgctgctg

SEQ ID NO: 170530 - DNA, 23 bp, Homo sapiens
ggggctcactcagtctgtgtcca

SEQ ID NO: 170531 - DNA, 23 bp, Homo sapiens
gtgtgtgacactgtgagtgtgtc

SEQ ID NO: 170532 - DNA, 23 bp, Homo sapiens
atcagagaggactgagagaggtc

SEQ ID NO: 170533 - DNA, 23 bp, Homo sapiens
ctgagtgacatgtatgtggagag

SEQ ID NO: 170534 - DNA, 23 bp, Homo sapiens
agagagtactgagtgaggtcatg

SEQ ID NO: 170535 - DNA, 21 bp, Homo sapiens
agtggggaatgtcttacccaa

SEQ ID NO: 170536 - DNA, 21 bp, Homo sapiens
agtcacattctctgtgtctct

SEQ ID NO: 170537 - DNA, 23 bp, Homo sapiens
aacactcagaacagtgtctggcc

SEQ ID NO: 170538 - DNA, 23 bp, Homo sapiens
tcagaggtgactgagtagagagc

SEQ ID NO: 170539 - DNA, 23 bp, Homo sapiens
tgtgtgtctgtgtcctaatgtcc

SEQ ID NO: 170540 - DNA, 19 bp, Homo sapiens
gctcaggctttctccagtg

SEQ ID NO: 170541 - DNA, 22 bp, Homo sapiens
tgagagagaagtgagtgggctg

SEQ ID NO: 170542 - DNA, 23 bp, Homo sapiens
tacctagttctaaatatgtgctg

SEQ ID NO: 170543 - DNA, 18 bp, Homo sapiens
tgaggtagaaactagtat

SEQ ID NO: 170544 - DNA, 23 bp, Homo sapiens
tgagttcattgtagattctggat

SEQ ID NO: 170545 - DNA, 23 bp, Homo sapiens
tgagttcattgtagattctggat

SEQ ID NO: 170546 - DNA, 23 bp, Homo sapiens
acagctttattgagttatagttg

SEQ ID NO: 170547 - DNA, 23 bp, Homo sapiens
tggaataatattcattttgaata

SEQ ID NO: 170548 - DNA, 20 bp, Homo sapiens
tcaaatgctcagactcctgt

SEQ ID NO: 170549 - DNA, 23 bp, Homo sapiens
tttgagcatgtgctatggtgtct

SEQ ID NO: 170550 - DNA, 20 bp, Homo sapiens
tcaaatgctcagactcctgt

SEQ ID NO: 170551 - DNA, 23 bp, Homo sapiens
tgagcatgtgctacggtgtctac

SEQ ID NO: 170552 - DNA, 23 bp, Homo sapiens
tgagttcattgtagattctggat

SEQ ID NO: 170553 - DNA, 23 bp, Homo sapiens
tgagttcattgtagattctggat

SEQ ID NO: 170554 - DNA, 23 bp, Homo sapiens
ttttgcttgatctatgccttgag

SEQ ID NO: 170555 - DNA, 23 bp, Homo sapiens
tatgtgtatatatacatatgtgt

SEQ ID NO: 170556 - DNA, 21 bp, Homo sapiens
aggttcatctggaactgttga

SEQ ID NO: 170557 - DNA, 22 bp, Homo sapiens
aagtcactagtggttccgttta

SEQ ID NO: 170558 - DNA, 20 bp, Homo sapiens
atatgtatatgtatatatgt

SEQ ID NO: 170559 - DNA, 22 bp, Homo sapiens
tatgtgcatatatatacatata

SEQ ID NO: 170560 - DNA, 22 bp, Homo sapiens
gctctgtatcgctgactgtatc

SEQ ID NO: 170561 - DNA, 23 bp, Homo sapiens
gacagtctggagagagagagctc

SEQ ID NO: 170562 - DNA, 23 bp, Homo sapiens
aggtacacatacatatagatatg

SEQ ID NO: 170563 - DNA, 18 bp, Homo sapiens
agagagaaagaaaactct

SEQ ID NO: 170564 - DNA, 23 bp, Homo sapiens
ccctgcgtctgtgtttctgtcca

SEQ ID NO: 170565 - DNA, 20 bp, Homo sapiens
aaagagaagcattaaggatg

SEQ ID NO: 170566 - DNA, 23 bp, Homo sapiens
tgagacagagtctggctctgtcg

SEQ ID NO: 170567 - DNA, 23 bp, Homo sapiens
ttctgtgaagaaagtcagtggta

SEQ ID NO: 170568 - DNA, 18 bp, Homo sapiens
tctgatggtagagttgac

SEQ ID NO: 170569 - DNA, 23 bp, Homo sapiens
acagaagactcaaagctgatagc

SEQ ID NO: 170570 - DNA, 22 bp, Homo sapiens
agggagtcagctctgtggctgt

SEQ ID NO: 170571 - DNA, 23 bp, Homo sapiens
tgagacagagtctcgctctgtca

SEQ ID NO: 170572 - DNA, 19 bp, Homo sapiens
tgactccttttcttgacaa

SEQ ID NO: 170573 - DNA, 23 bp, Homo sapiens
tttctgtctggatgacttgtcca

SEQ ID NO: 170574 - DNA, 21 bp, Homo sapiens
atcactagtaatatttctgac

SEQ ID NO: 170575 - DNA, 23 bp, Homo sapiens
agctgacagaactgagaaaggag

SEQ ID NO: 170576 - DNA, 19 bp, Homo sapiens
tctctgtagtctgtgcaat

SEQ ID NO: 170577 - DNA, 22 bp, Homo sapiens
tatagtgtatatatatacatgt

SEQ ID NO: 170578 - DNA, 19 bp, Homo sapiens
atacacgtatatactgtat

SEQ ID NO: 170579 - DNA, 20 bp, Homo sapiens
actgtatatatatactgtat

SEQ ID NO: 170580 - DNA, 20 bp, Homo sapiens
tacacagtatatatacatgt

SEQ ID NO: 170581 - DNA, 22 bp, Homo sapiens
atacacagtatatatacactgt

SEQ ID NO: 170582 - DNA, 21 bp, Homo sapiens
tacagtatatatatacatgta

SEQ ID NO: 170583 - DNA, 18 bp, Homo sapiens
atgtgtatatatacgtat

SEQ ID NO: 170584 - DNA, 18 bp, Homo sapiens
tggttaaggagcaggcag

SEQ ID NO: 170585 - DNA, 21 bp, Homo sapiens
ggctgagttcttaggtcttag

SEQ ID NO: 170586 - DNA, 20 bp, Homo sapiens
tggctgcctgactctctgac

SEQ ID NO: 170587 - DNA, 21 bp, Homo sapiens
actcactgcctctttatgtcc

SEQ ID NO: 170588 - DNA, 20 bp, Homo sapiens
tgtgacccagttaatctatt

SEQ ID NO: 170589 - DNA, 22 bp, Homo sapiens
tcactctgcctctggctctctt

SEQ ID NO: 170590 - DNA, 23 bp, Homo sapiens
tggactgtctgcatctcttgcag

SEQ ID NO: 170591 - DNA, 22 bp, Homo sapiens
atgtgtaattatatgaatgtat

SEQ ID NO: 170592 - DNA, 21 bp, Homo sapiens
tatatatctcatatatatcag

SEQ ID NO: 170593 - DNA, 22 bp, Homo sapiens
tactgagaacattgactgctct

SEQ ID NO: 170594 - DNA, 23 bp, Homo sapiens
aggatgtaagattctgagttgaa

SEQ ID NO: 170595 - DNA, 19 bp, Homo sapiens
tgagacagagtctcactct

SEQ ID NO: 170596 - DNA, 23 bp, Homo sapiens
tatatatgtgtgtgtgtgtagat

SEQ ID NO: 170597 - DNA, 21 bp, Homo sapiens
tactgacagtcagaaattggg

SEQ ID NO: 170598 - DNA, 23 bp, Homo sapiens
atttgtctcagtggaattttgtg

SEQ ID NO: 170599 - DNA, 23 bp, Homo sapiens
tacatgtgcacaacgtgcaggtt

SEQ ID NO: 170600 - DNA, 23 bp, Homo sapiens
attgtgtgtgtatatgtatacat

SEQ ID NO: 170601 - DNA, 23 bp, Homo sapiens
atgcaatgcctgcctgtctgcca

SEQ ID NO: 170602 - DNA, 19 bp, Homo sapiens
atatatgtgtgcatgtgta

SEQ ID NO: 170603 - DNA, 23 bp, Homo sapiens
tgagttcattgtagattctggat

SEQ ID NO: 170604 - DNA, 23 bp, Homo sapiens
tgagttcattgtagattctggat

SEQ ID NO: 170605 - DNA, 23 bp, Homo sapiens
tgtgtgtgtgtatgtctgtgtgt

SEQ ID NO: 170606 - DNA, 21 bp, Homo sapiens
tttcactgaggtataattgcc

SEQ ID NO: 170607 - DNA, 23 bp, Homo sapiens
acatacatgtatacagaatatct

SEQ ID NO: 170608 - DNA, 23 bp, Homo sapiens
tatatactgtatatatgtatgtg

SEQ ID NO: 170609 - DNA, 23 bp, Homo sapiens
ctcattgtggttttgatttgcat

SEQ ID NO: 170610 - DNA, 23 bp, Homo sapiens
agtcagcagactgtgagctcaca

SEQ ID NO: 170611 - DNA, 23 bp, Homo sapiens
atatgtgtgtatatatatgtgtg

SEQ ID NO: 170612 - DNA, 18 bp, Homo sapiens
tatatgtatgtatatatg

SEQ ID NO: 170613 - DNA, 23 bp, Homo sapiens
tgagttcattgtagattctggat

SEQ ID NO: 170614 - DNA, 22 bp, Homo sapiens
ttaatgtatataatgaatcctt

SEQ ID NO: 170615 - DNA, 19 bp, Homo sapiens
tataagtatataaggattc

SEQ ID NO: 170616 - DNA, 18 bp, Homo sapiens
ataagtatataaggattc

SEQ ID NO: 170617 - DNA, 20 bp, Homo sapiens
tatgtaatgtatataatgta

SEQ ID NO: 170618 - DNA, 23 bp, Homo sapiens
tgtgtatatgtatgtatgtgtat

SEQ ID NO: 170619 - DNA, 23 bp, Homo sapiens
gtgtgtatatatgtatatgtgtg

SEQ ID NO: 170620 - DNA, 23 bp, Homo sapiens
atatatgcacgtatacacacata

SEQ ID NO: 170621 - DNA, 23 bp, Homo sapiens
taagtgctcaaaaaggattgttg

SEQ ID NO: 170622 - DNA, 22 bp, Homo sapiens
atatgtgtatgtgtatatgtgt

SEQ ID NO: 170623 - DNA, 21 bp, Homo sapiens
atctcggctcactgcaagctc

SEQ ID NO: 170624 - DNA, 23 bp, Homo sapiens
ggagtctctctctgtcactcagg

SEQ ID NO: 170625 - DNA, 20 bp, Homo sapiens
tatatgtatatatgtataca

SEQ ID NO: 170626 - DNA, 23 bp, Homo sapiens
cggagtctcgctctgtctcccag

SEQ ID NO: 170627 - DNA, 21 bp, Homo sapiens
tcccaaattgctgggattaca

SEQ ID NO: 170628 - DNA, 23 bp, Homo sapiens
tgtatatatgtatatatgtgtgt

SEQ ID NO: 170629 - DNA, 21 bp, Homo sapiens
atatatacatatggaatacat

SEQ ID NO: 170630 - DNA, 19 bp, Homo sapiens
tatacacataatatatatg

SEQ ID NO: 170631 - DNA, 23 bp, Homo sapiens
cacatatatgtatgtgtatatac

SEQ ID NO: 170632 - DNA, 19 bp, Homo sapiens
tgtgtgtatatatgtgtgt

SEQ ID NO: 170633 - DNA, 23 bp, Homo sapiens
tttttgtgtggatatcttctcat

SEQ ID NO: 170634 - DNA, 21 bp, Homo sapiens
ttgattttgtatcctgaaatt

SEQ ID NO: 170635 - DNA, 23 bp, Homo sapiens
agactatggggttttctagatat

SEQ ID NO: 170636 - DNA, 21 bp, Homo sapiens
tgtgtgtgtgtatatatacac

SEQ ID NO: 170637 - DNA, 23 bp, Homo sapiens
tgcatagaactgtgcatgtgcat

SEQ ID NO: 170638 - DNA, 23 bp, Homo sapiens
atgcagatgtgtttgtatacatt

SEQ ID NO: 170639 - DNA, 18 bp, Homo sapiens
tgtgtatatatatgtgtg

SEQ ID NO: 170640 - DNA, 23 bp, Homo sapiens
tatatacatatacatatgtgtat

SEQ ID NO: 170641 - DNA, 23 bp, Homo sapiens
tgagttcattgtagattctggat

SEQ ID NO: 170642 - DNA, 23 bp, Homo sapiens
tgagttcattgtagattctggat

SEQ ID NO: 170643 - DNA, 23 bp, Homo sapiens
ttgaaatacatactgctaaccat

SEQ ID NO: 170644 - DNA, 21 bp, Homo sapiens
tagctagtaatgtgttatcat

SEQ ID NO: 170645 - DNA, 23 bp, Homo sapiens
tgactgtagtctgtcactctgat

SEQ ID NO: 170646 - DNA, 22 bp, Homo sapiens
actcagagtgctgccagtgctc

SEQ ID NO: 170647 - DNA, 23 bp, Homo sapiens
cttgaggaagtatcaatgtttct

SEQ ID NO: 170648 - DNA, 23 bp, Homo sapiens
gttactgagtttgttgttcactt

SEQ ID NO: 170649 - DNA, 23 bp, Homo sapiens
aaaggtccaaatagtggagaatg

SEQ ID NO: 170650 - DNA, 20 bp, Homo sapiens
tagaaccttatataatatga

SEQ ID NO: 170651 - DNA, 22 bp, Homo sapiens
tgaaatttcgatttcatttctt

SEQ ID NO: 170652 - DNA, 23 bp, Homo sapiens
aaagccactgggagaagtgagcc

SEQ ID NO: 170653 - DNA, 21 bp, Homo sapiens
atatatgtatatgtgtgtgtg

SEQ ID NO: 170654 - DNA, 23 bp, Homo sapiens
tcactgaatctcaacagtttgtt

SEQ ID NO: 170655 - DNA, 21 bp, Homo sapiens
tgtgtgcctgtgtgcgtgtgt

SEQ ID NO: 170656 - DNA, 23 bp, Homo sapiens
gatatggtttccatttctagtgt

SEQ ID NO: 170657 - DNA, 23 bp, Homo sapiens
tttaagtcccaaaatgatctcct

SEQ ID NO: 170658 - DNA, 23 bp, Homo sapiens
tgagttcattgtagattctggat

SEQ ID NO: 170659 - DNA, 23 bp, Homo sapiens
tgagttcattgtagattctggat

SEQ ID NO: 170660 - DNA, 23 bp, Homo sapiens
gtccatctctgtactgcttcggt

SEQ ID NO: 170661 - DNA, 18 bp, Homo sapiens
tggaacacagtaagcaca

SEQ ID NO: 170662 - DNA, 23 bp, Homo sapiens
tttagttccaatagtctgtgaaa

SEQ ID NO: 170663 - DNA, 20 bp, Homo sapiens
tcactagactgtatccacta

SEQ ID NO: 170664 - DNA, 21 bp, Homo sapiens
agagggccagctttccatata

SEQ ID NO: 170665 - DNA, 23 bp, Homo sapiens
tgtgtgacttgagtgtgtgcaga

SEQ ID NO: 170666 - DNA, 21 bp, Homo sapiens
tgcgtattgtgtgtgtatggt

SEQ ID NO: 170667 - DNA, 22 bp, Homo sapiens
atatatgtatatatgtatatgt

SEQ ID NO: 170668 - DNA, 23 bp, Homo sapiens
tatgtgtatgcacattgtgtgtg

SEQ ID NO: 170669 - DNA, 23 bp, Homo sapiens
tgagttcattgtagattctggat

SEQ ID NO: 170670 - DNA, 23 bp, Homo sapiens
tgagttcattgtagattctggat

SEQ ID NO: 170671 - DNA, 19 bp, Homo sapiens
tatatctacacatggaaat

SEQ ID NO: 170672 - DNA, 21 bp, Homo sapiens
tctatcaggttctcgaggcac

SEQ ID NO: 170673 - DNA, 23 bp, Homo sapiens
tacatgtgcagaatgtgctggtt

SEQ ID NO: 170674 - DNA, 18 bp, Homo sapiens
agcctgagaatggactaa

SEQ ID NO: 170675 - DNA, 23 bp, Homo sapiens
atatgtatatatatgtatgtgta

SEQ ID NO: 170676 - DNA, 23 bp, Homo sapiens
tatgtgtatgtatatatatgtgt

SEQ ID NO: 170677 - DNA, 23 bp, Homo sapiens
tgtgtgtgtatatatatacacat

SEQ ID NO: 170678 - DNA, 18 bp, Homo sapiens
tacatatatatgctttgt

SEQ ID NO: 170679 - DNA, 22 bp, Homo sapiens
tatagatatgtatgtatatgta

SEQ ID NO: 170680 - DNA, 19 bp, Homo sapiens
atatgtctgtgtgtgtgtg

SEQ ID NO: 170681 - DNA, 23 bp, Homo sapiens
gagacacagtctcactctgtcac

SEQ ID NO: 170682 - DNA, 23 bp, Homo sapiens
acgtgcatttagaaagatttaga

SEQ ID NO: 170683 - DNA, 23 bp, Homo sapiens
tttagattgttcactgttggtat

SEQ ID NO: 170684 - DNA, 23 bp, Homo sapiens
ttagtgcttatgttcctgtatca

SEQ ID NO: 170685 - DNA, 23 bp, Homo sapiens
tgagttcattgtagattctggat

SEQ ID NO: 170686 - DNA, 23 bp, Homo sapiens
tgagttcattgtagattctggat

SEQ ID NO: 170687 - DNA, 19 bp, Homo sapiens
tgagaatatatttatatct

SEQ ID NO: 170688 - DNA, 22 bp, Homo sapiens
tgccctagattagtacatctgg

SEQ ID NO: 170689 - DNA, 23 bp, Homo sapiens
tgagtgtagaaggtggatagaga

SEQ ID NO: 170690 - DNA, 23 bp, Homo sapiens
tctctctctctgtcatttgctgc

SEQ ID NO: 170691 - DNA, 23 bp, Homo sapiens
tgtatatatgtatatgtgtgtgc

SEQ ID NO: 170692 - DNA, 23 bp, Homo sapiens
tgtatatatgtatacatgtattc

SEQ ID NO: 170693 - DNA, 23 bp, Homo sapiens
catgtatatgtatgcatatgtgt

SEQ ID NO: 170694 - DNA, 21 bp, Homo sapiens
atctatctatatgtatatatg

SEQ ID NO: 170695 - DNA, 23 bp, Homo sapiens
attatacaacatatagcatagtg

SEQ ID NO: 170696 - DNA, 21 bp, Homo sapiens
tatatagtgtacaagatttga

SEQ ID NO: 170697 - DNA, 18 bp, Homo sapiens
atagtctcttaaagcttt

SEQ ID NO: 170698 - DNA, 18 bp, Homo sapiens
tatcaaaacatcatgttg

SEQ ID NO: 170699 - DNA, 23 bp, Homo sapiens
tgagttcattgtagattctggat

SEQ ID NO: 170700 - DNA, 23 bp, Homo sapiens
tgagttcattgtagattctggat

SEQ ID NO: 170701 - DNA, 18 bp, Homo sapiens
acacacatatatatgtgt

SEQ ID NO: 170702 - DNA, 23 bp, Homo sapiens
tgcatgtgtgtatgtatacatat

SEQ ID NO: 170703 - DNA, 23 bp, Homo sapiens
tatatatgtttgcataaatgtgt

SEQ ID NO: 170704 - DNA, 23 bp, Homo sapiens
tgagttcattgtagattctggat

SEQ ID NO: 170705 - DNA, 23 bp, Homo sapiens
tgagttcattgtagattctggat

SEQ ID NO: 170706 - DNA, 21 bp, Homo sapiens
acacatgtatatgctgtgtat

SEQ ID NO: 170707 - DNA, 21 bp, Homo sapiens
atcagtgacatgtaaggagca

SEQ ID NO: 170708 - DNA, 23 bp, Homo sapiens
ctatgtgtgtatatgtgtgtgtg

SEQ ID NO: 170709 - DNA, 19 bp, Homo sapiens
agaagacagtgagatgagt

SEQ ID NO: 170710 - DNA, 18 bp, Homo sapiens
atttgtcagagttataga

SEQ ID NO: 170711 - DNA, 23 bp, Homo sapiens
tgtgaagaatgtcaatggtagtt

SEQ ID NO: 170712 - DNA, 23 bp, Homo sapiens
aaatcgaatgtattgagatttat

SEQ ID NO: 170713 - DNA, 23 bp, Homo sapiens
atatgtctatatatatatgtgtg

SEQ ID NO: 170714 - DNA, 22 bp, Homo sapiens
tgtgtgtatatatatatatgtg

SEQ ID NO: 170715 - DNA, 19 bp, Homo sapiens
tctcactctgtcacccagg

SEQ ID NO: 170716 - DNA, 20 bp, Homo sapiens
tgtgccactgcatctgctgg

SEQ ID NO: 170717 - DNA, 22 bp, Homo sapiens
attctgcaaagcgaccagattg

SEQ ID NO: 170718 - DNA, 22 bp, Homo sapiens
tttacctcttagtagaacgaca

SEQ ID NO: 170719 - DNA, 23 bp, Homo sapiens
tgtgtgtatatatatatgtgtgg

SEQ ID NO: 170720 - DNA, 20 bp, Homo sapiens
tatatgtatatatacatgta

SEQ ID NO: 170721 - DNA, 18 bp, Homo sapiens
tcagtttggaaaaggaga

SEQ ID NO: 170722 - DNA, 19 bp, Homo sapiens
tgcatatgtgtatatatgt

SEQ ID NO: 170723 - DNA, 23 bp, Homo sapiens
tatatacacatacgcatatgtgt

SEQ ID NO: 170724 - DNA, 23 bp, Homo sapiens
tatatacacatacgcatatgtgt

SEQ ID NO: 170725 - DNA, 23 bp, Homo sapiens
atgtacacatatgcatatgtgta

SEQ ID NO: 170726 - DNA, 22 bp, Homo sapiens
gtacacatatgcatatgtgtat

SEQ ID NO: 170727 - DNA, 21 bp, Homo sapiens
atgtatgtatatatgtgtgta

SEQ ID NO: 170728 - DNA, 21 bp, Homo sapiens
atgtatgtatatatgtgtgta

SEQ ID NO: 170729 - DNA, 21 bp, Homo sapiens
tttctgagggagactgctctg

SEQ ID NO: 170730 - DNA, 23 bp, Homo sapiens
caagtgtctgtgtctctctctct

SEQ ID NO: 170731 - DNA, 18 bp, Homo sapiens
taagtgtgccctttagtt

SEQ ID NO: 170732 - DNA, 22 bp, Homo sapiens
aatgtgctatactaaagtgtca

SEQ ID NO: 170733 - DNA, 23 bp, Homo sapiens
atatgtgtgtgtgtatatacaca

SEQ ID NO: 170734 - DNA, 23 bp, Homo sapiens
ttggtgctatctgagatttcagg

SEQ ID NO: 170735 - DNA, 21 bp, Homo sapiens
tcaggctccctgaattcagag

SEQ ID NO: 170736 - DNA, 22 bp, Homo sapiens
tcttctgattttcattttctgt

SEQ ID NO: 170737 - DNA, 23 bp, Homo sapiens
agatggagtctcgctctgtcacc

SEQ ID NO: 170738 - DNA, 23 bp, Homo sapiens
tctgagtctcactttctttattt

SEQ ID NO: 170739 - DNA, 21 bp, Homo sapiens
tgtgtacatatatatgtgtgt

SEQ ID NO: 170740 - DNA, 21 bp, Homo sapiens
tatatggatatatatggatat

SEQ ID NO: 170741 - DNA, 21 bp, Homo sapiens
tcactaatgagtaagatgttg

SEQ ID NO: 170742 - DNA, 22 bp, Homo sapiens
atgactgagaagactgaggtca

SEQ ID NO: 170743 - DNA, 20 bp, Homo sapiens
gagagatctgtgaagccaca

SEQ ID NO: 170744 - DNA, 22 bp, Homo sapiens
agattcaggaagtgcatgtgca

SEQ ID NO: 170745 - DNA, 23 bp, Homo sapiens
atgggtatactgcataatgctga

SEQ ID NO: 170746 - DNA, 22 bp, Homo sapiens
ttttccctgctgatggttttct

SEQ ID NO: 170747 - DNA, 23 bp, Homo sapiens
ctgacactgtctgccttagaact

SEQ ID NO: 170748 - DNA, 23 bp, Homo sapiens
tgcattacatatatgtgtgtgtg

SEQ ID NO: 170749 - DNA, 23 bp, Homo sapiens
acacatgtatatgtgtatgtttg

SEQ ID NO: 170750 - DNA, 23 bp, Homo sapiens
tagcctgtgtgtatttctgtgtg

SEQ ID NO: 170751 - DNA, 23 bp, Homo sapiens
cagacttgaggcttgttaactct

SEQ ID NO: 170752 - DNA, 19 bp, Homo sapiens
ttaaaatgactttttgatg

SEQ ID NO: 170753 - DNA, 23 bp, Homo sapiens
tgagttcattgtagattctggat

SEQ ID NO: 170754 - DNA, 23 bp, Homo sapiens
tgagttcattgtagattctggat

SEQ ID NO: 170755 - DNA, 20 bp, Homo sapiens
attctgattgaaagatcttt

SEQ ID NO: 170756 - DNA, 23 bp, Homo sapiens
ataagaggttgttagtctttggt

SEQ ID NO: 170757 - DNA, 22 bp, Homo sapiens
tttatagcagtgccccacttct

SEQ ID NO: 170758 - DNA, 21 bp, Homo sapiens
tgctataaagaactgccagag

SEQ ID NO: 170759 - DNA, 23 bp, Homo sapiens
ctctctctcactggctgagcctg

SEQ ID NO: 170760 - DNA, 22 bp, Homo sapiens
caattctctcaagtcatgctgc

SEQ ID NO: 170761 - DNA, 23 bp, Homo sapiens
tctactgttgttgttgttcttgt

SEQ ID NO: 170762 - DNA, 23 bp, Homo sapiens
tatttctttatagcagtatgaaa

SEQ ID NO: 170763 - DNA, 23 bp, Homo sapiens
tattcactaaatgaatatcaggt

SEQ ID NO: 170764 - DNA, 18 bp, Homo sapiens
tatacctaaatgaaaatg

SEQ ID NO: 170765 - DNA, 22 bp, Homo sapiens
ctctgtctgtctgagtgggagc

SEQ ID NO: 170766 - DNA, 23 bp, Homo sapiens
tgagttcattgtagattctggat

SEQ ID NO: 170767 - DNA, 23 bp, Homo sapiens
tgagttcattgtagattctggat

SEQ ID NO: 170768 - DNA, 18 bp, Homo sapiens
tctcaaggggaatgcttc

SEQ ID NO: 170769 - DNA, 19 bp, Homo sapiens
tgaagacgaactgcagctg

SEQ ID NO: 170770 - DNA, 23 bp, Homo sapiens
atctctctcagtcagtcttccct

SEQ ID NO: 170771 - DNA, 23 bp, Homo sapiens
tgagttcattgtagattctggat

SEQ ID NO: 170772 - DNA, 23 bp, Homo sapiens
tgagttcattgtagattctggat

SEQ ID NO: 170773 - DNA, 23 bp, Homo sapiens
gacgagtctcactctgtcaccca

SEQ ID NO: 170774 - DNA, 23 bp, Homo sapiens
tgaagtctcactctgtcacccac

SEQ ID NO: 170775 - DNA, 20 bp, Homo sapiens
tgcaatggtgtgatctcagc

SEQ ID NO: 170776 - DNA, 23 bp, Homo sapiens
cccagcctccataactgtgagag

SEQ ID NO: 170777 - DNA, 23 bp, Homo sapiens
tgtgtgtgagctgtctttgtgtt

SEQ ID NO: 170778 - DNA, 21 bp, Homo sapiens
atatgtgtatatatatgtgtg

SEQ ID NO: 170779 - DNA, 21 bp, Homo sapiens
aacactatgccactttattct

SEQ ID NO: 170780 - DNA, 18 bp, Homo sapiens
gagtctcactctgtcact

SEQ ID NO: 170781 - DNA, 23 bp, Homo sapiens
cagagtctcactctgtcacccag

SEQ ID NO: 170782 - DNA, 22 bp, Homo sapiens
agatgcagtttcaccatgttgg

SEQ ID NO: 170783 - DNA, 23 bp, Homo sapiens
atgcactttattaagttgaagaa

SEQ ID NO: 170784 - DNA, 18 bp, Homo sapiens
ttaagtgctttttctgca

SEQ ID NO: 170785 - DNA, 23 bp, Homo sapiens
cttgcttcagtgtggcattcatc

SEQ ID NO: 170786 - DNA, 21 bp, Homo sapiens
aatgagagatcagagagaaga

SEQ ID NO: 170787 - DNA, 23 bp, Homo sapiens
tagttgttatactgcattgggtt

SEQ ID NO: 170788 - DNA, 23 bp, Homo sapiens
tgaacacagactagagagaggcc

SEQ ID NO: 170789 - DNA, 19 bp, Homo sapiens
atatgtatgtatacctata

SEQ ID NO: 170790 - DNA, 18 bp, Homo sapiens
tgagacacagtcttgctc

SEQ ID NO: 170791 - DNA, 23 bp, Homo sapiens
actgtgtcactgtcactacactc

SEQ ID NO: 170792 - DNA, 21 bp, Homo sapiens
aagaggtagagagaaaattgt

SEQ ID NO: 170793 - DNA, 20 bp, Homo sapiens
ttatactcacagatagttct

SEQ ID NO: 170794 - DNA, 23 bp, Homo sapiens
tgtgtgtgtgtgtcagatcatgc

SEQ ID NO: 170795 - DNA, 23 bp, Homo sapiens
gaaagtgtgtgtgtgcatgtata

SEQ ID NO: 170796 - DNA, 23 bp, Homo sapiens
acacacacacacattaaaatctc

SEQ ID NO: 170797 - DNA, 23 bp, Homo sapiens
gaaagtgtgtgtgtgcatgtata

SEQ ID NO: 170798 - DNA, 23 bp, Homo sapiens
acacacacacacattaaaatctc

SEQ ID NO: 170799 - DNA, 23 bp, Homo sapiens
tctgagaacagtctgaggttttg

SEQ ID NO: 170800 - DNA, 19 bp, Homo sapiens
tgttatacttttgagaatg

SEQ ID NO: 170801 - DNA, 22 bp, Homo sapiens
gttgtccattgttatggtgtgt

SEQ ID NO: 170802 - DNA, 23 bp, Homo sapiens
gtatgtgtgtgtgtatatgcatg

SEQ ID NO: 170803 - DNA, 23 bp, Homo sapiens
tgtgtgtgtgtatatgcatgtat

SEQ ID NO: 170804 - DNA, 23 bp, Homo sapiens
aagagacacgcattatcattagt

SEQ ID NO: 170805 - DNA, 19 bp, Homo sapiens
tcaaagtcccagcaagtgt

SEQ ID NO: 170806 - DNA, 18 bp, Homo sapiens
aagtgctgggattacagg

SEQ ID NO: 170807 - DNA, 23 bp, Homo sapiens
ttaggcttagaaagttatgtttg

SEQ ID NO: 170808 - DNA, 23 bp, Homo sapiens
atttgtagagttggggcactgat

SEQ ID NO: 170809 - DNA, 23 bp, Homo sapiens
tatacatatgtatatgtatgtgt

SEQ ID NO: 170810 - DNA, 23 bp, Homo sapiens
gagacagagtctcagtctgtcgc

SEQ ID NO: 170811 - DNA, 22 bp, Homo sapiens
acaaagaccctgctcttgtggt

SEQ ID NO: 170812 - DNA, 23 bp, Homo sapiens
acattgagttgtgcctctgtctc

SEQ ID NO: 170813 - DNA, 19 bp, Homo sapiens
tgtgagtggctgataaatg

SEQ ID NO: 170814 - DNA, 23 bp, Homo sapiens
ttcacaggattgttgtgaggatc

SEQ ID NO: 170815 - DNA, 23 bp, Homo sapiens
gagagaagtctgtggcatacttg

SEQ ID NO: 170816 - DNA, 23 bp, Homo sapiens
ctgtgagtgaggatgaacttttt

SEQ ID NO: 170817 - DNA, 23 bp, Homo sapiens
aaaagtgcttacagtgcaggtag

SEQ ID NO: 170818 - DNA, 23 bp, Homo sapiens
actgcaatgtaagcacttcttac

SEQ ID NO: 170819 - DNA, 23 bp, Homo sapiens
gagctgcttcttataatgtgtct

SEQ ID NO: 170820 - DNA, 23 bp, Homo sapiens
aaagtgctcatagtgcaggtagt

SEQ ID NO: 170821 - DNA, 20 bp, Homo sapiens
gactctactgtagtatgggc

SEQ ID NO: 170822 - DNA, 21 bp, Homo sapiens
agtactcttggataacaaatc

SEQ ID NO: 170823 - DNA, 20 bp, Homo sapiens
ttagttttgcaggtttgcat

SEQ ID NO: 170824 - DNA, 23 bp, Homo sapiens
tgtgcaaatccatgcaaaactga

SEQ ID NO: 170825 - DNA, 21 bp, Homo sapiens
atttgttgcattacttgtgtt

SEQ ID NO: 170826 - DNA, 22 bp, Homo sapiens
tattgcacttgtcccggcctgt

SEQ ID NO: 170827 - DNA, 23 bp, Homo sapiens
aatattcctttagtgaatgaatg

SEQ ID NO: 170828 - DNA, 23 bp, Homo sapiens
atgaataaggaagttttctgggc

SEQ ID NO: 170829 - DNA, 21 bp, Homo sapiens
tcactagacacacatacccct

SEQ ID NO: 170830 - DNA, 23 bp, Homo sapiens
tctgtggaattattttgataagt

SEQ ID NO: 170831 - DNA, 23 bp, Homo sapiens
tctgagcctcagtgtctgcatgc

SEQ ID NO: 170832 - DNA, 19 bp, Homo sapiens
aggaagaatatgaagtatg

SEQ ID NO: 170833 - DNA, 23 bp, Homo sapiens
gacagagtctcgctctgtcaccc

SEQ ID NO: 170834 - DNA, 23 bp, Homo sapiens
cttctgtccttttgattggaaga

SEQ ID NO: 170835 - DNA, 19 bp, Homo sapiens
ccaaccttttgtagtctga

SEQ ID NO: 170836 - DNA, 23 bp, Homo sapiens
gtgagacagtattcagtgtgcag

SEQ ID NO: 170837 - DNA, 21 bp, Homo sapiens
tatttggaagtactggaagca

SEQ ID NO: 170838 - DNA, 21 bp, Homo sapiens
attggtgcatttacaaacctt

SEQ ID NO: 170839 - DNA, 20 bp, Homo sapiens
tctgcctgactgtctcactc

SEQ ID NO: 170840 - DNA, 18 bp, Homo sapiens
ctgaccgtctgtctgtcc

SEQ ID NO: 170841 - DNA, 22 bp, Homo sapiens
ttggctcctgtgcaaatcagag

SEQ ID NO: 170842 - DNA, 23 bp, Homo sapiens
atactccttgcttttcatttcct

SEQ ID NO: 170843 - DNA, 23 bp, Homo sapiens
gttaagagttcagactctggagt

SEQ ID NO: 170844 - DNA, 22 bp, Homo sapiens
cattgtgcttttggtgctgcat

SEQ ID NO: 170845 - DNA, 23 bp, Homo sapiens
gtgaaaccttcagaattccatgg

SEQ ID NO: 170846 - DNA, 23 bp, Homo sapiens
tacatgtgcaggatgtgcaggtt

SEQ ID NO: 170847 - DNA, 20 bp, Homo sapiens
tcatgtgtcagttaatgatg

SEQ ID NO: 170848 - DNA, 23 bp, Homo sapiens
tgagttcattgtagattctggat

SEQ ID NO: 170849 - DNA, 23 bp, Homo sapiens
tgagttcattgtagattctggat

SEQ ID NO: 170850 - DNA, 21 bp, Homo sapiens
ttatttgttctggaaatcagt

SEQ ID NO: 170851 - DNA, 22 bp, Homo sapiens
tactgtatacatatatatgtat

SEQ ID NO: 170852 - DNA, 21 bp, Homo sapiens
tatactgtatacatatatatg

SEQ ID NO: 170853 - DNA, 23 bp, Homo sapiens
tttgcccctcgtatatatgtgtg

SEQ ID NO: 170854 - DNA, 23 bp, Homo sapiens
atcaggatctatatgaatgctct

SEQ ID NO: 170855 - DNA, 23 bp, Homo sapiens
tctgtcactgtctctcatgaccc

SEQ ID NO: 170856 - DNA, 23 bp, Homo sapiens
ggatcatctagttgcaggaaaac

SEQ ID NO: 170857 - DNA, 23 bp, Homo sapiens
agtctcttctggcttgtagggtt

SEQ ID NO: 170858 - DNA, 23 bp, Homo sapiens
tgagttcattgtagattctggat

SEQ ID NO: 170859 - DNA, 23 bp, Homo sapiens
tgagttcattgtagattctggat

SEQ ID NO: 170860 - DNA, 23 bp, Homo sapiens
tgagttcattgtagattctggat

SEQ ID NO: 170861 - DNA, 23 bp, Homo sapiens
tgagttcattgtagattctggat

SEQ ID NO: 170862 - DNA, 23 bp, Homo sapiens
gacagagtctcgctctgtcaccc

SEQ ID NO: 170863 - DNA, 18 bp, Homo sapiens
actgcaacctctgcttcc

SEQ ID NO: 170864 - DNA, 23 bp, Homo sapiens
tctctctctctatatctatctat

SEQ ID NO: 170865 - DNA, 22 bp, Homo sapiens
atttcttgtgtaaatggattgt

SEQ ID NO: 170866 - DNA, 23 bp, Homo sapiens
tgagttcattgtagattctggat

SEQ ID NO: 170867 - DNA, 23 bp, Homo sapiens
tgtgtgtatatgtgtatatatgt

SEQ ID NO: 170868 - DNA, 23 bp, Homo sapiens
tatgtgtatatatgtatatgtgt

SEQ ID NO: 170869 - DNA, 22 bp, Homo sapiens
tatacatgtatatatgtatgca

SEQ ID NO: 170870 - DNA, 22 bp, Homo sapiens
tgtgtatatatatatgtgtaca

SEQ ID NO: 170871 - DNA, 22 bp, Homo sapiens
tatatatgtatatgtaagcata

SEQ ID NO: 170872 - DNA, 19 bp, Homo sapiens
ttactctgtttctctgtgg

SEQ ID NO: 170873 - DNA, 20 bp, Homo sapiens
gtatgtgccaaacttgttcc

SEQ ID NO: 170874 - DNA, 23 bp, Homo sapiens
ttataagtgagatatagcaggaa

SEQ ID NO: 170875 - DNA, 23 bp, Homo sapiens
cggagtctcactctgtcacccag

SEQ ID NO: 170876 - DNA, 23 bp, Homo sapiens
gagtctcactctgtcacccaggc

SEQ ID NO: 170877 - DNA, 23 bp, Homo sapiens
tgagacggagtctcgctctgtca

SEQ ID NO: 170878 - DNA, 23 bp, Homo sapiens
tgagttcattgtagattctggat

SEQ ID NO: 170879 - DNA, 23 bp, Homo sapiens
tgagttcattgtagattctggat

SEQ ID NO: 170880 - DNA, 23 bp, Homo sapiens
tgatgaggatgatgatgatgatg

SEQ ID NO: 170881 - DNA, 23 bp, Homo sapiens
tgagttcattgtagattctggat

SEQ ID NO: 170882 - DNA, 23 bp, Homo sapiens
tgagttcattgtagattctggat

SEQ ID NO: 170883 - DNA, 18 bp, Homo sapiens
aaatctctcttgggtggg

SEQ ID NO: 170884 - DNA, 22 bp, Homo sapiens
actcctactctctctctaagat

SEQ ID NO: 170885 - DNA, 23 bp, Homo sapiens
gtactctgtcagtctcttgcctc

SEQ ID NO: 170886 - DNA, 23 bp, Homo sapiens
tacagtgttatttagaatttttt

SEQ ID NO: 170887 - DNA, 23 bp, Homo sapiens
tggagtctcactctgtcacccag

SEQ ID NO: 170888 - DNA, 22 bp, Homo sapiens
attggccctgaagaacagctct

SEQ ID NO: 170889 - DNA, 22 bp, Homo sapiens
tcactgtgtgtgtgtgtgcgcg

SEQ ID NO: 170890 - DNA, 22 bp, Homo sapiens
agacagtctcgctctgtcaccc

SEQ ID NO: 170891 - DNA, 23 bp, Homo sapiens
tcttgtgcatctgattttgtgag

SEQ ID NO: 170892 - DNA, 23 bp, Homo sapiens
tcgaagaaatgtgaattagttga

SEQ ID NO: 170893 - DNA, 22 bp, Homo sapiens
tgtgtatgtatgtatatgtata

SEQ ID NO: 170894 - DNA, 23 bp, Homo sapiens
tgagttcattgtagattctggat

SEQ ID NO: 170895 - DNA, 23 bp, Homo sapiens
tgagttcattgtagattctggat

SEQ ID NO: 170896 - DNA, 18 bp, Homo sapiens
aaactgaaaggtatgact

SEQ ID NO: 170897 - DNA, 23 bp, Homo sapiens
acatggtttttgaaccacatttg

SEQ ID NO: 170898 - DNA, 23 bp, Homo sapiens
taacagctattacatgagattct

SEQ ID NO: 170899 - DNA, 19 bp, Homo sapiens
tttaaaggatatttatagc

SEQ ID NO: 170900 - DNA, 18 bp, Homo sapiens
tgagacagagtctctctc

SEQ ID NO: 170901 - DNA, 18 bp, Homo sapiens
cagattatatatataaca

SEQ ID NO: 170902 - DNA, 20 bp, Homo sapiens
aacatatgtgaatatgtatt

SEQ ID NO: 170903 - DNA, 23 bp, Homo sapiens
tcagagaatatatatgtgtgtgt

SEQ ID NO: 170904 - DNA, 23 bp, Homo sapiens
ttagagaccgagtctcactctgt

SEQ ID NO: 170905 - DNA, 23 bp, Homo sapiens
aagtcacagaactaattaatgac

SEQ ID NO: 170906 - DNA, 23 bp, Homo sapiens
taagtcactagtctttctgtcac

SEQ ID NO: 170907 - DNA, 19 bp, Homo sapiens
atacacacacatatgtgta

SEQ ID NO: 170908 - DNA, 23 bp, Homo sapiens
atatatgcacataaatgtatgtg

SEQ ID NO: 170909 - DNA, 20 bp, Homo sapiens
tgaatggataaagaatatgt

SEQ ID NO: 170910 - DNA, 21 bp, Homo sapiens
ttattacaatatgataagggc

SEQ ID NO: 170911 - DNA, 20 bp, Homo sapiens
tgtatcagcttgaacagaga

SEQ ID NO: 170912 - DNA, 23 bp, Homo sapiens
tatgtatagttgtactagtggta

SEQ ID NO: 170913 - DNA, 19 bp, Homo sapiens
ttagtatatcgtcctgttt

SEQ ID NO: 170914 - DNA, 22 bp, Homo sapiens
ttattgatagctgaggctgtct

SEQ ID NO: 170915 - DNA, 18 bp, Homo sapiens
gtatttttagccatgtga

SEQ ID NO: 170916 - DNA, 23 bp, Homo sapiens
gatatcactggaaggaaatcttg

SEQ ID NO: 170917 - DNA, 23 bp, Homo sapiens
ttcattgtttatgaatagcactg

SEQ ID NO: 170918 - DNA, 18 bp, Homo sapiens
tcaccagcatctgttgtt

SEQ ID NO: 170919 - DNA, 23 bp, Homo sapiens
acactagacaggtaactcacact

SEQ ID NO: 170920 - DNA, 19 bp, Homo sapiens
tctggttgactttacataa

SEQ ID NO: 170921 - DNA, 23 bp, Homo sapiens
ttttgtagttccatatgaatttt

SEQ ID NO: 170922 - DNA, 22 bp, Homo sapiens
tataattatctctttgatattg

SEQ ID NO: 170923 - DNA, 23 bp, Homo sapiens
ataatgatgatgatgatgatgac

SEQ ID NO: 170924 - DNA, 23 bp, Homo sapiens
tgagttcattgtagattctggat

SEQ ID NO: 170925 - DNA, 23 bp, Homo sapiens
tgagttcattgtagattctggat

SEQ ID NO: 170926 - DNA, 23 bp, Homo sapiens
tgtctcagatgagactgtggact

SEQ ID NO: 170927 - DNA, 23 bp, Homo sapiens
tgagttcattgtagattctggat

SEQ ID NO: 170928 - DNA, 23 bp, Homo sapiens
tgagttcattgtagattctggat

SEQ ID NO: 170929 - DNA, 23 bp, Homo sapiens
ttcttcattctgttaacgtggtt

SEQ ID NO: 170930 - DNA, 22 bp, Homo sapiens
aatgtatgttgaactatactta

SEQ ID NO: 170931 - DNA, 23 bp, Homo sapiens
aatgagcatatgaatgcatgtgt

SEQ ID NO: 170932 - DNA, 22 bp, Homo sapiens
tgtgtatatatgtatatatgtg

SEQ ID NO: 170933 - DNA, 18 bp, Homo sapiens
gcctggatgtaggctttg

SEQ ID NO: 170934 - DNA, 22 bp, Homo sapiens
tatgtgtgtgtgtatgtagtaa

SEQ ID NO: 170935 - DNA, 22 bp, Homo sapiens
tgtgcatgtatgtatgtgtgta

SEQ ID NO: 170936 - DNA, 23 bp, Homo sapiens
atgtgtatatatgtatgtgtgtg

SEQ ID NO: 170937 - DNA, 21 bp, Homo sapiens
tttagtagagatgtagtttca

SEQ ID NO: 170938 - DNA, 18 bp, Homo sapiens
tagactggtcttgaactc

SEQ ID NO: 170939 - DNA, 19 bp, Homo sapiens
tgcaaattttaggattttt

SEQ ID NO: 170940 - DNA, 22 bp, Homo sapiens
tttcacagagattgtgttcagt

SEQ ID NO: 170941 - DNA, 23 bp, Homo sapiens
ataaatgtacatgtaatgtgtgt

SEQ ID NO: 170942 - DNA, 23 bp, Homo sapiens
atacacacacacacatatgcata

SEQ ID NO: 170943 - DNA, 22 bp, Homo sapiens
taaggatcttgagatgggaaga

SEQ ID NO: 170944 - DNA, 23 bp, Homo sapiens
tgagttcattgtagattctggat

SEQ ID NO: 170945 - DNA, 23 bp, Homo sapiens
tgagttcattgtagattctggat

SEQ ID NO: 170946 - DNA, 21 bp, Homo sapiens
aatgactcagattattttttc

SEQ ID NO: 170947 - DNA, 23 bp, Homo sapiens
catacatcattgacatttgaagt

SEQ ID NO: 170948 - DNA, 23 bp, Homo sapiens
atgtgtgtgagatatgtgtgtat

SEQ ID NO: 170949 - DNA, 23 bp, Homo sapiens
tatatcacttctgtgcgtgtgat

SEQ ID NO: 170950 - DNA, 22 bp, Homo sapiens
tttgtgagtacatagtaggtgt

SEQ ID NO: 170951 - DNA, 23 bp, Homo sapiens
atgtgtatgtatatatatgtgtg

SEQ ID NO: 170952 - DNA, 19 bp, Homo sapiens
tatacacacatatgcatat

SEQ ID NO: 170953 - DNA, 18 bp, Homo sapiens
agagatgatttagatttg

SEQ ID NO: 170954 - DNA, 23 bp, Homo sapiens
tatttttcttgatgatttatgtt

SEQ ID NO: 170955 - DNA, 23 bp, Homo sapiens
ttgggtctgctagtataatgttg

SEQ ID NO: 170956 - DNA, 23 bp, Homo sapiens
gatgtctttagctcttgtatcag

SEQ ID NO: 170957 - DNA, 20 bp, Homo sapiens
agagagactgtttttttttt

SEQ ID NO: 170958 - DNA, 23 bp, Homo sapiens
cctaatagttttcagcactttgt

SEQ ID NO: 170959 - DNA, 21 bp, Homo sapiens
aggcaagcttcagcagctgtt

SEQ ID NO: 170960 - DNA, 19 bp, Homo sapiens
caggtatttttttatcttt

SEQ ID NO: 170961 - DNA, 20 bp, Homo sapiens
tttggacatttaaaagtggt

SEQ ID NO: 170962 - DNA, 23 bp, Homo sapiens
ttttcttgacaccagatgtgtgt

SEQ ID NO: 170963 - DNA, 18 bp, Homo sapiens
catgtgagaagaaagcat

SEQ ID NO: 170964 - DNA, 22 bp, Homo sapiens
tttatatgtgcagctatttctt

SEQ ID NO: 170965 - DNA, 23 bp, Homo sapiens
cggagtctcgctctgtctcccag

SEQ ID NO: 170966 - DNA, 23 bp, Homo sapiens
ttatctttgaagagcaggaggtt

SEQ ID NO: 170967 - DNA, 23 bp, Homo sapiens
tgtttatgtccatatctatattt

SEQ ID NO: 170968 - DNA, 18 bp, Homo sapiens
tgacagtctggaggcatt

SEQ ID NO: 170969 - DNA, 18 bp, Homo sapiens
ttgattgtcacaatttgg

SEQ ID NO: 170970 - DNA, 22 bp, Homo sapiens
tgtctctctggctctcaggcct

SEQ ID NO: 170971 - DNA, 23 bp, Homo sapiens
tgtatagagattttgtagtttgc

SEQ ID NO: 170972 - DNA, 20 bp, Homo sapiens
atttagttgaaaggtgttgt

SEQ ID NO: 170973 - DNA, 23 bp, Homo sapiens
ttaatgttgcacataatgtagct

SEQ ID NO: 170974 - DNA, 21 bp, Homo sapiens
tgtgaagaaagtcaatggtag

SEQ ID NO: 170975 - DNA, 23 bp, Homo sapiens
gtgtgtgtgtgtgtgtgcatatg

SEQ ID NO: 170976 - DNA, 22 bp, Homo sapiens
cttcacagtagataatctggag

SEQ ID NO: 170977 - DNA, 22 bp, Homo sapiens
ttgcagtgagctgaggttgcac

SEQ ID NO: 170978 - DNA, 20 bp, Homo sapiens
tatgtgtatatatgtatatg

SEQ ID NO: 170979 - DNA, 23 bp, Homo sapiens
ttaactgataatatatatgtgtg

SEQ ID NO: 170980 - DNA, 20 bp, Homo sapiens
tggtgtcttgctctgtcacc

SEQ ID NO: 170981 - DNA, 23 bp, Homo sapiens
aattatggggattttctagtttt

SEQ ID NO: 170982 - DNA, 23 bp, Homo sapiens
tgaagttggaaaacacacacatg

SEQ ID NO: 170983 - DNA, 23 bp, Homo sapiens
atagaatgagcttggagttagtc

SEQ ID NO: 170984 - DNA, 23 bp, Homo sapiens
aggtggagtctccctctgtcacc

SEQ ID NO: 170985 - DNA, 19 bp, Homo sapiens
tattagttcttgttcatgt

SEQ ID NO: 170986 - DNA, 23 bp, Homo sapiens
tttttagttaaccaggtgtaggg

SEQ ID NO: 170987 - DNA, 23 bp, Homo sapiens
tcacttgagtctgggaagttgag

SEQ ID NO: 170988 - DNA, 23 bp, Homo sapiens
acagtgtctcactctgtcgccca

SEQ ID NO: 170989 - DNA, 22 bp, Homo sapiens
aagaaattagaagagggagact

SEQ ID NO: 170990 - DNA, 18 bp, Homo sapiens
tttttcttcttttttttt

SEQ ID NO: 170991 - DNA, 23 bp, Homo sapiens
actcactgcaactgcatctcctg

SEQ ID NO: 170992 - DNA, 19 bp, Homo sapiens
tgagatggagtctcactct

SEQ ID NO: 170993 - DNA, 18 bp, Homo sapiens
agtggtgtctcattgtgg

SEQ ID NO: 170994 - DNA, 19 bp, Homo sapiens
tttgcatttgctgaggagt

SEQ ID NO: 170995 - DNA, 23 bp, Homo sapiens
tttgagatggagtctcactcttt

SEQ ID NO: 170996 - DNA, 23 bp, Homo sapiens
gccagtctcactctcactgtgcc

SEQ ID NO: 170997 - DNA, 20 bp, Homo sapiens
tgggagacagattttttctt

SEQ ID NO: 170998 - DNA, 22 bp, Homo sapiens
aggtggcagtgtttcacctgtg

SEQ ID NO: 170999 - DNA, 23 bp, Homo sapiens
tgagatggagtctcacactgtca

SEQ ID NO: 171000 - DNA, 23 bp, Homo sapiens
atacatgtgcaggatgtgcaggt

SEQ ID NO: 171001 - DNA, 23 bp, Homo sapiens
tctcacacacatatatatctgta

SEQ ID NO: 171002 - DNA, 22 bp, Homo sapiens
acaggtatttaaagctatgact

SEQ ID NO: 171003 - DNA, 23 bp, Homo sapiens
aatctgtgattttgtatgtagtt

SEQ ID NO: 171004 - DNA, 22 bp, Homo sapiens
acatgtgcacaatgtgcaggtt

SEQ ID NO: 171005 - DNA, 23 bp, Homo sapiens
tatctctgtgtaaagtttgagat

SEQ ID NO: 171006 - DNA, 23 bp, Homo sapiens
tgataactgtttgacatgctgat

SEQ ID NO: 171007 - DNA, 22 bp, Homo sapiens
gtattactggatcaaatgacag

SEQ ID NO: 171008 - DNA, 23 bp, Homo sapiens
agacaaagtctcgctctgtcacc

SEQ ID NO: 171009 - DNA, 23 bp, Homo sapiens
tgagaagtgtctctctgtcagga

SEQ ID NO: 171010 - DNA, 23 bp, Homo sapiens
tatgtgtgtctctgtatgtgaga

SEQ ID NO: 171011 - DNA, 20 bp, Homo sapiens
cagcacactgatgggtcttg

SEQ ID NO: 171012 - DNA, 23 bp, Homo sapiens
tggagccctcacacagagtctcc

SEQ ID NO: 171013 - DNA, 22 bp, Homo sapiens
agctgtgagaagagagacacca

SEQ ID NO: 171014 - DNA, 20 bp, Homo sapiens
aacagtgtgtgctcacttgg

SEQ ID NO: 171015 - DNA, 20 bp, Homo sapiens
aggaatgattagagctatgg

SEQ ID NO: 171016 - DNA, 23 bp, Homo sapiens
gatctcagtctgtatctctgatc

SEQ ID NO: 171017 - DNA, 23 bp, Homo sapiens
gactgagtctcgctctgtcaccc

SEQ ID NO: 171018 - DNA, 23 bp, Homo sapiens
tatgtgtgtatatatatgtgtgt

SEQ ID NO: 171019 - DNA, 23 bp, Homo sapiens
ttttttggttccatatgaaattt

SEQ ID NO: 171020 - DNA, 20 bp, Homo sapiens
ttcaattatctcatatctgt

SEQ ID NO: 171021 - DNA, 23 bp, Homo sapiens
tctgcaggtgctgagatagtatt

SEQ ID NO: 171022 - DNA, 23 bp, Homo sapiens
agagaagagtcattgcagagggt

SEQ ID NO: 171023 - DNA, 23 bp, Homo sapiens
ttcagacttgaccctgtaggcaa

SEQ ID NO: 171024 - DNA, 22 bp, Homo sapiens
ctaactgctgtacctgctccca

SEQ ID NO: 171025 - DNA, 19 bp, Homo sapiens
agtgagccatgattgcacc

SEQ ID NO: 171026 - DNA, 21 bp, Homo sapiens
actcattcactcacacattcc

SEQ ID NO: 171027 - DNA, 23 bp, Homo sapiens
tatatttgtttttgtgtgccaat

SEQ ID NO: 171028 - DNA, 23 bp, Homo sapiens
tatgtatatgtaggagatataga

SEQ ID NO: 171029 - DNA, 22 bp, Homo sapiens
tcggagtctcactctgtcaccc

SEQ ID NO: 171030 - DNA, 23 bp, Homo sapiens
tgagacggagtctcgctctgtct

SEQ ID NO: 171031 - DNA, 23 bp, Homo sapiens
gacagagtctcgctctgtcaccc

SEQ ID NO: 171032 - DNA, 23 bp, Homo sapiens
cggagtctcactctgtcacccag

SEQ ID NO: 171033 - DNA, 23 bp, Homo sapiens
gagtctcactctgtcacccaggc

SEQ ID NO: 171034 - DNA, 19 bp, Homo sapiens
tgactgaagagagtccggt

SEQ ID NO: 171035 - DNA, 20 bp, Homo sapiens
agacagggtctcactctgtc

SEQ ID NO: 171036 - DNA, 23 bp, Homo sapiens
gagatggagtctcactctgtcac

SEQ ID NO: 171037 - DNA, 19 bp, Homo sapiens
tctacagatatatagatgt

SEQ ID NO: 171038 - DNA, 23 bp, Homo sapiens
ctctctgggctttctgtctctgt

SEQ ID NO: 171039 - DNA, 23 bp, Homo sapiens
tgagttcattgtagattctggat

SEQ ID NO: 171040 - DNA, 23 bp, Homo sapiens
tgagttcattgtagattctggat

SEQ ID NO: 171041 - DNA, 23 bp, Homo sapiens
tatcactgtttagtattgtgtct

SEQ ID NO: 171042 - DNA, 18 bp, Homo sapiens
ttttgagagggagtctcg

SEQ ID NO: 171043 - DNA, 20 bp, Homo sapiens
ttactggacgttctccacca

SEQ ID NO: 171044 - DNA, 23 bp, Homo sapiens
tctcagtagatagataccagtgc

SEQ ID NO: 171045 - DNA, 19 bp, Homo sapiens
tgggttgttgtggctttag

SEQ ID NO: 171046 - DNA, 23 bp, Homo sapiens
atgttctggaagactagtgaaga

SEQ ID NO: 171047 - DNA, 23 bp, Homo sapiens
tttgagacggagtctcactctgt

SEQ ID NO: 171048 - DNA, 19 bp, Homo sapiens
attagggatttgaaactct

SEQ ID NO: 171049 - DNA, 22 bp, Homo sapiens
tgagaggcagaggttgcagtga

SEQ ID NO: 171050 - DNA, 23 bp, Homo sapiens
gactgagtctcgctctgtcaccc

SEQ ID NO: 171051 - DNA, 21 bp, Homo sapiens
ctcacacctgtaatcccagca

SEQ ID NO: 171052 - DNA, 22 bp, Homo sapiens
atatgtgtatttatagatgtgt

SEQ ID NO: 171053 - DNA, 23 bp, Homo sapiens
gaggctgtgagtgactaatctct

SEQ ID NO: 171054 - DNA, 23 bp, Homo sapiens
tgagttcattgtagattctggat

SEQ ID NO: 171055 - DNA, 23 bp, Homo sapiens
tgagttcattgtagattctggat

SEQ ID NO: 171056 - DNA, 23 bp, Homo sapiens
tgagttcattgtagattctggat

SEQ ID NO: 171057 - DNA, 23 bp, Homo sapiens
tgagttcattgtagattctggat

SEQ ID NO: 171058 - DNA, 23 bp, Homo sapiens
atgactaatgattttgagcatct

SEQ ID NO: 171059 - DNA, 23 bp, Homo sapiens
tatctttgagtatgtgttcagat

SEQ ID NO: 171060 - DNA, 18 bp, Homo sapiens
ttacagacggtagttaag

SEQ ID NO: 171061 - DNA, 23 bp, Homo sapiens
tgagttcattgtagattctggat

SEQ ID NO: 171062 - DNA, 23 bp, Homo sapiens
tgagttcattgtagattctggat

SEQ ID NO: 171063 - DNA, 23 bp, Homo sapiens
atagagcggaaaagtagtctctc

SEQ ID NO: 171064 - DNA, 23 bp, Homo sapiens
ggagtctcactctgtctcccagg

SEQ ID NO: 171065 - DNA, 21 bp, Homo sapiens
tgtggcatattattctttact

SEQ ID NO: 171066 - DNA, 20 bp, Homo sapiens
atctacattgtatatgtata

SEQ ID NO: 171067 - DNA, 19 bp, Homo sapiens
catatatatgtgtatgtgt

SEQ ID NO: 171068 - DNA, 23 bp, Homo sapiens
tagtgtgtatatatgtatatgta

SEQ ID NO: 171069 - DNA, 22 bp, Homo sapiens
ttcctctagtcctagctacttg

SEQ ID NO: 171070 - DNA, 23 bp, Homo sapiens
taaggttaatattgttatgtgtg

SEQ ID NO: 171071 - DNA, 23 bp, Homo sapiens
tggagtctcactctgtcacccag

SEQ ID NO: 171072 - DNA, 18 bp, Homo sapiens
aagaggaagagagaagat

SEQ ID NO: 171073 - DNA, 22 bp, Homo sapiens
cactcagttctcattctctctc

SEQ ID NO: 171074 - DNA, 18 bp, Homo sapiens
tatagatgcacatatgta

SEQ ID NO: 171075 - DNA, 21 bp, Homo sapiens
tatatgtatatatacatatgt

SEQ ID NO: 171076 - DNA, 23 bp, Homo sapiens
taatttctgtggtcatttctgag

SEQ ID NO: 171077 - DNA, 23 bp, Homo sapiens
tgagttcattgtagattctggat

SEQ ID NO: 171078 - DNA, 23 bp, Homo sapiens
tgagttcattgtagattctggat

SEQ ID NO: 171079 - DNA, 19 bp, Homo sapiens
atataccagtatataccta

SEQ ID NO: 171080 - DNA, 23 bp, Homo sapiens
atgtatatatacatgtatgcata

SEQ ID NO: 171081 - DNA, 18 bp, Homo sapiens
tatgtatatatacatgta

SEQ ID NO: 171082 - DNA, 18 bp, Homo sapiens
actatatatattcagtat

SEQ ID NO: 171083 - DNA, 23 bp, Homo sapiens
tatagtacatatatattcagtat

SEQ ID NO: 171084 - DNA, 22 bp, Homo sapiens
atggtacatatatattcagtat

SEQ ID NO: 171085 - DNA, 23 bp, Homo sapiens
acttcatccacatgaagtacctt

SEQ ID NO: 171086 - DNA, 23 bp, Homo sapiens
ttgagacggagtttctctcttgt

SEQ ID NO: 171087 - DNA, 23 bp, Homo sapiens
tctatcctgagggtctctctctc

SEQ ID NO: 171088 - DNA, 22 bp, Homo sapiens
tgacagggtctcactctgtcac

SEQ ID NO: 171089 - DNA, 23 bp, Homo sapiens
tgtcagtgagtcagtctgttcct

SEQ ID NO: 171090 - DNA, 18 bp, Homo sapiens
atatgtatgtatatgtat

SEQ ID NO: 171091 - DNA, 21 bp, Homo sapiens
tgtatgtatatgtatatgtat

SEQ ID NO: 171092 - DNA, 23 bp, Homo sapiens
tacatgtatgtatgcatatgtat

SEQ ID NO: 171093 - DNA, 23 bp, Homo sapiens
atatatgtatgcatatgtatata

SEQ ID NO: 171094 - DNA, 18 bp, Homo sapiens
atatgtatgtatatgtat

SEQ ID NO: 171095 - DNA, 18 bp, Homo sapiens
atatgtatgtatatgtat

SEQ ID NO: 171096 - DNA, 20 bp, Homo sapiens
tatacgtgtatatatatatg

SEQ ID NO: 171097 - DNA, 23 bp, Homo sapiens
atatgtgtatatatatatgtgtg

SEQ ID NO: 171098 - DNA, 23 bp, Homo sapiens
tgagttcattgtagattctggat

SEQ ID NO: 171099 - DNA, 23 bp, Homo sapiens
tgagttcattgtagattctggat

SEQ ID NO: 171100 - DNA, 23 bp, Homo sapiens
tgtatatgtgtgtgaatatatgt

SEQ ID NO: 171101 - DNA, 21 bp, Homo sapiens
tatttgcacatatatggatgt

SEQ ID NO: 171102 - DNA, 19 bp, Homo sapiens
ctgggcacagtgactcaca

SEQ ID NO: 171103 - DNA, 20 bp, Homo sapiens
tgtttgtgtgttatacgatc

SEQ ID NO: 171104 - DNA, 23 bp, Homo sapiens
tctgttgttaggtacatatatgt

SEQ ID NO: 171105 - DNA, 23 bp, Homo sapiens
ttatatgttcttgatggcttgaa

SEQ ID NO: 171106 - DNA, 23 bp, Homo sapiens
agacttagagttcagtcttgcct

SEQ ID NO: 171107 - DNA, 23 bp, Homo sapiens
ttgatttattttgagtttacctt

SEQ ID NO: 171108 - DNA, 23 bp, Homo sapiens
tgagagggagaggatctggctct

SEQ ID NO: 171109 - DNA, 23 bp, Homo sapiens
ttgtagcatatgtttttattttg

SEQ ID NO: 171110 - DNA, 23 bp, Homo sapiens
tgagttcattgtagattctggat

SEQ ID NO: 171111 - DNA, 23 bp, Homo sapiens
tgagttcattgtagattctggat

SEQ ID NO: 171112 - DNA, 23 bp, Homo sapiens
tgagttcattgtagattctggat

SEQ ID NO: 171113 - DNA, 23 bp, Homo sapiens
tgagttcattgtagattctggat

SEQ ID NO: 171114 - DNA, 22 bp, Homo sapiens
agccagggttttctttttctct

SEQ ID NO: 171115 - DNA, 22 bp, Homo sapiens
ttgacagcattttggtgaggat

SEQ ID NO: 171116 - DNA, 22 bp, Homo sapiens
tctttgtcaggttttgttatca

SEQ ID NO: 171117 - DNA, 22 bp, Homo sapiens
tgagttacaaatacagtaagaa

SEQ ID NO: 171118 - DNA, 23 bp, Homo sapiens
tgagttgaggcagtcccctttgg

SEQ ID NO: 171119 - DNA, 18 bp, Homo sapiens
tatgtgtatgtatatatg

SEQ ID NO: 171120 - DNA, 23 bp, Homo sapiens
tctgaagtgagagagcagtcttg

SEQ ID NO: 171121 - DNA, 23 bp, Homo sapiens
tggagtctcactctgtcacccag

SEQ ID NO: 171122 - DNA, 22 bp, Homo sapiens
tgattgatcttaaccagattag

SEQ ID NO: 171123 - DNA, 22 bp, Homo sapiens
ctttgtccattaaatttgacgt

SEQ ID NO: 171124 - DNA, 23 bp, Homo sapiens
tgacagcagggtatgcagtttga

SEQ ID NO: 171125 - DNA, 23 bp, Homo sapiens
tgagacagggtctggctgtgttg

SEQ ID NO: 171126 - DNA, 18 bp, Homo sapiens
tgggattgctagatcata

SEQ ID NO: 171127 - DNA, 18 bp, Homo sapiens
tcatagtggttgaaccat

SEQ ID NO: 171128 - DNA, 20 bp, Homo sapiens
ttttggtttcatatgaactt

SEQ ID NO: 171129 - DNA, 23 bp, Homo sapiens
gttgtgacttatgtgattggtga

SEQ ID NO: 171130 - DNA, 21 bp, Homo sapiens
tttagttttttgaggaacttc

SEQ ID NO: 171131 - DNA, 22 bp, Homo sapiens
tctctcagtggctgtactaatt

SEQ ID NO: 171132 - DNA, 21 bp, Homo sapiens
aaagtggtatcacattgtggt

SEQ ID NO: 171133 - DNA, 21 bp, Homo sapiens
acactttttttttttttgaga

SEQ ID NO: 171134 - DNA, 22 bp, Homo sapiens
gagtcagtcttgctctgtcacc

SEQ ID NO: 171135 - DNA, 23 bp, Homo sapiens
aatacagtcagccttccgtatct

SEQ ID NO: 171136 - DNA, 19 bp, Homo sapiens
ctatgtggtatcagttcag

SEQ ID NO: 171137 - DNA, 18 bp, Homo sapiens
tacacacacatctttgta

SEQ ID NO: 171138 - DNA, 21 bp, Homo sapiens
tacagtgcagattaagttcaa

SEQ ID NO: 171139 - DNA, 22 bp, Homo sapiens
agtcagattgactctgtggtat

SEQ ID NO: 171140 - DNA, 23 bp, Homo sapiens
cacactcagataattcagctagt

SEQ ID NO: 171141 - DNA, 23 bp, Homo sapiens
caggcagtctgattctgtggtct

SEQ ID NO: 171142 - DNA, 18 bp, Homo sapiens
ctccaggacagttactga

SEQ ID NO: 171143 - DNA, 23 bp, Homo sapiens
tctctcacagagtatctacttgg

SEQ ID NO: 171144 - DNA, 23 bp, Homo sapiens
tggagtctcactctgtcacccag

SEQ ID NO: 171145 - DNA, 23 bp, Homo sapiens
acaacagattttgttaatgacac

SEQ ID NO: 171146 - DNA, 21 bp, Homo sapiens
aaacagagtttcgctttgttg

SEQ ID NO: 171147 - DNA, 20 bp, Homo sapiens
aggtacttattctctctaaa

SEQ ID NO: 171148 - DNA, 21 bp, Homo sapiens
ttttgaggatgatgttgacac

SEQ ID NO: 171149 - DNA, 20 bp, Homo sapiens
aggcactgtgctaagcactt

SEQ ID NO: 171150 - DNA, 21 bp, Homo sapiens
tatctgcatatatatgcatat

SEQ ID NO: 171151 - DNA, 23 bp, Homo sapiens
tgcatatatatccatatatatac

SEQ ID NO: 171152 - DNA, 21 bp, Homo sapiens
ttcatgtggttttggtatcaa

SEQ ID NO: 171153 - DNA, 23 bp, Homo sapiens
gagtctcactctgtcacccaggc

SEQ ID NO: 171154 - DNA, 18 bp, Homo sapiens
tatacacacacacatata

SEQ ID NO: 171155 - DNA, 21 bp, Homo sapiens
tatatgtatatgtatatatgt

SEQ ID NO: 171156 - DNA, 22 bp, Homo sapiens
attgattatatgttgaaatgct

SEQ ID NO: 171157 - DNA, 20 bp, Homo sapiens
agtactgtggtttttccttt

SEQ ID NO: 171158 - DNA, 23 bp, Homo sapiens
aaagtaaatgtaatgcaggtatg

SEQ ID NO: 171159 - DNA, 23 bp, Homo sapiens
tatgtgtgtatatatatatgtgt

SEQ ID NO: 171160 - DNA, 19 bp, Homo sapiens
cagtgcctgtgtcagcggc

SEQ ID NO: 171161 - DNA, 23 bp, Homo sapiens
tgagtcggtgtctcactctgttg

SEQ ID NO: 171162 - DNA, 23 bp, Homo sapiens
tgtgtgactgactagtttgctgt

SEQ ID NO: 171163 - DNA, 21 bp, Homo sapiens
ctcactgaatccttctctttt

SEQ ID NO: 171164 - DNA, 18 bp, Homo sapiens
ttactccctccttctgtt

SEQ ID NO: 171165 - DNA, 18 bp, Homo sapiens
cagtgagtacagattggg

SEQ ID NO: 171166 - DNA, 21 bp, Homo sapiens
tatgagtatatatatacgagt

SEQ ID NO: 171167 - DNA, 23 bp, Homo sapiens
tgtgagaacacagaatgcagagg

SEQ ID NO: 171168 - DNA, 23 bp, Homo sapiens
tgagttcattgtagattctggat

SEQ ID NO: 171169 - DNA, 23 bp, Homo sapiens
tatgtgtgtctctgtatgtgaga

SEQ ID NO: 171170 - DNA, 22 bp, Homo sapiens
ttccttgtagattctggatatt

SEQ ID NO: 171171 - DNA, 19 bp, Homo sapiens
cttttgaatagaatgtgta

SEQ ID NO: 171172 - DNA, 22 bp, Homo sapiens
atgtgtatatatatgtgtgtgt

SEQ ID NO: 171173 - DNA, 23 bp, Homo sapiens
tgagttcattgtagattctggat

SEQ ID NO: 171174 - DNA, 23 bp, Homo sapiens
tgagttcattgtagattctggat

SEQ ID NO: 171175 - DNA, 21 bp, Homo sapiens
tcagagaagagtgatagctct

SEQ ID NO: 171176 - DNA, 23 bp, Homo sapiens
tctatccatccctctctctgtcc

SEQ ID NO: 171177 - DNA, 23 bp, Homo sapiens
aagcttgagcagagtgtgaccac

SEQ ID NO: 171178 - DNA, 19 bp, Homo sapiens
aagaggcaggactccagca

SEQ ID NO: 171179 - DNA, 23 bp, Homo sapiens
acagccagtttttttaagtgaga

SEQ ID NO: 171180 - DNA, 23 bp, Homo sapiens
ttacaggtgcttgaaagttgttg

SEQ ID NO: 171181 - DNA, 23 bp, Homo sapiens
ttgagagtgaactttgagagctc

SEQ ID NO: 171182 - DNA, 21 bp, Homo sapiens
gaggctccctgtatgtcaata

SEQ ID NO: 171183 - DNA, 20 bp, Homo sapiens
atatgtgtatatgtatgtgt

SEQ ID NO: 171184 - DNA, 21 bp, Homo sapiens
atatgtgtgtatattatgtgt

SEQ ID NO: 171185 - DNA, 22 bp, Homo sapiens
atatagatatctatagatctat

SEQ ID NO: 171186 - DNA, 21 bp, Homo sapiens
ctctctgtctctctctctaca

SEQ ID NO: 171187 - DNA, 23 bp, Homo sapiens
ttgacactgacagatatctcagg

SEQ ID NO: 171188 - DNA, 23 bp, Homo sapiens
tgagacagagtctggctctgtcg

SEQ ID NO: 171189 - DNA, 19 bp, Homo sapiens
agctaaagtatccttaaga

SEQ ID NO: 171190 - DNA, 23 bp, Homo sapiens
ttttggtcttgaactcttggctt

SEQ ID NO: 171191 - DNA, 23 bp, Homo sapiens
tgtgtctgggagagtagtgtgga

SEQ ID NO: 171192 - DNA, 23 bp, Homo sapiens
ggggctgactgtgtggctgagcg

SEQ ID NO: 171193 - DNA, 23 bp, Homo sapiens
tttgtctggttttgatatcagag

SEQ ID NO: 171194 - DNA, 19 bp, Homo sapiens
tcccctcagtactaggaat

SEQ ID NO: 171195 - DNA, 23 bp, Homo sapiens
tgagttcattgtagattctggat

SEQ ID NO: 171196 - DNA, 23 bp, Homo sapiens
tgagttcattgtagattctggat

SEQ ID NO: 171197 - DNA, 23 bp, Homo sapiens
tatctgaatatatatatatctga

SEQ ID NO: 171198 - DNA, 23 bp, Homo sapiens
tctctctgagtctgtatcttcat

SEQ ID NO: 171199 - DNA, 21 bp, Homo sapiens
tctttgcatctaaagtgtgtt

SEQ ID NO: 171200 - DNA, 19 bp, Homo sapiens
atatagattaactacaggt

SEQ ID NO: 171201 - DNA, 19 bp, Homo sapiens
tgttctctggctcctcgag

SEQ ID NO: 171202 - DNA, 21 bp, Homo sapiens
acctggagctctggctgcagt

SEQ ID NO: 171203 - DNA, 19 bp, Homo sapiens
tgcaaatatcatggtgaag

SEQ ID NO: 171204 - DNA, 23 bp, Homo sapiens
tgagttcattgtagattctggat

SEQ ID NO: 171205 - DNA, 23 bp, Homo sapiens
tgagttcattgtagattctggat

SEQ ID NO: 171206 - DNA, 23 bp, Homo sapiens
tcaagcaagaacttgccattcag

SEQ ID NO: 171207 - DNA, 23 bp, Homo sapiens
tgagtgaatttgtaagtgtgtgc

SEQ ID NO: 171208 - DNA, 18 bp, Homo sapiens
gatagagcttgtgcagag

SEQ ID NO: 171209 - DNA, 23 bp, Homo sapiens
tctgtgtgagtcttcatgtcagt

SEQ ID NO: 171210 - DNA, 23 bp, Homo sapiens
aatcacactctacatgctgtctc

SEQ ID NO: 171211 - DNA, 23 bp, Homo sapiens
tgagttcattgtagattctggat

SEQ ID NO: 171212 - DNA, 23 bp, Homo sapiens
tgagttcattgtagattctggat

SEQ ID NO: 171213 - DNA, 23 bp, Homo sapiens
tttgagagggagttttgctctgt

SEQ ID NO: 171214 - DNA, 23 bp, Homo sapiens
tgagttcattgtagattctggat

SEQ ID NO: 171215 - DNA, 23 bp, Homo sapiens
tgagttcattgtagattctggat

SEQ ID NO: 171216 - DNA, 23 bp, Homo sapiens
ggcactctctctcggtctctctc

SEQ ID NO: 171217 - DNA, 23 bp, Homo sapiens
tgtgtatatatatgtatatgtgt

SEQ ID NO: 171218 - DNA, 23 bp, Homo sapiens
agtggttgttagtagtagtgtaa

SEQ ID NO: 171219 - DNA, 23 bp, Homo sapiens
tattctcagcctgataaatcagt

SEQ ID NO: 171220 - DNA, 22 bp, Homo sapiens
tttactctatttgtttatatca

SEQ ID NO: 171221 - DNA, 21 bp, Homo sapiens
acatgtgcacaatgtgcaggt

SEQ ID NO: 171222 - DNA, 19 bp, Homo sapiens
tatgtatataatattatgt

SEQ ID NO: 171223 - DNA, 18 bp, Homo sapiens
tatgtatataatattatg

SEQ ID NO: 171224 - DNA, 23 bp, Homo sapiens
ttttttggttccatatgaaattt

SEQ ID NO: 171225 - DNA, 23 bp, Homo sapiens
catatgtgtgtatatatatgtgt

SEQ ID NO: 171226 - DNA, 23 bp, Homo sapiens
tgagttcattgtagattctggat

SEQ ID NO: 171227 - DNA, 23 bp, Homo sapiens
tgagttcattgtagattctggat

SEQ ID NO: 171228 - DNA, 21 bp, Homo sapiens
tgaggtaggaggatcacttga

SEQ ID NO: 171229 - DNA, 22 bp, Homo sapiens
tactgtatttttctatttgatg

SEQ ID NO: 171230 - DNA, 23 bp, Homo sapiens
tcaattagctagaaaaagcatga

SEQ ID NO: 171231 - DNA, 23 bp, Homo sapiens
gagacagagtctcgctctgtcac

SEQ ID NO: 171232 - DNA, 18 bp, Homo sapiens
tggcttgtattgccattg

SEQ ID NO: 171233 - DNA, 19 bp, Homo sapiens
tgcctggctctttgggccc

SEQ ID NO: 171234 - DNA, 23 bp, Homo sapiens
acctcctacactctatgtgtata

SEQ ID NO: 171235 - DNA, 23 bp, Homo sapiens
tgaatcataccatttgatgtgat

SEQ ID NO: 171236 - DNA, 23 bp, Homo sapiens
agtctgggaaaagtgtgtcctta

SEQ ID NO: 171237 - DNA, 23 bp, Homo sapiens
agactgactcagtgactgcttcc

SEQ ID NO: 171238 - DNA, 22 bp, Homo sapiens
tatgtgtgtatatatatgtatg

SEQ ID NO: 171239 - DNA, 23 bp, Homo sapiens
tgagttcattgtagattctggat

SEQ ID NO: 171240 - DNA, 23 bp, Homo sapiens
tgagttcattgtagattctggat

SEQ ID NO: 171241 - DNA, 22 bp, Homo sapiens
gaggcatgtattgaagtttgta

SEQ ID NO: 171242 - DNA, 23 bp, Homo sapiens
atgaatgagcactgattttgttg

SEQ ID NO: 171243 - DNA, 21 bp, Homo sapiens
tcttgtcagaaccttgttgag

SEQ ID NO: 171244 - DNA, 23 bp, Homo sapiens
acagagtctcgcactgtcaccca

SEQ ID NO: 171245 - DNA, 23 bp, Homo sapiens
tacatatgtatacatgtatatac

SEQ ID NO: 171246 - DNA, 23 bp, Homo sapiens
attggatatgtgactctggatgt

SEQ ID NO: 171247 - DNA, 23 bp, Homo sapiens
tgagttcattgtagattctggat

SEQ ID NO: 171248 - DNA, 23 bp, Homo sapiens
tgagttcattgtagattctggat

SEQ ID NO: 171249 - DNA, 18 bp, Homo sapiens
atgtatatatatacgtat

SEQ ID NO: 171250 - DNA, 21 bp, Homo sapiens
aactttactgaatttgttgat

SEQ ID NO: 171251 - DNA, 21 bp, Homo sapiens
gttgtaggagctaaaattttt

SEQ ID NO: 171252 - DNA, 23 bp, Homo sapiens
gactgtctctgtctgacctcttg

SEQ ID NO: 171253 - DNA, 22 bp, Homo sapiens
cactcttactgtgtggttatct

SEQ ID NO: 171254 - DNA, 23 bp, Homo sapiens
tgtgggtcagaaatctggatgtg

SEQ ID NO: 171255 - DNA, 23 bp, Homo sapiens
tctggctcagagtctctcacaga

SEQ ID NO: 171256 - DNA, 23 bp, Homo sapiens
acagtgcatgtgcaagtgcatgc

SEQ ID NO: 171257 - DNA, 23 bp, Homo sapiens
tgagttcattgtagattctggat

SEQ ID NO: 171258 - DNA, 23 bp, Homo sapiens
tgagttcattgtagattctggat

SEQ ID NO: 171259 - DNA, 23 bp, Homo sapiens
tgagttcattgtagattctggat

SEQ ID NO: 171260 - DNA, 23 bp, Homo sapiens
tgagttcattgtagattctggat

SEQ ID NO: 171261 - DNA, 23 bp, Homo sapiens
cagtcagagtcactgcctctgtc

SEQ ID NO: 171262 - DNA, 23 bp, Homo sapiens
gacagagtctcgctctgtcaccc

SEQ ID NO: 171263 - DNA, 22 bp, Homo sapiens
tacagtggcacgattttggctc

SEQ ID NO: 171264 - DNA, 23 bp, Homo sapiens
taggtgcatgttctccagatgtg

SEQ ID NO: 171265 - DNA, 23 bp, Homo sapiens
tatatgtacatatgtttatatgt

SEQ ID NO: 171266 - DNA, 21 bp, Homo sapiens
tatatgtacatataggtacat

SEQ ID NO: 171267 - DNA, 23 bp, Homo sapiens
gtgactgagactgctttctttct

SEQ ID NO: 171268 - DNA, 22 bp, Homo sapiens
ttaactggatatctatatagaa

SEQ ID NO: 171269 - DNA, 20 bp, Homo sapiens
aaatgaactatctcaaacca

SEQ ID NO: 171270 - DNA, 20 bp, Homo sapiens
cgagcatctacacatagcca

SEQ ID NO: 171271 - DNA, 19 bp, Homo sapiens
tatcacatagcaatccaag

SEQ ID NO: 171272 - DNA, 23 bp, Homo sapiens
tgagacagtctcactctgtcacc

SEQ ID NO: 171273 - DNA, 23 bp, Homo sapiens
ttgtgtgtgcgtgagtgtgtgcg

SEQ ID NO: 171274 - DNA, 23 bp, Homo sapiens
taagtagtgtagtagctttctga

SEQ ID NO: 171275 - DNA, 23 bp, Homo sapiens
tttgtgcatctattttgttttat

SEQ ID NO: 171276 - DNA, 21 bp, Homo sapiens
tacaatgtgatgtttcgatgt

SEQ ID NO: 171277 - DNA, 21 bp, Homo sapiens
acacctgtagttccagctaca

SEQ ID NO: 171278 - DNA, 18 bp, Homo sapiens
gagtctggctctgtcacc

SEQ ID NO: 171279 - DNA, 22 bp, Homo sapiens
tctcactctgtcacccaggctg

SEQ ID NO: 171280 - DNA, 23 bp, Homo sapiens
tgtgtgtgtgtgtgtgtatctag

SEQ ID NO: 171281 - DNA, 23 bp, Homo sapiens
cttgtgcatttgtatgaatattt

SEQ ID NO: 171282 - DNA, 23 bp, Homo sapiens
aagtcatattgcttggttaagta

SEQ ID NO: 171283 - DNA, 23 bp, Homo sapiens
agagtctcactctgtcacccagg

SEQ ID NO: 171284 - DNA, 23 bp, Homo sapiens
gagtctcactctgtcacccaggc

SEQ ID NO: 171285 - DNA, 23 bp, Homo sapiens
agagttgtttaccacctgtagaa

SEQ ID NO: 171286 - DNA, 23 bp, Homo sapiens
agtgtttcttacaaattggatgt

SEQ ID NO: 171287 - DNA, 21 bp, Homo sapiens
tgtgtactgtgtagattggat

SEQ ID NO: 171288 - DNA, 21 bp, Homo sapiens
agaggttgcagtgagctgaga

SEQ ID NO: 171289 - DNA, 23 bp, Homo sapiens
tctgagtatttccttgtctagca

SEQ ID NO: 171290 - DNA, 23 bp, Homo sapiens
ttttttggttccatatgaaattt

SEQ ID NO: 171291 - DNA, 23 bp, Homo sapiens
ttctgtgatgaaagtcagtggta

SEQ ID NO: 171292 - DNA, 19 bp, Homo sapiens
ttcactcatgatttggctc

SEQ ID NO: 171293 - DNA, 23 bp, Homo sapiens
tctgcatatgtgtgtatatgtgt

SEQ ID NO: 171294 - DNA, 23 bp, Homo sapiens
tgagttcattgtagattctggat

SEQ ID NO: 171295 - DNA, 23 bp, Homo sapiens
tgagttcattgtagattctggat

SEQ ID NO: 171296 - DNA, 18 bp, Homo sapiens
actggttgaactttgaat

SEQ ID NO: 171297 - DNA, 19 bp, Homo sapiens
gtcagtgagctttgctttt

SEQ ID NO: 171298 - DNA, 23 bp, Homo sapiens
cattgagtatgatgttagctgta

SEQ ID NO: 171299 - DNA, 23 bp, Homo sapiens
atgcttcttgttcaagttgaaag

SEQ ID NO: 171300 - DNA, 23 bp, Homo sapiens
cactcacctaaggaaaagtgtgt

SEQ ID NO: 171301 - DNA, 23 bp, Homo sapiens
tactgagtgcatggagattctgt

SEQ ID NO: 171302 - DNA, 21 bp, Homo sapiens
tctgaacatatgttactgtgc

SEQ ID NO: 171303 - DNA, 23 bp, Homo sapiens
tgagttcattgtagattctggat

SEQ ID NO: 171304 - DNA, 23 bp, Homo sapiens
tgagttcattgtagattctggat

SEQ ID NO: 171305 - DNA, 23 bp, Homo sapiens
tatccatttcttctagattttcc

SEQ ID NO: 171306 - DNA, 21 bp, Homo sapiens
ttttatgaagaaagtcaatgg

SEQ ID NO: 171307 - DNA, 23 bp, Homo sapiens
actggaacaggtgctgttatcca

SEQ ID NO: 171308 - DNA, 22 bp, Homo sapiens
tggaaatgaaataagtttgttg

SEQ ID NO: 171309 - DNA, 23 bp, Homo sapiens
acagacagaagagtgtgtggaga

SEQ ID NO: 171310 - DNA, 22 bp, Homo sapiens
taagaacttgctttatgaatct

SEQ ID NO: 171311 - DNA, 21 bp, Homo sapiens
aatgtggtcagggacctggtt

SEQ ID NO: 171312 - DNA, 22 bp, Homo sapiens
aacctgtctttagtcattctct

SEQ ID NO: 171313 - DNA, 19 bp, Homo sapiens
actatgaagctagactttc

SEQ ID NO: 171314 - DNA, 22 bp, Homo sapiens
tatgtgtatatatatatgtatg

SEQ ID NO: 171315 - DNA, 23 bp, Homo sapiens
aattgctccatatcctttccagc

SEQ ID NO: 171316 - DNA, 23 bp, Homo sapiens
tgagttcattgtagattctggat

SEQ ID NO: 171317 - DNA, 23 bp, Homo sapiens
tgagttcattgtagattctggat

SEQ ID NO: 171318 - DNA, 21 bp, Homo sapiens
ttatctcaaggttctggagta

SEQ ID NO: 171319 - DNA, 23 bp, Homo sapiens
gattttgaggttgttggatgaat

SEQ ID NO: 171320 - DNA, 20 bp, Homo sapiens
tgtacttttctttgaatcag

SEQ ID NO: 171321 - DNA, 23 bp, Homo sapiens
gtggtcaacagtgtggttggtat

SEQ ID NO: 171322 - DNA, 19 bp, Homo sapiens
tgtgtggttgatcatagag

SEQ ID NO: 171323 - DNA, 22 bp, Homo sapiens
gggtctctgtttcccacttcag

SEQ ID NO: 171324 - DNA, 23 bp, Homo sapiens
tgtccaattgtatggtcaatttt

SEQ ID NO: 171325 - DNA, 23 bp, Homo sapiens
agtattctgtaaatgtctattag

SEQ ID NO: 171326 - DNA, 21 bp, Homo sapiens
aacaacagaatatggtttctt

SEQ ID NO: 171327 - DNA, 22 bp, Homo sapiens
ttggaagtaaacaagattggag

SEQ ID NO: 171328 - DNA, 18 bp, Homo sapiens
ttgccaggcacagtggct

SEQ ID NO: 171329 - DNA, 23 bp, Homo sapiens
tgcctgaaatctcagcactttgg

SEQ ID NO: 171330 - DNA, 23 bp, Homo sapiens
agagtctcactctgtcacccagg

SEQ ID NO: 171331 - DNA, 23 bp, Homo sapiens
gcagagtcacgctctgtcaccca

SEQ ID NO: 171332 - DNA, 18 bp, Homo sapiens
tttagcaagtctattatt

SEQ ID NO: 171333 - DNA, 23 bp, Homo sapiens
gacggagactcgctgtctcccag

SEQ ID NO: 171334 - DNA, 23 bp, Homo sapiens
atgtcactggtggttctgtgagt

SEQ ID NO: 171335 - DNA, 23 bp, Homo sapiens
ataaaggtggaatacaattaaca

SEQ ID NO: 171336 - DNA, 21 bp, Homo sapiens
tgtgtatatatatgtgtgtgt

SEQ ID NO: 171337 - DNA, 23 bp, Homo sapiens
atatatgtgtatgtatatggatg

SEQ ID NO: 171338 - DNA, 23 bp, Homo sapiens
gggtctcactctgtcacccaggc

SEQ ID NO: 171339 - DNA, 21 bp, Homo sapiens
ttctctctctgtgtctcttga

SEQ ID NO: 171340 - DNA, 22 bp, Homo sapiens
agagagagagacagatatgagt

SEQ ID NO: 171341 - DNA, 23 bp, Homo sapiens
attctccttaatttcctatgtgt

SEQ ID NO: 171342 - DNA, 19 bp, Homo sapiens
agtatacttcgaagcacaa

SEQ ID NO: 171343 - DNA, 23 bp, Homo sapiens
ttgttgtctgtgcttttgatagt

SEQ ID NO: 171344 - DNA, 23 bp, Homo sapiens
tgtgtgtgcatgtatatgtttat

SEQ ID NO: 171345 - DNA, 23 bp, Homo sapiens
atatatgtgtatgcatatgtata

SEQ ID NO: 171346 - DNA, 22 bp, Homo sapiens
aatggcagtgcattaggtttgt

SEQ ID NO: 171347 - DNA, 23 bp, Homo sapiens
tcactgtctcagttataattttg

SEQ ID NO: 171348 - DNA, 23 bp, Homo sapiens
gagacatgagtgggagctgtgat

SEQ ID NO: 171349 - DNA, 23 bp, Homo sapiens
ttaggcaacggtttcttttcttt

SEQ ID NO: 171350 - DNA, 22 bp, Homo sapiens
tttattgaatttgtttatcagt

SEQ ID NO: 171351 - DNA, 23 bp, Homo sapiens
tgagttcattgtagattctggat

SEQ ID NO: 171352 - DNA, 23 bp, Homo sapiens
tgagttcattgtagattctggat

SEQ ID NO: 171353 - DNA, 18 bp, Homo sapiens
ttctgaatcaggttttgt

SEQ ID NO: 171354 - DNA, 22 bp, Homo sapiens
ataatgcatgactaagtattac

SEQ ID NO: 171355 - DNA, 23 bp, Homo sapiens
tgactcagttttgctttgtgaaa

SEQ ID NO: 171356 - DNA, 23 bp, Homo sapiens
tatcccatgcttttcagatgtgt

SEQ ID NO: 171357 - DNA, 21 bp, Homo sapiens
aaatggcatttttaatagtgt

SEQ ID NO: 171358 - DNA, 19 bp, Homo sapiens
ttgttttattaaaagtgtt

SEQ ID NO: 171359 - DNA, 23 bp, Homo sapiens
attactgagtgcttgtgatatga

SEQ ID NO: 171360 - DNA, 23 bp, Homo sapiens
tctggcttgtagagtttctggtg

SEQ ID NO: 171361 - DNA, 22 bp, Homo sapiens
tggtaagtaatgatgttagaaa

SEQ ID NO: 171362 - DNA, 18 bp, Homo sapiens
tgctattttgatacatgt

SEQ ID NO: 171363 - DNA, 23 bp, Homo sapiens
tgtgtgtgtatactgtgtgtgtg

SEQ ID NO: 171364 - DNA, 23 bp, Homo sapiens
atatatacgtactgtgtgtgtgt

SEQ ID NO: 171365 - DNA, 22 bp, Homo sapiens
atactgtgtgtgtatatacagt

SEQ ID NO: 171366 - DNA, 21 bp, Homo sapiens
tatgtccttaaaggactggaa

SEQ ID NO: 171367 - DNA, 21 bp, Homo sapiens
atatacacacatatatacaca

SEQ ID NO: 171368 - DNA, 20 bp, Homo sapiens
tatatgtaatatagataaca

SEQ ID NO: 171369 - DNA, 20 bp, Homo sapiens
tatatgtaatatagataaca

SEQ ID NO: 171370 - DNA, 22 bp, Homo sapiens
atatatctatatgtaatataga

SEQ ID NO: 171371 - DNA, 20 bp, Homo sapiens
atatgtaatatagataacag

SEQ ID NO: 171372 - DNA, 21 bp, Homo sapiens
tatatataatatagataacag

SEQ ID NO: 171373 - DNA, 23 bp, Homo sapiens
agctgtgagaagagagccaccag

SEQ ID NO: 171374 - DNA, 21 bp, Homo sapiens
catgaatttgaaatgagtggg

SEQ ID NO: 171375 - DNA, 21 bp, Homo sapiens
ccctctgtgttagcaggttct

SEQ ID NO: 171376 - DNA, 23 bp, Homo sapiens
tgagacggagtctcactctgtcg

SEQ ID NO: 171377 - DNA, 23 bp, Homo sapiens
tgagttcattgtagattctggat

SEQ ID NO: 171378 - DNA, 23 bp, Homo sapiens
tgagttcattgtagattctggat

SEQ ID NO: 171379 - DNA, 22 bp, Homo sapiens
atatgtgtatatatatgtgtgt

SEQ ID NO: 171380 - DNA, 21 bp, Homo sapiens
actctcatttactctctccta

SEQ ID NO: 171381 - DNA, 23 bp, Homo sapiens
atgtgtgtgtctatgtatatgtg

SEQ ID NO: 171382 - DNA, 19 bp, Homo sapiens
tgcttttagacaagtgaat

SEQ ID NO: 171383 - DNA, 23 bp, Homo sapiens
tgagttcattgtagattctggat

SEQ ID NO: 171384 - DNA, 23 bp, Homo sapiens
tgagttcattgtagattctggat

SEQ ID NO: 171385 - DNA, 21 bp, Homo sapiens
atagatcaagttctttttttt

SEQ ID NO: 171386 - DNA, 23 bp, Homo sapiens
tgcaaaggtgtgatcttggctca

SEQ ID NO: 171387 - DNA, 23 bp, Homo sapiens
ttacagcttctaattttgtcttt

SEQ ID NO: 171388 - DNA, 23 bp, Homo sapiens
tattattcattccacaatgtgta

SEQ ID NO: 171389 - DNA, 23 bp, Homo sapiens
tctctgagtggtcaaaaactgtg

SEQ ID NO: 171390 - DNA, 23 bp, Homo sapiens
tgagttcattgtagattctggat

SEQ ID NO: 171391 - DNA, 23 bp, Homo sapiens
tgagttcattgtagattctggat

SEQ ID NO: 171392 - DNA, 23 bp, Homo sapiens
ttcagtgctttgatctctgaatc

SEQ ID NO: 171393 - DNA, 21 bp, Homo sapiens
tgtagagaagtctgagaggtg

SEQ ID NO: 171394 - DNA, 18 bp, Homo sapiens
agagtctcgctccatcac

SEQ ID NO: 171395 - DNA, 23 bp, Homo sapiens
tcttttttggttccatatgaaat

SEQ ID NO: 171396 - DNA, 23 bp, Homo sapiens
ttctatgaagaaagtcaatggta

SEQ ID NO: 171397 - DNA, 23 bp, Homo sapiens
tgtaataacttatctaatcctta

SEQ ID NO: 171398 - DNA, 22 bp, Homo sapiens
aataaggaagataaggcagaga

SEQ ID NO: 171399 - DNA, 23 bp, Homo sapiens
tgagttcattgtagattctggat

SEQ ID NO: 171400 - DNA, 23 bp, Homo sapiens
tgagttcattgtagattctggat

SEQ ID NO: 171401 - DNA, 20 bp, Homo sapiens
tatctcagtggatgatgcca

SEQ ID NO: 171402 - DNA, 23 bp, Homo sapiens
tatgttgattttgtatcctgaaa

SEQ ID NO: 171403 - DNA, 18 bp, Homo sapiens
tctggacatgcagggttt

SEQ ID NO: 171404 - DNA, 23 bp, Homo sapiens
taagtgtatatatatgtatgtgt

SEQ ID NO: 171405 - DNA, 19 bp, Homo sapiens
catgtgcatatacatatat

SEQ ID NO: 171406 - DNA, 23 bp, Homo sapiens
acatgtgcatatgtatatatgta

SEQ ID NO: 171407 - DNA, 23 bp, Homo sapiens
gagttacatgactttgagttatc

SEQ ID NO: 171408 - DNA, 23 bp, Homo sapiens
tttaatataaggtagtttgtgtg

SEQ ID NO: 171409 - DNA, 23 bp, Homo sapiens
atgtgtggaagtatatacagata

SEQ ID NO: 171410 - DNA, 23 bp, Homo sapiens
acaattatatttgagaaatagtt

SEQ ID NO: 171411 - DNA, 23 bp, Homo sapiens
tgagtctcactctgtcacccagg

SEQ ID NO: 171412 - DNA, 18 bp, Homo sapiens
acgatgagctgtgattgt

SEQ ID NO: 171413 - DNA, 23 bp, Homo sapiens
atttcactgtgttggcttccaga

SEQ ID NO: 171414 - DNA, 23 bp, Homo sapiens
tccatttgttctagactatggtt

SEQ ID NO: 171415 - DNA, 20 bp, Homo sapiens
gtctagtgccggcagtggag

SEQ ID NO: 171416 - DNA, 23 bp, Homo sapiens
attgaaggtagtttaatgagtta

SEQ ID NO: 171417 - DNA, 20 bp, Homo sapiens
tcagcagtgagagacctcac

SEQ ID NO: 171418 - DNA, 21 bp, Homo sapiens
gttgaggtcagtctcacttct

SEQ ID NO: 171419 - DNA, 22 bp, Homo sapiens
tgtttagagtttagactgtagg

SEQ ID NO: 171420 - DNA, 23 bp, Homo sapiens
tgagttcattgtagattctggat

SEQ ID NO: 171421 - DNA, 23 bp, Homo sapiens
tgagttcattgtagattctggat

SEQ ID NO: 171422 - DNA, 23 bp, Homo sapiens
catctgtcactgtcagggtttgg

SEQ ID NO: 171423 - DNA, 23 bp, Homo sapiens
cctccctgtctgccagcctctct

SEQ ID NO: 171424 - DNA, 23 bp, Homo sapiens
tgctgtgcaggagctctttagtg

SEQ ID NO: 171425 - DNA, 23 bp, Homo sapiens
tgagttcattgtagattctggat

SEQ ID NO: 171426 - DNA, 23 bp, Homo sapiens
tgagttcattgtagattctggat

SEQ ID NO: 171427 - DNA, 22 bp, Homo sapiens
ctgacagaagcctctgagcaga

SEQ ID NO: 171428 - DNA, 23 bp, Homo sapiens
atgcgtatgtgtgtgtatatgta

SEQ ID NO: 171429 - DNA, 22 bp, Homo sapiens
atacaattgaatacgtagaggt

SEQ ID NO: 171430 - DNA, 23 bp, Homo sapiens
atctgtgtgtcagtgtatgtttt

SEQ ID NO: 171431 - DNA, 21 bp, Homo sapiens
taatgagcaactagattgatt

SEQ ID NO: 171432 - DNA, 18 bp, Homo sapiens
gtgtgtttttcttcactg

SEQ ID NO: 171433 - DNA, 23 bp, Homo sapiens
tgttactgcaaaggccatgattt

SEQ ID NO: 171434 - DNA, 20 bp, Homo sapiens
ctcatgacagttacagtcct

SEQ ID NO: 171435 - DNA, 23 bp, Homo sapiens
tgtggttgtagctggaattgatg

SEQ ID NO: 171436 - DNA, 21 bp, Homo sapiens
ttgcagtccttccaggtatga

SEQ ID NO: 171437 - DNA, 23 bp, Homo sapiens
atttatgtgaatggaaatgattg

SEQ ID NO: 171438 - DNA, 23 bp, Homo sapiens
tatacatatatatacgtatgtat

SEQ ID NO: 171439 - DNA, 23 bp, Homo sapiens
aatatcagtgtttaagttaacat

SEQ ID NO: 171440 - DNA, 23 bp, Homo sapiens
tagatgtatgtatttatgtatgg

SEQ ID NO: 171441 - DNA, 23 bp, Homo sapiens
tcactcactcactcactcactca

SEQ ID NO: 171442 - DNA, 23 bp, Homo sapiens
tctccctctctctctgtctcact

SEQ ID NO: 171443 - DNA, 23 bp, Homo sapiens
ggtggtaggttgattacattgga

SEQ ID NO: 171444 - DNA, 23 bp, Homo sapiens
tattcagtatatatatgtgtgtg

SEQ ID NO: 171445 - DNA, 23 bp, Homo sapiens
atgtgtatatatgtatatatgtg

SEQ ID NO: 171446 - DNA, 23 bp, Homo sapiens
tatgtgtgtatatatatgtgtgt

SEQ ID NO: 171447 - DNA, 20 bp, Homo sapiens
tgtatatatatactatatgt

SEQ ID NO: 171448 - DNA, 23 bp, Homo sapiens
aggtctcactctgtcactcgagc

SEQ ID NO: 171449 - DNA, 23 bp, Homo sapiens
aagttgtatagacagaattgtat

SEQ ID NO: 171450 - DNA, 23 bp, Homo sapiens
agagtctcactctgtcacccagg

SEQ ID NO: 171451 - DNA, 21 bp, Homo sapiens
atatgtatatatatggtgtat

SEQ ID NO: 171452 - DNA, 21 bp, Homo sapiens
tataggtatatatttatatgt

SEQ ID NO: 171453 - DNA, 23 bp, Homo sapiens
atatccatatgtatatatgtatg

SEQ ID NO: 171454 - DNA, 23 bp, Homo sapiens
atatgtgtatatatataggtgtg

SEQ ID NO: 171455 - DNA, 23 bp, Homo sapiens
tgagatcaaggtgttagcaagtt

SEQ ID NO: 171456 - DNA, 21 bp, Homo sapiens
caggggctctcaggccttcgg

SEQ ID NO: 171457 - DNA, 21 bp, Homo sapiens
agtttttgcccattcagtatg

SEQ ID NO: 171458 - DNA, 18 bp, Homo sapiens
attcgtatatattcatat

SEQ ID NO: 171459 - DNA, 23 bp, Homo sapiens
tgaggcttttaatttttttgttg

SEQ ID NO: 171460 - DNA, 23 bp, Homo sapiens
tgagttcattgtagattctggat

SEQ ID NO: 171461 - DNA, 23 bp, Homo sapiens
tgagttcattgtagattctggat

SEQ ID NO: 171462 - DNA, 18 bp, Homo sapiens
gcaaaacaagagttaact

SEQ ID NO: 171463 - DNA, 23 bp, Homo sapiens
gctgatccttgttttgtttttca

SEQ ID NO: 171464 - DNA, 21 bp, Homo sapiens
tcatgtggtttaacttaatat

SEQ ID NO: 171465 - DNA, 18 bp, Homo sapiens
tatactttaagttctggg

SEQ ID NO: 171466 - DNA, 22 bp, Homo sapiens
acatgtgcagaatgtgcaggtt

SEQ ID NO: 171467 - DNA, 23 bp, Homo sapiens
ctggatgtgcatctcatttggtt

SEQ ID NO: 171468 - DNA, 23 bp, Homo sapiens
tgtatgtgagtatgtgtgttatc

SEQ ID NO: 171469 - DNA, 22 bp, Homo sapiens
gtgaaagagaagagtttctctt

SEQ ID NO: 171470 - DNA, 18 bp, Homo sapiens
aaaccatcagatcttgtg

SEQ ID NO: 171471 - DNA, 23 bp, Homo sapiens
tgtatatatatgtatatatgtgt

SEQ ID NO: 171472 - DNA, 23 bp, Homo sapiens
atgtgtgtgtatatatatatgtg

SEQ ID NO: 171473 - DNA, 21 bp, Homo sapiens
tgttttctctgcaaatgttat

SEQ ID NO: 171474 - DNA, 23 bp, Homo sapiens
ttaattggtgaagttaacattta

SEQ ID NO: 171475 - DNA, 20 bp, Homo sapiens
tatacaccatggaatactgt

SEQ ID NO: 171476 - DNA, 23 bp, Homo sapiens
atgtgtgtatatatatgtgtgtg

SEQ ID NO: 171477 - DNA, 21 bp, Homo sapiens
aagattctgaatttcttctgt

SEQ ID NO: 171478 - DNA, 23 bp, Homo sapiens
ctctgtcactctgagattgttca

SEQ ID NO: 171479 - DNA, 23 bp, Homo sapiens
cattttgaatgtgaaaaagaagg

SEQ ID NO: 171480 - DNA, 21 bp, Homo sapiens
tggagtctcactgtcgctcag

SEQ ID NO: 171481 - DNA, 23 bp, Homo sapiens
tatgttgaatagggatggtgagt

SEQ ID NO: 171482 - DNA, 23 bp, Homo sapiens
tttgtccattcaatatgatgttg

SEQ ID NO: 171483 - DNA, 23 bp, Homo sapiens
tatgtgcatataaatacatgtgt

SEQ ID NO: 171484 - DNA, 23 bp, Homo sapiens
tgagttcattgtagattctggat

SEQ ID NO: 171485 - DNA, 23 bp, Homo sapiens
tgagttcattgtagattctggat

SEQ ID NO: 171486 - DNA, 23 bp, Homo sapiens
gcattgtggttttgatttgcatt

SEQ ID NO: 171487 - DNA, 22 bp, Homo sapiens
agagcatgttggttattttgtt

SEQ ID NO: 171488 - DNA, 21 bp, Homo sapiens
tattgtgtgggagtctaagtc

SEQ ID NO: 171489 - DNA, 23 bp, Homo sapiens
tgtggttgtagctggtattgatg

SEQ ID NO: 171490 - DNA, 23 bp, Homo sapiens
tgagttcattgtagattctggat

SEQ ID NO: 171491 - DNA, 23 bp, Homo sapiens
tgagttcattgtagattctggat

SEQ ID NO: 171492 - DNA, 23 bp, Homo sapiens
tcgctcactcattgtagatggtg

SEQ ID NO: 171493 - DNA, 20 bp, Homo sapiens
atacgtatatatatatgtgt

SEQ ID NO: 171494 - DNA, 19 bp, Homo sapiens
agacaatttattttgttct

SEQ ID NO: 171495 - DNA, 19 bp, Homo sapiens
attccagtacaattgaatc

SEQ ID NO: 171496 - DNA, 23 bp, Homo sapiens
ttttagatggagtcttactctgt

SEQ ID NO: 171497 - DNA, 23 bp, Homo sapiens
tgagttcattgtagattctggat

SEQ ID NO: 171498 - DNA, 23 bp, Homo sapiens
tgagttcattgtagattctggat

SEQ ID NO: 171499 - DNA, 23 bp, Homo sapiens
taatatctaaatgaatatctgac

SEQ ID NO: 171500 - DNA, 23 bp, Homo sapiens
tctgcaaagtactggcagaggtc

SEQ ID NO: 171501 - DNA, 22 bp, Homo sapiens
acatgatgaaactccatctcta

SEQ ID NO: 171502 - DNA, 23 bp, Homo sapiens
acaaaggctcactgtgtctccta

SEQ ID NO: 171503 - DNA, 21 bp, Homo sapiens
ttcacactctgtctttgtgat

SEQ ID NO: 171504 - DNA, 19 bp, Homo sapiens
tgcattgaacatgggagtg

SEQ ID NO: 171505 - DNA, 21 bp, Homo sapiens
taatttttttgtggaacctcc

SEQ ID NO: 171506 - DNA, 21 bp, Homo sapiens
ggggcagtagatctattgtgt

SEQ ID NO: 171507 - DNA, 19 bp, Homo sapiens
tagtatttcatggtgtata

SEQ ID NO: 171508 - DNA, 23 bp, Homo sapiens
ttttttacatttcaggctcattt

SEQ ID NO: 171509 - DNA, 21 bp, Homo sapiens
acatgtgcacaatgtggaggt

SEQ ID NO: 171510 - DNA, 21 bp, Homo sapiens
acaagttcttactctgtcacc

SEQ ID NO: 171511 - DNA, 23 bp, Homo sapiens
attggcagaggttttgataagcg

SEQ ID NO: 171512 - DNA, 23 bp, Homo sapiens
tctgtctgcctgcctgactgcct

SEQ ID NO: 171513 - DNA, 23 bp, Homo sapiens
ttttatatagaatatgtagatat

SEQ ID NO: 171514 - DNA, 23 bp, Homo sapiens
ttttcatatgttatctacatctc

SEQ ID NO: 171515 - DNA, 23 bp, Homo sapiens
agactgagtctcattctgtcacc

SEQ ID NO: 171516 - DNA, 21 bp, Homo sapiens
atgtacaagacttgccaacat

SEQ ID NO: 171517 - DNA, 20 bp, Homo sapiens
cacaagactatcacttagaa

SEQ ID NO: 171518 - DNA, 22 bp, Homo sapiens
aagccctacttcaaaatagaga

SEQ ID NO: 171519 - DNA, 23 bp, Homo sapiens
ggagtctcactctgtcacccagg

SEQ ID NO: 171520 - DNA, 23 bp, Homo sapiens
tgtgtgtatatatatatgtgtgt

SEQ ID NO: 171521 - DNA, 23 bp, Homo sapiens
tgtgtatatatgtgtgtgtgtgt

SEQ ID NO: 171522 - DNA, 23 bp, Homo sapiens
ttttttggttccatatgaaattt

SEQ ID NO: 171523 - DNA, 23 bp, Homo sapiens
atagtccttgcatgatttcctca

SEQ ID NO: 171524 - DNA, 23 bp, Homo sapiens
tttagtggagactatgttgaagt

SEQ ID NO: 171525 - DNA, 23 bp, Homo sapiens
tatatatatatgtgtgtgtgtgt

SEQ ID NO: 171526 - DNA, 23 bp, Homo sapiens
attttcgctggatatgctatgct

SEQ ID NO: 171527 - DNA, 23 bp, Homo sapiens
tgagttcattgtagattctggat

SEQ ID NO: 171528 - DNA, 23 bp, Homo sapiens
tgagttcattgtagattctggat

SEQ ID NO: 171529 - DNA, 20 bp, Homo sapiens
atatgcttatgtatgtgtgt

SEQ ID NO: 171530 - DNA, 20 bp, Homo sapiens
cagtactaggttgaatagaa

SEQ ID NO: 171531 - DNA, 20 bp, Homo sapiens
ttaacttgttttttacattt

SEQ ID NO: 171532 - DNA, 23 bp, Homo sapiens
attccaaggatctgaaagggatt

SEQ ID NO: 171533 - DNA, 22 bp, Homo sapiens
tcagttcagttttccttgatga

SEQ ID NO: 171534 - DNA, 20 bp, Homo sapiens
tatcctatatatctatatct

SEQ ID NO: 171535 - DNA, 23 bp, Homo sapiens
tgattggagtgaggtgatgtctc

SEQ ID NO: 171536 - DNA, 18 bp, Homo sapiens
tgcattttttttttttga

SEQ ID NO: 171537 - DNA, 23 bp, Homo sapiens
tctttgcttgggactgtcttggc

SEQ ID NO: 171538 - DNA, 23 bp, Homo sapiens
tgtatttcaatgtgtttttgtag

SEQ ID NO: 171539 - DNA, 19 bp, Homo sapiens
tgtgtgtgtgtgtgtgtgt

SEQ ID NO: 171540 - DNA, 23 bp, Homo sapiens
ttttggttccatatgaaatgtga

SEQ ID NO: 171541 - DNA, 23 bp, Homo sapiens
tatgtatatatatatgtgtgtgt

SEQ ID NO: 171542 - DNA, 21 bp, Homo sapiens
tttagggttttctagatatag

SEQ ID NO: 171543 - DNA, 18 bp, Homo sapiens
atacacacacatacacat

SEQ ID NO: 171544 - DNA, 22 bp, Homo sapiens
attggcataaaattgtgcatat

SEQ ID NO: 171545 - DNA, 22 bp, Homo sapiens
ttatacgtatatgtatatatgt

SEQ ID NO: 171546 - DNA, 23 bp, Homo sapiens
tgagttcattgtagattctggat

SEQ ID NO: 171547 - DNA, 23 bp, Homo sapiens
tgagttcattgtagattctggat

SEQ ID NO: 171548 - DNA, 23 bp, Homo sapiens
atatgtgtatgtatatatgtgtg

SEQ ID NO: 171549 - DNA, 23 bp, Homo sapiens
ggccattcatattcaaggtgaat

SEQ ID NO: 171550 - DNA, 23 bp, Homo sapiens
tgagttcattgtagattctggat

SEQ ID NO: 171551 - DNA, 23 bp, Homo sapiens
tgagttcattgtagattctggat

SEQ ID NO: 171552 - DNA, 23 bp, Homo sapiens
acaaggcagagattcttcttttc

SEQ ID NO: 171553 - DNA, 23 bp, Homo sapiens
agtctctctgtctgtgctgagcc

SEQ ID NO: 171554 - DNA, 19 bp, Homo sapiens
cactggagtctaattgtgt

SEQ ID NO: 171555 - DNA, 20 bp, Homo sapiens
tgagtttaatgttagctttt

SEQ ID NO: 171556 - DNA, 23 bp, Homo sapiens
tgtgtgcatgtatatatatgtgt

SEQ ID NO: 171557 - DNA, 23 bp, Homo sapiens
aaagaggtacttctaactgccat

SEQ ID NO: 171558 - DNA, 23 bp, Homo sapiens
atacagacagtgggtgttctttt

SEQ ID NO: 171559 - DNA, 23 bp, Homo sapiens
tagtattccattgtgtatatgta

SEQ ID NO: 171560 - DNA, 23 bp, Homo sapiens
tggaatatatatgtgtgtgtgtg

SEQ ID NO: 171561 - DNA, 23 bp, Homo sapiens
aaatatgtgcttttgaatgcata

SEQ ID NO: 171562 - DNA, 18 bp, Homo sapiens
tggtctagaacatacttt

SEQ ID NO: 171563 - DNA, 18 bp, Homo sapiens
agatgtgttttatagcac

SEQ ID NO: 171564 - DNA, 23 bp, Homo sapiens
gtatgtatgtatgtgtgtgtgtg

SEQ ID NO: 171565 - DNA, 20 bp, Homo sapiens
tccttaagatatgttaggaa

SEQ ID NO: 171566 - DNA, 22 bp, Homo sapiens
aaagagactgcatttaatctgt

SEQ ID NO: 171567 - DNA, 21 bp, Homo sapiens
atatgtgtatatatatgtgtg

SEQ ID NO: 171568 - DNA, 23 bp, Homo sapiens
atatgtatatatatttgtgtgtg

SEQ ID NO: 171569 - DNA, 23 bp, Homo sapiens
tgaaatgttcaaaacatttcatg

SEQ ID NO: 171570 - DNA, 21 bp, Homo sapiens
taactcactctgacttggttg

SEQ ID NO: 171571 - DNA, 23 bp, Homo sapiens
tgtgtgtatatgtatgtgtgtgt

SEQ ID NO: 171572 - DNA, 23 bp, Homo sapiens
tgagttcattgtagattctggat

SEQ ID NO: 171573 - DNA, 23 bp, Homo sapiens
tgagttcattgtagattctggat

SEQ ID NO: 171574 - DNA, 22 bp, Homo sapiens
atttatgtagatatacatagat

SEQ ID NO: 171575 - DNA, 23 bp, Homo sapiens
tcatgtcaaattgtaattctcat

SEQ ID NO: 171576 - DNA, 23 bp, Homo sapiens
tatacatacagatatatatgtgt

SEQ ID NO: 171577 - DNA, 23 bp, Homo sapiens
ctatatctatatatctgtatgtg

SEQ ID NO: 171578 - DNA, 23 bp, Homo sapiens
atgagctgacagcatttgtgcag

SEQ ID NO: 171579 - DNA, 22 bp, Homo sapiens
tacatgtgcaggatgtgcaggt

SEQ ID NO: 171580 - DNA, 20 bp, Homo sapiens
tgagacagagtctcgctctg

SEQ ID NO: 171581 - DNA, 23 bp, Homo sapiens
tgagttcattgtagattctggat

SEQ ID NO: 171582 - DNA, 23 bp, Homo sapiens
tgagttcattgtagattctggat

SEQ ID NO: 171583 - DNA, 23 bp, Homo sapiens
gtgaagaatgtgtatgtgtgcat

SEQ ID NO: 171584 - DNA, 20 bp, Homo sapiens
atttactgggttgaatagtt

SEQ ID NO: 171585 - DNA, 23 bp, Homo sapiens
gacagagtctcgctctgtcaccc

SEQ ID NO: 171586 - DNA, 23 bp, Homo sapiens
aagtagcttgtattgttttgaaa

SEQ ID NO: 171587 - DNA, 23 bp, Homo sapiens
tcagtacctagtttattgagagt

SEQ ID NO: 171588 - DNA, 23 bp, Homo sapiens
tagagattgcattagatctgtaa

SEQ ID NO: 171589 - DNA, 23 bp, Homo sapiens
gacagagtctcgctctgtcaccc

SEQ ID NO: 171590 - DNA, 22 bp, Homo sapiens
gtctctgtttgagtgtgtgtat

SEQ ID NO: 171591 - DNA, 22 bp, Homo sapiens
tttagagtacagtgctcaatgg

SEQ ID NO: 171592 - DNA, 23 bp, Homo sapiens
catacacgtatacatatatatgc

SEQ ID NO: 171593 - DNA, 23 bp, Homo sapiens
tgagttcattgtagattctggat

SEQ ID NO: 171594 - DNA, 23 bp, Homo sapiens
tgagttcattgtagattctggat

SEQ ID NO: 171595 - DNA, 22 bp, Homo sapiens
tgagctactaaaatgtatatct

SEQ ID NO: 171596 - DNA, 23 bp, Homo sapiens
tttctaggacagggaggtttggt

SEQ ID NO: 171597 - DNA, 23 bp, Homo sapiens
tgagttcattgtagattctggat

SEQ ID NO: 171598 - DNA, 23 bp, Homo sapiens
tgagttcattgtagattctggat

SEQ ID NO: 171599 - DNA, 20 bp, Homo sapiens
tctgtgttttactgtctgct

SEQ ID NO: 171600 - DNA, 23 bp, Homo sapiens
tagctcccagagacaaatgacag

SEQ ID NO: 171601 - DNA, 23 bp, Homo sapiens
tttttttgcttaggattgtcttg

SEQ ID NO: 171602 - DNA, 18 bp, Homo sapiens
ttagtatgttttatttgc

SEQ ID NO: 171603 - DNA, 20 bp, Homo sapiens
atgtccatagtttattcagt

SEQ ID NO: 171604 - DNA, 18 bp, Homo sapiens
gttctttttggttaggat

SEQ ID NO: 171605 - DNA, 23 bp, Homo sapiens
tgtatattagaactttctcagat

SEQ ID NO: 171606 - DNA, 20 bp, Homo sapiens
atagcatgtatatacacata

SEQ ID NO: 171607 - DNA, 23 bp, Homo sapiens
tatggatgtgtatatatatgtgt

SEQ ID NO: 171608 - DNA, 22 bp, Homo sapiens
tatatgtgtatatatatgtgtg

SEQ ID NO: 171609 - DNA, 22 bp, Homo sapiens
ttttatatctctatagacttga

SEQ ID NO: 171610 - DNA, 21 bp, Homo sapiens
aaatagaataacattagggtt

SEQ ID NO: 171611 - DNA, 20 bp, Homo sapiens
tgcctgtatgttattctaca

SEQ ID NO: 171612 - DNA, 23 bp, Homo sapiens
tctttggaaaatattgctgtata

SEQ ID NO: 171613 - DNA, 18 bp, Homo sapiens
tatatttttgcagctgtt

SEQ ID NO: 171614 - DNA, 22 bp, Homo sapiens
tgaagtgtgcgtcattgagccc

SEQ ID NO: 171615 - DNA, 18 bp, Homo sapiens
atgcgtatatatacatat

SEQ ID NO: 171616 - DNA, 20 bp, Homo sapiens
atatagtttatgtccatgta

SEQ ID NO: 171617 - DNA, 23 bp, Homo sapiens
atgtatgtatatatatatgtgta

SEQ ID NO: 171618 - DNA, 22 bp, Homo sapiens
tacagcagtgtggagattcctt

SEQ ID NO: 171619 - DNA, 20 bp, Homo sapiens
caccatatatatacacacat

SEQ ID NO: 171620 - DNA, 23 bp, Homo sapiens
tctcactcacactgtgccccact

SEQ ID NO: 171621 - DNA, 23 bp, Homo sapiens
aggcagccagtgagcagtgctga

SEQ ID NO: 171622 - DNA, 18 bp, Homo sapiens
gtggtgatgaattccctc

SEQ ID NO: 171623 - DNA, 23 bp, Homo sapiens
ttgagatggagtctcactctgtc

SEQ ID NO: 171624 - DNA, 23 bp, Homo sapiens
atgtcaaattgtaattctcaatg

SEQ ID NO: 171625 - DNA, 23 bp, Homo sapiens
tggcattactctctgtagcctgt

SEQ ID NO: 171626 - DNA, 23 bp, Homo sapiens
atgacagtgactatgaggtgagg

SEQ ID NO: 171627 - DNA, 23 bp, Homo sapiens
tgagttcattgtagattctggat

SEQ ID NO: 171628 - DNA, 23 bp, Homo sapiens
tgagttcattgtagattctggat

SEQ ID NO: 171629 - DNA, 23 bp, Homo sapiens
tgagttcattgtagattctggat

SEQ ID NO: 171630 - DNA, 23 bp, Homo sapiens
tgagttcattgtagattctggat

SEQ ID NO: 171631 - DNA, 22 bp, Homo sapiens
aacaggagttatctgtgtgata

SEQ ID NO: 171632 - DNA, 23 bp, Homo sapiens
tttcatgtgcttttcataagttc

SEQ ID NO: 171633 - DNA, 23 bp, Homo sapiens
ggtctcactctgtcactctctca

SEQ ID NO: 171634 - DNA, 21 bp, Homo sapiens
tgagacagagtctcgctctgt

SEQ ID NO: 171635 - DNA, 23 bp, Homo sapiens
tggagtctcgctgtgtcacccag

SEQ ID NO: 171636 - DNA, 23 bp, Homo sapiens
gacagagtctcactctgtcgccc

SEQ ID NO: 171637 - DNA, 23 bp, Homo sapiens
tatatatgcatatatatacatat

SEQ ID NO: 171638 - DNA, 23 bp, Homo sapiens
atatatatgcatatatatacata

SEQ ID NO: 171639 - DNA, 23 bp, Homo sapiens
caacacagtgagacaccttattt

SEQ ID NO: 171640 - DNA, 20 bp, Homo sapiens
gagtctcactctgtcgccca

SEQ ID NO: 171641 - DNA, 22 bp, Homo sapiens
ttttgtttttttctgagatagg

SEQ ID NO: 171642 - DNA, 23 bp, Homo sapiens
ataaaagagagattagcattgat

SEQ ID NO: 171643 - DNA, 23 bp, Homo sapiens
tttgagacagagtctcacactgt

SEQ ID NO: 171644 - DNA, 18 bp, Homo sapiens
gtgagccactgtgcccag

SEQ ID NO: 171645 - DNA, 19 bp, Homo sapiens
taatatgtgttattgaagt

SEQ ID NO: 171646 - DNA, 23 bp, Homo sapiens
tcagttggttttgtaaagaatga

SEQ ID NO: 171647 - DNA, 22 bp, Homo sapiens
gagagcaatataattggatgat

SEQ ID NO: 171648 - DNA, 19 bp, Homo sapiens
ttttttctttgttaaataa

SEQ ID NO: 171649 - DNA, 22 bp, Homo sapiens
atttagagttggatagagtgac

SEQ ID NO: 171650 - DNA, 23 bp, Homo sapiens
tacatctgcattagtattagttg

SEQ ID NO: 171651 - DNA, 23 bp, Homo sapiens
agagtctcactctgtcacccagg

SEQ ID NO: 171652 - DNA, 21 bp, Homo sapiens
actcaaggtactgtttgcttt

SEQ ID NO: 171653 - DNA, 23 bp, Homo sapiens
ataatgacaggtttccatagtgt

SEQ ID NO: 171654 - DNA, 23 bp, Homo sapiens
catcttaagttaacagactcttt

SEQ ID NO: 171655 - DNA, 23 bp, Homo sapiens
tggctcagctagaagcatgttgt

SEQ ID NO: 171656 - DNA, 23 bp, Homo sapiens
tgagttcattgtagattctggat

SEQ ID NO: 171657 - DNA, 23 bp, Homo sapiens
tgagttcattgtagattctggat

SEQ ID NO: 171658 - DNA, 20 bp, Homo sapiens
ttctgcatctattgaggtga

SEQ ID NO: 171659 - DNA, 19 bp, Homo sapiens
tttgtcacccaggctggaa

SEQ ID NO: 171660 - DNA, 21 bp, Homo sapiens
tctgtctcccaggctagagtg

SEQ ID NO: 171661 - DNA, 23 bp, Homo sapiens
cactgcagtctcagtcacccagg

SEQ ID NO: 171662 - DNA, 18 bp, Homo sapiens
actttttcttacccaatt

SEQ ID NO: 171663 - DNA, 23 bp, Homo sapiens
ggtactacgttgaatagaagtgg

SEQ ID NO: 171664 - DNA, 23 bp, Homo sapiens
tttgtggttccatatcaatttta

SEQ ID NO: 171665 - DNA, 22 bp, Homo sapiens
ataggcattgtatgaaatctgt

SEQ ID NO: 171666 - DNA, 23 bp, Homo sapiens
ttttttggttccatatgaaattt

SEQ ID NO: 171667 - DNA, 23 bp, Homo sapiens
catttctgtgacaaaagtcagtg

SEQ ID NO: 171668 - DNA, 23 bp, Homo sapiens
tgtctgcctgagttcacatggag

SEQ ID NO: 171669 - DNA, 19 bp, Homo sapiens
agattcttcatttgtgaaa

SEQ ID NO: 171670 - DNA, 23 bp, Homo sapiens
tatttcagtcaagtagagtttga

SEQ ID NO: 171671 - DNA, 23 bp, Homo sapiens
tgagttcattgtagattctggat

SEQ ID NO: 171672 - DNA, 23 bp, Homo sapiens
tgagttcattgtagattctggat

SEQ ID NO: 171673 - DNA, 23 bp, Homo sapiens
taaaaggaagtttagttggctga

SEQ ID NO: 171674 - DNA, 23 bp, Homo sapiens
gtttttaattctgtttatgtagt

SEQ ID NO: 171675 - DNA, 22 bp, Homo sapiens
atcttattgtagttctgatttg

SEQ ID NO: 171676 - DNA, 19 bp, Homo sapiens
atggccattcttgcaggag

SEQ ID NO: 171677 - DNA, 23 bp, Homo sapiens
tgagttcttgatttgatcttcag

SEQ ID NO: 171678 - DNA, 21 bp, Homo sapiens
aaatatgtgcaagtatatata

SEQ ID NO: 171679 - DNA, 23 bp, Homo sapiens
agatgaggtagaatcttgaattc

SEQ ID NO: 171680 - DNA, 23 bp, Homo sapiens
gttctcagttggagaaataggac

SEQ ID NO: 171681 - DNA, 22 bp, Homo sapiens
ttatctctctcactgtgaggcc

SEQ ID NO: 171682 - DNA, 21 bp, Homo sapiens
gaaagacaatgggtttttttt

SEQ ID NO: 171683 - DNA, 19 bp, Homo sapiens
agacacagtttctctctgt

SEQ ID NO: 171684 - DNA, 23 bp, Homo sapiens
aaagtcagtggtagattgatggg

SEQ ID NO: 171685 - DNA, 23 bp, Homo sapiens
tgagtggctgttgagagtctgca

SEQ ID NO: 171686 - DNA, 23 bp, Homo sapiens
tgagttcattgtagattctggat

SEQ ID NO: 171687 - DNA, 23 bp, Homo sapiens
tgagttcattgtagattctggat

SEQ ID NO: 171688 - DNA, 23 bp, Homo sapiens
tttgtagttcttgaagaggtcct

SEQ ID NO: 171689 - DNA, 21 bp, Homo sapiens
ttcactcatgatttggctctc

SEQ ID NO: 171690 - DNA, 23 bp, Homo sapiens
gacagagtctcgctctgtcaccc

SEQ ID NO: 171691 - DNA, 23 bp, Homo sapiens
acagagtctcgctctgtcaccca

SEQ ID NO: 171692 - DNA, 23 bp, Homo sapiens
gaagagttgagtatttattgtag

SEQ ID NO: 171693 - DNA, 23 bp, Homo sapiens
tgaagattgtgtgcactgttgca

SEQ ID NO: 171694 - DNA, 23 bp, Homo sapiens
ttgtgcatgttgaaccagccttg

SEQ ID NO: 171695 - DNA, 23 bp, Homo sapiens
tggatttaatttgctaacatttt

SEQ ID NO: 171696 - DNA, 23 bp, Homo sapiens
tgagttcattgtagattctggat

SEQ ID NO: 171697 - DNA, 23 bp, Homo sapiens
tgagttcattgtagattctggat

SEQ ID NO: 171698 - DNA, 23 bp, Homo sapiens
attgtattgtgcatgagtattct

SEQ ID NO: 171699 - DNA, 23 bp, Homo sapiens
tacatgtgcacattgtgcaggat

SEQ ID NO: 171700 - DNA, 23 bp, Homo sapiens
atatgtatatatgtatgtgtgtg

SEQ ID NO: 171701 - DNA, 21 bp, Homo sapiens
ttaatacatgctcacacatat

SEQ ID NO: 171702 - DNA, 23 bp, Homo sapiens
ggctaagtcatatggtaggcata

SEQ ID NO: 171703 - DNA, 19 bp, Homo sapiens
ttctatcctgtccctgtgt

SEQ ID NO: 171704 - DNA, 18 bp, Homo sapiens
tgatctttggatacctaa

SEQ ID NO: 171705 - DNA, 21 bp, Homo sapiens
acagagcagagtgtggagact

SEQ ID NO: 171706 - DNA, 23 bp, Homo sapiens
tagagcttcaggttaggatatga

SEQ ID NO: 171707 - DNA, 23 bp, Homo sapiens
tttgtctttagaaactatcctct

SEQ ID NO: 171708 - DNA, 19 bp, Homo sapiens
tccttctcagtttttgttt

SEQ ID NO: 171709 - DNA, 23 bp, Homo sapiens
agagtgcttggactttgagtgag

SEQ ID NO: 171710 - DNA, 23 bp, Homo sapiens
tgagttcattgtagattctggat

SEQ ID NO: 171711 - DNA, 23 bp, Homo sapiens
tgagttcattgtagattctggat

SEQ ID NO: 171712 - DNA, 18 bp, Homo sapiens
gttccatgtgagttttag

SEQ ID NO: 171713 - DNA, 23 bp, Homo sapiens
gggagagtgaagtgactggggac

SEQ ID NO: 171714 - DNA, 23 bp, Homo sapiens
tgtatacgtgtgtgtgtatacac

SEQ ID NO: 171715 - DNA, 23 bp, Homo sapiens
gtatatatacgtgtgtgtatatg

SEQ ID NO: 171716 - DNA, 23 bp, Homo sapiens
tccagatgtgattttgttgatga

SEQ ID NO: 171717 - DNA, 20 bp, Homo sapiens
tctggaagaagattcgtact

SEQ ID NO: 171718 - DNA, 19 bp, Homo sapiens
ttttgagacggagtcttct

SEQ ID NO: 171719 - DNA, 23 bp, Homo sapiens
tgagatgtagtctcgctctgtcg

SEQ ID NO: 171720 - DNA, 23 bp, Homo sapiens
tgtcagcctgactggctctttcc

SEQ ID NO: 171721 - DNA, 23 bp, Homo sapiens
gaaatgctacaggtttttgtatg

SEQ ID NO: 171722 - DNA, 22 bp, Homo sapiens
atattgcaatacaaatgtgtca

SEQ ID NO: 171723 - DNA, 23 bp, Homo sapiens
tgagttcattgtagattctggat

SEQ ID NO: 171724 - DNA, 23 bp, Homo sapiens
tgagttcattgtagattctggat

SEQ ID NO: 171725 - DNA, 21 bp, Homo sapiens
taggcagaagatagttaggtc

SEQ ID NO: 171726 - DNA, 21 bp, Homo sapiens
atgtatgtatacatgtataca

SEQ ID NO: 171727 - DNA, 21 bp, Homo sapiens
atacacacactatatatacac

SEQ ID NO: 171728 - DNA, 19 bp, Homo sapiens
ttgtttatgtatgctgaat

SEQ ID NO: 171729 - DNA, 22 bp, Homo sapiens
tcttttgtatcctcttgctgtg

SEQ ID NO: 171730 - DNA, 18 bp, Homo sapiens
tatactttaagttctgga

SEQ ID NO: 171731 - DNA, 22 bp, Homo sapiens
tacatgtgcagaatgtgcagtt

SEQ ID NO: 171732 - DNA, 23 bp, Homo sapiens
tgagttcattgtagattctggat

SEQ ID NO: 171733 - DNA, 23 bp, Homo sapiens
tgagttcattgtagattctggat

SEQ ID NO: 171734 - DNA, 19 bp, Homo sapiens
atatgtgtgcatgtgtata

SEQ ID NO: 171735 - DNA, 22 bp, Homo sapiens
tgacctcgaggcttatgcatgt

SEQ ID NO: 171736 - DNA, 20 bp, Homo sapiens
ttttattgtgttggtatcag

SEQ ID NO: 171737 - DNA, 20 bp, Homo sapiens
tgatgctgatagaatgagtt

SEQ ID NO: 171738 - DNA, 23 bp, Homo sapiens
tgagttcattgtagattctggat

SEQ ID NO: 171739 - DNA, 23 bp, Homo sapiens
tgagttcattgtagattctggat

SEQ ID NO: 171740 - DNA, 21 bp, Homo sapiens
gagttgcatgacttaactgtt

SEQ ID NO: 171741 - DNA, 18 bp, Homo sapiens
atgcatatatatatgtat

SEQ ID NO: 171742 - DNA, 23 bp, Homo sapiens
tgagttcattgtagattctggat

SEQ ID NO: 171743 - DNA, 23 bp, Homo sapiens
tgagttcattgtagattctggat

SEQ ID NO: 171744 - DNA, 23 bp, Homo sapiens
cacttcattctagagagagagct

SEQ ID NO: 171745 - DNA, 19 bp, Homo sapiens
tgtatctatgtctatatct

SEQ ID NO: 171746 - DNA, 23 bp, Homo sapiens
tgagttcattgtagattctggat

SEQ ID NO: 171747 - DNA, 23 bp, Homo sapiens
tgagttcattgtagattctggat

SEQ ID NO: 171748 - DNA, 23 bp, Homo sapiens
tgagttcattgtagattctggat

SEQ ID NO: 171749 - DNA, 23 bp, Homo sapiens
tgagttcattgtagattctggat

SEQ ID NO: 171750 - DNA, 23 bp, Homo sapiens
gtattgtacaatgctgtctctcc

SEQ ID NO: 171751 - DNA, 23 bp, Homo sapiens
atatatgtaggtatgcatatgta

SEQ ID NO: 171752 - DNA, 23 bp, Homo sapiens
aagtgtcagtacagagggagtct

SEQ ID NO: 171753 - DNA, 23 bp, Homo sapiens
tgtggtccaagagtacacttggt

SEQ ID NO: 171754 - DNA, 23 bp, Homo sapiens
gacagagtctcgctctgtcaccc

SEQ ID NO: 171755 - DNA, 23 bp, Homo sapiens
tgagttcattgtagattctggat

SEQ ID NO: 171756 - DNA, 23 bp, Homo sapiens
tgagttcattgtagattctggat

SEQ ID NO: 171757 - DNA, 23 bp, Homo sapiens
ctgtgaagaaagtcaatagtagc

SEQ ID NO: 171758 - DNA, 20 bp, Homo sapiens
acactgagacaaaggggaaa

SEQ ID NO: 171759 - DNA, 23 bp, Homo sapiens
agatggcatctcactctgtcacc

SEQ ID NO: 171760 - DNA, 21 bp, Homo sapiens
ttctgagacggagtctccctc

SEQ ID NO: 171761 - DNA, 22 bp, Homo sapiens
ccagcagtttgtgttatcacag

SEQ ID NO: 171762 - DNA, 23 bp, Homo sapiens
tgtatatatgtatgcatatatac

SEQ ID NO: 171763 - DNA, 22 bp, Homo sapiens
tatgtatatatgtatatatgtg

SEQ ID NO: 171764 - DNA, 23 bp, Homo sapiens
tatgtatatatatgtgtgtgtgt

SEQ ID NO: 171765 - DNA, 20 bp, Homo sapiens
tgaggtgatgttgttgttct

SEQ ID NO: 171766 - DNA, 23 bp, Homo sapiens
aatatagacatattctatatcca

SEQ ID NO: 171767 - DNA, 23 bp, Homo sapiens
atagagacatattctatatccat

SEQ ID NO: 171768 - DNA, 23 bp, Homo sapiens
tctgtcactcaggctaagtacag

SEQ ID NO: 171769 - DNA, 18 bp, Homo sapiens
tagtgagatcccatctct

SEQ ID NO: 171770 - DNA, 22 bp, Homo sapiens
tcccacagactcaattttttct

SEQ ID NO: 171771 - DNA, 23 bp, Homo sapiens
ttagtcaccctctctgaggcact

SEQ ID NO: 171772 - DNA, 22 bp, Homo sapiens
agataactagttgactaggggt

SEQ ID NO: 171773 - DNA, 22 bp, Homo sapiens
tgcttgttgactgagcagatat

SEQ ID NO: 171774 - DNA, 19 bp, Homo sapiens
tgagacagattctcactct

SEQ ID NO: 171775 - DNA, 23 bp, Homo sapiens
cagaatctcactctgtctctcag

SEQ ID NO: 171776 - DNA, 23 bp, Homo sapiens
tgagttcattgtagattctggat

SEQ ID NO: 171777 - DNA, 23 bp, Homo sapiens
tgagttcattgtagattctggat

SEQ ID NO: 171778 - DNA, 21 bp, Homo sapiens
tagttctgtgaagaaagtcag

SEQ ID NO: 171779 - DNA, 23 bp, Homo sapiens
tgtgtctctgtgtgtgagatggt

SEQ ID NO: 171780 - DNA, 19 bp, Homo sapiens
agcacactgatgggtcttg

SEQ ID NO: 171781 - DNA, 20 bp, Homo sapiens
tttagcagagatgggggtct

SEQ ID NO: 171782 - DNA, 18 bp, Homo sapiens
atgtgtatatatatttgt

SEQ ID NO: 171783 - DNA, 23 bp, Homo sapiens
tgtgtgtgtatatatatatgtgt

SEQ ID NO: 171784 - DNA, 18 bp, Homo sapiens
tgagtagattagctattg

SEQ ID NO: 171785 - DNA, 21 bp, Homo sapiens
agtataatttgaaatcagaaa

SEQ ID NO: 171786 - DNA, 21 bp, Homo sapiens
tttggcacagagtcttttgtg

SEQ ID NO: 171787 - DNA, 22 bp, Homo sapiens
cacagatgtgtgccaccacatc

SEQ ID NO: 171788 - DNA, 22 bp, Homo sapiens
ttttagtagagatggggtttca

SEQ ID NO: 171789 - DNA, 23 bp, Homo sapiens
cagggtctcactgtgtcacccag

SEQ ID NO: 171790 - DNA, 19 bp, Homo sapiens
aggctatagatagagtaga

SEQ ID NO: 171791 - DNA, 19 bp, Homo sapiens
tatgtgtatatatatacgt

SEQ ID NO: 171792 - DNA, 23 bp, Homo sapiens
agagtctcactctgtcacccagg

SEQ ID NO: 171793 - DNA, 22 bp, Homo sapiens
atagcaagtaagtgacagaact

SEQ ID NO: 171794 - DNA, 23 bp, Homo sapiens
agatggagtctcgctctgtcacc

SEQ ID NO: 171795 - DNA, 20 bp, Homo sapiens
actttgcagcttcatttttc

SEQ ID NO: 171796 - DNA, 23 bp, Homo sapiens
tgagttcattgtagattctggat

SEQ ID NO: 171797 - DNA, 23 bp, Homo sapiens
tgagttcattgtagattctggat

SEQ ID NO: 171798 - DNA, 23 bp, Homo sapiens
tgagttcattgtagattctggat

SEQ ID NO: 171799 - DNA, 23 bp, Homo sapiens
tgagttcattgtagattctggat

SEQ ID NO: 171800 - DNA, 22 bp, Homo sapiens
ttgacacggagtctcgctctgt

SEQ ID NO: 171801 - DNA, 23 bp, Homo sapiens
cagcacacagagaagtgtgtgag

SEQ ID NO: 171802 - DNA, 21 bp, Homo sapiens
tgtgtgtgtgtgtatacacat

SEQ ID NO: 171803 - DNA, 20 bp, Homo sapiens
atatagcttgtacatgcctt

SEQ ID NO: 171804 - DNA, 18 bp, Homo sapiens
ttgcatatgttgaaccag

SEQ ID NO: 171805 - DNA, 20 bp, Homo sapiens
aaacttgatcgtggtggata

SEQ ID NO: 171806 - DNA, 23 bp, Homo sapiens
tctgagcctcagtgtctgcctct

SEQ ID NO: 171807 - DNA, 23 bp, Homo sapiens
tattctctgaggtttcaatgaca

SEQ ID NO: 171808 - DNA, 21 bp, Homo sapiens
aattaccaagccttttgtgtg

SEQ ID NO: 171809 - DNA, 18 bp, Homo sapiens
tgaggtattaagtggaag

SEQ ID NO: 171810 - DNA, 20 bp, Homo sapiens
ttatatgcacatatacatat

SEQ ID NO: 171811 - DNA, 23 bp, Homo sapiens
agacagggtctggctctgttgtc

SEQ ID NO: 171812 - DNA, 21 bp, Homo sapiens
ctctggctctgtctctggctc

SEQ ID NO: 171813 - DNA, 22 bp, Homo sapiens
agagaagtcagagaagtcagga

SEQ ID NO: 171814 - DNA, 23 bp, Homo sapiens
ctgtgtctgtctctgtatgtgct

SEQ ID NO: 171815 - DNA, 23 bp, Homo sapiens
tgtctgtgcaaatgcgtgtgtgt

SEQ ID NO: 171816 - DNA, 23 bp, Homo sapiens
ctctccctctctgacaggctgtg

SEQ ID NO: 171817 - DNA, 21 bp, Homo sapiens
agcctagatgtggcagaggtg

SEQ ID NO: 171818 - DNA, 23 bp, Homo sapiens
gtcagtctcactctgtgtccagt

SEQ ID NO: 171819 - DNA, 23 bp, Homo sapiens
tgcctggctgtgtctctgtgtgt

SEQ ID NO: 171820 - DNA, 23 bp, Homo sapiens
tgttgtgtacctgtagtcccagc

SEQ ID NO: 171821 - DNA, 23 bp, Homo sapiens
acagagtctcactctgtcgccca

SEQ ID NO: 171822 - DNA, 21 bp, Homo sapiens
tgagactgtcttgctctgtca

SEQ ID NO: 171823 - DNA, 19 bp, Homo sapiens
tgtatgtatgtatgtatgt

SEQ ID NO: 171824 - DNA, 21 bp, Homo sapiens
tgatcactgctcgctacagtc

SEQ ID NO: 171825 - DNA, 23 bp, Homo sapiens
aactgtgtcccagagattctggt

SEQ ID NO: 171826 - DNA, 23 bp, Homo sapiens
tgagttcattgtagattctggat

SEQ ID NO: 171827 - DNA, 23 bp, Homo sapiens
tgagttcattgtagattctggat

SEQ ID NO: 171828 - DNA, 23 bp, Homo sapiens
aagaggtttatattggctcacag

SEQ ID NO: 171829 - DNA, 20 bp, Homo sapiens
atatagatagtatatctata

SEQ ID NO: 171830 - DNA, 23 bp, Homo sapiens
ctgtctcggtctctatatgaaga

SEQ ID NO: 171831 - DNA, 19 bp, Homo sapiens
tattcagtttttctaatac

SEQ ID NO: 171832 - DNA, 23 bp, Homo sapiens
tttaatagttgtggtacccttgt

SEQ ID NO: 171833 - DNA, 23 bp, Homo sapiens
tatatgtgtgtatatatatagaa

SEQ ID NO: 171834 - DNA, 23 bp, Homo sapiens
ttttgattccatatgaactgtaa

SEQ ID NO: 171835 - DNA, 20 bp, Homo sapiens
tatatgtgtgagtatatgta

SEQ ID NO: 171836 - DNA, 21 bp, Homo sapiens
atacacacgtatatacacaca

SEQ ID NO: 171837 - DNA, 18 bp, Homo sapiens
atgtctttgtaaactgat

SEQ ID NO: 171838 - DNA, 23 bp, Homo sapiens
atagatatagatacagatataga

SEQ ID NO: 171839 - DNA, 23 bp, Homo sapiens
tatatctgtatatgtatatgtat

SEQ ID NO: 171840 - DNA, 19 bp, Homo sapiens
atgtgtgtgtatatgtata

SEQ ID NO: 171841 - DNA, 22 bp, Homo sapiens
gtgtgcatgtttgtatatgctt

SEQ ID NO: 171842 - DNA, 22 bp, Homo sapiens
ttggcagcatgtatgtcttttg

SEQ ID NO: 171843 - DNA, 23 bp, Homo sapiens
tatgtgtgtatatatatgtgtgt

SEQ ID NO: 171844 - DNA, 18 bp, Homo sapiens
tatcacagtattccatgt

SEQ ID NO: 171845 - DNA, 19 bp, Homo sapiens
tatacatggaatactgtga

SEQ ID NO: 171846 - DNA, 22 bp, Homo sapiens
cattgtggttttaatttgcatt

SEQ ID NO: 171847 - DNA, 23 bp, Homo sapiens
tggagtctcactctgtcacccag

SEQ ID NO: 171848 - DNA, 23 bp, Homo sapiens
tggagtctcactctgtcacccag

SEQ ID NO: 171849 - DNA, 22 bp, Homo sapiens
ttttgagatagagtcttgctct

SEQ ID NO: 171850 - DNA, 23 bp, Homo sapiens
tctctgtgtgtgtgtgtatgggc

SEQ ID NO: 171851 - DNA, 23 bp, Homo sapiens
tgaggcagtagtatctgagctca

SEQ ID NO: 171852 - DNA, 23 bp, Homo sapiens
atgtgtatatatatatatgtgtg

SEQ ID NO: 171853 - DNA, 19 bp, Homo sapiens
acacatatgtatacatata

SEQ ID NO: 171854 - DNA, 21 bp, Homo sapiens
acagtgggattgctggaacat

SEQ ID NO: 171855 - DNA, 23 bp, Homo sapiens
tttgaggaacttctaaactgttt

SEQ ID NO: 171856 - DNA, 23 bp, Homo sapiens
tgagttcattgtagattctggat

SEQ ID NO: 171857 - DNA, 23 bp, Homo sapiens
aaatcacccttctgagtcactca

SEQ ID NO: 171858 - DNA, 23 bp, Homo sapiens
tgataggtaatctttcacctctc

SEQ ID NO: 171859 - DNA, 19 bp, Homo sapiens
ttgagtgcagtggcacagt

SEQ ID NO: 171860 - DNA, 23 bp, Homo sapiens
gtaagaaatgtcattgtattttg

SEQ ID NO: 171861 - DNA, 23 bp, Homo sapiens
tgagttcattgtagattctggat

SEQ ID NO: 171862 - DNA, 23 bp, Homo sapiens
tgagttcattgtagattctggat

SEQ ID NO: 171863 - DNA, 23 bp, Homo sapiens
tctgtgaagaaagtcaatggtag

SEQ ID NO: 171864 - DNA, 20 bp, Homo sapiens
actgattcagaatttgtaat

SEQ ID NO: 171865 - DNA, 23 bp, Homo sapiens
tcattgtggttttgatttgcatt

SEQ ID NO: 171866 - DNA, 22 bp, Homo sapiens
aaaactgaaagcattccctttg

SEQ ID NO: 171867 - DNA, 23 bp, Homo sapiens
gtgaggaagatgttagtaatgat

SEQ ID NO: 171868 - DNA, 18 bp, Homo sapiens
atatatgtacacatacat

SEQ ID NO: 171869 - DNA, 19 bp, Homo sapiens
tatatgtacacatacatgt

SEQ ID NO: 171870 - DNA, 21 bp, Homo sapiens
tataaatatatgctgtatatg

SEQ ID NO: 171871 - DNA, 23 bp, Homo sapiens
ctttatggctgaccatgtaattg

SEQ ID NO: 171872 - DNA, 23 bp, Homo sapiens
tacagtgtgattttgatacatgt

SEQ ID NO: 171873 - DNA, 22 bp, Homo sapiens
tatttgtatatctatctgtaga

SEQ ID NO: 171874 - DNA, 23 bp, Homo sapiens
tatgtatatctatctgtagatct

SEQ ID NO: 171875 - DNA, 23 bp, Homo sapiens
atgtacagagagagaaagatata

SEQ ID NO: 171876 - DNA, 23 bp, Homo sapiens
gtgagtgtgctgactgtgcacat

SEQ ID NO: 171877 - DNA, 23 bp, Homo sapiens
atatgtgtatatatatatgtatg

SEQ ID NO: 171878 - DNA, 23 bp, Homo sapiens
gtgtgtatgtatgtatgtgtgtg

SEQ ID NO: 171879 - DNA, 23 bp, Homo sapiens
taatacagagtatggattctgct

SEQ ID NO: 171880 - DNA, 23 bp, Homo sapiens
gacagagtctcgctctgtcaccc

SEQ ID NO: 171881 - DNA, 23 bp, Homo sapiens
tgtctgtctgtgtttttgcatag

SEQ ID NO: 171882 - DNA, 23 bp, Homo sapiens
tgtgtatgtgaagtgggagctct

SEQ ID NO: 171883 - DNA, 23 bp, Homo sapiens
ctcagtccctcacattcaccttt

SEQ ID NO: 171884 - DNA, 23 bp, Homo sapiens
gtgtgtgtatgtgtgtgccatat

SEQ ID NO: 171885 - DNA, 23 bp, Homo sapiens
tgtgtatatctatgtatatgtaa

SEQ ID NO: 171886 - DNA, 20 bp, Homo sapiens
catatctgtatatgtatata

SEQ ID NO: 171887 - DNA, 23 bp, Homo sapiens
tatgtatgtgtatatgtatgtgt

SEQ ID NO: 171888 - DNA, 22 bp, Homo sapiens
acatgtgcacaacgtgcaggtt

SEQ ID NO: 171889 - DNA, 23 bp, Homo sapiens
tagtttggctggatatgaaattc

SEQ ID NO: 171890 - DNA, 19 bp, Homo sapiens
atatgtataaatatatatg

SEQ ID NO: 171891 - DNA, 23 bp, Homo sapiens
tgagttcattgtagattctggat

SEQ ID NO: 171892 - DNA, 23 bp, Homo sapiens
tgagttcattgtagattctggat

SEQ ID NO: 171893 - DNA, 23 bp, Homo sapiens
tggagtctctctctgtcacccag

SEQ ID NO: 171894 - DNA, 20 bp, Homo sapiens
aagacaaaatagggatgagt

SEQ ID NO: 171895 - DNA, 22 bp, Homo sapiens
tgtgtgtgtctctattacttta

SEQ ID NO: 171896 - DNA, 18 bp, Homo sapiens
atactttaagttttaggg

SEQ ID NO: 171897 - DNA, 23 bp, Homo sapiens
tgagttcattgtagattctggat

SEQ ID NO: 171898 - DNA, 23 bp, Homo sapiens
tgagttcattgtagattctggat

SEQ ID NO: 171899 - DNA, 23 bp, Homo sapiens
cagggtgtgtgtctctttcactg

SEQ ID NO: 171900 - DNA, 23 bp, Homo sapiens
gtggaaagaagttcaccaaggga

SEQ ID NO: 171901 - DNA, 21 bp, Homo sapiens
acactgggtgaaatccaggga

SEQ ID NO: 171902 - DNA, 18 bp, Homo sapiens
tggtgtacaaagatgcac

SEQ ID NO: 171903 - DNA, 21 bp, Homo sapiens
acagacagaagtgtgactgta

SEQ ID NO: 171904 - DNA, 23 bp, Homo sapiens
acatattagtgtttctgttagtg

SEQ ID NO: 171905 - DNA, 21 bp, Homo sapiens
agtttttttctaattctgtga

SEQ ID NO: 171906 - DNA, 20 bp, Homo sapiens
acacacacacatatgtgtat

SEQ ID NO: 171907 - DNA, 22 bp, Homo sapiens
aaaaatgcttatgttttgtata

SEQ ID NO: 171908 - DNA, 21 bp, Homo sapiens
acagagtggtgagtgagggca

SEQ ID NO: 171909 - DNA, 23 bp, Homo sapiens
tgagttcattgtagattctggat

SEQ ID NO: 171910 - DNA, 23 bp, Homo sapiens
tgagttcattgtagattctggat

SEQ ID NO: 171911 - DNA, 22 bp, Homo sapiens
ttcactcatgatttggctctct

SEQ ID NO: 171912 - DNA, 23 bp, Homo sapiens
ttatttgtttttgtattcagtaa

SEQ ID NO: 171913 - DNA, 21 bp, Homo sapiens
tttgctttatataactatgtg

SEQ ID NO: 171914 - DNA, 21 bp, Homo sapiens
tggaatgtaaactagtataac

SEQ ID NO: 171915 - DNA, 20 bp, Homo sapiens
gttatgataggaaaagtatt

SEQ ID NO: 171916 - DNA, 18 bp, Homo sapiens
atatgtatatatgtacat

SEQ ID NO: 171917 - DNA, 23 bp, Homo sapiens
tacgtatgtatatatgtacatat

SEQ ID NO: 171918 - DNA, 23 bp, Homo sapiens
atgtgtatatatgtatatatgtg

SEQ ID NO: 171919 - DNA, 19 bp, Homo sapiens
tgcatgtatgtatatatat

SEQ ID NO: 171920 - DNA, 22 bp, Homo sapiens
atagagatagcattgaatctct

SEQ ID NO: 171921 - DNA, 23 bp, Homo sapiens
ttttatacatgtgcatgtgcttg

SEQ ID NO: 171922 - DNA, 23 bp, Homo sapiens
catacacatttgcatatggtcgt

SEQ ID NO: 171923 - DNA, 19 bp, Homo sapiens
taagtatatatatataggt

SEQ ID NO: 171924 - DNA, 23 bp, Homo sapiens
tgagttcattgtagattctggat

SEQ ID NO: 171925 - DNA, 23 bp, Homo sapiens
tgagttcattgtagattctggat

SEQ ID NO: 171926 - DNA, 23 bp, Homo sapiens
aagcatattgtgtgtgggtatgt

SEQ ID NO: 171927 - DNA, 19 bp, Homo sapiens
tctgccagtgcatctgaaa

SEQ ID NO: 171928 - DNA, 21 bp, Homo sapiens
acatgtgcacaatgtgcaggt

SEQ ID NO: 171929 - DNA, 20 bp, Homo sapiens
tgagatacagtctcactctt

SEQ ID NO: 171930 - DNA, 21 bp, Homo sapiens
agtgggacagtctcagctcac

SEQ ID NO: 171931 - DNA, 23 bp, Homo sapiens
atgagtctgaagtctgagtccac

SEQ ID NO: 171932 - DNA, 18 bp, Homo sapiens
atcacaaagggctaagga

SEQ ID NO: 171933 - DNA, 23 bp, Homo sapiens
tctctgcctctatctgaaagggg

SEQ ID NO: 171934 - DNA, 18 bp, Homo sapiens
atatatatgcatatgtgt

SEQ ID NO: 171935 - DNA, 18 bp, Homo sapiens
atatgtgtatatgtatat

SEQ ID NO: 171936 - DNA, 23 bp, Homo sapiens
tatgtgtatatacatatatgtgt

SEQ ID NO: 171937 - DNA, 23 bp, Homo sapiens
atgtgtatatatgtatatatgtt

SEQ ID NO: 171938 - DNA, 23 bp, Homo sapiens
tgagttcattgtagattctggat

SEQ ID NO: 171939 - DNA, 23 bp, Homo sapiens
tgagttcattgtagattctggat

SEQ ID NO: 171940 - DNA, 23 bp, Homo sapiens
ttgaaaatgcatgttttagttga

SEQ ID NO: 171941 - DNA, 22 bp, Homo sapiens
acgtgtgagctttagttggtct

SEQ ID NO: 171942 - DNA, 22 bp, Homo sapiens
tacacgtatatatatgtgtata

SEQ ID NO: 171943 - DNA, 23 bp, Homo sapiens
atatatgtatatatatatgtgtg

SEQ ID NO: 171944 - DNA, 20 bp, Homo sapiens
cagactgaagagacaacctg

SEQ ID NO: 171945 - DNA, 23 bp, Homo sapiens
tttgttctttttgcttaggactg

SEQ ID NO: 171946 - DNA, 18 bp, Homo sapiens
tatccatatatatccata

SEQ ID NO: 171947 - DNA, 23 bp, Homo sapiens
ctctcaatcactgtcaaactgtg

SEQ ID NO: 171948 - DNA, 23 bp, Homo sapiens
atatgatttgtgtgtgtatgtgt

SEQ ID NO: 171949 - DNA, 21 bp, Homo sapiens
caggacactgtgtctgttttg

SEQ ID NO: 171950 - DNA, 22 bp, Homo sapiens
ttacaactcagtgtctgttcta

SEQ ID NO: 171951 - DNA, 23 bp, Homo sapiens
tatgtgctacatttcaatagagt

SEQ ID NO: 171952 - DNA, 22 bp, Homo sapiens
ggatacatgtgcaggatgtgca

SEQ ID NO: 171953 - DNA, 23 bp, Homo sapiens
gctggctctgactctgtgtcttt

SEQ ID NO: 171954 - DNA, 21 bp, Homo sapiens
tgcatggcagggtgcctggct

SEQ ID NO: 171955 - DNA, 22 bp, Homo sapiens
atgatgatgatgatgatgatga

SEQ ID NO: 171956 - DNA, 20 bp, Homo sapiens
aaagcactcggccgggcgtg

SEQ ID NO: 171957 - DNA, 18 bp, Homo sapiens
tccctcttgatgggcatg

SEQ ID NO: 171958 - DNA, 22 bp, Homo sapiens
tgagatgtagtctcgctctgtt

SEQ ID NO: 171959 - DNA, 23 bp, Homo sapiens
tatgtatatgtatatgtacatgt

SEQ ID NO: 171960 - DNA, 22 bp, Homo sapiens
atatgtgtatatatatatgtgt

SEQ ID NO: 171961 - DNA, 23 bp, Homo sapiens
agagtctcactctgtcacccagg

SEQ ID NO: 171962 - DNA, 23 bp, Homo sapiens
gggagaaactgcataggatactg

SEQ ID NO: 171963 - DNA, 22 bp, Homo sapiens
tatagtacatttggaaatcagg

SEQ ID NO: 171964 - DNA, 23 bp, Homo sapiens
aatgtgagtcctccaactttgtt

SEQ ID NO: 171965 - DNA, 22 bp, Homo sapiens
gaatgcttccatcttttgccca

SEQ ID NO: 171966 - DNA, 23 bp, Homo sapiens
aggctgaggtagctgtgacaatt

SEQ ID NO: 171967 - DNA, 22 bp, Homo sapiens
tgagatggagtttcggtcttgt

SEQ ID NO: 171968 - DNA, 23 bp, Homo sapiens
ggactctcactctgtctcccagg

SEQ ID NO: 171969 - DNA, 22 bp, Homo sapiens
agtagagagacaatcatgtcac

SEQ ID NO: 171970 - DNA, 23 bp, Homo sapiens
ttttattatctttttctgatgtt

SEQ ID NO: 171971 - DNA, 18 bp, Homo sapiens
ctgtgctggcttctgtct

SEQ ID NO: 171972 - DNA, 23 bp, Homo sapiens
tctgactagttgtgagaacttgg

SEQ ID NO: 171973 - DNA, 21 bp, Homo sapiens
ttcagtactcactttcttcat

SEQ ID NO: 171974 - DNA, 23 bp, Homo sapiens
acagagtctcactctgtcgccca

SEQ ID NO: 171975 - DNA, 23 bp, Homo sapiens
aagtctcactctgtcacccaggc

SEQ ID NO: 171976 - DNA, 22 bp, Homo sapiens
ttactgctattgaaaacagtat

SEQ ID NO: 171977 - DNA, 18 bp, Homo sapiens
tggctgagtggttctggt

SEQ ID NO: 171978 - DNA, 23 bp, Homo sapiens
tgacatggagtttcactctgtca

SEQ ID NO: 171979 - DNA, 23 bp, Homo sapiens
gaaggtgacaaatgagagagagg

SEQ ID NO: 171980 - DNA, 23 bp, Homo sapiens
agagtctcactctgtcacccagg

SEQ ID NO: 171981 - DNA, 18 bp, Homo sapiens
acgggcacatactctagt

SEQ ID NO: 171982 - DNA, 19 bp, Homo sapiens
gactcgcttgaacctgaga

SEQ ID NO: 171983 - DNA, 22 bp, Homo sapiens
agagtgagaccctgtgtcacac

SEQ ID NO: 171984 - DNA, 23 bp, Homo sapiens
gtatagttctgtgaatttgaaca

SEQ ID NO: 171985 - DNA, 23 bp, Homo sapiens
gcttctctcttctgtgtgtctgt

SEQ ID NO: 171986 - DNA, 23 bp, Homo sapiens
ttgattggaatagtttcagaagg

SEQ ID NO: 171987 - DNA, 23 bp, Homo sapiens
aaacagtagtatcattggtcttt

SEQ ID NO: 171988 - DNA, 21 bp, Homo sapiens
acatgtgcacaatgtgcaggt

SEQ ID NO: 171989 - DNA, 23 bp, Homo sapiens
gtggatggtactacaggtgcgaa

SEQ ID NO: 171990 - DNA, 23 bp, Homo sapiens
tggagtctcacactgttgccaag

SEQ ID NO: 171991 - DNA, 23 bp, Homo sapiens
atagtctcactctgtctgttgcc

SEQ ID NO: 171992 - DNA, 21 bp, Homo sapiens
acatctatgctatcactgagt

SEQ ID NO: 171993 - DNA, 19 bp, Homo sapiens
aaataccttgagttggaaa

SEQ ID NO: 171994 - DNA, 23 bp, Homo sapiens
atatatcctgattttcttgtaca

SEQ ID NO: 171995 - DNA, 23 bp, Homo sapiens
tgagttcattgtagattctggat

SEQ ID NO: 171996 - DNA, 23 bp, Homo sapiens
tgagttcattgtagattctggat

SEQ ID NO: 171997 - DNA, 18 bp, Homo sapiens
tagttatttaaaagtgga

SEQ ID NO: 171998 - DNA, 18 bp, Homo sapiens
cagaaaatataatctgaa

SEQ ID NO: 171999 - DNA, 20 bp, Homo sapiens
agaccttgcatcttctggtc

SEQ ID NO: 172000 - DNA, 23 bp, Homo sapiens
tatgagtgagaacacacagtgtt

SEQ ID NO: 172001 - DNA, 22 bp, Homo sapiens
tacaatgtatacatgtattgaa

SEQ ID NO: 172002 - DNA, 21 bp, Homo sapiens
tggagatgcagggctggtgca

SEQ ID NO: 172003 - DNA, 23 bp, Homo sapiens
gacagggtctcactctgtcaccc

SEQ ID NO: 172004 - DNA, 23 bp, Homo sapiens
atacagtatgtagccttttcttt

SEQ ID NO: 172005 - DNA, 23 bp, Homo sapiens
agacagggactcgctctgttgtc

SEQ ID NO: 172006 - DNA, 19 bp, Homo sapiens
tgtgcatatatatatatgt

SEQ ID NO: 172007 - DNA, 23 bp, Homo sapiens
tatgtacgtatatatacgtatat

SEQ ID NO: 172008 - DNA, 22 bp, Homo sapiens
atatttcatatgtagcattcac

SEQ ID NO: 172009 - DNA, 23 bp, Homo sapiens
tgatcatggctcactgcatcctt

SEQ ID NO: 172010 - DNA, 22 bp, Homo sapiens
tacatgtgcacaatgtgcagtt

SEQ ID NO: 172011 - DNA, 23 bp, Homo sapiens
tgagttcattgtagattctggat

SEQ ID NO: 172012 - DNA, 23 bp, Homo sapiens
tgagttcattgtagattctggat

SEQ ID NO: 172013 - DNA, 23 bp, Homo sapiens
agaggctctctgtgtggctcaga

SEQ ID NO: 172014 - DNA, 23 bp, Homo sapiens
gaggctctctgtgtggctcagac

SEQ ID NO: 172015 - DNA, 22 bp, Homo sapiens
ctgactgtctctgtggctctga

SEQ ID NO: 172016 - DNA, 18 bp, Homo sapiens
atatgtgtatatgtatat

SEQ ID NO: 172017 - DNA, 22 bp, Homo sapiens
agtctcactcacacattttggt

SEQ ID NO: 172018 - DNA, 23 bp, Homo sapiens
cactcacagagtgggaaccaagt

SEQ ID NO: 172019 - DNA, 23 bp, Homo sapiens
acctatatagatgattttgtagt

SEQ ID NO: 172020 - DNA, 19 bp, Homo sapiens
tcagtgtgtgagtgaatgg

SEQ ID NO: 172021 - DNA, 23 bp, Homo sapiens
atctcgtctcactacaacctctg

SEQ ID NO: 172022 - DNA, 22 bp, Homo sapiens
acatgtgcacattgtgcaggtt

SEQ ID NO: 172023 - DNA, 23 bp, Homo sapiens
atgtctcagactgtgtgtgtgtg

SEQ ID NO: 172024 - DNA, 23 bp, Homo sapiens
ggagtctcacactgtcacccagg

SEQ ID NO: 172025 - DNA, 19 bp, Homo sapiens
ttacattttagccttaggt

SEQ ID NO: 172026 - DNA, 23 bp, Homo sapiens
tgagagtgtctttgttcatctga

SEQ ID NO: 172027 - DNA, 23 bp, Homo sapiens
tatgctaacagtgtgacttattg

SEQ ID NO: 172028 - DNA, 23 bp, Homo sapiens
agtgtcttagtctgtttttgctg

SEQ ID NO: 172029 - DNA, 19 bp, Homo sapiens
tatgtatatatatatgtat

SEQ ID NO: 172030 - DNA, 23 bp, Homo sapiens
acagggtctcgctctgtcgctca

SEQ ID NO: 172031 - DNA, 23 bp, Homo sapiens
agtagcgtgatcttggctcactg

SEQ ID NO: 172032 - DNA, 23 bp, Homo sapiens
agcagctggtcatgcagtgactc

SEQ ID NO: 172033 - DNA, 23 bp, Homo sapiens
tgagaacattgtttgcacacttt

SEQ ID NO: 172034 - DNA, 23 bp, Homo sapiens
gagacagagtttcgctcttgttg

SEQ ID NO: 172035 - DNA, 23 bp, Homo sapiens
ggagtctcactctgtcacccagg

SEQ ID NO: 172036 - DNA, 23 bp, Homo sapiens
gacagagtctcgctctgtcaccc

SEQ ID NO: 172037 - DNA, 18 bp, Homo sapiens
tctcaagagtgtgaggtc

SEQ ID NO: 172038 - DNA, 23 bp, Homo sapiens
ttgagacacagtcttgatctgtc

SEQ ID NO: 172039 - DNA, 20 bp, Homo sapiens
catctctttgtgggtgtgta

SEQ ID NO: 172040 - DNA, 23 bp, Homo sapiens
tctgagtgtgtatttgccaggat

SEQ ID NO: 172041 - DNA, 23 bp, Homo sapiens
tgtcagaaatgtaagatcataag

SEQ ID NO: 172042 - DNA, 18 bp, Homo sapiens
ctcactctgagagtcagg

SEQ ID NO: 172043 - DNA, 23 bp, Homo sapiens
catgcctctgagagtgagtgcct

SEQ ID NO: 172044 - DNA, 23 bp, Homo sapiens
cggagtctcgctctgtcgctcag

SEQ ID NO: 172045 - DNA, 23 bp, Homo sapiens
aggtttctatagaagaattcaca

SEQ ID NO: 172046 - DNA, 19 bp, Homo sapiens
tgagtctgtagagtgagtg

SEQ ID NO: 172047 - DNA, 23 bp, Homo sapiens
gagactatggcttttctgtttgt

SEQ ID NO: 172048 - DNA, 21 bp, Homo sapiens
acattcaagttcacatacaca

SEQ ID NO: 172049 - DNA, 22 bp, Homo sapiens
tcactctctttgtgtctggcac

SEQ ID NO: 172050 - DNA, 23 bp, Homo sapiens
gagcctctcactctcgctctgtc

SEQ ID NO: 172051 - DNA, 20 bp, Homo sapiens
tgggtccaggcatgtttccc

SEQ ID NO: 172052 - DNA, 23 bp, Homo sapiens
tgagacagagtctcgctctgttg

SEQ ID NO: 172053 - DNA, 21 bp, Homo sapiens
agatatgtatacgtatacata

SEQ ID NO: 172054 - DNA, 22 bp, Homo sapiens
ttgagcactgtctcacgtgtct

SEQ ID NO: 172055 - DNA, 23 bp, Homo sapiens
tgactagtgggtattctgctttt

SEQ ID NO: 172056 - DNA, 20 bp, Homo sapiens
tggcaattactatttgctgt

SEQ ID NO: 172057 - DNA, 23 bp, Homo sapiens
cagggtctctccctctgtcaccc

SEQ ID NO: 172058 - DNA, 23 bp, Homo sapiens
actgagtccctctctgtcaccca

SEQ ID NO: 172059 - DNA, 23 bp, Homo sapiens
tctcactctgtcttatgcccctc

SEQ ID NO: 172060 - DNA, 21 bp, Homo sapiens
cagtggcatgatcatggccca

SEQ ID NO: 172061 - DNA, 23 bp, Homo sapiens
tctccacacttcatggctcactg

SEQ ID NO: 172062 - DNA, 23 bp, Homo sapiens
acagagtctccctctgtcaccca

SEQ ID NO: 172063 - DNA, 20 bp, Homo sapiens
ctctgtggaaataggctgtc

SEQ ID NO: 172064 - DNA, 22 bp, Homo sapiens
agcctgggtgacagagtgcgac

SEQ ID NO: 172065 - DNA, 23 bp, Homo sapiens
tgagatggagtctcactttgttg

SEQ ID NO: 172066 - DNA, 18 bp, Homo sapiens
ccaggcacagtggctcac

SEQ ID NO: 172067 - DNA, 23 bp, Homo sapiens
gcaattgttttgtatatgtatgt

SEQ ID NO: 172068 - DNA, 18 bp, Homo sapiens
agcttccttcctggttct

SEQ ID NO: 172069 - DNA, 23 bp, Homo sapiens
gggtctcactctgtcactcaggc

SEQ ID NO: 172070 - DNA, 23 bp, Homo sapiens
acagagtctcactctgtcgccca

SEQ ID NO: 172071 - DNA, 23 bp, Homo sapiens
ttctttttctgctagttcattat

SEQ ID NO: 172072 - DNA, 22 bp, Homo sapiens
agtagcgtgatcttggctcact

SEQ ID NO: 172073 - DNA, 22 bp, Homo sapiens
cttctctccctctgtcacccag

SEQ ID NO: 172074 - DNA, 23 bp, Homo sapiens
gactgtgactcactctgtcgcca

SEQ ID NO: 172075 - DNA, 23 bp, Homo sapiens
agagtctcactctgtcacccagg

SEQ ID NO: 172076 - DNA, 23 bp, Homo sapiens
tgacagaacagagagaacagagt

SEQ ID NO: 172077 - DNA, 23 bp, Homo sapiens
agctacatctggctactgggtct

SEQ ID NO: 172078 - DNA, 23 bp, Homo sapiens
tgaacctggcatacaatgtagat

SEQ ID NO: 172079 - DNA, 23 bp, Homo sapiens
agctacattgtctgctgggtttc

SEQ ID NO: 172080 - DNA, 23 bp, Homo sapiens
atgcatatgcatatatatgtgta

SEQ ID NO: 172081 - DNA, 23 bp, Homo sapiens
atatgtatatgtatatgtatacg

SEQ ID NO: 172082 - DNA, 23 bp, Homo sapiens
aatgcttccagcttttgctcatt

SEQ ID NO: 172083 - DNA, 23 bp, Homo sapiens
gacagagtctcgctctgtcaccc

SEQ ID NO: 172084 - DNA, 18 bp, Homo sapiens
tgttatcactgtcaagaa

SEQ ID NO: 172085 - DNA, 23 bp, Homo sapiens
gattgagcatctgcatctggtga

SEQ ID NO: 172086 - DNA, 23 bp, Homo sapiens
tgtgtctctgtctttatgtggct

SEQ ID NO: 172087 - DNA, 20 bp, Homo sapiens
aaaactagtcatattggatt

SEQ ID NO: 172088 - DNA, 18 bp, Homo sapiens
agtgctgggattacaggc

SEQ ID NO: 172089 - DNA, 19 bp, Homo sapiens
tgagccactgtacccagcc

SEQ ID NO: 172090 - DNA, 20 bp, Homo sapiens
tgtgcttggctgagtttctt

SEQ ID NO: 172091 - DNA, 23 bp, Homo sapiens
agtcactgagtgagcacatgctg

SEQ ID NO: 172092 - DNA, 23 bp, Homo sapiens
agagtctcactctgtcacccagg

SEQ ID NO: 172093 - DNA, 23 bp, Homo sapiens
gagtctcactctgtcacccaggc

SEQ ID NO: 172094 - DNA, 23 bp, Homo sapiens
ggagtctcactctgtcacgtcag

SEQ ID NO: 172095 - DNA, 23 bp, Homo sapiens
tgagatggagtctcgctctgtca

SEQ ID NO: 172096 - DNA, 23 bp, Homo sapiens
agatggagtctcgctctgtctcc

SEQ ID NO: 172097 - DNA, 23 bp, Homo sapiens
gaagtctctctctgtcacccagg

SEQ ID NO: 172098 - DNA, 22 bp, Homo sapiens
atgtgtgtatatatatatgtat

SEQ ID NO: 172099 - DNA, 19 bp, Homo sapiens
catgtgtatatatatacat

SEQ ID NO: 172100 - DNA, 20 bp, Homo sapiens
ttgaggtaaatttcatgtaa

SEQ ID NO: 172101 - DNA, 23 bp, Homo sapiens
ccttggagagagtaggcagttgg

SEQ ID NO: 172102 - DNA, 20 bp, Homo sapiens
aggtaagctagaaagatgta

SEQ ID NO: 172103 - DNA, 23 bp, Homo sapiens
ttttgagacagactctcactctg

SEQ ID NO: 172104 - DNA, 23 bp, Homo sapiens
gtcactggatgcaactgctattg

SEQ ID NO: 172105 - DNA, 23 bp, Homo sapiens
tatgtctatttgtatctttgtgt

SEQ ID NO: 172106 - DNA, 21 bp, Homo sapiens
tgaggtaggtggatcacttga

SEQ ID NO: 172107 - DNA, 23 bp, Homo sapiens
gggtctcactctgtcactctggt

SEQ ID NO: 172108 - DNA, 23 bp, Homo sapiens
cggagtctcactctgtcacccag

SEQ ID NO: 172109 - DNA, 23 bp, Homo sapiens
gagtctcactctgtcacccaggc

SEQ ID NO: 172110 - DNA, 20 bp, Homo sapiens
ttcagaggccatgtgtccca

SEQ ID NO: 172111 - DNA, 23 bp, Homo sapiens
accttttgcagagtttttgaaga

SEQ ID NO: 172112 - DNA, 23 bp, Homo sapiens
aagactgaagtctgtcagcacag

SEQ ID NO: 172113 - DNA, 23 bp, Homo sapiens
tcatgtacctaaacatgtatatg

SEQ ID NO: 172114 - DNA, 23 bp, Homo sapiens
tgagttcattgtagattctggat

SEQ ID NO: 172115 - DNA, 23 bp, Homo sapiens
tgagttcattgtagattctggat

SEQ ID NO: 172116 - DNA, 22 bp, Homo sapiens
tctttcagtctttttgatgtag

SEQ ID NO: 172117 - DNA, 23 bp, Homo sapiens
tgagtctcactgaactcccatgg

SEQ ID NO: 172118 - DNA, 21 bp, Homo sapiens
tttgaggtaggttcctttgat

SEQ ID NO: 172119 - DNA, 23 bp, Homo sapiens
aggctgacagctgaagacagtct

SEQ ID NO: 172120 - DNA, 19 bp, Homo sapiens
tatgtgtgtacacacacac

SEQ ID NO: 172121 - DNA, 19 bp, Homo sapiens
atctacccaatgcctgtac

SEQ ID NO: 172122 - DNA, 23 bp, Homo sapiens
tgtgtcttgaaagtaactaactt

SEQ ID NO: 172123 - DNA, 23 bp, Homo sapiens
cagactcacagacacaggacagt

SEQ ID NO: 172124 - DNA, 22 bp, Homo sapiens
atttcctggtattgtaagcttt

SEQ ID NO: 172125 - DNA, 23 bp, Homo sapiens
tgcctgtgactggctgactccca

SEQ ID NO: 172126 - DNA, 23 bp, Homo sapiens
ttttgagacggagtcttgctctg

SEQ ID NO: 172127 - DNA, 23 bp, Homo sapiens
tgagttcattgtagattctggat

SEQ ID NO: 172128 - DNA, 23 bp, Homo sapiens
tgagttcattgtagattctggat

SEQ ID NO: 172129 - DNA, 21 bp, Homo sapiens
tgaggtaggaggatcacttga

SEQ ID NO: 172130 - DNA, 22 bp, Homo sapiens
tgtgtgtgtgtgtcagggcctc

SEQ ID NO: 172131 - DNA, 23 bp, Homo sapiens
aaaatgattcttctggcagactc

SEQ ID NO: 172132 - DNA, 22 bp, Homo sapiens
atgatgatgatgatgatgatga

SEQ ID NO: 172133 - DNA, 23 bp, Homo sapiens
gacagagtctcgctctgtcaccc

SEQ ID NO: 172134 - DNA, 23 bp, Homo sapiens
tggtaaatgtagtgcgaccagga

SEQ ID NO: 172135 - DNA, 23 bp, Homo sapiens
caagagtctcactctgtcaccca

SEQ ID NO: 172136 - DNA, 23 bp, Homo sapiens
agtctcactctgtcacccaggct

SEQ ID NO: 172137 - DNA, 23 bp, Homo sapiens
aggcagaatctcactctgtcacc

SEQ ID NO: 172138 - DNA, 23 bp, Homo sapiens
tacagtggcgtgatcttggctct

SEQ ID NO: 172139 - DNA, 20 bp, Homo sapiens
tattgctattttttttgttt

SEQ ID NO: 172140 - DNA, 23 bp, Homo sapiens
atgtagtgatgttcctggagtca

SEQ ID NO: 172141 - DNA, 23 bp, Homo sapiens
tacctctagaacccaaagacagg

SEQ ID NO: 172142 - DNA, 23 bp, Homo sapiens
tgtatatgcatatatatgtgtat

SEQ ID NO: 172143 - DNA, 23 bp, Homo sapiens
cagagtctcactgtgtttcccca

SEQ ID NO: 172144 - DNA, 23 bp, Homo sapiens
tgagacatttttgtttgtttgga

SEQ ID NO: 172145 - DNA, 23 bp, Homo sapiens
gagaaggagcctcactctgtcac

SEQ ID NO: 172146 - DNA, 23 bp, Homo sapiens
tggagtctcactctgtcacccag

SEQ ID NO: 172147 - DNA, 21 bp, Homo sapiens
tatgtgtacatatgtatgtgt

SEQ ID NO: 172148 - DNA, 23 bp, Homo sapiens
atatgtatacatgtatgtgtgtg

SEQ ID NO: 172149 - DNA, 23 bp, Homo sapiens
gacagagtctcgctctgtcaccc

SEQ ID NO: 172150 - DNA, 22 bp, Homo sapiens
taagaggttttggtttgtatct

SEQ ID NO: 172151 - DNA, 23 bp, Homo sapiens
gtgcgtgtgtgtctgtgtgcgtg

SEQ ID NO: 172152 - DNA, 23 bp, Homo sapiens
acaagtgagtgagatgactccag

SEQ ID NO: 172153 - DNA, 23 bp, Homo sapiens
tttgagacggagtctcactctgt

SEQ ID NO: 172154 - DNA, 21 bp, Homo sapiens
agacggcgtctcactctgtcg

SEQ ID NO: 172155 - DNA, 23 bp, Homo sapiens
gactgagtctcgctctgtcaccc

SEQ ID NO: 172156 - DNA, 18 bp, Homo sapiens
ctcacagacacgcactct

SEQ ID NO: 172157 - DNA, 23 bp, Homo sapiens
tcagtgtgtctgtctgtctgtct

SEQ ID NO: 172158 - DNA, 23 bp, Homo sapiens
cgcgctctcagtcgctgtcaccc

SEQ ID NO: 172159 - DNA, 23 bp, Homo sapiens
acacatgtgtctgtcttgttctg

SEQ ID NO: 172160 - DNA, 23 bp, Homo sapiens
tcacccagactgtctgactcttg

SEQ ID NO: 172161 - DNA, 23 bp, Homo sapiens
cctaggcactgccactgctgaga

SEQ ID NO: 172162 - DNA, 23 bp, Homo sapiens
tttgagacggactctcgctctgt

SEQ ID NO: 172163 - DNA, 23 bp, Homo sapiens
tctgtctgagtctgtctcagggg

SEQ ID NO: 172164 - DNA, 22 bp, Homo sapiens
tgcatgtgtgcgtgtgcatgcg

SEQ ID NO: 172165 - DNA, 19 bp, Homo sapiens
ttcacctcttattttcatg

SEQ ID NO: 172166 - DNA, 20 bp, Homo sapiens
tctgttaagtccatttgttc

SEQ ID NO: 172167 - DNA, 23 bp, Homo sapiens
agagtctcactctgtcacccagg

SEQ ID NO: 172168 - DNA, 22 bp, Homo sapiens
tgaggtaggaggatcacttgag

SEQ ID NO: 172169 - DNA, 21 bp, Homo sapiens
actcacagccaagggctgtct

SEQ ID NO: 172170 - DNA, 21 bp, Homo sapiens
tatatacacatatacatatgt

SEQ ID NO: 172171 - DNA, 22 bp, Homo sapiens
tggccaacttgaaggtcccttc

SEQ ID NO: 172172 - DNA, 21 bp, Homo sapiens
aaggaggtcttcatttggctt

SEQ ID NO: 172173 - DNA, 19 bp, Homo sapiens
tgggtgctagtaagaattt

SEQ ID NO: 172174 - DNA, 23 bp, Homo sapiens
ttgtcattttatttgaatgtgta

SEQ ID NO: 172175 - DNA, 18 bp, Homo sapiens
tacatacatatattgtat

SEQ ID NO: 172176 - DNA, 19 bp, Homo sapiens
tgtgtgtgtgtgtgtgtat

SEQ ID NO: 172177 - DNA, 23 bp, Homo sapiens
gaaaatctctttgaaaatgatta

SEQ ID NO: 172178 - DNA, 23 bp, Homo sapiens
atttgagtcaggcattgatggat

SEQ ID NO: 172179 - DNA, 20 bp, Homo sapiens
aaataacagagtctggctgt

SEQ ID NO: 172180 - DNA, 23 bp, Homo sapiens
atgattactctctgtagacattg

SEQ ID NO: 172181 - DNA, 23 bp, Homo sapiens
tatatatgtatgtgtgtatatgt

SEQ ID NO: 172182 - DNA, 23 bp, Homo sapiens
tttcaacaggatttctttggctg

SEQ ID NO: 172183 - DNA, 23 bp, Homo sapiens
tgagagtagactgtgagagctag

SEQ ID NO: 172184 - DNA, 23 bp, Homo sapiens
tgattcagtaattctacttctgg

SEQ ID NO: 172185 - DNA, 18 bp, Homo sapiens
tgtgtgtgtgtgtgtgtg

SEQ ID NO: 172186 - DNA, 20 bp, Homo sapiens
acacacatacatatacatgt

SEQ ID NO: 172187 - DNA, 23 bp, Homo sapiens
tatgtgtgtggttttgagaaatc

SEQ ID NO: 172188 - DNA, 23 bp, Homo sapiens
ttgcactgtgatctgagaatgtg

SEQ ID NO: 172189 - DNA, 18 bp, Homo sapiens
aatttttcttgagtgggg

SEQ ID NO: 172190 - DNA, 23 bp, Homo sapiens
aatagggtctcactctgtcacct

SEQ ID NO: 172191 - DNA, 18 bp, Homo sapiens
gatgtacatatttgtttt

SEQ ID NO: 172192 - DNA, 23 bp, Homo sapiens
atactgacagctaaaatcgtcag

SEQ ID NO: 172193 - DNA, 23 bp, Homo sapiens
atagttctccattgtgtatatgt

SEQ ID NO: 172194 - DNA, 21 bp, Homo sapiens
acatgtgcacaatgtgcaggt

SEQ ID NO: 172195 - DNA, 23 bp, Homo sapiens
tatgtgtgtgtatatgtatgtgt

SEQ ID NO: 172196 - DNA, 20 bp, Homo sapiens
agtaagactctcttttttca

SEQ ID NO: 172197 - DNA, 23 bp, Homo sapiens
actgagtctcactctgtggccca

SEQ ID NO: 172198 - DNA, 23 bp, Homo sapiens
tccctgtgtggctgggtccctgg

SEQ ID NO: 172199 - DNA, 23 bp, Homo sapiens
tatatatgtagatatacatatgt

SEQ ID NO: 172200 - DNA, 19 bp, Homo sapiens
tatgtatatatatatatgt

SEQ ID NO: 172201 - DNA, 20 bp, Homo sapiens
atatgtatatatatatatgt

SEQ ID NO: 172202 - DNA, 20 bp, Homo sapiens
cagagatcagtatctgtact

SEQ ID NO: 172203 - DNA, 20 bp, Homo sapiens
tctcactgtctgtttcttgg

SEQ ID NO: 172204 - DNA, 21 bp, Homo sapiens
tttgtgtatatatatacagat

SEQ ID NO: 172205 - DNA, 23 bp, Homo sapiens
tatagtgtgtgtgtttatgtata

SEQ ID NO: 172206 - DNA, 22 bp, Homo sapiens
ttgagacagagtttcgctctgt

SEQ ID NO: 172207 - DNA, 23 bp, Homo sapiens
tgagttcattgtagattctggat

SEQ ID NO: 172208 - DNA, 23 bp, Homo sapiens
tgagttcattgtagattctggat

SEQ ID NO: 172209 - DNA, 19 bp, Homo sapiens
tgtagtatacttactatga

SEQ ID NO: 172210 - DNA, 22 bp, Homo sapiens
tgtcagcgaagagaaagggaaa

SEQ ID NO: 172211 - DNA, 20 bp, Homo sapiens
cagcttgttgcttgaaatgt

SEQ ID NO: 172212 - DNA, 23 bp, Homo sapiens
tgagacagagtctggctctgtcg

SEQ ID NO: 172213 - DNA, 23 bp, Homo sapiens
actgagtctcactctgtcgccca

SEQ ID NO: 172214 - DNA, 21 bp, Homo sapiens
acatgtgcacaatgtgcaggt

SEQ ID NO: 172215 - DNA, 23 bp, Homo sapiens
catgaccaaatcatatgtatatg

SEQ ID NO: 172216 - DNA, 23 bp, Homo sapiens
tatacatacatatacatatgatt

SEQ ID NO: 172217 - DNA, 21 bp, Homo sapiens
acttctctgatgattagtgat

SEQ ID NO: 172218 - DNA, 22 bp, Homo sapiens
tctgaaaagtgtctgttaatgt

SEQ ID NO: 172219 - DNA, 23 bp, Homo sapiens
tttttcttggtaatgctttgttt

SEQ ID NO: 172220 - DNA, 23 bp, Homo sapiens
ttttcagaagaaaatcagctaag

SEQ ID NO: 172221 - DNA, 23 bp, Homo sapiens
attttgaggaacctctatactgt

SEQ ID NO: 172222 - DNA, 22 bp, Homo sapiens
ttggatgtgcatggatgtgtat

SEQ ID NO: 172223 - DNA, 23 bp, Homo sapiens
atatgtgtatatatatgtgtgtg

SEQ ID NO: 172224 - DNA, 20 bp, Homo sapiens
cagtgctattgatttgtgta

SEQ ID NO: 172225 - DNA, 19 bp, Homo sapiens
atatgtgtgtatctatata

SEQ ID NO: 172226 - DNA, 20 bp, Homo sapiens
atatgcaatatgaaggtatg

SEQ ID NO: 172227 - DNA, 23 bp, Homo sapiens
tatgcatacatatgtgtatctat

SEQ ID NO: 172228 - DNA, 18 bp, Homo sapiens
tcttttactctttctaag

SEQ ID NO: 172229 - DNA, 23 bp, Homo sapiens
tgagttcattgtagattctggat

SEQ ID NO: 172230 - DNA, 23 bp, Homo sapiens
tgagttcattgtagattctggat

SEQ ID NO: 172231 - DNA, 23 bp, Homo sapiens
ctgactcatttactctctgcttt

SEQ ID NO: 172232 - DNA, 22 bp, Homo sapiens
taaaaagcaaaatgtggagtga

SEQ ID NO: 172233 - DNA, 21 bp, Homo sapiens
tatgtatacatgcatatatgt

SEQ ID NO: 172234 - DNA, 23 bp, Homo sapiens
gacagagtctcgctctgtcaccc

SEQ ID NO: 172235 - DNA, 23 bp, Homo sapiens
acagagtctcgctctgtcaccca

SEQ ID NO: 172236 - DNA, 22 bp, Homo sapiens
tatatgtgtgtatatatggtgt

SEQ ID NO: 172237 - DNA, 23 bp, Homo sapiens
acacagatttctgggtctcactc

SEQ ID NO: 172238 - DNA, 23 bp, Homo sapiens
aaaatggatcaggatttgaaaac

SEQ ID NO: 172239 - DNA, 21 bp, Homo sapiens
tggagtctcactgtgtcaccc

SEQ ID NO: 172240 - DNA, 23 bp, Homo sapiens
gacagagtctcgctctgtcaccc

SEQ ID NO: 172241 - DNA, 21 bp, Homo sapiens
tacagaggtatattgtaatca

SEQ ID NO: 172242 - DNA, 23 bp, Homo sapiens
ttagttgttaatctcttactatg

SEQ ID NO: 172243 - DNA, 22 bp, Homo sapiens
tctagtgtatatagggttaggt

SEQ ID NO: 172244 - DNA, 23 bp, Homo sapiens
tgtattgtgtataggtaccatat

SEQ ID NO: 172245 - DNA, 22 bp, Homo sapiens
acatgtgcacattgtgcaggtt

SEQ ID NO: 172246 - DNA, 23 bp, Homo sapiens
aaatcacacgcattttcatttta

SEQ ID NO: 172247 - DNA, 23 bp, Homo sapiens
tgtggttttatctccctttgtat

SEQ ID NO: 172248 - DNA, 23 bp, Homo sapiens
aattcatgtagcagtttctatat

SEQ ID NO: 172249 - DNA, 23 bp, Homo sapiens
tttgtgcaggaagagcaggataa

SEQ ID NO: 172250 - DNA, 18 bp, Homo sapiens
atctaggaagttcttgag

SEQ ID NO: 172251 - DNA, 23 bp, Homo sapiens
taatatttgctttatatatctgt

SEQ ID NO: 172252 - DNA, 21 bp, Homo sapiens
tgagtgcatatataattgtta

SEQ ID NO: 172253 - DNA, 19 bp, Homo sapiens
tattgattgcaaaactgtt

SEQ ID NO: 172254 - DNA, 23 bp, Homo sapiens
tacatatatgtgtgtgtgtatat

SEQ ID NO: 172255 - DNA, 21 bp, Homo sapiens
acacatgtgttcttgtatatg

SEQ ID NO: 172256 - DNA, 21 bp, Homo sapiens
tatgtatgtatgtatgtatgt

SEQ ID NO: 172257 - DNA, 19 bp, Homo sapiens
tgtatgtatgtatttgaga

SEQ ID NO: 172258 - DNA, 23 bp, Homo sapiens
ttttggagttgaagggaatgagt

SEQ ID NO: 172259 - DNA, 22 bp, Homo sapiens
tatatggttatatatacagata

SEQ ID NO: 172260 - DNA, 19 bp, Homo sapiens
aagttgtacaggatgaaca

SEQ ID NO: 172261 - DNA, 21 bp, Homo sapiens
acatgtgcacaatgtgcaggt

SEQ ID NO: 172262 - DNA, 23 bp, Homo sapiens
gtgtgtctgtaaagtatgtgtgt

SEQ ID NO: 172263 - DNA, 21 bp, Homo sapiens
attgtgtcaaggacatttttg

SEQ ID NO: 172264 - DNA, 23 bp, Homo sapiens
actctcccactcacatcttggct

SEQ ID NO: 172265 - DNA, 23 bp, Homo sapiens
aggagatgagtttgtaggctaag

SEQ ID NO: 172266 - DNA, 19 bp, Homo sapiens
tgagatctttttagattct

SEQ ID NO: 172267 - DNA, 22 bp, Homo sapiens
aaggatgtgatattgtttttga

SEQ ID NO: 172268 - DNA, 21 bp, Homo sapiens
tacgtgtgtgtatatatatac

SEQ ID NO: 172269 - DNA, 19 bp, Homo sapiens
atatacacacacgtatata

SEQ ID NO: 172270 - DNA, 22 bp, Homo sapiens
agactgcatgctctaactctgg

SEQ ID NO: 172271 - DNA, 22 bp, Homo sapiens
aggaacccactgttctgggttg

SEQ ID NO: 172272 - DNA, 23 bp, Homo sapiens
gaagactagaaggagacattttt

SEQ ID NO: 172273 - DNA, 23 bp, Homo sapiens
tgagactgagtctcgctctgtcg

SEQ ID NO: 172274 - DNA, 22 bp, Homo sapiens
agtgagggtcatattgctctat

SEQ ID NO: 172275 - DNA, 23 bp, Homo sapiens
atatgtgtgtgtatatgtatgtg

SEQ ID NO: 172276 - DNA, 20 bp, Homo sapiens
atatgtatatgtatatatgt

SEQ ID NO: 172277 - DNA, 22 bp, Homo sapiens
taactttttttttttagcttct

SEQ ID NO: 172278 - DNA, 22 bp, Homo sapiens
tagaagcaaatgaagattggtg

SEQ ID NO: 172279 - DNA, 23 bp, Homo sapiens
agatatgttgatgtaagtgtatt

SEQ ID NO: 172280 - DNA, 23 bp, Homo sapiens
tgagatggagtctcgctctgtca

SEQ ID NO: 172281 - DNA, 18 bp, Homo sapiens
tctgtgtgtctttttttt

SEQ ID NO: 172282 - DNA, 22 bp, Homo sapiens
ttctttatttttctatatgctt

SEQ ID NO: 172283 - DNA, 23 bp, Homo sapiens
tgagttcattgtagattctggat

SEQ ID NO: 172284 - DNA, 23 bp, Homo sapiens
tgagttcattgtagattctggat

SEQ ID NO: 172285 - DNA, 23 bp, Homo sapiens
atatgtgtatatatgtgtgtgtg

SEQ ID NO: 172286 - DNA, 23 bp, Homo sapiens
catatgtatacatagatgtatac

SEQ ID NO: 172287 - DNA, 19 bp, Homo sapiens
acatatatgtatatatgta

SEQ ID NO: 172288 - DNA, 20 bp, Homo sapiens
tgtgtgtctgtcatcaaaca

SEQ ID NO: 172289 - DNA, 22 bp, Homo sapiens
ctgtatcttgatgacagtgcat

SEQ ID NO: 172290 - DNA, 23 bp, Homo sapiens
tataatccacatattcatgttat

SEQ ID NO: 172291 - DNA, 23 bp, Homo sapiens
tatatgtgtgtatatgtatatta

SEQ ID NO: 172292 - DNA, 20 bp, Homo sapiens
gtgagtatatttgtaactgg

SEQ ID NO: 172293 - DNA, 21 bp, Homo sapiens
cactaacagcctttctgatga

SEQ ID NO: 172294 - DNA, 23 bp, Homo sapiens
tattatggttctgaatggtttca

SEQ ID NO: 172295 - DNA, 22 bp, Homo sapiens
gttctgtctcagttattttgtc

SEQ ID NO: 172296 - DNA, 22 bp, Homo sapiens
acacgcacacacacacactcac

SEQ ID NO: 172297 - DNA, 22 bp, Homo sapiens
gagtgtttacacagtttcagaa

SEQ ID NO: 172298 - DNA, 23 bp, Homo sapiens
tttgatgttcttcttgtctgaac

SEQ ID NO: 172299 - DNA, 18 bp, Homo sapiens
tatcactatgtttatgca

SEQ ID NO: 172300 - DNA, 19 bp, Homo sapiens
aagcaagctaggtgctggt

SEQ ID NO: 172301 - DNA, 23 bp, Homo sapiens
tgcttaacaatgtgcatcctcag

SEQ ID NO: 172302 - DNA, 23 bp, Homo sapiens
tgagttcattgtagattctggat

SEQ ID NO: 172303 - DNA, 21 bp, Homo sapiens
tctcactctgtcacccaggct

SEQ ID NO: 172304 - DNA, 23 bp, Homo sapiens
tgagttcattgtagattctggat

SEQ ID NO: 172305 - DNA, 23 bp, Homo sapiens
tgagttcattgtagattctggat

SEQ ID NO: 172306 - DNA, 19 bp, Homo sapiens
atgtcattatacatatgtg

SEQ ID NO: 172307 - DNA, 22 bp, Homo sapiens
tctcactgtgtgtctctcctat

SEQ ID NO: 172308 - DNA, 18 bp, Homo sapiens
atatgtatacatatgtat

SEQ ID NO: 172309 - DNA, 21 bp, Homo sapiens
atacgtatatgtgcatacata

SEQ ID NO: 172310 - DNA, 22 bp, Homo sapiens
aaaagaactctggagattggtt

SEQ ID NO: 172311 - DNA, 18 bp, Homo sapiens
tatgtatattatatatgc

SEQ ID NO: 172312 - DNA, 23 bp, Homo sapiens
atatgtttgcttaactaggaaat

SEQ ID NO: 172313 - DNA, 18 bp, Homo sapiens
tgtagtcctagctactcc

SEQ ID NO: 172314 - DNA, 21 bp, Homo sapiens
aagaagttgaggctgaggtga

SEQ ID NO: 172315 - DNA, 19 bp, Homo sapiens
ttctctgtgtttgctcatg

SEQ ID NO: 172316 - DNA, 22 bp, Homo sapiens
tttgtgggtacatagtaggtgt

SEQ ID NO: 172317 - DNA, 23 bp, Homo sapiens
atctatatgtgtgtgttaatgta

SEQ ID NO: 172318 - DNA, 19 bp, Homo sapiens
tcatgtagtaacatatata

SEQ ID NO: 172319 - DNA, 23 bp, Homo sapiens
tgtgtgtagatctatgtgtgtgt

SEQ ID NO: 172320 - DNA, 22 bp, Homo sapiens
tatgtgtatatgtatatatgac

SEQ ID NO: 172321 - DNA, 22 bp, Homo sapiens
tatgtgtatatgtatatatgac

SEQ ID NO: 172322 - DNA, 23 bp, Homo sapiens
atatgtgtatatgtatatatgac

SEQ ID NO: 172323 - DNA, 23 bp, Homo sapiens
atatgtgtatatgtatatatgac

SEQ ID NO: 172324 - DNA, 21 bp, Homo sapiens
tatgtgtatatgtatatgtat

SEQ ID NO: 172325 - DNA, 23 bp, Homo sapiens
ataagacatatacatgtgtgtgt

SEQ ID NO: 172326 - DNA, 23 bp, Homo sapiens
aggagatagtccacttagattgt

SEQ ID NO: 172327 - DNA, 23 bp, Homo sapiens
ttttttaggtggagtctcgctct

SEQ ID NO: 172328 - DNA, 19 bp, Homo sapiens
atataatatgtatacatat

SEQ ID NO: 172329 - DNA, 23 bp, Homo sapiens
tgaagcttctatatcatatgata

SEQ ID NO: 172330 - DNA, 21 bp, Homo sapiens
taatatagtagcttcagatat

SEQ ID NO: 172331 - DNA, 23 bp, Homo sapiens
acggagtctcactctgtctccag

SEQ ID NO: 172332 - DNA, 18 bp, Homo sapiens
acagtggtgtgatctcag

SEQ ID NO: 172333 - DNA, 22 bp, Homo sapiens
atgtgtatacatacatatatgt

SEQ ID NO: 172334 - DNA, 22 bp, Homo sapiens
acatatggatatatatgcgtat

SEQ ID NO: 172335 - DNA, 22 bp, Homo sapiens
tatttacatatgtttatgtata

SEQ ID NO: 172336 - DNA, 22 bp, Homo sapiens
catatatacatatgtttgtgta

SEQ ID NO: 172337 - DNA, 20 bp, Homo sapiens
tgtccatatatatagataga

SEQ ID NO: 172338 - DNA, 21 bp, Homo sapiens
atacacacacatatatgtatg

SEQ ID NO: 172339 - DNA, 23 bp, Homo sapiens
agacaatagctttatgagaaaaa

SEQ ID NO: 172340 - DNA, 21 bp, Homo sapiens
tttctcaattggaatttgtct

SEQ ID NO: 172341 - DNA, 21 bp, Homo sapiens
atattcatgaaaaccatgtga

SEQ ID NO: 172342 - DNA, 22 bp, Homo sapiens
tgagttgtacgtgtgtatgtat

SEQ ID NO: 172343 - DNA, 23 bp, Homo sapiens
ttgtgtgtctgtgtatgttgact

SEQ ID NO: 172344 - DNA, 23 bp, Homo sapiens
acaaggtctcactctgtcaccca

SEQ ID NO: 172345 - DNA, 23 bp, Homo sapiens
agaaaatagggaagagacttggt

SEQ ID NO: 172346 - DNA, 23 bp, Homo sapiens
acacagtcactctttatgtgtct

SEQ ID NO: 172347 - DNA, 22 bp, Homo sapiens
atatatgtacatatcatatgta

SEQ ID NO: 172348 - DNA, 21 bp, Homo sapiens
atatatgtatatatgtatgtt

SEQ ID NO: 172349 - DNA, 18 bp, Homo sapiens
tgtgtacatatgtatatg

SEQ ID NO: 172350 - DNA, 22 bp, Homo sapiens
taatatgcatatataatctgta

SEQ ID NO: 172351 - DNA, 22 bp, Homo sapiens
agatatgtatttatatatgtgt

SEQ ID NO: 172352 - DNA, 23 bp, Homo sapiens
tgtacataccatatgtatagata

SEQ ID NO: 172353 - DNA, 23 bp, Homo sapiens
tatatctatatgaataactgtgc

SEQ ID NO: 172354 - DNA, 23 bp, Homo sapiens
accaagttcatataggtgtataa

SEQ ID NO: 172355 - DNA, 23 bp, Homo sapiens
tgtgtgtgtgtgtgtgcatgtgt

SEQ ID NO: 172356 - DNA, 23 bp, Homo sapiens
cgtgtgtgtgtgtgtgcgcgcgt

SEQ ID NO: 172357 - DNA, 23 bp, Homo sapiens
acactgcatgtacaatataaatg

SEQ ID NO: 172358 - DNA, 23 bp, Homo sapiens
attagaggaattacattttataa

SEQ ID NO: 172359 - DNA, 23 bp, Homo sapiens
tgagttcattgtagattctggat

SEQ ID NO: 172360 - DNA, 23 bp, Homo sapiens
tgagttcattgtagattctggat

SEQ ID NO: 172361 - DNA, 22 bp, Homo sapiens
tgagtgggcatttttattcttt

SEQ ID NO: 172362 - DNA, 23 bp, Homo sapiens
tgtgtgagatgtgtgtatgtgtg

SEQ ID NO: 172363 - DNA, 23 bp, Homo sapiens
catatgtatatatgtgtatgtat

SEQ ID NO: 172364 - DNA, 23 bp, Homo sapiens
tatatgcatgtgtatgtatacat

SEQ ID NO: 172365 - DNA, 20 bp, Homo sapiens
tgtgtgtgtgtgtatatata

SEQ ID NO: 172366 - DNA, 23 bp, Homo sapiens
tctgtctgtctgtctgtctctca

SEQ ID NO: 172367 - DNA, 22 bp, Homo sapiens
atgtgtatatatatgtgtgtgt

SEQ ID NO: 172368 - DNA, 21 bp, Homo sapiens
tgtatgtatatgtatatgtat

SEQ ID NO: 172369 - DNA, 21 bp, Homo sapiens
accaatatatatatgtgtgta

SEQ ID NO: 172370 - DNA, 21 bp, Homo sapiens
aagttctttggggaaggaggt

SEQ ID NO: 172371 - DNA, 21 bp, Homo sapiens
atcctgtgattctgttggctt

SEQ ID NO: 172372 - DNA, 19 bp, Homo sapiens
acgttctaagaaaaagtgt

SEQ ID NO: 172373 - DNA, 21 bp, Homo sapiens
tgaggtaggaggatcatttgt

SEQ ID NO: 172374 - DNA, 21 bp, Homo sapiens
tctcactctgtcaccagcgtg

SEQ ID NO: 172375 - DNA, 22 bp, Homo sapiens
ctcactgacaatgcacctagtc

SEQ ID NO: 172376 - DNA, 23 bp, Homo sapiens
atatatgtatatgtgtgtgtgtg

SEQ ID NO: 172377 - DNA, 23 bp, Homo sapiens
ggtggttgtctgtgcttatttct

SEQ ID NO: 172378 - DNA, 23 bp, Homo sapiens
agatggagtctcactctgtcacc

SEQ ID NO: 172379 - DNA, 19 bp, Homo sapiens
ttttatgacgtaaaggttt

SEQ ID NO: 172380 - DNA, 23 bp, Homo sapiens
tataatctatatgtatatgtgtt

SEQ ID NO: 172381 - DNA, 23 bp, Homo sapiens
gctcactgtggtgtctgtgcaga

SEQ ID NO: 172382 - DNA, 23 bp, Homo sapiens
cagggtctcactctgtctccaag

SEQ ID NO: 172383 - DNA, 18 bp, Homo sapiens
tgacagtaatactgtttt

SEQ ID NO: 172384 - DNA, 23 bp, Homo sapiens
agacagtgtcactctgtctccca

SEQ ID NO: 172385 - DNA, 23 bp, Homo sapiens
tcaaactggaaacattttacatt

SEQ ID NO: 172386 - DNA, 23 bp, Homo sapiens
taagagatttgttgatgttttca

SEQ ID NO: 172387 - DNA, 23 bp, Homo sapiens
tttaactcagatagggaatgtgg

SEQ ID NO: 172388 - DNA, 20 bp, Homo sapiens
attattcattgtttatctga

SEQ ID NO: 172389 - DNA, 23 bp, Homo sapiens
ttttggtaggaattgcattgaat

SEQ ID NO: 172390 - DNA, 23 bp, Homo sapiens
tgagttcattgtagattctggat

SEQ ID NO: 172391 - DNA, 23 bp, Homo sapiens
tgagttcattgtagattctggat

SEQ ID NO: 172392 - DNA, 23 bp, Homo sapiens
gacagagtctcgctctgtcaccc

SEQ ID NO: 172393 - DNA, 23 bp, Homo sapiens
acagagtctcgctctgtcaccca

SEQ ID NO: 172394 - DNA, 18 bp, Homo sapiens
tagtgagttactgaaaaa

SEQ ID NO: 172395 - DNA, 23 bp, Homo sapiens
agagtctcactctgtcacccagg

SEQ ID NO: 172396 - DNA, 23 bp, Homo sapiens
acctgtcttctgtgtcactcagc

SEQ ID NO: 172397 - DNA, 23 bp, Homo sapiens
gactctgtttgactctcccactg

SEQ ID NO: 172398 - DNA, 21 bp, Homo sapiens
aggatagctcaggagtctgga

SEQ ID NO: 172399 - DNA, 23 bp, Homo sapiens
gttttgagacaggtcttgctctg

SEQ ID NO: 172400 - DNA, 23 bp, Homo sapiens
tacatcgatgtatatgtgtgtgt

SEQ ID NO: 172401 - DNA, 23 bp, Homo sapiens
atatacatcatgtatatatgtgt

SEQ ID NO: 172402 - DNA, 21 bp, Homo sapiens
acagtttggaaatgcaatcta

SEQ ID NO: 172403 - DNA, 20 bp, Homo sapiens
atatgtttgtgtgtatgtgt

SEQ ID NO: 172404 - DNA, 23 bp, Homo sapiens
aagggtctggatatcttggggtt

SEQ ID NO: 172405 - DNA, 23 bp, Homo sapiens
ttttgagacggagtctcactctc

SEQ ID NO: 172406 - DNA, 23 bp, Homo sapiens
gatacatgtgcaggatgtgcagg

SEQ ID NO: 172407 - DNA, 23 bp, Homo sapiens
gtttgtgtcagagtcagtgtctc

SEQ ID NO: 172408 - DNA, 23 bp, Homo sapiens
acagaatctatgttcctgtgttt

SEQ ID NO: 172409 - DNA, 20 bp, Homo sapiens
acacacacacatatgcatat

SEQ ID NO: 172410 - DNA, 23 bp, Homo sapiens
tcttttctcagcctcctttgcag

SEQ ID NO: 172411 - DNA, 21 bp, Homo sapiens
agttccagccaaagagatgtg

SEQ ID NO: 172412 - DNA, 23 bp, Homo sapiens
tactaagtggtactgtatactat

SEQ ID NO: 172413 - DNA, 18 bp, Homo sapiens
accattacatagatgtgt

SEQ ID NO: 172414 - DNA, 21 bp, Homo sapiens
ctctatctcttattcgttttg

SEQ ID NO: 172415 - DNA, 18 bp, Homo sapiens
acaccaatgtgaatgata

SEQ ID NO: 172416 - DNA, 23 bp, Homo sapiens
ctctctcatacacaccttctctt

SEQ ID NO: 172417 - DNA, 22 bp, Homo sapiens
ttattgttgattgctgtttggt

SEQ ID NO: 172418 - DNA, 23 bp, Homo sapiens
attctctctctctttgtgctaag

SEQ ID NO: 172419 - DNA, 20 bp, Homo sapiens
ttatgtaatatatattatgt

SEQ ID NO: 172420 - DNA, 22 bp, Homo sapiens
atgcctgtagtctcagctactt

SEQ ID NO: 172421 - DNA, 23 bp, Homo sapiens
tgagttcattgtagattctggat

SEQ ID NO: 172422 - DNA, 23 bp, Homo sapiens
tgagttcattgtagattctggat

SEQ ID NO: 172423 - DNA, 22 bp, Homo sapiens
tttatatctgtatatcaaggga

SEQ ID NO: 172424 - DNA, 23 bp, Homo sapiens
tgagttcattgtagattctggat

SEQ ID NO: 172425 - DNA, 23 bp, Homo sapiens
tgagttcattgtagattctggat

SEQ ID NO: 172426 - DNA, 21 bp, Homo sapiens
atttctgatgatagagaggac

SEQ ID NO: 172427 - DNA, 23 bp, Homo sapiens
tggaactgagagtctattggggt

SEQ ID NO: 172428 - DNA, 23 bp, Homo sapiens
tgagttcattgtagattctggat

SEQ ID NO: 172429 - DNA, 21 bp, Homo sapiens
aaagttttgctcttgttgccc

SEQ ID NO: 172430 - DNA, 23 bp, Homo sapiens
tgagttcattgtagattctggat

SEQ ID NO: 172431 - DNA, 23 bp, Homo sapiens
tgagttcattgtagattctggat

SEQ ID NO: 172432 - DNA, 23 bp, Homo sapiens
tttagaactgtttttcatgtatt

SEQ ID NO: 172433 - DNA, 23 bp, Homo sapiens
gagtctcacactgtcacccaggc

SEQ ID NO: 172434 - DNA, 23 bp, Homo sapiens
gagtgtctcactctgtccctgag

SEQ ID NO: 172435 - DNA, 20 bp, Homo sapiens
ttctgagcctgtctttgttg

SEQ ID NO: 172436 - DNA, 21 bp, Homo sapiens
cagacagtgtcagtgactcag

SEQ ID NO: 172437 - DNA, 22 bp, Homo sapiens
aggtatgtactcatgtatggag

SEQ ID NO: 172438 - DNA, 20 bp, Homo sapiens
tttttctctgtgagttgttc

SEQ ID NO: 172439 - DNA, 23 bp, Homo sapiens
tgtgtgtgtgtgtatttagacat

SEQ ID NO: 172440 - DNA, 22 bp, Homo sapiens
agacttagatatggcattgcta

SEQ ID NO: 172441 - DNA, 19 bp, Homo sapiens
taaagtatcagagagagaa

SEQ ID NO: 172442 - DNA, 23 bp, Homo sapiens
attttagatgaagtcttgctgtg

SEQ ID NO: 172443 - DNA, 23 bp, Homo sapiens
acagagtctcactctgtcgccca

SEQ ID NO: 172444 - DNA, 23 bp, Homo sapiens
tgagtctcactctgtcacccagg

SEQ ID NO: 172445 - DNA, 22 bp, Homo sapiens
aagaatatttgaatctcctgag

SEQ ID NO: 172446 - DNA, 21 bp, Homo sapiens
ttgtgcttgtagttaaaatat

SEQ ID NO: 172447 - DNA, 23 bp, Homo sapiens
tacagcatcaagaagtcagagca

SEQ ID NO: 172448 - DNA, 23 bp, Homo sapiens
tcctcactgtgaagaaatcttat

SEQ ID NO: 172449 - DNA, 19 bp, Homo sapiens
agatagatagatataatgt

SEQ ID NO: 172450 - DNA, 23 bp, Homo sapiens
tatcagtcacactttctttttct

SEQ ID NO: 172451 - DNA, 22 bp, Homo sapiens
atatgtgtatacatatatatgt

SEQ ID NO: 172452 - DNA, 22 bp, Homo sapiens
tttgagacagagtctcacctgt

SEQ ID NO: 172453 - DNA, 23 bp, Homo sapiens
ttatggtactagcatgtttagtt

SEQ ID NO: 172454 - DNA, 23 bp, Homo sapiens
ttcctagagaggctgtactattg

SEQ ID NO: 172455 - DNA, 23 bp, Homo sapiens
cagggtttcactctgtcactcag

SEQ ID NO: 172456 - DNA, 19 bp, Homo sapiens
tgcaatggagtgatctctg

SEQ ID NO: 172457 - DNA, 20 bp, Homo sapiens
accttcttcacatggcagca

SEQ ID NO: 172458 - DNA, 21 bp, Homo sapiens
tctgtagagtctcagcactgt

SEQ ID NO: 172459 - DNA, 22 bp, Homo sapiens
tcaccctgtgtgtgtctgctga

SEQ ID NO: 172460 - DNA, 23 bp, Homo sapiens
aaggtgattctcagatactctgt

SEQ ID NO: 172461 - DNA, 20 bp, Homo sapiens
tgtgtatatatatacgtata

SEQ ID NO: 172462 - DNA, 19 bp, Homo sapiens
aaatccttatgtttatggt

SEQ ID NO: 172463 - DNA, 20 bp, Homo sapiens
agagtgagaccctgtctcaa

SEQ ID NO: 172464 - DNA, 23 bp, Homo sapiens
ttttgagacagagtctcgctctg

SEQ ID NO: 172465 - DNA, 21 bp, Homo sapiens
aatacctttattttaaaatga

SEQ ID NO: 172466 - DNA, 20 bp, Homo sapiens
tttgggagtaggagaatttt

SEQ ID NO: 172467 - DNA, 23 bp, Homo sapiens
agcaagaaagtttatttttttct

SEQ ID NO: 172468 - DNA, 23 bp, Homo sapiens
tttggcagtcaggtttccaggta

SEQ ID NO: 172469 - DNA, 23 bp, Homo sapiens
tatcactctcatgagattgggtt

SEQ ID NO: 172470 - DNA, 23 bp, Homo sapiens
tgtgtgcatgtatgtgtgtgtgt

SEQ ID NO: 172471 - DNA, 18 bp, Homo sapiens
tcacacatgtatctgcag

SEQ ID NO: 172472 - DNA, 23 bp, Homo sapiens
atgtgtgtgtatatatatgtgtg

SEQ ID NO: 172473 - DNA, 23 bp, Homo sapiens
acagagtcacgctctgtcaccca

SEQ ID NO: 172474 - DNA, 23 bp, Homo sapiens
acactttctgtctctatttattt

SEQ ID NO: 172475 - DNA, 21 bp, Homo sapiens
taagtggcagttattattttg

SEQ ID NO: 172476 - DNA, 23 bp, Homo sapiens
taacttgaacaggagctgggctg

SEQ ID NO: 172477 - DNA, 23 bp, Homo sapiens
agtcgttttgtgtatgtttgcct

SEQ ID NO: 172478 - DNA, 23 bp, Homo sapiens
ttatttttgtgcatgtgcaggtt

SEQ ID NO: 172479 - DNA, 23 bp, Homo sapiens
gatggagtctcactctgtctcca

SEQ ID NO: 172480 - DNA, 21 bp, Homo sapiens
tagattggaatattgtggctt

SEQ ID NO: 172481 - DNA, 23 bp, Homo sapiens
tgagttcattgtagattctggat

SEQ ID NO: 172482 - DNA, 22 bp, Homo sapiens
tatgactgactggtactctttt

SEQ ID NO: 172483 - DNA, 22 bp, Homo sapiens
aaactacgtggcaattctgact

SEQ ID NO: 172484 - DNA, 22 bp, Homo sapiens
agatacttcatgtgagtggaat

SEQ ID NO: 172485 - DNA, 23 bp, Homo sapiens
tttacttagcataatgtccttga

SEQ ID NO: 172486 - DNA, 22 bp, Homo sapiens
ctatgtgcctccctgtttgcca

SEQ ID NO: 172487 - DNA, 20 bp, Homo sapiens
aatgaagtccttgccctcat

SEQ ID NO: 172488 - DNA, 23 bp, Homo sapiens
ttctgtgtgtgcatgtgcatggg

SEQ ID NO: 172489 - DNA, 23 bp, Homo sapiens
tttttgtttattttgcatggcaa

SEQ ID NO: 172490 - DNA, 22 bp, Homo sapiens
aacagacaacccacagagtggg

SEQ ID NO: 172491 - DNA, 23 bp, Homo sapiens
aagaagctgaatttggaaagagt

SEQ ID NO: 172492 - DNA, 21 bp, Homo sapiens
tagcattttgtagctgacatg

SEQ ID NO: 172493 - DNA, 22 bp, Homo sapiens
tgtgtctggatgggaagtggag

SEQ ID NO: 172494 - DNA, 23 bp, Homo sapiens
taaggatatatatgcaatatgta

SEQ ID NO: 172495 - DNA, 19 bp, Homo sapiens
acagtctgatgggctgtgt

SEQ ID NO: 172496 - DNA, 19 bp, Homo sapiens
tgtatgcagattttgtatc

SEQ ID NO: 172497 - DNA, 21 bp, Homo sapiens
tttactgaatttgtttatcag

SEQ ID NO: 172498 - DNA, 19 bp, Homo sapiens
taagtggggtgacaatttg

SEQ ID NO: 172499 - DNA, 23 bp, Homo sapiens
gcctctcactgcctctttatagc

SEQ ID NO: 172500 - DNA, 20 bp, Homo sapiens
tgacaggagagactctggac

SEQ ID NO: 172501 - DNA, 21 bp, Homo sapiens
gacggaggctgagtctctcct

SEQ ID NO: 172502 - DNA, 19 bp, Homo sapiens
tgccagatgggagttggta

SEQ ID NO: 172503 - DNA, 19 bp, Homo sapiens
gtttaactttcagatgtca

SEQ ID NO: 172504 - DNA, 22 bp, Homo sapiens
aaccggcaagttgatgttgtct

SEQ ID NO: 172505 - DNA, 22 bp, Homo sapiens
atgtgtatatatatgtgtgtgt

SEQ ID NO: 172506 - DNA, 22 bp, Homo sapiens
atatgtgtgtatgtgttcacat

SEQ ID NO: 172507 - DNA, 23 bp, Homo sapiens
tttatgtacatatgcatgtttat

SEQ ID NO: 172508 - DNA, 22 bp, Homo sapiens
gagtctcactctgtcacccagg

SEQ ID NO: 172509 - DNA, 23 bp, Homo sapiens
gttttgagtgcaaagcttctgcc

SEQ ID NO: 172510 - DNA, 23 bp, Homo sapiens
ttttgaggacttgccatactgtt

SEQ ID NO: 172511 - DNA, 22 bp, Homo sapiens
tcactggctccaagagtagtgt

SEQ ID NO: 172512 - DNA, 23 bp, Homo sapiens
tttgtaattcatgtgccactggt

SEQ ID NO: 172513 - DNA, 19 bp, Homo sapiens
tcattcattctctggcaga

SEQ ID NO: 172514 - DNA, 19 bp, Homo sapiens
tggcactcaactgtcgtcc

SEQ ID NO: 172515 - DNA, 23 bp, Homo sapiens
atgtaagcacttcaggagcagaa

SEQ ID NO: 172516 - DNA, 23 bp, Homo sapiens
agttgttctgggtcagtcagtga

SEQ ID NO: 172517 - DNA, 22 bp, Homo sapiens
tgagatgttggtgtttgactca

SEQ ID NO: 172518 - DNA, 23 bp, Homo sapiens
cttctcactgtgtctctcccttt

SEQ ID NO: 172519 - DNA, 23 bp, Homo sapiens
tggagtctcactctgtcacccag

SEQ ID NO: 172520 - DNA, 23 bp, Homo sapiens
tgagttcattgtagattctggat

SEQ ID NO: 172521 - DNA, 23 bp, Homo sapiens
tgagttcattgtagattctggat

SEQ ID NO: 172522 - DNA, 23 bp, Homo sapiens
gaaaccacaagtcagagctgggt

SEQ ID NO: 172523 - DNA, 18 bp, Homo sapiens
gtgtacatgtctatgtca

SEQ ID NO: 172524 - DNA, 19 bp, Homo sapiens
tgaatatgtatatgtgtgc

SEQ ID NO: 172525 - DNA, 23 bp, Homo sapiens
tccttcactctcagtatctttag

SEQ ID NO: 172526 - DNA, 23 bp, Homo sapiens
ttgtagagtactatgctgtttgg

SEQ ID NO: 172527 - DNA, 23 bp, Homo sapiens
tgtagccttatagtacagtttga

SEQ ID NO: 172528 - DNA, 23 bp, Homo sapiens
aattgtgaatgggagttcactga

SEQ ID NO: 172529 - DNA, 23 bp, Homo sapiens
attagtagtatgagcaggcatat

SEQ ID NO: 172530 - DNA, 20 bp, Homo sapiens
tttgttctagacaatgtaaa

SEQ ID NO: 172531 - DNA, 23 bp, Homo sapiens
tgacaaggagcgtatgtctattt

SEQ ID NO: 172532 - DNA, 20 bp, Homo sapiens
gtaaagattcttaatattgg

SEQ ID NO: 172533 - DNA, 21 bp, Homo sapiens
tgtgtacataatgtatgcata

SEQ ID NO: 172534 - DNA, 23 bp, Homo sapiens
tctctctctcattcacttgagcc

SEQ ID NO: 172535 - DNA, 22 bp, Homo sapiens
atttgactttggtgtgaaagag

SEQ ID NO: 172536 - DNA, 21 bp, Homo sapiens
cacttcttttcttttggagac

SEQ ID NO: 172537 - DNA, 23 bp, Homo sapiens
tggagtctcactctgtcacccag

SEQ ID NO: 172538 - DNA, 23 bp, Homo sapiens
tgagagagttttgctcttgttgc

SEQ ID NO: 172539 - DNA, 23 bp, Homo sapiens
agatggagtctcactctgtcacc

SEQ ID NO: 172540 - DNA, 23 bp, Homo sapiens
acagagtctcactctgtcgccca

SEQ ID NO: 172541 - DNA, 22 bp, Homo sapiens
agacatgatggtgtatgcctgt

SEQ ID NO: 172542 - DNA, 23 bp, Homo sapiens
gttttgcacactcactctgagtg

SEQ ID NO: 172543 - DNA, 19 bp, Homo sapiens
tctctctatcacactccca

SEQ ID NO: 172544 - DNA, 19 bp, Homo sapiens
aattcacaaaatgtacaac

SEQ ID NO: 172545 - DNA, 20 bp, Homo sapiens
tcattctttgaaaagagtca

SEQ ID NO: 172546 - DNA, 22 bp, Homo sapiens
tttttagatggagtctcgctct

SEQ ID NO: 172547 - DNA, 23 bp, Homo sapiens
ttaaggggtatatgtacaggttg

SEQ ID NO: 172548 - DNA, 21 bp, Homo sapiens
tgtgtatatatgtgtatgcat

SEQ ID NO: 172549 - DNA, 18 bp, Homo sapiens
tatgtatatatgtgtatg

SEQ ID NO: 172550 - DNA, 22 bp, Homo sapiens
atatgtgtatacatatatatgc

SEQ ID NO: 172551 - DNA, 22 bp, Homo sapiens
gacaaaggtgatgctgggcaca

SEQ ID NO: 172552 - DNA, 22 bp, Homo sapiens
gacaaaggtgatgctgggcaca

SEQ ID NO: 172553 - DNA, 23 bp, Homo sapiens
ttttttggttccatatgaaattt

SEQ ID NO: 172554 - DNA, 21 bp, Homo sapiens
tgtatatatgcatgtgtgtgt

SEQ ID NO: 172555 - DNA, 23 bp, Homo sapiens
atgtgtgtatatatatatgtgtg

SEQ ID NO: 172556 - DNA, 22 bp, Homo sapiens
tatatgcatacacatgtatgca

SEQ ID NO: 172557 - DNA, 23 bp, Homo sapiens
tatatctgtatatatatatctgt

SEQ ID NO: 172558 - DNA, 23 bp, Homo sapiens
tatatctgtatatatatatctgt

SEQ ID NO: 172559 - DNA, 23 bp, Homo sapiens
tatatctgtatatatatatctgt

SEQ ID NO: 172560 - DNA, 23 bp, Homo sapiens
agttctgtctgactgagtccttc

SEQ ID NO: 172561 - DNA, 23 bp, Homo sapiens
agtggaaatgttttgaagaatgc

SEQ ID NO: 172562 - DNA, 23 bp, Homo sapiens
ttatgagatattctttgccaacc

SEQ ID NO: 172563 - DNA, 21 bp, Homo sapiens
actatggaattgaaggaaaac

SEQ ID NO: 172564 - DNA, 23 bp, Homo sapiens
tgtgaagtagtaggatcatttgt

SEQ ID NO: 172565 - DNA, 23 bp, Homo sapiens
acagagtctcactctgtcaccag

SEQ ID NO: 172566 - DNA, 22 bp, Homo sapiens
tatacatctgtatatatataca

SEQ ID NO: 172567 - DNA, 23 bp, Homo sapiens
tctttgtgagtagctaaggagtg

SEQ ID NO: 172568 - DNA, 18 bp, Homo sapiens
aagagcttgggtagtgag

SEQ ID NO: 172569 - DNA, 23 bp, Homo sapiens
tgtatatatatacaatatgttgt

SEQ ID NO: 172570 - DNA, 23 bp, Homo sapiens
tgtatatatctacaatatgttgt

SEQ ID NO: 172571 - DNA, 23 bp, Homo sapiens
tctttcactgtcataattttctc

SEQ ID NO: 172572 - DNA, 22 bp, Homo sapiens
ttgacttatgtaaatgatcttt

SEQ ID NO: 172573 - DNA, 23 bp, Homo sapiens
acatatacatgatgtgcaggttt

SEQ ID NO: 172574 - DNA, 23 bp, Homo sapiens
tcagaatctcactctgtcactta

SEQ ID NO: 172575 - DNA, 23 bp, Homo sapiens
tgagttcattgtagattctggat

SEQ ID NO: 172576 - DNA, 23 bp, Homo sapiens
tgagttcattgtagattctggat

SEQ ID NO: 172577 - DNA, 23 bp, Homo sapiens
tgtgtatatatatgtgtgtgtgt

SEQ ID NO: 172578 - DNA, 23 bp, Homo sapiens
tgaccatgtgcatgtgcttgtag

SEQ ID NO: 172579 - DNA, 19 bp, Homo sapiens
tgagagaagtgagtgctga

SEQ ID NO: 172580 - DNA, 22 bp, Homo sapiens
agagatggaattgctgtcttaa

SEQ ID NO: 172581 - DNA, 22 bp, Homo sapiens
tagcaggacatgttttgaaaga

SEQ ID NO: 172582 - DNA, 23 bp, Homo sapiens
cttgagacaaggttttgctctgt

SEQ ID NO: 172583 - DNA, 19 bp, Homo sapiens
tgttcttacagttctagaa

SEQ ID NO: 172584 - DNA, 20 bp, Homo sapiens
tgggcttgtaggtggtgtct

SEQ ID NO: 172585 - DNA, 23 bp, Homo sapiens
tgagttcattgtagattctggat

SEQ ID NO: 172586 - DNA, 23 bp, Homo sapiens
tgagttcattgtagattctggat

SEQ ID NO: 172587 - DNA, 21 bp, Homo sapiens
tgtgtgtgtgtgtgtgtacac

SEQ ID NO: 172588 - DNA, 23 bp, Homo sapiens
tatgtctatatgtatatgtgtct

SEQ ID NO: 172589 - DNA, 22 bp, Homo sapiens
atatgtctatatgtatatatgt

SEQ ID NO: 172590 - DNA, 23 bp, Homo sapiens
atgtgtctatatgtatatatgtc

SEQ ID NO: 172591 - DNA, 23 bp, Homo sapiens
atgtgtctatatgtatatgtgtg

SEQ ID NO: 172592 - DNA, 23 bp, Homo sapiens
tatactgtatgtgtatatatatt

SEQ ID NO: 172593 - DNA, 23 bp, Homo sapiens
tacatatagtatgtattgtgtat

SEQ ID NO: 172594 - DNA, 22 bp, Homo sapiens
atatacacatagtatatgtgtg

SEQ ID NO: 172595 - DNA, 22 bp, Homo sapiens
tatagtgtatatatgtatatgt

SEQ ID NO: 172596 - DNA, 23 bp, Homo sapiens
tatatgcatagtgtatatgtagt

SEQ ID NO: 172597 - DNA, 19 bp, Homo sapiens
tgcaacatctgcctcctgg

SEQ ID NO: 172598 - DNA, 21 bp, Homo sapiens
tctgacaagagacagagctca

SEQ ID NO: 172599 - DNA, 21 bp, Homo sapiens
tgggatatgtctttatcatca

SEQ ID NO: 172600 - DNA, 23 bp, Homo sapiens
atctatctatatctatatctgtc

SEQ ID NO: 172601 - DNA, 23 bp, Homo sapiens
ttacttgtcagtaaaacacctga

SEQ ID NO: 172602 - DNA, 23 bp, Homo sapiens
gaatctcactctgtcacccaggc

SEQ ID NO: 172603 - DNA, 23 bp, Homo sapiens
acacatgtgggtgtgtgtattat

SEQ ID NO: 172604 - DNA, 23 bp, Homo sapiens
tatatgtatatatacgtgtgtgt

SEQ ID NO: 172605 - DNA, 23 bp, Homo sapiens
tatttacatgtttatctagaagt

SEQ ID NO: 172606 - DNA, 22 bp, Homo sapiens
tgtgtctgtgtatgtgaatatg

SEQ ID NO: 172607 - DNA, 22 bp, Homo sapiens
ctgaggtagcaggatctcttga

SEQ ID NO: 172608 - DNA, 20 bp, Homo sapiens
aaatatctatagctatatct

SEQ ID NO: 172609 - DNA, 18 bp, Homo sapiens
acacacacacacatacat

SEQ ID NO: 172610 - DNA, 23 bp, Homo sapiens
tgactcactgtatgtaaacctct

SEQ ID NO: 172611 - DNA, 19 bp, Homo sapiens
acatgagatattttgatat

SEQ ID NO: 172612 - DNA, 23 bp, Homo sapiens
aaaaatgtatatgtatatatgtg

SEQ ID NO: 172613 - DNA, 22 bp, Homo sapiens
atatgtgtatatatatatgtgt

SEQ ID NO: 172614 - DNA, 23 bp, Homo sapiens
tgtgtgtgcatctgcttctgtgt

SEQ ID NO: 172615 - DNA, 18 bp, Homo sapiens
ctgtgtgtgtgtgtgtgt

SEQ ID NO: 172616 - DNA, 21 bp, Homo sapiens
ttgaggctagaaagggagctg

SEQ ID NO: 172617 - DNA, 20 bp, Homo sapiens
aatcatgtgtgtatatgtgt

SEQ ID NO: 172618 - DNA, 23 bp, Homo sapiens
ggttcccatttcagtgtgtagtt

SEQ ID NO: 172619 - DNA, 23 bp, Homo sapiens
tgtatgtgtgcatgtgtatgtgt

SEQ ID NO: 172620 - DNA, 23 bp, Homo sapiens
aaaatcacatttacttttgcacc

SEQ ID NO: 172621 - DNA, 18 bp, Homo sapiens
tatgtatgtatgtatgta

SEQ ID NO: 172622 - DNA, 20 bp, Homo sapiens
atttgcaatctcacaggtgt

SEQ ID NO: 172623 - DNA, 23 bp, Homo sapiens
acataacctattgaaatgatata

SEQ ID NO: 172624 - DNA, 18 bp, Homo sapiens
aactcataggggattgga

SEQ ID NO: 172625 - DNA, 23 bp, Homo sapiens
tgtcttcagtctctgtgtgggag

SEQ ID NO: 172626 - DNA, 19 bp, Homo sapiens
tcatcatcgttgtcatcat

SEQ ID NO: 172627 - DNA, 23 bp, Homo sapiens
cattatgatcatgatgatgatga

SEQ ID NO: 172628 - DNA, 23 bp, Homo sapiens
tgagttcattgtagattctggat

SEQ ID NO: 172629 - DNA, 23 bp, Homo sapiens
tgagttcattgtagattctggat

SEQ ID NO: 172630 - DNA, 23 bp, Homo sapiens
atcatctgagaacagactgagca

SEQ ID NO: 172631 - DNA, 23 bp, Homo sapiens
cgtctcactgtgtctttatgtgg

SEQ ID NO: 172632 - DNA, 19 bp, Homo sapiens
tgagaggacagagtgtgct

SEQ ID NO: 172633 - DNA, 23 bp, Homo sapiens
tttagacaaggtttcactctgtc

SEQ ID NO: 172634 - DNA, 20 bp, Homo sapiens
tatatgagtcatgttgatat

SEQ ID NO: 172635 - DNA, 21 bp, Homo sapiens
tatatgcacgtgtgtgtgtgt

SEQ ID NO: 172636 - DNA, 23 bp, Homo sapiens
aaagaacaagacccagagtgaag

SEQ ID NO: 172637 - DNA, 23 bp, Homo sapiens
agatggagtctcactctgtcacc

SEQ ID NO: 172638 - DNA, 18 bp, Homo sapiens
acctttttataaatgtat

SEQ ID NO: 172639 - DNA, 19 bp, Homo sapiens
gtgtatatatatacacgta

SEQ ID NO: 172640 - DNA, 18 bp, Homo sapiens
tatgtatatatatacgtg

SEQ ID NO: 172641 - DNA, 21 bp, Homo sapiens
tatgtatgtatatatacgtgt

SEQ ID NO: 172642 - DNA, 21 bp, Homo sapiens
ttatatatgtacatgtgcatg

SEQ ID NO: 172643 - DNA, 23 bp, Homo sapiens
tcactatatatatgtgtgtgtgt

SEQ ID NO: 172644 - DNA, 22 bp, Homo sapiens
ttgtgaagatgccattttgttg

SEQ ID NO: 172645 - DNA, 18 bp, Homo sapiens
tttgtatatttgctatct

SEQ ID NO: 172646 - DNA, 19 bp, Homo sapiens
gtgtatgtatatgtatgtg

SEQ ID NO: 172647 - DNA, 23 bp, Homo sapiens
tgaaacggtgtggatgtccagtg

SEQ ID NO: 172648 - DNA, 21 bp, Homo sapiens
tgaggtggtaggatcacttga

SEQ ID NO: 172649 - DNA, 23 bp, Homo sapiens
tttgcatatatattgatatacca

SEQ ID NO: 172650 - DNA, 20 bp, Homo sapiens
tgcatgactgtatatttcta

SEQ ID NO: 172651 - DNA, 21 bp, Homo sapiens
tgggaacttgtggcagtgcag

SEQ ID NO: 172652 - DNA, 22 bp, Homo sapiens
tgttccttatctttagtgatac

SEQ ID NO: 172653 - DNA, 23 bp, Homo sapiens
ggtctggctctgtcactgaggct

SEQ ID NO: 172654 - DNA, 21 bp, Homo sapiens
tcttgtctcgctctgtcaccc

SEQ ID NO: 172655 - DNA, 19 bp, Homo sapiens
agtggctcagtctcagctc

SEQ ID NO: 172656 - DNA, 22 bp, Homo sapiens
tgtgtgtatatattaacgtgta

SEQ ID NO: 172657 - DNA, 23 bp, Homo sapiens
tgtgtgtatatatgtatgtgtgt

SEQ ID NO: 172658 - DNA, 23 bp, Homo sapiens
atattactatgtatgcatgtgag

SEQ ID NO: 172659 - DNA, 23 bp, Homo sapiens
tcagatctcttacactgtctcag

SEQ ID NO: 172660 - DNA, 23 bp, Homo sapiens
tgacagagtgaagtgagtcacca

SEQ ID NO: 172661 - DNA, 20 bp, Homo sapiens
tagacatatgaaataaatgt

SEQ ID NO: 172662 - DNA, 23 bp, Homo sapiens
gtgtgtgtctgtgtccttatctc

SEQ ID NO: 172663 - DNA, 23 bp, Homo sapiens
tctgtctgtctttctgtctatcc

SEQ ID NO: 172664 - DNA, 21 bp, Homo sapiens
tagtcacagctactcaagagg

SEQ ID NO: 172665 - DNA, 21 bp, Homo sapiens
tgaggctgctgtgagctatga

SEQ ID NO: 172666 - DNA, 22 bp, Homo sapiens
catccacacactgtctctcttt

SEQ ID NO: 172667 - DNA, 20 bp, Homo sapiens
taacagagggatgttgtagt

SEQ ID NO: 172668 - DNA, 18 bp, Homo sapiens
agacagggtctgtctctg

SEQ ID NO: 172669 - DNA, 23 bp, Homo sapiens
tggatatgtaatataataaatgt

SEQ ID NO: 172670 - DNA, 23 bp, Homo sapiens
atgtatataacatatggtgtgtg

SEQ ID NO: 172671 - DNA, 20 bp, Homo sapiens
agagctttagggtttttgtt

SEQ ID NO: 172672 - DNA, 23 bp, Homo sapiens
gagacagagtctcgctctgtcac

SEQ ID NO: 172673 - DNA, 23 bp, Homo sapiens
gacagagtctcgctctgtcaccc

SEQ ID NO: 172674 - DNA, 19 bp, Homo sapiens
tatgtgtatatgtacatgt

SEQ ID NO: 172675 - DNA, 23 bp, Homo sapiens
atatgcatgtgtctatgtgtgta

SEQ ID NO: 172676 - DNA, 23 bp, Homo sapiens
tatggtacttgtatgtgcatata

SEQ ID NO: 172677 - DNA, 22 bp, Homo sapiens
tgtgtatgcatgatgtatgtat

SEQ ID NO: 172678 - DNA, 23 bp, Homo sapiens
tatatgtgtatggcatatatgtg

SEQ ID NO: 172679 - DNA, 23 bp, Homo sapiens
tgtatatgtgtgtgcatttgcat

SEQ ID NO: 172680 - DNA, 20 bp, Homo sapiens
tatgtacatgttttatgtat

SEQ ID NO: 172681 - DNA, 21 bp, Homo sapiens
tgtgcctgtagtttcagctac

SEQ ID NO: 172682 - DNA, 19 bp, Homo sapiens
aagaatttgaggctgcagt

SEQ ID NO: 172683 - DNA, 23 bp, Homo sapiens
tgagacggagtctcgctctgtca

SEQ ID NO: 172684 - DNA, 23 bp, Homo sapiens
agcctctcagtctctgtttatga

SEQ ID NO: 172685 - DNA, 23 bp, Homo sapiens
tatatgggtgtgcatgtgcactg

SEQ ID NO: 172686 - DNA, 23 bp, Homo sapiens
cacatgtgacttgctgtgtgggt

SEQ ID NO: 172687 - DNA, 23 bp, Homo sapiens
atgtgtgtgtgtatgtatatgtg

SEQ ID NO: 172688 - DNA, 21 bp, Homo sapiens
agcatctgttgtttcctgact

SEQ ID NO: 172689 - DNA, 23 bp, Homo sapiens
gtgtctctctccctgtgtcctca

SEQ ID NO: 172690 - DNA, 23 bp, Homo sapiens
cggagtctcactctgtcacccag

SEQ ID NO: 172691 - DNA, 23 bp, Homo sapiens
atatgcatatgtatacacataca

SEQ ID NO: 172692 - DNA, 22 bp, Homo sapiens
tatacacgtgtatgtgtataca

SEQ ID NO: 172693 - DNA, 23 bp, Homo sapiens
acagagtctcactctgtcgccca

SEQ ID NO: 172694 - DNA, 22 bp, Homo sapiens
aatgagacagcttttggaatag

SEQ ID NO: 172695 - DNA, 18 bp, Homo sapiens
tcagatggagtctcactc

SEQ ID NO: 172696 - DNA, 23 bp, Homo sapiens
tagtttctgctagtttatgttga

SEQ ID NO: 172697 - DNA, 19 bp, Homo sapiens
gagtctcgctctgtcactg

SEQ ID NO: 172698 - DNA, 23 bp, Homo sapiens
acagagtctcactctgtcgccca

SEQ ID NO: 172699 - DNA, 23 bp, Homo sapiens
atattctgaaattgttgatgaga

SEQ ID NO: 172700 - DNA, 23 bp, Homo sapiens
ctgtatgtccgtgtgtgtgtgtg

SEQ ID NO: 172701 - DNA, 23 bp, Homo sapiens
tgtgcatgtctgcgtctgtgtgc

SEQ ID NO: 172702 - DNA, 23 bp, Homo sapiens
tgtctgcgtctgtgtgtgcctgt

SEQ ID NO: 172703 - DNA, 23 bp, Homo sapiens
ctgtgtgtccgtgcgtgagtgtg

SEQ ID NO: 172704 - DNA, 18 bp, Homo sapiens
tccgtgtcttgaagagct

SEQ ID NO: 172705 - DNA, 23 bp, Homo sapiens
tgtgtgtgtctgtgtcctcgtct

SEQ ID NO: 172706 - DNA, 23 bp, Homo sapiens
tgtgtgtgtctgtgtcctcgtct

SEQ ID NO: 172707 - DNA, 23 bp, Homo sapiens
tgtgtgtgtctgtgtcctcgtct

SEQ ID NO: 172708 - DNA, 23 bp, Homo sapiens
tgtgtgtgtctgtgtcctcgtct

SEQ ID NO: 172709 - DNA, 23 bp, Homo sapiens
tgtgtgtgtctgtgtcctcgtct

SEQ ID NO: 172710 - DNA, 23 bp, Homo sapiens
tgtgtgtgtctgtgtcctcgtct

SEQ ID NO: 172711 - DNA, 23 bp, Homo sapiens
tgtgtgtgtctgtgtcctcgtct

SEQ ID NO: 172712 - DNA, 23 bp, Homo sapiens
tgtgtgtgtctgtgtcctcgtct

SEQ ID NO: 172713 - DNA, 23 bp, Homo sapiens
tgtgtgtgtctgtgtcctcgtct

SEQ ID NO: 172714 - DNA, 23 bp, Homo sapiens
tgtgtgtgtctgtgtcctcgtct

SEQ ID NO: 172715 - DNA, 23 bp, Homo sapiens
tgtgtgtgtctgtgtcctcgtct

SEQ ID NO: 172716 - DNA, 23 bp, Homo sapiens
tgtgtgtgtctgtgtcctcgtct

SEQ ID NO: 172717 - DNA, 18 bp, Homo sapiens
tgagatggagtctcactc

SEQ ID NO: 172718 - DNA, 23 bp, Homo sapiens
atggagtctctctctgtcaccca

SEQ ID NO: 172719 - DNA, 23 bp, Homo sapiens
atggagtctctctctgtcaccca

SEQ ID NO: 172720 - DNA, 23 bp, Homo sapiens
cggagtctcgctctgtcacccac

SEQ ID NO: 172721 - DNA, 23 bp, Homo sapiens
tccacttctgtgtgtatctgtct

SEQ ID NO: 172722 - DNA, 22 bp, Homo sapiens
gttgagggtgaaatcacagggg

SEQ ID NO: 172723 - DNA, 23 bp, Homo sapiens
gtgctgtcttctgttcctgtgtg

SEQ ID NO: 172724 - DNA, 23 bp, Homo sapiens
ctgagtgagttctcacaagatct

SEQ ID NO: 172725 - DNA, 23 bp, Homo sapiens
agtgagactctgattgcagtgga

SEQ ID NO: 172726 - DNA, 21 bp, Homo sapiens
tggagtctcgctctgtcaccc

SEQ ID NO: 172727 - DNA, 23 bp, Homo sapiens
cagagagttgagagagtgaccag

SEQ ID NO: 172728 - DNA, 22 bp, Homo sapiens
tgagaagctgtccacctctact

SEQ ID NO: 172729 - DNA, 21 bp, Homo sapiens
tgtcgatatatatcgatatgt

SEQ ID NO: 172730 - DNA, 23 bp, Homo sapiens
tatgtatgtatatgtgtatgtat

SEQ ID NO: 172731 - DNA, 23 bp, Homo sapiens
tatgtaaatgtaactatatatgt

SEQ ID NO: 172732 - DNA, 23 bp, Homo sapiens
ctttctctgaggatagattgagc

SEQ ID NO: 172733 - DNA, 23 bp, Homo sapiens
tgagacggagtctcgctctgtcg

SEQ ID NO: 172734 - DNA, 23 bp, Homo sapiens
gaggagctctgtctctctgtctc

SEQ ID NO: 172735 - DNA, 19 bp, Homo sapiens
agacaaagtctggctctgt

SEQ ID NO: 172736 - DNA, 23 bp, Homo sapiens
tctctgcctctgtctgtggcctt

SEQ ID NO: 172737 - DNA, 19 bp, Homo sapiens
cctctgtgtctgtgtctcc

SEQ ID NO: 172738 - DNA, 23 bp, Homo sapiens
tcctctgtgtctgtgtctcctct

SEQ ID NO: 172739 - DNA, 19 bp, Homo sapiens
ttctctgtgtctgtgtctc

SEQ ID NO: 172740 - DNA, 23 bp, Homo sapiens
cttctctgtgtctgtgtctccta

SEQ ID NO: 172741 - DNA, 22 bp, Homo sapiens
tttttacttttcttctttagag

SEQ ID NO: 172742 - DNA, 23 bp, Homo sapiens
tctctgcgtgcataggtgcaaat

SEQ ID NO: 172743 - DNA, 22 bp, Homo sapiens
cgtgtgtctgtgcatgtacatg

SEQ ID NO: 172744 - DNA, 23 bp, Homo sapiens
tgtgtgcacatgtgtgcatgcct

SEQ ID NO: 172745 - DNA, 21 bp, Homo sapiens
tccatttatgtatctatctac

SEQ ID NO: 172746 - DNA, 23 bp, Homo sapiens
atgcctgtaattccagctctttg

SEQ ID NO: 172747 - DNA, 21 bp, Homo sapiens
gtgtatatatctatatgtgta

SEQ ID NO: 172748 - DNA, 23 bp, Homo sapiens
tatgtgtatatatgtatatatgt

SEQ ID NO: 172749 - DNA, 23 bp, Homo sapiens
cgctgtctgtgtctctgtgtccc

SEQ ID NO: 172750 - DNA, 23 bp, Homo sapiens
tttaagccacttctacatttaac

SEQ ID NO: 172751 - DNA, 23 bp, Homo sapiens
tctctctgtcaagtgatcatagg

SEQ ID NO: 172752 - DNA, 21 bp, Homo sapiens
tcggttggtgggtgaaatgtt

SEQ ID NO: 172753 - DNA, 23 bp, Homo sapiens
aaagtttgagtggtgagagagag

SEQ ID NO: 172754 - DNA, 22 bp, Homo sapiens
atatgtgtatatatatacgtgt

SEQ ID NO: 172755 - DNA, 23 bp, Homo sapiens
tgagttcattgtagattctggat

SEQ ID NO: 172756 - DNA, 23 bp, Homo sapiens
tgagttcattgtagattctggat

SEQ ID NO: 172757 - DNA, 23 bp, Homo sapiens
aaatctgaggattttttttctat

SEQ ID NO: 172758 - DNA, 23 bp, Homo sapiens
tgtgaagaatatcattggaattt

SEQ ID NO: 172759 - DNA, 23 bp, Homo sapiens
tggattgttcagaacctcaatga

SEQ ID NO: 172760 - DNA, 23 bp, Homo sapiens
tgagttcattgtagattctggat

SEQ ID NO: 172761 - DNA, 23 bp, Homo sapiens
tgagttcattgtagattctggat

SEQ ID NO: 172762 - DNA, 23 bp, Homo sapiens
tgagttcattgtagattctggat

SEQ ID NO: 172763 - DNA, 23 bp, Homo sapiens
tgagttcattgtagattctggat

SEQ ID NO: 172764 - DNA, 22 bp, Homo sapiens
tctgtctgtctgactgggagct

SEQ ID NO: 172765 - DNA, 19 bp, Homo sapiens
tggttctagccactattga

SEQ ID NO: 172766 - DNA, 23 bp, Homo sapiens
tatatgtatatatacgtatgtat

SEQ ID NO: 172767 - DNA, 23 bp, Homo sapiens
tatatacgtatatatatgtgtgt

SEQ ID NO: 172768 - DNA, 23 bp, Homo sapiens
tgagttcattgtagattctggat

SEQ ID NO: 172769 - DNA, 23 bp, Homo sapiens
tgagttcattgtagattctggat

SEQ ID NO: 172770 - DNA, 19 bp, Homo sapiens
agcaacactaatacactgt

SEQ ID NO: 172771 - DNA, 23 bp, Homo sapiens
atcactcactgcctctcttgggt

SEQ ID NO: 172772 - DNA, 18 bp, Homo sapiens
cacatatgtatatgtgta

SEQ ID NO: 172773 - DNA, 22 bp, Homo sapiens
tatgtgtatgtgtatatatgtt

SEQ ID NO: 172774 - DNA, 23 bp, Homo sapiens
ccgagtctcgctctgtctccctg

SEQ ID NO: 172775 - DNA, 22 bp, Homo sapiens
aaactctcttcaattctctgac

SEQ ID NO: 172776 - DNA, 19 bp, Homo sapiens
tccatataaattgcatgat

SEQ ID NO: 172777 - DNA, 23 bp, Homo sapiens
taatagggattgcattaaatctg

SEQ ID NO: 172778 - DNA, 18 bp, Homo sapiens
ttattttacatgctcata

SEQ ID NO: 172779 - DNA, 23 bp, Homo sapiens
ttacctggacttcatctggattc

SEQ ID NO: 172780 - DNA, 20 bp, Homo sapiens
tatatacatgtacacatatg

SEQ ID NO: 172781 - DNA, 22 bp, Homo sapiens
acatgtgcacaatgtgcaggtt

SEQ ID NO: 172782 - DNA, 23 bp, Homo sapiens
tggatctgtagtgattttgtgct

SEQ ID NO: 172783 - DNA, 22 bp, Homo sapiens
attgtgaatgggagttcactca

SEQ ID NO: 172784 - DNA, 23 bp, Homo sapiens
tgccagactcagtggctcacagc

SEQ ID NO: 172785 - DNA, 23 bp, Homo sapiens
tgcacacatgtacgtgtgtgtgt

SEQ ID NO: 172786 - DNA, 18 bp, Homo sapiens
atatgaatacgtattcat

SEQ ID NO: 172787 - DNA, 20 bp, Homo sapiens
tatgtgtatatatgaatatg

SEQ ID NO: 172788 - DNA, 23 bp, Homo sapiens
tgagttcattgtagattctggat

SEQ ID NO: 172789 - DNA, 23 bp, Homo sapiens
tgagttcattgtagattctggat

SEQ ID NO: 172790 - DNA, 19 bp, Homo sapiens
tgcctctctctgagcctct

SEQ ID NO: 172791 - DNA, 23 bp, Homo sapiens
ttacaagtaaggactctgctctt

SEQ ID NO: 172792 - DNA, 23 bp, Homo sapiens
tgaggttctgagacagtctgtct

SEQ ID NO: 172793 - DNA, 18 bp, Homo sapiens
tatgtgaatctaatatgg

SEQ ID NO: 172794 - DNA, 22 bp, Homo sapiens
gacagagtctcactgcctcacc

SEQ ID NO: 172795 - DNA, 23 bp, Homo sapiens
ttagaggaagaagtatggtgaag

SEQ ID NO: 172796 - DNA, 23 bp, Homo sapiens
aagagaggatactattctctttc

SEQ ID NO: 172797 - DNA, 23 bp, Homo sapiens
tggcagaggaacataaattgtga

SEQ ID NO: 172798 - DNA, 23 bp, Homo sapiens
taatatggacatttatcagttct

SEQ ID NO: 172799 - DNA, 23 bp, Homo sapiens
tggtttatctttctgaatggttt

SEQ ID NO: 172800 - DNA, 23 bp, Homo sapiens
tgcattggtgtgtgtgtgtgtgt

SEQ ID NO: 172801 - DNA, 22 bp, Homo sapiens
tatatgcatatatatttaggtg

SEQ ID NO: 172802 - DNA, 18 bp, Homo sapiens
ctgagttcaggaatgaga

SEQ ID NO: 172803 - DNA, 23 bp, Homo sapiens
acagagtctcactctgtcactca

SEQ ID NO: 172804 - DNA, 22 bp, Homo sapiens
tatgagtttttgtatatgtgag

SEQ ID NO: 172805 - DNA, 23 bp, Homo sapiens
atatgagttttggtatatgtgag

SEQ ID NO: 172806 - DNA, 23 bp, Homo sapiens
gtgaatgtgcatgtgctagtctc

SEQ ID NO: 172807 - DNA, 21 bp, Homo sapiens
atgtatatatacatgtgtatg

SEQ ID NO: 172808 - DNA, 23 bp, Homo sapiens
atatacatgtgtatgtttatata

SEQ ID NO: 172809 - DNA, 23 bp, Homo sapiens
attgagcttcttggatgtttatt

SEQ ID NO: 172810 - DNA, 19 bp, Homo sapiens
tattccagaatcaggtccc

SEQ ID NO: 172811 - DNA, 19 bp, Homo sapiens
aataacagtgctatagtgg

SEQ ID NO: 172812 - DNA, 19 bp, Homo sapiens
tattgcatgtatatgtaat

SEQ ID NO: 172813 - DNA, 23 bp, Homo sapiens
ctctcggtctctgtcttttgtct

SEQ ID NO: 172814 - DNA, 19 bp, Homo sapiens
acaaaacagacacacctag

SEQ ID NO: 172815 - DNA, 23 bp, Homo sapiens
ttgaagactcactctgtcaccca

SEQ ID NO: 172816 - DNA, 22 bp, Homo sapiens
gtacatggtgcagtctcagctc

SEQ ID NO: 172817 - DNA, 23 bp, Homo sapiens
taaagtatgttttgctaaagtgg

SEQ ID NO: 172818 - DNA, 19 bp, Homo sapiens
ggtctgagttagctttttg

SEQ ID NO: 172819 - DNA, 21 bp, Homo sapiens
atgggtgtgtggttaagatgt

SEQ ID NO: 172820 - DNA, 23 bp, Homo sapiens
agagtctcactctgtcacccagg

SEQ ID NO: 172821 - DNA, 22 bp, Homo sapiens
tgcaatcttggctcactgtctc

SEQ ID NO: 172822 - DNA, 23 bp, Homo sapiens
tgagttcattgtagattctggat

SEQ ID NO: 172823 - DNA, 23 bp, Homo sapiens
tgagttcattgtagattctggat

SEQ ID NO: 172824 - DNA, 23 bp, Homo sapiens
ctcagctcactgcagcctctgac

SEQ ID NO: 172825 - DNA, 23 bp, Homo sapiens
atgtgtgtgtatatattatgtgt

SEQ ID NO: 172826 - DNA, 21 bp, Homo sapiens
atacatacacatacataaatg

SEQ ID NO: 172827 - DNA, 23 bp, Homo sapiens
tgtgtacatatgtatagacacac

SEQ ID NO: 172828 - DNA, 20 bp, Homo sapiens
tgcctgtaggttgcattcta

SEQ ID NO: 172829 - DNA, 23 bp, Homo sapiens
gcctgtcactctcacaaatgacg

SEQ ID NO: 172830 - DNA, 19 bp, Homo sapiens
tatatgcatgtgtatatat

SEQ ID NO: 172831 - DNA, 22 bp, Homo sapiens
atatatgtgtgtatacatatgt

SEQ ID NO: 172832 - DNA, 23 bp, Homo sapiens
tgtgtgtgtatatatatgtgtgt

SEQ ID NO: 172833 - DNA, 21 bp, Homo sapiens
ttaggtatatgtacatatatg

SEQ ID NO: 172834 - DNA, 23 bp, Homo sapiens
tgtgtatatatatatgtgtgtgt

SEQ ID NO: 172835 - DNA, 22 bp, Homo sapiens
atgtgtgtatatatgtgtgtgt

SEQ ID NO: 172836 - DNA, 23 bp, Homo sapiens
tgaggtaggaggatcacttgagt

SEQ ID NO: 172837 - DNA, 21 bp, Homo sapiens
atgattagtgatattgaggtt

SEQ ID NO: 172838 - DNA, 18 bp, Homo sapiens
tctcgctctgtcacccag

SEQ ID NO: 172839 - DNA, 23 bp, Homo sapiens
aggagtctcactcactctttcgc

SEQ ID NO: 172840 - DNA, 20 bp, Homo sapiens
agctggagtgtagtggcaca

SEQ ID NO: 172841 - DNA, 23 bp, Homo sapiens
agagtctctctctgtcacccagg

SEQ ID NO: 172842 - DNA, 23 bp, Homo sapiens
agacagagtctgtctctgtcgcc

SEQ ID NO: 172843 - DNA, 23 bp, Homo sapiens
ttgaatgtgtggacaagcttcag

SEQ ID NO: 172844 - DNA, 22 bp, Homo sapiens
ctacagaaaacagtgtggagat

SEQ ID NO: 172845 - DNA, 23 bp, Homo sapiens
tgagttcattgtagattctggat

SEQ ID NO: 172846 - DNA, 23 bp, Homo sapiens
tgagttcattgtagattctggat

SEQ ID NO: 172847 - DNA, 19 bp, Homo sapiens
attgtgactggttgtcctg

SEQ ID NO: 172848 - DNA, 23 bp, Homo sapiens
tgagttcattgtagattctggat

SEQ ID NO: 172849 - DNA, 23 bp, Homo sapiens
tgagttcattgtagattctggat

SEQ ID NO: 172850 - DNA, 20 bp, Homo sapiens
ctttactgggcactctgctg

SEQ ID NO: 172851 - DNA, 23 bp, Homo sapiens
agggtctcactctgtcacttagg

SEQ ID NO: 172852 - DNA, 23 bp, Homo sapiens
tacagattgacttaagaaactgt

SEQ ID NO: 172853 - DNA, 23 bp, Homo sapiens
acagtctcactctgtaatccagg

SEQ ID NO: 172854 - DNA, 23 bp, Homo sapiens
tgggtctcactctgtcacccagg

SEQ ID NO: 172855 - DNA, 22 bp, Homo sapiens
ctgtctctctgtgtggcctttt

SEQ ID NO: 172856 - DNA, 23 bp, Homo sapiens
tttcctagtggtaggaggttcta

SEQ ID NO: 172857 - DNA, 22 bp, Homo sapiens
gaagaatagacattttgttgat

SEQ ID NO: 172858 - DNA, 23 bp, Homo sapiens
agagttctgtagatgtctattag

SEQ ID NO: 172859 - DNA, 23 bp, Homo sapiens
tactctttgtgtgtgatattaaa

SEQ ID NO: 172860 - DNA, 22 bp, Homo sapiens
ttaagtgcaactaatttctatt

SEQ ID NO: 172861 - DNA, 20 bp, Homo sapiens
tacatacacacatatgtgta

SEQ ID NO: 172862 - DNA, 23 bp, Homo sapiens
atatacatatacacatatgtgta

SEQ ID NO: 172863 - DNA, 23 bp, Homo sapiens
tgagttcattgtagattctggat

SEQ ID NO: 172864 - DNA, 23 bp, Homo sapiens
tgagttcattgtagattctggat

SEQ ID NO: 172865 - DNA, 23 bp, Homo sapiens
tgagttcattgtagattctggat

SEQ ID NO: 172866 - DNA, 23 bp, Homo sapiens
tgagttcattgtagattctggat

SEQ ID NO: 172867 - DNA, 23 bp, Homo sapiens
tgagttcattgtagattctggat

SEQ ID NO: 172868 - DNA, 23 bp, Homo sapiens
tgagttcattgtagattctggat

SEQ ID NO: 172869 - DNA, 22 bp, Homo sapiens
cttccaggaagcatgtgtgctg

SEQ ID NO: 172870 - DNA, 23 bp, Homo sapiens
tgacacagtgtttcactctgtta

SEQ ID NO: 172871 - DNA, 23 bp, Homo sapiens
tgagttcattgtagattctggat

SEQ ID NO: 172872 - DNA, 23 bp, Homo sapiens
tgagttcattgtagattctggat

SEQ ID NO: 172873 - DNA, 23 bp, Homo sapiens
tgagttcattgtagattctggat

SEQ ID NO: 172874 - DNA, 20 bp, Homo sapiens
tatgtacatatatatgtaca

SEQ ID NO: 172875 - DNA, 23 bp, Homo sapiens
atatatgtacatatatatgtaca

SEQ ID NO: 172876 - DNA, 23 bp, Homo sapiens
atatatgtacatatatatgtaca

SEQ ID NO: 172877 - DNA, 19 bp, Homo sapiens
tgtgcatatatatatatat

SEQ ID NO: 172878 - DNA, 23 bp, Homo sapiens
atacatgtgtatatgtatacata

SEQ ID NO: 172879 - DNA, 20 bp, Homo sapiens
tgtgcaagccaaagaagtgt

SEQ ID NO: 172880 - DNA, 23 bp, Homo sapiens
tgagttcattgtagattctggat

SEQ ID NO: 172881 - DNA, 23 bp, Homo sapiens
tgagttcattgtagattctggat

SEQ ID NO: 172882 - DNA, 20 bp, Homo sapiens
agtcagcatccctttgcaca

SEQ ID NO: 172883 - DNA, 22 bp, Homo sapiens
tgtgtgacaccctataaacagt

SEQ ID NO: 172884 - DNA, 18 bp, Homo sapiens
ttctagagagttatagca

SEQ ID NO: 172885 - DNA, 21 bp, Homo sapiens
ttgagaggtgagtgtgttgaa

SEQ ID NO: 172886 - DNA, 21 bp, Homo sapiens
tggttcacacctgtaatcaca

SEQ ID NO: 172887 - DNA, 23 bp, Homo sapiens
attgctctttctgcttgtagttt

SEQ ID NO: 172888 - DNA, 18 bp, Homo sapiens
aggtatgcttatatgtgt

SEQ ID NO: 172889 - DNA, 23 bp, Homo sapiens
tgcattcttttgagtttccgatt

SEQ ID NO: 172890 - DNA, 23 bp, Homo sapiens
tacagtgtatgtgtatatatgtc

SEQ ID NO: 172891 - DNA, 23 bp, Homo sapiens
gaaggaacttctagacatctttt

SEQ ID NO: 172892 - DNA, 19 bp, Homo sapiens
atcatgggagtggctgtcc

SEQ ID NO: 172893 - DNA, 23 bp, Homo sapiens
tgagttcattgtagattctggat

SEQ ID NO: 172894 - DNA, 23 bp, Homo sapiens
tgagttcattgtagattctggat

SEQ ID NO: 172895 - DNA, 23 bp, Homo sapiens
cggagtctcgctctgtcgctcag

SEQ ID NO: 172896 - DNA, 23 bp, Homo sapiens
tgagttcattgtagattctggat

SEQ ID NO: 172897 - DNA, 23 bp, Homo sapiens
tgagttcattgtagattctggat

SEQ ID NO: 172898 - DNA, 18 bp, Homo sapiens
tgaacccagtacctcaga

SEQ ID NO: 172899 - DNA, 19 bp, Homo sapiens
gcatacacacatatgtgta

SEQ ID NO: 172900 - DNA, 21 bp, Homo sapiens
tgtgtgtgtatatatgtgtgt

SEQ ID NO: 172901 - DNA, 22 bp, Homo sapiens
atatgtatatgtatatgtgtgt

SEQ ID NO: 172902 - DNA, 23 bp, Homo sapiens
atgtgtgtgcatgtgtatatgta

SEQ ID NO: 172903 - DNA, 21 bp, Homo sapiens
tatacacacatatacatatac

SEQ ID NO: 172904 - DNA, 18 bp, Homo sapiens
tatgcatatataatgtat

SEQ ID NO: 172905 - DNA, 23 bp, Homo sapiens
atatgtgtatgtgtatatatatg

SEQ ID NO: 172906 - DNA, 23 bp, Homo sapiens
tgagttcattgtagattctggat

SEQ ID NO: 172907 - DNA, 23 bp, Homo sapiens
tgagttcattgtagattctggat

SEQ ID NO: 172908 - DNA, 22 bp, Homo sapiens
tgatactgctttgtgatgtgtg

SEQ ID NO: 172909 - DNA, 22 bp, Homo sapiens
taggttgaaaacactctttaga

SEQ ID NO: 172910 - DNA, 23 bp, Homo sapiens
caaagtctcactgtgtcacccag

SEQ ID NO: 172911 - DNA, 20 bp, Homo sapiens
tcagtggctctcactctctg

SEQ ID NO: 172912 - DNA, 18 bp, Homo sapiens
tatgtatacacacacaca

SEQ ID NO: 172913 - DNA, 21 bp, Homo sapiens
tttggttttgatttgaatgtc

SEQ ID NO: 172914 - DNA, 18 bp, Homo sapiens
gtgaaatagatttgttta

SEQ ID NO: 172915 - DNA, 20 bp, Homo sapiens
gtcaactctctttcactgtc

SEQ ID NO: 172916 - DNA, 23 bp, Homo sapiens
tatatgcatatatgtatatatgt

SEQ ID NO: 172917 - DNA, 20 bp, Homo sapiens
tgcaatgtaaagaagaatac

SEQ ID NO: 172918 - DNA, 22 bp, Homo sapiens
cagcactagcaccagtggaggt

SEQ ID NO: 172919 - DNA, 23 bp, Homo sapiens
aagggaagtacaatgggctctgt

SEQ ID NO: 172920 - DNA, 19 bp, Homo sapiens
ttaatgcattagtgtagtg

SEQ ID NO: 172921 - DNA, 23 bp, Homo sapiens
ccatctgtgacagcttcttgatc

SEQ ID NO: 172922 - DNA, 23 bp, Homo sapiens
tgagttcattgtagattctggat

SEQ ID NO: 172923 - DNA, 23 bp, Homo sapiens
tgagttcattgtagattctggat

SEQ ID NO: 172924 - DNA, 23 bp, Homo sapiens
tgagttcattgtagattctggat

SEQ ID NO: 172925 - DNA, 23 bp, Homo sapiens
tgagttcattgtagattctggat

SEQ ID NO: 172926 - DNA, 23 bp, Homo sapiens
tgtgacagagaacagactgatct

SEQ ID NO: 172927 - DNA, 21 bp, Homo sapiens
actcagtggtagtacagcagt

SEQ ID NO: 172928 - DNA, 23 bp, Homo sapiens
tgagttcattgtagattctggat

SEQ ID NO: 172929 - DNA, 23 bp, Homo sapiens
tgagttcattgtagattctggat

SEQ ID NO: 172930 - DNA, 20 bp, Homo sapiens
tatatatgtgtatatgtata

SEQ ID NO: 172931 - DNA, 23 bp, Homo sapiens
tgagttcattgtagattctggat

SEQ ID NO: 172932 - DNA, 23 bp, Homo sapiens
tgagttcattgtagattctggat

SEQ ID NO: 172933 - DNA, 22 bp, Homo sapiens
cagtgatatgttgaagaggacg

SEQ ID NO: 172934 - DNA, 23 bp, Homo sapiens
tgtctggttctaggtctcagagg

SEQ ID NO: 172935 - DNA, 23 bp, Homo sapiens
tgtctcactcagtgtacattggc

SEQ ID NO: 172936 - DNA, 23 bp, Homo sapiens
gcaaagatcatgcctgttctagg

SEQ ID NO: 172937 - DNA, 23 bp, Homo sapiens
ctgcctgcctgcctacctgcctg

SEQ ID NO: 172938 - DNA, 23 bp, Homo sapiens
atatttgttgttcagtaatgttt

SEQ ID NO: 172939 - DNA, 23 bp, Homo sapiens
tgttctgcaatatttgctgttct

SEQ ID NO: 172940 - DNA, 23 bp, Homo sapiens
agtctcactctgtcaccctggct

SEQ ID NO: 172941 - DNA, 20 bp, Homo sapiens
cttgttgtgactggttgtcc

SEQ ID NO: 172942 - DNA, 19 bp, Homo sapiens
aggtggttgactgtgttca

SEQ ID NO: 172943 - DNA, 23 bp, Homo sapiens
tgagtctcacactgtcacccagg

SEQ ID NO: 172944 - DNA, 20 bp, Homo sapiens
aaacaactcttccaggaagc

SEQ ID NO: 172945 - DNA, 23 bp, Homo sapiens
tggatagaattgattttatattg

SEQ ID NO: 172946 - DNA, 18 bp, Homo sapiens
aatgtgggtggatttatt

SEQ ID NO: 172947 - DNA, 23 bp, Homo sapiens
ctgtgtgtgtgtgtgtgtccctg

SEQ ID NO: 172948 - DNA, 18 bp, Homo sapiens
tgttttactatctgctct

SEQ ID NO: 172949 - DNA, 23 bp, Homo sapiens
tgtgagtatgaagttacttggaa

SEQ ID NO: 172950 - DNA, 21 bp, Homo sapiens
aatttcagccttttccatatc

SEQ ID NO: 172951 - DNA, 20 bp, Homo sapiens
tacctgcttactcagttact

SEQ ID NO: 172952 - DNA, 22 bp, Homo sapiens
tacatgtgcacattgtgcacat

SEQ ID NO: 172953 - DNA, 19 bp, Homo sapiens
aatatacatcatgatatag

SEQ ID NO: 172954 - DNA, 23 bp, Homo sapiens
ttttgcaggctatagtattcttt

SEQ ID NO: 172955 - DNA, 20 bp, Homo sapiens
ttaggctatttatttcagtg

SEQ ID NO: 172956 - DNA, 23 bp, Homo sapiens
aatatgtgtgatattcatagtat

SEQ ID NO: 172957 - DNA, 23 bp, Homo sapiens
aggtgttcactgaggctgtgttt

SEQ ID NO: 172958 - DNA, 22 bp, Homo sapiens
gacagagtctcactgcctcacc

SEQ ID NO: 172959 - DNA, 20 bp, Homo sapiens
aaacaactcttccaggaagc

SEQ ID NO: 172960 - DNA, 23 bp, Homo sapiens
tggatagaattgattttatattg

SEQ ID NO: 172961 - DNA, 23 bp, Homo sapiens
agatggagtctcactctctcacc

SEQ ID NO: 172962 - DNA, 20 bp, Homo sapiens
tctcttagtctgttaagaga

SEQ ID NO: 172963 - DNA, 23 bp, Homo sapiens
cagtgtttgtagtcttggctact

SEQ ID NO: 172964 - DNA, 22 bp, Homo sapiens
attcacacacatatataagtgt

SEQ ID NO: 172965 - DNA, 23 bp, Homo sapiens
tatacacatacacacatatgtgt

SEQ ID NO: 172966 - DNA, 23 bp, Homo sapiens
tgtgtatatgtatatatgtgtgt

SEQ ID NO: 172967 - DNA, 22 bp, Homo sapiens
tgtgtgtatgtgtatatgtata

SEQ ID NO: 172968 - DNA, 23 bp, Homo sapiens
tatgtgtatatgtatatgtctgt

SEQ ID NO: 172969 - DNA, 22 bp, Homo sapiens
atgtatgtgcacatgtgtatgt

SEQ ID NO: 172970 - DNA, 22 bp, Homo sapiens
atcatggtcattctctgtctca

SEQ ID NO: 172971 - DNA, 19 bp, Homo sapiens
aatatacatcatgatatag

SEQ ID NO: 172972 - DNA, 23 bp, Homo sapiens
ttttgcaggctatagtattcttt

SEQ ID NO: 172973 - DNA, 20 bp, Homo sapiens
ttaggctatttatttcagtg

SEQ ID NO: 172974 - DNA, 21 bp, Homo sapiens
tattggttaaaaatggaaaga

SEQ ID NO: 172975 - DNA, 21 bp, Homo sapiens
tattttttatttcgatagctt

SEQ ID NO: 172976 - DNA, 23 bp, Homo sapiens
agatggactctcactctggcact

SEQ ID NO: 172977 - DNA, 21 bp, Homo sapiens
ttttgcactcagtggtatgtc

SEQ ID NO: 172978 - DNA, 18 bp, Homo sapiens
aaggaagaaataaggtat

SEQ ID NO: 172979 - DNA, 23 bp, Homo sapiens
ggaaaagtctgactggatggctt

SEQ ID NO: 172980 - DNA, 23 bp, Homo sapiens
ggagtctcgctctgtcactcagg

SEQ ID NO: 172981 - DNA, 20 bp, Homo sapiens
tggtgtgatcttggctcact

SEQ ID NO: 172982 - DNA, 18 bp, Homo sapiens
tgatgatttaatctgtag

SEQ ID NO: 172983 - DNA, 23 bp, Homo sapiens
cgtgtgtatatgtatatatgtgt

SEQ ID NO: 172984 - DNA, 22 bp, Homo sapiens
tgtgtgtatgtgtatatgtata

SEQ ID NO: 172985 - DNA, 23 bp, Homo sapiens
atatatgtgtatgtgtatataga

SEQ ID NO: 172986 - DNA, 21 bp, Homo sapiens
tccttatcttactgcacctga

SEQ ID NO: 172987 - DNA, 21 bp, Homo sapiens
gaagacaagtgatttccttga

SEQ ID NO: 172988 - DNA, 22 bp, Homo sapiens
ctagtggaatatatatatatgt

SEQ ID NO: 172989 - DNA, 23 bp, Homo sapiens
atgtatatatatattcctgtgtg

SEQ ID NO: 172990 - DNA, 18 bp, Homo sapiens
gatgtgtgtgtgtgagaa

SEQ ID NO: 172991 - DNA, 23 bp, Homo sapiens
tgtgagtatgaagttacttggaa

SEQ ID NO: 172992 - DNA, 21 bp, Homo sapiens
aatttcagccttttccatatc

SEQ ID NO: 172993 - DNA, 20 bp, Homo sapiens
tacctgcttactcagttact

SEQ ID NO: 172994 - DNA, 22 bp, Homo sapiens
tacatgtgcacattgtgcacat

SEQ ID NO: 172995 - DNA, 23 bp, Homo sapiens
cagatgtgagccactgtgcttgg

SEQ ID NO: 172996 - DNA, 23 bp, Homo sapiens
cagagtctcactctggttgtcca

SEQ ID NO: 172997 - DNA, 23 bp, Homo sapiens
tatgagcatgtgtatatatatgt

SEQ ID NO: 172998 - DNA, 23 bp, Homo sapiens
actgtggtcagagtgtgtgcttg

SEQ ID NO: 172999 - DNA, 22 bp, Homo sapiens
aagcatgtggttgatcttagaa

SEQ ID NO: 173000 - DNA, 23 bp, Homo sapiens
ttgtgatcagtggaaatgacagg

SEQ ID NO: 173001 - DNA, 23 bp, Homo sapiens
tatgtgtacctataagtgtgtgt

SEQ ID NO: 173002 - DNA, 23 bp, Homo sapiens
gacagaatctcactctgccaccc

SEQ ID NO: 173003 - DNA, 23 bp, Homo sapiens
tgtgtgtgtatgtgtatgcatgc

SEQ ID NO: 173004 - DNA, 23 bp, Homo sapiens
ttctgtgaagaaagtcaatggta

SEQ ID NO: 173005 - DNA, 19 bp, Homo sapiens
tgtctgcttgtgatatttg

SEQ ID NO: 173006 - DNA, 23 bp, Homo sapiens
attttctttcttaacaattgatt

SEQ ID NO: 173007 - DNA, 23 bp, Homo sapiens
ttagttaaactttggttggttag

SEQ ID NO: 173008 - DNA, 23 bp, Homo sapiens
gacagagtctcgctctgtcaccc

SEQ ID NO: 173009 - DNA, 23 bp, Homo sapiens
aatatgtgtgatattcatagtat

SEQ ID NO: 173010 - DNA, 23 bp, Homo sapiens
aggtgttcactgaggctgtgttt

SEQ ID NO: 173011 - DNA, 22 bp, Homo sapiens
gacagagtctcactgcctcacc

SEQ ID NO: 173012 - DNA, 20 bp, Homo sapiens
aaacaactcttccaggaagc

SEQ ID NO: 173013 - DNA, 23 bp, Homo sapiens
tggatagaattgattttatattg

SEQ ID NO: 173014 - DNA, 23 bp, Homo sapiens
agatggagtctcactctctcacc

SEQ ID NO: 173015 - DNA, 20 bp, Homo sapiens
tctcttagtctgttaagaga

SEQ ID NO: 173016 - DNA, 23 bp, Homo sapiens
cagtgtttgtagtcttggctact

SEQ ID NO: 173017 - DNA, 22 bp, Homo sapiens
attcacacacatatataagtgt

SEQ ID NO: 173018 - DNA, 23 bp, Homo sapiens
tatacacatacacacatatgtgt

SEQ ID NO: 173019 - DNA, 23 bp, Homo sapiens
cgtgtgtatatgtatatatgtgt

SEQ ID NO: 173020 - DNA, 22 bp, Homo sapiens
tgtgtgtatgtgtatatgtata

SEQ ID NO: 173021 - DNA, 23 bp, Homo sapiens
tatgtgtatatgtatatgtctgt

SEQ ID NO: 173022 - DNA, 22 bp, Homo sapiens
atgtatgtgcacatgtgtatgt

SEQ ID NO: 173023 - DNA, 22 bp, Homo sapiens
atcatggtcattctctgtctca

SEQ ID NO: 173024 - DNA, 19 bp, Homo sapiens
aatatacatcatgatatag

SEQ ID NO: 173025 - DNA, 23 bp, Homo sapiens
ttttgcaggctatagtattcttt

SEQ ID NO: 173026 - DNA, 20 bp, Homo sapiens
ttaggctatttatttcagtg

SEQ ID NO: 173027 - DNA, 21 bp, Homo sapiens
tattggttaaaaatggaaaga

SEQ ID NO: 173028 - DNA, 21 bp, Homo sapiens
tattttttatttcgatagctt

SEQ ID NO: 173029 - DNA, 23 bp, Homo sapiens
agatggactctcactctggcact

SEQ ID NO: 173030 - DNA, 21 bp, Homo sapiens
ttttgcactcagtggtatgtc

SEQ ID NO: 173031 - DNA, 18 bp, Homo sapiens
aaggaagaaataaggtat

SEQ ID NO: 173032 - DNA, 23 bp, Homo sapiens
ggaaaagtctgactggatggctt

SEQ ID NO: 173033 - DNA, 23 bp, Homo sapiens
ggagtctcgctctgtcactcagg

SEQ ID NO: 173034 - DNA, 20 bp, Homo sapiens
tggtgtgatcttggctcact

SEQ ID NO: 173035 - DNA, 21 bp, Homo sapiens
gatgattagttaaggtcctag

SEQ ID NO: 173036 - DNA, 18 bp, Homo sapiens
tgatgatttaatctgtag

SEQ ID NO: 173037 - DNA, 23 bp, Homo sapiens
cgtgtgtatatgtatatatgtgt

SEQ ID NO: 173038 - DNA, 22 bp, Homo sapiens
tgtgtgtatgtgtatatgtata

SEQ ID NO: 173039 - DNA, 23 bp, Homo sapiens
atatatgtgtatgtgtatataga

SEQ ID NO: 173040 - DNA, 21 bp, Homo sapiens
tccttatcttactgcacctga

SEQ ID NO: 173041 - DNA, 21 bp, Homo sapiens
gaagacaagtgatttccttga

SEQ ID NO: 173042 - DNA, 22 bp, Homo sapiens
ctagtggaatatatatatatgt

SEQ ID NO: 173043 - DNA, 23 bp, Homo sapiens
atgtatatatatattcctgtgtg

SEQ ID NO: 173044 - DNA, 18 bp, Homo sapiens
gatgtgtgtgtgtgagaa

SEQ ID NO: 173045 - DNA, 23 bp, Homo sapiens
tgtgagtatgaagttacttggaa

SEQ ID NO: 173046 - DNA, 21 bp, Homo sapiens
aatttcagccttttccatatc

SEQ ID NO: 173047 - DNA, 20 bp, Homo sapiens
tacctgcttactcagttact

SEQ ID NO: 173048 - DNA, 22 bp, Homo sapiens
tacatgtgcacattgtgcacat

SEQ ID NO: 173049 - DNA, 23 bp, Homo sapiens
agatggactctcactctggcact

SEQ ID NO: 173050 - DNA, 21 bp, Homo sapiens
ttttgcactcagtggtatgtc

SEQ ID NO: 173051 - DNA, 22 bp, Homo sapiens
gacagagtctcactgcctcacc

SEQ ID NO: 173052 - DNA, 20 bp, Homo sapiens
aaacaactcttccaggaagc

SEQ ID NO: 173053 - DNA, 23 bp, Homo sapiens
tggatagaattgattttatattg

SEQ ID NO: 173054 - DNA, 23 bp, Homo sapiens
ctagagatgggatttcatgatgt

SEQ ID NO: 173055 - DNA, 23 bp, Homo sapiens
gttttactgcctgctcttttgag

SEQ ID NO: 173056 - DNA, 23 bp, Homo sapiens
tgtgagtatgaagttacttggaa

SEQ ID NO: 173057 - DNA, 20 bp, Homo sapiens
aagctctcttctgtgcagaa

SEQ ID NO: 173058 - DNA, 21 bp, Homo sapiens
aatttcagccttttccatatc

SEQ ID NO: 173059 - DNA, 20 bp, Homo sapiens
tacctgcttactcagttact

SEQ ID NO: 173060 - DNA, 22 bp, Homo sapiens
tacatgtgcacattgtgcacat

SEQ ID NO: 173061 - DNA, 20 bp, Homo sapiens
tgacaccttcttgatctgtc

SEQ ID NO: 173062 - DNA, 23 bp, Homo sapiens
gtcagtggctgtgttcaacaggt

SEQ ID NO: 173063 - DNA, 23 bp, Homo sapiens
gtgtgtgtgtatctgtgtgtatg

SEQ ID NO: 173064 - DNA, 22 bp, Homo sapiens
ttatttttggattgccatactg

SEQ ID NO: 173065 - DNA, 23 bp, Homo sapiens
caaatgtgagacaccacactcag

SEQ ID NO: 173066 - DNA, 18 bp, Homo sapiens
acacacacacacatacat

SEQ ID NO: 173067 - DNA, 19 bp, Homo sapiens
gtgtgtgtgtatataaata

SEQ ID NO: 173068 - DNA, 22 bp, Homo sapiens
tgcctgcctccctgcctgcctg

SEQ ID NO: 173069 - DNA, 23 bp, Homo sapiens
tatgtacaagtggagcaggttct

SEQ ID NO: 173070 - DNA, 23 bp, Homo sapiens
agttcagactcactgactgactt

SEQ ID NO: 173071 - DNA, 23 bp, Homo sapiens
ttgtggtagtgtctggtacatac

SEQ ID NO: 173072 - DNA, 18 bp, Homo sapiens
agcaacctctgcctcctg

SEQ ID NO: 173073 - DNA, 22 bp, Homo sapiens
gactttcttcttttccctgaat

SEQ ID NO: 173074 - DNA, 22 bp, Homo sapiens
ttagtttctttttcatttgaag

SEQ ID NO: 173075 - DNA, 23 bp, Homo sapiens
atgtgtgtgtgcatatgtgtatc

SEQ ID NO: 173076 - DNA, 23 bp, Homo sapiens
cagagtggtcatgggtcaggctt

SEQ ID NO: 173077 - DNA, 23 bp, Homo sapiens
ttacagcctctgaaagtgttgga

SEQ ID NO: 173078 - DNA, 23 bp, Homo sapiens
aaatgtgagacaccacactcagc

SEQ ID NO: 173079 - DNA, 23 bp, Homo sapiens
taggttcaaagagtagatgtgca

SEQ ID NO: 173080 - DNA, 23 bp, Homo sapiens
gtttctcactctgggtgtacatt

SEQ ID NO: 173081 - DNA, 23 bp, Homo sapiens
atatgcgtgcatatgtatgtgta

SEQ ID NO: 173082 - DNA, 23 bp, Homo sapiens
tacacatataatttgtgtgtgta

SEQ ID NO: 173083 - DNA, 22 bp, Homo sapiens
ttatagtaattgtgaatgggag

SEQ ID NO: 173084 - DNA, 21 bp, Homo sapiens
tcacacttgaagcagtagtct

SEQ ID NO: 173085 - DNA, 19 bp, Homo sapiens
tatctgcatctattgggat

SEQ ID NO: 173086 - DNA, 23 bp, Homo sapiens
acatatatgtacacatacataca

SEQ ID NO: 173087 - DNA, 18 bp, Homo sapiens
atacatgtatatatgtat

SEQ ID NO: 173088 - DNA, 23 bp, Homo sapiens
aatgagagtgaagagagagtgta

SEQ ID NO: 173089 - DNA, 18 bp, Homo sapiens
atgtatgtatatatgtgt

SEQ ID NO: 173090 - DNA, 18 bp, Homo sapiens
ttggagctctctgtgttt

SEQ ID NO: 173091 - DNA, 23 bp, Homo sapiens
aagttttctttctgttctgtcat

SEQ ID NO: 173092 - DNA, 21 bp, Homo sapiens
tgagtctcattctgtcaccca

SEQ ID NO: 173093 - DNA, 23 bp, Homo sapiens
tttttgtgtatatataatgtgta

SEQ ID NO: 173094 - DNA, 21 bp, Homo sapiens
gagtctcactctgtcacccgg

SEQ ID NO: 173095 - DNA, 18 bp, Homo sapiens
gtgaaatagatttgttta

SEQ ID NO: 173096 - DNA, 20 bp, Homo sapiens
gtcaactctctttcactgtc

SEQ ID NO: 173097 - DNA, 23 bp, Homo sapiens
tatatgcatatatgtatatatgt

SEQ ID NO: 173098 - DNA, 18 bp, Homo sapiens
tgaacccagtacctcaga

SEQ ID NO: 173099 - DNA, 19 bp, Homo sapiens
gcatacacacatatgtgta

SEQ ID NO: 173100 - DNA, 21 bp, Homo sapiens
tgtgtgtgtatatatgtgtgt

SEQ ID NO: 173101 - DNA, 22 bp, Homo sapiens
atatgtatatgtatatgtgtgt

SEQ ID NO: 173102 - DNA, 23 bp, Homo sapiens
atgtgtgtgcatgtgtatatgta

SEQ ID NO: 173103 - DNA, 21 bp, Homo sapiens
tatacacacatatacatatac

SEQ ID NO: 173104 - DNA, 18 bp, Homo sapiens
tatgcatatataatgtat

SEQ ID NO: 173105 - DNA, 23 bp, Homo sapiens
atatgtgtatgtgtatatatatg

SEQ ID NO: 173106 - DNA, 18 bp, Homo sapiens
tatgcatatataatgtat

SEQ ID NO: 173107 - DNA, 23 bp, Homo sapiens
atgtgtatgtgtatatatatgca

SEQ ID NO: 173108 - DNA, 23 bp, Homo sapiens
tgtgtgtctcttagtgtattacc

SEQ ID NO: 173109 - DNA, 23 bp, Homo sapiens
tgagttcattgtagattctggat

SEQ ID NO: 173110 - DNA, 23 bp, Homo sapiens
tgagttcattgtagattctggat

SEQ ID NO: 173111 - DNA, 22 bp, Homo sapiens
tgatactgctttgtgatgtgtg

SEQ ID NO: 173112 - DNA, 22 bp, Homo sapiens
taggttgaaaacactctttaga

SEQ ID NO: 173113 - DNA, 23 bp, Homo sapiens
caaagtctcactgtgtcacccag

SEQ ID NO: 173114 - DNA, 20 bp, Homo sapiens
tcagtggctctcactctctg

SEQ ID NO: 173115 - DNA, 18 bp, Homo sapiens
tatgtatacacacacaca

SEQ ID NO: 173116 - DNA, 21 bp, Homo sapiens
tttggttttgatttgaatgtc

SEQ ID NO: 173117 - DNA, 20 bp, Homo sapiens
tgaggttggaggatcttttg

SEQ ID NO: 173118 - DNA, 18 bp, Homo sapiens
tgtgtatgtatatatacg

SEQ ID NO: 173119 - DNA, 22 bp, Homo sapiens
atatgtatatatgtatgtgtgt

SEQ ID NO: 173120 - DNA, 23 bp, Homo sapiens
tgtatctatgtatgtgtgtatct

SEQ ID NO: 173121 - DNA, 23 bp, Homo sapiens
ggagtctcactctgtctcccagg

SEQ ID NO: 173122 - DNA, 23 bp, Homo sapiens
taatacagagggtttatgttttt

SEQ ID NO: 173123 - DNA, 21 bp, Homo sapiens
atataattttattgcattgtg

SEQ ID NO: 173124 - DNA, 20 bp, Homo sapiens
tgagaggtgacagtgtgctg

SEQ ID NO: 173125 - DNA, 23 bp, Homo sapiens
attccactatatatagtatgtat

SEQ ID NO: 173126 - DNA, 19 bp, Homo sapiens
tcagccacactcactgcct

SEQ ID NO: 173127 - DNA, 18 bp, Homo sapiens
tcacttctcactatgtct

SEQ ID NO: 173128 - DNA, 21 bp, Homo sapiens
tcctatctctgtatggcctgg

SEQ ID NO: 173129 - DNA, 22 bp, Homo sapiens
ctgggttatgattatagagtga

SEQ ID NO: 173130 - DNA, 20 bp, Homo sapiens
ttgtctctgccaggctttgg

SEQ ID NO: 173131 - DNA, 23 bp, Homo sapiens
agagaaaactagatacctgatat

SEQ ID NO: 173132 - DNA, 20 bp, Homo sapiens
atctatgtatgcatgtgtgt

SEQ ID NO: 173133 - DNA, 22 bp, Homo sapiens
tgtgttgtgtgtacatatacct

SEQ ID NO: 173134 - DNA, 21 bp, Homo sapiens
tgtgtacttacctataagttc

SEQ ID NO: 173135 - DNA, 23 bp, Homo sapiens
ctgctgtctttttgttcatctgt

SEQ ID NO: 173136 - DNA, 20 bp, Homo sapiens
agtcagcatccctttgcaca

SEQ ID NO: 173137 - DNA, 22 bp, Homo sapiens
tgtgtgacaccctataaacagt

SEQ ID NO: 173138 - DNA, 18 bp, Homo sapiens
ttctagagagttatagca

SEQ ID NO: 173139 - DNA, 21 bp, Homo sapiens
ttgagaggtgagtgtgttgaa

SEQ ID NO: 173140 - DNA, 21 bp, Homo sapiens
tggttcacacctgtaatcaca

SEQ ID NO: 173141 - DNA, 23 bp, Homo sapiens
attgctctttctgcttgtagttt

SEQ ID NO: 173142 - DNA, 22 bp, Homo sapiens
tgacaaggatatagcttgattt

SEQ ID NO: 173143 - DNA, 18 bp, Homo sapiens
aggtatgcttatatgtgt

SEQ ID NO: 173144 - DNA, 19 bp, Homo sapiens
aaaattgtttttgttgagc

SEQ ID NO: 173145 - DNA, 21 bp, Homo sapiens
tatctctgtcgcttacatatt

SEQ ID NO: 173146 - DNA, 23 bp, Homo sapiens
atatatgtacatatatatgtaca

SEQ ID NO: 173147 - DNA, 23 bp, Homo sapiens
atatatgtacatatatatgtaca

SEQ ID NO: 173148 - DNA, 20 bp, Homo sapiens
atatatgtacatatatatgt

SEQ ID NO: 173149 - DNA, 22 bp, Homo sapiens
tttctcaggctgtttcttctga

SEQ ID NO: 173150 - DNA, 22 bp, Homo sapiens
tgcaaagtggtatatttctctt

SEQ ID NO: 173151 - DNA, 23 bp, Homo sapiens
tacaagtgcagaatgtgcagctt

SEQ ID NO: 173152 - DNA, 19 bp, Homo sapiens
tcagaataggagatgttac

SEQ ID NO: 173153 - DNA, 23 bp, Homo sapiens
taagtgttaataattcaggtatg

SEQ ID NO: 173154 - DNA, 23 bp, Homo sapiens
tacatgtgcctttctctctctct

SEQ ID NO: 173155 - DNA, 23 bp, Homo sapiens
ctgtgtgtatatatatatatgtg

SEQ ID NO: 173156 - DNA, 20 bp, Homo sapiens
acagtatattactatatgta

SEQ ID NO: 173157 - DNA, 20 bp, Homo sapiens
tgtatagtatagtacatata

SEQ ID NO: 173158 - DNA, 19 bp, Homo sapiens
gtgtgtgtgtgtgtgtgtg

SEQ ID NO: 173159 - DNA, 21 bp, Homo sapiens
tcactgcagtttcaatctctc

SEQ ID NO: 173160 - DNA, 23 bp, Homo sapiens
acattgtctggctctgtcactca

SEQ ID NO: 173161 - DNA, 21 bp, Homo sapiens
acatgtgcagaatgtgcaggt

SEQ ID NO: 173162 - DNA, 23 bp, Homo sapiens
tctgagatcaaggtgtaagcaga

SEQ ID NO: 173163 - DNA, 23 bp, Homo sapiens
cttagcttgttgatgctgtcttc

SEQ ID NO: 173164 - DNA, 23 bp, Homo sapiens
tatgtgtgtgcgtgtatagttcc

SEQ ID NO: 173165 - DNA, 21 bp, Homo sapiens
tatacacacacatatgtatgt

SEQ ID NO: 173166 - DNA, 23 bp, Homo sapiens
tatgtgtatatatatgtgtgtgt

SEQ ID NO: 173167 - DNA, 23 bp, Homo sapiens
tgagttcattgtagattctggat

SEQ ID NO: 173168 - DNA, 23 bp, Homo sapiens
tgagttcattgtagattctggat

SEQ ID NO: 173169 - DNA, 23 bp, Homo sapiens
agaatacaaagctaaatctgcat

SEQ ID NO: 173170 - DNA, 23 bp, Homo sapiens
taacagagacaagtgagaggaca

SEQ ID NO: 173171 - DNA, 23 bp, Homo sapiens
tttctctctacctctaatttcat

SEQ ID NO: 173172 - DNA, 23 bp, Homo sapiens
atcattatgtagtagtagtgctg

SEQ ID NO: 173173 - DNA, 23 bp, Homo sapiens
atgatgatgatgatgatgatggc

SEQ ID NO: 173174 - DNA, 23 bp, Homo sapiens
tatacatgtatgtacatatgtgt

SEQ ID NO: 173175 - DNA, 22 bp, Homo sapiens
ccttggaattgttgatgtacat

SEQ ID NO: 173176 - DNA, 23 bp, Homo sapiens
actgggtctggctctgttctcca

SEQ ID NO: 173177 - DNA, 21 bp, Homo sapiens
agtacagtggctcaatctcag

SEQ ID NO: 173178 - DNA, 21 bp, Homo sapiens
taccagactggcagaatactc

SEQ ID NO: 173179 - DNA, 23 bp, Homo sapiens
aatgaacattgcagaacttttga

SEQ ID NO: 173180 - DNA, 23 bp, Homo sapiens
cggagtctcgctctgtctcccag

SEQ ID NO: 173181 - DNA, 23 bp, Homo sapiens
tatgtatatatacatatgtgtat

SEQ ID NO: 173182 - DNA, 18 bp, Homo sapiens
tgggctcatgtacccaat

SEQ ID NO: 173183 - DNA, 22 bp, Homo sapiens
atatatgtgcatgtgtttttta

SEQ ID NO: 173184 - DNA, 23 bp, Homo sapiens
acatgtgcacaatgtgcaggttt

SEQ ID NO: 173185 - DNA, 21 bp, Homo sapiens
tgtatatatatatgtgtgtat

SEQ ID NO: 173186 - DNA, 23 bp, Homo sapiens
tatacgtgtgtgtgtgtgtgtgt

SEQ ID NO: 173187 - DNA, 23 bp, Homo sapiens
tgagttcattgtagattctggat

SEQ ID NO: 173188 - DNA, 23 bp, Homo sapiens
tgagttcattgtagattctggat

SEQ ID NO: 173189 - DNA, 21 bp, Homo sapiens
atcacattttcttaatctgag

SEQ ID NO: 173190 - DNA, 23 bp, Homo sapiens
agatctgagaatgatgttgtatg

SEQ ID NO: 173191 - DNA, 23 bp, Homo sapiens
aagtactgtttttagctgtttgt

SEQ ID NO: 173192 - DNA, 20 bp, Homo sapiens
atactgctggttacagtctt

SEQ ID NO: 173193 - DNA, 19 bp, Homo sapiens
aaaggaaaagaaggaaaga

SEQ ID NO: 173194 - DNA, 20 bp, Homo sapiens
acggactctcgctctgtcgc

SEQ ID NO: 173195 - DNA, 23 bp, Homo sapiens
acagccaggtacagtttcctaaa

SEQ ID NO: 173196 - DNA, 23 bp, Homo sapiens
gcttactgtagtagacaaaggta

SEQ ID NO: 173197 - DNA, 21 bp, Homo sapiens
agacacaatctgtgtcacact

SEQ ID NO: 173198 - DNA, 23 bp, Homo sapiens
tgtcacttgagtctctgtgaaga

SEQ ID NO: 173199 - DNA, 23 bp, Homo sapiens
tatgtttatgtatacgttcatgt

SEQ ID NO: 173200 - DNA, 22 bp, Homo sapiens
cctctcagcctgactctgtgga

SEQ ID NO: 173201 - DNA, 23 bp, Homo sapiens
gtgtgcatgcgtgtttagatgtg

SEQ ID NO: 173202 - DNA, 23 bp, Homo sapiens
tatctctttggtaatgttggagt

SEQ ID NO: 173203 - DNA, 22 bp, Homo sapiens
cagaaagtattgagataccaca

SEQ ID NO: 173204 - DNA, 22 bp, Homo sapiens
gactcactgggtctctctttcc

SEQ ID NO: 173205 - DNA, 22 bp, Homo sapiens
tgaggtggaaggatgatttgat

SEQ ID NO: 173206 - DNA, 19 bp, Homo sapiens
atgcagtcctccatgtgga

SEQ ID NO: 173207 - DNA, 23 bp, Homo sapiens
tttggaatgtattgttgaaagaa

SEQ ID NO: 173208 - DNA, 23 bp, Homo sapiens
tgagttcattgtagattctggat

SEQ ID NO: 173209 - DNA, 23 bp, Homo sapiens
tgagttcattgtagattctggat

SEQ ID NO: 173210 - DNA, 19 bp, Homo sapiens
atatgtatacatgtatatg

SEQ ID NO: 173211 - DNA, 23 bp, Homo sapiens
ctgtgcctgtgtctgtgtcctca

SEQ ID NO: 173212 - DNA, 23 bp, Homo sapiens
agactgctatcacagaatgccat

SEQ ID NO: 173213 - DNA, 21 bp, Homo sapiens
tatgtgtatatatatatatgt

SEQ ID NO: 173214 - DNA, 23 bp, Homo sapiens
tacatgtgtgtatatgtttgtat

SEQ ID NO: 173215 - DNA, 23 bp, Homo sapiens
aaagatagtacatctgtgtgtat

SEQ ID NO: 173216 - DNA, 23 bp, Homo sapiens
tgtgtgtgtacatgcttgtgtgt

SEQ ID NO: 173217 - DNA, 21 bp, Homo sapiens
tcactgccaggtttttgggag

SEQ ID NO: 173218 - DNA, 23 bp, Homo sapiens
tggaatctcactctgtcactcag

SEQ ID NO: 173219 - DNA, 18 bp, Homo sapiens
acagtggtgtgatctcag

SEQ ID NO: 173220 - DNA, 22 bp, Homo sapiens
gcagagtctcactctgtcgccg

SEQ ID NO: 173221 - DNA, 19 bp, Homo sapiens
aggtgcttaatatttattt

SEQ ID NO: 173222 - DNA, 23 bp, Homo sapiens
tgagagatgaaagtgatacccag

SEQ ID NO: 173223 - DNA, 20 bp, Homo sapiens
gagtgaacatagtcagttgt

SEQ ID NO: 173224 - DNA, 23 bp, Homo sapiens
tgagttcattgtagattctggat

SEQ ID NO: 173225 - DNA, 23 bp, Homo sapiens
tgagttcattgtagattctggat

SEQ ID NO: 173226 - DNA, 22 bp, Homo sapiens
ttaatacatgtatattgtgcat

SEQ ID NO: 173227 - DNA, 21 bp, Homo sapiens
tatgtctatatataaatatgt

SEQ ID NO: 173228 - DNA, 23 bp, Homo sapiens
ttacctggacttcatctggattc

SEQ ID NO: 173229 - DNA, 19 bp, Homo sapiens
ttctgacaaaagaaacctt

SEQ ID NO: 173230 - DNA, 22 bp, Homo sapiens
acatgtgcacaatgtgcaggtt

SEQ ID NO: 173231 - DNA, 23 bp, Homo sapiens
tggatctgtagtgattttgtgct

SEQ ID NO: 173232 - DNA, 22 bp, Homo sapiens
attgtgaatgggagttcactca

SEQ ID NO: 173233 - DNA, 23 bp, Homo sapiens
atgtgtgtgtatatgtacatata

SEQ ID NO: 173234 - DNA, 22 bp, Homo sapiens
atatacatgtatatgtatacac

SEQ ID NO: 173235 - DNA, 21 bp, Homo sapiens
gaaaatcccaatgaatgctga

SEQ ID NO: 173236 - DNA, 21 bp, Homo sapiens
gaaaatcccaatgaatgctga

SEQ ID NO: 173237 - DNA, 21 bp, Homo sapiens
gaaaatcccaatgaatgctga

SEQ ID NO: 173238 - DNA, 18 bp, Homo sapiens
tagcttcagtgtcatctg

SEQ ID NO: 173239 - DNA, 23 bp, Homo sapiens
tgtcaggctctgtgtttctgttg

SEQ ID NO: 173240 - DNA, 23 bp, Homo sapiens
cccagagagaagacaggcaggag

SEQ ID NO: 173241 - DNA, 21 bp, Homo sapiens
tctgactccattcccaaaaga

SEQ ID NO: 173242 - DNA, 23 bp, Homo sapiens
tggattggaatgtagtctggtgt

SEQ ID NO: 173243 - DNA, 21 bp, Homo sapiens
attctgtctgtatgtcttttg

SEQ ID NO: 173244 - DNA, 21 bp, Homo sapiens
cacctaggtgcttccctagtt

SEQ ID NO: 173245 - DNA, 21 bp, Homo sapiens
ctgagaaaagagactctgcac

SEQ ID NO: 173246 - DNA, 20 bp, Homo sapiens
aagcagtcaggaatagtaca

SEQ ID NO: 173247 - DNA, 23 bp, Homo sapiens
tgagttcattgtagattctggat

SEQ ID NO: 173248 - DNA, 23 bp, Homo sapiens
tgagttcattgtagattctggat

SEQ ID NO: 173249 - DNA, 21 bp, Homo sapiens
tgcattattaagaagtctgtc

SEQ ID NO: 173250 - DNA, 19 bp, Homo sapiens
agaggatttaaaaatatgt

SEQ ID NO: 173251 - DNA, 21 bp, Homo sapiens
tgtatacatatacaaaatgta

SEQ ID NO: 173252 - DNA, 21 bp, Homo sapiens
agttccagagtgagacttttt

SEQ ID NO: 173253 - DNA, 23 bp, Homo sapiens
gggagtctcactctgtcactcag

SEQ ID NO: 173254 - DNA, 23 bp, Homo sapiens
tatgacagtcaatatctctctta

SEQ ID NO: 173255 - DNA, 21 bp, Homo sapiens
tgagaacattattagacctgt

SEQ ID NO: 173256 - DNA, 22 bp, Homo sapiens
atgtgcacaacgtgcaggtttg

SEQ ID NO: 173257 - DNA, 21 bp, Homo sapiens
tacatgtgccatgttggtgtg

SEQ ID NO: 173258 - DNA, 23 bp, Homo sapiens
tgcagtactgagtgttctgcctc

SEQ ID NO: 173259 - DNA, 23 bp, Homo sapiens
aagaaatgtgtggttttgtggat

SEQ ID NO: 173260 - DNA, 23 bp, Homo sapiens
aagtatactgtttttgttgttgt

SEQ ID NO: 173261 - DNA, 21 bp, Homo sapiens
tttgagacggagtttagctct

SEQ ID NO: 173262 - DNA, 22 bp, Homo sapiens
aaaggggatgggttttctatgt

SEQ ID NO: 173263 - DNA, 23 bp, Homo sapiens
tcgagtctcactctgtcacccag

SEQ ID NO: 173264 - DNA, 22 bp, Homo sapiens
gtatgtagatgtccatgtgtgt

SEQ ID NO: 173265 - DNA, 23 bp, Homo sapiens
tagtgtctatttgtatatgtgtg

SEQ ID NO: 173266 - DNA, 22 bp, Homo sapiens
tgtttctgtgtgtttatagata

SEQ ID NO: 173267 - DNA, 23 bp, Homo sapiens
tgagcaaatgttgagatcttgtt

SEQ ID NO: 173268 - DNA, 20 bp, Homo sapiens
aacaggatgtttccatatct

SEQ ID NO: 173269 - DNA, 23 bp, Homo sapiens
atataggtatatatacttgtatg

SEQ ID NO: 173270 - DNA, 22 bp, Homo sapiens
tgggatacatgtgcaggatgtg

SEQ ID NO: 173271 - DNA, 23 bp, Homo sapiens
tgttttgagatggagtttcactc

SEQ ID NO: 173272 - DNA, 23 bp, Homo sapiens
acaacccacagacagactgtctc

SEQ ID NO: 173273 - DNA, 23 bp, Homo sapiens
ctaaagtgctgggattacaggca

SEQ ID NO: 173274 - DNA, 19 bp, Homo sapiens
atgttgctgcaaaagatat

SEQ ID NO: 173275 - DNA, 23 bp, Homo sapiens
actgcaacctctgtctcctaggt

SEQ ID NO: 173276 - DNA, 21 bp, Homo sapiens
tatttggttatatatacactt

SEQ ID NO: 173277 - DNA, 19 bp, Homo sapiens
agattcagggggttcatgt

SEQ ID NO: 173278 - DNA, 23 bp, Homo sapiens
agaagctgtggctgtgagtggct

SEQ ID NO: 173279 - DNA, 20 bp, Homo sapiens
atgaggatgtcaaatgaaat

SEQ ID NO: 173280 - DNA, 23 bp, Homo sapiens
attttctagttctgatattcatt

SEQ ID NO: 173281 - DNA, 18 bp, Homo sapiens
atgtatataagtatgtgt

SEQ ID NO: 173282 - DNA, 19 bp, Homo sapiens
tatacatatgtatgtgtat

SEQ ID NO: 173283 - DNA, 23 bp, Homo sapiens
tatgtgtatatatgtatgtgtgt

SEQ ID NO: 173284 - DNA, 19 bp, Homo sapiens
ttcatatatgaatatgtac

SEQ ID NO: 173285 - DNA, 23 bp, Homo sapiens
tgaggcttttaatttttttgttg

SEQ ID NO: 173286 - DNA, 19 bp, Homo sapiens
aataacagtgctatagtgg

SEQ ID NO: 173287 - DNA, 19 bp, Homo sapiens
tattgcatgtatatgtaat

SEQ ID NO: 173288 - DNA, 23 bp, Homo sapiens
tttaatataaggtagtttgtgtg

SEQ ID NO: 173289 - DNA, 23 bp, Homo sapiens
tctgtgtggaagtatatacagat

SEQ ID NO: 173290 - DNA, 18 bp, Homo sapiens
tgtataatttcaggtatt

SEQ ID NO: 173291 - DNA, 22 bp, Homo sapiens
atatacacatatacatatgtgt

SEQ ID NO: 173292 - DNA, 23 bp, Homo sapiens
tcaagagtatgcttgatatgatt

SEQ ID NO: 173293 - DNA, 23 bp, Homo sapiens
acaattatatttgagaaatagtt

SEQ ID NO: 173294 - DNA, 23 bp, Homo sapiens
atatatagatgcatatgtcttgt

SEQ ID NO: 173295 - DNA, 23 bp, Homo sapiens
tgagtctcactctgtcacccagg

SEQ ID NO: 173296 - DNA, 23 bp, Homo sapiens
tgagaagagccttgagtcaagat

SEQ ID NO: 173297 - DNA, 23 bp, Homo sapiens
atagtaatgaaggatatgttttg

SEQ ID NO: 173298 - DNA, 23 bp, Homo sapiens
taacatatgtatatgtatatgtg

SEQ ID NO: 173299 - DNA, 21 bp, Homo sapiens
tgtttagagtttagactgtag

SEQ ID NO: 173300 - DNA, 23 bp, Homo sapiens
catctgtcactgtcagggtttgg

SEQ ID NO: 173301 - DNA, 20 bp, Homo sapiens
ctttctcttacttatatgcc

SEQ ID NO: 173302 - DNA, 23 bp, Homo sapiens
atgtcagtggcaatttagtggaa

SEQ ID NO: 173303 - DNA, 23 bp, Homo sapiens
atctgtgtgtcagtgtatgtttt

SEQ ID NO: 173304 - DNA, 23 bp, Homo sapiens
aatatcagtgtttaagttaacat

SEQ ID NO: 173305 - DNA, 23 bp, Homo sapiens
tagatgtatgtatttatgtatgg

SEQ ID NO: 173306 - DNA, 23 bp, Homo sapiens
tatcgatatatatagatatagga

SEQ ID NO: 173307 - DNA, 23 bp, Homo sapiens
tctccctctctctctgtctcact

SEQ ID NO: 173308 - DNA, 23 bp, Homo sapiens
ggtggtaggttgattacattgga

SEQ ID NO: 173309 - DNA, 21 bp, Homo sapiens
tgtatatatatatgtctctat

SEQ ID NO: 173310 - DNA, 18 bp, Homo sapiens
tatatgcatgtatatgta

SEQ ID NO: 173311 - DNA, 23 bp, Homo sapiens
tatatgtatatatgtatatgtgt

SEQ ID NO: 173312 - DNA, 23 bp, Homo sapiens
atgtgtatatatgtatatgtgta

SEQ ID NO: 173313 - DNA, 19 bp, Homo sapiens
tgtacatatgtatacatat

SEQ ID NO: 173314 - DNA, 23 bp, Homo sapiens
atatgtgtatatgtatatatgtg

SEQ ID NO: 173315 - DNA, 23 bp, Homo sapiens
atgcgtgtatatgtatatatgtg

SEQ ID NO: 173316 - DNA, 23 bp, Homo sapiens
atgcgtgtatatgtatatatgtg

SEQ ID NO: 173317 - DNA, 23 bp, Homo sapiens
atgcgtgtatatgtatatatgtg

SEQ ID NO: 173318 - DNA, 23 bp, Homo sapiens
atgtgtgtatatgtatatatgtg

SEQ ID NO: 173319 - DNA, 23 bp, Homo sapiens
atatgtgtatatgtatatatgtg

SEQ ID NO: 173320 - DNA, 23 bp, Homo sapiens
atgtgtgtatatgtatatatgtg

SEQ ID NO: 173321 - DNA, 23 bp, Homo sapiens
atgtgtgtatatgtatatatgtg

SEQ ID NO: 173322 - DNA, 23 bp, Homo sapiens
catgtgtgtatatgtatatatgt

SEQ ID NO: 173323 - DNA, 22 bp, Homo sapiens
tgtgtgtatatgtatatatatg

SEQ ID NO: 173324 - DNA, 23 bp, Homo sapiens
tgtgtgtatatgtatatatatgt

SEQ ID NO: 173325 - DNA, 23 bp, Homo sapiens
agacggagtctcactgtctccca

SEQ ID NO: 173326 - DNA, 23 bp, Homo sapiens
aagttgtatagacagaattgtat

SEQ ID NO: 173327 - DNA, 23 bp, Homo sapiens
gttgagagactgattttgaactg

SEQ ID NO: 173328 - DNA, 21 bp, Homo sapiens
tatatgtactatatatatgtt

SEQ ID NO: 173329 - DNA, 23 bp, Homo sapiens
tgagttcattgtagattctggat

SEQ ID NO: 173330 - DNA, 23 bp, Homo sapiens
tgagttcattgtagattctggat

SEQ ID NO: 173331 - DNA, 21 bp, Homo sapiens
cacacagacacacatgtatat

SEQ ID NO: 173332 - DNA, 23 bp, Homo sapiens
tgcggtgactgattgctgatact

SEQ ID NO: 173333 - DNA, 20 bp, Homo sapiens
tacacctgtaaatatcctgt

SEQ ID NO: 173334 - DNA, 21 bp, Homo sapiens
caggggctctcaggccttcgg

SEQ ID NO: 173335 - DNA, 21 bp, Homo sapiens
atgtgtgtgtgtgtgtatcag

SEQ ID NO: 173336 - DNA, 22 bp, Homo sapiens
caagtgattctcatgcctcagc

SEQ ID NO: 173337 - DNA, 22 bp, Mus musculus
ttttgtgacccattatatggtc

SEQ ID NO: 173338 - DNA, 18 bp, Mus musculus
atttttcattttcttttg

SEQ ID NO: 173339 - DNA, 22 bp, Mus musculus
tgttttgtgaccaattatatgg

SEQ ID NO: 173340 - DNA, 23 bp, Mus musculus
acatatgtatatatatatgagtg

SEQ ID NO: 173341 - DNA, 22 bp, Mus musculus
tgttttgtgaccaattatatgg

SEQ ID NO: 173342 - DNA, 22 bp, Mus musculus
tgcaaaggaaagaagggacgtg

SEQ ID NO: 173343 - DNA, 22 bp, Mus musculus
ataagtgcatatattactgata

SEQ ID NO: 173344 - DNA, 22 bp, Mus musculus
aaactgtcagctgaatatatgt

SEQ ID NO: 173345 - DNA, 19 bp, Mus musculus
taaggaaaagtaattgttg

SEQ ID NO: 173346 - DNA, 20 bp, Mus musculus
aggtttgttgagggattact

SEQ ID NO: 173347 - DNA, 23 bp, Mus musculus
ttcatctctgtctctgtctcacc

SEQ ID NO: 173348 - DNA, 22 bp, Mus musculus
tgttttgtgaccaattatatgg

SEQ ID NO: 173349 - DNA, 23 bp, Mus musculus
ggcactgactgctcttccagagg

SEQ ID NO: 173350 - DNA, 23 bp, Mus musculus
cctgtgtctgtgtgagtctatgc

SEQ ID NO: 173351 - DNA, 23 bp, Mus musculus
tctgagaccctgagatcctggtt

SEQ ID NO: 173352 - DNA, 23 bp, Mus musculus
gtaataaaccttgagtgagatac

SEQ ID NO: 173353 - DNA, 23 bp, Mus musculus
tgcctgtctgtcgcactgtctgc

SEQ ID NO: 173354 - DNA, 23 bp, Mus musculus
tgactctctctctgacttgctcc

SEQ ID NO: 173355 - DNA, 23 bp, Mus musculus
actgtctgtgtgtctgtctgtct

SEQ ID NO: 173356 - DNA, 23 bp, Mus musculus
cagcctgtctgtctgtctgtcta

SEQ ID NO: 173357 - DNA, 22 bp, Mus musculus
tgttttgtgaccaattatatgg

SEQ ID NO: 173358 - DNA, 22 bp, Mus musculus
tctcagtgagtcaaacaaggca

SEQ ID NO: 173359 - DNA, 23 bp, Mus musculus
attcacactctgggtttaagttg

SEQ ID NO: 173360 - DNA, 23 bp, Mus musculus
aatttatcatgatctgataggat

SEQ ID NO: 173361 - DNA, 21 bp, Mus musculus
atagttattgtaaagggttct

SEQ ID NO: 173362 - DNA, 23 bp, Mus musculus
gtttctgatgactttgaggtaac

SEQ ID NO: 173363 - DNA, 23 bp, Mus musculus
attgatttcaaccagcagtttga

SEQ ID NO: 173364 - DNA, 22 bp, Mus musculus
tgttttgtgaccaattatatgg

SEQ ID NO: 173365 - DNA, 20 bp, Mus musculus
tctgtagtagtttctatctg

SEQ ID NO: 173366 - DNA, 23 bp, Mus musculus
aagagaagctgctttgaacaggg

SEQ ID NO: 173367 - DNA, 23 bp, Mus musculus
tcttcctgaggaactgccacgct

SEQ ID NO: 173368 - DNA, 22 bp, Mus musculus
gtgacactgaagagtaagtggg

SEQ ID NO: 173369 - DNA, 23 bp, Mus musculus
agacttgaagcttcagtgtctct

SEQ ID NO: 173370 - DNA, 23 bp, Mus musculus
tcctggactcattctgtctcaga

SEQ ID NO: 173371 - DNA, 22 bp, Mus musculus
tgttttgtgaccaattatatgg

SEQ ID NO: 173372 - DNA, 21 bp, Mus musculus
tactgcttttaatattctgtc

SEQ ID NO: 173373 - DNA, 23 bp, Mus musculus
ctgtcccagaaatggctggcctc

SEQ ID NO: 173374 - DNA, 22 bp, Mus musculus
tgttttgtgaccaattatatgg

SEQ ID NO: 173375 - DNA, 23 bp, Mus musculus
tctgtctctgtttagtttgtgaa

SEQ ID NO: 173376 - DNA, 23 bp, Mus musculus
atgtatatgtgtatgtgtatatg

SEQ ID NO: 173377 - DNA, 23 bp, Mus musculus
tatgtatgtgtatgtgtatgtgt

SEQ ID NO: 173378 - DNA, 19 bp, Mus musculus
taatattgaattccatggt

SEQ ID NO: 173379 - DNA, 23 bp, Mus musculus
tggatttcttcaggatctgttgt

SEQ ID NO: 173380 - DNA, 22 bp, Mus musculus
tgttttgtgaccaattatatgg

SEQ ID NO: 173381 - DNA, 23 bp, Mus musculus
tagtccatggtgatctgatagga

SEQ ID NO: 173382 - DNA, 23 bp, Mus musculus
agtgccaatgaactgtacccaaa

SEQ ID NO: 173383 - DNA, 18 bp, Mus musculus
agggcattcacacacaca

SEQ ID NO: 173384 - DNA, 23 bp, Mus musculus
tctctgtgtctatgtgtagtgta

SEQ ID NO: 173385 - DNA, 20 bp, Mus musculus
tcatacatgtgagtgtgcag

SEQ ID NO: 173386 - DNA, 23 bp, Mus musculus
caaatctcagcaaccacatgatg

SEQ ID NO: 173387 - DNA, 21 bp, Mus musculus
atcagtagctctttctttagg

SEQ ID NO: 173388 - DNA, 20 bp, Mus musculus
cactgagtgagggctttgca

SEQ ID NO: 173389 - DNA, 23 bp, Mus musculus
aaggtagagaactgatttagtag

SEQ ID NO: 173390 - DNA, 23 bp, Mus musculus
agttctgagtgtaaagtgattgt

SEQ ID NO: 173391 - DNA, 23 bp, Mus musculus
tgacatgtgacacattgtgcatg

SEQ ID NO: 173392 - DNA, 18 bp, Mus musculus
tcactgagccagctgtga

SEQ ID NO: 173393 - DNA, 18 bp, Mus musculus
accaataacgtgtggaac

SEQ ID NO: 173394 - DNA, 22 bp, Mus musculus
agatactttgttcatctcagtc

SEQ ID NO: 173395 - DNA, 23 bp, Mus musculus
gtgtgcatgtatgtatgtatgta

SEQ ID NO: 173396 - DNA, 23 bp, Mus musculus
gaatgctaggtaaagtgtcacac

SEQ ID NO: 173397 - DNA, 23 bp, Mus musculus
gaagcacagaaaatagagagcag

SEQ ID NO: 173398 - DNA, 23 bp, Mus musculus
atagtgcatgtataattaagatg

SEQ ID NO: 173399 - DNA, 22 bp, Mus musculus
tgttttgtgaccaattatatgg

SEQ ID NO: 173400 - DNA, 22 bp, Mus musculus
tgttttgtgaccaattatatgg

SEQ ID NO: 173401 - DNA, 23 bp, Mus musculus
aggttcccagtctctgtgtgtgt

SEQ ID NO: 173402 - DNA, 21 bp, Mus musculus
agagactgcctttggattgag

SEQ ID NO: 173403 - DNA, 20 bp, Mus musculus
tatatgtatgtatatatgtg

SEQ ID NO: 173404 - DNA, 22 bp, Mus musculus
tgttttgtgaccaattatatgg

SEQ ID NO: 173405 - DNA, 20 bp, Mus musculus
tatcactcatgtatacatat

SEQ ID NO: 173406 - DNA, 21 bp, Mus musculus
atgtatgcatatatatgggaa

SEQ ID NO: 173407 - DNA, 18 bp, Mus musculus
tgggatcttttggaaatc

SEQ ID NO: 173408 - DNA, 23 bp, Mus musculus
tgtgggatggaatagcagagtat

SEQ ID NO: 173409 - DNA, 23 bp, Mus musculus
ttgacacatgacagactgcagta

SEQ ID NO: 173410 - DNA, 23 bp, Mus musculus
taactgctccttgtggttgtagg

SEQ ID NO: 173411 - DNA, 23 bp, Mus musculus
tgaattgttatggagcttaaaga

SEQ ID NO: 173412 - DNA, 22 bp, Mus musculus
tgttttgtgaccaattatatgg

SEQ ID NO: 173413 - DNA, 20 bp, Mus musculus
ggctctcttctgtaattgaa

SEQ ID NO: 173414 - DNA, 23 bp, Mus musculus
tgtgtctctgtatctctttccat

SEQ ID NO: 173415 - DNA, 20 bp, Mus musculus
aagtgtacacattttggtgt

SEQ ID NO: 173416 - DNA, 23 bp, Mus musculus
tagtccatggtgatctgatagga

SEQ ID NO: 173417 - DNA, 22 bp, Mus musculus
tgttttgtaaccaattgtatgg

SEQ ID NO: 173418 - DNA, 23 bp, Mus musculus
tttccaagcctctgaggtagtgt

SEQ ID NO: 173419 - DNA, 23 bp, Mus musculus
agcagcttgtaggtagcatagta

SEQ ID NO: 173420 - DNA, 21 bp, Mus musculus
tgtgcatgatacagtgtgtgt

SEQ ID NO: 173421 - DNA, 23 bp, Mus musculus
attcaggaaggtatagagatggt

SEQ ID NO: 173422 - DNA, 23 bp, Mus musculus
tctctgtctctgggagagttttc

SEQ ID NO: 173423 - DNA, 22 bp, Mus musculus
tatgcctttggtagagttgtct

SEQ ID NO: 173424 - DNA, 23 bp, Mus musculus
tagtgtcagtgtctctctctctg

SEQ ID NO: 173425 - DNA, 21 bp, Mus musculus
gtgagccagactgtctcccag

SEQ ID NO: 173426 - DNA, 22 bp, Mus musculus
aaatctgtctctctgtctgtct

SEQ ID NO: 173427 - DNA, 18 bp, Mus musculus
tgtctgcctgcctgcctg

SEQ ID NO: 173428 - DNA, 18 bp, Mus musculus
gatcatacacattagcat

SEQ ID NO: 173429 - DNA, 23 bp, Mus musculus
tttggattttaagtgcagactct

SEQ ID NO: 173430 - DNA, 19 bp, Mus musculus
atgtgtatgtagaaatacc

SEQ ID NO: 173431 - DNA, 23 bp, Mus musculus
atgtatgtgtatatgcatatgtg

SEQ ID NO: 173432 - DNA, 20 bp, Mus musculus
atcatgaggggctggagaga

SEQ ID NO: 173433 - DNA, 22 bp, Mus musculus
atatgtattttctacatatgtg

SEQ ID NO: 173434 - DNA, 19 bp, Mus musculus
atatgtatacatacataca

SEQ ID NO: 173435 - DNA, 20 bp, Mus musculus
aggatgtatgtatgaatgta

SEQ ID NO: 173436 - DNA, 19 bp, Mus musculus
gtatgtatgtatgtatgta

SEQ ID NO: 173437 - DNA, 23 bp, Mus musculus
gaatagtagtagtagtagtagta

SEQ ID NO: 173438 - DNA, 22 bp, Mus musculus
tgttttgtgaccaattatatgg

SEQ ID NO: 173439 - DNA, 23 bp, Mus musculus
gctgctaatcattcagatgttca

SEQ ID NO: 173440 - DNA, 23 bp, Mus musculus
agaatactgagtgtagacatggc

SEQ ID NO: 173441 - DNA, 23 bp, Mus musculus
acaaagaatttgtagtctcctag

SEQ ID NO: 173442 - DNA, 21 bp, Mus musculus
tcagagcactctctgcaggca

SEQ ID NO: 173443 - DNA, 23 bp, Mus musculus
gcatgtgcatgtgcacgtgcgtg

SEQ ID NO: 173444 - DNA, 22 bp, Mus musculus
tgttttgtgaccaattatatgg

SEQ ID NO: 173445 - DNA, 20 bp, Mus musculus
tgagctttttctgacctgtg

SEQ ID NO: 173446 - DNA, 20 bp, Mus musculus
tcacagctaggatagttccc

SEQ ID NO: 173447 - DNA, 23 bp, Mus musculus
gcatgtgtgtctctatgtgtgtg

SEQ ID NO: 173448 - DNA, 23 bp, Mus musculus
atatgtatgtgtgcatgtgtttg

SEQ ID NO: 173449 - DNA, 22 bp, Mus musculus
tgttttgtgaccaattatatgg

SEQ ID NO: 173450 - DNA, 23 bp, Mus musculus
gtgtgtatgagtgtgagtgtatg

SEQ ID NO: 173451 - DNA, 23 bp, Mus musculus
ctatggctgaagacactgtgcac

SEQ ID NO: 173452 - DNA, 19 bp, Mus musculus
ttgagcaatcaacatggag

SEQ ID NO: 173453 - DNA, 23 bp, Mus musculus
tatgtgacagaggacagaggggc

SEQ ID NO: 173454 - DNA, 18 bp, Mus musculus
tggtgatggagactatga

SEQ ID NO: 173455 - DNA, 23 bp, Mus musculus
ggcactgtgacacactcactcaa

SEQ ID NO: 173456 - DNA, 23 bp, Mus musculus
atgtctgtctgtctgtctgtctg

SEQ ID NO: 173457 - DNA, 23 bp, Mus musculus
tatgatcatcttctttaggttag

SEQ ID NO: 173458 - DNA, 23 bp, Mus musculus
ttcttctgtgattttgttgaaga

SEQ ID NO: 173459 - DNA, 23 bp, Mus musculus
gccatgtctctgtctgagtcccc

SEQ ID NO: 173460 - DNA, 22 bp, Mus musculus
tgttttgtgaccaattatatgg

SEQ ID NO: 173461 - DNA, 23 bp, Mus musculus
tgactcactggctgtgtgaatgg

SEQ ID NO: 173462 - DNA, 23 bp, Mus musculus
ttcaaatctcagcaaccacatgg

SEQ ID NO: 173463 - DNA, 23 bp, Mus musculus
acattctagttctagtgcctttg

SEQ ID NO: 173464 - DNA, 23 bp, Mus musculus
cttctgaccttcacatactggct

SEQ ID NO: 173465 - DNA, 23 bp, Mus musculus
agtgagtctgtgagtgggtgagt

SEQ ID NO: 173466 - DNA, 22 bp, Mus musculus
tatcctgtagatgtgattgtca

SEQ ID NO: 173467 - DNA, 19 bp, Mus musculus
tttggtcatctgataggat

SEQ ID NO: 173468 - DNA, 23 bp, Mus musculus
ttttgtgaccaattatatggtca

SEQ ID NO: 173469 - DNA, 18 bp, Mus musculus
agttctctttctttgttg

SEQ ID NO: 173470 - DNA, 22 bp, Mus musculus
ttcgttgaatgaattgggtaga

SEQ ID NO: 173471 - DNA, 23 bp, Mus musculus
taaaagatggttatgatttgaga

SEQ ID NO: 173472 - DNA, 22 bp, Mus musculus
tgttttgtgaccaattatatgg

SEQ ID NO: 173473 - DNA, 20 bp, Mus musculus
tggctcagaggttaggagca

SEQ ID NO: 173474 - DNA, 22 bp, Mus musculus
caggctcagtctcactccctct

SEQ ID NO: 173475 - DNA, 18 bp, Mus musculus
tactaatctcagcttcac

SEQ ID NO: 173476 - DNA, 18 bp, Mus musculus
tgtcagtatattcttatc

SEQ ID NO: 173477 - DNA, 21 bp, Mus musculus
tctgtagaatgttgtttggtt

SEQ ID NO: 173478 - DNA, 21 bp, Mus musculus
aggaactgttcattagtgaga

SEQ ID NO: 173479 - DNA, 21 bp, Mus musculus
aactcctaacagtggaagcag

SEQ ID NO: 173480 - DNA, 23 bp, Mus musculus
attctcactcagtcaaaagaccc

SEQ ID NO: 173481 - DNA, 19 bp, Mus musculus
tgactgaattcctaagtgt

SEQ ID NO: 173482 - DNA, 23 bp, Mus musculus
aagtgttgtgctttctgtctctc

SEQ ID NO: 173483 - DNA, 22 bp, Mus musculus
tgttttgtgaccaattatatgg

SEQ ID NO: 173484 - DNA, 23 bp, Mus musculus
atggaatgtaaggaagtgtgtgg

SEQ ID NO: 173485 - DNA, 23 bp, Mus musculus
gaaaccactgtgactgtgactct

SEQ ID NO: 173486 - DNA, 23 bp, Mus musculus
tcactgttctgactcactgcctg

SEQ ID NO: 173487 - DNA, 23 bp, Mus musculus
tttgtatatttacatgtatgagt

SEQ ID NO: 173488 - DNA, 20 bp, Mus musculus
tttcctggcatgtaaatatg

SEQ ID NO: 173489 - DNA, 19 bp, Mus musculus
gtcagaagtgtatgtgcac

SEQ ID NO: 173490 - DNA, 21 bp, Mus musculus
tcagtctctctggttctcatc

SEQ ID NO: 173491 - DNA, 22 bp, Mus musculus
tatgtctatatgtatgtgtgtg

SEQ ID NO: 173492 - DNA, 23 bp, Mus musculus
agtgtgtgtgtgtgtgtgtgcaa

SEQ ID NO: 173493 - DNA, 23 bp, Mus musculus
catctatatctatatgtatatct

SEQ ID NO: 173494 - DNA, 23 bp, Mus musculus
atataggttgtatatgattagcc

SEQ ID NO: 173495 - DNA, 23 bp, Mus musculus
tatatgtgtatatgtatacatat

SEQ ID NO: 173496 - DNA, 23 bp, Mus musculus
tgtgtacatatgtatgcatatgt

SEQ ID NO: 173497 - DNA, 23 bp, Mus musculus
agtcacagaaaagtgtcaggtgt

SEQ ID NO: 173498 - DNA, 23 bp, Mus musculus
tggtagtcagatgattaagcttt

SEQ ID NO: 173499 - DNA, 22 bp, Mus musculus
tgttttgtgaccaattatatgg

SEQ ID NO: 173500 - DNA, 23 bp, Mus musculus
tgtaaacatcctcgactggaagc

SEQ ID NO: 173501 - DNA, 23 bp, Mus musculus
gctttcagtcggatgtttgcagc

SEQ ID NO: 173502 - DNA, 23 bp, Mus musculus
tgtaaacatcctacactctcagc

SEQ ID NO: 173503 - DNA, 22 bp, Mus musculus
tgtttactctctctgccttgga

SEQ ID NO: 173504 - DNA, 23 bp, Mus musculus
tgcatgtgtgtgtgtgtgtgaga

SEQ ID NO: 173505 - DNA, 22 bp, Mus musculus
ctgagtgattatgttcttgtga

SEQ ID NO: 173506 - DNA, 23 bp, Mus musculus
gctatacacatacatgtatacac

SEQ ID NO: 173507 - DNA, 23 bp, Mus musculus
atgtatgtatgtatgtatgtatg

SEQ ID NO: 173508 - DNA, 18 bp, Mus musculus
tgatgtctcccacgacac

SEQ ID NO: 173509 - DNA, 20 bp, Mus musculus
cctaacagtcagggcacttg

SEQ ID NO: 173510 - DNA, 18 bp, Mus musculus
tacctattgtgagtcgaa

SEQ ID NO: 173511 - DNA, 22 bp, Mus musculus
atacatgtatgttatgtttaca

SEQ ID NO: 173512 - DNA, 23 bp, Mus musculus
cagtgtgtctctcactgactcct

SEQ ID NO: 173513 - DNA, 23 bp, Mus musculus
ttcatagaagagagagagcaggt

SEQ ID NO: 173514 - DNA, 23 bp, Mus musculus
aacagggtatagagggactggag

SEQ ID NO: 173515 - DNA, 21 bp, Mus musculus
tccatggtggtctgataggat

SEQ ID NO: 173516 - DNA, 23 bp, Mus musculus
tgtatgcatgtatatatatgtgt

SEQ ID NO: 173517 - DNA, 23 bp, Mus musculus
tctctcccactctctgagcttgc

SEQ ID NO: 173518 - DNA, 18 bp, Mus musculus
tatatgctatataaagga

SEQ ID NO: 173519 - DNA, 22 bp, Mus musculus
gttctatagttttgtctttgga

SEQ ID NO: 173520 - DNA, 23 bp, Mus musculus
tgagaggtgtgtgacctgactct

SEQ ID NO: 173521 - DNA, 22 bp, Mus musculus
atgtatgtatgtatgtatgtgt

SEQ ID NO: 173522 - DNA, 22 bp, Mus musculus
taacagcatgttaatctatatt

SEQ ID NO: 173523 - DNA, 23 bp, Mus musculus
gtgtgtgtgtgtgtacacgtgca

SEQ ID NO: 173524 - DNA, 21 bp, Mus musculus
atgagcatgcacacacacaca

SEQ ID NO: 173525 - DNA, 22 bp, Mus musculus
acaggatcttacttccatattt

SEQ ID NO: 173526 - DNA, 23 bp, Mus musculus
tgtggtaatatgttgtaatgttt

SEQ ID NO: 173527 - DNA, 22 bp, Mus musculus
tgttttgtgaccaattatatgg

SEQ ID NO: 173528 - DNA, 23 bp, Mus musculus
tgtctgtctgtctgtctgtctct

SEQ ID NO: 173529 - DNA, 22 bp, Mus musculus
tgttttgtgaccaattatatgg

SEQ ID NO: 173530 - DNA, 23 bp, Mus musculus
ctctgtctctgtttagtttctgt

SEQ ID NO: 173531 - DNA, 22 bp, Mus musculus
aggatctgtccattgatgagag

SEQ ID NO: 173532 - DNA, 19 bp, Mus musculus
tgtatttatgtatgtatgc

SEQ ID NO: 173533 - DNA, 22 bp, Mus musculus
gagtaggtattcttgtcttgtc

SEQ ID NO: 173534 - DNA, 20 bp, Mus musculus
taaaagagacacactcctgt

SEQ ID NO: 173535 - DNA, 20 bp, Mus musculus
acagcagtaaaaccctaact

SEQ ID NO: 173536 - DNA, 23 bp, Mus musculus
tcactgtctctgttaattttctg

SEQ ID NO: 173537 - DNA, 23 bp, Mus musculus
tgtgtgtatatatatatgtgtgt

SEQ ID NO: 173538 - DNA, 23 bp, Mus musculus
agtctcagaattgactgaggtca

SEQ ID NO: 173539 - DNA, 23 bp, Mus musculus
gtccatggttatctgatagtatg

SEQ ID NO: 173540 - DNA, 21 bp, Mus musculus
tacacacacacatatctatct

SEQ ID NO: 173541 - DNA, 22 bp, Mus musculus
atatctatatctatatctatat

SEQ ID NO: 173542 - DNA, 23 bp, Mus musculus
ctttgtatttgtcaggctctgga

SEQ ID NO: 173543 - DNA, 21 bp, Mus musculus
tctttaagtgcatctccatgt

SEQ ID NO: 173544 - DNA, 23 bp, Mus musculus
tgtcttctgatattgttcttgtg

SEQ ID NO: 173545 - DNA, 23 bp, Mus musculus
tgcgtgtgtgtgcacattctgtg

SEQ ID NO: 173546 - DNA, 22 bp, Mus musculus
tatttggtgattatgtagttga

SEQ ID NO: 173547 - DNA, 21 bp, Mus musculus
caatactagtgaaattgttga

SEQ ID NO: 173548 - DNA, 22 bp, Mus musculus
tttcagcaagatttttgttaga

SEQ ID NO: 173549 - DNA, 18 bp, Mus musculus
ttggagtctcttacatat

SEQ ID NO: 173550 - DNA, 23 bp, Mus musculus
tgagtcccactgtcagacacttc

SEQ ID NO: 173551 - DNA, 23 bp, Mus musculus
gtatgtatgtatatatgtgtgtg

SEQ ID NO: 173552 - DNA, 23 bp, Mus musculus
gacttgatagatgatagctaatt

SEQ ID NO: 173553 - DNA, 22 bp, Mus musculus
tgttttgtgaccaattatatgg

SEQ ID NO: 173554 - DNA, 22 bp, Mus musculus
tgttttgtgaccaattatatgg

SEQ ID NO: 173555 - DNA, 22 bp, Mus musculus
tgttttgtgaccaattatatgg

SEQ ID NO: 173556 - DNA, 23 bp, Mus musculus
agagatgtgtgtggatgtggatg

SEQ ID NO: 173557 - DNA, 22 bp, Mus musculus
tgttttgtgaccaattatatgg

SEQ ID NO: 173558 - DNA, 23 bp, Mus musculus
tctggctctcacactgtttctag

SEQ ID NO: 173559 - DNA, 23 bp, Mus musculus
aggttgttgattgtagtgtctct

SEQ ID NO: 173560 - DNA, 20 bp, Mus musculus
acagacaagccagtgagctc

SEQ ID NO: 173561 - DNA, 22 bp, Mus musculus
tgttttgtgaccaattatatgg

SEQ ID NO: 173562 - DNA, 23 bp, Mus musculus
acatagtatacatagtatacaca

SEQ ID NO: 173563 - DNA, 21 bp, Mus musculus
tgtaaataaattgcatatgta

SEQ ID NO: 173564 - DNA, 23 bp, Mus musculus
agtccatggtgatctgataggat

SEQ ID NO: 173565 - DNA, 23 bp, Mus musculus
tctctgcaacagaatctcttatt

SEQ ID NO: 173566 - DNA, 20 bp, Mus musculus
ttaagctagattggggtttc

SEQ ID NO: 173567 - DNA, 23 bp, Mus musculus
ttctctgtatttctatctctctg

SEQ ID NO: 173568 - DNA, 23 bp, Mus musculus
ttgattgatattgaatagggctg

SEQ ID NO: 173569 - DNA, 23 bp, Mus musculus
cttcaaaaagctactacatgcat

SEQ ID NO: 173570 - DNA, 18 bp, Mus musculus
atagtggtctgataggat

SEQ ID NO: 173571 - DNA, 23 bp, Mus musculus
ctctgtctctctttctgcatatg

SEQ ID NO: 173572 - DNA, 23 bp, Mus musculus
aaaggtcatgctgtgcatgtaga

SEQ ID NO: 173573 - DNA, 19 bp, Mus musculus
taaagagcagagagaccag

SEQ ID NO: 173574 - DNA, 23 bp, Mus musculus
tatgtgtgtctctcagtgactca

SEQ ID NO: 173575 - DNA, 23 bp, Mus musculus
atatatatgcatatgtatgtata

SEQ ID NO: 173576 - DNA, 23 bp, Mus musculus
tgaaatgacaggcagcagtgtga

SEQ ID NO: 173577 - DNA, 20 bp, Mus musculus
tatacatatgatatgtgtat

SEQ ID NO: 173578 - DNA, 22 bp, Mus musculus
tgttttgtgaccaattatatgg

SEQ ID NO: 173579 - DNA, 22 bp, Mus musculus
ctgactgactgactgactgact

SEQ ID NO: 173580 - DNA, 23 bp, Mus musculus
agacagacaggcatagatgtggt

SEQ ID NO: 173581 - DNA, 23 bp, Mus musculus
ttactgactaaattacatgtgtt

SEQ ID NO: 173582 - DNA, 22 bp, Mus musculus
tgcaaactattcatgtttgtag

SEQ ID NO: 173583 - DNA, 22 bp, Mus musculus
cagtcttaggccatggtggtct

SEQ ID NO: 173584 - DNA, 23 bp, Mus musculus
ccagcacagtgtaaagacttggt

SEQ ID NO: 173585 - DNA, 21 bp, Mus musculus
aaatatgtctgctatgcttct

SEQ ID NO: 173586 - DNA, 23 bp, Mus musculus
tttcaagctcttatagtaagact

SEQ ID NO: 173587 - DNA, 23 bp, Mus musculus
gactctggctctcagtcaccaca

SEQ ID NO: 173588 - DNA, 23 bp, Mus musculus
tccatggtggtctgaaaggatgc

SEQ ID NO: 173589 - DNA, 23 bp, Mus musculus
ctgtgtctctgtttagtttctgt

SEQ ID NO: 173590 - DNA, 22 bp, Mus musculus
atctgtccattgatgagagtgg

SEQ ID NO: 173591 - DNA, 21 bp, Mus musculus
tgtcagcctgtgtgtatctcc

SEQ ID NO: 173592 - DNA, 22 bp, Mus musculus
tgttttgtgaccaattatatgg

SEQ ID NO: 173593 - DNA, 18 bp, Mus musculus
tgtctgcatgtcacttca

SEQ ID NO: 173594 - DNA, 23 bp, Mus musculus
aggaagcaggagatggagcagcc

SEQ ID NO: 173595 - DNA, 19 bp, Mus musculus
attctgactcgctgttttg

SEQ ID NO: 173596 - DNA, 20 bp, Mus musculus
tagtccatcataaaacctga

SEQ ID NO: 173597 - DNA, 22 bp, Mus musculus
tgttttgtgaccaattatatgg

SEQ ID NO: 173598 - DNA, 22 bp, Mus musculus
tgttttgtgaccaattatatgg

SEQ ID NO: 173599 - DNA, 22 bp, Mus musculus
tgttttgtgaccaattatatgg

SEQ ID NO: 173600 - DNA, 23 bp, Mus musculus
tgcctgcctgcctgcctgcctgc

SEQ ID NO: 173601 - DNA, 23 bp, Mus musculus
ctgtctgtctgtctgtctgtcct

SEQ ID NO: 173602 - DNA, 18 bp, Mus musculus
tctcctacagagtgtcag

SEQ ID NO: 173603 - DNA, 23 bp, Mus musculus
ctgtctgtctgtctccttgctgt

SEQ ID NO: 173604 - DNA, 23 bp, Mus musculus
gccactctgcctgtctcttagga

SEQ ID NO: 173605 - DNA, 18 bp, Mus musculus
agagggaagagaatctgg

SEQ ID NO: 173606 - DNA, 23 bp, Mus musculus
gtagtctctgtctctgtgtccgt

SEQ ID NO: 173607 - DNA, 23 bp, Mus musculus
tgtaagagtggaagacgaatgaa

SEQ ID NO: 173608 - DNA, 22 bp, Mus musculus
tcacagaaaggttttgtagaga

SEQ ID NO: 173609 - DNA, 23 bp, Mus musculus
tctgtcacactttgctctgctta

SEQ ID NO: 173610 - DNA, 23 bp, Mus musculus
agaacactgactgctcttccaga

SEQ ID NO: 173611 - DNA, 23 bp, Mus musculus
gctatcacttgagtttttgatct

SEQ ID NO: 173612 - DNA, 23 bp, Mus musculus
atcttggagttgttttgatttgc

SEQ ID NO: 173613 - DNA, 23 bp, Mus musculus
agatgataacaaatcaaggtaag

SEQ ID NO: 173614 - DNA, 23 bp, Mus musculus
tggctgaggcactctctgcctgt

SEQ ID NO: 173615 - DNA, 23 bp, Mus musculus
atctgtgtctgtatatgtatatg

SEQ ID NO: 173616 - DNA, 21 bp, Mus musculus
agaggtcaggggctggagaga

SEQ ID NO: 173617 - DNA, 19 bp, Mus musculus
tatgtatgtgtatgtgcta

SEQ ID NO: 173618 - DNA, 20 bp, Mus musculus
tgtgtgtatatctctgtgtg

SEQ ID NO: 173619 - DNA, 20 bp, Mus musculus
tatgtatgtatgtgtgtatg

SEQ ID NO: 173620 - DNA, 23 bp, Mus musculus
tgcctgcctgcctgcttcactga

SEQ ID NO: 173621 - DNA, 21 bp, Mus musculus
ccactgttctgtttctgtgac

SEQ ID NO: 173622 - DNA, 23 bp, Mus musculus
tagtgcatggtgatctgatagga

SEQ ID NO: 173623 - DNA, 21 bp, Mus musculus
ttgttttgtcaccaattttgt

SEQ ID NO: 173624 - DNA, 23 bp, Mus musculus
taaagtccttcttgaggtactct

SEQ ID NO: 173625 - DNA, 23 bp, Mus musculus
tctctctgtatgtctgtctgtct

SEQ ID NO: 173626 - DNA, 22 bp, Mus musculus
tacctgcacttgataatgcaca

SEQ ID NO: 173627 - DNA, 22 bp, Mus musculus
ttaatgtgtacatgcatgcact

SEQ ID NO: 173628 - DNA, 18 bp, Mus musculus
tgtgctaccatgacaggc

SEQ ID NO: 173629 - DNA, 23 bp, Mus musculus
aggtaggtgttctatctgtctct

SEQ ID NO: 173630 - DNA, 23 bp, Mus musculus
acatgctatgtaatgccatggct

SEQ ID NO: 173631 - DNA, 23 bp, Mus musculus
agtctctgtgagtcactgcaggc

SEQ ID NO: 173632 - DNA, 22 bp, Mus musculus
agagcatttaagaaatatttat

SEQ ID NO: 173633 - DNA, 20 bp, Mus musculus
acagaggagttaagatctca

SEQ ID NO: 173634 - DNA, 22 bp, Mus musculus
tcactcactctgagaaaactca

SEQ ID NO: 173635 - DNA, 23 bp, Mus musculus
tgtctccctcactgtctccctgt

SEQ ID NO: 173636 - DNA, 23 bp, Mus musculus
ttatgtatatgtatatgtgtaat

SEQ ID NO: 173637 - DNA, 23 bp, Mus musculus
tgtgtgtgtgtgtgtgtgtacat

SEQ ID NO: 173638 - DNA, 18 bp, Mus musculus
atatatgtacatactatg

SEQ ID NO: 173639 - DNA, 23 bp, Mus musculus
tgtgtctgtgtgtctgtccatta

SEQ ID NO: 173640 - DNA, 21 bp, Mus musculus
tgtggctgtgagtatcaggtc

SEQ ID NO: 173641 - DNA, 23 bp, Mus musculus
tctgaggcagagtctctcactga

SEQ ID NO: 173642 - DNA, 22 bp, Mus musculus
atacttcatattgtatgcagta

SEQ ID NO: 173643 - DNA, 22 bp, Mus musculus
tttgcaaatgcatgcatatgtg

SEQ ID NO: 173644 - DNA, 18 bp, Mus musculus
acagaagtgtgagtggcc

SEQ ID NO: 173645 - DNA, 19 bp, Mus musculus
agaggaaagaatagagggt

SEQ ID NO: 173646 - DNA, 23 bp, Mus musculus
tctgtgcccatctgtctgtctgt

SEQ ID NO: 173647 - DNA, 23 bp, Mus musculus
agagatgacagactgcagacaga

SEQ ID NO: 173648 - DNA, 22 bp, Mus musculus
tgtcacactttctactccctaa

SEQ ID NO: 173649 - DNA, 22 bp, Mus musculus
tgagtttcttacagtcagagtc

SEQ ID NO: 173650 - DNA, 22 bp, Mus musculus
ctgcctgcctgcctgcctgcct

SEQ ID NO: 173651 - DNA, 23 bp, Mus musculus
gcctgtcctgactctaatggctt

SEQ ID NO: 173652 - DNA, 20 bp, Mus musculus
attatggtgtctctgcggtg

SEQ ID NO: 173653 - DNA, 23 bp, Mus musculus
agaggagtcagagacaacagtgg

SEQ ID NO: 173654 - DNA, 23 bp, Mus musculus
tgtgtgtgtgtgtaagtatatgt

SEQ ID NO: 173655 - DNA, 23 bp, Mus musculus
tatctctacatatgtgtgtgtgt

SEQ ID NO: 173656 - DNA, 18 bp, Mus musculus
atacacacacgcatacat

SEQ ID NO: 173657 - DNA, 18 bp, Mus musculus
ctgaggaagaaggttgaa

SEQ ID NO: 173658 - DNA, 20 bp, Mus musculus
gtgtgggtgtctgaggggag

SEQ ID NO: 173659 - DNA, 23 bp, Mus musculus
ttggagcttacacactgtgtctc

SEQ ID NO: 173660 - DNA, 23 bp, Mus musculus
atcactgaggctgtttaagtggt

SEQ ID NO: 173661 - DNA, 23 bp, Mus musculus
atgtgtgtgtgctgtgtatgtgt

SEQ ID NO: 173662 - DNA, 21 bp, Mus musculus
tgtctctctctgggggtgcca

SEQ ID NO: 173663 - DNA, 23 bp, Mus musculus
gacatgtctctctctgggggtgc

SEQ ID NO: 173664 - DNA, 22 bp, Mus musculus
acatgtctctctctgggggtgc

SEQ ID NO: 173665 - DNA, 21 bp, Mus musculus
tccctcagaaggtaacatgtc

SEQ ID NO: 173666 - DNA, 23 bp, Mus musculus
acacaacactgacacaccttgag

SEQ ID NO: 173667 - DNA, 23 bp, Mus musculus
tctctcagactgtctcgctctgt

SEQ ID NO: 173668 - DNA, 23 bp, Mus musculus
gaatgtctttctgactctgtgtg

SEQ ID NO: 173669 - DNA, 23 bp, Mus musculus
ttctgtcacgattatttctggca

SEQ ID NO: 173670 - DNA, 19 bp, Mus musculus
tgagagatctcagtggtca

SEQ ID NO: 173671 - DNA, 23 bp, Mus musculus
cctgtgtgtctgtctgtgtgcca

SEQ ID NO: 173672 - DNA, 21 bp, Mus musculus
tctggaaatccatgctaaagt

SEQ ID NO: 173673 - DNA, 22 bp, Mus musculus
tgtgggcctctctgactctcac

SEQ ID NO: 173674 - DNA, 23 bp, Mus musculus
tgtgtgtatgtacatgtatgtga

SEQ ID NO: 173675 - DNA, 23 bp, Mus musculus
aagagcactgtctgctcttccag

SEQ ID NO: 173676 - DNA, 23 bp, Mus musculus
tttgcctgggtgagtgtatgcaa

SEQ ID NO: 173677 - DNA, 19 bp, Mus musculus
ttctctagtgatattgggg

SEQ ID NO: 173678 - DNA, 23 bp, Mus musculus
gacagaacacagactgggtggga

SEQ ID NO: 173679 - DNA, 23 bp, Mus musculus
agatgaatacaaggcatttagtg

SEQ ID NO: 173680 - DNA, 21 bp, Mus musculus
tgcctgcctgcctgtgtggaa

SEQ ID NO: 173681 - DNA, 19 bp, Mus musculus
tgtgcttgtcaaaagatga

SEQ ID NO: 173682 - DNA, 18 bp, Mus musculus
tctcaacgagacagagtg

SEQ ID NO: 173683 - DNA, 23 bp, Mus musculus
atttgaagtgaattagttgttct

SEQ ID NO: 173684 - DNA, 23 bp, Mus musculus
gctgtgagcctctgtgtgtgtgt

SEQ ID NO: 173685 - DNA, 23 bp, Mus musculus
tatgtatttgtatgtgtatgtat

SEQ ID NO: 173686 - DNA, 20 bp, Mus musculus
attatgtatatgtgtgtatg

SEQ ID NO: 173687 - DNA, 23 bp, Mus musculus
ttatatatgtatgtatatgtata

SEQ ID NO: 173688 - DNA, 23 bp, Mus musculus
acaggaacatgtcaccaagtaca

SEQ ID NO: 173689 - DNA, 18 bp, Mus musculus
ctcaccatagatgctcag

SEQ ID NO: 173690 - DNA, 18 bp, Mus musculus
tctctgcaaactcagtct

SEQ ID NO: 173691 - DNA, 23 bp, Mus musculus
gtctctctcagttagttttgaac

SEQ ID NO: 173692 - DNA, 19 bp, Mus musculus
aaggacagtgtctaagggg

SEQ ID NO: 173693 - DNA, 22 bp, Mus musculus
tgtcaagctgcaacactgaggt

SEQ ID NO: 173694 - DNA, 23 bp, Mus musculus
tctggcactgacatcctatctga

SEQ ID NO: 173695 - DNA, 23 bp, Mus musculus
atttgacagtcattttgatgaag

SEQ ID NO: 173696 - DNA, 21 bp, Mus musculus
atatatatgtgtatatgtata

SEQ ID NO: 173697 - DNA, 23 bp, Mus musculus
tttgtacatgagtgtgtatatgg

SEQ ID NO: 173698 - DNA, 23 bp, Mus musculus
tgacacacatacatatatgtgtg

SEQ ID NO: 173699 - DNA, 23 bp, Mus musculus
atatgtctgtgcatgtgtatgtg

SEQ ID NO: 173700 - DNA, 19 bp, Mus musculus
caaatggagatgctgcctt

SEQ ID NO: 173701 - DNA, 18 bp, Mus musculus
ttgctgttcctctgcatg

SEQ ID NO: 173702 - DNA, 22 bp, Mus musculus
ctgagtctcacagtctgtgttg

SEQ ID NO: 173703 - DNA, 19 bp, Mus musculus
tagtgcgaggagaggtgct

SEQ ID NO: 173704 - DNA, 22 bp, Mus musculus
agtggcccagccattgagctga

SEQ ID NO: 173705 - DNA, 23 bp, Mus musculus
actcagagggcttacccagtgtg

SEQ ID NO: 173706 - DNA, 23 bp, Mus musculus
tgcaaagtcacaagttggtttct

SEQ ID NO: 173707 - DNA, 18 bp, Mus musculus
gaggagtgaatctgttga

SEQ ID NO: 173708 - DNA, 22 bp, Mus musculus
tatcactctctgctttagtttt

SEQ ID NO: 173709 - DNA, 23 bp, Mus musculus
cctgctgtcacaggcccatcatg

SEQ ID NO: 173710 - DNA, 20 bp, Mus musculus
atgtatgtatgtatgtatgt

SEQ ID NO: 173711 - DNA, 23 bp, Mus musculus
agtccaatcactgtctctctgag

SEQ ID NO: 173712 - DNA, 22 bp, Mus musculus
gtgacattcagatgctgtgtga

SEQ ID NO: 173713 - DNA, 19 bp, Mus musculus
cacctcttcacttgtatgt

SEQ ID NO: 173714 - DNA, 23 bp, Mus musculus
gagactgatacaggtttagatgt

SEQ ID NO: 173715 - DNA, 23 bp, Mus musculus
tcaggttctcagttactctctca

SEQ ID NO: 173716 - DNA, 22 bp, Mus musculus
tctaagcacatatatgtttaga

SEQ ID NO: 173717 - DNA, 22 bp, Mus musculus
tatatgcatatatataagtatc

SEQ ID NO: 173718 - DNA, 23 bp, Mus musculus
tatatgtatatgtgcacatatat

SEQ ID NO: 173719 - DNA, 22 bp, Mus musculus
atgcctttttatatatatgtca

SEQ ID NO: 173720 - DNA, 22 bp, Mus musculus
tgtgtgtacatgttcgagtgtg

SEQ ID NO: 173721 - DNA, 23 bp, Mus musculus
gtgtgcatgcttgtgcatgtgca

SEQ ID NO: 173722 - DNA, 21 bp, Mus musculus
atatgtatatgtatatgtata

SEQ ID NO: 173723 - DNA, 19 bp, Mus musculus
tatgtacatatatatatgt

SEQ ID NO: 173724 - DNA, 18 bp, Mus musculus
tggagtgaagcctgcctg

SEQ ID NO: 173725 - DNA, 23 bp, Mus musculus
gagggtcagactcagtctctctc

SEQ ID NO: 173726 - DNA, 23 bp, Mus musculus
gtatgtatctgtgcacacatatg

SEQ ID NO: 173727 - DNA, 22 bp, Mus musculus
gttataattcataggtgtcaca

SEQ ID NO: 173728 - DNA, 22 bp, Mus musculus
taactgcatgtacacacatata

SEQ ID NO: 173729 - DNA, 23 bp, Mus musculus
cactgagatcatcctgtttccat

SEQ ID NO: 173730 - DNA, 23 bp, Mus musculus
ttactggaatacaatgtatcatg

SEQ ID NO: 173731 - DNA, 23 bp, Mus musculus
atgtatgtgtatgtgtatatgta

SEQ ID NO: 173732 - DNA, 23 bp, Mus musculus
atatcacacacatatatgtgtgt

SEQ ID NO: 173733 - DNA, 23 bp, Mus musculus
tagatgaccaattgtaatggagt

SEQ ID NO: 173734 - DNA, 23 bp, Mus musculus
acaagaggcagccttggtagctg

SEQ ID NO: 173735 - DNA, 22 bp, Mus musculus
taatgctggttctccagtcagt

SEQ ID NO: 173736 - DNA, 23 bp, Mus musculus
cttagcttagttgtctctctctc

SEQ ID NO: 173737 - DNA, 21 bp, Mus musculus
atgtgtgtgtgcatgtgtgtg

SEQ ID NO: 173738 - DNA, 21 bp, Mus musculus
ccagaccctgtctgtctcagt

SEQ ID NO: 173739 - DNA, 22 bp, Mus musculus
tgttttgtgaccaattatatgg

SEQ ID NO: 173740 - DNA, 20 bp, Mus musculus
tctggtttgaactcagtgtg

SEQ ID NO: 173741 - DNA, 23 bp, Mus musculus
tgtcacagtctctgagttcatgc

SEQ ID NO: 173742 - DNA, 23 bp, Mus musculus
tgcaagtatgtatgtatgtatgt

SEQ ID NO: 173743 - DNA, 19 bp, Mus musculus
tagtgctgctgctcttagt

SEQ ID NO: 173744 - DNA, 23 bp, Mus musculus
cacgcagacgctctgactgactt

SEQ ID NO: 173745 - DNA, 23 bp, Mus musculus
tcagtgactctgtgacaaggcga

SEQ ID NO: 173746 - DNA, 23 bp, Mus musculus
ctctctgtgtgtcattgttcgga

SEQ ID NO: 173747 - DNA, 21 bp, Mus musculus
tctccacttctttccaaagct

SEQ ID NO: 173748 - DNA, 23 bp, Mus musculus
ctatctgtctcacattagcttct

SEQ ID NO: 173749 - DNA, 22 bp, Mus musculus
ttggatgttatgttttctgttt

SEQ ID NO: 173750 - DNA, 23 bp, Mus musculus
agtgagaggagtctgaggccact

SEQ ID NO: 173751 - DNA, 21 bp, Mus musculus
aaaactgtgtccatatcgtct

SEQ ID NO: 173752 - DNA, 18 bp, Mus musculus
tctcacagcctgttttgt

SEQ ID NO: 173753 - DNA, 23 bp, Mus musculus
ctctcggtctgtgagtgagatga

SEQ ID NO: 173754 - DNA, 19 bp, Mus musculus
caagtgtttgttacttctt

SEQ ID NO: 173755 - DNA, 22 bp, Mus musculus
atgtatggaagtatgttggtca

SEQ ID NO: 173756 - DNA, 19 bp, Mus musculus
tgagtgggtttatttcttc

SEQ ID NO: 173757 - DNA, 20 bp, Mus musculus
aatgacactacacatgaagt

SEQ ID NO: 173758 - DNA, 22 bp, Mus musculus
tgttttgtgaccaattatatgg

SEQ ID NO: 173759 - DNA, 22 bp, Mus musculus
tgttttgtgaccaattatatgg

SEQ ID NO: 173760 - DNA, 23 bp, Mus musculus
atgtctatggtattcttgttgta

SEQ ID NO: 173761 - DNA, 21 bp, Mus musculus
tttaagatgattttgcaatga

SEQ ID NO: 173762 - DNA, 20 bp, Mus musculus
aaagacctaggctgattaat

SEQ ID NO: 173763 - DNA, 21 bp, Mus musculus
tccatggtggtctgataggat

SEQ ID NO: 173764 - DNA, 22 bp, Mus musculus
tgttttgtgaccaattatatgg

SEQ ID NO: 173765 - DNA, 22 bp, Mus musculus
tgttttgtgaccaattatatgg

SEQ ID NO: 173766 - DNA, 21 bp, Mus musculus
tgaagagctaaaagcttttaa

SEQ ID NO: 173767 - DNA, 22 bp, Mus musculus
tatgtaactatgtatgaggtta

SEQ ID NO: 173768 - DNA, 23 bp, Mus musculus
tggatgagcatctgcttgtctga

SEQ ID NO: 173769 - DNA, 22 bp, Mus musculus
ttccaacaaccacatggtgact

SEQ ID NO: 173770 - DNA, 19 bp, Mus musculus
tgagacccacatttctgag

SEQ ID NO: 173771 - DNA, 18 bp, Mus musculus
tgaccttcaagatgtgct

SEQ ID NO: 173772 - DNA, 22 bp, Mus musculus
cctgacatgtgaggaactgtat

SEQ ID NO: 173773 - DNA, 21 bp, Mus musculus
aacagagtgcagcctcacctc

SEQ ID NO: 173774 - DNA, 22 bp, Mus musculus
aattatgtactactgatgggat

SEQ ID NO: 173775 - DNA, 23 bp, Mus musculus
agagacacaacagagtctgatca

SEQ ID NO: 173776 - DNA, 23 bp, Mus musculus
caactgggtgtcacatacctgaa

SEQ ID NO: 173777 - DNA, 23 bp, Mus musculus
ttgctccaagatcaagatctcct

SEQ ID NO: 173778 - DNA, 23 bp, Mus musculus
ctgacatgtgaggaactgtatta

SEQ ID NO: 173779 - DNA, 21 bp, Mus musculus
aacagagtgcagcctcacctc

SEQ ID NO: 173780 - DNA, 22 bp, Mus musculus
tgtgtgtctcactcaatagtga

SEQ ID NO: 173781 - DNA, 22 bp, Mus musculus
tgttttgtgaccaattatatgg

SEQ ID NO: 173782 - DNA, 23 bp, Mus musculus
ctgttgcttcttctaccaggtta

SEQ ID NO: 173783 - DNA, 22 bp, Mus musculus
tatgtgtatatatatttgtgtg

SEQ ID NO: 173784 - DNA, 22 bp, Mus musculus
tgttttgtgaccaattatatgg

SEQ ID NO: 173785 - DNA, 23 bp, Mus musculus
aaactaaggaagagactctgtgg

SEQ ID NO: 173786 - DNA, 23 bp, Mus musculus
gtgtctatgtctgtgtgtgtata

SEQ ID NO: 173787 - DNA, 23 bp, Mus musculus
ttgtctaagctttagaaatgtat

SEQ ID NO: 173788 - DNA, 23 bp, Mus musculus
actgagctagaagcttctttcct

SEQ ID NO: 173789 - DNA, 23 bp, Mus musculus
gacctagatggttctattgttct

SEQ ID NO: 173790 - DNA, 20 bp, Mus musculus
tgacactcactttctttatt

SEQ ID NO: 173791 - DNA, 23 bp, Mus musculus
aactgtgaagatggtactgttag

SEQ ID NO: 173792 - DNA, 22 bp, Mus musculus
tgttttgtgaccaattatatgg

SEQ ID NO: 173793 - DNA, 23 bp, Mus musculus
tacacacaggattagagatgttt

SEQ ID NO: 173794 - DNA, 23 bp, Mus musculus
atccgtgtgtgtgtgtgtacatg

SEQ ID NO: 173795 - DNA, 23 bp, Mus musculus
tgcgtgtgtgtctgtctctcatt

SEQ ID NO: 173796 - DNA, 23 bp, Mus musculus
tagtccatggtgatctgatagga

SEQ ID NO: 173797 - DNA, 23 bp, Mus musculus
tcagtggctctgtggctctgcct

SEQ ID NO: 173798 - DNA, 20 bp, Mus musculus
agctgtccggttctgtagtg

SEQ ID NO: 173799 - DNA, 21 bp, Mus musculus
tatatgcatatatatacatat

SEQ ID NO: 173800 - DNA, 22 bp, Mus musculus
tgttttgtgaccaattatatgg

SEQ ID NO: 173801 - DNA, 23 bp, Mus musculus
tataacaggcaggttttgtgccc

SEQ ID NO: 173802 - DNA, 23 bp, Mus musculus
aagatagacatagctatagatat

SEQ ID NO: 173803 - DNA, 22 bp, Mus musculus
atatctatttttgcttagttta

SEQ ID NO: 173804 - DNA, 22 bp, Mus musculus
tgttttgtgaccaattatatgg

SEQ ID NO: 173805 - DNA, 22 bp, Mus musculus
tgttttgtgaccaattatatgg

SEQ ID NO: 173806 - DNA, 21 bp, Mus musculus
tcatatctggaaggccttcag

SEQ ID NO: 173807 - DNA, 22 bp, Mus musculus
ttgtgtatgcatgtatatatat

SEQ ID NO: 173808 - DNA, 22 bp, Mus musculus
tatatgtgtgtgtgtgtataca

SEQ ID NO: 173809 - DNA, 20 bp, Mus musculus
tgtatgtatatatgtataca

SEQ ID NO: 173810 - DNA, 18 bp, Mus musculus
tgtatatatatgtgtatg

SEQ ID NO: 173811 - DNA, 19 bp, Mus musculus
tgacatcaatgggaggaga

SEQ ID NO: 173812 - DNA, 23 bp, Mus musculus
aaagacacagatgatactgtgct

SEQ ID NO: 173813 - DNA, 22 bp, Mus musculus
ggtatgtaggtatgtatgtatg

SEQ ID NO: 173814 - DNA, 23 bp, Mus musculus
gtatgtatgcatttatgtatgta

SEQ ID NO: 173815 - DNA, 20 bp, Mus musculus
gtgaactcattaatttcttg

SEQ ID NO: 173816 - DNA, 22 bp, Mus musculus
tgttttgtgaccaattatatgg

SEQ ID NO: 173817 - DNA, 22 bp, Mus musculus
atatgtatatatgcataggtac

SEQ ID NO: 173818 - DNA, 21 bp, Mus musculus
ttgtgtgtgtgtgtctatgtc

SEQ ID NO: 173819 - DNA, 22 bp, Mus musculus
gtgggtctctctgtgtgtgggt

SEQ ID NO: 173820 - DNA, 23 bp, Mus musculus
tctgacttagatggttgtattgt

SEQ ID NO: 173821 - DNA, 23 bp, Mus musculus
gttagatgttcttgctgtctctg

SEQ ID NO: 173822 - DNA, 23 bp, Mus musculus
tgtgtatgtgtatgtatatatat

SEQ ID NO: 173823 - DNA, 22 bp, Mus musculus
ctctttaggtcttcttgtgctg

SEQ ID NO: 173824 - DNA, 22 bp, Mus musculus
tgtatgcatatatatatgtttg

SEQ ID NO: 173825 - DNA, 22 bp, Mus musculus
tgttttgtgaccaattatatgg

SEQ ID NO: 173826 - DNA, 21 bp, Mus musculus
tgtgcatatatatatgtatgt

SEQ ID NO: 173827 - DNA, 20 bp, Mus musculus
tgtgagtgtctctgtgtgtc

SEQ ID NO: 173828 - DNA, 22 bp, Mus musculus
tgttttgtgaccaattatatgg

SEQ ID NO: 173829 - DNA, 21 bp, Mus musculus
gaacagaactcacagtgagag

SEQ ID NO: 173830 - DNA, 23 bp, Mus musculus
tactagaactgttttgttgagga

SEQ ID NO: 173831 - DNA, 19 bp, Mus musculus
ttttccaagacatgcaatg

SEQ ID NO: 173832 - DNA, 23 bp, Mus musculus
tatatgtgtattatgtattgtgt

SEQ ID NO: 173833 - DNA, 23 bp, Mus musculus
gtgggtcactctctggctgggat

SEQ ID NO: 173834 - DNA, 21 bp, Mus musculus
tgtgagtgggaaatgtgtgac

SEQ ID NO: 173835 - DNA, 23 bp, Mus musculus
gaaatggttaacactgcctgtgt

SEQ ID NO: 173836 - DNA, 23 bp, Mus musculus
ctcagagttgtgacttcctgttc

SEQ ID NO: 173837 - DNA, 23 bp, Mus musculus
gatctggttccaggcttgattca

SEQ ID NO: 173838 - DNA, 23 bp, Mus musculus
atgtatgcatgtagtatgtatat

SEQ ID NO: 173839 - DNA, 22 bp, Mus musculus
tgttttgtgaccaattatatgg

SEQ ID NO: 173840 - DNA, 23 bp, Mus musculus
ttatcactcaccctgagtctgtg

SEQ ID NO: 173841 - DNA, 22 bp, Mus musculus
acacacacacacatatatgtgt

SEQ ID NO: 173842 - DNA, 23 bp, Mus musculus
agcttttctgagacaagttagag

SEQ ID NO: 173843 - DNA, 23 bp, Mus musculus
tttgcctcacagtctcagtgtgt

SEQ ID NO: 173844 - DNA, 23 bp, Mus musculus
acatgcgacttgctctttgtgtg

SEQ ID NO: 173845 - DNA, 23 bp, Mus musculus
cacagagaacacagattgcactt

SEQ ID NO: 173846 - DNA, 23 bp, Mus musculus
agtctgactcactctttcctcac

SEQ ID NO: 173847 - DNA, 23 bp, Mus musculus
actcagtggcagagtatatgctg

SEQ ID NO: 173848 - DNA, 21 bp, Mus musculus
atgctctagactctgggttaa

SEQ ID NO: 173849 - DNA, 23 bp, Mus musculus
gagaggctctgtcagtgcctgac

SEQ ID NO: 173850 - DNA, 22 bp, Mus musculus
tggaggacagagtcaagtgaac

SEQ ID NO: 173851 - DNA, 23 bp, Mus musculus
tcttgttcctactctctctcttt

SEQ ID NO: 173852 - DNA, 21 bp, Mus musculus
gacctagatggttctattctt

SEQ ID NO: 173853 - DNA, 21 bp, Mus musculus
gtggtctgtctgtctgtctgt

SEQ ID NO: 173854 - DNA, 22 bp, Mus musculus
ttacatcatggtctctgggaca

SEQ ID NO: 173855 - DNA, 23 bp, Mus musculus
tatgtatgtatgtatgtatgact

SEQ ID NO: 173856 - DNA, 21 bp, Mus musculus
agacttgagggagcagggttc

SEQ ID NO: 173857 - DNA, 23 bp, Mus musculus
gaccagtgcttctgtgttccttc

SEQ ID NO: 173858 - DNA, 21 bp, Mus musculus
gtgtgtatatatatatgtaca

SEQ ID NO: 173859 - DNA, 23 bp, Mus musculus
ctgtgtctctgtttagtttctgt

SEQ ID NO: 173860 - DNA, 23 bp, Mus musculus
aggatctgtccattgatgagagt

SEQ ID NO: 173861 - DNA, 23 bp, Mus musculus
attctctcagtgtgttgccaggg

SEQ ID NO: 173862 - DNA, 23 bp, Mus musculus
tccttttgttatcaagctgtatc

SEQ ID NO: 173863 - DNA, 23 bp, Mus musculus
atatacattactctgggtcagaa

SEQ ID NO: 173864 - DNA, 21 bp, Mus musculus
agcctacagacagattctcct

SEQ ID NO: 173865 - DNA, 23 bp, Mus musculus
gactgtgtgtctctggctgtcct

SEQ ID NO: 173866 - DNA, 23 bp, Mus musculus
acttcactctacagaattgctta

SEQ ID NO: 173867 - DNA, 23 bp, Mus musculus
tatttgttaaggaagaatactaa

SEQ ID NO: 173868 - DNA, 18 bp, Mus musculus
tgtcagaattcttttgca

SEQ ID NO: 173869 - DNA, 22 bp, Mus musculus
taatattgttgttcagaaagct

SEQ ID NO: 173870 - DNA, 21 bp, Mus musculus
tatgtgcatgcatgtcgtgtg

SEQ ID NO: 173871 - DNA, 23 bp, Mus musculus
cagtctctctgtctcttgaaggg

SEQ ID NO: 173872 - DNA, 22 bp, Mus musculus
tatatatgtatgtaaatttagg

SEQ ID NO: 173873 - DNA, 21 bp, Mus musculus
tgagagacatctgaactgcag

SEQ ID NO: 173874 - DNA, 23 bp, Mus musculus
agcagatgtgattttgtagagct

SEQ ID NO: 173875 - DNA, 22 bp, Mus musculus
tttgtgcttgcttgtaattcag

SEQ ID NO: 173876 - DNA, 23 bp, Mus musculus
tgactcagtgtgtcaaagcgctc

SEQ ID NO: 173877 - DNA, 23 bp, Mus musculus
actctgcctgagtcactgactgt

SEQ ID NO: 173878 - DNA, 23 bp, Mus musculus
cctctctggctctcagaggcact

SEQ ID NO: 173879 - DNA, 21 bp, Mus musculus
tagagcgctgaaagtttgtgc

SEQ ID NO: 173880 - DNA, 18 bp, Mus musculus
tgtgagaactcagtgtgc

SEQ ID NO: 173881 - DNA, 23 bp, Mus musculus
atgtctacagattttgtagttct

SEQ ID NO: 173882 - DNA, 23 bp, Mus musculus
tgtgtctgtttgtcactcattca

SEQ ID NO: 173883 - DNA, 18 bp, Mus musculus
tctatgctagctcctgtg

SEQ ID NO: 173884 - DNA, 23 bp, Mus musculus
actctgcctctctctcactctga

SEQ ID NO: 173885 - DNA, 18 bp, Mus musculus
actccatcttactagcag

SEQ ID NO: 173886 - DNA, 21 bp, Mus musculus
aacaaggaagttgtatttcct

SEQ ID NO: 173887 - DNA, 23 bp, Mus musculus
tctgctacaggttttcttatgta

SEQ ID NO: 173888 - DNA, 18 bp, Mus musculus
aacagagcagtagtacct

SEQ ID NO: 173889 - DNA, 21 bp, Mus musculus
tagtgcaatgcacttggaaga

SEQ ID NO: 173890 - DNA, 22 bp, Mus musculus
aatcgctttgttttgctttggc

SEQ ID NO: 173891 - DNA, 23 bp, Mus musculus
cctctgtgaagacagacagacag

SEQ ID NO: 173892 - DNA, 21 bp, Mus musculus
cagacagagagaacacttgca

SEQ ID NO: 173893 - DNA, 20 bp, Mus musculus
agagacaagagagtctgcat

SEQ ID NO: 173894 - DNA, 23 bp, Mus musculus
tggatgtatgtgtgcctgtctgt

SEQ ID NO: 173895 - DNA, 21 bp, Mus musculus
tctgctcctctgtcagactgt

SEQ ID NO: 173896 - DNA, 23 bp, Mus musculus
catatgagtgtgtgtgtatatgt

SEQ ID NO: 173897 - DNA, 22 bp, Mus musculus
tataaacgtatatatatgtgtg

SEQ ID NO: 173898 - DNA, 23 bp, Mus musculus
agagtacacagcctgctgtctga

SEQ ID NO: 173899 - DNA, 23 bp, Mus musculus
aagacaacactcagagcacaaat

SEQ ID NO: 173900 - DNA, 22 bp, Mus musculus
tgagttctctgactgcacagtg

SEQ ID NO: 173901 - DNA, 21 bp, Mus musculus
ctggaagttagttgtattcta

SEQ ID NO: 173902 - DNA, 23 bp, Mus musculus
gaatataactgaagcacttttgg

SEQ ID NO: 173903 - DNA, 23 bp, Mus musculus
agagtccaatgggaagtgttagt

SEQ ID NO: 173904 - DNA, 23 bp, Mus musculus
tgacacaacagaaagagctgatg

SEQ ID NO: 173905 - DNA, 21 bp, Mus musculus
ctgtcagtcagtccagcgctg

SEQ ID NO: 173906 - DNA, 21 bp, Mus musculus
ctcagcatgtttttaccttca

SEQ ID NO: 173907 - DNA, 23 bp, Mus musculus
tggctgcctcagtctgactctgc

SEQ ID NO: 173908 - DNA, 22 bp, Mus musculus
gatgtctgactctctttctctg

SEQ ID NO: 173909 - DNA, 23 bp, Mus musculus
atcaccatcatctgctcccaatt

SEQ ID NO: 173910 - DNA, 18 bp, Mus musculus
gtatctggtcaagggagt

SEQ ID NO: 173911 - DNA, 23 bp, Mus musculus
ttatctgattatttttctctgtg

SEQ ID NO: 173912 - DNA, 20 bp, Mus musculus
taggtgagctttctgctaca

SEQ ID NO: 173913 - DNA, 23 bp, Mus musculus
tttacttgtacttgagcaagtga

SEQ ID NO: 173914 - DNA, 21 bp, Mus musculus
acactcagttggggctctcat

SEQ ID NO: 173915 - DNA, 22 bp, Mus musculus
tgttttgtgaccaattatatgg

SEQ ID NO: 173916 - DNA, 19 bp, Mus musculus
acagctattctctgagaat

SEQ ID NO: 173917 - DNA, 23 bp, Mus musculus
acaacactgtgtgcttcaagttc

SEQ ID NO: 173918 - DNA, 21 bp, Mus musculus
agtctcagagctttccaagac

SEQ ID NO: 173919 - DNA, 23 bp, Mus musculus
tgacagggtctcagtctcagaca

SEQ ID NO: 173920 - DNA, 23 bp, Mus musculus
tgtatgcatgtatatgtataggt

SEQ ID NO: 173921 - DNA, 20 bp, Mus musculus
tatgtatatgtatatgatgt

SEQ ID NO: 173922 - DNA, 19 bp, Mus musculus
tgtggtgatgcttttgaca

SEQ ID NO: 173923 - DNA, 23 bp, Mus musculus
tgccagaagagagagagcacatg

SEQ ID NO: 173924 - DNA, 23 bp, Mus musculus
ttctgtgcctctgtgtgtgtgca

SEQ ID NO: 173925 - DNA, 23 bp, Mus musculus
tgcacacgcaagtgtgcatgtgt

SEQ ID NO: 173926 - DNA, 23 bp, Mus musculus
tgtgtgtatgtatatatgtgtgt

SEQ ID NO: 173927 - DNA, 21 bp, Mus musculus
atgtatgtatgtatgtatgta

SEQ ID NO: 173928 - DNA, 21 bp, Mus musculus
atgtatatatgcatgagtctg

SEQ ID NO: 173929 - DNA, 23 bp, Mus musculus
tatgtgtgtacatgtatatgtgt

SEQ ID NO: 173930 - DNA, 23 bp, Mus musculus
gacatggtgaagtttcaggtctg

SEQ ID NO: 173931 - DNA, 21 bp, Mus musculus
ttgtgcaactcagactctctc

SEQ ID NO: 173932 - DNA, 23 bp, Mus musculus
tctcttcactccctgtctgcagt

SEQ ID NO: 173933 - DNA, 23 bp, Mus musculus
caacgtctgcctgtcttctgatg

SEQ ID NO: 173934 - DNA, 21 bp, Mus musculus
tgagaagatcgcatagtggag

SEQ ID NO: 173935 - DNA, 19 bp, Mus musculus
atgtatatatgtatgtatg

SEQ ID NO: 173936 - DNA, 23 bp, Mus musculus
tatacatatatatacatatgtat

SEQ ID NO: 173937 - DNA, 22 bp, Mus musculus
tgttttgtgaccaattatatgg

SEQ ID NO: 173938 - DNA, 22 bp, Mus musculus
ttactctgactgggactgtcac

SEQ ID NO: 173939 - DNA, 23 bp, Mus musculus
aatctgtctgtctctgcctccct

SEQ ID NO: 173940 - DNA, 20 bp, Mus musculus
tttgtcacaggctgtcagag

SEQ ID NO: 173941 - DNA, 20 bp, Mus musculus
tcagtgtggttaagagcact

SEQ ID NO: 173942 - DNA, 21 bp, Mus musculus
tgtgattttgtttttctctct

SEQ ID NO: 173943 - DNA, 23 bp, Mus musculus
atatgtatgtatatatgtgtgtg

SEQ ID NO: 173944 - DNA, 23 bp, Mus musculus
tgaataagctttctcatgaatca

SEQ ID NO: 173945 - DNA, 23 bp, Mus musculus
aaactcactcatatacatatgtg

SEQ ID NO: 173946 - DNA, 18 bp, Mus musculus
atctgattccttatcttg

SEQ ID NO: 173947 - DNA, 23 bp, Mus musculus
tcttatctctgcgtgcttatgca

SEQ ID NO: 173948 - DNA, 22 bp, Mus musculus
tgttttgtgaccaattatatgg

SEQ ID NO: 173949 - DNA, 19 bp, Mus musculus
tatgtatatatgtatgtat

SEQ ID NO: 173950 - DNA, 23 bp, Mus musculus
catgctgttggagtcagagctac

SEQ ID NO: 173951 - DNA, 23 bp, Mus musculus
agctgtaactccaacagcaagtg

SEQ ID NO: 173952 - DNA, 19 bp, Mus musculus
tatgcatatatatgtgtat

SEQ ID NO: 173953 - DNA, 19 bp, Mus musculus
gtcagtcattcagtccgtg

SEQ ID NO: 173954 - DNA, 22 bp, Mus musculus
agacacacacacatatggctgg

SEQ ID NO: 173955 - DNA, 23 bp, Mus musculus
gtgtcactgtgtcttacaggact

SEQ ID NO: 173956 - DNA, 20 bp, Mus musculus
gtgtgtatatgtgtatgcat

SEQ ID NO: 173957 - DNA, 23 bp, Mus musculus
ggccctgtgtctctctctgcctg

SEQ ID NO: 173958 - DNA, 23 bp, Mus musculus
tatgtcagtatgtatatgtgtgt

SEQ ID NO: 173959 - DNA, 22 bp, Mus musculus
tgaccatatgtgtgtgtatata

SEQ ID NO: 173960 - DNA, 22 bp, Mus musculus
atgtgcatgtgtatgcatgtgt

SEQ ID NO: 173961 - DNA, 23 bp, Mus musculus
tgtgtgtgtgtgcgtgcatgtgc

SEQ ID NO: 173962 - DNA, 20 bp, Mus musculus
atgtgtgcatatgcatgtgt

SEQ ID NO: 173963 - DNA, 20 bp, Mus musculus
taaatccatctggttatgaa

SEQ ID NO: 173964 - DNA, 23 bp, Mus musculus
gtatctatctctcagtgattcca

SEQ ID NO: 173965 - DNA, 23 bp, Mus musculus
tcttgtggtagcaggatctttag

SEQ ID NO: 173966 - DNA, 23 bp, Mus musculus
tgtgtgtatgtatatatgtgtgt

SEQ ID NO: 173967 - DNA, 23 bp, Mus musculus
tgagagatgtgactgtggaatgg

SEQ ID NO: 173968 - DNA, 23 bp, Mus musculus
gttagtgtatatgttagtctgtg

SEQ ID NO: 173969 - DNA, 23 bp, Mus musculus
ctgtttctctgactggtaggcct

SEQ ID NO: 173970 - DNA, 23 bp, Mus musculus
atgtagcattttgtatatttgtg

SEQ ID NO: 173971 - DNA, 21 bp, Mus musculus
tgtatgtatgtatatctgtgt

SEQ ID NO: 173972 - DNA, 23 bp, Mus musculus
tcaattagatgttcttatttgtt

SEQ ID NO: 173973 - DNA, 22 bp, Mus musculus
tgttttgtgaccaattatatgg

SEQ ID NO: 173974 - DNA, 23 bp, Mus musculus
ttttttaaagagggagctagaat

SEQ ID NO: 173975 - DNA, 18 bp, Mus musculus
gtatcagcaagtattctg

SEQ ID NO: 173976 - DNA, 23 bp, Mus musculus
tgtgcactgtgtgcactgtgtgt

SEQ ID NO: 173977 - DNA, 20 bp, Mus musculus
agagagtgctcagtggggtc

SEQ ID NO: 173978 - DNA, 23 bp, Mus musculus
aattcagtgggtaactttagagt

SEQ ID NO: 173979 - DNA, 22 bp, Mus musculus
aaggcatgcagacagaacacat

SEQ ID NO: 173980 - DNA, 23 bp, Mus musculus
tgtatctctgtttgttattgtga

SEQ ID NO: 173981 - DNA, 20 bp, Mus musculus
ttagctagtgtttgtgcaca

SEQ ID NO: 173982 - DNA, 22 bp, Mus musculus
tgttttgtgaccaattatatgg

SEQ ID NO: 173983 - DNA, 23 bp, Mus musculus
tcagtcttaagccatggtggtct

SEQ ID NO: 173984 - DNA, 19 bp, Mus musculus
tatgtaaacacacacatat

SEQ ID NO: 173985 - DNA, 18 bp, Mus musculus
tttttcaagtcgatctga

SEQ ID NO: 173986 - DNA, 23 bp, Mus musculus
tatgtctgtgtgtatgtatatat

SEQ ID NO: 173987 - DNA, 20 bp, Mus musculus
acagcataatttaagtctga

SEQ ID NO: 173988 - DNA, 23 bp, Mus musculus
atcctgcaaatagttggcataac

SEQ ID NO: 173989 - DNA, 23 bp, Mus musculus
actactgaatttgtggatctgtt

SEQ ID NO: 173990 - DNA, 18 bp, Mus musculus
cagcacataaaggacaag

SEQ ID NO: 173991 - DNA, 22 bp, Mus musculus
ttaatacttgtttgtttgcagt

SEQ ID NO: 173992 - DNA, 20 bp, Mus musculus
tgaattgttatggtcctctt

SEQ ID NO: 173993 - DNA, 21 bp, Mus musculus
tctgtctcactgtcattctgc

SEQ ID NO: 173994 - DNA, 23 bp, Mus musculus
agtcatgcattttttatctatag

SEQ ID NO: 173995 - DNA, 23 bp, Mus musculus
ttttatgatgaataccaatggat

SEQ ID NO: 173996 - DNA, 19 bp, Mus musculus
atgtgtatgaatgtgtata

SEQ ID NO: 173997 - DNA, 23 bp, Mus musculus
tctgtgtgtgtatatatatgtgt

SEQ ID NO: 173998 - DNA, 23 bp, Mus musculus
tcagtggcattgtgcctgccata

SEQ ID NO: 173999 - DNA, 23 bp, Mus musculus
cagagaagactgtgagctgtcat

SEQ ID NO: 174000 - DNA, 23 bp, Mus musculus
gagctgacagaggagagtgagcg

SEQ ID NO: 174001 - DNA, 19 bp, Mus musculus
ttaagagagatgaaagctg

SEQ ID NO: 174002 - DNA, 23 bp, Mus musculus
tagtcagtagaagggtttggctt

SEQ ID NO: 174003 - DNA, 23 bp, Mus musculus
atcaagaagtaaaggaaaagact

SEQ ID NO: 174004 - DNA, 21 bp, Mus musculus
ttgcatgtatgcagatgtgcg

SEQ ID NO: 174005 - DNA, 23 bp, Mus musculus
tgtgtatgtatgcatgtatatgt

SEQ ID NO: 174006 - DNA, 21 bp, Mus musculus
tatgcatgtatatatatatgt

SEQ ID NO: 174007 - DNA, 23 bp, Mus musculus
tcactctgactgactttcatggt

SEQ ID NO: 174008 - DNA, 23 bp, Mus musculus
cactgtgagcagactctgaggac

SEQ ID NO: 174009 - DNA, 21 bp, Mus musculus
tctctcttgctctcagtgtcc

SEQ ID NO: 174010 - DNA, 22 bp, Mus musculus
tgtgtatgtatgtatgtatgta

SEQ ID NO: 174011 - DNA, 20 bp, Mus musculus
acatagtatgagtatagttt

SEQ ID NO: 174012 - DNA, 23 bp, Mus musculus
tagacttactgcaacttgatgtg

SEQ ID NO: 174013 - DNA, 22 bp, Mus musculus
gaaagctactttgtgtgtgtgt

SEQ ID NO: 174014 - DNA, 22 bp, Mus musculus
tgttttgtgaccaattatatgg

SEQ ID NO: 174015 - DNA, 20 bp, Mus musculus
tgagttttatgtgaaggctt

SEQ ID NO: 174016 - DNA, 20 bp, Mus musculus
tgaggaagagttcagtaatt

SEQ ID NO: 174017 - DNA, 23 bp, Mus musculus
tcaaagagaagctggaagcaatc

SEQ ID NO: 174018 - DNA, 22 bp, Mus musculus
tctctgccagactcacagcctc

SEQ ID NO: 174019 - DNA, 23 bp, Mus musculus
tgagtgctttagagcctgtgaca

SEQ ID NO: 174020 - DNA, 23 bp, Mus musculus
agtgtgcctgacaggctcactgt

SEQ ID NO: 174021 - DNA, 18 bp, Mus musculus
atagtggtctgataggat

SEQ ID NO: 174022 - DNA, 22 bp, Mus musculus
tgttttgtgaccaattatatgg

SEQ ID NO: 174023 - DNA, 22 bp, Mus musculus
atgtatgtgtgtatgtgtatgt

SEQ ID NO: 174024 - DNA, 22 bp, Mus musculus
tgtgtgtatgtatgtatatatg

SEQ ID NO: 174025 - DNA, 22 bp, Mus musculus
tgtgtatatatgtgtgtgtgta

SEQ ID NO: 174026 - DNA, 23 bp, Mus musculus
tagagacactttctggtttccat

SEQ ID NO: 174027 - DNA, 21 bp, Mus musculus
tcacagagtctcagaatctcc

SEQ ID NO: 174028 - DNA, 19 bp, Mus musculus
agaggcgggcagatttctg

SEQ ID NO: 174029 - DNA, 21 bp, Mus musculus
tgtctctctcactctaactgg

SEQ ID NO: 174030 - DNA, 21 bp, Mus musculus
ttgaggcttttgaggagcatg

SEQ ID NO: 174031 - DNA, 20 bp, Mus musculus
cactggattgttggaaggtc

SEQ ID NO: 174032 - DNA, 22 bp, Mus musculus
ttgactggagtgtgtgtggact

SEQ ID NO: 174033 - DNA, 23 bp, Mus musculus
tctctctgtgctcagtgtctgtc

SEQ ID NO: 174034 - DNA, 20 bp, Mus musculus
actgagcagagttttaaggg

SEQ ID NO: 174035 - DNA, 23 bp, Mus musculus
tgtagtgacagttgtggaactct

SEQ ID NO: 174036 - DNA, 22 bp, Mus musculus
tgttttgtgaccaattatatgg

SEQ ID NO: 174037 - DNA, 21 bp, Mus musculus
tccctggctccctgtctgcaa

SEQ ID NO: 174038 - DNA, 21 bp, Mus musculus
tatctgtatatgtatatgtat

SEQ ID NO: 174039 - DNA, 22 bp, Mus musculus
tttgggagtggattttaagtgt

SEQ ID NO: 174040 - DNA, 23 bp, Mus musculus
ctgtgtctctgtttagtttctgt

SEQ ID NO: 174041 - DNA, 23 bp, Mus musculus
gatggcactgacactctctctgt

SEQ ID NO: 174042 - DNA, 22 bp, Mus musculus
ctcactctgcctgtgtgtgagc

SEQ ID NO: 174043 - DNA, 21 bp, Mus musculus
tctgtctgtctgtcttacggc

SEQ ID NO: 174044 - DNA, 20 bp, Mus musculus
aaggtctctgtctgtctttt

SEQ ID NO: 174045 - DNA, 20 bp, Mus musculus
tgtgtatggtgtatgcatgt

SEQ ID NO: 174046 - DNA, 22 bp, Mus musculus
ttcaagtaattcaggataggtt

SEQ ID NO: 174047 - DNA, 23 bp, Mus musculus
ttcagtgtgtgtatatgtgcttt

SEQ ID NO: 174048 - DNA, 23 bp, Mus musculus
tagagcactgactgctcttccag

SEQ ID NO: 174049 - DNA, 22 bp, Mus musculus
agagagatcacagagacctgta

SEQ ID NO: 174050 - DNA, 23 bp, Mus musculus
ccatggctctgggtgtgtgcagt

SEQ ID NO: 174051 - DNA, 23 bp, Mus musculus
tctgctctgtctctcacacagcc

SEQ ID NO: 174052 - DNA, 22 bp, Mus musculus
atgcatgtgaatctttttcatt

SEQ ID NO: 174053 - DNA, 20 bp, Mus musculus
tgtcttagggaaatgagatt

SEQ ID NO: 174054 - DNA, 23 bp, Mus musculus
cgtctgtcattcactgtcacccg

SEQ ID NO: 174055 - DNA, 22 bp, Mus musculus
aaaaagtgggtggagacatggt

SEQ ID NO: 174056 - DNA, 21 bp, Mus musculus
ttcggtccagccttctatccc

SEQ ID NO: 174057 - DNA, 23 bp, Mus musculus
tggttcactcaccctctgaggct

SEQ ID NO: 174058 - DNA, 23 bp, Mus musculus
ttgtctgtctgtctgtctgtcta

SEQ ID NO: 174059 - DNA, 23 bp, Mus musculus
ttgacccaagtcaatttctactt

SEQ ID NO: 174060 - DNA, 19 bp, Mus musculus
atggtgtatgtatgagtgt

SEQ ID NO: 174061 - DNA, 23 bp, Mus musculus
ctgactgcctctgagtctcaagt

SEQ ID NO: 174062 - DNA, 22 bp, Mus musculus
ctcgtctctctcactgtgtgag

SEQ ID NO: 174063 - DNA, 22 bp, Mus musculus
aatggacaggatcaattgagag

SEQ ID NO: 174064 - DNA, 23 bp, Mus musculus
aagttggtttacatttgcaagct

SEQ ID NO: 174065 - DNA, 18 bp, Mus musculus
tagaagtacctgtgcagc

SEQ ID NO: 174066 - DNA, 23 bp, Mus musculus
tgaagtttcaaaagcctatgcca

SEQ ID NO: 174067 - DNA, 23 bp, Mus musculus
tctgtctgtctgtccgtccgtcc

SEQ ID NO: 174068 - DNA, 21 bp, Mus musculus
gaagttcctagttatggatcc

SEQ ID NO: 174069 - DNA, 23 bp, Mus musculus
tgtatacatgtatgcatttgtgt

SEQ ID NO: 174070 - DNA, 22 bp, Mus musculus
tgaatgctgattgtgaatgact

SEQ ID NO: 174071 - DNA, 23 bp, Mus musculus
ttgtgtgcatgtgtgtgtgtgtg

SEQ ID NO: 174072 - DNA, 18 bp, Mus musculus
atatgtgtgtgcatatat

SEQ ID NO: 174073 - DNA, 23 bp, Mus musculus
tatgtgtttatatatgtaggtgt

SEQ ID NO: 174074 - DNA, 23 bp, Mus musculus
cactcagtgtgacagtgacaact

SEQ ID NO: 174075 - DNA, 19 bp, Mus musculus
actagatggttctgtgaga

SEQ ID NO: 174076 - DNA, 20 bp, Mus musculus
tttttgagtgactggaaaag

SEQ ID NO: 174077 - DNA, 23 bp, Mus musculus
taacatcactgagaatttccttc

SEQ ID NO: 174078 - DNA, 19 bp, Mus musculus
gtgagacgagtgtgagcac

SEQ ID NO: 174079 - DNA, 23 bp, Mus musculus
aatcacacacacgcacatatatg

SEQ ID NO: 174080 - DNA, 23 bp, Mus musculus
tggtacataagtatgcatatcta

SEQ ID NO: 174081 - DNA, 18 bp, Mus musculus
ttatgtgtgtatatgcac

SEQ ID NO: 174082 - DNA, 23 bp, Mus musculus
tgtatatatgtatgtatgtgtct

SEQ ID NO: 174083 - DNA, 23 bp, Mus musculus
atatgtatatgtgtatgtgtgtg

SEQ ID NO: 174084 - DNA, 19 bp, Mus musculus
tctatgtatctatatatgt

SEQ ID NO: 174085 - DNA, 23 bp, Mus musculus
ctgtgtctctgtttagtatctgt

SEQ ID NO: 174086 - DNA, 21 bp, Mus musculus
atctgtccattgatgagagtg

SEQ ID NO: 174087 - DNA, 23 bp, Mus musculus
aattggactgggaatcttgtctg

SEQ ID NO: 174088 - DNA, 21 bp, Mus musculus
cttgtctcactgtcagtcggc

SEQ ID NO: 174089 - DNA, 21 bp, Mus musculus
aggtacaagctgatgggatgg

SEQ ID NO: 174090 - DNA, 22 bp, Mus musculus
gcctgcctctgtcactctcatc

SEQ ID NO: 174091 - DNA, 23 bp, Mus musculus
tgtctctgtgtgtctctatgtgt

SEQ ID NO: 174092 - DNA, 22 bp, Mus musculus
tccctgctcactctctctctcc

SEQ ID NO: 174093 - DNA, 23 bp, Mus musculus
tcaaagtagagtgtctgctcact

SEQ ID NO: 174094 - DNA, 23 bp, Mus musculus
tttccacacattttgtatttgtg

SEQ ID NO: 174095 - DNA, 23 bp, Mus musculus
ctctctgagtgtctctgcttctg

SEQ ID NO: 174096 - DNA, 18 bp, Mus musculus
catcattgtcttttgggt

SEQ ID NO: 174097 - DNA, 22 bp, Mus musculus
gataatggctgtgcatctttag

SEQ ID NO: 174098 - DNA, 21 bp, Mus musculus
ttacatgtctctagttcttgt

SEQ ID NO: 174099 - DNA, 18 bp, Mus musculus
tgaggtacttaatttaat

SEQ ID NO: 174100 - DNA, 20 bp, Mus musculus
atcagtgggagccatcttgg

SEQ ID NO: 174101 - DNA, 21 bp, Mus musculus
aattacagttcagactcagtg

SEQ ID NO: 174102 - DNA, 23 bp, Mus musculus
agacacaagagtgtgaccagttt

SEQ ID NO: 174103 - DNA, 23 bp, Mus musculus
tagactgagtgatatgaatgtgt

SEQ ID NO: 174104 - DNA, 22 bp, Mus musculus
tgttttgtgaccaattatatgg

SEQ ID NO: 174105 - DNA, 21 bp, Mus musculus
gtaactggataaccaattgct

SEQ ID NO: 174106 - DNA, 23 bp, Mus musculus
tagaggcatgttgtctgggttgt

SEQ ID NO: 174107 - DNA, 23 bp, Mus musculus
ttttgtatatgtgcatgtggatg

SEQ ID NO: 174108 - DNA, 23 bp, Mus musculus
agtagaatgttgtttagtttcca

SEQ ID NO: 174109 - DNA, 18 bp, Mus musculus
agtgaccataggtgtgtg

SEQ ID NO: 174110 - DNA, 23 bp, Mus musculus
atatgtgtatatgtatttacata

SEQ ID NO: 174111 - DNA, 23 bp, Mus musculus
aatcattggtagttttcagtctt

SEQ ID NO: 174112 - DNA, 22 bp, Mus musculus
tgttttgtgaccaattatatgg

SEQ ID NO: 174113 - DNA, 19 bp, Mus musculus
atatctaccacaagggatg

SEQ ID NO: 174114 - DNA, 23 bp, Mus musculus
tttcattactctctctgtgaccc

SEQ ID NO: 174115 - DNA, 22 bp, Mus musculus
atgaagaactctcagtctactt

SEQ ID NO: 174116 - DNA, 23 bp, Mus musculus
agtctgagtgtctgtaaaggctt

SEQ ID NO: 174117 - DNA, 23 bp, Mus musculus
tgagatgagtccctagtctggcc

SEQ ID NO: 174118 - DNA, 23 bp, Mus musculus
tatatgtgtaatgtttatgttca

SEQ ID NO: 174119 - DNA, 22 bp, Mus musculus
ctcactgtttctcacctctcag

SEQ ID NO: 174120 - DNA, 22 bp, Mus musculus
tgttttgtgaccaattatatgg

SEQ ID NO: 174121 - DNA, 23 bp, Mus musculus
tctctctgtcagtcagaggttgt

SEQ ID NO: 174122 - DNA, 23 bp, Mus musculus
taagagcactgactgctcttcca

SEQ ID NO: 174123 - DNA, 22 bp, Mus musculus
tgtcagaaggaatgagggttgc

SEQ ID NO: 174124 - DNA, 23 bp, Mus musculus
gtggctctctcagtgtttcccag

SEQ ID NO: 174125 - DNA, 23 bp, Mus musculus
tgtgtatgtgcatgtgtatgtat

SEQ ID NO: 174126 - DNA, 18 bp, Mus musculus
tatatacacatgcataca

SEQ ID NO: 174127 - DNA, 23 bp, Mus musculus
tctctcattcagtggctccctct

SEQ ID NO: 174128 - DNA, 23 bp, Mus musculus
tctctcacacacgtatggctcat

SEQ ID NO: 174129 - DNA, 23 bp, Mus musculus
agcaacagtgattaaaaactggg

SEQ ID NO: 174130 - DNA, 22 bp, Mus musculus
ttaagagcactgactgctcttc

SEQ ID NO: 174131 - DNA, 23 bp, Mus musculus
aatctttgagaggtagagaatgc

SEQ ID NO: 174132 - DNA, 23 bp, Mus musculus
gtctgactgtgtctgtgagtttc

SEQ ID NO: 174133 - DNA, 22 bp, Mus musculus
tgttttgtgaccaattatatgg

SEQ ID NO: 174134 - DNA, 23 bp, Mus musculus
aggacaagacagacagacagaca

SEQ ID NO: 174135 - DNA, 23 bp, Mus musculus
tgggttgagagcattattgtgtg

SEQ ID NO: 174136 - DNA, 22 bp, Mus musculus
tgttttgtgaccaattatatgg

SEQ ID NO: 174137 - DNA, 20 bp, Mus musculus
tgctttgtctagctttatca

SEQ ID NO: 174138 - DNA, 19 bp, Mus musculus
agtgaagtactagataggt

SEQ ID NO: 174139 - DNA, 22 bp, Mus musculus
tgttttgtgaccaattatatgg

SEQ ID NO: 174140 - DNA, 23 bp, Mus musculus
ctctgtcatatcactctcaactt

SEQ ID NO: 174141 - DNA, 23 bp, Mus musculus
acatacaaatctgtttttcatga

SEQ ID NO: 174142 - DNA, 23 bp, Mus musculus
tatctccatatgtaaactgaggc

SEQ ID NO: 174143 - DNA, 18 bp, Mus musculus
tgacactactgaatgagg

SEQ ID NO: 174144 - DNA, 23 bp, Mus musculus
tcttaagttctacaggctgttgt

SEQ ID NO: 174145 - DNA, 23 bp, Mus musculus
tagtccatggtgatctgatagga

SEQ ID NO: 174146 - DNA, 23 bp, Mus musculus
actgtgtctctgtttagtttctg

SEQ ID NO: 174147 - DNA, 23 bp, Mus musculus
caatatttttgtatctgttgagg

SEQ ID NO: 174148 - DNA, 18 bp, Mus musculus
agagatggctcagcagcg

SEQ ID NO: 174149 - DNA, 18 bp, Mus musculus
atttttgttgttatgtga

SEQ ID NO: 174150 - DNA, 22 bp, Mus musculus
atggttgcagttttagaactca

SEQ ID NO: 174151 - DNA, 18 bp, Mus musculus
tgcaagggaaagctgtga

SEQ ID NO: 174152 - DNA, 23 bp, Mus musculus
gtctctcacagtggctgtagtta

SEQ ID NO: 174153 - DNA, 23 bp, Mus musculus
ctctctctgtcacactcactgcc

SEQ ID NO: 174154 - DNA, 23 bp, Mus musculus
acccatggtgtaggcagagctga

SEQ ID NO: 174155 - DNA, 23 bp, Mus musculus
tagagtctatttcctggaatttc

SEQ ID NO: 174156 - DNA, 21 bp, Mus musculus
agacagacctgacagtgttga

SEQ ID NO: 174157 - DNA, 22 bp, Mus musculus
ctctctcactgaatatggagct

SEQ ID NO: 174158 - DNA, 22 bp, Mus musculus
tagagagaacacacactggaca

SEQ ID NO: 174159 - DNA, 21 bp, Mus musculus
ctctcgtctgtgttcctgctg

SEQ ID NO: 174160 - DNA, 23 bp, Mus musculus
atgtgtatgtccatgtgcaagtg

SEQ ID NO: 174161 - DNA, 23 bp, Mus musculus
tagtgcatggtgatctgatagga

SEQ ID NO: 174162 - DNA, 22 bp, Mus musculus
agacaggtgacagaagacagtt

SEQ ID NO: 174163 - DNA, 23 bp, Mus musculus
actgtactgacttggcattcaga

SEQ ID NO: 174164 - DNA, 23 bp, Mus musculus
aatcagactggttgatttctggg

SEQ ID NO: 174165 - DNA, 23 bp, Mus musculus
agaactacacacaggctggagag

SEQ ID NO: 174166 - DNA, 19 bp, Mus musculus
aagagcactgactgctctt

SEQ ID NO: 174167 - DNA, 22 bp, Mus musculus
agtgctggagagatagctcaga

SEQ ID NO: 174168 - DNA, 23 bp, Mus musculus
taagagcactgactgctctacca

SEQ ID NO: 174169 - DNA, 18 bp, Mus musculus
ttgctgtggggctggtga

SEQ ID NO: 174170 - DNA, 21 bp, Mus musculus
gataggtacatgtgcatgcag

SEQ ID NO: 174171 - DNA, 23 bp, Mus musculus
cctggaactcactcactgattca

SEQ ID NO: 174172 - DNA, 18 bp, Mus musculus
agagagctgtcagtgatc

SEQ ID NO: 174173 - DNA, 23 bp, Mus musculus
tgtgtgtctgtgtctgagggaca

SEQ ID NO: 174174 - DNA, 23 bp, Mus musculus
agctgacagagctgagtctggtg

SEQ ID NO: 174175 - DNA, 18 bp, Mus musculus
tgcagttaaattgacttt

SEQ ID NO: 174176 - DNA, 21 bp, Mus musculus
agcttggtcttcttgtgggac

SEQ ID NO: 174177 - DNA, 23 bp, Mus musculus
actagctgtggttgtatgttctt

SEQ ID NO: 174178 - DNA, 23 bp, Mus musculus
cactgacagagagaggatggttt

SEQ ID NO: 174179 - DNA, 19 bp, Mus musculus
gtctatgagtatatgtgtg

SEQ ID NO: 174180 - DNA, 23 bp, Mus musculus
aagttgtccctgaggtaaccagg

SEQ ID NO: 174181 - DNA, 23 bp, Mus musculus
gtcaagtctgtgtttgttgtctg

SEQ ID NO: 174182 - DNA, 22 bp, Mus musculus
aggaactgtacatcgttctcag

SEQ ID NO: 174183 - DNA, 23 bp, Mus musculus
atgaatgagtgagtgagtgcatg

SEQ ID NO: 174184 - DNA, 23 bp, Mus musculus
tggttagttcatcttgttgttcc

SEQ ID NO: 174185 - DNA, 18 bp, Mus musculus
tcatgatgcttagtttat

SEQ ID NO: 174186 - DNA, 23 bp, Mus musculus
tctcaagtctttttgattttcat

SEQ ID NO: 174187 - DNA, 23 bp, Mus musculus
ttattagaatacaaggaaattga

SEQ ID NO: 174188 - DNA, 22 bp, Mus musculus
tttcagattgctagttcatggt

SEQ ID NO: 174189 - DNA, 23 bp, Mus musculus
tatgtgagcatgtatatgtgtgt

SEQ ID NO: 174190 - DNA, 20 bp, Mus musculus
tatatgtgagcatgtgtatg

SEQ ID NO: 174191 - DNA, 18 bp, Mus musculus
ccatggtgactaaagagt

SEQ ID NO: 174192 - DNA, 21 bp, Mus musculus
aaatgcaagttattacccatg

SEQ ID NO: 174193 - DNA, 20 bp, Mus musculus
tgtttctctctgtctcatgt

SEQ ID NO: 174194 - DNA, 23 bp, Mus musculus
taagagcactgactcctcttcca

SEQ ID NO: 174195 - DNA, 22 bp, Mus musculus
tatgtgcatgtgtatgtgcatg

SEQ ID NO: 174196 - DNA, 23 bp, Mus musculus
atgtatgtgtgcgtgtgtgtgtg

SEQ ID NO: 174197 - DNA, 23 bp, Mus musculus
gtgtgtctgtctgtctatcgtgt

SEQ ID NO: 174198 - DNA, 22 bp, Mus musculus
tgttttgtgaccaattatatgg

SEQ ID NO: 174199 - DNA, 20 bp, Mus musculus
gtgcacagtcactgagtcac

SEQ ID NO: 174200 - DNA, 20 bp, Mus musculus
tgagttgatattcctccgca

SEQ ID NO: 174201 - DNA, 20 bp, Mus musculus
tgagaaaagtgactggggag

SEQ ID NO: 174202 - DNA, 23 bp, Mus musculus
gtgtctctctgtgcgtctatgca

SEQ ID NO: 174203 - DNA, 23 bp, Mus musculus
actgtgactgtcactgagaggca

SEQ ID NO: 174204 - DNA, 19 bp, Mus musculus
agtgggatgtgactgacca

SEQ ID NO: 174205 - DNA, 23 bp, Mus musculus
gtcccactgtccctttgaactga

SEQ ID NO: 174206 - DNA, 23 bp, Mus musculus
tgagtttatttctttatatgaag

SEQ ID NO: 174207 - DNA, 23 bp, Mus musculus
atcctcagtgaagattctgaggt

SEQ ID NO: 174208 - DNA, 23 bp, Mus musculus
gagagaagagatggagctgagag

SEQ ID NO: 174209 - DNA, 20 bp, Mus musculus
ttcgtgtatttattttctct

SEQ ID NO: 174210 - DNA, 23 bp, Mus musculus
cttcactctctcacaggcttcaa

SEQ ID NO: 174211 - DNA, 20 bp, Mus musculus
tgacagaacagaatgagcag

SEQ ID NO: 174212 - DNA, 18 bp, Mus musculus
acagcacctatcatattg

SEQ ID NO: 174213 - DNA, 23 bp, Mus musculus
taaatttcagtttttgttgttgt

SEQ ID NO: 174214 - DNA, 20 bp, Mus musculus
ataggaagtgggagctgtgt

SEQ ID NO: 174215 - DNA, 23 bp, Mus musculus
cactgtaagaggaagttctcaaa

SEQ ID NO: 174216 - DNA, 23 bp, Mus musculus
tgactccctctcagagttttaag

SEQ ID NO: 174217 - DNA, 23 bp, Mus musculus
tctctttgtctttggttgtattg

SEQ ID NO: 174218 - DNA, 23 bp, Mus musculus
gtctgtctgtctgcctgtctaca

SEQ ID NO: 174219 - DNA, 22 bp, Mus musculus
agtgtatgctgtgcctctgtct

SEQ ID NO: 174220 - DNA, 23 bp, Mus musculus
tgtctgtatctgtgtgtacatga

SEQ ID NO: 174221 - DNA, 23 bp, Mus musculus
tcaatgtctcacactgtcatttc

SEQ ID NO: 174222 - DNA, 19 bp, Mus musculus
gccttgtatttgcattgtt

SEQ ID NO: 174223 - DNA, 23 bp, Mus musculus
aattcaaggttctctctctctct

SEQ ID NO: 174224 - DNA, 22 bp, Mus musculus
aagtctctccttatatatttat

SEQ ID NO: 174225 - DNA, 23 bp, Mus musculus
tgaacacagtgtattgagtatag

SEQ ID NO: 174226 - DNA, 23 bp, Mus musculus
aggactagtcaccgactgactga

SEQ ID NO: 174227 - DNA, 18 bp, Mus musculus
tgagaagtatgtgaggag

SEQ ID NO: 174228 - DNA, 21 bp, Mus musculus
tctgtctctttcactgtggat

SEQ ID NO: 174229 - DNA, 23 bp, Mus musculus
tgacaggactcagtgtgtagtct

SEQ ID NO: 174230 - DNA, 22 bp, Mus musculus
atatgtatacatgtatgtgtgt

SEQ ID NO: 174231 - DNA, 22 bp, Mus musculus
atcttgagtgcttagggtgtgt

SEQ ID NO: 174232 - DNA, 23 bp, Mus musculus
tcttgtgtgcttagggtgtgtgt

SEQ ID NO: 174233 - DNA, 20 bp, Mus musculus
aggatgtatgtatgtatgta

SEQ ID NO: 174234 - DNA, 21 bp, Mus musculus
cgtatgtatgcatgtgtgtgc

SEQ ID NO: 174235 - DNA, 20 bp, Mus musculus
gagtgtggatgagttctgct

SEQ ID NO: 174236 - DNA, 22 bp, Mus musculus
tctcagtggtatgtatgtatgt

SEQ ID NO: 174237 - DNA, 18 bp, Mus musculus
atgcttatatatgtgtat

SEQ ID NO: 174238 - DNA, 22 bp, Mus musculus
atgagaacagagccaggacact

SEQ ID NO: 174239 - DNA, 22 bp, Mus musculus
aagctggccctctgactccctc

SEQ ID NO: 174240 - DNA, 21 bp, Mus musculus
atcactcattacagtctcaga

SEQ ID NO: 174241 - DNA, 22 bp, Mus musculus
acagacagttcagacagtgatg

SEQ ID NO: 174242 - DNA, 21 bp, Mus musculus
tgggcctcttcacagtgctgt

SEQ ID NO: 174243 - DNA, 23 bp, Mus musculus
tctctctctcagactttcctctc

SEQ ID NO: 174244 - DNA, 22 bp, Mus musculus
tccagtgtcacactctctccct

SEQ ID NO: 174245 - DNA, 22 bp, Mus musculus
ttgagagcctctagtctcagcc

SEQ ID NO: 174246 - DNA, 21 bp, Mus musculus
cagagttctctgctcctgagt

SEQ ID NO: 174247 - DNA, 23 bp, Mus musculus
tctggctcactctgtggctgagc

SEQ ID NO: 174248 - DNA, 23 bp, Mus musculus
aacatgtagaaggtagcattgtt

SEQ ID NO: 174249 - DNA, 23 bp, Mus musculus
atgaaatgattagtatagtaata

SEQ ID NO: 174250 - DNA, 22 bp, Mus musculus
atattgctagctaagtttttct

SEQ ID NO: 174251 - DNA, 23 bp, Mus musculus
tgaggcacatatagtagtagaga

SEQ ID NO: 174252 - DNA, 20 bp, Mus musculus
atatgtatatatgtatatgt

SEQ ID NO: 174253 - DNA, 21 bp, Mus musculus
tatatgtatatatgtatatgt

SEQ ID NO: 174254 - DNA, 19 bp, Mus musculus
tgtgagtggtgtgacacag

SEQ ID NO: 174255 - DNA, 23 bp, Mus musculus
tgtctcactgcctgtgttagggc

SEQ ID NO: 174256 - DNA, 22 bp, Mus musculus
tgctggtgtacagactgtggtg

SEQ ID NO: 174257 - DNA, 20 bp, Mus musculus
tggctgcctccctctatgcc

SEQ ID NO: 174258 - DNA, 23 bp, Mus musculus
ttttgtcagtttcttgttgtctc

SEQ ID NO: 174259 - DNA, 19 bp, Mus musculus
aaggcatggaacctggagg

SEQ ID NO: 174260 - DNA, 23 bp, Mus musculus
agtggctcagtggctcagtggca

SEQ ID NO: 174261 - DNA, 23 bp, Mus musculus
ggtcactgggttacttctgcagc

SEQ ID NO: 174262 - DNA, 23 bp, Mus musculus
tgtctctgtgtgtctgtatgtgt

SEQ ID NO: 174263 - DNA, 20 bp, Mus musculus
aaaggtcagcgactcattgg

SEQ ID NO: 174264 - DNA, 21 bp, Mus musculus
tgtgacttttattgctcagct

SEQ ID NO: 174265 - DNA, 23 bp, Mus musculus
tgtagtcacagagcagagagacg

SEQ ID NO: 174266 - DNA, 22 bp, Mus musculus
ttctccttttgattgagtgtag

SEQ ID NO: 174267 - DNA, 23 bp, Mus musculus
ttgtctgtgacgtaaggtgatca

SEQ ID NO: 174268 - DNA, 23 bp, Mus musculus
tctaagggagagaaaggagaatc

SEQ ID NO: 174269 - DNA, 23 bp, Mus musculus
tccctctctctgtctaagttgtt

SEQ ID NO: 174270 - DNA, 23 bp, Mus musculus
tgtctcacagcctgaatggcccc

SEQ ID NO: 174271 - DNA, 23 bp, Mus musculus
ctgtctgtgacagagccctgtgt

SEQ ID NO: 174272 - DNA, 23 bp, Mus musculus
cacaccagagtctgtctgtgaca

SEQ ID NO: 174273 - DNA, 23 bp, Mus musculus
agtgtgcctctgtccctcagttg

SEQ ID NO: 174274 - DNA, 21 bp, Mus musculus
ttgggtattcaagtgcataca

SEQ ID NO: 174275 - DNA, 21 bp, Mus musculus
tgtgaccatctgtcagtctct

SEQ ID NO: 174276 - DNA, 22 bp, Mus musculus
tctggctccgtgtcttcactcc

SEQ ID NO: 174277 - DNA, 19 bp, Mus musculus
tcatgattgttaatcttga

SEQ ID NO: 174278 - DNA, 23 bp, Mus musculus
tcaaatctcagcaaccacatggt

SEQ ID NO: 174279 - DNA, 23 bp, Mus musculus
gttttcactgtcattatgatctt

SEQ ID NO: 174280 - DNA, 23 bp, Mus musculus
ttagatctatgtcattagatcat

SEQ ID NO: 174281 - DNA, 20 bp, Mus musculus
tgatgtatatatgtatagag

SEQ ID NO: 174282 - DNA, 23 bp, Mus musculus
cactgtgtctcagtgcttgccat

SEQ ID NO: 174283 - DNA, 23 bp, Mus musculus
tggattgttccaggcactcagag

SEQ ID NO: 174284 - DNA, 23 bp, Mus musculus
tgctctctctctctcagataatc

SEQ ID NO: 174285 - DNA, 19 bp, Mus musculus
taccaggaagtaagtggtt

SEQ ID NO: 174286 - DNA, 18 bp, Mus musculus
tggaatccatacctgtgt

SEQ ID NO: 174287 - DNA, 20 bp, Mus musculus
tctctcttctgctcatgtgt

SEQ ID NO: 174288 - DNA, 23 bp, Mus musculus
tcatggactgtgtgaacacagag

SEQ ID NO: 174289 - DNA, 23 bp, Mus musculus
ctgggtgtcactcagtctgactg

SEQ ID NO: 174290 - DNA, 19 bp, Mus musculus
tctactctggttccagatc

SEQ ID NO: 174291 - DNA, 23 bp, Mus musculus
tctgtctgtctgtctgtctgtct

SEQ ID NO: 174292 - DNA, 18 bp, Mus musculus
atgtgtatatatatatgt

SEQ ID NO: 174293 - DNA, 22 bp, Mus musculus
tgttttgtgaccaattatatgg

SEQ ID NO: 174294 - DNA, 23 bp, Mus musculus
tctgtctctatctctaatcaggt

SEQ ID NO: 174295 - DNA, 22 bp, Mus musculus
tgtctgtctttctctctcataa

SEQ ID NO: 174296 - DNA, 23 bp, Mus musculus
tgctttaaagtagaaaaagtaga

SEQ ID NO: 174297 - DNA, 22 bp, Mus musculus
acaggttcttgcttcatggttt

SEQ ID NO: 174298 - DNA, 23 bp, Mus musculus
ctgtcacagtctctgtgggtttg

SEQ ID NO: 174299 - DNA, 22 bp, Mus musculus
ttgtgtttggttatcaagctga

SEQ ID NO: 174300 - DNA, 22 bp, Mus musculus
tgttttgtgaccaattatatgg

SEQ ID NO: 174301 - DNA, 18 bp, Mus musculus
ttctttaggttaggtaaa

SEQ ID NO: 174302 - DNA, 22 bp, Mus musculus
ttctggccctttgaattgggaa

SEQ ID NO: 174303 - DNA, 19 bp, Mus musculus
accatgtctctgactctct

SEQ ID NO: 174304 - DNA, 22 bp, Mus musculus
attgaggacattttggaattca

SEQ ID NO: 174305 - DNA, 22 bp, Mus musculus
tggtttgattagaagtttcttc

SEQ ID NO: 174306 - DNA, 22 bp, Mus musculus
agtcacaggacactctaatcac

SEQ ID NO: 174307 - DNA, 22 bp, Mus musculus
ataatacatgctatatgcatgt

SEQ ID NO: 174308 - DNA, 23 bp, Mus musculus
tatgcatatatgtatgtatgtat

SEQ ID NO: 174309 - DNA, 22 bp, Mus musculus
tcttatgaaaagatgtattgtg

SEQ ID NO: 174310 - DNA, 23 bp, Mus musculus
tgattttctggattccattttct

SEQ ID NO: 174311 - DNA, 18 bp, Mus musculus
tacatacatatgtgtgtg

SEQ ID NO: 174312 - DNA, 19 bp, Mus musculus
aaagtcatggtcttataga

SEQ ID NO: 174313 - DNA, 22 bp, Mus musculus
tccttgtttttgaagcttagta

SEQ ID NO: 174314 - DNA, 22 bp, Mus musculus
tgttttgtgaccaattatatgg

SEQ ID NO: 174315 - DNA, 22 bp, Mus musculus
ttgggagtgcatatgaagggat

SEQ ID NO: 174316 - DNA, 23 bp, Mus musculus
tcaatatttttgtatctgttgag

SEQ ID NO: 174317 - DNA, 20 bp, Mus musculus
atgtatgtatgtatatatgt

SEQ ID NO: 174318 - DNA, 23 bp, Mus musculus
ttggaagtatgagatctgccttt

SEQ ID NO: 174319 - DNA, 23 bp, Mus musculus
gaaagtgtgtcacagtggttggg

SEQ ID NO: 174320 - DNA, 23 bp, Mus musculus
cccactcacactctctctaccca

SEQ ID NO: 174321 - DNA, 22 bp, Mus musculus
tgttttgtgaccaattatatgg

SEQ ID NO: 174322 - DNA, 21 bp, Mus musculus
tttccatttattatcctttgt

SEQ ID NO: 174323 - DNA, 23 bp, Mus musculus
tgtctgtctgtgtatttctgtgt

SEQ ID NO: 174324 - DNA, 20 bp, Mus musculus
tgtgtgtgtgtgtgtggggg

SEQ ID NO: 174325 - DNA, 19 bp, Mus musculus
acaggaaagtctttgctgt

SEQ ID NO: 174326 - DNA, 23 bp, Mus musculus
atctggctatggtagtacaagaa

SEQ ID NO: 174327 - DNA, 21 bp, Mus musculus
tctatgtatttccatgtctat

SEQ ID NO: 174328 - DNA, 22 bp, Mus musculus
tgttttgtgaccaattatatgg

SEQ ID NO: 174329 - DNA, 23 bp, Mus musculus
catttgttgcatttgttgtctat

SEQ ID NO: 174330 - DNA, 23 bp, Mus musculus
ttttgtggtctaattgctctgtg

SEQ ID NO: 174331 - DNA, 23 bp, Mus musculus
atgtaaagtactatattgaatag

SEQ ID NO: 174332 - DNA, 23 bp, Mus musculus
tttgtgactgggttagctcattc

SEQ ID NO: 174333 - DNA, 21 bp, Mus musculus
tgtgtgtatatgtatgtgtgt

SEQ ID NO: 174334 - DNA, 23 bp, Mus musculus
aattgggtttggtagatttaaga

SEQ ID NO: 174335 - DNA, 22 bp, Mus musculus
actattttctctatctcttgta

SEQ ID NO: 174336 - DNA, 22 bp, Mus musculus
tgttttgtgaccaattatatgg

SEQ ID NO: 174337 - DNA, 21 bp, Mus musculus
ttaatgtacatatgcaaatgt

SEQ ID NO: 174338 - DNA, 23 bp, Mus musculus
tctctctgtctgtctgtctctct

SEQ ID NO: 174339 - DNA, 23 bp, Mus musculus
aggtatgtataagtgtgtgcaca

SEQ ID NO: 174340 - DNA, 23 bp, Mus musculus
cgatgagtagagaatttgttcag

SEQ ID NO: 174341 - DNA, 21 bp, Mus musculus
atgtacatacatatatgtgtg

SEQ ID NO: 174342 - DNA, 23 bp, Mus musculus
tgtgtaaatgtatgtatatatgt

SEQ ID NO: 174343 - DNA, 22 bp, Mus musculus
tttgtgattgttcatgatcatg

SEQ ID NO: 174344 - DNA, 23 bp, Mus musculus
tgccacagactctctgggtccct

SEQ ID NO: 174345 - DNA, 23 bp, Mus musculus
tgatagtggatgttgaagtagag

SEQ ID NO: 174346 - DNA, 23 bp, Mus musculus
tctgggagtagaattggtggtct

SEQ ID NO: 174347 - DNA, 21 bp, Mus musculus
atatgtatatgtatgcatatg

SEQ ID NO: 174348 - DNA, 23 bp, Mus musculus
gtctgtctgtctgtctgtctttc

SEQ ID NO: 174349 - DNA, 23 bp, Mus musculus
tattagtaagctgttatcagaca

SEQ ID NO: 174350 - DNA, 21 bp, Mus musculus
actccatttccatccctgtaa

SEQ ID NO: 174351 - DNA, 23 bp, Mus musculus
ttacaggattggcaaagctagtt

SEQ ID NO: 174352 - DNA, 18 bp, Mus musculus
gtcagtgtagagagactg

SEQ ID NO: 174353 - DNA, 21 bp, Mus musculus
atatgtatatatatatatgtg

SEQ ID NO: 174354 - DNA, 20 bp, Mus musculus
atgggtctatatctatatct

SEQ ID NO: 174355 - DNA, 18 bp, Mus musculus
ttgacagaaactttgttg

SEQ ID NO: 174356 - DNA, 22 bp, Mus musculus
tgttttgtgaccaattatatgg

SEQ ID NO: 174357 - DNA, 20 bp, Mus musculus
tacagcagagcctggaggca

SEQ ID NO: 174358 - DNA, 23 bp, Mus musculus
catgtatacatgcacaagtgagt

SEQ ID NO: 174359 - DNA, 23 bp, Mus musculus
tgcacactggcatatatatatgt

SEQ ID NO: 174360 - DNA, 22 bp, Mus musculus
atgtaaatatgtatatatgtgt

SEQ ID NO: 174361 - DNA, 22 bp, Mus musculus
gtatgtatgtatgtatgtatgt

SEQ ID NO: 174362 - DNA, 23 bp, Mus musculus
tatgtaatgcattgccagtgtag

SEQ ID NO: 174363 - DNA, 21 bp, Mus musculus
aatgagtatggctattatgtg

SEQ ID NO: 174364 - DNA, 21 bp, Mus musculus
agagaggaatagagaaggtgc

SEQ ID NO: 174365 - DNA, 22 bp, Mus musculus
tgttttgtgaccaattatatgg

SEQ ID NO: 174366 - DNA, 22 bp, Mus musculus
tgttttgtgaccaattatatgg

SEQ ID NO: 174367 - DNA, 23 bp, Mus musculus
tgcatgtgtatatgtatatgtgt

SEQ ID NO: 174368 - DNA, 22 bp, Mus musculus
agtatgtatgtatatatgtatg

SEQ ID NO: 174369 - DNA, 22 bp, Mus musculus
tatcagtgagtacatattgttt

SEQ ID NO: 174370 - DNA, 22 bp, Mus musculus
tgttttgtgaccaattatatgg

SEQ ID NO: 174371 - DNA, 23 bp, Mus musculus
atgaaagtgatagctatcagagt

SEQ ID NO: 174372 - DNA, 19 bp, Mus musculus
tctctgaggttacctaaaa

SEQ ID NO: 174373 - DNA, 23 bp, Mus musculus
agtactgagagtggagatagagg

SEQ ID NO: 174374 - DNA, 23 bp, Mus musculus
taaggaagagctgagaatggagt

SEQ ID NO: 174375 - DNA, 22 bp, Mus musculus
tgttttgtgaccaattatatgg

SEQ ID NO: 174376 - DNA, 18 bp, Mus musculus
ataggtttatgtatgcat

SEQ ID NO: 174377 - DNA, 21 bp, Mus musculus
taatacatgtacacatgggct

SEQ ID NO: 174378 - DNA, 22 bp, Mus musculus
tgttttgtgaccaattatatgg

SEQ ID NO: 174379 - DNA, 23 bp, Mus musculus
tctgtagtgatctgataggatgc

SEQ ID NO: 174380 - DNA, 23 bp, Mus musculus
ttttgtgaccaattatatgctca

SEQ ID NO: 174381 - DNA, 21 bp, Mus musculus
ctgccacttgcacacttttgg

SEQ ID NO: 174382 - DNA, 20 bp, Mus musculus
aaacttactggacagcaatt

SEQ ID NO: 174383 - DNA, 21 bp, Mus musculus
attgagctttttatttgtaag

SEQ ID NO: 174384 - DNA, 23 bp, Mus musculus
tagttcagcttgagttaaggatt

SEQ ID NO: 174385 - DNA, 22 bp, Mus musculus
tgttttgtgaccaattatatgg

SEQ ID NO: 174386 - DNA, 23 bp, Mus musculus
actcaccctcactgaagtgtctg

SEQ ID NO: 174387 - DNA, 21 bp, Mus musculus
atgattggtgattttgctgtt

SEQ ID NO: 174388 - DNA, 22 bp, Mus musculus
tgttttgtgaccaattatatgg

SEQ ID NO: 174389 - DNA, 23 bp, Mus musculus
tgtgtttgcatgtgcatgtgcat

SEQ ID NO: 174390 - DNA, 22 bp, Mus musculus
tgtatgtgtgtgcatatgatgc

SEQ ID NO: 174391 - DNA, 23 bp, Mus musculus
tattacatcagttactttcctga

SEQ ID NO: 174392 - DNA, 23 bp, Mus musculus
ttaagagagtctctctctgtgat

SEQ ID NO: 174393 - DNA, 19 bp, Mus musculus
aagaattacaaggagtttg

SEQ ID NO: 174394 - DNA, 23 bp, Mus musculus
tttgtttttcattttcaagcagc

SEQ ID NO: 174395 - DNA, 20 bp, Mus musculus
tttttgtatctattgtggcc

SEQ ID NO: 174396 - DNA, 22 bp, Mus musculus
ttatgtctgtctctgatgtgtg

SEQ ID NO: 174397 - DNA, 20 bp, Mus musculus
aagaggaaacttacaggagt

SEQ ID NO: 174398 - DNA, 23 bp, Mus musculus
gagtatgtccatgtgcatgtgct

SEQ ID NO: 174399 - DNA, 19 bp, Mus musculus
aatggacatgtccatgtac

SEQ ID NO: 174400 - DNA, 23 bp, Mus musculus
tctcagagatgctaagttcagaa

SEQ ID NO: 174401 - DNA, 22 bp, Mus musculus
tgcagaccctttcagctgttgg

SEQ ID NO: 174402 - DNA, 23 bp, Mus musculus
tgtatttctgtgtgcaaatgtat

SEQ ID NO: 174403 - DNA, 19 bp, Mus musculus
ttgtatctctgaatgtaga

SEQ ID NO: 174404 - DNA, 23 bp, Mus musculus
ttgtctccttgactattgatctg

SEQ ID NO: 174405 - DNA, 22 bp, Mus musculus
tgttttgtgaccaattatatgg

SEQ ID NO: 174406 - DNA, 23 bp, Mus musculus
ttgtgaccaattatattgtcaat

SEQ ID NO: 174407 - DNA, 23 bp, Mus musculus
catggaatgtggaatgagtctag

SEQ ID NO: 174408 - DNA, 22 bp, Mus musculus
tgttttgtgaccaattatatgg

SEQ ID NO: 174409 - DNA, 22 bp, Mus musculus
tgttttgtgaccaattatatgg

SEQ ID NO: 174410 - DNA, 22 bp, Mus musculus
tgttttgtgaccaattatatgg

SEQ ID NO: 174411 - DNA, 23 bp, Mus musculus
tttgattctttatgatactgtta

SEQ ID NO: 174412 - DNA, 20 bp, Mus musculus
tggaggtggtggtggtggtt

SEQ ID NO: 174413 - DNA, 23 bp, Mus musculus
ctgtctctgtcacactggctccc

SEQ ID NO: 174414 - DNA, 21 bp, Mus musculus
tactgactgctcttccagagg

SEQ ID NO: 174415 - DNA, 20 bp, Mus musculus
tcaattccacagtaaccaca

SEQ ID NO: 174416 - DNA, 22 bp, Mus musculus
tgttttgtgaccaattatatgg

SEQ ID NO: 174417 - DNA, 23 bp, Mus musculus
taggctacacagtgagctcagtg

SEQ ID NO: 174418 - DNA, 22 bp, Mus musculus
aattatctgtggtcttgttggc

SEQ ID NO: 174419 - DNA, 23 bp, Mus musculus
tttgtctgttaattttatatcct

SEQ ID NO: 174420 - DNA, 23 bp, Mus musculus
gaggcagacagtactgtctctag

SEQ ID NO: 174421 - DNA, 22 bp, Mus musculus
ttggaccttggaccttgcttga

SEQ ID NO: 174422 - DNA, 23 bp, Mus musculus
aatatgtacatctgtgtgtgcac

SEQ ID NO: 174423 - DNA, 23 bp, Mus musculus
gtgtgagtgtgcatgtgcatgtg

SEQ ID NO: 174424 - DNA, 23 bp, Mus musculus
tggctctctctgagtctctcagc

SEQ ID NO: 174425 - DNA, 23 bp, Mus musculus
gctggctctctgacaaacctctt

SEQ ID NO: 174426 - DNA, 23 bp, Mus musculus
cacccactgtctctgtgtgaggc

SEQ ID NO: 174427 - DNA, 23 bp, Mus musculus
gagctttgacttggaggtttcaa

SEQ ID NO: 174428 - DNA, 21 bp, Mus musculus
taatgtgattatggagtgctg

SEQ ID NO: 174429 - DNA, 23 bp, Mus musculus
aggtagaatcttgttttgatttg

SEQ ID NO: 174430 - DNA, 23 bp, Mus musculus
accttctcaatttgtttttcagt

SEQ ID NO: 174431 - DNA, 20 bp, Mus musculus
ttcagtgtttgctttggctc

SEQ ID NO: 174432 - DNA, 23 bp, Mus musculus
tctgcactctgtccatcctgtga

SEQ ID NO: 174433 - DNA, 21 bp, Mus musculus
tccatgttggtctgataggat

SEQ ID NO: 174434 - DNA, 18 bp, Mus musculus
agcttgagcattcctagt

SEQ ID NO: 174435 - DNA, 23 bp, Mus musculus
tgcattctgtccatcctctgaca

SEQ ID NO: 174436 - DNA, 23 bp, Mus musculus
acagatgtcactgtgcaatggtt

SEQ ID NO: 174437 - DNA, 18 bp, Mus musculus
tgtgtgtgtgtgtgtgtg

SEQ ID NO: 174438 - DNA, 22 bp, Mus musculus
ctgattcaatggagatagagtt

SEQ ID NO: 174439 - DNA, 21 bp, Mus musculus
atgtgtgtgtgtgtatgtata

SEQ ID NO: 174440 - DNA, 23 bp, Mus musculus
aatgcttagtctgtatagtgttg

SEQ ID NO: 174441 - DNA, 23 bp, Mus musculus
catgtgtgtgcatgtgcttgtgt

SEQ ID NO: 174442 - DNA, 23 bp, Mus musculus
cttctcatgtgactttccttaac

SEQ ID NO: 174443 - DNA, 22 bp, Mus musculus
taagagagagatcacagagtgg

SEQ ID NO: 174444 - DNA, 23 bp, Mus musculus
aggctcacactctgggattggtc

SEQ ID NO: 174445 - DNA, 18 bp, Mus musculus
aggaattctagatcaata

SEQ ID NO: 174446 - DNA, 22 bp, Mus musculus
tatggaactagtatgttttttt

SEQ ID NO: 174447 - DNA, 22 bp, Mus musculus
taagagaatacacttactagta

SEQ ID NO: 174448 - DNA, 23 bp, Mus musculus
atataggtatacatttgcatgca

SEQ ID NO: 174449 - DNA, 23 bp, Mus musculus
cacgtgtgtgtgtgtactgggta

SEQ ID NO: 174450 - DNA, 23 bp, Mus musculus
ctgagagaaccagcagagtctga

SEQ ID NO: 174451 - DNA, 23 bp, Mus musculus
aatgtctgtgcttgtctagtgtt

SEQ ID NO: 174452 - DNA, 21 bp, Mus musculus
tataaggacagaaatgataag

SEQ ID NO: 174453 - DNA, 23 bp, Mus musculus
agtccatggtgatctgataggat

SEQ ID NO: 174454 - DNA, 22 bp, Mus musculus
tgttttgtgaccaattatatgg

SEQ ID NO: 174455 - DNA, 18 bp, Mus musculus
tgtatattatatgtgcta

SEQ ID NO: 174456 - DNA, 18 bp, Mus musculus
tataatatgcaaatgtaa

SEQ ID NO: 174457 - DNA, 23 bp, Mus musculus
tggagctgagactgtctctgaca

SEQ ID NO: 174458 - DNA, 23 bp, Mus musculus
ttgagaatataaagtgatgtgtt

SEQ ID NO: 174459 - DNA, 18 bp, Mus musculus
tgcatttcataattgttt

SEQ ID NO: 174460 - DNA, 22 bp, Mus musculus
taggcatgatcttgttggagta

SEQ ID NO: 174461 - DNA, 23 bp, Mus musculus
aggagacagagatgagacacaga

SEQ ID NO: 174462 - DNA, 19 bp, Mus musculus
tatgcataaatatacatgt

SEQ ID NO: 174463 - DNA, 19 bp, Mus musculus
gtatgtatgtatgtgtgtg

SEQ ID NO: 174464 - DNA, 23 bp, Mus musculus
tgtatgtatgtatgtatgtatgt

SEQ ID NO: 174465 - DNA, 20 bp, Mus musculus
tccatggtggtctgatagga

SEQ ID NO: 174466 - DNA, 22 bp, Mus musculus
tgttttgtgaccaattatatgg

SEQ ID NO: 174467 - DNA, 22 bp, Mus musculus
tggctgagtattcacttactgt

SEQ ID NO: 174468 - DNA, 23 bp, Mus musculus
tagtgcatggtgatctgatagga

SEQ ID NO: 174469 - DNA, 22 bp, Mus musculus
tgttttgtgacctattatgtgg

SEQ ID NO: 174470 - DNA, 23 bp, Mus musculus
tgtgtatgtgcatgtgcatgtgc

SEQ ID NO: 174471 - DNA, 23 bp, Mus musculus
tatgtatatgcatatgcatatgc

SEQ ID NO: 174472 - DNA, 23 bp, Mus musculus
catatgcatatgtatatgtatat

SEQ ID NO: 174473 - DNA, 23 bp, Mus musculus
tagtgcatggtgatctgatagga

SEQ ID NO: 174474 - DNA, 23 bp, Mus musculus
agagagaacagagtcaggaagca

SEQ ID NO: 174475 - DNA, 22 bp, Mus musculus
tgttttgtgaccaattatatgg

SEQ ID NO: 174476 - DNA, 23 bp, Mus musculus
tgttgatctacctgtctgtcact

SEQ ID NO: 174477 - DNA, 20 bp, Mus musculus
tattgtacagcttgaggtca

SEQ ID NO: 174478 - DNA, 18 bp, Mus musculus
ccagctattggctgtcta

SEQ ID NO: 174479 - DNA, 23 bp, Mus musculus
tcagacagaaaagtcagagttgt

SEQ ID NO: 174480 - DNA, 19 bp, Mus musculus
ttaactttgtacagtgtcg

SEQ ID NO: 174481 - DNA, 22 bp, Mus musculus
tgttttgtgaccaattatatgg

SEQ ID NO: 174482 - DNA, 23 bp, Mus musculus
ccagtgtttgagagatcttaggg

SEQ ID NO: 174483 - DNA, 21 bp, Mus musculus
tgttaagatttttctgtgggc

SEQ ID NO: 174484 - DNA, 20 bp, Mus musculus
tgcatgtatgtatatatgta

SEQ ID NO: 174485 - DNA, 22 bp, Mus musculus
tgttttgtgaccaattatatgg

SEQ ID NO: 174486 - DNA, 21 bp, Mus musculus
taaagtaacatgtccttttgt

SEQ ID NO: 174487 - DNA, 23 bp, Mus musculus
ctctaggtggatatgttatgaat

SEQ ID NO: 174488 - DNA, 23 bp, Mus musculus
tttgtgtgtggttgtcaattgga

SEQ ID NO: 174489 - DNA, 23 bp, Mus musculus
gtctacttccacaacacaatgct

SEQ ID NO: 174490 - DNA, 22 bp, Mus musculus
tgttttgtgaccaattatatgg

SEQ ID NO: 174491 - DNA, 20 bp, Mus musculus
gaccaaaactatactctgtc

SEQ ID NO: 174492 - DNA, 23 bp, Mus musculus
gtcacagcatcaggaactggatt

SEQ ID NO: 174493 - DNA, 19 bp, Mus musculus
tgtgaccctaaaagctgtg

SEQ ID NO: 174494 - DNA, 23 bp, Mus musculus
tatgcatacatgtgtgtttgtgt

SEQ ID NO: 174495 - DNA, 23 bp, Mus musculus
gtatgcatatatacatgtatgca

SEQ ID NO: 174496 - DNA, 23 bp, Mus musculus
atgtgtatgtgcatgtgtatgtg

SEQ ID NO: 174497 - DNA, 23 bp, Mus musculus
tatatgtgcgagtatatgtgtgt

SEQ ID NO: 174498 - DNA, 23 bp, Mus musculus
tttgtgtccaattatatggtcaa

SEQ ID NO: 174499 - DNA, 22 bp, Mus musculus
tatgtgtgagagtatatttagt

SEQ ID NO: 174500 - DNA, 21 bp, Mus musculus
acaagtacatggatgtataga

SEQ ID NO: 174501 - DNA, 23 bp, Mus musculus
ctcaagacgatcaggtatagagt

SEQ ID NO: 174502 - DNA, 23 bp, Mus musculus
agactggctgcctgatttcctgc

SEQ ID NO: 174503 - DNA, 21 bp, Mus musculus
gaactgagtagaagttggtga

SEQ ID NO: 174504 - DNA, 22 bp, Mus musculus
gtatgtatgtatgtatgtatat

SEQ ID NO: 174505 - DNA, 22 bp, Mus musculus
tatgacatacctatatctgtat

SEQ ID NO: 174506 - DNA, 21 bp, Mus musculus
atttggtttgcaagaaatcag

SEQ ID NO: 174507 - DNA, 21 bp, Mus musculus
tatgcatatatatatgaatga

SEQ ID NO: 174508 - DNA, 23 bp, Mus musculus
tgtgtccatgtatgcatatatga

SEQ ID NO: 174509 - DNA, 23 bp, Mus musculus
agagtcttgtgacattgttcttt

SEQ ID NO: 174510 - DNA, 20 bp, Mus musculus
gcattccttgtgtttttgta

SEQ ID NO: 174511 - DNA, 19 bp, Mus musculus
cttgtgtctgtgtgtctat

SEQ ID NO: 174512 - DNA, 20 bp, Mus musculus
atctctgtgtatgcctttgt

SEQ ID NO: 174513 - DNA, 23 bp, Mus musculus
gtgcgtgtctgtgtgagtgtgtg

SEQ ID NO: 174514 - DNA, 21 bp, Mus musculus
atgaggtcttgaatggtgata

SEQ ID NO: 174515 - DNA, 21 bp, Mus musculus
gctttactatctagtaacttg

SEQ ID NO: 174516 - DNA, 18 bp, Mus musculus
tggtgttttaggtttgag

SEQ ID NO: 174517 - DNA, 21 bp, Mus musculus
atctggacctataagatgact

SEQ ID NO: 174518 - DNA, 23 bp, Mus musculus
agtatttttactgtatctatatt

SEQ ID NO: 174519 - DNA, 23 bp, Mus musculus
tctgtctctgtcttccatatgtt

SEQ ID NO: 174520 - DNA, 18 bp, Mus musculus
accaatacagaacataga

SEQ ID NO: 174521 - DNA, 23 bp, Mus musculus
taataattatgttttggggaaca

SEQ ID NO: 174522 - DNA, 23 bp, Mus musculus
gactggttatgcacagcccctgc

SEQ ID NO: 174523 - DNA, 23 bp, Mus musculus
tggctgtctctgtcagtgacttc

SEQ ID NO: 174524 - DNA, 21 bp, Mus musculus
ttgtatgtatgtatgtatgta

SEQ ID NO: 174525 - DNA, 19 bp, Mus musculus
agcacctaatgtgatctct

SEQ ID NO: 174526 - DNA, 23 bp, Mus musculus
tctgacaggatacatgagacaat

SEQ ID NO: 174527 - DNA, 23 bp, Mus musculus
tagtgcatggtgatctgatagga

SEQ ID NO: 174528 - DNA, 22 bp, Mus musculus
tgttttgtgacctattatgtgg

SEQ ID NO: 174529 - DNA, 22 bp, Mus musculus
gtcactccctccctgattggct

SEQ ID NO: 174530 - DNA, 23 bp, Mus musculus
tggctgggtctctgactgggtca

SEQ ID NO: 174531 - DNA, 23 bp, Mus musculus
agacagaactcacagagcagcta

SEQ ID NO: 174532 - DNA, 23 bp, Mus musculus
agactgtgtgtgtcttctcactg

SEQ ID NO: 174533 - DNA, 19 bp, Mus musculus
acactgcatctgctgtcag

SEQ ID NO: 174534 - DNA, 23 bp, Mus musculus
tttctgaagtgcttgttgactgc

SEQ ID NO: 174535 - DNA, 23 bp, Mus musculus
aggcatgagtgtcagcacaggga

SEQ ID NO: 174536 - DNA, 19 bp, Mus musculus
cttatatgtatgtgcacac

SEQ ID NO: 174537 - DNA, 23 bp, Mus musculus
tctgtgtctgtctgtgtgtgtat

SEQ ID NO: 174538 - DNA, 21 bp, Mus musculus
gagtctctctcactgagcctg

SEQ ID NO: 174539 - DNA, 21 bp, Mus musculus
ctcaccctcactgtcactgcc

SEQ ID NO: 174540 - DNA, 20 bp, Mus musculus
actctctctgtgtcctctgt

SEQ ID NO: 174541 - DNA, 18 bp, Mus musculus
tatgtacctgcatattca

SEQ ID NO: 174542 - DNA, 23 bp, Mus musculus
ctctcagtgtctcagactgtgcc

SEQ ID NO: 174543 - DNA, 20 bp, Mus musculus
caggttgtaggttggtaagt

SEQ ID NO: 174544 - DNA, 20 bp, Mus musculus
ttcaattctcagcaaccaca

SEQ ID NO: 174545 - DNA, 23 bp, Mus musculus
tactgtgacctttgcatgtgtac

SEQ ID NO: 174546 - DNA, 21 bp, Mus musculus
tgaggtacaagcatgaaaaga

SEQ ID NO: 174547 - DNA, 23 bp, Mus musculus
taagcaaatgtatgcaaaacaca

SEQ ID NO: 174548 - DNA, 23 bp, Mus musculus
tgtcatgtatggacattgacatt

SEQ ID NO: 174549 - DNA, 23 bp, Mus musculus
agcacattcagtgtgtgcatgtg

SEQ ID NO: 174550 - DNA, 23 bp, Mus musculus
tcccccttaattttctgtctgcc

SEQ ID NO: 174551 - DNA, 21 bp, Mus musculus
atgtatgtatgcatgtatgtg

SEQ ID NO: 174552 - DNA, 23 bp, Mus musculus
tgtctgtctgcctctgtagatac

SEQ ID NO: 174553 - DNA, 23 bp, Mus musculus
agcatgtctctctgtaagtgtct

SEQ ID NO: 174554 - DNA, 21 bp, Mus musculus
tgtctgtcactcagagcctgg

SEQ ID NO: 174555 - DNA, 23 bp, Mus musculus
agaacattgactgcattggttcc

SEQ ID NO: 174556 - DNA, 21 bp, Mus musculus
tgtgtgtctcactgtctgggc

SEQ ID NO: 174557 - DNA, 18 bp, Mus musculus
aaagctagattagccact

SEQ ID NO: 174558 - DNA, 23 bp, Mus musculus
tcagacagacccaggaactgtga

SEQ ID NO: 174559 - DNA, 22 bp, Mus musculus
agacctgagagaagagagttag

SEQ ID NO: 174560 - DNA, 23 bp, Mus musculus
tgtttgcatgtatgtatgtgtgt

SEQ ID NO: 174561 - DNA, 23 bp, Mus musculus
atctcagagtgcctgtcttcaga

SEQ ID NO: 174562 - DNA, 23 bp, Mus musculus
tgtgactgtgtaagatatgtatg

SEQ ID NO: 174563 - DNA, 23 bp, Mus musculus
atgtgcacaatgtctatgcacat

SEQ ID NO: 174564 - DNA, 22 bp, Mus musculus
tatgcatgagtgtttatgtgta

SEQ ID NO: 174565 - DNA, 23 bp, Mus musculus
tcttcacagtttctttttgtcag

SEQ ID NO: 174566 - DNA, 22 bp, Mus musculus
tgtgtgtgttatgtgtatgtct

SEQ ID NO: 174567 - DNA, 23 bp, Mus musculus
tatgtgtgtatgtgtatatgtgt

SEQ ID NO: 174568 - DNA, 23 bp, Mus musculus
agtctctgagtgtctgggaacct

SEQ ID NO: 174569 - DNA, 23 bp, Mus musculus
cctgtctgtctgtctgtctgtct

SEQ ID NO: 174570 - DNA, 23 bp, Mus musculus
gtgtgtctctgtgcctctgaccc

SEQ ID NO: 174571 - DNA, 23 bp, Mus musculus
tagtgaatctggtcagtttcagg

SEQ ID NO: 174572 - DNA, 23 bp, Mus musculus
tatgtgtgtgcattggtatttgt

SEQ ID NO: 174573 - DNA, 21 bp, Mus musculus
tatatatttatgtgtatgcat

SEQ ID NO: 174574 - DNA, 23 bp, Mus musculus
tcagaggctgaagagatagctta

SEQ ID NO: 174575 - DNA, 22 bp, Mus musculus
tgttttgtgaccaattatatgg

SEQ ID NO: 174576 - DNA, 21 bp, Mus musculus
agacagaagagtgtctgggat

SEQ ID NO: 174577 - DNA, 23 bp, Mus musculus
atccaggcagtgactgatcttgg

SEQ ID NO: 174578 - DNA, 20 bp, Mus musculus
tatgtcacacacaaagctgt

SEQ ID NO: 174579 - DNA, 22 bp, Mus musculus
tgttttgtgaccaattatatgg

SEQ ID NO: 174580 - DNA, 23 bp, Mus musculus
tctctgtgtgtctctgtgtgtat

SEQ ID NO: 174581 - DNA, 21 bp, Mus musculus
tgtgcagatacctgatgaatc

SEQ ID NO: 174582 - DNA, 23 bp, Mus musculus
atctgtgtgtgcatgtgcatgtg

SEQ ID NO: 174583 - DNA, 21 bp, Mus musculus
acatgtatgtacctgtgtatg

SEQ ID NO: 174584 - DNA, 23 bp, Mus musculus
agtatatgtgcctgtgtgtctgt

SEQ ID NO: 174585 - DNA, 23 bp, Mus musculus
tcatgtgaatttgtaaatatgtg

SEQ ID NO: 174586 - DNA, 21 bp, Mus musculus
tggaagactactgtattagtt

SEQ ID NO: 174587 - DNA, 22 bp, Mus musculus
ttatggatagtctctatacagt

SEQ ID NO: 174588 - DNA, 23 bp, Mus musculus
agcagagagactagagagtaggt

SEQ ID NO: 174589 - DNA, 19 bp, Mus musculus
tgtctgcctgtctgtctgc

SEQ ID NO: 174590 - DNA, 22 bp, Mus musculus
tgttttgtgaccaattatatgg

SEQ ID NO: 174591 - DNA, 22 bp, Mus musculus
tgttttgtgaccaattatatgg

SEQ ID NO: 174592 - DNA, 23 bp, Mus musculus
gtctgtctttctgtctgtctggg

SEQ ID NO: 174593 - DNA, 23 bp, Mus musculus
gtgtgtgtctctctctctgtgtg

SEQ ID NO: 174594 - DNA, 22 bp, Mus musculus
tatgtgtgtggctgttgttata

SEQ ID NO: 174595 - DNA, 20 bp, Mus musculus
taacagtttaattatgtatg

SEQ ID NO: 174596 - DNA, 19 bp, Mus musculus
aggctgtgacacaggaaga

SEQ ID NO: 174597 - DNA, 23 bp, Mus musculus
atggctgtcatagtaatgcctac

SEQ ID NO: 174598 - DNA, 23 bp, Mus musculus
agtgtgtatatatatttgtgtgt

SEQ ID NO: 174599 - DNA, 19 bp, Mus musculus
tatgtttctaagtgtgtat

SEQ ID NO: 174600 - DNA, 21 bp, Mus musculus
aaatctcctccttatggtctt

SEQ ID NO: 174601 - DNA, 23 bp, Mus musculus
tgtatatatatgtgtgtgtatgt

SEQ ID NO: 174602 - DNA, 18 bp, Mus musculus
agctttcctttgactaca

SEQ ID NO: 174603 - DNA, 21 bp, Mus musculus
tttcagaacagtcacagcaga

SEQ ID NO: 174604 - DNA, 23 bp, Mus musculus
attgagagtttggttgggtatag

SEQ ID NO: 174605 - DNA, 18 bp, Mus musculus
tatatgtgccatatacat

SEQ ID NO: 174606 - DNA, 23 bp, Mus musculus
tctctgtttgtgagtaaatgcag

SEQ ID NO: 174607 - DNA, 21 bp, Mus musculus
agaggctagaagacagcattg

SEQ ID NO: 174608 - DNA, 23 bp, Mus musculus
tgtgtgcactctgtctgtgtgtc

SEQ ID NO: 174609 - DNA, 23 bp, Mus musculus
tgcctgcctgcctgcctgtagcc

SEQ ID NO: 174610 - DNA, 21 bp, Mus musculus
tataccaagtagttcacaaga

SEQ ID NO: 174611 - DNA, 22 bp, Mus musculus
acagaacattgcaaaagctaag

SEQ ID NO: 174612 - DNA, 22 bp, Mus musculus
tgtatatatgtatgtatagtgt

SEQ ID NO: 174613 - DNA, 22 bp, Mus musculus
tgttttgtgaccaattatatgg

SEQ ID NO: 174614 - DNA, 23 bp, Mus musculus
actgacagtgtaaacctttctga

SEQ ID NO: 174615 - DNA, 22 bp, Mus musculus
tgttttgtgaccaattatatgg

SEQ ID NO: 174616 - DNA, 23 bp, Mus musculus
tatgtgtgcatgtatatatgtgt

SEQ ID NO: 174617 - DNA, 23 bp, Mus musculus
tgtgtgtgttcatgtgtatatat

SEQ ID NO: 174618 - DNA, 19 bp, Mus musculus
acggatatgtatacacaca

SEQ ID NO: 174619 - DNA, 23 bp, Mus musculus
tgtcagaggtacatgaaagtaga

SEQ ID NO: 174620 - DNA, 23 bp, Mus musculus
acagcctgcctgtctgcctgcct

SEQ ID NO: 174621 - DNA, 23 bp, Mus musculus
tgcctgcctgcctgcctgcctgc

SEQ ID NO: 174622 - DNA, 23 bp, Mus musculus
atatgtgtatatgtatatatgta

SEQ ID NO: 174623 - DNA, 22 bp, Mus musculus
tgtgtatatgtttttgagtatg

SEQ ID NO: 174624 - DNA, 23 bp, Mus musculus
tatacatgcttgtgtttgtgtgt

SEQ ID NO: 174625 - DNA, 19 bp, Mus musculus
gtatatatgtatatgtgtg

SEQ ID NO: 174626 - DNA, 23 bp, Mus musculus
tgaatgcatgtatatatgtatgt

SEQ ID NO: 174627 - DNA, 23 bp, Mus musculus
tggctcagtgggaagtagctgat

SEQ ID NO: 174628 - DNA, 23 bp, Mus musculus
atgaattctaccttgagattagg

SEQ ID NO: 174629 - DNA, 23 bp, Mus musculus
ttgttaagagaaagtatgtcact

SEQ ID NO: 174630 - DNA, 23 bp, Mus musculus
attcccagtctcattctctctgc

SEQ ID NO: 174631 - DNA, 23 bp, Mus musculus
tactctgtccctctgtcccagcc

SEQ ID NO: 174632 - DNA, 18 bp, Mus musculus
agacagacagacaggctg

SEQ ID NO: 174633 - DNA, 20 bp, Mus musculus
atatacgtggcatatgtatg

SEQ ID NO: 174634 - DNA, 19 bp, Mus musculus
acatgtgtgtatgtacatg

SEQ ID NO: 174635 - DNA, 22 bp, Mus musculus
ttttcactgtggctgctttggg

SEQ ID NO: 174636 - DNA, 19 bp, Mus musculus
ttgacatgatttggtatgc

SEQ ID NO: 174637 - DNA, 21 bp, Mus musculus
aggttggtcatgctgcatttc

SEQ ID NO: 174638 - DNA, 19 bp, Mus musculus
acacacatgactgtgtgca

SEQ ID NO: 174639 - DNA, 23 bp, Mus musculus
atctatgcatatatattgtgtgt

SEQ ID NO: 174640 - DNA, 23 bp, Mus musculus
tgtatgtatgtatgtatgtatgt

SEQ ID NO: 174641 - DNA, 23 bp, Mus musculus
agcatagttcttcacaatgtcac

SEQ ID NO: 174642 - DNA, 21 bp, Mus musculus
tggttgacatgtgatttagaa

SEQ ID NO: 174643 - DNA, 23 bp, Mus musculus
agtctagatgctttcagttgatg

SEQ ID NO: 174644 - DNA, 23 bp, Mus musculus
cgtgtcactccctgactggctgc

SEQ ID NO: 174645 - DNA, 21 bp, Mus musculus
aacacactcactctatcccgt

SEQ ID NO: 174646 - DNA, 23 bp, Mus musculus
cgtgtcactccctgactggctgc

SEQ ID NO: 174647 - DNA, 18 bp, Mus musculus
gtactggggctggagaga

SEQ ID NO: 174648 - DNA, 22 bp, Mus musculus
tgacttcatgtttccattgccc

SEQ ID NO: 174649 - DNA, 23 bp, Mus musculus
tatgtgtatatatatgcatatgt

SEQ ID NO: 174650 - DNA, 23 bp, Mus musculus
tttgtgtgtgagagtctgtctgt

SEQ ID NO: 174651 - DNA, 18 bp, Mus musculus
tctaatcagtatggtcat

SEQ ID NO: 174652 - DNA, 21 bp, Mus musculus
tcacagtgaaccggtctcttt

SEQ ID NO: 174653 - DNA, 21 bp, Mus musculus
atagtgcttcctaaatgtttc

SEQ ID NO: 174654 - DNA, 23 bp, Mus musculus
ctcagggtcagtgtgtggctctg

SEQ ID NO: 174655 - DNA, 22 bp, Mus musculus
tgttttgtgaccaattatatgg

SEQ ID NO: 174656 - DNA, 18 bp, Mus musculus
agtcttctgtttttgttg

SEQ ID NO: 174657 - DNA, 22 bp, Mus musculus
tgttttgtgaccaattatatgg

SEQ ID NO: 174658 - DNA, 23 bp, Mus musculus
tgtctgtctgtttgtctgtcctt

SEQ ID NO: 174659 - DNA, 18 bp, Mus musculus
agacagacagacagatgt

SEQ ID NO: 174660 - DNA, 23 bp, Mus musculus
gtgcagacatccctgatctgggc

SEQ ID NO: 174661 - DNA, 19 bp, Mus musculus
agaatgtcagctttagtag

SEQ ID NO: 174662 - DNA, 22 bp, Mus musculus
ctcatctctctttgtatttctg

SEQ ID NO: 174663 - DNA, 19 bp, Mus musculus
tctctcacttgatgtctct

SEQ ID NO: 174664 - DNA, 21 bp, Mus musculus
aaagtactagagatcgaatgc

SEQ ID NO: 174665 - DNA, 21 bp, Mus musculus
tagtttctaattattttagtg

SEQ ID NO: 174666 - DNA, 20 bp, Mus musculus
atgtgtgtgtgtatgtgtat

SEQ ID NO: 174667 - DNA, 20 bp, Mus musculus
catgccagtgtgtgtttaga

SEQ ID NO: 174668 - DNA, 23 bp, Mus musculus
ctctctctctctcttagaaaaga

SEQ ID NO: 174669 - DNA, 21 bp, Mus musculus
agcaagagagagtagatgtct

SEQ ID NO: 174670 - DNA, 22 bp, Mus musculus
tgttttgtgaccaattatatgg

SEQ ID NO: 174671 - DNA, 21 bp, Mus musculus
ttttgtgctgggaattggtag

SEQ ID NO: 174672 - DNA, 19 bp, Mus musculus
acatgtgcacatgcatata

SEQ ID NO: 174673 - DNA, 22 bp, Mus musculus
atatgtgtgtatgtatatatgt

SEQ ID NO: 174674 - DNA, 23 bp, Mus musculus
acacagtgaatcctgtgtctttg

SEQ ID NO: 174675 - DNA, 23 bp, Mus musculus
tcgttttaggttgtatacttagg

SEQ ID NO: 174676 - DNA, 22 bp, Mus musculus
tgtgtgcatgagcatatgcatg

SEQ ID NO: 174677 - DNA, 22 bp, Mus musculus
tgtgcttcttttagatcccaaa

SEQ ID NO: 174678 - DNA, 18 bp, Mus musculus
tgccagcctattttgtga

SEQ ID NO: 174679 - DNA, 23 bp, Mus musculus
taggtgctgagtctctgagtgtg

SEQ ID NO: 174680 - DNA, 22 bp, Mus musculus
tgttttgtgaccaattatatgg

SEQ ID NO: 174681 - DNA, 22 bp, Mus musculus
ttttgtgacggattatgtggtc

SEQ ID NO: 174682 - DNA, 18 bp, Mus musculus
aggcagaagattcgaggt

SEQ ID NO: 174683 - DNA, 22 bp, Mus musculus
tgacagactttctgtctgtcct

SEQ ID NO: 174684 - DNA, 22 bp, Mus musculus
gttaggaatgtttacttgtatg

SEQ ID NO: 174685 - DNA, 20 bp, Mus musculus
actctgaagtgactgtgctc

SEQ ID NO: 174686 - DNA, 23 bp, Mus musculus
atctgcatctgcatctgcaagaa

SEQ ID NO: 174687 - DNA, 22 bp, Mus musculus
gttgacagttcagtctctgtga

SEQ ID NO: 174688 - DNA, 23 bp, Mus musculus
aatatctgctttactttttctgt

SEQ ID NO: 174689 - DNA, 23 bp, Mus musculus
agtattctcagtagagatggtct

SEQ ID NO: 174690 - DNA, 23 bp, Mus musculus
gttataggtacaaaattgtcaaa

SEQ ID NO: 174691 - DNA, 18 bp, Mus musculus
acagatgaaacagtgcac

SEQ ID NO: 174692 - DNA, 23 bp, Mus musculus
atgtatgtatttatgtatgcatg

SEQ ID NO: 174693 - DNA, 23 bp, Mus musculus
tctctttctgcttgatcttgtcc

SEQ ID NO: 174694 - DNA, 23 bp, Mus musculus
tgcagagagaaatgagagtgagc

SEQ ID NO: 174695 - DNA, 23 bp, Mus musculus
ttacacatcattcacatcacagt

SEQ ID NO: 174696 - DNA, 23 bp, Mus musculus
tttttactttatgtatatgagtg

SEQ ID NO: 174697 - DNA, 21 bp, Mus musculus
ttcagaggagagagtgagctg

SEQ ID NO: 174698 - DNA, 23 bp, Mus musculus
tcacaaagtgctgagtgtggcct

SEQ ID NO: 174699 - DNA, 23 bp, Mus musculus
ctgcctgcctgtctgtctatctt

SEQ ID NO: 174700 - DNA, 19 bp, Mus musculus
tttttccttgacattactt

SEQ ID NO: 174701 - DNA, 23 bp, Mus musculus
cccaagtctctgtggctgttctt

SEQ ID NO: 174702 - DNA, 23 bp, Mus musculus
agcccatgttgatctgataggat

SEQ ID NO: 174703 - DNA, 23 bp, Mus musculus
tttgtgaccaattatatggtcaa

SEQ ID NO: 174704 - DNA, 23 bp, Mus musculus
gtaatcacagtgatcagtgattc

SEQ ID NO: 174705 - DNA, 20 bp, Mus musculus
tagtgttcattttcttagca

SEQ ID NO: 174706 - DNA, 20 bp, Mus musculus
gtgtatatgtatatatgtgt

SEQ ID NO: 174707 - DNA, 23 bp, Mus musculus
tatgtgtatataaatgtatgtgt

SEQ ID NO: 174708 - DNA, 23 bp, Mus musculus
tatggcttttcattcctatgtga

SEQ ID NO: 174709 - DNA, 23 bp, Mus musculus
atatgtatgtgtccatgtatatg

SEQ ID NO: 174710 - DNA, 20 bp, Mus musculus
acgatgtatgtatgtatgta

SEQ ID NO: 174711 - DNA, 23 bp, Mus musculus
ttcagtgttattcttatgcctga

SEQ ID NO: 174712 - DNA, 19 bp, Mus musculus
acaggcactcactgactgt

SEQ ID NO: 174713 - DNA, 23 bp, Mus musculus
tgtgtgtctgtatgtgtgtgtgc

SEQ ID NO: 174714 - DNA, 23 bp, Mus musculus
tatgtatgtatatgtatgcatat

SEQ ID NO: 174715 - DNA, 20 bp, Mus musculus
tgaaaacttccagggctgga

SEQ ID NO: 174716 - DNA, 23 bp, Mus musculus
tagcactgactgctcttccagag

SEQ ID NO: 174717 - DNA, 23 bp, Mus musculus
tgtaaacattcttctctgtcacc

SEQ ID NO: 174718 - DNA, 20 bp, Mus musculus
cttacacctgaggcaggaga

SEQ ID NO: 174719 - DNA, 20 bp, Mus musculus
tgctctcttcagttcctgcc

SEQ ID NO: 174720 - DNA, 18 bp, Mus musculus
ttagcttctggaccagga

SEQ ID NO: 174721 - DNA, 23 bp, Mus musculus
gtctgcctgtctgtctatgtctc

SEQ ID NO: 174722 - DNA, 23 bp, Mus musculus
tttctgggactcaaagtctctct

SEQ ID NO: 174723 - DNA, 18 bp, Mus musculus
agaaacctgaggaagctg

SEQ ID NO: 174724 - DNA, 23 bp, Mus musculus
tagctctgactgcctctcttcag

SEQ ID NO: 174725 - DNA, 18 bp, Mus musculus
tatctgagaagcgatgag

SEQ ID NO: 174726 - DNA, 19 bp, Mus musculus
tgacaggtgacagtgggca

SEQ ID NO: 174727 - DNA, 21 bp, Mus musculus
tcagaacactgactgctcttc

SEQ ID NO: 174728 - DNA, 23 bp, Mus musculus
aggtctgagagtgtagactgctg

SEQ ID NO: 174729 - DNA, 23 bp, Mus musculus
tggtgtctgtagactgtcagatc

SEQ ID NO: 174730 - DNA, 23 bp, Mus musculus
ttacagacagttgtgagccacca

SEQ ID NO: 174731 - DNA, 23 bp, Mus musculus
agacagatctctgtgagttcaag

SEQ ID NO: 174732 - DNA, 23 bp, Mus musculus
tctacagagcacgtgtgtgtgtg

SEQ ID NO: 174733 - DNA, 21 bp, Mus musculus
atatcatattcatatgcatag

SEQ ID NO: 174734 - DNA, 23 bp, Mus musculus
tgtgtgtgtgacagagaaaagcc

SEQ ID NO: 174735 - DNA, 19 bp, Mus musculus
tgtatgtatgtatgtgtgt

SEQ ID NO: 174736 - DNA, 23 bp, Mus musculus
atacacacatatataaatgtgta

SEQ ID NO: 174737 - DNA, 18 bp, Mus musculus
agctgtctcactatacag

SEQ ID NO: 174738 - DNA, 23 bp, Mus musculus
tctgtctctctgtgttgtgtgcc

SEQ ID NO: 174739 - DNA, 21 bp, Mus musculus
gggtctctcacccactgtgag

SEQ ID NO: 174740 - DNA, 19 bp, Mus musculus
ggaagtgcagaggctggac

SEQ ID NO: 174741 - DNA, 22 bp, Mus musculus
tgagtctgtgtgtatgtggtac

SEQ ID NO: 174742 - DNA, 20 bp, Mus musculus
tatgtatgtatgtatatatg

SEQ ID NO: 174743 - DNA, 23 bp, Mus musculus
tatgagtgagtgtgtatgtggta

SEQ ID NO: 174744 - DNA, 23 bp, Mus musculus
tacatgcacacatatatgtacgt

SEQ ID NO: 174745 - DNA, 23 bp, Mus musculus
atgtgtatatgtatgtgtgtgtg

SEQ ID NO: 174746 - DNA, 22 bp, Mus musculus
ctagttgtgtgtctgtactaca

SEQ ID NO: 174747 - DNA, 23 bp, Mus musculus
tatgcaatgtttacatgtctgta

SEQ ID NO: 174748 - DNA, 21 bp, Mus musculus
tatcatttgaaatgtaaatga

SEQ ID NO: 174749 - DNA, 23 bp, Mus musculus
cctctctgacagtctgcagggct

SEQ ID NO: 174750 - DNA, 20 bp, Mus musculus
aagagcactgactgctcttc

SEQ ID NO: 174751 - DNA, 23 bp, Mus musculus
actgactgctcttccagaggtcc

SEQ ID NO: 174752 - DNA, 22 bp, Mus musculus
ggaattgattctctctctctat

SEQ ID NO: 174753 - DNA, 21 bp, Mus musculus
tgaggattgaatccaggtagt

SEQ ID NO: 174754 - DNA, 18 bp, Mus musculus
atgaatatttatatgtga

SEQ ID NO: 174755 - DNA, 23 bp, Mus musculus
gctgcctggctctctgactgcca

SEQ ID NO: 174756 - DNA, 22 bp, Mus musculus
aacagtcttgtttggaaccact

SEQ ID NO: 174757 - DNA, 19 bp, Mus musculus
gcatgcatgtatgtatgta

SEQ ID NO: 174758 - DNA, 23 bp, Mus musculus
tctctgtcactgcctccctctgg

SEQ ID NO: 174759 - DNA, 18 bp, Mus musculus
agctgctctgactcctgg

SEQ ID NO: 174760 - DNA, 18 bp, Mus musculus
ttgagggtggttttcctt

SEQ ID NO: 174761 - DNA, 22 bp, Mus musculus
attgtggatatctaggagttcg

SEQ ID NO: 174762 - DNA, 18 bp, Mus musculus
atggtattttatgatgta

SEQ ID NO: 174763 - DNA, 23 bp, Mus musculus
tgtgtgcgtgagtgcatgcctct

SEQ ID NO: 174764 - DNA, 23 bp, Mus musculus
taagagcactgtctgctcttcca

SEQ ID NO: 174765 - DNA, 23 bp, Mus musculus
tgtctgtctgtctgtctgtctgt

SEQ ID NO: 174766 - DNA, 23 bp, Mus musculus
tctctctctctctctccatgagt

SEQ ID NO: 174767 - DNA, 19 bp, Mus musculus
tggacaatggcccaggaga

SEQ ID NO: 174768 - DNA, 23 bp, Mus musculus
tgtctgtcagtctctctgcatgg

SEQ ID NO: 174769 - DNA, 22 bp, Mus musculus
ttcaattctcagcaaccacatg

SEQ ID NO: 174770 - DNA, 19 bp, Mus musculus
ctatgggctttgtgtatgt

SEQ ID NO: 174771 - DNA, 23 bp, Mus musculus
gtctctgtatctgtattagtcag

SEQ ID NO: 174772 - DNA, 22 bp, Mus musculus
cctgggtgccagagttcaggtg

SEQ ID NO: 174773 - DNA, 21 bp, Mus musculus
gatggcagtgagtagagatgg

SEQ ID NO: 174774 - DNA, 23 bp, Mus musculus
tctctgactctctgtgttttgtg

SEQ ID NO: 174775 - DNA, 22 bp, Mus musculus
tgttttgtgaccaattatatgg

SEQ ID NO: 174776 - DNA, 20 bp, Mus musculus
aatatatatgtatatgtgta

SEQ ID NO: 174777 - DNA, 23 bp, Mus musculus
ctctgcctgtctgtctgcatgca

SEQ ID NO: 174778 - DNA, 22 bp, Mus musculus
aaatctgggttgtttccagctt

SEQ ID NO: 174779 - DNA, 21 bp, Mus musculus
agcgacaatgtttcaggagag

SEQ ID NO: 174780 - DNA, 23 bp, Mus musculus
aacattcaacgctgtcggtgagt

SEQ ID NO: 174781 - DNA, 22 bp, Mus musculus
accatcgaccgttgattgtacc

SEQ ID NO: 174782 - DNA, 23 bp, Mus musculus
acattcattgctgtcggtgggtt

SEQ ID NO: 174783 - DNA, 18 bp, Mus musculus
aacaatgaatgcaactgt

SEQ ID NO: 174784 - DNA, 23 bp, Mus musculus
ttgtgtgtgttatgatgaagatg

SEQ ID NO: 174785 - DNA, 21 bp, Mus musculus
acacacacacagaaatacatg

SEQ ID NO: 174786 - DNA, 22 bp, Mus musculus
tattcagcttatttgattattt

SEQ ID NO: 174787 - DNA, 19 bp, Mus musculus
agacagaaggatctgagct

SEQ ID NO: 174788 - DNA, 18 bp, Mus musculus
agtcaagtcactctgcac

SEQ ID NO: 174789 - DNA, 18 bp, Mus musculus
tgtctggccattctctct

SEQ ID NO: 174790 - DNA, 19 bp, Mus musculus
tatgtatatatgtatgtgt

SEQ ID NO: 174791 - DNA, 22 bp, Mus musculus
gtagagagtgggtgttctattt

SEQ ID NO: 174792 - DNA, 23 bp, Mus musculus
gactgccagtctgactgccaatg

SEQ ID NO: 174793 - DNA, 23 bp, Mus musculus
agggaagagagtgaggacaggca

SEQ ID NO: 174794 - DNA, 23 bp, Mus musculus
tcactctgtgactcatttggctc

SEQ ID NO: 174795 - DNA, 23 bp, Mus musculus
tacacacacacatatgtgtgtgt

SEQ ID NO: 174796 - DNA, 22 bp, Mus musculus
tgttttgtgaccaattatatgg

SEQ ID NO: 174797 - DNA, 22 bp, Mus musculus
ttagagcatatgtacgaaaaga

SEQ ID NO: 174798 - DNA, 19 bp, Mus musculus
atctatacacacacacaca

SEQ ID NO: 174799 - DNA, 23 bp, Mus musculus
taagtgaagaaactgaggacagg

SEQ ID NO: 174800 - DNA, 23 bp, Mus musculus
atacttaggatatgtgagagcta

SEQ ID NO: 174801 - DNA, 22 bp, Mus musculus
tgactatgtaattagctgttgg

SEQ ID NO: 174802 - DNA, 23 bp, Mus musculus
tatgtgcttctttaaatgtgaag

SEQ ID NO: 174803 - DNA, 22 bp, Mus musculus
tatgtgcatgagttttgcctgc

SEQ ID NO: 174804 - DNA, 21 bp, Mus musculus
aaatgtataaatgtatacctg

SEQ ID NO: 174805 - DNA, 18 bp, Mus musculus
atatgtatacatgtatat

SEQ ID NO: 174806 - DNA, 21 bp, Mus musculus
acacactcacacgttgcatat

SEQ ID NO: 174807 - DNA, 21 bp, Mus musculus
tatatgcaacgtgtgagtgtg

SEQ ID NO: 174808 - DNA, 23 bp, Mus musculus
atatatgtatatgtatatgtatg

SEQ ID NO: 174809 - DNA, 22 bp, Mus musculus
tgcagtctctagatggtccatc

SEQ ID NO: 174810 - DNA, 23 bp, Mus musculus
aatggatagttgacaggaggaaa

SEQ ID NO: 174811 - DNA, 23 bp, Mus musculus
tctcactgtcaaaggtgaataac

SEQ ID NO: 174812 - DNA, 20 bp, Mus musculus
atatggagaagagtgggact

SEQ ID NO: 174813 - DNA, 21 bp, Mus musculus
aaaactcttttgattctccct

SEQ ID NO: 174814 - DNA, 23 bp, Mus musculus
tatgtatatgcatatgtgtgtgt

SEQ ID NO: 174815 - DNA, 18 bp, Mus musculus
agtgaacatacatcattg

SEQ ID NO: 174816 - DNA, 19 bp, Mus musculus
atcaatgatgcttatgtaa

SEQ ID NO: 174817 - DNA, 23 bp, Mus musculus
ctgtgtctctgtttagtttctgt

SEQ ID NO: 174818 - DNA, 23 bp, Mus musculus
aggatctgtccattgatgagagt

SEQ ID NO: 174819 - DNA, 22 bp, Mus musculus
tgttttgtgaccaattatatgg

SEQ ID NO: 174820 - DNA, 23 bp, Mus musculus
tagtgcatggtgatctgatagga

SEQ ID NO: 174821 - DNA, 21 bp, Mus musculus
tgttttgtgacctattatgtg

SEQ ID NO: 174822 - DNA, 19 bp, Mus musculus
tgaggttgtatgtaggatg

SEQ ID NO: 174823 - DNA, 22 bp, Mus musculus
tgttttgtgaccaattatatgg

SEQ ID NO: 174824 - DNA, 21 bp, Mus musculus
ggactgtgagaaatgaggagc

SEQ ID NO: 174825 - DNA, 23 bp, Mus musculus
gcagactggctggctctttccca

SEQ ID NO: 174826 - DNA, 22 bp, Mus musculus
tgttttgtgaccaattatatgg

SEQ ID NO: 174827 - DNA, 23 bp, Mus musculus
tcacactgagtgaggtaacctag

SEQ ID NO: 174828 - DNA, 23 bp, Mus musculus
ctctctcactctacctgtctctg

SEQ ID NO: 174829 - DNA, 23 bp, Mus musculus
tatcaggcctatagttttctctt

SEQ ID NO: 174830 - DNA, 23 bp, Mus musculus
tccttaagagaacatactgggat

SEQ ID NO: 174831 - DNA, 20 bp, Mus musculus
tgcatgtatatgtacatata

SEQ ID NO: 174832 - DNA, 23 bp, Mus musculus
gtatgtatgtatgtatgtatgta

SEQ ID NO: 174833 - DNA, 22 bp, Mus musculus
ctgcctgaatgtctgtctgtct

SEQ ID NO: 174834 - DNA, 23 bp, Mus musculus
tctgtgtgtctctgtctctctct

SEQ ID NO: 174835 - DNA, 23 bp, Mus musculus
ttttgtgagcttttcttgtccaa

SEQ ID NO: 174836 - DNA, 22 bp, Mus musculus
acacacacgagagagagaagta

SEQ ID NO: 174837 - DNA, 22 bp, Mus musculus
gtccatggtggtctgataggat

SEQ ID NO: 174838 - DNA, 23 bp, Mus musculus
tctgaagttctctatctttgttg

SEQ ID NO: 174839 - DNA, 23 bp, Mus musculus
atgttctgaaatcaagttcttgt

SEQ ID NO: 174840 - DNA, 23 bp, Mus musculus
tcatgtctatatgttgttatgtg

SEQ ID NO: 174841 - DNA, 22 bp, Mus musculus
tgttttgtgaccaattatatgg

SEQ ID NO: 174842 - DNA, 22 bp, Mus musculus
ttgactgcagagagtgctcaga

SEQ ID NO: 174843 - DNA, 23 bp, Mus musculus
tctctctgtcactgagaatcggc

SEQ ID NO: 174844 - DNA, 23 bp, Mus musculus
tgggtctctgtttctatctcgat

SEQ ID NO: 174845 - DNA, 19 bp, Mus musculus
tacatatatatgcagtttt

SEQ ID NO: 174846 - DNA, 22 bp, Mus musculus
cattcagtctgatgtttggatg

SEQ ID NO: 174847 - DNA, 20 bp, Mus musculus
gtcaggctctgacagggcct

SEQ ID NO: 174848 - DNA, 23 bp, Mus musculus
accatgttcattgctattctagg

SEQ ID NO: 174849 - DNA, 21 bp, Mus musculus
tgttttgttttgttgctcccc

SEQ ID NO: 174850 - DNA, 21 bp, Mus musculus
ttatgtgtgtgtgtatgtata

SEQ ID NO: 174851 - DNA, 20 bp, Mus musculus
tgcatgtatgtatatatgta

SEQ ID NO: 174852 - DNA, 20 bp, Mus musculus
gtatgtatgtatgtatgtat

SEQ ID NO: 174853 - DNA, 23 bp, Mus musculus
tgtgtcagtctcagtgtcttgtc

SEQ ID NO: 174854 - DNA, 23 bp, Mus musculus
acgtgcacacacacatatgtata

SEQ ID NO: 174855 - DNA, 21 bp, Mus musculus
ttgtatgtgtgcatgtgtgtg

SEQ ID NO: 174856 - DNA, 23 bp, Mus musculus
tcagaaatcctcagagtccagct

SEQ ID NO: 174857 - DNA, 22 bp, Mus musculus
tgtgatcctgagatcctgggtg

SEQ ID NO: 174858 - DNA, 22 bp, Mus musculus
tgttttgtgtccaattatttgg

SEQ ID NO: 174859 - DNA, 23 bp, Mus musculus
gcaacactagtgactatgtagtt

SEQ ID NO: 174860 - DNA, 19 bp, Mus musculus
acacacagtgataacttgt

SEQ ID NO: 174861 - DNA, 23 bp, Mus musculus
tatgtatatgtatatatgtgtgt

SEQ ID NO: 174862 - DNA, 22 bp, Mus musculus
tgttttgtgaccaattatatgg

SEQ ID NO: 174863 - DNA, 19 bp, Mus musculus
tatatgtacttatttttgt

SEQ ID NO: 174864 - DNA, 22 bp, Mus musculus
tgttttgtgaccaattatatgg

SEQ ID NO: 174865 - DNA, 23 bp, Mus musculus
tttattagatcaagtctgtcact

SEQ ID NO: 174866 - DNA, 22 bp, Mus musculus
ctgacactatcactcaggctat

SEQ ID NO: 174867 - DNA, 23 bp, Mus musculus
tgcaggcttgataccccagtgta

SEQ ID NO: 174868 - DNA, 23 bp, Mus musculus
gttatggatctgtagaataggct

SEQ ID NO: 174869 - DNA, 23 bp, Mus musculus
tgttttgtaaccaattatatggt

SEQ ID NO: 174870 - DNA, 22 bp, Mus musculus
atttttgtgtgaatgtttactg

SEQ ID NO: 174871 - DNA, 22 bp, Mus musculus
tgttttgtgaccaattatatgg

SEQ ID NO: 174872 - DNA, 23 bp, Mus musculus
cgtcatgctcagtaatgctgcag

SEQ ID NO: 174873 - DNA, 23 bp, Mus musculus
gactctgcattagcatctgcttc

SEQ ID NO: 174874 - DNA, 23 bp, Mus musculus
agagaagtgagactttcagcttt

SEQ ID NO: 174875 - DNA, 20 bp, Mus musculus
tcagtgatgactgactgcag

SEQ ID NO: 174876 - DNA, 21 bp, Mus musculus
tgtgtatatatatgtatgtgt

SEQ ID NO: 174877 - DNA, 22 bp, Mus musculus
cactggggatggactttgaggt

SEQ ID NO: 174878 - DNA, 21 bp, Mus musculus
tctcactctctgttatagagg

SEQ ID NO: 174879 - DNA, 23 bp, Mus musculus
tctctgactgggtactcattcag

SEQ ID NO: 174880 - DNA, 22 bp, Mus musculus
caagtctgctggtacattgttc

SEQ ID NO: 174881 - DNA, 19 bp, Mus musculus
atagtcctaattctttttt

SEQ ID NO: 174882 - DNA, 23 bp, Mus musculus
ctgtctctgactctctctcacac

SEQ ID NO: 174883 - DNA, 22 bp, Mus musculus
tctctctttctgtttcacctgt

SEQ ID NO: 174884 - DNA, 23 bp, Mus musculus
ctgcctctgcctctgagagtctg

SEQ ID NO: 174885 - DNA, 19 bp, Mus musculus
tcactgtgtagcccaggct

SEQ ID NO: 174886 - DNA, 23 bp, Mus musculus
actctgagtgccagagttacagg

SEQ ID NO: 174887 - DNA, 23 bp, Mus musculus
tatgtgtatgcatatgcagacac

SEQ ID NO: 174888 - DNA, 18 bp, Mus musculus
aactttggggtctgatgg

SEQ ID NO: 174889 - DNA, 19 bp, Mus musculus
agacacatgtctgtgtgga

SEQ ID NO: 174890 - DNA, 21 bp, Mus musculus
ttgcacagggtcacctagctg

SEQ ID NO: 174891 - DNA, 19 bp, Mus musculus
agaggtagatggatctttc

SEQ ID NO: 174892 - DNA, 23 bp, Mus musculus
tgtgcgtgcgtgcgtgcgtgtgt

SEQ ID NO: 174893 - DNA, 23 bp, Mus musculus
agagcacagactgcgaattctgt

SEQ ID NO: 174894 - DNA, 21 bp, Mus musculus
atatgcatatatatatgtatg

SEQ ID NO: 174895 - DNA, 21 bp, Mus musculus
tcaggaggcagagacaggcag

SEQ ID NO: 174896 - DNA, 19 bp, Mus musculus
catatgtatacatgtatgt

SEQ ID NO: 174897 - DNA, 23 bp, Mus musculus
tatctgtctgtctgtctgtttgc

SEQ ID NO: 174898 - DNA, 22 bp, Mus musculus
tttgagcttgtatagataagtt

SEQ ID NO: 174899 - DNA, 23 bp, Mus musculus
tgtcacacttgagagtctggagt

SEQ ID NO: 174900 - DNA, 23 bp, Mus musculus
actctcactggatttctagttct

SEQ ID NO: 174901 - DNA, 22 bp, Mus musculus
agtcagtgcttgtccttttgtg

SEQ ID NO: 174902 - DNA, 23 bp, Mus musculus
acaggttccctgtctggctgcca

SEQ ID NO: 174903 - DNA, 23 bp, Mus musculus
agccaatcagaggacagttgtca

SEQ ID NO: 174904 - DNA, 23 bp, Mus musculus
gtctgagtgttcagagtgtgcag

SEQ ID NO: 174905 - DNA, 23 bp, Mus musculus
agtctccggagtctctgtgtctc

SEQ ID NO: 174906 - DNA, 22 bp, Mus musculus
tgtgtgagtgtgtctgtatagg

SEQ ID NO: 174907 - DNA, 23 bp, Mus musculus
agacaagcatcggtgctggagag

SEQ ID NO: 174908 - DNA, 23 bp, Mus musculus
aagagcactgactgctcttccac

SEQ ID NO: 174909 - DNA, 21 bp, Mus musculus
tgtgtgaccacagggaagtca

SEQ ID NO: 174910 - DNA, 23 bp, Mus musculus
cactgtctgtctgcctctgtctg

SEQ ID NO: 174911 - DNA, 23 bp, Mus musculus
tgtatgtgtgtatgtatatatgt

SEQ ID NO: 174912 - DNA, 22 bp, Mus musculus
tgttttgtgaccaattatatgg

SEQ ID NO: 174913 - DNA, 23 bp, Mus musculus
tgaccttcacacacactctctct

SEQ ID NO: 174914 - DNA, 23 bp, Mus musculus
atgtatgtatgtatgtatgtatc

SEQ ID NO: 174915 - DNA, 23 bp, Mus musculus
ttcagagctgattgctgcttcag

SEQ ID NO: 174916 - DNA, 23 bp, Mus musculus
gagcagttgtgtctttgtagatg

SEQ ID NO: 174917 - DNA, 23 bp, Mus musculus
tgtgagtatgtctgtgtgtgttc

SEQ ID NO: 174918 - DNA, 23 bp, Mus musculus
ctatctgctcactgtctctctgg

SEQ ID NO: 174919 - DNA, 23 bp, Mus musculus
ctgtctgtctgtctgtctgtcta

SEQ ID NO: 174920 - DNA, 23 bp, Mus musculus
gtgtacattgtggtgatctagtg

SEQ ID NO: 174921 - DNA, 23 bp, Mus musculus
ctgtcacactgtgtgcctttgag

SEQ ID NO: 174922 - DNA, 18 bp, Mus musculus
acaagtgcccaaagtaca

SEQ ID NO: 174923 - DNA, 23 bp, Mus musculus
gacgcatgaattgggatgctgct

SEQ ID NO: 174924 - DNA, 20 bp, Mus musculus
agagaagatggtagtaggaa

SEQ ID NO: 174925 - DNA, 22 bp, Mus musculus
ttggtaaatgaaaagggtttga

SEQ ID NO: 174926 - DNA, 18 bp, Mus musculus
gactggtctacatagtgg

SEQ ID NO: 174927 - DNA, 23 bp, Mus musculus
tctctcactctgtgtaattaccc

SEQ ID NO: 174928 - DNA, 23 bp, Mus musculus
caaaggatgtttgtatttttgta

SEQ ID NO: 174929 - DNA, 22 bp, Mus musculus
atatctgtctgccattgtgttg

SEQ ID NO: 174930 - DNA, 23 bp, Mus musculus
aggtgtcagaatattgtgagctg

SEQ ID NO: 174931 - DNA, 20 bp, Mus musculus
tctctactttcactgcccct

SEQ ID NO: 174932 - DNA, 23 bp, Mus musculus
ctgtcactgtcactgtgctcctg

SEQ ID NO: 174933 - DNA, 20 bp, Mus musculus
tcaagtgctctgtatggtga

SEQ ID NO: 174934 - DNA, 23 bp, Mus musculus
agtgcatatgtatgcatgcttca

SEQ ID NO: 174935 - DNA, 23 bp, Mus musculus
agtgcggaaaggttggtgtctct

SEQ ID NO: 174936 - DNA, 23 bp, Mus musculus
atttgtctaggctttcccactgt

SEQ ID NO: 174937 - DNA, 19 bp, Mus musculus
tgagtgacaggcatcgtag

SEQ ID NO: 174938 - DNA, 22 bp, Mus musculus
tgcaaagtttagaagtttgccc

SEQ ID NO: 174939 - DNA, 22 bp, Mus musculus
agctggagaagacggttcagtg

SEQ ID NO: 174940 - DNA, 22 bp, Mus musculus
actcacactgagtttatattgt

SEQ ID NO: 174941 - DNA, 23 bp, Mus musculus
tggtttgattgtgagtgtgtcct

SEQ ID NO: 174942 - DNA, 23 bp, Mus musculus
tactttgagtctggctcagttct

SEQ ID NO: 174943 - DNA, 22 bp, Mus musculus
tgtctggcaggaactcttgaat

SEQ ID NO: 174944 - DNA, 21 bp, Mus musculus
tctggatctacttgtcagttt

SEQ ID NO: 174945 - DNA, 23 bp, Mus musculus
tatagatactgacagtcatttca

SEQ ID NO: 174946 - DNA, 23 bp, Mus musculus
ctcaggtcacctgtaagagcagt

SEQ ID NO: 174947 - DNA, 23 bp, Mus musculus
gggagacattctggggtgcctct

SEQ ID NO: 174948 - DNA, 23 bp, Mus musculus
tctgtctgtctgtctgtctctgt

SEQ ID NO: 174949 - DNA, 22 bp, Mus musculus
actctatttgtttatttcatgt

SEQ ID NO: 174950 - DNA, 23 bp, Mus musculus
aaagaagtcacactggagaggta

SEQ ID NO: 174951 - DNA, 23 bp, Mus musculus
tgtgtatgggtattttatctgca

SEQ ID NO: 174952 - DNA, 23 bp, Mus musculus
tgaacttctctgtctctgtctca

SEQ ID NO: 174953 - DNA, 20 bp, Mus musculus
tggagctggagatggctcag

SEQ ID NO: 174954 - DNA, 23 bp, Mus musculus
tttgaggttctaggttcaattct

SEQ ID NO: 174955 - DNA, 21 bp, Mus musculus
gacagacagacagagagacag

SEQ ID NO: 174956 - DNA, 19 bp, Mus musculus
ttagctcctgccaaattat

SEQ ID NO: 174957 - DNA, 23 bp, Mus musculus
agatgtggaaaacataaggagag

SEQ ID NO: 174958 - DNA, 23 bp, Mus musculus
aaactgatgggatatgattctct

SEQ ID NO: 174959 - DNA, 19 bp, Mus musculus
tatctttatcctgcttgtt

SEQ ID NO: 174960 - DNA, 23 bp, Mus musculus
agctcagtcacttaagtgatcag

SEQ ID NO: 174961 - DNA, 20 bp, Mus musculus
attcagactcacactgcatg

SEQ ID NO: 174962 - DNA, 23 bp, Mus musculus
gagccactctgtccctctctccc

SEQ ID NO: 174963 - DNA, 23 bp, Mus musculus
ccttctgaagtcactttgttgta

SEQ ID NO: 174964 - DNA, 22 bp, Mus musculus
ttgtctctaccacatttaaggg

SEQ ID NO: 174965 - DNA, 21 bp, Mus musculus
caggtacttacagagtctctt

SEQ ID NO: 174966 - DNA, 21 bp, Mus musculus
taatacacagttgaaaaagtg

SEQ ID NO: 174967 - DNA, 19 bp, Mus musculus
ctctgtgaagagtgtcgtg

SEQ ID NO: 174968 - DNA, 20 bp, Mus musculus
gtctatactgtgtggcaagg

SEQ ID NO: 174969 - DNA, 22 bp, Mus musculus
ctaattttcttgttcatatact

SEQ ID NO: 174970 - DNA, 23 bp, Mus musculus
tctgagctcatgctgtctgtgta

SEQ ID NO: 174971 - DNA, 18 bp, Mus musculus
gaggaattgaaatgtgtg

SEQ ID NO: 174972 - DNA, 19 bp, Mus musculus
attgctttattatgcagga

SEQ ID NO: 174973 - DNA, 21 bp, Mus musculus
tgtcttgaattaggtttgttt

SEQ ID NO: 174974 - DNA, 21 bp, Mus musculus
taatgtggtgatccagcaaga

SEQ ID NO: 174975 - DNA, 23 bp, Mus musculus
tagatctctgtaatgcattgttg

SEQ ID NO: 174976 - DNA, 20 bp, Mus musculus
taatgaacagattttgtttt

SEQ ID NO: 174977 - DNA, 22 bp, Mus musculus
tgttttgtgaccaattatatgg

SEQ ID NO: 174978 - DNA, 18 bp, Mus musculus
cagaggtcctgagttcaa

SEQ ID NO: 174979 - DNA, 19 bp, Mus musculus
agcaggagagtctcttttg

SEQ ID NO: 174980 - DNA, 23 bp, Mus musculus
cctcacagtgactcacttcctcc

SEQ ID NO: 174981 - DNA, 23 bp, Mus musculus
gtgtgtgtgtgtgcacctgcatc

SEQ ID NO: 174982 - DNA, 19 bp, Mus musculus
tgtgtgtgcatatgcatgt

SEQ ID NO: 174983 - DNA, 23 bp, Mus musculus
acattctgtctgtctgtataagg

SEQ ID NO: 174984 - DNA, 23 bp, Mus musculus
tttctgttcacacttctctctgt

SEQ ID NO: 174985 - DNA, 19 bp, Mus musculus
acctattttaagtctaagt

SEQ ID NO: 174986 - DNA, 23 bp, Mus musculus
aatgtgtgtttgctgtctgtctc

SEQ ID NO: 174987 - DNA, 20 bp, Mus musculus
tgtatgtatgtatgtatgta

SEQ ID NO: 174988 - DNA, 23 bp, Mus musculus
actagcatatgtgtatatgttta

SEQ ID NO: 174989 - DNA, 23 bp, Mus musculus
atgtgtgcatctatatatgtatg

SEQ ID NO: 174990 - DNA, 20 bp, Mus musculus
tgacagttcagactgtgccc

SEQ ID NO: 174991 - DNA, 23 bp, Mus musculus
tctctgtgagtctctctcaccat

SEQ ID NO: 174992 - DNA, 23 bp, Mus musculus
tgtgtctgcctgtctacacttgc

SEQ ID NO: 174993 - DNA, 23 bp, Mus musculus
acagcaggcacagacaggcagtc

SEQ ID NO: 174994 - DNA, 22 bp, Mus musculus
tgttttgtgaccaattatatgg

SEQ ID NO: 174995 - DNA, 23 bp, Mus musculus
tctgtctgtctgtctgtgctctc

SEQ ID NO: 174996 - DNA, 23 bp, Mus musculus
tttcacttagcattacaatagat

SEQ ID NO: 174997 - DNA, 22 bp, Mus musculus
gtatatgtatatatgtatatgt

SEQ ID NO: 174998 - DNA, 23 bp, Mus musculus
acacatttgaatatgtgtatacg

SEQ ID NO: 174999 - DNA, 23 bp, Mus musculus
atatgtatatatgtgtgtgtgca

SEQ ID NO: 175000 - DNA, 19 bp, Mus musculus
tcagtcagtagccgactgt

SEQ ID NO: 175001 - DNA, 23 bp, Mus musculus
tcttcacatactcactcagtgac

SEQ ID NO: 175002 - DNA, 22 bp, Mus musculus
tgttttgtgaccaattatatgg

SEQ ID NO: 175003 - DNA, 22 bp, Mus musculus
actccagtgagcatttttgtct

SEQ ID NO: 175004 - DNA, 23 bp, Mus musculus
tatgtctcttactctgtctcctc

SEQ ID NO: 175005 - DNA, 22 bp, Mus musculus
tgttttgtgaccaattatatgg

SEQ ID NO: 175006 - DNA, 23 bp, Mus musculus
cttcactcactccctgtgactgt

SEQ ID NO: 175007 - DNA, 23 bp, Mus musculus
tctgcctctctgcctctgtctgt

SEQ ID NO: 175008 - DNA, 22 bp, Mus musculus
tgtttgggaggcagtgtggcct

SEQ ID NO: 175009 - DNA, 21 bp, Mus musculus
tactgcttttaatattcagtc

SEQ ID NO: 175010 - DNA, 23 bp, Mus musculus
tgtgtgaccctctgtgaggctga

SEQ ID NO: 175011 - DNA, 23 bp, Mus musculus
gtaacaggaccaggagcacattc

SEQ ID NO: 175012 - DNA, 23 bp, Mus musculus
atgtgtgtgtatatatagtgtat

SEQ ID NO: 175013 - DNA, 23 bp, Mus musculus
gtctgtgcatatgcatgtggaag

SEQ ID NO: 175014 - DNA, 23 bp, Mus musculus
tcatggtagttcctcagttaatt

SEQ ID NO: 175015 - DNA, 19 bp, Mus musculus
tataggaacacttacctaa

SEQ ID NO: 175016 - DNA, 23 bp, Mus musculus
atcactgtactctgaaaggacat

SEQ ID NO: 175017 - DNA, 22 bp, Mus musculus
aagtgagaagagtgtgtccaca

SEQ ID NO: 175018 - DNA, 22 bp, Mus musculus
ctggctggctctctgtttccct

SEQ ID NO: 175019 - DNA, 19 bp, Mus musculus
tatacacatatatgtgtac

SEQ ID NO: 175020 - DNA, 19 bp, Mus musculus
ctgtgtctgtctgtccggc

SEQ ID NO: 175021 - DNA, 20 bp, Mus musculus
tggaggatatatatacatat

SEQ ID NO: 175022 - DNA, 23 bp, Mus musculus
gatgtgtgtaatgcagatgtgtg

SEQ ID NO: 175023 - DNA, 23 bp, Mus musculus
tacagatgtgtgtgtgcagatgt

SEQ ID NO: 175024 - DNA, 21 bp, Mus musculus
tgtggtcatggtgtctgttta

SEQ ID NO: 175025 - DNA, 23 bp, Mus musculus
tgcatgtgtgtatatgcatgcat

SEQ ID NO: 175026 - DNA, 23 bp, Mus musculus
tatgtatgtatatatgtatatgt

SEQ ID NO: 175027 - DNA, 21 bp, Mus musculus
gtccttctaatagctactatt

SEQ ID NO: 175028 - DNA, 22 bp, Mus musculus
tttatacttattgtgttacata

SEQ ID NO: 175029 - DNA, 18 bp, Mus musculus
tctttgcatgtgtgcatg

SEQ ID NO: 175030 - DNA, 19 bp, Mus musculus
taagagcttttgcatttgc

SEQ ID NO: 175031 - DNA, 19 bp, Mus musculus
tgctgctttcagtctctgt

SEQ ID NO: 175032 - DNA, 23 bp, Mus musculus
ttagcatccttcacaggtttggt

SEQ ID NO: 175033 - DNA, 23 bp, Mus musculus
gtttgtctgtctgtctgtctgtc

SEQ ID NO: 175034 - DNA, 23 bp, Mus musculus
agtgtctgtcacactccctgtgc

SEQ ID NO: 175035 - DNA, 21 bp, Mus musculus
atgtcacttacagatttaaag

SEQ ID NO: 175036 - DNA, 23 bp, Mus musculus
tggtaaactagtgattttgttat

SEQ ID NO: 175037 - DNA, 22 bp, Mus musculus
tgttttgtgaccaattatatgg

SEQ ID NO: 175038 - DNA, 18 bp, Mus musculus
agcaggagcagtgaatct

SEQ ID NO: 175039 - DNA, 18 bp, Mus musculus
tgatcagtcaccctgttg

SEQ ID NO: 175040 - DNA, 23 bp, Mus musculus
tcttctgtctggctgattacaga

SEQ ID NO: 175041 - DNA, 23 bp, Mus musculus
atagaaatcatgagtgacaagtg

SEQ ID NO: 175042 - DNA, 23 bp, Mus musculus
agaaaacatcttgttgtggaaac

SEQ ID NO: 175043 - DNA, 19 bp, Mus musculus
acatcttcacttgcaaatg

SEQ ID NO: 175044 - DNA, 23 bp, Mus musculus
ttctgtctgtctgtctgtctgtc

SEQ ID NO: 175045 - DNA, 23 bp, Mus musculus
gtctgtctgtctgtctgtgtgag

SEQ ID NO: 175046 - DNA, 23 bp, Mus musculus
ggagctacagacagtggtaagct

SEQ ID NO: 175047 - DNA, 23 bp, Mus musculus
gtcatcatctaattgatttgtgt

SEQ ID NO: 175048 - DNA, 22 bp, Mus musculus
ttatttgtttgctttggcttgg

SEQ ID NO: 175049 - DNA, 23 bp, Mus musculus
tacaaagatgtagatgggttttc

SEQ ID NO: 175050 - DNA, 22 bp, Mus musculus
attttagtagggaaatcaaatg

SEQ ID NO: 175051 - DNA, 20 bp, Mus musculus
gaaagtagtattcttttgtt

SEQ ID NO: 175052 - DNA, 20 bp, Mus musculus
tggtatgtatacaagtatct

SEQ ID NO: 175053 - DNA, 23 bp, Mus musculus
tttctctctctggctctgttggc

SEQ ID NO: 175054 - DNA, 22 bp, Mus musculus
aggcaaacagtatgtatatatg

SEQ ID NO: 175055 - DNA, 23 bp, Mus musculus
atgtatgtgtgcatgtacatgtg

SEQ ID NO: 175056 - DNA, 21 bp, Mus musculus
atgtatatatatgtatatgta

SEQ ID NO: 175057 - DNA, 23 bp, Mus musculus
tcacagcaaaatagagtctgagg

SEQ ID NO: 175058 - DNA, 23 bp, Mus musculus
gtatgtgtatatgtatgtgtatg

SEQ ID NO: 175059 - DNA, 23 bp, Mus musculus
tatgtatatgtatacacacacat

SEQ ID NO: 175060 - DNA, 22 bp, Mus musculus
atagacatatgtatacacacac

SEQ ID NO: 175061 - DNA, 19 bp, Mus musculus
ttccctcatgtaggcatta

SEQ ID NO: 175062 - DNA, 22 bp, Mus musculus
tgttttgtgaccaattatatgg

SEQ ID NO: 175063 - DNA, 18 bp, Mus musculus
tggaagacgtatgtctct

SEQ ID NO: 175064 - DNA, 23 bp, Mus musculus
taagagcactgactgctcttcca

SEQ ID NO: 175065 - DNA, 23 bp, Mus musculus
agttctgagatgagactgtacac

SEQ ID NO: 175066 - DNA, 19 bp, Mus musculus
agtggttgtggtggttcat

SEQ ID NO: 175067 - DNA, 21 bp, Mus musculus
atactctgagataatggacag

SEQ ID NO: 175068 - DNA, 23 bp, Mus musculus
atgtgtgtgtgtgactgtgtgtg

SEQ ID NO: 175069 - DNA, 23 bp, Mus musculus
gctgtctctgactctgttgtggg

SEQ ID NO: 175070 - DNA, 18 bp, Mus musculus
gactgggggtccatctgg

SEQ ID NO: 175071 - DNA, 21 bp, Mus musculus
tggacagatgactctctgctc

SEQ ID NO: 175072 - DNA, 23 bp, Mus musculus
tgtgtgtgtgcatgtacatgtgc

SEQ ID NO: 175073 - DNA, 20 bp, Mus musculus
atgtgtgtgtgcatatgcat

SEQ ID NO: 175074 - DNA, 23 bp, Mus musculus
gtctctgtctgtgtgtgtgtgtg

SEQ ID NO: 175075 - DNA, 21 bp, Mus musculus
agccggagagaaggttcagtg

SEQ ID NO: 175076 - DNA, 21 bp, Mus musculus
ctgagtggaacaacagggtga

SEQ ID NO: 175077 - DNA, 23 bp, Mus musculus
tgtctgagcgtctgttgccaagt

SEQ ID NO: 175078 - DNA, 23 bp, Mus musculus
gctgtcctggaactcactctgta

SEQ ID NO: 175079 - DNA, 23 bp, Mus musculus
ttgacagacagagacaatcagct

SEQ ID NO: 175080 - DNA, 23 bp, Mus musculus
agacagaagaggctgtggtcagt

SEQ ID NO: 175081 - DNA, 21 bp, Mus musculus
tatgcctatatatgtataagt

SEQ ID NO: 175082 - DNA, 23 bp, Mus musculus
gttatgtatctatatgtatatat

SEQ ID NO: 175083 - DNA, 20 bp, Mus musculus
agcgagtgttcttacctgct

SEQ ID NO: 175084 - DNA, 20 bp, Mus musculus
agcaccaacagaattcagca

SEQ ID NO: 175085 - DNA, 23 bp, Mus musculus
cagtctgtctgtctgcctgtctg

SEQ ID NO: 175086 - DNA, 23 bp, Mus musculus
agagtcagtcctgactcagctca

SEQ ID NO: 175087 - DNA, 23 bp, Mus musculus
tctgtctgtctcagagtgtgggc

SEQ ID NO: 175088 - DNA, 20 bp, Mus musculus
agtgtggactaagtggagac

SEQ ID NO: 175089 - DNA, 18 bp, Mus musculus
ttgaagatagacagcaca

SEQ ID NO: 175090 - DNA, 23 bp, Mus musculus
agaagagtgttgttcagtttcca

SEQ ID NO: 175091 - DNA, 22 bp, Mus musculus
cttagtccatggtgatctgata

SEQ ID NO: 175092 - DNA, 18 bp, Mus musculus
tcatagatccgtgttgct

SEQ ID NO: 175093 - DNA, 22 bp, Mus musculus
tgttttgtgaccaattatatgg

SEQ ID NO: 175094 - DNA, 23 bp, Mus musculus
tgtctgtctgtctgtctgtctgt

SEQ ID NO: 175095 - DNA, 22 bp, Mus musculus
tgttttgtgaccaattatatgg

SEQ ID NO: 175096 - DNA, 22 bp, Mus musculus
tgttttgtgaccaattatatgg

SEQ ID NO: 175097 - DNA, 23 bp, Mus musculus
tctgcgtctcagtgtctgtgtgt

SEQ ID NO: 175098 - DNA, 22 bp, Mus musculus
cagtgtgtatttctgtctgctt

SEQ ID NO: 175099 - DNA, 23 bp, Mus musculus
atgtatatgtatatgtatatgta

SEQ ID NO: 175100 - DNA, 23 bp, Mus musculus
tggtagactagtgacattgctga

SEQ ID NO: 175101 - DNA, 18 bp, Mus musculus
catgaggggctggagaga

SEQ ID NO: 175102 - DNA, 22 bp, Mus musculus
tgttttgtgaccaattatatgg

SEQ ID NO: 175103 - DNA, 20 bp, Mus musculus
tatatgcatgtgtatatgta

SEQ ID NO: 175104 - DNA, 22 bp, Mus musculus
tgttttgtgaccaattatatgg

SEQ ID NO: 175105 - DNA, 19 bp, Mus musculus
tgcacatatatatctatgt

SEQ ID NO: 175106 - DNA, 22 bp, Mus musculus
tcagtgttcagtcttgctcttg

SEQ ID NO: 175107 - DNA, 23 bp, Mus musculus
ccagtgttcagacttcctgatca

SEQ ID NO: 175108 - DNA, 22 bp, Mus musculus
tgttttgtgaccaattatatgg

SEQ ID NO: 175109 - DNA, 21 bp, Mus musculus
atatgtgtctggcaataatgt

SEQ ID NO: 175110 - DNA, 23 bp, Mus musculus
gcttagaattcatggtgtagacc

SEQ ID NO: 175111 - DNA, 22 bp, Mus musculus
tctgtctgcctctgactcctga

SEQ ID NO: 175112 - DNA, 21 bp, Mus musculus
taagagcactgactgctcttc

SEQ ID NO: 175113 - DNA, 23 bp, Mus musculus
aaaacgtgttattagagcagaga

SEQ ID NO: 175114 - DNA, 23 bp, Mus musculus
tctgtctgtctgtctgtccctgt

SEQ ID NO: 175115 - DNA, 23 bp, Mus musculus
ctctctcaggccatggagacaga

SEQ ID NO: 175116 - DNA, 23 bp, Mus musculus
aagagcactgactcctcttccag

SEQ ID NO: 175117 - DNA, 18 bp, Mus musculus
agagggttgactctcaga

SEQ ID NO: 175118 - DNA, 21 bp, Mus musculus
taacctcatttgtgaggggca

SEQ ID NO: 175119 - DNA, 23 bp, Mus musculus
ctctgtctgtctgtctgtctgag

SEQ ID NO: 175120 - DNA, 23 bp, Mus musculus
ggggctgtctctgactctgttgc

SEQ ID NO: 175121 - DNA, 23 bp, Mus musculus
tcatatctggaaccttcagtctg

SEQ ID NO: 175122 - DNA, 23 bp, Mus musculus
tctcagagaagtgagtctgaaaa

SEQ ID NO: 175123 - DNA, 19 bp, Mus musculus
aagagcactgactgctctt

SEQ ID NO: 175124 - DNA, 23 bp, Mus musculus
tcattgactccctcacttcacag

SEQ ID NO: 175125 - DNA, 22 bp, Mus musculus
tgttgtgaattttataaaatgt

SEQ ID NO: 175126 - DNA, 23 bp, Mus musculus
atagaccaagaatttgtttctaa

SEQ ID NO: 175127 - DNA, 23 bp, Mus musculus
catgcctgtgtgcctgtgtgtca

SEQ ID NO: 175128 - DNA, 23 bp, Mus musculus
tgaccctcagactgtctgtgtgt

SEQ ID NO: 175129 - DNA, 23 bp, Mus musculus
tctagtctctctctctctgcctg

SEQ ID NO: 175130 - DNA, 23 bp, Mus musculus
tgtgtgtgtgtgtgtatgtactg

SEQ ID NO: 175131 - DNA, 23 bp, Mus musculus
gtgtgtctgtctgtctgtctgaa

SEQ ID NO: 175132 - DNA, 23 bp, Mus musculus
cagtctgtgtctgcctctcaagt

SEQ ID NO: 175133 - DNA, 22 bp, Mus musculus
tctgagaagagactctggactt

SEQ ID NO: 175134 - DNA, 23 bp, Mus musculus
caggacacactggattgatgctc

SEQ ID NO: 175135 - DNA, 23 bp, Mus musculus
tctgcctgcctgcctgcctctgc

SEQ ID NO: 175136 - DNA, 22 bp, Mus musculus
tgttttgtgaccaattatatgg

SEQ ID NO: 175137 - DNA, 22 bp, Mus musculus
tttctctcaggctgtctcttct

SEQ ID NO: 175138 - DNA, 23 bp, Mus musculus
cagtgacgctctgacactgcttt

SEQ ID NO: 175139 - DNA, 23 bp, Mus musculus
agaggtttggttcagagccacag

SEQ ID NO: 175140 - DNA, 20 bp, Mus musculus
tgtcattttgtagttctgtg

SEQ ID NO: 175141 - DNA, 22 bp, Mus musculus
tgccctctgagtgtctgtgtgt

SEQ ID NO: 175142 - DNA, 23 bp, Mus musculus
cacagcagctctctgccactgtg

SEQ ID NO: 175143 - DNA, 20 bp, Mus musculus
atttgtgtatgtatatatgt

SEQ ID NO: 175144 - DNA, 23 bp, Mus musculus
tatatgtatatatacatatgtgt

SEQ ID NO: 175145 - DNA, 20 bp, Mus musculus
ttatatgtacatatatatgt

SEQ ID NO: 175146 - DNA, 19 bp, Mus musculus
tgtatgtatgtatatatgt

SEQ ID NO: 175147 - DNA, 21 bp, Mus musculus
gtcactgtgtcagagagccaa

SEQ ID NO: 175148 - DNA, 22 bp, Mus musculus
aagcagtgtgagcatgtgtgtg

SEQ ID NO: 175149 - DNA, 22 bp, Mus musculus
tgtatctgtgtgtgtgtgtgtg

SEQ ID NO: 175150 - DNA, 22 bp, Mus musculus
agagtgctaggattacaagtgt

SEQ ID NO: 175151 - DNA, 20 bp, Mus musculus
tggctcagtggttaggagca

SEQ ID NO: 175152 - DNA, 22 bp, Mus musculus
tacactaagtgtggctgtactt

SEQ ID NO: 175153 - DNA, 23 bp, Mus musculus
tataagtgcatgtgcaagcggat

SEQ ID NO: 175154 - DNA, 23 bp, Mus musculus
tgactctgtgtgtgtgtgtgtgt

SEQ ID NO: 175155 - DNA, 23 bp, Mus musculus
ggacatcagatcatggtagcatg

SEQ ID NO: 175156 - DNA, 23 bp, Mus musculus
aacatttacatagctacttctaa

SEQ ID NO: 175157 - DNA, 20 bp, Mus musculus
acagctatatcaggctcctg

SEQ ID NO: 175158 - DNA, 18 bp, Mus musculus
ctgcctccctgtctccca

SEQ ID NO: 175159 - DNA, 23 bp, Mus musculus
gtctgtctgtctgtctgtctctc

SEQ ID NO: 175160 - DNA, 23 bp, Mus musculus
acacaggggattctagatctagg

SEQ ID NO: 175161 - DNA, 23 bp, Mus musculus
tttctctgtgggtgtttagggag

SEQ ID NO: 175162 - DNA, 22 bp, Mus musculus
tgtcatgcatgtgttaagcagt

SEQ ID NO: 175163 - DNA, 23 bp, Mus musculus
tctcagtgactcaagactctggg

SEQ ID NO: 175164 - DNA, 22 bp, Mus musculus
aaattgactggagagacggctc

SEQ ID NO: 175165 - DNA, 23 bp, Mus musculus
gaacactgactgctcttccagag

SEQ ID NO: 175166 - DNA, 23 bp, Mus musculus
tctggatggtttctgtctctaag

SEQ ID NO: 175167 - DNA, 23 bp, Mus musculus
ggtcacactcactgtgaatctcc

SEQ ID NO: 175168 - DNA, 21 bp, Mus musculus
ttcaaatctcagcaaccacat

SEQ ID NO: 175169 - DNA, 23 bp, Mus musculus
tacacattgtgtcattgtgtgtc

SEQ ID NO: 175170 - DNA, 22 bp, Mus musculus
atgtacacactgtgtcactgtg

SEQ ID NO: 175171 - DNA, 23 bp, Mus musculus
gggaacactctgtctctgtctcc

SEQ ID NO: 175172 - DNA, 23 bp, Mus musculus
caggatcacagagtacacccctg

SEQ ID NO: 175173 - DNA, 23 bp, Mus musculus
aatgccactgcaaggtttcactg

SEQ ID NO: 175174 - DNA, 23 bp, Mus musculus
agtgggagaaaaggctgtgaaca

SEQ ID NO: 175175 - DNA, 23 bp, Mus musculus
ctgcctgtctgtctgcctgcctg

SEQ ID NO: 175176 - DNA, 21 bp, Mus musculus
tgtatgtgcatgtggatatga

SEQ ID NO: 175177 - DNA, 23 bp, Mus musculus
tctaacacatgggatcatgttgt

SEQ ID NO: 175178 - DNA, 23 bp, Mus musculus
actatgctgttgtagctgacctg

SEQ ID NO: 175179 - DNA, 23 bp, Mus musculus
aggaaaatcattgtggttcagaa

SEQ ID NO: 175180 - DNA, 19 bp, Mus musculus
ggctcagtggttaggagca

SEQ ID NO: 175181 - DNA, 23 bp, Mus musculus
tctggcccacagttactcactct

SEQ ID NO: 175182 - DNA, 23 bp, Mus musculus
gtgtcactcactgggagtagctt

SEQ ID NO: 175183 - DNA, 23 bp, Mus musculus
cctgtgtcacactctgcctgagg

SEQ ID NO: 175184 - DNA, 23 bp, Mus musculus
gagcgtgtatcctggttgaccta

SEQ ID NO: 175185 - DNA, 23 bp, Mus musculus
aagtatctctctctctattctga

SEQ ID NO: 175186 - DNA, 23 bp, Mus musculus
aaagaggtagaagagactgtgga

SEQ ID NO: 175187 - DNA, 22 bp, Mus musculus
gctcagcctctgtcactgtgtc

SEQ ID NO: 175188 - DNA, 23 bp, Mus musculus
tgtccttgagttgtttgcaaatc

SEQ ID NO: 175189 - DNA, 21 bp, Mus musculus
tgactctttctctccctgaaa

SEQ ID NO: 175190 - DNA, 23 bp, Mus musculus
aggagcacagagaccacacaggg

SEQ ID NO: 175191 - DNA, 18 bp, Mus musculus
cagctagatctgactgaa

SEQ ID NO: 175192 - DNA, 23 bp, Mus musculus
tgtgtttgccacacaagtatgag

SEQ ID NO: 175193 - DNA, 23 bp, Mus musculus
atatgtatatgtgtatatgtgtg

SEQ ID NO: 175194 - DNA, 23 bp, Mus musculus
tatgtatatgcatatgtatatat

SEQ ID NO: 175195 - DNA, 23 bp, Mus musculus
ctgtgtgtgtgtatgcatatatg

SEQ ID NO: 175196 - DNA, 22 bp, Mus musculus
atgtgtatatatttatatgtgt

SEQ ID NO: 175197 - DNA, 22 bp, Mus musculus
actgacagagaaaccgaaccgg

SEQ ID NO: 175198 - DNA, 23 bp, Mus musculus
tactctctctggtatgtttttct

SEQ ID NO: 175199 - DNA, 23 bp, Mus musculus
cacatatatgtgtatttgtatat

SEQ ID NO: 175200 - DNA, 23 bp, Mus musculus
ttgtgtatgtccatgtgtatgca

SEQ ID NO: 175201 - DNA, 23 bp, Mus musculus
taaagtgcttagactgctgcagg

SEQ ID NO: 175202 - DNA, 18 bp, Mus musculus
caggggcagtcacacccc

SEQ ID NO: 175203 - DNA, 20 bp, Mus musculus
agagagagataaatgattga

SEQ ID NO: 175204 - DNA, 23 bp, Mus musculus
ctgtgactcacagtgaggcacag

SEQ ID NO: 175205 - DNA, 23 bp, Mus musculus
tggctctctgagccagacactgg

SEQ ID NO: 175206 - DNA, 21 bp, Mus musculus
cgtgaggttcagtctcctgtt

SEQ ID NO: 175207 - DNA, 23 bp, Mus musculus
aacagaagtcagatagcagaaga

SEQ ID NO: 175208 - DNA, 20 bp, Mus musculus
tctctgtatctgtctccatt

SEQ ID NO: 175209 - DNA, 23 bp, Mus musculus
actgagtaaagacagtgtggaag

SEQ ID NO: 175210 - DNA, 21 bp, Mus musculus
tggagcaggagttgcctgaca

SEQ ID NO: 175211 - DNA, 22 bp, Mus musculus
tgaaagaacagagtgtgctctt

SEQ ID NO: 175212 - DNA, 21 bp, Mus musculus
ttttcaaagacatcctttgtg

SEQ ID NO: 175213 - DNA, 23 bp, Mus musculus
gccagttgtcgctcgtgtgctgg

SEQ ID NO: 175214 - DNA, 23 bp, Mus musculus
gtaactgagtccattgccacact

SEQ ID NO: 175215 - DNA, 19 bp, Mus musculus
tggatggatggatcaatct

SEQ ID NO: 175216 - DNA, 20 bp, Mus musculus
taaagctgctaatctgggct

SEQ ID NO: 175217 - DNA, 23 bp, Mus musculus
gtctatctgtctgtgtgtcttct

SEQ ID NO: 175218 - DNA, 18 bp, Mus musculus
tggagaaatggtgcagtg

SEQ ID NO: 175219 - DNA, 23 bp, Mus musculus
tgccagtctctgtcagtgtcagc

SEQ ID NO: 175220 - DNA, 23 bp, Mus musculus
gtgtgtgtgtgtcatttgtgcat

SEQ ID NO: 175221 - DNA, 23 bp, Mus musculus
cacgcacacacacacacattatg

SEQ ID NO: 175222 - DNA, 22 bp, Mus musculus
acagtagttagaaagcagacac

SEQ ID NO: 175223 - DNA, 22 bp, Mus musculus
tgtaacagcaactccatgtgga

SEQ ID NO: 175224 - DNA, 22 bp, Mus musculus
gattccagtggagctgctgtta

SEQ ID NO: 175225 - DNA, 23 bp, Mus musculus
atctatgtgtgcatgtggaagtc

SEQ ID NO: 175226 - DNA, 21 bp, Mus musculus
ttgttctatctccatatatgt

SEQ ID NO: 175227 - DNA, 21 bp, Mus musculus
tatatgagtttttggaattga

SEQ ID NO: 175228 - DNA, 23 bp, Mus musculus
aagagcaaagttgtctggaacct

SEQ ID NO: 175229 - DNA, 23 bp, Mus musculus
gagaaaagacactctgcagagag

SEQ ID NO: 175230 - DNA, 22 bp, Mus musculus
taggcaagagagtcagctgagg

SEQ ID NO: 175231 - DNA, 20 bp, Mus musculus
atttgtgggtggctgaatac

SEQ ID NO: 175232 - DNA, 19 bp, Mus musculus
ttatatgatgtattcatat

SEQ ID NO: 175233 - DNA, 22 bp, Mus musculus
tctgcctctctctcatcctgtc

SEQ ID NO: 175234 - DNA, 19 bp, Mus musculus
tgcatgcatgcatgtatgt

SEQ ID NO: 175235 - DNA, 20 bp, Mus musculus
atgaatacatacatgtgtgt

SEQ ID NO: 175236 - DNA, 23 bp, Mus musculus
tgtctgtctgtctgcctgtgcac

SEQ ID NO: 175237 - DNA, 18 bp, Mus musculus
tgaggacgtacagaacac

SEQ ID NO: 175238 - DNA, 23 bp, Mus musculus
tgtctctgtctccctctgtcaac

SEQ ID NO: 175239 - DNA, 19 bp, Mus musculus
atgtatatgtatatatgtg

SEQ ID NO: 175240 - DNA, 23 bp, Mus musculus
gtatatatgtatgtatgtgcatg

SEQ ID NO: 175241 - DNA, 22 bp, Mus musculus
tctcagtaagtctcacttctag

SEQ ID NO: 175242 - DNA, 23 bp, Mus musculus
ttgcttccatttgaaatgtaaac

SEQ ID NO: 175243 - DNA, 23 bp, Mus musculus
tgagtggatgatctaagcaagga

SEQ ID NO: 175244 - DNA, 23 bp, Mus musculus
gctgtctgtcactctgtccgcat

SEQ ID NO: 175245 - DNA, 23 bp, Mus musculus
actgagtcggtgtgtgctggcta

SEQ ID NO: 175246 - DNA, 23 bp, Mus musculus
atttctgactctctgagtgcctg

SEQ ID NO: 175247 - DNA, 23 bp, Mus musculus
catgtgtatgtccatgtgcatgt

SEQ ID NO: 175248 - DNA, 22 bp, Mus musculus
atgcttgtatatgtatgtgtgt

SEQ ID NO: 175249 - DNA, 21 bp, Mus musculus
ttaagagcactcactgctctt

SEQ ID NO: 175250 - DNA, 19 bp, Mus musculus
tatgactgtagggggctgg

SEQ ID NO: 175251 - DNA, 23 bp, Mus musculus
tcctgcctactcagtgagactct

SEQ ID NO: 175252 - DNA, 23 bp, Mus musculus
gcctgtcactctgtctgtgtgca

SEQ ID NO: 175253 - DNA, 21 bp, Mus musculus
agttcacagctttagaagtag

SEQ ID NO: 175254 - DNA, 21 bp, Mus musculus
gtggcactagtagcaggtgtg

SEQ ID NO: 175255 - DNA, 23 bp, Mus musculus
agtgtgtcactgtgtgggtggct

SEQ ID NO: 175256 - DNA, 23 bp, Mus musculus
tgtctgtgtctctgcatgtgagt

SEQ ID NO: 175257 - DNA, 21 bp, Mus musculus
ttgtctgcagagagtgatctg

SEQ ID NO: 175258 - DNA, 22 bp, Mus musculus
tggcattagatagccaatgtat

SEQ ID NO: 175259 - DNA, 23 bp, Mus musculus
tatctctgtctgtctgtcggcct

SEQ ID NO: 175260 - DNA, 22 bp, Mus musculus
tatgtgtatatatatatgtgtg

SEQ ID NO: 175261 - DNA, 18 bp, Mus musculus
tgtgtatatatgtgtgtg

SEQ ID NO: 175262 - DNA, 23 bp, Mus musculus
ctcttggagcttttcaaatctga

SEQ ID NO: 175263 - DNA, 23 bp, Mus musculus
tcacactctgtctctgacctccc

SEQ ID NO: 175264 - DNA, 23 bp, Mus musculus
cacacacaacacacacagctgga

SEQ ID NO: 175265 - DNA, 20 bp, Mus musculus
atgtacatacatgtatacat

SEQ ID NO: 175266 - DNA, 21 bp, Mus musculus
atatacatacatatagatgtg

SEQ ID NO: 175267 - DNA, 22 bp, Mus musculus
tttcacagtgggtgatgttagt

SEQ ID NO: 175268 - DNA, 23 bp, Mus musculus
gtgactctgtgagtcagtggctg

SEQ ID NO: 175269 - DNA, 23 bp, Mus musculus
tatgagttcaggaaaagatatac

SEQ ID NO: 175270 - DNA, 22 bp, Mus musculus
ggaagaccatttgaatggctta

SEQ ID NO: 175271 - DNA, 18 bp, Mus musculus
agaggacctgagttctat

SEQ ID NO: 175272 - DNA, 20 bp, Mus musculus
tgtatgtatgtatctgtgtg

SEQ ID NO: 175273 - DNA, 23 bp, Mus musculus
ttctgtgtcactgtttaggctgt

SEQ ID NO: 175274 - DNA, 22 bp, Mus musculus
agtaaacactgaaatctcatct

SEQ ID NO: 175275 - DNA, 23 bp, Mus musculus
gtgcatgtgtgtacatgtgtatg

SEQ ID NO: 175276 - DNA, 23 bp, Mus musculus
acatgtgtgtgtgtgtaatagct

SEQ ID NO: 175277 - DNA, 23 bp, Mus musculus
tagagaaagaccttagctcctgt

SEQ ID NO: 175278 - DNA, 23 bp, Mus musculus
tgctgcttctctctgtctgtctg

SEQ ID NO: 175279 - DNA, 18 bp, Mus musculus
ttgcctgcgtgtatgttt

SEQ ID NO: 175280 - DNA, 21 bp, Mus musculus
gtcagccttggatgagctgtg

SEQ ID NO: 175281 - DNA, 22 bp, Mus musculus
tatgtgtatatgtatatatgtg

SEQ ID NO: 175282 - DNA, 21 bp, Mus musculus
ctctgactctcacactggggt

SEQ ID NO: 175283 - DNA, 23 bp, Mus musculus
acagccacaccgactgagcagtg

SEQ ID NO: 175284 - DNA, 22 bp, Mus musculus
tgcagagctttctggctgactc

SEQ ID NO: 175285 - DNA, 23 bp, Mus musculus
tctgagacagtctctccctctgc

SEQ ID NO: 175286 - DNA, 23 bp, Mus musculus
tgcatgagagaaatgtgtgtcaa

SEQ ID NO: 175287 - DNA, 22 bp, Mus musculus
tgagtccctgtgtccctccctc

SEQ ID NO: 175288 - DNA, 23 bp, Mus musculus
ctgtccgtccgtccgtctgtccg

SEQ ID NO: 175289 - DNA, 23 bp, Mus musculus
ggctcactgaattgtctactctc

SEQ ID NO: 175290 - DNA, 23 bp, Mus musculus
tgtctgcctgtctgcctgcctgc

SEQ ID NO: 175291 - DNA, 18 bp, Mus musculus
taggtacacactcacact

SEQ ID NO: 175292 - DNA, 23 bp, Mus musculus
ttgtctgtgtgtctgtctgtgga

SEQ ID NO: 175293 - DNA, 23 bp, Mus musculus
tctctgtgtgtgcatatgtcttt

SEQ ID NO: 175294 - DNA, 22 bp, Mus musculus
aatgtgcatatgtatgtgtaag

SEQ ID NO: 175295 - DNA, 23 bp, Mus musculus
gtctctctgtgtcacatactgga

SEQ ID NO: 175296 - DNA, 23 bp, Mus musculus
tgagtgtgtggatgtgcttgtga

SEQ ID NO: 175297 - DNA, 23 bp, Mus musculus
gtgcattcctgtgcatgagtgtg

SEQ ID NO: 175298 - DNA, 23 bp, Mus musculus
tgtatgtgcatgtacatgtacac

SEQ ID NO: 175299 - DNA, 22 bp, Mus musculus
agagacaggactgtgagaccag

SEQ ID NO: 175300 - DNA, 18 bp, Mus musculus
tagaaagtggactccaag

SEQ ID NO: 175301 - DNA, 23 bp, Mus musculus
gtctgtctgtgtcacacacactc

SEQ ID NO: 175302 - DNA, 23 bp, Mus musculus
catatatgtatatatgtattgta

SEQ ID NO: 175303 - DNA, 19 bp, Mus musculus
atatgtatatatatatatg

SEQ ID NO: 175304 - DNA, 23 bp, Mus musculus
acaagtcacttacaatgtgatta

SEQ ID NO: 175305 - DNA, 23 bp, Mus musculus
gagtctggttcatttttgagtca

SEQ ID NO: 175306 - DNA, 18 bp, Mus musculus
ctgttctggaacttttaa

SEQ ID NO: 175307 - DNA, 23 bp, Mus musculus
tcctacactgtgatgtgtgtgtg

SEQ ID NO: 175308 - DNA, 19 bp, Mus musculus
tacacatcctacactgtgc

SEQ ID NO: 175309 - DNA, 23 bp, Mus musculus
acttacacctgtctgtcactaac

SEQ ID NO: 175310 - DNA, 23 bp, Mus musculus
tatgtgtgtgtgtatatatatat

SEQ ID NO: 175311 - DNA, 23 bp, Mus musculus
catgtgtgggtgtgagagggaca

SEQ ID NO: 175312 - DNA, 23 bp, Mus musculus
tgtgtgtgtctgtatgtgtgtct

SEQ ID NO: 175313 - DNA, 23 bp, Mus musculus
acgtgtgtatgtgtgtatatgca

SEQ ID NO: 175314 - DNA, 19 bp, Mus musculus
tgtgtctgagtgtgatttc

SEQ ID NO: 175315 - DNA, 23 bp, Mus musculus
gtgcctggctccctgacaggact

SEQ ID NO: 175316 - DNA, 22 bp, Mus musculus
aagcagcagttcttgggctgca

SEQ ID NO: 175317 - DNA, 23 bp, Mus musculus
ttagagcactgactgctcttcca

SEQ ID NO: 175318 - DNA, 23 bp, Mus musculus
tgtgcctgcctcacactgtgcct

SEQ ID NO: 175319 - DNA, 23 bp, Mus musculus
ctgatgaaactcagaggctcact

SEQ ID NO: 175320 - DNA, 22 bp, Mus musculus
tggctctcagaatgggcttcct

SEQ ID NO: 175321 - DNA, 21 bp, Mus musculus
agtgagcagacactgtgcagt

SEQ ID NO: 175322 - DNA, 23 bp, Mus musculus
tgcatatctgtgtgtctgtgtga

SEQ ID NO: 175323 - DNA, 23 bp, Mus musculus
tgtctgtctgtctgtctgtgtgc

SEQ ID NO: 175324 - DNA, 19 bp, Mus musculus
cgtccatctgtctgtctgt

SEQ ID NO: 175325 - DNA, 23 bp, Mus musculus
tgtctgtctgtctgtcatctacc

SEQ ID NO: 175326 - DNA, 20 bp, Mus musculus
tgtcagatgagtgtgacctc

SEQ ID NO: 175327 - DNA, 21 bp, Mus musculus
tctgagggagtcactgagcct

SEQ ID NO: 175328 - DNA, 21 bp, Mus musculus
aaagcttctttcaatggcagt

SEQ ID NO: 175329 - DNA, 23 bp, Mus musculus
atgtgtgtgtgcatatgcatgtg

SEQ ID NO: 175330 - DNA, 23 bp, Mus musculus
ctgtctgtctgtctgtctgtctt

SEQ ID NO: 175331 - DNA, 23 bp, Mus musculus
aggtttacatgtgcatgtgttca

SEQ ID NO: 175332 - DNA, 22 bp, Mus musculus
tgtgttcatgcatgtgtgtgta

SEQ ID NO: 175333 - DNA, 18 bp, Mus musculus
tttatgtgtgttcattgc

SEQ ID NO: 175334 - DNA, 23 bp, Mus musculus
taaaactgagtaattgatgttga

SEQ ID NO: 175335 - DNA, 23 bp, Mus musculus
ccctgtgttcagacttgcttgag

SEQ ID NO: 175336 - DNA, 21 bp, Mus musculus
atgcatgtgtgcacatgtgtg

SEQ ID NO: 175337 - DNA, 23 bp, Mus musculus
tgtctcagtcagggtttctattg

SEQ ID NO: 175338 - DNA, 20 bp, Mus musculus
atgtatgcatgtatgtggat

SEQ ID NO: 175339 - DNA, 19 bp, Mus musculus
gcatgtgtgtgggtataca

SEQ ID NO: 175340 - DNA, 23 bp, Mus musculus
agacaccatgcagtttctgttgt

SEQ ID NO: 175341 - DNA, 23 bp, Mus musculus
ctgtctgcaagtcttgctcctgg

SEQ ID NO: 175342 - DNA, 22 bp, Mus musculus
aagactgacagatacctaaaag

SEQ ID NO: 175343 - DNA, 23 bp, Mus musculus
atgtctgtgtatgtgtatatgtg

SEQ ID NO: 175344 - DNA, 19 bp, Mus musculus
acatacatacacacacaca

SEQ ID NO: 175345 - DNA, 23 bp, Mus musculus
ggggctcactctgtccctctctt

SEQ ID NO: 175346 - DNA, 23 bp, Mus musculus
aatgctcacagagaaggcagagc

SEQ ID NO: 175347 - DNA, 23 bp, Mus musculus
tgagtctgttacactctctgtca

SEQ ID NO: 175348 - DNA, 21 bp, Mus musculus
aaatgcatgtgtatgcataca

SEQ ID NO: 175349 - DNA, 21 bp, Mus musculus
tgaaaatgctaagacaatctc

SEQ ID NO: 175350 - DNA, 23 bp, Mus musculus
ttgcttgttttgaagtggatgaa

SEQ ID NO: 175351 - DNA, 23 bp, Mus musculus
tactctcaggctgtcactccata

SEQ ID NO: 175352 - DNA, 23 bp, Mus musculus
ctctgccagtctctcagaggttg

SEQ ID NO: 175353 - DNA, 21 bp, Mus musculus
tggggactgcatgatgtcttg

SEQ ID NO: 175354 - DNA, 23 bp, Mus musculus
acaggcacacactgagtgttcac

SEQ ID NO: 175355 - DNA, 23 bp, Mus musculus
agagacaccaagaccaagacaac

SEQ ID NO: 175356 - DNA, 23 bp, Mus musculus
ccctgtctctctcactcactgac

SEQ ID NO: 175357 - DNA, 21 bp, Mus musculus
tactgtgtgtgtttacagact

SEQ ID NO: 175358 - DNA, 23 bp, Mus musculus
gcatatctgtatgtatatgtgtg

SEQ ID NO: 175359 - DNA, 22 bp, Mus musculus
tgtgcatgtttgtatgtatgta

SEQ ID NO: 175360 - DNA, 22 bp, Mus musculus
tatgtgtgcatatgtatatata

SEQ ID NO: 175361 - DNA, 20 bp, Mus musculus
ctgtccctcagtgtgtcaca

SEQ ID NO: 175362 - DNA, 23 bp, Mus musculus
tatgcatatatatactcattgca

SEQ ID NO: 175363 - DNA, 21 bp, Mus musculus
aaatgcacacaaaaacatctg

SEQ ID NO: 175364 - DNA, 19 bp, Mus musculus
atgcttggtgaacatgggt

SEQ ID NO: 175365 - DNA, 22 bp, Mus musculus
ttccaagtttgttaagtgaaga

SEQ ID NO: 175366 - DNA, 19 bp, Mus musculus
tttcacatggtggcttaga

SEQ ID NO: 175367 - DNA, 23 bp, Mus musculus
ctagcaccatttgaaatcagtgt

SEQ ID NO: 175368 - DNA, 23 bp, Mus musculus
ctagcaccatttgaaatcggtta

SEQ ID NO: 175369 - DNA, 22 bp, Mus musculus
tgttttgtgaccaattatatgg

SEQ ID NO: 175370 - DNA, 22 bp, Mus musculus
tgttttgtgaccaattatatgg

SEQ ID NO: 175371 - DNA, 23 bp, Mus musculus
tctgtctctgttactattttgtt

SEQ ID NO: 175372 - DNA, 23 bp, Mus musculus
tgagtgagtgttgtttttggaag

SEQ ID NO: 175373 - DNA, 23 bp, Mus musculus
atatatgtacatatatatagtgt

SEQ ID NO: 175374 - DNA, 23 bp, Mus musculus
aggcagagaggttacctgtttgt

SEQ ID NO: 175375 - DNA, 18 bp, Mus musculus
agagtgtttttccttgag

SEQ ID NO: 175376 - DNA, 23 bp, Mus musculus
tgtgagttgagtgacagcaggac

SEQ ID NO: 175377 - DNA, 22 bp, Mus musculus
tatgtatgtgtatatgtgagtg

SEQ ID NO: 175378 - DNA, 22 bp, Mus musculus
tgttttgtgaccaattatatgg

SEQ ID NO: 175379 - DNA, 19 bp, Mus musculus
tatggtcaattttggagaa

SEQ ID NO: 175380 - DNA, 22 bp, Mus musculus
aagtcctatttatgcaaagaca

SEQ ID NO: 175381 - DNA, 22 bp, Mus musculus
tgttttgtgaccaattatatgg

SEQ ID NO: 175382 - DNA, 23 bp, Mus musculus
tgtgtgtgcctgtgtgcctgtct

SEQ ID NO: 175383 - DNA, 20 bp, Mus musculus
tctgtgcctctgactgcctg

SEQ ID NO: 175384 - DNA, 23 bp, Mus musculus
ctgttcagagtgctgaagagtga

SEQ ID NO: 175385 - DNA, 23 bp, Mus musculus
agacatcactgagtcactggctg

SEQ ID NO: 175386 - DNA, 23 bp, Mus musculus
tgtctctcagtctctgtgttaga

SEQ ID NO: 175387 - DNA, 23 bp, Mus musculus
agtcactcagtgcttcccttttc

SEQ ID NO: 175388 - DNA, 23 bp, Mus musculus
actggctctgactctatccagct

SEQ ID NO: 175389 - DNA, 23 bp, Mus musculus
agattctggaagaagtctgtact

SEQ ID NO: 175390 - DNA, 23 bp, Mus musculus
taaggcacactcactgacacctt

SEQ ID NO: 175391 - DNA, 18 bp, Mus musculus
gggcagactctgtggctg

SEQ ID NO: 175392 - DNA, 23 bp, Mus musculus
cagagagacacacacacacatgt

SEQ ID NO: 175393 - DNA, 23 bp, Mus musculus
atggctgagttctgagttcctct

SEQ ID NO: 175394 - DNA, 22 bp, Mus musculus
tgccatggagtctgaaatcaca

SEQ ID NO: 175395 - DNA, 22 bp, Mus musculus
gatgaggttcagatggcacagt

SEQ ID NO: 175396 - DNA, 23 bp, Mus musculus
actgacactgtgtctgtcctctt

SEQ ID NO: 175397 - DNA, 23 bp, Mus musculus
tggtactttctgtgtgagtctgt

SEQ ID NO: 175398 - DNA, 23 bp, Mus musculus
aatagtacatgctttctgtcaaa

SEQ ID NO: 175399 - DNA, 23 bp, Mus musculus
aagtgtgtttgtatatgtgtgtc

SEQ ID NO: 175400 - DNA, 23 bp, Mus musculus
tttgatagtgcctttcttctcac

SEQ ID NO: 175401 - DNA, 23 bp, Mus musculus
tgagtctctctctgcctgcactc

SEQ ID NO: 175402 - DNA, 22 bp, Mus musculus
tctgtctgacacctatggatca

SEQ ID NO: 175403 - DNA, 22 bp, Mus musculus
aaaaggatgtgtgtggtttcct

SEQ ID NO: 175404 - DNA, 22 bp, Mus musculus
tatgtcactggctctaaaatga

SEQ ID NO: 175405 - DNA, 22 bp, Mus musculus
ctctctctctgtcacagggtgc

SEQ ID NO: 175406 - DNA, 22 bp, Mus musculus
tcacttgctgtctgcccatcct

SEQ ID NO: 175407 - DNA, 19 bp, Mus musculus
taagtgtacacacagagca

SEQ ID NO: 175408 - DNA, 22 bp, Mus musculus
cacacagagcacagtgtaggat

SEQ ID NO: 175409 - DNA, 23 bp, Mus musculus
taagtgcacacagagcacagtgt

SEQ ID NO: 175410 - DNA, 22 bp, Mus musculus
gtaagtactgacacagcacagt

SEQ ID NO: 175411 - DNA, 23 bp, Mus musculus
taagtgcacacacagagcactgt

SEQ ID NO: 175412 - DNA, 20 bp, Mus musculus
gtctgacagaaagcagtgat

SEQ ID NO: 175413 - DNA, 23 bp, Mus musculus
gtgtatttatatgtatgtgtata

SEQ ID NO: 175414 - DNA, 23 bp, Mus musculus
gagcctgtctctgtctctgcctt

SEQ ID NO: 175415 - DNA, 18 bp, Mus musculus
ttggatgagacagtgctc

SEQ ID NO: 175416 - DNA, 22 bp, Mus musculus
tcagagaggagacagagtgcag

SEQ ID NO: 175417 - DNA, 18 bp, Mus musculus
cgctctgtggctggctgt

SEQ ID NO: 175418 - DNA, 22 bp, Mus musculus
tgtatgtgcatctgtgtgtata

SEQ ID NO: 175419 - DNA, 23 bp, Mus musculus
ctgtatatgtgtctgcatgtgta

SEQ ID NO: 175420 - DNA, 23 bp, Mus musculus
gcccagtgtctctctctctccca

SEQ ID NO: 175421 - DNA, 23 bp, Mus musculus
gagatgacagagaggagagagct

SEQ ID NO: 175422 - DNA, 21 bp, Mus musculus
tgtgcatgctcactctatgtg

SEQ ID NO: 175423 - DNA, 23 bp, Mus musculus
tgtctctcactctctttccagtg

SEQ ID NO: 175424 - DNA, 23 bp, Mus musculus
tctcttactgactgcactgtggg

SEQ ID NO: 175425 - DNA, 19 bp, Mus musculus
agtccaagtcagtggggac

SEQ ID NO: 175426 - DNA, 23 bp, Mus musculus
gcgtctgtcagtgtctgtctggg

SEQ ID NO: 175427 - DNA, 23 bp, Mus musculus
agcatgtcatactgcagtgacac

SEQ ID NO: 175428 - DNA, 21 bp, Mus musculus
tgagctacgaaatccatgtct

SEQ ID NO: 175429 - DNA, 23 bp, Mus musculus
tgcatgtccatgtgtatgcatgt

SEQ ID NO: 175430 - DNA, 22 bp, Mus musculus
aagacacactatgtcttcctcc

SEQ ID NO: 175431 - DNA, 23 bp, Mus musculus
tctgactgattggttatgcagct

SEQ ID NO: 175432 - DNA, 23 bp, Mus musculus
gtgtgtgtgtgtgtgtctgcatg

SEQ ID NO: 175433 - DNA, 23 bp, Mus musculus
gtatgtgtgtgtgcatgtgcatg

SEQ ID NO: 175434 - DNA, 23 bp, Mus musculus
cagtctgactgactggcagcctt

SEQ ID NO: 175435 - DNA, 21 bp, Mus musculus
tgtgtctgtctgtcaattccc

SEQ ID NO: 175436 - DNA, 23 bp, Mus musculus
tgtattcatgtgtgtacatgtag

SEQ ID NO: 175437 - DNA, 23 bp, Mus musculus
cacactagcaagatactgtatcc

SEQ ID NO: 175438 - DNA, 20 bp, Mus musculus
tgtagcagcatctccaagtg

SEQ ID NO: 175439 - DNA, 20 bp, Mus musculus
gtcagtccatccaagttctt

SEQ ID NO: 175440 - DNA, 20 bp, Mus musculus
tgaggttgatgtctggtttc

SEQ ID NO: 175441 - DNA, 23 bp, Mus musculus
aatcactcactttctgactgtga

SEQ ID NO: 175442 - DNA, 20 bp, Mus musculus
tatgtggctgtatatgtata

SEQ ID NO: 175443 - DNA, 23 bp, Mus musculus
gtttctgcaattgtgctggtgtg

SEQ ID NO: 175444 - DNA, 23 bp, Mus musculus
atatgtgtctatatatatgtgtg

SEQ ID NO: 175445 - DNA, 20 bp, Mus musculus
tgcatgtgtgcatgcgaatg

SEQ ID NO: 175446 - DNA, 23 bp, Mus musculus
atgtatgtgtgcatgtgcttgtg

SEQ ID NO: 175447 - DNA, 22 bp, Mus musculus
ttatgcttttgatttcctctgt

SEQ ID NO: 175448 - DNA, 23 bp, Mus musculus
tatgtgtgcatgaatatgtatgt

SEQ ID NO: 175449 - DNA, 18 bp, Mus musculus
agcacacactgttaattg

SEQ ID NO: 175450 - DNA, 20 bp, Mus musculus
tgtctgaacactgtgtgctg

SEQ ID NO: 175451 - DNA, 23 bp, Mus musculus
tgtatttgtgcatgtgcatgtgc

SEQ ID NO: 175452 - DNA, 19 bp, Mus musculus
tgtattcatgcacatgtgt

SEQ ID NO: 175453 - DNA, 21 bp, Mus musculus
ctcttggtgatgtttccatgt

SEQ ID NO: 175454 - DNA, 23 bp, Mus musculus
aagctcagagtagtgacagagaa

SEQ ID NO: 175455 - DNA, 23 bp, Mus musculus
ctttttctctatgtctgtctgtc

SEQ ID NO: 175456 - DNA, 23 bp, Mus musculus
tctatatctgtctgtctgtctgt

SEQ ID NO: 175457 - DNA, 21 bp, Mus musculus
tacacacacagcatactatat

SEQ ID NO: 175458 - DNA, 22 bp, Mus musculus
atatatgtatatgtgtatgtgt

SEQ ID NO: 175459 - DNA, 23 bp, Mus musculus
tatagcactatgcactatgcatg

SEQ ID NO: 175460 - DNA, 23 bp, Mus musculus
tatgtgcatgcatgtatgtatgt

SEQ ID NO: 175461 - DNA, 22 bp, Mus musculus
tatgtatgtgtgcatgtgcttg

SEQ ID NO: 175462 - DNA, 21 bp, Mus musculus
tttgaacatttctttgggtgc

SEQ ID NO: 175463 - DNA, 22 bp, Mus musculus
gagtaagcaactttgattgaat

SEQ ID NO: 175464 - DNA, 22 bp, Mus musculus
aaaacacactggacagctggat

SEQ ID NO: 175465 - DNA, 23 bp, Mus musculus
tgcagctgtgtgagtgtgtgtgt

SEQ ID NO: 175466 - DNA, 23 bp, Mus musculus
aatgatatatattataggtaaca

SEQ ID NO: 175467 - DNA, 22 bp, Mus musculus
ctggctcactgtctccatctga

SEQ ID NO: 175468 - DNA, 22 bp, Mus musculus
tatatacacacacacatatatg

SEQ ID NO: 175469 - DNA, 20 bp, Mus musculus
tgtgtatatatgtatatatg

SEQ ID NO: 175470 - DNA, 23 bp, Mus musculus
agacagaacacagtggctaggat

SEQ ID NO: 175471 - DNA, 23 bp, Mus musculus
tagtgccatgtcggtctgtctgt

SEQ ID NO: 175472 - DNA, 22 bp, Mus musculus
tgtctgtgtatgtgtgtgtgta

SEQ ID NO: 175473 - DNA, 22 bp, Mus musculus
gtgcgtgcgtgtgtgcatgcgt

SEQ ID NO: 175474 - DNA, 23 bp, Mus musculus
atggagatttgttggtgttgtag

SEQ ID NO: 175475 - DNA, 20 bp, Mus musculus
tttgtatctgtattacatat

SEQ ID NO: 175476 - DNA, 22 bp, Mus musculus
aaagtctctcactctctgcaca

SEQ ID NO: 175477 - DNA, 18 bp, Mus musculus
acacagggagatgaaata

SEQ ID NO: 175478 - DNA, 22 bp, Mus musculus
actgagtcaccttctcatcagt

SEQ ID NO: 175479 - DNA, 23 bp, Mus musculus
actgagaacatggtggaaggtac

SEQ ID NO: 175480 - DNA, 22 bp, Mus musculus
tatcacaggaatcttctgtgtc

SEQ ID NO: 175481 - DNA, 23 bp, Mus musculus
gctgtttctgcttcttctgattc

SEQ ID NO: 175482 - DNA, 23 bp, Mus musculus
agagtcagccacagagtgtggag

SEQ ID NO: 175483 - DNA, 18 bp, Mus musculus
tctctagtgtcttagcgg

SEQ ID NO: 175484 - DNA, 23 bp, Mus musculus
agacagaagtcactcaggagtga

SEQ ID NO: 175485 - DNA, 19 bp, Mus musculus
tatgactgtagggggctgg

SEQ ID NO: 175486 - DNA, 23 bp, Mus musculus
agcaaaaatgactgaaacacttc

SEQ ID NO: 175487 - DNA, 23 bp, Mus musculus
gtagagagacagctgagagctga

SEQ ID NO: 175488 - DNA, 23 bp, Mus musculus
agacagatgagtgtctgtaatgg

SEQ ID NO: 175489 - DNA, 23 bp, Mus musculus
aacctgtccttgtacttgggact

SEQ ID NO: 175490 - DNA, 23 bp, Mus musculus
tgactctggcagaaatgactgag

SEQ ID NO: 175491 - DNA, 23 bp, Mus musculus
cagtgtagaatgctgattgctct

SEQ ID NO: 175492 - DNA, 23 bp, Mus musculus
tctcactgagtttgggattactg

SEQ ID NO: 175493 - DNA, 20 bp, Mus musculus
tggctcagtggttaggagca

SEQ ID NO: 175494 - DNA, 23 bp, Mus musculus
atatatgtatgcatgcatgtgta

SEQ ID NO: 175495 - DNA, 23 bp, Mus musculus
atgtgtgcatatttatatatgtg

SEQ ID NO: 175496 - DNA, 23 bp, Mus musculus
ttatatagatccatatctatgga

SEQ ID NO: 175497 - DNA, 23 bp, Mus musculus
tgtgtgcatgtgtatgtgcatgc

SEQ ID NO: 175498 - DNA, 23 bp, Mus musculus
tgtctgtctgtctgtctgtctgt

SEQ ID NO: 175499 - DNA, 22 bp, Mus musculus
agaccaggctgtctctgtctct

SEQ ID NO: 175500 - DNA, 19 bp, Mus musculus
tgacagtagttagagaact

SEQ ID NO: 175501 - DNA, 20 bp, Mus musculus
aaaggagtgtgaggtggcag

SEQ ID NO: 175502 - DNA, 21 bp, Mus musculus
cagtgtcattcactgtctgtt

SEQ ID NO: 175503 - DNA, 23 bp, Mus musculus
tgtatctgtgcatgtgcatgtgt

SEQ ID NO: 175504 - DNA, 23 bp, Mus musculus
atctgtctgtctgtctttcttat

SEQ ID NO: 175505 - DNA, 23 bp, Mus musculus
taaccctgtgggagtaagaacag

SEQ ID NO: 175506 - DNA, 23 bp, Mus musculus
acggtgcctctgagcctccctga

SEQ ID NO: 175507 - DNA, 23 bp, Mus musculus
gactcagtcattcattgtgtgtg

SEQ ID NO: 175508 - DNA, 23 bp, Mus musculus
acatacactcgaatgtctgctat

SEQ ID NO: 175509 - DNA, 23 bp, Mus musculus
tagtgcatggtgatctgatagga

SEQ ID NO: 175510 - DNA, 23 bp, Mus musculus
agactgaagactgcctggacttt

SEQ ID NO: 175511 - DNA, 22 bp, Mus musculus
aaacaggcagacaatttacagt

SEQ ID NO: 175512 - DNA, 22 bp, Mus musculus
tttgtgtgtctggtatggtaga

SEQ ID NO: 175513 - DNA, 23 bp, Mus musculus
ttctgtctggctcactcatgttc

SEQ ID NO: 175514 - DNA, 23 bp, Mus musculus
aaaacacacagacgaaagcagct

SEQ ID NO: 175515 - DNA, 21 bp, Mus musculus
ttgagctaaggttggtctctg

SEQ ID NO: 175516 - DNA, 23 bp, Mus musculus
ctctgcctgtctctgcctccttg

SEQ ID NO: 175517 - DNA, 20 bp, Mus musculus
agagatggcagagactgtgg

SEQ ID NO: 175518 - DNA, 23 bp, Mus musculus
atgtctctctcatttctagcagt

SEQ ID NO: 175519 - DNA, 23 bp, Mus musculus
taaagagttgatggagacatcct

SEQ ID NO: 175520 - DNA, 22 bp, Mus musculus
tctctctgtctctatgtaatgt

SEQ ID NO: 175521 - DNA, 19 bp, Mus musculus
ggagatgaagagctgtagg

SEQ ID NO: 175522 - DNA, 23 bp, Mus musculus
gggtcactctctgagtaacatga

SEQ ID NO: 175523 - DNA, 23 bp, Mus musculus
tttcacactgtgtcactgtctgt

SEQ ID NO: 175524 - DNA, 23 bp, Mus musculus
tctgtctgtttgtctatctgtct

SEQ ID NO: 175525 - DNA, 22 bp, Mus musculus
atgagtacacagatatgtgcag

SEQ ID NO: 175526 - DNA, 23 bp, Mus musculus
tatgtgtgtatatgtatatgtat

SEQ ID NO: 175527 - DNA, 22 bp, Mus musculus
tgtgtgtgtgtttatgtgcata

SEQ ID NO: 175528 - DNA, 21 bp, Mus musculus
tgtatacacacattcacatat

SEQ ID NO: 175529 - DNA, 23 bp, Mus musculus
ctctgtctcactctccttgtctg

SEQ ID NO: 175530 - DNA, 18 bp, Mus musculus
tgccacatgactgtgaag

SEQ ID NO: 175531 - DNA, 23 bp, Mus musculus
tgacttcaaggaggagaaaaaga

SEQ ID NO: 175532 - DNA, 23 bp, Mus musculus
tctgtgtgtgtgagtggcagcga

SEQ ID NO: 175533 - DNA, 23 bp, Mus musculus
tgtcagcatgtatgtatgtatgt

SEQ ID NO: 175534 - DNA, 22 bp, Mus musculus
gtatgccatgtatgtgcagtga

SEQ ID NO: 175535 - DNA, 22 bp, Mus musculus
actctgcctgtctctctcctgc

SEQ ID NO: 175536 - DNA, 23 bp, Mus musculus
tgatacagcatttgaaaaggaag

SEQ ID NO: 175537 - DNA, 23 bp, Mus musculus
agtctcaaacactcagtgtgaag

SEQ ID NO: 175538 - DNA, 19 bp, Mus musculus
tgtgctcagtctgatggtt

SEQ ID NO: 175539 - DNA, 23 bp, Mus musculus
ctcaagctactcccagtgagtga

SEQ ID NO: 175540 - DNA, 23 bp, Mus musculus
tgtctgtctgtctctgtctgggc

SEQ ID NO: 175541 - DNA, 19 bp, Mus musculus
ttagctttagtacagtttt

SEQ ID NO: 175542 - DNA, 23 bp, Mus musculus
cagagtctgtctgtctgtcttct

SEQ ID NO: 175543 - DNA, 20 bp, Mus musculus
tccacaagtgttttagatgt

SEQ ID NO: 175544 - DNA, 23 bp, Mus musculus
tctctctggctcagtctcagaag

SEQ ID NO: 175545 - DNA, 22 bp, Mus musculus
tgtgtctgtgcatgtgcatgtg

SEQ ID NO: 175546 - DNA, 22 bp, Mus musculus
atttgtgggtgtgtgtctagac

SEQ ID NO: 175547 - DNA, 18 bp, Mus musculus
ttgaggtttcccaggata

SEQ ID NO: 175548 - DNA, 23 bp, Mus musculus
acagtgacacagtgtgtacatgg

SEQ ID NO: 175549 - DNA, 22 bp, Mus musculus
ttaactgctgaaccatctccta

SEQ ID NO: 175550 - DNA, 21 bp, Mus musculus
tggctcagtgggtaagagcac

SEQ ID NO: 175551 - DNA, 22 bp, Mus musculus
tgcatgtatgcatgcatgtatg

SEQ ID NO: 175552 - DNA, 23 bp, Mus musculus
tctgcctctctcggcctgacatt

SEQ ID NO: 175553 - DNA, 23 bp, Mus musculus
tttactctgtgtatgatgcgtgt

SEQ ID NO: 175554 - DNA, 22 bp, Mus musculus
gtctgtatatctgtctgtctgt

SEQ ID NO: 175555 - DNA, 23 bp, Mus musculus
tgtgagcctgagtctgtggctct

SEQ ID NO: 175556 - DNA, 19 bp, Mus musculus
cacacagctcaggcaccag

SEQ ID NO: 175557 - DNA, 20 bp, Mus musculus
agttcaaatctcagcaacca

SEQ ID NO: 175558 - DNA, 23 bp, Mus musculus
acacgctttctgtctctagtgcc

SEQ ID NO: 175559 - DNA, 21 bp, Mus musculus
atgtatgtgtacatgtgcatg

SEQ ID NO: 175560 - DNA, 23 bp, Mus musculus
gacagacagacagacagacaggg

SEQ ID NO: 175561 - DNA, 19 bp, Mus musculus
tctgatgcattgtgtctgt

SEQ ID NO: 175562 - DNA, 23 bp, Mus musculus
ctgcctctgtctctgattgcctc

SEQ ID NO: 175563 - DNA, 23 bp, Mus musculus
agttctagcagtcccagggatga

SEQ ID NO: 175564 - DNA, 23 bp, Mus musculus
tctcagtggagactgagcactgg

SEQ ID NO: 175565 - DNA, 23 bp, Mus musculus
actcagaagagtctgagctgaag

SEQ ID NO: 175566 - DNA, 23 bp, Mus musculus
agccaagctctgtctctgtctct

SEQ ID NO: 175567 - DNA, 23 bp, Mus musculus
tatatgtacattatgtatacatg

SEQ ID NO: 175568 - DNA, 23 bp, Mus musculus
caggctgtgactgagtggctctt

SEQ ID NO: 175569 - DNA, 19 bp, Mus musculus
ctgagttatcctgctcacc

SEQ ID NO: 175570 - DNA, 22 bp, Mus musculus
tgaggatgttggaagttggact

SEQ ID NO: 175571 - DNA, 21 bp, Mus musculus
agagggtgccactgagcatgg

SEQ ID NO: 175572 - DNA, 23 bp, Mus musculus
tctcacactgacagcaaacgccc

SEQ ID NO: 175573 - DNA, 23 bp, Mus musculus
cctgagtgtcagttcagtctctg

SEQ ID NO: 175574 - DNA, 22 bp, Mus musculus
ctctctcccccatgtctctctc

SEQ ID NO: 175575 - DNA, 23 bp, Mus musculus
acactgtctgtctgtctatctgc

SEQ ID NO: 175576 - DNA, 18 bp, Mus musculus
tcagaggacagtttgcag

SEQ ID NO: 175577 - DNA, 23 bp, Mus musculus
attgtgtctcactgagtctcagg

SEQ ID NO: 175578 - DNA, 20 bp, Mus musculus
tcactggctataatgtgtgt

SEQ ID NO: 175579 - DNA, 22 bp, Mus musculus
ctgtctgtctgtctgtctgtct

SEQ ID NO: 175580 - DNA, 21 bp, Mus musculus
tgtgacagtctctcactggcc

SEQ ID NO: 175581 - DNA, 23 bp, Mus musculus
aggctgacagactgaactctcag

SEQ ID NO: 175582 - DNA, 23 bp, Mus musculus
agcgctgactctgtcagtccctc

SEQ ID NO: 175583 - DNA, 19 bp, Mus musculus
ctctgtcatcagctgggag

SEQ ID NO: 175584 - DNA, 23 bp, Mus musculus
tcacagtttcagtgagtctgtgg

SEQ ID NO: 175585 - DNA, 23 bp, Mus musculus
tgtgtgcctgtgtgtgtcagtgt

SEQ ID NO: 175586 - DNA, 18 bp, Mus musculus
tgctctgacagaaagcag

SEQ ID NO: 175587 - DNA, 23 bp, Mus musculus
gtatgtatgtatgtgtgtatgta

SEQ ID NO: 175588 - DNA, 23 bp, Mus musculus
acagagcatgtcagtacttgcct

SEQ ID NO: 175589 - DNA, 23 bp, Mus musculus
agaggcagacacagactgtctgt

SEQ ID NO: 175590 - DNA, 23 bp, Mus musculus
gaacactgactgctcttccagag

SEQ ID NO: 175591 - DNA, 23 bp, Mus musculus
gctctgactgtctctgtcatgtc

SEQ ID NO: 175592 - DNA, 23 bp, Mus musculus
atgtgaaagtgcatgtgcaggtg

SEQ ID NO: 175593 - DNA, 19 bp, Mus musculus
tcctgcacacactcagtgg

SEQ ID NO: 175594 - DNA, 23 bp, Mus musculus
tctatctatctttgtgtgtgtgt

SEQ ID NO: 175595 - DNA, 23 bp, Mus musculus
agttatgagaggattgggttact

SEQ ID NO: 175596 - DNA, 23 bp, Mus musculus
agttttgtctagtagtgtttgtt

SEQ ID NO: 175597 - DNA, 23 bp, Mus musculus
atatgtatgtatgtatatgtgta

SEQ ID NO: 175598 - DNA, 21 bp, Mus musculus
atatgtgtacatgtgtttata

SEQ ID NO: 175599 - DNA, 23 bp, Mus musculus
tctgtctgtctgtctgcctgtct

SEQ ID NO: 175600 - DNA, 23 bp, Mus musculus
agaaataggcagtggttttagac

SEQ ID NO: 175601 - DNA, 23 bp, Mus musculus
agagtaaagtgcatgcgctttgg

SEQ ID NO: 175602 - DNA, 23 bp, Mus musculus
tcacaaagcccatacactttcac

SEQ ID NO: 175603 - DNA, 23 bp, Mus musculus
tgactctgtgtgtgcatgtgtgt

SEQ ID NO: 175604 - DNA, 19 bp, Mus musculus
aagagcactgactgctctt

SEQ ID NO: 175605 - DNA, 23 bp, Mus musculus
tctgtctcagtctgttttcacca

SEQ ID NO: 175606 - DNA, 23 bp, Mus musculus
ctgagccatctctctgtctctca

SEQ ID NO: 175607 - DNA, 23 bp, Mus musculus
agtgtgtgtgtttgtgtatatcc

SEQ ID NO: 175608 - DNA, 22 bp, Mus musculus
tgttttgtgaccaattatatgg

SEQ ID NO: 175609 - DNA, 23 bp, Mus musculus
cctgcctgtatgataactctcta

SEQ ID NO: 175610 - DNA, 23 bp, Mus musculus
tgtgtctctgtcactcttgttac

SEQ ID NO: 175611 - DNA, 22 bp, Mus musculus
tgacaaagacttcaggctccag

SEQ ID NO: 175612 - DNA, 19 bp, Mus musculus
tctctctgtttttctctct

SEQ ID NO: 175613 - DNA, 23 bp, Mus musculus
gaggtgagagaagacagcctgat

SEQ ID NO: 175614 - DNA, 20 bp, Mus musculus
gagttcaattcccagcaatc

SEQ ID NO: 175615 - DNA, 23 bp, Mus musculus
tccattactagtgattttcatat

SEQ ID NO: 175616 - DNA, 23 bp, Mus musculus
cataggatgtctcagagctggca

SEQ ID NO: 175617 - DNA, 23 bp, Mus musculus
tgtgagctgtcttgtgtggctgc

SEQ ID NO: 175618 - DNA, 18 bp, Mus musculus
ggacttaagtttagctcc

SEQ ID NO: 175619 - DNA, 23 bp, Mus musculus
aaacgtgaaggaactcaaaggct

SEQ ID NO: 175620 - DNA, 23 bp, Mus musculus
agtctctgtcagtgttttatccc

SEQ ID NO: 175621 - DNA, 21 bp, Mus musculus
caaagagagcaacacagtggg

SEQ ID NO: 175622 - DNA, 23 bp, Mus musculus
atagataagtattcatatacaca

SEQ ID NO: 175623 - DNA, 20 bp, Mus musculus
agacagttgtaagtcaccac

SEQ ID NO: 175624 - DNA, 22 bp, Mus musculus
gtgtacatgcatatctctggtt

SEQ ID NO: 175625 - DNA, 18 bp, Mus musculus
ttttgtatctgttgagtc

SEQ ID NO: 175626 - DNA, 23 bp, Mus musculus
tatgtgtatgtatatgtatacgt

SEQ ID NO: 175627 - DNA, 23 bp, Mus musculus
tgtatatgtatatgtatatgtat

SEQ ID NO: 175628 - DNA, 22 bp, Mus musculus
aatcacagaagtgtctgtgcag

SEQ ID NO: 175629 - DNA, 22 bp, Mus musculus
tgttttgtgaccaattatatgg

SEQ ID NO: 175630 - DNA, 20 bp, Mus musculus
tcctgaagtctttaagttgt

SEQ ID NO: 175631 - DNA, 23 bp, Mus musculus
cagtgtgtatttctgtctgcttt

SEQ ID NO: 175632 - DNA, 22 bp, Mus musculus
tgttttgtgaccaattatatgg

SEQ ID NO: 175633 - DNA, 23 bp, Mus musculus
atttcagcagagccaccacactg

SEQ ID NO: 175634 - DNA, 23 bp, Mus musculus
tgtctccctcacaggctgctggt

SEQ ID NO: 175635 - DNA, 21 bp, Mus musculus
tagatgcttgtgaaggggcta

SEQ ID NO: 175636 - DNA, 23 bp, Mus musculus
agagcatgagattgcttagtgag

SEQ ID NO: 175637 - DNA, 21 bp, Mus musculus
tgacagtacagactatggtca

SEQ ID NO: 175638 - DNA, 23 bp, Mus musculus
agagagacattagtgagaccttc

SEQ ID NO: 175639 - DNA, 18 bp, Mus musculus
atagtggtctgataggat

SEQ ID NO: 175640 - DNA, 22 bp, Mus musculus
tgttttgtgaccaattatatgg

SEQ ID NO: 175641 - DNA, 22 bp, Mus musculus
tgttttgtgaccaattatatgg

SEQ ID NO: 175642 - DNA, 22 bp, Mus musculus
tgttttgtgaccaattatatgg

SEQ ID NO: 175643 - DNA, 22 bp, Mus musculus
tgttttgtgaccaattatatgg

SEQ ID NO: 175644 - DNA, 22 bp, Mus musculus
tatgtgtatgtgtatatgtgtg

SEQ ID NO: 175645 - DNA, 23 bp, Mus musculus
gtaagtgatactgttttgtattt

SEQ ID NO: 175646 - DNA, 22 bp, Mus musculus
agtctgtctcactcaggggctg

SEQ ID NO: 175647 - DNA, 23 bp, Mus musculus
tgagagaactgtgtgtgtttagc

SEQ ID NO: 175648 - DNA, 20 bp, Mus musculus
agacttgcaccagttagcca

SEQ ID NO: 175649 - DNA, 22 bp, Mus musculus
tgttttgtgaccaattatatgg

SEQ ID NO: 175650 - DNA, 19 bp, Mus musculus
aaagcactgactgctcttc

SEQ ID NO: 175651 - DNA, 19 bp, Mus musculus
ctgtgcctgtctggctcgc

SEQ ID NO: 175652 - DNA, 21 bp, Mus musculus
aagaatgttgcctgaggctgt

SEQ ID NO: 175653 - DNA, 22 bp, Mus musculus
ttgacttagaaggtttcatagt

SEQ ID NO: 175654 - DNA, 22 bp, Mus musculus
actgctgcttggatttgagtct

SEQ ID NO: 175655 - DNA, 23 bp, Mus musculus
ggtctcactgtgtgtctcttgtg

SEQ ID NO: 175656 - DNA, 23 bp, Mus musculus
tcgagtctcttctggttgccttt

SEQ ID NO: 175657 - DNA, 23 bp, Mus musculus
aagatcactgactgctcttccag

SEQ ID NO: 175658 - DNA, 19 bp, Mus musculus
cactcactcactgtgtctt

SEQ ID NO: 175659 - DNA, 23 bp, Mus musculus
tctctcaggttctcatttcatat

SEQ ID NO: 175660 - DNA, 20 bp, Mus musculus
atgtgtgtgtgtgtgtgtgt

SEQ ID NO: 175661 - DNA, 22 bp, Mus musculus
aatgtctgaggcattcttggga

SEQ ID NO: 175662 - DNA, 18 bp, Mus musculus
aatgactggaagctatga

SEQ ID NO: 175663 - DNA, 22 bp, Mus musculus
tcaatggggtttgttttggaaa

SEQ ID NO: 175664 - DNA, 23 bp, Mus musculus
atatgtatgcatatgtatacata

SEQ ID NO: 175665 - DNA, 22 bp, Mus musculus
tatatgtacatatacatagttt

SEQ ID NO: 175666 - DNA, 22 bp, Mus musculus
tcagagaaaagtcagagcccag

SEQ ID NO: 175667 - DNA, 20 bp, Mus musculus
tctcacccagtgagccttcc

SEQ ID NO: 175668 - DNA, 21 bp, Mus musculus
tattgcttaatgatgcatagt

SEQ ID NO: 175669 - DNA, 23 bp, Mus musculus
tctgtgtgaatctgtgtgtggga

SEQ ID NO: 175670 - DNA, 23 bp, Mus musculus
tttctagtgcttttgttctggtg

SEQ ID NO: 175671 - DNA, 23 bp, Mus musculus
caaattctccaggcaattcttag

SEQ ID NO: 175672 - DNA, 22 bp, Mus musculus
tgttttgtgaccaattatatgg

SEQ ID NO: 175673 - DNA, 22 bp, Mus musculus
tgttttgtgaccaattatatgg

SEQ ID NO: 175674 - DNA, 23 bp, Mus musculus
atgtagcatcttttcttttcact

SEQ ID NO: 175675 - DNA, 23 bp, Mus musculus
tagcttgtagttaacaaattgac

SEQ ID NO: 175676 - DNA, 23 bp, Mus musculus
ggtcacagttcagtttgtggact

SEQ ID NO: 175677 - DNA, 22 bp, Mus musculus
agagttattgtttatgtgtgct

SEQ ID NO: 175678 - DNA, 18 bp, Mus musculus
tagaacctggacacagtg

SEQ ID NO: 175679 - DNA, 23 bp, Mus musculus
tgtgtatgcatgtgtgtgtgtgt

SEQ ID NO: 175680 - DNA, 21 bp, Mus musculus
atgtatgtgagcatgtgtaat

SEQ ID NO: 175681 - DNA, 23 bp, Mus musculus
tgtttgtgtgtgtatgtagtatg

SEQ ID NO: 175682 - DNA, 22 bp, Mus musculus
tgtctgcatttatttgagattg

SEQ ID NO: 175683 - DNA, 22 bp, Mus musculus
tcaaactctcaggcattgaagg

SEQ ID NO: 175684 - DNA, 21 bp, Mus musculus
tttcccactgtctctccatct

SEQ ID NO: 175685 - DNA, 23 bp, Mus musculus
acagtatctctgtctctattatc

SEQ ID NO: 175686 - DNA, 21 bp, Mus musculus
tatgcactatgtatatatgtg

SEQ ID NO: 175687 - DNA, 23 bp, Mus musculus
tctcactcactcaattatgtgct

SEQ ID NO: 175688 - DNA, 23 bp, Mus musculus
acatgtgcatatgtaaacctgtc

SEQ ID NO: 175689 - DNA, 23 bp, Mus musculus
tgtatgtatgcatgtgtgtatgt

SEQ ID NO: 175690 - DNA, 18 bp, Mus musculus
agagcactctgggagctc

SEQ ID NO: 175691 - DNA, 21 bp, Mus musculus
ctctggctctctgaccctctc

SEQ ID NO: 175692 - DNA, 21 bp, Mus musculus
aactgcattatcaccggagtc

SEQ ID NO: 175693 - DNA, 23 bp, Mus musculus
tgtgagactcactgtgtcaatgc

SEQ ID NO: 175694 - DNA, 23 bp, Mus musculus
cacatgtgtgtgtgtttgatctt

SEQ ID NO: 175695 - DNA, 18 bp, Mus musculus
tccaatctaaagatgaga

SEQ ID NO: 175696 - DNA, 21 bp, Mus musculus
tatttcagtcttcataggtac

SEQ ID NO: 175697 - DNA, 23 bp, Mus musculus
atctttgtgtgcatgtgcatgtg

SEQ ID NO: 175698 - DNA, 23 bp, Mus musculus
acggagacaactattttagttgt

SEQ ID NO: 175699 - DNA, 22 bp, Mus musculus
tctcccactctctgtgagtccc

SEQ ID NO: 175700 - DNA, 21 bp, Mus musculus
gtctagtctctctctcagtgc

SEQ ID NO: 175701 - DNA, 19 bp, Mus musculus
tgccaggctccgtgaaagc

SEQ ID NO: 175702 - DNA, 23 bp, Mus musculus
tctttctcagtctttgaatgtct

SEQ ID NO: 175703 - DNA, 23 bp, Mus musculus
tgtctctcggtgtcaaggagcca

SEQ ID NO: 175704 - DNA, 23 bp, Mus musculus
agaggatgtctttggttttctag

SEQ ID NO: 175705 - DNA, 19 bp, Mus musculus
tatgtatatgtatacatat

SEQ ID NO: 175706 - DNA, 23 bp, Mus musculus
ttacactgagattataagctgtg

SEQ ID NO: 175707 - DNA, 22 bp, Mus musculus
tacatagtttttgttaaagggc

SEQ ID NO: 175708 - DNA, 22 bp, Mus musculus
tgttttgtgaccaattatatgg

SEQ ID NO: 175709 - DNA, 23 bp, Mus musculus
atatacatatgtgtgtgtgtgta

SEQ ID NO: 175710 - DNA, 20 bp, Mus musculus
tggtggtctgataggattca

SEQ ID NO: 175711 - DNA, 22 bp, Mus musculus
tgttttgtgaccaattatatgg

SEQ ID NO: 175712 - DNA, 20 bp, Mus musculus
tggtggtctgataggattca

SEQ ID NO: 175713 - DNA, 22 bp, Mus musculus
tgttttgtgaccaattatatgg

SEQ ID NO: 175714 - DNA, 23 bp, Mus musculus
aagatgcagtcccagtctctact

SEQ ID NO: 175715 - DNA, 23 bp, Mus musculus
ctgtgtatgtctgtctgtgtatt

SEQ ID NO: 175716 - DNA, 22 bp, Mus musculus
tgtaaagtatacatgatactag

SEQ ID NO: 175717 - DNA, 23 bp, Mus musculus
tatgtgtatgcatacatatgtgt

SEQ ID NO: 175718 - DNA, 23 bp, Mus musculus
gtgaatgatagtagtgtgtgacg

SEQ ID NO: 175719 - DNA, 23 bp, Mus musculus
tgcattgacacatcttcaacact

SEQ ID NO: 175720 - DNA, 23 bp, Mus musculus
gtctgtctgtctgtctgttgtct

SEQ ID NO: 175721 - DNA, 18 bp, Mus musculus
actccaactctaaccatc

SEQ ID NO: 175722 - DNA, 23 bp, Mus musculus
gtgtgtgtgtgtgtgtgcatgcg

SEQ ID NO: 175723 - DNA, 22 bp, Mus musculus
ttgacagtggagcaagtctgta

SEQ ID NO: 175724 - DNA, 20 bp, Mus musculus
tatgtatgtatgtatgtgta

SEQ ID NO: 175725 - DNA, 23 bp, Mus musculus
gtctgttatcctagcatttgaaa

SEQ ID NO: 175726 - DNA, 23 bp, Mus musculus
tgctcagaagtttgagaccagac

SEQ ID NO: 175727 - DNA, 20 bp, Mus musculus
tctgagtgtgtggtaaggct

SEQ ID NO: 175728 - DNA, 23 bp, Mus musculus
caacttctgtgacagactctgtt

SEQ ID NO: 175729 - DNA, 23 bp, Mus musculus
tcagtctctgcctgtgtttgcac

SEQ ID NO: 175730 - DNA, 22 bp, Mus musculus
tgtctctgtctccctgacatca

SEQ ID NO: 175731 - DNA, 23 bp, Mus musculus
tgtctccataagcacgtcaatga

SEQ ID NO: 175732 - DNA, 23 bp, Mus musculus
cacaacctgctttgatgagggat

SEQ ID NO: 175733 - DNA, 23 bp, Mus musculus
ctgtgactgcgtcagttctgtgg

SEQ ID NO: 175734 - DNA, 18 bp, Mus musculus
gtcaggcagctttggatg

SEQ ID NO: 175735 - DNA, 20 bp, Mus musculus
acagagaggttgaccagtgg

SEQ ID NO: 175736 - DNA, 20 bp, Mus musculus
aatagcttcagatatggtga

SEQ ID NO: 175737 - DNA, 22 bp, Mus musculus
tatctatctatctgtctgtctg

SEQ ID NO: 175738 - DNA, 23 bp, Mus musculus
agtctggctcacactgggtcaca

SEQ ID NO: 175739 - DNA, 18 bp, Mus musculus
atacacacacacacacat

SEQ ID NO: 175740 - DNA, 23 bp, Mus musculus
tgtgtgtgtgtatgtatatatgt

SEQ ID NO: 175741 - DNA, 23 bp, Mus musculus
ctgtgtgtgtgtgtctgtatgtg

SEQ ID NO: 175742 - DNA, 23 bp, Mus musculus
ttttagaacttttactagatgtg

SEQ ID NO: 175743 - DNA, 20 bp, Mus musculus
caaagctctagttgtggtgt

SEQ ID NO: 175744 - DNA, 22 bp, Mus musculus
ttgaacttttggtggtatctgt

SEQ ID NO: 175745 - DNA, 23 bp, Mus musculus
gacacctggaattctctctgtgc

SEQ ID NO: 175746 - DNA, 23 bp, Mus musculus
atgggagaagagactgaacagag

SEQ ID NO: 175747 - DNA, 23 bp, Mus musculus
atgtatatgtatatgtatatgta

SEQ ID NO: 175748 - DNA, 18 bp, Mus musculus
tctttcttctttcttttt

SEQ ID NO: 175749 - DNA, 23 bp, Mus musculus
tatgtgtcagagtcaaagctgtg

SEQ ID NO: 175750 - DNA, 23 bp, Mus musculus
acagtctgtttcttaaatactgt

SEQ ID NO: 175751 - DNA, 20 bp, Mus musculus
ctgagaattctacatcttca

SEQ ID NO: 175752 - DNA, 23 bp, Mus musculus
cttccatgatttgaagtagtcta

SEQ ID NO: 175753 - DNA, 23 bp, Mus musculus
tgtgtgtgtgcatgtccatttga

SEQ ID NO: 175754 - DNA, 22 bp, Mus musculus
acatgtgtctgagtgagtatgc

SEQ ID NO: 175755 - DNA, 22 bp, Mus musculus
actctcagtaagtcaatcaaca

SEQ ID NO: 175756 - DNA, 23 bp, Mus musculus
tacacatgtgtgtgtgcacatat

SEQ ID NO: 175757 - DNA, 23 bp, Mus musculus
tatgaaatgatacataatcaatg

SEQ ID NO: 175758 - DNA, 23 bp, Mus musculus
tgtttgaaaatgtatgatttata

SEQ ID NO: 175759 - DNA, 21 bp, Mus musculus
tatgtatatgtatacacatac

SEQ ID NO: 175760 - DNA, 19 bp, Mus musculus
tatgtatgtgtatacacat

SEQ ID NO: 175761 - DNA, 20 bp, Mus musculus
atgtgtatatatatatatgt

SEQ ID NO: 175762 - DNA, 23 bp, Mus musculus
ctgtctgtttgtctgtctgtctg

SEQ ID NO: 175763 - DNA, 22 bp, Mus musculus
tgtgtgtgtatatatatatgtg

SEQ ID NO: 175764 - DNA, 23 bp, Mus musculus
gtatgcatgcatgcatgtctgtg

SEQ ID NO: 175765 - DNA, 22 bp, Mus musculus
tttcagttctaattctttactt

SEQ ID NO: 175766 - DNA, 23 bp, Mus musculus
atagtgcttgaagcttgtaaaca

SEQ ID NO: 175767 - DNA, 18 bp, Mus musculus
ttttctaaggttggagta

SEQ ID NO: 175768 - DNA, 23 bp, Mus musculus
atgtaactagatagagagcactt

SEQ ID NO: 175769 - DNA, 22 bp, Mus musculus
attgtccttactttaaaagtct

SEQ ID NO: 175770 - DNA, 23 bp, Mus musculus
tctctcagcctctgactttgtcc

SEQ ID NO: 175771 - DNA, 23 bp, Mus musculus
aaggtctccctgtctctgtgagt

SEQ ID NO: 175772 - DNA, 23 bp, Mus musculus
tgactggctggctctgtctctcc

SEQ ID NO: 175773 - DNA, 22 bp, Mus musculus
agaggaagaggatagactgaca

SEQ ID NO: 175774 - DNA, 23 bp, Mus musculus
ctagtctctctcagtctctctct

SEQ ID NO: 175775 - DNA, 23 bp, Mus musculus
atcatgagacttcttagcttcta

SEQ ID NO: 175776 - DNA, 23 bp, Mus musculus
tgtctgtctgtctgtctgtctgt

SEQ ID NO: 175777 - DNA, 23 bp, Mus musculus
cttcagtgagagactctgtctca

SEQ ID NO: 175778 - DNA, 23 bp, Mus musculus
tgaatgtatatatgtatgtatgt

SEQ ID NO: 175779 - DNA, 23 bp, Mus musculus
ttacactctctgcaagatgtgtc

SEQ ID NO: 175780 - DNA, 18 bp, Mus musculus
tttgagtggaaaaatgtt

SEQ ID NO: 175781 - DNA, 20 bp, Mus musculus
tggacttctacatggtttct

SEQ ID NO: 175782 - DNA, 22 bp, Mus musculus
caaacactgtggacatccatgt

SEQ ID NO: 175783 - DNA, 23 bp, Mus musculus
ctagatctgtgaggtaatcatgc

SEQ ID NO: 175784 - DNA, 23 bp, Mus musculus
atgcctaagataacctacagctc

SEQ ID NO: 175785 - DNA, 23 bp, Mus musculus
tctctctcaatttgtcctagtac

SEQ ID NO: 175786 - DNA, 23 bp, Mus musculus
taatgacagtaggctgtgagcag

SEQ ID NO: 175787 - DNA, 23 bp, Mus musculus
tgtgtgtgtgtttgtgtgtacgc

SEQ ID NO: 175788 - DNA, 20 bp, Mus musculus
tgtgcatgtatgtatgtatg

SEQ ID NO: 175789 - DNA, 22 bp, Mus musculus
tgtatatgtatatgtatatgtg

SEQ ID NO: 175790 - DNA, 22 bp, Mus musculus
aagtgcaattcaagactgtgag

SEQ ID NO: 175791 - DNA, 21 bp, Mus musculus
cattagaaatgtacctgaaga

SEQ ID NO: 175792 - DNA, 23 bp, Mus musculus
tcagagtgagctctcagctactg

SEQ ID NO: 175793 - DNA, 21 bp, Mus musculus
tagccatgggctaaccttctg

SEQ ID NO: 175794 - DNA, 21 bp, Mus musculus
tgtgtatatatatatatgtac

SEQ ID NO: 175795 - DNA, 23 bp, Mus musculus
tgctgtgagaagagtgtggccac

SEQ ID NO: 175796 - DNA, 23 bp, Mus musculus
tctggttcatttcagctccttca

SEQ ID NO: 175797 - DNA, 23 bp, Mus musculus
tgggggtagagactgtctcagtt

SEQ ID NO: 175798 - DNA, 23 bp, Mus musculus
gtctctctgtgcctcagcttccc

SEQ ID NO: 175799 - DNA, 23 bp, Mus musculus
aattctatgattttatatatagc

SEQ ID NO: 175800 - DNA, 18 bp, Mus musculus
taaaacaggtatttatca

SEQ ID NO: 175801 - DNA, 23 bp, Mus musculus
gtatgtatgtatatatgtatgta

SEQ ID NO: 175802 - DNA, 23 bp, Mus musculus
ttaattccattatgatgacatag

SEQ ID NO: 175803 - DNA, 22 bp, Mus musculus
ttttgtatgatctgttttggaa

SEQ ID NO: 175804 - DNA, 23 bp, Mus musculus
tttgagcttcagtaaagtttctt

SEQ ID NO: 175805 - DNA, 23 bp, Mus musculus
agatgtttagaattgagagttca

SEQ ID NO: 175806 - DNA, 18 bp, Mus musculus
agcaggatgtttgagctc

SEQ ID NO: 175807 - DNA, 20 bp, Mus musculus
agaggaacaaaactgataga

SEQ ID NO: 175808 - DNA, 23 bp, Mus musculus
gaatctatcagtctgtctgtcta

SEQ ID NO: 175809 - DNA, 18 bp, Mus musculus
tttgctcttttatttcat

SEQ ID NO: 175810 - DNA, 21 bp, Mus musculus
aaaaagtcagaagacagcctg

SEQ ID NO: 175811 - DNA, 23 bp, Mus musculus
tgtttctggtagatttcaggtga

SEQ ID NO: 175812 - DNA, 20 bp, Mus musculus
taggtgttgtctgcgcctga

SEQ ID NO: 175813 - DNA, 23 bp, Mus musculus
ggatgagactgtgcagagtgggc

SEQ ID NO: 175814 - DNA, 23 bp, Mus musculus
ctgtctgtctgtgggactctgct

SEQ ID NO: 175815 - DNA, 23 bp, Mus musculus
tttctctgtggttttattttccc

SEQ ID NO: 175816 - DNA, 23 bp, Mus musculus
agtcagagacagagagagacaca

SEQ ID NO: 175817 - DNA, 22 bp, Mus musculus
agagtgaagtgagtgtgtgaat

SEQ ID NO: 175818 - DNA, 22 bp, Mus musculus
tatgtatgtatgtatatgtgta

SEQ ID NO: 175819 - DNA, 19 bp, Mus musculus
atgtgtatgtatgtatatg

SEQ ID NO: 175820 - DNA, 23 bp, Mus musculus
gcactctcacacataagggtgtc

SEQ ID NO: 175821 - DNA, 23 bp, Mus musculus
tgaaagactagagacagtttgag

SEQ ID NO: 175822 - DNA, 21 bp, Mus musculus
tagcagtgagctgaagtctgt

SEQ ID NO: 175823 - DNA, 23 bp, Mus musculus
cactctgcctcaaatctgtctgt

SEQ ID NO: 175824 - DNA, 22 bp, Mus musculus
tagggaatgccagtagtcagta

SEQ ID NO: 175825 - DNA, 23 bp, Mus musculus
gttcactcacagtctgacagcct

SEQ ID NO: 175826 - DNA, 23 bp, Mus musculus
tgtgtgtctgtctgtctgtctgt

SEQ ID NO: 175827 - DNA, 23 bp, Mus musculus
atcgagaagattgtgtgtcactt

SEQ ID NO: 175828 - DNA, 23 bp, Mus musculus
tgtgcatatgtctctctgtgtgt

SEQ ID NO: 175829 - DNA, 22 bp, Mus musculus
tgtatgtggatgtacatatatg

SEQ ID NO: 175830 - DNA, 20 bp, Mus musculus
taaggatatataatgaataa

SEQ ID NO: 175831 - DNA, 18 bp, Mus musculus
acagttgtgagcacatgg

SEQ ID NO: 175832 - DNA, 23 bp, Mus musculus
ttagttctcagaaaccacattgt

SEQ ID NO: 175833 - DNA, 23 bp, Mus musculus
tgtcattgttaatgtgactctgt

SEQ ID NO: 175834 - DNA, 20 bp, Mus musculus
agagtttacattctgggctg

SEQ ID NO: 175835 - DNA, 22 bp, Mus musculus
actgtcagtaggctgtgtgtac

SEQ ID NO: 175836 - DNA, 23 bp, Mus musculus
tgaatctggctgtactttttgag

SEQ ID NO: 175837 - DNA, 23 bp, Mus musculus
tctctctgactcacagacggctt

SEQ ID NO: 175838 - DNA, 20 bp, Mus musculus
tgtatgcatgtatgtatgtg

SEQ ID NO: 175839 - DNA, 20 bp, Mus musculus
agactgctcttccaaaggtc

SEQ ID NO: 175840 - DNA, 23 bp, Mus musculus
cccagtgctaagtctttgtagcc

SEQ ID NO: 175841 - DNA, 23 bp, Mus musculus
atttcactccctctgtcactgag

SEQ ID NO: 175842 - DNA, 23 bp, Mus musculus
atctctgtgcagcagattggttt

SEQ ID NO: 175843 - DNA, 23 bp, Mus musculus
tgtctgtctgtctgcctgcctga

SEQ ID NO: 175844 - DNA, 22 bp, Mus musculus
aaatgtgtgtgcatgcatgtgt

SEQ ID NO: 175845 - DNA, 20 bp, Mus musculus
tcagtagtcacaactgtcat

SEQ ID NO: 175846 - DNA, 23 bp, Mus musculus
ttgagcaagagagactctatcct

SEQ ID NO: 175847 - DNA, 22 bp, Mus musculus
tacacacacatatatgtatgtg

SEQ ID NO: 175848 - DNA, 23 bp, Mus musculus
tgtgtgtatgtatatgtatgtat

SEQ ID NO: 175849 - DNA, 23 bp, Mus musculus
taacacagggagctatcatctgc

SEQ ID NO: 175850 - DNA, 23 bp, Mus musculus
tgtctgtgtgtctgtctgtgtgt

SEQ ID NO: 175851 - DNA, 19 bp, Mus musculus
tgtgctgtcactggaggct

SEQ ID NO: 175852 - DNA, 23 bp, Mus musculus
ggatctctctgtgagtctgagcc

SEQ ID NO: 175853 - DNA, 23 bp, Mus musculus
tatgtctcagagattgaactcag

SEQ ID NO: 175854 - DNA, 18 bp, Mus musculus
acatatcaccaaatgcaa

SEQ ID NO: 175855 - DNA, 22 bp, Mus musculus
ttagagcttccaacttaaagct

SEQ ID NO: 175856 - DNA, 22 bp, Mus musculus
aggaagcaggcttcattgcggg

SEQ ID NO: 175857 - DNA, 23 bp, Mus musculus
tcagggtctgtctgtctctgcct

SEQ ID NO: 175858 - DNA, 20 bp, Mus musculus
aatgtgtctgtatatgtgtg

SEQ ID NO: 175859 - DNA, 23 bp, Mus musculus
ctgtctgtctgtctgcctctctt

SEQ ID NO: 175860 - DNA, 23 bp, Mus musculus
aaactgcacttcgggcaccttgt

SEQ ID NO: 175861 - DNA, 23 bp, Mus musculus
tatttctttgaatttctaatgtt

SEQ ID NO: 175862 - DNA, 23 bp, Mus musculus
tcattgtaactagtctgtgtgca

SEQ ID NO: 175863 - DNA, 21 bp, Mus musculus
tttgttttaggaaagctgtgc

SEQ ID NO: 175864 - DNA, 23 bp, Mus musculus
tgtgagtctgtaagtctgtgtca

SEQ ID NO: 175865 - DNA, 22 bp, Mus musculus
tgttttgtgaccaattatatgg

SEQ ID NO: 175866 - DNA, 19 bp, Mus musculus
ttaccctggtttagcatgg

SEQ ID NO: 175867 - DNA, 23 bp, Mus musculus
tactagctccatgttgttggcta

SEQ ID NO: 175868 - DNA, 23 bp, Mus musculus
acttggagtctggatgtgttctg

SEQ ID NO: 175869 - DNA, 18 bp, Mus musculus
tatatgtgtgtatatgta

SEQ ID NO: 175870 - DNA, 20 bp, Mus musculus
atgtatatgtacgtatatgt

SEQ ID NO: 175871 - DNA, 22 bp, Mus musculus
atgtgtgtgtgtatgtgcaagt

SEQ ID NO: 175872 - DNA, 23 bp, Mus musculus
ttggttgaagtcctgaatacaga

SEQ ID NO: 175873 - DNA, 22 bp, Mus musculus
atagaaaaggagctggagagat

SEQ ID NO: 175874 - DNA, 23 bp, Mus musculus
gtatgtatgcatgtatatgtata

SEQ ID NO: 175875 - DNA, 19 bp, Mus musculus
tatgtgtatatatatatgt

SEQ ID NO: 175876 - DNA, 20 bp, Mus musculus
agacagaagtgacaaagcac

SEQ ID NO: 175877 - DNA, 22 bp, Mus musculus
ttttggtttttattcacttctt

SEQ ID NO: 175878 - DNA, 23 bp, Mus musculus
ctaaattataatgttgtattaga

SEQ ID NO: 175879 - DNA, 23 bp, Mus musculus
atatgatacgatatgatatgata

SEQ ID NO: 175880 - DNA, 23 bp, Mus musculus
gtgcatccatgttgaagtagaca

SEQ ID NO: 175881 - DNA, 20 bp, Mus musculus
actctgggccaaagttcaca

SEQ ID NO: 175882 - DNA, 23 bp, Mus musculus
tcattgcagtgtctctttgtgag

SEQ ID NO: 175883 - DNA, 23 bp, Mus musculus
cggagaagatgcacctaaccatc

SEQ ID NO: 175884 - DNA, 20 bp, Mus musculus
atgctatatataactatatg

SEQ ID NO: 175885 - DNA, 22 bp, Mus musculus
tgttttgtgaccaattatatgg

SEQ ID NO: 175886 - DNA, 21 bp, Mus musculus
agacctgtactttggtgagag

SEQ ID NO: 175887 - DNA, 18 bp, Mus musculus
ccatgtataagaatccat

SEQ ID NO: 175888 - DNA, 21 bp, Mus musculus
agagagtctggtagtgaccca

SEQ ID NO: 175889 - DNA, 23 bp, Mus musculus
atatgtgtgcatatatatacata

SEQ ID NO: 175890 - DNA, 23 bp, Mus musculus
tgtgagcatgtgcaagtgagcat

SEQ ID NO: 175891 - DNA, 23 bp, Mus musculus
actgtgtttgtacatgtgtgaat

SEQ ID NO: 175892 - DNA, 19 bp, Mus musculus
ttcacacatgtgatgctgc

SEQ ID NO: 175893 - DNA, 23 bp, Mus musculus
agctgccttcagtatctgttttt

SEQ ID NO: 175894 - DNA, 22 bp, Mus musculus
gaaatgaagtgcatggagaaca

SEQ ID NO: 175895 - DNA, 23 bp, Mus musculus
gtttcatctgttttgcaaattgt

SEQ ID NO: 175896 - DNA, 23 bp, Mus musculus
ttaatgagtgcatatcatgggtg

SEQ ID NO: 175897 - DNA, 22 bp, Mus musculus
tgttttgtgaccaattatatgg

SEQ ID NO: 175898 - DNA, 22 bp, Mus musculus
tgttttgtgaccaattatatgg

SEQ ID NO: 175899 - DNA, 22 bp, Mus musculus
tgttttgtgaccaattatatgg

SEQ ID NO: 175900 - DNA, 21 bp, Mus musculus
tatatatgtatgtatgtatgt

SEQ ID NO: 175901 - DNA, 23 bp, Mus musculus
atgtatatatgtatgtatgtgag

SEQ ID NO: 175902 - DNA, 22 bp, Mus musculus
taattgctgggaattgaactca

SEQ ID NO: 175903 - DNA, 23 bp, Mus musculus
cactcacattatgtgtgtgtgta

SEQ ID NO: 175904 - DNA, 23 bp, Mus musculus
acatacacacacacataatatgt

SEQ ID NO: 175905 - DNA, 18 bp, Mus musculus
gtgtgtgtgtgtgtgtgt

SEQ ID NO: 175906 - DNA, 20 bp, Mus musculus
atacactctggtagagtcag

SEQ ID NO: 175907 - DNA, 23 bp, Mus musculus
tagttgcatcttcattggggaga

SEQ ID NO: 175908 - DNA, 18 bp, Mus musculus
ttgaaactatctgaattc

SEQ ID NO: 175909 - DNA, 18 bp, Mus musculus
attcatctctctcactct

SEQ ID NO: 175910 - DNA, 23 bp, Mus musculus
tgcatcttttaattcctatctca

SEQ ID NO: 175911 - DNA, 23 bp, Mus musculus
tagtgcatggtgatctgatagga

SEQ ID NO: 175912 - DNA, 22 bp, Mus musculus
tgttttgtgacctattatgtgg

SEQ ID NO: 175913 - DNA, 23 bp, Mus musculus
actgacagagttatcactgagca

SEQ ID NO: 175914 - DNA, 23 bp, Mus musculus
tgttcagtttttgtaattgtgtg

SEQ ID NO: 175915 - DNA, 23 bp, Mus musculus
gagggtctctctcttgctctcat

SEQ ID NO: 175916 - DNA, 21 bp, Mus musculus
aggttgttccttgaattgtta

SEQ ID NO: 175917 - DNA, 23 bp, Mus musculus
tctgtctctctgtgtgtatgtgc

SEQ ID NO: 175918 - DNA, 20 bp, Mus musculus
ttgtcagttgagacacagca

SEQ ID NO: 175919 - DNA, 21 bp, Mus musculus
tccctctgactttgtctctcc

SEQ ID NO: 175920 - DNA, 23 bp, Mus musculus
ctgtgaaaacatgaaatgctcaa

SEQ ID NO: 175921 - DNA, 22 bp, Mus musculus
tgttttgtgaccaattatatgg

SEQ ID NO: 175922 - DNA, 22 bp, Mus musculus
tgttttgtgaccaattatatgg

SEQ ID NO: 175923 - DNA, 23 bp, Mus musculus
acagacagcattctctttccttt

SEQ ID NO: 175924 - DNA, 19 bp, Mus musculus
atatatatacatgtataca

SEQ ID NO: 175925 - DNA, 18 bp, Mus musculus
agaaaatttctagaagtg

SEQ ID NO: 175926 - DNA, 21 bp, Mus musculus
atgtttagtgacataaacaag

SEQ ID NO: 175927 - DNA, 22 bp, Mus musculus
tgttttgtgaccaattatatgg

SEQ ID NO: 175928 - DNA, 22 bp, Mus musculus
tgtgtgtgtatatatatgtatg

SEQ ID NO: 175929 - DNA, 23 bp, Mus musculus
ttcagaatgactcagtctctctc

SEQ ID NO: 175930 - DNA, 20 bp, Mus musculus
tcagtgtttagtctgctcac

SEQ ID NO: 175931 - DNA, 20 bp, Mus musculus
atatatgtgtgcatgtgtac

SEQ ID NO: 175932 - DNA, 22 bp, Mus musculus
tgtgtgtatgtatgtatatgtg

SEQ ID NO: 175933 - DNA, 22 bp, Mus musculus
tgtgtgtatgtgtatatgtata

SEQ ID NO: 175934 - DNA, 21 bp, Mus musculus
acatgtatatatatatatgtg

SEQ ID NO: 175935 - DNA, 22 bp, Mus musculus
tgttttgtgaccaattatatgg

SEQ ID NO: 175936 - DNA, 22 bp, Mus musculus
ttatagtgatactcttgccttg

SEQ ID NO: 175937 - DNA, 23 bp, Mus musculus
aggctgaggtagaagtgtcttgt

SEQ ID NO: 175938 - DNA, 23 bp, Mus musculus
ttcttagttagtgatgcatatgg

SEQ ID NO: 175939 - DNA, 20 bp, Mus musculus
actcactgcacttagtgtca

SEQ ID NO: 175940 - DNA, 20 bp, Mus musculus
ttttgtgaagagtgtgagat

SEQ ID NO: 175941 - DNA, 22 bp, Mus musculus
agagaagatctacagttgtagt

SEQ ID NO: 175942 - DNA, 22 bp, Mus musculus
tttcattcaatagattcagctg

SEQ ID NO: 175943 - DNA, 23 bp, Mus musculus
ttaaaagctactctagatggtct

SEQ ID NO: 175944 - DNA, 18 bp, Mus musculus
caggcagagaaaataatc

SEQ ID NO: 175945 - DNA, 23 bp, Mus musculus
tagtgcatggtgatctgatagga

SEQ ID NO: 175946 - DNA, 23 bp, Mus musculus
attgatgtgaagtgattttgatg

SEQ ID NO: 175947 - DNA, 23 bp, Mus musculus
ggtaatttatcactttacctttc

SEQ ID NO: 175948 - DNA, 22 bp, Mus musculus
tgttttgtgaccaattatatgg

SEQ ID NO: 175949 - DNA, 19 bp, Mus musculus
acactcacacgttgcatat

SEQ ID NO: 175950 - DNA, 21 bp, Mus musculus
tatatgcaacgtgtgagtgtg

SEQ ID NO: 175951 - DNA, 23 bp, Mus musculus
caactgtctgtgactacagttac

SEQ ID NO: 175952 - DNA, 18 bp, Mus musculus
tactgcattatacatgaa

SEQ ID NO: 175953 - DNA, 18 bp, Mus musculus
tactgcattatacatgaa

SEQ ID NO: 175954 - DNA, 18 bp, Mus musculus
tactgcattatacatgaa

SEQ ID NO: 175955 - DNA, 19 bp, Mus musculus
tacacacacacgtagatgt

SEQ ID NO: 175956 - DNA, 20 bp, Mus musculus
agagaggaaccactctaggt

SEQ ID NO: 175957 - DNA, 23 bp, Mus musculus
accctcacagtttgcaagctgat

SEQ ID NO: 175958 - DNA, 22 bp, Mus musculus
tgttttgtgaccaagtatatgg

SEQ ID NO: 175959 - DNA, 23 bp, Mus musculus
agtgctgtagaaatcagtataca

SEQ ID NO: 175960 - DNA, 23 bp, Mus musculus
gtatgtatgtatgtatgtatgta

SEQ ID NO: 175961 - DNA, 18 bp, Mus musculus
tacagcctgatctcatgg

SEQ ID NO: 175962 - DNA, 23 bp, Mus musculus
acagacagacagacaggcaggca

SEQ ID NO: 175963 - DNA, 23 bp, Mus musculus
tatatacacacacatacatgtgt

SEQ ID NO: 175964 - DNA, 22 bp, Mus musculus
atgtatgtatgtatgtatgtct

SEQ ID NO: 175965 - DNA, 23 bp, Mus musculus
aactgtgactgaaaagctgctgg

SEQ ID NO: 175966 - DNA, 23 bp, Mus musculus
tgcatgtatgtatgtatgtatgt

SEQ ID NO: 175967 - DNA, 21 bp, Mus musculus
atgtatgtatgtatgtatgta

SEQ ID NO: 175968 - DNA, 20 bp, Mus musculus
atatgtgtgtgtgtatatgt

SEQ ID NO: 175969 - DNA, 22 bp, Mus musculus
tgttttgtgaccaattatatgg

SEQ ID NO: 175970 - DNA, 23 bp, Mus musculus
actttcagttgtttatttgatga

SEQ ID NO: 175971 - DNA, 23 bp, Mus musculus
tgacatgctggtgagaccttatg

SEQ ID NO: 175972 - DNA, 23 bp, Mus musculus
atacagcattgtatttcagtctc

SEQ ID NO: 175973 - DNA, 19 bp, Mus musculus
taggaacatcagataacag

SEQ ID NO: 175974 - DNA, 23 bp, Mus musculus
tgtatatgtatacatatatgtgt

SEQ ID NO: 175975 - DNA, 22 bp, Mus musculus
tgttttgtgaccaattatatgg

SEQ ID NO: 175976 - DNA, 23 bp, Mus musculus
tttctgtcagagtctttgttgtt

SEQ ID NO: 175977 - DNA, 23 bp, Mus musculus
tatgcatatatatatgtgtgtgt

SEQ ID NO: 175978 - DNA, 22 bp, Mus musculus
tgttttgtgaccaattatatgg

SEQ ID NO: 175979 - DNA, 18 bp, Mus musculus
tgcgtgtatgtatatatg

SEQ ID NO: 175980 - DNA, 23 bp, Mus musculus
tataaagtagtatgtattagtct

SEQ ID NO: 175981 - DNA, 23 bp, Mus musculus
attaaccaagtacaagtttagtt

SEQ ID NO: 175982 - DNA, 23 bp, Mus musculus
tcaaggtccttcttcaggggaat

SEQ ID NO: 175983 - DNA, 23 bp, Mus musculus
tcagacacttgctctctgtttcc

SEQ ID NO: 175984 - DNA, 23 bp, Mus musculus
tgtatgtatgtatgtatgtatgt

SEQ ID NO: 175985 - DNA, 23 bp, Mus musculus
actgtctgtgactcttgttccag

SEQ ID NO: 175986 - DNA, 22 bp, Mus musculus
acactcagcctctgtgtgcccc

SEQ ID NO: 175987 - DNA, 23 bp, Mus musculus
acactcagcctctgtgtgtctgt

SEQ ID NO: 175988 - DNA, 22 bp, Mus musculus
tggctgcctctgtgcctgtgac

SEQ ID NO: 175989 - DNA, 22 bp, Mus musculus
tatgtatatagaatgtgctgtc

SEQ ID NO: 175990 - DNA, 22 bp, Mus musculus
tatatgtatatagaatgtgcta

SEQ ID NO: 175991 - DNA, 21 bp, Mus musculus
tggctctgtcactggttctga

SEQ ID NO: 175992 - DNA, 23 bp, Mus musculus
tgccagtcagaacagactgcctt

SEQ ID NO: 175993 - DNA, 23 bp, Mus musculus
cagtcactcagagataaggagct

SEQ ID NO: 175994 - DNA, 23 bp, Mus musculus
acctgctcctgtctgtctgtcta

SEQ ID NO: 175995 - DNA, 19 bp, Mus musculus
cagagcaagcttgtagggg

SEQ ID NO: 175996 - DNA, 23 bp, Mus musculus
cactggctgtctcagttccttgt

SEQ ID NO: 175997 - DNA, 23 bp, Mus musculus
ctactgtctctctgtgagtcagc

SEQ ID NO: 175998 - DNA, 23 bp, Mus musculus
cagtggcaggagatatagcttag

SEQ ID NO: 175999 - DNA, 23 bp, Mus musculus
agagacactcacactttctggtt

SEQ ID NO: 176000 - DNA, 23 bp, Mus musculus
aggcagatctctgtgagctcagg

SEQ ID NO: 176001 - DNA, 23 bp, Mus musculus
tgagagaggtgtgagtgctcatg

SEQ ID NO: 176002 - DNA, 21 bp, Mus musculus
aatgactcccagctatcttga

SEQ ID NO: 176003 - DNA, 23 bp, Mus musculus
tgcctgactctgtgtctcagtgc

SEQ ID NO: 176004 - DNA, 23 bp, Mus musculus
aaaagcactgactgctcttccag

SEQ ID NO: 176005 - DNA, 21 bp, Mus musculus
tgtgtgcatgttcacatgtgt

SEQ ID NO: 176006 - DNA, 23 bp, Mus musculus
acatatgtatgtgtgcatgtgta

SEQ ID NO: 176007 - DNA, 23 bp, Mus musculus
tgtctctgagtccgagtccgtct

SEQ ID NO: 176008 - DNA, 23 bp, Mus musculus
ttacagagcctctgtgtgtgtgt

SEQ ID NO: 176009 - DNA, 23 bp, Mus musculus
ttgtggtagttggttctttcctt

SEQ ID NO: 176010 - DNA, 23 bp, Mus musculus
agcatcttacctacagagtcatc

SEQ ID NO: 176011 - DNA, 22 bp, Mus musculus
tttcacacaggactgacagcag

SEQ ID NO: 176012 - DNA, 22 bp, Mus musculus
attgggtccctgtgctcagtcc

SEQ ID NO: 176013 - DNA, 23 bp, Mus musculus
tgtgagcatctggatctgtattg

SEQ ID NO: 176014 - DNA, 23 bp, Mus musculus
tgtcttagtcagtgttctattgc

SEQ ID NO: 176015 - DNA, 21 bp, Mus musculus
tggctcagaggttaagagtgc

SEQ ID NO: 176016 - DNA, 18 bp, Mus musculus
aaacagaggagtgggatg

SEQ ID NO: 176017 - DNA, 23 bp, Mus musculus
tttcacttttcccagcctctttt

SEQ ID NO: 176018 - DNA, 23 bp, Mus musculus
tgagtcagatctgtgtgagctgt

SEQ ID NO: 176019 - DNA, 22 bp, Mus musculus
tgatttctaggtcatcatttgt

SEQ ID NO: 176020 - DNA, 21 bp, Mus musculus
acagatttaaagaacaaagcc

SEQ ID NO: 176021 - DNA, 23 bp, Mus musculus
cctgtgtctgtatctgtctccta

SEQ ID NO: 176022 - DNA, 23 bp, Mus musculus
tcctggagttgacactctggtat

SEQ ID NO: 176023 - DNA, 21 bp, Mus musculus
cactgtgaaaaggaggagcag

SEQ ID NO: 176024 - DNA, 23 bp, Mus musculus
gtctgtctgtcctggaactcact

SEQ ID NO: 176025 - DNA, 23 bp, Mus musculus
gtttgtctgtctggtaaaggatt

SEQ ID NO: 176026 - DNA, 22 bp, Mus musculus
actagtccttattggaaacatt

SEQ ID NO: 176027 - DNA, 23 bp, Mus musculus
ggactcagcttctaatttccatc

SEQ ID NO: 176028 - DNA, 23 bp, Mus musculus
tgtctggctctgaccatttctag

SEQ ID NO: 176029 - DNA, 23 bp, Mus musculus
actctcggtctgaatctgtagtc

SEQ ID NO: 176030 - DNA, 23 bp, Mus musculus
catacagtgttcagttctcttgg

SEQ ID NO: 176031 - DNA, 23 bp, Mus musculus
tctgtctgtctgtctgagggtgt

SEQ ID NO: 176032 - DNA, 23 bp, Mus musculus
gtgtttctcaaactccatgtggt

SEQ ID NO: 176033 - DNA, 23 bp, Mus musculus
gactgacagactgactggcactt

SEQ ID NO: 176034 - DNA, 23 bp, Mus musculus
tgtctgtctgtctatcatctatc

SEQ ID NO: 176035 - DNA, 21 bp, Mus musculus
atcaccacctatttgagtgac

SEQ ID NO: 176036 - DNA, 23 bp, Mus musculus
tctctatctctgggcttttgtgg

SEQ ID NO: 176037 - DNA, 22 bp, Mus musculus
ctctgtctgtctctgcctctat

SEQ ID NO: 176038 - DNA, 23 bp, Mus musculus
tgcctgtctgtctgtctgtctct

SEQ ID NO: 176039 - DNA, 23 bp, Mus musculus
tgtctctctgagtctcctgtgcc

SEQ ID NO: 176040 - DNA, 23 bp, Mus musculus
ctgtatctctttgctcttctgta

SEQ ID NO: 176041 - DNA, 23 bp, Mus musculus
aatgagagtaaagagttagcaga

SEQ ID NO: 176042 - DNA, 23 bp, Mus musculus
tagagacagttgtgagccaccac

SEQ ID NO: 176043 - DNA, 23 bp, Mus musculus
tgtctccctctctctgtgaactt

SEQ ID NO: 176044 - DNA, 23 bp, Mus musculus
atttctctctggagtggctctgt

SEQ ID NO: 176045 - DNA, 21 bp, Mus musculus
atgtatgtatgtatgtatgta

SEQ ID NO: 176046 - DNA, 23 bp, Mus musculus
tatgtatgtgtatatgtatgtat

SEQ ID NO: 176047 - DNA, 23 bp, Mus musculus
tctacaactccttctccaccctc

SEQ ID NO: 176048 - DNA, 23 bp, Mus musculus
tgatgaggagagagtctgcagaa

SEQ ID NO: 176049 - DNA, 22 bp, Mus musculus
agtgaattctaggactagggga

SEQ ID NO: 176050 - DNA, 23 bp, Mus musculus
ctgagacactggctgttctcttc

SEQ ID NO: 176051 - DNA, 23 bp, Mus musculus
ggtgtgtgtctgtcactctttcg

SEQ ID NO: 176052 - DNA, 19 bp, Mus musculus
tacacacatttgtatatga

SEQ ID NO: 176053 - DNA, 23 bp, Mus musculus
tatggttgtatgtatgaatgtgt

SEQ ID NO: 176054 - DNA, 22 bp, Mus musculus
gagattttctttttttgtagct

SEQ ID NO: 176055 - DNA, 23 bp, Mus musculus
aatggtggtaattgaactggtga

SEQ ID NO: 176056 - DNA, 23 bp, Mus musculus
agtctgtctgtctgtctctgtcc

SEQ ID NO: 176057 - DNA, 23 bp, Mus musculus
tagtctgtgtgtgtctctggatg

SEQ ID NO: 176058 - DNA, 19 bp, Mus musculus
tcagagccagaggacctgc

SEQ ID NO: 176059 - DNA, 23 bp, Mus musculus
taagtgtgtctatctctgagtcc

SEQ ID NO: 176060 - DNA, 23 bp, Mus musculus
tagtccatggtgatctgatagga

SEQ ID NO: 176061 - DNA, 19 bp, Mus musculus
acaatagtgtatttgttga

SEQ ID NO: 176062 - DNA, 23 bp, Mus musculus
aatttctctagtgattttgttga

SEQ ID NO: 176063 - DNA, 23 bp, Mus musculus
taacagtctactcactttctgta

SEQ ID NO: 176064 - DNA, 23 bp, Mus musculus
tgtgtgtatctgtgtgtcgctca

SEQ ID NO: 176065 - DNA, 23 bp, Mus musculus
aattcatagtatttgatgtcata

SEQ ID NO: 176066 - DNA, 23 bp, Mus musculus
tttctgtggtttagatatcagag

SEQ ID NO: 176067 - DNA, 23 bp, Mus musculus
tgtgtgtgtgtgtgcgagtgtgg

SEQ ID NO: 176068 - DNA, 23 bp, Mus musculus
atctgtgtgtatatctgtgtgtg

SEQ ID NO: 176069 - DNA, 23 bp, Mus musculus
agagagctttatttttcaggtac

SEQ ID NO: 176070 - DNA, 23 bp, Mus musculus
ctacctggagtctttctatgctg

SEQ ID NO: 176071 - DNA, 21 bp, Mus musculus
atgtatgtatgtatgtgtatg

SEQ ID NO: 176072 - DNA, 23 bp, Mus musculus
tagttccttccatatgttaaaat

SEQ ID NO: 176073 - DNA, 19 bp, Mus musculus
tgactcaggtgaaagctgt

SEQ ID NO: 176074 - DNA, 23 bp, Mus musculus
taatgagaatttgtacatgtgag

SEQ ID NO: 176075 - DNA, 23 bp, Mus musculus
tgacctgggacactgaggctccc

SEQ ID NO: 176076 - DNA, 22 bp, Mus musculus
tatgtgtatatgtatatatgta

SEQ ID NO: 176077 - DNA, 23 bp, Mus musculus
cctccctgcctgcctgcctgcct

SEQ ID NO: 176078 - DNA, 18 bp, Mus musculus
tgttttgatatattgcta

SEQ ID NO: 176079 - DNA, 23 bp, Mus musculus
tctgtgtgtaattctctgtccat

SEQ ID NO: 176080 - DNA, 21 bp, Mus musculus
ttctgctccatctttactcca

SEQ ID NO: 176081 - DNA, 23 bp, Mus musculus
tgattgtcagttgagtgtgggta

SEQ ID NO: 176082 - DNA, 20 bp, Mus musculus
tgtgtagtgttagacaggcc

SEQ ID NO: 176083 - DNA, 23 bp, Mus musculus
ttctctctgtctctatttctatt

SEQ ID NO: 176084 - DNA, 20 bp, Mus musculus
aagcaggttatgagcgttca

SEQ ID NO: 176085 - DNA, 23 bp, Mus musculus
tctgtgtctgtctgatgtgcatg

SEQ ID NO: 176086 - DNA, 20 bp, Mus musculus
actgtggacaaatgtagtta

SEQ ID NO: 176087 - DNA, 18 bp, Mus musculus
tgtgttacctgtatgtat

SEQ ID NO: 176088 - DNA, 21 bp, Mus musculus
tgtgtctgagtgttttgcctg

SEQ ID NO: 176089 - DNA, 23 bp, Mus musculus
cttctgtctgtctcagtttcctt

SEQ ID NO: 176090 - DNA, 20 bp, Mus musculus
agagcaaggagtatcagact

SEQ ID NO: 176091 - DNA, 22 bp, Mus musculus
cttcagagtgtctgtgtgtgtg

SEQ ID NO: 176092 - DNA, 23 bp, Mus musculus
tacatatgtaaacatgtatgtgc

SEQ ID NO: 176093 - DNA, 22 bp, Mus musculus
tcactgtgtctctgatggcttc

SEQ ID NO: 176094 - DNA, 22 bp, Mus musculus
tttgtatggattgcaaatgtgt

SEQ ID NO: 176095 - DNA, 23 bp, Mus musculus
tgcatgtgaatttgtgtgcttgt

SEQ ID NO: 176096 - DNA, 21 bp, Mus musculus
gtgattcagaaaagccagagc

SEQ ID NO: 176097 - DNA, 23 bp, Mus musculus
gctctgtctgtctgtctgtctct

SEQ ID NO: 176098 - DNA, 21 bp, Mus musculus
tatatgtatgtatatatatgt

SEQ ID NO: 176099 - DNA, 23 bp, Mus musculus
tgtctctctgtgtgggtaccagc

SEQ ID NO: 176100 - DNA, 23 bp, Mus musculus
tctctctgcctcagagccaccca

SEQ ID NO: 176101 - DNA, 23 bp, Mus musculus
tacattcatctctctctatctca

SEQ ID NO: 176102 - DNA, 23 bp, Mus musculus
acacgtgtatgtgtgtgtattat

SEQ ID NO: 176103 - DNA, 23 bp, Mus musculus
acacacacacacacatttgtgtg

SEQ ID NO: 176104 - DNA, 23 bp, Mus musculus
agagacaagacagtcagcatgtg

SEQ ID NO: 176105 - DNA, 18 bp, Mus musculus
agaggaacccacttttgt

SEQ ID NO: 176106 - DNA, 21 bp, Mus musculus
tcaggttaaatctgtgtgagt

SEQ ID NO: 176107 - DNA, 23 bp, Mus musculus
agtctattaggttaacagtgagt

SEQ ID NO: 176108 - DNA, 22 bp, Mus musculus
tctatgcatttctttctctgtg

SEQ ID NO: 176109 - DNA, 23 bp, Mus musculus
tgtgtacatgtatgtatgtgtgt

SEQ ID NO: 176110 - DNA, 23 bp, Mus musculus
ttgtatgtatatgtatgtataca

SEQ ID NO: 176111 - DNA, 22 bp, Mus musculus
gacagacagacagaattcctaa

SEQ ID NO: 176112 - DNA, 21 bp, Mus musculus
agacacagagagacatatgtg

SEQ ID NO: 176113 - DNA, 23 bp, Mus musculus
gttgagaggaatcatgtttggag

SEQ ID NO: 176114 - DNA, 23 bp, Mus musculus
cagagactagagagtgtgcagaa

SEQ ID NO: 176115 - DNA, 20 bp, Mus musculus
aagctcccttcagagctgtt

SEQ ID NO: 176116 - DNA, 23 bp, Mus musculus
gtcattgctgatcttcctgattg

SEQ ID NO: 176117 - DNA, 23 bp, Mus musculus
ctgatattgggatgtaaagttaa

SEQ ID NO: 176118 - DNA, 23 bp, Mus musculus
taatgtcagtgattggttcttgt

SEQ ID NO: 176119 - DNA, 23 bp, Mus musculus
tttgtaagtccatatgtttatat

SEQ ID NO: 176120 - DNA, 23 bp, Mus musculus
tctcagggtgattttcttgatta

SEQ ID NO: 176121 - DNA, 23 bp, Mus musculus
tcagtgtcactcctggatatgtg

SEQ ID NO: 176122 - DNA, 23 bp, Mus musculus
ccatctcactctcagaaagctag

SEQ ID NO: 176123 - DNA, 23 bp, Mus musculus
tctgtctgtctgtttgtggatat

SEQ ID NO: 176124 - DNA, 19 bp, Mus musculus
aggtcctatggaaatcaga

SEQ ID NO: 176125 - DNA, 21 bp, Mus musculus
tccatggtggtctgataggat

SEQ ID NO: 176126 - DNA, 22 bp, Mus musculus
tgttttgtgaccaattatatgg

SEQ ID NO: 176127 - DNA, 22 bp, Mus musculus
tgttttgtgaccaattatatgg

SEQ ID NO: 176128 - DNA, 20 bp, Mus musculus
gcatgaatattgagaagaca

SEQ ID NO: 176129 - DNA, 23 bp, Mus musculus
gtggatgacatatgagactgagg

SEQ ID NO: 176130 - DNA, 22 bp, Mus musculus
tccatgatgatctgataggatg

SEQ ID NO: 176131 - DNA, 23 bp, Mus musculus
ttgaagcttgttttgtatccaat

SEQ ID NO: 176132 - DNA, 18 bp, Mus musculus
acagccaaatacagacag

SEQ ID NO: 176133 - DNA, 23 bp, Mus musculus
tttgtgtctgtatatgtacacaa

SEQ ID NO: 176134 - DNA, 23 bp, Mus musculus
tatatatgtacatgtatagcata

SEQ ID NO: 176135 - DNA, 19 bp, Mus musculus
agagaactgagattacaga

SEQ ID NO: 176136 - DNA, 22 bp, Mus musculus
atgtgcagaacaaatctctcct

SEQ ID NO: 176137 - DNA, 23 bp, Mus musculus
tgtgtctgacacatactctgtct

SEQ ID NO: 176138 - DNA, 21 bp, Mus musculus
tgtatgtgtgtatgtatatac

SEQ ID NO: 176139 - DNA, 20 bp, Mus musculus
atatgtatatatgtaaagct

SEQ ID NO: 176140 - DNA, 18 bp, Mus musculus
tctagcttctccattgag

SEQ ID NO: 176141 - DNA, 23 bp, Mus musculus
atcacttgagattttgatcttca

SEQ ID NO: 176142 - DNA, 23 bp, Mus musculus
tggaatttcaggttctgtttgat

SEQ ID NO: 176143 - DNA, 23 bp, Mus musculus
caatatttttgtatctgttgagg

SEQ ID NO: 176144 - DNA, 22 bp, Mus musculus
tgttttgtgaccaattatatgg

SEQ ID NO: 176145 - DNA, 20 bp, Mus musculus
tgtgtatatatatatgtgtg

SEQ ID NO: 176146 - DNA, 23 bp, Mus musculus
gcactgtgtgtatggtacatatc

SEQ ID NO: 176147 - DNA, 23 bp, Mus musculus
tatgtgtgcatgtgcatgtgtgt

SEQ ID NO: 176148 - DNA, 23 bp, Mus musculus
tgtgtatgtgcatgtgtactgat

SEQ ID NO: 176149 - DNA, 23 bp, Mus musculus
tcctgttgagagactttttcttt

SEQ ID NO: 176150 - DNA, 20 bp, Mus musculus
aaagtttcccagtctttgct

SEQ ID NO: 176151 - DNA, 22 bp, Mus musculus
ttctccacctagttctctgaga

SEQ ID NO: 176152 - DNA, 19 bp, Mus musculus
actgaacctggaggtcact

SEQ ID NO: 176153 - DNA, 22 bp, Mus musculus
tcagttcatcgagaaaggaagt

SEQ ID NO: 176154 - DNA, 22 bp, Mus musculus
tctgtctctgcctctctggtgc

SEQ ID NO: 176155 - DNA, 19 bp, Mus musculus
tctgccagcaaagcatatt

SEQ ID NO: 176156 - DNA, 21 bp, Mus musculus
tatatgcatgtgtatatgtat

SEQ ID NO: 176157 - DNA, 23 bp, Mus musculus
acctgtagaaatcagagttcaac

SEQ ID NO: 176158 - DNA, 23 bp, Mus musculus
tctgctacatagtgagactttat

SEQ ID NO: 176159 - DNA, 23 bp, Mus musculus
tcgtaatgtatacaatgtatttg

SEQ ID NO: 176160 - DNA, 23 bp, Mus musculus
ttagatccctcactctctgtcta

SEQ ID NO: 176161 - DNA, 22 bp, Mus musculus
acttcagttgatattcactcct

SEQ ID NO: 176162 - DNA, 23 bp, Mus musculus
aacaggaatgaaatgactttcag

SEQ ID NO: 176163 - DNA, 21 bp, Mus musculus
ctgacacaggaaccccagtgc

SEQ ID NO: 176164 - DNA, 23 bp, Mus musculus
atgtatgtagatgctgtgtgtga

SEQ ID NO: 176165 - DNA, 20 bp, Mus musculus
tctctgaagagagagatcag

SEQ ID NO: 176166 - DNA, 23 bp, Mus musculus
cacacgtgtgtgtgtgtgtgtgt

SEQ ID NO: 176167 - DNA, 21 bp, Mus musculus
tctctctctgtgtgtccacac

SEQ ID NO: 176168 - DNA, 23 bp, Mus musculus
ccctctggtagtactatgtccaa

SEQ ID NO: 176169 - DNA, 19 bp, Mus musculus
tgttttgaagatatgtaag

SEQ ID NO: 176170 - DNA, 21 bp, Mus musculus
aaaacaagcttgtgagctggt

SEQ ID NO: 176171 - DNA, 23 bp, Mus musculus
gtgcacagatttgagtgtgcaca

SEQ ID NO: 176172 - DNA, 20 bp, Mus musculus
tgtgcacaggcactggtgtg

SEQ ID NO: 176173 - DNA, 23 bp, Mus musculus
tctgtcacactgactgtcctgcc

SEQ ID NO: 176174 - DNA, 23 bp, Mus musculus
ggggaaagtatttcagtaatgaa

SEQ ID NO: 176175 - DNA, 21 bp, Mus musculus
tctgtcactatgtgtgtccaa

SEQ ID NO: 176176 - DNA, 23 bp, Mus musculus
tagaacttagagtatggggactg

SEQ ID NO: 176177 - DNA, 23 bp, Mus musculus
tctcctgagtgaggagactgagc

SEQ ID NO: 176178 - DNA, 23 bp, Mus musculus
gactggattgtagagagctatca

SEQ ID NO: 176179 - DNA, 20 bp, Mus musculus
tttgtgcgcaatgtgtatgt

SEQ ID NO: 176180 - DNA, 23 bp, Mus musculus
tgtgtgtatctgtgtctccgtgt

SEQ ID NO: 176181 - DNA, 23 bp, Mus musculus
ttgagatgctcaaagtccttgga

SEQ ID NO: 176182 - DNA, 23 bp, Mus musculus
ctctgtctctgtgtctctgtttc

SEQ ID NO: 176183 - DNA, 23 bp, Mus musculus
tgagagaaatgactcagcagtga

SEQ ID NO: 176184 - DNA, 23 bp, Mus musculus
tatatctacatctgtatgtctgt

SEQ ID NO: 176185 - DNA, 23 bp, Mus musculus
atgtatgactgcatgtatgtatg

SEQ ID NO: 176186 - DNA, 23 bp, Mus musculus
gtatgtgcatgtacatgtgagtg

SEQ ID NO: 176187 - DNA, 23 bp, Mus musculus
tgtgtgtgtgcatgtatatgtgt

SEQ ID NO: 176188 - DNA, 23 bp, Mus musculus
tgtgtgtgcatgtacatgtgtgt

SEQ ID NO: 176189 - DNA, 20 bp, Mus musculus
atgtgtgtgtgtgtgcatgt

SEQ ID NO: 176190 - DNA, 23 bp, Mus musculus
tgtgcatgtacatgtgtatgggt

SEQ ID NO: 176191 - DNA, 23 bp, Mus musculus
tgtggtacaatgtgtgtgtgcat

SEQ ID NO: 176192 - DNA, 23 bp, Mus musculus
agattcagtcactcactgtttac

SEQ ID NO: 176193 - DNA, 23 bp, Mus musculus
gccactgtgagtcactcaggccc

SEQ ID NO: 176194 - DNA, 21 bp, Mus musculus
agactctgaccacacagcctg

SEQ ID NO: 176195 - DNA, 21 bp, Mus musculus
tccatgtgctgtcattatggt

SEQ ID NO: 176196 - DNA, 19 bp, Mus musculus
tgaccagccatatagatct

SEQ ID NO: 176197 - DNA, 22 bp, Mus musculus
tatatgtgtatgcatatgtgtg

SEQ ID NO: 176198 - DNA, 21 bp, Mus musculus
tgtgtgtgtgtgtatgtgcta

SEQ ID NO: 176199 - DNA, 23 bp, Mus musculus
atgtgtctatatgtatgtgtgtg

SEQ ID NO: 176200 - DNA, 23 bp, Mus musculus
tgtgactggctgagtgcctgcca

SEQ ID NO: 176201 - DNA, 23 bp, Mus musculus
tccatctgtgtctgtgtactgtg

SEQ ID NO: 176202 - DNA, 21 bp, Mus musculus
tgaggaagtggctccattaga

SEQ ID NO: 176203 - DNA, 23 bp, Mus musculus
tgtgttcatgcttgtgtgtctgt

SEQ ID NO: 176204 - DNA, 23 bp, Mus musculus
agactctggtggcatctgtactt

SEQ ID NO: 176205 - DNA, 23 bp, Mus musculus
tttagtctggctctcttctcaag

SEQ ID NO: 176206 - DNA, 21 bp, Mus musculus
ttactctgtctgtcttactcc

SEQ ID NO: 176207 - DNA, 22 bp, Mus musculus
cttagtccatggtgatctgata

SEQ ID NO: 176208 - DNA, 20 bp, Mus musculus
tcacagaactgagtgacttg

SEQ ID NO: 176209 - DNA, 23 bp, Mus musculus
tatctaacactgacttaataagt

SEQ ID NO: 176210 - DNA, 22 bp, Mus musculus
tgttttgtgaccaattatatgg

SEQ ID NO: 176211 - DNA, 23 bp, Mus musculus
tatgtgtgtgttcatgcactggt

SEQ ID NO: 176212 - DNA, 23 bp, Mus musculus
aggctcagcttagtcagtgactg

SEQ ID NO: 176213 - DNA, 23 bp, Mus musculus
acactgactgcagattctgtgct

SEQ ID NO: 176214 - DNA, 21 bp, Mus musculus
tcgtctgcaatctagtttcag

SEQ ID NO: 176215 - DNA, 21 bp, Mus musculus
ggtctctctcactctgtatcc

SEQ ID NO: 176216 - DNA, 20 bp, Mus musculus
tatagagcagactgacctca

SEQ ID NO: 176217 - DNA, 23 bp, Mus musculus
tatatatatatgtgtgtgtatgt

SEQ ID NO: 176218 - DNA, 21 bp, Mus musculus
tattcctgttttgtgagggct

SEQ ID NO: 176219 - DNA, 21 bp, Mus musculus
aatgtagtgttttccatatca

SEQ ID NO: 176220 - DNA, 21 bp, Mus musculus
ttaacaccaatttgcagtttt

SEQ ID NO: 176221 - DNA, 23 bp, Mus musculus
gcagtctgtgtctgtgtgtgttt

SEQ ID NO: 176222 - DNA, 23 bp, Mus musculus
tctgtttctctcacttagtacat

SEQ ID NO: 176223 - DNA, 18 bp, Mus musculus
agtgctatggagtttggt

SEQ ID NO: 176224 - DNA, 23 bp, Mus musculus
atttgacaggaggtggtttcgtg

SEQ ID NO: 176225 - DNA, 22 bp, Mus musculus
taggcactacttggataattgt

SEQ ID NO: 176226 - DNA, 23 bp, Mus musculus
aagtgtgtgcatatttattcata

SEQ ID NO: 176227 - DNA, 23 bp, Mus musculus
tatgtctctctgtgtgtatgcgt

SEQ ID NO: 176228 - DNA, 23 bp, Mus musculus
atgtgtgtgtgtgtatgtctgtg

SEQ ID NO: 176229 - DNA, 23 bp, Mus musculus
tcctagatggttctattgttctg

SEQ ID NO: 176230 - DNA, 18 bp, Mus musculus
tgggaattgacagacaga

SEQ ID NO: 176231 - DNA, 18 bp, Mus musculus
tgctggatctgaatgcaa

SEQ ID NO: 176232 - DNA, 22 bp, Mus musculus
tgttttgtgaccaattatatgg

SEQ ID NO: 176233 - DNA, 23 bp, Mus musculus
gtcactctgtatcagtagctttt

SEQ ID NO: 176234 - DNA, 23 bp, Mus musculus
ctctgtagtacagattgaggtca

SEQ ID NO: 176235 - DNA, 21 bp, Mus musculus
catcctgctgactctgttctg

SEQ ID NO: 176236 - DNA, 19 bp, Mus musculus
tgtatatttgtatgtatga

SEQ ID NO: 176237 - DNA, 22 bp, Mus musculus
gtgtctctctgtgtggctcttc

SEQ ID NO: 176238 - DNA, 23 bp, Mus musculus
tcaaacaggttgtcttactgagt

SEQ ID NO: 176239 - DNA, 20 bp, Mus musculus
aagacagaggttagcttcac

SEQ ID NO: 176240 - DNA, 20 bp, Mus musculus
cttatgtatgtatgtatgta

SEQ ID NO: 176241 - DNA, 21 bp, Mus musculus
tatggagaagaagcccaactc

SEQ ID NO: 176242 - DNA, 23 bp, Mus musculus
gtctgtgtctgtctctctggggg

SEQ ID NO: 176243 - DNA, 23 bp, Mus musculus
tactagcttgcagaatacagcct

SEQ ID NO: 176244 - DNA, 20 bp, Mus musculus
aagtgtttttctttataaga

SEQ ID NO: 176245 - DNA, 22 bp, Mus musculus
tcacatctgtcacagtcagctg

SEQ ID NO: 176246 - DNA, 19 bp, Mus musculus
tgtgcatatatagatgtgt

SEQ ID NO: 176247 - DNA, 20 bp, Mus musculus
tatgggactcactgatttgt

SEQ ID NO: 176248 - DNA, 23 bp, Mus musculus
tgtctatgaggatatgtatgcat

SEQ ID NO: 176249 - DNA, 23 bp, Mus musculus
gtatgtgtgcatgtccatgtgca

SEQ ID NO: 176250 - DNA, 23 bp, Mus musculus
tagtccatggtgatctgatagga

SEQ ID NO: 176251 - DNA, 22 bp, Mus musculus
tgttttgtgaccaattatatgg

SEQ ID NO: 176252 - DNA, 22 bp, Mus musculus
accctagaaattttgttgttca

SEQ ID NO: 176253 - DNA, 23 bp, Mus musculus
tatgtatgtgtatgtgtatatgt

SEQ ID NO: 176254 - DNA, 21 bp, Mus musculus
tcacacctataattcttgctg

SEQ ID NO: 176255 - DNA, 23 bp, Mus musculus
agtctgtctcactctcaattcct

SEQ ID NO: 176256 - DNA, 20 bp, Mus musculus
tcacagaactgagtgacttg

SEQ ID NO: 176257 - DNA, 22 bp, Mus musculus
tgttttgtgaccaattatatgg

SEQ ID NO: 176258 - DNA, 22 bp, Mus musculus
tgttttgtgaccaattatatgg

SEQ ID NO: 176259 - DNA, 22 bp, Mus musculus
aagtctctgtttatctctctgt

SEQ ID NO: 176260 - DNA, 23 bp, Mus musculus
tggatctctgagtctctgagttt

SEQ ID NO: 176261 - DNA, 23 bp, Mus musculus
tatactaccttgattctgacttg

SEQ ID NO: 176262 - DNA, 21 bp, Mus musculus
tagtgctgccataaagtgact

SEQ ID NO: 176263 - DNA, 23 bp, Mus musculus
attgcactgaatgtagtacttat

SEQ ID NO: 176264 - DNA, 20 bp, Mus musculus
tcttggtagacaacgattca

SEQ ID NO: 176265 - DNA, 23 bp, Mus musculus
taattagttgattgaatgctgtg

SEQ ID NO: 176266 - DNA, 23 bp, Mus musculus
atactgattttctaattgtcttc

SEQ ID NO: 176267 - DNA, 23 bp, Mus musculus
agtgtctgtgccagattactagc

SEQ ID NO: 176268 - DNA, 23 bp, Mus musculus
tctgtgctatttgtttggtttgg

SEQ ID NO: 176269 - DNA, 22 bp, Mus musculus
tgtgcatgtatgtatatatata

SEQ ID NO: 176270 - DNA, 22 bp, Mus musculus
atatgtatatatatgtatgtgt

SEQ ID NO: 176271 - DNA, 23 bp, Mus musculus
actgtgaggatctgcatctgtat

SEQ ID NO: 176272 - DNA, 20 bp, Mus musculus
tggcagattgtcctaggaga

SEQ ID NO: 176273 - DNA, 22 bp, Mus musculus
tatatgcatatgcatacacata

SEQ ID NO: 176274 - DNA, 21 bp, Mus musculus
tatgcatgtattttcatgtgt

SEQ ID NO: 176275 - DNA, 22 bp, Mus musculus
tgttttgtgaccaattatatgg

SEQ ID NO: 176276 - DNA, 23 bp, Mus musculus
ttttctctctgtctgtcatagta

SEQ ID NO: 176277 - DNA, 23 bp, Mus musculus
agatttctgacaagattgagagc

SEQ ID NO: 176278 - DNA, 22 bp, Mus musculus
acacacacacacatatatatgt

SEQ ID NO: 176279 - DNA, 19 bp, Mus musculus
tattgatgctggtgaccat

SEQ ID NO: 176280 - DNA, 21 bp, Mus musculus
tatggtcattcaggttgtaca

SEQ ID NO: 176281 - DNA, 22 bp, Mus musculus
gcctctgactcagacactccct

SEQ ID NO: 176282 - DNA, 23 bp, Mus musculus
agtactgacaacttggagtttga

SEQ ID NO: 176283 - DNA, 23 bp, Mus musculus
ttcttacaagattgagagcagtg

SEQ ID NO: 176284 - DNA, 22 bp, Mus musculus
tctcagatctgagtgatgagaa

SEQ ID NO: 176285 - DNA, 23 bp, Mus musculus
ctaagcactgagagaatgggcat

SEQ ID NO: 176286 - DNA, 20 bp, Mus musculus
gagtatagtattagctcttc

SEQ ID NO: 176287 - DNA, 20 bp, Mus musculus
accctcagtgtcttacatgt

SEQ ID NO: 176288 - DNA, 23 bp, Mus musculus
tgtatgtgcaaatgtatgcatgt

SEQ ID NO: 176289 - DNA, 23 bp, Mus musculus
atgtatgtgtgcatgtccatgtg

SEQ ID NO: 176290 - DNA, 23 bp, Mus musculus
atgtgtacatatatgtctgtgca

SEQ ID NO: 176291 - DNA, 22 bp, Mus musculus
aagttgtagttttggggctggt

SEQ ID NO: 176292 - DNA, 23 bp, Mus musculus
tgtagagggtgtgtctatgtgtg

SEQ ID NO: 176293 - DNA, 20 bp, Mus musculus
acccagcagtagatcttgtg

SEQ ID NO: 176294 - DNA, 21 bp, Mus musculus
tctggcagttgtctgtccagt

SEQ ID NO: 176295 - DNA, 23 bp, Mus musculus
tcactgtgactgacagactgatc

SEQ ID NO: 176296 - DNA, 18 bp, Mus musculus
atacacacacacatatac

SEQ ID NO: 176297 - DNA, 22 bp, Mus musculus
tcactcccagtctgtgactgtg

SEQ ID NO: 176298 - DNA, 23 bp, Mus musculus
ttctctcagtctctgttccattt

SEQ ID NO: 176299 - DNA, 19 bp, Mus musculus
tttagaccatatgatatct

SEQ ID NO: 176300 - DNA, 21 bp, Mus musculus
tgaatcaccagcacgtcctgg

SEQ ID NO: 176301 - DNA, 22 bp, Mus musculus
cggctctctcaggctctcacac

SEQ ID NO: 176302 - DNA, 23 bp, Mus musculus
tttaggaacgtatagtaggcata

SEQ ID NO: 176303 - DNA, 23 bp, Mus musculus
ggtgagcaagtaggttttaaagt

SEQ ID NO: 176304 - DNA, 20 bp, Mus musculus
taacatccagttgtggttac

SEQ ID NO: 176305 - DNA, 21 bp, Mus musculus
cagagccttagactgaggcag

SEQ ID NO: 176306 - DNA, 21 bp, Mus musculus
agaggtatttcccacagctga

SEQ ID NO: 176307 - DNA, 18 bp, Mus musculus
tatgtttgtgtgtctgtg

SEQ ID NO: 176308 - DNA, 20 bp, Mus musculus
tctctctgcataaggtctgg

SEQ ID NO: 176309 - DNA, 23 bp, Mus musculus
tatttgacttttctctgtctgca

SEQ ID NO: 176310 - DNA, 22 bp, Mus musculus
gtatgcatgcatgtgtgtatgt

SEQ ID NO: 176311 - DNA, 23 bp, Mus musculus
caatatttttgtatctgttgagg

SEQ ID NO: 176312 - DNA, 18 bp, Mus musculus
ataatcaaatagattttg

SEQ ID NO: 176313 - DNA, 20 bp, Mus musculus
tgtgtgtgtgtgtgtgtgtg

SEQ ID NO: 176314 - DNA, 23 bp, Mus musculus
tgtgcatgtatgtatacatgatg

SEQ ID NO: 176315 - DNA, 23 bp, Mus musculus
atagaatctacagttaggtgaaa

SEQ ID NO: 176316 - DNA, 23 bp, Mus musculus
tgactagagtgtcgttcagcttc

SEQ ID NO: 176317 - DNA, 23 bp, Mus musculus
agaatgtggttgtgtaatgataa

SEQ ID NO: 176318 - DNA, 20 bp, Mus musculus
tgtctctcactgaatctaga

SEQ ID NO: 176319 - DNA, 22 bp, Mus musculus
tgttttgtgaccaattatatgg

SEQ ID NO: 176320 - DNA, 18 bp, Mus musculus
tgagccaaatcagaacct

SEQ ID NO: 176321 - DNA, 23 bp, Mus musculus
tgcttagtggtgatggagctggt

SEQ ID NO: 176322 - DNA, 23 bp, Mus musculus
acacacactttctctaacacata

SEQ ID NO: 176323 - DNA, 23 bp, Mus musculus
taaagtggagatcattaagttga

SEQ ID NO: 176324 - DNA, 22 bp, Mus musculus
tgttttgtgaccaattatatgg

SEQ ID NO: 176325 - DNA, 23 bp, Mus musculus
attcagagagtgatattaggcat

SEQ ID NO: 176326 - DNA, 21 bp, Mus musculus
ctctgtcactctctgactttg

SEQ ID NO: 176327 - DNA, 22 bp, Mus musculus
tgttttgtgaccaattatatgg

SEQ ID NO: 176328 - DNA, 23 bp, Mus musculus
tttatgcatgtatatatgtatgt

SEQ ID NO: 176329 - DNA, 22 bp, Mus musculus
tgttttgtgaccaattatatgg

SEQ ID NO: 176330 - DNA, 20 bp, Mus musculus
ttttggtctgataggataca

SEQ ID NO: 176331 - DNA, 22 bp, Mus musculus
tgttttgtgaccaattatatgg

SEQ ID NO: 176332 - DNA, 22 bp, Mus musculus
tatatgtatatgtatacgtgta

SEQ ID NO: 176333 - DNA, 23 bp, Mus musculus
atgagcatctgcatctctattgg

SEQ ID NO: 176334 - DNA, 23 bp, Mus musculus
atatatatatatgagtatgtgtt

SEQ ID NO: 176335 - DNA, 23 bp, Mus musculus
tgtgagtctgttagtctctgtca

SEQ ID NO: 176336 - DNA, 19 bp, Mus musculus
tctgggtgtcagacagctc

SEQ ID NO: 176337 - DNA, 20 bp, Mus musculus
ttaggtttcagatacttaag

SEQ ID NO: 176338 - DNA, 21 bp, Mus musculus
ttactgattgctttagatctg

SEQ ID NO: 176339 - DNA, 23 bp, Mus musculus
tcataactggtcaaagttcaggt

SEQ ID NO: 176340 - DNA, 23 bp, Mus musculus
tcagtgtgtgtctgacaggtttt

SEQ ID NO: 176341 - DNA, 23 bp, Mus musculus
tgtatgtgtctgtcacataaagg

SEQ ID NO: 176342 - DNA, 23 bp, Mus musculus
tctactccttatggtcctctatc

SEQ ID NO: 176343 - DNA, 22 bp, Mus musculus
tgtgtatgtatgtatatatgta

SEQ ID NO: 176344 - DNA, 23 bp, Mus musculus
atgtgtgtatctctatgtatgtg

SEQ ID NO: 176345 - DNA, 23 bp, Mus musculus
tatacaacttactgtggttgttg

SEQ ID NO: 176346 - DNA, 21 bp, Mus musculus
tctagtaggacttggcaatga

SEQ ID NO: 176347 - DNA, 23 bp, Mus musculus
gctgagactccaactggatgtgt

SEQ ID NO: 176348 - DNA, 23 bp, Mus musculus
tgtcttattcttatgtttccaat

SEQ ID NO: 176349 - DNA, 19 bp, Mus musculus
ttttgtggtaggatctgat

SEQ ID NO: 176350 - DNA, 20 bp, Mus musculus
aaacagaatgtaaactggaa

SEQ ID NO: 176351 - DNA, 22 bp, Mus musculus
tcacatctctgtctctgatctt

SEQ ID NO: 176352 - DNA, 20 bp, Mus musculus
tgtcactggagagatggctc

SEQ ID NO: 176353 - DNA, 23 bp, Mus musculus
tatccattagatttccttttgtt

SEQ ID NO: 176354 - DNA, 23 bp, Mus musculus
ttaatacagattttgttaatgtt

SEQ ID NO: 176355 - DNA, 23 bp, Mus musculus
aggttctcctgcttatgtacgct

SEQ ID NO: 176356 - DNA, 23 bp, Mus musculus
tccctctcagtgtgtgaagatgc

SEQ ID NO: 176357 - DNA, 20 bp, Mus musculus
agtgtgtttgtatatatgta

SEQ ID NO: 176358 - DNA, 20 bp, Mus musculus
gtaagaattgatgactgggc

SEQ ID NO: 176359 - DNA, 23 bp, Mus musculus
tgtatgtatttatgtttgcatgt

SEQ ID NO: 176360 - DNA, 23 bp, Mus musculus
ttatgtctgtggttgtgtacaca

SEQ ID NO: 176361 - DNA, 18 bp, Mus musculus
ggtatgcatatatgtgtg

SEQ ID NO: 176362 - DNA, 22 bp, Mus musculus
tgttttgtgaccaattatatgg

SEQ ID NO: 176363 - DNA, 22 bp, Mus musculus
tgttttgtgaccaattatatgg

SEQ ID NO: 176364 - DNA, 18 bp, Mus musculus
atagtggtctgataggat

SEQ ID NO: 176365 - DNA, 23 bp, Mus musculus
tgtgctcagagggatcttgttag

SEQ ID NO: 176366 - DNA, 22 bp, Mus musculus
tgttttgtgaccaattatatgg

SEQ ID NO: 176367 - DNA, 22 bp, Mus musculus
tgttttgtgaccaattatatgg

SEQ ID NO: 176368 - DNA, 22 bp, Mus musculus
tgttttgtgaccaattatatgg

SEQ ID NO: 176369 - DNA, 23 bp, Mus musculus
agaaattgtagtcctcatgcatt

SEQ ID NO: 176370 - DNA, 22 bp, Mus musculus
gattctgttgttatgtctctct

SEQ ID NO: 176371 - DNA, 23 bp, Mus musculus
tgttttaatgtttgaaaagtact

SEQ ID NO: 176372 - DNA, 20 bp, Mus musculus
tggtggtctgataggattca

SEQ ID NO: 176373 - DNA, 22 bp, Mus musculus
tgttttgtgaccaattatatgg

SEQ ID NO: 176374 - DNA, 20 bp, Mus musculus
tactgcagattacttgggct

SEQ ID NO: 176375 - DNA, 19 bp, Mus musculus
gtacttacatgtgtatgtg

SEQ ID NO: 176376 - DNA, 23 bp, Mus musculus
tgcctctgtgcctctgtgtctgc

SEQ ID NO: 176377 - DNA, 23 bp, Mus musculus
gtacaaggtagagtgaggaggcc

SEQ ID NO: 176378 - DNA, 22 bp, Mus musculus
gtacagttctaattttgtagta

SEQ ID NO: 176379 - DNA, 22 bp, Mus musculus
aaactgactgtacatagcaagt

SEQ ID NO: 176380 - DNA, 23 bp, Mus musculus
tgtgcacacaagtagttacgtaa

SEQ ID NO: 176381 - DNA, 23 bp, Mus musculus
cagagctgtgtgtgtgtgtgtgt

SEQ ID NO: 176382 - DNA, 22 bp, Mus musculus
ttagggatttgtttgctatgtg

SEQ ID NO: 176383 - DNA, 19 bp, Mus musculus
ttagtctgatgtgtgctgc

SEQ ID NO: 176384 - DNA, 19 bp, Mus musculus
catgtatatacatgtttat

SEQ ID NO: 176385 - DNA, 20 bp, Mus musculus
atctatgtatttatgtatac

SEQ ID NO: 176386 - DNA, 23 bp, Mus musculus
atctatgtatatatattgtgcat

SEQ ID NO: 176387 - DNA, 18 bp, Mus musculus
gtggagtccattctgcct

SEQ ID NO: 176388 - DNA, 23 bp, Mus musculus
agatgtgactggcagaaaattct

SEQ ID NO: 176389 - DNA, 22 bp, Mus musculus
tgtgtcacacagtaaacccttt

SEQ ID NO: 176390 - DNA, 18 bp, Mus musculus
tctacatatctttacttg

SEQ ID NO: 176391 - DNA, 19 bp, Mus musculus
atgtgtatgtatgtgtatg

SEQ ID NO: 176392 - DNA, 21 bp, Mus musculus
atgtatgtgtatatgtatatg

SEQ ID NO: 176393 - DNA, 23 bp, Mus musculus
tatatgtatatgtatatgtatat

SEQ ID NO: 176394 - DNA, 23 bp, Mus musculus
aagtaatggtactcttccttttg

SEQ ID NO: 176395 - DNA, 22 bp, Mus musculus
ctgaaattctctatgtttgttg

SEQ ID NO: 176396 - DNA, 22 bp, Mus musculus
catagaatgagttgggtagagt

SEQ ID NO: 176397 - DNA, 21 bp, Mus musculus
tccatggtggtctgataggat

SEQ ID NO: 176398 - DNA, 18 bp, Mus musculus
atttgctagatataatag

SEQ ID NO: 176399 - DNA, 20 bp, Mus musculus
tttaatataaagtggggcct

SEQ ID NO: 176400 - DNA, 23 bp, Mus musculus
tgtcactgggtgtgaatgttgaa

SEQ ID NO: 176401 - DNA, 22 bp, Mus musculus
tgttttgtgaccaattatatgg

SEQ ID NO: 176402 - DNA, 19 bp, Mus musculus
gcgaaatgtagaaaaagaa

SEQ ID NO: 176403 - DNA, 22 bp, Mus musculus
tgttttgtgaccaattatatgg

SEQ ID NO: 176404 - DNA, 23 bp, Mus musculus
aaagaaaggaacacagtctcatt

SEQ ID NO: 176405 - DNA, 23 bp, Mus musculus
aactctagtgaaagaatggtgta

SEQ ID NO: 176406 - DNA, 23 bp, Mus musculus
atatgactgttgttatgttcatt

SEQ ID NO: 176407 - DNA, 22 bp, Mus musculus
tgttttgtgaccaattatatgg

SEQ ID NO: 176408 - DNA, 23 bp, Mus musculus
atgtatgtatataagtatgtatg

SEQ ID NO: 176409 - DNA, 23 bp, Mus musculus
tgtatgtatgtatatatgtatgt

SEQ ID NO: 176410 - DNA, 18 bp, Mus musculus
atatgtatgtatatatgt

SEQ ID NO: 176411 - DNA, 23 bp, Mus musculus
ggttaagatcatgtgctcttaga

SEQ ID NO: 176412 - DNA, 23 bp, Mus musculus
atatagcagcatatggtagctgt

SEQ ID NO: 176413 - DNA, 21 bp, Mus musculus
ctcaggtaattaaacagtttg

SEQ ID NO: 176414 - DNA, 23 bp, Mus musculus
agtgtctgtatctgtcttagtca

SEQ ID NO: 176415 - DNA, 23 bp, Mus musculus
tgagaggacaacatgctcttgtc

SEQ ID NO: 176416 - DNA, 19 bp, Mus musculus
tacatgtatatatatgtat

SEQ ID NO: 176417 - DNA, 22 bp, Mus musculus
taaatacaagtaggccagcaga

SEQ ID NO: 176418 - DNA, 22 bp, Mus musculus
tgttttgtgaccaattatatgg

SEQ ID NO: 176419 - DNA, 23 bp, Mus musculus
cttctgcctctctgtgtgtctgt

SEQ ID NO: 176420 - DNA, 21 bp, Mus musculus
tgctgtcttctcttggtgtcc

SEQ ID NO: 176421 - DNA, 23 bp, Mus musculus
tcaccctctgactctggctcacc

SEQ ID NO: 176422 - DNA, 20 bp, Mus musculus
aatacctgtatgaggcgcgt

SEQ ID NO: 176423 - DNA, 23 bp, Mus musculus
tgcctgtgaccctctgtccctgc

SEQ ID NO: 176424 - DNA, 23 bp, Mus musculus
tgtgacccctttcctactgtcac

SEQ ID NO: 176425 - DNA, 23 bp, Mus musculus
tacatatatgtatgcatgtatgt

SEQ ID NO: 176426 - DNA, 23 bp, Mus musculus
ttctgtcgctcacagcctgcctg

SEQ ID NO: 176427 - DNA, 23 bp, Mus musculus
tgttgtgagtatatgtgtatgtg

SEQ ID NO: 176428 - DNA, 23 bp, Mus musculus
cagtggctcacacagtccctctc

SEQ ID NO: 176429 - DNA, 23 bp, Mus musculus
tgggagtctgattagagtgtgga

SEQ ID NO: 176430 - DNA, 19 bp, Mus musculus
agctcctttgtgactgtgt

SEQ ID NO: 176431 - DNA, 23 bp, Mus musculus
taagtctgtctgtaagagatatg

SEQ ID NO: 176432 - DNA, 20 bp, Mus musculus
tctgagcctgtctgtgcctg

SEQ ID NO: 176433 - DNA, 23 bp, Mus musculus
caggacagagtcaggacactcgg

SEQ ID NO: 176434 - DNA, 20 bp, Mus musculus
aagtgcttgtttcttcccct

SEQ ID NO: 176435 - DNA, 22 bp, Mus musculus
ctgaggctgtctgtggctgtga

SEQ ID NO: 176436 - DNA, 22 bp, Mus musculus
tatgtgcatgtgtatgtgcatg

SEQ ID NO: 176437 - DNA, 23 bp, Mus musculus
caggctttgctttgtcctcagtt

SEQ ID NO: 176438 - DNA, 23 bp, Mus musculus
gctctgatgtgactgagcagaga

SEQ ID NO: 176439 - DNA, 23 bp, Mus musculus
ttagctctggcagattcagtgga

SEQ ID NO: 176440 - DNA, 23 bp, Mus musculus
ctgagtcacacactcactgttct

SEQ ID NO: 176441 - DNA, 19 bp, Mus musculus
tagcaaccacatggtggct

SEQ ID NO: 176442 - DNA, 22 bp, Mus musculus
acagttgtctctgcctcactga

SEQ ID NO: 176443 - DNA, 23 bp, Mus musculus
tctctgcacatatctgggtctac

SEQ ID NO: 176444 - DNA, 23 bp, Mus musculus
aacacaccctgcattgtactgca

SEQ ID NO: 176445 - DNA, 23 bp, Mus musculus
tgtgtctgtctctggatgaggag

SEQ ID NO: 176446 - DNA, 19 bp, Mus musculus
tctctcggagtctgccagc

SEQ ID NO: 176447 - DNA, 22 bp, Mus musculus
aaaggcactgcctgagttcagg

SEQ ID NO: 176448 - DNA, 23 bp, Mus musculus
tgtgtgtcagtgactgtatacac

SEQ ID NO: 176449 - DNA, 22 bp, Mus musculus
cgagaggctctgagagtcagtg

SEQ ID NO: 176450 - DNA, 21 bp, Mus musculus
atatgtatatatatatatgtg

SEQ ID NO: 176451 - DNA, 20 bp, Mus musculus
tctgcttgtagagtgtgtac

SEQ ID NO: 176452 - DNA, 22 bp, Mus musculus
tggctcactgcctctctgattt

SEQ ID NO: 176453 - DNA, 19 bp, Mus musculus
tgagagatgagagtgaccc

SEQ ID NO: 176454 - DNA, 23 bp, Mus musculus
tactcagtctgtctgtctgtctg

SEQ ID NO: 176455 - DNA, 21 bp, Mus musculus
ggaagtggcgttggtgttact

SEQ ID NO: 176456 - DNA, 23 bp, Mus musculus
gtcactcagtccatctctcactg

SEQ ID NO: 176457 - DNA, 19 bp, Mus musculus
gtatgtatgcatgtgtgtg

SEQ ID NO: 176458 - DNA, 23 bp, Mus musculus
cagctctgtctgtctgtctgttg

SEQ ID NO: 176459 - DNA, 23 bp, Mus musculus
tcgctggctctctccttctgcat

SEQ ID NO: 176460 - DNA, 21 bp, Mus musculus
aagacagaggagagtcagcag

SEQ ID NO: 176461 - DNA, 18 bp, Mus musculus
tgctgtctgcgaaggttg

SEQ ID NO: 176462 - DNA, 23 bp, Mus musculus
tgtagacatccttcttaccatgc

SEQ ID NO: 176463 - DNA, 23 bp, Mus musculus
gtctgtctgtctgtctgtctgct

SEQ ID NO: 176464 - DNA, 20 bp, Mus musculus
aggacacagagaactgaggc

SEQ ID NO: 176465 - DNA, 23 bp, Mus musculus
agtctatttgaagttctgtatgc

SEQ ID NO: 176466 - DNA, 21 bp, Mus musculus
atctccttctttaggctagga

SEQ ID NO: 176467 - DNA, 23 bp, Mus musculus
taggagcacttgttgctctgtca

SEQ ID NO: 176468 - DNA, 21 bp, Mus musculus
atcctggtcctgcctgtcttc

SEQ ID NO: 176469 - DNA, 23 bp, Mus musculus
gtatgtgcatgtatgtgtatctg

SEQ ID NO: 176470 - DNA, 23 bp, Mus musculus
tctgcatctgtctggaaatgaga

SEQ ID NO: 176471 - DNA, 20 bp, Mus musculus
actggagagaaggctcagca

SEQ ID NO: 176472 - DNA, 21 bp, Mus musculus
aatcacactctctcttctgcc

SEQ ID NO: 176473 - DNA, 23 bp, Mus musculus
gcaacagtatggatatgttttgt

SEQ ID NO: 176474 - DNA, 23 bp, Mus musculus
ctctgtctgtcagtgtccgatgc

SEQ ID NO: 176475 - DNA, 20 bp, Mus musculus
tgtgagcttgcctttctgga

SEQ ID NO: 176476 - DNA, 22 bp, Mus musculus
cctgtctgtctgtctgcctctg

SEQ ID NO: 176477 - DNA, 21 bp, Mus musculus
atgtaagtacttgaggatgtg

SEQ ID NO: 176478 - DNA, 23 bp, Mus musculus
tttggtcagctactcctctcaaa

SEQ ID NO: 176479 - DNA, 23 bp, Mus musculus
gtcagaggagacagaggtatagc

SEQ ID NO: 176480 - DNA, 23 bp, Mus musculus
actgtgtctctcactcttttgcc

SEQ ID NO: 176481 - DNA, 23 bp, Mus musculus
tgcctgcctgcctgcctgcctgc

SEQ ID NO: 176482 - DNA, 19 bp, Mus musculus
cacactacagctttccaca

SEQ ID NO: 176483 - DNA, 20 bp, Mus musculus
aagaagtgtccaaatgggct

SEQ ID NO: 176484 - DNA, 23 bp, Mus musculus
aggagcacaccttcactgactca

SEQ ID NO: 176485 - DNA, 23 bp, Mus musculus
tctcagcatgtaagcctggctgt

SEQ ID NO: 176486 - DNA, 23 bp, Mus musculus
tctgtctgtctgtctgtctgtct

SEQ ID NO: 176487 - DNA, 23 bp, Mus musculus
ccctctgtctgtctgtctgtctg

SEQ ID NO: 176488 - DNA, 23 bp, Mus musculus
cagtccctccctgtatccctttc

SEQ ID NO: 176489 - DNA, 18 bp, Mus musculus
agagtgctctgtgaggcc

SEQ ID NO: 176490 - DNA, 22 bp, Mus musculus
cagctcagagtggagactcagc

SEQ ID NO: 176491 - DNA, 23 bp, Mus musculus
atgtatgtatgtatgtatgtatg

SEQ ID NO: 176492 - DNA, 23 bp, Mus musculus
tggctctgcctcacttctggacc

SEQ ID NO: 176493 - DNA, 23 bp, Mus musculus
acactgtatgtcagaggtaaagt

SEQ ID NO: 176494 - DNA, 18 bp, Mus musculus
catactggtagagagagg

SEQ ID NO: 176495 - DNA, 23 bp, Mus musculus
tcagagatgacagagctgagaac

SEQ ID NO: 176496 - DNA, 23 bp, Mus musculus
tttttctcaggtttttttcattt

SEQ ID NO: 176497 - DNA, 22 bp, Mus musculus
agagtgtgttcacagggagcag

SEQ ID NO: 176498 - DNA, 23 bp, Mus musculus
tagtgcatggtgatctgatagga

SEQ ID NO: 176499 - DNA, 22 bp, Mus musculus
tgttttgtgacctattatgtgg

SEQ ID NO: 176500 - DNA, 22 bp, Mus musculus
ttgtatttttgtaaatgtctcc

SEQ ID NO: 176501 - DNA, 23 bp, Mus musculus
tgttggtggcactgtaatctgtg

SEQ ID NO: 176502 - DNA, 23 bp, Mus musculus
acagaaatcagtgtgaagaacta

SEQ ID NO: 176503 - DNA, 18 bp, Mus musculus
agagctgacagtgttgaa

SEQ ID NO: 176504 - DNA, 21 bp, Mus musculus
tatcagtttggctatcttgtc

SEQ ID NO: 176505 - DNA, 18 bp, Mus musculus
tgcaggcctgtcagttgc

SEQ ID NO: 176506 - DNA, 23 bp, Mus musculus
cgtctgtctgtctgtctgtctgt

SEQ ID NO: 176507 - DNA, 19 bp, Mus musculus
tgagagcacagagagacct

SEQ ID NO: 176508 - DNA, 23 bp, Mus musculus
tctcactgcccctcagtgtctgt

SEQ ID NO: 176509 - DNA, 20 bp, Mus musculus
attgtcctcatggagctgag

SEQ ID NO: 176510 - DNA, 23 bp, Mus musculus
tctgtcagtgactgacactgcgg

SEQ ID NO: 176511 - DNA, 23 bp, Mus musculus
tcctctctgtcagtgactgacac

SEQ ID NO: 176512 - DNA, 23 bp, Mus musculus
ctgtcagtgactgacactgcggg

SEQ ID NO: 176513 - DNA, 23 bp, Mus musculus
acatctctctctgtcagtgactg

SEQ ID NO: 176514 - DNA, 23 bp, Mus musculus
agtgctgactgctcttccagagg

SEQ ID NO: 176515 - DNA, 23 bp, Mus musculus
tcccagactactgttttggatga

SEQ ID NO: 176516 - DNA, 23 bp, Mus musculus
tgacagatgactgtgttcagtcc

SEQ ID NO: 176517 - DNA, 20 bp, Mus musculus
tcactctgtatgggaaacta

SEQ ID NO: 176518 - DNA, 19 bp, Mus musculus
tgagagagagagagactcc

SEQ ID NO: 176519 - DNA, 20 bp, Mus musculus
tttgtctctctctctctctc

SEQ ID NO: 176520 - DNA, 22 bp, Mus musculus
atgatgtttttctggatgccgt

SEQ ID NO: 176521 - DNA, 23 bp, Mus musculus
tgtgagagcgcatgtgatgcttt

SEQ ID NO: 176522 - DNA, 23 bp, Mus musculus
agacacttgagagtgcacatgat

SEQ ID NO: 176523 - DNA, 20 bp, Mus musculus
atatgtatatatgtatgtgt

SEQ ID NO: 176524 - DNA, 23 bp, Mus musculus
ttgacattgccctttgacctttt

SEQ ID NO: 176525 - DNA, 23 bp, Mus musculus
tatagtgtgtgtatgtatatgta

SEQ ID NO: 176526 - DNA, 22 bp, Mus musculus
agatgcacacacataatatata

SEQ ID NO: 176527 - DNA, 23 bp, Mus musculus
tgtctctgtctatttctctctct

SEQ ID NO: 176528 - DNA, 23 bp, Mus musculus
gtatgtgcttgccttttctgttt

SEQ ID NO: 176529 - DNA, 20 bp, Mus musculus
tagctactttttaaaaaagt

SEQ ID NO: 176530 - DNA, 20 bp, Mus musculus
aaacagattacagatagaga

SEQ ID NO: 176531 - DNA, 22 bp, Mus musculus
aggctctgcccttttgaagtgt

SEQ ID NO: 176532 - DNA, 23 bp, Mus musculus
gtgatatttatagactgagccag

SEQ ID NO: 176533 - DNA, 23 bp, Mus musculus
aaatgtatataagtatgtattgt

SEQ ID NO: 176534 - DNA, 23 bp, Mus musculus
tgtgtgtatgttcatgcaggtgt

SEQ ID NO: 176535 - DNA, 23 bp, Mus musculus
tgcatgtgtgtgtgcatgagcat

SEQ ID NO: 176536 - DNA, 19 bp, Mus musculus
tgtctgtgtagggtgtgtg

SEQ ID NO: 176537 - DNA, 21 bp, Mus musculus
ttactctgtcacataaccttc

SEQ ID NO: 176538 - DNA, 21 bp, Mus musculus
ttgagcttatgcaggttttgg

SEQ ID NO: 176539 - DNA, 23 bp, Mus musculus
tctcacagtctctgtgagttcat

SEQ ID NO: 176540 - DNA, 23 bp, Mus musculus
atggtttcaggaagttttcagta

SEQ ID NO: 176541 - DNA, 23 bp, Mus musculus
tgactggcacactcagtcctttg

SEQ ID NO: 176542 - DNA, 22 bp, Mus musculus
tgttttgtgaccaattatatgg

SEQ ID NO: 176543 - DNA, 22 bp, Mus musculus
tgttttgtgaccaattatatgg

SEQ ID NO: 176544 - DNA, 22 bp, Mus musculus
tgttttgtgaccaattatatgg

SEQ ID NO: 176545 - DNA, 23 bp, Mus musculus
gtctgtctgtctgtctgtctgtc

SEQ ID NO: 176546 - DNA, 23 bp, Mus musculus
actagtgtctgaaagttgaaact

SEQ ID NO: 176547 - DNA, 20 bp, Mus musculus
tcactttctctctgtctctc

SEQ ID NO: 176548 - DNA, 23 bp, Mus musculus
tctggtaaagctggatatgttac

SEQ ID NO: 176549 - DNA, 23 bp, Mus musculus
tcagtggctccctcagtggctct

SEQ ID NO: 176550 - DNA, 23 bp, Mus musculus
ttggtgagggtctctctgggcct

SEQ ID NO: 176551 - DNA, 21 bp, Mus musculus
attaacttgtggagctagaga

SEQ ID NO: 176552 - DNA, 21 bp, Mus musculus
ttaagagcactgactgctctt

SEQ ID NO: 176553 - DNA, 21 bp, Mus musculus
ttaagagcactgactgctctt

SEQ ID NO: 176554 - DNA, 19 bp, Mus musculus
ttgctggcattgttagagc

SEQ ID NO: 176555 - DNA, 21 bp, Mus musculus
tagtgagtagtagtactacta

SEQ ID NO: 176556 - DNA, 23 bp, Mus musculus
gcctgcctgtctgcctgtctgcc

SEQ ID NO: 176557 - DNA, 23 bp, Mus musculus
agatcagaagcaagtctctctca

SEQ ID NO: 176558 - DNA, 23 bp, Mus musculus
acccctctgtctctctgagcatc

SEQ ID NO: 176559 - DNA, 21 bp, Mus musculus
tagcctgggtcagtgggaggg

SEQ ID NO: 176560 - DNA, 20 bp, Mus musculus
tgagatgatttgttctaagc

SEQ ID NO: 176561 - DNA, 22 bp, Mus musculus
ttcatatagatttagtatatga

SEQ ID NO: 176562 - DNA, 20 bp, Mus musculus
agagactctggactagaatg

SEQ ID NO: 176563 - DNA, 23 bp, Mus musculus
tgtctgcgtctgtctgtcaattc

SEQ ID NO: 176564 - DNA, 19 bp, Mus musculus
caaagagctcaagaagctg

SEQ ID NO: 176565 - DNA, 23 bp, Mus musculus
tgttcttagttcagtagttaggt

SEQ ID NO: 176566 - DNA, 20 bp, Mus musculus
tccaacactgaatattttgt

SEQ ID NO: 176567 - DNA, 21 bp, Mus musculus
aaagatgctgttccactggag

SEQ ID NO: 176568 - DNA, 23 bp, Mus musculus
agtactgctgctagtctgaaaga

SEQ ID NO: 176569 - DNA, 21 bp, Mus musculus
ctcagtggacaaggtgcttgt

SEQ ID NO: 176570 - DNA, 19 bp, Mus musculus
tgaaagatcagagaccgga

SEQ ID NO: 176571 - DNA, 23 bp, Mus musculus
tgtgtatgtatgtaggtatgtat

SEQ ID NO: 176572 - DNA, 20 bp, Mus musculus
tagatacataggtagagagt

SEQ ID NO: 176573 - DNA, 21 bp, Mus musculus
tccatggtggtctgataggat

SEQ ID NO: 176574 - DNA, 22 bp, Mus musculus
tgttttgtgaccaattatatgg

SEQ ID NO: 176575 - DNA, 23 bp, Mus musculus
gagagaagaaactgtggactttg

SEQ ID NO: 176576 - DNA, 19 bp, Mus musculus
tatgtatatgtacatattc

SEQ ID NO: 176577 - DNA, 22 bp, Mus musculus
atggcacaggcagaaatgagag

SEQ ID NO: 176578 - DNA, 21 bp, Mus musculus
aactgtttctggctaagttgt

SEQ ID NO: 176579 - DNA, 19 bp, Mus musculus
tgtgtatatctatacatat

SEQ ID NO: 176580 - DNA, 20 bp, Mus musculus
ccatagtgatctgataggat

SEQ ID NO: 176581 - DNA, 23 bp, Mus musculus
tgtatgcatatgtgtgtgtgtat

SEQ ID NO: 176582 - DNA, 20 bp, Mus musculus
atatatgtacatatacatgt

SEQ ID NO: 176583 - DNA, 23 bp, Mus musculus
tgtatatgtgcatgttcatgtga

SEQ ID NO: 176584 - DNA, 22 bp, Mus musculus
atgagtgtgtgttcatatgtgt

SEQ ID NO: 176585 - DNA, 23 bp, Mus musculus
tatgcatgtgtatatatataggt

SEQ ID NO: 176586 - DNA, 21 bp, Mus musculus
ttatggatatgtatacacatt

SEQ ID NO: 176587 - DNA, 20 bp, Mus musculus
acctatatacatattcatga

SEQ ID NO: 176588 - DNA, 19 bp, Mus musculus
ctgctcacagtgtgccaga

SEQ ID NO: 176589 - DNA, 23 bp, Mus musculus
tgtctgcatgtgttgtgattttg

SEQ ID NO: 176590 - DNA, 23 bp, Mus musculus
tctctgtctctgtgagaaaacac

SEQ ID NO: 176591 - DNA, 22 bp, Mus musculus
gtatgtatgtatgtatgtatgt

SEQ ID NO: 176592 - DNA, 23 bp, Mus musculus
tgggtctcagcctgtatctcgtc

SEQ ID NO: 176593 - DNA, 23 bp, Mus musculus
tagatgctagttgaagctgtgtt

SEQ ID NO: 176594 - DNA, 22 bp, Mus musculus
tgttttgtgaccaattatatgg

SEQ ID NO: 176595 - DNA, 23 bp, Mus musculus
aatgacagtccttagggattctc

SEQ ID NO: 176596 - DNA, 22 bp, Mus musculus
tctttatatatgtatatgtgta

SEQ ID NO: 176597 - DNA, 23 bp, Mus musculus
atatatatgtacatgctgtgcac

SEQ ID NO: 176598 - DNA, 22 bp, Mus musculus
aaccagagagcactggctgagg

SEQ ID NO: 176599 - DNA, 18 bp, Mus musculus
accctctctgagtctctg

SEQ ID NO: 176600 - DNA, 23 bp, Mus musculus
gcctggctgtgagcaatggtgtt

SEQ ID NO: 176601 - DNA, 23 bp, Mus musculus
tgtgtctgcctgtctgtctgtct

SEQ ID NO: 176602 - DNA, 21 bp, Mus musculus
tcggtagctttgggaccctca

SEQ ID NO: 176603 - DNA, 23 bp, Mus musculus
tgcatgtatgtatgtatgtatgt

SEQ ID NO: 176604 - DNA, 22 bp, Mus musculus
tgtctgtctgtctgtgtactac

SEQ ID NO: 176605 - DNA, 23 bp, Mus musculus
acacagagtaactctctctttct

SEQ ID NO: 176606 - DNA, 23 bp, Mus musculus
actcactctgccagtcagaactc

SEQ ID NO: 176607 - DNA, 23 bp, Mus musculus
ctttgtctggctctgttctgctg

SEQ ID NO: 176608 - DNA, 23 bp, Mus musculus
taaagatacatttccaaatgtca

SEQ ID NO: 176609 - DNA, 23 bp, Mus musculus
atgtgacactttacccatatgta

SEQ ID NO: 176610 - DNA, 19 bp, Mus musculus
gcagggtaggatgtgtgtg

SEQ ID NO: 176611 - DNA, 23 bp, Mus musculus
aatgagattttatttcaatgaga

SEQ ID NO: 176612 - DNA, 23 bp, Mus musculus
tccctcagaacttagagagcact

SEQ ID NO: 176613 - DNA, 23 bp, Mus musculus
aagtcaagtgaaattgttgagtt

SEQ ID NO: 176614 - DNA, 23 bp, Mus musculus
tggagaagggggtgtgtgtgact

SEQ ID NO: 176615 - DNA, 23 bp, Mus musculus
atgtgtgtgcatatacatgtgta

SEQ ID NO: 176616 - DNA, 21 bp, Mus musculus
aataagtctctgcttatcagg

SEQ ID NO: 176617 - DNA, 23 bp, Mus musculus
tatatagagatttacatatctgg

SEQ ID NO: 176618 - DNA, 22 bp, Mus musculus
ttatagtacatatggatatcta

SEQ ID NO: 176619 - DNA, 18 bp, Mus musculus
atagcaatgttctctgca

SEQ ID NO: 176620 - DNA, 18 bp, Mus musculus
tgtgtgcttttgtgtttc

SEQ ID NO: 176621 - DNA, 20 bp, Mus musculus
atattggttattctcagtgc

SEQ ID NO: 176622 - DNA, 23 bp, Mus musculus
gttgtctgtgggagtcattccgc

SEQ ID NO: 176623 - DNA, 23 bp, Mus musculus
atgacagaagaatgagaggtatg

SEQ ID NO: 176624 - DNA, 22 bp, Mus musculus
ttaccattctaacgatttgtca

SEQ ID NO: 176625 - DNA, 22 bp, Mus musculus
agatatataaacatggatagag

SEQ ID NO: 176626 - DNA, 23 bp, Mus musculus
actgtctttatatatatgtgtgt

SEQ ID NO: 176627 - DNA, 23 bp, Mus musculus
tgtatgtatttatgtatgtatgt

SEQ ID NO: 176628 - DNA, 23 bp, Mus musculus
aaaaagtgtttggatttcctatg

SEQ ID NO: 176629 - DNA, 22 bp, Mus musculus
atcagtaggctataggtgtgtg

SEQ ID NO: 176630 - DNA, 22 bp, Mus musculus
tgttttgtgaccaattatatgg

SEQ ID NO: 176631 - DNA, 23 bp, Mus musculus
gggactggagagatggctcagct

SEQ ID NO: 176632 - DNA, 23 bp, Mus musculus
atgtgtgcatgtgtatatatgta

SEQ ID NO: 176633 - DNA, 23 bp, Mus musculus
tctgtctgtctgtctgtctgtct

SEQ ID NO: 176634 - DNA, 23 bp, Mus musculus
caagagcttgaagcagaaaccat

SEQ ID NO: 176635 - DNA, 23 bp, Mus musculus
tgacagtgtcctcactgcgtcct

SEQ ID NO: 176636 - DNA, 20 bp, Mus musculus
tcaggcactgtgtctgacac

SEQ ID NO: 176637 - DNA, 22 bp, Mus musculus
aatacaggcactggctttggag

SEQ ID NO: 176638 - DNA, 23 bp, Mus musculus
tgtgtcactgtgtgtctgtcatg

SEQ ID NO: 176639 - DNA, 23 bp, Mus musculus
tctggaacttgttggttatgtgg

SEQ ID NO: 176640 - DNA, 23 bp, Mus musculus
ttagttacccacactactacgtt

SEQ ID NO: 176641 - DNA, 23 bp, Mus musculus
agtctgtctgtctgtctctgtgt

SEQ ID NO: 176642 - DNA, 23 bp, Mus musculus
cagtcttctgtgtcactgacacc

SEQ ID NO: 176643 - DNA, 21 bp, Mus musculus
tcctgtgttctcaaggagctg

SEQ ID NO: 176644 - DNA, 20 bp, Mus musculus
aactgctgggattaaggtgt

SEQ ID NO: 176645 - DNA, 23 bp, Mus musculus
agttcaaatctcagcaaccacat

SEQ ID NO: 176646 - DNA, 23 bp, Mus musculus
tctggttctctgagactctgaaa

SEQ ID NO: 176647 - DNA, 19 bp, Mus musculus
gaagagcactggctgttct

SEQ ID NO: 176648 - DNA, 19 bp, Mus musculus
agccatggaagtgcagact

SEQ ID NO: 176649 - DNA, 23 bp, Mus musculus
ctgaggtagaagattgtgaattc

SEQ ID NO: 176650 - DNA, 20 bp, Mus musculus
ctctcagccctacatcctgt

SEQ ID NO: 176651 - DNA, 23 bp, Mus musculus
gggtctctgtgtggctgagtctc

SEQ ID NO: 176652 - DNA, 18 bp, Mus musculus
aagctgttgggacttgtg

SEQ ID NO: 176653 - DNA, 20 bp, Mus musculus
tggctatctaaaccttgggt

SEQ ID NO: 176654 - DNA, 19 bp, Mus musculus
aggagggctgcatggttaa

SEQ ID NO: 176655 - DNA, 19 bp, Mus musculus
atgtatgtatgcatgtatg

SEQ ID NO: 176656 - DNA, 23 bp, Mus musculus
tgtctctctctctctctctgggt

SEQ ID NO: 176657 - DNA, 22 bp, Mus musculus
tgttttgtgaccaattatatgg

SEQ ID NO: 176658 - DNA, 23 bp, Mus musculus
gtctgtcagtctgtttgtctgtc

SEQ ID NO: 176659 - DNA, 23 bp, Mus musculus
tgccactgaggtaggctttgagg

SEQ ID NO: 176660 - DNA, 23 bp, Mus musculus
tgactgcagcatcatgagggggt

SEQ ID NO: 176661 - DNA, 23 bp, Mus musculus
tgaactcagtcaacacagagagc

SEQ ID NO: 176662 - DNA, 23 bp, Mus musculus
atatgtgtatctatatgtatgta

SEQ ID NO: 176663 - DNA, 23 bp, Mus musculus
tctcagacactctgtcctttcca

SEQ ID NO: 176664 - DNA, 22 bp, Mus musculus
atgacagcgcagtcagtatggc

SEQ ID NO: 176665 - DNA, 23 bp, Mus musculus
gcatcacacacagtctctgtctc

SEQ ID NO: 176666 - DNA, 23 bp, Mus musculus
ggttcggtgtctgcctctatcac

SEQ ID NO: 176667 - DNA, 23 bp, Mus musculus
tatatgagtaccctgtagctgtc

SEQ ID NO: 176668 - DNA, 23 bp, Mus musculus
tatgtgtgtatatgtatatgtat

SEQ ID NO: 176669 - DNA, 23 bp, Mus musculus
tatgtgtatatatatgtatgtat

SEQ ID NO: 176670 - DNA, 23 bp, Mus musculus
tagctgagcctctgtcactgtct

SEQ ID NO: 176671 - DNA, 21 bp, Mus musculus
tgctgactgctcttccagagg

SEQ ID NO: 176672 - DNA, 22 bp, Mus musculus
tgtagcaacactgactgatttc

SEQ ID NO: 176673 - DNA, 22 bp, Mus musculus
ggcacagttaagttccaggcca

SEQ ID NO: 176674 - DNA, 19 bp, Mus musculus
aaagtctagagagtgtgca

SEQ ID NO: 176675 - DNA, 23 bp, Mus musculus
tcactgcgtctttagtatcacag

SEQ ID NO: 176676 - DNA, 22 bp, Mus musculus
tgtgtatatatgtatatgtgtg

SEQ ID NO: 176677 - DNA, 19 bp, Mus musculus
tgtatgtatgtatatatgc

SEQ ID NO: 176678 - DNA, 19 bp, Mus musculus
tatatgcatgcatgcatgt

SEQ ID NO: 176679 - DNA, 23 bp, Mus musculus
actttgttcatgtacttgtgtgt

SEQ ID NO: 176680 - DNA, 19 bp, Mus musculus
tgtatatatgtatatatgt

SEQ ID NO: 176681 - DNA, 19 bp, Mus musculus
tgtatgtatgtatgtatgt

SEQ ID NO: 176682 - DNA, 23 bp, Mus musculus
tgtgtcactgactggcagacatg

SEQ ID NO: 176683 - DNA, 21 bp, Mus musculus
tggcaggcatggaacacagtg

SEQ ID NO: 176684 - DNA, 22 bp, Mus musculus
tgttttgtgaccaattatatgg

SEQ ID NO: 176685 - DNA, 19 bp, Mus musculus
tgagatcagagtgtgcgca

SEQ ID NO: 176686 - DNA, 23 bp, Mus musculus
tatatgcatgtatacatgcacat

SEQ ID NO: 176687 - DNA, 21 bp, Mus musculus
tatgtatatatgtatatgtat

SEQ ID NO: 176688 - DNA, 23 bp, Mus musculus
actctgtcagtgtttctatttcc

SEQ ID NO: 176689 - DNA, 23 bp, Mus musculus
caactctgtgtctcacttcaacc

SEQ ID NO: 176690 - DNA, 23 bp, Mus musculus
actgtcggtctctggctgagtct

SEQ ID NO: 176691 - DNA, 23 bp, Mus musculus
tgtgcatatgtatgccataccat

SEQ ID NO: 176692 - DNA, 20 bp, Mus musculus
agtgatgtaggtgggaaagg

SEQ ID NO: 176693 - DNA, 21 bp, Mus musculus
tgagtgtagagacagtgcgga

SEQ ID NO: 176694 - DNA, 21 bp, Mus musculus
acagcatcattttcttgccat

SEQ ID NO: 176695 - DNA, 23 bp, Mus musculus
tgtagagtaaacaacctttaggt

SEQ ID NO: 176696 - DNA, 23 bp, Mus musculus
aggtgcatagtagatatgtatgt

SEQ ID NO: 176697 - DNA, 20 bp, Mus musculus
attttctagagagaggctct

SEQ ID NO: 176698 - DNA, 23 bp, Mus musculus
tatgtatgtatgtatatgtatgt

SEQ ID NO: 176699 - DNA, 22 bp, Mus musculus
tgtatgtgtatatgtatatgtg

SEQ ID NO: 176700 - DNA, 23 bp, Mus musculus
atatgcatgtgtatatgtacatg

SEQ ID NO: 176701 - DNA, 23 bp, Mus musculus
acttgagagagtggacagacaga

SEQ ID NO: 176702 - DNA, 22 bp, Mus musculus
tgtgagtctctgagtttcctgt

SEQ ID NO: 176703 - DNA, 23 bp, Mus musculus
tgtatcagagaagaggcaaggct

SEQ ID NO: 176704 - DNA, 23 bp, Mus musculus
cataactctgtcttagctgcatg

SEQ ID NO: 176705 - DNA, 23 bp, Mus musculus
tagagagagtagatggttaactg

SEQ ID NO: 176706 - DNA, 19 bp, Mus musculus
tttggttctctgtctctct

SEQ ID NO: 176707 - DNA, 23 bp, Mus musculus
atgagaagaaattgattacaaat

SEQ ID NO: 176708 - DNA, 23 bp, Mus musculus
tgcctctgcttctagagctgtca

SEQ ID NO: 176709 - DNA, 18 bp, Mus musculus
atgacagaagatagaaag

SEQ ID NO: 176710 - DNA, 22 bp, Mus musculus
gtagaagtggatgtagaaggga

SEQ ID NO: 176711 - DNA, 22 bp, Mus musculus
tgttttgtgaccaattatatgg

SEQ ID NO: 176712 - DNA, 23 bp, Mus musculus
tttaacttgataatcttaagatg

SEQ ID NO: 176713 - DNA, 23 bp, Mus musculus
tgggaatatatatgtttgtgtat

SEQ ID NO: 176714 - DNA, 23 bp, Mus musculus
ttgactgtgagcatctgcatctg

SEQ ID NO: 176715 - DNA, 22 bp, Mus musculus
tgttttgtgaccaattatatgg

SEQ ID NO: 176716 - DNA, 23 bp, Mus musculus
aataggaatgttttgaagaatgc

SEQ ID NO: 176717 - DNA, 23 bp, Mus musculus
taagtctttcaggttctgtttcc

SEQ ID NO: 176718 - DNA, 23 bp, Mus musculus
tgtccacgtgttttctcagtgga

SEQ ID NO: 176719 - DNA, 21 bp, Mus musculus
tatgtatgtatatatgtatgt

SEQ ID NO: 176720 - DNA, 21 bp, Mus musculus
atgttagtagtactgaactgt

SEQ ID NO: 176721 - DNA, 22 bp, Mus musculus
tgttttgtgaccaattatatgg

SEQ ID NO: 176722 - DNA, 23 bp, Mus musculus
acactgtatctcactgtaaccca

SEQ ID NO: 176723 - DNA, 23 bp, Mus musculus
tgtgacatgtggtaaaacatctg

SEQ ID NO: 176724 - DNA, 22 bp, Mus musculus
tcagagtgaagagagagtgctc

SEQ ID NO: 176725 - DNA, 21 bp, Mus musculus
atatgcatatatacatgtata

SEQ ID NO: 176726 - DNA, 23 bp, Mus musculus
cagtgtatttctctcacgtagag

SEQ ID NO: 176727 - DNA, 23 bp, Mus musculus
cgtgtctgtgtctgtgtcacggc

SEQ ID NO: 176728 - DNA, 22 bp, Mus musculus
aggtgacacaaccagcaggtgg

SEQ ID NO: 176729 - DNA, 23 bp, Mus musculus
tctcccactctgcctcagttgcc

SEQ ID NO: 176730 - DNA, 23 bp, Mus musculus
gttgttcagcttccatgtgtatg

SEQ ID NO: 176731 - DNA, 23 bp, Mus musculus
atattgatattgaagatcagctt

SEQ ID NO: 176732 - DNA, 23 bp, Mus musculus
tgtgtctttatctctgtcagctg

SEQ ID NO: 176733 - DNA, 23 bp, Mus musculus
aatctttgcttttcaagctgaaa

SEQ ID NO: 176734 - DNA, 20 bp, Mus musculus
gtgacaagtttgggcactca

SEQ ID NO: 176735 - DNA, 19 bp, Mus musculus
aatgacagggttaatgggg

SEQ ID NO: 176736 - DNA, 23 bp, Mus musculus
tgtctgcctgtctgcctgtctgt

SEQ ID NO: 176737 - DNA, 22 bp, Mus musculus
tgttttgtgaccaattatatgg

SEQ ID NO: 176738 - DNA, 18 bp, Mus musculus
ttttgtatctgttgagtc

SEQ ID NO: 176739 - DNA, 22 bp, Mus musculus
acactgtggttcttcttctggt

SEQ ID NO: 176740 - DNA, 20 bp, Mus musculus
atgtatgtacatgatttatg

SEQ ID NO: 176741 - DNA, 22 bp, Mus musculus
aactcaccgagctttcatgtcc

SEQ ID NO: 176742 - DNA, 22 bp, Mus musculus
agaaatcaaaacttggtggtgt

SEQ ID NO: 176743 - DNA, 22 bp, Mus musculus
ttgtgtgctgtggctcctgagt

SEQ ID NO: 176744 - DNA, 21 bp, Mus musculus
atatgcatatgtttacataga

SEQ ID NO: 176745 - DNA, 23 bp, Mus musculus
catgtgcatatgtatgcatatat

SEQ ID NO: 176746 - DNA, 23 bp, Mus musculus
tgtatatgtgtgtgtatgatatg

SEQ ID NO: 176747 - DNA, 22 bp, Mus musculus
gtgtgcgtatatatatgtgtgt

SEQ ID NO: 176748 - DNA, 21 bp, Mus musculus
ctgactgctcttccagaggtc

SEQ ID NO: 176749 - DNA, 23 bp, Mus musculus
ccagactctgtgtgtgtgtgcgc

SEQ ID NO: 176750 - DNA, 23 bp, Mus musculus
atctgacgctgtcactcacagct

SEQ ID NO: 176751 - DNA, 23 bp, Mus musculus
gatgaaaggaatgatgtatgctg

SEQ ID NO: 176752 - DNA, 19 bp, Mus musculus
tcactgagagtgcatgagg

SEQ ID NO: 176753 - DNA, 18 bp, Mus musculus
tatgtgcatgtatatata

SEQ ID NO: 176754 - DNA, 21 bp, Mus musculus
tgtggattgatgtctgggtca

SEQ ID NO: 176755 - DNA, 22 bp, Mus musculus
tgtatgtatgtgtatatgtaca

SEQ ID NO: 176756 - DNA, 21 bp, Mus musculus
ctgtgtttctaaatatctcct

SEQ ID NO: 176757 - DNA, 23 bp, Mus musculus
taagacaaagtttctttactgag

SEQ ID NO: 176758 - DNA, 18 bp, Mus musculus
acatacacacatatacat

SEQ ID NO: 176759 - DNA, 22 bp, Mus musculus
aaaagatgctggatatgctgac

SEQ ID NO: 176760 - DNA, 22 bp, Mus musculus
tgtggtagtaaggaccagtgtg

SEQ ID NO: 176761 - DNA, 19 bp, Mus musculus
tgtatgtatgtatgtatgc

SEQ ID NO: 176762 - DNA, 19 bp, Mus musculus
tatacatagatgtgtgcac

SEQ ID NO: 176763 - DNA, 18 bp, Mus musculus
agactcacattctgctag

SEQ ID NO: 176764 - DNA, 23 bp, Mus musculus
gcaacagtctctctttctcatta

SEQ ID NO: 176765 - DNA, 18 bp, Mus musculus
gctggcactctgtattcc

SEQ ID NO: 176766 - DNA, 22 bp, Mus musculus
tgttttgtgaccaattatatgg

SEQ ID NO: 176767 - DNA, 23 bp, Mus musculus
actgttgcacttgtgccggccac

SEQ ID NO: 176768 - DNA, 23 bp, Mus musculus
tgagtctctgtctctgcttgatg

SEQ ID NO: 176769 - DNA, 23 bp, Mus musculus
agcttcctccactgagtggctgg

SEQ ID NO: 176770 - DNA, 23 bp, Mus musculus
tacatgtatgtatttatgtatac

SEQ ID NO: 176771 - DNA, 23 bp, Mus musculus
ctgtctagtagctacactctgtc

SEQ ID NO: 176772 - DNA, 22 bp, Mus musculus
tgtgggtgtctttcatgtatgt

SEQ ID NO: 176773 - DNA, 22 bp, Mus musculus
tatctgggtgtatgtatatatg

SEQ ID NO: 176774 - DNA, 23 bp, Mus musculus
tatacacacacatatacatatgt

SEQ ID NO: 176775 - DNA, 23 bp, Mus musculus
gacttctgtcactgtatctggct

SEQ ID NO: 176776 - DNA, 20 bp, Mus musculus
aggggctgtctctgactctg

SEQ ID NO: 176777 - DNA, 23 bp, Mus musculus
agatagatagtacatgtgtttgt

SEQ ID NO: 176778 - DNA, 23 bp, Mus musculus
aacagagagaagagtgacagccc

SEQ ID NO: 176779 - DNA, 23 bp, Mus musculus
actgaggctcacaattagctcag

SEQ ID NO: 176780 - DNA, 23 bp, Mus musculus
acagtcagtcctcagtgagcaga

SEQ ID NO: 176781 - DNA, 23 bp, Mus musculus
tagaatagcagtggatgggaatg

SEQ ID NO: 176782 - DNA, 21 bp, Mus musculus
atgtatgtatatatatgtgca

SEQ ID NO: 176783 - DNA, 23 bp, Mus musculus
tcacactctcagtttatcagact

SEQ ID NO: 176784 - DNA, 21 bp, Mus musculus
agacgttgtaggttgcttata

SEQ ID NO: 176785 - DNA, 19 bp, Mus musculus
agtttgcttttgtatcatt

SEQ ID NO: 176786 - DNA, 23 bp, Mus musculus
gacagtctcactgtgtgttgcag

SEQ ID NO: 176787 - DNA, 22 bp, Mus musculus
tgttttgtgaccaattatatgg

SEQ ID NO: 176788 - DNA, 23 bp, Mus musculus
acagagtcacactttctgttgtc

SEQ ID NO: 176789 - DNA, 22 bp, Mus musculus
tgttttgtgaccaattatatgg

SEQ ID NO: 176790 - DNA, 21 bp, Mus musculus
agagtgacagagttacatctc

SEQ ID NO: 176791 - DNA, 22 bp, Mus musculus
tgttttgtgaccaattatatgg

SEQ ID NO: 176792 - DNA, 21 bp, Mus musculus
ttaaccttattaaagtatact

SEQ ID NO: 176793 - DNA, 23 bp, Mus musculus
aaactgagagtaacctgagtcta

SEQ ID NO: 176794 - DNA, 22 bp, Mus musculus
cagactgactgcatgaagtgtg

SEQ ID NO: 176795 - DNA, 18 bp, Mus musculus
tttgttagttttgcatag

SEQ ID NO: 176796 - DNA, 23 bp, Mus musculus
aagagcaagtttattgaataact

SEQ ID NO: 176797 - DNA, 20 bp, Mus musculus
gtgtgcctgtgtctgtgtct

SEQ ID NO: 176798 - DNA, 22 bp, Mus musculus
tgttttgtgaccaattatatgg

SEQ ID NO: 176799 - DNA, 21 bp, Mus musculus
tcatcatcatcatcatctggt

SEQ ID NO: 176800 - DNA, 19 bp, Mus musculus
accgactggtgtgaggtgg

SEQ ID NO: 176801 - DNA, 23 bp, Mus musculus
tctgacacattttgtttttctga

SEQ ID NO: 176802 - DNA, 22 bp, Mus musculus
tgttttgtgaccaattatatgg

SEQ ID NO: 176803 - DNA, 22 bp, Mus musculus
gttggttctgtggctatgtttt

SEQ ID NO: 176804 - DNA, 21 bp, Mus musculus
acacacacacaaaagttctgt

SEQ ID NO: 176805 - DNA, 23 bp, Mus musculus
atgtatctgagcatgtgcttgtg

SEQ ID NO: 176806 - DNA, 23 bp, Mus musculus
atgtatagagagtccagaggttg

SEQ ID NO: 176807 - DNA, 22 bp, Mus musculus
aattacttctggagctggagag

SEQ ID NO: 176808 - DNA, 23 bp, Mus musculus
catctctcactggatcagagatc

SEQ ID NO: 176809 - DNA, 23 bp, Mus musculus
ttgtgtctcattctgtctgatct

SEQ ID NO: 176810 - DNA, 22 bp, Mus musculus
tcagtagagacagagaacatgg

SEQ ID NO: 176811 - DNA, 23 bp, Mus musculus
gtgtattcatgaatttgtatatg

SEQ ID NO: 176812 - DNA, 23 bp, Mus musculus
ttcaaatctcagcaaccacatgg

SEQ ID NO: 176813 - DNA, 23 bp, Mus musculus
atttgtactacagatatgttatg

SEQ ID NO: 176814 - DNA, 23 bp, Mus musculus
tgcatatatgtatgtatgtgtgt

SEQ ID NO: 176815 - DNA, 19 bp, Mus musculus
agacttgatgtatattcat

SEQ ID NO: 176816 - DNA, 23 bp, Mus musculus
ctctctcagtgagctttggagaa

SEQ ID NO: 176817 - DNA, 23 bp, Mus musculus
tgttctctctgtctgtctgtctg

SEQ ID NO: 176818 - DNA, 23 bp, Mus musculus
tatgtatgtatgtatgtatgtgc

SEQ ID NO: 176819 - DNA, 19 bp, Mus musculus
gtaggggcagagagaatta

SEQ ID NO: 176820 - DNA, 21 bp, Mus musculus
acctcaaccaagttgtactgt

SEQ ID NO: 176821 - DNA, 20 bp, Mus musculus
aacagaaagctagacttgtg

SEQ ID NO: 176822 - DNA, 23 bp, Mus musculus
ctagactgtctcactcactgcct

SEQ ID NO: 176823 - DNA, 23 bp, Mus musculus
tctgcctctccgtctctgtctat

SEQ ID NO: 176824 - DNA, 18 bp, Mus musculus
aggagcatgagtgagggg

SEQ ID NO: 176825 - DNA, 22 bp, Mus musculus
tgagctaaaactgtaatctgta

SEQ ID NO: 176826 - DNA, 23 bp, Mus musculus
aggaagagtacagttttagctca

SEQ ID NO: 176827 - DNA, 23 bp, Mus musculus
cagtgtctgtcagtgtcaagtat

SEQ ID NO: 176828 - DNA, 21 bp, Mus musculus
tgtgtttatatatgtatgtgt

SEQ ID NO: 176829 - DNA, 19 bp, Mus musculus
agagaagaggcagaggtca

SEQ ID NO: 176830 - DNA, 20 bp, Mus musculus
gttcactgctttttctgata

SEQ ID NO: 176831 - DNA, 23 bp, Mus musculus
gtgaatagtcattttcttgttta

SEQ ID NO: 176832 - DNA, 23 bp, Mus musculus
cctctcagtgtctttctctctgc

SEQ ID NO: 176833 - DNA, 19 bp, Mus musculus
ctcactggtctaggaggag

SEQ ID NO: 176834 - DNA, 19 bp, Mus musculus
ctctcaccttgttttctga

SEQ ID NO: 176835 - DNA, 20 bp, Mus musculus
tcagctaagatgaagggcca

SEQ ID NO: 176836 - DNA, 23 bp, Mus musculus
tgtatatgtatatgtatatgtat

SEQ ID NO: 176837 - DNA, 23 bp, Mus musculus
ttctctgtctgtcatttttgtaa

SEQ ID NO: 176838 - DNA, 22 bp, Mus musculus
tagagtgtatatatgtatactg

SEQ ID NO: 176839 - DNA, 19 bp, Mus musculus
aacatgtaatatatgtttg

SEQ ID NO: 176840 - DNA, 22 bp, Mus musculus
tgttttgtgaccaattatatgg

SEQ ID NO: 176841 - DNA, 19 bp, Mus musculus
tgaaggtagacaaagattg

SEQ ID NO: 176842 - DNA, 23 bp, Mus musculus
tgatacatggatatgtatttctg

SEQ ID NO: 176843 - DNA, 23 bp, Mus musculus
ccacactctgtcactggatatca

SEQ ID NO: 176844 - DNA, 22 bp, Mus musculus
tgttttgtgaccaattatatgg

SEQ ID NO: 176845 - DNA, 23 bp, Mus musculus
tgtatatgtgcatgttcatgtgt

SEQ ID NO: 176846 - DNA, 20 bp, Mus musculus
cagtgcatatgtgtaggtac

SEQ ID NO: 176847 - DNA, 21 bp, Mus musculus
tttctcagtgtttgaggtctc

SEQ ID NO: 176848 - DNA, 21 bp, Mus musculus
tgtctggcactgtgtctggca

SEQ ID NO: 176849 - DNA, 23 bp, Mus musculus
tgtaagactccgaccttcagtca

SEQ ID NO: 176850 - DNA, 21 bp, Mus musculus
tttttacttcatggactggag

SEQ ID NO: 176851 - DNA, 22 bp, Mus musculus
ctcatcttgttgcttctagggt

SEQ ID NO: 176852 - DNA, 23 bp, Mus musculus
tataggttgattagcacagtgga

SEQ ID NO: 176853 - DNA, 23 bp, Mus musculus
gaagtgagtcaggtgagtgagtt

SEQ ID NO: 176854 - DNA, 22 bp, Mus musculus
cacacctcagactctgagtctg

SEQ ID NO: 176855 - DNA, 22 bp, Mus musculus
gactgtccctctctgtgtccct

SEQ ID NO: 176856 - DNA, 22 bp, Mus musculus
gtcagaggacaacttgcagtag

SEQ ID NO: 176857 - DNA, 22 bp, Mus musculus
ggttgagattactggaagagca

SEQ ID NO: 176858 - DNA, 23 bp, Mus musculus
gtaaggagaacattctgaaagct

SEQ ID NO: 176859 - DNA, 23 bp, Mus musculus
tattgcagacaggaaaagctgca

SEQ ID NO: 176860 - DNA, 23 bp, Mus musculus
taaaaaagtagctgttattgaga

SEQ ID NO: 176861 - DNA, 22 bp, Mus musculus
cttagtccatggtgatctgata

SEQ ID NO: 176862 - DNA, 23 bp, Mus musculus
acaagcatgtgcctggttgttta

SEQ ID NO: 176863 - DNA, 19 bp, Mus musculus
ttcagcttaaatgtatact

SEQ ID NO: 176864 - DNA, 22 bp, Mus musculus
ttacatgtagatgttagctttt

SEQ ID NO: 176865 - DNA, 19 bp, Mus musculus
tattgacaaaggttaggta

SEQ ID NO: 176866 - DNA, 23 bp, Mus musculus
agcgtctcacactctatcttctg

SEQ ID NO: 176867 - DNA, 20 bp, Mus musculus
ctgtccctgcgaggttgcca

SEQ ID NO: 176868 - DNA, 21 bp, Mus musculus
aatgctgttattcctgtttga

SEQ ID NO: 176869 - DNA, 23 bp, Mus musculus
tggttgtggttgtaggttctaaa

SEQ ID NO: 176870 - DNA, 23 bp, Mus musculus
tgtgtctttttcactgtctgctc

SEQ ID NO: 176871 - DNA, 20 bp, Mus musculus
atgtaaatatatatatgtgt

SEQ ID NO: 176872 - DNA, 21 bp, Mus musculus
tctgtgaattctgttgcttct

SEQ ID NO: 176873 - DNA, 21 bp, Mus musculus
ttcctagaaggttggaaagtt

SEQ ID NO: 176874 - DNA, 21 bp, Mus musculus
agtcagagctgtaaagtgtct

SEQ ID NO: 176875 - DNA, 23 bp, Mus musculus
cattggtcttactgtctgtcact

SEQ ID NO: 176876 - DNA, 21 bp, Mus musculus
tttgagcaagaccatttgctg

SEQ ID NO: 176877 - DNA, 23 bp, Mus musculus
tcaggtacaatgtcttagcagtt

SEQ ID NO: 176878 - DNA, 19 bp, Mus musculus
acgtatgtatatttgtgtg

SEQ ID NO: 176879 - DNA, 23 bp, Mus musculus
tgagtgtgtctcagtggcagaat

SEQ ID NO: 176880 - DNA, 18 bp, Mus musculus
atagtggtctgataggat

SEQ ID NO: 176881 - DNA, 22 bp, Mus musculus
tgttttgtgaccaattatatgg

SEQ ID NO: 176882 - DNA, 22 bp, Mus musculus
gtgtgcgtgtgtgtgcacgtga

SEQ ID NO: 176883 - DNA, 23 bp, Mus musculus
tccctgtagatttgataggctgc

SEQ ID NO: 176884 - DNA, 23 bp, Mus musculus
atgtatgtatgtatgtatgtatg

SEQ ID NO: 176885 - DNA, 23 bp, Mus musculus
atgactgtatatacgtatgtatg

SEQ ID NO: 176886 - DNA, 22 bp, Mus musculus
aattgcaactttgtgtggctga

SEQ ID NO: 176887 - DNA, 23 bp, Mus musculus
tgtaagagcaacatcatgtgttt

SEQ ID NO: 176888 - DNA, 23 bp, Mus musculus
tgcctcagtgcctctgtgcttcc

SEQ ID NO: 176889 - DNA, 22 bp, Mus musculus
tgttttgtgaccaattatatgg

SEQ ID NO: 176890 - DNA, 21 bp, Mus musculus
cagctgcagaaaaactaaaga

SEQ ID NO: 176891 - DNA, 20 bp, Mus musculus
tacttacaatagatatgaaa

SEQ ID NO: 176892 - DNA, 20 bp, Mus musculus
taaatttcttgatgtaattg

SEQ ID NO: 176893 - DNA, 20 bp, Mus musculus
tggtggtctgatagaataca

SEQ ID NO: 176894 - DNA, 22 bp, Mus musculus
tgttttgtgaccaattatatgg

SEQ ID NO: 176895 - DNA, 23 bp, Mus musculus
tagtgcatggtgatctgatagga

SEQ ID NO: 176896 - DNA, 22 bp, Mus musculus
tgttttgtgacctattatgtgg

SEQ ID NO: 176897 - DNA, 21 bp, Mus musculus
aaaagaactttatctaattga

SEQ ID NO: 176898 - DNA, 23 bp, Mus musculus
tagtccatggtgatctgatagga

SEQ ID NO: 176899 - DNA, 23 bp, Mus musculus
agagatgaacttcagtagtagat

SEQ ID NO: 176900 - DNA, 23 bp, Mus musculus
ttcaaatgtggaagacttgagaa

SEQ ID NO: 176901 - DNA, 23 bp, Mus musculus
cacacccagtctgtgtgtgtgtg

SEQ ID NO: 176902 - DNA, 22 bp, Mus musculus
tgttttgtgaccaattatatgg

SEQ ID NO: 176903 - DNA, 23 bp, Mus musculus
atagcttaagaattgtatattca

SEQ ID NO: 176904 - DNA, 21 bp, Mus musculus
taagagcactgactgctcttc

SEQ ID NO: 176905 - DNA, 22 bp, Mus musculus
tgttttgtgaccaattatatgg

SEQ ID NO: 176906 - DNA, 18 bp, Mus musculus
ttagtctcccaaattgcc

SEQ ID NO: 176907 - DNA, 23 bp, Mus musculus
tggctctggctgactgactcagt

SEQ ID NO: 176908 - DNA, 23 bp, Mus musculus
tattgttctacaactggatctct

SEQ ID NO: 176909 - DNA, 23 bp, Mus musculus
tacactgtgactgtgcttcttgt

SEQ ID NO: 176910 - DNA, 20 bp, Mus musculus
tttcctcttgatgcatataa

SEQ ID NO: 176911 - DNA, 18 bp, Mus musculus
tggcttttgtatttcagt

SEQ ID NO: 176912 - DNA, 22 bp, Mus musculus
tgttttgtgaccaattatatgg

SEQ ID NO: 176913 - DNA, 18 bp, Mus musculus
actgagtcaagagtcctg

SEQ ID NO: 176914 - DNA, 22 bp, Mus musculus
tgttttgtgaccaattatatgg

SEQ ID NO: 176915 - DNA, 22 bp, Mus musculus
tgttttgtgaccaattatatgg

SEQ ID NO: 176916 - DNA, 19 bp, Mus musculus
tctccatttccatccctat

SEQ ID NO: 176917 - DNA, 22 bp, Mus musculus
tgacatctctgtgtgtcagcag

SEQ ID NO: 176918 - DNA, 21 bp, Mus musculus
agtgtacaattaatatgcatt

SEQ ID NO: 176919 - DNA, 23 bp, Mus musculus
ggtgagagtgcacagagtgtaga

SEQ ID NO: 176920 - DNA, 18 bp, Mus musculus
actcaagtgtttcccctg

SEQ ID NO: 176921 - DNA, 23 bp, Mus musculus
cagtgtgtgtgtgtctgtatctg

SEQ ID NO: 176922 - DNA, 20 bp, Mus musculus
acatgtgcatgtatatgcct

SEQ ID NO: 176923 - DNA, 23 bp, Mus musculus
agagatgttgagcgactgctgtg

SEQ ID NO: 176924 - DNA, 23 bp, Mus musculus
actctctcagtgaaatgctgctt

SEQ ID NO: 176925 - DNA, 23 bp, Mus musculus
ttgtcactgtcctatgcatttcc

SEQ ID NO: 176926 - DNA, 20 bp, Mus musculus
tatggctatggctatggctg

SEQ ID NO: 176927 - DNA, 23 bp, Mus musculus
ctctctctgagtctcagtttccc

SEQ ID NO: 176928 - DNA, 22 bp, Mus musculus
tgttttgtgaccaattatatgg

SEQ ID NO: 176929 - DNA, 23 bp, Mus musculus
tctttcactttgagctatggtgg

SEQ ID NO: 176930 - DNA, 23 bp, Mus musculus
ggagagactgactctgtgcctct

SEQ ID NO: 176931 - DNA, 23 bp, Mus musculus
tgtgtgtgtgtatatgtatatat

SEQ ID NO: 176932 - DNA, 23 bp, Mus musculus
catttctacaagaaggacaggtg

SEQ ID NO: 176933 - DNA, 22 bp, Mus musculus
atgtatgtaagcatgtatgtag

SEQ ID NO: 176934 - DNA, 22 bp, Mus musculus
taaatacacacatatgtgtgta

SEQ ID NO: 176935 - DNA, 23 bp, Mus musculus
ttgaaacagtctgaatatctgca

SEQ ID NO: 176936 - DNA, 23 bp, Mus musculus
atatgtgtgtgcatgtgcatgtg

SEQ ID NO: 176937 - DNA, 21 bp, Mus musculus
agacagtctgacaagtttgaa

SEQ ID NO: 176938 - DNA, 21 bp, Mus musculus
tatgcatgtatgtatgtatgt

SEQ ID NO: 176939 - DNA, 23 bp, Mus musculus
tgtctggcactgtctcatttgta

SEQ ID NO: 176940 - DNA, 22 bp, Mus musculus
gactacaatgatttcgctgctg

SEQ ID NO: 176941 - DNA, 22 bp, Mus musculus
tgtgtgtgtgcacactgtgtct

SEQ ID NO: 176942 - DNA, 22 bp, Mus musculus
tgttttgtgaccaattatatgg

SEQ ID NO: 176943 - DNA, 21 bp, Mus musculus
gtatatgtgtatgtatatgta

SEQ ID NO: 176944 - DNA, 21 bp, Mus musculus
tgtgtatatatatgtatgtat

SEQ ID NO: 176945 - DNA, 20 bp, Mus musculus
tatgtctatatctatatctc

SEQ ID NO: 176946 - DNA, 21 bp, Mus musculus
tgttaggttcttgtagttcag

SEQ ID NO: 176947 - DNA, 22 bp, Mus musculus
atatatgtatatgtacatatgt

SEQ ID NO: 176948 - DNA, 23 bp, Mus musculus
tgtcacagtcactatgagttcac

SEQ ID NO: 176949 - DNA, 23 bp, Mus musculus
tgtgagtatctgcatctgcattg

SEQ ID NO: 176950 - DNA, 21 bp, Mus musculus
tgtctgtctgtctgcctgcct

SEQ ID NO: 176951 - DNA, 23 bp, Mus musculus
gtgtgtgtgtgtgcatgtgtgta

SEQ ID NO: 176952 - DNA, 19 bp, Mus musculus
gtgtgctattatgttttgt

SEQ ID NO: 176953 - DNA, 23 bp, Mus musculus
aggctgaggaagatggttctgtt

SEQ ID NO: 176954 - DNA, 23 bp, Mus musculus
ctacatccagacactgaatgagt

SEQ ID NO: 176955 - DNA, 21 bp, Mus musculus
aaatcctatagtcatcactca

SEQ ID NO: 176956 - DNA, 23 bp, Mus musculus
cctctgtctcagtgagttgaccc

SEQ ID NO: 176957 - DNA, 23 bp, Mus musculus
ctcactcctctcactctgtgacc

SEQ ID NO: 176958 - DNA, 19 bp, Mus musculus
tatcagcgaagtctgaagg

SEQ ID NO: 176959 - DNA, 23 bp, Mus musculus
ccagtgaacagtgacatttgaga

SEQ ID NO: 176960 - DNA, 22 bp, Mus musculus
acaaacagcaacaggagctgca

SEQ ID NO: 176961 - DNA, 23 bp, Mus musculus
tacatgtttaatgtgtgtgtata

SEQ ID NO: 176962 - DNA, 22 bp, Mus musculus
tccccgtgggtgagttctgacc

SEQ ID NO: 176963 - DNA, 22 bp, Mus musculus
atgcctcttcaacgggtgctca

SEQ ID NO: 176964 - DNA, 23 bp, Mus musculus
tctgagtctctgtgactgtggga

SEQ ID NO: 176965 - DNA, 23 bp, Mus musculus
tttgtgtgcatgtacatgtgtgt

SEQ ID NO: 176966 - DNA, 23 bp, Mus musculus
atttatgtgtacatgcacacaca

SEQ ID NO: 176967 - DNA, 23 bp, Mus musculus
tgtgtgtgtatatatatatgtgt

SEQ ID NO: 176968 - DNA, 20 bp, Mus musculus
aagagcactgactgctcttc

SEQ ID NO: 176969 - DNA, 23 bp, Mus musculus
caaccctgtgtgtgagagagccg

SEQ ID NO: 176970 - DNA, 22 bp, Mus musculus
tgtatctgtgtgcaatagagct

SEQ ID NO: 176971 - DNA, 23 bp, Mus musculus
tctgggtcaggctttcttctggg

SEQ ID NO: 176972 - DNA, 18 bp, Mus musculus
ttgcagctgacaggcatt

SEQ ID NO: 176973 - DNA, 23 bp, Mus musculus
aaaagtagactgtgtgctcagct

SEQ ID NO: 176974 - DNA, 23 bp, Mus musculus
tgtgtatgtgtatatgatgtgta

SEQ ID NO: 176975 - DNA, 23 bp, Mus musculus
atgtatatatgtatatatgtata

SEQ ID NO: 176976 - DNA, 22 bp, Mus musculus
gtgcatgcgtgcgtgcgtgtgt

SEQ ID NO: 176977 - DNA, 19 bp, Mus musculus
atatgtttgtttgtaaatg

SEQ ID NO: 176978 - DNA, 23 bp, Mus musculus
tatatgtatatatagatgtgtgt

SEQ ID NO: 176979 - DNA, 23 bp, Mus musculus
tatgtatatgtgtacatgtgtgt

SEQ ID NO: 176980 - DNA, 23 bp, Mus musculus
tatatgtgtgtatgtatatatgt

SEQ ID NO: 176981 - DNA, 21 bp, Mus musculus
atatatgtatatatgtacaag

SEQ ID NO: 176982 - DNA, 23 bp, Mus musculus
tatgtgtgtatatatatgtgtgt

SEQ ID NO: 176983 - DNA, 18 bp, Mus musculus
gttgtgagagaggacaca

SEQ ID NO: 176984 - DNA, 23 bp, Mus musculus
tcgctcgctcgctcgctcggaga

SEQ ID NO: 176985 - DNA, 20 bp, Mus musculus
atgtatgtatacatatgtgt

SEQ ID NO: 176986 - DNA, 23 bp, Mus musculus
tttggctctggtagttgtttgtc

SEQ ID NO: 176987 - DNA, 23 bp, Mus musculus
tatgtcacagtagcctgtgtgct

SEQ ID NO: 176988 - DNA, 23 bp, Mus musculus
ttgagacagtctcacactgggtc

SEQ ID NO: 176989 - DNA, 23 bp, Mus musculus
gtctgtatctcagtgggtttgtg

SEQ ID NO: 176990 - DNA, 21 bp, Mus musculus
ggtagtagaggggctggtgag

SEQ ID NO: 176991 - DNA, 18 bp, Mus musculus
atgctcctgtgcatgtgt

SEQ ID NO: 176992 - DNA, 23 bp, Mus musculus
ctctgtgtgtgcatgtgcatgtg

SEQ ID NO: 176993 - DNA, 23 bp, Mus musculus
tcagcctgtcactcagtttgagc

SEQ ID NO: 176994 - DNA, 18 bp, Mus musculus
gtatgtatgtatgtatgt

SEQ ID NO: 176995 - DNA, 23 bp, Mus musculus
atgcttgcagagacagaaatcac

SEQ ID NO: 176996 - DNA, 23 bp, Mus musculus
tctgggagtctgtttctgtcagt

SEQ ID NO: 176997 - DNA, 23 bp, Mus musculus
actgctgcatttgaaaccgctca

SEQ ID NO: 176998 - DNA, 23 bp, Mus musculus
tgtgtgcatgtgtttgtgtgtgt

SEQ ID NO: 176999 - DNA, 23 bp, Mus musculus
tgtggtcagtctgtctcagcctg

SEQ ID NO: 177000 - DNA, 21 bp, Mus musculus
tgtatgtgtgtgtgaatgtgc

SEQ ID NO: 177001 - DNA, 21 bp, Mus musculus
gttgtagatggttttattgtc

SEQ ID NO: 177002 - DNA, 23 bp, Mus musculus
tttcaggtagatggtttttaagt

SEQ ID NO: 177003 - DNA, 23 bp, Mus musculus
cttctgagttgtgcaagtgcaga

SEQ ID NO: 177004 - DNA, 22 bp, Mus musculus
gtgtgtatatatgcatgtgtgt

SEQ ID NO: 177005 - DNA, 23 bp, Mus musculus
tatgccatatctgtctgtctctg

SEQ ID NO: 177006 - DNA, 19 bp, Mus musculus
gagagaagacagacaccag

SEQ ID NO: 177007 - DNA, 22 bp, Mus musculus
taagcctttgttgccattttga

SEQ ID NO: 177008 - DNA, 23 bp, Mus musculus
tcagtctgtctgtcttctctgat

SEQ ID NO: 177009 - DNA, 23 bp, Mus musculus
tcagccagtgctcctggtccacc

SEQ ID NO: 177010 - DNA, 21 bp, Mus musculus
actcagacacactcactgttg

SEQ ID NO: 177011 - DNA, 23 bp, Mus musculus
gctctgtctgagttcctgcctga

SEQ ID NO: 177012 - DNA, 23 bp, Mus musculus
tcactctgttactgtctcctagc

SEQ ID NO: 177013 - DNA, 23 bp, Mus musculus
tgtgtttgcagaatatgaagatc

SEQ ID NO: 177014 - DNA, 23 bp, Mus musculus
aacttccaggatatgttaatcaa

SEQ ID NO: 177015 - DNA, 23 bp, Mus musculus
gtatgtgtgtgtgtgtgtgcgcg

SEQ ID NO: 177016 - DNA, 21 bp, Mus musculus
tactgactgttctctctgtgc

SEQ ID NO: 177017 - DNA, 23 bp, Mus musculus
aatgtcactgcctctgttcagtg

SEQ ID NO: 177018 - DNA, 23 bp, Mus musculus
agcactgtcagtctctgtgccat

SEQ ID NO: 177019 - DNA, 21 bp, Mus musculus
tggagcatgagtttctgcagt

SEQ ID NO: 177020 - DNA, 22 bp, Mus musculus
aatgtgtctgaagggaaagagt

SEQ ID NO: 177021 - DNA, 23 bp, Mus musculus
tgccactgcctgatgtcagcgct

SEQ ID NO: 177022 - DNA, 23 bp, Mus musculus
tatatgtgcatgtgcatgggtat

SEQ ID NO: 177023 - DNA, 20 bp, Mus musculus
tccatgtgtccattgctggt

SEQ ID NO: 177024 - DNA, 23 bp, Mus musculus
tgtatgtatgcgtgtgtgtatat

SEQ ID NO: 177025 - DNA, 23 bp, Mus musculus
tgtgtctgtctgtctgtctgtct

SEQ ID NO: 177026 - DNA, 23 bp, Mus musculus
tgtagaaagtgtgtgatgatagg

SEQ ID NO: 177027 - DNA, 23 bp, Mus musculus
tgtctgtctgtctgtctgtctct

SEQ ID NO: 177028 - DNA, 23 bp, Mus musculus
gttacagcaagaggaagtgaaag

SEQ ID NO: 177029 - DNA, 21 bp, Mus musculus
cagtggctggctcagtctctc

SEQ ID NO: 177030 - DNA, 19 bp, Mus musculus
atacacatgtagatataca

SEQ ID NO: 177031 - DNA, 23 bp, Mus musculus
tcagtcacgctctgagtacttac

SEQ ID NO: 177032 - DNA, 23 bp, Mus musculus
tcttcagagcagtctctacttta

SEQ ID NO: 177033 - DNA, 23 bp, Mus musculus
tgagtgcgtgtgtgcgtgcctgt

SEQ ID NO: 177034 - DNA, 18 bp, Mus musculus
tagatgaggggacagggt

SEQ ID NO: 177035 - DNA, 23 bp, Mus musculus
tctgtctctctgtctgactgttt

SEQ ID NO: 177036 - DNA, 23 bp, Mus musculus
tcatgggtaagacaggacacagg

SEQ ID NO: 177037 - DNA, 23 bp, Mus musculus
tctgaggttgtagtttgttctgt

SEQ ID NO: 177038 - DNA, 18 bp, Mus musculus
tcagagggaagtgttggg

SEQ ID NO: 177039 - DNA, 19 bp, Mus musculus
atgtgcttgtgtattgtgt

SEQ ID NO: 177040 - DNA, 22 bp, Mus musculus
tgtatgtcagtgaatcatgtgg

SEQ ID NO: 177041 - DNA, 19 bp, Mus musculus
aacaatgtctgctgtttgt

SEQ ID NO: 177042 - DNA, 23 bp, Mus musculus
tcagacactctcagatgttgttc

SEQ ID NO: 177043 - DNA, 18 bp, Mus musculus
tgattctgtgtctctcag

SEQ ID NO: 177044 - DNA, 23 bp, Mus musculus
atctagatcttgaggtgggaaga

SEQ ID NO: 177045 - DNA, 18 bp, Mus musculus
ctctgcctcagtgtctgc

SEQ ID NO: 177046 - DNA, 22 bp, Mus musculus
atgtttgtgtgcatgtgtatgt

SEQ ID NO: 177047 - DNA, 21 bp, Mus musculus
tatatggttgtgtatgtgcat

SEQ ID NO: 177048 - DNA, 23 bp, Mus musculus
tatgtgtgtatatatatatgtgt

SEQ ID NO: 177049 - DNA, 22 bp, Mus musculus
ttttttctctgtgtgtgagcac

SEQ ID NO: 177050 - DNA, 23 bp, Mus musculus
tatattgtaattcatagcagtat

SEQ ID NO: 177051 - DNA, 22 bp, Mus musculus
gtctgtctgtctgtgtgggagt

SEQ ID NO: 177052 - DNA, 23 bp, Mus musculus
tgtcagtatatgtgtgtgtgtgt

SEQ ID NO: 177053 - DNA, 21 bp, Mus musculus
tgtgtgtgcatgctcatgcat

SEQ ID NO: 177054 - DNA, 21 bp, Mus musculus
atgtttgtgtgcatgtgcatg

SEQ ID NO: 177055 - DNA, 23 bp, Mus musculus
tggctgaggcactctctgcctgt

SEQ ID NO: 177056 - DNA, 23 bp, Mus musculus
tctgtctgcctgtctgtctgcct

SEQ ID NO: 177057 - DNA, 23 bp, Mus musculus
gtctgtgtgtctgtgggacggtc

SEQ ID NO: 177058 - DNA, 23 bp, Mus musculus
tgttgaagatgctgtctcttctc

SEQ ID NO: 177059 - DNA, 23 bp, Mus musculus
tttgtgagaactcagacagcagt

SEQ ID NO: 177060 - DNA, 19 bp, Mus musculus
ccctgtgatctgaggttga

SEQ ID NO: 177061 - DNA, 23 bp, Mus musculus
tgtgcttgaatgctgtgttgatg

SEQ ID NO: 177062 - DNA, 23 bp, Mus musculus
aagacacatgtgagagagcacac

SEQ ID NO: 177063 - DNA, 23 bp, Mus musculus
gctcgctcgctctctcgctcatt

SEQ ID NO: 177064 - DNA, 23 bp, Mus musculus
tcagccagagacaggactaggac

SEQ ID NO: 177065 - DNA, 23 bp, Mus musculus
gtgtccctctcttcctctgtcac

SEQ ID NO: 177066 - DNA, 23 bp, Mus musculus
cacagtagtgactgtgcagagag

SEQ ID NO: 177067 - DNA, 21 bp, Mus musculus
ggaaagaactaacagagaatg

SEQ ID NO: 177068 - DNA, 20 bp, Mus musculus
agaggtagttctttaggtca

SEQ ID NO: 177069 - DNA, 21 bp, Mus musculus
ttttcaaggattttttttcta

SEQ ID NO: 177070 - DNA, 23 bp, Mus musculus
tatttattgatccattctaaaaa

SEQ ID NO: 177071 - DNA, 23 bp, Mus musculus
gtaactcctgtaatagttctgag

SEQ ID NO: 177072 - DNA, 23 bp, Mus musculus
ttaggatgaaatgttttgtatat

SEQ ID NO: 177073 - DNA, 23 bp, Mus musculus
ctcagtccatttgttgtctgtaa

SEQ ID NO: 177074 - DNA, 21 bp, Mus musculus
atagggaaagaaagaactgag

SEQ ID NO: 177075 - DNA, 23 bp, Mus musculus
tccatagcaatgtactctgtttc

SEQ ID NO: 177076 - DNA, 22 bp, Mus musculus
tatatgtctatttgcatacatg

SEQ ID NO: 177077 - DNA, 22 bp, Mus musculus
tattatgtataaatagcattga

SEQ ID NO: 177078 - DNA, 23 bp, Mus musculus
tatgtgtgtgtatatgtatatat

SEQ ID NO: 177079 - DNA, 22 bp, Mus musculus
tgttttgtgaccaattatatgg

SEQ ID NO: 177080 - DNA, 23 bp, Mus musculus
tatctgtctctgtaacttgtcag

SEQ ID NO: 177081 - DNA, 22 bp, Mus musculus
tgactcagtggttaagagcact

SEQ ID NO: 177082 - DNA, 22 bp, Mus musculus
atgacagatcagagagaagtgg

SEQ ID NO: 177083 - DNA, 22 bp, Mus musculus
tcagaaactgctctctttctgt

SEQ ID NO: 177084 - DNA, 23 bp, Mus musculus
atatctagatatctgtatctatc

SEQ ID NO: 177085 - DNA, 18 bp, Mus musculus
ttggagtggccctctaga

SEQ ID NO: 177086 - DNA, 23 bp, Mus musculus
aacataacagatgtgagagacca

SEQ ID NO: 177087 - DNA, 23 bp, Mus musculus
ttctctcacacagttacttgtat

SEQ ID NO: 177088 - DNA, 23 bp, Mus musculus
actgtgtctctgtttagtttctg

SEQ ID NO: 177089 - DNA, 23 bp, Mus musculus
ttttaggatgtgcaagttttgat

SEQ ID NO: 177090 - DNA, 23 bp, Mus musculus
acacatgacagtgtgcagaccat

SEQ ID NO: 177091 - DNA, 22 bp, Mus musculus
ttgggctatgggtgttgtcagt

SEQ ID NO: 177092 - DNA, 20 bp, Mus musculus
atctgatcctgtttagcttt

SEQ ID NO: 177093 - DNA, 20 bp, Mus musculus
tgtatacatgcatatgtgtg

SEQ ID NO: 177094 - DNA, 21 bp, Mus musculus
tatgtatgtatgtatatgtgt

SEQ ID NO: 177095 - DNA, 23 bp, Mus musculus
aacacacttgtctctgtcactct

SEQ ID NO: 177096 - DNA, 20 bp, Mus musculus
tcctgcactttgaggacatt

SEQ ID NO: 177097 - DNA, 23 bp, Mus musculus
agtgcatggtgatctgataggat

SEQ ID NO: 177098 - DNA, 22 bp, Mus musculus
tgttttgtgacctattatgtgg

SEQ ID NO: 177099 - DNA, 23 bp, Mus musculus
tgtgtgtgtgtgtgtgtatgcat

SEQ ID NO: 177100 - DNA, 23 bp, Mus musculus
ctcagtcacagtgtggttacatg

SEQ ID NO: 177101 - DNA, 23 bp, Mus musculus
ctgagaggaacattatccctcca

SEQ ID NO: 177102 - DNA, 23 bp, Mus musculus
tagtgcatggtgatctgatagga

SEQ ID NO: 177103 - DNA, 22 bp, Mus musculus
tgttttgtgacctattatgtgg

SEQ ID NO: 177104 - DNA, 23 bp, Mus musculus
atgataggaccaagttggttgtg

SEQ ID NO: 177105 - DNA, 23 bp, Mus musculus
tctccatgtattgtctttttggt

SEQ ID NO: 177106 - DNA, 23 bp, Mus musculus
ctctttcacactgatattggaga

SEQ ID NO: 177107 - DNA, 20 bp, Mus musculus
tctatactctccaaatctga

SEQ ID NO: 177108 - DNA, 23 bp, Mus musculus
tatactatgtatatgcatacata

SEQ ID NO: 177109 - DNA, 23 bp, Mus musculus
gcagactctgacactctggggta

SEQ ID NO: 177110 - DNA, 23 bp, Mus musculus
tagtccatggtgatctgatagga

SEQ ID NO: 177111 - DNA, 18 bp, Mus musculus
atatgacacttgtatgga

SEQ ID NO: 177112 - DNA, 21 bp, Mus musculus
atgtatgtatgtatatgtata

SEQ ID NO: 177113 - DNA, 23 bp, Mus musculus
gctctgagcttcaggaatgcagc

SEQ ID NO: 177114 - DNA, 23 bp, Mus musculus
tagtccatggtgatctgatagga

SEQ ID NO: 177115 - DNA, 22 bp, Mus musculus
tgttttgtgaccaattatatgg

SEQ ID NO: 177116 - DNA, 20 bp, Mus musculus
agtggatgctgagtgagtgt

SEQ ID NO: 177117 - DNA, 22 bp, Mus musculus
atattcttgagggagctggaga

SEQ ID NO: 177118 - DNA, 22 bp, Mus musculus
tgccttggaattgttctgaatc

SEQ ID NO: 177119 - DNA, 20 bp, Mus musculus
atacacacacatatacatat

SEQ ID NO: 177120 - DNA, 23 bp, Mus musculus
tgtgagtgtgtgtgtgtcagtga

SEQ ID NO: 177121 - DNA, 23 bp, Mus musculus
tctacctgtctgtctgtctgtct

SEQ ID NO: 177122 - DNA, 18 bp, Mus musculus
acagtagtgattttgttc

SEQ ID NO: 177123 - DNA, 23 bp, Mus musculus
atatgtatatatgtatatgtgtg

SEQ ID NO: 177124 - DNA, 23 bp, Mus musculus
tgtatgtatgtatgtatgtatgt

SEQ ID NO: 177125 - DNA, 23 bp, Mus musculus
tgtgacagaggatgatctttttg

SEQ ID NO: 177126 - DNA, 19 bp, Mus musculus
ctctcttgagtaggtgtac

SEQ ID NO: 177127 - DNA, 23 bp, Mus musculus
gcatgtgtgtgtgcttgtgcatg

SEQ ID NO: 177128 - DNA, 23 bp, Mus musculus
atatgttcatgcacacacaccag

SEQ ID NO: 177129 - DNA, 19 bp, Mus musculus
taactacctgtaagtcagt

SEQ ID NO: 177130 - DNA, 23 bp, Mus musculus
gtaagagatcagtctgtgctcag

SEQ ID NO: 177131 - DNA, 23 bp, Mus musculus
ctgtgagtatctccatctgtatt

SEQ ID NO: 177132 - DNA, 23 bp, Mus musculus
acatacacacacatatatataag

SEQ ID NO: 177133 - DNA, 23 bp, Mus musculus
atatgtaattatatatgtgtgtg

SEQ ID NO: 177134 - DNA, 21 bp, Mus musculus
tatgtatgtatgtatgtatgt

SEQ ID NO: 177135 - DNA, 19 bp, Mus musculus
tatgcatatatatacatat

SEQ ID NO: 177136 - DNA, 23 bp, Mus musculus
atttatggaagtgattggataga

SEQ ID NO: 177137 - DNA, 23 bp, Mus musculus
aagtatttctatctatttatgaa

SEQ ID NO: 177138 - DNA, 19 bp, Mus musculus
tagaatgaattgcgtagag

SEQ ID NO: 177139 - DNA, 23 bp, Mus musculus
actgtttgtcattttgttcattt

SEQ ID NO: 177140 - DNA, 21 bp, Mus musculus
cctatgcttttgtagcagcat

SEQ ID NO: 177141 - DNA, 21 bp, Mus musculus
tgtgcatatgagtatgtgtgt

SEQ ID NO: 177142 - DNA, 23 bp, Mus musculus
atatgtatatatgtatttgtgtg

SEQ ID NO: 177143 - DNA, 22 bp, Mus musculus
atatgtgtatatgtgtatgtgt

SEQ ID NO: 177144 - DNA, 23 bp, Mus musculus
tatgtgtgtgtatatatgtgtgt

SEQ ID NO: 177145 - DNA, 23 bp, Mus musculus
atgtatgtatatatgtgtgtgtg

SEQ ID NO: 177146 - DNA, 22 bp, Mus musculus
tgttttgtgaccaattatatgg

SEQ ID NO: 177147 - DNA, 23 bp, Mus musculus
aagaccagacagagaaggcatga

SEQ ID NO: 177148 - DNA, 22 bp, Mus musculus
tatgtctgtctgtctgtctgtc

SEQ ID NO: 177149 - DNA, 22 bp, Mus musculus
tcagaactttgtaattcagatt

SEQ ID NO: 177150 - DNA, 23 bp, Mus musculus
aatgactgtagtaatgaattgga

SEQ ID NO: 177151 - DNA, 23 bp, Mus musculus
tctaaagatctaaatgtatagaa

SEQ ID NO: 177152 - DNA, 23 bp, Mus musculus
tcatcaaggaattgtgtgtgtgt

SEQ ID NO: 177153 - DNA, 21 bp, Mus musculus
ttatctatgatgaaagctgaa

SEQ ID NO: 177154 - DNA, 21 bp, Mus musculus
tatgcataagtatatctttct

SEQ ID NO: 177155 - DNA, 19 bp, Mus musculus
tatagatagatatacatat

SEQ ID NO: 177156 - DNA, 21 bp, Mus musculus
tatgagggtcaatatgtggct

SEQ ID NO: 177157 - DNA, 23 bp, Mus musculus
agtgtttgtatatatatatgtgt

SEQ ID NO: 177158 - DNA, 23 bp, Mus musculus
taatatgtatatgtgtatatgta

SEQ ID NO: 177159 - DNA, 22 bp, Mus musculus
tgttttgtgaccaattatatgg

SEQ ID NO: 177160 - DNA, 20 bp, Mus musculus
ttggatgacctctccttcct

SEQ ID NO: 177161 - DNA, 23 bp, Mus musculus
atgtcagaagaaagacaggtgta

SEQ ID NO: 177162 - DNA, 22 bp, Mus musculus
tgcatatatatgtgtgtgtgtg

SEQ ID NO: 177163 - DNA, 22 bp, Mus musculus
tttggtagaattttcttatgta

SEQ ID NO: 177164 - DNA, 22 bp, Mus musculus
tgttttgtgaccaattatatgg

SEQ ID NO: 177165 - DNA, 23 bp, Mus musculus
taatttgcttttctgttgctatg

SEQ ID NO: 177166 - DNA, 22 bp, Mus musculus
tgttttgtgaccaattatatgg

SEQ ID NO: 177167 - DNA, 22 bp, Mus musculus
tgttttgtgaccaattatatgg

SEQ ID NO: 177168 - DNA, 23 bp, Mus musculus
tgcctggctgcctgattgccatc

SEQ ID NO: 177169 - DNA, 22 bp, Mus musculus
ctagaaatgtgaatttgaagat

SEQ ID NO: 177170 - DNA, 23 bp, Mus musculus
tctgaagcagtggcaatgctgat

SEQ ID NO: 177171 - DNA, 23 bp, Mus musculus
aactgtgtagatcctagagattg

SEQ ID NO: 177172 - DNA, 23 bp, Mus musculus
gtcttcctctgtctctatctcat

SEQ ID NO: 177173 - DNA, 23 bp, Mus musculus
tcagacagatgtgtgtgtgtgtt

SEQ ID NO: 177174 - DNA, 19 bp, Mus musculus
atgtatgtatacaacaatg

SEQ ID NO: 177175 - DNA, 22 bp, Mus musculus
tcccattatggtggttatgctg

SEQ ID NO: 177176 - DNA, 21 bp, Mus musculus
ttgacacaagctagagtcctc

SEQ ID NO: 177177 - DNA, 23 bp, Mus musculus
actaggacaacacattctcaggg

SEQ ID NO: 177178 - DNA, 23 bp, Mus musculus
atatctgtatttgtatatatctg

SEQ ID NO: 177179 - DNA, 23 bp, Mus musculus
agagcaatgaagacagtctgcac

SEQ ID NO: 177180 - DNA, 22 bp, Mus musculus
aatctctgtggacttactgtct

SEQ ID NO: 177181 - DNA, 23 bp, Mus musculus
gcttactggatgtttaatgacca

SEQ ID NO: 177182 - DNA, 22 bp, Mus musculus
tgttttgtgaccaattatatgg

SEQ ID NO: 177183 - DNA, 23 bp, Mus musculus
atgtgtgtgtgcatgtgtgtata

SEQ ID NO: 177184 - DNA, 21 bp, Mus musculus
tgttttgtgaccaattatatg

SEQ ID NO: 177185 - DNA, 18 bp, Mus musculus
cccagtctttgaagagtt

SEQ ID NO: 177186 - DNA, 23 bp, Mus musculus
gggaaactgactctcagtctccc

SEQ ID NO: 177187 - DNA, 19 bp, Mus musculus
tgtctcagtggaaagcctg

SEQ ID NO: 177188 - DNA, 23 bp, Mus musculus
ctgggaggaagaagttgatgcag

SEQ ID NO: 177189 - DNA, 21 bp, Mus musculus
tatgtatgtatatgtgtgtgt

SEQ ID NO: 177190 - DNA, 23 bp, Mus musculus
ttcttctctctggctctgttctg

SEQ ID NO: 177191 - DNA, 23 bp, Mus musculus
cagtgagtcagaacagtgagctg

SEQ ID NO: 177192 - DNA, 18 bp, Mus musculus
aaagagagtaaacagaac

SEQ ID NO: 177193 - DNA, 23 bp, Mus musculus
ttgagtttggtttctgattttat

SEQ ID NO: 177194 - DNA, 21 bp, Mus musculus
gctcatcaaagaattcagtga

SEQ ID NO: 177195 - DNA, 23 bp, Mus musculus
gagaggtttgtagactgtggtag

SEQ ID NO: 177196 - DNA, 19 bp, Mus musculus
tggctgcctgtcttcagcc

SEQ ID NO: 177197 - DNA, 18 bp, Mus musculus
aagaaagacagcatagct

SEQ ID NO: 177198 - DNA, 23 bp, Mus musculus
atgtgtatgcatttggtgtgatt

SEQ ID NO: 177199 - DNA, 23 bp, Mus musculus
tctctccagcaacacacatttta

SEQ ID NO: 177200 - DNA, 22 bp, Mus musculus
aaacaggctccacaatcacaga

SEQ ID NO: 177201 - DNA, 23 bp, Mus musculus
ctctgtgtgtgcatcgtgtttgt

SEQ ID NO: 177202 - DNA, 23 bp, Mus musculus
agagttctgttttggttgtactt

SEQ ID NO: 177203 - DNA, 23 bp, Mus musculus
gaatatatacatgtgtgtatgtg

SEQ ID NO: 177204 - DNA, 23 bp, Mus musculus
ctatgcatatatgtatgtatata

SEQ ID NO: 177205 - DNA, 23 bp, Mus musculus
gtatgtatgcatgtatgtgtctt

SEQ ID NO: 177206 - DNA, 23 bp, Mus musculus
tgtatgtatgtatgtatgtatgt

SEQ ID NO: 177207 - DNA, 18 bp, Mus musculus
taggtgatcagataggat

SEQ ID NO: 177208 - DNA, 23 bp, Mus musculus
tatttgtatctgcagagacctgt

SEQ ID NO: 177209 - DNA, 21 bp, Mus musculus
tatatatctgtatgtatatgt

SEQ ID NO: 177210 - DNA, 23 bp, Mus musculus
tatatatgtgtatatgtatatgt

SEQ ID NO: 177211 - DNA, 23 bp, Mus musculus
atgtatgtatgcatgtgtgtgtg

SEQ ID NO: 177212 - DNA, 23 bp, Mus musculus
cgtgtgtgtgtgtgattaagtag

SEQ ID NO: 177213 - DNA, 22 bp, Mus musculus
acagacatttgtttctctgaag

SEQ ID NO: 177214 - DNA, 21 bp, Mus musculus
tcaaagaaagagaagatgttt

SEQ ID NO: 177215 - DNA, 23 bp, Mus musculus
tagtgcatggtgatctgatagga

SEQ ID NO: 177216 - DNA, 22 bp, Mus musculus
tgttttgtgacctattatgtgg

SEQ ID NO: 177217 - DNA, 22 bp, Mus musculus
agtctgcgacaacaccaggtca

SEQ ID NO: 177218 - DNA, 23 bp, Mus musculus
tatatgtgtacatgtatgtatgt

SEQ ID NO: 177219 - DNA, 18 bp, Mus musculus
tatgcgtatgtatgggta

SEQ ID NO: 177220 - DNA, 23 bp, Mus musculus
actgtaaaaggaggatttactcg

SEQ ID NO: 177221 - DNA, 22 bp, Mus musculus
atccatggtgatctgataggat

SEQ ID NO: 177222 - DNA, 19 bp, Mus musculus
tttcagagtttctcactct

SEQ ID NO: 177223 - DNA, 21 bp, Mus musculus
tgggtactaatagatatcagt

SEQ ID NO: 177224 - DNA, 18 bp, Mus musculus
aagtgatatctcatagca

SEQ ID NO: 177225 - DNA, 20 bp, Mus musculus
atatgtatgtatatatatgt

SEQ ID NO: 177226 - DNA, 22 bp, Mus musculus
tgcatgtgtgtactgtgtccat

SEQ ID NO: 177227 - DNA, 23 bp, Mus musculus
atcagtctacctcatgacccagc

SEQ ID NO: 177228 - DNA, 22 bp, Mus musculus
ttaagagcactgactgctcttc

SEQ ID NO: 177229 - DNA, 21 bp, Mus musculus
tactcaggagtggtatagttg

SEQ ID NO: 177230 - DNA, 18 bp, Mus musculus
ttcattatttgtgtgtgt

SEQ ID NO: 177231 - DNA, 22 bp, Mus musculus
tgttttgtgaccaattatatgg

SEQ ID NO: 177232 - DNA, 21 bp, Mus musculus
tgtttatagagtggataacat

SEQ ID NO: 177233 - DNA, 23 bp, Mus musculus
taatgtagccaataaaatcccat

SEQ ID NO: 177234 - DNA, 20 bp, Mus musculus
atgttcatgcacgggtgcac

SEQ ID NO: 177235 - DNA, 23 bp, Mus musculus
atgtgtgtgtgcttgtgcatgtg

SEQ ID NO: 177236 - DNA, 22 bp, Mus musculus
tgttttgtgaccaattatatgg

SEQ ID NO: 177237 - DNA, 21 bp, Mus musculus
tctgtctgtggatatctgcat

SEQ ID NO: 177238 - DNA, 23 bp, Mus musculus
tagtccatggtgatctgatagga

SEQ ID NO: 177239 - DNA, 23 bp, Mus musculus
tagtccatggtgatctgatagga

SEQ ID NO: 177240 - DNA, 22 bp, Mus musculus
tgttttgtgaccaattatatgg

SEQ ID NO: 177241 - DNA, 23 bp, Mus musculus
atacatatgtgtgtgtatgtata

SEQ ID NO: 177242 - DNA, 19 bp, Mus musculus
agaccagctctgaggctgt

SEQ ID NO: 177243 - DNA, 23 bp, Mus musculus
taatggtcttcagtccccctgac

SEQ ID NO: 177244 - DNA, 19 bp, Mus musculus
ctgtagaaggacatctgaa

SEQ ID NO: 177245 - DNA, 20 bp, Mus musculus
ttctgagagtcaatagtttc

SEQ ID NO: 177246 - DNA, 22 bp, Mus musculus
aagtgtgcatggatgtgtatgt

SEQ ID NO: 177247 - DNA, 23 bp, Mus musculus
gtctcctgtgtctgtgtctgtgc

SEQ ID NO: 177248 - DNA, 22 bp, Mus musculus
tgttttgtgaccaattatatgg

SEQ ID NO: 177249 - DNA, 23 bp, Mus musculus
actacatcacgtattgattggat

SEQ ID NO: 177250 - DNA, 23 bp, Mus musculus
aaatcacagtgggagatgtgtgt

SEQ ID NO: 177251 - DNA, 23 bp, Mus musculus
taatctgaaatacatgaagtaac

SEQ ID NO: 177252 - DNA, 23 bp, Mus musculus
tgtgcatctctctctctctcgtg

SEQ ID NO: 177253 - DNA, 23 bp, Mus musculus
agtgacaggtgtgggtgtgcact

SEQ ID NO: 177254 - DNA, 21 bp, Mus musculus
attggcacagtgtgttatctg

SEQ ID NO: 177255 - DNA, 20 bp, Mus musculus
taaggaaaagtaattgttgc

SEQ ID NO: 177256 - DNA, 23 bp, Mus musculus
gtacacaacacagagtgtagaga

SEQ ID NO: 177257 - DNA, 19 bp, Mus musculus
tagctgtctgtgctctctc

SEQ ID NO: 177258 - DNA, 20 bp, Mus musculus
tgtcagaacatagtcagctg

SEQ ID NO: 177259 - DNA, 23 bp, Mus musculus
tgtgtgtgtctgtgtatgtctat

SEQ ID NO: 177260 - DNA, 23 bp, Mus musculus
gtctcccacactctgagaagtca

SEQ ID NO: 177261 - DNA, 23 bp, Mus musculus
tctcactctggctcacatggggc

SEQ ID NO: 177262 - DNA, 21 bp, Mus musculus
ataactgtatacagagggcct

SEQ ID NO: 177263 - DNA, 23 bp, Mus musculus
tgactcctcactctgtcaggtgt

SEQ ID NO: 177264 - DNA, 23 bp, Mus musculus
tgtctctgtctctcatacttgat

SEQ ID NO: 177265 - DNA, 23 bp, Mus musculus
agtctcactccctgatttctcgg

SEQ ID NO: 177266 - DNA, 23 bp, Mus musculus
tatgtgtgtgtatgtgtatatca

SEQ ID NO: 177267 - DNA, 22 bp, Mus musculus
ctttgtctcagagtcacacagc

SEQ ID NO: 177268 - DNA, 23 bp, Mus musculus
agggacagtcttagataagggtg

SEQ ID NO: 177269 - DNA, 23 bp, Mus musculus
cacagtctctctgtggttctcat

SEQ ID NO: 177270 - DNA, 23 bp, Mus musculus
gagacagagaagacattgagcac

SEQ ID NO: 177271 - DNA, 22 bp, Mus musculus
tcacttggtctctgtgtttgca

SEQ ID NO: 177272 - DNA, 23 bp, Mus musculus
tgtgtgtgcatgtgcatgagctt

SEQ ID NO: 177273 - DNA, 23 bp, Mus musculus
agtatatgtcattttcttgttgt

SEQ ID NO: 177274 - DNA, 23 bp, Mus musculus
tgtatatgtgtatatatgatgtg

SEQ ID NO: 177275 - DNA, 20 bp, Mus musculus
agtattgctgagagtttgga

SEQ ID NO: 177276 - DNA, 23 bp, Mus musculus
tgtgtctgtctgtctctcatctt

SEQ ID NO: 177277 - DNA, 22 bp, Mus musculus
aattgttcaattacagaagaga

SEQ ID NO: 177278 - DNA, 22 bp, Mus musculus
tgttttgtgaccaattatatgg

SEQ ID NO: 177279 - DNA, 23 bp, Mus musculus
tgaatgtgtatgtataggtatgt

SEQ ID NO: 177280 - DNA, 22 bp, Mus musculus
tgttttgtgaccaattatatgg

SEQ ID NO: 177281 - DNA, 23 bp, Mus musculus
atatgcatgtatgtatgtatgta

SEQ ID NO: 177282 - DNA, 23 bp, Mus musculus
aaattccagtctctcttttgtca

SEQ ID NO: 177283 - DNA, 23 bp, Mus musculus
tagtccatggtgatctgatagga

SEQ ID NO: 177284 - DNA, 19 bp, Mus musculus
actccctctgtgtttctag

SEQ ID NO: 177285 - DNA, 19 bp, Mus musculus
attctgtggttttttttgt

SEQ ID NO: 177286 - DNA, 23 bp, Mus musculus
tgagcttgagttttcatgtatgt

SEQ ID NO: 177287 - DNA, 20 bp, Mus musculus
gtatgcatgtttatttaggt

SEQ ID NO: 177288 - DNA, 23 bp, Mus musculus
caatatttttgtatatgttgagg

SEQ ID NO: 177289 - DNA, 22 bp, Mus musculus
tatggcccatcatgtgctcaaa

SEQ ID NO: 177290 - DNA, 23 bp, Mus musculus
gtgtgtgtgtctgtctgtcattc

SEQ ID NO: 177291 - DNA, 18 bp, Mus musculus
attccacgcagacacagg

SEQ ID NO: 177292 - DNA, 23 bp, Mus musculus
tgagtatctgcatctgtatttgt

SEQ ID NO: 177293 - DNA, 18 bp, Mus musculus
tggcagaacttttcaggg

SEQ ID NO: 177294 - DNA, 23 bp, Mus musculus
aattttgaaagtagttggtattt

SEQ ID NO: 177295 - DNA, 23 bp, Mus musculus
atggtggtctgataggatgtatg

SEQ ID NO: 177296 - DNA, 22 bp, Mus musculus
tgttttgtgaccaattatatgg

SEQ ID NO: 177297 - DNA, 22 bp, Mus musculus
tgttttgtgaccaattatatgg

SEQ ID NO: 177298 - DNA, 21 bp, Mus musculus
ttgtgtgtgcatgtgcatgtg

SEQ ID NO: 177299 - DNA, 23 bp, Mus musculus
tctctgcctccctgtctgtgtct

SEQ ID NO: 177300 - DNA, 19 bp, Mus musculus
tgagtatttttattaatgt

SEQ ID NO: 177301 - DNA, 23 bp, Mus musculus
tctcacagtctcacagatattcc

SEQ ID NO: 177302 - DNA, 20 bp, Mus musculus
aaagaactgggactggagag

SEQ ID NO: 177303 - DNA, 23 bp, Mus musculus
gtgtctctgtgtgtgtgaatgcc

SEQ ID NO: 177304 - DNA, 23 bp, Mus musculus
aagagcactgactgctcatccag

SEQ ID NO: 177305 - DNA, 23 bp, Mus musculus
agtactatagttgagtgttaact

SEQ ID NO: 177306 - DNA, 20 bp, Mus musculus
ttcccacttcatgttgagac

SEQ ID NO: 177307 - DNA, 23 bp, Mus musculus
catgtgagtagtgtcgttggtga

SEQ ID NO: 177308 - DNA, 22 bp, Mus musculus
tgttttgtgaccaattatatgg

SEQ ID NO: 177309 - DNA, 22 bp, Mus musculus
agtctctggtagagcagggtgt

SEQ ID NO: 177310 - DNA, 23 bp, Mus musculus
agtcaggacacagtgaggactag

SEQ ID NO: 177311 - DNA, 21 bp, Mus musculus
attatgagggatttctttgga

SEQ ID NO: 177312 - DNA, 23 bp, Mus musculus
tttttgtttgatgttaacacctg

SEQ ID NO: 177313 - DNA, 21 bp, Mus musculus
agaggtgttacatacaagatg

SEQ ID NO: 177314 - DNA, 23 bp, Mus musculus
tctctgtgtgtctaacttctgtc

SEQ ID NO: 177315 - DNA, 23 bp, Mus musculus
attgaagcctctagttagccatt

SEQ ID NO: 177316 - DNA, 22 bp, Mus musculus
tgttttgtgaccaattatatgg

SEQ ID NO: 177317 - DNA, 23 bp, Mus musculus
ctctctgtctctgggagtgttct

SEQ ID NO: 177318 - DNA, 22 bp, Mus musculus
tgttttgtgaccaattatatgg

SEQ ID NO: 177319 - DNA, 22 bp, Mus musculus
tttatccttgagaatctatgtg

SEQ ID NO: 177320 - DNA, 23 bp, Mus musculus
tctatgttacaatctgtacccca

SEQ ID NO: 177321 - DNA, 23 bp, Mus musculus
tatcagaggtttagtttgtaaaa

SEQ ID NO: 177322 - DNA, 22 bp, Mus musculus
tgttttgtgaccaattatatgg

SEQ ID NO: 177323 - DNA, 23 bp, Mus musculus
cagtggctctctctgtttgtcct

SEQ ID NO: 177324 - DNA, 23 bp, Mus musculus
aatttgttcttgtcatggaatat

SEQ ID NO: 177325 - DNA, 22 bp, Mus musculus
tgtgattctctgactcttgtga

SEQ ID NO: 177326 - DNA, 23 bp, Mus musculus
tcagaagtgtgtttgtagttgat

SEQ ID NO: 177327 - DNA, 23 bp, Mus musculus
tctgagtctgtctgtgtatgcag

SEQ ID NO: 177328 - DNA, 22 bp, Mus musculus
ttctctctgtctctgggagagt

SEQ ID NO: 177329 - DNA, 23 bp, Mus musculus
tgtcactgtcactctcagttgta

SEQ ID NO: 177330 - DNA, 22 bp, Mus musculus
tatgcatgtatgtatatatgta

SEQ ID NO: 177331 - DNA, 19 bp, Mus musculus
gtatgtatgtatgtatgta

SEQ ID NO: 177332 - DNA, 20 bp, Mus musculus
tctatgcatgttgtggtgct

SEQ ID NO: 177333 - DNA, 23 bp, Mus musculus
tcttttctgaggtacatttatgg

SEQ ID NO: 177334 - DNA, 23 bp, Mus musculus
actcgtattatatacatatatga

SEQ ID NO: 177335 - DNA, 23 bp, Mus musculus
tgtatgtatgtatgtatgtatgt

SEQ ID NO: 177336 - DNA, 21 bp, Mus musculus
tcatctctgggtcttcaattc

SEQ ID NO: 177337 - DNA, 23 bp, Mus musculus
tctgtgtatatctctgtgtgtgt

SEQ ID NO: 177338 - DNA, 21 bp, Mus musculus
ttcagaatatatattcagaat

SEQ ID NO: 177339 - DNA, 22 bp, Mus musculus
tgttttgtgaccaattatatgg

SEQ ID NO: 177340 - DNA, 22 bp, Mus musculus
tgttttgtgaccaattatatgg

SEQ ID NO: 177341 - DNA, 22 bp, Mus musculus
tgttttgtgaccaattatatgg

SEQ ID NO: 177342 - DNA, 22 bp, Mus musculus
tgctaggaattgaactcaggac

SEQ ID NO: 177343 - DNA, 20 bp, Mus musculus
tgtgtatatgtatatgtgtg

SEQ ID NO: 177344 - DNA, 23 bp, Mus musculus
agtctgcatgtgcatgtatatgt

SEQ ID NO: 177345 - DNA, 20 bp, Mus musculus
tgtcagttcaggctgagctg

SEQ ID NO: 177346 - DNA, 19 bp, Mus musculus
catggtggtctgataggat

SEQ ID NO: 177347 - DNA, 22 bp, Mus musculus
tgttttgtgaccaattatatgg

SEQ ID NO: 177348 - DNA, 18 bp, Mus musculus
tctctgtcccactgtttg

SEQ ID NO: 177349 - DNA, 23 bp, Mus musculus
agaagagtgttgttcagtttcca

SEQ ID NO: 177350 - DNA, 22 bp, Mus musculus
cttagtccatggtgatctgata

SEQ ID NO: 177351 - DNA, 21 bp, Mus musculus
tgttttgtaaccaattatatg

SEQ ID NO: 177352 - DNA, 23 bp, Mus musculus
tagtccatggtgatctgatagga

SEQ ID NO: 177353 - DNA, 21 bp, Mus musculus
aacagttctctttttgttctt

SEQ ID NO: 177354 - DNA, 22 bp, Mus musculus
aaagaactggataatctaagta

SEQ ID NO: 177355 - DNA, 23 bp, Mus musculus
tttgtgaccaattatattgtcaa

SEQ ID NO: 177356 - DNA, 18 bp, Mus musculus
ctggtcctccagctccag

SEQ ID NO: 177357 - DNA, 21 bp, Mus musculus
ctgtctgtctgtctgtctttt

SEQ ID NO: 177358 - DNA, 21 bp, Mus musculus
ggcaatgtctccctcactgac

SEQ ID NO: 177359 - DNA, 23 bp, Mus musculus
cactcgctgagtggctcactctg

SEQ ID NO: 177360 - DNA, 23 bp, Mus musculus
tgagtgtctggaagttttctgaa

SEQ ID NO: 177361 - DNA, 21 bp, Mus musculus
gaggtcctctcagtgagctac

SEQ ID NO: 177362 - DNA, 18 bp, Mus musculus
tatctatctatctatcta

SEQ ID NO: 177363 - DNA, 20 bp, Mus musculus
caggcagacagacagacaga

SEQ ID NO: 177364 - DNA, 23 bp, Mus musculus
ttgtcactcactgtgtccctgtc

SEQ ID NO: 177365 - DNA, 19 bp, Mus musculus
ttttagtgtcttaagtgtt

SEQ ID NO: 177366 - DNA, 21 bp, Mus musculus
tacagatgtctgctctttctt

SEQ ID NO: 177367 - DNA, 21 bp, Mus musculus
aggtggtcacagactgtcaca

SEQ ID NO: 177368 - DNA, 19 bp, Mus musculus
tgccaaatgaagataaagc

SEQ ID NO: 177369 - DNA, 23 bp, Mus musculus
tgtatgtgtgcatgtgtatgtgc

SEQ ID NO: 177370 - DNA, 23 bp, Mus musculus
tctgtctgtctgtctgtctgtct

SEQ ID NO: 177371 - DNA, 23 bp, Mus musculus
taggtaggtagatagatagatag

SEQ ID NO: 177372 - DNA, 22 bp, Mus musculus
tctggagactgactcagctttt

SEQ ID NO: 177373 - DNA, 23 bp, Mus musculus
aatagcactgactgctcttccag

SEQ ID NO: 177374 - DNA, 23 bp, Mus musculus
gagaacactgactgctcttccag

SEQ ID NO: 177375 - DNA, 23 bp, Mus musculus
tctctgtgtaactctgactgtct

SEQ ID NO: 177376 - DNA, 23 bp, Mus musculus
tatatgtatgtatatatgtgtgt

SEQ ID NO: 177377 - DNA, 23 bp, Mus musculus
tggctttgactccctgactctgt

SEQ ID NO: 177378 - DNA, 23 bp, Mus musculus
tctccgtctgtctgtctgtttgc

SEQ ID NO: 177379 - DNA, 23 bp, Mus musculus
ctgtctgtctgtgcctctaagtt

SEQ ID NO: 177380 - DNA, 23 bp, Mus musculus
acaagagagagtaagaagtgagt

SEQ ID NO: 177381 - DNA, 23 bp, Mus musculus
agccactgtgctaggtctatctg

SEQ ID NO: 177382 - DNA, 20 bp, Mus musculus
tgtgtgtgtgtatgtatata

SEQ ID NO: 177383 - DNA, 23 bp, Mus musculus
ataccacacagtgtcaccatgtc

SEQ ID NO: 177384 - DNA, 22 bp, Mus musculus
tcccctccctctgtgtctctgt

SEQ ID NO: 177385 - DNA, 21 bp, Mus musculus
gtgtgtgtgtgtgatctgtcc

SEQ ID NO: 177386 - DNA, 23 bp, Mus musculus
atatatgtgtatgtatatgtaag

SEQ ID NO: 177387 - DNA, 23 bp, Mus musculus
atgtattgatttctgtcagatgt

SEQ ID NO: 177388 - DNA, 23 bp, Mus musculus
tctgcttctgtccgtgtgtctca

SEQ ID NO: 177389 - DNA, 18 bp, Mus musculus
gtgagtgggtgctagaag

SEQ ID NO: 177390 - DNA, 22 bp, Mus musculus
gacaggagttaacagtgatagt

SEQ ID NO: 177391 - DNA, 22 bp, Mus musculus
tgactctgtaactctctggaat

SEQ ID NO: 177392 - DNA, 23 bp, Mus musculus
accaaggacaaggagctgcagag

SEQ ID NO: 177393 - DNA, 21 bp, Mus musculus
atactttaactatccgggatg

SEQ ID NO: 177394 - DNA, 23 bp, Mus musculus
actgttctgtatttgattttcag

SEQ ID NO: 177395 - DNA, 23 bp, Mus musculus
taagagcactgactgctcttcca

SEQ ID NO: 177396 - DNA, 23 bp, Mus musculus
ggataatggtatgtatgaattgc

SEQ ID NO: 177397 - DNA, 23 bp, Mus musculus
tgacagactctcactgtcccttc

SEQ ID NO: 177398 - DNA, 23 bp, Mus musculus
atgctctcactcagtgtgtcagc

SEQ ID NO: 177399 - DNA, 23 bp, Mus musculus
tgccagtgagtttgcaggcatgt

SEQ ID NO: 177400 - DNA, 22 bp, Mus musculus
aatctgcatatatatacatata

SEQ ID NO: 177401 - DNA, 23 bp, Mus musculus
ctagttctctctctctctctcat

SEQ ID NO: 177402 - DNA, 18 bp, Mus musculus
tacacacacacacatgtg

SEQ ID NO: 177403 - DNA, 23 bp, Mus musculus
tgtgtgtgtgtatatgtatatgt

SEQ ID NO: 177404 - DNA, 23 bp, Mus musculus
tagtgcatggtgatctgatagga

SEQ ID NO: 177405 - DNA, 22 bp, Mus musculus
tgttttgtgacctattatgtgg

SEQ ID NO: 177406 - DNA, 22 bp, Mus musculus
tgttttgtgaccaattatatgg

SEQ ID NO: 177407 - DNA, 23 bp, Mus musculus
tgatgcagatgcagttttctgat

SEQ ID NO: 177408 - DNA, 23 bp, Mus musculus
agacatcagagactgcattccat

SEQ ID NO: 177409 - DNA, 19 bp, Mus musculus
atgtgtgtatatatatatg

SEQ ID NO: 177410 - DNA, 22 bp, Mus musculus
tgtgcttctatgtatatatgta

SEQ ID NO: 177411 - DNA, 23 bp, Mus musculus
atcagtgagtgcataccatgtgt

SEQ ID NO: 177412 - DNA, 18 bp, Mus musculus
tgggtatatcctgggaga

SEQ ID NO: 177413 - DNA, 23 bp, Mus musculus
tgtatgtatgtatgcatgtgtca

SEQ ID NO: 177414 - DNA, 21 bp, Mus musculus
attgcttatcttggacaagaa

SEQ ID NO: 177415 - DNA, 22 bp, Mus musculus
caatgaggagaagcgtgactgc

SEQ ID NO: 177416 - DNA, 23 bp, Mus musculus
tgattcagtctctctctttgtgg

SEQ ID NO: 177417 - DNA, 20 bp, Mus musculus
aacacagaagaaagagtgca

SEQ ID NO: 177418 - DNA, 21 bp, Mus musculus
aaattgcatgtttatttaact

SEQ ID NO: 177419 - DNA, 23 bp, Mus musculus
tgttgatgtgaataagtataggt

SEQ ID NO: 177420 - DNA, 23 bp, Mus musculus
tttgtatatgtatatgcatatgt

SEQ ID NO: 177421 - DNA, 20 bp, Mus musculus
tgtatgtcatatgtatatgt

SEQ ID NO: 177422 - DNA, 23 bp, Mus musculus
atatgtgaatatgtatatgtgtg

SEQ ID NO: 177423 - DNA, 20 bp, Mus musculus
tggctgtggctgaatggagt

SEQ ID NO: 177424 - DNA, 23 bp, Mus musculus
tctaggtatgtatgtatgcatgt

SEQ ID NO: 177425 - DNA, 23 bp, Mus musculus
atgtatatgtgtgggtcagcatg

SEQ ID NO: 177426 - DNA, 22 bp, Mus musculus
actcttcagcttaaacacttca

SEQ ID NO: 177427 - DNA, 23 bp, Mus musculus
aactatgtatatatgtatgtatg

SEQ ID NO: 177428 - DNA, 21 bp, Mus musculus
tacacagttattttgcatgcg

SEQ ID NO: 177429 - DNA, 23 bp, Mus musculus
acaggagctggtggtccgtggct

SEQ ID NO: 177430 - DNA, 19 bp, Mus musculus
gtcattttcagtctctgtc

SEQ ID NO: 177431 - DNA, 18 bp, Mus musculus
actgtttctgcctctcca

SEQ ID NO: 177432 - DNA, 19 bp, Mus musculus
aagagcaccgactgctctt

SEQ ID NO: 177433 - DNA, 23 bp, Mus musculus
atcaaggtagtttaccaaagaca

SEQ ID NO: 177434 - DNA, 23 bp, Mus musculus
acgtgtgtgtgcatgtgcatgtg

SEQ ID NO: 177435 - DNA, 23 bp, Mus musculus
agttgtgtgtgcatgtgcatgtg

SEQ ID NO: 177436 - DNA, 21 bp, Mus musculus
atacacacacacgtataaacg

SEQ ID NO: 177437 - DNA, 23 bp, Mus musculus
tgtgtgtgcatgtgcatgtgtgt

SEQ ID NO: 177438 - DNA, 23 bp, Mus musculus
acacacacatacacactcatgta

SEQ ID NO: 177439 - DNA, 23 bp, Mus musculus
acgtgtgtgtgcatgtgcatgtg

SEQ ID NO: 177440 - DNA, 23 bp, Mus musculus
atgtatgtgtgcatgtgcatgtg

SEQ ID NO: 177441 - DNA, 23 bp, Mus musculus
atgtatgtgtgcatgtacatgtg

SEQ ID NO: 177442 - DNA, 20 bp, Mus musculus
acacgtgtatatgcaggcac

SEQ ID NO: 177443 - DNA, 23 bp, Mus musculus
tatagtttatgtgcatgtgcatg

SEQ ID NO: 177444 - DNA, 22 bp, Mus musculus
tgtgtatatgcaagcacacaca

SEQ ID NO: 177445 - DNA, 23 bp, Mus musculus
atttgtgtgtgcatgtgcttgtg

SEQ ID NO: 177446 - DNA, 23 bp, Mus musculus
atgtatgtgtgcatgtgcatgtg

SEQ ID NO: 177447 - DNA, 23 bp, Mus musculus
atgtatgtgtgcatgtgcatgtg

SEQ ID NO: 177448 - DNA, 18 bp, Mus musculus
tacacacatacccataca

SEQ ID NO: 177449 - DNA, 23 bp, Mus musculus
tgactgagctatctctctgtgtc

SEQ ID NO: 177450 - DNA, 23 bp, Mus musculus
aagtgtgtgtcactgtctctggc

SEQ ID NO: 177451 - DNA, 19 bp, Mus musculus
attatatatgtaggtgaat

SEQ ID NO: 177452 - DNA, 23 bp, Mus musculus
tacacacacacttatatgtgtgt

SEQ ID NO: 177453 - DNA, 22 bp, Mus musculus
tgttttgtgaccaattatatgg

SEQ ID NO: 177454 - DNA, 23 bp, Mus musculus
gaagaacatgactttgcttctgg

SEQ ID NO: 177455 - DNA, 23 bp, Mus musculus
ttgagaggagacagtgaactcac

SEQ ID NO: 177456 - DNA, 22 bp, Mus musculus
tatatatgttttcttagactag

SEQ ID NO: 177457 - DNA, 23 bp, Mus musculus
tgtaagagtcagatggaaatccc

SEQ ID NO: 177458 - DNA, 20 bp, Mus musculus
actgggtgacctttgctctt

SEQ ID NO: 177459 - DNA, 23 bp, Mus musculus
tgtgcatgcgtgtgtgcatgtgt

SEQ ID NO: 177460 - DNA, 22 bp, Mus musculus
ggttgagtggctgagtggctgc

SEQ ID NO: 177461 - DNA, 23 bp, Mus musculus
caggagtgaatttcttcttgtga

SEQ ID NO: 177462 - DNA, 22 bp, Mus musculus
ttaagagcactgactgctcttt

SEQ ID NO: 177463 - DNA, 23 bp, Mus musculus
gtatcactctgtgtctcaggccg

SEQ ID NO: 177464 - DNA, 23 bp, Mus musculus
cactcactcagtccctgtttgct

SEQ ID NO: 177465 - DNA, 18 bp, Mus musculus
acagtgggtggtcatgtt

SEQ ID NO: 177466 - DNA, 23 bp, Mus musculus
ctgtgtctgtgtgtctggctgtg

SEQ ID NO: 177467 - DNA, 18 bp, Mus musculus
agagaagtgggggagcag

SEQ ID NO: 177468 - DNA, 23 bp, Mus musculus
tgtctagtacctgattttagtag

SEQ ID NO: 177469 - DNA, 22 bp, Mus musculus
tgttttgtgaccaattatatgg

SEQ ID NO: 177470 - DNA, 22 bp, Mus musculus
acagaacattcgacatcctcca

SEQ ID NO: 177471 - DNA, 20 bp, Mus musculus
ttttgggttctgaggatagt

SEQ ID NO: 177472 - DNA, 23 bp, Mus musculus
actagctgcaaagtgtttgtata

SEQ ID NO: 177473 - DNA, 20 bp, Mus musculus
atacacacacatatatatgt

SEQ ID NO: 177474 - DNA, 20 bp, Mus musculus
atatgtctatatatatatgt

SEQ ID NO: 177475 - DNA, 21 bp, Mus musculus
actcatgtccatacctttagt

SEQ ID NO: 177476 - DNA, 23 bp, Mus musculus
aagcagatgaagtactgagagaa

SEQ ID NO: 177477 - DNA, 21 bp, Mus musculus
tcctcaaatcttgtcttgctc

SEQ ID NO: 177478 - DNA, 23 bp, Mus musculus
aatctatgtatatatgtatgcac

SEQ ID NO: 177479 - DNA, 22 bp, Mus musculus
agctagctagtgggtgtgtatt

SEQ ID NO: 177480 - DNA, 23 bp, Mus musculus
tccgtgaaagctttggctggact

SEQ ID NO: 177481 - DNA, 20 bp, Mus musculus
gtagagaagatatatagttg

SEQ ID NO: 177482 - DNA, 22 bp, Mus musculus
tctgtctctgtctcttctcact

SEQ ID NO: 177483 - DNA, 18 bp, Mus musculus
aagagactgatcagtggt

SEQ ID NO: 177484 - DNA, 23 bp, Mus musculus
atggcagtcatgcaactgtctgc

SEQ ID NO: 177485 - DNA, 23 bp, Mus musculus
ggggcagactgtctgactgcctc

SEQ ID NO: 177486 - DNA, 19 bp, Mus musculus
tgatctctgtgagctcaag

SEQ ID NO: 177487 - DNA, 23 bp, Mus musculus
cacagctcagtctttgtctgtca

SEQ ID NO: 177488 - DNA, 20 bp, Mus musculus
tgaagtgagagatcagacaa

SEQ ID NO: 177489 - DNA, 22 bp, Mus musculus
tcatctcagagggtgaatccag

SEQ ID NO: 177490 - DNA, 22 bp, Mus musculus
tgtatgcatgtatgtatgtatg

SEQ ID NO: 177491 - DNA, 23 bp, Mus musculus
tatgtatgcatgcatgtgtgtat

SEQ ID NO: 177492 - DNA, 18 bp, Mus musculus
cttcagtctctgtgagct

SEQ ID NO: 177493 - DNA, 22 bp, Mus musculus
tgttttgtgaccaattatatgg

SEQ ID NO: 177494 - DNA, 23 bp, Mus musculus
ctgtgcctcactcagtgtctctc

SEQ ID NO: 177495 - DNA, 21 bp, Mus musculus
atatgtgcagctggtactgtt

SEQ ID NO: 177496 - DNA, 18 bp, Mus musculus
gtatatatacctatgtat

SEQ ID NO: 177497 - DNA, 20 bp, Mus musculus
catatgtattgaagtatata

SEQ ID NO: 177498 - DNA, 23 bp, Mus musculus
atgtgtgtgtatatatgtgtgtg

SEQ ID NO: 177499 - DNA, 22 bp, Mus musculus
tgttttgtgaccaattatatgg

SEQ ID NO: 177500 - DNA, 20 bp, Mus musculus
aatggttttgaaatctaaat

SEQ ID NO: 177501 - DNA, 19 bp, Mus musculus
attgagatttaaaaaccat

SEQ ID NO: 177502 - DNA, 23 bp, Mus musculus
tgtctgtgtctgtgtgtgggcca

SEQ ID NO: 177503 - DNA, 23 bp, Mus musculus
tctcaccatgactcactctctca

SEQ ID NO: 177504 - DNA, 23 bp, Mus musculus
acttacttgatcatggtggatac

SEQ ID NO: 177505 - DNA, 23 bp, Mus musculus
tgaggatatttacagttatgatc

SEQ ID NO: 177506 - DNA, 19 bp, Mus musculus
ttgactcccaggaactctg

SEQ ID NO: 177507 - DNA, 22 bp, Mus musculus
aatcacaggatcacagaggcag

SEQ ID NO: 177508 - DNA, 21 bp, Mus musculus
ctatatctactttgctgtaag

SEQ ID NO: 177509 - DNA, 23 bp, Mus musculus
tgtggtcatatctctttctgtga

SEQ ID NO: 177510 - DNA, 22 bp, Mus musculus
tgttttgtgaccaattatatgg

SEQ ID NO: 177511 - DNA, 18 bp, Mus musculus
agtgcatctaagtagctg

SEQ ID NO: 177512 - DNA, 22 bp, Mus musculus
tgttttgtgaccaattatatgg

SEQ ID NO: 177513 - DNA, 22 bp, Mus musculus
tgttttgtgaccaattatatgg

SEQ ID NO: 177514 - DNA, 23 bp, Mus musculus
tttcattgttttcctttagtgtg

SEQ ID NO: 177515 - DNA, 23 bp, Mus musculus
tatgtgcaagtacatgtgtctgt

SEQ ID NO: 177516 - DNA, 23 bp, Mus musculus
tgtgtaaatgtgtgtgtatgtat

SEQ ID NO: 177517 - DNA, 22 bp, Mus musculus
tgttttgtgaccaattatatgg

SEQ ID NO: 177518 - DNA, 23 bp, Mus musculus
agatgagactggctgtggtaagt

SEQ ID NO: 177519 - DNA, 22 bp, Mus musculus
tgttttgtgaccaattatatgg

SEQ ID NO: 177520 - DNA, 19 bp, Mus musculus
agactcagtgactcatcag

SEQ ID NO: 177521 - DNA, 23 bp, Mus musculus
tctgtacatctatgtgtgtgcat

SEQ ID NO: 177522 - DNA, 22 bp, Mus musculus
tgttttgtgaccaattatatgg

SEQ ID NO: 177523 - DNA, 23 bp, Mus musculus
gcacagttgacttttccaaggta

SEQ ID NO: 177524 - DNA, 23 bp, Mus musculus
agtggttctaggttgtagaagaa

SEQ ID NO: 177525 - DNA, 22 bp, Mus musculus
tgaatctctctctctctcgcgc

SEQ ID NO: 177526 - DNA, 23 bp, Mus musculus
acacacaggttttgtaatgtgta

SEQ ID NO: 177527 - DNA, 23 bp, Mus musculus
tttactgtgtgtgtgtgtgtgtg

SEQ ID NO: 177528 - DNA, 20 bp, Mus musculus
aatgcataaaataaggttct

SEQ ID NO: 177529 - DNA, 20 bp, Mus musculus
ttgtgtgtatatgtatatac

SEQ ID NO: 177530 - DNA, 22 bp, Mus musculus
tgttttgtgaccaattatatgg

SEQ ID NO: 177531 - DNA, 23 bp, Mus musculus
cactcagactgagtgacagccag

SEQ ID NO: 177532 - DNA, 22 bp, Mus musculus
tgaacaatggtttccttgggaa

SEQ ID NO: 177533 - DNA, 23 bp, Mus musculus
tttctgcatctgatattcttcat

SEQ ID NO: 177534 - DNA, 23 bp, Mus musculus
agtactgagagtggagatagagg

SEQ ID NO: 177535 - DNA, 23 bp, Mus musculus
agtactgagagtggagatagagg

SEQ ID NO: 177536 - DNA, 21 bp, Mus musculus
gtgtgtacaaacacgtatgta

SEQ ID NO: 177537 - DNA, 23 bp, Mus musculus
tgtctccctcactgactgggttc

SEQ ID NO: 177538 - DNA, 23 bp, Mus musculus
agaatactcacaggctggagaga

SEQ ID NO: 177539 - DNA, 20 bp, Mus musculus
aagagcactgactgctcttc

SEQ ID NO: 177540 - DNA, 19 bp, Mus musculus
tgagttcaattcttagcaa

SEQ ID NO: 177541 - DNA, 18 bp, Mus musculus
cagtcttctgaaaagcac

SEQ ID NO: 177542 - DNA, 18 bp, Mus musculus
agtttcaggatatctctg

SEQ ID NO: 177543 - DNA, 20 bp, Mus musculus
atgtatgtgtgcatgtgtat

SEQ ID NO: 177544 - DNA, 23 bp, Mus musculus
atgtatgtgtgtatgtatgcata

SEQ ID NO: 177545 - DNA, 23 bp, Mus musculus
tatgtatgtgtgtgtatgtgtat

SEQ ID NO: 177546 - DNA, 23 bp, Mus musculus
tgagctctctcacagtctgagtg

SEQ ID NO: 177547 - DNA, 23 bp, Mus musculus
tgtatgtatgtatgtgtgtgtgt

SEQ ID NO: 177548 - DNA, 20 bp, Mus musculus
tggctttgtacagatgctga

SEQ ID NO: 177549 - DNA, 23 bp, Mus musculus
ctcagtgttcagacagccagcat

SEQ ID NO: 177550 - DNA, 23 bp, Mus musculus
agacagaagtgactttggacctg

SEQ ID NO: 177551 - DNA, 20 bp, Mus musculus
tggctcagtggttaggagca

SEQ ID NO: 177552 - DNA, 22 bp, Mus musculus
tgttttgtgaccaattatatgg

SEQ ID NO: 177553 - DNA, 19 bp, Mus musculus
gagggaagagtgtgggcat

SEQ ID NO: 177554 - DNA, 23 bp, Mus musculus
tgtcatggatttgctttcaaagt

SEQ ID NO: 177555 - DNA, 23 bp, Mus musculus
atatgtgtatatgtatactgact

SEQ ID NO: 177556 - DNA, 20 bp, Mus musculus
atgtatgtatgcatgtgtgt

SEQ ID NO: 177557 - DNA, 23 bp, Mus musculus
tttctcagtctgtctttctaccc

SEQ ID NO: 177558 - DNA, 23 bp, Mus musculus
atcagagatcagagagagaattc

SEQ ID NO: 177559 - DNA, 23 bp, Mus musculus
tgtcacgctgactgagtgggagc

SEQ ID NO: 177560 - DNA, 22 bp, Mus musculus
tcaacagttactgtatggattg

SEQ ID NO: 177561 - DNA, 23 bp, Mus musculus
tttctctccctgagtttgctgtg

SEQ ID NO: 177562 - DNA, 23 bp, Mus musculus
tttcatgttgttcttcttcctct

SEQ ID NO: 177563 - DNA, 23 bp, Mus musculus
tgtaaatgattatgtatatgtat

SEQ ID NO: 177564 - DNA, 21 bp, Mus musculus
tgagtagagagttgttcagct

SEQ ID NO: 177565 - DNA, 22 bp, Mus musculus
cttgccagttcattgccaacac

SEQ ID NO: 177566 - DNA, 23 bp, Mus musculus
actttgtgaagagagaaggttga

SEQ ID NO: 177567 - DNA, 21 bp, Mus musculus
acctgctatttgaattagtct

SEQ ID NO: 177568 - DNA, 23 bp, Mus musculus
tctctaagagtgtgtgcttaaga

SEQ ID NO: 177569 - DNA, 23 bp, Mus musculus
cagtagtcagagagcagtcaggt

SEQ ID NO: 177570 - DNA, 20 bp, Mus musculus
agtcccagaggatttgttat

SEQ ID NO: 177571 - DNA, 23 bp, Mus musculus
tgacttagtgtgacatcttacga

SEQ ID NO: 177572 - DNA, 23 bp, Mus musculus
tagtccgtgatgatctgatagga

SEQ ID NO: 177573 - DNA, 23 bp, Mus musculus
tgttttgtgacaattatatggtc

SEQ ID NO: 177574 - DNA, 20 bp, Mus musculus
tagaatcttcagtctccagg

SEQ ID NO: 177575 - DNA, 21 bp, Mus musculus
tgtgtctgtttgtcattccat

SEQ ID NO: 177576 - DNA, 23 bp, Mus musculus
ctcagctctcactgtgtgactga

SEQ ID NO: 177577 - DNA, 23 bp, Mus musculus
taaatattgtgggaccagagaat

SEQ ID NO: 177578 - DNA, 22 bp, Mus musculus
tgttttgtgaccaattatatgg

SEQ ID NO: 177579 - DNA, 18 bp, Mus musculus
tctgggagaactggtggt

SEQ ID NO: 177580 - DNA, 23 bp, Mus musculus
tagtccatggtgatctgatagga

SEQ ID NO: 177581 - DNA, 22 bp, Mus musculus
tgtatctatggaggcctgtttg

SEQ ID NO: 177582 - DNA, 20 bp, Mus musculus
tgaccaattatatggtcaat

SEQ ID NO: 177583 - DNA, 23 bp, Mus musculus
tttagaagcacagtgaggggaaa

SEQ ID NO: 177584 - DNA, 22 bp, Mus musculus
tgtgtgtctctctatgtgtctc

SEQ ID NO: 177585 - DNA, 22 bp, Mus musculus
tgttttgtgaccaattatatgg

SEQ ID NO: 177586 - DNA, 22 bp, Mus musculus
tattttgtgaccaattatatgg

SEQ ID NO: 177587 - DNA, 23 bp, Mus musculus
tgatctctatttctttatgtata

SEQ ID NO: 177588 - DNA, 22 bp, Mus musculus
tgagagggagagacacagtatt

SEQ ID NO: 177589 - DNA, 23 bp, Mus musculus
ttatggaaagtaatgatgtcaga

SEQ ID NO: 177590 - DNA, 22 bp, Mus musculus
agacatggtactattgccatag

SEQ ID NO: 177591 - DNA, 23 bp, Mus musculus
ttcagcatgcaaaacctgtgttt

SEQ ID NO: 177592 - DNA, 23 bp, Mus musculus
atgtgtatatgtgtatgtgtgtg

SEQ ID NO: 177593 - DNA, 22 bp, Mus musculus
tgttttgtgaccaattatatgg

SEQ ID NO: 177594 - DNA, 23 bp, Mus musculus
tttcacagagccaagtttgtccc

SEQ ID NO: 177595 - DNA, 21 bp, Mus musculus
tccatggtggtctgataggat

SEQ ID NO: 177596 - DNA, 23 bp, Mus musculus
tgttttgtgaccaattgtatggt

SEQ ID NO: 177597 - DNA, 22 bp, Mus musculus
tgttttgtgaccaattatatgg

SEQ ID NO: 177598 - DNA, 23 bp, Mus musculus
tcagagatgtgactgtgctatgg

SEQ ID NO: 177599 - DNA, 21 bp, Mus musculus
tgtctccctgctagagatgag

SEQ ID NO: 177600 - DNA, 23 bp, Mus musculus
tttgcagagtagagagtgtcgac

SEQ ID NO: 177601 - DNA, 20 bp, Mus musculus
aggcagtctccatttctgaa

SEQ ID NO: 177602 - DNA, 23 bp, Mus musculus
agcctgtgagcctgtgtgcctgt

SEQ ID NO: 177603 - DNA, 22 bp, Mus musculus
atttagacagcatagcattttc

SEQ ID NO: 177604 - DNA, 21 bp, Mus musculus
aacctgaacagtgtctgcagt

SEQ ID NO: 177605 - DNA, 19 bp, Mus musculus
actcagccagcttatttct

SEQ ID NO: 177606 - DNA, 21 bp, Mus musculus
taacacaagactctgaggaca

SEQ ID NO: 177607 - DNA, 20 bp, Mus musculus
tccagcttccagaactaggc

SEQ ID NO: 177608 - DNA, 23 bp, Mus musculus
ctctgtctctgtttagtttctgt

SEQ ID NO: 177609 - DNA, 23 bp, Mus musculus
atctgtccattgatgagagtaga

SEQ ID NO: 177610 - DNA, 22 bp, Mus musculus
tgttttgtgaccaattatatgg

SEQ ID NO: 177611 - DNA, 20 bp, Mus musculus
agtctgtaagtctctgtcag

SEQ ID NO: 177612 - DNA, 20 bp, Mus musculus
tctgacagttctgacagttc

SEQ ID NO: 177613 - DNA, 18 bp, Mus musculus
agtgtctctattctttga

SEQ ID NO: 177614 - DNA, 23 bp, Mus musculus
gtctctctctctctctgacccag

SEQ ID NO: 177615 - DNA, 23 bp, Mus musculus
ttagaaataatgtacgtgtgtgt

SEQ ID NO: 177616 - DNA, 23 bp, Mus musculus
ttagttactttatcaaggtcctt

SEQ ID NO: 177617 - DNA, 23 bp, Mus musculus
aacttttctggctctctgactct

SEQ ID NO: 177618 - DNA, 23 bp, Mus musculus
agtggttggaagttgtcctagtg

SEQ ID NO: 177619 - DNA, 22 bp, Mus musculus
aggctgtgacttcaagtcagcc

SEQ ID NO: 177620 - DNA, 23 bp, Mus musculus
aagtgtctgcaactggatctgat

SEQ ID NO: 177621 - DNA, 23 bp, Mus musculus
ctaacagcagcagcagcagattg

SEQ ID NO: 177622 - DNA, 23 bp, Mus musculus
gcctgtggggctggagagatgct

SEQ ID NO: 177623 - DNA, 20 bp, Mus musculus
tcatgacttacactgttctt

SEQ ID NO: 177624 - DNA, 21 bp, Mus musculus
tctctgggtccctgaatcagt

SEQ ID NO: 177625 - DNA, 23 bp, Mus musculus
ctctgtgttttccgtttgtattg

SEQ ID NO: 177626 - DNA, 22 bp, Mus musculus
acagagagaagagagactggac

SEQ ID NO: 177627 - DNA, 19 bp, Mus musculus
ttactctgcagtcagctgg

SEQ ID NO: 177628 - DNA, 23 bp, Mus musculus
agtctctcagagtcacattgtcc

SEQ ID NO: 177629 - DNA, 23 bp, Mus musculus
gttgacacactctcattctcttt

SEQ ID NO: 177630 - DNA, 23 bp, Mus musculus
ggctcagagagcctatggtgtct

SEQ ID NO: 177631 - DNA, 22 bp, Mus musculus
ttcaatggccaaggtgagagag

SEQ ID NO: 177632 - DNA, 20 bp, Mus musculus
aaagactactgactgggcag

SEQ ID NO: 177633 - DNA, 22 bp, Mus musculus
tgtgtgtatatgtatatatgta

SEQ ID NO: 177634 - DNA, 23 bp, Mus musculus
ttagttactttatcaaggtcctt

SEQ ID NO: 177635 - DNA, 23 bp, Mus musculus
tatgtctctctgtgtatctgtgt

SEQ ID NO: 177636 - DNA, 23 bp, Mus musculus
tctctctggctgtgtagctgtct

SEQ ID NO: 177637 - DNA, 23 bp, Mus musculus
atgagtgtgaggtcaggtagagg

SEQ ID NO: 177638 - DNA, 22 bp, Mus musculus
cactctatgtccacactcacct

SEQ ID NO: 177639 - DNA, 23 bp, Mus musculus
tgaggtggcactctgaggctctg

SEQ ID NO: 177640 - DNA, 21 bp, Mus musculus
cattattacttttggtacgcg

SEQ ID NO: 177641 - DNA, 23 bp, Mus musculus
actcgtaccgtgagtaataatgc

SEQ ID NO: 177642 - DNA, 23 bp, Mus musculus
gacaggtgacagtgtgaacacag

SEQ ID NO: 177643 - DNA, 19 bp, Mus musculus
agtggtcgagtatctgcct

SEQ ID NO: 177644 - DNA, 23 bp, Mus musculus
attgctggtctctctctctctct

SEQ ID NO: 177645 - DNA, 22 bp, Mus musculus
tgttttgtgaccaattatatgg

SEQ ID NO: 177646 - DNA, 23 bp, Mus musculus
tgggtctctgggtctctgtcttg

SEQ ID NO: 177647 - DNA, 23 bp, Mus musculus
tgtgtacatgttcatgtttgtgt

SEQ ID NO: 177648 - DNA, 23 bp, Mus musculus
gtgtgtgtgtgcatgtgcatatg

SEQ ID NO: 177649 - DNA, 22 bp, Mus musculus
agagatgctggagttgatgctt

SEQ ID NO: 177650 - DNA, 23 bp, Mus musculus
tgcctcactcacagtctcaaggc

SEQ ID NO: 177651 - DNA, 23 bp, Mus musculus
agacagatctctgtgagttcaag

SEQ ID NO: 177652 - DNA, 18 bp, Mus musculus
tacatagtgaggatctgt

SEQ ID NO: 177653 - DNA, 23 bp, Mus musculus
tgcgtgcatatgtatgcatatat

SEQ ID NO: 177654 - DNA, 23 bp, Mus musculus
tgtatgtatgtatgtatgtgtca

SEQ ID NO: 177655 - DNA, 22 bp, Mus musculus
atgtcagtcacctcactagcac

SEQ ID NO: 177656 - DNA, 21 bp, Mus musculus
tcaagtagaaggtctggagag

SEQ ID NO: 177657 - DNA, 22 bp, Mus musculus
actgactgctcttccagaggtc

SEQ ID NO: 177658 - DNA, 23 bp, Mus musculus
ccctcactcccactctctgtctt

SEQ ID NO: 177659 - DNA, 22 bp, Mus musculus
actgtcactgtctgactgactg

SEQ ID NO: 177660 - DNA, 23 bp, Mus musculus
tctgtctatctgtctgtctgagt

SEQ ID NO: 177661 - DNA, 22 bp, Mus musculus
gtgtacatatgcatgcatatgt

SEQ ID NO: 177662 - DNA, 20 bp, Mus musculus
gtgtgtctctatcactctgc

SEQ ID NO: 177663 - DNA, 23 bp, Mus musculus
agggctggctgtcagtgcctctc

SEQ ID NO: 177664 - DNA, 23 bp, Mus musculus
gtatgtatgcatgtatgtgctat

SEQ ID NO: 177665 - DNA, 23 bp, Mus musculus
tgtgtgcatgcatgtgtctgtct

SEQ ID NO: 177666 - DNA, 19 bp, Mus musculus
gagactctgactcagtgtg

SEQ ID NO: 177667 - DNA, 23 bp, Mus musculus
cagacagacaagagagtgtggag

SEQ ID NO: 177668 - DNA, 22 bp, Mus musculus
acagcatatataaacatctatg

SEQ ID NO: 177669 - DNA, 22 bp, Mus musculus
tattgtgcatgtgtatagttgt

SEQ ID NO: 177670 - DNA, 23 bp, Mus musculus
tctgtcactccctgacatcagac

SEQ ID NO: 177671 - DNA, 23 bp, Mus musculus
tgtctgtctgtctgtctgcctgt

SEQ ID NO: 177672 - DNA, 23 bp, Mus musculus
ttgaaagaacagtcagtgctctt

SEQ ID NO: 177673 - DNA, 20 bp, Mus musculus
actggaatgatgactcagca

SEQ ID NO: 177674 - DNA, 23 bp, Mus musculus
aaaaggcttgagctgttggccta

SEQ ID NO: 177675 - DNA, 19 bp, Mus musculus
tagggcttcaacatgcagt

SEQ ID NO: 177676 - DNA, 22 bp, Mus musculus
tgtctgagtatgtgtgtctgag

SEQ ID NO: 177677 - DNA, 19 bp, Mus musculus
cagagaggtaagcagcatg

SEQ ID NO: 177678 - DNA, 23 bp, Mus musculus
acagcagtgtgccacagtgtggg

SEQ ID NO: 177679 - DNA, 23 bp, Mus musculus
tgtgtgcctgtgtgtgtgtgcct

SEQ ID NO: 177680 - DNA, 22 bp, Mus musculus
aaaagagaggcatctttcaagt

SEQ ID NO: 177681 - DNA, 23 bp, Mus musculus
agttctgtgtgtgtatgtgtgtg

SEQ ID NO: 177682 - DNA, 21 bp, Mus musculus
aggcacagattggaaacccaa

SEQ ID NO: 177683 - DNA, 23 bp, Mus musculus
ggactgatgtgtgcctgtagact

SEQ ID NO: 177684 - DNA, 22 bp, Mus musculus
aagtactctgttgcttttgtac

SEQ ID NO: 177685 - DNA, 23 bp, Mus musculus
gcatctctgtcactgtcactcgg

SEQ ID NO: 177686 - DNA, 23 bp, Mus musculus
attggtgactctgtctgtccctg

SEQ ID NO: 177687 - DNA, 23 bp, Mus musculus
aggctctctccctcttttagagg

SEQ ID NO: 177688 - DNA, 23 bp, Mus musculus
gagactctgccagtgactgagtg

SEQ ID NO: 177689 - DNA, 21 bp, Mus musculus
aaaccctgagagcattggttg

SEQ ID NO: 177690 - DNA, 23 bp, Mus musculus
tgtatgtatgtatgtatgcatgt

SEQ ID NO: 177691 - DNA, 21 bp, Mus musculus
tgtgtgtgcatgtcagaggat

SEQ ID NO: 177692 - DNA, 23 bp, Mus musculus
tctcagtgcatgtgtgcagtcgc

SEQ ID NO: 177693 - DNA, 22 bp, Mus musculus
actgtgcatgtctgagagcctc

SEQ ID NO: 177694 - DNA, 23 bp, Mus musculus
gcactcagtctcagtccctggct

SEQ ID NO: 177695 - DNA, 23 bp, Mus musculus
acagaagagagtgatcacttggg

SEQ ID NO: 177696 - DNA, 23 bp, Mus musculus
tctctgtgactgtgtggccgcct

SEQ ID NO: 177697 - DNA, 19 bp, Mus musculus
gaaaagttattgcttggag

SEQ ID NO: 177698 - DNA, 23 bp, Mus musculus
agacactgcagggttctgagaca

SEQ ID NO: 177699 - DNA, 23 bp, Mus musculus
gcatctcagtgggactgtctctg

SEQ ID NO: 177700 - DNA, 23 bp, Mus musculus
tctgtgtaactctgtctcacact

SEQ ID NO: 177701 - DNA, 23 bp, Mus musculus
gcctgtctgagactgtgggtcag

SEQ ID NO: 177702 - DNA, 21 bp, Mus musculus
acacacacacacaggtatgca

SEQ ID NO: 177703 - DNA, 23 bp, Mus musculus
tgaggctgaattctcctcctgct

SEQ ID NO: 177704 - DNA, 23 bp, Mus musculus
tgtagcacagggaccctttcagc

SEQ ID NO: 177705 - DNA, 22 bp, Mus musculus
ttgcttcctcatctggctgaga

SEQ ID NO: 177706 - DNA, 23 bp, Mus musculus
gagcagagagtgtacagagaagg

SEQ ID NO: 177707 - DNA, 19 bp, Mus musculus
gtctctgtctcagaggacc

SEQ ID NO: 177708 - DNA, 23 bp, Mus musculus
tgtgtgtagatggtagagtccgg

SEQ ID NO: 177709 - DNA, 23 bp, Mus musculus
tgtctgtgtgagtgattgccaaa

SEQ ID NO: 177710 - DNA, 21 bp, Mus musculus
actcagcgtcttcaccaactg

SEQ ID NO: 177711 - DNA, 20 bp, Mus musculus
aagagcactgactgctcttc

SEQ ID NO: 177712 - DNA, 23 bp, Mus musculus
tgacagtgacactgtctcaaagc

SEQ ID NO: 177713 - DNA, 19 bp, Mus musculus
aggctgtgagcacatgtgt

SEQ ID NO: 177714 - DNA, 23 bp, Mus musculus
gatagactctagagtctcaccac

SEQ ID NO: 177715 - DNA, 19 bp, Mus musculus
atgtgtacatgatacatgc

SEQ ID NO: 177716 - DNA, 18 bp, Mus musculus
tggctcacatttctgcat

SEQ ID NO: 177717 - DNA, 23 bp, Mus musculus
aagacctgactgtgctcactggg

SEQ ID NO: 177718 - DNA, 23 bp, Mus musculus
tgagtctcataagagagtgtgca

SEQ ID NO: 177719 - DNA, 23 bp, Mus musculus
tgcctgcctgcctgcctgtctcc

SEQ ID NO: 177720 - DNA, 20 bp, Mus musculus
tgtgagaggctctcgtttta

SEQ ID NO: 177721 - DNA, 20 bp, Mus musculus
agagcgcgcacacactcaca

SEQ ID NO: 177722 - DNA, 18 bp, Mus musculus
cacacagctaatggacac

SEQ ID NO: 177723 - DNA, 23 bp, Mus musculus
tgactgtctctgtgattcatcac

SEQ ID NO: 177724 - DNA, 21 bp, Mus musculus
ctggctgcctggctgcctggc

SEQ ID NO: 177725 - DNA, 21 bp, Mus musculus
gtgggagtcagtgtggcagtg

SEQ ID NO: 177726 - DNA, 23 bp, Mus musculus
aagacagagaacactgagcacac

SEQ ID NO: 177727 - DNA, 18 bp, Mus musculus
tgcaggagtcagggcctg

SEQ ID NO: 177728 - DNA, 23 bp, Mus musculus
gtctgtctgtctgtctgggaccg

SEQ ID NO: 177729 - DNA, 23 bp, Mus musculus
gtcagcatctctcactgtctgct

SEQ ID NO: 177730 - DNA, 21 bp, Mus musculus
ttctctgctgtgtctctctca

SEQ ID NO: 177731 - DNA, 23 bp, Mus musculus
acgaagtttggagatctggagat

SEQ ID NO: 177732 - DNA, 18 bp, Mus musculus
aagagtagattctgcaga

SEQ ID NO: 177733 - DNA, 23 bp, Mus musculus
ctatgtctgtctgtctgtctgtc

SEQ ID NO: 177734 - DNA, 23 bp, Mus musculus
tctgcctgtctgacagtgttagc

SEQ ID NO: 177735 - DNA, 22 bp, Mus musculus
tctgtctgtctgtctgtcctaa

SEQ ID NO: 177736 - DNA, 23 bp, Mus musculus
tcactcccactctctgggattat

SEQ ID NO: 177737 - DNA, 18 bp, Mus musculus
ctagttgagggggaagta

SEQ ID NO: 177738 - DNA, 22 bp, Mus musculus
tgcatcactctgaaatgtgttc

SEQ ID NO: 177739 - DNA, 23 bp, Mus musculus
cccagtgtttagactacctgttc

SEQ ID NO: 177740 - DNA, 23 bp, Mus musculus
gtacagtagtctgcacattggtt

SEQ ID NO: 177741 - DNA, 23 bp, Mus musculus
gagcagagagatagcactgagga

SEQ ID NO: 177742 - DNA, 19 bp, Mus musculus
aaatgttctgatccagtag

SEQ ID NO: 177743 - DNA, 23 bp, Mus musculus
tctaaatctgtctggttttggcc

SEQ ID NO: 177744 - DNA, 22 bp, Mus musculus
aaaggtaagaagtttagagatg

SEQ ID NO: 177745 - DNA, 23 bp, Mus musculus
taactgaccctcagtggctgtgt

SEQ ID NO: 177746 - DNA, 23 bp, Mus musculus
gagtgtgtgtgtctgtgtgttga

SEQ ID NO: 177747 - DNA, 23 bp, Mus musculus
acgagcactgactgctcttccag

SEQ ID NO: 177748 - DNA, 23 bp, Mus musculus
gttgttcctgatctgtcttagct

SEQ ID NO: 177749 - DNA, 23 bp, Mus musculus
cagagaagacagtgagctcactc

SEQ ID NO: 177750 - DNA, 23 bp, Mus musculus
tctgtatgtctctctggctgtgc

SEQ ID NO: 177751 - DNA, 21 bp, Mus musculus
tgtccacctctcagtccctct

SEQ ID NO: 177752 - DNA, 18 bp, Mus musculus
ctgttctcagtctctcac

SEQ ID NO: 177753 - DNA, 18 bp, Mus musculus
ctgtcctctgtagctctc

SEQ ID NO: 177754 - DNA, 22 bp, Mus musculus
tctcagtcagcactgacagggc

SEQ ID NO: 177755 - DNA, 23 bp, Mus musculus
tctgtctgtgtctctctctctca

SEQ ID NO: 177756 - DNA, 22 bp, Mus musculus
atgtatgtatatgtatatgtat

SEQ ID NO: 177757 - DNA, 23 bp, Mus musculus
atttgtagagtgtccaccgagat

SEQ ID NO: 177758 - DNA, 23 bp, Mus musculus
gagagcctcagtgtgtctgtctg

SEQ ID NO: 177759 - DNA, 23 bp, Mus musculus
atatgtgtgtatatatatgtgtg

SEQ ID NO: 177760 - DNA, 23 bp, Mus musculus
tgagtgtgtgtgtatgtgctgac

SEQ ID NO: 177761 - DNA, 19 bp, Mus musculus
tgtatgtatgtatgtatgt

SEQ ID NO: 177762 - DNA, 22 bp, Mus musculus
atgtatgtatacatgtgtgtat

SEQ ID NO: 177763 - DNA, 23 bp, Mus musculus
atatgtatgtatacatgtgtgtg

SEQ ID NO: 177764 - DNA, 23 bp, Mus musculus
atgtatgtatgtatgtatgtgtg

SEQ ID NO: 177765 - DNA, 20 bp, Mus musculus
tctccgactctctgagctca

SEQ ID NO: 177766 - DNA, 19 bp, Mus musculus
aaagtctggatgttgatgc

SEQ ID NO: 177767 - DNA, 22 bp, Mus musculus
tctcagctgtgtctctctcagg

SEQ ID NO: 177768 - DNA, 22 bp, Mus musculus
tcaggggctggagagatggctt

SEQ ID NO: 177769 - DNA, 23 bp, Mus musculus
tgtctctgacactctcttctagc

SEQ ID NO: 177770 - DNA, 23 bp, Mus musculus
tcactcactcagtctgtggatgg

SEQ ID NO: 177771 - DNA, 18 bp, Mus musculus
tagaacagcgtggacagt

SEQ ID NO: 177772 - DNA, 23 bp, Mus musculus
aaaagcagagagtgagctgtgtg

SEQ ID NO: 177773 - DNA, 23 bp, Mus musculus
tttggctgagtatacagtgtgac

SEQ ID NO: 177774 - DNA, 23 bp, Mus musculus
acacagacagagtgagaatgagc

SEQ ID NO: 177775 - DNA, 23 bp, Mus musculus
gtggctctgtggctctgtggccc

SEQ ID NO: 177776 - DNA, 23 bp, Mus musculus
tatgtatgtatgtatatatgtgt

SEQ ID NO: 177777 - DNA, 23 bp, Mus musculus
actgttcaggaaggattaggatt

SEQ ID NO: 177778 - DNA, 19 bp, Mus musculus
aagagcactgactgctcct

SEQ ID NO: 177779 - DNA, 23 bp, Mus musculus
gaccctcagtctgactgtcctgt

SEQ ID NO: 177780 - DNA, 22 bp, Mus musculus
tctcttctttccatatatgtgt

SEQ ID NO: 177781 - DNA, 22 bp, Mus musculus
attgtatgtatacatgtatgta

SEQ ID NO: 177782 - DNA, 23 bp, Mus musculus
tgactctgcctggctcagtggct

SEQ ID NO: 177783 - DNA, 23 bp, Mus musculus
aggtgtgaggattagtgagtgac

SEQ ID NO: 177784 - DNA, 23 bp, Mus musculus
tcacacatgagagagtccagtag

SEQ ID NO: 177785 - DNA, 23 bp, Mus musculus
actagtgcatatgcatatgtgtg

SEQ ID NO: 177786 - DNA, 23 bp, Mus musculus
tcagttctcagcaaccacatggt

SEQ ID NO: 177787 - DNA, 20 bp, Mus musculus
gacagggagactgagagcct

SEQ ID NO: 177788 - DNA, 23 bp, Mus musculus
gtctcagtggttcatctcagtgg

SEQ ID NO: 177789 - DNA, 20 bp, Mus musculus
tctgaggtcttcaagacttt

SEQ ID NO: 177790 - DNA, 23 bp, Mus musculus
cacgctgactactgtttctgtgt

SEQ ID NO: 177791 - DNA, 20 bp, Mus musculus
aagtctgtgtggaaagcgcg

SEQ ID NO: 177792 - DNA, 19 bp, Mus musculus
tgagtctgagtctgagtca

SEQ ID NO: 177793 - DNA, 23 bp, Mus musculus
gtgtgtctgtgtgtctgtacata

SEQ ID NO: 177794 - DNA, 23 bp, Mus musculus
tatgtgtgtgtggataggtgtat

SEQ ID NO: 177795 - DNA, 20 bp, Mus musculus
atgtatgtgtgtatgtggtt

SEQ ID NO: 177796 - DNA, 18 bp, Mus musculus
ctacttcctctacctgca

SEQ ID NO: 177797 - DNA, 23 bp, Mus musculus
tcagtcaggctgagtggctgaca

SEQ ID NO: 177798 - DNA, 23 bp, Mus musculus
ctcactctctggtatttctgctg

SEQ ID NO: 177799 - DNA, 22 bp, Mus musculus
tgtatgtgtatgtgcatgtata

SEQ ID NO: 177800 - DNA, 23 bp, Mus musculus
ctggctcactgtttcatttcagg

SEQ ID NO: 177801 - DNA, 21 bp, Mus musculus
ttgcctgtctcccatacttca

SEQ ID NO: 177802 - DNA, 23 bp, Mus musculus
cagtgttctgcctgaatgtgtgc

SEQ ID NO: 177803 - DNA, 23 bp, Mus musculus
tctgtctggctctggctctctta

SEQ ID NO: 177804 - DNA, 23 bp, Mus musculus
agtttgagagagaattagttggg

SEQ ID NO: 177805 - DNA, 23 bp, Mus musculus
tggtggtctgataggatgcaggg

SEQ ID NO: 177806 - DNA, 22 bp, Mus musculus
tgttttgtgaccaattatatgg

SEQ ID NO: 177807 - DNA, 22 bp, Mus musculus
tgttttgtgaccaattatatgg

SEQ ID NO: 177808 - DNA, 21 bp, Mus musculus
atgagtgttgtttagtttcca

SEQ ID NO: 177809 - DNA, 23 bp, Mus musculus
caagtaactgatattgttgatct

SEQ ID NO: 177810 - DNA, 23 bp, Mus musculus
gaagtcttccactattaatgagt

SEQ ID NO: 177811 - DNA, 22 bp, Mus musculus
ttatgaatgtgggtgtctttgc

SEQ ID NO: 177812 - DNA, 18 bp, Mus musculus
tgagacactctgtcagca

SEQ ID NO: 177813 - DNA, 22 bp, Mus musculus
tgttttgtgaccaattatatgg

SEQ ID NO: 177814 - DNA, 18 bp, Mus musculus
gttttcattctctgggag

SEQ ID NO: 177815 - DNA, 21 bp, Mus musculus
aaatagtcagtgtgtaatctg

SEQ ID NO: 177816 - DNA, 23 bp, Mus musculus
ggccctgtgtctggctgtctctg

SEQ ID NO: 177817 - DNA, 20 bp, Mus musculus
cactgactgctcttccagag

SEQ ID NO: 177818 - DNA, 21 bp, Mus musculus
atcaagtagagagtgagcaca

SEQ ID NO: 177819 - DNA, 23 bp, Mus musculus
ctgtgagtgtctgtgtaaggtgt

SEQ ID NO: 177820 - DNA, 23 bp, Mus musculus
aatgtgcatatgtctgtgtctgt

SEQ ID NO: 177821 - DNA, 20 bp, Mus musculus
tctctccctctcacatcttg

SEQ ID NO: 177822 - DNA, 23 bp, Mus musculus
agaacactgactgctcttccaga

SEQ ID NO: 177823 - DNA, 22 bp, Mus musculus
aagtttctagtaccaggcatga

SEQ ID NO: 177824 - DNA, 19 bp, Mus musculus
agtctaatttgggagctgt

SEQ ID NO: 177825 - DNA, 23 bp, Mus musculus
tcactttctgtttttgattttat

SEQ ID NO: 177826 - DNA, 21 bp, Mus musculus
cacttcaaggatcactgggag

SEQ ID NO: 177827 - DNA, 21 bp, Mus musculus
agagagaagaaattgagcact

SEQ ID NO: 177828 - DNA, 23 bp, Mus musculus
cagctcagtgtgagtctaggtcc

SEQ ID NO: 177829 - DNA, 23 bp, Mus musculus
aacattcaacgctgtcggtgagt

SEQ ID NO: 177830 - DNA, 23 bp, Mus musculus
accaccgaccgttgactgtacct

SEQ ID NO: 177831 - DNA, 23 bp, Mus musculus
acattcattgctgtcggtgggtt

SEQ ID NO: 177832 - DNA, 23 bp, Mus musculus
tcaaccaactcactgatcaatga

SEQ ID NO: 177833 - DNA, 18 bp, Mus musculus
ttgtcccttgtgactcag

SEQ ID NO: 177834 - DNA, 18 bp, Mus musculus
tggtatccttagacatca

SEQ ID NO: 177835 - DNA, 23 bp, Mus musculus
tcaaatctcagcaaccacatggt

SEQ ID NO: 177836 - DNA, 22 bp, Mus musculus
taaactcaatttgtatatttga

SEQ ID NO: 177837 - DNA, 20 bp, Mus musculus
aaggtagttgaggattgtat

SEQ ID NO: 177838 - DNA, 22 bp, Mus musculus
tgtgtctctgtttagtttctgt

SEQ ID NO: 177839 - DNA, 21 bp, Mus musculus
tccatggtggtctgataggat

SEQ ID NO: 177840 - DNA, 23 bp, Mus musculus
tcaatatttttgtatctgttgag

SEQ ID NO: 177841 - DNA, 22 bp, Mus musculus
tgttttgtgaccaattatatgg

SEQ ID NO: 177842 - DNA, 21 bp, Mus musculus
tgaaccatttgctgagtaagt

SEQ ID NO: 177843 - DNA, 22 bp, Mus musculus
tgtctctctgattccttcttct

SEQ ID NO: 177844 - DNA, 22 bp, Mus musculus
tgttttgtgaccaattatatgg

SEQ ID NO: 177845 - DNA, 23 bp, Mus musculus
atatgtatatatgtatatgtacc

SEQ ID NO: 177846 - DNA, 23 bp, Mus musculus
atatgtatatatgtatatgtgtg

SEQ ID NO: 177847 - DNA, 23 bp, Mus musculus
tctcagcctctgtcaggctttgt

SEQ ID NO: 177848 - DNA, 23 bp, Mus musculus
atatgtatgtatacgtatacata

SEQ ID NO: 177849 - DNA, 23 bp, Mus musculus
tatgtatgcttctatatatgcat

SEQ ID NO: 177850 - DNA, 20 bp, Mus musculus
tcacagaactgagtgacttg

SEQ ID NO: 177851 - DNA, 23 bp, Mus musculus
atgtatctatatatatgtgtgtg

SEQ ID NO: 177852 - DNA, 23 bp, Mus musculus
tgtctgtctgtctctgtgtgtat

SEQ ID NO: 177853 - DNA, 22 bp, Mus musculus
gtatgcatgtatgtatatttgt

SEQ ID NO: 177854 - DNA, 22 bp, Mus musculus
tgttttgtgaccaattatatgg

SEQ ID NO: 177855 - DNA, 22 bp, Mus musculus
atcagttctgaatttctttttc

SEQ ID NO: 177856 - DNA, 22 bp, Mus musculus
tgtatgaatgtatgtatgtatg

SEQ ID NO: 177857 - DNA, 18 bp, Mus musculus
atctcaagagagagagca

SEQ ID NO: 177858 - DNA, 23 bp, Mus musculus
tttgtgattgggttatctcactc

SEQ ID NO: 177859 - DNA, 23 bp, Mus musculus
atgcatgtgtatatatatgtgtg

SEQ ID NO: 177860 - DNA, 23 bp, Mus musculus
ggatacagtcaaaagtgacagtg

SEQ ID NO: 177861 - DNA, 23 bp, Mus musculus
ttagtctcaagttttggcacaga

SEQ ID NO: 177862 - DNA, 23 bp, Mus musculus
ttacaaaggattattctgtgctc

SEQ ID NO: 177863 - DNA, 23 bp, Mus musculus
atatcagctggtgtatgttgtct

SEQ ID NO: 177864 - DNA, 23 bp, Mus musculus
ggtggtccagtgtttcagagatc

SEQ ID NO: 177865 - DNA, 20 bp, Mus musculus
gaaacttctggtcctcctgc

SEQ ID NO: 177866 - DNA, 22 bp, Mus musculus
ttagtcagtagactgagagctc

SEQ ID NO: 177867 - DNA, 22 bp, Mus musculus
gacttgtatatggactctagct

SEQ ID NO: 177868 - DNA, 22 bp, Mus musculus
tgttttgtgaccaattatatgg

SEQ ID NO: 177869 - DNA, 23 bp, Mus musculus
tattttcatttagtatttgactg

SEQ ID NO: 177870 - DNA, 19 bp, Mus musculus
acacagggatttggtctga

SEQ ID NO: 177871 - DNA, 23 bp, Mus musculus
tcagaggaattttaaagtgttag

SEQ ID NO: 177872 - DNA, 19 bp, Mus musculus
attgtttatgtttacatat

SEQ ID NO: 177873 - DNA, 23 bp, Mus musculus
atatgtgtataaatatatgtgtg

SEQ ID NO: 177874 - DNA, 19 bp, Mus musculus
actaaagatactacacaca

SEQ ID NO: 177875 - DNA, 23 bp, Mus musculus
ttagaaacactttttcttcttct

SEQ ID NO: 177876 - DNA, 23 bp, Mus musculus
tgtacaggctctctctctctctc

SEQ ID NO: 177877 - DNA, 22 bp, Mus musculus
tgacatgtgtttttgttctgga

SEQ ID NO: 177878 - DNA, 21 bp, Mus musculus
gtgtgcctatattttgtgcat

SEQ ID NO: 177879 - DNA, 23 bp, Mus musculus
cacacacacacatatacatgtat

SEQ ID NO: 177880 - DNA, 23 bp, Mus musculus
tgtgaacatgtatgtatgtgtgt

SEQ ID NO: 177881 - DNA, 22 bp, Mus musculus
tatgcatgtatgtatgtatgta

SEQ ID NO: 177882 - DNA, 20 bp, Mus musculus
acacacacagatagatagac

SEQ ID NO: 177883 - DNA, 23 bp, Mus musculus
tggatgactactgtttatgaaat

SEQ ID NO: 177884 - DNA, 23 bp, Mus musculus
cacacacacatatgtgtgtgtgt

SEQ ID NO: 177885 - DNA, 22 bp, Mus musculus
tgttttgtgaccaattatatgg

SEQ ID NO: 177886 - DNA, 22 bp, Mus musculus
tatgtgtgtatgtatgtgtgta

SEQ ID NO: 177887 - DNA, 18 bp, Mus musculus
gtatgtatgtatgtatgt

SEQ ID NO: 177888 - DNA, 23 bp, Mus musculus
aatttatttgcatttcaagtgtt

SEQ ID NO: 177889 - DNA, 19 bp, Mus musculus
agttctctgtcattacctt

SEQ ID NO: 177890 - DNA, 23 bp, Mus musculus
tggttgtaaagttatatgattcg

SEQ ID NO: 177891 - DNA, 23 bp, Mus musculus
tgatgtgcttatacaaagaggta

SEQ ID NO: 177892 - DNA, 22 bp, Mus musculus
tgttttgtgaccaattatatgg

SEQ ID NO: 177893 - DNA, 18 bp, Mus musculus
atatgcatgttttacata

SEQ ID NO: 177894 - DNA, 22 bp, Mus musculus
cacaagtatattattgctgaaa

SEQ ID NO: 177895 - DNA, 23 bp, Mus musculus
tcacaaaagtgtatccatgatct

SEQ ID NO: 177896 - DNA, 23 bp, Mus musculus
atatgtgtatatatatatgtatg

SEQ ID NO: 177897 - DNA, 23 bp, Mus musculus
tcacctggatagaaatctccttg

SEQ ID NO: 177898 - DNA, 22 bp, Mus musculus
cactgtgtcattctacagcttc

SEQ ID NO: 177899 - DNA, 21 bp, Mus musculus
gtccttgtactggccattgat

SEQ ID NO: 177900 - DNA, 23 bp, Mus musculus
acacagtcagtcactcaggcttt

SEQ ID NO: 177901 - DNA, 22 bp, Mus musculus
tatgtacatatatatatgtgtg

SEQ ID NO: 177902 - DNA, 23 bp, Mus musculus
tatatgtatatgtatatgtatgt

SEQ ID NO: 177903 - DNA, 23 bp, Mus musculus
atttcagagtctgcaatgatgag

SEQ ID NO: 177904 - DNA, 23 bp, Mus musculus
gagttcaactctcagcaaccaca

SEQ ID NO: 177905 - DNA, 18 bp, Mus musculus
aagacagtgatgttatct

SEQ ID NO: 177906 - DNA, 21 bp, Mus musculus
tatgtatatatgtatgtatgt

SEQ ID NO: 177907 - DNA, 18 bp, Mus musculus
cagagcctagaagcagtg

SEQ ID NO: 177908 - DNA, 23 bp, Mus musculus
attctctctctctatgtcctgac

SEQ ID NO: 177909 - DNA, 23 bp, Mus musculus
tgtcttcctcagtctctgggtcc

SEQ ID NO: 177910 - DNA, 23 bp, Mus musculus
tgccaggctccctgtatctctgt

SEQ ID NO: 177911 - DNA, 20 bp, Mus musculus
agagtttgtactttccttgt

SEQ ID NO: 177912 - DNA, 19 bp, Mus musculus
ggaacagcagccagtggtc

SEQ ID NO: 177913 - DNA, 23 bp, Mus musculus
aagaactgtgtgcattaatctgt

SEQ ID NO: 177914 - DNA, 23 bp, Mus musculus
tctgatcttgatggctaagctga

SEQ ID NO: 177915 - DNA, 21 bp, Mus musculus
aatcactctctgaaatgcatg

SEQ ID NO: 177916 - DNA, 23 bp, Mus musculus
gttcaaagtctctcactctctgc

SEQ ID NO: 177917 - DNA, 18 bp, Mus musculus
ttttttttcagttagcta

SEQ ID NO: 177918 - DNA, 22 bp, Mus musculus
tgactgagtaaggcattgatga

SEQ ID NO: 177919 - DNA, 23 bp, Mus musculus
tatagcattttattcatatctgt

SEQ ID NO: 177920 - DNA, 23 bp, Mus musculus
tctttctcactgacaattgttat

SEQ ID NO: 177921 - DNA, 23 bp, Mus musculus
aagatatttctggttgtagatca

SEQ ID NO: 177922 - DNA, 22 bp, Mus musculus
tacattgtgtacactgtgcaca

SEQ ID NO: 177923 - DNA, 23 bp, Mus musculus
tctctttctgtgtatttcacatg

SEQ ID NO: 177924 - DNA, 19 bp, Mus musculus
gaggatttggattccctag

SEQ ID NO: 177925 - DNA, 23 bp, Mus musculus
tgagtgtgtatggtgtgacagta

SEQ ID NO: 177926 - DNA, 21 bp, Mus musculus
atgtgtgaatttgtgtgtgag

SEQ ID NO: 177927 - DNA, 21 bp, Mus musculus
tacatacattcatgagtgtgc

SEQ ID NO: 177928 - DNA, 23 bp, Mus musculus
attgtgagcattacatatctatc

SEQ ID NO: 177929 - DNA, 21 bp, Mus musculus
tgtatagtgagtatgtgaaca

SEQ ID NO: 177930 - DNA, 23 bp, Mus musculus
tagtgtgtttggaaatgaagctg

SEQ ID NO: 177931 - DNA, 23 bp, Mus musculus
agtgtgtgtcaagtgtgtgtgta

SEQ ID NO: 177932 - DNA, 23 bp, Mus musculus
gaagagtgaggttttcttgcttt

SEQ ID NO: 177933 - DNA, 21 bp, Mus musculus
tgtcttcctctgtcactgtct

SEQ ID NO: 177934 - DNA, 23 bp, Mus musculus
tggctcactcgctcactgtctct

SEQ ID NO: 177935 - DNA, 22 bp, Mus musculus
ttcagggtgagttttccatgct

SEQ ID NO: 177936 - DNA, 23 bp, Mus musculus
tctgtgtgtatgtctgtgtgagg

SEQ ID NO: 177937 - DNA, 23 bp, Mus musculus
ctctgtctatgtatttgtgtgtg

SEQ ID NO: 177938 - DNA, 23 bp, Mus musculus
gcaactgattagtcttagccttc

SEQ ID NO: 177939 - DNA, 23 bp, Mus musculus
cctctcagtgtctcactctattc

SEQ ID NO: 177940 - DNA, 23 bp, Mus musculus
aaccaggctgtagttgtgttctc

SEQ ID NO: 177941 - DNA, 23 bp, Mus musculus
tcagctgtgtctctctcagtgaa

SEQ ID NO: 177942 - DNA, 21 bp, Mus musculus
agacacaagacccacaagcgt

SEQ ID NO: 177943 - DNA, 23 bp, Mus musculus
atgtatgtatgcatgtgtgtatg

SEQ ID NO: 177944 - DNA, 23 bp, Mus musculus
tcagagatgtaagagagtgtcca

SEQ ID NO: 177945 - DNA, 23 bp, Mus musculus
tggggctctcagtgcctctgaac

SEQ ID NO: 177946 - DNA, 23 bp, Mus musculus
ctgtcactgagtccctgtgtact

SEQ ID NO: 177947 - DNA, 23 bp, Mus musculus
ctgactgctcttccagaggtcct

SEQ ID NO: 177948 - DNA, 23 bp, Mus musculus
aagaactgagcttctatatttac

SEQ ID NO: 177949 - DNA, 23 bp, Mus musculus
tatcagcttttgataacttcaag

SEQ ID NO: 177950 - DNA, 22 bp, Mus musculus
tgtgtcactgggaatgggctct

SEQ ID NO: 177951 - DNA, 23 bp, Mus musculus
cacactagactcagtctgtctgt

SEQ ID NO: 177952 - DNA, 22 bp, Mus musculus
ttcagaaaatgcataatgacac

SEQ ID NO: 177953 - DNA, 19 bp, Mus musculus
agagcaggctgagcaagcc

SEQ ID NO: 177954 - DNA, 22 bp, Mus musculus
tgttttgtgaccaattatatgg

SEQ ID NO: 177955 - DNA, 22 bp, Mus musculus
tgttttgtgaccaattatatgg

SEQ ID NO: 177956 - DNA, 22 bp, Mus musculus
tgttttgtgaccaattatatgg

SEQ ID NO: 177957 - DNA, 23 bp, Mus musculus
ggcctgttgttggtgttctctct

SEQ ID NO: 177958 - DNA, 19 bp, Mus musculus
acttaacacaacaaacaga

SEQ ID NO: 177959 - DNA, 22 bp, Mus musculus
tgttttgtgaccaattatatgg

SEQ ID NO: 177960 - DNA, 18 bp, Mus musculus
gtggatgagtttggctag

SEQ ID NO: 177961 - DNA, 23 bp, Mus musculus
tgcatgtgtgtttgtacatgtgt

SEQ ID NO: 177962 - DNA, 21 bp, Mus musculus
aaagtgatgggatttgtttga

SEQ ID NO: 177963 - DNA, 23 bp, Mus musculus
gtctcacactcagagagtactga

SEQ ID NO: 177964 - DNA, 23 bp, Mus musculus
tatatgtatgtatatatatgtat

SEQ ID NO: 177965 - DNA, 23 bp, Mus musculus
gagtgtgtatatgcatgtgtgtg

SEQ ID NO: 177966 - DNA, 18 bp, Mus musculus
atgtgtgtgtgtatgtag

SEQ ID NO: 177967 - DNA, 23 bp, Mus musculus
atgtttccatctgtaatgatagt

SEQ ID NO: 177968 - DNA, 22 bp, Mus musculus
tgttttgtgaccaattatatgg

SEQ ID NO: 177969 - DNA, 23 bp, Mus musculus
tatgtgtgtgtatatgtatgtgt

SEQ ID NO: 177970 - DNA, 22 bp, Mus musculus
tgttttgtgaccaattatatgg

SEQ ID NO: 177971 - DNA, 22 bp, Mus musculus
tgttttgtgaccaattatatgg

SEQ ID NO: 177972 - DNA, 22 bp, Mus musculus
tgttttgtgaccaattatatgg

SEQ ID NO: 177973 - DNA, 22 bp, Mus musculus
tgttttgtgaccaattatatgg

SEQ ID NO: 177974 - DNA, 22 bp, Mus musculus
gtgaccataggtgtgtggattc

SEQ ID NO: 177975 - DNA, 23 bp, Mus musculus
gctgtcacttgtgtttttgatct

SEQ ID NO: 177976 - DNA, 23 bp, Mus musculus
actccatggtgatctgataggat

SEQ ID NO: 177977 - DNA, 23 bp, Mus musculus
tatgtgcatatatattgataact

SEQ ID NO: 177978 - DNA, 22 bp, Mus musculus
tcatttcacagatttgcctatc

SEQ ID NO: 177979 - DNA, 23 bp, Mus musculus
gtatgtatgtatgtatgtatgta

SEQ ID NO: 177980 - DNA, 20 bp, Mus musculus
gtgtgtgtgtatgtgtgtgc

SEQ ID NO: 177981 - DNA, 22 bp, Mus musculus
tgttttgtgaccaattatatgg

SEQ ID NO: 177982 - DNA, 18 bp, Mus musculus
tagatacatactgaatta

SEQ ID NO: 177983 - DNA, 22 bp, Mus musculus
tgttttgtgaccaattatatgg

SEQ ID NO: 177984 - DNA, 22 bp, Mus musculus
tgtatgtatatgtatatgtata

SEQ ID NO: 177985 - DNA, 23 bp, Mus musculus
aacaacagctaaatgtgtgtgta

SEQ ID NO: 177986 - DNA, 22 bp, Mus musculus
attctctcttctcattgtgatc

SEQ ID NO: 177987 - DNA, 22 bp, Mus musculus
tgttttgtgaccaattatatgg

SEQ ID NO: 177988 - DNA, 23 bp, Mus musculus
tgagcacagagtcagcagacacc

SEQ ID NO: 177989 - DNA, 22 bp, Mus musculus
tgttttgtgaccaattatatgg

SEQ ID NO: 177990 - DNA, 22 bp, Mus musculus
tgttttgtgaccaattatatgg

SEQ ID NO: 177991 - DNA, 23 bp, Mus musculus
atgtgagtgttttgccaacatgt

SEQ ID NO: 177992 - DNA, 23 bp, Mus musculus
atgcatgcatgtatgtaggtatg

SEQ ID NO: 177993 - DNA, 22 bp, Mus musculus
cagggtctctctgtgtaacagc

SEQ ID NO: 177994 - DNA, 21 bp, Mus musculus
ttgtcgactagtttgtccctg

SEQ ID NO: 177995 - DNA, 23 bp, Mus musculus
ttgtgtagctgagagaagagact

SEQ ID NO: 177996 - DNA, 23 bp, Mus musculus
ccacagagataagagagtcctca

SEQ ID NO: 177997 - DNA, 23 bp, Mus musculus
actcttaaagcatgcttacaaat

SEQ ID NO: 177998 - DNA, 23 bp, Mus musculus
tagttccatttgtttgcttgcaa

SEQ ID NO: 177999 - DNA, 23 bp, Mus musculus
gtgtgtatatgtatatgtatatg

SEQ ID NO: 178000 - DNA, 22 bp, Mus musculus
aatgacagtaaagagtgaggag

SEQ ID NO: 178001 - DNA, 23 bp, Mus musculus
tctctctctctgtgtgtgtgtgt

SEQ ID NO: 178002 - DNA, 23 bp, Mus musculus
cactttagttgatgagttcacat

SEQ ID NO: 178003 - DNA, 20 bp, Mus musculus
aaagtagtacgttgtaaggt

SEQ ID NO: 178004 - DNA, 22 bp, Mus musculus
tatgtgtgtgcatgttgtatgg

SEQ ID NO: 178005 - DNA, 23 bp, Mus musculus
agaccgtgtgcatatgatgtgat

SEQ ID NO: 178006 - DNA, 22 bp, Mus musculus
atatgatatgatatgatatgat

SEQ ID NO: 178007 - DNA, 19 bp, Mus musculus
tatgtatatgtatacatgt

SEQ ID NO: 178008 - DNA, 22 bp, Mus musculus
tgttttgtgaccaattatatgg

SEQ ID NO: 178009 - DNA, 22 bp, Mus musculus
tgtcatgagctaataggaaaat

SEQ ID NO: 178010 - DNA, 23 bp, Mus musculus
aacatctctcagcctgacctgag

SEQ ID NO: 178011 - DNA, 23 bp, Mus musculus
tgtctctttgtcagtctttagct

SEQ ID NO: 178012 - DNA, 23 bp, Mus musculus
tgacagtagacagtgagcatagg

SEQ ID NO: 178013 - DNA, 23 bp, Mus musculus
tcactctctccctctgaactggc

SEQ ID NO: 178014 - DNA, 21 bp, Mus musculus
ttttgtcactctgtgtctgtg

SEQ ID NO: 178015 - DNA, 18 bp, Mus musculus
cagagttttgaaggtcag

SEQ ID NO: 178016 - DNA, 19 bp, Mus musculus
tagctgattgcatgttcta

SEQ ID NO: 178017 - DNA, 22 bp, Mus musculus
gaatttttagcatgaactaagc

SEQ ID NO: 178018 - DNA, 21 bp, Mus musculus
tctctcgctcgctcgctcgca

SEQ ID NO: 178019 - DNA, 23 bp, Mus musculus
aggttcagtatagaggtagcagt

SEQ ID NO: 178020 - DNA, 23 bp, Mus musculus
actcacacatattctctctcaca

SEQ ID NO: 178021 - DNA, 23 bp, Mus musculus
ttagcactctcagaaccagctgt

SEQ ID NO: 178022 - DNA, 23 bp, Mus musculus
gtgtctgtgtctctgtcttctgt

SEQ ID NO: 178023 - DNA, 21 bp, Mus musculus
agcagctctgattctgtctgt

SEQ ID NO: 178024 - DNA, 18 bp, Mus musculus
atgtaagaggaggcagac

SEQ ID NO: 178025 - DNA, 19 bp, Mus musculus
aagagatggctcagtgctg

SEQ ID NO: 178026 - DNA, 21 bp, Mus musculus
cgctgactgctcttccagagg

SEQ ID NO: 178027 - DNA, 23 bp, Mus musculus
atgtgtgcgtgtgtgtgcgcgcg

SEQ ID NO: 178028 - DNA, 22 bp, Mus musculus
gtgcgtgcgtgcgtgcgtgcgt

SEQ ID NO: 178029 - DNA, 23 bp, Mus musculus
ggcctttcagtcagtgtctctca

SEQ ID NO: 178030 - DNA, 23 bp, Mus musculus
ctgagactgagtgagtgtggctg

SEQ ID NO: 178031 - DNA, 23 bp, Mus musculus
ccctgcctgtctccctgtatgtc

SEQ ID NO: 178032 - DNA, 18 bp, Mus musculus
tctgagtactgagatgag

SEQ ID NO: 178033 - DNA, 23 bp, Mus musculus
tgggtcccacactggctgtgaca

SEQ ID NO: 178034 - DNA, 23 bp, Mus musculus
gcatgtatgtatatatgtataca

SEQ ID NO: 178035 - DNA, 23 bp, Mus musculus
gaatgcatgcatgtgtctatgta

SEQ ID NO: 178036 - DNA, 19 bp, Mus musculus
atatgtgtatatgtatata

SEQ ID NO: 178037 - DNA, 23 bp, Mus musculus
atgtatgtatatatgtatgtgtg

SEQ ID NO: 178038 - DNA, 23 bp, Mus musculus
tgtgtgtatatatatgtgtgtct

SEQ ID NO: 178039 - DNA, 22 bp, Mus musculus
tgttttgtgaccaattatatgg

SEQ ID NO: 178040 - DNA, 22 bp, Mus musculus
tgtatatatatatgtgtgtgtg

SEQ ID NO: 178041 - DNA, 23 bp, Mus musculus
agatactggtttgacatatgggc

SEQ ID NO: 178042 - DNA, 23 bp, Mus musculus
ctgtggtagcaggttgattggtt

SEQ ID NO: 178043 - DNA, 20 bp, Mus musculus
ctgagttcaaatccagcaac

SEQ ID NO: 178044 - DNA, 21 bp, Mus musculus
tccatggtggtctgataggat

SEQ ID NO: 178045 - DNA, 22 bp, Mus musculus
tgttttgtgaccaattatatgg

SEQ ID NO: 178046 - DNA, 21 bp, Mus musculus
ttgactgtgaggaaatgtttt

SEQ ID NO: 178047 - DNA, 22 bp, Mus musculus
tgttttgtgaccaattatatgg

SEQ ID NO: 178048 - DNA, 21 bp, Mus musculus
attttctagttctaatcattt

SEQ ID NO: 178049 - DNA, 23 bp, Mus musculus
taagaatttcatgaagtcattgt

SEQ ID NO: 178050 - DNA, 23 bp, Mus musculus
tgacccagtaagtgtgtctgtag

SEQ ID NO: 178051 - DNA, 19 bp, Mus musculus
tgtgattcttttaacatgt

SEQ ID NO: 178052 - DNA, 21 bp, Mus musculus
agccatcatcttctgtgttct

SEQ ID NO: 178053 - DNA, 22 bp, Mus musculus
tgttttgtgaccaattatatgg

SEQ ID NO: 178054 - DNA, 22 bp, Mus musculus
tctctctgcgtgatatctggct

SEQ ID NO: 178055 - DNA, 19 bp, Mus musculus
tcacagagtgggaagctgc

SEQ ID NO: 178056 - DNA, 23 bp, Mus musculus
tctgagtttctcactgtgtgtac

SEQ ID NO: 178057 - DNA, 23 bp, Mus musculus
tgacatgacattcagatactaca

SEQ ID NO: 178058 - DNA, 23 bp, Mus musculus
ctgtgtgtatctgtctgtcaatc

SEQ ID NO: 178059 - DNA, 19 bp, Mus musculus
tgtctctgtgtgtctgtgg

SEQ ID NO: 178060 - DNA, 19 bp, Mus musculus
tgtctagaaggtcacagat

SEQ ID NO: 178061 - DNA, 23 bp, Mus musculus
tagagtgttgaaagaggtctgtc

SEQ ID NO: 178062 - DNA, 23 bp, Mus musculus
atatctgagagaaccgtcttact

SEQ ID NO: 178063 - DNA, 23 bp, Mus musculus
atttttctacatgctgacatttt

SEQ ID NO: 178064 - DNA, 18 bp, Mus musculus
tacacagaacacagagag

SEQ ID NO: 178065 - DNA, 23 bp, Mus musculus
tctctcacatagtaatctgagct

SEQ ID NO: 178066 - DNA, 21 bp, Mus musculus
tatttggtcaattttggagaa

SEQ ID NO: 178067 - DNA, 18 bp, Mus musculus
agtggaaatgatttagta

SEQ ID NO: 178068 - DNA, 22 bp, Mus musculus
tgttttgtgaccaattatatgg

SEQ ID NO: 178069 - DNA, 23 bp, Mus musculus
tgacaacatttgtataagtgagt

SEQ ID NO: 178070 - DNA, 22 bp, Mus musculus
tgttttgtgaccaattatatgg

SEQ ID NO: 178071 - DNA, 23 bp, Mus musculus
aacacagaacacagacaggagtt

SEQ ID NO: 178072 - DNA, 21 bp, Mus musculus
tccatggtgatctgataggat

SEQ ID NO: 178073 - DNA, 22 bp, Mus musculus
taatgtgaatatgtctttgttc

SEQ ID NO: 178074 - DNA, 19 bp, Mus musculus
cagtccaatgttgaatggg

SEQ ID NO: 178075 - DNA, 22 bp, Mus musculus
tgttttgtgaccaattatatgg

SEQ ID NO: 178076 - DNA, 22 bp, Mus musculus
tgagaacaagaatgaatgaatg

SEQ ID NO: 178077 - DNA, 18 bp, Mus musculus
agtttgacagctgggatt

SEQ ID NO: 178078 - DNA, 23 bp, Mus musculus
aggacactctgtctgtgccagtg

SEQ ID NO: 178079 - DNA, 21 bp, Mus musculus
tctctcaggctctgctctgtg

SEQ ID NO: 178080 - DNA, 23 bp, Mus musculus
acacgtatatgtgtatgtgtatg

SEQ ID NO: 178081 - DNA, 23 bp, Mus musculus
gcctgcctgcctgcctgcctgcc

SEQ ID NO: 178082 - DNA, 23 bp, Mus musculus
gtatatgtgtgtgtatatgtaca

SEQ ID NO: 178083 - DNA, 22 bp, Mus musculus
cagcttttgataacagagatgt

SEQ ID NO: 178084 - DNA, 22 bp, Mus musculus
tgagttgctgcttctttggtca

SEQ ID NO: 178085 - DNA, 18 bp, Mus musculus
tatatatgtttgtgtgca

SEQ ID NO: 178086 - DNA, 19 bp, Mus musculus
tggaaaactcaaggctcac

SEQ ID NO: 178087 - DNA, 23 bp, Mus musculus
tatgtatgtatgtatgtatgtgt

SEQ ID NO: 178088 - DNA, 23 bp, Mus musculus
acacacacacacatatatatgtg

SEQ ID NO: 178089 - DNA, 23 bp, Mus musculus
tgtatgtatgtatgtatgtatgt

SEQ ID NO: 178090 - DNA, 23 bp, Mus musculus
taaatatgtagatgttgtagttg

SEQ ID NO: 178091 - DNA, 21 bp, Mus musculus
ttgaacttatacaggtcctgt

SEQ ID NO: 178092 - DNA, 23 bp, Mus musculus
tgtcacagtctctgtgagttcat

SEQ ID NO: 178093 - DNA, 22 bp, Mus musculus
atacacacacagatatatatgt

SEQ ID NO: 178094 - DNA, 22 bp, Mus musculus
tgttttgtgaccaattatatgg

SEQ ID NO: 178095 - DNA, 22 bp, Mus musculus
catgcctgcctccctgtctgac

SEQ ID NO: 178096 - DNA, 23 bp, Mus musculus
gaaatgtgtgtctcattctgtct

SEQ ID NO: 178097 - DNA, 20 bp, Mus musculus
aatctatagtccttttgggg

SEQ ID NO: 178098 - DNA, 22 bp, Mus musculus
tctaatagtgtcaggtataggt

SEQ ID NO: 178099 - DNA, 23 bp, Mus musculus
atgtgtgtgtgtatacacatata

SEQ ID NO: 178100 - DNA, 23 bp, Mus musculus
gtctctgtgtgtgtctgtgtatg

SEQ ID NO: 178101 - DNA, 22 bp, Mus musculus
cgagtctggctcacttctcctc

SEQ ID NO: 178102 - DNA, 22 bp, Mus musculus
cttggagtcccttctgcctctg

SEQ ID NO: 178103 - DNA, 21 bp, Mus musculus
tggctcactgtctcactgagg

SEQ ID NO: 178104 - DNA, 23 bp, Mus musculus
actggaaataggttgtattgttt

SEQ ID NO: 178105 - DNA, 19 bp, Mus musculus
atatatgtgtatatgtatt

SEQ ID NO: 178106 - DNA, 23 bp, Mus musculus
tctctctctatgtgtgtgtgtgt

SEQ ID NO: 178107 - DNA, 23 bp, Mus musculus
aagtggtattggtattctagatg

SEQ ID NO: 178108 - DNA, 19 bp, Mus musculus
tttgcgtgtgagattgatg

SEQ ID NO: 178109 - DNA, 20 bp, Mus musculus
agttcagtctggatgtccat

SEQ ID NO: 178110 - DNA, 23 bp, Mus musculus
taagagcactgactgctcttcca

SEQ ID NO: 178111 - DNA, 22 bp, Mus musculus
tatgtgtgtatgtatatgtata

SEQ ID NO: 178112 - DNA, 21 bp, Mus musculus
atgtgtatatatatgtgtatg

SEQ ID NO: 178113 - DNA, 19 bp, Mus musculus
ctggatattatatatgtgt

SEQ ID NO: 178114 - DNA, 23 bp, Mus musculus
gagtcactgtgtctgtccctcag

SEQ ID NO: 178115 - DNA, 19 bp, Mus musculus
tgaggtagtagcttgtttt

SEQ ID NO: 178116 - DNA, 21 bp, Mus musculus
agggatgttgaggctgtctag

SEQ ID NO: 178117 - DNA, 21 bp, Mus musculus
tcacacagtccctagaatcct

SEQ ID NO: 178118 - DNA, 23 bp, Mus musculus
agtagagcaatttttgtccagtg

SEQ ID NO: 178119 - DNA, 23 bp, Mus musculus
actcctaaatgatgatgatgcct

SEQ ID NO: 178120 - DNA, 22 bp, Mus musculus
gtgtgtatatatgtatatgtgt

SEQ ID NO: 178121 - DNA, 23 bp, Mus musculus
gtgagaaaagactgtgagcttgc

SEQ ID NO: 178122 - DNA, 23 bp, Mus musculus
tcagaagaccctgcactctgtct

SEQ ID NO: 178123 - DNA, 23 bp, Mus musculus
tgcgtgcgtgcgtgcgtgcgtgc

SEQ ID NO: 178124 - DNA, 22 bp, Mus musculus
tagagagctaagactcttcaga

SEQ ID NO: 178125 - DNA, 22 bp, Mus musculus
ctgagatctgagtgtggagagt

SEQ ID NO: 178126 - DNA, 21 bp, Mus musculus
ttcagagagttagttttagag

SEQ ID NO: 178127 - DNA, 23 bp, Mus musculus
tgtcacgctgtgtgtttcatgtg

SEQ ID NO: 178128 - DNA, 23 bp, Mus musculus
agtgtaaggaaaagaaacatttt

SEQ ID NO: 178129 - DNA, 21 bp, Mus musculus
tactgtagtgaaattcttgaa

SEQ ID NO: 178130 - DNA, 23 bp, Mus musculus
tatgtatgtatgtattgttatgt

SEQ ID NO: 178131 - DNA, 20 bp, Mus musculus
gtaggcattggaatttcaga

SEQ ID NO: 178132 - DNA, 23 bp, Mus musculus
gcccagtctctctctctgcctga

SEQ ID NO: 178133 - DNA, 23 bp, Mus musculus
aagacttatgttttgtgtgtgca

SEQ ID NO: 178134 - DNA, 23 bp, Mus musculus
tctgtgcttgttctaagtggtga

SEQ ID NO: 178135 - DNA, 23 bp, Mus musculus
tctctctctgtggttgtggagtt

SEQ ID NO: 178136 - DNA, 22 bp, Mus musculus
tgagaagaatgactgctctgaa

SEQ ID NO: 178137 - DNA, 21 bp, Mus musculus
tgaaagaatagttacagttca

SEQ ID NO: 178138 - DNA, 23 bp, Mus musculus
accctctctcactgtgagaagtc

SEQ ID NO: 178139 - DNA, 20 bp, Mus musculus
ttttgggttgtaaagaagta

SEQ ID NO: 178140 - DNA, 23 bp, Mus musculus
ctctcacactgtctgtagctcca

SEQ ID NO: 178141 - DNA, 23 bp, Mus musculus
tctcacacagatgtgcgtgcagg

SEQ ID NO: 178142 - DNA, 19 bp, Mus musculus
tccctgtctgaaaaagaag

SEQ ID NO: 178143 - DNA, 23 bp, Mus musculus
ctgtgactgggtctgtgagtggt

SEQ ID NO: 178144 - DNA, 23 bp, Mus musculus
ttgctacatacagagcacctatg

SEQ ID NO: 178145 - DNA, 23 bp, Mus musculus
agtgcctgtctgagtccctgtct

SEQ ID NO: 178146 - DNA, 22 bp, Mus musculus
gagatgacagtgacaggactga

SEQ ID NO: 178147 - DNA, 23 bp, Mus musculus
gtgtgtagagagggagctgagca

SEQ ID NO: 178148 - DNA, 19 bp, Mus musculus
tgttcatctccctcccgct

SEQ ID NO: 178149 - DNA, 18 bp, Mus musculus
tttcagcaaccacatggt

SEQ ID NO: 178150 - DNA, 22 bp, Mus musculus
ggcagtctgtcactgatgtagc

SEQ ID NO: 178151 - DNA, 23 bp, Mus musculus
gtctgtgtcaatctgtgtgaccc

SEQ ID NO: 178152 - DNA, 18 bp, Mus musculus
atgcagatctccctggtt

SEQ ID NO: 178153 - DNA, 20 bp, Mus musculus
tgggacagggactcctcagc

SEQ ID NO: 178154 - DNA, 23 bp, Mus musculus
actgagggcctctctcttgctct

SEQ ID NO: 178155 - DNA, 21 bp, Mus musculus
actatgtgttgagaaatactc

SEQ ID NO: 178156 - DNA, 22 bp, Mus musculus
tgtgtgtcaccaggtccagcac

SEQ ID NO: 178157 - DNA, 23 bp, Mus musculus
tgtgagaacactctcagcactgg

SEQ ID NO: 178158 - DNA, 23 bp, Mus musculus
taccctgtagaaccgaatttgtg

SEQ ID NO: 178159 - DNA, 21 bp, Mus musculus
attctaggggaatatatggtc

SEQ ID NO: 178160 - DNA, 19 bp, Mus musculus
atgtgtgtgtatgtatata

SEQ ID NO: 178161 - DNA, 19 bp, Mus musculus
agggaggaagtaggctaag

SEQ ID NO: 178162 - DNA, 20 bp, Mus musculus
tacatacacatatacatatg

SEQ ID NO: 178163 - DNA, 22 bp, Mus musculus
atgccactgtggctctgtttgt

SEQ ID NO: 178164 - DNA, 23 bp, Mus musculus
aaattacattgcatttggtttgt

SEQ ID NO: 178165 - DNA, 23 bp, Mus musculus
tctgtcactcattatctgtgtgg

SEQ ID NO: 178166 - DNA, 23 bp, Mus musculus
tcttgagtgtgagctctgtctct

SEQ ID NO: 178167 - DNA, 20 bp, Mus musculus
atctcaagtcaacttgctga

SEQ ID NO: 178168 - DNA, 23 bp, Mus musculus
tcacactggctaagttaagttag

SEQ ID NO: 178169 - DNA, 23 bp, Mus musculus
tcacactggctgagttaactagc

SEQ ID NO: 178170 - DNA, 22 bp, Mus musculus
tgtgtctgtgcatgtgcacatg

SEQ ID NO: 178171 - DNA, 23 bp, Mus musculus
ctgtctgtctgtctgtctgtctg

SEQ ID NO: 178172 - DNA, 23 bp, Mus musculus
gatgtctgaatttcttgttgtgt

SEQ ID NO: 178173 - DNA, 23 bp, Mus musculus
ctcttttctgactctctcacctt

SEQ ID NO: 178174 - DNA, 23 bp, Mus musculus
aatgtaggtgacattggacgtca

SEQ ID NO: 178175 - DNA, 23 bp, Mus musculus
tgtgtgcgtctgtctctggctta

SEQ ID NO: 178176 - DNA, 23 bp, Mus musculus
gtgacagaagattcagacccaca

SEQ ID NO: 178177 - DNA, 21 bp, Mus musculus
agtggaaataggttgtacaga

SEQ ID NO: 178178 - DNA, 23 bp, Mus musculus
ctctccctcactctctgtttgac

SEQ ID NO: 178179 - DNA, 21 bp, Mus musculus
aatgccagtatgtttatatct

SEQ ID NO: 178180 - DNA, 19 bp, Mus musculus
agactgagagcaatgctgg

SEQ ID NO: 178181 - DNA, 23 bp, Mus musculus
gttgacttcaggatgtctttcct

SEQ ID NO: 178182 - DNA, 21 bp, Mus musculus
ttattctattttaaggaatga

SEQ ID NO: 178183 - DNA, 20 bp, Mus musculus
ttttgtgaccaattatatgg

SEQ ID NO: 178184 - DNA, 23 bp, Mus musculus
agctgactgctcttccagaggtc

SEQ ID NO: 178185 - DNA, 19 bp, Mus musculus
tgagacatacacaaaggag

SEQ ID NO: 178186 - DNA, 20 bp, Mus musculus
tctgattttattttctttgt

SEQ ID NO: 178187 - DNA, 23 bp, Mus musculus
agttgtgctggagaggcagctca

SEQ ID NO: 178188 - DNA, 20 bp, Mus musculus
aaactgctttgtcaggactg

SEQ ID NO: 178189 - DNA, 18 bp, Mus musculus
tctgggtgtgtgagttca

SEQ ID NO: 178190 - DNA, 23 bp, Mus musculus
agactgcatcctgtgtctctgtc

SEQ ID NO: 178191 - DNA, 22 bp, Mus musculus
tgtctctctccctctcttgtgg

SEQ ID NO: 178192 - DNA, 23 bp, Mus musculus
gtgtgcctgtctctctgcctccc

SEQ ID NO: 178193 - DNA, 23 bp, Mus musculus
ttctactgacaggatttttctgt

SEQ ID NO: 178194 - DNA, 23 bp, Mus musculus
cagaaattctgtcttctagcctt

SEQ ID NO: 178195 - DNA, 19 bp, Mus musculus
gaatatttgttacgtgata

SEQ ID NO: 178196 - DNA, 19 bp, Mus musculus
catgtacctagtgtctgtg

SEQ ID NO: 178197 - DNA, 23 bp, Mus musculus
cctggtggtctctgtctctgtca

SEQ ID NO: 178198 - DNA, 22 bp, Mus musculus
tgttttgtgaccaattatatgg

SEQ ID NO: 178199 - DNA, 22 bp, Mus musculus
tgttttgtgaccaattatatgg

SEQ ID NO: 178200 - DNA, 22 bp, Mus musculus
tgttttgtgaccaattatatgg

SEQ ID NO: 178201 - DNA, 19 bp, Mus musculus
cttgagtagtgagcaaatt

SEQ ID NO: 178202 - DNA, 22 bp, Mus musculus
atctctctgtgtcagatatacc

SEQ ID NO: 178203 - DNA, 21 bp, Mus musculus
aagtatgtatgtatgtgtgtg

SEQ ID NO: 178204 - DNA, 23 bp, Mus musculus
atgtatgtatgtgtgcaggtgaa

SEQ ID NO: 178205 - DNA, 23 bp, Mus musculus
ttcagtgtctgtcagtgacagtc

SEQ ID NO: 178206 - DNA, 23 bp, Mus musculus
cactttctgtgactcagtttgtg

SEQ ID NO: 178207 - DNA, 22 bp, Mus musculus
tgttttgtgaccaattatatgg

SEQ ID NO: 178208 - DNA, 23 bp, Mus musculus
ctcagttctcagtgagcagtttc

SEQ ID NO: 178209 - DNA, 23 bp, Mus musculus
tttactggacctgctgctgtttt

SEQ ID NO: 178210 - DNA, 21 bp, Mus musculus
atatgtatgtgtatatatgtg

SEQ ID NO: 178211 - DNA, 23 bp, Mus musculus
gcctgcctgcctgcctgcctgcc

SEQ ID NO: 178212 - DNA, 21 bp, Mus musculus
agtgcaaattgtatgtgatag

SEQ ID NO: 178213 - DNA, 20 bp, Mus musculus
tatgtgtatgtatatatgta

SEQ ID NO: 178214 - DNA, 18 bp, Mus musculus
atgtatctatatgtgtgc

SEQ ID NO: 178215 - DNA, 20 bp, Mus musculus
tgtacatgcacacacatata

SEQ ID NO: 178216 - DNA, 19 bp, Mus musculus
atgcataaatacatatgtg

SEQ ID NO: 178217 - DNA, 18 bp, Mus musculus
tcagtgctctgtatcgtc

SEQ ID NO: 178218 - DNA, 23 bp, Mus musculus
tctgtctgcctgcctgcctgcct

SEQ ID NO: 178219 - DNA, 23 bp, Mus musculus
tcagaggtctacatagctctttg

SEQ ID NO: 178220 - DNA, 23 bp, Mus musculus
agctcacactctgtctctgtctg

SEQ ID NO: 178221 - DNA, 20 bp, Mus musculus
tgtgtgtgtgtgtgtgtgtg

SEQ ID NO: 178222 - DNA, 23 bp, Mus musculus
atatgtatgcatatatatgcata

SEQ ID NO: 178223 - DNA, 22 bp, Mus musculus
tgttttgtgaccaattatatgg

SEQ ID NO: 178224 - DNA, 22 bp, Mus musculus
tgttttgtgaccaattatatgg

SEQ ID NO: 178225 - DNA, 23 bp, Mus musculus
ctgtctctgagtgtgggaaaggt

SEQ ID NO: 178226 - DNA, 23 bp, Mus musculus
tatatacatgtatatgtatacat

SEQ ID NO: 178227 - DNA, 23 bp, Mus musculus
atgaaatgatgatatgggtctga

SEQ ID NO: 178228 - DNA, 20 bp, Mus musculus
gagagtccagagtgaggtca

SEQ ID NO: 178229 - DNA, 23 bp, Mus musculus
ttagttctctattgattgtgtag

SEQ ID NO: 178230 - DNA, 23 bp, Mus musculus
ttctcacattgtatgctgctggt

SEQ ID NO: 178231 - DNA, 21 bp, Mus musculus
ggatgacttgtgtttatgttc

SEQ ID NO: 178232 - DNA, 22 bp, Mus musculus
atagttggtccacagtcagaga

SEQ ID NO: 178233 - DNA, 23 bp, Mus musculus
cttctctgtcagtgttaagtagc

SEQ ID NO: 178234 - DNA, 23 bp, Mus musculus
tctgtgtctgtctctaaaccttg

SEQ ID NO: 178235 - DNA, 19 bp, Mus musculus
aaagattcaaggtgagagt

SEQ ID NO: 178236 - DNA, 23 bp, Mus musculus
atgtgtacatatcattggtatat

SEQ ID NO: 178237 - DNA, 23 bp, Mus musculus
tgtgtgtgcatgtgcttgtgtgt

SEQ ID NO: 178238 - DNA, 22 bp, Mus musculus
tgttttgtgaccaattatatgg

SEQ ID NO: 178239 - DNA, 22 bp, Mus musculus
tgttttgtgaccaattatatgg

SEQ ID NO: 178240 - DNA, 23 bp, Mus musculus
atcaaccttgaaagtgatagtac

SEQ ID NO: 178241 - DNA, 22 bp, Mus musculus
ttttaggaagtgattgttatca

SEQ ID NO: 178242 - DNA, 22 bp, Mus musculus
tatgtatgtatgtatgtatcaa

SEQ ID NO: 178243 - DNA, 23 bp, Mus musculus
tgtatgcatgcatgtatgtatgt

SEQ ID NO: 178244 - DNA, 22 bp, Mus musculus
tgttttgtgaccaattatatgg

SEQ ID NO: 178245 - DNA, 21 bp, Mus musculus
ctcacttactcactgagccat

SEQ ID NO: 178246 - DNA, 22 bp, Mus musculus
tgttttgtgaccaattatatgg

SEQ ID NO: 178247 - DNA, 23 bp, Mus musculus
gtatatatgtatatgtgtatatg

SEQ ID NO: 178248 - DNA, 20 bp, Mus musculus
tatgtgcatgtatatcgcat

SEQ ID NO: 178249 - DNA, 20 bp, Mus musculus
tcagtgttgccctctgtcct

SEQ ID NO: 178250 - DNA, 23 bp, Mus musculus
aagagcactgactgctcttccag

SEQ ID NO: 178251 - DNA, 23 bp, Mus musculus
tatacatgtgtttatgtatatga

SEQ ID NO: 178252 - DNA, 22 bp, Mus musculus
ttgatcttccagaggaccagag

SEQ ID NO: 178253 - DNA, 20 bp, Mus musculus
tgactgatgactgtctctag

SEQ ID NO: 178254 - DNA, 23 bp, Mus musculus
tatatgtatatgtatatgtgtgt

SEQ ID NO: 178255 - DNA, 23 bp, Mus musculus
gtatgtatgtatgtatgtatgtg

SEQ ID NO: 178256 - DNA, 23 bp, Mus musculus
gtctgcatgtgtgtgtgtgtatg

SEQ ID NO: 178257 - DNA, 23 bp, Mus musculus
tctctctctcactgtgtgcgtgc

SEQ ID NO: 178258 - DNA, 18 bp, Mus musculus
gctggcactctgtattcc

SEQ ID NO: 178259 - DNA, 21 bp, Mus musculus
tgtatacatgtatgtgtgtgt

SEQ ID NO: 178260 - DNA, 19 bp, Mus musculus
tgcatgtacatatgtgtgt

SEQ ID NO: 178261 - DNA, 19 bp, Mus musculus
tgcaagtacatatgtgtgt

SEQ ID NO: 178262 - DNA, 23 bp, Mus musculus
tatgtatgtatgtatgtatgtat

SEQ ID NO: 178263 - DNA, 22 bp, Mus musculus
atatgagacagctataccaggg

SEQ ID NO: 178264 - DNA, 23 bp, Mus musculus
ttctctctgactcctatggaaat

SEQ ID NO: 178265 - DNA, 18 bp, Mus musculus
tagtcagtgtttatgata

SEQ ID NO: 178266 - DNA, 20 bp, Mus musculus
aggagcttctggctttcata

SEQ ID NO: 178267 - DNA, 23 bp, Mus musculus
acactgtatgtcagaggtaaagt

SEQ ID NO: 178268 - DNA, 22 bp, Mus musculus
tttatagtttagcagcagatag

SEQ ID NO: 178269 - DNA, 20 bp, Mus musculus
ttgagctttgtgcaaggtga

SEQ ID NO: 178270 - DNA, 23 bp, Mus musculus
gtgtagctccatgtgtaatcttt

SEQ ID NO: 178271 - DNA, 23 bp, Mus musculus
actgtgtctctgtttagtttctg

SEQ ID NO: 178272 - DNA, 23 bp, Mus musculus
ctgtccattgatgagagtggggt

SEQ ID NO: 178273 - DNA, 23 bp, Mus musculus
gtctctctgtgggtgtctctctg

SEQ ID NO: 178274 - DNA, 21 bp, Mus musculus
ttcagacaacatagaagagag

SEQ ID NO: 178275 - DNA, 22 bp, Mus musculus
tgttttgtgaccaattatatgg

SEQ ID NO: 178276 - DNA, 19 bp, Mus musculus
aagaatagagatttagggc

SEQ ID NO: 178277 - DNA, 22 bp, Mus musculus
tgttttgtgaccaattatatgg

SEQ ID NO: 178278 - DNA, 23 bp, Mus musculus
ttgtgagagccagagttgttgga

SEQ ID NO: 178279 - DNA, 23 bp, Mus musculus
ttgagtttatttatctaagtgat

SEQ ID NO: 178280 - DNA, 22 bp, Mus musculus
tgttttgtgaccaattatatgg

SEQ ID NO: 178281 - DNA, 22 bp, Mus musculus
tgttttgtgaccaattatatgg

SEQ ID NO: 178282 - DNA, 22 bp, Mus musculus
tgttttgtgaccaattatatgg

SEQ ID NO: 178283 - DNA, 21 bp, Mus musculus
tgcagaagactgaaacctgaa

SEQ ID NO: 178284 - DNA, 18 bp, Mus musculus
ttcaaaatctttacacat

SEQ ID NO: 178285 - DNA, 23 bp, Mus musculus
tctgtatctgtctgagtcagctg

SEQ ID NO: 178286 - DNA, 23 bp, Mus musculus
gaatttcagggtcattttgattt

SEQ ID NO: 178287 - DNA, 22 bp, Mus musculus
tatgtgtatgcatatacataca

SEQ ID NO: 178288 - DNA, 19 bp, Mus musculus
actcactgagatctgcaac

SEQ ID NO: 178289 - DNA, 22 bp, Mus musculus
tgttttgtgaccaattatatgg

SEQ ID NO: 178290 - DNA, 23 bp, Mus musculus
tatgtagaatatgtatacatatg

SEQ ID NO: 178291 - DNA, 18 bp, Mus musculus
tgtgtgtgtatgtatata

SEQ ID NO: 178292 - DNA, 23 bp, Mus musculus
tagagagatgattcagaggtcaa

SEQ ID NO: 178293 - DNA, 23 bp, Mus musculus
ttttgatgaagacaccccatatg

SEQ ID NO: 178294 - DNA, 23 bp, Mus musculus
cattgatgtctgcattagttctc

SEQ ID NO: 178295 - DNA, 22 bp, Mus musculus
tgttttgtgaccaattatatgg

SEQ ID NO: 178296 - DNA, 22 bp, Mus musculus
tgttttgtgaccaattatatgg

SEQ ID NO: 178297 - DNA, 23 bp, Mus musculus
gcctcagtccctctgtgcttctg

SEQ ID NO: 178298 - DNA, 23 bp, Mus musculus
tgcatgtatgtatacttgttgat

SEQ ID NO: 178299 - DNA, 18 bp, Mus musculus
tgtgatgattttgtaaag

SEQ ID NO: 178300 - DNA, 22 bp, Mus musculus
tgttttgtgaccaattttatgg

SEQ ID NO: 178301 - DNA, 23 bp, Mus musculus
tgagttagtagcatgtactcata

SEQ ID NO: 178302 - DNA, 23 bp, Mus musculus
tgtgtgagtgcctgtcacgtgtg

SEQ ID NO: 178303 - DNA, 22 bp, Mus musculus
actccttcgttgtttgtgtgcc

SEQ ID NO: 178304 - DNA, 21 bp, Mus musculus
ctggggctgaagagatggctc

SEQ ID NO: 178305 - DNA, 20 bp, Mus musculus
ggctgcctcactcattcact

SEQ ID NO: 178306 - DNA, 23 bp, Mus musculus
ctggcagtagtgttcatgtatat

SEQ ID NO: 178307 - DNA, 23 bp, Mus musculus
ggtctctgtgtctgtgtgtagtg

SEQ ID NO: 178308 - DNA, 23 bp, Mus musculus
agagaggaaatggtacttgtcac

SEQ ID NO: 178309 - DNA, 23 bp, Mus musculus
ccagtctctgtctgtctcctgtc

SEQ ID NO: 178310 - DNA, 18 bp, Mus musculus
acagtagatttgcaaatg

SEQ ID NO: 178311 - DNA, 23 bp, Mus musculus
aagagcactgtctctcttctgga

SEQ ID NO: 178312 - DNA, 21 bp, Mus musculus
actctcactcacacatggaac

SEQ ID NO: 178313 - DNA, 20 bp, Mus musculus
gtggttaaaacatatggttc

SEQ ID NO: 178314 - DNA, 22 bp, Mus musculus
accccaagatcatagtggcctg

SEQ ID NO: 178315 - DNA, 19 bp, Mus musculus
aaattctgtgaacaaggtg

SEQ ID NO: 178316 - DNA, 23 bp, Mus musculus
tcacacagagaaggctttgccat

SEQ ID NO: 178317 - DNA, 23 bp, Mus musculus
tgtgtgtctgtgtgtctgtctgc

SEQ ID NO: 178318 - DNA, 23 bp, Mus musculus
ttttaagagcaggtttattggtg

SEQ ID NO: 178319 - DNA, 23 bp, Mus musculus
gggactctgtctgtcagtggggc

SEQ ID NO: 178320 - DNA, 21 bp, Mus musculus
tagtccttcctactactcaag

SEQ ID NO: 178321 - DNA, 23 bp, Mus musculus
tgtctctctgtgattagtgattg

SEQ ID NO: 178322 - DNA, 20 bp, Mus musculus
ggttagaacttgctttgtag

SEQ ID NO: 178323 - DNA, 23 bp, Mus musculus
tctctgtgtgatgggtttgtaaa

SEQ ID NO: 178324 - DNA, 23 bp, Mus musculus
atcactctcacggtctcatttgg

SEQ ID NO: 178325 - DNA, 23 bp, Mus musculus
cggtccgtccgtccgtccgtccg

SEQ ID NO: 178326 - DNA, 22 bp, Mus musculus
tctcactgtacagtctgaggac

SEQ ID NO: 178327 - DNA, 19 bp, Mus musculus
atggctcagctctgtgtct

SEQ ID NO: 178328 - DNA, 22 bp, Mus musculus
tactcctagaaaacagtatgga

SEQ ID NO: 178329 - DNA, 23 bp, Mus musculus
tgagagaagagacacagcttaga

SEQ ID NO: 178330 - DNA, 22 bp, Mus musculus
agagaccagaaggagcaccaga

SEQ ID NO: 178331 - DNA, 23 bp, Mus musculus
ttctcagttgtgtgtgtctcagc

SEQ ID NO: 178332 - DNA, 20 bp, Mus musculus
agggtgtgtgctggtgcagt

SEQ ID NO: 178333 - DNA, 22 bp, Mus musculus
tgttactgcaagaccacctgtg

SEQ ID NO: 178334 - DNA, 20 bp, Mus musculus
ttcaattctcagcaaccaca

SEQ ID NO: 178335 - DNA, 20 bp, Mus musculus
tactcctcttattctactag

SEQ ID NO: 178336 - DNA, 23 bp, Mus musculus
caaatcccagaaaccacatgatg

SEQ ID NO: 178337 - DNA, 20 bp, Mus musculus
ctcagactccctgtaagcct

SEQ ID NO: 178338 - DNA, 19 bp, Mus musculus
tgtatgcatatgcttgtgt

SEQ ID NO: 178339 - DNA, 20 bp, Mus musculus
tttgtgtatgtatgtatatg

SEQ ID NO: 178340 - DNA, 18 bp, Mus musculus
gtgtctatgtgtgtgtgc

SEQ ID NO: 178341 - DNA, 22 bp, Mus musculus
tttctgcatgtgtatgtgcatg

SEQ ID NO: 178342 - DNA, 18 bp, Mus musculus
tgcatctgtgtatatatg

SEQ ID NO: 178343 - DNA, 23 bp, Mus musculus
agaggttcctctgtctctgcctc

SEQ ID NO: 178344 - DNA, 23 bp, Mus musculus
tgtgaaactcagagattagggaa

SEQ ID NO: 178345 - DNA, 23 bp, Mus musculus
agactctctgcctgagactggga

SEQ ID NO: 178346 - DNA, 23 bp, Mus musculus
tctctgcctgtctgctctattct

SEQ ID NO: 178347 - DNA, 23 bp, Mus musculus
gaagtgtagagagtctcagctct

SEQ ID NO: 178348 - DNA, 23 bp, Mus musculus
tgtgtggatgatcacagctgctg

SEQ ID NO: 178349 - DNA, 20 bp, Mus musculus
cactgtgtgcctgtgtcctt

SEQ ID NO: 178350 - DNA, 23 bp, Mus musculus
tctctgtatgtgtgtgtacatgt

SEQ ID NO: 178351 - DNA, 18 bp, Mus musculus
tctgatcctctcagagct

SEQ ID NO: 178352 - DNA, 23 bp, Mus musculus
tgtcgttcttgaaagctgtttca

SEQ ID NO: 178353 - DNA, 20 bp, Mus musculus
tctgcataactattctgaaa

SEQ ID NO: 178354 - DNA, 23 bp, Mus musculus
taggggtatagttcagtgtggaa

SEQ ID NO: 178355 - DNA, 23 bp, Mus musculus
agacactactgtcagagcagagt

SEQ ID NO: 178356 - DNA, 23 bp, Mus musculus
tttgtcctgtagtattgagtaag

SEQ ID NO: 178357 - DNA, 23 bp, Mus musculus
cctgagtgcgtgtgtgcgtgcgt

SEQ ID NO: 178358 - DNA, 23 bp, Mus musculus
gcactctctggctcttacagtcc

SEQ ID NO: 178359 - DNA, 21 bp, Mus musculus
agacagtcatgtcacctccat

SEQ ID NO: 178360 - DNA, 18 bp, Mus musculus
tccacatatgtatgtatg

SEQ ID NO: 178361 - DNA, 23 bp, Mus musculus
gaaagtggatggatagaagcagt

SEQ ID NO: 178362 - DNA, 23 bp, Mus musculus
ttaactctcatgcctctgcctgt

SEQ ID NO: 178363 - DNA, 23 bp, Mus musculus
tctgatcatggtacactggctca

SEQ ID NO: 178364 - DNA, 23 bp, Mus musculus
tgtatgtatgtatatatgaatgt

SEQ ID NO: 178365 - DNA, 23 bp, Mus musculus
tctgcctctcacactctttgggc

SEQ ID NO: 178366 - DNA, 18 bp, Mus musculus
tatgtatgtatgtatgta

SEQ ID NO: 178367 - DNA, 20 bp, Mus musculus
gacaagatcctaaatgatta

SEQ ID NO: 178368 - DNA, 23 bp, Mus musculus
tctatctatatctatatctgtgt

SEQ ID NO: 178369 - DNA, 22 bp, Mus musculus
tgttttgtgaccaattatatgg

SEQ ID NO: 178370 - DNA, 23 bp, Mus musculus
tatatgtaatgtatacatatatg

SEQ ID NO: 178371 - DNA, 22 bp, Mus musculus
tgttttgtgaccaattatatgg

SEQ ID NO: 178372 - DNA, 22 bp, Mus musculus
tgttttgtgaccaattatatgg

SEQ ID NO: 178373 - DNA, 18 bp, Mus musculus
acccactgcctaacatgt

SEQ ID NO: 178374 - DNA, 23 bp, Mus musculus
atttatatacatgtgcaagtgtt

SEQ ID NO: 178375 - DNA, 22 bp, Mus musculus
tgaagtactatgttgaatagtt

SEQ ID NO: 178376 - DNA, 23 bp, Mus musculus
tctccctgccagaggagagtcag

SEQ ID NO: 178377 - DNA, 19 bp, Mus musculus
ggctcacactctgggactc

SEQ ID NO: 178378 - DNA, 22 bp, Mus musculus
tgttttgtgaccaattatatgg

SEQ ID NO: 178379 - DNA, 23 bp, Mus musculus
tctgtctgtctgtctgtctgtct

SEQ ID NO: 178380 - DNA, 23 bp, Mus musculus
atatctgtgtggttttgtgcatg

SEQ ID NO: 178381 - DNA, 22 bp, Mus musculus
tactctcatttttttctagttg

SEQ ID NO: 178382 - DNA, 19 bp, Mus musculus
cttgctgtctgtgaactct

SEQ ID NO: 178383 - DNA, 22 bp, Mus musculus
tgttttgtgaccaattatatgg

SEQ ID NO: 178384 - DNA, 19 bp, Mus musculus
atgtgtatacatgtagtac

SEQ ID NO: 178385 - DNA, 21 bp, Mus musculus
atgtatgtatgtatgtatgta

SEQ ID NO: 178386 - DNA, 18 bp, Mus musculus
tgtaggtatccctggttt

SEQ ID NO: 178387 - DNA, 23 bp, Mus musculus
agagactgaactgtgtgagttca

SEQ ID NO: 178388 - DNA, 21 bp, Mus musculus
aacagagtttggttttcaatt

SEQ ID NO: 178389 - DNA, 22 bp, Mus musculus
tgttttgtgaccaattatatgg

SEQ ID NO: 178390 - DNA, 23 bp, Mus musculus
agatacagcttgagaaatgctgg

SEQ ID NO: 178391 - DNA, 23 bp, Mus musculus
actgtctgtctgtctgtctgtct

SEQ ID NO: 178392 - DNA, 23 bp, Mus musculus
taggagaacttgcagattttgag

SEQ ID NO: 178393 - DNA, 23 bp, Mus musculus
gttatcactgtgaatttcaaatg

SEQ ID NO: 178394 - DNA, 19 bp, Mus musculus
tgtgacaacagaaacagat

SEQ ID NO: 178395 - DNA, 22 bp, Mus musculus
atgcatgtatatatatatgtat

SEQ ID NO: 178396 - DNA, 23 bp, Mus musculus
atacattcatcactttctggatc

SEQ ID NO: 178397 - DNA, 23 bp, Mus musculus
agtgtttatggaagctctttttc

SEQ ID NO: 178398 - DNA, 22 bp, Mus musculus
tgttttgtgaccaattatatgg

SEQ ID NO: 178399 - DNA, 22 bp, Mus musculus
tgttttgtgaccaattatatgg

SEQ ID NO: 178400 - DNA, 20 bp, Mus musculus
attttgtcactcactcacat

SEQ ID NO: 178401 - DNA, 23 bp, Mus musculus
atgagactagagtgtgagtcaac

SEQ ID NO: 178402 - DNA, 23 bp, Mus musculus
actgagtagacactgaggacatg

SEQ ID NO: 178403 - DNA, 23 bp, Mus musculus
tcgctctgtgtctgtatgtctgt

SEQ ID NO: 178404 - DNA, 23 bp, Mus musculus
caagacatcttcatctaaactac

SEQ ID NO: 178405 - DNA, 19 bp, Mus musculus
aagaaaggtagtaagattg

SEQ ID NO: 178406 - DNA, 23 bp, Mus musculus
tatggagagagataaagatatga

SEQ ID NO: 178407 - DNA, 22 bp, Mus musculus
tgttttgtgaccaattatatgg

SEQ ID NO: 178408 - DNA, 20 bp, Mus musculus
ttatgtgaccaattatatgg

SEQ ID NO: 178409 - DNA, 22 bp, Mus musculus
tgttttgtgaccaattatatgg

SEQ ID NO: 178410 - DNA, 23 bp, Mus musculus
tgtgtatgtgtgtgtaaatatgt

SEQ ID NO: 178411 - DNA, 19 bp, Mus musculus
atgtatatatgtatgtatg

SEQ ID NO: 178412 - DNA, 23 bp, Mus musculus
ctttagatagtgtgcatgtgtat

SEQ ID NO: 178413 - DNA, 19 bp, Mus musculus
tatgtgtgtgtgcatatat

SEQ ID NO: 178414 - DNA, 23 bp, Mus musculus
tcaatgtcagtgcctctttacac

SEQ ID NO: 178415 - DNA, 23 bp, Mus musculus
gtggttgaaagtcagcattgaaa

SEQ ID NO: 178416 - DNA, 20 bp, Mus musculus
atgtgtatatatatatatgt

SEQ ID NO: 178417 - DNA, 21 bp, Mus musculus
tgtgcttcatctaatgattga

SEQ ID NO: 178418 - DNA, 22 bp, Mus musculus
tgttttgtgaccaattatatgg

SEQ ID NO: 178419 - DNA, 22 bp, Mus musculus
tgttttgtgaccaattatatgg

SEQ ID NO: 178420 - DNA, 22 bp, Mus musculus
tgttttgtgaccaattatatgg

SEQ ID NO: 178421 - DNA, 23 bp, Mus musculus
gtctctgtctgtctgtctgcctt

SEQ ID NO: 178422 - DNA, 22 bp, Mus musculus
tgagtgaggatatgtatggctt

SEQ ID NO: 178423 - DNA, 21 bp, Mus musculus
tatgggaatgtaatgctatgt

SEQ ID NO: 178424 - DNA, 21 bp, Mus musculus
tggaggcctgggtgtttctgc

SEQ ID NO: 178425 - DNA, 22 bp, Mus musculus
tgttttgtgaccaattatatgg

SEQ ID NO: 178426 - DNA, 18 bp, Mus musculus
tgtgtatgctatatatac

SEQ ID NO: 178427 - DNA, 22 bp, Mus musculus
tgttttgtgaccaattatatgg

SEQ ID NO: 178428 - DNA, 18 bp, Mus musculus
tgtgtatgctatatatac

SEQ ID NO: 178429 - DNA, 23 bp, Mus musculus
tgagttgcaagataatctagcct

SEQ ID NO: 178430 - DNA, 21 bp, Mus musculus
cttagtccatggtgatctgat

SEQ ID NO: 178431 - DNA, 23 bp, Mus musculus
gtctgtggctatgcagcaacaga

SEQ ID NO: 178432 - DNA, 21 bp, Mus musculus
aatgtctgtggctcatattac

SEQ ID NO: 178433 - DNA, 20 bp, Mus musculus
tatgcatgaatatgtattgt

SEQ ID NO: 178434 - DNA, 22 bp, Mus musculus
gctcctgtctctctgtctgtcc

SEQ ID NO: 178435 - DNA, 21 bp, Mus musculus
atgcctgtctgtgtgtgtgtg

SEQ ID NO: 178436 - DNA, 18 bp, Mus musculus
gtatatatggataagtgt

SEQ ID NO: 178437 - DNA, 21 bp, Mus musculus
tatatgtataagtatgtgtgt

SEQ ID NO: 178438 - DNA, 20 bp, Mus musculus
ctgcctgcctgcctgcctgc

SEQ ID NO: 178439 - DNA, 23 bp, Mus musculus
tatctctctgcctgtctgtctct

SEQ ID NO: 178440 - DNA, 23 bp, Mus musculus
tctgtgcctgtgtgggtctctcc

SEQ ID NO: 178441 - DNA, 23 bp, Mus musculus
aattctcagcaaccacatagcag

SEQ ID NO: 178442 - DNA, 23 bp, Mus musculus
tgactgctcttccagaggtcctg

SEQ ID NO: 178443 - DNA, 23 bp, Mus musculus
tttatgaccatctgtaatgggat

SEQ ID NO: 178444 - DNA, 19 bp, Mus musculus
agcaacttgggagttctgt

SEQ ID NO: 178445 - DNA, 20 bp, Mus musculus
aaagccaatgttttcctttg

SEQ ID NO: 178446 - DNA, 23 bp, Mus musculus
tttggctatgctagaactcactc

SEQ ID NO: 178447 - DNA, 23 bp, Mus musculus
tctctgtgactctgagtttcttt

SEQ ID NO: 178448 - DNA, 23 bp, Mus musculus
tgactaagtgcttgcgatttgag

SEQ ID NO: 178449 - DNA, 23 bp, Mus musculus
aatccttcatcaagtttgcttta

SEQ ID NO: 178450 - DNA, 23 bp, Mus musculus
ttccttcatgagattgccttagc

SEQ ID NO: 178451 - DNA, 22 bp, Mus musculus
tgttttgtgaccaattatatgg

SEQ ID NO: 178452 - DNA, 23 bp, Mus musculus
actggtattttactgtgtttgaa

SEQ ID NO: 178453 - DNA, 22 bp, Mus musculus
gcctcactccctgtcagcctcc

SEQ ID NO: 178454 - DNA, 23 bp, Mus musculus
agccacagtcactcactcagcga

SEQ ID NO: 178455 - DNA, 23 bp, Mus musculus
cctggctctctcagcctctccct

SEQ ID NO: 178456 - DNA, 23 bp, Mus musculus
cttgtcactgtcactgtcactgt

SEQ ID NO: 178457 - DNA, 23 bp, Mus musculus
agagtatgtgtatacatgtatgt

SEQ ID NO: 178458 - DNA, 19 bp, Mus musculus
tcactggaaagttgactcg

SEQ ID NO: 178459 - DNA, 23 bp, Mus musculus
tgtctgggtctcagtttcctcag

SEQ ID NO: 178460 - DNA, 23 bp, Mus musculus
actactaggttggaattgtcaaa

SEQ ID NO: 178461 - DNA, 23 bp, Mus musculus
agatttgtaatgtaatctagaag

SEQ ID NO: 178462 - DNA, 21 bp, Mus musculus
caggaacacatattttgtgta

SEQ ID NO: 178463 - DNA, 20 bp, Mus musculus
tacagatgtatgtatgcaga

SEQ ID NO: 178464 - DNA, 23 bp, Mus musculus
tgagtgtatatgtgtgtgtgtac

SEQ ID NO: 178465 - DNA, 23 bp, Mus musculus
gaatgtggatgtgtattgtatgt

SEQ ID NO: 178466 - DNA, 21 bp, Mus musculus
tcggagtagttttgatttgca

SEQ ID NO: 178467 - DNA, 23 bp, Mus musculus
tgtgtctgtctgtctgcgtgtgt

SEQ ID NO: 178468 - DNA, 22 bp, Mus musculus
ttcaagctctgtgtcacactgt

SEQ ID NO: 178469 - DNA, 23 bp, Mus musculus
tcagcctctgtcactgtctgtcg

SEQ ID NO: 178470 - DNA, 22 bp, Mus musculus
atgtatattagtagtatcatgt

SEQ ID NO: 178471 - DNA, 21 bp, Mus musculus
atacacacatatacacacaca

SEQ ID NO: 178472 - DNA, 23 bp, Mus musculus
cattttaagaaatggaaagaggt

SEQ ID NO: 178473 - DNA, 23 bp, Mus musculus
tgcctatctgtctgcttgattat

SEQ ID NO: 178474 - DNA, 22 bp, Mus musculus
tgtcaggctccctgtttgcttt

SEQ ID NO: 178475 - DNA, 22 bp, Mus musculus
tattgggctgtgaaggcagttg

SEQ ID NO: 178476 - DNA, 23 bp, Mus musculus
agctctcacagtcagctcagggc

SEQ ID NO: 178477 - DNA, 23 bp, Mus musculus
aggggcagtgagtgatcagagtg

SEQ ID NO: 178478 - DNA, 19 bp, Mus musculus
agcaacctagactagctga

SEQ ID NO: 178479 - DNA, 23 bp, Mus musculus
tctctgtccaagagtccctgcct

SEQ ID NO: 178480 - DNA, 23 bp, Mus musculus
tccatttcaagacactgtttctc

SEQ ID NO: 178481 - DNA, 22 bp, Mus musculus
ttactcagatttgttcttcagt

SEQ ID NO: 178482 - DNA, 22 bp, Mus musculus
tgttttgtgaccaattatatgg

SEQ ID NO: 178483 - DNA, 23 bp, Mus musculus
tctgtctgtctgtctgtctttct

SEQ ID NO: 178484 - DNA, 19 bp, Mus musculus
tgtgtgtgtatgtacgtat

SEQ ID NO: 178485 - DNA, 23 bp, Mus musculus
tatgtggtattatttagatatct

SEQ ID NO: 178486 - DNA, 21 bp, Mus musculus
tatgctaattattgtatacta

SEQ ID NO: 178487 - DNA, 23 bp, Mus musculus
agcatatatgtacattatgatat

SEQ ID NO: 178488 - DNA, 21 bp, Mus musculus
tgcatccagatgtagaactct

SEQ ID NO: 178489 - DNA, 22 bp, Mus musculus
gcactgtgctagtgagtgcttg

SEQ ID NO: 178490 - DNA, 18 bp, Mus musculus
aagtttttttaaaagtat

SEQ ID NO: 178491 - DNA, 23 bp, Mus musculus
actcactgtcatgtgttctgagc

SEQ ID NO: 178492 - DNA, 21 bp, Mus musculus
tctctcacacacacaggcagt

SEQ ID NO: 178493 - DNA, 23 bp, Mus musculus
tagtcactttttatcaatgactt

SEQ ID NO: 178494 - DNA, 22 bp, Mus musculus
tgttttgtgaccaattatatgg

SEQ ID NO: 178495 - DNA, 22 bp, Mus musculus
gtggatgaggacttgactgctt

SEQ ID NO: 178496 - DNA, 23 bp, Mus musculus
tacagtgtctgtgtgtgtgtgtg

SEQ ID NO: 178497 - DNA, 22 bp, Mus musculus
ttcatccagtttttctagttct

SEQ ID NO: 178498 - DNA, 22 bp, Mus musculus
tgttttgtgaccaattatatgg

SEQ ID NO: 178499 - DNA, 22 bp, Mus musculus
tgttttgtgaccaattatatgg

SEQ ID NO: 178500 - DNA, 23 bp, Mus musculus
gtatggttgttttactgtatgta

SEQ ID NO: 178501 - DNA, 22 bp, Mus musculus
tatgtgtatatgtatatgtgtg

SEQ ID NO: 178502 - DNA, 18 bp, Mus musculus
tgtgtgcagatgcctgtg

SEQ ID NO: 178503 - DNA, 22 bp, Mus musculus
tatatttggataagaaatctct

SEQ ID NO: 178504 - DNA, 23 bp, Mus musculus
cactgtgattactgagacaggga

SEQ ID NO: 178505 - DNA, 23 bp, Mus musculus
tgtatgcatgtatgtatgtatgt

SEQ ID NO: 178506 - DNA, 22 bp, Mus musculus
tgtatgtgcatgtgcatgtgta

SEQ ID NO: 178507 - DNA, 23 bp, Mus musculus
tgtatgtgcatgtgcatgtgtat

SEQ ID NO: 178508 - DNA, 22 bp, Mus musculus
tgttttgtgaccaattatatgg

SEQ ID NO: 178509 - DNA, 21 bp, Mus musculus
tatgtatacacacacacacac

SEQ ID NO: 178510 - DNA, 18 bp, Mus musculus
gtgacaatacattcagat

SEQ ID NO: 178511 - DNA, 23 bp, Mus musculus
gtgttgatctgtctgtctgtcat

SEQ ID NO: 178512 - DNA, 23 bp, Mus musculus
tcttaggcagactaagaagtgac

SEQ ID NO: 178513 - DNA, 22 bp, Mus musculus
agttttctggcctttctctgtg

SEQ ID NO: 178514 - DNA, 22 bp, Mus musculus
atccatggtgatctgataggat

SEQ ID NO: 178515 - DNA, 21 bp, Mus musculus
aatgcaaagaagccatctctt

SEQ ID NO: 178516 - DNA, 22 bp, Mus musculus
tgttttgtgaccaattatatgg

SEQ ID NO: 178517 - DNA, 23 bp, Mus musculus
tgagatgagtcaaacaggttcag

SEQ ID NO: 178518 - DNA, 22 bp, Mus musculus
tgttttgtgaccaattatatgg

SEQ ID NO: 178519 - DNA, 23 bp, Mus musculus
ggctgtctctgactctgttgcct

SEQ ID NO: 178520 - DNA, 23 bp, Mus musculus
tctcactgtgtgtagtaagcagg

SEQ ID NO: 178521 - DNA, 22 bp, Mus musculus
tgttttgtgaccaattatatgg

SEQ ID NO: 178522 - DNA, 22 bp, Mus musculus
tgcctcctttataaatctatgt

SEQ ID NO: 178523 - DNA, 22 bp, Mus musculus
tgttttgtgaccaattatatgg

SEQ ID NO: 178524 - DNA, 23 bp, Mus musculus
ttagaggatgtggttatgatttt

SEQ ID NO: 178525 - DNA, 22 bp, Mus musculus
tgttttgtgaccaattatatgg

SEQ ID NO: 178526 - DNA, 23 bp, Mus musculus
tctctctttgtctgattgctctc

SEQ ID NO: 178527 - DNA, 23 bp, Mus musculus
attcaattcctagtaaacacatg

SEQ ID NO: 178528 - DNA, 23 bp, Mus musculus
tttaggtagaatagttttcaatt

SEQ ID NO: 178529 - DNA, 21 bp, Mus musculus
aactgtcagactgatttccag

SEQ ID NO: 178530 - DNA, 22 bp, Mus musculus
tgttttgtgaccaattatatgg

SEQ ID NO: 178531 - DNA, 22 bp, Mus musculus
tgttttgtgaccaattatatgg

SEQ ID NO: 178532 - DNA, 23 bp, Mus musculus
gagattagataaagacatccaat

SEQ ID NO: 178533 - DNA, 23 bp, Mus musculus
tctcactctctgtgtactgtcca

SEQ ID NO: 178534 - DNA, 22 bp, Mus musculus
tgttttgtgaccaattatatgg

SEQ ID NO: 178535 - DNA, 18 bp, Mus musculus
ggtgagagactctcgggg

SEQ ID NO: 178536 - DNA, 22 bp, Mus musculus
tgacagtagagagagagaattt

SEQ ID NO: 178537 - DNA, 22 bp, Mus musculus
tgttttgtgaccaattatatgg

SEQ ID NO: 178538 - DNA, 21 bp, Mus musculus
tgaacaccaatcttatatagt

SEQ ID NO: 178539 - DNA, 23 bp, Mus musculus
gtctgtctcagtcagctgttggt

SEQ ID NO: 178540 - DNA, 22 bp, Mus musculus
tgttttgtgaccaattatatgg

SEQ ID NO: 178541 - DNA, 20 bp, Mus musculus
atcatgttgatgtgttcttg

SEQ ID NO: 178542 - DNA, 20 bp, Mus musculus
cagacatcttggttctggga

SEQ ID NO: 178543 - DNA, 23 bp, Mus musculus
tctgagactctgagatcctggtg

SEQ ID NO: 178544 - DNA, 19 bp, Mus musculus
tatgtgtgtatatatatgt

SEQ ID NO: 178545 - DNA, 23 bp, Mus musculus
atatgtatatatacatatgtata

SEQ ID NO: 178546 - DNA, 21 bp, Mus musculus
attcactggcaaattctagag

SEQ ID NO: 178547 - DNA, 23 bp, Mus musculus
gtgtgtgtgtgtgcatgtgcaca

SEQ ID NO: 178548 - DNA, 19 bp, Mus musculus
atgggtgtggatgtttgtt

SEQ ID NO: 178549 - DNA, 21 bp, Mus musculus
caatatttttgtatcagttga

SEQ ID NO: 178550 - DNA, 21 bp, Mus musculus
tgtccaattatatggtcaatt

SEQ ID NO: 178551 - DNA, 23 bp, Mus musculus
acagtgtggctgtctgtctggca

SEQ ID NO: 178552 - DNA, 19 bp, Mus musculus
tacagagctgtgaactgtc

SEQ ID NO: 178553 - DNA, 22 bp, Mus musculus
agtggcggagagaaactgttgt

SEQ ID NO: 178554 - DNA, 22 bp, Mus musculus
taaagtctatttgatttggggt

SEQ ID NO: 178555 - DNA, 23 bp, Mus musculus
gtctgtctgtctgtctgcctgtc

SEQ ID NO: 178556 - DNA, 23 bp, Mus musculus
ctgagtgagtggtgagtcagcac

SEQ ID NO: 178557 - DNA, 23 bp, Mus musculus
tagaacacagagtggacagacgg

SEQ ID NO: 178558 - DNA, 23 bp, Mus musculus
tcactatgtgcaacatttagaag

SEQ ID NO: 178559 - DNA, 23 bp, Mus musculus
attttgtggatttcttttgataa

SEQ ID NO: 178560 - DNA, 21 bp, Mus musculus
ttcctgtattctttttaatgc

SEQ ID NO: 178561 - DNA, 21 bp, Mus musculus
tctgtctcttaatcactgagc

SEQ ID NO: 178562 - DNA, 23 bp, Mus musculus
gggacactgtgtgcctctcttca

SEQ ID NO: 178563 - DNA, 20 bp, Mus musculus
gcatgtatatgtgtgtgtgt

SEQ ID NO: 178564 - DNA, 23 bp, Mus musculus
tgtggttgggtgtgaaaacagga

SEQ ID NO: 178565 - DNA, 18 bp, Mus musculus
tatatgtgtgtatatgta

SEQ ID NO: 178566 - DNA, 23 bp, Mus musculus
tttctcagtttatttgaattttt

SEQ ID NO: 178567 - DNA, 22 bp, Mus musculus
tgttttgtgaccaattatatgg

SEQ ID NO: 178568 - DNA, 19 bp, Mus musculus
agggccagttgtatcacct

SEQ ID NO: 178569 - DNA, 23 bp, Mus musculus
atcactctctgtctcaatttttg

SEQ ID NO: 178570 - DNA, 22 bp, Mus musculus
tgttttgtgaccaattatatgg

SEQ ID NO: 178571 - DNA, 23 bp, Mus musculus
tctgagtgtctgagtgtcatgtg

SEQ ID NO: 178572 - DNA, 22 bp, Mus musculus
aatgacatcatgcttttcagac

SEQ ID NO: 178573 - DNA, 23 bp, Mus musculus
ttcagtgtgtgtgtgtgtgtgtg

SEQ ID NO: 178574 - DNA, 23 bp, Mus musculus
acaggtacagatgtctgcacata

SEQ ID NO: 178575 - DNA, 23 bp, Mus musculus
tgattgtatgtgtgtatgtgtgt

SEQ ID NO: 178576 - DNA, 23 bp, Mus musculus
atctgtctgtctgtctgtctgtg

SEQ ID NO: 178577 - DNA, 23 bp, Mus musculus
tatgtgcatgtgcatgtgcatgt

SEQ ID NO: 178578 - DNA, 23 bp, Mus musculus
gtgtcactgtgtgttttaaggga

SEQ ID NO: 178579 - DNA, 20 bp, Mus musculus
cttgagaaaatcattcccta

SEQ ID NO: 178580 - DNA, 22 bp, Mus musculus
gagtgcagagaacccagagaga

SEQ ID NO: 178581 - DNA, 23 bp, Mus musculus
actatctctctgacacttttccc

SEQ ID NO: 178582 - DNA, 23 bp, Mus musculus
tgacaggaaatgaagtgtcaatg

SEQ ID NO: 178583 - DNA, 23 bp, Mus musculus
ttctgagatgatggagaatgcaa

SEQ ID NO: 178584 - DNA, 23 bp, Mus musculus
acctcaaaagtttagatcaatga

SEQ ID NO: 178585 - DNA, 20 bp, Mus musculus
ttttctttgactaaaagttt

SEQ ID NO: 178586 - DNA, 21 bp, Mus musculus
tctcagggggagcagagttgg

SEQ ID NO: 178587 - DNA, 22 bp, Mus musculus
tgtcattccaaaggaaatgtct

SEQ ID NO: 178588 - DNA, 22 bp, Mus musculus
agatgctcttctctctctctca

SEQ ID NO: 178589 - DNA, 23 bp, Mus musculus
agctcaggatttctttgcaagcg

SEQ ID NO: 178590 - DNA, 23 bp, Mus musculus
gtcctgtgagagcagccagtgct

SEQ ID NO: 178591 - DNA, 23 bp, Mus musculus
gaactcccagtctttctgtctct

SEQ ID NO: 178592 - DNA, 23 bp, Mus musculus
tgtctccctgcctgcctcccagt

SEQ ID NO: 178593 - DNA, 23 bp, Mus musculus
attgttctcagagagcacagaag

SEQ ID NO: 178594 - DNA, 23 bp, Mus musculus
acaactttccagaagagtgtgag

SEQ ID NO: 178595 - DNA, 23 bp, Mus musculus
ctgtcacagaacatagagggcag

SEQ ID NO: 178596 - DNA, 22 bp, Mus musculus
gcactgactgctcttccagagg

SEQ ID NO: 178597 - DNA, 21 bp, Mus musculus
gcactgactgctcttccagag

SEQ ID NO: 178598 - DNA, 22 bp, Mus musculus
tagacaagtctccactatggaa

SEQ ID NO: 178599 - DNA, 22 bp, Mus musculus
agagttcattagttcaaatccc

SEQ ID NO: 178600 - DNA, 23 bp, Mus musculus
actgatgtgtgtgtgctcagaag

SEQ ID NO: 178601 - DNA, 20 bp, Mus musculus
gtgtgtgtgtgtgtgtgtgt

SEQ ID NO: 178602 - DNA, 19 bp, Mus musculus
atatgaacttatgggatgg

SEQ ID NO: 178603 - DNA, 23 bp, Mus musculus
actgcagtactttagtttttact

SEQ ID NO: 178604 - DNA, 22 bp, Mus musculus
tgtcactttgggtggactttga

SEQ ID NO: 178605 - DNA, 23 bp, Mus musculus
gtctctctctgcctgtgggtcag

SEQ ID NO: 178606 - DNA, 19 bp, Mus musculus
tatctgcctcaatattttc

SEQ ID NO: 178607 - DNA, 18 bp, Mus musculus
ttctccccatttgagagc

SEQ ID NO: 178608 - DNA, 23 bp, Mus musculus
gaatgagtgtgtatgatgtatgt

SEQ ID NO: 178609 - DNA, 19 bp, Mus musculus
tcatatgaactgagacagg

SEQ ID NO: 178610 - DNA, 19 bp, Mus musculus
tatggatagttgggagctg

SEQ ID NO: 178611 - DNA, 18 bp, Mus musculus
tcagcctcctagcatcag

SEQ ID NO: 178612 - DNA, 22 bp, Mus musculus
acacatgtgttttacatgtaca

SEQ ID NO: 178613 - DNA, 19 bp, Mus musculus
tcagcttacaaatgtctgt

SEQ ID NO: 178614 - DNA, 21 bp, Mus musculus
accctcacacagacatatatg

SEQ ID NO: 178615 - DNA, 20 bp, Mus musculus
tggctcagtggttaggagca

SEQ ID NO: 178616 - DNA, 23 bp, Mus musculus
gatgactgactgactgactgact

SEQ ID NO: 178617 - DNA, 20 bp, Mus musculus
agagatggttcagaagagca

SEQ ID NO: 178618 - DNA, 23 bp, Mus musculus
ccctcacacagacatacatgcag

SEQ ID NO: 178619 - DNA, 23 bp, Mus musculus
tgtatgtgtgtatatatatatga

SEQ ID NO: 178620 - DNA, 23 bp, Mus musculus
atgcatgtgttcttgtggaggcc

SEQ ID NO: 178621 - DNA, 21 bp, Mus musculus
tccatggtggtctgataggat

SEQ ID NO: 178622 - DNA, 22 bp, Mus musculus
tgttttgtgaccaattatatgg

SEQ ID NO: 178623 - DNA, 18 bp, Mus musculus
atggtgatctgataggat

SEQ ID NO: 178624 - DNA, 23 bp, Mus musculus
aacattgctctctctgtctttgt

SEQ ID NO: 178625 - DNA, 23 bp, Mus musculus
tctgtagagacagtggaaacagt

SEQ ID NO: 178626 - DNA, 23 bp, Mus musculus
cagagagtttactgtgtgagcct

SEQ ID NO: 178627 - DNA, 23 bp, Mus musculus
tgtgtgtctgtgtgagagtatgt

SEQ ID NO: 178628 - DNA, 22 bp, Mus musculus
tacatgtgtgtgtgtatacaca

SEQ ID NO: 178629 - DNA, 22 bp, Mus musculus
tgtagaacaatttgcaatctag

SEQ ID NO: 178630 - DNA, 23 bp, Mus musculus
tcagtctatttctgtctcatatt

SEQ ID NO: 178631 - DNA, 22 bp, Mus musculus
tcccatgcagaaaatctggaca

SEQ ID NO: 178632 - DNA, 22 bp, Mus musculus
tgttttgtgaccaattatatgg

SEQ ID NO: 178633 - DNA, 23 bp, Mus musculus
caattacaaatctcatattcttc

SEQ ID NO: 178634 - DNA, 23 bp, Mus musculus
tagtagacttgtgagtttgtact

SEQ ID NO: 178635 - DNA, 23 bp, Mus musculus
tcacttcaggaaactgtgtcagt

SEQ ID NO: 178636 - DNA, 22 bp, Mus musculus
tgttttgtgaccaattatatgg

SEQ ID NO: 178637 - DNA, 23 bp, Mus musculus
atgtctcagaaaacactgagtcc

SEQ ID NO: 178638 - DNA, 23 bp, Mus musculus
acttcttggtactgtgtgtctct

SEQ ID NO: 178639 - DNA, 23 bp, Mus musculus
gctgcctccctgtctgcaactgt

SEQ ID NO: 178640 - DNA, 22 bp, Mus musculus
tataatagagaaacatatgtag

SEQ ID NO: 178641 - DNA, 23 bp, Mus musculus
tatgtatgtgtatttcatgtcat

SEQ ID NO: 178642 - DNA, 22 bp, Mus musculus
atgcactcatgtatacatatgc

SEQ ID NO: 178643 - DNA, 23 bp, Mus musculus
tagtccatggtgatctgatagga

SEQ ID NO: 178644 - DNA, 22 bp, Mus musculus
tgttttgtgaccaattatatgg

SEQ ID NO: 178645 - DNA, 23 bp, Mus musculus
aaacaagacagtgtgcttagttg

SEQ ID NO: 178646 - DNA, 23 bp, Mus musculus
aaggttagtgatattgttgttct

SEQ ID NO: 178647 - DNA, 20 bp, Mus musculus
tcagtccttcccctaactct

SEQ ID NO: 178648 - DNA, 21 bp, Mus musculus
gacagacagatatatgtatct

SEQ ID NO: 178649 - DNA, 23 bp, Mus musculus
aagtggaactgatttcttgaagt

SEQ ID NO: 178650 - DNA, 23 bp, Mus musculus
ttctcacccctaattcagagttt

SEQ ID NO: 178651 - DNA, 20 bp, Mus musculus
tatgtgtgtgtatgtattca

SEQ ID NO: 178652 - DNA, 19 bp, Mus musculus
atgcagcagctgggatcct

SEQ ID NO: 178653 - DNA, 23 bp, Mus musculus
tcagaagatgcacagatgctcaa

SEQ ID NO: 178654 - DNA, 23 bp, Mus musculus
tgtgagtgtgtgtatgtatacat

SEQ ID NO: 178655 - DNA, 21 bp, Mus musculus
tatgtatgtttgtatatatgt

SEQ ID NO: 178656 - DNA, 21 bp, Mus musculus
atcccatatgtaagcactcag

SEQ ID NO: 178657 - DNA, 20 bp, Mus musculus
ggctcagtgactccctctct

SEQ ID NO: 178658 - DNA, 23 bp, Mus musculus
gccagactctctggctcagatac

SEQ ID NO: 178659 - DNA, 23 bp, Mus musculus
ttgacagttgtgactcacctcag

SEQ ID NO: 178660 - DNA, 21 bp, Mus musculus
ttacagagatgagccatggag

SEQ ID NO: 178661 - DNA, 22 bp, Mus musculus
tggtacagtcttgaggaaagca

SEQ ID NO: 178662 - DNA, 22 bp, Mus musculus
tgttttgtgaccaattatatgg

SEQ ID NO: 178663 - DNA, 23 bp, Mus musculus
tcacagaagtgagtcttcagaag

SEQ ID NO: 178664 - DNA, 23 bp, Mus musculus
gtctgtgactgcctgaatactgt

SEQ ID NO: 178665 - DNA, 23 bp, Mus musculus
gtctgtgtgtgcatgtgcatgtg

SEQ ID NO: 178666 - DNA, 20 bp, Mus musculus
acagactgcttttccagacg

SEQ ID NO: 178667 - DNA, 22 bp, Mus musculus
tatgtgcttatatgttcatatt

SEQ ID NO: 178668 - DNA, 21 bp, Mus musculus
tatgcatatatattgcttaaa

SEQ ID NO: 178669 - DNA, 23 bp, Mus musculus
atatgtctatatgtatatgtgtg

SEQ ID NO: 178670 - DNA, 23 bp, Mus musculus
ctgtcagcctgtgtcagtctgtc

SEQ ID NO: 178671 - DNA, 23 bp, Mus musculus
aagtgtatttcttaatctgaaca

SEQ ID NO: 178672 - DNA, 22 bp, Mus musculus
ttagagaaactgggaaagttca

SEQ ID NO: 178673 - DNA, 23 bp, Mus musculus
catggatgtgtgcatgtgtgtag

SEQ ID NO: 178674 - DNA, 22 bp, Mus musculus
tgttttgtgaccaattatatgg

SEQ ID NO: 178675 - DNA, 23 bp, Mus musculus
gtgtgtgcaagaggatctgaatc

SEQ ID NO: 178676 - DNA, 23 bp, Mus musculus
ctgtgcctatacagtgtgagctg

SEQ ID NO: 178677 - DNA, 23 bp, Mus musculus
ggtagatggtgcctatacagtgt

SEQ ID NO: 178678 - DNA, 19 bp, Mus musculus
aagctgatactcaaagtca

SEQ ID NO: 178679 - DNA, 22 bp, Mus musculus
ttcagacatgagagtgagttca

SEQ ID NO: 178680 - DNA, 19 bp, Mus musculus
gatttatttaatgtatgtg

SEQ ID NO: 178681 - DNA, 23 bp, Mus musculus
gtatatatgtctatgtgtgtatg

SEQ ID NO: 178682 - DNA, 23 bp, Mus musculus
gattatgtaaatgtaagctgagt

SEQ ID NO: 178683 - DNA, 18 bp, Mus musculus
cctctgaatgcaccatga

SEQ ID NO: 178684 - DNA, 23 bp, Mus musculus
ttctcactggctgagtagtccct

SEQ ID NO: 178685 - DNA, 19 bp, Mus musculus
atggtcagggtctggagag

SEQ ID NO: 178686 - DNA, 18 bp, Mus musculus
tcactcaacagtgtgacg

SEQ ID NO: 178687 - DNA, 23 bp, Mus musculus
actgtctgtgactccagatccat

SEQ ID NO: 178688 - DNA, 21 bp, Mus musculus
ctctgagatgagagtccgtac

SEQ ID NO: 178689 - DNA, 23 bp, Mus musculus
ctctcactctctgggctctttgt

SEQ ID NO: 178690 - DNA, 23 bp, Mus musculus
ctactcagtgcttttcttgtctc

SEQ ID NO: 178691 - DNA, 22 bp, Mus musculus
ctgcctctctctcccaggctct

SEQ ID NO: 178692 - DNA, 21 bp, Mus musculus
tcagaactcacagagcacagc

SEQ ID NO: 178693 - DNA, 22 bp, Mus musculus
ggtgatgactgtgttttctgtt

SEQ ID NO: 178694 - DNA, 22 bp, Mus musculus
ctctgtctgcctctctgtaccc

SEQ ID NO: 178695 - DNA, 23 bp, Mus musculus
gagagagtgtgtgtgtgtatctg

SEQ ID NO: 178696 - DNA, 23 bp, Mus musculus
tactgtgaggatatgtttgtaag

SEQ ID NO: 178697 - DNA, 22 bp, Mus musculus
taaatgtgtgttcatgtatatg

SEQ ID NO: 178698 - DNA, 19 bp, Mus musculus
tctagttgcccttgtggtc

SEQ ID NO: 178699 - DNA, 23 bp, Mus musculus
aagctgcctgttcatggtgtgtg

SEQ ID NO: 178700 - DNA, 23 bp, Mus musculus
tgtgtctatatctatatatgtgt

SEQ ID NO: 178701 - DNA, 19 bp, Mus musculus
tgggtgagtgtgagcctca

SEQ ID NO: 178702 - DNA, 20 bp, Mus musculus
tctgtgtctgtcttacacga

SEQ ID NO: 178703 - DNA, 18 bp, Mus musculus
aactcactgtggtaaaga

SEQ ID NO: 178704 - DNA, 23 bp, Mus musculus
atctgtttctgtctctgggtccc

SEQ ID NO: 178705 - DNA, 22 bp, Mus musculus
agttcctacttgtttacagtca

SEQ ID NO: 178706 - DNA, 23 bp, Mus musculus
tggtgagaaaacagagagaattg

SEQ ID NO: 178707 - DNA, 20 bp, Mus musculus
gtgtgtgtgtgtgtgtgtat

SEQ ID NO: 178708 - DNA, 19 bp, Mus musculus
atgtgtgtgtatatgtata

SEQ ID NO: 178709 - DNA, 23 bp, Mus musculus
atatgtgtgtgtatgtatacaca

SEQ ID NO: 178710 - DNA, 20 bp, Mus musculus
atatgtgtgtatatatatgt

SEQ ID NO: 178711 - DNA, 23 bp, Mus musculus
tgtgtatatatgtatagatatgt

SEQ ID NO: 178712 - DNA, 20 bp, Mus musculus
agtgtatatgtatatatgta

SEQ ID NO: 178713 - DNA, 22 bp, Mus musculus
tgacagtagactgtgtggctct

SEQ ID NO: 178714 - DNA, 18 bp, Mus musculus
taagcactagtggcatcc

SEQ ID NO: 178715 - DNA, 23 bp, Mus musculus
tgagtggtgagtgtgtgcagagc

SEQ ID NO: 178716 - DNA, 23 bp, Mus musculus
tgcagtgagtttcatgatgaagg

SEQ ID NO: 178717 - DNA, 21 bp, Mus musculus
gggaagagtgtgtgcagagag

SEQ ID NO: 178718 - DNA, 23 bp, Mus musculus
tgtccctgtctctcactgacttc

SEQ ID NO: 178719 - DNA, 22 bp, Mus musculus
tggctcagtggttaagagcact

SEQ ID NO: 178720 - DNA, 23 bp, Mus musculus
ctggctggctggctggctggttg

SEQ ID NO: 178721 - DNA, 20 bp, Mus musculus
gtttctgactgactctgtcc

SEQ ID NO: 178722 - DNA, 23 bp, Mus musculus
agactatctctctctctgccata

SEQ ID NO: 178723 - DNA, 23 bp, Mus musculus
tgaccacagccaagacactgagc

SEQ ID NO: 178724 - DNA, 23 bp, Mus musculus
cagacgtgacagaggagagacag

SEQ ID NO: 178725 - DNA, 23 bp, Mus musculus
cagagattgtttttgttttgcct

SEQ ID NO: 178726 - DNA, 22 bp, Mus musculus
ggcttgatttgtctgtcttcct

SEQ ID NO: 178727 - DNA, 23 bp, Mus musculus
ataagtgcctgagtaccagggag

SEQ ID NO: 178728 - DNA, 18 bp, Mus musculus
agagctacgtgtgggtct

SEQ ID NO: 178729 - DNA, 22 bp, Mus musculus
acactgcctctgagcctctgtc

SEQ ID NO: 178730 - DNA, 18 bp, Mus musculus
tgtatgtatgtatatatg

SEQ ID NO: 178731 - DNA, 22 bp, Mus musculus
caagcacagtgagtctctctct

SEQ ID NO: 178732 - DNA, 23 bp, Mus musculus
tgacagttgtgtgagaagagatt

SEQ ID NO: 178733 - DNA, 20 bp, Mus musculus
acacagatgactgggaggag

SEQ ID NO: 178734 - DNA, 22 bp, Mus musculus
tgtccatatttatttatgtttc

SEQ ID NO: 178735 - DNA, 20 bp, Mus musculus
tatacatagatatacacaca

SEQ ID NO: 178736 - DNA, 23 bp, Mus musculus
ctttcagcttctttacagtgctg

SEQ ID NO: 178737 - DNA, 23 bp, Mus musculus
agcagcattgtacagggctatga

SEQ ID NO: 178738 - DNA, 20 bp, Mus musculus
tgcctgtgtgctgacaagga

SEQ ID NO: 178739 - DNA, 23 bp, Mus musculus
gtatgcatgtatgtatgtatgta

SEQ ID NO: 178740 - DNA, 23 bp, Mus musculus
agctgacagcatcttgagagcag

SEQ ID NO: 178741 - DNA, 20 bp, Mus musculus
tgtatgtgtgcatgtgcttg

SEQ ID NO: 178742 - DNA, 23 bp, Mus musculus
tagtgcatggtgatctgatagga

SEQ ID NO: 178743 - DNA, 18 bp, Mus musculus
ttcagagactgtagtagt

SEQ ID NO: 178744 - DNA, 23 bp, Mus musculus
tcggtactctgaagtctgtgtgc

SEQ ID NO: 178745 - DNA, 22 bp, Mus musculus
ttttgtactgaatgtatgcaga

SEQ ID NO: 178746 - DNA, 21 bp, Mus musculus
tcacagatcacacagagcagc

SEQ ID NO: 178747 - DNA, 23 bp, Mus musculus
gacatctcactgtcactgtctct

SEQ ID NO: 178748 - DNA, 20 bp, Mus musculus
aagagcactgactgctcttc

SEQ ID NO: 178749 - DNA, 22 bp, Mus musculus
tatcgtcatcatcatcttcatc

SEQ ID NO: 178750 - DNA, 22 bp, Mus musculus
tgcctggtgttctgaggcaagt

SEQ ID NO: 178751 - DNA, 21 bp, Mus musculus
tctgtgtatatatgtgtgtgt

SEQ ID NO: 178752 - DNA, 23 bp, Mus musculus
ctctggctgttgagtctgagctg

SEQ ID NO: 178753 - DNA, 23 bp, Mus musculus
tctgtctctgtctctgcttgcct

SEQ ID NO: 178754 - DNA, 23 bp, Mus musculus
acttgagatattcttgttgagtg

SEQ ID NO: 178755 - DNA, 21 bp, Mus musculus
tgtacatatgtatccatatat

SEQ ID NO: 178756 - DNA, 22 bp, Mus musculus
tatatgtatgtatatatgtatg

SEQ ID NO: 178757 - DNA, 23 bp, Mus musculus
aagtgactgaagactaattcttc

SEQ ID NO: 178758 - DNA, 23 bp, Mus musculus
tgtgaatttcttcattacctgct

SEQ ID NO: 178759 - DNA, 23 bp, Mus musculus
acacacacacacatatatgtgtc

SEQ ID NO: 178760 - DNA, 23 bp, Mus musculus
tgaatgtatgtgtgtgcttatgt

SEQ ID NO: 178761 - DNA, 23 bp, Mus musculus
gtgtgtatatgtgtatgcatatg

SEQ ID NO: 178762 - DNA, 20 bp, Mus musculus
tgacaccctgactcactgtg

SEQ ID NO: 178763 - DNA, 22 bp, Mus musculus
tgagcatgtatgtatatatgta

SEQ ID NO: 178764 - DNA, 23 bp, Mus musculus
tgtatgcatgtatgtatgtatgt

SEQ ID NO: 178765 - DNA, 23 bp, Mus musculus
ttgtgaatctccatgtggttgtt

SEQ ID NO: 178766 - DNA, 20 bp, Mus musculus
agaatgaagtcagtgagcag

SEQ ID NO: 178767 - DNA, 23 bp, Mus musculus
atggtctctgcttcagttcttgc

SEQ ID NO: 178768 - DNA, 22 bp, Mus musculus
tgttttgtgaccaattatatgg

SEQ ID NO: 178769 - DNA, 23 bp, Mus musculus
ttaagtctttgcttttatttgcc

SEQ ID NO: 178770 - DNA, 23 bp, Mus musculus
gggactgtctctgactctgttgc

SEQ ID NO: 178771 - DNA, 18 bp, Mus musculus
aaggtgttttcaatcccc

SEQ ID NO: 178772 - DNA, 23 bp, Mus musculus
tctgacagtagagagagggaact

SEQ ID NO: 178773 - DNA, 22 bp, Mus musculus
ttgccagatgacagagtgcaca

SEQ ID NO: 178774 - DNA, 19 bp, Mus musculus
gtttctatgtaatacaaaa

SEQ ID NO: 178775 - DNA, 23 bp, Mus musculus
acagttctgtttatgtaatactg

SEQ ID NO: 178776 - DNA, 21 bp, Mus musculus
agagtgtggttttgctgatgg

SEQ ID NO: 178777 - DNA, 18 bp, Mus musculus
attatgcaagatatacaa

SEQ ID NO: 178778 - DNA, 21 bp, Mus musculus
cagttgtgtgtttgttcatgt

SEQ ID NO: 178779 - DNA, 23 bp, Mus musculus
acactgtggaattgatctagtag

SEQ ID NO: 178780 - DNA, 22 bp, Mus musculus
aattttgtggcttgtgtccagc

SEQ ID NO: 178781 - DNA, 23 bp, Mus musculus
acactagagaattatatgtatgc

SEQ ID NO: 178782 - DNA, 23 bp, Mus musculus
tgtggtgttgaaggaacttgaga

SEQ ID NO: 178783 - DNA, 23 bp, Mus musculus
catgtgtagagactcctgtgtgt

SEQ ID NO: 178784 - DNA, 22 bp, Mus musculus
aggtttgtatgtatgtgtgtgc

SEQ ID NO: 178785 - DNA, 19 bp, Mus musculus
ggtccgtctgtcccaggca

SEQ ID NO: 178786 - DNA, 21 bp, Mus musculus
tgtgtgtgtgtctgcctctgt

SEQ ID NO: 178787 - DNA, 20 bp, Mus musculus
aaaatgtaattgaggaaggt

SEQ ID NO: 178788 - DNA, 23 bp, Mus musculus
tctgtgacacaggaaaatttgag

SEQ ID NO: 178789 - DNA, 22 bp, Mus musculus
tgtgcatgtatgtatatatgta

SEQ ID NO: 178790 - DNA, 23 bp, Mus musculus
tgtgtgtgtgtgttatatgtatg

SEQ ID NO: 178791 - DNA, 23 bp, Mus musculus
gtgtgtgtgtgttatatgtatgt

SEQ ID NO: 178792 - DNA, 19 bp, Mus musculus
tgtgtatgtgtatatatgt

SEQ ID NO: 178793 - DNA, 23 bp, Mus musculus
aacaaatgtgattttgtagttgt

SEQ ID NO: 178794 - DNA, 23 bp, Mus musculus
attaggcagcaaatgaaatgcat

SEQ ID NO: 178795 - DNA, 19 bp, Mus musculus
aaatgtctgataatgttca

SEQ ID NO: 178796 - DNA, 22 bp, Mus musculus
aaaggtgtgtgctagggttgag

SEQ ID NO: 178797 - DNA, 23 bp, Mus musculus
gcctctgcatcagctcctgcctc

SEQ ID NO: 178798 - DNA, 23 bp, Mus musculus
tagaacggtctctccctctctct

SEQ ID NO: 178799 - DNA, 23 bp, Mus musculus
taaatgagctttattgttggtgt

SEQ ID NO: 178800 - DNA, 23 bp, Mus musculus
atgtatatgtgtatgtgtgtgtg

SEQ ID NO: 178801 - DNA, 23 bp, Mus musculus
caatatttttgtatctgttgagg

SEQ ID NO: 178802 - DNA, 21 bp, Mus musculus
atacacacacacatatataac

SEQ ID NO: 178803 - DNA, 19 bp, Mus musculus
tcagggactcagattctgc

SEQ ID NO: 178804 - DNA, 23 bp, Mus musculus
tgtcctagctgttgtagctgggg

SEQ ID NO: 178805 - DNA, 22 bp, Mus musculus
caagtatgtatgtatgtatgta

SEQ ID NO: 178806 - DNA, 22 bp, Mus musculus
atgtatggacataatacacttc

SEQ ID NO: 178807 - DNA, 22 bp, Mus musculus
tgttttgtgaccaattatatgg

SEQ ID NO: 178808 - DNA, 22 bp, Mus musculus
tgttttgtgaccaattatatgg

SEQ ID NO: 178809 - DNA, 22 bp, Mus musculus
tgttttgtgaccaattatatgg

SEQ ID NO: 178810 - DNA, 22 bp, Mus musculus
acagaccgtgcaagttgtgttt

SEQ ID NO: 178811 - DNA, 22 bp, Mus musculus
agagacgcgctgaaggagatgt

SEQ ID NO: 178812 - DNA, 23 bp, Mus musculus
aggcagctttctagaactcaatg

SEQ ID NO: 178813 - DNA, 23 bp, Mus musculus
agtcacagagtcatctcaggcat

SEQ ID NO: 178814 - DNA, 23 bp, Mus musculus
tgcttctgagtgtgcagactccc

SEQ ID NO: 178815 - DNA, 22 bp, Mus musculus
tgttttgtgaccaattatatgg

SEQ ID NO: 178816 - DNA, 21 bp, Mus musculus
tgactctctttgtctcactgc

SEQ ID NO: 178817 - DNA, 21 bp, Mus musculus
tccatggtggtctgataggat

SEQ ID NO: 178818 - DNA, 22 bp, Mus musculus
tgttttgtgaccaattatatgg

SEQ ID NO: 178819 - DNA, 23 bp, Mus musculus
ctgtctgtctgtctgtctgattt

SEQ ID NO: 178820 - DNA, 23 bp, Mus musculus
agagttcagtgttaatcttcctt

SEQ ID NO: 178821 - DNA, 21 bp, Mus musculus
tgtatgtatgcatgtatgtac

SEQ ID NO: 178822 - DNA, 23 bp, Mus musculus
tgagtgtgtatatatgtatatat

SEQ ID NO: 178823 - DNA, 23 bp, Mus musculus
tatgtgtgtgtacatatatgtgt

SEQ ID NO: 178824 - DNA, 21 bp, Mus musculus
tatgtgtatatatagatatgt

SEQ ID NO: 178825 - DNA, 23 bp, Mus musculus
tgtatgtatgtatgtatgtatgt

SEQ ID NO: 178826 - DNA, 21 bp, Mus musculus
tcactcttttactctctacta

SEQ ID NO: 178827 - DNA, 23 bp, Mus musculus
aataactcacatcaaagaagcac

SEQ ID NO: 178828 - DNA, 23 bp, Mus musculus
cattggtctacttgtctgtcact

SEQ ID NO: 178829 - DNA, 21 bp, Mus musculus
ttatctcttgtttgtgaacac

SEQ ID NO: 178830 - DNA, 22 bp, Mus musculus
catatgaatacacaatgagtac

SEQ ID NO: 178831 - DNA, 19 bp, Mus musculus
atggtaggacattatctct

SEQ ID NO: 178832 - DNA, 21 bp, Mus musculus
ttatctatttaaaaatgagtt

SEQ ID NO: 178833 - DNA, 21 bp, Mus musculus
ttatttttgcatcgatattca

SEQ ID NO: 178834 - DNA, 22 bp, Mus musculus
tgttttgtgaccaattatatgg

SEQ ID NO: 178835 - DNA, 23 bp, Mus musculus
atatgtcacttggctttgaggtt

SEQ ID NO: 178836 - DNA, 21 bp, Mus musculus
gcccagtgtctctctctgcct

SEQ ID NO: 178837 - DNA, 23 bp, Mus musculus
tttcctggatgtgagttgctatg

SEQ ID NO: 178838 - DNA, 23 bp, Mus musculus
tggctatctcacagtactggaag

SEQ ID NO: 178839 - DNA, 21 bp, Mus musculus
tatacaagcaacactgtgtcc

SEQ ID NO: 178840 - DNA, 22 bp, Mus musculus
ttctctgagtataagatagctg

SEQ ID NO: 178841 - DNA, 23 bp, Mus musculus
tgtctctctcgagaagcagctct

SEQ ID NO: 178842 - DNA, 22 bp, Mus musculus
acacacctttagttcctgaact

SEQ ID NO: 178843 - DNA, 23 bp, Mus musculus
agaggtagatggatctctgtgag

SEQ ID NO: 178844 - DNA, 23 bp, Mus musculus
agcatgttgattaacactcagga

SEQ ID NO: 178845 - DNA, 22 bp, Mus musculus
agttgtttgtctgtgtatgtat

SEQ ID NO: 178846 - DNA, 21 bp, Mus musculus
atggcagtgtggtaatgaact

SEQ ID NO: 178847 - DNA, 23 bp, Mus musculus
acacatacacactgacttcttgg

SEQ ID NO: 178848 - DNA, 22 bp, Mus musculus
tgttttgtgaccaattatatgg

SEQ ID NO: 178849 - DNA, 23 bp, Mus musculus
gtaggatgtgctgtgtgtccagt

SEQ ID NO: 178850 - DNA, 20 bp, Mus musculus
gtgtttcagtggcttcttta

SEQ ID NO: 178851 - DNA, 23 bp, Mus musculus
tcactgtggttggactttgaggt

SEQ ID NO: 178852 - DNA, 18 bp, Mus musculus
taccacttagtgtctctg

SEQ ID NO: 178853 - DNA, 22 bp, Mus musculus
tatcagactgttctcaccctgt

SEQ ID NO: 178854 - DNA, 19 bp, Mus musculus
aacacactaatgggttgtt

SEQ ID NO: 178855 - DNA, 23 bp, Mus musculus
tttatatgttatgttgcatattt

SEQ ID NO: 178856 - DNA, 18 bp, Mus musculus
tccatttccatccctgta

SEQ ID NO: 178857 - DNA, 21 bp, Mus musculus
ttgacacaagttagagtcctc

SEQ ID NO: 178858 - DNA, 22 bp, Mus musculus
ttcagtcaagaaatgcctccct

SEQ ID NO: 178859 - DNA, 23 bp, Mus musculus
tctctctttctatatatatgtac

SEQ ID NO: 178860 - DNA, 23 bp, Mus musculus
agcctctgacagtctctgttcat

SEQ ID NO: 178861 - DNA, 23 bp, Mus musculus
ttacagtgcaatgttatatggcc

SEQ ID NO: 178862 - DNA, 23 bp, Mus musculus
aaatgtagtgaatttgttgtatt

SEQ ID NO: 178863 - DNA, 22 bp, Mus musculus
accaacctgttctaccctttaa

SEQ ID NO: 178864 - DNA, 23 bp, Mus musculus
tctgaggtagttagtgtctgtct

SEQ ID NO: 178865 - DNA, 18 bp, Mus musculus
gaacaggggcaggagaga

SEQ ID NO: 178866 - DNA, 23 bp, Mus musculus
tgtctgtctgtctatctccatgc

SEQ ID NO: 178867 - DNA, 22 bp, Mus musculus
gttatgattttgaaggagagta

SEQ ID NO: 178868 - DNA, 19 bp, Mus musculus
catgttgatctggctagac

SEQ ID NO: 178869 - DNA, 23 bp, Mus musculus
tgtgtatatgtatatgtatatgt

SEQ ID NO: 178870 - DNA, 23 bp, Mus musculus
gctgtgcctgacttctcatcctg

SEQ ID NO: 178871 - DNA, 22 bp, Mus musculus
tgttttgtgaccaattatatgg

SEQ ID NO: 178872 - DNA, 23 bp, Mus musculus
catatgtatatattcttatgtat

SEQ ID NO: 178873 - DNA, 22 bp, Mus musculus
atatatatgatgtatatgctta

SEQ ID NO: 178874 - DNA, 22 bp, Mus musculus
atcagaactcactttccagttg

SEQ ID NO: 178875 - DNA, 22 bp, Mus musculus
tgttttgtgaccaattatatgg

SEQ ID NO: 178876 - DNA, 23 bp, Mus musculus
tttcaatgtttcttaaggcaagg

SEQ ID NO: 178877 - DNA, 23 bp, Mus musculus
tcctgaaagcttttgcataggag

SEQ ID NO: 178878 - DNA, 23 bp, Mus musculus
tgcagaaagcataagaaatgtgc

SEQ ID NO: 178879 - DNA, 22 bp, Mus musculus
tgtatgtatgtatgtgtatatg

SEQ ID NO: 178880 - DNA, 20 bp, Mus musculus
tgcctgggaaatcaactgct

SEQ ID NO: 178881 - DNA, 19 bp, Mus musculus
ttcctgtctaaccagtttg

SEQ ID NO: 178882 - DNA, 20 bp, Mus musculus
tcaggttcccatagtgacac

SEQ ID NO: 178883 - DNA, 19 bp, Mus musculus
tgacacacacacttccttg

SEQ ID NO: 178884 - DNA, 20 bp, Mus musculus
tctatacatatatgtgtgtg

SEQ ID NO: 178885 - DNA, 23 bp, Mus musculus
tatgtgtgtgtttgtcactgtat

SEQ ID NO: 178886 - DNA, 23 bp, Mus musculus
tgtatgtgtatatgtatgtgtgt

SEQ ID NO: 178887 - DNA, 23 bp, Mus musculus
cacactcagacactgctggttgt

SEQ ID NO: 178888 - DNA, 23 bp, Mus musculus
ctgtctgtgtgtctgtctgcctt

SEQ ID NO: 178889 - DNA, 22 bp, Mus musculus
gtctgtgtgtctgtctgtgtag

SEQ ID NO: 178890 - DNA, 22 bp, Mus musculus
aaactgcttgggattagttgct

SEQ ID NO: 178891 - DNA, 23 bp, Mus musculus
gtctgtctgtctgtctgcctgcc

SEQ ID NO: 178892 - DNA, 23 bp, Mus musculus
tttctgtgactctgactgactct

SEQ ID NO: 178893 - DNA, 19 bp, Mus musculus
gctgccccaccagctgctc

SEQ ID NO: 178894 - DNA, 19 bp, Mus musculus
ccagagatgagcagctggt

SEQ ID NO: 178895 - DNA, 22 bp, Mus musculus
ttaaaggttgtaaagttaaaag

SEQ ID NO: 178896 - DNA, 19 bp, Mus musculus
actgaagagatggctcagc

SEQ ID NO: 178897 - DNA, 21 bp, Mus musculus
tgaggttgtaggttgaaggtc

SEQ ID NO: 178898 - DNA, 23 bp, Mus musculus
atgctgtctggtagtgttgtgaa

SEQ ID NO: 178899 - DNA, 22 bp, Mus musculus
tgttttgtgaccaattatatgg

SEQ ID NO: 178900 - DNA, 18 bp, Mus musculus
catctgatgtaggtgctg

SEQ ID NO: 178901 - DNA, 23 bp, Mus musculus
tgcctgcctgcctgtctgcctgc

SEQ ID NO: 178902 - DNA, 19 bp, Mus musculus
agtggtgtttgggtatgaa

SEQ ID NO: 178903 - DNA, 20 bp, Mus musculus
tcagagaactaagtgtgcag

SEQ ID NO: 178904 - DNA, 21 bp, Mus musculus
actgagtctctgtgttttgag

SEQ ID NO: 178905 - DNA, 23 bp, Mus musculus
aatgttgtttgagtgtaccagca

SEQ ID NO: 178906 - DNA, 23 bp, Mus musculus
gtttttgctgcctcaggaccctg

SEQ ID NO: 178907 - DNA, 21 bp, Mus musculus
atgtgtgtagtatatatgaat

SEQ ID NO: 178908 - DNA, 18 bp, Mus musculus
tctgacatagtataaggg

SEQ ID NO: 178909 - DNA, 23 bp, Mus musculus
aaatgatagtgctaacttagcat

SEQ ID NO: 178910 - DNA, 23 bp, Mus musculus
tttctctcaatctggatgcagtg

SEQ ID NO: 178911 - DNA, 23 bp, Mus musculus
tcactagcttatagactgagtag

SEQ ID NO: 178912 - DNA, 23 bp, Mus musculus
gtgtggatatttaaatgagcttt

SEQ ID NO: 178913 - DNA, 21 bp, Mus musculus
tcgtgtgttgtgtaccttcgg

SEQ ID NO: 178914 - DNA, 21 bp, Mus musculus
cttctgagcagagagcagagt

SEQ ID NO: 178915 - DNA, 23 bp, Mus musculus
gtgtgggtcagtctctgtcagtg

SEQ ID NO: 178916 - DNA, 23 bp, Mus musculus
agaggatcaagtctgacacagtc

SEQ ID NO: 178917 - DNA, 23 bp, Mus musculus
cagtctctcactttttctctgtg

SEQ ID NO: 178918 - DNA, 23 bp, Mus musculus
tgcacactgaagtctgagtgcac

SEQ ID NO: 178919 - DNA, 22 bp, Mus musculus
tcacacagaggtatatacatca

SEQ ID NO: 178920 - DNA, 21 bp, Mus musculus
actggctttctttgcctctgt

SEQ ID NO: 178921 - DNA, 22 bp, Mus musculus
tgtgaggaaaagcatctcttca

SEQ ID NO: 178922 - DNA, 23 bp, Mus musculus
gcccacagagaagacagagctca

SEQ ID NO: 178923 - DNA, 21 bp, Mus musculus
tctgaaagaagtcagagctgg

SEQ ID NO: 178924 - DNA, 23 bp, Mus musculus
tattggatgataatgtatgattt

SEQ ID NO: 178925 - DNA, 23 bp, Mus musculus
aggaactagaacaggactgggta

SEQ ID NO: 178926 - DNA, 23 bp, Mus musculus
ttaccttgtctctctgtgtctca

SEQ ID NO: 178927 - DNA, 22 bp, Mus musculus
tgagtcctaccacactcactac

SEQ ID NO: 178928 - DNA, 23 bp, Mus musculus
atctgtctgagtcatctgttggg

SEQ ID NO: 178929 - DNA, 22 bp, Mus musculus
tcactatgtttaagatacagaa

SEQ ID NO: 178930 - DNA, 21 bp, Mus musculus
tatagttagtatacgttaact

SEQ ID NO: 178931 - DNA, 23 bp, Mus musculus
gaaactctcactttttctgtctc

SEQ ID NO: 178932 - DNA, 23 bp, Mus musculus
tctgtgtgcattctgtttctata

SEQ ID NO: 178933 - DNA, 23 bp, Mus musculus
aatggaatgtttagaaatatgca

SEQ ID NO: 178934 - DNA, 23 bp, Mus musculus
aacttgttgcctgagtcttccgt

SEQ ID NO: 178935 - DNA, 23 bp, Mus musculus
caacagctcagactccagcagca

SEQ ID NO: 178936 - DNA, 23 bp, Mus musculus
cactgtctgtgtgtgactcttct

SEQ ID NO: 178937 - DNA, 23 bp, Mus musculus
agcattccagatgagatggcttc

SEQ ID NO: 178938 - DNA, 23 bp, Mus musculus
actgctttctctgtgtctgtgtg

SEQ ID NO: 178939 - DNA, 19 bp, Mus musculus
actccaggggctggagaga

SEQ ID NO: 178940 - DNA, 19 bp, Mus musculus
tccatggtggtctgatagg

SEQ ID NO: 178941 - DNA, 22 bp, Mus musculus
tgttttgtgaccaattatatgg

SEQ ID NO: 178942 - DNA, 18 bp, Mus musculus
ctgaggtcatgtctgtca

SEQ ID NO: 178943 - DNA, 21 bp, Mus musculus
tgctgactgctcttccagagg

SEQ ID NO: 178944 - DNA, 23 bp, Mus musculus
tgtctctctgtgtgtgtctctgt

SEQ ID NO: 178945 - DNA, 19 bp, Mus musculus
agatgctggcatcatggtc

SEQ ID NO: 178946 - DNA, 21 bp, Mus musculus
tcactgacctcactatgtggg

SEQ ID NO: 178947 - DNA, 22 bp, Mus musculus
tgtgctggtgctttgttgctct

SEQ ID NO: 178948 - DNA, 20 bp, Mus musculus
tgtctcagtttctctctcag

SEQ ID NO: 178949 - DNA, 23 bp, Mus musculus
gcagtatatatgtttatctacac

SEQ ID NO: 178950 - DNA, 23 bp, Mus musculus
aggcaggcagatctttgtgagct

SEQ ID NO: 178951 - DNA, 23 bp, Mus musculus
tccctctgagtctgtctgtcacc

SEQ ID NO: 178952 - DNA, 23 bp, Mus musculus
tagtgcatggtgatctgatagga

SEQ ID NO: 178953 - DNA, 21 bp, Mus musculus
tgttttgtgacctattatgtg

SEQ ID NO: 178954 - DNA, 22 bp, Mus musculus
tgttttgtgaccaattatatgg

SEQ ID NO: 178955 - DNA, 22 bp, Mus musculus
tgttttgtgaccaattatatgg

SEQ ID NO: 178956 - DNA, 23 bp, Mus musculus
cagtgagcctcagatgaaaggtg

SEQ ID NO: 178957 - DNA, 22 bp, Mus musculus
ccttcagaggagtcatcactga

SEQ ID NO: 178958 - DNA, 23 bp, Mus musculus
agaggtgatgtatacatgaagct

SEQ ID NO: 178959 - DNA, 23 bp, Mus musculus
gctgctgtgagtcacactgtgtg

SEQ ID NO: 178960 - DNA, 23 bp, Mus musculus
ttcatcactggaaatcttctcca

SEQ ID NO: 178961 - DNA, 23 bp, Mus musculus
tctcacagactccctgtgttcac

SEQ ID NO: 178962 - DNA, 18 bp, Mus musculus
cagtacaaattagaagtg

SEQ ID NO: 178963 - DNA, 20 bp, Mus musculus
atatgtgtatatatatgtgt

SEQ ID NO: 178964 - DNA, 23 bp, Mus musculus
tgtatatgcacgtgtgtatgtat

SEQ ID NO: 178965 - DNA, 23 bp, Mus musculus
ccaaatgtgtctgctctgagtgt

SEQ ID NO: 178966 - DNA, 20 bp, Mus musculus
ttaacaagctaacccattgt

SEQ ID NO: 178967 - DNA, 22 bp, Mus musculus
gtctgacagtgtctccctggcc

SEQ ID NO: 178968 - DNA, 22 bp, Mus musculus
gaactagcttgtttagttttcc

SEQ ID NO: 178969 - DNA, 20 bp, Mus musculus
aagacaagcaggtctggtcc

SEQ ID NO: 178970 - DNA, 19 bp, Mus musculus
agtcagtacggagtgtgta

SEQ ID NO: 178971 - DNA, 21 bp, Mus musculus
aactgtctgcccatgctcctg

SEQ ID NO: 178972 - DNA, 23 bp, Mus musculus
ctggctcagaactgactgtgcac

SEQ ID NO: 178973 - DNA, 19 bp, Mus musculus
aggaccatctggcatctgg

SEQ ID NO: 178974 - DNA, 23 bp, Mus musculus
tctgcctgcctgcctgcctgcct

SEQ ID NO: 178975 - DNA, 23 bp, Mus musculus
atatgcatatgtatgtatgtatg

SEQ ID NO: 178976 - DNA, 23 bp, Mus musculus
tcctagcatctctcatgttgtac

SEQ ID NO: 178977 - DNA, 23 bp, Mus musculus
ttactgcaagtcctccagattac

SEQ ID NO: 178978 - DNA, 23 bp, Mus musculus
tcgtcgtttgttaagaagtaaga

SEQ ID NO: 178979 - DNA, 21 bp, Mus musculus
gcactgactgctcttccagag

SEQ ID NO: 178980 - DNA, 23 bp, Mus musculus
tgacagaacagagacaactgttg

SEQ ID NO: 178981 - DNA, 21 bp, Mus musculus
tatgtatgtatgtatgtatgt

SEQ ID NO: 178982 - DNA, 19 bp, Mus musculus
ttaagagcactgtctgctc

SEQ ID NO: 178983 - DNA, 21 bp, Mus musculus
catgatccagtctcggactct

SEQ ID NO: 178984 - DNA, 21 bp, Mus musculus
tgaagaggagacagtggtgaa

SEQ ID NO: 178985 - DNA, 23 bp, Mus musculus
gggctctctctctctctgctgga

SEQ ID NO: 178986 - DNA, 23 bp, Mus musculus
agcaactacatggtgggatctga

SEQ ID NO: 178987 - DNA, 23 bp, Mus musculus
ttgtggttgtaccttgcttagct

SEQ ID NO: 178988 - DNA, 22 bp, Mus musculus
tgactcactttgtcagtctgag

SEQ ID NO: 178989 - DNA, 23 bp, Mus musculus
atgctcagttgatacaagcaggg

SEQ ID NO: 178990 - DNA, 23 bp, Mus musculus
agtattacagattttgttgtaca

SEQ ID NO: 178991 - DNA, 23 bp, Mus musculus
tgtgtctttaagtagggtaaagt

SEQ ID NO: 178992 - DNA, 23 bp, Mus musculus
gaacaaatgtgtaggggctggag

SEQ ID NO: 178993 - DNA, 23 bp, Mus musculus
ctgcctgtctctgtgcgtgcgtg

SEQ ID NO: 178994 - DNA, 23 bp, Mus musculus
tgtctgtctgtgtgtgtgcaccc

SEQ ID NO: 178995 - DNA, 23 bp, Mus musculus
tcagtctcactcagtctgtgaaa

SEQ ID NO: 178996 - DNA, 21 bp, Mus musculus
cagcctcacagtgtctctgtt

SEQ ID NO: 178997 - DNA, 23 bp, Mus musculus
ttttacagtgtgcaattatgtgg

SEQ ID NO: 178998 - DNA, 20 bp, Mus musculus
tggctctggagcaggtgtct

SEQ ID NO: 178999 - DNA, 21 bp, Mus musculus
ctggctgagtctctgcgtctg

SEQ ID NO: 179000 - DNA, 23 bp, Mus musculus
taagagcactgactgctcttctg

SEQ ID NO: 179001 - DNA, 23 bp, Mus musculus
cagtgtctgtgtctcactttctc

SEQ ID NO: 179002 - DNA, 23 bp, Mus musculus
tatgtgtgtatatatgtatgtgt

SEQ ID NO: 179003 - DNA, 18 bp, Mus musculus
tgtatgtatgtatatatg

SEQ ID NO: 179004 - DNA, 23 bp, Mus musculus
tcccagtggcttagctctctctg

SEQ ID NO: 179005 - DNA, 23 bp, Mus musculus
agtcactgtgtatttctggtggt

SEQ ID NO: 179006 - DNA, 20 bp, Mus musculus
agggtgtgggatagatgtgt

SEQ ID NO: 179007 - DNA, 20 bp, Mus musculus
tgtgtacatacatatatgtg

SEQ ID NO: 179008 - DNA, 23 bp, Mus musculus
ggtatatatacatatgtgtacac

SEQ ID NO: 179009 - DNA, 22 bp, Mus musculus
atcagttaccttgagaatgctt

SEQ ID NO: 179010 - DNA, 22 bp, Mus musculus
ctctctctgcctgtcctgacac

SEQ ID NO: 179011 - DNA, 23 bp, Mus musculus
tatgtatatgtgcatctacatat

SEQ ID NO: 179012 - DNA, 23 bp, Mus musculus
atacatatatgtgttgtatatga

SEQ ID NO: 179013 - DNA, 21 bp, Mus musculus
taataagcttttgaaaaggac

SEQ ID NO: 179014 - DNA, 23 bp, Mus musculus
tgtggctgtgactcagggacaat

SEQ ID NO: 179015 - DNA, 23 bp, Mus musculus
tgtgagactgtgtctataacccc

SEQ ID NO: 179016 - DNA, 21 bp, Mus musculus
ttagagacagttgtcagctgc

SEQ ID NO: 179017 - DNA, 23 bp, Mus musculus
aagagcactgactgctcttccag

SEQ ID NO: 179018 - DNA, 22 bp, Mus musculus
tgtcggactgactcacacatca

SEQ ID NO: 179019 - DNA, 23 bp, Mus musculus
tatagagaagatgctgagctcaa

SEQ ID NO: 179020 - DNA, 21 bp, Mus musculus
aactggaattgcagctgtggt

SEQ ID NO: 179021 - DNA, 21 bp, Mus musculus
gtattgtacatcctggagttg

SEQ ID NO: 179022 - DNA, 23 bp, Mus musculus
cagggtctcagtgtctcagtcat

SEQ ID NO: 179023 - DNA, 23 bp, Mus musculus
taagagcactgactgctcttctg

SEQ ID NO: 179024 - DNA, 23 bp, Mus musculus
actgtctgtggctcagttccagg

SEQ ID NO: 179025 - DNA, 23 bp, Mus musculus
gggtccctctgtgtgtgcgtgtc

SEQ ID NO: 179026 - DNA, 23 bp, Mus musculus
atatgtgtatatgtatacatatg

SEQ ID NO: 179027 - DNA, 22 bp, Mus musculus
tgcctgcctgactgcctgcctc

SEQ ID NO: 179028 - DNA, 23 bp, Mus musculus
cctctgtctatgtctctgtctct

SEQ ID NO: 179029 - DNA, 21 bp, Mus musculus
agagactagtgactcaggaga

SEQ ID NO: 179030 - DNA, 23 bp, Mus musculus
gtggctgtctctgtgtctgtctg

SEQ ID NO: 179031 - DNA, 23 bp, Mus musculus
tatatgtgtatatgtatgtgtgt

SEQ ID NO: 179032 - DNA, 23 bp, Mus musculus
tctctctgtctgagtgctagagt

SEQ ID NO: 179033 - DNA, 19 bp, Mus musculus
tcactgctagccttctgtc

SEQ ID NO: 179034 - DNA, 23 bp, Mus musculus
gagtctacagagacagctcagtg

SEQ ID NO: 179035 - DNA, 21 bp, Mus musculus
tgcacactgctcttgctgagg

SEQ ID NO: 179036 - DNA, 23 bp, Mus musculus
tcagttctgtcactcatgtgggg

SEQ ID NO: 179037 - DNA, 22 bp, Mus musculus
atccactttatctttttgtata

SEQ ID NO: 179038 - DNA, 23 bp, Mus musculus
cctactgtgggagctaacctcaa

SEQ ID NO: 179039 - DNA, 18 bp, Mus musculus
agacaagtatctcacaga

SEQ ID NO: 179040 - DNA, 23 bp, Mus musculus
tctgagtcagacattttgtggta

SEQ ID NO: 179041 - DNA, 22 bp, Mus musculus
tctctcagtgacatttagctca

SEQ ID NO: 179042 - DNA, 23 bp, Mus musculus
gactctgtctgagtcagttggtg

SEQ ID NO: 179043 - DNA, 23 bp, Mus musculus
tgcgtgcgtgcgtgcgtgtgtgc

SEQ ID NO: 179044 - DNA, 23 bp, Mus musculus
tgggtgtctgtgttctgtctggg

SEQ ID NO: 179045 - DNA, 23 bp, Mus musculus
cagtggctcacagtctcctttcc

SEQ ID NO: 179046 - DNA, 23 bp, Mus musculus
gtatctatccatctgtgtgtgtt

SEQ ID NO: 179047 - DNA, 21 bp, Mus musculus
atgactgaaggaagtcaggac

SEQ ID NO: 179048 - DNA, 21 bp, Mus musculus
ccagtgactctgtgactcttc

SEQ ID NO: 179049 - DNA, 18 bp, Mus musculus
gtgtcttctcactctgtc

SEQ ID NO: 179050 - DNA, 19 bp, Mus musculus
gagaggaacacaagcagct

SEQ ID NO: 179051 - DNA, 23 bp, Mus musculus
gagttgactcagtcagaccctct

SEQ ID NO: 179052 - DNA, 23 bp, Mus musculus
tctcagcacctcactctctgtct

SEQ ID NO: 179053 - DNA, 22 bp, Mus musculus
tctgtctgtctgtctgctccag

SEQ ID NO: 179054 - DNA, 23 bp, Mus musculus
tcacactgacagtactgagtgtt

SEQ ID NO: 179055 - DNA, 22 bp, Mus musculus
gccttatctcagtctccctgtc

SEQ ID NO: 179056 - DNA, 23 bp, Mus musculus
tgagtctcagtgcctgtcagcca

SEQ ID NO: 179057 - DNA, 23 bp, Mus musculus
agtctgacagtcacggccagtga

SEQ ID NO: 179058 - DNA, 23 bp, Mus musculus
tgtgtctttatctctgtgacatc

SEQ ID NO: 179059 - DNA, 21 bp, Mus musculus
tgtgcaaaagacacccacaga

SEQ ID NO: 179060 - DNA, 19 bp, Mus musculus
tccctgtgtgcttttgtgc

SEQ ID NO: 179061 - DNA, 18 bp, Mus musculus
gaacaaagagcagcccct

SEQ ID NO: 179062 - DNA, 22 bp, Mus musculus
ctctctctctgactcatgttcg

SEQ ID NO: 179063 - DNA, 22 bp, Mus musculus
gtgcctggctggctggctgagt

SEQ ID NO: 179064 - DNA, 21 bp, Mus musculus
tacaggtagatgtttctatgg

SEQ ID NO: 179065 - DNA, 23 bp, Mus musculus
atgtctcagagtatggacatacc

SEQ ID NO: 179066 - DNA, 23 bp, Mus musculus
aggctctctctctctatccctgc

SEQ ID NO: 179067 - DNA, 22 bp, Mus musculus
agagacagatgtgaggcagcag

SEQ ID NO: 179068 - DNA, 23 bp, Mus musculus
gtatatgtatgtatatgtgtatg

SEQ ID NO: 179069 - DNA, 23 bp, Mus musculus
attttcatgggtgttgttttctt

SEQ ID NO: 179070 - DNA, 23 bp, Mus musculus
atatgtgtatatgtatatatgtg

SEQ ID NO: 179071 - DNA, 22 bp, Mus musculus
tatgtgtgcatatatatatgtg

SEQ ID NO: 179072 - DNA, 23 bp, Mus musculus
gccagaactgagccaggagaggt

SEQ ID NO: 179073 - DNA, 20 bp, Mus musculus
atgtatgtatgtatgtatgt

SEQ ID NO: 179074 - DNA, 23 bp, Mus musculus
tgtcagtagtcacagaggacttg

SEQ ID NO: 179075 - DNA, 23 bp, Mus musculus
tgccaagttgtgccaattactga

SEQ ID NO: 179076 - DNA, 23 bp, Mus musculus
atctctctgactctctgtctctc

SEQ ID NO: 179077 - DNA, 23 bp, Mus musculus
cacaattcacagtgcttgtgctc

SEQ ID NO: 179078 - DNA, 22 bp, Mus musculus
tgttttgtgaccaattatatgg

SEQ ID NO: 179079 - DNA, 21 bp, Mus musculus
atattgctttaattttgactt

SEQ ID NO: 179080 - DNA, 23 bp, Mus musculus
tgacactggctcgttccttgagt

SEQ ID NO: 179081 - DNA, 23 bp, Mus musculus
atatgtatatgtatatgtatacg

SEQ ID NO: 179082 - DNA, 18 bp, Mus musculus
ttgaacctatgcaggtgt

SEQ ID NO: 179083 - DNA, 23 bp, Mus musculus
ttgagatgtgaatttcatgttgt

SEQ ID NO: 179084 - DNA, 21 bp, Mus musculus
tacatgtatatgtatatgtat

SEQ ID NO: 179085 - DNA, 19 bp, Mus musculus
cagtggaattttctgaggc

SEQ ID NO: 179086 - DNA, 23 bp, Mus musculus
tgatacagtgtggtgtatgctga

SEQ ID NO: 179087 - DNA, 23 bp, Mus musculus
cctgcgtctgtccatctgtctct

SEQ ID NO: 179088 - DNA, 23 bp, Mus musculus
tcactcagagactctgtaaaatc

SEQ ID NO: 179089 - DNA, 23 bp, Mus musculus
aagttaacaagcttacagtgcag

SEQ ID NO: 179090 - DNA, 23 bp, Mus musculus
cctgacagtctgagtctctgaca

SEQ ID NO: 179091 - DNA, 21 bp, Mus musculus
gcagctcctacagattgggca

SEQ ID NO: 179092 - DNA, 20 bp, Mus musculus
gtctccctcagtgtctctca

SEQ ID NO: 179093 - DNA, 23 bp, Mus musculus
agtctcacactcaatgaacatac

SEQ ID NO: 179094 - DNA, 23 bp, Mus musculus
ctctgtgtgtctgtgtgcgtgac

SEQ ID NO: 179095 - DNA, 22 bp, Mus musculus
tttcaaagctgtccctctgtcc

SEQ ID NO: 179096 - DNA, 20 bp, Mus musculus
tcactgcctgtgacagcggg

SEQ ID NO: 179097 - DNA, 20 bp, Mus musculus
agtcagacccttagctcttt

SEQ ID NO: 179098 - DNA, 23 bp, Mus musculus
ttttgtgacagagtctatgttgc

SEQ ID NO: 179099 - DNA, 23 bp, Mus musculus
gtctgtctgtctgtctgtctgtc

SEQ ID NO: 179100 - DNA, 22 bp, Mus musculus
tctgtctctctggctctgcctc

SEQ ID NO: 179101 - DNA, 23 bp, Mus musculus
gctgtcactatcattttagcttt

SEQ ID NO: 179102 - DNA, 23 bp, Mus musculus
tgtatgcatgcgtgtgtgtacat

SEQ ID NO: 179103 - DNA, 23 bp, Mus musculus
atgtgtgcttgtgcatgtgcatg

SEQ ID NO: 179104 - DNA, 23 bp, Mus musculus
ttatgtgtgtgtgtatgatgtgt

SEQ ID NO: 179105 - DNA, 23 bp, Mus musculus
tatgtgtatatatatgtgtgtgt

SEQ ID NO: 179106 - DNA, 21 bp, Mus musculus
agagaagacagtgaggagaag

SEQ ID NO: 179107 - DNA, 23 bp, Mus musculus
tgtctacctccttctgtttggaa

SEQ ID NO: 179108 - DNA, 23 bp, Mus musculus
atatctggcatatgtatatatgt

SEQ ID NO: 179109 - DNA, 23 bp, Mus musculus
tgtgtatctctgtgtgtacatgt

SEQ ID NO: 179110 - DNA, 20 bp, Mus musculus
aagagtgcagtgggcacaga

SEQ ID NO: 179111 - DNA, 22 bp, Mus musculus
aacaactgcatattgtgatcat

SEQ ID NO: 179112 - DNA, 19 bp, Mus musculus
tcaggccctgtctctgtct

SEQ ID NO: 179113 - DNA, 23 bp, Mus musculus
acagaagagaatgagtaactgtt

SEQ ID NO: 179114 - DNA, 23 bp, Mus musculus
ccctggcagccagcctctatgcc

SEQ ID NO: 179115 - DNA, 19 bp, Mus musculus
gtgagtgtcaaatggcttc

SEQ ID NO: 179116 - DNA, 18 bp, Mus musculus
ataagcaaggtctgcaat

SEQ ID NO: 179117 - DNA, 18 bp, Mus musculus
gacagccacacatgctgg

SEQ ID NO: 179118 - DNA, 23 bp, Mus musculus
gtctctctgtgtgtctgtctgtc

SEQ ID NO: 179119 - DNA, 19 bp, Mus musculus
cattaaatctctgactcac

SEQ ID NO: 179120 - DNA, 23 bp, Mus musculus
aggagagagagttcagagtgagc

SEQ ID NO: 179121 - DNA, 20 bp, Mus musculus
caggctatctctgtctctga

SEQ ID NO: 179122 - DNA, 23 bp, Mus musculus
tgccagtgagcctttcttgagtg

SEQ ID NO: 179123 - DNA, 23 bp, Mus musculus
tgcctccctctgtcactgctacc

SEQ ID NO: 179124 - DNA, 23 bp, Mus musculus
atgtctcactggattggaagttt

SEQ ID NO: 179125 - DNA, 20 bp, Mus musculus
aagagcactgactgctcttc

SEQ ID NO: 179126 - DNA, 20 bp, Mus musculus
atgtgctctgggtccagggt

SEQ ID NO: 179127 - DNA, 19 bp, Mus musculus
tcatgtgtgagtgtgctgt

SEQ ID NO: 179128 - DNA, 23 bp, Mus musculus
aggaactgtgttgtaccagtgag

SEQ ID NO: 179129 - DNA, 19 bp, Mus musculus
tcaaagggtcagtacatgc

SEQ ID NO: 179130 - DNA, 23 bp, Mus musculus
taagaatcgctgaatacttggag

SEQ ID NO: 179131 - DNA, 23 bp, Mus musculus
tctgtatttattcatgtgtgtgt

SEQ ID NO: 179132 - DNA, 23 bp, Mus musculus
acatatgtgagttagtatatgtg

SEQ ID NO: 179133 - DNA, 23 bp, Mus musculus
tgtttctctccctcactgtttac

SEQ ID NO: 179134 - DNA, 23 bp, Mus musculus
acattctccctgagtgcctctct

SEQ ID NO: 179135 - DNA, 23 bp, Mus musculus
agaacacagggtgctttgtagta

SEQ ID NO: 179136 - DNA, 19 bp, Mus musculus
atgactggctgctaaggat

SEQ ID NO: 179137 - DNA, 23 bp, Mus musculus
cctgcctgcctgcctgcctgcct

SEQ ID NO: 179138 - DNA, 23 bp, Mus musculus
aatgggcctgatttttctcccag

SEQ ID NO: 179139 - DNA, 22 bp, Mus musculus
tggctggagacatggcttagtg

SEQ ID NO: 179140 - DNA, 23 bp, Mus musculus
tagagcatgtgcatgtgcatatg

SEQ ID NO: 179141 - DNA, 19 bp, Mus musculus
tgtgtgtgcatatgtgcgt

SEQ ID NO: 179142 - DNA, 22 bp, Mus musculus
cttcactctccctgtactgaag

SEQ ID NO: 179143 - DNA, 23 bp, Mus musculus
ctgttctctctctcacttctagc

SEQ ID NO: 179144 - DNA, 23 bp, Mus musculus
tatgagagtgcatgtgcttgtgg

SEQ ID NO: 179145 - DNA, 23 bp, Mus musculus
tgacagagaccagagactgacct

SEQ ID NO: 179146 - DNA, 23 bp, Mus musculus
gggctgttgatggttaagtgaca

SEQ ID NO: 179147 - DNA, 23 bp, Mus musculus
cacctgtctgtctgtcagggtgc

SEQ ID NO: 179148 - DNA, 23 bp, Mus musculus
taaactctctcactgtctcccaa

SEQ ID NO: 179149 - DNA, 22 bp, Mus musculus
gccactcactgtcacactgcga

SEQ ID NO: 179150 - DNA, 23 bp, Mus musculus
tgcctctctgtgatatagctctg

SEQ ID NO: 179151 - DNA, 21 bp, Mus musculus
actcactcacccatatacatg

SEQ ID NO: 179152 - DNA, 23 bp, Mus musculus
tctctctgtctcagaaatcacac

SEQ ID NO: 179153 - DNA, 23 bp, Mus musculus
ctgagggtgactgacaggcaggg

SEQ ID NO: 179154 - DNA, 23 bp, Mus musculus
gacatcctgactgtctgtctctc

SEQ ID NO: 179155 - DNA, 19 bp, Mus musculus
tccaccattgttctggagt

SEQ ID NO: 179156 - DNA, 23 bp, Mus musculus
acacagagtcctgacttcctagt

SEQ ID NO: 179157 - DNA, 23 bp, Mus musculus
tagactcggccagagtaggttca

SEQ ID NO: 179158 - DNA, 19 bp, Mus musculus
ctgcgactcactgcctctg

SEQ ID NO: 179159 - DNA, 23 bp, Mus musculus
gcactgactgctcttccagaggc

SEQ ID NO: 179160 - DNA, 22 bp, Mus musculus
agagagacaactcagagcgcag

SEQ ID NO: 179161 - DNA, 23 bp, Mus musculus
cactgcctctgtctctgcctcag

SEQ ID NO: 179162 - DNA, 22 bp, Mus musculus
aatcacaggcattttgttgagt

SEQ ID NO: 179163 - DNA, 23 bp, Mus musculus
ggaagtgagtcagtagagacagg

SEQ ID NO: 179164 - DNA, 23 bp, Mus musculus
cactgctctgtgactcactctct

SEQ ID NO: 179165 - DNA, 20 bp, Mus musculus
acatacaggcttgtttggga

SEQ ID NO: 179166 - DNA, 23 bp, Mus musculus
attctgtctgtctgtctgtttgc

SEQ ID NO: 179167 - DNA, 23 bp, Mus musculus
ttgaggggctggagagatggctc

SEQ ID NO: 179168 - DNA, 23 bp, Mus musculus
tgacagaagagacacacatctag

SEQ ID NO: 179169 - DNA, 23 bp, Mus musculus
tgtgtgtatatatatgtgtgtgt

SEQ ID NO: 179170 - DNA, 21 bp, Mus musculus
ccagaacttgctgctttggct

SEQ ID NO: 179171 - DNA, 23 bp, Mus musculus
ccctgtctctgcctctgagtggg

SEQ ID NO: 179172 - DNA, 23 bp, Mus musculus
tggctctgtgtatctttgtgctt

SEQ ID NO: 179173 - DNA, 22 bp, Mus musculus
agagagctgtgtgtgcacactc

SEQ ID NO: 179174 - DNA, 23 bp, Mus musculus
tcctcagtgagtctgtgcgtctg

SEQ ID NO: 179175 - DNA, 23 bp, Mus musculus
cccagatcacagcaagtatcagg

SEQ ID NO: 179176 - DNA, 19 bp, Mus musculus
acagctatacaactgcagt

SEQ ID NO: 179177 - DNA, 23 bp, Mus musculus
ttcatagacacatgtgagcatgt

SEQ ID NO: 179178 - DNA, 23 bp, Mus musculus
gggtctgagattgacttttgttt

SEQ ID NO: 179179 - DNA, 23 bp, Mus musculus
acagtgcagatcatctgcctgaa

SEQ ID NO: 179180 - DNA, 23 bp, Mus musculus
cgtctgtctgtctgtctgtctgt

SEQ ID NO: 179181 - DNA, 23 bp, Mus musculus
gggtgtctgtctgtctgtctgtc

SEQ ID NO: 179182 - DNA, 23 bp, Mus musculus
tcacttctgtccctgtctgtgag

SEQ ID NO: 179183 - DNA, 22 bp, Mus musculus
tgtgtgtatgtatgtatgtatg

SEQ ID NO: 179184 - DNA, 20 bp, Mus musculus
tattggttttttgagacagg

SEQ ID NO: 179185 - DNA, 23 bp, Mus musculus
acagggcatggaaatactcattc

SEQ ID NO: 179186 - DNA, 21 bp, Mus musculus
attgtgattgtttctttttgc

SEQ ID NO: 179187 - DNA, 21 bp, Mus musculus
agtcactactgatattcttgt

SEQ ID NO: 179188 - DNA, 18 bp, Mus musculus
gggatcctaagtacaaag

SEQ ID NO: 179189 - DNA, 23 bp, Mus musculus
aagatgtcagggtcttctgtttg

SEQ ID NO: 179190 - DNA, 22 bp, Mus musculus
actgacaggagagagagagccc

SEQ ID NO: 179191 - DNA, 23 bp, Mus musculus
gttaagatcctgtacttggggct

SEQ ID NO: 179192 - DNA, 22 bp, Mus musculus
tgactgtcacgacttctgctgt

SEQ ID NO: 179193 - DNA, 22 bp, Mus musculus
gtgtgcctgtgtgcctgtgtac

SEQ ID NO: 179194 - DNA, 21 bp, Mus musculus
gatcagtctgtgtctgtgacc

SEQ ID NO: 179195 - DNA, 23 bp, Mus musculus
ttagagaacagagtgcagtcact

SEQ ID NO: 179196 - DNA, 21 bp, Mus musculus
aactctggtcagtgggtctct

SEQ ID NO: 179197 - DNA, 22 bp, Mus musculus
tgtatgtatgcatgtatgtatg

SEQ ID NO: 179198 - DNA, 23 bp, Mus musculus
agtggctgcctgcctgcctgcct

SEQ ID NO: 179199 - DNA, 19 bp, Mus musculus
actgagcaaactatgatgg

SEQ ID NO: 179200 - DNA, 23 bp, Mus musculus
tcactgtctctcacagtttggtg

SEQ ID NO: 179201 - DNA, 23 bp, Mus musculus
tccttgactcactcaatcattct

SEQ ID NO: 179202 - DNA, 23 bp, Mus musculus
ctgagggtgatgtgtgtgggtct

SEQ ID NO: 179203 - DNA, 23 bp, Mus musculus
cctgtgtgtctgtctcagtgtgc

SEQ ID NO: 179204 - DNA, 23 bp, Mus musculus
aggactcagtgctttggttgtgt

SEQ ID NO: 179205 - DNA, 23 bp, Mus musculus
ctgtctgtgtctgtctgtggagc

SEQ ID NO: 179206 - DNA, 23 bp, Mus musculus
aactatcatctcagcccctgtct

SEQ ID NO: 179207 - DNA, 18 bp, Mus musculus
tcagaaggctgtgagctg

SEQ ID NO: 179208 - DNA, 18 bp, Mus musculus
tatatgtatatgtgtaca

SEQ ID NO: 179209 - DNA, 23 bp, Mus musculus
tgtgtgtgtatatatatatgtgt

SEQ ID NO: 179210 - DNA, 23 bp, Mus musculus
tccacttgtgtctgtgtgtctgt

SEQ ID NO: 179211 - DNA, 21 bp, Mus musculus
aacagcttgcaggagttgggg

SEQ ID NO: 179212 - DNA, 23 bp, Mus musculus
tgacagtacagacagttctccgt

SEQ ID NO: 179213 - DNA, 21 bp, Mus musculus
gtcagcctgtctctctgcctc

SEQ ID NO: 179214 - DNA, 22 bp, Mus musculus
aagtatgtttgtatatgtgtgc

SEQ ID NO: 179215 - DNA, 19 bp, Mus musculus
agagagctgacagagaaga

SEQ ID NO: 179216 - DNA, 20 bp, Mus musculus
tgtatgtatgtatgtatgta

SEQ ID NO: 179217 - DNA, 23 bp, Mus musculus
atggaattgcactctctgtctgt

SEQ ID NO: 179218 - DNA, 18 bp, Mus musculus
aaaagctgcttttcctca

SEQ ID NO: 179219 - DNA, 20 bp, Mus musculus
gtccctgggagtttaccagt

SEQ ID NO: 179220 - DNA, 22 bp, Mus musculus
agagagaaatgactgagctggt

SEQ ID NO: 179221 - DNA, 23 bp, Mus musculus
gtgagagagagttttgtgtgtgt

SEQ ID NO: 179222 - DNA, 23 bp, Mus musculus
tgtgtgtgtgtgtatatacatac

SEQ ID NO: 179223 - DNA, 22 bp, Mus musculus
tgccataggctctctctgtctc

SEQ ID NO: 179224 - DNA, 23 bp, Mus musculus
tgtgcacatgtgtctgtgtgtat

SEQ ID NO: 179225 - DNA, 23 bp, Mus musculus
cacccactcgcacactcagtgga

SEQ ID NO: 179226 - DNA, 23 bp, Mus musculus
tgtgtgtgtctgtctgtatatgc

SEQ ID NO: 179227 - DNA, 23 bp, Mus musculus
tctgagggtctgagcttgggtct

SEQ ID NO: 179228 - DNA, 20 bp, Mus musculus
gactctctctgactctcagc

SEQ ID NO: 179229 - DNA, 23 bp, Mus musculus
ctgtgtgaatgtgtatatgtgtg

SEQ ID NO: 179230 - DNA, 23 bp, Mus musculus
atctgtgtatctatggtctatct

SEQ ID NO: 179231 - DNA, 21 bp, Mus musculus
tctgtcattcactggctgtgt

SEQ ID NO: 179232 - DNA, 23 bp, Mus musculus
tgtcagtgtctctgtccaatgcc

SEQ ID NO: 179233 - DNA, 23 bp, Mus musculus
ctgtctgtgtgactgagtttctt

SEQ ID NO: 179234 - DNA, 23 bp, Mus musculus
cagctacacagtgagactctgtc

SEQ ID NO: 179235 - DNA, 23 bp, Mus musculus
gtgtgtgtgtgtgtgtcatgtag

SEQ ID NO: 179236 - DNA, 21 bp, Mus musculus
tgtgcatatgtgtacgtgtgt

SEQ ID NO: 179237 - DNA, 23 bp, Mus musculus
ctgttgagactgtttctcttgtg

SEQ ID NO: 179238 - DNA, 18 bp, Mus musculus
aggttcattgattagggt

SEQ ID NO: 179239 - DNA, 23 bp, Mus musculus
gaatgcctctgtctctgactccc

SEQ ID NO: 179240 - DNA, 23 bp, Mus musculus
ggctggctggctggctggctggc

SEQ ID NO: 179241 - DNA, 23 bp, Mus musculus
catctgtctgtctgtctttgcac

SEQ ID NO: 179242 - DNA, 22 bp, Mus musculus
cccagtctctctctttctgagt

SEQ ID NO: 179243 - DNA, 23 bp, Mus musculus
tacgtgtgtatgcatgtgtgtgc

SEQ ID NO: 179244 - DNA, 21 bp, Mus musculus
atgtgtgtgctcatgtgtgtg

SEQ ID NO: 179245 - DNA, 20 bp, Mus musculus
gtctgtctgtctgtctgtct

SEQ ID NO: 179246 - DNA, 23 bp, Mus musculus
aagttgtattagaagaaaactca

SEQ ID NO: 179247 - DNA, 23 bp, Mus musculus
tgtgaggcaggactgtgagctca

SEQ ID NO: 179248 - DNA, 23 bp, Mus musculus
tctctctgcctcgctgtctccct

SEQ ID NO: 179249 - DNA, 18 bp, Mus musculus
tgactagagatggaggtg

SEQ ID NO: 179250 - DNA, 22 bp, Mus musculus
agtcagaacacagagtgagatc

SEQ ID NO: 179251 - DNA, 23 bp, Mus musculus
agtcaaagctttttgtttgtcta

SEQ ID NO: 179252 - DNA, 20 bp, Mus musculus
tgtgtgtgtgtgtgtgtata

SEQ ID NO: 179253 - DNA, 23 bp, Mus musculus
tatatgtgtgtgtatatatatac

SEQ ID NO: 179254 - DNA, 21 bp, Mus musculus
tgtgcatgtatgtgtatgtat

SEQ ID NO: 179255 - DNA, 18 bp, Mus musculus
agtgtatgtatgtatata

SEQ ID NO: 179256 - DNA, 23 bp, Mus musculus
tatgcatgtgcatgtatgtatag

SEQ ID NO: 179257 - DNA, 21 bp, Mus musculus
tgtgtacatgcatgtgtgtgt

SEQ ID NO: 179258 - DNA, 18 bp, Mus musculus
tctctctgtatgtcagtc

SEQ ID NO: 179259 - DNA, 23 bp, Mus musculus
gtgtgcatgtgtgtatgtatata

SEQ ID NO: 179260 - DNA, 23 bp, Mus musculus
atacatgtatatatgtatagtag

SEQ ID NO: 179261 - DNA, 20 bp, Mus musculus
tgtgttcagtgttccagaac

SEQ ID NO: 179262 - DNA, 22 bp, Mus musculus
ctgacttctgaccgacgaggag

SEQ ID NO: 179263 - DNA, 18 bp, Mus musculus
cagcaagtcacactctgt

SEQ ID NO: 179264 - DNA, 23 bp, Mus musculus
tgtctctctccctctctgaaagc

SEQ ID NO: 179265 - DNA, 23 bp, Mus musculus
agaagacagtatcaggtgttgtt

SEQ ID NO: 179266 - DNA, 23 bp, Mus musculus
tgacatccaccttctctgtctgt

SEQ ID NO: 179267 - DNA, 22 bp, Mus musculus
tctgtggctcactggctgactg

SEQ ID NO: 179268 - DNA, 23 bp, Mus musculus
ctctctcactgtctcacacgggg

SEQ ID NO: 179269 - DNA, 23 bp, Mus musculus
tctgtgtctgacactaactgcta

SEQ ID NO: 179270 - DNA, 19 bp, Mus musculus
gccacaagtgaatgagcac

SEQ ID NO: 179271 - DNA, 22 bp, Mus musculus
tgtgtctgtgtatgtttgtgtg

SEQ ID NO: 179272 - DNA, 21 bp, Mus musculus
tatatgtatatgaatatatgt

SEQ ID NO: 179273 - DNA, 22 bp, Mus musculus
tatgaatgtgtgtgtgtgtatt

SEQ ID NO: 179274 - DNA, 23 bp, Mus musculus
atgtgtctgtgtatgtatatatg

SEQ ID NO: 179275 - DNA, 23 bp, Mus musculus
tgtatgtatgtatgcatgtgtgt

SEQ ID NO: 179276 - DNA, 23 bp, Mus musculus
tgtttgtggttgtataatcctgt

SEQ ID NO: 179277 - DNA, 23 bp, Mus musculus
tgactgatgtgtttttcttgtat

SEQ ID NO: 179278 - DNA, 23 bp, Mus musculus
actatgtatgtactatatgtgca

SEQ ID NO: 179279 - DNA, 23 bp, Mus musculus
gagtgtgtgtctgtgtgtgatat

SEQ ID NO: 179280 - DNA, 23 bp, Mus musculus
agtcatgtctgttgatggctttg

SEQ ID NO: 179281 - DNA, 23 bp, Mus musculus
tcagagaagtcacactgcatgac

SEQ ID NO: 179282 - DNA, 22 bp, Mus musculus
tcacagtctctgagtttaagga

SEQ ID NO: 179283 - DNA, 21 bp, Mus musculus
acagtgtcagcagagagggcc

SEQ ID NO: 179284 - DNA, 21 bp, Mus musculus
tctgagggcttaacttcagca

SEQ ID NO: 179285 - DNA, 20 bp, Mus musculus
gtatacatgcatgtatgtac

SEQ ID NO: 179286 - DNA, 23 bp, Mus musculus
catgtgtgtgtatgtgcatgtgc

SEQ ID NO: 179287 - DNA, 20 bp, Mus musculus
agagcaggttgagatccgga

SEQ ID NO: 179288 - DNA, 23 bp, Mus musculus
aacacacacacacacatatagat

SEQ ID NO: 179289 - DNA, 22 bp, Mus musculus
tgacagacaagagagacaacag

SEQ ID NO: 179290 - DNA, 23 bp, Mus musculus
tgtctgtgcctgtgtatgtgcct

SEQ ID NO: 179291 - DNA, 21 bp, Mus musculus
atagagtcagggagtcttgta

SEQ ID NO: 179292 - DNA, 22 bp, Mus musculus
atgtgcatgtccatgtgtgtga

SEQ ID NO: 179293 - DNA, 23 bp, Mus musculus
cactgtctgtgtgtgactcttct

SEQ ID NO: 179294 - DNA, 23 bp, Mus musculus
ctcactctctggctctctgggtg

SEQ ID NO: 179295 - DNA, 23 bp, Mus musculus
tgtctgtctgtctatatgtgtgt

SEQ ID NO: 179296 - DNA, 21 bp, Mus musculus
agtgacaggcttcaaagcagg

SEQ ID NO: 179297 - DNA, 23 bp, Mus musculus
tgcctctcacgctcagttattca

SEQ ID NO: 179298 - DNA, 19 bp, Mus musculus
tctctccttcactctagca

SEQ ID NO: 179299 - DNA, 23 bp, Mus musculus
ggtgacagagattgaagaatgaa

SEQ ID NO: 179300 - DNA, 22 bp, Mus musculus
cttaatgtctctgtggatcact

SEQ ID NO: 179301 - DNA, 22 bp, Mus musculus
taaagctcctttctgtgtatct

SEQ ID NO: 179302 - DNA, 21 bp, Mus musculus
cctggacctgtgtgtgatcct

SEQ ID NO: 179303 - DNA, 22 bp, Mus musculus
tgtggggttgatctcttggggt

SEQ ID NO: 179304 - DNA, 23 bp, Mus musculus
ctgtctgtcactttatggtgtgt

SEQ ID NO: 179305 - DNA, 23 bp, Mus musculus
tctgtctgtctgtctgactgtct

SEQ ID NO: 179306 - DNA, 23 bp, Mus musculus
ttcactctgtgagacaaggttat

SEQ ID NO: 179307 - DNA, 20 bp, Mus musculus
atgtatgtatgtatgtgtgt

SEQ ID NO: 179308 - DNA, 23 bp, Mus musculus
tatacaaatgcatgcatatctgt

SEQ ID NO: 179309 - DNA, 20 bp, Mus musculus
acctggagggttaagggact

SEQ ID NO: 179310 - DNA, 23 bp, Mus musculus
tgtttgacctgctctctctctga

SEQ ID NO: 179311 - DNA, 21 bp, Mus musculus
tttgaagtgcaggctgtgact

SEQ ID NO: 179312 - DNA, 23 bp, Mus musculus
gtgtctccctccctcttactcat

SEQ ID NO: 179313 - DNA, 23 bp, Mus musculus
actgactgactgactgccaccca

SEQ ID NO: 179314 - DNA, 20 bp, Mus musculus
tctccctctctgtcagccga

SEQ ID NO: 179315 - DNA, 23 bp, Mus musculus
ctgatgtgtctctgtgtctgtgt

SEQ ID NO: 179316 - DNA, 23 bp, Mus musculus
aggaagtgcgtcactgtaggggt

SEQ ID NO: 179317 - DNA, 23 bp, Mus musculus
gtgtgtgtgtatacatgtgtgaa

SEQ ID NO: 179318 - DNA, 23 bp, Mus musculus
gtatatgtgtgtgtgcatgtgta

SEQ ID NO: 179319 - DNA, 23 bp, Mus musculus
tcagtctcattctctgtcatctg

SEQ ID NO: 179320 - DNA, 23 bp, Mus musculus
taaagtacatatagtggaagttg

SEQ ID NO: 179321 - DNA, 21 bp, Mus musculus
tgcctctgtctgtctgtctgt

SEQ ID NO: 179322 - DNA, 21 bp, Mus musculus
tatagatatttgtataaatgt

SEQ ID NO: 179323 - DNA, 21 bp, Mus musculus
tgtatacatggatgtatggat

SEQ ID NO: 179324 - DNA, 18 bp, Mus musculus
tatagatggatgtataga

SEQ ID NO: 179325 - DNA, 22 bp, Mus musculus
ctctgagccttagtggtgatgc

SEQ ID NO: 179326 - DNA, 18 bp, Mus musculus
gagcaaggtgtgcagatt

SEQ ID NO: 179327 - DNA, 22 bp, Mus musculus
tgttttgttctttgtgtgacct

SEQ ID NO: 179328 - DNA, 21 bp, Mus musculus
acgacctttccatttctgatt

SEQ ID NO: 179329 - DNA, 23 bp, Mus musculus
agcctgactgcctgagttctgct

SEQ ID NO: 179330 - DNA, 23 bp, Mus musculus
cacagtagacagagacgacctgc

SEQ ID NO: 179331 - DNA, 23 bp, Mus musculus
aagtctggggacttcctgggctt

SEQ ID NO: 179332 - DNA, 23 bp, Mus musculus
aattctgtgagctactgatgtat

SEQ ID NO: 179333 - DNA, 23 bp, Mus musculus
atagatgtatgtatgtatgtatg

SEQ ID NO: 179334 - DNA, 21 bp, Mus musculus
tttgagtgatttcttggggag

SEQ ID NO: 179335 - DNA, 21 bp, Mus musculus
cactgactgctcttccagagg

SEQ ID NO: 179336 - DNA, 23 bp, Mus musculus
ccctccctgtgtgccacagctgt

SEQ ID NO: 179337 - DNA, 23 bp, Mus musculus
tgtctatctatctgtctgtctgt

SEQ ID NO: 179338 - DNA, 23 bp, Mus musculus
atgatgcctcagtcttgcccaag

SEQ ID NO: 179339 - DNA, 23 bp, Mus musculus
tcagagaacacagagaggacagt

SEQ ID NO: 179340 - DNA, 23 bp, Mus musculus
tgtctctgactgacatgatgggc

SEQ ID NO: 179341 - DNA, 22 bp, Mus musculus
tgttttgtgaccaattatatgg

SEQ ID NO: 179342 - DNA, 22 bp, Mus musculus
tgttttgtgaccaattatatgg

SEQ ID NO: 179343 - DNA, 22 bp, Mus musculus
tgttttgtgaccaattatatgg

SEQ ID NO: 179344 - DNA, 22 bp, Mus musculus
tgttttgtgaccaattatatgg

SEQ ID NO: 179345 - DNA, 23 bp, Mus musculus
tgatcatgttgatgttcttggat

SEQ ID NO: 179346 - DNA, 22 bp, Mus musculus
tgttttgtgaccaattatatgg

SEQ ID NO: 179347 - DNA, 23 bp, Mus musculus
tgatcatgttgatgttcttggat

SEQ ID NO: 179348 - DNA, 22 bp, Mus musculus
ccactgtctcactgtctgtgtg

SEQ ID NO: 179349 - DNA, 22 bp, Mus musculus
tgttttgtgaccaattatatgg

SEQ ID NO: 179350 - DNA, 22 bp, Mus musculus
ccactgtctcactgtctgtgtg

SEQ ID NO: 179351 - DNA, 23 bp, Mus musculus
tgctagttcagactctggaagca

SEQ ID NO: 179352 - DNA, 23 bp, Mus musculus
tgatcatgttgatgttcttggat

SEQ ID NO: 179353 - DNA, 23 bp, Mus musculus
tctgtggtgtttctgataggatg

SEQ ID NO: 179354 - DNA, 23 bp, Mus musculus
atgtgtgtgtagagtgtgtgcag

SEQ ID NO: 179355 - DNA, 22 bp, Mus musculus
gtcagggtctctctgtgtggca

SEQ ID NO: 179356 - DNA, 23 bp, Mus musculus
tatgacagtaccagaaatttcca

SEQ ID NO: 179357 - DNA, 21 bp, Mus musculus
atatgtatatatatatacgtg

SEQ ID NO: 179358 - DNA, 23 bp, Mus musculus
tgtgtgtgtgtgtgcatgtgtgt

SEQ ID NO: 179359 - DNA, 19 bp, Mus musculus
aggtcagctttaaagtgtg

SEQ ID NO: 179360 - DNA, 22 bp, Mus musculus
tctctgcctcagcctcagcctc

SEQ ID NO: 179361 - DNA, 19 bp, Mus musculus
ggctgactcagtgtgtgac

SEQ ID NO: 179362 - DNA, 21 bp, Mus musculus
gcacagtgtatctgtctgtat

SEQ ID NO: 179363 - DNA, 23 bp, Mus musculus
tcagacattttctttctgctagg

SEQ ID NO: 179364 - DNA, 22 bp, Mus musculus
tgttttgtgaccaattatatgg

SEQ ID NO: 179365 - DNA, 22 bp, Mus musculus
tgatcatgtatatcttatctac

SEQ ID NO: 179366 - DNA, 22 bp, Mus musculus
ctgtgtgtatatggatgtgcat

SEQ ID NO: 179367 - DNA, 22 bp, Mus musculus
gtgtatgtctgtgtgtgtatat

SEQ ID NO: 179368 - DNA, 21 bp, Mus musculus
tctggaacaatctctctctct

SEQ ID NO: 179369 - DNA, 23 bp, Mus musculus
atgcctctccctctgactctgag

SEQ ID NO: 179370 - DNA, 19 bp, Mus musculus
tagatatagattagatata

SEQ ID NO: 179371 - DNA, 18 bp, Mus musculus
tgcatgtgtgtgtgcatg

SEQ ID NO: 179372 - DNA, 23 bp, Mus musculus
ctgtcacactgtggtattgatga

SEQ ID NO: 179373 - DNA, 23 bp, Mus musculus
gtgtgtgactgactgtgtcacta

SEQ ID NO: 179374 - DNA, 23 bp, Mus musculus
tcagaccctctgtggctgtgggt

SEQ ID NO: 179375 - DNA, 21 bp, Mus musculus
tcactgcagattataaagtag

SEQ ID NO: 179376 - DNA, 23 bp, Mus musculus
tatgtgtatatatgtgtgtgtga

SEQ ID NO: 179377 - DNA, 21 bp, Mus musculus
tatgtgtgtggtacatgtgtg

SEQ ID NO: 179378 - DNA, 23 bp, Mus musculus
gtatgtatgttgtatgtatgctg

SEQ ID NO: 179379 - DNA, 23 bp, Mus musculus
ctctgtgacatcctctctctgtg

SEQ ID NO: 179380 - DNA, 23 bp, Mus musculus
agcactgactactcttgcagagg

SEQ ID NO: 179381 - DNA, 23 bp, Mus musculus
aatgtgtatgtataagtgaatgt

SEQ ID NO: 179382 - DNA, 23 bp, Mus musculus
tgtgtgtctctgtgtcctctgtc

SEQ ID NO: 179383 - DNA, 19 bp, Mus musculus
tgtgtatatatatacatat

SEQ ID NO: 179384 - DNA, 21 bp, Mus musculus
agtgtatgtgtgtgaggtatg

SEQ ID NO: 179385 - DNA, 23 bp, Mus musculus
tgtctgtctgtctgtctgtttgt

SEQ ID NO: 179386 - DNA, 20 bp, Mus musculus
tagagtcaagagagaggagg

SEQ ID NO: 179387 - DNA, 23 bp, Mus musculus
tcacttgagactctcccactctg

SEQ ID NO: 179388 - DNA, 21 bp, Mus musculus
tatacacacatgtatatatgt

SEQ ID NO: 179389 - DNA, 23 bp, Mus musculus
tatatgtatgtatacatgtgtgt

SEQ ID NO: 179390 - DNA, 21 bp, Mus musculus
tatgtgtatatacatatgtgt

SEQ ID NO: 179391 - DNA, 23 bp, Mus musculus
atctttgatggacagatagtcag

SEQ ID NO: 179392 - DNA, 23 bp, Mus musculus
tctgtttgtttttgataccaaaa

SEQ ID NO: 179393 - DNA, 23 bp, Mus musculus
atctgacttgtggaagtcgaact

SEQ ID NO: 179394 - DNA, 23 bp, Mus musculus
tatgtgtatatgtatgtgtgtgc

SEQ ID NO: 179395 - DNA, 23 bp, Mus musculus
tgtgtatatgtatgagtatatgt

SEQ ID NO: 179396 - DNA, 23 bp, Mus musculus
tatgtgtgtgtgcatgtgcatgc

SEQ ID NO: 179397 - DNA, 22 bp, Mus musculus
tgtgtgtggaaatgtatgtatt

SEQ ID NO: 179398 - DNA, 23 bp, Mus musculus
gtctgtctgtctgtctgtgtctg

SEQ ID NO: 179399 - DNA, 23 bp, Mus musculus
ggcttgaacttggagacgagctg

SEQ ID NO: 179400 - DNA, 21 bp, Mus musculus
gactctcactgactgtgggcc

SEQ ID NO: 179401 - DNA, 23 bp, Mus musculus
tagcagtgaggagacactgtgga

SEQ ID NO: 179402 - DNA, 22 bp, Mus musculus
tgtgacagtgtctgtgtgcatc

SEQ ID NO: 179403 - DNA, 23 bp, Mus musculus
tctatgtgtgcattattgtgtga

SEQ ID NO: 179404 - DNA, 23 bp, Mus musculus
cagtctgacagtgtctgtgtgtg

SEQ ID NO: 179405 - DNA, 19 bp, Mus musculus
agacaaggtctcgctctgt

SEQ ID NO: 179406 - DNA, 20 bp, Mus musculus
acagatgatccattgtgaaa

SEQ ID NO: 179407 - DNA, 22 bp, Mus musculus
aaggtgagaagataaacatctg

SEQ ID NO: 179408 - DNA, 21 bp, Mus musculus
tggaatgtaaagaagtatgta

SEQ ID NO: 179409 - DNA, 22 bp, Mus musculus
tctctggctgtgactggggggc

SEQ ID NO: 179410 - DNA, 20 bp, Mus musculus
tgtgttgtttgaagagtgtg

SEQ ID NO: 179411 - DNA, 19 bp, Mus musculus
attggtgttatagccgggt

SEQ ID NO: 179412 - DNA, 18 bp, Mus musculus
gcaaggtgctcaatgaca

SEQ ID NO: 179413 - DNA, 23 bp, Mus musculus
tctgtttctctgagtctgtcagg

SEQ ID NO: 179414 - DNA, 23 bp, Mus musculus
tgtttgtgcatgtgcatgtgtga

SEQ ID NO: 179415 - DNA, 23 bp, Mus musculus
tccttttgtcattttctagattt

SEQ ID NO: 179416 - DNA, 19 bp, Mus musculus
acaggtcagggatgtggct

SEQ ID NO: 179417 - DNA, 23 bp, Mus musculus
taaggcacgcggtgaatgccaag

SEQ ID NO: 179418 - DNA, 23 bp, Mus musculus
cacacattctcactctctgttct

SEQ ID NO: 179419 - DNA, 23 bp, Mus musculus
tcagacagtgaacagactaggtg

SEQ ID NO: 179420 - DNA, 23 bp, Mus musculus
gcagtggaatgttaagtggggtt

SEQ ID NO: 179421 - DNA, 18 bp, Mus musculus
tcggagcagggttgtttc

SEQ ID NO: 179422 - DNA, 23 bp, Mus musculus
tagacagagatgagagaggacac

SEQ ID NO: 179423 - DNA, 22 bp, Mus musculus
acagagccacagctaaacaggt

SEQ ID NO: 179424 - DNA, 22 bp, Mus musculus
tgttttgtgaccaattatatgg

SEQ ID NO: 179425 - DNA, 23 bp, Mus musculus
atgtatatctgcatgttttctgg

SEQ ID NO: 179426 - DNA, 21 bp, Mus musculus
tcaattcccatcagacctcat

SEQ ID NO: 179427 - DNA, 23 bp, Mus musculus
agcaccctcttcaggcagttcac

SEQ ID NO: 179428 - DNA, 23 bp, Mus musculus
gtatgtatgtatatatgtatgta

SEQ ID NO: 179429 - DNA, 20 bp, Mus musculus
atgtgtgtatgtatgtatgc

SEQ ID NO: 179430 - DNA, 20 bp, Mus musculus
aaaggtactaagttcaaatc

SEQ ID NO: 179431 - DNA, 18 bp, Mus musculus
cagaggtattgagttcaa

SEQ ID NO: 179432 - DNA, 23 bp, Mus musculus
agcaaagagacaggtgagagagg

SEQ ID NO: 179433 - DNA, 23 bp, Mus musculus
ttaagagcactgactgctcttcc

SEQ ID NO: 179434 - DNA, 21 bp, Mus musculus
cttgtcctccactttaggtgt

SEQ ID NO: 179435 - DNA, 22 bp, Mus musculus
tgtgtgtgtgtgtatttgcata

SEQ ID NO: 179436 - DNA, 22 bp, Mus musculus
cgtatgtatatatgtatgtgtg

SEQ ID NO: 179437 - DNA, 22 bp, Mus musculus
tatatgtgtatatgtatatatg

SEQ ID NO: 179438 - DNA, 23 bp, Mus musculus
tcagtcaccctgtgtgcctggga

SEQ ID NO: 179439 - DNA, 22 bp, Mus musculus
tctctgagtcacacattttaac

SEQ ID NO: 179440 - DNA, 23 bp, Mus musculus
tttgaaagtcaagaatgtgtgca

SEQ ID NO: 179441 - DNA, 23 bp, Mus musculus
tgtctgtctgtctgtctgtctgt

SEQ ID NO: 179442 - DNA, 23 bp, Mus musculus
tctctcagacactgactccatgt

SEQ ID NO: 179443 - DNA, 23 bp, Mus musculus
tctgtctctctcatttgtgagga

SEQ ID NO: 179444 - DNA, 23 bp, Mus musculus
acacagagacagacttcatgggc

SEQ ID NO: 179445 - DNA, 21 bp, Mus musculus
ttgtctcaagagactcaggtc

SEQ ID NO: 179446 - DNA, 22 bp, Mus musculus
ccctctgtgtgtctgtgcctta

SEQ ID NO: 179447 - DNA, 21 bp, Mus musculus
tgtcagaagtctgtgtggtca

SEQ ID NO: 179448 - DNA, 23 bp, Mus musculus
tttcttcttgttgttctagagct

SEQ ID NO: 179449 - DNA, 18 bp, Mus musculus
caggaaccagtttgaggt

SEQ ID NO: 179450 - DNA, 22 bp, Mus musculus
cactctcagttcaggccagtgt

SEQ ID NO: 179451 - DNA, 22 bp, Mus musculus
tgtctgtctgtctatctgtctg

SEQ ID NO: 179452 - DNA, 22 bp, Mus musculus
agcctgcctgtctgtctgcctg

SEQ ID NO: 179453 - DNA, 19 bp, Mus musculus
gcctgttagaatgtatgta

SEQ ID NO: 179454 - DNA, 23 bp, Mus musculus
tatatctatatattcatatgtgt

SEQ ID NO: 179455 - DNA, 23 bp, Mus musculus
tgtggctgtggttgttgtctctg

SEQ ID NO: 179456 - DNA, 23 bp, Mus musculus
aagagttctgtctatgtctgtct

SEQ ID NO: 179457 - DNA, 23 bp, Mus musculus
agcaactgaactgtgagaggtca

SEQ ID NO: 179458 - DNA, 21 bp, Mus musculus
tgtgtgtatatatgtgtgtat

SEQ ID NO: 179459 - DNA, 18 bp, Mus musculus
ttggaggacagaatgaca

SEQ ID NO: 179460 - DNA, 22 bp, Mus musculus
aagtctgtgtcgccagatggaa

SEQ ID NO: 179461 - DNA, 21 bp, Mus musculus
tggagatgctgggcaggtggt

SEQ ID NO: 179462 - DNA, 23 bp, Mus musculus
ccctcacactggctctgtctgcc

SEQ ID NO: 179463 - DNA, 21 bp, Mus musculus
atatgtgtatatatatgtgtg

SEQ ID NO: 179464 - DNA, 21 bp, Mus musculus
atgtgtgtatatatgtatgta

SEQ ID NO: 179465 - DNA, 20 bp, Mus musculus
tgtatgtctgactgtgtgca

SEQ ID NO: 179466 - DNA, 23 bp, Mus musculus
catcgtctctgtgtgtatgtctg

SEQ ID NO: 179467 - DNA, 22 bp, Mus musculus
tgtgtgtgtgcatgtgcatgtg

SEQ ID NO: 179468 - DNA, 19 bp, Mus musculus
gtgtacatgcatgtgtgtg

SEQ ID NO: 179469 - DNA, 23 bp, Mus musculus
tctatctctgtttctctgtgtgt

SEQ ID NO: 179470 - DNA, 20 bp, Mus musculus
atgtgtgcatatgcatgtgt

SEQ ID NO: 179471 - DNA, 23 bp, Mus musculus
tctgtgaggatgtgcttgtgcat

SEQ ID NO: 179472 - DNA, 23 bp, Mus musculus
acactcacgaatagatgtgatgt

SEQ ID NO: 179473 - DNA, 20 bp, Mus musculus
gtgtgtgtgtgtgtgtgcat

SEQ ID NO: 179474 - DNA, 22 bp, Mus musculus
agctgagtcttcatgatgacag

SEQ ID NO: 179475 - DNA, 18 bp, Mus musculus
ctgtggtttgtcaaacag

SEQ ID NO: 179476 - DNA, 23 bp, Mus musculus
tcagtctctccatgaccactggc

SEQ ID NO: 179477 - DNA, 23 bp, Mus musculus
gtctctcagtctctctgctctct

SEQ ID NO: 179478 - DNA, 18 bp, Mus musculus
agagacatagctcagtga

SEQ ID NO: 179479 - DNA, 20 bp, Mus musculus
cgtgcattgcatgtgtgtga

SEQ ID NO: 179480 - DNA, 22 bp, Mus musculus
tgtgtgtgcaagtgcatgtgta

SEQ ID NO: 179481 - DNA, 23 bp, Mus musculus
tctgagtcacctggtgccattgt

SEQ ID NO: 179482 - DNA, 23 bp, Mus musculus
tgggtcagtgggtcagtgttggc

SEQ ID NO: 179483 - DNA, 23 bp, Mus musculus
tgtgtctgcatgtgtattcatgt

SEQ ID NO: 179484 - DNA, 23 bp, Mus musculus
ttcctgtatgtgtatctgcatgt

SEQ ID NO: 179485 - DNA, 22 bp, Mus musculus
ctctgggactcacactcactct

SEQ ID NO: 179486 - DNA, 23 bp, Mus musculus
caacatgcatgtgtgtatgtgtt

SEQ ID NO: 179487 - DNA, 23 bp, Mus musculus
acatgtgtgtgcgtgtgcatgtg

SEQ ID NO: 179488 - DNA, 23 bp, Mus musculus
aataccagatcttcaggttgtca

SEQ ID NO: 179489 - DNA, 22 bp, Mus musculus
ccactgtctcactgtctgtgtg

SEQ ID NO: 179490 - DNA, 23 bp, Mus musculus
tgatcatgttgatgttcttggat

SEQ ID NO: 179491 - DNA, 22 bp, Mus musculus
tgttttgtgaccaattatatgg

SEQ ID NO: 179492 - DNA, 22 bp, Mus musculus
ccactgtctcactgtctgtgtg

SEQ ID NO: 179493 - DNA, 22 bp, Mus musculus
tgttttgtgaccaattatatgg

SEQ ID NO: 179494 - DNA, 22 bp, Mus musculus
ccactgtctcactgtctgtgtg

SEQ ID NO: 179495 - DNA, 23 bp, Mus musculus
tgatcatgttgatgttcttggat

SEQ ID NO: 179496 - DNA, 23 bp, Mus musculus
tgatcatgttgatgttcttggat

SEQ ID NO: 179497 - DNA, 23 bp, Mus musculus
tgatcatgttgatgttcttggat

SEQ ID NO: 179498 - DNA, 22 bp, Mus musculus
tgttttgtgaccaattatatgg

SEQ ID NO: 179499 - DNA, 22 bp, Mus musculus
atatatgtatatatggaatgtg

SEQ ID NO: 179500 - DNA, 19 bp, Mus musculus
tgactcactttctctcact

SEQ ID NO: 179501 - DNA, 23 bp, Mus musculus
actgactgacttacttaagtggt

SEQ ID NO: 179502 - DNA, 22 bp, Mus musculus
tagttagttagttagttagtta

SEQ ID NO: 179503 - DNA, 23 bp, Mus musculus
tatgtgtgggtctgtgagtctgt

SEQ ID NO: 179504 - DNA, 23 bp, Mus musculus
tcagcttgacactctctctctcc

SEQ ID NO: 179505 - DNA, 23 bp, Mus musculus
ccaaggtgtcagaagacagtctc

SEQ ID NO: 179506 - DNA, 23 bp, Mus musculus
gtgtgtatgtgtctctgtgtgcc

SEQ ID NO: 179507 - DNA, 23 bp, Mus musculus
ggcagaggagggctgttcttccc

SEQ ID NO: 179508 - DNA, 21 bp, Mus musculus
aggaactagccttctctcagc

SEQ ID NO: 179509 - DNA, 22 bp, Mus musculus
agggccccccctcaatcctgtt

SEQ ID NO: 179510 - DNA, 23 bp, Mus musculus
atgtgtgtgtgcatgtgtatgga

SEQ ID NO: 179511 - DNA, 22 bp, Mus musculus
tgcatgtatgtatgtatgtatg

SEQ ID NO: 179512 - DNA, 19 bp, Mus musculus
atgtatgtatgcatgtatg

SEQ ID NO: 179513 - DNA, 23 bp, Mus musculus
aaagcctgggtccctgcttggct

SEQ ID NO: 179514 - DNA, 23 bp, Mus musculus
gtgtagaaagaagtgtgtttcca

SEQ ID NO: 179515 - DNA, 23 bp, Mus musculus
ttgatcagagactttgttgtttg

SEQ ID NO: 179516 - DNA, 23 bp, Mus musculus
tgtcactctctgtgtgctctgtg

SEQ ID NO: 179517 - DNA, 20 bp, Mus musculus
tgtcactgtgtgacaaaaga

SEQ ID NO: 179518 - DNA, 23 bp, Mus musculus
tgtggatgcagtgtgacttgctg

SEQ ID NO: 179519 - DNA, 20 bp, Mus musculus
agactcacactgtgggtcac

SEQ ID NO: 179520 - DNA, 23 bp, Mus musculus
gctgcttctcctcctgctgctca

SEQ ID NO: 179521 - DNA, 23 bp, Mus musculus
tgctggctctgtctgtctgtctt

SEQ ID NO: 179522 - DNA, 22 bp, Mus musculus
tttgcagatcaagatgtgagct

SEQ ID NO: 179523 - DNA, 23 bp, Mus musculus
tgagaaagctatggaaatgcatc

SEQ ID NO: 179524 - DNA, 20 bp, Mus musculus
gctccacagtcactctctcc

SEQ ID NO: 179525 - DNA, 23 bp, Mus musculus
tttcagtgtcactctctcttcct

SEQ ID NO: 179526 - DNA, 23 bp, Mus musculus
gccccagtctcactttgtctctg

SEQ ID NO: 179527 - DNA, 19 bp, Mus musculus
ccgtgcgtatgtagagtgc

SEQ ID NO: 179528 - DNA, 23 bp, Mus musculus
gtgtctgtggttcagagtcgcgg

SEQ ID NO: 179529 - DNA, 23 bp, Mus musculus
ctgtctgtctgtctgtctagtcg

SEQ ID NO: 179530 - DNA, 19 bp, Mus musculus
tctctgtgtgtgcctggct

SEQ ID NO: 179531 - DNA, 22 bp, Mus musculus
caggcacactgtcactgtccct

SEQ ID NO: 179532 - DNA, 21 bp, Mus musculus
ttcaggttcatgttgtcatgt

SEQ ID NO: 179533 - DNA, 20 bp, Mus musculus
ctcagcctctgtcactgtct

SEQ ID NO: 179534 - DNA, 22 bp, Mus musculus
tcacacattgtcagtgtcttga

SEQ ID NO: 179535 - DNA, 23 bp, Mus musculus
gctctcagtctgtgactttggac

SEQ ID NO: 179536 - DNA, 23 bp, Mus musculus
tgactcagtcagcctctgggact

SEQ ID NO: 179537 - DNA, 21 bp, Mus musculus
ctagaccttagaggtttgctt

SEQ ID NO: 179538 - DNA, 22 bp, Mus musculus
gtatgtatgtctgtgtgtgtat

SEQ ID NO: 179539 - DNA, 18 bp, Mus musculus
tgtatgtatatgtatgtg

SEQ ID NO: 179540 - DNA, 23 bp, Mus musculus
gctcctgctgaacctgcagctct

SEQ ID NO: 179541 - DNA, 23 bp, Mus musculus
tccctgattagccatgtgtgtgt

SEQ ID NO: 179542 - DNA, 23 bp, Mus musculus
gtcactcacactctggcaacgca

SEQ ID NO: 179543 - DNA, 23 bp, Mus musculus
gtgtgagcatgtgcatgtgtgtg

SEQ ID NO: 179544 - DNA, 23 bp, Mus musculus
acactggaaggtcccagagtgag

SEQ ID NO: 179545 - DNA, 20 bp, Mus musculus
tgtgtagcactggctgtcct

SEQ ID NO: 179546 - DNA, 22 bp, Mus musculus
gtcactctgtgtgtgtgatttc

SEQ ID NO: 179547 - DNA, 23 bp, Mus musculus
tgtgtgtgtgggaagctctttgc

SEQ ID NO: 179548 - DNA, 20 bp, Mus musculus
taacacacagactcacttca

SEQ ID NO: 179549 - DNA, 23 bp, Mus musculus
tgtctgtgtgtatgtgtgtgcgt

SEQ ID NO: 179550 - DNA, 23 bp, Mus musculus
tctgcctccgtgtctggattgct

SEQ ID NO: 179551 - DNA, 23 bp, Mus musculus
ctctgtgcctgtctgagagtgtc

SEQ ID NO: 179552 - DNA, 18 bp, Mus musculus
catgtgcatgctgtgctc

SEQ ID NO: 179553 - DNA, 19 bp, Mus musculus
tctgcatcaaattctctct

SEQ ID NO: 179554 - DNA, 22 bp, Mus musculus
tttgaagaagagggtgtgtaga

SEQ ID NO: 179555 - DNA, 19 bp, Mus musculus
atatgtgtgtatacatatg

SEQ ID NO: 179556 - DNA, 23 bp, Mus musculus
aatgcacatgtatgtatacttga

SEQ ID NO: 179557 - DNA, 21 bp, Mus musculus
agaaaatgcttggcttttgca

SEQ ID NO: 179558 - DNA, 23 bp, Mus musculus
acaaagacttcaaggaatccagc

SEQ ID NO: 179559 - DNA, 23 bp, Mus musculus
tctcactcacgctctgtgtggtt

SEQ ID NO: 179560 - DNA, 23 bp, Mus musculus
tacagatgtgtgtgtgcagatgt

SEQ ID NO: 179561 - DNA, 20 bp, Mus musculus
atgtgtatatatatatatgt

SEQ ID NO: 179562 - DNA, 23 bp, Mus musculus
catctgtgtctgtctgtctgtct

SEQ ID NO: 179563 - DNA, 23 bp, Mus musculus
tgtgtgtgtgtgtttatctataa

SEQ ID NO: 179564 - DNA, 20 bp, Mus musculus
tatatgtatatgtatatgta

SEQ ID NO: 179565 - DNA, 21 bp, Mus musculus
atgactgtctttcataattac

SEQ ID NO: 179566 - DNA, 23 bp, Mus musculus
tatgtgtgcatggtatggatgtg

SEQ ID NO: 179567 - DNA, 23 bp, Mus musculus
tgatatgtgtgagatgtgtatgt

SEQ ID NO: 179568 - DNA, 23 bp, Mus musculus
tctggctcacagtctcagtggac

SEQ ID NO: 179569 - DNA, 21 bp, Mus musculus
agggactggagagccagcagt

SEQ ID NO: 179570 - DNA, 23 bp, Mus musculus
tatatgtgtgtatatgtatatac

SEQ ID NO: 179571 - DNA, 23 bp, Mus musculus
tgtacgtatgtatgcatgtatgt

SEQ ID NO: 179572 - DNA, 21 bp, Mus musculus
atcatctatgtatacacacac

SEQ ID NO: 179573 - DNA, 23 bp, Mus musculus
cactctctgtggctctggcagac

SEQ ID NO: 179574 - DNA, 22 bp, Mus musculus
atgtatatgtgtatgtatatgt

SEQ ID NO: 179575 - DNA, 21 bp, Mus musculus
atgtatgtatgcatatgtatg

SEQ ID NO: 179576 - DNA, 21 bp, Mus musculus
ttcctgagaggaaaaactcag

SEQ ID NO: 179577 - DNA, 22 bp, Mus musculus
tctctgagtctctctatcctgt

SEQ ID NO: 179578 - DNA, 19 bp, Mus musculus
ttctgatctccacgtgcac

SEQ ID NO: 179579 - DNA, 23 bp, Mus musculus
cagtcacacactggcacacatct

SEQ ID NO: 179580 - DNA, 22 bp, Mus musculus
agcctctctgtgcctctcactc

SEQ ID NO: 179581 - DNA, 23 bp, Mus musculus
atgtgtgtgcatgtatatgtgtg

SEQ ID NO: 179582 - DNA, 21 bp, Mus musculus
gtgtgtgtgtgtatgtgtctg

SEQ ID NO: 179583 - DNA, 23 bp, Mus musculus
gtgtgcatgtatgtatatatcta

SEQ ID NO: 179584 - DNA, 22 bp, Mus musculus
atgtatgcatatgtatgcgtat

SEQ ID NO: 179585 - DNA, 19 bp, Mus musculus
gtggcctgtgtgtttgtgc

SEQ ID NO: 179586 - DNA, 23 bp, Mus musculus
tgtgtctgtctgtctgtctttta

SEQ ID NO: 179587 - DNA, 23 bp, Mus musculus
tctgcctgtcacagtcacactgg

SEQ ID NO: 179588 - DNA, 23 bp, Mus musculus
tgacactcagtcacaattcagaa

SEQ ID NO: 179589 - DNA, 18 bp, Mus musculus
acacggaacagggctgga

SEQ ID NO: 179590 - DNA, 23 bp, Mus musculus
tatgtctgtctgtctttcagcag

SEQ ID NO: 179591 - DNA, 23 bp, Mus musculus
catatgtctgtctgtctgtcagc

SEQ ID NO: 179592 - DNA, 23 bp, Mus musculus
agaatgtgctttgactttcagag

SEQ ID NO: 179593 - DNA, 23 bp, Mus musculus
ggcagtgtctctcactgagcctg

SEQ ID NO: 179594 - DNA, 23 bp, Mus musculus
gtcattctgtcactgtgtctggc

SEQ ID NO: 179595 - DNA, 23 bp, Mus musculus
tactcagagacaaagcaggacga

SEQ ID NO: 179596 - DNA, 23 bp, Mus musculus
atgtgtgtagtgcatgtgtgtgt

SEQ ID NO: 179597 - DNA, 23 bp, Mus musculus
ctgcagaagcttgagagttcttg

SEQ ID NO: 179598 - DNA, 22 bp, Mus musculus
gctgactctctgactctgccat

SEQ ID NO: 179599 - DNA, 23 bp, Mus musculus
atgtgcactgtgtccagatgtcc

SEQ ID NO: 179600 - DNA, 23 bp, Mus musculus
atatgtgcattgtgtgcagatgt

SEQ ID NO: 179601 - DNA, 23 bp, Mus musculus
agcatgaatgtatgtatgtatgt

SEQ ID NO: 179602 - DNA, 20 bp, Mus musculus
tatgcatgcatgtatgtatg

SEQ ID NO: 179603 - DNA, 22 bp, Mus musculus
ctctctccacttgctgttgttt

SEQ ID NO: 179604 - DNA, 23 bp, Mus musculus
actctgtctgagcattgggactg

SEQ ID NO: 179605 - DNA, 23 bp, Mus musculus
acctgatgtgtgtgtgtgtgtgt

SEQ ID NO: 179606 - DNA, 23 bp, Mus musculus
tctctgtggctcccactctgtct

SEQ ID NO: 179607 - DNA, 18 bp, Mus musculus
ctctgtccctgctgctgc

SEQ ID NO: 179608 - DNA, 23 bp, Mus musculus
ctgagagtctgtaactgctgcct

SEQ ID NO: 179609 - DNA, 23 bp, Mus musculus
gctggctctcagtgtcactgtct

SEQ ID NO: 179610 - DNA, 23 bp, Mus musculus
tgtctctgagtgagtccctgtca

SEQ ID NO: 179611 - DNA, 18 bp, Mus musculus
ctgtccctctgactgccc

SEQ ID NO: 179612 - DNA, 22 bp, Mus musculus
agatttcatatgatgttgtttc

SEQ ID NO: 179613 - DNA, 23 bp, Mus musculus
tgtccctctcgctgactttctgg

SEQ ID NO: 179614 - DNA, 23 bp, Mus musculus
agtcacacactgtgtgtctggga

SEQ ID NO: 179615 - DNA, 23 bp, Mus musculus
tgactagacacaggctccagaag

SEQ ID NO: 179616 - DNA, 23 bp, Mus musculus
tgtagccagtctgtgtcagtctg

SEQ ID NO: 179617 - DNA, 23 bp, Mus musculus
gggtgactttaatttgtggtgag

SEQ ID NO: 179618 - DNA, 21 bp, Mus musculus
tctgacaccctcacacagaca

SEQ ID NO: 179619 - DNA, 23 bp, Mus musculus
actggatctctgaatcactgtgg

SEQ ID NO: 179620 - DNA, 19 bp, Mus musculus
tgtccaggtggagcaccta

SEQ ID NO: 179621 - DNA, 22 bp, Mus musculus
gatctcactgtgagactgtgcc

SEQ ID NO: 179622 - DNA, 20 bp, Mus musculus
tcacagtggagtctgtgctc

SEQ ID NO: 179623 - DNA, 23 bp, Mus musculus
gtctgcctctgcctctgcctctg

SEQ ID NO: 179624 - DNA, 23 bp, Mus musculus
cttctctgtcaatctgactgtgt

SEQ ID NO: 179625 - DNA, 23 bp, Mus musculus
gacagttgtgtgagaggaggtga

SEQ ID NO: 179626 - DNA, 23 bp, Mus musculus
aaggctgtgtgcatagctgcatg

SEQ ID NO: 179627 - DNA, 23 bp, Mus musculus
agtgtccctctgtgtctccttgg

SEQ ID NO: 179628 - DNA, 22 bp, Mus musculus
cattgctcagagacagcacggt

SEQ ID NO: 179629 - DNA, 23 bp, Mus musculus
agtgtgactctgttagtgactct

SEQ ID NO: 179630 - DNA, 23 bp, Mus musculus
tatgtgtgtgcatgtgcatgtgt

SEQ ID NO: 179631 - DNA, 22 bp, Mus musculus
tatgtgtatatgtatatgtata

SEQ ID NO: 179632 - DNA, 20 bp, Mus musculus
atggcctttcatgttctagg

SEQ ID NO: 179633 - DNA, 23 bp, Mus musculus
ggtctgtctctctgtctctccat

SEQ ID NO: 179634 - DNA, 23 bp, Mus musculus
tctgtatcactctgtcactccct

SEQ ID NO: 179635 - DNA, 23 bp, Mus musculus
taggttgaagttcttcacttgtg

SEQ ID NO: 179636 - DNA, 18 bp, Mus musculus
aggttgcaggcttccttg

SEQ ID NO: 179637 - DNA, 20 bp, Mus musculus
tgacagatgtaagagaccag

SEQ ID NO: 179638 - DNA, 23 bp, Mus musculus
ctatgttcttgttcccgtcctga

SEQ ID NO: 179639 - DNA, 22 bp, Mus musculus
tgcctgtgtgtatatgtggtgt

SEQ ID NO: 179640 - DNA, 22 bp, Mus musculus
agtgtgtctctgaagtggactg

SEQ ID NO: 179641 - DNA, 23 bp, Mus musculus
agacatgagtagactgtgagcac

SEQ ID NO: 179642 - DNA, 23 bp, Mus musculus
tcttctgagatcttcctgtgagg

SEQ ID NO: 179643 - DNA, 23 bp, Mus musculus
tttgtacatgtttacgtatgtgt

SEQ ID NO: 179644 - DNA, 23 bp, Mus musculus
agtcccagaactgatgggttctt

SEQ ID NO: 179645 - DNA, 19 bp, Mus musculus
ctctgtcactgtatcagaa

SEQ ID NO: 179646 - DNA, 23 bp, Mus musculus
tgtgtgcatttgcatgtgtgtgt

SEQ ID NO: 179647 - DNA, 20 bp, Mus musculus
tcggtgagggaatgaagggt

SEQ ID NO: 179648 - DNA, 22 bp, Mus musculus
atgagaccctctcactctctcc

SEQ ID NO: 179649 - DNA, 23 bp, Mus musculus
ttaaagagttgtgtccagattgg

SEQ ID NO: 179650 - DNA, 23 bp, Mus musculus
tgtctctggctgtaaaatgtcct

SEQ ID NO: 179651 - DNA, 23 bp, Mus musculus
tatatcatatatatggtgtgtgt

SEQ ID NO: 179652 - DNA, 21 bp, Mus musculus
atctgtgtgtgtgtgtgtgtc

SEQ ID NO: 179653 - DNA, 23 bp, Mus musculus
cagatttcagctaaggctggact

SEQ ID NO: 179654 - DNA, 20 bp, Mus musculus
tatatgcaatagtctacact

SEQ ID NO: 179655 - DNA, 23 bp, Mus musculus
acactgagtctcacagatagccg

SEQ ID NO: 179656 - DNA, 22 bp, Mus musculus
aacaggctctgccatcttcctg

SEQ ID NO: 179657 - DNA, 23 bp, Mus musculus
tgtatgtgtgcatgtgtatgtgt

SEQ ID NO: 179658 - DNA, 22 bp, Mus musculus
atgtatatatgcatatgtatgt

SEQ ID NO: 179659 - DNA, 20 bp, Mus musculus
tgtatgtatgtatatatgta

SEQ ID NO: 179660 - DNA, 23 bp, Mus musculus
agtttcttcatcaggaagtgcag

SEQ ID NO: 179661 - DNA, 23 bp, Mus musculus
cctctctgtgtcaggctctctgt

SEQ ID NO: 179662 - DNA, 22 bp, Mus musculus
atgtatatgtatatgtatatat

SEQ ID NO: 179663 - DNA, 23 bp, Mus musculus
tctctgcctgtgtcccactgtga

SEQ ID NO: 179664 - DNA, 23 bp, Mus musculus
taacaacatcttccgcatcatga

SEQ ID NO: 179665 - DNA, 23 bp, Mus musculus
tctcagcctcgctgtctgccaat

SEQ ID NO: 179666 - DNA, 21 bp, Mus musculus
tgaggtactaggttcatttgt

SEQ ID NO: 179667 - DNA, 22 bp, Mus musculus
tcactgtctaagtcaataaggc

SEQ ID NO: 179668 - DNA, 18 bp, Mus musculus
acagtggacataactagg

SEQ ID NO: 179669 - DNA, 23 bp, Mus musculus
tatgtgtgcgtcaatgttgtgtg

SEQ ID NO: 179670 - DNA, 23 bp, Mus musculus
cactgctcagtgactctctgcct

SEQ ID NO: 179671 - DNA, 23 bp, Mus musculus
tcagagatctgtctgcctctgtc

SEQ ID NO: 179672 - DNA, 21 bp, Mus musculus
ttcgcttgttgagtcatctct

SEQ ID NO: 179673 - DNA, 23 bp, Mus musculus
gatgagttgtgttagtgatgtag

SEQ ID NO: 179674 - DNA, 23 bp, Mus musculus
gtgtctgttgagagtcaggtgta

SEQ ID NO: 179675 - DNA, 21 bp, Mus musculus
atctatctatgtgtgtgtgcg

SEQ ID NO: 179676 - DNA, 21 bp, Mus musculus
aggacacagtacagagacagc

SEQ ID NO: 179677 - DNA, 22 bp, Mus musculus
tgttttgtgaccaattatatgg

SEQ ID NO: 179678 - DNA, 23 bp, Mus musculus
tgtccatctgtctctccgtcaga

SEQ ID NO: 179679 - DNA, 23 bp, Mus musculus
tgagacctgggtaatcattactt

SEQ ID NO: 179680 - DNA, 23 bp, Mus musculus
atgtttgagtgcatgtgtatgtg

SEQ ID NO: 179681 - DNA, 23 bp, Mus musculus
tggaggggagaatatttctcaca

SEQ ID NO: 179682 - DNA, 19 bp, Mus musculus
agaggaaggatttgcttgt

SEQ ID NO: 179683 - DNA, 23 bp, Mus musculus
gtatgcatgcatgtatgtatgta

SEQ ID NO: 179684 - DNA, 23 bp, Mus musculus
tcccagtctgtgtttcaactctt

SEQ ID NO: 179685 - DNA, 22 bp, Mus musculus
actaatctatagatgtaattgt

SEQ ID NO: 179686 - DNA, 23 bp, Mus musculus
tgtgtctgagcatatgcatgtgt

SEQ ID NO: 179687 - DNA, 23 bp, Mus musculus
attcactctgtctgacagtgact

SEQ ID NO: 179688 - DNA, 21 bp, Mus musculus
aagccctaaggatttgtctgt

SEQ ID NO: 179689 - DNA, 23 bp, Mus musculus
gagacactgacataggagtttgt

SEQ ID NO: 179690 - DNA, 20 bp, Mus musculus
tcagactttttgtctctcct

SEQ ID NO: 179691 - DNA, 23 bp, Mus musculus
gagagagaatgagcatgtgtgag

SEQ ID NO: 179692 - DNA, 23 bp, Mus musculus
agcatctctgtttttctgtctct

SEQ ID NO: 179693 - DNA, 23 bp, Mus musculus
gactgtgtgtgcaagtgcatgtg

SEQ ID NO: 179694 - DNA, 19 bp, Mus musculus
aactgcttagatattcatt

SEQ ID NO: 179695 - DNA, 22 bp, Mus musculus
cactcttcagtgtctgtgttct

SEQ ID NO: 179696 - DNA, 23 bp, Mus musculus
tgatgtgtctgccaatcaatagg

SEQ ID NO: 179697 - DNA, 23 bp, Mus musculus
tcacaactgagtgtgtactattt

SEQ ID NO: 179698 - DNA, 23 bp, Mus musculus
gtgtctgtctgtgcctgtgtctg

SEQ ID NO: 179699 - DNA, 22 bp, Mus musculus
tctctctctctgttatatgtat

SEQ ID NO: 179700 - DNA, 23 bp, Mus musculus
ttctgcttgcccaatctgtagga

SEQ ID NO: 179701 - DNA, 23 bp, Mus musculus
actcagactgtcaggcaagctgg

SEQ ID NO: 179702 - DNA, 23 bp, Mus musculus
agtctctctccctttcagaacta

SEQ ID NO: 179703 - DNA, 22 bp, Mus musculus
tcaagctgggatgactggagca

SEQ ID NO: 179704 - DNA, 23 bp, Mus musculus
atgtctgtctgtctctgactccc

SEQ ID NO: 179705 - DNA, 23 bp, Mus musculus
gtctctctgtgtatgtgtctctg

SEQ ID NO: 179706 - DNA, 23 bp, Mus musculus
catgacagtgagcacagatgctg

SEQ ID NO: 179707 - DNA, 23 bp, Mus musculus
tgtctgtctctgtctctctatgt

SEQ ID NO: 179708 - DNA, 23 bp, Mus musculus
ctttgtctggcagtgagtcttca

SEQ ID NO: 179709 - DNA, 23 bp, Mus musculus
ttgtatgtaaagttgttagcata

SEQ ID NO: 179710 - DNA, 22 bp, Mus musculus
tgttttgtgaccaattatatgg

SEQ ID NO: 179711 - DNA, 23 bp, Mus musculus
tgtccacatatatgctgcatatg

SEQ ID NO: 179712 - DNA, 23 bp, Mus musculus
tactgactgcatatcttagctat

SEQ ID NO: 179713 - DNA, 22 bp, Mus musculus
tgttttgtgaccaattatatgg

SEQ ID NO: 179714 - DNA, 18 bp, Mus musculus
tgaactcaggtcctcctg

SEQ ID NO: 179715 - DNA, 18 bp, Mus musculus
tttagttctttctgttca

SEQ ID NO: 179716 - DNA, 22 bp, Mus musculus
tgaaagacaccagaaggctgtg

SEQ ID NO: 179717 - DNA, 20 bp, Mus musculus
tttcagctcatcccagtcag

SEQ ID NO: 179718 - DNA, 21 bp, Mus musculus
tgactctgcctggtcatgagc

SEQ ID NO: 179719 - DNA, 23 bp, Mus musculus
tgtcactgggtgtgggtttggat

SEQ ID NO: 179720 - DNA, 20 bp, Mus musculus
tccctccctgggtgcctgtg

SEQ ID NO: 179721 - DNA, 23 bp, Mus musculus
attctgcttcctgtttcactctc

SEQ ID NO: 179722 - DNA, 23 bp, Mus musculus
tatgtatgtattattacatgtgt

SEQ ID NO: 179723 - DNA, 23 bp, Mus musculus
ttatgtatgtattgcatacgtat

SEQ ID NO: 179724 - DNA, 23 bp, Mus musculus
tcagtgtctctggctggctggct

SEQ ID NO: 179725 - DNA, 23 bp, Mus musculus
tctctcaggcttaatattctgct

SEQ ID NO: 179726 - DNA, 23 bp, Mus musculus
tcacactgggtgaagcttgagca

SEQ ID NO: 179727 - DNA, 23 bp, Mus musculus
tatgtatatgaatatgtatatgt

SEQ ID NO: 179728 - DNA, 18 bp, Mus musculus
tccacaggggctggagag

SEQ ID NO: 179729 - DNA, 21 bp, Mus musculus
tgaggagtagtttgtcagtgt

SEQ ID NO: 179730 - DNA, 21 bp, Mus musculus
tgtatgttggtgtgcctgtgt

SEQ ID NO: 179731 - DNA, 23 bp, Mus musculus
tgggttggatttgcactgtcttt

SEQ ID NO: 179732 - DNA, 20 bp, Mus musculus
ctgagcaagtttggctctga

SEQ ID NO: 179733 - DNA, 23 bp, Mus musculus
ctgtgggtgagttcacacctgtg

SEQ ID NO: 179734 - DNA, 23 bp, Mus musculus
tgagtgagttcatacctgtgggt

SEQ ID NO: 179735 - DNA, 20 bp, Mus musculus
taagacaccctgcaaaggag

SEQ ID NO: 179736 - DNA, 22 bp, Mus musculus
attctcagttaactctctctct

SEQ ID NO: 179737 - DNA, 23 bp, Mus musculus
agactggctccctctctctgagc

SEQ ID NO: 179738 - DNA, 21 bp, Mus musculus
tcactacactcacagtctgcc

SEQ ID NO: 179739 - DNA, 20 bp, Mus musculus
agcagatgtgtgacagctca

SEQ ID NO: 179740 - DNA, 23 bp, Mus musculus
gactctgaactccatttgcttga

SEQ ID NO: 179741 - DNA, 23 bp, Mus musculus
actctgcctgtgtgtgtgcctgg

SEQ ID NO: 179742 - DNA, 23 bp, Mus musculus
tatcctggaactcactttgtaga

SEQ ID NO: 179743 - DNA, 19 bp, Mus musculus
tggcactcactctatctgg

SEQ ID NO: 179744 - DNA, 23 bp, Mus musculus
atgacctgactctctttctcagt

SEQ ID NO: 179745 - DNA, 23 bp, Mus musculus
tctctcagtgacatttagctcac

SEQ ID NO: 179746 - DNA, 22 bp, Mus musculus
aatgaagagagtaagctcttca

SEQ ID NO: 179747 - DNA, 23 bp, Mus musculus
gctgttatctctgtctgtctgag

SEQ ID NO: 179748 - DNA, 23 bp, Mus musculus
ctcgtgtctgtctgtctgtctgt

SEQ ID NO: 179749 - DNA, 22 bp, Mus musculus
ctgtgggtctctgtgtctgttc

SEQ ID NO: 179750 - DNA, 23 bp, Mus musculus
gtgtctgtctgtctgtgtacatg

SEQ ID NO: 179751 - DNA, 21 bp, Mus musculus
ttcagctatatatgtgtggag

SEQ ID NO: 179752 - DNA, 19 bp, Mus musculus
gcggctctgacacagcctg

SEQ ID NO: 179753 - DNA, 21 bp, Mus musculus
tgtgcatgtatatgtgtgtgt

SEQ ID NO: 179754 - DNA, 21 bp, Mus musculus
gtttggttttgtagctggttg

SEQ ID NO: 179755 - DNA, 19 bp, Mus musculus
tctccagcccatatatgtg

SEQ ID NO: 179756 - DNA, 22 bp, Mus musculus
tcagctacataatgagactctt

SEQ ID NO: 179757 - DNA, 23 bp, Mus musculus
tttgctttaaggttgaatactgt

SEQ ID NO: 179758 - DNA, 23 bp, Mus musculus
aaactgtggataagttgctgttt

SEQ ID NO: 179759 - DNA, 22 bp, Mus musculus
tgtatgcatgcatgcatttctg

SEQ ID NO: 179760 - DNA, 21 bp, Mus musculus
tttaggagtagatcctgtact

SEQ ID NO: 179761 - DNA, 18 bp, Mus musculus
tggattctaaggaagtta

SEQ ID NO: 179762 - DNA, 23 bp, Mus musculus
gtgtgtctgtgtgtgcctgagtg

SEQ ID NO: 179763 - DNA, 23 bp, Mus musculus
tcagtctcacagcctgtgttctc

SEQ ID NO: 179764 - DNA, 20 bp, Mus musculus
tatagtgtttttgttcatga

SEQ ID NO: 179765 - DNA, 18 bp, Mus musculus
aaatccaagttgagtcag

SEQ ID NO: 179766 - DNA, 20 bp, Mus musculus
aaggccagggactggagaga

SEQ ID NO: 179767 - DNA, 22 bp, Mus musculus
gtatatatatatgtgtgtgtgt

SEQ ID NO: 179768 - DNA, 23 bp, Mus musculus
tatacacacgtatacacatatat

SEQ ID NO: 179769 - DNA, 19 bp, Mus musculus
catcactgacaaccatagt

SEQ ID NO: 179770 - DNA, 23 bp, Mus musculus
ctctctgagtctcagtttcctct

SEQ ID NO: 179771 - DNA, 23 bp, Mus musculus
tgctgactgctcttccagaggtt

SEQ ID NO: 179772 - DNA, 23 bp, Mus musculus
tgtatgcatgcatgtgtgcatgt

SEQ ID NO: 179773 - DNA, 18 bp, Mus musculus
tacctgtggtacacatgc

SEQ ID NO: 179774 - DNA, 23 bp, Mus musculus
cttttctgtgtgtgtgagtgtgc

SEQ ID NO: 179775 - DNA, 23 bp, Mus musculus
tcctgactgactctgtgactgcc

SEQ ID NO: 179776 - DNA, 23 bp, Mus musculus
cctgtgtgtgtgtctgtcgctca

SEQ ID NO: 179777 - DNA, 19 bp, Mus musculus
attccacgcagacacaggg

SEQ ID NO: 179778 - DNA, 23 bp, Mus musculus
aaaagagcactgactgctcttcc

SEQ ID NO: 179779 - DNA, 23 bp, Mus musculus
tccctgtgtctttgtgtctctga

SEQ ID NO: 179780 - DNA, 21 bp, Mus musculus
tatgaggctgggtttgctggg

SEQ ID NO: 179781 - DNA, 23 bp, Mus musculus
agatcatcttctgctacactcag

SEQ ID NO: 179782 - DNA, 23 bp, Mus musculus
ctgtcactgaatttgcaggcacc

SEQ ID NO: 179783 - DNA, 23 bp, Mus musculus
atctgtgtatatatatatgtaac

SEQ ID NO: 179784 - DNA, 21 bp, Mus musculus
tcacatgtgggatctctgacc

SEQ ID NO: 179785 - DNA, 23 bp, Mus musculus
cacagtcacatgtgggatctctg

SEQ ID NO: 179786 - DNA, 23 bp, Mus musculus
gtttatgtgtgtgcttgaattct

SEQ ID NO: 179787 - DNA, 23 bp, Mus musculus
tggctcactgtctctccttgggt

SEQ ID NO: 179788 - DNA, 22 bp, Mus musculus
tgtatatatgtgtatgtatatg

SEQ ID NO: 179789 - DNA, 22 bp, Mus musculus
tctttctactcacactctgact

SEQ ID NO: 179790 - DNA, 18 bp, Mus musculus
tcctccaactgagtaggt

SEQ ID NO: 179791 - DNA, 18 bp, Mus musculus
caaaggacagaagagtga

SEQ ID NO: 179792 - DNA, 19 bp, Mus musculus
agagtacctcattctctct

SEQ ID NO: 179793 - DNA, 23 bp, Mus musculus
gaatgtccatgtgcatgtcggag

SEQ ID NO: 179794 - DNA, 23 bp, Mus musculus
tgagtcaacacagtgggcaaaag

SEQ ID NO: 179795 - DNA, 22 bp, Mus musculus
actgacacttgagactgtcctc

SEQ ID NO: 179796 - DNA, 23 bp, Mus musculus
tcatatcatagcctgcttctgtg

SEQ ID NO: 179797 - DNA, 22 bp, Mus musculus
tgtctgcctgcctgcctgcctg

SEQ ID NO: 179798 - DNA, 21 bp, Mus musculus
tatctgctttggtcttctgag

SEQ ID NO: 179799 - DNA, 23 bp, Mus musculus
tcactcgctcgctcactcactca

SEQ ID NO: 179800 - DNA, 23 bp, Mus musculus
tccctgtctcagagtcatctgtg

SEQ ID NO: 179801 - DNA, 19 bp, Mus musculus
cagttggtcctttgctaga

SEQ ID NO: 179802 - DNA, 23 bp, Mus musculus
tgtggctcagcttctgtcctctg

SEQ ID NO: 179803 - DNA, 20 bp, Mus musculus
actcagcacagagggtccac

SEQ ID NO: 179804 - DNA, 21 bp, Mus musculus
ttctgcacgctctgcaggctc

SEQ ID NO: 179805 - DNA, 21 bp, Mus musculus
aaaagggcctgggactttggt

SEQ ID NO: 179806 - DNA, 23 bp, Mus musculus
tcgcctgttctaccagaagtgcc

SEQ ID NO: 179807 - DNA, 23 bp, Mus musculus
aagagcactgactgctcttccag

SEQ ID NO: 179808 - DNA, 23 bp, Mus musculus
gtgagtcactgtgtgggtgtgag

SEQ ID NO: 179809 - DNA, 23 bp, Mus musculus
tgcaagagcaacaagtgctctaa

SEQ ID NO: 179810 - DNA, 21 bp, Mus musculus
aacagagatgagagacggcag

SEQ ID NO: 179811 - DNA, 22 bp, Mus musculus
ttgcctgcgtgtgtgtgtcact

SEQ ID NO: 179812 - DNA, 23 bp, Mus musculus
cgtccgtctgtccgtctgtctgg

SEQ ID NO: 179813 - DNA, 23 bp, Mus musculus
atgcatgtatgtatgtatgtatg

SEQ ID NO: 179814 - DNA, 19 bp, Mus musculus
tgcatgtatgtatatatgt

SEQ ID NO: 179815 - DNA, 23 bp, Mus musculus
gtccctctgtctctgggtgttct

SEQ ID NO: 179816 - DNA, 23 bp, Mus musculus
aaggaaggaagtcactcccagag

SEQ ID NO: 179817 - DNA, 22 bp, Mus musculus
tgttttgtgaccaattatatgg

SEQ ID NO: 179818 - DNA, 21 bp, Mus musculus
agtctgtgtacggatatgttt

SEQ ID NO: 179819 - DNA, 23 bp, Mus musculus
atgtctgtatatatatatgtgtg

SEQ ID NO: 179820 - DNA, 20 bp, Mus musculus
agggagagctgtgtgagtca

SEQ ID NO: 179821 - DNA, 22 bp, Mus musculus
tgttttgtgaccaattatatgg

SEQ ID NO: 179822 - DNA, 23 bp, Mus musculus
gaggtgatgtatacatggagctg

SEQ ID NO: 179823 - DNA, 23 bp, Mus musculus
gagctgctgtgagtcacactgtg

SEQ ID NO: 179824 - DNA, 22 bp, Mus musculus
tgttttgtgaccaattatatgg

SEQ ID NO: 179825 - DNA, 23 bp, Mus musculus
ttcatcactggaaatcttctcca

SEQ ID NO: 179826 - DNA, 18 bp, Mus musculus
ttatatttcctttgtcag

SEQ ID NO: 179827 - DNA, 23 bp, Mus musculus
ggacagtgtgtggctctctgggt

SEQ ID NO: 179828 - DNA, 22 bp, Mus musculus
tgttttgtgaccaattatatgg

SEQ ID NO: 179829 - DNA, 20 bp, Mus musculus
tagagagttgactcagcagt

SEQ ID NO: 179830 - DNA, 23 bp, Mus musculus
tttgagctccttaaggtccagca

SEQ ID NO: 179831 - DNA, 23 bp, Mus musculus
aatatttttgtatctcttgagat

SEQ ID NO: 179832 - DNA, 23 bp, Mus musculus
tgctgagaagaaggtatatcctt

SEQ ID NO: 179833 - DNA, 23 bp, Mus musculus
ccaacattgtgaagcctttgcat

SEQ ID NO: 179834 - DNA, 21 bp, Mus musculus
aaagttcaccactaggttctt

SEQ ID NO: 179835 - DNA, 23 bp, Mus musculus
tgtgtgtgtgggaagctctttgc

SEQ ID NO: 179836 - DNA, 20 bp, Mus musculus
taacacacagactcacttca

SEQ ID NO: 179837 - DNA, 23 bp, Mus musculus
tgtctgtgtgtatgtgtgtgcgt

SEQ ID NO: 179838 - DNA, 23 bp, Mus musculus
actgagggcctctctcttgctct

SEQ ID NO: 179839 - DNA, 23 bp, Mus musculus
tttctctctgggtgatagatccg

SEQ ID NO: 179840 - DNA, 23 bp, Mus musculus
acaagtgagattttctttaatgc

SEQ ID NO: 179841 - DNA, 23 bp, Mus musculus
taaagttgtacatgttcacatga

SEQ ID NO: 179842 - DNA, 20 bp, Mus musculus
agcatgtgagcatatttata

SEQ ID NO: 179843 - DNA, 22 bp, Mus musculus
tgttttgtgaccaattatatgg

SEQ ID NO: 179844 - DNA, 22 bp, Mus musculus
tgttttgtgaccaattatatgg

SEQ ID NO: 179845 - DNA, 18 bp, Mus musculus
tgtgggtgtgcatgtgca

SEQ ID NO: 179846 - DNA, 23 bp, Mus musculus
tacatgtgcatgtgcatgtgttt

SEQ ID NO: 179847 - DNA, 23 bp, Mus musculus
ggacgagagagtttatggctcag

SEQ ID NO: 179848 - DNA, 23 bp, Mus musculus
ttaagagcactgactgctctttc

SEQ ID NO: 179849 - DNA, 23 bp, Mus musculus
agagtcactgactcggtaagtag

SEQ ID NO: 179850 - DNA, 23 bp, Mus musculus
acagaagagtcattgcattccct

SEQ ID NO: 179851 - DNA, 22 bp, Mus musculus
atgcagggagtcgatcctgtgt

SEQ ID NO: 179852 - DNA, 21 bp, Mus musculus
tagactgtagtcagtgagctc

SEQ ID NO: 179853 - DNA, 19 bp, Mus musculus
actgcctctcacttactct

SEQ ID NO: 179854 - DNA, 23 bp, Mus musculus
cctgtgtgtataaatgaagtttt

SEQ ID NO: 179855 - DNA, 23 bp, Mus musculus
ttgggtatggtagatgagagtgt

SEQ ID NO: 179856 - DNA, 22 bp, Mus musculus
agaggtaggaggatcataagtt

SEQ ID NO: 179857 - DNA, 23 bp, Mus musculus
agcactgcatgtatgtatgtatg

SEQ ID NO: 179858 - DNA, 20 bp, Mus musculus
tgatatatcatgtatatggt

SEQ ID NO: 179859 - DNA, 23 bp, Mus musculus
agccactggtctatgaccaggct

SEQ ID NO: 179860 - DNA, 22 bp, Mus musculus
tgttttgtgaccaattatatgg

SEQ ID NO: 179861 - DNA, 23 bp, Mus musculus
tgtctgcctctgtctcagtcagc

SEQ ID NO: 179862 - DNA, 22 bp, Mus musculus
gaggagtggtaaatagatgtcc

SEQ ID NO: 179863 - DNA, 23 bp, Mus musculus
tactacacctgtttctggaagca

SEQ ID NO: 179864 - DNA, 23 bp, Mus musculus
tgtgacagaagagagtgagagat

SEQ ID NO: 179865 - DNA, 22 bp, Mus musculus
tgttttgtgaccaattatatgg

SEQ ID NO: 179866 - DNA, 23 bp, Mus musculus
acaaggtctccctctgtgactca

SEQ ID NO: 179867 - DNA, 22 bp, Mus musculus
tatatgtacataatacctgtat

SEQ ID NO: 179868 - DNA, 23 bp, Mus musculus
accatggtagactctgtcactct

SEQ ID NO: 179869 - DNA, 22 bp, Mus musculus
taagtgtgttctgcctgggtat

SEQ ID NO: 179870 - DNA, 18 bp, Mus musculus
tccacattttcatttata

SEQ ID NO: 179871 - DNA, 22 bp, Mus musculus
actgactgctcttccagaggtc

SEQ ID NO: 179872 - DNA, 20 bp, Mus musculus
tagctgttggtatttgcctt

SEQ ID NO: 179873 - DNA, 23 bp, Mus musculus
tggcttaggtagtactttctgtc

SEQ ID NO: 179874 - DNA, 21 bp, Mus musculus
acctgctgtctctgcaaccag

SEQ ID NO: 179875 - DNA, 19 bp, Mus musculus
tggctctctgtgactctgt

SEQ ID NO: 179876 - DNA, 19 bp, Mus musculus
agtgctgttactgcagcct

SEQ ID NO: 179877 - DNA, 23 bp, Mus musculus
aatgtcccaactgtttgctaagt

SEQ ID NO: 179878 - DNA, 23 bp, Mus musculus
tctctctctctgccaatggctca

SEQ ID NO: 179879 - DNA, 20 bp, Mus musculus
tagctggctagagagaccca

SEQ ID NO: 179880 - DNA, 21 bp, Mus musculus
taaggcaaactaagcaagtgt

SEQ ID NO: 179881 - DNA, 18 bp, Mus musculus
ctacaggggcatgtggct

SEQ ID NO: 179882 - DNA, 23 bp, Mus musculus
aggtactttggaaatcatatatt

SEQ ID NO: 179883 - DNA, 23 bp, Mus musculus
aaaatctgtaagtcattatcagc

SEQ ID NO: 179884 - DNA, 20 bp, Mus musculus
tggatcttgagatgggaaga

SEQ ID NO: 179885 - DNA, 20 bp, Mus musculus
tatctatttatttatttgtc

SEQ ID NO: 179886 - DNA, 18 bp, Mus musculus
agactgaccagagacagc

SEQ ID NO: 179887 - DNA, 23 bp, Mus musculus
aatttttgattatctttacctgt

SEQ ID NO: 179888 - DNA, 23 bp, Mus musculus
actttcagcatctgcatgagcta

SEQ ID NO: 179889 - DNA, 23 bp, Mus musculus
tctgtgtatatctgtgtctgtgt

SEQ ID NO: 179890 - DNA, 23 bp, Mus musculus
tatgtatatgtatatgtatatgt

SEQ ID NO: 179891 - DNA, 22 bp, Mus musculus
atctgtctgactctgtgtttgg

SEQ ID NO: 179892 - DNA, 22 bp, Mus musculus
tgttttgtgaccaattatatgg

SEQ ID NO: 179893 - DNA, 23 bp, Mus musculus
gtagtgttttgagtttctgttgt

SEQ ID NO: 179894 - DNA, 21 bp, Mus musculus
tgtgggagttgcttcatttgt

SEQ ID NO: 179895 - DNA, 23 bp, Mus musculus
aatcactgactgctcttccagag

SEQ ID NO: 179896 - DNA, 18 bp, Mus musculus
ttctagaacaggtaccat

SEQ ID NO: 179897 - DNA, 23 bp, Mus musculus
tcactcagtatctctcttctaca

SEQ ID NO: 179898 - DNA, 22 bp, Mus musculus
ttctgaattacttgatctgtga

SEQ ID NO: 179899 - DNA, 23 bp, Mus musculus
tgtctgtctgtctgtctgtgtat

SEQ ID NO: 179900 - DNA, 23 bp, Mus musculus
tatggaaagaacacagttggaca

SEQ ID NO: 179901 - DNA, 22 bp, Mus musculus
attggatctcctgggactggag

SEQ ID NO: 179902 - DNA, 19 bp, Mus musculus
gagagcaatcatgttcttc

SEQ ID NO: 179903 - DNA, 20 bp, Mus musculus
tttcagttgagttagtgatc

SEQ ID NO: 179904 - DNA, 18 bp, Mus musculus
ttactgtggtagtgactc

SEQ ID NO: 179905 - DNA, 23 bp, Mus musculus
tgaagacagtagagactgtgggg

SEQ ID NO: 179906 - DNA, 20 bp, Mus musculus
tgaagacatttcctgggatc

SEQ ID NO: 179907 - DNA, 23 bp, Mus musculus
cctgactcagtgtctcaaatttg

SEQ ID NO: 179908 - DNA, 23 bp, Mus musculus
cacaaaagcattagagtttgtag

SEQ ID NO: 179909 - DNA, 23 bp, Mus musculus
tagagtcagtaacaatctggcag

SEQ ID NO: 179910 - DNA, 21 bp, Mus musculus
agctgtggcctaatgtagggt

SEQ ID NO: 179911 - DNA, 23 bp, Mus musculus
ccaggctcactctgtccctggct

SEQ ID NO: 179912 - DNA, 22 bp, Mus musculus
taccacagaggagatgtgggag

SEQ ID NO: 179913 - DNA, 18 bp, Mus musculus
cagaggtcctgagttcaa

SEQ ID NO: 179914 - DNA, 18 bp, Mus musculus
tatgtgcatttatgtgta

SEQ ID NO: 179915 - DNA, 19 bp, Mus musculus
tgtttgtgtgttcatgggc

SEQ ID NO: 179916 - DNA, 22 bp, Mus musculus
aaggctgatgctacaatggagt

SEQ ID NO: 179917 - DNA, 23 bp, Mus musculus
gactgcctgtctgtctgtgtgag

SEQ ID NO: 179918 - DNA, 23 bp, Mus musculus
gtctgtgtcactggctttgcagt

SEQ ID NO: 179919 - DNA, 23 bp, Mus musculus
tagtccatggtgatctgatagga

SEQ ID NO: 179920 - DNA, 20 bp, Mus musculus
tgtgtgtgtatatatgtatg

SEQ ID NO: 179921 - DNA, 22 bp, Mus musculus
tgttttgtgaccaattatatgg

SEQ ID NO: 179922 - DNA, 21 bp, Mus musculus
tgacagaaaagtcagaggtgt

SEQ ID NO: 179923 - DNA, 20 bp, Mus musculus
gagatgaaatagggctggag

SEQ ID NO: 179924 - DNA, 23 bp, Mus musculus
aggtacacacacacaggtacaca

SEQ ID NO: 179925 - DNA, 23 bp, Mus musculus
tgtgtggaagatggttgtaaagt

SEQ ID NO: 179926 - DNA, 23 bp, Mus musculus
cagaacaatagcattgtcttaca

SEQ ID NO: 179927 - DNA, 23 bp, Mus musculus
aataatctcattttgttcttgtc

SEQ ID NO: 179928 - DNA, 23 bp, Mus musculus
aactgtcccctgcttttctgtct

SEQ ID NO: 179929 - DNA, 23 bp, Mus musculus
tatgtatatgtatgtgtatgtgt

SEQ ID NO: 179930 - DNA, 23 bp, Mus musculus
atgtgtatgtatatgtatgtgta

SEQ ID NO: 179931 - DNA, 22 bp, Mus musculus
atatgtgtatgtatatatatgt

SEQ ID NO: 179932 - DNA, 23 bp, Mus musculus
caaagacaggaaatagatatgag

SEQ ID NO: 179933 - DNA, 23 bp, Mus musculus
atgtgtgtatacatgtgtgtgca

SEQ ID NO: 179934 - DNA, 21 bp, Mus musculus
atgtgcatatgtatgtgtgca

SEQ ID NO: 179935 - DNA, 22 bp, Mus musculus
actctattctctaactcatata

SEQ ID NO: 179936 - DNA, 19 bp, Mus musculus
taagctagggaaagtgtct

SEQ ID NO: 179937 - DNA, 22 bp, Mus musculus
ctcactggaaataatttgtgaa

SEQ ID NO: 179938 - DNA, 23 bp, Mus musculus
cagaaaccatgttattcaatagt

SEQ ID NO: 179939 - DNA, 18 bp, Mus musculus
agccactgattaagagtc

SEQ ID NO: 179940 - DNA, 23 bp, Mus musculus
cactccgtctctgagtctcacag

SEQ ID NO: 179941 - DNA, 23 bp, Mus musculus
taaaggtagttttctttagaaat

SEQ ID NO: 179942 - DNA, 23 bp, Mus musculus
catgacagagtgaacacagtgtg

SEQ ID NO: 179943 - DNA, 23 bp, Mus musculus
atcatcagtgatgtagcaggtat

SEQ ID NO: 179944 - DNA, 23 bp, Mus musculus
taaagtgcttataatagtgttag

SEQ ID NO: 179945 - DNA, 23 bp, Mus musculus
agtctctgactcccagtcttaga

SEQ ID NO: 179946 - DNA, 20 bp, Mus musculus
agacagtagacagtaagcat

SEQ ID NO: 179947 - DNA, 20 bp, Mus musculus
tgttttctatgttgtctctg

SEQ ID NO: 179948 - DNA, 23 bp, Mus musculus
cctgggtgagtgtctggctgtga

SEQ ID NO: 179949 - DNA, 19 bp, Mus musculus
tactcacaggaaagtgtgt

SEQ ID NO: 179950 - DNA, 22 bp, Mus musculus
gaatgtgcatatgtatgtgtgt

SEQ ID NO: 179951 - DNA, 22 bp, Mus musculus
aattgctgctttgagggctaga

SEQ ID NO: 179952 - DNA, 23 bp, Mus musculus
tctctctgtgtctgtaagttaat

SEQ ID NO: 179953 - DNA, 21 bp, Mus musculus
taactacagagatcacagaag

SEQ ID NO: 179954 - DNA, 23 bp, Mus musculus
acactgacagcgatttacctcac

SEQ ID NO: 179955 - DNA, 18 bp, Mus musculus
agaaagatcatctgcacg

SEQ ID NO: 179956 - DNA, 23 bp, Mus musculus
gtagtaggatctgaagatgtttt

SEQ ID NO: 179957 - DNA, 23 bp, Mus musculus
tatgtctatgaatgctttgcctg

SEQ ID NO: 179958 - DNA, 22 bp, Mus musculus
tgttttgtgaccaattatatgg

SEQ ID NO: 179959 - DNA, 23 bp, Mus musculus
tttagattgcttaagcttaggtg

SEQ ID NO: 179960 - DNA, 18 bp, Mus musculus
ctctctctttgtctgggc

SEQ ID NO: 179961 - DNA, 22 bp, Mus musculus
tgttttgtgaccaattatatgg

SEQ ID NO: 179962 - DNA, 23 bp, Mus musculus
tgctgtcagaactgtgagtgctg

SEQ ID NO: 179963 - DNA, 23 bp, Mus musculus
ctcagagtgacatctgactctac

SEQ ID NO: 179964 - DNA, 23 bp, Mus musculus
agggtttctcactgtttctctgg

SEQ ID NO: 179965 - DNA, 22 bp, Mus musculus
tcctaaactcatgatcttcttg

SEQ ID NO: 179966 - DNA, 20 bp, Mus musculus
ttgaagttcatataagttat

SEQ ID NO: 179967 - DNA, 23 bp, Mus musculus
aatttcttacatgtgtgaactac

SEQ ID NO: 179968 - DNA, 19 bp, Mus musculus
tacacatacatgtatatat

SEQ ID NO: 179969 - DNA, 22 bp, Mus musculus
aggtgtgtcactgtgtgtgtgg

SEQ ID NO: 179970 - DNA, 23 bp, Mus musculus
atagtagtgatgatgatgatgat

SEQ ID NO: 179971 - DNA, 20 bp, Mus musculus
attctcagtcagtggaaggg

SEQ ID NO: 179972 - DNA, 23 bp, Mus musculus
gaggttatgaaagtagtgttggg

SEQ ID NO: 179973 - DNA, 23 bp, Mus musculus
attgtctcagcaaaccttttcat

SEQ ID NO: 179974 - DNA, 23 bp, Mus musculus
tctcactctgtaaatctctctct

SEQ ID NO: 179975 - DNA, 23 bp, Mus musculus
acttagtgactgctggatttcag

SEQ ID NO: 179976 - DNA, 23 bp, Mus musculus
tgtgtgtctgtgtgtgcctccta

SEQ ID NO: 179977 - DNA, 23 bp, Mus musculus
gtggagctctttctctctgcact

SEQ ID NO: 179978 - DNA, 21 bp, Mus musculus
acgcgcacacgcacttttcac

SEQ ID NO: 179979 - DNA, 23 bp, Mus musculus
actgtatcacagactgctatgaa

SEQ ID NO: 179980 - DNA, 23 bp, Mus musculus
gcataacagaggatggcatttct

SEQ ID NO: 179981 - DNA, 21 bp, Mus musculus
atgagttatgatttacatgtt

SEQ ID NO: 179982 - DNA, 18 bp, Mus musculus
tagcaagtaagcaaatca

SEQ ID NO: 179983 - DNA, 22 bp, Mus musculus
tgtcagtctgtctgtctgccaa

SEQ ID NO: 179984 - DNA, 22 bp, Mus musculus
tgttttgtgaccaattatatgg

SEQ ID NO: 179985 - DNA, 23 bp, Mus musculus
ctcactcagagtatttgcttttg

SEQ ID NO: 179986 - DNA, 19 bp, Mus musculus
actctcacactcactacat

SEQ ID NO: 179987 - DNA, 23 bp, Mus musculus
agttccaacaggatctgcttcct

SEQ ID NO: 179988 - DNA, 19 bp, Mus musculus
tatgttaagaaatttcctg

SEQ ID NO: 179989 - DNA, 23 bp, Mus musculus
ctgtcactgtctgagtgttgtag

SEQ ID NO: 179990 - DNA, 23 bp, Mus musculus
caacttactgcatggttttgatc

SEQ ID NO: 179991 - DNA, 23 bp, Mus musculus
tgtctcagactctgacagtcatc

SEQ ID NO: 179992 - DNA, 19 bp, Mus musculus
taaaggatgttcaaactat

SEQ ID NO: 179993 - DNA, 21 bp, Mus musculus
tctcagtctgtgaaattctgg

SEQ ID NO: 179994 - DNA, 22 bp, Mus musculus
tgagacagaagactgtgaggcc

SEQ ID NO: 179995 - DNA, 23 bp, Mus musculus
tacactttaagttcctgttttca

SEQ ID NO: 179996 - DNA, 22 bp, Mus musculus
cactcttaggccatggtggtct

SEQ ID NO: 179997 - DNA, 23 bp, Mus musculus
ttttgtgaccaactatatggtca

SEQ ID NO: 179998 - DNA, 22 bp, Mus musculus
cagtcttaggccatggtggtct

SEQ ID NO: 179999 - DNA, 23 bp, Mus musculus
ttttgtgaccaactatatggtca

SEQ ID NO: 180000 - DNA, 22 bp, Mus musculus
tgttttgtgaccaattatatgg

SEQ ID NO: 180001 - DNA, 22 bp, Mus musculus
tgtgaagtgataatgttgaagt

SEQ ID NO: 180002 - DNA, 20 bp, Mus musculus
aattaaactccagtatggtt

SEQ ID NO: 180003 - DNA, 22 bp, Mus musculus
agacagtgtacacagagcagag

SEQ ID NO: 180004 - DNA, 23 bp, Mus musculus
tctgtctgtctgtctgtttatag

SEQ ID NO: 180005 - DNA, 22 bp, Mus musculus
tgttttgtgaccaattatatgg

SEQ ID NO: 180006 - DNA, 21 bp, Mus musculus
tctggcacagcctctcatgtc

SEQ ID NO: 180007 - DNA, 23 bp, Mus musculus
tcctgatctctgacaggtgggag

SEQ ID NO: 180008 - DNA, 22 bp, Mus musculus
tgaccaagagaaattctttgct

SEQ ID NO: 180009 - DNA, 22 bp, Mus musculus
cccattctaatctgagtaaagt

SEQ ID NO: 180010 - DNA, 23 bp, Mus musculus
gtgcccactgactcacagactcc

SEQ ID NO: 180011 - DNA, 23 bp, Mus musculus
atatgtgtgatatgtgtatgtgt

SEQ ID NO: 180012 - DNA, 23 bp, Mus musculus
atatgtatagatgtatgtgtgta

SEQ ID NO: 180013 - DNA, 23 bp, Mus musculus
aaagagtcagcaagaaatgacaa

SEQ ID NO: 180014 - DNA, 23 bp, Mus musculus
atgtatgtgtgtgtatgtatatg

SEQ ID NO: 180015 - DNA, 18 bp, Mus musculus
tgtgttctggcatgtctg

SEQ ID NO: 180016 - DNA, 21 bp, Mus musculus
tctctctctctcactccctga

SEQ ID NO: 180017 - DNA, 23 bp, Mus musculus
ttggtcatgttgatttagagggc

SEQ ID NO: 180018 - DNA, 20 bp, Mus musculus
tattcatcatcatcttcatc

SEQ ID NO: 180019 - DNA, 22 bp, Mus musculus
tgggagggagagttactagtta

SEQ ID NO: 180020 - DNA, 19 bp, Mus musculus
aactgactgctcttcctga

SEQ ID NO: 180021 - DNA, 23 bp, Mus musculus
tataggtgacagaagatagattg

SEQ ID NO: 180022 - DNA, 22 bp, Mus musculus
tgttttgtgaccaattatatgg

SEQ ID NO: 180023 - DNA, 23 bp, Mus musculus
ggcaacacagaggcacacattgg

SEQ ID NO: 180024 - DNA, 22 bp, Mus musculus
actctgtgagtctttcttgtga

SEQ ID NO: 180025 - DNA, 21 bp, Mus musculus
tctgaggctgactgagatgat

SEQ ID NO: 180026 - DNA, 23 bp, Mus musculus
ttgagactgggtaccttatcagg

SEQ ID NO: 180027 - DNA, 20 bp, Mus musculus
gagtggctcagtgactgaga

SEQ ID NO: 180028 - DNA, 21 bp, Mus musculus
taagagacagaagtgagggct

SEQ ID NO: 180029 - DNA, 23 bp, Mus musculus
agagatgtgattatgttatagat

SEQ ID NO: 180030 - DNA, 23 bp, Mus musculus
tggtatgtgtgcaagtgcatgtg

SEQ ID NO: 180031 - DNA, 23 bp, Mus musculus
ggttctagcacccatatgatggc

SEQ ID NO: 180032 - DNA, 22 bp, Mus musculus
ctacagagtgagtttcaggaca

SEQ ID NO: 180033 - DNA, 23 bp, Mus musculus
tctaactggatctgttttgaatt

SEQ ID NO: 180034 - DNA, 23 bp, Mus musculus
aggtgtctctctgtaagtctgag

SEQ ID NO: 180035 - DNA, 23 bp, Mus musculus
aagggaatgtttgttcacaacag

SEQ ID NO: 180036 - DNA, 23 bp, Mus musculus
cagacagtcactgtctctgctgt

SEQ ID NO: 180037 - DNA, 20 bp, Mus musculus
tattcacaatttcatttact

SEQ ID NO: 180038 - DNA, 19 bp, Mus musculus
tttggtcatgaggggggct

SEQ ID NO: 180039 - DNA, 23 bp, Mus musculus
gcagtctctcactcagtgctttt

SEQ ID NO: 180040 - DNA, 23 bp, Mus musculus
tacatggcagtgggacaatatac

SEQ ID NO: 180041 - DNA, 20 bp, Mus musculus
tgtctacatgtatgtctggg

SEQ ID NO: 180042 - DNA, 19 bp, Mus musculus
actgcatgtgtgtctggtt

SEQ ID NO: 180043 - DNA, 20 bp, Mus musculus
agccagttaagggtactctg

SEQ ID NO: 180044 - DNA, 21 bp, Mus musculus
aacagatggattttgtttctt

SEQ ID NO: 180045 - DNA, 22 bp, Mus musculus
gcagtctcaattgattctgttc

SEQ ID NO: 180046 - DNA, 22 bp, Mus musculus
actgggcctgagagtgaggatt

SEQ ID NO: 180047 - DNA, 22 bp, Mus musculus
acggtgtgtccctatctggtgt

SEQ ID NO: 180048 - DNA, 22 bp, Mus musculus
tctatgtctgtgtgaaaggtca

SEQ ID NO: 180049 - DNA, 23 bp, Mus musculus
actggagttagaggcagttatga

SEQ ID NO: 180050 - DNA, 23 bp, Mus musculus
gacagatcagagtcagaacacac

SEQ ID NO: 180051 - DNA, 23 bp, Mus musculus
ggaggatcactaggagtacaaga

SEQ ID NO: 180052 - DNA, 22 bp, Mus musculus
tgtatataacatgcattacata

SEQ ID NO: 180053 - DNA, 19 bp, Mus musculus
agagatatctcagaggtca

SEQ ID NO: 180054 - DNA, 18 bp, Mus musculus
gccttggagtcaggctgt

SEQ ID NO: 180055 - DNA, 23 bp, Mus musculus
tctgactgactttcttcagtttg

SEQ ID NO: 180056 - DNA, 20 bp, Mus musculus
acatggaagaagttagggtt

SEQ ID NO: 180057 - DNA, 22 bp, Mus musculus
tgttttgtgaccaattatatgg

SEQ ID NO: 180058 - DNA, 21 bp, Mus musculus
aggccctgtctatgtgcattg

SEQ ID NO: 180059 - DNA, 21 bp, Mus musculus
atagaatttggaaaggccagc

SEQ ID NO: 180060 - DNA, 21 bp, Mus musculus
catatgtgtttttcaagttct

SEQ ID NO: 180061 - DNA, 23 bp, Mus musculus
tcagaagaagatgtcatatctct

SEQ ID NO: 180062 - DNA, 22 bp, Mus musculus
aaggatcaacacactgggctga

SEQ ID NO: 180063 - DNA, 23 bp, Mus musculus
ttgtgtgtctctgtcactggctg

SEQ ID NO: 180064 - DNA, 20 bp, Mus musculus
tttggctgtttatgggtttg

SEQ ID NO: 180065 - DNA, 23 bp, Mus musculus
gtcacactctgcctcactgtggg

SEQ ID NO: 180066 - DNA, 23 bp, Mus musculus
atgtgtatgtatgtatatgtata

SEQ ID NO: 180067 - DNA, 23 bp, Mus musculus
gtgtgtatgtatgtatgtgtgtg

SEQ ID NO: 180068 - DNA, 23 bp, Mus musculus
ccattcctgagtcactgcctcac

SEQ ID NO: 180069 - DNA, 18 bp, Mus musculus
gtgggtagagagttcctc

SEQ ID NO: 180070 - DNA, 23 bp, Mus musculus
acaactagctagagcgagggagt

SEQ ID NO: 180071 - DNA, 19 bp, Mus musculus
cagccagcctgatttgctc

SEQ ID NO: 180072 - DNA, 23 bp, Mus musculus
tctctccctgcctgtcagcaaga

SEQ ID NO: 180073 - DNA, 21 bp, Mus musculus
tgtaggaaagttcattctggt

SEQ ID NO: 180074 - DNA, 23 bp, Mus musculus
caactctgccactcacaggctca

SEQ ID NO: 180075 - DNA, 19 bp, Mus musculus
tgagttcaattcttagcaa

SEQ ID NO: 180076 - DNA, 23 bp, Mus musculus
gtacctctgtgtgtgtgacaccc

SEQ ID NO: 180077 - DNA, 23 bp, Mus musculus
tgtgtgtgtgtatgcacgtatat

SEQ ID NO: 180078 - DNA, 18 bp, Mus musculus
atgtgtgtatacatgtaa

SEQ ID NO: 180079 - DNA, 23 bp, Mus musculus
actatacaggtacatagatgtat

SEQ ID NO: 180080 - DNA, 23 bp, Mus musculus
tgtctgtctgtctgtctgtcgct

SEQ ID NO: 180081 - DNA, 21 bp, Mus musculus
aggggctacagtttgagtaga

SEQ ID NO: 180082 - DNA, 20 bp, Mus musculus
ccactgttctgtctctctca

SEQ ID NO: 180083 - DNA, 22 bp, Mus musculus
agagtagcaggaacaagaaata

SEQ ID NO: 180084 - DNA, 19 bp, Mus musculus
tgtgcgtgcatgtgtgtgt

SEQ ID NO: 180085 - DNA, 19 bp, Mus musculus
tgtgtgtgtgcatgtgtgt

SEQ ID NO: 180086 - DNA, 23 bp, Mus musculus
agaagcagtacgtcactttgaag

SEQ ID NO: 180087 - DNA, 23 bp, Mus musculus
tctgtctgtctgtctctctgtct

SEQ ID NO: 180088 - DNA, 20 bp, Mus musculus
aagaattgtgatactgtagt

SEQ ID NO: 180089 - DNA, 21 bp, Mus musculus
aagcagcagctattccattgt

SEQ ID NO: 180090 - DNA, 23 bp, Mus musculus
tgttgagtagattgctgattgga

SEQ ID NO: 180091 - DNA, 23 bp, Mus musculus
tgctgtgtcttttagctgtcact

SEQ ID NO: 180092 - DNA, 23 bp, Mus musculus
tagtccaaacatgttgttctgtg

SEQ ID NO: 180093 - DNA, 22 bp, Mus musculus
acagagctaaagaagtgactca

SEQ ID NO: 180094 - DNA, 22 bp, Mus musculus
tacagtgtagagagatagcaga

SEQ ID NO: 180095 - DNA, 21 bp, Mus musculus
tttatctgtggcagtgttgtc

SEQ ID NO: 180096 - DNA, 22 bp, Mus musculus
tgttttgtgaccaattatatgg

SEQ ID NO: 180097 - DNA, 19 bp, Mus musculus
cttcagttgaggagttcta

SEQ ID NO: 180098 - DNA, 23 bp, Mus musculus
acagtctgcctctctgcctcagt

SEQ ID NO: 180099 - DNA, 23 bp, Mus musculus
tatagtgtatatgaacatgtgtg

SEQ ID NO: 180100 - DNA, 23 bp, Mus musculus
tctctcactgactaggctagcct

SEQ ID NO: 180101 - DNA, 23 bp, Mus musculus
tctcactgacacaatgcacagtc

SEQ ID NO: 180102 - DNA, 23 bp, Mus musculus
agaaatgtgcatttcctttcctg

SEQ ID NO: 180103 - DNA, 20 bp, Mus musculus
ttggagagacaattctgttc

SEQ ID NO: 180104 - DNA, 23 bp, Mus musculus
tttgattttctcttaggatgacc

SEQ ID NO: 180105 - DNA, 21 bp, Mus musculus
tgtgagcttccatcactctga

SEQ ID NO: 180106 - DNA, 23 bp, Mus musculus
taacaccacaagaagagccacag

SEQ ID NO: 180107 - DNA, 19 bp, Mus musculus
agtggatatgctggtgttt

SEQ ID NO: 180108 - DNA, 23 bp, Mus musculus
agtaagtatatatcaatgtgttt

SEQ ID NO: 180109 - DNA, 19 bp, Mus musculus
tctgtgatttcagtttgtg

SEQ ID NO: 180110 - DNA, 22 bp, Mus musculus
tgaaatcatatatacctttgtg

SEQ ID NO: 180111 - DNA, 23 bp, Mus musculus
tctctgtcactgtgcctctcttc

SEQ ID NO: 180112 - DNA, 23 bp, Mus musculus
tagtccatggtgatctgatagga

SEQ ID NO: 180113 - DNA, 22 bp, Mus musculus
tgttttgtgacctattatgtgg

SEQ ID NO: 180114 - DNA, 23 bp, Mus musculus
acttgttcaggtcctctttattt

SEQ ID NO: 180115 - DNA, 19 bp, Mus musculus
tgagagatgagagacagct

SEQ ID NO: 180116 - DNA, 23 bp, Mus musculus
gaaagagagtacagagctgctcg

SEQ ID NO: 180117 - DNA, 23 bp, Mus musculus
tctgtgtatatgtatgtgtctgt

SEQ ID NO: 180118 - DNA, 21 bp, Mus musculus
tccatggtggtctgataggat

SEQ ID NO: 180119 - DNA, 22 bp, Mus musculus
tgttttgtgaccaattatatgg

SEQ ID NO: 180120 - DNA, 19 bp, Mus musculus
tgtatatgtatatgtatgt

SEQ ID NO: 180121 - DNA, 22 bp, Mus musculus
tccagagtagtgagtgtgcaga

SEQ ID NO: 180122 - DNA, 22 bp, Mus musculus
atgtttatatgtatgtatgtgt

SEQ ID NO: 180123 - DNA, 21 bp, Mus musculus
tgtatatatgtatgtgtctgt

SEQ ID NO: 180124 - DNA, 20 bp, Mus musculus
tatatgcatatatgtatgtg

SEQ ID NO: 180125 - DNA, 18 bp, Mus musculus
acagcctggataccattt

SEQ ID NO: 180126 - DNA, 23 bp, Mus musculus
agtgctaggaaatgaagcactat

SEQ ID NO: 180127 - DNA, 23 bp, Mus musculus
agagcttcaccaatcctcagtca

SEQ ID NO: 180128 - DNA, 23 bp, Mus musculus
tgagtgcattgttcaatgggttt

SEQ ID NO: 180129 - DNA, 23 bp, Mus musculus
acagcattaaaatcacttggaat

SEQ ID NO: 180130 - DNA, 23 bp, Mus musculus
tcagctatatactcactctcaaa

SEQ ID NO: 180131 - DNA, 23 bp, Mus musculus
atgacagatgagagagaacatgt

SEQ ID NO: 180132 - DNA, 20 bp, Mus musculus
acagacactgggtaacatca

SEQ ID NO: 180133 - DNA, 20 bp, Mus musculus
acagacactgggtaacatca

SEQ ID NO: 180134 - DNA, 23 bp, Mus musculus
gctttaactctgacctgtgaccc

SEQ ID NO: 180135 - DNA, 18 bp, Mus musculus
tgagttcaattcccagtg

SEQ ID NO: 180136 - DNA, 21 bp, Mus musculus
acactcagttactgtgtctct

SEQ ID NO: 180137 - DNA, 23 bp, Mus musculus
gagtctgtctgactgtgtaaatt

SEQ ID NO: 180138 - DNA, 18 bp, Mus musculus
ttggtgcttctttcctga

SEQ ID NO: 180139 - DNA, 23 bp, Mus musculus
ctctccctctgtgtgtgggtgtg

SEQ ID NO: 180140 - DNA, 23 bp, Mus musculus
gtgtgcctgtgtatgcatgtgtg

SEQ ID NO: 180141 - DNA, 21 bp, Mus musculus
tgaggattacatttgaactac

SEQ ID NO: 180142 - DNA, 23 bp, Mus musculus
ctgagctgtctctgtctgagctg

SEQ ID NO: 180143 - DNA, 23 bp, Mus musculus
taagagcactgactgctcttcca

SEQ ID NO: 180144 - DNA, 23 bp, Mus musculus
tgcatgcatgtatgtatgtatgt

SEQ ID NO: 180145 - DNA, 21 bp, Mus musculus
agacagacagacagacaggca

SEQ ID NO: 180146 - DNA, 19 bp, Mus musculus
tgagctccttaaagggtga

SEQ ID NO: 180147 - DNA, 23 bp, Mus musculus
tggtagtgataagattagggact

SEQ ID NO: 180148 - DNA, 22 bp, Mus musculus
ctgcctcagaccctagcatgtg

SEQ ID NO: 180149 - DNA, 20 bp, Mus musculus
gtcacttgagagtgtgctca

SEQ ID NO: 180150 - DNA, 22 bp, Mus musculus
tacagtcttgtctccctctgcc

SEQ ID NO: 180151 - DNA, 21 bp, Mus musculus
ctggaaatgtttgaagtcaga

SEQ ID NO: 180152 - DNA, 18 bp, Mus musculus
ctctgagttagggtgttg

SEQ ID NO: 180153 - DNA, 18 bp, Mus musculus
aggaagtgtgtcactgta

SEQ ID NO: 180154 - DNA, 23 bp, Mus musculus
gtgactctctccttggactcaag

SEQ ID NO: 180155 - DNA, 23 bp, Mus musculus
gtgagggtctgtggctggctggt

SEQ ID NO: 180156 - DNA, 23 bp, Mus musculus
ggagaactctgtgagtctctgtc

SEQ ID NO: 180157 - DNA, 23 bp, Mus musculus
cagtgtctgtgtgtctgtgagcc

SEQ ID NO: 180158 - DNA, 18 bp, Mus musculus
atggccttgctgacttca

SEQ ID NO: 180159 - DNA, 23 bp, Mus musculus
tatgcatgtgtttgtggtgtctg

SEQ ID NO: 180160 - DNA, 23 bp, Mus musculus
tatttgtgaatttgtacatgtgt

SEQ ID NO: 180161 - DNA, 21 bp, Mus musculus
ctgagagaagagacagggctg

SEQ ID NO: 180162 - DNA, 20 bp, Mus musculus
tgagaacactgacagctggc

SEQ ID NO: 180163 - DNA, 19 bp, Mus musculus
tgtctctgtacaggtctca

SEQ ID NO: 180164 - DNA, 23 bp, Mus musculus
aactgtctgtttctctgtgggat

SEQ ID NO: 180165 - DNA, 23 bp, Mus musculus
ttaagattggataggacttagct

SEQ ID NO: 180166 - DNA, 18 bp, Mus musculus
agaattcttcaccagcta

SEQ ID NO: 180167 - DNA, 21 bp, Mus musculus
tctttgctctttattgcaatt

SEQ ID NO: 180168 - DNA, 21 bp, Mus musculus
atgtatgtgtgcatgtgtgtg

SEQ ID NO: 180169 - DNA, 23 bp, Mus musculus
tctctctgtgagtatgttatgtg

SEQ ID NO: 180170 - DNA, 23 bp, Mus musculus
aagttatgaattttagaaagtgt

SEQ ID NO: 180171 - DNA, 20 bp, Mus musculus
tagcctgatctgccagctgt

SEQ ID NO: 180172 - DNA, 23 bp, Mus musculus
tgacagatctctcaggagacaga

SEQ ID NO: 180173 - DNA, 19 bp, Mus musculus
tgtgctatgaatgcacata

SEQ ID NO: 180174 - DNA, 23 bp, Mus musculus
tttatgcttttctaggtgtttgt

SEQ ID NO: 180175 - DNA, 22 bp, Mus musculus
ttggagcatttaataacagtta

SEQ ID NO: 180176 - DNA, 20 bp, Mus musculus
atgacttattcattctttca

SEQ ID NO: 180177 - DNA, 18 bp, Mus musculus
tcaggggctggagagatg

SEQ ID NO: 180178 - DNA, 19 bp, Mus musculus
tgacagctgcgttgtctga

SEQ ID NO: 180179 - DNA, 23 bp, Mus musculus
acactgactgttcttgcagaaga

SEQ ID NO: 180180 - DNA, 23 bp, Mus musculus
acagtctctctgtataactgcgt

SEQ ID NO: 180181 - DNA, 19 bp, Mus musculus
gtgagtactcagtgaggac

SEQ ID NO: 180182 - DNA, 19 bp, Mus musculus
tgagtgctctgggaggagt

SEQ ID NO: 180183 - DNA, 23 bp, Mus musculus
tggcagagtgattgctctatgat

SEQ ID NO: 180184 - DNA, 22 bp, Mus musculus
cacagcagagtgagtgctctgt

SEQ ID NO: 180185 - DNA, 18 bp, Mus musculus
cagagtgagtgatgtgag

SEQ ID NO: 180186 - DNA, 23 bp, Mus musculus
tggcagagtgattgctctatgat

SEQ ID NO: 180187 - DNA, 23 bp, Mus musculus
gcagagtgagtgctctgtgagga

SEQ ID NO: 180188 - DNA, 23 bp, Mus musculus
tggcagagtgagtgctctgtgag

SEQ ID NO: 180189 - DNA, 20 bp, Mus musculus
atatgtatgtgtatacatat

SEQ ID NO: 180190 - DNA, 23 bp, Mus musculus
atatgtgtgcatatgtatatatg

SEQ ID NO: 180191 - DNA, 23 bp, Mus musculus
agtgtctttctctgtcactctct

SEQ ID NO: 180192 - DNA, 23 bp, Mus musculus
ctctaccaccatctgtctgtgga

SEQ ID NO: 180193 - DNA, 22 bp, Mus musculus
caagatctaggcaattgcaagt

SEQ ID NO: 180194 - DNA, 23 bp, Mus musculus
ttcaagtgaatttgtacatgaga

SEQ ID NO: 180195 - DNA, 23 bp, Mus musculus
tgtatgtatgtatgtatgtatgt

SEQ ID NO: 180196 - DNA, 22 bp, Mus musculus
catgcgtgtacatgcctatatg

SEQ ID NO: 180197 - DNA, 22 bp, Mus musculus
gagggtagtaggttgtaatgta

SEQ ID NO: 180198 - DNA, 19 bp, Mus musculus
aagacaggagcaagaaact

SEQ ID NO: 180199 - DNA, 21 bp, Mus musculus
atctctctatctctctatctc

SEQ ID NO: 180200 - DNA, 23 bp, Mus musculus
tgagcttctagcttgtagatttg

SEQ ID NO: 180201 - DNA, 23 bp, Mus musculus
atctctgcagattttcttcttct

SEQ ID NO: 180202 - DNA, 23 bp, Mus musculus
ctatgtctacagtatttcttgtt

SEQ ID NO: 180203 - DNA, 22 bp, Mus musculus
ataagagcacagactgctcttc

SEQ ID NO: 180204 - DNA, 23 bp, Mus musculus
atgtgtttgtgcaagtgcatgtg

SEQ ID NO: 180205 - DNA, 23 bp, Mus musculus
tgacttgtcatagcatgttcttt

SEQ ID NO: 180206 - DNA, 23 bp, Mus musculus
agaagagaaagaatatgtctgag

SEQ ID NO: 180207 - DNA, 19 bp, Mus musculus
attctgctttggttttgtc

SEQ ID NO: 180208 - DNA, 22 bp, Mus musculus
ctgactcaccactcactcagct

SEQ ID NO: 180209 - DNA, 23 bp, Mus musculus
ttatagatatgtatagatggtaa

SEQ ID NO: 180210 - DNA, 23 bp, Mus musculus
tgtgtgtctgtgtgcatgtacat

SEQ ID NO: 180211 - DNA, 23 bp, Mus musculus
agagagaaatgactgtggacatg

SEQ ID NO: 180212 - DNA, 23 bp, Mus musculus
tgcttgttctcagcttaatttct

SEQ ID NO: 180213 - DNA, 22 bp, Mus musculus
tgttttgtgaccaattatatgg

SEQ ID NO: 180214 - DNA, 22 bp, Mus musculus
tcattgcttatctatctctttc

SEQ ID NO: 180215 - DNA, 23 bp, Mus musculus
ggtctctctgtctgtctggatgc

SEQ ID NO: 180216 - DNA, 23 bp, Mus musculus
gaaatcactgactctgactgacc

SEQ ID NO: 180217 - DNA, 23 bp, Mus musculus
gtgtgtgtgagtgtgtgtgcgcg

SEQ ID NO: 180218 - DNA, 18 bp, Mus musculus
gtgtgcacatgcacacac

SEQ ID NO: 180219 - DNA, 23 bp, Mus musculus
aagtatgcatgtatataagtatg

SEQ ID NO: 180220 - DNA, 21 bp, Mus musculus
tgacagttgactgtgagacgg

SEQ ID NO: 180221 - DNA, 21 bp, Mus musculus
tatttgaacttctgctttagt

SEQ ID NO: 180222 - DNA, 23 bp, Mus musculus
gagacagaagagagaaagctgtt

SEQ ID NO: 180223 - DNA, 19 bp, Mus musculus
ttagtacagtttaggtaac

SEQ ID NO: 180224 - DNA, 21 bp, Mus musculus
tttgctctaggtcaaagctgt

SEQ ID NO: 180225 - DNA, 23 bp, Mus musculus
aacacacacacagactaacattt

SEQ ID NO: 180226 - DNA, 22 bp, Mus musculus
agtaggatatggtttgtataga

SEQ ID NO: 180227 - DNA, 23 bp, Mus musculus
aagtgaatggaattgtaatctca

SEQ ID NO: 180228 - DNA, 23 bp, Mus musculus
gtaggtgcatatgtatttgtgtg

SEQ ID NO: 180229 - DNA, 23 bp, Mus musculus
tgtatgcatgcatgaatgcgtgc

SEQ ID NO: 180230 - DNA, 23 bp, Mus musculus
tagtccatggtgatctgatagga

SEQ ID NO: 180231 - DNA, 23 bp, Mus musculus
tttgtgaccaattatattgtcaa

SEQ ID NO: 180232 - DNA, 23 bp, Mus musculus
actggctgagttctgatgatgga

SEQ ID NO: 180233 - DNA, 18 bp, Mus musculus
atgtatatatatgtgtgt

SEQ ID NO: 180234 - DNA, 23 bp, Mus musculus
ttggctctgaagttaggtcattg

SEQ ID NO: 180235 - DNA, 23 bp, Mus musculus
tgtgagtgtgtttgtatatgtgt

SEQ ID NO: 180236 - DNA, 18 bp, Mus musculus
tagatgctgagtggcaga

SEQ ID NO: 180237 - DNA, 18 bp, Mus musculus
tgccaccagccttcatgc

SEQ ID NO: 180238 - DNA, 23 bp, Mus musculus
atatgtgtatatatatatatgtg

SEQ ID NO: 180239 - DNA, 21 bp, Mus musculus
aaaggactgtgactctcagtc

SEQ ID NO: 180240 - DNA, 18 bp, Mus musculus
atgtgtgtgcatatatgt

SEQ ID NO: 180241 - DNA, 22 bp, Mus musculus
tgttttgtgaccaattatatgg

SEQ ID NO: 180242 - DNA, 18 bp, Mus musculus
ttgtatgtatgtatgtac

SEQ ID NO: 180243 - DNA, 23 bp, Mus musculus
atgtgtgtacatatctgtgtgtg

SEQ ID NO: 180244 - DNA, 23 bp, Mus musculus
actgtgacagtcacatttctaag

SEQ ID NO: 180245 - DNA, 23 bp, Mus musculus
tctgtctgtgtcacatgatggca

SEQ ID NO: 180246 - DNA, 22 bp, Mus musculus
tgttttgtgaccaattatatgg

SEQ ID NO: 180247 - DNA, 23 bp, Mus musculus
tggtatgtgtacatgtgtgtgtg

SEQ ID NO: 180248 - DNA, 22 bp, Mus musculus
aatgtagtggatctgattgctt

SEQ ID NO: 180249 - DNA, 22 bp, Mus musculus
tgttttgtgaccaattatatgg

SEQ ID NO: 180250 - DNA, 22 bp, Mus musculus
tgttttgtgaccaattatatgg

SEQ ID NO: 180251 - DNA, 23 bp, Mus musculus
gaactatgtttatcttattcctt

SEQ ID NO: 180252 - DNA, 18 bp, Mus musculus
aaggagagatttgatgga

SEQ ID NO: 180253 - DNA, 23 bp, Mus musculus
atatatgcagtgtgtgtgtatgt

SEQ ID NO: 180254 - DNA, 23 bp, Mus musculus
ggcttatgatttgactgagtatt

SEQ ID NO: 180255 - DNA, 21 bp, Mus musculus
cttgagttttcagttagcaca

SEQ ID NO: 180256 - DNA, 20 bp, Mus musculus
tcaatcgctttatcaagtgt

SEQ ID NO: 180257 - DNA, 23 bp, Mus musculus
taagactcgctctgttctgatgc

SEQ ID NO: 180258 - DNA, 21 bp, Mus musculus
tagatctccatgacgatcttg

SEQ ID NO: 180259 - DNA, 19 bp, Mus musculus
gggctaacatgatctgata

SEQ ID NO: 180260 - DNA, 19 bp, Mus musculus
acaaggtttctctgtgtag

SEQ ID NO: 180261 - DNA, 23 bp, Mus musculus
ttcaagtacaaggttgaataggt

SEQ ID NO: 180262 - DNA, 22 bp, Mus musculus
tgttttgtgaccaattatatgg

SEQ ID NO: 180263 - DNA, 19 bp, Mus musculus
tatatgtatatgtatatgt

SEQ ID NO: 180264 - DNA, 23 bp, Mus musculus
aacactcgtgaatttgttgatca

SEQ ID NO: 180265 - DNA, 19 bp, Mus musculus
attggcatttatttggttt

SEQ ID NO: 180266 - DNA, 23 bp, Mus musculus
agacagagagataaacatatgta

SEQ ID NO: 180267 - DNA, 19 bp, Mus musculus
atgtgtgtgtgtgtgtgtg

SEQ ID NO: 180268 - DNA, 22 bp, Mus musculus
cttagtccatggtgatctgata

SEQ ID NO: 180269 - DNA, 23 bp, Mus musculus
tgtcattctctctgtgtgtctag

SEQ ID NO: 180270 - DNA, 23 bp, Mus musculus
tctccatttccatcagacagaaa

SEQ ID NO: 180271 - DNA, 22 bp, Mus musculus
tgttttgtgaccaattatatgg

SEQ ID NO: 180272 - DNA, 23 bp, Mus musculus
tctgcttttgtgtgtatatgtat

SEQ ID NO: 180273 - DNA, 20 bp, Mus musculus
aggattgaagctcggaatcc

SEQ ID NO: 180274 - DNA, 23 bp, Mus musculus
gagaggctctgtcaatgcctgac

SEQ ID NO: 180275 - DNA, 23 bp, Mus musculus
tacatgtgtatgtatagacacag

SEQ ID NO: 180276 - DNA, 23 bp, Mus musculus
actcagattctcagtgaattcag

SEQ ID NO: 180277 - DNA, 21 bp, Mus musculus
tctctgccttctctccagatt

SEQ ID NO: 180278 - DNA, 23 bp, Mus musculus
tctttttcatatgtttccctcct

SEQ ID NO: 180279 - DNA, 23 bp, Mus musculus
gaatcatttagaagccctggccc

SEQ ID NO: 180280 - DNA, 20 bp, Mus musculus
cagtgactgatgacagtggc

SEQ ID NO: 180281 - DNA, 18 bp, Mus musculus
tggtttgtgaggtgactc

SEQ ID NO: 180282 - DNA, 23 bp, Mus musculus
tcagaacctggattacttttctc

SEQ ID NO: 180283 - DNA, 23 bp, Mus musculus
ctcacagatagacaacacctatg

SEQ ID NO: 180284 - DNA, 23 bp, Mus musculus
tgtctggctctgacagagcctct

SEQ ID NO: 180285 - DNA, 22 bp, Mus musculus
tcagtactcagcacaatgaatc

SEQ ID NO: 180286 - DNA, 23 bp, Mus musculus
ttgtgaactgtctcccagctgtt

SEQ ID NO: 180287 - DNA, 21 bp, Mus musculus
tgtatacatatactactgtag

SEQ ID NO: 180288 - DNA, 23 bp, Mus musculus
tatttgtatatgtgtgcatgctg

SEQ ID NO: 180289 - DNA, 22 bp, Mus musculus
tgttttgtgaccaattatatgg

SEQ ID NO: 180290 - DNA, 22 bp, Mus musculus
agtgagtgtgcctttgaggagt

SEQ ID NO: 180291 - DNA, 19 bp, Mus musculus
tccaagcccatacacattg

SEQ ID NO: 180292 - DNA, 23 bp, Mus musculus
taatagcatatatatatgtgtgt

SEQ ID NO: 180293 - DNA, 23 bp, Mus musculus
atttgactatatgtatatctgta

SEQ ID NO: 180294 - DNA, 23 bp, Mus musculus
aaaagcctctctctgtgactcac

SEQ ID NO: 180295 - DNA, 23 bp, Mus musculus
tgtctgaagacagtgacgatgtg

SEQ ID NO: 180296 - DNA, 22 bp, Mus musculus
tatgtgagtacacaattactct

SEQ ID NO: 180297 - DNA, 23 bp, Mus musculus
tggtggactcagtatgttcttag

SEQ ID NO: 180298 - DNA, 21 bp, Mus musculus
agtcaacatctggtcctcttg

SEQ ID NO: 180299 - DNA, 21 bp, Mus musculus
ggagtctgtcatcttaagtgt

SEQ ID NO: 180300 - DNA, 23 bp, Mus musculus
aaaaatgagtatggtcatctcct

SEQ ID NO: 180301 - DNA, 21 bp, Mus musculus
aactggagggtgtggatgcag

SEQ ID NO: 180302 - DNA, 23 bp, Mus musculus
ctgtgtctctgtttagtttctgt

SEQ ID NO: 180303 - DNA, 23 bp, Mus musculus
aggatctgtccattgatgagagt

SEQ ID NO: 180304 - DNA, 22 bp, Mus musculus
tgagtctgagtgcctgaggtgt

SEQ ID NO: 180305 - DNA, 18 bp, Mus musculus
cacagcctcctatacaca

SEQ ID NO: 180306 - DNA, 23 bp, Mus musculus
taacctggtcctagttctgaaac

SEQ ID NO: 180307 - DNA, 22 bp, Mus musculus
gttacagacagttgtgagctgc

SEQ ID NO: 180308 - DNA, 23 bp, Mus musculus
ctctccctcagtctctcagtgaa

SEQ ID NO: 180309 - DNA, 23 bp, Mus musculus
aagttagatattgtgcaggttca

SEQ ID NO: 180310 - DNA, 20 bp, Mus musculus
aagagcactgactgctcttc

SEQ ID NO: 180311 - DNA, 23 bp, Mus musculus
tatatgtgtgtatatgtatgtat

SEQ ID NO: 180312 - DNA, 23 bp, Mus musculus
attgttctctgcgtcctgactgt

SEQ ID NO: 180313 - DNA, 19 bp, Mus musculus
tacatatatattcatatgt

SEQ ID NO: 180314 - DNA, 21 bp, Mus musculus
acaatgatgatgatgatgatg

SEQ ID NO: 180315 - DNA, 21 bp, Mus musculus
aatgatgaagaagacaatgat

SEQ ID NO: 180316 - DNA, 22 bp, Mus musculus
taacagagtctaccaacctgga

SEQ ID NO: 180317 - DNA, 20 bp, Mus musculus
ctcttctttcctctgtgttt

SEQ ID NO: 180318 - DNA, 22 bp, Mus musculus
tagtggtagagctcttgttcag

SEQ ID NO: 180319 - DNA, 23 bp, Mus musculus
gctgagcattacagttctcactg

SEQ ID NO: 180320 - DNA, 23 bp, Mus musculus
gcaagtgtcttgctgagactgga

SEQ ID NO: 180321 - DNA, 23 bp, Mus musculus
tatcagagggtttgttaagaaac

SEQ ID NO: 180322 - DNA, 23 bp, Mus musculus
gtaatgtctgataaattaacaca

SEQ ID NO: 180323 - DNA, 23 bp, Mus musculus
agtcactgcatctgcttgtctaa

SEQ ID NO: 180324 - DNA, 23 bp, Mus musculus
tgtatacatgtatagtgcatgca

SEQ ID NO: 180325 - DNA, 23 bp, Mus musculus
gacagatagatgatagacagcag

SEQ ID NO: 180326 - DNA, 23 bp, Mus musculus
ctggctggctgtttgcctgtctg

SEQ ID NO: 180327 - DNA, 21 bp, Mus musculus
gaagacttaggaaaaacagca

SEQ ID NO: 180328 - DNA, 23 bp, Mus musculus
tggaaagcatatgtgtgtgcata

SEQ ID NO: 180329 - DNA, 23 bp, Mus musculus
atgtgtatgtgcaagtgcatgtg

SEQ ID NO: 180330 - DNA, 21 bp, Mus musculus
tgactcccagtgtctcagtct

SEQ ID NO: 180331 - DNA, 19 bp, Mus musculus
ctccccacagtctcactgt

SEQ ID NO: 180332 - DNA, 19 bp, Mus musculus
gtgtatatgtatatgtgtg

SEQ ID NO: 180333 - DNA, 23 bp, Mus musculus
tctctgtatatgtgtctgtgtgc

SEQ ID NO: 180334 - DNA, 21 bp, Mus musculus
atgtaagtttgcatgtgtatg

SEQ ID NO: 180335 - DNA, 22 bp, Mus musculus
tgttttgtgaccaattatatgg

SEQ ID NO: 180336 - DNA, 23 bp, Mus musculus
atgtatacacatgtaagtgtgca

SEQ ID NO: 180337 - DNA, 23 bp, Mus musculus
aatatgtgcagatgaatgtgcac

SEQ ID NO: 180338 - DNA, 23 bp, Mus musculus
atggtagatgatgatgatgatga

SEQ ID NO: 180339 - DNA, 22 bp, Mus musculus
tacatatctattgtgtatgtat

SEQ ID NO: 180340 - DNA, 22 bp, Mus musculus
tagagagaatatgtatatatat

SEQ ID NO: 180341 - DNA, 22 bp, Mus musculus
tgttttgtgaccaattatatgg

SEQ ID NO: 180342 - DNA, 22 bp, Mus musculus
tacatatctattgtgtatgtat

SEQ ID NO: 180343 - DNA, 22 bp, Mus musculus
tagagagaatatgtatatatat

SEQ ID NO: 180344 - DNA, 23 bp, Mus musculus
tacatatctattgtgtatgtatg

SEQ ID NO: 180345 - DNA, 22 bp, Mus musculus
tgttttgtgaccaattatatgg

SEQ ID NO: 180346 - DNA, 22 bp, Mus musculus
tgttttgtgtccaattatatgg

SEQ ID NO: 180347 - DNA, 23 bp, Mus musculus
tgtctcatatctgtttttcttga

SEQ ID NO: 180348 - DNA, 23 bp, Mus musculus
tgtatctatatgtatgtgtgtat

SEQ ID NO: 180349 - DNA, 20 bp, Mus musculus
tgcatatatgtatatatgta

SEQ ID NO: 180350 - DNA, 18 bp, Mus musculus
tgcatatatgtatatatg

SEQ ID NO: 180351 - DNA, 18 bp, Mus musculus
tgcatatatgtatatatg

SEQ ID NO: 180352 - DNA, 23 bp, Mus musculus
tacactgaatatgtattcttatt

SEQ ID NO: 180353 - DNA, 23 bp, Mus musculus
agtatacatgtacagtatgtgtg

SEQ ID NO: 180354 - DNA, 21 bp, Mus musculus
tttgtatctattgaggcctgt

SEQ ID NO: 180355 - DNA, 23 bp, Mus musculus
tttcctctttgagcacagacttt

SEQ ID NO: 180356 - DNA, 23 bp, Mus musculus
actggaattgtcaagatggttca

SEQ ID NO: 180357 - DNA, 23 bp, Mus musculus
tctgtctgtgtcactgagaagtt

SEQ ID NO: 180358 - DNA, 20 bp, Mus musculus
attttcagtgagtatatgat

SEQ ID NO: 180359 - DNA, 19 bp, Mus musculus
accttcatggtagtgaagt

SEQ ID NO: 180360 - DNA, 22 bp, Mus musculus
aggtgcttgatatagctgtctc

SEQ ID NO: 180361 - DNA, 23 bp, Mus musculus
gagaggctctctcagtgcctgtc

SEQ ID NO: 180362 - DNA, 22 bp, Mus musculus
tgttttgtgaccaattatatgg

SEQ ID NO: 180363 - DNA, 22 bp, Mus musculus
tgttttgtgaccaattatatgg

SEQ ID NO: 180364 - DNA, 22 bp, Mus musculus
tgttttgtgaccaattatatgg

SEQ ID NO: 180365 - DNA, 20 bp, Mus musculus
tggaggggtgttagttactg

SEQ ID NO: 180366 - DNA, 22 bp, Mus musculus
tgttttgtgaccaattatatgg

SEQ ID NO: 180367 - DNA, 23 bp, Mus musculus
tactattatcatgctgatagcat

SEQ ID NO: 180368 - DNA, 20 bp, Mus musculus
attctactctataacctttc

SEQ ID NO: 180369 - DNA, 23 bp, Mus musculus
agagaagaacctagattaggtat

SEQ ID NO: 180370 - DNA, 23 bp, Mus musculus
tacagtaaagacaaagttgatct

SEQ ID NO: 180371 - DNA, 23 bp, Mus musculus
attagagaggttaagttaattgt

SEQ ID NO: 180372 - DNA, 23 bp, Mus musculus
actgtggatttcttgaggatctg

SEQ ID NO: 180373 - DNA, 22 bp, Mus musculus
tacacataggtaatatatgcat

SEQ ID NO: 180374 - DNA, 22 bp, Mus musculus
tatgtggatcaacttggcatag

SEQ ID NO: 180375 - DNA, 22 bp, Mus musculus
tgaagatatatatgcatatatg

SEQ ID NO: 180376 - DNA, 23 bp, Mus musculus
atatgtatcttcatatccatatc

SEQ ID NO: 180377 - DNA, 23 bp, Mus musculus
aatgagaattttatgatgggtga

SEQ ID NO: 180378 - DNA, 18 bp, Mus musculus
tccattacaattgtgttt

SEQ ID NO: 180379 - DNA, 23 bp, Mus musculus
tgtatgcatatgtatgtgcatga

SEQ ID NO: 180380 - DNA, 22 bp, Mus musculus
tgttttgtgaccaattatatgg

SEQ ID NO: 180381 - DNA, 22 bp, Mus musculus
tagagagcagagagtggtcaga

SEQ ID NO: 180382 - DNA, 23 bp, Mus musculus
tatgtatatatatatatgtgtag

SEQ ID NO: 180383 - DNA, 23 bp, Mus musculus
aatcaacaagagagcgacttgag

SEQ ID NO: 180384 - DNA, 23 bp, Mus musculus
tgtgtctgtgtgtatgtctgtgt

SEQ ID NO: 180385 - DNA, 18 bp, Mus musculus
gtgttctaatgtaccaca

SEQ ID NO: 180386 - DNA, 22 bp, Mus musculus
tgttttgtgaccaattatatgg

SEQ ID NO: 180387 - DNA, 23 bp, Mus musculus
tgactatagtttcagttctcaac

SEQ ID NO: 180388 - DNA, 21 bp, Mus musculus
taagagaactgtctgaggtca

SEQ ID NO: 180389 - DNA, 23 bp, Mus musculus
ttgtcacttcagtctctgtgagc

SEQ ID NO: 180390 - DNA, 23 bp, Mus musculus
tttgtcaagtctttctgttgttc

SEQ ID NO: 180391 - DNA, 21 bp, Mus musculus
gtatacagttgtttgtggaga

SEQ ID NO: 180392 - DNA, 22 bp, Mus musculus
tcacatcttgtgcctctcttca

SEQ ID NO: 180393 - DNA, 21 bp, Mus musculus
agagcaatgcaaattgtgcat

SEQ ID NO: 180394 - DNA, 22 bp, Mus musculus
tgttttgtgaccaattatatgg

SEQ ID NO: 180395 - DNA, 18 bp, Mus musculus
atgatggtctgataggat

SEQ ID NO: 180396 - DNA, 22 bp, Mus musculus
tgttttgtgaccaattatatgg

SEQ ID NO: 180397 - DNA, 18 bp, Mus musculus
tgtgtgcacgtgtgcatt

SEQ ID NO: 180398 - DNA, 23 bp, Mus musculus
gtgtctctctcagtcatttctca

SEQ ID NO: 180399 - DNA, 23 bp, Mus musculus
accatgtttgtgaattagaaaac

SEQ ID NO: 180400 - DNA, 21 bp, Mus musculus
tggcatatcttctgaaaccac

SEQ ID NO: 180401 - DNA, 23 bp, Mus musculus
ctttttgcggtctgggcttgctg

SEQ ID NO: 180402 - DNA, 22 bp, Mus musculus
aagcccttaccccaaaaagcat

SEQ ID NO: 180403 - DNA, 23 bp, Mus musculus
tgtgcatatgtatgtgtatgtat

SEQ ID NO: 180404 - DNA, 23 bp, Mus musculus
atgtgtgtattaggatttctgag

SEQ ID NO: 180405 - DNA, 21 bp, Mus musculus
tattctagagcaatatcagta

SEQ ID NO: 180406 - DNA, 22 bp, Mus musculus
tgagtgcttctgtcaacttgaa

SEQ ID NO: 180407 - DNA, 23 bp, Mus musculus
cagaaaagtcactcctctgtggg

SEQ ID NO: 180408 - DNA, 23 bp, Mus musculus
tctgaggctcagagagacgcaga

SEQ ID NO: 180409 - DNA, 23 bp, Mus musculus
tctctcattgatctgccactcac

SEQ ID NO: 180410 - DNA, 20 bp, Mus musculus
tcagttcttcctgaaaggaa

SEQ ID NO: 180411 - DNA, 23 bp, Mus musculus
ttacataggatctgagaacgcct

SEQ ID NO: 180412 - DNA, 21 bp, Mus musculus
cagagctttgctgtttagtgt

SEQ ID NO: 180413 - DNA, 23 bp, Mus musculus
ctcagccagtcacactctcagcc

SEQ ID NO: 180414 - DNA, 23 bp, Mus musculus
atctgtctgtctgtctgcatttt

SEQ ID NO: 180415 - DNA, 23 bp, Mus musculus
agagtggatggagattcggaaca

SEQ ID NO: 180416 - DNA, 23 bp, Mus musculus
tccgtctgtccgtcactgagtca

SEQ ID NO: 180417 - DNA, 21 bp, Mus musculus
tacaatgtatatgtatatgat

SEQ ID NO: 180418 - DNA, 20 bp, Mus musculus
agatagtttctcacacactc

SEQ ID NO: 180419 - DNA, 18 bp, Mus musculus
tggcagagaggtgaggtg

SEQ ID NO: 180420 - DNA, 21 bp, Mus musculus
acagcagtcactcagaccctg

SEQ ID NO: 180421 - DNA, 22 bp, Mus musculus
tgacactgggttgagtgggcca

SEQ ID NO: 180422 - DNA, 23 bp, Mus musculus
agtccctccgtctctctggattt

SEQ ID NO: 180423 - DNA, 20 bp, Mus musculus
ctgctgtgtctcactctctg

SEQ ID NO: 180424 - DNA, 19 bp, Mus musculus
tatattgtatgcatatgca

SEQ ID NO: 180425 - DNA, 22 bp, Mus musculus
aatgtgtatactatgcatgtgt

SEQ ID NO: 180426 - DNA, 21 bp, Mus musculus
tgactctagagagtgtggcag

SEQ ID NO: 180427 - DNA, 23 bp, Mus musculus
ggctggctgcctggctgcctgcc

SEQ ID NO: 180428 - DNA, 23 bp, Mus musculus
tcatggctcagtctgtctccctg

SEQ ID NO: 180429 - DNA, 23 bp, Mus musculus
tatgcatatatatgtgtatgtat

SEQ ID NO: 180430 - DNA, 23 bp, Mus musculus
ccgactgtcactcactccctctg

SEQ ID NO: 180431 - DNA, 21 bp, Mus musculus
gtgcgtgcgtgcgtgcgtgcg

SEQ ID NO: 180432 - DNA, 23 bp, Mus musculus
gagtgtgcgtgtgcatgtgcatg

SEQ ID NO: 180433 - DNA, 23 bp, Mus musculus
tcagttcctctctgcctctctgg

SEQ ID NO: 180434 - DNA, 22 bp, Mus musculus
atggaggagatgtttgtgaaga

SEQ ID NO: 180435 - DNA, 21 bp, Mus musculus
aattacactcatgtgtggcgg

SEQ ID NO: 180436 - DNA, 22 bp, Mus musculus
atgtatgtgtgtatatgtgtgt

SEQ ID NO: 180437 - DNA, 22 bp, Mus musculus
ggctggctgcctgcctgcctgc

SEQ ID NO: 180438 - DNA, 23 bp, Mus musculus
tctgcctgtgactctgtcatgaa

SEQ ID NO: 180439 - DNA, 23 bp, Mus musculus
gcccctgactctgtgcctgtctg

SEQ ID NO: 180440 - DNA, 18 bp, Mus musculus
actctctggctttcatca

SEQ ID NO: 180441 - DNA, 23 bp, Mus musculus
tgaagtgggctgaattgatggct

SEQ ID NO: 180442 - DNA, 23 bp, Mus musculus
ttaggaagtctctctgtctgaaa

SEQ ID NO: 180443 - DNA, 22 bp, Mus musculus
tgtgtctgtgtatctgttgggt

SEQ ID NO: 180444 - DNA, 21 bp, Mus musculus
tgctggagctcattgtgctgt

SEQ ID NO: 180445 - DNA, 23 bp, Mus musculus
tgggttctatatgaaatcaggtt

SEQ ID NO: 180446 - DNA, 22 bp, Mus musculus
acctggtctacagagtgagttc

SEQ ID NO: 180447 - DNA, 23 bp, Mus musculus
gtgtgtgtgtccatgtgcatgtg

SEQ ID NO: 180448 - DNA, 20 bp, Mus musculus
atgcacacgcacacacgtgt

SEQ ID NO: 180449 - DNA, 23 bp, Mus musculus
gtgtacctgtgtgagtctgtgtg

SEQ ID NO: 180450 - DNA, 22 bp, Mus musculus
tgaggtagaaggatcttaagtt

SEQ ID NO: 180451 - DNA, 21 bp, Mus musculus
ttcaactcccagtgaccacat

SEQ ID NO: 180452 - DNA, 19 bp, Mus musculus
tgacatcctcagtccctct

SEQ ID NO: 180453 - DNA, 23 bp, Mus musculus
atgtgtgtgtgtatgcatgtgta

SEQ ID NO: 180454 - DNA, 19 bp, Mus musculus
tggacttataggactagag

SEQ ID NO: 180455 - DNA, 19 bp, Mus musculus
agaggttctgagttcaaat

SEQ ID NO: 180456 - DNA, 22 bp, Mus musculus
tgtctgtgtggtttgcatgtat

SEQ ID NO: 180457 - DNA, 23 bp, Mus musculus
acatgtgtacagatcctaaagat

SEQ ID NO: 180458 - DNA, 21 bp, Mus musculus
gcttagtctatgtgtgagttt

SEQ ID NO: 180459 - DNA, 19 bp, Mus musculus
aacaggattcactttcacg

SEQ ID NO: 180460 - DNA, 23 bp, Mus musculus
tgtatatgtatatgtatatgtgt

SEQ ID NO: 180461 - DNA, 23 bp, Mus musculus
tgtatgtatatgtgtatgtatgt

SEQ ID NO: 180462 - DNA, 22 bp, Mus musculus
gctaagatttaggtgtgtaact

SEQ ID NO: 180463 - DNA, 23 bp, Mus musculus
tgtcctggaacttgctctgtaga

SEQ ID NO: 180464 - DNA, 23 bp, Mus musculus
tatgggtctgtctgtctgtctgt

SEQ ID NO: 180465 - DNA, 23 bp, Mus musculus
agaacaagccagtcactctctgt

SEQ ID NO: 180466 - DNA, 19 bp, Mus musculus
tgagagagagaatgggggg

SEQ ID NO: 180467 - DNA, 23 bp, Mus musculus
tgtgtctgtctgtctgtctgtct

SEQ ID NO: 180468 - DNA, 23 bp, Mus musculus
aggctggctgtgtgtgtagcaca

SEQ ID NO: 180469 - DNA, 22 bp, Mus musculus
tatgcatctatgtatctatgta

SEQ ID NO: 180470 - DNA, 22 bp, Mus musculus
gtatgtatgtatgtatgtatgt

SEQ ID NO: 180471 - DNA, 22 bp, Mus musculus
tgttttgtgaccaattatatgg

SEQ ID NO: 180472 - DNA, 22 bp, Mus musculus
tctctatgtctgtccatttcct

SEQ ID NO: 180473 - DNA, 18 bp, Mus musculus
tgtaaacaaagagctgtg

SEQ ID NO: 180474 - DNA, 23 bp, Mus musculus
atgaagtcatctgattgtgatgt

SEQ ID NO: 180475 - DNA, 23 bp, Mus musculus
cttatcttggttttctcaaagaa

SEQ ID NO: 180476 - DNA, 22 bp, Mus musculus
tgttttgtgaccaattatatgg

SEQ ID NO: 180477 - DNA, 23 bp, Mus musculus
ttctgtgagtttatgattttatg

SEQ ID NO: 180478 - DNA, 23 bp, Mus musculus
ggtttgttttcagtgtgttctag

SEQ ID NO: 180479 - DNA, 18 bp, Mus musculus
tctggctctgagtatcag

SEQ ID NO: 180480 - DNA, 22 bp, Mus musculus
atcagtccagtggttggcttta

SEQ ID NO: 180481 - DNA, 22 bp, Mus musculus
tgttttgtgaccaattatatgg

SEQ ID NO: 180482 - DNA, 22 bp, Mus musculus
atgtatacatatatgtatgtat

SEQ ID NO: 180483 - DNA, 23 bp, Mus musculus
catatatgtatatatgtatatgt

SEQ ID NO: 180484 - DNA, 23 bp, Mus musculus
catatatgtatatatgtatatgt

SEQ ID NO: 180485 - DNA, 22 bp, Mus musculus
atgtatacatatatgtatgtat

SEQ ID NO: 180486 - DNA, 22 bp, Mus musculus
atgtatacatatatgtatgtat

SEQ ID NO: 180487 - DNA, 19 bp, Mus musculus
tgagttcttccatgtttag

SEQ ID NO: 180488 - DNA, 23 bp, Mus musculus
gcatcaaatgtatgctagttaga

SEQ ID NO: 180489 - DNA, 23 bp, Mus musculus
aatctccatttaattgaagtttc

SEQ ID NO: 180490 - DNA, 21 bp, Mus musculus
ataggtttatgtagatgtgtg

SEQ ID NO: 180491 - DNA, 23 bp, Mus musculus
aggtctgtgagctagagtactga

SEQ ID NO: 180492 - DNA, 20 bp, Mus musculus
tgttagttgcttactttgaa

SEQ ID NO: 180493 - DNA, 23 bp, Mus musculus
tctcagtgaggaaacattcaggt

SEQ ID NO: 180494 - DNA, 22 bp, Mus musculus
tgttttgtgaccaattatatgg

SEQ ID NO: 180495 - DNA, 22 bp, Mus musculus
ttataggaaggaatccatacct

SEQ ID NO: 180496 - DNA, 23 bp, Mus musculus
gtattagtgtatggtattgtatc

SEQ ID NO: 180497 - DNA, 21 bp, Mus musculus
tgttttctttcttgactgtca

SEQ ID NO: 180498 - DNA, 18 bp, Mus musculus
atatgtatgcatatatat

SEQ ID NO: 180499 - DNA, 23 bp, Mus musculus
taagtgtatgtatatgtatgtgt

SEQ ID NO: 180500 - DNA, 20 bp, Mus musculus
ctgactgatagaccagggct

SEQ ID NO: 180501 - DNA, 23 bp, Mus musculus
tttttctgtcagcttataaaggc

SEQ ID NO: 180502 - DNA, 18 bp, Mus musculus
ctactttctagcaatgta

SEQ ID NO: 180503 - DNA, 22 bp, Mus musculus
tgaatggatctcatttcctgga

SEQ ID NO: 180504 - DNA, 19 bp, Mus musculus
tatatatatatctttaggc

SEQ ID NO: 180505 - DNA, 22 bp, Mus musculus
gcacagagtcagcagacacccc

SEQ ID NO: 180506 - DNA, 20 bp, Mus musculus
tgttttacaccttggtcatc

SEQ ID NO: 180507 - DNA, 19 bp, Mus musculus
tgaggaacaaggatgtaaa

SEQ ID NO: 180508 - DNA, 21 bp, Mus musculus
tacaccttggtcatccctatg

SEQ ID NO: 180509 - DNA, 20 bp, Mus musculus
tatgtctctctgtgtgtgtg

SEQ ID NO: 180510 - DNA, 22 bp, Mus musculus
tgttttgtgaccaattatatgg

SEQ ID NO: 180511 - DNA, 23 bp, Mus musculus
tctcattgtattgagagattaat

SEQ ID NO: 180512 - DNA, 21 bp, Mus musculus
atatctcaaaaattttcagtg

SEQ ID NO: 180513 - DNA, 21 bp, Mus musculus
ttgaggaacaaggatgtaaag

SEQ ID NO: 180514 - DNA, 22 bp, Mus musculus
acaggtagatggtaggttagtt

SEQ ID NO: 180515 - DNA, 23 bp, Mus musculus
atatatatgtttatgcagtgaag

SEQ ID NO: 180516 - DNA, 23 bp, Mus musculus
gttttacaccttggtcatcccaa

SEQ ID NO: 180517 - DNA, 21 bp, Mus musculus
tctgatcctgaagctttgata

SEQ ID NO: 180518 - DNA, 23 bp, Mus musculus
agtactgagagtggagatagagg

SEQ ID NO: 180519 - DNA, 20 bp, Mus musculus
caatgagggttacttggggg

SEQ ID NO: 180520 - DNA, 23 bp, Mus musculus
ccatgtgtgcatgcatctgtgtg

SEQ ID NO: 180521 - DNA, 20 bp, Mus musculus
tttgtgcatgcatatgttta

SEQ ID NO: 180522 - DNA, 22 bp, Mus musculus
acaggactcaaactctcacctt

SEQ ID NO: 180523 - DNA, 23 bp, Mus musculus
agacccagtctatctctctctgc

SEQ ID NO: 180524 - DNA, 22 bp, Mus musculus
cagtgcaatgttaaaagggcat

SEQ ID NO: 180525 - DNA, 21 bp, Mus musculus
tacattttatgtatatgtgtg

SEQ ID NO: 180526 - DNA, 23 bp, Mus musculus
gcctgcctgcctgcctgcctgcc

SEQ ID NO: 180527 - DNA, 23 bp, Mus musculus
tgtatgtatgtatgtatgcatgt

SEQ ID NO: 180528 - DNA, 23 bp, Mus musculus
gtgtgcctgtgtgtgtctgtgca

SEQ ID NO: 180529 - DNA, 20 bp, Mus musculus
atttctatttatgtatacag

SEQ ID NO: 180530 - DNA, 21 bp, Mus musculus
cactcacatactctcactgtg

SEQ ID NO: 180531 - DNA, 23 bp, Mus musculus
ctgagtctcagcagttgccactg

SEQ ID NO: 180532 - DNA, 18 bp, Mus musculus
cagaggtcctgagttcaa

SEQ ID NO: 180533 - DNA, 21 bp, Mus musculus
agacttctagaggagttgata

SEQ ID NO: 180534 - DNA, 22 bp, Mus musculus
tgttttgtgaccaattatatgg

SEQ ID NO: 180535 - DNA, 23 bp, Mus musculus
tgggtctgagaggtatctgagct

SEQ ID NO: 180536 - DNA, 22 bp, Mus musculus
tgttttgtgaccaattatatgg

SEQ ID NO: 180537 - DNA, 22 bp, Mus musculus
tgttttgtgaccaattatatgg

SEQ ID NO: 180538 - DNA, 19 bp, Mus musculus
tatgtatgtatattttagt

SEQ ID NO: 180539 - DNA, 22 bp, Mus musculus
tgttttgtgaccaattatatgg

SEQ ID NO: 180540 - DNA, 22 bp, Mus musculus
tgttttgtgaccaattatatgg

SEQ ID NO: 180541 - DNA, 23 bp, Mus musculus
ccatagaagcagcactgtatctg

SEQ ID NO: 180542 - DNA, 22 bp, Mus musculus
tgttttgtgaccaattatatgg

SEQ ID NO: 180543 - DNA, 22 bp, Mus musculus
tttgtggctcttctgtctctgt

SEQ ID NO: 180544 - DNA, 21 bp, Mus musculus
atctatctaattgtatatatg

SEQ ID NO: 180545 - DNA, 19 bp, Mus musculus
tacacacatatatagatat

SEQ ID NO: 180546 - DNA, 20 bp, Mus musculus
atacacacacacataatgtg

SEQ ID NO: 180547 - DNA, 23 bp, Mus musculus
acattgatgttgtaggggtgcag

SEQ ID NO: 180548 - DNA, 20 bp, Mus musculus
atggtcattgtagcagctca

SEQ ID NO: 180549 - DNA, 23 bp, Mus musculus
aactgtagtgttattgctgttct

SEQ ID NO: 180550 - DNA, 23 bp, Mus musculus
ataatgtagtaactcagtattcc

SEQ ID NO: 180551 - DNA, 21 bp, Mus musculus
ttagccacagcatcttaggtc

SEQ ID NO: 180552 - DNA, 22 bp, Mus musculus
tgttttgtgaccaattatatgg

SEQ ID NO: 180553 - DNA, 23 bp, Mus musculus
tgagagatgtgtgtgtacacacc

SEQ ID NO: 180554 - DNA, 21 bp, Mus musculus
tacatgaacatgtatatatga

SEQ ID NO: 180555 - DNA, 23 bp, Mus musculus
tgtgtgtatatatgcatgtgtgt

SEQ ID NO: 180556 - DNA, 22 bp, Mus musculus
tgttttgtgaccaattatatgg

SEQ ID NO: 180557 - DNA, 23 bp, Mus musculus
tgtttgtatttgtacatgtatga

SEQ ID NO: 180558 - DNA, 23 bp, Mus musculus
tatactctctggtagagttctgg

SEQ ID NO: 180559 - DNA, 18 bp, Mus musculus
tcagttttagtcttattc

SEQ ID NO: 180560 - DNA, 23 bp, Mus musculus
catgaatgtgtacaggcatgtga

SEQ ID NO: 180561 - DNA, 21 bp, Mus musculus
aaaatctgttaggcttagtac

SEQ ID NO: 180562 - DNA, 23 bp, Mus musculus
tctgaaagcagtttcaggagcca

SEQ ID NO: 180563 - DNA, 20 bp, Mus musculus
tgttttgtgacctattatgt

SEQ ID NO: 180564 - DNA, 23 bp, Mus musculus
tgagtgtctgactgtttatcatg

SEQ ID NO: 180565 - DNA, 18 bp, Mus musculus
ttggaggacagatatttt

SEQ ID NO: 180566 - DNA, 19 bp, Mus musculus
caaagttatgtattaaagg

SEQ ID NO: 180567 - DNA, 23 bp, Mus musculus
tttgaatgtggttaactattcct

SEQ ID NO: 180568 - DNA, 22 bp, Mus musculus
tgttttgtgaccaattatatgg

SEQ ID NO: 180569 - DNA, 21 bp, Mus musculus
tgaatgactctcatctattga

SEQ ID NO: 180570 - DNA, 22 bp, Mus musculus
tgttttgtgaccaattatatgg

SEQ ID NO: 180571 - DNA, 19 bp, Mus musculus
agtggtataatattttgca

SEQ ID NO: 180572 - DNA, 22 bp, Mus musculus
tgttttgtgaccaattatatgg

SEQ ID NO: 180573 - DNA, 23 bp, Mus musculus
tctctgtgtatatgaatatgtgt

SEQ ID NO: 180574 - DNA, 23 bp, Mus musculus
caagtcagtctgtcagtctgcct

SEQ ID NO: 180575 - DNA, 23 bp, Mus musculus
ttgtttatgttgatgtaggtgca

SEQ ID NO: 180576 - DNA, 23 bp, Mus musculus
atctgtgtatttgtatatgtgtt

SEQ ID NO: 180577 - DNA, 23 bp, Mus musculus
tgtatgtgtgtatatgtatatac

SEQ ID NO: 180578 - DNA, 22 bp, Mus musculus
atatacacacacatacaaatac

SEQ ID NO: 180579 - DNA, 23 bp, Mus musculus
cccgcctctgtctctctgtcatt

SEQ ID NO: 180580 - DNA, 18 bp, Mus musculus
tgtggtcctatctgtgtc

SEQ ID NO: 180581 - DNA, 22 bp, Mus musculus
tctcacccactcactggccttt

SEQ ID NO: 180582 - DNA, 23 bp, Mus musculus
agttctatctctgtctccttctc

SEQ ID NO: 180583 - DNA, 23 bp, Mus musculus
tatatggttgtacatgtatatac

SEQ ID NO: 180584 - DNA, 18 bp, Mus musculus
atgtatgtgtgtatgtat

SEQ ID NO: 180585 - DNA, 21 bp, Mus musculus
tatgtatgtatgtatatgtgt

SEQ ID NO: 180586 - DNA, 23 bp, Mus musculus
atatgtatgtatgtatatgtgtg

SEQ ID NO: 180587 - DNA, 23 bp, Mus musculus
tacatacacacacacgtatatat

SEQ ID NO: 180588 - DNA, 23 bp, Mus musculus
tatgtatatgtatatgtatatgt

SEQ ID NO: 180589 - DNA, 23 bp, Mus musculus
tagctaaagaatatgaatacggg

SEQ ID NO: 180590 - DNA, 23 bp, Mus musculus
aagagcactgactgctcttccag

SEQ ID NO: 180591 - DNA, 22 bp, Mus musculus
tgtgtcacacaactggcacgcc

SEQ ID NO: 180592 - DNA, 23 bp, Mus musculus
attgtgtatatgcatgtgtgttg

SEQ ID NO: 180593 - DNA, 23 bp, Mus musculus
ctgagtctgtgtgcctgtcttgt

SEQ ID NO: 180594 - DNA, 23 bp, Mus musculus
tgacttggatttgctgtctctct

SEQ ID NO: 180595 - DNA, 18 bp, Mus musculus
ctagtgattttcttcttc

SEQ ID NO: 180596 - DNA, 22 bp, Mus musculus
tgactgagaagggagatcaaca

SEQ ID NO: 180597 - DNA, 21 bp, Mus musculus
ctgactctcagtctaaggtct

SEQ ID NO: 180598 - DNA, 23 bp, Mus musculus
tactacagagagtggagagtgag

SEQ ID NO: 180599 - DNA, 22 bp, Mus musculus
tcacatacacacactcattgaa

SEQ ID NO: 180600 - DNA, 22 bp, Mus musculus
tgagactgtaaagccagacact

SEQ ID NO: 180601 - DNA, 21 bp, Mus musculus
actgttgtgattatgttgttg

SEQ ID NO: 180602 - DNA, 22 bp, Mus musculus
aaaaatgtcaccagctcattgc

SEQ ID NO: 180603 - DNA, 23 bp, Mus musculus
atgtcagctgccatctctcaagt

SEQ ID NO: 180604 - DNA, 22 bp, Mus musculus
atatagactattgactcactgt

SEQ ID NO: 180605 - DNA, 21 bp, Mus musculus
tgtcttctgactctgtcttct

SEQ ID NO: 180606 - DNA, 18 bp, Mus musculus
acatatgtatatgtgtat

SEQ ID NO: 180607 - DNA, 23 bp, Mus musculus
cccagtctctctctctccctctg

SEQ ID NO: 180608 - DNA, 20 bp, Mus musculus
tatatgcatatatatatccg

SEQ ID NO: 180609 - DNA, 23 bp, Mus musculus
gtatgtatgtatgtatgtatgta

SEQ ID NO: 180610 - DNA, 18 bp, Mus musculus
ctcagactctgaacccag

SEQ ID NO: 180611 - DNA, 23 bp, Mus musculus
ggacacactgtgcctgactctgg

SEQ ID NO: 180612 - DNA, 23 bp, Mus musculus
gacagtctgcttctgcttctgga

SEQ ID NO: 180613 - DNA, 22 bp, Mus musculus
tggtagactcagaagtacctgt

SEQ ID NO: 180614 - DNA, 23 bp, Mus musculus
tctctctccctgactgtgcagtt

SEQ ID NO: 180615 - DNA, 23 bp, Mus musculus
aattgttctggtttagtttggct

SEQ ID NO: 180616 - DNA, 23 bp, Mus musculus
ctagagtctctgtaacaaaagtg

SEQ ID NO: 180617 - DNA, 23 bp, Mus musculus
gaaacaggatctcactatgtaca

SEQ ID NO: 180618 - DNA, 20 bp, Mus musculus
tttctctgtggagccttgga

SEQ ID NO: 180619 - DNA, 18 bp, Mus musculus
tgctggacatgattctat

SEQ ID NO: 180620 - DNA, 20 bp, Mus musculus
atatgtgtatatatatatgt

SEQ ID NO: 180621 - DNA, 19 bp, Mus musculus
atgtgtgtgtgtgtacata

SEQ ID NO: 180622 - DNA, 23 bp, Mus musculus
tctcagtctgtcacagtgagctt

SEQ ID NO: 180623 - DNA, 21 bp, Mus musculus
ttctgacaagattgagagctc

SEQ ID NO: 180624 - DNA, 23 bp, Mus musculus
ctgtgagagaagagaaagagctg

SEQ ID NO: 180625 - DNA, 22 bp, Mus musculus
atgtttagagactgattcagct

SEQ ID NO: 180626 - DNA, 18 bp, Mus musculus
cagaggtactgagttcta

SEQ ID NO: 180627 - DNA, 23 bp, Mus musculus
aaactgtatcaggtagagttgac

SEQ ID NO: 180628 - DNA, 23 bp, Mus musculus
tgcgcctctctctggcactctgc

SEQ ID NO: 180629 - DNA, 20 bp, Mus musculus
tgtatgtatgcatctctatg

SEQ ID NO: 180630 - DNA, 23 bp, Mus musculus
aatcacaccctggtatgttttca

SEQ ID NO: 180631 - DNA, 21 bp, Mus musculus
atttcattttttttttcagag

SEQ ID NO: 180632 - DNA, 21 bp, Mus musculus
tcttaacctcctggtgcctca

SEQ ID NO: 180633 - DNA, 20 bp, Mus musculus
tctcagtgtgtgtttgtcgt

SEQ ID NO: 180634 - DNA, 20 bp, Mus musculus
atgtttccagagagaattca

SEQ ID NO: 180635 - DNA, 23 bp, Mus musculus
gaaggtgctagagagatggctca

SEQ ID NO: 180636 - DNA, 22 bp, Mus musculus
tatgtgtgtgtatatgtatata

SEQ ID NO: 180637 - DNA, 21 bp, Mus musculus
ctgtgtgtgcatgtgcatttg

SEQ ID NO: 180638 - DNA, 20 bp, Mus musculus
aaagatttgtacattttggt

SEQ ID NO: 180639 - DNA, 23 bp, Mus musculus
tcactgtctgacacaagtgtctt

SEQ ID NO: 180640 - DNA, 20 bp, Mus musculus
tttctctttcactctctgcc

SEQ ID NO: 180641 - DNA, 22 bp, Mus musculus
tgtgagtatgtgtatatgttac

SEQ ID NO: 180642 - DNA, 21 bp, Mus musculus
tatgtaagtgtgcaattgcat

SEQ ID NO: 180643 - DNA, 23 bp, Mus musculus
ttgagagtagagagtgtgtttgt

SEQ ID NO: 180644 - DNA, 23 bp, Mus musculus
tcactgcagtcagtgcagtcagt

SEQ ID NO: 180645 - DNA, 23 bp, Mus musculus
tcagtgcagtcagtgcagtcagt

SEQ ID NO: 180646 - DNA, 23 bp, Mus musculus
tcactgcagttagtgcagtcagt

SEQ ID NO: 180647 - DNA, 23 bp, Mus musculus
tcactgcagttagtgcagtcagt

SEQ ID NO: 180648 - DNA, 21 bp, Mus musculus
tcactgcagtcagtgtggtca

SEQ ID NO: 180649 - DNA, 21 bp, Mus musculus
tcactgcagtcagtgtggtca

SEQ ID NO: 180650 - DNA, 23 bp, Mus musculus
tcactgcagtcagtgcagtcagt

SEQ ID NO: 180651 - DNA, 23 bp, Mus musculus
actgcagtcagtgcagtcagtgt

SEQ ID NO: 180652 - DNA, 23 bp, Mus musculus
tcactgcagtcagtgcagtcagt

SEQ ID NO: 180653 - DNA, 19 bp, Mus musculus
tcactgcagtcagtgtggt

SEQ ID NO: 180654 - DNA, 23 bp, Mus musculus
tcactgcagtcagtgcagtcagt

SEQ ID NO: 180655 - DNA, 18 bp, Mus musculus
ctcatcatgtagatcagc

SEQ ID NO: 180656 - DNA, 23 bp, Mus musculus
cagtgtatagagtgtgtgcaata

SEQ ID NO: 180657 - DNA, 20 bp, Mus musculus
tgagcagtgaatacagtgtg

SEQ ID NO: 180658 - DNA, 23 bp, Mus musculus
cacccagtgtctctgagtggcct

SEQ ID NO: 180659 - DNA, 20 bp, Mus musculus
atgtgagtgtgtgtataaac

SEQ ID NO: 180660 - DNA, 20 bp, Mus musculus
atgcttgtgaaattattgag

SEQ ID NO: 180661 - DNA, 23 bp, Mus musculus
tctctgtgtgtgtctacatgtgt

SEQ ID NO: 180662 - DNA, 23 bp, Mus musculus
tccagagagatgagagtctggaa

SEQ ID NO: 180663 - DNA, 23 bp, Mus musculus
gtctgtctgtctgtttatctatt

SEQ ID NO: 180664 - DNA, 18 bp, Mus musculus
tatgtatgtatgcgtgta

SEQ ID NO: 180665 - DNA, 23 bp, Mus musculus
tatgtatgtatgcatatatgtgt

SEQ ID NO: 180666 - DNA, 22 bp, Mus musculus
tgtatgcatgtatgtatgtatg

SEQ ID NO: 180667 - DNA, 20 bp, Mus musculus
actctctcacactgacttct

SEQ ID NO: 180668 - DNA, 18 bp, Mus musculus
tcagcttctgggttggag

SEQ ID NO: 180669 - DNA, 19 bp, Mus musculus
gtcaaggtctggctggaga

SEQ ID NO: 180670 - DNA, 23 bp, Mus musculus
tgttagtctctgtctttttgttg

SEQ ID NO: 180671 - DNA, 23 bp, Mus musculus
acactcagagcagagagtgagct

SEQ ID NO: 180672 - DNA, 23 bp, Mus musculus
tgtgtctgtgtctctctgtgtga

SEQ ID NO: 180673 - DNA, 20 bp, Mus musculus
cagacacacacagagacaca

SEQ ID NO: 180674 - DNA, 21 bp, Mus musculus
gtatgtatgcatgtatgtatg

SEQ ID NO: 180675 - DNA, 23 bp, Mus musculus
atatgtgtatgtatgtatatatg

SEQ ID NO: 180676 - DNA, 23 bp, Mus musculus
tctattttggatcgattacaaat

SEQ ID NO: 180677 - DNA, 23 bp, Mus musculus
gctgtctgtctgtctgtctgtct

SEQ ID NO: 180678 - DNA, 22 bp, Mus musculus
tgttttgtgaccaattatatgg

SEQ ID NO: 180679 - DNA, 23 bp, Mus musculus
tcacactgagtctcattttagag

SEQ ID NO: 180680 - DNA, 21 bp, Mus musculus
tcagtgggagaagaagtgcct

SEQ ID NO: 180681 - DNA, 23 bp, Mus musculus
tttgggactggatgaaatgactg

SEQ ID NO: 180682 - DNA, 23 bp, Mus musculus
tatgtaaggatctctgtgtctct

SEQ ID NO: 180683 - DNA, 23 bp, Mus musculus
ttattatagatgaaagttgttgt

SEQ ID NO: 180684 - DNA, 23 bp, Mus musculus
gcattctttactagtgtcatatg

SEQ ID NO: 180685 - DNA, 23 bp, Mus musculus
taacaagaaatgcctctcttaat

SEQ ID NO: 180686 - DNA, 23 bp, Mus musculus
tacacacacatatatatatgtat

SEQ ID NO: 180687 - DNA, 23 bp, Mus musculus
tagtgtgcacatctgtgtgtgtg

SEQ ID NO: 180688 - DNA, 18 bp, Mus musculus
tgctattaaaatttgtca

SEQ ID NO: 180689 - DNA, 22 bp, Mus musculus
ttataggcactgaatgataaca

SEQ ID NO: 180690 - DNA, 23 bp, Mus musculus
tatctgtctgagtcatttgctgg

SEQ ID NO: 180691 - DNA, 20 bp, Mus musculus
aggacaacatgctcctgtct

SEQ ID NO: 180692 - DNA, 23 bp, Mus musculus
actgtgtctctgtttagtttctg

SEQ ID NO: 180693 - DNA, 22 bp, Mus musculus
atctgtccattgatgagagtgg

SEQ ID NO: 180694 - DNA, 22 bp, Mus musculus
tgttttgtgaccaattatatgg

SEQ ID NO: 180695 - DNA, 23 bp, Mus musculus
gaaagaacagagccaggagacca

SEQ ID NO: 180696 - DNA, 23 bp, Mus musculus
ttacactctgtggtaaggaacaa

SEQ ID NO: 180697 - DNA, 21 bp, Mus musculus
tattacagtattgtaggtagc

SEQ ID NO: 180698 - DNA, 23 bp, Mus musculus
aacagaagtctgaaagcactaga

SEQ ID NO: 180699 - DNA, 23 bp, Mus musculus
ttttacctgtgtcagagtcactg

SEQ ID NO: 180700 - DNA, 23 bp, Mus musculus
tgcatgtgtaaatgtatgtgtgt

SEQ ID NO: 180701 - DNA, 22 bp, Mus musculus
tatatttatatgtgcatatgtt

SEQ ID NO: 180702 - DNA, 23 bp, Mus musculus
tatatgtatatgtatgtgtgtgc

SEQ ID NO: 180703 - DNA, 22 bp, Mus musculus
aagattgatatgcatatatgta

SEQ ID NO: 180704 - DNA, 22 bp, Mus musculus
tgtgaagagtcagaatgagcat

SEQ ID NO: 180705 - DNA, 23 bp, Mus musculus
atctaatgtgttgtgtgttggaa

SEQ ID NO: 180706 - DNA, 23 bp, Mus musculus
accagccttctgtgcctggtgtg

SEQ ID NO: 180707 - DNA, 23 bp, Mus musculus
tagtgcatggtgatctgatagga

SEQ ID NO: 180708 - DNA, 21 bp, Mus musculus
tgttttgttacctattatgtg

SEQ ID NO: 180709 - DNA, 23 bp, Mus musculus
catagtcagtaaacagatgacag

SEQ ID NO: 180710 - DNA, 23 bp, Mus musculus
aaacaggttcttgtttgtgaaaa

SEQ ID NO: 180711 - DNA, 22 bp, Mus musculus
ttcagggcagacagtatctgtt

SEQ ID NO: 180712 - DNA, 20 bp, Mus musculus
ttatagtgtgtgtgtgtgta

SEQ ID NO: 180713 - DNA, 20 bp, Mus musculus
tcttgacaaattctagtaca

SEQ ID NO: 180714 - DNA, 22 bp, Mus musculus
gggagagacagagtgggtgtgg

SEQ ID NO: 180715 - DNA, 23 bp, Mus musculus
tcttttgagagttggagatatcc

SEQ ID NO: 180716 - DNA, 21 bp, Mus musculus
tccatggtggtctgataggat

SEQ ID NO: 180717 - DNA, 22 bp, Mus musculus
tgttttgtgaccaattatatgg

SEQ ID NO: 180718 - DNA, 23 bp, Mus musculus
catgtgtgtgtgtgtgtgtgcat

SEQ ID NO: 180719 - DNA, 23 bp, Mus musculus
tgtgtgtctgtctgtcattcatc

SEQ ID NO: 180720 - DNA, 23 bp, Mus musculus
tgtgcaattctgatggtactcat

SEQ ID NO: 180721 - DNA, 23 bp, Mus musculus
tcctacacactgtctcatagagc

SEQ ID NO: 180722 - DNA, 23 bp, Mus musculus
gctttaagatgagtagttagggc

SEQ ID NO: 180723 - DNA, 21 bp, Mus musculus
taagagcactgactgctcttc

SEQ ID NO: 180724 - DNA, 23 bp, Mus musculus
gtgtgtgtgtgagagagagaggg

SEQ ID NO: 180725 - DNA, 23 bp, Mus musculus
aactcctaatagtggaagctgat

SEQ ID NO: 180726 - DNA, 20 bp, Mus musculus
tttttcctactggattgcct

SEQ ID NO: 180727 - DNA, 21 bp, Mus musculus
aatatactgaagaccctgtct

SEQ ID NO: 180728 - DNA, 21 bp, Mus musculus
atggctctgggtgctttgagg

SEQ ID NO: 180729 - DNA, 22 bp, Mus musculus
tcagactcaagtgtgagagctg

SEQ ID NO: 180730 - DNA, 20 bp, Mus musculus
tctgcaccacctagtgacac

SEQ ID NO: 180731 - DNA, 19 bp, Mus musculus
caaagcccttccccagtgc

SEQ ID NO: 180732 - DNA, 18 bp, Mus musculus
tctgaagagagtcaggag

SEQ ID NO: 180733 - DNA, 23 bp, Mus musculus
atactctctctctgtatctccat

SEQ ID NO: 180734 - DNA, 23 bp, Mus musculus
tatctatgtatatgttttgctag

SEQ ID NO: 180735 - DNA, 21 bp, Mus musculus
agcttctagaaaaagcaaaat

SEQ ID NO: 180736 - DNA, 19 bp, Mus musculus
tgttttgtcctttttgttt

SEQ ID NO: 180737 - DNA, 22 bp, Mus musculus
tgctctgagtgtctctgtcttg

SEQ ID NO: 180738 - DNA, 23 bp, Mus musculus
cctctctgagtttctctctccct

SEQ ID NO: 180739 - DNA, 23 bp, Mus musculus
tgaagtaggtctcacacttcaag

SEQ ID NO: 180740 - DNA, 23 bp, Mus musculus
acagtcctaactgtgtgtcttac

SEQ ID NO: 180741 - DNA, 20 bp, Mus musculus
aaaatgagcatcacgatggg

SEQ ID NO: 180742 - DNA, 20 bp, Mus musculus
ctgcctcagtgtctccctgt

SEQ ID NO: 180743 - DNA, 23 bp, Mus musculus
tgttctctgtgccactctctgcc

SEQ ID NO: 180744 - DNA, 23 bp, Mus musculus
ttttgtctatttgtatttgaaat

SEQ ID NO: 180745 - DNA, 23 bp, Mus musculus
acagtcaagaggcatgtgtgttc

SEQ ID NO: 180746 - DNA, 22 bp, Mus musculus
aaaacagatgagagtgtggaca

SEQ ID NO: 180747 - DNA, 18 bp, Mus musculus
tgacattcctttccctgt

SEQ ID NO: 180748 - DNA, 22 bp, Mus musculus
tctgccactcacactgactgct

SEQ ID NO: 180749 - DNA, 23 bp, Mus musculus
acactggctctgtgtgtgaacac

SEQ ID NO: 180750 - DNA, 23 bp, Mus musculus
taatacaatggaaatgctatgta

SEQ ID NO: 180751 - DNA, 23 bp, Mus musculus
aaattgcacacactggactggga

SEQ ID NO: 180752 - DNA, 19 bp, Mus musculus
tcttctttcgttagcctgg

SEQ ID NO: 180753 - DNA, 23 bp, Mus musculus
gtatgtgcatatatatgtgtgtg

SEQ ID NO: 180754 - DNA, 23 bp, Mus musculus
tatatgtatatgtatgtgtgtgt

SEQ ID NO: 180755 - DNA, 23 bp, Mus musculus
tgtgtgtctgtgtcacttccagc

SEQ ID NO: 180756 - DNA, 23 bp, Mus musculus
tctgggaagatggcaggacagaa

SEQ ID NO: 180757 - DNA, 21 bp, Mus musculus
tgagtacttggtcagtgttac

SEQ ID NO: 180758 - DNA, 20 bp, Mus musculus
gatacagtagtgatttggta

SEQ ID NO: 180759 - DNA, 23 bp, Mus musculus
atgtggaagcataagaagtcagg

SEQ ID NO: 180760 - DNA, 23 bp, Mus musculus
ggttatgactacctatctgtctg

SEQ ID NO: 180761 - DNA, 23 bp, Mus musculus
acacacacacatgcatgtgcata

SEQ ID NO: 180762 - DNA, 23 bp, Mus musculus
tatatgcatatgtatggttttga

SEQ ID NO: 180763 - DNA, 19 bp, Mus musculus
attagactccctggcttag

SEQ ID NO: 180764 - DNA, 23 bp, Mus musculus
cccagtctgtctgtctgcctgtc

SEQ ID NO: 180765 - DNA, 22 bp, Mus musculus
tgttttgtgaccaattatatgg

SEQ ID NO: 180766 - DNA, 23 bp, Mus musculus
tgcagcaagttcaaggacaactc

SEQ ID NO: 180767 - DNA, 23 bp, Mus musculus
aaatcactctgtgaatgaggttc

SEQ ID NO: 180768 - DNA, 18 bp, Mus musculus
tagacaggtgccatgact

SEQ ID NO: 180769 - DNA, 20 bp, Mus musculus
agatgaggagtaagtcatgt

SEQ ID NO: 180770 - DNA, 23 bp, Mus musculus
caaaaaagtgtaacttttccttt

SEQ ID NO: 180771 - DNA, 23 bp, Mus musculus
tacagagttcaatatttgttcac

SEQ ID NO: 180772 - DNA, 22 bp, Mus musculus
tgttttgtgaccaattatatgg

SEQ ID NO: 180773 - DNA, 23 bp, Mus musculus
tttagtgagcttcttgtttgttt

SEQ ID NO: 180774 - DNA, 23 bp, Mus musculus
ttatgtctttgtgaaaatgaaat

SEQ ID NO: 180775 - DNA, 23 bp, Mus musculus
agtttgtcctactggatgggtaa

SEQ ID NO: 180776 - DNA, 22 bp, Mus musculus
tgattcagcaagaggaactgta

SEQ ID NO: 180777 - DNA, 23 bp, Mus musculus
ctctctgtgtgtgtatttcatgt

SEQ ID NO: 180778 - DNA, 23 bp, Mus musculus
tttgttctgattttcttgaagtt

SEQ ID NO: 180779 - DNA, 23 bp, Mus musculus
tagtccatggtgatcagatagga

SEQ ID NO: 180780 - DNA, 21 bp, Mus musculus
cactctgcatgagaataggtg

SEQ ID NO: 180781 - DNA, 23 bp, Mus musculus
tcatgtatgtgtgtgcatctatt

SEQ ID NO: 180782 - DNA, 22 bp, Mus musculus
tgttttgtgaccaattatatgg

SEQ ID NO: 180783 - DNA, 22 bp, Mus musculus
ttcaaatctcagcaaccacatg

SEQ ID NO: 180784 - DNA, 23 bp, Mus musculus
tctgtctgtctgtctgcagttgt

SEQ ID NO: 180785 - DNA, 22 bp, Mus musculus
tgttttgtgaccaattatatgg

SEQ ID NO: 180786 - DNA, 22 bp, Mus musculus
ttaagttggctgaagtaggcat

SEQ ID NO: 180787 - DNA, 23 bp, Mus musculus
gtgtgtgtgtgtgtgtgtacacg

SEQ ID NO: 180788 - DNA, 23 bp, Mus musculus
agagcatttgaaatgtaatgaag

SEQ ID NO: 180789 - DNA, 20 bp, Mus musculus
atgtatgtgtgtatgtgcat

SEQ ID NO: 180790 - DNA, 23 bp, Mus musculus
tgtatgcatctatgtatctatct

SEQ ID NO: 180791 - DNA, 22 bp, Mus musculus
tctgagcatgatgtttgctgct

SEQ ID NO: 180792 - DNA, 23 bp, Mus musculus
atgtagtggtcagacagcacact

SEQ ID NO: 180793 - DNA, 23 bp, Mus musculus
agtaatacatgttcattatggat

SEQ ID NO: 180794 - DNA, 23 bp, Mus musculus
actgtatatatataaaactgtat

SEQ ID NO: 180795 - DNA, 23 bp, Mus musculus
tcaggctctcagacactgtagat

SEQ ID NO: 180796 - DNA, 18 bp, Mus musculus
tgcactatttttctgtga

SEQ ID NO: 180797 - DNA, 23 bp, Mus musculus
gtctgtgtgtgtgtatgtgtgtg

SEQ ID NO: 180798 - DNA, 22 bp, Mus musculus
tgttttgtgaccaattatatgg

SEQ ID NO: 180799 - DNA, 23 bp, Mus musculus
tgtgtgtgtgtatatatatatgt

SEQ ID NO: 180800 - DNA, 23 bp, Mus musculus
tacactatgctacttattctatg

SEQ ID NO: 180801 - DNA, 23 bp, Mus musculus
aagcactgtgtaaattttgagga

SEQ ID NO: 180802 - DNA, 23 bp, Mus musculus
tattcttccataagatttcacag

SEQ ID NO: 180803 - DNA, 23 bp, Mus musculus
tagttggatctagataggggaga

SEQ ID NO: 180804 - DNA, 18 bp, Mus musculus
gtctctatctgtctgata

SEQ ID NO: 180805 - DNA, 22 bp, Mus musculus
tgttttgtgaccaattatatgg

SEQ ID NO: 180806 - DNA, 19 bp, Mus musculus
tgtgcctctgtgtgtgtgt

SEQ ID NO: 180807 - DNA, 23 bp, Mus musculus
tattcttccataagatttcacag

SEQ ID NO: 180808 - DNA, 23 bp, Mus musculus
tatgtattatatgtatgcattat

SEQ ID NO: 180809 - DNA, 22 bp, Mus musculus
ttaaagaaatgttcgacatcct

SEQ ID NO: 180810 - DNA, 19 bp, Mus musculus
acagtatttacaaatgaga

SEQ ID NO: 180811 - DNA, 22 bp, Mus musculus
aggcatgaaaacaagtttggtg

SEQ ID NO: 180812 - DNA, 22 bp, Mus musculus
tgttttgtgaccaattatatgg

SEQ ID NO: 180813 - DNA, 23 bp, Mus musculus
tgtcagttcagtctcagtgagcc

SEQ ID NO: 180814 - DNA, 19 bp, Mus musculus
taagactgtaaactggagg

SEQ ID NO: 180815 - DNA, 18 bp, Mus musculus
tatatgcatatacacaca

SEQ ID NO: 180816 - DNA, 23 bp, Mus musculus
tgtgtctttgactctgtgctaac

SEQ ID NO: 180817 - DNA, 21 bp, Mus musculus
attcaggcaaccctattgttg

SEQ ID NO: 180818 - DNA, 18 bp, Mus musculus
gaaacattttctctctcc

SEQ ID NO: 180819 - DNA, 20 bp, Mus musculus
atgcaaatcagacacagcaa

SEQ ID NO: 180820 - DNA, 23 bp, Mus musculus
aggaactcaagatcggagtttga

SEQ ID NO: 180821 - DNA, 21 bp, Mus musculus
tggctcgctccctgtttctca

SEQ ID NO: 180822 - DNA, 23 bp, Mus musculus
catatgtatatatgtatgtatgt

SEQ ID NO: 180823 - DNA, 22 bp, Mus musculus
ttgtgtgtgtatatgtatatat

SEQ ID NO: 180824 - DNA, 23 bp, Mus musculus
taattgtgtgtgtatatgtatat

SEQ ID NO: 180825 - DNA, 21 bp, Mus musculus
tgtgtgtatatgtatatatat

SEQ ID NO: 180826 - DNA, 18 bp, Mus musculus
gtgtgtgtatatgtatat

SEQ ID NO: 180827 - DNA, 23 bp, Mus musculus
ataactgtgtgtgtatatgtata

SEQ ID NO: 180828 - DNA, 18 bp, Mus musculus
gtgtgtgtatatgtatat

SEQ ID NO: 180829 - DNA, 19 bp, Mus musculus
tataactgtgtgtgtatat

SEQ ID NO: 180830 - DNA, 22 bp, Mus musculus
tatgtatatatataattgtgtg

SEQ ID NO: 180831 - DNA, 22 bp, Mus musculus
ttgtgtgtgtatatgtatatat

SEQ ID NO: 180832 - DNA, 23 bp, Mus musculus
taattgtgtgtgtatatgtatat

SEQ ID NO: 180833 - DNA, 22 bp, Mus musculus
ttgtgtgtgtatatgtatatat

SEQ ID NO: 180834 - DNA, 23 bp, Mus musculus
ttgtgtgtgtatatgtatatata

SEQ ID NO: 180835 - DNA, 23 bp, Mus musculus
attgtgtgtgtatatgtatatat

SEQ ID NO: 180836 - DNA, 23 bp, Mus musculus
attgtgtgtgtatatgtatatat

SEQ ID NO: 180837 - DNA, 23 bp, Mus musculus
actcagaagactgttagctgaat

SEQ ID NO: 180838 - DNA, 23 bp, Mus musculus
atatgtatatatgtatatgtgtg

SEQ ID NO: 180839 - DNA, 22 bp, Mus musculus
aatgtatgtatatatttgtgtg

SEQ ID NO: 180840 - DNA, 23 bp, Mus musculus
tgattgagtcatgagattgagtt

SEQ ID NO: 180841 - DNA, 21 bp, Mus musculus
tacagtgtatacatgtaaggt

SEQ ID NO: 180842 - DNA, 21 bp, Mus musculus
aagagagagagagagatgtct

SEQ ID NO: 180843 - DNA, 23 bp, Mus musculus
tctgtctgtctgtctgtctgtct

SEQ ID NO: 180844 - DNA, 22 bp, Mus musculus
gtatatatgtgtgtttgtgcat

SEQ ID NO: 180845 - DNA, 23 bp, Mus musculus
atgtgttagtctatgatgagtga

SEQ ID NO: 180846 - DNA, 22 bp, Mus musculus
ctgagctcttctgaaaatgtag

SEQ ID NO: 180847 - DNA, 22 bp, Mus musculus
tgtgtggatatgtggctctcac

SEQ ID NO: 180848 - DNA, 20 bp, Mus musculus
tttgagtctatttctaatat

SEQ ID NO: 180849 - DNA, 22 bp, Mus musculus
ccaagagtagagattttggaga

SEQ ID NO: 180850 - DNA, 18 bp, Mus musculus
aaactaagcttttgcata

SEQ ID NO: 180851 - DNA, 23 bp, Mus musculus
catggcatggatttgtgaagata

SEQ ID NO: 180852 - DNA, 22 bp, Mus musculus
atcatagacattggagatcact

SEQ ID NO: 180853 - DNA, 23 bp, Mus musculus
tctgggtctctgtgattagacac

SEQ ID NO: 180854 - DNA, 22 bp, Mus musculus
tgtctcagtgtgtcagtactag

SEQ ID NO: 180855 - DNA, 23 bp, Mus musculus
ccattctgactgatgtgaggtgg

SEQ ID NO: 180856 - DNA, 22 bp, Mus musculus
atgtatgtatgcatgtaatatg

SEQ ID NO: 180857 - DNA, 23 bp, Mus musculus
tatatgtgcataattttgtattc

SEQ ID NO: 180858 - DNA, 23 bp, Mus musculus
tctgcctctgcctctgcctctgc

SEQ ID NO: 180859 - DNA, 21 bp, Mus musculus
tagactcaatcactttcctct

SEQ ID NO: 180860 - DNA, 23 bp, Mus musculus
ttgatactcagaagtattggtgt

SEQ ID NO: 180861 - DNA, 22 bp, Mus musculus
tgtgtgtatatgtatatgtata

SEQ ID NO: 180862 - DNA, 19 bp, Mus musculus
tgaaaactgcatttggtgt

SEQ ID NO: 180863 - DNA, 23 bp, Mus musculus
tttgagagaacagtttttgcagt

SEQ ID NO: 180864 - DNA, 22 bp, Mus musculus
tgacagcagagagtgctctgag

SEQ ID NO: 180865 - DNA, 20 bp, Mus musculus
gtgtatatgtatgtgtgtgt

SEQ ID NO: 180866 - DNA, 18 bp, Mus musculus
tgattagatccttgagcc

SEQ ID NO: 180867 - DNA, 23 bp, Mus musculus
actcagtgtggtgtgagagcaca

SEQ ID NO: 180868 - DNA, 22 bp, Mus musculus
actgatccatctctcctgctct

SEQ ID NO: 180869 - DNA, 23 bp, Mus musculus
aaatcagtgctaaagaaaggatt

SEQ ID NO: 180870 - DNA, 19 bp, Mus musculus
actgtcactttctctcacc

SEQ ID NO: 180871 - DNA, 21 bp, Mus musculus
tgtttagtatgcatctttccc

SEQ ID NO: 180872 - DNA, 19 bp, Mus musculus
atttgtatgaaagaatatg

SEQ ID NO: 180873 - DNA, 21 bp, Mus musculus
ttctcatagcatttctatggt

SEQ ID NO: 180874 - DNA, 23 bp, Mus musculus
agccaatctgtctgtctgtcagg

SEQ ID NO: 180875 - DNA, 19 bp, Mus musculus
tacagtatatattttcatg

SEQ ID NO: 180876 - DNA, 22 bp, Mus musculus
tgttttgtgaccaattatatgg

SEQ ID NO: 180877 - DNA, 22 bp, Mus musculus
tgttttgtgaccaattatatgg

SEQ ID NO: 180878 - DNA, 23 bp, Mus musculus
ttctttgagtttgggtgtaaaat

SEQ ID NO: 180879 - DNA, 22 bp, Mus musculus
ttgtgaacttctaagaggtagg

SEQ ID NO: 180880 - DNA, 22 bp, Mus musculus
tgttttgtgaccaattatatgg

SEQ ID NO: 180881 - DNA, 23 bp, Mus musculus
gcatgtatgtatatatatacgtg

SEQ ID NO: 180882 - DNA, 23 bp, Mus musculus
tgtgtgtaagtgtgcatgtgtgt

SEQ ID NO: 180883 - DNA, 22 bp, Mus musculus
tgttttgtgaccaattatatgg

SEQ ID NO: 180884 - DNA, 21 bp, Mus musculus
atcacagttgtgtgtgtgctt

SEQ ID NO: 180885 - DNA, 22 bp, Mus musculus
aagtgtcctcttgctctacatc

SEQ ID NO: 180886 - DNA, 18 bp, Mus musculus
tgacagatgtatgatgga

SEQ ID NO: 180887 - DNA, 22 bp, Mus musculus
tgttttgtgaccaattatatgg

SEQ ID NO: 180888 - DNA, 20 bp, Mus musculus
ggctcactctctggctcagg

SEQ ID NO: 180889 - DNA, 21 bp, Mus musculus
agagagtagagagtgagcttg

SEQ ID NO: 180890 - DNA, 23 bp, Mus musculus
atgtcagtttgttaatgtgttgc

SEQ ID NO: 180891 - DNA, 23 bp, Mus musculus
catatgtgtgtgtgtctgtgtgc

SEQ ID NO: 180892 - DNA, 23 bp, Mus musculus
tattatgtatatatatatgtgtg

SEQ ID NO: 180893 - DNA, 23 bp, Mus musculus
atctgtctctgtaatggattctc

SEQ ID NO: 180894 - DNA, 23 bp, Mus musculus
tttcaggctcatattcaacttgc

SEQ ID NO: 180895 - DNA, 23 bp, Mus musculus
tgctcaactttgcccagtgtgac

SEQ ID NO: 180896 - DNA, 22 bp, Mus musculus
gtgaaatgttggtgttatgttc

SEQ ID NO: 180897 - DNA, 20 bp, Mus musculus
tacatttctgattttgtttt

SEQ ID NO: 180898 - DNA, 23 bp, Mus musculus
tagtgcatggtgatctgatagga

SEQ ID NO: 180899 - DNA, 22 bp, Mus musculus
tgttttgtgacctattatgtgg

SEQ ID NO: 180900 - DNA, 22 bp, Mus musculus
tgacaggctccttctctgcatt

SEQ ID NO: 180901 - DNA, 22 bp, Mus musculus
ttagagctattcactaccatgg

SEQ ID NO: 180902 - DNA, 23 bp, Mus musculus
ctcacaatgtctgtctgtcattt

SEQ ID NO: 180903 - DNA, 18 bp, Mus musculus
tatgtgtgtgtgtgtatg

SEQ ID NO: 180904 - DNA, 23 bp, Mus musculus
agtcacagtctttttgtggtagg

SEQ ID NO: 180905 - DNA, 22 bp, Mus musculus
cagagcacacagtgagtctctc

SEQ ID NO: 180906 - DNA, 18 bp, Mus musculus
agtcatacatttgctact

SEQ ID NO: 180907 - DNA, 23 bp, Mus musculus
gccacagtgtatttaatgaggta

SEQ ID NO: 180908 - DNA, 22 bp, Mus musculus
tgttttgtgaccaattatatgg

SEQ ID NO: 180909 - DNA, 23 bp, Mus musculus
tttcagacatgacagagtgtcct

SEQ ID NO: 180910 - DNA, 19 bp, Mus musculus
acaggacactatgggtgac

SEQ ID NO: 180911 - DNA, 18 bp, Mus musculus
agacatttgtgtatgtat

SEQ ID NO: 180912 - DNA, 23 bp, Mus musculus
atgtgcttatatacatgtgtgtc

SEQ ID NO: 180913 - DNA, 22 bp, Mus musculus
atgtagaactgcctctagatca

SEQ ID NO: 180914 - DNA, 22 bp, Mus musculus
tagaaaatttgttattgtgtcc

SEQ ID NO: 180915 - DNA, 23 bp, Mus musculus
ctgggtttgcatggcttacttct

SEQ ID NO: 180916 - DNA, 18 bp, Mus musculus
actgatgactggcaggag

SEQ ID NO: 180917 - DNA, 23 bp, Mus musculus
tatgcttgtagatacatgtatgt

SEQ ID NO: 180918 - DNA, 23 bp, Mus musculus
tatatgcatgtgcatgtggatgc

SEQ ID NO: 180919 - DNA, 22 bp, Mus musculus
tgacttttttcccttactgctt

SEQ ID NO: 180920 - DNA, 23 bp, Mus musculus
ctcagtcaaacacagaattccct

SEQ ID NO: 180921 - DNA, 22 bp, Mus musculus
tctggagctggaattatatgcc

SEQ ID NO: 180922 - DNA, 21 bp, Mus musculus
actgattcgaaaaggagaaac

SEQ ID NO: 180923 - DNA, 23 bp, Mus musculus
tgtcactgtatgtgtctctgttt

SEQ ID NO: 180924 - DNA, 19 bp, Mus musculus
actggcttgcatttgttta

SEQ ID NO: 180925 - DNA, 21 bp, Mus musculus
tgagcagttgtaaagcaggtt

SEQ ID NO: 180926 - DNA, 23 bp, Mus musculus
tgtttaggagagacaggaataac

SEQ ID NO: 180927 - DNA, 23 bp, Mus musculus
cagtatttatctgaaagctttat

SEQ ID NO: 180928 - DNA, 23 bp, Mus musculus
agatttctctccttctctgactc

SEQ ID NO: 180929 - DNA, 21 bp, Mus musculus
taacaggtacctctgtaaggc

SEQ ID NO: 180930 - DNA, 22 bp, Mus musculus
attacagaagagagagtggaga

SEQ ID NO: 180931 - DNA, 23 bp, Mus musculus
atttgcatgcatatataatgtga

SEQ ID NO: 180932 - DNA, 23 bp, Mus musculus
aaggaagaattttcttcttagag

SEQ ID NO: 180933 - DNA, 20 bp, Mus musculus
atatgtatgtgtgtatatgt

SEQ ID NO: 180934 - DNA, 21 bp, Mus musculus
acgtgcacctgtgtatgtgtg

SEQ ID NO: 180935 - DNA, 22 bp, Mus musculus
tgttttgtgaccaattatatgg

SEQ ID NO: 180936 - DNA, 23 bp, Mus musculus
ctctgcatcagtctgtgtgtcat

SEQ ID NO: 180937 - DNA, 23 bp, Mus musculus
tgctctacatatcttacccagct

SEQ ID NO: 180938 - DNA, 19 bp, Mus musculus
tatatgtacatatatatgt

SEQ ID NO: 180939 - DNA, 21 bp, Mus musculus
tccatggtggtctgataggat

SEQ ID NO: 180940 - DNA, 22 bp, Mus musculus
tgttttgtgaccaattatatgg

SEQ ID NO: 180941 - DNA, 23 bp, Mus musculus
gagtattgtctgttctctgcaag

SEQ ID NO: 180942 - DNA, 23 bp, Mus musculus
gtcagttcactctctgtgagtcc

SEQ ID NO: 180943 - DNA, 21 bp, Mus musculus
gtgtatatgtgtatatgtgta

SEQ ID NO: 180944 - DNA, 23 bp, Mus musculus
gtatgtatatatgtatatatgta

SEQ ID NO: 180945 - DNA, 18 bp, Mus musculus
atgatggtctgataggat

SEQ ID NO: 180946 - DNA, 22 bp, Mus musculus
tgttttgtgaccaattatatgg

SEQ ID NO: 180947 - DNA, 23 bp, Mus musculus
tatgtttatgtatgtgtatgtat

SEQ ID NO: 180948 - DNA, 23 bp, Mus musculus
ttgtatgttgattttggtatact

SEQ ID NO: 180949 - DNA, 23 bp, Mus musculus
tagtccatggtgatctgatagga

SEQ ID NO: 180950 - DNA, 21 bp, Mus musculus
tgttttgttaccaattatatg

SEQ ID NO: 180951 - DNA, 22 bp, Mus musculus
tgttttgtgaccaattatatgg

SEQ ID NO: 180952 - DNA, 21 bp, Mus musculus
aacacactcactctatcccgt

SEQ ID NO: 180953 - DNA, 23 bp, Mus musculus
agtatatctatttgaattataca

SEQ ID NO: 180954 - DNA, 22 bp, Mus musculus
atgaccacaggatgtgttcagg

SEQ ID NO: 180955 - DNA, 22 bp, Mus musculus
tgttttgtgaccaattatatgg

SEQ ID NO: 180956 - DNA, 18 bp, Mus musculus
tgttttgttaccaattat

SEQ ID NO: 180957 - DNA, 21 bp, Mus musculus
cttagtacatggtgatctggt

SEQ ID NO: 180958 - DNA, 22 bp, Mus musculus
gatcagaaggtgaacatgtgga

SEQ ID NO: 180959 - DNA, 22 bp, Mus musculus
ttagtgcttttcaataactttg

SEQ ID NO: 180960 - DNA, 23 bp, Mus musculus
acagtctgtcacacagtatgccc

SEQ ID NO: 180961 - DNA, 23 bp, Mus musculus
ggtgtgtcacagtctgtcacaca

SEQ ID NO: 180962 - DNA, 23 bp, Mus musculus
tctgtcacagaagggggatggaa

SEQ ID NO: 180963 - DNA, 22 bp, Mus musculus
ttacactagactgagagctctt

SEQ ID NO: 180964 - DNA, 20 bp, Mus musculus
tgtgggtcggagagatggct

SEQ ID NO: 180965 - DNA, 19 bp, Mus musculus
cagggaggaagccaccaaa

SEQ ID NO: 180966 - DNA, 22 bp, Mus musculus
actaaagatgctacagtctttg

SEQ ID NO: 180967 - DNA, 23 bp, Mus musculus
cctctgactgactctctcactca

SEQ ID NO: 180968 - DNA, 23 bp, Mus musculus
actccaagatgaggaagtgggtg

SEQ ID NO: 180969 - DNA, 23 bp, Mus musculus
gtaagagagcagagagtggagaa

SEQ ID NO: 180970 - DNA, 23 bp, Mus musculus
ctgtgtctgtctctgagggattt

SEQ ID NO: 180971 - DNA, 23 bp, Mus musculus
tcaccctgagtctgactctgtgc

SEQ ID NO: 180972 - DNA, 23 bp, Mus musculus
tgtctgtctgtaagataaattgg

SEQ ID NO: 180973 - DNA, 18 bp, Mus musculus
atgctatttcagataggc

SEQ ID NO: 180974 - DNA, 23 bp, Mus musculus
agaggtagttggttttaatcact

SEQ ID NO: 180975 - DNA, 21 bp, Mus musculus
aagactatagattattttctt

SEQ ID NO: 180976 - DNA, 21 bp, Mus musculus
ttaagtatagaaactaaaaga

SEQ ID NO: 180977 - DNA, 23 bp, Mus musculus
atgactgtcaggattagtagtca

SEQ ID NO: 180978 - DNA, 23 bp, Mus musculus
agttctgtgtgtctctgagtctg

SEQ ID NO: 180979 - DNA, 22 bp, Mus musculus
tgttttgtgaccaattatatgg

SEQ ID NO: 180980 - DNA, 20 bp, Mus musculus
atatacatacatgtatgcat

SEQ ID NO: 180981 - DNA, 22 bp, Mus musculus
tgttttgtgaccaattatatgg

SEQ ID NO: 180982 - DNA, 20 bp, Mus musculus
gggtgatgtaggagtgctgt

SEQ ID NO: 180983 - DNA, 19 bp, Mus musculus
ttctgatgatagtgagcag

SEQ ID NO: 180984 - DNA, 23 bp, Mus musculus
gtatgtatgtatgtatgtgtgtg

SEQ ID NO: 180985 - DNA, 23 bp, Mus musculus
atgtatgtatgtatgtatgtatg

SEQ ID NO: 180986 - DNA, 23 bp, Mus musculus
atctctgggatttctctttctgt

SEQ ID NO: 180987 - DNA, 19 bp, Mus musculus
tgtatgtctttatattcag

SEQ ID NO: 180988 - DNA, 22 bp, Mus musculus
attgagagcacagagtgaggct

SEQ ID NO: 180989 - DNA, 23 bp, Mus musculus
tgtcactcagtgtccctgtgacc

SEQ ID NO: 180990 - DNA, 22 bp, Mus musculus
tataatgtggtatgtgtgtgtg

SEQ ID NO: 180991 - DNA, 23 bp, Mus musculus
ccaagacagaactgggagcttgt

SEQ ID NO: 180992 - DNA, 22 bp, Mus musculus
actcacccagcttgtgagaggg

SEQ ID NO: 180993 - DNA, 22 bp, Mus musculus
tgtctgcagtgaacagtcttgg

SEQ ID NO: 180994 - DNA, 23 bp, Mus musculus
tttcagagcctggtttcatgagc

SEQ ID NO: 180995 - DNA, 22 bp, Mus musculus
tccttaggtattgagtcttatg

SEQ ID NO: 180996 - DNA, 23 bp, Mus musculus
tatatgtacatatatgtgtgtgt

SEQ ID NO: 180997 - DNA, 22 bp, Mus musculus
taagtacatgaatcagtatgga

SEQ ID NO: 180998 - DNA, 23 bp, Mus musculus
tgctctgtctgtctctcacctgt

SEQ ID NO: 180999 - DNA, 23 bp, Mus musculus
ctctctctctgtcaccctctgaa

SEQ ID NO: 181000 - DNA, 23 bp, Mus musculus
cactctgtctgtgtgtgtgtgcg

SEQ ID NO: 181001 - DNA, 21 bp, Mus musculus
atgtatgtgtatatgcctctg

SEQ ID NO: 181002 - DNA, 22 bp, Mus musculus
tatgtgtatgtataggtatgtg

SEQ ID NO: 181003 - DNA, 23 bp, Mus musculus
atatatgtatatgtgtatatgta

SEQ ID NO: 181004 - DNA, 21 bp, Mus musculus
acaggctctctcactgaagct

SEQ ID NO: 181005 - DNA, 18 bp, Mus musculus
tatgtatgtatgtatgta

SEQ ID NO: 181006 - DNA, 23 bp, Mus musculus
aatgcttgaaaaccagtttgaaa

SEQ ID NO: 181007 - DNA, 20 bp, Mus musculus
tgagtgtacactgagagcag

SEQ ID NO: 181008 - DNA, 18 bp, Mus musculus
agaggtaattgccttagc

SEQ ID NO: 181009 - DNA, 23 bp, Mus musculus
taggtatatgtatgtgtatatga

SEQ ID NO: 181010 - DNA, 23 bp, Mus musculus
tgtctgagcattagaattgtatt

SEQ ID NO: 181011 - DNA, 19 bp, Mus musculus
agaacactgactgctcttc

SEQ ID NO: 181012 - DNA, 23 bp, Mus musculus
tctgtcgctgtgtctgagcacgt

SEQ ID NO: 181013 - DNA, 19 bp, Mus musculus
agctggcttctgtcctcct

SEQ ID NO: 181014 - DNA, 23 bp, Mus musculus
ctctctcagtgtgtgtgacttga

SEQ ID NO: 181015 - DNA, 18 bp, Mus musculus
ccctgggactatggtggg

SEQ ID NO: 181016 - DNA, 22 bp, Mus musculus
attgagacaggattcctctgtg

SEQ ID NO: 181017 - DNA, 18 bp, Mus musculus
tccgagagacattggcag

SEQ ID NO: 181018 - DNA, 23 bp, Mus musculus
ttgagagcagagagtggacagtc

SEQ ID NO: 181019 - DNA, 23 bp, Mus musculus
tcagtactttaccagcagaatca

SEQ ID NO: 181020 - DNA, 23 bp, Mus musculus
tttgttgaaggagcagatgaagg

SEQ ID NO: 181021 - DNA, 23 bp, Mus musculus
taccttcagcatatgttttgtct

SEQ ID NO: 181022 - DNA, 18 bp, Mus musculus
tcctagtagtagcagtac

SEQ ID NO: 181023 - DNA, 19 bp, Mus musculus
agtcccactgcctctccca

SEQ ID NO: 181024 - DNA, 23 bp, Mus musculus
agctgtgtgtgtctgtgtgtctc

SEQ ID NO: 181025 - DNA, 20 bp, Mus musculus
gtgaagtcccaggagtgcag

SEQ ID NO: 181026 - DNA, 23 bp, Mus musculus
ttaagagcactgactgctctttc

SEQ ID NO: 181027 - DNA, 21 bp, Mus musculus
tgtcactgtcactgtttatgc

SEQ ID NO: 181028 - DNA, 23 bp, Mus musculus
tatgtgtgtgtatatgtgtatgt

SEQ ID NO: 181029 - DNA, 23 bp, Mus musculus
ggctctcagtctctctccctgag

SEQ ID NO: 181030 - DNA, 23 bp, Mus musculus
acttgagggaacaagatgggatt

SEQ ID NO: 181031 - DNA, 22 bp, Mus musculus
actatgattttgttcctgtgag

SEQ ID NO: 181032 - DNA, 23 bp, Mus musculus
tgggactggttgtagtttggggt

SEQ ID NO: 181033 - DNA, 23 bp, Mus musculus
tctgccacactgtgtctcttgct

SEQ ID NO: 181034 - DNA, 23 bp, Mus musculus
tgagtgagctcactgtcttctct

SEQ ID NO: 181035 - DNA, 23 bp, Mus musculus
gagctcactcactctgtgtcagg

SEQ ID NO: 181036 - DNA, 23 bp, Mus musculus
cagaaggtggtgtgtatatgtgt

SEQ ID NO: 181037 - DNA, 23 bp, Mus musculus
tgtgtattctagttgctttctgt

SEQ ID NO: 181038 - DNA, 23 bp, Mus musculus
gagagtacagagccaggtgctct

SEQ ID NO: 181039 - DNA, 19 bp, Mus musculus
agaccactgactgctcttc

SEQ ID NO: 181040 - DNA, 18 bp, Mus musculus
agtgtagactgagaggac

SEQ ID NO: 181041 - DNA, 23 bp, Mus musculus
agactgagactgaaaagagtgag

SEQ ID NO: 181042 - DNA, 23 bp, Mus musculus
tgggtctctcagtcactgtcctc

SEQ ID NO: 181043 - DNA, 23 bp, Mus musculus
ctgtgattctctgactttcagga

SEQ ID NO: 181044 - DNA, 23 bp, Mus musculus
tacacaggttatatgtgtgcata

SEQ ID NO: 181045 - DNA, 23 bp, Mus musculus
agactgtctctctctggggctgg

SEQ ID NO: 181046 - DNA, 22 bp, Mus musculus
gacagtctggcggtctgtccct

SEQ ID NO: 181047 - DNA, 23 bp, Mus musculus
tgaggtttgaagtctgggtccag

SEQ ID NO: 181048 - DNA, 23 bp, Mus musculus
gtctgcagagagtgaacacagga

SEQ ID NO: 181049 - DNA, 19 bp, Mus musculus
tctctgtttctctcccaaa

SEQ ID NO: 181050 - DNA, 21 bp, Mus musculus
tgtgtgcatttctgttggcta

SEQ ID NO: 181051 - DNA, 19 bp, Mus musculus
tgagaggacagagtgggca

SEQ ID NO: 181052 - DNA, 23 bp, Mus musculus
tccaacacactccctcactgtcc

SEQ ID NO: 181053 - DNA, 23 bp, Mus musculus
tctgtctgaggactgtagctgag

SEQ ID NO: 181054 - DNA, 22 bp, Mus musculus
gtcagtacagaggctgcactgt

SEQ ID NO: 181055 - DNA, 23 bp, Mus musculus
gagagtgtggtcactgtctgcac

SEQ ID NO: 181056 - DNA, 20 bp, Mus musculus
agacacagttcactgccaga

SEQ ID NO: 181057 - DNA, 19 bp, Mus musculus
actcatgacagttagcaga

SEQ ID NO: 181058 - DNA, 23 bp, Mus musculus
ctctctgtctgtctctcagctct

SEQ ID NO: 181059 - DNA, 22 bp, Mus musculus
gtatgtatgtatgtgtgtgtct

SEQ ID NO: 181060 - DNA, 23 bp, Mus musculus
gggagtcagtcactgcctgcctc

SEQ ID NO: 181061 - DNA, 23 bp, Mus musculus
tgagccactgagtctctgaggga

SEQ ID NO: 181062 - DNA, 23 bp, Mus musculus
ggcactgactgctcttccagagg

SEQ ID NO: 181063 - DNA, 21 bp, Mus musculus
atagtccaggggctggagaga

SEQ ID NO: 181064 - DNA, 19 bp, Mus musculus
agagcactgactgctcttc

SEQ ID NO: 181065 - DNA, 19 bp, Mus musculus
tgtgtgcacacacacacac

SEQ ID NO: 181066 - DNA, 23 bp, Mus musculus
ctctgtctctgagtgcttctcct

SEQ ID NO: 181067 - DNA, 23 bp, Mus musculus
atgtctctgtgtcactgagccac

SEQ ID NO: 181068 - DNA, 21 bp, Mus musculus
aatgcacttgaggcgcgctct

SEQ ID NO: 181069 - DNA, 22 bp, Mus musculus
ctcagtcattctgtgagtcagt

SEQ ID NO: 181070 - DNA, 23 bp, Mus musculus
gactgagtctgttttctgcctct

SEQ ID NO: 181071 - DNA, 23 bp, Mus musculus
acaggatctaagtgtgtctcttt

SEQ ID NO: 181072 - DNA, 23 bp, Mus musculus
cacaaggagcatgtatgtgatta

SEQ ID NO: 181073 - DNA, 23 bp, Mus musculus
agtaactgttgggtgagggagtg

SEQ ID NO: 181074 - DNA, 23 bp, Mus musculus
tcacaacttcaacctctctagaa

SEQ ID NO: 181075 - DNA, 21 bp, Mus musculus
acagatgagagacaggagaag

SEQ ID NO: 181076 - DNA, 21 bp, Mus musculus
cactgctctttgtgtgtgtgt

SEQ ID NO: 181077 - DNA, 23 bp, Mus musculus
gacttcactctctgagaacctgc

SEQ ID NO: 181078 - DNA, 19 bp, Mus musculus
tttctcagaagaggctgag

SEQ ID NO: 181079 - DNA, 23 bp, Mus musculus
agtgtcactcactctcttcttac

SEQ ID NO: 181080 - DNA, 21 bp, Mus musculus
tctgagatggtgtccctgaga

SEQ ID NO: 181081 - DNA, 23 bp, Mus musculus
tgtcactgtcactgcctggaacg

SEQ ID NO: 181082 - DNA, 21 bp, Mus musculus
ctcttagcttttgacatccaa

SEQ ID NO: 181083 - DNA, 23 bp, Mus musculus
tctgtgagcatctgcatctgtat

SEQ ID NO: 181084 - DNA, 23 bp, Mus musculus
tctgtgagcatctgcatctgtat

SEQ ID NO: 181085 - DNA, 19 bp, Mus musculus
acacacatattatatatgt

SEQ ID NO: 181086 - DNA, 23 bp, Mus musculus
tgtgagtgagtgtgtgcctgtgt

SEQ ID NO: 181087 - DNA, 22 bp, Mus musculus
tgtgtgtatgtgtgtatgcgca

SEQ ID NO: 181088 - DNA, 20 bp, Mus musculus
ggcagtagagagtgtcctct

SEQ ID NO: 181089 - DNA, 23 bp, Mus musculus
tcacagacccagagattgccact

SEQ ID NO: 181090 - DNA, 22 bp, Mus musculus
agagtgtgggtgtcttgtgatc

SEQ ID NO: 181091 - DNA, 23 bp, Mus musculus
tgtgtatgtgcatgtgtatgtgt

SEQ ID NO: 181092 - DNA, 22 bp, Mus musculus
tatgtgtgtctctgtgtgtgtg

SEQ ID NO: 181093 - DNA, 18 bp, Mus musculus
ggaacactgagagtaatg

SEQ ID NO: 181094 - DNA, 23 bp, Mus musculus
tgtgtgtgtgtgtgtgtgcatgt

SEQ ID NO: 181095 - DNA, 18 bp, Mus musculus
atgaccaacacacacaga

SEQ ID NO: 181096 - DNA, 23 bp, Mus musculus
ctgtggctctctccctatctgtc

SEQ ID NO: 181097 - DNA, 23 bp, Mus musculus
gaagatagagagctctctgaggt

SEQ ID NO: 181098 - DNA, 22 bp, Mus musculus
cagaaatactggcagcatacct

SEQ ID NO: 181099 - DNA, 23 bp, Mus musculus
tggctcagtctgtgtctcactgg

SEQ ID NO: 181100 - DNA, 23 bp, Mus musculus
gttgagggtctggtagaattgag

SEQ ID NO: 181101 - DNA, 19 bp, Mus musculus
gcctctggagcagtttgac

SEQ ID NO: 181102 - DNA, 23 bp, Mus musculus
gtctgtctgtctgtctccttgac

SEQ ID NO: 181103 - DNA, 19 bp, Mus musculus
actgtgcctcactgcctgc

SEQ ID NO: 181104 - DNA, 23 bp, Mus musculus
actgtgcctcactgcctgcagtg

SEQ ID NO: 181105 - DNA, 22 bp, Mus musculus
gtcactgtgcctcactgcctgc

SEQ ID NO: 181106 - DNA, 23 bp, Mus musculus
aggttatctgcttcaagacctgg

SEQ ID NO: 181107 - DNA, 23 bp, Mus musculus
acagtctctgagtctcataaccc

SEQ ID NO: 181108 - DNA, 23 bp, Mus musculus
tctggctgtcagtctcaggcact

SEQ ID NO: 181109 - DNA, 20 bp, Mus musculus
aactctgatttctgtcccta

SEQ ID NO: 181110 - DNA, 23 bp, Mus musculus
tcacacatgagagtcactacact

SEQ ID NO: 181111 - DNA, 23 bp, Mus musculus
tccctatctatttctttaatggc

SEQ ID NO: 181112 - DNA, 23 bp, Mus musculus
tgtgtgtgtctgtctatctgtct

SEQ ID NO: 181113 - DNA, 23 bp, Mus musculus
gtctctctgtctgtctctgtctc

SEQ ID NO: 181114 - DNA, 23 bp, Mus musculus
gacctgagggtctctgtgtcttt

SEQ ID NO: 181115 - DNA, 23 bp, Mus musculus
ctctgcctctgtgtggctgtatc

SEQ ID NO: 181116 - DNA, 23 bp, Mus musculus
tgacagaagagagtgagaacacg

SEQ ID NO: 181117 - DNA, 23 bp, Mus musculus
acaaggagatggaggtataggct

SEQ ID NO: 181118 - DNA, 23 bp, Mus musculus
tgtgtgtgagtgcatgagcatgt

SEQ ID NO: 181119 - DNA, 22 bp, Mus musculus
aggttctgcatctccatctgaa

SEQ ID NO: 181120 - DNA, 22 bp, Mus musculus
tcagaagacagacagacagaca

SEQ ID NO: 181121 - DNA, 19 bp, Mus musculus
tctcccagtgtgcttgtct

SEQ ID NO: 181122 - DNA, 23 bp, Mus musculus
ctactgtgtctgtgtctgtgcct

SEQ ID NO: 181123 - DNA, 20 bp, Mus musculus
agccagtgttcccagctctt

SEQ ID NO: 181124 - DNA, 19 bp, Mus musculus
tgcactattaagaagtatg

SEQ ID NO: 181125 - DNA, 23 bp, Mus musculus
tcagtcagcctcactgcctctct

SEQ ID NO: 181126 - DNA, 23 bp, Mus musculus
tgtgtgcctcactcactggctct

SEQ ID NO: 181127 - DNA, 23 bp, Mus musculus
tctctgtcacactctaagctcag

SEQ ID NO: 181128 - DNA, 20 bp, Mus musculus
tggctcagtggttaggagca

SEQ ID NO: 181129 - DNA, 22 bp, Mus musculus
tgtgtgtacatgcctatgtgtg

SEQ ID NO: 181130 - DNA, 23 bp, Mus musculus
acacacgcacacatatctttctc

SEQ ID NO: 181131 - DNA, 23 bp, Mus musculus
tgtggttccaggttcttttctct

SEQ ID NO: 181132 - DNA, 19 bp, Mus musculus
atgtgtgtatatgtgtatg

SEQ ID NO: 181133 - DNA, 23 bp, Mus musculus
gacagtgtgtctcagtgcgtcgg

SEQ ID NO: 181134 - DNA, 23 bp, Mus musculus
aagcatgtttcttgatgttgctt

SEQ ID NO: 181135 - DNA, 20 bp, Mus musculus
tatgtatatatgtatgtatg

SEQ ID NO: 181136 - DNA, 23 bp, Mus musculus
tgtatgtgtatatgtatatgagt

SEQ ID NO: 181137 - DNA, 23 bp, Mus musculus
cctcagttgagaatttgttgttt

SEQ ID NO: 181138 - DNA, 19 bp, Mus musculus
agtggtgatctgataggat

SEQ ID NO: 181139 - DNA, 23 bp, Mus musculus
ttttgtgtccgattatattgtca

SEQ ID NO: 181140 - DNA, 22 bp, Mus musculus
tgttttgtgaccaattatatgg

SEQ ID NO: 181141 - DNA, 23 bp, Mus musculus
gaggtctcactgcctctgtctct

SEQ ID NO: 181142 - DNA, 23 bp, Mus musculus
tcattgctacttcatagctgtaa

SEQ ID NO: 181143 - DNA, 23 bp, Mus musculus
ggttctcagtctcagtcattccc

SEQ ID NO: 181144 - DNA, 23 bp, Mus musculus
aagagtgaagagagtcaggatgc

SEQ ID NO: 181145 - DNA, 22 bp, Mus musculus
tgttttgtgaccaattatatgg

SEQ ID NO: 181146 - DNA, 23 bp, Mus musculus
tatgtatatatatgtatatgtgt

SEQ ID NO: 181147 - DNA, 23 bp, Mus musculus
ctggctcagacaccctgtctcaa

SEQ ID NO: 181148 - DNA, 23 bp, Mus musculus
tcaggaggtagagagaggctccc

SEQ ID NO: 181149 - DNA, 21 bp, Mus musculus
atgtatgtatgtatgtatgta

SEQ ID NO: 181150 - DNA, 23 bp, Mus musculus
gtatgcatgtatgtatgtatgta

SEQ ID NO: 181151 - DNA, 23 bp, Mus musculus
ttactctctgcatgttgtctgtc

SEQ ID NO: 181152 - DNA, 23 bp, Mus musculus
caatatttttgtatctgttgtgg

SEQ ID NO: 181153 - DNA, 23 bp, Mus musculus
tgtgtcacactgagtgtagcttg

SEQ ID NO: 181154 - DNA, 21 bp, Mus musculus
ctacagtgacatacttcttcc

SEQ ID NO: 181155 - DNA, 22 bp, Mus musculus
tgttttgtgaccaattatatgg

SEQ ID NO: 181156 - DNA, 23 bp, Mus musculus
aggatgaatgagtgcgtctgata

SEQ ID NO: 181157 - DNA, 22 bp, Mus musculus
ttctcactcttagacatcccag

SEQ ID NO: 181158 - DNA, 23 bp, Mus musculus
agagctgagaacagagtgtggac

SEQ ID NO: 181159 - DNA, 22 bp, Mus musculus
tgttttgtgaccaattatatgg

SEQ ID NO: 181160 - DNA, 22 bp, Mus musculus
tgttttgtgaccaattatatgg

SEQ ID NO: 181161 - DNA, 20 bp, Mus musculus
tcaatttagctccttattct

SEQ ID NO: 181162 - DNA, 18 bp, Mus musculus
tatgtatgtatgtatgta

SEQ ID NO: 181163 - DNA, 23 bp, Mus musculus
tgagaggctctgtctctcactta

SEQ ID NO: 181164 - DNA, 23 bp, Mus musculus
tgtctctgtgtggcttacaagtg

SEQ ID NO: 181165 - DNA, 20 bp, Mus musculus
tcagagaacagagagagatg

SEQ ID NO: 181166 - DNA, 21 bp, Mus musculus
attccaaatgaatctgcaaat

SEQ ID NO: 181167 - DNA, 23 bp, Mus musculus
acagacactacagtgagacctga

SEQ ID NO: 181168 - DNA, 21 bp, Mus musculus
agtggagttgatatgtgtatg

SEQ ID NO: 181169 - DNA, 23 bp, Mus musculus
atgtatgcatgcatatgataggt

SEQ ID NO: 181170 - DNA, 22 bp, Mus musculus
ttaaaagcactgactgctcttc

SEQ ID NO: 181171 - DNA, 22 bp, Mus musculus
atattcttgagggagctggaga

SEQ ID NO: 181172 - DNA, 23 bp, Mus musculus
attgtgtagtagtaccttcttta

SEQ ID NO: 181173 - DNA, 23 bp, Mus musculus
gtctttctgtctctgactgtggc

SEQ ID NO: 181174 - DNA, 23 bp, Mus musculus
tgtgtatatgtgtgtgtatatgt

SEQ ID NO: 181175 - DNA, 23 bp, Mus musculus
tgtctaagcatgagtgtgtcttt

SEQ ID NO: 181176 - DNA, 21 bp, Mus musculus
tctgaacattgattgctgtgg

SEQ ID NO: 181177 - DNA, 23 bp, Mus musculus
tagacacacacatttaatgtgtg

SEQ ID NO: 181178 - DNA, 22 bp, Mus musculus
tgtgtgtgtgtgtgtatgcgcg

SEQ ID NO: 181179 - DNA, 21 bp, Mus musculus
cagagatacatagatgtgtgt

SEQ ID NO: 181180 - DNA, 23 bp, Mus musculus
gtgcacactcagggagaatgagg

SEQ ID NO: 181181 - DNA, 23 bp, Mus musculus
aagctcagccatcagtgagtgtg

SEQ ID NO: 181182 - DNA, 18 bp, Mus musculus
ctgacagcaccaggagca

SEQ ID NO: 181183 - DNA, 21 bp, Mus musculus
actcacactcatactcacatc

SEQ ID NO: 181184 - DNA, 19 bp, Mus musculus
agagagtctaatcagtgcc

SEQ ID NO: 181185 - DNA, 23 bp, Mus musculus
tgtctgtttgtctctctgtgtat

SEQ ID NO: 181186 - DNA, 23 bp, Mus musculus
tgtgtgtgtgtatacacatgtgt

SEQ ID NO: 181187 - DNA, 22 bp, Mus musculus
tgtgtgtatgtatgtatgtatg

SEQ ID NO: 181188 - DNA, 20 bp, Mus musculus
cacaggctccctgaatggct

SEQ ID NO: 181189 - DNA, 22 bp, Mus musculus
tgagtgggaaccttttgggaaa

SEQ ID NO: 181190 - DNA, 23 bp, Mus musculus
tggaggaagtgtgttaatgtaga

SEQ ID NO: 181191 - DNA, 23 bp, Mus musculus
cagtgtgacacacagtctctcct

SEQ ID NO: 181192 - DNA, 19 bp, Mus musculus
agctgtgtctctctcagcg

SEQ ID NO: 181193 - DNA, 21 bp, Mus musculus
tctgagacaacagtctgggca

SEQ ID NO: 181194 - DNA, 23 bp, Mus musculus
atatgtatgtgtgcaagtgtatg

SEQ ID NO: 181195 - DNA, 23 bp, Mus musculus
atgtgtgtgtatgtatatatata

SEQ ID NO: 181196 - DNA, 23 bp, Mus musculus
tgtgtgtgtgtatgtgcttgtgt

SEQ ID NO: 181197 - DNA, 19 bp, Mus musculus
tggaagctgattatgggat

SEQ ID NO: 181198 - DNA, 23 bp, Mus musculus
ttttgaatggatatgtacacata

SEQ ID NO: 181199 - DNA, 19 bp, Mus musculus
atatgtgagtgttacatat

SEQ ID NO: 181200 - DNA, 23 bp, Mus musculus
ttccacagagtatgtagtatgta

SEQ ID NO: 181201 - DNA, 23 bp, Mus musculus
agatagacctagacctagatcta

SEQ ID NO: 181202 - DNA, 22 bp, Mus musculus
tgttttgtgaccaattatatgg

SEQ ID NO: 181203 - DNA, 23 bp, Mus musculus
ctgtgtctctgtttagtttctgt

SEQ ID NO: 181204 - DNA, 19 bp, Mus musculus
ttgtccattgataagagtg

SEQ ID NO: 181205 - DNA, 23 bp, Mus musculus
agaggtgctgagagtctctctgt

SEQ ID NO: 181206 - DNA, 20 bp, Mus musculus
atatagcaaacactcattgt

SEQ ID NO: 181207 - DNA, 23 bp, Mus musculus
ttttttccacagaatgctgtagg

SEQ ID NO: 181208 - DNA, 23 bp, Mus musculus
atgtgacagcctgacttgtgagc

SEQ ID NO: 181209 - DNA, 23 bp, Mus musculus
tggaaggaatagaagtttggaca

SEQ ID NO: 181210 - DNA, 23 bp, Mus musculus
tctgaaaacttctagaagtgtca

SEQ ID NO: 181211 - DNA, 22 bp, Mus musculus
tatatgtatgtgtatatgtatg

SEQ ID NO: 181212 - DNA, 23 bp, Mus musculus
tgtgtatgtatgtatttatgtat

SEQ ID NO: 181213 - DNA, 23 bp, Mus musculus
tatctcagccagctttgttttca

SEQ ID NO: 181214 - DNA, 19 bp, Mus musculus
ctgtgcagcatgtatgaac

SEQ ID NO: 181215 - DNA, 18 bp, Mus musculus
aatagagttatgttttct

SEQ ID NO: 181216 - DNA, 23 bp, Mus musculus
gtctgtctttgtgtcagtgtgtg

SEQ ID NO: 181217 - DNA, 22 bp, Mus musculus
tgttttgtgaccaattatatgg

SEQ ID NO: 181218 - DNA, 23 bp, Mus musculus
tatcacagccatataaaatagtg

SEQ ID NO: 181219 - DNA, 22 bp, Mus musculus
tgttttgtgaccaattatatgg

SEQ ID NO: 181220 - DNA, 23 bp, Mus musculus
gtatgtgtgggtgtgtgtacaca

SEQ ID NO: 181221 - DNA, 23 bp, Mus musculus
agtgtgcatgtgcacgtgcatgt

SEQ ID NO: 181222 - DNA, 22 bp, Mus musculus
gtgtgtgcatgtgtgtgtgcgt

SEQ ID NO: 181223 - DNA, 21 bp, Mus musculus
aatcactgtatagactgagct

SEQ ID NO: 181224 - DNA, 23 bp, Mus musculus
tgtctagaagaagctgtttcctt

SEQ ID NO: 181225 - DNA, 18 bp, Mus musculus
aagtcctatgtctgctcc

SEQ ID NO: 181226 - DNA, 21 bp, Mus musculus
tccatggtggtctgataggat

SEQ ID NO: 181227 - DNA, 21 bp, Mus musculus
atgtatgtatgcatgtgaaag

SEQ ID NO: 181228 - DNA, 23 bp, Mus musculus
tctgtctgtctctgtctgtcttt

SEQ ID NO: 181229 - DNA, 20 bp, Mus musculus
aaagtagctgacacagttct

SEQ ID NO: 181230 - DNA, 23 bp, Mus musculus
tgagtgtgtgagtgtgcgtgtgt

SEQ ID NO: 181231 - DNA, 23 bp, Mus musculus
tttttccaaggaaaagatgctgt

SEQ ID NO: 181232 - DNA, 21 bp, Mus musculus
aatccataatatatatatgtg

SEQ ID NO: 181233 - DNA, 23 bp, Mus musculus
gtgacacactctgtctgatgagg

SEQ ID NO: 181234 - DNA, 23 bp, Mus musculus
ctgcttttagatgcatctgtgtt

SEQ ID NO: 181235 - DNA, 23 bp, Mus musculus
tctgtcttgtgtctctctgtcta

SEQ ID NO: 181236 - DNA, 23 bp, Mus musculus
atcactctggctctcttgtgcag

SEQ ID NO: 181237 - DNA, 19 bp, Mus musculus
atcaggggtgtctttgtga

SEQ ID NO: 181238 - DNA, 23 bp, Mus musculus
aacacagaacaaagtcagatgtg

SEQ ID NO: 181239 - DNA, 22 bp, Mus musculus
tcaatctggacagactatttgg

SEQ ID NO: 181240 - DNA, 23 bp, Mus musculus
tgtctgtctgcctgtctgtccac

SEQ ID NO: 181241 - DNA, 22 bp, Mus musculus
tgttttgtgaccaattatatgg

SEQ ID NO: 181242 - DNA, 22 bp, Mus musculus
tgttttgtgaccgattatatgg

SEQ ID NO: 181243 - DNA, 23 bp, Mus musculus
gtgactcagtctgtcagcctgct

SEQ ID NO: 181244 - DNA, 23 bp, Mus musculus
agtatgtatcgatgtgtgtgtat

SEQ ID NO: 181245 - DNA, 23 bp, Mus musculus
tatgtatatgtatatatgtgtgt

SEQ ID NO: 181246 - DNA, 22 bp, Mus musculus
ttttcatttttatgctatccca

SEQ ID NO: 181247 - DNA, 18 bp, Mus musculus
accctgtcagatcctatt

SEQ ID NO: 181248 - DNA, 23 bp, Mus musculus
actccatctcctagtgatctgac

SEQ ID NO: 181249 - DNA, 23 bp, Mus musculus
gacagcctctgtgacactctgtt

SEQ ID NO: 181250 - DNA, 23 bp, Mus musculus
agctcactactcagtcagtcagt

SEQ ID NO: 181251 - DNA, 21 bp, Mus musculus
tcactcacagaggccatgaga

SEQ ID NO: 181252 - DNA, 20 bp, Mus musculus
gtgtactcagcaagtgctat

SEQ ID NO: 181253 - DNA, 23 bp, Mus musculus
gccactgtctgtctctcacgttc

SEQ ID NO: 181254 - DNA, 21 bp, Mus musculus
tctagtcaccaggaggttgag

SEQ ID NO: 181255 - DNA, 23 bp, Mus musculus
tctggctttctctcactgggact

SEQ ID NO: 181256 - DNA, 23 bp, Mus musculus
atttgagagtgtaagaactggaa

SEQ ID NO: 181257 - DNA, 23 bp, Mus musculus
tctctgcaactcaaactggtttc

SEQ ID NO: 181258 - DNA, 23 bp, Mus musculus
tcttttcctccttgacactgagc

SEQ ID NO: 181259 - DNA, 20 bp, Mus musculus
gtgtctttgtctctctgttt

SEQ ID NO: 181260 - DNA, 22 bp, Mus musculus
ttggagcatatgttggagttgt

SEQ ID NO: 181261 - DNA, 19 bp, Mus musculus
tgtgtgtgtgtatacattc

SEQ ID NO: 181262 - DNA, 22 bp, Mus musculus
tctgagtctgtttctgtcttca

SEQ ID NO: 181263 - DNA, 20 bp, Mus musculus
aacagcttttggaacacaat

SEQ ID NO: 181264 - DNA, 20 bp, Mus musculus
atgaactgtcatattctaaa

SEQ ID NO: 181265 - DNA, 22 bp, Mus musculus
ttcattattatgttcattggtt

SEQ ID NO: 181266 - DNA, 22 bp, Mus musculus
tatacacacatgcacattcttg

SEQ ID NO: 181267 - DNA, 22 bp, Mus musculus
tatacacacatgcacattcttg

SEQ ID NO: 181268 - DNA, 23 bp, Mus musculus
tgtctttggtaaactaccttgat

SEQ ID NO: 181269 - DNA, 21 bp, Mus musculus
aattgtctggaggaatctcag

SEQ ID NO: 181270 - DNA, 18 bp, Mus musculus
agagcactgactgctctt

SEQ ID NO: 181271 - DNA, 23 bp, Mus musculus
tccttggagacagtctgctgttg

SEQ ID NO: 181272 - DNA, 22 bp, Mus musculus
tgattgtcacactatgttctga

SEQ ID NO: 181273 - DNA, 23 bp, Mus musculus
acacaagtaatgtagctttcaat

SEQ ID NO: 181274 - DNA, 23 bp, Mus musculus
tatgtgagtggcactttattgtc

SEQ ID NO: 181275 - DNA, 21 bp, Mus musculus
aagccagtgtgtgaggctgag

SEQ ID NO: 181276 - DNA, 23 bp, Mus musculus
ttgacccacaggctctgtcactc

SEQ ID NO: 181277 - DNA, 23 bp, Mus musculus
tgtacaggtgaatgcatatgtgt

SEQ ID NO: 181278 - DNA, 23 bp, Mus musculus
gatggcacagcttgtattgactg

SEQ ID NO: 181279 - DNA, 23 bp, Mus musculus
gtcactgcacttgctgtcatcct

SEQ ID NO: 181280 - DNA, 23 bp, Mus musculus
tctctgtctgcctgtctgtctca

SEQ ID NO: 181281 - DNA, 23 bp, Mus musculus
tacacaggtatgaagaaaggaaa

SEQ ID NO: 181282 - DNA, 23 bp, Mus musculus
tttgtatttcttcaggatctgtt

SEQ ID NO: 181283 - DNA, 23 bp, Mus musculus
tcatttctgattttgttaattag

SEQ ID NO: 181284 - DNA, 21 bp, Mus musculus
actgaccctgagtgcctgtct

SEQ ID NO: 181285 - DNA, 23 bp, Mus musculus
atctcagaacacagtcagttcag

SEQ ID NO: 181286 - DNA, 22 bp, Mus musculus
ttttgtgacctattatgttgtc

SEQ ID NO: 181287 - DNA, 23 bp, Mus musculus
aactctctgtgcctaaatagtga

SEQ ID NO: 181288 - DNA, 23 bp, Mus musculus
tctgtgacagattatattgtcag

SEQ ID NO: 181289 - DNA, 22 bp, Mus musculus
tgttttgtgaccaattatatgg

SEQ ID NO: 181290 - DNA, 21 bp, Mus musculus
ggtgtctctctgtgtgaccct

SEQ ID NO: 181291 - DNA, 23 bp, Mus musculus
tttgaatttcttcaggatctgtt

SEQ ID NO: 181292 - DNA, 22 bp, Mus musculus
tatctgtagaggggtatgtgac

SEQ ID NO: 181293 - DNA, 22 bp, Mus musculus
tgttttgtgaccaattatatgg

SEQ ID NO: 181294 - DNA, 20 bp, Mus musculus
acatgtgtgtgtgtgtatat

SEQ ID NO: 181295 - DNA, 23 bp, Mus musculus
ataattgcttttcctttcctttc

SEQ ID NO: 181296 - DNA, 20 bp, Mus musculus
ccaagtagagacagagcagt

SEQ ID NO: 181297 - DNA, 19 bp, Mus musculus
tatgtattttatatggggt

SEQ ID NO: 181298 - DNA, 20 bp, Mus musculus
tttcagggtacagtcatgct

SEQ ID NO: 181299 - DNA, 22 bp, Mus musculus
tagagtcaggtattgaagtctc

SEQ ID NO: 181300 - DNA, 21 bp, Mus musculus
agatgtatatgtatatgtgtg

SEQ ID NO: 181301 - DNA, 20 bp, Mus musculus
catcatctagaacaggaggc

SEQ ID NO: 181302 - DNA, 22 bp, Mus musculus
acacacacacctctctgtgtct

SEQ ID NO: 181303 - DNA, 20 bp, Mus musculus
gtcagggtctctgtaactga

SEQ ID NO: 181304 - DNA, 23 bp, Mus musculus
tggactgtcagtctctgcctggg

SEQ ID NO: 181305 - DNA, 23 bp, Mus musculus
gttttgtgcctgtgaatgggcct

SEQ ID NO: 181306 - DNA, 23 bp, Mus musculus
tgagagagagttcactgtgggga

SEQ ID NO: 181307 - DNA, 18 bp, Mus musculus
atgttggtctgataggat

SEQ ID NO: 181308 - DNA, 22 bp, Mus musculus
tgttttgtgaccaattatatgg

SEQ ID NO: 181309 - DNA, 23 bp, Mus musculus
tgaacagtgtcagtcattgttgt

SEQ ID NO: 181310 - DNA, 22 bp, Mus musculus
acacagtgaacagtgtcagtag

SEQ ID NO: 181311 - DNA, 23 bp, Mus musculus
ggaagcagacagaatgcagagag

SEQ ID NO: 181312 - DNA, 20 bp, Mus musculus
agagtgaacactgtcagctg

SEQ ID NO: 181313 - DNA, 23 bp, Mus musculus
atctctgtgtctcggtctcttga

SEQ ID NO: 181314 - DNA, 18 bp, Mus musculus
gtggttttgtgtgcgtag

SEQ ID NO: 181315 - DNA, 23 bp, Mus musculus
atatgtatgtatgtatgtgtgtg

SEQ ID NO: 181316 - DNA, 22 bp, Mus musculus
tgtatacatgtatgtatacacg

SEQ ID NO: 181317 - DNA, 23 bp, Mus musculus
gtgtgtgtgtgtgcatgtgcata

SEQ ID NO: 181318 - DNA, 23 bp, Mus musculus
tgtatatatgtatgtgtgtatgt

SEQ ID NO: 181319 - DNA, 20 bp, Mus musculus
tacacacatataccatgtgt

SEQ ID NO: 181320 - DNA, 21 bp, Mus musculus
gaagtcagaacaggatctcaa

SEQ ID NO: 181321 - DNA, 21 bp, Mus musculus
tgagacaggattggtctgtgt

SEQ ID NO: 181322 - DNA, 23 bp, Mus musculus
tgtctgtctgtctgtctgtctag

SEQ ID NO: 181323 - DNA, 21 bp, Mus musculus
tctgaggacaggaacctgtgt

SEQ ID NO: 181324 - DNA, 23 bp, Mus musculus
aggtgacagaagtgaatgtgctg

SEQ ID NO: 181325 - DNA, 20 bp, Mus musculus
atgtgcttgtatttttatat

SEQ ID NO: 181326 - DNA, 22 bp, Mus musculus
tgttttgtgaccaattatatgg

SEQ ID NO: 181327 - DNA, 23 bp, Mus musculus
atgtgtgcatatgaacacatatg

SEQ ID NO: 181328 - DNA, 23 bp, Mus musculus
tctgtctgtctgtctgtctgcct

SEQ ID NO: 181329 - DNA, 23 bp, Mus musculus
tacacagtgtccacacaagctct

SEQ ID NO: 181330 - DNA, 19 bp, Mus musculus
ttggaggggatattgttgt

SEQ ID NO: 181331 - DNA, 21 bp, Mus musculus
agccagtggttcatgtcaggt

SEQ ID NO: 181332 - DNA, 20 bp, Mus musculus
tgtcataacacagtgagcac

SEQ ID NO: 181333 - DNA, 23 bp, Mus musculus
tgtgacaccacagtgagcactgt

SEQ ID NO: 181334 - DNA, 23 bp, Mus musculus
tgagaccacagtgagcacagtga

SEQ ID NO: 181335 - DNA, 22 bp, Mus musculus
agccagcacagtgagcattgtg

SEQ ID NO: 181336 - DNA, 20 bp, Mus musculus
tgtgacaccacagtgagcac

SEQ ID NO: 181337 - DNA, 20 bp, Mus musculus
tagcactatgacatcagagt

SEQ ID NO: 181338 - DNA, 22 bp, Mus musculus
agagcactgtgacaacacagtg

SEQ ID NO: 181339 - DNA, 23 bp, Mus musculus
attctccttatgtaaacctccag

SEQ ID NO: 181340 - DNA, 23 bp, Mus musculus
tagtccatggtgatctgataggc

SEQ ID NO: 181341 - DNA, 21 bp, Mus musculus
ttttgtatcttttgaggcctg

SEQ ID NO: 181342 - DNA, 21 bp, Mus musculus
tttgtgaccgattatgtagtc

SEQ ID NO: 181343 - DNA, 22 bp, Mus musculus
taggctttggtagtagagactc

SEQ ID NO: 181344 - DNA, 20 bp, Mus musculus
aatttcagggttgttttgat

SEQ ID NO: 181345 - DNA, 19 bp, Mus musculus
tcacattagtcctagtggt

SEQ ID NO: 181346 - DNA, 22 bp, Mus musculus
tgttttgtgaccaattatatgg

SEQ ID NO: 181347 - DNA, 23 bp, Mus musculus
agagcactgactgctcttccaga

SEQ ID NO: 181348 - DNA, 18 bp, Mus musculus
atctgtgtagcattgaag

SEQ ID NO: 181349 - DNA, 19 bp, Mus musculus
tgtggatatatatacatat

SEQ ID NO: 181350 - DNA, 21 bp, Mus musculus
tccatggtggtctgataggat

SEQ ID NO: 181351 - DNA, 23 bp, Mus musculus
gatgagttttggttgtctatgga

SEQ ID NO: 181352 - DNA, 22 bp, Mus musculus
tgttttgtgaccaattatatgg

SEQ ID NO: 181353 - DNA, 23 bp, Mus musculus
gaggtacaccttttattttcttg

SEQ ID NO: 181354 - DNA, 23 bp, Mus musculus
tagaactgtagtgagatttttga

SEQ ID NO: 181355 - DNA, 23 bp, Mus musculus
tagtccatgttgatctgatagga

SEQ ID NO: 181356 - DNA, 18 bp, Mus musculus
atggtgatctgataggat

SEQ ID NO: 181357 - DNA, 22 bp, Mus musculus
ttgtggtagaataggctacaca

SEQ ID NO: 181358 - DNA, 23 bp, Mus musculus
gtgtgtgtatgtgtatacagatt

SEQ ID NO: 181359 - DNA, 23 bp, Mus musculus
agtctctggggatctgatatgat

SEQ ID NO: 181360 - DNA, 23 bp, Mus musculus
ttttgtgaccgattatatagtga

SEQ ID NO: 181361 - DNA, 19 bp, Mus musculus
gcagaacttggcattgcca

SEQ ID NO: 181362 - DNA, 21 bp, Mus musculus
tgttctgtgaccaattatagg

SEQ ID NO: 181363 - DNA, 23 bp, Mus musculus
ttatgctgcaagtgtttggatta

SEQ ID NO: 181364 - DNA, 23 bp, Mus musculus
tgtgtgcatgtttgtatatatgt

SEQ ID NO: 181365 - DNA, 23 bp, Mus musculus
ttgctatccctctgtcagtctct

SEQ ID NO: 181366 - DNA, 23 bp, Mus musculus
gatgagagtgtctctggaggtgg

SEQ ID NO: 181367 - DNA, 21 bp, Mus musculus
tagatgtggataagttgaaga

SEQ ID NO: 181368 - DNA, 22 bp, Mus musculus
ttacaggatgactagtgagatt

SEQ ID NO: 181369 - DNA, 20 bp, Mus musculus
attgtctcaggttctgttgt

SEQ ID NO: 181370 - DNA, 23 bp, Mus musculus
gataacttcagattttgttgtag

SEQ ID NO: 181371 - DNA, 23 bp, Mus musculus
tttttttgtgattaacttcttga

SEQ ID NO: 181372 - DNA, 23 bp, Mus musculus
agaatacagaagatacagtccac

SEQ ID NO: 181373 - DNA, 23 bp, Mus musculus
tgtgtgtctgtctgtcattcatc

SEQ ID NO: 181374 - DNA, 22 bp, Mus musculus
tgttttgtgaccaattatatgg

SEQ ID NO: 181375 - DNA, 23 bp, Mus musculus
gccaaaaagttcttgctgatagg

SEQ ID NO: 181376 - DNA, 22 bp, Mus musculus
ctgagaggctctgtcagtgact

SEQ ID NO: 181377 - DNA, 22 bp, Mus musculus
tgtatgtgtgcgtgtgcatttt

SEQ ID NO: 181378 - DNA, 23 bp, Mus musculus
tttgtgtctgtccatgtggatgt

SEQ ID NO: 181379 - DNA, 23 bp, Mus musculus
gcagagattcgttttgaatatga

SEQ ID NO: 181380 - DNA, 23 bp, Mus musculus
gtatgtatgtgtgcatgtgtgtg

SEQ ID NO: 181381 - DNA, 23 bp, Mus musculus
cgtgtgcatgtttgtgtgtgtgt

SEQ ID NO: 181382 - DNA, 22 bp, Mus musculus
tgttttgtgaccaattatatgg

SEQ ID NO: 181383 - DNA, 22 bp, Mus musculus
tgttttgtgaccaattatatgg

SEQ ID NO: 181384 - DNA, 23 bp, Mus musculus
gacaatgtatgtgcaggtgcaca

SEQ ID NO: 181385 - DNA, 23 bp, Mus musculus
ttacacttgtgtctggtagattt

SEQ ID NO: 181386 - DNA, 22 bp, Mus musculus
tctcacctggagatttatccca

SEQ ID NO: 181387 - DNA, 23 bp, Mus musculus
tcagcatctgcatctgtattggt

SEQ ID NO: 181388 - DNA, 20 bp, Mus musculus
tacatcatcagcaagtctca

SEQ ID NO: 181389 - DNA, 19 bp, Mus musculus
aatacatcagacggaggtg

SEQ ID NO: 181390 - DNA, 23 bp, Mus musculus
ctctgcgtctctgtgagtgtggg

SEQ ID NO: 181391 - DNA, 22 bp, Mus musculus
tgttttgtgaccaattatatgg

SEQ ID NO: 181392 - DNA, 23 bp, Mus musculus
gacagtgtctctgtgtggctggc

SEQ ID NO: 181393 - DNA, 22 bp, Mus musculus
tgttttgtgaccaattatatgg

SEQ ID NO: 181394 - DNA, 19 bp, Mus musculus
cacagcgtctgacttctga

SEQ ID NO: 181395 - DNA, 23 bp, Mus musculus
tttgcaattgttgtgactcagtt

SEQ ID NO: 181396 - DNA, 23 bp, Mus musculus
tgaggctcagctacattacaaca

SEQ ID NO: 181397 - DNA, 23 bp, Mus musculus
ttagtccatggtgacctgatagg

SEQ ID NO: 181398 - DNA, 23 bp, Mus musculus
ttttgtgaccgattgtatggtca

SEQ ID NO: 181399 - DNA, 23 bp, Mus musculus
ctctctctctgtctcagctcttt

SEQ ID NO: 181400 - DNA, 22 bp, Mus musculus
tatgtgtgtgatatgtatacaa

SEQ ID NO: 181401 - DNA, 22 bp, Mus musculus
tagaatgtatatatgtatgcag

SEQ ID NO: 181402 - DNA, 20 bp, Mus musculus
tatgtgtgtgcattcctatt

SEQ ID NO: 181403 - DNA, 20 bp, Mus musculus
aatgtgtgtgatgtatgtgt

SEQ ID NO: 181404 - DNA, 19 bp, Mus musculus
gtcagtcagtcagtcagtc

SEQ ID NO: 181405 - DNA, 23 bp, Mus musculus
ctgcctgtctgtctgtcttgtgt

SEQ ID NO: 181406 - DNA, 23 bp, Mus musculus
tgtgtgtgagtcagaggatagct

SEQ ID NO: 181407 - DNA, 23 bp, Mus musculus
tctgtctgtctgtctgtctgtgc

SEQ ID NO: 181408 - DNA, 23 bp, Mus musculus
ctcagcatctcactcactctcct

SEQ ID NO: 181409 - DNA, 22 bp, Mus musculus
ctgagtgtagtgtgagtgcagg

SEQ ID NO: 181410 - DNA, 23 bp, Mus musculus
aagagagcacacagagtgcattg

SEQ ID NO: 181411 - DNA, 18 bp, Mus musculus
tacatatacatacacata

SEQ ID NO: 181412 - DNA, 19 bp, Mus musculus
atatgtatgtatatatgta

SEQ ID NO: 181413 - DNA, 21 bp, Mus musculus
gggagtcaaatgattttgttg

SEQ ID NO: 181414 - DNA, 22 bp, Mus musculus
tgtgtgtgtgcgtgtgcatgtg

SEQ ID NO: 181415 - DNA, 23 bp, Mus musculus
gtatatatgtatgtatgtatatg

SEQ ID NO: 181416 - DNA, 18 bp, Mus musculus
tacatacacatgtatgca

SEQ ID NO: 181417 - DNA, 23 bp, Mus musculus
catgaataacttgaccttttgga

SEQ ID NO: 181418 - DNA, 22 bp, Mus musculus
gatttgtttcctgtttgtcttc

SEQ ID NO: 181419 - DNA, 20 bp, Mus musculus
tttgctccctgtatttgttc

SEQ ID NO: 181420 - DNA, 23 bp, Mus musculus
tgagtgtctctctctctcctaga

SEQ ID NO: 181421 - DNA, 22 bp, Mus musculus
tgttttgtgaccaattatatgg

SEQ ID NO: 181422 - DNA, 23 bp, Mus musculus
tttatgtgtgcatgtttatgtgt

SEQ ID NO: 181423 - DNA, 20 bp, Mus musculus
aggctgagaaagcagcatgt

SEQ ID NO: 181424 - DNA, 22 bp, Mus musculus
tgttttgtgaccaattatatgg

SEQ ID NO: 181425 - DNA, 23 bp, Mus musculus
tctggcacggtatcttgtctttg

SEQ ID NO: 181426 - DNA, 23 bp, Mus musculus
agctgtgtcaccagggaactgag

SEQ ID NO: 181427 - DNA, 22 bp, Mus musculus
tgttttgtgaccaattatatgg

SEQ ID NO: 181428 - DNA, 23 bp, Mus musculus
atgtgtgtatgtatgtatgtatg

SEQ ID NO: 181429 - DNA, 23 bp, Mus musculus
tctttctgcacagtcaccacaca

SEQ ID NO: 181430 - DNA, 22 bp, Mus musculus
tattagtacttagaggttggtc

SEQ ID NO: 181431 - DNA, 23 bp, Mus musculus
acacagtatgtatatatccactg

SEQ ID NO: 181432 - DNA, 23 bp, Mus musculus
tatgagcacactctgtttatcac

SEQ ID NO: 181433 - DNA, 22 bp, Mus musculus
tgttttgtgaccaattatatgg

SEQ ID NO: 181434 - DNA, 20 bp, Mus musculus
tgtattgcactcaatggacc

SEQ ID NO: 181435 - DNA, 23 bp, Mus musculus
taaatgagagtacttattctgtt

SEQ ID NO: 181436 - DNA, 22 bp, Mus musculus
ggtttgagctgcagtctgaggc

SEQ ID NO: 181437 - DNA, 22 bp, Mus musculus
tgttttgtgaccaattatatgg

SEQ ID NO: 181438 - DNA, 22 bp, Mus musculus
aggggttttaattcctatgtca

SEQ ID NO: 181439 - DNA, 23 bp, Mus musculus
taaacataggatgagatatggct

SEQ ID NO: 181440 - DNA, 23 bp, Mus musculus
gtatctttttctttaggttaggg

SEQ ID NO: 181441 - DNA, 23 bp, Mus musculus
ttttcttctactaattttgttga

SEQ ID NO: 181442 - DNA, 18 bp, Mus musculus
ttttgtatctattgaggc

SEQ ID NO: 181443 - DNA, 22 bp, Mus musculus
tgttttgtgaccaattatatgg

SEQ ID NO: 181444 - DNA, 22 bp, Mus musculus
tgttttgtgaccaattatatgg

SEQ ID NO: 181445 - DNA, 23 bp, Mus musculus
tgtacatgtgatatggtatgtgt

SEQ ID NO: 181446 - DNA, 22 bp, Mus musculus
atatgtgtatgcaaatttacac

SEQ ID NO: 181447 - DNA, 23 bp, Mus musculus
tatatgtgtgttataggtgtgtg

SEQ ID NO: 181448 - DNA, 21 bp, Mus musculus
acaagagccaactgacaggag

SEQ ID NO: 181449 - DNA, 21 bp, Mus musculus
tgtgaggctctgtcagtgtct

SEQ ID NO: 181450 - DNA, 22 bp, Mus musculus
tgttttgtgaccaattttatgg

SEQ ID NO: 181451 - DNA, 22 bp, Mus musculus
tactgcttttagtattctgtct

SEQ ID NO: 181452 - DNA, 23 bp, Mus musculus
ttctggtacagtctatttggagt

SEQ ID NO: 181453 - DNA, 23 bp, Mus musculus
tgtctgtgtgtatatatacatat

SEQ ID NO: 181454 - DNA, 22 bp, Mus musculus
tgtgtgtgtataatatatgtgt

SEQ ID NO: 181455 - DNA, 21 bp, Mus musculus
tgtgtcgctccctgattggct

SEQ ID NO: 181456 - DNA, 23 bp, Mus musculus
ctgtctgtctgtctgtctgtcta

SEQ ID NO: 181457 - DNA, 22 bp, Mus musculus
tatcacagacttgtagattttt

SEQ ID NO: 181458 - DNA, 22 bp, Mus musculus
tgttttgtgaccaattatatgg

SEQ ID NO: 181459 - DNA, 20 bp, Mus musculus
atatgtgtgtatatatatgt

SEQ ID NO: 181460 - DNA, 22 bp, Mus musculus
tctgtgtgactctgtgtgtgtg

SEQ ID NO: 181461 - DNA, 19 bp, Mus musculus
aatgggagatgaaaactgt

SEQ ID NO: 181462 - DNA, 23 bp, Mus musculus
atcacagcttgatttgatgtgct

SEQ ID NO: 181463 - DNA, 21 bp, Mus musculus
tcaagtgaccataggtgtgtg

SEQ ID NO: 181464 - DNA, 23 bp, Mus musculus
cattggtctacttgtctgtcact

SEQ ID NO: 181465 - DNA, 23 bp, Mus musculus
tccattagtgcatttgttgttct

SEQ ID NO: 181466 - DNA, 23 bp, Mus musculus
tgagtgcctattgtatgctgtct

SEQ ID NO: 181467 - DNA, 22 bp, Mus musculus
tgttttgtgaccaattatatgg

SEQ ID NO: 181468 - DNA, 23 bp, Mus musculus
caatatggatgcacaatgtgcat

SEQ ID NO: 181469 - DNA, 22 bp, Mus musculus
tgttttgtgaccaattatatgg

SEQ ID NO: 181470 - DNA, 20 bp, Mus musculus
tccgtggtgatctgattgga

SEQ ID NO: 181471 - DNA, 23 bp, Mus musculus
ttttgtgaccaaatctatggtca

SEQ ID NO: 181472 - DNA, 20 bp, Mus musculus
tggtactgtcctttcctggt

SEQ ID NO: 181473 - DNA, 23 bp, Mus musculus
tctcttgctctcagtgtcctttc

SEQ ID NO: 181474 - DNA, 22 bp, Mus musculus
tgttttgtgaccaattatatgg

SEQ ID NO: 181475 - DNA, 22 bp, Mus musculus
tgttttgtgaccaattatatgg

SEQ ID NO: 181476 - DNA, 22 bp, Mus musculus
tgttttgtgaccaattatatgg

SEQ ID NO: 181477 - DNA, 23 bp, Mus musculus
tttcactgtctggatcttgtttt

SEQ ID NO: 181478 - DNA, 20 bp, Mus musculus
cctgtctgtctctgtctatg

SEQ ID NO: 181479 - DNA, 21 bp, Mus musculus
attcacagaggtgcacttgtc

SEQ ID NO: 181480 - DNA, 22 bp, Mus musculus
tgttttgtgaccaattatatgg

SEQ ID NO: 181481 - DNA, 19 bp, Mus musculus
tctttcacacactctcacc

SEQ ID NO: 181482 - DNA, 23 bp, Mus musculus
gtgactgtcagtgagtcttagga

SEQ ID NO: 181483 - DNA, 21 bp, Mus musculus
ttctgaaatactattgcactg

SEQ ID NO: 181484 - DNA, 21 bp, Mus musculus
aggtgcatgtatatacacata

SEQ ID NO: 181485 - DNA, 20 bp, Mus musculus
tgagtatatatgtatatgta

SEQ ID NO: 181486 - DNA, 22 bp, Mus musculus
ttttggagtagatatgggtttg

SEQ ID NO: 181487 - DNA, 22 bp, Mus musculus
tacctctactttctgaatcaca

SEQ ID NO: 181488 - DNA, 22 bp, Mus musculus
tgttttgtgaccaattatatgg

SEQ ID NO: 181489 - DNA, 23 bp, Mus musculus
agtgtctgtgtctcaatgaacag

SEQ ID NO: 181490 - DNA, 23 bp, Mus musculus
aagatcagagactctgctctccg

SEQ ID NO: 181491 - DNA, 23 bp, Mus musculus
taaggcacgcggtgaatgccaag

SEQ ID NO: 181492 - DNA, 21 bp, Mus musculus
gtgtgtatagtgcatatgtgt

SEQ ID NO: 181493 - DNA, 21 bp, Mus musculus
atgtctatatatatgtgtgtg

SEQ ID NO: 181494 - DNA, 23 bp, Mus musculus
tatatgtgtgcatgtgtatgtct

SEQ ID NO: 181495 - DNA, 23 bp, Mus musculus
aagtgtatatatgtgtatgtgtg

SEQ ID NO: 181496 - DNA, 22 bp, Mus musculus
tgttttgtgaccaattatatgg

SEQ ID NO: 181497 - DNA, 19 bp, Mus musculus
tgaggtccatggattgatg

SEQ ID NO: 181498 - DNA, 22 bp, Mus musculus
tgttttgtgaccaattatatgg

SEQ ID NO: 181499 - DNA, 21 bp, Mus musculus
tccatggtgatctgataggat

SEQ ID NO: 181500 - DNA, 22 bp, Mus musculus
tgttttgtgaccaattatatgg

SEQ ID NO: 181501 - DNA, 20 bp, Mus musculus
tctctcacttgatgtcctgt

SEQ ID NO: 181502 - DNA, 23 bp, Mus musculus
tcagtttgcacagagcatcgttc

SEQ ID NO: 181503 - DNA, 23 bp, Mus musculus
tacttctggatgacattctgcaa

SEQ ID NO: 181504 - DNA, 20 bp, Mus musculus
ggctagagagatggctcagc

SEQ ID NO: 181505 - DNA, 21 bp, Mus musculus
aaacagtaatgtgtgtggaca

SEQ ID NO: 181506 - DNA, 23 bp, Mus musculus
gctaggtgagtgaacagagtttg

SEQ ID NO: 181507 - DNA, 23 bp, Mus musculus
cacacatatatatgtgtaaatgt

SEQ ID NO: 181508 - DNA, 23 bp, Mus musculus
gtcactctctgtgacatttggag

SEQ ID NO: 181509 - DNA, 23 bp, Mus musculus
aatggcaatggaagaagagtgag

SEQ ID NO: 181510 - DNA, 21 bp, Mus musculus
tgtactgtgtctgtgtctgag

SEQ ID NO: 181511 - DNA, 23 bp, Mus musculus
tatatttttatctgtttcctgta

SEQ ID NO: 181512 - DNA, 23 bp, Mus musculus
tctcagtgaagtgaaggcaagag

SEQ ID NO: 181513 - DNA, 19 bp, Mus musculus
atatatgtatgcatgtgtg

SEQ ID NO: 181514 - DNA, 23 bp, Mus musculus
ccctaagtgtttgaaaagtgagt

SEQ ID NO: 181515 - DNA, 23 bp, Mus musculus
taaagtgaatttgtttttcttac

SEQ ID NO: 181516 - DNA, 19 bp, Mus musculus
tgtgtgtgtgtgtatgtgg

SEQ ID NO: 181517 - DNA, 22 bp, Mus musculus
tgttttgtgaccaattatatgg

SEQ ID NO: 181518 - DNA, 23 bp, Mus musculus
gtgcatgcgtgcgtgcgtgtgtg

SEQ ID NO: 181519 - DNA, 19 bp, Mus musculus
gccaggttttatcttcaca

SEQ ID NO: 181520 - DNA, 23 bp, Mus musculus
cagtgtgactgtatatgagtctg

SEQ ID NO: 181521 - DNA, 23 bp, Mus musculus
caatatttttgtatctgttgagg

SEQ ID NO: 181522 - DNA, 21 bp, Mus musculus
gactgtagtcagagagcacat

SEQ ID NO: 181523 - DNA, 23 bp, Mus musculus
tacttcagggtctattgtcatgg

SEQ ID NO: 181524 - DNA, 23 bp, Mus musculus
aattagtatgtataagaattatg

SEQ ID NO: 181525 - DNA, 22 bp, Mus musculus
tccatagtaatgaagtatgctg

SEQ ID NO: 181526 - DNA, 21 bp, Mus musculus
tctctctgtctctgggagagt

SEQ ID NO: 181527 - DNA, 18 bp, Mus musculus
tgtcagtttctgtctcca

SEQ ID NO: 181528 - DNA, 23 bp, Mus musculus
ttccctggatgattgactgagat

SEQ ID NO: 181529 - DNA, 20 bp, Mus musculus
cagaagcttgatgagagtgt

SEQ ID NO: 181530 - DNA, 19 bp, Mus musculus
gagctgtctgctgccattc

SEQ ID NO: 181531 - DNA, 21 bp, Mus musculus
tttctcagtgtctaaataatg

SEQ ID NO: 181532 - DNA, 23 bp, Mus musculus
tgtgtgtgtgtatgtgtgtgcat

SEQ ID NO: 181533 - DNA, 20 bp, Mus musculus
tatgtatatatatatgtatg

SEQ ID NO: 181534 - DNA, 19 bp, Mus musculus
acacacacatatatacaca

SEQ ID NO: 181535 - DNA, 23 bp, Mus musculus
atagcagtgatgattgtgtgcag

SEQ ID NO: 181536 - DNA, 21 bp, Mus musculus
tgagtcaaagacaaaacgagc

SEQ ID NO: 181537 - DNA, 23 bp, Mus musculus
tttcaatgtacttcatttgattt

SEQ ID NO: 181538 - DNA, 19 bp, Mus musculus
taaattcagtggttttgtt

SEQ ID NO: 181539 - DNA, 20 bp, Mus musculus
tttgtgaggttgggctagag

SEQ ID NO: 181540 - DNA, 22 bp, Mus musculus
tgttttgtgaccaattatatgg

SEQ ID NO: 181541 - DNA, 22 bp, Mus musculus
tgttttgtgaccaattatatgg

SEQ ID NO: 181542 - DNA, 19 bp, Mus musculus
catggtggtctgataggat

SEQ ID NO: 181543 - DNA, 22 bp, Mus musculus
tgttttgtgaccaattatatgg

SEQ ID NO: 181544 - DNA, 22 bp, Mus musculus
tgttttgtgaccaattatatgg

SEQ ID NO: 181545 - DNA, 21 bp, Mus musculus
tgtgctacattaatttgtttt

SEQ ID NO: 181546 - DNA, 23 bp, Mus musculus
ttgctctgagtacagcttgaggt

SEQ ID NO: 181547 - DNA, 22 bp, Mus musculus
tgttttgtgaccaattatatgg

SEQ ID NO: 181548 - DNA, 21 bp, Mus musculus
tatgtatatgtatgtgtgtga

SEQ ID NO: 181549 - DNA, 23 bp, Mus musculus
tgtgtatgcatgtatatatgtat

SEQ ID NO: 181550 - DNA, 23 bp, Mus musculus
tgtgtgtgtgtatgctctttatg

SEQ ID NO: 181551 - DNA, 18 bp, Mus musculus
tcatatgctaaatataat

SEQ ID NO: 181552 - DNA, 23 bp, Mus musculus
atgtatatatgcatgtatacaca

SEQ ID NO: 181553 - DNA, 22 bp, Mus musculus
tggatgttggatgtatagtttt

SEQ ID NO: 181554 - DNA, 20 bp, Mus musculus
taggatgtagctggatttgt

SEQ ID NO: 181555 - DNA, 22 bp, Mus musculus
atgtatgtatatatgtatgtat

SEQ ID NO: 181556 - DNA, 22 bp, Mus musculus
agccagaagaccaggatgtgga

SEQ ID NO: 181557 - DNA, 23 bp, Mus musculus
attaatttttcttcagcctgggt

SEQ ID NO: 181558 - DNA, 22 bp, Mus musculus
tgttttgtgaccaattatatgg

SEQ ID NO: 181559 - DNA, 23 bp, Mus musculus
tatgtgtgtgtttatgtgcatgt

SEQ ID NO: 181560 - DNA, 21 bp, Mus musculus
tatggatttaaatagcattga

SEQ ID NO: 181561 - DNA, 22 bp, Mus musculus
tgttttgtgaccaattatatgg

SEQ ID NO: 181562 - DNA, 18 bp, Mus musculus
ttacactcagattccaca

SEQ ID NO: 181563 - DNA, 23 bp, Mus musculus
tgtgtgtctgtttgtcattcatc

SEQ ID NO: 181564 - DNA, 23 bp, Mus musculus
gtgtgtgcatatttatacattat

SEQ ID NO: 181565 - DNA, 23 bp, Mus musculus
tcactgataagcatatgagaggc

SEQ ID NO: 181566 - DNA, 22 bp, Mus musculus
attcaatgttattctcagaagc

SEQ ID NO: 181567 - DNA, 22 bp, Mus musculus
tggtacacttgtgagattggag

SEQ ID NO: 181568 - DNA, 23 bp, Mus musculus
gtctgattacttgatgttgttgt

SEQ ID NO: 181569 - DNA, 22 bp, Mus musculus
tttatgcatgattacctgttca

SEQ ID NO: 181570 - DNA, 23 bp, Mus musculus
tagctgcatatgatatgctatca

SEQ ID NO: 181571 - DNA, 23 bp, Mus musculus
gtcttctctctgtctctcattgg

SEQ ID NO: 181572 - DNA, 22 bp, Mus musculus
taaagagcatttgctgcttgta

SEQ ID NO: 181573 - DNA, 20 bp, Mus musculus
tctcttcagattctgtgtcc

SEQ ID NO: 181574 - DNA, 23 bp, Mus musculus
tatgtatgtatgtatatatgtgt

SEQ ID NO: 181575 - DNA, 19 bp, Mus musculus
tctccctgtgggtccccaa

SEQ ID NO: 181576 - DNA, 23 bp, Mus musculus
aggtctctcagtctgagcctctg

SEQ ID NO: 181577 - DNA, 23 bp, Mus musculus
aagttctgggaactgacagatat

SEQ ID NO: 181578 - DNA, 22 bp, Mus musculus
acttgtatgtgtatgatatcag

SEQ ID NO: 181579 - DNA, 22 bp, Mus musculus
tgttttgtgaccaattatatgg

SEQ ID NO: 181580 - DNA, 21 bp, Mus musculus
tgttgcaatttatatttatgt

SEQ ID NO: 181581 - DNA, 23 bp, Mus musculus
tacttgtgtgtacagactgtgca

SEQ ID NO: 181582 - DNA, 20 bp, Mus musculus
cccactgtctatctctctgc

SEQ ID NO: 181583 - DNA, 22 bp, Mus musculus
agactggagagatggctcagtg

SEQ ID NO: 181584 - DNA, 22 bp, Mus musculus
gcactgactgctcttccagagg

SEQ ID NO: 181585 - DNA, 23 bp, Mus musculus
agatcagtgtgctgtgtaactgt

SEQ ID NO: 181586 - DNA, 22 bp, Mus musculus
tgttttgtgaccaattatatgg

SEQ ID NO: 181587 - DNA, 23 bp, Mus musculus
tgtctgggtgtctctttgcctgt

SEQ ID NO: 181588 - DNA, 22 bp, Mus musculus
tcactctctctcagtgttctta

SEQ ID NO: 181589 - DNA, 22 bp, Mus musculus
tgttttgtgaccaattatatgg

SEQ ID NO: 181590 - DNA, 23 bp, Mus musculus
tgtatgtatgtatgcatgtgtga

SEQ ID NO: 181591 - DNA, 23 bp, Mus musculus
tttctatgaggtactgatggctt

SEQ ID NO: 181592 - DNA, 23 bp, Mus musculus
tgtgtgtatatatatgtgtgtgt

SEQ ID NO: 181593 - DNA, 23 bp, Mus musculus
ctctccctatctgtctctttgtc

SEQ ID NO: 181594 - DNA, 23 bp, Mus musculus
tgactgtacagtgtctcctgtag

SEQ ID NO: 181595 - DNA, 23 bp, Mus musculus
gacagtgtctctcactgagccag

SEQ ID NO: 181596 - DNA, 23 bp, Mus musculus
ttcttagagaagatggtgtccac

SEQ ID NO: 181597 - DNA, 23 bp, Mus musculus
gacaccgtctgtctctgaggtct

SEQ ID NO: 181598 - DNA, 23 bp, Mus musculus
tgtgtggttgattgaatatgaga

SEQ ID NO: 181599 - DNA, 19 bp, Mus musculus
tatgtatatgtatatgtat

SEQ ID NO: 181600 - DNA, 18 bp, Mus musculus
taagacattatgtaactg

SEQ ID NO: 181601 - DNA, 23 bp, Mus musculus
ttgtaattgttgttgagataggg

SEQ ID NO: 181602 - DNA, 23 bp, Mus musculus
tctgggtgatcagagagagctct

SEQ ID NO: 181603 - DNA, 21 bp, Mus musculus
atgtatgtgtgcatatgtatg

SEQ ID NO: 181604 - DNA, 19 bp, Mus musculus
tatgtgtatgtgtatatgt

SEQ ID NO: 181605 - DNA, 23 bp, Mus musculus
cacacattgttctgtgacctcca

SEQ ID NO: 181606 - DNA, 21 bp, Mus musculus
tgtgtacatatgcctgtgtgc

SEQ ID NO: 181607 - DNA, 23 bp, Mus musculus
tgtctgtgtgtgcatatgcctgt

SEQ ID NO: 181608 - DNA, 23 bp, Mus musculus
tataggtgtgatgagagtccctc

SEQ ID NO: 181609 - DNA, 20 bp, Mus musculus
gaatatatacatatgtgtgt

SEQ ID NO: 181610 - DNA, 18 bp, Mus musculus
tcacaagatggactgaag

SEQ ID NO: 181611 - DNA, 23 bp, Mus musculus
agaaccagaggaacaggaagtag

SEQ ID NO: 181612 - DNA, 23 bp, Mus musculus
ctggctgcctgtctgcctgcctg

SEQ ID NO: 181613 - DNA, 20 bp, Mus musculus
actggtattaaaggtgtgtg

SEQ ID NO: 181614 - DNA, 22 bp, Mus musculus
tcacagtgtagtgactgaggac

SEQ ID NO: 181615 - DNA, 23 bp, Mus musculus
gtctctgtctgtgtgtgtgcatg

SEQ ID NO: 181616 - DNA, 18 bp, Mus musculus
tagacttaagggagctgg

SEQ ID NO: 181617 - DNA, 22 bp, Mus musculus
tgttttgtgaccaattatatgg

SEQ ID NO: 181618 - DNA, 22 bp, Mus musculus
attacagatattgttattcagt

SEQ ID NO: 181619 - DNA, 23 bp, Mus musculus
gtacagtgtgtgtgtgtgtgtgt

SEQ ID NO: 181620 - DNA, 22 bp, Mus musculus
tgttttgtgaccaattatatgg

SEQ ID NO: 181621 - DNA, 23 bp, Mus musculus
atctatgtctctctgcttggctg

SEQ ID NO: 181622 - DNA, 21 bp, Mus musculus
cactgttgaaccagagaatga

SEQ ID NO: 181623 - DNA, 23 bp, Mus musculus
tgtgtgtgtatatgtataggcat

SEQ ID NO: 181624 - DNA, 20 bp, Mus musculus
atatatgtatatgtatgtgt

SEQ ID NO: 181625 - DNA, 22 bp, Mus musculus
caagttgtagcagtatacatct

SEQ ID NO: 181626 - DNA, 23 bp, Mus musculus
tatagtcccagctgaggcagaca

SEQ ID NO: 181627 - DNA, 21 bp, Mus musculus
cttcatagtgatatctcttgc

SEQ ID NO: 181628 - DNA, 23 bp, Mus musculus
atgtgtgtcactagagagttcaa

SEQ ID NO: 181629 - DNA, 23 bp, Mus musculus
ctctttcagtgtctcattgttga

SEQ ID NO: 181630 - DNA, 23 bp, Mus musculus
aaatgtgtatatgcatatatgtg

SEQ ID NO: 181631 - DNA, 19 bp, Mus musculus
gtgggatgactcaagctct

SEQ ID NO: 181632 - DNA, 22 bp, Mus musculus
atacatgtatgtgtgcatgtgt

SEQ ID NO: 181633 - DNA, 19 bp, Mus musculus
aaacaccagagccagctct

SEQ ID NO: 181634 - DNA, 23 bp, Mus musculus
aaatctagccacactctcctcct

SEQ ID NO: 181635 - DNA, 18 bp, Mus musculus
tctgtctgtctgtctgtg

SEQ ID NO: 181636 - DNA, 21 bp, Mus musculus
tgtgtctgaagacagacagct

SEQ ID NO: 181637 - DNA, 22 bp, Mus musculus
tgtgtactcagctcattggtca

SEQ ID NO: 181638 - DNA, 23 bp, Mus musculus
tatcacagagtacagagaagcta

SEQ ID NO: 181639 - DNA, 23 bp, Mus musculus
aacagtgcaatgaagtatgggaa

SEQ ID NO: 181640 - DNA, 23 bp, Mus musculus
caagacagtgagcacatgatgag

SEQ ID NO: 181641 - DNA, 23 bp, Mus musculus
ctaggaggtcaagagacttacat

SEQ ID NO: 181642 - DNA, 22 bp, Mus musculus
tgttttgtgaccaattatatgg

SEQ ID NO: 181643 - DNA, 23 bp, Mus musculus
ttgtcactgggtcttcttgttga

SEQ ID NO: 181644 - DNA, 23 bp, Mus musculus
tatgtgtgtgtgcatgtgcatgt

SEQ ID NO: 181645 - DNA, 21 bp, Mus musculus
agggtagcatagcagagggta

SEQ ID NO: 181646 - DNA, 23 bp, Mus musculus
tctgtgtttatctctctgttata

SEQ ID NO: 181647 - DNA, 22 bp, Mus musculus
tgttttgtgaccaattatatgg

SEQ ID NO: 181648 - DNA, 20 bp, Mus musculus
tcatgttaccttggttatgg

SEQ ID NO: 181649 - DNA, 21 bp, Mus musculus
taactgggacgctgtatccca

SEQ ID NO: 181650 - DNA, 22 bp, Mus musculus
tgttttgtgaccaattatatgg

SEQ ID NO: 181651 - DNA, 21 bp, Mus musculus
aactaagtatgtatgtacatg

SEQ ID NO: 181652 - DNA, 21 bp, Mus musculus
tctgtacttcttaatttctgt

SEQ ID NO: 181653 - DNA, 23 bp, Mus musculus
ttgagtgaagaatgagtggacag

SEQ ID NO: 181654 - DNA, 23 bp, Mus musculus
tcacttctgatactgttgtagtg

SEQ ID NO: 181655 - DNA, 23 bp, Mus musculus
tgtcactgggattggactctgga

SEQ ID NO: 181656 - DNA, 18 bp, Mus musculus
tatagctgtgtctcatga

SEQ ID NO: 181657 - DNA, 23 bp, Mus musculus
ctgtgtctctgtttagtttctgt

SEQ ID NO: 181658 - DNA, 22 bp, Mus musculus
tgttttgtgaccaattatatgg

SEQ ID NO: 181659 - DNA, 23 bp, Mus musculus
acacagagtagtaaaggaatcct

SEQ ID NO: 181660 - DNA, 23 bp, Mus musculus
ttagtctctgtctctctcccctt

SEQ ID NO: 181661 - DNA, 23 bp, Mus musculus
tgtgtgcatgtctatatttgtgt

SEQ ID NO: 181662 - DNA, 23 bp, Mus musculus
tacatgtatgtatatgtacatat

SEQ ID NO: 181663 - DNA, 22 bp, Mus musculus
gattagagaagttactcagcag

SEQ ID NO: 181664 - DNA, 20 bp, Mus musculus
acctgtatatgaacatatgt

SEQ ID NO: 181665 - DNA, 19 bp, Mus musculus
actcacctagttattcata

SEQ ID NO: 181666 - DNA, 23 bp, Mus musculus
tgtgaacatgcaagtgtgtgtgt

SEQ ID NO: 181667 - DNA, 23 bp, Mus musculus
gtgtgtgtatatgtatgtgtgtg

SEQ ID NO: 181668 - DNA, 19 bp, Mus musculus
tatttcctgactctgggtc

SEQ ID NO: 181669 - DNA, 23 bp, Mus musculus
gtgagcagagtggctctgttctg

SEQ ID NO: 181670 - DNA, 23 bp, Mus musculus
aagtatgtatttgtatatgcatg

SEQ ID NO: 181671 - DNA, 23 bp, Mus musculus
tgtgtcttaggacattgttgctg

SEQ ID NO: 181672 - DNA, 23 bp, Mus musculus
ttttctgtacttcatttgcctgt

SEQ ID NO: 181673 - DNA, 22 bp, Mus musculus
catagtaactggttctcaaggt

SEQ ID NO: 181674 - DNA, 23 bp, Mus musculus
ccacagtgtctcactgtctccac

SEQ ID NO: 181675 - DNA, 22 bp, Mus musculus
atgggtctctgtgtcaattgcc

SEQ ID NO: 181676 - DNA, 23 bp, Mus musculus
gacagatcagaggctccagcctt

SEQ ID NO: 181677 - DNA, 22 bp, Mus musculus
aagtggctgcctactgacctgc

SEQ ID NO: 181678 - DNA, 23 bp, Mus musculus
ttcacacacacacacttaagaca

SEQ ID NO: 181679 - DNA, 22 bp, Mus musculus
agcagtgtactgatggtgcgag

SEQ ID NO: 181680 - DNA, 23 bp, Mus musculus
tgagcagtgtattgacagtctga

SEQ ID NO: 181681 - DNA, 23 bp, Mus musculus
ctgagtggctctgtctcaggctg

SEQ ID NO: 181682 - DNA, 21 bp, Mus musculus
tttaggagtagatttcctttg

SEQ ID NO: 181683 - DNA, 23 bp, Mus musculus
tcaacacagaagacagacagcac

SEQ ID NO: 181684 - DNA, 23 bp, Mus musculus
atagacatctaccttgactgtgt

SEQ ID NO: 181685 - DNA, 23 bp, Mus musculus
tgtatgcatgtatgtatagatgt

SEQ ID NO: 181686 - DNA, 23 bp, Mus musculus
caggccctctctgagtcactggg

SEQ ID NO: 181687 - DNA, 21 bp, Mus musculus
tgcctttgtgttcttagggga

SEQ ID NO: 181688 - DNA, 23 bp, Mus musculus
aacagccttctctctgtgtgtgt

SEQ ID NO: 181689 - DNA, 23 bp, Mus musculus
tctgtgtacagattcatacagga

SEQ ID NO: 181690 - DNA, 23 bp, Mus musculus
tgtatctgtctgtctgtgagcct

SEQ ID NO: 181691 - DNA, 20 bp, Mus musculus
tatgtgcatgtatgtgtata

SEQ ID NO: 181692 - DNA, 23 bp, Mus musculus
tgtgtatatgtatatgtatatgt

SEQ ID NO: 181693 - DNA, 23 bp, Mus musculus
tgtgtgtgtcctagaaatcactg

SEQ ID NO: 181694 - DNA, 22 bp, Mus musculus
tgttttgtgaccaattatatgg

SEQ ID NO: 181695 - DNA, 23 bp, Mus musculus
tgcacgatcttgatgctgtctgt

SEQ ID NO: 181696 - DNA, 23 bp, Mus musculus
tgagtgtgtgtgagtgcgtatgt

SEQ ID NO: 181697 - DNA, 22 bp, Mus musculus
ttaattctctaacttgttttga

SEQ ID NO: 181698 - DNA, 23 bp, Mus musculus
tgtctgtctgtctgtgtgttcag

SEQ ID NO: 181699 - DNA, 23 bp, Mus musculus
ctaatgctgattgtggtaccaga

SEQ ID NO: 181700 - DNA, 21 bp, Mus musculus
cacacacatatatgtgtgtgt

SEQ ID NO: 181701 - DNA, 22 bp, Mus musculus
ttactgtcttgctctctgtgac

SEQ ID NO: 181702 - DNA, 22 bp, Mus musculus
tagcactgttcagactgagcac

SEQ ID NO: 181703 - DNA, 21 bp, Mus musculus
tgtgtgcatatatacatgtgt

SEQ ID NO: 181704 - DNA, 23 bp, Mus musculus
tgcctggatgcctgtctgcctgg

SEQ ID NO: 181705 - DNA, 23 bp, Mus musculus
ttatttcagcttctaaatcttag

SEQ ID NO: 181706 - DNA, 22 bp, Mus musculus
tgttttgtgaccaattatatgg

SEQ ID NO: 181707 - DNA, 22 bp, Mus musculus
gatcttcttgttcatgctgctt

SEQ ID NO: 181708 - DNA, 22 bp, Mus musculus
tggttcagtctctgtgagtctc

SEQ ID NO: 181709 - DNA, 23 bp, Mus musculus
ataggaatgctttagaaatgaaa

SEQ ID NO: 181710 - DNA, 19 bp, Mus musculus
agagcactgactgctcttc

SEQ ID NO: 181711 - DNA, 22 bp, Mus musculus
acacagctgtttgtgaaacctg

SEQ ID NO: 181712 - DNA, 22 bp, Mus musculus
acagttctcactttcttcatgt

SEQ ID NO: 181713 - DNA, 23 bp, Mus musculus
attagtgtctctcagttctttct

SEQ ID NO: 181714 - DNA, 21 bp, Mus musculus
atgagagatgattgagaggac

SEQ ID NO: 181715 - DNA, 21 bp, Mus musculus
aaccttttacttcataatgcg

SEQ ID NO: 181716 - DNA, 23 bp, Mus musculus
tgcctgactgactggctcccact

SEQ ID NO: 181717 - DNA, 21 bp, Mus musculus
ctgaaggaagtctataggaga

SEQ ID NO: 181718 - DNA, 23 bp, Mus musculus
acctgtctgtggctgttgtttat

SEQ ID NO: 181719 - DNA, 21 bp, Mus musculus
atgtgcattcatatgtgtgtg

SEQ ID NO: 181720 - DNA, 23 bp, Mus musculus
tgagtacatgcatatgtgtatgt

SEQ ID NO: 181721 - DNA, 23 bp, Mus musculus
tcattgcttttcttgcagtagaa

SEQ ID NO: 181722 - DNA, 23 bp, Mus musculus
attaaagtccttctcgatgtcct

SEQ ID NO: 181723 - DNA, 23 bp, Mus musculus
gatgtcagtgtatgctcattgtt

SEQ ID NO: 181724 - DNA, 23 bp, Mus musculus
tttctctttgctccatgtttggg

SEQ ID NO: 181725 - DNA, 23 bp, Mus musculus
ctcaagtgagagaggaaagtgtg

SEQ ID NO: 181726 - DNA, 23 bp, Mus musculus
tgtgtgtctgtgtgcatgtgtat

SEQ ID NO: 181727 - DNA, 23 bp, Mus musculus
tacatgtgtgcttttgtattaat

SEQ ID NO: 181728 - DNA, 22 bp, Mus musculus
tgtctgtgagacgatttctaga

SEQ ID NO: 181729 - DNA, 22 bp, Mus musculus
tgcctccaaagtaattctgtct

SEQ ID NO: 181730 - DNA, 23 bp, Mus musculus
tagcttgttatatgatttagaag

SEQ ID NO: 181731 - DNA, 23 bp, Mus musculus
ggtgcatttccttgcaaaactga

SEQ ID NO: 181732 - DNA, 23 bp, Mus musculus
taatactgtgggtgttctcttag

SEQ ID NO: 181733 - DNA, 23 bp, Mus musculus
gtgtgtgcatatgcttgtgcatg

SEQ ID NO: 181734 - DNA, 23 bp, Mus musculus
aacacagcaactagcttcctcaa

SEQ ID NO: 181735 - DNA, 23 bp, Mus musculus
tctagttctgtcaggtagtgagg

SEQ ID NO: 181736 - DNA, 22 bp, Mus musculus
tgttttgtgaccaattatatgg

SEQ ID NO: 181737 - DNA, 18 bp, Mus musculus
aaccatctgaggatctgt

SEQ ID NO: 181738 - DNA, 23 bp, Mus musculus
actcacactctgagacttttaga

SEQ ID NO: 181739 - DNA, 21 bp, Mus musculus
tatcacacagcaactgatggg

SEQ ID NO: 181740 - DNA, 19 bp, Mus musculus
tatgtgcatagatgtattg

SEQ ID NO: 181741 - DNA, 18 bp, Mus musculus
acacacacacacatacat

SEQ ID NO: 181742 - DNA, 21 bp, Mus musculus
tgccagcctccctgaatggct

SEQ ID NO: 181743 - DNA, 23 bp, Mus musculus
aggaaggctgttggtgtcttacc

SEQ ID NO: 181744 - DNA, 23 bp, Mus musculus
tcagtctcagtatctttctctga

SEQ ID NO: 181745 - DNA, 21 bp, Mus musculus
tccatggtggtctgataggat

SEQ ID NO: 181746 - DNA, 22 bp, Mus musculus
tgttttgtgaccaattatatgg

SEQ ID NO: 181747 - DNA, 23 bp, Mus musculus
catgtaacacatagaagtatggt

SEQ ID NO: 181748 - DNA, 23 bp, Mus musculus
ttatttcattatgtacatatgtg

SEQ ID NO: 181749 - DNA, 19 bp, Mus musculus
tgtgggagactcacggcgt

SEQ ID NO: 181750 - DNA, 19 bp, Mus musculus
tctctcacttgctgactca

SEQ ID NO: 181751 - DNA, 23 bp, Mus musculus
ctaataatcgagcactgcttcct

SEQ ID NO: 181752 - DNA, 21 bp, Mus musculus
tgtgtatatatatgtgtgtat

SEQ ID NO: 181753 - DNA, 23 bp, Mus musculus
atgtttcttgttgcacattcttt

SEQ ID NO: 181754 - DNA, 23 bp, Mus musculus
atatctccaccagcttctgcctc

SEQ ID NO: 181755 - DNA, 18 bp, Mus musculus
tatgtgctgtgtatttta

SEQ ID NO: 181756 - DNA, 22 bp, Mus musculus
tgcaaaataattgaaatttcat

SEQ ID NO: 181757 - DNA, 19 bp, Mus musculus
ttctgctagtaagaggaat

SEQ ID NO: 181758 - DNA, 23 bp, Mus musculus
catacacacacacgtgatgatat

SEQ ID NO: 181759 - DNA, 20 bp, Mus musculus
atctgtgtgtgcttctgcat

SEQ ID NO: 181760 - DNA, 23 bp, Mus musculus
tatgtatatatatatgtgtgtgt

SEQ ID NO: 181761 - DNA, 21 bp, Mus musculus
tctgtctctatctgtgtctct

SEQ ID NO: 181762 - DNA, 23 bp, Mus musculus
atgtgaagtactgtcactctgtc

SEQ ID NO: 181763 - DNA, 22 bp, Mus musculus
tacatagatagataaagataga

SEQ ID NO: 181764 - DNA, 23 bp, Mus musculus
actggcacagttctgctcttgtt

SEQ ID NO: 181765 - DNA, 20 bp, Mus musculus
tctcagaagtctgtgacgac

SEQ ID NO: 181766 - DNA, 19 bp, Mus musculus
acagtgctgcagagttggt

SEQ ID NO: 181767 - DNA, 23 bp, Mus musculus
tctgtctgtgtgaatgctggagg

SEQ ID NO: 181768 - DNA, 23 bp, Mus musculus
taactgctacaccaaatgatttt

SEQ ID NO: 181769 - DNA, 19 bp, Mus musculus
agagccaaacagagatttt

SEQ ID NO: 181770 - DNA, 22 bp, Mus musculus
acagaggaatcttgaatggctg

SEQ ID NO: 181771 - DNA, 21 bp, Mus musculus
acactggtggttataacctga

SEQ ID NO: 181772 - DNA, 22 bp, Mus musculus
tgttttgtgaccaattatatgg

SEQ ID NO: 181773 - DNA, 23 bp, Mus musculus
tagaggatctcttgtgaatttgt

SEQ ID NO: 181774 - DNA, 23 bp, Mus musculus
catgactttgtggtttagaactc

SEQ ID NO: 181775 - DNA, 23 bp, Mus musculus
tttcagtttgcaaaacttgtggc

SEQ ID NO: 181776 - DNA, 23 bp, Mus musculus
tgtctgtgtctgtgtctgtgact

SEQ ID NO: 181777 - DNA, 22 bp, Mus musculus
atgtatgtatgtatgtatgtat

SEQ ID NO: 181778 - DNA, 23 bp, Mus musculus
tgtatgtatgtatgtatgtatgt

SEQ ID NO: 181779 - DNA, 23 bp, Mus musculus
tctgggtgtggatatgttgtctt

SEQ ID NO: 181780 - DNA, 19 bp, Mus musculus
cttaccacatctctggcat

SEQ ID NO: 181781 - DNA, 23 bp, Mus musculus
acagtgagcatgaaagtggtttt

SEQ ID NO: 181782 - DNA, 23 bp, Mus musculus
atagattatgctaagaaatcact

SEQ ID NO: 181783 - DNA, 21 bp, Mus musculus
aaagggactgccacgattgag

SEQ ID NO: 181784 - DNA, 23 bp, Mus musculus
ttttgagctctcacactagactc

SEQ ID NO: 181785 - DNA, 21 bp, Mus musculus
tgtgtatgtatatatatatgt

SEQ ID NO: 181786 - DNA, 22 bp, Mus musculus
tatgtctctgtgtgtgtctgtg

SEQ ID NO: 181787 - DNA, 22 bp, Mus musculus
tgttttgtgaccaattatatgg

SEQ ID NO: 181788 - DNA, 22 bp, Mus musculus
tgttttgtgaccaattatatgg

SEQ ID NO: 181789 - DNA, 23 bp, Mus musculus
atgcgcaatggtattcatatgta

SEQ ID NO: 181790 - DNA, 23 bp, Mus musculus
tttgaatttcttcaggatctgtt

SEQ ID NO: 181791 - DNA, 23 bp, Mus musculus
ttcatttctgattttgttaatta

SEQ ID NO: 181792 - DNA, 22 bp, Mus musculus
tgttttgtgaccaattatatgg

SEQ ID NO: 181793 - DNA, 22 bp, Mus musculus
tattttgtgaccaattttatgg

SEQ ID NO: 181794 - DNA, 22 bp, Mus musculus
tgttttgtgaccaattatatgg

SEQ ID NO: 181795 - DNA, 23 bp, Mus musculus
gtaagactgtatggtattgtggt

SEQ ID NO: 181796 - DNA, 22 bp, Mus musculus
cacaaagtcatcagtctgtagt

SEQ ID NO: 181797 - DNA, 23 bp, Mus musculus
ctgtgtctctgtttagtttctgt

SEQ ID NO: 181798 - DNA, 22 bp, Mus musculus
ctgaccatggatgagagtgagg

SEQ ID NO: 181799 - DNA, 21 bp, Mus musculus
tgtaaacaagctgatgtgttt

SEQ ID NO: 181800 - DNA, 23 bp, Mus musculus
tatgtatatgtatatatgtatgt

SEQ ID NO: 181801 - DNA, 22 bp, Mus musculus
atatatgtatatgtatatatgt

SEQ ID NO: 181802 - DNA, 23 bp, Mus musculus
tgtatatgtatatgtatatgtat

SEQ ID NO: 181803 - DNA, 23 bp, Mus musculus
tatactgctgatttagtagattt

SEQ ID NO: 181804 - DNA, 23 bp, Mus musculus
tgcatgtatgtgtgtgtgcatat

SEQ ID NO: 181805 - DNA, 23 bp, Mus musculus
atctgtctgcattagtttctgtt

SEQ ID NO: 181806 - DNA, 23 bp, Mus musculus
tctcagagagacaatacgctcct

SEQ ID NO: 181807 - DNA, 23 bp, Mus musculus
ctattgattaagattgagaaatg

SEQ ID NO: 181808 - DNA, 19 bp, Mus musculus
tgacaattttctcctggct

SEQ ID NO: 181809 - DNA, 19 bp, Mus musculus
tctctccctccctctcttc

SEQ ID NO: 181810 - DNA, 23 bp, Mus musculus
gtatacacccacacatactgtat

SEQ ID NO: 181811 - DNA, 23 bp, Mus musculus
gacctgcagttatcttactttat

SEQ ID NO: 181812 - DNA, 21 bp, Mus musculus
tatggatgttttcaggagtga

SEQ ID NO: 181813 - DNA, 23 bp, Mus musculus
tagtccatggtgatctgatagga

SEQ ID NO: 181814 - DNA, 23 bp, Mus musculus
gatagtagagtctgtaaaggcaa

SEQ ID NO: 181815 - DNA, 21 bp, Mus musculus
tatgtgtatttctacatgtca

SEQ ID NO: 181816 - DNA, 23 bp, Mus musculus
tagtgcatggtgatctgatagga

SEQ ID NO: 181817 - DNA, 22 bp, Mus musculus
tgttttgtgacctattatgtgg

SEQ ID NO: 181818 - DNA, 22 bp, Mus musculus
tgttttgtgaccaattatatgg

SEQ ID NO: 181819 - DNA, 18 bp, Mus musculus
tgtctccttccacaatca

SEQ ID NO: 181820 - DNA, 21 bp, Mus musculus
acactgcagagccttcagaat

SEQ ID NO: 181821 - DNA, 23 bp, Mus musculus
ctagtatggagactctctgtctc

SEQ ID NO: 181822 - DNA, 22 bp, Mus musculus
tgttttgtgaccaattatatgg

SEQ ID NO: 181823 - DNA, 18 bp, Mus musculus
atatagatatagatatgc

SEQ ID NO: 181824 - DNA, 23 bp, Mus musculus
tgtgtgtctgtctatctatctat

SEQ ID NO: 181825 - DNA, 22 bp, Mus musculus
agacatagacatggatatagat

SEQ ID NO: 181826 - DNA, 21 bp, Mus musculus
ataaaatgtgcagctgatctg

SEQ ID NO: 181827 - DNA, 20 bp, Mus musculus
tttttgtgggggttcgtttt

SEQ ID NO: 181828 - DNA, 20 bp, Mus musculus
cttaggtagtactttgtata

SEQ ID NO: 181829 - DNA, 23 bp, Mus musculus
tgtatatgtaagtatatgtttgt

SEQ ID NO: 181830 - DNA, 23 bp, Mus musculus
aatgtatacatgctgatttgata

SEQ ID NO: 181831 - DNA, 23 bp, Mus musculus
tatatcattgtttatgtttgcat

SEQ ID NO: 181832 - DNA, 23 bp, Mus musculus
atatatcatgcttatcataactt

SEQ ID NO: 181833 - DNA, 19 bp, Mus musculus
acacacacacgcatacatg

SEQ ID NO: 181834 - DNA, 23 bp, Mus musculus
tatatgcgtgtgtatgatgtatt

SEQ ID NO: 181835 - DNA, 22 bp, Mus musculus
gtatgtatgtatgtatgtatgt

SEQ ID NO: 181836 - DNA, 23 bp, Mus musculus
atatatgtatatgtatatgtgtg

SEQ ID NO: 181837 - DNA, 23 bp, Mus musculus
tgaaatacagagtaagttgtatc

SEQ ID NO: 181838 - DNA, 20 bp, Mus musculus
attggttctgttggctgtgt

SEQ ID NO: 181839 - DNA, 20 bp, Mus musculus
gtctcagatctacctcctgg

SEQ ID NO: 181840 - DNA, 23 bp, Mus musculus
aatataattatgtgatgaatggt

SEQ ID NO: 181841 - DNA, 20 bp, Mus musculus
tgtgtatatgtatatgtgtg

SEQ ID NO: 181842 - DNA, 22 bp, Mus musculus
actgtagtgattttgtagtaat

SEQ ID NO: 181843 - DNA, 22 bp, Mus musculus
tgttttgtgaccaattatatgg

SEQ ID NO: 181844 - DNA, 21 bp, Mus musculus
tgtgctataataccaatgtga

SEQ ID NO: 181845 - DNA, 23 bp, Mus musculus
atatgtgtatatatatgtgtgtg

SEQ ID NO: 181846 - DNA, 23 bp, Mus musculus
tatgcgtatatatatgtgtgtat

SEQ ID NO: 181847 - DNA, 23 bp, Mus musculus
tgagagtgcatataatgtttgga

SEQ ID NO: 181848 - DNA, 23 bp, Mus musculus
tcactgtaaatctctctccttga

SEQ ID NO: 181849 - DNA, 23 bp, Mus musculus
aacataagctggtatgcatgaca

SEQ ID NO: 181850 - DNA, 23 bp, Mus musculus
tatgcacacaagtgtgtgtgtac

SEQ ID NO: 181851 - DNA, 22 bp, Mus musculus
tgatttcaatgtttttttatct

SEQ ID NO: 181852 - DNA, 22 bp, Mus musculus
tgttttgtgaccaattatatgg

SEQ ID NO: 181853 - DNA, 23 bp, Mus musculus
tcttactctgtccctcagtgagt

SEQ ID NO: 181854 - DNA, 23 bp, Mus musculus
acactcagtatctgagtcttctc

SEQ ID NO: 181855 - DNA, 22 bp, Mus musculus
tagtaacaagcgtgtgtgtgtg

SEQ ID NO: 181856 - DNA, 18 bp, Mus musculus
acagtctgttatatatgt

SEQ ID NO: 181857 - DNA, 22 bp, Mus musculus
gtggctgtgaagctggcacaga

SEQ ID NO: 181858 - DNA, 22 bp, Mus musculus
ataggtctgactggaaacagca

SEQ ID NO: 181859 - DNA, 23 bp, Mus musculus
ccagacactctgcctcagtcttg

SEQ ID NO: 181860 - DNA, 22 bp, Mus musculus
tgttttgtgaccaattatatgg

SEQ ID NO: 181861 - DNA, 22 bp, Mus musculus
tgttttgtgaccaattatatgg

SEQ ID NO: 181862 - DNA, 23 bp, Mus musculus
gtatatatacacgtacatataca

SEQ ID NO: 181863 - DNA, 18 bp, Mus musculus
tgagctggggctggagag

SEQ ID NO: 181864 - DNA, 23 bp, Mus musculus
tgatcatggaagagtgtcactaa

SEQ ID NO: 181865 - DNA, 23 bp, Mus musculus
attacaccttgaatgttttattg

SEQ ID NO: 181866 - DNA, 21 bp, Mus musculus
tcagagcactgactgctcttc

SEQ ID NO: 181867 - DNA, 19 bp, Mus musculus
atgtgcttgctctttccca

SEQ ID NO: 181868 - DNA, 23 bp, Mus musculus
aaacactgactgctcttccagag

SEQ ID NO: 181869 - DNA, 20 bp, Mus musculus
acagcttcagtgtccttccc

SEQ ID NO: 181870 - DNA, 23 bp, Mus musculus
tctgtctgtctgtctgcctgact

SEQ ID NO: 181871 - DNA, 23 bp, Mus musculus
ttgctgactgctcttgctgaggt

SEQ ID NO: 181872 - DNA, 21 bp, Mus musculus
tgtgtgtgagggtgggatatg

SEQ ID NO: 181873 - DNA, 23 bp, Mus musculus
tctgaggttatctcaaagttagt

SEQ ID NO: 181874 - DNA, 21 bp, Mus musculus
tatagtctcactaagtagtct

SEQ ID NO: 181875 - DNA, 23 bp, Mus musculus
agtgtgagcatcgtacagagaga

SEQ ID NO: 181876 - DNA, 23 bp, Mus musculus
tgtgtctgtctgtctgtctgtct

SEQ ID NO: 181877 - DNA, 23 bp, Mus musculus
atatgtgaatatatatatgtgtg

SEQ ID NO: 181878 - DNA, 21 bp, Mus musculus
acacttgtttggttttgagac

SEQ ID NO: 181879 - DNA, 23 bp, Mus musculus
tgagactcactgtgtgaaacagg

SEQ ID NO: 181880 - DNA, 23 bp, Mus musculus
agaagcagctggcactgctgtga

SEQ ID NO: 181881 - DNA, 20 bp, Mus musculus
gagagatgtgatgtgtgagt

SEQ ID NO: 181882 - DNA, 23 bp, Mus musculus
aggagtggctgacttccttccac

SEQ ID NO: 181883 - DNA, 23 bp, Mus musculus
acaccctctgtctgtcatttgtg

SEQ ID NO: 181884 - DNA, 21 bp, Mus musculus
tgaaaagactctgggatgtct

SEQ ID NO: 181885 - DNA, 23 bp, Mus musculus
tttctctctctctctgattatcg

SEQ ID NO: 181886 - DNA, 22 bp, Mus musculus
acactccctgagtcacaccctg

SEQ ID NO: 181887 - DNA, 23 bp, Mus musculus
tctgtccttcattctgtctctct

SEQ ID NO: 181888 - DNA, 23 bp, Mus musculus
ggtcaatctctgagtctctgtga

SEQ ID NO: 181889 - DNA, 22 bp, Mus musculus
tgtgcagtatgctactgtgagc

SEQ ID NO: 181890 - DNA, 22 bp, Mus musculus
tgttttgtgaccaattatatgg

SEQ ID NO: 181891 - DNA, 23 bp, Mus musculus
gtgacatgtgggactgctgagtg

SEQ ID NO: 181892 - DNA, 22 bp, Mus musculus
acaccacccactctctcacttg

SEQ ID NO: 181893 - DNA, 23 bp, Mus musculus
atgtgtatgtatatatatgtgtg

SEQ ID NO: 181894 - DNA, 22 bp, Mus musculus
atagatgtacatatctatacat

SEQ ID NO: 181895 - DNA, 23 bp, Mus musculus
ttgctttctggatgtattctgtt

SEQ ID NO: 181896 - DNA, 23 bp, Mus musculus
tttctgtccatttgtaaagtgga

SEQ ID NO: 181897 - DNA, 19 bp, Mus musculus
acagagagacagagaccga

SEQ ID NO: 181898 - DNA, 21 bp, Mus musculus
actgcctcagtctctgtgagc

SEQ ID NO: 181899 - DNA, 18 bp, Mus musculus
tgggagaggatgagctta

SEQ ID NO: 181900 - DNA, 21 bp, Mus musculus
tcttacctggggagacagggg

SEQ ID NO: 181901 - DNA, 23 bp, Mus musculus
ctcccagagtattcatgttctgg

SEQ ID NO: 181902 - DNA, 23 bp, Mus musculus
tgttgttttgagacagggtctct

SEQ ID NO: 181903 - DNA, 21 bp, Mus musculus
tatatgtatttatgcatatgt

SEQ ID NO: 181904 - DNA, 23 bp, Mus musculus
gatgatgctctgcagaactctgt

SEQ ID NO: 181905 - DNA, 23 bp, Mus musculus
gagagtgaacagttactgcagac

SEQ ID NO: 181906 - DNA, 23 bp, Mus musculus
ggttcactctctgactccttctc

SEQ ID NO: 181907 - DNA, 23 bp, Mus musculus
gtatgtatgtatgtatgtatgta

SEQ ID NO: 181908 - DNA, 23 bp, Mus musculus
acaagagtctgcctgtctctgcc

SEQ ID NO: 181909 - DNA, 23 bp, Mus musculus
tatgtatgtatgtgtgtgtatat

SEQ ID NO: 181910 - DNA, 23 bp, Mus musculus
atatgtgtatatatatgtgtgtg

SEQ ID NO: 181911 - DNA, 23 bp, Mus musculus
gactattgtgtaagcttcataat

SEQ ID NO: 181912 - DNA, 19 bp, Mus musculus
ttaaagtgaggttaccata

SEQ ID NO: 181913 - DNA, 23 bp, Mus musculus
ctcaaagtgacagattatttttt

SEQ ID NO: 181914 - DNA, 22 bp, Mus musculus
tgagtacaaggaagtctgaccg

SEQ ID NO: 181915 - DNA, 23 bp, Mus musculus
ttaagagcactgactgctcttgc

SEQ ID NO: 181916 - DNA, 23 bp, Mus musculus
acgtcacatggtcctttggagaa

SEQ ID NO: 181917 - DNA, 19 bp, Mus musculus
gaaggtgagcttggggctg

SEQ ID NO: 181918 - DNA, 23 bp, Mus musculus
ttaagagcacatactgctcttac

SEQ ID NO: 181919 - DNA, 23 bp, Mus musculus
gtgtgtgtgtgtctgtgtgccat

SEQ ID NO: 181920 - DNA, 23 bp, Mus musculus
atatgtgtatatgtatatatgtg

SEQ ID NO: 181921 - DNA, 23 bp, Mus musculus
tgtgtatgtgtatatgtatacat

SEQ ID NO: 181922 - DNA, 22 bp, Mus musculus
atatgaatatatgtatagatga

SEQ ID NO: 181923 - DNA, 23 bp, Mus musculus
ttcagggtgaccgtaagagctgt

SEQ ID NO: 181924 - DNA, 23 bp, Mus musculus
actgagactgggagcttatcagt

SEQ ID NO: 181925 - DNA, 23 bp, Mus musculus
agcttaaagcttctactgattgg

SEQ ID NO: 181926 - DNA, 18 bp, Mus musculus
gtgcatacagatagagca

SEQ ID NO: 181927 - DNA, 23 bp, Mus musculus
gtgtgtgtctctgtgagtatatg

SEQ ID NO: 181928 - DNA, 23 bp, Mus musculus
tgtctgtctgtctgtctgtctat

SEQ ID NO: 181929 - DNA, 23 bp, Mus musculus
gcagtgtcaccctctctgcctgc

SEQ ID NO: 181930 - DNA, 22 bp, Mus musculus
tgttttgtgaccaattatatgg

SEQ ID NO: 181931 - DNA, 22 bp, Mus musculus
ttgggacaattttgagatgtca

SEQ ID NO: 181932 - DNA, 23 bp, Mus musculus
actctcagttgttcctgctgagt

SEQ ID NO: 181933 - DNA, 18 bp, Mus musculus
acatgaaggaataggtag

SEQ ID NO: 181934 - DNA, 21 bp, Mus musculus
taagagctctgactgctcttc

SEQ ID NO: 181935 - DNA, 21 bp, Mus musculus
taaacatgtatctgtggaggt

SEQ ID NO: 181936 - DNA, 23 bp, Mus musculus
tagttgtgtagtgatgttgtaca

SEQ ID NO: 181937 - DNA, 21 bp, Mus musculus
atatcacagtgaacatggctc

SEQ ID NO: 181938 - DNA, 19 bp, Mus musculus
aagccagtcgctgaaatga

SEQ ID NO: 181939 - DNA, 23 bp, Mus musculus
atgtctgtatgtgtgaatatgtc

SEQ ID NO: 181940 - DNA, 23 bp, Mus musculus
aagtgtaatgactgtgatcacaa

SEQ ID NO: 181941 - DNA, 19 bp, Mus musculus
caagaactctgacactgag

SEQ ID NO: 181942 - DNA, 23 bp, Mus musculus
gataggtctgacaaagaattctt

SEQ ID NO: 181943 - DNA, 23 bp, Mus musculus
tgcagagggagtgtttttgttgt

SEQ ID NO: 181944 - DNA, 23 bp, Mus musculus
agagaacacagttaccagacagt

SEQ ID NO: 181945 - DNA, 20 bp, Mus musculus
ctgcttgtgttcttttcatg

SEQ ID NO: 181946 - DNA, 23 bp, Mus musculus
tggcagagaagtgaattacatga

SEQ ID NO: 181947 - DNA, 22 bp, Mus musculus
ttagttctaccttgaatgactg

SEQ ID NO: 181948 - DNA, 21 bp, Mus musculus
gaatagacattatgtacttga

SEQ ID NO: 181949 - DNA, 22 bp, Mus musculus
tggcagggtacttatctggatg

SEQ ID NO: 181950 - DNA, 22 bp, Mus musculus
tatactctgagctcatgtctca

SEQ ID NO: 181951 - DNA, 22 bp, Mus musculus
tgttttgtgaccaattatatgg

SEQ ID NO: 181952 - DNA, 23 bp, Mus musculus
cagcctgcctctcagtgactcag

SEQ ID NO: 181953 - DNA, 23 bp, Mus musculus
tgtgtatatatatgtatgtgtat

SEQ ID NO: 181954 - DNA, 18 bp, Mus musculus
tatatgcatatgtatatg

SEQ ID NO: 181955 - DNA, 18 bp, Mus musculus
tactggaggggctggaga

SEQ ID NO: 181956 - DNA, 21 bp, Mus musculus
tgtctgaggagagagtggagt

SEQ ID NO: 181957 - DNA, 23 bp, Mus musculus
tgtgtctgtgtgtttatgtgtgt

SEQ ID NO: 181958 - DNA, 19 bp, Mus musculus
agacagacagacaaacacg

SEQ ID NO: 181959 - DNA, 22 bp, Mus musculus
tcaggggctgaaagagtggaag

SEQ ID NO: 181960 - DNA, 23 bp, Mus musculus
cagtggtcagtcatactctgtct

SEQ ID NO: 181961 - DNA, 23 bp, Mus musculus
cacactctgggtttctgtactgt

SEQ ID NO: 181962 - DNA, 19 bp, Mus musculus
agcaggattgaagagtggt

SEQ ID NO: 181963 - DNA, 23 bp, Mus musculus
tttttgaattacagctgggtttc

SEQ ID NO: 181964 - DNA, 23 bp, Mus musculus
cagatctgactgtctgtgtgcca

SEQ ID NO: 181965 - DNA, 23 bp, Mus musculus
ttatgagcttagttttcccagtg

SEQ ID NO: 181966 - DNA, 21 bp, Mus musculus
tcaattctcagcaaccatatg

SEQ ID NO: 181967 - DNA, 23 bp, Mus musculus
tacacttgagtgtcagctgacag

SEQ ID NO: 181968 - DNA, 22 bp, Mus musculus
aaatgggctgaaattcacctag

SEQ ID NO: 181969 - DNA, 23 bp, Mus musculus
cagtggctgtgagcatagcatct

SEQ ID NO: 181970 - DNA, 23 bp, Mus musculus
ctcactgtatctctgtctggctg

SEQ ID NO: 181971 - DNA, 21 bp, Mus musculus
gctagactcagagatctgttc

SEQ ID NO: 181972 - DNA, 20 bp, Mus musculus
actcagcctctctgggtctg

SEQ ID NO: 181973 - DNA, 22 bp, Mus musculus
tgttttgtgaccaattatatgg

SEQ ID NO: 181974 - DNA, 22 bp, Mus musculus
gaccatcatggtggagagcatg

SEQ ID NO: 181975 - DNA, 18 bp, Mus musculus
gtatgtatgtatgtatgc

SEQ ID NO: 181976 - DNA, 21 bp, Mus musculus
tatgcatatgtgcatgcacat

SEQ ID NO: 181977 - DNA, 20 bp, Mus musculus
actcctattgtagaagcttc

SEQ ID NO: 181978 - DNA, 19 bp, Mus musculus
agaaaattctagatggagt

SEQ ID NO: 181979 - DNA, 22 bp, Mus musculus
tgttttgtgaccaattatatgg

SEQ ID NO: 181980 - DNA, 23 bp, Mus musculus
tattgtcttgaacttgctatgaa

SEQ ID NO: 181981 - DNA, 23 bp, Mus musculus
tggaatgtaaagatgtttggaaa

SEQ ID NO: 181982 - DNA, 23 bp, Mus musculus
actgtcttcttgtgtttctccac

SEQ ID NO: 181983 - DNA, 22 bp, Mus musculus
tgttttgtgaccaattatatgg

SEQ ID NO: 181984 - DNA, 22 bp, Mus musculus
tgttttgtgaccaattatatgg

SEQ ID NO: 181985 - DNA, 23 bp, Mus musculus
tttcagagaatttgatatgtctt

SEQ ID NO: 181986 - DNA, 23 bp, Mus musculus
ctaagactgtgttttgtctctgt

SEQ ID NO: 181987 - DNA, 23 bp, Mus musculus
aatggcattgcttgatttgacgg

SEQ ID NO: 181988 - DNA, 23 bp, Mus musculus
tagtccatagtgatctgatagga

SEQ ID NO: 181989 - DNA, 22 bp, Mus musculus
tgttttgtgaccaattatatgg

SEQ ID NO: 181990 - DNA, 23 bp, Mus musculus
tgttcatggtggtctgataggat

SEQ ID NO: 181991 - DNA, 22 bp, Mus musculus
tgttttgtgaccaattatatgg

SEQ ID NO: 181992 - DNA, 22 bp, Mus musculus
tgttttgtgaccaattatatgg

SEQ ID NO: 181993 - DNA, 18 bp, Mus musculus
tgctgttttgtttgtttc

SEQ ID NO: 181994 - DNA, 22 bp, Mus musculus
aatctcagaagagactgaactg

SEQ ID NO: 181995 - DNA, 19 bp, Mus musculus
tatcagacagaagggatgt

SEQ ID NO: 181996 - DNA, 23 bp, Mus musculus
ttacttctgtctgtgtcttcttg

SEQ ID NO: 181997 - DNA, 21 bp, Mus musculus
cagaggtgtctgtctgtctat

SEQ ID NO: 181998 - DNA, 23 bp, Mus musculus
tagtgttagactatcctgtttgt

SEQ ID NO: 181999 - DNA, 21 bp, Mus musculus
tcaggatttcttgagcaggtc

SEQ ID NO: 182000 - DNA, 22 bp, Mus musculus
tgttttgtgaccaattatatgg

SEQ ID NO: 182001 - DNA, 22 bp, Mus musculus
ttcagtatatatatatgtgtgt

SEQ ID NO: 182002 - DNA, 23 bp, Mus musculus
taatcaggaggaaaaactgcttg

SEQ ID NO: 182003 - DNA, 23 bp, Mus musculus
tattagtctctggaaacccaacc

SEQ ID NO: 182004 - DNA, 22 bp, Mus musculus
tgagagaacacagtctgcttta

SEQ ID NO: 182005 - DNA, 22 bp, Mus musculus
tgttttgtgaccaattatatgg

SEQ ID NO: 182006 - DNA, 21 bp, Mus musculus
aaacgtagtggtttgttgtgt

SEQ ID NO: 182007 - DNA, 23 bp, Mus musculus
cgaagagacttgttctcctaagc

SEQ ID NO: 182008 - DNA, 23 bp, Mus musculus
gtatgtatgtatgtatgtatgtg

SEQ ID NO: 182009 - DNA, 20 bp, Mus musculus
tttataagtgttgccacggt

SEQ ID NO: 182010 - DNA, 23 bp, Mus musculus
tgtttgtcacagattaacctcag

SEQ ID NO: 182011 - DNA, 23 bp, Mus musculus
agaggaattctgcttattggctt

SEQ ID NO: 182012 - DNA, 23 bp, Mus musculus
aagcttctttcattttgtttgga

SEQ ID NO: 182013 - DNA, 22 bp, Mus musculus
tttctctctgtctctgggagag

SEQ ID NO: 182014 - DNA, 21 bp, Mus musculus
ttggaagaacaagttcatatt

SEQ ID NO: 182015 - DNA, 23 bp, Mus musculus
atcttgtgaatttgtattctcca

SEQ ID NO: 182016 - DNA, 22 bp, Mus musculus
tgttttgtgaccaattatatgg

SEQ ID NO: 182017 - DNA, 20 bp, Mus musculus
agtgtgtgtgtgtgtgtgtg

SEQ ID NO: 182018 - DNA, 23 bp, Mus musculus
tctctgtcacattctgccaagta

SEQ ID NO: 182019 - DNA, 19 bp, Mus musculus
tgtgtgtgtgtgtgtgtat

SEQ ID NO: 182020 - DNA, 21 bp, Mus musculus
agtctctatatctgtctccat

SEQ ID NO: 182021 - DNA, 20 bp, Mus musculus
atgtatatgtgtatatgtgt

SEQ ID NO: 182022 - DNA, 23 bp, Mus musculus
tctagtcattttctgttctttgg

SEQ ID NO: 182023 - DNA, 22 bp, Mus musculus
caatctctctgtctgtctctgg

SEQ ID NO: 182024 - DNA, 19 bp, Mus musculus
acagatgagagtcacttca

SEQ ID NO: 182025 - DNA, 23 bp, Mus musculus
tgtccctctgtgtgtctctctct

SEQ ID NO: 182026 - DNA, 22 bp, Mus musculus
tttaggtttgtaaggttttctt

SEQ ID NO: 182027 - DNA, 23 bp, Mus musculus
tctgtctgtctgtctgtctgtct

SEQ ID NO: 182028 - DNA, 23 bp, Mus musculus
acatggtcagtgtgtctctctcc

SEQ ID NO: 182029 - DNA, 23 bp, Mus musculus
acatgactcacaaactgcttagt

SEQ ID NO: 182030 - DNA, 21 bp, Mus musculus
tctgtcagtgtgtgtcacaca

SEQ ID NO: 182031 - DNA, 22 bp, Mus musculus
catctctccgtcacacactcat

SEQ ID NO: 182032 - DNA, 20 bp, Mus musculus
taagtctggcaatacatttt

SEQ ID NO: 182033 - DNA, 23 bp, Mus musculus
tgtatatgtatatatatgtatgt

SEQ ID NO: 182034 - DNA, 19 bp, Mus musculus
tggaaagaagtaggatatg

SEQ ID NO: 182035 - DNA, 20 bp, Mus musculus
aagccctttgttttcactct

SEQ ID NO: 182036 - DNA, 23 bp, Mus musculus
tctctctgtgtctgaattcatcg

SEQ ID NO: 182037 - DNA, 22 bp, Mus musculus
atgtgtgtgtgcatgtgcatgt

SEQ ID NO: 182038 - DNA, 20 bp, Mus musculus
tcctgcacaattagtggagt

SEQ ID NO: 182039 - DNA, 23 bp, Mus musculus
aaaacagttcagtctctgtgagc

SEQ ID NO: 182040 - DNA, 23 bp, Mus musculus
tcgctcactcactcactcactca

SEQ ID NO: 182041 - DNA, 19 bp, Mus musculus
cagtggctctctgcccctc

SEQ ID NO: 182042 - DNA, 23 bp, Mus musculus
catgcctgcctgcctgcctgcct

SEQ ID NO: 182043 - DNA, 22 bp, Mus musculus
tgttttgtgaccaattatatgg

SEQ ID NO: 182044 - DNA, 23 bp, Mus musculus
tgacagagtagtgatctctaagc

SEQ ID NO: 182045 - DNA, 23 bp, Mus musculus
gtgtgtgtattctttgagaatct

SEQ ID NO: 182046 - DNA, 20 bp, Mus musculus
tcagcttcctcacgtagcag

SEQ ID NO: 182047 - DNA, 21 bp, Mus musculus
aaggaccatgtgaaggaggtt

SEQ ID NO: 182048 - DNA, 23 bp, Mus musculus
ttaagagcactcactgctctttc

SEQ ID NO: 182049 - DNA, 22 bp, Mus musculus
tatgtgtgtgtatttatatatg

SEQ ID NO: 182050 - DNA, 23 bp, Mus musculus
tacatgtatatatgtatatgtgt

SEQ ID NO: 182051 - DNA, 23 bp, Mus musculus
ctctgcctgactcactccctgtc

SEQ ID NO: 182052 - DNA, 23 bp, Mus musculus
atttgtgtctgtcactctctctc

SEQ ID NO: 182053 - DNA, 23 bp, Mus musculus
aacagtgaactgtctctctgtcg

SEQ ID NO: 182054 - DNA, 22 bp, Mus musculus
tagcagcacatcatggtttaca

SEQ ID NO: 182055 - DNA, 21 bp, Mus musculus
ttgctgctctagaaatttaag

SEQ ID NO: 182056 - DNA, 23 bp, Mus musculus
tagcagcacgtaaatattggcgt

SEQ ID NO: 182057 - DNA, 21 bp, Mus musculus
aacaccaatattattgtgctg

SEQ ID NO: 182058 - DNA, 23 bp, Mus musculus
tcactgaagagagttagctgctg

SEQ ID NO: 182059 - DNA, 20 bp, Mus musculus
gcatcaactcgcttttcact

SEQ ID NO: 182060 - DNA, 23 bp, Mus musculus
aagaagattctgagagcttctga

SEQ ID NO: 182061 - DNA, 19 bp, Mus musculus
agagaagagtctgaggtct

SEQ ID NO: 182062 - DNA, 22 bp, Mus musculus
gtatgcatgtatgtatatatgt

SEQ ID NO: 182063 - DNA, 21 bp, Mus musculus
agtctaggctgtgtttggcaa

SEQ ID NO: 182064 - DNA, 20 bp, Mus musculus
aaggcagtaggagatctcac

SEQ ID NO: 182065 - DNA, 23 bp, Mus musculus
ggggctcacagactgtctctcag

SEQ ID NO: 182066 - DNA, 22 bp, Mus musculus
tgttttgtgaccaattatatgg

SEQ ID NO: 182067 - DNA, 22 bp, Mus musculus
tgttttgtgaccaattatatgg

SEQ ID NO: 182068 - DNA, 21 bp, Mus musculus
taggtacctactagttcctgc

SEQ ID NO: 182069 - DNA, 22 bp, Mus musculus
tagtggttctattcttgagtaa

SEQ ID NO: 182070 - DNA, 22 bp, Mus musculus
aattgctggtgtgtgacacttt

SEQ ID NO: 182071 - DNA, 22 bp, Mus musculus
tatatgtatatgtatatgtata

SEQ ID NO: 182072 - DNA, 23 bp, Mus musculus
tctctgtgtgtttttgtgcaatg

SEQ ID NO: 182073 - DNA, 23 bp, Mus musculus
aatgtgtgtgaaatattaaagca

SEQ ID NO: 182074 - DNA, 22 bp, Mus musculus
cactctgtctaaagtgcttggt

SEQ ID NO: 182075 - DNA, 21 bp, Mus musculus
gatctcaggctgtctctctgt

SEQ ID NO: 182076 - DNA, 23 bp, Mus musculus
tctgactgtggctgtgtgtggaa

SEQ ID NO: 182077 - DNA, 23 bp, Mus musculus
tgtatgaatgtatgtgtgtgcat

SEQ ID NO: 182078 - DNA, 23 bp, Mus musculus
aattgagaccttttcaacaacaa

SEQ ID NO: 182079 - DNA, 23 bp, Mus musculus
aagacagggggattttgatggga

SEQ ID NO: 182080 - DNA, 18 bp, Mus musculus
tatcagcttgtcttagat

SEQ ID NO: 182081 - DNA, 21 bp, Mus musculus
aaagaagaaggtagctaagaa

SEQ ID NO: 182082 - DNA, 22 bp, Mus musculus
tgttttgtgaccaattatatgg

SEQ ID NO: 182083 - DNA, 19 bp, Mus musculus
tatgtacatatatgtgtag

SEQ ID NO: 182084 - DNA, 23 bp, Mus musculus
tatgtatatgtatacacatacat

SEQ ID NO: 182085 - DNA, 22 bp, Mus musculus
tgttttgtgaccaattatatgg

SEQ ID NO: 182086 - DNA, 23 bp, Mus musculus
tttatacatatgtatacttgtgt

SEQ ID NO: 182087 - DNA, 23 bp, Mus musculus
atgattagagtgttagatcttgt

SEQ ID NO: 182088 - DNA, 18 bp, Mus musculus
cagactcctttgtgatga

SEQ ID NO: 182089 - DNA, 23 bp, Mus musculus
caattctcaccaatagttagctt

SEQ ID NO: 182090 - DNA, 22 bp, Mus musculus
tgttttgtgaccaattatatgg

SEQ ID NO: 182091 - DNA, 23 bp, Mus musculus
gaaagagtgaatggacacagtta

SEQ ID NO: 182092 - DNA, 22 bp, Mus musculus
gtctttagtgtatggatggtct

SEQ ID NO: 182093 - DNA, 23 bp, Mus musculus
atctctgagccattattatctca

SEQ ID NO: 182094 - DNA, 23 bp, Mus musculus
catctttcaggtaggacatgttg

SEQ ID NO: 182095 - DNA, 23 bp, Mus musculus
cctcttatctcctcacagtgttc

SEQ ID NO: 182096 - DNA, 23 bp, Mus musculus
tagtgcatggtgatctgatagga

SEQ ID NO: 182097 - DNA, 22 bp, Mus musculus
tgttttgtgacctattatgtgg

SEQ ID NO: 182098 - DNA, 18 bp, Mus musculus
agaacttctcttggtgtc

SEQ ID NO: 182099 - DNA, 21 bp, Mus musculus
tggaggcctggtagtttctgc

SEQ ID NO: 182100 - DNA, 18 bp, Mus musculus
tagacgtgtgtatcctca

SEQ ID NO: 182101 - DNA, 22 bp, Mus musculus
tatgttatgatatgatatgata

SEQ ID NO: 182102 - DNA, 22 bp, Mus musculus
atatggtatgatatgaagtcac

SEQ ID NO: 182103 - DNA, 23 bp, Mus musculus
gaaatggctggcactctgtattc

SEQ ID NO: 182104 - DNA, 23 bp, Mus musculus
tgggtcagaatctttatgagtgt

SEQ ID NO: 182105 - DNA, 23 bp, Mus musculus
tcaatatttttgtatctgttgag

SEQ ID NO: 182106 - DNA, 21 bp, Mus musculus
atcagctggtgtatgctgcct

SEQ ID NO: 182107 - DNA, 23 bp, Mus musculus
aagagcactgactgctcttccac

SEQ ID NO: 182108 - DNA, 23 bp, Mus musculus
tgtgtgtgtgtgtgtgtatactg

SEQ ID NO: 182109 - DNA, 23 bp, Mus musculus
cagtgtcagatcacctggaactg

SEQ ID NO: 182110 - DNA, 23 bp, Mus musculus
tgtgtactgacatgtgggtgctg

SEQ ID NO: 182111 - DNA, 23 bp, Mus musculus
ggtctgtctgtctgtctgtctgt

SEQ ID NO: 182112 - DNA, 23 bp, Mus musculus
tagtccatggtgatctgatagga

SEQ ID NO: 182113 - DNA, 22 bp, Mus musculus
tgttttgtgaccaattatatgg

SEQ ID NO: 182114 - DNA, 20 bp, Mus musculus
tctatctgtgtgtgtatata

SEQ ID NO: 182115 - DNA, 22 bp, Mus musculus
tatatgtatacatatgcaatcc

SEQ ID NO: 182116 - DNA, 23 bp, Mus musculus
atcatggaggaacatcttagcat

SEQ ID NO: 182117 - DNA, 23 bp, Mus musculus
gctgtgagcatctgcatctgtat

SEQ ID NO: 182118 - DNA, 23 bp, Mus musculus
tctctctctctctctctgtatgt

SEQ ID NO: 182119 - DNA, 22 bp, Mus musculus
tgttttgtgaccaattatatgg

SEQ ID NO: 182120 - DNA, 23 bp, Mus musculus
tccattgatctatctgtctgtca

SEQ ID NO: 182121 - DNA, 23 bp, Mus musculus
tttgtagtacagcttgaggtcag

SEQ ID NO: 182122 - DNA, 18 bp, Mus musculus
tgtctgtatacggatggg

SEQ ID NO: 182123 - DNA, 23 bp, Mus musculus
acaatcacacacatatatatatg

SEQ ID NO: 182124 - DNA, 23 bp, Mus musculus
atgtatgtatgtatgtatgtatg

SEQ ID NO: 182125 - DNA, 19 bp, Mus musculus
tggatttcttcagggtttg

SEQ ID NO: 182126 - DNA, 20 bp, Mus musculus
attttcaatgttactgaata

SEQ ID NO: 182127 - DNA, 22 bp, Mus musculus
tgttttgtgaccaattatatgg

SEQ ID NO: 182128 - DNA, 22 bp, Mus musculus
tgttttgtgaccaattatatgg

SEQ ID NO: 182129 - DNA, 23 bp, Mus musculus
tttgtatttgtatttgactcagc

SEQ ID NO: 182130 - DNA, 22 bp, Mus musculus
tatcaagttgcagtctcgcact

SEQ ID NO: 182131 - DNA, 21 bp, Mus musculus
ttactgcaacttgatatgaca

SEQ ID NO: 182132 - DNA, 22 bp, Mus musculus
tgttttgtgaccaattatatgg

SEQ ID NO: 182133 - DNA, 23 bp, Mus musculus
cacactgtactgtcattgctgtg

SEQ ID NO: 182134 - DNA, 23 bp, Mus musculus
tagtccgtggtgatcagatagga

SEQ ID NO: 182135 - DNA, 23 bp, Mus musculus
gttttgtgaccaactatatggtc

SEQ ID NO: 182136 - DNA, 23 bp, Mus musculus
cacactgagagaggagacacagg

SEQ ID NO: 182137 - DNA, 23 bp, Mus musculus
aagagcactgactgctcttccag

SEQ ID NO: 182138 - DNA, 23 bp, Mus musculus
tgagtgtaatagatgtgtgtgtg

SEQ ID NO: 182139 - DNA, 21 bp, Mus musculus
tgtctctgagtctgtttatgg

SEQ ID NO: 182140 - DNA, 23 bp, Mus musculus
tatttaacagattttcttgtttg

SEQ ID NO: 182141 - DNA, 23 bp, Mus musculus
agcttcctgctctgactgccata

SEQ ID NO: 182142 - DNA, 22 bp, Mus musculus
tgttttgtgaccaattatatgg

SEQ ID NO: 182143 - DNA, 23 bp, Mus musculus
ttctctgtggttctctctgagtc

SEQ ID NO: 182144 - DNA, 23 bp, Mus musculus
ctgtggccctgtgatgtagttca

SEQ ID NO: 182145 - DNA, 20 bp, Mus musculus
tgtatgtatgtatatgtgtg

SEQ ID NO: 182146 - DNA, 23 bp, Mus musculus
catgtgtgtacatatgtctatgc

SEQ ID NO: 182147 - DNA, 21 bp, Mus musculus
tatctgagacactgactcacg

SEQ ID NO: 182148 - DNA, 22 bp, Mus musculus
tgtatgcaattgatgtatatga

SEQ ID NO: 182149 - DNA, 23 bp, Mus musculus
tatatatgtacaaattgcagata

SEQ ID NO: 182150 - DNA, 22 bp, Mus musculus
tgttttgtgaccaattatatgg

SEQ ID NO: 182151 - DNA, 23 bp, Mus musculus
agaatccactgtgaatatgaagt

SEQ ID NO: 182152 - DNA, 22 bp, Mus musculus
tcactcttgttatgtgcttgta

SEQ ID NO: 182153 - DNA, 22 bp, Mus musculus
aatagaagcaaatgagcagaga

SEQ ID NO: 182154 - DNA, 22 bp, Mus musculus
tgttttgtgaccaattatatgg

SEQ ID NO: 182155 - DNA, 22 bp, Mus musculus
tgttttgtgaccaattatatgg

SEQ ID NO: 182156 - DNA, 21 bp, Mus musculus
atatgaatgaaatgctataca

SEQ ID NO: 182157 - DNA, 22 bp, Mus musculus
tgttttgtgaccaattatatgg

SEQ ID NO: 182158 - DNA, 23 bp, Mus musculus
gttaaaggtaagtaaggttttgt

SEQ ID NO: 182159 - DNA, 23 bp, Mus musculus
cattgtcaatttgttaatctgag

SEQ ID NO: 182160 - DNA, 23 bp, Mus musculus
atctcagaatgaattagttttgt

SEQ ID NO: 182161 - DNA, 20 bp, Mus musculus
gtatgtatgtatgtgtgtgt

SEQ ID NO: 182162 - DNA, 23 bp, Mus musculus
tgtatacacacacacatatatat

SEQ ID NO: 182163 - DNA, 23 bp, Mus musculus
aagtttctttttataagttgctt

SEQ ID NO: 182164 - DNA, 23 bp, Mus musculus
ttgtcacagcaactgaaaagtga

SEQ ID NO: 182165 - DNA, 20 bp, Mus musculus
ttgaagaacacatttgaatt

SEQ ID NO: 182166 - DNA, 23 bp, Mus musculus
tgtatgtatgtatgtatgtatgt

SEQ ID NO: 182167 - DNA, 22 bp, Mus musculus
cagtcacagcatacacacacac

SEQ ID NO: 182168 - DNA, 23 bp, Mus musculus
ctgtgatgtcatctggtacagat

SEQ ID NO: 182169 - DNA, 23 bp, Mus musculus
cctctgtctctatgaattcacat

SEQ ID NO: 182170 - DNA, 23 bp, Mus musculus
atacaagtatatctgtatatctt

SEQ ID NO: 182171 - DNA, 23 bp, Mus musculus
tagtgtgtatatgtaatatatag

SEQ ID NO: 182172 - DNA, 23 bp, Mus musculus
cactgcctctgtctcaggctccc

SEQ ID NO: 182173 - DNA, 20 bp, Mus musculus
attgagagttatgaagtatg

SEQ ID NO: 182174 - DNA, 23 bp, Mus musculus
aattcatgacattttgttgggtt

SEQ ID NO: 182175 - DNA, 20 bp, Mus musculus
ttaaatgtttgatagatttc

SEQ ID NO: 182176 - DNA, 22 bp, Mus musculus
agagagaagggagtgagctaag

SEQ ID NO: 182177 - DNA, 23 bp, Mus musculus
ctcagactctctcatggggagtg

SEQ ID NO: 182178 - DNA, 21 bp, Mus musculus
taagtctatgaagagggtaag

SEQ ID NO: 182179 - DNA, 20 bp, Mus musculus
ctcactcttatgtgtgtgtg

SEQ ID NO: 182180 - DNA, 19 bp, Mus musculus
tgtcctttcctaaagagaa

SEQ ID NO: 182181 - DNA, 22 bp, Mus musculus
tgtgtctctgtgtgttcatgtt

SEQ ID NO: 182182 - DNA, 23 bp, Mus musculus
ctggctcacagtttgcgaatgca

SEQ ID NO: 182183 - DNA, 21 bp, Mus musculus
ttatggtatcttaagatctgt

SEQ ID NO: 182184 - DNA, 21 bp, Mus musculus
atgagattcatgcctgctgaa

SEQ ID NO: 182185 - DNA, 19 bp, Mus musculus
tgcttctgtgttcaggaga

SEQ ID NO: 182186 - DNA, 23 bp, Mus musculus
ggacatctctctgacactgcctg

SEQ ID NO: 182187 - DNA, 23 bp, Mus musculus
aggtgcctgtcctgtcaccccac

SEQ ID NO: 182188 - DNA, 21 bp, Mus musculus
tcccagggccatcaatatcag

SEQ ID NO: 182189 - DNA, 20 bp, Mus musculus
agctaagtgaccatctactt

SEQ ID NO: 182190 - DNA, 20 bp, Mus musculus
acagtgtgcacagtggcctg

SEQ ID NO: 182191 - DNA, 21 bp, Mus musculus
tgaaatgaagtaagtctctgg

SEQ ID NO: 182192 - DNA, 21 bp, Mus musculus
gtgggtggctgtggggctgga

SEQ ID NO: 182193 - DNA, 23 bp, Mus musculus
atggctgtccctgaaagtactga

SEQ ID NO: 182194 - DNA, 23 bp, Mus musculus
tgtgtgtgtgcatgtgcatgtgt

SEQ ID NO: 182195 - DNA, 18 bp, Mus musculus
tgccaggattacaggtgt

SEQ ID NO: 182196 - DNA, 22 bp, Mus musculus
acttgagcttgtagtcctgttt

SEQ ID NO: 182197 - DNA, 23 bp, Mus musculus
tttccttgagtttgtgacccttt

SEQ ID NO: 182198 - DNA, 21 bp, Mus musculus
aagtgacatgtgactgtgatc

SEQ ID NO: 182199 - DNA, 23 bp, Mus musculus
actctggaactctgtgtcactgt

SEQ ID NO: 182200 - DNA, 20 bp, Mus musculus
tctgttaaactattgattct

SEQ ID NO: 182201 - DNA, 22 bp, Mus musculus
caacagtgtgcagacagtgctc

SEQ ID NO: 182202 - DNA, 18 bp, Mus musculus
aggtgtgacaggtgtgtg

SEQ ID NO: 182203 - DNA, 22 bp, Mus musculus
tctatctctctgtgtgtccttg

SEQ ID NO: 182204 - DNA, 23 bp, Mus musculus
tttaagtcctctctcactgactc

SEQ ID NO: 182205 - DNA, 23 bp, Mus musculus
tctgcccgtctgtctgtctgtat

SEQ ID NO: 182206 - DNA, 22 bp, Mus musculus
tacatatgtgtgtttatgtata

SEQ ID NO: 182207 - DNA, 23 bp, Mus musculus
tcagctacttagtgagcttgata

SEQ ID NO: 182208 - DNA, 19 bp, Mus musculus
tcactgtgtatcactgtgt

SEQ ID NO: 182209 - DNA, 23 bp, Mus musculus
gtttaagacagtctggtttacat

SEQ ID NO: 182210 - DNA, 23 bp, Mus musculus
tctagtgaaacccagagttatat

SEQ ID NO: 182211 - DNA, 22 bp, Mus musculus
tgttttgtgaccaattatatgg

SEQ ID NO: 182212 - DNA, 18 bp, Mus musculus
tttctgctacctagattt

SEQ ID NO: 182213 - DNA, 23 bp, Mus musculus
cactgtccatgccctttcactgt

SEQ ID NO: 182214 - DNA, 23 bp, Mus musculus
ctgctgagtgactgtcagtatat

SEQ ID NO: 182215 - DNA, 23 bp, Mus musculus
gtgctgagtgatgtgggtgagga

SEQ ID NO: 182216 - DNA, 23 bp, Mus musculus
tacatacacacatatgtgtacat

SEQ ID NO: 182217 - DNA, 18 bp, Mus musculus
tgtgtgtatgtagctagt

SEQ ID NO: 182218 - DNA, 18 bp, Mus musculus
agtgcacacagactcaca

SEQ ID NO: 182219 - DNA, 18 bp, Mus musculus
ggtcagagtctcaggtgc

SEQ ID NO: 182220 - DNA, 22 bp, Mus musculus
ctctgactggctgtctctcttc

SEQ ID NO: 182221 - DNA, 22 bp, Mus musculus
agtgtggaagacatagcctttc

SEQ ID NO: 182222 - DNA, 23 bp, Mus musculus
agcagaggcagctgtctctctct

SEQ ID NO: 182223 - DNA, 21 bp, Mus musculus
atgtgtgtgtatatatatgtg

SEQ ID NO: 182224 - DNA, 23 bp, Mus musculus
tttgcatatatatagatgttttg

SEQ ID NO: 182225 - DNA, 20 bp, Mus musculus
accacttctctctgtgtctc

SEQ ID NO: 182226 - DNA, 23 bp, Mus musculus
tgactggtagactagtgatcatc

SEQ ID NO: 182227 - DNA, 22 bp, Mus musculus
tgaccaggtcatctcaagctta

SEQ ID NO: 182228 - DNA, 22 bp, Mus musculus
tatattgtatatgtatatgtgt

SEQ ID NO: 182229 - DNA, 23 bp, Mus musculus
tggagtgttaagaagtaagacca

SEQ ID NO: 182230 - DNA, 22 bp, Mus musculus
agacagaacagtgacaggaagg

SEQ ID NO: 182231 - DNA, 23 bp, Mus musculus
tgtgtatacatatgtatatgtat

SEQ ID NO: 182232 - DNA, 23 bp, Mus musculus
tctttggttatctagctgtatga

SEQ ID NO: 182233 - DNA, 22 bp, Mus musculus
ataaagctagataaccgaaagt

SEQ ID NO: 182234 - DNA, 18 bp, Mus musculus
gacagctacagtgtgcta

SEQ ID NO: 182235 - DNA, 23 bp, Mus musculus
ttatgtgaatatgtacatatatg

SEQ ID NO: 182236 - DNA, 22 bp, Mus musculus
tagatctcccttgagtgagagg

SEQ ID NO: 182237 - DNA, 18 bp, Mus musculus
tgccttatttttgttaag

SEQ ID NO: 182238 - DNA, 19 bp, Mus musculus
acaggtgagagagtgcaga

SEQ ID NO: 182239 - DNA, 19 bp, Mus musculus
ctgggacccagagtggttg

SEQ ID NO: 182240 - DNA, 23 bp, Mus musculus
ctctctcacagtgcctttcaggc

SEQ ID NO: 182241 - DNA, 23 bp, Mus musculus
tgtcttcttctggctctcatgtt

SEQ ID NO: 182242 - DNA, 20 bp, Mus musculus
cactcagtgtctgtgtgggc

SEQ ID NO: 182243 - DNA, 21 bp, Mus musculus
ggttcaacatgtaaagtgcct

SEQ ID NO: 182244 - DNA, 23 bp, Mus musculus
tgggcatgactgactgactgtct

SEQ ID NO: 182245 - DNA, 23 bp, Mus musculus
ctctgactgctcttccagaggtc

SEQ ID NO: 182246 - DNA, 23 bp, Mus musculus
aggttgtatgtatgtatgtatgt

SEQ ID NO: 182247 - DNA, 23 bp, Mus musculus
actttggttctctctcagtctgt

SEQ ID NO: 182248 - DNA, 20 bp, Mus musculus
tcagagcccctagacttgga

SEQ ID NO: 182249 - DNA, 23 bp, Mus musculus
gactagtctggacaacttagtga

SEQ ID NO: 182250 - DNA, 23 bp, Mus musculus
tctggatatgtgtacttccacac

SEQ ID NO: 182251 - DNA, 20 bp, Mus musculus
agacactagacagaggcctg

SEQ ID NO: 182252 - DNA, 22 bp, Mus musculus
ttgtctatatatgtatatgttc

SEQ ID NO: 182253 - DNA, 22 bp, Mus musculus
gtgtgtaaagtgagaggacaca

SEQ ID NO: 182254 - DNA, 23 bp, Mus musculus
tctgtctgtctgcttacctattt

SEQ ID NO: 182255 - DNA, 23 bp, Mus musculus
catgccagtcccactgtttctct

SEQ ID NO: 182256 - DNA, 23 bp, Mus musculus
tgtgggtctgactgtctctcaga

SEQ ID NO: 182257 - DNA, 22 bp, Mus musculus
tgggagtctgctagtctggagc

SEQ ID NO: 182258 - DNA, 21 bp, Mus musculus
tgtgagtgcaatagcttttct

SEQ ID NO: 182259 - DNA, 23 bp, Mus musculus
gtgtgtctgacccactgtgagtc

SEQ ID NO: 182260 - DNA, 22 bp, Mus musculus
atgttcaattccagcacccaca

SEQ ID NO: 182261 - DNA, 22 bp, Mus musculus
atgagagccagctttctagaga

SEQ ID NO: 182262 - DNA, 23 bp, Mus musculus
taagacatgttggctgcttgtac

SEQ ID NO: 182263 - DNA, 23 bp, Mus musculus
tcacccactcacagtctcacttc

SEQ ID NO: 182264 - DNA, 23 bp, Mus musculus
tgactctttatctctctcctctg

SEQ ID NO: 182265 - DNA, 23 bp, Mus musculus
ctgtgagtctgtctctttcacct

SEQ ID NO: 182266 - DNA, 23 bp, Mus musculus
tgggtctcagcatctatgttgaa

SEQ ID NO: 182267 - DNA, 21 bp, Mus musculus
tccatggtggtctgataggat

SEQ ID NO: 182268 - DNA, 22 bp, Mus musculus
attacagatgattgtgagctgt

SEQ ID NO: 182269 - DNA, 23 bp, Mus musculus
tatgtgtatatatatatgtgtgt

SEQ ID NO: 182270 - DNA, 23 bp, Mus musculus
gtatgtctatatatatgtgtgtg

SEQ ID NO: 182271 - DNA, 23 bp, Mus musculus
tgatcagagtatttgtgctatct

SEQ ID NO: 182272 - DNA, 19 bp, Mus musculus
tctggggctgttattattg

SEQ ID NO: 182273 - DNA, 18 bp, Mus musculus
agcatctactttttgcat

SEQ ID NO: 182274 - DNA, 22 bp, Mus musculus
aaagaaccaggaaaggatgctg

SEQ ID NO: 182275 - DNA, 22 bp, Mus musculus
atgtatgtatatgtatatgcat

SEQ ID NO: 182276 - DNA, 22 bp, Mus musculus
tgcatatgcatatgtatacgta

SEQ ID NO: 182277 - DNA, 20 bp, Mus musculus
tgagaatcttcaccaagagg

SEQ ID NO: 182278 - DNA, 22 bp, Mus musculus
tgttttgtgaccaattatatgg

SEQ ID NO: 182279 - DNA, 23 bp, Mus musculus
tgatcagagaagtatgtgagcag

SEQ ID NO: 182280 - DNA, 19 bp, Mus musculus
gtatatatgaatatgtgtg

SEQ ID NO: 182281 - DNA, 19 bp, Mus musculus
aatgtatatgtttatgtgt

SEQ ID NO: 182282 - DNA, 21 bp, Mus musculus
agacttgactctctttcagac

SEQ ID NO: 182283 - DNA, 20 bp, Mus musculus
gctgagtactctctgatgca

SEQ ID NO: 182284 - DNA, 21 bp, Mus musculus
atatatgtattcaaggatact

SEQ ID NO: 182285 - DNA, 20 bp, Mus musculus
tgtgtgtatgtacatatatg

SEQ ID NO: 182286 - DNA, 23 bp, Mus musculus
tatgtgtgtgcatatatatatat

SEQ ID NO: 182287 - DNA, 18 bp, Mus musculus
tccttctgagaggctaag

SEQ ID NO: 182288 - DNA, 23 bp, Mus musculus
tccgtgtctgtgtctgtgcatgc

SEQ ID NO: 182289 - DNA, 19 bp, Mus musculus
tgtgtgtatatatgtgtgt

SEQ ID NO: 182290 - DNA, 23 bp, Mus musculus
acttgagctcatttctcaggacc

SEQ ID NO: 182291 - DNA, 22 bp, Mus musculus
gtttcttcttgagttcctctct

SEQ ID NO: 182292 - DNA, 19 bp, Mus musculus
ggtctctcactgagtctga

SEQ ID NO: 182293 - DNA, 22 bp, Mus musculus
agctggattgaactgggctgag

SEQ ID NO: 182294 - DNA, 23 bp, Mus musculus
aaaactcagagttcagagacaca

SEQ ID NO: 182295 - DNA, 23 bp, Mus musculus
agctctgactggctgttctttat

SEQ ID NO: 182296 - DNA, 23 bp, Mus musculus
agagtgagcagagactgagcagt

SEQ ID NO: 182297 - DNA, 22 bp, Mus musculus
tgttttgtgaccaattatatgg

SEQ ID NO: 182298 - DNA, 23 bp, Mus musculus
gtgagccactgtgtctgtctgag

SEQ ID NO: 182299 - DNA, 23 bp, Mus musculus
gtgagccactgtgtctgtctgag

SEQ ID NO: 182300 - DNA, 23 bp, Mus musculus
gtgagccactgtgtctgtctgag

SEQ ID NO: 182301 - DNA, 21 bp, Mus musculus
tgtgacaggctgacctgtgac

SEQ ID NO: 182302 - DNA, 23 bp, Mus musculus
tgtgagtgtcctgacagtggtga

SEQ ID NO: 182303 - DNA, 23 bp, Mus musculus
ctctgtcactgattctaaaggtt

SEQ ID NO: 182304 - DNA, 21 bp, Mus musculus
tatgttagatatgccagacat

SEQ ID NO: 182305 - DNA, 23 bp, Mus musculus
aagagtgtagctgcaagtctgtg

SEQ ID NO: 182306 - DNA, 22 bp, Mus musculus
tgttttgtgaccaattatatgg

SEQ ID NO: 182307 - DNA, 23 bp, Mus musculus
tctgtgtgtctgtctgtgcccca

SEQ ID NO: 182308 - DNA, 20 bp, Mus musculus
aagagcactgactgctcttc

SEQ ID NO: 182309 - DNA, 22 bp, Mus musculus
aggcagtgttctgagtagctgt

SEQ ID NO: 182310 - DNA, 23 bp, Mus musculus
tggaacttgctatgtaaatcaga

SEQ ID NO: 182311 - DNA, 23 bp, Mus musculus
agtgtctgtctgtctgtctgatg

SEQ ID NO: 182312 - DNA, 19 bp, Mus musculus
aggcaagaagagggtttag

SEQ ID NO: 182313 - DNA, 20 bp, Mus musculus
tgtatgtatgtagtatgtgc

SEQ ID NO: 182314 - DNA, 23 bp, Mus musculus
tggtacaggggctggacagatgg

SEQ ID NO: 182315 - DNA, 23 bp, Mus musculus
tcaatttccagcaactacatggt

SEQ ID NO: 182316 - DNA, 23 bp, Mus musculus
ctcacaaccatctgtaataggat

SEQ ID NO: 182317 - DNA, 22 bp, Mus musculus
taagagcaagatcaaacaagat

SEQ ID NO: 182318 - DNA, 23 bp, Mus musculus
aacttgtgtttgaaaatgatggt

SEQ ID NO: 182319 - DNA, 23 bp, Mus musculus
gtgcctgtgaccctgtgaccctg

SEQ ID NO: 182320 - DNA, 23 bp, Mus musculus
aagtagagcggcagcaatggatc

SEQ ID NO: 182321 - DNA, 23 bp, Mus musculus
gttgagagttaacacagtggtgt

SEQ ID NO: 182322 - DNA, 23 bp, Mus musculus
ttgtctgcctgactgttagccac

SEQ ID NO: 182323 - DNA, 22 bp, Mus musculus
tggctcagaccttgctgccact

SEQ ID NO: 182324 - DNA, 18 bp, Mus musculus
ctagatggttctattgtt

SEQ ID NO: 182325 - DNA, 23 bp, Mus musculus
atatgtatatatacatatgtgtg

SEQ ID NO: 182326 - DNA, 23 bp, Mus musculus
gaggaggcatgatgtttggaaag

SEQ ID NO: 182327 - DNA, 23 bp, Mus musculus
agacagtcagtgactctctcgca

SEQ ID NO: 182328 - DNA, 23 bp, Mus musculus
cctgtaagagattttcttgatct

SEQ ID NO: 182329 - DNA, 23 bp, Mus musculus
tgtgtgtgtgtgtgcacatgcat

SEQ ID NO: 182330 - DNA, 23 bp, Mus musculus
tctgtgtgcaagtgcatgtattt

SEQ ID NO: 182331 - DNA, 18 bp, Mus musculus
tttggtgatgagacagcc

SEQ ID NO: 182332 - DNA, 22 bp, Mus musculus
gttgggactcaggttgggaatt

SEQ ID NO: 182333 - DNA, 23 bp, Mus musculus
tgtctgtgtgtgcacttgctagt

SEQ ID NO: 182334 - DNA, 23 bp, Mus musculus
gagtctctgtccctgagacccag

SEQ ID NO: 182335 - DNA, 20 bp, Mus musculus
tctgagaactgagagagcag

SEQ ID NO: 182336 - DNA, 22 bp, Mus musculus
ttagtcagactttctttcttat

SEQ ID NO: 182337 - DNA, 23 bp, Mus musculus
ctctgaatctgtctggtactcac

SEQ ID NO: 182338 - DNA, 22 bp, Mus musculus
gtttggtgagtttttcctggct

SEQ ID NO: 182339 - DNA, 23 bp, Mus musculus
tataagccccattttcaagtgga

SEQ ID NO: 182340 - DNA, 19 bp, Mus musculus
tcacaatagacagtgagca

SEQ ID NO: 182341 - DNA, 23 bp, Mus musculus
tcagactgtgacttaggtgttgg

SEQ ID NO: 182342 - DNA, 22 bp, Mus musculus
tataatgtatgtgtatgtgtgt

SEQ ID NO: 182343 - DNA, 22 bp, Mus musculus
tctctgactgcctgtctctcag

SEQ ID NO: 182344 - DNA, 23 bp, Mus musculus
tgtgcatgtgtgtgtgcatgtgc

SEQ ID NO: 182345 - DNA, 23 bp, Mus musculus
agatcactgactgctcttgcagt

SEQ ID NO: 182346 - DNA, 23 bp, Mus musculus
ctctgtagacagtagtgtgtgtg

SEQ ID NO: 182347 - DNA, 23 bp, Mus musculus
tgtagacagtagtgtgtgtggtg

SEQ ID NO: 182348 - DNA, 23 bp, Mus musculus
ctctgtagacagtagtgtgtgtg

SEQ ID NO: 182349 - DNA, 23 bp, Mus musculus
tgtagacagtagtgtgtgtggtg

SEQ ID NO: 182350 - DNA, 23 bp, Mus musculus
ctctgtagacagtagtgtgtgtg

SEQ ID NO: 182351 - DNA, 18 bp, Mus musculus
tgtctgttggatgtttag

SEQ ID NO: 182352 - DNA, 23 bp, Mus musculus
aaagtctcagataagttttactc

SEQ ID NO: 182353 - DNA, 23 bp, Mus musculus
acaggactcactgactccatgca

SEQ ID NO: 182354 - DNA, 21 bp, Mus musculus
caaaggtcttgtggctgggtt

SEQ ID NO: 182355 - DNA, 22 bp, Mus musculus
aactgcttgaagagctggtatt

SEQ ID NO: 182356 - DNA, 21 bp, Mus musculus
ccagtaatcacagtgctcatg

SEQ ID NO: 182357 - DNA, 22 bp, Mus musculus
tgttttgtgaccaattatatgg

SEQ ID NO: 182358 - DNA, 23 bp, Mus musculus
agctacagaaaagagagagagaa

SEQ ID NO: 182359 - DNA, 22 bp, Mus musculus
acacagagagcagagtgtgctg

SEQ ID NO: 182360 - DNA, 20 bp, Mus musculus
atgtgtatatatacatgtgt

SEQ ID NO: 182361 - DNA, 23 bp, Mus musculus
tgacattttgtatttctgtctca

SEQ ID NO: 182362 - DNA, 21 bp, Mus musculus
tgggagagtgcagccctgagt

SEQ ID NO: 182363 - DNA, 19 bp, Mus musculus
aatggatatatattcaaaa

SEQ ID NO: 182364 - DNA, 22 bp, Mus musculus
atactgagtgtgtgtgtctttc

SEQ ID NO: 182365 - DNA, 22 bp, Mus musculus
tgtcagtggctcagatgtggca

SEQ ID NO: 182366 - DNA, 21 bp, Mus musculus
tctctgtcacagtctccctcc

SEQ ID NO: 182367 - DNA, 20 bp, Mus musculus
ttgagcctccctaaattcgc

SEQ ID NO: 182368 - DNA, 21 bp, Mus musculus
tcgcactctctgtctttcgga

SEQ ID NO: 182369 - DNA, 23 bp, Mus musculus
tctttggatatgtaactgtatca

SEQ ID NO: 182370 - DNA, 22 bp, Mus musculus
tgttttgtgaccaattatatgg

SEQ ID NO: 182371 - DNA, 23 bp, Mus musculus
cccattcattgtactgtgtttgc

SEQ ID NO: 182372 - DNA, 22 bp, Mus musculus
ttgctcctgagcaagtgtaaca

SEQ ID NO: 182373 - DNA, 22 bp, Mus musculus
tgttttgtgaccaattatatgg

SEQ ID NO: 182374 - DNA, 21 bp, Mus musculus
tccatggtggtctgataggat

SEQ ID NO: 182375 - DNA, 22 bp, Mus musculus
tgttttgtgaccaattatatgg

SEQ ID NO: 182376 - DNA, 18 bp, Mus musculus
aaaggaagcaagagagac

SEQ ID NO: 182377 - DNA, 23 bp, Mus musculus
ttctctctgtgtctgtctgtctg

SEQ ID NO: 182378 - DNA, 21 bp, Mus musculus
tatgctgctgaaccacaggct

SEQ ID NO: 182379 - DNA, 23 bp, Mus musculus
gggacactgactctgtgtttgtt

SEQ ID NO: 182380 - DNA, 23 bp, Mus musculus
taaggaatctagtgtggctggag

SEQ ID NO: 182381 - DNA, 23 bp, Mus musculus
tgactgtctgctgtcactgtctg

SEQ ID NO: 182382 - DNA, 20 bp, Mus musculus
ttgtgagtgtgcatgcttgc

SEQ ID NO: 182383 - DNA, 23 bp, Mus musculus
aagtccttctgggttatggatct

SEQ ID NO: 182384 - DNA, 20 bp, Mus musculus
tgaggtttttttttggtttg

SEQ ID NO: 182385 - DNA, 21 bp, Mus musculus
tatgtacaagcatgtgtgtgt

SEQ ID NO: 182386 - DNA, 20 bp, Mus musculus
cacacacacacttgctttta

SEQ ID NO: 182387 - DNA, 23 bp, Mus musculus
tgtgtgtgtgtctgtgtatgcgc

SEQ ID NO: 182388 - DNA, 23 bp, Mus musculus
tcactctgcctctgacacagtgt

SEQ ID NO: 182389 - DNA, 20 bp, Mus musculus
tgtctccttgctctttggag

SEQ ID NO: 182390 - DNA, 23 bp, Mus musculus
tcacactcagggtcatacagatg

SEQ ID NO: 182391 - DNA, 23 bp, Mus musculus
taaggtatatatgctttatctgt

SEQ ID NO: 182392 - DNA, 22 bp, Mus musculus
tatccaagtagtgggcctctct

SEQ ID NO: 182393 - DNA, 23 bp, Mus musculus
tcttaccttccttctgtctcact

SEQ ID NO: 182394 - DNA, 23 bp, Mus musculus
tctctctctctgggaaacatggc

SEQ ID NO: 182395 - DNA, 22 bp, Mus musculus
tgtatgtgcatatgcatgtgta

SEQ ID NO: 182396 - DNA, 20 bp, Mus musculus
tatgtgtgtgcatgtgtatg

SEQ ID NO: 182397 - DNA, 23 bp, Mus musculus
tgtgcctctgactgactgaatgt

SEQ ID NO: 182398 - DNA, 23 bp, Mus musculus
gcaagagctttcagtggtcgatg

SEQ ID NO: 182399 - DNA, 23 bp, Mus musculus
tcaaaggtctctctctctctctc

SEQ ID NO: 182400 - DNA, 19 bp, Mus musculus
gaggttagcatttgtgtca

SEQ ID NO: 182401 - DNA, 23 bp, Mus musculus
taagtatgatgttgatggtccat

SEQ ID NO: 182402 - DNA, 21 bp, Mus musculus
aaatggaattgtatgggacag

SEQ ID NO: 182403 - DNA, 22 bp, Mus musculus
tgttttgtgaccaattatatgg

SEQ ID NO: 182404 - DNA, 23 bp, Mus musculus
tttgtgcttggcattgtcatcca

SEQ ID NO: 182405 - DNA, 22 bp, Mus musculus
tcacactgggtcttctttatct

SEQ ID NO: 182406 - DNA, 23 bp, Mus musculus
tattcaggcaccattagttgtga

SEQ ID NO: 182407 - DNA, 18 bp, Mus musculus
cagaggtcctgagttcaa

SEQ ID NO: 182408 - DNA, 22 bp, Mus musculus
gcctgtctgtctgtctgtgtat

SEQ ID NO: 182409 - DNA, 20 bp, Mus musculus
aagagcactgactgctcttc

SEQ ID NO: 182410 - DNA, 19 bp, Mus musculus
attgtattgatgggagaag

SEQ ID NO: 182411 - DNA, 21 bp, Mus musculus
atgtatgtctgcttgtgcatg

SEQ ID NO: 182412 - DNA, 23 bp, Mus musculus
agattgaagactggcagctctct

SEQ ID NO: 182413 - DNA, 19 bp, Mus musculus
tcagagggagagagcgagc

SEQ ID NO: 182414 - DNA, 22 bp, Mus musculus
gagtggctggctggctgtttac

SEQ ID NO: 182415 - DNA, 23 bp, Mus musculus
atatctctatatctatatctata

SEQ ID NO: 182416 - DNA, 23 bp, Mus musculus
agatttgtgcttgtatttggagc

SEQ ID NO: 182417 - DNA, 23 bp, Mus musculus
tgactcactgtgtcatacatgtg

SEQ ID NO: 182418 - DNA, 23 bp, Mus musculus
actgtgtgtgcaagtgcatatgc

SEQ ID NO: 182419 - DNA, 23 bp, Mus musculus
taagagcactgactgctcttctg

SEQ ID NO: 182420 - DNA, 23 bp, Mus musculus
tgtataccatgcatatgtttaga

SEQ ID NO: 182421 - DNA, 22 bp, Mus musculus
tgttttgtgaccaattatatgg

SEQ ID NO: 182422 - DNA, 21 bp, Mus musculus
tctgagtcagtgtgatgggta

SEQ ID NO: 182423 - DNA, 23 bp, Mus musculus
gcttgaggtattgtaatgagtga

SEQ ID NO: 182424 - DNA, 19 bp, Mus musculus
aatgcctgtctgtttatat

SEQ ID NO: 182425 - DNA, 23 bp, Mus musculus
atgtgtctatagatatgtgtgtg

SEQ ID NO: 182426 - DNA, 19 bp, Mus musculus
gctcaccttactgttactg

SEQ ID NO: 182427 - DNA, 23 bp, Mus musculus
tgtcactgactgtagtgtgtggg

SEQ ID NO: 182428 - DNA, 23 bp, Mus musculus
aatgtgcaagtcaatgttgtgga

SEQ ID NO: 182429 - DNA, 18 bp, Mus musculus
actcacagactcagtaca

SEQ ID NO: 182430 - DNA, 20 bp, Mus musculus
tggggagatcattccgatgt

SEQ ID NO: 182431 - DNA, 22 bp, Mus musculus
actttgcttttgtaactgttgc

SEQ ID NO: 182432 - DNA, 23 bp, Mus musculus
tctccctctgtcactctttgcct

SEQ ID NO: 182433 - DNA, 23 bp, Mus musculus
agacagttgacaggcaggagtgt

SEQ ID NO: 182434 - DNA, 20 bp, Mus musculus
atgtgtgtgtgtgtatacac

SEQ ID NO: 182435 - DNA, 23 bp, Mus musculus
gtctgtctgtctgtctgtctgtc

SEQ ID NO: 182436 - DNA, 22 bp, Mus musculus
aagattatcactctctactggt

SEQ ID NO: 182437 - DNA, 23 bp, Mus musculus
cactgctgtctctgtctctgctg

SEQ ID NO: 182438 - DNA, 21 bp, Mus musculus
acagaaaactgagagtgcaga

SEQ ID NO: 182439 - DNA, 23 bp, Mus musculus
tggtccatgttgaacggcaacaa

SEQ ID NO: 182440 - DNA, 23 bp, Mus musculus
actgttctggatttgttgatctc

SEQ ID NO: 182441 - DNA, 19 bp, Mus musculus
aaatccagcagccttcagt

SEQ ID NO: 182442 - DNA, 23 bp, Mus musculus
ctgtgcctctgtctctgcatcac

SEQ ID NO: 182443 - DNA, 23 bp, Mus musculus
tgcatctgactgtgtatctgtct

SEQ ID NO: 182444 - DNA, 21 bp, Mus musculus
aacagttcagttgttaacctt

SEQ ID NO: 182445 - DNA, 23 bp, Mus musculus
tctgtctgtctgtctgcctgcct

SEQ ID NO: 182446 - DNA, 20 bp, Mus musculus
tgtctttatctaactgggtg

SEQ ID NO: 182447 - DNA, 22 bp, Mus musculus
tgttttgtgaccaattatatgg

SEQ ID NO: 182448 - DNA, 22 bp, Mus musculus
taagaatcagttagttaatagg

SEQ ID NO: 182449 - DNA, 23 bp, Mus musculus
agaagagtgttgttcagtttcca

SEQ ID NO: 182450 - DNA, 23 bp, Mus musculus
tgtcaggctgagtctaagccact

SEQ ID NO: 182451 - DNA, 23 bp, Mus musculus
atgtgtgtgaatatgcacactta

SEQ ID NO: 182452 - DNA, 19 bp, Mus musculus
gtctgagcctttgaggtgt

SEQ ID NO: 182453 - DNA, 20 bp, Mus musculus
gtcactgagtcagagagcca

SEQ ID NO: 182454 - DNA, 23 bp, Mus musculus
accctgtgtcagtccttgcctct

SEQ ID NO: 182455 - DNA, 23 bp, Mus musculus
tctgtgtggctctgagtctgcct

SEQ ID NO: 182456 - DNA, 21 bp, Mus musculus
catatttctgtggctccagct

SEQ ID NO: 182457 - DNA, 23 bp, Mus musculus
ctgtgcctctctcagagctctga

SEQ ID NO: 182458 - DNA, 23 bp, Mus musculus
gcgtgtgtgtagagtctccgttg

SEQ ID NO: 182459 - DNA, 21 bp, Mus musculus
tctctctgtctctgggagagt

SEQ ID NO: 182460 - DNA, 22 bp, Mus musculus
ttcagttctctgcagtttactt

SEQ ID NO: 182461 - DNA, 23 bp, Mus musculus
tgactatggttttggacttggta

SEQ ID NO: 182462 - DNA, 23 bp, Mus musculus
tgcctgcctgcctgcctgcctgc

SEQ ID NO: 182463 - DNA, 23 bp, Mus musculus
gtagtgcatgtccatgtgcatcc

SEQ ID NO: 182464 - DNA, 20 bp, Mus musculus
tccaaatatgtatatatcta

SEQ ID NO: 182465 - DNA, 23 bp, Mus musculus
tgatttgtttagaaatgagtagg

SEQ ID NO: 182466 - DNA, 23 bp, Mus musculus
gagcctgcctggctccctggaag

SEQ ID NO: 182467 - DNA, 18 bp, Mus musculus
ggagtgctacttacttca

SEQ ID NO: 182468 - DNA, 19 bp, Mus musculus
ttgctcttggctcttctgt

SEQ ID NO: 182469 - DNA, 23 bp, Mus musculus
gagtctcagtgtgtgtgtcggcc

SEQ ID NO: 182470 - DNA, 19 bp, Mus musculus
gatatcatcattcattgtc

SEQ ID NO: 182471 - DNA, 19 bp, Mus musculus
tgtcattgaaaccactgtg

SEQ ID NO: 182472 - DNA, 23 bp, Mus musculus
gatagagctactgctactgattt

SEQ ID NO: 182473 - DNA, 23 bp, Mus musculus
gggcagtgtgactcactggctgt

SEQ ID NO: 182474 - DNA, 19 bp, Mus musculus
acagtgaggagagactgag

SEQ ID NO: 182475 - DNA, 23 bp, Mus musculus
tctttacattctagagtctaatg

SEQ ID NO: 182476 - DNA, 20 bp, Mus musculus
agattatgtctatgtctata

SEQ ID NO: 182477 - DNA, 22 bp, Mus musculus
tgttttgtgaccaattatatgg

SEQ ID NO: 182478 - DNA, 23 bp, Mus musculus
acagagaaaagagtgacgtcagt

SEQ ID NO: 182479 - DNA, 21 bp, Mus musculus
cagactgaagactctgcgtct

SEQ ID NO: 182480 - DNA, 23 bp, Mus musculus
agcatctgtcagtctgtctcagc

SEQ ID NO: 182481 - DNA, 23 bp, Mus musculus
tttgtgtgcatatgtatgtacgt

SEQ ID NO: 182482 - DNA, 22 bp, Mus musculus
tatatgcatgtgatgggtgtct

SEQ ID NO: 182483 - DNA, 23 bp, Mus musculus
tacaggtattcaatctactgtgt

SEQ ID NO: 182484 - DNA, 20 bp, Mus musculus
cagtgtgtgggtcggtgtgg

SEQ ID NO: 182485 - DNA, 23 bp, Mus musculus
gagtcacaggcagtgtgctaggc

SEQ ID NO: 182486 - DNA, 21 bp, Mus musculus
tgtcaggctctgacagagcct

SEQ ID NO: 182487 - DNA, 23 bp, Mus musculus
tgacagaacagtgtctctacctc

SEQ ID NO: 182488 - DNA, 23 bp, Mus musculus
tgtatgtgtgcaagtgcatgtgt

SEQ ID NO: 182489 - DNA, 23 bp, Mus musculus
cacatatgtatatgtggaagtct

SEQ ID NO: 182490 - DNA, 22 bp, Mus musculus
gtgaccataggtgtgtggattc

SEQ ID NO: 182491 - DNA, 23 bp, Mus musculus
ataaagaaatagatgatagctgg

SEQ ID NO: 182492 - DNA, 18 bp, Mus musculus
ttctataactatatgtat

SEQ ID NO: 182493 - DNA, 23 bp, Mus musculus
tgtatgtatgtatgcatgtgtct

SEQ ID NO: 182494 - DNA, 23 bp, Mus musculus
ctctgtgtgtgcatctgtatgtg

SEQ ID NO: 182495 - DNA, 22 bp, Mus musculus
tgttttgtgaccaattatatgg

SEQ ID NO: 182496 - DNA, 21 bp, Mus musculus
tacagacatgattttgaggag

SEQ ID NO: 182497 - DNA, 23 bp, Mus musculus
tgtatgcatgtatgtatgtatgt

SEQ ID NO: 182498 - DNA, 22 bp, Mus musculus
tcttactgcaacttgatatgca

SEQ ID NO: 182499 - DNA, 19 bp, Mus musculus
aaaggccttctgttttctg

SEQ ID NO: 182500 - DNA, 22 bp, Mus musculus
atgtatgtatgtatatgtgtgt

SEQ ID NO: 182501 - DNA, 22 bp, Mus musculus
tgttttgtgaccaattatatgg

SEQ ID NO: 182502 - DNA, 23 bp, Mus musculus
tgtgtgtgtgcttatgtatatat

SEQ ID NO: 182503 - DNA, 22 bp, Mus musculus
tgttttgtgaccaattatatgg

SEQ ID NO: 182504 - DNA, 23 bp, Mus musculus
tctgaggtagtgtctgtctttgt

SEQ ID NO: 182505 - DNA, 21 bp, Mus musculus
tatctctatatgaaattgtct

SEQ ID NO: 182506 - DNA, 22 bp, Mus musculus
tgttttgtgaccaattatatgg

SEQ ID NO: 182507 - DNA, 22 bp, Mus musculus
tgttttgtgaccaattatatgg

SEQ ID NO: 182508 - DNA, 23 bp, Mus musculus
ggcatgtgtttcgaattccatga

SEQ ID NO: 182509 - DNA, 18 bp, Mus musculus
tagctgtacattgtgcat

SEQ ID NO: 182510 - DNA, 18 bp, Mus musculus
tgtgagagtaaaatgtgt

SEQ ID NO: 182511 - DNA, 22 bp, Mus musculus
aatgactccatggtaatcacag

SEQ ID NO: 182512 - DNA, 22 bp, Mus musculus
tgttttgtgaccaattatatgg

SEQ ID NO: 182513 - DNA, 23 bp, Mus musculus
tatatatgtgtatatctatatgt

SEQ ID NO: 182514 - DNA, 23 bp, Mus musculus
atatgtgtatatctatatgtata

SEQ ID NO: 182515 - DNA, 23 bp, Mus musculus
atatgtgtatatctatatgtata

SEQ ID NO: 182516 - DNA, 23 bp, Mus musculus
atatgtgtatatctatatgtata

SEQ ID NO: 182517 - DNA, 22 bp, Mus musculus
atgtgtatatctatatgtatat

SEQ ID NO: 182518 - DNA, 23 bp, Mus musculus
tcaggggctggagagatggctca

SEQ ID NO: 182519 - DNA, 21 bp, Mus musculus
tctgtggaaccatctgtgggt

SEQ ID NO: 182520 - DNA, 21 bp, Mus musculus
aggtccagtagagtgtctgtg

SEQ ID NO: 182521 - DNA, 23 bp, Mus musculus
tctgtctgtgctaatcgtcctgg

SEQ ID NO: 182522 - DNA, 23 bp, Mus musculus
tatctcagttattgaaagttctt

SEQ ID NO: 182523 - DNA, 23 bp, Mus musculus
tatgtgtatatgtgtatgtgtat

SEQ ID NO: 182524 - DNA, 22 bp, Mus musculus
tgttttgtgaccaattatatgg

SEQ ID NO: 182525 - DNA, 19 bp, Mus musculus
taatgtggggtaaaaatct

SEQ ID NO: 182526 - DNA, 22 bp, Mus musculus
acagtgagcagagagtgagcag

SEQ ID NO: 182527 - DNA, 23 bp, Mus musculus
tttagagcactgactgctctttc

SEQ ID NO: 182528 - DNA, 23 bp, Mus musculus
tcttgctgtctctgactgtggct

SEQ ID NO: 182529 - DNA, 23 bp, Mus musculus
atataatgtgtgtctgtgtgtct

SEQ ID NO: 182530 - DNA, 22 bp, Mus musculus
tgttttgtgaccaattatatgg

SEQ ID NO: 182531 - DNA, 22 bp, Mus musculus
tgttttgtgaccaattatatgg

SEQ ID NO: 182532 - DNA, 23 bp, Mus musculus
tacatatgatgtgattgtcttga

SEQ ID NO: 182533 - DNA, 23 bp, Mus musculus
tagtgcatggtgatctgatagga

SEQ ID NO: 182534 - DNA, 22 bp, Mus musculus
tgttttgtgacctattatgtgg

SEQ ID NO: 182535 - DNA, 19 bp, Mus musculus
attatgaggtactatgtga

SEQ ID NO: 182536 - DNA, 19 bp, Mus musculus
gacagacagacagacagac

SEQ ID NO: 182537 - DNA, 23 bp, Mus musculus
atatagagagaaagctggtagtt

SEQ ID NO: 182538 - DNA, 22 bp, Mus musculus
actgacccagtgactgtcccca

SEQ ID NO: 182539 - DNA, 20 bp, Mus musculus
cagtgactggctcagtggct

SEQ ID NO: 182540 - DNA, 22 bp, Mus musculus
gtatgtatgtatgtgtgtgtgt

SEQ ID NO: 182541 - DNA, 22 bp, Mus musculus
gcgttgcttcagagggggatgt

SEQ ID NO: 182542 - DNA, 23 bp, Mus musculus
agtctgagagggatatacttgtg

SEQ ID NO: 182543 - DNA, 23 bp, Mus musculus
tcacccactcagtgactctgaag

SEQ ID NO: 182544 - DNA, 23 bp, Mus musculus
tctctagtgaatttgttcaaaac

SEQ ID NO: 182545 - DNA, 23 bp, Mus musculus
tgtggagtatcctaggttaggca

SEQ ID NO: 182546 - DNA, 20 bp, Mus musculus
tgcctcaccagcagcacctg

SEQ ID NO: 182547 - DNA, 22 bp, Mus musculus
gtcagagtcagttatctctttc

SEQ ID NO: 182548 - DNA, 23 bp, Mus musculus
ctgcctctgacaggctctgatac

SEQ ID NO: 182549 - DNA, 23 bp, Mus musculus
ttaggttgtacatgatggaagga

SEQ ID NO: 182550 - DNA, 23 bp, Mus musculus
aattacaacatgctatggtttga

SEQ ID NO: 182551 - DNA, 21 bp, Mus musculus
caagagatctgactttgttgt

SEQ ID NO: 182552 - DNA, 23 bp, Mus musculus
tcactcatttgagttgagtcagt

SEQ ID NO: 182553 - DNA, 21 bp, Mus musculus
aagtcagtacagtgagtgcag

SEQ ID NO: 182554 - DNA, 23 bp, Mus musculus
tctctatctctgttcctggcatt

SEQ ID NO: 182555 - DNA, 21 bp, Mus musculus
tatatgtgtgtgcatatgtat

SEQ ID NO: 182556 - DNA, 23 bp, Mus musculus
acagtcagagaacaggaagagat

SEQ ID NO: 182557 - DNA, 23 bp, Mus musculus
tggtttagagcactctctgctct

SEQ ID NO: 182558 - DNA, 23 bp, Mus musculus
tgacagatgagactcagctcttt

SEQ ID NO: 182559 - DNA, 21 bp, Mus musculus
tacagttgactgcagatagca

SEQ ID NO: 182560 - DNA, 23 bp, Mus musculus
tcatctgccctatgtctttgtgc

SEQ ID NO: 182561 - DNA, 22 bp, Mus musculus
cagtcattaagaaaaggcgcag

SEQ ID NO: 182562 - DNA, 23 bp, Mus musculus
tactatatgtgtctggtaatgat

SEQ ID NO: 182563 - DNA, 22 bp, Mus musculus
tgttttgtgaccaattatatgg

SEQ ID NO: 182564 - DNA, 22 bp, Mus musculus
catcacagaagatggagaggaa

SEQ ID NO: 182565 - DNA, 18 bp, Mus musculus
tccatattttatgtattt

SEQ ID NO: 182566 - DNA, 18 bp, Mus musculus
tttcattaacaaatcact

SEQ ID NO: 182567 - DNA, 23 bp, Mus musculus
tctgactctcttcggtgacgggt

SEQ ID NO: 182568 - DNA, 23 bp, Mus musculus
ttattgcttaagaatacgcgtag

SEQ ID NO: 182569 - DNA, 23 bp, Mus musculus
tgtatatgtatgtatatgtatag

SEQ ID NO: 182570 - DNA, 23 bp, Mus musculus
ggatgtatgtatgcatgtatgtg

SEQ ID NO: 182571 - DNA, 21 bp, Mus musculus
tataaaactctcagctagctc

SEQ ID NO: 182572 - DNA, 22 bp, Mus musculus
atcatcttcttcttcttctgca

SEQ ID NO: 182573 - DNA, 21 bp, Mus musculus
tattggtatataagatttttg

SEQ ID NO: 182574 - DNA, 23 bp, Mus musculus
aagaatgagagcacacactgtcc

SEQ ID NO: 182575 - DNA, 23 bp, Mus musculus
atgctacttcttcaagagattat

SEQ ID NO: 182576 - DNA, 23 bp, Mus musculus
aatgtccttcaactttgagctga

SEQ ID NO: 182577 - DNA, 23 bp, Mus musculus
atgtgtatgtatatattaatgta

SEQ ID NO: 182578 - DNA, 23 bp, Mus musculus
ttttattcagattttgaagtttt

SEQ ID NO: 182579 - DNA, 23 bp, Mus musculus
ttttttggatttccaaggtttct

SEQ ID NO: 182580 - DNA, 19 bp, Mus musculus
cacaagatactcatgggtc

SEQ ID NO: 182581 - DNA, 21 bp, Mus musculus
tatctgtctgaatatcaagtg

SEQ ID NO: 182582 - DNA, 21 bp, Mus musculus
atgtctctctatatgtcactg

SEQ ID NO: 182583 - DNA, 19 bp, Mus musculus
atgggtggagaatcagctg

SEQ ID NO: 182584 - DNA, 23 bp, Mus musculus
tgtctgtgtgtctgtgtgcctgt

SEQ ID NO: 182585 - DNA, 22 bp, Mus musculus
tgttttgtgaccaattatatgg

SEQ ID NO: 182586 - DNA, 23 bp, Mus musculus
agggagaaggaagtatactaaag

SEQ ID NO: 182587 - DNA, 22 bp, Mus musculus
gtaagagagtttggaatttttc

SEQ ID NO: 182588 - DNA, 20 bp, Mus musculus
tccagtgaggagacactggg

SEQ ID NO: 182589 - DNA, 22 bp, Mus musculus
ttagaagaaagagaggactcag

SEQ ID NO: 182590 - DNA, 23 bp, Mus musculus
tctcagtgcctgagattctactt

SEQ ID NO: 182591 - DNA, 21 bp, Mus musculus
aatcagtttgtggtaagggag

SEQ ID NO: 182592 - DNA, 19 bp, Mus musculus
tggtgtcatgtaagcagaa

SEQ ID NO: 182593 - DNA, 23 bp, Mus musculus
tgcatgcctgcctgcctgcctgt

SEQ ID NO: 182594 - DNA, 23 bp, Mus musculus
ccctgagactcagtgtgtgtcat

SEQ ID NO: 182595 - DNA, 20 bp, Mus musculus
tccatgcatgtatgtatgtg

SEQ ID NO: 182596 - DNA, 22 bp, Mus musculus
tggacagagaagggtgtgaggt

SEQ ID NO: 182597 - DNA, 22 bp, Mus musculus
atttgacacgaattattcagtt

SEQ ID NO: 182598 - DNA, 23 bp, Mus musculus
ttgactttaaacttgttaatctt

SEQ ID NO: 182599 - DNA, 22 bp, Mus musculus
gaaatcatctttatcagtgact

SEQ ID NO: 182600 - DNA, 19 bp, Mus musculus
atatatatatgtggatgga

SEQ ID NO: 182601 - DNA, 22 bp, Mus musculus
gactctctttccctcagtagca

SEQ ID NO: 182602 - DNA, 23 bp, Mus musculus
gtctgggtgtgtctgccactgtg

SEQ ID NO: 182603 - DNA, 23 bp, Mus musculus
tggctggctggctggctggctgg

SEQ ID NO: 182604 - DNA, 23 bp, Mus musculus
ttatcactatgtatttatctgtc

SEQ ID NO: 182605 - DNA, 23 bp, Mus musculus
gaagagtacagggtagttgttct

SEQ ID NO: 182606 - DNA, 23 bp, Mus musculus
ataagaatcaatgcagagttgtt

SEQ ID NO: 182607 - DNA, 23 bp, Mus musculus
atgtatatgcatatgtatatatt

SEQ ID NO: 182608 - DNA, 23 bp, Mus musculus
tctgtctgtctgtctgtctacct

SEQ ID NO: 182609 - DNA, 23 bp, Mus musculus
agtttgcatttctagctgtttct

SEQ ID NO: 182610 - DNA, 18 bp, Mus musculus
tgtgtgtatatatatatg

SEQ ID NO: 182611 - DNA, 23 bp, Mus musculus
agtctgtgctgagtatgtccctg

SEQ ID NO: 182612 - DNA, 22 bp, Mus musculus
aattatgaaagattgcacagag

SEQ ID NO: 182613 - DNA, 22 bp, Mus musculus
atgtgtgtatatgtgtatgtgt

SEQ ID NO: 182614 - DNA, 23 bp, Mus musculus
gtcagccaccctgtgactttacc

SEQ ID NO: 182615 - DNA, 23 bp, Mus musculus
tctgtctgtctgtctgcctgtct

SEQ ID NO: 182616 - DNA, 22 bp, Mus musculus
tatatgtatatatgtatatctc

SEQ ID NO: 182617 - DNA, 23 bp, Mus musculus
tgtcgtagaagagagtgtggaga

SEQ ID NO: 182618 - DNA, 23 bp, Mus musculus
tgaggctctgtgtcactgacggg

SEQ ID NO: 182619 - DNA, 22 bp, Mus musculus
tgttttgtgaccaattatatgg

SEQ ID NO: 182620 - DNA, 23 bp, Mus musculus
taggagtctctggctcacacagt

SEQ ID NO: 182621 - DNA, 23 bp, Mus musculus
ctagagagactgcagagagtgag

SEQ ID NO: 182622 - DNA, 22 bp, Mus musculus
tgttttgtgaccaattatatgg

SEQ ID NO: 182623 - DNA, 18 bp, Mus musculus
ttgctgctgttctgcatc

SEQ ID NO: 182624 - DNA, 21 bp, Mus musculus
agagatgtctgagagctcatg

SEQ ID NO: 182625 - DNA, 22 bp, Mus musculus
tgttttgtgaccaattatatgg

SEQ ID NO: 182626 - DNA, 23 bp, Mus musculus
tcacctatagatatgtgtgtgtg

SEQ ID NO: 182627 - DNA, 22 bp, Mus musculus
tgtatgtatgtatgtatgtatg

SEQ ID NO: 182628 - DNA, 23 bp, Mus musculus
gtgtgtaattgtctgtgtatcta

SEQ ID NO: 182629 - DNA, 23 bp, Mus musculus
acactcaagctgtctctgactct

SEQ ID NO: 182630 - DNA, 21 bp, Mus musculus
tagagaagagtcagagctgtt

SEQ ID NO: 182631 - DNA, 23 bp, Mus musculus
tcactgagcttctgtgtattatt

SEQ ID NO: 182632 - DNA, 22 bp, Mus musculus
tggcatgatatccatcacaact

SEQ ID NO: 182633 - DNA, 23 bp, Mus musculus
ttggtctgaagttctctatcttt

SEQ ID NO: 182634 - DNA, 23 bp, Mus musculus
tttctgtggtttagatatcagag

SEQ ID NO: 182635 - DNA, 23 bp, Mus musculus
acacacacacacacatatatatg

SEQ ID NO: 182636 - DNA, 22 bp, Mus musculus
tgttttgtgaccaattatatgg

SEQ ID NO: 182637 - DNA, 20 bp, Mus musculus
cactcactcacacatgcatg

SEQ ID NO: 182638 - DNA, 23 bp, Mus musculus
attacttttgtatattaggtgtt

SEQ ID NO: 182639 - DNA, 23 bp, Mus musculus
aaggcccttaactattctgtgca

SEQ ID NO: 182640 - DNA, 23 bp, Mus musculus
tgtatcaagataaagtttagaaa

SEQ ID NO: 182641 - DNA, 19 bp, Mus musculus
agttgaagcttgtaaagta

SEQ ID NO: 182642 - DNA, 21 bp, Mus musculus
atctaatttgtatagctgctg

SEQ ID NO: 182643 - DNA, 22 bp, Mus musculus
actgggggtggctaaagggttt

SEQ ID NO: 182644 - DNA, 23 bp, Mus musculus
agattcagtggctctctgtctct

SEQ ID NO: 182645 - DNA, 22 bp, Mus musculus
tctttgtctctgtatctccttc

SEQ ID NO: 182646 - DNA, 20 bp, Mus musculus
agtcagttcagtgagtgcag

SEQ ID NO: 182647 - DNA, 20 bp, Mus musculus
tatagaatacatgtatgtag

SEQ ID NO: 182648 - DNA, 23 bp, Mus musculus
tgtgtatatccactatgtatgta

SEQ ID NO: 182649 - DNA, 22 bp, Mus musculus
tgttttgtgaccaattatatgg

SEQ ID NO: 182650 - DNA, 23 bp, Mus musculus
gttctgacaagtgagtgtccaga

SEQ ID NO: 182651 - DNA, 21 bp, Mus musculus
aatctgctgctgattctgttc

SEQ ID NO: 182652 - DNA, 23 bp, Mus musculus
aaagtagacattttgttgtagat

SEQ ID NO: 182653 - DNA, 23 bp, Mus musculus
gactctcacagtctttctaccca

SEQ ID NO: 182654 - DNA, 18 bp, Mus musculus
agggagtgtgaaacagat

SEQ ID NO: 182655 - DNA, 21 bp, Mus musculus
tccatggtgatctgataggat

SEQ ID NO: 182656 - DNA, 23 bp, Mus musculus
atgtagtagtttgaatagtaatg

SEQ ID NO: 182657 - DNA, 18 bp, Mus musculus
accagaggacttaagtgt

SEQ ID NO: 182658 - DNA, 23 bp, Mus musculus
tgtgtatgtgtatgtgtatatat

SEQ ID NO: 182659 - DNA, 23 bp, Mus musculus
ttgtctggatcctggagactctg

SEQ ID NO: 182660 - DNA, 23 bp, Mus musculus
acaggaaggactcttagcagtct

SEQ ID NO: 182661 - DNA, 23 bp, Mus musculus
catgtatatgtatgtatatcgtg

SEQ ID NO: 182662 - DNA, 21 bp, Mus musculus
tcagactcgcagagatctgtc

SEQ ID NO: 182663 - DNA, 20 bp, Mus musculus
tatgtgtatatatatgtatg

SEQ ID NO: 182664 - DNA, 18 bp, Mus musculus
tgtatatgtgtatgtatg

SEQ ID NO: 182665 - DNA, 21 bp, Mus musculus
tatacacacacatatatttgt

SEQ ID NO: 182666 - DNA, 23 bp, Mus musculus
atatatgcgtgtgtgtgtgtgtg

SEQ ID NO: 182667 - DNA, 23 bp, Mus musculus
taaatatctggttggcaatcttt

SEQ ID NO: 182668 - DNA, 18 bp, Mus musculus
agagtggatttttgactg

SEQ ID NO: 182669 - DNA, 21 bp, Mus musculus
atatatgcagatatacatgga

SEQ ID NO: 182670 - DNA, 22 bp, Mus musculus
tttgtcatggatatctagtatt

SEQ ID NO: 182671 - DNA, 23 bp, Mus musculus
tgagaactcagaaacttctagtg

SEQ ID NO: 182672 - DNA, 20 bp, Mus musculus
tgccccagacactcctgtga

SEQ ID NO: 182673 - DNA, 19 bp, Mus musculus
tttaaacacgtaaacattt

SEQ ID NO: 182674 - DNA, 23 bp, Mus musculus
aagagcactgactgctcttccag

SEQ ID NO: 182675 - DNA, 21 bp, Mus musculus
cagtgtcagtccctgtctcaa

SEQ ID NO: 182676 - DNA, 23 bp, Mus musculus
atgtatatgtatatgtatatgta

SEQ ID NO: 182677 - DNA, 22 bp, Mus musculus
tgtgctccaactccagggagag

SEQ ID NO: 182678 - DNA, 21 bp, Mus musculus
tgcctctgatgtgtgtgagca

SEQ ID NO: 182679 - DNA, 22 bp, Mus musculus
gagaccctgactgtgtggctcc

SEQ ID NO: 182680 - DNA, 20 bp, Mus musculus
gacagcgtttcacagcccct

SEQ ID NO: 182681 - DNA, 23 bp, Mus musculus
aaagactctcagatagcaccacc

SEQ ID NO: 182682 - DNA, 23 bp, Mus musculus
tcagtcagtcagtgttttgtgat

SEQ ID NO: 182683 - DNA, 20 bp, Mus musculus
tgtctgtgtatgtgtgtgtg

SEQ ID NO: 182684 - DNA, 22 bp, Mus musculus
taagtcagtacttctgggtcag

SEQ ID NO: 182685 - DNA, 18 bp, Mus musculus
acctgagaatggagagac

SEQ ID NO: 182686 - DNA, 22 bp, Mus musculus
taagtcagtttctaaatgtgtg

SEQ ID NO: 182687 - DNA, 23 bp, Mus musculus
tgaaactatgaatgtagtattca

SEQ ID NO: 182688 - DNA, 22 bp, Mus musculus
tgttttgtgaccaattatatgg

SEQ ID NO: 182689 - DNA, 23 bp, Mus musculus
ggtgtgtctgtcactctgagaca

SEQ ID NO: 182690 - DNA, 23 bp, Mus musculus
aagtctgtgaggttatgtggatg

SEQ ID NO: 182691 - DNA, 23 bp, Mus musculus
agacactatctcactctcctctg

SEQ ID NO: 182692 - DNA, 23 bp, Mus musculus
aatcacagataacggaagcgtag

SEQ ID NO: 182693 - DNA, 19 bp, Mus musculus
tagcttcaagtgcagattg

SEQ ID NO: 182694 - DNA, 23 bp, Mus musculus
actgaagtaatggcagtgttaat

SEQ ID NO: 182695 - DNA, 23 bp, Mus musculus
tatatgtatgtatatatgtgtgt

SEQ ID NO: 182696 - DNA, 22 bp, Mus musculus
tgtatgtatgtatatatgtatg

SEQ ID NO: 182697 - DNA, 22 bp, Mus musculus
gtatgtatgtatgtatgtatgt

SEQ ID NO: 182698 - DNA, 23 bp, Mus musculus
ggcactgactgctcttccagagg

SEQ ID NO: 182699 - DNA, 23 bp, Mus musculus
tacctgaatgaagaagcagcaga

SEQ ID NO: 182700 - DNA, 23 bp, Mus musculus
ttcagaggaatgttctgtgagtc

SEQ ID NO: 182701 - DNA, 18 bp, Mus musculus
agagtccgtacagacagg

SEQ ID NO: 182702 - DNA, 22 bp, Mus musculus
attcagagaacagacatggagg

SEQ ID NO: 182703 - DNA, 23 bp, Mus musculus
aactcagtggttgagtattgacc

SEQ ID NO: 182704 - DNA, 23 bp, Mus musculus
ttgatatacatatgcatatgcat

SEQ ID NO: 182705 - DNA, 23 bp, Mus musculus
tctctcactctctgtatactgcc

SEQ ID NO: 182706 - DNA, 19 bp, Mus musculus
tccatctaatccttactga

SEQ ID NO: 182707 - DNA, 23 bp, Mus musculus
cagcctcgctcagactatgcctc

SEQ ID NO: 182708 - DNA, 23 bp, Mus musculus
tgtgtgtgctttgtatatgtgtc

SEQ ID NO: 182709 - DNA, 23 bp, Mus musculus
atttgaacacatggtatggtgag

SEQ ID NO: 182710 - DNA, 23 bp, Mus musculus
atctcacacactctgttttcttc

SEQ ID NO: 182711 - DNA, 20 bp, Mus musculus
atttatacacatatacaagt

SEQ ID NO: 182712 - DNA, 23 bp, Mus musculus
cattcagcttgagtttccatatc

SEQ ID NO: 182713 - DNA, 22 bp, Mus musculus
ggttgatatgtttgagatcagc

SEQ ID NO: 182714 - DNA, 23 bp, Mus musculus
gtgctcactcagtctctgcctct

SEQ ID NO: 182715 - DNA, 23 bp, Mus musculus
tgaggatcacactgtctcacagc

SEQ ID NO: 182716 - DNA, 21 bp, Mus musculus
tgaggtagaagcatcatgagt

SEQ ID NO: 182717 - DNA, 23 bp, Mus musculus
ctgtgggtctctgtgactgttca

SEQ ID NO: 182718 - DNA, 23 bp, Mus musculus
gtgtcactgacacagtcacacac

SEQ ID NO: 182719 - DNA, 21 bp, Mus musculus
tgagaccagggttcattcccc

SEQ ID NO: 182720 - DNA, 20 bp, Mus musculus
aacctggaacttgataggta

SEQ ID NO: 182721 - DNA, 20 bp, Mus musculus
tgctgcttgttctttgtggt

SEQ ID NO: 182722 - DNA, 18 bp, Mus musculus
gtctgcctgtctctgcct

SEQ ID NO: 182723 - DNA, 23 bp, Mus musculus
agagttcagccttgacactctct

SEQ ID NO: 182724 - DNA, 23 bp, Mus musculus
atatgtgtatatatatgtgtgtg

SEQ ID NO: 182725 - DNA, 23 bp, Mus musculus
gtatgtgtgtgtttatctatatc

SEQ ID NO: 182726 - DNA, 22 bp, Mus musculus
tgtatatatatgaatatgtgag

SEQ ID NO: 182727 - DNA, 20 bp, Mus musculus
tgtcttgaagattctctgtt

SEQ ID NO: 182728 - DNA, 22 bp, Mus musculus
aaatcaacaaactgtttctcat

SEQ ID NO: 182729 - DNA, 23 bp, Mus musculus
tattttgtgtggtatttgtacag

SEQ ID NO: 182730 - DNA, 23 bp, Mus musculus
tagttttattggttttgatgaga

SEQ ID NO: 182731 - DNA, 18 bp, Mus musculus
ttttgtatctgttgagtc

SEQ ID NO: 182732 - DNA, 23 bp, Mus musculus
gattacagttctgtgtttgtata

SEQ ID NO: 182733 - DNA, 20 bp, Mus musculus
atgcagtggtacattacagg

SEQ ID NO: 182734 - DNA, 18 bp, Mus musculus
attggagagatggctcag

SEQ ID NO: 182735 - DNA, 23 bp, Mus musculus
tggctccctctctggctccctca

SEQ ID NO: 182736 - DNA, 23 bp, Mus musculus
tccctggctccctgcctgcctcc

SEQ ID NO: 182737 - DNA, 23 bp, Mus musculus
ttctgagtgagttttgttcaagt

SEQ ID NO: 182738 - DNA, 23 bp, Mus musculus
atgagagtgtatatgtatgcgta

SEQ ID NO: 182739 - DNA, 22 bp, Mus musculus
tatgtgtgtatgcatgtgtagt

SEQ ID NO: 182740 - DNA, 21 bp, Mus musculus
atgtagtgtgagtgtgtgtgc

SEQ ID NO: 182741 - DNA, 21 bp, Mus musculus
ggtatacatgcacgtgtgtgc

SEQ ID NO: 182742 - DNA, 23 bp, Mus musculus
gtatgtatgtatgtatgtatgta

SEQ ID NO: 182743 - DNA, 21 bp, Mus musculus
gcatatgtgtgcatatgcatg

SEQ ID NO: 182744 - DNA, 23 bp, Mus musculus
aagaatgtatgtgtgtatgtgca

SEQ ID NO: 182745 - DNA, 23 bp, Mus musculus
acctccaactctcactgtctctc

SEQ ID NO: 182746 - DNA, 22 bp, Mus musculus
tgtcaggctctgtcagagcctc

SEQ ID NO: 182747 - DNA, 23 bp, Mus musculus
agacagaaccctgagaggactca

SEQ ID NO: 182748 - DNA, 22 bp, Mus musculus
accaatgtattgaagtatccac

SEQ ID NO: 182749 - DNA, 23 bp, Mus musculus
atgtgtgtatatatatgtgtgta

SEQ ID NO: 182750 - DNA, 21 bp, Mus musculus
ctgtggtttgtgtatgtatga

SEQ ID NO: 182751 - DNA, 22 bp, Mus musculus
tgttttgtgaccaattatatgg

SEQ ID NO: 182752 - DNA, 19 bp, Mus musculus
gtatagatgtataaatgtg

SEQ ID NO: 182753 - DNA, 20 bp, Mus musculus
gacagtagtcaggcagcact

SEQ ID NO: 182754 - DNA, 22 bp, Mus musculus
tgttttgtgaccaattatatgg

SEQ ID NO: 182755 - DNA, 23 bp, Mus musculus
gtcagtctgtctgtctctgcctg

SEQ ID NO: 182756 - DNA, 23 bp, Mus musculus
acacctggagaaaaagttgagag

SEQ ID NO: 182757 - DNA, 22 bp, Mus musculus
tagctcagtattgtgggtggag

SEQ ID NO: 182758 - DNA, 21 bp, Mus musculus
tgtgtatatatatatgtgtgt

SEQ ID NO: 182759 - DNA, 23 bp, Mus musculus
tcacagtgtctctgcatccctct

SEQ ID NO: 182760 - DNA, 20 bp, Mus musculus
atgtgtgtatatatatatgt

SEQ ID NO: 182761 - DNA, 21 bp, Mus musculus
tatatgcatatatatgcatat

SEQ ID NO: 182762 - DNA, 18 bp, Mus musculus
aggagcttcatgaacagt

SEQ ID NO: 182763 - DNA, 23 bp, Mus musculus
acaatgacaagggtttttgatga

SEQ ID NO: 182764 - DNA, 19 bp, Mus musculus
atcagcctggatcatgatt

SEQ ID NO: 182765 - DNA, 23 bp, Mus musculus
ctgtgtctgtctcagtcagttgg

SEQ ID NO: 182766 - DNA, 21 bp, Mus musculus
tgtcagaaaatcttgcaatga

SEQ ID NO: 182767 - DNA, 21 bp, Mus musculus
ttacagaacagactgaggact

SEQ ID NO: 182768 - DNA, 21 bp, Mus musculus
tccctgtagttaagtaatggc

SEQ ID NO: 182769 - DNA, 20 bp, Mus musculus
agtgctggcaagtctcgctg

SEQ ID NO: 182770 - DNA, 23 bp, Mus musculus
tgagtgacactgtagcgctttca

SEQ ID NO: 182771 - DNA, 23 bp, Mus musculus
tctctgtgtgtgtctgtgtctcc

SEQ ID NO: 182772 - DNA, 23 bp, Mus musculus
tcagagcttctgaggctgagacg

SEQ ID NO: 182773 - DNA, 23 bp, Mus musculus
ctcagggtctctctctgttttct

SEQ ID NO: 182774 - DNA, 23 bp, Mus musculus
acactggacagtctggacacagt

SEQ ID NO: 182775 - DNA, 20 bp, Mus musculus
gatatgtatagcatattcat

SEQ ID NO: 182776 - DNA, 19 bp, Mus musculus
acagtgtgtgtgtgcatgc

SEQ ID NO: 182777 - DNA, 22 bp, Mus musculus
atgtatgtatgcatgtgtgtgc

SEQ ID NO: 182778 - DNA, 23 bp, Mus musculus
tcagaaggttttggtatcagagg

SEQ ID NO: 182779 - DNA, 23 bp, Mus musculus
tgtctgtctgtctgtctgtctgt

SEQ ID NO: 182780 - DNA, 19 bp, Mus musculus
tgtgtatatatacatatgt

SEQ ID NO: 182781 - DNA, 21 bp, Mus musculus
atcatttatgacactcacact

SEQ ID NO: 182782 - DNA, 21 bp, Mus musculus
ataaatgttgagagaggaggt

SEQ ID NO: 182783 - DNA, 19 bp, Mus musculus
tgtatgtatgtatatgcat

SEQ ID NO: 182784 - DNA, 22 bp, Mus musculus
tgttttgtgaccaattatatgg

SEQ ID NO: 182785 - DNA, 22 bp, Mus musculus
tgttttgtgaccaattatatgg

SEQ ID NO: 182786 - DNA, 23 bp, Mus musculus
tgactgtgagtctctgtatctgc

SEQ ID NO: 182787 - DNA, 23 bp, Mus musculus
tgggaggaagcttctctgatgac

SEQ ID NO: 182788 - DNA, 23 bp, Mus musculus
tctcagtctgactgagttcccgg

SEQ ID NO: 182789 - DNA, 20 bp, Mus musculus
ttgtctctgactgtgaactt

SEQ ID NO: 182790 - DNA, 23 bp, Mus musculus
tatatgtatatatatgtatgtgt

SEQ ID NO: 182791 - DNA, 23 bp, Mus musculus
aaaggtgtcattttgatataatg

SEQ ID NO: 182792 - DNA, 23 bp, Mus musculus
agttgtggaagtattctgatgtc

SEQ ID NO: 182793 - DNA, 23 bp, Mus musculus
attctgtatttctatttctgtga

SEQ ID NO: 182794 - DNA, 22 bp, Mus musculus
tgtgtgtgtgtgcatgtgaatg

SEQ ID NO: 182795 - DNA, 20 bp, Mus musculus
tgtatgtgtgcatgtgcatg

SEQ ID NO: 182796 - DNA, 22 bp, Mus musculus
tgtatgtgtgcatgtgcatgtg

SEQ ID NO: 182797 - DNA, 21 bp, Mus musculus
atatagactatgtatatgtga

SEQ ID NO: 182798 - DNA, 18 bp, Mus musculus
acactcacatacatgtga

SEQ ID NO: 182799 - DNA, 23 bp, Mus musculus
ttatatactgatatacatgtttg

SEQ ID NO: 182800 - DNA, 23 bp, Mus musculus
ataagtatgtgcacactttgtgt

SEQ ID NO: 182801 - DNA, 23 bp, Mus musculus
ctctgtctctgactggagcctgt

SEQ ID NO: 182802 - DNA, 23 bp, Mus musculus
tgtgatcctggttgtgtcagagc

SEQ ID NO: 182803 - DNA, 23 bp, Mus musculus
tgtatgtatgtatgtatgtatgt

SEQ ID NO: 182804 - DNA, 23 bp, Mus musculus
tgtcccacacactctgaattggg

SEQ ID NO: 182805 - DNA, 21 bp, Mus musculus
atagttacacatatacatgat

SEQ ID NO: 182806 - DNA, 19 bp, Mus musculus
tgactctggctctctgaag

SEQ ID NO: 182807 - DNA, 19 bp, Mus musculus
cactgtgtacactcatgga

SEQ ID NO: 182808 - DNA, 22 bp, Mus musculus
ttccagcattagaaatgagagc

SEQ ID NO: 182809 - DNA, 23 bp, Mus musculus
aaagcactgattaacatgatcta

SEQ ID NO: 182810 - DNA, 23 bp, Mus musculus
ttccatatatatgtaataatgtg

SEQ ID NO: 182811 - DNA, 21 bp, Mus musculus
tcacagtctcagagttagcca

SEQ ID NO: 182812 - DNA, 21 bp, Mus musculus
ttgagagaagtttctgaacag

SEQ ID NO: 182813 - DNA, 22 bp, Mus musculus
tgtgtatatatgtatatgtgtg

SEQ ID NO: 182814 - DNA, 23 bp, Mus musculus
atacacacacacatatatatatg

SEQ ID NO: 182815 - DNA, 23 bp, Mus musculus
gtctgtctgtctgtctgtctgtc

SEQ ID NO: 182816 - DNA, 21 bp, Mus musculus
cactgctaaagctaaggagag

SEQ ID NO: 182817 - DNA, 23 bp, Mus musculus
agtctcactgccaggctgattgg

SEQ ID NO: 182818 - DNA, 19 bp, Mus musculus
taggtacagatttagaaac

SEQ ID NO: 182819 - DNA, 21 bp, Mus musculus
tcactctgtatgaggaggtgc

SEQ ID NO: 182820 - DNA, 22 bp, Mus musculus
tcagctccattagcaaagctat

SEQ ID NO: 182821 - DNA, 22 bp, Mus musculus
ctgagctgtgatgcaggctctc

SEQ ID NO: 182822 - DNA, 18 bp, Mus musculus
aagtcctagagataactc

SEQ ID NO: 182823 - DNA, 18 bp, Mus musculus
gagggtgactgtgggcca

SEQ ID NO: 182824 - DNA, 23 bp, Mus musculus
atctgtgtggcaaagatcttcct

SEQ ID NO: 182825 - DNA, 20 bp, Mus musculus
agatctgttaagatggtctg

SEQ ID NO: 182826 - DNA, 23 bp, Mus musculus
tagctcactgatctgtctgagtc

SEQ ID NO: 182827 - DNA, 23 bp, Mus musculus
tgtctcagtgagaggctctcctt

SEQ ID NO: 182828 - DNA, 23 bp, Mus musculus
cttagtacatgcagaggctctgt

SEQ ID NO: 182829 - DNA, 23 bp, Mus musculus
acagtctctgtctcactaatgtg

SEQ ID NO: 182830 - DNA, 23 bp, Mus musculus
agctgtctccctctgtatcctca

SEQ ID NO: 182831 - DNA, 23 bp, Mus musculus
tttctctctgtgtctttatcccc

SEQ ID NO: 182832 - DNA, 18 bp, Mus musculus
tatctgtgtcgctctctt

SEQ ID NO: 182833 - DNA, 19 bp, Mus musculus
tatgtacatatgtatatat

SEQ ID NO: 182834 - DNA, 23 bp, Mus musculus
atatgtatatatatttatgtgac

SEQ ID NO: 182835 - DNA, 23 bp, Mus musculus
tgaaagagaatgagcaaaggacc

SEQ ID NO: 182836 - DNA, 23 bp, Mus musculus
cctctcactgactcagcttctga

SEQ ID NO: 182837 - DNA, 23 bp, Mus musculus
gggcactctgtgactgcgtgagc

SEQ ID NO: 182838 - DNA, 23 bp, Mus musculus
gcatcagagaagatggagtggac

SEQ ID NO: 182839 - DNA, 23 bp, Mus musculus
aaagctgttgtaactttccttgt

SEQ ID NO: 182840 - DNA, 23 bp, Mus musculus
ttacacaagagagagagcagaac

SEQ ID NO: 182841 - DNA, 23 bp, Mus musculus
ttactgtagtctgtgaggagaac

SEQ ID NO: 182842 - DNA, 22 bp, Mus musculus
aaacttctagatctcaggagca

SEQ ID NO: 182843 - DNA, 20 bp, Mus musculus
tgagtggatgcacactgtta

SEQ ID NO: 182844 - DNA, 23 bp, Mus musculus
tgtgcatctgactcacacagtcc

SEQ ID NO: 182845 - DNA, 22 bp, Mus musculus
tatctatgtatctatctgtctg

SEQ ID NO: 182846 - DNA, 23 bp, Mus musculus
acagcttctgggacagcatcctt

SEQ ID NO: 182847 - DNA, 23 bp, Mus musculus
tttggatcaagatgtagaactct

SEQ ID NO: 182848 - DNA, 20 bp, Mus musculus
tctgagtgagattcatgcat

SEQ ID NO: 182849 - DNA, 22 bp, Mus musculus
tgttgtatggttatcctgcact

SEQ ID NO: 182850 - DNA, 21 bp, Mus musculus
tgtgtacatgtatatgtgtgt

SEQ ID NO: 182851 - DNA, 23 bp, Mus musculus
atgtatgtacatgtatatgtgtg

SEQ ID NO: 182852 - DNA, 23 bp, Mus musculus
tgtctctctgtgagtgcgtgtgc

SEQ ID NO: 182853 - DNA, 20 bp, Mus musculus
acacacacagataaatattt

SEQ ID NO: 182854 - DNA, 23 bp, Mus musculus
tacagacagatgagactaaccag

SEQ ID NO: 182855 - DNA, 23 bp, Mus musculus
ttaaatccacattttctagttca

SEQ ID NO: 182856 - DNA, 23 bp, Mus musculus
attctctctgtgtctctctctgt

SEQ ID NO: 182857 - DNA, 23 bp, Mus musculus
gagatttgtctgtttctctgtct

SEQ ID NO: 182858 - DNA, 20 bp, Mus musculus
atgtgtatacatgtatatac

SEQ ID NO: 182859 - DNA, 23 bp, Mus musculus
tgtctgtgcctcagtatctcagt

SEQ ID NO: 182860 - DNA, 23 bp, Mus musculus
tcagtggtgcttgtttgctgtgt

SEQ ID NO: 182861 - DNA, 21 bp, Mus musculus
caaggtctacagggacctggg

SEQ ID NO: 182862 - DNA, 23 bp, Mus musculus
agggactgaagagatggctcagt

SEQ ID NO: 182863 - DNA, 23 bp, Mus musculus
tattgtcagtacagagatggatg

SEQ ID NO: 182864 - DNA, 21 bp, Mus musculus
atagccttggatatttaatga

SEQ ID NO: 182865 - DNA, 18 bp, Mus musculus
gtatgcatacacagcagt

SEQ ID NO: 182866 - DNA, 23 bp, Mus musculus
agtctgtctgcctctctcatcaa

SEQ ID NO: 182867 - DNA, 23 bp, Mus musculus
tgactccctcactggcttacctg

SEQ ID NO: 182868 - DNA, 23 bp, Mus musculus
ggaggtttgtatatgagatggac

SEQ ID NO: 182869 - DNA, 22 bp, Mus musculus
ttgagctgtgtgaggacactgg

SEQ ID NO: 182870 - DNA, 23 bp, Mus musculus
cactgtctctgtcagcattaatc

SEQ ID NO: 182871 - DNA, 23 bp, Mus musculus
atttggacttgatcatgatatga

SEQ ID NO: 182872 - DNA, 23 bp, Mus musculus
tagtgcttcactattgagttagg

SEQ ID NO: 182873 - DNA, 21 bp, Mus musculus
tgtgtcagcagatatctgtga

SEQ ID NO: 182874 - DNA, 23 bp, Mus musculus
tgtgtcagaagatatttgtgagt

SEQ ID NO: 182875 - DNA, 22 bp, Mus musculus
tatttgtgagtagtgtgtccgc

SEQ ID NO: 182876 - DNA, 22 bp, Mus musculus
tgtgagtagtgtgtcagcagat

SEQ ID NO: 182877 - DNA, 22 bp, Mus musculus
tgttttgtgaccaattatatgg

SEQ ID NO: 182878 - DNA, 23 bp, Mus musculus
acttcagtgtgcttgctttgagt

SEQ ID NO: 182879 - DNA, 22 bp, Mus musculus
tgtctcactctcacttcaatcc

SEQ ID NO: 182880 - DNA, 22 bp, Mus musculus
cactggaatctccaaaggccta

SEQ ID NO: 182881 - DNA, 22 bp, Mus musculus
tgttttgtgaccaattatatgg

SEQ ID NO: 182882 - DNA, 23 bp, Mus musculus
ccctctctctctgtctatctgtc

SEQ ID NO: 182883 - DNA, 19 bp, Mus musculus
tgtctatattaatacagat

SEQ ID NO: 182884 - DNA, 23 bp, Mus musculus
tttagacaggtatagataactta

SEQ ID NO: 182885 - DNA, 23 bp, Mus musculus
tttctgtgtgcctcactgctctg

SEQ ID NO: 182886 - DNA, 20 bp, Mus musculus
atgtatgtatgtatgtatgt

SEQ ID NO: 182887 - DNA, 21 bp, Mus musculus
tggaaagttaacatgttactt

SEQ ID NO: 182888 - DNA, 22 bp, Mus musculus
tgtgagccactttatgatgtta

SEQ ID NO: 182889 - DNA, 23 bp, Mus musculus
gtgttacacaactgattttgaac

SEQ ID NO: 182890 - DNA, 23 bp, Mus musculus
acaattttctgcttctggtagca

SEQ ID NO: 182891 - DNA, 23 bp, Mus musculus
aggtatgtatgcaagtgtgtgtg

SEQ ID NO: 182892 - DNA, 18 bp, Mus musculus
tatgtatgtatgtatgta

SEQ ID NO: 182893 - DNA, 22 bp, Mus musculus
gggaagggtctgtctttgtttt

SEQ ID NO: 182894 - DNA, 18 bp, Mus musculus
acatatgtatatctgtat

SEQ ID NO: 182895 - DNA, 23 bp, Mus musculus
tatgtatatgtatgcgtatgtgt

SEQ ID NO: 182896 - DNA, 19 bp, Mus musculus
acagaggatgaaatttcat

SEQ ID NO: 182897 - DNA, 23 bp, Mus musculus
taaagtagtcagcactaaggttt

SEQ ID NO: 182898 - DNA, 23 bp, Mus musculus
agggtctctctgtgtaacaagcc

SEQ ID NO: 182899 - DNA, 19 bp, Mus musculus
tctctttgtagtcctgtct

SEQ ID NO: 182900 - DNA, 23 bp, Mus musculus
cacagagcttgaacatgacaaag

SEQ ID NO: 182901 - DNA, 23 bp, Mus musculus
tgtcagtcagtgtcacaggtgtc

SEQ ID NO: 182902 - DNA, 22 bp, Mus musculus
tatgtatatgtatacctatacc

SEQ ID NO: 182903 - DNA, 23 bp, Mus musculus
atatgtatatgtatatgtatatg

SEQ ID NO: 182904 - DNA, 23 bp, Mus musculus
gagagcctacatctggacgtgtt

SEQ ID NO: 182905 - DNA, 22 bp, Mus musculus
aatatcctcattttgtaaatga

SEQ ID NO: 182906 - DNA, 22 bp, Mus musculus
atgtcaatatatatgtgtgtgt

SEQ ID NO: 182907 - DNA, 20 bp, Mus musculus
atatgtatatatgtgtatgt

SEQ ID NO: 182908 - DNA, 20 bp, Mus musculus
atatgtatatatgtgtatgt

SEQ ID NO: 182909 - DNA, 23 bp, Mus musculus
gtgagatttgtgtttgtgtgact

SEQ ID NO: 182910 - DNA, 23 bp, Mus musculus
atttcaaagttttagaattcttc

SEQ ID NO: 182911 - DNA, 22 bp, Mus musculus
atatgtccacataatgatctac

SEQ ID NO: 182912 - DNA, 23 bp, Mus musculus
tgtgtgtgtgcatatgcatgtgc

SEQ ID NO: 182913 - DNA, 22 bp, Mus musculus
tgttttgtgaccaattatatgg

SEQ ID NO: 182914 - DNA, 23 bp, Mus musculus
gtcttagtacaacagctagagaa

SEQ ID NO: 182915 - DNA, 23 bp, Mus musculus
atgtatgtatatgtatatgtgtg

SEQ ID NO: 182916 - DNA, 22 bp, Mus musculus
taaaacagatgttttgttttct

SEQ ID NO: 182917 - DNA, 23 bp, Mus musculus
gagatagatgatagagatagagc

SEQ ID NO: 182918 - DNA, 23 bp, Mus musculus
ctgtgagcatctgcatctggatt

SEQ ID NO: 182919 - DNA, 20 bp, Mus musculus
tgtgactgattttcctgaga

SEQ ID NO: 182920 - DNA, 21 bp, Mus musculus
aatacatagaacaggaatcag

SEQ ID NO: 182921 - DNA, 23 bp, Mus musculus
atttcagagtacacagtttggac

SEQ ID NO: 182922 - DNA, 18 bp, Mus musculus
ctcttatggaaatgttgt

SEQ ID NO: 182923 - DNA, 22 bp, Mus musculus
tgcatgtatgtatgtatgtatg

SEQ ID NO: 182924 - DNA, 23 bp, Mus musculus
acatgtgtatatatatttgtgtg

SEQ ID NO: 182925 - DNA, 21 bp, Mus musculus
aatcactgagacacataatac

SEQ ID NO: 182926 - DNA, 22 bp, Mus musculus
tctgaggatgtagtttgtggaa

SEQ ID NO: 182927 - DNA, 23 bp, Mus musculus
acagaactgagactcttttcaag

SEQ ID NO: 182928 - DNA, 21 bp, Mus musculus
agtctctgaggaactcatgag

SEQ ID NO: 182929 - DNA, 22 bp, Mus musculus
tgttttgtgaccaattatatgg

SEQ ID NO: 182930 - DNA, 22 bp, Mus musculus
agagagataggtgtatgcatgt

SEQ ID NO: 182931 - DNA, 18 bp, Mus musculus
atgtatatgtacatgtat

SEQ ID NO: 182932 - DNA, 23 bp, Mus musculus
tatacatagatgtgtgtgtgcat

SEQ ID NO: 182933 - DNA, 21 bp, Mus musculus
tctctccctctcactgttcct

SEQ ID NO: 182934 - DNA, 23 bp, Mus musculus
tgattgtacaaacgcattactgg

SEQ ID NO: 182935 - DNA, 20 bp, Mus musculus
gctgttctagctctctgtga

SEQ ID NO: 182936 - DNA, 22 bp, Mus musculus
tatgtgtgtgcaaatgcatgtg

SEQ ID NO: 182937 - DNA, 22 bp, Mus musculus
aaagatcactggctgctcgtca

SEQ ID NO: 182938 - DNA, 23 bp, Mus musculus
ctgagcgtcctttggaattctgt

SEQ ID NO: 182939 - DNA, 23 bp, Mus musculus
tgagagatgagtgtgaagcctgc

SEQ ID NO: 182940 - DNA, 23 bp, Mus musculus
ggatgcctggctgcgtgtttcct

SEQ ID NO: 182941 - DNA, 23 bp, Mus musculus
ccacagtgggtctgtctgtgtga

SEQ ID NO: 182942 - DNA, 23 bp, Mus musculus
acagagacacactatatacatgt

SEQ ID NO: 182943 - DNA, 23 bp, Mus musculus
ctatacatctgtgtgtctctgta

SEQ ID NO: 182944 - DNA, 22 bp, Mus musculus
tatatgtgtatatgtatatgtg

SEQ ID NO: 182945 - DNA, 23 bp, Mus musculus
ttatgtatgtgtatatgtatatg

SEQ ID NO: 182946 - DNA, 23 bp, Mus musculus
cagaattgtgactctaaaggcta

SEQ ID NO: 182947 - DNA, 23 bp, Mus musculus
tatgtacatatgtatatgtacat

SEQ ID NO: 182948 - DNA, 23 bp, Mus musculus
ttatgtgtttatgtacttgtgta

SEQ ID NO: 182949 - DNA, 19 bp, Mus musculus
atgtgtgtatgcatgtgtg

SEQ ID NO: 182950 - DNA, 22 bp, Mus musculus
atgtccatcagaacatgtcaaa

SEQ ID NO: 182951 - DNA, 19 bp, Mus musculus
aactgcaacttggtgtggt

SEQ ID NO: 182952 - DNA, 23 bp, Mus musculus
agacactggctatttgtgtgtgt

SEQ ID NO: 182953 - DNA, 22 bp, Mus musculus
ctatggatgtatatgtttatgt

SEQ ID NO: 182954 - DNA, 21 bp, Mus musculus
agtgcactcgacatctgtgtg

SEQ ID NO: 182955 - DNA, 23 bp, Mus musculus
aatgtgtgcatatgtgtacctgg

SEQ ID NO: 182956 - DNA, 21 bp, Mus musculus
agtgctacatggttgtattct

SEQ ID NO: 182957 - DNA, 18 bp, Mus musculus
cagtgagtacacaatgag

SEQ ID NO: 182958 - DNA, 23 bp, Mus musculus
cactgactgctcttcctgaggtc

SEQ ID NO: 182959 - DNA, 23 bp, Mus musculus
ctgccctatctgacactctctca

SEQ ID NO: 182960 - DNA, 22 bp, Mus musculus
tgttttgtgaccaattatatgg

SEQ ID NO: 182961 - DNA, 23 bp, Mus musculus
ttgctgcatcctctctgtgtctc

SEQ ID NO: 182962 - DNA, 22 bp, Mus musculus
gggtgtacatgtgcatgtgtgt

SEQ ID NO: 182963 - DNA, 19 bp, Mus musculus
atgtgggtgtacatgtgca

SEQ ID NO: 182964 - DNA, 23 bp, Mus musculus
tgtgggtgtgcatgtgcatgtgt

SEQ ID NO: 182965 - DNA, 23 bp, Mus musculus
tgtgggtgtgcatgtgcatgtgt

SEQ ID NO: 182966 - DNA, 23 bp, Mus musculus
tgggtgtgcatgtgcatgtgtgt

SEQ ID NO: 182967 - DNA, 20 bp, Mus musculus
atgtgggtgtgcatgtgcat

SEQ ID NO: 182968 - DNA, 23 bp, Mus musculus
tgggtgtgcatgtgcatgtgtgt

SEQ ID NO: 182969 - DNA, 20 bp, Mus musculus
atgtgggtgtacatgtgcat

SEQ ID NO: 182970 - DNA, 23 bp, Mus musculus
tttgtctgcctctgtctctccgt

SEQ ID NO: 182971 - DNA, 21 bp, Mus musculus
taatctttggtagtgaaggct

SEQ ID NO: 182972 - DNA, 23 bp, Mus musculus
ctgagtactgagagacctcagaa

SEQ ID NO: 182973 - DNA, 23 bp, Mus musculus
tctctgtagtgtctgagtcctca

SEQ ID NO: 182974 - DNA, 23 bp, Mus musculus
gtcagtctctctgtggtaatact

SEQ ID NO: 182975 - DNA, 22 bp, Mus musculus
tatatttttgaactcatgctct

SEQ ID NO: 182976 - DNA, 19 bp, Mus musculus
atatatgtatatgtatatg

SEQ ID NO: 182977 - DNA, 22 bp, Mus musculus
tgttttgtgaccaattatatgg

SEQ ID NO: 182978 - DNA, 22 bp, Mus musculus
tgttttgtgaccaattatatgg

SEQ ID NO: 182979 - DNA, 19 bp, Mus musculus
gttgtcagtgtctgtctca

SEQ ID NO: 182980 - DNA, 19 bp, Mus musculus
agagcctcctacagactct

SEQ ID NO: 182981 - DNA, 23 bp, Mus musculus
ctcacagacattaggcattctgt

SEQ ID NO: 182982 - DNA, 23 bp, Mus musculus
gactgtgagaatagacagagggc

SEQ ID NO: 182983 - DNA, 23 bp, Mus musculus
caggttgaaaattctccaagtgg

SEQ ID NO: 182984 - DNA, 23 bp, Mus musculus
catgtggatggtaatgaattcaa

SEQ ID NO: 182985 - DNA, 20 bp, Mus musculus
cacttttctctgctggactt

SEQ ID NO: 182986 - DNA, 23 bp, Mus musculus
tgtgtgtgtgtgtgtacatggaa

SEQ ID NO: 182987 - DNA, 22 bp, Mus musculus
tgttttgtgaccaattatatgg

SEQ ID NO: 182988 - DNA, 21 bp, Mus musculus
aggagagtagagaatgagctc

SEQ ID NO: 182989 - DNA, 21 bp, Mus musculus
ttctccaggctgtgctggtac

SEQ ID NO: 182990 - DNA, 22 bp, Mus musculus
tgtcaccatgtcacactgcctg

SEQ ID NO: 182991 - DNA, 23 bp, Mus musculus
cactgaatatatatatatgtgtg

SEQ ID NO: 182992 - DNA, 23 bp, Mus musculus
acatcagtctgtttctctcttct

SEQ ID NO: 182993 - DNA, 23 bp, Mus musculus
cagaggctctgtcagtgcctcac

SEQ ID NO: 182994 - DNA, 23 bp, Mus musculus
agatacagtgtatatgtagttga

SEQ ID NO: 182995 - DNA, 23 bp, Mus musculus
tgtctgtctgtctgtccagtatc

SEQ ID NO: 182996 - DNA, 23 bp, Mus musculus
ttattgtctgaccaagacagatc

SEQ ID NO: 182997 - DNA, 23 bp, Mus musculus
ctgtgtcactgtttagtttctgt

SEQ ID NO: 182998 - DNA, 21 bp, Mus musculus
atctgtccattgatgagagtg

SEQ ID NO: 182999 - DNA, 23 bp, Mus musculus
tatgtgtgtatatatgtatgtgt

SEQ ID NO: 183000 - DNA, 23 bp, Mus musculus
cctatgtgcatatgtatttctca

SEQ ID NO: 183001 - DNA, 23 bp, Mus musculus
tgaatgtatttatgtatgtgtgt

SEQ ID NO: 183002 - DNA, 23 bp, Mus musculus
actatgtatgcatatgtacatgt

SEQ ID NO: 183003 - DNA, 23 bp, Mus musculus
cacatgctttaacaagtgattgc

SEQ ID NO: 183004 - DNA, 22 bp, Mus musculus
tgttttgtgaccaattatatgg

SEQ ID NO: 183005 - DNA, 18 bp, Mus musculus
agcagtaggaagccttgt

SEQ ID NO: 183006 - DNA, 23 bp, Mus musculus
taaactctgttcagtgtgtgtca

SEQ ID NO: 183007 - DNA, 21 bp, Mus musculus
aatttctatatcatcctgtgt

SEQ ID NO: 183008 - DNA, 23 bp, Mus musculus
tgatttcacagtcagctttggtg

SEQ ID NO: 183009 - DNA, 23 bp, Mus musculus
ggaatcatggtacagagtaagaa

SEQ ID NO: 183010 - DNA, 23 bp, Mus musculus
acaggctcacactcactgttgtc

SEQ ID NO: 183011 - DNA, 22 bp, Mus musculus
tgttttgtgaccaattatatgg

SEQ ID NO: 183012 - DNA, 23 bp, Mus musculus
taagatcttaagaatccttgttg

SEQ ID NO: 183013 - DNA, 22 bp, Mus musculus
tgttttgtgaccaattatatgg

SEQ ID NO: 183014 - DNA, 23 bp, Mus musculus
tgtatgtatgtttgtatgtatgt

SEQ ID NO: 183015 - DNA, 22 bp, Mus musculus
tgttttgtgaccaattatatgg

SEQ ID NO: 183016 - DNA, 23 bp, Mus musculus
ttcagactgtggagtcttggtgt

SEQ ID NO: 183017 - DNA, 19 bp, Mus musculus
taggactgaggtttacagg

SEQ ID NO: 183018 - DNA, 23 bp, Mus musculus
caaagaattctccttttgggctt

SEQ ID NO: 183019 - DNA, 23 bp, Mus musculus
acactgtctcagaaagctgactc

SEQ ID NO: 183020 - DNA, 23 bp, Mus musculus
atatgatgcacagacatatgctt

SEQ ID NO: 183021 - DNA, 20 bp, Mus musculus
gtgtgtgtgcatgtgcatgt

SEQ ID NO: 183022 - DNA, 23 bp, Mus musculus
tgtgtgcttgcatgtttgtgtgt

SEQ ID NO: 183023 - DNA, 22 bp, Mus musculus
tgttttgtgaccaattatatgg

SEQ ID NO: 183024 - DNA, 22 bp, Mus musculus
tgttttgtgaccaattatatgg

SEQ ID NO: 183025 - DNA, 23 bp, Mus musculus
tctgtgtcaggcagtgttctggg

SEQ ID NO: 183026 - DNA, 23 bp, Mus musculus
tatgtatgtatgtgtgtacttat

SEQ ID NO: 183027 - DNA, 22 bp, Mus musculus
atgtgcatgtgtcaaattgttg

SEQ ID NO: 183028 - DNA, 23 bp, Mus musculus
acactgactctcagtgagcactg

SEQ ID NO: 183029 - DNA, 20 bp, Mus musculus
aacaatagtgattttgctca

SEQ ID NO: 183030 - DNA, 23 bp, Mus musculus
atccactcatgtatagaagtaag

SEQ ID NO: 183031 - DNA, 22 bp, Mus musculus
tcagtggatcacagtaacataa

SEQ ID NO: 183032 - DNA, 23 bp, Mus musculus
taaatgcatcatgttttgtgtct

SEQ ID NO: 183033 - DNA, 23 bp, Mus musculus
atgcaacagaatcagcttgtaag

SEQ ID NO: 183034 - DNA, 23 bp, Mus musculus
actctcaggctgcattcatcagc

SEQ ID NO: 183035 - DNA, 22 bp, Mus musculus
tgtatgtgtatatctatatcta

SEQ ID NO: 183036 - DNA, 23 bp, Mus musculus
taagtacttgtgcatgtgctatg

SEQ ID NO: 183037 - DNA, 20 bp, Mus musculus
atgaaatcagtatgtggtgg

SEQ ID NO: 183038 - DNA, 23 bp, Mus musculus
tgaccctcaacatcccatatact

SEQ ID NO: 183039 - DNA, 23 bp, Mus musculus
tatatgcatgtgtgtgtacatat

SEQ ID NO: 183040 - DNA, 23 bp, Mus musculus
aagactagagacagagcagtctt

SEQ ID NO: 183041 - DNA, 23 bp, Mus musculus
ttctactttgtccttaggccttt

SEQ ID NO: 183042 - DNA, 23 bp, Mus musculus
atggagaagacactggctgacat

SEQ ID NO: 183043 - DNA, 18 bp, Mus musculus
atgtatgtatctatgtgt

SEQ ID NO: 183044 - DNA, 18 bp, Mus musculus
cagtgtggcttcaggcat

SEQ ID NO: 183045 - DNA, 23 bp, Mus musculus
tctcagtgtctctataacatctg

SEQ ID NO: 183046 - DNA, 22 bp, Mus musculus
tgttttgtgaccaattatatgg

SEQ ID NO: 183047 - DNA, 18 bp, Mus musculus
aattgagcatgtagaatc

SEQ ID NO: 183048 - DNA, 23 bp, Mus musculus
gctctcaatctctgtctattgtg

SEQ ID NO: 183049 - DNA, 22 bp, Mus musculus
tgttttgtgaccaattatatgg

SEQ ID NO: 183050 - DNA, 23 bp, Mus musculus
aatccatgatgatctgataggat

SEQ ID NO: 183051 - DNA, 23 bp, Mus musculus
aatccatgatgatctgataggat

SEQ ID NO: 183052 - DNA, 22 bp, Mus musculus
tgttttgtgaccaattatatgg

SEQ ID NO: 183053 - DNA, 21 bp, Mus musculus
atatgtatgaatgcattgctt

SEQ ID NO: 183054 - DNA, 20 bp, Mus musculus
tgcgtgtgtgtgtgtgtgtg

SEQ ID NO: 183055 - DNA, 22 bp, Mus musculus
tgttttgtgaccaattatatgg

SEQ ID NO: 183056 - DNA, 21 bp, Mus musculus
ttgaggtatttgaacaggtat

SEQ ID NO: 183057 - DNA, 19 bp, Mus musculus
tataggtgccttcagagtc

SEQ ID NO: 183058 - DNA, 21 bp, Mus musculus
attcctactcgaaaagatgtg

SEQ ID NO: 183059 - DNA, 23 bp, Mus musculus
agtccatgatggtctgataggat

SEQ ID NO: 183060 - DNA, 18 bp, Mus musculus
tatatggtcaattttgga

SEQ ID NO: 183061 - DNA, 23 bp, Mus musculus
ctaggaaatgcagtttttaggac

SEQ ID NO: 183062 - DNA, 22 bp, Mus musculus
tgttttgtgaccaattatatgg

SEQ ID NO: 183063 - DNA, 23 bp, Mus musculus
tgtctgagtcactcaatcttttg

SEQ ID NO: 183064 - DNA, 23 bp, Mus musculus
tcagtactgggaattgagttggc

SEQ ID NO: 183065 - DNA, 19 bp, Mus musculus
atgtgagtgtgcatgtgca

SEQ ID NO: 183066 - DNA, 23 bp, Mus musculus
tatgtgtgtatatatatatgtgt

SEQ ID NO: 183067 - DNA, 20 bp, Mus musculus
attatgaagcctttgggtct

SEQ ID NO: 183068 - DNA, 18 bp, Mus musculus
tatggttggtcttacaat

SEQ ID NO: 183069 - DNA, 23 bp, Mus musculus
actgactttggctctcttctctt

SEQ ID NO: 183070 - DNA, 18 bp, Mus musculus
tatatatatgtgcaccta

SEQ ID NO: 183071 - DNA, 23 bp, Mus musculus
atcatgtctgtgtatatgtgtgt

SEQ ID NO: 183072 - DNA, 23 bp, Mus musculus
agtggagtttctttgtgcagtgg

SEQ ID NO: 183073 - DNA, 23 bp, Mus musculus
gtatgtgcatgtgcatctgtatg

SEQ ID NO: 183074 - DNA, 23 bp, Mus musculus
atatagatagatatagatatagt

SEQ ID NO: 183075 - DNA, 23 bp, Mus musculus
ctgagtgtgtcttcagagctgta

SEQ ID NO: 183076 - DNA, 23 bp, Mus musculus
tttgactccagacacaatcagct

SEQ ID NO: 183077 - DNA, 23 bp, Mus musculus
gactctttctgtcactcccagtc

SEQ ID NO: 183078 - DNA, 22 bp, Mus musculus
tgttttgtgaccaattatatgg

SEQ ID NO: 183079 - DNA, 23 bp, Mus musculus
cgtcactctgtcactctgtcagc

SEQ ID NO: 183080 - DNA, 23 bp, Mus musculus
tttggagattttggcagtttgac

SEQ ID NO: 183081 - DNA, 21 bp, Mus musculus
tacataatgtatgtatatgta

SEQ ID NO: 183082 - DNA, 22 bp, Mus musculus
tgtatgtatttatatatgcatg

SEQ ID NO: 183083 - DNA, 23 bp, Mus musculus
atgtgtgtgtatgtatatatgtg

SEQ ID NO: 183084 - DNA, 23 bp, Mus musculus
atatgcacatatgttttgtatat

SEQ ID NO: 183085 - DNA, 22 bp, Mus musculus
gaaaaaggttctataatgtgga

SEQ ID NO: 183086 - DNA, 23 bp, Mus musculus
atttctggttcatctttggttac

SEQ ID NO: 183087 - DNA, 22 bp, Mus musculus
tgttttgtgaccaattatatgg

SEQ ID NO: 183088 - DNA, 23 bp, Mus musculus
cactaggtggaacactgttacta

SEQ ID NO: 183089 - DNA, 23 bp, Mus musculus
ttgtatgtgtgcatgtgcatgtg

SEQ ID NO: 183090 - DNA, 22 bp, Mus musculus
tgtgtgtgtgtatatgatgtat

SEQ ID NO: 183091 - DNA, 23 bp, Mus musculus
tctgactgatctgtcttggtcag

SEQ ID NO: 183092 - DNA, 23 bp, Mus musculus
cttagatactggacagacagaca

SEQ ID NO: 183093 - DNA, 23 bp, Mus musculus
aagccagatgtagaactttaggt

SEQ ID NO: 183094 - DNA, 18 bp, Mus musculus
agtggactttgaagtttc

SEQ ID NO: 183095 - DNA, 23 bp, Mus musculus
aagccagatgtagaactttaggt

SEQ ID NO: 183096 - DNA, 22 bp, Mus musculus
tgtgtgtgtgtgtgcatgtgtt

SEQ ID NO: 183097 - DNA, 23 bp, Mus musculus
atgtgtgtgtgcattagcatgtg

SEQ ID NO: 183098 - DNA, 23 bp, Mus musculus
tgactgggtgcaaaacattttat

SEQ ID NO: 183099 - DNA, 23 bp, Mus musculus
agatatatgtatttatgtatgta

SEQ ID NO: 183100 - DNA, 20 bp, Mus musculus
atgtactatgtgtgtatata

SEQ ID NO: 183101 - DNA, 20 bp, Mus musculus
tattatgtgtgtatttatgt

SEQ ID NO: 183102 - DNA, 23 bp, Mus musculus
tctctcactctctcattcttgtt

SEQ ID NO: 183103 - DNA, 22 bp, Mus musculus
ggatagataagtagatgaccga

SEQ ID NO: 183104 - DNA, 23 bp, Mus musculus
cgttctctcactggtcatgatgg

SEQ ID NO: 183105 - DNA, 22 bp, Mus musculus
tagtggaagtgttaacatgctt

SEQ ID NO: 183106 - DNA, 20 bp, Mus musculus
ctgaaggtgcgtgtatgtgt

SEQ ID NO: 183107 - DNA, 21 bp, Mus musculus
aatgactttctaggagttaga

SEQ ID NO: 183108 - DNA, 22 bp, Mus musculus
tggtttgtgtctgtaattctga

SEQ ID NO: 183109 - DNA, 21 bp, Mus musculus
accacacacttctgccacacc

SEQ ID NO: 183110 - DNA, 23 bp, Mus musculus
cggtgtctgtctgtgtgtgagcc

SEQ ID NO: 183111 - DNA, 23 bp, Mus musculus
tcactgtttgtcactgaggatgg

SEQ ID NO: 183112 - DNA, 18 bp, Mus musculus
agtctgaagtcagtgtgg

SEQ ID NO: 183113 - DNA, 19 bp, Mus musculus
gagagagagagagagagag

SEQ ID NO: 183114 - DNA, 23 bp, Mus musculus
tgcctcagtctctcacaggctgc

SEQ ID NO: 183115 - DNA, 21 bp, Mus musculus
tcagagaagtctctgttctca

SEQ ID NO: 183116 - DNA, 23 bp, Mus musculus
tgtctgtctgtctctctccatat

SEQ ID NO: 183117 - DNA, 22 bp, Mus musculus
tagatagatatagatgatctat

SEQ ID NO: 183118 - DNA, 21 bp, Mus musculus
tcatgtgcatacacatgtcta

SEQ ID NO: 183119 - DNA, 23 bp, Mus musculus
acacacatgtgtgtgtccagact

SEQ ID NO: 183120 - DNA, 23 bp, Mus musculus
acacacagatgtatagagaaaca

SEQ ID NO: 183121 - DNA, 23 bp, Mus musculus
tgtgtctctgtgtgtgcgtgtga

SEQ ID NO: 183122 - DNA, 23 bp, Mus musculus
aaagagtgcctcacttcagttct

SEQ ID NO: 183123 - DNA, 23 bp, Mus musculus
agtctgtctctctgcgtgagtgg

SEQ ID NO: 183124 - DNA, 23 bp, Mus musculus
gcctgactctgtctctgagtact

SEQ ID NO: 183125 - DNA, 19 bp, Mus musculus
tgcaacgttgtgggggcgt

SEQ ID NO: 183126 - DNA, 22 bp, Mus musculus
tgactggcactctctttggcag

SEQ ID NO: 183127 - DNA, 22 bp, Mus musculus
tgacacacctactccaacaggg

SEQ ID NO: 183128 - DNA, 23 bp, Mus musculus
gtgtgtctgactctgtgcctgtc

SEQ ID NO: 183129 - DNA, 19 bp, Mus musculus
ttggtgtaatgatggagtg

SEQ ID NO: 183130 - DNA, 23 bp, Mus musculus
tccttgttatgtattcaggctgt

SEQ ID NO: 183131 - DNA, 23 bp, Mus musculus
tgtgtgtgtataagtatgtatat

SEQ ID NO: 183132 - DNA, 22 bp, Mus musculus
tgttttgtgaccaattatatgg

SEQ ID NO: 183133 - DNA, 22 bp, Mus musculus
ttcaagttaacctgctttggat

SEQ ID NO: 183134 - DNA, 23 bp, Mus musculus
agagactcaggcactctgtcaga

SEQ ID NO: 183135 - DNA, 20 bp, Mus musculus
aagtgcatatcgagtactta

SEQ ID NO: 183136 - DNA, 18 bp, Mus musculus
gaactcatgatctaccac

SEQ ID NO: 183137 - DNA, 22 bp, Mus musculus
tgtgtgtgtgtgcatgtgcatg

SEQ ID NO: 183138 - DNA, 22 bp, Mus musculus
tgtgtgcctgtgtgtatacatg

SEQ ID NO: 183139 - DNA, 23 bp, Mus musculus
tgagaagatagtgagcacatgga

SEQ ID NO: 183140 - DNA, 23 bp, Mus musculus
atatatgtgtatgtatatgtatg

SEQ ID NO: 183141 - DNA, 21 bp, Mus musculus
aagaggacactgtgtttgctg

SEQ ID NO: 183142 - DNA, 23 bp, Mus musculus
tgtgaagtagtatttgtcttcat

SEQ ID NO: 183143 - DNA, 23 bp, Mus musculus
gtatgtatgtatgtatgtatgtg

SEQ ID NO: 183144 - DNA, 23 bp, Mus musculus
atcagaaagtgcatgtgcttgtg

SEQ ID NO: 183145 - DNA, 22 bp, Mus musculus
tgttttgtgaccaattatatgg

SEQ ID NO: 183146 - DNA, 19 bp, Mus musculus
tatatgcatacatatatgt

SEQ ID NO: 183147 - DNA, 23 bp, Mus musculus
ctctttatgtctctgtctctatg

SEQ ID NO: 183148 - DNA, 22 bp, Mus musculus
tatatatgtatatgtatatgtg

SEQ ID NO: 183149 - DNA, 23 bp, Mus musculus
tgactgtccttgaacttgctcga

SEQ ID NO: 183150 - DNA, 23 bp, Mus musculus
cagcctcactctgtgtctctgat

SEQ ID NO: 183151 - DNA, 19 bp, Mus musculus
caagggcagacactggagt

SEQ ID NO: 183152 - DNA, 23 bp, Mus musculus
agggtcagtgactgtctgtgtgt

SEQ ID NO: 183153 - DNA, 23 bp, Mus musculus
actgtcagtaacactctgggtgt

SEQ ID NO: 183154 - DNA, 22 bp, Mus musculus
gaattgaacgttaagagttaga

SEQ ID NO: 183155 - DNA, 21 bp, Mus musculus
taaaagttctttgtcattcca

SEQ ID NO: 183156 - DNA, 23 bp, Mus musculus
tatattgtatgcatgtgtgtatg

SEQ ID NO: 183157 - DNA, 23 bp, Mus musculus
gactgaagagtggctggagacat

SEQ ID NO: 183158 - DNA, 20 bp, Mus musculus
agagaaatttagaagatact

SEQ ID NO: 183159 - DNA, 22 bp, Mus musculus
atggagagaagagtgccagcac

SEQ ID NO: 183160 - DNA, 23 bp, Mus musculus
agtggaagagttctgagttactt

SEQ ID NO: 183161 - DNA, 23 bp, Mus musculus
tgagttcagactgtgctcttgca

SEQ ID NO: 183162 - DNA, 20 bp, Mus musculus
tatatatatatgctgtatgt

SEQ ID NO: 183163 - DNA, 22 bp, Mus musculus
tgtatgcatgtatgtatgtatg

SEQ ID NO: 183164 - DNA, 21 bp, Mus musculus
actcagtacagaatcacttct

SEQ ID NO: 183165 - DNA, 23 bp, Mus musculus
ccttagacagtgaatccagaagc

SEQ ID NO: 183166 - DNA, 23 bp, Mus musculus
agcctctgactatactgactcaa

SEQ ID NO: 183167 - DNA, 23 bp, Mus musculus
gtgtgtctctgtgtgtatactga

SEQ ID NO: 183168 - DNA, 20 bp, Mus musculus
tcccctttctgtctctgtgg

SEQ ID NO: 183169 - DNA, 23 bp, Mus musculus
agtctgcttattaattccttgct

SEQ ID NO: 183170 - DNA, 22 bp, Mus musculus
atgacagaagtgagttagtatt

SEQ ID NO: 183171 - DNA, 23 bp, Mus musculus
tcactctggatttagtcaaaggt

SEQ ID NO: 183172 - DNA, 23 bp, Mus musculus
aaccatgtttgctgatggatctg

SEQ ID NO: 183173 - DNA, 23 bp, Mus musculus
atatcctagatgaggtcttgata

SEQ ID NO: 183174 - DNA, 23 bp, Mus musculus
tcagtgtgacacagtctctcctt

SEQ ID NO: 183175 - DNA, 23 bp, Mus musculus
tgtctctgtgcctctgtggatct

SEQ ID NO: 183176 - DNA, 21 bp, Mus musculus
agcagtgaccttgatctgtgg

SEQ ID NO: 183177 - DNA, 23 bp, Mus musculus
gatcaatgtgaaatcttggaaac

SEQ ID NO: 183178 - DNA, 22 bp, Mus musculus
tggcttccacttccactgtact

SEQ ID NO: 183179 - DNA, 23 bp, Mus musculus
atcacagtggagtccctgtcttg

SEQ ID NO: 183180 - DNA, 21 bp, Mus musculus
tgacctagatggttctattct

SEQ ID NO: 183181 - DNA, 21 bp, Mus musculus
ttcatttctcagcaaccacat

SEQ ID NO: 183182 - DNA, 20 bp, Mus musculus
cactgtgattaagtgaggta

SEQ ID NO: 183183 - DNA, 23 bp, Mus musculus
tagctgattatgatttcacatgc

SEQ ID NO: 183184 - DNA, 22 bp, Mus musculus
tgttttgtgaccaattatatgg

SEQ ID NO: 183185 - DNA, 23 bp, Mus musculus
gaaaacagtgtccaccctggtca

SEQ ID NO: 183186 - DNA, 23 bp, Mus musculus
ctgcctcactgaatctgtgttgc

SEQ ID NO: 183187 - DNA, 22 bp, Mus musculus
tacagctcctcagtgtgccgta

SEQ ID NO: 183188 - DNA, 22 bp, Mus musculus
ctctctcagtgcctctcagagt

SEQ ID NO: 183189 - DNA, 23 bp, Mus musculus
gggtgtctctgtgtctctgctct

SEQ ID NO: 183190 - DNA, 21 bp, Mus musculus
tacattctatacatgtatgca

SEQ ID NO: 183191 - DNA, 19 bp, Mus musculus
tacattgtatacatgtaag

SEQ ID NO: 183192 - DNA, 23 bp, Mus musculus
atatgtatatatgtacatgtata

SEQ ID NO: 183193 - DNA, 23 bp, Mus musculus
agcacacagagcacacagagcac

SEQ ID NO: 183194 - DNA, 18 bp, Mus musculus
ttacaacctccacaggca

SEQ ID NO: 183195 - DNA, 18 bp, Mus musculus
ggtgggtgtgatgtgtgc

SEQ ID NO: 183196 - DNA, 23 bp, Mus musculus
tctgactctgacactgaggagag

SEQ ID NO: 183197 - DNA, 23 bp, Mus musculus
agaagacacaagtttgactgcag

SEQ ID NO: 183198 - DNA, 22 bp, Mus musculus
gaatagtctcagcctaacttct

SEQ ID NO: 183199 - DNA, 23 bp, Mus musculus
tatgcatgtgtgtatatatgttt

SEQ ID NO: 183200 - DNA, 23 bp, Mus musculus
agtctctgaaagtctgtggatca

SEQ ID NO: 183201 - DNA, 23 bp, Mus musculus
agagctcccagagactaaaccac

SEQ ID NO: 183202 - DNA, 22 bp, Mus musculus
tatctgcattttttctggacag

SEQ ID NO: 183203 - DNA, 23 bp, Mus musculus
tcagaatctttctctctctgtca

SEQ ID NO: 183204 - DNA, 23 bp, Mus musculus
ggctatgactctcccatggaaca

SEQ ID NO: 183205 - DNA, 23 bp, Mus musculus
tatgtatgcaaatatgtatgtat

SEQ ID NO: 183206 - DNA, 22 bp, Mus musculus
cttaacaatttgctctcaaagt

SEQ ID NO: 183207 - DNA, 23 bp, Mus musculus
gagtgttgtcttgctcaaggtca

SEQ ID NO: 183208 - DNA, 22 bp, Mus musculus
tgtgacaccatgtggatctggt

SEQ ID NO: 183209 - DNA, 23 bp, Mus musculus
acagtgtggacactgctgagtca

SEQ ID NO: 183210 - DNA, 23 bp, Mus musculus
acttaagttgttcttgtgttatg

SEQ ID NO: 183211 - DNA, 23 bp, Mus musculus
gaattctagaagacctagtcctg

SEQ ID NO: 183212 - DNA, 21 bp, Mus musculus
gtcatggtcgacaaggagatt

SEQ ID NO: 183213 - DNA, 23 bp, Mus musculus
tgtctgtctgtccatcactcacc

SEQ ID NO: 183214 - DNA, 23 bp, Mus musculus
gagcactccaactaagattcttt

SEQ ID NO: 183215 - DNA, 19 bp, Mus musculus
tgcttttgttaatctgttc

SEQ ID NO: 183216 - DNA, 23 bp, Mus musculus
gtctgtgtctgtgagtgtgtgca

SEQ ID NO: 183217 - DNA, 23 bp, Mus musculus
tctctctctgcctgtgtcacctc

SEQ ID NO: 183218 - DNA, 23 bp, Mus musculus
tgtgtgtatatatgtgtgtgtgc

SEQ ID NO: 183219 - DNA, 23 bp, Mus musculus
atatatgtatatatatatgtgtg

SEQ ID NO: 183220 - DNA, 23 bp, Mus musculus
atctgcttatgatgctaggctga

SEQ ID NO: 183221 - DNA, 23 bp, Mus musculus
agaatgagactgaagggtgcggg

SEQ ID NO: 183222 - DNA, 23 bp, Mus musculus
acaatcttgatcatgctgaatgc

SEQ ID NO: 183223 - DNA, 21 bp, Mus musculus
acctccttgtataacctcaaa

SEQ ID NO: 183224 - DNA, 23 bp, Mus musculus
tgtgtgtatatatgtatatatgt

SEQ ID NO: 183225 - DNA, 18 bp, Mus musculus
atgtgtggatgtcagaag

SEQ ID NO: 183226 - DNA, 23 bp, Mus musculus
agcagggactgtctctgactctg

SEQ ID NO: 183227 - DNA, 23 bp, Mus musculus
tctgtctctctgtgtgtctgtgt

SEQ ID NO: 183228 - DNA, 18 bp, Mus musculus
ttttgaaaggaaagcaga

SEQ ID NO: 183229 - DNA, 19 bp, Mus musculus
agcctagttggatgctaag

SEQ ID NO: 183230 - DNA, 23 bp, Mus musculus
gtctgtgtgtctatatgtctctg

SEQ ID NO: 183231 - DNA, 23 bp, Mus musculus
atatgcaagtcaatagacaacct

SEQ ID NO: 183232 - DNA, 23 bp, Mus musculus
tctactctctgtgtttttcagtg

SEQ ID NO: 183233 - DNA, 23 bp, Mus musculus
tttaaatgtggtaatgttctatt

SEQ ID NO: 183234 - DNA, 23 bp, Mus musculus
gtgtgtgtaaagtcatagatgca

SEQ ID NO: 183235 - DNA, 21 bp, Mus musculus
tagacacagagcctacctcgt

SEQ ID NO: 183236 - DNA, 22 bp, Mus musculus
tgttttgtgaccaattatatgg

SEQ ID NO: 183237 - DNA, 23 bp, Mus musculus
tagtccatggtgatctgatagga

SEQ ID NO: 183238 - DNA, 19 bp, Mus musculus
tggaataggtttcaagatg

SEQ ID NO: 183239 - DNA, 23 bp, Mus musculus
ttaaagcaccattagctttgagt

SEQ ID NO: 183240 - DNA, 23 bp, Mus musculus
tagaaatgtaaagtagaatgaac

SEQ ID NO: 183241 - DNA, 23 bp, Mus musculus
agagttgcttttagtggtggtgg

SEQ ID NO: 183242 - DNA, 22 bp, Mus musculus
atattctaattgattaggcaag

SEQ ID NO: 183243 - DNA, 22 bp, Mus musculus
tgttttgtgaccaattatatgg

SEQ ID NO: 183244 - DNA, 23 bp, Mus musculus
tctgtgtctgtttctctgatcct

SEQ ID NO: 183245 - DNA, 19 bp, Mus musculus
gcatgcacacacactcgtg

SEQ ID NO: 183246 - DNA, 22 bp, Mus musculus
tatatgtgcatatatatgttta

SEQ ID NO: 183247 - DNA, 23 bp, Mus musculus
gtgtgcgtgtgtgtatgtatgta

SEQ ID NO: 183248 - DNA, 23 bp, Mus musculus
tatgtgtgtgtatatgtatatgt

SEQ ID NO: 183249 - DNA, 23 bp, Mus musculus
tctctgagcttgttctttgttga

SEQ ID NO: 183250 - DNA, 22 bp, Mus musculus
tgttttgtgaccaattatatgg

SEQ ID NO: 183251 - DNA, 22 bp, Mus musculus
tgttttgtgaccaattatatgg

SEQ ID NO: 183252 - DNA, 20 bp, Mus musculus
attcgacacactgagttcag

SEQ ID NO: 183253 - DNA, 23 bp, Mus musculus
tgcacatttgaatgtttcttttt

SEQ ID NO: 183254 - DNA, 23 bp, Mus musculus
gtttagcatatctaagcataact

SEQ ID NO: 183255 - DNA, 23 bp, Mus musculus
tgtttattaatgtagagtagagt

SEQ ID NO: 183256 - DNA, 18 bp, Mus musculus
tcaacagttttgagccat

SEQ ID NO: 183257 - DNA, 21 bp, Mus musculus
tgtgacagaacacagtgagga

SEQ ID NO: 183258 - DNA, 22 bp, Mus musculus
agggtgacaaattggtgctctg

SEQ ID NO: 183259 - DNA, 18 bp, Mus musculus
cacaagcagcaggcttgt

SEQ ID NO: 183260 - DNA, 23 bp, Mus musculus
tccctttcactgtctctcaccgg

SEQ ID NO: 183261 - DNA, 19 bp, Mus musculus
aacaaatcactgggtactg

SEQ ID NO: 183262 - DNA, 19 bp, Mus musculus
ttgacactgcagctcctta

SEQ ID NO: 183263 - DNA, 23 bp, Mus musculus
acagtcactgtctggctgtgagc

SEQ ID NO: 183264 - DNA, 22 bp, Mus musculus
tgtatgcatgatacatgtagat

SEQ ID NO: 183265 - DNA, 23 bp, Mus musculus
tgactgtttatctgtcacctaaa

SEQ ID NO: 183266 - DNA, 22 bp, Mus musculus
tgagaccggaagagctgactct

SEQ ID NO: 183267 - DNA, 23 bp, Mus musculus
tgagccgtctgtctgtctgtctc

SEQ ID NO: 183268 - DNA, 23 bp, Mus musculus
agctctctctgtgtctgtctgct

SEQ ID NO: 183269 - DNA, 23 bp, Mus musculus
attacttgctgtgtatgtgtact

SEQ ID NO: 183270 - DNA, 23 bp, Mus musculus
agagaagacagtttcctgtgtgt

SEQ ID NO: 183271 - DNA, 23 bp, Mus musculus
cttctgtctgtctgtctgtctgt

SEQ ID NO: 183272 - DNA, 23 bp, Mus musculus
atgtgtgtgtatatgtatatgta

SEQ ID NO: 183273 - DNA, 18 bp, Mus musculus
tcagagaacactgtcagg

SEQ ID NO: 183274 - DNA, 23 bp, Mus musculus
cctgtctctgtctgccactgatg

SEQ ID NO: 183275 - DNA, 19 bp, Mus musculus
atgtatgtatgtatgtatg

SEQ ID NO: 183276 - DNA, 23 bp, Mus musculus
tagtctgcacagtactccaacac

SEQ ID NO: 183277 - DNA, 21 bp, Mus musculus
tgacacacacagaggctctgg

SEQ ID NO: 183278 - DNA, 18 bp, Mus musculus
tagaagcagaaaagggtt

SEQ ID NO: 183279 - DNA, 21 bp, Mus musculus
gtgtctcactgtgtgtgtggg

SEQ ID NO: 183280 - DNA, 23 bp, Mus musculus
tttctctcagtttggtgtatgga

SEQ ID NO: 183281 - DNA, 23 bp, Mus musculus
ctgaaagtgcatctccatgggaa

SEQ ID NO: 183282 - DNA, 23 bp, Mus musculus
tgtgcttttctatgctagtctct

SEQ ID NO: 183283 - DNA, 23 bp, Mus musculus
atatgtgtgtgtgcatgtgcatg

SEQ ID NO: 183284 - DNA, 22 bp, Mus musculus
atgtgtatgcatgtatatttgt

SEQ ID NO: 183285 - DNA, 23 bp, Mus musculus
aaaagcataaatctgaacttgtg

SEQ ID NO: 183286 - DNA, 22 bp, Mus musculus
gtccatagtggtctgataggat

SEQ ID NO: 183287 - DNA, 23 bp, Mus musculus
tattcccagttcttggtatctcc

SEQ ID NO: 183288 - DNA, 18 bp, Mus musculus
tggtacctcattgcttta

SEQ ID NO: 183289 - DNA, 22 bp, Mus musculus
cttctctgtattgacagtggtg

SEQ ID NO: 183290 - DNA, 23 bp, Mus musculus
ttgaagtctaatttctatagttc

SEQ ID NO: 183291 - DNA, 23 bp, Mus musculus
ttagtacttcgtcagatgcagag

SEQ ID NO: 183292 - DNA, 22 bp, Mus musculus
aacagcatatatatacatatat

SEQ ID NO: 183293 - DNA, 19 bp, Mus musculus
gtgagtgtgtgtgtcagtg

SEQ ID NO: 183294 - DNA, 23 bp, Mus musculus
tgaatgcttagtcacctggtagt

SEQ ID NO: 183295 - DNA, 23 bp, Mus musculus
tctatgactccctgtcactgtgt

SEQ ID NO: 183296 - DNA, 23 bp, Mus musculus
tgaatgtgtgtctcttttttggg

SEQ ID NO: 183297 - DNA, 22 bp, Mus musculus
aagaatcaccagaagcttgtga

SEQ ID NO: 183298 - DNA, 23 bp, Mus musculus
atgtgtgtatatatgtgtgtgta

SEQ ID NO: 183299 - DNA, 21 bp, Mus musculus
tcacaggattcttctctggag

SEQ ID NO: 183300 - DNA, 21 bp, Mus musculus
ttgacacatgagtctgaggac

SEQ ID NO: 183301 - DNA, 23 bp, Mus musculus
agcaggtattgctaactgattac

SEQ ID NO: 183302 - DNA, 22 bp, Mus musculus
ctgtcactgtcactgcccctgc

SEQ ID NO: 183303 - DNA, 22 bp, Mus musculus
actgactgctcttccagaggtc

SEQ ID NO: 183304 - DNA, 18 bp, Mus musculus
tgagtatataggtatatg

SEQ ID NO: 183305 - DNA, 23 bp, Mus musculus
ctgagcctctctctgtgccttaa

SEQ ID NO: 183306 - DNA, 20 bp, Mus musculus
ttatgtgtcaggaggagtat

SEQ ID NO: 183307 - DNA, 23 bp, Mus musculus
ttttctactgtttatgttgttat

SEQ ID NO: 183308 - DNA, 22 bp, Mus musculus
atagtgagctaataggatgcat

SEQ ID NO: 183309 - DNA, 23 bp, Mus musculus
tctttaattatatatctgttatc

SEQ ID NO: 183310 - DNA, 23 bp, Mus musculus
tggtggtagtgagatattgcaca

SEQ ID NO: 183311 - DNA, 22 bp, Mus musculus
tgttttgtgaccaattatatgg

SEQ ID NO: 183312 - DNA, 23 bp, Mus musculus
agcattctaaatgtaattgagga

SEQ ID NO: 183313 - DNA, 23 bp, Mus musculus
acacatgtgtgtgtgtatatata

SEQ ID NO: 183314 - DNA, 22 bp, Mus musculus
tctatgtgacttagctgggtat

SEQ ID NO: 183315 - DNA, 23 bp, Mus musculus
tgtgtgtgtgtgtatatatgtat

SEQ ID NO: 183316 - DNA, 20 bp, Mus musculus
tatgtgtgtatgcatgtatt

SEQ ID NO: 183317 - DNA, 23 bp, Mus musculus
tagtgtctggctcactcacaagt

SEQ ID NO: 183318 - DNA, 23 bp, Mus musculus
ttaagacattggatctttagtga

SEQ ID NO: 183319 - DNA, 20 bp, Mus musculus
atgagctttgaaattacaga

SEQ ID NO: 183320 - DNA, 21 bp, Mus musculus
gtatgcatatatgtatgtatg

SEQ ID NO: 183321 - DNA, 21 bp, Mus musculus
atgtgtatatatgtatgtgtg

SEQ ID NO: 183322 - DNA, 23 bp, Mus musculus
cttttgctgctgagactgccaga

SEQ ID NO: 183323 - DNA, 23 bp, Mus musculus
gaagacactgaagtgtgtgtgat

SEQ ID NO: 183324 - DNA, 19 bp, Mus musculus
cacctcttttcttccatac

SEQ ID NO: 183325 - DNA, 23 bp, Mus musculus
tctggtgcctacagaggacatca

SEQ ID NO: 183326 - DNA, 23 bp, Mus musculus
taagctccacccagtgcagatga

SEQ ID NO: 183327 - DNA, 23 bp, Mus musculus
tgtctgtgcctctgtcatctcag

SEQ ID NO: 183328 - DNA, 22 bp, Mus musculus
tttgctatgtgagcaaagtcag

SEQ ID NO: 183329 - DNA, 21 bp, Mus musculus
aaaatgctgtctctcttgaag

SEQ ID NO: 183330 - DNA, 22 bp, Mus musculus
ataggaatgatggctgcttagg

SEQ ID NO: 183331 - DNA, 22 bp, Mus musculus
tttacattttactgtgtgcgtg

SEQ ID NO: 183332 - DNA, 23 bp, Mus musculus
tgtagctgtattttaattcagtg

SEQ ID NO: 183333 - DNA, 23 bp, Mus musculus
ttggattggagtcagaagttaca

SEQ ID NO: 183334 - DNA, 23 bp, Mus musculus
ccatctgtctgagtgtgtctgtg

SEQ ID NO: 183335 - DNA, 23 bp, Mus musculus
atagacttctgattatgtccttc

SEQ ID NO: 183336 - DNA, 23 bp, Mus musculus
acatagaacagtctcagctctga

SEQ ID NO: 183337 - DNA, 23 bp, Mus musculus
tttcaggcaggatttgttggcat

SEQ ID NO: 183338 - DNA, 23 bp, Mus musculus
tttcagctacttgttgtgcctct

SEQ ID NO: 183339 - DNA, 23 bp, Mus musculus
tctctctctctctgtgtgtgtgt

SEQ ID NO: 183340 - DNA, 21 bp, Mus musculus
tgtgtgtatgtatatatgtgt

SEQ ID NO: 183341 - DNA, 23 bp, Mus musculus
ttgacagaacagagagatttcct

SEQ ID NO: 183342 - DNA, 23 bp, Mus musculus
ctcagcatgtagacaacggcact

SEQ ID NO: 183343 - DNA, 19 bp, Mus musculus
ttggactccttgagaactg

SEQ ID NO: 183344 - DNA, 23 bp, Mus musculus
ggcccagtgtctctctctgcctc

SEQ ID NO: 183345 - DNA, 23 bp, Mus musculus
tgtgtatatgtatatgtatatga

SEQ ID NO: 183346 - DNA, 22 bp, Mus musculus
aatatgtgtgcatatgtatgag

SEQ ID NO: 183347 - DNA, 23 bp, Mus musculus
tgcgtctgtgtgagtgtgtgtat

SEQ ID NO: 183348 - DNA, 21 bp, Mus musculus
tccatggtggtctgataggat

SEQ ID NO: 183349 - DNA, 22 bp, Mus musculus
tgttttgtgaccaattatatgg

SEQ ID NO: 183350 - DNA, 20 bp, Mus musculus
tgtgcaggtggaagtcagag

SEQ ID NO: 183351 - DNA, 22 bp, Mus musculus
tgttttgtgaccaattatatgg

SEQ ID NO: 183352 - DNA, 23 bp, Mus musculus
atgtgctagatggttctatgtta

SEQ ID NO: 183353 - DNA, 22 bp, Mus musculus
tgttttgtgaccaattatatgg

SEQ ID NO: 183354 - DNA, 21 bp, Mus musculus
tgtgaccctctcacgctccct

SEQ ID NO: 183355 - DNA, 23 bp, Mus musculus
cctgtcagactgtgtccctctga

SEQ ID NO: 183356 - DNA, 22 bp, Mus musculus
tcacaggcagctttgtggagca

SEQ ID NO: 183357 - DNA, 23 bp, Mus musculus
tgtgtatatatatgtatatgtga

SEQ ID NO: 183358 - DNA, 18 bp, Mus musculus
atatgtgtatgtgatata

SEQ ID NO: 183359 - DNA, 23 bp, Mus musculus
tctctctgtcagagacagatctg

SEQ ID NO: 183360 - DNA, 20 bp, Mus musculus
tacaagtctgtgtttcgaga

SEQ ID NO: 183361 - DNA, 23 bp, Mus musculus
acacacactcacagtttatggat

SEQ ID NO: 183362 - DNA, 23 bp, Mus musculus
gagaggctctgtcagtgcctgag

SEQ ID NO: 183363 - DNA, 23 bp, Mus musculus
tgtgtgagtatggtgtatgtggt

SEQ ID NO: 183364 - DNA, 18 bp, Mus musculus
cccagatgcagaattcac

SEQ ID NO: 183365 - DNA, 23 bp, Mus musculus
tagtccatggtgatctgatagga

SEQ ID NO: 183366 - DNA, 20 bp, Mus musculus
taattcagataaagtagtca

SEQ ID NO: 183367 - DNA, 23 bp, Mus musculus
acatacacacacgtatatattac

SEQ ID NO: 183368 - DNA, 23 bp, Mus musculus
tgcatatatgtttgtatatatac

SEQ ID NO: 183369 - DNA, 23 bp, Mus musculus
tgtatatgatgtatatgtaaaca

SEQ ID NO: 183370 - DNA, 23 bp, Mus musculus
agaaagagaagagtgtgtccaca

SEQ ID NO: 183371 - DNA, 20 bp, Mus musculus
ttactacaagaactctgctt

SEQ ID NO: 183372 - DNA, 23 bp, Mus musculus
tgtctctgatgtatgttcttgta

SEQ ID NO: 183373 - DNA, 22 bp, Mus musculus
tatgttgtatcagatagcgtat

SEQ ID NO: 183374 - DNA, 19 bp, Mus musculus
acacgattttgttagtatt

SEQ ID NO: 183375 - DNA, 23 bp, Mus musculus
ttaattctgtggtaaacatgact

SEQ ID NO: 183376 - DNA, 23 bp, Mus musculus
ctctgagtcaacagagagagcac

SEQ ID NO: 183377 - DNA, 23 bp, Mus musculus
agtgcttgagaaagaagattcct

SEQ ID NO: 183378 - DNA, 21 bp, Mus musculus
cccctctgtgtgtgtgtgtgt

SEQ ID NO: 183379 - DNA, 23 bp, Mus musculus
tggttcagtggctgcgtgtctgg

SEQ ID NO: 183380 - DNA, 23 bp, Mus musculus
tgtgtgtatgtatgtacatatgt

SEQ ID NO: 183381 - DNA, 22 bp, Mus musculus
tatgtatgaatgtatgtgtgta

SEQ ID NO: 183382 - DNA, 23 bp, Mus musculus
ttatggtagaattctgtataagt

SEQ ID NO: 183383 - DNA, 19 bp, Mus musculus
agtcttcttgaattttatg

SEQ ID NO: 183384 - DNA, 20 bp, Mus musculus
accactgtgggaatgtcttc

SEQ ID NO: 183385 - DNA, 18 bp, Mus musculus
tgcaactttaaacatgtg

SEQ ID NO: 183386 - DNA, 23 bp, Mus musculus
tctgtctgtctgtctgtctgtct

SEQ ID NO: 183387 - DNA, 23 bp, Mus musculus
taacagtcctgagtgtcctggaa

SEQ ID NO: 183388 - DNA, 22 bp, Mus musculus
tgtgtgtgcatgaccatgtgtg

SEQ ID NO: 183389 - DNA, 19 bp, Mus musculus
tacatgtctgtaagctgat

SEQ ID NO: 183390 - DNA, 23 bp, Mus musculus
gagactcagtgtgtgaggtgatt

SEQ ID NO: 183391 - DNA, 23 bp, Mus musculus
gtatgtatatgtgtatatgtaca

SEQ ID NO: 183392 - DNA, 22 bp, Mus musculus
tgttttgtgaccaattatatgg

SEQ ID NO: 183393 - DNA, 23 bp, Mus musculus
tctctcagtgtcagaatcctctg

SEQ ID NO: 183394 - DNA, 23 bp, Mus musculus
tatttcatatgtatgtatacaca

SEQ ID NO: 183395 - DNA, 20 bp, Mus musculus
aatggctcaccttgtacttg

SEQ ID NO: 183396 - DNA, 23 bp, Mus musculus
aattcagacaagtcagtgagctc

SEQ ID NO: 183397 - DNA, 18 bp, Mus musculus
aacctcaggctttgttct

SEQ ID NO: 183398 - DNA, 23 bp, Mus musculus
agtgtcagaagactgagagcttc

SEQ ID NO: 183399 - DNA, 23 bp, Mus musculus
ttgtaatcttgggagtttgagat

SEQ ID NO: 183400 - DNA, 21 bp, Mus musculus
actcacccacagtgactcatt

SEQ ID NO: 183401 - DNA, 21 bp, Mus musculus
tttctgtgtggctcagtagcg

SEQ ID NO: 183402 - DNA, 23 bp, Mus musculus
tattaaccatacatttggaatgt

SEQ ID NO: 183403 - DNA, 23 bp, Mus musculus
tgaaaacaaatttaatgtgaagc

SEQ ID NO: 183404 - DNA, 22 bp, Mus musculus
atatgatgtaggatgtatattt

SEQ ID NO: 183405 - DNA, 22 bp, Mus musculus
tgttttgtgaccaattatatgg

SEQ ID NO: 183406 - DNA, 22 bp, Mus musculus
atatatatatatgtatatgtgt

SEQ ID NO: 183407 - DNA, 23 bp, Mus musculus
agatgacagttgtaaggctggac

SEQ ID NO: 183408 - DNA, 23 bp, Mus musculus
atagtgatgttagatagctgaag

SEQ ID NO: 183409 - DNA, 23 bp, Mus musculus
agccatgactcaatccagatagc

SEQ ID NO: 183410 - DNA, 20 bp, Mus musculus
tgtcttcattttagtgtgtg

SEQ ID NO: 183411 - DNA, 22 bp, Mus musculus
aatgtatatatgtatatgtgtg

SEQ ID NO: 183412 - DNA, 20 bp, Mus musculus
acacacacacacttacatat

SEQ ID NO: 183413 - DNA, 22 bp, Mus musculus
tgttttgtgaccaattatatgg

SEQ ID NO: 183414 - DNA, 23 bp, Mus musculus
tgtggatttagattcttctgagt

SEQ ID NO: 183415 - DNA, 19 bp, Mus musculus
tgtatgtatgtatatatgt

SEQ ID NO: 183416 - DNA, 23 bp, Mus musculus
tgagcatctgcatctgtatttgt

SEQ ID NO: 183417 - DNA, 20 bp, Mus musculus
tcttccttcaatgtgtatgg

SEQ ID NO: 183418 - DNA, 22 bp, Mus musculus
acacttagatatgacaatggag

SEQ ID NO: 183419 - DNA, 22 bp, Mus musculus
tgttttgtgaccaattatatgg

SEQ ID NO: 183420 - DNA, 21 bp, Mus musculus
gtcctagtatgtgttcagttt

SEQ ID NO: 183421 - DNA, 19 bp, Mus musculus
ctgagtgtgtatatgtgca

SEQ ID NO: 183422 - DNA, 23 bp, Mus musculus
taatgacctagtactggtgttga

SEQ ID NO: 183423 - DNA, 23 bp, Mus musculus
cacatacacacacatatatatgt

SEQ ID NO: 183424 - DNA, 22 bp, Mus musculus
atgtgtgtgtgtgtgtatacac

SEQ ID NO: 183425 - DNA, 23 bp, Mus musculus
cactgggtgactctgtgcctcac

SEQ ID NO: 183426 - DNA, 23 bp, Mus musculus
tgacacttgagagtgtgagcctc

SEQ ID NO: 183427 - DNA, 23 bp, Mus musculus
aagtggctctagaacagattggt

SEQ ID NO: 183428 - DNA, 22 bp, Mus musculus
ctctgtcactgtgtgggtgagc

SEQ ID NO: 183429 - DNA, 23 bp, Mus musculus
aaagagagtggaaagtgactctt

SEQ ID NO: 183430 - DNA, 22 bp, Mus musculus
tgttttgtgaccaattatatgg

SEQ ID NO: 183431 - DNA, 22 bp, Mus musculus
tgttttgtgaccaattatatgg

SEQ ID NO: 183432 - DNA, 21 bp, Mus musculus
tttgaaaatatgtatatctgt

SEQ ID NO: 183433 - DNA, 22 bp, Mus musculus
tctttggtgttatagctcttgt

SEQ ID NO: 183434 - DNA, 23 bp, Mus musculus
cactctgcctctgtctgtagtgt

SEQ ID NO: 183435 - DNA, 23 bp, Mus musculus
catgcctgtgtgtcaccctctgt

SEQ ID NO: 183436 - DNA, 19 bp, Mus musculus
acatgtgtgtgtatatgtt

SEQ ID NO: 183437 - DNA, 23 bp, Mus musculus
gtaagtatgtatttatgtatgta

SEQ ID NO: 183438 - DNA, 23 bp, Mus musculus
ggctggctcagtcagtgggtgtc

SEQ ID NO: 183439 - DNA, 22 bp, Mus musculus
caacagacacctagtgctcagc

SEQ ID NO: 183440 - DNA, 23 bp, Mus musculus
cacacagtcagtctgtcagctca

SEQ ID NO: 183441 - DNA, 23 bp, Mus musculus
gctgctgacagaccaaagtgttc

SEQ ID NO: 183442 - DNA, 22 bp, Mus musculus
agcagtgtgtgtaaacagttga

SEQ ID NO: 183443 - DNA, 19 bp, Mus musculus
agacttgttggagagatag

SEQ ID NO: 183444 - DNA, 23 bp, Mus musculus
cgtgtctctctcactcactgggg

SEQ ID NO: 183445 - DNA, 19 bp, Mus musculus
acagaagacagtggacact

SEQ ID NO: 183446 - DNA, 23 bp, Mus musculus
tatcagtgactgcttgttgacag

SEQ ID NO: 183447 - DNA, 23 bp, Mus musculus
tcagtgcttctcaatagctcagt

SEQ ID NO: 183448 - DNA, 21 bp, Mus musculus
actgtgaactgaaatgaatgg

SEQ ID NO: 183449 - DNA, 23 bp, Mus musculus
tcactgtctctctgtgggagtcc

SEQ ID NO: 183450 - DNA, 20 bp, Mus musculus
cttcagagggagcagagaag

SEQ ID NO: 183451 - DNA, 23 bp, Mus musculus
aagtgttttatgctgattggtgt

SEQ ID NO: 183452 - DNA, 22 bp, Mus musculus
ttgaatttgaattccagtgttt

SEQ ID NO: 183453 - DNA, 23 bp, Mus musculus
atgtatgtatgtatgtatatgta

SEQ ID NO: 183454 - DNA, 20 bp, Mus musculus
agggtctctcactgacttga

SEQ ID NO: 183455 - DNA, 18 bp, Mus musculus
agagatgcctcactttat

SEQ ID NO: 183456 - DNA, 23 bp, Mus musculus
gtgtgtgcctgtgtgcgtgcgac

SEQ ID NO: 183457 - DNA, 22 bp, Mus musculus
tgtggaggtcaaacacagctct

SEQ ID NO: 183458 - DNA, 21 bp, Mus musculus
tgtgtgtgtgtgtgtgtatac

SEQ ID NO: 183459 - DNA, 20 bp, Mus musculus
aagagcactgactgctcttc

SEQ ID NO: 183460 - DNA, 22 bp, Mus musculus
actgaggtattctcttcccagg

SEQ ID NO: 183461 - DNA, 23 bp, Mus musculus
cagtctctctggtggtggtttgc

SEQ ID NO: 183462 - DNA, 22 bp, Mus musculus
ttaagagctctgactgctcttc

SEQ ID NO: 183463 - DNA, 22 bp, Mus musculus
tagcagggagttaatggtgaga

SEQ ID NO: 183464 - DNA, 23 bp, Mus musculus
atgtatatgtatatgtatatgta

SEQ ID NO: 183465 - DNA, 22 bp, Mus musculus
tgttttgtgaccaattatatgg

SEQ ID NO: 183466 - DNA, 23 bp, Mus musculus
cacagacacactgtctctgacac

SEQ ID NO: 183467 - DNA, 23 bp, Mus musculus
gtgtgtcactgtcacagtctctg

SEQ ID NO: 183468 - DNA, 20 bp, Mus musculus
tgacagtgaacagagatgga

SEQ ID NO: 183469 - DNA, 21 bp, Mus musculus
ttttgaggtattgttaatggg

SEQ ID NO: 183470 - DNA, 23 bp, Mus musculus
ttttctgagtctctttcttggcc

SEQ ID NO: 183471 - DNA, 23 bp, Mus musculus
tctctgcgtgtctgtctgtctgc

SEQ ID NO: 183472 - DNA, 21 bp, Mus musculus
aagaaggtttttgaaatgtgg

SEQ ID NO: 183473 - DNA, 18 bp, Mus musculus
tatttagagctggctgcc

SEQ ID NO: 183474 - DNA, 23 bp, Mus musculus
tctgcagagtagtgtgagagcac

SEQ ID NO: 183475 - DNA, 23 bp, Mus musculus
caatttctagaaaccacatggtg

SEQ ID NO: 183476 - DNA, 18 bp, Mus musculus
tcctgagccacatagatg

SEQ ID NO: 183477 - DNA, 23 bp, Mus musculus
ctgtctgtctgtctatctacaca

SEQ ID NO: 183478 - DNA, 23 bp, Mus musculus
aatgtatatgcatatgatgtata

SEQ ID NO: 183479 - DNA, 23 bp, Mus musculus
gtcacagtatagagtgaagcctg

SEQ ID NO: 183480 - DNA, 23 bp, Mus musculus
tatagattgtatatgtatgtgta

SEQ ID NO: 183481 - DNA, 19 bp, Mus musculus
gactgatgagagtgtggag

SEQ ID NO: 183482 - DNA, 23 bp, Mus musculus
agagtgtagtgagtgtggagctg

SEQ ID NO: 183483 - DNA, 19 bp, Mus musculus
tacctcctttactgttccc

SEQ ID NO: 183484 - DNA, 23 bp, Mus musculus
catctgcatctggatctgtaagg

SEQ ID NO: 183485 - DNA, 19 bp, Mus musculus
atccatatcagactcatga

SEQ ID NO: 183486 - DNA, 21 bp, Mus musculus
tccatggtggtctgataggat

SEQ ID NO: 183487 - DNA, 22 bp, Mus musculus
tgttttgtgaccaattatatgg

SEQ ID NO: 183488 - DNA, 23 bp, Mus musculus
aaaacacattttgtatttgtgtc

SEQ ID NO: 183489 - DNA, 22 bp, Mus musculus
tgttttgtgaccaattatatgg

SEQ ID NO: 183490 - DNA, 23 bp, Mus musculus
tgaggttctaggttccatattgt

SEQ ID NO: 183491 - DNA, 21 bp, Mus musculus
caacaggaaaaacagaatttg

SEQ ID NO: 183492 - DNA, 22 bp, Mus musculus
aaagagcatagtctatgtgagt

SEQ ID NO: 183493 - DNA, 19 bp, Mus musculus
tcagcagagtcaggttagc

SEQ ID NO: 183494 - DNA, 22 bp, Mus musculus
ttctgaagtgtgctcattgcca

SEQ ID NO: 183495 - DNA, 23 bp, Mus musculus
ctgtgtgcttgatatttcctagt

SEQ ID NO: 183496 - DNA, 22 bp, Mus musculus
tatttatagatgacatagctag

SEQ ID NO: 183497 - DNA, 22 bp, Mus musculus
tgttttgtgaccaattatatgg

SEQ ID NO: 183498 - DNA, 23 bp, Mus musculus
caccatgtgacatgtgtgcacct

SEQ ID NO: 183499 - DNA, 23 bp, Mus musculus
gacacacacagaatcacatgacg

SEQ ID NO: 183500 - DNA, 22 bp, Mus musculus
tctcaccagtatttcttgtgtc

SEQ ID NO: 183501 - DNA, 23 bp, Mus musculus
ctctgcttttgatatctattgta

SEQ ID NO: 183502 - DNA, 18 bp, Mus musculus
gaagcagctctgaaagtt

SEQ ID NO: 183503 - DNA, 22 bp, Mus musculus
tggcttacaatggaaaactgaa

SEQ ID NO: 183504 - DNA, 19 bp, Mus musculus
tctgtagctacagtttcag

SEQ ID NO: 183505 - DNA, 18 bp, Mus musculus
aactcactcacagagata

SEQ ID NO: 183506 - DNA, 18 bp, Mus musculus
tgtgggtgtgtgtgtggg

SEQ ID NO: 183507 - DNA, 23 bp, Mus musculus
tgtgtatatgtttccatttttac

SEQ ID NO: 183508 - DNA, 18 bp, Mus musculus
tcagtcatcactgtgagc

SEQ ID NO: 183509 - DNA, 21 bp, Mus musculus
atactgtgtgcagtgcccgtc

SEQ ID NO: 183510 - DNA, 21 bp, Mus musculus
atactgtgtgcagtgcccgtc

SEQ ID NO: 183511 - DNA, 23 bp, Mus musculus
aggagagctacaaggttgtattt

SEQ ID NO: 183512 - DNA, 23 bp, Mus musculus
ctgtgtctgtgtgtgtgtgcgcg

SEQ ID NO: 183513 - DNA, 23 bp, Mus musculus
gcaaggtctgtgtataacgagtg

SEQ ID NO: 183514 - DNA, 21 bp, Mus musculus
tttgtgcaaatactacggact

SEQ ID NO: 183515 - DNA, 23 bp, Mus musculus
tcgctgggaggatgattgctttg

SEQ ID NO: 183516 - DNA, 23 bp, Mus musculus
gagtcactgagtgggtgactcgc

SEQ ID NO: 183517 - DNA, 23 bp, Mus musculus
tgtgtggaaatgaatgcaaaact

SEQ ID NO: 183518 - DNA, 22 bp, Mus musculus
tggttgtgtctatacagaccac

SEQ ID NO: 183519 - DNA, 19 bp, Mus musculus
acaggtggctgtcctggaa

SEQ ID NO: 183520 - DNA, 22 bp, Mus musculus
agcaggggctgtctctgactct

SEQ ID NO: 183521 - DNA, 21 bp, Mus musculus
aagttactttgcatatgtatg

SEQ ID NO: 183522 - DNA, 23 bp, Mus musculus
ataaagggtatcttttagaatga

SEQ ID NO: 183523 - DNA, 23 bp, Mus musculus
aaatacagagatatagatatcta

SEQ ID NO: 183524 - DNA, 23 bp, Mus musculus
tctctccatatctgtctgtctgt

SEQ ID NO: 183525 - DNA, 22 bp, Mus musculus
tgttttgtgaccaattatatgg

SEQ ID NO: 183526 - DNA, 23 bp, Mus musculus
agacatgaacgtcttcaaaaggc

SEQ ID NO: 183527 - DNA, 18 bp, Mus musculus
tgtgtatgtgtatacatg

SEQ ID NO: 183528 - DNA, 20 bp, Mus musculus
atgtgtatatatgtatgtgt

SEQ ID NO: 183529 - DNA, 21 bp, Mus musculus
atctcaatacatctatggttg

SEQ ID NO: 183530 - DNA, 23 bp, Mus musculus
aaaaagcattgtgagtattgaga

SEQ ID NO: 183531 - DNA, 23 bp, Mus musculus
taattatgtatgtgtatagattt

SEQ ID NO: 183532 - DNA, 23 bp, Mus musculus
ctgtgtctctgtttagtttctgt

SEQ ID NO: 183533 - DNA, 21 bp, Mus musculus
atctgtccattgatgagagtg

SEQ ID NO: 183534 - DNA, 22 bp, Mus musculus
caatttagtcactttctctcac

SEQ ID NO: 183535 - DNA, 22 bp, Mus musculus
tgttttgtgaccaattatatgg

SEQ ID NO: 183536 - DNA, 18 bp, Mus musculus
gtagagccagagagaata

SEQ ID NO: 183537 - DNA, 21 bp, Mus musculus
tatatatgtatatatgttcca

SEQ ID NO: 183538 - DNA, 19 bp, Mus musculus
atggtgttacaggtatttg

SEQ ID NO: 183539 - DNA, 20 bp, Mus musculus
acacacacatatatctatgt

SEQ ID NO: 183540 - DNA, 23 bp, Mus musculus
ttctctgcgtctctttctgtcag

SEQ ID NO: 183541 - DNA, 23 bp, Mus musculus
atgtatgtatgtatgtatgtatg

SEQ ID NO: 183542 - DNA, 20 bp, Mus musculus
atacgaacagtctaacttac

SEQ ID NO: 183543 - DNA, 23 bp, Mus musculus
tctgtgtctgtttctatcagcta

SEQ ID NO: 183544 - DNA, 23 bp, Mus musculus
tatgtttatgaacactttgagta

SEQ ID NO: 183545 - DNA, 22 bp, Mus musculus
cacagaactgtcagtgcacaca

SEQ ID NO: 183546 - DNA, 20 bp, Mus musculus
ttttgtgcagatatgcttct

SEQ ID NO: 183547 - DNA, 21 bp, Mus musculus
aaagttgttcattatgaatag

SEQ ID NO: 183548 - DNA, 23 bp, Mus musculus
tagtccatggtgatctgatagga

SEQ ID NO: 183549 - DNA, 23 bp, Mus musculus
agaaacacacacatatgtatgtg

SEQ ID NO: 183550 - DNA, 23 bp, Mus musculus
tagttatgatgatcacaaaggtt

SEQ ID NO: 183551 - DNA, 23 bp, Mus musculus
tatgtatatgtatatttgtgtgt

SEQ ID NO: 183552 - DNA, 23 bp, Mus musculus
tgtgtgtgtgtaaaacatcaatg

SEQ ID NO: 183553 - DNA, 23 bp, Mus musculus
atttgtatatgtttgcatatatt

SEQ ID NO: 183554 - DNA, 23 bp, Mus musculus
aggtatcagagtaattgtggctt

SEQ ID NO: 183555 - DNA, 23 bp, Mus musculus
tattctttgaagttctgatagaa

SEQ ID NO: 183556 - DNA, 21 bp, Mus musculus
aaaaataactgattttcatgt

SEQ ID NO: 183557 - DNA, 20 bp, Mus musculus
atttaattttgtgaaaccag

SEQ ID NO: 183558 - DNA, 22 bp, Mus musculus
tgttttgtgaccaattatatgg

SEQ ID NO: 183559 - DNA, 22 bp, Mus musculus
tgttttgtgaccaattatatgg

SEQ ID NO: 183560 - DNA, 21 bp, Mus musculus
atatgtgtatatgaatatatg

SEQ ID NO: 183561 - DNA, 23 bp, Mus musculus
agtgagctagtagtttccagggt

SEQ ID NO: 183562 - DNA, 21 bp, Mus musculus
tgagaagagagtgatggcttc

SEQ ID NO: 183563 - DNA, 21 bp, Mus musculus
agtctacagctttccaagtca

SEQ ID NO: 183564 - DNA, 21 bp, Mus musculus
cacagttctgtttctctgttc

SEQ ID NO: 183565 - DNA, 19 bp, Mus musculus
taaagtgaattcaaagtgg

SEQ ID NO: 183566 - DNA, 23 bp, Mus musculus
tgtaagagttgagtttctgtttt

SEQ ID NO: 183567 - DNA, 23 bp, Mus musculus
gtgcctcagagaagccagtgaga

SEQ ID NO: 183568 - DNA, 23 bp, Mus musculus
cacagactctctgggagttctga

SEQ ID NO: 183569 - DNA, 23 bp, Mus musculus
gagacagtctgtcactggctcgg

SEQ ID NO: 183570 - DNA, 23 bp, Mus musculus
agctcagtagtgagagtgttcac

SEQ ID NO: 183571 - DNA, 23 bp, Mus musculus
tctgtctgtctgtctgtctgtct

SEQ ID NO: 183572 - DNA, 23 bp, Mus musculus
agaacactgactgctcttccaga

SEQ ID NO: 183573 - DNA, 22 bp, Mus musculus
aatatgtatgtgcattatatga

SEQ ID NO: 183574 - DNA, 23 bp, Mus musculus
gttatgtgaatatgtatatctgt

SEQ ID NO: 183575 - DNA, 18 bp, Mus musculus
tatgtatgtatgtttgta

SEQ ID NO: 183576 - DNA, 23 bp, Mus musculus
gtctgtctgtctgtctgcctgtc

SEQ ID NO: 183577 - DNA, 21 bp, Mus musculus
gagagaccaaagtgtccagtt

SEQ ID NO: 183578 - DNA, 23 bp, Mus musculus
atatgcatgtttacaagtatgtg

SEQ ID NO: 183579 - DNA, 22 bp, Mus musculus
ttaccactgcatgcacagactg

SEQ ID NO: 183580 - DNA, 19 bp, Mus musculus
aagaaccagggctggagag

SEQ ID NO: 183581 - DNA, 23 bp, Mus musculus
ttctgtgtctctctgtgtcactc

SEQ ID NO: 183582 - DNA, 23 bp, Mus musculus
ttgacagtgtacacagaaaatgt

SEQ ID NO: 183583 - DNA, 22 bp, Mus musculus
tgtctgtctgcctgtctgcatg

SEQ ID NO: 183584 - DNA, 20 bp, Mus musculus
aaccttgaagcagaggctca

SEQ ID NO: 183585 - DNA, 23 bp, Mus musculus
ggcactgagtctgtcactcaggg

SEQ ID NO: 183586 - DNA, 23 bp, Mus musculus
tatatatgtgtatgtataatgta

SEQ ID NO: 183587 - DNA, 22 bp, Mus musculus
cagtcaggttctctaatctggc

SEQ ID NO: 183588 - DNA, 22 bp, Mus musculus
tgttttgtgaccaattatatgg

SEQ ID NO: 183589 - DNA, 23 bp, Mus musculus
cagtggctctgtgcctctgcctg

SEQ ID NO: 183590 - DNA, 20 bp, Mus musculus
aggaattgtgtatgtatgta

SEQ ID NO: 183591 - DNA, 22 bp, Mus musculus
tgttttgtgaccaattatatgg

SEQ ID NO: 183592 - DNA, 18 bp, Mus musculus
tgtgtatatatatgtgtg

SEQ ID NO: 183593 - DNA, 23 bp, Mus musculus
aagggaatgcttaagtttcccaa

SEQ ID NO: 183594 - DNA, 22 bp, Mus musculus
tgttttgtgaccaattatatgg

SEQ ID NO: 183595 - DNA, 20 bp, Mus musculus
gtgtgtgtgtgttttgtgat

SEQ ID NO: 183596 - DNA, 23 bp, Mus musculus
gtatgcatttatgtatgtataca

SEQ ID NO: 183597 - DNA, 21 bp, Mus musculus
tcaagtgaccataggtgtgtg

SEQ ID NO: 183598 - DNA, 23 bp, Mus musculus
cattggtctacttgtctgtcact

SEQ ID NO: 183599 - DNA, 21 bp, Mus musculus
tcaagtgaccataggtgtgtg

SEQ ID NO: 183600 - DNA, 23 bp, Mus musculus
cattggtctacttgtctgtcact

SEQ ID NO: 183601 - DNA, 23 bp, Mus musculus
ctgtgtctctgtttagtttctgt

SEQ ID NO: 183602 - DNA, 23 bp, Mus musculus
atctgtccactgatgagagtggg

SEQ ID NO: 183603 - DNA, 22 bp, Mus musculus
tctctggttgatctttccaata

SEQ ID NO: 183604 - DNA, 18 bp, Mus musculus
tcagctaggctaaagaga

SEQ ID NO: 183605 - DNA, 23 bp, Mus musculus
ctttctcataggtctttctgaag

SEQ ID NO: 183606 - DNA, 23 bp, Mus musculus
ctgagctagacaaaggctctctt

SEQ ID NO: 183607 - DNA, 23 bp, Mus musculus
tctgtctgtcggtcagtctgtct

SEQ ID NO: 183608 - DNA, 23 bp, Mus musculus
tgactcagtgtgtctgtgttcta

SEQ ID NO: 183609 - DNA, 19 bp, Mus musculus
gagagatgatggctcagca

SEQ ID NO: 183610 - DNA, 23 bp, Mus musculus
tgtctgcctgcctgcctgcctat

SEQ ID NO: 183611 - DNA, 21 bp, Mus musculus
atagacagagggataatatgg

SEQ ID NO: 183612 - DNA, 23 bp, Mus musculus
actcacacactggcacagtagtc

SEQ ID NO: 183613 - DNA, 19 bp, Mus musculus
tttctagttgagcccttct

SEQ ID NO: 183614 - DNA, 23 bp, Mus musculus
ctacttgagattttgttctactt

SEQ ID NO: 183615 - DNA, 23 bp, Mus musculus
gcctgcatgtatgtatgtatgta

SEQ ID NO: 183616 - DNA, 23 bp, Mus musculus
tctgcttctctcagtctctccat

SEQ ID NO: 183617 - DNA, 22 bp, Mus musculus
actgagttctctgggtgtgctg

SEQ ID NO: 183618 - DNA, 18 bp, Mus musculus
agagatgatggctcaatg

SEQ ID NO: 183619 - DNA, 23 bp, Mus musculus
ttgtctgtctgtctatctgtctg

SEQ ID NO: 183620 - DNA, 23 bp, Mus musculus
ttctctgaacacagtgaggtgta

SEQ ID NO: 183621 - DNA, 23 bp, Mus musculus
tgtgagaacagagtacaacacat

SEQ ID NO: 183622 - DNA, 23 bp, Mus musculus
tacttcaccatcatcttcgtcct

SEQ ID NO: 183623 - DNA, 23 bp, Mus musculus
gtgaaggtcctgtctgagtagat

SEQ ID NO: 183624 - DNA, 18 bp, Mus musculus
acacagagaaaccctgtc

SEQ ID NO: 183625 - DNA, 20 bp, Mus musculus
acatatgtgtgtgtgtgttt

SEQ ID NO: 183626 - DNA, 22 bp, Mus musculus
tgttttgtgaccaattatatgg

SEQ ID NO: 183627 - DNA, 23 bp, Mus musculus
tgtttcactgtttaggttgttaa

SEQ ID NO: 183628 - DNA, 23 bp, Mus musculus
tttatagtgatactgttcttctg

SEQ ID NO: 183629 - DNA, 23 bp, Mus musculus
agaggatgacattggaaaaataa

SEQ ID NO: 183630 - DNA, 21 bp, Mus musculus
catctgtgtttttcttgttga

SEQ ID NO: 183631 - DNA, 23 bp, Mus musculus
agactatgtcacactcagtgtag

SEQ ID NO: 183632 - DNA, 19 bp, Mus musculus
tatgagttttcaaagcctg

SEQ ID NO: 183633 - DNA, 21 bp, Mus musculus
catgtgcatatgtgtagataa

SEQ ID NO: 183634 - DNA, 18 bp, Mus musculus
gaagatgcacttcagaaa

SEQ ID NO: 183635 - DNA, 23 bp, Mus musculus
tgtctgtctgtctgtctgtctat

SEQ ID NO: 183636 - DNA, 23 bp, Mus musculus
gctctggctctgactctggctct

SEQ ID NO: 183637 - DNA, 23 bp, Mus musculus
ttggcagttcatttcataagtaa

SEQ ID NO: 183638 - DNA, 18 bp, Mus musculus
aagaggtagtagaatcta

SEQ ID NO: 183639 - DNA, 20 bp, Mus musculus
agacagtagacatgggatgc

SEQ ID NO: 183640 - DNA, 23 bp, Mus musculus
tgtgtatatatagtgtgcacaca

SEQ ID NO: 183641 - DNA, 22 bp, Mus musculus
tggctccgaggttaagatctct

SEQ ID NO: 183642 - DNA, 23 bp, Mus musculus
tgtgtgtgtgtatgtacatgtgt

SEQ ID NO: 183643 - DNA, 23 bp, Mus musculus
tttttctatgataatgttgggta

SEQ ID NO: 183644 - DNA, 23 bp, Mus musculus
caagagttagggagaagaaaatg

SEQ ID NO: 183645 - DNA, 23 bp, Mus musculus
tgtctgtctgtctgcctatgtgt

SEQ ID NO: 183646 - DNA, 22 bp, Mus musculus
tgttttgtgaccaattatatgg

SEQ ID NO: 183647 - DNA, 23 bp, Mus musculus
cccagactcactccctgaccctg

SEQ ID NO: 183648 - DNA, 23 bp, Mus musculus
atgaatgtgtgcatgtgcatgtg

SEQ ID NO: 183649 - DNA, 18 bp, Mus musculus
atatatgcatgtatgtgt

SEQ ID NO: 183650 - DNA, 20 bp, Mus musculus
tatatgcatatatattcata

SEQ ID NO: 183651 - DNA, 23 bp, Mus musculus
tagacttgtgtgtgcagtttcct

SEQ ID NO: 183652 - DNA, 20 bp, Mus musculus
tggcacagttcctactgcgt

SEQ ID NO: 183653 - DNA, 18 bp, Mus musculus
tctcattctgtcagggtt

SEQ ID NO: 183654 - DNA, 23 bp, Mus musculus
actgaagactcaactgtattggc

SEQ ID NO: 183655 - DNA, 23 bp, Mus musculus
cactggctcgctctctgtagctt

SEQ ID NO: 183656 - DNA, 22 bp, Mus musculus
ttcaggtgtacctgcatgtgtg

SEQ ID NO: 183657 - DNA, 20 bp, Mus musculus
tatgtgtatatatgtgtgtg

SEQ ID NO: 183658 - DNA, 23 bp, Mus musculus
tgactctctgtctgtctgcatca

SEQ ID NO: 183659 - DNA, 23 bp, Mus musculus
ctctgctgtagacctgaaagtca

SEQ ID NO: 183660 - DNA, 21 bp, Mus musculus
tctgagcttctcttatctgca

SEQ ID NO: 183661 - DNA, 21 bp, Mus musculus
ttcccttgctgagaggaggga

SEQ ID NO: 183662 - DNA, 23 bp, Mus musculus
aggtatagtagtcattttgtagg

SEQ ID NO: 183663 - DNA, 21 bp, Mus musculus
tggctgattgctttccatctc

SEQ ID NO: 183664 - DNA, 23 bp, Mus musculus
tatatcacatatccttgacccat

SEQ ID NO: 183665 - DNA, 22 bp, Mus musculus
ccctgtgtctctctgagtctgt

SEQ ID NO: 183666 - DNA, 21 bp, Mus musculus
tctgtggtgattagataggat

SEQ ID NO: 183667 - DNA, 18 bp, Mus musculus
ttttgtatctctggaggc

SEQ ID NO: 183668 - DNA, 22 bp, Mus musculus
tgttttgtgaccaattatatgg

SEQ ID NO: 183669 - DNA, 19 bp, Mus musculus
aatgtctcagtttaatcag

SEQ ID NO: 183670 - DNA, 21 bp, Mus musculus
atggctcagtggttaagagca

SEQ ID NO: 183671 - DNA, 22 bp, Mus musculus
ttttcaagaactccagggcatt

SEQ ID NO: 183672 - DNA, 22 bp, Mus musculus
cagcttttctatatgtatgtgt

SEQ ID NO: 183673 - DNA, 22 bp, Mus musculus
tcagagtggacagtgtgcactg

SEQ ID NO: 183674 - DNA, 20 bp, Mus musculus
agagaaccaggtttggagag

SEQ ID NO: 183675 - DNA, 23 bp, Mus musculus
tatgtgcatatgtatatgtttat

SEQ ID NO: 183676 - DNA, 23 bp, Mus musculus
tgtatacatgtatgtatgtatgt

SEQ ID NO: 183677 - DNA, 23 bp, Mus musculus
cactctgcactagctctgaatgg

SEQ ID NO: 183678 - DNA, 23 bp, Mus musculus
acacacactcagtatgcggtgcg

SEQ ID NO: 183679 - DNA, 22 bp, Mus musculus
atatatgcacataaacatatgt

SEQ ID NO: 183680 - DNA, 23 bp, Mus musculus
tctgtctctcagtgtcttcagtt

SEQ ID NO: 183681 - DNA, 19 bp, Mus musculus
atgtgtgtcctgggaactg

SEQ ID NO: 183682 - DNA, 23 bp, Mus musculus
ttacacactgtcctttattcagg

SEQ ID NO: 183683 - DNA, 22 bp, Mus musculus
tgttttgtgaccaattatatgg

SEQ ID NO: 183684 - DNA, 23 bp, Mus musculus
cagatctctctctctctctagcc

SEQ ID NO: 183685 - DNA, 22 bp, Mus musculus
accctcagtgtcttacatatgg

SEQ ID NO: 183686 - DNA, 23 bp, Mus musculus
tccagctgcagcctctgtattct

SEQ ID NO: 183687 - DNA, 22 bp, Mus musculus
ctgagctacagacagacagaca

SEQ ID NO: 183688 - DNA, 19 bp, Mus musculus
catggaagagagagagcac

SEQ ID NO: 183689 - DNA, 22 bp, Mus musculus
attcttagtgtttggtgaggca

SEQ ID NO: 183690 - DNA, 21 bp, Mus musculus
tctcagaatcacataaggaag

SEQ ID NO: 183691 - DNA, 23 bp, Mus musculus
catttgagaaaatgtttttgtgt

SEQ ID NO: 183692 - DNA, 21 bp, Mus musculus
tagatcagggtacactgctgg

SEQ ID NO: 183693 - DNA, 21 bp, Mus musculus
ggtcagttctgagagtgctga

SEQ ID NO: 183694 - DNA, 23 bp, Mus musculus
tacatacatgaggctttgttttt

SEQ ID NO: 183695 - DNA, 23 bp, Mus musculus
tcagtcactctgataatcctgta

SEQ ID NO: 183696 - DNA, 22 bp, Mus musculus
atgggtatatataagtgtgtgt

SEQ ID NO: 183697 - DNA, 23 bp, Mus musculus
tatatgtatatgtatatgtgtgt

SEQ ID NO: 183698 - DNA, 21 bp, Mus musculus
tgagaccaagcagtcatgggc

SEQ ID NO: 183699 - DNA, 23 bp, Mus musculus
tgtgaccacacaggcaggtatgg

SEQ ID NO: 183700 - DNA, 23 bp, Mus musculus
tttctggtgcttgaatgtgtctt

SEQ ID NO: 183701 - DNA, 23 bp, Mus musculus
taaagttaccaattgttatgaca

SEQ ID NO: 183702 - DNA, 23 bp, Mus musculus
tctgtctgtctgtctgtctgtct

SEQ ID NO: 183703 - DNA, 23 bp, Mus musculus
cttaacaacctacagtctgtgtt

SEQ ID NO: 183704 - DNA, 23 bp, Mus musculus
tggtatgctcatccttctcatgg

SEQ ID NO: 183705 - DNA, 23 bp, Mus musculus
aggctctgagtcgctctgtccct

SEQ ID NO: 183706 - DNA, 23 bp, Mus musculus
agagttggttttgatcagtttct

SEQ ID NO: 183707 - DNA, 23 bp, Mus musculus
ttctctttgttcttctcattgct

SEQ ID NO: 183708 - DNA, 19 bp, Mus musculus
tgtctctctctctctgcct

SEQ ID NO: 183709 - DNA, 23 bp, Mus musculus
tatctgtgggtctgtctgcccgt

SEQ ID NO: 183710 - DNA, 23 bp, Mus musculus
tgtctctgaccctccctctctgc

SEQ ID NO: 183711 - DNA, 22 bp, Mus musculus
tctgtgtatctgtgtatgtggt

SEQ ID NO: 183712 - DNA, 18 bp, Mus musculus
gtagtaatgagggcctgg

SEQ ID NO: 183713 - DNA, 19 bp, Mus musculus
tctgactcagtctttgacc

SEQ ID NO: 183714 - DNA, 19 bp, Mus musculus
gagagatgactgagagcac

SEQ ID NO: 183715 - DNA, 23 bp, Mus musculus
aagagcactgactcctcttccag

SEQ ID NO: 183716 - DNA, 23 bp, Mus musculus
aagacctgagaaatgagtgagga

SEQ ID NO: 183717 - DNA, 22 bp, Mus musculus
ttgagacaggatttctctgtaa

SEQ ID NO: 183718 - DNA, 20 bp, Mus musculus
acaaagatctggctggagag

SEQ ID NO: 183719 - DNA, 23 bp, Mus musculus
aagagcactgactcctcttccag

SEQ ID NO: 183720 - DNA, 22 bp, Mus musculus
ttgagacaggatttctctgtaa

SEQ ID NO: 183721 - DNA, 23 bp, Mus musculus
tgtctgtctgtctgtctgtgcac

SEQ ID NO: 183722 - DNA, 23 bp, Mus musculus
cctgcctgcctgcctgcctgcct

SEQ ID NO: 183723 - DNA, 23 bp, Mus musculus
aatctcaataagcaggagctaca

SEQ ID NO: 183724 - DNA, 23 bp, Mus musculus
attcatgtgcatttcttttcatc

SEQ ID NO: 183725 - DNA, 18 bp, Mus musculus
gagggctcgaagaaggtg

SEQ ID NO: 183726 - DNA, 20 bp, Mus musculus
tgacctatagttgactttat

SEQ ID NO: 183727 - DNA, 18 bp, Mus musculus
aaggtaggtgctaaggtt

SEQ ID NO: 183728 - DNA, 23 bp, Mus musculus
tttggattgttatgaataatggt

SEQ ID NO: 183729 - DNA, 23 bp, Mus musculus
ggctgcctgtctgagtgtctgcc

SEQ ID NO: 183730 - DNA, 23 bp, Mus musculus
tgttgtagcatctctcttactca

SEQ ID NO: 183731 - DNA, 23 bp, Mus musculus
catacctcactctgtctcagagc

SEQ ID NO: 183732 - DNA, 21 bp, Mus musculus
agactccctcagtcacttcct

SEQ ID NO: 183733 - DNA, 23 bp, Mus musculus
ttatctatccctcactagctata

SEQ ID NO: 183734 - DNA, 19 bp, Mus musculus
aatatcaagataactcttg

SEQ ID NO: 183735 - DNA, 23 bp, Mus musculus
tgagcatgttcttgtttaggtgg

SEQ ID NO: 183736 - DNA, 23 bp, Mus musculus
tcactcacaggctcacttatgtg

SEQ ID NO: 183737 - DNA, 21 bp, Mus musculus
aagagaggcagatagatctct

SEQ ID NO: 183738 - DNA, 22 bp, Mus musculus
ttaatgtggcattttgaagagt

SEQ ID NO: 183739 - DNA, 23 bp, Mus musculus
tcactgagtagagtgttcttcag

SEQ ID NO: 183740 - DNA, 19 bp, Mus musculus
attgttattgaagatcagt

SEQ ID NO: 183741 - DNA, 23 bp, Mus musculus
ctgctgatttctctctgtctctg

SEQ ID NO: 183742 - DNA, 23 bp, Mus musculus
tagtccatggagatctgatagga

SEQ ID NO: 183743 - DNA, 23 bp, Mus musculus
tttttgtatctcttcaggcctgt

SEQ ID NO: 183744 - DNA, 19 bp, Mus musculus
tgataggatgcataggata

SEQ ID NO: 183745 - DNA, 23 bp, Mus musculus
tgaccttctttctctgcagaatc

SEQ ID NO: 183746 - DNA, 23 bp, Mus musculus
atttttcaagagaaagctggtcc

SEQ ID NO: 183747 - DNA, 23 bp, Mus musculus
gtgttctgataggatgcatagga

SEQ ID NO: 183748 - DNA, 23 bp, Mus musculus
tcacttcagtctctgtgagcccc

SEQ ID NO: 183749 - DNA, 23 bp, Mus musculus
gttcatatgtatatgtatatgtg

SEQ ID NO: 183750 - DNA, 23 bp, Mus musculus
tatgtatatatgcagctagacac

SEQ ID NO: 183751 - DNA, 23 bp, Mus musculus
atgccacagtagagtgtgaccac

SEQ ID NO: 183752 - DNA, 23 bp, Mus musculus
gggaacactgtgactctgtttct

SEQ ID NO: 183753 - DNA, 18 bp, Mus musculus
taagtgcttccccagctg

SEQ ID NO: 183754 - DNA, 23 bp, Mus musculus
ccacctcactgtgacagtgtctc

SEQ ID NO: 183755 - DNA, 23 bp, Mus musculus
actgccctcacagacagacagac

SEQ ID NO: 183756 - DNA, 23 bp, Mus musculus
tgtctgtcagtctttcaatcctg

SEQ ID NO: 183757 - DNA, 20 bp, Mus musculus
aaggaccaagttgtgcaaca

SEQ ID NO: 183758 - DNA, 18 bp, Mus musculus
gagtgcttctgtctgcta

SEQ ID NO: 183759 - DNA, 23 bp, Mus musculus
tgagaacatggtctgaacatgag

SEQ ID NO: 183760 - DNA, 18 bp, Mus musculus
tgcctgaggatacaatgt

SEQ ID NO: 183761 - DNA, 18 bp, Mus musculus
agtgaagtagggctggag

SEQ ID NO: 183762 - DNA, 23 bp, Mus musculus
tgtcactgtgtgtctgtgtgtgt

SEQ ID NO: 183763 - DNA, 22 bp, Mus musculus
cactcactcactcactttaatc

SEQ ID NO: 183764 - DNA, 22 bp, Mus musculus
cactcactcactcactttaatc

SEQ ID NO: 183765 - DNA, 23 bp, Mus musculus
agtctctgcaacagtgtactaag

SEQ ID NO: 183766 - DNA, 23 bp, Mus musculus
actctcacacactcatcttacag

SEQ ID NO: 183767 - DNA, 22 bp, Mus musculus
aatgacatgcaatatgatgttt

SEQ ID NO: 183768 - DNA, 21 bp, Mus musculus
atgtatgtgtccatgtgcatg

SEQ ID NO: 183769 - DNA, 18 bp, Mus musculus
aagattgagtccatgtag

SEQ ID NO: 183770 - DNA, 23 bp, Mus musculus
gcttcagtcaccctaaagaggct

SEQ ID NO: 183771 - DNA, 22 bp, Mus musculus
tttcggttatctagctttatga

SEQ ID NO: 183772 - DNA, 23 bp, Mus musculus
atacagctagataaccaaagata

SEQ ID NO: 183773 - DNA, 18 bp, Mus musculus
acagtgcatgctgtggac

SEQ ID NO: 183774 - DNA, 23 bp, Mus musculus
ggaagagtgaagtgtgggagcac

SEQ ID NO: 183775 - DNA, 20 bp, Mus musculus
aaaacatacatatacatatg

SEQ ID NO: 183776 - DNA, 22 bp, Mus musculus
tgacaaccaagagtgtgagctg

SEQ ID NO: 183777 - DNA, 23 bp, Mus musculus
gtgtgtcactgtgcctgagtcta

SEQ ID NO: 183778 - DNA, 23 bp, Mus musculus
tatgtgtgtctgagtatggtgtg

SEQ ID NO: 183779 - DNA, 23 bp, Mus musculus
tgcgttcacccatgcctgctgct

SEQ ID NO: 183780 - DNA, 23 bp, Mus musculus
ctacttactgagatgcttttctg

SEQ ID NO: 183781 - DNA, 20 bp, Mus musculus
agtcagtgcctttttttttt

SEQ ID NO: 183782 - DNA, 23 bp, Mus musculus
tctgtcactgtgtggctctcact

SEQ ID NO: 183783 - DNA, 23 bp, Mus musculus
ttttctagtggaacttctttaga

SEQ ID NO: 183784 - DNA, 23 bp, Mus musculus
tcagagagagtacacactgggat

SEQ ID NO: 183785 - DNA, 21 bp, Mus musculus
tgtctctctggttttcttccc

SEQ ID NO: 183786 - DNA, 23 bp, Mus musculus
gtatactagctacatacacacat

SEQ ID NO: 183787 - DNA, 19 bp, Mus musculus
acacatatgtgtgtatgta

SEQ ID NO: 183788 - DNA, 23 bp, Mus musculus
tatatgtatgtatgcatgtatgt

SEQ ID NO: 183789 - DNA, 23 bp, Mus musculus
tatgtgtgtgtgtattatgtatg

SEQ ID NO: 183790 - DNA, 23 bp, Mus musculus
tctgtccctctctgggcctcatt

SEQ ID NO: 183791 - DNA, 23 bp, Mus musculus
atgtatgtatgtgtgtgtgtatg

SEQ ID NO: 183792 - DNA, 23 bp, Mus musculus
tatatgcatgcatatgtgtgtaa

SEQ ID NO: 183793 - DNA, 23 bp, Mus musculus
aaaagcactgactgctcttccag

SEQ ID NO: 183794 - DNA, 23 bp, Mus musculus
cgtcagtcactctggctgtccat

SEQ ID NO: 183795 - DNA, 23 bp, Mus musculus
cttgtgagtctgagaacactctg

SEQ ID NO: 183796 - DNA, 23 bp, Mus musculus
catgagtgactctcagactctgc

SEQ ID NO: 183797 - DNA, 22 bp, Mus musculus
tcatcacatgggatcttgttcc

SEQ ID NO: 183798 - DNA, 22 bp, Mus musculus
tccacacggttcttcctcctgg

SEQ ID NO: 183799 - DNA, 22 bp, Mus musculus
tctatctccattctctctcaca

SEQ ID NO: 183800 - DNA, 23 bp, Mus musculus
actgatgctagagagacagctct

SEQ ID NO: 183801 - DNA, 23 bp, Mus musculus
aaacacactgctgtgcttgttgg

SEQ ID NO: 183802 - DNA, 21 bp, Mus musculus
aagcagttctttttgatatga

SEQ ID NO: 183803 - DNA, 23 bp, Mus musculus
agtctcagaggtattaatcagtt

SEQ ID NO: 183804 - DNA, 23 bp, Mus musculus
ctgtccgtctgtccgtgtgtgtg

SEQ ID NO: 183805 - DNA, 19 bp, Mus musculus
gagagagagagagagagag

SEQ ID NO: 183806 - DNA, 19 bp, Mus musculus
atgcacgtgatggcttgga

SEQ ID NO: 183807 - DNA, 20 bp, Mus musculus
tggctcagtggttaggagca

SEQ ID NO: 183808 - DNA, 23 bp, Mus musculus
aatttttactgtgatcattccag

SEQ ID NO: 183809 - DNA, 23 bp, Mus musculus
tgtgagtctgtttgtctgtccct

SEQ ID NO: 183810 - DNA, 21 bp, Mus musculus
aagagacctgtgtgagcacag

SEQ ID NO: 183811 - DNA, 23 bp, Mus musculus
tgtgtgtcctgtgtgtgtgtcct

SEQ ID NO: 183812 - DNA, 23 bp, Mus musculus
ctccatatcatatcacagacaca

SEQ ID NO: 183813 - DNA, 19 bp, Mus musculus
ggtggcagtgtgttttgtc

SEQ ID NO: 183814 - DNA, 22 bp, Mus musculus
tgttttgtgaccaattatatgg

SEQ ID NO: 183815 - DNA, 21 bp, Mus musculus
tcaacaacaaacagactcttc

SEQ ID NO: 183816 - DNA, 23 bp, Mus musculus
caggtgtctgtctgtctgtatct

SEQ ID NO: 183817 - DNA, 23 bp, Mus musculus
tgtgtctctgtgtgtgtagtgca

SEQ ID NO: 183818 - DNA, 21 bp, Mus musculus
tttccctggccaattgttgag

SEQ ID NO: 183819 - DNA, 23 bp, Mus musculus
tgtgggtctctgcctccctctga

SEQ ID NO: 183820 - DNA, 18 bp, Mus musculus
tgtgtgcatgtatgtatg

SEQ ID NO: 183821 - DNA, 23 bp, Mus musculus
ttgtctgtcagtcagacctgtta

SEQ ID NO: 183822 - DNA, 23 bp, Mus musculus
tctaatgaataagacaaggtaaa

SEQ ID NO: 183823 - DNA, 23 bp, Mus musculus
accagtctctctctctctattct

SEQ ID NO: 183824 - DNA, 23 bp, Mus musculus
ttacagaggctcagttctgaacc

SEQ ID NO: 183825 - DNA, 19 bp, Mus musculus
taagctgggtgctgattgg

SEQ ID NO: 183826 - DNA, 23 bp, Mus musculus
tgtgtccctcagtcagtcccaga

SEQ ID NO: 183827 - DNA, 19 bp, Mus musculus
tgtactcattccttgtgca

SEQ ID NO: 183828 - DNA, 22 bp, Mus musculus
tcagagctccatctgctttctg

SEQ ID NO: 183829 - DNA, 23 bp, Mus musculus
agatctgtctgtctctgtctcct

SEQ ID NO: 183830 - DNA, 19 bp, Mus musculus
agaagacagatctagaaga

SEQ ID NO: 183831 - DNA, 23 bp, Mus musculus
tgaatgtgcatgtatattggtat

SEQ ID NO: 183832 - DNA, 23 bp, Mus musculus
tgtatgtgtgtatatgtatatgt

SEQ ID NO: 183833 - DNA, 22 bp, Mus musculus
ttatatcacattctggttgtca

SEQ ID NO: 183834 - DNA, 21 bp, Mus musculus
tgtgcatttatatatttatgt

SEQ ID NO: 183835 - DNA, 23 bp, Mus musculus
tatatatatatgtgtgcgtgtgt

SEQ ID NO: 183836 - DNA, 19 bp, Mus musculus
atatgagttatgaatgccc

SEQ ID NO: 183837 - DNA, 23 bp, Mus musculus
atatttttctgattgtcatacag

SEQ ID NO: 183838 - DNA, 23 bp, Mus musculus
accatgtagttgctgggatttga

SEQ ID NO: 183839 - DNA, 19 bp, Mus musculus
tctcaggagttctaacaca

SEQ ID NO: 183840 - DNA, 21 bp, Mus musculus
tatgtatatgtatgtgtatgt

SEQ ID NO: 183841 - DNA, 22 bp, Mus musculus
aatgtgtgtatatacatgtgtg

SEQ ID NO: 183842 - DNA, 23 bp, Mus musculus
tgtcagcagactgtctgtgtgac

SEQ ID NO: 183843 - DNA, 23 bp, Mus musculus
atgcagtaatctctggtggtttg

SEQ ID NO: 183844 - DNA, 23 bp, Mus musculus
ttgacagaacagtgtgaggatgc

SEQ ID NO: 183845 - DNA, 23 bp, Mus musculus
tctgtctatctgtgtctctttcc

SEQ ID NO: 183846 - DNA, 23 bp, Mus musculus
tgtatgtgtgtgtgtttgcaatg

SEQ ID NO: 183847 - DNA, 21 bp, Mus musculus
ttctgtgtctcatagtctctc

SEQ ID NO: 183848 - DNA, 23 bp, Mus musculus
acccatggacctctcaaagagtg

SEQ ID NO: 183849 - DNA, 23 bp, Mus musculus
gatccactcactcactcactcac

SEQ ID NO: 183850 - DNA, 23 bp, Mus musculus
agtatctgcatctgtattggtca

SEQ ID NO: 183851 - DNA, 23 bp, Mus musculus
atgtatgtatgtatgtatacatg

SEQ ID NO: 183852 - DNA, 19 bp, Mus musculus
gtgtgcgtgtgtgtgtgtg

SEQ ID NO: 183853 - DNA, 22 bp, Mus musculus
atacagcttagggtaagcgtct

SEQ ID NO: 183854 - DNA, 23 bp, Mus musculus
cactgcagcttccataatgagat

SEQ ID NO: 183855 - DNA, 22 bp, Mus musculus
tgttttgtgaccaattatatgg

SEQ ID NO: 183856 - DNA, 23 bp, Mus musculus
tctgtgtgtctgtgtgtctgtct

SEQ ID NO: 183857 - DNA, 22 bp, Mus musculus
aacagagttttttttccatcca

SEQ ID NO: 183858 - DNA, 22 bp, Mus musculus
aggattaagcttgttaagcatt

SEQ ID NO: 183859 - DNA, 23 bp, Mus musculus
gtggatcactgtgtgcgttatct

SEQ ID NO: 183860 - DNA, 21 bp, Mus musculus
aattaactctggaactcagtc

SEQ ID NO: 183861 - DNA, 21 bp, Mus musculus
agcacctatttgatgcattta

SEQ ID NO: 183862 - DNA, 20 bp, Mus musculus
acagacacacatatatatgt

SEQ ID NO: 183863 - DNA, 23 bp, Mus musculus
tgtgtgtatatgtatatgtatat

SEQ ID NO: 183864 - DNA, 23 bp, Mus musculus
tgtatactgctagtacataatat

SEQ ID NO: 183865 - DNA, 23 bp, Mus musculus
tgacactatcactgaggctatgg

SEQ ID NO: 183866 - DNA, 22 bp, Mus musculus
tgttttgtgaccaattatatgg

SEQ ID NO: 183867 - DNA, 23 bp, Mus musculus
tgagaggctctgtcagtgcctga

SEQ ID NO: 183868 - DNA, 23 bp, Mus musculus
attaatgactttttctatttctt

SEQ ID NO: 183869 - DNA, 21 bp, Mus musculus
tatgtatgtatgcatgtgtaa

SEQ ID NO: 183870 - DNA, 23 bp, Mus musculus
tgtgtgtgtgtatgtacatgtat

SEQ ID NO: 183871 - DNA, 23 bp, Mus musculus
gtatatgtatatgcatttgtata

SEQ ID NO: 183872 - DNA, 23 bp, Mus musculus
attactcagttgtaaccaatatc

SEQ ID NO: 183873 - DNA, 20 bp, Mus musculus
taagtattcttttgtacctg

SEQ ID NO: 183874 - DNA, 23 bp, Mus musculus
gtagagtagagtatttgttgagt

SEQ ID NO: 183875 - DNA, 20 bp, Mus musculus
tggtattttgtttggttcct

SEQ ID NO: 183876 - DNA, 23 bp, Mus musculus
attgctgtggaaaacttgactgt

SEQ ID NO: 183877 - DNA, 22 bp, Mus musculus
aagaatgtggatgacttctgaa

SEQ ID NO: 183878 - DNA, 21 bp, Mus musculus
ttaaactgcaaaagccattca

SEQ ID NO: 183879 - DNA, 22 bp, Mus musculus
tgtggaagatggtagtttagtg

SEQ ID NO: 183880 - DNA, 20 bp, Mus musculus
aggcacacagcatctattca

SEQ ID NO: 183881 - DNA, 20 bp, Mus musculus
ttagaatacaagcattggca

SEQ ID NO: 183882 - DNA, 20 bp, Mus musculus
tcagtggaaagagaggccca

SEQ ID NO: 183883 - DNA, 22 bp, Mus musculus
tgtgagtaacacatatacatat

SEQ ID NO: 183884 - DNA, 23 bp, Mus musculus
tctctgtcagcatctctttttcg

SEQ ID NO: 183885 - DNA, 21 bp, Mus musculus
tacagtggataatagatagag

SEQ ID NO: 183886 - DNA, 23 bp, Mus musculus
tcagtggctctgtggctctgcct

SEQ ID NO: 183887 - DNA, 23 bp, Mus musculus
ctctgtgtctgtctcttattttg

SEQ ID NO: 183888 - DNA, 23 bp, Mus musculus
gttgctgtgttactgctgtgtta

SEQ ID NO: 183889 - DNA, 23 bp, Mus musculus
attactgtgtgactgtgtgactg

SEQ ID NO: 183890 - DNA, 23 bp, Mus musculus
tttcactgagttctaatctggat

SEQ ID NO: 183891 - DNA, 23 bp, Mus musculus
aagattctgacccattatgatga

SEQ ID NO: 183892 - DNA, 22 bp, Mus musculus
tgttttgtgaccaattatatgg

SEQ ID NO: 183893 - DNA, 23 bp, Mus musculus
ggtttggtcttcagtctgtagga

SEQ ID NO: 183894 - DNA, 23 bp, Mus musculus
aaggttctgacacctagagaagt

SEQ ID NO: 183895 - DNA, 21 bp, Mus musculus
tcatggatattctgctaggtc

SEQ ID NO: 183896 - DNA, 21 bp, Mus musculus
tgttctttcaatgttcttgta

SEQ ID NO: 183897 - DNA, 18 bp, Mus musculus
tattccgaggaaaactct

SEQ ID NO: 183898 - DNA, 21 bp, Mus musculus
attcctcggactactacagtt

SEQ ID NO: 183899 - DNA, 23 bp, Mus musculus
actgcaaatcaaaactactttgt

SEQ ID NO: 183900 - DNA, 23 bp, Mus musculus
tgttttgtgaccaattatatggt

SEQ ID NO: 183901 - DNA, 22 bp, Mus musculus
tctgtgtgtgagtgtgtgtgtg

SEQ ID NO: 183902 - DNA, 22 bp, Mus musculus
aagctacatgctgtgggactga

SEQ ID NO: 183903 - DNA, 19 bp, Mus musculus
tcagtgcatgaaaggagat

SEQ ID NO: 183904 - DNA, 22 bp, Mus musculus
tgttttgtgaccaattatatgg

SEQ ID NO: 183905 - DNA, 23 bp, Mus musculus
tatttgataatatgcttgtgtga

SEQ ID NO: 183906 - DNA, 23 bp, Mus musculus
atatatgttaatgtagtcatgca

SEQ ID NO: 183907 - DNA, 23 bp, Mus musculus
tttattctttgcttatggaatgt

SEQ ID NO: 183908 - DNA, 23 bp, Mus musculus
tacttcctcatagtcaagttagc

SEQ ID NO: 183909 - DNA, 23 bp, Mus musculus
ctcaggctatcagtgtgtgtgtc

SEQ ID NO: 183910 - DNA, 21 bp, Mus musculus
tgaggtgtctgctcattggtt

SEQ ID NO: 183911 - DNA, 22 bp, Mus musculus
tgttttgtgaccaattatatgg

SEQ ID NO: 183912 - DNA, 22 bp, Mus musculus
tttcttcaggatctgttgttat

SEQ ID NO: 183913 - DNA, 22 bp, Mus musculus
tttagtgagtctagctaagggt

SEQ ID NO: 183914 - DNA, 22 bp, Mus musculus
tgtatgtatgtatgtatgtatg

SEQ ID NO: 183915 - DNA, 21 bp, Mus musculus
tctgtctatctgtctgtcttg

SEQ ID NO: 183916 - DNA, 21 bp, Mus musculus
tcatttctaaagtagtatttt

SEQ ID NO: 183917 - DNA, 22 bp, Mus musculus
ctgtgtatatgcatttgtgtgt

SEQ ID NO: 183918 - DNA, 22 bp, Mus musculus
tgttttgtgaccaattatatgg

SEQ ID NO: 183919 - DNA, 22 bp, Mus musculus
tgttttgtgaccaattatatgg

SEQ ID NO: 183920 - DNA, 19 bp, Mus musculus
tttactctgtctgttcatt

SEQ ID NO: 183921 - DNA, 23 bp, Mus musculus
atatgtgtgtatatataagtgtg

SEQ ID NO: 183922 - DNA, 21 bp, Mus musculus
tgtgtatgtatgagtgtgtgt

SEQ ID NO: 183923 - DNA, 23 bp, Mus musculus
gcatgtgtatgagtgtgtacata

SEQ ID NO: 183924 - DNA, 21 bp, Mus musculus
ggggctcactctgtgcctgtg

SEQ ID NO: 183925 - DNA, 22 bp, Mus musculus
actctctggctgtatgtctgtg

SEQ ID NO: 183926 - DNA, 23 bp, Mus musculus
agatggcactactctcgggctgc

SEQ ID NO: 183927 - DNA, 23 bp, Mus musculus
gcctgcctgtctgtctgtctgtc

SEQ ID NO: 183928 - DNA, 20 bp, Mus musculus
atgtgtatacatatatatgc

SEQ ID NO: 183929 - DNA, 23 bp, Mus musculus
tgtgcatatatatgtatatgtat

SEQ ID NO: 183930 - DNA, 23 bp, Mus musculus
gagaagtgacagtttgtggttgt

SEQ ID NO: 183931 - DNA, 19 bp, Mus musculus
atatgtatatgtatatatc

SEQ ID NO: 183932 - DNA, 19 bp, Mus musculus
atatgtatatatgtataca

SEQ ID NO: 183933 - DNA, 22 bp, Mus musculus
gattttgagtttcttctttgaa

SEQ ID NO: 183934 - DNA, 23 bp, Mus musculus
acaggaatttttatgaggaagga

SEQ ID NO: 183935 - DNA, 22 bp, Mus musculus
gagagtgttcacacacagagaa

SEQ ID NO: 183936 - DNA, 23 bp, Mus musculus
tcagagaagagtctttgcaccct

SEQ ID NO: 183937 - DNA, 22 bp, Mus musculus
tgttttgtgaccaattatatgg

SEQ ID NO: 183938 - DNA, 22 bp, Mus musculus
tatggtacacacacttttttgt

SEQ ID NO: 183939 - DNA, 23 bp, Mus musculus
ctccctctctcaaagcctctctt

SEQ ID NO: 183940 - DNA, 23 bp, Mus musculus
tgtgaggtagaatgttctatggg

SEQ ID NO: 183941 - DNA, 23 bp, Mus musculus
gtatgtacatctgtatgtatgta

SEQ ID NO: 183942 - DNA, 22 bp, Mus musculus
tgtatgtgcacatgcatatgta

SEQ ID NO: 183943 - DNA, 23 bp, Mus musculus
tgtgctagttctctgaagttctg

SEQ ID NO: 183944 - DNA, 21 bp, Mus musculus
tatgcatatatatacacatat

SEQ ID NO: 183945 - DNA, 22 bp, Mus musculus
tggtctgataggatgtatggga

SEQ ID NO: 183946 - DNA, 22 bp, Mus musculus
tgttttgtgaccaattatatgg

SEQ ID NO: 183947 - DNA, 22 bp, Mus musculus
tgttttgtgaccaattatatgg

SEQ ID NO: 183948 - DNA, 23 bp, Mus musculus
atatatatgcatatgtatgcata

SEQ ID NO: 183949 - DNA, 22 bp, Mus musculus
tgttttgtgaccaattatatgg

SEQ ID NO: 183950 - DNA, 23 bp, Mus musculus
ctcactgtgtgagcctgtgacac

SEQ ID NO: 183951 - DNA, 22 bp, Mus musculus
tgttttgtgaccaattatatgg

SEQ ID NO: 183952 - DNA, 18 bp, Mus musculus
agacacacacacatacat

SEQ ID NO: 183953 - DNA, 23 bp, Mus musculus
actgagagagcagagtcagggca

SEQ ID NO: 183954 - DNA, 22 bp, Mus musculus
tctgtcactctccctgtgttgt

SEQ ID NO: 183955 - DNA, 23 bp, Mus musculus
gatatgttcttctagctgggttg

SEQ ID NO: 183956 - DNA, 21 bp, Mus musculus
tgtgtacatatgtatacatgt

SEQ ID NO: 183957 - DNA, 23 bp, Mus musculus
ataacattgttcagtgacaacag

SEQ ID NO: 183958 - DNA, 23 bp, Mus musculus
ctcagacagtctgtcttgtttat

SEQ ID NO: 183959 - DNA, 23 bp, Mus musculus
tgtgtgtgcatatgcatgtgtac

SEQ ID NO: 183960 - DNA, 21 bp, Mus musculus
tgtgtgcatgtgtgtgtgcgt

SEQ ID NO: 183961 - DNA, 22 bp, Mus musculus
tgttttgtgaccaattatatgg

SEQ ID NO: 183962 - DNA, 23 bp, Mus musculus
agtctatgatgatctgataggat

SEQ ID NO: 183963 - DNA, 21 bp, Mus musculus
tgttttgtgaccaattatgtg

SEQ ID NO: 183964 - DNA, 23 bp, Mus musculus
ttctagtacaaggttgaataggt

SEQ ID NO: 183965 - DNA, 22 bp, Mus musculus
aaagtggacagccttgtctagt

SEQ ID NO: 183966 - DNA, 22 bp, Mus musculus
tgctttgcagagttgctgcaga

SEQ ID NO: 183967 - DNA, 23 bp, Mus musculus
ctatgacagcctgctctgaaggt

SEQ ID NO: 183968 - DNA, 23 bp, Mus musculus
cactctgtcactctgtctcagag

SEQ ID NO: 183969 - DNA, 23 bp, Mus musculus
tatgtgacagctagatttgtgtg

SEQ ID NO: 183970 - DNA, 23 bp, Mus musculus
cagacagacagacagacaggtga

SEQ ID NO: 183971 - DNA, 19 bp, Mus musculus
tatgtgtatatatatatgt

SEQ ID NO: 183972 - DNA, 18 bp, Mus musculus
acacacatagacacatgc

SEQ ID NO: 183973 - DNA, 23 bp, Mus musculus
gacagaagagacagatgacattt

SEQ ID NO: 183974 - DNA, 23 bp, Mus musculus
cagcctcagccatttgcctcaga

SEQ ID NO: 183975 - DNA, 22 bp, Mus musculus
gagaagtgtttgtttgctttta

SEQ ID NO: 183976 - DNA, 23 bp, Mus musculus
gaaagacattcctagatctctca

SEQ ID NO: 183977 - DNA, 23 bp, Mus musculus
agacacagaggctagacactgtg

SEQ ID NO: 183978 - DNA, 23 bp, Mus musculus
gtgtcaggaagtcatgacattgc

SEQ ID NO: 183979 - DNA, 19 bp, Mus musculus
tgatacagaatgctgcagg

SEQ ID NO: 183980 - DNA, 23 bp, Mus musculus
gccacagtctctgtgcattcata

SEQ ID NO: 183981 - DNA, 22 bp, Mus musculus
gtgccttgtactagtagaggtg

SEQ ID NO: 183982 - DNA, 23 bp, Mus musculus
tctctctctctctctcacacaca

SEQ ID NO: 183983 - DNA, 22 bp, Mus musculus
tgttttgtgaccaattatatgg

SEQ ID NO: 183984 - DNA, 23 bp, Mus musculus
gaaattctgtgaggtatagaatg

SEQ ID NO: 183985 - DNA, 23 bp, Mus musculus
atactgagaagacactgagtgca

SEQ ID NO: 183986 - DNA, 20 bp, Mus musculus
agagctcttatttcagttcc

SEQ ID NO: 183987 - DNA, 20 bp, Mus musculus
tgtacaggagccagcatttc

SEQ ID NO: 183988 - DNA, 19 bp, Mus musculus
gtcagaagagtctctgcag

SEQ ID NO: 183989 - DNA, 22 bp, Mus musculus
tgttttgtgaccaattatatgg

SEQ ID NO: 183990 - DNA, 18 bp, Mus musculus
tatgtgtatatatatatg

SEQ ID NO: 183991 - DNA, 23 bp, Mus musculus
aatagatagcatttgaaaaggtg

SEQ ID NO: 183992 - DNA, 20 bp, Mus musculus
aaggtacttcaaggacatta

SEQ ID NO: 183993 - DNA, 23 bp, Mus musculus
tagtgcatggtgatctgatagga

SEQ ID NO: 183994 - DNA, 22 bp, Mus musculus
tgttttgtgacctattatgtgg

SEQ ID NO: 183995 - DNA, 23 bp, Mus musculus
tagtgcatggtgatctgatagga

SEQ ID NO: 183996 - DNA, 22 bp, Mus musculus
tgttttgtgacctattatgtgg

SEQ ID NO: 183997 - DNA, 21 bp, Mus musculus
agtgtctctgggttggttatt

SEQ ID NO: 183998 - DNA, 23 bp, Mus musculus
taacaaggttcagatttgttttt

SEQ ID NO: 183999 - DNA, 23 bp, Mus musculus
agtaaagttgtagctgagttggt

SEQ ID NO: 184000 - DNA, 19 bp, Mus musculus
ggttacatttggaaggcta

SEQ ID NO: 184001 - DNA, 21 bp, Mus musculus
tagtatctatagtactaatgt

SEQ ID NO: 184002 - DNA, 23 bp, Mus musculus
tgtgtgtgcatgtgcatgtgcat

SEQ ID NO: 184003 - DNA, 18 bp, Mus musculus
atgcacgtgtgtgtgtgt

SEQ ID NO: 184004 - DNA, 20 bp, Mus musculus
attctcaggctattacttta

SEQ ID NO: 184005 - DNA, 23 bp, Mus musculus
gatcaatgtgtctgtctctgtat

SEQ ID NO: 184006 - DNA, 21 bp, Mus musculus
ctctgtagtaaagcttgaggt

SEQ ID NO: 184007 - DNA, 22 bp, Mus musculus
tgttttgtgaccaattatatgg

SEQ ID NO: 184008 - DNA, 23 bp, Mus musculus
ttgctgatgatgctggagaagca

SEQ ID NO: 184009 - DNA, 23 bp, Mus musculus
tctgtctgtctctcttattgcag

SEQ ID NO: 184010 - DNA, 21 bp, Mus musculus
agaactgaaaccaaattttgg

SEQ ID NO: 184011 - DNA, 20 bp, Mus musculus
tgtatgtgtatgggcatgtg

SEQ ID NO: 184012 - DNA, 23 bp, Mus musculus
gtatgtatacatgtgtgtgcatg

SEQ ID NO: 184013 - DNA, 23 bp, Mus musculus
tttatgcttgaaatatttggtga

SEQ ID NO: 184014 - DNA, 23 bp, Mus musculus
tatgtgaccaattatattgtcaa

SEQ ID NO: 184015 - DNA, 21 bp, Mus musculus
tcaggcagtaagaatttttat

SEQ ID NO: 184016 - DNA, 21 bp, Mus musculus
gtcatagtctctgtctccctg

SEQ ID NO: 184017 - DNA, 21 bp, Mus musculus
tcgctgtctgcctgagtgact

SEQ ID NO: 184018 - DNA, 23 bp, Mus musculus
tagtccatggtgatctgatagga

SEQ ID NO: 184019 - DNA, 21 bp, Mus musculus
tgttttgttaccaattatatg

SEQ ID NO: 184020 - DNA, 23 bp, Mus musculus
actgtctctgactctattgcctg

SEQ ID NO: 184021 - DNA, 22 bp, Mus musculus
tctgtctttggatctttatgca

SEQ ID NO: 184022 - DNA, 21 bp, Mus musculus
tgaccatacacttacaggtgt

SEQ ID NO: 184023 - DNA, 23 bp, Mus musculus
acagaggaatggcatcagtgtct

SEQ ID NO: 184024 - DNA, 20 bp, Mus musculus
tgtgtgtagagactgagcgc

SEQ ID NO: 184025 - DNA, 23 bp, Mus musculus
acacagcaaggtgaatgctacat

SEQ ID NO: 184026 - DNA, 22 bp, Mus musculus
atggttggtgtgggacagaaca

SEQ ID NO: 184027 - DNA, 18 bp, Mus musculus
cacacacacatatatcca

SEQ ID NO: 184028 - DNA, 22 bp, Mus musculus
aaaagaaggtccagtgaccgac

SEQ ID NO: 184029 - DNA, 18 bp, Mus musculus
tgtggtaggatctgaaga

SEQ ID NO: 184030 - DNA, 20 bp, Mus musculus
ctgttcttccttgtgtgtgc

SEQ ID NO: 184031 - DNA, 18 bp, Mus musculus
tgttatctttgaattttt

SEQ ID NO: 184032 - DNA, 19 bp, Mus musculus
aaaagtgctgtgtattgac

SEQ ID NO: 184033 - DNA, 19 bp, Mus musculus
agacatctcatttagagct

SEQ ID NO: 184034 - DNA, 23 bp, Mus musculus
tctctctgtgtgtttctgtctct

SEQ ID NO: 184035 - DNA, 21 bp, Mus musculus
agactgcacacactgtccagt

SEQ ID NO: 184036 - DNA, 20 bp, Mus musculus
tccgggacacaatgatgatt

SEQ ID NO: 184037 - DNA, 22 bp, Mus musculus
tcatctgaggatggtgtgtgtg

SEQ ID NO: 184038 - DNA, 23 bp, Mus musculus
cacctcttactctatggaaatgt

SEQ ID NO: 184039 - DNA, 22 bp, Mus musculus
tgttttgtgaccaattatatgg

SEQ ID NO: 184040 - DNA, 23 bp, Mus musculus
tgatcttgacagatgagctactg

SEQ ID NO: 184041 - DNA, 23 bp, Mus musculus
gaaacagagttgatggagtgtta

SEQ ID NO: 184042 - DNA, 22 bp, Mus musculus
aagtctgtgctagacatctcta

SEQ ID NO: 184043 - DNA, 23 bp, Mus musculus
ttacttgtgtggttacttgtgtg

SEQ ID NO: 184044 - DNA, 20 bp, Mus musculus
tccagtcaagacagatggtg

SEQ ID NO: 184045 - DNA, 23 bp, Mus musculus
ttgtgagaagagagacagcagct

SEQ ID NO: 184046 - DNA, 23 bp, Mus musculus
tatttgatgttctgtatgctttt

SEQ ID NO: 184047 - DNA, 23 bp, Mus musculus
tagacatttctggtagaagttag

SEQ ID NO: 184048 - DNA, 23 bp, Mus musculus
tgtgtgtgagatgtgtgtgtatg

SEQ ID NO: 184049 - DNA, 23 bp, Mus musculus
tatacacattatatatatatgtg

SEQ ID NO: 184050 - DNA, 23 bp, Mus musculus
acacacacatatatacacactca

SEQ ID NO: 184051 - DNA, 23 bp, Mus musculus
acatgtgtatatatatgtgtgtg

SEQ ID NO: 184052 - DNA, 23 bp, Mus musculus
gacagggtctctctctctggccc

SEQ ID NO: 184053 - DNA, 19 bp, Mus musculus
agagcacacggaaatcaga

SEQ ID NO: 184054 - DNA, 23 bp, Mus musculus
gctcactctgaacagtctctgtg

SEQ ID NO: 184055 - DNA, 19 bp, Mus musculus
tgcatatttatatatttgt

SEQ ID NO: 184056 - DNA, 23 bp, Mus musculus
tatgtatatatatgagcatgcag

SEQ ID NO: 184057 - DNA, 23 bp, Mus musculus
tatctattggcaagagtggagta

SEQ ID NO: 184058 - DNA, 23 bp, Mus musculus
aacatgtatgtatatatgtatga

SEQ ID NO: 184059 - DNA, 23 bp, Mus musculus
agttcttatgtatacatgttagt

SEQ ID NO: 184060 - DNA, 22 bp, Mus musculus
tcattgagcaacatgtaactct

SEQ ID NO: 184061 - DNA, 22 bp, Mus musculus
atttgtatacatatgtatatgg

SEQ ID NO: 184062 - DNA, 23 bp, Mus musculus
tgtatatatgtatatatgtgtgt

SEQ ID NO: 184063 - DNA, 22 bp, Mus musculus
tgttttgtgaccaattatatgg

SEQ ID NO: 184064 - DNA, 23 bp, Mus musculus
gtgtgtcactgtgtgggtgggat

SEQ ID NO: 184065 - DNA, 21 bp, Mus musculus
ttggaatctatagaatagttg

SEQ ID NO: 184066 - DNA, 23 bp, Mus musculus
gagacagagcatagacagagcag

SEQ ID NO: 184067 - DNA, 23 bp, Mus musculus
gcctcagtccctctgtgcttctg

SEQ ID NO: 184068 - DNA, 23 bp, Mus musculus
tatatatgtatatgtatatgtat

SEQ ID NO: 184069 - DNA, 23 bp, Mus musculus
gttgatagaaagtgtttaagtgt

SEQ ID NO: 184070 - DNA, 22 bp, Mus musculus
tgacttaggtgcaaatatagct

SEQ ID NO: 184071 - DNA, 23 bp, Mus musculus
aatcactgactgctcttccagag

SEQ ID NO: 184072 - DNA, 20 bp, Mus musculus
atatatgtgtgggtgtgtat

SEQ ID NO: 184073 - DNA, 23 bp, Mus musculus
gtctgtctgtctgtctgtgtcgg

SEQ ID NO: 184074 - DNA, 22 bp, Mus musculus
tgttttgtgaccaattatatgg

SEQ ID NO: 184075 - DNA, 21 bp, Mus musculus
agtcactgtcacagtaaccag

SEQ ID NO: 184076 - DNA, 23 bp, Mus musculus
tagtgcatggtgatctgatagga

SEQ ID NO: 184077 - DNA, 22 bp, Mus musculus
tgttttgtgacctattatgtgg

SEQ ID NO: 184078 - DNA, 19 bp, Mus musculus
aagtaaagatgtaaaggga

SEQ ID NO: 184079 - DNA, 23 bp, Mus musculus
tggctgccactctgagtgtcacc

SEQ ID NO: 184080 - DNA, 20 bp, Mus musculus
tagctgtatgagtatggcca

SEQ ID NO: 184081 - DNA, 23 bp, Mus musculus
ctcacccagtctctgcaatgatt

SEQ ID NO: 184082 - DNA, 20 bp, Mus musculus
agactagagaatgagacccc

SEQ ID NO: 184083 - DNA, 22 bp, Mus musculus
tttctctctgtgtctgtagttt

SEQ ID NO: 184084 - DNA, 21 bp, Mus musculus
tgtcacactgtctttctggtc

SEQ ID NO: 184085 - DNA, 23 bp, Mus musculus
acacagataattgtgaggacaga

SEQ ID NO: 184086 - DNA, 21 bp, Mus musculus
tcggtacatttagacattgga

SEQ ID NO: 184087 - DNA, 23 bp, Mus musculus
atgtgtgcatgtatatatgtatg

SEQ ID NO: 184088 - DNA, 23 bp, Mus musculus
tcactgtcactctgtccatcctt

SEQ ID NO: 184089 - DNA, 23 bp, Mus musculus
cagaggaatcttgaatggccaag

SEQ ID NO: 184090 - DNA, 23 bp, Mus musculus
aaaggaatgttcactgtcctttg

SEQ ID NO: 184091 - DNA, 19 bp, Mus musculus
acagtaacatcaaagcaag

SEQ ID NO: 184092 - DNA, 20 bp, Mus musculus
tcacagaacacactgaggtc

SEQ ID NO: 184093 - DNA, 23 bp, Mus musculus
tctctccatatctattcagtatg

SEQ ID NO: 184094 - DNA, 23 bp, Mus musculus
atatgtaagtatatatatgtgtg

SEQ ID NO: 184095 - DNA, 23 bp, Mus musculus
tgtgtttgtgtctcatgttacca

SEQ ID NO: 184096 - DNA, 23 bp, Mus musculus
tctgtatcaatagtgaatccatt

SEQ ID NO: 184097 - DNA, 21 bp, Mus musculus
acctatgtagattggtttgtt

SEQ ID NO: 184098 - DNA, 23 bp, Mus musculus
attgttgttccaaggcagatcta

SEQ ID NO: 184099 - DNA, 23 bp, Mus musculus
tgagagcagcctcacagcctctg

SEQ ID NO: 184100 - DNA, 23 bp, Mus musculus
tgtctgagtctgtgtctgacctg

SEQ ID NO: 184101 - DNA, 23 bp, Mus musculus
aatgtgggtgaggttgtgatgac

SEQ ID NO: 184102 - DNA, 20 bp, Mus musculus
ctcacagtgtgtcagaccag

SEQ ID NO: 184103 - DNA, 22 bp, Mus musculus
ttaagagcactgactggtctta

SEQ ID NO: 184104 - DNA, 23 bp, Mus musculus
tctccctctctctgccaagagga

SEQ ID NO: 184105 - DNA, 19 bp, Mus musculus
caggtggcagtgagaagtt

SEQ ID NO: 184106 - DNA, 21 bp, Mus musculus
ttaaaacaccatcgtgtggtg

SEQ ID NO: 184107 - DNA, 23 bp, Mus musculus
ctggcctcagtctctctgtctct

SEQ ID NO: 184108 - DNA, 23 bp, Mus musculus
ccacactctcactctcactcaca

SEQ ID NO: 184109 - DNA, 22 bp, Mus musculus
tgaaagaacagtcagtgctctt

SEQ ID NO: 184110 - DNA, 20 bp, Mus musculus
actctggctctgacagtcac

SEQ ID NO: 184111 - DNA, 23 bp, Mus musculus
tctctgaccctctgtggcagtct

SEQ ID NO: 184112 - DNA, 21 bp, Mus musculus
tgtctgtatgtctgtacacac

SEQ ID NO: 184113 - DNA, 23 bp, Mus musculus
tgactcagtgctatgttgtctgg

SEQ ID NO: 184114 - DNA, 21 bp, Mus musculus
atctgagaagagtgtgaggac

SEQ ID NO: 184115 - DNA, 19 bp, Mus musculus
aaagagcatgaggttatga

SEQ ID NO: 184116 - DNA, 23 bp, Mus musculus
tcactgtttctgtctacagtgta

SEQ ID NO: 184117 - DNA, 18 bp, Mus musculus
ctgcctccgtgtttgcca

SEQ ID NO: 184118 - DNA, 23 bp, Mus musculus
tatgtatgtatgatataatatgt

SEQ ID NO: 184119 - DNA, 23 bp, Mus musculus
ctgactgctcttccagaggtcct

SEQ ID NO: 184120 - DNA, 19 bp, Mus musculus
ttgctcagtggttaggaga

SEQ ID NO: 184121 - DNA, 21 bp, Mus musculus
ttagcaagcagttgtccgtgc

SEQ ID NO: 184122 - DNA, 23 bp, Mus musculus
actgtctgtgcgtgacagtctgc

SEQ ID NO: 184123 - DNA, 21 bp, Mus musculus
tgagcaccatgagcaccgtga

SEQ ID NO: 184124 - DNA, 23 bp, Mus musculus
accatgagcaccatgagcaccgt

SEQ ID NO: 184125 - DNA, 23 bp, Mus musculus
atatatgtatatgtacgtgtata

SEQ ID NO: 184126 - DNA, 18 bp, Mus musculus
tagacatatatatgtaca

SEQ ID NO: 184127 - DNA, 22 bp, Mus musculus
tgttttgtgaccaattatatgg

SEQ ID NO: 184128 - DNA, 18 bp, Mus musculus
tagcatgtatatatgtat

SEQ ID NO: 184129 - DNA, 22 bp, Mus musculus
agagagtgtgtagggagagacc

SEQ ID NO: 184130 - DNA, 21 bp, Mus musculus
agttatttctgattggtgaat

SEQ ID NO: 184131 - DNA, 22 bp, Mus musculus
tgttttgtgaccaattatatgg

SEQ ID NO: 184132 - DNA, 21 bp, Mus musculus
atgtgtgtgtgtgtgtataca

SEQ ID NO: 184133 - DNA, 23 bp, Mus musculus
tgcatctgtgtctgtctgctact

SEQ ID NO: 184134 - DNA, 22 bp, Mus musculus
gtgtctactgagagtccacact

SEQ ID NO: 184135 - DNA, 21 bp, Mus musculus
ggactctcagtaaggttttgc

SEQ ID NO: 184136 - DNA, 23 bp, Mus musculus
ttgtagctaatcttgctgtacct

SEQ ID NO: 184137 - DNA, 23 bp, Mus musculus
ttgtaagtataacagtaagttgt

SEQ ID NO: 184138 - DNA, 23 bp, Mus musculus
gtaaacatgtttgtatatgaaca

SEQ ID NO: 184139 - DNA, 23 bp, Mus musculus
tactctctgtgtcctttggctgt

SEQ ID NO: 184140 - DNA, 22 bp, Mus musculus
tattggtaggtatggttaggta

SEQ ID NO: 184141 - DNA, 22 bp, Mus musculus
tattcagagcaagccattgctg

SEQ ID NO: 184142 - DNA, 23 bp, Mus musculus
atagcgtttagaaacatttctgt

SEQ ID NO: 184143 - DNA, 23 bp, Mus musculus
tcagtctgagatcggtttcagat

SEQ ID NO: 184144 - DNA, 22 bp, Mus musculus
tgttttgtgaccaattatatgg

SEQ ID NO: 184145 - DNA, 18 bp, Mus musculus
caggactagggagactga

SEQ ID NO: 184146 - DNA, 22 bp, Mus musculus
tctgtgtctctgtgtgtatgta

SEQ ID NO: 184147 - DNA, 23 bp, Mus musculus
cgtctctgtctgagtctctggga

SEQ ID NO: 184148 - DNA, 18 bp, Mus musculus
tgtgtgtatatatgtgtg

SEQ ID NO: 184149 - DNA, 23 bp, Mus musculus
tgtgtgtgtgtgtgtgtgtcata

SEQ ID NO: 184150 - DNA, 23 bp, Mus musculus
tcactgattttagtgggattgct

SEQ ID NO: 184151 - DNA, 23 bp, Mus musculus
tctcactagttactttgatgttg

SEQ ID NO: 184152 - DNA, 23 bp, Mus musculus
tctccctgtctctgagccagtgt

SEQ ID NO: 184153 - DNA, 21 bp, Mus musculus
tatatatgcatgtgtgtgcag

SEQ ID NO: 184154 - DNA, 23 bp, Mus musculus
tatgtatatatgtatgtatatat

SEQ ID NO: 184155 - DNA, 22 bp, Mus musculus
tgttttgtgaccaattatatgg

SEQ ID NO: 184156 - DNA, 22 bp, Mus musculus
tgttttgtgaccaattatatgg

SEQ ID NO: 184157 - DNA, 23 bp, Mus musculus
gtctctgactgctatgtgtgcac

SEQ ID NO: 184158 - DNA, 23 bp, Mus musculus
ctgtttttgatgaatgttgtata

SEQ ID NO: 184159 - DNA, 21 bp, Mus musculus
ttcatgtaaaattgaatatca

SEQ ID NO: 184160 - DNA, 23 bp, Mus musculus
tgttagagcacctggaactggta

SEQ ID NO: 184161 - DNA, 20 bp, Mus musculus
tcttctagccttttcctatc

SEQ ID NO: 184162 - DNA, 23 bp, Mus musculus
tgtatgtattacatatgcgtatg

SEQ ID NO: 184163 - DNA, 23 bp, Mus musculus
tagtccatggtgatctgatagga

SEQ ID NO: 184164 - DNA, 21 bp, Mus musculus
aagagtctccaagctccatcc

SEQ ID NO: 184165 - DNA, 21 bp, Mus musculus
tctgtttcagtcagctattgt

SEQ ID NO: 184166 - DNA, 23 bp, Mus musculus
atttttgtgaatttcttcttgtc

SEQ ID NO: 184167 - DNA, 20 bp, Mus musculus
tatatgcatatctatatcta

SEQ ID NO: 184168 - DNA, 19 bp, Mus musculus
tcagaggaggtttatgcta

SEQ ID NO: 184169 - DNA, 23 bp, Mus musculus
tggtggcatcggagtatgtgcat

SEQ ID NO: 184170 - DNA, 22 bp, Mus musculus
ttaagatggcacagtcactagt

SEQ ID NO: 184171 - DNA, 22 bp, Mus musculus
tgttttgtgaccaattatatgg

SEQ ID NO: 184172 - DNA, 23 bp, Mus musculus
tgtgtatgtgcatgtgtatgtat

SEQ ID NO: 184173 - DNA, 23 bp, Mus musculus
gatgtatatgtatgtgtatgtgt

SEQ ID NO: 184174 - DNA, 23 bp, Mus musculus
tggatgtgtcacaaaatttagtc

SEQ ID NO: 184175 - DNA, 22 bp, Mus musculus
atgtctggttatgattagttgt

SEQ ID NO: 184176 - DNA, 23 bp, Mus musculus
agtttacttcttatggatttcat

SEQ ID NO: 184177 - DNA, 18 bp, Mus musculus
gacaacttcttcatcttg

SEQ ID NO: 184178 - DNA, 23 bp, Mus musculus
aacagttgagagtgtgcagttac

SEQ ID NO: 184179 - DNA, 22 bp, Mus musculus
tgttttgtgaccaattatatgg

SEQ ID NO: 184180 - DNA, 23 bp, Mus musculus
tatgtgtgtgtacatatgtgtgt

SEQ ID NO: 184181 - DNA, 23 bp, Mus musculus
gtcttctaggaacagtgtcaagt

SEQ ID NO: 184182 - DNA, 23 bp, Mus musculus
aatgtggatgcttatggttagat

SEQ ID NO: 184183 - DNA, 21 bp, Mus musculus
actgtgtctggaatggatccc

SEQ ID NO: 184184 - DNA, 22 bp, Mus musculus
tccatggtcatctgataggatg

SEQ ID NO: 184185 - DNA, 20 bp, Mus musculus
ttttgtgactaagtatatgg

SEQ ID NO: 184186 - DNA, 19 bp, Mus musculus
tatgtgtatgtatatatgt

SEQ ID NO: 184187 - DNA, 19 bp, Mus musculus
cagaaaagagtgacaacac

SEQ ID NO: 184188 - DNA, 23 bp, Mus musculus
atgaatgtatgcatgtgagtgtg

SEQ ID NO: 184189 - DNA, 22 bp, Mus musculus
attgtggaaagccattggaagt

SEQ ID NO: 184190 - DNA, 22 bp, Mus musculus
attgtggaaagccattggaagt

SEQ ID NO: 184191 - DNA, 23 bp, Mus musculus
tagtgcatggtgatctgatagga

SEQ ID NO: 184192 - DNA, 22 bp, Mus musculus
tgttttgtgaccaattatatgg

SEQ ID NO: 184193 - DNA, 22 bp, Mus musculus
tgttttgtgaccaattatatgg

SEQ ID NO: 184194 - DNA, 23 bp, Mus musculus
tgtagtacagcttgaattcaggg

SEQ ID NO: 184195 - DNA, 22 bp, Mus musculus
tgttttgtgaccaattatatgg

SEQ ID NO: 184196 - DNA, 23 bp, Mus musculus
ttcatgataggatcatatgtgtt

SEQ ID NO: 184197 - DNA, 23 bp, Mus musculus
ttgatctcagctattcagatagg

SEQ ID NO: 184198 - DNA, 22 bp, Mus musculus
tgcatgcatgtgtacgtgtatg

SEQ ID NO: 184199 - DNA, 18 bp, Mus musculus
ggagatcagtttgcctgc

SEQ ID NO: 184200 - DNA, 23 bp, Mus musculus
tgagtgtctgcctgtctgtctgc

SEQ ID NO: 184201 - DNA, 21 bp, Mus musculus
actgagtagagagacagcagt

SEQ ID NO: 184202 - DNA, 18 bp, Mus musculus
taccatgtactccctgcc

SEQ ID NO: 184203 - DNA, 23 bp, Mus musculus
gagtccactgaacactgtgacta

SEQ ID NO: 184204 - DNA, 22 bp, Mus musculus
tttgagtctagtgtgagagctc

SEQ ID NO: 184205 - DNA, 20 bp, Mus musculus
tctcacatagactcaatcgt

SEQ ID NO: 184206 - DNA, 18 bp, Mus musculus
tatgagtgatttcttagc

SEQ ID NO: 184207 - DNA, 20 bp, Mus musculus
tgactctctaacactgtctt

SEQ ID NO: 184208 - DNA, 23 bp, Mus musculus
ataactctgcttagggttctgat

SEQ ID NO: 184209 - DNA, 21 bp, Mus musculus
tgtcacaggccaaagcaacac

SEQ ID NO: 184210 - DNA, 22 bp, Mus musculus
tgttttgtgaccaattatatgg

SEQ ID NO: 184211 - DNA, 23 bp, Mus musculus
tagtgtatagtttgctttgcttt

SEQ ID NO: 184212 - DNA, 23 bp, Mus musculus
tctgaatgtatatgtatatatgt

SEQ ID NO: 184213 - DNA, 23 bp, Mus musculus
ctctcagtctcagagctgattag

SEQ ID NO: 184214 - DNA, 18 bp, Mus musculus
tgtgagtctctgtattag

SEQ ID NO: 184215 - DNA, 22 bp, Mus musculus
tcaggtagaatgttgattagca

SEQ ID NO: 184216 - DNA, 22 bp, Mus musculus
actgtgtggctcacttgtgtgt

SEQ ID NO: 184217 - DNA, 21 bp, Mus musculus
tggctcagtggttaagaggag

SEQ ID NO: 184218 - DNA, 18 bp, Mus musculus
tcagacttgggaggcaga

SEQ ID NO: 184219 - DNA, 22 bp, Mus musculus
tatatagttcaaggccagcttg

SEQ ID NO: 184220 - DNA, 23 bp, Mus musculus
gtggatgtatgtatgtatgtatg

SEQ ID NO: 184221 - DNA, 23 bp, Mus musculus
tgcgcgtgtgtgcgtgtgtatgt

SEQ ID NO: 184222 - DNA, 22 bp, Mus musculus
tctatgactgtcaggtgttgtc

SEQ ID NO: 184223 - DNA, 22 bp, Mus musculus
gcatctatatgtgtgtggaatc

SEQ ID NO: 184224 - DNA, 18 bp, Mus musculus
gtatgtatgtatgtatgt

SEQ ID NO: 184225 - DNA, 23 bp, Mus musculus
aacagttgattaaactgatagga

SEQ ID NO: 184226 - DNA, 23 bp, Mus musculus
atgagtgaagttacagtgctgaa

SEQ ID NO: 184227 - DNA, 23 bp, Mus musculus
gtgtgtgtgtgtgtatgtgcatg

SEQ ID NO: 184228 - DNA, 23 bp, Mus musculus
catctgtatttttctatttgtat

SEQ ID NO: 184229 - DNA, 23 bp, Mus musculus
tgtgtggagagagtgagcagtga

SEQ ID NO: 184230 - DNA, 23 bp, Mus musculus
tgtgtatacatgtacaaatgtgt

SEQ ID NO: 184231 - DNA, 23 bp, Mus musculus
aaatgtgtatatgtatatatgtg

SEQ ID NO: 184232 - DNA, 23 bp, Mus musculus
atacatttactacatatactatg

SEQ ID NO: 184233 - DNA, 23 bp, Mus musculus
tatatgtactatgtatatactgt

SEQ ID NO: 184234 - DNA, 23 bp, Mus musculus
ctctctgacacactggagacagg

SEQ ID NO: 184235 - DNA, 22 bp, Mus musculus
tcagttgctgcacaggtggtga

SEQ ID NO: 184236 - DNA, 21 bp, Mus musculus
tccatggtggtctgataggat

SEQ ID NO: 184237 - DNA, 22 bp, Mus musculus
tgttttgtgaccaattatatgg

SEQ ID NO: 184238 - DNA, 18 bp, Mus musculus
gaagagtctgagcactgt

SEQ ID NO: 184239 - DNA, 23 bp, Mus musculus
acacatgtgtgtatgtatatgtg

SEQ ID NO: 184240 - DNA, 19 bp, Mus musculus
tatgcatgtttctgagtct

SEQ ID NO: 184241 - DNA, 19 bp, Mus musculus
aggttgatgtgtgtgtagt

SEQ ID NO: 184242 - DNA, 22 bp, Mus musculus
attgtgatgtgtatagagtgtg

SEQ ID NO: 184243 - DNA, 23 bp, Mus musculus
tgtatgtgcatgtacatgtgtat

SEQ ID NO: 184244 - DNA, 22 bp, Mus musculus
tttctcagtctggcttctttct

SEQ ID NO: 184245 - DNA, 18 bp, Mus musculus
cctgctgctcctgctctg

SEQ ID NO: 184246 - DNA, 18 bp, Mus musculus
tgtcagatgaaagtgagg

SEQ ID NO: 184247 - DNA, 23 bp, Mus musculus
gagggcagactctgaggtttcaa

SEQ ID NO: 184248 - DNA, 20 bp, Mus musculus
ccagagtctcactctctgcc

SEQ ID NO: 184249 - DNA, 23 bp, Mus musculus
tgctttagatttcaaagtcattg

SEQ ID NO: 184250 - DNA, 23 bp, Mus musculus
tatgtatgtgcatgtgcatgtgt

SEQ ID NO: 184251 - DNA, 22 bp, Mus musculus
tgttttgtgaccaattatatgg

SEQ ID NO: 184252 - DNA, 19 bp, Mus musculus
tgaagtcattggcacagga

SEQ ID NO: 184253 - DNA, 23 bp, Mus musculus
ttatgtgtgtgtgtgtgtctgtg

SEQ ID NO: 184254 - DNA, 23 bp, Mus musculus
cttgagtgtctctcactggctgt

SEQ ID NO: 184255 - DNA, 23 bp, Mus musculus
tgtctgtctctgacaccaactct

SEQ ID NO: 184256 - DNA, 23 bp, Mus musculus
atccagtggtcatggtgcaggct

SEQ ID NO: 184257 - DNA, 23 bp, Mus musculus
tcacatgtgtgtgagcacacgtg

SEQ ID NO: 184258 - DNA, 23 bp, Mus musculus
acagaagtgtctgaggtgtgcat

SEQ ID NO: 184259 - DNA, 23 bp, Mus musculus
tatagcacaaatgtaatgagaga

SEQ ID NO: 184260 - DNA, 20 bp, Mus musculus
tttacttttcaagctaccgg

SEQ ID NO: 184261 - DNA, 18 bp, Mus musculus
aatgacacagagacttat

SEQ ID NO: 184262 - DNA, 23 bp, Mus musculus
gactcattgactgactagcctag

SEQ ID NO: 184263 - DNA, 23 bp, Mus musculus
tcaggtcacagtgactgagtctg

SEQ ID NO: 184264 - DNA, 22 bp, Mus musculus
gaatttgatcctgggataggag

SEQ ID NO: 184265 - DNA, 23 bp, Mus musculus
tgtgtgtgtgtctgtgcatctgt

SEQ ID NO: 184266 - DNA, 23 bp, Mus musculus
tctgtctctgtgtgggtatgaac

SEQ ID NO: 184267 - DNA, 23 bp, Mus musculus
gtgacagtgtcaaaagtgagtca

SEQ ID NO: 184268 - DNA, 23 bp, Mus musculus
acacggacacacaatctgcataa

SEQ ID NO: 184269 - DNA, 23 bp, Mus musculus
tcacagggaccttttctcttcta

SEQ ID NO: 184270 - DNA, 23 bp, Mus musculus
aggtagagaagagattagttttg

SEQ ID NO: 184271 - DNA, 18 bp, Mus musculus
attgaggctgagagttat

SEQ ID NO: 184272 - DNA, 20 bp, Mus musculus
atgtatgtgtggaggtgcat

SEQ ID NO: 184273 - DNA, 23 bp, Mus musculus
ttagatgttctagcagtctctgg

SEQ ID NO: 184274 - DNA, 20 bp, Mus musculus
atgcaaggacaagcagggct

SEQ ID NO: 184275 - DNA, 21 bp, Mus musculus
tctacttgtctgtctctatat

SEQ ID NO: 184276 - DNA, 22 bp, Mus musculus
gataactttgtagaatctgggt

SEQ ID NO: 184277 - DNA, 23 bp, Mus musculus
tagtccatggtgatctgatagga

SEQ ID NO: 184278 - DNA, 23 bp, Mus musculus
tgtgactctctgtatgtgtggag

SEQ ID NO: 184279 - DNA, 22 bp, Mus musculus
atatacactatgaagttgtaca

SEQ ID NO: 184280 - DNA, 23 bp, Mus musculus
acagagagagaaaagagtgatgt

SEQ ID NO: 184281 - DNA, 23 bp, Mus musculus
agtgagaagagtgagatagtggt

SEQ ID NO: 184282 - DNA, 23 bp, Mus musculus
acagagtcaggttagttccagcc

SEQ ID NO: 184283 - DNA, 23 bp, Mus musculus
gatgtgtcgctccctgattggct

SEQ ID NO: 184284 - DNA, 23 bp, Mus musculus
ttgcacatgtgacaccctgggtt

SEQ ID NO: 184285 - DNA, 22 bp, Mus musculus
tgtcctactctctcactccctg

SEQ ID NO: 184286 - DNA, 21 bp, Mus musculus
tccgtggtgatctgatagaat

SEQ ID NO: 184287 - DNA, 23 bp, Mus musculus
ttcttctaggcatttcaacttgt

SEQ ID NO: 184288 - DNA, 21 bp, Mus musculus
tgaaatctagttagtttcagg

SEQ ID NO: 184289 - DNA, 23 bp, Mus musculus
atgtcttgtgtttttctacatgt

SEQ ID NO: 184290 - DNA, 22 bp, Mus musculus
tgttttgtgaccaattatatgg

SEQ ID NO: 184291 - DNA, 23 bp, Mus musculus
gagaaagagtggatacttgtcag

SEQ ID NO: 184292 - DNA, 23 bp, Mus musculus
tatatgtatatgtatatgtgtat

SEQ ID NO: 184293 - DNA, 21 bp, Mus musculus
atatacatacatatacaatgt

SEQ ID NO: 184294 - DNA, 23 bp, Mus musculus
tacatgtgtttatgtatatgtat

SEQ ID NO: 184295 - DNA, 19 bp, Mus musculus
aatgtgtatatatacatat

SEQ ID NO: 184296 - DNA, 23 bp, Mus musculus
atatgcatatatatactatgttt

SEQ ID NO: 184297 - DNA, 23 bp, Mus musculus
atataaggatgtattatatatgt

SEQ ID NO: 184298 - DNA, 23 bp, Mus musculus
ttcactgtggtagtgttgtgtag

SEQ ID NO: 184299 - DNA, 21 bp, Mus musculus
tgcctgcgtggctctttccct

SEQ ID NO: 184300 - DNA, 23 bp, Mus musculus
catcggcgtctctgtatctctgt

SEQ ID NO: 184301 - DNA, 23 bp, Mus musculus
cagggttgagggtgtggctcagt

SEQ ID NO: 184302 - DNA, 23 bp, Mus musculus
tctgtcagactctgtctttggca

SEQ ID NO: 184303 - DNA, 19 bp, Mus musculus
tctattctgtcttagctga

SEQ ID NO: 184304 - DNA, 23 bp, Mus musculus
ttcagagtagattgagaggtcag

SEQ ID NO: 184305 - DNA, 19 bp, Mus musculus
tctgtctctctgattcagc

SEQ ID NO: 184306 - DNA, 23 bp, Mus musculus
tcaggctctcagacactcaggca

SEQ ID NO: 184307 - DNA, 23 bp, Mus musculus
cacagcttaacagagtgagcact

SEQ ID NO: 184308 - DNA, 23 bp, Mus musculus
tgactcagcacagaggctcttaa

SEQ ID NO: 184309 - DNA, 20 bp, Mus musculus
ttgtgacccctttggcagtc

SEQ ID NO: 184310 - DNA, 23 bp, Mus musculus
taagtcatatgtaaagatgtaac

SEQ ID NO: 184311 - DNA, 23 bp, Mus musculus
agtttttgtctggatgacctgtc

SEQ ID NO: 184312 - DNA, 18 bp, Mus musculus
tatgggatttaagctgta

SEQ ID NO: 184313 - DNA, 23 bp, Mus musculus
ttctctctgtatctgtctgtctg

SEQ ID NO: 184314 - DNA, 22 bp, Mus musculus
tgttttgtgaccaattatatgg

SEQ ID NO: 184315 - DNA, 22 bp, Mus musculus
tgttttgtgaccaattatatgg

SEQ ID NO: 184316 - DNA, 22 bp, Mus musculus
ttgagagaagaaagggagctca

SEQ ID NO: 184317 - DNA, 22 bp, Mus musculus
tgttctcattctctcagcttcc

SEQ ID NO: 184318 - DNA, 23 bp, Mus musculus
tgacttcagtctgtctcagttat

SEQ ID NO: 184319 - DNA, 22 bp, Mus musculus
caatggatttctagcagtaata

SEQ ID NO: 184320 - DNA, 20 bp, Mus musculus
tctgtcagtttctctctctt

SEQ ID NO: 184321 - DNA, 20 bp, Mus musculus
acacagtagagggtgagcag

SEQ ID NO: 184322 - DNA, 19 bp, Mus musculus
agtgctagggctatgggtc

SEQ ID NO: 184323 - DNA, 23 bp, Mus musculus
acatgactgtgtctgtctgtgtg

SEQ ID NO: 184324 - DNA, 23 bp, Mus musculus
tgtgtcactgggtctctgcattt

SEQ ID NO: 184325 - DNA, 23 bp, Mus musculus
caaagagaagtgggtccaggcta

SEQ ID NO: 184326 - DNA, 21 bp, Mus musculus
taaaggttctacaatctccta

SEQ ID NO: 184327 - DNA, 23 bp, Mus musculus
cactctctcactgagtttgttga

SEQ ID NO: 184328 - DNA, 22 bp, Mus musculus
tgttttgtgaccaattatatgg

SEQ ID NO: 184329 - DNA, 23 bp, Mus musculus
atggcttttatttgctctatggt

SEQ ID NO: 184330 - DNA, 23 bp, Mus musculus
aaatagagacaggataacatggt

SEQ ID NO: 184331 - DNA, 23 bp, Mus musculus
tcatgaagatcacttgttttaga

SEQ ID NO: 184332 - DNA, 22 bp, Mus musculus
tgttttgtgaccaattatatgg

SEQ ID NO: 184333 - DNA, 20 bp, Mus musculus
tgttttgtgacctattatgt

SEQ ID NO: 184334 - DNA, 23 bp, Mus musculus
tgtgcgtctgtctgtcaatttaa

SEQ ID NO: 184335 - DNA, 21 bp, Mus musculus
tccatggtggtctgataggat

SEQ ID NO: 184336 - DNA, 23 bp, Mus musculus
acacacacgtctgtactgtagct

SEQ ID NO: 184337 - DNA, 21 bp, Mus musculus
tagacagaagtgactgaggtg

SEQ ID NO: 184338 - DNA, 19 bp, Mus musculus
aagagcactgactgctctt

SEQ ID NO: 184339 - DNA, 23 bp, Mus musculus
gccacttcagtctctgtgagccc

SEQ ID NO: 184340 - DNA, 23 bp, Mus musculus
atttgtgggtgctttgcctgtgt

SEQ ID NO: 184341 - DNA, 23 bp, Mus musculus
ccttctagctgtgcatcaaccaa

SEQ ID NO: 184342 - DNA, 23 bp, Mus musculus
tgtctgtctgtcttgtatagtgg

SEQ ID NO: 184343 - DNA, 23 bp, Mus musculus
caatatttttgtatctgttgagg

SEQ ID NO: 184344 - DNA, 23 bp, Mus musculus
tgtgcatttgtatgcatatgtgt

SEQ ID NO: 184345 - DNA, 20 bp, Mus musculus
atttgcgtgtgtatgtgtgt

SEQ ID NO: 184346 - DNA, 22 bp, Mus musculus
tgttttgtgaccaattatatgg

SEQ ID NO: 184347 - DNA, 23 bp, Mus musculus
tgtgtgagtgcatgagcatatgc

SEQ ID NO: 184348 - DNA, 20 bp, Mus musculus
tctgcatgtgcatgtacatg

SEQ ID NO: 184349 - DNA, 23 bp, Mus musculus
atgtaaatgtgcatgtacatttg

SEQ ID NO: 184350 - DNA, 21 bp, Mus musculus
agaacaaaaagaacacggagt

SEQ ID NO: 184351 - DNA, 23 bp, Mus musculus
ttcactgagcattatatatctct

SEQ ID NO: 184352 - DNA, 21 bp, Mus musculus
tttttcagaatacatggtagc

SEQ ID NO: 184353 - DNA, 20 bp, Mus musculus
tctgtctgtctatgtaccta

SEQ ID NO: 184354 - DNA, 23 bp, Mus musculus
gtaagaacacaggcagctcagga

SEQ ID NO: 184355 - DNA, 22 bp, Mus musculus
tcttccccactgttacttctgt

SEQ ID NO: 184356 - DNA, 23 bp, Mus musculus
ttaaatccactttctctttcacg

SEQ ID NO: 184357 - DNA, 20 bp, Mus musculus
agttagtagtaaccgttttc

SEQ ID NO: 184358 - DNA, 23 bp, Mus musculus
tctgagcctcagacgctctctgt

SEQ ID NO: 184359 - DNA, 21 bp, Mus musculus
atagtgtatataaatgtatgt

SEQ ID NO: 184360 - DNA, 22 bp, Mus musculus
aatgtctcattgtaaatgtgat

SEQ ID NO: 184361 - DNA, 19 bp, Mus musculus
atgtgtccaatttgtgcag

SEQ ID NO: 184362 - DNA, 21 bp, Mus musculus
gaaggatttgatggcgatatc

SEQ ID NO: 184363 - DNA, 19 bp, Mus musculus
tgtgtctctggatttgttc

SEQ ID NO: 184364 - DNA, 23 bp, Mus musculus
tagtccatggtgatctgatagga

SEQ ID NO: 184365 - DNA, 23 bp, Mus musculus
tgtgtcgctgtctctctcttcac

SEQ ID NO: 184366 - DNA, 23 bp, Mus musculus
gagcatcagaaatgacagtccag

SEQ ID NO: 184367 - DNA, 23 bp, Mus musculus
gatatgttgtcactgtgtgtcat

SEQ ID NO: 184368 - DNA, 18 bp, Mus musculus
agagcttagagtacagct

SEQ ID NO: 184369 - DNA, 21 bp, Mus musculus
agagtgacaggagagtctgtg

SEQ ID NO: 184370 - DNA, 23 bp, Mus musculus
aaagtctgtctgactgtctgtgg

SEQ ID NO: 184371 - DNA, 23 bp, Mus musculus
tgtgtgtgcaagtgcatgtgtac

SEQ ID NO: 184372 - DNA, 23 bp, Mus musculus
gattgtctcattgtctctctgga

SEQ ID NO: 184373 - DNA, 20 bp, Mus musculus
agagcactggggctggagag

SEQ ID NO: 184374 - DNA, 23 bp, Mus musculus
tgtgtctgtcagagtggaagagc

SEQ ID NO: 184375 - DNA, 22 bp, Mus musculus
gaaagtggaagagttatgtaga

SEQ ID NO: 184376 - DNA, 23 bp, Mus musculus
cactccaatctatctctatctgt

SEQ ID NO: 184377 - DNA, 23 bp, Mus musculus
cctttctctggtaacttctcagg

SEQ ID NO: 184378 - DNA, 23 bp, Mus musculus
cactgctgtcagtctctgtgtgt

SEQ ID NO: 184379 - DNA, 23 bp, Mus musculus
gtacacacacaaaaacgtattgt

SEQ ID NO: 184380 - DNA, 20 bp, Mus musculus
atcagtacctcatagaaaag

SEQ ID NO: 184381 - DNA, 23 bp, Mus musculus
tatgtatgtatgtatgtatgtat

SEQ ID NO: 184382 - DNA, 18 bp, Mus musculus
acaggctgtggtagaggg

SEQ ID NO: 184383 - DNA, 18 bp, Mus musculus
tcactgaatgtctgtcag

SEQ ID NO: 184384 - DNA, 23 bp, Mus musculus
aagctgtagctcacttcatgagg

SEQ ID NO: 184385 - DNA, 19 bp, Mus musculus
ctctcactgtctctggccc

SEQ ID NO: 184386 - DNA, 18 bp, Mus musculus
tcagaacatcctggagac

SEQ ID NO: 184387 - DNA, 23 bp, Mus musculus
gtgtgtgtgtgtatgtatgtatg

SEQ ID NO: 184388 - DNA, 18 bp, Mus musculus
atacatacatatggttag

SEQ ID NO: 184389 - DNA, 18 bp, Mus musculus
tttgtctctgtaacttct

SEQ ID NO: 184390 - DNA, 23 bp, Mus musculus
tttctcagtccaatagttggctg

SEQ ID NO: 184391 - DNA, 23 bp, Mus musculus
tgcagactgaagtcagacaggtg

SEQ ID NO: 184392 - DNA, 23 bp, Mus musculus
acacttctggattagatgatctg

SEQ ID NO: 184393 - DNA, 21 bp, Mus musculus
tatatgcaggcttattatatg

SEQ ID NO: 184394 - DNA, 23 bp, Mus musculus
gttggtgctttgtaattctatgt

SEQ ID NO: 184395 - DNA, 23 bp, Mus musculus
taaaggagaattctgaagcagcc

SEQ ID NO: 184396 - DNA, 23 bp, Mus musculus
ctcctgattcagtctgtcagtgt

SEQ ID NO: 184397 - DNA, 23 bp, Mus musculus
gtaagatatgagagtgtgactta

SEQ ID NO: 184398 - DNA, 23 bp, Mus musculus
agttgtctgcacatggactcagt

SEQ ID NO: 184399 - DNA, 22 bp, Mus musculus
cagtgaattgatcagtgagtag

SEQ ID NO: 184400 - DNA, 22 bp, Mus musculus
ccctcacaacactttctgatgt

SEQ ID NO: 184401 - DNA, 22 bp, Mus musculus
tacatgtatatatgtatatgtg

SEQ ID NO: 184402 - DNA, 22 bp, Mus musculus
tgttttgtgaccaattatatgg

SEQ ID NO: 184403 - DNA, 20 bp, Mus musculus
taattgctcatgtgacagtt

SEQ ID NO: 184404 - DNA, 21 bp, Mus musculus
aatgagattggtcatagaaaa

SEQ ID NO: 184405 - DNA, 18 bp, Mus musculus
acacacacacatatatat

SEQ ID NO: 184406 - DNA, 22 bp, Mus musculus
gtatagatatgtttatatatgt

SEQ ID NO: 184407 - DNA, 23 bp, Mus musculus
tgtatatgtatgtatatatgtat

SEQ ID NO: 184408 - DNA, 20 bp, Mus musculus
cacattatatctctatccat

SEQ ID NO: 184409 - DNA, 20 bp, Mus musculus
atatatgtgtgcatttgtag

SEQ ID NO: 184410 - DNA, 20 bp, Mus musculus
taacagatctgacagaggag

SEQ ID NO: 184411 - DNA, 22 bp, Mus musculus
tgttttgtgaccaattatatgg

SEQ ID NO: 184412 - DNA, 23 bp, Mus musculus
gtctgtctgtctgtctgtctgtc

SEQ ID NO: 184413 - DNA, 23 bp, Mus musculus
atatgtttctatatatatgtgtg

SEQ ID NO: 184414 - DNA, 23 bp, Mus musculus
acctgtcatattgttttggatgc

SEQ ID NO: 184415 - DNA, 23 bp, Mus musculus
aatatttcttttccattggatag

SEQ ID NO: 184416 - DNA, 23 bp, Mus musculus
atgtttatgtgcatgtccatgtg

SEQ ID NO: 184417 - DNA, 21 bp, Mus musculus
tatggtaaagtttgtgactgt

SEQ ID NO: 184418 - DNA, 23 bp, Mus musculus
gtttactgactacacagtcacca

SEQ ID NO: 184419 - DNA, 22 bp, Mus musculus
tgttttgtgaccaattatatgg

SEQ ID NO: 184420 - DNA, 21 bp, Mus musculus
atgtgtgtgtgcatgtgtatg

SEQ ID NO: 184421 - DNA, 23 bp, Mus musculus
gattgatgtccatttctgaagat

SEQ ID NO: 184422 - DNA, 22 bp, Mus musculus
tgttttgtgaccaattatatgg

SEQ ID NO: 184423 - DNA, 22 bp, Mus musculus
tgttttgtgaccaattatatgg

SEQ ID NO: 184424 - DNA, 23 bp, Mus musculus
gtgagtctgtaagtctctgtcag

SEQ ID NO: 184425 - DNA, 20 bp, Mus musculus
aactgatggaaaataaaggt

SEQ ID NO: 184426 - DNA, 20 bp, Mus musculus
atgggatggattgaggcttg

SEQ ID NO: 184427 - DNA, 22 bp, Mus musculus
tgagagactctgtctgtgcctg

SEQ ID NO: 184428 - DNA, 21 bp, Mus musculus
tccatggtggtctgataggat

SEQ ID NO: 184429 - DNA, 22 bp, Mus musculus
tgttttgtgaccaattatatgg

SEQ ID NO: 184430 - DNA, 23 bp, Mus musculus
tgtctacagtgttagttattagg

SEQ ID NO: 184431 - DNA, 23 bp, Mus musculus
tcaacaggctaaagagtgtcctt

SEQ ID NO: 184432 - DNA, 22 bp, Mus musculus
tggagcagattctgatttctga

SEQ ID NO: 184433 - DNA, 18 bp, Mus musculus
atgtatatgtattcatat

SEQ ID NO: 184434 - DNA, 20 bp, Mus musculus
tggaacctactatggtcctt

SEQ ID NO: 184435 - DNA, 21 bp, Mus musculus
tatatgtatgtatgtttacaa

SEQ ID NO: 184436 - DNA, 21 bp, Mus musculus
tgtgcatatatatatatatgt

SEQ ID NO: 184437 - DNA, 22 bp, Mus musculus
atatgtgtttatgtattgtgta

SEQ ID NO: 184438 - DNA, 22 bp, Mus musculus
ctctctctgtcactgcagttag

SEQ ID NO: 184439 - DNA, 19 bp, Mus musculus
tgtcaccatcagtgcatgg

SEQ ID NO: 184440 - DNA, 21 bp, Mus musculus
tgtgtcgctccctgattggct

SEQ ID NO: 184441 - DNA, 23 bp, Mus musculus
cagtgaccttggaggttgtatag

SEQ ID NO: 184442 - DNA, 22 bp, Mus musculus
atttgtgtatatatgtatgtgt

SEQ ID NO: 184443 - DNA, 23 bp, Mus musculus
tctggctctttctgactctggga

SEQ ID NO: 184444 - DNA, 23 bp, Mus musculus
actttcattttcaaggtctatca

SEQ ID NO: 184445 - DNA, 21 bp, Mus musculus
tgaatgaagttcctggaggtt

SEQ ID NO: 184446 - DNA, 23 bp, Mus musculus
taagtctctacttgaataagtga

SEQ ID NO: 184447 - DNA, 22 bp, Mus musculus
tttttaggtttttttctagaac

SEQ ID NO: 184448 - DNA, 21 bp, Mus musculus
atgtgtgtgtgtggtatatct

SEQ ID NO: 184449 - DNA, 20 bp, Mus musculus
taatgcatgtttgtttgtgt

SEQ ID NO: 184450 - DNA, 23 bp, Mus musculus
agaggaagtgcttagtcttactg

SEQ ID NO: 184451 - DNA, 21 bp, Mus musculus
agagtcgtgctctttttctgt

SEQ ID NO: 184452 - DNA, 20 bp, Mus musculus
tcacaatcagtgtgtgtgtg

SEQ ID NO: 184453 - DNA, 23 bp, Mus musculus
tccagtgtgtcactgagacactc

SEQ ID NO: 184454 - DNA, 19 bp, Mus musculus
tgtctgtctgattctgtac

SEQ ID NO: 184455 - DNA, 22 bp, Mus musculus
tgttttgtgaccaattatatgg

SEQ ID NO: 184456 - DNA, 23 bp, Mus musculus
tgtatttatgtatgtatgtgtgt

SEQ ID NO: 184457 - DNA, 23 bp, Mus musculus
tgtatgcatgcatgtatgtgtgt

SEQ ID NO: 184458 - DNA, 23 bp, Mus musculus
tccctatgtctgtctctgtctgt

SEQ ID NO: 184459 - DNA, 21 bp, Mus musculus
tctctccttccatctttatgt

SEQ ID NO: 184460 - DNA, 19 bp, Mus musculus
tacatgtgggcacacgtgt

SEQ ID NO: 184461 - DNA, 23 bp, Mus musculus
tcagccttagttcacggtgatct

SEQ ID NO: 184462 - DNA, 23 bp, Mus musculus
atgaatgtggtagtcaaatggat

SEQ ID NO: 184463 - DNA, 23 bp, Mus musculus
gtgtgtctgtgtgtgcatgtata

SEQ ID NO: 184464 - DNA, 22 bp, Mus musculus
tgttttgtgaccaattatatgg

SEQ ID NO: 184465 - DNA, 22 bp, Mus musculus
tgttttgtgaccaattatatgg

SEQ ID NO: 184466 - DNA, 22 bp, Mus musculus
tgtatgtatgtatatatgtatg

SEQ ID NO: 184467 - DNA, 18 bp, Mus musculus
gtatgtatgtatgtatgt

SEQ ID NO: 184468 - DNA, 23 bp, Mus musculus
gtaataatgtaaatgtgtgtgtg

SEQ ID NO: 184469 - DNA, 21 bp, Mus musculus
atgagcaactaaaagattgta

SEQ ID NO: 184470 - DNA, 18 bp, Mus musculus
ttgaattttgctgtgttt

SEQ ID NO: 184471 - DNA, 22 bp, Mus musculus
ttggttagtagcttgttttgtt

SEQ ID NO: 184472 - DNA, 23 bp, Mus musculus
atgacaggagtgtgcacaaaggt

SEQ ID NO: 184473 - DNA, 21 bp, Mus musculus
aaaacacacacatatatatgt

SEQ ID NO: 184474 - DNA, 22 bp, Mus musculus
tgttttgtgaccaattatatgg

SEQ ID NO: 184475 - DNA, 21 bp, Mus musculus
agactaagagcacaggttgtc

SEQ ID NO: 184476 - DNA, 23 bp, Mus musculus
actccatggtgatctgataggat

SEQ ID NO: 184477 - DNA, 23 bp, Mus musculus
taaccctgttttgttaccgatta

SEQ ID NO: 184478 - DNA, 23 bp, Mus musculus
tgttttgtgaccaattgtatggt

SEQ ID NO: 184479 - DNA, 22 bp, Mus musculus
tgttttgtgaccaattatatgg

SEQ ID NO: 184480 - DNA, 22 bp, Mus musculus
tgttttgtgaccaattatatgg

SEQ ID NO: 184481 - DNA, 20 bp, Mus musculus
tcacagaactgagtgacttg

SEQ ID NO: 184482 - DNA, 23 bp, Mus musculus
ttgtgatttagatcatgaagctg

SEQ ID NO: 184483 - DNA, 23 bp, Mus musculus
acatctgtaattcaagaactgag

SEQ ID NO: 184484 - DNA, 18 bp, Mus musculus
tgagctacagagtgagac

SEQ ID NO: 184485 - DNA, 21 bp, Mus musculus
tctggctgtctctgtgcattg

SEQ ID NO: 184486 - DNA, 22 bp, Mus musculus
tatgattgtatgtatgatagtg

SEQ ID NO: 184487 - DNA, 23 bp, Mus musculus
agtcagtatggctatcttctgag

SEQ ID NO: 184488 - DNA, 23 bp, Mus musculus
ttatctgtgtggttaatgatctg

SEQ ID NO: 184489 - DNA, 22 bp, Mus musculus
tgttttgtgaccaattatatgg

SEQ ID NO: 184490 - DNA, 22 bp, Mus musculus
tgttttgtgaccaattatatgg

SEQ ID NO: 184491 - DNA, 21 bp, Mus musculus
gtcaggtactgcattgggaat

SEQ ID NO: 184492 - DNA, 18 bp, Mus musculus
tctcatgctgaaagaccg

SEQ ID NO: 184493 - DNA, 20 bp, Mus musculus
tgtttctagacagtctgctc

SEQ ID NO: 184494 - DNA, 21 bp, Mus musculus
aacctagatgcagaatgcttg

SEQ ID NO: 184495 - DNA, 23 bp, Mus musculus
atgtgtctctgtctatgtctctg

SEQ ID NO: 184496 - DNA, 22 bp, Mus musculus
aatttgcatcattttatattgt

SEQ ID NO: 184497 - DNA, 23 bp, Mus musculus
tgttgtggcagagttcagatttt

SEQ ID NO: 184498 - DNA, 21 bp, Mus musculus
cactgtcattttctctctgct

SEQ ID NO: 184499 - DNA, 23 bp, Mus musculus
ctacagcttctacattgagatga

SEQ ID NO: 184500 - DNA, 23 bp, Mus musculus
tcacaggtgagagtgtggacagg

SEQ ID NO: 184501 - DNA, 19 bp, Mus musculus
attcagtatatatatatgt

SEQ ID NO: 184502 - DNA, 23 bp, Mus musculus
caatatttttgtatctgttgagg

SEQ ID NO: 184503 - DNA, 22 bp, Mus musculus
tggatcagagctctgttctgtg

SEQ ID NO: 184504 - DNA, 20 bp, Mus musculus
tggcagtttcagtttgatca

SEQ ID NO: 184505 - DNA, 22 bp, Mus musculus
tcatgactgatacttgtttgtc

SEQ ID NO: 184506 - DNA, 23 bp, Mus musculus
tgtgtgtgtgtgtgcatgtttat

SEQ ID NO: 184507 - DNA, 19 bp, Mus musculus
tgtatgcatgcatgtatgt

SEQ ID NO: 184508 - DNA, 22 bp, Mus musculus
ttattactctatttcatgttgt

SEQ ID NO: 184509 - DNA, 23 bp, Mus musculus
tatgcatgtgttaaatgtctagt

SEQ ID NO: 184510 - DNA, 23 bp, Mus musculus
tgtctgtctgtctattacttatc

SEQ ID NO: 184511 - DNA, 18 bp, Mus musculus
tatgcatatatatttgga

SEQ ID NO: 184512 - DNA, 22 bp, Mus musculus
tgttttgtgaccaattatatgg

SEQ ID NO: 184513 - DNA, 19 bp, Mus musculus
tttggtagagggatatgtg

SEQ ID NO: 184514 - DNA, 22 bp, Mus musculus
ataggctaaggtagaagtcaca

SEQ ID NO: 184515 - DNA, 23 bp, Mus musculus
gagactttctgctgcagcatttc

SEQ ID NO: 184516 - DNA, 23 bp, Mus musculus
ctgtttatggcactccaagataa

SEQ ID NO: 184517 - DNA, 22 bp, Mus musculus
tccatgttgatctgataggatg

SEQ ID NO: 184518 - DNA, 22 bp, Mus musculus
tatagggtccattttgtagaag

SEQ ID NO: 184519 - DNA, 22 bp, Mus musculus
tgttttgtgaccaattatatgg

SEQ ID NO: 184520 - DNA, 23 bp, Mus musculus
ctgtatatctctgtctttttatt

SEQ ID NO: 184521 - DNA, 22 bp, Mus musculus
tatgttgagacacattgatgac

SEQ ID NO: 184522 - DNA, 23 bp, Mus musculus
caatatttttgtatctgttgagg

SEQ ID NO: 184523 - DNA, 23 bp, Mus musculus
ccttctctgaatatgcccagcag

SEQ ID NO: 184524 - DNA, 20 bp, Mus musculus
tcactggctcactggctcac

SEQ ID NO: 184525 - DNA, 21 bp, Mus musculus
atgtatatatataaatgtatg

SEQ ID NO: 184526 - DNA, 23 bp, Mus musculus
tgttaatatctatatatgtatat

SEQ ID NO: 184527 - DNA, 20 bp, Mus musculus
tgtgtgtgtgtgtgtgtgtg

SEQ ID NO: 184528 - DNA, 22 bp, Mus musculus
attctgtgtcagtttctttata

SEQ ID NO: 184529 - DNA, 23 bp, Mus musculus
atactctcactcttcctgtctca

SEQ ID NO: 184530 - DNA, 19 bp, Mus musculus
actcccattttaacactgt

SEQ ID NO: 184531 - DNA, 19 bp, Mus musculus
acatatgtatatttatgtg

SEQ ID NO: 184532 - DNA, 19 bp, Mus musculus
tgtgtctgtctgtcaattc

SEQ ID NO: 184533 - DNA, 23 bp, Mus musculus
tcactcactgtttctccaaggcc

SEQ ID NO: 184534 - DNA, 23 bp, Mus musculus
ctgtgtctctgaatctgactgtc

SEQ ID NO: 184535 - DNA, 23 bp, Mus musculus
tgtgtctctgtttagtttctgtt

SEQ ID NO: 184536 - DNA, 19 bp, Mus musculus
tccctgactctataccatc

SEQ ID NO: 184537 - DNA, 21 bp, Mus musculus
tagctagatggtttcaaagta

SEQ ID NO: 184538 - DNA, 20 bp, Mus musculus
aggatgtatgtatgtatgta

SEQ ID NO: 184539 - DNA, 23 bp, Mus musculus
actccttcagtctctgtttcaca

SEQ ID NO: 184540 - DNA, 22 bp, Mus musculus
tgagagaatgctgacagacaga

SEQ ID NO: 184541 - DNA, 23 bp, Mus musculus
tctgtgagacattatcttgatta

SEQ ID NO: 184542 - DNA, 21 bp, Mus musculus
ctatatatgtgtatgtatatg

SEQ ID NO: 184543 - DNA, 23 bp, Mus musculus
ctctgcctgtctctctcttggct

SEQ ID NO: 184544 - DNA, 23 bp, Mus musculus
acagatcttacagagcagtcagt

SEQ ID NO: 184545 - DNA, 23 bp, Mus musculus
acatgtgctatgactggattatg

SEQ ID NO: 184546 - DNA, 18 bp, Mus musculus
agatctggggctggagag

SEQ ID NO: 184547 - DNA, 22 bp, Mus musculus
ctgaggattgatctctgtctcc

SEQ ID NO: 184548 - DNA, 23 bp, Mus musculus
tctcagacaacagtagtctgtgg

SEQ ID NO: 184549 - DNA, 23 bp, Mus musculus
tctgtctgtctgtctgcctgcct

SEQ ID NO: 184550 - DNA, 22 bp, Mus musculus
tctgtgtctgtgtgtgtctatg

SEQ ID NO: 184551 - DNA, 23 bp, Mus musculus
ggtctctgtctgtctgtgggcct

SEQ ID NO: 184552 - DNA, 23 bp, Mus musculus
gtggtactaggctgtattcttgc

SEQ ID NO: 184553 - DNA, 22 bp, Mus musculus
tgttttgtgaccaattatatgg

SEQ ID NO: 184554 - DNA, 23 bp, Mus musculus
tgagaggctctgtcagtgcctga

SEQ ID NO: 184555 - DNA, 23 bp, Mus musculus
tgtgtgtgcatgtggaagtgtaa

SEQ ID NO: 184556 - DNA, 23 bp, Mus musculus
atatgtatacatggatactgtgc

SEQ ID NO: 184557 - DNA, 22 bp, Mus musculus
tgttttgtgaccaattatatgg

SEQ ID NO: 184558 - DNA, 22 bp, Mus musculus
tgttttgtgaccaattatatgg

SEQ ID NO: 184559 - DNA, 19 bp, Mus musculus
gtcttgaaactatagtctg

SEQ ID NO: 184560 - DNA, 23 bp, Mus musculus
atttctttgatttactatagttt

SEQ ID NO: 184561 - DNA, 23 bp, Mus musculus
attgagcttgtttaagtgttgat

SEQ ID NO: 184562 - DNA, 23 bp, Mus musculus
atgatactcacaatggttcttga

SEQ ID NO: 184563 - DNA, 23 bp, Mus musculus
acactttgtggatgaagtaagga

SEQ ID NO: 184564 - DNA, 23 bp, Mus musculus
ctgtgagttgtcttgaagctgta

SEQ ID NO: 184565 - DNA, 23 bp, Mus musculus
tcaaagttatagcttctggtcca

SEQ ID NO: 184566 - DNA, 21 bp, Mus musculus
tgggtctctctgatgtgtttg

SEQ ID NO: 184567 - DNA, 22 bp, Mus musculus
cagtggctgtctctgactcttg

SEQ ID NO: 184568 - DNA, 22 bp, Mus musculus
gttatctgtgacatgatgatgt

SEQ ID NO: 184569 - DNA, 19 bp, Mus musculus
agacagaaattagagagca

SEQ ID NO: 184570 - DNA, 23 bp, Mus musculus
atctctcagttgagagtcacctc

SEQ ID NO: 184571 - DNA, 22 bp, Mus musculus
atgtgtgcctctgtgtttggtt

SEQ ID NO: 184572 - DNA, 23 bp, Mus musculus
cctctggtagtactatgttcaat

SEQ ID NO: 184573 - DNA, 22 bp, Mus musculus
tacttagaaaatgtttctgata

SEQ ID NO: 184574 - DNA, 22 bp, Mus musculus
tgttttgtgaccaattatatgg

SEQ ID NO: 184575 - DNA, 20 bp, Mus musculus
tgttagcctctgtcagcaga

SEQ ID NO: 184576 - DNA, 18 bp, Mus musculus
tttcagtgatcagagtac

SEQ ID NO: 184577 - DNA, 19 bp, Mus musculus
tgtctgtctgtctgtccta

SEQ ID NO: 184578 - DNA, 23 bp, Mus musculus
agtccatggtgaactgataggat

SEQ ID NO: 184579 - DNA, 22 bp, Mus musculus
tgttttgtgaccaattatatgg

SEQ ID NO: 184580 - DNA, 20 bp, Mus musculus
tcacagaactgagtgacttg

SEQ ID NO: 184581 - DNA, 23 bp, Mus musculus
acagtgctcactgtggtgtcaca

SEQ ID NO: 184582 - DNA, 22 bp, Mus musculus
tgttttgtgaccaattatatgg

SEQ ID NO: 184583 - DNA, 20 bp, Mus musculus
tgtgacatcagagtgagcac

SEQ ID NO: 184584 - DNA, 23 bp, Mus musculus
gtcttctgtctgggtctcatggc

SEQ ID NO: 184585 - DNA, 23 bp, Mus musculus
tgtgagaagtgagtcagctgaag

SEQ ID NO: 184586 - DNA, 23 bp, Mus musculus
gctgtgtgtctgtgtctctgtgc

SEQ ID NO: 184587 - DNA, 22 bp, Mus musculus
tttggtttcccaggaatgtcct

SEQ ID NO: 184588 - DNA, 23 bp, Mus musculus
agtgcctggctcagtggttggca

SEQ ID NO: 184589 - DNA, 23 bp, Mus musculus
gtctgggagagtcagtgcatcgc

SEQ ID NO: 184590 - DNA, 22 bp, Mus musculus
tgttttgtgaccaattatatgg

SEQ ID NO: 184591 - DNA, 20 bp, Mus musculus
aggaagtgtgtcactgtggg

SEQ ID NO: 184592 - DNA, 23 bp, Mus musculus
tttctcagtttctcagtttctgc

SEQ ID NO: 184593 - DNA, 23 bp, Mus musculus
tttctcagtttctcagtttctgc

SEQ ID NO: 184594 - DNA, 22 bp, Mus musculus
tatcacatttagtgtatctgat

SEQ ID NO: 184595 - DNA, 18 bp, Mus musculus
cctgatcagagagaggtg

SEQ ID NO: 184596 - DNA, 23 bp, Mus musculus
tcagggatggtcatggagtcttc

SEQ ID NO: 184597 - DNA, 23 bp, Mus musculus
agaaatctgtctgcctctgcctc

SEQ ID NO: 184598 - DNA, 22 bp, Mus musculus
tgttttgtgaccaattatatgg

SEQ ID NO: 184599 - DNA, 22 bp, Mus musculus
tgttttgtgaccaactatatgg

SEQ ID NO: 184600 - DNA, 22 bp, Mus musculus
tgttttgtgaccaattatatgg

SEQ ID NO: 184601 - DNA, 23 bp, Mus musculus
ctgtgtcaggctccctgtgtggc

SEQ ID NO: 184602 - DNA, 19 bp, Mus musculus
aatgtgctagttcattttt

SEQ ID NO: 184603 - DNA, 22 bp, Mus musculus
tatagacaggtagataatagat

SEQ ID NO: 184604 - DNA, 19 bp, Mus musculus
tctcactctgagacccacc

SEQ ID NO: 184605 - DNA, 21 bp, Mus musculus
atattgctacagaatgtattt

SEQ ID NO: 184606 - DNA, 23 bp, Mus musculus
aggagtcagaagagaaacaggtc

SEQ ID NO: 184607 - DNA, 22 bp, Mus musculus
tgttttgtgaccaattatatgg

SEQ ID NO: 184608 - DNA, 19 bp, Mus musculus
attattgtatacatgcttt

SEQ ID NO: 184609 - DNA, 23 bp, Mus musculus
tcactgtgaagtttacttttcag

SEQ ID NO: 184610 - DNA, 19 bp, Mus musculus
actgaaggagttgctggta

SEQ ID NO: 184611 - DNA, 20 bp, Mus musculus
tcttatgttctctaacttca

SEQ ID NO: 184612 - DNA, 21 bp, Mus musculus
tctgtggtgattagataggat

SEQ ID NO: 184613 - DNA, 23 bp, Mus musculus
tctacagcttgtttgatgaggct

SEQ ID NO: 184614 - DNA, 23 bp, Mus musculus
cccacagttcacactagctgttg

SEQ ID NO: 184615 - DNA, 22 bp, Mus musculus
tgttttgtgaccaattatatgg

SEQ ID NO: 184616 - DNA, 21 bp, Mus musculus
ttagtctgttagttgtcaggg

SEQ ID NO: 184617 - DNA, 21 bp, Mus musculus
atactgtatatgtatatgtgt

SEQ ID NO: 184618 - DNA, 22 bp, Mus musculus
tgttttgtgaccaattatatgg

SEQ ID NO: 184619 - DNA, 21 bp, Mus musculus
gccactgtggtttgctggttg

SEQ ID NO: 184620 - DNA, 23 bp, Mus musculus
atctgacagatataggactggtg

SEQ ID NO: 184621 - DNA, 23 bp, Mus musculus
acactgtatgtcagaggtaaagt

SEQ ID NO: 184622 - DNA, 23 bp, Mus musculus
tcatttgtggagaagctgtacag

SEQ ID NO: 184623 - DNA, 21 bp, Mus musculus
tatgcatatatgtatgtatgt

SEQ ID NO: 184624 - DNA, 20 bp, Mus musculus
atgtgtgtatatatgtatgt

SEQ ID NO: 184625 - DNA, 22 bp, Mus musculus
ttactgcatagagtctcactat

SEQ ID NO: 184626 - DNA, 23 bp, Mus musculus
tctccaacacttgtcattttcta

SEQ ID NO: 184627 - DNA, 23 bp, Mus musculus
tggggaaagtagaatgagatgtg

SEQ ID NO: 184628 - DNA, 21 bp, Mus musculus
tgtgtcttcaaaccatatctg

SEQ ID NO: 184629 - DNA, 22 bp, Mus musculus
cagagtagtgtgcagataggac

SEQ ID NO: 184630 - DNA, 21 bp, Mus musculus
atgtatgtatgtatgtatgtt

SEQ ID NO: 184631 - DNA, 23 bp, Mus musculus
tgtatgtgtgtatgtatgtgtat

SEQ ID NO: 184632 - DNA, 23 bp, Mus musculus
aatctgctagttttatgtattta

SEQ ID NO: 184633 - DNA, 22 bp, Mus musculus
gtttgccagttatctgttgctg

SEQ ID NO: 184634 - DNA, 23 bp, Mus musculus
gagtgtctgtctgcctctcctct

SEQ ID NO: 184635 - DNA, 23 bp, Mus musculus
ttactgggtgtctgtctgcctct

SEQ ID NO: 184636 - DNA, 22 bp, Mus musculus
tgcttgtgcaagtagtatgcat

SEQ ID NO: 184637 - DNA, 22 bp, Mus musculus
gcgtgtgtctgtgtgtgtgtag

SEQ ID NO: 184638 - DNA, 23 bp, Mus musculus
ttgatcttgatgtacggcgcata

SEQ ID NO: 184639 - DNA, 23 bp, Mus musculus
gtggtgtcacactgtctgcgtgc

SEQ ID NO: 184640 - DNA, 21 bp, Mus musculus
ggtctcactcagtcattctcc

SEQ ID NO: 184641 - DNA, 20 bp, Mus musculus
tcacacttccataatgctgt

SEQ ID NO: 184642 - DNA, 23 bp, Mus musculus
tcctcagtggaattgtaggcttt

SEQ ID NO: 184643 - DNA, 23 bp, Mus musculus
taagagactggaacttttggtgg

SEQ ID NO: 184644 - DNA, 23 bp, Mus musculus
agtgctcccacactcacaccctc

SEQ ID NO: 184645 - DNA, 20 bp, Mus musculus
cttctccagcctcacctcag

SEQ ID NO: 184646 - DNA, 18 bp, Mus musculus
tctggctggctttgatct

SEQ ID NO: 184647 - DNA, 21 bp, Mus musculus
gtcagacttagaatgcactta

SEQ ID NO: 184648 - DNA, 21 bp, Mus musculus
tagtggtagtaggttccatgt

SEQ ID NO: 184649 - DNA, 22 bp, Mus musculus
tgttttgtgaccaattatatgg

SEQ ID NO: 184650 - DNA, 23 bp, Mus musculus
gtctctcagtgtctttcatgggt

SEQ ID NO: 184651 - DNA, 22 bp, Mus musculus
tgctgagtccttgtgcacaggc

SEQ ID NO: 184652 - DNA, 22 bp, Mus musculus
tgttttgtgaccaattatatgg

SEQ ID NO: 184653 - DNA, 23 bp, Mus musculus
taagacactctgcctgctcacgt

SEQ ID NO: 184654 - DNA, 23 bp, Mus musculus
agacactctgcctctgttcaggt

SEQ ID NO: 184655 - DNA, 23 bp, Mus musculus
agactgtgtctctcagtaatgtc

SEQ ID NO: 184656 - DNA, 23 bp, Mus musculus
tctctctttctctcagagtcctt

SEQ ID NO: 184657 - DNA, 19 bp, Mus musculus
agcaactgccatctcggtg

SEQ ID NO: 184658 - DNA, 22 bp, Mus musculus
tgtctatatgtatatgtgtctg

SEQ ID NO: 184659 - DNA, 21 bp, Mus musculus
ataaatgtttttttggttggg

SEQ ID NO: 184660 - DNA, 23 bp, Mus musculus
taggatagactggaaagacgttg

SEQ ID NO: 184661 - DNA, 22 bp, Mus musculus
agtgactcaagtaagtgagctg

SEQ ID NO: 184662 - DNA, 23 bp, Mus musculus
agtcagcttgtataagaaggtat

SEQ ID NO: 184663 - DNA, 23 bp, Mus musculus
ctgtgtctctgtttagtttctgt

SEQ ID NO: 184664 - DNA, 23 bp, Mus musculus
catgcacacagtcactgtgtctg

SEQ ID NO: 184665 - DNA, 23 bp, Mus musculus
ctagggacagtgagggaatgaag

SEQ ID NO: 184666 - DNA, 21 bp, Mus musculus
gagtgcaatgttctcagggca

SEQ ID NO: 184667 - DNA, 19 bp, Mus musculus
agccctgtgtgattgcaat

SEQ ID NO: 184668 - DNA, 23 bp, Mus musculus
aagtcactttttggtaatgtgaa

SEQ ID NO: 184669 - DNA, 22 bp, Mus musculus
ctctctatgtctgtctgtttat

SEQ ID NO: 184670 - DNA, 23 bp, Mus musculus
gtatgtgtatatgtgtatatgat

SEQ ID NO: 184671 - DNA, 22 bp, Mus musculus
tgttttgtgaccaattatatgg

SEQ ID NO: 184672 - DNA, 20 bp, Mus musculus
tgtgtgtgtgtacatgtaca

SEQ ID NO: 184673 - DNA, 22 bp, Mus musculus
tatgtctgtgtatatgatgtat

SEQ ID NO: 184674 - DNA, 22 bp, Mus musculus
tgttttgtgaccaattatatgg

SEQ ID NO: 184675 - DNA, 22 bp, Mus musculus
tgttttgtgaccaattatatgg

SEQ ID NO: 184676 - DNA, 18 bp, Mus musculus
tgtgtatatgcatacaca

SEQ ID NO: 184677 - DNA, 22 bp, Mus musculus
ctgtctcactgtgtgttatatc

SEQ ID NO: 184678 - DNA, 22 bp, Mus musculus
tagtggtagttcctttatgcat

SEQ ID NO: 184679 - DNA, 23 bp, Mus musculus
ttacttttctccttctgattttg

SEQ ID NO: 184680 - DNA, 22 bp, Mus musculus
tgtgtatgtatgtttatatgct

SEQ ID NO: 184681 - DNA, 23 bp, Mus musculus
attacatgactatgtctatagat

SEQ ID NO: 184682 - DNA, 23 bp, Mus musculus
attaaggtgctttttaagtgggt

SEQ ID NO: 184683 - DNA, 23 bp, Mus musculus
ttcactggaatatagtctgtcat

SEQ ID NO: 184684 - DNA, 23 bp, Mus musculus
ttttatgatttactggatgaagt

SEQ ID NO: 184685 - DNA, 23 bp, Mus musculus
aaagtcgagtagctgctcttctg

SEQ ID NO: 184686 - DNA, 18 bp, Mus musculus
tcctgaaatatggtgatt

SEQ ID NO: 184687 - DNA, 21 bp, Mus musculus
atgaagaaactgagcacagga

SEQ ID NO: 184688 - DNA, 22 bp, Mus musculus
tgtgtgtgcacacatgtgtgta

SEQ ID NO: 184689 - DNA, 22 bp, Mus musculus
tgttttgtgaccaattatatgg

SEQ ID NO: 184690 - DNA, 22 bp, Mus musculus
gacagacagacagacagacagt

SEQ ID NO: 184691 - DNA, 23 bp, Mus musculus
caaagtctgtcaggtattctagg

SEQ ID NO: 184692 - DNA, 18 bp, Mus musculus
gcgtgtccatgtgtttgt

SEQ ID NO: 184693 - DNA, 23 bp, Mus musculus
agactctctgggtccctgtgtct

SEQ ID NO: 184694 - DNA, 22 bp, Mus musculus
tgttttgtgaccaattatatgg

SEQ ID NO: 184695 - DNA, 23 bp, Mus musculus
tagtgcatggtgatctgatagga

SEQ ID NO: 184696 - DNA, 22 bp, Mus musculus
tgttttgtgacctattatgtgg

SEQ ID NO: 184697 - DNA, 21 bp, Mus musculus
tatgcatatatatatgtatgt

SEQ ID NO: 184698 - DNA, 20 bp, Mus musculus
aatctgaatgtatttgttag

SEQ ID NO: 184699 - DNA, 23 bp, Mus musculus
aagtcacatcaggcaaggtacat

SEQ ID NO: 184700 - DNA, 23 bp, Mus musculus
gatttctctctgtctctgggaga

SEQ ID NO: 184701 - DNA, 22 bp, Mus musculus
tgttttgtgaccaattatatgg

SEQ ID NO: 184702 - DNA, 20 bp, Mus musculus
tgaggaatgagtttcacttg

SEQ ID NO: 184703 - DNA, 18 bp, Mus musculus
tacatatatgcatatgtg

SEQ ID NO: 184704 - DNA, 23 bp, Mus musculus
tatatatatatgcatatgtgtgt

SEQ ID NO: 184705 - DNA, 23 bp, Mus musculus
atattaggatgttgataacgtgt

SEQ ID NO: 184706 - DNA, 22 bp, Mus musculus
atgtttcaatttttctaattca

SEQ ID NO: 184707 - DNA, 23 bp, Mus musculus
atatgtatgaatatgtaatgtat

SEQ ID NO: 184708 - DNA, 22 bp, Mus musculus
tgttttgtgaccaattatatgg

SEQ ID NO: 184709 - DNA, 22 bp, Mus musculus
tgttttgtgaccaattatatgg

SEQ ID NO: 184710 - DNA, 22 bp, Mus musculus
tgttttgtgaccaattatatgg

SEQ ID NO: 184711 - DNA, 23 bp, Mus musculus
tttcatcttccaacacactagct

SEQ ID NO: 184712 - DNA, 23 bp, Mus musculus
catgtgtgttctttggtgattgg

SEQ ID NO: 184713 - DNA, 23 bp, Mus musculus
taatgcatgtattacgtatgtat

SEQ ID NO: 184714 - DNA, 21 bp, Mus musculus
gtaagtgcctagagagcggat

SEQ ID NO: 184715 - DNA, 19 bp, Mus musculus
atgtatgtatgtatatgta

SEQ ID NO: 184716 - DNA, 22 bp, Mus musculus
acacacgcatatgtgtgtgtga

SEQ ID NO: 184717 - DNA, 23 bp, Mus musculus
tatatctatatatatatgtgtgt

SEQ ID NO: 184718 - DNA, 23 bp, Mus musculus
tttctgtgtctgagttacctcac

SEQ ID NO: 184719 - DNA, 22 bp, Mus musculus
tgttttgtgaccaattatatgg

SEQ ID NO: 184720 - DNA, 22 bp, Mus musculus
tgttttgtgaccaattatatgg

SEQ ID NO: 184721 - DNA, 22 bp, Mus musculus
tgttttgtgaccaattatatgg

SEQ ID NO: 184722 - DNA, 22 bp, Mus musculus
taggtagtatttatatgttcag

SEQ ID NO: 184723 - DNA, 23 bp, Mus musculus
gtctgtctgtctgtctatcatct

SEQ ID NO: 184724 - DNA, 22 bp, Mus musculus
tgagacagttatgtttggggga

SEQ ID NO: 184725 - DNA, 23 bp, Mus musculus
actctctcagtctctgtctccat

SEQ ID NO: 184726 - DNA, 22 bp, Mus musculus
tgttttgtgaccaattatatgg

SEQ ID NO: 184727 - DNA, 22 bp, Mus musculus
tgttttgtgaccaattatatgg

SEQ ID NO: 184728 - DNA, 23 bp, Mus musculus
gtctgtctgtctgtctgtctgtc

SEQ ID NO: 184729 - DNA, 22 bp, Mus musculus
tgttttgtgaccaattatatgg

SEQ ID NO: 184730 - DNA, 22 bp, Mus musculus
tgttttgtgaccaattatatgg

SEQ ID NO: 184731 - DNA, 23 bp, Mus musculus
atgtctttgagggattttcttga

SEQ ID NO: 184732 - DNA, 23 bp, Mus musculus
tatagaagatcctgaggccttga

SEQ ID NO: 184733 - DNA, 23 bp, Mus musculus
ggaggaagtgagtcactaggggt

SEQ ID NO: 184734 - DNA, 23 bp, Mus musculus
gactcagtgtctctctaactgct

SEQ ID NO: 184735 - DNA, 23 bp, Mus musculus
ttggatgttgtagtaggttgaat

SEQ ID NO: 184736 - DNA, 23 bp, Mus musculus
atctgtatctgcatctgtatctg

SEQ ID NO: 184737 - DNA, 23 bp, Mus musculus
ctagactgtgactgtctctttcc

SEQ ID NO: 184738 - DNA, 22 bp, Mus musculus
aggtttgtaaagaactatgttg

SEQ ID NO: 184739 - DNA, 23 bp, Mus musculus
attgatctgtacattgcttttgg

SEQ ID NO: 184740 - DNA, 23 bp, Mus musculus
agacacccacactgacttatctg

SEQ ID NO: 184741 - DNA, 23 bp, Mus musculus
tgtgtgtgcatgtgttttccttt

SEQ ID NO: 184742 - DNA, 22 bp, Mus musculus
tgttttgtgaccaattatatgg

SEQ ID NO: 184743 - DNA, 23 bp, Mus musculus
tctatctatatctatatctatat

SEQ ID NO: 184744 - DNA, 22 bp, Mus musculus
aaattgtttcactgcaggtgag

SEQ ID NO: 184745 - DNA, 23 bp, Mus musculus
acagaactgtgtgtgataaggga

SEQ ID NO: 184746 - DNA, 23 bp, Mus musculus
gaatagatgtggacgtggagaga

SEQ ID NO: 184747 - DNA, 22 bp, Mus musculus
atagtaatcaagatgactttat

SEQ ID NO: 184748 - DNA, 23 bp, Mus musculus
tcatgtaaataacatttgcattg

SEQ ID NO: 184749 - DNA, 22 bp, Mus musculus
tgttttgtgaccaattatatgg

SEQ ID NO: 184750 - DNA, 23 bp, Mus musculus
tctgcctctcactctcgctctct

SEQ ID NO: 184751 - DNA, 23 bp, Mus musculus
accacagattttctatttctgag

SEQ ID NO: 184752 - DNA, 18 bp, Mus musculus
aaagagctagggctggag

SEQ ID NO: 184753 - DNA, 23 bp, Mus musculus
atgcatgtatgcatgtatacaca

SEQ ID NO: 184754 - DNA, 23 bp, Mus musculus
ttagtagtggatgaccagctggt

SEQ ID NO: 184755 - DNA, 21 bp, Mus musculus
actggggtgactgtttctctc

SEQ ID NO: 184756 - DNA, 18 bp, Mus musculus
tccagctctctatgaaac

SEQ ID NO: 184757 - DNA, 22 bp, Mus musculus
tgttttgtgaccaattatatgg

SEQ ID NO: 184758 - DNA, 22 bp, Mus musculus
tgttttgtgaccaattatatgg

SEQ ID NO: 184759 - DNA, 22 bp, Mus musculus
tgttttgtgaccaattatatgg

SEQ ID NO: 184760 - DNA, 22 bp, Mus musculus
tctctgttcactcttcctgttc

SEQ ID NO: 184761 - DNA, 22 bp, Mus musculus
tgttttgtgaccaattatatgg

SEQ ID NO: 184762 - DNA, 22 bp, Mus musculus
atctatgtatttatgtatctat

SEQ ID NO: 184763 - DNA, 23 bp, Mus musculus
ttagtggatctatctatctatct

SEQ ID NO: 184764 - DNA, 22 bp, Mus musculus
tgttttgtgaccaattatatgg

SEQ ID NO: 184765 - DNA, 23 bp, Mus musculus
aggctgagaagtgattttgtaga

SEQ ID NO: 184766 - DNA, 22 bp, Mus musculus
tgttttgtgaccaattatatgg

SEQ ID NO: 184767 - DNA, 22 bp, Mus musculus
ttagttcttgacattagtactt

SEQ ID NO: 184768 - DNA, 23 bp, Mus musculus
tgacaagtgtattacatgttcat

SEQ ID NO: 184769 - DNA, 23 bp, Mus musculus
tgattcagttgtgttattgatct

SEQ ID NO: 184770 - DNA, 19 bp, Mus musculus
aattgcttttttaatcatg

SEQ ID NO: 184771 - DNA, 22 bp, Mus musculus
tgttttgtgaccaattatatgg

SEQ ID NO: 184772 - DNA, 23 bp, Mus musculus
attgctctttcaccatatatatt

SEQ ID NO: 184773 - DNA, 21 bp, Mus musculus
tgtgtatgtatgtatgtatgt

SEQ ID NO: 184774 - DNA, 23 bp, Mus musculus
acacatatatgtatgtgcatgta

SEQ ID NO: 184775 - DNA, 19 bp, Mus musculus
tgtatgtatgtatgtatgc

SEQ ID NO: 184776 - DNA, 23 bp, Mus musculus
tgtctctgtgtgtaattcttgtg

SEQ ID NO: 184777 - DNA, 21 bp, Mus musculus
cagtttctcactgactctctg

SEQ ID NO: 184778 - DNA, 23 bp, Mus musculus
atctgactggctgatttttatct

SEQ ID NO: 184779 - DNA, 21 bp, Mus musculus
ttcacagtagataaagagcag

SEQ ID NO: 184780 - DNA, 22 bp, Mus musculus
tgttttgtgaccaattatatgg

SEQ ID NO: 184781 - DNA, 23 bp, Mus musculus
ctgtgtctctgtttagtttctgt

SEQ ID NO: 184782 - DNA, 23 bp, Mus musculus
aggatctgtccatagatgagagt

SEQ ID NO: 184783 - DNA, 23 bp, Mus musculus
tgaaatgtttggtagatatctgt

SEQ ID NO: 184784 - DNA, 23 bp, Mus musculus
acttctgttagtttcactctgtc

SEQ ID NO: 184785 - DNA, 22 bp, Mus musculus
tgttttgtgaccaattatatgg

SEQ ID NO: 184786 - DNA, 23 bp, Mus musculus
tgtctgtgtctgtctctatgtct

SEQ ID NO: 184787 - DNA, 20 bp, Mus musculus
ctatctatatgtatatctat

SEQ ID NO: 184788 - DNA, 22 bp, Mus musculus
tgttttgtgaccaattatatgg

SEQ ID NO: 184789 - DNA, 23 bp, Mus musculus
tgactcagtggttaagagcactg

SEQ ID NO: 184790 - DNA, 23 bp, Mus musculus
tgtaagtaactttgcaactgtgt

SEQ ID NO: 184791 - DNA, 23 bp, Mus musculus
tgtgtgtgtgatatgtatgtatg

SEQ ID NO: 184792 - DNA, 23 bp, Mus musculus
ccgtgtgttatgacaggaatatg

SEQ ID NO: 184793 - DNA, 23 bp, Mus musculus
taaattctctggttctgtggctc

SEQ ID NO: 184794 - DNA, 20 bp, Mus musculus
tgtggtgatgatagaggcac

SEQ ID NO: 184795 - DNA, 23 bp, Mus musculus
gtgtgtgttcatgtccatgtgca

SEQ ID NO: 184796 - DNA, 20 bp, Mus musculus
agcaatatgtattcatgtat

SEQ ID NO: 184797 - DNA, 21 bp, Mus musculus
acagagttccttttccactct

SEQ ID NO: 184798 - DNA, 22 bp, Mus musculus
tgttttgtgaccaattatatgg

SEQ ID NO: 184799 - DNA, 22 bp, Mus musculus
actatggtttttatatctgtat

SEQ ID NO: 184800 - DNA, 21 bp, Mus musculus
aatgctagatttaagtgaata

SEQ ID NO: 184801 - DNA, 23 bp, Mus musculus
atactggagtttggtttaggttg

SEQ ID NO: 184802 - DNA, 19 bp, Mus musculus
tacagaagaaacactggtg

SEQ ID NO: 184803 - DNA, 22 bp, Mus musculus
tgttttgtgaccaattatatgg

SEQ ID NO: 184804 - DNA, 23 bp, Mus musculus
tagtgcatggtgatctgatagga

SEQ ID NO: 184805 - DNA, 22 bp, Mus musculus
ttttgacctattatatggtcag

SEQ ID NO: 184806 - DNA, 23 bp, Mus musculus
tcagagactctgtgcttccgtct

SEQ ID NO: 184807 - DNA, 23 bp, Mus musculus
gtgtctctctttctctaactgct

SEQ ID NO: 184808 - DNA, 23 bp, Mus musculus
atagctgtgtcaccagggaactg

SEQ ID NO: 184809 - DNA, 20 bp, Mus musculus
tcacagaactgagtgacttg

SEQ ID NO: 184810 - DNA, 20 bp, Mus musculus
tacagtacacagaaagcaca

SEQ ID NO: 184811 - DNA, 23 bp, Mus musculus
tttctacctctttgtgtctgact

SEQ ID NO: 184812 - DNA, 21 bp, Mus musculus
acattgatagagaaaatgcat

SEQ ID NO: 184813 - DNA, 23 bp, Mus musculus
tgagagaggcacagtggagaact

SEQ ID NO: 184814 - DNA, 23 bp, Mus musculus
tcccactgactcataatggttct

SEQ ID NO: 184815 - DNA, 23 bp, Mus musculus
agtcagaacacagacagaccaat

SEQ ID NO: 184816 - DNA, 23 bp, Mus musculus
tatatgtatatgtatatgtgagt

SEQ ID NO: 184817 - DNA, 23 bp, Mus musculus
acacctctgagtgtgtcagtgcg

SEQ ID NO: 184818 - DNA, 22 bp, Mus musculus
tgttttgtgaccaattatatgg

SEQ ID NO: 184819 - DNA, 23 bp, Mus musculus
agactagacactttcaggattgg

SEQ ID NO: 184820 - DNA, 21 bp, Mus musculus
agtgtcagtctgtctctccta

SEQ ID NO: 184821 - DNA, 22 bp, Mus musculus
aagagtcagattagaggtgact

SEQ ID NO: 184822 - DNA, 22 bp, Mus musculus
tgatgtcctgtcttcctgctgg

SEQ ID NO: 184823 - DNA, 21 bp, Mus musculus
actgcttgctgtcttgctctc

SEQ ID NO: 184824 - DNA, 22 bp, Mus musculus
gtgtgtgtatgtctgtgtctat

SEQ ID NO: 184825 - DNA, 20 bp, Mus musculus
cctgtgtgcacatgcaggtg

SEQ ID NO: 184826 - DNA, 23 bp, Mus musculus
gcagaagtctggagtttggttac

SEQ ID NO: 184827 - DNA, 19 bp, Mus musculus
aactttagagttgaagaac

SEQ ID NO: 184828 - DNA, 23 bp, Mus musculus
aactttggttttgaagctgaagt

SEQ ID NO: 184829 - DNA, 22 bp, Mus musculus
acagttgggtttttgttgatgt

SEQ ID NO: 184830 - DNA, 20 bp, Mus musculus
gggcctcagtctgtctgtca

SEQ ID NO: 184831 - DNA, 23 bp, Mus musculus
cggtgagctgctgtaggagcctg

SEQ ID NO: 184832 - DNA, 23 bp, Mus musculus
gccagactcagtctttctctctc

SEQ ID NO: 184833 - DNA, 22 bp, Mus musculus
tagaatgttcaaggaatcctgt

SEQ ID NO: 184834 - DNA, 23 bp, Mus musculus
ctgtctgtctgtctgtgcgtgag

SEQ ID NO: 184835 - DNA, 18 bp, Mus musculus
tcctgggaattgaacctg

SEQ ID NO: 184836 - DNA, 23 bp, Mus musculus
tctgtagtacagcttgaggtctg

SEQ ID NO: 184837 - DNA, 23 bp, Mus musculus
tgggagaagagacggtggagact

SEQ ID NO: 184838 - DNA, 19 bp, Mus musculus
tcacttctacctgtaccca

SEQ ID NO: 184839 - DNA, 23 bp, Mus musculus
agatatattgtaaggggttggag

SEQ ID NO: 184840 - DNA, 23 bp, Mus musculus
tcacaggcttttcactctgtcct

SEQ ID NO: 184841 - DNA, 23 bp, Mus musculus
atacagtactgtgaatccagagc

SEQ ID NO: 184842 - DNA, 23 bp, Mus musculus
tgtgagtctgtgtatttgttctc

SEQ ID NO: 184843 - DNA, 23 bp, Mus musculus
tatccatctgtctgcatatgtta

SEQ ID NO: 184844 - DNA, 23 bp, Mus musculus
gtctgtggtcctgctgcagctgg

SEQ ID NO: 184845 - DNA, 23 bp, Mus musculus
tgtctctgtgtctcaatttccct

SEQ ID NO: 184846 - DNA, 22 bp, Mus musculus
gactagagtcagagtcagagtc

SEQ ID NO: 184847 - DNA, 22 bp, Mus musculus
tctgtcactgtgataaagcact

SEQ ID NO: 184848 - DNA, 22 bp, Mus musculus
tgttttgtgaccaattatatgg

SEQ ID NO: 184849 - DNA, 23 bp, Mus musculus
tgcagcttgttcttcatgtaagt

SEQ ID NO: 184850 - DNA, 23 bp, Mus musculus
tatcatagtgaagagattggagg

SEQ ID NO: 184851 - DNA, 22 bp, Mus musculus
tgttttgtgaccaattatatgg

SEQ ID NO: 184852 - DNA, 23 bp, Mus musculus
gtgattgtgtgtgtgtgtgcgcg

SEQ ID NO: 184853 - DNA, 19 bp, Mus musculus
acagctatcttagattgag

SEQ ID NO: 184854 - DNA, 22 bp, Mus musculus
ctaagaagagagcttttgaggt

SEQ ID NO: 184855 - DNA, 22 bp, Mus musculus
aaacatgtggatattatgacaa

SEQ ID NO: 184856 - DNA, 23 bp, Mus musculus
tgtatgtatgtatgtatgtatgt

SEQ ID NO: 184857 - DNA, 23 bp, Mus musculus
tgccacttcagactcactgactg

SEQ ID NO: 184858 - DNA, 20 bp, Mus musculus
tctgagcttgctgaggtggt

SEQ ID NO: 184859 - DNA, 22 bp, Mus musculus
tgttttgtgaccaattatatgg

SEQ ID NO: 184860 - DNA, 23 bp, Mus musculus
cccactctgagacaaaggggtaa

SEQ ID NO: 184861 - DNA, 22 bp, Mus musculus
tgttttgtgaccaattatatgg

SEQ ID NO: 184862 - DNA, 22 bp, Mus musculus
gagtgtgaatgtgtgtgcatgc

SEQ ID NO: 184863 - DNA, 23 bp, Mus musculus
tgtgcatgtatctctgtgtgcat

SEQ ID NO: 184864 - DNA, 23 bp, Mus musculus
tgtctctccatgatctaagcttc

SEQ ID NO: 184865 - DNA, 21 bp, Mus musculus
tgtcttctttcaggaaaggat

SEQ ID NO: 184866 - DNA, 23 bp, Mus musculus
tgtgcatgtaagtgtgtatgtat

SEQ ID NO: 184867 - DNA, 23 bp, Mus musculus
atgttcacatccagtatgttgac

SEQ ID NO: 184868 - DNA, 22 bp, Mus musculus
aattaatgaagaagttctttta

SEQ ID NO: 184869 - DNA, 22 bp, Mus musculus
tgttttgtgaccaattatatgg

SEQ ID NO: 184870 - DNA, 23 bp, Mus musculus
ctgagaggctctgtcagtgcctg

SEQ ID NO: 184871 - DNA, 21 bp, Mus musculus
agcaccaattaaattttgtat

SEQ ID NO: 184872 - DNA, 23 bp, Mus musculus
tataagacttgcattggtcatgg

SEQ ID NO: 184873 - DNA, 23 bp, Mus musculus
tagtccatggtgatctgatagga

SEQ ID NO: 184874 - DNA, 23 bp, Mus musculus
tgttttgttttcaattagatggt

SEQ ID NO: 184875 - DNA, 22 bp, Mus musculus
tgttttgtgaccaattatatgg

SEQ ID NO: 184876 - DNA, 23 bp, Mus musculus
gagaagagacattatggttagga

SEQ ID NO: 184877 - DNA, 21 bp, Mus musculus
atatgtatgtatgtatatttc

SEQ ID NO: 184878 - DNA, 22 bp, Mus musculus
ttttcatatttatccaatgtct

SEQ ID NO: 184879 - DNA, 23 bp, Mus musculus
ctggatcaagcatatggtagatt

SEQ ID NO: 184880 - DNA, 22 bp, Mus musculus
gtggctggtaaagaatttctcc

SEQ ID NO: 184881 - DNA, 18 bp, Mus musculus
gagagaagaatgagacca

SEQ ID NO: 184882 - DNA, 21 bp, Mus musculus
agagtttgcatggttatgtca

SEQ ID NO: 184883 - DNA, 22 bp, Mus musculus
tctgtgcttggacatgggaagg

SEQ ID NO: 184884 - DNA, 23 bp, Mus musculus
aatgtgtatatatatgtgtgtgt

SEQ ID NO: 184885 - DNA, 23 bp, Mus musculus
atcaactgtagtgtggagtttgg

SEQ ID NO: 184886 - DNA, 23 bp, Mus musculus
gccagatcttcactgtgcttgtc

SEQ ID NO: 184887 - DNA, 21 bp, Mus musculus
tagagagaagtgagtgtccgc

SEQ ID NO: 184888 - DNA, 20 bp, Mus musculus
aagagcactgactgctcttc

SEQ ID NO: 184889 - DNA, 19 bp, Mus musculus
ctcactgtctctgtccatc

SEQ ID NO: 184890 - DNA, 20 bp, Mus musculus
actctctgactcacttgata

SEQ ID NO: 184891 - DNA, 21 bp, Mus musculus
tcagtgaagtcttagagatgt

SEQ ID NO: 184892 - DNA, 19 bp, Mus musculus
agcacaagtgagtgtggac

SEQ ID NO: 184893 - DNA, 23 bp, Mus musculus
ttcaattctcagcaaccacatgg

SEQ ID NO: 184894 - DNA, 23 bp, Mus musculus
gaatcagagctcaactgtgtctg

SEQ ID NO: 184895 - DNA, 19 bp, Mus musculus
tgtgggtgttctacaggga

SEQ ID NO: 184896 - DNA, 21 bp, Mus musculus
acagtcactgtgtgacagcct

SEQ ID NO: 184897 - DNA, 23 bp, Mus musculus
tctaaagtcctagctgtcctgga

SEQ ID NO: 184898 - DNA, 23 bp, Mus musculus
taagaacaagctctgactggtga

SEQ ID NO: 184899 - DNA, 19 bp, Mus musculus
tcccagtcttcgggtgtgt

SEQ ID NO: 184900 - DNA, 23 bp, Mus musculus
agagctacactcacactctcgga

SEQ ID NO: 184901 - DNA, 23 bp, Mus musculus
aatactgtgtttgttcatgtggt

SEQ ID NO: 184902 - DNA, 22 bp, Mus musculus
caaactgtgcagttcacagtca

SEQ ID NO: 184903 - DNA, 22 bp, Mus musculus
cagtgtctgtctgtctgtctcc

SEQ ID NO: 184904 - DNA, 20 bp, Mus musculus
tctgactgtgagtttctgag

SEQ ID NO: 184905 - DNA, 23 bp, Mus musculus
tcgctcgctcgctcgctctctcg

SEQ ID NO: 184906 - DNA, 23 bp, Mus musculus
atgtatgtacatgttcaggtgtt

SEQ ID NO: 184907 - DNA, 23 bp, Mus musculus
gtgtctgtcagcgtctgtcagtg

SEQ ID NO: 184908 - DNA, 23 bp, Mus musculus
tgtgacagactgctgtgagctgt

SEQ ID NO: 184909 - DNA, 23 bp, Mus musculus
agagagatgagagagagcaagac

SEQ ID NO: 184910 - DNA, 20 bp, Mus musculus
tgcagagtgagcagaaccct

SEQ ID NO: 184911 - DNA, 19 bp, Mus musculus
ctgacttttctcactctgc

SEQ ID NO: 184912 - DNA, 23 bp, Mus musculus
ctcactctgtcagtgttttatga

SEQ ID NO: 184913 - DNA, 23 bp, Mus musculus
agagagatgagagagagcaagac

SEQ ID NO: 184914 - DNA, 21 bp, Mus musculus
aactgactgctcttccagagg

SEQ ID NO: 184915 - DNA, 23 bp, Mus musculus
tctgcctctgcctctgcctctgc

SEQ ID NO: 184916 - DNA, 21 bp, Mus musculus
agagaacatgcacacacaatt

SEQ ID NO: 184917 - DNA, 18 bp, Mus musculus
aggatagtagaacacaga

SEQ ID NO: 184918 - DNA, 21 bp, Mus musculus
tggctcccagcctgtaagcca

SEQ ID NO: 184919 - DNA, 19 bp, Mus musculus
aaagcacagtgaggtttga

SEQ ID NO: 184920 - DNA, 22 bp, Mus musculus
ttaagagcactgactgctcttc

SEQ ID NO: 184921 - DNA, 23 bp, Mus musculus
ctgtcctcactgtctgacatgcc

SEQ ID NO: 184922 - DNA, 20 bp, Mus musculus
agtggaatatgtatatatgt

SEQ ID NO: 184923 - DNA, 22 bp, Mus musculus
tgtgtatatatgtatatatgtg

SEQ ID NO: 184924 - DNA, 21 bp, Mus musculus
aaaggctgtaggacaattctg

SEQ ID NO: 184925 - DNA, 22 bp, Mus musculus
atagtacatgacttaggaacag

SEQ ID NO: 184926 - DNA, 23 bp, Mus musculus
agacttgctaagagtatgttata

SEQ ID NO: 184927 - DNA, 23 bp, Mus musculus
tgtgtcactgacttaatcatcac

SEQ ID NO: 184928 - DNA, 23 bp, Mus musculus
ccttgaactaagaactctacctg

SEQ ID NO: 184929 - DNA, 20 bp, Mus musculus
atgcatgtgtgtctgtgtat

SEQ ID NO: 184930 - DNA, 19 bp, Mus musculus
atgtaagcatgcatgtgtg

SEQ ID NO: 184931 - DNA, 23 bp, Mus musculus
catcacagtgtcttagttagggt

SEQ ID NO: 184932 - DNA, 21 bp, Mus musculus
tgtgaagagacacaatgacct

SEQ ID NO: 184933 - DNA, 23 bp, Mus musculus
gtctgtctgtctgtctatcatgg

SEQ ID NO: 184934 - DNA, 23 bp, Mus musculus
tggctcagtagttaagaacactg

SEQ ID NO: 184935 - DNA, 23 bp, Mus musculus
tcaggactgtctgtctgtctgtc

SEQ ID NO: 184936 - DNA, 18 bp, Mus musculus
ctagattccctgcagacc

SEQ ID NO: 184937 - DNA, 23 bp, Mus musculus
tggatgtgtgcctatgtacatgc

SEQ ID NO: 184938 - DNA, 22 bp, Mus musculus
tttcactcactttgttctctct

SEQ ID NO: 184939 - DNA, 23 bp, Mus musculus
tgtgtgcctgtgtgactgtctgc

SEQ ID NO: 184940 - DNA, 23 bp, Mus musculus
cttgtctagagaaattcttgatg

SEQ ID NO: 184941 - DNA, 19 bp, Mus musculus
aatcagtttatccactgca

SEQ ID NO: 184942 - DNA, 23 bp, Mus musculus
tccctctgactcacagtgccctc

SEQ ID NO: 184943 - DNA, 20 bp, Mus musculus
aagcagagagaagaagaagc

SEQ ID NO: 184944 - DNA, 20 bp, Mus musculus
ctattggtgagagtggagta

SEQ ID NO: 184945 - DNA, 23 bp, Mus musculus
atcatgagagtcagcacacagtg

SEQ ID NO: 184946 - DNA, 23 bp, Mus musculus
agatggactcactctgtggctca

SEQ ID NO: 184947 - DNA, 19 bp, Mus musculus
agttcaattcccagcaatc

SEQ ID NO: 184948 - DNA, 23 bp, Mus musculus
gacttgccttggtcatggtgtct

SEQ ID NO: 184949 - DNA, 23 bp, Mus musculus
tctctcactgtcatcatatctgt

SEQ ID NO: 184950 - DNA, 19 bp, Mus musculus
caagtggcaaatgtgttct

SEQ ID NO: 184951 - DNA, 23 bp, Mus musculus
tctgcctgtctcccacccactga

SEQ ID NO: 184952 - DNA, 23 bp, Mus musculus
gtatgcatgtatgtatgtatgta

SEQ ID NO: 184953 - DNA, 19 bp, Mus musculus
tgtatgcatgtatgtatgc

SEQ ID NO: 184954 - DNA, 23 bp, Mus musculus
tctctcactgagcctcagtttcc

SEQ ID NO: 184955 - DNA, 23 bp, Mus musculus
tgcaaatgttgcttctctgggcc

SEQ ID NO: 184956 - DNA, 23 bp, Mus musculus
aagagcactgactgctctttcag

SEQ ID NO: 184957 - DNA, 23 bp, Mus musculus
tgagtgtgtatatgtatgtgtgt

SEQ ID NO: 184958 - DNA, 23 bp, Mus musculus
tgtgtgtgcatatgtatgcatat

SEQ ID NO: 184959 - DNA, 22 bp, Mus musculus
tgtgtgcatatgtatgcatatg

SEQ ID NO: 184960 - DNA, 22 bp, Mus musculus
tgtgtgcatatgtatgcatatg

SEQ ID NO: 184961 - DNA, 23 bp, Mus musculus
atgtgtgtacacatgtgtgtatg

SEQ ID NO: 184962 - DNA, 23 bp, Mus musculus
ccctggctctgtgtgtctgtaag

SEQ ID NO: 184963 - DNA, 21 bp, Mus musculus
gtgacagacagatgggagtgt

SEQ ID NO: 184964 - DNA, 23 bp, Mus musculus
tctgtggctctctgcctgccaca

SEQ ID NO: 184965 - DNA, 23 bp, Mus musculus
tgagcttctgactaactgtctct

SEQ ID NO: 184966 - DNA, 23 bp, Mus musculus
atatgtgtgtatatgtatatatg

SEQ ID NO: 184967 - DNA, 18 bp, Mus musculus
gtaggtgacagtcagcat

SEQ ID NO: 184968 - DNA, 22 bp, Mus musculus
tatttcaggagggagctggaga

SEQ ID NO: 184969 - DNA, 23 bp, Mus musculus
gtgactcacaaacaccattgaaa

SEQ ID NO: 184970 - DNA, 21 bp, Mus musculus
gctctgtgtgtgtgtgtctcc

SEQ ID NO: 184971 - DNA, 23 bp, Mus musculus
actcaatctctctgtgtgtcgcc

SEQ ID NO: 184972 - DNA, 23 bp, Mus musculus
agactctgaacagaggtgtgtag

SEQ ID NO: 184973 - DNA, 23 bp, Mus musculus
ctgtctgtctgtctgtgttcatg

SEQ ID NO: 184974 - DNA, 23 bp, Mus musculus
acagggtttctctgtgtagctct

SEQ ID NO: 184975 - DNA, 23 bp, Mus musculus
cccaggctctctgtttctctctg

SEQ ID NO: 184976 - DNA, 23 bp, Mus musculus
gtctgtccctgtctgtctgttct

SEQ ID NO: 184977 - DNA, 22 bp, Mus musculus
ctcacaccgtgtgtgactggct

SEQ ID NO: 184978 - DNA, 23 bp, Mus musculus
gagtccctgcctgcctcaatcac

SEQ ID NO: 184979 - DNA, 23 bp, Mus musculus
tgttactcccactctctgactct

SEQ ID NO: 184980 - DNA, 21 bp, Mus musculus
acacactttgtctctctccat

SEQ ID NO: 184981 - DNA, 23 bp, Mus musculus
ttctcagggtctagaatccagca

SEQ ID NO: 184982 - DNA, 23 bp, Mus musculus
aacactctgcctctgggtctctg

SEQ ID NO: 184983 - DNA, 20 bp, Mus musculus
tgtatatgtgtatatgatat

SEQ ID NO: 184984 - DNA, 22 bp, Mus musculus
gcacaggaatacagtcacttca

SEQ ID NO: 184985 - DNA, 19 bp, Mus musculus
tctgtttggcttggctttg

SEQ ID NO: 184986 - DNA, 23 bp, Mus musculus
ggctctttctgtacttccacagg

SEQ ID NO: 184987 - DNA, 23 bp, Mus musculus
aagaagtttgtggctgactgtga

SEQ ID NO: 184988 - DNA, 23 bp, Mus musculus
tcaaatgaagtgtgttcttgggt

SEQ ID NO: 184989 - DNA, 22 bp, Mus musculus
taaaatttgacctagagatact

SEQ ID NO: 184990 - DNA, 20 bp, Mus musculus
aagttctcagtttttgaata

SEQ ID NO: 184991 - DNA, 23 bp, Mus musculus
ctggctcactctctggctcacaa

SEQ ID NO: 184992 - DNA, 23 bp, Mus musculus
atgtatgtatgtatgtatgtatg

SEQ ID NO: 184993 - DNA, 23 bp, Mus musculus
taagagcactgactgctcttcca

SEQ ID NO: 184994 - DNA, 19 bp, Mus musculus
acactgagcaagtggagac

SEQ ID NO: 184995 - DNA, 20 bp, Mus musculus
tctcactgctcactgtctca

SEQ ID NO: 184996 - DNA, 23 bp, Mus musculus
tgtgtgtgtgtgtatattcatat

SEQ ID NO: 184997 - DNA, 23 bp, Mus musculus
atacatgtgtgtatgtatgcatg

SEQ ID NO: 184998 - DNA, 23 bp, Mus musculus
gtctggctgtgggtctctgtgtc

SEQ ID NO: 184999 - DNA, 22 bp, Mus musculus
tcacagagcagacactctcggg

SEQ ID NO: 185000 - DNA, 23 bp, Mus musculus
gcgatctgtgtgtctctgtggca

SEQ ID NO: 185001 - DNA, 23 bp, Mus musculus
gatgggtcggtcggtctgtctct

SEQ ID NO: 185002 - DNA, 22 bp, Mus musculus
gagtctcctaatgattgctgtg

SEQ ID NO: 185003 - DNA, 23 bp, Mus musculus
acgagcactgactgctcttccag

SEQ ID NO: 185004 - DNA, 22 bp, Mus musculus
atggttagaaatcttgactgtt

SEQ ID NO: 185005 - DNA, 20 bp, Mus musculus
tgttaagatttttaccatac

SEQ ID NO: 185006 - DNA, 22 bp, Mus musculus
tgttttgtgaccaattatatgg

SEQ ID NO: 185007 - DNA, 21 bp, Mus musculus
acattgctatagaacctgttg

SEQ ID NO: 185008 - DNA, 21 bp, Mus musculus
tcaggtgttgttatgcatgtg

SEQ ID NO: 185009 - DNA, 22 bp, Mus musculus
tgttttgtgaccaattatatgg

SEQ ID NO: 185010 - DNA, 23 bp, Mus musculus
tatgtatgtatatgaaaacacat

SEQ ID NO: 185011 - DNA, 23 bp, Mus musculus
atgaatgcatgtgcatgtatgca

SEQ ID NO: 185012 - DNA, 23 bp, Mus musculus
atgtgtcttcctctctttgactc

SEQ ID NO: 185013 - DNA, 22 bp, Mus musculus
tgttttgtgaccaattatatgg

SEQ ID NO: 185014 - DNA, 23 bp, Mus musculus
ctgggactttttgacattgtttg

SEQ ID NO: 185015 - DNA, 22 bp, Mus musculus
tgttttgtgaccaattatatgg

SEQ ID NO: 185016 - DNA, 23 bp, Mus musculus
tactgcatggtgatctgatagga

SEQ ID NO: 185017 - DNA, 22 bp, Mus musculus
tgttttgtgacctattatgtgg

SEQ ID NO: 185018 - DNA, 20 bp, Mus musculus
tgtgacatcagtgagaggag

SEQ ID NO: 185019 - DNA, 22 bp, Mus musculus
tgttttgtgaccaattatatgg

SEQ ID NO: 185020 - DNA, 22 bp, Mus musculus
tggttatatatggtatagatgc

SEQ ID NO: 185021 - DNA, 22 bp, Mus musculus
tgttttgtgaccaattatatgg

SEQ ID NO: 185022 - DNA, 21 bp, Mus musculus
aacagttcagatattgtagat

SEQ ID NO: 185023 - DNA, 23 bp, Mus musculus
atgaactgattttgttttcattt

SEQ ID NO: 185024 - DNA, 23 bp, Mus musculus
tgtattatcacaatgtttatctt

SEQ ID NO: 185025 - DNA, 22 bp, Mus musculus
tgttttgtgaccaattatatgg

SEQ ID NO: 185026 - DNA, 23 bp, Mus musculus
acttactatggtctttgtagggt

SEQ ID NO: 185027 - DNA, 23 bp, Mus musculus
gggctgtctctgactctgtgacc

SEQ ID NO: 185028 - DNA, 22 bp, Mus musculus
tgtatgtatgtatatatgtatg

SEQ ID NO: 185029 - DNA, 20 bp, Mus musculus
gtatatgtgtgtatatgtat

SEQ ID NO: 185030 - DNA, 23 bp, Mus musculus
cactggctgtgtggcactctggc

SEQ ID NO: 185031 - DNA, 23 bp, Mus musculus
cttgtcacagtgtcacctgccag

SEQ ID NO: 185032 - DNA, 23 bp, Mus musculus
acagtctcaggttgatgtcatgt

SEQ ID NO: 185033 - DNA, 21 bp, Mus musculus
ggtgtcaaaagacagtctgct

SEQ ID NO: 185034 - DNA, 21 bp, Mus musculus
cttctctgaggatggctgagc

SEQ ID NO: 185035 - DNA, 20 bp, Mus musculus
ctaaggtcatgagagtgaag

SEQ ID NO: 185036 - DNA, 23 bp, Mus musculus
atgcatatacatgtatatgtgtg

SEQ ID NO: 185037 - DNA, 23 bp, Mus musculus
gggggtctcactgtcagtcagag

SEQ ID NO: 185038 - DNA, 23 bp, Mus musculus
ctcactctcactggccttgagct

SEQ ID NO: 185039 - DNA, 22 bp, Mus musculus
aataaatgtgtagaaagtgcag

SEQ ID NO: 185040 - DNA, 22 bp, Mus musculus
ttcctgcttaataagaaaccag

SEQ ID NO: 185041 - DNA, 22 bp, Mus musculus
tctgagacagtcttgctgtata

SEQ ID NO: 185042 - DNA, 19 bp, Mus musculus
gtgcccatactgtgtctgt

SEQ ID NO: 185043 - DNA, 18 bp, Mus musculus
gggtgatgaacctgtaca

SEQ ID NO: 185044 - DNA, 19 bp, Mus musculus
ttttcagagcttttgcaga

SEQ ID NO: 185045 - DNA, 23 bp, Mus musculus
gaacatgacatcgttttctgtgt

SEQ ID NO: 185046 - DNA, 23 bp, Mus musculus
ccaaggagacagaagtcagtgac

SEQ ID NO: 185047 - DNA, 23 bp, Mus musculus
ctgaatacaattgcaactgaatt

SEQ ID NO: 185048 - DNA, 21 bp, Mus musculus
cttctctctctggcttcctgg

SEQ ID NO: 185049 - DNA, 19 bp, Mus musculus
ttaggagtccatggagaac

SEQ ID NO: 185050 - DNA, 19 bp, Mus musculus
agtgcttgaaagttctttt

SEQ ID NO: 185051 - DNA, 21 bp, Mus musculus
tcagagtcaggcttgcttctt

SEQ ID NO: 185052 - DNA, 20 bp, Mus musculus
ctgactggctctttgactct

SEQ ID NO: 185053 - DNA, 22 bp, Mus musculus
ggcagatctctgtgagctcaag

SEQ ID NO: 185054 - DNA, 23 bp, Mus musculus
agagagctgagagtgaagaaact

SEQ ID NO: 185055 - DNA, 23 bp, Mus musculus
atcattctaatctggctgtgaag

SEQ ID NO: 185056 - DNA, 23 bp, Mus musculus
tgcctgcctgcctgcctgcctgc

SEQ ID NO: 185057 - DNA, 19 bp, Mus musculus
tgtacatgcatgtgtgtgc

SEQ ID NO: 185058 - DNA, 20 bp, Mus musculus
tatgtatgtacctgtgagtg

SEQ ID NO: 185059 - DNA, 22 bp, Mus musculus
tgttttgtgaccaattatatgg

SEQ ID NO: 185060 - DNA, 22 bp, Mus musculus
tacaaagtatttttatagtgtt

SEQ ID NO: 185061 - DNA, 23 bp, Mus musculus
attagaccatttgatatctgcaa

SEQ ID NO: 185062 - DNA, 23 bp, Mus musculus
ccagtctgtagtcattttcttga

SEQ ID NO: 185063 - DNA, 21 bp, Mus musculus
tatgtgtatatgtgtatgcat

SEQ ID NO: 185064 - DNA, 23 bp, Mus musculus
tatgtatatgaatatgtatatgt

SEQ ID NO: 185065 - DNA, 22 bp, Mus musculus
tgttttgtgaccaattatatgg

SEQ ID NO: 185066 - DNA, 19 bp, Mus musculus
tgttaagttgttagtatga

SEQ ID NO: 185067 - DNA, 22 bp, Mus musculus
tcatctctctcactgtttcttt

SEQ ID NO: 185068 - DNA, 21 bp, Mus musculus
tgaacagaacgaggagaatgc

SEQ ID NO: 185069 - DNA, 19 bp, Mus musculus
tgccaagcagtggctgtct

SEQ ID NO: 185070 - DNA, 21 bp, Mus musculus
agggactcagaatcactcctc

SEQ ID NO: 185071 - DNA, 22 bp, Mus musculus
aggctcactccctctctccaag

SEQ ID NO: 185072 - DNA, 23 bp, Mus musculus
ctgcctctgactgtcggtgtctc

SEQ ID NO: 185073 - DNA, 23 bp, Mus musculus
actcactgtctggctcatgattt

SEQ ID NO: 185074 - DNA, 23 bp, Mus musculus
tgagtatgtatgtattatgcatg

SEQ ID NO: 185075 - DNA, 23 bp, Mus musculus
cctgtctctctcagactcaagag

SEQ ID NO: 185076 - DNA, 21 bp, Mus musculus
ttctatttatataagtcttga

SEQ ID NO: 185077 - DNA, 23 bp, Mus musculus
tggtatgttgtctgggtggaagc

SEQ ID NO: 185078 - DNA, 22 bp, Mus musculus
acagtcagagcaaatgtggact

SEQ ID NO: 185079 - DNA, 23 bp, Mus musculus
gtgtgtgactgtgtgtgtgtgca

SEQ ID NO: 185080 - DNA, 22 bp, Mus musculus
gtatgtatgtatgcatgtgttt

SEQ ID NO: 185081 - DNA, 23 bp, Mus musculus
aggtaagcagatgtctgtgagtt

SEQ ID NO: 185082 - DNA, 23 bp, Mus musculus
ttcagaacagtcagagctgtgta

SEQ ID NO: 185083 - DNA, 23 bp, Mus musculus
gtctgtctgtctgtcggtcggtc

SEQ ID NO: 185084 - DNA, 23 bp, Mus musculus
tgtgtgcgtgtgtgcgtgcatgt

SEQ ID NO: 185085 - DNA, 22 bp, Mus musculus
tgttttgtgaccaattatatgg

SEQ ID NO: 185086 - DNA, 22 bp, Mus musculus
tctcagagctgtgtgtggacag

SEQ ID NO: 185087 - DNA, 23 bp, Mus musculus
tgtgtgtgtgcatgtgcgtgtgc

SEQ ID NO: 185088 - DNA, 23 bp, Mus musculus
atctgtgtgtgtatctgtgtgtt

SEQ ID NO: 185089 - DNA, 20 bp, Mus musculus
ttaaacttgaggctgttgaa

SEQ ID NO: 185090 - DNA, 21 bp, Mus musculus
tgctacagcaattctaagtag

SEQ ID NO: 185091 - DNA, 23 bp, Mus musculus
atatacgtatatatacacatgtg

SEQ ID NO: 185092 - DNA, 23 bp, Mus musculus
tcaggatgggtaatgtctgtgag

SEQ ID NO: 185093 - DNA, 23 bp, Mus musculus
gtcacattcactcaggctaagga

SEQ ID NO: 185094 - DNA, 23 bp, Mus musculus
tcacttttgaaaagactcatctc

SEQ ID NO: 185095 - DNA, 19 bp, Mus musculus
tgtgtctgtctgtcaattc

SEQ ID NO: 185096 - DNA, 23 bp, Mus musculus
gccacagtctctgtcagtggccg

SEQ ID NO: 185097 - DNA, 21 bp, Mus musculus
tagagtttgaactgtgcatgg

SEQ ID NO: 185098 - DNA, 21 bp, Mus musculus
tcatgcaaatagtccgagctg

SEQ ID NO: 185099 - DNA, 18 bp, Mus musculus
tcaggctggagagatggc

SEQ ID NO: 185100 - DNA, 23 bp, Mus musculus
tattctgtgtattatagttgctt

SEQ ID NO: 185101 - DNA, 23 bp, Mus musculus
tgagtgtgtcactgtgtctgagg

SEQ ID NO: 185102 - DNA, 21 bp, Mus musculus
tctgacactcaacactgacgg

SEQ ID NO: 185103 - DNA, 18 bp, Mus musculus
tatgtatgtatgtatgta

SEQ ID NO: 185104 - DNA, 23 bp, Mus musculus
gtatgaatgtatgtatgtatgtg

SEQ ID NO: 185105 - DNA, 23 bp, Mus musculus
gtgtgtgtgtgtgtttttcaaga

SEQ ID NO: 185106 - DNA, 23 bp, Mus musculus
tgtgtgtgtgtgtaagtgcctac

SEQ ID NO: 185107 - DNA, 23 bp, Mus musculus
acagtgtgtggttatgtaggtga

SEQ ID NO: 185108 - DNA, 23 bp, Mus musculus
attctcagcagccatatgatggc

SEQ ID NO: 185109 - DNA, 23 bp, Mus musculus
cttgttgcactactgtgggcctg

SEQ ID NO: 185110 - DNA, 23 bp, Mus musculus
aatgcagtggcatttgtgtttgt

SEQ ID NO: 185111 - DNA, 23 bp, Mus musculus
acagcctctgcctctgtctcctg

SEQ ID NO: 185112 - DNA, 19 bp, Mus musculus
aagagcactgactgctctt

SEQ ID NO: 185113 - DNA, 23 bp, Mus musculus
acatagaacagagatagcacttg

SEQ ID NO: 185114 - DNA, 19 bp, Mus musculus
gaggctgagagaatgttca

SEQ ID NO: 185115 - DNA, 23 bp, Mus musculus
ctgtctgtctgtctgtctgcctg

SEQ ID NO: 185116 - DNA, 20 bp, Mus musculus
tggcagttctgtgtgacctc

SEQ ID NO: 185117 - DNA, 23 bp, Mus musculus
tttgagagagaagagagagccct

SEQ ID NO: 185118 - DNA, 22 bp, Mus musculus
cactgatgagagtgagctgttg

SEQ ID NO: 185119 - DNA, 23 bp, Mus musculus
aaaagcactgactgctcttccag

SEQ ID NO: 185120 - DNA, 21 bp, Mus musculus
atggctcagtggttagaagca

SEQ ID NO: 185121 - DNA, 23 bp, Mus musculus
tctgtctatatatatatgtgcat

SEQ ID NO: 185122 - DNA, 23 bp, Mus musculus
atgtatgtataagtgtatgtata

SEQ ID NO: 185123 - DNA, 23 bp, Mus musculus
aagtagaagcttgaaaagttctc

SEQ ID NO: 185124 - DNA, 23 bp, Mus musculus
atccgggcagggttacatgtgtt

SEQ ID NO: 185125 - DNA, 22 bp, Mus musculus
tgatctgtcattttgttgagct

SEQ ID NO: 185126 - DNA, 23 bp, Mus musculus
tgtctgtctgtctgtctgtctgg

SEQ ID NO: 185127 - DNA, 23 bp, Mus musculus
ctgtcacactgggtgtaacttga

SEQ ID NO: 185128 - DNA, 23 bp, Mus musculus
caggctggcttcaaagtcgcaga

SEQ ID NO: 185129 - DNA, 23 bp, Mus musculus
tgcctctgtctctgagtgctagg

SEQ ID NO: 185130 - DNA, 23 bp, Mus musculus
tgtgtcagtgggtgttgttctgg

SEQ ID NO: 185131 - DNA, 23 bp, Mus musculus
tggttgtgactcactgtgtgggt

SEQ ID NO: 185132 - DNA, 21 bp, Mus musculus
tttttatttctgaggatgaag

SEQ ID NO: 185133 - DNA, 23 bp, Mus musculus
tagtgcatggtgatctgatagga

SEQ ID NO: 185134 - DNA, 22 bp, Mus musculus
tcaatatttttgtatctgttga

SEQ ID NO: 185135 - DNA, 23 bp, Mus musculus
tttgtgaccaattgtatgctcaa

SEQ ID NO: 185136 - DNA, 23 bp, Mus musculus
ttttgtgaccaattatatggtca

SEQ ID NO: 185137 - DNA, 22 bp, Mus musculus
tgttttgtgaccaattatatgg

SEQ ID NO: 185138 - DNA, 20 bp, Mus musculus
acagagacagaaaagcatct

SEQ ID NO: 185139 - DNA, 23 bp, Mus musculus
tctcagtgtctatctgtctgtct

SEQ ID NO: 185140 - DNA, 23 bp, Mus musculus
acccaggctgtgctagaactcag

SEQ ID NO: 185141 - DNA, 20 bp, Mus musculus
acagagccagaaaagcatct

SEQ ID NO: 185142 - DNA, 23 bp, Mus musculus
tctcagtgtctatctgtctgtct

SEQ ID NO: 185143 - DNA, 23 bp, Mus musculus
acccaggctgtgctagaactcag

SEQ ID NO: 185144 - DNA, 23 bp, Mus musculus
tttgtgaccaattgtatgctcaa

SEQ ID NO: 185145 - DNA, 22 bp, Mus musculus
tgttttgtgaccaattatatgg

SEQ ID NO: 185146 - DNA, 23 bp, Mus musculus
tcactgtcagccccacatttttc

SEQ ID NO: 185147 - DNA, 21 bp, Mus musculus
tgtgtctctgtttagtttctg

SEQ ID NO: 185148 - DNA, 23 bp, Mus musculus
tatgagatcttggttcagtgtca

SEQ ID NO: 185149 - DNA, 23 bp, Mus musculus
tggaatatatatatgtatgtatg

SEQ ID NO: 185150 - DNA, 23 bp, Mus musculus
gctcttactctcggagtcatatc

SEQ ID NO: 185151 - DNA, 21 bp, Mus musculus
ttgacttcagtctgtgtgtgg

SEQ ID NO: 185152 - DNA, 22 bp, Mus musculus
ttcggtcagcaagttctgccaa

SEQ ID NO: 185153 - DNA, 22 bp, Mus musculus
tgttttgtgaccaattatatgg

SEQ ID NO: 185154 - DNA, 23 bp, Mus musculus
atctctgagcctcagtttcccca

SEQ ID NO: 185155 - DNA, 22 bp, Mus musculus
tgcctgagtctgatagatctga

SEQ ID NO: 185156 - DNA, 20 bp, Mus musculus
agcgtgtagagagtgagcac

SEQ ID NO: 185157 - DNA, 22 bp, Mus musculus
tcccagtctgttcttggatgtg

SEQ ID NO: 185158 - DNA, 20 bp, Mus musculus
ctgagttctctttctgtgcc

SEQ ID NO: 185159 - DNA, 23 bp, Mus musculus
atttctctctgtctctgggagag

SEQ ID NO: 185160 - DNA, 23 bp, Mus musculus
ctggctcagtggctcgctggctc

SEQ ID NO: 185161 - DNA, 22 bp, Mus musculus
tctctctgcctctgtggatggc

SEQ ID NO: 185162 - DNA, 23 bp, Mus musculus
gactgtctctgtgtgtccctctg

SEQ ID NO: 185163 - DNA, 22 bp, Mus musculus
agagagagagaataacaagtga

SEQ ID NO: 185164 - DNA, 20 bp, Mus musculus
tcaatgcgtgaagatagggg

SEQ ID NO: 185165 - DNA, 23 bp, Mus musculus
atgctgctctggggctggagaga

SEQ ID NO: 185166 - DNA, 19 bp, Mus musculus
cagcaaccatatagtgtct

SEQ ID NO: 185167 - DNA, 19 bp, Mus musculus
tcaggcagcctgtgatctc

SEQ ID NO: 185168 - DNA, 19 bp, Mus musculus
agagcctctgattgttctg

SEQ ID NO: 185169 - DNA, 18 bp, Mus musculus
tccagagctattcttggc

SEQ ID NO: 185170 - DNA, 23 bp, Mus musculus
tgggactctgacaggctcagtgg

SEQ ID NO: 185171 - DNA, 23 bp, Mus musculus
cagagtgagtcacagtcactgcc

SEQ ID NO: 185172 - DNA, 23 bp, Mus musculus
cagagtgagtcacagtcactgcc

SEQ ID NO: 185173 - DNA, 23 bp, Mus musculus
ttaaacatgtatgtgaaaatagg

SEQ ID NO: 185174 - DNA, 22 bp, Mus musculus
tagtgtgtgtgcatgtgcatgt

SEQ ID NO: 185175 - DNA, 23 bp, Mus musculus
agccagtgtgtctcactcagtgt

SEQ ID NO: 185176 - DNA, 23 bp, Mus musculus
taagcttcctcatcaaatggctg

SEQ ID NO: 185177 - DNA, 23 bp, Mus musculus
gtattctgactgtagttagtctc

SEQ ID NO: 185178 - DNA, 23 bp, Mus musculus
atttacttcatgtttcacatttg

SEQ ID NO: 185179 - DNA, 20 bp, Mus musculus
tcagaggcgttttccagggc

SEQ ID NO: 185180 - DNA, 23 bp, Mus musculus
tgtatgtatgtatgtatgtatgt

SEQ ID NO: 185181 - DNA, 23 bp, Mus musculus
tgccatttgactatctgtagaag

SEQ ID NO: 185182 - DNA, 21 bp, Mus musculus
atttatttctttagatagcat

SEQ ID NO: 185183 - DNA, 23 bp, Mus musculus
tattcctaggttgagaattcgtt

SEQ ID NO: 185184 - DNA, 22 bp, Mus musculus
actcacctctcagtctgtggct

SEQ ID NO: 185185 - DNA, 23 bp, Mus musculus
gtggtccagtgtctgcgagttct

SEQ ID NO: 185186 - DNA, 23 bp, Mus musculus
gtcattgactctgtgtcacctca

SEQ ID NO: 185187 - DNA, 20 bp, Mus musculus
ccatggtgatctgataggat

SEQ ID NO: 185188 - DNA, 23 bp, Mus musculus
ttttgtgaccaattgtatggtca

SEQ ID NO: 185189 - DNA, 20 bp, Mus musculus
gtttctggaagactagtgat

SEQ ID NO: 185190 - DNA, 19 bp, Mus musculus
tgttctcaaaagatcattc

SEQ ID NO: 185191 - DNA, 23 bp, Mus musculus
aaattgactttcaagttttgagc

SEQ ID NO: 185192 - DNA, 22 bp, Mus musculus
attaggaccaaagtgtcaacat

SEQ ID NO: 185193 - DNA, 21 bp, Mus musculus
tgtgcatttttgtttatgtct

SEQ ID NO: 185194 - DNA, 18 bp, Mus musculus
ataaccatacatatgaat

SEQ ID NO: 185195 - DNA, 22 bp, Mus musculus
tagcaacaaataaattctgtgt

SEQ ID NO: 185196 - DNA, 20 bp, Mus musculus
tttacttttttgatgagaat

SEQ ID NO: 185197 - DNA, 19 bp, Mus musculus
atgtattttcatgttaatc

SEQ ID NO: 185198 - DNA, 18 bp, Mus musculus
accaaaaatattctgtct

SEQ ID NO: 185199 - DNA, 21 bp, Mus musculus
tcaggaggaatttttttttct

SEQ ID NO: 185200 - DNA, 23 bp, Mus musculus
ccttcttctgctctctgtgtgca

SEQ ID NO: 185201 - DNA, 22 bp, Mus musculus
aatgtacatgcacacagacaga

SEQ ID NO: 185202 - DNA, 23 bp, Mus musculus
aactgcattaagaaagtctggaa

SEQ ID NO: 185203 - DNA, 22 bp, Mus musculus
tttcagaacagtcagatttgtg

SEQ ID NO: 185204 - DNA, 20 bp, Mus musculus
tatatgcatatataggtacg

SEQ ID NO: 185205 - DNA, 20 bp, Mus musculus
gagggagatatcagtgtaga

SEQ ID NO: 185206 - DNA, 19 bp, Mus musculus
tatgtatatgtatatgaat

SEQ ID NO: 185207 - DNA, 23 bp, Mus musculus
acatataaggttgcattccttag

SEQ ID NO: 185208 - DNA, 23 bp, Mus musculus
tatcttggtaactttcctaaaga

SEQ ID NO: 185209 - DNA, 20 bp, Mus musculus
aacagactcaaataaatgag

SEQ ID NO: 185210 - DNA, 21 bp, Mus musculus
tatagcttttatataaagtct

SEQ ID NO: 185211 - DNA, 21 bp, Mus musculus
tctctctttgtgtctgtgtct

SEQ ID NO: 185212 - DNA, 23 bp, Mus musculus
aaattctaagctgtgcatgtgtc

SEQ ID NO: 185213 - DNA, 23 bp, Mus musculus
atgaaaatccttctctcagtcta

SEQ ID NO: 185214 - DNA, 22 bp, Mus musculus
aatgagtgagatttactttttt

SEQ ID NO: 185215 - DNA, 23 bp, Mus musculus
ctatactgtaatacattatgtat

SEQ ID NO: 185216 - DNA, 20 bp, Mus musculus
ttcaaactatttgaaaagca

SEQ ID NO: 185217 - DNA, 22 bp, Mus musculus
tgttttgtgaccaattatatgg

SEQ ID NO: 185218 - DNA, 23 bp, Mus musculus
tatatgtgtgttgatgcacagat

SEQ ID NO: 185219 - DNA, 23 bp, Mus musculus
cttattctgtttttgtaaataag

SEQ ID NO: 185220 - DNA, 18 bp, Mus musculus
tgtgattatttaaatagg

SEQ ID NO: 185221 - DNA, 23 bp, Mus musculus
tgcctctctcacaaaatccgatt

SEQ ID NO: 185222 - DNA, 18 bp, Mus musculus
actctcttgaatgctctg

SEQ ID NO: 185223 - DNA, 22 bp, Mus musculus
aaagaagccattttgttgtagt

SEQ ID NO: 185224 - DNA, 22 bp, Mus musculus
tccatggtggtctgataggatg

SEQ ID NO: 185225 - DNA, 22 bp, Mus musculus
tgttttgtgaccaattatatgg

SEQ ID NO: 185226 - DNA, 23 bp, Mus musculus
ctgtctgtctgtctgtctgtctg

SEQ ID NO: 185227 - DNA, 23 bp, Mus musculus
tgtctctgtaactctttccatgg

SEQ ID NO: 185228 - DNA, 23 bp, Mus musculus
aatatatgtgtgtgtgtgtacat

SEQ ID NO: 185229 - DNA, 23 bp, Mus musculus
tagtccatggtgatctgatagga

SEQ ID NO: 185230 - DNA, 23 bp, Mus musculus
tctgaagactctcagactctcag

SEQ ID NO: 185231 - DNA, 19 bp, Mus musculus
aagaactgggagcttaaca

SEQ ID NO: 185232 - DNA, 23 bp, Mus musculus
atatataagtgaatgcatgttta

SEQ ID NO: 185233 - DNA, 23 bp, Mus musculus
taagtttctgcctcagtctgctc

SEQ ID NO: 185234 - DNA, 21 bp, Mus musculus
agtgagggaagagaacgggaa

SEQ ID NO: 185235 - DNA, 21 bp, Mus musculus
atgtccaagtttacctttcgt

SEQ ID NO: 185236 - DNA, 22 bp, Mus musculus
tgttttgtgaccaattatatgg

SEQ ID NO: 185237 - DNA, 23 bp, Mus musculus
cttcaatgtctctcattctcagt

SEQ ID NO: 185238 - DNA, 23 bp, Mus musculus
ttctatgtggaaaacaacctcct

SEQ ID NO: 185239 - DNA, 23 bp, Mus musculus
aagtttcaagttgttgtgttggg

SEQ ID NO: 185240 - DNA, 19 bp, Mus musculus
aagagtgtcaggttacctg

SEQ ID NO: 185241 - DNA, 23 bp, Mus musculus
tacaatatgtatatgtatgtaca

SEQ ID NO: 185242 - DNA, 23 bp, Mus musculus
tgagacagccagctttgttgacc

SEQ ID NO: 185243 - DNA, 22 bp, Mus musculus
tgttttgtgaccaattatatgg

SEQ ID NO: 185244 - DNA, 22 bp, Mus musculus
tgttttgtgaccaattatatgg

SEQ ID NO: 185245 - DNA, 23 bp, Mus musculus
tcaatctgtctgtctctgtacca

SEQ ID NO: 185246 - DNA, 23 bp, Mus musculus
taatagtgtgtgtatatgtatat

SEQ ID NO: 185247 - DNA, 22 bp, Mus musculus
tcatacatatacttatgatgtt

SEQ ID NO: 185248 - DNA, 23 bp, Mus musculus
tgcctgcctctgtctctgagtgc

SEQ ID NO: 185249 - DNA, 23 bp, Mus musculus
gagatgctccctctctgtcactc

SEQ ID NO: 185250 - DNA, 23 bp, Mus musculus
ttgtgtggaatattctctggttt

SEQ ID NO: 185251 - DNA, 19 bp, Mus musculus
tatatctgtgtgcatgtac

SEQ ID NO: 185252 - DNA, 23 bp, Mus musculus
tctctccctgtgtcttacatctg

SEQ ID NO: 185253 - DNA, 23 bp, Mus musculus
ctagtctccagaactgtcagttt

SEQ ID NO: 185254 - DNA, 18 bp, Mus musculus
actgtccctttcttttct

SEQ ID NO: 185255 - DNA, 23 bp, Mus musculus
ccagcctgtgtaagctcttagtg

SEQ ID NO: 185256 - DNA, 19 bp, Mus musculus
tctgttttctgaatgcaag

SEQ ID NO: 185257 - DNA, 23 bp, Mus musculus
tgtttagtttttttgatgcaatt

SEQ ID NO: 185258 - DNA, 21 bp, Mus musculus
aagtcacaacaaacagagctc

SEQ ID NO: 185259 - DNA, 22 bp, Mus musculus
tagcagacagcacatcaagctg

SEQ ID NO: 185260 - DNA, 19 bp, Mus musculus
tgcttggttgacaaggggt

SEQ ID NO: 185261 - DNA, 19 bp, Mus musculus
acacacgcatgtatatatg

SEQ ID NO: 185262 - DNA, 20 bp, Mus musculus
tgaactgcaattgagttcaa

SEQ ID NO: 185263 - DNA, 23 bp, Mus musculus
aatgtgcatgtacatgtgtgttt

SEQ ID NO: 185264 - DNA, 23 bp, Mus musculus
agcctgcctgactgcctgtcttg

SEQ ID NO: 185265 - DNA, 22 bp, Mus musculus
tgttttgtgaccaattatatgg

SEQ ID NO: 185266 - DNA, 22 bp, Mus musculus
tgttttgtgaccaattatatgg

SEQ ID NO: 185267 - DNA, 22 bp, Mus musculus
tgttttgtgaccaattatatgg

SEQ ID NO: 185268 - DNA, 23 bp, Mus musculus
ttttgagttaggatctttttgca

SEQ ID NO: 185269 - DNA, 23 bp, Mus musculus
tctgagattctttctccatctct

SEQ ID NO: 185270 - DNA, 22 bp, Mus musculus
tttctcagcgattaagagcagt

SEQ ID NO: 185271 - DNA, 22 bp, Mus musculus
tgttttgtgaccaattatatgg

SEQ ID NO: 185272 - DNA, 19 bp, Mus musculus
catggtggtctgataggat

SEQ ID NO: 185273 - DNA, 22 bp, Mus musculus
tgttttgtgaccaattatatgg

SEQ ID NO: 185274 - DNA, 23 bp, Mus musculus
gagactctccctgactctgttgc

SEQ ID NO: 185275 - DNA, 23 bp, Mus musculus
tatcagtgggagagaatgtgcct

SEQ ID NO: 185276 - DNA, 23 bp, Mus musculus
gacactgactgctcttccagagg

SEQ ID NO: 185277 - DNA, 22 bp, Mus musculus
tgttttgtgaccaattatatgg

SEQ ID NO: 185278 - DNA, 18 bp, Mus musculus
atgttggtctgataggat

SEQ ID NO: 185279 - DNA, 23 bp, Mus musculus
cagtggctgtcttgtgttgaagt

SEQ ID NO: 185280 - DNA, 19 bp, Mus musculus
taaagatggaggtgcgtgt

SEQ ID NO: 185281 - DNA, 21 bp, Mus musculus
tctgtctctatctctacgtat

SEQ ID NO: 185282 - DNA, 23 bp, Mus musculus
tgaagaagttactgtttttgtgg

SEQ ID NO: 185283 - DNA, 22 bp, Mus musculus
tgttttgtgaccaattatatgg

SEQ ID NO: 185284 - DNA, 23 bp, Mus musculus
tagcagacacaaaatcttgtggt

SEQ ID NO: 185285 - DNA, 23 bp, Mus musculus
tgttgagagatgttagggaccag

SEQ ID NO: 185286 - DNA, 23 bp, Mus musculus
ttttatgttgatatcttttcata

SEQ ID NO: 185287 - DNA, 18 bp, Mus musculus
ttatagtgtgttattgaa

SEQ ID NO: 185288 - DNA, 23 bp, Mus musculus
tgtcagtctgtgtatatacattg

SEQ ID NO: 185289 - DNA, 23 bp, Mus musculus
tcagctacatgtgagagctaact

SEQ ID NO: 185290 - DNA, 22 bp, Mus musculus
attaagaagttattgatgtata

SEQ ID NO: 185291 - DNA, 23 bp, Mus musculus
acccaaaggttcagaaattgcta

SEQ ID NO: 185292 - DNA, 19 bp, Mus musculus
tgaatacacacatatgtat

SEQ ID NO: 185293 - DNA, 23 bp, Mus musculus
gatcctgacagaactctgtgtgc

SEQ ID NO: 185294 - DNA, 23 bp, Mus musculus
agctattgtgaaagtatatgacc

SEQ ID NO: 185295 - DNA, 19 bp, Mus musculus
tgtctctctgtaaatgtcc

SEQ ID NO: 185296 - DNA, 23 bp, Mus musculus
tgtctgtctgtctgtctgtctgt

SEQ ID NO: 185297 - DNA, 20 bp, Mus musculus
tgtatgtatatgtgtgtgta

SEQ ID NO: 185298 - DNA, 22 bp, Mus musculus
tgttttgtgaccaattatatgg

SEQ ID NO: 185299 - DNA, 22 bp, Mus musculus
tatcacacttgctctgtctgag

SEQ ID NO: 185300 - DNA, 23 bp, Mus musculus
aatccaactgcatgaattcagag

SEQ ID NO: 185301 - DNA, 21 bp, Mus musculus
attctgacttctcaagttgtg

SEQ ID NO: 185302 - DNA, 23 bp, Mus musculus
tgtgtgagtgagtgactctgtga

SEQ ID NO: 185303 - DNA, 23 bp, Mus musculus
tatgtctctgtgtgtgtctgggc

SEQ ID NO: 185304 - DNA, 23 bp, Mus musculus
tttctctgactctgtgttctacc

SEQ ID NO: 185305 - DNA, 23 bp, Mus musculus
tctatatgtatatgtctatatct

SEQ ID NO: 185306 - DNA, 22 bp, Mus musculus
gcaaatctttaagaaaacactt

SEQ ID NO: 185307 - DNA, 20 bp, Mus musculus
agaggatggcacatgaagct

SEQ ID NO: 185308 - DNA, 23 bp, Mus musculus
cagtgtgtgtgtgtctctgcctc

SEQ ID NO: 185309 - DNA, 21 bp, Mus musculus
tcaggaagctgaggactctga

SEQ ID NO: 185310 - DNA, 23 bp, Mus musculus
accttgacacaaattaggttcac

SEQ ID NO: 185311 - DNA, 23 bp, Mus musculus
tgtctctctgtgtgtgatcaaca

SEQ ID NO: 185312 - DNA, 18 bp, Mus musculus
catgaggggcaagagggt

SEQ ID NO: 185313 - DNA, 22 bp, Mus musculus
tgttttgtgaccaattatatgg

SEQ ID NO: 185314 - DNA, 23 bp, Mus musculus
tgtgtgtgtgtgtctatctctat

SEQ ID NO: 185315 - DNA, 23 bp, Mus musculus
atttattttagttaacaatggga

SEQ ID NO: 185316 - DNA, 22 bp, Mus musculus
ttaactgattttgaaaatttga

SEQ ID NO: 185317 - DNA, 21 bp, Mus musculus
gaggggcagtgaattatcata

SEQ ID NO: 185318 - DNA, 23 bp, Mus musculus
ctttttgcatatgatatgatagt

SEQ ID NO: 185319 - DNA, 23 bp, Mus musculus
atacgcacacacacatatagaag

SEQ ID NO: 185320 - DNA, 23 bp, Mus musculus
ctgcctcagtggctctgtgcctc

SEQ ID NO: 185321 - DNA, 23 bp, Mus musculus
aatcagattttttttctttgtgt

SEQ ID NO: 185322 - DNA, 23 bp, Mus musculus
gaagaatttcatctacaagtcaa

SEQ ID NO: 185323 - DNA, 21 bp, Mus musculus
tatctgatttagaataggtaa

SEQ ID NO: 185324 - DNA, 23 bp, Mus musculus
tgttttgtgaccaattatagggt

SEQ ID NO: 185325 - DNA, 23 bp, Mus musculus
tgtctgccagtctgtcttattcc

SEQ ID NO: 185326 - DNA, 23 bp, Mus musculus
actgtgtctctgcttagtttttg

SEQ ID NO: 185327 - DNA, 23 bp, Mus musculus
tgtccattgatgagagtgatgta

SEQ ID NO: 185328 - DNA, 22 bp, Mus musculus
tgttttgtgaccaattatatgg

SEQ ID NO: 185329 - DNA, 23 bp, Mus musculus
tgtatgtgtgtatgtgtatatgt

SEQ ID NO: 185330 - DNA, 23 bp, Mus musculus
tgtgactgggtgaactcacttgg

SEQ ID NO: 185331 - DNA, 21 bp, Mus musculus
tatcacagatgagtctgagga

SEQ ID NO: 185332 - DNA, 23 bp, Mus musculus
agtagtcaggtgttgctgagtat

SEQ ID NO: 185333 - DNA, 18 bp, Mus musculus
aaagtagacagttagcac

SEQ ID NO: 185334 - DNA, 22 bp, Mus musculus
ttgaattctgaatatgtacttc

SEQ ID NO: 185335 - DNA, 23 bp, Mus musculus
tactctgagcaactagtttcttt

SEQ ID NO: 185336 - DNA, 22 bp, Mus musculus
atgaaactttggttgggtatag

SEQ ID NO: 185337 - DNA, 23 bp, Mus musculus
tctcagtgtctgtataacatctg

SEQ ID NO: 185338 - DNA, 20 bp, Mus musculus
ttctatttttcatagtctct

SEQ ID NO: 185339 - DNA, 21 bp, Mus musculus
tccatggtggtctgataggat

SEQ ID NO: 185340 - DNA, 19 bp, Mus musculus
tgttttgttaccaattata

SEQ ID NO: 185341 - DNA, 23 bp, Mus musculus
aggaacttgaagaagcagccatg

SEQ ID NO: 185342 - DNA, 23 bp, Mus musculus
tgctggctcactctctgactgtc

SEQ ID NO: 185343 - DNA, 23 bp, Mus musculus
tgagtcactgtgagtctccagct

SEQ ID NO: 185344 - DNA, 19 bp, Mus musculus
gcttttaacaggtaagctt

SEQ ID NO: 185345 - DNA, 23 bp, Mus musculus
tcagtctgtctgtctgtgcagcg

SEQ ID NO: 185346 - DNA, 22 bp, Mus musculus
actgtctatgtaaggtttccat

SEQ ID NO: 185347 - DNA, 22 bp, Mus musculus
tgttttgtgaccaattatatgg

SEQ ID NO: 185348 - DNA, 23 bp, Mus musculus
ataggtatagatatgtgtgtgta

SEQ ID NO: 185349 - DNA, 23 bp, Mus musculus
ttcatgctgctttgtactgggca

SEQ ID NO: 185350 - DNA, 22 bp, Mus musculus
tctctggctcagtctttcccag

SEQ ID NO: 185351 - DNA, 20 bp, Mus musculus
tatgtctatatatgtgtatg

SEQ ID NO: 185352 - DNA, 21 bp, Mus musculus
aactcagaggctcttctttgt

SEQ ID NO: 185353 - DNA, 18 bp, Mus musculus
tggagcatcagagataga

SEQ ID NO: 185354 - DNA, 22 bp, Mus musculus
tgttttgtgaccaattatatgg

SEQ ID NO: 185355 - DNA, 20 bp, Mus musculus
agctgtgtctccatactgct

SEQ ID NO: 185356 - DNA, 23 bp, Mus musculus
tgactcactgtctgtgttctgtc

SEQ ID NO: 185357 - DNA, 23 bp, Mus musculus
ggcgtctgtctgtggctctcagg

SEQ ID NO: 185358 - DNA, 23 bp, Mus musculus
atatgtgtgtgtatatatgtatg

SEQ ID NO: 185359 - DNA, 23 bp, Mus musculus
tcactgggggattttcttctgta

SEQ ID NO: 185360 - DNA, 22 bp, Mus musculus
tccctgtcaccctgattggctg

SEQ ID NO: 185361 - DNA, 18 bp, Mus musculus
tgtgagtggatggggact

SEQ ID NO: 185362 - DNA, 22 bp, Mus musculus
tgttttgtgaccaattatatgg

SEQ ID NO: 185363 - DNA, 23 bp, Mus musculus
tatatatgtatatgtatacatgt

SEQ ID NO: 185364 - DNA, 23 bp, Mus musculus
tatgtcatcatgcatatatgtgc

SEQ ID NO: 185365 - DNA, 23 bp, Mus musculus
ctcagactgaagaatgacaggag

SEQ ID NO: 185366 - DNA, 23 bp, Mus musculus
aagtctcttttccttcagtctac

SEQ ID NO: 185367 - DNA, 20 bp, Mus musculus
tcatagtaagttgtaaagta

SEQ ID NO: 185368 - DNA, 23 bp, Mus musculus
ctgcctgcctgcctgcctgcctg

SEQ ID NO: 185369 - DNA, 23 bp, Mus musculus
tgacactgtaggttttctcttgg

SEQ ID NO: 185370 - DNA, 22 bp, Mus musculus
tgttttgtgaccaattatatgg

SEQ ID NO: 185371 - DNA, 23 bp, Mus musculus
ctgggagaagttggagaggtgaa

SEQ ID NO: 185372 - DNA, 22 bp, Mus musculus
gtgacagcctctctctgtgcgt

SEQ ID NO: 185373 - DNA, 23 bp, Mus musculus
tgtctcgggatatctgttccttt

SEQ ID NO: 185374 - DNA, 23 bp, Mus musculus
tctctgtgtttcactctcctgtt

SEQ ID NO: 185375 - DNA, 18 bp, Mus musculus
tggttgtactttgtgtta

SEQ ID NO: 185376 - DNA, 23 bp, Mus musculus
ttcacagtcttttactctctgca

SEQ ID NO: 185377 - DNA, 23 bp, Mus musculus
gtctctgtgtgtgcatgtgtgtg

SEQ ID NO: 185378 - DNA, 20 bp, Mus musculus
ttggatgcatgcatgtgtca

SEQ ID NO: 185379 - DNA, 21 bp, Mus musculus
tatgcatgtatatacgtgtgt

SEQ ID NO: 185380 - DNA, 21 bp, Mus musculus
tgtctatgtatatatgtgtgt

SEQ ID NO: 185381 - DNA, 23 bp, Mus musculus
tgtatatatgtgtgtatatgtat

SEQ ID NO: 185382 - DNA, 23 bp, Mus musculus
tatgtgtgtgtatgtaaataccc

SEQ ID NO: 185383 - DNA, 23 bp, Mus musculus
gtgtgtgcatatacatgtgtgta

SEQ ID NO: 185384 - DNA, 20 bp, Mus musculus
aagcggaagacatttggcat

SEQ ID NO: 185385 - DNA, 23 bp, Mus musculus
tgagaacacattttgtagttctg

SEQ ID NO: 185386 - DNA, 22 bp, Mus musculus
tgttttgtgaccaattatatgg

SEQ ID NO: 185387 - DNA, 23 bp, Mus musculus
tgaatgtatgtatgtatgtatgt

SEQ ID NO: 185388 - DNA, 20 bp, Mus musculus
tgcatgcataccatgtgtgt

SEQ ID NO: 185389 - DNA, 23 bp, Mus musculus
gcatgcatgtatgtatgtatgta

SEQ ID NO: 185390 - DNA, 21 bp, Mus musculus
tttctgacagtctctcagatt

SEQ ID NO: 185391 - DNA, 23 bp, Mus musculus
ttttttttttcaggaatgtcatg

SEQ ID NO: 185392 - DNA, 23 bp, Mus musculus
gtgtgtctgtgtgcctatgatct

SEQ ID NO: 185393 - DNA, 21 bp, Mus musculus
taggtacttaggataactaga

SEQ ID NO: 185394 - DNA, 23 bp, Mus musculus
gacaacatgcttccgtctacaag

SEQ ID NO: 185395 - DNA, 23 bp, Mus musculus
aacagacttctgactctgtcacc

SEQ ID NO: 185396 - DNA, 18 bp, Mus musculus
ttcaaatatattcaaatc

SEQ ID NO: 185397 - DNA, 23 bp, Mus musculus
acaccctctctctttcatctgta

SEQ ID NO: 185398 - DNA, 22 bp, Mus musculus
tgttttgtgaccaattatatgg

SEQ ID NO: 185399 - DNA, 23 bp, Mus musculus
tgtgtgtatatatatgtgtgtgt

SEQ ID NO: 185400 - DNA, 23 bp, Mus musculus
atgaggtgctcagaatgtccaga

SEQ ID NO: 185401 - DNA, 19 bp, Mus musculus
tatgtgcactgatattttg

SEQ ID NO: 185402 - DNA, 22 bp, Mus musculus
tgttttgtgaccaattatatgg

SEQ ID NO: 185403 - DNA, 23 bp, Mus musculus
ctttctctcagtctgtggctgac

SEQ ID NO: 185404 - DNA, 23 bp, Mus musculus
tgtgcttgtgtttgcatatgtgt

SEQ ID NO: 185405 - DNA, 22 bp, Mus musculus
tgtgaagcacctgtatgtgtag

SEQ ID NO: 185406 - DNA, 22 bp, Mus musculus
agttcagttctcagcaaccaca

SEQ ID NO: 185407 - DNA, 19 bp, Mus musculus
tgagacagtggagagagcc

SEQ ID NO: 185408 - DNA, 21 bp, Mus musculus
tagctctgggtcattgctgct

SEQ ID NO: 185409 - DNA, 23 bp, Mus musculus
ccttctctctctcagtcaggcag

SEQ ID NO: 185410 - DNA, 22 bp, Mus musculus
ataagtgcaagtattggagaaa

SEQ ID NO: 185411 - DNA, 23 bp, Mus musculus
attagtcagccttaatgttggaa

SEQ ID NO: 185412 - DNA, 23 bp, Mus musculus
cattgatggagactctgcatagt

SEQ ID NO: 185413 - DNA, 23 bp, Mus musculus
cactccacacactgtcacgctct

SEQ ID NO: 185414 - DNA, 23 bp, Mus musculus
gaatgtgtgtgtatatggtgtgt

SEQ ID NO: 185415 - DNA, 23 bp, Mus musculus
tcttcctctgtcagtctctgcct

SEQ ID NO: 185416 - DNA, 22 bp, Mus musculus
tttggttgtagagtcagtgttt

SEQ ID NO: 185417 - DNA, 18 bp, Mus musculus
gctctgagatatgaaaga

SEQ ID NO: 185418 - DNA, 23 bp, Mus musculus
atttctctgaatatatttgcttt

SEQ ID NO: 185419 - DNA, 23 bp, Mus musculus
acacagaagcaaatgtttgggga

SEQ ID NO: 185420 - DNA, 21 bp, Mus musculus
tgcctgtgcctgtgcctgtgt

SEQ ID NO: 185421 - DNA, 23 bp, Mus musculus
tctgtctgcctgcctgcctgcct

SEQ ID NO: 185422 - DNA, 18 bp, Mus musculus
tgtgtgtgtgtgttgtgg

SEQ ID NO: 185423 - DNA, 23 bp, Mus musculus
tctatggctgtcctagaacttac

SEQ ID NO: 185424 - DNA, 18 bp, Mus musculus
agtgtaagtcattggtgt

SEQ ID NO: 185425 - DNA, 21 bp, Mus musculus
atatgtgagtgtaaaacatgt

SEQ ID NO: 185426 - DNA, 22 bp, Mus musculus
cagtcttaggccatggtggtct

SEQ ID NO: 185427 - DNA, 23 bp, Mus musculus
catgtgacttgttgatgggtttt

SEQ ID NO: 185428 - DNA, 22 bp, Mus musculus
ctgtgcttctgtgtgtgtgaaa

SEQ ID NO: 185429 - DNA, 23 bp, Mus musculus
cagtctgtctgtctgtctgtctg

SEQ ID NO: 185430 - DNA, 21 bp, Mus musculus
atgtgcatatggaggacactg

SEQ ID NO: 185431 - DNA, 23 bp, Mus musculus
atatatatctgcttctggaccct

SEQ ID NO: 185432 - DNA, 19 bp, Mus musculus
atgatcagcacattactgt

SEQ ID NO: 185433 - DNA, 23 bp, Mus musculus
tattttgcctgagtggatgcctg

SEQ ID NO: 185434 - DNA, 18 bp, Mus musculus
tgtatgtatgtatgtatg

SEQ ID NO: 185435 - DNA, 23 bp, Mus musculus
gtatgcatgtatgtacatatgta

SEQ ID NO: 185436 - DNA, 18 bp, Mus musculus
tgtgtggtatatgaactc

SEQ ID NO: 185437 - DNA, 22 bp, Mus musculus
tgttttgtgaccaattatatgg

SEQ ID NO: 185438 - DNA, 22 bp, Mus musculus
cctgacagtagagagagggaac

SEQ ID NO: 185439 - DNA, 23 bp, Mus musculus
tgtgtgcgtgcgtgcctgcctgc

SEQ ID NO: 185440 - DNA, 23 bp, Mus musculus
tgtgtagattggtcttcctgggg

SEQ ID NO: 185441 - DNA, 21 bp, Mus musculus
tatgttcttctagctgtgctg

SEQ ID NO: 185442 - DNA, 19 bp, Mus musculus
tagcagccactattttgtc

SEQ ID NO: 185443 - DNA, 23 bp, Mus musculus
tagctggtattatattccatttg

SEQ ID NO: 185444 - DNA, 23 bp, Mus musculus
tgtatgtatatgtgcgtgtatat

SEQ ID NO: 185445 - DNA, 22 bp, Mus musculus
tgttttgtgaccaattatatgg

SEQ ID NO: 185446 - DNA, 23 bp, Mus musculus
ttctctaacagttaatgttctac

SEQ ID NO: 185447 - DNA, 23 bp, Mus musculus
ataagagaatttctacttgagat

SEQ ID NO: 185448 - DNA, 23 bp, Mus musculus
aagtatgtgtgtatgtctatgtg

SEQ ID NO: 185449 - DNA, 20 bp, Mus musculus
tcacagaactgagtgacttg

SEQ ID NO: 185450 - DNA, 22 bp, Mus musculus
tgtcactgaggatgggctttga

SEQ ID NO: 185451 - DNA, 21 bp, Mus musculus
tgttttgtgaccaattatatg

SEQ ID NO: 185452 - DNA, 23 bp, Mus musculus
ctgtatctgtgtgtgtgtgtatg

SEQ ID NO: 185453 - DNA, 23 bp, Mus musculus
ttctttggttttaatgtagttca

SEQ ID NO: 185454 - DNA, 22 bp, Mus musculus
tctgtctgtataatatgtctgt

SEQ ID NO: 185455 - DNA, 23 bp, Mus musculus
gagtatggttttctagctgtaga

SEQ ID NO: 185456 - DNA, 20 bp, Mus musculus
tattatgtttgggtttgtag

SEQ ID NO: 185457 - DNA, 22 bp, Mus musculus
tgttttgtgaccaattatatgg

SEQ ID NO: 185458 - DNA, 22 bp, Mus musculus
tgttttgtgaccaattatatgg

SEQ ID NO: 185459 - DNA, 23 bp, Mus musculus
tgcttaccttagaagagagaagc

SEQ ID NO: 185460 - DNA, 23 bp, Mus musculus
agctattctccttaggaagtatt

SEQ ID NO: 185461 - DNA, 22 bp, Mus musculus
acaggggctgtctctgactctg

SEQ ID NO: 185462 - DNA, 22 bp, Mus musculus
tgttttgtgaccaattatatgg

SEQ ID NO: 185463 - DNA, 21 bp, Mus musculus
tcacagaagatagttagctcg

SEQ ID NO: 185464 - DNA, 22 bp, Mus musculus
tgttttgtgaccaattatatgg

SEQ ID NO: 185465 - DNA, 23 bp, Mus musculus
agactgagaatgtttacacacac

SEQ ID NO: 185466 - DNA, 23 bp, Mus musculus
tgatgtagatgtagatgtagatg

SEQ ID NO: 185467 - DNA, 23 bp, Mus musculus
atatgtatatgtatatgtatatg

SEQ ID NO: 185468 - DNA, 22 bp, Mus musculus
atcactctattatagtttgaca

SEQ ID NO: 185469 - DNA, 23 bp, Mus musculus
atatgatgtatatgcatatttat

SEQ ID NO: 185470 - DNA, 23 bp, Mus musculus
tgtgagtatgtatatatgagtgt

SEQ ID NO: 185471 - DNA, 22 bp, Mus musculus
tgtgctacttggttgatttgtt

SEQ ID NO: 185472 - DNA, 23 bp, Mus musculus
tgacagctaggtggttgtcattt

SEQ ID NO: 185473 - DNA, 23 bp, Mus musculus
tagtccatggtgatctgatagga

SEQ ID NO: 185474 - DNA, 23 bp, Mus musculus
tgtcttgtgaccaattatatggt

SEQ ID NO: 185475 - DNA, 18 bp, Mus musculus
tagatgctcctatttatc

SEQ ID NO: 185476 - DNA, 18 bp, Mus musculus
gtgcaagatgaatggatg

SEQ ID NO: 185477 - DNA, 23 bp, Mus musculus
atgaggcactatgttggttagta

SEQ ID NO: 185478 - DNA, 22 bp, Mus musculus
taatgcaagatgtaacaatgtt

SEQ ID NO: 185479 - DNA, 22 bp, Mus musculus
actttaggcagatgttgtaacg

SEQ ID NO: 185480 - DNA, 23 bp, Mus musculus
tatgcatgtatgtatgtatgtat

SEQ ID NO: 185481 - DNA, 23 bp, Mus musculus
tgtctgtctctgcttcttgagtg

SEQ ID NO: 185482 - DNA, 20 bp, Mus musculus
tttatacttctaatctatgg

SEQ ID NO: 185483 - DNA, 23 bp, Mus musculus
ccgtctgtctgtctgtctgcctg

SEQ ID NO: 185484 - DNA, 23 bp, Mus musculus
gtggagctgagtgtgtattggca

SEQ ID NO: 185485 - DNA, 20 bp, Mus musculus
tcacagtctgtatttcacca

SEQ ID NO: 185486 - DNA, 23 bp, Mus musculus
agttgacacactgtaactagtct

SEQ ID NO: 185487 - DNA, 23 bp, Mus musculus
ctgtctctgggtctgagtggcag

SEQ ID NO: 185488 - DNA, 23 bp, Mus musculus
tgtatctgtgtatgtgtgtgtgt

SEQ ID NO: 185489 - DNA, 23 bp, Mus musculus
tgtgactgtcactttgtcttgtg

SEQ ID NO: 185490 - DNA, 22 bp, Mus musculus
aggcagcttgagatttcaaaag

SEQ ID NO: 185491 - DNA, 20 bp, Mus musculus
ttgactgaagaaagacacct

SEQ ID NO: 185492 - DNA, 23 bp, Mus musculus
ttggaagtgtaaggttttgttga

SEQ ID NO: 185493 - DNA, 19 bp, Mus musculus
ttactctctattcatgcct

SEQ ID NO: 185494 - DNA, 23 bp, Mus musculus
tatcttgttcagtgtcatccaca

SEQ ID NO: 185495 - DNA, 23 bp, Mus musculus
ttgactgcatgtccatctgcatg

SEQ ID NO: 185496 - DNA, 23 bp, Mus musculus
ggtgtgtcactgtgtgtgtgggc

SEQ ID NO: 185497 - DNA, 21 bp, Mus musculus
gagagagtagacattgagctc

SEQ ID NO: 185498 - DNA, 22 bp, Mus musculus
tgttttgtgaccaattatatgg

SEQ ID NO: 185499 - DNA, 21 bp, Mus musculus
tatgcatgaatgtatgtatgt

SEQ ID NO: 185500 - DNA, 23 bp, Mus musculus
tatgaatgcttatatagcagtag

SEQ ID NO: 185501 - DNA, 22 bp, Mus musculus
tgttttgtgaccaattatatgg

SEQ ID NO: 185502 - DNA, 23 bp, Mus musculus
acttaggatctagattctgaaag

SEQ ID NO: 185503 - DNA, 22 bp, Mus musculus
tgttttgtgaccaattatatgg

SEQ ID NO: 185504 - DNA, 23 bp, Mus musculus
gacagaggtaagtgaggagccag

SEQ ID NO: 185505 - DNA, 19 bp, Mus musculus
gaatacatgcatgtgtatg

SEQ ID NO: 185506 - DNA, 22 bp, Mus musculus
atgtatgtatgtatgtatgctg

SEQ ID NO: 185507 - DNA, 23 bp, Mus musculus
ctgtgtctctgtttagtttctgt

SEQ ID NO: 185508 - DNA, 23 bp, Mus musculus
aggatctgtccattgatgagagt

SEQ ID NO: 185509 - DNA, 22 bp, Mus musculus
tgttttgtgaccaattatatgg

SEQ ID NO: 185510 - DNA, 23 bp, Mus musculus
agagttcacagaggagagagaga

SEQ ID NO: 185511 - DNA, 21 bp, Mus musculus
gtctcactcacggactctttt

SEQ ID NO: 185512 - DNA, 23 bp, Mus musculus
aatggtcatagactatgcagact

SEQ ID NO: 185513 - DNA, 23 bp, Mus musculus
tgtttagatagcatactcttttg

SEQ ID NO: 185514 - DNA, 20 bp, Mus musculus
ttttgtctcccattgtgcct

SEQ ID NO: 185515 - DNA, 18 bp, Mus musculus
acagctgagagtgtggac

SEQ ID NO: 185516 - DNA, 21 bp, Mus musculus
tgtagtgtatatatatatatg

SEQ ID NO: 185517 - DNA, 23 bp, Mus musculus
ttttggttctgcatcgtctctct

SEQ ID NO: 185518 - DNA, 22 bp, Mus musculus
tagcaagtatttgtctatgttt

SEQ ID NO: 185519 - DNA, 20 bp, Mus musculus
aagtgacttgattgacagcc

SEQ ID NO: 185520 - DNA, 22 bp, Mus musculus
tctgtctgtctgtttctactct

SEQ ID NO: 185521 - DNA, 22 bp, Mus musculus
gcctctctgcctctctcacagt

SEQ ID NO: 185522 - DNA, 21 bp, Mus musculus
aagtgctcatatagatgagag

SEQ ID NO: 185523 - DNA, 20 bp, Mus musculus
tctctggtgagtgtgtgcac

SEQ ID NO: 185524 - DNA, 23 bp, Mus musculus
aactagtgagtggcagacttaac

SEQ ID NO: 185525 - DNA, 23 bp, Mus musculus
gctctctgacttactctcttcgc

SEQ ID NO: 185526 - DNA, 21 bp, Mus musculus
aaggcagaagacagacagcag

SEQ ID NO: 185527 - DNA, 23 bp, Mus musculus
gtgtccctgtctgtttctgtgtg

SEQ ID NO: 185528 - DNA, 23 bp, Mus musculus
tttaagcttcagtttggactgtc

SEQ ID NO: 185529 - DNA, 20 bp, Mus musculus
tgtatgtgtgtgtgtgtata

SEQ ID NO: 185530 - DNA, 22 bp, Mus musculus
tgttttgtgaccaattatatgg

SEQ ID NO: 185531 - DNA, 18 bp, Mus musculus
tatctgtctgagtcagct

SEQ ID NO: 185532 - DNA, 23 bp, Mus musculus
atatctggatttcttttcttatt

SEQ ID NO: 185533 - DNA, 22 bp, Mus musculus
tcaggtagttggatgtaagctg

SEQ ID NO: 185534 - DNA, 23 bp, Mus musculus
gtccatctctctgtctgtctata

SEQ ID NO: 185535 - DNA, 20 bp, Mus musculus
gcccttgatccgaacttgag

SEQ ID NO: 185536 - DNA, 22 bp, Mus musculus
tgttttgtgaccaattatatgg

SEQ ID NO: 185537 - DNA, 23 bp, Mus musculus
gagtgtgtctgtgtgtgcctgtg

SEQ ID NO: 185538 - DNA, 21 bp, Mus musculus
gatatgaaaggaagtgagggc

SEQ ID NO: 185539 - DNA, 23 bp, Mus musculus
tcaatgtcagacatttatttggg

SEQ ID NO: 185540 - DNA, 18 bp, Mus musculus
tgtgtgtatgtatatata

SEQ ID NO: 185541 - DNA, 21 bp, Mus musculus
atgcctgttcctgtgaaaacc

SEQ ID NO: 185542 - DNA, 20 bp, Mus musculus
gtgtacagacatagatgaag

SEQ ID NO: 185543 - DNA, 19 bp, Mus musculus
atgtatgtatgtatgtatg

SEQ ID NO: 185544 - DNA, 23 bp, Mus musculus
cacacagttcagagtgtgcaggt

SEQ ID NO: 185545 - DNA, 23 bp, Mus musculus
actctctctctctcaggctctgt

SEQ ID NO: 185546 - DNA, 22 bp, Mus musculus
tcatgtctgatgaaaactgtgt

SEQ ID NO: 185547 - DNA, 22 bp, Mus musculus
actggaagaggctcagtttggc

SEQ ID NO: 185548 - DNA, 21 bp, Mus musculus
agacagcgagcatacatccag

SEQ ID NO: 185549 - DNA, 21 bp, Mus musculus
tagagctagtcttcctttgga

SEQ ID NO: 185550 - DNA, 22 bp, Mus musculus
tgttttgtgaccaattatatgg

SEQ ID NO: 185551 - DNA, 22 bp, Mus musculus
gtgactctctccctgtccttct

SEQ ID NO: 185552 - DNA, 22 bp, Mus musculus
tgttttgtgaccaattatatgg

SEQ ID NO: 185553 - DNA, 23 bp, Mus musculus
tgaacagagagtacagagaaaga

SEQ ID NO: 185554 - DNA, 19 bp, Mus musculus
tgtttggctgggtggctgt

SEQ ID NO: 185555 - DNA, 19 bp, Mus musculus
atgcagctcagaatctatt

SEQ ID NO: 185556 - DNA, 23 bp, Mus musculus
actgactgctcttccagaggtcc

SEQ ID NO: 185557 - DNA, 23 bp, Mus musculus
tctggctctcacaccctcaggtc

SEQ ID NO: 185558 - DNA, 23 bp, Mus musculus
aattttgtttttcttaaagtctg

SEQ ID NO: 185559 - DNA, 22 bp, Mus musculus
tgtgttcagtgaagtgacgttg

SEQ ID NO: 185560 - DNA, 23 bp, Mus musculus
aggaatcctttgtgagcagctgc

SEQ ID NO: 185561 - DNA, 23 bp, Mus musculus
gaagagagagatcttgctgaatg

SEQ ID NO: 185562 - DNA, 23 bp, Mus musculus
acacacacacatatatatatgta

SEQ ID NO: 185563 - DNA, 23 bp, Mus musculus
atgtgggtatatatatgtgtgtg

SEQ ID NO: 185564 - DNA, 19 bp, Mus musculus
tatcacacagatgagcaat

SEQ ID NO: 185565 - DNA, 20 bp, Mus musculus
ctggtcacattgattcctca

SEQ ID NO: 185566 - DNA, 23 bp, Mus musculus
tgtgactctctgtggctctgctt

SEQ ID NO: 185567 - DNA, 21 bp, Mus musculus
tctctgggagagagaaagcag

SEQ ID NO: 185568 - DNA, 23 bp, Mus musculus
tctgcaattttctctggctccag

SEQ ID NO: 185569 - DNA, 23 bp, Mus musculus
tgacagagaggtgacactgttca

SEQ ID NO: 185570 - DNA, 23 bp, Mus musculus
ccttctttgatcaacttctgtag

SEQ ID NO: 185571 - DNA, 20 bp, Mus musculus
atgtatatatctgtgtgtgt

SEQ ID NO: 185572 - DNA, 23 bp, Mus musculus
actgtgtctgcatctcttgaggg

SEQ ID NO: 185573 - DNA, 23 bp, Mus musculus
acatacatgacagagacagtata

SEQ ID NO: 185574 - DNA, 23 bp, Mus musculus
tgtatacatgtttgtgtgtgtat

SEQ ID NO: 185575 - DNA, 22 bp, Mus musculus
tgtgtgtctctgtgtgtgtgca

SEQ ID NO: 185576 - DNA, 23 bp, Mus musculus
tatgtgtatgtatatgtatacac

SEQ ID NO: 185577 - DNA, 20 bp, Mus musculus
atgtgtgtgtgtatgtgtat

SEQ ID NO: 185578 - DNA, 18 bp, Mus musculus
atgtatgtatgtgtgtgt

SEQ ID NO: 185579 - DNA, 23 bp, Mus musculus
tgagtgagtgagtgagtggctgg

SEQ ID NO: 185580 - DNA, 23 bp, Mus musculus
tgactgactgactgactgactga

SEQ ID NO: 185581 - DNA, 23 bp, Mus musculus
ttggcttatggttgtaatgtttt

SEQ ID NO: 185582 - DNA, 23 bp, Mus musculus
agcctgtgctacacttgagataa

SEQ ID NO: 185583 - DNA, 18 bp, Mus musculus
tcaagctgcctggaagag

SEQ ID NO: 185584 - DNA, 23 bp, Mus musculus
tgtctatctgtttgtctgtccct

SEQ ID NO: 185585 - DNA, 23 bp, Mus musculus
ttaagtgtgtgagttgagtccaa

SEQ ID NO: 185586 - DNA, 23 bp, Mus musculus
tgtgagtgtgtgtgtgtgtgcgt

SEQ ID NO: 185587 - DNA, 20 bp, Mus musculus
ctcacaagtgtgtcagcact

SEQ ID NO: 185588 - DNA, 18 bp, Mus musculus
tgtctctatctctctcaa

SEQ ID NO: 185589 - DNA, 21 bp, Mus musculus
tggctgcatctaggcacatca

SEQ ID NO: 185590 - DNA, 22 bp, Mus musculus
agagagtggaattttgtgtggc

SEQ ID NO: 185591 - DNA, 23 bp, Mus musculus
tatatgtatatctttatgtgtgt

SEQ ID NO: 185592 - DNA, 21 bp, Mus musculus
tttatgtgtatatgcatagat

SEQ ID NO: 185593 - DNA, 18 bp, Mus musculus
tacatatacacacacatt

SEQ ID NO: 185594 - DNA, 23 bp, Mus musculus
ttctcccagtacatagtgtgcag

SEQ ID NO: 185595 - DNA, 21 bp, Mus musculus
ttaaaaggtgcttgtatttgt

SEQ ID NO: 185596 - DNA, 23 bp, Mus musculus
agcctctctgggtgcctgtgctc

SEQ ID NO: 185597 - DNA, 22 bp, Mus musculus
agagagcacagagaggtcagtg

SEQ ID NO: 185598 - DNA, 23 bp, Mus musculus
cagtccctctgtgtccctttctg

SEQ ID NO: 185599 - DNA, 22 bp, Mus musculus
agaagctgcgtctcttgtctgg

SEQ ID NO: 185600 - DNA, 18 bp, Mus musculus
tgtcaggctagtctaggc

SEQ ID NO: 185601 - DNA, 23 bp, Mus musculus
agtatatttgtatatgtgtgtgc

SEQ ID NO: 185602 - DNA, 22 bp, Mus musculus
ctcagtggctcactgtgtccct

SEQ ID NO: 185603 - DNA, 22 bp, Mus musculus
gagtggatttgtgataggtctt

SEQ ID NO: 185604 - DNA, 22 bp, Mus musculus
tgagtacagattttcttattct

SEQ ID NO: 185605 - DNA, 23 bp, Mus musculus
agcctgttctttgcatttcaata

SEQ ID NO: 185606 - DNA, 21 bp, Mus musculus
gtgtatattgctcaatggcat

SEQ ID NO: 185607 - DNA, 23 bp, Mus musculus
tctctgtgagcctcagtttctgc

SEQ ID NO: 185608 - DNA, 23 bp, Mus musculus
agcatctctgagaagacactgag

SEQ ID NO: 185609 - DNA, 20 bp, Mus musculus
tgagttcaattctcagcaac

SEQ ID NO: 185610 - DNA, 21 bp, Mus musculus
tttcaagagttttgaggttgg

SEQ ID NO: 185611 - DNA, 23 bp, Mus musculus
tgtgtgtcacacaaactggctca

SEQ ID NO: 185612 - DNA, 23 bp, Mus musculus
gacagtgcgtgagcttctgctct

SEQ ID NO: 185613 - DNA, 23 bp, Mus musculus
actggtggtaaggttttgagttt

SEQ ID NO: 185614 - DNA, 22 bp, Mus musculus
gccaggctcactgtcactctct

SEQ ID NO: 185615 - DNA, 23 bp, Mus musculus
tatcactgagtattggcacctca

SEQ ID NO: 185616 - DNA, 19 bp, Mus musculus
acagacacagcacattgga

SEQ ID NO: 185617 - DNA, 23 bp, Mus musculus
ctgtctgtgtgtctgtctgtgtg

SEQ ID NO: 185618 - DNA, 23 bp, Mus musculus
agaacactgactgctcttccaga

SEQ ID NO: 185619 - DNA, 23 bp, Mus musculus
gtatgagcatgtggaagtcagag

SEQ ID NO: 185620 - DNA, 23 bp, Mus musculus
aggcagatctctgtgagctcaag

SEQ ID NO: 185621 - DNA, 19 bp, Mus musculus
tgctagtctcggcccctca

SEQ ID NO: 185622 - DNA, 23 bp, Mus musculus
tactcagtacagagagtgctgat

SEQ ID NO: 185623 - DNA, 21 bp, Mus musculus
tctaatagttcagctatatct

SEQ ID NO: 185624 - DNA, 23 bp, Mus musculus
aggagcactgactgctcttccag

SEQ ID NO: 185625 - DNA, 18 bp, Mus musculus
gagggttctcttgagcta

SEQ ID NO: 185626 - DNA, 22 bp, Mus musculus
ctttcacactgagactctggct

SEQ ID NO: 185627 - DNA, 21 bp, Mus musculus
tgggattcagacccaagtcct

SEQ ID NO: 185628 - DNA, 23 bp, Mus musculus
ttctgagtctagatagtgacctg

SEQ ID NO: 185629 - DNA, 20 bp, Mus musculus
taccacatgggctggagaga

SEQ ID NO: 185630 - DNA, 23 bp, Mus musculus
gacagggtttctctgtgtatctc

SEQ ID NO: 185631 - DNA, 22 bp, Mus musculus
tatatgacacatatagatatgt

SEQ ID NO: 185632 - DNA, 22 bp, Mus musculus
agtgactgtttcgtgactgata

SEQ ID NO: 185633 - DNA, 23 bp, Mus musculus
tatcactgtcaggttttctttat

SEQ ID NO: 185634 - DNA, 21 bp, Mus musculus
tgactttgctgtctgtgcctt

SEQ ID NO: 185635 - DNA, 20 bp, Mus musculus
tatgtgtatgtatatgtata

SEQ ID NO: 185636 - DNA, 22 bp, Mus musculus
tgttttgtgaccaattatatgg

SEQ ID NO: 185637 - DNA, 22 bp, Mus musculus
tgttttgtgaccaattatatgg

SEQ ID NO: 185638 - DNA, 21 bp, Mus musculus
tgcttagttgtttcaatgggg

SEQ ID NO: 185639 - DNA, 20 bp, Mus musculus
tatacatgtgtgtacgtatg

SEQ ID NO: 185640 - DNA, 22 bp, Mus musculus
tgttttgtgaccaattatatgg

SEQ ID NO: 185641 - DNA, 19 bp, Mus musculus
acacatggagtattgcttt

SEQ ID NO: 185642 - DNA, 23 bp, Mus musculus
gtctgtctgtctgtctgtgttct

SEQ ID NO: 185643 - DNA, 23 bp, Mus musculus
agacagactctcagtgacttaca

SEQ ID NO: 185644 - DNA, 22 bp, Mus musculus
tgttttgtgaccaattatatgg

SEQ ID NO: 185645 - DNA, 20 bp, Mus musculus
ctctgagccatctctccagc

SEQ ID NO: 185646 - DNA, 23 bp, Mus musculus
tttctgtttggttttgcagctgt

SEQ ID NO: 185647 - DNA, 23 bp, Mus musculus
tgtatctatctgtctgtctgtct

SEQ ID NO: 185648 - DNA, 23 bp, Mus musculus
aagagtgctcacttctcttacag

SEQ ID NO: 185649 - DNA, 22 bp, Mus musculus
tgttttgtgaccaattatatgg

SEQ ID NO: 185650 - DNA, 23 bp, Mus musculus
tcagtgtcatgtgatgtgaaggt

SEQ ID NO: 185651 - DNA, 19 bp, Mus musculus
tgtatatatgtatatgtgt

SEQ ID NO: 185652 - DNA, 22 bp, Mus musculus
tgttttgtgaccaattatatgg

SEQ ID NO: 185653 - DNA, 22 bp, Mus musculus
tgttgcttgctcataggatgga

SEQ ID NO: 185654 - DNA, 23 bp, Mus musculus
caatatttttgtatctgttgagg

SEQ ID NO: 185655 - DNA, 23 bp, Mus musculus
tttgtgtccaattatatggtcaa

SEQ ID NO: 185656 - DNA, 18 bp, Mus musculus
agactctcctgtatgcag

SEQ ID NO: 185657 - DNA, 19 bp, Mus musculus
atcatatgtatcatataca

SEQ ID NO: 185658 - DNA, 23 bp, Mus musculus
aatagatatagatgtagatatag

SEQ ID NO: 185659 - DNA, 19 bp, Mus musculus
tcagttactaaaagatggg

SEQ ID NO: 185660 - DNA, 23 bp, Mus musculus
ctctgtctctgtttagtttctgt

SEQ ID NO: 185661 - DNA, 23 bp, Mus musculus
aagagaaaaaaagttgttgtagc

SEQ ID NO: 185662 - DNA, 23 bp, Mus musculus
attggctaagttttggaagctct

SEQ ID NO: 185663 - DNA, 23 bp, Mus musculus
ttttgagaccaattatatggttg

SEQ ID NO: 185664 - DNA, 22 bp, Mus musculus
ttttatctatgttaagtttgca

SEQ ID NO: 185665 - DNA, 23 bp, Mus musculus
ttgaattagtttctctttttgca

SEQ ID NO: 185666 - DNA, 22 bp, Mus musculus
gaggattgagtcagatgttttc

SEQ ID NO: 185667 - DNA, 23 bp, Mus musculus
agtccatgataatctgataggat

SEQ ID NO: 185668 - DNA, 23 bp, Mus musculus
ttatgaccaattatatagtcaat

SEQ ID NO: 185669 - DNA, 19 bp, Mus musculus
tctgtctgtctgtctgtct

SEQ ID NO: 185670 - DNA, 21 bp, Mus musculus
tcagcctctcctatggcttag

SEQ ID NO: 185671 - DNA, 23 bp, Mus musculus
acgagtcagttctttcgttgcag

SEQ ID NO: 185672 - DNA, 23 bp, Mus musculus
ctgagtctcagtctgtgaccggg

SEQ ID NO: 185673 - DNA, 23 bp, Mus musculus
tgcctcagtgcctctgtgcttcc

SEQ ID NO: 185674 - DNA, 23 bp, Mus musculus
gtgtagaatctgaatgtattgtc

SEQ ID NO: 185675 - DNA, 23 bp, Mus musculus
caaaagaagacactgagctcagg

SEQ ID NO: 185676 - DNA, 23 bp, Mus musculus
gttgctgtctgcgtatttagtga

SEQ ID NO: 185677 - DNA, 19 bp, Mus musculus
tggtggtctgataggatgc

SEQ ID NO: 185678 - DNA, 22 bp, Mus musculus
tgttttgtgaccaattatatgg

SEQ ID NO: 185679 - DNA, 23 bp, Mus musculus
tgctgtgggttcagtctcagtca

SEQ ID NO: 185680 - DNA, 20 bp, Mus musculus
aaagcagtagagctgggcgt

SEQ ID NO: 185681 - DNA, 22 bp, Mus musculus
agtgatgaaggtgaagggtcgt

SEQ ID NO: 185682 - DNA, 23 bp, Mus musculus
ttatctttggttatcttgctgtg

SEQ ID NO: 185683 - DNA, 23 bp, Mus musculus
actgactgctcttccagaggtcc

SEQ ID NO: 185684 - DNA, 23 bp, Mus musculus
cagaccctcactgcctctgattc

SEQ ID NO: 185685 - DNA, 23 bp, Mus musculus
catgtgtgagtaatgtgaatgtc

SEQ ID NO: 185686 - DNA, 22 bp, Mus musculus
tcagtgtttttctgtgtctgat

SEQ ID NO: 185687 - DNA, 22 bp, Mus musculus
ggctctgtgggtagatgttctc

SEQ ID NO: 185688 - DNA, 23 bp, Mus musculus
agagagaacagattcccataggt

SEQ ID NO: 185689 - DNA, 23 bp, Mus musculus
ctgtcactgtctcacaggctgac

SEQ ID NO: 185690 - DNA, 23 bp, Mus musculus
ctgccacagcctcatcagtgtca

SEQ ID NO: 185691 - DNA, 19 bp, Mus musculus
tgactgaggacactgtggt

SEQ ID NO: 185692 - DNA, 23 bp, Mus musculus
tctgtctgtctgtctgtctgtct

SEQ ID NO: 185693 - DNA, 23 bp, Mus musculus
tgtgtctgcaagtgtatctgtat

SEQ ID NO: 185694 - DNA, 23 bp, Mus musculus
aagagcactgactgctcttccag

SEQ ID NO: 185695 - DNA, 23 bp, Mus musculus
acaggtagttggttgtaagctgc

SEQ ID NO: 185696 - DNA, 23 bp, Mus musculus
tctgtgtgtgcctctgtgtgtgc

SEQ ID NO: 185697 - DNA, 20 bp, Mus musculus
gggagagacacacacagaca

SEQ ID NO: 185698 - DNA, 23 bp, Mus musculus
gtctgtctgtgagacttgctctg

SEQ ID NO: 185699 - DNA, 23 bp, Mus musculus
acactgtatgtcagaggtaaagt

SEQ ID NO: 185700 - DNA, 23 bp, Mus musculus
tgtctttgtccttatctatccca

SEQ ID NO: 185701 - DNA, 23 bp, Mus musculus
ctggtctctctctctctgacctt

SEQ ID NO: 185702 - DNA, 22 bp, Mus musculus
cactgtccctctctgggtggga

SEQ ID NO: 185703 - DNA, 23 bp, Mus musculus
atgtgtgtctgtctgtctctcct

SEQ ID NO: 185704 - DNA, 23 bp, Mus musculus
agacatagacacacacacataca

SEQ ID NO: 185705 - DNA, 23 bp, Mus musculus
ctgcctcacactgcctctgtctt

SEQ ID NO: 185706 - DNA, 23 bp, Mus musculus
gagtccactgtcgctctcttcag

SEQ ID NO: 185707 - DNA, 23 bp, Mus musculus
acagtatagttgtgtaagtgatg

SEQ ID NO: 185708 - DNA, 23 bp, Mus musculus
tctgtctgtctgtctgtctttct

SEQ ID NO: 185709 - DNA, 22 bp, Mus musculus
ctgtcccactgtctgacccagt

SEQ ID NO: 185710 - DNA, 23 bp, Mus musculus
tgtgcagaacaggaagaagagga

SEQ ID NO: 185711 - DNA, 23 bp, Mus musculus
tgactgactgtctcagtgccttc

SEQ ID NO: 185712 - DNA, 23 bp, Mus musculus
tgtctctctgagtctctgatgtc

SEQ ID NO: 185713 - DNA, 23 bp, Mus musculus
tctcacacaggctgtctcggtgg

SEQ ID NO: 185714 - DNA, 21 bp, Mus musculus
tcccagcaactacattgtggc

SEQ ID NO: 185715 - DNA, 23 bp, Mus musculus
aagtaggtggaagttgaggtggt

SEQ ID NO: 185716 - DNA, 20 bp, Mus musculus
agtctggctctcagtcactg

SEQ ID NO: 185717 - DNA, 21 bp, Mus musculus
atacatatagattttgcctgc

SEQ ID NO: 185718 - DNA, 23 bp, Mus musculus
atgtcagtgcaccatgtatgtgt

SEQ ID NO: 185719 - DNA, 23 bp, Mus musculus
agcctggctctcagtcactgcct

SEQ ID NO: 185720 - DNA, 23 bp, Mus musculus
tgtgtgtgtatgtgcatgtgcat

SEQ ID NO: 185721 - DNA, 23 bp, Mus musculus
tgtgtctgtgtgagaagcccctc

SEQ ID NO: 185722 - DNA, 23 bp, Mus musculus
tactgtgtctgcatgtgtgtgcg

SEQ ID NO: 185723 - DNA, 22 bp, Mus musculus
tgttacatttgtgtgtgtgcct

SEQ ID NO: 185724 - DNA, 23 bp, Mus musculus
tgtgtgcctgtgtgtgtgccagt

SEQ ID NO: 185725 - DNA, 20 bp, Mus musculus
ttgacagatgaaagtgttca

SEQ ID NO: 185726 - DNA, 19 bp, Mus musculus
tttcacactgtcttagctc

SEQ ID NO: 185727 - DNA, 19 bp, Mus musculus
ttagaaaatatgcttttca

SEQ ID NO: 185728 - DNA, 20 bp, Mus musculus
ctgagactctgtgtgtgtgc

SEQ ID NO: 185729 - DNA, 23 bp, Mus musculus
tctgtgtgcctgtgtgcctgtga

SEQ ID NO: 185730 - DNA, 23 bp, Mus musculus
aaaggatcaagatgataagagat

SEQ ID NO: 185731 - DNA, 21 bp, Mus musculus
tgactctgccaccctcgatct

SEQ ID NO: 185732 - DNA, 19 bp, Mus musculus
gcacactctgtcactgtgc

SEQ ID NO: 185733 - DNA, 22 bp, Mus musculus
tgtcatgtcagagctggaggat

SEQ ID NO: 185734 - DNA, 20 bp, Mus musculus
tctggctctgacagagccac

SEQ ID NO: 185735 - DNA, 22 bp, Mus musculus
atatgtgtatatatatgtgtgt

SEQ ID NO: 185736 - DNA, 23 bp, Mus musculus
atatgtatgtttctgtgtatgca

SEQ ID NO: 185737 - DNA, 22 bp, Mus musculus
tgtgcatttttgtatgactata

SEQ ID NO: 185738 - DNA, 19 bp, Mus musculus
tgtatgtgtgcatgtgcat

SEQ ID NO: 185739 - DNA, 23 bp, Mus musculus
tgcctgagtgcgtgtgagtggct

SEQ ID NO: 185740 - DNA, 21 bp, Mus musculus
attagaagaattaggaagtgg

SEQ ID NO: 185741 - DNA, 22 bp, Mus musculus
agtgagcatggttgactggtag

SEQ ID NO: 185742 - DNA, 23 bp, Mus musculus
actctgtctgtgtgtgaggatgc

SEQ ID NO: 185743 - DNA, 23 bp, Mus musculus
tatgtcacacacacataaatggc

SEQ ID NO: 185744 - DNA, 23 bp, Mus musculus
cagtgtctctacaagagctggag

SEQ ID NO: 185745 - DNA, 23 bp, Mus musculus
tgcctggctccctgtatgattac

SEQ ID NO: 185746 - DNA, 23 bp, Mus musculus
agtgtgcaaaggatcctgttcag

SEQ ID NO: 185747 - DNA, 23 bp, Mus musculus
gaagtctgggtgtgtctgccgca

SEQ ID NO: 185748 - DNA, 21 bp, Mus musculus
tcacagacacctaaggtgtct

SEQ ID NO: 185749 - DNA, 18 bp, Mus musculus
aagtgcctggatgtggtg

SEQ ID NO: 185750 - DNA, 23 bp, Mus musculus
ggaagtgtcttgagtctgtctca

SEQ ID NO: 185751 - DNA, 23 bp, Mus musculus
gagttcaattctcagcaaccaca

SEQ ID NO: 185752 - DNA, 19 bp, Mus musculus
tgtgtgtaaatgtatatat

SEQ ID NO: 185753 - DNA, 20 bp, Mus musculus
tcacagaactgagtgacttg

SEQ ID NO: 185754 - DNA, 19 bp, Mus musculus
tgtgttcatctctagcact

SEQ ID NO: 185755 - DNA, 23 bp, Mus musculus
tgactgagtggttatgagtatag

SEQ ID NO: 185756 - DNA, 22 bp, Mus musculus
tgttttgtgaccaattatatgg

SEQ ID NO: 185757 - DNA, 23 bp, Mus musculus
agcagctgagagaatttagagac

SEQ ID NO: 185758 - DNA, 23 bp, Mus musculus
tgtgagactgcaagagcatctgt

SEQ ID NO: 185759 - DNA, 23 bp, Mus musculus
tgactgagtggttatgagtatag

SEQ ID NO: 185760 - DNA, 23 bp, Mus musculus
tgtgagactgcaagagcatctgt

SEQ ID NO: 185761 - DNA, 18 bp, Mus musculus
agagatcatgagttcaat

SEQ ID NO: 185762 - DNA, 23 bp, Mus musculus
atattgagatctgattttgtttt

SEQ ID NO: 185763 - DNA, 23 bp, Mus musculus
actatgtgtgtatctgtgtgtgt

SEQ ID NO: 185764 - DNA, 22 bp, Mus musculus
aagctacatactgaggagctgg

SEQ ID NO: 185765 - DNA, 23 bp, Mus musculus
tgtctgtctgtctgcctgtctgt

SEQ ID NO: 185766 - DNA, 20 bp, Mus musculus
ttgtgagctgttatgtgggt

SEQ ID NO: 185767 - DNA, 23 bp, Mus musculus
tgtgtgcaagtgtgtctgtctca

SEQ ID NO: 185768 - DNA, 20 bp, Mus musculus
tgttcatgcttatatgtgca

SEQ ID NO: 185769 - DNA, 21 bp, Mus musculus
tgttcatgcgtgtgcctgtgt

SEQ ID NO: 185770 - DNA, 23 bp, Mus musculus
agatttcaagttgaagtcccctt

SEQ ID NO: 185771 - DNA, 19 bp, Mus musculus
cacagaaaacagtgaccag

SEQ ID NO: 185772 - DNA, 21 bp, Mus musculus
tggtgcacgtgcatgtgtgtg

SEQ ID NO: 185773 - DNA, 19 bp, Mus musculus
cacagatgtgtgtgtgcac

SEQ ID NO: 185774 - DNA, 23 bp, Mus musculus
tcactgctcttccagaggtcctg

SEQ ID NO: 185775 - DNA, 20 bp, Mus musculus
gagttctgagaagcaatcat

SEQ ID NO: 185776 - DNA, 21 bp, Mus musculus
ggctgtcactcactgccactc

SEQ ID NO: 185777 - DNA, 19 bp, Mus musculus
gggggtctctcactggctc

SEQ ID NO: 185778 - DNA, 23 bp, Mus musculus
gtgggtctctctgtgtgtgtgga

SEQ ID NO: 185779 - DNA, 21 bp, Mus musculus
acagatgtctgccaccagaga

SEQ ID NO: 185780 - DNA, 23 bp, Mus musculus
tcaccctcagactgtctgatagt

SEQ ID NO: 185781 - DNA, 22 bp, Mus musculus
caagagcagcaggtgctctaac

SEQ ID NO: 185782 - DNA, 23 bp, Mus musculus
ggtcactgtgtctgtctgtccag

SEQ ID NO: 185783 - DNA, 23 bp, Mus musculus
tgtgtgcgtgtgtgtatgtacac

SEQ ID NO: 185784 - DNA, 23 bp, Mus musculus
gtatgtatgtatgtatgtatgtt

SEQ ID NO: 185785 - DNA, 23 bp, Mus musculus
gtctgtctgtctgtctggcactc

SEQ ID NO: 185786 - DNA, 19 bp, Mus musculus
cttgagggatgaacctggg

SEQ ID NO: 185787 - DNA, 19 bp, Mus musculus
ggcatctctgtctctctgt

SEQ ID NO: 185788 - DNA, 23 bp, Mus musculus
tgtatagtgtgtatgctgtatgt

SEQ ID NO: 185789 - DNA, 23 bp, Mus musculus
tgtgtgtgtgtgtgcgcgtgcat

SEQ ID NO: 185790 - DNA, 23 bp, Mus musculus
cagtcagtctctgactcattccc

SEQ ID NO: 185791 - DNA, 23 bp, Mus musculus
cactggctgactgaaaccctgtt

SEQ ID NO: 185792 - DNA, 19 bp, Mus musculus
agtctgcctctgactcagt

SEQ ID NO: 185793 - DNA, 20 bp, Mus musculus
tgacacactgtgacccactg

SEQ ID NO: 185794 - DNA, 23 bp, Mus musculus
ctgtgtgtctgtctgtctgtctg

SEQ ID NO: 185795 - DNA, 22 bp, Mus musculus
tcagtccatctcacagtctcgg

SEQ ID NO: 185796 - DNA, 20 bp, Mus musculus
aacagaactctgtatgtaga

SEQ ID NO: 185797 - DNA, 23 bp, Mus musculus
atctgtgtgtgtgtgtatatata

SEQ ID NO: 185798 - DNA, 19 bp, Mus musculus
tatatgcaaatactcatac

SEQ ID NO: 185799 - DNA, 23 bp, Mus musculus
tgtattatttctgctgtgtcatt

SEQ ID NO: 185800 - DNA, 23 bp, Mus musculus
ttgcacacaggaagaattcagtt

SEQ ID NO: 185801 - DNA, 23 bp, Mus musculus
ttctctctgtctgactgccttgt

SEQ ID NO: 185802 - DNA, 23 bp, Mus musculus
gttgcttctcttccaggaggtgt

SEQ ID NO: 185803 - DNA, 21 bp, Mus musculus
tgtgtcacagacaaagctccg

SEQ ID NO: 185804 - DNA, 20 bp, Mus musculus
ctctgcacatatgtgtatgt

SEQ ID NO: 185805 - DNA, 22 bp, Mus musculus
gtaagtatgcatttgtatgtgt

SEQ ID NO: 185806 - DNA, 23 bp, Mus musculus
ctaatgacagtgtactcagggcc

SEQ ID NO: 185807 - DNA, 20 bp, Mus musculus
tgtcacgctgtcactgccca

SEQ ID NO: 185808 - DNA, 23 bp, Mus musculus
attctgtcagactctctatagtc

SEQ ID NO: 185809 - DNA, 23 bp, Mus musculus
ttctccatgcaaatgttgtctta

SEQ ID NO: 185810 - DNA, 23 bp, Mus musculus
cctaggacagagaattgagtgtg

SEQ ID NO: 185811 - DNA, 23 bp, Mus musculus
agaaaaattgtatttctcatagc

SEQ ID NO: 185812 - DNA, 18 bp, Mus musculus
agatctctctctctcttt

SEQ ID NO: 185813 - DNA, 23 bp, Mus musculus
ttatgtgtatatatatatgtgtg

SEQ ID NO: 185814 - DNA, 23 bp, Mus musculus
gcagagagtgagcagagagacag

SEQ ID NO: 185815 - DNA, 20 bp, Mus musculus
tacagttgtgagcctttgtg

SEQ ID NO: 185816 - DNA, 23 bp, Mus musculus
acactatgtatatatgtatgtat

SEQ ID NO: 185817 - DNA, 23 bp, Mus musculus
tgtatgcatgtacatatgtgtgt

SEQ ID NO: 185818 - DNA, 23 bp, Mus musculus
tgtttcctgtgtttggatgctct

SEQ ID NO: 185819 - DNA, 23 bp, Mus musculus
tggacagagaagagacagggcag

SEQ ID NO: 185820 - DNA, 21 bp, Mus musculus
atgtatgtatgtatgtatgca

SEQ ID NO: 185821 - DNA, 20 bp, Mus musculus
tgcatgcatgcatgcatgta

SEQ ID NO: 185822 - DNA, 19 bp, Mus musculus
agagagtccacagtgaccc

SEQ ID NO: 185823 - DNA, 23 bp, Mus musculus
tctctgtatgtgtgtgtgtcaaa

SEQ ID NO: 185824 - DNA, 23 bp, Mus musculus
tctcccacactgggtgctacagt

SEQ ID NO: 185825 - DNA, 23 bp, Mus musculus
accctggcaccctctctgcctct

SEQ ID NO: 185826 - DNA, 21 bp, Mus musculus
tatgtatgtatgtatgtatac

SEQ ID NO: 185827 - DNA, 18 bp, Mus musculus
tatacacacacacataca

SEQ ID NO: 185828 - DNA, 23 bp, Mus musculus
ctgcccctgactctgtggctctt

SEQ ID NO: 185829 - DNA, 21 bp, Mus musculus
tctctggctgagcatctgcga

SEQ ID NO: 185830 - DNA, 23 bp, Mus musculus
tatgtcactgtatttctgtgtgc

SEQ ID NO: 185831 - DNA, 18 bp, Mus musculus
gctggcactctgtattcc

SEQ ID NO: 185832 - DNA, 22 bp, Mus musculus
ccaaagcacttggtcccttgct

SEQ ID NO: 185833 - DNA, 23 bp, Mus musculus
tgcatgtgtacaagcatgtgtgt

SEQ ID NO: 185834 - DNA, 22 bp, Mus musculus
aagctggagagatggcttagtg

SEQ ID NO: 185835 - DNA, 23 bp, Mus musculus
tctctcggtctgactgagactcc

SEQ ID NO: 185836 - DNA, 23 bp, Mus musculus
atgagtaaggtagaagagtgatt

SEQ ID NO: 185837 - DNA, 20 bp, Mus musculus
tttcagcttcctgttcccaa

SEQ ID NO: 185838 - DNA, 18 bp, Mus musculus
tcaggggctggagagatg

SEQ ID NO: 185839 - DNA, 23 bp, Mus musculus
cgctctctgcctcagttttgtcc

SEQ ID NO: 185840 - DNA, 23 bp, Mus musculus
tctgcagtctcactctccctggc

SEQ ID NO: 185841 - DNA, 23 bp, Mus musculus
actgtcgttagtgtttccatgat

SEQ ID NO: 185842 - DNA, 18 bp, Mus musculus
tgtgggtacacaggtgat

SEQ ID NO: 185843 - DNA, 21 bp, Mus musculus
tcaggcccagtctgtctgtct

SEQ ID NO: 185844 - DNA, 23 bp, Mus musculus
gtgtctgtgtgtgtatgtttatt

SEQ ID NO: 185845 - DNA, 22 bp, Mus musculus
agctacatgtgcggctggtgag

SEQ ID NO: 185846 - DNA, 23 bp, Mus musculus
gtctctgcagttccaggagttgt

SEQ ID NO: 185847 - DNA, 22 bp, Mus musculus
tcacaccctctgtcactccgag

SEQ ID NO: 185848 - DNA, 23 bp, Mus musculus
cgaggaaccctgggtctttgtac

SEQ ID NO: 185849 - DNA, 19 bp, Mus musculus
atgctggctgcttgctctt

SEQ ID NO: 185850 - DNA, 23 bp, Mus musculus
caaggagttcagagaacctgttc

SEQ ID NO: 185851 - DNA, 21 bp, Mus musculus
taagagcactgactgctcttc

SEQ ID NO: 185852 - DNA, 18 bp, Mus musculus
catctatgtatatatgta

SEQ ID NO: 185853 - DNA, 23 bp, Mus musculus
catgtatatgtacgtgtatatgt

SEQ ID NO: 185854 - DNA, 23 bp, Mus musculus
gtgtctctgtgtgtctgtgggtg

SEQ ID NO: 185855 - DNA, 23 bp, Mus musculus
agtgagtgtagtgagtgtgagtg

SEQ ID NO: 185856 - DNA, 23 bp, Mus musculus
tgtagtactcagagtgctcacag

SEQ ID NO: 185857 - DNA, 23 bp, Mus musculus
agtttatctgggactggttcagc

SEQ ID NO: 185858 - DNA, 23 bp, Mus musculus
taaagtggacagagtgctcatcc

SEQ ID NO: 185859 - DNA, 22 bp, Mus musculus
tttggctctgcatgaattctag

SEQ ID NO: 185860 - DNA, 23 bp, Mus musculus
tgtgtgtatgtatctatatttgt

SEQ ID NO: 185861 - DNA, 23 bp, Mus musculus
taatgtgtgtgtcaatcatgtat

SEQ ID NO: 185862 - DNA, 23 bp, Mus musculus
tctgaaagccacttgtctctcac

SEQ ID NO: 185863 - DNA, 20 bp, Mus musculus
tgactgatgacagtgatcag

SEQ ID NO: 185864 - DNA, 21 bp, Mus musculus
tgcctgggtgcctgtaatggt

SEQ ID NO: 185865 - DNA, 23 bp, Mus musculus
atgactgtgtggatagctggatg

SEQ ID NO: 185866 - DNA, 23 bp, Mus musculus
actgtccctctgtgccttgcatc

SEQ ID NO: 185867 - DNA, 22 bp, Mus musculus
agagtgtgtctgtgtgtgagtg

SEQ ID NO: 185868 - DNA, 23 bp, Mus musculus
tgtgagtgtgcctgcttgagaga

SEQ ID NO: 185869 - DNA, 23 bp, Mus musculus
gtgggtgacacactctgtgtctc

SEQ ID NO: 185870 - DNA, 23 bp, Mus musculus
tcccaggctcgctgcatgccagt

SEQ ID NO: 185871 - DNA, 19 bp, Mus musculus
tgtgtgtttgtcttatatg

SEQ ID NO: 185872 - DNA, 23 bp, Mus musculus
atatatgttgcatataatatctt

SEQ ID NO: 185873 - DNA, 22 bp, Mus musculus
ggatgaagtgtgtgagcagagc

SEQ ID NO: 185874 - DNA, 23 bp, Mus musculus
tgagtgaggaagttgtatgttta

SEQ ID NO: 185875 - DNA, 22 bp, Mus musculus
gccactgtctgtctgtgccacc

SEQ ID NO: 185876 - DNA, 22 bp, Mus musculus
tcacagtacagtgtgaggttga

SEQ ID NO: 185877 - DNA, 23 bp, Mus musculus
gtgtgtgcatgtgtatgtgtgtg

SEQ ID NO: 185878 - DNA, 22 bp, Mus musculus
taagatcactgactgctcttcc

SEQ ID NO: 185879 - DNA, 21 bp, Mus musculus
tatcttcttgctgtgtctgtg

SEQ ID NO: 185880 - DNA, 23 bp, Mus musculus
tatcttaggttgggtttctattg

SEQ ID NO: 185881 - DNA, 22 bp, Mus musculus
agagaggaagctgagtggaaca

SEQ ID NO: 185882 - DNA, 23 bp, Mus musculus
agactggctcagtgcctggctct

SEQ ID NO: 185883 - DNA, 23 bp, Mus musculus
gtcagggtctcactgtggctctg

SEQ ID NO: 185884 - DNA, 23 bp, Mus musculus
cataccagacccagtctcactct

SEQ ID NO: 185885 - DNA, 23 bp, Mus musculus
tgtcactgtatctgtcacattgg

SEQ ID NO: 185886 - DNA, 22 bp, Mus musculus
atatgtgtatgtatataatcag

SEQ ID NO: 185887 - DNA, 22 bp, Mus musculus
taagtctttaccaaatgagcta

SEQ ID NO: 185888 - DNA, 23 bp, Mus musculus
acatcttctgacagcctctgtgt

SEQ ID NO: 185889 - DNA, 23 bp, Mus musculus
tactgaactagaccattccatga

SEQ ID NO: 185890 - DNA, 23 bp, Mus musculus
atatgtgtatggtgtatgtgtgt

SEQ ID NO: 185891 - DNA, 18 bp, Mus musculus
catgtgtatggtgtatgt

SEQ ID NO: 185892 - DNA, 23 bp, Mus musculus
ctgtctcagtgtgtcaggctggg

SEQ ID NO: 185893 - DNA, 20 bp, Mus musculus
ttgagatggagatagaatac

SEQ ID NO: 185894 - DNA, 23 bp, Mus musculus
atctaagtacactgtagctgtct

SEQ ID NO: 185895 - DNA, 23 bp, Mus musculus
ctgtgcctcactgtctctctggt

SEQ ID NO: 185896 - DNA, 23 bp, Mus musculus
cacagtgccatagtgcatgcata

SEQ ID NO: 185897 - DNA, 22 bp, Mus musculus
atatgcatgcatatatatgtgt

SEQ ID NO: 185898 - DNA, 19 bp, Mus musculus
cagaggtcctgagttcaat

SEQ ID NO: 185899 - DNA, 23 bp, Mus musculus
gactgaagagtgtgactggtgcg

SEQ ID NO: 185900 - DNA, 23 bp, Mus musculus
tagctgagggtgaccttcaactc

SEQ ID NO: 185901 - DNA, 23 bp, Mus musculus
gagtacactgtggctctcttcag

SEQ ID NO: 185902 - DNA, 22 bp, Mus musculus
gacagaactgtggactgactct

SEQ ID NO: 185903 - DNA, 23 bp, Mus musculus
tctctctgtctctgaggaaagct

SEQ ID NO: 185904 - DNA, 20 bp, Mus musculus
cactgactgctcttccagag

SEQ ID NO: 185905 - DNA, 23 bp, Mus musculus
attcatcataaaaatgcttagaa

SEQ ID NO: 185906 - DNA, 21 bp, Mus musculus
tgggaccaggctagatggggc

SEQ ID NO: 185907 - DNA, 18 bp, Mus musculus
agacagttgtgagtgacc

SEQ ID NO: 185908 - DNA, 20 bp, Mus musculus
tgtgtgttgtgtgtgtgcac

SEQ ID NO: 185909 - DNA, 23 bp, Mus musculus
acatgtgtatctgtatctgtgtg

SEQ ID NO: 185910 - DNA, 22 bp, Mus musculus
tttgtgtgttgtgtgtgtgcac

SEQ ID NO: 185911 - DNA, 23 bp, Mus musculus
tctgtccgtctgtctctgtgttt

SEQ ID NO: 185912 - DNA, 22 bp, Mus musculus
tctcagtcaccgacacactgtt

SEQ ID NO: 185913 - DNA, 23 bp, Mus musculus
agaacactgactgctcttccaga

SEQ ID NO: 185914 - DNA, 20 bp, Mus musculus
aaacttcagggagctggaga

SEQ ID NO: 185915 - DNA, 23 bp, Mus musculus
aactgtctgtactctggctccag

SEQ ID NO: 185916 - DNA, 23 bp, Mus musculus
tctgcctctgtgtctctgtgtct

SEQ ID NO: 185917 - DNA, 23 bp, Mus musculus
tgtgtgtgtgtgactgttttagt

SEQ ID NO: 185918 - DNA, 23 bp, Mus musculus
tgtgtgtgactgagtgcctgtgc

SEQ ID NO: 185919 - DNA, 23 bp, Mus musculus
tttgtctgtgattatgttataaa

SEQ ID NO: 185920 - DNA, 23 bp, Mus musculus
tatctatgcttatgtatctgttt

SEQ ID NO: 185921 - DNA, 20 bp, Mus musculus
tctgtgtgtatctctttgtg

SEQ ID NO: 185922 - DNA, 23 bp, Mus musculus
tgagtcaggctcgctctctccca

SEQ ID NO: 185923 - DNA, 23 bp, Mus musculus
ggactgtgatgatcctatcagat

SEQ ID NO: 185924 - DNA, 23 bp, Mus musculus
tgtgtccctgtgtgtgtgtacct

SEQ ID NO: 185925 - DNA, 20 bp, Mus musculus
agcacaggggctggagagat

SEQ ID NO: 185926 - DNA, 23 bp, Mus musculus
acttagggagccttagtcagagc

SEQ ID NO: 185927 - DNA, 22 bp, Mus musculus
ctccctcactcactgtcactgt

SEQ ID NO: 185928 - DNA, 23 bp, Mus musculus
ttctgagtttagctgtactttcc

SEQ ID NO: 185929 - DNA, 23 bp, Mus musculus
cctcttgagtctgtctgtgtctc

SEQ ID NO: 185930 - DNA, 22 bp, Mus musculus
atccacaggggctagagagatg

SEQ ID NO: 185931 - DNA, 23 bp, Mus musculus
tgcatgtatgtatgtatgtatgt

SEQ ID NO: 185932 - DNA, 23 bp, Mus musculus
ccagagagtctgtgaacagcctt

SEQ ID NO: 185933 - DNA, 23 bp, Mus musculus
ctgtctgtctgtctgtctgtgta

SEQ ID NO: 185934 - DNA, 18 bp, Mus musculus
tctctctctcactcccgc

SEQ ID NO: 185935 - DNA, 19 bp, Mus musculus
cagtgacagtgtgagcaga

SEQ ID NO: 185936 - DNA, 23 bp, Mus musculus
tcacactctggctgtgactcaga

SEQ ID NO: 185937 - DNA, 23 bp, Mus musculus
agagccttgactctagcagatca

SEQ ID NO: 185938 - DNA, 23 bp, Mus musculus
acgtgactggtagagtactggat

SEQ ID NO: 185939 - DNA, 21 bp, Mus musculus
tttatgttgaccaaggctagt

SEQ ID NO: 185940 - DNA, 22 bp, Mus musculus
tttctcagtgcatggtgtctga

SEQ ID NO: 185941 - DNA, 23 bp, Mus musculus
ggtactgagtgctcttccagagg

SEQ ID NO: 185942 - DNA, 19 bp, Mus musculus
tcatacatgtgtgtgctgt

SEQ ID NO: 185943 - DNA, 23 bp, Mus musculus
ctgtctgtctgtctgtctgtctg

SEQ ID NO: 185944 - DNA, 19 bp, Mus musculus
gaagtgactcacacccatt

SEQ ID NO: 185945 - DNA, 19 bp, Mus musculus
tctggggggctttgatgga

SEQ ID NO: 185946 - DNA, 23 bp, Mus musculus
tcagtgactccctcactgaggcc

SEQ ID NO: 185947 - DNA, 23 bp, Mus musculus
gtctgtctgtctgtctgactgct

SEQ ID NO: 185948 - DNA, 23 bp, Mus musculus
ctcactgactgctcttccagagg

SEQ ID NO: 185949 - DNA, 23 bp, Mus musculus
tcacactgagagttgagaggcag

SEQ ID NO: 185950 - DNA, 23 bp, Mus musculus
agtttcaccttctaactcccaac

SEQ ID NO: 185951 - DNA, 22 bp, Mus musculus
agcatcagtttagagagtgcag

SEQ ID NO: 185952 - DNA, 20 bp, Mus musculus
agacagaagactcagaggcc

SEQ ID NO: 185953 - DNA, 19 bp, Mus musculus
agaggttctgagttcaatt

SEQ ID NO: 185954 - DNA, 23 bp, Mus musculus
acagtcactggttgttgtaactg

SEQ ID NO: 185955 - DNA, 23 bp, Mus musculus
ttagatcaataacttctctgaca

SEQ ID NO: 185956 - DNA, 22 bp, Mus musculus
cacacatgacacagtgcacatg

SEQ ID NO: 185957 - DNA, 23 bp, Mus musculus
ctgagccactgtgcctgtctctc

SEQ ID NO: 185958 - DNA, 22 bp, Mus musculus
tatatgcatatgtatatattga

SEQ ID NO: 185959 - DNA, 23 bp, Mus musculus
tatgtgtgcatgtgtatgtgtat

SEQ ID NO: 185960 - DNA, 23 bp, Mus musculus
atgtatatgtgtatgtatgtgtg

SEQ ID NO: 185961 - DNA, 22 bp, Mus musculus
tatgtgtatatatatatgtgtg

SEQ ID NO: 185962 - DNA, 21 bp, Mus musculus
atgtatgtgtgtatctgtatt

SEQ ID NO: 185963 - DNA, 22 bp, Mus musculus
tgtatatatgtatgtgtgtatc

SEQ ID NO: 185964 - DNA, 22 bp, Mus musculus
atgtcactgactctgtcccatg

SEQ ID NO: 185965 - DNA, 23 bp, Mus musculus
tgggatgtagagaggtacctgta

SEQ ID NO: 185966 - DNA, 21 bp, Mus musculus
gtttgtgcatatgcatgtgtg

SEQ ID NO: 185967 - DNA, 23 bp, Mus musculus
tttcagtgcccagtcattaactc

SEQ ID NO: 185968 - DNA, 23 bp, Mus musculus
gtgtctctccctgactgggtctg

SEQ ID NO: 185969 - DNA, 23 bp, Mus musculus
gtctcatgtaattcagactagcc

SEQ ID NO: 185970 - DNA, 23 bp, Mus musculus
aaacactgactgctcttccagag

SEQ ID NO: 185971 - DNA, 23 bp, Mus musculus
tgtgtatatatatgtatatgtgt

SEQ ID NO: 185972 - DNA, 21 bp, Mus musculus
tatatgcatatatatacatat

SEQ ID NO: 185973 - DNA, 23 bp, Mus musculus
attgaactacatctccagctttt

SEQ ID NO: 185974 - DNA, 23 bp, Mus musculus
gactagagagagaactcagtggg

SEQ ID NO: 185975 - DNA, 23 bp, Mus musculus
tgtgcgtgtgtctgtctgtctgt

SEQ ID NO: 185976 - DNA, 19 bp, Mus musculus
ccctgacttttctggaact

SEQ ID NO: 185977 - DNA, 22 bp, Mus musculus
tatatatatatgtatggtgtat

SEQ ID NO: 185978 - DNA, 22 bp, Mus musculus
aaggtgacaccactagctgtac

SEQ ID NO: 185979 - DNA, 18 bp, Mus musculus
cagaggtcttgagttcaa

SEQ ID NO: 185980 - DNA, 23 bp, Mus musculus
gacttgacagtgagctgacttgg

SEQ ID NO: 185981 - DNA, 23 bp, Mus musculus
tatgtatgtatgtatgtatgtgc

SEQ ID NO: 185982 - DNA, 23 bp, Mus musculus
gactgtctgtctgtctgtcttgt

SEQ ID NO: 185983 - DNA, 21 bp, Mus musculus
tccgtgtacaccatgtgcatg

SEQ ID NO: 185984 - DNA, 23 bp, Mus musculus
ctgtgtgtctgtctgtgcgtaag

SEQ ID NO: 185985 - DNA, 23 bp, Mus musculus
acattcagcagttactggatgcc

SEQ ID NO: 185986 - DNA, 23 bp, Mus musculus
tctgtccatttgatttcactgat

SEQ ID NO: 185987 - DNA, 22 bp, Mus musculus
gtgtctgtgtgtctgtccttgg

SEQ ID NO: 185988 - DNA, 23 bp, Mus musculus
taagagcactgactgctcttcca

SEQ ID NO: 185989 - DNA, 20 bp, Mus musculus
gtatgtatgtatgtatgtgt

SEQ ID NO: 185990 - DNA, 23 bp, Mus musculus
ttgtttgatgactccattgggtg

SEQ ID NO: 185991 - DNA, 20 bp, Mus musculus
acatgtgtgtggatgtcctt

SEQ ID NO: 185992 - DNA, 18 bp, Mus musculus
gtggcaggcagtctggct

SEQ ID NO: 185993 - DNA, 23 bp, Mus musculus
tgactgactgactgactgaggct

SEQ ID NO: 185994 - DNA, 21 bp, Mus musculus
atgtatgtatgtatatgtgtg

SEQ ID NO: 185995 - DNA, 23 bp, Mus musculus
gcatgtgtgcatgtgtgtgtaga

SEQ ID NO: 185996 - DNA, 18 bp, Mus musculus
acatgtatatacacacac

SEQ ID NO: 185997 - DNA, 23 bp, Mus musculus
ggctgtctgtctgtctttgaggt

SEQ ID NO: 185998 - DNA, 23 bp, Mus musculus
atatgtgtatatatatatatgag

SEQ ID NO: 185999 - DNA, 23 bp, Mus musculus
ttcgaagagcaaagattctctct

SEQ ID NO: 186000 - DNA, 23 bp, Mus musculus
acatgtgtgtatccatgtgtgtg

SEQ ID NO: 186001 - DNA, 23 bp, Mus musculus
tgagtatgtatgtatatatgtgt

SEQ ID NO: 186002 - DNA, 22 bp, Mus musculus
tgtgtgtatatatctatatatg

SEQ ID NO: 186003 - DNA, 21 bp, Mus musculus
tctccagacttaatctactct

SEQ ID NO: 186004 - DNA, 23 bp, Mus musculus
tgtcacagatggcatgggactgt

SEQ ID NO: 186005 - DNA, 23 bp, Mus musculus
ctaatctctctgtgcctctgagt

SEQ ID NO: 186006 - DNA, 23 bp, Mus musculus
tgtgtctctctctgactctggat

SEQ ID NO: 186007 - DNA, 18 bp, Mus musculus
tgtatgcctgtgtgtctg

SEQ ID NO: 186008 - DNA, 23 bp, Mus musculus
cagtagacacagaggatctacaa

SEQ ID NO: 186009 - DNA, 19 bp, Mus musculus
aatatcagggacctggaga

SEQ ID NO: 186010 - DNA, 22 bp, Mus musculus
ttaaagctgcctttgctgtgct

SEQ ID NO: 186011 - DNA, 22 bp, Mus musculus
ttgtcagggaggtaaagctcac

SEQ ID NO: 186012 - DNA, 20 bp, Mus musculus
taaggtggtgagtctgatga

SEQ ID NO: 186013 - DNA, 20 bp, Mus musculus
gccagtggcttgtgtccagg

SEQ ID NO: 186014 - DNA, 23 bp, Mus musculus
gagtgagtgagtgagtgcctccc

SEQ ID NO: 186015 - DNA, 23 bp, Mus musculus
acctctgtctgtctctgtctggc

SEQ ID NO: 186016 - DNA, 23 bp, Mus musculus
taacactagcagctaatgaatgt

SEQ ID NO: 186017 - DNA, 23 bp, Mus musculus
gacagtacacagtgtcaactcaa

SEQ ID NO: 186018 - DNA, 23 bp, Mus musculus
tgtgtgtgtgtgtgtgcctgcct

SEQ ID NO: 186019 - DNA, 23 bp, Mus musculus
gtgtgcctgtgtgtgtgctggca

SEQ ID NO: 186020 - DNA, 23 bp, Mus musculus
gtcagttctctccgtccacctct

SEQ ID NO: 186021 - DNA, 21 bp, Mus musculus
tatgtatatatgtatatatgt

SEQ ID NO: 186022 - DNA, 18 bp, Mus musculus
tattgcatatatacatat

SEQ ID NO: 186023 - DNA, 23 bp, Mus musculus
tgtgtgcatatgtatgcatatgt

SEQ ID NO: 186024 - DNA, 19 bp, Mus musculus
tcactgccacatgagtcag

SEQ ID NO: 186025 - DNA, 23 bp, Mus musculus
tatgtgcatgtacatgtgtatgt

SEQ ID NO: 186026 - DNA, 23 bp, Mus musculus
cacagcctctctgcctctgagaa

SEQ ID NO: 186027 - DNA, 22 bp, Mus musculus
aaactgatagctcatactaact

SEQ ID NO: 186028 - DNA, 23 bp, Mus musculus
aattctgtctgtctgtctgcctg

SEQ ID NO: 186029 - DNA, 20 bp, Mus musculus
ttcaattcctagtaaccaca

SEQ ID NO: 186030 - DNA, 19 bp, Mus musculus
atcagagccttttcttgtg

SEQ ID NO: 186031 - DNA, 23 bp, Mus musculus
tgtatgtgtatatgtatatatgt

SEQ ID NO: 186032 - DNA, 18 bp, Mus musculus
tatgcgtgtatgtgtatg

SEQ ID NO: 186033 - DNA, 23 bp, Mus musculus
tgtatgtatgtacatgctcacat

SEQ ID NO: 186034 - DNA, 22 bp, Mus musculus
tatgtgtgtgtgcatgtgcatg

SEQ ID NO: 186035 - DNA, 20 bp, Mus musculus
tgtttgcatgtatgtatgtg

SEQ ID NO: 186036 - DNA, 23 bp, Mus musculus
tgcatgtgtgtattatgtgtgta

SEQ ID NO: 186037 - DNA, 21 bp, Mus musculus
tgtccttatataatgtgtatg

SEQ ID NO: 186038 - DNA, 18 bp, Mus musculus
gagtgtgaatatagacca

SEQ ID NO: 186039 - DNA, 23 bp, Mus musculus
tgtgtgtctgtgtcacaccaaag

SEQ ID NO: 186040 - DNA, 23 bp, Mus musculus
ctgtgtggatttgcatgtgcatc

SEQ ID NO: 186041 - DNA, 22 bp, Mus musculus
catatgtatgctcattctgtgg

SEQ ID NO: 186042 - DNA, 23 bp, Mus musculus
aatgtgcttgacctagggagtag

SEQ ID NO: 186043 - DNA, 22 bp, Mus musculus
actgtccctctttgccactctc

SEQ ID NO: 186044 - DNA, 23 bp, Mus musculus
ctgagtctcagttatctgcttgt

SEQ ID NO: 186045 - DNA, 23 bp, Mus musculus
gcctgcctgtgtgcctgtgtgct

SEQ ID NO: 186046 - DNA, 21 bp, Mus musculus
ttaagagcattcactgctctt

SEQ ID NO: 186047 - DNA, 18 bp, Mus musculus
tgtagtgagctcactcca

SEQ ID NO: 186048 - DNA, 23 bp, Mus musculus
gtctgtctgtctgtctgtctgcc

SEQ ID NO: 186049 - DNA, 22 bp, Mus musculus
cagaagtttcctgatggaggct

SEQ ID NO: 186050 - DNA, 21 bp, Mus musculus
tggctgggtcactgttgccag

SEQ ID NO: 186051 - DNA, 23 bp, Mus musculus
tgaggtatgtgtgtctgtgactc

SEQ ID NO: 186052 - DNA, 19 bp, Mus musculus
acactcagcatggttcaga

SEQ ID NO: 186053 - DNA, 21 bp, Mus musculus
gcactgactgctcttccagag

SEQ ID NO: 186054 - DNA, 23 bp, Mus musculus
ctgtgtgtgtgcctgtgtgcaca

SEQ ID NO: 186055 - DNA, 22 bp, Mus musculus
gtgtttgaatgtgtatgcattt

SEQ ID NO: 186056 - DNA, 23 bp, Mus musculus
tgtgagtgtatgtgcatgtgcat

SEQ ID NO: 186057 - DNA, 23 bp, Mus musculus
tctgtcagagcatgtggaactga

SEQ ID NO: 186058 - DNA, 20 bp, Mus musculus
gtatatgtgtatatgtgtgt

SEQ ID NO: 186059 - DNA, 21 bp, Mus musculus
gcgtgtgcatgcgtatgtgtg

SEQ ID NO: 186060 - DNA, 23 bp, Mus musculus
acactgactctgtctcctccagg

SEQ ID NO: 186061 - DNA, 23 bp, Mus musculus
tcccaggctctgtgtgtgtctaa

SEQ ID NO: 186062 - DNA, 23 bp, Mus musculus
tgctgactgtcacactctgtcac

SEQ ID NO: 186063 - DNA, 23 bp, Mus musculus
gcctgtgtctgtgtctgtgtgtg

SEQ ID NO: 186064 - DNA, 23 bp, Mus musculus
tgactgtctgccactgtccgtct

SEQ ID NO: 186065 - DNA, 19 bp, Mus musculus
cacggtgtctcacagtctg

SEQ ID NO: 186066 - DNA, 23 bp, Mus musculus
acaccaagtgaaagcaaaggcat

SEQ ID NO: 186067 - DNA, 21 bp, Mus musculus
tggctagatgttcctgttctg

SEQ ID NO: 186068 - DNA, 19 bp, Mus musculus
tagagaagccatctgtgta

SEQ ID NO: 186069 - DNA, 23 bp, Mus musculus
cattcactcactcactcactcat

SEQ ID NO: 186070 - DNA, 23 bp, Mus musculus
attcacctagcatttcttctgat

SEQ ID NO: 186071 - DNA, 18 bp, Mus musculus
ccacagtgtatacgtgga

SEQ ID NO: 186072 - DNA, 20 bp, Mus musculus
tataggagcagtaaccctct

SEQ ID NO: 186073 - DNA, 23 bp, Mus musculus
tgtatgtatgtatgtatgtgtgt

SEQ ID NO: 186074 - DNA, 23 bp, Mus musculus
ataggtgtatatatatgcatgtg

SEQ ID NO: 186075 - DNA, 23 bp, Mus musculus
gtctgtgtctgtgtccgtgtctg

SEQ ID NO: 186076 - DNA, 23 bp, Mus musculus
tcagtgtcaggacacagtgagga

SEQ ID NO: 186077 - DNA, 22 bp, Mus musculus
tggggctcagaatataatcagg

SEQ ID NO: 186078 - DNA, 23 bp, Mus musculus
ttagttatgcttggactcctgat

SEQ ID NO: 186079 - DNA, 22 bp, Mus musculus
aaaggggacttttaggtatgac

SEQ ID NO: 186080 - DNA, 21 bp, Mus musculus
aaggggcagaccaagaagtct

SEQ ID NO: 186081 - DNA, 23 bp, Mus musculus
ctgtctgtctgtctgtgtctctc

SEQ ID NO: 186082 - DNA, 23 bp, Mus musculus
gttctagatccgtatgtgatgtg

SEQ ID NO: 186083 - DNA, 23 bp, Mus musculus
cacagtcttcacacacacggtct

SEQ ID NO: 186084 - DNA, 21 bp, Mus musculus
aaagctgatgtggggctggag

SEQ ID NO: 186085 - DNA, 23 bp, Mus musculus
tccaacatgaggatctgattcac

SEQ ID NO: 186086 - DNA, 20 bp, Mus musculus
tgagagcagactgagaggag

SEQ ID NO: 186087 - DNA, 19 bp, Mus musculus
catgtatgtatacatgtat

SEQ ID NO: 186088 - DNA, 18 bp, Mus musculus
atagcaacatgattcagg

SEQ ID NO: 186089 - DNA, 23 bp, Mus musculus
aaccagaatatctaagtgtattc

SEQ ID NO: 186090 - DNA, 23 bp, Mus musculus
tagtccatggtgatctgatagga

SEQ ID NO: 186091 - DNA, 23 bp, Mus musculus
ttgttttgtgaccaattatgtgg

SEQ ID NO: 186092 - DNA, 23 bp, Mus musculus
tacagagttctgtctgtctctgc

SEQ ID NO: 186093 - DNA, 21 bp, Mus musculus
aagactttcctcgaactatga

SEQ ID NO: 186094 - DNA, 23 bp, Mus musculus
tctcactgtctgtctcctgtctg

SEQ ID NO: 186095 - DNA, 23 bp, Mus musculus
tctgtctcactgtgcctgatttc

SEQ ID NO: 186096 - DNA, 21 bp, Mus musculus
ttatgacaacacagtgctgat

SEQ ID NO: 186097 - DNA, 19 bp, Mus musculus
agacagcagacagtgaggg

SEQ ID NO: 186098 - DNA, 22 bp, Mus musculus
agagactgtcagaattcagtgt

SEQ ID NO: 186099 - DNA, 23 bp, Mus musculus
agtgtgtcagactctgcttctgg

SEQ ID NO: 186100 - DNA, 22 bp, Mus musculus
actctgtgtgtgtcattcttct

SEQ ID NO: 186101 - DNA, 22 bp, Mus musculus
cacagggacaatccaggatgaa

SEQ ID NO: 186102 - DNA, 21 bp, Mus musculus
ggctgtcactctgtgcctctc

SEQ ID NO: 186103 - DNA, 23 bp, Mus musculus
tctctctgactggaactgtggct

SEQ ID NO: 186104 - DNA, 19 bp, Mus musculus
acacctctctgtggacaga

SEQ ID NO: 186105 - DNA, 23 bp, Mus musculus
tagaggtagaaggatcagaagtt

SEQ ID NO: 186106 - DNA, 23 bp, Mus musculus
ccaaggtctctcctcttggtgag

SEQ ID NO: 186107 - DNA, 23 bp, Mus musculus
ctgctgtctgtctgtctgttatt

SEQ ID NO: 186108 - DNA, 23 bp, Mus musculus
gaataggatcggtgtgacagaca

SEQ ID NO: 186109 - DNA, 23 bp, Mus musculus
tgagtgcttgtctgtctgtctgt

SEQ ID NO: 186110 - DNA, 21 bp, Mus musculus
atgtatgtatgcatgtgttaa

SEQ ID NO: 186111 - DNA, 21 bp, Mus musculus
acattgcatatgtacatgagt

SEQ ID NO: 186112 - DNA, 23 bp, Mus musculus
aagagcactgactgctcttccag

SEQ ID NO: 186113 - DNA, 23 bp, Mus musculus
ctgctgtctgtctgtctgttatt

SEQ ID NO: 186114 - DNA, 23 bp, Mus musculus
gaataggatcggtgtgacagaca

SEQ ID NO: 186115 - DNA, 23 bp, Mus musculus
aagagcactgactgctcttccag

SEQ ID NO: 186116 - DNA, 23 bp, Mus musculus
gtctcagattcttcactccctcc

SEQ ID NO: 186117 - DNA, 22 bp, Mus musculus
tactgtctagacacacgcagca

SEQ ID NO: 186118 - DNA, 18 bp, Mus musculus
atggactaagtgaatact

SEQ ID NO: 186119 - DNA, 23 bp, Mus musculus
ggtgtgagtgagaagagagagcc

SEQ ID NO: 186120 - DNA, 18 bp, Mus musculus
agggcattttctatctga

SEQ ID NO: 186121 - DNA, 23 bp, Mus musculus
tgattagtcattttgtagtggag

SEQ ID NO: 186122 - DNA, 23 bp, Mus musculus
tctgttggagttggtctggtgtt

SEQ ID NO: 186123 - DNA, 23 bp, Mus musculus
tctgtgtggttctctgtttgcct

SEQ ID NO: 186124 - DNA, 22 bp, Mus musculus
ttgatgcacagtcacacagacc

SEQ ID NO: 186125 - DNA, 22 bp, Mus musculus
tatgcatctatgtatctatcta

SEQ ID NO: 186126 - DNA, 18 bp, Mus musculus
gtatgtatgtatgtatgt

SEQ ID NO: 186127 - DNA, 23 bp, Mus musculus
tgcatgtatgtatgcatgtatgt

SEQ ID NO: 186128 - DNA, 23 bp, Mus musculus
agcagagagtgaacagagagtgg

SEQ ID NO: 186129 - DNA, 23 bp, Mus musculus
cctctcaggcagctcctctgtct

SEQ ID NO: 186130 - DNA, 23 bp, Mus musculus
tctgtgtgttatgactgcatgtt

SEQ ID NO: 186131 - DNA, 20 bp, Mus musculus
atgcatgtacgtgtgtaggt

SEQ ID NO: 186132 - DNA, 23 bp, Mus musculus
tacaatgtatacatgtatgtatg

SEQ ID NO: 186133 - DNA, 23 bp, Mus musculus
taacactgtgtggttctttaagc

SEQ ID NO: 186134 - DNA, 21 bp, Mus musculus
ttgtggtcttcactctgtagg

SEQ ID NO: 186135 - DNA, 19 bp, Mus musculus
tgacagcacacagagccca

SEQ ID NO: 186136 - DNA, 20 bp, Mus musculus
ttcactgctcagtatccaga

SEQ ID NO: 186137 - DNA, 22 bp, Mus musculus
acactgacacactctccctgtg

SEQ ID NO: 186138 - DNA, 19 bp, Mus musculus
tctccctgccagtcccctc

SEQ ID NO: 186139 - DNA, 21 bp, Mus musculus
tgacccgctgtctgtctccca

SEQ ID NO: 186140 - DNA, 23 bp, Mus musculus
tgtgtatctgtctgtctgtgtat

SEQ ID NO: 186141 - DNA, 23 bp, Mus musculus
taatatgtatgcacatatgtgtg

SEQ ID NO: 186142 - DNA, 23 bp, Mus musculus
tgcctgcctgcctgcctgcctgg

SEQ ID NO: 186143 - DNA, 23 bp, Mus musculus
tctgtgagtgtgtgtgtctgtgt

SEQ ID NO: 186144 - DNA, 23 bp, Mus musculus
ctcactggagttccttgagcatg

SEQ ID NO: 186145 - DNA, 23 bp, Mus musculus
agaacactgactgctcttccaga

SEQ ID NO: 186146 - DNA, 23 bp, Mus musculus
attctgtctgtctgtctgtctgt

SEQ ID NO: 186147 - DNA, 23 bp, Mus musculus
ctctgtctctgtgtgtgcatgcg

SEQ ID NO: 186148 - DNA, 22 bp, Mus musculus
tttgagagaacagtgactgggc

SEQ ID NO: 186149 - DNA, 20 bp, Mus musculus
tcagagaagggtgtcaggag

SEQ ID NO: 186150 - DNA, 23 bp, Mus musculus
gaattcagactccacagattctc

SEQ ID NO: 186151 - DNA, 21 bp, Mus musculus
gtggctcactctcagcagttc

SEQ ID NO: 186152 - DNA, 23 bp, Mus musculus
gacagggtctctcactgattaag

SEQ ID NO: 186153 - DNA, 19 bp, Mus musculus
atatgtatatatgtgtgtg

SEQ ID NO: 186154 - DNA, 23 bp, Mus musculus
ctgaccctgtctctgagtgcctg

SEQ ID NO: 186155 - DNA, 23 bp, Mus musculus
tggcagtgtcttagctggttgtt

SEQ ID NO: 186156 - DNA, 23 bp, Mus musculus
tgtctgtctgtctgtgtgagggt

SEQ ID NO: 186157 - DNA, 23 bp, Mus musculus
tgtatgtatgtatatgtatatat

SEQ ID NO: 186158 - DNA, 23 bp, Mus musculus
cactcagtggctcactactctct

SEQ ID NO: 186159 - DNA, 21 bp, Mus musculus
tagtgggttctcaaggcgtta

SEQ ID NO: 186160 - DNA, 23 bp, Mus musculus
acattaatgatgaagaggctgtt

SEQ ID NO: 186161 - DNA, 20 bp, Mus musculus
atacctaggtgtgggttgga

SEQ ID NO: 186162 - DNA, 23 bp, Mus musculus
agagtaagaggaacatattgaac

SEQ ID NO: 186163 - DNA, 22 bp, Mus musculus
agaaatgtgtttttcttcttgt

SEQ ID NO: 186164 - DNA, 23 bp, Mus musculus
tgcctgcctgcctgcctgcctgc

SEQ ID NO: 186165 - DNA, 20 bp, Mus musculus
agagagcaaggacagtggaa

SEQ ID NO: 186166 - DNA, 23 bp, Mus musculus
actgtctctgactcttttgctgc

SEQ ID NO: 186167 - DNA, 23 bp, Mus musculus
agagacttactgactcagtcaaa

SEQ ID NO: 186168 - DNA, 23 bp, Mus musculus
attcaagagtggcagtctcaggc

SEQ ID NO: 186169 - DNA, 19 bp, Mus musculus
ttaagagcactgactgctc

SEQ ID NO: 186170 - DNA, 21 bp, Mus musculus
gacagggaaactctgtgctta

SEQ ID NO: 186171 - DNA, 22 bp, Mus musculus
ataacattcttgtcggagctaa

SEQ ID NO: 186172 - DNA, 21 bp, Mus musculus
tcacagtcacagtaacagcgg

SEQ ID NO: 186173 - DNA, 20 bp, Mus musculus
tgtctcactcacacaggatg

SEQ ID NO: 186174 - DNA, 22 bp, Mus musculus
actcaagaggttttgttgttgt

SEQ ID NO: 186175 - DNA, 23 bp, Mus musculus
acattgcccagtgacaaagaaga

SEQ ID NO: 186176 - DNA, 23 bp, Mus musculus
tacttgcctctctctcagactgt

SEQ ID NO: 186177 - DNA, 20 bp, Mus musculus
tatctacttgccctggacag

SEQ ID NO: 186178 - DNA, 23 bp, Mus musculus
tacagtgtgtatgtgtatatgtg

SEQ ID NO: 186179 - DNA, 23 bp, Mus musculus
atatatgtatatgtgtatgtgta

SEQ ID NO: 186180 - DNA, 23 bp, Mus musculus
tcagagtctgtctgggactgtag

SEQ ID NO: 186181 - DNA, 22 bp, Mus musculus
atgtatgtgtgcatgtatgtac

SEQ ID NO: 186182 - DNA, 20 bp, Mus musculus
tttatctgtgtaaatgaatg

SEQ ID NO: 186183 - DNA, 20 bp, Mus musculus
acacacacacatatacttct

SEQ ID NO: 186184 - DNA, 23 bp, Mus musculus
tatatttgaatatgtatatgtat

SEQ ID NO: 186185 - DNA, 23 bp, Mus musculus
tcacaggtagaccagagggacca

SEQ ID NO: 186186 - DNA, 19 bp, Mus musculus
tccttctatctatctatct

SEQ ID NO: 186187 - DNA, 23 bp, Mus musculus
acaacagtcatgatgatgaagac

SEQ ID NO: 186188 - DNA, 23 bp, Mus musculus
tccctctgaccctgaagccagtc

SEQ ID NO: 186189 - DNA, 21 bp, Mus musculus
taactcctgtctgtgctgtgt

SEQ ID NO: 186190 - DNA, 19 bp, Mus musculus
ctgtgatcagtgtgagcac

SEQ ID NO: 186191 - DNA, 19 bp, Mus musculus
taaaatgtttttgttgggg

SEQ ID NO: 186192 - DNA, 20 bp, Mus musculus
tgtgtgtctgtctgtccgtc

SEQ ID NO: 186193 - DNA, 23 bp, Mus musculus
acggtcacactttaaagtgagga

SEQ ID NO: 186194 - DNA, 19 bp, Mus musculus
tctgtctcattctgtcagc

SEQ ID NO: 186195 - DNA, 22 bp, Mus musculus
acagggggagaggaagctgtct

SEQ ID NO: 186196 - DNA, 22 bp, Mus musculus
tgtgtgtgtgcatgtgtgtgca

SEQ ID NO: 186197 - DNA, 23 bp, Mus musculus
tgtatatgtgcatgtgcatgcat

SEQ ID NO: 186198 - DNA, 23 bp, Mus musculus
tctcagactgacagagctgcttc

SEQ ID NO: 186199 - DNA, 23 bp, Mus musculus
tctgtgtctgtgtgtctgccact

SEQ ID NO: 186200 - DNA, 18 bp, Mus musculus
gtgtgtgtgacccagcca

SEQ ID NO: 186201 - DNA, 23 bp, Mus musculus
accagctgccactgtgtctctgt

SEQ ID NO: 186202 - DNA, 23 bp, Mus musculus
tctgcctctctgtgactctgtgg

SEQ ID NO: 186203 - DNA, 18 bp, Mus musculus
agagaagccactgactgt

SEQ ID NO: 186204 - DNA, 23 bp, Mus musculus
tgtctgtgtctctgtccctgtct

SEQ ID NO: 186205 - DNA, 22 bp, Mus musculus
tctgtggctgagactcagctgt

SEQ ID NO: 186206 - DNA, 21 bp, Mus musculus
tatgtgtgtgtggtttacatg

SEQ ID NO: 186207 - DNA, 23 bp, Mus musculus
aggtatgaggatgaattctgatt

SEQ ID NO: 186208 - DNA, 23 bp, Mus musculus
tgtgtctgtgtgtgtgtttcacg

SEQ ID NO: 186209 - DNA, 23 bp, Mus musculus
ccccttctctgtctgtctgtctg

SEQ ID NO: 186210 - DNA, 23 bp, Mus musculus
gggcactcagtctgtcagtcact

SEQ ID NO: 186211 - DNA, 22 bp, Mus musculus
acatctgaccaagtgtacaccg

SEQ ID NO: 186212 - DNA, 22 bp, Mus musculus
tgtaacagaatcaggatgtgga

SEQ ID NO: 186213 - DNA, 23 bp, Mus musculus
tctgtctctgtttgttctgtctg

SEQ ID NO: 186214 - DNA, 18 bp, Mus musculus
ttgagacaggctctctca

SEQ ID NO: 186215 - DNA, 22 bp, Mus musculus
agacctggagctcagtgattag

SEQ ID NO: 186216 - DNA, 21 bp, Mus musculus
tccctgagtcacttaaatgtt

SEQ ID NO: 186217 - DNA, 18 bp, Mus musculus
cactctgttttttcagag

SEQ ID NO: 186218 - DNA, 23 bp, Mus musculus
tctgcctctgtctcacacttgga

SEQ ID NO: 186219 - DNA, 19 bp, Mus musculus
atgagtgcatagatgtatg

SEQ ID NO: 186220 - DNA, 22 bp, Mus musculus
gtgtacatgcatgtgtgcatgt

SEQ ID NO: 186221 - DNA, 20 bp, Mus musculus
tgtatgtgtgcatgtgcatg

SEQ ID NO: 186222 - DNA, 23 bp, Mus musculus
tgcatgtgcatgtgtatatgtga

SEQ ID NO: 186223 - DNA, 23 bp, Mus musculus
gatctgtctctctgatgagcctg

SEQ ID NO: 186224 - DNA, 23 bp, Mus musculus
aagacagcccagcctttcactca

SEQ ID NO: 186225 - DNA, 23 bp, Mus musculus
ctgtctgtctgtctgtcaccttg

SEQ ID NO: 186226 - DNA, 23 bp, Mus musculus
tgcctgcctgcctgcctgctacg

SEQ ID NO: 186227 - DNA, 22 bp, Mus musculus
gaagctgagagtatagagatgg

SEQ ID NO: 186228 - DNA, 20 bp, Mus musculus
cactctgcctgtcacacctt

SEQ ID NO: 186229 - DNA, 23 bp, Mus musculus
tgtggagtgagtgtagttgtgcg

SEQ ID NO: 186230 - DNA, 23 bp, Mus musculus
agtggtgttcttacacagacaga

SEQ ID NO: 186231 - DNA, 23 bp, Mus musculus
acacacacagagattatggaccg

SEQ ID NO: 186232 - DNA, 23 bp, Mus musculus
ttgacagtcagtctgtccgtcac

SEQ ID NO: 186233 - DNA, 23 bp, Mus musculus
ctcaggctgtgtctgtctggcac

SEQ ID NO: 186234 - DNA, 23 bp, Mus musculus
gcctcagtcactctgtgtcctca

SEQ ID NO: 186235 - DNA, 18 bp, Mus musculus
agagcacagaatggctgt

SEQ ID NO: 186236 - DNA, 18 bp, Mus musculus
tgagtgttctgtgtgccc

SEQ ID NO: 186237 - DNA, 18 bp, Mus musculus
tgaactggattcgctcat

SEQ ID NO: 186238 - DNA, 23 bp, Mus musculus
tcagtggctctctgtctctgtga

SEQ ID NO: 186239 - DNA, 19 bp, Mus musculus
atgtgtgtatatatatatg

SEQ ID NO: 186240 - DNA, 20 bp, Mus musculus
atatgtacatgtgtgtatat

SEQ ID NO: 186241 - DNA, 19 bp, Mus musculus
agaccccagtgactggaga

SEQ ID NO: 186242 - DNA, 23 bp, Mus musculus
atatgtgtgtatgtatctgtgtg

SEQ ID NO: 186243 - DNA, 19 bp, Mus musculus
acagggactgagacgggct

SEQ ID NO: 186244 - DNA, 21 bp, Mus musculus
cccctctctccctgtctgagg

SEQ ID NO: 186245 - DNA, 22 bp, Mus musculus
agtctctgacacagttactcat

SEQ ID NO: 186246 - DNA, 23 bp, Mus musculus
gtctctgtctgtctgtctcgggc

SEQ ID NO: 186247 - DNA, 18 bp, Mus musculus
tgcctgcctgcctgcctc

SEQ ID NO: 186248 - DNA, 23 bp, Mus musculus
tgcctgcctgcctgcctgcctgc

SEQ ID NO: 186249 - DNA, 21 bp, Mus musculus
gtctgggaatttcatggcatt

SEQ ID NO: 186250 - DNA, 20 bp, Mus musculus
ggaactgtgtcaccatgggt

SEQ ID NO: 186251 - DNA, 23 bp, Mus musculus
cagtcactctgaccctgaggaac

SEQ ID NO: 186252 - DNA, 23 bp, Mus musculus
tatggttccatctgtgtctttgg

SEQ ID NO: 186253 - DNA, 18 bp, Mus musculus
gaggctgtcagggtccct

SEQ ID NO: 186254 - DNA, 23 bp, Mus musculus
cacacatgtgtatgtgtacatgt

SEQ ID NO: 186255 - DNA, 23 bp, Mus musculus
gtctctctctctgtgagggatgg

SEQ ID NO: 186256 - DNA, 23 bp, Mus musculus
tgtgtgtcacactggctgtgcta

SEQ ID NO: 186257 - DNA, 18 bp, Mus musculus
tcaagtcccagaaaccac

SEQ ID NO: 186258 - DNA, 23 bp, Mus musculus
gtgctctgcctgtgtgtctgtgt

SEQ ID NO: 186259 - DNA, 22 bp, Mus musculus
ggctctctctgtatctcactta

SEQ ID NO: 186260 - DNA, 19 bp, Mus musculus
acacggatgaaggctggaa

SEQ ID NO: 186261 - DNA, 23 bp, Mus musculus
tgtgtgtgtatctgtgtgttaca

SEQ ID NO: 186262 - DNA, 22 bp, Mus musculus
gttcttgccttcggcacaggct

SEQ ID NO: 186263 - DNA, 21 bp, Mus musculus
gtggtggacagtgtcaccgag

SEQ ID NO: 186264 - DNA, 19 bp, Mus musculus
cacactgtaacacctgtgc

SEQ ID NO: 186265 - DNA, 23 bp, Mus musculus
tgtctcagtctgtctgtgtgcag

SEQ ID NO: 186266 - DNA, 23 bp, Mus musculus
gtctcagtcagtctgtgtgcaga

SEQ ID NO: 186267 - DNA, 23 bp, Mus musculus
tttgatgtagtggtacttgttta

SEQ ID NO: 186268 - DNA, 23 bp, Mus musculus
tttctgtgtcagtgactcctacc

SEQ ID NO: 186269 - DNA, 23 bp, Mus musculus
tggaagagaactgattcctgcat

SEQ ID NO: 186270 - DNA, 23 bp, Mus musculus
tctaatactgcctggtaatgatg

SEQ ID NO: 186271 - DNA, 23 bp, Mus musculus
ctaacactgtctggtaacgatgt

SEQ ID NO: 186272 - DNA, 21 bp, Mus musculus
taccagacatggttagatctg

SEQ ID NO: 186273 - DNA, 23 bp, Mus musculus
gtctaatactgtctggtaatgcc

SEQ ID NO: 186274 - DNA, 22 bp, Mus musculus
tgtaggagtgggtgtgatcttg

SEQ ID NO: 186275 - DNA, 23 bp, Mus musculus
tttgacacagtgtctagtgtaga

SEQ ID NO: 186276 - DNA, 19 bp, Mus musculus
aagcaacagaatttgtaag

SEQ ID NO: 186277 - DNA, 21 bp, Mus musculus
atgtatgtatgtatgtctgta

SEQ ID NO: 186278 - DNA, 23 bp, Mus musculus
tcaaaagctaagaagatggttct

SEQ ID NO: 186279 - DNA, 22 bp, Mus musculus
tgagtgcctcactctctcccaa

SEQ ID NO: 186280 - DNA, 23 bp, Mus musculus
gacagtgagaacagtgggaccag

SEQ ID NO: 186281 - DNA, 19 bp, Mus musculus
tcacactgcatctgcagtc

SEQ ID NO: 186282 - DNA, 23 bp, Mus musculus
agtcagtacactgtaaactgtcc

SEQ ID NO: 186283 - DNA, 23 bp, Mus musculus
caggctgtcactcactgtgtcac

SEQ ID NO: 186284 - DNA, 23 bp, Mus musculus
ctcctgtctgctgctagttgctg

SEQ ID NO: 186285 - DNA, 23 bp, Mus musculus
tgtctctggctgtgtgcgtggct

SEQ ID NO: 186286 - DNA, 23 bp, Mus musculus
tgcatccctgtgtccctctgtct

SEQ ID NO: 186287 - DNA, 18 bp, Mus musculus
agagatagctgaccaggt

SEQ ID NO: 186288 - DNA, 23 bp, Mus musculus
ctagacaggcagctatgctcagg

SEQ ID NO: 186289 - DNA, 23 bp, Mus musculus
tattagctgggtctctgtgtgag

SEQ ID NO: 186290 - DNA, 23 bp, Mus musculus
cgtctgtccgtctgtctgtctgt

SEQ ID NO: 186291 - DNA, 23 bp, Mus musculus
tgttgtcagagtgcagacactgg

SEQ ID NO: 186292 - DNA, 20 bp, Mus musculus
gtgtgtatatgtatgtgtat

SEQ ID NO: 186293 - DNA, 19 bp, Mus musculus
tgtatgtatgtgtgcatgt

SEQ ID NO: 186294 - DNA, 23 bp, Mus musculus
atatgtgtgtatatatatgtgtg

SEQ ID NO: 186295 - DNA, 23 bp, Mus musculus
taaaccttgttgacaaaggccat

SEQ ID NO: 186296 - DNA, 23 bp, Mus musculus
tctgtgagcatgtgcatctgtac

SEQ ID NO: 186297 - DNA, 21 bp, Mus musculus
atttgcacatgtgcacgactg

SEQ ID NO: 186298 - DNA, 23 bp, Mus musculus
ctttgtctgtctgtctgtctgtc

SEQ ID NO: 186299 - DNA, 23 bp, Mus musculus
gtatgtatgtatgtatgtatgta

SEQ ID NO: 186300 - DNA, 23 bp, Mus musculus
ttccctgtgtccctcactgcctg

SEQ ID NO: 186301 - DNA, 21 bp, Mus musculus
ttctctcactgagtgctaagg

SEQ ID NO: 186302 - DNA, 23 bp, Mus musculus
acacttactcactggtaatcctg

SEQ ID NO: 186303 - DNA, 23 bp, Mus musculus
acactctgacactgaagcttgtg

SEQ ID NO: 186304 - DNA, 21 bp, Mus musculus
tgtctatttgttcatgtgtgt

SEQ ID NO: 186305 - DNA, 23 bp, Mus musculus
ctccactctctctctctgttttc

SEQ ID NO: 186306 - DNA, 22 bp, Mus musculus
tgtgcatgtatgtatatatgta

SEQ ID NO: 186307 - DNA, 23 bp, Mus musculus
atgcatgtgtgtgtgtgtgtgtg

SEQ ID NO: 186308 - DNA, 23 bp, Mus musculus
acatttgtgacggacagactgac

SEQ ID NO: 186309 - DNA, 21 bp, Mus musculus
taactgactgactctatggtg

SEQ ID NO: 186310 - DNA, 21 bp, Mus musculus
atgagtgctttgactgcatct

SEQ ID NO: 186311 - DNA, 23 bp, Mus musculus
tatgtatgtatgtatatgtattg

SEQ ID NO: 186312 - DNA, 23 bp, Mus musculus
ttttgtcacacagcagtcaggcc

SEQ ID NO: 186313 - DNA, 21 bp, Mus musculus
ctctgagatgtgtgagtgcac

SEQ ID NO: 186314 - DNA, 23 bp, Mus musculus
tgtgtgtttgccttgagtctcag

SEQ ID NO: 186315 - DNA, 23 bp, Mus musculus
ggacaagcgtctgtcagtctgtc

SEQ ID NO: 186316 - DNA, 23 bp, Mus musculus
gctcagcgactctgactctgtgg

SEQ ID NO: 186317 - DNA, 23 bp, Mus musculus
tatgtgtatatatacatatgtgt

SEQ ID NO: 186318 - DNA, 23 bp, Mus musculus
tgagcctgggtctgtcgctcagt

SEQ ID NO: 186319 - DNA, 23 bp, Mus musculus
gtgtaatgttgtgtgctgtttgc

SEQ ID NO: 186320 - DNA, 23 bp, Mus musculus
gtctgtctctctgtgagctcatg

SEQ ID NO: 186321 - DNA, 20 bp, Mus musculus
gagagagccatagcagtcag

SEQ ID NO: 186322 - DNA, 23 bp, Mus musculus
tggggctcactcactgtgtgcct

SEQ ID NO: 186323 - DNA, 20 bp, Mus musculus
attgatcaagcagatgcctg

SEQ ID NO: 186324 - DNA, 21 bp, Mus musculus
taaccctctccatttgttctg

SEQ ID NO: 186325 - DNA, 23 bp, Mus musculus
tctgtgtgtctgagaatctggct

SEQ ID NO: 186326 - DNA, 18 bp, Mus musculus
tacaaccttcctcacact

SEQ ID NO: 186327 - DNA, 23 bp, Mus musculus
taacaggagagagtgggcacttc

SEQ ID NO: 186328 - DNA, 22 bp, Mus musculus
gtttgcttcagtattgagatag

SEQ ID NO: 186329 - DNA, 23 bp, Mus musculus
tgtgtgtgcatatgcatgtgaat

SEQ ID NO: 186330 - DNA, 22 bp, Mus musculus
attcatgcatatgtgtatgtgt

SEQ ID NO: 186331 - DNA, 21 bp, Mus musculus
ctctgtatgtgcgtgtgcgtg

SEQ ID NO: 186332 - DNA, 23 bp, Mus musculus
actgtgtgcatgtgcatgtgtgt

SEQ ID NO: 186333 - DNA, 19 bp, Mus musculus
tgcactgtgtgcatgtgta

SEQ ID NO: 186334 - DNA, 23 bp, Mus musculus
actgtgtgcatgtgcatgtgtgt

SEQ ID NO: 186335 - DNA, 21 bp, Mus musculus
tgcactgtgtgcatgtgtacc

SEQ ID NO: 186336 - DNA, 23 bp, Mus musculus
gactgacactgtctgtgtcactg

SEQ ID NO: 186337 - DNA, 19 bp, Mus musculus
tttaagtaaatgtgcacac

SEQ ID NO: 186338 - DNA, 18 bp, Mus musculus
gtctgtgtgtcactgcat

SEQ ID NO: 186339 - DNA, 22 bp, Mus musculus
tgtgtgtgtgtctatgtctctg

SEQ ID NO: 186340 - DNA, 19 bp, Mus musculus
ctcagactggcaaagaacc

SEQ ID NO: 186341 - DNA, 22 bp, Mus musculus
tgtgtacatgtacaggtggctt

SEQ ID NO: 186342 - DNA, 22 bp, Mus musculus
acttatgtatatatgtttatgt

SEQ ID NO: 186343 - DNA, 20 bp, Mus musculus
tgtgtgcatatgcatctgca

SEQ ID NO: 186344 - DNA, 20 bp, Mus musculus
ttgcagctgagactcgttgg

SEQ ID NO: 186345 - DNA, 23 bp, Mus musculus
agagtgtcactctgcctgtgaca

SEQ ID NO: 186346 - DNA, 19 bp, Mus musculus
tctgctacacctgaccttg

SEQ ID NO: 186347 - DNA, 23 bp, Mus musculus
gacagtgtggctctgtctgtctg

SEQ ID NO: 186348 - DNA, 23 bp, Mus musculus
tctctgtgtctctgtttgaaatg

SEQ ID NO: 186349 - DNA, 19 bp, Mus musculus
tgtgtgtacatatgtgtgt

SEQ ID NO: 186350 - DNA, 18 bp, Mus musculus
cactgactgctcttccag

SEQ ID NO: 186351 - DNA, 23 bp, Mus musculus
tccgtccatctgtctgtctgtct

SEQ ID NO: 186352 - DNA, 23 bp, Mus musculus
gtctgtctctgtcatctccttct

SEQ ID NO: 186353 - DNA, 22 bp, Mus musculus
ctgtcaggagtagctacagagt

SEQ ID NO: 186354 - DNA, 23 bp, Mus musculus
gtgtgtgtatatgtatatatgtg

SEQ ID NO: 186355 - DNA, 22 bp, Mus musculus
acacacatatgtatacacacac

SEQ ID NO: 186356 - DNA, 23 bp, Mus musculus
cttggaactcacactgaagttca

SEQ ID NO: 186357 - DNA, 19 bp, Mus musculus
gtgtgcatatgtgtgtgta

SEQ ID NO: 186358 - DNA, 23 bp, Mus musculus
tgtgtacatgtgcatgtacatgt

SEQ ID NO: 186359 - DNA, 21 bp, Mus musculus
atgtgtgtctgtatgtgtgtc

SEQ ID NO: 186360 - DNA, 22 bp, Mus musculus
atatgcatatatatatgtgtgt

SEQ ID NO: 186361 - DNA, 22 bp, Mus musculus
agacaggtcactgaggacagac

SEQ ID NO: 186362 - DNA, 23 bp, Mus musculus
atgtgtgtatatgtatatgtgtg

SEQ ID NO: 186363 - DNA, 23 bp, Mus musculus
atatgtgcgtgtaagtgtgtctc

SEQ ID NO: 186364 - DNA, 23 bp, Mus musculus
tgtgtgtacagtgagtgcagacc

SEQ ID NO: 186365 - DNA, 23 bp, Mus musculus
tgtgtgtacagtgagtgcagacc

SEQ ID NO: 186366 - DNA, 23 bp, Mus musculus
tgtgtgtacagtgagtgcagacc

SEQ ID NO: 186367 - DNA, 23 bp, Mus musculus
gtgtgtacagtgagtgcagacct

SEQ ID NO: 186368 - DNA, 23 bp, Mus musculus
actgtgtgtacagtgagtgcaga

SEQ ID NO: 186369 - DNA, 23 bp, Mus musculus
gtgtgtacagtgagtgcagacct

SEQ ID NO: 186370 - DNA, 22 bp, Mus musculus
tgtgtgtatagtgagtgcagac

SEQ ID NO: 186371 - DNA, 23 bp, Mus musculus
tgtgtgtacagtgagtgcagacc

SEQ ID NO: 186372 - DNA, 23 bp, Mus musculus
tgtgtacagtgaatgcagaccta

SEQ ID NO: 186373 - DNA, 23 bp, Mus musculus
tgtgtgtctgtgtctgtctgtct

SEQ ID NO: 186374 - DNA, 23 bp, Mus musculus
aggacttgttcctcagtaggtct

SEQ ID NO: 186375 - DNA, 23 bp, Mus musculus
gtgtctgtccctctctgaatttg

SEQ ID NO: 186376 - DNA, 23 bp, Mus musculus
aatcagatctcatagagttagag

SEQ ID NO: 186377 - DNA, 23 bp, Mus musculus
tatgtgcatgtatttatatgtga

SEQ ID NO: 186378 - DNA, 23 bp, Mus musculus
tgagtgtatgtatgtatatgtgc

SEQ ID NO: 186379 - DNA, 23 bp, Mus musculus
tcccagacagactctgagtcacc

SEQ ID NO: 186380 - DNA, 23 bp, Mus musculus
cactcagtctctgtctcacctgt

SEQ ID NO: 186381 - DNA, 23 bp, Mus musculus
tgaagcagccagcgtgagttttc

SEQ ID NO: 186382 - DNA, 23 bp, Mus musculus
ctgtgtgtatgtgtgtgtgtctg

SEQ ID NO: 186383 - DNA, 22 bp, Mus musculus
acagctgctgagagtcaggaga

SEQ ID NO: 186384 - DNA, 21 bp, Mus musculus
ttccaatagtgattttgtttt

SEQ ID NO: 186385 - DNA, 23 bp, Mus musculus
cttgggaggtagagagatggctt

SEQ ID NO: 186386 - DNA, 18 bp, Mus musculus
tcacgggctggagagatg

SEQ ID NO: 186387 - DNA, 23 bp, Mus musculus
atttatttgatgtgtgtaggtgt

SEQ ID NO: 186388 - DNA, 23 bp, Mus musculus
gcgtgtctctgccactgtgtgcc

SEQ ID NO: 186389 - DNA, 23 bp, Mus musculus
cgcactctgtctccatggttctg

SEQ ID NO: 186390 - DNA, 23 bp, Mus musculus
agacacggagtctgtgtccctgt

SEQ ID NO: 186391 - DNA, 23 bp, Mus musculus
tttagtgtatgtatgtatgtatg

SEQ ID NO: 186392 - DNA, 23 bp, Mus musculus
tgcatgcatgcatgtatgggtga

SEQ ID NO: 186393 - DNA, 23 bp, Mus musculus
gtctctctgtgtgtgtgtgcgtg

SEQ ID NO: 186394 - DNA, 18 bp, Mus musculus
ccttatcattttctgaag

SEQ ID NO: 186395 - DNA, 23 bp, Mus musculus
ggggtgtctctgagtctgtgcct

SEQ ID NO: 186396 - DNA, 23 bp, Mus musculus
ctgggtgtctctgtggctcacag

SEQ ID NO: 186397 - DNA, 18 bp, Mus musculus
gtatgtatgcatgtatgt

SEQ ID NO: 186398 - DNA, 23 bp, Mus musculus
agagttgacttggagctggagag

SEQ ID NO: 186399 - DNA, 23 bp, Mus musculus
ctggctgcctgtcacccttcctg

SEQ ID NO: 186400 - DNA, 22 bp, Mus musculus
gcacacagtgaagtctgcagag

SEQ ID NO: 186401 - DNA, 23 bp, Mus musculus
tatgggtctgtgtgtgggtctaa

SEQ ID NO: 186402 - DNA, 18 bp, Mus musculus
tctctatatctatctatc

SEQ ID NO: 186403 - DNA, 23 bp, Mus musculus
atctgtctgtctatctgtctgtg

SEQ ID NO: 186404 - DNA, 19 bp, Mus musculus
gaatgtggtgacagatctc

SEQ ID NO: 186405 - DNA, 23 bp, Mus musculus
agacagtacagtgagagaagttg

SEQ ID NO: 186406 - DNA, 22 bp, Mus musculus
acacagagagagatagtactga

SEQ ID NO: 186407 - DNA, 21 bp, Mus musculus
tgagtgtgaggttaggcaggg

SEQ ID NO: 186408 - DNA, 23 bp, Mus musculus
agtgcggtgtgtctgtctgtctg

SEQ ID NO: 186409 - DNA, 23 bp, Mus musculus
tctgtctgtctgtctgtccttgt

SEQ ID NO: 186410 - DNA, 21 bp, Mus musculus
tggctgtagtctgtgtgctct

SEQ ID NO: 186411 - DNA, 20 bp, Mus musculus
atgtatgtatgcatgtgtat

SEQ ID NO: 186412 - DNA, 23 bp, Mus musculus
ctccctactgtgtctgtctcctg

SEQ ID NO: 186413 - DNA, 23 bp, Mus musculus
tgatcacagacactctctgtggc

SEQ ID NO: 186414 - DNA, 23 bp, Mus musculus
tctcagcctctctcagtgacatc

SEQ ID NO: 186415 - DNA, 23 bp, Mus musculus
tgtctgtctgtctgtctgtctgt

SEQ ID NO: 186416 - DNA, 20 bp, Mus musculus
taaggaaggcattcttgtca

SEQ ID NO: 186417 - DNA, 22 bp, Mus musculus
tgacagagaggacagtgggggc

SEQ ID NO: 186418 - DNA, 23 bp, Mus musculus
aaagagcctctctcactgggtgt

SEQ ID NO: 186419 - DNA, 23 bp, Mus musculus
tggctcagactctgactggctgc

SEQ ID NO: 186420 - DNA, 23 bp, Mus musculus
actgtgggtctgtgtgactgtgc

SEQ ID NO: 186421 - DNA, 18 bp, Mus musculus
tgagtcacagagtgggca

SEQ ID NO: 186422 - DNA, 23 bp, Mus musculus
cggagcctgtgtctctctctccg

SEQ ID NO: 186423 - DNA, 23 bp, Mus musculus
ggagcctgtgtctctctctccgt

SEQ ID NO: 186424 - DNA, 18 bp, Mus musculus
gttctcactttgtctctg

SEQ ID NO: 186425 - DNA, 23 bp, Mus musculus
aagagcactgactgctcttccag

SEQ ID NO: 186426 - DNA, 23 bp, Mus musculus
atctgaatgtttttatgtgtata

SEQ ID NO: 186427 - DNA, 23 bp, Mus musculus
aggagtatactttgcatgctgaa

SEQ ID NO: 186428 - DNA, 21 bp, Mus musculus
gtgagagtaaacactggggtc

SEQ ID NO: 186429 - DNA, 23 bp, Mus musculus
tgagtgcttgtctgtctgtctgt

SEQ ID NO: 186430 - DNA, 23 bp, Mus musculus
aagagcactgactgctcttccag

SEQ ID NO: 186431 - DNA, 23 bp, Mus musculus
ctgtctgtctgtctgttatttat

SEQ ID NO: 186432 - DNA, 23 bp, Mus musculus
tgctgtctgtctgtctgttattt

SEQ ID NO: 186433 - DNA, 22 bp, Mus musculus
atcctagttgaatgagtacatg

SEQ ID NO: 186434 - DNA, 23 bp, Mus musculus
gaataggatcggtgtgacagaca

SEQ ID NO: 186435 - DNA, 23 bp, Mus musculus
aggagtatactttgcatgctgaa

SEQ ID NO: 186436 - DNA, 21 bp, Mus musculus
gtgagagtaaacactggggtc

SEQ ID NO: 186437 - DNA, 23 bp, Mus musculus
tgagtgcttgtctgtctgtctgt

SEQ ID NO: 186438 - DNA, 21 bp, Mus musculus
atgtatgtatgcatgtgttaa

SEQ ID NO: 186439 - DNA, 21 bp, Mus musculus
tccatggtggtctgataggat

SEQ ID NO: 186440 - DNA, 22 bp, Mus musculus
tgttttgtgaccaattatatgg

SEQ ID NO: 186441 - DNA, 22 bp, Mus musculus
ctatgacagttgagggtgggag

SEQ ID NO: 186442 - DNA, 22 bp, Mus musculus
gtctctgtcactggctcagtgt

SEQ ID NO: 186443 - DNA, 22 bp, Mus musculus
ttgagtgagaggaagtgctcac

SEQ ID NO: 186444 - DNA, 21 bp, Mus musculus
tatatgtatatatatatgtgt

SEQ ID NO: 186445 - DNA, 23 bp, Mus musculus
agtgtggaatgttgtttgctatc

SEQ ID NO: 186446 - DNA, 21 bp, Mus musculus
tgaaaatcaaacttgagtctt

SEQ ID NO: 186447 - DNA, 23 bp, Mus musculus
ttctgtgttctggctcctgctga

SEQ ID NO: 186448 - DNA, 23 bp, Mus musculus
tgtatgtgcatctgaatgtatgt

SEQ ID NO: 186449 - DNA, 20 bp, Mus musculus
actgctaatgtatgctctct

SEQ ID NO: 186450 - DNA, 21 bp, Mus musculus
atatggatttgaatggagaat

SEQ ID NO: 186451 - DNA, 23 bp, Mus musculus
atgtctgttttcttccttcagtg

SEQ ID NO: 186452 - DNA, 23 bp, Mus musculus
ctgagagaagagactaaggtgct

SEQ ID NO: 186453 - DNA, 23 bp, Mus musculus
gtgtgtctgtgtttctgtatctc

SEQ ID NO: 186454 - DNA, 22 bp, Mus musculus
atgtagagggcatagctcagat

SEQ ID NO: 186455 - DNA, 20 bp, Mus musculus
tgggtatatattgtgtatgt

SEQ ID NO: 186456 - DNA, 18 bp, Mus musculus
agaagaagcaatatgaga

SEQ ID NO: 186457 - DNA, 23 bp, Mus musculus
tgttcatggtggtctgataggat

SEQ ID NO: 186458 - DNA, 23 bp, Mus musculus
caatatttttgtatctgttgagg

SEQ ID NO: 186459 - DNA, 23 bp, Mus musculus
ttggagctagagagatggctcag

SEQ ID NO: 186460 - DNA, 21 bp, Mus musculus
tgctgagccatgactccagct

SEQ ID NO: 186461 - DNA, 21 bp, Mus musculus
tgtcttagcaagaacacaggg

SEQ ID NO: 186462 - DNA, 20 bp, Mus musculus
tggctcagtggttaggagca

SEQ ID NO: 186463 - DNA, 18 bp, Mus musculus
tgccttccatggtgctgg

SEQ ID NO: 186464 - DNA, 23 bp, Mus musculus
ctgtctgtctgtctgtctgtagg

SEQ ID NO: 186465 - DNA, 19 bp, Mus musculus
tctcagggaggataggtag

SEQ ID NO: 186466 - DNA, 21 bp, Mus musculus
tagaagttactgttgaatctg

SEQ ID NO: 186467 - DNA, 21 bp, Mus musculus
atgtgtatatatatatatctc

SEQ ID NO: 186468 - DNA, 23 bp, Mus musculus
cagggtctgtgagtctctcttaa

SEQ ID NO: 186469 - DNA, 23 bp, Mus musculus
atggttgttttcggttactgttt

SEQ ID NO: 186470 - DNA, 23 bp, Mus musculus
tgagaggatttttcagtggccaa

SEQ ID NO: 186471 - DNA, 23 bp, Mus musculus
ggcgtctgtctgtctgtccatgc

SEQ ID NO: 186472 - DNA, 23 bp, Mus musculus
tagctgtgaggaaatcaagagtt

SEQ ID NO: 186473 - DNA, 20 bp, Mus musculus
tgtgtgtgtatgtgtatatg

SEQ ID NO: 186474 - DNA, 23 bp, Mus musculus
atatatgtgtccatgtgtatgca

SEQ ID NO: 186475 - DNA, 23 bp, Mus musculus
actgttgtgaagttgttgttcag

SEQ ID NO: 186476 - DNA, 21 bp, Mus musculus
tgtcagtctctgtgcttgtgc

SEQ ID NO: 186477 - DNA, 20 bp, Mus musculus
tcacctcaagctgctgcctg

SEQ ID NO: 186478 - DNA, 19 bp, Mus musculus
tgtggggctggaaagatgg

SEQ ID NO: 186479 - DNA, 23 bp, Mus musculus
tacacacatatgtatacatgtat

SEQ ID NO: 186480 - DNA, 23 bp, Mus musculus
tgcatgtgtgtatatgtatatgt

SEQ ID NO: 186481 - DNA, 23 bp, Mus musculus
tgcctggctgcctgatttgctgt

SEQ ID NO: 186482 - DNA, 23 bp, Mus musculus
taagagcactgactgctcttcca

SEQ ID NO: 186483 - DNA, 23 bp, Mus musculus
gagagcctctgtctgtctcctag

SEQ ID NO: 186484 - DNA, 21 bp, Mus musculus
tctgtgagtcagacattccgt

SEQ ID NO: 186485 - DNA, 21 bp, Mus musculus
tcagtcacgttgtctagctcg

SEQ ID NO: 186486 - DNA, 23 bp, Mus musculus
cctctctcaccctctctgtaagg

SEQ ID NO: 186487 - DNA, 23 bp, Mus musculus
actgaagagagactggtgtgtgg

SEQ ID NO: 186488 - DNA, 23 bp, Mus musculus
atcttcaccagcatctcgagcag

SEQ ID NO: 186489 - DNA, 20 bp, Mus musculus
tctgtctgactctccccgcc

SEQ ID NO: 186490 - DNA, 23 bp, Mus musculus
tcactctccatctctctgagctc

SEQ ID NO: 186491 - DNA, 23 bp, Mus musculus
gaaaggctgagaacagaggtcca

SEQ ID NO: 186492 - DNA, 22 bp, Mus musculus
tgtgtgtgtgcatttgcatgtg

SEQ ID NO: 186493 - DNA, 23 bp, Mus musculus
tatgtgcatgtgtgtatatgtgt

SEQ ID NO: 186494 - DNA, 20 bp, Mus musculus
tcactgaggtgggctgtgag

SEQ ID NO: 186495 - DNA, 23 bp, Mus musculus
tgctctgttctgagcctctgtgt

SEQ ID NO: 186496 - DNA, 20 bp, Mus musculus
atggctcccaggctggactg

SEQ ID NO: 186497 - DNA, 22 bp, Mus musculus
ttgtgtctgagtcactgtacat

SEQ ID NO: 186498 - DNA, 23 bp, Mus musculus
aattgtgcatgtaattacatgtg

SEQ ID NO: 186499 - DNA, 23 bp, Mus musculus
tctgaccctgtgtgactcgctgc

SEQ ID NO: 186500 - DNA, 20 bp, Mus musculus
tgcatgtgtgcatgtgcatg

SEQ ID NO: 186501 - DNA, 19 bp, Mus musculus
tgtatgtatgtatatgtat

SEQ ID NO: 186502 - DNA, 23 bp, Mus musculus
tctgtctgtctgtctgtctggtc

SEQ ID NO: 186503 - DNA, 23 bp, Mus musculus
ctgctgtggatgcagctgtaact

SEQ ID NO: 186504 - DNA, 23 bp, Mus musculus
cagtcactcactcactcactcac

SEQ ID NO: 186505 - DNA, 23 bp, Mus musculus
gagtcactctctggttctgctgt

SEQ ID NO: 186506 - DNA, 22 bp, Mus musculus
ctctgtctgtctgtccttcccg

SEQ ID NO: 186507 - DNA, 21 bp, Mus musculus
tctccgtctctctctagctgg

SEQ ID NO: 186508 - DNA, 23 bp, Mus musculus
agaacctctgtctgtctgtctct

SEQ ID NO: 186509 - DNA, 22 bp, Mus musculus
tcagcgtctcagagtctctcta

SEQ ID NO: 186510 - DNA, 23 bp, Mus musculus
tgtctctgaggttgttctatttc

SEQ ID NO: 186511 - DNA, 19 bp, Mus musculus
tgggagagaagtctaggca

SEQ ID NO: 186512 - DNA, 22 bp, Mus musculus
tgtgaggcagaggaagtgaaca

SEQ ID NO: 186513 - DNA, 23 bp, Mus musculus
ctctctctgactcactcttccct

SEQ ID NO: 186514 - DNA, 23 bp, Mus musculus
agcctgtgagaaccgagagtgct

SEQ ID NO: 186515 - DNA, 23 bp, Mus musculus
ggaggttagaacaggaagaggag

SEQ ID NO: 186516 - DNA, 23 bp, Mus musculus
tcagtccctcacagctgctccca

SEQ ID NO: 186517 - DNA, 23 bp, Mus musculus
tgggtagagatgaagctgagaga

SEQ ID NO: 186518 - DNA, 23 bp, Mus musculus
cactgatatatatgtgtatatgt

SEQ ID NO: 186519 - DNA, 21 bp, Mus musculus
atatatgtatgtatgtgtatg

SEQ ID NO: 186520 - DNA, 20 bp, Mus musculus
atatgtatatatatatatgt

SEQ ID NO: 186521 - DNA, 23 bp, Mus musculus
atatacggtgtatatctatatct

SEQ ID NO: 186522 - DNA, 22 bp, Mus musculus
tatatatgtatgtgtgtatgct

SEQ ID NO: 186523 - DNA, 18 bp, Mus musculus
ctcctcctccttctcctc

SEQ ID NO: 186524 - DNA, 23 bp, Mus musculus
cttgtctgtcagagtcagtcagc

SEQ ID NO: 186525 - DNA, 22 bp, Mus musculus
tgtgtgtgtatgtgtgtctgta

SEQ ID NO: 186526 - DNA, 23 bp, Mus musculus
tttctattgtctgtttcttatta

SEQ ID NO: 186527 - DNA, 23 bp, Mus musculus
tattgtgtatatataaacatgtg

SEQ ID NO: 186528 - DNA, 18 bp, Mus musculus
acacatataaaatgtatg

SEQ ID NO: 186529 - DNA, 22 bp, Mus musculus
atttatgtatataaacatatgt

SEQ ID NO: 186530 - DNA, 23 bp, Mus musculus
tcacttgctctctgtctttcatt

SEQ ID NO: 186531 - DNA, 23 bp, Mus musculus
ggattctatgactctgtatgggg

SEQ ID NO: 186532 - DNA, 19 bp, Mus musculus
aagagactctgggactctg

SEQ ID NO: 186533 - DNA, 23 bp, Mus musculus
tcacacagagtcattcttctcta

SEQ ID NO: 186534 - DNA, 23 bp, Mus musculus
atgtgtgtatgtgcatatgagtg

SEQ ID NO: 186535 - DNA, 23 bp, Mus musculus
tgagagaagacactgtgctgatc

SEQ ID NO: 186536 - DNA, 23 bp, Mus musculus
ggtgtgtgtctgtctgtctgtct

SEQ ID NO: 186537 - DNA, 23 bp, Mus musculus
tctctctcactctgacctccacc

SEQ ID NO: 186538 - DNA, 23 bp, Mus musculus
tgtatgcatgtatatatgtgtgt

SEQ ID NO: 186539 - DNA, 22 bp, Mus musculus
tgtatgcatgtatatacgtatg

SEQ ID NO: 186540 - DNA, 20 bp, Mus musculus
agcatgtatgtatgtatgta

SEQ ID NO: 186541 - DNA, 19 bp, Mus musculus
ctcagtggttagagaactg

SEQ ID NO: 186542 - DNA, 23 bp, Mus musculus
ctctctctcagtctctcgcgtgt

SEQ ID NO: 186543 - DNA, 18 bp, Mus musculus
gagagagagagagagctg

SEQ ID NO: 186544 - DNA, 23 bp, Mus musculus
tgagtctgacagagtcagaacag

SEQ ID NO: 186545 - DNA, 23 bp, Mus musculus
tgcgtgcgtgcatgcgtgcgtgt

SEQ ID NO: 186546 - DNA, 23 bp, Mus musculus
tacacacaaatgtatgcatatat

SEQ ID NO: 186547 - DNA, 20 bp, Mus musculus
gtatttatgcaagtgtgtgt

SEQ ID NO: 186548 - DNA, 20 bp, Mus musculus
tgtgtgcatgttttcatctg

SEQ ID NO: 186549 - DNA, 20 bp, Mus musculus
tctgaagtttctcaggagag

SEQ ID NO: 186550 - DNA, 23 bp, Mus musculus
tgcctcgctctgtgtctggcttt

SEQ ID NO: 186551 - DNA, 18 bp, Mus musculus
aaccacagtggcagtaga

SEQ ID NO: 186552 - DNA, 23 bp, Mus musculus
ttagtggttacagagaagccttg

SEQ ID NO: 186553 - DNA, 22 bp, Mus musculus
tatgtactaggtctacacacac

SEQ ID NO: 186554 - DNA, 23 bp, Mus musculus
tctgtctttctgtgactggctta

SEQ ID NO: 186555 - DNA, 23 bp, Mus musculus
gtgtgcatgtgcatgtgaattct

SEQ ID NO: 186556 - DNA, 23 bp, Mus musculus
tatgagtgtatgtgtgaatgtgt

SEQ ID NO: 186557 - DNA, 23 bp, Mus musculus
cagcctgcctgcctgcctgcctc

SEQ ID NO: 186558 - DNA, 23 bp, Mus musculus
ctgactgactctggcacccatga

SEQ ID NO: 186559 - DNA, 23 bp, Mus musculus
tatcactctgactccttcctgta

SEQ ID NO: 186560 - DNA, 23 bp, Mus musculus
ataagaaattgtcaggctggaca

SEQ ID NO: 186561 - DNA, 22 bp, Mus musculus
tatcggcacaggatgaaataag

SEQ ID NO: 186562 - DNA, 19 bp, Mus musculus
ctgtctttagagtgtcagt

SEQ ID NO: 186563 - DNA, 21 bp, Mus musculus
atcagttttcaatattgagtc

SEQ ID NO: 186564 - DNA, 23 bp, Mus musculus
gttcaaagtgtgcagagggctgg

SEQ ID NO: 186565 - DNA, 23 bp, Mus musculus
tgcatgcatgcatatgtatgtat

SEQ ID NO: 186566 - DNA, 23 bp, Mus musculus
tgacaggatttgttttcttccta

SEQ ID NO: 186567 - DNA, 19 bp, Mus musculus
tcctgcagccgttaggtgt

SEQ ID NO: 186568 - DNA, 18 bp, Mus musculus
ttctgcttcagcttccaa

SEQ ID NO: 186569 - DNA, 22 bp, Mus musculus
tcaccctgtcactttgttcata

SEQ ID NO: 186570 - DNA, 23 bp, Mus musculus
tgctgcatgtgtgtctgtgtgag

SEQ ID NO: 186571 - DNA, 23 bp, Mus musculus
agcaaactaagcaagttactagt

SEQ ID NO: 186572 - DNA, 23 bp, Mus musculus
tgtcagtctttatgtctgtccct

SEQ ID NO: 186573 - DNA, 22 bp, Mus musculus
agtagtgatggtctggctcagt

SEQ ID NO: 186574 - DNA, 23 bp, Mus musculus
tctgtgattctagtgactttggt

SEQ ID NO: 186575 - DNA, 22 bp, Mus musculus
gtcagtcctatctctcactgac

SEQ ID NO: 186576 - DNA, 21 bp, Mus musculus
tgtctcagacatagggctccc

SEQ ID NO: 186577 - DNA, 23 bp, Mus musculus
tgtgtgtgtctgtgtatgtgtgt

SEQ ID NO: 186578 - DNA, 23 bp, Mus musculus
gtgtgtatgtgtgcatgtgtgtg

SEQ ID NO: 186579 - DNA, 22 bp, Mus musculus
atgtatgtgtgcatgtgtatat

SEQ ID NO: 186580 - DNA, 23 bp, Mus musculus
ctgtcctggaactcactctcact

SEQ ID NO: 186581 - DNA, 20 bp, Mus musculus
agacagggtcttactttgta

SEQ ID NO: 186582 - DNA, 21 bp, Mus musculus
tgtgctttttaatggctgtag

SEQ ID NO: 186583 - DNA, 23 bp, Mus musculus
ttgtctgcctgtgtgtccccctc

SEQ ID NO: 186584 - DNA, 23 bp, Mus musculus
tggagagatggctgttcttgcag

SEQ ID NO: 186585 - DNA, 20 bp, Mus musculus
tgactcagtggttaggagca

SEQ ID NO: 186586 - DNA, 20 bp, Mus musculus
tgcacgtgtgtatgtaatgt

SEQ ID NO: 186587 - DNA, 23 bp, Mus musculus
tgtgaccctcactctcattgcac

SEQ ID NO: 186588 - DNA, 20 bp, Mus musculus
tgtgtgtgtgtgtgtgtgtg

SEQ ID NO: 186589 - DNA, 23 bp, Mus musculus
atatgtgtgtgtatgtatatgtg

SEQ ID NO: 186590 - DNA, 23 bp, Mus musculus
atgtgtgtgcatatattatgtgt

SEQ ID NO: 186591 - DNA, 21 bp, Mus musculus
atatgggtgcatatgtataca

SEQ ID NO: 186592 - DNA, 19 bp, Mus musculus
tatgcctgcttctgactgc

SEQ ID NO: 186593 - DNA, 23 bp, Mus musculus
gtgtgctttgtcagtctgtctgt

SEQ ID NO: 186594 - DNA, 23 bp, Mus musculus
tgtctgtctgtctgtctgtggta

SEQ ID NO: 186595 - DNA, 23 bp, Mus musculus
tgtgtgtgtgtgtgttttactgg

SEQ ID NO: 186596 - DNA, 23 bp, Mus musculus
aaggttcaagaagagggtttgag

SEQ ID NO: 186597 - DNA, 23 bp, Mus musculus
taggctgtgcttgaatttagaga

SEQ ID NO: 186598 - DNA, 20 bp, Mus musculus
gttttattggagcagtgtat

SEQ ID NO: 186599 - DNA, 19 bp, Mus musculus
cacctgggggtgctggaga

SEQ ID NO: 186600 - DNA, 23 bp, Mus musculus
ttctctctctgtcgatgagcatg

SEQ ID NO: 186601 - DNA, 19 bp, Mus musculus
ctgagtgtgtgttgtacgt

SEQ ID NO: 186602 - DNA, 23 bp, Mus musculus
aggccatcactcactgtctctgc

SEQ ID NO: 186603 - DNA, 19 bp, Mus musculus
tgtgtgtgtgtgtgtgtgt

SEQ ID NO: 186604 - DNA, 22 bp, Mus musculus
tgtatgtatatgcatgtgagtg

SEQ ID NO: 186605 - DNA, 22 bp, Mus musculus
atatatgtgtgtatgtatatgt

SEQ ID NO: 186606 - DNA, 21 bp, Mus musculus
tgtgtatatgtgtatgtgtgt

SEQ ID NO: 186607 - DNA, 23 bp, Mus musculus
tatgtgtgtatgtatatgtgagt

SEQ ID NO: 186608 - DNA, 21 bp, Mus musculus
gaaacaggttccagagtgtga

SEQ ID NO: 186609 - DNA, 22 bp, Mus musculus
tacagttgtctggaatatgctt

SEQ ID NO: 186610 - DNA, 22 bp, Mus musculus
aagagagaaatgagactgtgga

SEQ ID NO: 186611 - DNA, 23 bp, Mus musculus
caaggtctctgagtctctcagtt

SEQ ID NO: 186612 - DNA, 23 bp, Mus musculus
ctaagagtctgtggtaaagacgt

SEQ ID NO: 186613 - DNA, 23 bp, Mus musculus
agaactctgagaccagtccatct

SEQ ID NO: 186614 - DNA, 23 bp, Mus musculus
ctgtccatctgtctgtgcctgtc

SEQ ID NO: 186615 - DNA, 22 bp, Mus musculus
catctgtgtcagtgtatataga

SEQ ID NO: 186616 - DNA, 21 bp, Mus musculus
gggccactcactgtgtgactc

SEQ ID NO: 186617 - DNA, 23 bp, Mus musculus
tttctcaatggtgtctgtccagt

SEQ ID NO: 186618 - DNA, 23 bp, Mus musculus
tcagaggctgtctggctgactca

SEQ ID NO: 186619 - DNA, 18 bp, Mus musculus
actgctgagccatctctc

SEQ ID NO: 186620 - DNA, 23 bp, Mus musculus
tctcagagcagactgagctctca

SEQ ID NO: 186621 - DNA, 23 bp, Mus musculus
gagcactgactgctcttccagag

SEQ ID NO: 186622 - DNA, 23 bp, Mus musculus
tctgtctctgtctgcctgtcaat

SEQ ID NO: 186623 - DNA, 23 bp, Mus musculus
tctctccgtgtgtgtctctgtta

SEQ ID NO: 186624 - DNA, 23 bp, Mus musculus
tttctgtgtgtctgtgtgtccgt

SEQ ID NO: 186625 - DNA, 23 bp, Mus musculus
agcaggacagtctctgtgagtct

SEQ ID NO: 186626 - DNA, 23 bp, Mus musculus
tgtgtgtatgtatatgtatacat

SEQ ID NO: 186627 - DNA, 22 bp, Mus musculus
gatggctcagtggttacgagca

SEQ ID NO: 186628 - DNA, 23 bp, Mus musculus
ttagtagatgtccatgggtttgt

SEQ ID NO: 186629 - DNA, 22 bp, Mus musculus
gaccctctgactctctgcttcc

SEQ ID NO: 186630 - DNA, 20 bp, Mus musculus
tggggcaggaagataggaga

SEQ ID NO: 186631 - DNA, 18 bp, Mus musculus
agtacaggggctggagag

SEQ ID NO: 186632 - DNA, 22 bp, Mus musculus
taagtctttaccaaatgagcta

SEQ ID NO: 186633 - DNA, 23 bp, Mus musculus
aaaagcttggaaatgaaaggttt

SEQ ID NO: 186634 - DNA, 23 bp, Mus musculus
atatgtgtatggtgtatgtgtgt

SEQ ID NO: 186635 - DNA, 18 bp, Mus musculus
catgtgtatggtgtatgt

SEQ ID NO: 186636 - DNA, 23 bp, Mus musculus
ctgtctcagtgtgtcaggctggg

SEQ ID NO: 186637 - DNA, 20 bp, Mus musculus
ttgagatggagatagaatac

SEQ ID NO: 186638 - DNA, 23 bp, Mus musculus
atctaagtacactgtagctgtct

SEQ ID NO: 186639 - DNA, 21 bp, Mus musculus
agtgttgagaggataggtgtg

SEQ ID NO: 186640 - DNA, 23 bp, Mus musculus
ctggctcactgtctgactggccc

SEQ ID NO: 186641 - DNA, 23 bp, Mus musculus
agtctagtacgtctgtctgtctg

SEQ ID NO: 186642 - DNA, 18 bp, Mus musculus
agggactcatttgctttt

SEQ ID NO: 186643 - DNA, 18 bp, Mus musculus
tgtgtgaactggatctct

SEQ ID NO: 186644 - DNA, 23 bp, Mus musculus
ctctgtctttcagtgtgcctggt

SEQ ID NO: 186645 - DNA, 23 bp, Mus musculus
acacagcaagaagatagctgctt

SEQ ID NO: 186646 - DNA, 23 bp, Mus musculus
atatatgtatatgtgtatatgtg

SEQ ID NO: 186647 - DNA, 23 bp, Mus musculus
cgctttgcacattgagtacactg

SEQ ID NO: 186648 - DNA, 19 bp, Mus musculus
tcaggcccagaactgtgcc

SEQ ID NO: 186649 - DNA, 23 bp, Mus musculus
tgtgttcactgtctcagttctcc

SEQ ID NO: 186650 - DNA, 23 bp, Mus musculus
atatatgtgtgcatatgtatgta

SEQ ID NO: 186651 - DNA, 21 bp, Mus musculus
tgtgtatatgtatatatgtgt

SEQ ID NO: 186652 - DNA, 23 bp, Mus musculus
tgtgcgtgtctctctctgtgtgt

SEQ ID NO: 186653 - DNA, 21 bp, Mus musculus
tctgtctatatgtgtgtgcat

SEQ ID NO: 186654 - DNA, 22 bp, Mus musculus
ttgtgtgtgttaaggcatgtgt

SEQ ID NO: 186655 - DNA, 20 bp, Mus musculus
tgacatcattaggactctcc

SEQ ID NO: 186656 - DNA, 21 bp, Mus musculus
aatgtgtatgtcggtatatgt

SEQ ID NO: 186657 - DNA, 23 bp, Mus musculus
atttcaagcatttctagacataa

SEQ ID NO: 186658 - DNA, 19 bp, Mus musculus
atgtatgtgcatgagtatg

SEQ ID NO: 186659 - DNA, 20 bp, Mus musculus
tatgttcatgtagtatgtgt

SEQ ID NO: 186660 - DNA, 21 bp, Mus musculus
tacatacatatgcatgtgtat

SEQ ID NO: 186661 - DNA, 23 bp, Mus musculus
aggttagtgcatttgatatgtat

SEQ ID NO: 186662 - DNA, 19 bp, Mus musculus
ggctcagtggttaggagca

SEQ ID NO: 186663 - DNA, 23 bp, Mus musculus
aagtttgttgattgactgaagga

SEQ ID NO: 186664 - DNA, 20 bp, Mus musculus
aggtatgtacgtgtacgtgt

SEQ ID NO: 186665 - DNA, 23 bp, Mus musculus
actatctcactgtctctgcttcc

SEQ ID NO: 186666 - DNA, 23 bp, Mus musculus
tgtctgtgtgtgagtgtgtgcgt

SEQ ID NO: 186667 - DNA, 22 bp, Mus musculus
gccagggagactatcggcttct

SEQ ID NO: 186668 - DNA, 21 bp, Mus musculus
tgtgtagtatcatttgtgtgt

SEQ ID NO: 186669 - DNA, 23 bp, Mus musculus
aggactcagaacagtgacaggac

SEQ ID NO: 186670 - DNA, 20 bp, Mus musculus
atgtatgtatgcatgtgttt

SEQ ID NO: 186671 - DNA, 20 bp, Mus musculus
tgcactgtgtgtgtggtata

SEQ ID NO: 186672 - DNA, 21 bp, Mus musculus
taagagcactgactgctcttc

SEQ ID NO: 186673 - DNA, 23 bp, Mus musculus
actgggtctcactgtgtgtcttg

SEQ ID NO: 186674 - DNA, 23 bp, Mus musculus
actcacactcactacactcactc

SEQ ID NO: 186675 - DNA, 23 bp, Mus musculus
actgtctgtctgtctgaacgtcg

SEQ ID NO: 186676 - DNA, 23 bp, Mus musculus
tctgggagtctgagagctttggc

SEQ ID NO: 186677 - DNA, 23 bp, Mus musculus
ctgagtggatgctctctctcttt

SEQ ID NO: 186678 - DNA, 23 bp, Mus musculus
tatgtgcatgtgcatgtgcatgt

SEQ ID NO: 186679 - DNA, 23 bp, Mus musculus
gcctgtgtgtatgcctgtgtgtg

SEQ ID NO: 186680 - DNA, 22 bp, Mus musculus
atatgtgtatacatgcatatgt

SEQ ID NO: 186681 - DNA, 18 bp, Mus musculus
tctgacacactgtttcac

SEQ ID NO: 186682 - DNA, 20 bp, Mus musculus
aagagcactgactgctcttc

SEQ ID NO: 186683 - DNA, 22 bp, Mus musculus
atgttctagggctggagagatg

SEQ ID NO: 186684 - DNA, 23 bp, Mus musculus
acactgtccctctctctcagcct

SEQ ID NO: 186685 - DNA, 23 bp, Mus musculus
tccctgcctgtctgtctgtatgt

SEQ ID NO: 186686 - DNA, 20 bp, Mus musculus
tcctggctgaaagagaacag

SEQ ID NO: 186687 - DNA, 23 bp, Mus musculus
ctctgtgtgtgtgtgtgtccccc

SEQ ID NO: 186688 - DNA, 23 bp, Mus musculus
tgtaagtacactgtagctgtctt

SEQ ID NO: 186689 - DNA, 18 bp, Mus musculus
actcatgagtgtttgctc

SEQ ID NO: 186690 - DNA, 21 bp, Mus musculus
caacacactcactgtttctgt

SEQ ID NO: 186691 - DNA, 22 bp, Mus musculus
actctctcagtctctgcctggc

SEQ ID NO: 186692 - DNA, 23 bp, Mus musculus
tgtgtgtctgtgttacatgtatg

SEQ ID NO: 186693 - DNA, 22 bp, Mus musculus
atacacacagatatatatatgt

SEQ ID NO: 186694 - DNA, 23 bp, Mus musculus
tgactgagtctcaggtcaagcca

SEQ ID NO: 186695 - DNA, 22 bp, Mus musculus
gtgtggctctgtctctgcatgc

SEQ ID NO: 186696 - DNA, 23 bp, Mus musculus
gtgtgtgtgtgtgtcagtgtgtg

SEQ ID NO: 186697 - DNA, 21 bp, Mus musculus
atatatgtatgtatatgtata

SEQ ID NO: 186698 - DNA, 22 bp, Mus musculus
aatgcatgtatgtatatatgta

SEQ ID NO: 186699 - DNA, 20 bp, Mus musculus
tgtatgcctatatatgcatg

SEQ ID NO: 186700 - DNA, 21 bp, Mus musculus
ctgcctgagtgactgccttca

SEQ ID NO: 186701 - DNA, 22 bp, Mus musculus
tgcgtgtgtgcatgtgtgtgtg

SEQ ID NO: 186702 - DNA, 19 bp, Mus musculus
atatgactattgctagctc

SEQ ID NO: 186703 - DNA, 23 bp, Mus musculus
ctctgtgtctgtcagctgtcaga

SEQ ID NO: 186704 - DNA, 20 bp, Mus musculus
tgagaacagacagaatgtct

SEQ ID NO: 186705 - DNA, 20 bp, Mus musculus
tcaggtcatccaggagggac

SEQ ID NO: 186706 - DNA, 20 bp, Mus musculus
gtctgtctctctctctcttt

SEQ ID NO: 186707 - DNA, 23 bp, Mus musculus
tactgggtagttcatattgttgt

SEQ ID NO: 186708 - DNA, 23 bp, Mus musculus
atttcacagagctcacaagcacc

SEQ ID NO: 186709 - DNA, 22 bp, Mus musculus
ataactccagctccagctccag

SEQ ID NO: 186710 - DNA, 21 bp, Mus musculus
atggcttgttgatacaaatga

SEQ ID NO: 186711 - DNA, 22 bp, Mus musculus
atccctttagtttctgcactgg

SEQ ID NO: 186712 - DNA, 19 bp, Mus musculus
atctgaccctgcctctctg

SEQ ID NO: 186713 - DNA, 23 bp, Mus musculus
gtgtgtgcatgcttgtatgtacg

SEQ ID NO: 186714 - DNA, 23 bp, Mus musculus
gtatgcatacatgtgtgtatgta

SEQ ID NO: 186715 - DNA, 23 bp, Mus musculus
gtgggtgcctcagtccctagctt

SEQ ID NO: 186716 - DNA, 23 bp, Mus musculus
gggtctgactcagtcagtgtggc

SEQ ID NO: 186717 - DNA, 20 bp, Mus musculus
aacacatgtatacacagaga

SEQ ID NO: 186718 - DNA, 23 bp, Mus musculus
ctcactctaaacacttggtgcga

SEQ ID NO: 186719 - DNA, 23 bp, Mus musculus
gcagaggtagaaggatctcttga

SEQ ID NO: 186720 - DNA, 23 bp, Mus musculus
tatatgtgtgtgtatatgtatat

SEQ ID NO: 186721 - DNA, 23 bp, Mus musculus
ggcctgactgactgactgactgg

SEQ ID NO: 186722 - DNA, 21 bp, Mus musculus
ctctctattgtttccgttttg

SEQ ID NO: 186723 - DNA, 21 bp, Mus musculus
ttgaatgttttactattctca

SEQ ID NO: 186724 - DNA, 22 bp, Mus musculus
tataatgatataatgataagtg

SEQ ID NO: 186725 - DNA, 20 bp, Mus musculus
atatagatagatatagatat

SEQ ID NO: 186726 - DNA, 18 bp, Mus musculus
agtatatctatctatatc

SEQ ID NO: 186727 - DNA, 23 bp, Mus musculus
tctgtccctgtctgggtctgagg

SEQ ID NO: 186728 - DNA, 23 bp, Mus musculus
cctttctcagactaaaagctggg

SEQ ID NO: 186729 - DNA, 21 bp, Mus musculus
agctacatcctcaggaaggat

SEQ ID NO: 186730 - DNA, 21 bp, Mus musculus
aagttgagtctcaaagcagtt

SEQ ID NO: 186731 - DNA, 23 bp, Mus musculus
gtctcagcacttggaccagttac

SEQ ID NO: 186732 - DNA, 23 bp, Mus musculus
tcaaactcaggcggttagtctgg

SEQ ID NO: 186733 - DNA, 20 bp, Mus musculus
ttaagagcactgactgctct

SEQ ID NO: 186734 - DNA, 20 bp, Mus musculus
gtcatttgtgagtgaccaca

SEQ ID NO: 186735 - DNA, 23 bp, Mus musculus
caaatttcagcaaccacatggtg

SEQ ID NO: 186736 - DNA, 19 bp, Mus musculus
acactggactggctgtgtg

SEQ ID NO: 186737 - DNA, 20 bp, Mus musculus
tctgaatctccacacacagc

SEQ ID NO: 186738 - DNA, 23 bp, Mus musculus
ctgagttcaaatcccagtgacca

SEQ ID NO: 186739 - DNA, 18 bp, Mus musculus
agactggcagactgcctc

SEQ ID NO: 186740 - DNA, 21 bp, Mus musculus
gtgtgacagtcactgtctgcc

SEQ ID NO: 186741 - DNA, 23 bp, Mus musculus
tctgtctgtctgtctgtctgtct

SEQ ID NO: 186742 - DNA, 22 bp, Mus musculus
tccttggtgttaaaaggtgttt

SEQ ID NO: 186743 - DNA, 21 bp, Mus musculus
attgttcatgtttttaagtga

SEQ ID NO: 186744 - DNA, 23 bp, Mus musculus
tatctgtgcatgtacatatgtat

SEQ ID NO: 186745 - DNA, 23 bp, Mus musculus
tgacagaactcagtgtggttcca

SEQ ID NO: 186746 - DNA, 23 bp, Mus musculus
tggagagtactgagctcatagga

SEQ ID NO: 186747 - DNA, 22 bp, Mus musculus
ggtcacagactcagtccctggg

SEQ ID NO: 186748 - DNA, 23 bp, Mus musculus
ccctgtgagcctccctgtctcag

SEQ ID NO: 186749 - DNA, 19 bp, Mus musculus
tgagtcaggctttctgcct

SEQ ID NO: 186750 - DNA, 23 bp, Mus musculus
tgtgtgcctgagtgcctggatcc

SEQ ID NO: 186751 - DNA, 19 bp, Mus musculus
tggagggagagaaaggact

SEQ ID NO: 186752 - DNA, 23 bp, Mus musculus
ttctctctctgtgtgtgacttct

SEQ ID NO: 186753 - DNA, 23 bp, Mus musculus
cagtgtctgtctctctccatctc

SEQ ID NO: 186754 - DNA, 20 bp, Mus musculus
cttctcagcctgtgtccttc

SEQ ID NO: 186755 - DNA, 23 bp, Mus musculus
tgtgtgtcactgaaagatagctc

SEQ ID NO: 186756 - DNA, 23 bp, Mus musculus
ttcagtgtgcctcagagatgatg

SEQ ID NO: 186757 - DNA, 22 bp, Mus musculus
aagctatcgtcctgtaggtgca

SEQ ID NO: 186758 - DNA, 23 bp, Mus musculus
tgtggctgtctgtctgtctgtct

SEQ ID NO: 186759 - DNA, 23 bp, Mus musculus
tatatgtatatgtatatgtatat

SEQ ID NO: 186760 - DNA, 23 bp, Mus musculus
tccttctctgagaaatgtttgtg

SEQ ID NO: 186761 - DNA, 22 bp, Mus musculus
tgtgtggatgtgtgcttaggtg

SEQ ID NO: 186762 - DNA, 23 bp, Mus musculus
cacagaagtgacttagctcaagg

SEQ ID NO: 186763 - DNA, 23 bp, Mus musculus
tgtatatgtatatgtatatgtat

SEQ ID NO: 186764 - DNA, 23 bp, Mus musculus
gtctgtatacatgtatgtatgca

SEQ ID NO: 186765 - DNA, 23 bp, Mus musculus
ctctgtgtgtagttgcttgtgtg

SEQ ID NO: 186766 - DNA, 23 bp, Mus musculus
tctctctctgtctgcttgtcctt

SEQ ID NO: 186767 - DNA, 21 bp, Mus musculus
ttcaattctcagcaacaacat

SEQ ID NO: 186768 - DNA, 21 bp, Mus musculus
atgtatgtgtgtatgtgcata

SEQ ID NO: 186769 - DNA, 21 bp, Mus musculus
atctgggtcctctgtaagagt

SEQ ID NO: 186770 - DNA, 23 bp, Mus musculus
tggagagactgctcttccagagg

SEQ ID NO: 186771 - DNA, 23 bp, Mus musculus
aacacagggcctcgtgtgttaga

SEQ ID NO: 186772 - DNA, 22 bp, Mus musculus
tgtatgagtgctttgcttgaat

SEQ ID NO: 186773 - DNA, 23 bp, Mus musculus
ctctggtcaactctggttgctca

SEQ ID NO: 186774 - DNA, 20 bp, Mus musculus
tcagatgtaccagagagggt

SEQ ID NO: 186775 - DNA, 23 bp, Mus musculus
ctcagtcagtctcacaaacttct

SEQ ID NO: 186776 - DNA, 23 bp, Mus musculus
ttcaaatctcagcaaccacatgg

SEQ ID NO: 186777 - DNA, 23 bp, Mus musculus
aatgctcaagtcaggcccagtgt

SEQ ID NO: 186778 - DNA, 23 bp, Mus musculus
ctgtctttgtctgtctgtctgtc

SEQ ID NO: 186779 - DNA, 22 bp, Mus musculus
gtatgtatgtatgtatgtatgt

SEQ ID NO: 186780 - DNA, 23 bp, Mus musculus
atgtatgtatttgtgtatatgta

SEQ ID NO: 186781 - DNA, 19 bp, Mus musculus
tatgtgtatgtatgtatat

SEQ ID NO: 186782 - DNA, 20 bp, Mus musculus
ctatatgtgcgtgcacatgt

SEQ ID NO: 186783 - DNA, 19 bp, Mus musculus
aaggatttgatggagacat

SEQ ID NO: 186784 - DNA, 20 bp, Mus musculus
gactgtagagactctttctg

SEQ ID NO: 186785 - DNA, 21 bp, Mus musculus
tatatgtatatgtatatgtat

SEQ ID NO: 186786 - DNA, 19 bp, Mus musculus
tcaagctggatcttagtgt

SEQ ID NO: 186787 - DNA, 23 bp, Mus musculus
gtatgtatacacacacacacaca

SEQ ID NO: 186788 - DNA, 20 bp, Mus musculus
tgcatatgcatatgtataca

SEQ ID NO: 186789 - DNA, 19 bp, Mus musculus
tcaagctggatcttagtgt

SEQ ID NO: 186790 - DNA, 23 bp, Mus musculus
tgagtagagtgtcattcagcttc

SEQ ID NO: 186791 - DNA, 23 bp, Mus musculus
tatttatgttgatattgaagatc

SEQ ID NO: 186792 - DNA, 23 bp, Mus musculus
gtatgtatacacacacacacaca

SEQ ID NO: 186793 - DNA, 20 bp, Mus musculus
tgcatatgcatatgtataca

SEQ ID NO: 186794 - DNA, 23 bp, Mus musculus
tatatagtgtgtgtatgtatatg

SEQ ID NO: 186795 - DNA, 23 bp, Mus musculus
tcatcatcttctagcctttctct

SEQ ID NO: 186796 - DNA, 23 bp, Mus musculus
tactgcatggtgatctgatagga

SEQ ID NO: 186797 - DNA, 22 bp, Mus musculus
tgttttgtgacctattatgtgg

SEQ ID NO: 186798 - DNA, 22 bp, Mus musculus
agtacaaggtactaggtctgag

SEQ ID NO: 186799 - DNA, 23 bp, Mus musculus
tgtaaacatccttgactggaagc

SEQ ID NO: 186800 - DNA, 23 bp, Mus musculus
gctttcagtcggatgtttacagc

SEQ ID NO: 186801 - DNA, 23 bp, Mus musculus
tgtaaacatcctacactctcagc

SEQ ID NO: 186802 - DNA, 20 bp, Mus musculus
accctgtcagctcttgccag

SEQ ID NO: 186803 - DNA, 23 bp, Mus musculus
aggtgtgagtgtctgtactcatg

SEQ ID NO: 186804 - DNA, 18 bp, Mus musculus
agaggaggacatttgtgc

SEQ ID NO: 186805 - DNA, 20 bp, Mus musculus
taagagtagcctgatggtga

SEQ ID NO: 186806 - DNA, 23 bp, Mus musculus
tatgtgcaagtacatgtgtgtgt

SEQ ID NO: 186807 - DNA, 21 bp, Mus musculus
tgtatgtatgtatgtatgtgt

SEQ ID NO: 186808 - DNA, 18 bp, Mus musculus
tgcctgaaaagagaagcg

SEQ ID NO: 186809 - DNA, 23 bp, Mus musculus
ctcagtttctctctgtggctcag

SEQ ID NO: 186810 - DNA, 23 bp, Mus musculus
tgcaacactgtgtgtgtatctgt

SEQ ID NO: 186811 - DNA, 19 bp, Mus musculus
atacatgtgggcatgcatg

SEQ ID NO: 186812 - DNA, 23 bp, Mus musculus
tgagatcagactcagtctctgta

SEQ ID NO: 186813 - DNA, 23 bp, Mus musculus
agggctgtgcttttgtttcaaat

SEQ ID NO: 186814 - DNA, 23 bp, Mus musculus
tgccaatgcctgtccttgagcaa

SEQ ID NO: 186815 - DNA, 23 bp, Mus musculus
agcacaggctagtttatctgtat

SEQ ID NO: 186816 - DNA, 23 bp, Mus musculus
cacagagaaaagagactgtggaa

SEQ ID NO: 186817 - DNA, 23 bp, Mus musculus
agtttaggaccttgagagagcca

SEQ ID NO: 186818 - DNA, 23 bp, Mus musculus
ctgcatgggtctgacagagcctg

SEQ ID NO: 186819 - DNA, 23 bp, Mus musculus
agagagaggtttgttgactggtg

SEQ ID NO: 186820 - DNA, 22 bp, Mus musculus
tctttgtcctaaggcttttctt

SEQ ID NO: 186821 - DNA, 19 bp, Mus musculus
tctttgagtgtctgagtct

SEQ ID NO: 186822 - DNA, 18 bp, Mus musculus
tccctgtgtgtccaagac

SEQ ID NO: 186823 - DNA, 21 bp, Mus musculus
aacctgggtctgcatgagttg

SEQ ID NO: 186824 - DNA, 23 bp, Mus musculus
tatgtgcaccaggtatgtatctg

SEQ ID NO: 186825 - DNA, 23 bp, Mus musculus
aggcttttgtagtaggatctgat

SEQ ID NO: 186826 - DNA, 21 bp, Mus musculus
atctcctcagattctgttgtc

SEQ ID NO: 186827 - DNA, 22 bp, Mus musculus
agagcctctgtgtgtctctcat

SEQ ID NO: 186828 - DNA, 22 bp, Mus musculus
agaccttgtgttttggatgatt

SEQ ID NO: 186829 - DNA, 18 bp, Mus musculus
agacacatcacagtgggc

SEQ ID NO: 186830 - DNA, 23 bp, Mus musculus
cgactctgactctgactccggct

SEQ ID NO: 186831 - DNA, 23 bp, Mus musculus
cactgagaagagagtcagcttac

SEQ ID NO: 186832 - DNA, 23 bp, Mus musculus
tacagagtgaagagtgtgtcttc

SEQ ID NO: 186833 - DNA, 23 bp, Mus musculus
atatgtgtatatatgtatgtgtg

SEQ ID NO: 186834 - DNA, 21 bp, Mus musculus
ttctatttatgtatatgtgta

SEQ ID NO: 186835 - DNA, 23 bp, Mus musculus
tgcatgtgtgtatatttgtatgc

SEQ ID NO: 186836 - DNA, 23 bp, Mus musculus
tatgcatgcatgcatgtgtctat

SEQ ID NO: 186837 - DNA, 23 bp, Mus musculus
tgcatgtctgtatgtttgtatat

SEQ ID NO: 186838 - DNA, 23 bp, Mus musculus
tgtatgcatgcatgtgtgtatgt

SEQ ID NO: 186839 - DNA, 23 bp, Mus musculus
tgcatgtgtgtatatatgtatgt

SEQ ID NO: 186840 - DNA, 23 bp, Mus musculus
tgtgtctctgtctccttcacgaa

SEQ ID NO: 186841 - DNA, 23 bp, Mus musculus
tctgtctctgggtctctgggtct

SEQ ID NO: 186842 - DNA, 23 bp, Mus musculus
ctgcctgcctgtgtgtctgtgta

SEQ ID NO: 186843 - DNA, 22 bp, Mus musculus
tgcctgcctgcctgcctggcac

SEQ ID NO: 186844 - DNA, 23 bp, Mus musculus
gtctgtctgtgtctgggtgtgtg

SEQ ID NO: 186845 - DNA, 23 bp, Mus musculus
tgttgtctgagtatgtctttttg

SEQ ID NO: 186846 - DNA, 21 bp, Mus musculus
ttgtcagtcactctgtgggtc

SEQ ID NO: 186847 - DNA, 23 bp, Mus musculus
cctggaagagcagccagtgctct

SEQ ID NO: 186848 - DNA, 22 bp, Mus musculus
actgtgcctgtcacagtgactg

SEQ ID NO: 186849 - DNA, 19 bp, Mus musculus
tgagatagggtctgtagtc

SEQ ID NO: 186850 - DNA, 23 bp, Mus musculus
agaaggctgtcactgtgtgactg

SEQ ID NO: 186851 - DNA, 23 bp, Mus musculus
acatacacacttgtatacatgtg

SEQ ID NO: 186852 - DNA, 23 bp, Mus musculus
gttatgagtgtgtgcacacacag

SEQ ID NO: 186853 - DNA, 21 bp, Mus musculus
agaggtactgagttcaattct

SEQ ID NO: 186854 - DNA, 20 bp, Mus musculus
ctgactgctcttccagaggt

SEQ ID NO: 186855 - DNA, 23 bp, Mus musculus
gctcagtgtctgtctgcttgctc

SEQ ID NO: 186856 - DNA, 19 bp, Mus musculus
actgcactcacacacacgg

SEQ ID NO: 186857 - DNA, 23 bp, Mus musculus
gtgtcactgtgtgtcactgcctc

SEQ ID NO: 186858 - DNA, 23 bp, Mus musculus
agaacactgactgctcttccaga

SEQ ID NO: 186859 - DNA, 23 bp, Mus musculus
atccaagctgtggaatactaagc

SEQ ID NO: 186860 - DNA, 22 bp, Mus musculus
tactcactaccaggtttacagt

SEQ ID NO: 186861 - DNA, 18 bp, Mus musculus
tcatatgtacatcaatga

SEQ ID NO: 186862 - DNA, 22 bp, Mus musculus
attgcatgtatgtatgtatgta

SEQ ID NO: 186863 - DNA, 23 bp, Mus musculus
agtactgactgctcttccagagg

SEQ ID NO: 186864 - DNA, 22 bp, Mus musculus
ttagtccatgtgatctgatagg

SEQ ID NO: 186865 - DNA, 23 bp, Mus musculus
ttgttttgtgaccaattatgtgg

SEQ ID NO: 186866 - DNA, 22 bp, Mus musculus
aagaagttcatgtctagttgag

SEQ ID NO: 186867 - DNA, 23 bp, Mus musculus
gtgagtgagtgagtgagtgagtg

SEQ ID NO: 186868 - DNA, 23 bp, Mus musculus
aaagcactgactgctcttccaga

SEQ ID NO: 186869 - DNA, 22 bp, Mus musculus
ctgtgtctctctggctgtcctg

SEQ ID NO: 186870 - DNA, 22 bp, Mus musculus
tgttttctgaccaattatatgg

SEQ ID NO: 186871 - DNA, 23 bp, Mus musculus
tgggtctgtgggtctgtggctcg

SEQ ID NO: 186872 - DNA, 23 bp, Mus musculus
tttcaatgtattgaaatatagca

SEQ ID NO: 186873 - DNA, 23 bp, Mus musculus
ctctgagaccctgagaccctggg

SEQ ID NO: 186874 - DNA, 21 bp, Mus musculus
tgttagagtgcctgagagtgg

SEQ ID NO: 186875 - DNA, 23 bp, Mus musculus
agatgttctgtagatatctgtaa

SEQ ID NO: 186876 - DNA, 23 bp, Mus musculus
taggtgcaggtgtaggtgcagat

SEQ ID NO: 186877 - DNA, 22 bp, Mus musculus
tgtaagtgcatgtgcaggtgca

SEQ ID NO: 186878 - DNA, 21 bp, Mus musculus
ctgacagtctgtctcacaggg

SEQ ID NO: 186879 - DNA, 19 bp, Mus musculus
tgtgtgcatatgcatgtgt

SEQ ID NO: 186880 - DNA, 23 bp, Mus musculus
gacagatctaagtgtgcagagat

SEQ ID NO: 186881 - DNA, 23 bp, Mus musculus
agtgagactactgagtgtggagt

SEQ ID NO: 186882 - DNA, 23 bp, Mus musculus
actcagttactttagctctgtga

SEQ ID NO: 186883 - DNA, 23 bp, Mus musculus
agagtagactgtgaggtgaggtc

SEQ ID NO: 186884 - DNA, 23 bp, Mus musculus
aagagagaagtcagtcagggcaa

SEQ ID NO: 186885 - DNA, 23 bp, Mus musculus
aaagcactgactgctcttccaga

SEQ ID NO: 186886 - DNA, 23 bp, Mus musculus
aactcactgtcctttgatggagg

SEQ ID NO: 186887 - DNA, 22 bp, Mus musculus
tgacactcatagacattgtgct

SEQ ID NO: 186888 - DNA, 21 bp, Mus musculus
tccatggtggtctgataggat

SEQ ID NO: 186889 - DNA, 22 bp, Mus musculus
tgttttgtgaccaattatatgg

SEQ ID NO: 186890 - DNA, 23 bp, Mus musculus
tgtatgtatgtatgtatgtatgt

SEQ ID NO: 186891 - DNA, 23 bp, Mus musculus
gtgtggatgtttagtgattcagt

SEQ ID NO: 186892 - DNA, 19 bp, Mus musculus
actgtgaacaggccactct

SEQ ID NO: 186893 - DNA, 23 bp, Mus musculus
aacagaatatatttatatgtgtg

SEQ ID NO: 186894 - DNA, 23 bp, Mus musculus
ttctctcagagactctcaccttc

SEQ ID NO: 186895 - DNA, 23 bp, Mus musculus
tatctgatactttctagagggtc

SEQ ID NO: 186896 - DNA, 23 bp, Mus musculus
caatatttttgtatctgttgagg

SEQ ID NO: 186897 - DNA, 18 bp, Mus musculus
acgtatatatatatatga

SEQ ID NO: 186898 - DNA, 23 bp, Mus musculus
aatgtatatatgtaaatatgtat

SEQ ID NO: 186899 - DNA, 22 bp, Mus musculus
tgttttgtgaccaattatatgg

SEQ ID NO: 186900 - DNA, 23 bp, Mus musculus
atatgtgtgcatgtgtatatatg

SEQ ID NO: 186901 - DNA, 23 bp, Mus musculus
tgtgcatatgtacatatgaatgt

SEQ ID NO: 186902 - DNA, 22 bp, Mus musculus
tttcatgtgttttgcaaattgt

SEQ ID NO: 186903 - DNA, 23 bp, Mus musculus
agagacaacattcagagcagaga

SEQ ID NO: 186904 - DNA, 22 bp, Mus musculus
tgttttgtgaccaattatatgg

SEQ ID NO: 186905 - DNA, 22 bp, Mus musculus
tatcagtgaagacacactctgt

SEQ ID NO: 186906 - DNA, 23 bp, Mus musculus
gtgtgtgtgtgtgtttgtacata

SEQ ID NO: 186907 - DNA, 23 bp, Mus musculus
tatgcatatatatgtgtgtgtgt

SEQ ID NO: 186908 - DNA, 22 bp, Mus musculus
tgttttgtgaccaattatatgg

SEQ ID NO: 186909 - DNA, 20 bp, Mus musculus
taatgtgtatatgtatatat

SEQ ID NO: 186910 - DNA, 19 bp, Mus musculus
tatgtgtatatgtatattt

SEQ ID NO: 186911 - DNA, 22 bp, Mus musculus
tgttttgtgaccaattatatgg

SEQ ID NO: 186912 - DNA, 23 bp, Mus musculus
tgtaactgtgtctgtctttctgg

SEQ ID NO: 186913 - DNA, 19 bp, Mus musculus
cagcttgaacagtagctga

SEQ ID NO: 186914 - DNA, 22 bp, Mus musculus
tcagggtgattggcagagtgat

SEQ ID NO: 186915 - DNA, 22 bp, Mus musculus
aaagcctgtggatgacttgtga

SEQ ID NO: 186916 - DNA, 22 bp, Mus musculus
tgttttgtgaccaattatatgg

SEQ ID NO: 186917 - DNA, 22 bp, Mus musculus
tgttttgtgaccaattatatgg

SEQ ID NO: 186918 - DNA, 23 bp, Mus musculus
gtgtgtatatatgtatatgtgtg

SEQ ID NO: 186919 - DNA, 19 bp, Mus musculus
atagacatatctatatgtg

SEQ ID NO: 186920 - DNA, 23 bp, Mus musculus
aacacagactcagtttttaggag

SEQ ID NO: 186921 - DNA, 22 bp, Mus musculus
ttgtgtgatcctctcgttgttt

SEQ ID NO: 186922 - DNA, 22 bp, Mus musculus
actcactcatctgataccttgt

SEQ ID NO: 186923 - DNA, 23 bp, Mus musculus
ttcaattccatctgtaatgggat

SEQ ID NO: 186924 - DNA, 19 bp, Mus musculus
tgtgtgtgtgtgtacatag

SEQ ID NO: 186925 - DNA, 22 bp, Mus musculus
tacatatgtgtgtgtgtatata

SEQ ID NO: 186926 - DNA, 22 bp, Mus musculus
gagtgtgcatatgcatgtgaat

SEQ ID NO: 186927 - DNA, 23 bp, Mus musculus
tcagtctgcctgtgtgcctgctt

SEQ ID NO: 186928 - DNA, 23 bp, Mus musculus
ggtcatggactcactgtctgaca

SEQ ID NO: 186929 - DNA, 23 bp, Mus musculus
tggctgtcctagaactcactgtg

SEQ ID NO: 186930 - DNA, 21 bp, Mus musculus
tccaatgtgctgtgtctgtgt

SEQ ID NO: 186931 - DNA, 23 bp, Mus musculus
ctgtgacacgctgtctctcaccc

SEQ ID NO: 186932 - DNA, 22 bp, Mus musculus
aggcagagtggagtagacctct

SEQ ID NO: 186933 - DNA, 19 bp, Mus musculus
atgtgcttgaaaatgtcct

SEQ ID NO: 186934 - DNA, 21 bp, Mus musculus
tgtgaggacactctgagctct

SEQ ID NO: 186935 - DNA, 23 bp, Mus musculus
cctcagtgtgtgtctctgtgtgc

SEQ ID NO: 186936 - DNA, 21 bp, Mus musculus
tcagtttgatttctcttggaa

SEQ ID NO: 186937 - DNA, 18 bp, Mus musculus
aacatgatctggtgcctt

SEQ ID NO: 186938 - DNA, 23 bp, Mus musculus
tgtgacacactcagtcggttcta

SEQ ID NO: 186939 - DNA, 19 bp, Mus musculus
tgtcactcttggtgtctct

SEQ ID NO: 186940 - DNA, 20 bp, Mus musculus
agacaggagtgagagtcgag

SEQ ID NO: 186941 - DNA, 23 bp, Mus musculus
ctgcctgcctgcctgcctgcctg

SEQ ID NO: 186942 - DNA, 19 bp, Mus musculus
agactcaacacatttagga

SEQ ID NO: 186943 - DNA, 22 bp, Mus musculus
tacactctgagtgactctggtg

SEQ ID NO: 186944 - DNA, 23 bp, Mus musculus
ggtgctctgtctctgtccctcac

SEQ ID NO: 186945 - DNA, 22 bp, Mus musculus
tgtgtgtgtacatacgtgtatg

SEQ ID NO: 186946 - DNA, 23 bp, Mus musculus
atgtgtgcatatgtaggtgtatg

SEQ ID NO: 186947 - DNA, 19 bp, Mus musculus
ccagagtgtgtctctagtc

SEQ ID NO: 186948 - DNA, 18 bp, Mus musculus
cagtggtatactgtggtc

SEQ ID NO: 186949 - DNA, 20 bp, Mus musculus
ctgtgactctgtgactgcca

SEQ ID NO: 186950 - DNA, 20 bp, Mus musculus
attagtccagctttccattt

SEQ ID NO: 186951 - DNA, 19 bp, Mus musculus
tgagctagtaggtaggtaa

SEQ ID NO: 186952 - DNA, 21 bp, Mus musculus
tttgggtgactccctgccctt

SEQ ID NO: 186953 - DNA, 23 bp, Mus musculus
tgtctgtcagtcagtcagccagt

SEQ ID NO: 186954 - DNA, 23 bp, Mus musculus
cagagactgatcactatcactat

SEQ ID NO: 186955 - DNA, 22 bp, Mus musculus
ttcagacacagtataggcacta

SEQ ID NO: 186956 - DNA, 23 bp, Mus musculus
tgactgtgtttgactgtgcacta

SEQ ID NO: 186957 - DNA, 22 bp, Mus musculus
aatctcctactgtcttgtgtat

SEQ ID NO: 186958 - DNA, 22 bp, Mus musculus
tgttttgtgaccaattatatgg

SEQ ID NO: 186959 - DNA, 23 bp, Mus musculus
tacacagcagtgattggcgtctc

SEQ ID NO: 186960 - DNA, 23 bp, Mus musculus
tagaagcaggtcactaagggtgg

SEQ ID NO: 186961 - DNA, 22 bp, Mus musculus
tggaagactcatggctttctgg

SEQ ID NO: 186962 - DNA, 23 bp, Mus musculus
tctagctagaggctctcagtctc

SEQ ID NO: 186963 - DNA, 23 bp, Mus musculus
ttgtgtgtgtgcatgtgcatgtg

SEQ ID NO: 186964 - DNA, 23 bp, Mus musculus
tatagcttgcacatacacaagtg

SEQ ID NO: 186965 - DNA, 23 bp, Mus musculus
ttgtctctccctctgtgactcct

SEQ ID NO: 186966 - DNA, 23 bp, Mus musculus
tcttaagatgccagtgttataag

SEQ ID NO: 186967 - DNA, 23 bp, Mus musculus
taaacacttttactttaggattt

SEQ ID NO: 186968 - DNA, 20 bp, Mus musculus
acctgcctgtagttcctgga

SEQ ID NO: 186969 - DNA, 21 bp, Mus musculus
aaactacaggggctggagaga

SEQ ID NO: 186970 - DNA, 23 bp, Mus musculus
tctgtatatgtgtctttctctgt

SEQ ID NO: 186971 - DNA, 23 bp, Mus musculus
agcatttggctctgtctgtctgt

SEQ ID NO: 186972 - DNA, 22 bp, Mus musculus
tgttttgtgaccaattatatgg

SEQ ID NO: 186973 - DNA, 23 bp, Mus musculus
tgtctgcctgtctgtctctgtac

SEQ ID NO: 186974 - DNA, 20 bp, Mus musculus
tctgactctgtctctcgctc

SEQ ID NO: 186975 - DNA, 22 bp, Mus musculus
tgttttgtgaccaattatatgg

SEQ ID NO: 186976 - DNA, 19 bp, Mus musculus
tatatatgtccctgtacat

SEQ ID NO: 186977 - DNA, 22 bp, Mus musculus
gcacagctttaagattgtgtta

SEQ ID NO: 186978 - DNA, 23 bp, Mus musculus
tagtgcatggtgatctgatagga

SEQ ID NO: 186979 - DNA, 22 bp, Mus musculus
tgttttgtgacctattatgtgg

SEQ ID NO: 186980 - DNA, 23 bp, Mus musculus
tttgtggatgactacatgtttgt

SEQ ID NO: 186981 - DNA, 21 bp, Mus musculus
tgacagcagagagtgaggtgt

SEQ ID NO: 186982 - DNA, 21 bp, Mus musculus
tggaacagttctggccattga

SEQ ID NO: 186983 - DNA, 23 bp, Mus musculus
atgccagtggaagagttcaggga

SEQ ID NO: 186984 - DNA, 23 bp, Mus musculus
gactttactctttggcaatagac

SEQ ID NO: 186985 - DNA, 23 bp, Mus musculus
actccctcagagtctcttgtcag

SEQ ID NO: 186986 - DNA, 18 bp, Mus musculus
tatgaatacaagtataca

SEQ ID NO: 186987 - DNA, 23 bp, Mus musculus
ctgtgtctctgtctctcttgtgt

SEQ ID NO: 186988 - DNA, 23 bp, Mus musculus
agcccactgcctgctgtgtgtga

SEQ ID NO: 186989 - DNA, 19 bp, Mus musculus
gcatgtagctcagcatgca

SEQ ID NO: 186990 - DNA, 20 bp, Mus musculus
aagcctttgatcgcatcttg

SEQ ID NO: 186991 - DNA, 23 bp, Mus musculus
tattatagtgattatgtacttta

SEQ ID NO: 186992 - DNA, 18 bp, Mus musculus
acagccattgatttttag

SEQ ID NO: 186993 - DNA, 19 bp, Mus musculus
atatgtagggagagagtgg

SEQ ID NO: 186994 - DNA, 23 bp, Mus musculus
ttactctgcatttattttgatgt

SEQ ID NO: 186995 - DNA, 18 bp, Mus musculus
tgggaagacatgggcagt

SEQ ID NO: 186996 - DNA, 23 bp, Mus musculus
attcttgccacttcttgtctttc

SEQ ID NO: 186997 - DNA, 21 bp, Mus musculus
gctcactcactcactcactca

SEQ ID NO: 186998 - DNA, 23 bp, Mus musculus
agaaatctctcagtccttagcat

SEQ ID NO: 186999 - DNA, 23 bp, Mus musculus
gtcttactgctagttgatatgct

SEQ ID NO: 187000 - DNA, 18 bp, Mus musculus
ttcttgttcatcatgatg

SEQ ID NO: 187001 - DNA, 23 bp, Mus musculus
tctctctatatgtctgtcacaca

SEQ ID NO: 187002 - DNA, 21 bp, Mus musculus
tagaggtttcagtctcactgt

SEQ ID NO: 187003 - DNA, 23 bp, Mus musculus
tctatatttgtatatctatatgt

SEQ ID NO: 187004 - DNA, 23 bp, Mus musculus
gacctcactctctctctcaggct

SEQ ID NO: 187005 - DNA, 21 bp, Mus musculus
aacagacaggttgtgctgagt

SEQ ID NO: 187006 - DNA, 23 bp, Mus musculus
tctgcctgtctgtctgcctcttt

SEQ ID NO: 187007 - DNA, 23 bp, Mus musculus
tgagaacaaactggattcagagg

SEQ ID NO: 187008 - DNA, 22 bp, Mus musculus
tggctggatttgatttggttct

SEQ ID NO: 187009 - DNA, 23 bp, Mus musculus
cagagcctctcactctctagacc

SEQ ID NO: 187010 - DNA, 23 bp, Mus musculus
ttatcacagtgctgatgctgtcc

SEQ ID NO: 187011 - DNA, 23 bp, Mus musculus
gtacagtactgtgataactgaag

SEQ ID NO: 187012 - DNA, 23 bp, Mus musculus
ctgtctctgtctcctagtgttgt

SEQ ID NO: 187013 - DNA, 22 bp, Mus musculus
tcagagaagagagtgtccatgt

SEQ ID NO: 187014 - DNA, 20 bp, Mus musculus
taactctggagacttactct

SEQ ID NO: 187015 - DNA, 23 bp, Mus musculus
tgcactgtctgtctgtctgtctg

SEQ ID NO: 187016 - DNA, 23 bp, Mus musculus
accactgaagtaagtcaggacag

SEQ ID NO: 187017 - DNA, 22 bp, Mus musculus
tgttttgtgaccaattatatgg

SEQ ID NO: 187018 - DNA, 23 bp, Mus musculus
aggacaacttgcagaagttggtt

SEQ ID NO: 187019 - DNA, 18 bp, Mus musculus
tgaactcaggttgtccat

SEQ ID NO: 187020 - DNA, 23 bp, Mus musculus
ctatttttctttctgtgaaagga

SEQ ID NO: 187021 - DNA, 23 bp, Mus musculus
ctcagtgactcagtctggatgtg

SEQ ID NO: 187022 - DNA, 22 bp, Mus musculus
tgttttgtgaccaattatatgg

SEQ ID NO: 187023 - DNA, 23 bp, Mus musculus
atctcagactcagtgagtgttaa

SEQ ID NO: 187024 - DNA, 22 bp, Mus musculus
tgtgtcactgtgtgcctccttt

SEQ ID NO: 187025 - DNA, 18 bp, Mus musculus
ctgtctttatctgtctct

SEQ ID NO: 187026 - DNA, 23 bp, Mus musculus
gtctagctctcagagtctgtctt

SEQ ID NO: 187027 - DNA, 21 bp, Mus musculus
tatacctcctaggacaatgca

SEQ ID NO: 187028 - DNA, 23 bp, Mus musculus
tattcacttgcatgctttaggga

SEQ ID NO: 187029 - DNA, 21 bp, Mus musculus
ctctgaggcagcctctaagcc

SEQ ID NO: 187030 - DNA, 23 bp, Mus musculus
ttagtgcatgtagtgtgtgtgta

SEQ ID NO: 187031 - DNA, 21 bp, Mus musculus
tctggggcagggaaataactg

SEQ ID NO: 187032 - DNA, 23 bp, Mus musculus
gcactcactctaaacacaaaatg

SEQ ID NO: 187033 - DNA, 22 bp, Mus musculus
agaggaagtttgattatttttt

SEQ ID NO: 187034 - DNA, 21 bp, Mus musculus
tgaaaagagtttggcataact

SEQ ID NO: 187035 - DNA, 19 bp, Mus musculus
taagcaaagatcacaggcg

SEQ ID NO: 187036 - DNA, 23 bp, Mus musculus
tctctgtttctggtttccatgaa

SEQ ID NO: 187037 - DNA, 19 bp, Mus musculus
tcagtgactcagacactca

SEQ ID NO: 187038 - DNA, 22 bp, Mus musculus
tgtatgtgtgcatgttcatgta

SEQ ID NO: 187039 - DNA, 21 bp, Mus musculus
tgtgtgtgcatacatgtgtgt

SEQ ID NO: 187040 - DNA, 21 bp, Mus musculus
tctgtggaagtcagaagtggg

SEQ ID NO: 187041 - DNA, 23 bp, Mus musculus
acatgtgagtacagtgtctgaag

SEQ ID NO: 187042 - DNA, 23 bp, Mus musculus
tgtctcagcctcactgactgctc

SEQ ID NO: 187043 - DNA, 23 bp, Mus musculus
aagaaagtcaggatggatgtgga

SEQ ID NO: 187044 - DNA, 19 bp, Mus musculus
tagatttatatagatatgt

SEQ ID NO: 187045 - DNA, 23 bp, Mus musculus
tgtgtgtgtgtgtgtgtgcatgt

SEQ ID NO: 187046 - DNA, 23 bp, Mus musculus
catatatttagaatatgcaagat

SEQ ID NO: 187047 - DNA, 23 bp, Mus musculus
atatatatgtagctatgtgtatg

SEQ ID NO: 187048 - DNA, 23 bp, Mus musculus
ctccatctgcaacagcatctgca

SEQ ID NO: 187049 - DNA, 23 bp, Mus musculus
tctctctctccaacagaacacat

SEQ ID NO: 187050 - DNA, 23 bp, Mus musculus
ctgtctgtctgtctatgtctcac

SEQ ID NO: 187051 - DNA, 20 bp, Mus musculus
gctggctctgtctgtctctt

SEQ ID NO: 187052 - DNA, 23 bp, Mus musculus
tatgaggaaggctctcatcactg

SEQ ID NO: 187053 - DNA, 23 bp, Mus musculus
acacggacacacatacttgtgag

SEQ ID NO: 187054 - DNA, 23 bp, Mus musculus
tctgtgtctaagtctgtctgtct

SEQ ID NO: 187055 - DNA, 23 bp, Mus musculus
accctatgaaatgtaaagaatat

SEQ ID NO: 187056 - DNA, 22 bp, Mus musculus
agaaatgagtgagtagagtgac

SEQ ID NO: 187057 - DNA, 23 bp, Mus musculus
attttgttgatcttatagcatct

SEQ ID NO: 187058 - DNA, 23 bp, Mus musculus
tgcctgcctgcctgcctgtctgt

SEQ ID NO: 187059 - DNA, 22 bp, Mus musculus
tgttttgtgaccaattatatgg

SEQ ID NO: 187060 - DNA, 21 bp, Mus musculus
tccatggtggtctgataggat

SEQ ID NO: 187061 - DNA, 21 bp, Mus musculus
tttttccatcagttaataagt

SEQ ID NO: 187062 - DNA, 23 bp, Mus musculus
tagtgcatggtgatctgatagga

SEQ ID NO: 187063 - DNA, 23 bp, Mus musculus
cagctctctctgtgtgtgtctat

SEQ ID NO: 187064 - DNA, 23 bp, Mus musculus
tcacagagttcactctggctgag

SEQ ID NO: 187065 - DNA, 22 bp, Mus musculus
tgttttgtgaccaattatatgg

SEQ ID NO: 187066 - DNA, 19 bp, Mus musculus
cccggtggacagctgcact

SEQ ID NO: 187067 - DNA, 23 bp, Mus musculus
gtatacgtgcacgtgtgtgtata

SEQ ID NO: 187068 - DNA, 22 bp, Mus musculus
tgttttgtgaccaattatatgg

SEQ ID NO: 187069 - DNA, 23 bp, Mus musculus
gtgactgacactctcactggttt

SEQ ID NO: 187070 - DNA, 20 bp, Mus musculus
ttaagagcactcactgctct

SEQ ID NO: 187071 - DNA, 23 bp, Mus musculus
ttgaaggacagtggctgttctat

SEQ ID NO: 187072 - DNA, 23 bp, Mus musculus
gacaggacagactgtaaggacta

SEQ ID NO: 187073 - DNA, 23 bp, Mus musculus
tctgaccgttagtgtctgtcatc

SEQ ID NO: 187074 - DNA, 22 bp, Mus musculus
tatagctgagtcttatagtagt

SEQ ID NO: 187075 - DNA, 23 bp, Mus musculus
ttgaatagatgagttattgtagt

SEQ ID NO: 187076 - DNA, 18 bp, Mus musculus
tgcatcttacattgaagg

SEQ ID NO: 187077 - DNA, 23 bp, Mus musculus
tatttgctattgtaggggtagtg

SEQ ID NO: 187078 - DNA, 23 bp, Mus musculus
agacaggatcactcagacatgtt

SEQ ID NO: 187079 - DNA, 23 bp, Mus musculus
cttgtctctgtttctaaatctct

SEQ ID NO: 187080 - DNA, 20 bp, Mus musculus
agtgtggaactgaagctgaa

SEQ ID NO: 187081 - DNA, 22 bp, Mus musculus
tgttttgtgaccaattatatgg

SEQ ID NO: 187082 - DNA, 20 bp, Mus musculus
tatatatgtgtgtgtgtgta

SEQ ID NO: 187083 - DNA, 22 bp, Mus musculus
tgttttgtgaccaattatatgg

SEQ ID NO: 187084 - DNA, 20 bp, Mus musculus
tataattaagaactagtaga

SEQ ID NO: 187085 - DNA, 23 bp, Mus musculus
tgcctcagaatctctgtggttcc

SEQ ID NO: 187086 - DNA, 23 bp, Mus musculus
atatgtatgtatgtatatatgta

SEQ ID NO: 187087 - DNA, 19 bp, Mus musculus
gtgaccatatgtgtgtgga

SEQ ID NO: 187088 - DNA, 22 bp, Mus musculus
tgttttgtgaccaattatatgg

SEQ ID NO: 187089 - DNA, 21 bp, Mus musculus
agaggaaccactctcactctg

SEQ ID NO: 187090 - DNA, 22 bp, Mus musculus
actacaggactaggagcatcct

SEQ ID NO: 187091 - DNA, 22 bp, Mus musculus
agcatatatgaatctaaacacc

SEQ ID NO: 187092 - DNA, 23 bp, Mus musculus
tagtccatggtgatctgatagga

SEQ ID NO: 187093 - DNA, 23 bp, Mus musculus
tttgtgaccaattatattgtcaa

SEQ ID NO: 187094 - DNA, 22 bp, Mus musculus
atctgctggcttgtgttgcagc

SEQ ID NO: 187095 - DNA, 23 bp, Mus musculus
atgtagtatttactgaatgtata

SEQ ID NO: 187096 - DNA, 22 bp, Mus musculus
tgttttgtgaccaattatatgg

SEQ ID NO: 187097 - DNA, 22 bp, Mus musculus
ttccacatgagtgttggctttc

SEQ ID NO: 187098 - DNA, 21 bp, Mus musculus
tgttttgtgacctattatgtg

SEQ ID NO: 187099 - DNA, 23 bp, Mus musculus
gtcagtgtttagagttcctgtag

SEQ ID NO: 187100 - DNA, 19 bp, Mus musculus
tactctttatttcttcaag

SEQ ID NO: 187101 - DNA, 23 bp, Mus musculus
ggcacagaaaagagacagaggac

SEQ ID NO: 187102 - DNA, 22 bp, Mus musculus
ttcagtttctttgtcattcttt

SEQ ID NO: 187103 - DNA, 20 bp, Mus musculus
taaaggtgatgtgttggatg

SEQ ID NO: 187104 - DNA, 21 bp, Mus musculus
atgtatgtatgtatgtatgca

SEQ ID NO: 187105 - DNA, 22 bp, Mus musculus
tgacctggctatttttttcttt

SEQ ID NO: 187106 - DNA, 19 bp, Mus musculus
ctgtcaagttgacaaagga

SEQ ID NO: 187107 - DNA, 19 bp, Mus musculus
agtttagtctgcatagtga

SEQ ID NO: 187108 - DNA, 18 bp, Mus musculus
tgttatggtttactgtca

SEQ ID NO: 187109 - DNA, 21 bp, Mus musculus
tgaagttctctttctttgttg

SEQ ID NO: 187110 - DNA, 23 bp, Mus musculus
tcacagaatgaattgggtagagt

SEQ ID NO: 187111 - DNA, 22 bp, Mus musculus
tgttttgtgaccaattatatgg

SEQ ID NO: 187112 - DNA, 20 bp, Mus musculus
tttagtgtgctgacttctgt

SEQ ID NO: 187113 - DNA, 23 bp, Mus musculus
aggcaagatgctggcatagctgt

SEQ ID NO: 187114 - DNA, 23 bp, Mus musculus
gacagacagacagactggcaggc

SEQ ID NO: 187115 - DNA, 23 bp, Mus musculus
aaagtgcaaagactttcagctgt

SEQ ID NO: 187116 - DNA, 23 bp, Mus musculus
tgtctgtgagcgtgacttgtgag

SEQ ID NO: 187117 - DNA, 22 bp, Mus musculus
gtagaacttcctgactttctct

SEQ ID NO: 187118 - DNA, 20 bp, Mus musculus
tgtatgtgtatctacatacg

SEQ ID NO: 187119 - DNA, 18 bp, Mus musculus
tagcaccaatccaaaaga

SEQ ID NO: 187120 - DNA, 21 bp, Mus musculus
tctcactgtgactttttgcac

SEQ ID NO: 187121 - DNA, 22 bp, Mus musculus
tagagacaagatgctgagctca

SEQ ID NO: 187122 - DNA, 19 bp, Mus musculus
tctggggcagtcaagttgg

SEQ ID NO: 187123 - DNA, 23 bp, Mus musculus
gtactgtgtgggacaatagtggc

SEQ ID NO: 187124 - DNA, 23 bp, Mus musculus
cactttgtgggtctctctcacgc

SEQ ID NO: 187125 - DNA, 19 bp, Mus musculus
gtatgtatgtatgtatgta

SEQ ID NO: 187126 - DNA, 21 bp, Mus musculus
aagtgaggtgactgagctgtg

SEQ ID NO: 187127 - DNA, 21 bp, Mus musculus
attcacactcacacacatatg

SEQ ID NO: 187128 - DNA, 23 bp, Mus musculus
tgtatgtgtgcttgtgcatgtgg

SEQ ID NO: 187129 - DNA, 22 bp, Mus musculus
atctctgtggctatgtatgcct

SEQ ID NO: 187130 - DNA, 23 bp, Mus musculus
catctctctgtgtgtatgtgtgc

SEQ ID NO: 187131 - DNA, 23 bp, Mus musculus
tgtgtgtctgtgtatcatgtgta

SEQ ID NO: 187132 - DNA, 21 bp, Mus musculus
agaatctagaaaaggaaagct

SEQ ID NO: 187133 - DNA, 23 bp, Mus musculus
tctctctcacagttaagggtccc

SEQ ID NO: 187134 - DNA, 22 bp, Mus musculus
tgcctgtctgctcatgtgtctg

SEQ ID NO: 187135 - DNA, 23 bp, Mus musculus
ggttccatgtgcatgtgaatgga

SEQ ID NO: 187136 - DNA, 23 bp, Mus musculus
ctggcagactcactggctgtgca

SEQ ID NO: 187137 - DNA, 22 bp, Mus musculus
agagaacaatgactgctgtggg

SEQ ID NO: 187138 - DNA, 20 bp, Mus musculus
agtccatcctttttctctga

SEQ ID NO: 187139 - DNA, 19 bp, Mus musculus
agcatatatgtatgtatat

SEQ ID NO: 187140 - DNA, 18 bp, Mus musculus
attgcatatatgggtgga

SEQ ID NO: 187141 - DNA, 22 bp, Mus musculus
tgttttgtgaccaattatatgg

SEQ ID NO: 187142 - DNA, 23 bp, Mus musculus
atgacagtgaagccaggatgtgg

SEQ ID NO: 187143 - DNA, 22 bp, Mus musculus
tgttttgtgaccaattatatgg

SEQ ID NO: 187144 - DNA, 22 bp, Mus musculus
tatgtgtgtgtgtatgtatgtg

SEQ ID NO: 187145 - DNA, 20 bp, Mus musculus
tggctcagtggttaggagca

SEQ ID NO: 187146 - DNA, 23 bp, Mus musculus
tgtctgtctgtgtctgacacaca

SEQ ID NO: 187147 - DNA, 23 bp, Mus musculus
ggatctaatgtttggaagcagaa

SEQ ID NO: 187148 - DNA, 21 bp, Mus musculus
tatatgtgtgcatgtgcatgc

SEQ ID NO: 187149 - DNA, 21 bp, Mus musculus
tgcctgtgtatgtgtatatgt

SEQ ID NO: 187150 - DNA, 22 bp, Mus musculus
tctgtgtatgcatgtgtgtgtg

SEQ ID NO: 187151 - DNA, 23 bp, Mus musculus
atgtatgtatgtatgtgtgtgtg

SEQ ID NO: 187152 - DNA, 23 bp, Mus musculus
tacatatacacacacatatacat

SEQ ID NO: 187153 - DNA, 23 bp, Mus musculus
tgcgatagcttgaattcaaaatg

SEQ ID NO: 187154 - DNA, 21 bp, Mus musculus
tgtttgcctgtgtgtatgtct

SEQ ID NO: 187155 - DNA, 21 bp, Mus musculus
gtgcatgaatgtatgtatgta

SEQ ID NO: 187156 - DNA, 22 bp, Mus musculus
atatatatgtacatgtgtatct

SEQ ID NO: 187157 - DNA, 23 bp, Mus musculus
tctgcctgcctgcctgcctgtgt

SEQ ID NO: 187158 - DNA, 22 bp, Mus musculus
tctagtgatttagtagtactgg

SEQ ID NO: 187159 - DNA, 22 bp, Mus musculus
tgtatgcctgtgctatattaga

SEQ ID NO: 187160 - DNA, 23 bp, Mus musculus
agaatatagactgaacaggcagc

SEQ ID NO: 187161 - DNA, 20 bp, Mus musculus
gaacgctcatctgaattggg

SEQ ID NO: 187162 - DNA, 23 bp, Mus musculus
tgtctctgcctcgctctcacatg

SEQ ID NO: 187163 - DNA, 22 bp, Mus musculus
tgttttgtgaccaattatatgg

SEQ ID NO: 187164 - DNA, 23 bp, Mus musculus
tatatgtatatgtatatgtatat

SEQ ID NO: 187165 - DNA, 23 bp, Mus musculus
aggcagtctgacagtagctcagg

SEQ ID NO: 187166 - DNA, 23 bp, Mus musculus
aatggaatctcagagtcattttg

SEQ ID NO: 187167 - DNA, 21 bp, Mus musculus
cagagacaggagacagagagt

SEQ ID NO: 187168 - DNA, 23 bp, Mus musculus
acacaaaagagactgtgctgatt

SEQ ID NO: 187169 - DNA, 23 bp, Mus musculus
catgtgtgtgttacgtgtttgtg

SEQ ID NO: 187170 - DNA, 22 bp, Mus musculus
atgtatgtatgcaagtatgtgc

SEQ ID NO: 187171 - DNA, 23 bp, Mus musculus
tgcctgactgccagtctccaagc

SEQ ID NO: 187172 - DNA, 23 bp, Mus musculus
ggctcagtctctctctgtgcctg

SEQ ID NO: 187173 - DNA, 21 bp, Mus musculus
atctgtctctgtctctatagg

SEQ ID NO: 187174 - DNA, 23 bp, Mus musculus
gggcctgtctctgagtctgttgc

SEQ ID NO: 187175 - DNA, 23 bp, Mus musculus
tgacagagtcagtgtctctgtgg

SEQ ID NO: 187176 - DNA, 21 bp, Mus musculus
tatgtgtgtattggcacggac

SEQ ID NO: 187177 - DNA, 23 bp, Mus musculus
tacaactttaactccagctgcag

SEQ ID NO: 187178 - DNA, 21 bp, Mus musculus
ttatttgttcttctcttagtg

SEQ ID NO: 187179 - DNA, 22 bp, Mus musculus
ttcacacacactgagtttgggg

SEQ ID NO: 187180 - DNA, 23 bp, Mus musculus
tatgtatgtatgtatgtgtctgg

SEQ ID NO: 187181 - DNA, 23 bp, Mus musculus
tgtatgtatgcatgtatgtgtca

SEQ ID NO: 187182 - DNA, 19 bp, Mus musculus
tgtatgtatgcatgtgtat

SEQ ID NO: 187183 - DNA, 23 bp, Mus musculus
atgtgactatatgtatatatgtg

SEQ ID NO: 187184 - DNA, 23 bp, Mus musculus
atatgtgtgtgtgtttctgtgtg

SEQ ID NO: 187185 - DNA, 18 bp, Mus musculus
ttaaggcagctttcctta

SEQ ID NO: 187186 - DNA, 23 bp, Mus musculus
aggaacagagtctgcacactgcc

SEQ ID NO: 187187 - DNA, 23 bp, Mus musculus
tagctaaacacagagatgtatag

SEQ ID NO: 187188 - DNA, 23 bp, Mus musculus
tgcctcagtctctctctgtgagt

SEQ ID NO: 187189 - DNA, 23 bp, Mus musculus
tttctaatacatccagtttccct

SEQ ID NO: 187190 - DNA, 23 bp, Mus musculus
aatcactgggtctctgactccca

SEQ ID NO: 187191 - DNA, 23 bp, Mus musculus
tctccctctgactgcattcccat

SEQ ID NO: 187192 - DNA, 23 bp, Mus musculus
agtctcagtgaaagtacagtggg

SEQ ID NO: 187193 - DNA, 23 bp, Mus musculus
gcctgtctgggagggtctatcct

SEQ ID NO: 187194 - DNA, 23 bp, Mus musculus
ctgtgtgtgtctgcctctgtgtg

SEQ ID NO: 187195 - DNA, 22 bp, Mus musculus
tttaacaatatgtatatatgta

SEQ ID NO: 187196 - DNA, 23 bp, Mus musculus
ctttagtgattatgtagattagt

SEQ ID NO: 187197 - DNA, 21 bp, Mus musculus
ttgcagagtgctagaattcag

SEQ ID NO: 187198 - DNA, 22 bp, Mus musculus
tgacgacagccagtattgtttt

SEQ ID NO: 187199 - DNA, 23 bp, Mus musculus
acaacttgtaggttgttttgttc

SEQ ID NO: 187200 - DNA, 23 bp, Mus musculus
acacactctctatctttctcttt

SEQ ID NO: 187201 - DNA, 23 bp, Mus musculus
aggactagttggtattgaagaac

SEQ ID NO: 187202 - DNA, 23 bp, Mus musculus
tctcccactctcagtgttcctta

SEQ ID NO: 187203 - DNA, 22 bp, Mus musculus
atatgtgtatatgtatatatgt

SEQ ID NO: 187204 - DNA, 22 bp, Mus musculus
tgttttgtgaccaattatatgg

SEQ ID NO: 187205 - DNA, 23 bp, Mus musculus
acagattcagcaagagcatgtcg

SEQ ID NO: 187206 - DNA, 21 bp, Mus musculus
ttgtattttatgcatatgagc

SEQ ID NO: 187207 - DNA, 23 bp, Mus musculus
tgactctggcacactgtaacttt

SEQ ID NO: 187208 - DNA, 23 bp, Mus musculus
ttgtgctacaagaaggcaatgct

SEQ ID NO: 187209 - DNA, 22 bp, Mus musculus
tgttttgtgaccaattatatgg

SEQ ID NO: 187210 - DNA, 18 bp, Mus musculus
atgatggtctgataggat

SEQ ID NO: 187211 - DNA, 22 bp, Mus musculus
tatatgcacatatatatcttct

SEQ ID NO: 187212 - DNA, 23 bp, Mus musculus
ctctgtgtgtcacagtggctcaa

SEQ ID NO: 187213 - DNA, 20 bp, Mus musculus
ctctgtgtgtcacagtggct

SEQ ID NO: 187214 - DNA, 22 bp, Mus musculus
tgttttgtgaccaattatatgg

SEQ ID NO: 187215 - DNA, 22 bp, Mus musculus
acacacacacatatatatgtgt

SEQ ID NO: 187216 - DNA, 23 bp, Mus musculus
tgtctctgcctgtgtttaaggga

SEQ ID NO: 187217 - DNA, 23 bp, Mus musculus
agagttctgattttgttgttctg

SEQ ID NO: 187218 - DNA, 18 bp, Mus musculus
caaaggacaggccctgga

SEQ ID NO: 187219 - DNA, 22 bp, Mus musculus
ctacactcacagtgtcacactt

SEQ ID NO: 187220 - DNA, 19 bp, Mus musculus
gtagatatttattcttata

SEQ ID NO: 187221 - DNA, 23 bp, Mus musculus
tgtcatataactcctagtgtttg

SEQ ID NO: 187222 - DNA, 23 bp, Mus musculus
tatctctctgcatcatctgctgg

SEQ ID NO: 187223 - DNA, 23 bp, Mus musculus
tatgtgtgtgcatatgatgtgtg

SEQ ID NO: 187224 - DNA, 23 bp, Mus musculus
ctctctgtgtctctcatctcttt

SEQ ID NO: 187225 - DNA, 23 bp, Mus musculus
attttgaccttagctattctgag

SEQ ID NO: 187226 - DNA, 23 bp, Mus musculus
tctgattgactaaggatgttgaa

SEQ ID NO: 187227 - DNA, 20 bp, Mus musculus
atcacagatgagtctgagga

SEQ ID NO: 187228 - DNA, 23 bp, Mus musculus
tatgtgtgtatatgatgtacatg

SEQ ID NO: 187229 - DNA, 23 bp, Mus musculus
tgtgtgtgtgtgtgtgtgcatgt

SEQ ID NO: 187230 - DNA, 23 bp, Mus musculus
tgcatatgaaagtatagatgtgt

SEQ ID NO: 187231 - DNA, 23 bp, Mus musculus
ttgagagacaggaatgtagggag

SEQ ID NO: 187232 - DNA, 23 bp, Mus musculus
acacacacatatgcatacaggta

SEQ ID NO: 187233 - DNA, 23 bp, Mus musculus
tatctgtgtgcatatgtatatgt

SEQ ID NO: 187234 - DNA, 20 bp, Mus musculus
tccctcctgagcagatgcca

SEQ ID NO: 187235 - DNA, 21 bp, Mus musculus
tattttggaaatgttgaactt

SEQ ID NO: 187236 - DNA, 22 bp, Mus musculus
tgttttgtgaccaattatatgg

SEQ ID NO: 187237 - DNA, 23 bp, Mus musculus
tcactgttattctgtctctcact

SEQ ID NO: 187238 - DNA, 23 bp, Mus musculus
tacagactgccagttagatcagc

SEQ ID NO: 187239 - DNA, 23 bp, Mus musculus
tttggcattgttttgtctaagat

SEQ ID NO: 187240 - DNA, 22 bp, Mus musculus
actactggtaaatgtggagggt

SEQ ID NO: 187241 - DNA, 23 bp, Mus musculus
ttcagtgtatttcttcttctgag

SEQ ID NO: 187242 - DNA, 23 bp, Mus musculus
gtagaaaagcaatgcatagaggt

SEQ ID NO: 187243 - DNA, 19 bp, Mus musculus
tatatccatgtattcttaa

SEQ ID NO: 187244 - DNA, 20 bp, Mus musculus
tgtgaccctcagtgagtctg

SEQ ID NO: 187245 - DNA, 23 bp, Mus musculus
ttcactgtgtctgaactatggga

SEQ ID NO: 187246 - DNA, 23 bp, Mus musculus
tctctgtgtctctctgtctctct

SEQ ID NO: 187247 - DNA, 23 bp, Mus musculus
agtcagagagagatcaatcctcg

SEQ ID NO: 187248 - DNA, 18 bp, Mus musculus
acagtacacaaaacattc

SEQ ID NO: 187249 - DNA, 22 bp, Mus musculus
atgtgtgtatatgtatatgtat

SEQ ID NO: 187250 - DNA, 21 bp, Mus musculus
tgtatgtacatatgtatttat

SEQ ID NO: 187251 - DNA, 19 bp, Mus musculus
ttatgctatttgacaaaag

SEQ ID NO: 187252 - DNA, 22 bp, Mus musculus
tgtatacatgtatatatatgta

SEQ ID NO: 187253 - DNA, 21 bp, Mus musculus
aatgtatatatatatatgtgt

SEQ ID NO: 187254 - DNA, 23 bp, Mus musculus
attgaaactggaaaacatttaga

SEQ ID NO: 187255 - DNA, 20 bp, Mus musculus
ttccatctgtctggtagctg

SEQ ID NO: 187256 - DNA, 21 bp, Mus musculus
atatgtatgtacatgcataca

SEQ ID NO: 187257 - DNA, 23 bp, Mus musculus
atatgtgtatgtatacaagtatg

SEQ ID NO: 187258 - DNA, 23 bp, Mus musculus
tgatggttcagagtatgagaact

SEQ ID NO: 187259 - DNA, 22 bp, Mus musculus
tgttttgtgaccaattatatgg

SEQ ID NO: 187260 - DNA, 22 bp, Mus musculus
tgttttgtgaccaattatatgg

SEQ ID NO: 187261 - DNA, 23 bp, Mus musculus
tagatactatttgaatttggatt

SEQ ID NO: 187262 - DNA, 22 bp, Mus musculus
tctggttgaaggtagtatatta

SEQ ID NO: 187263 - DNA, 22 bp, Mus musculus
tgttttgtgaccaattatatgg

SEQ ID NO: 187264 - DNA, 20 bp, Mus musculus
atgatttcactatattctgt

SEQ ID NO: 187265 - DNA, 22 bp, Mus musculus
tgttttgtgaccaattatatgg

SEQ ID NO: 187266 - DNA, 23 bp, Mus musculus
tctctctgtgtgtgatagtgtgt

SEQ ID NO: 187267 - DNA, 21 bp, Mus musculus
gactgtatacatgtatatgtg

SEQ ID NO: 187268 - DNA, 18 bp, Mus musculus
aaagcattgatggagctg

SEQ ID NO: 187269 - DNA, 22 bp, Mus musculus
tgtcaggctttgatttctacag

SEQ ID NO: 187270 - DNA, 23 bp, Mus musculus
tagtgcatggtgatctgatagga

SEQ ID NO: 187271 - DNA, 22 bp, Mus musculus
tgttttgtgacctattatgtgg

SEQ ID NO: 187272 - DNA, 23 bp, Mus musculus
attgttacagttattgttgttgt

SEQ ID NO: 187273 - DNA, 23 bp, Mus musculus
gagtagtcactttgttcttagca

SEQ ID NO: 187274 - DNA, 20 bp, Mus musculus
tcagtctttttctctctgaa

SEQ ID NO: 187275 - DNA, 20 bp, Mus musculus
catgtgtgtgtgtgtacatg

SEQ ID NO: 187276 - DNA, 21 bp, Mus musculus
tatgcatatatatctgtatat

SEQ ID NO: 187277 - DNA, 23 bp, Mus musculus
tgtgtgtgtatgttatatgtatg

SEQ ID NO: 187278 - DNA, 22 bp, Mus musculus
cctgtcactgcctgtaatgtgt

SEQ ID NO: 187279 - DNA, 23 bp, Mus musculus
aatgcttatgcatctgtatattt

SEQ ID NO: 187280 - DNA, 21 bp, Mus musculus
atttatgcgtgtgcatgtgta

SEQ ID NO: 187281 - DNA, 19 bp, Mus musculus
gtgatcatccacttctatg

SEQ ID NO: 187282 - DNA, 22 bp, Mus musculus
tttctgggagttcaagtgagga

SEQ ID NO: 187283 - DNA, 22 bp, Mus musculus
tcagaagtgcacagggtccaga

SEQ ID NO: 187284 - DNA, 21 bp, Mus musculus
tgacggtctggatctgctggg

SEQ ID NO: 187285 - DNA, 22 bp, Mus musculus
tgttttgtgaccaattatatgg

SEQ ID NO: 187286 - DNA, 20 bp, Mus musculus
tggaagaaggaagttttgtt

SEQ ID NO: 187287 - DNA, 23 bp, Mus musculus
aggcaagacaatctatcttgttt

SEQ ID NO: 187288 - DNA, 23 bp, Mus musculus
atgtttgtatttgtattcatatg

SEQ ID NO: 187289 - DNA, 23 bp, Mus musculus
gtgtgtgcatgtgtattgattgt

SEQ ID NO: 187290 - DNA, 21 bp, Mus musculus
tatccgtttatatttcaatat

SEQ ID NO: 187291 - DNA, 22 bp, Mus musculus
ataattgacattttgtagttct

SEQ ID NO: 187292 - DNA, 20 bp, Mus musculus
gaatgttaagtagctgctcc

SEQ ID NO: 187293 - DNA, 20 bp, Mus musculus
tatgtatgtatgtatgtatg

SEQ ID NO: 187294 - DNA, 23 bp, Mus musculus
gatctgcctgtctttctgactct

SEQ ID NO: 187295 - DNA, 22 bp, Mus musculus
atgccatatcatgaaggcttga

SEQ ID NO: 187296 - DNA, 22 bp, Mus musculus
atataaaagttgatgaagatgt

SEQ ID NO: 187297 - DNA, 21 bp, Mus musculus
gtcatcttccctcagtccctg

SEQ ID NO: 187298 - DNA, 23 bp, Mus musculus
tctgccatttgtttgctgtgtaa

SEQ ID NO: 187299 - DNA, 23 bp, Mus musculus
gtatgtatatatgtatgtgtgtg

SEQ ID NO: 187300 - DNA, 20 bp, Mus musculus
atgtatgtatgtatgtatgt

SEQ ID NO: 187301 - DNA, 22 bp, Mus musculus
tcatgtaaaaacttgctttgaa

SEQ ID NO: 187302 - DNA, 23 bp, Mus musculus
ctgtctctctgagtcagctgctg

SEQ ID NO: 187303 - DNA, 22 bp, Mus musculus
tgttttgtgaccaattatatgg

SEQ ID NO: 187304 - DNA, 21 bp, Mus musculus
aagactcagcatatagctctg

SEQ ID NO: 187305 - DNA, 22 bp, Mus musculus
ttatgtgtctgggggaatttct

SEQ ID NO: 187306 - DNA, 23 bp, Mus musculus
agctccaaactctgtctctgtaa

SEQ ID NO: 187307 - DNA, 23 bp, Mus musculus
ttctgttttcatgtcattggtag

SEQ ID NO: 187308 - DNA, 23 bp, Mus musculus
tttagatgttccagttgccttca

SEQ ID NO: 187309 - DNA, 23 bp, Mus musculus
acagagtgtagagtgtgacatct

SEQ ID NO: 187310 - DNA, 22 bp, Mus musculus
tgttttgtgaccaattatatgg

SEQ ID NO: 187311 - DNA, 22 bp, Mus musculus
tgttttgtgaccaattatatgg

SEQ ID NO: 187312 - DNA, 19 bp, Mus musculus
atatgagtatatatgtatg

SEQ ID NO: 187313 - DNA, 22 bp, Mus musculus
atgactctgtgtgtgtgtgcat

SEQ ID NO: 187314 - DNA, 21 bp, Mus musculus
actcagtgtggagacaagccc

SEQ ID NO: 187315 - DNA, 21 bp, Mus musculus
gcttcttctccacttagtcca

SEQ ID NO: 187316 - DNA, 20 bp, Mus musculus
acagcctgctctgtctgtgt

SEQ ID NO: 187317 - DNA, 21 bp, Mus musculus
tttgtttatcatttagaacac

SEQ ID NO: 187318 - DNA, 23 bp, Mus musculus
atgtatgtatgtatgtatgtatg

SEQ ID NO: 187319 - DNA, 21 bp, Mus musculus
agcacctgtaatttataggag

SEQ ID NO: 187320 - DNA, 23 bp, Mus musculus
tagtgcatggtgatctgatagga

SEQ ID NO: 187321 - DNA, 22 bp, Mus musculus
tgttttgtgacctattatgtgg

SEQ ID NO: 187322 - DNA, 19 bp, Mus musculus
gaagagactttgtagccat

SEQ ID NO: 187323 - DNA, 23 bp, Mus musculus
ttcatggttctagttgatgatat

SEQ ID NO: 187324 - DNA, 22 bp, Mus musculus
tgttttgtgaccaattatatgg

SEQ ID NO: 187325 - DNA, 23 bp, Mus musculus
tgttgatctcattttgtagttgt

SEQ ID NO: 187326 - DNA, 19 bp, Mus musculus
ttctgtggatgtatgttta

SEQ ID NO: 187327 - DNA, 23 bp, Mus musculus
agaggtgcacacagagagcagaa

SEQ ID NO: 187328 - DNA, 20 bp, Mus musculus
tgtgggtatgtatatgtacg

SEQ ID NO: 187329 - DNA, 23 bp, Mus musculus
atgtatgtatgtgtgtatgtaca

SEQ ID NO: 187330 - DNA, 22 bp, Mus musculus
tgttttgtgaccaattatatgg

SEQ ID NO: 187331 - DNA, 23 bp, Mus musculus
tcagtgtgtgattttctcagtgc

SEQ ID NO: 187332 - DNA, 22 bp, Mus musculus
aagacttttgactttgtccttc

SEQ ID NO: 187333 - DNA, 19 bp, Mus musculus
catggtggtctgataggat

SEQ ID NO: 187334 - DNA, 22 bp, Mus musculus
tgttttgtgaccaattatatgg

SEQ ID NO: 187335 - DNA, 23 bp, Mus musculus
ttatttgtgctctgtgtctcaga

SEQ ID NO: 187336 - DNA, 22 bp, Mus musculus
catttgttgtaattggtatata

SEQ ID NO: 187337 - DNA, 23 bp, Mus musculus
tatatcatactttatatatgtgt

SEQ ID NO: 187338 - DNA, 23 bp, Mus musculus
acactcattgtctctctcctttc

SEQ ID NO: 187339 - DNA, 23 bp, Mus musculus
tattaagtgaatttgaatatatg

SEQ ID NO: 187340 - DNA, 23 bp, Mus musculus
atcagactgtctgtctacacttg

SEQ ID NO: 187341 - DNA, 22 bp, Mus musculus
ttcagaaaagtgagagtgctga

SEQ ID NO: 187342 - DNA, 22 bp, Mus musculus
ctgtgacactgtgtctcccatt

SEQ ID NO: 187343 - DNA, 23 bp, Mus musculus
tataggagctgagtgtgcagaga

SEQ ID NO: 187344 - DNA, 23 bp, Mus musculus
ctttcctctgtctgtctgtctgt

SEQ ID NO: 187345 - DNA, 23 bp, Mus musculus
atttgaggagttgtatgttcctt

SEQ ID NO: 187346 - DNA, 22 bp, Mus musculus
tgttttgtgaccaattatatgg

SEQ ID NO: 187347 - DNA, 23 bp, Mus musculus
cttaagtgagcattagcttggta

SEQ ID NO: 187348 - DNA, 23 bp, Mus musculus
ccatcttgtgtaagccagggcct

SEQ ID NO: 187349 - DNA, 22 bp, Mus musculus
tatgtatgtgcatgtatgtata

SEQ ID NO: 187350 - DNA, 20 bp, Mus musculus
tatatgcatatacatataga

SEQ ID NO: 187351 - DNA, 21 bp, Mus musculus
agtgctcacagaggatttact

SEQ ID NO: 187352 - DNA, 20 bp, Mus musculus
tcccacagtccctctgtggc

SEQ ID NO: 187353 - DNA, 21 bp, Mus musculus
tccactgaagtgagtgagccc

SEQ ID NO: 187354 - DNA, 23 bp, Mus musculus
aactggctcctctgcatgtcaga

SEQ ID NO: 187355 - DNA, 20 bp, Mus musculus
gtatgtatgtacgtgtgtgt

SEQ ID NO: 187356 - DNA, 18 bp, Mus musculus
acctctggaactgtgagc

SEQ ID NO: 187357 - DNA, 22 bp, Mus musculus
tgtgaacctcaggcaggcttct

SEQ ID NO: 187358 - DNA, 18 bp, Mus musculus
atgtgtgtgtgtatatgt

SEQ ID NO: 187359 - DNA, 23 bp, Mus musculus
tttatgtgtgtgccatacatggg

SEQ ID NO: 187360 - DNA, 20 bp, Mus musculus
attacagggattttgatcag

SEQ ID NO: 187361 - DNA, 23 bp, Mus musculus
atcctgctattaagtcttgttat

SEQ ID NO: 187362 - DNA, 23 bp, Mus musculus
tcactctgtcagtgggagtacac

SEQ ID NO: 187363 - DNA, 23 bp, Mus musculus
ctctctctctctgtgtgtgtgtg

SEQ ID NO: 187364 - DNA, 18 bp, Mus musculus
catctatgtggacagcta

SEQ ID NO: 187365 - DNA, 23 bp, Mus musculus
gtaggtattcactctgattctct

SEQ ID NO: 187366 - DNA, 22 bp, Mus musculus
agagatgactcagtggttaagg

SEQ ID NO: 187367 - DNA, 20 bp, Mus musculus
cttccctctctgtggctgtg

SEQ ID NO: 187368 - DNA, 22 bp, Mus musculus
taagagatatcagagatggtca

SEQ ID NO: 187369 - DNA, 22 bp, Mus musculus
taagagatatcagagatggtca

SEQ ID NO: 187370 - DNA, 23 bp, Mus musculus
actgtctcactgtctcactgtct

SEQ ID NO: 187371 - DNA, 20 bp, Mus musculus
acagagccagaaaagcatct

SEQ ID NO: 187372 - DNA, 23 bp, Mus musculus
tctcagtgtctatctgtctgtct

SEQ ID NO: 187373 - DNA, 23 bp, Mus musculus
acccaggctgtgctagaactcag

SEQ ID NO: 187374 - DNA, 20 bp, Mus musculus
acagagccagaaaagcatct

SEQ ID NO: 187375 - DNA, 23 bp, Mus musculus
tctcagtgtctatctgtctgtct

SEQ ID NO: 187376 - DNA, 20 bp, Mus musculus
acagagccagaaaagcatct

SEQ ID NO: 187377 - DNA, 23 bp, Mus musculus
tctcagtgtctatctgtctgtct

SEQ ID NO: 187378 - DNA, 23 bp, Mus musculus
acccaggctgtgctagaactcag

SEQ ID NO: 187379 - DNA, 20 bp, Mus musculus
acagagccagaaaagcatct

SEQ ID NO: 187380 - DNA, 23 bp, Mus musculus
tctcagtgtctatctgtctgtct

SEQ ID NO: 187381 - DNA, 23 bp, Mus musculus
tgtctgtctgtcctggagctcac

SEQ ID NO: 187382 - DNA, 23 bp, Mus musculus
tttgtgaccaattgtatgctcaa

SEQ ID NO: 187383 - DNA, 20 bp, Mus musculus
acagagccagaaaagcatct

SEQ ID NO: 187384 - DNA, 23 bp, Mus musculus
tctcagtgtctatctgtctgtct

SEQ ID NO: 187385 - DNA, 22 bp, Mus musculus
atgactttgaacaatacttgta

SEQ ID NO: 187386 - DNA, 20 bp, Mus musculus
acagagccagaaaagcatct

SEQ ID NO: 187387 - DNA, 23 bp, Mus musculus
tctcagtgtctatctgtctgtct

SEQ ID NO: 187388 - DNA, 23 bp, Mus musculus
acccaggctgtgctagaactcag

SEQ ID NO: 187389 - DNA, 20 bp, Mus musculus
acagagccagaaaagcatct

SEQ ID NO: 187390 - DNA, 23 bp, Mus musculus
tctcagtgtctatctgtctgtct

SEQ ID NO: 187391 - DNA, 23 bp, Mus musculus
acccaggctgtgctagaactcag

SEQ ID NO: 187392 - DNA, 22 bp, Mus musculus
tgttttgtgaccaattatatgg

SEQ ID NO: 187393 - DNA, 23 bp, Mus musculus
tatatgtgtgtatatgtatatac

SEQ ID NO: 187394 - DNA, 23 bp, Mus musculus
tctgacaggatttagaatcacca

SEQ ID NO: 187395 - DNA, 20 bp, Mus musculus
atttgatggagataacccat

SEQ ID NO: 187396 - DNA, 22 bp, Mus musculus
aaagctgtactggtgggggtga

SEQ ID NO: 187397 - DNA, 23 bp, Mus musculus
tccagcatctctgactgactgac

SEQ ID NO: 187398 - DNA, 22 bp, Mus musculus
atctgctacctctggactctga

SEQ ID NO: 187399 - DNA, 23 bp, Mus musculus
tctgtctgtctgtctgtctgtgt

SEQ ID NO: 187400 - DNA, 22 bp, Mus musculus
ttaagagcactgactgctcttc

SEQ ID NO: 187401 - DNA, 23 bp, Mus musculus
taaactgagaagacagaaggact

SEQ ID NO: 187402 - DNA, 22 bp, Mus musculus
tgttttgtgaccaattatatgg

SEQ ID NO: 187403 - DNA, 23 bp, Mus musculus
taagatcttcctctgtgtgtgtg

SEQ ID NO: 187404 - DNA, 23 bp, Mus musculus
attcacagcaagctactgatatt

SEQ ID NO: 187405 - DNA, 23 bp, Mus musculus
ttcaattccatttgtaatgggat

SEQ ID NO: 187406 - DNA, 23 bp, Mus musculus
tcaggggctggagagatggctct

SEQ ID NO: 187407 - DNA, 22 bp, Mus musculus
atatacttacatgtatagtgta

SEQ ID NO: 187408 - DNA, 23 bp, Mus musculus
ttttgtgtctgtaaggtgatttg

SEQ ID NO: 187409 - DNA, 23 bp, Mus musculus
gtatatatgtgtatgtatacata

SEQ ID NO: 187410 - DNA, 22 bp, Mus musculus
tatgtgtgtatacacatacaca

SEQ ID NO: 187411 - DNA, 23 bp, Mus musculus
attatagtgacttacatttctct

SEQ ID NO: 187412 - DNA, 23 bp, Mus musculus
tcacacagcctcagtgtttgcca

SEQ ID NO: 187413 - DNA, 23 bp, Mus musculus
ctgtgagtgtgtgcatgtgcatg

SEQ ID NO: 187414 - DNA, 20 bp, Mus musculus
gtctgggtctatctctgcct

SEQ ID NO: 187415 - DNA, 21 bp, Mus musculus
gtgtacatatgcttgtgtgca

SEQ ID NO: 187416 - DNA, 23 bp, Mus musculus
tgagtgagtgtgcatgtgcatgt

SEQ ID NO: 187417 - DNA, 19 bp, Mus musculus
acacagaagagagtcagga

SEQ ID NO: 187418 - DNA, 23 bp, Mus musculus
aatgagtcaccattttgtagtga

SEQ ID NO: 187419 - DNA, 22 bp, Mus musculus
tgttttgtgaccaattatatgg

SEQ ID NO: 187420 - DNA, 23 bp, Mus musculus
agtgatgacactgggtgttcagg

SEQ ID NO: 187421 - DNA, 23 bp, Mus musculus
agtaaatgtctctgaaatatgca

SEQ ID NO: 187422 - DNA, 23 bp, Mus musculus
tctgtctctctgcgtatgtagtg

SEQ ID NO: 187423 - DNA, 23 bp, Mus musculus
gggctgactctgtgcctgtcctt

SEQ ID NO: 187424 - DNA, 23 bp, Mus musculus
acagtcatcgcattctgtttctc

SEQ ID NO: 187425 - DNA, 22 bp, Mus musculus
tgtatatgtatgtgtatgtatg

SEQ ID NO: 187426 - DNA, 23 bp, Mus musculus
acttacatcctcagcaactggtt

SEQ ID NO: 187427 - DNA, 19 bp, Mus musculus
tgtgtatgtgtatatgtgt

SEQ ID NO: 187428 - DNA, 18 bp, Mus musculus
tttgaggtttcaaaggcc

SEQ ID NO: 187429 - DNA, 22 bp, Mus musculus
atgtctctctcagtctctcagt

SEQ ID NO: 187430 - DNA, 23 bp, Mus musculus
tcactgtgtgactgtgacaaagc

SEQ ID NO: 187431 - DNA, 23 bp, Mus musculus
ggtctgtgtctctgggtgtggtg

SEQ ID NO: 187432 - DNA, 19 bp, Mus musculus
ctctcagctgtgcctggag

SEQ ID NO: 187433 - DNA, 21 bp, Mus musculus
ctcagagaacacagtcagcag

SEQ ID NO: 187434 - DNA, 21 bp, Mus musculus
ttttctgggagctttgatgag

SEQ ID NO: 187435 - DNA, 22 bp, Mus musculus
atattgcacattactaagttgc

SEQ ID NO: 187436 - DNA, 23 bp, Mus musculus
tcaatgcaatttagtgtgtgtga

SEQ ID NO: 187437 - DNA, 23 bp, Mus musculus
taagagatagaaaaggttttcca

SEQ ID NO: 187438 - DNA, 23 bp, Mus musculus
actgactgctcttctagaggttc

SEQ ID NO: 187439 - DNA, 20 bp, Mus musculus
tggtggtctgatagaataca

SEQ ID NO: 187440 - DNA, 22 bp, Mus musculus
tgttttgtgaccaattatatgg

SEQ ID NO: 187441 - DNA, 23 bp, Mus musculus
tgtgtgtacagagtgtgtacata

SEQ ID NO: 187442 - DNA, 22 bp, Mus musculus
tgttttgtgaccaattatatgg

SEQ ID NO: 187443 - DNA, 22 bp, Mus musculus
tgttttgtgaccaattatatgg

SEQ ID NO: 187444 - DNA, 22 bp, Mus musculus
tgttttgtgaccaattatatgg

SEQ ID NO: 187445 - DNA, 21 bp, Mus musculus
tccctgtcatctcagcagttt

SEQ ID NO: 187446 - DNA, 22 bp, Mus musculus
atgtctggcactttatcaggtt

SEQ ID NO: 187447 - DNA, 19 bp, Mus musculus
acagatatatgggtactga

SEQ ID NO: 187448 - DNA, 23 bp, Mus musculus
tctcagtctcacttatatttcag

SEQ ID NO: 187449 - DNA, 23 bp, Mus musculus
tgttatcacaccgagctttctct

SEQ ID NO: 187450 - DNA, 21 bp, Mus musculus
atatgcaggttatatgtgatc

SEQ ID NO: 187451 - DNA, 23 bp, Mus musculus
gtgcgtgcgtgcgtgcgtgcatg

SEQ ID NO: 187452 - DNA, 22 bp, Mus musculus
gtgcatgtgtgtgtggatgtgt

SEQ ID NO: 187453 - DNA, 23 bp, Mus musculus
tactcagtcactctgtggcactg

SEQ ID NO: 187454 - DNA, 22 bp, Mus musculus
gtatgtatgtatgcaagtgtga

SEQ ID NO: 187455 - DNA, 23 bp, Mus musculus
agcttatgtcattttgtagatga

SEQ ID NO: 187456 - DNA, 18 bp, Mus musculus
tttgtctgcatgaggctg

SEQ ID NO: 187457 - DNA, 23 bp, Mus musculus
tggttctagcttgatttctattg

SEQ ID NO: 187458 - DNA, 22 bp, Mus musculus
ctgcctgtctctgtgcctcacc

SEQ ID NO: 187459 - DNA, 23 bp, Mus musculus
atgcctgatatgttggtgctggg

SEQ ID NO: 187460 - DNA, 22 bp, Mus musculus
tatatgtatgtgtggatctgca

SEQ ID NO: 187461 - DNA, 23 bp, Mus musculus
tgtggttgtatctccctgtggct

SEQ ID NO: 187462 - DNA, 22 bp, Mus musculus
gcatatctgaccgtgtgtttcc

SEQ ID NO: 187463 - DNA, 19 bp, Mus musculus
tgctgggttgattttgtga

SEQ ID NO: 187464 - DNA, 23 bp, Mus musculus
gagagacagttcactgaggccag

SEQ ID NO: 187465 - DNA, 23 bp, Mus musculus
tgtgtgcatgcattgtgtgtgag

SEQ ID NO: 187466 - DNA, 19 bp, Mus musculus
acacacagctcatgtatac

SEQ ID NO: 187467 - DNA, 23 bp, Mus musculus
tgagagcagagtgtgttcatcct

SEQ ID NO: 187468 - DNA, 23 bp, Mus musculus
ttgagagtgtttgagaagcaact

SEQ ID NO: 187469 - DNA, 22 bp, Mus musculus
aggttttagcttctaaacattt

SEQ ID NO: 187470 - DNA, 23 bp, Mus musculus
tgtttgcaatgcaaaggaatctt

SEQ ID NO: 187471 - DNA, 22 bp, Mus musculus
tattttgtgaccaattatatgg

SEQ ID NO: 187472 - DNA, 22 bp, Mus musculus
tacatgtgtatacttgcataca

SEQ ID NO: 187473 - DNA, 21 bp, Mus musculus
atgtgtgtatatatatgtgtg

SEQ ID NO: 187474 - DNA, 20 bp, Mus musculus
tctgtcactctgtgtcctct

SEQ ID NO: 187475 - DNA, 23 bp, Mus musculus
gtgtgtgcatgtgttgtgtatgt

SEQ ID NO: 187476 - DNA, 22 bp, Mus musculus
tgttttgtgaccaattatatgg

SEQ ID NO: 187477 - DNA, 22 bp, Mus musculus
tgttttgtgaccaattatatgg

SEQ ID NO: 187478 - DNA, 23 bp, Mus musculus
tctctctctctgagttggaggct

SEQ ID NO: 187479 - DNA, 23 bp, Mus musculus
ctgactgctcttccagaggtcct

SEQ ID NO: 187480 - DNA, 23 bp, Mus musculus
ttaagcacaggctcagttcaggt

SEQ ID NO: 187481 - DNA, 22 bp, Mus musculus
tgcttggtcatgatgttttgtg

SEQ ID NO: 187482 - DNA, 22 bp, Mus musculus
taagacactcactgaatgggct

SEQ ID NO: 187483 - DNA, 23 bp, Mus musculus
agtgagtccataccatgtgtgtt

SEQ ID NO: 187484 - DNA, 20 bp, Mus musculus
acctagatggttctattgtt

SEQ ID NO: 187485 - DNA, 22 bp, Mus musculus
gaaagagcagacagtgctctta

SEQ ID NO: 187486 - DNA, 21 bp, Mus musculus
aggaagactactgattttttt

SEQ ID NO: 187487 - DNA, 23 bp, Mus musculus
ttgtctatatatttgtgtgactg

SEQ ID NO: 187488 - DNA, 23 bp, Mus musculus
taagcatctatgaatacttgtgg

SEQ ID NO: 187489 - DNA, 22 bp, Mus musculus
aatagtatgtttcagtgaatgt

SEQ ID NO: 187490 - DNA, 23 bp, Mus musculus
tatgtatttgtatgcataagtgt

SEQ ID NO: 187491 - DNA, 22 bp, Mus musculus
tgttttgtgaccaattatatgg

SEQ ID NO: 187492 - DNA, 20 bp, Mus musculus
taagagtctcattcctaagg

SEQ ID NO: 187493 - DNA, 23 bp, Mus musculus
tgttagggtccatgaatcactga

SEQ ID NO: 187494 - DNA, 22 bp, Mus musculus
ttatttttacatgtgggtgtgt

SEQ ID NO: 187495 - DNA, 23 bp, Mus musculus
ctgtaagagatacttcttggtgt

SEQ ID NO: 187496 - DNA, 18 bp, Mus musculus
aaggcagactctggcttt

SEQ ID NO: 187497 - DNA, 20 bp, Mus musculus
actccttctaagtgtctcac

SEQ ID NO: 187498 - DNA, 22 bp, Mus musculus
tgttttgtgaccaattatatgg

SEQ ID NO: 187499 - DNA, 22 bp, Mus musculus
tgttttgtgaccaattatatgg

SEQ ID NO: 187500 - DNA, 22 bp, Mus musculus
tgttttgtgaccaattatatgg

SEQ ID NO: 187501 - DNA, 20 bp, Mus musculus
ctgtctgtctctgtgtgtgt

SEQ ID NO: 187502 - DNA, 23 bp, Mus musculus
ttggttctctgtgtctaacttct

SEQ ID NO: 187503 - DNA, 22 bp, Mus musculus
tgttttgtgaccaattatatgg

SEQ ID NO: 187504 - DNA, 23 bp, Mus musculus
aaatcttgctagtgtatgcaatg

SEQ ID NO: 187505 - DNA, 20 bp, Mus musculus
aatgacacaagtatacaact

SEQ ID NO: 187506 - DNA, 20 bp, Mus musculus
acacacacacatttacatat

SEQ ID NO: 187507 - DNA, 23 bp, Mus musculus
tctatatcatctatatcgtgtgt

SEQ ID NO: 187508 - DNA, 22 bp, Mus musculus
tgttttgtgaccaattatatgg

SEQ ID NO: 187509 - DNA, 18 bp, Mus musculus
tgcctttcagtgccatag

SEQ ID NO: 187510 - DNA, 23 bp, Mus musculus
atccctgtgtctgaagtatattg

SEQ ID NO: 187511 - DNA, 23 bp, Mus musculus
ctgaccctgcctctgtcacactg

SEQ ID NO: 187512 - DNA, 18 bp, Mus musculus
tgtctgtgtgcatatctt

SEQ ID NO: 187513 - DNA, 22 bp, Mus musculus
tgttttgtgaccaattatatgg

SEQ ID NO: 187514 - DNA, 22 bp, Mus musculus
tgttttgtgaccaattatatgg

SEQ ID NO: 187515 - DNA, 22 bp, Mus musculus
tgttttgtgaccaattatatgg

SEQ ID NO: 187516 - DNA, 22 bp, Mus musculus
tgttttgtgaccaattatatgg

SEQ ID NO: 187517 - DNA, 19 bp, Mus musculus
ttgtaccctcttgctgaat

SEQ ID NO: 187518 - DNA, 22 bp, Mus musculus
taaagagcattttgttcaagta

SEQ ID NO: 187519 - DNA, 23 bp, Mus musculus
tttccttctcagtgtctttgtgt

SEQ ID NO: 187520 - DNA, 22 bp, Mus musculus
aagcaacagaagaattgtgaaa

SEQ ID NO: 187521 - DNA, 23 bp, Mus musculus
tatgtatgtatgtatgtatacag

SEQ ID NO: 187522 - DNA, 21 bp, Mus musculus
tccctgcctgcctgtatccta

SEQ ID NO: 187523 - DNA, 23 bp, Mus musculus
taagtgatttttttcatatgtca

SEQ ID NO: 187524 - DNA, 19 bp, Mus musculus
aaatatctagatgatggat

SEQ ID NO: 187525 - DNA, 23 bp, Mus musculus
aggagagagtcagcactcaggtg

SEQ ID NO: 187526 - DNA, 23 bp, Mus musculus
tacccttggttatgtaatgaaaa

SEQ ID NO: 187527 - DNA, 23 bp, Mus musculus
ctaagagatgacacttgctgatc

SEQ ID NO: 187528 - DNA, 22 bp, Mus musculus
tataaaagttgagcagctgtag

SEQ ID NO: 187529 - DNA, 18 bp, Mus musculus
ccatatcttagcagaatg

SEQ ID NO: 187530 - DNA, 23 bp, Mus musculus
gaatgtctccaaatgtgtgacct

SEQ ID NO: 187531 - DNA, 21 bp, Mus musculus
ttatgagttgaccccctgtct

SEQ ID NO: 187532 - DNA, 23 bp, Mus musculus
gcgcgcgtgtgtctgtctgtgtg

SEQ ID NO: 187533 - DNA, 23 bp, Mus musculus
agagagtagagagtctgggcatg

SEQ ID NO: 187534 - DNA, 21 bp, Mus musculus
actctgtaggtagaggtgagt

SEQ ID NO: 187535 - DNA, 23 bp, Mus musculus
tctctctgtctctgtgtgtgtgt

SEQ ID NO: 187536 - DNA, 19 bp, Mus musculus
tgtgagaagtgactgacga

SEQ ID NO: 187537 - DNA, 23 bp, Mus musculus
tgtgatgctgtgtgtctgagtgc

SEQ ID NO: 187538 - DNA, 23 bp, Mus musculus
atgaagtgcagtctgtggtctga

SEQ ID NO: 187539 - DNA, 23 bp, Mus musculus
ggctgtctctggctctgtttgtc

SEQ ID NO: 187540 - DNA, 22 bp, Mus musculus
tgtgcgcctctgtgtgtgtctg

SEQ ID NO: 187541 - DNA, 23 bp, Mus musculus
cctctcagactctctcacttctc

SEQ ID NO: 187542 - DNA, 23 bp, Mus musculus
cagggtctctgtgtctgtcagct

SEQ ID NO: 187543 - DNA, 19 bp, Mus musculus
ctgttgtttgtgctgtgtg

SEQ ID NO: 187544 - DNA, 23 bp, Mus musculus
ttaaacactgaatggtctggctc

SEQ ID NO: 187545 - DNA, 23 bp, Mus musculus
cacacacagactgtcctatggat

SEQ ID NO: 187546 - DNA, 23 bp, Mus musculus
cacacacagtctgacagacagac

SEQ ID NO: 187547 - DNA, 23 bp, Mus musculus
tactctcaggctgctttgttgtg

SEQ ID NO: 187548 - DNA, 18 bp, Mus musculus
agtggtttgaactcagtg

SEQ ID NO: 187549 - DNA, 23 bp, Mus musculus
tctcagactggctcagttctgaa

SEQ ID NO: 187550 - DNA, 23 bp, Mus musculus
actgtaaatccatcagacagagc

SEQ ID NO: 187551 - DNA, 23 bp, Mus musculus
tgtctggctgagtgattacggtg

SEQ ID NO: 187552 - DNA, 23 bp, Mus musculus
agagagagaagagtggcaggagt

SEQ ID NO: 187553 - DNA, 21 bp, Mus musculus
agactggggttgaaataacac

SEQ ID NO: 187554 - DNA, 23 bp, Mus musculus
gagagtcactctccgtctggctg

SEQ ID NO: 187555 - DNA, 23 bp, Mus musculus
tcggatgaagatgtagaactctc

SEQ ID NO: 187556 - DNA, 23 bp, Mus musculus
actctgtgtgcctgtgtgtgtgc

SEQ ID NO: 187557 - DNA, 23 bp, Mus musculus
gaatgtgtatatgtatatgtatg

SEQ ID NO: 187558 - DNA, 20 bp, Mus musculus
gtatgtataagtatgtgtgt

SEQ ID NO: 187559 - DNA, 23 bp, Mus musculus
aaccatggactgcctctcttcat

SEQ ID NO: 187560 - DNA, 23 bp, Mus musculus
atgtgtgtacatgtgcatatgtg

SEQ ID NO: 187561 - DNA, 23 bp, Mus musculus
tgtatgtgcgtgagcatgtgcaa

SEQ ID NO: 187562 - DNA, 23 bp, Mus musculus
actggtgggcctcactgggaagt

SEQ ID NO: 187563 - DNA, 22 bp, Mus musculus
atcagagccagctttgctgtgg

SEQ ID NO: 187564 - DNA, 21 bp, Mus musculus
tgtagacagacctggctggtg

SEQ ID NO: 187565 - DNA, 20 bp, Mus musculus
ctctcaatcactctgggctg

SEQ ID NO: 187566 - DNA, 23 bp, Mus musculus
tatctctctgtgtgtgtcttgct

SEQ ID NO: 187567 - DNA, 22 bp, Mus musculus
tatgtaaggatttgaatactaa

SEQ ID NO: 187568 - DNA, 23 bp, Mus musculus
cttgtctcagcaggtttaagctt

SEQ ID NO: 187569 - DNA, 23 bp, Mus musculus
attccagtggctgtgatcacctg

SEQ ID NO: 187570 - DNA, 18 bp, Mus musculus
tggggaagttagaagtat

SEQ ID NO: 187571 - DNA, 23 bp, Mus musculus
tgtatgtatgtatgtatgtatgt

SEQ ID NO: 187572 - DNA, 19 bp, Mus musculus
tgtctgtctgtcttgctgt

SEQ ID NO: 187573 - DNA, 23 bp, Mus musculus
tcagagcctctgtgtgtgtgctg

SEQ ID NO: 187574 - DNA, 23 bp, Mus musculus
gattatccctctgctccctcact

SEQ ID NO: 187575 - DNA, 23 bp, Mus musculus
tgtgagtctctgattcttgtgcc

SEQ ID NO: 187576 - DNA, 20 bp, Mus musculus
ttctccttctgtttgtttct

SEQ ID NO: 187577 - DNA, 23 bp, Mus musculus
acacaggcagctgacaactgtct

SEQ ID NO: 187578 - DNA, 23 bp, Mus musculus
cagtcgcacagtccctgggtcag

SEQ ID NO: 187579 - DNA, 23 bp, Mus musculus
agaggagagagagctgtgagtgc

SEQ ID NO: 187580 - DNA, 23 bp, Mus musculus
tgatgtcactggaagagctgccc

SEQ ID NO: 187581 - DNA, 23 bp, Mus musculus
gtccagtctctctctgtcagcca

SEQ ID NO: 187582 - DNA, 20 bp, Mus musculus
tagagctggcttttgttttc

SEQ ID NO: 187583 - DNA, 23 bp, Mus musculus
attactacacattgtgtgtgtct

SEQ ID NO: 187584 - DNA, 19 bp, Mus musculus
atcacatttacctaaactg

SEQ ID NO: 187585 - DNA, 23 bp, Mus musculus
ttaacagtgaatgcataggaaaa

SEQ ID NO: 187586 - DNA, 18 bp, Mus musculus
gcaagaggaacagcaact

SEQ ID NO: 187587 - DNA, 20 bp, Mus musculus
cactcattttctctctctct

SEQ ID NO: 187588 - DNA, 23 bp, Mus musculus
gctctgtgcctctcactgactct

SEQ ID NO: 187589 - DNA, 23 bp, Mus musculus
tgtatgtgtatatttatatgtgt

SEQ ID NO: 187590 - DNA, 23 bp, Mus musculus
tgactgctcttccagaggtcctg

SEQ ID NO: 187591 - DNA, 21 bp, Mus musculus
ttagagagatcttggttttca

SEQ ID NO: 187592 - DNA, 22 bp, Mus musculus
tttgcaaggtaaagtgatgatt

SEQ ID NO: 187593 - DNA, 23 bp, Mus musculus
gactcacacagtgtatcagctta

SEQ ID NO: 187594 - DNA, 23 bp, Mus musculus
cttcagtacagagagaggtcaag

SEQ ID NO: 187595 - DNA, 21 bp, Mus musculus
tattcctctaaaggcaggcag

SEQ ID NO: 187596 - DNA, 23 bp, Mus musculus
tgcagtaagaactcagggtgctg

SEQ ID NO: 187597 - DNA, 20 bp, Mus musculus
actgagaagaaactgaggcc

SEQ ID NO: 187598 - DNA, 20 bp, Mus musculus
tgtgtgagggtcaatactgt

SEQ ID NO: 187599 - DNA, 22 bp, Mus musculus
tgttttgtgaccaattatatgg

SEQ ID NO: 187600 - DNA, 23 bp, Mus musculus
tgggctctctctgactctgtggc

SEQ ID NO: 187601 - DNA, 18 bp, Mus musculus
tgagcactgactgctcat

SEQ ID NO: 187602 - DNA, 18 bp, Mus musculus
tggtggtggtggtggtgg

SEQ ID NO: 187603 - DNA, 23 bp, Mus musculus
gttcaattcttagcaaccacatg

SEQ ID NO: 187604 - DNA, 23 bp, Mus musculus
aaaaactcacatctaaagaggtt

SEQ ID NO: 187605 - DNA, 18 bp, Mus musculus
gtatttggttgcaaagta

SEQ ID NO: 187606 - DNA, 19 bp, Mus musculus
actctctctcacaaggtgc

SEQ ID NO: 187607 - DNA, 19 bp, Mus musculus
atctttgctgtcccagaca

SEQ ID NO: 187608 - DNA, 22 bp, Mus musculus
atgtctgagagctcaagtgtca

SEQ ID NO: 187609 - DNA, 23 bp, Mus musculus
actattctctgtctgtgtctcct

SEQ ID NO: 187610 - DNA, 19 bp, Mus musculus
atctttgctgtcccagaca

SEQ ID NO: 187611 - DNA, 22 bp, Mus musculus
atgtctgagagctcaagtgtca

SEQ ID NO: 187612 - DNA, 23 bp, Mus musculus
tagcttgttatgccttgtttggt

SEQ ID NO: 187613 - DNA, 22 bp, Mus musculus
ctgagaagagacagagcagggt

SEQ ID NO: 187614 - DNA, 23 bp, Mus musculus
gcctcctgtacaatccagtttgt

SEQ ID NO: 187615 - DNA, 23 bp, Mus musculus
aggatctgggtcactcactcaga

SEQ ID NO: 187616 - DNA, 22 bp, Mus musculus
tgcatgtatgtatgtatgtatg

SEQ ID NO: 187617 - DNA, 23 bp, Mus musculus
atgtgtgtgtaccctatgtgtgc

SEQ ID NO: 187618 - DNA, 23 bp, Mus musculus
cctgaaattggagttacagaggg

SEQ ID NO: 187619 - DNA, 19 bp, Mus musculus
tttgtgacagttttgctat

SEQ ID NO: 187620 - DNA, 23 bp, Mus musculus
tgtgtgtctgtcttatctgtctg

SEQ ID NO: 187621 - DNA, 20 bp, Mus musculus
tggctcagtggtcaagagca

SEQ ID NO: 187622 - DNA, 23 bp, Mus musculus
agagagatgtgtgtgtacatgtg

SEQ ID NO: 187623 - DNA, 23 bp, Mus musculus
ctaaacccacagagtctctgagt

SEQ ID NO: 187624 - DNA, 23 bp, Mus musculus
taacagtacagtctgtgctgagg

SEQ ID NO: 187625 - DNA, 20 bp, Mus musculus
aactgtacagtctgtgctga

SEQ ID NO: 187626 - DNA, 18 bp, Mus musculus
ttattttcatagctgttt

SEQ ID NO: 187627 - DNA, 23 bp, Mus musculus
actgtctctgcctctgcctctcc

SEQ ID NO: 187628 - DNA, 23 bp, Mus musculus
gtgtgtgtgcgtgtatatgtgtg

SEQ ID NO: 187629 - DNA, 23 bp, Mus musculus
atgtgctgcctggtcttcttgtg

SEQ ID NO: 187630 - DNA, 23 bp, Mus musculus
aactagagcaggggctgtctctg

SEQ ID NO: 187631 - DNA, 23 bp, Mus musculus
tacatgtatgtgtgcacacacgc

SEQ ID NO: 187632 - DNA, 23 bp, Mus musculus
cgagatgtgtgtgcttacactgt

SEQ ID NO: 187633 - DNA, 23 bp, Mus musculus
ggtccagtgtctctctgtctgcc

SEQ ID NO: 187634 - DNA, 23 bp, Mus musculus
gcagagtcagagtacacagaggg

SEQ ID NO: 187635 - DNA, 20 bp, Mus musculus
tctgtggatttccatggctt

SEQ ID NO: 187636 - DNA, 23 bp, Mus musculus
aacagcactgactgctcttccag

SEQ ID NO: 187637 - DNA, 18 bp, Mus musculus
gtgcatgtgtgtgtgtgc

SEQ ID NO: 187638 - DNA, 22 bp, Mus musculus
gtatgtatgtatgtatgtatgt

SEQ ID NO: 187639 - DNA, 22 bp, Mus musculus
gtatgtatttcatgtgcatgtg

SEQ ID NO: 187640 - DNA, 21 bp, Mus musculus
ttttatcagggtttctttagt

SEQ ID NO: 187641 - DNA, 22 bp, Mus musculus
tgttttgtgaccaattatatgg

SEQ ID NO: 187642 - DNA, 22 bp, Mus musculus
tgttttgtgaccaattatatgg

SEQ ID NO: 187643 - DNA, 22 bp, Mus musculus
tctcagagaggtaagctggtac

SEQ ID NO: 187644 - DNA, 23 bp, Mus musculus
tcagatcttctgcagctggagtg

SEQ ID NO: 187645 - DNA, 23 bp, Mus musculus
tttgtgactggaagactagagtc

SEQ ID NO: 187646 - DNA, 23 bp, Mus musculus
tgaaatggacctgagactattca

SEQ ID NO: 187647 - DNA, 23 bp, Mus musculus
taatgtgcatgattatgtgtgtg

SEQ ID NO: 187648 - DNA, 23 bp, Mus musculus
tgtgtgtctatgtgtgtctactt

SEQ ID NO: 187649 - DNA, 22 bp, Mus musculus
tgagcatgtaaatatatatgta

SEQ ID NO: 187650 - DNA, 19 bp, Mus musculus
tatacatacacatacaaat

SEQ ID NO: 187651 - DNA, 22 bp, Mus musculus
tgttttgtgaccaattatatgg

SEQ ID NO: 187652 - DNA, 21 bp, Mus musculus
tcaagtgaccatagctgtgtg

SEQ ID NO: 187653 - DNA, 23 bp, Mus musculus
tattatctgcatgaacacttctt

SEQ ID NO: 187654 - DNA, 23 bp, Mus musculus
ttagttttgtacatcaagtggtc

SEQ ID NO: 187655 - DNA, 22 bp, Mus musculus
tttgaccattccacttgtgtgt

SEQ ID NO: 187656 - DNA, 22 bp, Mus musculus
tgttttgtgaccaattatatgg

SEQ ID NO: 187657 - DNA, 23 bp, Mus musculus
tagtccatggtgatctgatagga

SEQ ID NO: 187658 - DNA, 22 bp, Mus musculus
tgttttgtgaccaattatatgg

SEQ ID NO: 187659 - DNA, 23 bp, Mus musculus
ctgtggaaaacaaatcaaaagtg

SEQ ID NO: 187660 - DNA, 23 bp, Mus musculus
gtcagtgagagcttggttatgta

SEQ ID NO: 187661 - DNA, 23 bp, Mus musculus
agtgtgcatctctctctctctgt

SEQ ID NO: 187662 - DNA, 20 bp, Mus musculus
aggaatgtaaagttgtagac

SEQ ID NO: 187663 - DNA, 23 bp, Mus musculus
tgtgtgtctgtctgtcattcatc

SEQ ID NO: 187664 - DNA, 23 bp, Mus musculus
caagtgactgaagactgtgagct

SEQ ID NO: 187665 - DNA, 22 bp, Mus musculus
tagtccatggtgaactgatagg

SEQ ID NO: 187666 - DNA, 22 bp, Mus musculus
tgttttgtgaccaattatatgg

SEQ ID NO: 187667 - DNA, 22 bp, Mus musculus
agaatgtgtcttgaggctctgt

SEQ ID NO: 187668 - DNA, 22 bp, Mus musculus
tgttttgtgaccaattatatgg

SEQ ID NO: 187669 - DNA, 19 bp, Mus musculus
tgagcaactgtatctgcag

SEQ ID NO: 187670 - DNA, 22 bp, Mus musculus
gtatgtatgtgcctgtgcatgt

SEQ ID NO: 187671 - DNA, 23 bp, Mus musculus
tatactatatatgtatatgtata

SEQ ID NO: 187672 - DNA, 23 bp, Mus musculus
tcttactgtctggtaaagatggg

SEQ ID NO: 187673 - DNA, 22 bp, Mus musculus
aaacttagactagtgtcttcct

SEQ ID NO: 187674 - DNA, 22 bp, Mus musculus
acacacacacacttatggaaca

SEQ ID NO: 187675 - DNA, 22 bp, Mus musculus
ttacaagctcagcttctctata

SEQ ID NO: 187676 - DNA, 23 bp, Mus musculus
cacagagaagagagtcagtgccc

SEQ ID NO: 187677 - DNA, 23 bp, Mus musculus
atacctgtacatatgtatgtgtg

SEQ ID NO: 187678 - DNA, 20 bp, Mus musculus
tctgtatatttatgtatgca

SEQ ID NO: 187679 - DNA, 21 bp, Mus musculus
aagtgtatatttatatgtgta

SEQ ID NO: 187680 - DNA, 21 bp, Mus musculus
atttatgtgtacatgtgcata

SEQ ID NO: 187681 - DNA, 20 bp, Mus musculus
gtatagttaggtgcatgcat

SEQ ID NO: 187682 - DNA, 23 bp, Mus musculus
tgtctgcctgcctgtctgtctgt

SEQ ID NO: 187683 - DNA, 22 bp, Mus musculus
ctgacagggagagatagctcag

SEQ ID NO: 187684 - DNA, 21 bp, Mus musculus
tactgactgctcttccagagg

SEQ ID NO: 187685 - DNA, 22 bp, Mus musculus
tgttttgtgaccaattatatgg

SEQ ID NO: 187686 - DNA, 23 bp, Mus musculus
tagtccatggtgatctgatagga

SEQ ID NO: 187687 - DNA, 23 bp, Mus musculus
ctgtgtcagaggaacttgtttgt

SEQ ID NO: 187688 - DNA, 23 bp, Mus musculus
atgtatgtatatgtatatgtgtg

SEQ ID NO: 187689 - DNA, 22 bp, Mus musculus
catgtgtgtgtatgtgcatgtg

SEQ ID NO: 187690 - DNA, 23 bp, Mus musculus
ccttctctgtcactctcacaggt

SEQ ID NO: 187691 - DNA, 19 bp, Mus musculus
attggtgaataccgtgggt

SEQ ID NO: 187692 - DNA, 23 bp, Mus musculus
ttgctgagcaaactttttgtttt

SEQ ID NO: 187693 - DNA, 23 bp, Mus musculus
ttagctacttttagggctgaaaa

SEQ ID NO: 187694 - DNA, 23 bp, Mus musculus
tagatccgtctcactctctgtct

SEQ ID NO: 187695 - DNA, 19 bp, Mus musculus
tctcctagaactgcagtta

SEQ ID NO: 187696 - DNA, 23 bp, Mus musculus
tctgtctgtctgtctgtctgtct

SEQ ID NO: 187697 - DNA, 23 bp, Mus musculus
tattgaattgtattaggcctcta

SEQ ID NO: 187698 - DNA, 19 bp, Mus musculus
gtctgcctgagtgcccaag

SEQ ID NO: 187699 - DNA, 20 bp, Mus musculus
agtgctttataagctgtctc

SEQ ID NO: 187700 - DNA, 23 bp, Mus musculus
agaatagttgtcgggctggagag

SEQ ID NO: 187701 - DNA, 22 bp, Mus musculus
ctctgtcagcctgagtcagagc

SEQ ID NO: 187702 - DNA, 23 bp, Mus musculus
tggctcagtggttaagagcactg

SEQ ID NO: 187703 - DNA, 23 bp, Mus musculus
gctgactctctccctgcctctgg

SEQ ID NO: 187704 - DNA, 23 bp, Mus musculus
tgcataggtgtgtgtgtgtggtg

SEQ ID NO: 187705 - DNA, 23 bp, Mus musculus
gtctcagtttctctctctctctg

SEQ ID NO: 187706 - DNA, 23 bp, Mus musculus
tccagaggctttcttcagcagca

SEQ ID NO: 187707 - DNA, 20 bp, Mus musculus
cagttgtgtgtgtgtgtcag

SEQ ID NO: 187708 - DNA, 20 bp, Mus musculus
tcagattgtcctacaggcag

SEQ ID NO: 187709 - DNA, 22 bp, Mus musculus
gaaaacaggtagtaggctggtt

SEQ ID NO: 187710 - DNA, 23 bp, Mus musculus
tgtctgtctgtctgtctgtctgt

SEQ ID NO: 187711 - DNA, 23 bp, Mus musculus
ggtgtcacactcactagttgcag

SEQ ID NO: 187712 - DNA, 21 bp, Mus musculus
aggtaaattaacatctgagct

SEQ ID NO: 187713 - DNA, 23 bp, Mus musculus
tgtgaggagtcagtgtctgtgct

SEQ ID NO: 187714 - DNA, 22 bp, Mus musculus
tgttttgtgaccaattatatgg

SEQ ID NO: 187715 - DNA, 20 bp, Mus musculus
ttaagctagtcaaggcatat

SEQ ID NO: 187716 - DNA, 23 bp, Mus musculus
actcactctctgtcagaaactgc

SEQ ID NO: 187717 - DNA, 22 bp, Mus musculus
tatgtatgtatgtgtgtgtgta

SEQ ID NO: 187718 - DNA, 22 bp, Mus musculus
tgttttgtgaccaattatatgg

SEQ ID NO: 187719 - DNA, 23 bp, Mus musculus
aaatgtgtgcttcttgtttctta

SEQ ID NO: 187720 - DNA, 23 bp, Mus musculus
ttgttggtagttaatcatgtgat

SEQ ID NO: 187721 - DNA, 22 bp, Mus musculus
tgtttacatatgtatagatgta

SEQ ID NO: 187722 - DNA, 23 bp, Mus musculus
gtgagtgactgtaagttgagacc

SEQ ID NO: 187723 - DNA, 23 bp, Mus musculus
aggtgggacagtctctgaatggc

SEQ ID NO: 187724 - DNA, 21 bp, Mus musculus
ctctgcttcacactgtgtctc

SEQ ID NO: 187725 - DNA, 22 bp, Mus musculus
tgttttgtgaccaattatatgg

SEQ ID NO: 187726 - DNA, 18 bp, Mus musculus
ttggatagtggagggaaa

SEQ ID NO: 187727 - DNA, 23 bp, Mus musculus
tgctgtctccctcactgtgtctg

SEQ ID NO: 187728 - DNA, 23 bp, Mus musculus
tatatctatatgaatatgtgact

SEQ ID NO: 187729 - DNA, 20 bp, Mus musculus
tatgcttatatatgtttatg

SEQ ID NO: 187730 - DNA, 22 bp, Mus musculus
tgttttgtgaccaattatatgg

SEQ ID NO: 187731 - DNA, 22 bp, Mus musculus
tgttttgtgaccaattatatgg

SEQ ID NO: 187732 - DNA, 23 bp, Mus musculus
gtgtctatgtgcatgtgtatgtg

SEQ ID NO: 187733 - DNA, 23 bp, Mus musculus
tttgtacatatatatgtacatat

SEQ ID NO: 187734 - DNA, 20 bp, Mus musculus
tgtatatatatctcctccct

SEQ ID NO: 187735 - DNA, 23 bp, Mus musculus
ttcaggtagaaagttgttaacat

SEQ ID NO: 187736 - DNA, 23 bp, Mus musculus
tctgatgctttgtctgtgtattg

SEQ ID NO: 187737 - DNA, 23 bp, Mus musculus
ttgacacaagatagagtcatcag

SEQ ID NO: 187738 - DNA, 20 bp, Mus musculus
atatatgcacatatgtatgt

SEQ ID NO: 187739 - DNA, 23 bp, Mus musculus
tatgtatatatttctatgtcaga

SEQ ID NO: 187740 - DNA, 22 bp, Mus musculus
tgttttgtgaccaattatatgg

SEQ ID NO: 187741 - DNA, 23 bp, Mus musculus
ggctgtgagcatctgcatctgca

SEQ ID NO: 187742 - DNA, 19 bp, Mus musculus
tgatgagtgttaagagtag

SEQ ID NO: 187743 - DNA, 23 bp, Mus musculus
tgttttcactgggattgtagctt

SEQ ID NO: 187744 - DNA, 23 bp, Mus musculus
aaagagagtgtgcatctggatgg

SEQ ID NO: 187745 - DNA, 22 bp, Mus musculus
atatatcttggtattcatgttg

SEQ ID NO: 187746 - DNA, 23 bp, Mus musculus
tcctctgttgtgaaggtggttag

SEQ ID NO: 187747 - DNA, 23 bp, Mus musculus
tcacacacagtcacacatatatc

SEQ ID NO: 187748 - DNA, 23 bp, Mus musculus
tttctctctgtctctgggagagt

SEQ ID NO: 187749 - DNA, 18 bp, Mus musculus
tatgcttatgtatgtata

SEQ ID NO: 187750 - DNA, 23 bp, Mus musculus
tgtgtattgtgagcatgattttg

SEQ ID NO: 187751 - DNA, 22 bp, Mus musculus
tgttttgtgaccaattatatgg

SEQ ID NO: 187752 - DNA, 20 bp, Mus musculus
agtatatatatctatatgca

SEQ ID NO: 187753 - DNA, 22 bp, Mus musculus
tatgtgcatacttgtatatgca

SEQ ID NO: 187754 - DNA, 21 bp, Mus musculus
tgaagttctctttctttgttg

SEQ ID NO: 187755 - DNA, 22 bp, Mus musculus
tgttttgtgaccaattatatgg

SEQ ID NO: 187756 - DNA, 22 bp, Mus musculus
tgttttgtgaccaattatatgg

SEQ ID NO: 187757 - DNA, 22 bp, Mus musculus
tgttttgtgaccaattatatgg

SEQ ID NO: 187758 - DNA, 23 bp, Mus musculus
caatatttttgtatctgttgagg

SEQ ID NO: 187759 - DNA, 22 bp, Mus musculus
tgttttgtgaccaattatatgg

SEQ ID NO: 187760 - DNA, 22 bp, Mus musculus
tgttttgtgaccaattatatgg

SEQ ID NO: 187761 - DNA, 22 bp, Mus musculus
tctctgttcactcttcctgttc

SEQ ID NO: 187762 - DNA, 22 bp, Mus musculus
tgttttgtgaccaattatatgg

SEQ ID NO: 187763 - DNA, 23 bp, Mus musculus
atcttattgtgtgcaactcttca

SEQ ID NO: 187764 - DNA, 21 bp, Mus musculus
tagtaggttgtttaataagca

SEQ ID NO: 187765 - DNA, 22 bp, Mus musculus
tgttttgtgaccaattatatgg

SEQ ID NO: 187766 - DNA, 22 bp, Mus musculus
tgttttgtgaccaattatatgg

SEQ ID NO: 187767 - DNA, 19 bp, Mus musculus
tgtgtgtgtgtaatggccc

SEQ ID NO: 187768 - DNA, 18 bp, Mus musculus
actggagagatggctcag

SEQ ID NO: 187769 - DNA, 18 bp, Mus musculus
cagaggtattgagttcta

SEQ ID NO: 187770 - DNA, 20 bp, Mus musculus
aagaggacatgagacatcct

SEQ ID NO: 187771 - DNA, 19 bp, Mus musculus
aaagctacagattacctga

SEQ ID NO: 187772 - DNA, 23 bp, Mus musculus
gaatgtagtgtgtcagcacatct

SEQ ID NO: 187773 - DNA, 23 bp, Mus musculus
atgatgtatgtgtgcacttatca

SEQ ID NO: 187774 - DNA, 21 bp, Mus musculus
atgtatgtatgtatgtatgta

SEQ ID NO: 187775 - DNA, 23 bp, Mus musculus
atatgatgtatatgtatacatgc

SEQ ID NO: 187776 - DNA, 23 bp, Mus musculus
atatgtgtgtacagtgtatgcac

SEQ ID NO: 187777 - DNA, 21 bp, Mus musculus
atgtgtgtatgtatatgtatg

SEQ ID NO: 187778 - DNA, 23 bp, Mus musculus
tcttctgtatttctttaagtgag

SEQ ID NO: 187779 - DNA, 22 bp, Mus musculus
tctatctatctgtcggtctgtc

SEQ ID NO: 187780 - DNA, 23 bp, Mus musculus
actatatgtatatgtatacttac

SEQ ID NO: 187781 - DNA, 20 bp, Mus musculus
taaagtaatgtgagtcttga

SEQ ID NO: 187782 - DNA, 22 bp, Mus musculus
attctgtgggtcatattcttat

SEQ ID NO: 187783 - DNA, 19 bp, Mus musculus
aaacagtgagcacagaggg

SEQ ID NO: 187784 - DNA, 22 bp, Mus musculus
aaatctgctgatgctcacaaac

SEQ ID NO: 187785 - DNA, 22 bp, Mus musculus
tgttttgtgaccaattatatgg

SEQ ID NO: 187786 - DNA, 23 bp, Mus musculus
tagtccatggtgacctgataaga

SEQ ID NO: 187787 - DNA, 23 bp, Mus musculus
ctcactttcactgtgatcctgtg

SEQ ID NO: 187788 - DNA, 23 bp, Mus musculus
tgcttgcttcacatcctcatcag

SEQ ID NO: 187789 - DNA, 21 bp, Mus musculus
tccatggtggtctgataggat

SEQ ID NO: 187790 - DNA, 23 bp, Mus musculus
acagaagagagagagcatacaga

SEQ ID NO: 187791 - DNA, 23 bp, Mus musculus
acacagaggatttgtaaagaatg

SEQ ID NO: 187792 - DNA, 22 bp, Mus musculus
tgttttgtgaccaattatatgg

SEQ ID NO: 187793 - DNA, 22 bp, Mus musculus
tgttttgtgaccaattatatgg

SEQ ID NO: 187794 - DNA, 23 bp, Mus musculus
agccaaactcactctatcactga

SEQ ID NO: 187795 - DNA, 22 bp, Mus musculus
cagtcttaggccatggtggtct

SEQ ID NO: 187796 - DNA, 23 bp, Mus musculus
tgttttgtgaccaactatatggt

SEQ ID NO: 187797 - DNA, 23 bp, Mus musculus
agcttgtttactttagttaaaag

SEQ ID NO: 187798 - DNA, 18 bp, Mus musculus
cagagctgaaggacgagt

SEQ ID NO: 187799 - DNA, 23 bp, Mus musculus
tcctgggagttcgtgcactgtgt

SEQ ID NO: 187800 - DNA, 22 bp, Mus musculus
tctctctctgtcagtctgttct

SEQ ID NO: 187801 - DNA, 19 bp, Mus musculus
tctgacgtagttggaagga

SEQ ID NO: 187802 - DNA, 21 bp, Mus musculus
cagagacaactgagagtccag

SEQ ID NO: 187803 - DNA, 21 bp, Mus musculus
cggggtgagaatggagtgtgt

SEQ ID NO: 187804 - DNA, 23 bp, Mus musculus
tacacacccagcattgaacatgg

SEQ ID NO: 187805 - DNA, 23 bp, Mus musculus
agaaagctgagcaagtcacaggt

SEQ ID NO: 187806 - DNA, 22 bp, Mus musculus
tgttttgtgaccaattatatgg

SEQ ID NO: 187807 - DNA, 23 bp, Mus musculus
tatgtctatatgtgtgtgtgtgt

SEQ ID NO: 187808 - DNA, 23 bp, Mus musculus
caatatttttgtatctgttgagg

SEQ ID NO: 187809 - DNA, 22 bp, Mus musculus
cagtcttaggccatggtggtct

SEQ ID NO: 187810 - DNA, 23 bp, Mus musculus
tgttttgtgaccaattgtatggt

SEQ ID NO: 187811 - DNA, 22 bp, Mus musculus
tgttttgtgaccaattatatgg

SEQ ID NO: 187812 - DNA, 21 bp, Mus musculus
actctaaggaagtgtctgtct

SEQ ID NO: 187813 - DNA, 23 bp, Mus musculus
caccatttatttgcttatgtata

SEQ ID NO: 187814 - DNA, 21 bp, Mus musculus
taagcatcaagatagggaata

SEQ ID NO: 187815 - DNA, 23 bp, Mus musculus
ttgaattttttcagtttctgttg

SEQ ID NO: 187816 - DNA, 18 bp, Mus musculus
aagtatttttttttaact

SEQ ID NO: 187817 - DNA, 22 bp, Mus musculus
tgttttgtgaccaattatatgg

SEQ ID NO: 187818 - DNA, 19 bp, Mus musculus
tttctaaatgtatatgtat

SEQ ID NO: 187819 - DNA, 23 bp, Mus musculus
tgtattctgggtattctgcactt

SEQ ID NO: 187820 - DNA, 22 bp, Mus musculus
tgttttgtgaccaattatatgg

SEQ ID NO: 187821 - DNA, 23 bp, Mus musculus
ttctgacctctgatctgtctctc

SEQ ID NO: 187822 - DNA, 20 bp, Mus musculus
tatgtatatgtacatgtatg

SEQ ID NO: 187823 - DNA, 23 bp, Mus musculus
tcagaggatctactgttgacaca

SEQ ID NO: 187824 - DNA, 22 bp, Mus musculus
tgtgagctcataatgtattgtg

SEQ ID NO: 187825 - DNA, 23 bp, Mus musculus
aacactgcactctgtgtgtgtgt

SEQ ID NO: 187826 - DNA, 20 bp, Mus musculus
tgggtgggtgcgtagcaagt

SEQ ID NO: 187827 - DNA, 22 bp, Mus musculus
tgttttgtgaccaattatatgg

SEQ ID NO: 187828 - DNA, 22 bp, Mus musculus
tgttttgtgaccaattatatgg

SEQ ID NO: 187829 - DNA, 22 bp, Mus musculus
tgttttgtgaccaattatatgg

SEQ ID NO: 187830 - DNA, 19 bp, Mus musculus
agggatcttcatgagaagt

SEQ ID NO: 187831 - DNA, 22 bp, Mus musculus
tgttttgtgaccaattatatgg

SEQ ID NO: 187832 - DNA, 23 bp, Mus musculus
acactcactgactgtgtggtaaa

SEQ ID NO: 187833 - DNA, 18 bp, Mus musculus
tgtatatatgtatgtaag

SEQ ID NO: 187834 - DNA, 18 bp, Mus musculus
tagttgatgttgtggaag

SEQ ID NO: 187835 - DNA, 22 bp, Mus musculus
tgttttgtgaccaattatatgg

SEQ ID NO: 187836 - DNA, 22 bp, Mus musculus
tgttttgtgaccaattatatgg

SEQ ID NO: 187837 - DNA, 23 bp, Mus musculus
tttctgctacttagaatttatgt

SEQ ID NO: 187838 - DNA, 23 bp, Mus musculus
atttagttctagtacttaattct

SEQ ID NO: 187839 - DNA, 21 bp, Mus musculus
tgcagatatagtttgtaatga

SEQ ID NO: 187840 - DNA, 23 bp, Mus musculus
gtgtcattatttctttatgtgtg

SEQ ID NO: 187841 - DNA, 23 bp, Mus musculus
taaacagttgtctgactctagac

SEQ ID NO: 187842 - DNA, 23 bp, Mus musculus
catccaatttcatggagtttttg

SEQ ID NO: 187843 - DNA, 23 bp, Mus musculus
tgtgagcatctgcatctgtattt

SEQ ID NO: 187844 - DNA, 23 bp, Mus musculus
tgtgtcactgtgtgtgtgtgtgc

SEQ ID NO: 187845 - DNA, 22 bp, Mus musculus
tctggaattgttctgattgtga

SEQ ID NO: 187846 - DNA, 22 bp, Mus musculus
tgttttgtgaccaattatatgg

SEQ ID NO: 187847 - DNA, 23 bp, Mus musculus
gagaaatgtgcagcagcagaagt

SEQ ID NO: 187848 - DNA, 21 bp, Mus musculus
aggctctctgcttttccagct

SEQ ID NO: 187849 - DNA, 21 bp, Mus musculus
agacgtcctaagtggctggag

SEQ ID NO: 187850 - DNA, 22 bp, Mus musculus
tgttttgtgaccaattatatgg

SEQ ID NO: 187851 - DNA, 22 bp, Mus musculus
tgttttgtgaccaattatatgg

SEQ ID NO: 187852 - DNA, 19 bp, Mus musculus
atagaatatatgtatatgt

SEQ ID NO: 187853 - DNA, 21 bp, Mus musculus
tagacacattgtatttgtgac

SEQ ID NO: 187854 - DNA, 19 bp, Mus musculus
agctatcctgtttgtatgg

SEQ ID NO: 187855 - DNA, 22 bp, Mus musculus
tgttttgtgaccaattatatgg

SEQ ID NO: 187856 - DNA, 23 bp, Mus musculus
tctgcgtgtgtgtgcgtgtgtat

SEQ ID NO: 187857 - DNA, 21 bp, Mus musculus
gtactgtgcatatatgtgtgt

SEQ ID NO: 187858 - DNA, 23 bp, Mus musculus
tctggctcggtgtcttttctgtg

SEQ ID NO: 187859 - DNA, 20 bp, Mus musculus
agaagaggcttgaaaggacc

SEQ ID NO: 187860 - DNA, 23 bp, Mus musculus
tagtgcatggtgatctgatagga

SEQ ID NO: 187861 - DNA, 22 bp, Mus musculus
tatgtacatctgaaggtaggag

SEQ ID NO: 187862 - DNA, 23 bp, Mus musculus
ttgaatctttcagaaaacacgtg

SEQ ID NO: 187863 - DNA, 23 bp, Mus musculus
aattctatggttttcctgacagg

SEQ ID NO: 187864 - DNA, 22 bp, Mus musculus
tgttttgtgaccaattatatgg

SEQ ID NO: 187865 - DNA, 22 bp, Mus musculus
tgttttgtgaccaattatatgg

SEQ ID NO: 187866 - DNA, 22 bp, Mus musculus
gctgtgtctgtgactgtgtgtg

SEQ ID NO: 187867 - DNA, 23 bp, Mus musculus
tttaagagcctgagaaacagagt

SEQ ID NO: 187868 - DNA, 22 bp, Mus musculus
atatgtgtgtatatgtgtgtgt

SEQ ID NO: 187869 - DNA, 22 bp, Mus musculus
ttaagtgagtagaagataagag

SEQ ID NO: 187870 - DNA, 23 bp, Mus musculus
attatgcagtcttgctggggtca

SEQ ID NO: 187871 - DNA, 22 bp, Mus musculus
accctctgagacaatgatgtat

SEQ ID NO: 187872 - DNA, 23 bp, Mus musculus
tataatagtgtacatgcagaaga

SEQ ID NO: 187873 - DNA, 23 bp, Mus musculus
aatgtgttctctgtgtctgtctc

SEQ ID NO: 187874 - DNA, 22 bp, Mus musculus
gtagagagttaacatgttctcc

SEQ ID NO: 187875 - DNA, 23 bp, Mus musculus
tctgtgtcagtggatctcatgtg

SEQ ID NO: 187876 - DNA, 23 bp, Mus musculus
ctctctcactctctccttgtaac

SEQ ID NO: 187877 - DNA, 23 bp, Mus musculus
ctgtgtctctgtttagtttctgt

SEQ ID NO: 187878 - DNA, 22 bp, Mus musculus
agagttgtcattttcatgctgt

SEQ ID NO: 187879 - DNA, 23 bp, Mus musculus
aagataagtgattatgaagaaca

SEQ ID NO: 187880 - DNA, 18 bp, Mus musculus
tttctctctatgtctcac

SEQ ID NO: 187881 - DNA, 22 bp, Mus musculus
tgttttgtgaccaattatatgg

SEQ ID NO: 187882 - DNA, 23 bp, Mus musculus
aacctcagtgtactcccagtgac

SEQ ID NO: 187883 - DNA, 23 bp, Mus musculus
tgacctaggtggttctattgttc

SEQ ID NO: 187884 - DNA, 19 bp, Mus musculus
agggaggtgttggctttga

SEQ ID NO: 187885 - DNA, 23 bp, Mus musculus
ctctctgtatctgtctgtctgtc

SEQ ID NO: 187886 - DNA, 23 bp, Mus musculus
atcatatgttgatttgtgtcccc

SEQ ID NO: 187887 - DNA, 23 bp, Mus musculus
aactctgtgtggcactctctgtg

SEQ ID NO: 187888 - DNA, 23 bp, Mus musculus
ggtatgtcacaggcatatgtgcc

SEQ ID NO: 187889 - DNA, 23 bp, Mus musculus
ctgtcccagtgtctctctcttcc

SEQ ID NO: 187890 - DNA, 19 bp, Mus musculus
aaagcaaccagagggaggc

SEQ ID NO: 187891 - DNA, 21 bp, Mus musculus
actatgatgtaattggtttgg

SEQ ID NO: 187892 - DNA, 21 bp, Mus musculus
agaaagcttttctttacttaa

SEQ ID NO: 187893 - DNA, 21 bp, Mus musculus
gaagttggttgtaaagttttg

SEQ ID NO: 187894 - DNA, 20 bp, Mus musculus
tgccactgacttacattctt

SEQ ID NO: 187895 - DNA, 23 bp, Mus musculus
acagtctctgtgtgtaactacgg

SEQ ID NO: 187896 - DNA, 23 bp, Mus musculus
agcctgactcactctaagacccc

SEQ ID NO: 187897 - DNA, 22 bp, Mus musculus
tgtctctctctgtctgtctgtc

SEQ ID NO: 187898 - DNA, 18 bp, Mus musculus
tagagccttcagaggaac

SEQ ID NO: 187899 - DNA, 23 bp, Mus musculus
agaagactgtggttgtcaagtct

SEQ ID NO: 187900 - DNA, 18 bp, Mus musculus
atcagaatgatcacaggt

SEQ ID NO: 187901 - DNA, 18 bp, Mus musculus
gtctctgtgttctctggt

SEQ ID NO: 187902 - DNA, 23 bp, Mus musculus
gtgattggttttgtagcagtgac

SEQ ID NO: 187903 - DNA, 21 bp, Mus musculus
tatatgaatatgtatatgtat

SEQ ID NO: 187904 - DNA, 23 bp, Mus musculus
ttaggaatctagtgtggctggag

SEQ ID NO: 187905 - DNA, 19 bp, Mus musculus
ttgacaaaggcagagttga

SEQ ID NO: 187906 - DNA, 23 bp, Mus musculus
ttcttggctgaggctctcatcag

SEQ ID NO: 187907 - DNA, 23 bp, Mus musculus
gagggactgtgtgtctctgtcat

SEQ ID NO: 187908 - DNA, 23 bp, Mus musculus
cttggtttgttgtctgggagctg

SEQ ID NO: 187909 - DNA, 23 bp, Mus musculus
atgctttccagatcatactgtct

SEQ ID NO: 187910 - DNA, 22 bp, Mus musculus
tgttttgtgaccaattatatgg

SEQ ID NO: 187911 - DNA, 20 bp, Mus musculus
agtgcatgagtagctggaga

SEQ ID NO: 187912 - DNA, 23 bp, Mus musculus
tgtcactgtctcagaagggagta

SEQ ID NO: 187913 - DNA, 20 bp, Mus musculus
tttttaagttactaaagtgg

SEQ ID NO: 187914 - DNA, 20 bp, Mus musculus
tgtattcatacacacacaca

SEQ ID NO: 187915 - DNA, 21 bp, Mus musculus
agtgagttcaacttcaagagg

SEQ ID NO: 187916 - DNA, 22 bp, Mus musculus
tcagctactgctccatcacctg

SEQ ID NO: 187917 - DNA, 23 bp, Mus musculus
agactctgactctgcctgcctca

SEQ ID NO: 187918 - DNA, 23 bp, Mus musculus
tctgtctgtctgtccgtttgtga

SEQ ID NO: 187919 - DNA, 19 bp, Mus musculus
ctccctgacactgtcactt

SEQ ID NO: 187920 - DNA, 19 bp, Mus musculus
gcatgtatgtatgtatgta

SEQ ID NO: 187921 - DNA, 20 bp, Mus musculus
acgtatgtatgcatgtatgt

SEQ ID NO: 187922 - DNA, 22 bp, Mus musculus
tgaggtaggaggatgctaagtt

SEQ ID NO: 187923 - DNA, 23 bp, Mus musculus
actgtctctctctggtgttggca

SEQ ID NO: 187924 - DNA, 22 bp, Mus musculus
tgttttgtgaccaattatatgg

SEQ ID NO: 187925 - DNA, 23 bp, Mus musculus
atgtctgtctatatgtatgtgta

SEQ ID NO: 187926 - DNA, 19 bp, Mus musculus
atatctatatatctatatc

SEQ ID NO: 187927 - DNA, 22 bp, Mus musculus
cagggtctctgagtgtctgggg

SEQ ID NO: 187928 - DNA, 23 bp, Mus musculus
gtcagagggtgtttttctacttc

SEQ ID NO: 187929 - DNA, 23 bp, Mus musculus
cttcttttattttgaagtattct

SEQ ID NO: 187930 - DNA, 22 bp, Mus musculus
ttcaatacatgtatttgtgtgc

SEQ ID NO: 187931 - DNA, 22 bp, Mus musculus
tgttttgtgaccaattatatgg

SEQ ID NO: 187932 - DNA, 21 bp, Mus musculus
tataagcactgtcaggtggca

SEQ ID NO: 187933 - DNA, 23 bp, Mus musculus
tgtatgtatgtatgtatgtatgt

SEQ ID NO: 187934 - DNA, 22 bp, Mus musculus
tatatgcatatatatatgtgtg

SEQ ID NO: 187935 - DNA, 20 bp, Mus musculus
tatgtgtatatgtatatgtg

SEQ ID NO: 187936 - DNA, 23 bp, Mus musculus
tatgtgcttcttctatgatgtga

SEQ ID NO: 187937 - DNA, 23 bp, Mus musculus
atagatagatagatagatagata

SEQ ID NO: 187938 - DNA, 21 bp, Mus musculus
tgagatgaaagacaggagagg

SEQ ID NO: 187939 - DNA, 21 bp, Mus musculus
tttgtctatatataattgtct

SEQ ID NO: 187940 - DNA, 23 bp, Mus musculus
tatgtataatttgtctatatgta

SEQ ID NO: 187941 - DNA, 22 bp, Mus musculus
catctctgtgccacagtctatc

SEQ ID NO: 187942 - DNA, 21 bp, Mus musculus
ctctagtaaccttttgttttc

SEQ ID NO: 187943 - DNA, 20 bp, Mus musculus
gcatgtgtccatttgtgtgt

SEQ ID NO: 187944 - DNA, 23 bp, Mus musculus
tgtatgtatgtatgtatgtatgt

SEQ ID NO: 187945 - DNA, 19 bp, Mus musculus
actgtaactgccatgtgta

SEQ ID NO: 187946 - DNA, 23 bp, Mus musculus
aagactgtagacacagtggacaa

SEQ ID NO: 187947 - DNA, 22 bp, Mus musculus
tgttttgtgaccaattatatgg

SEQ ID NO: 187948 - DNA, 23 bp, Mus musculus
agtaattattagcaggaaaaaca

SEQ ID NO: 187949 - DNA, 22 bp, Mus musculus
agctgtggtagaaattagtagt

SEQ ID NO: 187950 - DNA, 22 bp, Mus musculus
tgttttgtgaccaattatatgg

SEQ ID NO: 187951 - DNA, 21 bp, Mus musculus
taagagcactgactgctcttt

SEQ ID NO: 187952 - DNA, 20 bp, Mus musculus
atgtatgtatgcatgtatgt

SEQ ID NO: 187953 - DNA, 23 bp, Mus musculus
tatattgattggataagaactgg

SEQ ID NO: 187954 - DNA, 18 bp, Mus musculus
gactaggaggagttcagg

SEQ ID NO: 187955 - DNA, 22 bp, Mus musculus
tgttttgtgaccaattttatgg

SEQ ID NO: 187956 - DNA, 20 bp, Mus musculus
aacagtttagtttatgtttg

SEQ ID NO: 187957 - DNA, 23 bp, Mus musculus
ttttagtcatttggttcagaaga

SEQ ID NO: 187958 - DNA, 23 bp, Mus musculus
tctgtgcctctgtggctgtgtct

SEQ ID NO: 187959 - DNA, 21 bp, Mus musculus
tgtcacttgtactctaatgct

SEQ ID NO: 187960 - DNA, 23 bp, Mus musculus
ctcagagacaagacagtctgcac

SEQ ID NO: 187961 - DNA, 22 bp, Mus musculus
gttgtctctagagaatctgcac

SEQ ID NO: 187962 - DNA, 23 bp, Mus musculus
tatatctgcatctgcacctgtat

SEQ ID NO: 187963 - DNA, 19 bp, Mus musculus
atgtatgtatgcatgttca

SEQ ID NO: 187964 - DNA, 20 bp, Mus musculus
tcacattcccatatcactgt

SEQ ID NO: 187965 - DNA, 22 bp, Mus musculus
tgctagagagctcaatatgctg

SEQ ID NO: 187966 - DNA, 23 bp, Mus musculus
caatatttttgtatctgttgagg

SEQ ID NO: 187967 - DNA, 23 bp, Mus musculus
ttgtgtccaattatatggtcaat

SEQ ID NO: 187968 - DNA, 20 bp, Mus musculus
agagtgttgttcagtttcca

SEQ ID NO: 187969 - DNA, 22 bp, Mus musculus
tgttttgtgaccaattatatgg

SEQ ID NO: 187970 - DNA, 23 bp, Mus musculus
ctgcctctgtgtgactgaggctg

SEQ ID NO: 187971 - DNA, 23 bp, Mus musculus
acacagccactctctttctactc

SEQ ID NO: 187972 - DNA, 23 bp, Mus musculus
tgtgagaagtgagtcagctgaag

SEQ ID NO: 187973 - DNA, 23 bp, Mus musculus
tgaaggaacacactgagcactcc

SEQ ID NO: 187974 - DNA, 21 bp, Mus musculus
aaatgtattgttgattctgtg

SEQ ID NO: 187975 - DNA, 23 bp, Mus musculus
gagatgtgagagtgtgcacatgc

SEQ ID NO: 187976 - DNA, 21 bp, Mus musculus
tgataggattcatgagacaat

SEQ ID NO: 187977 - DNA, 22 bp, Mus musculus
tgttttgtgaccaattatatgg

SEQ ID NO: 187978 - DNA, 23 bp, Mus musculus
tctgtctgtctgtctgtctgtct

SEQ ID NO: 187979 - DNA, 23 bp, Mus musculus
acaaagctttagaagtcttaagc

SEQ ID NO: 187980 - DNA, 23 bp, Mus musculus
cactgttttctgcaatactttcc

SEQ ID NO: 187981 - DNA, 23 bp, Mus musculus
gtgtctgtgtgtctcaccctgcc

SEQ ID NO: 187982 - DNA, 23 bp, Mus musculus
cagatccaggctgtgtgtcagct

SEQ ID NO: 187983 - DNA, 22 bp, Mus musculus
tgttttgtgaccaattatatgg

SEQ ID NO: 187984 - DNA, 23 bp, Mus musculus
cactcactgtgaagtacactcac

SEQ ID NO: 187985 - DNA, 22 bp, Mus musculus
tctgtgtgtatatatgtgtgta

SEQ ID NO: 187986 - DNA, 22 bp, Mus musculus
atgtgtctgtgtgtgtatttgc

SEQ ID NO: 187987 - DNA, 18 bp, Mus musculus
acacagaaagaaacagtt

SEQ ID NO: 187988 - DNA, 23 bp, Mus musculus
tatgtgagtacactgtcactctc

SEQ ID NO: 187989 - DNA, 23 bp, Mus musculus
attcacccagctctgagtcttct

SEQ ID NO: 187990 - DNA, 23 bp, Mus musculus
tatatatgcatatgtacatgtat

SEQ ID NO: 187991 - DNA, 23 bp, Mus musculus
gtatgtatgtatgtatgtgtgtg

SEQ ID NO: 187992 - DNA, 23 bp, Mus musculus
tatctgcatgtatatgtatatat

SEQ ID NO: 187993 - DNA, 23 bp, Mus musculus
gtatgtgtatgtatatatgtatc

SEQ ID NO: 187994 - DNA, 23 bp, Mus musculus
actgactgactgctcttccagag

SEQ ID NO: 187995 - DNA, 23 bp, Mus musculus
cacagatgagtgtctgctatgga

SEQ ID NO: 187996 - DNA, 23 bp, Mus musculus
acatagagcactgattacagtgg

SEQ ID NO: 187997 - DNA, 23 bp, Mus musculus
tctttctgtgtctggtaagctag

SEQ ID NO: 187998 - DNA, 21 bp, Mus musculus
atgtgtatatgtatgtgtata

SEQ ID NO: 187999 - DNA, 23 bp, Mus musculus
ttcttctgacggtttgtcttgtc

SEQ ID NO: 188000 - DNA, 23 bp, Mus musculus
gtgtgtgtgtgcacgtgcatgtg

SEQ ID NO: 188001 - DNA, 19 bp, Mus musculus
tgtatgtgtgcatgctcat

SEQ ID NO: 188002 - DNA, 22 bp, Mus musculus
agagatcaatgactgctcagat

SEQ ID NO: 188003 - DNA, 23 bp, Mus musculus
ctgaagcagaagtcgtggaggag

SEQ ID NO: 188004 - DNA, 23 bp, Mus musculus
gtatgtatgtatgtatgtaacct

SEQ ID NO: 188005 - DNA, 21 bp, Mus musculus
tgttgcaaatgttgtcagata

SEQ ID NO: 188006 - DNA, 21 bp, Mus musculus
tccatggtggtctgataggat

SEQ ID NO: 188007 - DNA, 22 bp, Mus musculus
tgttttgtgaccaattatatgg

SEQ ID NO: 188008 - DNA, 22 bp, Mus musculus
tgttttgtgaccaattatatgg

SEQ ID NO: 188009 - DNA, 23 bp, Mus musculus
tgtgagtctcactttgtccctca

SEQ ID NO: 188010 - DNA, 23 bp, Mus musculus
ttttagaagcatgagtaaggcta

SEQ ID NO: 188011 - DNA, 23 bp, Mus musculus
tctctctccatatgtgtgtgtgt

SEQ ID NO: 188012 - DNA, 21 bp, Mus musculus
tacctacatctacatatgtac

SEQ ID NO: 188013 - DNA, 18 bp, Mus musculus
tatgtatgtatgtatgtt

SEQ ID NO: 188014 - DNA, 23 bp, Mus musculus
tgtgtgtctgcaacagcatgtgg

SEQ ID NO: 188015 - DNA, 23 bp, Mus musculus
tgcatgtatatacatatgtgtgt

SEQ ID NO: 188016 - DNA, 22 bp, Mus musculus
tgttttgtgaccaattatatgg

SEQ ID NO: 188017 - DNA, 22 bp, Mus musculus
aggtatttatagatgtatagtc

SEQ ID NO: 188018 - DNA, 23 bp, Mus musculus
atgtgtgagtacagagatgagtg

SEQ ID NO: 188019 - DNA, 20 bp, Mus musculus
tttactttgttttagtatgg

SEQ ID NO: 188020 - DNA, 19 bp, Mus musculus
acaggtcctattccttcct

SEQ ID NO: 188021 - DNA, 23 bp, Mus musculus
tatctctcagtctctgtctgacc

SEQ ID NO: 188022 - DNA, 23 bp, Mus musculus
tgaatgatatgatatatatatgt

SEQ ID NO: 188023 - DNA, 22 bp, Mus musculus
tgacacaagagaatcagaaact

SEQ ID NO: 188024 - DNA, 23 bp, Mus musculus
tatctagttcaacacggtgtctt

SEQ ID NO: 188025 - DNA, 23 bp, Mus musculus
agacccacaggctgtattgtctc

SEQ ID NO: 188026 - DNA, 22 bp, Mus musculus
acacacaggctgtattgtctct

SEQ ID NO: 188027 - DNA, 22 bp, Mus musculus
tctctctgtacatatgcctctg

SEQ ID NO: 188028 - DNA, 22 bp, Mus musculus
acacacaggctgtattgtctct

SEQ ID NO: 188029 - DNA, 22 bp, Mus musculus
tctctctgtacatatgcctctg

SEQ ID NO: 188030 - DNA, 21 bp, Mus musculus
aaggtcctgagttataatccc

SEQ ID NO: 188031 - DNA, 23 bp, Mus musculus
atgtatgtatatatgtgtgtgtg

SEQ ID NO: 188032 - DNA, 22 bp, Mus musculus
agtgagaagacacagacctctt

SEQ ID NO: 188033 - DNA, 22 bp, Mus musculus
tctctgtctttgtgtcagtctg

SEQ ID NO: 188034 - DNA, 18 bp, Mus musculus
tgtgtgtgtgtgtgtgta

SEQ ID NO: 188035 - DNA, 23 bp, Mus musculus
tctatgtatgcatgtatgtgtgt

SEQ ID NO: 188036 - DNA, 23 bp, Mus musculus
tctgattgcacatgtatatgcat

SEQ ID NO: 188037 - DNA, 20 bp, Mus musculus
atatatgtacatacacaaac

SEQ ID NO: 188038 - DNA, 23 bp, Mus musculus
gagagatatgtagatagagacga

SEQ ID NO: 188039 - DNA, 21 bp, Mus musculus
tatatctctatatctatatgt

SEQ ID NO: 188040 - DNA, 19 bp, Mus musculus
tgtatgtatgtatatatgt

SEQ ID NO: 188041 - DNA, 23 bp, Mus musculus
aagagagagaacagagtcagggc

SEQ ID NO: 188042 - DNA, 23 bp, Mus musculus
tgtctgagagatcacagggtcca

SEQ ID NO: 188043 - DNA, 23 bp, Mus musculus
attgagactgctgttcttcctac

SEQ ID NO: 188044 - DNA, 23 bp, Mus musculus
tagtgtctccatgctcagtcaga

SEQ ID NO: 188045 - DNA, 23 bp, Mus musculus
tgtgagcatctgcttctgtattg

SEQ ID NO: 188046 - DNA, 20 bp, Mus musculus
agacatatatggcatgtgta

SEQ ID NO: 188047 - DNA, 23 bp, Mus musculus
aatgtatatgtatatgtatatgt

SEQ ID NO: 188048 - DNA, 23 bp, Mus musculus
tatatgtatatgtatatgtgtac

SEQ ID NO: 188049 - DNA, 20 bp, Mus musculus
actgtgtgggcatatcaact

SEQ ID NO: 188050 - DNA, 22 bp, Mus musculus
tgttttgtgaccaattatatgg

SEQ ID NO: 188051 - DNA, 23 bp, Mus musculus
atatgtatgtatatatgtatgta

SEQ ID NO: 188052 - DNA, 23 bp, Mus musculus
tggtttcttgtgtagcagggcga

SEQ ID NO: 188053 - DNA, 18 bp, Mus musculus
atagtgactagaatggtg

SEQ ID NO: 188054 - DNA, 23 bp, Mus musculus
tcactctctgccagtcaggctac

SEQ ID NO: 188055 - DNA, 23 bp, Mus musculus
tgttcatatgaatggctgtcagt

SEQ ID NO: 188056 - DNA, 22 bp, Mus musculus
tgtggaatatattgctatgtgt

SEQ ID NO: 188057 - DNA, 21 bp, Mus musculus
acaaatgcagtgtgtgctgtt

SEQ ID NO: 188058 - DNA, 18 bp, Mus musculus
attggttttcatatgtat

SEQ ID NO: 188059 - DNA, 18 bp, Mus musculus
tgcatgtgagaatttttt

SEQ ID NO: 188060 - DNA, 23 bp, Mus musculus
aactacctcgactgtttacatgc

SEQ ID NO: 188061 - DNA, 23 bp, Mus musculus
atatgcatatgaaaggaaaagaa

SEQ ID NO: 188062 - DNA, 22 bp, Mus musculus
acactcagtcagactctttgcc

SEQ ID NO: 188063 - DNA, 23 bp, Mus musculus
tgtctcactcactctcttgaacc

SEQ ID NO: 188064 - DNA, 18 bp, Mus musculus
acacccacagtgtctgtc

SEQ ID NO: 188065 - DNA, 23 bp, Mus musculus
aacacactctgggtctttttatg

SEQ ID NO: 188066 - DNA, 22 bp, Mus musculus
tgttttgtgaccaattatatgg

SEQ ID NO: 188067 - DNA, 22 bp, Mus musculus
tgtctgtgtgtgtatatctctg

SEQ ID NO: 188068 - DNA, 23 bp, Mus musculus
gtgtttgctgagttcactgtctc

SEQ ID NO: 188069 - DNA, 19 bp, Mus musculus
gatcattgagtagtgagtt

SEQ ID NO: 188070 - DNA, 21 bp, Mus musculus
tccagtttcccagatttccat

SEQ ID NO: 188071 - DNA, 19 bp, Mus musculus
tattttcttaatgtagaag

SEQ ID NO: 188072 - DNA, 23 bp, Mus musculus
tgtgtctctgtttagtttctgct

SEQ ID NO: 188073 - DNA, 21 bp, Mus musculus
atctgtccattgatgagagtg

SEQ ID NO: 188074 - DNA, 20 bp, Mus musculus
aagagcactgactgctcttc

SEQ ID NO: 188075 - DNA, 21 bp, Mus musculus
tctgtgtgtgtgtgtcacttc

SEQ ID NO: 188076 - DNA, 23 bp, Mus musculus
ttttcagtgcttggcttatttca

SEQ ID NO: 188077 - DNA, 20 bp, Mus musculus
ctgacatgagtgagtgcaca

SEQ ID NO: 188078 - DNA, 23 bp, Mus musculus
gagtgacacacacagtctgacca

SEQ ID NO: 188079 - DNA, 22 bp, Mus musculus
gactcactgtcagaatccagga

SEQ ID NO: 188080 - DNA, 22 bp, Mus musculus
ttcatccttatgataacagtgg

SEQ ID NO: 188081 - DNA, 23 bp, Mus musculus
atagacacagcatcaagtctttc

SEQ ID NO: 188082 - DNA, 23 bp, Mus musculus
tggatctctgtgactgtctatta

SEQ ID NO: 188083 - DNA, 23 bp, Mus musculus
tgtgtatatgtatacatgtatgt

SEQ ID NO: 188084 - DNA, 23 bp, Mus musculus
ataaagcatatatgtctgtacat

SEQ ID NO: 188085 - DNA, 22 bp, Mus musculus
tcagtcactctaactgtgacct

SEQ ID NO: 188086 - DNA, 22 bp, Mus musculus
agccagactgcaagtaatgaca

SEQ ID NO: 188087 - DNA, 20 bp, Mus musculus
atatgtatatgaattgtata

SEQ ID NO: 188088 - DNA, 22 bp, Mus musculus
atttgactttatctagttctat

SEQ ID NO: 188089 - DNA, 23 bp, Mus musculus
acaacaggttctctctcagtctc

SEQ ID NO: 188090 - DNA, 18 bp, Mus musculus
tgtgaggcaaagaagaca

SEQ ID NO: 188091 - DNA, 23 bp, Mus musculus
aactgtctcactgtctttgatgt

SEQ ID NO: 188092 - DNA, 23 bp, Mus musculus
ataatgttggatatgtttacata

SEQ ID NO: 188093 - DNA, 22 bp, Mus musculus
tatgaaagaagaatctgagctg

SEQ ID NO: 188094 - DNA, 22 bp, Mus musculus
ttgagagaagatagtgagcaga

SEQ ID NO: 188095 - DNA, 23 bp, Mus musculus
tttgtatgtgtatactcatatgt

SEQ ID NO: 188096 - DNA, 23 bp, Mus musculus
agtagatatgcttatggatctga

SEQ ID NO: 188097 - DNA, 23 bp, Mus musculus
atatgtttatatgtatgtgtgta

SEQ ID NO: 188098 - DNA, 23 bp, Mus musculus
actctatctcatgcaatgagact

SEQ ID NO: 188099 - DNA, 19 bp, Mus musculus
tcgctcagacccttataag

SEQ ID NO: 188100 - DNA, 23 bp, Mus musculus
tggttctgtgtggctgtgttctc

SEQ ID NO: 188101 - DNA, 19 bp, Mus musculus
tgcagatgagatgctctgc

SEQ ID NO: 188102 - DNA, 22 bp, Mus musculus
ctaggcagagagactcactgtc

SEQ ID NO: 188103 - DNA, 23 bp, Mus musculus
tttgagcaactacttagcaaagt

SEQ ID NO: 188104 - DNA, 18 bp, Mus musculus
cagtgcatttttagccta

SEQ ID NO: 188105 - DNA, 18 bp, Mus musculus
tctctttgttgtttactc

SEQ ID NO: 188106 - DNA, 23 bp, Mus musculus
gtctccgtctgtctcccgctgac

SEQ ID NO: 188107 - DNA, 23 bp, Mus musculus
tcacagtacagagtgagcaaggt

SEQ ID NO: 188108 - DNA, 23 bp, Mus musculus
tcagaaaatgataagggctttga

SEQ ID NO: 188109 - DNA, 23 bp, Mus musculus
tgtctgtcactcaccccgtgtct

SEQ ID NO: 188110 - DNA, 21 bp, Mus musculus
tatgtgtatatgtatatgtct

SEQ ID NO: 188111 - DNA, 23 bp, Mus musculus
gtttatcaccttgttcatgtgtg

SEQ ID NO: 188112 - DNA, 23 bp, Mus musculus
ttagggacactctgtccctgtcc

SEQ ID NO: 188113 - DNA, 21 bp, Mus musculus
tatgtatatatgtatgcatgt

SEQ ID NO: 188114 - DNA, 23 bp, Mus musculus
tctgtctctcagtgcttcccagc

SEQ ID NO: 188115 - DNA, 19 bp, Mus musculus
atgtgtgtgtatgtatata

SEQ ID NO: 188116 - DNA, 23 bp, Mus musculus
tgtcattttgttgtattcttcta

SEQ ID NO: 188117 - DNA, 18 bp, Mus musculus
ttcctcatgggctggtgt

SEQ ID NO: 188118 - DNA, 23 bp, Mus musculus
tagagagtagacacagagctcta

SEQ ID NO: 188119 - DNA, 18 bp, Mus musculus
gtgtgtatgtgtgtctgt

SEQ ID NO: 188120 - DNA, 18 bp, Mus musculus
gtggagacactcagcaga

SEQ ID NO: 188121 - DNA, 21 bp, Mus musculus
ttatctctctgtgtctctgac

SEQ ID NO: 188122 - DNA, 22 bp, Mus musculus
agtccgtgctctgtctgtctgt

SEQ ID NO: 188123 - DNA, 23 bp, Mus musculus
atgtaactagatagagagcactt

SEQ ID NO: 188124 - DNA, 22 bp, Mus musculus
attgtccttactttaaaagtct

SEQ ID NO: 188125 - DNA, 20 bp, Mus musculus
atataccatatatatgatat

SEQ ID NO: 188126 - DNA, 23 bp, Mus musculus
cacttcacactggcacatctaag

SEQ ID NO: 188127 - DNA, 20 bp, Mus musculus
ttagtgcatgatcaccatgt

SEQ ID NO: 188128 - DNA, 23 bp, Mus musculus
gttgttagtactgtctctgaaga

SEQ ID NO: 188129 - DNA, 18 bp, Mus musculus
aatctcagggttattttg

SEQ ID NO: 188130 - DNA, 22 bp, Mus musculus
attttgaacatttctttaggtg

SEQ ID NO: 188131 - DNA, 22 bp, Mus musculus
tgtctgtctgtctatctgtctg

SEQ ID NO: 188132 - DNA, 22 bp, Mus musculus
ctgagtcctcattctgtcagtc

SEQ ID NO: 188133 - DNA, 20 bp, Mus musculus
agtatggttgatccaccagt

SEQ ID NO: 188134 - DNA, 18 bp, Mus musculus
gcatatatgtgacaagct

SEQ ID NO: 188135 - DNA, 18 bp, Mus musculus
atcaggctggatatgcat

SEQ ID NO: 188136 - DNA, 20 bp, Mus musculus
aatgtgcaagttttatacat

SEQ ID NO: 188137 - DNA, 23 bp, Mus musculus
aatgtgtgaaaagtgagtgagca

SEQ ID NO: 188138 - DNA, 23 bp, Mus musculus
gcctcactcagtttctctgactg

SEQ ID NO: 188139 - DNA, 23 bp, Mus musculus
gtctcactgagtggcttggaact

SEQ ID NO: 188140 - DNA, 23 bp, Mus musculus
aaagcaatgttgagagctggaga

SEQ ID NO: 188141 - DNA, 23 bp, Mus musculus
tctctctctgtctctcactggga

SEQ ID NO: 188142 - DNA, 18 bp, Mus musculus
tgtgattgtggctgtgat

SEQ ID NO: 188143 - DNA, 23 bp, Mus musculus
tgtggctgtgactgtggctgtga

SEQ ID NO: 188144 - DNA, 22 bp, Mus musculus
ttcacagcaagtcctccagcca

SEQ ID NO: 188145 - DNA, 23 bp, Mus musculus
tgagagaagagacacaggtcctg

SEQ ID NO: 188146 - DNA, 21 bp, Mus musculus
agtcagagtgcagaaacagca

SEQ ID NO: 188147 - DNA, 23 bp, Mus musculus
tctctgtctcactgcgtgtgcat

SEQ ID NO: 188148 - DNA, 21 bp, Mus musculus
acatggtacctgtgtgcatga

SEQ ID NO: 188149 - DNA, 23 bp, Mus musculus
accacagagtcagctaagcagga

SEQ ID NO: 188150 - DNA, 23 bp, Mus musculus
ttctctctgcctcttgctgtgta

SEQ ID NO: 188151 - DNA, 23 bp, Mus musculus
ctctgagtcagtgtctccgtgag

SEQ ID NO: 188152 - DNA, 23 bp, Mus musculus
tgatatgtatagaagtcagctgt

SEQ ID NO: 188153 - DNA, 22 bp, Mus musculus
atgtgcatgtatggtagtgtgt

SEQ ID NO: 188154 - DNA, 23 bp, Mus musculus
acgtatgtatgcatgtatgtatg

SEQ ID NO: 188155 - DNA, 23 bp, Mus musculus
tcactcactttctgtcacctgtt

SEQ ID NO: 188156 - DNA, 22 bp, Mus musculus
gtcagtctgtgtgtgagcctgt

SEQ ID NO: 188157 - DNA, 23 bp, Mus musculus
atctctgcctggatacttgtctg

SEQ ID NO: 188158 - DNA, 19 bp, Mus musculus
cagtgtcttgtgtgagaga

SEQ ID NO: 188159 - DNA, 23 bp, Mus musculus
agagagatatcagtcagcacact

SEQ ID NO: 188160 - DNA, 23 bp, Mus musculus
gtgtctcactgtctgcctggttc

SEQ ID NO: 188161 - DNA, 23 bp, Mus musculus
tgtgtgcttgtgtgtgcatgtgt

SEQ ID NO: 188162 - DNA, 20 bp, Mus musculus
atgtatgtgcacatgtgtgt

SEQ ID NO: 188163 - DNA, 23 bp, Mus musculus
tatgtatgcatgtatgtagtatg

SEQ ID NO: 188164 - DNA, 19 bp, Mus musculus
atatatgtaaatgtatgtg

SEQ ID NO: 188165 - DNA, 23 bp, Mus musculus
ataatcatcatcatcatcagggc

SEQ ID NO: 188166 - DNA, 23 bp, Mus musculus
tgtctgtgtggttgtttagaggc

SEQ ID NO: 188167 - DNA, 23 bp, Mus musculus
gactctgaatccactctctctct

SEQ ID NO: 188168 - DNA, 19 bp, Mus musculus
tcagagaacattctcagca

SEQ ID NO: 188169 - DNA, 23 bp, Mus musculus
cccttactgtctcactctatctg

SEQ ID NO: 188170 - DNA, 23 bp, Mus musculus
tgtctgtgtgtacttgtgctcac

SEQ ID NO: 188171 - DNA, 22 bp, Mus musculus
tcagagcgcattgtgtgtatgt

SEQ ID NO: 188172 - DNA, 21 bp, Mus musculus
atgacagaagaaagtgtgaag

SEQ ID NO: 188173 - DNA, 20 bp, Mus musculus
tgtctgaagagtctgaactc

SEQ ID NO: 188174 - DNA, 20 bp, Mus musculus
agaggtctgggactggagag

SEQ ID NO: 188175 - DNA, 22 bp, Mus musculus
tgttttgtgaccaattatatgg

SEQ ID NO: 188176 - DNA, 23 bp, Mus musculus
agtgtgtagtgtgtgtgcacatg

SEQ ID NO: 188177 - DNA, 19 bp, Mus musculus
catacatacgttttgtgtg

SEQ ID NO: 188178 - DNA, 19 bp, Mus musculus
atgtatgtatgtatgtatg

SEQ ID NO: 188179 - DNA, 23 bp, Mus musculus
gacagtgacactgtgtctcagcc

SEQ ID NO: 188180 - DNA, 19 bp, Mus musculus
acagaacagtctctgcaga

SEQ ID NO: 188181 - DNA, 20 bp, Mus musculus
tgtctgtagagagtagtctc

SEQ ID NO: 188182 - DNA, 23 bp, Mus musculus
atagcagagagactgcacacagc

SEQ ID NO: 188183 - DNA, 20 bp, Mus musculus
ttaatcaagggctggaagag

SEQ ID NO: 188184 - DNA, 21 bp, Mus musculus
tatgtatgtatgtatctctga

SEQ ID NO: 188185 - DNA, 18 bp, Mus musculus
agtgtttgcctagcttgt

SEQ ID NO: 188186 - DNA, 22 bp, Mus musculus
atgtgtatatatatgtatgtgt

SEQ ID NO: 188187 - DNA, 22 bp, Mus musculus
tatgtatgtatgcatgtgtata

SEQ ID NO: 188188 - DNA, 21 bp, Mus musculus
atgtatgtatgcatgtgtata

SEQ ID NO: 188189 - DNA, 23 bp, Mus musculus
atgtatgtgtgtgtatatgtata

SEQ ID NO: 188190 - DNA, 18 bp, Mus musculus
gtatgtatgcatgtgtgt

SEQ ID NO: 188191 - DNA, 20 bp, Mus musculus
tctgtggctctgtgggtctg

SEQ ID NO: 188192 - DNA, 19 bp, Mus musculus
tgagatgaactaagtgaga

SEQ ID NO: 188193 - DNA, 19 bp, Mus musculus
ctagagagacagctcagtg

SEQ ID NO: 188194 - DNA, 21 bp, Mus musculus
aacagtttgatttgtcactgt

SEQ ID NO: 188195 - DNA, 23 bp, Mus musculus
actagaggtatagggtataagca

SEQ ID NO: 188196 - DNA, 23 bp, Mus musculus
gtcttgactctcattcaggtttg

SEQ ID NO: 188197 - DNA, 23 bp, Mus musculus
gcatgtctatggagtatttttct

SEQ ID NO: 188198 - DNA, 23 bp, Mus musculus
catgtgtgcatgtttgtacgtgt

SEQ ID NO: 188199 - DNA, 23 bp, Mus musculus
caggacagcctctgtctgtgact

SEQ ID NO: 188200 - DNA, 23 bp, Mus musculus
tgtgtcagtttgtctgtctgtct

SEQ ID NO: 188201 - DNA, 19 bp, Mus musculus
acatgcacgcatacacact

SEQ ID NO: 188202 - DNA, 23 bp, Mus musculus
atgtatgtatgcatgtatattgg

SEQ ID NO: 188203 - DNA, 21 bp, Mus musculus
aaaagcaggtgctgtttttct

SEQ ID NO: 188204 - DNA, 21 bp, Mus musculus
actctctggggttagcttgca

SEQ ID NO: 188205 - DNA, 20 bp, Mus musculus
tagtgagaagacagagatgt

SEQ ID NO: 188206 - DNA, 21 bp, Mus musculus
tatgtgtatatatgtatatgt

SEQ ID NO: 188207 - DNA, 23 bp, Mus musculus
gttctgactgaccacagagaggt

SEQ ID NO: 188208 - DNA, 23 bp, Mus musculus
agtggtgttcatctacttctggt

SEQ ID NO: 188209 - DNA, 21 bp, Mus musculus
tgctcagagccttttctcttt

SEQ ID NO: 188210 - DNA, 19 bp, Mus musculus
aatgtcagtaaagtcgatg

SEQ ID NO: 188211 - DNA, 23 bp, Mus musculus
cactgtgtgatgtgacagaggag

SEQ ID NO: 188212 - DNA, 23 bp, Mus musculus
tagatggttgtaaactattgtgt

SEQ ID NO: 188213 - DNA, 23 bp, Mus musculus
tgttcattccatatgaattgtaa

SEQ ID NO: 188214 - DNA, 22 bp, Mus musculus
aatgagatgattttgtttggga

SEQ ID NO: 188215 - DNA, 22 bp, Mus musculus
ataaaggaggctatgaagttga

SEQ ID NO: 188216 - DNA, 20 bp, Mus musculus
tagggagtagagggtgggat

SEQ ID NO: 188217 - DNA, 22 bp, Mus musculus
cttaactttctgccctgtaact

SEQ ID NO: 188218 - DNA, 21 bp, Mus musculus
tagagatcatggaaaggtgag

SEQ ID NO: 188219 - DNA, 22 bp, Mus musculus
tttgtgtgtctcacttatttca

SEQ ID NO: 188220 - DNA, 23 bp, Mus musculus
actcactcagactcatttttctg

SEQ ID NO: 188221 - DNA, 23 bp, Mus musculus
tgcagtgagcaaatgaagtcctt

SEQ ID NO: 188222 - DNA, 22 bp, Mus musculus
aaatgtatgcatgtatgtgtgt

SEQ ID NO: 188223 - DNA, 23 bp, Mus musculus
ctgacacacagagagtgctgtat

SEQ ID NO: 188224 - DNA, 19 bp, Mus musculus
tcagtgcagaagttacagg

SEQ ID NO: 188225 - DNA, 23 bp, Mus musculus
tttctgtctctgactttagggtt

SEQ ID NO: 188226 - DNA, 23 bp, Mus musculus
catgtaggaggtcctgggtttga

SEQ ID NO: 188227 - DNA, 23 bp, Mus musculus
gactgaggctctgactgaggctc

SEQ ID NO: 188228 - DNA, 23 bp, Mus musculus
ctgtcagtctcagtccatctgca

SEQ ID NO: 188229 - DNA, 23 bp, Mus musculus
tgcctaggtgagtgcctggctct

SEQ ID NO: 188230 - DNA, 21 bp, Mus musculus
agtgtgaagtagaacccttta

SEQ ID NO: 188231 - DNA, 23 bp, Mus musculus
catgcatgtatgtgtaaatgtga

SEQ ID NO: 188232 - DNA, 22 bp, Mus musculus
gtgtgtgcaaaagcatgtggag

SEQ ID NO: 188233 - DNA, 23 bp, Mus musculus
ataagactggataagtgagagag

SEQ ID NO: 188234 - DNA, 19 bp, Mus musculus
tctcactcagtcatcctcg

SEQ ID NO: 188235 - DNA, 23 bp, Mus musculus
tgttagagcagagtgtgtgcaga

SEQ ID NO: 188236 - DNA, 20 bp, Mus musculus
atgtatatatatgtgtgtgt

SEQ ID NO: 188237 - DNA, 23 bp, Mus musculus
agtctctgtctgtgtttctggct

SEQ ID NO: 188238 - DNA, 22 bp, Mus musculus
tccaggtagtatctcagtctct

SEQ ID NO: 188239 - DNA, 23 bp, Mus musculus
tgtctgtctgtctgtctgtctgt

SEQ ID NO: 188240 - DNA, 22 bp, Mus musculus
gttactctgtctttttctcagt

SEQ ID NO: 188241 - DNA, 23 bp, Mus musculus
tctccctctctcagtgttttctg

SEQ ID NO: 188242 - DNA, 23 bp, Mus musculus
tgtctgtctgactgtctgggtac

SEQ ID NO: 188243 - DNA, 23 bp, Mus musculus
gtctgtctgtctgtctgtctgta

SEQ ID NO: 188244 - DNA, 23 bp, Mus musculus
tagcactacacagtgagctcaag

SEQ ID NO: 188245 - DNA, 23 bp, Mus musculus
gactgtgtgtatgcatgcacatg

SEQ ID NO: 188246 - DNA, 18 bp, Mus musculus
acacatgctcatcctgga

SEQ ID NO: 188247 - DNA, 23 bp, Mus musculus
atgtgtgtatatatacgtgtgtg

SEQ ID NO: 188248 - DNA, 23 bp, Mus musculus
tttccttatctaggtgtttgaca

SEQ ID NO: 188249 - DNA, 22 bp, Mus musculus
agtctctgacaggaatggttat

SEQ ID NO: 188250 - DNA, 21 bp, Mus musculus
tttcagtcagaagggagctgg

SEQ ID NO: 188251 - DNA, 22 bp, Mus musculus
tctgtgacactgagagcctggg

SEQ ID NO: 188252 - DNA, 23 bp, Mus musculus
ttcattgtacaaggaagtgatac

SEQ ID NO: 188253 - DNA, 23 bp, Mus musculus
ctgtctgtctgtctgtctttctc

SEQ ID NO: 188254 - DNA, 23 bp, Mus musculus
ggctctcacagtctgtcatctct

SEQ ID NO: 188255 - DNA, 23 bp, Mus musculus
tgtggagctaaatgtgctgcttg

SEQ ID NO: 188256 - DNA, 18 bp, Mus musculus
gtttgacgttgttatgtg

SEQ ID NO: 188257 - DNA, 19 bp, Mus musculus
aactggagtctggatttgg

SEQ ID NO: 188258 - DNA, 23 bp, Mus musculus
tgagatcagaggccatatgaggc

SEQ ID NO: 188259 - DNA, 23 bp, Mus musculus
ctccctgtctctcaggctgattc

SEQ ID NO: 188260 - DNA, 19 bp, Mus musculus
tactgtgcacagccagggt

SEQ ID NO: 188261 - DNA, 23 bp, Mus musculus
caggacattagtgagtgttcgtg

SEQ ID NO: 188262 - DNA, 18 bp, Mus musculus
atatgtgtgcatattttt

SEQ ID NO: 188263 - DNA, 22 bp, Mus musculus
acaggagcaacaaatgcacttt

SEQ ID NO: 188264 - DNA, 23 bp, Mus musculus
ctgggtgtgtgtgtcacatgttg

SEQ ID NO: 188265 - DNA, 21 bp, Mus musculus
aactggtttttttggtttgtg

SEQ ID NO: 188266 - DNA, 20 bp, Mus musculus
agagcagatgtcaactttgt

SEQ ID NO: 188267 - DNA, 23 bp, Mus musculus
tgaatctcagtttctctatctgc

SEQ ID NO: 188268 - DNA, 19 bp, Mus musculus
aagagaaatagatcagatg

SEQ ID NO: 188269 - DNA, 23 bp, Mus musculus
tctcacagtctttctctgtcaga

SEQ ID NO: 188270 - DNA, 23 bp, Mus musculus
actcactgactccttctccactt

SEQ ID NO: 188271 - DNA, 23 bp, Mus musculus
attctccctcgggttgagggact

SEQ ID NO: 188272 - DNA, 19 bp, Mus musculus
cctgccttctctcctgcta

SEQ ID NO: 188273 - DNA, 20 bp, Mus musculus
tcaggctagcaggacagtct

SEQ ID NO: 188274 - DNA, 23 bp, Mus musculus
ttcaatgtctttgaaaaggttat

SEQ ID NO: 188275 - DNA, 20 bp, Mus musculus
ctgactgctcttccagaggt

SEQ ID NO: 188276 - DNA, 23 bp, Mus musculus
acaaccatctgcaatgggatcag

SEQ ID NO: 188277 - DNA, 23 bp, Mus musculus
ttcaattctcagcaaccacatgg

SEQ ID NO: 188278 - DNA, 23 bp, Mus musculus
taagtgtgcttgagtatatatgt

SEQ ID NO: 188279 - DNA, 22 bp, Mus musculus
atatagcacattcatgcaggag

SEQ ID NO: 188280 - DNA, 23 bp, Mus musculus
ctgtatgtggatgtgcatgtgct

SEQ ID NO: 188281 - DNA, 23 bp, Mus musculus
agacagccaactgtctctgtcac

SEQ ID NO: 188282 - DNA, 23 bp, Mus musculus
ttgacagaagagactgtggaatt

SEQ ID NO: 188283 - DNA, 22 bp, Mus musculus
tgcctgtgcatcaggatgtaaa

SEQ ID NO: 188284 - DNA, 20 bp, Mus musculus
tcactgtactgagtgagctg

SEQ ID NO: 188285 - DNA, 23 bp, Mus musculus
actgtctctgtgtctcttgtgca

SEQ ID NO: 188286 - DNA, 23 bp, Mus musculus
cagtatctccatgtggaactgct

SEQ ID NO: 188287 - DNA, 22 bp, Mus musculus
tgagtggaatgatctttggtgt

SEQ ID NO: 188288 - DNA, 23 bp, Mus musculus
catatcacactcttcttgttctc

SEQ ID NO: 188289 - DNA, 22 bp, Mus musculus
taggtgtcagaactactgtttg

SEQ ID NO: 188290 - DNA, 20 bp, Mus musculus
aatggcagtagcagaatgga

SEQ ID NO: 188291 - DNA, 23 bp, Mus musculus
ctctcactctctcgatgtctgtg

SEQ ID NO: 188292 - DNA, 23 bp, Mus musculus
catcagagtgtcttggctctgtg

SEQ ID NO: 188293 - DNA, 23 bp, Mus musculus
ctaggctgtctgaatcttccttg

SEQ ID NO: 188294 - DNA, 23 bp, Mus musculus
gtctgagtcactggctgagactt

SEQ ID NO: 188295 - DNA, 23 bp, Mus musculus
tgtctctgcctggcaatctagag

SEQ ID NO: 188296 - DNA, 19 bp, Mus musculus
tgactcactgattgtcata

SEQ ID NO: 188297 - DNA, 22 bp, Mus musculus
tatgcatgtatgtatgtatgta

SEQ ID NO: 188298 - DNA, 21 bp, Mus musculus
atgtatgtatgcatgtggatg

SEQ ID NO: 188299 - DNA, 18 bp, Mus musculus
gtgatgaaggctgcatgg

SEQ ID NO: 188300 - DNA, 23 bp, Mus musculus
tgagtccaggcttcagtggcaga

SEQ ID NO: 188301 - DNA, 19 bp, Mus musculus
tatacactcacatatgtgt

SEQ ID NO: 188302 - DNA, 23 bp, Mus musculus
tatatgtgactgtgtgtggtgtg

SEQ ID NO: 188303 - DNA, 22 bp, Mus musculus
ggcagagtactgagcaagttgc

SEQ ID NO: 188304 - DNA, 23 bp, Mus musculus
catacacatctctatctgtctgc

SEQ ID NO: 188305 - DNA, 18 bp, Mus musculus
tgtgtgtggaagggctga

SEQ ID NO: 188306 - DNA, 23 bp, Mus musculus
tttgctcatctctctctctgtgt

SEQ ID NO: 188307 - DNA, 21 bp, Mus musculus
agggtgtgatgtgaagcttgg

SEQ ID NO: 188308 - DNA, 23 bp, Mus musculus
agatgacagccagcttagttggg

SEQ ID NO: 188309 - DNA, 20 bp, Mus musculus
aagagcactgactgctcttc

SEQ ID NO: 188310 - DNA, 22 bp, Mus musculus
actgctggtgtgtatgtggaca

SEQ ID NO: 188311 - DNA, 23 bp, Mus musculus
agagatgttggagacagaacaca

SEQ ID NO: 188312 - DNA, 18 bp, Mus musculus
agtgttgcaagtgtgtga

SEQ ID NO: 188313 - DNA, 23 bp, Mus musculus
atctctctctgcctctgtgagtg

SEQ ID NO: 188314 - DNA, 23 bp, Mus musculus
gtgtatgtatatatgtatgtatg

SEQ ID NO: 188315 - DNA, 21 bp, Mus musculus
atatggatgtgtgtatgtatg

SEQ ID NO: 188316 - DNA, 22 bp, Mus musculus
tgagagttctacatcttgattc

SEQ ID NO: 188317 - DNA, 22 bp, Mus musculus
agacttctgggaagcctctaga

SEQ ID NO: 188318 - DNA, 23 bp, Mus musculus
gcaaccctcagtctctctgcgtc

SEQ ID NO: 188319 - DNA, 22 bp, Mus musculus
taaccagagccatgactcgtgg

SEQ ID NO: 188320 - DNA, 18 bp, Mus musculus
atatgtatgtatgtatgt

SEQ ID NO: 188321 - DNA, 23 bp, Mus musculus
tgtgtgtgtatatgtatgtgtat

SEQ ID NO: 188322 - DNA, 21 bp, Mus musculus
agagcaaagacagtgtccaca

SEQ ID NO: 188323 - DNA, 23 bp, Mus musculus
caccctctgacactgtaggcaag

SEQ ID NO: 188324 - DNA, 23 bp, Mus musculus
agctgcgatctgtctctgtgtct

SEQ ID NO: 188325 - DNA, 23 bp, Mus musculus
gagttggcaagaattgacagaca

SEQ ID NO: 188326 - DNA, 22 bp, Mus musculus
taagctaggaggttgaatagtg

SEQ ID NO: 188327 - DNA, 23 bp, Mus musculus
gtgtgtgactctctgggagtccc

SEQ ID NO: 188328 - DNA, 23 bp, Mus musculus
gtgtatgtgtatatgcatgtgca

SEQ ID NO: 188329 - DNA, 23 bp, Mus musculus
acaggccattctgtcactctgtg

SEQ ID NO: 188330 - DNA, 21 bp, Mus musculus
tgtgagctgggagaatggtgt

SEQ ID NO: 188331 - DNA, 18 bp, Mus musculus
tcgagactgtctgggctg

SEQ ID NO: 188332 - DNA, 18 bp, Mus musculus
tcgagactgtctgggctg

SEQ ID NO: 188333 - DNA, 20 bp, Mus musculus
tgtctgcctgtctgtctgcc

SEQ ID NO: 188334 - DNA, 21 bp, Mus musculus
actcagcattccacttcttcc

SEQ ID NO: 188335 - DNA, 23 bp, Mus musculus
tattgagactactatggactgtg

SEQ ID NO: 188336 - DNA, 21 bp, Mus musculus
atatctatgtgtatatctata

SEQ ID NO: 188337 - DNA, 22 bp, Mus musculus
ccaagcccttctactgagcttg

SEQ ID NO: 188338 - DNA, 20 bp, Mus musculus
gtttcagcaagattagtgaa

SEQ ID NO: 188339 - DNA, 23 bp, Mus musculus
agacactgagatatgcatatgta

SEQ ID NO: 188340 - DNA, 20 bp, Mus musculus
tgagagaagagagtcttctc

SEQ ID NO: 188341 - DNA, 19 bp, Mus musculus
gtgtgtgtgtatgtatata

SEQ ID NO: 188342 - DNA, 22 bp, Mus musculus
agtgtggacattgtcctggaag

SEQ ID NO: 188343 - DNA, 23 bp, Mus musculus
aaatgtggtatttcataagagat

SEQ ID NO: 188344 - DNA, 23 bp, Mus musculus
gagactatcagagatcttttcag

SEQ ID NO: 188345 - DNA, 23 bp, Mus musculus
tgtccctcactcccactcttgaa

SEQ ID NO: 188346 - DNA, 21 bp, Mus musculus
tccatggtggtctgataggat

SEQ ID NO: 188347 - DNA, 22 bp, Mus musculus
tgttttgtgaccaattatatgg

SEQ ID NO: 188348 - DNA, 19 bp, Mus musculus
tctgagttcaattctcagt

SEQ ID NO: 188349 - DNA, 23 bp, Mus musculus
ctgtgatacagtttccatgatgt

SEQ ID NO: 188350 - DNA, 21 bp, Mus musculus
gagcatgtgtgaatctatata

SEQ ID NO: 188351 - DNA, 23 bp, Mus musculus
tgtagcgtatatatatgtgtgtg

SEQ ID NO: 188352 - DNA, 19 bp, Mus musculus
agctattataactagagtt

SEQ ID NO: 188353 - DNA, 22 bp, Mus musculus
tctctagttcattattgctgtt

SEQ ID NO: 188354 - DNA, 22 bp, Mus musculus
tgttttgtgaccaattatatgg

SEQ ID NO: 188355 - DNA, 22 bp, Mus musculus
gtgtgagttagtgtttaccacc

SEQ ID NO: 188356 - DNA, 23 bp, Mus musculus
cagataagtgtgtatatatatgt

SEQ ID NO: 188357 - DNA, 18 bp, Mus musculus
tgacactaaagagtgagc

SEQ ID NO: 188358 - DNA, 21 bp, Mus musculus
tgtgtctggaaacctctctct

SEQ ID NO: 188359 - DNA, 23 bp, Mus musculus
tcactttgcttatctttctgtag

SEQ ID NO: 188360 - DNA, 23 bp, Mus musculus
atcagacttgatggcgtggacat

SEQ ID NO: 188361 - DNA, 23 bp, Mus musculus
tattctcattttgaaaatctgtg

SEQ ID NO: 188362 - DNA, 20 bp, Mus musculus
tgtatgtatgtaattatgta

SEQ ID NO: 188363 - DNA, 23 bp, Mus musculus
atgtatatatgtatatgtgtatg

SEQ ID NO: 188364 - DNA, 22 bp, Mus musculus
ttaatgggattgcataaaatct

SEQ ID NO: 188365 - DNA, 23 bp, Mus musculus
gtgtgtgtgtctgtatgtgtctg

SEQ ID NO: 188366 - DNA, 23 bp, Mus musculus
aatgtactatttgatatgagttt

SEQ ID NO: 188367 - DNA, 23 bp, Mus musculus
ggtatgtatagtatactaggcat

SEQ ID NO: 188368 - DNA, 19 bp, Mus musculus
ttatttgtatacgttcttc

SEQ ID NO: 188369 - DNA, 22 bp, Mus musculus
tttcccgctgaataaggagcta

SEQ ID NO: 188370 - DNA, 23 bp, Mus musculus
tctgagagtactgagttatctca

SEQ ID NO: 188371 - DNA, 23 bp, Mus musculus
tatgtgtgtgtgtgtaatgcatg

SEQ ID NO: 188372 - DNA, 21 bp, Mus musculus
tccatggtggtctgataggat

SEQ ID NO: 188373 - DNA, 23 bp, Mus musculus
atgagcatcagagatctttccat

SEQ ID NO: 188374 - DNA, 23 bp, Mus musculus
tcccactgagtcttgagagtcac

SEQ ID NO: 188375 - DNA, 23 bp, Mus musculus
atgcagttctctctgtgtgtatg

SEQ ID NO: 188376 - DNA, 22 bp, Mus musculus
gtgtctctcactgagcctgtgg

SEQ ID NO: 188377 - DNA, 18 bp, Mus musculus
tgtacattttcctaagca

SEQ ID NO: 188378 - DNA, 23 bp, Mus musculus
atatctatatatctatatgtcta

SEQ ID NO: 188379 - DNA, 23 bp, Mus musculus
actgagtgttcagattgctatgg

SEQ ID NO: 188380 - DNA, 23 bp, Mus musculus
tgtgtggattcatctctgggtat

SEQ ID NO: 188381 - DNA, 19 bp, Mus musculus
cattggtctacttatctgt

SEQ ID NO: 188382 - DNA, 23 bp, Mus musculus
tatctatacacacacacacatgt

SEQ ID NO: 188383 - DNA, 20 bp, Mus musculus
tcaccaagacatatgtatgt

SEQ ID NO: 188384 - DNA, 20 bp, Mus musculus
ggtatgcatgtatgtatgta

SEQ ID NO: 188385 - DNA, 22 bp, Mus musculus
acgtgactacttcctatagcca

SEQ ID NO: 188386 - DNA, 22 bp, Mus musculus
tgttttgtgaccaattatatgg

SEQ ID NO: 188387 - DNA, 23 bp, Mus musculus
tatgtatatatgtatgtatgtgc

SEQ ID NO: 188388 - DNA, 18 bp, Mus musculus
tacagatgtatgaatgca

SEQ ID NO: 188389 - DNA, 23 bp, Mus musculus
tttgtgcgtgtgtatgtgcgtgt

SEQ ID NO: 188390 - DNA, 22 bp, Mus musculus
tgttttgtgaccaattatatgg

SEQ ID NO: 188391 - DNA, 22 bp, Mus musculus
agcgtgaacttgtgcaggtctt

SEQ ID NO: 188392 - DNA, 22 bp, Mus musculus
aatctctgtgagttcatgtgca

SEQ ID NO: 188393 - DNA, 20 bp, Mus musculus
acacagaagacagtcaagac

SEQ ID NO: 188394 - DNA, 22 bp, Mus musculus
tggtaactcacactctgtcatc

SEQ ID NO: 188395 - DNA, 23 bp, Mus musculus
ttgaggctggtactcatgtccat

SEQ ID NO: 188396 - DNA, 23 bp, Mus musculus
tcaaagctttccctgtgtgtgtg

SEQ ID NO: 188397 - DNA, 23 bp, Mus musculus
tgtgaagacttcacacagactca

SEQ ID NO: 188398 - DNA, 23 bp, Mus musculus
tctgtgtacatgtatgtatgtct

SEQ ID NO: 188399 - DNA, 21 bp, Mus musculus
ttatgcttacatgctgtatgt

SEQ ID NO: 188400 - DNA, 23 bp, Mus musculus
gtgtgtgtgtctgtgtctgagca

SEQ ID NO: 188401 - DNA, 23 bp, Mus musculus
gagtgtgcactgtgtgtgtctgt

SEQ ID NO: 188402 - DNA, 23 bp, Mus musculus
tgtcactcacacagcacagcttg

SEQ ID NO: 188403 - DNA, 18 bp, Mus musculus
catacacagtcatgtatt

SEQ ID NO: 188404 - DNA, 23 bp, Mus musculus
catgtctctctgtgtgtatgtac

SEQ ID NO: 188405 - DNA, 20 bp, Mus musculus
agtctcactgagaatatagg

SEQ ID NO: 188406 - DNA, 23 bp, Mus musculus
ctctgtatctcagtgtcattcag

SEQ ID NO: 188407 - DNA, 22 bp, Mus musculus
tgttttgtgaccaattatatgg

SEQ ID NO: 188408 - DNA, 19 bp, Mus musculus
aattaccatggcaaccatt

SEQ ID NO: 188409 - DNA, 23 bp, Mus musculus
ctgagaggctctgtcagtgcctg

SEQ ID NO: 188410 - DNA, 22 bp, Mus musculus
ttacactgaaacctaaggaatt

SEQ ID NO: 188411 - DNA, 22 bp, Mus musculus
tgttttgtgaccaattatatgg

SEQ ID NO: 188412 - DNA, 23 bp, Mus musculus
tagaacgtctgcaacagcatgag

SEQ ID NO: 188413 - DNA, 22 bp, Mus musculus
ttcgtgaaacttgtacacatgt

SEQ ID NO: 188414 - DNA, 21 bp, Mus musculus
gtgtgtacatgtttgtgtgtg

SEQ ID NO: 188415 - DNA, 22 bp, Mus musculus
aaatgatagatttatttgcaat

SEQ ID NO: 188416 - DNA, 20 bp, Mus musculus
tgcctggatccctgaatcac

SEQ ID NO: 188417 - DNA, 21 bp, Mus musculus
atacacacacatatacacaca

SEQ ID NO: 188418 - DNA, 22 bp, Mus musculus
tgttttgtgaccaattatatgg

SEQ ID NO: 188419 - DNA, 23 bp, Mus musculus
aggcagttgaatcaccaaatcct

SEQ ID NO: 188420 - DNA, 21 bp, Mus musculus
tgagcatatatgtacatgtga

SEQ ID NO: 188421 - DNA, 23 bp, Mus musculus
tgtatgtatgtatgtatgtatgt

SEQ ID NO: 188422 - DNA, 23 bp, Mus musculus
tcccattgcaatgttataaatgg

SEQ ID NO: 188423 - DNA, 18 bp, Mus musculus
ttgcaacagtcaatgtat

SEQ ID NO: 188424 - DNA, 21 bp, Mus musculus
atgtatgtatgcatgtgaatg

SEQ ID NO: 188425 - DNA, 23 bp, Mus musculus
gtatgtatgtatgtatgtatgta

SEQ ID NO: 188426 - DNA, 19 bp, Mus musculus
atacatacatatgtgtatg

SEQ ID NO: 188427 - DNA, 22 bp, Mus musculus
tgttttgtgaccaattatatgg

SEQ ID NO: 188428 - DNA, 23 bp, Mus musculus
tgtctgaggaaatggtttgacaa

SEQ ID NO: 188429 - DNA, 22 bp, Mus musculus
tctgtctgtgagatttttttct

SEQ ID NO: 188430 - DNA, 22 bp, Mus musculus
agtgctgacttctgagtgactc

SEQ ID NO: 188431 - DNA, 23 bp, Mus musculus
agcatgtatgtatgtatgtatgt

SEQ ID NO: 188432 - DNA, 23 bp, Mus musculus
tgcatgtatgtatagtgagtgtg

SEQ ID NO: 188433 - DNA, 23 bp, Mus musculus
agaactgactgctcttccagagg

SEQ ID NO: 188434 - DNA, 23 bp, Mus musculus
tatatgtatgtatgcatgtgtgt

SEQ ID NO: 188435 - DNA, 22 bp, Mus musculus
ttgtgcttgatctaaccatgtg

SEQ ID NO: 188436 - DNA, 18 bp, Mus musculus
tacatacacacacatata

SEQ ID NO: 188437 - DNA, 19 bp, Mus musculus
tgagagtttcctgcatttc

SEQ ID NO: 188438 - DNA, 23 bp, Mus musculus
tatgttgtttgtgagaaaacagt

SEQ ID NO: 188439 - DNA, 23 bp, Mus musculus
tgcacccttagactgtaatttga

SEQ ID NO: 188440 - DNA, 23 bp, Mus musculus
atatgtgtatatgtatatgtatg

SEQ ID NO: 188441 - DNA, 23 bp, Mus musculus
tgtatgattcatgttaggagttc

SEQ ID NO: 188442 - DNA, 19 bp, Mus musculus
taactgtggcaataagagg

SEQ ID NO: 188443 - DNA, 23 bp, Mus musculus
agtccatggtgatcagataggat

SEQ ID NO: 188444 - DNA, 22 bp, Mus musculus
atttttgtatctgtggaggcct

SEQ ID NO: 188445 - DNA, 19 bp, Mus musculus
ttttgtgaccaattatatg

SEQ ID NO: 188446 - DNA, 22 bp, Mus musculus
tgttttgtgaccaattatatgg

SEQ ID NO: 188447 - DNA, 22 bp, Mus musculus
accaatgtattgatgtgtgtag

SEQ ID NO: 188448 - DNA, 23 bp, Mus musculus
tggctcagaccagcaggaactca

SEQ ID NO: 188449 - DNA, 18 bp, Mus musculus
cagaagtgcctgaggtct

SEQ ID NO: 188450 - DNA, 23 bp, Mus musculus
tgtagactagcctctgactaaag

SEQ ID NO: 188451 - DNA, 23 bp, Mus musculus
tgtcagtctcttagtctctgtca

SEQ ID NO: 188452 - DNA, 23 bp, Mus musculus
tgtgcatgtgtgtgtgtatgtgt

SEQ ID NO: 188453 - DNA, 23 bp, Mus musculus
gtgtgtgtgtgcatgtgtattgt

SEQ ID NO: 188454 - DNA, 22 bp, Mus musculus
tgttttgtgaccaattatatgg

SEQ ID NO: 188455 - DNA, 22 bp, Mus musculus
tgttttgtgaccaattatatgg

SEQ ID NO: 188456 - DNA, 23 bp, Mus musculus
ataatgtttatgtatgtatgtat

SEQ ID NO: 188457 - DNA, 23 bp, Mus musculus
agactgagaatagagagagagca

SEQ ID NO: 188458 - DNA, 22 bp, Mus musculus
actctgtctcactgttagctct

SEQ ID NO: 188459 - DNA, 21 bp, Mus musculus
atgtgtgtgtgtgtacatgta

SEQ ID NO: 188460 - DNA, 23 bp, Mus musculus
gagtctccatttctattgtagct

SEQ ID NO: 188461 - DNA, 18 bp, Mus musculus
aaaggagtctcaatggag

SEQ ID NO: 188462 - DNA, 20 bp, Mus musculus
aaagcaaaggggctggagag

SEQ ID NO: 188463 - DNA, 23 bp, Mus musculus
acatagggttaacagtgtctctg

SEQ ID NO: 188464 - DNA, 23 bp, Mus musculus
agatttgggttgatgcagtagtg

SEQ ID NO: 188465 - DNA, 20 bp, Mus musculus
tgtgcctcatgtttccacca

SEQ ID NO: 188466 - DNA, 22 bp, Mus musculus
gtgtctgtgtgtgtgcctatgt

SEQ ID NO: 188467 - DNA, 22 bp, Mus musculus
atgttacacattttgtacttgt

SEQ ID NO: 188468 - DNA, 20 bp, Mus musculus
ttgttagaacatggagtttg

SEQ ID NO: 188469 - DNA, 23 bp, Mus musculus
gtgtgtgtgcctcagacacacac

SEQ ID NO: 188470 - DNA, 21 bp, Mus musculus
acagtgtttgtctctggtttc

SEQ ID NO: 188471 - DNA, 23 bp, Mus musculus
catctcacagtctggtatgcagc

SEQ ID NO: 188472 - DNA, 21 bp, Mus musculus
taagagcacagactgctcttc

SEQ ID NO: 188473 - DNA, 19 bp, Mus musculus
aagtcagcatatcctcggt

SEQ ID NO: 188474 - DNA, 21 bp, Mus musculus
taggtgactgacttgagtgtg

SEQ ID NO: 188475 - DNA, 21 bp, Mus musculus
acctccattgattgtggtgag

SEQ ID NO: 188476 - DNA, 23 bp, Mus musculus
ttcctgcctgcctgcctgcctgt

SEQ ID NO: 188477 - DNA, 20 bp, Mus musculus
tggctcagtggttaggagca

SEQ ID NO: 188478 - DNA, 18 bp, Mus musculus
acacatatgtatgtgtgt

SEQ ID NO: 188479 - DNA, 19 bp, Mus musculus
atatatctgtatgtgtata

SEQ ID NO: 188480 - DNA, 23 bp, Mus musculus
tctttgtgtatccctgactatcc

SEQ ID NO: 188481 - DNA, 23 bp, Mus musculus
agggagtgttgtatggtgaaagc

SEQ ID NO: 188482 - DNA, 23 bp, Mus musculus
gtcctctgtgtgtcactgtatcc

SEQ ID NO: 188483 - DNA, 22 bp, Mus musculus
atgggattttgattccactcag

SEQ ID NO: 188484 - DNA, 21 bp, Mus musculus
tgtgtgtatgtatatgtgtat

SEQ ID NO: 188485 - DNA, 18 bp, Mus musculus
atatctgtgcagtgccat

SEQ ID NO: 188486 - DNA, 23 bp, Mus musculus
cttattttcagtggtaacgcttt

SEQ ID NO: 188487 - DNA, 19 bp, Mus musculus
cagaaagtagtagcaaaag

SEQ ID NO: 188488 - DNA, 23 bp, Mus musculus
gtctgatcttttagaggatgtgg

SEQ ID NO: 188489 - DNA, 22 bp, Mus musculus
tctactgccttgaatccacatt

SEQ ID NO: 188490 - DNA, 23 bp, Mus musculus
tctcagtctctgtatgttttatg

SEQ ID NO: 188491 - DNA, 18 bp, Mus musculus
tgtgacctttctacctct

SEQ ID NO: 188492 - DNA, 23 bp, Mus musculus
tagagtactgaaattcatgtggt

SEQ ID NO: 188493 - DNA, 23 bp, Mus musculus
ttggtcttcatgtgtgtccccca

SEQ ID NO: 188494 - DNA, 23 bp, Mus musculus
tgcctctgactcagactctgttc

SEQ ID NO: 188495 - DNA, 23 bp, Mus musculus
actagtattgatagtgataaagg

SEQ ID NO: 188496 - DNA, 22 bp, Mus musculus
atagagctgatggagtctctaa

SEQ ID NO: 188497 - DNA, 23 bp, Mus musculus
aaagcatactgtgctgctactgg

SEQ ID NO: 188498 - DNA, 23 bp, Mus musculus
gtggaactcttagcttattgttt

SEQ ID NO: 188499 - DNA, 23 bp, Mus musculus
acacctaatgcattgatggaaga

SEQ ID NO: 188500 - DNA, 23 bp, Mus musculus
ctcatctatctcctctctcactg

SEQ ID NO: 188501 - DNA, 22 bp, Mus musculus
ctgtgcctctgtgccactgagc

SEQ ID NO: 188502 - DNA, 22 bp, Mus musculus
tatgcatatgtatatgtatatg

SEQ ID NO: 188503 - DNA, 23 bp, Mus musculus
atatgcatatgtatatgtatatg

SEQ ID NO: 188504 - DNA, 21 bp, Mus musculus
agtgtgtgaagttactctgca

SEQ ID NO: 188505 - DNA, 23 bp, Mus musculus
tagcttatgtctttttataggtg

SEQ ID NO: 188506 - DNA, 22 bp, Mus musculus
gagtccattaatattgagagac

SEQ ID NO: 188507 - DNA, 23 bp, Mus musculus
atggcagtgtggtttgctgtttg

SEQ ID NO: 188508 - DNA, 22 bp, Mus musculus
tgttttgtgaccaattatatgg

SEQ ID NO: 188509 - DNA, 22 bp, Mus musculus
tgttttgtgaccaattatatgg

SEQ ID NO: 188510 - DNA, 21 bp, Mus musculus
atgtgtgtgcatatatatatg

SEQ ID NO: 188511 - DNA, 19 bp, Mus musculus
atatgtgtgtatatatatg

SEQ ID NO: 188512 - DNA, 22 bp, Mus musculus
atcattttgatcttcatcttgt

SEQ ID NO: 188513 - DNA, 23 bp, Mus musculus
tagagagactgaagagactacct

SEQ ID NO: 188514 - DNA, 23 bp, Mus musculus
ctatttctgtctggtaaggaagt

SEQ ID NO: 188515 - DNA, 21 bp, Mus musculus
ttattgagggtgacatggggg

SEQ ID NO: 188516 - DNA, 23 bp, Mus musculus
tctcgttcactctgagtgtctca

SEQ ID NO: 188517 - DNA, 18 bp, Mus musculus
tgagcatgtatgtgtata

SEQ ID NO: 188518 - DNA, 22 bp, Mus musculus
tctctggtggtatttgttgtca

SEQ ID NO: 188519 - DNA, 20 bp, Mus musculus
tgtgtgtatgtatatatgta

SEQ ID NO: 188520 - DNA, 23 bp, Mus musculus
tgtgtgtatttatatgtgtatgt

SEQ ID NO: 188521 - DNA, 18 bp, Mus musculus
tgaggaagactatgtttt

SEQ ID NO: 188522 - DNA, 23 bp, Mus musculus
tttatgctggataaagagagata

SEQ ID NO: 188523 - DNA, 23 bp, Mus musculus
tctctatatctatatatgaatat

SEQ ID NO: 188524 - DNA, 19 bp, Mus musculus
catggtggtctgataggat

SEQ ID NO: 188525 - DNA, 23 bp, Mus musculus
acatctgtttttcttattttcaa

SEQ ID NO: 188526 - DNA, 23 bp, Mus musculus
tgtgtgtggatgtccatgtgcat

SEQ ID NO: 188527 - DNA, 23 bp, Mus musculus
gcactgtctctttcacactgtgg

SEQ ID NO: 188528 - DNA, 20 bp, Mus musculus
tttgttgtcgaattgctatg

SEQ ID NO: 188529 - DNA, 18 bp, Mus musculus
tcagtccttcccctaact

SEQ ID NO: 188530 - DNA, 22 bp, Mus musculus
aagaaactgatgtagctttgtg

SEQ ID NO: 188531 - DNA, 18 bp, Mus musculus
gagctctgaattagttct

SEQ ID NO: 188532 - DNA, 20 bp, Mus musculus
tatggttgaaggttctatgg

SEQ ID NO: 188533 - DNA, 22 bp, Mus musculus
tcattcctgcttctggttgtgt

SEQ ID NO: 188534 - DNA, 18 bp, Mus musculus
ttcatcctgtaataaatc

SEQ ID NO: 188535 - DNA, 21 bp, Mus musculus
atcagaccaacctatgctgtt

SEQ ID NO: 188536 - DNA, 21 bp, Mus musculus
atatatgtatgtgtgtgtgtg

SEQ ID NO: 188537 - DNA, 23 bp, Mus musculus
ttctgtcagcctgtgtcagcact

SEQ ID NO: 188538 - DNA, 21 bp, Mus musculus
tctctcactgcaagataaggg

SEQ ID NO: 188539 - DNA, 23 bp, Mus musculus
gcatctgcatttgtatgggtcag

SEQ ID NO: 188540 - DNA, 19 bp, Mus musculus
gtgtggcatatgtatatgt

SEQ ID NO: 188541 - DNA, 23 bp, Mus musculus
ttatgcatgtgtgtatgaatgta

SEQ ID NO: 188542 - DNA, 21 bp, Mus musculus
tatgtgtgtgtatatatatac

SEQ ID NO: 188543 - DNA, 19 bp, Mus musculus
aggggaggatatgtatcct

SEQ ID NO: 188544 - DNA, 23 bp, Mus musculus
atatatgtatgcatatatattcc

SEQ ID NO: 188545 - DNA, 20 bp, Mus musculus
aagagtctgctgacaggagc

SEQ ID NO: 188546 - DNA, 23 bp, Mus musculus
tgcgtggctctgtcagtgcctgg

SEQ ID NO: 188547 - DNA, 23 bp, Mus musculus
tacatgaggttgaaaattttagt

SEQ ID NO: 188548 - DNA, 22 bp, Mus musculus
tgttttgtgaccaattatatgg

SEQ ID NO: 188549 - DNA, 23 bp, Mus musculus
cagactctctgggtccctgtgtc

SEQ ID NO: 188550 - DNA, 20 bp, Mus musculus
ttggtcaggaatagatttaa

SEQ ID NO: 188551 - DNA, 23 bp, Mus musculus
tgctggggttctttaatctgctc

SEQ ID NO: 188552 - DNA, 21 bp, Mus musculus
atgataaataccattagactt

SEQ ID NO: 188553 - DNA, 22 bp, Mus musculus
tatacatacacgttatgtgtgt

SEQ ID NO: 188554 - DNA, 22 bp, Mus musculus
tgttttgtgaccaattatatgg

SEQ ID NO: 188555 - DNA, 23 bp, Mus musculus
tttgtatgtatgtatgagtgtat

SEQ ID NO: 188556 - DNA, 23 bp, Mus musculus
acacacacacatacatatgttag

SEQ ID NO: 188557 - DNA, 23 bp, Mus musculus
gtgtgtgtgagtctctgtgggtg

SEQ ID NO: 188558 - DNA, 23 bp, Mus musculus
aaagaaagagcagtgtgtctctt

SEQ ID NO: 188559 - DNA, 19 bp, Mus musculus
cacttggtagaccaggctg

SEQ ID NO: 188560 - DNA, 20 bp, Mus musculus
ctgtctctgcctccctgcct

SEQ ID NO: 188561 - DNA, 22 bp, Mus musculus
tgttttgtgaccaattatatgg

SEQ ID NO: 188562 - DNA, 22 bp, Mus musculus
tgttttgtgaccaattatatgg

SEQ ID NO: 188563 - DNA, 23 bp, Mus musculus
tctctgctataatgtctgtgtca

SEQ ID NO: 188564 - DNA, 23 bp, Mus musculus
agcctagagacagaaatggaagc

SEQ ID NO: 188565 - DNA, 23 bp, Mus musculus
cttcccactggctctcactgcct

SEQ ID NO: 188566 - DNA, 23 bp, Mus musculus
ctgtttctgtctctgactctctc

SEQ ID NO: 188567 - DNA, 19 bp, Mus musculus
gagagagagagagagagag

SEQ ID NO: 188568 - DNA, 23 bp, Mus musculus
cttcactgtctattcagtacaga

SEQ ID NO: 188569 - DNA, 23 bp, Mus musculus
tgtgagaagacagtgagtgtgca

SEQ ID NO: 188570 - DNA, 22 bp, Mus musculus
actctcacacaacggcagacat

SEQ ID NO: 188571 - DNA, 22 bp, Mus musculus
tatgtgtatgtgtagctagagt

SEQ ID NO: 188572 - DNA, 23 bp, Mus musculus
tatgctctacatacatatatgtg

SEQ ID NO: 188573 - DNA, 21 bp, Mus musculus
atatgtatagtagagatacta

SEQ ID NO: 188574 - DNA, 18 bp, Mus musculus
tagcatctctgtgtattt

SEQ ID NO: 188575 - DNA, 19 bp, Mus musculus
gtatgtatgtatatatgta

SEQ ID NO: 188576 - DNA, 23 bp, Mus musculus
tttggatagagactgtatcttgt

SEQ ID NO: 188577 - DNA, 23 bp, Mus musculus
gttgtggagtagaattcttgaac

SEQ ID NO: 188578 - DNA, 19 bp, Mus musculus
tagatacttttacaaatgc

SEQ ID NO: 188579 - DNA, 20 bp, Mus musculus
cagagcactgactgctcttc

SEQ ID NO: 188580 - DNA, 20 bp, Mus musculus
ccatgtgtcatctgtgtctg

SEQ ID NO: 188581 - DNA, 21 bp, Mus musculus
tactgactgctcttccagagg

SEQ ID NO: 188582 - DNA, 23 bp, Mus musculus
tcacaaccatctgtaatgagatt

SEQ ID NO: 188583 - DNA, 23 bp, Mus musculus
ctctctctgtctttacatcttgt

SEQ ID NO: 188584 - DNA, 23 bp, Mus musculus
catctcaggagcaactttgtcct

SEQ ID NO: 188585 - DNA, 21 bp, Mus musculus
acctaccatatctctatgtgt

SEQ ID NO: 188586 - DNA, 22 bp, Mus musculus
tatggtaggtatatatgcacat

SEQ ID NO: 188587 - DNA, 21 bp, Mus musculus
attgactctcacacactcatg

SEQ ID NO: 188588 - DNA, 23 bp, Mus musculus
atgtaagagtgtgtgatatagga

SEQ ID NO: 188589 - DNA, 23 bp, Mus musculus
actcttctctgtgtgtgtgcctg

SEQ ID NO: 188590 - DNA, 22 bp, Mus musculus
agcaatactgtacttgttggga

SEQ ID NO: 188591 - DNA, 23 bp, Mus musculus
ttgattacataggaattctagga

SEQ ID NO: 188592 - DNA, 18 bp, Mus musculus
atgttttccttgtgatga

SEQ ID NO: 188593 - DNA, 22 bp, Mus musculus
gtaactggttaattttaggtgt

SEQ ID NO: 188594 - DNA, 23 bp, Mus musculus
gagtctgtgactcactggctttt

SEQ ID NO: 188595 - DNA, 22 bp, Mus musculus
ctcacacacacacagtacttga

SEQ ID NO: 188596 - DNA, 20 bp, Mus musculus
tcacagaacagacagcacac

SEQ ID NO: 188597 - DNA, 23 bp, Mus musculus
tttactgagattgttgatgtctg

SEQ ID NO: 188598 - DNA, 23 bp, Mus musculus
tctcatagtcactgactcttctt

SEQ ID NO: 188599 - DNA, 23 bp, Mus musculus
acaacatatctctgggtctgaat

SEQ ID NO: 188600 - DNA, 18 bp, Mus musculus
gctaccctgtgaacttga

SEQ ID NO: 188601 - DNA, 23 bp, Mus musculus
aagagcactgagtgctctttcag

SEQ ID NO: 188602 - DNA, 23 bp, Mus musculus
gagagtttggagggtgacttttg

SEQ ID NO: 188603 - DNA, 22 bp, Mus musculus
ctagactcactttgtagagcag

SEQ ID NO: 188604 - DNA, 20 bp, Mus musculus
ttgaactggggctggagaga

SEQ ID NO: 188605 - DNA, 23 bp, Mus musculus
taagagcactgactgctcttctg

SEQ ID NO: 188606 - DNA, 19 bp, Mus musculus
ttaagagcactgactgctc

SEQ ID NO: 188607 - DNA, 23 bp, Mus musculus
tttaatagctctccatctcttca

SEQ ID NO: 188608 - DNA, 23 bp, Mus musculus
aatgtgactgtactgttgctgtc

SEQ ID NO: 188609 - DNA, 21 bp, Mus musculus
tgtgtgcatgtgcatttgcat

SEQ ID NO: 188610 - DNA, 23 bp, Mus musculus
agagagagcatgtgtgtgtatat

SEQ ID NO: 188611 - DNA, 23 bp, Mus musculus
tgtacacacagtttgtttctctt

SEQ ID NO: 188612 - DNA, 23 bp, Mus musculus
gattgtctgatgagtgtgagaac

SEQ ID NO: 188613 - DNA, 23 bp, Mus musculus
gtctgtctgtctgtctgtctgtg

SEQ ID NO: 188614 - DNA, 23 bp, Mus musculus
ttattctctggaagatttcagtg

SEQ ID NO: 188615 - DNA, 21 bp, Mus musculus
acagggcaagaatctggaggc

SEQ ID NO: 188616 - DNA, 23 bp, Mus musculus
atcagcatgagcatgtgaaagtg

SEQ ID NO: 188617 - DNA, 23 bp, Mus musculus
ttctgagttgttggtgtaacttt

SEQ ID NO: 188618 - DNA, 18 bp, Mus musculus
agtgaaggctgtcctggc

SEQ ID NO: 188619 - DNA, 20 bp, Mus musculus
tcacacagtcactcatcccc

SEQ ID NO: 188620 - DNA, 19 bp, Mus musculus
tgtgtatatatatacagat

SEQ ID NO: 188621 - DNA, 19 bp, Mus musculus
tgtatgcgtgatgtatgtg

SEQ ID NO: 188622 - DNA, 23 bp, Mus musculus
tatgtatgtacatatatgtgtgt

SEQ ID NO: 188623 - DNA, 23 bp, Mus musculus
ttatacattgcataggtgtgtgt

SEQ ID NO: 188624 - DNA, 23 bp, Mus musculus
tatgtgaatgtatgatgtatgtg

SEQ ID NO: 188625 - DNA, 23 bp, Mus musculus
ccaggtccagagtctgtctctct

SEQ ID NO: 188626 - DNA, 21 bp, Mus musculus
tgtgtgagtgcatgtgcatgt

SEQ ID NO: 188627 - DNA, 23 bp, Mus musculus
tcagtagtgactgaggacaaggg

SEQ ID NO: 188628 - DNA, 21 bp, Mus musculus
tgtgtgtgtgtgtgtgtacac

SEQ ID NO: 188629 - DNA, 23 bp, Mus musculus
gtgtctctgaaacagaaattgag

SEQ ID NO: 188630 - DNA, 19 bp, Mus musculus
ctgtagtgtcaattgagat

SEQ ID NO: 188631 - DNA, 23 bp, Mus musculus
ctctctttgtgtgactgtgttac

SEQ ID NO: 188632 - DNA, 19 bp, Mus musculus
gtatgtgtgtgtgtgtgta

SEQ ID NO: 188633 - DNA, 20 bp, Mus musculus
tataccataaatatacacat

SEQ ID NO: 188634 - DNA, 21 bp, Mus musculus
gtatatgcatgtatatacata

SEQ ID NO: 188635 - DNA, 23 bp, Mus musculus
tgtatgtctatatgtatatgaaa

SEQ ID NO: 188636 - DNA, 21 bp, Mus musculus
ttgtatgtatatatgtgtgtg

SEQ ID NO: 188637 - DNA, 22 bp, Mus musculus
tgttttgtgaccaattatatgg

SEQ ID NO: 188638 - DNA, 19 bp, Mus musculus
atgtatatatgtatgtatg

SEQ ID NO: 188639 - DNA, 23 bp, Mus musculus
atgtatctgtatatgaaatactg

SEQ ID NO: 188640 - DNA, 22 bp, Mus musculus
aagaaagagtgtagtacccaat

SEQ ID NO: 188641 - DNA, 22 bp, Mus musculus
tatatacagtgaaggctttgag

SEQ ID NO: 188642 - DNA, 22 bp, Mus musculus
tgttttgtgaccaattatatgg

SEQ ID NO: 188643 - DNA, 21 bp, Mus musculus
acaagagcctgctgaggagat

SEQ ID NO: 188644 - DNA, 23 bp, Mus musculus
cctgtgaggctctgtcagtgtct

SEQ ID NO: 188645 - DNA, 18 bp, Mus musculus
tgtgggactcataacagt

SEQ ID NO: 188646 - DNA, 22 bp, Mus musculus
tgttttgtgaccaattatatgg

SEQ ID NO: 188647 - DNA, 23 bp, Mus musculus
ttatatgtatatatgtatgtgtg

SEQ ID NO: 188648 - DNA, 23 bp, Mus musculus
gaggctctctctgactctgttgc

SEQ ID NO: 188649 - DNA, 22 bp, Mus musculus
tagggtctgggagacttagcaa

SEQ ID NO: 188650 - DNA, 23 bp, Mus musculus
agcagaggctctcagtctctgtc

SEQ ID NO: 188651 - DNA, 22 bp, Mus musculus
tgttttgtgaccaattatatgg

SEQ ID NO: 188652 - DNA, 23 bp, Mus musculus
aacatgcttatatgtgtgcctgt

SEQ ID NO: 188653 - DNA, 22 bp, Mus musculus
tgttttgtgaccaattatatgg

SEQ ID NO: 188654 - DNA, 18 bp, Mus musculus
atttgaaccttggtcttt

SEQ ID NO: 188655 - DNA, 23 bp, Mus musculus
aacagggactgtctctgactctg

SEQ ID NO: 188656 - DNA, 23 bp, Mus musculus
agtttagtgtttttgtagtactc

SEQ ID NO: 188657 - DNA, 20 bp, Mus musculus
aaggctatatttttatttct

SEQ ID NO: 188658 - DNA, 21 bp, Mus musculus
atctatcatagaagtgtgtgc

SEQ ID NO: 188659 - DNA, 22 bp, Mus musculus
agaagtacttggaagtaaagat

SEQ ID NO: 188660 - DNA, 23 bp, Mus musculus
acatgatgaagcttgaatacttg

SEQ ID NO: 188661 - DNA, 23 bp, Mus musculus
aacttgtgttttgtgtatgtgat

SEQ ID NO: 188662 - DNA, 23 bp, Mus musculus
cacacatacatactcacacacat

SEQ ID NO: 188663 - DNA, 23 bp, Mus musculus
atgaatctttttgaattggccag

SEQ ID NO: 188664 - DNA, 19 bp, Mus musculus
ctgagttcaattcccagtg

SEQ ID NO: 188665 - DNA, 23 bp, Mus musculus
gaagcagattcttgatttggaag

SEQ ID NO: 188666 - DNA, 23 bp, Mus musculus
tctcttttgtgtgagggatcatt

SEQ ID NO: 188667 - DNA, 19 bp, Mus musculus
tatatgtgtatatgtatat

SEQ ID NO: 188668 - DNA, 20 bp, Mus musculus
tacagagtaattcacaaggc

SEQ ID NO: 188669 - DNA, 20 bp, Mus musculus
tgcatgaatctatatatgaa

SEQ ID NO: 188670 - DNA, 23 bp, Mus musculus
tctgtctgtctatctccatgtga

SEQ ID NO: 188671 - DNA, 23 bp, Mus musculus
gcactgactgctcttccagaggt

SEQ ID NO: 188672 - DNA, 20 bp, Mus musculus
acagccgctgactatgattt

SEQ ID NO: 188673 - DNA, 23 bp, Mus musculus
tgtctgtctgcctgtctgtctgt

SEQ ID NO: 188674 - DNA, 23 bp, Mus musculus
agctcagagacctgagtgtgtgc

SEQ ID NO: 188675 - DNA, 23 bp, Mus musculus
gtctcactatgtcactctcgttg

SEQ ID NO: 188676 - DNA, 23 bp, Mus musculus
agaatgtgcaagtatatatgtga

SEQ ID NO: 188677 - DNA, 23 bp, Mus musculus
ttttctacagttcaaagtggagg

SEQ ID NO: 188678 - DNA, 22 bp, Mus musculus
ctgtgtggtttttgtttccagc

SEQ ID NO: 188679 - DNA, 18 bp, Mus musculus
tatgtatatatgtataga

SEQ ID NO: 188680 - DNA, 22 bp, Mus musculus
ctcacagctaaacaagtgattg

SEQ ID NO: 188681 - DNA, 23 bp, Mus musculus
tgagaggtagttgattctttaga

SEQ ID NO: 188682 - DNA, 23 bp, Mus musculus
atgtatgtacccatgtgtgtgtg

SEQ ID NO: 188683 - DNA, 23 bp, Mus musculus
tatgtgtctgtattcgcatgtgt

SEQ ID NO: 188684 - DNA, 22 bp, Mus musculus
aaacaccaagtgcatctcatgc

SEQ ID NO: 188685 - DNA, 23 bp, Mus musculus
tgtatatctatatgtatatctat

SEQ ID NO: 188686 - DNA, 23 bp, Mus musculus
cttgtactgattttctaaatctg

SEQ ID NO: 188687 - DNA, 23 bp, Mus musculus
taggaattctctctctctcaatg

SEQ ID NO: 188688 - DNA, 23 bp, Mus musculus
tgagtagattatattagctcttt

SEQ ID NO: 188689 - DNA, 23 bp, Mus musculus
acagtgtgtggctggctgtgttc

SEQ ID NO: 188690 - DNA, 19 bp, Mus musculus
agtgtatttgtatgtgtgt

SEQ ID NO: 188691 - DNA, 22 bp, Mus musculus
atgtgtacatatgtgtgtgtgc

SEQ ID NO: 188692 - DNA, 21 bp, Mus musculus
atatgtattatatacatgtgt

SEQ ID NO: 188693 - DNA, 20 bp, Mus musculus
tgacacagtcattcactctc

SEQ ID NO: 188694 - DNA, 23 bp, Mus musculus
tttgagacagtgtctcactctgt

SEQ ID NO: 188695 - DNA, 23 bp, Mus musculus
ttttgagacagtgtctcactctg

SEQ ID NO: 188696 - DNA, 20 bp, Mus musculus
gagagtagagaaagtggaca

SEQ ID NO: 188697 - DNA, 23 bp, Mus musculus
acaggctctctctatgtagttct

SEQ ID NO: 188698 - DNA, 20 bp, Mus musculus
aagacagccagagctgtccc

SEQ ID NO: 188699 - DNA, 18 bp, Mus musculus
aaataagatgcaaatgtc

SEQ ID NO: 188700 - DNA, 23 bp, Mus musculus
agatctggccattgtttatgtct

SEQ ID NO: 188701 - DNA, 23 bp, Mus musculus
gtctgcctctctgtctttgctgc

SEQ ID NO: 188702 - DNA, 23 bp, Mus musculus
tctgtctctctgtctgtctgtct

SEQ ID NO: 188703 - DNA, 23 bp, Mus musculus
atgtgtatatgtatatgtatatg

SEQ ID NO: 188704 - DNA, 19 bp, Mus musculus
tgagttcaaattaatttgg

SEQ ID NO: 188705 - DNA, 21 bp, Mus musculus
gaacacacacgatgagcacgg

SEQ ID NO: 188706 - DNA, 23 bp, Mus musculus
ctgtctgtctgtctgtctgtctg

SEQ ID NO: 188707 - DNA, 19 bp, Mus musculus
tgcaggcatcagagaagga

SEQ ID NO: 188708 - DNA, 22 bp, Mus musculus
atacacacatgtatatatgtat

SEQ ID NO: 188709 - DNA, 23 bp, Mus musculus
cacctgtatatatgtatgtgtat

SEQ ID NO: 188710 - DNA, 23 bp, Mus musculus
tgtgtcactggggttgggctttg

SEQ ID NO: 188711 - DNA, 23 bp, Mus musculus
cagccagactctgtgtctctctc

SEQ ID NO: 188712 - DNA, 18 bp, Mus musculus
gtctctgtgtgtgagagc

SEQ ID NO: 188713 - DNA, 23 bp, Mus musculus
cctgtctgtctcactctctaaga

SEQ ID NO: 188714 - DNA, 23 bp, Mus musculus
tgcctgcctggctgtttcagtct

SEQ ID NO: 188715 - DNA, 23 bp, Mus musculus
tgtatgtgtatatgtgtatgtaa

SEQ ID NO: 188716 - DNA, 20 bp, Mus musculus
tacatgtatgtatatatgta

SEQ ID NO: 188717 - DNA, 18 bp, Mus musculus
atatgtgtatatgtatat

SEQ ID NO: 188718 - DNA, 23 bp, Mus musculus
gagagtctgtctgtctgcctgcc

SEQ ID NO: 188719 - DNA, 23 bp, Mus musculus
tgtctgtctctctgtgtgtccct

SEQ ID NO: 188720 - DNA, 23 bp, Mus musculus
tgtctgtccaactctctgtctct

SEQ ID NO: 188721 - DNA, 21 bp, Mus musculus
aaggaagtacaatcagccaag

SEQ ID NO: 188722 - DNA, 23 bp, Mus musculus
tctctgcctgacacatttagttc

SEQ ID NO: 188723 - DNA, 23 bp, Mus musculus
aattgtgctggaaagagagagtg

SEQ ID NO: 188724 - DNA, 23 bp, Mus musculus
atgtatgtatatgtatatatgta

SEQ ID NO: 188725 - DNA, 22 bp, Mus musculus
tgttttgtgaccaattatatgg

SEQ ID NO: 188726 - DNA, 20 bp, Mus musculus
aatgtgcatccagtaagtct

SEQ ID NO: 188727 - DNA, 22 bp, Mus musculus
tgttttgtgaccaattatatgg

SEQ ID NO: 188728 - DNA, 23 bp, Mus musculus
gtctctggatggtcattccttca

SEQ ID NO: 188729 - DNA, 20 bp, Mus musculus
acacacactcacttccttca

SEQ ID NO: 188730 - DNA, 23 bp, Mus musculus
agctgaaggaagtgaatggttaa

SEQ ID NO: 188731 - DNA, 23 bp, Mus musculus
tctgtcaagttgtactgtattat

SEQ ID NO: 188732 - DNA, 23 bp, Mus musculus
tactgtgtgcttatgatttcagt

SEQ ID NO: 188733 - DNA, 23 bp, Mus musculus
tgatgatttaggatgttgaatgt

SEQ ID NO: 188734 - DNA, 18 bp, Mus musculus
ttgtgatactcgttgtgt

SEQ ID NO: 188735 - DNA, 23 bp, Mus musculus
gtgtgtgtgtgtgtatatgtata

SEQ ID NO: 188736 - DNA, 21 bp, Mus musculus
atatcacttagagaaacgaca

SEQ ID NO: 188737 - DNA, 19 bp, Mus musculus
tgtggctcactctatgtgt

SEQ ID NO: 188738 - DNA, 23 bp, Mus musculus
gactgatcacagtgagtgtgctt

SEQ ID NO: 188739 - DNA, 23 bp, Mus musculus
gtcacactgggactgtgtgtcag

SEQ ID NO: 188740 - DNA, 20 bp, Mus musculus
cacagatgatacagaggagt

SEQ ID NO: 188741 - DNA, 23 bp, Mus musculus
ttcttgaagatagtgcttttctt

SEQ ID NO: 188742 - DNA, 21 bp, Mus musculus
tcaggaaatgtaacctttaga

SEQ ID NO: 188743 - DNA, 23 bp, Mus musculus
aatacctagagatttacatgata

SEQ ID NO: 188744 - DNA, 22 bp, Mus musculus
tgttttgtgaccaattatatgg

SEQ ID NO: 188745 - DNA, 18 bp, Mus musculus
aatggatggaataagtac

SEQ ID NO: 188746 - DNA, 23 bp, Mus musculus
tcagagtagtgtgtgtgttcatg

SEQ ID NO: 188747 - DNA, 23 bp, Mus musculus
tctgtaaatgtgacgttttcatt

SEQ ID NO: 188748 - DNA, 23 bp, Mus musculus
aagatctcgataacagttctttg

SEQ ID NO: 188749 - DNA, 20 bp, Mus musculus
gttaggttatagaggatata

SEQ ID NO: 188750 - DNA, 22 bp, Mus musculus
tgttttgtgaccaattatatgg

SEQ ID NO: 188751 - DNA, 23 bp, Mus musculus
tcagggggaatttcttttctggt

SEQ ID NO: 188752 - DNA, 19 bp, Mus musculus
catggtggtctgataggat

SEQ ID NO: 188753 - DNA, 23 bp, Mus musculus
tggagagaattgatggagacaag

SEQ ID NO: 188754 - DNA, 22 bp, Mus musculus
tgttttgtgaccaattatatgg

SEQ ID NO: 188755 - DNA, 21 bp, Mus musculus
tgcacacatgagtgtgtgcac

SEQ ID NO: 188756 - DNA, 23 bp, Mus musculus
atgatgtggtaggttgtttagat

SEQ ID NO: 188757 - DNA, 23 bp, Mus musculus
gtgtatgtgtgtcgtaatgttat

SEQ ID NO: 188758 - DNA, 23 bp, Mus musculus
tatgcaacagaatgatttgacat

SEQ ID NO: 188759 - DNA, 23 bp, Mus musculus
gtttttaaggagcattgctaaaa

SEQ ID NO: 188760 - DNA, 19 bp, Mus musculus
gcatcactgtaatagatga

SEQ ID NO: 188761 - DNA, 23 bp, Mus musculus
aaataatcagtgtatacacatta

SEQ ID NO: 188762 - DNA, 23 bp, Mus musculus
tgtaagtgtagttggttatgtgt

SEQ ID NO: 188763 - DNA, 22 bp, Mus musculus
actcagtgcttatgaattgtat

SEQ ID NO: 188764 - DNA, 22 bp, Mus musculus
tgttttgtgaccaattatatgg

SEQ ID NO: 188765 - DNA, 20 bp, Mus musculus
tgtgctggaaaagcattgga

SEQ ID NO: 188766 - DNA, 19 bp, Mus musculus
tgagctagattggctgtct

SEQ ID NO: 188767 - DNA, 22 bp, Mus musculus
tgttttgtgaccaattatatgg

SEQ ID NO: 188768 - DNA, 23 bp, Mus musculus
gagaggctctgtcagtgcctgac

SEQ ID NO: 188769 - DNA, 18 bp, Mus musculus
tgtggtattccattgagg

SEQ ID NO: 188770 - DNA, 23 bp, Mus musculus
tctgtgacactctgtatttgatc

SEQ ID NO: 188771 - DNA, 23 bp, Mus musculus
agtttttgtgctagtttaatgca

SEQ ID NO: 188772 - DNA, 19 bp, Mus musculus
tatgtctgtgtactctgtg

SEQ ID NO: 188773 - DNA, 21 bp, Mus musculus
tgatatgtaaagaagttttta

SEQ ID NO: 188774 - DNA, 21 bp, Mus musculus
ttttttcatttccatatgaag

SEQ ID NO: 188775 - DNA, 22 bp, Mus musculus
tttgaacatttctttgggtgct

SEQ ID NO: 188776 - DNA, 23 bp, Mus musculus
tctgttctgaattcttggtttag

SEQ ID NO: 188777 - DNA, 22 bp, Mus musculus
tatgaacaacagaaatgtgtgt

SEQ ID NO: 188778 - DNA, 23 bp, Mus musculus
tatgtatgtatgtatgtatatgt

SEQ ID NO: 188779 - DNA, 23 bp, Mus musculus
actatctcaatatgattaagagt

SEQ ID NO: 188780 - DNA, 23 bp, Mus musculus
ttctcactctctgtctgatgtta

SEQ ID NO: 188781 - DNA, 23 bp, Mus musculus
atgtatgtatatgtgtatgtata

SEQ ID NO: 188782 - DNA, 23 bp, Mus musculus
tatcttagcaactgtgaataaat

SEQ ID NO: 188783 - DNA, 20 bp, Mus musculus
aactgtgtacaggacaaaga

SEQ ID NO: 188784 - DNA, 23 bp, Mus musculus
gtgtatgtgtgtatatgtatata

SEQ ID NO: 188785 - DNA, 22 bp, Mus musculus
tagtctttatatataattgtca

SEQ ID NO: 188786 - DNA, 23 bp, Mus musculus
atgtgtgtgtgcatgttcatgtg

SEQ ID NO: 188787 - DNA, 23 bp, Mus musculus
acaggttgatgtgtgcatgcttg

SEQ ID NO: 188788 - DNA, 18 bp, Mus musculus
tgcataagtatacatgta

SEQ ID NO: 188789 - DNA, 22 bp, Mus musculus
tatatacatatgtatacatgta

SEQ ID NO: 188790 - DNA, 23 bp, Mus musculus
gtatgtatatatgtgtgtgtata

SEQ ID NO: 188791 - DNA, 22 bp, Mus musculus
taaagcatgttaaggaaatttt

SEQ ID NO: 188792 - DNA, 23 bp, Mus musculus
tttgcttgattactttagtttca

SEQ ID NO: 188793 - DNA, 23 bp, Mus musculus
cgctcgctcgctcgctcgctcgc

SEQ ID NO: 188794 - DNA, 22 bp, Mus musculus
tgttttgtgaccaattatatgg

SEQ ID NO: 188795 - DNA, 21 bp, Mus musculus
atgtgtgtatatgtatatatc

SEQ ID NO: 188796 - DNA, 18 bp, Mus musculus
taagtatatatgtgtgtg

SEQ ID NO: 188797 - DNA, 23 bp, Mus musculus
actatctggtaacccaattaagc

SEQ ID NO: 188798 - DNA, 22 bp, Mus musculus
tgaaaaatgatttggctgggtg

SEQ ID NO: 188799 - DNA, 22 bp, Mus musculus
taacaggttttctgtctcagat

SEQ ID NO: 188800 - DNA, 20 bp, Mus musculus
tgactcaatggtaactgtga

SEQ ID NO: 188801 - DNA, 22 bp, Mus musculus
atatatgtatgtgtatatgtgt

SEQ ID NO: 188802 - DNA, 21 bp, Mus musculus
tgtgtatatatatatatgtgt

SEQ ID NO: 188803 - DNA, 23 bp, Mus musculus
ctggtctttctgtctctgactgt

SEQ ID NO: 188804 - DNA, 21 bp, Mus musculus
tgtcagtactcagagaccagt

SEQ ID NO: 188805 - DNA, 21 bp, Mus musculus
tccgtagtgatctgataggat

SEQ ID NO: 188806 - DNA, 23 bp, Mus musculus
cactgtgtctctgtttagcttct

SEQ ID NO: 188807 - DNA, 21 bp, Mus musculus
atctgtccattgatgagagtg

SEQ ID NO: 188808 - DNA, 23 bp, Mus musculus
cattattcatatagttctagctt

SEQ ID NO: 188809 - DNA, 20 bp, Mus musculus
atatatgtatggttatgtgt

SEQ ID NO: 188810 - DNA, 19 bp, Mus musculus
aagtacaggggctggagag

SEQ ID NO: 188811 - DNA, 18 bp, Mus musculus
agtgctgcccctcctcag

SEQ ID NO: 188812 - DNA, 21 bp, Mus musculus
tgaggtttttttttactgtga

SEQ ID NO: 188813 - DNA, 23 bp, Mus musculus
tagtgcatggtgatctgatagga

SEQ ID NO: 188814 - DNA, 22 bp, Mus musculus
tgttttgtgacctattatgtgg

SEQ ID NO: 188815 - DNA, 22 bp, Mus musculus
ggaagagtagagattcagctca

SEQ ID NO: 188816 - DNA, 20 bp, Mus musculus
tttctctgaggaaaagagtt

SEQ ID NO: 188817 - DNA, 23 bp, Mus musculus
cagtgtctgtgtgactgatttgg

SEQ ID NO: 188818 - DNA, 22 bp, Mus musculus
tgttttgtgaccaattatatgg

SEQ ID NO: 188819 - DNA, 23 bp, Mus musculus
tgtgtttagaattgagatatcat

SEQ ID NO: 188820 - DNA, 22 bp, Mus musculus
tttttttcattgatgaatacat

SEQ ID NO: 188821 - DNA, 23 bp, Mus musculus
tggtatagtgatattcttgtaga

SEQ ID NO: 188822 - DNA, 23 bp, Mus musculus
atgtatatgtatatgtatatgta

SEQ ID NO: 188823 - DNA, 23 bp, Mus musculus
tgtctctgagtgtgtgtatgtcc

SEQ ID NO: 188824 - DNA, 22 bp, Mus musculus
tgttttgtgaccaattatatgg

SEQ ID NO: 188825 - DNA, 20 bp, Mus musculus
actgtgattttcctaaggac

SEQ ID NO: 188826 - DNA, 23 bp, Mus musculus
tttttttctttagtaatgcaggt

SEQ ID NO: 188827 - DNA, 22 bp, Mus musculus
gtgtgtatgtgtgtgcatgtgt

SEQ ID NO: 188828 - DNA, 22 bp, Mus musculus
atatgtgtatatgtatatgtat

SEQ ID NO: 188829 - DNA, 21 bp, Mus musculus
tatgtgtatatgtatatgtgt

SEQ ID NO: 188830 - DNA, 21 bp, Mus musculus
gcactgactgctcttccagtg

SEQ ID NO: 188831 - DNA, 23 bp, Mus musculus
actgactgactgctcttgcagag

SEQ ID NO: 188832 - DNA, 23 bp, Mus musculus
gtgtgcctctgtgtgtgtgtgta

SEQ ID NO: 188833 - DNA, 18 bp, Mus musculus
tatgtacaagcacatatg

SEQ ID NO: 188834 - DNA, 22 bp, Mus musculus
tgttttgtgaccaattatatgg

SEQ ID NO: 188835 - DNA, 22 bp, Mus musculus
tcacatgtacacatggttagag

SEQ ID NO: 188836 - DNA, 23 bp, Mus musculus
aatctgatactagtatgtgtgta

SEQ ID NO: 188837 - DNA, 23 bp, Mus musculus
aatgagcaagaggaagtggtttg

SEQ ID NO: 188838 - DNA, 22 bp, Mus musculus
acggagtgtagtgtggatggag

SEQ ID NO: 188839 - DNA, 23 bp, Mus musculus
gctctctctgtctctatgttgca

SEQ ID NO: 188840 - DNA, 23 bp, Mus musculus
gcttgaactcgttctccagcttg

SEQ ID NO: 188841 - DNA, 18 bp, Mus musculus
tggagagagaatctggag

SEQ ID NO: 188842 - DNA, 22 bp, Mus musculus
tatgtatatatgtatgtatgca

SEQ ID NO: 188843 - DNA, 23 bp, Mus musculus
cagtgggtcacagagtgtcactg

SEQ ID NO: 188844 - DNA, 21 bp, Mus musculus
tcacagagagtccatttagtg

SEQ ID NO: 188845 - DNA, 19 bp, Mus musculus
ggtgtgtctactgggacag

SEQ ID NO: 188846 - DNA, 21 bp, Mus musculus
agctacattttcttttccctt

SEQ ID NO: 188847 - DNA, 22 bp, Mus musculus
tgttttgtgaccaattatatgg

SEQ ID NO: 188848 - DNA, 22 bp, Mus musculus
tatgagctgatgtatacatgtg

SEQ ID NO: 188849 - DNA, 19 bp, Mus musculus
agtgcactgaacacactag

SEQ ID NO: 188850 - DNA, 23 bp, Mus musculus
ctgactctacgtctctgtgtctg

SEQ ID NO: 188851 - DNA, 23 bp, Mus musculus
acactcactccctggctcagtgt

SEQ ID NO: 188852 - DNA, 23 bp, Mus musculus
tctgtgtcctctcaatctctgtc

SEQ ID NO: 188853 - DNA, 23 bp, Mus musculus
gtatgtgtatggtgtatgtatgt

SEQ ID NO: 188854 - DNA, 23 bp, Mus musculus
tctgagtctgtctctctctgctt

SEQ ID NO: 188855 - DNA, 21 bp, Mus musculus
tgccatgaggtaggcagtgct

SEQ ID NO: 188856 - DNA, 19 bp, Mus musculus
gtatatatgtatgtatgca

SEQ ID NO: 188857 - DNA, 23 bp, Mus musculus
tatctatgtatgcaagtgtgtgt

SEQ ID NO: 188858 - DNA, 22 bp, Mus musculus
aacagacagaattcagcaaata

SEQ ID NO: 188859 - DNA, 23 bp, Mus musculus
tatgtgtctgtctgtctgtcagc

SEQ ID NO: 188860 - DNA, 20 bp, Mus musculus
tctctgtgagtttgaggcca

SEQ ID NO: 188861 - DNA, 23 bp, Mus musculus
tctccaaggagtgaggattgttg

SEQ ID NO: 188862 - DNA, 23 bp, Mus musculus
attggtcatctgtccctgtgtca

SEQ ID NO: 188863 - DNA, 22 bp, Mus musculus
acacagaactcagagtgctctt

SEQ ID NO: 188864 - DNA, 23 bp, Mus musculus
gaacactttggaaatctttgcaa

SEQ ID NO: 188865 - DNA, 19 bp, Mus musculus
taagagggctcaatgcagg

SEQ ID NO: 188866 - DNA, 22 bp, Mus musculus
gtgtgagctcatgtgtgtgtgt

SEQ ID NO: 188867 - DNA, 23 bp, Mus musculus
agacagatctctgtgagctcaag

SEQ ID NO: 188868 - DNA, 18 bp, Mus musculus
acacagagaaatcctgtc

SEQ ID NO: 188869 - DNA, 23 bp, Mus musculus
atgtatgcatatcatatgtgtgt

SEQ ID NO: 188870 - DNA, 23 bp, Mus musculus
tgcatgcgtgtgtgcgtgcctct

SEQ ID NO: 188871 - DNA, 23 bp, Mus musculus
ctcctcagagactcactctctcc

SEQ ID NO: 188872 - DNA, 23 bp, Mus musculus
ttgtctcaggatctgctctgggt

SEQ ID NO: 188873 - DNA, 23 bp, Mus musculus
ttttctctgggagaaatttgggt

SEQ ID NO: 188874 - DNA, 23 bp, Mus musculus
tgcatgtgtaggtttgtgtgtgt

SEQ ID NO: 188875 - DNA, 23 bp, Mus musculus
catatcacacacattatgaacac

SEQ ID NO: 188876 - DNA, 23 bp, Mus musculus
tctctctgtgtgtgttagttctc

SEQ ID NO: 188877 - DNA, 22 bp, Mus musculus
tgttttgtgaccaattatatgg

SEQ ID NO: 188878 - DNA, 22 bp, Mus musculus
tacatccttgacatggagatgt

SEQ ID NO: 188879 - DNA, 18 bp, Mus musculus
ctgtctggctgtcatctc

SEQ ID NO: 188880 - DNA, 22 bp, Mus musculus
tgttttgtgaccaattatatgg

SEQ ID NO: 188881 - DNA, 22 bp, Mus musculus
tacatccttgacatggagatgt

SEQ ID NO: 188882 - DNA, 18 bp, Mus musculus
ctgtctggctgtcatctc

SEQ ID NO: 188883 - DNA, 22 bp, Mus musculus
tgttttgtgaccaattatatgg

SEQ ID NO: 188884 - DNA, 22 bp, Mus musculus
tgttttgtgaccaattatatgg

SEQ ID NO: 188885 - DNA, 21 bp, Mus musculus
ttgctaggtgatgttctccta

SEQ ID NO: 188886 - DNA, 19 bp, Mus musculus
agcaacctcctaatgctgg

SEQ ID NO: 188887 - DNA, 21 bp, Mus musculus
tcaccctgtcagtcacttctc

SEQ ID NO: 188888 - DNA, 23 bp, Mus musculus
tggtgtggtagctggtagaaatc

SEQ ID NO: 188889 - DNA, 23 bp, Mus musculus
gtctggtctctgtctctctgccc

SEQ ID NO: 188890 - DNA, 18 bp, Mus musculus
ctacaagatgatctgaca

SEQ ID NO: 188891 - DNA, 23 bp, Mus musculus
gatgaaacagtttttctatttga

SEQ ID NO: 188892 - DNA, 23 bp, Mus musculus
aattgtcaaattgaaagtacttt

SEQ ID NO: 188893 - DNA, 23 bp, Mus musculus
aagactctgtgtgtatctgactg

SEQ ID NO: 188894 - DNA, 23 bp, Mus musculus
tgtctcacagactgtctttactc

SEQ ID NO: 188895 - DNA, 19 bp, Mus musculus
atgtgtgtgtgcatgtgca

SEQ ID NO: 188896 - DNA, 23 bp, Mus musculus
atcgattagagctgtagctcaga

SEQ ID NO: 188897 - DNA, 23 bp, Mus musculus
ctttgtaatgttgaatgttttag

SEQ ID NO: 188898 - DNA, 23 bp, Mus musculus
agttctgacactctcagtctgtg

SEQ ID NO: 188899 - DNA, 20 bp, Mus musculus
tctatgggtctagatagcat

SEQ ID NO: 188900 - DNA, 22 bp, Mus musculus
tagacgcatgatgatgctttgt

SEQ ID NO: 188901 - DNA, 23 bp, Mus musculus
tctaagtctctctctcagtcagc

SEQ ID NO: 188902 - DNA, 21 bp, Mus musculus
atgtatgtatgtatgtatgta

SEQ ID NO: 188903 - DNA, 22 bp, Mus musculus
tgtgtgtatgtatgtatgtgtg

SEQ ID NO: 188904 - DNA, 18 bp, Mus musculus
gtatgtatgtatgtgtat

SEQ ID NO: 188905 - DNA, 23 bp, Mus musculus
tctgagttctctttctctcagct

SEQ ID NO: 188906 - DNA, 19 bp, Mus musculus
tctctgctccacactgtgt

SEQ ID NO: 188907 - DNA, 20 bp, Mus musculus
tgtatgtatgtatgtatgtg

SEQ ID NO: 188908 - DNA, 23 bp, Mus musculus
tgtgcatgcgtgtgtgcatgtgt

SEQ ID NO: 188909 - DNA, 23 bp, Mus musculus
tgacacatgtgagtgttgactac

SEQ ID NO: 188910 - DNA, 23 bp, Mus musculus
attgagagagtacagtgtgaaca

SEQ ID NO: 188911 - DNA, 19 bp, Mus musculus
tgtgtgcattatgtatgca

SEQ ID NO: 188912 - DNA, 23 bp, Mus musculus
tgtgtgtatatctgtgtgtgcat

SEQ ID NO: 188913 - DNA, 23 bp, Mus musculus
gttttctgtctgtctgactgtgg

SEQ ID NO: 188914 - DNA, 22 bp, Mus musculus
atgcatgtatatgtatgtgtat

SEQ ID NO: 188915 - DNA, 23 bp, Mus musculus
tgagttcaactcccagaatccac

SEQ ID NO: 188916 - DNA, 23 bp, Mus musculus
tgtgtgtctgtctgtctgtgtgt

SEQ ID NO: 188917 - DNA, 23 bp, Mus musculus
atgtatgtgtgcatgtgcatgtg

SEQ ID NO: 188918 - DNA, 19 bp, Mus musculus
tgtccatgcatatgtatct

SEQ ID NO: 188919 - DNA, 23 bp, Mus musculus
attctgtcagggagtttttggtg

SEQ ID NO: 188920 - DNA, 22 bp, Mus musculus
ctcagagcgtgcctctttccca

SEQ ID NO: 188921 - DNA, 23 bp, Mus musculus
tggataaggaaggcattcttgtc

SEQ ID NO: 188922 - DNA, 19 bp, Mus musculus
aggatcatgaactggaagc

SEQ ID NO: 188923 - DNA, 21 bp, Mus musculus
ggcatctggttttctagatct

SEQ ID NO: 188924 - DNA, 23 bp, Mus musculus
ctgagtgactgagagaaaggtct

SEQ ID NO: 188925 - DNA, 23 bp, Mus musculus
tggtggactggagagatggctca

SEQ ID NO: 188926 - DNA, 21 bp, Mus musculus
ctcaccgtgtctgagtctgtg

SEQ ID NO: 188927 - DNA, 20 bp, Mus musculus
tgtatgtatgtatgtatgta

SEQ ID NO: 188928 - DNA, 22 bp, Mus musculus
gtatgcatgtatgtatatatgt

SEQ ID NO: 188929 - DNA, 23 bp, Mus musculus
atagatatagattaggtatagat

SEQ ID NO: 188930 - DNA, 21 bp, Mus musculus
tatatgcatgtatatatatgt

SEQ ID NO: 188931 - DNA, 23 bp, Mus musculus
tgtatgtgtatatgtatatgtgt

SEQ ID NO: 188932 - DNA, 22 bp, Mus musculus
aaaagtcctaatcttatttata

SEQ ID NO: 188933 - DNA, 23 bp, Mus musculus
atgtgaatatatgtatatgtgtg

SEQ ID NO: 188934 - DNA, 23 bp, Mus musculus
attatatgtgtatgtatatatgt

SEQ ID NO: 188935 - DNA, 22 bp, Mus musculus
tgttttgtgaccaattatatgg

SEQ ID NO: 188936 - DNA, 23 bp, Mus musculus
tcacaactgtcactctgacacaa

SEQ ID NO: 188937 - DNA, 23 bp, Mus musculus
cgacagaaagatctgggtgcagt

SEQ ID NO: 188938 - DNA, 23 bp, Mus musculus
tctgtctgtctctgtggcccaca

SEQ ID NO: 188939 - DNA, 21 bp, Mus musculus
ctcagtggttaagagcacagg

SEQ ID NO: 188940 - DNA, 23 bp, Mus musculus
cagaggatagaagagaccatcag

SEQ ID NO: 188941 - DNA, 23 bp, Mus musculus
agggtctctctctgtatagcctt

SEQ ID NO: 188942 - DNA, 20 bp, Mus musculus
ttgcaatatatatatgtgta

SEQ ID NO: 188943 - DNA, 22 bp, Mus musculus
tgttttgtgaccaattatatgg

SEQ ID NO: 188944 - DNA, 22 bp, Mus musculus
tgttttgtgaccaattatatgg

SEQ ID NO: 188945 - DNA, 23 bp, Mus musculus
tatctgtgtgtgtatatgtatat

SEQ ID NO: 188946 - DNA, 20 bp, Mus musculus
tatgtgtgtgtgtgtgtgtg

SEQ ID NO: 188947 - DNA, 23 bp, Mus musculus
tagtgaactgattaagtagttgt

SEQ ID NO: 188948 - DNA, 20 bp, Mus musculus
tatgttcatatacatacatg

SEQ ID NO: 188949 - DNA, 23 bp, Mus musculus
aatatgtgtgtatatctatatat

SEQ ID NO: 188950 - DNA, 23 bp, Mus musculus
aagaccactgactgctcttccag

SEQ ID NO: 188951 - DNA, 21 bp, Mus musculus
atgtatgtatgcatgtgtata

SEQ ID NO: 188952 - DNA, 23 bp, Mus musculus
atgtatgtgtatatgtatgtgtg

SEQ ID NO: 188953 - DNA, 23 bp, Mus musculus
acagctagaagtttgtaaactct

SEQ ID NO: 188954 - DNA, 23 bp, Mus musculus
actgggtatatatacgtgtgtat

SEQ ID NO: 188955 - DNA, 23 bp, Mus musculus
ttatctcacgggcagtaagacat

SEQ ID NO: 188956 - DNA, 23 bp, Mus musculus
tgtctctgtctgcttttgaagac

SEQ ID NO: 188957 - DNA, 23 bp, Mus musculus
gtgtgtcactctgactttctcac

SEQ ID NO: 188958 - DNA, 23 bp, Mus musculus
tttaagattgcatatggtttgaa

SEQ ID NO: 188959 - DNA, 23 bp, Mus musculus
cgtgtgtcttctccttggattag

SEQ ID NO: 188960 - DNA, 21 bp, Mus musculus
tcagagtagagtgagaggcct

SEQ ID NO: 188961 - DNA, 23 bp, Mus musculus
cacgctcagtctgtcttctaccg

SEQ ID NO: 188962 - DNA, 23 bp, Mus musculus
tgtctctctgagtcagttggggg

SEQ ID NO: 188963 - DNA, 23 bp, Mus musculus
ctgggggatgtacatgcaatgta

SEQ ID NO: 188964 - DNA, 20 bp, Mus musculus
gtgaatagagaatctgctgt

SEQ ID NO: 188965 - DNA, 23 bp, Mus musculus
cactggctcagtgagtcacagac

SEQ ID NO: 188966 - DNA, 22 bp, Mus musculus
ctctgtctgcctgtctgcctgt

SEQ ID NO: 188967 - DNA, 23 bp, Mus musculus
ttgaagttcaggcagcaagaggt

SEQ ID NO: 188968 - DNA, 23 bp, Mus musculus
tatttcagactttcttgttctga

SEQ ID NO: 188969 - DNA, 22 bp, Mus musculus
gtatgtatgtatgtatgtatgt

SEQ ID NO: 188970 - DNA, 22 bp, Mus musculus
aacaagtttttcagcaggacct

SEQ ID NO: 188971 - DNA, 23 bp, Mus musculus
gaacacagacagctcaaaatcac

SEQ ID NO: 188972 - DNA, 23 bp, Mus musculus
aaaagaagtgcttcatatcatct

SEQ ID NO: 188973 - DNA, 23 bp, Mus musculus
gagagtgtatatgtatgtgtgag

SEQ ID NO: 188974 - DNA, 19 bp, Mus musculus
gggattgaacttaggttgt

SEQ ID NO: 188975 - DNA, 19 bp, Mus musculus
tccctcacacactgagtca

SEQ ID NO: 188976 - DNA, 20 bp, Mus musculus
tccctctgactctgactgac

SEQ ID NO: 188977 - DNA, 23 bp, Mus musculus
tcaatttccagcaactgcatggt

SEQ ID NO: 188978 - DNA, 19 bp, Mus musculus
atgcattatgtgatatatg

SEQ ID NO: 188979 - DNA, 21 bp, Mus musculus
agatatgtgtgcatgtgtgtg

SEQ ID NO: 188980 - DNA, 21 bp, Mus musculus
acatatgtatacatacacaca

SEQ ID NO: 188981 - DNA, 23 bp, Mus musculus
atatatatatatgtatatgtgtg

SEQ ID NO: 188982 - DNA, 19 bp, Mus musculus
tttgtgtgtgtgtgtttgt

SEQ ID NO: 188983 - DNA, 23 bp, Mus musculus
tattagactccatatgtaaacca

SEQ ID NO: 188984 - DNA, 23 bp, Mus musculus
tgattagagaagttactcagcag

SEQ ID NO: 188985 - DNA, 19 bp, Mus musculus
gtacagtatgcatgtagaa

SEQ ID NO: 188986 - DNA, 23 bp, Mus musculus
ctctctctggttcttcattctgg

SEQ ID NO: 188987 - DNA, 20 bp, Mus musculus
cactgcatgcattcactgcc

SEQ ID NO: 188988 - DNA, 23 bp, Mus musculus
tgtctttctctgtcattctctgt

SEQ ID NO: 188989 - DNA, 23 bp, Mus musculus
tgtgtgcatgagtgtacatgtgt

SEQ ID NO: 188990 - DNA, 23 bp, Mus musculus
caaactctgggaggaaaaggagt

SEQ ID NO: 188991 - DNA, 23 bp, Mus musculus
atgtatgtgtatatgtatatgtg

SEQ ID NO: 188992 - DNA, 23 bp, Mus musculus
tgtatgtatgtatgtatgtagtt

SEQ ID NO: 188993 - DNA, 22 bp, Mus musculus
tccctgaagcttcaggaaaggg

SEQ ID NO: 188994 - DNA, 23 bp, Mus musculus
tcagtgtctgtgcctgtcactgt

SEQ ID NO: 188995 - DNA, 21 bp, Mus musculus
actgtcacagacagctttaaa

SEQ ID NO: 188996 - DNA, 23 bp, Mus musculus
taggatgtatagatgtgaaattg

SEQ ID NO: 188997 - DNA, 20 bp, Mus musculus
ttgggacagggactcctcag

SEQ ID NO: 188998 - DNA, 23 bp, Mus musculus
tctctcttgctctcagtgtcctt

SEQ ID NO: 188999 - DNA, 19 bp, Mus musculus
tggtgagaagaataggtgt

SEQ ID NO: 189000 - DNA, 23 bp, Mus musculus
tgtcagtctggttctctgtgctt

SEQ ID NO: 189001 - DNA, 23 bp, Mus musculus
ctaccaggacagaattttgtgtg

SEQ ID NO: 189002 - DNA, 23 bp, Mus musculus
aatagcttacatagttttgtttt

SEQ ID NO: 189003 - DNA, 22 bp, Mus musculus
tgtgtgcctgggtatgtacaca

SEQ ID NO: 189004 - DNA, 23 bp, Mus musculus
ctgtgtgtgtatgtgtgtgcctg

SEQ ID NO: 189005 - DNA, 23 bp, Mus musculus
ttttaagcttatgaaatgagaag

SEQ ID NO: 189006 - DNA, 23 bp, Mus musculus
ctgagtctctgtgagtgcctggc

SEQ ID NO: 189007 - DNA, 23 bp, Mus musculus
ttgagtctctgtgagtgcctggc

SEQ ID NO: 189008 - DNA, 22 bp, Mus musculus
taagattttaatgaacagtcaa

SEQ ID NO: 189009 - DNA, 20 bp, Mus musculus
acatgtgtgtgcatatgtat

SEQ ID NO: 189010 - DNA, 23 bp, Mus musculus
aaagaggtagcatgttgtatagt

SEQ ID NO: 189011 - DNA, 18 bp, Mus musculus
gtgttttctaactgtgct

SEQ ID NO: 189012 - DNA, 23 bp, Mus musculus
ttggaagaagatactcagcatag

SEQ ID NO: 189013 - DNA, 23 bp, Mus musculus
atgtcactgactgtgtctccctc

SEQ ID NO: 189014 - DNA, 20 bp, Mus musculus
caattcccagaaaccacatg

SEQ ID NO: 189015 - DNA, 23 bp, Mus musculus
tttctctgactgtgtccgtgcca

SEQ ID NO: 189016 - DNA, 22 bp, Mus musculus
agcctctggctcccaaatcttc

SEQ ID NO: 189017 - DNA, 23 bp, Mus musculus
tatgtgtgtgtatatgtatgtat

SEQ ID NO: 189018 - DNA, 23 bp, Mus musculus
gaggtcagtgagtgcacagaacc

SEQ ID NO: 189019 - DNA, 23 bp, Mus musculus
taagagcctgtgaagatggctca

SEQ ID NO: 189020 - DNA, 23 bp, Mus musculus
agtactgactcctcttccagagg

SEQ ID NO: 189021 - DNA, 22 bp, Mus musculus
tgttttgtgaccaattatatgg

SEQ ID NO: 189022 - DNA, 23 bp, Mus musculus
ttgagttcatttatatagcatac

SEQ ID NO: 189023 - DNA, 23 bp, Mus musculus
tctgtgctttactatacatattc

SEQ ID NO: 189024 - DNA, 22 bp, Mus musculus
tgcatgcatgcatgtgtgtatg

SEQ ID NO: 189025 - DNA, 22 bp, Mus musculus
tgttttgtgaccaattatatgg

SEQ ID NO: 189026 - DNA, 23 bp, Mus musculus
tctgtgtgacactggctgtcctg

SEQ ID NO: 189027 - DNA, 21 bp, Mus musculus
atgtatgtatgtatgtatgta

SEQ ID NO: 189028 - DNA, 18 bp, Mus musculus
acacatgcacacacacac

SEQ ID NO: 189029 - DNA, 23 bp, Mus musculus
gcagtgataagttgtaaagactg

SEQ ID NO: 189030 - DNA, 22 bp, Mus musculus
ttgaggtatttaacacctggct

SEQ ID NO: 189031 - DNA, 22 bp, Mus musculus
tagtccagttccaggttgctat

SEQ ID NO: 189032 - DNA, 21 bp, Mus musculus
tcctgggattacagatgtgtc

SEQ ID NO: 189033 - DNA, 23 bp, Mus musculus
gtgtatgtacatatgtgtgtatg

SEQ ID NO: 189034 - DNA, 23 bp, Mus musculus
taagtgtatatatgtatatgtgt

SEQ ID NO: 189035 - DNA, 23 bp, Mus musculus
cattcatacatgtgtgaatatgt

SEQ ID NO: 189036 - DNA, 19 bp, Mus musculus
acatacacatgtatacagc

SEQ ID NO: 189037 - DNA, 18 bp, Mus musculus
agtggaggggctggagag

SEQ ID NO: 189038 - DNA, 19 bp, Mus musculus
atgctctagggggttggag

SEQ ID NO: 189039 - DNA, 23 bp, Mus musculus
tttgagtgtgcatgacatctctg

SEQ ID NO: 189040 - DNA, 22 bp, Mus musculus
taattttagttgaagttttggt

SEQ ID NO: 189041 - DNA, 19 bp, Mus musculus
tagtcactgacactgtctt

SEQ ID NO: 189042 - DNA, 23 bp, Mus musculus
cttctctctgtgtctcacagacc

SEQ ID NO: 189043 - DNA, 22 bp, Mus musculus
tctgtgttgtaaatgtaaatgt

SEQ ID NO: 189044 - DNA, 21 bp, Mus musculus
tacagagaccaggctgacctc

SEQ ID NO: 189045 - DNA, 23 bp, Mus musculus
tgtctctctcagtgtgttaatct

SEQ ID NO: 189046 - DNA, 23 bp, Mus musculus
ctgtgaattgatgaggagcgctt

SEQ ID NO: 189047 - DNA, 23 bp, Mus musculus
actctgaccctcactgtgagcgt

SEQ ID NO: 189048 - DNA, 19 bp, Mus musculus
tcagggttagcacatggct

SEQ ID NO: 189049 - DNA, 21 bp, Mus musculus
cacacttcactttctgtgaag

SEQ ID NO: 189050 - DNA, 22 bp, Mus musculus
gtatgtgagtgtgtgtatgtgt

SEQ ID NO: 189051 - DNA, 23 bp, Mus musculus
agcgtcagtctctgagtccctgc

SEQ ID NO: 189052 - DNA, 23 bp, Mus musculus
cactgcgtctgtctgtctgtccg

SEQ ID NO: 189053 - DNA, 18 bp, Mus musculus
tcacaggaaccttccagt

SEQ ID NO: 189054 - DNA, 18 bp, Mus musculus
tggggctggaagaggtct

SEQ ID NO: 189055 - DNA, 22 bp, Mus musculus
tatatgtatatgtgtatgtata

SEQ ID NO: 189056 - DNA, 23 bp, Mus musculus
atgtatgtatatatgtatgtgtg

SEQ ID NO: 189057 - DNA, 23 bp, Mus musculus
tatatgtatatatgcatatgtgt

SEQ ID NO: 189058 - DNA, 21 bp, Mus musculus
taggagagtgagcacactggg

SEQ ID NO: 189059 - DNA, 23 bp, Mus musculus
atatgtgtatatgtatatgtgtg

SEQ ID NO: 189060 - DNA, 21 bp, Mus musculus
atgtatgtatatgtttgtgta

SEQ ID NO: 189061 - DNA, 19 bp, Mus musculus
agcagtctctggcatctgt

SEQ ID NO: 189062 - DNA, 23 bp, Mus musculus
agtgtgagtagtgtgagcagtgt

SEQ ID NO: 189063 - DNA, 23 bp, Mus musculus
ttgtccattcagtgggtggaggt

SEQ ID NO: 189064 - DNA, 23 bp, Mus musculus
ctgtgtgtgtgtgtgcaatatgt

SEQ ID NO: 189065 - DNA, 21 bp, Mus musculus
tgtgcacatatgtgcatatga

SEQ ID NO: 189066 - DNA, 20 bp, Mus musculus
ttggctttgtgaaccaaacc

SEQ ID NO: 189067 - DNA, 23 bp, Mus musculus
gtctctctgtgtctcactggctg

SEQ ID NO: 189068 - DNA, 20 bp, Mus musculus
attgtcactaaacgttttct

SEQ ID NO: 189069 - DNA, 20 bp, Mus musculus
gcctggctgcctgttagcca

SEQ ID NO: 189070 - DNA, 23 bp, Mus musculus
ataggtgtgcatatatgtatgta

SEQ ID NO: 189071 - DNA, 23 bp, Mus musculus
tatgtgtgtatgtatatgtgtgt

SEQ ID NO: 189072 - DNA, 23 bp, Mus musculus
atatgtgtgtatgtatatgtgta

SEQ ID NO: 189073 - DNA, 23 bp, Mus musculus
atgtgtatatgtatatatgtgca

SEQ ID NO: 189074 - DNA, 20 bp, Mus musculus
tatagatggatggatgtgta

SEQ ID NO: 189075 - DNA, 21 bp, Mus musculus
gatgtatatgttgatgttgat

SEQ ID NO: 189076 - DNA, 19 bp, Mus musculus
agagcactgactgcacttc

SEQ ID NO: 189077 - DNA, 22 bp, Mus musculus
atgtgtatgtatccatgtgtgt

SEQ ID NO: 189078 - DNA, 23 bp, Mus musculus
agtctagaactggggactggaga

SEQ ID NO: 189079 - DNA, 21 bp, Mus musculus
tgcctgagagcctctttccca

SEQ ID NO: 189080 - DNA, 18 bp, Mus musculus
gtgggcaaagcatgagtt

SEQ ID NO: 189081 - DNA, 22 bp, Mus musculus
aggtctgtctgtctgtctgtct

SEQ ID NO: 189082 - DNA, 21 bp, Mus musculus
acatgtgcataaacatgtgtt

SEQ ID NO: 189083 - DNA, 22 bp, Mus musculus
acctccatctctgtctctgtgt

SEQ ID NO: 189084 - DNA, 23 bp, Mus musculus
cttgtactccggctgctactggt

SEQ ID NO: 189085 - DNA, 23 bp, Mus musculus
tgtgtggtatatatatgtgtatg

SEQ ID NO: 189086 - DNA, 21 bp, Mus musculus
atgtatgtatgtgtgtatgta

SEQ ID NO: 189087 - DNA, 23 bp, Mus musculus
tgtgtgcctgtgtgcctgtgtgt

SEQ ID NO: 189088 - DNA, 23 bp, Mus musculus
tctgcctgtcagtctgtctgtcc

SEQ ID NO: 189089 - DNA, 23 bp, Mus musculus
cactggtcagtcagtctgtcagt

SEQ ID NO: 189090 - DNA, 19 bp, Mus musculus
tgtgtggtacatatatgtg

SEQ ID NO: 189091 - DNA, 18 bp, Mus musculus
tgagtctatatgctgcat

SEQ ID NO: 189092 - DNA, 23 bp, Mus musculus
atgtgcatgagatatgtgagtgc

SEQ ID NO: 189093 - DNA, 23 bp, Mus musculus
acacagagcaatgcatttgtctc

SEQ ID NO: 189094 - DNA, 20 bp, Mus musculus
gtatatgtgtgtgcatgttt

SEQ ID NO: 189095 - DNA, 23 bp, Mus musculus
gctcagtcagtcggtcggtctct

SEQ ID NO: 189096 - DNA, 23 bp, Mus musculus
gtatgtgcatatgtatatgtatg

SEQ ID NO: 189097 - DNA, 20 bp, Mus musculus
gtgtgtctgagtgtgtctgt

SEQ ID NO: 189098 - DNA, 23 bp, Mus musculus
gtgtgtttatgtgcatgtccatg

SEQ ID NO: 189099 - DNA, 22 bp, Mus musculus
atgaatatgtgtgtgtatatgt

SEQ ID NO: 189100 - DNA, 20 bp, Mus musculus
tatttgtgtgtgcatgtata

SEQ ID NO: 189101 - DNA, 23 bp, Mus musculus
gtgagcctggctctgtgtgtctg

SEQ ID NO: 189102 - DNA, 23 bp, Mus musculus
tgtgtgcctctgtgtgtgggtaa

SEQ ID NO: 189103 - DNA, 19 bp, Mus musculus
tgtatgcatgcatgtgtgt

SEQ ID NO: 189104 - DNA, 20 bp, Mus musculus
tgcatgtgtgtgtgcatgtg

SEQ ID NO: 189105 - DNA, 20 bp, Mus musculus
tctctgtgtgtgtatatgag

SEQ ID NO: 189106 - DNA, 23 bp, Mus musculus
aagacagatcttgctctgctgtg

SEQ ID NO: 189107 - DNA, 23 bp, Mus musculus
tgtgagtttctctgtgtttatta

SEQ ID NO: 189108 - DNA, 23 bp, Mus musculus
atgtatgcatgtatgtatgtatg

SEQ ID NO: 189109 - DNA, 23 bp, Mus musculus
aagagcactgactgctcttccag

SEQ ID NO: 189110 - DNA, 22 bp, Mus musculus
ataactgtatacctatatgtgt

SEQ ID NO: 189111 - DNA, 23 bp, Mus musculus
atatgtgtttatgtgtatgtgag

SEQ ID NO: 189112 - DNA, 22 bp, Mus musculus
tctgagacaagattgtctgcac

SEQ ID NO: 189113 - DNA, 19 bp, Mus musculus
atgagacacgagggaggtg

SEQ ID NO: 189114 - DNA, 23 bp, Mus musculus
gggtctgtccctcagtccctcac

SEQ ID NO: 189115 - DNA, 18 bp, Mus musculus
tgtgtacacactgtgtgt

SEQ ID NO: 189116 - DNA, 23 bp, Mus musculus
tgtgtgtgtgtgcaaaccatgtg

SEQ ID NO: 189117 - DNA, 23 bp, Mus musculus
gtgcctcagtgcctgacactgag

SEQ ID NO: 189118 - DNA, 23 bp, Mus musculus
tgtctcagagcgtcaccttgagg

SEQ ID NO: 189119 - DNA, 23 bp, Mus musculus
cagtgtgcatttgaaatcaaagg

SEQ ID NO: 189120 - DNA, 23 bp, Mus musculus
gtcttctctctgcctgtctctgg

SEQ ID NO: 189121 - DNA, 20 bp, Mus musculus
gtgaggctgagtaaggcggt

SEQ ID NO: 189122 - DNA, 23 bp, Mus musculus
ctcactgtgtcactgtctgactg

SEQ ID NO: 189123 - DNA, 23 bp, Mus musculus
tgtcactgtctgactgctgtgca

SEQ ID NO: 189124 - DNA, 18 bp, Mus musculus
tgtcaccgtctaacagtg

SEQ ID NO: 189125 - DNA, 23 bp, Mus musculus
ccaggccctgtctgtctgtctgt

SEQ ID NO: 189126 - DNA, 23 bp, Mus musculus
tgtatgtatgtatgtatacatgt

SEQ ID NO: 189127 - DNA, 23 bp, Mus musculus
atgtatatatatgtatgtgtgtg

SEQ ID NO: 189128 - DNA, 23 bp, Mus musculus
ccctctgtgtgtgtgtgtctccg

SEQ ID NO: 189129 - DNA, 23 bp, Mus musculus
tgtgtatatgtgtgtgcacatgt

SEQ ID NO: 189130 - DNA, 23 bp, Mus musculus
gtatgtgtgcatgtgcatgtgta

SEQ ID NO: 189131 - DNA, 19 bp, Mus musculus
tcacagatgtgacttatct

SEQ ID NO: 189132 - DNA, 23 bp, Mus musculus
agaatggttacactgcaggctct

SEQ ID NO: 189133 - DNA, 23 bp, Mus musculus
tgcctgcctgcctgcctgcctgc

SEQ ID NO: 189134 - DNA, 20 bp, Mus musculus
tgcagcagtaagtgcacagt

SEQ ID NO: 189135 - DNA, 23 bp, Mus musculus
actcactgtcccactctgtctgc

SEQ ID NO: 189136 - DNA, 18 bp, Mus musculus
agtgtcagcataggctct

SEQ ID NO: 189137 - DNA, 23 bp, Mus musculus
gtctctgtgtctcaaagccctgt

SEQ ID NO: 189138 - DNA, 23 bp, Mus musculus
tgtgtgtctgtgtgtgcctatgc

SEQ ID NO: 189139 - DNA, 23 bp, Mus musculus
ttctctccgtctgtccgtctgtc

SEQ ID NO: 189140 - DNA, 23 bp, Mus musculus
tgcctctctgggagtgtgtgtgg

SEQ ID NO: 189141 - DNA, 23 bp, Mus musculus
cagagctgagtgaagtgactttg

SEQ ID NO: 189142 - DNA, 23 bp, Mus musculus
agtctctccctctgaataatggg

SEQ ID NO: 189143 - DNA, 23 bp, Mus musculus
tctcggtctctgtttctgacagg

SEQ ID NO: 189144 - DNA, 23 bp, Mus musculus
ctggcttagaaatcatgatcttc

SEQ ID NO: 189145 - DNA, 23 bp, Mus musculus
tcgctgactcacttgctcctcat

SEQ ID NO: 189146 - DNA, 23 bp, Mus musculus
taactgacactagagagagggga

SEQ ID NO: 189147 - DNA, 23 bp, Mus musculus
atgtatgcatgtatgtatgtatg

SEQ ID NO: 189148 - DNA, 22 bp, Mus musculus
tgactcacagtggtactacagt

SEQ ID NO: 189149 - DNA, 21 bp, Mus musculus
agtgtgtctgtctctgtgggg

SEQ ID NO: 189150 - DNA, 19 bp, Mus musculus
aaaggttctcatgtgttac

SEQ ID NO: 189151 - DNA, 20 bp, Mus musculus
gagccactctgagccacaca

SEQ ID NO: 189152 - DNA, 22 bp, Mus musculus
gggaacttctgtctgtctgtct

SEQ ID NO: 189153 - DNA, 23 bp, Mus musculus
tattatgttatagtaatactaag

SEQ ID NO: 189154 - DNA, 23 bp, Mus musculus
cctgtctctgactccctggcact

SEQ ID NO: 189155 - DNA, 23 bp, Mus musculus
gtatgtatgtatatgtgtgtgtg

SEQ ID NO: 189156 - DNA, 23 bp, Mus musculus
gtatgtatgtatgtatgtcttga

SEQ ID NO: 189157 - DNA, 23 bp, Mus musculus
tgtgtcctacctggttgttttct

SEQ ID NO: 189158 - DNA, 23 bp, Mus musculus
actccctgaagagacaggcagtt

SEQ ID NO: 189159 - DNA, 23 bp, Mus musculus
acacacagcacacacagcagcag

SEQ ID NO: 189160 - DNA, 23 bp, Mus musculus
ctcagtggctctgtagctctctg

SEQ ID NO: 189161 - DNA, 19 bp, Mus musculus
cctcaggcaagaaggtcag

SEQ ID NO: 189162 - DNA, 20 bp, Mus musculus
aagagcactgactgctcttc

SEQ ID NO: 189163 - DNA, 19 bp, Mus musculus
agagctctggctgcccttg

SEQ ID NO: 189164 - DNA, 22 bp, Mus musculus
gttttgagacagggtcttatgt

SEQ ID NO: 189165 - DNA, 23 bp, Mus musculus
tctctcactctgtgcttcctata

SEQ ID NO: 189166 - DNA, 23 bp, Mus musculus
tgggtgactggatcagctgtcgg

SEQ ID NO: 189167 - DNA, 23 bp, Mus musculus
gacactctggctgtgaggctggg

SEQ ID NO: 189168 - DNA, 23 bp, Mus musculus
tcgctcgctcgctcgctcgctag

SEQ ID NO: 189169 - DNA, 21 bp, Mus musculus
tgccaggctccctcaaagcca

SEQ ID NO: 189170 - DNA, 23 bp, Mus musculus
taagagcactgactgctcttcca

SEQ ID NO: 189171 - DNA, 21 bp, Mus musculus
tctctcagagtctcaccaggc

SEQ ID NO: 189172 - DNA, 23 bp, Mus musculus
ctcagagactgtatggtgacgtt

SEQ ID NO: 189173 - DNA, 21 bp, Mus musculus
tgcctctccagcaccatgtct

SEQ ID NO: 189174 - DNA, 21 bp, Mus musculus
ttcaaatctcagcaaccacat

SEQ ID NO: 189175 - DNA, 23 bp, Mus musculus
aaggatgttgagggtatagctct

SEQ ID NO: 189176 - DNA, 19 bp, Mus musculus
cacgcaccctctctggctc

SEQ ID NO: 189177 - DNA, 21 bp, Mus musculus
tctctgtgtgtgcatgtgtgt

SEQ ID NO: 189178 - DNA, 23 bp, Mus musculus
atatatgtgtgtatttatctatg

SEQ ID NO: 189179 - DNA, 20 bp, Mus musculus
aagtatctatgcatgtatgt

SEQ ID NO: 189180 - DNA, 23 bp, Mus musculus
atgtcagactccaactcgatgtg

SEQ ID NO: 189181 - DNA, 23 bp, Mus musculus
tcactcactctttctgtctctgc

SEQ ID NO: 189182 - DNA, 20 bp, Mus musculus
tgtgtgtgtattgagtatat

SEQ ID NO: 189183 - DNA, 23 bp, Mus musculus
tgtatgtgtgcatgtgcatgtgt

SEQ ID NO: 189184 - DNA, 23 bp, Mus musculus
atgtgtgtgtgtgtatgtacata

SEQ ID NO: 189185 - DNA, 21 bp, Mus musculus
atatgtatatatgtacatgta

SEQ ID NO: 189186 - DNA, 19 bp, Mus musculus
atgtatgtatgcatgtgtg

SEQ ID NO: 189187 - DNA, 23 bp, Mus musculus
gtgtgtgtgtgtgtatgcatgca

SEQ ID NO: 189188 - DNA, 23 bp, Mus musculus
atatgtatgtgtatgattgtgta

SEQ ID NO: 189189 - DNA, 18 bp, Mus musculus
atatatgagtgtgtgcac

SEQ ID NO: 189190 - DNA, 23 bp, Mus musculus
tgagtccctttgtcacaggctct

SEQ ID NO: 189191 - DNA, 23 bp, Mus musculus
acatcagacagacagacagacag

SEQ ID NO: 189192 - DNA, 23 bp, Mus musculus
tctgtggatgagtctgaggtagg

SEQ ID NO: 189193 - DNA, 23 bp, Mus musculus
ctctctctgacagtatcttcaga

SEQ ID NO: 189194 - DNA, 20 bp, Mus musculus
tgactgtagactgagtgaac

SEQ ID NO: 189195 - DNA, 22 bp, Mus musculus
tgttttgtgaccaattatatgg

SEQ ID NO: 189196 - DNA, 21 bp, Mus musculus
tcagaggctcagagtcatgat

SEQ ID NO: 189197 - DNA, 23 bp, Mus musculus
tgtgtctgtctgtctgtctgtgt

SEQ ID NO: 189198 - DNA, 22 bp, Mus musculus
acagagtttccatagcgtctgt

SEQ ID NO: 189199 - DNA, 23 bp, Mus musculus
tgtgtgtatgtatatatgtgtgt

SEQ ID NO: 189200 - DNA, 23 bp, Mus musculus
atgtgcatatatatgcatatatg

SEQ ID NO: 189201 - DNA, 23 bp, Mus musculus
ggtcaagactgtgtctctgtgtc

SEQ ID NO: 189202 - DNA, 21 bp, Mus musculus
tgttgtgtgtgcatgtgtatg

SEQ ID NO: 189203 - DNA, 23 bp, Mus musculus
tgttgtgtgcatgtacatatgtt

SEQ ID NO: 189204 - DNA, 20 bp, Mus musculus
attgtgcatgtacatatgtt

SEQ ID NO: 189205 - DNA, 22 bp, Mus musculus
tatgtatatgtatatatgtgtg

SEQ ID NO: 189206 - DNA, 23 bp, Mus musculus
tctgagactctgtctcaaaaaac

SEQ ID NO: 189207 - DNA, 20 bp, Mus musculus
agtgtgctcactgtgtgtgt

SEQ ID NO: 189208 - DNA, 23 bp, Mus musculus
caggaactgcatctggagctgca

SEQ ID NO: 189209 - DNA, 23 bp, Mus musculus
atacactcagtctttcctgatgg

SEQ ID NO: 189210 - DNA, 23 bp, Mus musculus
agaggatctgacagtgaatgagg

SEQ ID NO: 189211 - DNA, 20 bp, Mus musculus
agacagggaggggaagtcct

SEQ ID NO: 189212 - DNA, 23 bp, Mus musculus
cacaccacagtttgtctgtctgt

SEQ ID NO: 189213 - DNA, 21 bp, Mus musculus
tggctgggtccctccatcgct

SEQ ID NO: 189214 - DNA, 22 bp, Mus musculus
taatagcatggttatcaataga

SEQ ID NO: 189215 - DNA, 23 bp, Mus musculus
ttactgtgagggtgctaggttgt

SEQ ID NO: 189216 - DNA, 22 bp, Mus musculus
atgtgtgtatatatgtatatat

SEQ ID NO: 189217 - DNA, 22 bp, Mus musculus
ttgcatatgtatgtgtatatgt

SEQ ID NO: 189218 - DNA, 20 bp, Mus musculus
tgtgtatatgtatatatgtg

SEQ ID NO: 189219 - DNA, 22 bp, Mus musculus
atgtgtatatgtatatatgtac

SEQ ID NO: 189220 - DNA, 23 bp, Mus musculus
attatgtccatatgtatttatgt

SEQ ID NO: 189221 - DNA, 20 bp, Mus musculus
tgagagatgacactcaggcc

SEQ ID NO: 189222 - DNA, 23 bp, Mus musculus
tatcacggagaagttgatcccca

SEQ ID NO: 189223 - DNA, 20 bp, Mus musculus
tgtgggacggactctggtga

SEQ ID NO: 189224 - DNA, 22 bp, Mus musculus
agagtgtctttctgtgactgtg

SEQ ID NO: 189225 - DNA, 23 bp, Mus musculus
cacagatgttgtgattttcatgt

SEQ ID NO: 189226 - DNA, 23 bp, Mus musculus
tcattcagtgtctctgtgatccc

SEQ ID NO: 189227 - DNA, 23 bp, Mus musculus
tttattcactgctatagctgaga

SEQ ID NO: 189228 - DNA, 23 bp, Mus musculus
gcctgcctgcctgcctgcctgcc

SEQ ID NO: 189229 - DNA, 18 bp, Mus musculus
tactcagcagaaatgtga

SEQ ID NO: 189230 - DNA, 20 bp, Mus musculus
tgtgtcactgtatctctccg

SEQ ID NO: 189231 - DNA, 18 bp, Mus musculus
tggatttttattgttgtt

SEQ ID NO: 189232 - DNA, 20 bp, Mus musculus
aagagcactgactgctcttc

SEQ ID NO: 189233 - DNA, 23 bp, Mus musculus
tgtcccatccttatgatatgtct

SEQ ID NO: 189234 - DNA, 23 bp, Mus musculus
gtcagactgtactctctgagctc

SEQ ID NO: 189235 - DNA, 23 bp, Mus musculus
tctctgtctgtctatcttttcac

SEQ ID NO: 189236 - DNA, 23 bp, Mus musculus
ggatgtgcctctgcttgaacatg

SEQ ID NO: 189237 - DNA, 22 bp, Mus musculus
atgtgcctctgcttgaacatgc

SEQ ID NO: 189238 - DNA, 23 bp, Mus musculus
tgtgtggctctctgtccctcctt

SEQ ID NO: 189239 - DNA, 21 bp, Mus musculus
aagtcacgacgtctaacctag

SEQ ID NO: 189240 - DNA, 23 bp, Mus musculus
tggaaaactctgtcttcttctac

SEQ ID NO: 189241 - DNA, 23 bp, Mus musculus
tgtgcatgtgtgtctgtgtgtat

SEQ ID NO: 189242 - DNA, 20 bp, Mus musculus
actgagtcacctctgcaacc

SEQ ID NO: 189243 - DNA, 18 bp, Mus musculus
aggctgcctgtggccagt

SEQ ID NO: 189244 - DNA, 23 bp, Mus musculus
tcagcctcagacagcctgtcact

SEQ ID NO: 189245 - DNA, 20 bp, Mus musculus
atagtgacacagttccttca

SEQ ID NO: 189246 - DNA, 23 bp, Mus musculus
cagtgtgtgtgtgtctgtctgtc

SEQ ID NO: 189247 - DNA, 23 bp, Mus musculus
tatgtgtgcatgtgtgtgcatgt

SEQ ID NO: 189248 - DNA, 21 bp, Mus musculus
tacacgtgtatatacatgcat

SEQ ID NO: 189249 - DNA, 23 bp, Mus musculus
tgtaatgatggtgatggctgtgg

SEQ ID NO: 189250 - DNA, 22 bp, Mus musculus
atgtatgtgtgcatgtgtatat

SEQ ID NO: 189251 - DNA, 18 bp, Mus musculus
ttcaattctcagcaacca

SEQ ID NO: 189252 - DNA, 21 bp, Mus musculus
tgtggctgactgggcctctga

SEQ ID NO: 189253 - DNA, 23 bp, Mus musculus
atgtatgtgtgcatgtgcatatg

SEQ ID NO: 189254 - DNA, 23 bp, Mus musculus
tgttcaccagcatgagtgtgtgc

SEQ ID NO: 189255 - DNA, 21 bp, Mus musculus
aatctctctagctctgtctat

SEQ ID NO: 189256 - DNA, 23 bp, Mus musculus
tgtatatgtgtgtgcatgtgcat

SEQ ID NO: 189257 - DNA, 22 bp, Mus musculus
ttttaaggatgaaatggaatca

SEQ ID NO: 189258 - DNA, 22 bp, Mus musculus
agatcagaatcacagctcttac

SEQ ID NO: 189259 - DNA, 23 bp, Mus musculus
ctgtctctgtctctctgtctctg

SEQ ID NO: 189260 - DNA, 22 bp, Mus musculus
accctctctgcctctgtcaaga

SEQ ID NO: 189261 - DNA, 23 bp, Mus musculus
tgagtgttttgtctgtgtgtatg

SEQ ID NO: 189262 - DNA, 23 bp, Mus musculus
acagagagagttgacagatggga

SEQ ID NO: 189263 - DNA, 23 bp, Mus musculus
tgtgtatgtatgtatgtgtatat

SEQ ID NO: 189264 - DNA, 23 bp, Mus musculus
aagagagatgtgagagacctgag

SEQ ID NO: 189265 - DNA, 22 bp, Mus musculus
tgtgtgtgtaagtgcatgcaca

SEQ ID NO: 189266 - DNA, 23 bp, Mus musculus
atatgtgtgtgcattgtatgtgt

SEQ ID NO: 189267 - DNA, 23 bp, Mus musculus
tgtgcatgtgtgtatatgtatgt

SEQ ID NO: 189268 - DNA, 23 bp, Mus musculus
atatgtgtatatatgtgtgtgtg

SEQ ID NO: 189269 - DNA, 22 bp, Mus musculus
aagtacttgtgtatacatggat

SEQ ID NO: 189270 - DNA, 20 bp, Mus musculus
atgtatgtgtgcatgtgcaa

SEQ ID NO: 189271 - DNA, 21 bp, Mus musculus
tgagcaactaggtagtgtaga

SEQ ID NO: 189272 - DNA, 23 bp, Mus musculus
tgcctggctctgtctctggatca

SEQ ID NO: 189273 - DNA, 23 bp, Mus musculus
gagaagtctgtcaggtcaccagg

SEQ ID NO: 189274 - DNA, 18 bp, Mus musculus
cccactctctgtgactcc

SEQ ID NO: 189275 - DNA, 20 bp, Mus musculus
tggcagcctgcctgtaaccc

SEQ ID NO: 189276 - DNA, 20 bp, Mus musculus
tatgtatgtatatgtacaca

SEQ ID NO: 189277 - DNA, 22 bp, Mus musculus
tatgtgtgtatatctatatcta

SEQ ID NO: 189278 - DNA, 22 bp, Mus musculus
ttctcttgactgtactttggtt

SEQ ID NO: 189279 - DNA, 23 bp, Mus musculus
agacacactcacatgaaagcatg

SEQ ID NO: 189280 - DNA, 23 bp, Mus musculus
tgtgtgtacatgcatgtgtgtgt

SEQ ID NO: 189281 - DNA, 20 bp, Mus musculus
tagagagtgtggtcaggtag

SEQ ID NO: 189282 - DNA, 23 bp, Mus musculus
tgtgcgtctgtctgtccatctgt

SEQ ID NO: 189283 - DNA, 20 bp, Mus musculus
ggatgggaccctctttgcca

SEQ ID NO: 189284 - DNA, 21 bp, Mus musculus
ttcaattcacagcaaccacat

SEQ ID NO: 189285 - DNA, 23 bp, Mus musculus
tgtgtgcctgtgtgcctgtgtgt

SEQ ID NO: 189286 - DNA, 22 bp, Mus musculus
tgtgtggctcagtggctgagtg

SEQ ID NO: 189287 - DNA, 23 bp, Mus musculus
tctgtgcctctgtggctgtgaca

SEQ ID NO: 189288 - DNA, 19 bp, Mus musculus
tgtgggaggtttatttctg

SEQ ID NO: 189289 - DNA, 19 bp, Mus musculus
caaagcagggaagattgtt

SEQ ID NO: 189290 - DNA, 18 bp, Mus musculus
ctgggtttgatttctagc

SEQ ID NO: 189291 - DNA, 22 bp, Mus musculus
attgagctgttttagctttctg

SEQ ID NO: 189292 - DNA, 23 bp, Mus musculus
tctcagacctttagaagttgcat

SEQ ID NO: 189293 - DNA, 23 bp, Mus musculus
tctgtgagtgagatatcccagac

SEQ ID NO: 189294 - DNA, 19 bp, Mus musculus
ctgtacatggtgaagtgtc

SEQ ID NO: 189295 - DNA, 18 bp, Mus musculus
atagataggtagacagac

SEQ ID NO: 189296 - DNA, 23 bp, Mus musculus
tcagtccctgtctgtctgttgtt

SEQ ID NO: 189297 - DNA, 23 bp, Mus musculus
tcagagatgtagttctgttggtg

SEQ ID NO: 189298 - DNA, 23 bp, Mus musculus
aagtatgtaagtatgtaagtatg

SEQ ID NO: 189299 - DNA, 21 bp, Mus musculus
acacacacagagtcactgagc

SEQ ID NO: 189300 - DNA, 23 bp, Mus musculus
ttgtagctgtgtggatttgaact

SEQ ID NO: 189301 - DNA, 20 bp, Mus musculus
tttgccttatgttttctgtt

SEQ ID NO: 189302 - DNA, 19 bp, Mus musculus
gtgcctgtcactctctgcc

SEQ ID NO: 189303 - DNA, 23 bp, Mus musculus
ctcagggagtctgtctgtctgtc

SEQ ID NO: 189304 - DNA, 23 bp, Mus musculus
ttggtgctagagaaatggctcag

SEQ ID NO: 189305 - DNA, 22 bp, Mus musculus
ctgtgtaactcagtgtatagag

SEQ ID NO: 189306 - DNA, 23 bp, Mus musculus
aggctggccttgaactcacagag

SEQ ID NO: 189307 - DNA, 23 bp, Mus musculus
aacatttccatgtgaggctgtgt

SEQ ID NO: 189308 - DNA, 19 bp, Mus musculus
aatgtccagctccaggaga

SEQ ID NO: 189309 - DNA, 23 bp, Mus musculus
gtctgcctgtgtgtctgtgtgcc

SEQ ID NO: 189310 - DNA, 22 bp, Mus musculus
acctgattctacatgccttaga

SEQ ID NO: 189311 - DNA, 23 bp, Mus musculus
tgtatgtgtgtatgtatatatgc

SEQ ID NO: 189312 - DNA, 23 bp, Mus musculus
tgtgtatgtatgtatacatgtat

SEQ ID NO: 189313 - DNA, 23 bp, Mus musculus
tttcctcatgactctctctgtga

SEQ ID NO: 189314 - DNA, 22 bp, Mus musculus
tatgtgcatgtatgtatgtatg

SEQ ID NO: 189315 - DNA, 22 bp, Mus musculus
tatttatgtatgtaagtgcatg

SEQ ID NO: 189316 - DNA, 23 bp, Mus musculus
atcacctcttagaagatgctctc

SEQ ID NO: 189317 - DNA, 23 bp, Mus musculus
ctctgacactcacagccactgtt

SEQ ID NO: 189318 - DNA, 23 bp, Mus musculus
gcgctgactgctcttccagaggt

SEQ ID NO: 189319 - DNA, 23 bp, Mus musculus
atgagttgtctgcagattgctat

SEQ ID NO: 189320 - DNA, 18 bp, Mus musculus
tcaaggacaggctggaga

SEQ ID NO: 189321 - DNA, 20 bp, Mus musculus
agagtgtagacggaagacag

SEQ ID NO: 189322 - DNA, 23 bp, Mus musculus
tttgcctacatgtatgtatgtgt

SEQ ID NO: 189323 - DNA, 23 bp, Mus musculus
tgtgtgtgtgtctgtctatgtat

SEQ ID NO: 189324 - DNA, 23 bp, Mus musculus
tatctgtctgtctgtctgggatt

SEQ ID NO: 189325 - DNA, 23 bp, Mus musculus
tgctgactgctcttccagaggtc

SEQ ID NO: 189326 - DNA, 23 bp, Mus musculus
tatatgtatatgtatgtgtatgt

SEQ ID NO: 189327 - DNA, 20 bp, Mus musculus
aagagcactgactgctcttc

SEQ ID NO: 189328 - DNA, 23 bp, Mus musculus
tgcatgaatgtatgtgtgtgtgt

SEQ ID NO: 189329 - DNA, 23 bp, Mus musculus
tctcctgaacctggagttcactg

SEQ ID NO: 189330 - DNA, 23 bp, Mus musculus
catctctgtggcttggtttacta

SEQ ID NO: 189331 - DNA, 23 bp, Mus musculus
aatattgtgcatgttctttgacc

SEQ ID NO: 189332 - DNA, 21 bp, Mus musculus
ttgagaactgttaggcttggg

SEQ ID NO: 189333 - DNA, 23 bp, Mus musculus
ctgtctgtctgtctgtctgtctg

SEQ ID NO: 189334 - DNA, 19 bp, Mus musculus
tcaaacacaagacttggca

SEQ ID NO: 189335 - DNA, 19 bp, Mus musculus
agagtcctgaggaagcaca

SEQ ID NO: 189336 - DNA, 23 bp, Mus musculus
atgcacctgtgtgggtctcacgc

SEQ ID NO: 189337 - DNA, 23 bp, Mus musculus
atatctatatatatatatgtgta

SEQ ID NO: 189338 - DNA, 21 bp, Mus musculus
tctatctatatgtatatatat

SEQ ID NO: 189339 - DNA, 23 bp, Mus musculus
tgtgtatatatctatatgtgtgt

SEQ ID NO: 189340 - DNA, 20 bp, Mus musculus
tggctatccttgaactcact

SEQ ID NO: 189341 - DNA, 23 bp, Mus musculus
tggctcagtggctgaacagtgag

SEQ ID NO: 189342 - DNA, 22 bp, Mus musculus
tatctcttctttattctgtgtg

SEQ ID NO: 189343 - DNA, 23 bp, Mus musculus
tgtgtcacagtgtacacacagag

SEQ ID NO: 189344 - DNA, 18 bp, Mus musculus
acatctttccttgtaaat

SEQ ID NO: 189345 - DNA, 19 bp, Mus musculus
tcagtgctgaactaggcct

SEQ ID NO: 189346 - DNA, 22 bp, Mus musculus
tggatctctgagagttcaaggc

SEQ ID NO: 189347 - DNA, 23 bp, Mus musculus
ctctgcctctgtctctgacaccc

SEQ ID NO: 189348 - DNA, 23 bp, Mus musculus
tgaagagactctcactgtgtgaa

SEQ ID NO: 189349 - DNA, 23 bp, Mus musculus
gtcacactctgtttctacaaagt

SEQ ID NO: 189350 - DNA, 22 bp, Mus musculus
aggtccaagtgctacacttggg

SEQ ID NO: 189351 - DNA, 22 bp, Mus musculus
tgaagtgtgtcatgactgtgtg

SEQ ID NO: 189352 - DNA, 23 bp, Mus musculus
taagagtctccctctgtgtctgc

SEQ ID NO: 189353 - DNA, 21 bp, Mus musculus
agtgaacatgctgagcagatg

SEQ ID NO: 189354 - DNA, 21 bp, Mus musculus
atgtatgtgtgcatatgtgtg

SEQ ID NO: 189355 - DNA, 18 bp, Mus musculus
tgagttaagtgtgtgtgg

SEQ ID NO: 189356 - DNA, 20 bp, Mus musculus
ttcttcttcacagtgctggt

SEQ ID NO: 189357 - DNA, 23 bp, Mus musculus
tgttcctcacacagcttctggga

SEQ ID NO: 189358 - DNA, 23 bp, Mus musculus
tctgcatgtatgtatgtatgtat

SEQ ID NO: 189359 - DNA, 22 bp, Mus musculus
tatgtgcaccatgtgcatgcag

SEQ ID NO: 189360 - DNA, 23 bp, Mus musculus
atttcttcactgtctgccatgga

SEQ ID NO: 189361 - DNA, 22 bp, Mus musculus
taagccagggagactgtgaagt

SEQ ID NO: 189362 - DNA, 22 bp, Mus musculus
ttattgagtcattttgttgaat

SEQ ID NO: 189363 - DNA, 20 bp, Mus musculus
ttgaaacattaccaaagtga

SEQ ID NO: 189364 - DNA, 22 bp, Mus musculus
acaagaaagtcagcagtcagaa

SEQ ID NO: 189365 - DNA, 23 bp, Mus musculus
ttgatgagtggaaagttgtgagg

SEQ ID NO: 189366 - DNA, 20 bp, Mus musculus
atgtatgtatgcttgtgtgt

SEQ ID NO: 189367 - DNA, 23 bp, Mus musculus
tctatgtatgtatgtatgtatgt

SEQ ID NO: 189368 - DNA, 23 bp, Mus musculus
gttgatacaagctgtcttagtta

SEQ ID NO: 189369 - DNA, 23 bp, Mus musculus
tgtgtgtgtgtttgcatgtgtat

SEQ ID NO: 189370 - DNA, 23 bp, Mus musculus
tatgtgtgtctatatacgtgtgt

SEQ ID NO: 189371 - DNA, 23 bp, Mus musculus
tgtacatgtatgtatatatgtat

SEQ ID NO: 189372 - DNA, 23 bp, Mus musculus
tgtatgtatatacatgtatatgg

SEQ ID NO: 189373 - DNA, 23 bp, Mus musculus
atgtctgtcaggcattttcttaa

SEQ ID NO: 189374 - DNA, 22 bp, Mus musculus
gggtcttgaagagataagagat

SEQ ID NO: 189375 - DNA, 21 bp, Mus musculus
tatgcatgtatgtatatatgt

SEQ ID NO: 189376 - DNA, 23 bp, Mus musculus
atatgcatatgtatatgtgtgtg

SEQ ID NO: 189377 - DNA, 23 bp, Mus musculus
gactctgtgtgcatgtgcatgtg

SEQ ID NO: 189378 - DNA, 19 bp, Mus musculus
gagggagagagagagagag

SEQ ID NO: 189379 - DNA, 19 bp, Mus musculus
agactccaggagcagggca

SEQ ID NO: 189380 - DNA, 20 bp, Mus musculus
cagagatgagagagtccaca

SEQ ID NO: 189381 - DNA, 20 bp, Mus musculus
tgtgcatatgtatatatggt

SEQ ID NO: 189382 - DNA, 21 bp, Mus musculus
gtgtgtatgtatgtgtatatg

SEQ ID NO: 189383 - DNA, 23 bp, Mus musculus
atgttacacatatacatatgtgt

SEQ ID NO: 189384 - DNA, 23 bp, Mus musculus
tgtgtgaatatgtatgtgtttgc

SEQ ID NO: 189385 - DNA, 21 bp, Mus musculus
acatatgtatttgtatatgtg

SEQ ID NO: 189386 - DNA, 22 bp, Mus musculus
tgttttgtgaccaattatatgg

SEQ ID NO: 189387 - DNA, 18 bp, Mus musculus
tgtgtacatacctgtatc

SEQ ID NO: 189388 - DNA, 23 bp, Mus musculus
tatatgtatctgtatacatgtca

SEQ ID NO: 189389 - DNA, 23 bp, Mus musculus
tgtatatgcatgtatatacatag

SEQ ID NO: 189390 - DNA, 22 bp, Mus musculus
agtgtgcatatatatacatata

SEQ ID NO: 189391 - DNA, 21 bp, Mus musculus
tgtctagtgtatgtgtgttct

SEQ ID NO: 189392 - DNA, 22 bp, Mus musculus
agggcctgaagtttgctgaatg

SEQ ID NO: 189393 - DNA, 22 bp, Mus musculus
tatgcatgcatgtgtgcatgta

SEQ ID NO: 189394 - DNA, 23 bp, Mus musculus
atttgtgtatacatgtatatgta

SEQ ID NO: 189395 - DNA, 23 bp, Mus musculus
atgtatatgtatatgtatatgta

SEQ ID NO: 189396 - DNA, 23 bp, Mus musculus
atgtatatgtacatgtacatgta

SEQ ID NO: 189397 - DNA, 19 bp, Mus musculus
agctatttagacaggagga

SEQ ID NO: 189398 - DNA, 23 bp, Mus musculus
tccctgactctcaaggttgtatc

SEQ ID NO: 189399 - DNA, 18 bp, Mus musculus
tgtgcaagagtctgtgtg

SEQ ID NO: 189400 - DNA, 21 bp, Mus musculus
agtgcatgcatgcctttgtgt

SEQ ID NO: 189401 - DNA, 21 bp, Mus musculus
gcagagagaaatgactgaagc

SEQ ID NO: 189402 - DNA, 21 bp, Mus musculus
aggaagattttctgtatcctt

SEQ ID NO: 189403 - DNA, 21 bp, Mus musculus
actgacaaagcaggaagttga

SEQ ID NO: 189404 - DNA, 23 bp, Mus musculus
tctctgggtcagtgtctgaggtg

SEQ ID NO: 189405 - DNA, 23 bp, Mus musculus
tgtgtgtctcactgggtgtagct

SEQ ID NO: 189406 - DNA, 23 bp, Mus musculus
gcattgttctctgaattgtatgt

SEQ ID NO: 189407 - DNA, 23 bp, Mus musculus
ctgggtctgtctgtctgtctgtc

SEQ ID NO: 189408 - DNA, 23 bp, Mus musculus
actctgcctctctcggtcccaga

SEQ ID NO: 189409 - DNA, 21 bp, Mus musculus
atatgtatgtatatatacatg

SEQ ID NO: 189410 - DNA, 23 bp, Mus musculus
cttgtctctctctctctgaaggc

SEQ ID NO: 189411 - DNA, 23 bp, Mus musculus
atctagacacacaggttaggttc

SEQ ID NO: 189412 - DNA, 23 bp, Mus musculus
ctgtgtctgtctgtgactgcctc

SEQ ID NO: 189413 - DNA, 21 bp, Mus musculus
gatgacagaagactgtgggaa

SEQ ID NO: 189414 - DNA, 23 bp, Mus musculus
cacacacttctcttgtcactgct

SEQ ID NO: 189415 - DNA, 23 bp, Mus musculus
tccctgtgtctgtttgttttatc

SEQ ID NO: 189416 - DNA, 20 bp, Mus musculus
catcagctgcggcacctgaa

SEQ ID NO: 189417 - DNA, 23 bp, Mus musculus
agagcactgactgctcttccaga

SEQ ID NO: 189418 - DNA, 23 bp, Mus musculus
agcactctgtcagtctgtctgcc

SEQ ID NO: 189419 - DNA, 23 bp, Mus musculus
ggtgacagtctgctcttgtcact

SEQ ID NO: 189420 - DNA, 23 bp, Mus musculus
gggtgggtgggtcagttcatgtg

SEQ ID NO: 189421 - DNA, 23 bp, Mus musculus
atggcaggatgtgtgtgtgcagt

SEQ ID NO: 189422 - DNA, 22 bp, Mus musculus
tcagagagttcagacagtgcac

SEQ ID NO: 189423 - DNA, 23 bp, Mus musculus
ctctaactcagtggttctcaacc

SEQ ID NO: 189424 - DNA, 21 bp, Mus musculus
tatatgcatgagtaggtaatt

SEQ ID NO: 189425 - DNA, 23 bp, Mus musculus
tattgttatcctgctctacatat

SEQ ID NO: 189426 - DNA, 18 bp, Mus musculus
atcttgttacacagctac

SEQ ID NO: 189427 - DNA, 21 bp, Mus musculus
tatatgtatatgtatacatat

SEQ ID NO: 189428 - DNA, 23 bp, Mus musculus
ggaagagaaattttattgaggtg

SEQ ID NO: 189429 - DNA, 23 bp, Mus musculus
agtcctaatcttgtcatgctctg

SEQ ID NO: 189430 - DNA, 23 bp, Mus musculus
gtatatgtgtatgtgtatatgtg

SEQ ID NO: 189431 - DNA, 20 bp, Mus musculus
ttacattttatgtatacatg

SEQ ID NO: 189432 - DNA, 21 bp, Mus musculus
tgtgtgtctgtgtgtgtgcaa

SEQ ID NO: 189433 - DNA, 23 bp, Mus musculus
tttgtgtctctgtgtgtatgtat

SEQ ID NO: 189434 - DNA, 19 bp, Mus musculus
tatatgtatgcaggtatat

SEQ ID NO: 189435 - DNA, 18 bp, Mus musculus
atctgtctgacccactgg

SEQ ID NO: 189436 - DNA, 18 bp, Mus musculus
cagctcaaaaccatctgt

SEQ ID NO: 189437 - DNA, 23 bp, Mus musculus
tttgtacatgtgtgtgtgtatgt

SEQ ID NO: 189438 - DNA, 23 bp, Mus musculus
tttgtacatgtgtgtgtgtatgt

SEQ ID NO: 189439 - DNA, 23 bp, Mus musculus
tgagttcaagtctcagcaaccac

SEQ ID NO: 189440 - DNA, 19 bp, Mus musculus
tatttttgaagctttggta

SEQ ID NO: 189441 - DNA, 19 bp, Mus musculus
tatatggtcaattttggag

SEQ ID NO: 189442 - DNA, 23 bp, Mus musculus
tgtcaggctctgtcagagcctct

SEQ ID NO: 189443 - DNA, 23 bp, Mus musculus
gactgcatgcatgtctgtgtgag

SEQ ID NO: 189444 - DNA, 23 bp, Mus musculus
taattgtgtttgtacatgtgagt

SEQ ID NO: 189445 - DNA, 23 bp, Mus musculus
tctctgtgtgatagtttacagag

SEQ ID NO: 189446 - DNA, 18 bp, Mus musculus
tgtgtatgtatatatatg

SEQ ID NO: 189447 - DNA, 23 bp, Mus musculus
agaagagatgttcctcctggctg

SEQ ID NO: 189448 - DNA, 23 bp, Mus musculus
taagagagactctttctggttgc

SEQ ID NO: 189449 - DNA, 23 bp, Mus musculus
tcagagattactgattgcagata

SEQ ID NO: 189450 - DNA, 23 bp, Mus musculus
tgccctgtctctgtctctgagtg

SEQ ID NO: 189451 - DNA, 23 bp, Mus musculus
ctacgtgtctgtctgtctgtatg

SEQ ID NO: 189452 - DNA, 23 bp, Mus musculus
aatttttaagttgttattgtcat

SEQ ID NO: 189453 - DNA, 23 bp, Mus musculus
atacaacctactgagtctgtttt

SEQ ID NO: 189454 - DNA, 20 bp, Mus musculus
ctctctctctctctctctct

SEQ ID NO: 189455 - DNA, 21 bp, Mus musculus
atatacacagagacatatgtg

SEQ ID NO: 189456 - DNA, 19 bp, Mus musculus
tctgtgctgtgctctttgg

SEQ ID NO: 189457 - DNA, 20 bp, Mus musculus
ctctgtgctgtgtctctctc

SEQ ID NO: 189458 - DNA, 23 bp, Mus musculus
gtatgtgcaagtgcatgtgcaca

SEQ ID NO: 189459 - DNA, 20 bp, Mus musculus
agtacatgagattgagcctg

SEQ ID NO: 189460 - DNA, 23 bp, Mus musculus
tctctggctcagtctcattattg

SEQ ID NO: 189461 - DNA, 23 bp, Mus musculus
tatttgtgtgcatatctatatgt

SEQ ID NO: 189462 - DNA, 23 bp, Mus musculus
tatatgtgcatctatatgcacat

SEQ ID NO: 189463 - DNA, 21 bp, Mus musculus
tgtgtcgctccctgattggct

SEQ ID NO: 189464 - DNA, 18 bp, Mus musculus
gtatgtatgtatgtatgt

SEQ ID NO: 189465 - DNA, 23 bp, Mus musculus
taagagcactgactgctcttcca

SEQ ID NO: 189466 - DNA, 20 bp, Mus musculus
atgtgtatatatatatatgt

SEQ ID NO: 189467 - DNA, 23 bp, Mus musculus
tgtatatatgtatgtgtatatgt

SEQ ID NO: 189468 - DNA, 22 bp, Mus musculus
atatgtgtgtgtatgtacacag

SEQ ID NO: 189469 - DNA, 23 bp, Mus musculus
tgtctgtctgtctgtctgtctgt

SEQ ID NO: 189470 - DNA, 23 bp, Mus musculus
tcaggctctgtctgtgtttgccc

SEQ ID NO: 189471 - DNA, 21 bp, Mus musculus
gagagatgacagagagacaga

SEQ ID NO: 189472 - DNA, 23 bp, Mus musculus
taagagcactgactgctcttcct

SEQ ID NO: 189473 - DNA, 23 bp, Mus musculus
gggtgtcactgccagggtgtctt

SEQ ID NO: 189474 - DNA, 19 bp, Mus musculus
tgtgcaatgaagaggggtg

SEQ ID NO: 189475 - DNA, 23 bp, Mus musculus
tctgtctgtctgcctgtctctct

SEQ ID NO: 189476 - DNA, 18 bp, Mus musculus
acacacatacatacatgt

SEQ ID NO: 189477 - DNA, 21 bp, Mus musculus
tcactggggataggctttgag

SEQ ID NO: 189478 - DNA, 20 bp, Mus musculus
agactcacagcgttcctagt

SEQ ID NO: 189479 - DNA, 22 bp, Mus musculus
tctcagtctgtcttttatgtgt

SEQ ID NO: 189480 - DNA, 23 bp, Mus musculus
acatctctctctctctgtccaca

SEQ ID NO: 189481 - DNA, 23 bp, Mus musculus
gatgctctgtgcctgtgtgtctc

SEQ ID NO: 189482 - DNA, 22 bp, Mus musculus
atcagtcgccctgtatacttgg

SEQ ID NO: 189483 - DNA, 21 bp, Mus musculus
tcagaaggctcagagctcagg

SEQ ID NO: 189484 - DNA, 19 bp, Mus musculus
cagtcaagagcctaggaga

SEQ ID NO: 189485 - DNA, 21 bp, Mus musculus
tccatgtcagttaatgaagcc

SEQ ID NO: 189486 - DNA, 23 bp, Mus musculus
acactgtatgtcagaggtaaagt

SEQ ID NO: 189487 - DNA, 23 bp, Mus musculus
ctgtctctctctgtatctggact

SEQ ID NO: 189488 - DNA, 23 bp, Mus musculus
tgatctctgtgagtttgagccag

SEQ ID NO: 189489 - DNA, 22 bp, Mus musculus
tgagtccagagtgaccagagtg

SEQ ID NO: 189490 - DNA, 23 bp, Mus musculus
gtctgcctgtctgtgtgtctggg

SEQ ID NO: 189491 - DNA, 21 bp, Mus musculus
ttcacagtgatgtacctgcac

SEQ ID NO: 189492 - DNA, 21 bp, Mus musculus
agactgatctctgtgagctca

SEQ ID NO: 189493 - DNA, 23 bp, Mus musculus
ctatctgtcacccactcagtgtg

SEQ ID NO: 189494 - DNA, 20 bp, Mus musculus
ccaggcagtgccagtcctga

SEQ ID NO: 189495 - DNA, 23 bp, Mus musculus
gctggctgggtcactgtttgcct

SEQ ID NO: 189496 - DNA, 22 bp, Mus musculus
gacagacagacagacaggcagg

SEQ ID NO: 189497 - DNA, 23 bp, Mus musculus
ctagtagctgtggctgtgtagtt

SEQ ID NO: 189498 - DNA, 23 bp, Mus musculus
tgcgcgtgtgttttacatgtcta

SEQ ID NO: 189499 - DNA, 23 bp, Mus musculus
tgtttgcaaatgtatgtgtttgt

SEQ ID NO: 189500 - DNA, 23 bp, Mus musculus
tcacgggttcatgttcagctagc

SEQ ID NO: 189501 - DNA, 23 bp, Mus musculus
actgcctgcctgtctgcctgcct

SEQ ID NO: 189502 - DNA, 18 bp, Mus musculus
aggaaaaaaagagctgtg

SEQ ID NO: 189503 - DNA, 18 bp, Mus musculus
tgtgttgacactaactct

SEQ ID NO: 189504 - DNA, 20 bp, Mus musculus
tttctgcctcagagtctcgg

SEQ ID NO: 189505 - DNA, 21 bp, Mus musculus
aaaggaggctgagcaagccat

SEQ ID NO: 189506 - DNA, 23 bp, Mus musculus
ctctgccacggtctctctgtcag

SEQ ID NO: 189507 - DNA, 23 bp, Mus musculus
gaacttctctgagcctctgtttc

SEQ ID NO: 189508 - DNA, 23 bp, Mus musculus
aaatgtgagtgtgtacatgtatg

SEQ ID NO: 189509 - DNA, 21 bp, Mus musculus
atgtatgcgtgcatgtgcatg

SEQ ID NO: 189510 - DNA, 23 bp, Mus musculus
tgagatgactttgtagtgctgac

SEQ ID NO: 189511 - DNA, 22 bp, Mus musculus
acacatacatactaactgacat

SEQ ID NO: 189512 - DNA, 21 bp, Mus musculus
tgtctgacagctacagtgtac

SEQ ID NO: 189513 - DNA, 23 bp, Mus musculus
taagtacactgtggctgtcttca

SEQ ID NO: 189514 - DNA, 23 bp, Mus musculus
ccctgtctctgtctctgaagacc

SEQ ID NO: 189515 - DNA, 23 bp, Mus musculus
tgtatatatgtatgttatatatg

SEQ ID NO: 189516 - DNA, 19 bp, Mus musculus
atacacacatgtatatatg

SEQ ID NO: 189517 - DNA, 23 bp, Mus musculus
agagcagactctcactgcctcag

SEQ ID NO: 189518 - DNA, 21 bp, Mus musculus
tccatggtggtctgataggat

SEQ ID NO: 189519 - DNA, 22 bp, Mus musculus
tgttttgtgaccaattatatgg

SEQ ID NO: 189520 - DNA, 23 bp, Mus musculus
cattgctgaccctctgtgtctct

SEQ ID NO: 189521 - DNA, 21 bp, Mus musculus
ttaagagcacagagtgctctt

SEQ ID NO: 189522 - DNA, 22 bp, Mus musculus
tgttttgtgaccaattatatgg

SEQ ID NO: 189523 - DNA, 23 bp, Mus musculus
tatatgtatatgtatatgtatat

SEQ ID NO: 189524 - DNA, 23 bp, Mus musculus
aaatgatcttcaggagctaagct

SEQ ID NO: 189525 - DNA, 23 bp, Mus musculus
ttgaactcagactctcagacttt

SEQ ID NO: 189526 - DNA, 18 bp, Mus musculus
aggtgggtagagggtgtg

SEQ ID NO: 189527 - DNA, 23 bp, Mus musculus
acacagactgcctctctctggct

SEQ ID NO: 189528 - DNA, 20 bp, Mus musculus
gagatgatcgtgaagtctgt

SEQ ID NO: 189529 - DNA, 21 bp, Mus musculus
cagctgagtagtgagtcgcca

SEQ ID NO: 189530 - DNA, 23 bp, Mus musculus
tcgctcgctcgctcgctcactcg

SEQ ID NO: 189531 - DNA, 23 bp, Mus musculus
tcaactgtatttcttcatgagag

SEQ ID NO: 189532 - DNA, 23 bp, Mus musculus
agtggaactgctattagacaggg

SEQ ID NO: 189533 - DNA, 23 bp, Mus musculus
tgtctgtctgtctgtctgtctgt

SEQ ID NO: 189534 - DNA, 23 bp, Mus musculus
ccctcctctgtggctgtgttcag

SEQ ID NO: 189535 - DNA, 22 bp, Mus musculus
tatgtctggctttatattggtt

SEQ ID NO: 189536 - DNA, 21 bp, Mus musculus
agaccactggggctgcagaga

SEQ ID NO: 189537 - DNA, 23 bp, Mus musculus
ccacacacaggggctgcagagat

SEQ ID NO: 189538 - DNA, 21 bp, Mus musculus
cacataccagaagagggtgtc

SEQ ID NO: 189539 - DNA, 23 bp, Mus musculus
gctgagtgtctctgagtgtaggt

SEQ ID NO: 189540 - DNA, 20 bp, Mus musculus
tgtggctgagcctttgctga

SEQ ID NO: 189541 - DNA, 23 bp, Mus musculus
gccactctgcctgtccctcactt

SEQ ID NO: 189542 - DNA, 20 bp, Mus musculus
gtcagaagagagtgaccagt

SEQ ID NO: 189543 - DNA, 18 bp, Mus musculus
tgacactacagtggctgc

SEQ ID NO: 189544 - DNA, 23 bp, Mus musculus
ctggctcacactgtcagtgtgtg

SEQ ID NO: 189545 - DNA, 23 bp, Mus musculus
atgacagaagattgacagcactg

SEQ ID NO: 189546 - DNA, 23 bp, Mus musculus
agagactactcagtgtgcaaact

SEQ ID NO: 189547 - DNA, 21 bp, Mus musculus
tcactgaaacctacctgtgac

SEQ ID NO: 189548 - DNA, 23 bp, Mus musculus
cagaagacacagttgactcatgc

SEQ ID NO: 189549 - DNA, 23 bp, Mus musculus
tgtgtgtctgtgactctctctgt

SEQ ID NO: 189550 - DNA, 23 bp, Mus musculus
cacacactgtcacgctctgaact

SEQ ID NO: 189551 - DNA, 23 bp, Mus musculus
accgtctcacacactgtcacttc

SEQ ID NO: 189552 - DNA, 23 bp, Mus musculus
acacacagcacagtgtgcacact

SEQ ID NO: 189553 - DNA, 23 bp, Mus musculus
tctcagtcagtctctcagtctct

SEQ ID NO: 189554 - DNA, 18 bp, Mus musculus
agaggtttgtgtcaggtg

SEQ ID NO: 189555 - DNA, 23 bp, Mus musculus
atcactgactctctgacgctgtg

SEQ ID NO: 189556 - DNA, 23 bp, Mus musculus
tgtctgcctgcttgcctgcctgc

SEQ ID NO: 189557 - DNA, 23 bp, Mus musculus
gatggctctggaagaaatcacag

SEQ ID NO: 189558 - DNA, 21 bp, Mus musculus
agaggttagatgcatgcagag

SEQ ID NO: 189559 - DNA, 23 bp, Mus musculus
tgcctgcctgcctgtctgtgtgc

SEQ ID NO: 189560 - DNA, 21 bp, Mus musculus
atttgcagcagtggcagggtt

SEQ ID NO: 189561 - DNA, 23 bp, Mus musculus
tatgtgtatatatgtatatgtgt

SEQ ID NO: 189562 - DNA, 23 bp, Mus musculus
ctatgtgtgcaagtgtgtgtgtg

SEQ ID NO: 189563 - DNA, 21 bp, Mus musculus
tgtgtgtgtagacatgtgagt

SEQ ID NO: 189564 - DNA, 23 bp, Mus musculus
tgtgtctatatttgtatatgtgt

SEQ ID NO: 189565 - DNA, 20 bp, Mus musculus
tatatgtgtgtatatgtata

SEQ ID NO: 189566 - DNA, 22 bp, Mus musculus
tgttttgtgaccaattatatgg

SEQ ID NO: 189567 - DNA, 21 bp, Mus musculus
atatatgtacatatccataca

SEQ ID NO: 189568 - DNA, 23 bp, Mus musculus
ctgagagattagagtgtgcacct

SEQ ID NO: 189569 - DNA, 22 bp, Mus musculus
tgctcagattgcatcctgtagt

SEQ ID NO: 189570 - DNA, 21 bp, Mus musculus
ctgacaggaatgtgtgagcac

SEQ ID NO: 189571 - DNA, 23 bp, Mus musculus
ctctgtgtgtgtgtgtgtgcgcg

SEQ ID NO: 189572 - DNA, 22 bp, Mus musculus
ttctgagggaagttggctgggt

SEQ ID NO: 189573 - DNA, 22 bp, Mus musculus
tgttttgtgaccaattatatgg

SEQ ID NO: 189574 - DNA, 23 bp, Mus musculus
ctcagggtgtctctgtggctcag

SEQ ID NO: 189575 - DNA, 22 bp, Mus musculus
acacagtctttgtctctctgtt

SEQ ID NO: 189576 - DNA, 19 bp, Mus musculus
tcagagatcagggatgact

SEQ ID NO: 189577 - DNA, 23 bp, Mus musculus
ggctctgcctgtctgtgccccag

SEQ ID NO: 189578 - DNA, 20 bp, Mus musculus
actgagacatgtgaaggcac

SEQ ID NO: 189579 - DNA, 23 bp, Mus musculus
agtatgcctatgttaacctatgt

SEQ ID NO: 189580 - DNA, 20 bp, Mus musculus
tgtgtgtgcatgtccatgtg

SEQ ID NO: 189581 - DNA, 23 bp, Mus musculus
tgacacgctctctgtgagactat

SEQ ID NO: 189582 - DNA, 21 bp, Mus musculus
tgtcacactgttactgtctca

SEQ ID NO: 189583 - DNA, 22 bp, Mus musculus
acctggctctctcagtctctgc

SEQ ID NO: 189584 - DNA, 23 bp, Mus musculus
caggctctcactatgtgtctctg

SEQ ID NO: 189585 - DNA, 23 bp, Mus musculus
cagggtctctcactgaatctgga

SEQ ID NO: 189586 - DNA, 20 bp, Mus musculus
aagagcactgactgctcttc

SEQ ID NO: 189587 - DNA, 23 bp, Mus musculus
agacacgtgctagatggcttgta

SEQ ID NO: 189588 - DNA, 19 bp, Mus musculus
agagacaagagagtctgca

SEQ ID NO: 189589 - DNA, 19 bp, Mus musculus
gtagacccaagtgtttctc

SEQ ID NO: 189590 - DNA, 23 bp, Mus musculus
gctggttctgagctgtcctgtga

SEQ ID NO: 189591 - DNA, 23 bp, Mus musculus
tctgaagtgtgtgagctctgggg

SEQ ID NO: 189592 - DNA, 21 bp, Mus musculus
tgtcctgctctgtcactctct

SEQ ID NO: 189593 - DNA, 23 bp, Mus musculus
gctctcagtctgtgtgcctggct

SEQ ID NO: 189594 - DNA, 23 bp, Mus musculus
agtctctgtgtctgagaccagct

SEQ ID NO: 189595 - DNA, 23 bp, Mus musculus
tgggtgtgactcagtgtctgcct

SEQ ID NO: 189596 - DNA, 23 bp, Mus musculus
aacaacccaatacttcctctaat

SEQ ID NO: 189597 - DNA, 19 bp, Mus musculus
tcaggcccagtctctctct

SEQ ID NO: 189598 - DNA, 23 bp, Mus musculus
attgaggaaaatctgctggagta

SEQ ID NO: 189599 - DNA, 23 bp, Mus musculus
cacacactgtctgtctgtctgtc

SEQ ID NO: 189600 - DNA, 20 bp, Mus musculus
agtgtactcacatacgtgat

SEQ ID NO: 189601 - DNA, 21 bp, Mus musculus
acagtgtgcatagactaccac

SEQ ID NO: 189602 - DNA, 18 bp, Mus musculus
agttcaattctcagcaac

SEQ ID NO: 189603 - DNA, 22 bp, Mus musculus
atatatgtatatgtatatgtat

SEQ ID NO: 189604 - DNA, 22 bp, Mus musculus
tgtgcatgtatgtgcatgtgta

SEQ ID NO: 189605 - DNA, 22 bp, Mus musculus
acacacacatatatatgtgtat

SEQ ID NO: 189606 - DNA, 23 bp, Mus musculus
tatgtgtatctatgtgtatgtat

SEQ ID NO: 189607 - DNA, 23 bp, Mus musculus
ttgtctatctgtttgtttatttt

SEQ ID NO: 189608 - DNA, 23 bp, Mus musculus
tgtctgtcacactgacagttccc

SEQ ID NO: 189609 - DNA, 23 bp, Mus musculus
acagtctgactcagtggctgcgt

SEQ ID NO: 189610 - DNA, 19 bp, Mus musculus
gtgtgtctgtgtctgagtg

SEQ ID NO: 189611 - DNA, 22 bp, Mus musculus
aagctctaggttccaatctgag

SEQ ID NO: 189612 - DNA, 18 bp, Mus musculus
acagctggagatagctca

SEQ ID NO: 189613 - DNA, 23 bp, Mus musculus
tctctatgatcctgtgattctgg

SEQ ID NO: 189614 - DNA, 23 bp, Mus musculus
atgtatgtatgtatgtgtgtatg

SEQ ID NO: 189615 - DNA, 21 bp, Mus musculus
aaaagattagaagtaccccac

SEQ ID NO: 189616 - DNA, 23 bp, Mus musculus
ttactgcttttagtattcaatct

SEQ ID NO: 189617 - DNA, 23 bp, Mus musculus
tgaatttccacaggttgtcttct

SEQ ID NO: 189618 - DNA, 23 bp, Mus musculus
tgtctccctgtggctctgtctca

SEQ ID NO: 189619 - DNA, 23 bp, Mus musculus
actcactctagagactcacaatt

SEQ ID NO: 189620 - DNA, 23 bp, Mus musculus
tgtctgtctctgtgagttaagtc

SEQ ID NO: 189621 - DNA, 23 bp, Mus musculus
atgaagctagaataggatattaa

SEQ ID NO: 189622 - DNA, 23 bp, Mus musculus
tgtctatgtctctgacacagtgc

SEQ ID NO: 189623 - DNA, 22 bp, Mus musculus
aaaggacttcagcaactgatga

SEQ ID NO: 189624 - DNA, 23 bp, Mus musculus
aacagtgcagttatgagggttgc

SEQ ID NO: 189625 - DNA, 23 bp, Mus musculus
tctctgcctctctgcctctgcct

SEQ ID NO: 189626 - DNA, 21 bp, Mus musculus
tacagcttggtcttcatttgg

SEQ ID NO: 189627 - DNA, 23 bp, Mus musculus
gcagttgtaaagtcactgtgtgg

SEQ ID NO: 189628 - DNA, 23 bp, Mus musculus
tcagctagtgccttctattgttc

SEQ ID NO: 189629 - DNA, 23 bp, Mus musculus
ggttcactctctcggagtctggc

SEQ ID NO: 189630 - DNA, 23 bp, Mus musculus
gaactgtcagccacagtctcact

SEQ ID NO: 189631 - DNA, 18 bp, Mus musculus
tccctctgacagtgagct

SEQ ID NO: 189632 - DNA, 22 bp, Mus musculus
ctgtcctagaacttactgtaga

SEQ ID NO: 189633 - DNA, 19 bp, Mus musculus
gcacacctccagcagcaga

SEQ ID NO: 189634 - DNA, 23 bp, Mus musculus
acaaccatctgtaatgggatctg

SEQ ID NO: 189635 - DNA, 21 bp, Mus musculus
agtggaaggttctagatgtct

SEQ ID NO: 189636 - DNA, 22 bp, Mus musculus
atctccatccattagatgcaga

SEQ ID NO: 189637 - DNA, 23 bp, Mus musculus
gtggagagagaggacagtctgtg

SEQ ID NO: 189638 - DNA, 23 bp, Mus musculus
ggagggactctctgtggctcagc

SEQ ID NO: 189639 - DNA, 21 bp, Mus musculus
ccctgactgctcttccagagg

SEQ ID NO: 189640 - DNA, 23 bp, Mus musculus
agaattcacaggcagttttgagc

SEQ ID NO: 189641 - DNA, 23 bp, Mus musculus
ctgtgcaactctcctgttgaatg

SEQ ID NO: 189642 - DNA, 22 bp, Mus musculus
cagtctgaggtgagcctgctgg

SEQ ID NO: 189643 - DNA, 23 bp, Mus musculus
ttttagatgttctattgatcata

SEQ ID NO: 189644 - DNA, 22 bp, Mus musculus
tgaaatgatagtttatttactt

SEQ ID NO: 189645 - DNA, 18 bp, Mus musculus
ttataaggttagtgagca

SEQ ID NO: 189646 - DNA, 20 bp, Mus musculus
tttgctcttgggctggagag

SEQ ID NO: 189647 - DNA, 23 bp, Mus musculus
accatagcatctgtgtctctctg

SEQ ID NO: 189648 - DNA, 21 bp, Mus musculus
tatgtatgtatgtagtattga

SEQ ID NO: 189649 - DNA, 21 bp, Mus musculus
tcggacagggagagatcaggc

SEQ ID NO: 189650 - DNA, 23 bp, Mus musculus
atgaatgtgtgcatgtatttttc

SEQ ID NO: 189651 - DNA, 20 bp, Mus musculus
tgtgatgtctgggaccagct

SEQ ID NO: 189652 - DNA, 23 bp, Mus musculus
ctgcgtgtctgtgtgtgtctgtg

SEQ ID NO: 189653 - DNA, 22 bp, Mus musculus
tgtgcgtgtgtgtaattttcct

SEQ ID NO: 189654 - DNA, 19 bp, Mus musculus
gagttgtggtttggctgga

SEQ ID NO: 189655 - DNA, 22 bp, Mus musculus
cggggtctctctgagcctgagc

SEQ ID NO: 189656 - DNA, 23 bp, Mus musculus
atgtgtgcatatatgtgtgtgtg

SEQ ID NO: 189657 - DNA, 21 bp, Mus musculus
atatgtatatatgttctagta

SEQ ID NO: 189658 - DNA, 19 bp, Mus musculus
cttctgtgtcttaattctt

SEQ ID NO: 189659 - DNA, 23 bp, Mus musculus
ctgtctgtctgtctgtctgcctg

SEQ ID NO: 189660 - DNA, 23 bp, Mus musculus
cagtccctgtgtcacaggctgag

SEQ ID NO: 189661 - DNA, 23 bp, Mus musculus
ctgatcagacagctgctgagtta

SEQ ID NO: 189662 - DNA, 22 bp, Mus musculus
tgccagaagagaaagtgctgag

SEQ ID NO: 189663 - DNA, 23 bp, Mus musculus
ttattctgtctgcttttcctgag

SEQ ID NO: 189664 - DNA, 22 bp, Mus musculus
tatgtttatctatatctcactc

SEQ ID NO: 189665 - DNA, 20 bp, Mus musculus
agagggtaatggcaatggat

SEQ ID NO: 189666 - DNA, 21 bp, Mus musculus
aatatctcagtgtctgttctc

SEQ ID NO: 189667 - DNA, 20 bp, Mus musculus
atgacagaagttggatgggt

SEQ ID NO: 189668 - DNA, 21 bp, Mus musculus
atctggatcttctatgtcttg

SEQ ID NO: 189669 - DNA, 18 bp, Mus musculus
aaacaccatgacccagag

SEQ ID NO: 189670 - DNA, 21 bp, Mus musculus
tgtgggactgagtctgtgggg

SEQ ID NO: 189671 - DNA, 21 bp, Mus musculus
ttgctgagagatctaaacagt

SEQ ID NO: 189672 - DNA, 23 bp, Mus musculus
gtatgtatgtatgtatgtgtgtg

SEQ ID NO: 189673 - DNA, 19 bp, Mus musculus
tctgtctgtgtgtgtgtcc

SEQ ID NO: 189674 - DNA, 23 bp, Mus musculus
gcctggctggctggctgagtgac

SEQ ID NO: 189675 - DNA, 23 bp, Mus musculus
acatacacacacacatatatatg

SEQ ID NO: 189676 - DNA, 20 bp, Mus musculus
ctactttacacagctgctgt

SEQ ID NO: 189677 - DNA, 23 bp, Mus musculus
aaattggaagtactttgtggctt

SEQ ID NO: 189678 - DNA, 22 bp, Mus musculus
tcttctctctgccacctgctga

SEQ ID NO: 189679 - DNA, 20 bp, Mus musculus
agcatatgtgtgtatacagt

SEQ ID NO: 189680 - DNA, 23 bp, Mus musculus
atatgtatgcatatatgtatgta

SEQ ID NO: 189681 - DNA, 20 bp, Mus musculus
aagagcactgactgctcttc

SEQ ID NO: 189682 - DNA, 23 bp, Mus musculus
gatagaactgacagaccacttct

SEQ ID NO: 189683 - DNA, 23 bp, Mus musculus
atatatgaatatatatatgtgag

SEQ ID NO: 189684 - DNA, 23 bp, Mus musculus
ccctagagaggagatagtgagga

SEQ ID NO: 189685 - DNA, 23 bp, Mus musculus
actggacagaagtgtgtgagggc

SEQ ID NO: 189686 - DNA, 22 bp, Mus musculus
atgaggaatttttctggtcatg

SEQ ID NO: 189687 - DNA, 23 bp, Mus musculus
tagtgcatggtgatctgatagaa

SEQ ID NO: 189688 - DNA, 22 bp, Mus musculus
tgttttgtgacctattatgtgg

SEQ ID NO: 189689 - DNA, 23 bp, Mus musculus
tgagcctgtctctctcacacctt

SEQ ID NO: 189690 - DNA, 23 bp, Mus musculus
tagtgcatggtgatctgatagga

SEQ ID NO: 189691 - DNA, 22 bp, Mus musculus
tgttttgtgacctattatgtgg

SEQ ID NO: 189692 - DNA, 23 bp, Mus musculus
tctatgtctctgtcactctttcc

SEQ ID NO: 189693 - DNA, 21 bp, Mus musculus
tttgagtggcagttttcatgg

SEQ ID NO: 189694 - DNA, 22 bp, Mus musculus
tttgagtggcagttttcatggt

SEQ ID NO: 189695 - DNA, 22 bp, Mus musculus
tgttttgtgaccaattatatgg

SEQ ID NO: 189696 - DNA, 23 bp, Mus musculus
tgtgtctctgggtctcaacttgc

SEQ ID NO: 189697 - DNA, 23 bp, Mus musculus
tctgtaggtaatgtgtgtgttgt

SEQ ID NO: 189698 - DNA, 22 bp, Mus musculus
tctgtgcttcctacttccagtc

SEQ ID NO: 189699 - DNA, 20 bp, Mus musculus
ccatggtgatctgataggat

SEQ ID NO: 189700 - DNA, 23 bp, Mus musculus
gtatatgttgaagcttgttttgt

SEQ ID NO: 189701 - DNA, 19 bp, Mus musculus
agataactcattagcatgg

SEQ ID NO: 189702 - DNA, 23 bp, Mus musculus
gtttttaatgctatgtgactggt

SEQ ID NO: 189703 - DNA, 23 bp, Mus musculus
tgaggttgttggttctctccttc

SEQ ID NO: 189704 - DNA, 23 bp, Mus musculus
tatgtctgtgtccctctgtgtgt

SEQ ID NO: 189705 - DNA, 23 bp, Mus musculus
agtgtgtatgtatgtatgtgtgt

SEQ ID NO: 189706 - DNA, 23 bp, Mus musculus
tatatgtgcatgtgcatgtgtgt

SEQ ID NO: 189707 - DNA, 22 bp, Mus musculus
tggtgctggagatggttcagag

SEQ ID NO: 189708 - DNA, 19 bp, Mus musculus
tcagaggcctacagctgag

SEQ ID NO: 189709 - DNA, 22 bp, Mus musculus
tcactctctctatcttagttgt

SEQ ID NO: 189710 - DNA, 23 bp, Mus musculus
acagatgacagagatacgtgttc

SEQ ID NO: 189711 - DNA, 20 bp, Mus musculus
atttttcttctcctttgctt

SEQ ID NO: 189712 - DNA, 22 bp, Mus musculus
ttgtacctgatctagccattca

SEQ ID NO: 189713 - DNA, 21 bp, Mus musculus
aggtagggtgtgaccgtgtct

SEQ ID NO: 189714 - DNA, 23 bp, Mus musculus
tgatgataatggactgaacctct

SEQ ID NO: 189715 - DNA, 23 bp, Mus musculus
agagttgccttggtcatggtgtc

SEQ ID NO: 189716 - DNA, 23 bp, Mus musculus
tgagagtagatagaaagctgtag

SEQ ID NO: 189717 - DNA, 22 bp, Mus musculus
tgactcagtggttaagaggact

SEQ ID NO: 189718 - DNA, 23 bp, Mus musculus
tttaactggagatgtatgcatgt

SEQ ID NO: 189719 - DNA, 23 bp, Mus musculus
gtctgtctgtctgtctgtgtcct

SEQ ID NO: 189720 - DNA, 23 bp, Mus musculus
atgtatgtatgtatgtatgtatg

SEQ ID NO: 189721 - DNA, 23 bp, Mus musculus
atatgtgtatatgtatatgtgtg

SEQ ID NO: 189722 - DNA, 23 bp, Mus musculus
atgtctctgtgtatatgtatgtg

SEQ ID NO: 189723 - DNA, 18 bp, Mus musculus
tatgtgtgggtatgtatg

SEQ ID NO: 189724 - DNA, 23 bp, Mus musculus
atatgtgtatatgtatatgtgtg

SEQ ID NO: 189725 - DNA, 23 bp, Mus musculus
tacagtctctcgttgtctgtgtg

SEQ ID NO: 189726 - DNA, 23 bp, Mus musculus
ggcactgactgctcttccagagg

SEQ ID NO: 189727 - DNA, 23 bp, Mus musculus
taagagcactgactgctcttcca

SEQ ID NO: 189728 - DNA, 23 bp, Mus musculus
tgtgtgtatctctctctcccacc

SEQ ID NO: 189729 - DNA, 23 bp, Mus musculus
agagagatgtgagtgagatatag

SEQ ID NO: 189730 - DNA, 23 bp, Mus musculus
tggaacagaagacagaaagctca

SEQ ID NO: 189731 - DNA, 21 bp, Mus musculus
ttttgaaaacaggatcttgta

SEQ ID NO: 189732 - DNA, 21 bp, Mus musculus
tgtctgtctgtctgtctgtct

SEQ ID NO: 189733 - DNA, 18 bp, Mus musculus
tgagttctgccaggtcca

SEQ ID NO: 189734 - DNA, 20 bp, Mus musculus
tgactagatttgtgggtaag

SEQ ID NO: 189735 - DNA, 23 bp, Mus musculus
gcctcactcacactctgagagcc

SEQ ID NO: 189736 - DNA, 22 bp, Mus musculus
agactctctctctctcttacac

SEQ ID NO: 189737 - DNA, 23 bp, Mus musculus
atcagactgtagagatggcttcg

SEQ ID NO: 189738 - DNA, 20 bp, Mus musculus
tgactcagaggttaagagcg

SEQ ID NO: 189739 - DNA, 23 bp, Mus musculus
agagcaaggtagtatgacactaa

SEQ ID NO: 189740 - DNA, 23 bp, Mus musculus
agttctacatcttgttctgaaga

SEQ ID NO: 189741 - DNA, 23 bp, Mus musculus
cttgggctgagaatatcgagttg

SEQ ID NO: 189742 - DNA, 23 bp, Mus musculus
atgagggacattatgaagctctg

SEQ ID NO: 189743 - DNA, 23 bp, Mus musculus
tgctagtgttgtgaaatgcatca

SEQ ID NO: 189744 - DNA, 20 bp, Mus musculus
atgcatgtgtgcttgtgtgt

SEQ ID NO: 189745 - DNA, 20 bp, Mus musculus
tgtgtatatatgcgtgtgca

SEQ ID NO: 189746 - DNA, 23 bp, Mus musculus
gtgtatgtctgtgtgtctgtgtg

SEQ ID NO: 189747 - DNA, 19 bp, Mus musculus
tgagttttatctttgaagt

SEQ ID NO: 189748 - DNA, 23 bp, Mus musculus
gcgcactgactgctcttccagag

SEQ ID NO: 189749 - DNA, 18 bp, Mus musculus
tctgtctgcctctctgcc

SEQ ID NO: 189750 - DNA, 19 bp, Mus musculus
tcacagctgaggctgggaa

SEQ ID NO: 189751 - DNA, 23 bp, Mus musculus
atgtgtgtgtatatatgtatgta

SEQ ID NO: 189752 - DNA, 23 bp, Mus musculus
ccgtgtgcttttcttctgatcat

SEQ ID NO: 189753 - DNA, 23 bp, Mus musculus
tctctttggtaatcaaggtgact

SEQ ID NO: 189754 - DNA, 21 bp, Mus musculus
aacacagaagtgtgtgatcac

SEQ ID NO: 189755 - DNA, 23 bp, Mus musculus
agaaggtcgtctttaactctgtg

SEQ ID NO: 189756 - DNA, 23 bp, Mus musculus
tgtctgtctttctgtgcctggct

SEQ ID NO: 189757 - DNA, 22 bp, Mus musculus
atgaaggattacaaggacctga

SEQ ID NO: 189758 - DNA, 22 bp, Mus musculus
aataactggttctcctaaccat

SEQ ID NO: 189759 - DNA, 23 bp, Mus musculus
tcactgtgactttactgagcctc

SEQ ID NO: 189760 - DNA, 21 bp, Mus musculus
agaagtggatcagatccccta

SEQ ID NO: 189761 - DNA, 22 bp, Mus musculus
accacgcttctctgtctgtcat

SEQ ID NO: 189762 - DNA, 19 bp, Mus musculus
atttggttctgtgtcccgc

SEQ ID NO: 189763 - DNA, 22 bp, Mus musculus
aacagtgggttgaagttgtgtg

SEQ ID NO: 189764 - DNA, 23 bp, Mus musculus
tgcctcagtctctgtctccatgc

SEQ ID NO: 189765 - DNA, 23 bp, Mus musculus
tgtctacctcctgctcagtgtct

SEQ ID NO: 189766 - DNA, 19 bp, Mus musculus
tggagcgaagactccagga

SEQ ID NO: 189767 - DNA, 20 bp, Mus musculus
acacatacatacacatatac

SEQ ID NO: 189768 - DNA, 23 bp, Mus musculus
tcccactctctgaaatccctgag

SEQ ID NO: 189769 - DNA, 23 bp, Mus musculus
tttatgtgtctggtaatgaccct

SEQ ID NO: 189770 - DNA, 18 bp, Mus musculus
agggaggatgtggggaaa

SEQ ID NO: 189771 - DNA, 21 bp, Mus musculus
tactgaagaatgttagcagaa

SEQ ID NO: 189772 - DNA, 23 bp, Mus musculus
ttcctgcctctgtctctgcctcc

SEQ ID NO: 189773 - DNA, 23 bp, Mus musculus
tctgtgtgactgtggctgtcttg

SEQ ID NO: 189774 - DNA, 23 bp, Mus musculus
tgggtgagtgtctgtgtctgagt

SEQ ID NO: 189775 - DNA, 20 bp, Mus musculus
gtgagtgaggtgactgtcag

SEQ ID NO: 189776 - DNA, 23 bp, Mus musculus
tggacctgttgttcaaggtgttt

SEQ ID NO: 189777 - DNA, 23 bp, Mus musculus
tcagtggatgctcttgcagagga

SEQ ID NO: 189778 - DNA, 20 bp, Mus musculus
gctaagagcacttgctgctc

SEQ ID NO: 189779 - DNA, 20 bp, Mus musculus
tctgtctgagtcagctgtta

SEQ ID NO: 189780 - DNA, 23 bp, Mus musculus
ttttgagtgcatgcatgtgtgtg

SEQ ID NO: 189781 - DNA, 22 bp, Mus musculus
acatggatgtgtgcattcctgt

SEQ ID NO: 189782 - DNA, 21 bp, Mus musculus
tagcacacggaacttcatgtc

SEQ ID NO: 189783 - DNA, 23 bp, Mus musculus
caatatttttgtatctgttgagg

SEQ ID NO: 189784 - DNA, 22 bp, Mus musculus
tgttttgtgaccaattatatgg

SEQ ID NO: 189785 - DNA, 21 bp, Mus musculus
tgtagatgatgtttggctcag

SEQ ID NO: 189786 - DNA, 21 bp, Mus musculus
tgtagatgatgtttggctcag

SEQ ID NO: 189787 - DNA, 22 bp, Mus musculus
tgttttgtgaccaattatatgg

SEQ ID NO: 189788 - DNA, 22 bp, Mus musculus
tgttttgtgaccaattatatgg

SEQ ID NO: 189789 - DNA, 23 bp, Mus musculus
tatatctgcatctgcatctgcat

SEQ ID NO: 189790 - DNA, 18 bp, Mus musculus
tacacaatatattttgta

SEQ ID NO: 189791 - DNA, 23 bp, Mus musculus
aagtgagaggtcacacagtgagg

SEQ ID NO: 189792 - DNA, 20 bp, Mus musculus
ggcaggctatacttactgct

SEQ ID NO: 189793 - DNA, 23 bp, Mus musculus
agaatgcatatgttttggcacag

SEQ ID NO: 189794 - DNA, 20 bp, Mus musculus
gagactggcacaaaacaggc

SEQ ID NO: 189795 - DNA, 23 bp, Mus musculus
actgttaagagtgtgtgcagtca

SEQ ID NO: 189796 - DNA, 23 bp, Mus musculus
ctgtctgtctgtctgtctgaggg

SEQ ID NO: 189797 - DNA, 18 bp, Mus musculus
tcaggggctggagagatg

SEQ ID NO: 189798 - DNA, 20 bp, Mus musculus
aagagcactgactgctctac

SEQ ID NO: 189799 - DNA, 20 bp, Mus musculus
gggtccctcacaggtagggt

SEQ ID NO: 189800 - DNA, 23 bp, Mus musculus
accgtctgtctgtctgtctgtct

SEQ ID NO: 189801 - DNA, 23 bp, Mus musculus
atatgtatatatgtatgtgtgtg

SEQ ID NO: 189802 - DNA, 23 bp, Mus musculus
ctgcctggctgcctctgtccctg

SEQ ID NO: 189803 - DNA, 23 bp, Mus musculus
tgtaagagttcagagtgtggtga

SEQ ID NO: 189804 - DNA, 18 bp, Mus musculus
agacaggacatgctgacc

SEQ ID NO: 189805 - DNA, 23 bp, Mus musculus
atttgtgtgtgtgcatgtgcatg

SEQ ID NO: 189806 - DNA, 23 bp, Mus musculus
gcgcctgtctctgtctctcagca

SEQ ID NO: 189807 - DNA, 23 bp, Mus musculus
tgtctgtgtggctatgtgttcac

SEQ ID NO: 189808 - DNA, 19 bp, Mus musculus
cagtggctctctgcccctc

SEQ ID NO: 189809 - DNA, 23 bp, Mus musculus
tctgtctgtctgtctgtctatct

SEQ ID NO: 189810 - DNA, 23 bp, Mus musculus
gtctcctttggtgtgtgtctggt

SEQ ID NO: 189811 - DNA, 23 bp, Mus musculus
aatcttagccattctgatgagta

SEQ ID NO: 189812 - DNA, 23 bp, Mus musculus
agagatcagtctgtctctgcctc

SEQ ID NO: 189813 - DNA, 23 bp, Mus musculus
actgagagcaaatctttacaata

SEQ ID NO: 189814 - DNA, 23 bp, Mus musculus
ttattgtggatatgaaattgcct

SEQ ID NO: 189815 - DNA, 23 bp, Mus musculus
ctgactctcactcggtgcctcag

SEQ ID NO: 189816 - DNA, 22 bp, Mus musculus
cattaagagcactggctgctct

SEQ ID NO: 189817 - DNA, 20 bp, Mus musculus
agagttgtcttggggctggt

SEQ ID NO: 189818 - DNA, 22 bp, Mus musculus
tgacactcagagcttatgtagt

SEQ ID NO: 189819 - DNA, 23 bp, Mus musculus
acgcactctctgtggggctcagt

SEQ ID NO: 189820 - DNA, 23 bp, Mus musculus
tccctggctggctgtatgctgaa

SEQ ID NO: 189821 - DNA, 20 bp, Mus musculus
atgtatgtgtgcatgtgtgt

SEQ ID NO: 189822 - DNA, 19 bp, Mus musculus
tgcatgtatgtgtgcatgt

SEQ ID NO: 189823 - DNA, 22 bp, Mus musculus
gactgtctctcactgaccctag

SEQ ID NO: 189824 - DNA, 21 bp, Mus musculus
tcaggttcaaggtagtatggt

SEQ ID NO: 189825 - DNA, 23 bp, Mus musculus
tgtacatgcatatgtaaatgtat

SEQ ID NO: 189826 - DNA, 22 bp, Mus musculus
catgtatgtatttatgtatgca

SEQ ID NO: 189827 - DNA, 18 bp, Mus musculus
ttagcctatgcaagaggt

SEQ ID NO: 189828 - DNA, 22 bp, Mus musculus
ctatctcactgtctggctctgc

SEQ ID NO: 189829 - DNA, 23 bp, Mus musculus
atctctgcttgttgttacctgaa

SEQ ID NO: 189830 - DNA, 21 bp, Mus musculus
atgcatgtgtgcatgtgcatg

SEQ ID NO: 189831 - DNA, 21 bp, Mus musculus
tgtgtgtgtatgtgtgtgtgc

SEQ ID NO: 189832 - DNA, 23 bp, Mus musculus
tggcagcctgcctgtattccagc

SEQ ID NO: 189833 - DNA, 23 bp, Mus musculus
tacttgactatgtgtgtgctcat

SEQ ID NO: 189834 - DNA, 22 bp, Mus musculus
gtgtgtgtgtgcatgtgcatgt

SEQ ID NO: 189835 - DNA, 22 bp, Mus musculus
atctgtgtgcatttgcatgtgg

SEQ ID NO: 189836 - DNA, 23 bp, Mus musculus
tagctcactgcagtgtgtgacag

SEQ ID NO: 189837 - DNA, 21 bp, Mus musculus
tgcatgtttggatttgcatga

SEQ ID NO: 189838 - DNA, 22 bp, Mus musculus
atgtctgtgtatgtatatgagt

SEQ ID NO: 189839 - DNA, 21 bp, Mus musculus
atacacatatacatatgcata

SEQ ID NO: 189840 - DNA, 22 bp, Mus musculus
agaaaacagagggtggtactga

SEQ ID NO: 189841 - DNA, 23 bp, Mus musculus
tagcactgactgctcttccagag

SEQ ID NO: 189842 - DNA, 23 bp, Mus musculus
ttctctgtgtgtctgtgactgct

SEQ ID NO: 189843 - DNA, 23 bp, Mus musculus
tgaatgtgtgcaagtgcatgtgt

SEQ ID NO: 189844 - DNA, 23 bp, Mus musculus
atacagtgtgtgtgtacattcgt

SEQ ID NO: 189845 - DNA, 23 bp, Mus musculus
tgtatgtatatgtatttgtgtac

SEQ ID NO: 189846 - DNA, 23 bp, Mus musculus
tttgtgtgtatatgtatatctgt

SEQ ID NO: 189847 - DNA, 21 bp, Mus musculus
tatgtcacggtcactgtcaca

SEQ ID NO: 189848 - DNA, 23 bp, Mus musculus
aagacacagaacagtgagtgctg

SEQ ID NO: 189849 - DNA, 22 bp, Mus musculus
atgtgcatgtgtatatatgtgt

SEQ ID NO: 189850 - DNA, 23 bp, Mus musculus
tatgtgtatatatgtatatgtgt

SEQ ID NO: 189851 - DNA, 23 bp, Mus musculus
tatgtgtatatatgtatatgtgt

SEQ ID NO: 189852 - DNA, 23 bp, Mus musculus
atgtgtatatatgtatatgtgtg

SEQ ID NO: 189853 - DNA, 20 bp, Mus musculus
ttgaccagatatagagatgt

SEQ ID NO: 189854 - DNA, 23 bp, Mus musculus
ttgagagaacacggtgagcaaag

SEQ ID NO: 189855 - DNA, 22 bp, Mus musculus
tgagacagtctctcactgagcc

SEQ ID NO: 189856 - DNA, 23 bp, Mus musculus
taagagcactgtctgctcttcca

SEQ ID NO: 189857 - DNA, 22 bp, Mus musculus
ctctcactctctgcgtgtcggt

SEQ ID NO: 189858 - DNA, 22 bp, Mus musculus
cagggtcagtctcagtctctgc

SEQ ID NO: 189859 - DNA, 22 bp, Mus musculus
cagggtggctctgtagtagcct

SEQ ID NO: 189860 - DNA, 23 bp, Mus musculus
tccatctctctctctctctgtct

SEQ ID NO: 189861 - DNA, 23 bp, Mus musculus
acactgtgtgtgtctcacagagc

SEQ ID NO: 189862 - DNA, 23 bp, Mus musculus
agagaacagacaatagactgacc

SEQ ID NO: 189863 - DNA, 22 bp, Mus musculus
agacaggatttttctgtgtatc

SEQ ID NO: 189864 - DNA, 23 bp, Mus musculus
agttgtctccctctctgtgtggt

SEQ ID NO: 189865 - DNA, 21 bp, Mus musculus
tgagtgctgatggtgaatggt

SEQ ID NO: 189866 - DNA, 23 bp, Mus musculus
gagagtacagtgtgagcatacag

SEQ ID NO: 189867 - DNA, 21 bp, Mus musculus
ctgtccctctgacaggggctg

SEQ ID NO: 189868 - DNA, 23 bp, Mus musculus
tcagggtctctcactgactcagc

SEQ ID NO: 189869 - DNA, 20 bp, Mus musculus
ggctgtcactgtgggactag

SEQ ID NO: 189870 - DNA, 23 bp, Mus musculus
tgattgtctctgtgtgtgaaccc

SEQ ID NO: 189871 - DNA, 22 bp, Mus musculus
ctctgtgtctatctctgtccta

SEQ ID NO: 189872 - DNA, 19 bp, Mus musculus
tgtgtgcatgtgcatgtgt

SEQ ID NO: 189873 - DNA, 21 bp, Mus musculus
atgtgtgtgcatatgcatgtg

SEQ ID NO: 189874 - DNA, 19 bp, Mus musculus
tgcatgtatctaagtatgt

SEQ ID NO: 189875 - DNA, 23 bp, Mus musculus
gtcttctcactctctcactgagc

SEQ ID NO: 189876 - DNA, 23 bp, Mus musculus
tgtctctctgtgaggccttcatc

SEQ ID NO: 189877 - DNA, 18 bp, Mus musculus
agagaggcaggaatgcag

SEQ ID NO: 189878 - DNA, 18 bp, Mus musculus
tgaggtgttctagagtgt

SEQ ID NO: 189879 - DNA, 23 bp, Mus musculus
ctttgggtctgagtgagtggggc

SEQ ID NO: 189880 - DNA, 23 bp, Mus musculus
gtctgtctgtctgtctgcatgcc

SEQ ID NO: 189881 - DNA, 23 bp, Mus musculus
gtgtctctgtctctgtgcctgtg

SEQ ID NO: 189882 - DNA, 20 bp, Mus musculus
gcttatgtgtatgtatgtat

SEQ ID NO: 189883 - DNA, 21 bp, Mus musculus
cagatctctgtgagctcaagg

SEQ ID NO: 189884 - DNA, 20 bp, Mus musculus
tctctgtgtacccatgtgtg

SEQ ID NO: 189885 - DNA, 21 bp, Mus musculus
acatgtgtgcatgtgcataca

SEQ ID NO: 189886 - DNA, 21 bp, Mus musculus
ttgactgatgagtcggaggtg

SEQ ID NO: 189887 - DNA, 21 bp, Mus musculus
tccctgtcctccaggagctca

SEQ ID NO: 189888 - DNA, 23 bp, Mus musculus
gtctctccctctgtgtgtgtcct

SEQ ID NO: 189889 - DNA, 23 bp, Mus musculus
tctgacagacagacagacacact

SEQ ID NO: 189890 - DNA, 21 bp, Mus musculus
tatgtatgtatgtatgtatgt

SEQ ID NO: 189891 - DNA, 23 bp, Mus musculus
gcatgtatgtatatatgtatgta

SEQ ID NO: 189892 - DNA, 19 bp, Mus musculus
gcctgtatgtacctgtgtg

SEQ ID NO: 189893 - DNA, 22 bp, Mus musculus
tttgtgtgtctataggtatctg

SEQ ID NO: 189894 - DNA, 19 bp, Mus musculus
tttcaggaatcagttctcc

SEQ ID NO: 189895 - DNA, 19 bp, Mus musculus
ttctgaggattgaagtcag

SEQ ID NO: 189896 - DNA, 23 bp, Mus musculus
agcctttgtttggagacagtcac

SEQ ID NO: 189897 - DNA, 23 bp, Mus musculus
actaggtggagatgcagcaggga

SEQ ID NO: 189898 - DNA, 23 bp, Mus musculus
tctctggctcactccctcactca

SEQ ID NO: 189899 - DNA, 19 bp, Mus musculus
tcactgagagctgcagttt

SEQ ID NO: 189900 - DNA, 21 bp, Mus musculus
tggaccattttcaggagcttc

SEQ ID NO: 189901 - DNA, 23 bp, Mus musculus
aggagtggcttcagtttgtgttt

SEQ ID NO: 189902 - DNA, 18 bp, Mus musculus
tgaattgattaactgatc

SEQ ID NO: 189903 - DNA, 18 bp, Mus musculus
ataacagcaattaccatt

SEQ ID NO: 189904 - DNA, 23 bp, Mus musculus
caaagtgctgttcgtgcaggtag

SEQ ID NO: 189905 - DNA, 23 bp, Mus musculus
cagtgttgagaggcggagacttg

SEQ ID NO: 189906 - DNA, 23 bp, Mus musculus
cattgcacttgtctcggtctgac

SEQ ID NO: 189907 - DNA, 22 bp, Mus musculus
aaaaggtggatggtgctgggct

SEQ ID NO: 189908 - DNA, 18 bp, Mus musculus
gaacactctggtatttgt

SEQ ID NO: 189909 - DNA, 23 bp, Mus musculus
atagggactctgtttgcctcagc

SEQ ID NO: 189910 - DNA, 23 bp, Mus musculus
gtccctcactcccttcagtgtcc

SEQ ID NO: 189911 - DNA, 23 bp, Mus musculus
ctgtctgtctgtctgtctgtctg

SEQ ID NO: 189912 - DNA, 23 bp, Mus musculus
tctctcactgaacttggagctca

SEQ ID NO: 189913 - DNA, 23 bp, Mus musculus
ggaggtgagttgcattgtgtctg

SEQ ID NO: 189914 - DNA, 23 bp, Mus musculus
tatgtgtatatgtatatgtgtgt

SEQ ID NO: 189915 - DNA, 23 bp, Mus musculus
agtgtctcaaactctctctcctc

SEQ ID NO: 189916 - DNA, 23 bp, Mus musculus
tctttgtgaggcagagtctcagg

SEQ ID NO: 189917 - DNA, 22 bp, Mus musculus
tgatctttctgtctctgactcc

SEQ ID NO: 189918 - DNA, 20 bp, Mus musculus
tgtgaaaagagtcagtccac

SEQ ID NO: 189919 - DNA, 23 bp, Mus musculus
atgtgtgtatatgtatatgtatg

SEQ ID NO: 189920 - DNA, 22 bp, Mus musculus
tgtctgtctgtctgtctagctg

SEQ ID NO: 189921 - DNA, 23 bp, Mus musculus
atctgtctgtctgtctatcttgc

SEQ ID NO: 189922 - DNA, 23 bp, Mus musculus
tctctctctcagcatatcctctc

SEQ ID NO: 189923 - DNA, 23 bp, Mus musculus
tctgtctgtctgtctgtctgcct

SEQ ID NO: 189924 - DNA, 22 bp, Mus musculus
ttcatcactgaaggaagtcagg

SEQ ID NO: 189925 - DNA, 23 bp, Mus musculus
gtctctctggctcactctgaggc

SEQ ID NO: 189926 - DNA, 23 bp, Mus musculus
aatgatgacagtgtgagcagtca

SEQ ID NO: 189927 - DNA, 21 bp, Mus musculus
ttttggtcatggtgctttaca

SEQ ID NO: 189928 - DNA, 23 bp, Mus musculus
ggtttctgtcagatgtttggccg

SEQ ID NO: 189929 - DNA, 23 bp, Mus musculus
atatatgtatatgtgtataagtg

SEQ ID NO: 189930 - DNA, 23 bp, Mus musculus
tatatctatatatgtatgcatat

SEQ ID NO: 189931 - DNA, 23 bp, Mus musculus
acatgtggctgagtatatatggt

SEQ ID NO: 189932 - DNA, 18 bp, Mus musculus
catgtatgtatgtatgta

SEQ ID NO: 189933 - DNA, 23 bp, Mus musculus
gtctgtcacacagtctggttgcg

SEQ ID NO: 189934 - DNA, 23 bp, Mus musculus
tgtgtgggtctctgtgacagaaa

SEQ ID NO: 189935 - DNA, 23 bp, Mus musculus
acagagaagtctgagggcagaca

SEQ ID NO: 189936 - DNA, 23 bp, Mus musculus
acaggctgggtctgtggacagga

SEQ ID NO: 189937 - DNA, 21 bp, Mus musculus
gactctgtagtgaggagcatt

SEQ ID NO: 189938 - DNA, 23 bp, Mus musculus
cactctctgtctgcttttgtgtg

SEQ ID NO: 189939 - DNA, 23 bp, Mus musculus
cagagagaagagacagtccagtt

SEQ ID NO: 189940 - DNA, 18 bp, Mus musculus
aatcaactgtaggggctg

SEQ ID NO: 189941 - DNA, 19 bp, Mus musculus
ttaagaatcataatatagg

SEQ ID NO: 189942 - DNA, 21 bp, Mus musculus
atgtgtatatgtatatatgtg

SEQ ID NO: 189943 - DNA, 21 bp, Mus musculus
tatctatatatgtatatgtgt

SEQ ID NO: 189944 - DNA, 23 bp, Mus musculus
atccaactgtgacagtttcagtc

SEQ ID NO: 189945 - DNA, 23 bp, Mus musculus
cgctctgtctctcagtctctgtc

SEQ ID NO: 189946 - DNA, 19 bp, Mus musculus
ctgcccatgaaagagcctc

SEQ ID NO: 189947 - DNA, 18 bp, Mus musculus
actggagagatggctcaa

SEQ ID NO: 189948 - DNA, 23 bp, Mus musculus
gggtctctctgtggctgtcctaa

SEQ ID NO: 189949 - DNA, 20 bp, Mus musculus
tgagttcaattctcagcaac

SEQ ID NO: 189950 - DNA, 23 bp, Mus musculus
actacatagtgagttcaaggccc

SEQ ID NO: 189951 - DNA, 21 bp, Mus musculus
tggctcagtggttaagagcac

SEQ ID NO: 189952 - DNA, 23 bp, Mus musculus
acacagagcatctggatgtgaag

SEQ ID NO: 189953 - DNA, 23 bp, Mus musculus
atgtgtgtgcatgcttatgtgtg

SEQ ID NO: 189954 - DNA, 22 bp, Mus musculus
tttaatactgtttctgctgggt

SEQ ID NO: 189955 - DNA, 19 bp, Mus musculus
atggactgatggaagatgg

SEQ ID NO: 189956 - DNA, 23 bp, Mus musculus
ttctctctgtctctctgtcatct

SEQ ID NO: 189957 - DNA, 19 bp, Mus musculus
actggagagagagctcagt

SEQ ID NO: 189958 - DNA, 18 bp, Mus musculus
atgatggctcagcgtttc

SEQ ID NO: 189959 - DNA, 23 bp, Mus musculus
ttaaaaggtgttatgggagctgg

SEQ ID NO: 189960 - DNA, 21 bp, Mus musculus
acagtcttagtcactgtttta

SEQ ID NO: 189961 - DNA, 20 bp, Mus musculus
ttgtgcttctacattgcctt

SEQ ID NO: 189962 - DNA, 23 bp, Mus musculus
agagatctgtctgcctctgtctc

SEQ ID NO: 189963 - DNA, 23 bp, Mus musculus
ctctctctgtgtgtgtgtgtgtg

SEQ ID NO: 189964 - DNA, 22 bp, Mus musculus
ctttgaggttttatgttctcaa

SEQ ID NO: 189965 - DNA, 23 bp, Mus musculus
atctggatgtagaactcttagta

SEQ ID NO: 189966 - DNA, 23 bp, Mus musculus
atatgtgtctgtgtgtgtatata

SEQ ID NO: 189967 - DNA, 23 bp, Mus musculus
tgtatctctctctctctgtatat

SEQ ID NO: 189968 - DNA, 23 bp, Mus musculus
tttgtgtcaggttgtcatgaaac

SEQ ID NO: 189969 - DNA, 19 bp, Mus musculus
tctgtatatctatatataa

SEQ ID NO: 189970 - DNA, 23 bp, Mus musculus
acagacacccacacatacacata

SEQ ID NO: 189971 - DNA, 18 bp, Mus musculus
tgcatgcacacatatgta

SEQ ID NO: 189972 - DNA, 22 bp, Mus musculus
tatgtctctgtgtgtgtgtgtg

SEQ ID NO: 189973 - DNA, 21 bp, Mus musculus
atacatgtatatgcatgtgca

SEQ ID NO: 189974 - DNA, 23 bp, Mus musculus
tatgagtatatgtgtatatgtgt

SEQ ID NO: 189975 - DNA, 18 bp, Mus musculus
taagtgtttgctagtatt

SEQ ID NO: 189976 - DNA, 18 bp, Mus musculus
ttcacagtagactctcag

SEQ ID NO: 189977 - DNA, 22 bp, Mus musculus
aaaactgtatttgtaaatgtct

SEQ ID NO: 189978 - DNA, 23 bp, Mus musculus
ctctctctgtcactctctgtctc

SEQ ID NO: 189979 - DNA, 23 bp, Mus musculus
atggtagagaattgagtgtggac

SEQ ID NO: 189980 - DNA, 20 bp, Mus musculus
acactgctgaggttctactt

SEQ ID NO: 189981 - DNA, 19 bp, Mus musculus
tccactctgcttctgcact

SEQ ID NO: 189982 - DNA, 22 bp, Mus musculus
tgtgtgtgtatacagtatgtat

SEQ ID NO: 189983 - DNA, 19 bp, Mus musculus
tatattgtatgtatacacg

SEQ ID NO: 189984 - DNA, 23 bp, Mus musculus
tttatgtatatgtgtatgccttt

SEQ ID NO: 189985 - DNA, 23 bp, Mus musculus
ctgagaagggagtcccagtgatc

SEQ ID NO: 189986 - DNA, 23 bp, Mus musculus
atctgtgagcatgtgcatgtggt

SEQ ID NO: 189987 - DNA, 23 bp, Mus musculus
caactctcagtgtctgtgactaa

SEQ ID NO: 189988 - DNA, 23 bp, Mus musculus
tggctcactctctggctgtctag

SEQ ID NO: 189989 - DNA, 23 bp, Mus musculus
tatgtatgtatatgtatgtgtac

SEQ ID NO: 189990 - DNA, 22 bp, Mus musculus
atatgtgtgtgtatatgtgtgt

SEQ ID NO: 189991 - DNA, 23 bp, Mus musculus
atatgtgtgtatatatgtgtgta

SEQ ID NO: 189992 - DNA, 23 bp, Mus musculus
tatgtgagcctttgtgtttgttt

SEQ ID NO: 189993 - DNA, 21 bp, Mus musculus
ttaggtgtatgagattgtcaa

SEQ ID NO: 189994 - DNA, 22 bp, Mus musculus
tatatgtgtgtatggagtaggt

SEQ ID NO: 189995 - DNA, 23 bp, Mus musculus
tacagcaaagcttatcagatgag

SEQ ID NO: 189996 - DNA, 23 bp, Mus musculus
ggactcactgtcactctcactgg

SEQ ID NO: 189997 - DNA, 21 bp, Mus musculus
acacacatacatatacgtgac

SEQ ID NO: 189998 - DNA, 19 bp, Mus musculus
atatatgtgtgcatgtata

SEQ ID NO: 189999 - DNA, 23 bp, Mus musculus
tatatgtacatataggtataatg

SEQ ID NO: 190000 - DNA, 20 bp, Mus musculus
tatctatatatacatgttca

SEQ ID NO: 190001 - DNA, 18 bp, Mus musculus
taaacaacttattcccac

SEQ ID NO: 190002 - DNA, 21 bp, Mus musculus
aggggaagaaggttctatggg

SEQ ID NO: 190003 - DNA, 23 bp, Mus musculus
agtgaaggggctctgtctgtctg

SEQ ID NO: 190004 - DNA, 23 bp, Mus musculus
agtgaaggggctctgtctgtctg

SEQ ID NO: 190005 - DNA, 21 bp, Mus musculus
agtattaggtttgcctcagtg

SEQ ID NO: 190006 - DNA, 23 bp, Mus musculus
atgagtagatggtttcttggtgt

SEQ ID NO: 190007 - DNA, 23 bp, Mus musculus
atatatatatctggaagctggct

SEQ ID NO: 190008 - DNA, 22 bp, Mus musculus
ttggaagaaggttggattgtta

SEQ ID NO: 190009 - DNA, 23 bp, Mus musculus
ttgtgagtgcttgtgatatgttt

SEQ ID NO: 190010 - DNA, 20 bp, Mus musculus
tccaagacgtaagtgcctct

SEQ ID NO: 190011 - DNA, 23 bp, Mus musculus
atgtatgtatctatgtatctatc

SEQ ID NO: 190012 - DNA, 23 bp, Mus musculus
tgatggtagatattgttgccata

SEQ ID NO: 190013 - DNA, 19 bp, Mus musculus
tcttctcagaggctgcatc

SEQ ID NO: 190014 - DNA, 23 bp, Mus musculus
agtcagatttaggaggactccct

SEQ ID NO: 190015 - DNA, 20 bp, Mus musculus
tctctgcgtctatctctgtc

SEQ ID NO: 190016 - DNA, 23 bp, Mus musculus
gtgtgtctgtgtgtgtctctgtc

SEQ ID NO: 190017 - DNA, 23 bp, Mus musculus
tgtctatatatctatgtgtgtat

SEQ ID NO: 190018 - DNA, 20 bp, Mus musculus
ttatagatgcatataaatgg

SEQ ID NO: 190019 - DNA, 21 bp, Mus musculus
atgtgcaaataattatatttg

SEQ ID NO: 190020 - DNA, 19 bp, Mus musculus
tgataagtatatatgtatg

SEQ ID NO: 190021 - DNA, 23 bp, Mus musculus
taacattatgtagatgtacatgg

SEQ ID NO: 190022 - DNA, 23 bp, Mus musculus
tatgtgtatatgtatatctgtgt

SEQ ID NO: 190023 - DNA, 23 bp, Mus musculus
tctgactctccgtcgcaatagga

SEQ ID NO: 190024 - DNA, 20 bp, Mus musculus
tattgatgctagagagccgg

SEQ ID NO: 190025 - DNA, 23 bp, Mus musculus
tcattaagagtcttgtttttgtc

SEQ ID NO: 190026 - DNA, 23 bp, Mus musculus
tctctcactgtgtgtgatcttga

SEQ ID NO: 190027 - DNA, 23 bp, Mus musculus
tggaatgatggatgtgtatcaca

SEQ ID NO: 190028 - DNA, 23 bp, Mus musculus
ctgagagcttacagtgcagcttg

SEQ ID NO: 190029 - DNA, 23 bp, Mus musculus
ctcactgtgtctccttcacgagt

SEQ ID NO: 190030 - DNA, 20 bp, Mus musculus
tgacagatgtgtgccagcac

SEQ ID NO: 190031 - DNA, 23 bp, Mus musculus
agagtgctgaggaagtaggttgt

SEQ ID NO: 190032 - DNA, 23 bp, Mus musculus
tgtatatatgtatagatatatgc

SEQ ID NO: 190033 - DNA, 23 bp, Mus musculus
ctcagagtgagacacatgttcaa

SEQ ID NO: 190034 - DNA, 23 bp, Mus musculus
gtctgtctgtctgtctgtgtgaa

SEQ ID NO: 190035 - DNA, 22 bp, Mus musculus
gaagttcactgtgtggctgagg

SEQ ID NO: 190036 - DNA, 23 bp, Mus musculus
gagctctgtctctgtctccacag

SEQ ID NO: 190037 - DNA, 21 bp, Mus musculus
acagttcttcacattgtggtg

SEQ ID NO: 190038 - DNA, 23 bp, Mus musculus
tctctgtgtgtgtgtgtgcacgc

SEQ ID NO: 190039 - DNA, 20 bp, Mus musculus
tgtgaggggctggagagatg

SEQ ID NO: 190040 - DNA, 23 bp, Mus musculus
atggattgtaatgtagatatctg

SEQ ID NO: 190041 - DNA, 20 bp, Mus musculus
tatgtgtatatatatgtatg

SEQ ID NO: 190042 - DNA, 23 bp, Mus musculus
gtatatatgtatatatgtgtgtg

SEQ ID NO: 190043 - DNA, 20 bp, Mus musculus
atatgtgtatgtatatatgt

SEQ ID NO: 190044 - DNA, 21 bp, Mus musculus
tcccacacacccacagttgag

SEQ ID NO: 190045 - DNA, 21 bp, Mus musculus
aacactgtgagcaatgagcca

SEQ ID NO: 190046 - DNA, 23 bp, Mus musculus
ttagtgtctgtcagagtcactgg

SEQ ID NO: 190047 - DNA, 19 bp, Mus musculus
ggcatgatgtgggcgtgtt

SEQ ID NO: 190048 - DNA, 20 bp, Mus musculus
actggtgagactttgtgaat

SEQ ID NO: 190049 - DNA, 22 bp, Mus musculus
tatgtatgtatgtatgtatgta

SEQ ID NO: 190050 - DNA, 23 bp, Mus musculus
gtatacacacacacatatatggc

SEQ ID NO: 190051 - DNA, 21 bp, Mus musculus
tatatggtacatatatatggt

SEQ ID NO: 190052 - DNA, 20 bp, Mus musculus
taagaccattgactgctctt

SEQ ID NO: 190053 - DNA, 23 bp, Mus musculus
tgcgtgtgtctgtctgtctgtct

SEQ ID NO: 190054 - DNA, 20 bp, Mus musculus
tttgctgctgtggctggaga

SEQ ID NO: 190055 - DNA, 20 bp, Mus musculus
attctacatctgtgtgtgtg

SEQ ID NO: 190056 - DNA, 23 bp, Mus musculus
gtatatgcagcaggtgcaggtgc

SEQ ID NO: 190057 - DNA, 18 bp, Mus musculus
tctcactctctggaaagg

SEQ ID NO: 190058 - DNA, 21 bp, Mus musculus
ttcatctacgtgtgcacgcac

SEQ ID NO: 190059 - DNA, 23 bp, Mus musculus
tatgtgtgtgcatgttcatgtgg

SEQ ID NO: 190060 - DNA, 23 bp, Mus musculus
gatgtgtgtgagctcatgtgtgt

SEQ ID NO: 190061 - DNA, 23 bp, Mus musculus
gactgtctctatatgtgtctctg

SEQ ID NO: 190062 - DNA, 23 bp, Mus musculus
agctgtcagtagagagactggag

SEQ ID NO: 190063 - DNA, 23 bp, Mus musculus
tgtgagtgttatgtatgtgtata

SEQ ID NO: 190064 - DNA, 19 bp, Mus musculus
tagtgtatacatatataag

SEQ ID NO: 190065 - DNA, 19 bp, Mus musculus
catgctgctttcagaggaa

SEQ ID NO: 190066 - DNA, 23 bp, Mus musculus
tatgtgtatatgtatatatgtgc

SEQ ID NO: 190067 - DNA, 23 bp, Mus musculus
atatgtgtatatgtgtatatgta

SEQ ID NO: 190068 - DNA, 21 bp, Mus musculus
actgagctggagaaagcttga

SEQ ID NO: 190069 - DNA, 23 bp, Mus musculus
attccctccctcggtcactcatt

SEQ ID NO: 190070 - DNA, 18 bp, Mus musculus
atatgtgtctctatgtgg

SEQ ID NO: 190071 - DNA, 22 bp, Mus musculus
tatatgtacatgtacatgtata

SEQ ID NO: 190072 - DNA, 23 bp, Mus musculus
gctgtagtgtgctttcttctctg

SEQ ID NO: 190073 - DNA, 23 bp, Mus musculus
tatcagtctctagagtcacctag

SEQ ID NO: 190074 - DNA, 23 bp, Mus musculus
tgtgtgcgtgcgtgtatgcctct

SEQ ID NO: 190075 - DNA, 23 bp, Mus musculus
tgcacgtgtgcatgtgtgtgcat

SEQ ID NO: 190076 - DNA, 23 bp, Mus musculus
agactgtctctttatcaggaaga

SEQ ID NO: 190077 - DNA, 19 bp, Mus musculus
agtgacacagtgaatttca

SEQ ID NO: 190078 - DNA, 21 bp, Mus musculus
tggtatgtattcatgtgcatg

SEQ ID NO: 190079 - DNA, 23 bp, Mus musculus
gcatatgtgtgcatgtacttgtg

SEQ ID NO: 190080 - DNA, 21 bp, Mus musculus
tcgagctataattatgcttgc

SEQ ID NO: 190081 - DNA, 20 bp, Mus musculus
tgtgacccacacactctgtt

SEQ ID NO: 190082 - DNA, 19 bp, Mus musculus
tgtgcatatgtatgtgcat

SEQ ID NO: 190083 - DNA, 23 bp, Mus musculus
tttgtgtgtggatatgcatttgc

SEQ ID NO: 190084 - DNA, 21 bp, Mus musculus
tgtgtatgtgcatatgcatgt

SEQ ID NO: 190085 - DNA, 23 bp, Mus musculus
atgtatatgtgcatgtgtatgtg

SEQ ID NO: 190086 - DNA, 23 bp, Mus musculus
catgtatctgtgtatatgtgtgt

SEQ ID NO: 190087 - DNA, 23 bp, Mus musculus
tgtatatgtatatgtatatgtat

SEQ ID NO: 190088 - DNA, 23 bp, Mus musculus
aatgtatatgtatatgtatatgt

SEQ ID NO: 190089 - DNA, 22 bp, Mus musculus
atgtagacttgattgatgaatg

SEQ ID NO: 190090 - DNA, 23 bp, Mus musculus
atgtgtgtgtgcatatgtatgtg

SEQ ID NO: 190091 - DNA, 23 bp, Mus musculus
gtccaagtgctacacttggggaa

SEQ ID NO: 190092 - DNA, 23 bp, Mus musculus
tttcactgaagtgtgtaaggact

SEQ ID NO: 190093 - DNA, 23 bp, Mus musculus
tgaatgtattttatatgcacttg

SEQ ID NO: 190094 - DNA, 21 bp, Mus musculus
aagcagtcaccaatacatgac

SEQ ID NO: 190095 - DNA, 22 bp, Mus musculus
aacagagtctgtgtatctgtgt

SEQ ID NO: 190096 - DNA, 23 bp, Mus musculus
atatgtaatgtatacatgtatat

SEQ ID NO: 190097 - DNA, 23 bp, Mus musculus
aactgtctcactgtctcatgtgt

SEQ ID NO: 190098 - DNA, 20 bp, Mus musculus
tgtgtatttgtgtatgtgta

SEQ ID NO: 190099 - DNA, 22 bp, Mus musculus
tatatgtgtttgtgcatatgtg

SEQ ID NO: 190100 - DNA, 21 bp, Mus musculus
tgtaaagtggctggagtttgt

SEQ ID NO: 190101 - DNA, 23 bp, Mus musculus
cactctgcgtgtgtgtgtgtgtg

SEQ ID NO: 190102 - DNA, 23 bp, Mus musculus
tgtgtgcacatgcatgtgtgtgt

SEQ ID NO: 190103 - DNA, 23 bp, Mus musculus
tgtgtgtatgtgcaaatgcatgt

SEQ ID NO: 190104 - DNA, 23 bp, Mus musculus
gtgtattgtatatgtgtatatgt

SEQ ID NO: 190105 - DNA, 23 bp, Mus musculus
cacactctgtcagactctgaggg

SEQ ID NO: 190106 - DNA, 21 bp, Mus musculus
ataaacactgatgttggtgat

SEQ ID NO: 190107 - DNA, 23 bp, Mus musculus
atgtatgtatgttcatctatgtg

SEQ ID NO: 190108 - DNA, 23 bp, Mus musculus
cagtctggctctgtggctccatg

SEQ ID NO: 190109 - DNA, 23 bp, Mus musculus
atatatgtgtgtatgtatgcaca

SEQ ID NO: 190110 - DNA, 21 bp, Mus musculus
tgtgcatacatatctgtgtgt

SEQ ID NO: 190111 - DNA, 23 bp, Mus musculus
tggcacagacagatgcatgtgag

SEQ ID NO: 190112 - DNA, 20 bp, Mus musculus
ttgggacagggattcatcag

SEQ ID NO: 190113 - DNA, 23 bp, Mus musculus
ctctctcttgctctcagtgtcct

SEQ ID NO: 190114 - DNA, 23 bp, Mus musculus
tgtgtctgtcactgactggcaag

SEQ ID NO: 190115 - DNA, 18 bp, Mus musculus
tatgtgagtatgtgtatg

SEQ ID NO: 190116 - DNA, 19 bp, Mus musculus
tatgtatatatgtatgttg

SEQ ID NO: 190117 - DNA, 23 bp, Mus musculus
atgtgcatgtatgcatgtgtgtg

SEQ ID NO: 190118 - DNA, 20 bp, Mus musculus
agtctgactagttagctgga

SEQ ID NO: 190119 - DNA, 22 bp, Mus musculus
gcctgtctgtctgtgtctccca

SEQ ID NO: 190120 - DNA, 23 bp, Mus musculus
atgtatatatatgtgtatatgta

SEQ ID NO: 190121 - DNA, 20 bp, Mus musculus
tacatatgtaatgtgtatgt

SEQ ID NO: 190122 - DNA, 19 bp, Mus musculus
aggaccgtcaggaagccct

SEQ ID NO: 190123 - DNA, 23 bp, Mus musculus
agctaagtagagacagagcagag

SEQ ID NO: 190124 - DNA, 23 bp, Mus musculus
acctagctggttctattgttctg

SEQ ID NO: 190125 - DNA, 22 bp, Mus musculus
aactcagagggctagagagatg

SEQ ID NO: 190126 - DNA, 23 bp, Mus musculus
ctgactgctcttccagaggtcct

SEQ ID NO: 190127 - DNA, 23 bp, Mus musculus
gcttgagtctgtgtctgcgtccc

SEQ ID NO: 190128 - DNA, 21 bp, Mus musculus
ctctggactctgactctctgt

SEQ ID NO: 190129 - DNA, 23 bp, Mus musculus
gtgtgtgtgtgtgtgtatacaca

SEQ ID NO: 190130 - DNA, 23 bp, Mus musculus
ttcctcgatgaaatgttttctat

SEQ ID NO: 190131 - DNA, 21 bp, Mus musculus
tagccagttcctgcgatgttg

SEQ ID NO: 190132 - DNA, 22 bp, Mus musculus
tatgtactttccaagacagtct

SEQ ID NO: 190133 - DNA, 23 bp, Mus musculus
tctgtgcctcactctccccatct

SEQ ID NO: 190134 - DNA, 23 bp, Mus musculus
acacagcctctctctcagtcctt

SEQ ID NO: 190135 - DNA, 23 bp, Mus musculus
tgcctgtctcactccttctctct

SEQ ID NO: 190136 - DNA, 23 bp, Mus musculus
tcaccctcacactcaccttcatc

SEQ ID NO: 190137 - DNA, 20 bp, Mus musculus
tgtatgtatgtatatatgta

SEQ ID NO: 190138 - DNA, 23 bp, Mus musculus
tatgtatgtatgtatgtatgtat

SEQ ID NO: 190139 - DNA, 23 bp, Mus musculus
tgtaagtatgtatgtatgtatgt

SEQ ID NO: 190140 - DNA, 22 bp, Mus musculus
tacctgctacagtcttgctatg

SEQ ID NO: 190141 - DNA, 23 bp, Mus musculus
aggcagtgtctctcagtgtggct

SEQ ID NO: 190142 - DNA, 20 bp, Mus musculus
caaagcagaggagctgctga

SEQ ID NO: 190143 - DNA, 22 bp, Mus musculus
ttcagacacccaacaccctctc

SEQ ID NO: 190144 - DNA, 23 bp, Mus musculus
acagtgtttctgcatgtctgtgt

SEQ ID NO: 190145 - DNA, 23 bp, Mus musculus
aggtcattgtcactctctggctg

SEQ ID NO: 190146 - DNA, 18 bp, Mus musculus
tgtgctttatcttgggag

SEQ ID NO: 190147 - DNA, 23 bp, Mus musculus
agagcactgactgctcttccaga

SEQ ID NO: 190148 - DNA, 23 bp, Mus musculus
tctgtggtatgtatatgtatgtg

SEQ ID NO: 190149 - DNA, 23 bp, Mus musculus
gtgtatgtctgtctgtctgcctg

SEQ ID NO: 190150 - DNA, 22 bp, Mus musculus
cactcactggctctgtggctgg

SEQ ID NO: 190151 - DNA, 23 bp, Mus musculus
tttaactttttgaaatctggtag

SEQ ID NO: 190152 - DNA, 23 bp, Mus musculus
gtgtgtgtatatgtatgtgtgtg

SEQ ID NO: 190153 - DNA, 22 bp, Mus musculus
agtgctgactgctcttccagag

SEQ ID NO: 190154 - DNA, 21 bp, Mus musculus
agtctctctgtgagtttgaag

SEQ ID NO: 190155 - DNA, 23 bp, Mus musculus
tgtgagagagtatttagtgagga

SEQ ID NO: 190156 - DNA, 18 bp, Mus musculus
tctagtgtgcaagaatgt

SEQ ID NO: 190157 - DNA, 23 bp, Mus musculus
atgtgtgtgtgtctatatgtaca

SEQ ID NO: 190158 - DNA, 23 bp, Mus musculus
tgtatgtatgtatgtatgtatgt

SEQ ID NO: 190159 - DNA, 23 bp, Mus musculus
tctcagtgtctttctctgtgcct

SEQ ID NO: 190160 - DNA, 21 bp, Mus musculus
aactaccacatgatggctcac

SEQ ID NO: 190161 - DNA, 23 bp, Mus musculus
atgtgtatgtatatatatgtgtg

SEQ ID NO: 190162 - DNA, 20 bp, Mus musculus
tatgtgtgtgtgtatgtata

SEQ ID NO: 190163 - DNA, 21 bp, Mus musculus
agggtcaagtcatagcagggg

SEQ ID NO: 190164 - DNA, 23 bp, Mus musculus
acagtcacactggcattcctgac

SEQ ID NO: 190165 - DNA, 23 bp, Mus musculus
acagacagacagacaacagacac

SEQ ID NO: 190166 - DNA, 23 bp, Mus musculus
tcacttccttgaactcctggatc

SEQ ID NO: 190167 - DNA, 23 bp, Mus musculus
agtccatcctttcacacacacct

SEQ ID NO: 190168 - DNA, 23 bp, Mus musculus
gtgtctgtctgtgaatggggaaa

SEQ ID NO: 190169 - DNA, 19 bp, Mus musculus
tctcagagcctctgtttcc

SEQ ID NO: 190170 - DNA, 20 bp, Mus musculus
aagagcactgactgctcttc

SEQ ID NO: 190171 - DNA, 23 bp, Mus musculus
cattgcttcacacactgtctctc

SEQ ID NO: 190172 - DNA, 20 bp, Mus musculus
gacagggtttgcctgtgtag

SEQ ID NO: 190173 - DNA, 18 bp, Mus musculus
tacaaggagaactggagg

SEQ ID NO: 190174 - DNA, 23 bp, Mus musculus
taggctcagtgactctgtgtgtg

SEQ ID NO: 190175 - DNA, 22 bp, Mus musculus
tgcttcaagaagacgaggcaga

SEQ ID NO: 190176 - DNA, 22 bp, Mus musculus
ctctgctgtctgtctctggcac

SEQ ID NO: 190177 - DNA, 23 bp, Mus musculus
tggcactgtctgataaccttctc

SEQ ID NO: 190178 - DNA, 22 bp, Mus musculus
ataactggggctggagagatgg

SEQ ID NO: 190179 - DNA, 23 bp, Mus musculus
cactccctcagtgtctgcgagct

SEQ ID NO: 190180 - DNA, 23 bp, Mus musculus
tgggtcgctgtctgtctccctgt

SEQ ID NO: 190181 - DNA, 20 bp, Mus musculus
gtctgcctcactcactcact

SEQ ID NO: 190182 - DNA, 23 bp, Mus musculus
gactgtcactcactgtgtagcct

SEQ ID NO: 190183 - DNA, 22 bp, Mus musculus
agacagacagacaatggggtct

SEQ ID NO: 190184 - DNA, 23 bp, Mus musculus
tctaaacatcattctgtgtctgt

SEQ ID NO: 190185 - DNA, 23 bp, Mus musculus
gtgtgtgtgtctgtgcacatgtg

SEQ ID NO: 190186 - DNA, 23 bp, Mus musculus
tgtctgtctgtcttgatggtcac

SEQ ID NO: 190187 - DNA, 20 bp, Mus musculus
tgacaaggacattgcctgga

SEQ ID NO: 190188 - DNA, 23 bp, Mus musculus
ttacacacacacacctctgtgac

SEQ ID NO: 190189 - DNA, 23 bp, Mus musculus
agagaagagagtcttggtagtca

SEQ ID NO: 190190 - DNA, 23 bp, Mus musculus
tatttgtatgtatgtgtacatgt

SEQ ID NO: 190191 - DNA, 18 bp, Mus musculus
atatgtgtgtgcatgtgt

SEQ ID NO: 190192 - DNA, 23 bp, Mus musculus
gtctgtctgtctgtctgtcccta

SEQ ID NO: 190193 - DNA, 23 bp, Mus musculus
ctgtctgtctgtctgcctgcctg

SEQ ID NO: 190194 - DNA, 21 bp, Mus musculus
gtatgtatctatgtatgcatc

SEQ ID NO: 190195 - DNA, 18 bp, Mus musculus
aagcctcacttatggctt

SEQ ID NO: 190196 - DNA, 23 bp, Mus musculus
tctctgcatctccatgtggttgg

SEQ ID NO: 190197 - DNA, 23 bp, Mus musculus
gttccctctgtgcctcagtttcc

SEQ ID NO: 190198 - DNA, 23 bp, Mus musculus
ttctgttttgctgttctgagcct

SEQ ID NO: 190199 - DNA, 18 bp, Mus musculus
tcactgaagacacagagc

SEQ ID NO: 190200 - DNA, 23 bp, Mus musculus
agtgtgtcactgagtgtggggtg

SEQ ID NO: 190201 - DNA, 20 bp, Mus musculus
agaatcttgaaattgggctg

SEQ ID NO: 190202 - DNA, 20 bp, Mus musculus
gtagcaccggctactgggac

SEQ ID NO: 190203 - DNA, 18 bp, Mus musculus
acacaggctggagagatg

SEQ ID NO: 190204 - DNA, 23 bp, Mus musculus
catgtggctctctctgactggct

SEQ ID NO: 190205 - DNA, 23 bp, Mus musculus
tgtgtgcacttgtgtctgtgtgt

SEQ ID NO: 190206 - DNA, 23 bp, Mus musculus
tgtgtgtgtgctatgcatgtgta

SEQ ID NO: 190207 - DNA, 23 bp, Mus musculus
tatgtatgtatatgtatgtgtgt

SEQ ID NO: 190208 - DNA, 23 bp, Mus musculus
accagcacctggcgctctctctc

SEQ ID NO: 190209 - DNA, 23 bp, Mus musculus
atgtgtgtatatatatatgtgtg

SEQ ID NO: 190210 - DNA, 18 bp, Mus musculus
acacacacacatatacat

SEQ ID NO: 190211 - DNA, 23 bp, Mus musculus
atctctcatgtttttcagaactg

SEQ ID NO: 190212 - DNA, 23 bp, Mus musculus
tcttgtcagtgctgagtgacctg

SEQ ID NO: 190213 - DNA, 20 bp, Mus musculus
aagagcactgactgctcttc

SEQ ID NO: 190214 - DNA, 20 bp, Mus musculus
tgcctgtatgaatatatgta

SEQ ID NO: 190215 - DNA, 23 bp, Mus musculus
atgtatgcatgtatgtatgtatg

SEQ ID NO: 190216 - DNA, 23 bp, Mus musculus
tctctgtgactcagtttccttgg

SEQ ID NO: 190217 - DNA, 23 bp, Mus musculus
tatgtatgtatatgtatatgtgt

SEQ ID NO: 190218 - DNA, 20 bp, Mus musculus
atgtatgtatatatatatgt

SEQ ID NO: 190219 - DNA, 18 bp, Mus musculus
atagcagggtgttgtggg

SEQ ID NO: 190220 - DNA, 23 bp, Mus musculus
tgtgtctctgtgtgtgcctgcgt

SEQ ID NO: 190221 - DNA, 23 bp, Mus musculus
gtctctgtgtgtctgtgtgaggc

SEQ ID NO: 190222 - DNA, 19 bp, Mus musculus
ttcatgtgtgtgcatgtgt

SEQ ID NO: 190223 - DNA, 23 bp, Mus musculus
tgtatatgtgcatgtgcatgtgt

SEQ ID NO: 190224 - DNA, 19 bp, Mus musculus
tgttttcttatgttacagc

SEQ ID NO: 190225 - DNA, 23 bp, Mus musculus
cagagactcactctgtcagaagt

SEQ ID NO: 190226 - DNA, 23 bp, Mus musculus
tggagagttgactgactctgtgt

SEQ ID NO: 190227 - DNA, 20 bp, Mus musculus
aagagcactgactgctcttc

SEQ ID NO: 190228 - DNA, 22 bp, Mus musculus
tcagactgtgagtcccagaggc

SEQ ID NO: 190229 - DNA, 22 bp, Mus musculus
tgtgtatatatgtatatgtgtg

SEQ ID NO: 190230 - DNA, 22 bp, Mus musculus
ttcagtagatggtgaatgcatg

SEQ ID NO: 190231 - DNA, 19 bp, Mus musculus
atgaatgtgtgtgttcatg

SEQ ID NO: 190232 - DNA, 23 bp, Mus musculus
gtgcatgtatgcatgcatgtatg

SEQ ID NO: 190233 - DNA, 23 bp, Mus musculus
cactgtctgtctgtctctcattc

SEQ ID NO: 190234 - DNA, 23 bp, Mus musculus
cctgcctgcctgcctgcctgcct

SEQ ID NO: 190235 - DNA, 23 bp, Mus musculus
gcctctctgtgtctgtctccccc

SEQ ID NO: 190236 - DNA, 22 bp, Mus musculus
atgtgtatgtgcatgtatatgc

SEQ ID NO: 190237 - DNA, 23 bp, Mus musculus
gaagaatgaccttgaactctgga

SEQ ID NO: 190238 - DNA, 22 bp, Mus musculus
tatgtgtatatatatgtatgtg

SEQ ID NO: 190239 - DNA, 23 bp, Mus musculus
gactttctctgtgtggctctgtt

SEQ ID NO: 190240 - DNA, 23 bp, Mus musculus
tatgtatgtatgtatgtatgtat

SEQ ID NO: 190241 - DNA, 18 bp, Mus musculus
aaagtgtttgggatttga

SEQ ID NO: 190242 - DNA, 20 bp, Mus musculus
agtctccctgactctgtcaa

SEQ ID NO: 190243 - DNA, 23 bp, Mus musculus
aatatagttgaagaagtggtgaa

SEQ ID NO: 190244 - DNA, 20 bp, Mus musculus
tcctcctgagaatttgttgt

SEQ ID NO: 190245 - DNA, 23 bp, Mus musculus
aagagtggagaacgaggtcagag

SEQ ID NO: 190246 - DNA, 21 bp, Mus musculus
actgattccacattctgtgcc

SEQ ID NO: 190247 - DNA, 23 bp, Mus musculus
aagagcactgactggtcttccag

SEQ ID NO: 190248 - DNA, 19 bp, Mus musculus
gagacagcgagcacagttt

SEQ ID NO: 190249 - DNA, 23 bp, Mus musculus
ggctgactgactcacttcacagg

SEQ ID NO: 190250 - DNA, 18 bp, Mus musculus
gctatcccttatgcatgt

SEQ ID NO: 190251 - DNA, 22 bp, Mus musculus
tatgcgtgtgtatatgtatgtg

SEQ ID NO: 190252 - DNA, 21 bp, Mus musculus
tctctgtgtgtgtgtgttcac

SEQ ID NO: 190253 - DNA, 22 bp, Mus musculus
gtatgtatgtatgtatgtgtgt

SEQ ID NO: 190254 - DNA, 22 bp, Mus musculus
taagtgtgcatatgtattgcga

SEQ ID NO: 190255 - DNA, 23 bp, Mus musculus
tgtgatatgtgtactgtgtgagt

SEQ ID NO: 190256 - DNA, 22 bp, Mus musculus
tttaaggtaagtctggtaagtc

SEQ ID NO: 190257 - DNA, 22 bp, Mus musculus
tatatgtgtgtgatatacatgt

SEQ ID NO: 190258 - DNA, 23 bp, Mus musculus
tgtgtgtatgtatctgtatgtgt

SEQ ID NO: 190259 - DNA, 18 bp, Mus musculus
tacctgtatatgtacgtg

SEQ ID NO: 190260 - DNA, 20 bp, Mus musculus
cacaccagacagacagacag

SEQ ID NO: 190261 - DNA, 23 bp, Mus musculus
tccctgtggctcttctaagttct

SEQ ID NO: 190262 - DNA, 21 bp, Mus musculus
tcagtgggtggacaaagggag

SEQ ID NO: 190263 - DNA, 23 bp, Mus musculus
tggatgaggctgtgtgtcctgtg

SEQ ID NO: 190264 - DNA, 20 bp, Mus musculus
tctcgcgcactctgtctgct

SEQ ID NO: 190265 - DNA, 23 bp, Mus musculus
ctagctaaaggcagtacagtgtg

SEQ ID NO: 190266 - DNA, 23 bp, Mus musculus
ctgcctgtctgcctgtctgtctg

SEQ ID NO: 190267 - DNA, 18 bp, Mus musculus
cagacatgcaagtgtaga

SEQ ID NO: 190268 - DNA, 19 bp, Mus musculus
gcagcctaagagttgttac

SEQ ID NO: 190269 - DNA, 23 bp, Mus musculus
ttgagcaacttgaggggattcat

SEQ ID NO: 190270 - DNA, 23 bp, Mus musculus
gtatgtggaagtgtatagtatat

SEQ ID NO: 190271 - DNA, 19 bp, Mus musculus
tgctaattaataaggatag

SEQ ID NO: 190272 - DNA, 18 bp, Mus musculus
tcagtgggcagagagcac

SEQ ID NO: 190273 - DNA, 23 bp, Mus musculus
ggttgcttccgtgcttctgtgag

SEQ ID NO: 190274 - DNA, 22 bp, Mus musculus
tctgtgtgtgcagtgactccac

SEQ ID NO: 190275 - DNA, 23 bp, Mus musculus
tgagtctgtagatgcctctctga

SEQ ID NO: 190276 - DNA, 23 bp, Mus musculus
gccacagactctctattctccag

SEQ ID NO: 190277 - DNA, 23 bp, Mus musculus
tgtgttcatgcatgtgtgtgtgt

SEQ ID NO: 190278 - DNA, 22 bp, Mus musculus
gtgtgtatgtatgtgtgtgagt

SEQ ID NO: 190279 - DNA, 23 bp, Mus musculus
atatgtgtatatgtatatgtctg

SEQ ID NO: 190280 - DNA, 22 bp, Mus musculus
tgattgcgactagtacttctga

SEQ ID NO: 190281 - DNA, 19 bp, Mus musculus
tatgtgcatatgtgaatgt

SEQ ID NO: 190282 - DNA, 21 bp, Mus musculus
atgtatatgtatatgtgtgtg

SEQ ID NO: 190283 - DNA, 22 bp, Mus musculus
ctttcctgttttctctgtaggt

SEQ ID NO: 190284 - DNA, 23 bp, Mus musculus
gactgacagacagacagacagac

SEQ ID NO: 190285 - DNA, 20 bp, Mus musculus
ttagggagatgatgcgttca

SEQ ID NO: 190286 - DNA, 20 bp, Mus musculus
caagggaagttgatagtgca

SEQ ID NO: 190287 - DNA, 22 bp, Mus musculus
ctgactgacactgtcagtcctt

SEQ ID NO: 190288 - DNA, 19 bp, Mus musculus
tctgtttcttctttgacct

SEQ ID NO: 190289 - DNA, 23 bp, Mus musculus
gtctgtctgtctgtctgaaccac

SEQ ID NO: 190290 - DNA, 23 bp, Mus musculus
actctccgtgcctcagtctcctc

SEQ ID NO: 190291 - DNA, 23 bp, Mus musculus
atgtatgtatatatgtatgtgtg

SEQ ID NO: 190292 - DNA, 19 bp, Mus musculus
ggggctgaagagatggctc

SEQ ID NO: 190293 - DNA, 20 bp, Mus musculus
atatgtgtgtgtgtatatgt

SEQ ID NO: 190294 - DNA, 23 bp, Mus musculus
tgcctgcctgcctgcctgcctgc

SEQ ID NO: 190295 - DNA, 22 bp, Mus musculus
taatgtgaattgagagctggaa

SEQ ID NO: 190296 - DNA, 18 bp, Mus musculus
ttacaagagatgcgtgtg

SEQ ID NO: 190297 - DNA, 23 bp, Mus musculus
tgtgtgtgtgcatatgcatgtga

SEQ ID NO: 190298 - DNA, 23 bp, Mus musculus
tatgtatgtgtatatgtatgtgt

SEQ ID NO: 190299 - DNA, 20 bp, Mus musculus
tgtgtgtgtgtgtgtctgct

SEQ ID NO: 190300 - DNA, 23 bp, Mus musculus
tgtatatgatatgcatcatatgt

SEQ ID NO: 190301 - DNA, 20 bp, Mus musculus
atatgatacatgttatatgt

SEQ ID NO: 190302 - DNA, 23 bp, Mus musculus
atatgtgtatatatgtatatgta

SEQ ID NO: 190303 - DNA, 22 bp, Mus musculus
atatgtgtatatatgtatatgt

SEQ ID NO: 190304 - DNA, 23 bp, Mus musculus
tatgtgtatgtatgtatatgtgt

SEQ ID NO: 190305 - DNA, 23 bp, Mus musculus
agtgcaccactaagtcggtcagc

SEQ ID NO: 190306 - DNA, 23 bp, Mus musculus
ctctgcttccctctctgtctaca

SEQ ID NO: 190307 - DNA, 21 bp, Mus musculus
tatgacaggcatcttagaggc

SEQ ID NO: 190308 - DNA, 19 bp, Mus musculus
cagagagatgactcagcag

SEQ ID NO: 190309 - DNA, 23 bp, Mus musculus
aagagcactgactgctcttccag

SEQ ID NO: 190310 - DNA, 20 bp, Mus musculus
gtctctctgtctctcccagg

SEQ ID NO: 190311 - DNA, 23 bp, Mus musculus
tctgtggctgagagacagggtga

SEQ ID NO: 190312 - DNA, 20 bp, Mus musculus
aagagcactgactgctcttc

SEQ ID NO: 190313 - DNA, 23 bp, Mus musculus
cccagagacaagagagtccccac

SEQ ID NO: 190314 - DNA, 23 bp, Mus musculus
gaaatgagagagctaggcgtgtc

SEQ ID NO: 190315 - DNA, 19 bp, Mus musculus
ctctctgtatatctgtctg

SEQ ID NO: 190316 - DNA, 23 bp, Mus musculus
gagcctgcctctgagcctcagtg

SEQ ID NO: 190317 - DNA, 20 bp, Mus musculus
tgtagtatgcatgcacatga

SEQ ID NO: 190318 - DNA, 22 bp, Mus musculus
ctgtggctctgagtgtcccact

SEQ ID NO: 190319 - DNA, 19 bp, Mus musculus
tgtgtgtatatctgtgtgt

SEQ ID NO: 190320 - DNA, 20 bp, Mus musculus
taagagcactgactgctcct

SEQ ID NO: 190321 - DNA, 23 bp, Mus musculus
agtctgtctgcctgtctgcctgt

SEQ ID NO: 190322 - DNA, 23 bp, Mus musculus
tctcaggctctgtgttacctgtg

SEQ ID NO: 190323 - DNA, 23 bp, Mus musculus
tgtacttctatggatatgtgtgt

SEQ ID NO: 190324 - DNA, 23 bp, Mus musculus
acatatgtatatgaatttatgtg

SEQ ID NO: 190325 - DNA, 21 bp, Mus musculus
atatgtgtatatgaatttatg

SEQ ID NO: 190326 - DNA, 23 bp, Mus musculus
tgtatgtatgtatgtatatatgt

SEQ ID NO: 190327 - DNA, 22 bp, Mus musculus
ctccatcttcctcacactcact

SEQ ID NO: 190328 - DNA, 21 bp, Mus musculus
tttagtgctgagaaagcagga

SEQ ID NO: 190329 - DNA, 23 bp, Mus musculus
cgggtcactgtgactctcagtat

SEQ ID NO: 190330 - DNA, 23 bp, Mus musculus
cagcctcagtctgtgttttactc

SEQ ID NO: 190331 - DNA, 23 bp, Mus musculus
gtgagtgagtgagtgtgtgtgtg

SEQ ID NO: 190332 - DNA, 23 bp, Mus musculus
ccacacagtgactgagtgtgtgc

SEQ ID NO: 190333 - DNA, 23 bp, Mus musculus
accacacagtgatgagtgtgtgc

SEQ ID NO: 190334 - DNA, 23 bp, Mus musculus
gtctgtctgtctgtatgttttct

SEQ ID NO: 190335 - DNA, 23 bp, Mus musculus
gtgttacactggctgttttcaag

SEQ ID NO: 190336 - DNA, 23 bp, Mus musculus
tctctgtgtgtgtatatgcactg

SEQ ID NO: 190337 - DNA, 22 bp, Mus musculus
tatgcagtgcatgcatgtgtgt

SEQ ID NO: 190338 - DNA, 23 bp, Mus musculus
tctgtctgtctgtctgtctgtct

SEQ ID NO: 190339 - DNA, 23 bp, Mus musculus
aagagtcaggtatacttgaggat

SEQ ID NO: 190340 - DNA, 23 bp, Mus musculus
tctctccctgtctgtgtggcttt

SEQ ID NO: 190341 - DNA, 23 bp, Mus musculus
tttatcactgaaggcagtcaggg

SEQ ID NO: 190342 - DNA, 23 bp, Mus musculus
gtctggctccctgacattacctc

SEQ ID NO: 190343 - DNA, 22 bp, Mus musculus
tgacagaggtcacagggcagaa

SEQ ID NO: 190344 - DNA, 22 bp, Mus musculus
tgtgagaacagagtcagctttg

SEQ ID NO: 190345 - DNA, 23 bp, Mus musculus
gtcagtcagtctgtcagtctgag

SEQ ID NO: 190346 - DNA, 22 bp, Mus musculus
tatgtgtgtatgtgcatatgat

SEQ ID NO: 190347 - DNA, 23 bp, Mus musculus
tgcatatatatcatgtgtgtatg

SEQ ID NO: 190348 - DNA, 22 bp, Mus musculus
gggtgactgaatgcctgactca

SEQ ID NO: 190349 - DNA, 21 bp, Mus musculus
aagcaggtttgtactggactg

SEQ ID NO: 190350 - DNA, 23 bp, Mus musculus
atctctgaccctgactcttacta

SEQ ID NO: 190351 - DNA, 23 bp, Mus musculus
tgtgagtgttttgcctgcctgtg

SEQ ID NO: 190352 - DNA, 23 bp, Mus musculus
atgtctgtccctcacaaagggct

SEQ ID NO: 190353 - DNA, 22 bp, Mus musculus
tgtgtgtgagcatgtgcatgtg

SEQ ID NO: 190354 - DNA, 21 bp, Mus musculus
tgtgggtgggtgtttgtacac

SEQ ID NO: 190355 - DNA, 18 bp, Mus musculus
ctgaggctctttagtggc

SEQ ID NO: 190356 - DNA, 23 bp, Mus musculus
tatatgcatgtatacttatgtgt

SEQ ID NO: 190357 - DNA, 18 bp, Mus musculus
tgtgtgtgtatgtacata

SEQ ID NO: 190358 - DNA, 23 bp, Mus musculus
tctctctctgtgtatgtgtacat

SEQ ID NO: 190359 - DNA, 23 bp, Mus musculus
cagagctggagagatggcttact

SEQ ID NO: 190360 - DNA, 23 bp, Mus musculus
ttctgctgtctgtctgtctgtct

SEQ ID NO: 190361 - DNA, 23 bp, Mus musculus
ctgtctgtctctctgtgtgttct

SEQ ID NO: 190362 - DNA, 23 bp, Mus musculus
atgtatgtagtacaggtggtgtt

SEQ ID NO: 190363 - DNA, 22 bp, Mus musculus
ccactgtctctgtctctcatct

SEQ ID NO: 190364 - DNA, 23 bp, Mus musculus
caccttttgttttgtttctgagc

SEQ ID NO: 190365 - DNA, 23 bp, Mus musculus
gttatcagaagtcactctgctca

SEQ ID NO: 190366 - DNA, 23 bp, Mus musculus
ttgtgcatgtgtgtgtgcatgcg

SEQ ID NO: 190367 - DNA, 20 bp, Mus musculus
aagtatgtgtgcatgtgtgt

SEQ ID NO: 190368 - DNA, 18 bp, Mus musculus
tatgactggagctggagg

SEQ ID NO: 190369 - DNA, 19 bp, Mus musculus
ttactggtttctcaatctg

SEQ ID NO: 190370 - DNA, 23 bp, Mus musculus
ttgtgcatctgtatgtgcatgta

SEQ ID NO: 190371 - DNA, 19 bp, Mus musculus
caaggcatagattctggga

SEQ ID NO: 190372 - DNA, 21 bp, Mus musculus
tgtatgcatgtatgtatgtgc

SEQ ID NO: 190373 - DNA, 23 bp, Mus musculus
tgtatgtgtgcatgtgtgtgagt

SEQ ID NO: 190374 - DNA, 23 bp, Mus musculus
tgcctgcctgccagtcagccagt

SEQ ID NO: 190375 - DNA, 19 bp, Mus musculus
cagtgccgcagcagctctc

SEQ ID NO: 190376 - DNA, 21 bp, Mus musculus
agggtcagacaggcacactgg

SEQ ID NO: 190377 - DNA, 23 bp, Mus musculus
tgtctgtctctgagcctgtctgt

SEQ ID NO: 190378 - DNA, 21 bp, Mus musculus
tatgtgtgtgtatatgtgtgt

SEQ ID NO: 190379 - DNA, 23 bp, Mus musculus
tgcatgtgtgcctgagtaatatg

SEQ ID NO: 190380 - DNA, 23 bp, Mus musculus
tattgtgtatatgtatatgtatg

SEQ ID NO: 190381 - DNA, 19 bp, Mus musculus
atatgtgtatatatgaata

SEQ ID NO: 190382 - DNA, 23 bp, Mus musculus
ttgactgtgagaatccagcctga

SEQ ID NO: 190383 - DNA, 23 bp, Mus musculus
agccacaccaactcgatgtgctc

SEQ ID NO: 190384 - DNA, 23 bp, Mus musculus
tggatctgagttttgtgttaggg

SEQ ID NO: 190385 - DNA, 18 bp, Mus musculus
tgcatatgtatgcatata

SEQ ID NO: 190386 - DNA, 23 bp, Mus musculus
ggaaagagcaacaggatgtggtg

SEQ ID NO: 190387 - DNA, 23 bp, Mus musculus
tatacacatgtatgcatatgtgt

SEQ ID NO: 190388 - DNA, 20 bp, Mus musculus
atgtatgtatgcatgtatgt

SEQ ID NO: 190389 - DNA, 20 bp, Mus musculus
tctctcacctccaggagctc

SEQ ID NO: 190390 - DNA, 19 bp, Mus musculus
tctgtcagtgtgtctgggg

SEQ ID NO: 190391 - DNA, 21 bp, Mus musculus
tgtgtgtatatgtgtctgtat

SEQ ID NO: 190392 - DNA, 23 bp, Mus musculus
acactcagtggctgtgtggctcc

SEQ ID NO: 190393 - DNA, 21 bp, Mus musculus
agcctgcctccgtgtttccca

SEQ ID NO: 190394 - DNA, 23 bp, Mus musculus
cctgactccggctgtgtctcaga

SEQ ID NO: 190395 - DNA, 23 bp, Mus musculus
tctgtctctctctcacacacaca

SEQ ID NO: 190396 - DNA, 23 bp, Mus musculus
gtcactctgactctgtgtgggca

SEQ ID NO: 190397 - DNA, 23 bp, Mus musculus
cacccacagtgtctgtctctctc

SEQ ID NO: 190398 - DNA, 19 bp, Mus musculus
tgtctcaggttcagctggc

SEQ ID NO: 190399 - DNA, 19 bp, Mus musculus
atcacagcattctagtgtg

SEQ ID NO: 190400 - DNA, 23 bp, Mus musculus
agtgactagtcactgtgcacaag

SEQ ID NO: 190401 - DNA, 23 bp, Mus musculus
gtgtagttctgtttgtcttagtt

SEQ ID NO: 190402 - DNA, 23 bp, Mus musculus
ctgaacagtgatcagagtgactg

SEQ ID NO: 190403 - DNA, 20 bp, Mus musculus
atatatgtatgtgtattagt

SEQ ID NO: 190404 - DNA, 21 bp, Mus musculus
tagtggattttcagatgtgtg

SEQ ID NO: 190405 - DNA, 23 bp, Mus musculus
acagaaaatcaagagctatgaat

SEQ ID NO: 190406 - DNA, 23 bp, Mus musculus
tgagcatgtctctgtgtgtgttt

SEQ ID NO: 190407 - DNA, 23 bp, Mus musculus
caagtctgactctgtgtctggca

SEQ ID NO: 190408 - DNA, 20 bp, Mus musculus
tacagtagtgagataggtga

SEQ ID NO: 190409 - DNA, 23 bp, Mus musculus
agggattgaactcaggtcatcag

SEQ ID NO: 190410 - DNA, 22 bp, Mus musculus
gtagtaggagagctgggttctg

SEQ ID NO: 190411 - DNA, 23 bp, Mus musculus
tgtattgattatgttcttgtgct

SEQ ID NO: 190412 - DNA, 23 bp, Mus musculus
ttgaaggtgtgtctctgtctccc

SEQ ID NO: 190413 - DNA, 22 bp, Mus musculus
aaagaaatgttcaaagtcttag

SEQ ID NO: 190414 - DNA, 20 bp, Mus musculus
tcatggtggtctgataggat

SEQ ID NO: 190415 - DNA, 22 bp, Mus musculus
tgttttgtgaccaattatatgg

SEQ ID NO: 190416 - DNA, 21 bp, Mus musculus
ttggtcatgatgtttgtgcag

SEQ ID NO: 190417 - DNA, 21 bp, Mus musculus
taagacactcactgataaggc

SEQ ID NO: 190418 - DNA, 23 bp, Mus musculus
cagtctcttagtctctcttttta

SEQ ID NO: 190419 - DNA, 23 bp, Mus musculus
tctcacaagtgagtcagcactcc

SEQ ID NO: 190420 - DNA, 23 bp, Mus musculus
tagtgcatggtgatctgatagga

SEQ ID NO: 190421 - DNA, 22 bp, Mus musculus
tgttttgtgacctattatgtgg

SEQ ID NO: 190422 - DNA, 23 bp, Mus musculus
atatgtacatatacattctgaaa

SEQ ID NO: 190423 - DNA, 23 bp, Mus musculus
tatgtatatatatatgtgtgtgt

SEQ ID NO: 190424 - DNA, 21 bp, Mus musculus
agacagtgagctctgagctcc

SEQ ID NO: 190425 - DNA, 23 bp, Mus musculus
ttcaggagtatccagagactctg

SEQ ID NO: 190426 - DNA, 21 bp, Mus musculus
ggcacattcttgtctatggaa

SEQ ID NO: 190427 - DNA, 22 bp, Mus musculus
acagaggcagtcaaagtggtct

SEQ ID NO: 190428 - DNA, 22 bp, Mus musculus
tgtctcagttactgtttcttct

SEQ ID NO: 190429 - DNA, 23 bp, Mus musculus
tgtgtctctgtttagtttctgtt

SEQ ID NO: 190430 - DNA, 19 bp, Mus musculus
ttggaggctagagagatgg

SEQ ID NO: 190431 - DNA, 23 bp, Mus musculus
accatgagatgtgtgtgtgcaca

SEQ ID NO: 190432 - DNA, 23 bp, Mus musculus
aggttgtatgtatgtatgtatgt

SEQ ID NO: 190433 - DNA, 21 bp, Mus musculus
taggtgctcattaacagatga

SEQ ID NO: 190434 - DNA, 23 bp, Mus musculus
tatatatctatatctataatgga

SEQ ID NO: 190435 - DNA, 23 bp, Mus musculus
tctgtagtagggtagcacaactt

SEQ ID NO: 190436 - DNA, 23 bp, Mus musculus
aagagcactgactgctcttccag

SEQ ID NO: 190437 - DNA, 23 bp, Mus musculus
caacactcactgtgaccaaggga

SEQ ID NO: 190438 - DNA, 22 bp, Mus musculus
tcctaggctgagtgacactcac

SEQ ID NO: 190439 - DNA, 20 bp, Mus musculus
aatcagttatcttctttacc

SEQ ID NO: 190440 - DNA, 23 bp, Mus musculus
atgtatgtatgtatgtatgtatg

SEQ ID NO: 190441 - DNA, 23 bp, Mus musculus
gcatgcatgcatgtgtctgtgtg

SEQ ID NO: 190442 - DNA, 23 bp, Mus musculus
tctctgcctctctgtcggtctct

SEQ ID NO: 190443 - DNA, 22 bp, Mus musculus
gtgtgtgcatgtgcaagtgtgt

SEQ ID NO: 190444 - DNA, 23 bp, Mus musculus
tgtgtgtgtgagtgcatgtgcat

SEQ ID NO: 190445 - DNA, 19 bp, Mus musculus
tgtgcatgtgtgttcatgt

SEQ ID NO: 190446 - DNA, 20 bp, Mus musculus
agacctggagctacaggcag

SEQ ID NO: 190447 - DNA, 22 bp, Mus musculus
ccatgcctctgtgttagctcct

SEQ ID NO: 190448 - DNA, 18 bp, Mus musculus
agatgagtctatgctctt

SEQ ID NO: 190449 - DNA, 23 bp, Mus musculus
caggctgtcagtctcccagtctg

SEQ ID NO: 190450 - DNA, 22 bp, Mus musculus
atgtgtatgcatgcattcacat

SEQ ID NO: 190451 - DNA, 23 bp, Mus musculus
acatgtatgtgtgcatgtgtgtg

SEQ ID NO: 190452 - DNA, 23 bp, Mus musculus
tgtgtgtacatgtgcatgtgtct

SEQ ID NO: 190453 - DNA, 23 bp, Mus musculus
atgtgtgcgtgtgtgtgcacgca

SEQ ID NO: 190454 - DNA, 23 bp, Mus musculus
tctgtctgtctgtctgcctgtgt

SEQ ID NO: 190455 - DNA, 18 bp, Mus musculus
acctggatataaatgtat

SEQ ID NO: 190456 - DNA, 23 bp, Mus musculus
tggatataagtgtatatgtatat

SEQ ID NO: 190457 - DNA, 23 bp, Mus musculus
agctgtgtgacatcctgttcttc

SEQ ID NO: 190458 - DNA, 21 bp, Mus musculus
gacacaggacagtgagcacac

SEQ ID NO: 190459 - DNA, 19 bp, Mus musculus
tgagggtgtgagagctgga

SEQ ID NO: 190460 - DNA, 22 bp, Mus musculus
ctcagttctcagcaaccacatg

SEQ ID NO: 190461 - DNA, 23 bp, Mus musculus
tgtatgtatgtatatatgtatgt

SEQ ID NO: 190462 - DNA, 22 bp, Mus musculus
gttcaaatctcagcaaccacat

SEQ ID NO: 190463 - DNA, 23 bp, Mus musculus
aatgctgtctccctctctacaca

SEQ ID NO: 190464 - DNA, 23 bp, Mus musculus
tagctcaggcagtctgtccctcc

SEQ ID NO: 190465 - DNA, 23 bp, Mus musculus
tacaggagagaaatgagaaggaa

SEQ ID NO: 190466 - DNA, 23 bp, Mus musculus
gtatatgttctccaagggctgga

SEQ ID NO: 190467 - DNA, 23 bp, Mus musculus
agtactgactgctcttccagagg

SEQ ID NO: 190468 - DNA, 18 bp, Mus musculus
acacagaggagagtgagc

SEQ ID NO: 190469 - DNA, 18 bp, Mus musculus
atatagcccaggctgtct

SEQ ID NO: 190470 - DNA, 23 bp, Mus musculus
ttagtccatgttggtctgatagg

SEQ ID NO: 190471 - DNA, 22 bp, Mus musculus
tgttttgtgaccaactatgtgg

SEQ ID NO: 190472 - DNA, 23 bp, Mus musculus
tacagagtcattatgctttggat

SEQ ID NO: 190473 - DNA, 23 bp, Mus musculus
ctcaccctgactcactgcatcag

SEQ ID NO: 190474 - DNA, 20 bp, Mus musculus
agtggtagtcagactttctg

SEQ ID NO: 190475 - DNA, 23 bp, Mus musculus
gttctgagtctgagtctgtgtgt

SEQ ID NO: 190476 - DNA, 22 bp, Mus musculus
gacttgactctttgatgttctc

SEQ ID NO: 190477 - DNA, 23 bp, Mus musculus
tctcagtggcatatttcagagct

SEQ ID NO: 190478 - DNA, 23 bp, Mus musculus
tggtcacttgtctcgctgctggt

SEQ ID NO: 190479 - DNA, 20 bp, Mus musculus
gatgacaagtgtatttgaag

SEQ ID NO: 190480 - DNA, 23 bp, Mus musculus
acacagtacagagagagttcaag

SEQ ID NO: 190481 - DNA, 21 bp, Mus musculus
ttgtatgtgtgcatctgtatg

SEQ ID NO: 190482 - DNA, 21 bp, Mus musculus
tctgtgtctgtgtgtgtacat

SEQ ID NO: 190483 - DNA, 23 bp, Mus musculus
tgactgactgtctcacaaagccc

SEQ ID NO: 190484 - DNA, 23 bp, Mus musculus
aggaacacgaagtgctaagctca

SEQ ID NO: 190485 - DNA, 23 bp, Mus musculus
ctgacaccctcagtgacaggcag

SEQ ID NO: 190486 - DNA, 18 bp, Mus musculus
ggacttgacaggctgtga

SEQ ID NO: 190487 - DNA, 21 bp, Mus musculus
ctctcccactcagagcctgtg

SEQ ID NO: 190488 - DNA, 22 bp, Mus musculus
gacacagtaaatatatatctat

SEQ ID NO: 190489 - DNA, 19 bp, Mus musculus
tatggagtgaatggaagtt

SEQ ID NO: 190490 - DNA, 22 bp, Mus musculus
tgttttgtgaccaattatatgg

SEQ ID NO: 190491 - DNA, 22 bp, Mus musculus
atgtttacatcctacagtgtag

SEQ ID NO: 190492 - DNA, 22 bp, Mus musculus
tgttttgtgaccaattatatgg

SEQ ID NO: 190493 - DNA, 23 bp, Mus musculus
agattgacagttaagggtagaac

SEQ ID NO: 190494 - DNA, 22 bp, Mus musculus
aaggtagtacatgaattgagtc

SEQ ID NO: 190495 - DNA, 23 bp, Mus musculus
aagagtgctgtctgctcttccag

SEQ ID NO: 190496 - DNA, 23 bp, Mus musculus
aagagagcagagtgaggactcac

SEQ ID NO: 190497 - DNA, 23 bp, Mus musculus
ggcacactcagaggctaacctga

SEQ ID NO: 190498 - DNA, 23 bp, Mus musculus
tgtgtatgcacatgtgtgtgtgt

SEQ ID NO: 190499 - DNA, 21 bp, Mus musculus
cctctggctctgtgggactgt

SEQ ID NO: 190500 - DNA, 21 bp, Mus musculus
ttctcctaacagttctgtgtc

SEQ ID NO: 190501 - DNA, 18 bp, Mus musculus
cagtcgctctcacggtgg

SEQ ID NO: 190502 - DNA, 21 bp, Mus musculus
tgcctgcctgcctgcctgcga

SEQ ID NO: 190503 - DNA, 23 bp, Mus musculus
ccgtggctcagactcagtctcac

SEQ ID NO: 190504 - DNA, 23 bp, Mus musculus
atacacacatatgtatacacaca

SEQ ID NO: 190505 - DNA, 23 bp, Mus musculus
tatatgtatatatacatatgtgt

SEQ ID NO: 190506 - DNA, 21 bp, Mus musculus
taactctctccttctgttcac

SEQ ID NO: 190507 - DNA, 22 bp, Mus musculus
gtgtctgtctcagtcagtggct

SEQ ID NO: 190508 - DNA, 23 bp, Mus musculus
tgagactgtgactcataacgcac

SEQ ID NO: 190509 - DNA, 23 bp, Mus musculus
tttccactgtcttgatcttggtc

SEQ ID NO: 190510 - DNA, 18 bp, Mus musculus
ttatctaggagagactct

SEQ ID NO: 190511 - DNA, 23 bp, Mus musculus
tgtgtgtgcatgtgcatgtgtgc

SEQ ID NO: 190512 - DNA, 23 bp, Mus musculus
aagagcactgactgctcttccag

SEQ ID NO: 190513 - DNA, 20 bp, Mus musculus
cacactgtgcacacatcctg

SEQ ID NO: 190514 - DNA, 21 bp, Mus musculus
tctctgtctatgtcactgcta

SEQ ID NO: 190515 - DNA, 23 bp, Mus musculus
aaatgttgaactctggggctgga

SEQ ID NO: 190516 - DNA, 21 bp, Mus musculus
tctccctctcagtggcaagtc

SEQ ID NO: 190517 - DNA, 20 bp, Mus musculus
ctgtcactgacacacagcct

SEQ ID NO: 190518 - DNA, 23 bp, Mus musculus
tcactgcctgtctccgtccctct

SEQ ID NO: 190519 - DNA, 22 bp, Mus musculus
ccacacactcatgcgtgtgcca

SEQ ID NO: 190520 - DNA, 22 bp, Mus musculus
tagagttagatggtgtttgcct

SEQ ID NO: 190521 - DNA, 22 bp, Mus musculus
agaggtagatggatctctgtga

SEQ ID NO: 190522 - DNA, 23 bp, Mus musculus
tatgtgtgtgtacatgtgcatgt

SEQ ID NO: 190523 - DNA, 23 bp, Mus musculus
gaaccatgattagaaagcactct

SEQ ID NO: 190524 - DNA, 23 bp, Mus musculus
tctgtctgtctgtctgtctgcct

SEQ ID NO: 190525 - DNA, 23 bp, Mus musculus
gtctctctctgagtgtaggaggt

SEQ ID NO: 190526 - DNA, 19 bp, Mus musculus
tgtatatctgtgtgtgcag

SEQ ID NO: 190527 - DNA, 21 bp, Mus musculus
tcaggtagaagctactgttct

SEQ ID NO: 190528 - DNA, 22 bp, Mus musculus
tgttttgtgaccaattatatgg

SEQ ID NO: 190529 - DNA, 23 bp, Mus musculus
tatgtatgtgtatatctatagat

SEQ ID NO: 190530 - DNA, 23 bp, Mus musculus
ttgtctgtctgtctgtcaacatc

SEQ ID NO: 190531 - DNA, 23 bp, Mus musculus
ccagcaccttctgtgactctgtc

SEQ ID NO: 190532 - DNA, 23 bp, Mus musculus
tatgtatgtatatataagtgtgt

SEQ ID NO: 190533 - DNA, 23 bp, Mus musculus
atgtgaatatatgtatatgtgta

SEQ ID NO: 190534 - DNA, 23 bp, Mus musculus
tatgtgaatatatatatgtgtgg

SEQ ID NO: 190535 - DNA, 23 bp, Mus musculus
atatgtgtatatgtatatatgtg

SEQ ID NO: 190536 - DNA, 23 bp, Mus musculus
tatgtgacacagtaaaggtatga

SEQ ID NO: 190537 - DNA, 22 bp, Mus musculus
tgtcactcactctaagatctgt

SEQ ID NO: 190538 - DNA, 22 bp, Mus musculus
tgtgtatatatgtgtgtgtgta

SEQ ID NO: 190539 - DNA, 22 bp, Mus musculus
atatatgtgtgtatatatatgt

SEQ ID NO: 190540 - DNA, 23 bp, Mus musculus
gattctcaggttaggactttgct

SEQ ID NO: 190541 - DNA, 23 bp, Mus musculus
agagtgagactacagagacagtt

SEQ ID NO: 190542 - DNA, 23 bp, Mus musculus
tctctgtgtgtgtgtgtatgaat

SEQ ID NO: 190543 - DNA, 21 bp, Mus musculus
tttagttgctaatcgctgact

SEQ ID NO: 190544 - DNA, 23 bp, Mus musculus
tgtcacagtctctgagtgactga

SEQ ID NO: 190545 - DNA, 22 bp, Mus musculus
tgttttgtgaccaattatatgg

SEQ ID NO: 190546 - DNA, 19 bp, Mus musculus
aggagtggcctacatatct

SEQ ID NO: 190547 - DNA, 18 bp, Mus musculus
aaaggttctgagttcaat

SEQ ID NO: 190548 - DNA, 18 bp, Mus musculus
taagtggatgagttcagt

SEQ ID NO: 190549 - DNA, 22 bp, Mus musculus
tgtcacacaggatttcattttc

SEQ ID NO: 190550 - DNA, 20 bp, Mus musculus
tgagtggtagaaagaagtta

SEQ ID NO: 190551 - DNA, 19 bp, Mus musculus
atacatatattttcctatg

SEQ ID NO: 190552 - DNA, 23 bp, Mus musculus
tctgtgtatttacataggtgagt

SEQ ID NO: 190553 - DNA, 21 bp, Mus musculus
atctgtgtgtctgtgtgtctg

SEQ ID NO: 190554 - DNA, 18 bp, Mus musculus
atataggactatttgaag

SEQ ID NO: 190555 - DNA, 21 bp, Mus musculus
gaagagaaatgattttgatga

SEQ ID NO: 190556 - DNA, 21 bp, Mus musculus
ttcttgcacttcctcaggata

SEQ ID NO: 190557 - DNA, 18 bp, Mus musculus
gatgagtgccaagagagg

SEQ ID NO: 190558 - DNA, 23 bp, Mus musculus
ttatttggttttctagatgattt

SEQ ID NO: 190559 - DNA, 21 bp, Mus musculus
cagaaaggaaaggaagtctga

SEQ ID NO: 190560 - DNA, 23 bp, Mus musculus
aaatttcattttgtgtatgtgag

SEQ ID NO: 190561 - DNA, 18 bp, Mus musculus
tctcattgtctttccttg

SEQ ID NO: 190562 - DNA, 19 bp, Mus musculus
tgggacagggactcctcag

SEQ ID NO: 190563 - DNA, 22 bp, Mus musculus
gacctctctcttgctctcagtg

SEQ ID NO: 190564 - DNA, 23 bp, Mus musculus
agtagagtgttgttcagtttcca

SEQ ID NO: 190565 - DNA, 22 bp, Mus musculus
gtgtgcaacagataggagttcc

SEQ ID NO: 190566 - DNA, 23 bp, Mus musculus
actagtctcaagctcactctgac

SEQ ID NO: 190567 - DNA, 23 bp, Mus musculus
tctgtgcttctgtgtgcaggctt

SEQ ID NO: 190568 - DNA, 23 bp, Mus musculus
tgcgtgtgtgtctgtctgcctgt

SEQ ID NO: 190569 - DNA, 23 bp, Mus musculus
catgtgtgtgtgcatgtgcatgt

SEQ ID NO: 190570 - DNA, 23 bp, Mus musculus
tacatgtgtgtgcatgttcatgc

SEQ ID NO: 190571 - DNA, 20 bp, Mus musculus
atttatagtgcaggttcatc

SEQ ID NO: 190572 - DNA, 23 bp, Mus musculus
tatgtgtgcatgtgtgtatatgt

SEQ ID NO: 190573 - DNA, 21 bp, Mus musculus
tatgtgtatatgtatatgtgt

SEQ ID NO: 190574 - DNA, 23 bp, Mus musculus
atgcatgtgtgtgtgtgtgtgtg

SEQ ID NO: 190575 - DNA, 21 bp, Mus musculus
caaagatctgtgagtggtgct

SEQ ID NO: 190576 - DNA, 23 bp, Mus musculus
cagcgtgactgtctctgtggccc

SEQ ID NO: 190577 - DNA, 18 bp, Mus musculus
atacacacacacacatat

SEQ ID NO: 190578 - DNA, 22 bp, Mus musculus
tctggctctgacactctctcta

SEQ ID NO: 190579 - DNA, 21 bp, Mus musculus
ttgagaaatgtttagtagtgt

SEQ ID NO: 190580 - DNA, 21 bp, Mus musculus
tgctgcatattttatctgata

SEQ ID NO: 190581 - DNA, 23 bp, Mus musculus
ttatcaggcacttgaagtttttt

SEQ ID NO: 190582 - DNA, 23 bp, Mus musculus
tttaatgttctactgtattgttt

SEQ ID NO: 190583 - DNA, 22 bp, Mus musculus
atcacagttgctatctagggcc

SEQ ID NO: 190584 - DNA, 23 bp, Mus musculus
ttaatctctgtgaacctctgttt

SEQ ID NO: 190585 - DNA, 22 bp, Mus musculus
tgttttgtgaccaattatatgg

SEQ ID NO: 190586 - DNA, 22 bp, Mus musculus
tgttttgtgaccaattatatgg

SEQ ID NO: 190587 - DNA, 22 bp, Mus musculus
tcccatcctccaagtgtgtcgg

SEQ ID NO: 190588 - DNA, 23 bp, Mus musculus
cccttgatttttgacaaagccaa

SEQ ID NO: 190589 - DNA, 23 bp, Mus musculus
cccttgatttttgacaaagccaa

SEQ ID NO: 190590 - DNA, 23 bp, Mus musculus
cccttgatttttgacaaagccaa

SEQ ID NO: 190591 - DNA, 22 bp, Mus musculus
tacatccttgacatggagatgt

SEQ ID NO: 190592 - DNA, 18 bp, Mus musculus
ctgtctggctgtcatctc

SEQ ID NO: 190593 - DNA, 22 bp, Mus musculus
tgttttgtgaccaattatatgg

SEQ ID NO: 190594 - DNA, 22 bp, Mus musculus
ttatatgcagaggtataattgt

SEQ ID NO: 190595 - DNA, 22 bp, Mus musculus
tatgtgtgtgcttatgtgtgtg

SEQ ID NO: 190596 - DNA, 23 bp, Mus musculus
tctctctctgtgcctcagttgat

SEQ ID NO: 190597 - DNA, 20 bp, Mus musculus
agttcaattcccagcaaacc

SEQ ID NO: 190598 - DNA, 19 bp, Mus musculus
aagagagggttgagacctg

SEQ ID NO: 190599 - DNA, 21 bp, Mus musculus
agagaatttttgttgttgtta

SEQ ID NO: 190600 - DNA, 23 bp, Mus musculus
taagagcactgactgctctttca

SEQ ID NO: 190601 - DNA, 22 bp, Mus musculus
ctctgcctctgtgtctgtcttt

SEQ ID NO: 190602 - DNA, 23 bp, Mus musculus
tgttgagttctaagacagtcagg

SEQ ID NO: 190603 - DNA, 23 bp, Mus musculus
tgtatgtccatgtgcatgtggca

SEQ ID NO: 190604 - DNA, 23 bp, Mus musculus
gtgtgatctgctggatgtgggtg

SEQ ID NO: 190605 - DNA, 22 bp, Mus musculus
cttgtctgtctgtctgtctctc

SEQ ID NO: 190606 - DNA, 23 bp, Mus musculus
agtgttgttcctctgtctgtgtg

SEQ ID NO: 190607 - DNA, 23 bp, Mus musculus
agacagacagacagggatgatgg

SEQ ID NO: 190608 - DNA, 23 bp, Mus musculus
tatgtgtgtatgtgtatatgtgt

SEQ ID NO: 190609 - DNA, 23 bp, Mus musculus
gtgcatttgcatgtgcatgtgta

SEQ ID NO: 190610 - DNA, 19 bp, Mus musculus
tatgtgtgcgtgcatttgt

SEQ ID NO: 190611 - DNA, 23 bp, Mus musculus
ccctggctcactctctgcttctg

SEQ ID NO: 190612 - DNA, 21 bp, Mus musculus
agagcttacactaacactaca

SEQ ID NO: 190613 - DNA, 19 bp, Mus musculus
tctctctgcagggcagtct

SEQ ID NO: 190614 - DNA, 20 bp, Mus musculus
tgagagggaatgaattgact

SEQ ID NO: 190615 - DNA, 22 bp, Mus musculus
gcttagctctcactttaagaag

SEQ ID NO: 190616 - DNA, 19 bp, Mus musculus
gtatgtatgtatgtatgca

SEQ ID NO: 190617 - DNA, 21 bp, Mus musculus
gtatgcatgcatgcatgtatg

SEQ ID NO: 190618 - DNA, 22 bp, Mus musculus
tgttttgtgaccaattatatgg

SEQ ID NO: 190619 - DNA, 22 bp, Mus musculus
accatgctggtcactttgttgt

SEQ ID NO: 190620 - DNA, 23 bp, Mus musculus
ttctctctctttcagagtgtctg

SEQ ID NO: 190621 - DNA, 23 bp, Mus musculus
ttttactcactccatgatctctc

SEQ ID NO: 190622 - DNA, 19 bp, Mus musculus
acctggcttgaatgggtct

SEQ ID NO: 190623 - DNA, 22 bp, Mus musculus
tgttttgtgaccaattatatgg

SEQ ID NO: 190624 - DNA, 19 bp, Mus musculus
ttattctttatttgaatga

SEQ ID NO: 190625 - DNA, 23 bp, Mus musculus
tgctaagaaattccttacctcta

SEQ ID NO: 190626 - DNA, 22 bp, Mus musculus
tgttttgtgaccaattatatgg

SEQ ID NO: 190627 - DNA, 22 bp, Mus musculus
tgttttgtgaccaattatatgg

SEQ ID NO: 190628 - DNA, 21 bp, Mus musculus
tcacaggagagtgaagtcacc

SEQ ID NO: 190629 - DNA, 23 bp, Mus musculus
gacactctgtgacccactgaagg

SEQ ID NO: 190630 - DNA, 23 bp, Mus musculus
tcagactggaaaacgaagacact

SEQ ID NO: 190631 - DNA, 23 bp, Mus musculus
tcccaggctcacaaccatctgtt

SEQ ID NO: 190632 - DNA, 23 bp, Mus musculus
acacaaatgagtttcatatgttc

SEQ ID NO: 190633 - DNA, 23 bp, Mus musculus
ctaattctgtctggttttcatgt

SEQ ID NO: 190634 - DNA, 20 bp, Mus musculus
ttctgcagagcatctattgt

SEQ ID NO: 190635 - DNA, 21 bp, Mus musculus
tttaatccatttcattttcac

SEQ ID NO: 190636 - DNA, 23 bp, Mus musculus
agcacacagtggagtgtgaggtg

SEQ ID NO: 190637 - DNA, 22 bp, Mus musculus
tgttttgtgaccaattatatgg

SEQ ID NO: 190638 - DNA, 23 bp, Mus musculus
tatgtgtgcatgtgtacctgcat

SEQ ID NO: 190639 - DNA, 23 bp, Mus musculus
cttggaatagattatctaatata

SEQ ID NO: 190640 - DNA, 23 bp, Mus musculus
attctgtggataataatgtctaa

SEQ ID NO: 190641 - DNA, 23 bp, Mus musculus
tgagaaagacattgtttaacctg

SEQ ID NO: 190642 - DNA, 23 bp, Mus musculus
ctgtctgtctgtctgtctgtctg

SEQ ID NO: 190643 - DNA, 23 bp, Mus musculus
atgtgtatttataaatgtatgtg

SEQ ID NO: 190644 - DNA, 23 bp, Mus musculus
tgccactgtgcctgtgacagtgc

SEQ ID NO: 190645 - DNA, 23 bp, Mus musculus
agtgaccataggtgtgtggattc

SEQ ID NO: 190646 - DNA, 23 bp, Mus musculus
tatgagtgtgtatatgcagaggt

SEQ ID NO: 190647 - DNA, 23 bp, Mus musculus
gaatgtgtgtgtatatacgtata

SEQ ID NO: 190648 - DNA, 22 bp, Mus musculus
tgtgtgtacatatatgtgtgtg

SEQ ID NO: 190649 - DNA, 23 bp, Mus musculus
atatgtgtatatatatatgtgtg

SEQ ID NO: 190650 - DNA, 20 bp, Mus musculus
tggctcagtggttaggagca

SEQ ID NO: 190651 - DNA, 18 bp, Mus musculus
ctctaacagtctgttgtt

SEQ ID NO: 190652 - DNA, 18 bp, Mus musculus
tgggaagatagctcgatg

SEQ ID NO: 190653 - DNA, 23 bp, Mus musculus
tctttaagtggtgcttatgacaa

SEQ ID NO: 190654 - DNA, 23 bp, Mus musculus
taacaagatggagtgtgttgtgg

SEQ ID NO: 190655 - DNA, 23 bp, Mus musculus
acaactctctctctctcttttgg

SEQ ID NO: 190656 - DNA, 23 bp, Mus musculus
attagagtaggaggagttaggca

SEQ ID NO: 190657 - DNA, 23 bp, Mus musculus
ctcaggatttactttgtggaagg

SEQ ID NO: 190658 - DNA, 22 bp, Mus musculus
tgttttgtgaccaattatatgg

SEQ ID NO: 190659 - DNA, 23 bp, Mus musculus
atgtgagtgtatgcatatatgtg

SEQ ID NO: 190660 - DNA, 22 bp, Mus musculus
aacaaactttgtatttgtgtaa

SEQ ID NO: 190661 - DNA, 19 bp, Mus musculus
tgtaatataggtgctatgg

SEQ ID NO: 190662 - DNA, 23 bp, Mus musculus
tgctctcatctgtatcagttagg

SEQ ID NO: 190663 - DNA, 22 bp, Mus musculus
agtactctcatctgtatcagtt

SEQ ID NO: 190664 - DNA, 23 bp, Mus musculus
atacttgggtctgtgaatgtcaa

SEQ ID NO: 190665 - DNA, 23 bp, Mus musculus
tatgtatttatgcatatgtgtgt

SEQ ID NO: 190666 - DNA, 23 bp, Mus musculus
atgtatgtatgcatgtttgtatg

SEQ ID NO: 190667 - DNA, 19 bp, Mus musculus
cactggaatgatgtaaggc

SEQ ID NO: 190668 - DNA, 21 bp, Mus musculus
tgagtatagaagtagaacccc

SEQ ID NO: 190669 - DNA, 22 bp, Mus musculus
cagtcttaggccatggtggtct

SEQ ID NO: 190670 - DNA, 21 bp, Mus musculus
tccatggtggtctgataggat

SEQ ID NO: 190671 - DNA, 22 bp, Mus musculus
tgttttgtgaccaattatatgg

SEQ ID NO: 190672 - DNA, 22 bp, Mus musculus
cttgttcagttttcttggagta

SEQ ID NO: 190673 - DNA, 23 bp, Mus musculus
atatgtatatatgtatatatgtg

SEQ ID NO: 190674 - DNA, 22 bp, Mus musculus
tgttttgtgaccaattatatgg

SEQ ID NO: 190675 - DNA, 23 bp, Mus musculus
aaaaggttgtacaataagtgaag

SEQ ID NO: 190676 - DNA, 21 bp, Mus musculus
ctgtgagcatctgcatctgga

SEQ ID NO: 190677 - DNA, 21 bp, Mus musculus
catcttcctctctctgtccct

SEQ ID NO: 190678 - DNA, 23 bp, Mus musculus
aaacactgagtgctcttccagag

SEQ ID NO: 190679 - DNA, 23 bp, Mus musculus
tcaacagcaagcactgcacatag

SEQ ID NO: 190680 - DNA, 21 bp, Mus musculus
aaggctgtatatgcatcgtgt

SEQ ID NO: 190681 - DNA, 22 bp, Mus musculus
acacagagcagagtcaggctag

SEQ ID NO: 190682 - DNA, 19 bp, Mus musculus
atatgtgtatatatatttg

SEQ ID NO: 190683 - DNA, 21 bp, Mus musculus
aaacatacatgtatacatgtg

SEQ ID NO: 190684 - DNA, 19 bp, Mus musculus
tgagagaagaaagtgacca

SEQ ID NO: 190685 - DNA, 22 bp, Mus musculus
tgttttgtgaccaattatatgg

SEQ ID NO: 190686 - DNA, 23 bp, Mus musculus
caatatttttgtatctgttgagg

SEQ ID NO: 190687 - DNA, 19 bp, Mus musculus
aagactcaacacagaagca

SEQ ID NO: 190688 - DNA, 20 bp, Mus musculus
tatgagtcctgtttagttga

SEQ ID NO: 190689 - DNA, 22 bp, Mus musculus
atttccattttctgcatccaga

SEQ ID NO: 190690 - DNA, 23 bp, Mus musculus
tatgtatatgtatatgtatatgt

SEQ ID NO: 190691 - DNA, 21 bp, Mus musculus
ttatgctaaagaaatctcaga

SEQ ID NO: 190692 - DNA, 22 bp, Mus musculus
tgttttgtgaccaattatatgg

SEQ ID NO: 190693 - DNA, 22 bp, Mus musculus
tgttttgtgaccaattatatgg

SEQ ID NO: 190694 - DNA, 22 bp, Mus musculus
tgttttgtgaccaattatatgg

SEQ ID NO: 190695 - DNA, 23 bp, Mus musculus
tagtgcatggtgatctgatagga

SEQ ID NO: 190696 - DNA, 21 bp, Mus musculus
tgttttgtgaccaattatgtg

SEQ ID NO: 190697 - DNA, 23 bp, Mus musculus
gtgtgtgtctctgtgtgtgctca

SEQ ID NO: 190698 - DNA, 23 bp, Mus musculus
aaattgaacttctggaggactat

SEQ ID NO: 190699 - DNA, 19 bp, Mus musculus
agctatgttgtacagattc

SEQ ID NO: 190700 - DNA, 19 bp, Mus musculus
tatatgtatatgtatgtga

SEQ ID NO: 190701 - DNA, 23 bp, Mus musculus
tcagtatgtatatgtttgtgtat

SEQ ID NO: 190702 - DNA, 22 bp, Mus musculus
atatgtccatttctgtatgcat

SEQ ID NO: 190703 - DNA, 22 bp, Mus musculus
ctgtctctgactggagtctgtt

SEQ ID NO: 190704 - DNA, 22 bp, Mus musculus
tcagaactccttagagtccagt

SEQ ID NO: 190705 - DNA, 23 bp, Mus musculus
tgagaagagagtgagctctatag

SEQ ID NO: 190706 - DNA, 23 bp, Mus musculus
acaactatgcaaaacttatatga

SEQ ID NO: 190707 - DNA, 23 bp, Mus musculus
tgtatgtgcatgtgcatgtgtct

SEQ ID NO: 190708 - DNA, 20 bp, Mus musculus
tatatgtacatatacataca

SEQ ID NO: 190709 - DNA, 22 bp, Mus musculus
ttgaggtagaagtatgcatagt

SEQ ID NO: 190710 - DNA, 21 bp, Mus musculus
catctgataaagttgttgtga

SEQ ID NO: 190711 - DNA, 23 bp, Mus musculus
gtacatatgtatgcatgtatgca

SEQ ID NO: 190712 - DNA, 22 bp, Mus musculus
gtatgcatgtatgtaaatatgt

SEQ ID NO: 190713 - DNA, 23 bp, Mus musculus
tatcattatctcataggtttccc

SEQ ID NO: 190714 - DNA, 23 bp, Mus musculus
gagaagtcttaatcttgttaaag

SEQ ID NO: 190715 - DNA, 22 bp, Mus musculus
tgttttgtgaccaattatatgg

SEQ ID NO: 190716 - DNA, 23 bp, Mus musculus
tttctgactctgactgtggcttg

SEQ ID NO: 190717 - DNA, 22 bp, Mus musculus
atacacacacacgtatgtatgt

SEQ ID NO: 190718 - DNA, 23 bp, Mus musculus
tgtatgtatgtatgtatgtatgt

SEQ ID NO: 190719 - DNA, 23 bp, Mus musculus
gatcagtgcctgtctttgtcagt

SEQ ID NO: 190720 - DNA, 23 bp, Mus musculus
atatgtatatatgcatactgtag

SEQ ID NO: 190721 - DNA, 23 bp, Mus musculus
tccatggttgtctgataggatgc

SEQ ID NO: 190722 - DNA, 22 bp, Mus musculus
tgttttgtgaccaattatatgg

SEQ ID NO: 190723 - DNA, 21 bp, Mus musculus
cacagctacagctttccaaca

SEQ ID NO: 190724 - DNA, 23 bp, Mus musculus
acgtgcttgatcaactgattaca

SEQ ID NO: 190725 - DNA, 23 bp, Mus musculus
tatgtgtgtgtatatgtatgtgt

SEQ ID NO: 190726 - DNA, 23 bp, Mus musculus
agagaggactctgtgtgtctatg

SEQ ID NO: 190727 - DNA, 21 bp, Mus musculus
aagcatgtatgtatgtatgta

SEQ ID NO: 190728 - DNA, 19 bp, Mus musculus
aattctgaaaatttatttg

SEQ ID NO: 190729 - DNA, 23 bp, Mus musculus
ctatctgtggcactgtctgacag

SEQ ID NO: 190730 - DNA, 22 bp, Mus musculus
tgttttgtgaccaattatatgg

SEQ ID NO: 190731 - DNA, 22 bp, Mus musculus
gtgtgcatatatatatgtttat

SEQ ID NO: 190732 - DNA, 23 bp, Mus musculus
gtacatgtgtatacatgtaatgt

SEQ ID NO: 190733 - DNA, 23 bp, Mus musculus
ttatgcatttgtatatgtatgca

SEQ ID NO: 190734 - DNA, 23 bp, Mus musculus
atatgtatatatatatgtgtgtg

SEQ ID NO: 190735 - DNA, 23 bp, Mus musculus
tatgcatatattcctgtatgagt

SEQ ID NO: 190736 - DNA, 22 bp, Mus musculus
tgttttgtgaccaattatatgg

SEQ ID NO: 190737 - DNA, 22 bp, Mus musculus
tagctcagtcatattgaagatt

SEQ ID NO: 190738 - DNA, 23 bp, Mus musculus
tgattttcatagtgactgtgcca

SEQ ID NO: 190739 - DNA, 22 bp, Mus musculus
tgttttgtgaccaattatatgg

SEQ ID NO: 190740 - DNA, 20 bp, Mus musculus
aatgagcattctgaatgtga

SEQ ID NO: 190741 - DNA, 23 bp, Mus musculus
catctcattgtatgctgattatt

SEQ ID NO: 190742 - DNA, 18 bp, Mus musculus
aatgtggtgactttgcta

SEQ ID NO: 190743 - DNA, 23 bp, Mus musculus
atgtatatgtatatgtatatgta

SEQ ID NO: 190744 - DNA, 23 bp, Mus musculus
tgtatatgtatatgtatatgtat

SEQ ID NO: 190745 - DNA, 22 bp, Mus musculus
atgtatatgtatatgtatatga

SEQ ID NO: 190746 - DNA, 23 bp, Mus musculus
atagcttgttgtacttatgagat

SEQ ID NO: 190747 - DNA, 21 bp, Mus musculus
taaggtagttggaagtagagt

SEQ ID NO: 190748 - DNA, 22 bp, Mus musculus
tgttttgtgaccaattatatgg

SEQ ID NO: 190749 - DNA, 20 bp, Mus musculus
tatatgtgtatgtatatgta

SEQ ID NO: 190750 - DNA, 22 bp, Mus musculus
tgttttgtgaccaattatatgg

SEQ ID NO: 190751 - DNA, 23 bp, Mus musculus
tgtctgtctgtgtgcgtgtgagg

SEQ ID NO: 190752 - DNA, 19 bp, Mus musculus
agatccttagttcaaatcc

SEQ ID NO: 190753 - DNA, 21 bp, Mus musculus
aggtgagagagctatcttgtg

SEQ ID NO: 190754 - DNA, 22 bp, Mus musculus
tgttttgtgaccaattatatgg

SEQ ID NO: 190755 - DNA, 23 bp, Mus musculus
agaacactgactgctcttccaga

SEQ ID NO: 190756 - DNA, 22 bp, Mus musculus
agtatctgcatctgcttgtctt

SEQ ID NO: 190757 - DNA, 19 bp, Mus musculus
taggtcctgagttcaattc

SEQ ID NO: 190758 - DNA, 23 bp, Mus musculus
ctgagtctctgtttctctttcca

SEQ ID NO: 190759 - DNA, 23 bp, Mus musculus
atgtctgtctgtctgtctctcct

SEQ ID NO: 190760 - DNA, 19 bp, Mus musculus
tgtcactctggctttgaag

SEQ ID NO: 190761 - DNA, 18 bp, Mus musculus
catgtgtgtatatgtata

SEQ ID NO: 190762 - DNA, 23 bp, Mus musculus
gacagagagaagagagtctcctg

SEQ ID NO: 190763 - DNA, 20 bp, Mus musculus
atatctacatacacacacac

SEQ ID NO: 190764 - DNA, 23 bp, Mus musculus
aggagcagagtctgaagagagtg

SEQ ID NO: 190765 - DNA, 23 bp, Mus musculus
tgcttctggaagtgaaaagtgac

SEQ ID NO: 190766 - DNA, 23 bp, Mus musculus
gaagaaagaaactgaaaagccta

SEQ ID NO: 190767 - DNA, 18 bp, Mus musculus
tatatgtatatgtatatg

SEQ ID NO: 190768 - DNA, 23 bp, Mus musculus
gtcttcactgcacagtgccctct

SEQ ID NO: 190769 - DNA, 20 bp, Mus musculus
tgtgccacagtcccactctg

SEQ ID NO: 190770 - DNA, 18 bp, Mus musculus
gaaggctgtgaagagagc

SEQ ID NO: 190771 - DNA, 20 bp, Mus musculus
ctgaccctctgtctgtccct

SEQ ID NO: 190772 - DNA, 23 bp, Mus musculus
tatatatgtatgtctatgtatgt

SEQ ID NO: 190773 - DNA, 19 bp, Mus musculus
tatatgtatgtatatgtat

SEQ ID NO: 190774 - DNA, 19 bp, Mus musculus
tcctgctaattcactacct

SEQ ID NO: 190775 - DNA, 18 bp, Mus musculus
gggttctctctctctctc

SEQ ID NO: 190776 - DNA, 23 bp, Mus musculus
tctctcactctctcaaaatgatg

SEQ ID NO: 190777 - DNA, 22 bp, Mus musculus
gttctgtctctgtctgtctgtc

SEQ ID NO: 190778 - DNA, 22 bp, Mus musculus
atacacacacatatatgtatgt

SEQ ID NO: 190779 - DNA, 20 bp, Mus musculus
atttatgtatgtatgtgtgt

SEQ ID NO: 190780 - DNA, 23 bp, Mus musculus
agagagagcagagagagtggaga

SEQ ID NO: 190781 - DNA, 22 bp, Mus musculus
tctcaggttctgttctttcaga

SEQ ID NO: 190782 - DNA, 23 bp, Mus musculus
tgatttacagttcctatagagag

SEQ ID NO: 190783 - DNA, 22 bp, Mus musculus
tggaaagtaatgttctatccac

SEQ ID NO: 190784 - DNA, 23 bp, Mus musculus
tgtgtcactggttgaatggagtt

SEQ ID NO: 190785 - DNA, 23 bp, Mus musculus
cagttacttccagtattgggaca

SEQ ID NO: 190786 - DNA, 21 bp, Mus musculus
aattgtttctgctattgtcac

SEQ ID NO: 190787 - DNA, 23 bp, Mus musculus
tgtatgtatgtatgtatgtatgt

SEQ ID NO: 190788 - DNA, 19 bp, Mus musculus
tgtatgtatgtatgtatgt

SEQ ID NO: 190789 - DNA, 23 bp, Mus musculus
atgtatgtatgtatgtatgtatg

SEQ ID NO: 190790 - DNA, 21 bp, Mus musculus
tatgcctatatgtatgtatgt

SEQ ID NO: 190791 - DNA, 21 bp, Mus musculus
atgtatgtatgtatgtatgtt

SEQ ID NO: 190792 - DNA, 21 bp, Mus musculus
tgtatgtatgtatgtatgtcc

SEQ ID NO: 190793 - DNA, 23 bp, Mus musculus
gtatgtatgtatgtgtgtccgcg

SEQ ID NO: 190794 - DNA, 23 bp, Mus musculus
ccctgtctcagtgtctgtgtacc

SEQ ID NO: 190795 - DNA, 18 bp, Mus musculus
tctgcagaaccatgtctg

SEQ ID NO: 190796 - DNA, 19 bp, Mus musculus
atgtgtgtgtgcatgtgca

SEQ ID NO: 190797 - DNA, 18 bp, Mus musculus
tgtatgtgcatgtgcatc

SEQ ID NO: 190798 - DNA, 18 bp, Mus musculus
cacacccagatttcaacc

SEQ ID NO: 190799 - DNA, 19 bp, Mus musculus
tgtacatgtgtatatgtgt

SEQ ID NO: 190800 - DNA, 19 bp, Mus musculus
tgtgtatgtgtctgtgtgt

SEQ ID NO: 190801 - DNA, 18 bp, Mus musculus
atcgtgttggagctgcag

SEQ ID NO: 190802 - DNA, 21 bp, Mus musculus
ttaggagagggccttctctga

SEQ ID NO: 190803 - DNA, 22 bp, Mus musculus
tctctgtgtgtgtatgatgtat

SEQ ID NO: 190804 - DNA, 19 bp, Mus musculus
tatgtgtgtgtgatatgta

SEQ ID NO: 190805 - DNA, 19 bp, Mus musculus
tgtgtgtgagtgtatatgc

SEQ ID NO: 190806 - DNA, 23 bp, Mus musculus
gactgagtatctggtctgtaatt

SEQ ID NO: 190807 - DNA, 21 bp, Mus musculus
ttgtatgtgtgcatgtgcatg

SEQ ID NO: 190808 - DNA, 23 bp, Mus musculus
tgtgtatgtgtatatgtatgtat

SEQ ID NO: 190809 - DNA, 21 bp, Mus musculus
atacacacacacatatatatg

SEQ ID NO: 190810 - DNA, 23 bp, Mus musculus
cagcctctgtagagagtcagctg

SEQ ID NO: 190811 - DNA, 23 bp, Mus musculus
accagagtcagcacttgacagag

SEQ ID NO: 190812 - DNA, 21 bp, Mus musculus
aaccggaaagttcagtgattg

SEQ ID NO: 190813 - DNA, 22 bp, Mus musculus
tgagtgtatgtgaatgtgcaca

SEQ ID NO: 190814 - DNA, 21 bp, Mus musculus
gagacatgagagagagacctg

SEQ ID NO: 190815 - DNA, 23 bp, Mus musculus
agtcacatgtgtatagagtgttc

SEQ ID NO: 190816 - DNA, 22 bp, Mus musculus
tcctggagctcactgtgtagac

SEQ ID NO: 190817 - DNA, 23 bp, Mus musculus
atgtatctgtctgactgtctcgg

SEQ ID NO: 190818 - DNA, 23 bp, Mus musculus
cttctgtctctctcacttccagc

SEQ ID NO: 190819 - DNA, 23 bp, Mus musculus
atgtatatgtataagtatatgta

SEQ ID NO: 190820 - DNA, 23 bp, Mus musculus
gcctgagtgactgagtgactgag

SEQ ID NO: 190821 - DNA, 19 bp, Mus musculus
ctggggtctctctgtctct

SEQ ID NO: 190822 - DNA, 23 bp, Mus musculus
actgaccactgtgagcagtcatt

SEQ ID NO: 190823 - DNA, 23 bp, Mus musculus
ttcagtcaccatatgcatgcctt

SEQ ID NO: 190824 - DNA, 19 bp, Mus musculus
tagactgtgggagaacggt

SEQ ID NO: 190825 - DNA, 22 bp, Mus musculus
tgttttgtgaccaattatatgg

SEQ ID NO: 190826 - DNA, 23 bp, Mus musculus
tgtgagtatgtatgtgtgtatgt

SEQ ID NO: 190827 - DNA, 21 bp, Mus musculus
agagcttctagattgattact

SEQ ID NO: 190828 - DNA, 23 bp, Mus musculus
tgtgtgtatatgtatatgtgtct

SEQ ID NO: 190829 - DNA, 22 bp, Mus musculus
tgtatgtatgtatgtatgtatg

SEQ ID NO: 190830 - DNA, 23 bp, Mus musculus
taagcaattcttttgatgtatct

SEQ ID NO: 190831 - DNA, 22 bp, Mus musculus
tgttttgtgaccaattatatgg

SEQ ID NO: 190832 - DNA, 23 bp, Mus musculus
cttttgagagccattttgaagag

SEQ ID NO: 190833 - DNA, 20 bp, Mus musculus
aagactatgcctattctatg

SEQ ID NO: 190834 - DNA, 22 bp, Mus musculus
tataggacgtataaaatagaga

SEQ ID NO: 190835 - DNA, 21 bp, Mus musculus
atcactgaaggaagtcaggac

SEQ ID NO: 190836 - DNA, 22 bp, Mus musculus
tgtctatctatctgtctgtctg

SEQ ID NO: 190837 - DNA, 20 bp, Mus musculus
agtatgtgtgtctgcgcatg

SEQ ID NO: 190838 - DNA, 20 bp, Mus musculus
attgagactgctttttttat

SEQ ID NO: 190839 - DNA, 21 bp, Mus musculus
aaggtagaaggttgttttgat

SEQ ID NO: 190840 - DNA, 23 bp, Mus musculus
agtactgagagaggagatagagg

SEQ ID NO: 190841 - DNA, 23 bp, Mus musculus
tctgaatttggttggaaaactca

SEQ ID NO: 190842 - DNA, 22 bp, Mus musculus
tgacgtagatattacattggag

SEQ ID NO: 190843 - DNA, 22 bp, Mus musculus
tgagatgcttcagtgtccgtct

SEQ ID NO: 190844 - DNA, 20 bp, Mus musculus
tctgtctgagtcagctgatg

SEQ ID NO: 190845 - DNA, 22 bp, Mus musculus
agacaggacaaaatgcattctg

SEQ ID NO: 190846 - DNA, 18 bp, Mus musculus
tgacattgatatctgtac

SEQ ID NO: 190847 - DNA, 23 bp, Mus musculus
gggtgtgtccttgctcattggtt

SEQ ID NO: 190848 - DNA, 20 bp, Mus musculus
aatgcaaaggtatctatagt

SEQ ID NO: 190849 - DNA, 23 bp, Mus musculus
aatgactgggagctaagcatctc

SEQ ID NO: 190850 - DNA, 23 bp, Mus musculus
gttttatacatgcatatctatat

SEQ ID NO: 190851 - DNA, 20 bp, Mus musculus
atctatgtatggatgtgcat

SEQ ID NO: 190852 - DNA, 19 bp, Mus musculus
tatgtgtatatgtatatgt

SEQ ID NO: 190853 - DNA, 23 bp, Mus musculus
gtctctctgactatcaggcaggg

SEQ ID NO: 190854 - DNA, 21 bp, Mus musculus
agccagggtgttcatgagcag

SEQ ID NO: 190855 - DNA, 23 bp, Mus musculus
cgacagtgtgtatgctacaggtt

SEQ ID NO: 190856 - DNA, 19 bp, Mus musculus
gacttgagtatgtattggg

SEQ ID NO: 190857 - DNA, 18 bp, Mus musculus
tattcacatgcatataca

SEQ ID NO: 190858 - DNA, 22 bp, Mus musculus
tgttttgtgaccaattatatgg

SEQ ID NO: 190859 - DNA, 23 bp, Mus musculus
gtgtgtctctgtgtgagtgtgtc

SEQ ID NO: 190860 - DNA, 23 bp, Mus musculus
tctgtgtcactctaagtgctgtg

SEQ ID NO: 190861 - DNA, 23 bp, Mus musculus
aaaaatgtggttagatttattag

SEQ ID NO: 190862 - DNA, 23 bp, Mus musculus
cggtggagagagaaaacagaggg

SEQ ID NO: 190863 - DNA, 18 bp, Mus musculus
tttatggcagtctgtgtg

SEQ ID NO: 190864 - DNA, 22 bp, Mus musculus
tgttttgtgaccaattatatgg

SEQ ID NO: 190865 - DNA, 20 bp, Mus musculus
cctctgcagacactgacagg

SEQ ID NO: 190866 - DNA, 22 bp, Mus musculus
cccactctccctgtgctacccc

SEQ ID NO: 190867 - DNA, 23 bp, Mus musculus
aatagtgtcatgagtggctgcag

SEQ ID NO: 190868 - DNA, 23 bp, Mus musculus
cagccactctcagtgtgtcccca

SEQ ID NO: 190869 - DNA, 20 bp, Mus musculus
tgtgcctcgctctggggtgt

SEQ ID NO: 190870 - DNA, 22 bp, Mus musculus
tgtgtctgaagacagtgtactc

SEQ ID NO: 190871 - DNA, 23 bp, Mus musculus
aaagtacttccacatagtacagg

SEQ ID NO: 190872 - DNA, 23 bp, Mus musculus
aggatgtaaagttctaagttact

SEQ ID NO: 190873 - DNA, 21 bp, Mus musculus
tttcagtagattttgatctga

SEQ ID NO: 190874 - DNA, 18 bp, Mus musculus
gtatatatatttctgtgt

SEQ ID NO: 190875 - DNA, 22 bp, Mus musculus
atgatctgtccattgctgagaa

SEQ ID NO: 190876 - DNA, 23 bp, Mus musculus
gtgtgtgtgtctgcatgtgcatg

SEQ ID NO: 190877 - DNA, 18 bp, Mus musculus
gtggctgcctgtaagcca

SEQ ID NO: 190878 - DNA, 23 bp, Mus musculus
atcactcactggcttagtgactg

SEQ ID NO: 190879 - DNA, 23 bp, Mus musculus
tgcctgtctgactctctgcctgt

SEQ ID NO: 190880 - DNA, 22 bp, Mus musculus
acactggggtttgaatttctga

SEQ ID NO: 190881 - DNA, 23 bp, Mus musculus
acatctctctgtctctgtccacg

SEQ ID NO: 190882 - DNA, 18 bp, Mus musculus
tctctctctgtgtctgtg

SEQ ID NO: 190883 - DNA, 22 bp, Mus musculus
agatactcagtgagtcttcggg

SEQ ID NO: 190884 - DNA, 22 bp, Mus musculus
tgactgggactctgtctaagga

SEQ ID NO: 190885 - DNA, 21 bp, Mus musculus
tggagagagggtggctcagca

SEQ ID NO: 190886 - DNA, 23 bp, Mus musculus
actgaaacgctgagatgatgagt

SEQ ID NO: 190887 - DNA, 23 bp, Mus musculus
tgtctggttatctagctcaaact

SEQ ID NO: 190888 - DNA, 23 bp, Mus musculus
gggtctctggctcagttctgctc

SEQ ID NO: 190889 - DNA, 18 bp, Mus musculus
atggtggctcatgaacat

SEQ ID NO: 190890 - DNA, 20 bp, Mus musculus
ctctgtatatgtctctctgt

SEQ ID NO: 190891 - DNA, 20 bp, Mus musculus
tatgtgtgtgtgtatgtata

SEQ ID NO: 190892 - DNA, 23 bp, Mus musculus
gccagtctcagtgtctctctctt

SEQ ID NO: 190893 - DNA, 19 bp, Mus musculus
tctgtggtcaaaagactgt

SEQ ID NO: 190894 - DNA, 21 bp, Mus musculus
tctcccagagtctgtcactct

SEQ ID NO: 190895 - DNA, 23 bp, Mus musculus
ttacaggctgaagagctggctca

SEQ ID NO: 190896 - DNA, 23 bp, Mus musculus
agagcttcaggagtggctagaga

SEQ ID NO: 190897 - DNA, 23 bp, Mus musculus
gtgtgtgtgcatgtgtatgtcca

SEQ ID NO: 190898 - DNA, 23 bp, Mus musculus
gcctcactgtgtcactgggactg

SEQ ID NO: 190899 - DNA, 23 bp, Mus musculus
tgttaggtaaactttgtcattaa

SEQ ID NO: 190900 - DNA, 21 bp, Mus musculus
tgtatgtatatgtatgcatgt

SEQ ID NO: 190901 - DNA, 23 bp, Mus musculus
tctgtcactgtcttagatggcag

SEQ ID NO: 190902 - DNA, 22 bp, Mus musculus
tcagtgactcattttgaagtca

SEQ ID NO: 190903 - DNA, 21 bp, Mus musculus
ataggtagatagtgagttgga

SEQ ID NO: 190904 - DNA, 20 bp, Mus musculus
taaagggaggtaatgatgat

SEQ ID NO: 190905 - DNA, 20 bp, Mus musculus
attgattactagctcatggt

SEQ ID NO: 190906 - DNA, 19 bp, Mus musculus
tgtgcaagtatgtattatg

SEQ ID NO: 190907 - DNA, 23 bp, Mus musculus
tatgcttgtatgtatgtatgtac

SEQ ID NO: 190908 - DNA, 22 bp, Mus musculus
tgttttgtgaccaattatatgg

SEQ ID NO: 190909 - DNA, 20 bp, Mus musculus
tcttggaggtgtgagtctct

SEQ ID NO: 190910 - DNA, 20 bp, Mus musculus
tttagttttgtaagtctagt

SEQ ID NO: 190911 - DNA, 20 bp, Mus musculus
aagagagcagacaatggaca

SEQ ID NO: 190912 - DNA, 23 bp, Mus musculus
tgtatgtggatgtccttgtgcat

SEQ ID NO: 190913 - DNA, 20 bp, Mus musculus
atacatacacaatatgtatg

SEQ ID NO: 190914 - DNA, 23 bp, Mus musculus
atgtatgtatgtatgtatgtatg

SEQ ID NO: 190915 - DNA, 22 bp, Mus musculus
acacacagtcacgtatatatgt

SEQ ID NO: 190916 - DNA, 19 bp, Mus musculus
tgtatgtatgtatgtatgt

SEQ ID NO: 190917 - DNA, 23 bp, Mus musculus
tctgtcggtctgtctgtctcttt

SEQ ID NO: 190918 - DNA, 23 bp, Mus musculus
gtgtaggtcactctctctctttg

SEQ ID NO: 190919 - DNA, 21 bp, Mus musculus
gtgagcatttgaaaccccaaa

SEQ ID NO: 190920 - DNA, 21 bp, Mus musculus
acacaggggtcatgttgagtc

SEQ ID NO: 190921 - DNA, 23 bp, Mus musculus
ttcagactcaccctctgtgactg

SEQ ID NO: 190922 - DNA, 23 bp, Mus musculus
ttagtccgtgatgatctgatagg

SEQ ID NO: 190923 - DNA, 23 bp, Mus musculus
gtatgtgaatatgtgtataggta

SEQ ID NO: 190924 - DNA, 20 bp, Mus musculus
atatctaaatatgtatatat

SEQ ID NO: 190925 - DNA, 23 bp, Mus musculus
tatatatctgaatatctatatgt

SEQ ID NO: 190926 - DNA, 21 bp, Mus musculus
tgtgtccatgcatgtatgtat

SEQ ID NO: 190927 - DNA, 22 bp, Mus musculus
tacatatctctatatgtttttc

SEQ ID NO: 190928 - DNA, 18 bp, Mus musculus
aacacactcaggttatgt

SEQ ID NO: 190929 - DNA, 23 bp, Mus musculus
tctctgtctctgtctctgcctct

SEQ ID NO: 190930 - DNA, 21 bp, Mus musculus
tccatggtggtctgataggat

SEQ ID NO: 190931 - DNA, 23 bp, Mus musculus
tcaagttcatagtttccagaatg

SEQ ID NO: 190932 - DNA, 22 bp, Mus musculus
tgttttgtgaccaattatatgg

SEQ ID NO: 190933 - DNA, 22 bp, Mus musculus
tgttttgtgaccaattatatgg

SEQ ID NO: 190934 - DNA, 20 bp, Mus musculus
tagatgcatatgtaaatata

SEQ ID NO: 190935 - DNA, 18 bp, Mus musculus
atgtgtgtatttatgtat

SEQ ID NO: 190936 - DNA, 21 bp, Mus musculus
tgtaggtatgtatgcatatgt

SEQ ID NO: 190937 - DNA, 23 bp, Mus musculus
tgggtctctgtatctgtctccta

SEQ ID NO: 190938 - DNA, 23 bp, Mus musculus
atgtgtatgtgtgtatatgtaca

SEQ ID NO: 190939 - DNA, 23 bp, Mus musculus
ttattagttgctcaatgtggaca

SEQ ID NO: 190940 - DNA, 20 bp, Mus musculus
atgaccttgttggatgttaa

SEQ ID NO: 190941 - DNA, 22 bp, Mus musculus
tgttttgtgaccaattatatgg

SEQ ID NO: 190942 - DNA, 22 bp, Mus musculus
tgttttgtgaccaattatatgg

SEQ ID NO: 190943 - DNA, 22 bp, Mus musculus
ttattctcaggtattatatttg

SEQ ID NO: 190944 - DNA, 18 bp, Mus musculus
tgggccagacactgttga

SEQ ID NO: 190945 - DNA, 22 bp, Mus musculus
taaatgtcgatagcatatatat

SEQ ID NO: 190946 - DNA, 23 bp, Mus musculus
aatgcaaatgtaagcatttatga

SEQ ID NO: 190947 - DNA, 23 bp, Mus musculus
actctgtctctgtttagtttctg

SEQ ID NO: 190948 - DNA, 23 bp, Mus musculus
aggatctgtccattgatgagagt

SEQ ID NO: 190949 - DNA, 19 bp, Mus musculus
tatgtatatatacatatgt

SEQ ID NO: 190950 - DNA, 20 bp, Mus musculus
tatatgtatatgtatgtgta

SEQ ID NO: 190951 - DNA, 23 bp, Mus musculus
gacattggatatttatgcagtat

SEQ ID NO: 190952 - DNA, 18 bp, Mus musculus
atggtggtctgataggat

SEQ ID NO: 190953 - DNA, 18 bp, Mus musculus
tatagacatgtatatttg

SEQ ID NO: 190954 - DNA, 23 bp, Mus musculus
gtgaatgttcaggttggcttttg

SEQ ID NO: 190955 - DNA, 23 bp, Mus musculus
attcagagccagctttgaacatg

SEQ ID NO: 190956 - DNA, 22 bp, Mus musculus
tgttttgtgaccaattatatgg

SEQ ID NO: 190957 - DNA, 22 bp, Mus musculus
tgttttgtgaccaattatatgg

SEQ ID NO: 190958 - DNA, 23 bp, Mus musculus
tcaatgcaagagagaacaaacat

SEQ ID NO: 190959 - DNA, 21 bp, Mus musculus
aatggtgctggtgtagctggt

SEQ ID NO: 190960 - DNA, 22 bp, Mus musculus
tgttttgtgaccaattatatgg

SEQ ID NO: 190961 - DNA, 21 bp, Mus musculus
tatgtatgtatgtatatgtac

SEQ ID NO: 190962 - DNA, 23 bp, Mus musculus
ataggaaggatggttgtgtttac

SEQ ID NO: 190963 - DNA, 22 bp, Mus musculus
aacaatgtgtgtttctatagtg

SEQ ID NO: 190964 - DNA, 21 bp, Mus musculus
agttgtgtctgcctcagtctc

SEQ ID NO: 190965 - DNA, 22 bp, Mus musculus
tttgacattggataatctatca

SEQ ID NO: 190966 - DNA, 21 bp, Mus musculus
aaatgtgtatatgtatatatg

SEQ ID NO: 190967 - DNA, 23 bp, Mus musculus
attgggtttctaatctaaagtga

SEQ ID NO: 190968 - DNA, 21 bp, Mus musculus
tgtcagttgagtgagtgcagt

SEQ ID NO: 190969 - DNA, 22 bp, Mus musculus
catgcatggatgtatgtatgta

SEQ ID NO: 190970 - DNA, 18 bp, Mus musculus
agtttcaagtatgtgcat

SEQ ID NO: 190971 - DNA, 22 bp, Mus musculus
agatagatagatagatagatag

SEQ ID NO: 190972 - DNA, 19 bp, Mus musculus
ttggacacttcaatgtccc

SEQ ID NO: 190973 - DNA, 22 bp, Mus musculus
atgtgtttggtactgctctctg

SEQ ID NO: 190974 - DNA, 23 bp, Mus musculus
agttctgtgaacagtgactgtag

SEQ ID NO: 190975 - DNA, 22 bp, Mus musculus
tgttttgtgaccaattatatgg

SEQ ID NO: 190976 - DNA, 22 bp, Mus musculus
tgttttgtgaccaattatatgg

SEQ ID NO: 190977 - DNA, 23 bp, Mus musculus
ttgactgactgagtgtaacctgg

SEQ ID NO: 190978 - DNA, 19 bp, Mus musculus
tatggtcttctagaagacc

SEQ ID NO: 190979 - DNA, 22 bp, Mus musculus
aaaagtgtcctcagtctctgtt

SEQ ID NO: 190980 - DNA, 20 bp, Mus musculus
ttccctgttatttggtgact

SEQ ID NO: 190981 - DNA, 23 bp, Mus musculus
aagtgtctacactgtaggtgttc

SEQ ID NO: 190982 - DNA, 23 bp, Mus musculus
atgtatgtatgtatgtatgtgag

SEQ ID NO: 190983 - DNA, 22 bp, Mus musculus
tgttttgtgaccaattatatgg

SEQ ID NO: 190984 - DNA, 23 bp, Mus musculus
actgtctctctgtctctatcctg

SEQ ID NO: 190985 - DNA, 23 bp, Mus musculus
gacggacagacagactcactagg

SEQ ID NO: 190986 - DNA, 21 bp, Mus musculus
tgaccctgtgtctctgcctct

SEQ ID NO: 190987 - DNA, 22 bp, Mus musculus
cacagtggcatagagctgtgac

SEQ ID NO: 190988 - DNA, 23 bp, Mus musculus
tctctgtgtggctcagtttgcgc

SEQ ID NO: 190989 - DNA, 23 bp, Mus musculus
ccttgtcacatgagtgtgaggac

SEQ ID NO: 190990 - DNA, 18 bp, Mus musculus
gtatatatgtgtgaatgt

SEQ ID NO: 190991 - DNA, 23 bp, Mus musculus
gagagagagagatatgtttctga

SEQ ID NO: 190992 - DNA, 23 bp, Mus musculus
gctgtctcactgtctgtcaccta

SEQ ID NO: 190993 - DNA, 21 bp, Mus musculus
tgcagggactcagacaggtgg

SEQ ID NO: 190994 - DNA, 22 bp, Mus musculus
tgttttgtgaccaattatatgg

SEQ ID NO: 190995 - DNA, 19 bp, Mus musculus
cactcactcagtccctgct

SEQ ID NO: 190996 - DNA, 20 bp, Mus musculus
tctgtgtgtacagggtgcct

SEQ ID NO: 190997 - DNA, 20 bp, Mus musculus
aatgaggatgaagatggaga

SEQ ID NO: 190998 - DNA, 19 bp, Mus musculus
tctgtgctactgacttatt

SEQ ID NO: 190999 - DNA, 23 bp, Mus musculus
tatgtgtgtatatgtatgcatat

SEQ ID NO: 191000 - DNA, 23 bp, Mus musculus
tgaatccctgagaccctgagtgg

SEQ ID NO: 191001 - DNA, 23 bp, Mus musculus
tatgtggtgtacgtgtatgtatg

SEQ ID NO: 191002 - DNA, 21 bp, Mus musculus
ccaatgcctgtgagagagctg

SEQ ID NO: 191003 - DNA, 23 bp, Mus musculus
agaaagtgagcagagagtgagct

SEQ ID NO: 191004 - DNA, 23 bp, Mus musculus
ctgtggtttctgcttgaattcct

SEQ ID NO: 191005 - DNA, 23 bp, Mus musculus
tgaacttggctagctcttggctt

SEQ ID NO: 191006 - DNA, 23 bp, Mus musculus
tcagtcaagactcacagctgatg

SEQ ID NO: 191007 - DNA, 23 bp, Mus musculus
gatgaaatgtctaaggaagtctt

SEQ ID NO: 191008 - DNA, 21 bp, Mus musculus
tgacaggagtgactgtggaca

SEQ ID NO: 191009 - DNA, 23 bp, Mus musculus
atgagtgtgatgacagtgacctc

SEQ ID NO: 191010 - DNA, 23 bp, Mus musculus
gttttaactcttcctcatgctca

SEQ ID NO: 191011 - DNA, 19 bp, Mus musculus
ctctgtggagtgagtgcag

SEQ ID NO: 191012 - DNA, 23 bp, Mus musculus
gtgtggatatgtatatgtgtatg

SEQ ID NO: 191013 - DNA, 23 bp, Mus musculus
atttggctctagatctaatctgt

SEQ ID NO: 191014 - DNA, 23 bp, Mus musculus
atgtatgtgtgcatgtgtgtgtc

SEQ ID NO: 191015 - DNA, 21 bp, Mus musculus
tgggttcatgtatgtatgtgt

SEQ ID NO: 191016 - DNA, 22 bp, Mus musculus
ttacagttgatttctatacttt

SEQ ID NO: 191017 - DNA, 23 bp, Mus musculus
tctctctctctctttgttgagtc

SEQ ID NO: 191018 - DNA, 23 bp, Mus musculus
tctgtgtgtgcatgtccatgtgt

SEQ ID NO: 191019 - DNA, 18 bp, Mus musculus
atgcatatatttatgtat

SEQ ID NO: 191020 - DNA, 23 bp, Mus musculus
tcacttgagtttttgattttaag

SEQ ID NO: 191021 - DNA, 23 bp, Mus musculus
atctcagagtcattttgatatgc

SEQ ID NO: 191022 - DNA, 20 bp, Mus musculus
atgctagaagaccaaagtgt

SEQ ID NO: 191023 - DNA, 23 bp, Mus musculus
gtgtctctgagcctctgtgagcc

SEQ ID NO: 191024 - DNA, 22 bp, Mus musculus
gtcagtgtgtctgtctcagttt

SEQ ID NO: 191025 - DNA, 21 bp, Mus musculus
tgtggtgttcatatcttcgta

SEQ ID NO: 191026 - DNA, 21 bp, Mus musculus
atgggtatgtgcttatctagt

SEQ ID NO: 191027 - DNA, 23 bp, Mus musculus
agtcattctggttgtcctatggt

SEQ ID NO: 191028 - DNA, 23 bp, Mus musculus
tgagacagaactgtttttcttgt

SEQ ID NO: 191029 - DNA, 23 bp, Mus musculus
atatggttcactgtttgagttcc

SEQ ID NO: 191030 - DNA, 18 bp, Mus musculus
actgattcactggctcac

SEQ ID NO: 191031 - DNA, 19 bp, Mus musculus
ccctcacacttagtctata

SEQ ID NO: 191032 - DNA, 22 bp, Mus musculus
ttttgcttcaggtagtggtggt

SEQ ID NO: 191033 - DNA, 21 bp, Mus musculus
tgaaacctaggcatagtgtga

SEQ ID NO: 191034 - DNA, 23 bp, Mus musculus
agtagacactgagctttgaagat

SEQ ID NO: 191035 - DNA, 21 bp, Mus musculus
tgtttcgagtacatgcagctg

SEQ ID NO: 191036 - DNA, 19 bp, Mus musculus
tctatatgtgtgtgcatgc

SEQ ID NO: 191037 - DNA, 21 bp, Mus musculus
atttgacagaggcaggaatca

SEQ ID NO: 191038 - DNA, 23 bp, Mus musculus
agatttgacagaaatagttcttt

SEQ ID NO: 191039 - DNA, 20 bp, Mus musculus
gactgggtgtgtcaatgtct

SEQ ID NO: 191040 - DNA, 22 bp, Mus musculus
tgttttgtgaccaattatatgg

SEQ ID NO: 191041 - DNA, 23 bp, Mus musculus
tctcagtggaaatctatgtctca

SEQ ID NO: 191042 - DNA, 21 bp, Mus musculus
atatatgttgtgatggtttgt

SEQ ID NO: 191043 - DNA, 20 bp, Mus musculus
aagggacttgtacccctgat

SEQ ID NO: 191044 - DNA, 22 bp, Mus musculus
tattgcttcactctcactctta

SEQ ID NO: 191045 - DNA, 23 bp, Mus musculus
tgtgtgtgtatgaatatacatgt

SEQ ID NO: 191046 - DNA, 20 bp, Mus musculus
ttcgatgttaagcaatgcat

SEQ ID NO: 191047 - DNA, 21 bp, Mus musculus
atacgcatattttatatctga

SEQ ID NO: 191048 - DNA, 20 bp, Mus musculus
atatgttatatgtgaaaggt

SEQ ID NO: 191049 - DNA, 23 bp, Mus musculus
aacagttgagactcagcactgtg

SEQ ID NO: 191050 - DNA, 23 bp, Mus musculus
tgacagcaattcaaagagattgg

SEQ ID NO: 191051 - DNA, 20 bp, Mus musculus
tgtatgtatgtatatgtata

SEQ ID NO: 191052 - DNA, 23 bp, Mus musculus
gaaggatatggcaggcattcttc

SEQ ID NO: 191053 - DNA, 23 bp, Mus musculus
gatagatactctgtgcatatctt

SEQ ID NO: 191054 - DNA, 22 bp, Mus musculus
tgttttgtgaccaattatatgg

SEQ ID NO: 191055 - DNA, 23 bp, Mus musculus
tgtaaacatgcttgactctgtgg

SEQ ID NO: 191056 - DNA, 23 bp, Mus musculus
tatgcatggaaaagtagaatcta

SEQ ID NO: 191057 - DNA, 19 bp, Mus musculus
tcttagagcagagggaaca

SEQ ID NO: 191058 - DNA, 23 bp, Mus musculus
tctcactcactgatattaatttg

SEQ ID NO: 191059 - DNA, 20 bp, Mus musculus
tgctagagtgattttgtagt

SEQ ID NO: 191060 - DNA, 23 bp, Mus musculus
tctgcttcacactttgtctctgt

SEQ ID NO: 191061 - DNA, 23 bp, Mus musculus
tacaaggttgaaaactaaggact

SEQ ID NO: 191062 - DNA, 23 bp, Mus musculus
tagcatgtagaaatcctggtttg

SEQ ID NO: 191063 - DNA, 23 bp, Mus musculus
ttctgcagatgaagttgcagtgg

SEQ ID NO: 191064 - DNA, 18 bp, Mus musculus
tgtgcgtatgattgcatg

SEQ ID NO: 191065 - DNA, 21 bp, Mus musculus
tggcacaggatcagctctggg

SEQ ID NO: 191066 - DNA, 22 bp, Mus musculus
tggtctacttgtctgtcactat

SEQ ID NO: 191067 - DNA, 23 bp, Mus musculus
ctcctgtctctgtgtctgtgccc

SEQ ID NO: 191068 - DNA, 22 bp, Mus musculus
tgttttgtgaccaattatatgg

SEQ ID NO: 191069 - DNA, 23 bp, Mus musculus
agagacagagacatattgcacac

SEQ ID NO: 191070 - DNA, 21 bp, Mus musculus
cagtgcctatgaagagtctgt

SEQ ID NO: 191071 - DNA, 20 bp, Mus musculus
acagtgccaccaagtgggga

SEQ ID NO: 191072 - DNA, 23 bp, Mus musculus
tcagtatgacatgaagaagaagt

SEQ ID NO: 191073 - DNA, 23 bp, Mus musculus
ttctctggttctggttctctctc

SEQ ID NO: 191074 - DNA, 23 bp, Mus musculus
aggtctctctctgtgtttatgtc

SEQ ID NO: 191075 - DNA, 23 bp, Mus musculus
ttctgtcactgtgtctttctaat

SEQ ID NO: 191076 - DNA, 19 bp, Mus musculus
gtctctgtatccaccatca

SEQ ID NO: 191077 - DNA, 23 bp, Mus musculus
tttgaattgagattctgttgttc

SEQ ID NO: 191078 - DNA, 23 bp, Mus musculus
tcacacacactgggtgtcttaag

SEQ ID NO: 191079 - DNA, 23 bp, Mus musculus
atcactcactgactttcacacgt

SEQ ID NO: 191080 - DNA, 20 bp, Mus musculus
aaggttctaggagaggaggt

SEQ ID NO: 191081 - DNA, 23 bp, Mus musculus
ttgatgagtcattttgttcttcg

SEQ ID NO: 191082 - DNA, 20 bp, Mus musculus
aggagctatatttatcagat

SEQ ID NO: 191083 - DNA, 23 bp, Mus musculus
tgttgtgtttgcatgtatattac

SEQ ID NO: 191084 - DNA, 20 bp, Mus musculus
agtgaggtgagagtgaccag

SEQ ID NO: 191085 - DNA, 18 bp, Mus musculus
tcctgagttcaattgtgg

SEQ ID NO: 191086 - DNA, 21 bp, Mus musculus
attgtgtatcttgagattctg

SEQ ID NO: 191087 - DNA, 23 bp, Mus musculus
tctctcccagtctctctgctcca

SEQ ID NO: 191088 - DNA, 18 bp, Mus musculus
tttgagacgtaactgtct

SEQ ID NO: 191089 - DNA, 20 bp, Mus musculus
acaactggttgttatcatgt

SEQ ID NO: 191090 - DNA, 22 bp, Mus musculus
tcacattcacacccactgtctg

SEQ ID NO: 191091 - DNA, 22 bp, Mus musculus
tgttttgtgaccaattatatgg

SEQ ID NO: 191092 - DNA, 23 bp, Mus musculus
tgtagagatttcatgttttagaa

SEQ ID NO: 191093 - DNA, 23 bp, Mus musculus
agtccttctcagagactctgtca

SEQ ID NO: 191094 - DNA, 23 bp, Mus musculus
cactgtctgtctgtaatactgaa

SEQ ID NO: 191095 - DNA, 21 bp, Mus musculus
agagtggttttactatcaaga

SEQ ID NO: 191096 - DNA, 21 bp, Mus musculus
tatatgtatatatgtatacgt

SEQ ID NO: 191097 - DNA, 23 bp, Mus musculus
gattctgcaagtccaactgactg

SEQ ID NO: 191098 - DNA, 18 bp, Mus musculus
tgccttctaatgaacttt

SEQ ID NO: 191099 - DNA, 18 bp, Mus musculus
ctctctctttatatatac

SEQ ID NO: 191100 - DNA, 22 bp, Mus musculus
atacatgtgtgtgtgtgtatag

SEQ ID NO: 191101 - DNA, 23 bp, Mus musculus
aaatgaagactctgagatatcac

SEQ ID NO: 191102 - DNA, 21 bp, Mus musculus
tgtgtgtgtatatgtatatat

SEQ ID NO: 191103 - DNA, 21 bp, Mus musculus
tgatatgtatgtatttgtata

SEQ ID NO: 191104 - DNA, 20 bp, Mus musculus
tgggggtgtctttgagctga

SEQ ID NO: 191105 - DNA, 23 bp, Mus musculus
caaactgcatgtccttgtccaag

SEQ ID NO: 191106 - DNA, 22 bp, Mus musculus
gacagatgaattggagcacatg

SEQ ID NO: 191107 - DNA, 23 bp, Mus musculus
tctttgcctgtgtctcactctgt

SEQ ID NO: 191108 - DNA, 23 bp, Mus musculus
tttactagacacactctgtgaca

SEQ ID NO: 191109 - DNA, 22 bp, Mus musculus
tgttttgtgaccaattatatgg

SEQ ID NO: 191110 - DNA, 23 bp, Mus musculus
atacatttttgacagtgcctctg

SEQ ID NO: 191111 - DNA, 22 bp, Mus musculus
tgttttgtgaccaattatatgg

SEQ ID NO: 191112 - DNA, 22 bp, Mus musculus
tgttttgtgaccaattatatgg

SEQ ID NO: 191113 - DNA, 21 bp, Mus musculus
acagaaatgtagatagtactt

SEQ ID NO: 191114 - DNA, 23 bp, Mus musculus
aagtatttgattgcatttcttga

SEQ ID NO: 191115 - DNA, 23 bp, Mus musculus
gtgtgtgtgtgtgtgtgtgcatg

SEQ ID NO: 191116 - DNA, 23 bp, Mus musculus
gtctgtctctcaagcctcttcct

SEQ ID NO: 191117 - DNA, 21 bp, Mus musculus
aaatacagggtggatttcagg

SEQ ID NO: 191118 - DNA, 19 bp, Mus musculus
ttttgtattcttaggaatt

SEQ ID NO: 191119 - DNA, 18 bp, Mus musculus
aatttccacttaaacatg

SEQ ID NO: 191120 - DNA, 20 bp, Mus musculus
aatctcagagcttaacatct

SEQ ID NO: 191121 - DNA, 23 bp, Mus musculus
tagtccatgatgatctgatagga

SEQ ID NO: 191122 - DNA, 18 bp, Mus musculus
tgtgggactgagagggtg

SEQ ID NO: 191123 - DNA, 23 bp, Mus musculus
acactgaacaaacagtgcagaac

SEQ ID NO: 191124 - DNA, 22 bp, Mus musculus
tgttttgtgaccaattatatgg

SEQ ID NO: 191125 - DNA, 20 bp, Mus musculus
ttggccttatgttcctttgt

SEQ ID NO: 191126 - DNA, 21 bp, Mus musculus
tataagtttgtgtatatgtta

SEQ ID NO: 191127 - DNA, 21 bp, Mus musculus
agaagtttcaagtctgtgcca

SEQ ID NO: 191128 - DNA, 23 bp, Mus musculus
caattgtgttctctgagatcgtg

SEQ ID NO: 191129 - DNA, 22 bp, Mus musculus
tcacagaggactgactgagcag

SEQ ID NO: 191130 - DNA, 22 bp, Mus musculus
tgaatggtatacttcgagacac

SEQ ID NO: 191131 - DNA, 21 bp, Mus musculus
tctgaggaatgaccagactga

SEQ ID NO: 191132 - DNA, 23 bp, Mus musculus
atatgtatatatatatgtgtgtg

SEQ ID NO: 191133 - DNA, 22 bp, Mus musculus
gactccactgatgagagatgag

SEQ ID NO: 191134 - DNA, 22 bp, Mus musculus
agagtagtacctgccattctgg

SEQ ID NO: 191135 - DNA, 23 bp, Mus musculus
tcagtattcatccttcactcttc

SEQ ID NO: 191136 - DNA, 23 bp, Mus musculus
tctgcacttgctcctctgtgaga

SEQ ID NO: 191137 - DNA, 20 bp, Mus musculus
agagttcagtcagtgtctgt

SEQ ID NO: 191138 - DNA, 21 bp, Mus musculus
cacagagcacagtgagcacaa

SEQ ID NO: 191139 - DNA, 23 bp, Mus musculus
agctattgtgaaagtatatgacc

SEQ ID NO: 191140 - DNA, 19 bp, Mus musculus
tgtctctctgtaaatgtcc

SEQ ID NO: 191141 - DNA, 23 bp, Mus musculus
tgtctgtctgtctgtctgtctgt

SEQ ID NO: 191142 - DNA, 20 bp, Mus musculus
tgtatgtatatgtgtgtgta

SEQ ID NO: 191143 - DNA, 21 bp, Mus musculus
tctgtgtctgtcatcctccca

SEQ ID NO: 191144 - DNA, 22 bp, Mus musculus
agaggaagaaagcatgagagtg

SEQ ID NO: 191145 - DNA, 22 bp, Mus musculus
ctagagactccctgtcttcacc

SEQ ID NO: 191146 - DNA, 23 bp, Mus musculus
tacgagactgatttgtgtatgtt

SEQ ID NO: 191147 - DNA, 23 bp, Mus musculus
gtctgtctgtctctctctcacac

SEQ ID NO: 191148 - DNA, 20 bp, Mus musculus
gtgaggattgaagtggggtt

SEQ ID NO: 191149 - DNA, 23 bp, Mus musculus
tcactgacaggctctgtgattgg

SEQ ID NO: 191150 - DNA, 18 bp, Mus musculus
tccatgacagctttgcct

SEQ ID NO: 191151 - DNA, 23 bp, Mus musculus
aacagtcagcctgtttctctgtg

SEQ ID NO: 191152 - DNA, 19 bp, Mus musculus
ttcatgaagattgcttggc

SEQ ID NO: 191153 - DNA, 21 bp, Mus musculus
tatgtatgtatatatgtatgt

SEQ ID NO: 191154 - DNA, 22 bp, Mus musculus
tgttttgtgaccaattatatgg

SEQ ID NO: 191155 - DNA, 22 bp, Mus musculus
tatatctatgtgtatatgtata

SEQ ID NO: 191156 - DNA, 23 bp, Mus musculus
gggtgactctgagactctcagca

SEQ ID NO: 191157 - DNA, 22 bp, Mus musculus
tgtgtgtgtatatatatatgtg

SEQ ID NO: 191158 - DNA, 22 bp, Mus musculus
tctgcccccctaattcatgtgt

SEQ ID NO: 191159 - DNA, 22 bp, Mus musculus
ttgtctcagtgactaaacaggc

SEQ ID NO: 191160 - DNA, 20 bp, Mus musculus
atgcagaccacagggggtga

SEQ ID NO: 191161 - DNA, 18 bp, Mus musculus
agagagcaatgtgaactg

SEQ ID NO: 191162 - DNA, 23 bp, Mus musculus
tgtctctgagcattggaagacag

SEQ ID NO: 191163 - DNA, 23 bp, Mus musculus
acacactgtgcctgtctgcctac

SEQ ID NO: 191164 - DNA, 18 bp, Mus musculus
ttaaatgtaaacatgttt

SEQ ID NO: 191165 - DNA, 22 bp, Mus musculus
tcagactcacacagaggctcag

SEQ ID NO: 191166 - DNA, 22 bp, Mus musculus
tctaacagtgacaggtaaagat

SEQ ID NO: 191167 - DNA, 19 bp, Mus musculus
tagaagtatatgtctagcc

SEQ ID NO: 191168 - DNA, 22 bp, Mus musculus
cttggagtgtccttgtcatttg

SEQ ID NO: 191169 - DNA, 21 bp, Mus musculus
ttcaccatgtggaagtgcttc

SEQ ID NO: 191170 - DNA, 23 bp, Mus musculus
tctctgtccctctcatattttag

SEQ ID NO: 191171 - DNA, 23 bp, Mus musculus
atgtgtgtgtgtctgtgtaagta

SEQ ID NO: 191172 - DNA, 23 bp, Mus musculus
gtgtgtctgtgttaagtatgtgc

SEQ ID NO: 191173 - DNA, 23 bp, Mus musculus
tgtgtgtgtctgtgtaagtatat

SEQ ID NO: 191174 - DNA, 23 bp, Mus musculus
gagactgtctgagtgacaggctc

SEQ ID NO: 191175 - DNA, 23 bp, Mus musculus
tgagtctgaagttactgtgctct

SEQ ID NO: 191176 - DNA, 21 bp, Mus musculus
tgtgaggctatgtgactgtgt

SEQ ID NO: 191177 - DNA, 23 bp, Mus musculus
tctttctgtctgtcagatggagg

SEQ ID NO: 191178 - DNA, 22 bp, Mus musculus
aagggttcttcatccagctgag

SEQ ID NO: 191179 - DNA, 23 bp, Mus musculus
tgtgtcctacctctgtgtgtgtg

SEQ ID NO: 191180 - DNA, 23 bp, Mus musculus
ggctgtgtctctctctgcctgct

SEQ ID NO: 191181 - DNA, 21 bp, Mus musculus
agactctggctctgtccctgt

SEQ ID NO: 191182 - DNA, 23 bp, Mus musculus
gaccctcacaatgccctagaatg

SEQ ID NO: 191183 - DNA, 18 bp, Mus musculus
acacagaagtgactctgc

SEQ ID NO: 191184 - DNA, 23 bp, Mus musculus
gagtggctggctctctgggcctg

SEQ ID NO: 191185 - DNA, 23 bp, Mus musculus
acagacagacagacattaaggtc

SEQ ID NO: 191186 - DNA, 18 bp, Mus musculus
tcaggccctcactgtcac

SEQ ID NO: 191187 - DNA, 23 bp, Mus musculus
gcttgcagctctcattctctgtc

SEQ ID NO: 191188 - DNA, 23 bp, Mus musculus
aatccactgtctgtctctctggc

SEQ ID NO: 191189 - DNA, 23 bp, Mus musculus
tcacactgcctcacacccacctt

SEQ ID NO: 191190 - DNA, 23 bp, Mus musculus
tccattctgctactgccattcct

SEQ ID NO: 191191 - DNA, 18 bp, Mus musculus
tacatacacacacatata

SEQ ID NO: 191192 - DNA, 20 bp, Mus musculus
ctcagtggacacagagcaca

SEQ ID NO: 191193 - DNA, 23 bp, Mus musculus
gaaagtgctttgtcagcactggg

SEQ ID NO: 191194 - DNA, 23 bp, Mus musculus
ctctgtgtgtgtgactggctgtt

SEQ ID NO: 191195 - DNA, 23 bp, Mus musculus
agggagtgtggtttcctgattgt

SEQ ID NO: 191196 - DNA, 19 bp, Mus musculus
ggtgtctactgatggcagt

SEQ ID NO: 191197 - DNA, 22 bp, Mus musculus
cggagacactgtgtccctctgc

SEQ ID NO: 191198 - DNA, 21 bp, Mus musculus
tgccagctttattattctctt

SEQ ID NO: 191199 - DNA, 23 bp, Mus musculus
atatggctgtgtgtatctgtgtc

SEQ ID NO: 191200 - DNA, 22 bp, Mus musculus
tctagtgtttggcagtagctgc

SEQ ID NO: 191201 - DNA, 23 bp, Mus musculus
gtttgacacaagagtctgagcac

SEQ ID NO: 191202 - DNA, 23 bp, Mus musculus
gagtctcacagtgcttctacttt

SEQ ID NO: 191203 - DNA, 23 bp, Mus musculus
tcttctgccatctgtctctgtct

SEQ ID NO: 191204 - DNA, 22 bp, Mus musculus
ggtgagtcagaacatcgtggca

SEQ ID NO: 191205 - DNA, 23 bp, Mus musculus
gtctctctgtggctgtgtagagg

SEQ ID NO: 191206 - DNA, 23 bp, Mus musculus
agaggactcgagttcatttccag

SEQ ID NO: 191207 - DNA, 23 bp, Mus musculus
gtgtcattctctctctctcgtgt

SEQ ID NO: 191208 - DNA, 23 bp, Mus musculus
actcacatggtcatcctgtcttc

SEQ ID NO: 191209 - DNA, 23 bp, Mus musculus
agctggtagatctggggctcctc

SEQ ID NO: 191210 - DNA, 21 bp, Mus musculus
tatctgtatttaaaggtgtat

SEQ ID NO: 191211 - DNA, 22 bp, Mus musculus
tgtgtgcacttctatacattta

SEQ ID NO: 191212 - DNA, 23 bp, Mus musculus
tcaaatctcagcaaccacatggt

SEQ ID NO: 191213 - DNA, 23 bp, Mus musculus
caaatcacactctctctctctcc

SEQ ID NO: 191214 - DNA, 21 bp, Mus musculus
agagagtgtgcagagatgggc

SEQ ID NO: 191215 - DNA, 18 bp, Mus musculus
cagtccccttctaaagta

SEQ ID NO: 191216 - DNA, 22 bp, Mus musculus
caagaattcattggttatatgg

SEQ ID NO: 191217 - DNA, 23 bp, Mus musculus
tatgtgtggaggtcaaaggacaa

SEQ ID NO: 191218 - DNA, 19 bp, Mus musculus
tgagtctctctgtgtctgg

SEQ ID NO: 191219 - DNA, 23 bp, Mus musculus
cagagaactctgtgtggacagat

SEQ ID NO: 191220 - DNA, 22 bp, Mus musculus
ttgagtagttgtgtatatgtat

SEQ ID NO: 191221 - DNA, 23 bp, Mus musculus
atatatgtagttgacatgccctg

SEQ ID NO: 191222 - DNA, 20 bp, Mus musculus
tgtgtgtcctatgtatatgt

SEQ ID NO: 191223 - DNA, 23 bp, Mus musculus
tgcatgtgtgtatatgttgtata

SEQ ID NO: 191224 - DNA, 23 bp, Mus musculus
tatgtgtatatgtatatgtgtgt

SEQ ID NO: 191225 - DNA, 23 bp, Mus musculus
tatttgtaagtggaattgggtga

SEQ ID NO: 191226 - DNA, 23 bp, Mus musculus
agaagaataagaaatctggtttg

SEQ ID NO: 191227 - DNA, 23 bp, Mus musculus
ctgatcagagtgagcagaggtcc

SEQ ID NO: 191228 - DNA, 23 bp, Mus musculus
tagtccatggtgatctgatagga

SEQ ID NO: 191229 - DNA, 23 bp, Mus musculus
gcaagaggatctctgtggggctg

SEQ ID NO: 191230 - DNA, 23 bp, Mus musculus
tcagtcacacagagtgtaggtgc

SEQ ID NO: 191231 - DNA, 20 bp, Mus musculus
cggtgagccttacttgagat

SEQ ID NO: 191232 - DNA, 23 bp, Mus musculus
tcaaaagagtagcaagtctcaac

SEQ ID NO: 191233 - DNA, 23 bp, Mus musculus
cagtctctctgtgggaagctttt

SEQ ID NO: 191234 - DNA, 20 bp, Mus musculus
gctgacagtctgtctgacac

SEQ ID NO: 191235 - DNA, 23 bp, Mus musculus
tcaggcactctgtgtgtctgctt

SEQ ID NO: 191236 - DNA, 21 bp, Mus musculus
gagaggtaggcgtgcagaaac

SEQ ID NO: 191237 - DNA, 22 bp, Mus musculus
tgccagacccagtgtctcactc

SEQ ID NO: 191238 - DNA, 20 bp, Mus musculus
tggtgcccaacatccatatg

SEQ ID NO: 191239 - DNA, 23 bp, Mus musculus
tgtctctgtgtcacctgggatga

SEQ ID NO: 191240 - DNA, 23 bp, Mus musculus
tgtatgtatgtgtgtatgtatat

SEQ ID NO: 191241 - DNA, 22 bp, Mus musculus
tatgtgtatatgtatatgtgtg

SEQ ID NO: 191242 - DNA, 22 bp, Mus musculus
tatgtatgtatgtatatgtgtg

SEQ ID NO: 191243 - DNA, 20 bp, Mus musculus
aaactgaagtcactgtgctc

SEQ ID NO: 191244 - DNA, 23 bp, Mus musculus
ctgtctgtctgtctgtctgtctg

SEQ ID NO: 191245 - DNA, 23 bp, Mus musculus
tcacatagcactgtctggaggca

SEQ ID NO: 191246 - DNA, 23 bp, Mus musculus
tgtgtaccacatcatgcactcag

SEQ ID NO: 191247 - DNA, 22 bp, Mus musculus
acctgctacagaggctggagag

SEQ ID NO: 191248 - DNA, 20 bp, Mus musculus
gccttgttggaggtgtgtca

SEQ ID NO: 191249 - DNA, 23 bp, Mus musculus
ctcagtctctgtttctctgcctc

SEQ ID NO: 191250 - DNA, 23 bp, Mus musculus
attctgcttagaatttagagtct

SEQ ID NO: 191251 - DNA, 21 bp, Mus musculus
tttctagttgagatctctaga

SEQ ID NO: 191252 - DNA, 22 bp, Mus musculus
acatgtgttatgtgtgtgtgta

SEQ ID NO: 191253 - DNA, 20 bp, Mus musculus
ataggtaggaagagagtggg

SEQ ID NO: 191254 - DNA, 22 bp, Mus musculus
aacagaagtgattatcttgtag

SEQ ID NO: 191255 - DNA, 18 bp, Mus musculus
ctgagtctctgggtctca

SEQ ID NO: 191256 - DNA, 23 bp, Mus musculus
tgagttgtttctggacccttgct

SEQ ID NO: 191257 - DNA, 21 bp, Mus musculus
tggtccattaacttctgttag

SEQ ID NO: 191258 - DNA, 23 bp, Mus musculus
ttcatcagaagtgctttagttgt

SEQ ID NO: 191259 - DNA, 22 bp, Mus musculus
tagagacagcttgagttcagga

SEQ ID NO: 191260 - DNA, 23 bp, Mus musculus
tgtctgtctgtctgtctttattc

SEQ ID NO: 191261 - DNA, 19 bp, Mus musculus
agagttctcaaacagcaga

SEQ ID NO: 191262 - DNA, 20 bp, Mus musculus
aaaactgaagttattgtagt

SEQ ID NO: 191263 - DNA, 23 bp, Mus musculus
ttttgtgtatatatatatgtgtg

SEQ ID NO: 191264 - DNA, 23 bp, Mus musculus
tgagtagagtgttgttcagcttc

SEQ ID NO: 191265 - DNA, 21 bp, Mus musculus
ttagttcgtgatgatctgata

SEQ ID NO: 191266 - DNA, 23 bp, Mus musculus
tttacagtctacacagtgagctc

SEQ ID NO: 191267 - DNA, 23 bp, Mus musculus
attgtcagagtgaaattggggtg

SEQ ID NO: 191268 - DNA, 20 bp, Mus musculus
acacctttttgtagagagac

SEQ ID NO: 191269 - DNA, 20 bp, Mus musculus
tgaccctcggtggctagctt

SEQ ID NO: 191270 - DNA, 22 bp, Mus musculus
agctctactctgtctttggatt

SEQ ID NO: 191271 - DNA, 23 bp, Mus musculus
gactacacagagaaaccctgtct

SEQ ID NO: 191272 - DNA, 20 bp, Mus musculus
tctctctgtttctcagtgct

SEQ ID NO: 191273 - DNA, 22 bp, Mus musculus
tactgtctctgactgtggcttg

SEQ ID NO: 191274 - DNA, 23 bp, Mus musculus
gctgacaatctctctctcacagg

SEQ ID NO: 191275 - DNA, 19 bp, Mus musculus
acttcaggctgtgctcctc

SEQ ID NO: 191276 - DNA, 23 bp, Mus musculus
acccactctgcgtcagtgtgggg

SEQ ID NO: 191277 - DNA, 21 bp, Mus musculus
tcaaaggactttatgctttgt

SEQ ID NO: 191278 - DNA, 20 bp, Mus musculus
tggaagattcagtggtgtca

SEQ ID NO: 191279 - DNA, 22 bp, Mus musculus
acatgttcctagtcactctcga

SEQ ID NO: 191280 - DNA, 23 bp, Mus musculus
aaagcctgtctggtaacgaggat

SEQ ID NO: 191281 - DNA, 18 bp, Mus musculus
actgcaggggctggagag

SEQ ID NO: 191282 - DNA, 22 bp, Mus musculus
aaaggccgagttcaaatcccag

SEQ ID NO: 191283 - DNA, 23 bp, Mus musculus
tgtagagccagacaggcagactc

SEQ ID NO: 191284 - DNA, 23 bp, Mus musculus
tgtctgtgtgtctgtgtgcatga

SEQ ID NO: 191285 - DNA, 23 bp, Mus musculus
tcccactgtggcactgacagccc

SEQ ID NO: 191286 - DNA, 20 bp, Mus musculus
atttgtgcatgtgcatgtat

SEQ ID NO: 191287 - DNA, 23 bp, Mus musculus
ctgagggacactcactcaattgt

SEQ ID NO: 191288 - DNA, 23 bp, Mus musculus
aactcactgctcagtcactctga

SEQ ID NO: 191289 - DNA, 23 bp, Mus musculus
tctgagtcactgagaggctggct

SEQ ID NO: 191290 - DNA, 23 bp, Mus musculus
tgtcactctctctaggagactgt

SEQ ID NO: 191291 - DNA, 23 bp, Mus musculus
taagcaggagttgcagagacact

SEQ ID NO: 191292 - DNA, 23 bp, Mus musculus
ctgtcactctgtgggtctgcatg

SEQ ID NO: 191293 - DNA, 22 bp, Mus musculus
tactgcctatagaacacatggg

SEQ ID NO: 191294 - DNA, 23 bp, Mus musculus
gtcatgtgtctgtctgtctctcc

SEQ ID NO: 191295 - DNA, 23 bp, Mus musculus
catctgcttctgtctctgcctct

SEQ ID NO: 191296 - DNA, 19 bp, Mus musculus
agaaagaaacagatttgct

SEQ ID NO: 191297 - DNA, 19 bp, Mus musculus
tgccttggtcatggtgtct

SEQ ID NO: 191298 - DNA, 20 bp, Mus musculus
agacacatgactcaatgcac

SEQ ID NO: 191299 - DNA, 22 bp, Mus musculus
aggacacagtgctatccatctt

SEQ ID NO: 191300 - DNA, 22 bp, Mus musculus
tgtcagtctgactggatttaga

SEQ ID NO: 191301 - DNA, 23 bp, Mus musculus
aactggaggcgaaatgtgaccaa

SEQ ID NO: 191302 - DNA, 23 bp, Mus musculus
catgtgcatgtatgtataaatgt

SEQ ID NO: 191303 - DNA, 23 bp, Mus musculus
gtgtatgtgactatttgtgtctc

SEQ ID NO: 191304 - DNA, 23 bp, Mus musculus
tatgtagctatgcatgtatgtgc

SEQ ID NO: 191305 - DNA, 23 bp, Mus musculus
tgtgtgcatgctctgtctgtgtg

SEQ ID NO: 191306 - DNA, 18 bp, Mus musculus
tgtcaagtctctctctgt

SEQ ID NO: 191307 - DNA, 23 bp, Mus musculus
tgtgtgtatatatgtatgtgtgt

SEQ ID NO: 191308 - DNA, 20 bp, Mus musculus
tttatttctttatgaacatg

SEQ ID NO: 191309 - DNA, 18 bp, Mus musculus
cccctcctgcaatgctgt

SEQ ID NO: 191310 - DNA, 20 bp, Mus musculus
cagggactggagatggctca

SEQ ID NO: 191311 - DNA, 23 bp, Mus musculus
gtctctgtgggtctctgtgggtc

SEQ ID NO: 191312 - DNA, 23 bp, Mus musculus
tatctctgactggtttggaactc

SEQ ID NO: 191313 - DNA, 23 bp, Mus musculus
tgtctggtagagcaatgggacat

SEQ ID NO: 191314 - DNA, 23 bp, Mus musculus
attccacttgttgagatggtgtg

SEQ ID NO: 191315 - DNA, 18 bp, Mus musculus
agagatctgaacaagcag

SEQ ID NO: 191316 - DNA, 23 bp, Mus musculus
attagatctagagcttgctgagt

SEQ ID NO: 191317 - DNA, 23 bp, Mus musculus
ctctgcctctgtctttccagtga

SEQ ID NO: 191318 - DNA, 20 bp, Mus musculus
tggcagtgtacacctcaaac

SEQ ID NO: 191319 - DNA, 23 bp, Mus musculus
actctgtctcactgtgtacatcc

SEQ ID NO: 191320 - DNA, 23 bp, Mus musculus
gcccagtctctctgtgacacttt

SEQ ID NO: 191321 - DNA, 23 bp, Mus musculus
tgtctgtctgtctgtctgtctgt

SEQ ID NO: 191322 - DNA, 19 bp, Mus musculus
tgaagcatgaggttggcct

SEQ ID NO: 191323 - DNA, 23 bp, Mus musculus
cactgcagcctactgagcacata

SEQ ID NO: 191324 - DNA, 21 bp, Mus musculus
gtcagtgtctcactcaggggc

SEQ ID NO: 191325 - DNA, 23 bp, Mus musculus
aagagttgagagagagctcttga

SEQ ID NO: 191326 - DNA, 22 bp, Mus musculus
gagagcaatgttcaatgggaaa

SEQ ID NO: 191327 - DNA, 23 bp, Mus musculus
gagagagagacttaattgtgcaa

SEQ ID NO: 191328 - DNA, 21 bp, Mus musculus
tcaaaggactttatgctttgt

SEQ ID NO: 191329 - DNA, 22 bp, Mus musculus
tatgtgtatatgtgtatgtgtg

SEQ ID NO: 191330 - DNA, 22 bp, Mus musculus
tgtgtatgtgtatatgtgtatg

SEQ ID NO: 191331 - DNA, 21 bp, Mus musculus
tcaggtagtaaaaatatctgt

SEQ ID NO: 191332 - DNA, 21 bp, Mus musculus
agtccactgaatactgatctt

SEQ ID NO: 191333 - DNA, 23 bp, Mus musculus
tgagattcttgttcttggtgcat

SEQ ID NO: 191334 - DNA, 23 bp, Mus musculus
tctctctccctgtgtgggtgtct

SEQ ID NO: 191335 - DNA, 23 bp, Mus musculus
tctctgtcagtctttcacacata

SEQ ID NO: 191336 - DNA, 19 bp, Mus musculus
agactagtgggatgattga

SEQ ID NO: 191337 - DNA, 23 bp, Mus musculus
atgtttctatccatatgtatcta

SEQ ID NO: 191338 - DNA, 23 bp, Mus musculus
agcacacactctgtctctctgat

SEQ ID NO: 191339 - DNA, 23 bp, Mus musculus
ctcatatttgccaggacttgttg

SEQ ID NO: 191340 - DNA, 23 bp, Mus musculus
taactttgtagatgtcttagggt

SEQ ID NO: 191341 - DNA, 22 bp, Mus musculus
tgttttgtgaccaattatatgg

SEQ ID NO: 191342 - DNA, 20 bp, Mus musculus
actgggcataataaatgagc

SEQ ID NO: 191343 - DNA, 23 bp, Mus musculus
cagatgtcttagtgaggatctcc

SEQ ID NO: 191344 - DNA, 23 bp, Mus musculus
catgtgtgtatataagtatgtat

SEQ ID NO: 191345 - DNA, 23 bp, Mus musculus
cagttgctggatgagtgagttaa

SEQ ID NO: 191346 - DNA, 23 bp, Mus musculus
ctcgtctgtctgtctgtgccact

SEQ ID NO: 191347 - DNA, 23 bp, Mus musculus
tttgaaatacagatggtatactg

SEQ ID NO: 191348 - DNA, 23 bp, Mus musculus
gtatgtatgtatgtgtgtgtgta

SEQ ID NO: 191349 - DNA, 19 bp, Mus musculus
acatatgtgtgtatatgta

SEQ ID NO: 191350 - DNA, 23 bp, Mus musculus
tctgtgtgtgtctctcatctgtt

SEQ ID NO: 191351 - DNA, 23 bp, Mus musculus
atttgaagaactatgcagtactg

SEQ ID NO: 191352 - DNA, 23 bp, Mus musculus
gttagaggttgtggaactgatga

SEQ ID NO: 191353 - DNA, 23 bp, Mus musculus
tcggtctgtctgtctgtttgtct

SEQ ID NO: 191354 - DNA, 23 bp, Mus musculus
aaaagagctacagttttgtctta

SEQ ID NO: 191355 - DNA, 23 bp, Mus musculus
actgactctgtatcacatccctg

SEQ ID NO: 191356 - DNA, 20 bp, Mus musculus
cagcaggagattctgaagtt

SEQ ID NO: 191357 - DNA, 23 bp, Mus musculus
actctgtctgcctgtctgtctgc

SEQ ID NO: 191358 - DNA, 22 bp, Mus musculus
tgttttgtgaccaattatatgg

SEQ ID NO: 191359 - DNA, 23 bp, Mus musculus
tatatgtgtgtatatgcatatgt

SEQ ID NO: 191360 - DNA, 21 bp, Mus musculus
atatgttcatatgcatgttgt

SEQ ID NO: 191361 - DNA, 21 bp, Mus musculus
tccatggtggtctgataggat

SEQ ID NO: 191362 - DNA, 20 bp, Mus musculus
ctctctctctctctctccac

SEQ ID NO: 191363 - DNA, 23 bp, Mus musculus
actattgagaatttcatcttctc

SEQ ID NO: 191364 - DNA, 22 bp, Mus musculus
tgttttgtgaccaattatatgg

SEQ ID NO: 191365 - DNA, 22 bp, Mus musculus
atactggccttggtgcagctaa

SEQ ID NO: 191366 - DNA, 20 bp, Mus musculus
cagacagttgtggcacctgc

SEQ ID NO: 191367 - DNA, 20 bp, Mus musculus
cagaggcaggctgatttctg

SEQ ID NO: 191368 - DNA, 22 bp, Mus musculus
tatatgtatatatgtatatgtg

SEQ ID NO: 191369 - DNA, 20 bp, Mus musculus
ctcagagcctgtgagctgag

SEQ ID NO: 191370 - DNA, 22 bp, Mus musculus
tgttttgtgaccaattatatgg

SEQ ID NO: 191371 - DNA, 23 bp, Mus musculus
cgccctgggtttgttttcctggg

SEQ ID NO: 191372 - DNA, 22 bp, Mus musculus
tatttctctcactctcagtact

SEQ ID NO: 191373 - DNA, 18 bp, Mus musculus
tacattatatatgtatat

SEQ ID NO: 191374 - DNA, 23 bp, Mus musculus
tctatgtatgtgtgtatgtgtgt

SEQ ID NO: 191375 - DNA, 23 bp, Mus musculus
atgcatgatttgttcatcaaaga

SEQ ID NO: 191376 - DNA, 23 bp, Mus musculus
agtgtcagtgagagtaagtcatg

SEQ ID NO: 191377 - DNA, 23 bp, Mus musculus
agcctgacagttgacattgaggt

SEQ ID NO: 191378 - DNA, 23 bp, Mus musculus
tgtcgctgtctgtctatatggtg

SEQ ID NO: 191379 - DNA, 22 bp, Mus musculus
tgttttgtgaccaattatatgg

SEQ ID NO: 191380 - DNA, 23 bp, Mus musculus
agttgagtgcagttcaattgagt

SEQ ID NO: 191381 - DNA, 21 bp, Mus musculus
tggcagtgaggtttctatgta

SEQ ID NO: 191382 - DNA, 23 bp, Mus musculus
gtgtgtgaatgtgcatgtgtatg

SEQ ID NO: 191383 - DNA, 23 bp, Mus musculus
aagtgagataattctgcagaaac

SEQ ID NO: 191384 - DNA, 22 bp, Mus musculus
tatagctacaaaaggaaggggt

SEQ ID NO: 191385 - DNA, 22 bp, Mus musculus
atacactctctgcataggctct

SEQ ID NO: 191386 - DNA, 19 bp, Mus musculus
aacagtacacagagtgcac

SEQ ID NO: 191387 - DNA, 23 bp, Mus musculus
acacactctgtgtgtccatgtct

SEQ ID NO: 191388 - DNA, 22 bp, Mus musculus
acagagacagtggtacatcagt

SEQ ID NO: 191389 - DNA, 23 bp, Mus musculus
gtaagtatgtatgtatgtatgaa

SEQ ID NO: 191390 - DNA, 20 bp, Mus musculus
gtatgcattcatggctgcag

SEQ ID NO: 191391 - DNA, 20 bp, Mus musculus
agaagaaaatgttttccttc

SEQ ID NO: 191392 - DNA, 20 bp, Mus musculus
agctgagggctattcaagtg

SEQ ID NO: 191393 - DNA, 21 bp, Mus musculus
tatgtgcatatatatgtatgt

SEQ ID NO: 191394 - DNA, 22 bp, Mus musculus
tgagatgagagtctgtagtttc

SEQ ID NO: 191395 - DNA, 23 bp, Mus musculus
atctgtctgtctgtctatttatc

SEQ ID NO: 191396 - DNA, 23 bp, Mus musculus
atgactggagagtgagtgcacaa

SEQ ID NO: 191397 - DNA, 23 bp, Mus musculus
cgttgtacattctgtgcacataa

SEQ ID NO: 191398 - DNA, 23 bp, Mus musculus
cttgcttctctgttgctatcatt

SEQ ID NO: 191399 - DNA, 22 bp, Mus musculus
caagacagatgatagaaaggag

SEQ ID NO: 191400 - DNA, 21 bp, Mus musculus
tccatggtggtctgataggat

SEQ ID NO: 191401 - DNA, 22 bp, Mus musculus
atttaacaactgcctgacttct

SEQ ID NO: 191402 - DNA, 22 bp, Mus musculus
tgttttgtgaccaattatatgg

SEQ ID NO: 191403 - DNA, 23 bp, Mus musculus
tcagtatctcagagtctatggag

SEQ ID NO: 191404 - DNA, 19 bp, Mus musculus
tgtgcacgtgcatgtgtgt

SEQ ID NO: 191405 - DNA, 20 bp, Mus musculus
catagaactaacagtggagt

SEQ ID NO: 191406 - DNA, 23 bp, Mus musculus
atgtgccactcttacatgtgtct

SEQ ID NO: 191407 - DNA, 22 bp, Mus musculus
tatatgtcacttaaacttgaga

SEQ ID NO: 191408 - DNA, 23 bp, Mus musculus
cacagaagtgggtcagcaaagca

SEQ ID NO: 191409 - DNA, 23 bp, Mus musculus
aaacactctctgtgactcttcat

SEQ ID NO: 191410 - DNA, 23 bp, Mus musculus
caaaccagacagaagacacagag

SEQ ID NO: 191411 - DNA, 21 bp, Mus musculus
agtagtcaactagtttctttt

SEQ ID NO: 191412 - DNA, 23 bp, Mus musculus
tgtatgttctgaggtttgaatcc

SEQ ID NO: 191413 - DNA, 22 bp, Mus musculus
tgttttgtgaccaattatatgg

SEQ ID NO: 191414 - DNA, 21 bp, Mus musculus
tttggacaagaaagaggaatt

SEQ ID NO: 191415 - DNA, 21 bp, Mus musculus
tgcgtgcctctaatctcagca

SEQ ID NO: 191416 - DNA, 23 bp, Mus musculus
caagcagatcaatgtgaattgga

SEQ ID NO: 191417 - DNA, 23 bp, Mus musculus
actctctctgagagcattttccc

SEQ ID NO: 191418 - DNA, 22 bp, Mus musculus
tgttttgtgaccaattatatgg

SEQ ID NO: 191419 - DNA, 23 bp, Mus musculus
tatcagtgggtgacattgcttga

SEQ ID NO: 191420 - DNA, 23 bp, Mus musculus
ttagttagtgaatttgttgttct

SEQ ID NO: 191421 - DNA, 23 bp, Mus musculus
atgtgtgaggctttccttggagt

SEQ ID NO: 191422 - DNA, 18 bp, Mus musculus
tgtctgcagagagtgttc

SEQ ID NO: 191423 - DNA, 21 bp, Mus musculus
tttatgcatgcattcatatgt

SEQ ID NO: 191424 - DNA, 23 bp, Mus musculus
ctctctctctgtaccagtactac

SEQ ID NO: 191425 - DNA, 21 bp, Mus musculus
gtatggcttgagattagggat

SEQ ID NO: 191426 - DNA, 23 bp, Mus musculus
tgagccattttgaagatcttgta

SEQ ID NO: 191427 - DNA, 23 bp, Mus musculus
tatagcagaccttcaattgactc

SEQ ID NO: 191428 - DNA, 22 bp, Mus musculus
tgttttgtgaccaattatatgg

SEQ ID NO: 191429 - DNA, 23 bp, Mus musculus
tgtatctgtgtatgtatatgtga

SEQ ID NO: 191430 - DNA, 23 bp, Mus musculus
actgagaacagagtaagcacttc

SEQ ID NO: 191431 - DNA, 23 bp, Mus musculus
tgttgctgactcactgcctctgc

SEQ ID NO: 191432 - DNA, 20 bp, Mus musculus
agtttttggcttccttatgt

SEQ ID NO: 191433 - DNA, 22 bp, Mus musculus
tgttttgtgaccaattatatgg

SEQ ID NO: 191434 - DNA, 22 bp, Mus musculus
tgttttgtgaccaattatatgg

SEQ ID NO: 191435 - DNA, 21 bp, Mus musculus
agatgacgatgaggacttgta

SEQ ID NO: 191436 - DNA, 22 bp, Mus musculus
tacagtgctcatgagttcaaag

SEQ ID NO: 191437 - DNA, 19 bp, Mus musculus
ctgtacaaggcagtgtgac

SEQ ID NO: 191438 - DNA, 22 bp, Mus musculus
tgttttgtgaccaattatatgg

SEQ ID NO: 191439 - DNA, 23 bp, Mus musculus
tatatgcatatatatgcatatat

SEQ ID NO: 191440 - DNA, 23 bp, Mus musculus
atgtgtatatatgtatatgtgtg

SEQ ID NO: 191441 - DNA, 19 bp, Mus musculus
ctggagagatggcttagtg

SEQ ID NO: 191442 - DNA, 19 bp, Mus musculus
aagagcactgactgctctt

SEQ ID NO: 191443 - DNA, 23 bp, Mus musculus
tagagatttgtagattatgggtt

SEQ ID NO: 191444 - DNA, 22 bp, Mus musculus
tcagtcactgagtaagaagttt

SEQ ID NO: 191445 - DNA, 18 bp, Mus musculus
tgtctctacacagtgagc

SEQ ID NO: 191446 - DNA, 21 bp, Mus musculus
tcactctgtgcatgtctggca

SEQ ID NO: 191447 - DNA, 20 bp, Mus musculus
aagcactagaaccaaagctc

SEQ ID NO: 191448 - DNA, 21 bp, Mus musculus
atgtgtgtgtgtatgtatgta

SEQ ID NO: 191449 - DNA, 21 bp, Mus musculus
acagtagtaagatagctctac

SEQ ID NO: 191450 - DNA, 23 bp, Mus musculus
ccttgactgtgagaataaactct

SEQ ID NO: 191451 - DNA, 23 bp, Mus musculus
agggtttctctgtgtagcctggc

SEQ ID NO: 191452 - DNA, 23 bp, Mus musculus
cactcactgtgaagtacactcac

SEQ ID NO: 191453 - DNA, 20 bp, Mus musculus
ccatgatggtctgataggat

SEQ ID NO: 191454 - DNA, 23 bp, Mus musculus
ccgtgtcagtctctggctctctc

SEQ ID NO: 191455 - DNA, 23 bp, Mus musculus
agacagaccacagtcagggcttt

SEQ ID NO: 191456 - DNA, 20 bp, Mus musculus
gatcagaagacagtttgcag

SEQ ID NO: 191457 - DNA, 22 bp, Mus musculus
tgtggctctcagagtctccttt

SEQ ID NO: 191458 - DNA, 23 bp, Mus musculus
gtctctctctctgtgtccgtgtg

SEQ ID NO: 191459 - DNA, 23 bp, Mus musculus
tcactctgtctctcaaaaatccc

SEQ ID NO: 191460 - DNA, 23 bp, Mus musculus
acattaaggttgtaaaggaaggg

SEQ ID NO: 191461 - DNA, 22 bp, Mus musculus
tgttttgtgaccaattatatgg

SEQ ID NO: 191462 - DNA, 23 bp, Mus musculus
tgccagagaagtcattttgttgt

SEQ ID NO: 191463 - DNA, 21 bp, Mus musculus
aatacctatatgtggtatgtg

SEQ ID NO: 191464 - DNA, 23 bp, Mus musculus
ctgtgtctctgtttagtttctgt

SEQ ID NO: 191465 - DNA, 20 bp, Mus musculus
aggatctgtccattgatgaa

SEQ ID NO: 191466 - DNA, 23 bp, Mus musculus
tgccagagaagtcattttgttgt

SEQ ID NO: 191467 - DNA, 23 bp, Mus musculus
ggctctgcttctgaatgcctctt

SEQ ID NO: 191468 - DNA, 23 bp, Mus musculus
agacaggaaatgtatgcttagag

SEQ ID NO: 191469 - DNA, 23 bp, Mus musculus
acactcagtctgtctgtctctct

SEQ ID NO: 191470 - DNA, 22 bp, Mus musculus
tgttttgtgaccaattatatgg

SEQ ID NO: 191471 - DNA, 23 bp, Mus musculus
tctgtgtctagtggatagaggct

SEQ ID NO: 191472 - DNA, 22 bp, Mus musculus
acactgtcatatgagtatctat

SEQ ID NO: 191473 - DNA, 23 bp, Mus musculus
ttcaatgtatatatgtattcagc

SEQ ID NO: 191474 - DNA, 18 bp, Mus musculus
cacaggtaacacagactg

SEQ ID NO: 191475 - DNA, 23 bp, Mus musculus
agttttctcagtttgcacatgtc

SEQ ID NO: 191476 - DNA, 18 bp, Mus musculus
tctgttagaagaaagcac

SEQ ID NO: 191477 - DNA, 21 bp, Mus musculus
ttttggatgctattggtaggg

SEQ ID NO: 191478 - DNA, 23 bp, Mus musculus
tgactagtcactcactcaccagg

SEQ ID NO: 191479 - DNA, 22 bp, Mus musculus
tgttttgtgaccaattatatgg

SEQ ID NO: 191480 - DNA, 23 bp, Mus musculus
taatgtgtgtgcagagagagcag

SEQ ID NO: 191481 - DNA, 23 bp, Mus musculus
tgtacacagtgtcatttcctacg

SEQ ID NO: 191482 - DNA, 18 bp, Mus musculus
acacagggtctacactgg

SEQ ID NO: 191483 - DNA, 23 bp, Mus musculus
tgtgacactgtctgtgttgtctg

SEQ ID NO: 191484 - DNA, 22 bp, Mus musculus
tttctgtcaccctgtgtccctc

SEQ ID NO: 191485 - DNA, 23 bp, Mus musculus
tgtaagcttccttgtctcgctgg

SEQ ID NO: 191486 - DNA, 22 bp, Mus musculus
tatgtgtgtatatatatatgtg

SEQ ID NO: 191487 - DNA, 22 bp, Mus musculus
tctacagcacgaggagacatgg

SEQ ID NO: 191488 - DNA, 23 bp, Mus musculus
cacccagtctctttctctttaac

SEQ ID NO: 191489 - DNA, 23 bp, Mus musculus
tcacggtctgtaagtgtgttctt

SEQ ID NO: 191490 - DNA, 23 bp, Mus musculus
actgcttactgactcactctcaa

SEQ ID NO: 191491 - DNA, 18 bp, Mus musculus
cagagaccctgagttcag

SEQ ID NO: 191492 - DNA, 23 bp, Mus musculus
acaaacacaagtaggatttctct

SEQ ID NO: 191493 - DNA, 23 bp, Mus musculus
agattctccaaaggaaaaatctg

SEQ ID NO: 191494 - DNA, 20 bp, Mus musculus
agaggttcaaggtagaattg

SEQ ID NO: 191495 - DNA, 23 bp, Mus musculus
tagtgcatggtgatctgatagga

SEQ ID NO: 191496 - DNA, 22 bp, Mus musculus
tgttttgtgacctattatgtgg

SEQ ID NO: 191497 - DNA, 23 bp, Mus musculus
gtgtgtgcgtgcgtgcgtgcgtg

SEQ ID NO: 191498 - DNA, 23 bp, Mus musculus
tgtgactgacagtctgtaacaga

SEQ ID NO: 191499 - DNA, 20 bp, Mus musculus
agagaacatattggatgttt

SEQ ID NO: 191500 - DNA, 22 bp, Mus musculus
atatgtatgtgtatatgtagat

SEQ ID NO: 191501 - DNA, 23 bp, Mus musculus
ttgctgagagaagtgagccacca

SEQ ID NO: 191502 - DNA, 23 bp, Mus musculus
tcacttcctctctgtctctctgc

SEQ ID NO: 191503 - DNA, 21 bp, Mus musculus
agagagagagtgatgtttctc

SEQ ID NO: 191504 - DNA, 23 bp, Mus musculus
tggtaagattttatgtttgggga

SEQ ID NO: 191505 - DNA, 22 bp, Mus musculus
acacacacacacatatatgtat

SEQ ID NO: 191506 - DNA, 23 bp, Mus musculus
atgtgtatatatatgtgtgtgtg

SEQ ID NO: 191507 - DNA, 23 bp, Mus musculus
agtgtgaggaagttcagtgtacc

SEQ ID NO: 191508 - DNA, 23 bp, Mus musculus
caaagacagaatttagagtccag

SEQ ID NO: 191509 - DNA, 23 bp, Mus musculus
gtctgtctctgtcagctgcttgt

SEQ ID NO: 191510 - DNA, 19 bp, Mus musculus
tttcatcattttggagttc

SEQ ID NO: 191511 - DNA, 23 bp, Mus musculus
gagtactgactgctcttccagag

SEQ ID NO: 191512 - DNA, 21 bp, Mus musculus
ttctacatgctgaccaccagt

SEQ ID NO: 191513 - DNA, 23 bp, Mus musculus
cttttttccactggatggtttta

SEQ ID NO: 191514 - DNA, 22 bp, Mus musculus
tgttgtgtgaccaattatatgg

SEQ ID NO: 191515 - DNA, 23 bp, Mus musculus
tgaagagctgcctatgagaggca

SEQ ID NO: 191516 - DNA, 21 bp, Mus musculus
attactgttgatatgtttccc

SEQ ID NO: 191517 - DNA, 22 bp, Mus musculus
tgctctattttttcctatgtga

SEQ ID NO: 191518 - DNA, 23 bp, Mus musculus
tgattagacagatgacagcggcc

SEQ ID NO: 191519 - DNA, 23 bp, Mus musculus
tttatgtttgtgtgcatagatag

SEQ ID NO: 191520 - DNA, 19 bp, Mus musculus
tttatgtttgtgtacatgc

SEQ ID NO: 191521 - DNA, 23 bp, Mus musculus
atgtaaatgtgtatatgtttgtg

SEQ ID NO: 191522 - DNA, 19 bp, Mus musculus
atatggttcctgtttcttt

SEQ ID NO: 191523 - DNA, 23 bp, Mus musculus
aaacacagagcatatttattcta

SEQ ID NO: 191524 - DNA, 23 bp, Mus musculus
tcagcttgtggttgggtgactta

SEQ ID NO: 191525 - DNA, 23 bp, Mus musculus
tgagcagctcgagaagggagtta

SEQ ID NO: 191526 - DNA, 21 bp, Mus musculus
agacatggatctggattgttt

SEQ ID NO: 191527 - DNA, 23 bp, Mus musculus
tcaccactttggtagtggtcagc

SEQ ID NO: 191528 - DNA, 23 bp, Mus musculus
gtggatggttgaattcatagtgg

SEQ ID NO: 191529 - DNA, 23 bp, Mus musculus
ttaatctgctacaggtactgttt

SEQ ID NO: 191530 - DNA, 23 bp, Mus musculus
taggcacttctaccactcaatct

SEQ ID NO: 191531 - DNA, 22 bp, Mus musculus
tgttttgtgaccaattatatgg

SEQ ID NO: 191532 - DNA, 21 bp, Mus musculus
tgattttttatttagcaaaga

SEQ ID NO: 191533 - DNA, 23 bp, Mus musculus
cagcttaatgtatctacttatct

SEQ ID NO: 191534 - DNA, 18 bp, Mus musculus
attcactggtttattcag

SEQ ID NO: 191535 - DNA, 23 bp, Mus musculus
gagagagaggtaagtgtggtgtt

SEQ ID NO: 191536 - DNA, 23 bp, Mus musculus
ttatatggtgaattacattgaca

SEQ ID NO: 191537 - DNA, 18 bp, Mus musculus
tccacctgaatgttggct

SEQ ID NO: 191538 - DNA, 21 bp, Mus musculus
cttagtccatggtgatctgat

SEQ ID NO: 191539 - DNA, 18 bp, Mus musculus
atagatagatagatagat

SEQ ID NO: 191540 - DNA, 23 bp, Mus musculus
tgtatgcatgtatgtatgtgtga

SEQ ID NO: 191541 - DNA, 23 bp, Mus musculus
atatgcatgcatacttatgaagt

SEQ ID NO: 191542 - DNA, 21 bp, Mus musculus
tgggtgtgtcagaggttttgg

SEQ ID NO: 191543 - DNA, 23 bp, Mus musculus
tctgagactctgagatactggtg

SEQ ID NO: 191544 - DNA, 23 bp, Mus musculus
tatatgtgtgtgtgtgtatatac

SEQ ID NO: 191545 - DNA, 20 bp, Mus musculus
atatatgtatacacacacac

SEQ ID NO: 191546 - DNA, 22 bp, Mus musculus
tgttttgtgaccaattatatgg

SEQ ID NO: 191547 - DNA, 22 bp, Mus musculus
agactcactgtcatacaccatg

SEQ ID NO: 191548 - DNA, 23 bp, Mus musculus
tagtccatggtgatcagatagga

SEQ ID NO: 191549 - DNA, 23 bp, Mus musculus
ttgtatctgtcaactttggagga

SEQ ID NO: 191550 - DNA, 22 bp, Mus musculus
tgttttgtgaccaattatatgg

SEQ ID NO: 191551 - DNA, 23 bp, Mus musculus
gaatcaggttgtttacttgagag

SEQ ID NO: 191552 - DNA, 23 bp, Mus musculus
atctctctcaatttctctctaca

SEQ ID NO: 191553 - DNA, 21 bp, Mus musculus
tccatgatgatctgacaggaa

SEQ ID NO: 191554 - DNA, 22 bp, Mus musculus
accactgcaacatttttacagt

SEQ ID NO: 191555 - DNA, 18 bp, Mus musculus
atgttggtctgataggat

SEQ ID NO: 191556 - DNA, 22 bp, Mus musculus
tgttttgtgaccaattatatgg

SEQ ID NO: 191557 - DNA, 22 bp, Mus musculus
tgttttgtgaccaattatatgg

SEQ ID NO: 191558 - DNA, 23 bp, Mus musculus
ctgtctgtctgtctgtctgcctc

SEQ ID NO: 191559 - DNA, 22 bp, Mus musculus
atgtgtgcctctctctttgtct

SEQ ID NO: 191560 - DNA, 22 bp, Mus musculus
tagtcctggctgtcctggaact

SEQ ID NO: 191561 - DNA, 23 bp, Mus musculus
ggctgtgtgtgtctctcttattc

SEQ ID NO: 191562 - DNA, 23 bp, Mus musculus
tcagtggatttttctctgctctg

SEQ ID NO: 191563 - DNA, 22 bp, Mus musculus
tgttttgtgaccaattatatgg

SEQ ID NO: 191564 - DNA, 23 bp, Mus musculus
tgtcccacaggaaaacatcattg

SEQ ID NO: 191565 - DNA, 22 bp, Mus musculus
tgttttgtgaccaattatatgg

SEQ ID NO: 191566 - DNA, 22 bp, Mus musculus
gtctctcactgtgtggctacag

SEQ ID NO: 191567 - DNA, 23 bp, Mus musculus
tatctcagtagtcccagtgtggc

SEQ ID NO: 191568 - DNA, 22 bp, Mus musculus
tgagtgctccagtgtctctcac

SEQ ID NO: 191569 - DNA, 23 bp, Mus musculus
acatatgtatgtgtgtgtgtgtg

SEQ ID NO: 191570 - DNA, 19 bp, Mus musculus
acatatgtcaatatatatg

SEQ ID NO: 191571 - DNA, 22 bp, Mus musculus
tgttttgtgaccaattatatgg

SEQ ID NO: 191572 - DNA, 23 bp, Mus musculus
aagtttctttttctaattccctg

SEQ ID NO: 191573 - DNA, 23 bp, Mus musculus
tgttatatgttctagtttatggg

SEQ ID NO: 191574 - DNA, 18 bp, Mus musculus
gtcatcagcaaaacttga

SEQ ID NO: 191575 - DNA, 23 bp, Mus musculus
tgtgtgtgtgcatatgcatgtgt

SEQ ID NO: 191576 - DNA, 18 bp, Mus musculus
ccctagaaggcatgctct

SEQ ID NO: 191577 - DNA, 19 bp, Mus musculus
tattgtatctgagtgtgta

SEQ ID NO: 191578 - DNA, 23 bp, Mus musculus
acatgcattgtacttcaggatga

SEQ ID NO: 191579 - DNA, 22 bp, Mus musculus
tgttttgtgaccaattatatgg

SEQ ID NO: 191580 - DNA, 23 bp, Mus musculus
attcagagttgtaatcttttact

SEQ ID NO: 191581 - DNA, 23 bp, Mus musculus
gctccctctgtgacactctgtgc

SEQ ID NO: 191582 - DNA, 22 bp, Mus musculus
tctgtctctttgtctatgtctg

SEQ ID NO: 191583 - DNA, 23 bp, Mus musculus
tgtatatatgtacatatatatgt

SEQ ID NO: 191584 - DNA, 23 bp, Mus musculus
acgtgctccctctgcttacactg

SEQ ID NO: 191585 - DNA, 21 bp, Mus musculus
cattctgtctccctctgcagt

SEQ ID NO: 191586 - DNA, 23 bp, Mus musculus
tgtgagaatagagtgagtggact

SEQ ID NO: 191587 - DNA, 19 bp, Mus musculus
attttgagacatatgctta

SEQ ID NO: 191588 - DNA, 22 bp, Mus musculus
tgttttgtgaccaattatatgg

SEQ ID NO: 191589 - DNA, 23 bp, Mus musculus
tatgatttgtagaagagagtgac

SEQ ID NO: 191590 - DNA, 23 bp, Mus musculus
tgagttcctgtcgctctgttcag

SEQ ID NO: 191591 - DNA, 23 bp, Mus musculus
tctccctccctctcagcttgtgg

SEQ ID NO: 191592 - DNA, 20 bp, Mus musculus
taagactcagctatatatat

SEQ ID NO: 191593 - DNA, 23 bp, Mus musculus
gagtgtctcagtgtctgtgtcat

SEQ ID NO: 191594 - DNA, 23 bp, Mus musculus
gtatatacatctgcatgtatatt

SEQ ID NO: 191595 - DNA, 21 bp, Mus musculus
acagaaaatttcatggagtat

SEQ ID NO: 191596 - DNA, 20 bp, Mus musculus
agccgctcaagaatatgtta

SEQ ID NO: 191597 - DNA, 21 bp, Mus musculus
atgcttcttcttgttggctag

SEQ ID NO: 191598 - DNA, 23 bp, Mus musculus
actccatggtgatcagataggat

SEQ ID NO: 191599 - DNA, 18 bp, Mus musculus
tgctgactgctcttccag

SEQ ID NO: 191600 - DNA, 23 bp, Mus musculus
tatatgtatatatacatatgtgt

SEQ ID NO: 191601 - DNA, 18 bp, Mus musculus
tgttctcactcagtctca

SEQ ID NO: 191602 - DNA, 23 bp, Mus musculus
cacttgtgtctctttcaccttgc

SEQ ID NO: 191603 - DNA, 23 bp, Mus musculus
caggaactaggttgagagctttt

SEQ ID NO: 191604 - DNA, 23 bp, Mus musculus
ccttaccttctctctgtgtctgt

SEQ ID NO: 191605 - DNA, 21 bp, Mus musculus
acacagtgaccacagactctc

SEQ ID NO: 191606 - DNA, 22 bp, Mus musculus
actgcctctctctttctgcact

SEQ ID NO: 191607 - DNA, 23 bp, Mus musculus
gtctgaactgtctcagcacaggg

SEQ ID NO: 191608 - DNA, 19 bp, Mus musculus
tgcaaagaccgttctgaca

SEQ ID NO: 191609 - DNA, 22 bp, Mus musculus
attttggcttttaaatctgttt

SEQ ID NO: 191610 - DNA, 21 bp, Mus musculus
ttaaaagttgatgctgctgga

SEQ ID NO: 191611 - DNA, 20 bp, Mus musculus
aggcccagtggaaaggatgt

SEQ ID NO: 191612 - DNA, 18 bp, Mus musculus
tcactctctttctgtttc

SEQ ID NO: 191613 - DNA, 23 bp, Mus musculus
tttcaggagtcagtgtttttgct

SEQ ID NO: 191614 - DNA, 21 bp, Mus musculus
atcctactgctagagcagcct

SEQ ID NO: 191615 - DNA, 23 bp, Mus musculus
gctgctgacagtagatagactgg

SEQ ID NO: 191616 - DNA, 23 bp, Mus musculus
ttattagttgaagctctagtagt

SEQ ID NO: 191617 - DNA, 18 bp, Mus musculus
ttgtgagagttacactgg

SEQ ID NO: 191618 - DNA, 22 bp, Mus musculus
tgttttgtgaccaattatatgg

SEQ ID NO: 191619 - DNA, 21 bp, Mus musculus
tctctgggagaggaatactgg

SEQ ID NO: 191620 - DNA, 23 bp, Mus musculus
gtgaagacagagatgagagatgc

SEQ ID NO: 191621 - DNA, 22 bp, Mus musculus
atgtctagctagtcaagccatc

SEQ ID NO: 191622 - DNA, 22 bp, Mus musculus
tgttttgtgaccaattatatgg

SEQ ID NO: 191623 - DNA, 23 bp, Mus musculus
tctgagtgactgaatgttctgtg

SEQ ID NO: 191624 - DNA, 23 bp, Mus musculus
aaactttatctgctggttcaaca

SEQ ID NO: 191625 - DNA, 22 bp, Mus musculus
atatatgcatataatgcagaat

SEQ ID NO: 191626 - DNA, 23 bp, Mus musculus
aagctcatgatgacctggtttta

SEQ ID NO: 191627 - DNA, 23 bp, Mus musculus
aaatgtgaatttgaaaaatactg

SEQ ID NO: 191628 - DNA, 23 bp, Mus musculus
aacagtgtttacttcatacaatg

SEQ ID NO: 191629 - DNA, 23 bp, Mus musculus
tctgcatttcttttgtatagatt

SEQ ID NO: 191630 - DNA, 22 bp, Mus musculus
attctctgatatttacatgtat

SEQ ID NO: 191631 - DNA, 22 bp, Mus musculus
aagtaaaaattcatatgtagct

SEQ ID NO: 191632 - DNA, 20 bp, Mus musculus
ctccttgtagcttctttgtt

SEQ ID NO: 191633 - DNA, 19 bp, Mus musculus
tgtgtgtgtgtgtgcatgt

SEQ ID NO: 191634 - DNA, 22 bp, Mus musculus
tcagtgaagactgagtggaata

SEQ ID NO: 191635 - DNA, 23 bp, Mus musculus
tgtgtatatgtaatgtgacggga

SEQ ID NO: 191636 - DNA, 23 bp, Mus musculus
gtcagagaagagagtgtgtcaag

SEQ ID NO: 191637 - DNA, 22 bp, Mus musculus
ttttctcagtttcttagatgtg

SEQ ID NO: 191638 - DNA, 23 bp, Mus musculus
aaatatggtagttctttccattg

SEQ ID NO: 191639 - DNA, 23 bp, Mus musculus
cggagtctgcttttgtgatttta

SEQ ID NO: 191640 - DNA, 23 bp, Mus musculus
aaagcccgagttcaaatcccagt

SEQ ID NO: 191641 - DNA, 23 bp, Mus musculus
atagcctctgcttcacttcagac

SEQ ID NO: 191642 - DNA, 23 bp, Mus musculus
ggagcaggaaatcaatggtgaga

SEQ ID NO: 191643 - DNA, 22 bp, Mus musculus
tatctctcccaggtttcttctg

SEQ ID NO: 191644 - DNA, 23 bp, Mus musculus
ttcgctacttctcttgactgcgg

SEQ ID NO: 191645 - DNA, 23 bp, Mus musculus
tgagaactgggtgagtctctgtt

SEQ ID NO: 191646 - DNA, 22 bp, Mus musculus
agaaggagctggtaactgtgta

SEQ ID NO: 191647 - DNA, 23 bp, Mus musculus
aagagcactgactgctcttccag

SEQ ID NO: 191648 - DNA, 22 bp, Mus musculus
tgttttgtgaccaattatatgg

SEQ ID NO: 191649 - DNA, 22 bp, Mus musculus
atatgtagtagacggagctaga

SEQ ID NO: 191650 - DNA, 18 bp, Mus musculus
atggtggtctgataggat

SEQ ID NO: 191651 - DNA, 23 bp, Mus musculus
tttgtgaccaattatattgtcaa

SEQ ID NO: 191652 - DNA, 20 bp, Mus musculus
actgaagagatggctcagtg

SEQ ID NO: 191653 - DNA, 22 bp, Mus musculus
agcatgtaggcatgcatgtaag

SEQ ID NO: 191654 - DNA, 23 bp, Mus musculus
tgcatggatgcatgtatgtatgt

SEQ ID NO: 191655 - DNA, 22 bp, Mus musculus
tgtgtatatatgtatatatgtg

SEQ ID NO: 191656 - DNA, 23 bp, Mus musculus
atgaggaagcctgtagacatacc

SEQ ID NO: 191657 - DNA, 23 bp, Mus musculus
tgcagagagatgtcagggacgag

SEQ ID NO: 191658 - DNA, 22 bp, Mus musculus
tgttttgtgaccaattatatgg

SEQ ID NO: 191659 - DNA, 22 bp, Mus musculus
atacacacacatatgtgtatat

SEQ ID NO: 191660 - DNA, 22 bp, Mus musculus
tatgtatatatgtgtgtgtatg

SEQ ID NO: 191661 - DNA, 21 bp, Mus musculus
tcactggctccctgtaaggca

SEQ ID NO: 191662 - DNA, 21 bp, Mus musculus
tgtgtgtatatatatgtgcat

SEQ ID NO: 191663 - DNA, 19 bp, Mus musculus
tatattcaatttgtatatg

SEQ ID NO: 191664 - DNA, 22 bp, Mus musculus
tgttttgtgaccaattatatgg

SEQ ID NO: 191665 - DNA, 23 bp, Mus musculus
aaagcctgtggtagacttgacat

SEQ ID NO: 191666 - DNA, 19 bp, Mus musculus
agagacaccatgaccacgg

SEQ ID NO: 191667 - DNA, 21 bp, Mus musculus
atttcttcttccatgatgttc

SEQ ID NO: 191668 - DNA, 22 bp, Mus musculus
actcagagccttgaatttgcta

SEQ ID NO: 191669 - DNA, 22 bp, Mus musculus
tgttttgtgaccaattatatgg

SEQ ID NO: 191670 - DNA, 22 bp, Mus musculus
tgttttgtgaccaattatatgg

SEQ ID NO: 191671 - DNA, 19 bp, Mus musculus
ttactcctctagtaccagg

SEQ ID NO: 191672 - DNA, 21 bp, Mus musculus
atagtccttgaattttgcttg

SEQ ID NO: 191673 - DNA, 23 bp, Mus musculus
atgtatgtatagatgtaagtaag

SEQ ID NO: 191674 - DNA, 19 bp, Mus musculus
catggtggtctgataggat

SEQ ID NO: 191675 - DNA, 22 bp, Mus musculus
tgttttgtgaccaattatatgg

SEQ ID NO: 191676 - DNA, 23 bp, Mus musculus
tggatgagaagtgatattgatgt

SEQ ID NO: 191677 - DNA, 23 bp, Mus musculus
ttgtaacactggtagaaattact

SEQ ID NO: 191678 - DNA, 23 bp, Mus musculus
tagtccatggtgatctgatagga

SEQ ID NO: 191679 - DNA, 22 bp, Mus musculus
tgttttgtgaccaattatgtgg

SEQ ID NO: 191680 - DNA, 20 bp, Mus musculus
tcagagtaaacagagagcag

SEQ ID NO: 191681 - DNA, 23 bp, Mus musculus
tgacagagatgactgagggtgca

SEQ ID NO: 191682 - DNA, 23 bp, Mus musculus
tatgtctccttttcatttctgat

SEQ ID NO: 191683 - DNA, 22 bp, Mus musculus
tgttttgtgaccaattatatgg

SEQ ID NO: 191684 - DNA, 23 bp, Mus musculus
tttgcttttatctctctgtgatc

SEQ ID NO: 191685 - DNA, 19 bp, Mus musculus
aggagcttgatatagctgt

SEQ ID NO: 191686 - DNA, 23 bp, Mus musculus
attcagttatgttacctatgtct

SEQ ID NO: 191687 - DNA, 22 bp, Mus musculus
taatgtgaactagggaaactgt

SEQ ID NO: 191688 - DNA, 21 bp, Mus musculus
gtcagaactctgagagcagta

SEQ ID NO: 191689 - DNA, 21 bp, Mus musculus
agtagtctgtttatgttgttg

SEQ ID NO: 191690 - DNA, 23 bp, Mus musculus
caagagtctaatgtgtaggctgt

SEQ ID NO: 191691 - DNA, 20 bp, Mus musculus
aaactaagtactgacaaggt

SEQ ID NO: 191692 - DNA, 23 bp, Mus musculus
tgtccatctgtccctctgttact

SEQ ID NO: 191693 - DNA, 22 bp, Mus musculus
tgttttgtgaccaattatatgg

SEQ ID NO: 191694 - DNA, 20 bp, Mus musculus
gctcagaggctaagagctct

SEQ ID NO: 191695 - DNA, 19 bp, Mus musculus
ctgctgctgtgcctcctgt

SEQ ID NO: 191696 - DNA, 23 bp, Mus musculus
gtgtgtctgtctgtctgtctgtc

SEQ ID NO: 191697 - DNA, 23 bp, Mus musculus
tgtgtgtgtgcatgtgtatatgt

SEQ ID NO: 191698 - DNA, 22 bp, Mus musculus
ctttttgcggtctgggcttgct

SEQ ID NO: 191699 - DNA, 22 bp, Mus musculus
aagcccttaccccaaaaagtat

SEQ ID NO: 191700 - DNA, 23 bp, Mus musculus
tttttcttctattctcatcaagg

SEQ ID NO: 191701 - DNA, 23 bp, Mus musculus
cagatgacagtagactcagagga

SEQ ID NO: 191702 - DNA, 21 bp, Mus musculus
atgtctctactattcatgccg

SEQ ID NO: 191703 - DNA, 22 bp, Mus musculus
taggtgtgggactcctagcaga

SEQ ID NO: 191704 - DNA, 23 bp, Mus musculus
tgtctctgactcctttggctgcc

SEQ ID NO: 191705 - DNA, 23 bp, Mus musculus
gtctgtgcctgtgtctgtgtctg

SEQ ID NO: 191706 - DNA, 23 bp, Mus musculus
gcttactttcactttcttccaga

SEQ ID NO: 191707 - DNA, 21 bp, Mus musculus
agagagtagtcagtgaggact

SEQ ID NO: 191708 - DNA, 23 bp, Mus musculus
ctgtcagtctctctcttggatgt

SEQ ID NO: 191709 - DNA, 22 bp, Mus musculus
aggcttcatcatgaggtggtca

SEQ ID NO: 191710 - DNA, 22 bp, Mus musculus
tgtgtctctgtcacaatacagt

SEQ ID NO: 191711 - DNA, 23 bp, Mus musculus
gagtgtagagagtttgctgagca

SEQ ID NO: 191712 - DNA, 23 bp, Mus musculus
cactctctctctctctcagttac

SEQ ID NO: 191713 - DNA, 23 bp, Mus musculus
taagagcactgactgctcttcca

SEQ ID NO: 191714 - DNA, 23 bp, Mus musculus
agccagtcagatttctctgctgg

SEQ ID NO: 191715 - DNA, 23 bp, Mus musculus
cagactgaagagactgagccaat

SEQ ID NO: 191716 - DNA, 23 bp, Mus musculus
taagaccgtcctctctctctctc

SEQ ID NO: 191717 - DNA, 23 bp, Mus musculus
ttgtgaggttttgttatctgtgt

SEQ ID NO: 191718 - DNA, 23 bp, Mus musculus
gttgctgagacttaaaaccatgt

SEQ ID NO: 191719 - DNA, 23 bp, Mus musculus
ccgggactctgtgtgcctgtgcg

SEQ ID NO: 191720 - DNA, 23 bp, Mus musculus
cagacactgtggagttggtgagg

SEQ ID NO: 191721 - DNA, 20 bp, Mus musculus
ttttaaagctggatgtggtt

SEQ ID NO: 191722 - DNA, 23 bp, Mus musculus
tcaagagcaataacgaaaaatgt

SEQ ID NO: 191723 - DNA, 22 bp, Mus musculus
tattgctcctgaccccctctca

SEQ ID NO: 191724 - DNA, 23 bp, Mus musculus
agagctatagatgagacagagca

SEQ ID NO: 191725 - DNA, 22 bp, Mus musculus
tctatcatgaatttggtatgca

SEQ ID NO: 191726 - DNA, 23 bp, Mus musculus
tgaatttatatggagatactgct

SEQ ID NO: 191727 - DNA, 19 bp, Mus musculus
tccctcagacctctgctgt

SEQ ID NO: 191728 - DNA, 23 bp, Mus musculus
cagagacacacacttgttacctc

SEQ ID NO: 191729 - DNA, 20 bp, Mus musculus
atatgtatgaaatgtgtgtg

SEQ ID NO: 191730 - DNA, 23 bp, Mus musculus
actcctgagagactcacacagac

SEQ ID NO: 191731 - DNA, 22 bp, Mus musculus
tgactgttaatcttaattgtca

SEQ ID NO: 191732 - DNA, 23 bp, Mus musculus
tcctaactctcatcagtgtctgt

SEQ ID NO: 191733 - DNA, 23 bp, Mus musculus
tttctccttatgtttaggttttg

SEQ ID NO: 191734 - DNA, 23 bp, Mus musculus
agaggacatctatgtctctcagt

SEQ ID NO: 191735 - DNA, 22 bp, Mus musculus
tccatgttgatctgataggatg

SEQ ID NO: 191736 - DNA, 23 bp, Mus musculus
ttttgtgaccaattatatggtca

SEQ ID NO: 191737 - DNA, 23 bp, Mus musculus
aagtgctttgtctgcagatatga

SEQ ID NO: 191738 - DNA, 19 bp, Mus musculus
catgcaaagggtgtgtggg

SEQ ID NO: 191739 - DNA, 23 bp, Mus musculus
aagtcagagctattgaaatggga

SEQ ID NO: 191740 - DNA, 18 bp, Mus musculus
aaagcagactcccaggag

SEQ ID NO: 191741 - DNA, 23 bp, Mus musculus
tgtgtatgtgtgtgtgtgtacat

SEQ ID NO: 191742 - DNA, 19 bp, Mus musculus
gactcagcaaagcctagag

SEQ ID NO: 191743 - DNA, 23 bp, Mus musculus
tctctctggctctgtgggtctct

SEQ ID NO: 191744 - DNA, 23 bp, Mus musculus
gatgtctgtctgtctgtctgtct

SEQ ID NO: 191745 - DNA, 23 bp, Mus musculus
gagaagtgtgcgccttctgtgac

SEQ ID NO: 191746 - DNA, 23 bp, Mus musculus
atagagactgcacacagtgctgc

SEQ ID NO: 191747 - DNA, 23 bp, Mus musculus
cacaactgtctgtgattccagct

SEQ ID NO: 191748 - DNA, 21 bp, Mus musculus
tgtccatatatatgcatgtgt

SEQ ID NO: 191749 - DNA, 23 bp, Mus musculus
tatatgtctggatatgtatatgt

SEQ ID NO: 191750 - DNA, 23 bp, Mus musculus
atgcagtgctcacagagctcaga

SEQ ID NO: 191751 - DNA, 20 bp, Mus musculus
gtggtcacagagtgtctgca

SEQ ID NO: 191752 - DNA, 23 bp, Mus musculus
tacacacatatatagacacacgc

SEQ ID NO: 191753 - DNA, 23 bp, Mus musculus
tatctctgtgtccctctgtgtcc

SEQ ID NO: 191754 - DNA, 22 bp, Mus musculus
ttgactctgaaattattgtgtg

SEQ ID NO: 191755 - DNA, 23 bp, Mus musculus
agcttctacagttttgatttact

SEQ ID NO: 191756 - DNA, 22 bp, Mus musculus
gatgactcaagagtgtgtggcc

SEQ ID NO: 191757 - DNA, 22 bp, Mus musculus
atttgcacatgcacaccaacca

SEQ ID NO: 191758 - DNA, 22 bp, Mus musculus
tatgtgcatatatatgtgcata

SEQ ID NO: 191759 - DNA, 23 bp, Mus musculus
ttgagacactgactggagactgc

SEQ ID NO: 191760 - DNA, 20 bp, Mus musculus
gtgtgacagtgagtgactgt

SEQ ID NO: 191761 - DNA, 18 bp, Mus musculus
tagggctagctctttcct

SEQ ID NO: 191762 - DNA, 22 bp, Mus musculus
ttccttgtcccagtgatggcgc

SEQ ID NO: 191763 - DNA, 22 bp, Mus musculus
tgttttgtgaccaattatatgg

SEQ ID NO: 191764 - DNA, 22 bp, Mus musculus
cttgtcccagtgctggtgcagc

SEQ ID NO: 191765 - DNA, 23 bp, Mus musculus
ctgagagaagatggtctccacat

SEQ ID NO: 191766 - DNA, 20 bp, Mus musculus
cgtgagtaatcatggtcttt

SEQ ID NO: 191767 - DNA, 23 bp, Mus musculus
actgagtgttggatgtggtctgt

SEQ ID NO: 191768 - DNA, 22 bp, Mus musculus
cagtagatggagaagccaaaca

SEQ ID NO: 191769 - DNA, 23 bp, Mus musculus
aagagaagagactcaggactcgg

SEQ ID NO: 191770 - DNA, 20 bp, Mus musculus
ttttctgatcttgtatttga

SEQ ID NO: 191771 - DNA, 23 bp, Mus musculus
taaattctagagcatgaaatctc

SEQ ID NO: 191772 - DNA, 20 bp, Mus musculus
ttgtgaaattctaattatcc

SEQ ID NO: 191773 - DNA, 23 bp, Mus musculus
aaaaggtagatggacatttcaaa

SEQ ID NO: 191774 - DNA, 23 bp, Mus musculus
ctactactagctagaatagttgg

SEQ ID NO: 191775 - DNA, 23 bp, Mus musculus
tgtgtatatgtatgtatatatac

SEQ ID NO: 191776 - DNA, 21 bp, Mus musculus
atatgtgtacgtgtatatgtg

SEQ ID NO: 191777 - DNA, 20 bp, Mus musculus
tgtgtatacacacacacaca

SEQ ID NO: 191778 - DNA, 21 bp, Mus musculus
tcccagaagactgtgagctct

SEQ ID NO: 191779 - DNA, 22 bp, Mus musculus
gagtggctaattattctcagac

SEQ ID NO: 191780 - DNA, 21 bp, Mus musculus
tgagctgggactttcagcaaa

SEQ ID NO: 191781 - DNA, 18 bp, Mus musculus
ctccatttccatccctgt

SEQ ID NO: 191782 - DNA, 23 bp, Mus musculus
tatgtgtctctccatgtgttctg

SEQ ID NO: 191783 - DNA, 23 bp, Mus musculus
gtgtatcagattcttttagaagt

SEQ ID NO: 191784 - DNA, 23 bp, Mus musculus
atatgttctactagaatgcatga

SEQ ID NO: 191785 - DNA, 22 bp, Mus musculus
tgttttgtgaccaattatatgg

SEQ ID NO: 191786 - DNA, 23 bp, Mus musculus
ctacactaactctgttctatgca

SEQ ID NO: 191787 - DNA, 23 bp, Mus musculus
gagagtttagtctttttgttctt

SEQ ID NO: 191788 - DNA, 23 bp, Mus musculus
gatgtctttgaaatttgaggtta

SEQ ID NO: 191789 - DNA, 23 bp, Mus musculus
gtttgaaaaataaaagtggtatg

SEQ ID NO: 191790 - DNA, 18 bp, Mus musculus
cacacacagagtattgac

SEQ ID NO: 191791 - DNA, 23 bp, Mus musculus
tatgtgtatgtatatgtatatat

SEQ ID NO: 191792 - DNA, 19 bp, Mus musculus
agaggtggaactagggact

SEQ ID NO: 191793 - DNA, 23 bp, Mus musculus
acagtactctaatgcaataatgg

SEQ ID NO: 191794 - DNA, 20 bp, Mus musculus
taagagcattgactgctctt

SEQ ID NO: 191795 - DNA, 23 bp, Mus musculus
tgcaattgttcagatggaagtgg

SEQ ID NO: 191796 - DNA, 23 bp, Mus musculus
tatgtgcatatgtatatatgtgt

SEQ ID NO: 191797 - DNA, 23 bp, Mus musculus
tagtccatggtgatctgatagga

SEQ ID NO: 191798 - DNA, 23 bp, Mus musculus
atatttttgtatctgtggaggcc

SEQ ID NO: 191799 - DNA, 23 bp, Mus musculus
ctgtgtctctgtttagtttctgt

SEQ ID NO: 191800 - DNA, 21 bp, Mus musculus
agacaccctctgtgaatgggt

SEQ ID NO: 191801 - DNA, 19 bp, Mus musculus
acagggcatagtagatcag

SEQ ID NO: 191802 - DNA, 22 bp, Mus musculus
tatgtgtatatgtatatatgtg

SEQ ID NO: 191803 - DNA, 23 bp, Mus musculus
atgtgtgtatatgtatatatgta

SEQ ID NO: 191804 - DNA, 23 bp, Mus musculus
caaatatgtgtatgtgtatgttg

SEQ ID NO: 191805 - DNA, 23 bp, Mus musculus
atgtgtgtgtgcatgtggttgtg

SEQ ID NO: 191806 - DNA, 23 bp, Mus musculus
tgtttacttcatgacctgctctg

SEQ ID NO: 191807 - DNA, 18 bp, Mus musculus
tgtagtagagttagcttc

SEQ ID NO: 191808 - DNA, 23 bp, Mus musculus
tctctctctacgtgtgtgtctgt

SEQ ID NO: 191809 - DNA, 21 bp, Mus musculus
acagacagacctactcctcag

SEQ ID NO: 191810 - DNA, 23 bp, Mus musculus
aacttgcttctggctgtgcctct

SEQ ID NO: 191811 - DNA, 22 bp, Mus musculus
gtgcctctctgagtggctctga

SEQ ID NO: 191812 - DNA, 23 bp, Mus musculus
tgacggttcacactgtggctgtc

SEQ ID NO: 191813 - DNA, 20 bp, Mus musculus
tcacagaggcatgggtggag

SEQ ID NO: 191814 - DNA, 23 bp, Mus musculus
agtactgactgctcttccagagg

SEQ ID NO: 191815 - DNA, 21 bp, Mus musculus
atgtgcatcatgtatgtatgt

SEQ ID NO: 191816 - DNA, 23 bp, Mus musculus
tatgtatgtatgtatgtatgtat

SEQ ID NO: 191817 - DNA, 23 bp, Mus musculus
tgactcagaggttaagaacactg

SEQ ID NO: 191818 - DNA, 20 bp, Mus musculus
agagtccctgtgagactggg

SEQ ID NO: 191819 - DNA, 23 bp, Mus musculus
gacacggtctctcactgggcctg

SEQ ID NO: 191820 - DNA, 19 bp, Mus musculus
tcagccactctgactaagt

SEQ ID NO: 191821 - DNA, 18 bp, Mus musculus
cagatgcactgagactgt

SEQ ID NO: 191822 - DNA, 23 bp, Mus musculus
atgtgtctctatgtatgtgtgtc

SEQ ID NO: 191823 - DNA, 23 bp, Mus musculus
catgtgactctctatctctgatc

SEQ ID NO: 191824 - DNA, 23 bp, Mus musculus
tggctgtgtcactctaaaccctc

SEQ ID NO: 191825 - DNA, 18 bp, Mus musculus
actcagaggttaagagcc

SEQ ID NO: 191826 - DNA, 18 bp, Mus musculus
agcatctacatggtggct

SEQ ID NO: 191827 - DNA, 23 bp, Mus musculus
tctggagattcagattcaggttg

SEQ ID NO: 191828 - DNA, 23 bp, Mus musculus
gagcctctgtctgtgttccttgt

SEQ ID NO: 191829 - DNA, 23 bp, Mus musculus
ccagcaagttattgttaaagaat

SEQ ID NO: 191830 - DNA, 23 bp, Mus musculus
gacatgtgacactttctcctcag

SEQ ID NO: 191831 - DNA, 20 bp, Mus musculus
aaatcaatcatcaatcagtc

SEQ ID NO: 191832 - DNA, 23 bp, Mus musculus
tctgagtgtgatcagacagtgcg

SEQ ID NO: 191833 - DNA, 23 bp, Mus musculus
aactgtctacttgggaatttctc

SEQ ID NO: 191834 - DNA, 22 bp, Mus musculus
aatctctgcatgaaactgtttc

SEQ ID NO: 191835 - DNA, 19 bp, Mus musculus
acagttgtcactgaggtct

SEQ ID NO: 191836 - DNA, 23 bp, Mus musculus
tagtgtcaggctgtgtgtctctg

SEQ ID NO: 191837 - DNA, 23 bp, Mus musculus
ggatgaagcttctctgatgatgg

SEQ ID NO: 191838 - DNA, 22 bp, Mus musculus
tgttttgtgaccaattatatgg

SEQ ID NO: 191839 - DNA, 21 bp, Mus musculus
atgtgtatttatatatatgag

SEQ ID NO: 191840 - DNA, 20 bp, Mus musculus
tacagcatatatatagtata

SEQ ID NO: 191841 - DNA, 19 bp, Mus musculus
gtaaagaaggatggttctg

SEQ ID NO: 191842 - DNA, 21 bp, Mus musculus
tatctctctccctctttagtg

SEQ ID NO: 191843 - DNA, 23 bp, Mus musculus
ctctctgtatttgtctctctatc

SEQ ID NO: 191844 - DNA, 23 bp, Mus musculus
tctctgtctgtctgtctatacag

SEQ ID NO: 191845 - DNA, 22 bp, Mus musculus
atatacataggtagatgataga

SEQ ID NO: 191846 - DNA, 22 bp, Mus musculus
tgaaggagctggtgctgcagat

SEQ ID NO: 191847 - DNA, 23 bp, Mus musculus
tctctactaggctttctcagtcc

SEQ ID NO: 191848 - DNA, 23 bp, Mus musculus
cagggacactgactcagtacttg

SEQ ID NO: 191849 - DNA, 22 bp, Mus musculus
atatgtgaatatatatgtgtgt

SEQ ID NO: 191850 - DNA, 23 bp, Mus musculus
tgggagaattcagatgtagctga

SEQ ID NO: 191851 - DNA, 22 bp, Mus musculus
tgttttgtgaccaattatatgg

SEQ ID NO: 191852 - DNA, 22 bp, Mus musculus
tgttttgtgaccaattatatgg

SEQ ID NO: 191853 - DNA, 23 bp, Mus musculus
tagtccgtgatgatctgatagga

SEQ ID NO: 191854 - DNA, 22 bp, Mus musculus
tgttttgtgaccaattatatgg

SEQ ID NO: 191855 - DNA, 22 bp, Mus musculus
tgttttgtgaccaattatatgg

SEQ ID NO: 191856 - DNA, 22 bp, Mus musculus
tgttttgtgaccaattatatgg

SEQ ID NO: 191857 - DNA, 22 bp, Mus musculus
tgttttgtgaccaattatatgg

SEQ ID NO: 191858 - DNA, 22 bp, Mus musculus
tgttttgtgaccaattatatgg

SEQ ID NO: 191859 - DNA, 23 bp, Mus musculus
gctgtgtctctgtccctctatca

SEQ ID NO: 191860 - DNA, 22 bp, Mus musculus
aatggatcttcatgatagcagc

SEQ ID NO: 191861 - DNA, 23 bp, Mus musculus
gaccagtgtcagtgtctcacagg

SEQ ID NO: 191862 - DNA, 19 bp, Mus musculus
ttgagcacattgtgcccac

SEQ ID NO: 191863 - DNA, 23 bp, Mus musculus
tttaagagggttttgcttttgga

SEQ ID NO: 191864 - DNA, 23 bp, Mus musculus
tgtgtgtctgtgtctctgtgtgt

SEQ ID NO: 191865 - DNA, 22 bp, Mus musculus
tgttttgtgaccaattatatgg

SEQ ID NO: 191866 - DNA, 18 bp, Mus musculus
gtgtagctctgggtctct

SEQ ID NO: 191867 - DNA, 23 bp, Mus musculus
tagttacttgaagctgactcaca

SEQ ID NO: 191868 - DNA, 23 bp, Mus musculus
tctatacatagttttagataaca

SEQ ID NO: 191869 - DNA, 18 bp, Mus musculus
tgggttggatgaggaggg

SEQ ID NO: 191870 - DNA, 23 bp, Mus musculus
tgtctgtctgtctttttcaactg

SEQ ID NO: 191871 - DNA, 23 bp, Mus musculus
gtatgtgtgtgtgtatacatgta

SEQ ID NO: 191872 - DNA, 22 bp, Mus musculus
tgttttgtgaccaattatatgg

SEQ ID NO: 191873 - DNA, 21 bp, Mus musculus
agagattagagagtgatcttg

SEQ ID NO: 191874 - DNA, 22 bp, Mus musculus
tgttttgtgaccaattatatgg

SEQ ID NO: 191875 - DNA, 18 bp, Mus musculus
aggagagtttgcatcctg

SEQ ID NO: 191876 - DNA, 23 bp, Mus musculus
agaaaactgactgtggcaaggct

SEQ ID NO: 191877 - DNA, 23 bp, Mus musculus
ttgctcagatttgaaagtgagga

SEQ ID NO: 191878 - DNA, 23 bp, Mus musculus
tatgaaaatggatatcatttgtt

SEQ ID NO: 191879 - DNA, 19 bp, Mus musculus
atgtatgtatatgtatatg

SEQ ID NO: 191880 - DNA, 22 bp, Mus musculus
tgttttgtgaccaattatatgg

SEQ ID NO: 191881 - DNA, 23 bp, Mus musculus
tagtccatggtgatctgatagga

SEQ ID NO: 191882 - DNA, 22 bp, Mus musculus
tgttttgtgtccaattatgtgg

SEQ ID NO: 191883 - DNA, 23 bp, Mus musculus
tttctgtctccatgaattgtcca

SEQ ID NO: 191884 - DNA, 22 bp, Mus musculus
tgttttgtgtccaattatgtgg

SEQ ID NO: 191885 - DNA, 23 bp, Mus musculus
tagtccatggtgatctgatagga

SEQ ID NO: 191886 - DNA, 22 bp, Mus musculus
tgttttgtgtccaattatgtgg

SEQ ID NO: 191887 - DNA, 23 bp, Mus musculus
tttctgtctccatgaattgtcca

SEQ ID NO: 191888 - DNA, 22 bp, Mus musculus
tgttttgtgtccaattatgtgg

SEQ ID NO: 191889 - DNA, 22 bp, Mus musculus
tgttttgtgaccaattatatgg

SEQ ID NO: 191890 - DNA, 19 bp, Mus musculus
tgtagttttcactttcaat

SEQ ID NO: 191891 - DNA, 22 bp, Mus musculus
tgttttgtgaccaattatatgg

SEQ ID NO: 191892 - DNA, 23 bp, Mus musculus
tgtgtgtcttgtgtacctgtgtt

SEQ ID NO: 191893 - DNA, 23 bp, Mus musculus
tgacagtagagtgattgcactag

SEQ ID NO: 191894 - DNA, 18 bp, Mus musculus
aagaatatttattgctct

SEQ ID NO: 191895 - DNA, 23 bp, Mus musculus
ttaaactgtgtttttgttgatgt

SEQ ID NO: 191896 - DNA, 23 bp, Mus musculus
tcaaatgcagacatagataggag

SEQ ID NO: 191897 - DNA, 18 bp, Mus musculus
tagagtcactatcagcaa

SEQ ID NO: 191898 - DNA, 21 bp, Mus musculus
tgtctcagtgtatatgtcatc

SEQ ID NO: 191899 - DNA, 18 bp, Mus musculus
atgttttaaattgagaaa

SEQ ID NO: 191900 - DNA, 22 bp, Mus musculus
tgttttgtgaccaattatatgg

SEQ ID NO: 191901 - DNA, 23 bp, Mus musculus
tgtcactgtgtatattggctctg

SEQ ID NO: 191902 - DNA, 20 bp, Mus musculus
tatgacgctggtctggtggt

SEQ ID NO: 191903 - DNA, 20 bp, Mus musculus
gtaatgtatgatatatatct

SEQ ID NO: 191904 - DNA, 23 bp, Mus musculus
aagtctttagtttttgatgttgt

SEQ ID NO: 191905 - DNA, 23 bp, Mus musculus
ttgtgtgtttcgaattgaagtgc

SEQ ID NO: 191906 - DNA, 19 bp, Mus musculus
tttctacttggtcactagg

SEQ ID NO: 191907 - DNA, 23 bp, Mus musculus
tagatagactgatgatagacaga

SEQ ID NO: 191908 - DNA, 20 bp, Mus musculus
tggattggagagaggactca

SEQ ID NO: 191909 - DNA, 21 bp, Mus musculus
ctgacccattaagaagacctg

SEQ ID NO: 191910 - DNA, 23 bp, Mus musculus
tctgtctgtgtatagtcatcaga

SEQ ID NO: 191911 - DNA, 23 bp, Mus musculus
ttcatgtttgtgtggaaatatat

SEQ ID NO: 191912 - DNA, 22 bp, Mus musculus
agtctctcccactctttctcct

SEQ ID NO: 191913 - DNA, 21 bp, Mus musculus
tagagcattaaattatgtgtt

SEQ ID NO: 191914 - DNA, 21 bp, Mus musculus
tgtgtatatgtatacttgtgt

SEQ ID NO: 191915 - DNA, 20 bp, Mus musculus
agtgttccaactctcactgt

SEQ ID NO: 191916 - DNA, 21 bp, Mus musculus
actcattctgtcttccctggc

SEQ ID NO: 191917 - DNA, 23 bp, Mus musculus
tctgtttagttatggacgtctac

SEQ ID NO: 191918 - DNA, 22 bp, Mus musculus
tgtctctctgtgtttcaattct

SEQ ID NO: 191919 - DNA, 23 bp, Mus musculus
cagtgtctgagactctctgttca

SEQ ID NO: 191920 - DNA, 23 bp, Mus musculus
ctttctctctgaaagaactcaca

SEQ ID NO: 191921 - DNA, 18 bp, Mus musculus
tttcctttaagaggtgaa

SEQ ID NO: 191922 - DNA, 21 bp, Mus musculus
cagactgagagagagtggctg

SEQ ID NO: 191923 - DNA, 23 bp, Mus musculus
gtctctcactgttttaataaagg

SEQ ID NO: 191924 - DNA, 23 bp, Mus musculus
tttgtgaggcaggtatggtgaga

SEQ ID NO: 191925 - DNA, 22 bp, Mus musculus
tgttttgtgaccaattatatgg

SEQ ID NO: 191926 - DNA, 21 bp, Mus musculus
tccatggtggtctgataggat

SEQ ID NO: 191927 - DNA, 22 bp, Mus musculus
tgttttgtgaccaattatatgg

SEQ ID NO: 191928 - DNA, 22 bp, Mus musculus
aggctctcagctaaacagctgt

SEQ ID NO: 191929 - DNA, 21 bp, Mus musculus
agtcagtctgtctctgtctcg

SEQ ID NO: 191930 - DNA, 20 bp, Mus musculus
atgtatatatgtatatgtat

SEQ ID NO: 191931 - DNA, 18 bp, Mus musculus
tctgtttatgtatacata

SEQ ID NO: 191932 - DNA, 18 bp, Mus musculus
atgtatgtatgtatgtgt

SEQ ID NO: 191933 - DNA, 18 bp, Mus musculus
acttgctccacttcatgg

SEQ ID NO: 191934 - DNA, 21 bp, Mus musculus
atgtaaatccagcccctctaa

SEQ ID NO: 191935 - DNA, 20 bp, Mus musculus
gtgcatgtatatatgtatat

SEQ ID NO: 191936 - DNA, 22 bp, Mus musculus
tatgtgtgtgtgtatgtacatg

SEQ ID NO: 191937 - DNA, 23 bp, Mus musculus
tgtgtgactgtagggagttgcta

SEQ ID NO: 191938 - DNA, 21 bp, Mus musculus
tgtctgcagttggtagtgaca

SEQ ID NO: 191939 - DNA, 23 bp, Mus musculus
tgtatgtatgtatgtatgtatgt

SEQ ID NO: 191940 - DNA, 23 bp, Mus musculus
gccactcactgactgtttacatt

SEQ ID NO: 191941 - DNA, 23 bp, Mus musculus
ctgtgtctctgtttagtttctgt

SEQ ID NO: 191942 - DNA, 23 bp, Mus musculus
aggatctgtccattgatgagagt

SEQ ID NO: 191943 - DNA, 22 bp, Mus musculus
ctctcctgttgatggttctttg

SEQ ID NO: 191944 - DNA, 23 bp, Mus musculus
taaactgtggtcagtgtgtgtgt

SEQ ID NO: 191945 - DNA, 22 bp, Mus musculus
accaggctgtccttgaactcac

SEQ ID NO: 191946 - DNA, 23 bp, Mus musculus
actgtgtctgtgtgtctttgtac

SEQ ID NO: 191947 - DNA, 19 bp, Mus musculus
agcagagatcaaaggacaa

SEQ ID NO: 191948 - DNA, 20 bp, Mus musculus
ctgcagtctttgactctgtc

SEQ ID NO: 191949 - DNA, 20 bp, Mus musculus
tctcgatgagaattgattta

SEQ ID NO: 191950 - DNA, 20 bp, Mus musculus
aagagcactgactgctcttc

SEQ ID NO: 191951 - DNA, 20 bp, Mus musculus
atgtatgtatgtatgtatgt

SEQ ID NO: 191952 - DNA, 21 bp, Mus musculus
aattaacagagtatttgaaat

SEQ ID NO: 191953 - DNA, 22 bp, Mus musculus
aagatttgtttttgtttcatgt

SEQ ID NO: 191954 - DNA, 18 bp, Mus musculus
cagaggtcctgagttcaa

SEQ ID NO: 191955 - DNA, 21 bp, Mus musculus
tgtgtgtgtgtgtatatatac

SEQ ID NO: 191956 - DNA, 23 bp, Mus musculus
tgtaatgtatacaatgacttcca

SEQ ID NO: 191957 - DNA, 23 bp, Mus musculus
atgtatgtatgtatgtatgtatg

SEQ ID NO: 191958 - DNA, 22 bp, Mus musculus
tgcatgcatgcatgtatgtatc

SEQ ID NO: 191959 - DNA, 23 bp, Mus musculus
tgtctgtctgtctgtctgtctat

SEQ ID NO: 191960 - DNA, 22 bp, Mus musculus
tgttttgtgaccaattatatgg

SEQ ID NO: 191961 - DNA, 20 bp, Mus musculus
caggaacaagattatatatt

SEQ ID NO: 191962 - DNA, 20 bp, Mus musculus
atgatttgtgttcttttgtt

SEQ ID NO: 191963 - DNA, 23 bp, Mus musculus
tgagaagagagagaaggcttaaa

SEQ ID NO: 191964 - DNA, 23 bp, Mus musculus
tgcatacatgagtgtatgtataa

SEQ ID NO: 191965 - DNA, 23 bp, Mus musculus
atgtttgtgcatatatttacatg

SEQ ID NO: 191966 - DNA, 19 bp, Mus musculus
tgtgtgtgcatgtgtgcgc

SEQ ID NO: 191967 - DNA, 23 bp, Mus musculus
tatctgtgtatatgtatgtgtgt

SEQ ID NO: 191968 - DNA, 23 bp, Mus musculus
ctgttatgtcattttcttgttga

SEQ ID NO: 191969 - DNA, 18 bp, Mus musculus
accagagtgaggtgagtg

SEQ ID NO: 191970 - DNA, 23 bp, Mus musculus
tgtctgcacactgtctaagctgt

SEQ ID NO: 191971 - DNA, 23 bp, Mus musculus
tatgtgtgtgtgatacatctaag

SEQ ID NO: 191972 - DNA, 23 bp, Mus musculus
tgtctgtctcagctttgggtctg

SEQ ID NO: 191973 - DNA, 23 bp, Mus musculus
acagagtagacagagatagagct

SEQ ID NO: 191974 - DNA, 21 bp, Mus musculus
atgacacaacagagtctccag

SEQ ID NO: 191975 - DNA, 18 bp, Mus musculus
taggaggacagtaagaaa

SEQ ID NO: 191976 - DNA, 22 bp, Mus musculus
aggttgaactgcgggtggactg

SEQ ID NO: 191977 - DNA, 23 bp, Mus musculus
tgcctctcacactcactcggcct

SEQ ID NO: 191978 - DNA, 21 bp, Mus musculus
agagcaggtgttatggtgtca

SEQ ID NO: 191979 - DNA, 23 bp, Mus musculus
ctcagtcattcccctttgccttt

SEQ ID NO: 191980 - DNA, 23 bp, Mus musculus
ttccctgtctctgtctctgtctc

SEQ ID NO: 191981 - DNA, 23 bp, Mus musculus
gtgtgactgtgtgtctgtgtggg

SEQ ID NO: 191982 - DNA, 19 bp, Mus musculus
tatggcaggcaaagaaagg

SEQ ID NO: 191983 - DNA, 23 bp, Mus musculus
ctgcactctgtctctgacagccc

SEQ ID NO: 191984 - DNA, 19 bp, Mus musculus
agtcagccccagaggcagc

SEQ ID NO: 191985 - DNA, 22 bp, Mus musculus
aggaagactgaatctaactgct

SEQ ID NO: 191986 - DNA, 23 bp, Mus musculus
attttgcctcttcaaagctatct

SEQ ID NO: 191987 - DNA, 22 bp, Mus musculus
ccttctgctgtctctccaggta

SEQ ID NO: 191988 - DNA, 19 bp, Mus musculus
tctagaagggtttctctga

SEQ ID NO: 191989 - DNA, 20 bp, Mus musculus
ttgggtctacatagtgaatt

SEQ ID NO: 191990 - DNA, 19 bp, Mus musculus
acagatgtgtgtgtgcaca

SEQ ID NO: 191991 - DNA, 23 bp, Mus musculus
agtaatactcattggtttcccaa

SEQ ID NO: 191992 - DNA, 22 bp, Mus musculus
tgttttgtgaccaattatatgg

SEQ ID NO: 191993 - DNA, 23 bp, Mus musculus
agtcagtctgaaattggttgaga

SEQ ID NO: 191994 - DNA, 23 bp, Mus musculus
gcctgtctgcctgtctgcctgtc

SEQ ID NO: 191995 - DNA, 23 bp, Mus musculus
aggatagctgctctctttcttgt

SEQ ID NO: 191996 - DNA, 22 bp, Mus musculus
tctcactgtatctgtgtcttca

SEQ ID NO: 191997 - DNA, 23 bp, Mus musculus
cactgtgtctctgtttaggttct

SEQ ID NO: 191998 - DNA, 22 bp, Mus musculus
atctgtccattgatgagagtgg

SEQ ID NO: 191999 - DNA, 23 bp, Mus musculus
atgtacctgtctgtctctgtatc

SEQ ID NO: 192000 - DNA, 23 bp, Mus musculus
tgtgtagaacatctcgaggtcag

SEQ ID NO: 192001 - DNA, 21 bp, Mus musculus
tcctcattttgtaattggttt

SEQ ID NO: 192002 - DNA, 23 bp, Mus musculus
tctgtccttgtctgtctctaaca

SEQ ID NO: 192003 - DNA, 23 bp, Mus musculus
ctgaatctgtcagattttgatgt

SEQ ID NO: 192004 - DNA, 23 bp, Mus musculus
ttagtctctggtgatctgttagg

SEQ ID NO: 192005 - DNA, 23 bp, Mus musculus
tttttgcatgttttgaggcctgt

SEQ ID NO: 192006 - DNA, 21 bp, Mus musculus
ccgggtctctcactgtcagtc

SEQ ID NO: 192007 - DNA, 23 bp, Mus musculus
tctgacatcactgatggctcttc

SEQ ID NO: 192008 - DNA, 23 bp, Mus musculus
gctttacatgaacaactgctgga

SEQ ID NO: 192009 - DNA, 21 bp, Mus musculus
ttatgtctggaatttgatgag

SEQ ID NO: 192010 - DNA, 22 bp, Mus musculus
tgttttgtgaccaattatatgg

SEQ ID NO: 192011 - DNA, 22 bp, Mus musculus
ctatgtgcaactgcaagtggtt

SEQ ID NO: 192012 - DNA, 23 bp, Mus musculus
ttcttcagtcattttctacttct

SEQ ID NO: 192013 - DNA, 22 bp, Mus musculus
tgttttgtgaccaattatatgg

SEQ ID NO: 192014 - DNA, 23 bp, Mus musculus
tagttcatagtgatctgatagca

SEQ ID NO: 192015 - DNA, 19 bp, Mus musculus
tgttttgttaccaattata

SEQ ID NO: 192016 - DNA, 20 bp, Mus musculus
tgtgtgtgtgtattctatgt

SEQ ID NO: 192017 - DNA, 23 bp, Mus musculus
tgtgtatgtgtgtgtattctatg

SEQ ID NO: 192018 - DNA, 23 bp, Mus musculus
taaatgcatcatatatatacaca

SEQ ID NO: 192019 - DNA, 20 bp, Mus musculus
ttacagagttaggtctaact

SEQ ID NO: 192020 - DNA, 22 bp, Mus musculus
tgttttgtgaccaattatatgg

SEQ ID NO: 192021 - DNA, 21 bp, Mus musculus
ttagaagttgatattgcatct

SEQ ID NO: 192022 - DNA, 22 bp, Mus musculus
tgttttgtgaccaattatatgg

SEQ ID NO: 192023 - DNA, 23 bp, Mus musculus
actacatctacattgtgtgttgg

SEQ ID NO: 192024 - DNA, 18 bp, Mus musculus
tttaatgtatacatgtga

SEQ ID NO: 192025 - DNA, 18 bp, Mus musculus
tatgcatatgtataaatg

SEQ ID NO: 192026 - DNA, 23 bp, Mus musculus
ttagacagaagacagacaggtct

SEQ ID NO: 192027 - DNA, 22 bp, Mus musculus
atgttagtcatctactactagg

SEQ ID NO: 192028 - DNA, 19 bp, Mus musculus
gtaagaagaagcaaaggag

SEQ ID NO: 192029 - DNA, 23 bp, Mus musculus
ttctgcttactctcttgctctct

SEQ ID NO: 192030 - DNA, 22 bp, Mus musculus
tagtagtaatggaggataggga

SEQ ID NO: 192031 - DNA, 22 bp, Mus musculus
tctgtatccaactgagttgttg

SEQ ID NO: 192032 - DNA, 23 bp, Mus musculus
tagtgcatggtgatctgatagga

SEQ ID NO: 192033 - DNA, 22 bp, Mus musculus
tgttttgtgacctattatgtgg

SEQ ID NO: 192034 - DNA, 23 bp, Mus musculus
agtcagagatgagacaaggatgt

SEQ ID NO: 192035 - DNA, 23 bp, Mus musculus
attattgtgcttgaagtggtact

SEQ ID NO: 192036 - DNA, 23 bp, Mus musculus
ttggaagctgatcatgggaatga

SEQ ID NO: 192037 - DNA, 23 bp, Mus musculus
catcacacttccaaattttgtct

SEQ ID NO: 192038 - DNA, 21 bp, Mus musculus
aatgtatgtatatatgtgtgt

SEQ ID NO: 192039 - DNA, 23 bp, Mus musculus
aacagttattcatgatgaggtag

SEQ ID NO: 192040 - DNA, 22 bp, Mus musculus
tgttttgtgaccaattatatgg

SEQ ID NO: 192041 - DNA, 21 bp, Mus musculus
acatatgagtgcatttgaaga

SEQ ID NO: 192042 - DNA, 22 bp, Mus musculus
tgttttgtgaccaattatatgg

SEQ ID NO: 192043 - DNA, 23 bp, Mus musculus
atcacagatgttagaaagcactt

SEQ ID NO: 192044 - DNA, 23 bp, Mus musculus
atgtatgaatgtatgtatgtatg

SEQ ID NO: 192045 - DNA, 20 bp, Mus musculus
tatgcatttaagtatgtatg

SEQ ID NO: 192046 - DNA, 22 bp, Mus musculus
tgttttgtgaccaattatatgg

SEQ ID NO: 192047 - DNA, 21 bp, Mus musculus
tgtgcatgtgtatgtgtgtgt

SEQ ID NO: 192048 - DNA, 21 bp, Mus musculus
cctgagttcaattccagcagc

SEQ ID NO: 192049 - DNA, 23 bp, Mus musculus
acagtacagtgtgagcattgaca

SEQ ID NO: 192050 - DNA, 23 bp, Mus musculus
tctgtctctgactctttcagctg

SEQ ID NO: 192051 - DNA, 23 bp, Mus musculus
atgctcaagccagacccactgtc

SEQ ID NO: 192052 - DNA, 22 bp, Mus musculus
tgttttgtgaccaattatatgg

SEQ ID NO: 192053 - DNA, 22 bp, Mus musculus
cattcttctctggctgctgcag

SEQ ID NO: 192054 - DNA, 23 bp, Mus musculus
ctgtgaaatctctttggctggca

SEQ ID NO: 192055 - DNA, 20 bp, Mus musculus
tttgtgaatgtatatgtgtg

SEQ ID NO: 192056 - DNA, 23 bp, Mus musculus
tatatgcatgtgaacatgtgtgt

SEQ ID NO: 192057 - DNA, 23 bp, Mus musculus
agaaaatctcggactttttattg

SEQ ID NO: 192058 - DNA, 20 bp, Mus musculus
gtctctcctgtgagtcctga

SEQ ID NO: 192059 - DNA, 22 bp, Mus musculus
tgttttgtgaccaattatatgg

SEQ ID NO: 192060 - DNA, 22 bp, Mus musculus
tatatttccatatgtgtatgtt

SEQ ID NO: 192061 - DNA, 23 bp, Mus musculus
agtcactggctgcctctcacact

SEQ ID NO: 192062 - DNA, 23 bp, Mus musculus
gacaggcaatgttttgtctgcat

SEQ ID NO: 192063 - DNA, 23 bp, Mus musculus
acatgagacagtgaacacatgca

SEQ ID NO: 192064 - DNA, 23 bp, Mus musculus
caagtgagcatgtggttttgaga

SEQ ID NO: 192065 - DNA, 23 bp, Mus musculus
ttagtgcatggtgatctgatagg

SEQ ID NO: 192066 - DNA, 23 bp, Mus musculus
tagtccatggtgatctgatagga

SEQ ID NO: 192067 - DNA, 23 bp, Mus musculus
ttgttctgtgaccaattatgtgg

SEQ ID NO: 192068 - DNA, 23 bp, Mus musculus
cactgtacctctctgtctcctga

SEQ ID NO: 192069 - DNA, 19 bp, Mus musculus
ttctgagggagaaaggaag

SEQ ID NO: 192070 - DNA, 22 bp, Mus musculus
tgttttgtgaccaattatatgg

SEQ ID NO: 192071 - DNA, 21 bp, Mus musculus
tccatggtggtctgataggat

SEQ ID NO: 192072 - DNA, 22 bp, Mus musculus
tgttttgtgaccaattatatgg

SEQ ID NO: 192073 - DNA, 22 bp, Mus musculus
tatgcatgtatgtatgtattta

SEQ ID NO: 192074 - DNA, 19 bp, Mus musculus
agagctagcatgtatacat

SEQ ID NO: 192075 - DNA, 21 bp, Mus musculus
ttggtgctgactaacatatgc

SEQ ID NO: 192076 - DNA, 22 bp, Mus musculus
attaattcagtggaaatgatgt

SEQ ID NO: 192077 - DNA, 21 bp, Mus musculus
tagctagaaccacacagtgag

SEQ ID NO: 192078 - DNA, 23 bp, Mus musculus
tctctgccacactctctgtgtta

SEQ ID NO: 192079 - DNA, 23 bp, Mus musculus
gggctgtctctgactctgttgcc

SEQ ID NO: 192080 - DNA, 23 bp, Mus musculus
gctctctcagactaacagtcact

SEQ ID NO: 192081 - DNA, 21 bp, Mus musculus
ttttcagaacatagtgaggac

SEQ ID NO: 192082 - DNA, 19 bp, Mus musculus
atatcagctgtgtgtggtg

SEQ ID NO: 192083 - DNA, 21 bp, Mus musculus
tgttttgtgaccaattatatg

SEQ ID NO: 192084 - DNA, 21 bp, Mus musculus
tgtgtcgctccctgattggct

SEQ ID NO: 192085 - DNA, 23 bp, Mus musculus
atgtatgtggatatgtatctatg

SEQ ID NO: 192086 - DNA, 22 bp, Mus musculus
ttcttcattacatatgatctaa

SEQ ID NO: 192087 - DNA, 23 bp, Mus musculus
agatacacatgtgatgttgtagt

SEQ ID NO: 192088 - DNA, 23 bp, Mus musculus
tgacaccaacttcctgtgtgtga

SEQ ID NO: 192089 - DNA, 23 bp, Mus musculus
tgtctctgtctgtctgtctgtct

SEQ ID NO: 192090 - DNA, 23 bp, Mus musculus
tgtgtgtgtgtgtgtgtgtacat

SEQ ID NO: 192091 - DNA, 23 bp, Mus musculus
agagtgcatgtacatgtgcatgt

SEQ ID NO: 192092 - DNA, 23 bp, Mus musculus
actgtgtgtgtgcatgtgcatgt

SEQ ID NO: 192093 - DNA, 23 bp, Mus musculus
atgtatgtacatatggatatgta

SEQ ID NO: 192094 - DNA, 23 bp, Mus musculus
gcatacatacaagtgtacacatg

SEQ ID NO: 192095 - DNA, 23 bp, Mus musculus
tgcctgcctgcctgcctgtctgt

SEQ ID NO: 192096 - DNA, 23 bp, Mus musculus
tgtgtgtgcatgtctatgtgcat

SEQ ID NO: 192097 - DNA, 23 bp, Mus musculus
ggatctgagttcaaatcttagca

SEQ ID NO: 192098 - DNA, 23 bp, Mus musculus
ctacagtgaatatatatttgtct

SEQ ID NO: 192099 - DNA, 23 bp, Mus musculus
taaatgagttctcactatgtagt

SEQ ID NO: 192100 - DNA, 23 bp, Mus musculus
tattttgtatctatatctataga

SEQ ID NO: 192101 - DNA, 22 bp, Mus musculus
acagtgagaccatcacttctga

SEQ ID NO: 192102 - DNA, 20 bp, Mus musculus
agtgcagatctgtgcgtgcc

SEQ ID NO: 192103 - DNA, 23 bp, Mus musculus
atgctgccacagtctgtttctgt

SEQ ID NO: 192104 - DNA, 20 bp, Mus musculus
aatgtgtatatatgtgtgtg

SEQ ID NO: 192105 - DNA, 20 bp, Mus musculus
atgtatgtatgcatatgtgt

SEQ ID NO: 192106 - DNA, 23 bp, Mus musculus
tgtgcatgcatgtgtgtgtgtgt

SEQ ID NO: 192107 - DNA, 23 bp, Mus musculus
ttgcctctgtgtatgtctgtgaa

SEQ ID NO: 192108 - DNA, 23 bp, Mus musculus
gtatcacatcacctggaactgga

SEQ ID NO: 192109 - DNA, 19 bp, Mus musculus
atgtatgtacgtatgtatg

SEQ ID NO: 192110 - DNA, 23 bp, Mus musculus
tgtatgtacatatgtatgtatat

SEQ ID NO: 192111 - DNA, 19 bp, Mus musculus
ggttgatgttagatgtctc

SEQ ID NO: 192112 - DNA, 23 bp, Mus musculus
agtctctcacagaatctggagtt

SEQ ID NO: 192113 - DNA, 23 bp, Mus musculus
cagcctctctctggctctgagtc

SEQ ID NO: 192114 - DNA, 20 bp, Mus musculus
cagaggggttaggttctctg

SEQ ID NO: 192115 - DNA, 23 bp, Mus musculus
ctgtctgtctgtctgtgtatcac

SEQ ID NO: 192116 - DNA, 23 bp, Mus musculus
gaggctgagagagacataagagt

SEQ ID NO: 192117 - DNA, 23 bp, Mus musculus
tgcatgtgtgcatctatgtgtct

SEQ ID NO: 192118 - DNA, 20 bp, Mus musculus
atgtatgtatgtatgtgtgt

SEQ ID NO: 192119 - DNA, 23 bp, Mus musculus
atatgtgtatatatatgtatgtg

SEQ ID NO: 192120 - DNA, 21 bp, Mus musculus
cactcctaaactttgttgtct

SEQ ID NO: 192121 - DNA, 23 bp, Mus musculus
ttttcatggtttagtgatggggt

SEQ ID NO: 192122 - DNA, 22 bp, Mus musculus
tgcatgtgcatgtgcatgtgtg

SEQ ID NO: 192123 - DNA, 23 bp, Mus musculus
gtgtgcctgtgtgtgtgcgtgtg

SEQ ID NO: 192124 - DNA, 21 bp, Mus musculus
tggcagtgaggcaaatgcgtg

SEQ ID NO: 192125 - DNA, 20 bp, Mus musculus
tgatcacacagtatggccat

SEQ ID NO: 192126 - DNA, 21 bp, Mus musculus
acatgtccattctctgtgtct

SEQ ID NO: 192127 - DNA, 22 bp, Mus musculus
tgttttgtgaccaattatatgg

SEQ ID NO: 192128 - DNA, 23 bp, Mus musculus
tttctcagccctagacttgactg

SEQ ID NO: 192129 - DNA, 23 bp, Mus musculus
ttagtctgtggtgatctgatagg

SEQ ID NO: 192130 - DNA, 20 bp, Mus musculus
ttttgtgaccgattatatgg

SEQ ID NO: 192131 - DNA, 22 bp, Mus musculus
tgtgtgtatatatatatgtgtg

SEQ ID NO: 192132 - DNA, 23 bp, Mus musculus
gtgagttatgtttgaaaatgtta

SEQ ID NO: 192133 - DNA, 23 bp, Mus musculus
tattgcagttcagacagtgtcat

SEQ ID NO: 192134 - DNA, 23 bp, Mus musculus
acaattttaagccattctgtgga

SEQ ID NO: 192135 - DNA, 23 bp, Mus musculus
aatactccaagtcaatgagtgac

SEQ ID NO: 192136 - DNA, 20 bp, Mus musculus
tatgtatgtatgtatatgta

SEQ ID NO: 192137 - DNA, 23 bp, Mus musculus
gtgtgtgtgtctgtctgtcattc

SEQ ID NO: 192138 - DNA, 19 bp, Mus musculus
ctcacttactcactgggta

SEQ ID NO: 192139 - DNA, 23 bp, Mus musculus
tgtctgtctgtctgtctgtctgc

SEQ ID NO: 192140 - DNA, 22 bp, Mus musculus
tgttttgtgaccaattatatgg

SEQ ID NO: 192141 - DNA, 23 bp, Mus musculus
aaatgtttctatgtttttttgaa

SEQ ID NO: 192142 - DNA, 23 bp, Mus musculus
taaaagaggattgagaaagtgat

SEQ ID NO: 192143 - DNA, 22 bp, Mus musculus
tgttttgtgaccaattatatgg

SEQ ID NO: 192144 - DNA, 18 bp, Mus musculus
agcaagcagtgaagtttg

SEQ ID NO: 192145 - DNA, 22 bp, Mus musculus
tgttttgtgaccaattatatgg

SEQ ID NO: 192146 - DNA, 23 bp, Mus musculus
acatatgtgtgtatgtatatgta

SEQ ID NO: 192147 - DNA, 23 bp, Mus musculus
aagagttcagagtttcttgttgg

SEQ ID NO: 192148 - DNA, 21 bp, Mus musculus
tcatgtgagggtatgaacctg

SEQ ID NO: 192149 - DNA, 23 bp, Mus musculus
gaaaaagcatatgtattgtatac

SEQ ID NO: 192150 - DNA, 18 bp, Mus musculus
tatgtgcataagcatatg

SEQ ID NO: 192151 - DNA, 23 bp, Mus musculus
ttcagagaggcagagaagctgct

SEQ ID NO: 192152 - DNA, 18 bp, Mus musculus
acagagggaaatatgttg

SEQ ID NO: 192153 - DNA, 23 bp, Mus musculus
catatgtgtatgtatatatgtgt

SEQ ID NO: 192154 - DNA, 23 bp, Mus musculus
atggtggtctgataggattcact

SEQ ID NO: 192155 - DNA, 22 bp, Mus musculus
tgttttgtgaccaattatatgg

SEQ ID NO: 192156 - DNA, 22 bp, Mus musculus
tgttttgtgaccaattatatgg

SEQ ID NO: 192157 - DNA, 23 bp, Mus musculus
ttaatccttggtaatatatacat

SEQ ID NO: 192158 - DNA, 23 bp, Mus musculus
agtcagagccagaactgagttct

SEQ ID NO: 192159 - DNA, 23 bp, Mus musculus
aaagaatatgtatatgtatacat

SEQ ID NO: 192160 - DNA, 23 bp, Mus musculus
gttttctttgcaaatgtagctct

SEQ ID NO: 192161 - DNA, 23 bp, Mus musculus
gcaatgagagaagtgagtgcgga

SEQ ID NO: 192162 - DNA, 23 bp, Mus musculus
tgttcttgagtaagagtgacaga

SEQ ID NO: 192163 - DNA, 21 bp, Mus musculus
tctctcactcaggaaaagaag

SEQ ID NO: 192164 - DNA, 21 bp, Mus musculus
cacaggtatgtatcacttccc

SEQ ID NO: 192165 - DNA, 23 bp, Mus musculus
tcactctctctgaaactggtcag

SEQ ID NO: 192166 - DNA, 23 bp, Mus musculus
ctcccactctcagggtatctgtc

SEQ ID NO: 192167 - DNA, 23 bp, Mus musculus
aactgtctgaagagagagaggag

SEQ ID NO: 192168 - DNA, 21 bp, Mus musculus
tgaggtagtatgtatgtatgt

SEQ ID NO: 192169 - DNA, 23 bp, Mus musculus
tatgtatgtatgtatgtgtgtgt

SEQ ID NO: 192170 - DNA, 23 bp, Mus musculus
gtatgcatatatatgcatttgtg

SEQ ID NO: 192171 - DNA, 19 bp, Mus musculus
agaggtactaagttcaatt

SEQ ID NO: 192172 - DNA, 23 bp, Mus musculus
ttcagtatatattaagctcttgt

SEQ ID NO: 192173 - DNA, 23 bp, Mus musculus
tgggactgctattaggttctttt

SEQ ID NO: 192174 - DNA, 23 bp, Mus musculus
gaagagagaacatgttgagcaga

SEQ ID NO: 192175 - DNA, 22 bp, Mus musculus
tgttttgtgaccaattatatgg

SEQ ID NO: 192176 - DNA, 21 bp, Mus musculus
aatgggttctttacttggctt

SEQ ID NO: 192177 - DNA, 20 bp, Mus musculus
ttacactcagattccacacg

SEQ ID NO: 192178 - DNA, 23 bp, Mus musculus
tgtgtctcactgacagtgacagg

SEQ ID NO: 192179 - DNA, 23 bp, Mus musculus
gtatgtttgtatgtatgtatgta

SEQ ID NO: 192180 - DNA, 19 bp, Mus musculus
atatatgtgtatatgttca

SEQ ID NO: 192181 - DNA, 23 bp, Mus musculus
cagtctgtctgtctgtctatatg

SEQ ID NO: 192182 - DNA, 23 bp, Mus musculus
tttcagatgttttatatgtgtgt

SEQ ID NO: 192183 - DNA, 22 bp, Mus musculus
tatgcatcaacagtggtaagga

SEQ ID NO: 192184 - DNA, 23 bp, Mus musculus
tttgagcatcaagaatagtgtgt

SEQ ID NO: 192185 - DNA, 23 bp, Mus musculus
atcacacaacacagtgaccaatc

SEQ ID NO: 192186 - DNA, 23 bp, Mus musculus
ttgactgtggatgtgatgtgaat

SEQ ID NO: 192187 - DNA, 23 bp, Mus musculus
tgtatgtgtgcatgtgcatgtgc

SEQ ID NO: 192188 - DNA, 23 bp, Mus musculus
aaggctaattaatccataactta

SEQ ID NO: 192189 - DNA, 23 bp, Mus musculus
atctcagagcctcagttacagca

SEQ ID NO: 192190 - DNA, 23 bp, Mus musculus
tgtatgtttgtatgcatgtatat

SEQ ID NO: 192191 - DNA, 23 bp, Mus musculus
cactcacacacacactgtctcgc

SEQ ID NO: 192192 - DNA, 19 bp, Mus musculus
ggatgtatgtatgtatgta

SEQ ID NO: 192193 - DNA, 23 bp, Mus musculus
gtatatgtgtatgtgtacatgtg

SEQ ID NO: 192194 - DNA, 23 bp, Mus musculus
tgtacatgcatgtgtatgtgcat

SEQ ID NO: 192195 - DNA, 23 bp, Mus musculus
gtacatatgtatgggtgcttgtg

SEQ ID NO: 192196 - DNA, 23 bp, Mus musculus
tgtaagtatgtatgtatgtatgt

SEQ ID NO: 192197 - DNA, 21 bp, Mus musculus
ttcacagtggctttgaaggac

SEQ ID NO: 192198 - DNA, 23 bp, Mus musculus
ctccagtgcctcactgtgtctca

SEQ ID NO: 192199 - DNA, 19 bp, Mus musculus
tatgtgtgcctttatgtgt

SEQ ID NO: 192200 - DNA, 22 bp, Mus musculus
tgagtatctgcatctgtattgg

SEQ ID NO: 192201 - DNA, 23 bp, Mus musculus
tattgtgtgtatgtatatgtgtg

SEQ ID NO: 192202 - DNA, 23 bp, Mus musculus
ccactcttctgtgtgtctctgaa

SEQ ID NO: 192203 - DNA, 23 bp, Mus musculus
gaagaaggtgctcactgtcagtc

SEQ ID NO: 192204 - DNA, 22 bp, Mus musculus
ttgtttgttgaactagccaagg

SEQ ID NO: 192205 - DNA, 19 bp, Mus musculus
cttagtgaacacagcgagc

SEQ ID NO: 192206 - DNA, 22 bp, Mus musculus
aaggtagtctgagtgcatgcct

SEQ ID NO: 192207 - DNA, 23 bp, Mus musculus
tacaactctctctctctcttaat

SEQ ID NO: 192208 - DNA, 22 bp, Mus musculus
tgttttgtgaccaattatatgg

SEQ ID NO: 192209 - DNA, 19 bp, Mus musculus
tccagtgacccagttctat

SEQ ID NO: 192210 - DNA, 23 bp, Mus musculus
aggctctctgtctctatctgtct

SEQ ID NO: 192211 - DNA, 21 bp, Mus musculus
acagaatttgttgaggatgag

SEQ ID NO: 192212 - DNA, 23 bp, Mus musculus
actagaaccactatatcatttgt

SEQ ID NO: 192213 - DNA, 23 bp, Mus musculus
ctaaagtcactttgtagttgtga

SEQ ID NO: 192214 - DNA, 23 bp, Mus musculus
cagggtccctctgtgtgtccctg

SEQ ID NO: 192215 - DNA, 23 bp, Mus musculus
ccagcatgtgcctgtgtgcctgg

SEQ ID NO: 192216 - DNA, 20 bp, Mus musculus
ttctgtgtggctgacatcgg

SEQ ID NO: 192217 - DNA, 23 bp, Mus musculus
aggacagagagtattgagacagc

SEQ ID NO: 192218 - DNA, 23 bp, Mus musculus
tctctggctctctggctctctgt

SEQ ID NO: 192219 - DNA, 20 bp, Mus musculus
gacttcttcctcactgtctt

SEQ ID NO: 192220 - DNA, 22 bp, Mus musculus
tctctgcaagaccaagtgttct

SEQ ID NO: 192221 - DNA, 22 bp, Mus musculus
agaagtcttctcactggggctc

SEQ ID NO: 192222 - DNA, 22 bp, Mus musculus
tggctaagagtatttgttgttc

SEQ ID NO: 192223 - DNA, 20 bp, Mus musculus
tgtccagtctgagcacacag

SEQ ID NO: 192224 - DNA, 18 bp, Mus musculus
gggaatggtcttccagat

SEQ ID NO: 192225 - DNA, 22 bp, Mus musculus
tattcaccttactgtgctgtca

SEQ ID NO: 192226 - DNA, 23 bp, Mus musculus
agtggtcagaagtgagggaggag

SEQ ID NO: 192227 - DNA, 21 bp, Mus musculus
tcgctcgctcgctcgctcgga

SEQ ID NO: 192228 - DNA, 23 bp, Mus musculus
aaccccctctctgtctgtctcca

SEQ ID NO: 192229 - DNA, 18 bp, Mus musculus
atatgtatgtatatatgt

SEQ ID NO: 192230 - DNA, 22 bp, Mus musculus
tatgtgtgtatatatatgtgtg

SEQ ID NO: 192231 - DNA, 23 bp, Mus musculus
tctcccagtccctcactgcctct

SEQ ID NO: 192232 - DNA, 21 bp, Mus musculus
agccaccctgatgaacaagag

SEQ ID NO: 192233 - DNA, 23 bp, Mus musculus
tgtgtgtacatcgctgagtgtgc

SEQ ID NO: 192234 - DNA, 20 bp, Mus musculus
aactgagtcactgtgatagc

SEQ ID NO: 192235 - DNA, 23 bp, Mus musculus
tctctgtgtctctgtctgcctgc

SEQ ID NO: 192236 - DNA, 22 bp, Mus musculus
tgtgtgcttgagttgtgtgtgt

SEQ ID NO: 192237 - DNA, 23 bp, Mus musculus
gtgtgtgggtgtgggagtcctgt

SEQ ID NO: 192238 - DNA, 23 bp, Mus musculus
tctctctctctctgctaaggaca

SEQ ID NO: 192239 - DNA, 19 bp, Mus musculus
tgcatgtatgtatatatgt

SEQ ID NO: 192240 - DNA, 19 bp, Mus musculus
atgtatgcatgcatgtatg

SEQ ID NO: 192241 - DNA, 22 bp, Mus musculus
tctgtgtatctctgtgtgtgtg

SEQ ID NO: 192242 - DNA, 23 bp, Mus musculus
tctctctcacactgggactgcca

SEQ ID NO: 192243 - DNA, 22 bp, Mus musculus
agtgtccctgcctctctggttc

SEQ ID NO: 192244 - DNA, 23 bp, Mus musculus
aaagatctccaagtccttttcct

SEQ ID NO: 192245 - DNA, 20 bp, Mus musculus
tgagagaacagacactgcag

SEQ ID NO: 192246 - DNA, 23 bp, Mus musculus
gtgccctctgtctctcagccact

SEQ ID NO: 192247 - DNA, 20 bp, Mus musculus
tgtcaccccaagaaaagttc

SEQ ID NO: 192248 - DNA, 23 bp, Mus musculus
tcagtctgtttctgtcactgggc

SEQ ID NO: 192249 - DNA, 23 bp, Mus musculus
cagcactgaaatgagtgtccaga

SEQ ID NO: 192250 - DNA, 23 bp, Mus musculus
accttaatcaatctcttatgtga

SEQ ID NO: 192251 - DNA, 21 bp, Mus musculus
tgctttcttaagaagaatgtt

SEQ ID NO: 192252 - DNA, 23 bp, Mus musculus
taacttcactcagtgagtcagca

SEQ ID NO: 192253 - DNA, 20 bp, Mus musculus
tatttctatataaaagctgt

SEQ ID NO: 192254 - DNA, 22 bp, Mus musculus
actatgtatgtgtatatgtgta

SEQ ID NO: 192255 - DNA, 22 bp, Mus musculus
atatatacacatatacatatgt

SEQ ID NO: 192256 - DNA, 23 bp, Mus musculus
gatctgactccctattcttggct

SEQ ID NO: 192257 - DNA, 20 bp, Mus musculus
tggcagacaagaaagctggt

SEQ ID NO: 192258 - DNA, 19 bp, Mus musculus
tttggtctggttttggttt

SEQ ID NO: 192259 - DNA, 18 bp, Mus musculus
catctctcctattggtga

SEQ ID NO: 192260 - DNA, 22 bp, Mus musculus
ccagagaagagacttagctgag

SEQ ID NO: 192261 - DNA, 20 bp, Mus musculus
ctgcctggtctacaagcagt

SEQ ID NO: 192262 - DNA, 20 bp, Mus musculus
tgtatgtatgtatgtatgta

SEQ ID NO: 192263 - DNA, 18 bp, Mus musculus
tgcatgcatgcatgtatg

SEQ ID NO: 192264 - DNA, 23 bp, Mus musculus
attctcctgcttcagcttcactg

SEQ ID NO: 192265 - DNA, 23 bp, Mus musculus
gtatgtgtgtgtttatgtctgtg

SEQ ID NO: 192266 - DNA, 23 bp, Mus musculus
ggatgtgtctgtattgcctgtgt

SEQ ID NO: 192267 - DNA, 22 bp, Mus musculus
atgtttgtatgcatgtgtgtgt

SEQ ID NO: 192268 - DNA, 23 bp, Mus musculus
gaagcagggcatcttgtaggtca

SEQ ID NO: 192269 - DNA, 20 bp, Mus musculus
ggacactggtggagctgcag

SEQ ID NO: 192270 - DNA, 21 bp, Mus musculus
agacagagcattgggtatgga

SEQ ID NO: 192271 - DNA, 21 bp, Mus musculus
tctccacttctgtctctctgt

SEQ ID NO: 192272 - DNA, 23 bp, Mus musculus
aatgctgactgctcttccagagg

SEQ ID NO: 192273 - DNA, 22 bp, Mus musculus
gctatggtacatctcacggtgt

SEQ ID NO: 192274 - DNA, 18 bp, Mus musculus
tcccagcaaccatctgtg

SEQ ID NO: 192275 - DNA, 23 bp, Mus musculus
tatctctgtgtgtatgtggtgtg

SEQ ID NO: 192276 - DNA, 22 bp, Mus musculus
agacacacagggaaagaagtaa

SEQ ID NO: 192277 - DNA, 23 bp, Mus musculus
cacagagcagtctctctctctga

SEQ ID NO: 192278 - DNA, 22 bp, Mus musculus
ttagacgctgttagagttgtgt

SEQ ID NO: 192279 - DNA, 22 bp, Mus musculus
aaggttcttgattcagtagaga

SEQ ID NO: 192280 - DNA, 21 bp, Mus musculus
actcacacactctatgtagcc

SEQ ID NO: 192281 - DNA, 20 bp, Mus musculus
agctcatagctttgactgtg

SEQ ID NO: 192282 - DNA, 23 bp, Mus musculus
tcagtcggtctgtctctgtatct

SEQ ID NO: 192283 - DNA, 19 bp, Mus musculus
tgatgttggtgtgttgaga

SEQ ID NO: 192284 - DNA, 23 bp, Mus musculus
gaaactgggagacgatcagctca

SEQ ID NO: 192285 - DNA, 23 bp, Mus musculus
tctggtcactcactgtcagctca

SEQ ID NO: 192286 - DNA, 22 bp, Mus musculus
tggctgggagaaaaagtagaca

SEQ ID NO: 192287 - DNA, 18 bp, Mus musculus
tgagttcactgtagctgt

SEQ ID NO: 192288 - DNA, 23 bp, Mus musculus
tcactggctcagatcagaaggaa

SEQ ID NO: 192289 - DNA, 23 bp, Mus musculus
gccctcactctgacactgacatc

SEQ ID NO: 192290 - DNA, 23 bp, Mus musculus
agtcagagaaggctgtgtctggc

SEQ ID NO: 192291 - DNA, 22 bp, Mus musculus
tgtctgcctgagtcactgcttc

SEQ ID NO: 192292 - DNA, 23 bp, Mus musculus
tctctgtcactgagtctttccag

SEQ ID NO: 192293 - DNA, 23 bp, Mus musculus
gtctgtgtgtgtgtcagtgtcta

SEQ ID NO: 192294 - DNA, 19 bp, Mus musculus
tctgcgactcataggggtt

SEQ ID NO: 192295 - DNA, 23 bp, Mus musculus
aatgctgcttcaagtagggaatt

SEQ ID NO: 192296 - DNA, 22 bp, Mus musculus
tccctgtgtgctagaaagaaat

SEQ ID NO: 192297 - DNA, 22 bp, Mus musculus
aggcagagtcttactctataac

SEQ ID NO: 192298 - DNA, 22 bp, Mus musculus
ctgtctgtggctctgtgcctgt

SEQ ID NO: 192299 - DNA, 23 bp, Mus musculus
tctctgtcagcctgtggatcagc

SEQ ID NO: 192300 - DNA, 23 bp, Mus musculus
agaattgttgctgaggggctgga

SEQ ID NO: 192301 - DNA, 23 bp, Mus musculus
cagtaagtagttttgttttctgg

SEQ ID NO: 192302 - DNA, 20 bp, Mus musculus
tacactactgttactgttgt

SEQ ID NO: 192303 - DNA, 21 bp, Mus musculus
tgtgtgtctgtctgtctgtgt

SEQ ID NO: 192304 - DNA, 23 bp, Mus musculus
tctctgtgactctgtgcctcctt

SEQ ID NO: 192305 - DNA, 23 bp, Mus musculus
ctatctctgtcagcatgtgtctc

SEQ ID NO: 192306 - DNA, 23 bp, Mus musculus
acattgaagactctggcaaagct

SEQ ID NO: 192307 - DNA, 22 bp, Mus musculus
tcaagatctagtggggctgcag

SEQ ID NO: 192308 - DNA, 21 bp, Mus musculus
tgcatgcatgtatgtatgtgc

SEQ ID NO: 192309 - DNA, 18 bp, Mus musculus
tatgtatgtgcataggca

SEQ ID NO: 192310 - DNA, 23 bp, Mus musculus
gtctgtctctgccactgacttcc

SEQ ID NO: 192311 - DNA, 22 bp, Mus musculus
gacaccctgtctgaggagcttc

SEQ ID NO: 192312 - DNA, 20 bp, Mus musculus
atgtcactctcggtgtctct

SEQ ID NO: 192313 - DNA, 18 bp, Mus musculus
gaatatatatatgtgtgt

SEQ ID NO: 192314 - DNA, 23 bp, Mus musculus
agttatgtatacaggtatatgtg

SEQ ID NO: 192315 - DNA, 19 bp, Mus musculus
actctctttctctgagcaa

SEQ ID NO: 192316 - DNA, 23 bp, Mus musculus
tgtaaactactaagttcttggct

SEQ ID NO: 192317 - DNA, 22 bp, Mus musculus
tgttttgtgaccaattatatgg

SEQ ID NO: 192318 - DNA, 22 bp, Mus musculus
tgttttgtgaccaattatatgg

SEQ ID NO: 192319 - DNA, 22 bp, Mus musculus
tgttttgtgaccaattatatgg

SEQ ID NO: 192320 - DNA, 22 bp, Mus musculus
tgttttgtgaccaattatatgg

SEQ ID NO: 192321 - DNA, 22 bp, Mus musculus
tcagatgacctggtgatgtcaa

SEQ ID NO: 192322 - DNA, 18 bp, Mus musculus
tctctgcttcaatgtatg

SEQ ID NO: 192323 - DNA, 23 bp, Mus musculus
cctggcagtctcagtctttctgt

SEQ ID NO: 192324 - DNA, 19 bp, Mus musculus
ttgggtagctgtgagccat

SEQ ID NO: 192325 - DNA, 23 bp, Mus musculus
ttgcagtctgattcctccctgtc

SEQ ID NO: 192326 - DNA, 23 bp, Mus musculus
gcagtctgtgggtctgtcacttc

SEQ ID NO: 192327 - DNA, 23 bp, Mus musculus
atgtgtgtgtgtatgcacatgtg

SEQ ID NO: 192328 - DNA, 23 bp, Mus musculus
tctctggctctctcactgtgggg

SEQ ID NO: 192329 - DNA, 21 bp, Mus musculus
aggaatagcaaagccaatgta

SEQ ID NO: 192330 - DNA, 22 bp, Mus musculus
ttgcacagtggtgagttggctc

SEQ ID NO: 192331 - DNA, 22 bp, Mus musculus
atatgcatatgtatacgtctgt

SEQ ID NO: 192332 - DNA, 23 bp, Mus musculus
tgtatctatcgatgtatctgtgt

SEQ ID NO: 192333 - DNA, 21 bp, Mus musculus
atgagacttgagaggctgcac

SEQ ID NO: 192334 - DNA, 23 bp, Mus musculus
gtctgtctcagtgactgtgagct

SEQ ID NO: 192335 - DNA, 23 bp, Mus musculus
cccactcagactcaaaactgtta

SEQ ID NO: 192336 - DNA, 20 bp, Mus musculus
caggggctggaaagatggtg

SEQ ID NO: 192337 - DNA, 23 bp, Mus musculus
gagtactgactgctcttccagag

SEQ ID NO: 192338 - DNA, 23 bp, Mus musculus
cccactgtcactctctcttcctg

SEQ ID NO: 192339 - DNA, 23 bp, Mus musculus
gcctctctctctctgcttgtgca

SEQ ID NO: 192340 - DNA, 19 bp, Mus musculus
tcagtttttgtctttttca

SEQ ID NO: 192341 - DNA, 23 bp, Mus musculus
agctcctgcttctcctggatatg

SEQ ID NO: 192342 - DNA, 19 bp, Mus musculus
ctctgagcctcagttctgt

SEQ ID NO: 192343 - DNA, 23 bp, Mus musculus
ctctctgagtctctgagctgttt

SEQ ID NO: 192344 - DNA, 20 bp, Mus musculus
tgtgttagtctgtcactcag

SEQ ID NO: 192345 - DNA, 23 bp, Mus musculus
ctgagagactgatgtgagagggc

SEQ ID NO: 192346 - DNA, 21 bp, Mus musculus
taaacaggtgctcagtttgtg

SEQ ID NO: 192347 - DNA, 23 bp, Mus musculus
tgctcactgctctaccagagaat

SEQ ID NO: 192348 - DNA, 19 bp, Mus musculus
tatgagtgccagcaagcca

SEQ ID NO: 192349 - DNA, 23 bp, Mus musculus
tcttatctgtctgaggcaagctg

SEQ ID NO: 192350 - DNA, 23 bp, Mus musculus
tctctgtgtgtgcctctgtgtgt

SEQ ID NO: 192351 - DNA, 19 bp, Mus musculus
tcactctgtctctttcttg

SEQ ID NO: 192352 - DNA, 20 bp, Mus musculus
ctcaccctctttcactcaga

SEQ ID NO: 192353 - DNA, 23 bp, Mus musculus
tgagaagatgtggggaaaggcat

SEQ ID NO: 192354 - DNA, 23 bp, Mus musculus
tgagtcagtgagtctgtgggagt

SEQ ID NO: 192355 - DNA, 21 bp, Mus musculus
tatgactgactcaggatcggc

SEQ ID NO: 192356 - DNA, 23 bp, Mus musculus
atttatgtatgtaagtacactgt

SEQ ID NO: 192357 - DNA, 20 bp, Mus musculus
tgtgtgtatatatatgtgtg

SEQ ID NO: 192358 - DNA, 22 bp, Mus musculus
tgttttgtgaccaattatatgg

SEQ ID NO: 192359 - DNA, 22 bp, Mus musculus
tgttttgtgaccaattatatgg

SEQ ID NO: 192360 - DNA, 21 bp, Mus musculus
tgtgcatttatatttatgtgt

SEQ ID NO: 192361 - DNA, 22 bp, Mus musculus
agacttaagagacagtgcataa

SEQ ID NO: 192362 - DNA, 23 bp, Mus musculus
tgtatgcatgtatgtatgtatgt

SEQ ID NO: 192363 - DNA, 23 bp, Mus musculus
ggacacagtcaagtcagagagca

SEQ ID NO: 192364 - DNA, 23 bp, Mus musculus
gttagtgcttcctgtttcctgaa

SEQ ID NO: 192365 - DNA, 23 bp, Mus musculus
ctttcttcagtcagcatgtgtag

SEQ ID NO: 192366 - DNA, 23 bp, Mus musculus
gagcatcactgaagacagtttgc

SEQ ID NO: 192367 - DNA, 23 bp, Mus musculus
aacagtagtgtggaaagtgtaag

SEQ ID NO: 192368 - DNA, 23 bp, Mus musculus
tgcagtgcaaggaagagtgtgct

SEQ ID NO: 192369 - DNA, 19 bp, Mus musculus
tgtgcgtgtgtgcgtgcat

SEQ ID NO: 192370 - DNA, 23 bp, Mus musculus
atatgtgtgtgtgtgtacatgta

SEQ ID NO: 192371 - DNA, 20 bp, Mus musculus
aagctctctggctttctagt

SEQ ID NO: 192372 - DNA, 18 bp, Mus musculus
acagtaactcagtcactg

SEQ ID NO: 192373 - DNA, 22 bp, Mus musculus
aaagtgcttttgagttgtgatt

SEQ ID NO: 192374 - DNA, 21 bp, Mus musculus
tatgcatacgatatatataca

SEQ ID NO: 192375 - DNA, 22 bp, Mus musculus
tatgtgtatctatattttagtg

SEQ ID NO: 192376 - DNA, 23 bp, Mus musculus
tgtatggatatatgtgtgtatgt

SEQ ID NO: 192377 - DNA, 22 bp, Mus musculus
ttatgtatgtatgtatgtatgt

SEQ ID NO: 192378 - DNA, 23 bp, Mus musculus
caacagtgttgagactttgagtt

SEQ ID NO: 192379 - DNA, 22 bp, Mus musculus
tttagaactagtaagcgacttt

SEQ ID NO: 192380 - DNA, 20 bp, Mus musculus
attggatgtcaaacttcatg

SEQ ID NO: 192381 - DNA, 22 bp, Mus musculus
gacagtcattttctgtctccca

SEQ ID NO: 192382 - DNA, 22 bp, Mus musculus
atgtaagaacacagccagcaga

SEQ ID NO: 192383 - DNA, 19 bp, Mus musculus
atatgtattggggctggag

SEQ ID NO: 192384 - DNA, 22 bp, Mus musculus
ctgtccgtgtcactggctcaca

SEQ ID NO: 192385 - DNA, 23 bp, Mus musculus
tttactgcatcatgtttacatat

SEQ ID NO: 192386 - DNA, 20 bp, Mus musculus
tcaccatcagtgtaagatga

SEQ ID NO: 192387 - DNA, 23 bp, Mus musculus
tgtgagtctctgggtctcaacct

SEQ ID NO: 192388 - DNA, 19 bp, Mus musculus
gtgacaagagagtgaacac

SEQ ID NO: 192389 - DNA, 23 bp, Mus musculus
ctgtctgtctgtctgtctgtaga

SEQ ID NO: 192390 - DNA, 23 bp, Mus musculus
gctttcagagagtactgataagg

SEQ ID NO: 192391 - DNA, 22 bp, Mus musculus
ctgagaacagacagtgctcact

SEQ ID NO: 192392 - DNA, 23 bp, Mus musculus
ctggccttgaacttgctgtgtag

SEQ ID NO: 192393 - DNA, 20 bp, Mus musculus
acatggtcggactctttggg

SEQ ID NO: 192394 - DNA, 23 bp, Mus musculus
atgtatgtatgtatgtatgtatg

SEQ ID NO: 192395 - DNA, 23 bp, Mus musculus
atgactgtatatacgtatgtatg

SEQ ID NO: 192396 - DNA, 23 bp, Mus musculus
gtttatgatgtagatgtggtcac

SEQ ID NO: 192397 - DNA, 23 bp, Mus musculus
tgatgattgtcagctatcgttgg

SEQ ID NO: 192398 - DNA, 23 bp, Mus musculus
agtcttcatgcttttgtctgtct

SEQ ID NO: 192399 - DNA, 18 bp, Mus musculus
attctgagtgacatacat

SEQ ID NO: 192400 - DNA, 23 bp, Mus musculus
tgtctcggagactgagtcgattc

SEQ ID NO: 192401 - DNA, 23 bp, Mus musculus
agtatttaagatacactgaaatg

SEQ ID NO: 192402 - DNA, 23 bp, Mus musculus
gttcacagtgtagtgtgaggaca

SEQ ID NO: 192403 - DNA, 19 bp, Mus musculus
cgctgtgctccaggaactg

SEQ ID NO: 192404 - DNA, 18 bp, Mus musculus
tcagttgaggttcgctct

SEQ ID NO: 192405 - DNA, 23 bp, Mus musculus
gtctgtctgcctgtctgtctgtg

SEQ ID NO: 192406 - DNA, 23 bp, Mus musculus
ctgactttggactcactggtgcc

SEQ ID NO: 192407 - DNA, 23 bp, Mus musculus
tgtgtatacacacacacacacat

SEQ ID NO: 192408 - DNA, 23 bp, Mus musculus
agctgcagagtctctgagaatct

SEQ ID NO: 192409 - DNA, 22 bp, Mus musculus
atgcatgctatatattgtgtat

SEQ ID NO: 192410 - DNA, 23 bp, Mus musculus
tatacacatatattatatgtgtg

SEQ ID NO: 192411 - DNA, 22 bp, Mus musculus
tgttttgtgaccaattatatgg

SEQ ID NO: 192412 - DNA, 23 bp, Mus musculus
acacacagaatttcatgtgcatt

SEQ ID NO: 192413 - DNA, 18 bp, Mus musculus
tctgtgtctgtatatctt

SEQ ID NO: 192414 - DNA, 23 bp, Mus musculus
tatgtgtgggatacttagagcct

SEQ ID NO: 192415 - DNA, 22 bp, Mus musculus
atctcttatctgcactttggtt

SEQ ID NO: 192416 - DNA, 23 bp, Mus musculus
ttctgactcatattgttgttctg

SEQ ID NO: 192417 - DNA, 23 bp, Mus musculus
tgtgtgtatatatatatgtgtgt

SEQ ID NO: 192418 - DNA, 22 bp, Mus musculus
atatatgtgtatatgtatttgt

SEQ ID NO: 192419 - DNA, 23 bp, Mus musculus
tatctcagtggctgatctgatga

SEQ ID NO: 192420 - DNA, 18 bp, Mus musculus
agtcatcgagtttgattt

SEQ ID NO: 192421 - DNA, 23 bp, Mus musculus
aagcactgactgctcttccagag

SEQ ID NO: 192422 - DNA, 21 bp, Mus musculus
ttaagtgctgtaactcctctt

SEQ ID NO: 192423 - DNA, 22 bp, Mus musculus
tacactcactgtctcacttgga

SEQ ID NO: 192424 - DNA, 19 bp, Mus musculus
tcagaactgtgtctgtgaa

SEQ ID NO: 192425 - DNA, 20 bp, Mus musculus
atattgtatatgtatatgtg

SEQ ID NO: 192426 - DNA, 23 bp, Mus musculus
aaacagcagctggatgtgcagtc

SEQ ID NO: 192427 - DNA, 23 bp, Mus musculus
tgtctctctctgtgtttgcacac

SEQ ID NO: 192428 - DNA, 23 bp, Mus musculus
tgcacacagagttctgttgcgct

SEQ ID NO: 192429 - DNA, 22 bp, Mus musculus
ttgggacagtcactctcactga

SEQ ID NO: 192430 - DNA, 22 bp, Mus musculus
tgatatcaatggtgtggctggc

SEQ ID NO: 192431 - DNA, 19 bp, Mus musculus
ttgtgctgccacttatgtc

SEQ ID NO: 192432 - DNA, 22 bp, Mus musculus
tatgtcatgactttagcagatt

SEQ ID NO: 192433 - DNA, 21 bp, Mus musculus
tgactgtcaagagtttcactc

SEQ ID NO: 192434 - DNA, 20 bp, Mus musculus
gaggctcagtgcctctctct

SEQ ID NO: 192435 - DNA, 23 bp, Mus musculus
aaactgcagcttgtcctggctca

SEQ ID NO: 192436 - DNA, 23 bp, Mus musculus
acacatcttactctctcgccctc

SEQ ID NO: 192437 - DNA, 21 bp, Mus musculus
tatgtgtatatatatgtgtgt

SEQ ID NO: 192438 - DNA, 21 bp, Mus musculus
ctgcctgtctcccagattccc

SEQ ID NO: 192439 - DNA, 23 bp, Mus musculus
actgcctgtctgtctgtctgtct

SEQ ID NO: 192440 - DNA, 23 bp, Mus musculus
ggatatgtgtgcaaatgtgtcac

SEQ ID NO: 192441 - DNA, 19 bp, Mus musculus
aagtgcaggggctggatag

SEQ ID NO: 192442 - DNA, 23 bp, Mus musculus
tatggtgtgcatgctgtatgtat

SEQ ID NO: 192443 - DNA, 23 bp, Mus musculus
acactgtctgtctgtctgcctgt

SEQ ID NO: 192444 - DNA, 23 bp, Mus musculus
tgtctggctccctgtgtcctggc

SEQ ID NO: 192445 - DNA, 23 bp, Mus musculus
atcacacagaaggatgtagatct

SEQ ID NO: 192446 - DNA, 23 bp, Mus musculus
cctcagcctgtgtctgactccct

SEQ ID NO: 192447 - DNA, 23 bp, Mus musculus
tctctctctgcctctgtggactg

SEQ ID NO: 192448 - DNA, 23 bp, Mus musculus
cctatgtctgtctgtctgtctct

SEQ ID NO: 192449 - DNA, 23 bp, Mus musculus
tgtgtctgtgaggatgttttgag

SEQ ID NO: 192450 - DNA, 19 bp, Mus musculus
accacagtagagggctgga

SEQ ID NO: 192451 - DNA, 23 bp, Mus musculus
tgggttctaggtagtttagttgt

SEQ ID NO: 192452 - DNA, 23 bp, Mus musculus
tgactgactggctgactgactgg

SEQ ID NO: 192453 - DNA, 23 bp, Mus musculus
ctgtctgtgtgtgtctgtgcatg

SEQ ID NO: 192454 - DNA, 23 bp, Mus musculus
ctctccctgtctgtggctctgca

SEQ ID NO: 192455 - DNA, 21 bp, Mus musculus
tgtgtatgtgtaaatgtgtat

SEQ ID NO: 192456 - DNA, 23 bp, Mus musculus
tatgcatatttatgtatatatgt

SEQ ID NO: 192457 - DNA, 23 bp, Mus musculus
cactgcctctgagtctccagttc

SEQ ID NO: 192458 - DNA, 22 bp, Mus musculus
agaggtggcagtgactgaagac

SEQ ID NO: 192459 - DNA, 23 bp, Mus musculus
tttgtcacggtcagtgagtcaca

SEQ ID NO: 192460 - DNA, 23 bp, Mus musculus
aacacagtgtggggaaaagctgt

SEQ ID NO: 192461 - DNA, 22 bp, Mus musculus
aggtcccttggtcatggtgtct

SEQ ID NO: 192462 - DNA, 19 bp, Mus musculus
tacatatacacacacatat

SEQ ID NO: 192463 - DNA, 23 bp, Mus musculus
ctttcaggatgtttactgagcat

SEQ ID NO: 192464 - DNA, 23 bp, Mus musculus
tcactctgccagtgactcatgca

SEQ ID NO: 192465 - DNA, 23 bp, Mus musculus
atgtatgtatgcatgtgtgtatg

SEQ ID NO: 192466 - DNA, 22 bp, Mus musculus
ttacaggctatattgtgactct

SEQ ID NO: 192467 - DNA, 23 bp, Mus musculus
tgaatgtgtgtagtatatgtgtg

SEQ ID NO: 192468 - DNA, 22 bp, Mus musculus
tgtccatctatgtatgaatcta

SEQ ID NO: 192469 - DNA, 22 bp, Mus musculus
tgttttgtgaccaattatatgg

SEQ ID NO: 192470 - DNA, 22 bp, Mus musculus
tgttttgtgaccaattatatgg

SEQ ID NO: 192471 - DNA, 23 bp, Mus musculus
taaaacagtgtgagtataatgtg

SEQ ID NO: 192472 - DNA, 22 bp, Mus musculus
tgttttgtgaccaattatatgg

SEQ ID NO: 192473 - DNA, 22 bp, Mus musculus
tgagaagaacgctgtgtcgtcg

SEQ ID NO: 192474 - DNA, 23 bp, Mus musculus
tcggagacagaagtgacaggaga

SEQ ID NO: 192475 - DNA, 21 bp, Mus musculus
tatgtacatatatatatgtgt

SEQ ID NO: 192476 - DNA, 23 bp, Mus musculus
tgtctgtctgtctatttattgag

SEQ ID NO: 192477 - DNA, 23 bp, Mus musculus
acaatgagttctgtttttcaagt

SEQ ID NO: 192478 - DNA, 21 bp, Mus musculus
tgtgcatgtatgtatgtatgt

SEQ ID NO: 192479 - DNA, 23 bp, Mus musculus
aatccttatgaaagactcacact

SEQ ID NO: 192480 - DNA, 23 bp, Mus musculus
tctcttaagtatagttggagagg

SEQ ID NO: 192481 - DNA, 21 bp, Mus musculus
gctgacataagacattctgat

SEQ ID NO: 192482 - DNA, 19 bp, Mus musculus
tatatgcacatatatatgt

SEQ ID NO: 192483 - DNA, 23 bp, Mus musculus
tgtctgtctgtctgtctgtctaa

SEQ ID NO: 192484 - DNA, 19 bp, Mus musculus
tgaagctgagactgctgct

SEQ ID NO: 192485 - DNA, 23 bp, Mus musculus
tgtgtgtctatgtgtttgtgtca

SEQ ID NO: 192486 - DNA, 23 bp, Mus musculus
tctaagtcttctgtttatgttat

SEQ ID NO: 192487 - DNA, 23 bp, Mus musculus
ttgtgaccaattatattgtcaat

SEQ ID NO: 192488 - DNA, 23 bp, Mus musculus
tatgccatatgttcaagatgctg

SEQ ID NO: 192489 - DNA, 22 bp, Mus musculus
tatcagtgaagactctgtgcac

SEQ ID NO: 192490 - DNA, 21 bp, Mus musculus
aattgtgtattagtaacaggt

SEQ ID NO: 192491 - DNA, 19 bp, Mus musculus
atgtgtttatatgtgtttg

SEQ ID NO: 192492 - DNA, 22 bp, Mus musculus
tgttttgtgaccaattatatgg

SEQ ID NO: 192493 - DNA, 23 bp, Mus musculus
cctaaggatatctagctgttaca

SEQ ID NO: 192494 - DNA, 23 bp, Mus musculus
ttgtaatttttagatgtattcat

SEQ ID NO: 192495 - DNA, 20 bp, Mus musculus
ttgcatgcacatatatatgt

SEQ ID NO: 192496 - DNA, 23 bp, Mus musculus
ttcagtgcatataatgctatgtg

SEQ ID NO: 192497 - DNA, 22 bp, Mus musculus
tgttttgtgaccaattatatgg

SEQ ID NO: 192498 - DNA, 22 bp, Mus musculus
tgttttgtgaccaattatatgg

SEQ ID NO: 192499 - DNA, 23 bp, Mus musculus
tgtgtgtatatatatgtgtgtgt

SEQ ID NO: 192500 - DNA, 20 bp, Mus musculus
tgttttgtgacctattatgt

SEQ ID NO: 192501 - DNA, 23 bp, Mus musculus
gcaaggaaaagaagtgtggatga

SEQ ID NO: 192502 - DNA, 23 bp, Mus musculus
tatgcatatgtacatatacgtaa

SEQ ID NO: 192503 - DNA, 19 bp, Mus musculus
ttttactattagtggagat

SEQ ID NO: 192504 - DNA, 23 bp, Mus musculus
atatatgtttttcaaaaggtgac

SEQ ID NO: 192505 - DNA, 23 bp, Mus musculus
tcagtgtctatttctttttctat

SEQ ID NO: 192506 - DNA, 23 bp, Mus musculus
tagtgcatggtgatctgatagga

SEQ ID NO: 192507 - DNA, 23 bp, Mus musculus
cagctatccttcagaagacaaga

SEQ ID NO: 192508 - DNA, 23 bp, Mus musculus
ccagacagaaaatagagtccaca

SEQ ID NO: 192509 - DNA, 23 bp, Mus musculus
tgtgtctctgtctcagttttggc

SEQ ID NO: 192510 - DNA, 22 bp, Mus musculus
tctctcacactgtaacatctca

SEQ ID NO: 192511 - DNA, 22 bp, Mus musculus
agtgcctgacagatatatttat

SEQ ID NO: 192512 - DNA, 22 bp, Mus musculus
tgttttgtgaccaattatatgg

SEQ ID NO: 192513 - DNA, 22 bp, Mus musculus
tgttttgtgaccaattatatgg

SEQ ID NO: 192514 - DNA, 23 bp, Mus musculus
tttcagggtgtctctgtgtctta

SEQ ID NO: 192515 - DNA, 22 bp, Mus musculus
tgttttgtgaccaattatatgg

SEQ ID NO: 192516 - DNA, 23 bp, Mus musculus
atctgtctctctttggtgcatgt

SEQ ID NO: 192517 - DNA, 23 bp, Mus musculus
tgtctgtctgtctatatgcatgt

SEQ ID NO: 192518 - DNA, 22 bp, Mus musculus
gtctgtctgtctgtctgtctac

SEQ ID NO: 192519 - DNA, 19 bp, Mus musculus
tgcgtgcctgtgtgcctgc

SEQ ID NO: 192520 - DNA, 20 bp, Mus musculus
tttgttgtcagcacattggt

SEQ ID NO: 192521 - DNA, 22 bp, Mus musculus
tatcccacccagtgtctatagt

SEQ ID NO: 192522 - DNA, 23 bp, Mus musculus
atcagcaatgactatcagtgact

SEQ ID NO: 192523 - DNA, 23 bp, Mus musculus
gagagtgcagaagcagctcttcc

SEQ ID NO: 192524 - DNA, 19 bp, Mus musculus
actggctgactctttctca

SEQ ID NO: 192525 - DNA, 20 bp, Mus musculus
tgtcccacgatgtgctgagt

SEQ ID NO: 192526 - DNA, 21 bp, Mus musculus
aagtatgtgtgcatgtgttta

SEQ ID NO: 192527 - DNA, 20 bp, Mus musculus
atttgtgaaagtgtgtgtgc

SEQ ID NO: 192528 - DNA, 23 bp, Mus musculus
tatatgtgcatgtgtatgtatat

SEQ ID NO: 192529 - DNA, 23 bp, Mus musculus
cctccctgcctgcctgcctgcct

SEQ ID NO: 192530 - DNA, 23 bp, Mus musculus
tagagtggaaatgagttttaatc

SEQ ID NO: 192531 - DNA, 23 bp, Mus musculus
gactcagtgactgactcagtccc

SEQ ID NO: 192532 - DNA, 23 bp, Mus musculus
tgggtcagtctgtgactgtgtgg

SEQ ID NO: 192533 - DNA, 23 bp, Mus musculus
acacacacacatatgcatataca

SEQ ID NO: 192534 - DNA, 23 bp, Mus musculus
atgtacatatgtatacatgtatg

SEQ ID NO: 192535 - DNA, 22 bp, Mus musculus
tgttttgtgaccaattatatgg

SEQ ID NO: 192536 - DNA, 23 bp, Mus musculus
tccttgagaagagtttttgctgt

SEQ ID NO: 192537 - DNA, 18 bp, Mus musculus
gtagagtgtcagctcagg

SEQ ID NO: 192538 - DNA, 20 bp, Mus musculus
aagtagtactccttttagtg

SEQ ID NO: 192539 - DNA, 23 bp, Mus musculus
agtgcaaatgtgtatatgatata

SEQ ID NO: 192540 - DNA, 23 bp, Mus musculus
tctctgtctctgtctctgatgtt

SEQ ID NO: 192541 - DNA, 23 bp, Mus musculus
cagatagtgtgatgtgagcagca

SEQ ID NO: 192542 - DNA, 23 bp, Mus musculus
gtctccgtcactgacaactcagg

SEQ ID NO: 192543 - DNA, 23 bp, Mus musculus
gtaatcttatcacactcatgttg

SEQ ID NO: 192544 - DNA, 19 bp, Mus musculus
tatgtatatatgtatatgt

SEQ ID NO: 192545 - DNA, 20 bp, Mus musculus
aatgtatgtgtataggtaag

SEQ ID NO: 192546 - DNA, 23 bp, Mus musculus
atgtatgtatgtattcatgtatg

SEQ ID NO: 192547 - DNA, 18 bp, Mus musculus
tagtgctaaatggaaaga

SEQ ID NO: 192548 - DNA, 20 bp, Mus musculus
actagagagacagctcagtt

SEQ ID NO: 192549 - DNA, 23 bp, Mus musculus
gttcatttagtcagtttcagata

SEQ ID NO: 192550 - DNA, 23 bp, Mus musculus
agatatggaattggtgtgtgtat

SEQ ID NO: 192551 - DNA, 23 bp, Mus musculus
tagccacctttgcaattgtctgc

SEQ ID NO: 192552 - DNA, 23 bp, Mus musculus
tatatatatgtgtgtgtgtatat

SEQ ID NO: 192553 - DNA, 21 bp, Mus musculus
tacacgtatatatatgtgtat

SEQ ID NO: 192554 - DNA, 22 bp, Mus musculus
tgtgtgtatgtatatgtatgtg

SEQ ID NO: 192555 - DNA, 23 bp, Mus musculus
ttgtgctggagagatagttcagt

SEQ ID NO: 192556 - DNA, 23 bp, Mus musculus
tgagtagcacttctcttacagtc

SEQ ID NO: 192557 - DNA, 22 bp, Mus musculus
aaagtcagatgtgagtgagcac

SEQ ID NO: 192558 - DNA, 18 bp, Mus musculus
tgcattactatgcccagt

SEQ ID NO: 192559 - DNA, 23 bp, Mus musculus
atgtgtgtgtggtataggtgaag

SEQ ID NO: 192560 - DNA, 23 bp, Mus musculus
tgtctgtctgcgtctctgtgagt

SEQ ID NO: 192561 - DNA, 23 bp, Mus musculus
tggctcgctcccagtttgccttg

SEQ ID NO: 192562 - DNA, 23 bp, Mus musculus
cctcattgcagaagaagtgtttt

SEQ ID NO: 192563 - DNA, 18 bp, Mus musculus
agtgtgtgagcttgccga

SEQ ID NO: 192564 - DNA, 21 bp, Mus musculus
agggcagcttctgtttgcatt

SEQ ID NO: 192565 - DNA, 21 bp, Mus musculus
tgcatgtgtgcatgtttgtgc

SEQ ID NO: 192566 - DNA, 23 bp, Mus musculus
cagtccaggcttctgtgtctgtc

SEQ ID NO: 192567 - DNA, 23 bp, Mus musculus
gtgttcctctgtgagtgagtaaa

SEQ ID NO: 192568 - DNA, 23 bp, Mus musculus
gtgcgtgtgcgtgtgtgcgtgtg

SEQ ID NO: 192569 - DNA, 23 bp, Mus musculus
tgtatgtgcatgaacatgtgtat

SEQ ID NO: 192570 - DNA, 23 bp, Mus musculus
actatgtatgtatatgtatatga

SEQ ID NO: 192571 - DNA, 22 bp, Mus musculus
agcttgaagcagaagcacagag

SEQ ID NO: 192572 - DNA, 23 bp, Mus musculus
tggctcactcgctgacaggctgg

SEQ ID NO: 192573 - DNA, 22 bp, Mus musculus
tccatcagtctgtgagtcactc

SEQ ID NO: 192574 - DNA, 23 bp, Mus musculus
cttctgtgtctcttctggttgtg

SEQ ID NO: 192575 - DNA, 18 bp, Mus musculus
tctgtctgtgtctgcctc

SEQ ID NO: 192576 - DNA, 23 bp, Mus musculus
ggtgagaagtgagactggacagg

SEQ ID NO: 192577 - DNA, 18 bp, Mus musculus
cagagggtagagattgtg

SEQ ID NO: 192578 - DNA, 22 bp, Mus musculus
tgttttgtgaccaattatatgg

SEQ ID NO: 192579 - DNA, 23 bp, Mus musculus
gcccgtcactgtgtcagtgtgtc

SEQ ID NO: 192580 - DNA, 19 bp, Mus musculus
gagccactctctgcctctc

SEQ ID NO: 192581 - DNA, 21 bp, Mus musculus
ttgagagctgactctgctgct

SEQ ID NO: 192582 - DNA, 23 bp, Mus musculus
ggtaaactttacagacagagaag

SEQ ID NO: 192583 - DNA, 19 bp, Mus musculus
agacacagaacagtctgag

SEQ ID NO: 192584 - DNA, 22 bp, Mus musculus
tagcaagtatacatgtttgtat

SEQ ID NO: 192585 - DNA, 18 bp, Mus musculus
tgtgtacatgtatgtatg

SEQ ID NO: 192586 - DNA, 21 bp, Mus musculus
tacaccatatatatacacata

SEQ ID NO: 192587 - DNA, 23 bp, Mus musculus
aggcctgggtgtctctctcactg

SEQ ID NO: 192588 - DNA, 19 bp, Mus musculus
tgtctgtctgtctatctac

SEQ ID NO: 192589 - DNA, 23 bp, Mus musculus
tgtaagagtatcctttcactgtc

SEQ ID NO: 192590 - DNA, 23 bp, Mus musculus
tgtcacagactctctgtctattt

SEQ ID NO: 192591 - DNA, 23 bp, Mus musculus
ctccctcactgtctgtgacatcc

SEQ ID NO: 192592 - DNA, 22 bp, Mus musculus
tgttttgtgaccaattatatgg

SEQ ID NO: 192593 - DNA, 20 bp, Mus musculus
aacaagcacagactgggaga

SEQ ID NO: 192594 - DNA, 23 bp, Mus musculus
catctctgactgtgtgcttggat

SEQ ID NO: 192595 - DNA, 23 bp, Mus musculus
actgggagtggctgtgttcagta

SEQ ID NO: 192596 - DNA, 23 bp, Mus musculus
tctacatagtgatacagcatgct

SEQ ID NO: 192597 - DNA, 22 bp, Mus musculus
tgttttgtgaccaattatatgg

SEQ ID NO: 192598 - DNA, 23 bp, Mus musculus
tggtgactgtcctaccttgtgct

SEQ ID NO: 192599 - DNA, 19 bp, Mus musculus
atgtatatacatgtgtgtg

SEQ ID NO: 192600 - DNA, 22 bp, Mus musculus
agaacgtggtacacacagtagt

SEQ ID NO: 192601 - DNA, 23 bp, Mus musculus
tctcactgagactctaataggcc

SEQ ID NO: 192602 - DNA, 21 bp, Mus musculus
tttgagctagcaactcttcct

SEQ ID NO: 192603 - DNA, 22 bp, Mus musculus
attcactctcaggctctgatct

SEQ ID NO: 192604 - DNA, 23 bp, Mus musculus
tgagtttctgtctgtcactccct

SEQ ID NO: 192605 - DNA, 23 bp, Mus musculus
tgtctgtctgtctgtctgtctgt

SEQ ID NO: 192606 - DNA, 22 bp, Mus musculus
tgtatgaatgctttacctgtgt

SEQ ID NO: 192607 - DNA, 19 bp, Mus musculus
ctctgcatattgtttggct

SEQ ID NO: 192608 - DNA, 23 bp, Mus musculus
aagcactgaggtgttgcagcagg

SEQ ID NO: 192609 - DNA, 23 bp, Mus musculus
tgtgtgtgtgcatgtgtatgtgt

SEQ ID NO: 192610 - DNA, 22 bp, Mus musculus
gtgtccctgtgtgtcttgctgt

SEQ ID NO: 192611 - DNA, 23 bp, Mus musculus
ttctctcgctgactcactggtta

SEQ ID NO: 192612 - DNA, 23 bp, Mus musculus
tgactctgtcacagacccctact

SEQ ID NO: 192613 - DNA, 23 bp, Mus musculus
tgcctgtctgtctgtctgtctgt

SEQ ID NO: 192614 - DNA, 21 bp, Mus musculus
tgaggagccacagtgaggaag

SEQ ID NO: 192615 - DNA, 23 bp, Mus musculus
tcttctgtctcactgtctttgac

SEQ ID NO: 192616 - DNA, 22 bp, Mus musculus
taacatgctagtcctgcccttc

SEQ ID NO: 192617 - DNA, 23 bp, Mus musculus
tcacagatgacagtgtgccttgc

SEQ ID NO: 192618 - DNA, 23 bp, Mus musculus
tcactgtgaaactctgtcactgc

SEQ ID NO: 192619 - DNA, 23 bp, Mus musculus
tctctcactgagtatccagtttg

SEQ ID NO: 192620 - DNA, 23 bp, Mus musculus
tgagaccagacagaggtgactga

SEQ ID NO: 192621 - DNA, 21 bp, Mus musculus
catctgtgtgtctgtccttgc

SEQ ID NO: 192622 - DNA, 19 bp, Mus musculus
atgacattggctgtcctgt

SEQ ID NO: 192623 - DNA, 23 bp, Mus musculus
aaagacacagcagtgtcagggga

SEQ ID NO: 192624 - DNA, 23 bp, Mus musculus
tgttcacagaaaacacagagaag

SEQ ID NO: 192625 - DNA, 23 bp, Mus musculus
actccgcatcctgtgtttgcagt

SEQ ID NO: 192626 - DNA, 20 bp, Mus musculus
tctgtgagtgtgtctccatt

SEQ ID NO: 192627 - DNA, 18 bp, Mus musculus
tccctctgaggatgggac

SEQ ID NO: 192628 - DNA, 22 bp, Mus musculus
tctgatactctgtctttgagag

SEQ ID NO: 192629 - DNA, 18 bp, Mus musculus
tcgctcagtccctgcttg

SEQ ID NO: 192630 - DNA, 22 bp, Mus musculus
tagctgtcttcagatgcaccag

SEQ ID NO: 192631 - DNA, 23 bp, Mus musculus
tacctttagttatctcatgtagg

SEQ ID NO: 192632 - DNA, 20 bp, Mus musculus
aagagcactgactgctcttc

SEQ ID NO: 192633 - DNA, 18 bp, Mus musculus
agtagctcttgctcttgt

SEQ ID NO: 192634 - DNA, 23 bp, Mus musculus
tggttgtcagtagagcctgaggt

SEQ ID NO: 192635 - DNA, 21 bp, Mus musculus
gtgttgtctgggactggagag

SEQ ID NO: 192636 - DNA, 23 bp, Mus musculus
cctctgtgtgtgtgtctgtgcat

SEQ ID NO: 192637 - DNA, 23 bp, Mus musculus
taagagcactgactgctctttca

SEQ ID NO: 192638 - DNA, 19 bp, Mus musculus
tctctttatttggctgtgt

SEQ ID NO: 192639 - DNA, 23 bp, Mus musculus
tctgtgagtctgtgagtctggaa

SEQ ID NO: 192640 - DNA, 23 bp, Mus musculus
tcaggttgtctctctgactctaa

SEQ ID NO: 192641 - DNA, 23 bp, Mus musculus
ttctctgtcactctgtctctctc

SEQ ID NO: 192642 - DNA, 23 bp, Mus musculus
gtctctgcctgtctgcctgcctg

SEQ ID NO: 192643 - DNA, 23 bp, Mus musculus
cagactggagagatggttcagtg

SEQ ID NO: 192644 - DNA, 20 bp, Mus musculus
tgtgctcttcagaagtttca

SEQ ID NO: 192645 - DNA, 21 bp, Mus musculus
aaatctttttttaaaaaagac

SEQ ID NO: 192646 - DNA, 19 bp, Mus musculus
agtgcaatcagaagaggct

SEQ ID NO: 192647 - DNA, 20 bp, Mus musculus
aagagcactgactgctcttc

SEQ ID NO: 192648 - DNA, 23 bp, Mus musculus
agacagggtctctcactatggag

SEQ ID NO: 192649 - DNA, 20 bp, Mus musculus
gccactgcttagtgcagtct

SEQ ID NO: 192650 - DNA, 20 bp, Mus musculus
gtttccgtgcctgcttctaa

SEQ ID NO: 192651 - DNA, 19 bp, Mus musculus
aagagctgagtcagctggt

SEQ ID NO: 192652 - DNA, 22 bp, Mus musculus
tgtgtccttgctgattcctgct

SEQ ID NO: 192653 - DNA, 23 bp, Mus musculus
taagtccatattttttctgatga

SEQ ID NO: 192654 - DNA, 23 bp, Mus musculus
agcttggtcttcctgtgggtccc

SEQ ID NO: 192655 - DNA, 23 bp, Mus musculus
ccaactctgtggaattgttgcgt

SEQ ID NO: 192656 - DNA, 18 bp, Mus musculus
agacaggaacctagcatg

SEQ ID NO: 192657 - DNA, 23 bp, Mus musculus
atatgtatgcatatatgtgtgta

SEQ ID NO: 192658 - DNA, 23 bp, Mus musculus
aagcacagggtgacaggcacaga

SEQ ID NO: 192659 - DNA, 23 bp, Mus musculus
tctgacaagtgtgtgtgcactag

SEQ ID NO: 192660 - DNA, 20 bp, Mus musculus
agttactctcaccctaaaga

SEQ ID NO: 192661 - DNA, 21 bp, Mus musculus
tctgtcactttctgagtctgt

SEQ ID NO: 192662 - DNA, 23 bp, Mus musculus
ttcatcaagatcaggatggatat

SEQ ID NO: 192663 - DNA, 23 bp, Mus musculus
tctgagtcaccctctctgacttg

SEQ ID NO: 192664 - DNA, 21 bp, Mus musculus
tctcactctgtaagaccaggc

SEQ ID NO: 192665 - DNA, 23 bp, Mus musculus
agatctgtctgcctgtgcctctc

SEQ ID NO: 192666 - DNA, 23 bp, Mus musculus
tctgagtcaccctctctgactgg

SEQ ID NO: 192667 - DNA, 18 bp, Mus musculus
tgttttgtgaccaattat

SEQ ID NO: 192668 - DNA, 23 bp, Mus musculus
aatacatggtggtctgataggat

SEQ ID NO: 192669 - DNA, 21 bp, Mus musculus
tgttttgtgaccaattatgtg

SEQ ID NO: 192670 - DNA, 20 bp, Mus musculus
acatcttggttcagagactc

SEQ ID NO: 192671 - DNA, 23 bp, Mus musculus
cacaggtgagagtgtggactaca

SEQ ID NO: 192672 - DNA, 21 bp, Mus musculus
ctctgctctttctccagtctg

SEQ ID NO: 192673 - DNA, 23 bp, Mus musculus
tgtctgccagcattgatgttctt

SEQ ID NO: 192674 - DNA, 23 bp, Mus musculus
tgtgtgtgtatatgtatacatgt

SEQ ID NO: 192675 - DNA, 21 bp, Mus musculus
tatatgtatatatgtatatgt

SEQ ID NO: 192676 - DNA, 20 bp, Mus musculus
tctgtggtagtagatacaag

SEQ ID NO: 192677 - DNA, 23 bp, Mus musculus
tgactcagaggttaagagcactg

SEQ ID NO: 192678 - DNA, 20 bp, Mus musculus
tacatatgtgtgtatatata

SEQ ID NO: 192679 - DNA, 18 bp, Mus musculus
atgcatacacacatatga

SEQ ID NO: 192680 - DNA, 23 bp, Mus musculus
agtgttttacatgcatttgtgtg

SEQ ID NO: 192681 - DNA, 23 bp, Mus musculus
gagaattcagagactctagatca

SEQ ID NO: 192682 - DNA, 23 bp, Mus musculus
agagagatgagagtgagttcatt

SEQ ID NO: 192683 - DNA, 23 bp, Mus musculus
tttctctttttctttttgaggag

SEQ ID NO: 192684 - DNA, 22 bp, Mus musculus
tgttttgtgaccaattatatgg

SEQ ID NO: 192685 - DNA, 23 bp, Mus musculus
aagagaacactgagtgctgtgat

SEQ ID NO: 192686 - DNA, 22 bp, Mus musculus
aattccaacctcattctcaggc

SEQ ID NO: 192687 - DNA, 23 bp, Mus musculus
agacagacattatgctaaagtga

SEQ ID NO: 192688 - DNA, 22 bp, Mus musculus
tgttttgtgaccaattatatgg

SEQ ID NO: 192689 - DNA, 20 bp, Mus musculus
taggtccctgtgctcagtcc

SEQ ID NO: 192690 - DNA, 22 bp, Mus musculus
tgttttgtgaccaattatatgg

SEQ ID NO: 192691 - DNA, 23 bp, Mus musculus
ctgtgtctctgtttagtttctgt

SEQ ID NO: 192692 - DNA, 23 bp, Mus musculus
aggatctgtccattgatgagagt

SEQ ID NO: 192693 - DNA, 22 bp, Mus musculus
attgtctctgtatttcctcctg

SEQ ID NO: 192694 - DNA, 18 bp, Mus musculus
ctcattttgtctgtcctt

SEQ ID NO: 192695 - DNA, 23 bp, Mus musculus
agaggaatggttaatcttgtttt

SEQ ID NO: 192696 - DNA, 21 bp, Mus musculus
agtcctggctgtctttatctg

SEQ ID NO: 192697 - DNA, 23 bp, Mus musculus
aagagcactgactgctcttccag

SEQ ID NO: 192698 - DNA, 23 bp, Mus musculus
tccctgagtccctcaatgctccc

SEQ ID NO: 192699 - DNA, 23 bp, Mus musculus
aattctggcaccaaaacttttct

SEQ ID NO: 192700 - DNA, 22 bp, Mus musculus
agctaaagctttctgattcctt

SEQ ID NO: 192701 - DNA, 22 bp, Mus musculus
tagggatgaaggttgtatggtt

SEQ ID NO: 192702 - DNA, 23 bp, Mus musculus
cgggctcactcactccctgttag

SEQ ID NO: 192703 - DNA, 23 bp, Mus musculus
tttgtgtctgggtgttttgcctg

SEQ ID NO: 192704 - DNA, 23 bp, Mus musculus
tcacatgcatgttgtacccatag

SEQ ID NO: 192705 - DNA, 23 bp, Mus musculus
tctgtatttgtctgtctgtctgt

SEQ ID NO: 192706 - DNA, 21 bp, Mus musculus
tcatttaacctgtgcctggcc

SEQ ID NO: 192707 - DNA, 23 bp, Mus musculus
tggttgacttctgattttgttct

SEQ ID NO: 192708 - DNA, 22 bp, Mus musculus
tgtgtgtgtctctctctctcca

SEQ ID NO: 192709 - DNA, 19 bp, Mus musculus
atacacacatatatatgtg

SEQ ID NO: 192710 - DNA, 22 bp, Mus musculus
tgcctgcctgcctgcctgcctg

SEQ ID NO: 192711 - DNA, 23 bp, Mus musculus
tctgtctgtgcctctgtctcact

SEQ ID NO: 192712 - DNA, 20 bp, Mus musculus
gtatacatatgtatgtgtat

SEQ ID NO: 192713 - DNA, 19 bp, Mus musculus
tccctggctgtctgggtgg

SEQ ID NO: 192714 - DNA, 23 bp, Mus musculus
tatgtatatgtatatgtatatgt

SEQ ID NO: 192715 - DNA, 21 bp, Mus musculus
atgtgtgtgtggatgtgcatg

SEQ ID NO: 192716 - DNA, 18 bp, Mus musculus
tgaagcttccttttgaga

SEQ ID NO: 192717 - DNA, 23 bp, Mus musculus
tatatatatgtatctgtatatct

SEQ ID NO: 192718 - DNA, 23 bp, Mus musculus
gagtatgtacatatgtgtatatg

SEQ ID NO: 192719 - DNA, 19 bp, Mus musculus
tatgagtatgtatgtatat

SEQ ID NO: 192720 - DNA, 23 bp, Mus musculus
ctctgcgtctgtcactgtcactg

SEQ ID NO: 192721 - DNA, 18 bp, Mus musculus
tagtggctggagaggagg

SEQ ID NO: 192722 - DNA, 22 bp, Mus musculus
ctctgtctgtctgtctgtctgc

SEQ ID NO: 192723 - DNA, 23 bp, Mus musculus
atgtatgcatgtatgtatatgtg

SEQ ID NO: 192724 - DNA, 23 bp, Mus musculus
atgtatgtatgtatgtatgtatg

SEQ ID NO: 192725 - DNA, 18 bp, Mus musculus
cagtcctttttgtgaatg

SEQ ID NO: 192726 - DNA, 23 bp, Mus musculus
aaaacactgctaaaaaaatcctt

SEQ ID NO: 192727 - DNA, 23 bp, Mus musculus
tagtgcatggtgatctgatagga

SEQ ID NO: 192728 - DNA, 22 bp, Mus musculus
tgttttgtgacctattatgtgg

SEQ ID NO: 192729 - DNA, 23 bp, Mus musculus
ttttgagtagttggtcctcagtg

SEQ ID NO: 192730 - DNA, 21 bp, Mus musculus
tgtatatatgtatgagtgtgc

SEQ ID NO: 192731 - DNA, 22 bp, Mus musculus
atgtgtgtatatgtatatgtgt

SEQ ID NO: 192732 - DNA, 22 bp, Mus musculus
atgtgtgtatatgtatatgtgt

SEQ ID NO: 192733 - DNA, 21 bp, Mus musculus
tataggtaaataagaggggtg

SEQ ID NO: 192734 - DNA, 19 bp, Mus musculus
atggcagtggcagtggagt

SEQ ID NO: 192735 - DNA, 22 bp, Mus musculus
gtctccctgaatgtctgtctta

SEQ ID NO: 192736 - DNA, 23 bp, Mus musculus
atgcaggtatatacatgtatatg

SEQ ID NO: 192737 - DNA, 23 bp, Mus musculus
tatgtatatgtatatatatgtat

SEQ ID NO: 192738 - DNA, 23 bp, Mus musculus
atatgtgtatatgtatatgtgtg

SEQ ID NO: 192739 - DNA, 23 bp, Mus musculus
tcttgtctcagtgtgaccctgtg

SEQ ID NO: 192740 - DNA, 22 bp, Mus musculus
tgtatgtatgatgtatgtacgt

SEQ ID NO: 192741 - DNA, 23 bp, Mus musculus
tgcatatgtatatatatatgtgt

SEQ ID NO: 192742 - DNA, 23 bp, Mus musculus
tgtaatatatgtgtatatgtata

SEQ ID NO: 192743 - DNA, 23 bp, Mus musculus
attgttcagcctcctagacagtc

SEQ ID NO: 192744 - DNA, 23 bp, Mus musculus
tctcaaccagaaactctctgtct

SEQ ID NO: 192745 - DNA, 18 bp, Mus musculus
tttccctgttccagatga

SEQ ID NO: 192746 - DNA, 22 bp, Mus musculus
cgagcatctgttgttagcattt

SEQ ID NO: 192747 - DNA, 23 bp, Mus musculus
tctgtctgtgtgtgtgcgagcga

SEQ ID NO: 192748 - DNA, 21 bp, Mus musculus
atgtatgtatgtatgtatgta

SEQ ID NO: 192749 - DNA, 23 bp, Mus musculus
tgcatgcatgcatgtatgtatgt

SEQ ID NO: 192750 - DNA, 22 bp, Mus musculus
aagctgggtctcattcatctgt

SEQ ID NO: 192751 - DNA, 23 bp, Mus musculus
agtcactcacactgtgtgatctt

SEQ ID NO: 192752 - DNA, 23 bp, Mus musculus
atgtatatatgtgtatgtatatg

SEQ ID NO: 192753 - DNA, 23 bp, Mus musculus
atggctgagtccttaggtagtag

SEQ ID NO: 192754 - DNA, 19 bp, Mus musculus
agtgactggggctggagag

SEQ ID NO: 192755 - DNA, 19 bp, Mus musculus
tggcagagtgcttaccaag

SEQ ID NO: 192756 - DNA, 23 bp, Mus musculus
tctcatactgtccctctctggcc

SEQ ID NO: 192757 - DNA, 19 bp, Mus musculus
gagcaaggatgttaaggta

SEQ ID NO: 192758 - DNA, 23 bp, Mus musculus
acagcatgtatcatatatacaag

SEQ ID NO: 192759 - DNA, 23 bp, Mus musculus
tgtatgtatgtacgtatgtatgt

SEQ ID NO: 192760 - DNA, 23 bp, Mus musculus
tagagtacagtgttacatgttga

SEQ ID NO: 192761 - DNA, 19 bp, Mus musculus
tctcactctctctgtgctg

SEQ ID NO: 192762 - DNA, 22 bp, Mus musculus
tgtgtgtgtgtgtgtacgtaca

SEQ ID NO: 192763 - DNA, 20 bp, Mus musculus
atgtatgtatgcatgtatgt

SEQ ID NO: 192764 - DNA, 23 bp, Mus musculus
tgtgtgtgtgtgtgtgtatactg

SEQ ID NO: 192765 - DNA, 23 bp, Mus musculus
catactccttttattttcatgga

SEQ ID NO: 192766 - DNA, 22 bp, Mus musculus
atgtatctttttaaagcttaat

SEQ ID NO: 192767 - DNA, 23 bp, Mus musculus
tttccatatatatgtgtgtgtgt

SEQ ID NO: 192768 - DNA, 23 bp, Mus musculus
tcaccactgcctgatttcaatgt

SEQ ID NO: 192769 - DNA, 23 bp, Mus musculus
ttgagtgtgtatttgatgtcttt

SEQ ID NO: 192770 - DNA, 23 bp, Mus musculus
ttgatgaagaagctcgaaaaggt

SEQ ID NO: 192771 - DNA, 23 bp, Mus musculus
tctgtgcatgagcatgtgtctgt

SEQ ID NO: 192772 - DNA, 23 bp, Mus musculus
tagtccatggtgatctgatagga

SEQ ID NO: 192773 - DNA, 23 bp, Mus musculus
gttttgtgactgattatgtggtc

SEQ ID NO: 192774 - DNA, 23 bp, Mus musculus
tgtgacactgacagagttgcaac

SEQ ID NO: 192775 - DNA, 23 bp, Mus musculus
atttacatgtatatgtacacata

SEQ ID NO: 192776 - DNA, 21 bp, Mus musculus
tgtacatatatatacatatgt

SEQ ID NO: 192777 - DNA, 23 bp, Mus musculus
agcatcagcatctgtattggtca

SEQ ID NO: 192778 - DNA, 23 bp, Mus musculus
ttgagcttaatgatttgagtgtt

SEQ ID NO: 192779 - DNA, 21 bp, Mus musculus
gtctgcctgagacacagccag

SEQ ID NO: 192780 - DNA, 20 bp, Mus musculus
tctgactttgattgtctgct

SEQ ID NO: 192781 - DNA, 19 bp, Mus musculus
atgtatgtctccatgttct

SEQ ID NO: 192782 - DNA, 23 bp, Mus musculus
tagataggagagagtgagcagtc

SEQ ID NO: 192783 - DNA, 23 bp, Mus musculus
tttgtctgtgattttgttggccc

SEQ ID NO: 192784 - DNA, 22 bp, Mus musculus
tgttttgtgaccaattatatgg

SEQ ID NO: 192785 - DNA, 22 bp, Mus musculus
tgagacctgttttgtgaccaat

SEQ ID NO: 192786 - DNA, 22 bp, Mus musculus
tgttttgtgaccaattatatgg

SEQ ID NO: 192787 - DNA, 22 bp, Mus musculus
tgttttgtgaccaattatatgg

SEQ ID NO: 192788 - DNA, 22 bp, Mus musculus
tctcagcatcacaggatcccag

SEQ ID NO: 192789 - DNA, 23 bp, Mus musculus
tagaatgaattgggtagagtacc

SEQ ID NO: 192790 - DNA, 19 bp, Mus musculus
tcaatatgaatacataagg

SEQ ID NO: 192791 - DNA, 19 bp, Mus musculus
tcaatatgaatacataagg

SEQ ID NO: 192792 - DNA, 21 bp, Mus musculus
tctgaggctccgagtatccct

SEQ ID NO: 192793 - DNA, 23 bp, Mus musculus
tggaagtgaactgtttttctttt

SEQ ID NO: 192794 - DNA, 23 bp, Mus musculus
aaaacacactgaacagtgcagct

SEQ ID NO: 192795 - DNA, 23 bp, Mus musculus
agtgtctcaggttttcatttccc

SEQ ID NO: 192796 - DNA, 18 bp, Mus musculus
tatttgctgcagaggaag

SEQ ID NO: 192797 - DNA, 21 bp, Mus musculus
ttctgacatgaatgtcagcac

SEQ ID NO: 192798 - DNA, 20 bp, Mus musculus
tctcattctgtcttactccc

SEQ ID NO: 192799 - DNA, 23 bp, Mus musculus
tcagtctctgtgtccctgtgaga

SEQ ID NO: 192800 - DNA, 23 bp, Mus musculus
agtcatttgtttttgttcttgag

SEQ ID NO: 192801 - DNA, 23 bp, Mus musculus
tattgagctgagtttgatcttgg

SEQ ID NO: 192802 - DNA, 20 bp, Mus musculus
ttgcatgtgtgcacatgtgt

SEQ ID NO: 192803 - DNA, 22 bp, Mus musculus
tagcttgtagctctcgctctct

SEQ ID NO: 192804 - DNA, 18 bp, Mus musculus
tgactgactgatttagaa

SEQ ID NO: 192805 - DNA, 21 bp, Mus musculus
tcctccaggtcaaggagcagt

SEQ ID NO: 192806 - DNA, 23 bp, Mus musculus
tgaccctgacactccctgacact

SEQ ID NO: 192807 - DNA, 19 bp, Mus musculus
atatgtatacaagcatata

SEQ ID NO: 192808 - DNA, 22 bp, Mus musculus
tgtatatatgtatgtatgtggg

SEQ ID NO: 192809 - DNA, 19 bp, Mus musculus
atatgtatgtatgtgtgta

SEQ ID NO: 192810 - DNA, 23 bp, Mus musculus
acttctgtccctctgacacccag

SEQ ID NO: 192811 - DNA, 18 bp, Mus musculus
atgtgtgtatatgcatgt

SEQ ID NO: 192812 - DNA, 23 bp, Mus musculus
atgagtctcaatctggatcagtc

SEQ ID NO: 192813 - DNA, 23 bp, Mus musculus
tctctgcctctctgggtccctgt

SEQ ID NO: 192814 - DNA, 23 bp, Mus musculus
tgtaaagctctcagctactcctc

SEQ ID NO: 192815 - DNA, 22 bp, Mus musculus
tatggatgcatatgaatatata

SEQ ID NO: 192816 - DNA, 21 bp, Mus musculus
tgaggggcagctacattgcac

SEQ ID NO: 192817 - DNA, 20 bp, Mus musculus
atagacaaacacgtacaggt

SEQ ID NO: 192818 - DNA, 23 bp, Mus musculus
cagatcacactctgtcactgagg

SEQ ID NO: 192819 - DNA, 23 bp, Mus musculus
gctccctctctcagactaatttc

SEQ ID NO: 192820 - DNA, 23 bp, Mus musculus
tgtgtctgtctctctccctcata

SEQ ID NO: 192821 - DNA, 23 bp, Mus musculus
tatgtcactggaagtgaactttg

SEQ ID NO: 192822 - DNA, 21 bp, Mus musculus
tcagattcagtgtgtgtctct

SEQ ID NO: 192823 - DNA, 21 bp, Mus musculus
gtaagaagaaagtgaggtgag

SEQ ID NO: 192824 - DNA, 23 bp, Mus musculus
tcaccacctgtcactctctgtct

SEQ ID NO: 192825 - DNA, 19 bp, Mus musculus
actctccctccctgactaa

SEQ ID NO: 192826 - DNA, 20 bp, Mus musculus
ttgagtcagcagagagggag

SEQ ID NO: 192827 - DNA, 23 bp, Mus musculus
atgtctcagtcactctgcttccg

SEQ ID NO: 192828 - DNA, 23 bp, Mus musculus
aacactgactgctcttccagagg

SEQ ID NO: 192829 - DNA, 21 bp, Mus musculus
tccaatcatgcatgcattcct

SEQ ID NO: 192830 - DNA, 23 bp, Mus musculus
acacacagttctttcctgtagct

SEQ ID NO: 192831 - DNA, 22 bp, Mus musculus
tctgcctctgtgtctggcgcag

SEQ ID NO: 192832 - DNA, 19 bp, Mus musculus
tgagagtttatgtgtctac

SEQ ID NO: 192833 - DNA, 23 bp, Mus musculus
aaaatgacttaaggcagctggag

SEQ ID NO: 192834 - DNA, 23 bp, Mus musculus
taagagcactgactgctcttcca

SEQ ID NO: 192835 - DNA, 18 bp, Mus musculus
tggtggtctgaaagtatg

SEQ ID NO: 192836 - DNA, 22 bp, Mus musculus
tgttttgtgaccaattatatgg

SEQ ID NO: 192837 - DNA, 23 bp, Mus musculus
tcagactctcagcctctgactct

SEQ ID NO: 192838 - DNA, 22 bp, Mus musculus
tatgacagtgaagtgagtgtgt

SEQ ID NO: 192839 - DNA, 20 bp, Mus musculus
tctgcgtgtgtctgtgtgtg

SEQ ID NO: 192840 - DNA, 23 bp, Mus musculus
attgctgtgcatatgatatgtat

SEQ ID NO: 192841 - DNA, 23 bp, Mus musculus
tattatgttgttatatattcgtg

SEQ ID NO: 192842 - DNA, 23 bp, Mus musculus
acctgtctgcctgtcagtctgtg

SEQ ID NO: 192843 - DNA, 23 bp, Mus musculus
cactcagagcttagactttgtga

SEQ ID NO: 192844 - DNA, 21 bp, Mus musculus
agatgtaagaagtggctctct

SEQ ID NO: 192845 - DNA, 23 bp, Mus musculus
tttcgtcttgttttcgtatgtat

SEQ ID NO: 192846 - DNA, 23 bp, Mus musculus
gtgtgtgtgtgcataagcatgag

SEQ ID NO: 192847 - DNA, 23 bp, Mus musculus
ctctgtgtgtgcatatgcttgtg

SEQ ID NO: 192848 - DNA, 23 bp, Mus musculus
tccatgacagacagtaaatgcag

SEQ ID NO: 192849 - DNA, 20 bp, Mus musculus
tatatgcaaatatatgtgtg

SEQ ID NO: 192850 - DNA, 23 bp, Mus musculus
aatgtctggctgtcagtctctgc

SEQ ID NO: 192851 - DNA, 21 bp, Mus musculus
ggaacacttcagtttttcatg

SEQ ID NO: 192852 - DNA, 23 bp, Mus musculus
tgggtcaggtagtaaaatgttaa

SEQ ID NO: 192853 - DNA, 22 bp, Mus musculus
tgttttgtgaccaattatatgg

SEQ ID NO: 192854 - DNA, 23 bp, Mus musculus
tgtcagtgactccctgagatctg

SEQ ID NO: 192855 - DNA, 21 bp, Mus musculus
aagtctgaggctgttcaatat

SEQ ID NO: 192856 - DNA, 23 bp, Mus musculus
caatgtatatatgtatatatgtg

SEQ ID NO: 192857 - DNA, 22 bp, Mus musculus
cacatatgtatatatgtatatg

SEQ ID NO: 192858 - DNA, 22 bp, Mus musculus
tgttttgtgaccaattatatgg

SEQ ID NO: 192859 - DNA, 21 bp, Mus musculus
gtgtatatgtgtatatgtgta

SEQ ID NO: 192860 - DNA, 18 bp, Mus musculus
tgtgcactacaattgata

SEQ ID NO: 192861 - DNA, 21 bp, Mus musculus
tctccatttccattcctgtaa

SEQ ID NO: 192862 - DNA, 23 bp, Mus musculus
tataagttcatatcatatcttag

SEQ ID NO: 192863 - DNA, 22 bp, Mus musculus
actctgtgcttagaataactct

SEQ ID NO: 192864 - DNA, 23 bp, Mus musculus
ttcattgtggatgctgggaatct

SEQ ID NO: 192865 - DNA, 23 bp, Mus musculus
atctgacttctctctcaggctct

SEQ ID NO: 192866 - DNA, 23 bp, Mus musculus
tgtatgtatatgtatatgtatat

SEQ ID NO: 192867 - DNA, 21 bp, Mus musculus
aagatgctttcagtccatgtt

SEQ ID NO: 192868 - DNA, 18 bp, Mus musculus
tgaagacttcagatcatt

SEQ ID NO: 192869 - DNA, 23 bp, Mus musculus
atgtacatatgtatgcatgtgtg

SEQ ID NO: 192870 - DNA, 23 bp, Mus musculus
tctgtctgtctgtctgtgtgtca

SEQ ID NO: 192871 - DNA, 23 bp, Mus musculus
ttcagctaggactttgtgagcct

SEQ ID NO: 192872 - DNA, 23 bp, Mus musculus
cccgtgtctgtctgtctgtcagc

SEQ ID NO: 192873 - DNA, 23 bp, Mus musculus
tcagtctcgctctctcagaagcc

SEQ ID NO: 192874 - DNA, 20 bp, Mus musculus
aaattgcctgtagatcttca

SEQ ID NO: 192875 - DNA, 22 bp, Mus musculus
gaaagtcatgtacaagtgagac

SEQ ID NO: 192876 - DNA, 22 bp, Mus musculus
atgacagagtggaatagcactg

SEQ ID NO: 192877 - DNA, 23 bp, Mus musculus
tggacatagtgtgttcacactgg

SEQ ID NO: 192878 - DNA, 23 bp, Mus musculus
attcactctcactgagccagtct

SEQ ID NO: 192879 - DNA, 23 bp, Mus musculus
agtgttgatgcttgactgtcgca

SEQ ID NO: 192880 - DNA, 21 bp, Mus musculus
cattcctgatgatttctctgt

SEQ ID NO: 192881 - DNA, 23 bp, Mus musculus
tgtatgtatgtatgtatgtatgt

SEQ ID NO: 192882 - DNA, 23 bp, Mus musculus
tgtctgtgactctaattgcaggg

SEQ ID NO: 192883 - DNA, 23 bp, Mus musculus
tatgcatatgtatgtatatatgt

SEQ ID NO: 192884 - DNA, 22 bp, Mus musculus
atatatgcacatgtaaatgtac

SEQ ID NO: 192885 - DNA, 20 bp, Mus musculus
gtgtgtctgagtctgtgctt

SEQ ID NO: 192886 - DNA, 23 bp, Mus musculus
gcatgtatgtgtgtatacatgca

SEQ ID NO: 192887 - DNA, 18 bp, Mus musculus
tctctgtgggtttcttgt

SEQ ID NO: 192888 - DNA, 23 bp, Mus musculus
tggaaatgatatgaatattttgt

SEQ ID NO: 192889 - DNA, 21 bp, Mus musculus
tgtgtatatatatatgtgtgt

SEQ ID NO: 192890 - DNA, 23 bp, Mus musculus
gtgttttggtgttcagtgagatg

SEQ ID NO: 192891 - DNA, 23 bp, Mus musculus
ctggcacacacacacagagcctg

SEQ ID NO: 192892 - DNA, 20 bp, Mus musculus
aagagcactgactgctcttc

SEQ ID NO: 192893 - DNA, 23 bp, Mus musculus
tggtagagtgactgcttaacatg

SEQ ID NO: 192894 - DNA, 23 bp, Mus musculus
tgagtgtgtctctcagttcttac

SEQ ID NO: 192895 - DNA, 23 bp, Mus musculus
gatttatgaagaagatgcctaac

SEQ ID NO: 192896 - DNA, 23 bp, Mus musculus
ctgtgtctctgtttagtttctgt

SEQ ID NO: 192897 - DNA, 23 bp, Mus musculus
atacagacagaagtttggtggaa

SEQ ID NO: 192898 - DNA, 23 bp, Mus musculus
tttcacttgagtttttgatcttg

SEQ ID NO: 192899 - DNA, 22 bp, Mus musculus
tattttgtgaccaagtatatgg

SEQ ID NO: 192900 - DNA, 23 bp, Mus musculus
atgagacacagacactgtacgtc

SEQ ID NO: 192901 - DNA, 23 bp, Mus musculus
ctgtctgtatgtctgtgtgtctt

SEQ ID NO: 192902 - DNA, 23 bp, Mus musculus
aggtgacagatcagacacagctc

SEQ ID NO: 192903 - DNA, 23 bp, Mus musculus
gtgtgcatgtgtgtgtgtatgta

SEQ ID NO: 192904 - DNA, 23 bp, Mus musculus
aagcatgtgcatgtatatgtgtg

SEQ ID NO: 192905 - DNA, 21 bp, Mus musculus
tgtctgggtgtaacagaggtt

SEQ ID NO: 192906 - DNA, 23 bp, Mus musculus
tctgtctgtatttctgtctgtgt

SEQ ID NO: 192907 - DNA, 23 bp, Mus musculus
taaaaaacagtttggagttaagt

SEQ ID NO: 192908 - DNA, 23 bp, Mus musculus
tctctgggtgtgtgtctctatat

SEQ ID NO: 192909 - DNA, 19 bp, Mus musculus
tatgtgtgtatgcaggtac

SEQ ID NO: 192910 - DNA, 21 bp, Mus musculus
tctctctctatctctctgtct

SEQ ID NO: 192911 - DNA, 23 bp, Mus musculus
ctctgtcagtctgtcatctacct

SEQ ID NO: 192912 - DNA, 23 bp, Mus musculus
agatctgagtgtgtactcattcc

SEQ ID NO: 192913 - DNA, 21 bp, Mus musculus
tctgtctctgactcagggcct

SEQ ID NO: 192914 - DNA, 23 bp, Mus musculus
atgaacaacagtgtcccagaagt

SEQ ID NO: 192915 - DNA, 23 bp, Mus musculus
tcactctcacactgaattgtcca

SEQ ID NO: 192916 - DNA, 19 bp, Mus musculus
acacacgcatggctaatct

SEQ ID NO: 192917 - DNA, 23 bp, Mus musculus
tagatagcattggcacctgtgtg

SEQ ID NO: 192918 - DNA, 19 bp, Mus musculus
agagtctctatctgacttg

SEQ ID NO: 192919 - DNA, 23 bp, Mus musculus
cctgtctgtttctctgtgtccat

SEQ ID NO: 192920 - DNA, 22 bp, Mus musculus
gttaaagaactcctgttggagt

SEQ ID NO: 192921 - DNA, 23 bp, Mus musculus
catattaattctatatgaaatgt

SEQ ID NO: 192922 - DNA, 20 bp, Mus musculus
tagaaagaagacagccagca

SEQ ID NO: 192923 - DNA, 22 bp, Mus musculus
tagactaagcagtttctcagcc

SEQ ID NO: 192924 - DNA, 21 bp, Mus musculus
tgagttgagtgagagcaggag

SEQ ID NO: 192925 - DNA, 23 bp, Mus musculus
atatgaatgcatgtgtatatgta

SEQ ID NO: 192926 - DNA, 23 bp, Mus musculus
tagaaggatgagtggatagatag

SEQ ID NO: 192927 - DNA, 23 bp, Mus musculus
gtgtgtgtgcgtgcctgcgtgtg

SEQ ID NO: 192928 - DNA, 23 bp, Mus musculus
gtgcatatctgctggtgccacag

SEQ ID NO: 192929 - DNA, 23 bp, Mus musculus
gtctgtgtgtctatgtgtctgtg

SEQ ID NO: 192930 - DNA, 23 bp, Mus musculus
gtgtgcatgtgtatgtgcatgag

SEQ ID NO: 192931 - DNA, 20 bp, Mus musculus
tgtgtatgatttgtgaatgt

SEQ ID NO: 192932 - DNA, 19 bp, Mus musculus
tgtgtatgtgtatataggc

SEQ ID NO: 192933 - DNA, 23 bp, Mus musculus
tcacttgtggcttcactcactgt

SEQ ID NO: 192934 - DNA, 23 bp, Mus musculus
tatgtatgtacatgtatatgcat

SEQ ID NO: 192935 - DNA, 23 bp, Mus musculus
tgcctgtgtgtatatgtacacat

SEQ ID NO: 192936 - DNA, 23 bp, Mus musculus
atgtatgtatacttgtatgtgta

SEQ ID NO: 192937 - DNA, 21 bp, Mus musculus
tgtgtatgtatatgcatatgt

SEQ ID NO: 192938 - DNA, 23 bp, Mus musculus
gtttccctgactctgtctttctg

SEQ ID NO: 192939 - DNA, 22 bp, Mus musculus
tatatgaatatatatatgtgtg

SEQ ID NO: 192940 - DNA, 19 bp, Mus musculus
tgttgtcccagagctgaag

SEQ ID NO: 192941 - DNA, 20 bp, Mus musculus
gaacagaactggagctacag

SEQ ID NO: 192942 - DNA, 21 bp, Mus musculus
gagtcaccagtgggtgctggg

SEQ ID NO: 192943 - DNA, 23 bp, Mus musculus
tacagacagttgtgagtcaccag

SEQ ID NO: 192944 - DNA, 23 bp, Mus musculus
agacagttgtgagtcaccagtgg

SEQ ID NO: 192945 - DNA, 21 bp, Mus musculus
agaaaactgcccattttcttc

SEQ ID NO: 192946 - DNA, 23 bp, Mus musculus
ggggtgtgtatgtgtctgtctct

SEQ ID NO: 192947 - DNA, 18 bp, Mus musculus
tgtctgagacagggtctg

SEQ ID NO: 192948 - DNA, 23 bp, Mus musculus
acagacactgcgtctctcagaga

SEQ ID NO: 192949 - DNA, 20 bp, Mus musculus
aagtatatatatatgtatgt

SEQ ID NO: 192950 - DNA, 23 bp, Mus musculus
atggaactctcactctcagtctg

SEQ ID NO: 192951 - DNA, 23 bp, Mus musculus
aaactgagtggcatggcacatgg

SEQ ID NO: 192952 - DNA, 23 bp, Mus musculus
tgtctgtctgtctgtcaatgtcc

SEQ ID NO: 192953 - DNA, 21 bp, Mus musculus
tctattggtgagaatggagta

SEQ ID NO: 192954 - DNA, 23 bp, Mus musculus
gtcacccactctcactgtgtgag

SEQ ID NO: 192955 - DNA, 22 bp, Mus musculus
cacgcagttcatgaagagcagt

SEQ ID NO: 192956 - DNA, 23 bp, Mus musculus
tacactcctaacttactctgact

SEQ ID NO: 192957 - DNA, 21 bp, Mus musculus
tccctgcctgcctctttgcat

SEQ ID NO: 192958 - DNA, 22 bp, Mus musculus
aaagggcttccaggtgaggatg

SEQ ID NO: 192959 - DNA, 23 bp, Mus musculus
aggaaacagttgtgtgtgtccac

SEQ ID NO: 192960 - DNA, 22 bp, Mus musculus
tagcagtggctagatgtacgga

SEQ ID NO: 192961 - DNA, 21 bp, Mus musculus
ttacagagagctgtgtgcttc

SEQ ID NO: 192962 - DNA, 23 bp, Mus musculus
atctgtgagagcagacagtgctc

SEQ ID NO: 192963 - DNA, 18 bp, Mus musculus
gacagtgctgtagctcac

SEQ ID NO: 192964 - DNA, 20 bp, Mus musculus
tgacagatctgacacaggca

SEQ ID NO: 192965 - DNA, 23 bp, Mus musculus
tgaatgtgactagacagccagac

SEQ ID NO: 192966 - DNA, 23 bp, Mus musculus
tgtgtttatcatgatctggtgca

SEQ ID NO: 192967 - DNA, 23 bp, Mus musculus
gactcccagtctcaaagtttaaa

SEQ ID NO: 192968 - DNA, 22 bp, Mus musculus
ctgagtgcagagtcagctgaga

SEQ ID NO: 192969 - DNA, 23 bp, Mus musculus
tcatcactgaaggaagtcaggac

SEQ ID NO: 192970 - DNA, 18 bp, Mus musculus
atgtatgtatgtatgtat

SEQ ID NO: 192971 - DNA, 23 bp, Mus musculus
tatctgtctctatttctaactgc

SEQ ID NO: 192972 - DNA, 23 bp, Mus musculus
acctctgactcactgtgcatgtt

SEQ ID NO: 192973 - DNA, 21 bp, Mus musculus
tatatgtatatgtgtatgcat

SEQ ID NO: 192974 - DNA, 21 bp, Mus musculus
tgtgatgttacagatggggaa

SEQ ID NO: 192975 - DNA, 23 bp, Mus musculus
agtagactgagacgacagagtct

SEQ ID NO: 192976 - DNA, 23 bp, Mus musculus
actccctgtctctgcctcactgc

SEQ ID NO: 192977 - DNA, 21 bp, Mus musculus
tctgtcagtcagctttacatg

SEQ ID NO: 192978 - DNA, 23 bp, Mus musculus
cagtgtgttctctgtctctcagc

SEQ ID NO: 192979 - DNA, 23 bp, Mus musculus
ctccctgtgtattgcggcagtcc

SEQ ID NO: 192980 - DNA, 23 bp, Mus musculus
aacacatgcagctttgtattgcg

SEQ ID NO: 192981 - DNA, 22 bp, Mus musculus
tctctgtctctgacattcttct

SEQ ID NO: 192982 - DNA, 23 bp, Mus musculus
aaggtagttgtgagccaggagag

SEQ ID NO: 192983 - DNA, 23 bp, Mus musculus
tgtctgcctcagtccctgccttg

SEQ ID NO: 192984 - DNA, 21 bp, Mus musculus
ctctgcctcagtcgctcgctg

SEQ ID NO: 192985 - DNA, 20 bp, Mus musculus
acagtgtagagagtgaggac

SEQ ID NO: 192986 - DNA, 23 bp, Mus musculus
gtctctcagtctctttatagtta

SEQ ID NO: 192987 - DNA, 23 bp, Mus musculus
ggctcagtctcactctgtctctg

SEQ ID NO: 192988 - DNA, 20 bp, Mus musculus
tgagggagcagtgtgaatga

SEQ ID NO: 192989 - DNA, 22 bp, Mus musculus
ctgtgcaagtgtgaggccctga

SEQ ID NO: 192990 - DNA, 20 bp, Mus musculus
gtcacccactcactggcaca

SEQ ID NO: 192991 - DNA, 22 bp, Mus musculus
tgtgtgtgagagagacagagac

SEQ ID NO: 192992 - DNA, 18 bp, Mus musculus
agggaagagactgtggtc

SEQ ID NO: 192993 - DNA, 23 bp, Mus musculus
atgtgtgtgcatgtatatgtgta

SEQ ID NO: 192994 - DNA, 22 bp, Mus musculus
atacatgtgcatgtgtgtacat

SEQ ID NO: 192995 - DNA, 23 bp, Mus musculus
ttgtcactacttcataactgtga

SEQ ID NO: 192996 - DNA, 20 bp, Mus musculus
ttttgtgaccaattatatgg

SEQ ID NO: 192997 - DNA, 20 bp, Mus musculus
atcgattgtctacatatgtg

SEQ ID NO: 192998 - DNA, 23 bp, Mus musculus
tgagtacttgtatgtatatatgt

SEQ ID NO: 192999 - DNA, 23 bp, Mus musculus
atgaatgtgtgcatgtgtgttta

SEQ ID NO: 193000 - DNA, 23 bp, Mus musculus
atgtgcatctatgtatatgttta

SEQ ID NO: 193001 - DNA, 23 bp, Mus musculus
agattgctgtgtcattttccagt

SEQ ID NO: 193002 - DNA, 23 bp, Mus musculus
tgtgtgtgtgtgtgcatgttcat

SEQ ID NO: 193003 - DNA, 22 bp, Mus musculus
atatatgttgttgtgaaagata

SEQ ID NO: 193004 - DNA, 19 bp, Mus musculus
ttcttttctcattctcttc

SEQ ID NO: 193005 - DNA, 23 bp, Mus musculus
catttctgacccattctgacagc

SEQ ID NO: 193006 - DNA, 23 bp, Mus musculus
atatcagaggctgctttcataaa

SEQ ID NO: 193007 - DNA, 23 bp, Mus musculus
agtcctttagaaagcaacccctt

SEQ ID NO: 193008 - DNA, 23 bp, Mus musculus
atatcagaggctgctttcataaa

SEQ ID NO: 193009 - DNA, 23 bp, Mus musculus
agtcctttagaaagcaacccctt

SEQ ID NO: 193010 - DNA, 23 bp, Mus musculus
acacagaggtttttgtttttgtt

SEQ ID NO: 193011 - DNA, 23 bp, Mus musculus
tgtaagtcatgtgattttcttga

SEQ ID NO: 193012 - DNA, 23 bp, Mus musculus
tgacatcacaagtcactggaaga

SEQ ID NO: 193013 - DNA, 22 bp, Mus musculus
gatttcagtgtctttgtcttga

SEQ ID NO: 193014 - DNA, 21 bp, Mus musculus
atgaccagactgagctgggtc

SEQ ID NO: 193015 - DNA, 18 bp, Mus musculus
aagagaataaattgggtt

SEQ ID NO: 193016 - DNA, 23 bp, Mus musculus
tgggaggctgcctgtttgacact

SEQ ID NO: 193017 - DNA, 18 bp, Mus musculus
acaggaccagatatccct

SEQ ID NO: 193018 - DNA, 18 bp, Mus musculus
acttgaggggctggagag

SEQ ID NO: 193019 - DNA, 23 bp, Mus musculus
atgtatgtatgtatgtatgtatg

SEQ ID NO: 193020 - DNA, 23 bp, Mus musculus
atgtatgcatgcatgtgcatgtg

SEQ ID NO: 193021 - DNA, 18 bp, Mus musculus
tagaacaggggctggaga

SEQ ID NO: 193022 - DNA, 23 bp, Mus musculus
gagagacccatgcttttcactga

SEQ ID NO: 193023 - DNA, 20 bp, Mus musculus
tgtgtgtctatctctgtgtg

SEQ ID NO: 193024 - DNA, 23 bp, Mus musculus
taacagtgagaagagagactggt

SEQ ID NO: 193025 - DNA, 21 bp, Mus musculus
gtatgtgcatttgcatgtgta

SEQ ID NO: 193026 - DNA, 23 bp, Mus musculus
tctctgagaaaggagattgagat

SEQ ID NO: 193027 - DNA, 23 bp, Mus musculus
cacacccagtctgtctccttctc

SEQ ID NO: 193028 - DNA, 20 bp, Mus musculus
gaagagagaaaattgcagtg

SEQ ID NO: 193029 - DNA, 23 bp, Mus musculus
gtgtgtctctgtctttctctgtg

SEQ ID NO: 193030 - DNA, 22 bp, Mus musculus
tcatactgcatctgcatttctg

SEQ ID NO: 193031 - DNA, 23 bp, Mus musculus
actctgcagtgtgtgtgtgtgtg

SEQ ID NO: 193032 - DNA, 21 bp, Mus musculus
gtgtgtgtgtgaggtgtcagc

SEQ ID NO: 193033 - DNA, 22 bp, Mus musculus
tggctgtcgattctatcactca

SEQ ID NO: 193034 - DNA, 23 bp, Mus musculus
tctgtgtcagtgataaaactcac

SEQ ID NO: 193035 - DNA, 23 bp, Mus musculus
taagtagttgtgggtggagtaga

SEQ ID NO: 193036 - DNA, 18 bp, Mus musculus
tttactgaggattccctt

SEQ ID NO: 193037 - DNA, 23 bp, Mus musculus
gaatggagatgcaggtcctctgt

SEQ ID NO: 193038 - DNA, 21 bp, Mus musculus
tttgcctgctttccctcactc

SEQ ID NO: 193039 - DNA, 23 bp, Mus musculus
ctgtctgtctgtctgtctgtctg

SEQ ID NO: 193040 - DNA, 19 bp, Mus musculus
gcaacttggaactgggctt

SEQ ID NO: 193041 - DNA, 20 bp, Mus musculus
ttaagcagcattgagaaccg

SEQ ID NO: 193042 - DNA, 23 bp, Mus musculus
taccagcattcagattcagaact

SEQ ID NO: 193043 - DNA, 23 bp, Mus musculus
ctcttcacactcagtcagggatc

SEQ ID NO: 193044 - DNA, 21 bp, Mus musculus
aactctgtgtccctgcttgag

SEQ ID NO: 193045 - DNA, 23 bp, Mus musculus
aaagaattcacagtccaagtcta

SEQ ID NO: 193046 - DNA, 18 bp, Mus musculus
agtgcttcattgatgaat

SEQ ID NO: 193047 - DNA, 23 bp, Mus musculus
aatacactagtctctgtctcagg

SEQ ID NO: 193048 - DNA, 21 bp, Mus musculus
tctgggactctctccctgcct

SEQ ID NO: 193049 - DNA, 21 bp, Mus musculus
taactgatgagtgtgcacact

SEQ ID NO: 193050 - DNA, 23 bp, Mus musculus
tgtctgtctgtatctcattatgc

SEQ ID NO: 193051 - DNA, 23 bp, Mus musculus
agcagagagtaatcagagagcag

SEQ ID NO: 193052 - DNA, 23 bp, Mus musculus
tctgtgtgtctcactctcagtag

SEQ ID NO: 193053 - DNA, 18 bp, Mus musculus
attgtaatctatttgtaa

SEQ ID NO: 193054 - DNA, 23 bp, Mus musculus
ggctctctcagtccctctcagaa

SEQ ID NO: 193055 - DNA, 23 bp, Mus musculus
atgtgtgtatgtgtatatgtgtg

SEQ ID NO: 193056 - DNA, 22 bp, Mus musculus
atgtatatgtatgtatatgtgt

SEQ ID NO: 193057 - DNA, 22 bp, Mus musculus
tttggcgcagtttaagtccact

SEQ ID NO: 193058 - DNA, 20 bp, Mus musculus
agtgggtcaggaactgcatc

SEQ ID NO: 193059 - DNA, 23 bp, Mus musculus
tatgtgtgtgtatatgtacatat

SEQ ID NO: 193060 - DNA, 23 bp, Mus musculus
atatatgtatttgtgcatttgta

SEQ ID NO: 193061 - DNA, 20 bp, Mus musculus
aaggtgcagtcagtgctgag

SEQ ID NO: 193062 - DNA, 18 bp, Mus musculus
tctctctctgtctgtctg

SEQ ID NO: 193063 - DNA, 23 bp, Mus musculus
tcactgtctgcttgttgtcagtg

SEQ ID NO: 193064 - DNA, 18 bp, Mus musculus
attatgctctattgcaag

SEQ ID NO: 193065 - DNA, 23 bp, Mus musculus
gtctctgtgtctgtgtgtctttg

SEQ ID NO: 193066 - DNA, 22 bp, Mus musculus
agagtctgtagaaagtgaggac

SEQ ID NO: 193067 - DNA, 22 bp, Mus musculus
ggcagacactctcagccactga

SEQ ID NO: 193068 - DNA, 23 bp, Mus musculus
atcctagttgattctgcttgctt

SEQ ID NO: 193069 - DNA, 19 bp, Mus musculus
tgggcatggactgtcacat

SEQ ID NO: 193070 - DNA, 23 bp, Mus musculus
ctgtgtgtgtctcagtcacccag

SEQ ID NO: 193071 - DNA, 23 bp, Mus musculus
tcttggttgtagtgtttgcttgt

SEQ ID NO: 193072 - DNA, 23 bp, Mus musculus
tgtggcagaagtcaccaggagct

SEQ ID NO: 193073 - DNA, 23 bp, Mus musculus
ccacctctaagtctccctcactt

SEQ ID NO: 193074 - DNA, 21 bp, Mus musculus
taacgtaggaaagcctttgaa

SEQ ID NO: 193075 - DNA, 22 bp, Mus musculus
tttagtgctgtgtgcgtgaaca

SEQ ID NO: 193076 - DNA, 23 bp, Mus musculus
agacacctcaggatatgtgtggg

SEQ ID NO: 193077 - DNA, 23 bp, Mus musculus
tatttccaccataggaatgggtt

SEQ ID NO: 193078 - DNA, 22 bp, Mus musculus
tctcactgttgtttgcacttgg

SEQ ID NO: 193079 - DNA, 18 bp, Mus musculus
tccacagtttgccagttg

SEQ ID NO: 193080 - DNA, 18 bp, Mus musculus
cagaagttagctggttgt

SEQ ID NO: 193081 - DNA, 21 bp, Mus musculus
tcaggaagtctgtgtgtctca

SEQ ID NO: 193082 - DNA, 23 bp, Mus musculus
tctgtctgtctgtctgtcttcag

SEQ ID NO: 193083 - DNA, 22 bp, Mus musculus
tgttttgtgaccaattatatgg

SEQ ID NO: 193084 - DNA, 23 bp, Mus musculus
tgccacacacagagtgtgtccct

SEQ ID NO: 193085 - DNA, 21 bp, Mus musculus
ggtttgtatggtagtctctcc

SEQ ID NO: 193086 - DNA, 23 bp, Mus musculus
atcacagatcacactctgcagtg

SEQ ID NO: 193087 - DNA, 20 bp, Mus musculus
tgaatgatgtgtgtgtgcac

SEQ ID NO: 193088 - DNA, 23 bp, Mus musculus
acatttgttcctccactctgagg

SEQ ID NO: 193089 - DNA, 23 bp, Mus musculus
acttcctttctaaagagaattca

SEQ ID NO: 193090 - DNA, 22 bp, Mus musculus
aggcagtgaaattagcagaatg

SEQ ID NO: 193091 - DNA, 21 bp, Mus musculus
tgcagcaggaattgggtgtct

SEQ ID NO: 193092 - DNA, 23 bp, Mus musculus
cctcactgtctctctgtcaggaa

SEQ ID NO: 193093 - DNA, 20 bp, Mus musculus
tctctgtgactgactgggtg

SEQ ID NO: 193094 - DNA, 23 bp, Mus musculus
tcccagtcagtcagtaaggtgtg

SEQ ID NO: 193095 - DNA, 23 bp, Mus musculus
tgcctctctcactgtctctatgc

SEQ ID NO: 193096 - DNA, 23 bp, Mus musculus
gtgcatgtgtgtgtgtgtgtgtg

SEQ ID NO: 193097 - DNA, 23 bp, Mus musculus
gctcagtgtgcctgtgactcagt

SEQ ID NO: 193098 - DNA, 23 bp, Mus musculus
tttgcctgctgaagttggcatgt

SEQ ID NO: 193099 - DNA, 23 bp, Mus musculus
agatgagggttctctgaaacgtg

SEQ ID NO: 193100 - DNA, 23 bp, Mus musculus
ccctgcctgtgtgcctgtgtgcc

SEQ ID NO: 193101 - DNA, 23 bp, Mus musculus
attatgtacatacatatgtgtgt

SEQ ID NO: 193102 - DNA, 23 bp, Mus musculus
tatgtgtatgtatataagtatgt

SEQ ID NO: 193103 - DNA, 23 bp, Mus musculus
caatctcagaaatcagtgaggac

SEQ ID NO: 193104 - DNA, 23 bp, Mus musculus
cactgcacacacagtctcacagc

SEQ ID NO: 193105 - DNA, 19 bp, Mus musculus
atacatgtacacatacaca

SEQ ID NO: 193106 - DNA, 23 bp, Mus musculus
tggagatttagtgatatacatgt

SEQ ID NO: 193107 - DNA, 20 bp, Mus musculus
tatgtgtgtctgtgtgttat

SEQ ID NO: 193108 - DNA, 18 bp, Mus musculus
agagagattgcaaagaca

SEQ ID NO: 193109 - DNA, 21 bp, Mus musculus
aagtcagtttctatatgtgtg

SEQ ID NO: 193110 - DNA, 23 bp, Mus musculus
agagcagatgtaggtcatcagga

SEQ ID NO: 193111 - DNA, 22 bp, Mus musculus
ctgggtgcctgggtcccactgt

SEQ ID NO: 193112 - DNA, 23 bp, Mus musculus
tcaatgccaatggaagatctgac

SEQ ID NO: 193113 - DNA, 22 bp, Mus musculus
tgttttgtgaccaattatatgg

SEQ ID NO: 193114 - DNA, 18 bp, Mus musculus
cctctgagccatagctga

SEQ ID NO: 193115 - DNA, 23 bp, Mus musculus
tattgctgtcactgtagggagtg

SEQ ID NO: 193116 - DNA, 21 bp, Mus musculus
atatgtgcatgtgtatatgtg

SEQ ID NO: 193117 - DNA, 21 bp, Mus musculus
atatgcatgtatgtatgtatg

SEQ ID NO: 193118 - DNA, 23 bp, Mus musculus
gcatgcatgtatgtatgtatgta

SEQ ID NO: 193119 - DNA, 23 bp, Mus musculus
gtgaacacactgtccagtgaccc

SEQ ID NO: 193120 - DNA, 22 bp, Mus musculus
cagtgtgagcacactatgtcag

SEQ ID NO: 193121 - DNA, 18 bp, Mus musculus
tatccttcaggacagcaa

SEQ ID NO: 193122 - DNA, 22 bp, Mus musculus
atgcacaggggctggagagatg

SEQ ID NO: 193123 - DNA, 22 bp, Mus musculus
ataattagtttcctgtttccat

SEQ ID NO: 193124 - DNA, 22 bp, Mus musculus
tctgctacttgtaatcagagag

SEQ ID NO: 193125 - DNA, 23 bp, Mus musculus
actctctctgtctctgcttcgag

SEQ ID NO: 193126 - DNA, 23 bp, Mus musculus
actctctctgtctctgcttcgag

SEQ ID NO: 193127 - DNA, 23 bp, Mus musculus
tgtcactcacactgtcttgtctg

SEQ ID NO: 193128 - DNA, 23 bp, Mus musculus
gtgtgtctgtctgtctgtccctg

SEQ ID NO: 193129 - DNA, 20 bp, Mus musculus
tgcatgtatgtatgtatgta

SEQ ID NO: 193130 - DNA, 23 bp, Mus musculus
tgtatatgtatatgtatatgtgt

SEQ ID NO: 193131 - DNA, 21 bp, Mus musculus
tggtctgataggatgattggg

SEQ ID NO: 193132 - DNA, 22 bp, Mus musculus
tgttttgtgaccaattatatgg

SEQ ID NO: 193133 - DNA, 22 bp, Mus musculus
tattacacagatgtacatatgt

SEQ ID NO: 193134 - DNA, 23 bp, Mus musculus
tgtgtgtgtgtgtgtatccacat

SEQ ID NO: 193135 - DNA, 23 bp, Mus musculus
cactgtgtgagtctgacataggt

SEQ ID NO: 193136 - DNA, 21 bp, Mus musculus
tgtgagtctgacataggtcct

SEQ ID NO: 193137 - DNA, 23 bp, Mus musculus
gtttgtgtgcatgtgcatatgtg

SEQ ID NO: 193138 - DNA, 23 bp, Mus musculus
ccttcagctcgggctcctcgcac

SEQ ID NO: 193139 - DNA, 19 bp, Mus musculus
tgtgtgtatatatgtatgt

SEQ ID NO: 193140 - DNA, 23 bp, Mus musculus
attgtgtgtttacatatgtgtgt

SEQ ID NO: 193141 - DNA, 21 bp, Mus musculus
atgtgtgtttatatatgtgtg

SEQ ID NO: 193142 - DNA, 18 bp, Mus musculus
actgatttacaagccgaa

SEQ ID NO: 193143 - DNA, 23 bp, Mus musculus
aaaaggaatgtattgagttgctt

SEQ ID NO: 193144 - DNA, 22 bp, Mus musculus
actgctggattttgtttctgct

SEQ ID NO: 193145 - DNA, 23 bp, Mus musculus
tgactgtggctgtgactgtggct

SEQ ID NO: 193146 - DNA, 23 bp, Mus musculus
ttctcttctctctgtgtgtgcca

SEQ ID NO: 193147 - DNA, 22 bp, Mus musculus
tgttttgtgaccaattatatgg

SEQ ID NO: 193148 - DNA, 23 bp, Mus musculus
atgtatgtattgtgtatgtgtag

SEQ ID NO: 193149 - DNA, 23 bp, Mus musculus
tatgtgcaagtacatgtgtgtgt

SEQ ID NO: 193150 - DNA, 20 bp, Mus musculus
atgtatgtatatatgtgtat

SEQ ID NO: 193151 - DNA, 18 bp, Mus musculus
tgtgatgatccagaccag

SEQ ID NO: 193152 - DNA, 23 bp, Mus musculus
acaggtctgagagcagacactga

SEQ ID NO: 193153 - DNA, 23 bp, Mus musculus
tgtgtctctgtgtgtatagatga

SEQ ID NO: 193154 - DNA, 23 bp, Mus musculus
actgtctctgagtgcgtgtgagt

SEQ ID NO: 193155 - DNA, 20 bp, Mus musculus
tacagtgacatactcctctg

SEQ ID NO: 193156 - DNA, 22 bp, Mus musculus
ttgaaaggaattgaatacagtg

SEQ ID NO: 193157 - DNA, 21 bp, Mus musculus
tatggtggtagaaagggctgt

SEQ ID NO: 193158 - DNA, 21 bp, Mus musculus
agcccctttattttccagatt

SEQ ID NO: 193159 - DNA, 19 bp, Mus musculus
ctttattcctcaaattcca

SEQ ID NO: 193160 - DNA, 22 bp, Mus musculus
gtgtgcatgtatgtgtgtgtat

SEQ ID NO: 193161 - DNA, 23 bp, Mus musculus
tatgtgtgcatgtgtatatgtat

SEQ ID NO: 193162 - DNA, 20 bp, Mus musculus
atgcacgatttaattgaact

SEQ ID NO: 193163 - DNA, 23 bp, Mus musculus
tatgcatgcatgcatgtatgtat

SEQ ID NO: 193164 - DNA, 22 bp, Mus musculus
ttctgagggaggagactaacac

SEQ ID NO: 193165 - DNA, 19 bp, Mus musculus
agtgtctctgcctctctcc

SEQ ID NO: 193166 - DNA, 22 bp, Mus musculus
agagttgaaggagaaggctgag

SEQ ID NO: 193167 - DNA, 23 bp, Mus musculus
tccgtgtctctgtatgttctttt

SEQ ID NO: 193168 - DNA, 19 bp, Mus musculus
ttcaaatctcagcaaccac

SEQ ID NO: 193169 - DNA, 23 bp, Mus musculus
tgcctgcctctgtctctcaagtg

SEQ ID NO: 193170 - DNA, 23 bp, Mus musculus
gactctgacactggctctcagca

SEQ ID NO: 193171 - DNA, 23 bp, Mus musculus
tgctactcagtctggttgatgta

SEQ ID NO: 193172 - DNA, 23 bp, Mus musculus
taatttcttatactgcaggtagt

SEQ ID NO: 193173 - DNA, 20 bp, Mus musculus
tcccacagactcatatttct

SEQ ID NO: 193174 - DNA, 20 bp, Mus musculus
cagtcacatgtctggcccac

SEQ ID NO: 193175 - DNA, 21 bp, Mus musculus
aggaatggatagatgaatgaa

SEQ ID NO: 193176 - DNA, 18 bp, Mus musculus
tatctcgtgaatggtgtt

SEQ ID NO: 193177 - DNA, 23 bp, Mus musculus
tctgtctacagagtgcctgtcca

SEQ ID NO: 193178 - DNA, 23 bp, Mus musculus
ctgtctgcctgtctgcctgtctg

SEQ ID NO: 193179 - DNA, 22 bp, Mus musculus
tctgacacacagcctatttagt

SEQ ID NO: 193180 - DNA, 21 bp, Mus musculus
ttcggggactctttctgcaga

SEQ ID NO: 193181 - DNA, 21 bp, Mus musculus
agctggagagatagttcagtg

SEQ ID NO: 193182 - DNA, 23 bp, Mus musculus
agagaactgatttacttgctgtt

SEQ ID NO: 193183 - DNA, 21 bp, Mus musculus
tggaatgtatatatgtgtgta

SEQ ID NO: 193184 - DNA, 22 bp, Mus musculus
agctctgggtgggagcttgcct

SEQ ID NO: 193185 - DNA, 22 bp, Mus musculus
tattggagtgactgagcagaga

SEQ ID NO: 193186 - DNA, 23 bp, Mus musculus
tctgtgagtctgaagcctgagag

SEQ ID NO: 193187 - DNA, 23 bp, Mus musculus
gtgcagatcatcgtgaactctga

SEQ ID NO: 193188 - DNA, 21 bp, Mus musculus
ttttacatctaatggcaatgt

SEQ ID NO: 193189 - DNA, 20 bp, Mus musculus
tacgtacatcaacagcagtt

SEQ ID NO: 193190 - DNA, 18 bp, Mus musculus
tctgtctctgtctcactc

SEQ ID NO: 193191 - DNA, 22 bp, Mus musculus
tattttgtgaccaattatatgg

SEQ ID NO: 193192 - DNA, 23 bp, Mus musculus
agaagtgagagcagagagagccc

SEQ ID NO: 193193 - DNA, 23 bp, Mus musculus
ttcatcctgcatctccttcacct

SEQ ID NO: 193194 - DNA, 23 bp, Mus musculus
tagtgcatggtgatctgatagga

SEQ ID NO: 193195 - DNA, 22 bp, Mus musculus
tgttttgtgacctattatgtgg

SEQ ID NO: 193196 - DNA, 23 bp, Mus musculus
tagtgcatggtgatctgatagga

SEQ ID NO: 193197 - DNA, 22 bp, Mus musculus
tctcagcatcacaggatcccag

SEQ ID NO: 193198 - DNA, 23 bp, Mus musculus
tagtgcatggtgatctgatagga

SEQ ID NO: 193199 - DNA, 22 bp, Mus musculus
tgttttgtgacctattatgtgg

SEQ ID NO: 193200 - DNA, 22 bp, Mus musculus
tgttttgtgaccaattatatgg

SEQ ID NO: 193201 - DNA, 20 bp, Mus musculus
tttctgtgtggatgtgtatg

SEQ ID NO: 193202 - DNA, 18 bp, Mus musculus
atatgtgtgcttgtcttg

SEQ ID NO: 193203 - DNA, 23 bp, Mus musculus
tgtttctttatgtatgtatataa

SEQ ID NO: 193204 - DNA, 21 bp, Mus musculus
tagtatgtatttaagtatgca

SEQ ID NO: 193205 - DNA, 23 bp, Mus musculus
agatgcctcacagaatgtgagtg

SEQ ID NO: 193206 - DNA, 20 bp, Mus musculus
aatgtgttgacaaaggaaat

SEQ ID NO: 193207 - DNA, 23 bp, Mus musculus
agtgtctcagtgactgttttctc

SEQ ID NO: 193208 - DNA, 20 bp, Mus musculus
tattgtgcacatcaacttca

SEQ ID NO: 193209 - DNA, 23 bp, Mus musculus
taagtggatccttttcatgtctc

SEQ ID NO: 193210 - DNA, 22 bp, Mus musculus
tgttttgtgaccaattatatgg

SEQ ID NO: 193211 - DNA, 23 bp, Mus musculus
tagttcatgatgatctgatagga

SEQ ID NO: 193212 - DNA, 21 bp, Mus musculus
atgatagatggaggctttgct

SEQ ID NO: 193213 - DNA, 22 bp, Mus musculus
tgttttgtgaccaattatatgg

SEQ ID NO: 193214 - DNA, 23 bp, Mus musculus
tgtcactgtccctgtactatgca

SEQ ID NO: 193215 - DNA, 23 bp, Mus musculus
ctatgtagtacagcttgaggtca

SEQ ID NO: 193216 - DNA, 22 bp, Mus musculus
tgttttgtgaccaattatatgg

SEQ ID NO: 193217 - DNA, 23 bp, Mus musculus
atttttgtatctgttgagtcctg

SEQ ID NO: 193218 - DNA, 20 bp, Mus musculus
atggtacatttttatgccat

SEQ ID NO: 193219 - DNA, 21 bp, Mus musculus
tttagtccatcgtgatctgat

SEQ ID NO: 193220 - DNA, 22 bp, Mus musculus
tatgtgtgtatgtatgtgtgtg

SEQ ID NO: 193221 - DNA, 23 bp, Mus musculus
tgagtctctcagacattcatgtg

SEQ ID NO: 193222 - DNA, 19 bp, Mus musculus
gtgtacatatgtatatgta

SEQ ID NO: 193223 - DNA, 20 bp, Mus musculus
acacaggtgagagtgtggac

SEQ ID NO: 193224 - DNA, 22 bp, Mus musculus
acaaatgtgcaagtatgtttat

SEQ ID NO: 193225 - DNA, 18 bp, Mus musculus
tatactgtgtatgtatat

SEQ ID NO: 193226 - DNA, 23 bp, Mus musculus
tcactcagtccagtggctgcgtt

SEQ ID NO: 193227 - DNA, 23 bp, Mus musculus
accctctgggtccctttgtctgt

SEQ ID NO: 193228 - DNA, 23 bp, Mus musculus
tgtgtatgtatatgtatgtgtat

SEQ ID NO: 193229 - DNA, 20 bp, Mus musculus
ctgtgtgtgtagtgtatgtg

SEQ ID NO: 193230 - DNA, 18 bp, Mus musculus
tgctgactgctcttccag

SEQ ID NO: 193231 - DNA, 22 bp, Mus musculus
aatctcagggattctcctgtgt

SEQ ID NO: 193232 - DNA, 23 bp, Mus musculus
ttgacagtagaatctctgacatt

SEQ ID NO: 193233 - DNA, 23 bp, Mus musculus
gacagatgagagacagctctgaa

SEQ ID NO: 193234 - DNA, 23 bp, Mus musculus
atgaatgtatgtatgtatgtatg

SEQ ID NO: 193235 - DNA, 23 bp, Mus musculus
cacactcatcctgtctctcactg

SEQ ID NO: 193236 - DNA, 21 bp, Mus musculus
agtcatgttcctggaggcagt

SEQ ID NO: 193237 - DNA, 20 bp, Mus musculus
gctctgcctctgtgtctctg

SEQ ID NO: 193238 - DNA, 20 bp, Mus musculus
tgtgtgtgtgggtgggtgcg

SEQ ID NO: 193239 - DNA, 20 bp, Mus musculus
actttctgagggcacattcc

SEQ ID NO: 193240 - DNA, 20 bp, Mus musculus
gagctcacagcgtccagagt

SEQ ID NO: 193241 - DNA, 18 bp, Mus musculus
tgactcctaaaggtgtcg

SEQ ID NO: 193242 - DNA, 19 bp, Mus musculus
tgtatgagtgtttatgtac

SEQ ID NO: 193243 - DNA, 19 bp, Mus musculus
atgagcatgcggtacctgt

SEQ ID NO: 193244 - DNA, 23 bp, Mus musculus
tgtgtgtgtctgtctatcttatc

SEQ ID NO: 193245 - DNA, 22 bp, Mus musculus
aaccacagtgctcttgctgtgt

SEQ ID NO: 193246 - DNA, 22 bp, Mus musculus
tttgagacagagagtttctggt

SEQ ID NO: 193247 - DNA, 23 bp, Mus musculus
tcagtgtctgtttctctcaaagg

SEQ ID NO: 193248 - DNA, 23 bp, Mus musculus
tatacgttgtatatatacgtatg

SEQ ID NO: 193249 - DNA, 23 bp, Mus musculus
aaaggaggatttattttcgctca

SEQ ID NO: 193250 - DNA, 23 bp, Mus musculus
gtggggaatgttgactctcctgg

SEQ ID NO: 193251 - DNA, 23 bp, Mus musculus
tgtgtcactgggtttgaggcttc

SEQ ID NO: 193252 - DNA, 22 bp, Mus musculus
caagccagtctcactggctctc

SEQ ID NO: 193253 - DNA, 18 bp, Mus musculus
aagaaggagagagacaaa

SEQ ID NO: 193254 - DNA, 23 bp, Mus musculus
ctcagtctctctttctgttcagt

SEQ ID NO: 193255 - DNA, 18 bp, Mus musculus
aaacagtgaccagtcagg

SEQ ID NO: 193256 - DNA, 23 bp, Mus musculus
gctgtcagtagtgattttgatgt

SEQ ID NO: 193257 - DNA, 22 bp, Mus musculus
ctgtggatgacttgtgttttag

SEQ ID NO: 193258 - DNA, 20 bp, Mus musculus
acttgtagactgggtggtgt

SEQ ID NO: 193259 - DNA, 22 bp, Mus musculus
tccaaggatctagaaagccatg

SEQ ID NO: 193260 - DNA, 23 bp, Mus musculus
ctttcagtccgatgtttagtcca

SEQ ID NO: 193261 - DNA, 19 bp, Mus musculus
tgtatatatatatatgtgt

SEQ ID NO: 193262 - DNA, 23 bp, Mus musculus
ttgtctgtggctgatttgtgtct

SEQ ID NO: 193263 - DNA, 23 bp, Mus musculus
agtcacagggaattcagaatcac

SEQ ID NO: 193264 - DNA, 21 bp, Mus musculus
tgtcagcacactgtgagctca

SEQ ID NO: 193265 - DNA, 23 bp, Mus musculus
accagagcaatgtagagaggccc

SEQ ID NO: 193266 - DNA, 23 bp, Mus musculus
tgcgtcacacagtgactcagtgc

SEQ ID NO: 193267 - DNA, 23 bp, Mus musculus
ttgggtgtggtagtacacagatt

SEQ ID NO: 193268 - DNA, 23 bp, Mus musculus
ggttgatgtagtcctgccgctct

SEQ ID NO: 193269 - DNA, 22 bp, Mus musculus
aggtagttattgtcctgccgaa

SEQ ID NO: 193270 - DNA, 23 bp, Mus musculus
taatactgccgggtaatgatgga

SEQ ID NO: 193271 - DNA, 23 bp, Mus musculus
tctgggtccatcttccagtgcag

SEQ ID NO: 193272 - DNA, 23 bp, Mus musculus
taacactgtctggtaaagatggc

SEQ ID NO: 193273 - DNA, 21 bp, Mus musculus
actcagtgtaactctgtctcg

SEQ ID NO: 193274 - DNA, 20 bp, Mus musculus
ttgccttggtcatggtgtct

SEQ ID NO: 193275 - DNA, 18 bp, Mus musculus
cagggtctcactttgtag

SEQ ID NO: 193276 - DNA, 23 bp, Mus musculus
tctgcctttctctctgtctcacc

SEQ ID NO: 193277 - DNA, 20 bp, Mus musculus
tatcaatgcctgttcttttt

SEQ ID NO: 193278 - DNA, 22 bp, Mus musculus
tgaggtactccgatgtgtagtt

SEQ ID NO: 193279 - DNA, 20 bp, Mus musculus
cagacactagatttctgttt

SEQ ID NO: 193280 - DNA, 22 bp, Mus musculus
gtctctcactgcctgtgagagt

SEQ ID NO: 193281 - DNA, 23 bp, Mus musculus
acttaggtgctgtgactcttcag

SEQ ID NO: 193282 - DNA, 23 bp, Mus musculus
taatgaggacaaaggttttaaga

SEQ ID NO: 193283 - DNA, 22 bp, Mus musculus
agtgaggattggtataaaatgt

SEQ ID NO: 193284 - DNA, 20 bp, Mus musculus
tatgtgtgagccatagatgt

SEQ ID NO: 193285 - DNA, 22 bp, Mus musculus
tgttttgtgaccaattatatgg

SEQ ID NO: 193286 - DNA, 19 bp, Mus musculus
taggtgtctctggctggag

SEQ ID NO: 193287 - DNA, 18 bp, Mus musculus
taacactgcaagatatat

SEQ ID NO: 193288 - DNA, 23 bp, Mus musculus
tctcctagagtcagcaagacatc

SEQ ID NO: 193289 - DNA, 23 bp, Mus musculus
cttctgtctctgagagtctctgt

SEQ ID NO: 193290 - DNA, 23 bp, Mus musculus
tcagtggctctgtgcttctgtct

SEQ ID NO: 193291 - DNA, 23 bp, Mus musculus
cactgtggtagagtattgctttg

SEQ ID NO: 193292 - DNA, 23 bp, Mus musculus
cactgtggtagagtattgctttg

SEQ ID NO: 193293 - DNA, 23 bp, Mus musculus
atatatgcatatatatatgtaac

SEQ ID NO: 193294 - DNA, 23 bp, Mus musculus
agcacagggaactctgctgttgt

SEQ ID NO: 193295 - DNA, 23 bp, Mus musculus
ctgtggatgtatgtatgtatgta

SEQ ID NO: 193296 - DNA, 23 bp, Mus musculus
atctatctacatatctatctatg

SEQ ID NO: 193297 - DNA, 22 bp, Mus musculus
tatgcatgtatgtatgtatgta

SEQ ID NO: 193298 - DNA, 18 bp, Mus musculus
gatgtatgtatgtatgta

SEQ ID NO: 193299 - DNA, 22 bp, Mus musculus
tatgcatgtatgtatgtatgca

SEQ ID NO: 193300 - DNA, 23 bp, Mus musculus
atgtatgcatgcatgtgtgtatg

SEQ ID NO: 193301 - DNA, 21 bp, Mus musculus
tatgcatgtatgtatgtatgt

SEQ ID NO: 193302 - DNA, 23 bp, Mus musculus
gaatgagaatagagagagtggac

SEQ ID NO: 193303 - DNA, 18 bp, Mus musculus
acatctgtgtatgcacat

SEQ ID NO: 193304 - DNA, 23 bp, Mus musculus
gtatatgtgcatgtgcttgtgct

SEQ ID NO: 193305 - DNA, 18 bp, Mus musculus
tgaatttctggagttcag

SEQ ID NO: 193306 - DNA, 22 bp, Mus musculus
tgctctacactctgtctctgta

SEQ ID NO: 193307 - DNA, 23 bp, Mus musculus
ctctgtgcctcagtttcttcagt

SEQ ID NO: 193308 - DNA, 23 bp, Mus musculus
tctctcagcctcagtgtcatgcc

SEQ ID NO: 193309 - DNA, 18 bp, Mus musculus
tgtgcatgtgtgtgtgtg

SEQ ID NO: 193310 - DNA, 22 bp, Mus musculus
acagtacacactgagcttggta

SEQ ID NO: 193311 - DNA, 23 bp, Mus musculus
acactgtacacactgagcttggt

SEQ ID NO: 193312 - DNA, 23 bp, Mus musculus
tgtccctctgataagccatctct

SEQ ID NO: 193313 - DNA, 23 bp, Mus musculus
acagagagttgtgagccagcact

SEQ ID NO: 193314 - DNA, 23 bp, Mus musculus
tggaaatcaaacctctgcaagaa

SEQ ID NO: 193315 - DNA, 23 bp, Mus musculus
agtcacacacgttatcgtgtgtt

SEQ ID NO: 193316 - DNA, 21 bp, Mus musculus
tggatgggtggctgtaaggta

SEQ ID NO: 193317 - DNA, 23 bp, Mus musculus
agaactgacaggacatggacctc

SEQ ID NO: 193318 - DNA, 23 bp, Mus musculus
ggtgaggtagctgtttgaggtat

SEQ ID NO: 193319 - DNA, 23 bp, Mus musculus
tatatagttgtcctggagctcag

SEQ ID NO: 193320 - DNA, 23 bp, Mus musculus
acatacattatgtacctgtttgt

SEQ ID NO: 193321 - DNA, 23 bp, Mus musculus
atgtatgtatgcatgtgtgtatg

SEQ ID NO: 193322 - DNA, 22 bp, Mus musculus
gcactgactgctcttccagagg

SEQ ID NO: 193323 - DNA, 22 bp, Mus musculus
gcactgactgctcttccagagg

SEQ ID NO: 193324 - DNA, 23 bp, Mus musculus
tgagtacactgtagctgtactga

SEQ ID NO: 193325 - DNA, 23 bp, Mus musculus
aagcctgtagctgtcattctctc

SEQ ID NO: 193326 - DNA, 23 bp, Mus musculus
tgacccagggactttgtgttgtc

SEQ ID NO: 193327 - DNA, 22 bp, Mus musculus
atgtatgtatatatgtatgtat

SEQ ID NO: 193328 - DNA, 23 bp, Mus musculus
atatgtgtatatgtatatatgtg

SEQ ID NO: 193329 - DNA, 23 bp, Mus musculus
gctacgctcactcgctgcctcac

SEQ ID NO: 193330 - DNA, 23 bp, Mus musculus
aactctcaggtcacactcacttc

SEQ ID NO: 193331 - DNA, 23 bp, Mus musculus
gggagagaattcagagtagggac

SEQ ID NO: 193332 - DNA, 23 bp, Mus musculus
actgccagtctcagagattctga

SEQ ID NO: 193333 - DNA, 23 bp, Mus musculus
gagatctcagtagttgagatatc

SEQ ID NO: 193334 - DNA, 23 bp, Mus musculus
cttgaaggtcactctctgtgtgc

SEQ ID NO: 193335 - DNA, 20 bp, Mus musculus
tgtgcatgtatataatatgt

SEQ ID NO: 193336 - DNA, 23 bp, Mus musculus
tgtgtgcatatgtgtgtgcatgt

SEQ ID NO: 193337 - DNA, 20 bp, Mus musculus
cttctgagtgtctcttgtct

SEQ ID NO: 193338 - DNA, 23 bp, Mus musculus
gatgctcagtatacagtgtggag

SEQ ID NO: 193339 - DNA, 23 bp, Mus musculus
acaatatatatgaagtgggtatg

SEQ ID NO: 193340 - DNA, 23 bp, Mus musculus
tgtgtgcctgtctgcctgttttc

SEQ ID NO: 193341 - DNA, 23 bp, Mus musculus
cactcactcactcatatgcgagc

SEQ ID NO: 193342 - DNA, 21 bp, Mus musculus
atacaccttggcaagtgtgtg

SEQ ID NO: 193343 - DNA, 19 bp, Mus musculus
acacatgagacagtgcact

SEQ ID NO: 193344 - DNA, 23 bp, Mus musculus
gtttgatgcagtgcttcagaagt

SEQ ID NO: 193345 - DNA, 20 bp, Mus musculus
tgactgcagagcgtgagctc

SEQ ID NO: 193346 - DNA, 19 bp, Mus musculus
tggagctttgcatgtttgt

SEQ ID NO: 193347 - DNA, 23 bp, Mus musculus
acagaagaagtttgcattgtatg

SEQ ID NO: 193348 - DNA, 23 bp, Mus musculus
cactctgagtctctgtgtttcca

SEQ ID NO: 193349 - DNA, 23 bp, Mus musculus
gtgtgcgtgtgtgtatgcattgt

SEQ ID NO: 193350 - DNA, 23 bp, Mus musculus
gtatgtatgtatgtatatatgta

SEQ ID NO: 193351 - DNA, 20 bp, Mus musculus
acatgtgtatgtatgtgtgt

SEQ ID NO: 193352 - DNA, 23 bp, Mus musculus
gcactgactgctcttcctgaggt

SEQ ID NO: 193353 - DNA, 19 bp, Mus musculus
acagagtgagccgttgtga

SEQ ID NO: 193354 - DNA, 23 bp, Mus musculus
tctcttcagtcacactctgtctt

SEQ ID NO: 193355 - DNA, 23 bp, Mus musculus
tcacttcctctctgagtcctttg

SEQ ID NO: 193356 - DNA, 18 bp, Mus musculus
tgagaagccagagagcac

SEQ ID NO: 193357 - DNA, 23 bp, Mus musculus
tggctcagaatgaagcttgttta

SEQ ID NO: 193358 - DNA, 23 bp, Mus musculus
tttgtgagtgggaatgttctgcc

SEQ ID NO: 193359 - DNA, 23 bp, Mus musculus
taacctactatatgtctgtctgt

SEQ ID NO: 193360 - DNA, 21 bp, Mus musculus
cttgatctacctgtgtgatga

SEQ ID NO: 193361 - DNA, 20 bp, Mus musculus
attattgcaaggatttcaaa

SEQ ID NO: 193362 - DNA, 18 bp, Mus musculus
tcagtaccctgtgacctg

SEQ ID NO: 193363 - DNA, 23 bp, Mus musculus
aggataagcattcaaacatgtgt

SEQ ID NO: 193364 - DNA, 23 bp, Mus musculus
gaaagtcactctctgacagtggg

SEQ ID NO: 193365 - DNA, 22 bp, Mus musculus
gtttgtgtgcatgtgtacgtat

SEQ ID NO: 193366 - DNA, 23 bp, Mus musculus
aatgctactatgtcttttgtgat

SEQ ID NO: 193367 - DNA, 21 bp, Mus musculus
actgagacttttgagagaagg

SEQ ID NO: 193368 - DNA, 23 bp, Mus musculus
aagacagagagcaaagatggagg

SEQ ID NO: 193369 - DNA, 22 bp, Mus musculus
tgtatgtatgtatgtatgtatg

SEQ ID NO: 193370 - DNA, 23 bp, Mus musculus
aggacactgactgctcttccaga

SEQ ID NO: 193371 - DNA, 20 bp, Mus musculus
tatgtgtatatatatggtgt

SEQ ID NO: 193372 - DNA, 23 bp, Mus musculus
tgtaaactatagaagtgagatgt

SEQ ID NO: 193373 - DNA, 22 bp, Mus musculus
aagatggcatggttgtgctggg

SEQ ID NO: 193374 - DNA, 21 bp, Mus musculus
gtggtagtgagattgttttga

SEQ ID NO: 193375 - DNA, 23 bp, Mus musculus
tctctgtcactcagacagcagtg

SEQ ID NO: 193376 - DNA, 20 bp, Mus musculus
aacagcactagattagggct

SEQ ID NO: 193377 - DNA, 23 bp, Mus musculus
agtgtctgtgtgtgcgtgtgcat

SEQ ID NO: 193378 - DNA, 21 bp, Mus musculus
cccctcactctgtccctgagt

SEQ ID NO: 193379 - DNA, 23 bp, Mus musculus
ctgtctcagctagtagtttgctc

SEQ ID NO: 193380 - DNA, 23 bp, Mus musculus
tctctgtatctctctgtatctct

SEQ ID NO: 193381 - DNA, 19 bp, Mus musculus
catcagaaacactcactgc

SEQ ID NO: 193382 - DNA, 23 bp, Mus musculus
aaggtgtgcttgtctctacatca

SEQ ID NO: 193383 - DNA, 19 bp, Mus musculus
ttgacagagcagtgtgagc

SEQ ID NO: 193384 - DNA, 23 bp, Mus musculus
tctcagagccttagttttgcttg

SEQ ID NO: 193385 - DNA, 23 bp, Mus musculus
tcagtgagcagagaggctgttgt

SEQ ID NO: 193386 - DNA, 23 bp, Mus musculus
atgtatgtgtgcatgtgtatgtg

SEQ ID NO: 193387 - DNA, 23 bp, Mus musculus
ctgtgtgtctgtctgtctgtctg

SEQ ID NO: 193388 - DNA, 21 bp, Mus musculus
tgcctgcctgcctgcctgtct

SEQ ID NO: 193389 - DNA, 23 bp, Mus musculus
tgtgtatatgtatacatgtgtgt

SEQ ID NO: 193390 - DNA, 21 bp, Mus musculus
atgtgcatatatatgtgtgtg

SEQ ID NO: 193391 - DNA, 23 bp, Mus musculus
tgtcagtctcacaggttgtcgtt

SEQ ID NO: 193392 - DNA, 21 bp, Mus musculus
ttctttccacatctgtgtgaa

SEQ ID NO: 193393 - DNA, 20 bp, Mus musculus
tgtgtatgtatgtatatatg

SEQ ID NO: 193394 - DNA, 19 bp, Mus musculus
tgtatatatgtatgtacat

SEQ ID NO: 193395 - DNA, 22 bp, Mus musculus
cacgtgtgtgtgagtgcgtgtg

SEQ ID NO: 193396 - DNA, 22 bp, Mus musculus
agagtcaccacacagagagctc

SEQ ID NO: 193397 - DNA, 20 bp, Mus musculus
tctcagagctgagtgagctc

SEQ ID NO: 193398 - DNA, 23 bp, Mus musculus
gattgttctctggctgcttgacc

SEQ ID NO: 193399 - DNA, 23 bp, Mus musculus
acccagagtctctatctctctcc

SEQ ID NO: 193400 - DNA, 23 bp, Mus musculus
gctgtgtgtgtgcacaggctgag

SEQ ID NO: 193401 - DNA, 20 bp, Mus musculus
tttctctgtgtagccttggc

SEQ ID NO: 193402 - DNA, 22 bp, Mus musculus
ctctgtctccctgtctctgggt

SEQ ID NO: 193403 - DNA, 21 bp, Mus musculus
atgtatgtgtgcatgtgtatg

SEQ ID NO: 193404 - DNA, 21 bp, Mus musculus
tgtgcacatatgtgtgtatgt

SEQ ID NO: 193405 - DNA, 19 bp, Mus musculus
tgcatatatgtatgtatgt

SEQ ID NO: 193406 - DNA, 22 bp, Mus musculus
tctcaggctgtctcactgcccc

SEQ ID NO: 193407 - DNA, 21 bp, Mus musculus
acttaagacttgagactgggg

SEQ ID NO: 193408 - DNA, 22 bp, Mus musculus
tgttttgtgaccaattatatgg

SEQ ID NO: 193409 - DNA, 18 bp, Mus musculus
tcaggtccagggataagg

SEQ ID NO: 193410 - DNA, 19 bp, Mus musculus
tgaaagataaaccagctgt

SEQ ID NO: 193411 - DNA, 21 bp, Mus musculus
ttagtctgtcactgacaccct

SEQ ID NO: 193412 - DNA, 22 bp, Mus musculus
ttgagacaagtttttgctgtgt

SEQ ID NO: 193413 - DNA, 23 bp, Mus musculus
actctcctgcttagttttggtca

SEQ ID NO: 193414 - DNA, 23 bp, Mus musculus
atgtatgtatgtatgtatgtatg

SEQ ID NO: 193415 - DNA, 21 bp, Mus musculus
ttcaagagcatattgtcacat

SEQ ID NO: 193416 - DNA, 23 bp, Mus musculus
agacagctgacagctcatggtgc

SEQ ID NO: 193417 - DNA, 18 bp, Mus musculus
atatcacacacaaacata

SEQ ID NO: 193418 - DNA, 23 bp, Mus musculus
tatagtcagtaattaagatgtgt

SEQ ID NO: 193419 - DNA, 23 bp, Mus musculus
tgaatgtgtgtctctgtgtgtgt

SEQ ID NO: 193420 - DNA, 23 bp, Mus musculus
gcctcactgtgggtctcgtctct

SEQ ID NO: 193421 - DNA, 23 bp, Mus musculus
taactagttttttatttctgtaa

SEQ ID NO: 193422 - DNA, 23 bp, Mus musculus
agcttacacttccacattgctgt

SEQ ID NO: 193423 - DNA, 18 bp, Mus musculus
tgagttctctctgtttct

SEQ ID NO: 193424 - DNA, 23 bp, Mus musculus
gtgtaagagcatttgcatgtggt

SEQ ID NO: 193425 - DNA, 23 bp, Mus musculus
gtgtatacatgtacatatgctta

SEQ ID NO: 193426 - DNA, 23 bp, Mus musculus
ttgaggatgtgctctgtgtttga

SEQ ID NO: 193427 - DNA, 23 bp, Mus musculus
ctcaatctgagtcacactcatag

SEQ ID NO: 193428 - DNA, 23 bp, Mus musculus
atgtgtgtgtgtatatgtgtatg

SEQ ID NO: 193429 - DNA, 23 bp, Mus musculus
taggccatggtggtctgatagga

SEQ ID NO: 193430 - DNA, 23 bp, Mus musculus
tgttttgtgaccaactatatggt

SEQ ID NO: 193431 - DNA, 23 bp, Mus musculus
aatgtctggctctgagtctctgc

SEQ ID NO: 193432 - DNA, 23 bp, Mus musculus
agagcatctgcatctgtattggt

SEQ ID NO: 193433 - DNA, 18 bp, Mus musculus
tgtgcgttttgcatgtgt

SEQ ID NO: 193434 - DNA, 22 bp, Mus musculus
tgttttgtgaccaattatatgg

SEQ ID NO: 193435 - DNA, 23 bp, Mus musculus
caggctctgtctcccacttcctg

SEQ ID NO: 193436 - DNA, 23 bp, Mus musculus
caatatttttgtatctgttgagg

SEQ ID NO: 193437 - DNA, 23 bp, Mus musculus
gtatgtatgtatatatgtatgtg

SEQ ID NO: 193438 - DNA, 18 bp, Mus musculus
tgccagatgttgttcatg

SEQ ID NO: 193439 - DNA, 18 bp, Mus musculus
cagaggattgatcttagg

SEQ ID NO: 193440 - DNA, 19 bp, Mus musculus
acagaaagcatcacatggg

SEQ ID NO: 193441 - DNA, 23 bp, Mus musculus
ctctccgtgactcagtggctcaa

SEQ ID NO: 193442 - DNA, 21 bp, Mus musculus
gtgtccgtgtcactgccgctc

SEQ ID NO: 193443 - DNA, 23 bp, Mus musculus
gcctggctggctggctggctggc

SEQ ID NO: 193444 - DNA, 23 bp, Mus musculus
tgcttagcatatgtgtgtgtagg

SEQ ID NO: 193445 - DNA, 19 bp, Mus musculus
gtatgtatgtatgtatgta

SEQ ID NO: 193446 - DNA, 23 bp, Mus musculus
tgtttgtggatgtgcatgtggag

SEQ ID NO: 193447 - DNA, 23 bp, Mus musculus
tgtatcagcaactgcatcttcta

SEQ ID NO: 193448 - DNA, 23 bp, Mus musculus
taagtaaagaagtctgttgatct

SEQ ID NO: 193449 - DNA, 20 bp, Mus musculus
cagtcagtctcacacaccgc

SEQ ID NO: 193450 - DNA, 18 bp, Mus musculus
tctgaactggcttcctct

SEQ ID NO: 193451 - DNA, 22 bp, Mus musculus
ttcactgagtcatgatatgctg

SEQ ID NO: 193452 - DNA, 23 bp, Mus musculus
tatgagcactctgtctgtctgcc

SEQ ID NO: 193453 - DNA, 23 bp, Mus musculus
gtctgtctgtctgtctgtctgtc

SEQ ID NO: 193454 - DNA, 22 bp, Mus musculus
tgttttgtgaccaattatatgg

SEQ ID NO: 193455 - DNA, 20 bp, Mus musculus
aatcatgactggccatgtct

SEQ ID NO: 193456 - DNA, 23 bp, Mus musculus
ttcaaagcatgtaaacatatgca

SEQ ID NO: 193457 - DNA, 23 bp, Mus musculus
atgtatgtatatttgtacctgtt

SEQ ID NO: 193458 - DNA, 22 bp, Mus musculus
tgttttgtgaccaattatatgg

SEQ ID NO: 193459 - DNA, 19 bp, Mus musculus
tgagaggagacagtgtccc

SEQ ID NO: 193460 - DNA, 21 bp, Mus musculus
acttcagtctaattgttgggt

SEQ ID NO: 193461 - DNA, 23 bp, Mus musculus
tgtctatctgtctgtctgtctgt

SEQ ID NO: 193462 - DNA, 22 bp, Mus musculus
tgtgtgggtgactcacttgtag

SEQ ID NO: 193463 - DNA, 23 bp, Mus musculus
ttcactgttctgtcaagcagttg

SEQ ID NO: 193464 - DNA, 23 bp, Mus musculus
ttgaaaagtcattttgatgatga

SEQ ID NO: 193465 - DNA, 23 bp, Mus musculus
gtttctcagtccctctgtctgcc

SEQ ID NO: 193466 - DNA, 22 bp, Mus musculus
ccagtgttgatagatcatatat

SEQ ID NO: 193467 - DNA, 23 bp, Mus musculus
agagtgcttctctagctttcatg

SEQ ID NO: 193468 - DNA, 23 bp, Mus musculus
tgagctccaaggatgatttggtg

SEQ ID NO: 193469 - DNA, 23 bp, Mus musculus
gagagtctctgtcagtgcctgac

SEQ ID NO: 193470 - DNA, 23 bp, Mus musculus
ttacagtgcttttgaagacattt

SEQ ID NO: 193471 - DNA, 22 bp, Mus musculus
tacagtagagaattttttgatg

SEQ ID NO: 193472 - DNA, 23 bp, Mus musculus
tatatgtatatgtatatgtatat

SEQ ID NO: 193473 - DNA, 23 bp, Mus musculus
tgtgtgtgtgtgtgtatacatat

SEQ ID NO: 193474 - DNA, 21 bp, Mus musculus
tatgtgtatatatacatatgt

SEQ ID NO: 193475 - DNA, 23 bp, Mus musculus
gtcagttcagtgtctagttttca

SEQ ID NO: 193476 - DNA, 22 bp, Mus musculus
ttttctgaaagactctctcact

SEQ ID NO: 193477 - DNA, 20 bp, Mus musculus
ctgatgatcctccaatctct

SEQ ID NO: 193478 - DNA, 23 bp, Mus musculus
aagtaggctggatatgaactcat

SEQ ID NO: 193479 - DNA, 19 bp, Mus musculus
tctgtctgtttctgtctcc

SEQ ID NO: 193480 - DNA, 18 bp, Mus musculus
agaagcagcagtctcagc

SEQ ID NO: 193481 - DNA, 23 bp, Mus musculus
tgtgaccctgactgtgtctgact

SEQ ID NO: 193482 - DNA, 23 bp, Mus musculus
ttcatctgcgggagacatcttgg

SEQ ID NO: 193483 - DNA, 21 bp, Mus musculus
ccagtctgttactttatatct

SEQ ID NO: 193484 - DNA, 22 bp, Mus musculus
tgttttgtgaccaattatatgg

SEQ ID NO: 193485 - DNA, 23 bp, Mus musculus
cagtggcagcaaatgatgatttt

SEQ ID NO: 193486 - DNA, 22 bp, Mus musculus
tgttttgtgaccaattatatgg

SEQ ID NO: 193487 - DNA, 23 bp, Mus musculus
tgagaggctctgtcagtgcctga

SEQ ID NO: 193488 - DNA, 22 bp, Mus musculus
tgttttgtgaccaattatatgg

SEQ ID NO: 193489 - DNA, 23 bp, Mus musculus
cacacagaacagtttgattctat

SEQ ID NO: 193490 - DNA, 18 bp, Mus musculus
agaaaaaattcttctgtg

SEQ ID NO: 193491 - DNA, 23 bp, Mus musculus
tgtgtagctggatttgaaatcct

SEQ ID NO: 193492 - DNA, 23 bp, Mus musculus
atactcagtctcattctctctgg

SEQ ID NO: 193493 - DNA, 19 bp, Mus musculus
tgagcagatctcatgtatg

SEQ ID NO: 193494 - DNA, 23 bp, Mus musculus
ggagactggctctctgagtttca

SEQ ID NO: 193495 - DNA, 19 bp, Mus musculus
gtcagagcagtctctgcag

SEQ ID NO: 193496 - DNA, 23 bp, Mus musculus
gtgtgtgtctgtgagagtatttc

SEQ ID NO: 193497 - DNA, 23 bp, Mus musculus
tgtgtatctctctccctcatata

SEQ ID NO: 193498 - DNA, 23 bp, Mus musculus
ctctgccttggtctctgtttgcc

SEQ ID NO: 193499 - DNA, 23 bp, Mus musculus
acacgctgagtctgtgggagcca

SEQ ID NO: 193500 - DNA, 23 bp, Mus musculus
tatgtatatgtatatgtatgtgt

SEQ ID NO: 193501 - DNA, 23 bp, Mus musculus
tctgtgtctgtgtctgtgtgtac

SEQ ID NO: 193502 - DNA, 23 bp, Mus musculus
tggaagagaagtcattatcttca

SEQ ID NO: 193503 - DNA, 22 bp, Mus musculus
tgttttgtgaccaattatatgg

SEQ ID NO: 193504 - DNA, 23 bp, Mus musculus
gatctaggctttcactctgagtt

SEQ ID NO: 193505 - DNA, 21 bp, Mus musculus
tgacaggagtgagtcaccaca

SEQ ID NO: 193506 - DNA, 21 bp, Mus musculus
tgtcattatgctggaactttt

SEQ ID NO: 193507 - DNA, 23 bp, Mus musculus
tccctgtcacactgtctttcccc

SEQ ID NO: 193508 - DNA, 23 bp, Mus musculus
agggtcactgcctctctgtccca

SEQ ID NO: 193509 - DNA, 23 bp, Mus musculus
acaccctgggaaagatgtggctc

SEQ ID NO: 193510 - DNA, 23 bp, Mus musculus
agaagtggctagtgactgagtat

SEQ ID NO: 193511 - DNA, 23 bp, Mus musculus
aggactagttattgcatatctac

SEQ ID NO: 193512 - DNA, 22 bp, Mus musculus
tcacacagacagaaatcacagt

SEQ ID NO: 193513 - DNA, 19 bp, Mus musculus
ccgtgtctttcctgcttgt

SEQ ID NO: 193514 - DNA, 23 bp, Mus musculus
taccacacccagctttgaggacc

SEQ ID NO: 193515 - DNA, 23 bp, Mus musculus
tgagtctctgggtctcaacctgc

SEQ ID NO: 193516 - DNA, 23 bp, Mus musculus
accttgtcttctgtatatgttct

SEQ ID NO: 193517 - DNA, 23 bp, Mus musculus
ttctgcagctgtttgtcctggga

SEQ ID NO: 193518 - DNA, 23 bp, Mus musculus
agtctctgccactcactcccact

SEQ ID NO: 193519 - DNA, 23 bp, Mus musculus
gtatatgtatatgtatatgtatg

SEQ ID NO: 193520 - DNA, 18 bp, Mus musculus
tatgtgaggaagtccatg

SEQ ID NO: 193521 - DNA, 22 bp, Mus musculus
tgctgtgtgtgtgtgcacgtgc

SEQ ID NO: 193522 - DNA, 23 bp, Mus musculus
tgtgtgcgtgtgtgcctgcctgc

SEQ ID NO: 193523 - DNA, 23 bp, Mus musculus
acttttgtcagggagctttgaag

SEQ ID NO: 193524 - DNA, 18 bp, Mus musculus
gtatatatgtctgtttgc

SEQ ID NO: 193525 - DNA, 23 bp, Mus musculus
gcatgtctgtgtgtgtctaaggg

SEQ ID NO: 193526 - DNA, 23 bp, Mus musculus
tgtctgtctgtctgtgtacacag

SEQ ID NO: 193527 - DNA, 23 bp, Mus musculus
gttgagatgattatctagccatt

SEQ ID NO: 193528 - DNA, 19 bp, Mus musculus
tgcagtctgaggttcctga

SEQ ID NO: 193529 - DNA, 23 bp, Mus musculus
gtatgtgtatatgtatatatgtg

SEQ ID NO: 193530 - DNA, 20 bp, Mus musculus
aaatgtttgtgtatatgttt

SEQ ID NO: 193531 - DNA, 22 bp, Mus musculus
ttctgattttgtaattcagtga

SEQ ID NO: 193532 - DNA, 22 bp, Mus musculus
gttagatgatcagaaagtctgc

SEQ ID NO: 193533 - DNA, 23 bp, Mus musculus
gcctcagtctctgtgaggtactc

SEQ ID NO: 193534 - DNA, 23 bp, Mus musculus
tgtatgcatgtatgtatgtatgt

SEQ ID NO: 193535 - DNA, 23 bp, Mus musculus
ctgtgatttgtgtatttcttgtc

SEQ ID NO: 193536 - DNA, 23 bp, Mus musculus
aatgcttacataacaaatgtaaa

SEQ ID NO: 193537 - DNA, 23 bp, Mus musculus
tgtgtgtgtgtgtttgctccaag

SEQ ID NO: 193538 - DNA, 19 bp, Mus musculus
tgggtctctgtccctgtgt

SEQ ID NO: 193539 - DNA, 18 bp, Mus musculus
tgacacatccgagatggt

SEQ ID NO: 193540 - DNA, 23 bp, Mus musculus
agtaaggaagtatatttaggagt

SEQ ID NO: 193541 - DNA, 23 bp, Mus musculus
tgtgaagagagtcacctcacagg

SEQ ID NO: 193542 - DNA, 18 bp, Mus musculus
aaacagaaaccattttat

SEQ ID NO: 193543 - DNA, 22 bp, Mus musculus
atatatatatatgtatatgtgt

SEQ ID NO: 193544 - DNA, 19 bp, Mus musculus
atgtatgtatatgtatgtg

SEQ ID NO: 193545 - DNA, 21 bp, Mus musculus
ttatgcatatatatatgtgtg

SEQ ID NO: 193546 - DNA, 23 bp, Mus musculus
catgcatatgtgtgtgtatatgt

SEQ ID NO: 193547 - DNA, 23 bp, Mus musculus
acatgtgcattaatatacacaca

SEQ ID NO: 193548 - DNA, 21 bp, Mus musculus
tatgtatgtgtgtatgtatat

SEQ ID NO: 193549 - DNA, 20 bp, Mus musculus
ttctcatgagtctgagcaca

SEQ ID NO: 193550 - DNA, 20 bp, Mus musculus
atatgcatatatacatgtgt

SEQ ID NO: 193551 - DNA, 23 bp, Mus musculus
taatgtatatatgtatatatgtg

SEQ ID NO: 193552 - DNA, 23 bp, Mus musculus
tcttctaaatgtcaaatactgac

SEQ ID NO: 193553 - DNA, 22 bp, Mus musculus
tgttttgtgaccaattatatgg

SEQ ID NO: 193554 - DNA, 22 bp, Mus musculus
atgtgtgcataatattacatga

SEQ ID NO: 193555 - DNA, 19 bp, Mus musculus
tgaatatgtatgtatgtat

SEQ ID NO: 193556 - DNA, 21 bp, Mus musculus
atcaggtaggattctgtgaag

SEQ ID NO: 193557 - DNA, 23 bp, Mus musculus
acacagaagttagacagcactct

SEQ ID NO: 193558 - DNA, 22 bp, Mus musculus
tgttttgtgaccaattatatgg

SEQ ID NO: 193559 - DNA, 23 bp, Mus musculus
tagcatgtctattgatgaaaata

SEQ ID NO: 193560 - DNA, 21 bp, Mus musculus
ctaagagtgttatgttcaagt

SEQ ID NO: 193561 - DNA, 23 bp, Mus musculus
tgacagtagaaagtaacctgatc

SEQ ID NO: 193562 - DNA, 23 bp, Mus musculus
ttaaagtctctggatttctgggt

SEQ ID NO: 193563 - DNA, 23 bp, Mus musculus
gtatgtgtgcatgtgtatgtgca

SEQ ID NO: 193564 - DNA, 21 bp, Mus musculus
tataggtatatatgcacatgt

SEQ ID NO: 193565 - DNA, 18 bp, Mus musculus
tggacagaatcctatgtg

SEQ ID NO: 193566 - DNA, 23 bp, Mus musculus
tctgtctctgtctctcaagctct

SEQ ID NO: 193567 - DNA, 20 bp, Mus musculus
tttcatgtcccagtcatgag

SEQ ID NO: 193568 - DNA, 23 bp, Mus musculus
gactctctcagcttctggatctg

SEQ ID NO: 193569 - DNA, 23 bp, Mus musculus
tcgctctcagtgtgtctgtcatt

SEQ ID NO: 193570 - DNA, 19 bp, Mus musculus
atacacgttactctcacca

SEQ ID NO: 193571 - DNA, 19 bp, Mus musculus
ggtctgttgtgagccagca

SEQ ID NO: 193572 - DNA, 20 bp, Mus musculus
acacacatatatacatgtgt

SEQ ID NO: 193573 - DNA, 22 bp, Mus musculus
aatgtgtatgtatatatatgtg

SEQ ID NO: 193574 - DNA, 23 bp, Mus musculus
tctttctctgtcagtgtatgaag

SEQ ID NO: 193575 - DNA, 20 bp, Mus musculus
agggagctggagaaatggct

SEQ ID NO: 193576 - DNA, 23 bp, Mus musculus
gtgtgtgcatgactatgagtgtg

SEQ ID NO: 193577 - DNA, 23 bp, Mus musculus
tgaccttgtatgtgtatatgtgt

SEQ ID NO: 193578 - DNA, 21 bp, Mus musculus
tgtgtatatatgtgtatatgt

SEQ ID NO: 193579 - DNA, 23 bp, Mus musculus
tgtgtgactgcacctggatctga

SEQ ID NO: 193580 - DNA, 23 bp, Mus musculus
agacaggttctctctcactgtgt

SEQ ID NO: 193581 - DNA, 23 bp, Mus musculus
tttgtatcgttgtctctgtctat

SEQ ID NO: 193582 - DNA, 22 bp, Mus musculus
tactgtacagtagtaggtgtag

SEQ ID NO: 193583 - DNA, 23 bp, Mus musculus
gtgtctttctgtgtctctcacat

SEQ ID NO: 193584 - DNA, 18 bp, Mus musculus
tgagtccctgattatatt

SEQ ID NO: 193585 - DNA, 23 bp, Mus musculus
atactgtaaattgtaatgtctgt

SEQ ID NO: 193586 - DNA, 23 bp, Mus musculus
tgtctctctggcagtcttaagat

SEQ ID NO: 193587 - DNA, 21 bp, Mus musculus
ttgtctgtagttagtctccac

SEQ ID NO: 193588 - DNA, 23 bp, Mus musculus
atttgacatttctaagggaggga

SEQ ID NO: 193589 - DNA, 20 bp, Mus musculus
ctcactgactctctgggact

SEQ ID NO: 193590 - DNA, 23 bp, Mus musculus
agactgtagagtgagttcagaga

SEQ ID NO: 193591 - DNA, 23 bp, Mus musculus
tctctctgcttcctgattgtgag

SEQ ID NO: 193592 - DNA, 23 bp, Mus musculus
atgtatgtatatgtgtgtgtgtg

SEQ ID NO: 193593 - DNA, 23 bp, Mus musculus
tatacctagatattacatatgtg

SEQ ID NO: 193594 - DNA, 20 bp, Mus musculus
tctggcccagtttctcaaga

SEQ ID NO: 193595 - DNA, 23 bp, Mus musculus
attgctcagaagagtctgtcctc

SEQ ID NO: 193596 - DNA, 19 bp, Mus musculus
aaagtctgacaactcaggg

SEQ ID NO: 193597 - DNA, 23 bp, Mus musculus
agagtgactcagtgcctcccaca

SEQ ID NO: 193598 - DNA, 19 bp, Mus musculus
aacagctacatgagacact

SEQ ID NO: 193599 - DNA, 23 bp, Mus musculus
agtgttgtcttcttgttctgcag

SEQ ID NO: 193600 - DNA, 22 bp, Mus musculus
tatggtaggaatagatcgtgct

SEQ ID NO: 193601 - DNA, 22 bp, Mus musculus
acggtctcagtttctcctgttc

SEQ ID NO: 193602 - DNA, 23 bp, Mus musculus
attgctagtattttcttgaaaga

SEQ ID NO: 193603 - DNA, 23 bp, Mus musculus
tgtgtgtctgtgtgtatgtacat

SEQ ID NO: 193604 - DNA, 19 bp, Mus musculus
ttaagagcacagactgctc

SEQ ID NO: 193605 - DNA, 23 bp, Mus musculus
ctgtctgtctgtctgtctgtctg

SEQ ID NO: 193606 - DNA, 23 bp, Mus musculus
acctcttctaagactgcagctgg

SEQ ID NO: 193607 - DNA, 23 bp, Mus musculus
tcagtcacagtgtgatgagagct

SEQ ID NO: 193608 - DNA, 22 bp, Mus musculus
tgtatgtatatatatgtgtgtg

SEQ ID NO: 193609 - DNA, 19 bp, Mus musculus
cctaggtcctcacattgct

SEQ ID NO: 193610 - DNA, 19 bp, Mus musculus
ttttggttgcatctgaatt

SEQ ID NO: 193611 - DNA, 23 bp, Mus musculus
tttgatctctgactgtcacctcc

SEQ ID NO: 193612 - DNA, 21 bp, Mus musculus
tttctcttaataatcctatgt

SEQ ID NO: 193613 - DNA, 23 bp, Mus musculus
tcacacacacacacttaacgcag

SEQ ID NO: 193614 - DNA, 22 bp, Mus musculus
gatttcagagaatcccagactc

SEQ ID NO: 193615 - DNA, 21 bp, Mus musculus
tgggtcactgggtcactggac

SEQ ID NO: 193616 - DNA, 23 bp, Mus musculus
aagagaactcacagagcacagta

SEQ ID NO: 193617 - DNA, 23 bp, Mus musculus
ctgttcagttctcttttactcct

SEQ ID NO: 193618 - DNA, 23 bp, Mus musculus
tagatctcagtcactcagtggca

SEQ ID NO: 193619 - DNA, 23 bp, Mus musculus
tgtctgtcccactgtgtctggca

SEQ ID NO: 193620 - DNA, 23 bp, Mus musculus
tgagcgtctctctctgggagtgt

SEQ ID NO: 193621 - DNA, 23 bp, Mus musculus
tttttctagtagtcttggtctca

SEQ ID NO: 193622 - DNA, 23 bp, Mus musculus
cagctctctgtgtctcagagcta

SEQ ID NO: 193623 - DNA, 23 bp, Mus musculus
cctgagtccctctctgtgtggca

SEQ ID NO: 193624 - DNA, 23 bp, Mus musculus
tccctgtctctctgggtctcagg

SEQ ID NO: 193625 - DNA, 23 bp, Mus musculus
tcagtctcactgcctggtagcca

SEQ ID NO: 193626 - DNA, 23 bp, Mus musculus
tttccctctgtgcctgcctcctt

SEQ ID NO: 193627 - DNA, 23 bp, Mus musculus
tgtgagaagagtgtctgtagaga

SEQ ID NO: 193628 - DNA, 23 bp, Mus musculus
aaggagtctgtgggagacacacc

SEQ ID NO: 193629 - DNA, 23 bp, Mus musculus
ctgtgtgtgtgtctctctctctc

SEQ ID NO: 193630 - DNA, 20 bp, Mus musculus
atgtcagagggcaactttgg

SEQ ID NO: 193631 - DNA, 23 bp, Mus musculus
tggctctctgtgtctctctgtgc

SEQ ID NO: 193632 - DNA, 18 bp, Mus musculus
atattatatatgtgtgtg

SEQ ID NO: 193633 - DNA, 23 bp, Mus musculus
tcagtccctgtcagcctcactga

SEQ ID NO: 193634 - DNA, 23 bp, Mus musculus
aatggttcctctgtgtgtctgtg

SEQ ID NO: 193635 - DNA, 23 bp, Mus musculus
tgtctctagtgcatctgtctaat

SEQ ID NO: 193636 - DNA, 18 bp, Mus musculus
gtgttgtggacctcatgt

SEQ ID NO: 193637 - DNA, 23 bp, Mus musculus
ctcagtcagtgcctcacagataa

SEQ ID NO: 193638 - DNA, 22 bp, Mus musculus
ttttcatgagggactggagaga

SEQ ID NO: 193639 - DNA, 23 bp, Mus musculus
ttcctgaggcagtgtgtcagtct

SEQ ID NO: 193640 - DNA, 23 bp, Mus musculus
ctgtgtctctgtttagtttctgt

SEQ ID NO: 193641 - DNA, 21 bp, Mus musculus
atctgtccattgatgagagtg

SEQ ID NO: 193642 - DNA, 23 bp, Mus musculus
tagtgcatggtgatctgatagga

SEQ ID NO: 193643 - DNA, 23 bp, Mus musculus
ttttgtgacctattatatggtca

SEQ ID NO: 193644 - DNA, 22 bp, Mus musculus
tgttttgtgaccaattatatgg

SEQ ID NO: 193645 - DNA, 23 bp, Mus musculus
taaaatccagattttctagtaaa

SEQ ID NO: 193646 - DNA, 23 bp, Mus musculus
gaatctagagaagtatcaaacat

SEQ ID NO: 193647 - DNA, 23 bp, Mus musculus
aacagggtgtgtatactcttata

SEQ ID NO: 193648 - DNA, 23 bp, Mus musculus
ggaatctagagaagtatcaaaca

SEQ ID NO: 193649 - DNA, 23 bp, Mus musculus
acagggtgtgtatactcctatag

SEQ ID NO: 193650 - DNA, 23 bp, Mus musculus
tagtgcatggtgatctgatagga

SEQ ID NO: 193651 - DNA, 21 bp, Mus musculus
tgttttgtgaccaattatgtg

SEQ ID NO: 193652 - DNA, 23 bp, Mus musculus
gtgactgtgtctgtgtgtatctt

SEQ ID NO: 193653 - DNA, 23 bp, Mus musculus
tactctttgggaatgatctctgg

SEQ ID NO: 193654 - DNA, 23 bp, Mus musculus
tctggctgtgtgagcctctctaa

SEQ ID NO: 193655 - DNA, 22 bp, Mus musculus
catgcctctgttatacaatggg

SEQ ID NO: 193656 - DNA, 23 bp, Mus musculus
ctcactctgagtctctctggttt

SEQ ID NO: 193657 - DNA, 22 bp, Mus musculus
tgttttgtgaccaattatatgg

SEQ ID NO: 193658 - DNA, 22 bp, Mus musculus
ctctctgtgtgtcacctaacag

SEQ ID NO: 193659 - DNA, 22 bp, Mus musculus
tacaaaggtggtgcatagcagt

SEQ ID NO: 193660 - DNA, 23 bp, Mus musculus
atcagtatggatatagttagtat

SEQ ID NO: 193661 - DNA, 20 bp, Mus musculus
cctctcactctcagacttcc

SEQ ID NO: 193662 - DNA, 23 bp, Mus musculus
ctgtgtgtctgtctgtgttccat

SEQ ID NO: 193663 - DNA, 23 bp, Mus musculus
ttgtgctttcccaatgactttca

SEQ ID NO: 193664 - DNA, 18 bp, Mus musculus
tgcggtgtctgatagcag

SEQ ID NO: 193665 - DNA, 23 bp, Mus musculus
tcttactgaagtgtgttagcaga

SEQ ID NO: 193666 - DNA, 23 bp, Mus musculus
tgcgtgcgtgcgtgcgtgcgtgc

SEQ ID NO: 193667 - DNA, 19 bp, Mus musculus
aaacaggcaggtctccaag

SEQ ID NO: 193668 - DNA, 23 bp, Mus musculus
tgactgagctgacagtgagtgac

SEQ ID NO: 193669 - DNA, 18 bp, Mus musculus
agaactgtggggttggag

SEQ ID NO: 193670 - DNA, 23 bp, Mus musculus
aaattcaacctgtgctacagtga

SEQ ID NO: 193671 - DNA, 22 bp, Mus musculus
ggcagatctctgtgagctcaag

SEQ ID NO: 193672 - DNA, 23 bp, Mus musculus
gactacacagagaaaccctgtct

SEQ ID NO: 193673 - DNA, 23 bp, Mus musculus
ggactgtgagaccagacagggtc

SEQ ID NO: 193674 - DNA, 23 bp, Mus musculus
cagtctgtctgtcagtgtgagta

SEQ ID NO: 193675 - DNA, 20 bp, Mus musculus
atgcatgtgtgtatgtgcat

SEQ ID NO: 193676 - DNA, 23 bp, Mus musculus
tgtatgtgcatgtagtatgtgtg

SEQ ID NO: 193677 - DNA, 23 bp, Mus musculus
tggcacttgaagatgcctgaggt

SEQ ID NO: 193678 - DNA, 23 bp, Mus musculus
tgtctgtctgtctgtctgtctct

SEQ ID NO: 193679 - DNA, 23 bp, Mus musculus
tgtgcatatgtgtgcctatgtgt

SEQ ID NO: 193680 - DNA, 23 bp, Mus musculus
tcagtctctgactcactatatag

SEQ ID NO: 193681 - DNA, 23 bp, Mus musculus
tatgactcagaactcacagagat

SEQ ID NO: 193682 - DNA, 20 bp, Mus musculus
tgatccattgttttatgagt

SEQ ID NO: 193683 - DNA, 18 bp, Mus musculus
tggtttgtctgctggctg

SEQ ID NO: 193684 - DNA, 18 bp, Mus musculus
tgtgctacatagttccag

SEQ ID NO: 193685 - DNA, 23 bp, Mus musculus
agagtaggagagtcagaacactg

SEQ ID NO: 193686 - DNA, 23 bp, Mus musculus
tctctcactgagacctcatgcta

SEQ ID NO: 193687 - DNA, 21 bp, Mus musculus
tttctagctagtgagccccag

SEQ ID NO: 193688 - DNA, 20 bp, Mus musculus
aagagcactgactgctcttc

SEQ ID NO: 193689 - DNA, 23 bp, Mus musculus
taagagcacagactgttcttcct

SEQ ID NO: 193690 - DNA, 23 bp, Mus musculus
tgtgactgtcagcttagctcctc

SEQ ID NO: 193691 - DNA, 23 bp, Mus musculus
gggagagtcagtcactgcctctg

SEQ ID NO: 193692 - DNA, 22 bp, Mus musculus
acactagagaagcaactctaga

SEQ ID NO: 193693 - DNA, 21 bp, Mus musculus
ttgaggatcaagatataaaca

SEQ ID NO: 193694 - DNA, 21 bp, Mus musculus
tgcctgcctgcctgcctgcca

SEQ ID NO: 193695 - DNA, 23 bp, Mus musculus
tctccctccctctgtctggttga

SEQ ID NO: 193696 - DNA, 18 bp, Mus musculus
tgagcatcgttgtgagtg

SEQ ID NO: 193697 - DNA, 22 bp, Mus musculus
aagagcccacactctgactctg

SEQ ID NO: 193698 - DNA, 22 bp, Mus musculus
atgtctatgtatatgcatgtgt

SEQ ID NO: 193699 - DNA, 21 bp, Mus musculus
atttgtgtatacatgattttg

SEQ ID NO: 193700 - DNA, 23 bp, Mus musculus
tctgtctgtctgtctgcctgcct

SEQ ID NO: 193701 - DNA, 23 bp, Mus musculus
agacagaaaagacagtgcactag

SEQ ID NO: 193702 - DNA, 23 bp, Mus musculus
agtgcctggctgccagactgggt

SEQ ID NO: 193703 - DNA, 23 bp, Mus musculus
gtagacacatagtcactctccca

SEQ ID NO: 193704 - DNA, 22 bp, Mus musculus
aggctcagtcctccagctgcag

SEQ ID NO: 193705 - DNA, 23 bp, Mus musculus
agtctgtcagctccagctgctgc

SEQ ID NO: 193706 - DNA, 23 bp, Mus musculus
cagtgtgcctgcctgcctgcctg

SEQ ID NO: 193707 - DNA, 23 bp, Mus musculus
tgagtctctgtgactgaatttgc

SEQ ID NO: 193708 - DNA, 20 bp, Mus musculus
cagtctctgactcacctgtt

SEQ ID NO: 193709 - DNA, 21 bp, Mus musculus
tgtgactgccatagaagaggc

SEQ ID NO: 193710 - DNA, 23 bp, Mus musculus
tgtccacactgtctctctgtgtg

SEQ ID NO: 193711 - DNA, 22 bp, Mus musculus
atgtgtgtgtgtatgtatatac

SEQ ID NO: 193712 - DNA, 23 bp, Mus musculus
tatatatgtgtgtgtgcgtgtgt

SEQ ID NO: 193713 - DNA, 21 bp, Mus musculus
ttggaactctctctctctctc

SEQ ID NO: 193714 - DNA, 23 bp, Mus musculus
agacagagagatgtgcctgggag

SEQ ID NO: 193715 - DNA, 22 bp, Mus musculus
tgactcagtgggtaaaggctct

SEQ ID NO: 193716 - DNA, 23 bp, Mus musculus
tgtctctctctgaatctcctgtg

SEQ ID NO: 193717 - DNA, 21 bp, Mus musculus
ggagagagtgtataggctttg

SEQ ID NO: 193718 - DNA, 23 bp, Mus musculus
ctgtctgtctgtctgtctgtcct

SEQ ID NO: 193719 - DNA, 19 bp, Mus musculus
ccagacccagtctcactct

SEQ ID NO: 193720 - DNA, 21 bp, Mus musculus
gtctgtgtagtgtatatgtgt

SEQ ID NO: 193721 - DNA, 23 bp, Mus musculus
gtgtgtgtctgcacctgcatgtg

SEQ ID NO: 193722 - DNA, 23 bp, Mus musculus
gtatgtatgtatgtatgtatgtg

SEQ ID NO: 193723 - DNA, 18 bp, Mus musculus
ccacatatatatagtgta

SEQ ID NO: 193724 - DNA, 23 bp, Mus musculus
actgtggaacagtctgtggctca

SEQ ID NO: 193725 - DNA, 18 bp, Mus musculus
accatagctgttatgagt

SEQ ID NO: 193726 - DNA, 23 bp, Mus musculus
tgtgtgtcactgtacagtgtgtg

SEQ ID NO: 193727 - DNA, 23 bp, Mus musculus
tatatctgtgtgtgtatgtgtgt

SEQ ID NO: 193728 - DNA, 23 bp, Mus musculus
tgagagtttgtacatgtgtttga

SEQ ID NO: 193729 - DNA, 23 bp, Mus musculus
tgtctgtctgtctgtctgtgtgc

SEQ ID NO: 193730 - DNA, 18 bp, Mus musculus
accacatgctcctgctgc

SEQ ID NO: 193731 - DNA, 20 bp, Mus musculus
tgttttgtgacctattatgt

SEQ ID NO: 193732 - DNA, 22 bp, Mus musculus
tgttttgtgaccaattatatgg

SEQ ID NO: 193733 - DNA, 22 bp, Mus musculus
tgttttgtgaccaattatatgg

SEQ ID NO: 193734 - DNA, 23 bp, Mus musculus
ctttcagaggttaggctagagag

SEQ ID NO: 193735 - DNA, 23 bp, Mus musculus
agagagagaggcatatacctgtg

SEQ ID NO: 193736 - DNA, 22 bp, Mus musculus
tccatggtggtctgataggttg

SEQ ID NO: 193737 - DNA, 22 bp, Mus musculus
tgttttgtgaccaattatatgg

SEQ ID NO: 193738 - DNA, 23 bp, Mus musculus
gattcttgttcattatgcttctt

SEQ ID NO: 193739 - DNA, 23 bp, Mus musculus
ttttctaattatgcatatgtgtg

SEQ ID NO: 193740 - DNA, 23 bp, Mus musculus
actcactgactagttaggagcct

SEQ ID NO: 193741 - DNA, 23 bp, Mus musculus
ttggtgcctgtagttctgcagtg

SEQ ID NO: 193742 - DNA, 23 bp, Mus musculus
tgaatagtaaactttttgttgtt

SEQ ID NO: 193743 - DNA, 23 bp, Mus musculus
aatagaggcacagaaagcagtca

SEQ ID NO: 193744 - DNA, 23 bp, Mus musculus
tgagtttcttgttctctttgcat

SEQ ID NO: 193745 - DNA, 23 bp, Mus musculus
aggagctactttttttttgttta

SEQ ID NO: 193746 - DNA, 19 bp, Mus musculus
cttgtgtatgtttatatgt

SEQ ID NO: 193747 - DNA, 22 bp, Mus musculus
tatgtgcatatatacatctatg

SEQ ID NO: 193748 - DNA, 23 bp, Mus musculus
tgtctgtctgtctgtctgtctgt

SEQ ID NO: 193749 - DNA, 23 bp, Mus musculus
tgtatgtatgtatctgtgtgcat

SEQ ID NO: 193750 - DNA, 23 bp, Mus musculus
atcattgtaaaacagtttgtgat

SEQ ID NO: 193751 - DNA, 21 bp, Mus musculus
ttgcatagtgaatgttttctg

SEQ ID NO: 193752 - DNA, 20 bp, Mus musculus
atgcatatacatatgtatac

SEQ ID NO: 193753 - DNA, 22 bp, Mus musculus
aactgtagtctcaactttggaa

SEQ ID NO: 193754 - DNA, 18 bp, Mus musculus
gatgtctgtgcctgtgtt

SEQ ID NO: 193755 - DNA, 23 bp, Mus musculus
ctgtgtctctgtttagtttctgt

SEQ ID NO: 193756 - DNA, 23 bp, Mus musculus
atctgtccattgatgaaagtgga

SEQ ID NO: 193757 - DNA, 22 bp, Mus musculus
tgttttgtgaccaattatatgg

SEQ ID NO: 193758 - DNA, 22 bp, Mus musculus
tgttttgtgaccaattatatgg

SEQ ID NO: 193759 - DNA, 22 bp, Mus musculus
tataagcatatattcatgtttg

SEQ ID NO: 193760 - DNA, 23 bp, Mus musculus
atatgtatatgtgtatgtatatg

SEQ ID NO: 193761 - DNA, 23 bp, Mus musculus
ttctgagctgataacactgtaag

SEQ ID NO: 193762 - DNA, 23 bp, Mus musculus
ctttgtacagactgagatttcac

SEQ ID NO: 193763 - DNA, 22 bp, Mus musculus
tgttttgtgaccaattatatgg

SEQ ID NO: 193764 - DNA, 22 bp, Mus musculus
tgttttgtgaccaattatatgg

SEQ ID NO: 193765 - DNA, 22 bp, Mus musculus
tgttttgtgaccaattatatgg

SEQ ID NO: 193766 - DNA, 23 bp, Mus musculus
tctatgtgggctttgaagatcag

SEQ ID NO: 193767 - DNA, 22 bp, Mus musculus
tgttttgtgaccaattatatgg

SEQ ID NO: 193768 - DNA, 23 bp, Mus musculus
attcactgagagactctctgctt

SEQ ID NO: 193769 - DNA, 22 bp, Mus musculus
tgttttgtgaccaattatatgg

SEQ ID NO: 193770 - DNA, 23 bp, Mus musculus
cacacatgtttgcatgtatgtgg

SEQ ID NO: 193771 - DNA, 23 bp, Mus musculus
atttgtatacatgtatgtggaag

SEQ ID NO: 193772 - DNA, 23 bp, Mus musculus
tatattctatatgtatatgaatg

SEQ ID NO: 193773 - DNA, 21 bp, Mus musculus
tgtgtgcatatatatgtatat

SEQ ID NO: 193774 - DNA, 22 bp, Mus musculus
tgttttgtgaccaattatatgg

SEQ ID NO: 193775 - DNA, 23 bp, Mus musculus
aatgtgaatgcatttgatatgta

SEQ ID NO: 193776 - DNA, 23 bp, Mus musculus
ttatagcatacatttacattgga

SEQ ID NO: 193777 - DNA, 20 bp, Mus musculus
tgcatatgtgtatgtatgta

SEQ ID NO: 193778 - DNA, 23 bp, Mus musculus
cagagtgtgtgtgtttctgtgtg

SEQ ID NO: 193779 - DNA, 21 bp, Mus musculus
ctatagatacatttttatggt

SEQ ID NO: 193780 - DNA, 22 bp, Mus musculus
ctgcctgcctgcctgcctgcgt

SEQ ID NO: 193781 - DNA, 23 bp, Mus musculus
atgtatatgtatacatatacata

SEQ ID NO: 193782 - DNA, 22 bp, Mus musculus
tgttttgtgaccaattatatgg

SEQ ID NO: 193783 - DNA, 21 bp, Mus musculus
tatgtacatgtataaggttgt

SEQ ID NO: 193784 - DNA, 23 bp, Mus musculus
aactctactgatgaagttgtcac

SEQ ID NO: 193785 - DNA, 22 bp, Mus musculus
tgttttgtgaccaattatatgg

SEQ ID NO: 193786 - DNA, 22 bp, Mus musculus
tgtcatgagaaagagaacttca

SEQ ID NO: 193787 - DNA, 22 bp, Mus musculus
ctttctcatttttttcatgtgt

SEQ ID NO: 193788 - DNA, 21 bp, Mus musculus
tatatctatatctatatctat

SEQ ID NO: 193789 - DNA, 23 bp, Mus musculus
acttactgagcatttaatgtgtt

SEQ ID NO: 193790 - DNA, 19 bp, Mus musculus
tgagaggaagttaaataca

SEQ ID NO: 193791 - DNA, 23 bp, Mus musculus
tgggtttctctgttaggtgatgt

SEQ ID NO: 193792 - DNA, 23 bp, Mus musculus
tgtgtgtgcgtgtgtgtgcatgt

SEQ ID NO: 193793 - DNA, 23 bp, Mus musculus
acatgtgtatatgtatatgtgtc

SEQ ID NO: 193794 - DNA, 23 bp, Mus musculus
ctgtttatgtctctgtgtgtgtg

SEQ ID NO: 193795 - DNA, 22 bp, Mus musculus
tgtctctgtctctgtctctata

SEQ ID NO: 193796 - DNA, 22 bp, Mus musculus
ccatcactctgacatttcaaca

SEQ ID NO: 193797 - DNA, 22 bp, Mus musculus
ggtgtatctgtgtgtctgtgtg

SEQ ID NO: 193798 - DNA, 23 bp, Mus musculus
agtgaccataggtgtgtggattc

SEQ ID NO: 193799 - DNA, 21 bp, Mus musculus
tgtctctggttatcatgcagt

SEQ ID NO: 193800 - DNA, 22 bp, Mus musculus
tgttttgtgaccaattatatgg

SEQ ID NO: 193801 - DNA, 23 bp, Mus musculus
tgtccatggtgatctgataggat

SEQ ID NO: 193802 - DNA, 23 bp, Mus musculus
ttttgtgaccaattatgtgctca

SEQ ID NO: 193803 - DNA, 22 bp, Mus musculus
tgttttgtgaccaattatatgg

SEQ ID NO: 193804 - DNA, 23 bp, Mus musculus
actagtcactcacactctctatt

SEQ ID NO: 193805 - DNA, 20 bp, Mus musculus
tgtgtgtgtgtactcatgtg

SEQ ID NO: 193806 - DNA, 20 bp, Mus musculus
ttccagggtgtctatcttgt

SEQ ID NO: 193807 - DNA, 23 bp, Mus musculus
tgtgatcctggttgagtcagaac

SEQ ID NO: 193808 - DNA, 23 bp, Mus musculus
agagtctccatacagtctctgag

SEQ ID NO: 193809 - DNA, 23 bp, Mus musculus
tcaggctgactcagaggctcaca

SEQ ID NO: 193810 - DNA, 23 bp, Mus musculus
cccagtgtctcactctctgcctg

SEQ ID NO: 193811 - DNA, 22 bp, Mus musculus
gtaggtagataaatactgctgt

SEQ ID NO: 193812 - DNA, 23 bp, Mus musculus
agccacactcaatgtctctctcc

SEQ ID NO: 193813 - DNA, 20 bp, Mus musculus
tggcttcaacttacagagat

SEQ ID NO: 193814 - DNA, 20 bp, Mus musculus
actgggctctgagtcagtcc

SEQ ID NO: 193815 - DNA, 22 bp, Mus musculus
gtctctgcctgtctgtctgtgt

SEQ ID NO: 193816 - DNA, 23 bp, Mus musculus
atgctgttctggcctctacttgc

SEQ ID NO: 193817 - DNA, 21 bp, Mus musculus
acttgcaatatgttgctggaa

SEQ ID NO: 193818 - DNA, 21 bp, Mus musculus
tggctgggacagttgtgggca

SEQ ID NO: 193819 - DNA, 21 bp, Mus musculus
ctgtggctgtggctgcggctg

SEQ ID NO: 193820 - DNA, 23 bp, Mus musculus
tctttgtctctgagaatggggac

SEQ ID NO: 193821 - DNA, 23 bp, Mus musculus
cagggtgccagcctgcctgtgtg

SEQ ID NO: 193822 - DNA, 21 bp, Mus musculus
agggtggctgtgtagagttgg

SEQ ID NO: 193823 - DNA, 23 bp, Mus musculus
ttgcctgtctgtctgtctctgga

SEQ ID NO: 193824 - DNA, 19 bp, Mus musculus
ttactctttccgctttgtg

SEQ ID NO: 193825 - DNA, 21 bp, Mus musculus
tctgggtctctgagtctgatg

SEQ ID NO: 193826 - DNA, 23 bp, Mus musculus
gacagacagttgtgagccaccag

SEQ ID NO: 193827 - DNA, 18 bp, Mus musculus
atcgtggttgctcttaac

SEQ ID NO: 193828 - DNA, 19 bp, Mus musculus
tggtagtcgcagatgtgag

SEQ ID NO: 193829 - DNA, 23 bp, Mus musculus
tctctaaggtctgtctctctcac

SEQ ID NO: 193830 - DNA, 23 bp, Mus musculus
tcagtgtctgtatctgtctgtaa

SEQ ID NO: 193831 - DNA, 18 bp, Mus musculus
aacagagtgtcagggatt

SEQ ID NO: 193832 - DNA, 23 bp, Mus musculus
ttgagttcagattttgttgaggt

SEQ ID NO: 193833 - DNA, 23 bp, Mus musculus
tcaagtggcttcaagttgtttct

SEQ ID NO: 193834 - DNA, 23 bp, Mus musculus
tgttttgtttttgtgtagccctg

SEQ ID NO: 193835 - DNA, 23 bp, Mus musculus
tcagcatctgcttctgcatcttc

SEQ ID NO: 193836 - DNA, 18 bp, Mus musculus
aatgtttgctagaaagtg

SEQ ID NO: 193837 - DNA, 21 bp, Mus musculus
acagaacaaagtcagtggtgt

SEQ ID NO: 193838 - DNA, 23 bp, Mus musculus
tctgacagaacagccagtgctct

SEQ ID NO: 193839 - DNA, 23 bp, Mus musculus
tctctccagccaagtgtgcaagt

SEQ ID NO: 193840 - DNA, 21 bp, Mus musculus
atcagcacttgagaggcagag

SEQ ID NO: 193841 - DNA, 19 bp, Mus musculus
agtctggtctacagagtga

SEQ ID NO: 193842 - DNA, 18 bp, Mus musculus
actggagagatggctcag

SEQ ID NO: 193843 - DNA, 23 bp, Mus musculus
acaagatctcactttgtagttct

SEQ ID NO: 193844 - DNA, 23 bp, Mus musculus
tgtctgtctccatctctgagaac

SEQ ID NO: 193845 - DNA, 23 bp, Mus musculus
tgttgtggtcattatgttcttct

SEQ ID NO: 193846 - DNA, 23 bp, Mus musculus
tctctgtgtctcatttttctctg

SEQ ID NO: 193847 - DNA, 23 bp, Mus musculus
ttcactctgggtgtagtttgacc

SEQ ID NO: 193848 - DNA, 22 bp, Mus musculus
tcacagacgacactgacctcag

SEQ ID NO: 193849 - DNA, 23 bp, Mus musculus
agtgtctaaatctgtctcagtta

SEQ ID NO: 193850 - DNA, 23 bp, Mus musculus
ttcaacagagattttctgtttcc

SEQ ID NO: 193851 - DNA, 21 bp, Mus musculus
tgtgaaaacagagtgtccaca

SEQ ID NO: 193852 - DNA, 23 bp, Mus musculus
ctgtcaagatgattctctgtttc

SEQ ID NO: 193853 - DNA, 23 bp, Mus musculus
ttctgcagagactggttgcaaca

SEQ ID NO: 193854 - DNA, 22 bp, Mus musculus
ggttgcaggtgagcaagggttg

SEQ ID NO: 193855 - DNA, 21 bp, Mus musculus
tccatggtggtctgataggat

SEQ ID NO: 193856 - DNA, 22 bp, Mus musculus
tgttttgtgaccaattatatgg

SEQ ID NO: 193857 - DNA, 19 bp, Mus musculus
tatcattgtcattatagct

SEQ ID NO: 193858 - DNA, 23 bp, Mus musculus
tgttttgtgaccaattgtatggt

SEQ ID NO: 193859 - DNA, 23 bp, Mus musculus
tttagaggaaaatgcatttttgt

SEQ ID NO: 193860 - DNA, 18 bp, Mus musculus
gatagtagtgccactaga

SEQ ID NO: 193861 - DNA, 23 bp, Mus musculus
gtgcactacagacactaacagct

SEQ ID NO: 193862 - DNA, 23 bp, Mus musculus
gcacacacatatgtgtatgtgta

SEQ ID NO: 193863 - DNA, 19 bp, Mus musculus
gatctacctgtctgtcact

SEQ ID NO: 193864 - DNA, 23 bp, Mus musculus
ctctgtagtacagcttgaggtca

SEQ ID NO: 193865 - DNA, 22 bp, Mus musculus
tccatctattactttgaggttt

SEQ ID NO: 193866 - DNA, 23 bp, Mus musculus
gatgtgagagtccacaagaagag

SEQ ID NO: 193867 - DNA, 22 bp, Mus musculus
tgcccactggggctggagagat

SEQ ID NO: 193868 - DNA, 22 bp, Mus musculus
tcacagtacgggcttgcagaag

SEQ ID NO: 193869 - DNA, 20 bp, Mus musculus
tctggctctctccgagtcac

SEQ ID NO: 193870 - DNA, 23 bp, Mus musculus
tatatggtatatgtatatggtat

SEQ ID NO: 193871 - DNA, 18 bp, Mus musculus
cagaggtcttgagttcat

SEQ ID NO: 193872 - DNA, 22 bp, Mus musculus
tctcaggccaaaggttgtaggt

SEQ ID NO: 193873 - DNA, 23 bp, Mus musculus
taaagagtttctatggtcattgt

SEQ ID NO: 193874 - DNA, 22 bp, Mus musculus
ccaggtctagagttccttctga

SEQ ID NO: 193875 - DNA, 20 bp, Mus musculus
agctggtgagaatttacaga

SEQ ID NO: 193876 - DNA, 21 bp, Mus musculus
agactctgtcttacttgagac

SEQ ID NO: 193877 - DNA, 22 bp, Mus musculus
catgtgtattgtatatgtacat

SEQ ID NO: 193878 - DNA, 21 bp, Mus musculus
tgtgtatatatatatgtgtgt

SEQ ID NO: 193879 - DNA, 21 bp, Mus musculus
atatatgtgtgtatgtacatg

SEQ ID NO: 193880 - DNA, 23 bp, Mus musculus
atcagagactgagtacacagtgg

SEQ ID NO: 193881 - DNA, 22 bp, Mus musculus
tgttttgtgaccaattatatgg

SEQ ID NO: 193882 - DNA, 23 bp, Mus musculus
gaggctggagaaagagtactgtg

SEQ ID NO: 193883 - DNA, 22 bp, Mus musculus
acagtgctgaagagattgctca

SEQ ID NO: 193884 - DNA, 21 bp, Mus musculus
gtttgtggtcctgctgcagct

SEQ ID NO: 193885 - DNA, 22 bp, Mus musculus
tgttttgtgaccaattatatgg

SEQ ID NO: 193886 - DNA, 23 bp, Mus musculus
ctctcagtgtatttctctgtgct

SEQ ID NO: 193887 - DNA, 23 bp, Mus musculus
cagagagagattacaaagtgtgc

SEQ ID NO: 193888 - DNA, 22 bp, Mus musculus
tgttttgtgaccaattatatgg

SEQ ID NO: 193889 - DNA, 23 bp, Mus musculus
tcacttgagtttttgatgttagc

SEQ ID NO: 193890 - DNA, 23 bp, Mus musculus
ttaagagcactgactgctcttcc

SEQ ID NO: 193891 - DNA, 23 bp, Mus musculus
ttaagagcactgactgctcttcc

SEQ ID NO: 193892 - DNA, 22 bp, Mus musculus
tgttttgtgaccaattatatgg

SEQ ID NO: 193893 - DNA, 23 bp, Mus musculus
acagatcttgtacttagcaaata

SEQ ID NO: 193894 - DNA, 23 bp, Mus musculus
tgaatacatgtttgttttaaagt

SEQ ID NO: 193895 - DNA, 22 bp, Mus musculus
tgttttgtgaccaattatatgg

SEQ ID NO: 193896 - DNA, 22 bp, Mus musculus
ttggacaagctgccttgcttca

SEQ ID NO: 193897 - DNA, 23 bp, Mus musculus
tttgtgatgttgaaggttgtaat

SEQ ID NO: 193898 - DNA, 23 bp, Mus musculus
tgtatgtatgtatgtatgtatgt

SEQ ID NO: 193899 - DNA, 23 bp, Mus musculus
aaaagaagcttcattttctgaca

SEQ ID NO: 193900 - DNA, 18 bp, Mus musculus
tggatatatataaacaca

SEQ ID NO: 193901 - DNA, 23 bp, Mus musculus
atgtgtgtgtatatatatgtgtg

SEQ ID NO: 193902 - DNA, 23 bp, Mus musculus
attatagtctccaaatgtaatat

SEQ ID NO: 193903 - DNA, 23 bp, Mus musculus
tgtgtgtgtctgtagttgcatgt

SEQ ID NO: 193904 - DNA, 19 bp, Mus musculus
aatatactacttattctac

SEQ ID NO: 193905 - DNA, 23 bp, Mus musculus
gtgggaggaagtgtgttccttgg

SEQ ID NO: 193906 - DNA, 22 bp, Mus musculus
tgttttgtgaccaattatatgg

SEQ ID NO: 193907 - DNA, 23 bp, Mus musculus
tgactcagtggataagagcactg

SEQ ID NO: 193908 - DNA, 21 bp, Mus musculus
attatggctgttctttttttg

SEQ ID NO: 193909 - DNA, 19 bp, Mus musculus
tgagcagattgagaaacaa

SEQ ID NO: 193910 - DNA, 22 bp, Mus musculus
attgcatagctagctagctgta

SEQ ID NO: 193911 - DNA, 23 bp, Mus musculus
gctctgtctctgtcactccttgg

SEQ ID NO: 193912 - DNA, 22 bp, Mus musculus
atctgtctgagtcagctactgg

SEQ ID NO: 193913 - DNA, 22 bp, Mus musculus
tgtgcatgtgaatctgtatgtg

SEQ ID NO: 193914 - DNA, 20 bp, Mus musculus
tttatatgtacaactatatg

SEQ ID NO: 193915 - DNA, 22 bp, Mus musculus
tttcacagtggctgttatataa

SEQ ID NO: 193916 - DNA, 23 bp, Mus musculus
acagtggttttctatctgaatat

SEQ ID NO: 193917 - DNA, 21 bp, Mus musculus
tgcatgcatgcatgtatttag

SEQ ID NO: 193918 - DNA, 20 bp, Mus musculus
atatgtatgtatatatgtgt

SEQ ID NO: 193919 - DNA, 19 bp, Mus musculus
tatatgtgtgtgcgtgtgt

SEQ ID NO: 193920 - DNA, 23 bp, Mus musculus
tatggatatgtaatgtatatgtt

SEQ ID NO: 193921 - DNA, 22 bp, Mus musculus
atctgcttaatgattctctagg

SEQ ID NO: 193922 - DNA, 20 bp, Mus musculus
ttcacttgtgattttgttca

SEQ ID NO: 193923 - DNA, 23 bp, Mus musculus
tatgtaattcttttctttgcatt

SEQ ID NO: 193924 - DNA, 23 bp, Mus musculus
tagaatggaatgaagactggagt

SEQ ID NO: 193925 - DNA, 19 bp, Mus musculus
ttgcatacaagagatatat

SEQ ID NO: 193926 - DNA, 23 bp, Mus musculus
gtgtgtatctgtgtctctttgtg

SEQ ID NO: 193927 - DNA, 18 bp, Mus musculus
cacacacacatatgtgta

SEQ ID NO: 193928 - DNA, 18 bp, Mus musculus
gtatgtatgtatatatgc

SEQ ID NO: 193929 - DNA, 18 bp, Mus musculus
agcatctttgatgagggc

SEQ ID NO: 193930 - DNA, 23 bp, Mus musculus
atatgcatatgtaatcaaactct

SEQ ID NO: 193931 - DNA, 23 bp, Mus musculus
gatgtgtcgctccctgattggct

SEQ ID NO: 193932 - DNA, 21 bp, Mus musculus
ttctgtgtctgataatcttga

SEQ ID NO: 193933 - DNA, 23 bp, Mus musculus
atcaggtacagccttgtgtgtgt

SEQ ID NO: 193934 - DNA, 23 bp, Mus musculus
acagctgagactgaggattcgca

SEQ ID NO: 193935 - DNA, 22 bp, Mus musculus
aaagaagctagatgaatgcatg

SEQ ID NO: 193936 - DNA, 22 bp, Mus musculus
tgttttgtgaccaattatatgg

SEQ ID NO: 193937 - DNA, 23 bp, Mus musculus
agaagtgtatacatgtatgtgca

SEQ ID NO: 193938 - DNA, 18 bp, Mus musculus
gtgtgcaatcattttttg

SEQ ID NO: 193939 - DNA, 23 bp, Mus musculus
gtgaggaataagagagcagagag

SEQ ID NO: 193940 - DNA, 22 bp, Mus musculus
tcatacactcaacagtatatgt

SEQ ID NO: 193941 - DNA, 23 bp, Mus musculus
agaagtgtatacatgtatgtgca

SEQ ID NO: 193942 - DNA, 19 bp, Mus musculus
gtgtgcaatcatttttggg

SEQ ID NO: 193943 - DNA, 22 bp, Mus musculus
tgttttgtgaccaattatatgg

SEQ ID NO: 193944 - DNA, 23 bp, Mus musculus
acatgtgaatatgtatatgtgtg

SEQ ID NO: 193945 - DNA, 23 bp, Mus musculus
cactggaagaaatgtgaacagtg

SEQ ID NO: 193946 - DNA, 21 bp, Mus musculus
tggataaaatttcctatgtgt

SEQ ID NO: 193947 - DNA, 23 bp, Mus musculus
aaaaggtactgtactgcttcagt

SEQ ID NO: 193948 - DNA, 23 bp, Mus musculus
aacattcacagagcttttcttct

SEQ ID NO: 193949 - DNA, 22 bp, Mus musculus
atatgtatattacttcatgttc

SEQ ID NO: 193950 - DNA, 23 bp, Mus musculus
tgtggatttattttgctggactg

SEQ ID NO: 193951 - DNA, 22 bp, Mus musculus
tgttttgtgaccaattatatgg

SEQ ID NO: 193952 - DNA, 20 bp, Mus musculus
tggctcagtggttaggagca

SEQ ID NO: 193953 - DNA, 20 bp, Mus musculus
gaaaccaatgctgacagtag

SEQ ID NO: 193954 - DNA, 21 bp, Mus musculus
ttcttgtaggagtcatgctga

SEQ ID NO: 193955 - DNA, 22 bp, Mus musculus
tgttttgtgaccaattatatgg

SEQ ID NO: 193956 - DNA, 22 bp, Mus musculus
tgttttgtgaccaattatatgg

SEQ ID NO: 193957 - DNA, 23 bp, Mus musculus
tcactcagtctgtgacctttgag

SEQ ID NO: 193958 - DNA, 23 bp, Mus musculus
tgtatgcatgtatgtatgtgtgt

SEQ ID NO: 193959 - DNA, 23 bp, Mus musculus
gatgaagtatgtatgtatgtatg

SEQ ID NO: 193960 - DNA, 23 bp, Mus musculus
ttatgaccaattatatggtcaat

SEQ ID NO: 193961 - DNA, 19 bp, Mus musculus
tggtgaaggcaaagggaca

SEQ ID NO: 193962 - DNA, 23 bp, Mus musculus
tgactctgttcttttgagtggct

SEQ ID NO: 193963 - DNA, 23 bp, Mus musculus
ctgtgtgtctgtgtcttttatct

SEQ ID NO: 193964 - DNA, 18 bp, Mus musculus
gcattcctcagagctttg

SEQ ID NO: 193965 - DNA, 23 bp, Mus musculus
actgtgtctctgtttaggttctg

SEQ ID NO: 193966 - DNA, 21 bp, Mus musculus
atctgtccattgatgagagtg

SEQ ID NO: 193967 - DNA, 23 bp, Mus musculus
tgaagacttattcttgttgctga

SEQ ID NO: 193968 - DNA, 21 bp, Mus musculus
ttgacagaagctacagtcctc

SEQ ID NO: 193969 - DNA, 23 bp, Mus musculus
tttctgtggtttagatatcagag

SEQ ID NO: 193970 - DNA, 21 bp, Mus musculus
atagaatgagttgggtagagt

SEQ ID NO: 193971 - DNA, 23 bp, Mus musculus
gagagtgactgttgactgtgagg

SEQ ID NO: 193972 - DNA, 21 bp, Mus musculus
tatatgtttttctacaggatg

SEQ ID NO: 193973 - DNA, 23 bp, Mus musculus
gacacactcactgagaagaggga

SEQ ID NO: 193974 - DNA, 23 bp, Mus musculus
atttcttttcatcgatatgtcag

SEQ ID NO: 193975 - DNA, 19 bp, Mus musculus
tatatgcttgtatatatgc

SEQ ID NO: 193976 - DNA, 21 bp, Mus musculus
atatatgcatatatacaagta

SEQ ID NO: 193977 - DNA, 23 bp, Mus musculus
ttaaatgctgatgttgatgcttt

SEQ ID NO: 193978 - DNA, 22 bp, Mus musculus
tatctgtctgtctgtctgtctc

SEQ ID NO: 193979 - DNA, 23 bp, Mus musculus
ctgtgtctgtgtgtcttaaaagg

SEQ ID NO: 193980 - DNA, 23 bp, Mus musculus
cacactgtggctgagacactggc

SEQ ID NO: 193981 - DNA, 23 bp, Mus musculus
acacactctgtcatgggatctct

SEQ ID NO: 193982 - DNA, 23 bp, Mus musculus
ttccctctggctcactgtctctg

SEQ ID NO: 193983 - DNA, 21 bp, Mus musculus
ctgtgatgctcacagtggtgt

SEQ ID NO: 193984 - DNA, 23 bp, Mus musculus
tgtgtgtatgtatatgtatgtgt

SEQ ID NO: 193985 - DNA, 23 bp, Mus musculus
tcagtcagtcagtcactaaacac

SEQ ID NO: 193986 - DNA, 23 bp, Mus musculus
gctgagagaagtgacataggact

SEQ ID NO: 193987 - DNA, 23 bp, Mus musculus
tcatgtcacagccacacttgagg

SEQ ID NO: 193988 - DNA, 21 bp, Mus musculus
ttcaaatctcagcaaccacat

SEQ ID NO: 193989 - DNA, 21 bp, Mus musculus
tctcactgtcaggcctccaca

SEQ ID NO: 193990 - DNA, 19 bp, Mus musculus
tctctgtcagtgtgtctgg

SEQ ID NO: 193991 - DNA, 19 bp, Mus musculus
agcaaccacatgatggctt

SEQ ID NO: 193992 - DNA, 22 bp, Mus musculus
cctttgcctctgagtcactctg

SEQ ID NO: 193993 - DNA, 21 bp, Mus musculus
attgtaagtcttttgcctgag

SEQ ID NO: 193994 - DNA, 23 bp, Mus musculus
catctgtctcactgtggaacggg

SEQ ID NO: 193995 - DNA, 23 bp, Mus musculus
ttttgaacagttttggaactgtt

SEQ ID NO: 193996 - DNA, 22 bp, Mus musculus
aaggtcagtgagaaaggagaca

SEQ ID NO: 193997 - DNA, 23 bp, Mus musculus
ctcgcacactgtcggaacaacct

SEQ ID NO: 193998 - DNA, 23 bp, Mus musculus
tgtggattctgtgtctgacacgg

SEQ ID NO: 193999 - DNA, 23 bp, Mus musculus
ctctctctgtctcatatcgcagc

SEQ ID NO: 194000 - DNA, 22 bp, Mus musculus
tttctctcagatatacttcaga

SEQ ID NO: 194001 - DNA, 23 bp, Mus musculus
atgagagagaaggcagatggaca

SEQ ID NO: 194002 - DNA, 22 bp, Mus musculus
ctagactatagatattgtagtt

SEQ ID NO: 194003 - DNA, 18 bp, Mus musculus
agtaactccttctctctg

SEQ ID NO: 194004 - DNA, 19 bp, Mus musculus
ttccacagatgtgagctgg

SEQ ID NO: 194005 - DNA, 23 bp, Mus musculus
tatgcatatatatatgtatgctg

SEQ ID NO: 194006 - DNA, 23 bp, Mus musculus
ctgtctctctgtctgaaaattgt

SEQ ID NO: 194007 - DNA, 23 bp, Mus musculus
acatatgtgtgcatatgtatgta

SEQ ID NO: 194008 - DNA, 22 bp, Mus musculus
tgttttgtgaccaattatatgg

SEQ ID NO: 194009 - DNA, 22 bp, Mus musculus
cacattgtgtcacagtctgact

SEQ ID NO: 194010 - DNA, 23 bp, Mus musculus
tctgaagtgtttttccacagtca

SEQ ID NO: 194011 - DNA, 22 bp, Mus musculus
atgtgtgtatatatgtatgtat

SEQ ID NO: 194012 - DNA, 22 bp, Mus musculus
tctgtctctgtttagtttctgt

SEQ ID NO: 194013 - DNA, 23 bp, Mus musculus
cagagagatctgttaaagcctaa

SEQ ID NO: 194014 - DNA, 21 bp, Mus musculus
aggagttcagtaactgttgtg

SEQ ID NO: 194015 - DNA, 19 bp, Mus musculus
tgtctgtatatatatgtgt

SEQ ID NO: 194016 - DNA, 23 bp, Mus musculus
tctttgtacatgctacagacaga

SEQ ID NO: 194017 - DNA, 19 bp, Mus musculus
agagtgatgagagtcagca

SEQ ID NO: 194018 - DNA, 21 bp, Mus musculus
tatacagtgctgggaactgag

SEQ ID NO: 194019 - DNA, 23 bp, Mus musculus
gatggctgggtccctgtgtggga

SEQ ID NO: 194020 - DNA, 23 bp, Mus musculus
gtttttttttctagatgtatgtt

SEQ ID NO: 194021 - DNA, 23 bp, Mus musculus
gtcacagtctgaatttcttctgg

SEQ ID NO: 194022 - DNA, 23 bp, Mus musculus
actgtcacagacagaattgtccc

SEQ ID NO: 194023 - DNA, 20 bp, Mus musculus
atgttagtgtttcacctgtg

SEQ ID NO: 194024 - DNA, 23 bp, Mus musculus
atctgtggctctgtgagtctcct

SEQ ID NO: 194025 - DNA, 21 bp, Mus musculus
cctctccaggctacagtcagt

SEQ ID NO: 194026 - DNA, 19 bp, Mus musculus
ccagtttggtcttttgaga

SEQ ID NO: 194027 - DNA, 22 bp, Mus musculus
tcagtgcactacagaactttgt

SEQ ID NO: 194028 - DNA, 23 bp, Mus musculus
tcctagcttagtttgggtgtgtt

SEQ ID NO: 194029 - DNA, 23 bp, Mus musculus
tgtctcagactcactttttgcag

SEQ ID NO: 194030 - DNA, 22 bp, Mus musculus
tgagagagtgcctaaatccagt

SEQ ID NO: 194031 - DNA, 18 bp, Mus musculus
atatgtgtagtatatatg

SEQ ID NO: 194032 - DNA, 19 bp, Mus musculus
tgagtacactgttgctctc

SEQ ID NO: 194033 - DNA, 22 bp, Mus musculus
tgtctgtctgtctgtgtactac

SEQ ID NO: 194034 - DNA, 22 bp, Mus musculus
ttaagagcactgactgctgttc

SEQ ID NO: 194035 - DNA, 20 bp, Mus musculus
aaagacatcttaatggtgtg

SEQ ID NO: 194036 - DNA, 23 bp, Mus musculus
ttgaccttagtgtgctggctcac

SEQ ID NO: 194037 - DNA, 23 bp, Mus musculus
agctccagtagagactgtggtgt

SEQ ID NO: 194038 - DNA, 22 bp, Mus musculus
actgtgatagactatggggact

SEQ ID NO: 194039 - DNA, 23 bp, Mus musculus
tgtctgtctgtctgtctgtctgt

SEQ ID NO: 194040 - DNA, 23 bp, Mus musculus
tgtctgtctgtctgcgtgtctgt

SEQ ID NO: 194041 - DNA, 18 bp, Mus musculus
acaatttcataactgtat

SEQ ID NO: 194042 - DNA, 23 bp, Mus musculus
tgctactgatatgaattgtaatg

SEQ ID NO: 194043 - DNA, 22 bp, Mus musculus
attcatcatcacgatctgcaca

SEQ ID NO: 194044 - DNA, 19 bp, Mus musculus
aacctcctgccactttcca

SEQ ID NO: 194045 - DNA, 23 bp, Mus musculus
tgcctttgagagaacactggatg

SEQ ID NO: 194046 - DNA, 23 bp, Mus musculus
tcagtcagcctgtctgactggga

SEQ ID NO: 194047 - DNA, 18 bp, Mus musculus
tgagaggggaaggacaga

SEQ ID NO: 194048 - DNA, 23 bp, Mus musculus
atataagcacataatgtatatgt

SEQ ID NO: 194049 - DNA, 23 bp, Mus musculus
atgtatatgtgcatacactcctg

SEQ ID NO: 194050 - DNA, 23 bp, Mus musculus
tgtatatgtatatgtacatacat

SEQ ID NO: 194051 - DNA, 23 bp, Mus musculus
agagacagcggttgatttgtgag

SEQ ID NO: 194052 - DNA, 23 bp, Mus musculus
ctctctctcagtctgtctgtaag

SEQ ID NO: 194053 - DNA, 18 bp, Mus musculus
tgagaggaccctattctg

SEQ ID NO: 194054 - DNA, 20 bp, Mus musculus
tatgtatatatatgtatgtg

SEQ ID NO: 194055 - DNA, 23 bp, Mus musculus
tacatgctacacagatgtatagt

SEQ ID NO: 194056 - DNA, 23 bp, Mus musculus
gtctgtctgtctgtctgtctgca

SEQ ID NO: 194057 - DNA, 21 bp, Mus musculus
cagcgcttgttctgagtacct

SEQ ID NO: 194058 - DNA, 21 bp, Mus musculus
agtgtgcagagtcactgagag

SEQ ID NO: 194059 - DNA, 20 bp, Mus musculus
tgctgtcactgtcattagtc

SEQ ID NO: 194060 - DNA, 23 bp, Mus musculus
tgggatccacctatttactctct

SEQ ID NO: 194061 - DNA, 23 bp, Mus musculus
tgtcacactgggtgtaacttgag

SEQ ID NO: 194062 - DNA, 19 bp, Mus musculus
aagatgtggggctggagag

SEQ ID NO: 194063 - DNA, 23 bp, Mus musculus
ccctgtctgtctgtctgtctgtc

SEQ ID NO: 194064 - DNA, 23 bp, Mus musculus
actgtccctctgtccctctgtag

SEQ ID NO: 194065 - DNA, 21 bp, Mus musculus
tcacagtcaccccctgtgtca

SEQ ID NO: 194066 - DNA, 18 bp, Mus musculus
tggagctgtcagcctatc

SEQ ID NO: 194067 - DNA, 22 bp, Mus musculus
tgttttgtgaccaattatatgg

SEQ ID NO: 194068 - DNA, 23 bp, Mus musculus
agaggtagttggatctctgtgag

SEQ ID NO: 194069 - DNA, 21 bp, Mus musculus
cagcggctctctgtccctctg

SEQ ID NO: 194070 - DNA, 23 bp, Mus musculus
aagtcacaggtagttgtgagtca

SEQ ID NO: 194071 - DNA, 23 bp, Mus musculus
aaccagtgtagtttggtgtatgc

SEQ ID NO: 194072 - DNA, 23 bp, Mus musculus
aactacacggttgtgagacagtg

SEQ ID NO: 194073 - DNA, 23 bp, Mus musculus
agtgcttgaggaagtgggatgta

SEQ ID NO: 194074 - DNA, 23 bp, Mus musculus
ctcagagctgtcagtgctgagag

SEQ ID NO: 194075 - DNA, 23 bp, Mus musculus
tcacagaagacactctggagatg

SEQ ID NO: 194076 - DNA, 23 bp, Mus musculus
tgtagatttcttttgttgatgta

SEQ ID NO: 194077 - DNA, 23 bp, Mus musculus
gtctctctctctgtatgtgtata

SEQ ID NO: 194078 - DNA, 20 bp, Mus musculus
tatagatgatataggtatag

SEQ ID NO: 194079 - DNA, 19 bp, Mus musculus
atatgtatgtatacacaca

SEQ ID NO: 194080 - DNA, 22 bp, Mus musculus
tgttttgtgaccaattatatgg

SEQ ID NO: 194081 - DNA, 23 bp, Mus musculus
atatatgaacttgcacacacaca

SEQ ID NO: 194082 - DNA, 23 bp, Mus musculus
tgtgtgtatatgtatgtgtgtga

SEQ ID NO: 194083 - DNA, 23 bp, Mus musculus
tctgtccctgtctgtctctgttg

SEQ ID NO: 194084 - DNA, 23 bp, Mus musculus
tagcagacagaaaacacacagct

SEQ ID NO: 194085 - DNA, 23 bp, Mus musculus
ggcaagcctctgtctgtgcctct

SEQ ID NO: 194086 - DNA, 18 bp, Mus musculus
tcctgagtctcagtggtt

SEQ ID NO: 194087 - DNA, 20 bp, Mus musculus
ccatggtgatctgataggat

SEQ ID NO: 194088 - DNA, 23 bp, Mus musculus
tgttttgtgaccaattatatggt

SEQ ID NO: 194089 - DNA, 23 bp, Mus musculus
tgacaaatgacattcagttccag

SEQ ID NO: 194090 - DNA, 21 bp, Mus musculus
tgtgtctgtctgtcaattccc

SEQ ID NO: 194091 - DNA, 23 bp, Mus musculus
tgaagagtttggtatacacatcc

SEQ ID NO: 194092 - DNA, 23 bp, Mus musculus
tggttgagtgtctcaaagtctct

SEQ ID NO: 194093 - DNA, 23 bp, Mus musculus
tgagaaagttctgtgagatgctg

SEQ ID NO: 194094 - DNA, 20 bp, Mus musculus
tatgagtgttttgcctgcac

SEQ ID NO: 194095 - DNA, 23 bp, Mus musculus
tcaagattgaactcagttcatca

SEQ ID NO: 194096 - DNA, 23 bp, Mus musculus
gagaagtacctattgacatgaca

SEQ ID NO: 194097 - DNA, 23 bp, Mus musculus
tattatgtatgcatatggttagt

SEQ ID NO: 194098 - DNA, 20 bp, Mus musculus
tactgttttgattaagttgt

SEQ ID NO: 194099 - DNA, 23 bp, Mus musculus
tgtatgtatatgtatatgtatat

SEQ ID NO: 194100 - DNA, 23 bp, Mus musculus
tcatgaatgtgtgtacatgtatg

SEQ ID NO: 194101 - DNA, 21 bp, Mus musculus
aatggacaagttttgtcagtc

SEQ ID NO: 194102 - DNA, 23 bp, Mus musculus
caatctggttgtcatttgtatac

SEQ ID NO: 194103 - DNA, 22 bp, Mus musculus
tctggagttgagccaccaatgc

SEQ ID NO: 194104 - DNA, 22 bp, Mus musculus
tgtcagatgagtgtgacctcaa

SEQ ID NO: 194105 - DNA, 22 bp, Mus musculus
tgttttgtgaccaattatatgg

SEQ ID NO: 194106 - DNA, 22 bp, Mus musculus
actagtggtcattttgttgttc

SEQ ID NO: 194107 - DNA, 23 bp, Mus musculus
tcaacatacttctctgtgaatat

SEQ ID NO: 194108 - DNA, 23 bp, Mus musculus
tcagtgagtgaatatcatgtgtg

SEQ ID NO: 194109 - DNA, 23 bp, Mus musculus
gtcagaagtttgtgagcagaaag

SEQ ID NO: 194110 - DNA, 22 bp, Mus musculus
tgttttgtgaccaattatatgg

SEQ ID NO: 194111 - DNA, 23 bp, Mus musculus
tccctctgtctcagagaatggga

SEQ ID NO: 194112 - DNA, 20 bp, Mus musculus
tgtatgtgcatatattgtgt

SEQ ID NO: 194113 - DNA, 18 bp, Mus musculus
tatgtgtgtattgtgtgt

SEQ ID NO: 194114 - DNA, 23 bp, Mus musculus
gtatatctatatatgtatatgtg

SEQ ID NO: 194115 - DNA, 21 bp, Mus musculus
atacatgtatatatgcatata

SEQ ID NO: 194116 - DNA, 22 bp, Mus musculus
gacaggaaataatcactaagga

SEQ ID NO: 194117 - DNA, 23 bp, Mus musculus
tctatttctctcagctaagctca

SEQ ID NO: 194118 - DNA, 19 bp, Mus musculus
ttatgtatgttgatatatg

SEQ ID NO: 194119 - DNA, 23 bp, Mus musculus
tgcatgtatgtatgtatgtatgt

SEQ ID NO: 194120 - DNA, 23 bp, Mus musculus
agacaccatcctagagagttatg

SEQ ID NO: 194121 - DNA, 23 bp, Mus musculus
acatcttgatcttgatcttgctt

SEQ ID NO: 194122 - DNA, 18 bp, Mus musculus
aatcccagcaaccatgtg

SEQ ID NO: 194123 - DNA, 23 bp, Mus musculus
atcaagactattgactatgtagt

SEQ ID NO: 194124 - DNA, 23 bp, Mus musculus
tgaggggctggttaagagcactc

SEQ ID NO: 194125 - DNA, 23 bp, Mus musculus
cagtgtgacacagtatcctgtta

SEQ ID NO: 194126 - DNA, 21 bp, Mus musculus
tctcactgtgaagccttgaca

SEQ ID NO: 194127 - DNA, 22 bp, Mus musculus
ttgatggacatttggcttgtgt

SEQ ID NO: 194128 - DNA, 23 bp, Mus musculus
agacagggtctcactgtgtgtcc

SEQ ID NO: 194129 - DNA, 18 bp, Mus musculus
tgacgctcagagatggga

SEQ ID NO: 194130 - DNA, 21 bp, Mus musculus
tgtctatatatgtatatatgt

SEQ ID NO: 194131 - DNA, 21 bp, Mus musculus
tgaccacagaatcctccttca

SEQ ID NO: 194132 - DNA, 23 bp, Mus musculus
tctcactgtcagaatcaagtcag

SEQ ID NO: 194133 - DNA, 22 bp, Mus musculus
ttaatgtttgattggagaaggt

SEQ ID NO: 194134 - DNA, 22 bp, Mus musculus
tgattagatgtaatgctgttca

SEQ ID NO: 194135 - DNA, 23 bp, Mus musculus
cagtcattactaaatgttcagct

SEQ ID NO: 194136 - DNA, 21 bp, Mus musculus
gcagagagatgactgtgtggt

SEQ ID NO: 194137 - DNA, 19 bp, Mus musculus
aataatattcaaggttaga

SEQ ID NO: 194138 - DNA, 22 bp, Mus musculus
atcatgcactccatgaccttta

SEQ ID NO: 194139 - DNA, 23 bp, Mus musculus
agatctgtgtgaggtcagggtca

SEQ ID NO: 194140 - DNA, 23 bp, Mus musculus
tgcttgatgtgggtgctgggagt

SEQ ID NO: 194141 - DNA, 23 bp, Mus musculus
tgtgtctgtctgtctgtgcacat

SEQ ID NO: 194142 - DNA, 23 bp, Mus musculus
tgtccctgtgtccctgtgtgttc

SEQ ID NO: 194143 - DNA, 23 bp, Mus musculus
gtgtatgtgcatgtgtatgtgca

SEQ ID NO: 194144 - DNA, 23 bp, Mus musculus
tgtctgtctgtctgtctgtctgc

SEQ ID NO: 194145 - DNA, 23 bp, Mus musculus
gccaagatgtttgactggagaga

SEQ ID NO: 194146 - DNA, 22 bp, Mus musculus
gcctgtcagtcagtcagtgtga

SEQ ID NO: 194147 - DNA, 23 bp, Mus musculus
acagtgctgtgagtatgtgagcc

SEQ ID NO: 194148 - DNA, 23 bp, Mus musculus
actggctctgtgtcctttggatc

SEQ ID NO: 194149 - DNA, 18 bp, Mus musculus
agacatgacaatgtggac

SEQ ID NO: 194150 - DNA, 23 bp, Mus musculus
tcctctcagtctgtctctgttgt

SEQ ID NO: 194151 - DNA, 23 bp, Mus musculus
catgtctgagtctggtatggaca

SEQ ID NO: 194152 - DNA, 21 bp, Mus musculus
agttgtgctttctcttgccct

SEQ ID NO: 194153 - DNA, 23 bp, Mus musculus
gtctttctgtgctttgttttact

SEQ ID NO: 194154 - DNA, 23 bp, Mus musculus
gtgtgtatgtgtgcatgtacatg

SEQ ID NO: 194155 - DNA, 23 bp, Mus musculus
tttctcacagaatcagtctctga

SEQ ID NO: 194156 - DNA, 23 bp, Mus musculus
gagtcacagtcactgtgctttgt

SEQ ID NO: 194157 - DNA, 23 bp, Mus musculus
ttctgtctttctgtgcatgatac

SEQ ID NO: 194158 - DNA, 23 bp, Mus musculus
tatctcacccttagtatagggat

SEQ ID NO: 194159 - DNA, 23 bp, Mus musculus
tccttcacatctgaatatgttgt

SEQ ID NO: 194160 - DNA, 23 bp, Mus musculus
ttctctgtggttgacatttgatt

SEQ ID NO: 194161 - DNA, 21 bp, Mus musculus
ttataacttggagctcagagt

SEQ ID NO: 194162 - DNA, 19 bp, Mus musculus
tgcttattctccatttggt

SEQ ID NO: 194163 - DNA, 22 bp, Mus musculus
cgtgtcagatgaaggtgagcag

SEQ ID NO: 194164 - DNA, 22 bp, Mus musculus
tgttttgtgaccaattatatgg

SEQ ID NO: 194165 - DNA, 22 bp, Mus musculus
tcacagtctcattttgtccttg

SEQ ID NO: 194166 - DNA, 23 bp, Mus musculus
tgtcacaaatgaacaggaacatg

SEQ ID NO: 194167 - DNA, 23 bp, Mus musculus
caatgtcctcactgtcttgtcag

SEQ ID NO: 194168 - DNA, 23 bp, Mus musculus
cttttgtgtatcaatccattgca

SEQ ID NO: 194169 - DNA, 22 bp, Mus musculus
tgttttgtgaccaattatatgg

SEQ ID NO: 194170 - DNA, 22 bp, Mus musculus
ttgcatccaagtgtgtatgtgt

SEQ ID NO: 194171 - DNA, 23 bp, Mus musculus
aaatgtgtgtgcatgtggatgtg

SEQ ID NO: 194172 - DNA, 23 bp, Mus musculus
tgtgtgtgtatgtgtatatgtgt

SEQ ID NO: 194173 - DNA, 23 bp, Mus musculus
atgtgtgtgtatgtatgtgtata

SEQ ID NO: 194174 - DNA, 19 bp, Mus musculus
cagctttttctccatttga

SEQ ID NO: 194175 - DNA, 22 bp, Mus musculus
atagagcaaaggctgtctctgt

SEQ ID NO: 194176 - DNA, 23 bp, Mus musculus
tatgtgtatatatgcatgtatgt

SEQ ID NO: 194177 - DNA, 22 bp, Mus musculus
atatatgtgtttgtatatgtgt

SEQ ID NO: 194178 - DNA, 21 bp, Mus musculus
tagtagaacatatatgtttgt

SEQ ID NO: 194179 - DNA, 19 bp, Mus musculus
taacttctaaaagaatctg

SEQ ID NO: 194180 - DNA, 21 bp, Mus musculus
atacacacatgaaaagatgtt

SEQ ID NO: 194181 - DNA, 22 bp, Mus musculus
tgactgatgttagagaggagct

SEQ ID NO: 194182 - DNA, 22 bp, Mus musculus
atgtgtgtatatgtatatgtgt

SEQ ID NO: 194183 - DNA, 23 bp, Mus musculus
tctgtctgtctgtctgtctgcct

SEQ ID NO: 194184 - DNA, 23 bp, Mus musculus
tgtggctccctccctccatggct

SEQ ID NO: 194185 - DNA, 20 bp, Mus musculus
tgtgtgcatgtgactctgcg

SEQ ID NO: 194186 - DNA, 23 bp, Mus musculus
tatgtgtgagcatgtgcatgtgc

SEQ ID NO: 194187 - DNA, 23 bp, Mus musculus
tgacccacacactctctagaagt

SEQ ID NO: 194188 - DNA, 20 bp, Mus musculus
tgcatgtatgtatgtatgta

SEQ ID NO: 194189 - DNA, 23 bp, Mus musculus
tgcctgcctgcctgcctgcctgc

SEQ ID NO: 194190 - DNA, 23 bp, Mus musculus
tgtgtctgactctgacagcacta

SEQ ID NO: 194191 - DNA, 22 bp, Mus musculus
tgacaagctcaggacctgcaca

SEQ ID NO: 194192 - DNA, 23 bp, Mus musculus
tgcatgtatgtatgtatgtatgt

SEQ ID NO: 194193 - DNA, 23 bp, Mus musculus
ctgtcgctctgtcacagcttgtg

SEQ ID NO: 194194 - DNA, 23 bp, Mus musculus
agtcagagcacagagagactgga

SEQ ID NO: 194195 - DNA, 23 bp, Mus musculus
agttcaattctcagcaaccacat

SEQ ID NO: 194196 - DNA, 23 bp, Mus musculus
tctgttagtcattgtattctctc

SEQ ID NO: 194197 - DNA, 23 bp, Mus musculus
acagagcacagagtgtgctggga

SEQ ID NO: 194198 - DNA, 22 bp, Mus musculus
atgtgtctgcttgtttatgtgg

SEQ ID NO: 194199 - DNA, 22 bp, Mus musculus
agaatatgtgaatgtatgcttt

SEQ ID NO: 194200 - DNA, 22 bp, Mus musculus
tgttttgtgaccaattatatgg

SEQ ID NO: 194201 - DNA, 22 bp, Mus musculus
gtgaagtcaccttgagctgtcc

SEQ ID NO: 194202 - DNA, 23 bp, Mus musculus
tagacacacgcatatatatgtgt

SEQ ID NO: 194203 - DNA, 23 bp, Mus musculus
atatgtgtgtatatgtatataca

SEQ ID NO: 194204 - DNA, 22 bp, Mus musculus
tcagcttgtatgtatgtatgta

SEQ ID NO: 194205 - DNA, 21 bp, Mus musculus
atgcaaattgatgaactattg

SEQ ID NO: 194206 - DNA, 23 bp, Mus musculus
cactgtcctgtctctgtctcacc

SEQ ID NO: 194207 - DNA, 23 bp, Mus musculus
ttgagagaacagtgagaggagag

SEQ ID NO: 194208 - DNA, 19 bp, Mus musculus
gtgtgtgtatatgtatgtg

SEQ ID NO: 194209 - DNA, 22 bp, Mus musculus
aagcttatcacactgtgcctgt

SEQ ID NO: 194210 - DNA, 22 bp, Mus musculus
tcactctctcagtttttgttct

SEQ ID NO: 194211 - DNA, 21 bp, Mus musculus
cagagacagacagacagacag

SEQ ID NO: 194212 - DNA, 23 bp, Mus musculus
tgtgaagactcagaatctgcttc

SEQ ID NO: 194213 - DNA, 23 bp, Mus musculus
aaaaatgttctacttctgtctct

SEQ ID NO: 194214 - DNA, 23 bp, Mus musculus
tgtgtctgtgggtctgtctgctc

SEQ ID NO: 194215 - DNA, 23 bp, Mus musculus
agatatgactctgactgtgtcac

SEQ ID NO: 194216 - DNA, 23 bp, Mus musculus
aatgtgtctctcactcggtccct

SEQ ID NO: 194217 - DNA, 23 bp, Mus musculus
tgactccctgtgtggcagccagt

SEQ ID NO: 194218 - DNA, 23 bp, Mus musculus
tgtgtgtgcatgtgtgtgtgtgt

SEQ ID NO: 194219 - DNA, 23 bp, Mus musculus
tgtcacacactgtaaatgtccct

SEQ ID NO: 194220 - DNA, 23 bp, Mus musculus
gtctctcactgggtcagacttca

SEQ ID NO: 194221 - DNA, 20 bp, Mus musculus
ctcacaatctctctgtgtgt

SEQ ID NO: 194222 - DNA, 23 bp, Mus musculus
tcggtcactctttccatgaagtg

SEQ ID NO: 194223 - DNA, 23 bp, Mus musculus
aagtgtgtgtctctgtgtgtctg

SEQ ID NO: 194224 - DNA, 23 bp, Mus musculus
aaagcttcttcaggaagctggtt

SEQ ID NO: 194225 - DNA, 23 bp, Mus musculus
ctagcaccatttgaaatcagtgt

SEQ ID NO: 194226 - DNA, 23 bp, Mus musculus
ctagcaccatctgaaatcggtta

SEQ ID NO: 194227 - DNA, 23 bp, Mus musculus
tttttcactgtaagctttgttga

SEQ ID NO: 194228 - DNA, 22 bp, Mus musculus
aacgtgcatgtactgacctcag

SEQ ID NO: 194229 - DNA, 23 bp, Mus musculus
agagtccagagttcagagccctt

SEQ ID NO: 194230 - DNA, 20 bp, Mus musculus
tgtgtgcaagtgtgtgtgca

SEQ ID NO: 194231 - DNA, 23 bp, Mus musculus
ctgtctctgtctctctctgcccc

SEQ ID NO: 194232 - DNA, 23 bp, Mus musculus
tacagcaacagaaataggtgagt

SEQ ID NO: 194233 - DNA, 23 bp, Mus musculus
ctctctgtcagtctcggtcactt

SEQ ID NO: 194234 - DNA, 23 bp, Mus musculus
tatggcactggtagaattcactg

SEQ ID NO: 194235 - DNA, 23 bp, Mus musculus
tttggcactagcacatttttgct

SEQ ID NO: 194236 - DNA, 23 bp, Mus musculus
tttggcaatggtagaactcacac

SEQ ID NO: 194237 - DNA, 22 bp, Mus musculus
tggttctagacttgccaactat

SEQ ID NO: 194238 - DNA, 23 bp, Mus musculus
gtgtgtctgtgtgtgcctgagta

SEQ ID NO: 194239 - DNA, 23 bp, Mus musculus
gagcagagagtgttgtgtgatgc

SEQ ID NO: 194240 - DNA, 20 bp, Mus musculus
tccagctctccatttttctg

SEQ ID NO: 194241 - DNA, 23 bp, Mus musculus
agtctgtcagtctctgaaatggg

SEQ ID NO: 194242 - DNA, 23 bp, Mus musculus
gtatgcatgtatgtatgtatgtg

SEQ ID NO: 194243 - DNA, 23 bp, Mus musculus
acatgtatgcgtgtatatgtgtg

SEQ ID NO: 194244 - DNA, 22 bp, Mus musculus
acacacatatgtatacatgtat

SEQ ID NO: 194245 - DNA, 23 bp, Mus musculus
atatatgtatatatatgtgtgtg

SEQ ID NO: 194246 - DNA, 23 bp, Mus musculus
gtatgtatgcatgcatgtatgtg

SEQ ID NO: 194247 - DNA, 23 bp, Mus musculus
ttacactgtagtttcaggacagc

SEQ ID NO: 194248 - DNA, 23 bp, Mus musculus
tctcagtcagtcagtcagtcagt

SEQ ID NO: 194249 - DNA, 23 bp, Mus musculus
ctgtgctctctctctctcaggca

SEQ ID NO: 194250 - DNA, 19 bp, Mus musculus
ggtagtttcctggtttgcc

SEQ ID NO: 194251 - DNA, 23 bp, Mus musculus
tcagtctctcagaccacagtgct

SEQ ID NO: 194252 - DNA, 23 bp, Mus musculus
gtgtgtgtgtgtgtgagcgtgtg

SEQ ID NO: 194253 - DNA, 22 bp, Mus musculus
tcacactcacattctctctctt

SEQ ID NO: 194254 - DNA, 23 bp, Mus musculus
aaagagaactgtgagaggaggaa

SEQ ID NO: 194255 - DNA, 22 bp, Mus musculus
tcttttttgtggcaaagatagc

SEQ ID NO: 194256 - DNA, 23 bp, Mus musculus
actccaaaactgatctttctact

SEQ ID NO: 194257 - DNA, 20 bp, Mus musculus
tggctcagtggttaggagca

SEQ ID NO: 194258 - DNA, 23 bp, Mus musculus
atgtatgtatatatatatgtgtg

SEQ ID NO: 194259 - DNA, 22 bp, Mus musculus
agtcagtcgctcagtgtctctg

SEQ ID NO: 194260 - DNA, 21 bp, Mus musculus
tttttcatatgccactgttca

SEQ ID NO: 194261 - DNA, 21 bp, Mus musculus
caggggctgtctctgactctg

SEQ ID NO: 194262 - DNA, 23 bp, Mus musculus
ctctctgactcagtgtaatttct

SEQ ID NO: 194263 - DNA, 23 bp, Mus musculus
ttaagtgactttgtaattctctg

SEQ ID NO: 194264 - DNA, 21 bp, Mus musculus
gtgtggttaaagtaatggact

SEQ ID NO: 194265 - DNA, 23 bp, Mus musculus
tgtgtgtgtgtgtatatgcatgt

SEQ ID NO: 194266 - DNA, 22 bp, Mus musculus
tgttttgtgaccaattatatgg

SEQ ID NO: 194267 - DNA, 22 bp, Mus musculus
tgttttgtgaccaattatatgg

SEQ ID NO: 194268 - DNA, 23 bp, Mus musculus
tatgtgtctgtctctgtatgcca

SEQ ID NO: 194269 - DNA, 22 bp, Mus musculus
tgagcatgtatgtatatttgta

SEQ ID NO: 194270 - DNA, 23 bp, Mus musculus
atgtatgtatgtatatgtgtgtg

SEQ ID NO: 194271 - DNA, 23 bp, Mus musculus
tccctctgacagacactggtaaa

SEQ ID NO: 194272 - DNA, 23 bp, Mus musculus
ttctagtactacaacaccttcag

SEQ ID NO: 194273 - DNA, 21 bp, Mus musculus
atgtgtgtgtgcatgtgcatg

SEQ ID NO: 194274 - DNA, 22 bp, Mus musculus
tgttttgtgaccaattatatgg

SEQ ID NO: 194275 - DNA, 22 bp, Mus musculus
tgttttgtgaccaattatatgg

SEQ ID NO: 194276 - DNA, 20 bp, Mus musculus
atgtatgtatgcatgtgtga

SEQ ID NO: 194277 - DNA, 20 bp, Mus musculus
acagcggggtttgatgagca

SEQ ID NO: 194278 - DNA, 23 bp, Mus musculus
aaactgtatacagagagcagtct

SEQ ID NO: 194279 - DNA, 21 bp, Mus musculus
agctgcatgttctttctatgt

SEQ ID NO: 194280 - DNA, 22 bp, Mus musculus
gaggaacagtggaatagttgag

SEQ ID NO: 194281 - DNA, 22 bp, Mus musculus
tgttttgtgaccaattatatgg

SEQ ID NO: 194282 - DNA, 22 bp, Mus musculus
ttctctgaagacagtgagcaag

SEQ ID NO: 194283 - DNA, 23 bp, Mus musculus
taatagaactgacagagcacagt

SEQ ID NO: 194284 - DNA, 22 bp, Mus musculus
aagaggttggttttagacatga

SEQ ID NO: 194285 - DNA, 18 bp, Mus musculus
atcatatgaatacataca

SEQ ID NO: 194286 - DNA, 23 bp, Mus musculus
agagtgcttacactgtgtcttga

SEQ ID NO: 194287 - DNA, 23 bp, Mus musculus
acagacagtgtctacttaactga

SEQ ID NO: 194288 - DNA, 23 bp, Mus musculus
tgtatgtgtatatgtatatgtgt

SEQ ID NO: 194289 - DNA, 22 bp, Mus musculus
ttgaccatatatttagttattg

SEQ ID NO: 194290 - DNA, 22 bp, Mus musculus
tgttttgtgaccaattatatgg

SEQ ID NO: 194291 - DNA, 23 bp, Mus musculus
atatatgtgtgtgtgtgtgtaca

SEQ ID NO: 194292 - DNA, 23 bp, Mus musculus
atgtatgtatatatgtatgcatg

SEQ ID NO: 194293 - DNA, 19 bp, Mus musculus
tgtctgactgcctgtgtca

SEQ ID NO: 194294 - DNA, 23 bp, Mus musculus
aagtgacaacatccagtcgcaat

SEQ ID NO: 194295 - DNA, 21 bp, Mus musculus
agaggttgatggttgcgatga

SEQ ID NO: 194296 - DNA, 23 bp, Mus musculus
atactcactctgcataggtagac

SEQ ID NO: 194297 - DNA, 21 bp, Mus musculus
actgtcagtgtcagtgactgg

SEQ ID NO: 194298 - DNA, 22 bp, Mus musculus
actgtctcagaatctctgtggc

SEQ ID NO: 194299 - DNA, 23 bp, Mus musculus
gtctctcagagtgtcatttctgg

SEQ ID NO: 194300 - DNA, 22 bp, Mus musculus
tgttttgtgaccaattatatgg

SEQ ID NO: 194301 - DNA, 23 bp, Mus musculus
catctctggctctctcagtgttt

SEQ ID NO: 194302 - DNA, 22 bp, Mus musculus
agtcaggtgtagagatgtcaga

SEQ ID NO: 194303 - DNA, 20 bp, Mus musculus
tgtctgtagactgagtgctg

SEQ ID NO: 194304 - DNA, 23 bp, Mus musculus
tagagacttattgagctcgggtt

SEQ ID NO: 194305 - DNA, 21 bp, Mus musculus
acagcataattctagttcttg

SEQ ID NO: 194306 - DNA, 20 bp, Mus musculus
tgcatctatctatctatcta

SEQ ID NO: 194307 - DNA, 20 bp, Mus musculus
agatgtaaggatgtatttat

SEQ ID NO: 194308 - DNA, 23 bp, Mus musculus
tatatgtgtatatgtaatgtgta

SEQ ID NO: 194309 - DNA, 18 bp, Mus musculus
tgagatagggattcctca

SEQ ID NO: 194310 - DNA, 23 bp, Mus musculus
tctctcttgctctcagtgtcctt

SEQ ID NO: 194311 - DNA, 23 bp, Mus musculus
tctctcagacacttacttcttac

SEQ ID NO: 194312 - DNA, 18 bp, Mus musculus
ctgagacggacttttgtg

SEQ ID NO: 194313 - DNA, 23 bp, Mus musculus
ttatgtagtagatgcacacagag

SEQ ID NO: 194314 - DNA, 18 bp, Mus musculus
tgtagatgccaacaagtg

SEQ ID NO: 194315 - DNA, 21 bp, Mus musculus
taattaactgtaggtcagtaa

SEQ ID NO: 194316 - DNA, 19 bp, Mus musculus
attgacagaggatttctgg

SEQ ID NO: 194317 - DNA, 23 bp, Mus musculus
taacatttttgaggtgggtgggt

SEQ ID NO: 194318 - DNA, 23 bp, Mus musculus
ttttctgagagcttaacttgagt

SEQ ID NO: 194319 - DNA, 19 bp, Mus musculus
tatatgtgtgtgcatgtac

SEQ ID NO: 194320 - DNA, 22 bp, Mus musculus
tcactctacactgaaggactat

SEQ ID NO: 194321 - DNA, 23 bp, Mus musculus
agagacagtggatttattttctt

SEQ ID NO: 194322 - DNA, 23 bp, Mus musculus
gagtgtgtatgtgactgtgactg

SEQ ID NO: 194323 - DNA, 22 bp, Mus musculus
tgttttgtgaccaattatatgg

SEQ ID NO: 194324 - DNA, 22 bp, Mus musculus
tgttttgtgaccaattatatgg

SEQ ID NO: 194325 - DNA, 18 bp, Mus musculus
ttatatatatatgtgtgt

SEQ ID NO: 194326 - DNA, 23 bp, Mus musculus
attatatgcatatatatgcatgt

SEQ ID NO: 194327 - DNA, 20 bp, Mus musculus
agcttctagaatatcccaga

SEQ ID NO: 194328 - DNA, 18 bp, Mus musculus
aaacaacatggtaaggat

SEQ ID NO: 194329 - DNA, 23 bp, Mus musculus
ctatatttgttttgatcatgtag

SEQ ID NO: 194330 - DNA, 23 bp, Mus musculus
agacaatacatttagagcagaag

SEQ ID NO: 194331 - DNA, 23 bp, Mus musculus
tcagtgtgtgtgtgtgtgtctat

SEQ ID NO: 194332 - DNA, 19 bp, Mus musculus
tcagagatgtgactgtgga

SEQ ID NO: 194333 - DNA, 23 bp, Mus musculus
atgtgtgtatgttagtatgtgtg

SEQ ID NO: 194334 - DNA, 23 bp, Mus musculus
agaagagtgttgttcagtttcca

SEQ ID NO: 194335 - DNA, 23 bp, Mus musculus
tttattttgttattgaagatcag

SEQ ID NO: 194336 - DNA, 19 bp, Mus musculus
actggtttaacagtaaagt

SEQ ID NO: 194337 - DNA, 23 bp, Mus musculus
tgtgtctctgtgtgtatgtgttt

SEQ ID NO: 194338 - DNA, 22 bp, Mus musculus
tgttttgtgaccaattatatgg

SEQ ID NO: 194339 - DNA, 23 bp, Mus musculus
gggtgctctctctctctctcccg

SEQ ID NO: 194340 - DNA, 22 bp, Mus musculus
gcactctctgagacagttgatg

SEQ ID NO: 194341 - DNA, 23 bp, Mus musculus
tatatggatatatatacagatat

SEQ ID NO: 194342 - DNA, 21 bp, Mus musculus
tccatggtggtctgataggat

SEQ ID NO: 194343 - DNA, 22 bp, Mus musculus
tgttttgtgaccaattatatgg

SEQ ID NO: 194344 - DNA, 22 bp, Mus musculus
acagacaagccttagggattgg

SEQ ID NO: 194345 - DNA, 23 bp, Mus musculus
atacagtgggaaaagaatgtcag

SEQ ID NO: 194346 - DNA, 23 bp, Mus musculus
tggccctgtgtaactctctgaca

SEQ ID NO: 194347 - DNA, 22 bp, Mus musculus
catgaactagagtgtgagctct

SEQ ID NO: 194348 - DNA, 22 bp, Mus musculus
aaggactcagctactctattcc

SEQ ID NO: 194349 - DNA, 19 bp, Mus musculus
gaagcctttacttggtttt

SEQ ID NO: 194350 - DNA, 23 bp, Mus musculus
tatgtatgtatatatgtgtgttt

SEQ ID NO: 194351 - DNA, 21 bp, Mus musculus
tacacacacacatatgtatgt

SEQ ID NO: 194352 - DNA, 23 bp, Mus musculus
gtatgcatgcatgtatgtatgta

SEQ ID NO: 194353 - DNA, 20 bp, Mus musculus
agattggagaatacaatgtt

SEQ ID NO: 194354 - DNA, 23 bp, Mus musculus
tatctatatgtatatgtgtgtgt

SEQ ID NO: 194355 - DNA, 23 bp, Mus musculus
ttttgtgtgtgggtacatggagg

SEQ ID NO: 194356 - DNA, 19 bp, Mus musculus
tgatgtaaggtgattggtt

SEQ ID NO: 194357 - DNA, 19 bp, Mus musculus
ctagtgtttttcctggtac

SEQ ID NO: 194358 - DNA, 23 bp, Mus musculus
ctctgtgagactgtccctgtgtt

SEQ ID NO: 194359 - DNA, 19 bp, Mus musculus
attgaatgacacagaaaac

SEQ ID NO: 194360 - DNA, 23 bp, Mus musculus
tcagtgaagtgactgagcccttc

SEQ ID NO: 194361 - DNA, 22 bp, Mus musculus
gcactgactgctcttccagagg

SEQ ID NO: 194362 - DNA, 23 bp, Mus musculus
agtcctgttgtatctgtaaagcc

SEQ ID NO: 194363 - DNA, 20 bp, Mus musculus
aagtagttgcttacaaagtt

SEQ ID NO: 194364 - DNA, 19 bp, Mus musculus
ctgtgccactatgttgtct

SEQ ID NO: 194365 - DNA, 19 bp, Mus musculus
ctcagcagtcttcctcaag

SEQ ID NO: 194366 - DNA, 19 bp, Mus musculus
agcaagtcaatttagtgaa

SEQ ID NO: 194367 - DNA, 23 bp, Mus musculus
tatgtatatatgtatgtgtttgt

SEQ ID NO: 194368 - DNA, 23 bp, Mus musculus
gtgtgtcactctgtgggtgggtt

SEQ ID NO: 194369 - DNA, 23 bp, Mus musculus
ctgagtagtgatgatgttctcct

SEQ ID NO: 194370 - DNA, 20 bp, Mus musculus
atgtgtatgtatatatgtgt

SEQ ID NO: 194371 - DNA, 22 bp, Mus musculus
tgtatatatgtatgtatatgtg

SEQ ID NO: 194372 - DNA, 23 bp, Mus musculus
gagcatgagagtctcactgtcac

SEQ ID NO: 194373 - DNA, 23 bp, Mus musculus
actttaaatagtgctattgttga

SEQ ID NO: 194374 - DNA, 23 bp, Mus musculus
tatagtcctattgtaaagactca

SEQ ID NO: 194375 - DNA, 23 bp, Mus musculus
tttatatctatagatttgtgttg

SEQ ID NO: 194376 - DNA, 18 bp, Mus musculus
tgcatgtatatatgaatg

SEQ ID NO: 194377 - DNA, 19 bp, Mus musculus
gagaacgtggtgctcaaac

SEQ ID NO: 194378 - DNA, 21 bp, Mus musculus
acactatttcaatacttttct

SEQ ID NO: 194379 - DNA, 20 bp, Mus musculus
ttacactcagatctcacagg

SEQ ID NO: 194380 - DNA, 23 bp, Mus musculus
tgtgtgtctgtttgtcattcatc

SEQ ID NO: 194381 - DNA, 18 bp, Mus musculus
aagactcctaaccgtgga

SEQ ID NO: 194382 - DNA, 23 bp, Mus musculus
taatatgtatttgtgcactatat

SEQ ID NO: 194383 - DNA, 23 bp, Mus musculus
atatatgtgtgtgtatgcatgtg

SEQ ID NO: 194384 - DNA, 21 bp, Mus musculus
attcctgtaatggctgctttc

SEQ ID NO: 194385 - DNA, 21 bp, Mus musculus
atgtgtgtatatatatgtgtg

SEQ ID NO: 194386 - DNA, 23 bp, Mus musculus
tcactgaacattcagagctgaac

SEQ ID NO: 194387 - DNA, 22 bp, Mus musculus
tgttttgtgaccaattatatgg

SEQ ID NO: 194388 - DNA, 23 bp, Mus musculus
ggttccatttgtattcaagaagg

SEQ ID NO: 194389 - DNA, 19 bp, Mus musculus
attttgagtgagaatgttc

SEQ ID NO: 194390 - DNA, 23 bp, Mus musculus
caagataggaggtggttatgagt

SEQ ID NO: 194391 - DNA, 19 bp, Mus musculus
tgcaagcacaacatggcat

SEQ ID NO: 194392 - DNA, 23 bp, Mus musculus
tagtgcatggtgatctgatagga

SEQ ID NO: 194393 - DNA, 22 bp, Mus musculus
tgttttgtgacctattatgtgg

SEQ ID NO: 194394 - DNA, 21 bp, Mus musculus
atatgtatatatacatgtatg

SEQ ID NO: 194395 - DNA, 23 bp, Mus musculus
tgtttggcttgactttaggtatg

SEQ ID NO: 194396 - DNA, 22 bp, Mus musculus
tgttttgtgaccaattatatgg

SEQ ID NO: 194397 - DNA, 19 bp, Mus musculus
actccaggggctggagaga

SEQ ID NO: 194398 - DNA, 23 bp, Mus musculus
atagcactgactgctcatccaga

SEQ ID NO: 194399 - DNA, 22 bp, Mus musculus
tgttttgtgaccaattatatgg

SEQ ID NO: 194400 - DNA, 22 bp, Mus musculus
tgttttgtgaccaattatatgg

SEQ ID NO: 194401 - DNA, 23 bp, Mus musculus
acttcaagaacaaggttgaatag

SEQ ID NO: 194402 - DNA, 22 bp, Mus musculus
tgttttgtgaccaattatatgg

SEQ ID NO: 194403 - DNA, 18 bp, Mus musculus
tacatatgtatatttgta

SEQ ID NO: 194404 - DNA, 19 bp, Mus musculus
gtatgatgtgtggttatgt

SEQ ID NO: 194405 - DNA, 23 bp, Mus musculus
ttgtgtgtgcatatgtgtatttg

SEQ ID NO: 194406 - DNA, 22 bp, Mus musculus
tatgtctgtgtatatgcatgtg

SEQ ID NO: 194407 - DNA, 19 bp, Mus musculus
tctatctatctatctctct

SEQ ID NO: 194408 - DNA, 23 bp, Mus musculus
tgatgcttgaagtttccatgtct

SEQ ID NO: 194409 - DNA, 22 bp, Mus musculus
tgttttgtgaccaattatatgg

SEQ ID NO: 194410 - DNA, 22 bp, Mus musculus
tgttttgtgaccaattatatgg

SEQ ID NO: 194411 - DNA, 23 bp, Mus musculus
caaggtattctgacacaagtgta

SEQ ID NO: 194412 - DNA, 23 bp, Mus musculus
ttccatggtttagttatcagtgt

SEQ ID NO: 194413 - DNA, 19 bp, Mus musculus
tgagttgagtagagtacct

SEQ ID NO: 194414 - DNA, 20 bp, Mus musculus
tcacagaactgagtgacttg

SEQ ID NO: 194415 - DNA, 21 bp, Mus musculus
ctctgagaccagtctgtgcag

SEQ ID NO: 194416 - DNA, 23 bp, Mus musculus
aggatttctttttatatttctgt

SEQ ID NO: 194417 - DNA, 22 bp, Mus musculus
tgttttgtgaccaattatatgg

SEQ ID NO: 194418 - DNA, 22 bp, Mus musculus
taacatgtagatctctgtgtct

SEQ ID NO: 194419 - DNA, 23 bp, Mus musculus
gcagtgtgagagaatggagtgac

SEQ ID NO: 194420 - DNA, 21 bp, Mus musculus
tagaggtcagagcacaaatga

SEQ ID NO: 194421 - DNA, 23 bp, Mus musculus
tgcctgcctccctctgtgtgtca

SEQ ID NO: 194422 - DNA, 20 bp, Mus musculus
aagagcactgactgctcttc

SEQ ID NO: 194423 - DNA, 23 bp, Mus musculus
tttctctcacagtcactttagtt

SEQ ID NO: 194424 - DNA, 20 bp, Mus musculus
tgagatggatctctagtgca

SEQ ID NO: 194425 - DNA, 22 bp, Mus musculus
tgttgtgtgaccaattatatgg

SEQ ID NO: 194426 - DNA, 23 bp, Mus musculus
tctctctctgtctttatggttct

SEQ ID NO: 194427 - DNA, 23 bp, Mus musculus
gagcgagtgtctctgggtctgtc

SEQ ID NO: 194428 - DNA, 22 bp, Mus musculus
agagagctgggatctctgtttg

SEQ ID NO: 194429 - DNA, 19 bp, Mus musculus
aggagagtcagagttcctg

SEQ ID NO: 194430 - DNA, 19 bp, Mus musculus
catggtggtctgataggat

SEQ ID NO: 194431 - DNA, 22 bp, Mus musculus
ttatgaccaattatatggtcaa

SEQ ID NO: 194432 - DNA, 23 bp, Mus musculus
tttgtctgtaaggtaaagtacat

SEQ ID NO: 194433 - DNA, 22 bp, Mus musculus
aacagtgaagtcactgaggtca

SEQ ID NO: 194434 - DNA, 23 bp, Mus musculus
tgttaagtattctaactcatctc

SEQ ID NO: 194435 - DNA, 18 bp, Mus musculus
tgtcagatgagagagagc

SEQ ID NO: 194436 - DNA, 23 bp, Mus musculus
tttaagactgtgtttgtacagat

SEQ ID NO: 194437 - DNA, 23 bp, Mus musculus
tatttttcatcatgtaatgtaac

SEQ ID NO: 194438 - DNA, 23 bp, Mus musculus
tttatgctgctattgaagatcag

SEQ ID NO: 194439 - DNA, 23 bp, Mus musculus
tgatcatatgcgtgtgaagctgt

SEQ ID NO: 194440 - DNA, 18 bp, Mus musculus
tgtgaggctcattgggtc

SEQ ID NO: 194441 - DNA, 23 bp, Mus musculus
tgtgtctgtctgtctgtctgtct

SEQ ID NO: 194442 - DNA, 22 bp, Mus musculus
tgttttgtgaccaattatatgg

SEQ ID NO: 194443 - DNA, 20 bp, Mus musculus
aacacagtatatgtatgtgt

SEQ ID NO: 194444 - DNA, 19 bp, Mus musculus
gaggtactaagtgctaaga

SEQ ID NO: 194445 - DNA, 21 bp, Mus musculus
gtggacttgccacagtctgtg

SEQ ID NO: 194446 - DNA, 20 bp, Mus musculus
ttctctctcatactgtttcc

SEQ ID NO: 194447 - DNA, 19 bp, Mus musculus
ttgtacagcccaaatctct

SEQ ID NO: 194448 - DNA, 23 bp, Mus musculus
atcagtctatttgtttattagta

SEQ ID NO: 194449 - DNA, 21 bp, Mus musculus
ttctggtgatattggatagct

SEQ ID NO: 194450 - DNA, 23 bp, Mus musculus
agtcttactgcaacttgatatgt

SEQ ID NO: 194451 - DNA, 23 bp, Mus musculus
aatctactagagggagcctttct

SEQ ID NO: 194452 - DNA, 22 bp, Mus musculus
agaaagaatccactttgtgttt

SEQ ID NO: 194453 - DNA, 21 bp, Mus musculus
tcactgcgtctctgtgtgtct

SEQ ID NO: 194454 - DNA, 23 bp, Mus musculus
acatgtgtgtgtgtgtgtgagag

SEQ ID NO: 194455 - DNA, 23 bp, Mus musculus
atgtcactggaggtaggttttga

SEQ ID NO: 194456 - DNA, 23 bp, Mus musculus
gtctctgtttctctctgcctata

SEQ ID NO: 194457 - DNA, 22 bp, Mus musculus
ttctgtgatgaacagagcctgg

SEQ ID NO: 194458 - DNA, 21 bp, Mus musculus
atgtatgtatatatgtgtgtg

SEQ ID NO: 194459 - DNA, 22 bp, Mus musculus
tatgcatgtatgtatgtatgta

SEQ ID NO: 194460 - DNA, 23 bp, Mus musculus
tcagagcatcatgaatacagaaa

SEQ ID NO: 194461 - DNA, 23 bp, Mus musculus
agttttctgtttttcatattgtc

SEQ ID NO: 194462 - DNA, 23 bp, Mus musculus
tgagtgaactgtgtgagcccaga

SEQ ID NO: 194463 - DNA, 23 bp, Mus musculus
aagtcagtgtccacactgcctgt

SEQ ID NO: 194464 - DNA, 23 bp, Mus musculus
agcatatatacacatatacatat

SEQ ID NO: 194465 - DNA, 23 bp, Mus musculus
tttcggtcactctctcactgagc

SEQ ID NO: 194466 - DNA, 21 bp, Mus musculus
aattctgaagacagtctgcac

SEQ ID NO: 194467 - DNA, 23 bp, Mus musculus
ttctgacagatgacacagggcag

SEQ ID NO: 194468 - DNA, 23 bp, Mus musculus
catctctccttttcttatcacag

SEQ ID NO: 194469 - DNA, 21 bp, Mus musculus
ctagtgttcttgatcttcttc

SEQ ID NO: 194470 - DNA, 22 bp, Mus musculus
tgttttgtgaccaattatatgg

SEQ ID NO: 194471 - DNA, 18 bp, Mus musculus
acagaagagcattggtta

SEQ ID NO: 194472 - DNA, 18 bp, Mus musculus
atatgatttcttggacaa

SEQ ID NO: 194473 - DNA, 23 bp, Mus musculus
agagaaatgagtgtgtacagttt

SEQ ID NO: 194474 - DNA, 22 bp, Mus musculus
agacagacagacagacagacag

SEQ ID NO: 194475 - DNA, 23 bp, Mus musculus
cagacagacagacagacagacag

SEQ ID NO: 194476 - DNA, 23 bp, Mus musculus
tgactgggagtggatctgcatgt

SEQ ID NO: 194477 - DNA, 22 bp, Mus musculus
cagtgagcacatcctacaccca

SEQ ID NO: 194478 - DNA, 22 bp, Mus musculus
tgttttgtgaccaattatatgg

SEQ ID NO: 194479 - DNA, 22 bp, Mus musculus
tgttttgtgaccaattatatgg

SEQ ID NO: 194480 - DNA, 23 bp, Mus musculus
aagagctgacagaggagacattg

SEQ ID NO: 194481 - DNA, 19 bp, Mus musculus
ctgagttcaattcccagtg

SEQ ID NO: 194482 - DNA, 22 bp, Mus musculus
tgttttgtgaccaattatatgg

SEQ ID NO: 194483 - DNA, 22 bp, Mus musculus
tgttttgtgaccaattatatgg

SEQ ID NO: 194484 - DNA, 22 bp, Mus musculus
ttatatatctggaggaatttct

SEQ ID NO: 194485 - DNA, 21 bp, Mus musculus
tgctttgtaaagaactttgaa

SEQ ID NO: 194486 - DNA, 22 bp, Mus musculus
acacacacacacatatatgtgt

SEQ ID NO: 194487 - DNA, 23 bp, Mus musculus
gtatgtatgtatgtatgtatgta

SEQ ID NO: 194488 - DNA, 23 bp, Mus musculus
ctgtgtctctgtttagtttctgt

SEQ ID NO: 194489 - DNA, 23 bp, Mus musculus
aggatctgtccattgatgagagt

SEQ ID NO: 194490 - DNA, 22 bp, Mus musculus
tatgtctatactatgtgtgtgt

SEQ ID NO: 194491 - DNA, 23 bp, Mus musculus
tgtatgtgtgtgtgtgtaaatac

SEQ ID NO: 194492 - DNA, 21 bp, Mus musculus
tttgcatatacatacatgtat

SEQ ID NO: 194493 - DNA, 22 bp, Mus musculus
tgttttgtgaccaattatatgg

SEQ ID NO: 194494 - DNA, 23 bp, Mus musculus
atctcagaagattgaaagctctc

SEQ ID NO: 194495 - DNA, 22 bp, Mus musculus
tgttttgtgaccaattatatgg

SEQ ID NO: 194496 - DNA, 22 bp, Mus musculus
tgttttgtgaccaattatatgg

SEQ ID NO: 194497 - DNA, 22 bp, Mus musculus
tgttttgtgaccaattatatgg

SEQ ID NO: 194498 - DNA, 23 bp, Mus musculus
gtgtgcatgtgcatgtgcatgtg

SEQ ID NO: 194499 - DNA, 23 bp, Mus musculus
gatgtgtcgctccctgattggct

SEQ ID NO: 194500 - DNA, 23 bp, Mus musculus
gttttggataagttatcatgatg

SEQ ID NO: 194501 - DNA, 19 bp, Mus musculus
gtcttgtcactctttctgt

SEQ ID NO: 194502 - DNA, 23 bp, Mus musculus
catgaatatgtatgcaattgtgt

SEQ ID NO: 194503 - DNA, 21 bp, Mus musculus
tcacacaggatgtgcatgatg

SEQ ID NO: 194504 - DNA, 19 bp, Mus musculus
tagctgtgatgtggtgggg

SEQ ID NO: 194505 - DNA, 23 bp, Mus musculus
ctgtctgtctgtctgtctatcta

SEQ ID NO: 194506 - DNA, 18 bp, Mus musculus
gggatagactgtgggact

SEQ ID NO: 194507 - DNA, 22 bp, Mus musculus
cactatgggtctgtgtgactgt

SEQ ID NO: 194508 - DNA, 20 bp, Mus musculus
actgtgggtctgtgggtctg

SEQ ID NO: 194509 - DNA, 23 bp, Mus musculus
gtatgtatgtatgtatgtatgta

SEQ ID NO: 194510 - DNA, 22 bp, Mus musculus
atgtatgtatgcatgtgcatgc

SEQ ID NO: 194511 - DNA, 23 bp, Mus musculus
cagtcagtgtgtcagtgtgtcaa

SEQ ID NO: 194512 - DNA, 21 bp, Mus musculus
tgtgtgagaaatggctcagtg

SEQ ID NO: 194513 - DNA, 23 bp, Mus musculus
tgtgcgtgcatgcatgtgtgtct

SEQ ID NO: 194514 - DNA, 23 bp, Mus musculus
atgtatgcatgtatgtatgtgtg

SEQ ID NO: 194515 - DNA, 21 bp, Mus musculus
gaagtgagggtgagtaggtgc

SEQ ID NO: 194516 - DNA, 23 bp, Mus musculus
tgtgagaggctgcctgattccca

SEQ ID NO: 194517 - DNA, 22 bp, Mus musculus
aacacagcttcttgttccctct

SEQ ID NO: 194518 - DNA, 23 bp, Mus musculus
caggctctgtgcctcagtccttg

SEQ ID NO: 194519 - DNA, 22 bp, Mus musculus
tagagactgaggcacaaagagg

SEQ ID NO: 194520 - DNA, 23 bp, Mus musculus
gtgtccgtctgtctgtcttggta

SEQ ID NO: 194521 - DNA, 23 bp, Mus musculus
actgagaggagagagtggacttg

SEQ ID NO: 194522 - DNA, 23 bp, Mus musculus
ccctctgtttagtctgactaagg

SEQ ID NO: 194523 - DNA, 23 bp, Mus musculus
agcttgagtagacattttgttca

SEQ ID NO: 194524 - DNA, 23 bp, Mus musculus
tctctctagtgactgtcaaaggt

SEQ ID NO: 194525 - DNA, 22 bp, Mus musculus
tgttttgtgaccaattatatgg

SEQ ID NO: 194526 - DNA, 22 bp, Mus musculus
cagagatttcttcttgtggtgg

SEQ ID NO: 194527 - DNA, 23 bp, Mus musculus
tctcactgtcaagtagtcccgct

SEQ ID NO: 194528 - DNA, 23 bp, Mus musculus
tctgaccatttagattggtgttg

SEQ ID NO: 194529 - DNA, 18 bp, Mus musculus
tgtggaagtgaagctgct

SEQ ID NO: 194530 - DNA, 23 bp, Mus musculus
gtgtctctgacactgtgtgcaga

SEQ ID NO: 194531 - DNA, 23 bp, Mus musculus
tctgtctgtctgtctgtctgcct

SEQ ID NO: 194532 - DNA, 20 bp, Mus musculus
tgtgagtggtgggggtctgt

SEQ ID NO: 194533 - DNA, 23 bp, Mus musculus
tgagcaaagtgtgaggagacagg

SEQ ID NO: 194534 - DNA, 19 bp, Mus musculus
tgtctaccaataccctgtg

SEQ ID NO: 194535 - DNA, 23 bp, Mus musculus
atgtgtgtgtgcatgtgcatgtg

SEQ ID NO: 194536 - DNA, 21 bp, Mus musculus
tacgtcgtagaatataaaatc

SEQ ID NO: 194537 - DNA, 19 bp, Mus musculus
agctccatggtacagggct

SEQ ID NO: 194538 - DNA, 23 bp, Mus musculus
gtcccagtgtctgagtctgtgtg

SEQ ID NO: 194539 - DNA, 23 bp, Mus musculus
tctttccacatgttgccagtctg

SEQ ID NO: 194540 - DNA, 23 bp, Mus musculus
ttctctgtgtcactctttgcctg

SEQ ID NO: 194541 - DNA, 22 bp, Mus musculus
tgcaatgaaatttagaatggtt

SEQ ID NO: 194542 - DNA, 23 bp, Mus musculus
tgtcaggctccgtgaatcccaca

SEQ ID NO: 194543 - DNA, 23 bp, Mus musculus
tgtatgtatttgtatgagttatt

SEQ ID NO: 194544 - DNA, 23 bp, Mus musculus
ttctctgtgtcactctttgcctg

SEQ ID NO: 194545 - DNA, 21 bp, Mus musculus
tgtcaggctccgtgaatccca

SEQ ID NO: 194546 - DNA, 22 bp, Mus musculus
tgttttgtgaccaattatatgg

SEQ ID NO: 194547 - DNA, 23 bp, Mus musculus
tgtatgtatttgtatgagttatt

SEQ ID NO: 194548 - DNA, 23 bp, Mus musculus
tgcaatgaaattcagaatggttt

SEQ ID NO: 194549 - DNA, 23 bp, Mus musculus
tgtatgtatttgtatgagttatt

SEQ ID NO: 194550 - DNA, 23 bp, Mus musculus
ttctctgtgtcactctttgcctg

SEQ ID NO: 194551 - DNA, 21 bp, Mus musculus
tgtcaggctccgtgaatccca

SEQ ID NO: 194552 - DNA, 22 bp, Mus musculus
tgttttgtgaccaattatatgg

SEQ ID NO: 194553 - DNA, 23 bp, Mus musculus
gctctctctctgtgagactaggc

SEQ ID NO: 194554 - DNA, 23 bp, Mus musculus
tcagtagttcctcaggtagaagt

SEQ ID NO: 194555 - DNA, 23 bp, Mus musculus
cacagtgtgtgtgtgtgtccctg

SEQ ID NO: 194556 - DNA, 22 bp, Mus musculus
taaagctgcctctcagagcggg

SEQ ID NO: 194557 - DNA, 18 bp, Mus musculus
tagaagttgatgctggaa

SEQ ID NO: 194558 - DNA, 21 bp, Mus musculus
tttcagtctggatctttagac

SEQ ID NO: 194559 - DNA, 23 bp, Mus musculus
tctcactgtgtgagctctggcct

SEQ ID NO: 194560 - DNA, 23 bp, Mus musculus
taagtctccctctctgagccttt

SEQ ID NO: 194561 - DNA, 22 bp, Mus musculus
ggacctggcttgatcgtcctgt

SEQ ID NO: 194562 - DNA, 23 bp, Mus musculus
aggctcagaccgaatgtcatcac

SEQ ID NO: 194563 - DNA, 22 bp, Mus musculus
acacaggcttgagtgtgagctt

SEQ ID NO: 194564 - DNA, 23 bp, Mus musculus
gtgtctgtccctctgtccgccgc

SEQ ID NO: 194565 - DNA, 23 bp, Mus musculus
tccctgcctgcctgtgagcgaaa

SEQ ID NO: 194566 - DNA, 23 bp, Mus musculus
tctcatgacttcacactggccgt

SEQ ID NO: 194567 - DNA, 23 bp, Mus musculus
ggctcagtcagtgggtcagtgac

SEQ ID NO: 194568 - DNA, 19 bp, Mus musculus
tgcacttccacacactttt

SEQ ID NO: 194569 - DNA, 22 bp, Mus musculus
cctctgtcactctgtgtgtctg

SEQ ID NO: 194570 - DNA, 21 bp, Mus musculus
tctcactgtgtcactgtggct

SEQ ID NO: 194571 - DNA, 23 bp, Mus musculus
tgtgtccttgttctctctgtgtg

SEQ ID NO: 194572 - DNA, 23 bp, Mus musculus
tccctcactccctcactgagcca

SEQ ID NO: 194573 - DNA, 23 bp, Mus musculus
tgtgtgtatatatgtatatgtgt

SEQ ID NO: 194574 - DNA, 23 bp, Mus musculus
gcctacagaggtcagaagagggt

SEQ ID NO: 194575 - DNA, 22 bp, Mus musculus
atatatgtatatgtgtgtgtgt

SEQ ID NO: 194576 - DNA, 23 bp, Mus musculus
agagtctcactctcagacccctc

SEQ ID NO: 194577 - DNA, 23 bp, Mus musculus
cttccacctgttataggtatgag

SEQ ID NO: 194578 - DNA, 23 bp, Mus musculus
ttctgtgtcaggttttgatttag

SEQ ID NO: 194579 - DNA, 23 bp, Mus musculus
actgtcattttcttattctgtgt

SEQ ID NO: 194580 - DNA, 22 bp, Mus musculus
ttcagtgaagtggatgcgctat

SEQ ID NO: 194581 - DNA, 23 bp, Mus musculus
tgtctctatcactcagtggcaca

SEQ ID NO: 194582 - DNA, 18 bp, Mus musculus
ttaatagttttggtggag

SEQ ID NO: 194583 - DNA, 23 bp, Mus musculus
aaagatgagtgtgagctgagaag

SEQ ID NO: 194584 - DNA, 23 bp, Mus musculus
taccaccctggcttgatggtgcc

SEQ ID NO: 194585 - DNA, 21 bp, Mus musculus
tgtctatctaggcatgtgtct

SEQ ID NO: 194586 - DNA, 23 bp, Mus musculus
tatgtgtctgtataggcatgtgt

SEQ ID NO: 194587 - DNA, 19 bp, Mus musculus
tctgtctaggcatgtgtct

SEQ ID NO: 194588 - DNA, 22 bp, Mus musculus
tatatgtatctattgactatgt

SEQ ID NO: 194589 - DNA, 23 bp, Mus musculus
ttgtgtatttatgtatatgtaca

SEQ ID NO: 194590 - DNA, 23 bp, Mus musculus
ctctatctccatctccatctgca

SEQ ID NO: 194591 - DNA, 21 bp, Mus musculus
agctgaggtagaagattgttg

SEQ ID NO: 194592 - DNA, 21 bp, Mus musculus
tccatggtggtctgataggat

SEQ ID NO: 194593 - DNA, 22 bp, Mus musculus
tgttttgtgaccaattatatgg

SEQ ID NO: 194594 - DNA, 21 bp, Mus musculus
tcacctgatttctctctgtct

SEQ ID NO: 194595 - DNA, 18 bp, Mus musculus
tctgtgtcattgactctg

SEQ ID NO: 194596 - DNA, 23 bp, Mus musculus
ctgtgtctctgtttagtttctgt

SEQ ID NO: 194597 - DNA, 21 bp, Mus musculus
atctgtccattgatgagagtg

SEQ ID NO: 194598 - DNA, 18 bp, Mus musculus
actgtctgtaactcaagt

SEQ ID NO: 194599 - DNA, 20 bp, Mus musculus
tgtgagaagttacagaggag

SEQ ID NO: 194600 - DNA, 19 bp, Mus musculus
taggtcctgagttcaattc

SEQ ID NO: 194601 - DNA, 23 bp, Mus musculus
gcaactccttggacaccagcctc

SEQ ID NO: 194602 - DNA, 20 bp, Mus musculus
tcaggagttcaaggttgttc

SEQ ID NO: 194603 - DNA, 20 bp, Mus musculus
cagcgctcactctgactgac

SEQ ID NO: 194604 - DNA, 19 bp, Mus musculus
tgtcagagcttttgagact

SEQ ID NO: 194605 - DNA, 23 bp, Mus musculus
gtgtgcgcgtgtgcactcgcaca

SEQ ID NO: 194606 - DNA, 23 bp, Mus musculus
ctgtgtctctgtttagtttctgt

SEQ ID NO: 194607 - DNA, 23 bp, Mus musculus
aggatctgtccattgatgagagt

SEQ ID NO: 194608 - DNA, 21 bp, Mus musculus
tatgtctatttttttttaaga

SEQ ID NO: 194609 - DNA, 23 bp, Mus musculus
aagctggacatgaagtcactgta

SEQ ID NO: 194610 - DNA, 23 bp, Mus musculus
acttggttggttgtctttggcaa

SEQ ID NO: 194611 - DNA, 23 bp, Mus musculus
gacagagtctgactcagtccctc

SEQ ID NO: 194612 - DNA, 19 bp, Mus musculus
tgagtactggcatcagagg

SEQ ID NO: 194613 - DNA, 23 bp, Mus musculus
gccactctgcctgactcaaattg

SEQ ID NO: 194614 - DNA, 23 bp, Mus musculus
tgtttaagatgttaccttttggg

SEQ ID NO: 194615 - DNA, 23 bp, Mus musculus
aacagagagatcagactagatgg

SEQ ID NO: 194616 - DNA, 20 bp, Mus musculus
cacccatggttatcttctga

SEQ ID NO: 194617 - DNA, 19 bp, Mus musculus
gtatgtatgtatgtatgta

SEQ ID NO: 194618 - DNA, 23 bp, Mus musculus
cggtcacacagcctgtgtctctg

SEQ ID NO: 194619 - DNA, 23 bp, Mus musculus
tctccctcactgtctctctccta

SEQ ID NO: 194620 - DNA, 23 bp, Mus musculus
aaacacaatcattttcatttcct

SEQ ID NO: 194621 - DNA, 23 bp, Mus musculus
acttatgatccttctgtctcaaa

SEQ ID NO: 194622 - DNA, 22 bp, Mus musculus
tgaggatgttacagtggggtta

SEQ ID NO: 194623 - DNA, 23 bp, Mus musculus
ctctgtctctgtctggctgctct

SEQ ID NO: 194624 - DNA, 19 bp, Mus musculus
tcagtggttaagaacactg

SEQ ID NO: 194625 - DNA, 23 bp, Mus musculus
gactgtgtctctcttagtgataa

SEQ ID NO: 194626 - DNA, 21 bp, Mus musculus
atacagagagacttagtccag

SEQ ID NO: 194627 - DNA, 23 bp, Mus musculus
ccagtctaccagcaccagagaca

SEQ ID NO: 194628 - DNA, 21 bp, Mus musculus
tgacgagtgtctgtgtctgtc

SEQ ID NO: 194629 - DNA, 22 bp, Mus musculus
tcagacgctcacactgtcagtt

SEQ ID NO: 194630 - DNA, 21 bp, Mus musculus
cgctgactgctcttccagagg

SEQ ID NO: 194631 - DNA, 22 bp, Mus musculus
tgtatgtatgtatacatgtgtc

SEQ ID NO: 194632 - DNA, 23 bp, Mus musculus
ctgtggaagaagatcttgtaagg

SEQ ID NO: 194633 - DNA, 20 bp, Mus musculus
aagagcactgactgctcttc

SEQ ID NO: 194634 - DNA, 23 bp, Mus musculus
ctgtgtgctgcttggtctctgtc

SEQ ID NO: 194635 - DNA, 20 bp, Mus musculus
tgacagaagctagagtcacc

SEQ ID NO: 194636 - DNA, 18 bp, Mus musculus
agcatatcatatgtaagt

SEQ ID NO: 194637 - DNA, 21 bp, Mus musculus
tatgagtgtggagagtgtggg

SEQ ID NO: 194638 - DNA, 22 bp, Mus musculus
ctctcagctcattgaccactac

SEQ ID NO: 194639 - DNA, 23 bp, Mus musculus
tctctcagtcactttccactatg

SEQ ID NO: 194640 - DNA, 22 bp, Mus musculus
tactgcttgttctgttgtggtt

SEQ ID NO: 194641 - DNA, 23 bp, Mus musculus
acactgtcaccctcactgtgtgc

SEQ ID NO: 194642 - DNA, 21 bp, Mus musculus
tgatgcttgtattctaatgct

SEQ ID NO: 194643 - DNA, 23 bp, Mus musculus
actagagacaagagagtctgcag

SEQ ID NO: 194644 - DNA, 23 bp, Mus musculus
tctgtcctgtgtgtctctgtatc

SEQ ID NO: 194645 - DNA, 23 bp, Mus musculus
gagagcctctctgtgactctcgg

SEQ ID NO: 194646 - DNA, 22 bp, Mus musculus
tctgcctcagtctctctcctca

SEQ ID NO: 194647 - DNA, 21 bp, Mus musculus
tgtggctgtgaaagtccctgg

SEQ ID NO: 194648 - DNA, 23 bp, Mus musculus
gtgccactcagactcacttggtc

SEQ ID NO: 194649 - DNA, 18 bp, Mus musculus
tcagagcattactcttgg

SEQ ID NO: 194650 - DNA, 23 bp, Mus musculus
ggaacagtacagacagagctcag

SEQ ID NO: 194651 - DNA, 18 bp, Mus musculus
aaaaggtgtggcaggaaa

SEQ ID NO: 194652 - DNA, 23 bp, Mus musculus
tagtgcatggtgatctgatagga

SEQ ID NO: 194653 - DNA, 21 bp, Mus musculus
tgttttgtgaccaattatgtg

SEQ ID NO: 194654 - DNA, 22 bp, Mus musculus
ttctgaagtcactgaggtcagg

SEQ ID NO: 194655 - DNA, 23 bp, Mus musculus
ctgcccctgactgccagttgatg

SEQ ID NO: 194656 - DNA, 20 bp, Mus musculus
aacgccagttgtttcagcac

SEQ ID NO: 194657 - DNA, 23 bp, Mus musculus
gatgtgtttagcttccttgtcaa

SEQ ID NO: 194658 - DNA, 22 bp, Mus musculus
tgttttgtgaccaattatatgg

SEQ ID NO: 194659 - DNA, 18 bp, Mus musculus
tgttcaaacctttttgag

SEQ ID NO: 194660 - DNA, 21 bp, Mus musculus
atgatcaggaccagggagact

SEQ ID NO: 194661 - DNA, 23 bp, Mus musculus
tctctgtttctgtcaccaagtgc

SEQ ID NO: 194662 - DNA, 23 bp, Mus musculus
tctatctcagtgaatgggcttaa

SEQ ID NO: 194663 - DNA, 23 bp, Mus musculus
atgtatatgtgcatgtgtatatg

SEQ ID NO: 194664 - DNA, 23 bp, Mus musculus
atggaattgcacagatggctcat

SEQ ID NO: 194665 - DNA, 23 bp, Mus musculus
caatatttttgtatctgttgagg

SEQ ID NO: 194666 - DNA, 23 bp, Mus musculus
tgttttgtgaccaattatatgga

SEQ ID NO: 194667 - DNA, 23 bp, Mus musculus
tcacagaactgagtgacttgggg

SEQ ID NO: 194668 - DNA, 23 bp, Mus musculus
tttgaggaatttcattctgatgt

SEQ ID NO: 194669 - DNA, 23 bp, Mus musculus
ttgaatgatttaattccaccatt

SEQ ID NO: 194670 - DNA, 23 bp, Mus musculus
caatatttttgtatctgttgagg

SEQ ID NO: 194671 - DNA, 23 bp, Mus musculus
tgttttgtgaccaattatatgga

SEQ ID NO: 194672 - DNA, 20 bp, Mus musculus
tcacagaactgagtgacttg

SEQ ID NO: 194673 - DNA, 23 bp, Mus musculus
atggaattgcacagatagctcaa

SEQ ID NO: 194674 - DNA, 21 bp, Mus musculus
tccagcaagcacatggtgact

SEQ ID NO: 194675 - DNA, 23 bp, Mus musculus
attgtagaagatagagagcagag

SEQ ID NO: 194676 - DNA, 19 bp, Mus musculus
gagagagagagagagagag

SEQ ID NO: 194677 - DNA, 20 bp, Mus musculus
tttctcacaatctctctcct

SEQ ID NO: 194678 - DNA, 23 bp, Mus musculus
tagtccatggtgatctgatagga

SEQ ID NO: 194679 - DNA, 19 bp, Mus musculus
gagagagagagagagagag

SEQ ID NO: 194680 - DNA, 20 bp, Mus musculus
tttctcacaatctctctcct

SEQ ID NO: 194681 - DNA, 23 bp, Mus musculus
tagtccatggtgatctgatagga

SEQ ID NO: 194682 - DNA, 23 bp, Mus musculus
tgtacatggagcacacacatata

SEQ ID NO: 194683 - DNA, 23 bp, Mus musculus
tgtatatgtgcatgtccttgtgg

SEQ ID NO: 194684 - DNA, 21 bp, Mus musculus
gctctctcactctggctctcc

SEQ ID NO: 194685 - DNA, 20 bp, Mus musculus
atgtgtatgtgcatgtgttt

SEQ ID NO: 194686 - DNA, 22 bp, Mus musculus
tgttctggggctggagagatgg

SEQ ID NO: 194687 - DNA, 23 bp, Mus musculus
taagatcactgactgctcttcca

SEQ ID NO: 194688 - DNA, 23 bp, Mus musculus
gcatgtgtgtgtgcatgtgtgtg

SEQ ID NO: 194689 - DNA, 19 bp, Mus musculus
atgtgtgtgtgcatgtgca

SEQ ID NO: 194690 - DNA, 22 bp, Mus musculus
tttttgtacagatatggtgtgt

SEQ ID NO: 194691 - DNA, 23 bp, Mus musculus
ggtagaacaggccaatgctatgc

SEQ ID NO: 194692 - DNA, 23 bp, Mus musculus
acagcagtgtctgtctgtctgtc

SEQ ID NO: 194693 - DNA, 23 bp, Mus musculus
gtgtctgggtctgtgcctgcgtg

SEQ ID NO: 194694 - DNA, 23 bp, Mus musculus
agatgtgtatatgtacatgtgag

SEQ ID NO: 194695 - DNA, 22 bp, Mus musculus
ttgtatgaacatgtctgtatgt

SEQ ID NO: 194696 - DNA, 23 bp, Mus musculus
gagggtctgtcctgtggatgtct

SEQ ID NO: 194697 - DNA, 21 bp, Mus musculus
tgagctggtccaccacagcca

SEQ ID NO: 194698 - DNA, 22 bp, Mus musculus
acacacacactatagacaatga

SEQ ID NO: 194699 - DNA, 19 bp, Mus musculus
taacattcaacactcacac

SEQ ID NO: 194700 - DNA, 18 bp, Mus musculus
tgagcagacagagcacac

SEQ ID NO: 194701 - DNA, 23 bp, Mus musculus
gtgtgtgtgtgtctgtgtatgtg

SEQ ID NO: 194702 - DNA, 23 bp, Mus musculus
tatatgtgtctatatgtaatgga

SEQ ID NO: 194703 - DNA, 23 bp, Mus musculus
gtgacccagtcctggggtttctg

SEQ ID NO: 194704 - DNA, 23 bp, Mus musculus
actttgagctcactgtgcagtta

SEQ ID NO: 194705 - DNA, 23 bp, Mus musculus
gaatgaagagagtctgctttggt

SEQ ID NO: 194706 - DNA, 23 bp, Mus musculus
taagaccttgcacatactgagcc

SEQ ID NO: 194707 - DNA, 18 bp, Mus musculus
atgagtgcagtgcctgag

SEQ ID NO: 194708 - DNA, 21 bp, Mus musculus
tggctggctggctggctggct

SEQ ID NO: 194709 - DNA, 23 bp, Mus musculus
cctgcctgcctgcctgcctgcct

SEQ ID NO: 194710 - DNA, 22 bp, Mus musculus
gctaagatgtggaaccagccta

SEQ ID NO: 194711 - DNA, 20 bp, Mus musculus
attgcagagcttcctggagt

SEQ ID NO: 194712 - DNA, 23 bp, Mus musculus
taaggtatctttagaagtctgat

SEQ ID NO: 194713 - DNA, 22 bp, Mus musculus
gtgagtggatcagtagatggat

SEQ ID NO: 194714 - DNA, 18 bp, Mus musculus
atgtatgtatatatatgt

SEQ ID NO: 194715 - DNA, 23 bp, Mus musculus
tgtatgtgtatgtatatgcatgt

SEQ ID NO: 194716 - DNA, 23 bp, Mus musculus
tctacagaaacctgctgctgtcc

SEQ ID NO: 194717 - DNA, 23 bp, Mus musculus
attttgttcttgagtttgccttg

SEQ ID NO: 194718 - DNA, 19 bp, Mus musculus
tcttctacatgataggaca

SEQ ID NO: 194719 - DNA, 23 bp, Mus musculus
tgtggctaacttaagatggttgt

SEQ ID NO: 194720 - DNA, 23 bp, Mus musculus
gggactcactcagtggctgcctg

SEQ ID NO: 194721 - DNA, 18 bp, Mus musculus
tgtgtatgtatatatgta

SEQ ID NO: 194722 - DNA, 23 bp, Mus musculus
atgtatgtatgtatgtatgtgtg

SEQ ID NO: 194723 - DNA, 23 bp, Mus musculus
atgacagggtgcaatgacaggtc

SEQ ID NO: 194724 - DNA, 23 bp, Mus musculus
tgcctctgacactctctggttcc

SEQ ID NO: 194725 - DNA, 22 bp, Mus musculus
tgtgtgtgcaacatatatgtat

SEQ ID NO: 194726 - DNA, 23 bp, Mus musculus
aggttacctggtacttcctgagc

SEQ ID NO: 194727 - DNA, 21 bp, Mus musculus
tgtgcatatgtatatgtatgt

SEQ ID NO: 194728 - DNA, 23 bp, Mus musculus
atatgtgtatatatgtgtgtgtg

SEQ ID NO: 194729 - DNA, 21 bp, Mus musculus
tctccttgtaccccacccagc

SEQ ID NO: 194730 - DNA, 22 bp, Mus musculus
tctatctgcatctgcatgagga

SEQ ID NO: 194731 - DNA, 22 bp, Mus musculus
ccagtctgcatctgcatgagga

SEQ ID NO: 194732 - DNA, 18 bp, Mus musculus
gtctgtctgtctgcacct

SEQ ID NO: 194733 - DNA, 22 bp, Mus musculus
tatgcatgaatggatgtatgta

SEQ ID NO: 194734 - DNA, 22 bp, Mus musculus
ttgtatgtatgcatgtgtgtgc

SEQ ID NO: 194735 - DNA, 22 bp, Mus musculus
tgtgtttacacatgaagatcag

SEQ ID NO: 194736 - DNA, 20 bp, Mus musculus
atgagggtgttcatatgtgt

SEQ ID NO: 194737 - DNA, 19 bp, Mus musculus
tagaggaagtggacctggt

SEQ ID NO: 194738 - DNA, 22 bp, Mus musculus
aggatatgatacaccagaggaa

SEQ ID NO: 194739 - DNA, 22 bp, Mus musculus
tgttttgtgaccaattatatgg

SEQ ID NO: 194740 - DNA, 19 bp, Mus musculus
cagtgttactctgtctcag

SEQ ID NO: 194741 - DNA, 22 bp, Mus musculus
tgttttgtgaccaattatatgg

SEQ ID NO: 194742 - DNA, 23 bp, Mus musculus
taccatgttcaaacagctttgga

SEQ ID NO: 194743 - DNA, 23 bp, Mus musculus
cattaccatggctattcttctct

SEQ ID NO: 194744 - DNA, 22 bp, Mus musculus
aagcaagaatatgcatactagt

SEQ ID NO: 194745 - DNA, 22 bp, Mus musculus
tttatgattatcatcttgttat

SEQ ID NO: 194746 - DNA, 21 bp, Mus musculus
tcagtctctgtgagtccctct

SEQ ID NO: 194747 - DNA, 18 bp, Mus musculus
ttctgtctctgaatctgt

SEQ ID NO: 194748 - DNA, 23 bp, Mus musculus
atgtatgtatttgtgcatgtgtg

SEQ ID NO: 194749 - DNA, 23 bp, Mus musculus
tcacggtagagagtgatctcagg

SEQ ID NO: 194750 - DNA, 22 bp, Mus musculus
ctgtaactctctcagcctgtgt

SEQ ID NO: 194751 - DNA, 22 bp, Mus musculus
atttcataaaactctcaccaat

SEQ ID NO: 194752 - DNA, 19 bp, Mus musculus
tatcttctcaaaatgtttt

SEQ ID NO: 194753 - DNA, 23 bp, Mus musculus
agagtccctgggagcctgtctgc

SEQ ID NO: 194754 - DNA, 23 bp, Mus musculus
tgtgtgtacagtgtgtgctgatg

SEQ ID NO: 194755 - DNA, 22 bp, Mus musculus
tgagtctgttagtctctgtcag

SEQ ID NO: 194756 - DNA, 22 bp, Mus musculus
tgttttgtgaccaattatatgg

SEQ ID NO: 194757 - DNA, 22 bp, Mus musculus
tcaatatttttgtatctgttgc

SEQ ID NO: 194758 - DNA, 22 bp, Mus musculus
tgttttgtgaccaattatatgg

SEQ ID NO: 194759 - DNA, 23 bp, Mus musculus
ataaaactgatgcctatctgatg

SEQ ID NO: 194760 - DNA, 19 bp, Mus musculus
ccttggtcatgatgtctgt

SEQ ID NO: 194761 - DNA, 23 bp, Mus musculus
taatactctgaggaagagatgtc

SEQ ID NO: 194762 - DNA, 23 bp, Mus musculus
tgtgtgtatctgtctgtctgtct

SEQ ID NO: 194763 - DNA, 20 bp, Mus musculus
tcacagaactgagtgacttg

SEQ ID NO: 194764 - DNA, 22 bp, Mus musculus
tgagcatgcatgaatttgtata

SEQ ID NO: 194765 - DNA, 23 bp, Mus musculus
ctaggaggctagagagatgctca

SEQ ID NO: 194766 - DNA, 23 bp, Mus musculus
gattttagatgttatgcgttcgt

SEQ ID NO: 194767 - DNA, 21 bp, Mus musculus
cagtgcacaactcaacatgag

SEQ ID NO: 194768 - DNA, 22 bp, Mus musculus
tatgactggcagctatgttggg

SEQ ID NO: 194769 - DNA, 19 bp, Mus musculus
tgtagtactaagactgtgc

SEQ ID NO: 194770 - DNA, 18 bp, Mus musculus
taacttcagtctctccag

SEQ ID NO: 194771 - DNA, 22 bp, Mus musculus
tctctcactgtgtgtctcttcc

SEQ ID NO: 194772 - DNA, 19 bp, Mus musculus
gtatgtatgtatgtatgta

SEQ ID NO: 194773 - DNA, 23 bp, Mus musculus
atgtatgtatgtatgtgtgtgtg

SEQ ID NO: 194774 - DNA, 22 bp, Mus musculus
atgtttggtgaaatgtttgctg

SEQ ID NO: 194775 - DNA, 21 bp, Mus musculus
agtgcatctttctaatcccat

SEQ ID NO: 194776 - DNA, 23 bp, Mus musculus
gtggctcggtcagtggctccatc

SEQ ID NO: 194777 - DNA, 23 bp, Mus musculus
ctctgtgagtctcatcccacctg

SEQ ID NO: 194778 - DNA, 23 bp, Mus musculus
atatgtaagtacactgtagctgt

SEQ ID NO: 194779 - DNA, 20 bp, Mus musculus
acagacaagtgtgtgtgcat

SEQ ID NO: 194780 - DNA, 23 bp, Mus musculus
ttgagacagaagttagagaccgc

SEQ ID NO: 194781 - DNA, 20 bp, Mus musculus
ttaactgctgagccacctct

SEQ ID NO: 194782 - DNA, 23 bp, Mus musculus
tgtctgagtctctgcctctgtcc

SEQ ID NO: 194783 - DNA, 19 bp, Mus musculus
tgacacaagtgagtcacca

SEQ ID NO: 194784 - DNA, 23 bp, Mus musculus
acagactgcacactgtgtgagcc

SEQ ID NO: 194785 - DNA, 20 bp, Mus musculus
gggagagagagggaaagagg

SEQ ID NO: 194786 - DNA, 23 bp, Mus musculus
attgtgtggtatacctgcagtgt

SEQ ID NO: 194787 - DNA, 23 bp, Mus musculus
cacactcactgtctccttgttgt

SEQ ID NO: 194788 - DNA, 23 bp, Mus musculus
gggtgtgtccctctgtgggtgtg

SEQ ID NO: 194789 - DNA, 23 bp, Mus musculus
acacgtttctctctctgtctcca

SEQ ID NO: 194790 - DNA, 18 bp, Mus musculus
ttctggcttctgtcttcc

SEQ ID NO: 194791 - DNA, 23 bp, Mus musculus
tgagtctatgtctctggttcttg

SEQ ID NO: 194792 - DNA, 21 bp, Mus musculus
tttgagactggctctctcact

SEQ ID NO: 194793 - DNA, 20 bp, Mus musculus
ctgcctccctcgccacagtc

SEQ ID NO: 194794 - DNA, 23 bp, Mus musculus
ctgggtctgactgtgagtgattc

SEQ ID NO: 194795 - DNA, 21 bp, Mus musculus
gattggagagatgactcggct

SEQ ID NO: 194796 - DNA, 18 bp, Mus musculus
tgtggaggcccagacagg

SEQ ID NO: 194797 - DNA, 22 bp, Mus musculus
cagcctgtctgtctgggtctgt

SEQ ID NO: 194798 - DNA, 23 bp, Mus musculus
gagagcactgactgctcttccag

SEQ ID NO: 194799 - DNA, 23 bp, Mus musculus
ctatcactgagtcacactccagt

SEQ ID NO: 194800 - DNA, 23 bp, Mus musculus
tctctggatctctgactccctct

SEQ ID NO: 194801 - DNA, 22 bp, Mus musculus
ctgtctacctgtctcactctgt

SEQ ID NO: 194802 - DNA, 19 bp, Mus musculus
taagggaaaggttgatcag

SEQ ID NO: 194803 - DNA, 21 bp, Mus musculus
tagtatatgtgcatgtgtgtg

SEQ ID NO: 194804 - DNA, 21 bp, Mus musculus
tgtgagtgcatatgcatgtgc

SEQ ID NO: 194805 - DNA, 23 bp, Mus musculus
cctgtgagtcagtgtctgtctgt

SEQ ID NO: 194806 - DNA, 18 bp, Mus musculus
tctgtgtaagagagtcag

SEQ ID NO: 194807 - DNA, 23 bp, Mus musculus
ttacagacagttgtgagtcacca

SEQ ID NO: 194808 - DNA, 23 bp, Mus musculus
tagagaacagtgattgctctctg

SEQ ID NO: 194809 - DNA, 23 bp, Mus musculus
ttacagatgagtgacaccacatc

SEQ ID NO: 194810 - DNA, 23 bp, Mus musculus
gctcaattagcactcctaatgga

SEQ ID NO: 194811 - DNA, 19 bp, Mus musculus
gcctgaagagggactggtg

SEQ ID NO: 194812 - DNA, 18 bp, Mus musculus
tgactggcaaggcttctg

SEQ ID NO: 194813 - DNA, 21 bp, Mus musculus
actgactccctctgtcacctg

SEQ ID NO: 194814 - DNA, 21 bp, Mus musculus
ttcaattctcagcaaccacat

SEQ ID NO: 194815 - DNA, 23 bp, Mus musculus
tctctcactgctatgccattcct

SEQ ID NO: 194816 - DNA, 23 bp, Mus musculus
actctctgtggctctgtggttcc

SEQ ID NO: 194817 - DNA, 23 bp, Mus musculus
aggctctgtctgtctgtctccgc

SEQ ID NO: 194818 - DNA, 23 bp, Mus musculus
cgctgtctgtctgtctgtctgtc

SEQ ID NO: 194819 - DNA, 23 bp, Mus musculus
atttcagaaaccacatggtggct

SEQ ID NO: 194820 - DNA, 23 bp, Mus musculus
tgtgcttatgtgtatgtgtgtgt

SEQ ID NO: 194821 - DNA, 23 bp, Mus musculus
atgtgtgcatgcatgagtgtgtg

SEQ ID NO: 194822 - DNA, 22 bp, Mus musculus
cctgtgttcactgtgcctgtgg

SEQ ID NO: 194823 - DNA, 22 bp, Mus musculus
actgtcgcacagattcttctct

SEQ ID NO: 194824 - DNA, 23 bp, Mus musculus
ctggctcactctctgtggcttgc

SEQ ID NO: 194825 - DNA, 23 bp, Mus musculus
ctctgcttctcactcactgtaat

SEQ ID NO: 194826 - DNA, 23 bp, Mus musculus
ctgtgagtctgtgagagtctggg

SEQ ID NO: 194827 - DNA, 22 bp, Mus musculus
aactagcactttatgctgttct

SEQ ID NO: 194828 - DNA, 23 bp, Mus musculus
gtcccagtcactgtgtcttctcc

SEQ ID NO: 194829 - DNA, 23 bp, Mus musculus
taagaattactggggctggaaag

SEQ ID NO: 194830 - DNA, 23 bp, Mus musculus
ttaagagcacagactgctcttcc

SEQ ID NO: 194831 - DNA, 22 bp, Mus musculus
acagaggacagtgtgtgctctg

SEQ ID NO: 194832 - DNA, 23 bp, Mus musculus
gtttactgagttcttcctgtgtg

SEQ ID NO: 194833 - DNA, 23 bp, Mus musculus
tgccaagtgtcctgcaggtgctg

SEQ ID NO: 194834 - DNA, 18 bp, Mus musculus
tatgtctttcttaaagtc

SEQ ID NO: 194835 - DNA, 23 bp, Mus musculus
taagagtcatgcttttcttgtgt

SEQ ID NO: 194836 - DNA, 23 bp, Mus musculus
tatgtacatctacatctacatct

SEQ ID NO: 194837 - DNA, 23 bp, Mus musculus
tgctggaacactgtgtgcattct

SEQ ID NO: 194838 - DNA, 19 bp, Mus musculus
agagtctgcagacaccggc

SEQ ID NO: 194839 - DNA, 18 bp, Mus musculus
aggtatcttaagacctct

SEQ ID NO: 194840 - DNA, 22 bp, Mus musculus
atctctctgtctctgggagagt

SEQ ID NO: 194841 - DNA, 21 bp, Mus musculus
atgtgtatttacatatatgtg

SEQ ID NO: 194842 - DNA, 23 bp, Mus musculus
gagacaacacagtcaggtaacat

SEQ ID NO: 194843 - DNA, 23 bp, Mus musculus
atagtcattgcatagtcacactt

SEQ ID NO: 194844 - DNA, 23 bp, Mus musculus
gtgtgcgtctgtgtgtctgtgtg

SEQ ID NO: 194845 - DNA, 23 bp, Mus musculus
ttgagaatttgttgtagagttgc

SEQ ID NO: 194846 - DNA, 18 bp, Mus musculus
agatctccagtgaatagt

SEQ ID NO: 194847 - DNA, 23 bp, Mus musculus
tctctctctctctcagctctctg

SEQ ID NO: 194848 - DNA, 23 bp, Mus musculus
aagagcactgactgctcttccag

SEQ ID NO: 194849 - DNA, 23 bp, Mus musculus
ggagcctcagttgtctgtctgtc

SEQ ID NO: 194850 - DNA, 23 bp, Mus musculus
atatatgtgtgtatatgtatgta

SEQ ID NO: 194851 - DNA, 20 bp, Mus musculus
ttatatgtacatatatatac

SEQ ID NO: 194852 - DNA, 21 bp, Mus musculus
atatgcatatatatacatata

SEQ ID NO: 194853 - DNA, 23 bp, Mus musculus
tatatatctaatgttttgtagga

SEQ ID NO: 194854 - DNA, 21 bp, Mus musculus
tgtgcatgtatgtatgtatgt

SEQ ID NO: 194855 - DNA, 23 bp, Mus musculus
cagatctctgtgtgagttccagg

SEQ ID NO: 194856 - DNA, 23 bp, Mus musculus
aggtttacacagtcagagtctct

SEQ ID NO: 194857 - DNA, 23 bp, Mus musculus
cactttctgcatctggacctgaa

SEQ ID NO: 194858 - DNA, 23 bp, Mus musculus
tggctgtctcctttacattttac

SEQ ID NO: 194859 - DNA, 23 bp, Mus musculus
gtgaagtttcagagcagacaaca

SEQ ID NO: 194860 - DNA, 20 bp, Mus musculus
tgtatgtgcaggtgcatgtg

SEQ ID NO: 194861 - DNA, 20 bp, Mus musculus
ttatgcatgacatatgcgta

SEQ ID NO: 194862 - DNA, 22 bp, Mus musculus
agtccagaacttcctatgcagt

SEQ ID NO: 194863 - DNA, 22 bp, Mus musculus
ccttacactccaaagtgtttgg

SEQ ID NO: 194864 - DNA, 18 bp, Mus musculus
tatgtgtatgtatgttta

SEQ ID NO: 194865 - DNA, 22 bp, Mus musculus
tagtatagactccacattgctt

SEQ ID NO: 194866 - DNA, 23 bp, Mus musculus
tatatctatgtatatatgtgtgt

SEQ ID NO: 194867 - DNA, 18 bp, Mus musculus
tgtctacatgcatgtatc

SEQ ID NO: 194868 - DNA, 20 bp, Mus musculus
tatggacatatgcatgttca

SEQ ID NO: 194869 - DNA, 21 bp, Mus musculus
ttgtatgtgtggatgtccatg

SEQ ID NO: 194870 - DNA, 21 bp, Mus musculus
atattgcacatgtaggtgcac

SEQ ID NO: 194871 - DNA, 23 bp, Mus musculus
ggcaagcagagtcagctggcact

SEQ ID NO: 194872 - DNA, 21 bp, Mus musculus
cacagagtaaatcatgttcaa

SEQ ID NO: 194873 - DNA, 21 bp, Mus musculus
aaatgcagaatgagcaacctg

SEQ ID NO: 194874 - DNA, 23 bp, Mus musculus
atgtatgtatgtatgtatgtatg

SEQ ID NO: 194875 - DNA, 23 bp, Mus musculus
atgatatagatatagatgcgata

SEQ ID NO: 194876 - DNA, 22 bp, Mus musculus
tgttttgtgaccaattatatgg

SEQ ID NO: 194877 - DNA, 23 bp, Mus musculus
ggcagagacatggaggagtgatg

SEQ ID NO: 194878 - DNA, 23 bp, Mus musculus
tgactctctggctcactcttgtt

SEQ ID NO: 194879 - DNA, 19 bp, Mus musculus
ttacttttgaattcagatc

SEQ ID NO: 194880 - DNA, 21 bp, Mus musculus
tccatggtggtctgataggat

SEQ ID NO: 194881 - DNA, 22 bp, Mus musculus
tgttttgtgaccaattatatgg

SEQ ID NO: 194882 - DNA, 23 bp, Mus musculus
ccacacacctgcagattcactgt

SEQ ID NO: 194883 - DNA, 23 bp, Mus musculus
gtatatgtatgtagtgtgtatgt

SEQ ID NO: 194884 - DNA, 22 bp, Mus musculus
cacacacacacatatacatgta

SEQ ID NO: 194885 - DNA, 23 bp, Mus musculus
tatatatcttgatgatgcttttg

SEQ ID NO: 194886 - DNA, 18 bp, Mus musculus
acacagtgaaacagagac

SEQ ID NO: 194887 - DNA, 23 bp, Mus musculus
ttttctgagcctctctaatgttc

SEQ ID NO: 194888 - DNA, 22 bp, Mus musculus
gttaatgagtgtgtctgttgtt

SEQ ID NO: 194889 - DNA, 23 bp, Mus musculus
agcgtgcattacatatgtagatt

SEQ ID NO: 194890 - DNA, 23 bp, Mus musculus
atatgactatatgtatatatgtg

SEQ ID NO: 194891 - DNA, 22 bp, Mus musculus
tgttttgtgaccaattatatgg

SEQ ID NO: 194892 - DNA, 21 bp, Mus musculus
tagtgatatatacatatatgt

SEQ ID NO: 194893 - DNA, 22 bp, Mus musculus
tatatatgtgtgtgtctctttg

SEQ ID NO: 194894 - DNA, 22 bp, Mus musculus
tctctctatcacacacataata

SEQ ID NO: 194895 - DNA, 22 bp, Mus musculus
tatgcatgtatgtatgtatgta

SEQ ID NO: 194896 - DNA, 19 bp, Mus musculus
tgtatgtatatgtatgtgt

SEQ ID NO: 194897 - DNA, 22 bp, Mus musculus
aatcacataatacatatatgtg

SEQ ID NO: 194898 - DNA, 22 bp, Mus musculus
tcaagtcactttgctgctgtag

SEQ ID NO: 194899 - DNA, 22 bp, Mus musculus
tcaagtcactttgctgctgtag

SEQ ID NO: 194900 - DNA, 21 bp, Mus musculus
tatgtttatgggttatgtgta

SEQ ID NO: 194901 - DNA, 23 bp, Mus musculus
cctcactgcctgtctccctgtga

SEQ ID NO: 194902 - DNA, 22 bp, Mus musculus
tgttttgtgaccaattatatgg

SEQ ID NO: 194903 - DNA, 23 bp, Mus musculus
tatgcaaatgtatacatatacat

SEQ ID NO: 194904 - DNA, 23 bp, Mus musculus
cctgtcacagtctatcactgagg

SEQ ID NO: 194905 - DNA, 23 bp, Mus musculus
tctctcactgagcaaatgctgag

SEQ ID NO: 194906 - DNA, 21 bp, Mus musculus
tctctctcggtcagtggctcg

SEQ ID NO: 194907 - DNA, 19 bp, Mus musculus
agggcatgtagtaagcaga

SEQ ID NO: 194908 - DNA, 23 bp, Mus musculus
aaacaggaacgatatgtactgtt

SEQ ID NO: 194909 - DNA, 23 bp, Mus musculus
ttaaaagggtggaatagatggct

SEQ ID NO: 194910 - DNA, 23 bp, Mus musculus
gtgtctgtttctgtctctcttga

SEQ ID NO: 194911 - DNA, 21 bp, Mus musculus
tcagattttagagatgggtgg

SEQ ID NO: 194912 - DNA, 23 bp, Mus musculus
tctgtctgtctgtctgtctgtct

SEQ ID NO: 194913 - DNA, 19 bp, Mus musculus
tgtatatatgtatgtatgc

SEQ ID NO: 194914 - DNA, 21 bp, Mus musculus
tgtattatccatccatatcta

SEQ ID NO: 194915 - DNA, 22 bp, Mus musculus
tctgaggctgtaaatgttgtaa

SEQ ID NO: 194916 - DNA, 23 bp, Mus musculus
agacacttcagtgtgctcagaca

SEQ ID NO: 194917 - DNA, 18 bp, Mus musculus
tttagttttcaatactct

SEQ ID NO: 194918 - DNA, 22 bp, Mus musculus
accatggaggctagagagatgg

SEQ ID NO: 194919 - DNA, 23 bp, Mus musculus
agtctgtgtggtatagttgagct

SEQ ID NO: 194920 - DNA, 19 bp, Mus musculus
aactctcccacacacaccc

SEQ ID NO: 194921 - DNA, 22 bp, Mus musculus
tgttttgtgaccaattatatgg

SEQ ID NO: 194922 - DNA, 22 bp, Mus musculus
tatttatgcatgtgtgtagatg

SEQ ID NO: 194923 - DNA, 23 bp, Mus musculus
agagagaagatacagtggtgttt

SEQ ID NO: 194924 - DNA, 23 bp, Mus musculus
tctgcctctcacactgtataacc

SEQ ID NO: 194925 - DNA, 23 bp, Mus musculus
atagtagaagaggggctggaaag

SEQ ID NO: 194926 - DNA, 23 bp, Mus musculus
ctctgacacatgaaactatgcag

SEQ ID NO: 194927 - DNA, 23 bp, Mus musculus
tgcatgatgctcatgttccagtc

SEQ ID NO: 194928 - DNA, 22 bp, Mus musculus
aagccagagatgacaggttctc

SEQ ID NO: 194929 - DNA, 19 bp, Mus musculus
tgtctcagaagaatcagag

SEQ ID NO: 194930 - DNA, 23 bp, Mus musculus
tggggttccctgtctctctgtct

SEQ ID NO: 194931 - DNA, 23 bp, Mus musculus
aatgactgtgagagaaaagagtg

SEQ ID NO: 194932 - DNA, 22 bp, Mus musculus
tgttttgtgaccaattatatgg

SEQ ID NO: 194933 - DNA, 22 bp, Mus musculus
acagacacttctactggatctg

SEQ ID NO: 194934 - DNA, 23 bp, Mus musculus
agtactgagagtggagatagagg

SEQ ID NO: 194935 - DNA, 23 bp, Mus musculus
ggctgtattctgagctgttatca

SEQ ID NO: 194936 - DNA, 22 bp, Mus musculus
tatgaatacaactatgaacact

SEQ ID NO: 194937 - DNA, 23 bp, Mus musculus
aggtaaggatttcctagaagaca

SEQ ID NO: 194938 - DNA, 20 bp, Mus musculus
tatatttgtgtttgtgtaca

SEQ ID NO: 194939 - DNA, 22 bp, Mus musculus
cagtcttaggccatggtggtct

SEQ ID NO: 194940 - DNA, 23 bp, Mus musculus
ttttgtgaccaactatatggtca

SEQ ID NO: 194941 - DNA, 21 bp, Mus musculus
aatattctttatgtaattgag

SEQ ID NO: 194942 - DNA, 22 bp, Mus musculus
tgttttgtgaccaattatatgg

SEQ ID NO: 194943 - DNA, 23 bp, Mus musculus
ttcatgtaaaggacctaactcag

SEQ ID NO: 194944 - DNA, 18 bp, Mus musculus
gtggtagtttcaatatat

SEQ ID NO: 194945 - DNA, 23 bp, Mus musculus
atatagctgttactgcagttaga

SEQ ID NO: 194946 - DNA, 23 bp, Mus musculus
tctgtagtgcatgccatatgtct

SEQ ID NO: 194947 - DNA, 23 bp, Mus musculus
agaagagtgttgttcagtttcca

SEQ ID NO: 194948 - DNA, 22 bp, Mus musculus
cttagtccatggtgatctgata

SEQ ID NO: 194949 - DNA, 23 bp, Mus musculus
acacagtctcactcacttgagtg

SEQ ID NO: 194950 - DNA, 19 bp, Mus musculus
agaagtcagtatgaggagt

SEQ ID NO: 194951 - DNA, 20 bp, Mus musculus
actctgtcactgaatctaga

SEQ ID NO: 194952 - DNA, 22 bp, Mus musculus
tgaatatatatatgtgtgtatg

SEQ ID NO: 194953 - DNA, 18 bp, Mus musculus
aagatgctacctctccag

SEQ ID NO: 194954 - DNA, 23 bp, Mus musculus
cagagcttgtagattctcagaaa

SEQ ID NO: 194955 - DNA, 22 bp, Mus musculus
tcacgttctgaaattgtacatc

SEQ ID NO: 194956 - DNA, 23 bp, Mus musculus
atctctgaatttttatttctgta

SEQ ID NO: 194957 - DNA, 20 bp, Mus musculus
tagaaataaaggcaggtgtt

SEQ ID NO: 194958 - DNA, 23 bp, Mus musculus
ctgtctcactgtctgcgtggtac

SEQ ID NO: 194959 - DNA, 23 bp, Mus musculus
aggggctgtctctgactctgttg

SEQ ID NO: 194960 - DNA, 23 bp, Mus musculus
agacgtctaatgttgtttgaatg

SEQ ID NO: 194961 - DNA, 20 bp, Mus musculus
tcacagaactgagtgacttg

SEQ ID NO: 194962 - DNA, 21 bp, Mus musculus
tcaagtgaccataggtgtgtg

SEQ ID NO: 194963 - DNA, 23 bp, Mus musculus
cattggtctacttgtctgtcact

SEQ ID NO: 194964 - DNA, 20 bp, Mus musculus
tatctatttatatatgtatg

SEQ ID NO: 194965 - DNA, 23 bp, Mus musculus
atgtcggtctgtatacctatgtg

SEQ ID NO: 194966 - DNA, 23 bp, Mus musculus
ttcatagaggttagttactgaac

SEQ ID NO: 194967 - DNA, 19 bp, Mus musculus
agaaatactttctcaactg

SEQ ID NO: 194968 - DNA, 23 bp, Mus musculus
ttgttagggtttatattgagtta

SEQ ID NO: 194969 - DNA, 23 bp, Mus musculus
ctgtctctgacagtcagtgccac

SEQ ID NO: 194970 - DNA, 22 bp, Mus musculus
ccatgcctctgtggctctgtct

SEQ ID NO: 194971 - DNA, 23 bp, Mus musculus
tgacagactgtcagactctttct

SEQ ID NO: 194972 - DNA, 23 bp, Mus musculus
tctgtatgtctatgtgcatgcat

SEQ ID NO: 194973 - DNA, 22 bp, Mus musculus
agtgtgtatatatatatgtgtg

SEQ ID NO: 194974 - DNA, 23 bp, Mus musculus
tgagtcagtcagtatgtgtctgc

SEQ ID NO: 194975 - DNA, 23 bp, Mus musculus
gtccatgtgtctctctgtctggc

SEQ ID NO: 194976 - DNA, 22 bp, Mus musculus
ttccctttgtcatcctttgcct

SEQ ID NO: 194977 - DNA, 23 bp, Mus musculus
gtgtatgtatatgtatgtgtgtg

SEQ ID NO: 194978 - DNA, 23 bp, Mus musculus
aggtgtgtgtgcatgtgcatgtg

SEQ ID NO: 194979 - DNA, 23 bp, Mus musculus
gtgtatgtatatgtatgtgtgtg

SEQ ID NO: 194980 - DNA, 22 bp, Mus musculus
gtctgtgtgcatgtgcatgtgt

SEQ ID NO: 194981 - DNA, 23 bp, Mus musculus
gtgtgtgtgtgcatgtgcatgtg

SEQ ID NO: 194982 - DNA, 23 bp, Mus musculus
tgtgtgtgcatgtgcatgtgcat

SEQ ID NO: 194983 - DNA, 23 bp, Mus musculus
tgtgtgtgcatgtgcatgtgtgt

SEQ ID NO: 194984 - DNA, 23 bp, Mus musculus
aggtgtgtgtgcatgtgcatgtg

SEQ ID NO: 194985 - DNA, 19 bp, Mus musculus
ccaagacaggagtgtgttc

SEQ ID NO: 194986 - DNA, 23 bp, Mus musculus
acttgtgtgtctattgattatct

SEQ ID NO: 194987 - DNA, 22 bp, Mus musculus
agtcagttctctgagtgttctt

SEQ ID NO: 194988 - DNA, 22 bp, Mus musculus
tgttttgtgaccaattatatgg

SEQ ID NO: 194989 - DNA, 23 bp, Mus musculus
gtgtctgtgtgtgtgtgtgtatg

SEQ ID NO: 194990 - DNA, 23 bp, Mus musculus
tttgtatctgtatatatttctct

SEQ ID NO: 194991 - DNA, 23 bp, Mus musculus
tgtcagaggctgtgtttcctgtt

SEQ ID NO: 194992 - DNA, 23 bp, Mus musculus
gcatcacagatgacactgagggc

SEQ ID NO: 194993 - DNA, 23 bp, Mus musculus
ttgagatgtctatgtatgcagtt

SEQ ID NO: 194994 - DNA, 21 bp, Mus musculus
aagcttgagaatttcctttga

SEQ ID NO: 194995 - DNA, 20 bp, Mus musculus
cacaagcttcttattggtta

SEQ ID NO: 194996 - DNA, 19 bp, Mus musculus
tgtgtgtatatatatatgt

SEQ ID NO: 194997 - DNA, 21 bp, Mus musculus
taagagcactgtctgctcttc

SEQ ID NO: 194998 - DNA, 23 bp, Mus musculus
tgtgtatgtgtatatgtgtgtgt

SEQ ID NO: 194999 - DNA, 23 bp, Mus musculus
tcttctctcagcttcttgaaatc

SEQ ID NO: 195000 - DNA, 20 bp, Mus musculus
ctgactgctcttgcagagga

SEQ ID NO: 195001 - DNA, 20 bp, Mus musculus
tttgtgagtgtagagctgcc

SEQ ID NO: 195002 - DNA, 18 bp, Mus musculus
tttgtatgtgtgtgtaca

SEQ ID NO: 195003 - DNA, 21 bp, Mus musculus
tggcagagtcagaaactagag

SEQ ID NO: 195004 - DNA, 20 bp, Mus musculus
tgagagcagactgagaggag

SEQ ID NO: 195005 - DNA, 21 bp, Mus musculus
tgagagaagccagactccact

SEQ ID NO: 195006 - DNA, 21 bp, Mus musculus
cacagtgttcttcatgcagca

SEQ ID NO: 195007 - DNA, 23 bp, Mus musculus
tatggatgtatgtatatatgtat

SEQ ID NO: 195008 - DNA, 21 bp, Mus musculus
tactgagaagaaagagagctc

SEQ ID NO: 195009 - DNA, 18 bp, Mus musculus
tgtggaattatgtctgga

SEQ ID NO: 195010 - DNA, 23 bp, Mus musculus
tcagtcactcacaatgttattgt

SEQ ID NO: 195011 - DNA, 23 bp, Mus musculus
tctctcactgtctcagatcccac

SEQ ID NO: 195012 - DNA, 19 bp, Mus musculus
ctctccatgtatgtgtctc

SEQ ID NO: 195013 - DNA, 23 bp, Mus musculus
ttgtgtcagaactcagagtccag

SEQ ID NO: 195014 - DNA, 23 bp, Mus musculus
acagtctcaggaagacaacaaac

SEQ ID NO: 195015 - DNA, 23 bp, Mus musculus
cttgtgactttcttcatatgtgt

SEQ ID NO: 195016 - DNA, 23 bp, Mus musculus
tgtgtgtatatatatatgtgtgt

SEQ ID NO: 195017 - DNA, 23 bp, Mus musculus
tgtatatgtatgtatatatgtgt

SEQ ID NO: 195018 - DNA, 23 bp, Mus musculus
tgtctgtgtgtgttatgggacag

SEQ ID NO: 195019 - DNA, 21 bp, Mus musculus
tgtaagcatactactcacagt

SEQ ID NO: 195020 - DNA, 22 bp, Mus musculus
ttgtctgcttcctggagtgtct

SEQ ID NO: 195021 - DNA, 23 bp, Mus musculus
ttctgagagaccacagacaggac

SEQ ID NO: 195022 - DNA, 23 bp, Mus musculus
tgtagttccggattctcagtgtc

SEQ ID NO: 195023 - DNA, 22 bp, Mus musculus
aatctgagagtggattgcagat

SEQ ID NO: 195024 - DNA, 23 bp, Mus musculus
attctcagtgtcatgctagtgct

SEQ ID NO: 195025 - DNA, 19 bp, Mus musculus
aatctgagagtggattgca

SEQ ID NO: 195026 - DNA, 18 bp, Mus musculus
tctcctgttgctgctcta

SEQ ID NO: 195027 - DNA, 21 bp, Mus musculus
ttgaggagttcttggagctgg

SEQ ID NO: 195028 - DNA, 23 bp, Mus musculus
cgcagtgcttttgtaaagggtat

SEQ ID NO: 195029 - DNA, 23 bp, Mus musculus
agtgactgtcagacattctggga

SEQ ID NO: 195030 - DNA, 22 bp, Mus musculus
tatatgcatgtgtatgtgtata

SEQ ID NO: 195031 - DNA, 18 bp, Mus musculus
tgtgtatatatatgtatg

SEQ ID NO: 195032 - DNA, 22 bp, Mus musculus
ttatagacagttgtgagatgcc

SEQ ID NO: 195033 - DNA, 23 bp, Mus musculus
tgtatgtatatgtatatgtatat

SEQ ID NO: 195034 - DNA, 23 bp, Mus musculus
tctgtgaatctctgtgtatagga

SEQ ID NO: 195035 - DNA, 23 bp, Mus musculus
gagtctgtgtcacattttcttga

SEQ ID NO: 195036 - DNA, 23 bp, Mus musculus
ttcactgtggaacttgttttgga

SEQ ID NO: 195037 - DNA, 23 bp, Mus musculus
tagaaagacaacagagtgaggac

SEQ ID NO: 195038 - DNA, 23 bp, Mus musculus
ttttgtcatttgctatttgtgtt

SEQ ID NO: 195039 - DNA, 21 bp, Mus musculus
ggaagcttcatttggtgatga

SEQ ID NO: 195040 - DNA, 23 bp, Mus musculus
tgtatgtatgtatgtatatgtgt

SEQ ID NO: 195041 - DNA, 19 bp, Mus musculus
atacacatacacacacata

SEQ ID NO: 195042 - DNA, 20 bp, Mus musculus
atgtgcttggatgtatagct

SEQ ID NO: 195043 - DNA, 21 bp, Mus musculus
catctatatctagtgtgtttc

SEQ ID NO: 195044 - DNA, 22 bp, Mus musculus
gataaagttgaaagccattctg

SEQ ID NO: 195045 - DNA, 18 bp, Mus musculus
tgaatatatgtatgtatg

SEQ ID NO: 195046 - DNA, 20 bp, Mus musculus
tgcatgtatgtatgtatgta

SEQ ID NO: 195047 - DNA, 20 bp, Mus musculus
tatgtatgcatgtatgtatg

SEQ ID NO: 195048 - DNA, 23 bp, Mus musculus
tctttccctgtctgtatgtgtgc

SEQ ID NO: 195049 - DNA, 20 bp, Mus musculus
tgttagttagtaaataagtt

SEQ ID NO: 195050 - DNA, 22 bp, Mus musculus
gagatctgtctgtcaaaaccca

SEQ ID NO: 195051 - DNA, 22 bp, Mus musculus
tgtgtatatatgtatatatgtg

SEQ ID NO: 195052 - DNA, 18 bp, Mus musculus
tatgcatatatatgtata

SEQ ID NO: 195053 - DNA, 23 bp, Mus musculus
ttccatggaaaacagatactgtg

SEQ ID NO: 195054 - DNA, 22 bp, Mus musculus
gctctgtctgtcatatggttgt

SEQ ID NO: 195055 - DNA, 22 bp, Mus musculus
tagatgaactggctctaaactg

SEQ ID NO: 195056 - DNA, 19 bp, Mus musculus
tagctctctcggatacttc

SEQ ID NO: 195057 - DNA, 23 bp, Mus musculus
atgatgccagtaaagtcagtcgt

SEQ ID NO: 195058 - DNA, 18 bp, Mus musculus
tatatgcatgtgaaatgg

SEQ ID NO: 195059 - DNA, 23 bp, Mus musculus
tatgtgcatgtacatgtgcaagt

SEQ ID NO: 195060 - DNA, 23 bp, Mus musculus
tgtgtgtgtatctgtgtgtgtgt

SEQ ID NO: 195061 - DNA, 23 bp, Mus musculus
gtgtgtgtgtgtgtgtgcacatg

SEQ ID NO: 195062 - DNA, 23 bp, Mus musculus
tatgtgtgcatgtgcatgtgtgt

SEQ ID NO: 195063 - DNA, 22 bp, Mus musculus
agtctagagagacattctggat

SEQ ID NO: 195064 - DNA, 18 bp, Mus musculus
aaaggtactgagttcaat

SEQ ID NO: 195065 - DNA, 21 bp, Mus musculus
ctgtctgcctgcatgcctgcc

SEQ ID NO: 195066 - DNA, 22 bp, Mus musculus
tgttttgtgaccaattatatgg

SEQ ID NO: 195067 - DNA, 22 bp, Mus musculus
aatgttactctagagtgttggt

SEQ ID NO: 195068 - DNA, 23 bp, Mus musculus
atgtatgtatgtatgtatgaatg

SEQ ID NO: 195069 - DNA, 23 bp, Mus musculus
tgtgtgtgtgcatgtgcttgtgc

SEQ ID NO: 195070 - DNA, 23 bp, Mus musculus
tgttcatgtgtgtgtgtgtgtgt

SEQ ID NO: 195071 - DNA, 23 bp, Mus musculus
tctgtgtgtgtacttttgtgtgt

SEQ ID NO: 195072 - DNA, 21 bp, Mus musculus
tgtatgtatgtacatatgtat

SEQ ID NO: 195073 - DNA, 21 bp, Mus musculus
atgtatgtatgtatatgtgtg

SEQ ID NO: 195074 - DNA, 18 bp, Mus musculus
caaggaaatcagaagagt

SEQ ID NO: 195075 - DNA, 23 bp, Mus musculus
gagcctgtcactataatgtctgc

SEQ ID NO: 195076 - DNA, 22 bp, Mus musculus
tgttttgtgaccaattatatgg

SEQ ID NO: 195077 - DNA, 23 bp, Mus musculus
acatgtgcaagtttgtggtgtgt

SEQ ID NO: 195078 - DNA, 20 bp, Mus musculus
actcacagtgtgttaatctc

SEQ ID NO: 195079 - DNA, 23 bp, Mus musculus
tgtgtctgtgtgtacatgtgtgc

SEQ ID NO: 195080 - DNA, 23 bp, Mus musculus
tatgtgcatttgtacatgtgaca

SEQ ID NO: 195081 - DNA, 22 bp, Mus musculus
gagtgcctagagattcagatgt

SEQ ID NO: 195082 - DNA, 20 bp, Mus musculus
tatatgtgtgtatatgtata

SEQ ID NO: 195083 - DNA, 20 bp, Mus musculus
agagaagtcacagacatgaa

SEQ ID NO: 195084 - DNA, 22 bp, Mus musculus
gatgtgtcacactgtaatgact

SEQ ID NO: 195085 - DNA, 22 bp, Mus musculus
aacactttggaggtcattgcca

SEQ ID NO: 195086 - DNA, 23 bp, Mus musculus
aacttcaccttgtctttccttga

SEQ ID NO: 195087 - DNA, 23 bp, Mus musculus
gatgtagatatagatatgtatgt

SEQ ID NO: 195088 - DNA, 22 bp, Mus musculus
tatatgcatagatatttataga

SEQ ID NO: 195089 - DNA, 23 bp, Mus musculus
tatatgtgtggatatgtatgtat

SEQ ID NO: 195090 - DNA, 22 bp, Mus musculus
tgttttgtgaccaattatatgg

SEQ ID NO: 195091 - DNA, 23 bp, Mus musculus
tcacactatgtcagtctctggta

SEQ ID NO: 195092 - DNA, 22 bp, Mus musculus
gtgtgtgtgcatgtgcatgtgc

SEQ ID NO: 195093 - DNA, 23 bp, Mus musculus
cctgtcagtctctcagatagcag

SEQ ID NO: 195094 - DNA, 23 bp, Mus musculus
tacgtgtgtgtgtgtatgtgtat

SEQ ID NO: 195095 - DNA, 21 bp, Mus musculus
agtgctccagtcttccttgtg

SEQ ID NO: 195096 - DNA, 23 bp, Mus musculus
ttgctctgagttaagtctgagtg

SEQ ID NO: 195097 - DNA, 18 bp, Mus musculus
tgtctgtctgtccacatt

SEQ ID NO: 195098 - DNA, 23 bp, Mus musculus
ccactgactgtgtcccagaatgg

SEQ ID NO: 195099 - DNA, 23 bp, Mus musculus
ctcaggctgaattctgacagggt

SEQ ID NO: 195100 - DNA, 23 bp, Mus musculus
tatctgacaccctctttgacact

SEQ ID NO: 195101 - DNA, 20 bp, Mus musculus
tgtctgtctgtatttgtgtg

SEQ ID NO: 195102 - DNA, 23 bp, Mus musculus
acactgcctgccaaagacctgct

SEQ ID NO: 195103 - DNA, 21 bp, Mus musculus
tgggctgggtcagtgcggctg

SEQ ID NO: 195104 - DNA, 23 bp, Mus musculus
cacagtgactgggtgaggagtgg

SEQ ID NO: 195105 - DNA, 20 bp, Mus musculus
tgtatgtatgtatgtatgta

SEQ ID NO: 195106 - DNA, 20 bp, Mus musculus
atatgtgtgtgcatatgtgt

SEQ ID NO: 195107 - DNA, 20 bp, Mus musculus
attttcagttttgtgagatc

SEQ ID NO: 195108 - DNA, 23 bp, Mus musculus
tgatcctagtgcctgagctgttg

SEQ ID NO: 195109 - DNA, 21 bp, Mus musculus
tatgtgcatgtatatatgtat

SEQ ID NO: 195110 - DNA, 23 bp, Mus musculus
tgtgtgtctgtatatctgtatat

SEQ ID NO: 195111 - DNA, 22 bp, Mus musculus
ttcagctacacattttcacttt

SEQ ID NO: 195112 - DNA, 22 bp, Mus musculus
tatatgtgtgtgtctgtgtctg

SEQ ID NO: 195113 - DNA, 23 bp, Mus musculus
aagcatgcctgactcttttggtg

SEQ ID NO: 195114 - DNA, 22 bp, Mus musculus
tgttttgtgaccaattatatgg

SEQ ID NO: 195115 - DNA, 23 bp, Mus musculus
ttccaaattgatgctgaagatga

SEQ ID NO: 195116 - DNA, 19 bp, Mus musculus
tcactccctctctcagtgc

SEQ ID NO: 195117 - DNA, 21 bp, Mus musculus
taaggtgcttgttgtgtgggt

SEQ ID NO: 195118 - DNA, 23 bp, Mus musculus
ggatctgtctgtctgtcactgcc

SEQ ID NO: 195119 - DNA, 23 bp, Mus musculus
ttgctctcagtggaatccttccc

SEQ ID NO: 195120 - DNA, 23 bp, Mus musculus
aacacagtgagttaatgttgagt

SEQ ID NO: 195121 - DNA, 19 bp, Mus musculus
gaggttataagaaggaaag

SEQ ID NO: 195122 - DNA, 22 bp, Mus musculus
tttaactctcaaaagccttgca

SEQ ID NO: 195123 - DNA, 21 bp, Mus musculus
gtgcatgtgtgtgtggttgtg

SEQ ID NO: 195124 - DNA, 23 bp, Mus musculus
atgttcaatgagctgtgaggatg

SEQ ID NO: 195125 - DNA, 23 bp, Mus musculus
tgtcagtttagagagagcacttc

SEQ ID NO: 195126 - DNA, 23 bp, Mus musculus
tcagaccctctcattctgcaaaa

SEQ ID NO: 195127 - DNA, 19 bp, Mus musculus
ggcaggaggcttgattccc

SEQ ID NO: 195128 - DNA, 20 bp, Mus musculus
gacagaggagtgagagctga

SEQ ID NO: 195129 - DNA, 21 bp, Mus musculus
tgctatgtatatatgtataca

SEQ ID NO: 195130 - DNA, 23 bp, Mus musculus
ttttcattgcttatcttcctgat

SEQ ID NO: 195131 - DNA, 22 bp, Mus musculus
agagccagagtatcagatgtct

SEQ ID NO: 195132 - DNA, 23 bp, Mus musculus
gtgaggtaggatgttctatactt

SEQ ID NO: 195133 - DNA, 19 bp, Mus musculus
cacagacagtcactgagca

SEQ ID NO: 195134 - DNA, 23 bp, Mus musculus
ctgtctgtctgtccgtctgttga

SEQ ID NO: 195135 - DNA, 23 bp, Mus musculus
tgtagaataaggtctccaagcac

SEQ ID NO: 195136 - DNA, 23 bp, Mus musculus
tttggattgtaaggaagtcagac

SEQ ID NO: 195137 - DNA, 23 bp, Mus musculus
tgtgcctgtgtgtgtgtctgtgc

SEQ ID NO: 195138 - DNA, 22 bp, Mus musculus
tgttttgtgaccaattatatgg

SEQ ID NO: 195139 - DNA, 22 bp, Mus musculus
cagtcttaggccatggtggtct

SEQ ID NO: 195140 - DNA, 23 bp, Mus musculus
ttttgtgaccaactatatggtca

SEQ ID NO: 195141 - DNA, 23 bp, Mus musculus
tctctctctatgtctctctttca

SEQ ID NO: 195142 - DNA, 20 bp, Mus musculus
gagagagagagaggtagagg

SEQ ID NO: 195143 - DNA, 23 bp, Mus musculus
cacagctctgtctctgtctgacc

SEQ ID NO: 195144 - DNA, 19 bp, Mus musculus
tgtctatcattctctctct

SEQ ID NO: 195145 - DNA, 23 bp, Mus musculus
tggctgtcctagaactcactctg

SEQ ID NO: 195146 - DNA, 22 bp, Mus musculus
tcacagccactttctcactgtc

SEQ ID NO: 195147 - DNA, 22 bp, Mus musculus
tgttttgtgaccaattatatgg

SEQ ID NO: 195148 - DNA, 21 bp, Mus musculus
gtatgtgcatatgcatgtggt

SEQ ID NO: 195149 - DNA, 18 bp, Mus musculus
tcactgtgtgagttctct

SEQ ID NO: 195150 - DNA, 21 bp, Mus musculus
taacatgtacatgaagaccag

SEQ ID NO: 195151 - DNA, 23 bp, Mus musculus
aactccatgatgatgttttctga

SEQ ID NO: 195152 - DNA, 23 bp, Mus musculus
aaagttcatgttcaagtgtggga

SEQ ID NO: 195153 - DNA, 23 bp, Mus musculus
aaaggaggagacatttacatttg

SEQ ID NO: 195154 - DNA, 22 bp, Mus musculus
tatgtgtatttgtatgtgtatg

SEQ ID NO: 195155 - DNA, 19 bp, Mus musculus
tgagtcagtattgattggg

SEQ ID NO: 195156 - DNA, 18 bp, Mus musculus
ttactgtgttttagataa

SEQ ID NO: 195157 - DNA, 23 bp, Mus musculus
atatgtatgtatatgtatacaca

SEQ ID NO: 195158 - DNA, 20 bp, Mus musculus
atatacacatacacatacat

SEQ ID NO: 195159 - DNA, 23 bp, Mus musculus
ttatgagagaaacacaattccct

SEQ ID NO: 195160 - DNA, 23 bp, Mus musculus
agttagtagaaagcatatgaact

SEQ ID NO: 195161 - DNA, 23 bp, Mus musculus
tgcttctgtctctctctgtaaga

SEQ ID NO: 195162 - DNA, 23 bp, Mus musculus
tctgcctcagtctgcctcagtct

SEQ ID NO: 195163 - DNA, 23 bp, Mus musculus
taaactcattttctaaatctgtc

SEQ ID NO: 195164 - DNA, 23 bp, Mus musculus
tgttcagacttgagtctcagccc

SEQ ID NO: 195165 - DNA, 23 bp, Mus musculus
agaggctctgtcagtgcctgaca

SEQ ID NO: 195166 - DNA, 23 bp, Mus musculus
tctctctcagtccctctctacca

SEQ ID NO: 195167 - DNA, 20 bp, Mus musculus
actggagagatggctcaaca

SEQ ID NO: 195168 - DNA, 23 bp, Mus musculus
tggaagactagtgattttgttgt

SEQ ID NO: 195169 - DNA, 21 bp, Mus musculus
tccaacaacaagtcccagtct

SEQ ID NO: 195170 - DNA, 22 bp, Mus musculus
actgtctctatgtaatcttgaa

SEQ ID NO: 195171 - DNA, 23 bp, Mus musculus
gaacttgaccttgagttttgtgt

SEQ ID NO: 195172 - DNA, 22 bp, Mus musculus
acagagtcaacaggaccaggag

SEQ ID NO: 195173 - DNA, 19 bp, Mus musculus
tagcacaagggctggagag

SEQ ID NO: 195174 - DNA, 20 bp, Mus musculus
actcactgtatagacctagt

SEQ ID NO: 195175 - DNA, 20 bp, Mus musculus
ttgcttgatcaagaaaggaa

SEQ ID NO: 195176 - DNA, 21 bp, Mus musculus
ttgacactagctagtcaccac

SEQ ID NO: 195177 - DNA, 23 bp, Mus musculus
ccctcacactgacagatacatgt

SEQ ID NO: 195178 - DNA, 23 bp, Mus musculus
gacaggatatctctgtgtagcct

SEQ ID NO: 195179 - DNA, 23 bp, Mus musculus
catctcagtcacactgtgtgcca

SEQ ID NO: 195180 - DNA, 21 bp, Mus musculus
acacctagttcatacatatat

SEQ ID NO: 195181 - DNA, 18 bp, Mus musculus
tgtgtgtgtgtatgtgta

SEQ ID NO: 195182 - DNA, 23 bp, Mus musculus
atttcaacatgtggggctggaga

SEQ ID NO: 195183 - DNA, 23 bp, Mus musculus
tgtcacagtctgtcactgaggga

SEQ ID NO: 195184 - DNA, 23 bp, Mus musculus
agacagggtttgtctgtctgtct

SEQ ID NO: 195185 - DNA, 23 bp, Mus musculus
tttctgtatgtgctggttagtgt

SEQ ID NO: 195186 - DNA, 22 bp, Mus musculus
ttctctgagtgttaccccagag

SEQ ID NO: 195187 - DNA, 22 bp, Mus musculus
catctgtgcgtgtgtcaggggg

SEQ ID NO: 195188 - DNA, 23 bp, Mus musculus
tcagacaacacagactggagttg

SEQ ID NO: 195189 - DNA, 18 bp, Mus musculus
aaagaaccatttctaaac

SEQ ID NO: 195190 - DNA, 23 bp, Mus musculus
actcatgcagctttgttgaggcc

SEQ ID NO: 195191 - DNA, 23 bp, Mus musculus
tctcagggagattgcatgtgtag

SEQ ID NO: 195192 - DNA, 18 bp, Mus musculus
tatatatgtatgtatatg

SEQ ID NO: 195193 - DNA, 21 bp, Mus musculus
ttatatgtgtgtatatgtatg

SEQ ID NO: 195194 - DNA, 23 bp, Mus musculus
taccagtgaagggaggtggtgag

SEQ ID NO: 195195 - DNA, 23 bp, Mus musculus
tgctgtctgctctacctgagatg

SEQ ID NO: 195196 - DNA, 23 bp, Mus musculus
cccactctcaaatgtgctcaaag

SEQ ID NO: 195197 - DNA, 21 bp, Mus musculus
tgtctgcctgtgtgccacagt

SEQ ID NO: 195198 - DNA, 23 bp, Mus musculus
tgagacaggctcagttcagtggg

SEQ ID NO: 195199 - DNA, 22 bp, Mus musculus
gtgtgcatgtgtttgtgtgtgt

SEQ ID NO: 195200 - DNA, 22 bp, Mus musculus
atgagtgtgcacagtgagcaca

SEQ ID NO: 195201 - DNA, 23 bp, Mus musculus
tccctctgtctctgtctctgtct

SEQ ID NO: 195202 - DNA, 22 bp, Mus musculus
aatctgctcagactgtacttta

SEQ ID NO: 195203 - DNA, 20 bp, Mus musculus
tatgtatgtatgattatgta

SEQ ID NO: 195204 - DNA, 23 bp, Mus musculus
gtatatatgtgtatatgtatatg

SEQ ID NO: 195205 - DNA, 20 bp, Mus musculus
ttatgcatatatagtgatgt

SEQ ID NO: 195206 - DNA, 23 bp, Mus musculus
aaaggatgtggtagatgagtcag

SEQ ID NO: 195207 - DNA, 23 bp, Mus musculus
agtagacactgacctgtcatgtg

SEQ ID NO: 195208 - DNA, 21 bp, Mus musculus
tcttgcttgtttatgttgact

SEQ ID NO: 195209 - DNA, 22 bp, Mus musculus
agtttcctcttgatccctttgt

SEQ ID NO: 195210 - DNA, 23 bp, Mus musculus
gttttactgagtggtaatgttgt

SEQ ID NO: 195211 - DNA, 23 bp, Mus musculus
gcatgtgcatgtgcatgtgtatg

SEQ ID NO: 195212 - DNA, 21 bp, Mus musculus
agagtggttattctggaagat

SEQ ID NO: 195213 - DNA, 23 bp, Mus musculus
tcacagagcagatggaaagcagt

SEQ ID NO: 195214 - DNA, 23 bp, Mus musculus
tgtgcatatgtgtatatgtatat

SEQ ID NO: 195215 - DNA, 23 bp, Mus musculus
ctctgtccctctgtgtgtgtgtc

SEQ ID NO: 195216 - DNA, 23 bp, Mus musculus
atgtgtatgtttatgtatatgtg

SEQ ID NO: 195217 - DNA, 23 bp, Mus musculus
tgtctgtgtatatatgatgtata

SEQ ID NO: 195218 - DNA, 23 bp, Mus musculus
tgtgtgtccgtgtgtctgtcctt

SEQ ID NO: 195219 - DNA, 22 bp, Mus musculus
cagtgtgacatgtgacagaggc

SEQ ID NO: 195220 - DNA, 22 bp, Mus musculus
tgttttgtgaccaattatatgg

SEQ ID NO: 195221 - DNA, 23 bp, Mus musculus
ctgtctctctctgtgtggttgct

SEQ ID NO: 195222 - DNA, 22 bp, Mus musculus
tcagaggatggaatggtggtgt

SEQ ID NO: 195223 - DNA, 22 bp, Mus musculus
tgttttgtgaccaattatatgg

SEQ ID NO: 195224 - DNA, 23 bp, Mus musculus
taaagtgacactgtttgaagaga

SEQ ID NO: 195225 - DNA, 23 bp, Mus musculus
ctgcatctgcaattctattccat

SEQ ID NO: 195226 - DNA, 23 bp, Mus musculus
attctgttgatctacctgtgtgt

SEQ ID NO: 195227 - DNA, 23 bp, Mus musculus
tctgtagtactttaggtcaggtg

SEQ ID NO: 195228 - DNA, 22 bp, Mus musculus
ttctatatttttgatgaaggtt

SEQ ID NO: 195229 - DNA, 23 bp, Mus musculus
tgtctctgactctcaatgacctt

SEQ ID NO: 195230 - DNA, 20 bp, Mus musculus
tcacagaactgagtgacttg

SEQ ID NO: 195231 - DNA, 23 bp, Mus musculus
tcagtctgcctctctcaatccgt

SEQ ID NO: 195232 - DNA, 22 bp, Mus musculus
tgttttgtgaccaattatatgg

SEQ ID NO: 195233 - DNA, 23 bp, Mus musculus
gtactgagagtggagatagaggt

SEQ ID NO: 195234 - DNA, 23 bp, Mus musculus
gtgtctctctgagtcagctgttg

SEQ ID NO: 195235 - DNA, 23 bp, Mus musculus
ttctttgtggatttcatatcatg

SEQ ID NO: 195236 - DNA, 23 bp, Mus musculus
tttgtctctgtatctctgtccat

SEQ ID NO: 195237 - DNA, 21 bp, Mus musculus
aagaaggactgaagtatccac

SEQ ID NO: 195238 - DNA, 22 bp, Mus musculus
taatgtgtatatatatatgtgt

SEQ ID NO: 195239 - DNA, 23 bp, Mus musculus
cagatgagagtgtggactacaga

SEQ ID NO: 195240 - DNA, 23 bp, Mus musculus
atccatcagaatgactatgatca

SEQ ID NO: 195241 - DNA, 20 bp, Mus musculus
ttgagctttcaattcagaga

SEQ ID NO: 195242 - DNA, 22 bp, Mus musculus
tggagctgccatttttatgagt

SEQ ID NO: 195243 - DNA, 23 bp, Mus musculus
aatgtcagccattttgtacagtt

SEQ ID NO: 195244 - DNA, 18 bp, Mus musculus
tctatatctatatctcta

SEQ ID NO: 195245 - DNA, 23 bp, Mus musculus
aatgtatgtgtatatgcatatat

SEQ ID NO: 195246 - DNA, 23 bp, Mus musculus
tttgtctctgtcacacttcctgc

SEQ ID NO: 195247 - DNA, 23 bp, Mus musculus
ggtccatggtgatctgataggat

SEQ ID NO: 195248 - DNA, 22 bp, Mus musculus
ttttgtatcttatgaggcctgt

SEQ ID NO: 195249 - DNA, 23 bp, Mus musculus
actgttagccattgtaatgggat

SEQ ID NO: 195250 - DNA, 21 bp, Mus musculus
tcacaggcagcctgattggct

SEQ ID NO: 195251 - DNA, 23 bp, Mus musculus
tgtatgcatgtacatatgtatgt

SEQ ID NO: 195252 - DNA, 21 bp, Mus musculus
tattcacatggtgaacaatgg

SEQ ID NO: 195253 - DNA, 20 bp, Mus musculus
tagacagaagtgtgtgtgta

SEQ ID NO: 195254 - DNA, 23 bp, Mus musculus
tcaggtctgacaggttcttgttt

SEQ ID NO: 195255 - DNA, 18 bp, Mus musculus
cacgctgacagaaacatt

SEQ ID NO: 195256 - DNA, 23 bp, Mus musculus
agagttgaatgcatttggttcag

SEQ ID NO: 195257 - DNA, 21 bp, Mus musculus
gatagcaaccatatgtgaact

SEQ ID NO: 195258 - DNA, 23 bp, Mus musculus
atgtatgtatatgtatgtgtata

SEQ ID NO: 195259 - DNA, 21 bp, Mus musculus
atacacatacatatacacaca

SEQ ID NO: 195260 - DNA, 22 bp, Mus musculus
tgttttgtgaccaattatatgg

SEQ ID NO: 195261 - DNA, 23 bp, Mus musculus
aagctcatgttttgatctaaaac

SEQ ID NO: 195262 - DNA, 23 bp, Mus musculus
tgtatgtgtatgtatatatatgt

SEQ ID NO: 195263 - DNA, 23 bp, Mus musculus
tgttgaaagaagtgtgtgtgctc

SEQ ID NO: 195264 - DNA, 21 bp, Mus musculus
agtgtatatactaactcattc

SEQ ID NO: 195265 - DNA, 22 bp, Mus musculus
tgtttgtctctggattacttct

SEQ ID NO: 195266 - DNA, 23 bp, Mus musculus
cagcttggttatcattggcttaa

SEQ ID NO: 195267 - DNA, 23 bp, Mus musculus
atctcagaagagagtcatcagtt

SEQ ID NO: 195268 - DNA, 22 bp, Mus musculus
tgctagggaactctctctctct

SEQ ID NO: 195269 - DNA, 21 bp, Mus musculus
ttattgttccatttcaaatgt

SEQ ID NO: 195270 - DNA, 23 bp, Mus musculus
tcagagctcagtttctgtgtgtg

SEQ ID NO: 195271 - DNA, 18 bp, Mus musculus
tgtgagcatctgcctctg

SEQ ID NO: 195272 - DNA, 22 bp, Mus musculus
agctagatcaggctcctgtcag

SEQ ID NO: 195273 - DNA, 23 bp, Mus musculus
ctcaggatgacattttctagttc

SEQ ID NO: 195274 - DNA, 22 bp, Mus musculus
tctcagaagagagtgtgcagac

SEQ ID NO: 195275 - DNA, 19 bp, Mus musculus
tatatgtatgtatatatgt

SEQ ID NO: 195276 - DNA, 23 bp, Mus musculus
tgtaaactgagaacactgtcagt

SEQ ID NO: 195277 - DNA, 22 bp, Mus musculus
tgttttgtgaccaattatatgg

SEQ ID NO: 195278 - DNA, 23 bp, Mus musculus
tagactgtgtgctattgtatatg

SEQ ID NO: 195279 - DNA, 23 bp, Mus musculus
tggactgcgtgtaatgtgtctgt

SEQ ID NO: 195280 - DNA, 20 bp, Mus musculus
aggcagaagagactgaccag

SEQ ID NO: 195281 - DNA, 23 bp, Mus musculus
tctctctgtctttcatctgtctg

SEQ ID NO: 195282 - DNA, 22 bp, Mus musculus
tgttttgtgaccaattatatgg

SEQ ID NO: 195283 - DNA, 23 bp, Mus musculus
tgggtctcaggctttaaggtcag

SEQ ID NO: 195284 - DNA, 21 bp, Mus musculus
tctgaagaaccatcagactga

SEQ ID NO: 195285 - DNA, 23 bp, Mus musculus
tcattgtttgctcaggctgcctt

SEQ ID NO: 195286 - DNA, 23 bp, Mus musculus
tgtgtcaacttgacacaggttgg

SEQ ID NO: 195287 - DNA, 23 bp, Mus musculus
accagcagcaaattctatggata

SEQ ID NO: 195288 - DNA, 23 bp, Mus musculus
tagaacgatgactcaaggatttc

SEQ ID NO: 195289 - DNA, 23 bp, Mus musculus
cttgacactgcctttaatctgtg

SEQ ID NO: 195290 - DNA, 23 bp, Mus musculus
tatgtcttaccttcatttatgct

SEQ ID NO: 195291 - DNA, 22 bp, Mus musculus
tgttttgtgaccaattatatgg

SEQ ID NO: 195292 - DNA, 21 bp, Mus musculus
ttactctcatctcaagatctg

SEQ ID NO: 195293 - DNA, 23 bp, Mus musculus
aatgacagatgagagagtgtgtg

SEQ ID NO: 195294 - DNA, 18 bp, Mus musculus
tttgtgtgcatgtgtatg

SEQ ID NO: 195295 - DNA, 21 bp, Mus musculus
tatgtgtatatgtatatgtgt

SEQ ID NO: 195296 - DNA, 22 bp, Mus musculus
tggtaatccatgcttaagtgtt

SEQ ID NO: 195297 - DNA, 18 bp, Mus musculus
cagtcctggaatttactg

SEQ ID NO: 195298 - DNA, 22 bp, Mus musculus
tgttttgtgaccaattatatgg

SEQ ID NO: 195299 - DNA, 22 bp, Mus musculus
tctcacaggttaaatattccat

SEQ ID NO: 195300 - DNA, 23 bp, Mus musculus
aactgatgagtgtgtgcagagga

SEQ ID NO: 195301 - DNA, 23 bp, Mus musculus
agcccctctgttctgtctttgtc

SEQ ID NO: 195302 - DNA, 23 bp, Mus musculus
agtgagtcacactcaagtctgag

SEQ ID NO: 195303 - DNA, 23 bp, Mus musculus
tcactgtctcagagtgcctttga

SEQ ID NO: 195304 - DNA, 23 bp, Mus musculus
tgtgtctcgctcgctcactcgct

SEQ ID NO: 195305 - DNA, 23 bp, Mus musculus
attcagtctctctcagtcctact

SEQ ID NO: 195306 - DNA, 20 bp, Mus musculus
cactctgagaatggtgaagg

SEQ ID NO: 195307 - DNA, 23 bp, Mus musculus
tgtgatgatggagttaagacgtg

SEQ ID NO: 195308 - DNA, 23 bp, Mus musculus
acagccactctgtgacactctac

SEQ ID NO: 195309 - DNA, 20 bp, Mus musculus
acacagtctctcatatacac

SEQ ID NO: 195310 - DNA, 23 bp, Mus musculus
ctgtgtctctgtggataccaact

SEQ ID NO: 195311 - DNA, 19 bp, Mus musculus
tggagagaaggctcagttg

SEQ ID NO: 195312 - DNA, 22 bp, Mus musculus
atatgtgtatatgtatatgtgt

SEQ ID NO: 195313 - DNA, 23 bp, Mus musculus
tagaactcactctggagactaga

SEQ ID NO: 195314 - DNA, 19 bp, Mus musculus
tgtgtgtgtgtgcatgtac

SEQ ID NO: 195315 - DNA, 22 bp, Mus musculus
cagcaaccatctgtaatgggat

SEQ ID NO: 195316 - DNA, 23 bp, Mus musculus
tcagccagaagtattctcctttt

SEQ ID NO: 195317 - DNA, 23 bp, Mus musculus
tgtgacagatgattgtgtgctcg

SEQ ID NO: 195318 - DNA, 23 bp, Mus musculus
agtcttctagagggcctctgtat

SEQ ID NO: 195319 - DNA, 23 bp, Mus musculus
cacagtctctcagtccctgtggt

SEQ ID NO: 195320 - DNA, 22 bp, Mus musculus
gacacacacactcacagcgtct

SEQ ID NO: 195321 - DNA, 20 bp, Mus musculus
tagatcacacatatatatga

SEQ ID NO: 195322 - DNA, 23 bp, Mus musculus
tttttttcttgaggttctcacaa

SEQ ID NO: 195323 - DNA, 18 bp, Mus musculus
tcactggcacctgacctt

SEQ ID NO: 195324 - DNA, 20 bp, Mus musculus
ttgccttggctatggtgtct

SEQ ID NO: 195325 - DNA, 21 bp, Mus musculus
tgagagcatctgcatctgtat

SEQ ID NO: 195326 - DNA, 22 bp, Mus musculus
taaactgtttctttgataagct

SEQ ID NO: 195327 - DNA, 18 bp, Mus musculus
tgcagagggaggaatgtg

SEQ ID NO: 195328 - DNA, 23 bp, Mus musculus
ttagtcccacctctgtctctctg

SEQ ID NO: 195329 - DNA, 23 bp, Mus musculus
cactggctctcactgtccctgtg

SEQ ID NO: 195330 - DNA, 21 bp, Mus musculus
tctgcctgtgacactgcctct

SEQ ID NO: 195331 - DNA, 23 bp, Mus musculus
tcagtcagtcagtccgtccgtct

SEQ ID NO: 195332 - DNA, 23 bp, Mus musculus
actggcagctggagaaggtgaag

SEQ ID NO: 195333 - DNA, 23 bp, Mus musculus
cctgtcaccctctgtcactccta

SEQ ID NO: 195334 - DNA, 23 bp, Mus musculus
tgtctgtctgtctgtctgtccat

SEQ ID NO: 195335 - DNA, 23 bp, Mus musculus
tgtggctgggtctctaggcacga

SEQ ID NO: 195336 - DNA, 23 bp, Mus musculus
tcatctggaactcatgacaatat

SEQ ID NO: 195337 - DNA, 22 bp, Mus musculus
caggttttccatggtttccagt

SEQ ID NO: 195338 - DNA, 23 bp, Mus musculus
tggatctctgtatttgttctcat

SEQ ID NO: 195339 - DNA, 23 bp, Mus musculus
tttctctgagtcgctatgctgct

SEQ ID NO: 195340 - DNA, 23 bp, Mus musculus
aagacaatgcatttcaaatgtat

SEQ ID NO: 195341 - DNA, 23 bp, Mus musculus
aatgaatttcaaatgtaaaggtg

SEQ ID NO: 195342 - DNA, 22 bp, Mus musculus
aagtaattttaagaagatagtt

SEQ ID NO: 195343 - DNA, 18 bp, Mus musculus
cactgaagacagagagca

SEQ ID NO: 195344 - DNA, 20 bp, Mus musculus
agcaagcatcttttatgtat

SEQ ID NO: 195345 - DNA, 23 bp, Mus musculus
aagtatacacatccataagtaca

SEQ ID NO: 195346 - DNA, 23 bp, Mus musculus
aagtcagaagatacagagtatat

SEQ ID NO: 195347 - DNA, 22 bp, Mus musculus
tgtagcttctttgtgaatggct

SEQ ID NO: 195348 - DNA, 22 bp, Mus musculus
agagagcagagtgtggacagct

SEQ ID NO: 195349 - DNA, 23 bp, Mus musculus
tatgctgaatccagtgccagcca

SEQ ID NO: 195350 - DNA, 23 bp, Mus musculus
gatatctctctctctctcatatt

SEQ ID NO: 195351 - DNA, 18 bp, Mus musculus
ttctttgttgttgtgtcc

SEQ ID NO: 195352 - DNA, 22 bp, Mus musculus
tgcctgcctgcctgtctgattg

SEQ ID NO: 195353 - DNA, 23 bp, Mus musculus
tgtctgtctctgtgtatgtgtgt

SEQ ID NO: 195354 - DNA, 22 bp, Mus musculus
attcactggatttttgtctgtc

SEQ ID NO: 195355 - DNA, 23 bp, Mus musculus
ttatgagcagctggttatgtctg

SEQ ID NO: 195356 - DNA, 23 bp, Mus musculus
tctctttctctctgaattccacc

SEQ ID NO: 195357 - DNA, 23 bp, Mus musculus
tatttggtggacatttaggttgt

SEQ ID NO: 195358 - DNA, 23 bp, Mus musculus
ttgtctcagcctgggattaagac

SEQ ID NO: 195359 - DNA, 21 bp, Mus musculus
agtgagaagtcactgtggtca

SEQ ID NO: 195360 - DNA, 23 bp, Mus musculus
tagcactccctgctcagtgactc

SEQ ID NO: 195361 - DNA, 20 bp, Mus musculus
aagtgtgagtctctgtgttt

SEQ ID NO: 195362 - DNA, 18 bp, Mus musculus
tctacagtgcacgtgtct

SEQ ID NO: 195363 - DNA, 22 bp, Mus musculus
gagtaacaactgaagccagagt

SEQ ID NO: 195364 - DNA, 18 bp, Mus musculus
tatggtcttgttggagga

SEQ ID NO: 195365 - DNA, 21 bp, Mus musculus
cactgtgattgtctctgattt

SEQ ID NO: 195366 - DNA, 23 bp, Mus musculus
ttgactcatgaaatgaaggttct

SEQ ID NO: 195367 - DNA, 23 bp, Mus musculus
agagcactgactgctcttccaga

SEQ ID NO: 195368 - DNA, 23 bp, Mus musculus
tgtgaggttttgagttcaattct

SEQ ID NO: 195369 - DNA, 22 bp, Mus musculus
ctgacttcagtgttaccagaag

SEQ ID NO: 195370 - DNA, 19 bp, Mus musculus
gactcatagagactctgat

SEQ ID NO: 195371 - DNA, 22 bp, Mus musculus
ttgtcacttcagtctctgtgag

SEQ ID NO: 195372 - DNA, 23 bp, Mus musculus
attcatgttcatctgtatctcag

SEQ ID NO: 195373 - DNA, 22 bp, Mus musculus
tactgcttttaatattctgtct

SEQ ID NO: 195374 - DNA, 23 bp, Mus musculus
ttgtggtccagtctatttggagt

SEQ ID NO: 195375 - DNA, 23 bp, Mus musculus
gtttgtgtctgtattttatgtgt

SEQ ID NO: 195376 - DNA, 19 bp, Mus musculus
atatgtgcatgttcatgtg

SEQ ID NO: 195377 - DNA, 18 bp, Mus musculus
tgtgtgtgtgtgtgtgtg

SEQ ID NO: 195378 - DNA, 23 bp, Mus musculus
tagtgcatggtgatctgatagga

SEQ ID NO: 195379 - DNA, 21 bp, Mus musculus
tgatttgtgacctattatgtg

SEQ ID NO: 195380 - DNA, 22 bp, Mus musculus
tgttttgtgaccaattatatgg

SEQ ID NO: 195381 - DNA, 23 bp, Mus musculus
tatgtgcatatatatacatatgt

SEQ ID NO: 195382 - DNA, 23 bp, Mus musculus
tatatatgtacatttgtatatgt

SEQ ID NO: 195383 - DNA, 22 bp, Mus musculus
gaaaggaattctatcagtaact

SEQ ID NO: 195384 - DNA, 21 bp, Mus musculus
tcatttgttcattcattcagt

SEQ ID NO: 195385 - DNA, 23 bp, Mus musculus
ttaaggccttgtgaaagctctgt

SEQ ID NO: 195386 - DNA, 19 bp, Mus musculus
tcaggctggagagatggct

SEQ ID NO: 195387 - DNA, 23 bp, Mus musculus
agagaagagacataggaggtgtt

SEQ ID NO: 195388 - DNA, 19 bp, Mus musculus
agagaacctccatgcctta

SEQ ID NO: 195389 - DNA, 20 bp, Mus musculus
ttgagcatctgcctctgtat

SEQ ID NO: 195390 - DNA, 22 bp, Mus musculus
tgttttgtgaccaattatatgg

SEQ ID NO: 195391 - DNA, 19 bp, Mus musculus
gactctctgagaatgatcc

SEQ ID NO: 195392 - DNA, 22 bp, Mus musculus
tgttttgtgaccaattatatgg

SEQ ID NO: 195393 - DNA, 21 bp, Mus musculus
tctgtgattctgtgattccag

SEQ ID NO: 195394 - DNA, 23 bp, Mus musculus
atgtctgcagatatgatggatac

SEQ ID NO: 195395 - DNA, 23 bp, Mus musculus
tttgtccctgcatttctttagat

SEQ ID NO: 195396 - DNA, 23 bp, Mus musculus
gcatctgtgtgtatcgtgtatat

SEQ ID NO: 195397 - DNA, 23 bp, Mus musculus
tatgtgtatatatgtatgtgtgt

SEQ ID NO: 195398 - DNA, 23 bp, Mus musculus
tctcatctctgtggctgtgataa

SEQ ID NO: 195399 - DNA, 23 bp, Mus musculus
tacctgagaagagaaagggttta

SEQ ID NO: 195400 - DNA, 22 bp, Mus musculus
tctctgtcagtgtgtatagggt

SEQ ID NO: 195401 - DNA, 22 bp, Mus musculus
gtcggtcggtccgtccgtctgt

SEQ ID NO: 195402 - DNA, 20 bp, Mus musculus
tctgggggagacatcttggt

SEQ ID NO: 195403 - DNA, 21 bp, Mus musculus
ctgagatcctggatgtgtcag

SEQ ID NO: 195404 - DNA, 21 bp, Mus musculus
tgtctagtccttgattttagt

SEQ ID NO: 195405 - DNA, 18 bp, Mus musculus
aatttctggaaatcattt

SEQ ID NO: 195406 - DNA, 23 bp, Mus musculus
tgtctgtctgtctgtctgtctgt

SEQ ID NO: 195407 - DNA, 23 bp, Mus musculus
gagtctgtctgtctgtcatggtg

SEQ ID NO: 195408 - DNA, 23 bp, Mus musculus
attagctctctgtcagatgtggg

SEQ ID NO: 195409 - DNA, 23 bp, Mus musculus
tatagtcctggctgtcctggaac

SEQ ID NO: 195410 - DNA, 22 bp, Mus musculus
tcacagaagagagtgtggaagg

SEQ ID NO: 195411 - DNA, 20 bp, Mus musculus
tctctgctgtatgattatct

SEQ ID NO: 195412 - DNA, 23 bp, Mus musculus
atagtgcttgataatgtttgaat

SEQ ID NO: 195413 - DNA, 20 bp, Mus musculus
tgactaatggcatagtgatt

SEQ ID NO: 195414 - DNA, 23 bp, Mus musculus
tgtgagcgtgtctgtgtgtgtgt

SEQ ID NO: 195415 - DNA, 23 bp, Mus musculus
tctccatctctctgtctctgtct

SEQ ID NO: 195416 - DNA, 22 bp, Mus musculus
atctgcatgtgtagaagattga

SEQ ID NO: 195417 - DNA, 19 bp, Mus musculus
atatgcatttgtttactta

SEQ ID NO: 195418 - DNA, 21 bp, Mus musculus
acaggagatctttctgtctta

SEQ ID NO: 195419 - DNA, 23 bp, Mus musculus
agttgtgtgactctgtgtctccc

SEQ ID NO: 195420 - DNA, 23 bp, Mus musculus
cgtatgtatgtatgtgtgtgtga

SEQ ID NO: 195421 - DNA, 23 bp, Mus musculus
ttactggtcctttaagttgggaa

SEQ ID NO: 195422 - DNA, 20 bp, Mus musculus
gagaggtcagtgtgctcaag

SEQ ID NO: 195423 - DNA, 23 bp, Mus musculus
tttttgaggcagggtttctctgt

SEQ ID NO: 195424 - DNA, 23 bp, Mus musculus
ggctcagtgtcccagtgtagggg

SEQ ID NO: 195425 - DNA, 19 bp, Mus musculus
atgcagtgacagactctct

SEQ ID NO: 195426 - DNA, 19 bp, Mus musculus
ttactaacagtaatggatt

SEQ ID NO: 195427 - DNA, 21 bp, Mus musculus
tatatgagtgttgcccgccat

SEQ ID NO: 195428 - DNA, 22 bp, Mus musculus
tatagcatcatattcatgggga

SEQ ID NO: 195429 - DNA, 21 bp, Mus musculus
tccatggtggtctgataggat

SEQ ID NO: 195430 - DNA, 23 bp, Mus musculus
tgcctgtacatgcatgtgtgtct

SEQ ID NO: 195431 - DNA, 18 bp, Mus musculus
aatgtgtgcatgtatgtg

SEQ ID NO: 195432 - DNA, 23 bp, Mus musculus
actgcctcgctgttttctgtctg

SEQ ID NO: 195433 - DNA, 21 bp, Mus musculus
tgagtgactgactgactgtct

SEQ ID NO: 195434 - DNA, 23 bp, Mus musculus
tctgagcttgtaggttcttgact

SEQ ID NO: 195435 - DNA, 23 bp, Mus musculus
ctgtctgtctgcctgcctcagtc

SEQ ID NO: 195436 - DNA, 20 bp, Mus musculus
cattgtctggtatgtagtag

SEQ ID NO: 195437 - DNA, 22 bp, Mus musculus
atggactaatagatatcagagt

SEQ ID NO: 195438 - DNA, 23 bp, Mus musculus
ttgagtgaacagagtggctacag

SEQ ID NO: 195439 - DNA, 19 bp, Mus musculus
tatttccagaattttggag

SEQ ID NO: 195440 - DNA, 23 bp, Mus musculus
tgtgttcagtctatctgctgatt

SEQ ID NO: 195441 - DNA, 23 bp, Mus musculus
gactggagagacagtgacaactg

SEQ ID NO: 195442 - DNA, 23 bp, Mus musculus
tctggttgtcacactctctctgc

SEQ ID NO: 195443 - DNA, 19 bp, Mus musculus
cattgcttcttctttaagc

SEQ ID NO: 195444 - DNA, 23 bp, Mus musculus
gagacagagaagacagtcagcac

SEQ ID NO: 195445 - DNA, 21 bp, Mus musculus
ctgtgcctctctggctgtcct

SEQ ID NO: 195446 - DNA, 23 bp, Mus musculus
aatctgactggctgtctgcctcc

SEQ ID NO: 195447 - DNA, 21 bp, Mus musculus
atgagagaagagtgtgagctg

SEQ ID NO: 195448 - DNA, 20 bp, Mus musculus
acacagggtgtggtggtgca

SEQ ID NO: 195449 - DNA, 21 bp, Mus musculus
ttacagtagctagtttagaac

SEQ ID NO: 195450 - DNA, 23 bp, Mus musculus
tgttcagtattcaaacgaaatgg

SEQ ID NO: 195451 - DNA, 19 bp, Mus musculus
ttaagtgtgcacttaggtt

SEQ ID NO: 195452 - DNA, 18 bp, Mus musculus
cacagcagtagtcctgtg

SEQ ID NO: 195453 - DNA, 18 bp, Mus musculus
tgacagacacggctgctg

SEQ ID NO: 195454 - DNA, 23 bp, Mus musculus
tgctgctgctgctgctgctgctg

SEQ ID NO: 195455 - DNA, 19 bp, Mus musculus
agagaagagagataccaca

SEQ ID NO: 195456 - DNA, 23 bp, Mus musculus
tctctgtctgtctgtctgctcgc

SEQ ID NO: 195457 - DNA, 23 bp, Mus musculus
ctgtctctgtctcactgtgtcca

SEQ ID NO: 195458 - DNA, 23 bp, Mus musculus
tggaagagaacatgctgtctgct

SEQ ID NO: 195459 - DNA, 22 bp, Mus musculus
cagagctctgtctgactctgcc

SEQ ID NO: 195460 - DNA, 21 bp, Mus musculus
atatgctaatattttccattc

SEQ ID NO: 195461 - DNA, 23 bp, Mus musculus
tatgcatgattctgaatttggtg

SEQ ID NO: 195462 - DNA, 23 bp, Mus musculus
gcatgtgcacgtggatgagtatg

SEQ ID NO: 195463 - DNA, 23 bp, Mus musculus
gagtgtgtgtgcatgtgcacgtg

SEQ ID NO: 195464 - DNA, 23 bp, Mus musculus
agtgtgtgtgcatgtgcacgtgg

SEQ ID NO: 195465 - DNA, 23 bp, Mus musculus
atgtgagtgtgtgtgcatgtgca

SEQ ID NO: 195466 - DNA, 23 bp, Mus musculus
tgcatgtgcacatggatgagtct

SEQ ID NO: 195467 - DNA, 23 bp, Mus musculus
atgtgagtgtgtgtgcatgtgca

SEQ ID NO: 195468 - DNA, 19 bp, Mus musculus
gtgggaagtgtttgggaga

SEQ ID NO: 195469 - DNA, 23 bp, Mus musculus
actctctctctgtctttctgact

SEQ ID NO: 195470 - DNA, 23 bp, Mus musculus
cagaaggagcaggcagaaatcag

SEQ ID NO: 195471 - DNA, 23 bp, Mus musculus
aatagtgacaggttttggtctgt

SEQ ID NO: 195472 - DNA, 22 bp, Mus musculus
actgtggctatacattaggttt

SEQ ID NO: 195473 - DNA, 19 bp, Mus musculus
atgagccagcacacctggt

SEQ ID NO: 195474 - DNA, 23 bp, Mus musculus
tgccactcactgtctttcttctg

SEQ ID NO: 195475 - DNA, 23 bp, Mus musculus
tgtctaagagaattctgatgcca

SEQ ID NO: 195476 - DNA, 23 bp, Mus musculus
atgtgcatagatcatgtatatgg

SEQ ID NO: 195477 - DNA, 23 bp, Mus musculus
aagttgtcagtagatgatgagat

SEQ ID NO: 195478 - DNA, 21 bp, Mus musculus
tctgtttgtcactttctcata

SEQ ID NO: 195479 - DNA, 21 bp, Mus musculus
tgcctgacagctatcttggtg

SEQ ID NO: 195480 - DNA, 23 bp, Mus musculus
tctgtgccactgacagtctgtct

SEQ ID NO: 195481 - DNA, 22 bp, Mus musculus
tgtatatgtgtatatgtgtgtg

SEQ ID NO: 195482 - DNA, 23 bp, Mus musculus
ggctcagtggttaagagcaccga

SEQ ID NO: 195483 - DNA, 18 bp, Mus musculus
atggctttaaatttctca

SEQ ID NO: 195484 - DNA, 23 bp, Mus musculus
atgacagatttgtgtgagcacag

SEQ ID NO: 195485 - DNA, 23 bp, Mus musculus
agtcagtagacagagaggtgaat

SEQ ID NO: 195486 - DNA, 22 bp, Mus musculus
cacacactctctgtgtcagccc

SEQ ID NO: 195487 - DNA, 19 bp, Mus musculus
tttgtgtgtgtgtgtgtgg

SEQ ID NO: 195488 - DNA, 23 bp, Mus musculus
attcacactgaaactgttgtctg

SEQ ID NO: 195489 - DNA, 20 bp, Mus musculus
actctgcctttccttctgca

SEQ ID NO: 195490 - DNA, 18 bp, Mus musculus
tctgtgtagatcaggctg

SEQ ID NO: 195491 - DNA, 23 bp, Mus musculus
gaaatcagtctgtctctgcctct

SEQ ID NO: 195492 - DNA, 23 bp, Mus musculus
aaactggttcaccttctctctgg

SEQ ID NO: 195493 - DNA, 23 bp, Mus musculus
atccccatcctctcctggctgaa

SEQ ID NO: 195494 - DNA, 22 bp, Mus musculus
ctgtgagaagtgtctgtgctga

SEQ ID NO: 195495 - DNA, 23 bp, Mus musculus
gtgataccatttccatgtgttta

SEQ ID NO: 195496 - DNA, 21 bp, Mus musculus
tgacttgtcagttttctctac

SEQ ID NO: 195497 - DNA, 18 bp, Mus musculus
agaggctacacaggtctt

SEQ ID NO: 195498 - DNA, 23 bp, Mus musculus
gtgtgttttgagacagcctcact

SEQ ID NO: 195499 - DNA, 23 bp, Mus musculus
ttaaactcacaactgccttcctg

SEQ ID NO: 195500 - DNA, 23 bp, Mus musculus
agggtctctcactgaatttggag

SEQ ID NO: 195501 - DNA, 23 bp, Mus musculus
tatctctgtgtggttatgagcat

SEQ ID NO: 195502 - DNA, 23 bp, Mus musculus
ttatactgtctggttttgtgggt

SEQ ID NO: 195503 - DNA, 23 bp, Mus musculus
agctagatatagaagctagaaac

SEQ ID NO: 195504 - DNA, 21 bp, Mus musculus
acatggtggttctgataggat

SEQ ID NO: 195505 - DNA, 23 bp, Mus musculus
tgagatgtctcttcactctgtgt

SEQ ID NO: 195506 - DNA, 23 bp, Mus musculus
atcactgttgaagagaaagttct

SEQ ID NO: 195507 - DNA, 23 bp, Mus musculus
ttggttccttttctattgctgtg

SEQ ID NO: 195508 - DNA, 22 bp, Mus musculus
ttgtgacttcagagagtgagct

SEQ ID NO: 195509 - DNA, 23 bp, Mus musculus
tcagtgagtcagtcagtcagcat

SEQ ID NO: 195510 - DNA, 20 bp, Mus musculus
ccctgagaatggtagtactg

SEQ ID NO: 195511 - DNA, 23 bp, Mus musculus
atgtatgtatgtatgtatgtatg

SEQ ID NO: 195512 - DNA, 23 bp, Mus musculus
gtggctctcactgacacagtccc

SEQ ID NO: 195513 - DNA, 22 bp, Mus musculus
cagtctcagccagtctcaaagc

SEQ ID NO: 195514 - DNA, 22 bp, Mus musculus
actcatggtcctgctgtcatct

SEQ ID NO: 195515 - DNA, 22 bp, Mus musculus
actcagagacctgactgaggag

SEQ ID NO: 195516 - DNA, 21 bp, Mus musculus
ataagtctagagagagcatga

SEQ ID NO: 195517 - DNA, 23 bp, Mus musculus
gaagccagaggtttaattgattg

SEQ ID NO: 195518 - DNA, 18 bp, Mus musculus
tcacactcttactgagtg

SEQ ID NO: 195519 - DNA, 23 bp, Mus musculus
ataggcctctttgtcctggaggt

SEQ ID NO: 195520 - DNA, 23 bp, Mus musculus
tcacactggatatgtttacaagc

SEQ ID NO: 195521 - DNA, 18 bp, Mus musculus
tgtgtcattgctgatgga

SEQ ID NO: 195522 - DNA, 19 bp, Mus musculus
ttcaactatcacaggtagc

SEQ ID NO: 195523 - DNA, 23 bp, Mus musculus
gtcagaagacacactcacactca

SEQ ID NO: 195524 - DNA, 23 bp, Mus musculus
ttgagtgtacttctaactgtgag

SEQ ID NO: 195525 - DNA, 23 bp, Mus musculus
tttgagttttagttaaagagagg

SEQ ID NO: 195526 - DNA, 23 bp, Mus musculus
tataaactcctttttctgtagat

SEQ ID NO: 195527 - DNA, 19 bp, Mus musculus
atacacacacaaaaatatc

SEQ ID NO: 195528 - DNA, 23 bp, Mus musculus
tatatgtacttattcagctgatt

SEQ ID NO: 195529 - DNA, 20 bp, Mus musculus
atgcaagttttacaaagtat

SEQ ID NO: 195530 - DNA, 23 bp, Mus musculus
tgtgtgtgtatatatatatgtgt

SEQ ID NO: 195531 - DNA, 23 bp, Mus musculus
atgactgaacagagagagcttca

SEQ ID NO: 195532 - DNA, 23 bp, Mus musculus
ataaatgtatatgtatacacata

SEQ ID NO: 195533 - DNA, 18 bp, Mus musculus
ggctggagagactcagcg

SEQ ID NO: 195534 - DNA, 21 bp, Mus musculus
tcaggctctgtgaagttctag

SEQ ID NO: 195535 - DNA, 23 bp, Mus musculus
tatgtttatcttattggctcctc

SEQ ID NO: 195536 - DNA, 23 bp, Mus musculus
atgtatgtgtgcatgtgcatgtg

SEQ ID NO: 195537 - DNA, 21 bp, Mus musculus
atgtgtcccagtgcatgcgtt

SEQ ID NO: 195538 - DNA, 22 bp, Mus musculus
tgttttgtgaccaattatatgg

SEQ ID NO: 195539 - DNA, 20 bp, Mus musculus
atcagattgccaggggatag

SEQ ID NO: 195540 - DNA, 23 bp, Mus musculus
aatctttattgtccaacctgcct

SEQ ID NO: 195541 - DNA, 22 bp, Mus musculus
tgttttgtgaccaattatatgg

SEQ ID NO: 195542 - DNA, 18 bp, Mus musculus
cagggaagagacctgcta

SEQ ID NO: 195543 - DNA, 22 bp, Mus musculus
agcttctcaactagcagtgtct

SEQ ID NO: 195544 - DNA, 23 bp, Mus musculus
tggctcagtggttaagagcactg

SEQ ID NO: 195545 - DNA, 20 bp, Mus musculus
tgactgagcaaagtctgctg

SEQ ID NO: 195546 - DNA, 23 bp, Mus musculus
taaggaagtgtggctttgttggg

SEQ ID NO: 195547 - DNA, 23 bp, Mus musculus
gctgtctctgacttgacatgggt

SEQ ID NO: 195548 - DNA, 23 bp, Mus musculus
gactgtctgagtctctgtctggc

SEQ ID NO: 195549 - DNA, 21 bp, Mus musculus
tcaggtagaaggttgatagta

SEQ ID NO: 195550 - DNA, 23 bp, Mus musculus
tcatctgtctttgactgtctcca

SEQ ID NO: 195551 - DNA, 23 bp, Mus musculus
gcatgtgtggatgcctgtgtaga

SEQ ID NO: 195552 - DNA, 20 bp, Mus musculus
atgtgcatatgtatatatgt

SEQ ID NO: 195553 - DNA, 19 bp, Mus musculus
cctggtggtgactgtggtc

SEQ ID NO: 195554 - DNA, 18 bp, Mus musculus
gaaatctcttctttttct

SEQ ID NO: 195555 - DNA, 20 bp, Mus musculus
actgatgtagccctggtgca

SEQ ID NO: 195556 - DNA, 21 bp, Mus musculus
aagctgctgtacacaaccttg

SEQ ID NO: 195557 - DNA, 23 bp, Mus musculus
tgagaacaccaggagctgctgta

SEQ ID NO: 195558 - DNA, 23 bp, Mus musculus
gtctgtctgtcggtctgtctgtc

SEQ ID NO: 195559 - DNA, 21 bp, Mus musculus
ttctccttgttctccaggtcc

SEQ ID NO: 195560 - DNA, 23 bp, Mus musculus
acagagacagaagagacagggct

SEQ ID NO: 195561 - DNA, 20 bp, Mus musculus
tctgcctgcctctcttctac

SEQ ID NO: 195562 - DNA, 23 bp, Mus musculus
atatatgtatatgtaatgtgttt

SEQ ID NO: 195563 - DNA, 19 bp, Mus musculus
tatgtgcatgtatatatgt

SEQ ID NO: 195564 - DNA, 22 bp, Mus musculus
tatgtgtatatatatgtgtgtg

SEQ ID NO: 195565 - DNA, 23 bp, Mus musculus
acactgactcagaaaatctaaac

SEQ ID NO: 195566 - DNA, 23 bp, Mus musculus
gcctgtgtctgtctgtgcctgtg

SEQ ID NO: 195567 - DNA, 23 bp, Mus musculus
gggtctctcactgactcagtggg

SEQ ID NO: 195568 - DNA, 19 bp, Mus musculus
actctgactgactatctgc

SEQ ID NO: 195569 - DNA, 23 bp, Mus musculus
tgtatgtatgtatgtatgtatgt

SEQ ID NO: 195570 - DNA, 23 bp, Mus musculus
acacacacacatatatatttcat

SEQ ID NO: 195571 - DNA, 23 bp, Mus musculus
tgtctgtgtgtgggtatgtgcct

SEQ ID NO: 195572 - DNA, 23 bp, Mus musculus
taacttgtggatatgtatgtgtg

SEQ ID NO: 195573 - DNA, 23 bp, Mus musculus
agtgtctgtctgtgtgtattgac

SEQ ID NO: 195574 - DNA, 20 bp, Mus musculus
agtctacatagtgtgtctca

SEQ ID NO: 195575 - DNA, 22 bp, Mus musculus
ggaccacacactgagacactgt

SEQ ID NO: 195576 - DNA, 23 bp, Mus musculus
cctctgtgtgtctctgaccccca

SEQ ID NO: 195577 - DNA, 23 bp, Mus musculus
cagagacacaagagagtcagctg

SEQ ID NO: 195578 - DNA, 22 bp, Mus musculus
tgttttgtgaccaattatatgg

SEQ ID NO: 195579 - DNA, 23 bp, Mus musculus
tcacaggtacaagttcacctgtg

SEQ ID NO: 195580 - DNA, 20 bp, Mus musculus
tgtgtgtgtgtgtgtgcgct

SEQ ID NO: 195581 - DNA, 22 bp, Mus musculus
tgtgcatttgtgtgtgtgagag

SEQ ID NO: 195582 - DNA, 21 bp, Mus musculus
ttgactgaacagacatacctc

SEQ ID NO: 195583 - DNA, 20 bp, Mus musculus
tttattgcttggttatcaaa

SEQ ID NO: 195584 - DNA, 23 bp, Mus musculus
aatctgaagatagagagcagagg

SEQ ID NO: 195585 - DNA, 20 bp, Mus musculus
attgctgcttggtttgtgac

SEQ ID NO: 195586 - DNA, 22 bp, Mus musculus
cattgttcttcaataagcttga

SEQ ID NO: 195587 - DNA, 23 bp, Mus musculus
tgtacacagatatgagtgtgtgc

SEQ ID NO: 195588 - DNA, 23 bp, Mus musculus
ttgtgattcatgtacagatgtga

SEQ ID NO: 195589 - DNA, 20 bp, Mus musculus
cagtctctttgtgtctccat

SEQ ID NO: 195590 - DNA, 23 bp, Mus musculus
tgttcctggatttggtttgagag

SEQ ID NO: 195591 - DNA, 21 bp, Mus musculus
tcacagagcacagaggggagt

SEQ ID NO: 195592 - DNA, 23 bp, Mus musculus
tcaagagctttggaaagacattg

SEQ ID NO: 195593 - DNA, 19 bp, Mus musculus
tgtcgttcagtggtcttcg

SEQ ID NO: 195594 - DNA, 22 bp, Mus musculus
ttgtggtctgataggatgcatg

SEQ ID NO: 195595 - DNA, 23 bp, Mus musculus
tgactgctcttacagaggtcctg

SEQ ID NO: 195596 - DNA, 19 bp, Mus musculus
ttgagcagatcaaagatgg

SEQ ID NO: 195597 - DNA, 23 bp, Mus musculus
agataagtacatgaacatgtatt

SEQ ID NO: 195598 - DNA, 19 bp, Mus musculus
tcaggattgatgggaggtg

SEQ ID NO: 195599 - DNA, 23 bp, Mus musculus
agagctagctgtcactgtcactg

SEQ ID NO: 195600 - DNA, 23 bp, Mus musculus
tatatgtgtatatgtatatgtgt

SEQ ID NO: 195601 - DNA, 23 bp, Mus musculus
tttcattgagtttttgttgatgt

SEQ ID NO: 195602 - DNA, 22 bp, Mus musculus
tgttttgtgaccaattatatgg

SEQ ID NO: 195603 - DNA, 23 bp, Mus musculus
cgtatgtaagtatgtatgtgcat

SEQ ID NO: 195604 - DNA, 22 bp, Mus musculus
ttgcttagtgctaatgatatgg

SEQ ID NO: 195605 - DNA, 23 bp, Mus musculus
actctgagggtctctaagatgtg

SEQ ID NO: 195606 - DNA, 23 bp, Mus musculus
ctctaaattctgttagtaaactg

SEQ ID NO: 195607 - DNA, 23 bp, Mus musculus
tcaacttctgaatttgatgtcgt

SEQ ID NO: 195608 - DNA, 23 bp, Mus musculus
aggcttcactagaggaagcagtc

SEQ ID NO: 195609 - DNA, 23 bp, Mus musculus
tcactgtctgtctgcctttgttg

SEQ ID NO: 195610 - DNA, 19 bp, Mus musculus
tatatgtatgtgtgtgtgt

SEQ ID NO: 195611 - DNA, 23 bp, Mus musculus
tatctggggggaaatgtttggtt

SEQ ID NO: 195612 - DNA, 23 bp, Mus musculus
aacttgacacagtcgtctgagag

SEQ ID NO: 195613 - DNA, 21 bp, Mus musculus
agttgtgactctgtgtcacag

SEQ ID NO: 195614 - DNA, 23 bp, Mus musculus
ttgatgtcacagaaatcactacg

SEQ ID NO: 195615 - DNA, 23 bp, Mus musculus
cacagttgtgtgtgtgtgatgtc

SEQ ID NO: 195616 - DNA, 19 bp, Mus musculus
ttgttagacagtacgtgtg

SEQ ID NO: 195617 - DNA, 23 bp, Mus musculus
cactctctctctttgctggttct

SEQ ID NO: 195618 - DNA, 22 bp, Mus musculus
tgttttgtgaccaattatatgg

SEQ ID NO: 195619 - DNA, 23 bp, Mus musculus
tgtgcatgagttctgattttggt

SEQ ID NO: 195620 - DNA, 21 bp, Mus musculus
aatgtgtgggattatatctgg

SEQ ID NO: 195621 - DNA, 23 bp, Mus musculus
tgtgtgtgactgtgccaggctct

SEQ ID NO: 195622 - DNA, 19 bp, Mus musculus
tgtgtgtatgtatgtatat

SEQ ID NO: 195623 - DNA, 23 bp, Mus musculus
tatgtgtgtatgtatatatgtgt

SEQ ID NO: 195624 - DNA, 21 bp, Mus musculus
tggcagtgagggaatgttgtc

SEQ ID NO: 195625 - DNA, 23 bp, Mus musculus
tctgtctgtctatcctgtctgtg

SEQ ID NO: 195626 - DNA, 19 bp, Mus musculus
agcaatacagagtgattgg

SEQ ID NO: 195627 - DNA, 23 bp, Mus musculus
ttgtcagcatgtgtatctgcatg

SEQ ID NO: 195628 - DNA, 22 bp, Mus musculus
tctgtctctgaaatgggttctg

SEQ ID NO: 195629 - DNA, 23 bp, Mus musculus
agcacatgtagcagacactgtca

SEQ ID NO: 195630 - DNA, 19 bp, Mus musculus
tcttgctgtgtgcctctct

SEQ ID NO: 195631 - DNA, 19 bp, Mus musculus
tcatatgtaatgtatgtat

SEQ ID NO: 195632 - DNA, 22 bp, Mus musculus
tgttttgtgaccaattatatgg

SEQ ID NO: 195633 - DNA, 23 bp, Mus musculus
agtcaggctcagtgtctctctct

SEQ ID NO: 195634 - DNA, 23 bp, Mus musculus
ggtgtctctgtctcagtctcagc

SEQ ID NO: 195635 - DNA, 23 bp, Mus musculus
ttatgaatgtagttgcctttgca

SEQ ID NO: 195636 - DNA, 22 bp, Mus musculus
catagatgttcagaattgagac

SEQ ID NO: 195637 - DNA, 23 bp, Mus musculus
agatagcactgtctgggagatga

SEQ ID NO: 195638 - DNA, 18 bp, Mus musculus
tgtggggctggtaagatg

SEQ ID NO: 195639 - DNA, 23 bp, Mus musculus
atgagagcctgactaaaggacca

SEQ ID NO: 195640 - DNA, 21 bp, Mus musculus
tagacagcttgctttgaagag

SEQ ID NO: 195641 - DNA, 23 bp, Mus musculus
tctgagtgatttgagtgagatgt

SEQ ID NO: 195642 - DNA, 22 bp, Mus musculus
atatatgtatatgtatatgtgt

SEQ ID NO: 195643 - DNA, 23 bp, Mus musculus
gtccctctgacacactcttactc

SEQ ID NO: 195644 - DNA, 23 bp, Mus musculus
cgagagggttttgtttcaggatt

SEQ ID NO: 195645 - DNA, 23 bp, Mus musculus
gtcagttactctctgtgttttga

SEQ ID NO: 195646 - DNA, 19 bp, Mus musculus
ctgatctgaggtcaagtga

SEQ ID NO: 195647 - DNA, 20 bp, Mus musculus
ctcacacagtgacacccccc

SEQ ID NO: 195648 - DNA, 23 bp, Mus musculus
tatgtgtgtatgtacatgtatgc

SEQ ID NO: 195649 - DNA, 22 bp, Mus musculus
atatgagtatatgtatatgtgt

SEQ ID NO: 195650 - DNA, 23 bp, Mus musculus
atatgtgtatatgtatatatatg

SEQ ID NO: 195651 - DNA, 23 bp, Mus musculus
tatgtgtgtatatgtatatgtat

SEQ ID NO: 195652 - DNA, 19 bp, Mus musculus
atatgtgtgtatgtatata

SEQ ID NO: 195653 - DNA, 23 bp, Mus musculus
ctgtctgtctgtctgtctgtttc

SEQ ID NO: 195654 - DNA, 22 bp, Mus musculus
tatatgtatatgtgtgtgtgtg

SEQ ID NO: 195655 - DNA, 23 bp, Mus musculus
tctctgggtctctgtttcttgat

SEQ ID NO: 195656 - DNA, 22 bp, Mus musculus
gttaagtgattctccaaagcct

SEQ ID NO: 195657 - DNA, 19 bp, Mus musculus
tacttggcagtcgaagtct

SEQ ID NO: 195658 - DNA, 23 bp, Mus musculus
ccgtctctcactttctctctgcc

SEQ ID NO: 195659 - DNA, 19 bp, Mus musculus
tctcaaactcaactcggag

SEQ ID NO: 195660 - DNA, 20 bp, Mus musculus
agagatgacagacagcctct

SEQ ID NO: 195661 - DNA, 23 bp, Mus musculus
atgtgattccaagaactcaccat

SEQ ID NO: 195662 - DNA, 23 bp, Mus musculus
tgtgtctgtgtgcctgagtgtgt

SEQ ID NO: 195663 - DNA, 23 bp, Mus musculus
tgacagcactcagaggaaagact

SEQ ID NO: 195664 - DNA, 23 bp, Mus musculus
gtctgtctgtctgtctgtctatc

SEQ ID NO: 195665 - DNA, 23 bp, Mus musculus
tgtctgtctgtctgtctgcctgc

SEQ ID NO: 195666 - DNA, 20 bp, Mus musculus
ttaactgctgagacagctct

SEQ ID NO: 195667 - DNA, 23 bp, Mus musculus
gtctcactgtgtagtcatggctg

SEQ ID NO: 195668 - DNA, 19 bp, Mus musculus
caagactgcagttgcttgg

SEQ ID NO: 195669 - DNA, 19 bp, Mus musculus
attgcactgtgaggtgttt

SEQ ID NO: 195670 - DNA, 22 bp, Mus musculus
aaacagacaggacacagtgctc

SEQ ID NO: 195671 - DNA, 23 bp, Mus musculus
ctcgcactgtgcagctgcagctg

SEQ ID NO: 195672 - DNA, 23 bp, Mus musculus
actcaggctgctttcttcaggaa

SEQ ID NO: 195673 - DNA, 23 bp, Mus musculus
aagaccactgactgctcttccag

SEQ ID NO: 195674 - DNA, 22 bp, Mus musculus
tcccagtgacttaaggcagatg

SEQ ID NO: 195675 - DNA, 20 bp, Mus musculus
tgactcagtggttaggagca

SEQ ID NO: 195676 - DNA, 23 bp, Mus musculus
tacatgtatgcatatgtttgtgt

SEQ ID NO: 195677 - DNA, 18 bp, Mus musculus
tgcactgtggctgtacat

SEQ ID NO: 195678 - DNA, 23 bp, Mus musculus
agagagagaacagactttggact

SEQ ID NO: 195679 - DNA, 23 bp, Mus musculus
aaatcaattctgtctccagtttt

SEQ ID NO: 195680 - DNA, 23 bp, Mus musculus
atctgacgccctcttctggtgca

SEQ ID NO: 195681 - DNA, 22 bp, Mus musculus
agtcactctgtctgttctccgc

SEQ ID NO: 195682 - DNA, 19 bp, Mus musculus
aaatgtttgactaactgct

SEQ ID NO: 195683 - DNA, 23 bp, Mus musculus
ctatctatctgtctgtctgtgtt

SEQ ID NO: 195684 - DNA, 19 bp, Mus musculus
acacagactgcctggtctc

SEQ ID NO: 195685 - DNA, 23 bp, Mus musculus
ctcgcactgtctctcagtagatg

SEQ ID NO: 195686 - DNA, 20 bp, Mus musculus
tttcagacagggtcttgtca

SEQ ID NO: 195687 - DNA, 18 bp, Mus musculus
acagaaggaagtgagcac

SEQ ID NO: 195688 - DNA, 22 bp, Mus musculus
tgtgtgtgtagagatggctcag

SEQ ID NO: 195689 - DNA, 21 bp, Mus musculus
ggcagtcagtcagtccctcac

SEQ ID NO: 195690 - DNA, 23 bp, Mus musculus
aagagcactgactgctcttccag

SEQ ID NO: 195691 - DNA, 18 bp, Mus musculus
agatctggggctggagag

SEQ ID NO: 195692 - DNA, 23 bp, Mus musculus
tccctctctgtgtctgtgttgta

SEQ ID NO: 195693 - DNA, 23 bp, Mus musculus
tgacacactgacatatagatctc

SEQ ID NO: 195694 - DNA, 23 bp, Mus musculus
agtggctctctccctccgtggct

SEQ ID NO: 195695 - DNA, 20 bp, Mus musculus
tcactgtgtagatcaggctg

SEQ ID NO: 195696 - DNA, 20 bp, Mus musculus
ctctgcctctctgcctctga

SEQ ID NO: 195697 - DNA, 19 bp, Mus musculus
aggacaagcagcactttga

SEQ ID NO: 195698 - DNA, 23 bp, Mus musculus
ctatgtagtcctggcagtcctga

SEQ ID NO: 195699 - DNA, 23 bp, Mus musculus
ttagttgtaggttgaattgtagc

SEQ ID NO: 195700 - DNA, 21 bp, Mus musculus
ttatgagttagtcctggagga

SEQ ID NO: 195701 - DNA, 21 bp, Mus musculus
tacatcgatctgtgtctcagt

SEQ ID NO: 195702 - DNA, 21 bp, Mus musculus
tgtgcatgtatatatgtgtgt

SEQ ID NO: 195703 - DNA, 22 bp, Mus musculus
tgttttgtgaccaattatatgg

SEQ ID NO: 195704 - DNA, 23 bp, Mus musculus
gtgtgtatgtgtgcatgtacatg

SEQ ID NO: 195705 - DNA, 23 bp, Mus musculus
ctgccagtcacactgagtgaggc

SEQ ID NO: 195706 - DNA, 23 bp, Mus musculus
tgtgagcatgtgtatgtgcacat

SEQ ID NO: 195707 - DNA, 22 bp, Mus musculus
tgtgtatgtatgtatatatgta

SEQ ID NO: 195708 - DNA, 23 bp, Mus musculus
tatgtgtatgtatgtatatatgt

SEQ ID NO: 195709 - DNA, 23 bp, Mus musculus
tatgtgtatgtatgtatatatat

SEQ ID NO: 195710 - DNA, 20 bp, Mus musculus
tgctcactgctcttccagag

SEQ ID NO: 195711 - DNA, 23 bp, Mus musculus
actgtagagtgaagagacacagg

SEQ ID NO: 195712 - DNA, 23 bp, Mus musculus
aatagtcaaattcttcatgtgac

SEQ ID NO: 195713 - DNA, 23 bp, Mus musculus
agttgtgtgtgattgttctcagc

SEQ ID NO: 195714 - DNA, 20 bp, Mus musculus
gtgatcttcctaaaggatga

SEQ ID NO: 195715 - DNA, 23 bp, Mus musculus
tgagagagaacacactggccttg

SEQ ID NO: 195716 - DNA, 23 bp, Mus musculus
tatatgtgcttgtgtgtgtatgt

SEQ ID NO: 195717 - DNA, 22 bp, Mus musculus
tatacatatgtgtgtgtatata

SEQ ID NO: 195718 - DNA, 19 bp, Mus musculus
tatctctatatatatatgt

SEQ ID NO: 195719 - DNA, 18 bp, Mus musculus
tgtgcatgtatgatgtat

SEQ ID NO: 195720 - DNA, 21 bp, Mus musculus
tgtatgtatatgtatatgtat

SEQ ID NO: 195721 - DNA, 23 bp, Mus musculus
tctaagagctaagagttagtcct

SEQ ID NO: 195722 - DNA, 22 bp, Mus musculus
ctgacagatctctactcttagg

SEQ ID NO: 195723 - DNA, 23 bp, Mus musculus
gtctctctcactgtctgtcctgg

SEQ ID NO: 195724 - DNA, 21 bp, Mus musculus
attgagtgtccatgtatattc

SEQ ID NO: 195725 - DNA, 21 bp, Mus musculus
tgtaaatccatctgcatctgt

SEQ ID NO: 195726 - DNA, 23 bp, Mus musculus
agtgtgctgaagatgtcttagag

SEQ ID NO: 195727 - DNA, 23 bp, Mus musculus
ctccacaggaattcagtagctct

SEQ ID NO: 195728 - DNA, 23 bp, Mus musculus
atatgtgtatatatatgtgtgtg

SEQ ID NO: 195729 - DNA, 22 bp, Mus musculus
tttatggatatttaaaatatgt

SEQ ID NO: 195730 - DNA, 22 bp, Mus musculus
ttatctagaatctagttgggat

SEQ ID NO: 195731 - DNA, 23 bp, Mus musculus
tgtaatagtgtctgcttttggtg

SEQ ID NO: 195732 - DNA, 23 bp, Mus musculus
tctgattggtcttgtattctctt

SEQ ID NO: 195733 - DNA, 23 bp, Mus musculus
aagtctgcacctctttgcctcac

SEQ ID NO: 195734 - DNA, 23 bp, Mus musculus
tagttagagaggtttcctttcag

SEQ ID NO: 195735 - DNA, 20 bp, Mus musculus
tggttggagaggtagctcag

SEQ ID NO: 195736 - DNA, 23 bp, Mus musculus
aagagcactgactgctcttccag

SEQ ID NO: 195737 - DNA, 23 bp, Mus musculus
tgtctgtctgtctgtctgtgggc

SEQ ID NO: 195738 - DNA, 22 bp, Mus musculus
atgcatgatcatgtatgcatat

SEQ ID NO: 195739 - DNA, 23 bp, Mus musculus
tatatatatgttgatgttggcat

SEQ ID NO: 195740 - DNA, 21 bp, Mus musculus
agggtcagactctctctgtgc

SEQ ID NO: 195741 - DNA, 23 bp, Mus musculus
aagtctgtcagtctgtccctgag

SEQ ID NO: 195742 - DNA, 23 bp, Mus musculus
gagtgtcactagaggtgggcttt

SEQ ID NO: 195743 - DNA, 23 bp, Mus musculus
acccatggcaatcccagagtcag

SEQ ID NO: 195744 - DNA, 23 bp, Mus musculus
tctatctcactgtctgtgtggct

SEQ ID NO: 195745 - DNA, 23 bp, Mus musculus
tggctgtgaaatctgtctctgtg

SEQ ID NO: 195746 - DNA, 22 bp, Mus musculus
ctgtctgtctgtctgtctgtct

SEQ ID NO: 195747 - DNA, 22 bp, Mus musculus
gagtcactgtgtgtgtgcctga

SEQ ID NO: 195748 - DNA, 19 bp, Mus musculus
tctgacttgctatgagcct

SEQ ID NO: 195749 - DNA, 23 bp, Mus musculus
accagactctctgtggctgtctt

SEQ ID NO: 195750 - DNA, 23 bp, Mus musculus
tcagtgagagttcaagtcatggc

SEQ ID NO: 195751 - DNA, 20 bp, Mus musculus
gcttctagatgctcaggacc

SEQ ID NO: 195752 - DNA, 23 bp, Mus musculus
ttgtgattggctagtttctggtg

SEQ ID NO: 195753 - DNA, 23 bp, Mus musculus
tctctggctccctgactggccaa

SEQ ID NO: 195754 - DNA, 23 bp, Mus musculus
tgcagagcatggtgtaagggtct

SEQ ID NO: 195755 - DNA, 23 bp, Mus musculus
tctgctcacaagtgtctctgttt

SEQ ID NO: 195756 - DNA, 23 bp, Mus musculus
tgtgtgtgtatatgtatgtatat

SEQ ID NO: 195757 - DNA, 18 bp, Mus musculus
aaatgctgctgctctctg

SEQ ID NO: 195758 - DNA, 23 bp, Mus musculus
atctcctcttacctgagcatcat

SEQ ID NO: 195759 - DNA, 20 bp, Mus musculus
agtctgcagagactgaggac

SEQ ID NO: 195760 - DNA, 23 bp, Mus musculus
tgtgtgtctgtctgtctcccagc

SEQ ID NO: 195761 - DNA, 18 bp, Mus musculus
agggttttgttgctgtgc

SEQ ID NO: 195762 - DNA, 23 bp, Mus musculus
atatataacatatgtgtatgtat

SEQ ID NO: 195763 - DNA, 23 bp, Mus musculus
tatgtgtgtatatatatgtgtgt

SEQ ID NO: 195764 - DNA, 23 bp, Mus musculus
gagatgagtctgaggtttgggtc

SEQ ID NO: 195765 - DNA, 23 bp, Mus musculus
tgtatatgtatatgtgtgtgtgt

SEQ ID NO: 195766 - DNA, 20 bp, Mus musculus
atacatgaagggcagcagca

SEQ ID NO: 195767 - DNA, 21 bp, Mus musculus
agtggtaggaggttgttgagt

SEQ ID NO: 195768 - DNA, 18 bp, Mus musculus
tgagagagatgggtatac

SEQ ID NO: 195769 - DNA, 19 bp, Mus musculus
ttctgaatacactttcctt

SEQ ID NO: 195770 - DNA, 23 bp, Mus musculus
tcagagcttgttctatgttgagt

SEQ ID NO: 195771 - DNA, 23 bp, Mus musculus
ctgtgacgttagtgtgtgtgtgt

SEQ ID NO: 195772 - DNA, 23 bp, Mus musculus
ttctctctgtattatttatctct

SEQ ID NO: 195773 - DNA, 23 bp, Mus musculus
tgagttcagaggttactgtgtag

SEQ ID NO: 195774 - DNA, 23 bp, Mus musculus
actgccccagtctctgcctctca

SEQ ID NO: 195775 - DNA, 22 bp, Mus musculus
tgtcacatgggactttgagagc

SEQ ID NO: 195776 - DNA, 20 bp, Mus musculus
tctcttctgtgtcagtctgt

SEQ ID NO: 195777 - DNA, 20 bp, Mus musculus
tcaggctcactcactggctg

SEQ ID NO: 195778 - DNA, 23 bp, Mus musculus
atgtatgtgtgtatatgcatgtg

SEQ ID NO: 195779 - DNA, 21 bp, Mus musculus
tatgtgtatatatacatatgt

SEQ ID NO: 195780 - DNA, 22 bp, Mus musculus
atcagagctgaagctgcgcttt

SEQ ID NO: 195781 - DNA, 23 bp, Mus musculus
acagaggacagtgtggactgaag

SEQ ID NO: 195782 - DNA, 21 bp, Mus musculus
actgctagctctcctccttca

SEQ ID NO: 195783 - DNA, 22 bp, Mus musculus
tgacagtgtggtgagctggttc

SEQ ID NO: 195784 - DNA, 18 bp, Mus musculus
acagtgtgtagccttacc

SEQ ID NO: 195785 - DNA, 23 bp, Mus musculus
tcagtctgagtctagagggttgc

SEQ ID NO: 195786 - DNA, 22 bp, Mus musculus
gtgggactgtgtgtgtgtgcgc

SEQ ID NO: 195787 - DNA, 22 bp, Mus musculus
tgttttgtgaccaattatatgg

SEQ ID NO: 195788 - DNA, 23 bp, Mus musculus
tattagagcatgttcatgtggag

SEQ ID NO: 195789 - DNA, 23 bp, Mus musculus
tccagtctgtctatgctgttagt

SEQ ID NO: 195790 - DNA, 23 bp, Mus musculus
gtgaagtgtgtgtgctcagcttc

SEQ ID NO: 195791 - DNA, 22 bp, Mus musculus
aagcaaagccaaactcacacta

SEQ ID NO: 195792 - DNA, 23 bp, Mus musculus
tatgtgtgtgtaatgtatgtgat

SEQ ID NO: 195793 - DNA, 21 bp, Mus musculus
atgtatatgtgtatgtatatg

SEQ ID NO: 195794 - DNA, 21 bp, Mus musculus
atgtatgtatgcatgtgcatg

SEQ ID NO: 195795 - DNA, 20 bp, Mus musculus
tgtgcatgtatgtatatatg

SEQ ID NO: 195796 - DNA, 22 bp, Mus musculus
tcctattgtcagagatgggtct

SEQ ID NO: 195797 - DNA, 20 bp, Mus musculus
tcactccctgtgtgtctgac

SEQ ID NO: 195798 - DNA, 23 bp, Mus musculus
ttcacacaggctctcctcattca

SEQ ID NO: 195799 - DNA, 21 bp, Mus musculus
ctctttgtctctcagtctcag

SEQ ID NO: 195800 - DNA, 20 bp, Mus musculus
actctgtgcacatcgtccag

SEQ ID NO: 195801 - DNA, 22 bp, Mus musculus
atagttcttctagatttacttt

SEQ ID NO: 195802 - DNA, 23 bp, Mus musculus
agcctcacagtgtctcactggat

SEQ ID NO: 195803 - DNA, 20 bp, Mus musculus
taacagccactggaatggtg

SEQ ID NO: 195804 - DNA, 20 bp, Mus musculus
caaggagctgatggtgcaga

SEQ ID NO: 195805 - DNA, 18 bp, Mus musculus
tgctaggagtaggagccc

SEQ ID NO: 195806 - DNA, 23 bp, Mus musculus
ctctgtctctgagtgcttggttg

SEQ ID NO: 195807 - DNA, 23 bp, Mus musculus
tctgcccctgtgtgtgtgtgacc

SEQ ID NO: 195808 - DNA, 19 bp, Mus musculus
ctcagagcttctcatctgt

SEQ ID NO: 195809 - DNA, 20 bp, Mus musculus
cacagaagagtgacaggact

SEQ ID NO: 195810 - DNA, 23 bp, Mus musculus
ctgtgtctctgtttagtttctgt

SEQ ID NO: 195811 - DNA, 20 bp, Mus musculus
aagagtcaagacactccatt

SEQ ID NO: 195812 - DNA, 23 bp, Mus musculus
tttggaatgatatgatgtatgga

SEQ ID NO: 195813 - DNA, 18 bp, Mus musculus
tccatctctgtgcctctg

SEQ ID NO: 195814 - DNA, 20 bp, Mus musculus
taagtagttgtgggtgacta

SEQ ID NO: 195815 - DNA, 20 bp, Mus musculus
aagccactggctatcatcac

SEQ ID NO: 195816 - DNA, 23 bp, Mus musculus
tctctagcactgggtctctcttt

SEQ ID NO: 195817 - DNA, 23 bp, Mus musculus
ctgtccctctgtctgcccctcta

SEQ ID NO: 195818 - DNA, 20 bp, Mus musculus
ttcagctctgaaacactctg

SEQ ID NO: 195819 - DNA, 23 bp, Mus musculus
tctgtgggtgggtgcctctttgc

SEQ ID NO: 195820 - DNA, 18 bp, Mus musculus
tatgctggcctccttctt

SEQ ID NO: 195821 - DNA, 23 bp, Mus musculus
acactgagtgataaagaaaaagg

SEQ ID NO: 195822 - DNA, 23 bp, Mus musculus
ctggctctgtcactgtgtgcctg

SEQ ID NO: 195823 - DNA, 23 bp, Mus musculus
tctcagtcactctgaaaaggtag

SEQ ID NO: 195824 - DNA, 23 bp, Mus musculus
tgcctgcctgtctgcctgcctga

SEQ ID NO: 195825 - DNA, 18 bp, Mus musculus
gacagggaagtaggagag

SEQ ID NO: 195826 - DNA, 22 bp, Mus musculus
ctcccagttctcactggctgtt

SEQ ID NO: 195827 - DNA, 19 bp, Mus musculus
tcaccgggacagctgtggg

SEQ ID NO: 195828 - DNA, 23 bp, Mus musculus
ttgacagatgacagaagtcagtg

SEQ ID NO: 195829 - DNA, 19 bp, Mus musculus
tgagagctgagagtggcca

SEQ ID NO: 195830 - DNA, 23 bp, Mus musculus
tctcactctgactctgttccctt

SEQ ID NO: 195831 - DNA, 21 bp, Mus musculus
acacaggctggcaatgtgcag

SEQ ID NO: 195832 - DNA, 23 bp, Mus musculus
gctcatgtctgtctgcctgtctg

SEQ ID NO: 195833 - DNA, 23 bp, Mus musculus
actctctctgtctttaagcagat

SEQ ID NO: 195834 - DNA, 23 bp, Mus musculus
gtctctggaattggtactgtgag

SEQ ID NO: 195835 - DNA, 23 bp, Mus musculus
gtcctctgtgtctgtctccagcg

SEQ ID NO: 195836 - DNA, 23 bp, Mus musculus
agtctctgtctgtctcctctttg

SEQ ID NO: 195837 - DNA, 22 bp, Mus musculus
tggctctctcttagcctctgct

SEQ ID NO: 195838 - DNA, 23 bp, Mus musculus
ggtctctgtctgtctgtctgact

SEQ ID NO: 195839 - DNA, 23 bp, Mus musculus
ggatgggtggctgtctctcagtc

SEQ ID NO: 195840 - DNA, 21 bp, Mus musculus
tggtagcagccttgatagccc

SEQ ID NO: 195841 - DNA, 18 bp, Mus musculus
acctatcatttgcttgag

SEQ ID NO: 195842 - DNA, 19 bp, Mus musculus
agagggctgcttagtccct

SEQ ID NO: 195843 - DNA, 22 bp, Mus musculus
tgttttgtgaccaattatatgg

SEQ ID NO: 195844 - DNA, 23 bp, Mus musculus
tagtccatgttggtctgatagga

SEQ ID NO: 195845 - DNA, 23 bp, Mus musculus
ttttgtgaccaactatatggtca

SEQ ID NO: 195846 - DNA, 22 bp, Mus musculus
tgttttgtgaccaattatatgg

SEQ ID NO: 195847 - DNA, 20 bp, Mus musculus
tttgtactcagtcctcagtc

SEQ ID NO: 195848 - DNA, 22 bp, Mus musculus
aggctcacacatctccttctga

SEQ ID NO: 195849 - DNA, 23 bp, Mus musculus
gtctcagtgtccttatctgatag

SEQ ID NO: 195850 - DNA, 21 bp, Mus musculus
tgtttgtgcaaatgcatgtgg

SEQ ID NO: 195851 - DNA, 23 bp, Mus musculus
agactgcagtctcagtctctctg

SEQ ID NO: 195852 - DNA, 23 bp, Mus musculus
aaggacagtggtaagggtggtga

SEQ ID NO: 195853 - DNA, 23 bp, Mus musculus
tgtgagatgtgtgtgagaaggga

SEQ ID NO: 195854 - DNA, 22 bp, Mus musculus
tcaccaccatctgtaatggtat

SEQ ID NO: 195855 - DNA, 20 bp, Mus musculus
cattccctgtctgtcactgt

SEQ ID NO: 195856 - DNA, 23 bp, Mus musculus
aggcagatctctgtgagctcaag

SEQ ID NO: 195857 - DNA, 19 bp, Mus musculus
agaatagagtctgtcctgt

SEQ ID NO: 195858 - DNA, 23 bp, Mus musculus
acaggactctctctgtgtgccac

SEQ ID NO: 195859 - DNA, 21 bp, Mus musculus
tctgtatgagtattttgcctg

SEQ ID NO: 195860 - DNA, 22 bp, Mus musculus
tctgactctgtcttttttctca

SEQ ID NO: 195861 - DNA, 23 bp, Mus musculus
aatgcaggtgattttctagttgt

SEQ ID NO: 195862 - DNA, 19 bp, Mus musculus
aataagtacattcagctga

SEQ ID NO: 195863 - DNA, 23 bp, Mus musculus
gtgtgtctgtgtatgtatatgtg

SEQ ID NO: 195864 - DNA, 20 bp, Mus musculus
tatcatgtgaaggtgctcac

SEQ ID NO: 195865 - DNA, 22 bp, Mus musculus
tgacaagacagacattaggctt

SEQ ID NO: 195866 - DNA, 23 bp, Mus musculus
aaagtcagaattcacagagcaga

SEQ ID NO: 195867 - DNA, 23 bp, Mus musculus
ctgtcacagtcagccttcattgt

SEQ ID NO: 195868 - DNA, 22 bp, Mus musculus
agactgtgtccatgtgtctgtg

SEQ ID NO: 195869 - DNA, 23 bp, Mus musculus
tcaggcagggtctctcactgggt

SEQ ID NO: 195870 - DNA, 22 bp, Mus musculus
atcagagaggcaaagggagagc

SEQ ID NO: 195871 - DNA, 23 bp, Mus musculus
acggtgtcaccctctgactgaca

SEQ ID NO: 195872 - DNA, 23 bp, Mus musculus
atatatatgtgtgtgcatatata

SEQ ID NO: 195873 - DNA, 22 bp, Mus musculus
tgaagtaggttctaaggacctc

SEQ ID NO: 195874 - DNA, 23 bp, Mus musculus
aactgcaccacaaacttgcctac

SEQ ID NO: 195875 - DNA, 23 bp, Mus musculus
actgtctgcctgcctggctgcca

SEQ ID NO: 195876 - DNA, 23 bp, Mus musculus
aggctctcactgtgatctgcagg

SEQ ID NO: 195877 - DNA, 23 bp, Mus musculus
catctcagatgttgttcccatag

SEQ ID NO: 195878 - DNA, 20 bp, Mus musculus
ctctactttcttctaagagt

SEQ ID NO: 195879 - DNA, 23 bp, Mus musculus
ttgtaatactacctcctgagatg

SEQ ID NO: 195880 - DNA, 21 bp, Mus musculus
tccctgggtccctgtagccca

SEQ ID NO: 195881 - DNA, 23 bp, Mus musculus
tgacttgaccctactcggctgca

SEQ ID NO: 195882 - DNA, 22 bp, Mus musculus
tcaatatttttgtatctgttga

SEQ ID NO: 195883 - DNA, 22 bp, Mus musculus
tgaggttgtatgtatgtatgta

SEQ ID NO: 195884 - DNA, 23 bp, Mus musculus
aaggtactagatggggtggaaca

SEQ ID NO: 195885 - DNA, 23 bp, Mus musculus
taagagcactgactgctcttctg

SEQ ID NO: 195886 - DNA, 23 bp, Mus musculus
tgactcagaggttaagagcactg

SEQ ID NO: 195887 - DNA, 23 bp, Mus musculus
cagctgtctctgtctcagtccca

SEQ ID NO: 195888 - DNA, 23 bp, Mus musculus
tgtgcctgtgtgtgtgcctgtgt

SEQ ID NO: 195889 - DNA, 23 bp, Mus musculus
acatgttctgcaggagcagtgtc

SEQ ID NO: 195890 - DNA, 23 bp, Mus musculus
cactctcagactgtgcctttgat

SEQ ID NO: 195891 - DNA, 23 bp, Mus musculus
acacagctcacacagtcagcctg

SEQ ID NO: 195892 - DNA, 23 bp, Mus musculus
ctgtctgcctgtctctgcctgag

SEQ ID NO: 195893 - DNA, 18 bp, Mus musculus
gggtctcactctgtggct

SEQ ID NO: 195894 - DNA, 18 bp, Mus musculus
agagagctcagtgggcag

SEQ ID NO: 195895 - DNA, 23 bp, Mus musculus
aggtcacttcagttacactcagc

SEQ ID NO: 195896 - DNA, 21 bp, Mus musculus
ctgggctacaagaaaccgtgt

SEQ ID NO: 195897 - DNA, 23 bp, Mus musculus
tctgtctgcctgcctgtctgcct

SEQ ID NO: 195898 - DNA, 22 bp, Mus musculus
agttagttagttagaatgtgtg

SEQ ID NO: 195899 - DNA, 23 bp, Mus musculus
ctctgcctgtgagtgtgggtgtg

SEQ ID NO: 195900 - DNA, 23 bp, Mus musculus
atagaacacactgagctctcaga

SEQ ID NO: 195901 - DNA, 23 bp, Mus musculus
cagccactgtctctggctctggt

SEQ ID NO: 195902 - DNA, 23 bp, Mus musculus
atggagtcactcacagtgtcacg

SEQ ID NO: 195903 - DNA, 23 bp, Mus musculus
tggcatctggacgggtttgctac

SEQ ID NO: 195904 - DNA, 23 bp, Mus musculus
tctgcctgtgtgccaggctctct

SEQ ID NO: 195905 - DNA, 19 bp, Mus musculus
ccttgtctgtaaactgagg

SEQ ID NO: 195906 - DNA, 23 bp, Mus musculus
ctttctgtgtgtcactgtctgct

SEQ ID NO: 195907 - DNA, 23 bp, Mus musculus
tgactgactgactgagtgagtga

SEQ ID NO: 195908 - DNA, 21 bp, Mus musculus
tcactgggagttattgctcat

SEQ ID NO: 195909 - DNA, 21 bp, Mus musculus
agacagggtgggtgtctctct

SEQ ID NO: 195910 - DNA, 23 bp, Mus musculus
gagagctgacagtgtgcagacag

SEQ ID NO: 195911 - DNA, 23 bp, Mus musculus
tgacagagcagagtctcctgtgt

SEQ ID NO: 195912 - DNA, 23 bp, Mus musculus
ttctgtcttcctctctctgagta

SEQ ID NO: 195913 - DNA, 23 bp, Mus musculus
gctctcagaacaggaagagctga

SEQ ID NO: 195914 - DNA, 22 bp, Mus musculus
ctttgtctctgagtctcacctg

SEQ ID NO: 195915 - DNA, 22 bp, Mus musculus
ggctggctctgaagacagacat

SEQ ID NO: 195916 - DNA, 18 bp, Mus musculus
agccagcgtctaacctgg

SEQ ID NO: 195917 - DNA, 23 bp, Mus musculus
aatcatggatgtcccttggtgca

SEQ ID NO: 195918 - DNA, 20 bp, Mus musculus
agtgcctgtgtcaggccggg

SEQ ID NO: 195919 - DNA, 23 bp, Mus musculus
tcagatcagactgaggtcacagg

SEQ ID NO: 195920 - DNA, 22 bp, Mus musculus
ctctgacaccatttctctcata

SEQ ID NO: 195921 - DNA, 23 bp, Mus musculus
cttgcctgcctgtctgcctgact

SEQ ID NO: 195922 - DNA, 23 bp, Mus musculus
ttttgcatgtatgaatgtatgta

SEQ ID NO: 195923 - DNA, 20 bp, Mus musculus
cacttgcaatcactgtcttt

SEQ ID NO: 195924 - DNA, 18 bp, Mus musculus
agctcatcctcctttggt

SEQ ID NO: 195925 - DNA, 23 bp, Mus musculus
tactgtgagcatgatcagctagg

SEQ ID NO: 195926 - DNA, 22 bp, Mus musculus
tcagcatgctgtctgtgactac

SEQ ID NO: 195927 - DNA, 23 bp, Mus musculus
gaactcacagggagcattgatga

SEQ ID NO: 195928 - DNA, 18 bp, Mus musculus
gagagcaggtgcagctgg

SEQ ID NO: 195929 - DNA, 23 bp, Mus musculus
ctcagcctgtgactcagcctgcc

SEQ ID NO: 195930 - DNA, 20 bp, Mus musculus
agccagaggaagtctttgtc

SEQ ID NO: 195931 - DNA, 23 bp, Mus musculus
acacccactggctcatctgatcg

SEQ ID NO: 195932 - DNA, 21 bp, Mus musculus
tgggttgtttcaagttgatgg

SEQ ID NO: 195933 - DNA, 20 bp, Mus musculus
cagcctctgtctgtctccca

SEQ ID NO: 195934 - DNA, 23 bp, Mus musculus
atatctgtctctgactcagtgcc

SEQ ID NO: 195935 - DNA, 23 bp, Mus musculus
atatgtgtatatgtttgcatata

SEQ ID NO: 195936 - DNA, 22 bp, Mus musculus
tatgtgtgtatatatttgtatg

SEQ ID NO: 195937 - DNA, 23 bp, Mus musculus
tcagtcagtctgtcattcttgag

SEQ ID NO: 195938 - DNA, 23 bp, Mus musculus
ttgtgcctcttcaggctggctga

SEQ ID NO: 195939 - DNA, 22 bp, Mus musculus
tgagaatagacctttagcctga

SEQ ID NO: 195940 - DNA, 22 bp, Mus musculus
agtcacaatctcagctgggtgt

SEQ ID NO: 195941 - DNA, 23 bp, Mus musculus
gagtgtgtccttggtctttgtgt

SEQ ID NO: 195942 - DNA, 19 bp, Mus musculus
tgagtcacaggtttcaggt

SEQ ID NO: 195943 - DNA, 20 bp, Mus musculus
tgtgagaagatactctgcag

SEQ ID NO: 195944 - DNA, 21 bp, Mus musculus
ttcacaatgagtattggtttc

SEQ ID NO: 195945 - DNA, 23 bp, Mus musculus
ataggaatgtttagaattctctg

SEQ ID NO: 195946 - DNA, 21 bp, Mus musculus
aaatgagcaggttcattctac

SEQ ID NO: 195947 - DNA, 23 bp, Mus musculus
tacattcattgctgtagtatgca

SEQ ID NO: 195948 - DNA, 21 bp, Mus musculus
ttcttcatcctcacggtgtct

SEQ ID NO: 195949 - DNA, 23 bp, Mus musculus
tctcgctctcactccttcacctg

SEQ ID NO: 195950 - DNA, 23 bp, Mus musculus
tggctatgagaatctttatcttt

SEQ ID NO: 195951 - DNA, 22 bp, Mus musculus
ttaagagcactgactgctcttc

SEQ ID NO: 195952 - DNA, 22 bp, Mus musculus
tgccatacacttccatatcaca

SEQ ID NO: 195953 - DNA, 23 bp, Mus musculus
tgtctcacagacaaggcctctca

SEQ ID NO: 195954 - DNA, 23 bp, Mus musculus
agaagagagccagcaatacatga

SEQ ID NO: 195955 - DNA, 18 bp, Mus musculus
agaactgtctataacttc

SEQ ID NO: 195956 - DNA, 23 bp, Mus musculus
gccctcactctctcactctgccg

SEQ ID NO: 195957 - DNA, 23 bp, Mus musculus
ctgtgcgtgtgacagcggctgat

SEQ ID NO: 195958 - DNA, 23 bp, Mus musculus
ttagtttgaatttgaaatgacag

SEQ ID NO: 195959 - DNA, 23 bp, Mus musculus
cccactgtctgtgtgtctcccag

SEQ ID NO: 195960 - DNA, 21 bp, Mus musculus
tatgtatgcatgtatgtgcat

SEQ ID NO: 195961 - DNA, 23 bp, Mus musculus
tgtgcatgtatgtatgcatgtat

SEQ ID NO: 195962 - DNA, 23 bp, Mus musculus
ctcctctctgtgtgtcacatgcc

SEQ ID NO: 195963 - DNA, 23 bp, Mus musculus
cggtcagtgtccctcagtgactc

SEQ ID NO: 195964 - DNA, 21 bp, Mus musculus
tcatgagggaaattgatctga

SEQ ID NO: 195965 - DNA, 23 bp, Mus musculus
gaatgaattaggtagtgttcctt

SEQ ID NO: 195966 - DNA, 18 bp, Mus musculus
tatgcatatactgcatgt

SEQ ID NO: 195967 - DNA, 23 bp, Mus musculus
cactgttactctgactatctggg

SEQ ID NO: 195968 - DNA, 23 bp, Mus musculus
ctctctgactcattgtcttacct

SEQ ID NO: 195969 - DNA, 23 bp, Mus musculus
tgcacttggtagatcctgagtag

SEQ ID NO: 195970 - DNA, 22 bp, Mus musculus
tgttttgtgaccaattatatgg

SEQ ID NO: 195971 - DNA, 22 bp, Mus musculus
aagctctgtgtgtgtgtgtgac

SEQ ID NO: 195972 - DNA, 21 bp, Mus musculus
tctgtctctcaaacataagtc

SEQ ID NO: 195973 - DNA, 23 bp, Mus musculus
acagtgactctgtccctccctca

SEQ ID NO: 195974 - DNA, 20 bp, Mus musculus
tgacagggagaaactctgat

SEQ ID NO: 195975 - DNA, 22 bp, Mus musculus
gccaagctgagtggaatgctga

SEQ ID NO: 195976 - DNA, 23 bp, Mus musculus
tctgtctgtctctcagttttagg

SEQ ID NO: 195977 - DNA, 23 bp, Mus musculus
tgtccctgtctctggctctgtca

SEQ ID NO: 195978 - DNA, 21 bp, Mus musculus
tctcgctggctgttccttttt

SEQ ID NO: 195979 - DNA, 22 bp, Mus musculus
agaggtatagcgcatgggaaga

SEQ ID NO: 195980 - DNA, 23 bp, Mus musculus
ctgtgtgtctgtctgtccctgcc

SEQ ID NO: 195981 - DNA, 23 bp, Mus musculus
gcctgtctgtctgtctgtctctg

SEQ ID NO: 195982 - DNA, 23 bp, Mus musculus
tagagctgtcatctgtgtgagtc

SEQ ID NO: 195983 - DNA, 23 bp, Mus musculus
tctgcctctgcctctgcctctct

SEQ ID NO: 195984 - DNA, 23 bp, Mus musculus
acagaaatgacagaggacagagg

SEQ ID NO: 195985 - DNA, 21 bp, Mus musculus
agtctgtgtacgcagcagcaa

SEQ ID NO: 195986 - DNA, 22 bp, Mus musculus
tcacagtacaaagtgtggactt

SEQ ID NO: 195987 - DNA, 21 bp, Mus musculus
tatatgtgtgtgtgtgtatcc

SEQ ID NO: 195988 - DNA, 18 bp, Mus musculus
tctcaggctgtctgtgag

SEQ ID NO: 195989 - DNA, 18 bp, Mus musculus
tcagaagagtctagagtc

SEQ ID NO: 195990 - DNA, 23 bp, Mus musculus
cctctctcttgctctcagtgtcc

SEQ ID NO: 195991 - DNA, 22 bp, Mus musculus
ttgtgtacagcaacaatccact

SEQ ID NO: 195992 - DNA, 23 bp, Mus musculus
ttttgtgtatatggtcatgtttg

SEQ ID NO: 195993 - DNA, 23 bp, Mus musculus
acatgtctgtgtgtatatgtgca

SEQ ID NO: 195994 - DNA, 23 bp, Mus musculus
actcagcagactctcactatgtc

SEQ ID NO: 195995 - DNA, 21 bp, Mus musculus
tctgtctctatgagtctggct

SEQ ID NO: 195996 - DNA, 18 bp, Mus musculus
accaaggcttagtagaga

SEQ ID NO: 195997 - DNA, 23 bp, Mus musculus
tatctgtctgactctgtgcctgg

SEQ ID NO: 195998 - DNA, 21 bp, Mus musculus
agcggctagagtgatggtatc

SEQ ID NO: 195999 - DNA, 22 bp, Mus musculus
taccactctcctttacatgaca

SEQ ID NO: 196000 - DNA, 22 bp, Mus musculus
aagacagtctgcaaacatggcc

SEQ ID NO: 196001 - DNA, 23 bp, Mus musculus
gctcagtcagtcactctatcagg

SEQ ID NO: 196002 - DNA, 19 bp, Mus musculus
aggagcacgtcacacagga

SEQ ID NO: 196003 - DNA, 20 bp, Mus musculus
atgagtgtacatgtttatat

SEQ ID NO: 196004 - DNA, 19 bp, Mus musculus
tatgtgtgtgtatgatatg

SEQ ID NO: 196005 - DNA, 22 bp, Mus musculus
atatatgtaagcatgtgtgtgc

SEQ ID NO: 196006 - DNA, 23 bp, Mus musculus
ggcagagtcgatattaagtcaat

SEQ ID NO: 196007 - DNA, 23 bp, Mus musculus
tgagcctctgtctctccatcagt

SEQ ID NO: 196008 - DNA, 23 bp, Mus musculus
cttgctggattagaaatctttct

SEQ ID NO: 196009 - DNA, 23 bp, Mus musculus
tcactgggacagaatgtggattc

SEQ ID NO: 196010 - DNA, 19 bp, Mus musculus
actgtgttcctctaacttc

SEQ ID NO: 196011 - DNA, 18 bp, Mus musculus
tgggtgggaatgatcagt

SEQ ID NO: 196012 - DNA, 23 bp, Mus musculus
gagatagaccacaagtgtgggcc

SEQ ID NO: 196013 - DNA, 23 bp, Mus musculus
tctgagacctctctgtgtgtctg

SEQ ID NO: 196014 - DNA, 21 bp, Mus musculus
cactgactgctcttccagagg

SEQ ID NO: 196015 - DNA, 23 bp, Mus musculus
agtcagaagaaagactgcacttt

SEQ ID NO: 196016 - DNA, 23 bp, Mus musculus
agtgtggtagtagtttgaatagt

SEQ ID NO: 196017 - DNA, 19 bp, Mus musculus
aaaggcaggcttggtggct

SEQ ID NO: 196018 - DNA, 23 bp, Mus musculus
acagcacagagggagcttgacca

SEQ ID NO: 196019 - DNA, 22 bp, Mus musculus
tcactggtctacacatctgtct

SEQ ID NO: 196020 - DNA, 23 bp, Mus musculus
gacttactctgtgtttgtgtgtc

SEQ ID NO: 196021 - DNA, 23 bp, Mus musculus
taagaccactgactgctcttcca

SEQ ID NO: 196022 - DNA, 23 bp, Mus musculus
accactcagaggacagagtggac

SEQ ID NO: 196023 - DNA, 23 bp, Mus musculus
tgcctggctgcctctatgtgtgc

SEQ ID NO: 196024 - DNA, 23 bp, Mus musculus
atgaacaacatggggctctgagt

SEQ ID NO: 196025 - DNA, 22 bp, Mus musculus
gtttacagatgagagagagcac

SEQ ID NO: 196026 - DNA, 23 bp, Mus musculus
catctctctgagcctgccactca

SEQ ID NO: 196027 - DNA, 22 bp, Mus musculus
aggggtgtacttgcctctgtgt

SEQ ID NO: 196028 - DNA, 23 bp, Mus musculus
cacatgtgtatgtgtatatgtgt

SEQ ID NO: 196029 - DNA, 21 bp, Mus musculus
cagactctctgagtcccaggc

SEQ ID NO: 196030 - DNA, 20 bp, Mus musculus
tgtgtatatgcctgtgcatg

SEQ ID NO: 196031 - DNA, 23 bp, Mus musculus
tgtatgtgtgcatatgttttgat

SEQ ID NO: 196032 - DNA, 23 bp, Mus musculus
ttgtgtctttgttcttcactttg

SEQ ID NO: 196033 - DNA, 23 bp, Mus musculus
caccacaaggtagactgtgagct

SEQ ID NO: 196034 - DNA, 20 bp, Mus musculus
tcacagcactgagtgtggac

SEQ ID NO: 196035 - DNA, 23 bp, Mus musculus
tttcacagtcagcattcacttgc

SEQ ID NO: 196036 - DNA, 19 bp, Mus musculus
attctaaaccagtttggag

SEQ ID NO: 196037 - DNA, 21 bp, Mus musculus
cacactgaagtgagagcgctc

SEQ ID NO: 196038 - DNA, 20 bp, Mus musculus
ttgccactgaattgcgcact

SEQ ID NO: 196039 - DNA, 23 bp, Mus musculus
ctgagtctctgtcagtttgtatg

SEQ ID NO: 196040 - DNA, 19 bp, Mus musculus
tgtgtgaaactctctctta

SEQ ID NO: 196041 - DNA, 20 bp, Mus musculus
agtcatcacataggcaattc

SEQ ID NO: 196042 - DNA, 20 bp, Mus musculus
taactccctccatgttaagg

SEQ ID NO: 196043 - DNA, 18 bp, Mus musculus
tttaaaactgctgccagt

SEQ ID NO: 196044 - DNA, 21 bp, Mus musculus
ttttaaagaaattctgtacta

SEQ ID NO: 196045 - DNA, 23 bp, Mus musculus
gaggtcagagagtaacttgtgga

SEQ ID NO: 196046 - DNA, 19 bp, Mus musculus
tgggaggctccctgtatcc

SEQ ID NO: 196047 - DNA, 23 bp, Mus musculus
tcagtctgtctcagctttggttg

SEQ ID NO: 196048 - DNA, 23 bp, Mus musculus
aaatctatctgtataggtttttc

SEQ ID NO: 196049 - DNA, 23 bp, Mus musculus
atgaatagtctttatcttgttga

SEQ ID NO: 196050 - DNA, 23 bp, Mus musculus
ctctctctgtggatgtggatatg

SEQ ID NO: 196051 - DNA, 23 bp, Mus musculus
cctctctgcctgtgtggctcagt

SEQ ID NO: 196052 - DNA, 23 bp, Mus musculus
tctcactctctgaacattgtcca

SEQ ID NO: 196053 - DNA, 23 bp, Mus musculus
cactgtctcagtctctgcacctg

SEQ ID NO: 196054 - DNA, 23 bp, Mus musculus
tacagagagttgtgagagagctg

SEQ ID NO: 196055 - DNA, 21 bp, Mus musculus
aggcacagagccagcagtgag

SEQ ID NO: 196056 - DNA, 23 bp, Mus musculus
ctcagtctctgtgagtgagttca

SEQ ID NO: 196057 - DNA, 19 bp, Mus musculus
tcggtgttcacataggctc

SEQ ID NO: 196058 - DNA, 23 bp, Mus musculus
cagagatctctctctctctctga

SEQ ID NO: 196059 - DNA, 20 bp, Mus musculus
tcctgtcatgagttcctgcc

SEQ ID NO: 196060 - DNA, 23 bp, Mus musculus
atatgtgtatatatatgtgtgtg

SEQ ID NO: 196061 - DNA, 22 bp, Mus musculus
tgttttgtgaccaattatatgg

SEQ ID NO: 196062 - DNA, 22 bp, Mus musculus
acagagtcctagtgctgtgtct

SEQ ID NO: 196063 - DNA, 21 bp, Mus musculus
tgctcagcgctttgttgctgt

SEQ ID NO: 196064 - DNA, 23 bp, Mus musculus
atacatgtgtatgtatatatgta

SEQ ID NO: 196065 - DNA, 22 bp, Mus musculus
tgttttgtgaccaattatatgg

SEQ ID NO: 196066 - DNA, 19 bp, Mus musculus
cactttagaatcagtgatg

SEQ ID NO: 196067 - DNA, 23 bp, Mus musculus
catcactctgaaacctgtagtgt

SEQ ID NO: 196068 - DNA, 23 bp, Mus musculus
tgtgggaccctgagtgtctctgt

SEQ ID NO: 196069 - DNA, 23 bp, Mus musculus
ccataactgtgtctccatgtact

SEQ ID NO: 196070 - DNA, 23 bp, Mus musculus
ttacagactagagactggctcat

SEQ ID NO: 196071 - DNA, 22 bp, Mus musculus
tcagttctgtgtgagcacagag

SEQ ID NO: 196072 - DNA, 23 bp, Mus musculus
atgtctctgctcacagacctgat

SEQ ID NO: 196073 - DNA, 21 bp, Mus musculus
ggctctgtccgtctgtctgtc

SEQ ID NO: 196074 - DNA, 23 bp, Mus musculus
ctgtctgtctgtctgtctatttg

SEQ ID NO: 196075 - DNA, 21 bp, Mus musculus
tccctgcctcccagaatacct

SEQ ID NO: 196076 - DNA, 20 bp, Mus musculus
ttcaatggactcagtgccca

SEQ ID NO: 196077 - DNA, 23 bp, Mus musculus
gtagtgcatgtatgcatgtgtat

SEQ ID NO: 196078 - DNA, 23 bp, Mus musculus
atgtgcacatgtatgtttgttca

SEQ ID NO: 196079 - DNA, 21 bp, Mus musculus
gtctctctggcatagttctac

SEQ ID NO: 196080 - DNA, 22 bp, Mus musculus
agagtagatggtcagaaactta

SEQ ID NO: 196081 - DNA, 18 bp, Mus musculus
caaaagcagtgtctgctg

SEQ ID NO: 196082 - DNA, 23 bp, Mus musculus
gcacagtctgcagtgtatcactc

SEQ ID NO: 196083 - DNA, 23 bp, Mus musculus
tattcaggtgtgtgtgtgtgtgt

SEQ ID NO: 196084 - DNA, 23 bp, Mus musculus
ttacagtagtgactgtgcagtgt

SEQ ID NO: 196085 - DNA, 20 bp, Mus musculus
ttgtgcatatgtatatgtgt

SEQ ID NO: 196086 - DNA, 23 bp, Mus musculus
atatgtatgtgtgcatgtgtaag

SEQ ID NO: 196087 - DNA, 21 bp, Mus musculus
tctctgtgtctcatatccacc

SEQ ID NO: 196088 - DNA, 22 bp, Mus musculus
tctgtctgtctgcctgtctgtc

SEQ ID NO: 196089 - DNA, 22 bp, Mus musculus
tctggtggcttttggtgctctt

SEQ ID NO: 196090 - DNA, 23 bp, Mus musculus
taactcactccctctctcttggg

SEQ ID NO: 196091 - DNA, 22 bp, Mus musculus
tctggtactaggttcaagtgtt

SEQ ID NO: 196092 - DNA, 20 bp, Mus musculus
tttgagtctctggcttctag

SEQ ID NO: 196093 - DNA, 22 bp, Mus musculus
tctctttctgattttcattctg

SEQ ID NO: 196094 - DNA, 23 bp, Mus musculus
tatgtgcatgtgtgtatatgtgt

SEQ ID NO: 196095 - DNA, 22 bp, Mus musculus
tcaggagttcattggattaatg

SEQ ID NO: 196096 - DNA, 23 bp, Mus musculus
tgtccctgtctgtgtgtctctcc

SEQ ID NO: 196097 - DNA, 23 bp, Mus musculus
tgtgtccctctctgcctgtttcc

SEQ ID NO: 196098 - DNA, 20 bp, Mus musculus
tctgagagtctctctgtggc

SEQ ID NO: 196099 - DNA, 19 bp, Mus musculus
gccagaggatgaggaggag

SEQ ID NO: 196100 - DNA, 23 bp, Mus musculus
gtcctcagagactctgtgcctga

SEQ ID NO: 196101 - DNA, 22 bp, Mus musculus
gctctctgtcaccctctgtgga

SEQ ID NO: 196102 - DNA, 19 bp, Mus musculus
aagaatagatggcagctgt

SEQ ID NO: 196103 - DNA, 23 bp, Mus musculus
actttgtcttgagtttatgttgt

SEQ ID NO: 196104 - DNA, 19 bp, Mus musculus
tgaggatgaacgttttctt

SEQ ID NO: 196105 - DNA, 23 bp, Mus musculus
acagtggcagagatggaggttat

SEQ ID NO: 196106 - DNA, 20 bp, Mus musculus
tcacagaaggcagagagctc

SEQ ID NO: 196107 - DNA, 23 bp, Mus musculus
atatatgtatatatgtatgtgtg

SEQ ID NO: 196108 - DNA, 22 bp, Mus musculus
tccatgatgatctgataggatg

SEQ ID NO: 196109 - DNA, 21 bp, Mus musculus
tgttttgtgaccaattatatg

SEQ ID NO: 196110 - DNA, 23 bp, Mus musculus
catgtctgtgtctgtgtgtcagt

SEQ ID NO: 196111 - DNA, 23 bp, Mus musculus
agtgagcagactgcgtgtacaga

SEQ ID NO: 196112 - DNA, 23 bp, Mus musculus
agcaaagtattgtagactgagtg

SEQ ID NO: 196113 - DNA, 21 bp, Mus musculus
tgtgctcagtgtgtgtctgtg

SEQ ID NO: 196114 - DNA, 23 bp, Mus musculus
cggtgaagacagagaggacaaca

SEQ ID NO: 196115 - DNA, 19 bp, Mus musculus
tgcacgtgtgcatgtgcgt

SEQ ID NO: 196116 - DNA, 23 bp, Mus musculus
acacttgtgcatgcgtatctatg

SEQ ID NO: 196117 - DNA, 23 bp, Mus musculus
ggaggctagagagatggttcagt

SEQ ID NO: 196118 - DNA, 19 bp, Mus musculus
caagtctgagcttcttgag

SEQ ID NO: 196119 - DNA, 22 bp, Mus musculus
tgagctggtagtttctaaggct

SEQ ID NO: 196120 - DNA, 23 bp, Mus musculus
gcaagtcagaatagagtcaccac

SEQ ID NO: 196121 - DNA, 23 bp, Mus musculus
aagccactgtctgcctgtctccc

SEQ ID NO: 196122 - DNA, 19 bp, Mus musculus
tacagcagtcagtcttcct

SEQ ID NO: 196123 - DNA, 21 bp, Mus musculus
atgtatgtgtgtatgtgcatg

SEQ ID NO: 196124 - DNA, 20 bp, Mus musculus
tatgcatgtgtgtatgtatg

SEQ ID NO: 196125 - DNA, 23 bp, Mus musculus
ttagagagaagagactgactact

SEQ ID NO: 196126 - DNA, 22 bp, Mus musculus
tattccaggctggctttgatgt

SEQ ID NO: 196127 - DNA, 23 bp, Mus musculus
cactggctcactgactggctcac

SEQ ID NO: 196128 - DNA, 23 bp, Mus musculus
aggctctctctgtgtgtttggag

SEQ ID NO: 196129 - DNA, 19 bp, Mus musculus
aagaactggctttagggtc

SEQ ID NO: 196130 - DNA, 23 bp, Mus musculus
ctgtctgtctgtctgtccatctg

SEQ ID NO: 196131 - DNA, 19 bp, Mus musculus
acagcagagactgtggtgt

SEQ ID NO: 196132 - DNA, 19 bp, Mus musculus
ttcatctccgttttgttct

SEQ ID NO: 196133 - DNA, 21 bp, Mus musculus
tgagacttgagactgtggact

SEQ ID NO: 196134 - DNA, 21 bp, Mus musculus
agaggaccatacagactccat

SEQ ID NO: 196135 - DNA, 23 bp, Mus musculus
cagagcctagaagagagcatcca

SEQ ID NO: 196136 - DNA, 23 bp, Mus musculus
aagttgtagacagttgtgagcca

SEQ ID NO: 196137 - DNA, 23 bp, Mus musculus
agaatagtttttgttatcctagg

SEQ ID NO: 196138 - DNA, 23 bp, Mus musculus
ttctaactcagtgaagacttgag

SEQ ID NO: 196139 - DNA, 18 bp, Mus musculus
tttgaaaaaggagtctag

SEQ ID NO: 196140 - DNA, 23 bp, Mus musculus
agcactgactgctcttccagagg

SEQ ID NO: 196141 - DNA, 20 bp, Mus musculus
tggctcagtggttaggagca

SEQ ID NO: 196142 - DNA, 23 bp, Mus musculus
tcaattctcaacatggtggctca

SEQ ID NO: 196143 - DNA, 22 bp, Mus musculus
tgtgttgagcacagttctaagg

SEQ ID NO: 196144 - DNA, 23 bp, Mus musculus
acacacagagtctctgctgacag

SEQ ID NO: 196145 - DNA, 23 bp, Mus musculus
tctgactgcctcaggtactgtac

SEQ ID NO: 196146 - DNA, 23 bp, Mus musculus
tttgtgtgtctgggtatgtgcat

SEQ ID NO: 196147 - DNA, 23 bp, Mus musculus
ttgtctagactagctgttgagca

SEQ ID NO: 196148 - DNA, 23 bp, Mus musculus
tcagcctctctgtctgtctctag

SEQ ID NO: 196149 - DNA, 21 bp, Mus musculus
ttcaattcacagcaaccacat

SEQ ID NO: 196150 - DNA, 18 bp, Mus musculus
ctagaattaactctgtag

SEQ ID NO: 196151 - DNA, 23 bp, Mus musculus
atggtgactcacaaccatctgta

SEQ ID NO: 196152 - DNA, 23 bp, Mus musculus
ttgagagccagcttttgttgtgt

SEQ ID NO: 196153 - DNA, 21 bp, Mus musculus
acagtctgtaactctctgata

SEQ ID NO: 196154 - DNA, 22 bp, Mus musculus
tatgtatgtatgtatatatgta

SEQ ID NO: 196155 - DNA, 23 bp, Mus musculus
aaatcacagcaaccacatggtgg

SEQ ID NO: 196156 - DNA, 22 bp, Mus musculus
ttcaattcctagaaaccacatg

SEQ ID NO: 196157 - DNA, 23 bp, Mus musculus
ctgtgtatgtggggtgtctatat

SEQ ID NO: 196158 - DNA, 22 bp, Mus musculus
gatcctgatgatggttgtgagt

SEQ ID NO: 196159 - DNA, 23 bp, Mus musculus
ggacggtgtgtgtgtgtgtgggg

SEQ ID NO: 196160 - DNA, 18 bp, Mus musculus
tttgacttctgtctgagg

SEQ ID NO: 196161 - DNA, 23 bp, Mus musculus
atctctctctctatctctgctat

SEQ ID NO: 196162 - DNA, 20 bp, Mus musculus
tatcagctcctggatgtgag

SEQ ID NO: 196163 - DNA, 23 bp, Mus musculus
tgtgtgtgtgtgtcatgagtgtg

SEQ ID NO: 196164 - DNA, 19 bp, Mus musculus
ttacacactgaggtaaggt

SEQ ID NO: 196165 - DNA, 22 bp, Mus musculus
gacagtcagaagagagtgccct

SEQ ID NO: 196166 - DNA, 23 bp, Mus musculus
gaggtatagtagatccgaagcac

SEQ ID NO: 196167 - DNA, 23 bp, Mus musculus
catcttgtgactctcactgcctc

SEQ ID NO: 196168 - DNA, 23 bp, Mus musculus
tctctggcactctcaggcagtgg

SEQ ID NO: 196169 - DNA, 21 bp, Mus musculus
tgtatacatatatgtgtgtgt

SEQ ID NO: 196170 - DNA, 23 bp, Mus musculus
tgtgtctgtgtgagtgagtgcca

SEQ ID NO: 196171 - DNA, 23 bp, Mus musculus
agaactaggcaaactctctgcct

SEQ ID NO: 196172 - DNA, 19 bp, Mus musculus
ggagagctgtctcagcagt

SEQ ID NO: 196173 - DNA, 21 bp, Mus musculus
agccagtgaatttacctgaga

SEQ ID NO: 196174 - DNA, 23 bp, Mus musculus
gtgtacagcttgctctccagtgt

SEQ ID NO: 196175 - DNA, 19 bp, Mus musculus
tgtgtgtgtgcgtgggcga

SEQ ID NO: 196176 - DNA, 21 bp, Mus musculus
aaagtggtagtgatagttttc

SEQ ID NO: 196177 - DNA, 23 bp, Mus musculus
ttttctgtgcttgtcatttgttc

SEQ ID NO: 196178 - DNA, 23 bp, Mus musculus
ctgtgcctgtgtggttagcaggg

SEQ ID NO: 196179 - DNA, 18 bp, Mus musculus
tggctctgatggtgctgg

SEQ ID NO: 196180 - DNA, 21 bp, Mus musculus
agactggagagatggctcagt

SEQ ID NO: 196181 - DNA, 23 bp, Mus musculus
tctgcatatgtatgtatttctgt

SEQ ID NO: 196182 - DNA, 23 bp, Mus musculus
cagtctgtgtcttctgtatctgt

SEQ ID NO: 196183 - DNA, 23 bp, Mus musculus
tgtgtgtgtgcttctgcatgtgt

SEQ ID NO: 196184 - DNA, 23 bp, Mus musculus
attcttacccttggctgacttca

SEQ ID NO: 196185 - DNA, 23 bp, Mus musculus
cagacccactgtcagagttcatt

SEQ ID NO: 196186 - DNA, 22 bp, Mus musculus
ccctcagtcctgtagctgagcg

SEQ ID NO: 196187 - DNA, 20 bp, Mus musculus
tgagcactggatctgcagac

SEQ ID NO: 196188 - DNA, 21 bp, Mus musculus
cacagtactcacagagcacct

SEQ ID NO: 196189 - DNA, 18 bp, Mus musculus
tatgtatatgtatatatc

SEQ ID NO: 196190 - DNA, 21 bp, Mus musculus
tttacttctctcaggctctca

SEQ ID NO: 196191 - DNA, 23 bp, Mus musculus
tcatagtctctggaaaagatggt

SEQ ID NO: 196192 - DNA, 23 bp, Mus musculus
tctgtctccctgtgagacttgct

SEQ ID NO: 196193 - DNA, 22 bp, Mus musculus
ctcactgagccatcttcccagc

SEQ ID NO: 196194 - DNA, 23 bp, Mus musculus
tgtgcttgcatgtacatgtgtat

SEQ ID NO: 196195 - DNA, 21 bp, Mus musculus
tgtgtgcatgtaattgtgtgt

SEQ ID NO: 196196 - DNA, 22 bp, Mus musculus
tatatgcatgtgtattgtgttt

SEQ ID NO: 196197 - DNA, 20 bp, Mus musculus
cactgtttttttctgtattc

SEQ ID NO: 196198 - DNA, 21 bp, Mus musculus
tacaagagagaagtcagaagg

SEQ ID NO: 196199 - DNA, 21 bp, Mus musculus
tgtatgtatgtatatatagga

SEQ ID NO: 196200 - DNA, 22 bp, Mus musculus
tgttttgtgaccaattatatgg

SEQ ID NO: 196201 - DNA, 23 bp, Mus musculus
attctggcagctaaagaaaagtg

SEQ ID NO: 196202 - DNA, 20 bp, Mus musculus
gcagacagactctggctctg

SEQ ID NO: 196203 - DNA, 19 bp, Mus musculus
gagagtgaagaattctctt

SEQ ID NO: 196204 - DNA, 22 bp, Mus musculus
tgtatgtgagcatctgcatgtg

SEQ ID NO: 196205 - DNA, 23 bp, Mus musculus
acaaatgttatagttgtattgtc

SEQ ID NO: 196206 - DNA, 21 bp, Mus musculus
cagatgacattcaggtgtcac

SEQ ID NO: 196207 - DNA, 18 bp, Mus musculus
ctttgtggtaccacttgt

SEQ ID NO: 196208 - DNA, 23 bp, Mus musculus
acagtggcagaaagtgatagatc

SEQ ID NO: 196209 - DNA, 23 bp, Mus musculus
tcgctcgtgatgcagttctggtc

SEQ ID NO: 196210 - DNA, 22 bp, Mus musculus
aagcagcatgtgcagcaggaga

SEQ ID NO: 196211 - DNA, 18 bp, Mus musculus
tagcatgtgaagctgttt

SEQ ID NO: 196212 - DNA, 18 bp, Mus musculus
ctacatgtaactgtgtct

SEQ ID NO: 196213 - DNA, 23 bp, Mus musculus
atgtctgacccacacaaagagct

SEQ ID NO: 196214 - DNA, 19 bp, Mus musculus
cactctcactctaagtcag

SEQ ID NO: 196215 - DNA, 23 bp, Mus musculus
attcccagggtctgtgtgtgact

SEQ ID NO: 196216 - DNA, 23 bp, Mus musculus
ctgtgggtgtgactggctgcgtg

SEQ ID NO: 196217 - DNA, 23 bp, Mus musculus
ttcatttacacttggaatgttga

SEQ ID NO: 196218 - DNA, 23 bp, Mus musculus
ttcaaggttctcactgtgaaacg

SEQ ID NO: 196219 - DNA, 22 bp, Mus musculus
acctttactgaagagaaagaga

SEQ ID NO: 196220 - DNA, 19 bp, Mus musculus
atgtaagaggatagtttgt

SEQ ID NO: 196221 - DNA, 20 bp, Mus musculus
tttgagacagggtctcatgt

SEQ ID NO: 196222 - DNA, 23 bp, Mus musculus
atgtatgtgtgcatgtgtatgtg

SEQ ID NO: 196223 - DNA, 20 bp, Mus musculus
aatatgcaggtacagtgtgg

SEQ ID NO: 196224 - DNA, 23 bp, Mus musculus
tgaaatgtaatgtagaatcaggg

SEQ ID NO: 196225 - DNA, 23 bp, Mus musculus
agagtgaccatgtggttccagga

SEQ ID NO: 196226 - DNA, 23 bp, Mus musculus
agagactcgttgtcattcagtgg

SEQ ID NO: 196227 - DNA, 23 bp, Mus musculus
acagatgcctttggtatgatagc

SEQ ID NO: 196228 - DNA, 23 bp, Mus musculus
tctaacagcatcttcatctgtga

SEQ ID NO: 196229 - DNA, 19 bp, Mus musculus
tgtctgtctcctcaggagc

SEQ ID NO: 196230 - DNA, 22 bp, Mus musculus
tcttatcaactttgattggctc

SEQ ID NO: 196231 - DNA, 18 bp, Mus musculus
agtgtagagacatgcata

SEQ ID NO: 196232 - DNA, 23 bp, Mus musculus
gctgtctcactgtgtctcactgt

SEQ ID NO: 196233 - DNA, 21 bp, Mus musculus
gaagtacttgctctctttgta

SEQ ID NO: 196234 - DNA, 22 bp, Mus musculus
agacactctgtcttactagctt

SEQ ID NO: 196235 - DNA, 23 bp, Mus musculus
tatctgcctgactgcctgcctct

SEQ ID NO: 196236 - DNA, 21 bp, Mus musculus
acactcacactctatgtccag

SEQ ID NO: 196237 - DNA, 21 bp, Mus musculus
tgtgagctgtctgagctgtag

SEQ ID NO: 196238 - DNA, 23 bp, Mus musculus
tcatcatcgtcactgtctgtgtc

SEQ ID NO: 196239 - DNA, 20 bp, Mus musculus
atttagagtggtaggaaggt

SEQ ID NO: 196240 - DNA, 19 bp, Mus musculus
ttcagtgtcttaaagtttt

SEQ ID NO: 196241 - DNA, 23 bp, Mus musculus
gtaggtgcttgtggagctggacc

SEQ ID NO: 196242 - DNA, 22 bp, Mus musculus
atatagcagaatatcattagga

SEQ ID NO: 196243 - DNA, 22 bp, Mus musculus
attgactggcatgtttggttct

SEQ ID NO: 196244 - DNA, 21 bp, Mus musculus
gtcactcagtcgctctgcttt

SEQ ID NO: 196245 - DNA, 23 bp, Mus musculus
tcctacaggagacattttcttgt

SEQ ID NO: 196246 - DNA, 21 bp, Mus musculus
agtcagtgtctcagatctagc

SEQ ID NO: 196247 - DNA, 22 bp, Mus musculus
attttctctgtgacaattcacc

SEQ ID NO: 196248 - DNA, 22 bp, Mus musculus
aaagagagagggaaagttcact

SEQ ID NO: 196249 - DNA, 23 bp, Mus musculus
ctcagtgcaagtattttggtgga

SEQ ID NO: 196250 - DNA, 23 bp, Mus musculus
agaactgactgctcttccagagg

SEQ ID NO: 196251 - DNA, 19 bp, Mus musculus
tgagcaaagatgaaggtca

SEQ ID NO: 196252 - DNA, 23 bp, Mus musculus
aaaacactgaatatagagagcag

SEQ ID NO: 196253 - DNA, 18 bp, Mus musculus
cagaggtctttagttcaa

SEQ ID NO: 196254 - DNA, 23 bp, Mus musculus
tttggtggtgaatatggttaaca

SEQ ID NO: 196255 - DNA, 23 bp, Mus musculus
tgtggtcagaacagagtcagcac

SEQ ID NO: 196256 - DNA, 20 bp, Mus musculus
tcagtgcatggagagaggca

SEQ ID NO: 196257 - DNA, 22 bp, Mus musculus
agctgtctttctctgccactct

SEQ ID NO: 196258 - DNA, 23 bp, Mus musculus
tctgtgtgtctgtctgtctgtcc

SEQ ID NO: 196259 - DNA, 23 bp, Mus musculus
gtctctctgtgtgtgtctgtgca

SEQ ID NO: 196260 - DNA, 23 bp, Mus musculus
cctctgcctctctgcctctgcct

SEQ ID NO: 196261 - DNA, 23 bp, Mus musculus
catatgtatgtgtgcatgagcgt

SEQ ID NO: 196262 - DNA, 23 bp, Mus musculus
tctgaagtctgctcattgttttt

SEQ ID NO: 196263 - DNA, 22 bp, Mus musculus
cacacacacaaatgtggaagtc

SEQ ID NO: 196264 - DNA, 22 bp, Mus musculus
tggtcagttctctccttccaca

SEQ ID NO: 196265 - DNA, 23 bp, Mus musculus
gccagcctggctgcctgagaccc

SEQ ID NO: 196266 - DNA, 23 bp, Mus musculus
accatcaccattcagagtctgta

SEQ ID NO: 196267 - DNA, 18 bp, Mus musculus
atgatggtctgataggat

SEQ ID NO: 196268 - DNA, 22 bp, Mus musculus
tgttttgtgaccaattatatgg

SEQ ID NO: 196269 - DNA, 23 bp, Mus musculus
agcactcactgctctctctctct

SEQ ID NO: 196270 - DNA, 22 bp, Mus musculus
gtgagagagtcagagaggctcc

SEQ ID NO: 196271 - DNA, 22 bp, Mus musculus
tgacagaggtgacagaggacat

SEQ ID NO: 196272 - DNA, 21 bp, Mus musculus
tgaacttgaagactcctggtc

SEQ ID NO: 196273 - DNA, 22 bp, Mus musculus
cattctcagggttagtcatcag

SEQ ID NO: 196274 - DNA, 23 bp, Mus musculus
cagtctcagtctctctgctttct

SEQ ID NO: 196275 - DNA, 23 bp, Mus musculus
cccatctgtctctctgtccgcgg

SEQ ID NO: 196276 - DNA, 21 bp, Mus musculus
tcagtgagagtttggaaggaa

SEQ ID NO: 196277 - DNA, 23 bp, Mus musculus
acttcatccagctctctctgact

SEQ ID NO: 196278 - DNA, 21 bp, Mus musculus
gctaatgtcaggctttacaac

SEQ ID NO: 196279 - DNA, 23 bp, Mus musculus
cctgtctgtgtgtctatgtgtct

SEQ ID NO: 196280 - DNA, 23 bp, Mus musculus
gatggatgagtgagtgatgttct

SEQ ID NO: 196281 - DNA, 23 bp, Mus musculus
tctctgtctcactctgtcttgtc

SEQ ID NO: 196282 - DNA, 21 bp, Mus musculus
aaaagcagaaaatggagccag

SEQ ID NO: 196283 - DNA, 23 bp, Mus musculus
tgtgtgcctgagtgggtgggtct

SEQ ID NO: 196284 - DNA, 23 bp, Mus musculus
tacatcactctgtctgtctctat

SEQ ID NO: 196285 - DNA, 23 bp, Mus musculus
aacacagaatctgaaatggtgtg

SEQ ID NO: 196286 - DNA, 18 bp, Mus musculus
agcctagatgctcggtct

SEQ ID NO: 196287 - DNA, 23 bp, Mus musculus
aaactgactccagagactgagct

SEQ ID NO: 196288 - DNA, 18 bp, Mus musculus
atatgtatacataatgta

SEQ ID NO: 196289 - DNA, 23 bp, Mus musculus
atatgtgtgtatatatatgtgtg

SEQ ID NO: 196290 - DNA, 23 bp, Mus musculus
gctctgtctgcctgtctctcacc

SEQ ID NO: 196291 - DNA, 23 bp, Mus musculus
tcccagtgtctctccctctgact

SEQ ID NO: 196292 - DNA, 23 bp, Mus musculus
tgcctgtctctgtctctgcttcc

SEQ ID NO: 196293 - DNA, 23 bp, Mus musculus
tctcgctcgctcgctctctgtct

SEQ ID NO: 196294 - DNA, 23 bp, Mus musculus
aatagcactgactgctcttccag

SEQ ID NO: 196295 - DNA, 23 bp, Mus musculus
ttgctgtctggctgagtgctggg

SEQ ID NO: 196296 - DNA, 19 bp, Mus musculus
acagtgctggcattgacag

SEQ ID NO: 196297 - DNA, 23 bp, Mus musculus
ggtcatttctctctctccctttg

SEQ ID NO: 196298 - DNA, 23 bp, Mus musculus
tatgaatcagataaagatttctg

SEQ ID NO: 196299 - DNA, 23 bp, Mus musculus
ctttaagtagcactgagtctatt

SEQ ID NO: 196300 - DNA, 19 bp, Mus musculus
tgtatatgtgtttgtgtgt

SEQ ID NO: 196301 - DNA, 23 bp, Mus musculus
atgtgtgtatgtatgatgtgcat

SEQ ID NO: 196302 - DNA, 23 bp, Mus musculus
tttttcattgtttttgtagccat

SEQ ID NO: 196303 - DNA, 22 bp, Mus musculus
aagaggttttgaaaagtgtttg

SEQ ID NO: 196304 - DNA, 23 bp, Mus musculus
aatttgagctttccttttcaaat

SEQ ID NO: 196305 - DNA, 18 bp, Mus musculus
tgtttcaggtttgtcttt

SEQ ID NO: 196306 - DNA, 23 bp, Mus musculus
gtgctctaggcattttgttgttt

SEQ ID NO: 196307 - DNA, 20 bp, Mus musculus
atcaggaggagcagcagaaa

SEQ ID NO: 196308 - DNA, 20 bp, Mus musculus
tatttctgtatttcttattg

SEQ ID NO: 196309 - DNA, 22 bp, Mus musculus
gattgtatgtatgtatgtgtgt

SEQ ID NO: 196310 - DNA, 19 bp, Mus musculus
tagtgaagtgaccgtggtg

SEQ ID NO: 196311 - DNA, 22 bp, Mus musculus
caatgtcagggatgatggatgg

SEQ ID NO: 196312 - DNA, 22 bp, Mus musculus
tgtgcctctcagattacctgct

SEQ ID NO: 196313 - DNA, 23 bp, Mus musculus
ctctctctctctgactgtctctc

SEQ ID NO: 196314 - DNA, 22 bp, Mus musculus
tgttttgtgaccaattatatgg

SEQ ID NO: 196315 - DNA, 23 bp, Mus musculus
aacccattgtcttcctctgtcac

SEQ ID NO: 196316 - DNA, 23 bp, Mus musculus
tcactgacactctgggagacttt

SEQ ID NO: 196317 - DNA, 23 bp, Mus musculus
cttagtgctgtgggtatcttaca

SEQ ID NO: 196318 - DNA, 23 bp, Mus musculus
tgacttctccctctctcagtctg

SEQ ID NO: 196319 - DNA, 18 bp, Mus musculus
aagagggtagaaatacag

SEQ ID NO: 196320 - DNA, 23 bp, Mus musculus
tttcttaggttttctaggtctca

SEQ ID NO: 196321 - DNA, 19 bp, Mus musculus
taacagagggcttagggtt

SEQ ID NO: 196322 - DNA, 23 bp, Mus musculus
tctgtctgtctgtctatttggtc

SEQ ID NO: 196323 - DNA, 23 bp, Mus musculus
tctgtgcatggattttctgtatg

SEQ ID NO: 196324 - DNA, 22 bp, Mus musculus
aggagtcaggaaatgttgcagg

SEQ ID NO: 196325 - DNA, 21 bp, Mus musculus
atcagaatgtggtgcctatgc

SEQ ID NO: 196326 - DNA, 23 bp, Mus musculus
tcattctgtctgtctgtctgtct

SEQ ID NO: 196327 - DNA, 19 bp, Mus musculus
tgtcatggtttggctctct

SEQ ID NO: 196328 - DNA, 18 bp, Mus musculus
tggtcagtaagtaacctc

SEQ ID NO: 196329 - DNA, 23 bp, Mus musculus
gtattagtgcaaatgacatctta

SEQ ID NO: 196330 - DNA, 23 bp, Mus musculus
tatattgtagtacgtggttatgt

SEQ ID NO: 196331 - DNA, 22 bp, Mus musculus
atgtatgtatatgtgtatgtgc

SEQ ID NO: 196332 - DNA, 22 bp, Mus musculus
tatgtgtatatgtatatgtatg

SEQ ID NO: 196333 - DNA, 23 bp, Mus musculus
atgtgcatgtgtctgtgtgcctg

SEQ ID NO: 196334 - DNA, 19 bp, Mus musculus
caagggagtgtgggtgcca

SEQ ID NO: 196335 - DNA, 23 bp, Mus musculus
aggtccagagaagagggaagaga

SEQ ID NO: 196336 - DNA, 22 bp, Mus musculus
tatagatcaggtgggcctcaaa

SEQ ID NO: 196337 - DNA, 23 bp, Mus musculus
agagatctgtctgtatctgactc

SEQ ID NO: 196338 - DNA, 21 bp, Mus musculus
ctctagctccctctctctgtt

SEQ ID NO: 196339 - DNA, 23 bp, Mus musculus
acaatcctgttgtctcagtctct

SEQ ID NO: 196340 - DNA, 23 bp, Mus musculus
ccaatatgatggaatagcactct

SEQ ID NO: 196341 - DNA, 20 bp, Mus musculus
ttagacaatgttttactatg

SEQ ID NO: 196342 - DNA, 20 bp, Mus musculus
agtggattactaagcgacag

SEQ ID NO: 196343 - DNA, 21 bp, Mus musculus
aggcacacacagtctgacatg

SEQ ID NO: 196344 - DNA, 18 bp, Mus musculus
accgtgtactttgtgttg

SEQ ID NO: 196345 - DNA, 22 bp, Mus musculus
tgagcatgtattatgtgcatgc

SEQ ID NO: 196346 - DNA, 23 bp, Mus musculus
gtatgtttcttctctgcctccag

SEQ ID NO: 196347 - DNA, 23 bp, Mus musculus
cattgtctgaagacacactgctc

SEQ ID NO: 196348 - DNA, 22 bp, Mus musculus
tatggcactccctgttgttcct

SEQ ID NO: 196349 - DNA, 23 bp, Mus musculus
tgctttctctgcctctctgacac

SEQ ID NO: 196350 - DNA, 23 bp, Mus musculus
atgtatgtgagcatgtgcatgtg

SEQ ID NO: 196351 - DNA, 23 bp, Mus musculus
tagttatgtgcatttgcatgtgt

SEQ ID NO: 196352 - DNA, 21 bp, Mus musculus
caagaaggtagtttagttgaa

SEQ ID NO: 196353 - DNA, 21 bp, Mus musculus
taacactctgtgtcatttgtg

SEQ ID NO: 196354 - DNA, 23 bp, Mus musculus
tgtgactgaagagatggctcaga

SEQ ID NO: 196355 - DNA, 23 bp, Mus musculus
agtactgactgctcttccagagg

SEQ ID NO: 196356 - DNA, 19 bp, Mus musculus
cttcactggcacagtcctc

SEQ ID NO: 196357 - DNA, 22 bp, Mus musculus
tgtctgtccgtctgtctgcctc

SEQ ID NO: 196358 - DNA, 23 bp, Mus musculus
aaaagagccttcagagaagtcac

SEQ ID NO: 196359 - DNA, 23 bp, Mus musculus
tccaggtctctgtctgctgtctc

SEQ ID NO: 196360 - DNA, 20 bp, Mus musculus
ttaggttatatattcacata

SEQ ID NO: 196361 - DNA, 23 bp, Mus musculus
tatgtgtgtttattactttgtga

SEQ ID NO: 196362 - DNA, 23 bp, Mus musculus
tgaggaatgaagtaagagagcag

SEQ ID NO: 196363 - DNA, 23 bp, Mus musculus
tgtgtgcctctgtgtgtgcctgt

SEQ ID NO: 196364 - DNA, 23 bp, Mus musculus
cgcttcctcactcactgtgtctg

SEQ ID NO: 196365 - DNA, 22 bp, Mus musculus
atatttgctgagatatttgctt

SEQ ID NO: 196366 - DNA, 19 bp, Mus musculus
tacaccaatatttcttatg

SEQ ID NO: 196367 - DNA, 22 bp, Mus musculus
aatgtccttatgtaacccaacg

SEQ ID NO: 196368 - DNA, 23 bp, Mus musculus
actgatcagagagagaggactgt

SEQ ID NO: 196369 - DNA, 18 bp, Mus musculus
agagtaggcagagagggc

SEQ ID NO: 196370 - DNA, 23 bp, Mus musculus
ggctagagagatgatggctcagc

SEQ ID NO: 196371 - DNA, 23 bp, Mus musculus
ttgtctgaagtttgacagcactt

SEQ ID NO: 196372 - DNA, 21 bp, Mus musculus
tagtgctggaggttcagctag

SEQ ID NO: 196373 - DNA, 23 bp, Mus musculus
agccaggctgcctggtttggtct

SEQ ID NO: 196374 - DNA, 23 bp, Mus musculus
ctgtctgtctgtctgtctgttta

SEQ ID NO: 196375 - DNA, 23 bp, Mus musculus
ctatgtgcatttgtatacatata

SEQ ID NO: 196376 - DNA, 22 bp, Mus musculus
tgcatataaatgcctacttgag

SEQ ID NO: 196377 - DNA, 19 bp, Mus musculus
aacagtatacaatatatac

SEQ ID NO: 196378 - DNA, 20 bp, Mus musculus
atatgtatatatgtatatct

SEQ ID NO: 196379 - DNA, 18 bp, Mus musculus
catcaaagactgatggaa

SEQ ID NO: 196380 - DNA, 18 bp, Mus musculus
ttccatgtctctgccaaa

SEQ ID NO: 196381 - DNA, 23 bp, Mus musculus
tagtgcatggtgatctgatagga

SEQ ID NO: 196382 - DNA, 22 bp, Mus musculus
tgttttgtgacctattatgtgg

SEQ ID NO: 196383 - DNA, 23 bp, Mus musculus
tgtatgtatgtatgtatgtatgt

SEQ ID NO: 196384 - DNA, 22 bp, Mus musculus
tccatgttgatctgataggatg

SEQ ID NO: 196385 - DNA, 22 bp, Mus musculus
tgttttgtgaccaattatatgg

SEQ ID NO: 196386 - DNA, 22 bp, Mus musculus
tgttttgtgaccaattatatgg

SEQ ID NO: 196387 - DNA, 19 bp, Mus musculus
gcttacatcctggtctgtg

SEQ ID NO: 196388 - DNA, 22 bp, Mus musculus
agagactgcagtttgtgacctc

SEQ ID NO: 196389 - DNA, 23 bp, Mus musculus
tgtatgtatgtatgtatgtatat

SEQ ID NO: 196390 - DNA, 23 bp, Mus musculus
tatgcatgcatgtatgtatgaat

SEQ ID NO: 196391 - DNA, 22 bp, Mus musculus
tgttttgtcaccaattatatgg

SEQ ID NO: 196392 - DNA, 23 bp, Mus musculus
cagagactctgtggctctgcctg

SEQ ID NO: 196393 - DNA, 20 bp, Mus musculus
agactggaattacagatggt

SEQ ID NO: 196394 - DNA, 23 bp, Mus musculus
tgtatgtatgtatgtgtgtgtgt

SEQ ID NO: 196395 - DNA, 23 bp, Mus musculus
ctgcctgtctgtctgtctgtgca

SEQ ID NO: 196396 - DNA, 20 bp, Mus musculus
aatgcactcttcctacttct

SEQ ID NO: 196397 - DNA, 18 bp, Mus musculus
tgaagtaggcaaaggaag

SEQ ID NO: 196398 - DNA, 23 bp, Mus musculus
tatctatcaccagagtctgcagt

SEQ ID NO: 196399 - DNA, 23 bp, Mus musculus
tatggtaatgaaacatttgactg

SEQ ID NO: 196400 - DNA, 23 bp, Mus musculus
tgtttgtgtgcatgtgtatgtgt

SEQ ID NO: 196401 - DNA, 23 bp, Mus musculus
tgaagctacagactgtatgatgt

SEQ ID NO: 196402 - DNA, 21 bp, Mus musculus
ttgtattgttgtttcattccc

SEQ ID NO: 196403 - DNA, 22 bp, Mus musculus
tgtatgtatatgtaaatgtgtg

SEQ ID NO: 196404 - DNA, 23 bp, Mus musculus
tccagtgtcttagccctctctct

SEQ ID NO: 196405 - DNA, 18 bp, Mus musculus
agaggaaaaggggctgga

SEQ ID NO: 196406 - DNA, 21 bp, Mus musculus
tatgtgtgtgtgtataacctg

SEQ ID NO: 196407 - DNA, 23 bp, Mus musculus
tgagataaatgaatttgtatatg

SEQ ID NO: 196408 - DNA, 20 bp, Mus musculus
aggatatttgtataaaagta

SEQ ID NO: 196409 - DNA, 23 bp, Mus musculus
cctagatggttctattgttctgt

SEQ ID NO: 196410 - DNA, 23 bp, Mus musculus
tagtgcatggtgatctgatagga

SEQ ID NO: 196411 - DNA, 22 bp, Mus musculus
tgttttgtgacctattatgtgg

SEQ ID NO: 196412 - DNA, 23 bp, Mus musculus
agtctctgagtggctgtgcttct

SEQ ID NO: 196413 - DNA, 22 bp, Mus musculus
tgttttgtgaccaattatatgg

SEQ ID NO: 196414 - DNA, 22 bp, Mus musculus
tgttttgtgaccaattatatgg

SEQ ID NO: 196415 - DNA, 22 bp, Mus musculus
tgttttgtgaccaattatatgg

SEQ ID NO: 196416 - DNA, 22 bp, Mus musculus
tgttttgtgaccaattatatgg

SEQ ID NO: 196417 - DNA, 20 bp, Mus musculus
atggagtttagggagccgtt

SEQ ID NO: 196418 - DNA, 23 bp, Mus musculus
atttagctcatttacatttccaa

SEQ ID NO: 196419 - DNA, 23 bp, Mus musculus
tgtgaggctctgtcagtgcctgg

SEQ ID NO: 196420 - DNA, 18 bp, Mus musculus
agaggtactaggtccaat

SEQ ID NO: 196421 - DNA, 20 bp, Mus musculus
tgaagtccttaaagtcctgt

SEQ ID NO: 196422 - DNA, 23 bp, Mus musculus
tatctgtctgtgtggctctgtgc

SEQ ID NO: 196423 - DNA, 23 bp, Mus musculus
ctgtgcgtgtctctgtgtgtctg

SEQ ID NO: 196424 - DNA, 23 bp, Mus musculus
ggtacactcactggctgagtggg

SEQ ID NO: 196425 - DNA, 23 bp, Mus musculus
aaacagctcagagtggaaacact

SEQ ID NO: 196426 - DNA, 23 bp, Mus musculus
agtcactgcatctctgtttggct

SEQ ID NO: 196427 - DNA, 23 bp, Mus musculus
tccaggtctctccctctgtgtgt

SEQ ID NO: 196428 - DNA, 23 bp, Mus musculus
ggtacactcactggctgagtggg

SEQ ID NO: 196429 - DNA, 23 bp, Mus musculus
aaacagctcagagtggaaacact

SEQ ID NO: 196430 - DNA, 23 bp, Mus musculus
agtcactgcatctctgtttggct

SEQ ID NO: 196431 - DNA, 23 bp, Mus musculus
tccaggtctctccctctgtgtgt

SEQ ID NO: 196432 - DNA, 18 bp, Mus musculus
ttcaattcctagtaacca

SEQ ID NO: 196433 - DNA, 23 bp, Mus musculus
tgtctgtctgtctgtttatagcc

SEQ ID NO: 196434 - DNA, 22 bp, Mus musculus
gtatctgtgtgtcagtgtccgt

SEQ ID NO: 196435 - DNA, 20 bp, Mus musculus
agggtgttcatacagaagtc

SEQ ID NO: 196436 - DNA, 21 bp, Mus musculus
accaggagaaacaggtaggtg

SEQ ID NO: 196437 - DNA, 23 bp, Mus musculus
tctctctctctgagaagtctctt

SEQ ID NO: 196438 - DNA, 21 bp, Mus musculus
aactcctcagagtccagctgt

SEQ ID NO: 196439 - DNA, 20 bp, Mus musculus
tcagggcaacctgtgtctct

SEQ ID NO: 196440 - DNA, 23 bp, Mus musculus
taggtctgcctctgtctgtctct

SEQ ID NO: 196441 - DNA, 20 bp, Mus musculus
tcttttgtttcttctttgag

SEQ ID NO: 196442 - DNA, 23 bp, Mus musculus
tctgtctgcctgtctgcttgcaa

SEQ ID NO: 196443 - DNA, 22 bp, Mus musculus
ctggtgtacatggtgctgagga

SEQ ID NO: 196444 - DNA, 22 bp, Mus musculus
tgactcacattctcagtcccac

SEQ ID NO: 196445 - DNA, 23 bp, Mus musculus
gtgtgagcgtgcctgtgtgccac

SEQ ID NO: 196446 - DNA, 23 bp, Mus musculus
atgacagtggtcagtcactctga

SEQ ID NO: 196447 - DNA, 23 bp, Mus musculus
agactgtctgcctgcctgcctgc

SEQ ID NO: 196448 - DNA, 23 bp, Mus musculus
tcagtagtgtgtgatgagtggta

SEQ ID NO: 196449 - DNA, 21 bp, Mus musculus
ttccttcagcctctgctctga

SEQ ID NO: 196450 - DNA, 21 bp, Mus musculus
ctcacacatactacacactct

SEQ ID NO: 196451 - DNA, 23 bp, Mus musculus
gtttagtctgtgtgtgtgtgtct

SEQ ID NO: 196452 - DNA, 23 bp, Mus musculus
tgtgtgtctgtgtgcctgtgtgt

SEQ ID NO: 196453 - DNA, 23 bp, Mus musculus
agatgtgacaattgtgtgtgtac

SEQ ID NO: 196454 - DNA, 23 bp, Mus musculus
gtctgtgtgtgtgtgcctgcttg

SEQ ID NO: 196455 - DNA, 23 bp, Mus musculus
tctgtctgtctgtctgtctgtct

SEQ ID NO: 196456 - DNA, 19 bp, Mus musculus
agtcagagacaatttgtgg

SEQ ID NO: 196457 - DNA, 18 bp, Mus musculus
tgagcagctcttatctag

SEQ ID NO: 196458 - DNA, 22 bp, Mus musculus
tcgatgttgatggtctggaagc

SEQ ID NO: 196459 - DNA, 18 bp, Mus musculus
tgagcagctcttatctag

SEQ ID NO: 196460 - DNA, 22 bp, Mus musculus
tcgatgttgatggtctggaagc

SEQ ID NO: 196461 - DNA, 22 bp, Mus musculus
cagagtctctcactgagcctgg

SEQ ID NO: 196462 - DNA, 20 bp, Mus musculus
gctagtggccctagaacctg

SEQ ID NO: 196463 - DNA, 21 bp, Mus musculus
cagaagtgtttttcttgaagt

SEQ ID NO: 196464 - DNA, 23 bp, Mus musculus
aacacttctgagaatgcacttgc

SEQ ID NO: 196465 - DNA, 20 bp, Mus musculus
ttgacacaggagtttgtgtg

SEQ ID NO: 196466 - DNA, 22 bp, Mus musculus
tgacagaagtgacccagcacag

SEQ ID NO: 196467 - DNA, 23 bp, Mus musculus
aggagtgacagtaggctgtggga

SEQ ID NO: 196468 - DNA, 23 bp, Mus musculus
tgagacaacagagtctggtatgt

SEQ ID NO: 196469 - DNA, 19 bp, Mus musculus
acacagacacacatgctgg

SEQ ID NO: 196470 - DNA, 22 bp, Mus musculus
ctgtgtgtatctctgtgtgagg

SEQ ID NO: 196471 - DNA, 23 bp, Mus musculus
tttgagtgcctgagttcagttct

SEQ ID NO: 196472 - DNA, 20 bp, Mus musculus
gttgtcttgtttgaatgcag

SEQ ID NO: 196473 - DNA, 23 bp, Mus musculus
tgcagtaaacagactagctgtcg

SEQ ID NO: 196474 - DNA, 21 bp, Mus musculus
cagtgaacagactagctgttg

SEQ ID NO: 196475 - DNA, 23 bp, Mus musculus
aaggtgcctgcctgcctctaaac

SEQ ID NO: 196476 - DNA, 20 bp, Mus musculus
gtgagaaggcagagtgcaca

SEQ ID NO: 196477 - DNA, 23 bp, Mus musculus
ggttgtctgactgtctgtccgtg

SEQ ID NO: 196478 - DNA, 22 bp, Mus musculus
ccaataactatctggtcatgtt

SEQ ID NO: 196479 - DNA, 19 bp, Mus musculus
ataattgtctgctaatcat

SEQ ID NO: 196480 - DNA, 23 bp, Mus musculus
tctgctcaagctgacaccctgct

SEQ ID NO: 196481 - DNA, 21 bp, Mus musculus
aaaagtctcctttctgtgtgt

SEQ ID NO: 196482 - DNA, 21 bp, Mus musculus
atctctcccactcacacccag

SEQ ID NO: 196483 - DNA, 23 bp, Mus musculus
tctctcccactctgtgtaggctc

SEQ ID NO: 196484 - DNA, 23 bp, Mus musculus
agattcttagtgtaaaaggagtg

SEQ ID NO: 196485 - DNA, 21 bp, Mus musculus
ttttactagtgtcacctgcag

SEQ ID NO: 196486 - DNA, 19 bp, Mus musculus
atacacacatatttatatg

SEQ ID NO: 196487 - DNA, 23 bp, Mus musculus
tttatccagtctgtctctgtctc

SEQ ID NO: 196488 - DNA, 23 bp, Mus musculus
tgcatgactagtgtttgtgtaga

SEQ ID NO: 196489 - DNA, 23 bp, Mus musculus
acagaccacagtgaggacttact

SEQ ID NO: 196490 - DNA, 23 bp, Mus musculus
tgtatgtgtgtatgtgcatgtgt

SEQ ID NO: 196491 - DNA, 22 bp, Mus musculus
caggggctggagagatggctca

SEQ ID NO: 196492 - DNA, 23 bp, Mus musculus
tctgactctctcactttaggaca

SEQ ID NO: 196493 - DNA, 18 bp, Mus musculus
tatttttcattttaaagt

SEQ ID NO: 196494 - DNA, 21 bp, Mus musculus
cttgcctatctgtctgtctga

SEQ ID NO: 196495 - DNA, 23 bp, Mus musculus
accaacagtgaaaatgttgaagc

SEQ ID NO: 196496 - DNA, 23 bp, Mus musculus
tctctccctctggctttaatgtg

SEQ ID NO: 196497 - DNA, 19 bp, Mus musculus
gtcgcactctctgtggcag

SEQ ID NO: 196498 - DNA, 21 bp, Mus musculus
gagctgtgggtgctcagtgag

SEQ ID NO: 196499 - DNA, 23 bp, Mus musculus
tgactggccaatctttctcctca

SEQ ID NO: 196500 - DNA, 23 bp, Mus musculus
atgtatgtatgtatgtatgtatg

SEQ ID NO: 196501 - DNA, 21 bp, Mus musculus
atatgtatatatatatgtgtg

SEQ ID NO: 196502 - DNA, 21 bp, Mus musculus
actttgttgttgttgctctta

SEQ ID NO: 196503 - DNA, 23 bp, Mus musculus
caggctggacagctacaaggaga

SEQ ID NO: 196504 - DNA, 20 bp, Mus musculus
tgtcaggcagccagtatggg

SEQ ID NO: 196505 - DNA, 23 bp, Mus musculus
gagtctctctccctgtggctctg

SEQ ID NO: 196506 - DNA, 22 bp, Mus musculus
acaagggcctctctgtgtctga

SEQ ID NO: 196507 - DNA, 21 bp, Mus musculus
atacctccatcaggacctgat

SEQ ID NO: 196508 - DNA, 19 bp, Mus musculus
tgtatatatgtatgtatgc

SEQ ID NO: 196509 - DNA, 18 bp, Mus musculus
gcatagaggcatgaatgt

SEQ ID NO: 196510 - DNA, 23 bp, Mus musculus
tcacagaagatactatgctgagg

SEQ ID NO: 196511 - DNA, 22 bp, Mus musculus
agtctgtctgtctgtctgtctg

SEQ ID NO: 196512 - DNA, 23 bp, Mus musculus
gcagacagaggacacagagctgg

SEQ ID NO: 196513 - DNA, 23 bp, Mus musculus
atgggattgttgtttgggctaag

SEQ ID NO: 196514 - DNA, 23 bp, Mus musculus
ttaaattctcattttgtagatga

SEQ ID NO: 196515 - DNA, 18 bp, Mus musculus
taagcaatttgtctgagg

SEQ ID NO: 196516 - DNA, 23 bp, Mus musculus
ctggagtgtgtgagtctgtgtgt

SEQ ID NO: 196517 - DNA, 23 bp, Mus musculus
ttttctatggtattctaggattt

SEQ ID NO: 196518 - DNA, 23 bp, Mus musculus
tttgtaaacatgtttgtatgtgt

SEQ ID NO: 196519 - DNA, 22 bp, Mus musculus
tgttttgtgaccaattatatgg

SEQ ID NO: 196520 - DNA, 20 bp, Mus musculus
aacacatgtgagtaagcaca

SEQ ID NO: 196521 - DNA, 23 bp, Mus musculus
gtgtgtgcatatatatatgtgtg

SEQ ID NO: 196522 - DNA, 23 bp, Mus musculus
tgtatttctatttctgatagggg

SEQ ID NO: 196523 - DNA, 23 bp, Mus musculus
atgctgagctctgaattgtgtgt

SEQ ID NO: 196524 - DNA, 23 bp, Mus musculus
tgtctgcctgtctgcctgtctgc

SEQ ID NO: 196525 - DNA, 22 bp, Mus musculus
gattcaagtgatagagcagaag

SEQ ID NO: 196526 - DNA, 22 bp, Mus musculus
tgttttgtgaccaattatatgg

SEQ ID NO: 196527 - DNA, 23 bp, Mus musculus
tgtacgtgtgcatgtggatgtgc

SEQ ID NO: 196528 - DNA, 19 bp, Mus musculus
aaaatgacagtgttaaaga

SEQ ID NO: 196529 - DNA, 22 bp, Mus musculus
tgttttgtgaccaattatatgg

SEQ ID NO: 196530 - DNA, 21 bp, Mus musculus
tttctgtactgagtgaggtga

SEQ ID NO: 196531 - DNA, 23 bp, Mus musculus
tcactctctgtctcactactagg

SEQ ID NO: 196532 - DNA, 23 bp, Mus musculus
gtctgtctgtctgtctgtctgcc

SEQ ID NO: 196533 - DNA, 20 bp, Mus musculus
tatccttcataattgcattc

SEQ ID NO: 196534 - DNA, 20 bp, Mus musculus
aacaagaggctttgcttcta

SEQ ID NO: 196535 - DNA, 23 bp, Mus musculus
agactgaggctccctgtttggct

SEQ ID NO: 196536 - DNA, 20 bp, Mus musculus
tatatttgtgtgcctgcatt

SEQ ID NO: 196537 - DNA, 23 bp, Mus musculus
tgtgtatgcctgagtgtatgtat

SEQ ID NO: 196538 - DNA, 21 bp, Mus musculus
tgacttgatttagtcattgta

SEQ ID NO: 196539 - DNA, 22 bp, Mus musculus
ttcctggtcacagtctaatgag

SEQ ID NO: 196540 - DNA, 22 bp, Mus musculus
tgttttgtgaccaattatatgg

SEQ ID NO: 196541 - DNA, 22 bp, Mus musculus
acatagtacagacagagcacat

SEQ ID NO: 196542 - DNA, 22 bp, Mus musculus
tgttttgtgaccaattatatgg

SEQ ID NO: 196543 - DNA, 23 bp, Mus musculus
acttgtcaatttgattaagtgag

SEQ ID NO: 196544 - DNA, 22 bp, Mus musculus
gtgtgtgtatgtatatatgtgt

SEQ ID NO: 196545 - DNA, 23 bp, Mus musculus
atatgtgcatgtgtatatatgta

SEQ ID NO: 196546 - DNA, 18 bp, Mus musculus
tgtgtatgtgtatgtata

SEQ ID NO: 196547 - DNA, 23 bp, Mus musculus
tgtgtgcttctgagttcttggtg

SEQ ID NO: 196548 - DNA, 22 bp, Mus musculus
tatgtgtgcatgcatatatgtg

SEQ ID NO: 196549 - DNA, 23 bp, Mus musculus
tatatatgtatgtgtatacacac

SEQ ID NO: 196550 - DNA, 21 bp, Mus musculus
tgtcaggttttgtcttctgtg

SEQ ID NO: 196551 - DNA, 21 bp, Mus musculus
tggtttgtaaggaagaatgtt

SEQ ID NO: 196552 - DNA, 22 bp, Mus musculus
ttactgctacttgatatgccat

SEQ ID NO: 196553 - DNA, 20 bp, Mus musculus
aacatcaaaatcgatagatt

SEQ ID NO: 196554 - DNA, 23 bp, Mus musculus
aaagaacttcaaaagatttattg

SEQ ID NO: 196555 - DNA, 23 bp, Mus musculus
gtatgtatgcatgtatctgtgta

SEQ ID NO: 196556 - DNA, 22 bp, Mus musculus
taagaacaaagtgtgtatgtat

SEQ ID NO: 196557 - DNA, 23 bp, Mus musculus
atattgtctgcttattttgtctt

SEQ ID NO: 196558 - DNA, 20 bp, Mus musculus
ttatgcctgtggtacgaatg

SEQ ID NO: 196559 - DNA, 21 bp, Mus musculus
tctgccactgagtcacattcc

SEQ ID NO: 196560 - DNA, 22 bp, Mus musculus
ttttgagacagggtctcatgtg

SEQ ID NO: 196561 - DNA, 23 bp, Mus musculus
tttgcattgcatttcctgcacct

SEQ ID NO: 196562 - DNA, 23 bp, Mus musculus
ttttttctttgtgaaatgaatgg

SEQ ID NO: 196563 - DNA, 23 bp, Mus musculus
gacctgtctgtctctgcctctcc

SEQ ID NO: 196564 - DNA, 23 bp, Mus musculus
tatcacagagcagacactagctg

SEQ ID NO: 196565 - DNA, 23 bp, Mus musculus
caacaaatcaaaggctcctttcc

SEQ ID NO: 196566 - DNA, 20 bp, Mus musculus
tgatgcaagagtgtaagttg

SEQ ID NO: 196567 - DNA, 23 bp, Mus musculus
tttctctctctgtgtatcaagag

SEQ ID NO: 196568 - DNA, 18 bp, Mus musculus
tgatgtgtgcttgggaga

SEQ ID NO: 196569 - DNA, 22 bp, Mus musculus
agttgtttgatgctctgaaagc

SEQ ID NO: 196570 - DNA, 23 bp, Mus musculus
aagatttgaagtaaacttccctt

SEQ ID NO: 196571 - DNA, 21 bp, Mus musculus
ctttttgagttagaaaacatc

SEQ ID NO: 196572 - DNA, 23 bp, Mus musculus
tctgtatctgtctgagtcagctg

SEQ ID NO: 196573 - DNA, 22 bp, Mus musculus
tgttttgtgaccaattatatgg

SEQ ID NO: 196574 - DNA, 23 bp, Mus musculus
tgtgtgtctgtgtgtatgtgttg

SEQ ID NO: 196575 - DNA, 23 bp, Mus musculus
accttgaacatctccatgtattc

SEQ ID NO: 196576 - DNA, 18 bp, Mus musculus
tttacacatatacatgta

SEQ ID NO: 196577 - DNA, 23 bp, Mus musculus
taaatgtgtgtgtttgtgtgtgc

SEQ ID NO: 196578 - DNA, 23 bp, Mus musculus
taatgagatattgtatatgtatt

SEQ ID NO: 196579 - DNA, 19 bp, Mus musculus
tgtctatatatatatgtgt

SEQ ID NO: 196580 - DNA, 22 bp, Mus musculus
tgttttgtgaccaattatatgg

SEQ ID NO: 196581 - DNA, 22 bp, Mus musculus
tgtaaactaaaatagtaagtac

SEQ ID NO: 196582 - DNA, 23 bp, Mus musculus
ctgtctctgtgtctgcctgtagt

SEQ ID NO: 196583 - DNA, 19 bp, Mus musculus
tatgttctagatctggaca

SEQ ID NO: 196584 - DNA, 23 bp, Mus musculus
ttatctctctctcactgtccctg

SEQ ID NO: 196585 - DNA, 19 bp, Mus musculus
tcacacacacacatcacac

SEQ ID NO: 196586 - DNA, 22 bp, Mus musculus
tctgtgtgtgcgtgtgcatgta

SEQ ID NO: 196587 - DNA, 23 bp, Mus musculus
tgtgtatatatatatgtatatgt

SEQ ID NO: 196588 - DNA, 22 bp, Mus musculus
tgttttgtgaccaattatatgg

SEQ ID NO: 196589 - DNA, 18 bp, Mus musculus
tcctacagaaaatgccaa

SEQ ID NO: 196590 - DNA, 20 bp, Mus musculus
catgttctatgatttttttc

SEQ ID NO: 196591 - DNA, 22 bp, Mus musculus
tgttttgtgaccaattatatgg

SEQ ID NO: 196592 - DNA, 23 bp, Mus musculus
tcaatttccagcaaacacatagt

SEQ ID NO: 196593 - DNA, 23 bp, Mus musculus
tcacacagactgtatgtagctgc

SEQ ID NO: 196594 - DNA, 18 bp, Mus musculus
ggctcactcactggctca

SEQ ID NO: 196595 - DNA, 23 bp, Mus musculus
gaagctattcagcatgtgctgga

SEQ ID NO: 196596 - DNA, 23 bp, Mus musculus
tatgtaccaatatgtaaatatgt

SEQ ID NO: 196597 - DNA, 22 bp, Mus musculus
ttcagctagcatcaatgctctt

SEQ ID NO: 196598 - DNA, 18 bp, Mus musculus
aggtctgctagtctcagg

SEQ ID NO: 196599 - DNA, 20 bp, Mus musculus
tcaggaattttatttttaag

SEQ ID NO: 196600 - DNA, 23 bp, Mus musculus
aggtgctgagggtctcttgtgtt

SEQ ID NO: 196601 - DNA, 23 bp, Mus musculus
tgtcatcagagacgctctctgca

SEQ ID NO: 196602 - DNA, 23 bp, Mus musculus
gtgcagacagtgttcagttctga

SEQ ID NO: 196603 - DNA, 19 bp, Mus musculus
gtcacgctctctcagtaac

SEQ ID NO: 196604 - DNA, 22 bp, Mus musculus
gcactgagcttttgagtggtga

SEQ ID NO: 196605 - DNA, 23 bp, Mus musculus
tgtgtgtatgtatatgtgtgtgt

SEQ ID NO: 196606 - DNA, 21 bp, Mus musculus
cagacagacagagacagagag

SEQ ID NO: 196607 - DNA, 22 bp, Mus musculus
attttagtttgcttgttatggc

SEQ ID NO: 196608 - DNA, 19 bp, Mus musculus
cagtatcagatatgggaag

SEQ ID NO: 196609 - DNA, 23 bp, Mus musculus
gtgagtcttcagagtaggtcttc

SEQ ID NO: 196610 - DNA, 23 bp, Mus musculus
gagatctgtctgaagcactctca

SEQ ID NO: 196611 - DNA, 21 bp, Mus musculus
tgcctccctccctgaatctct

SEQ ID NO: 196612 - DNA, 23 bp, Mus musculus
agtgtctgtgtttatgtgcctct

SEQ ID NO: 196613 - DNA, 21 bp, Mus musculus
ttgattcttgaccatgggatg

SEQ ID NO: 196614 - DNA, 21 bp, Mus musculus
tgtgtagactttggtatagaa

SEQ ID NO: 196615 - DNA, 21 bp, Mus musculus
tataacattgtttggggtgag

SEQ ID NO: 196616 - DNA, 20 bp, Mus musculus
tctcaggcagggaagcatct

SEQ ID NO: 196617 - DNA, 19 bp, Mus musculus
gtggttccctctctgctga

SEQ ID NO: 196618 - DNA, 23 bp, Mus musculus
cagaacactgtgagctttctagt

SEQ ID NO: 196619 - DNA, 22 bp, Mus musculus
tatgtatgtatgtatgtatgta

SEQ ID NO: 196620 - DNA, 23 bp, Mus musculus
attcacacacacatatatgtgtg

SEQ ID NO: 196621 - DNA, 21 bp, Mus musculus
caggggctggagagatggctc

SEQ ID NO: 196622 - DNA, 22 bp, Mus musculus
gtctgtctgtctgtctgcttaa

SEQ ID NO: 196623 - DNA, 23 bp, Mus musculus
agtctgcctgtctctgtcccttc

SEQ ID NO: 196624 - DNA, 22 bp, Mus musculus
gaagggaggctgtgtcagcctg

SEQ ID NO: 196625 - DNA, 21 bp, Mus musculus
ctgaagagactggacggttcc

SEQ ID NO: 196626 - DNA, 23 bp, Mus musculus
cactgtccctgtcactcagctca

SEQ ID NO: 196627 - DNA, 23 bp, Mus musculus
tgggtgtctctgtgtgagtgcac

SEQ ID NO: 196628 - DNA, 23 bp, Mus musculus
tttctgtatgtgctggttagtgt

SEQ ID NO: 196629 - DNA, 23 bp, Mus musculus
tgtctcagaggttaagagcactg

SEQ ID NO: 196630 - DNA, 22 bp, Mus musculus
aatcatgatgatctggttggca

SEQ ID NO: 196631 - DNA, 23 bp, Mus musculus
agtgagaatagagattatgatga

SEQ ID NO: 196632 - DNA, 23 bp, Mus musculus
tgtctgtctgtctgatgtgtggg

SEQ ID NO: 196633 - DNA, 23 bp, Mus musculus
cttgcctggctccctcagtgaca

SEQ ID NO: 196634 - DNA, 22 bp, Mus musculus
agacagtggagacagtggactt

SEQ ID NO: 196635 - DNA, 18 bp, Mus musculus
tgtgtgcatatgcatgtg

SEQ ID NO: 196636 - DNA, 23 bp, Mus musculus
tcagtgagaggctcaggtaagga

SEQ ID NO: 196637 - DNA, 18 bp, Mus musculus
gagcctcactcactcact

SEQ ID NO: 196638 - DNA, 23 bp, Mus musculus
tgacagagttgagagttgttagt

SEQ ID NO: 196639 - DNA, 23 bp, Mus musculus
gttcagtgacactctctctccct

SEQ ID NO: 196640 - DNA, 23 bp, Mus musculus
tgtctgtgtgtctgtgtgcctat

SEQ ID NO: 196641 - DNA, 18 bp, Mus musculus
aggaggtgtagcatcagg

SEQ ID NO: 196642 - DNA, 23 bp, Mus musculus
tgagtgtctgtgcctgtgtctat

SEQ ID NO: 196643 - DNA, 23 bp, Mus musculus
agctggtatgcttttgatggcct

SEQ ID NO: 196644 - DNA, 18 bp, Mus musculus
attgtacatgctcagccc

SEQ ID NO: 196645 - DNA, 23 bp, Mus musculus
taagatttctggatggctttgaa

SEQ ID NO: 196646 - DNA, 23 bp, Mus musculus
actcactgtctctgtccttgcca

SEQ ID NO: 196647 - DNA, 23 bp, Mus musculus
agttcagagtagacagtctgctc

SEQ ID NO: 196648 - DNA, 23 bp, Mus musculus
ttttctcttgatcctgctttggt

SEQ ID NO: 196649 - DNA, 23 bp, Mus musculus
tgtgtatgtgtatatgtatatgt

SEQ ID NO: 196650 - DNA, 20 bp, Mus musculus
tccctcagaccctaacttta

SEQ ID NO: 196651 - DNA, 23 bp, Mus musculus
ctgttgaactgtgttttgtgttg

SEQ ID NO: 196652 - DNA, 23 bp, Mus musculus
tggactctctctctctctctctc

SEQ ID NO: 196653 - DNA, 21 bp, Mus musculus
tgtgcatctatgtatttctgt

SEQ ID NO: 196654 - DNA, 23 bp, Mus musculus
tctctctgttctctttgcctgct

SEQ ID NO: 196655 - DNA, 23 bp, Mus musculus
accaagagtgaagagtgagcgct

SEQ ID NO: 196656 - DNA, 23 bp, Mus musculus
gtatacatactacactctctgtg

SEQ ID NO: 196657 - DNA, 23 bp, Mus musculus
gttcaaatctcagcaaccacatg

SEQ ID NO: 196658 - DNA, 22 bp, Mus musculus
tgtcactgtgaggaaagggtgt

SEQ ID NO: 196659 - DNA, 23 bp, Mus musculus
atgtatgtatgtatgtatgtatg

SEQ ID NO: 196660 - DNA, 23 bp, Mus musculus
agagtgatagctaagccagagtc

SEQ ID NO: 196661 - DNA, 21 bp, Mus musculus
tctgctttggaaagcataagt

SEQ ID NO: 196662 - DNA, 23 bp, Mus musculus
tgtgtaagaggtactgtttggat

SEQ ID NO: 196663 - DNA, 21 bp, Mus musculus
tgccatgatcttggataagct

SEQ ID NO: 196664 - DNA, 23 bp, Mus musculus
actgtcactgtgatgtcaagatc

SEQ ID NO: 196665 - DNA, 19 bp, Mus musculus
gtcaggatcttcatagaag

SEQ ID NO: 196666 - DNA, 23 bp, Mus musculus
agagattttgttgatgtacttgc

SEQ ID NO: 196667 - DNA, 23 bp, Mus musculus
tttacattcaagaatagtctcat

SEQ ID NO: 196668 - DNA, 22 bp, Mus musculus
gtatatgcacatgtacatgtat

SEQ ID NO: 196669 - DNA, 23 bp, Mus musculus
cactctggctctcttacctgtgt

SEQ ID NO: 196670 - DNA, 23 bp, Mus musculus
ttcagactttctatttctgtgtc

SEQ ID NO: 196671 - DNA, 23 bp, Mus musculus
tgtgtgtctgtctgtctgtctgt

SEQ ID NO: 196672 - DNA, 22 bp, Mus musculus
tgttttgtgaccaattatatgg

SEQ ID NO: 196673 - DNA, 23 bp, Mus musculus
ttacactcagattcaagaagctt

SEQ ID NO: 196674 - DNA, 23 bp, Mus musculus
gtcttgtctgtttgtcactcacc

SEQ ID NO: 196675 - DNA, 23 bp, Mus musculus
gtctgtttctttctgtctgtcat

SEQ ID NO: 196676 - DNA, 23 bp, Mus musculus
tgtctctgaatctctctctctca

SEQ ID NO: 196677 - DNA, 22 bp, Mus musculus
tgttttgtgaccaattatatgg

SEQ ID NO: 196678 - DNA, 18 bp, Mus musculus
tcaggctggagagatggc

SEQ ID NO: 196679 - DNA, 23 bp, Mus musculus
aaagtacgtgtgcctgaggttgg

SEQ ID NO: 196680 - DNA, 23 bp, Mus musculus
acagtgtcactgtgtatgtagtc

SEQ ID NO: 196681 - DNA, 23 bp, Mus musculus
agcacagagaagacagtctggag

SEQ ID NO: 196682 - DNA, 20 bp, Mus musculus
agacacacaaacgtgtatat

SEQ ID NO: 196683 - DNA, 22 bp, Mus musculus
tatatgcatgtacatatatttg

SEQ ID NO: 196684 - DNA, 20 bp, Mus musculus
aaagatgaggggctggagag

SEQ ID NO: 196685 - DNA, 23 bp, Mus musculus
ttactctccctgacactgtggtc

SEQ ID NO: 196686 - DNA, 18 bp, Mus musculus
tgtgatgaggagcaggtg

SEQ ID NO: 196687 - DNA, 23 bp, Mus musculus
tgtcgcttaagatacagcactga

SEQ ID NO: 196688 - DNA, 21 bp, Mus musculus
taggcactagttacagagcac

SEQ ID NO: 196689 - DNA, 21 bp, Mus musculus
tctattgatctatctgtctgt

SEQ ID NO: 196690 - DNA, 22 bp, Mus musculus
ttgcagagtgagttagcagtct

SEQ ID NO: 196691 - DNA, 18 bp, Mus musculus
tctctctttgtgttacac

SEQ ID NO: 196692 - DNA, 23 bp, Mus musculus
caaagtctgtttcatatctatgt

SEQ ID NO: 196693 - DNA, 21 bp, Mus musculus
atagatatgttattgaattgt

SEQ ID NO: 196694 - DNA, 23 bp, Mus musculus
agtgcaatgttctgtgctttgaa

SEQ ID NO: 196695 - DNA, 22 bp, Mus musculus
tgttttgtgaccaattatatgg

SEQ ID NO: 196696 - DNA, 22 bp, Mus musculus
tttgagtgtcaggtaagaatgt

SEQ ID NO: 196697 - DNA, 23 bp, Mus musculus
aaattgcagtggaagttgctaat

SEQ ID NO: 196698 - DNA, 23 bp, Mus musculus
tatacgtgtatatatgtatgtgt

SEQ ID NO: 196699 - DNA, 23 bp, Mus musculus
tctgcaattcagagcagcttaca

SEQ ID NO: 196700 - DNA, 23 bp, Mus musculus
gtatatatgtatggatgtgtgtg

SEQ ID NO: 196701 - DNA, 19 bp, Mus musculus
actgtcccagtctggcccc

SEQ ID NO: 196702 - DNA, 22 bp, Mus musculus
tgactgttgagtgagtgcttag

SEQ ID NO: 196703 - DNA, 19 bp, Mus musculus
tctcaagttcacacagcaa

SEQ ID NO: 196704 - DNA, 21 bp, Mus musculus
cagtgactctcagaccctctg

SEQ ID NO: 196705 - DNA, 21 bp, Mus musculus
tcttgtctctagcctgtgact

SEQ ID NO: 196706 - DNA, 23 bp, Mus musculus
tgaggcgcagagttagtaggtag

SEQ ID NO: 196707 - DNA, 23 bp, Mus musculus
ctcaggaactttgatcatagcac

SEQ ID NO: 196708 - DNA, 20 bp, Mus musculus
cagtgaggtgtctgtcgtct

SEQ ID NO: 196709 - DNA, 22 bp, Mus musculus
atatgagtatatgtgtatatgt

SEQ ID NO: 196710 - DNA, 22 bp, Mus musculus
tgttttgtgaccaattatatgg

SEQ ID NO: 196711 - DNA, 22 bp, Mus musculus
ataactgacatcagagctggtg

SEQ ID NO: 196712 - DNA, 19 bp, Mus musculus
tatgtgtatatgtatatga

SEQ ID NO: 196713 - DNA, 23 bp, Mus musculus
tgtgtatgtatgtatatgtgtgt

SEQ ID NO: 196714 - DNA, 22 bp, Mus musculus
tattttgtgaccaattatatgg

SEQ ID NO: 196715 - DNA, 23 bp, Mus musculus
taggcttcagaggtataacctta

SEQ ID NO: 196716 - DNA, 23 bp, Mus musculus
ttgtattttagatttgtctaggt

SEQ ID NO: 196717 - DNA, 23 bp, Mus musculus
tataatttacataatgttgtatt

SEQ ID NO: 196718 - DNA, 23 bp, Mus musculus
aagagcacaagcttgagccacca

SEQ ID NO: 196719 - DNA, 20 bp, Mus musculus
gtgtgcgagagagagagaga

SEQ ID NO: 196720 - DNA, 22 bp, Mus musculus
tgttttgtgaccaattatatgg

SEQ ID NO: 196721 - DNA, 23 bp, Mus musculus
ggccactgtctgtctctctgctt

SEQ ID NO: 196722 - DNA, 23 bp, Mus musculus
ttgttctgcgcattgactttccc

SEQ ID NO: 196723 - DNA, 23 bp, Mus musculus
tgtatatatgtatgtatgcatgt

SEQ ID NO: 196724 - DNA, 21 bp, Mus musculus
tattggcatgtgtatgtgaat

SEQ ID NO: 196725 - DNA, 22 bp, Mus musculus
ataagtatgtgtgttcatatat

SEQ ID NO: 196726 - DNA, 21 bp, Mus musculus
attcactgagtctctaatttg

SEQ ID NO: 196727 - DNA, 23 bp, Mus musculus
tgactcagtggttaagagcactg

SEQ ID NO: 196728 - DNA, 23 bp, Mus musculus
aatgtatatgtagttgtgaaagg

SEQ ID NO: 196729 - DNA, 23 bp, Mus musculus
atattgtacatatatatatgtgt

SEQ ID NO: 196730 - DNA, 21 bp, Mus musculus
ttatgtatgtacatatgtatg

SEQ ID NO: 196731 - DNA, 23 bp, Mus musculus
gtgttgtctgtggttttcagagt

SEQ ID NO: 196732 - DNA, 21 bp, Mus musculus
aactgagtttgtaaatgaatc

SEQ ID NO: 196733 - DNA, 18 bp, Mus musculus
ctgagtgagtttggtggt

SEQ ID NO: 196734 - DNA, 18 bp, Mus musculus
tgtgtgtgcaaagtgtat

SEQ ID NO: 196735 - DNA, 23 bp, Mus musculus
tgtatgtgcatgtgtatatgtgt

SEQ ID NO: 196736 - DNA, 20 bp, Mus musculus
agagacgagacagaggacac

SEQ ID NO: 196737 - DNA, 19 bp, Mus musculus
aactgcttgttctttacct

SEQ ID NO: 196738 - DNA, 19 bp, Mus musculus
tgatttcatgttacaccta

SEQ ID NO: 196739 - DNA, 20 bp, Mus musculus
agatatgagcctccagcata

SEQ ID NO: 196740 - DNA, 23 bp, Mus musculus
aggttttactgttagcatttaat

SEQ ID NO: 196741 - DNA, 23 bp, Mus musculus
ggaagcttctaaggtagtaagtt

SEQ ID NO: 196742 - DNA, 23 bp, Mus musculus
ctcagaatacagactggacttgc

SEQ ID NO: 196743 - DNA, 23 bp, Mus musculus
tcagcctcagtctcactatatgc

SEQ ID NO: 196744 - DNA, 23 bp, Mus musculus
tgactcagtggttaagagcactg

SEQ ID NO: 196745 - DNA, 21 bp, Mus musculus
agtctctcactgaaactggag

SEQ ID NO: 196746 - DNA, 20 bp, Mus musculus
tgtgtgtgcatgtgcatgtg

SEQ ID NO: 196747 - DNA, 23 bp, Mus musculus
gagttgtgattttcttgttacca

SEQ ID NO: 196748 - DNA, 23 bp, Mus musculus
atcagctatggaattgagtccct

SEQ ID NO: 196749 - DNA, 23 bp, Mus musculus
gtgtgtgtgtgtgcatgtgtgaa

SEQ ID NO: 196750 - DNA, 23 bp, Mus musculus
gtgtacactttgtatatgtatgc

SEQ ID NO: 196751 - DNA, 22 bp, Mus musculus
aagcctctctctaattctctgt

SEQ ID NO: 196752 - DNA, 19 bp, Mus musculus
atacagtttatgtatatat

SEQ ID NO: 196753 - DNA, 23 bp, Mus musculus
tcacactcacagtgactcagaat

SEQ ID NO: 196754 - DNA, 22 bp, Mus musculus
tgtgcacatgtgcgtgtgtgca

SEQ ID NO: 196755 - DNA, 23 bp, Mus musculus
acacacacacacacacatttcag

SEQ ID NO: 196756 - DNA, 23 bp, Mus musculus
aatgtcctagtatgtgggtttct

SEQ ID NO: 196757 - DNA, 22 bp, Mus musculus
atgtgagaataaagagagcagt

SEQ ID NO: 196758 - DNA, 23 bp, Mus musculus
tgtatgtatgtatgtatgtatgt

SEQ ID NO: 196759 - DNA, 23 bp, Mus musculus
agacttgtggaaggactttggaa

SEQ ID NO: 196760 - DNA, 21 bp, Mus musculus
tccatggtggtctgataggat

SEQ ID NO: 196761 - DNA, 23 bp, Mus musculus
actcagggtctctgacactcact

SEQ ID NO: 196762 - DNA, 23 bp, Mus musculus
gactcactttcagtctgcctgtg

SEQ ID NO: 196763 - DNA, 20 bp, Mus musculus
tacccatacacacacatata

SEQ ID NO: 196764 - DNA, 22 bp, Mus musculus
catcacactcattcagtctctc

SEQ ID NO: 196765 - DNA, 23 bp, Mus musculus
ggctcagtctgtgactccttcac

SEQ ID NO: 196766 - DNA, 23 bp, Mus musculus
atgtgtgtgtgtgtatgtatata

SEQ ID NO: 196767 - DNA, 23 bp, Mus musculus
ctgtgtctgtgtgtctgtccttt

SEQ ID NO: 196768 - DNA, 23 bp, Mus musculus
ggtctctgacagttgtgggtcag

SEQ ID NO: 196769 - DNA, 21 bp, Mus musculus
tactgagactctgtctcaaag

SEQ ID NO: 196770 - DNA, 23 bp, Mus musculus
agccagtgttcagatgtgtgtgt

SEQ ID NO: 196771 - DNA, 21 bp, Mus musculus
tgtgatctgagtgtggtcaca

SEQ ID NO: 196772 - DNA, 20 bp, Mus musculus
aagtgaactgtgagtgcaca

SEQ ID NO: 196773 - DNA, 19 bp, Mus musculus
tgtatgcatgtatatatgt

SEQ ID NO: 196774 - DNA, 22 bp, Mus musculus
agtccgtggtgatcagatagga

SEQ ID NO: 196775 - DNA, 22 bp, Mus musculus
tgttttgtgaccaactatatgg

SEQ ID NO: 196776 - DNA, 23 bp, Mus musculus
agagagacaagcaagtgagctca

SEQ ID NO: 196777 - DNA, 22 bp, Mus musculus
ggagctttatcttactgtatct

SEQ ID NO: 196778 - DNA, 18 bp, Mus musculus
tgctgagtgaggttgctt

SEQ ID NO: 196779 - DNA, 23 bp, Mus musculus
tgacttcacacacactgagcctg

SEQ ID NO: 196780 - DNA, 23 bp, Mus musculus
tgtctgtcagtgtgtctgagcca

SEQ ID NO: 196781 - DNA, 23 bp, Mus musculus
tatcactgggaagtttgtagagg

SEQ ID NO: 196782 - DNA, 22 bp, Mus musculus
tcacaggtagagcaagagctta

SEQ ID NO: 196783 - DNA, 23 bp, Mus musculus
agatggcagtgggacacttgtgg

SEQ ID NO: 196784 - DNA, 23 bp, Mus musculus
tcacagctctggcacaaagctga

SEQ ID NO: 196785 - DNA, 23 bp, Mus musculus
atatgtatgtatatgtatgtgta

SEQ ID NO: 196786 - DNA, 20 bp, Mus musculus
cagagactctaagctcaggc

SEQ ID NO: 196787 - DNA, 23 bp, Mus musculus
acacagtgcttgtagaattgggt

SEQ ID NO: 196788 - DNA, 23 bp, Mus musculus
tgtctgtgtgtctctgtgagtgt

SEQ ID NO: 196789 - DNA, 23 bp, Mus musculus
agctcactgtagaaagagaggtg

SEQ ID NO: 196790 - DNA, 23 bp, Mus musculus
aaagggtggctctgtctgtctgt

SEQ ID NO: 196791 - DNA, 23 bp, Mus musculus
atcactgagtggaaatcttctgg

SEQ ID NO: 196792 - DNA, 23 bp, Mus musculus
tgatgaaaacccagacattcttt

SEQ ID NO: 196793 - DNA, 18 bp, Mus musculus
cagtacatctatatatct

SEQ ID NO: 196794 - DNA, 23 bp, Mus musculus
cacacactgtgagcttacctata

SEQ ID NO: 196795 - DNA, 20 bp, Mus musculus
agtcagttgccaggagcatt

SEQ ID NO: 196796 - DNA, 23 bp, Mus musculus
ctctctgagactctctgtggccc

SEQ ID NO: 196797 - DNA, 23 bp, Mus musculus
tgaggtgactctgtctgtgccac

SEQ ID NO: 196798 - DNA, 23 bp, Mus musculus
ggcactgactgctcttccagagg

SEQ ID NO: 196799 - DNA, 18 bp, Mus musculus
agagggaaacccacagtt

SEQ ID NO: 196800 - DNA, 23 bp, Mus musculus
tgtgcatgtgcacgtgcatgtgc

SEQ ID NO: 196801 - DNA, 22 bp, Mus musculus
tcacacactcatgcacacacac

SEQ ID NO: 196802 - DNA, 23 bp, Mus musculus
accatatgtatatgtatatatgt

SEQ ID NO: 196803 - DNA, 18 bp, Mus musculus
atgcatgtgtgtgtgtat

SEQ ID NO: 196804 - DNA, 21 bp, Mus musculus
tgtcacagtggcagtgtagtc

SEQ ID NO: 196805 - DNA, 21 bp, Mus musculus
agacagagcagtgtgaccaca

SEQ ID NO: 196806 - DNA, 23 bp, Mus musculus
tatgtatgtatgtatgtatgtgt

SEQ ID NO: 196807 - DNA, 23 bp, Mus musculus
tctttagctcttcactcagttgc

SEQ ID NO: 196808 - DNA, 23 bp, Mus musculus
ttctgggtctgtctgtctctgcc

SEQ ID NO: 196809 - DNA, 23 bp, Mus musculus
ctgtctgtctgtctgtgcctgtg

SEQ ID NO: 196810 - DNA, 20 bp, Mus musculus
agtttgttgaatctgcagat

SEQ ID NO: 196811 - DNA, 23 bp, Mus musculus
acactctgtctctctctcatctg

SEQ ID NO: 196812 - DNA, 22 bp, Mus musculus
tgttttgtgaccaattatatgg

SEQ ID NO: 196813 - DNA, 22 bp, Mus musculus
tggaaagcaaagaagtaagcag

SEQ ID NO: 196814 - DNA, 23 bp, Mus musculus
cactctggctgtgacactggtct

SEQ ID NO: 196815 - DNA, 23 bp, Mus musculus
gacatatccatgcatgtgtgtcc

SEQ ID NO: 196816 - DNA, 23 bp, Mus musculus
tctctgtgtctgtgtgtctgtct

SEQ ID NO: 196817 - DNA, 23 bp, Mus musculus
ctaagtggatgtcaattgtaaag

SEQ ID NO: 196818 - DNA, 20 bp, Mus musculus
agaccatggtgttgacaagt

SEQ ID NO: 196819 - DNA, 19 bp, Mus musculus
ttggtcagaggacaacagt

SEQ ID NO: 196820 - DNA, 22 bp, Mus musculus
ccagtctgtgggtctctgtgcc

SEQ ID NO: 196821 - DNA, 22 bp, Mus musculus
tgttttgtgaccaattatatgg

SEQ ID NO: 196822 - DNA, 23 bp, Mus musculus
atgagagtagcttaacacatcat

SEQ ID NO: 196823 - DNA, 23 bp, Mus musculus
tgtgtgtgtgtgtatatatacac

SEQ ID NO: 196824 - DNA, 21 bp, Mus musculus
tatgtatgtatgtatgtatgt

SEQ ID NO: 196825 - DNA, 22 bp, Mus musculus
tgttttgtgaccaattatatgg

SEQ ID NO: 196826 - DNA, 22 bp, Mus musculus
tgttttgtgaccaattatatgg

SEQ ID NO: 196827 - DNA, 22 bp, Mus musculus
tgttttgtgaccaattatatgg

SEQ ID NO: 196828 - DNA, 19 bp, Mus musculus
tactgctggttttctttgg

SEQ ID NO: 196829 - DNA, 20 bp, Mus musculus
tctactctctttctgtctct

SEQ ID NO: 196830 - DNA, 22 bp, Mus musculus
tgttttgtgaccaattatatgg

SEQ ID NO: 196831 - DNA, 21 bp, Mus musculus
tccagcttttttattcagact

SEQ ID NO: 196832 - DNA, 23 bp, Mus musculus
tatctatgtatatgtatgtatgt

SEQ ID NO: 196833 - DNA, 19 bp, Mus musculus
catggtggtctgataggat

SEQ ID NO: 196834 - DNA, 22 bp, Mus musculus
tgttttgtgaccaattatatgg

SEQ ID NO: 196835 - DNA, 20 bp, Mus musculus
aacagctacaacaaatatac

SEQ ID NO: 196836 - DNA, 22 bp, Mus musculus
tatgtgtgcatatttgtgtgta

SEQ ID NO: 196837 - DNA, 19 bp, Mus musculus
tatatgcatatatacacat

SEQ ID NO: 196838 - DNA, 22 bp, Mus musculus
cctgatctagccaaagcctgac

SEQ ID NO: 196839 - DNA, 23 bp, Mus musculus
agtgacagagtgtgtctcaaata

SEQ ID NO: 196840 - DNA, 23 bp, Mus musculus
tgatctagccaaagcctgactgt

SEQ ID NO: 196841 - DNA, 23 bp, Mus musculus
tgtttgtctatgtgcatgtatat

SEQ ID NO: 196842 - DNA, 22 bp, Mus musculus
tatgtctgtgtttaggtgtgtg

SEQ ID NO: 196843 - DNA, 23 bp, Mus musculus
tatatgtatatgtgtatatgtgt

SEQ ID NO: 196844 - DNA, 23 bp, Mus musculus
gtatgtatgtatgtatgtatgta

SEQ ID NO: 196845 - DNA, 21 bp, Mus musculus
tctatttatctatctatatct

SEQ ID NO: 196846 - DNA, 20 bp, Mus musculus
tatatagatagatatagata

SEQ ID NO: 196847 - DNA, 23 bp, Mus musculus
tggcagagtcttcagtgttgctt

SEQ ID NO: 196848 - DNA, 21 bp, Mus musculus
aatgtgcatatatatatgtat

SEQ ID NO: 196849 - DNA, 21 bp, Mus musculus
atgtgttgagacctgttttgt

SEQ ID NO: 196850 - DNA, 23 bp, Mus musculus
atgaagactagagtttttgttct

SEQ ID NO: 196851 - DNA, 19 bp, Mus musculus
tgactatctgcttttctcg

SEQ ID NO: 196852 - DNA, 22 bp, Mus musculus
tgttttgtgaccaattatatgg

SEQ ID NO: 196853 - DNA, 23 bp, Mus musculus
aaatagtcattttctttttgtgt

SEQ ID NO: 196854 - DNA, 23 bp, Mus musculus
gtggctggtataggaagctgaat

SEQ ID NO: 196855 - DNA, 21 bp, Mus musculus
atgtgtacatatatatgtgta

SEQ ID NO: 196856 - DNA, 21 bp, Mus musculus
agaccatttgcttggaaaatt

SEQ ID NO: 196857 - DNA, 22 bp, Mus musculus
tgttttgtgaccaattatatgg

SEQ ID NO: 196858 - DNA, 22 bp, Mus musculus
tctctctaactcatatgctgct

SEQ ID NO: 196859 - DNA, 23 bp, Mus musculus
tcatctgagtagtgtgtgaggaa

SEQ ID NO: 196860 - DNA, 21 bp, Mus musculus
atgtgtatgtatatgtagggg

SEQ ID NO: 196861 - DNA, 23 bp, Mus musculus
tctggatttgatttctagtgcta

SEQ ID NO: 196862 - DNA, 23 bp, Mus musculus
atattaagtgcaaagggaggcct

SEQ ID NO: 196863 - DNA, 22 bp, Mus musculus
agtgggtcactgtctctttctg

SEQ ID NO: 196864 - DNA, 22 bp, Mus musculus
ttacagcatatggattctctct

SEQ ID NO: 196865 - DNA, 23 bp, Mus musculus
attctcactgctggtagaaatgt

SEQ ID NO: 196866 - DNA, 22 bp, Mus musculus
tgagatgttttctctgctttgt

SEQ ID NO: 196867 - DNA, 21 bp, Mus musculus
tcttgtgttttttagttgaac

SEQ ID NO: 196868 - DNA, 22 bp, Mus musculus
tgttttgtgaccaattatatgg

SEQ ID NO: 196869 - DNA, 23 bp, Mus musculus
gagagaagtcacagaggctctcc

SEQ ID NO: 196870 - DNA, 22 bp, Mus musculus
tatgtgtgtatatatgtatgtg

SEQ ID NO: 196871 - DNA, 23 bp, Mus musculus
ccacttcagtctctgtgagcccc

SEQ ID NO: 196872 - DNA, 21 bp, Mus musculus
tgcttagttgactcatccaga

SEQ ID NO: 196873 - DNA, 19 bp, Mus musculus
atttttgttgttctcttag

SEQ ID NO: 196874 - DNA, 22 bp, Mus musculus
tgtgtatatgtatgtatatgta

SEQ ID NO: 196875 - DNA, 21 bp, Mus musculus
acactcatgcactctgtctct

SEQ ID NO: 196876 - DNA, 23 bp, Mus musculus
tgtgtgtatgtatatatgtgtat

SEQ ID NO: 196877 - DNA, 23 bp, Mus musculus
tctctctgacatattcttgaaat

SEQ ID NO: 196878 - DNA, 22 bp, Mus musculus
tgttttgtgaccaattatatgg

SEQ ID NO: 196879 - DNA, 21 bp, Mus musculus
tttcttgtatttcctttgaaa

SEQ ID NO: 196880 - DNA, 19 bp, Mus musculus
tcccaacagttggagcaga

SEQ ID NO: 196881 - DNA, 23 bp, Mus musculus
cttgctgagtgaggagacagagc

SEQ ID NO: 196882 - DNA, 19 bp, Mus musculus
aaaaatgctgttattgggc

SEQ ID NO: 196883 - DNA, 22 bp, Mus musculus
tgttttgtgaccaattatatgg

SEQ ID NO: 196884 - DNA, 23 bp, Mus musculus
tagttgggtctacttgtgtttct

SEQ ID NO: 196885 - DNA, 22 bp, Mus musculus
atgtatatgtgtgtatatatgt

SEQ ID NO: 196886 - DNA, 22 bp, Mus musculus
atgtatatgtgtgtatatatgt

SEQ ID NO: 196887 - DNA, 23 bp, Mus musculus
attgtttagtccttatgtagtct

SEQ ID NO: 196888 - DNA, 22 bp, Mus musculus
ctctggttgtgtctagaagttg

SEQ ID NO: 196889 - DNA, 19 bp, Mus musculus
agaattgtctgtatattta

SEQ ID NO: 196890 - DNA, 22 bp, Mus musculus
tatgatggtagcaaatctgatc

SEQ ID NO: 196891 - DNA, 23 bp, Mus musculus
ctgtccattgatgagagtggcat

SEQ ID NO: 196892 - DNA, 22 bp, Mus musculus
ttgtgaggtctgttgtgtgcct

SEQ ID NO: 196893 - DNA, 18 bp, Mus musculus
tggctgcttaggatagct

SEQ ID NO: 196894 - DNA, 19 bp, Mus musculus
cagagaactcagtgagcag

SEQ ID NO: 196895 - DNA, 23 bp, Mus musculus
ctgttttgtagtgactgtttggt

SEQ ID NO: 196896 - DNA, 23 bp, Mus musculus
tgtctgtgtgcatgtcttgtggc

SEQ ID NO: 196897 - DNA, 21 bp, Mus musculus
tcccagagtggtgagctgact

SEQ ID NO: 196898 - DNA, 23 bp, Mus musculus
tttgtccaaccagtgtgtgtgtg

SEQ ID NO: 196899 - DNA, 19 bp, Mus musculus
tgtatttttgtgtatgtta

SEQ ID NO: 196900 - DNA, 23 bp, Mus musculus
atatgttgaaaagtattgaaaat

SEQ ID NO: 196901 - DNA, 21 bp, Mus musculus
ctgtgtatctatcttctgtca

SEQ ID NO: 196902 - DNA, 22 bp, Mus musculus
tgttttgtgaccaattatatgg

SEQ ID NO: 196903 - DNA, 21 bp, Mus musculus
tggtgatgcaggggaccaggt

SEQ ID NO: 196904 - DNA, 23 bp, Mus musculus
tcactacttgctcattctgtgtc

SEQ ID NO: 196905 - DNA, 23 bp, Mus musculus
tttgagtggcagtgatattgatg

SEQ ID NO: 196906 - DNA, 23 bp, Mus musculus
tgcttctgcttctgcttctgctt

SEQ ID NO: 196907 - DNA, 22 bp, Mus musculus
atgacacttgagactgtggact

SEQ ID NO: 196908 - DNA, 19 bp, Mus musculus
ttctcatgtgtaatttgtg

SEQ ID NO: 196909 - DNA, 19 bp, Mus musculus
cacagccatctgtaatggg

SEQ ID NO: 196910 - DNA, 21 bp, Mus musculus
tttgtgggttttgtacatgtg

SEQ ID NO: 196911 - DNA, 23 bp, Mus musculus
aggccatgatggtctgataggat

SEQ ID NO: 196912 - DNA, 23 bp, Mus musculus
agagagaagacacagaggttaca

SEQ ID NO: 196913 - DNA, 23 bp, Mus musculus
catggatttgaaatctgagttgt

SEQ ID NO: 196914 - DNA, 19 bp, Mus musculus
agtcactgaagggccagcc

SEQ ID NO: 196915 - DNA, 22 bp, Mus musculus
tgtctctgtgtatacatgcatg

SEQ ID NO: 196916 - DNA, 23 bp, Mus musculus
tgtatctgtatatgtttatgtgt

SEQ ID NO: 196917 - DNA, 23 bp, Mus musculus
tttcagattttgtttatgtgact

SEQ ID NO: 196918 - DNA, 23 bp, Mus musculus
tgtctctgactctgttacttgac

SEQ ID NO: 196919 - DNA, 22 bp, Mus musculus
gaaatcagtgagagctttcaag

SEQ ID NO: 196920 - DNA, 21 bp, Mus musculus
tgagtagtttgaattctgcag

SEQ ID NO: 196921 - DNA, 22 bp, Mus musculus
cttagcaaccctgcctgagtca

SEQ ID NO: 196922 - DNA, 19 bp, Mus musculus
tgtgcatgtatattggcca

SEQ ID NO: 196923 - DNA, 20 bp, Mus musculus
atagcatataccatatatgt

SEQ ID NO: 196924 - DNA, 22 bp, Mus musculus
actctgagtcagtgtatgaact

SEQ ID NO: 196925 - DNA, 22 bp, Mus musculus
tgttttgtgaccaattatatgg

SEQ ID NO: 196926 - DNA, 23 bp, Mus musculus
agtaaaaggagcagattggttca

SEQ ID NO: 196927 - DNA, 23 bp, Mus musculus
tatctatgtatatatatgtgtgt

SEQ ID NO: 196928 - DNA, 23 bp, Mus musculus
attccttcttcttcctggtatcc

SEQ ID NO: 196929 - DNA, 23 bp, Mus musculus
gtttgtatggttctgtgtgtaca

SEQ ID NO: 196930 - DNA, 23 bp, Mus musculus
ctatctctcacactccacctgga

SEQ ID NO: 196931 - DNA, 23 bp, Mus musculus
ttgtgaaccctcaagcagggtga

SEQ ID NO: 196932 - DNA, 18 bp, Mus musculus
cacactgtgaaagtgtgt

SEQ ID NO: 196933 - DNA, 23 bp, Mus musculus
ctcaaagagcaaccacttaggct

SEQ ID NO: 196934 - DNA, 23 bp, Mus musculus
gtatgtatgtatgtatgtatatg

SEQ ID NO: 196935 - DNA, 18 bp, Mus musculus
tgagttcaattctcagca

SEQ ID NO: 196936 - DNA, 23 bp, Mus musculus
tgtcttctaatcactgactctga

SEQ ID NO: 196937 - DNA, 20 bp, Mus musculus
tatatgtgtatatgtatacc

SEQ ID NO: 196938 - DNA, 20 bp, Mus musculus
ctcactggtaaaggtgcatg

SEQ ID NO: 196939 - DNA, 22 bp, Mus musculus
tgtatgtatgtgtgtatatata

SEQ ID NO: 196940 - DNA, 23 bp, Mus musculus
tgtatgtgtgtatatatatgtat

SEQ ID NO: 196941 - DNA, 23 bp, Mus musculus
tatatgtatatgtatatgtatgt

SEQ ID NO: 196942 - DNA, 23 bp, Mus musculus
ccctgtgacactgactctcgctc

SEQ ID NO: 196943 - DNA, 21 bp, Mus musculus
ctgtcttcgtcagggtcagtt

SEQ ID NO: 196944 - DNA, 23 bp, Mus musculus
caatatttttgtatctgttgagg

SEQ ID NO: 196945 - DNA, 22 bp, Mus musculus
tgtaaggacttgtaactcttta

SEQ ID NO: 196946 - DNA, 23 bp, Mus musculus
attaaagtccttcctgttgtcct

SEQ ID NO: 196947 - DNA, 23 bp, Mus musculus
gaaatcattggcacaggaaaagt

SEQ ID NO: 196948 - DNA, 23 bp, Mus musculus
ctgtgcctgtgtgtgtgcctgag

SEQ ID NO: 196949 - DNA, 23 bp, Mus musculus
tgacagtgcctgtgcctgtgtct

SEQ ID NO: 196950 - DNA, 23 bp, Mus musculus
gtgtgtgagtctgtgtgtctgtg

SEQ ID NO: 196951 - DNA, 18 bp, Mus musculus
atgtatgcatgtgtgtga

SEQ ID NO: 196952 - DNA, 20 bp, Mus musculus
tatgtgtgtgtgtgtgtgtg

SEQ ID NO: 196953 - DNA, 23 bp, Mus musculus
tcggtctgacactcccactgttg

SEQ ID NO: 196954 - DNA, 23 bp, Mus musculus
tgtatataggatacatatgtaca

SEQ ID NO: 196955 - DNA, 23 bp, Mus musculus
tgtatataggatacatatgtaca

SEQ ID NO: 196956 - DNA, 18 bp, Mus musculus
tcactttctcaaaaagcc

SEQ ID NO: 196957 - DNA, 23 bp, Mus musculus
ggcagttaagagagagcacttgc

SEQ ID NO: 196958 - DNA, 22 bp, Mus musculus
agatagttgtgagtcaccacat

SEQ ID NO: 196959 - DNA, 22 bp, Mus musculus
taagagtgcctagtgttgggga

SEQ ID NO: 196960 - DNA, 23 bp, Mus musculus
cctagctgtctgtttctctctgc

SEQ ID NO: 196961 - DNA, 23 bp, Mus musculus
gggtgtgtctgtctgtgtctgtg

SEQ ID NO: 196962 - DNA, 20 bp, Mus musculus
ctcactctatgtctctggag

SEQ ID NO: 196963 - DNA, 23 bp, Mus musculus
ctcacagagatctgacagacacc

SEQ ID NO: 196964 - DNA, 20 bp, Mus musculus
tggctcagtggttaggagca

SEQ ID NO: 196965 - DNA, 23 bp, Mus musculus
gtcgccctctgtgcctctgtgca

SEQ ID NO: 196966 - DNA, 23 bp, Mus musculus
ctctgagactcagaattcagagt

SEQ ID NO: 196967 - DNA, 23 bp, Mus musculus
tgtatctctgtctctgtctctat

SEQ ID NO: 196968 - DNA, 23 bp, Mus musculus
gcaacagagattcctgttggtga

SEQ ID NO: 196969 - DNA, 20 bp, Mus musculus
ctgtgtgttgtgactaccag

SEQ ID NO: 196970 - DNA, 23 bp, Mus musculus
gtatgtgtgtatgcatgtacata

SEQ ID NO: 196971 - DNA, 18 bp, Mus musculus
gtatgtatgtatgtatgt

SEQ ID NO: 196972 - DNA, 21 bp, Mus musculus
tgtcagcagtagggatgctga

SEQ ID NO: 196973 - DNA, 23 bp, Mus musculus
agtcacaccctcccactgtctga

SEQ ID NO: 196974 - DNA, 22 bp, Mus musculus
atcacatgcatgcatgtgtgtc

SEQ ID NO: 196975 - DNA, 23 bp, Mus musculus
ctcagttaccaactgtctccgat

SEQ ID NO: 196976 - DNA, 23 bp, Mus musculus
tgtatgagcatctgcatctgtgt

SEQ ID NO: 196977 - DNA, 21 bp, Mus musculus
tctgagtctgtttctgtgtgc

SEQ ID NO: 196978 - DNA, 18 bp, Mus musculus
ctgtctttctctgaggca

SEQ ID NO: 196979 - DNA, 22 bp, Mus musculus
ctgtgacaaaacactgtgacca

SEQ ID NO: 196980 - DNA, 22 bp, Mus musculus
tatgtatgtatgtatgtgtgtg

SEQ ID NO: 196981 - DNA, 19 bp, Mus musculus
tgtctctgactgttttctc

SEQ ID NO: 196982 - DNA, 22 bp, Mus musculus
ccctccctgactctctgcctct

SEQ ID NO: 196983 - DNA, 23 bp, Mus musculus
taagagcactgactgctcctcct

SEQ ID NO: 196984 - DNA, 23 bp, Mus musculus
agacactcactctcattaacaac

SEQ ID NO: 196985 - DNA, 23 bp, Mus musculus
gtgagatcacctggatctggagt

SEQ ID NO: 196986 - DNA, 23 bp, Mus musculus
agtagctggtcaggctctcttct

SEQ ID NO: 196987 - DNA, 23 bp, Mus musculus
tgcctgtgaccgcttgtgctgcc

SEQ ID NO: 196988 - DNA, 23 bp, Mus musculus
ctgtctgtctgtctgtctgtcta

SEQ ID NO: 196989 - DNA, 23 bp, Mus musculus
tagaactcactctgcagaccagg

SEQ ID NO: 196990 - DNA, 23 bp, Mus musculus
agtggctcactctctctctcttc

SEQ ID NO: 196991 - DNA, 21 bp, Mus musculus
gtccctctatctgtggctcca

SEQ ID NO: 196992 - DNA, 18 bp, Mus musculus
ctttctgtctctctgtcc

SEQ ID NO: 196993 - DNA, 23 bp, Mus musculus
agttatctctctgactctccttc

SEQ ID NO: 196994 - DNA, 18 bp, Mus musculus
agtcaaggtctggggctg

SEQ ID NO: 196995 - DNA, 19 bp, Mus musculus
ttcactaataccttcctta

SEQ ID NO: 196996 - DNA, 23 bp, Mus musculus
ttgcattgtcctctggatccagc

SEQ ID NO: 196997 - DNA, 21 bp, Mus musculus
tggctcgctccctgttcctgt

SEQ ID NO: 196998 - DNA, 20 bp, Mus musculus
tagagtgttgagagtgtaga

SEQ ID NO: 196999 - DNA, 23 bp, Mus musculus
ctcactctgtctgtccttgtgga

SEQ ID NO: 197000 - DNA, 19 bp, Mus musculus
gacagttgtgggtctggac

SEQ ID NO: 197001 - DNA, 23 bp, Mus musculus
gtgtgtctgtgtgtctgtcttca

SEQ ID NO: 197002 - DNA, 22 bp, Mus musculus
ttgaagcttgactcactgtggt

SEQ ID NO: 197003 - DNA, 23 bp, Mus musculus
gatcacagaactgagtgaccaca

SEQ ID NO: 197004 - DNA, 23 bp, Mus musculus
gtgtctgtctgtctgtcatgagt

SEQ ID NO: 197005 - DNA, 23 bp, Mus musculus
ttctacactagtgtatttgattt

SEQ ID NO: 197006 - DNA, 23 bp, Mus musculus
gagtatctgtctctgtgtttgtc

SEQ ID NO: 197007 - DNA, 20 bp, Mus musculus
tcacagaactgagtgacttg

SEQ ID NO: 197008 - DNA, 23 bp, Mus musculus
tagtctgtggtgatcttatagga

SEQ ID NO: 197009 - DNA, 19 bp, Mus musculus
tgttttgtcaccaattata

SEQ ID NO: 197010 - DNA, 23 bp, Mus musculus
tcactgagtctctgtttagtttc

SEQ ID NO: 197011 - DNA, 23 bp, Mus musculus
actgatgagagtgaggttttgaa

SEQ ID NO: 197012 - DNA, 22 bp, Mus musculus
tgttttgtgaccaattatatgg

SEQ ID NO: 197013 - DNA, 22 bp, Mus musculus
tgttttgtgaccaattatatgg

SEQ ID NO: 197014 - DNA, 23 bp, Mus musculus
acctccatgtgtactctttggtt

SEQ ID NO: 197015 - DNA, 20 bp, Mus musculus
aatcactgggagctttgagg

SEQ ID NO: 197016 - DNA, 23 bp, Mus musculus
tctctctgcctgtctgattggca

SEQ ID NO: 197017 - DNA, 23 bp, Mus musculus
tgatgagagtgaggattactttt

SEQ ID NO: 197018 - DNA, 22 bp, Mus musculus
ttcaagttcaatggcaattgat

SEQ ID NO: 197019 - DNA, 22 bp, Mus musculus
gtttgagatagcataaacttct

SEQ ID NO: 197020 - DNA, 23 bp, Mus musculus
aggaaaatactatctgtgcaggc

SEQ ID NO: 197021 - DNA, 23 bp, Mus musculus
tgtcagaagtgggtcactaggtg

SEQ ID NO: 197022 - DNA, 21 bp, Mus musculus
atcagtggattaatctgtgga

SEQ ID NO: 197023 - DNA, 23 bp, Mus musculus
agtggttttaggttgtgtacaaa

SEQ ID NO: 197024 - DNA, 21 bp, Mus musculus
acagagtctccacacatggcc

SEQ ID NO: 197025 - DNA, 23 bp, Mus musculus
agaagtgctttgttagtctgggg

SEQ ID NO: 197026 - DNA, 22 bp, Mus musculus
tgttttgtgaccaattatatgg

SEQ ID NO: 197027 - DNA, 19 bp, Mus musculus
atctctcagtttctccctc

SEQ ID NO: 197028 - DNA, 23 bp, Mus musculus
gtgctggctctcactgtgtcaat

SEQ ID NO: 197029 - DNA, 23 bp, Mus musculus
tctcagtggtagtagtttgttag

SEQ ID NO: 197030 - DNA, 23 bp, Mus musculus
agatgagtgatcagagtgtggag

SEQ ID NO: 197031 - DNA, 21 bp, Mus musculus
atcactatatatgtattgtgt

SEQ ID NO: 197032 - DNA, 23 bp, Mus musculus
tatgtgtgtgtattcatatgtca

SEQ ID NO: 197033 - DNA, 23 bp, Mus musculus
ctgggtctctgtttgcctgcttg

SEQ ID NO: 197034 - DNA, 22 bp, Mus musculus
ttcaggaagtaggttgcagagt

SEQ ID NO: 197035 - DNA, 23 bp, Mus musculus
cccagagtgactcactccctgag

SEQ ID NO: 197036 - DNA, 23 bp, Mus musculus
attgccactcactagggatatca

SEQ ID NO: 197037 - DNA, 19 bp, Mus musculus
tattcttaggaagcatgag

SEQ ID NO: 197038 - DNA, 23 bp, Mus musculus
ggtgtgtcactgtgtgtgtgggc

SEQ ID NO: 197039 - DNA, 23 bp, Mus musculus
tcaggtgtctgtctctcgctccc

SEQ ID NO: 197040 - DNA, 19 bp, Mus musculus
acagacagacagatcactg

SEQ ID NO: 197041 - DNA, 19 bp, Mus musculus
ggtgtgtgttaggagtatg

SEQ ID NO: 197042 - DNA, 23 bp, Mus musculus
tgtcttctctctctgtgtcccca

SEQ ID NO: 197043 - DNA, 21 bp, Mus musculus
aagcagagagaagagactctc

SEQ ID NO: 197044 - DNA, 18 bp, Mus musculus
tatgtgtatatattcaca

SEQ ID NO: 197045 - DNA, 20 bp, Mus musculus
attcaggttacggagctgca

SEQ ID NO: 197046 - DNA, 23 bp, Mus musculus
ctgtctctgtctgtctgtctggt

SEQ ID NO: 197047 - DNA, 23 bp, Mus musculus
gtatgtatgtatatatgtatgta

SEQ ID NO: 197048 - DNA, 23 bp, Mus musculus
ctcccgctgtctctctgccactg

SEQ ID NO: 197049 - DNA, 21 bp, Mus musculus
tgtgcatatacatgcatttgt

SEQ ID NO: 197050 - DNA, 20 bp, Mus musculus
tatgcatttgtatatatgta

SEQ ID NO: 197051 - DNA, 23 bp, Mus musculus
atatgtgtatatgtatatgtgtg

SEQ ID NO: 197052 - DNA, 23 bp, Mus musculus
tcacactctctgccagtcatctc

SEQ ID NO: 197053 - DNA, 21 bp, Mus musculus
taccagcatgagaaaagagag

SEQ ID NO: 197054 - DNA, 23 bp, Mus musculus
tgaagctgtcagtctgtggctct

SEQ ID NO: 197055 - DNA, 23 bp, Mus musculus
actctctgtgcctcagtgtcttc

SEQ ID NO: 197056 - DNA, 18 bp, Mus musculus
tggagagaaagtttgttg

SEQ ID NO: 197057 - DNA, 22 bp, Mus musculus
gtctggctggctaagcagtgcc

SEQ ID NO: 197058 - DNA, 23 bp, Mus musculus
gtctgtctctgtctgtgcttggg

SEQ ID NO: 197059 - DNA, 21 bp, Mus musculus
tgtgtgtgtgagtgtctgtgt

SEQ ID NO: 197060 - DNA, 19 bp, Mus musculus
atgtgtgtgcatgtgcatg

SEQ ID NO: 197061 - DNA, 23 bp, Mus musculus
tctcttgctctcagtgtcctggc

SEQ ID NO: 197062 - DNA, 19 bp, Mus musculus
tgtatatacactatgtatg

SEQ ID NO: 197063 - DNA, 21 bp, Mus musculus
gaagaagtaggttgcttagga

SEQ ID NO: 197064 - DNA, 23 bp, Mus musculus
gagtctcactggctgtgtttatg

SEQ ID NO: 197065 - DNA, 19 bp, Mus musculus
gacagacgtagagttgtcc

SEQ ID NO: 197066 - DNA, 22 bp, Mus musculus
gtgacatcacaggctggagaga

SEQ ID NO: 197067 - DNA, 23 bp, Mus musculus
acactctgtccctgtgagcctgc

SEQ ID NO: 197068 - DNA, 23 bp, Mus musculus
acagtctctctgaccctcggttt

SEQ ID NO: 197069 - DNA, 23 bp, Mus musculus
tggaactggacttaggttgtgag

SEQ ID NO: 197070 - DNA, 23 bp, Mus musculus
tatgtactgattttgttgttttg

SEQ ID NO: 197071 - DNA, 23 bp, Mus musculus
tcacggtggctcgctggatggct

SEQ ID NO: 197072 - DNA, 23 bp, Mus musculus
ctggctgtctggctggctgtctg

SEQ ID NO: 197073 - DNA, 23 bp, Mus musculus
ttggctgtcctagaactcactct

SEQ ID NO: 197074 - DNA, 23 bp, Mus musculus
ctctgactctgactctctctctc

SEQ ID NO: 197075 - DNA, 20 bp, Mus musculus
aagagcactgactgctcttc

SEQ ID NO: 197076 - DNA, 23 bp, Mus musculus
tatgtatatgtatatatgtgtgt

SEQ ID NO: 197077 - DNA, 21 bp, Mus musculus
atatggatatagatgtataca

SEQ ID NO: 197078 - DNA, 23 bp, Mus musculus
tgaagaagtttctagatagggtt

SEQ ID NO: 197079 - DNA, 20 bp, Mus musculus
taagcttgtagttggagctg

SEQ ID NO: 197080 - DNA, 23 bp, Mus musculus
cactctgtctctctgccagcccc

SEQ ID NO: 197081 - DNA, 23 bp, Mus musculus
gctcacagggtgtaagttcctgc

SEQ ID NO: 197082 - DNA, 21 bp, Mus musculus
attctggttttagttttagca

SEQ ID NO: 197083 - DNA, 23 bp, Mus musculus
tgcagatttgagtgtgagcacag

SEQ ID NO: 197084 - DNA, 20 bp, Mus musculus
agactgtggggtttgttttt

SEQ ID NO: 197085 - DNA, 19 bp, Mus musculus
cagagtacacagtgaccag

SEQ ID NO: 197086 - DNA, 23 bp, Mus musculus
catgcagtgcttgtagataccag

SEQ ID NO: 197087 - DNA, 19 bp, Mus musculus
tccgggcctgattatctag

SEQ ID NO: 197088 - DNA, 23 bp, Mus musculus
gaatgtctgtgtgtgtgtgagaa

SEQ ID NO: 197089 - DNA, 23 bp, Mus musculus
atgtatgagtatgtgcatatgca

SEQ ID NO: 197090 - DNA, 22 bp, Mus musculus
acacactaaagtgtgaccagag

SEQ ID NO: 197091 - DNA, 21 bp, Mus musculus
acagactctcagctatccact

SEQ ID NO: 197092 - DNA, 23 bp, Mus musculus
tatctgtctgcctctgcctctca

SEQ ID NO: 197093 - DNA, 23 bp, Mus musculus
taagttttcttgaataattttct

SEQ ID NO: 197094 - DNA, 23 bp, Mus musculus
tacacacacacacatacatgtat

SEQ ID NO: 197095 - DNA, 21 bp, Mus musculus
tgagcttcaggtgcaggagct

SEQ ID NO: 197096 - DNA, 23 bp, Mus musculus
tgtgtgtgtatatgtatgtctat

SEQ ID NO: 197097 - DNA, 23 bp, Mus musculus
tgtgtgtatgtatgtatatgtgt

SEQ ID NO: 197098 - DNA, 23 bp, Mus musculus
aaggctctgggtctgtcagtgtc

SEQ ID NO: 197099 - DNA, 18 bp, Mus musculus
cacagagacaactttcca

SEQ ID NO: 197100 - DNA, 22 bp, Mus musculus
tgttttgtgaccaattatatgg

SEQ ID NO: 197101 - DNA, 22 bp, Mus musculus
tgttttgtgaccaattatatgg

SEQ ID NO: 197102 - DNA, 22 bp, Mus musculus
tgttttgtgaccaattatatgg

SEQ ID NO: 197103 - DNA, 20 bp, Mus musculus
tcacagaactgagtgacttg

SEQ ID NO: 197104 - DNA, 23 bp, Mus musculus
tctgttcatgtgtttgtgtactt

SEQ ID NO: 197105 - DNA, 23 bp, Mus musculus
tctcacaatgtcactccatcata

SEQ ID NO: 197106 - DNA, 23 bp, Mus musculus
tcacagtagagtgtcaggtaggc

SEQ ID NO: 197107 - DNA, 23 bp, Mus musculus
caatatttttgtatctgttgagg

SEQ ID NO: 197108 - DNA, 23 bp, Mus musculus
tgttttgtgaccaattatatgga

SEQ ID NO: 197109 - DNA, 18 bp, Mus musculus
aattcttcaggctctgtt

SEQ ID NO: 197110 - DNA, 22 bp, Mus musculus
aattgtcataatgttattcaat

SEQ ID NO: 197111 - DNA, 22 bp, Mus musculus
aattgtcataatgttattcaat

SEQ ID NO: 197112 - DNA, 23 bp, Mus musculus
tctgtggtgatctgataggatgc

SEQ ID NO: 197113 - DNA, 23 bp, Mus musculus
tgttttgtaaccaattctatggt

SEQ ID NO: 197114 - DNA, 23 bp, Mus musculus
agtctctatgtgtctggttaggg

SEQ ID NO: 197115 - DNA, 22 bp, Mus musculus
aacagggtacatggtcagcatg

SEQ ID NO: 197116 - DNA, 21 bp, Mus musculus
ctgagccaagtcactctctgt

SEQ ID NO: 197117 - DNA, 23 bp, Mus musculus
ggacactgagtattctctatcac

SEQ ID NO: 197118 - DNA, 22 bp, Mus musculus
ggaagagcaaccagtgctctta

SEQ ID NO: 197119 - DNA, 23 bp, Mus musculus
atggtttagagcacttactgctc

SEQ ID NO: 197120 - DNA, 23 bp, Mus musculus
tcaggtatcagtgtcagcacaga

SEQ ID NO: 197121 - DNA, 18 bp, Mus musculus
tgaggctgcctgacctgc

SEQ ID NO: 197122 - DNA, 23 bp, Mus musculus
tgtatatgcatatgtatctgtat

SEQ ID NO: 197123 - DNA, 21 bp, Mus musculus
gtctcacagagtctgtctggc

SEQ ID NO: 197124 - DNA, 21 bp, Mus musculus
tagagactacagtgtgtcctg

SEQ ID NO: 197125 - DNA, 23 bp, Mus musculus
tgtctgtctgcctgcctgcctgc

SEQ ID NO: 197126 - DNA, 23 bp, Mus musculus
gtgtgtgtatatatatatgtgtg

SEQ ID NO: 197127 - DNA, 23 bp, Mus musculus
atatgtacaatactgtatgtata

SEQ ID NO: 197128 - DNA, 23 bp, Mus musculus
tgtatgatgatgatgtatgcatg

SEQ ID NO: 197129 - DNA, 18 bp, Mus musculus
ccttagttttgagatagg

SEQ ID NO: 197130 - DNA, 21 bp, Mus musculus
ctgtctctgactccctggcac

SEQ ID NO: 197131 - DNA, 19 bp, Mus musculus
tcactccttgtgcataact

SEQ ID NO: 197132 - DNA, 20 bp, Mus musculus
tctgcagtggggctggagag

SEQ ID NO: 197133 - DNA, 23 bp, Mus musculus
gtatgtatgtgtgtatgtgtatg

SEQ ID NO: 197134 - DNA, 23 bp, Mus musculus
gtatgtatgtatgtgtgtatact

SEQ ID NO: 197135 - DNA, 23 bp, Mus musculus
tgcagctgagtattgacagttgc

SEQ ID NO: 197136 - DNA, 23 bp, Mus musculus
ttttgtctctgagactctcacag

SEQ ID NO: 197137 - DNA, 22 bp, Mus musculus
tgttttgtgaccaattatatgg

SEQ ID NO: 197138 - DNA, 19 bp, Mus musculus
gtgtactctggctggagag

SEQ ID NO: 197139 - DNA, 21 bp, Mus musculus
atctgactgctcttccagagg

SEQ ID NO: 197140 - DNA, 18 bp, Mus musculus
ggagtgtctctctgtgag

SEQ ID NO: 197141 - DNA, 22 bp, Mus musculus
ttcacacacgctcactcacacg

SEQ ID NO: 197142 - DNA, 21 bp, Mus musculus
attagacaggggctggagaga

SEQ ID NO: 197143 - DNA, 18 bp, Mus musculus
agagcactgactgctcgt

SEQ ID NO: 197144 - DNA, 23 bp, Mus musculus
atctgtctgtctgtctgtctata

SEQ ID NO: 197145 - DNA, 23 bp, Mus musculus
tgcagctgagtattgacagttgc

SEQ ID NO: 197146 - DNA, 23 bp, Mus musculus
agcctctgtgagtgcctgtgagg

SEQ ID NO: 197147 - DNA, 23 bp, Mus musculus
tgtcctggaactcactctgtaga

SEQ ID NO: 197148 - DNA, 23 bp, Mus musculus
gagtgtctgtgtgtgtcagaccc

SEQ ID NO: 197149 - DNA, 23 bp, Mus musculus
gatctgagtgtctgcacactggg

SEQ ID NO: 197150 - DNA, 23 bp, Mus musculus
gagaactcagtgtgtaaagcacc

SEQ ID NO: 197151 - DNA, 23 bp, Mus musculus
gtcagtctgtccatgtctctttc

SEQ ID NO: 197152 - DNA, 23 bp, Mus musculus
gggactctcactgagcctgagct

SEQ ID NO: 197153 - DNA, 19 bp, Mus musculus
ttcagtagccctttcctgt

SEQ ID NO: 197154 - DNA, 23 bp, Mus musculus
tcactcagactgtgactgagctg

SEQ ID NO: 197155 - DNA, 23 bp, Mus musculus
gagatgactgtgagatcagatgg

SEQ ID NO: 197156 - DNA, 20 bp, Mus musculus
caaatgaaacacagcagagg

SEQ ID NO: 197157 - DNA, 23 bp, Mus musculus
ctgtctctgcctcagactgtgcc

SEQ ID NO: 197158 - DNA, 23 bp, Mus musculus
tcattgtctctgtctctccacag

SEQ ID NO: 197159 - DNA, 23 bp, Mus musculus
tcagaccttcatctccttcactg

SEQ ID NO: 197160 - DNA, 19 bp, Mus musculus
tccaggatccctttcctgt

SEQ ID NO: 197161 - DNA, 23 bp, Mus musculus
tgagagatatcagtgagcagtgt

SEQ ID NO: 197162 - DNA, 22 bp, Mus musculus
atctgtatatgtatatgtatgt

SEQ ID NO: 197163 - DNA, 23 bp, Mus musculus
gtatgtatatatgtatgtgtgtg

SEQ ID NO: 197164 - DNA, 20 bp, Mus musculus
tctggctcactcagccactc

SEQ ID NO: 197165 - DNA, 23 bp, Mus musculus
tactgacagttgtgagccaccac

SEQ ID NO: 197166 - DNA, 23 bp, Mus musculus
agaggctctctctgaatctggaa

SEQ ID NO: 197167 - DNA, 18 bp, Mus musculus
tctgcctgtctctgcctc

SEQ ID NO: 197168 - DNA, 18 bp, Mus musculus
cacactctttctatatat

SEQ ID NO: 197169 - DNA, 23 bp, Mus musculus
agaaagtgtgtgtacatgtgctt

SEQ ID NO: 197170 - DNA, 23 bp, Mus musculus
tgtcacccagtgtcactctgcct

SEQ ID NO: 197171 - DNA, 19 bp, Mus musculus
tagtcctagtttatgagct

SEQ ID NO: 197172 - DNA, 23 bp, Mus musculus
tcagtctcagtatctgaaaggcc

SEQ ID NO: 197173 - DNA, 18 bp, Mus musculus
gtagaggcagagagaata

SEQ ID NO: 197174 - DNA, 23 bp, Mus musculus
ctcaaattctctctgtctctggg

SEQ ID NO: 197175 - DNA, 23 bp, Mus musculus
tgtgtgtgtgttcatgcgtgtgt

SEQ ID NO: 197176 - DNA, 23 bp, Mus musculus
tatatgtatatatatatgtgtgt

SEQ ID NO: 197177 - DNA, 23 bp, Mus musculus
tctcctcctcactgactctgtcc

SEQ ID NO: 197178 - DNA, 20 bp, Mus musculus
acagggtcagaatgcagatg

SEQ ID NO: 197179 - DNA, 23 bp, Mus musculus
gtgacacagtctcactatctagt

SEQ ID NO: 197180 - DNA, 23 bp, Mus musculus
agtggaactctgtctcaacctct

SEQ ID NO: 197181 - DNA, 21 bp, Mus musculus
tatgagcatattttgtgtgtg

SEQ ID NO: 197182 - DNA, 23 bp, Mus musculus
ctggagttggccaggcagtcctc

SEQ ID NO: 197183 - DNA, 22 bp, Mus musculus
ctcgcacactgtgtgagtccca

SEQ ID NO: 197184 - DNA, 23 bp, Mus musculus
gtgtctgtcagtgattctgttct

SEQ ID NO: 197185 - DNA, 18 bp, Mus musculus
gctggggtgacaggccca

SEQ ID NO: 197186 - DNA, 23 bp, Mus musculus
tgtcttcatctgtgtgtgtgtgt

SEQ ID NO: 197187 - DNA, 19 bp, Mus musculus
tatcacccgtgtgtgcttg

SEQ ID NO: 197188 - DNA, 23 bp, Mus musculus
agagatgccagaagagggctttg

SEQ ID NO: 197189 - DNA, 23 bp, Mus musculus
gcctgcctgcctgcctgcctgcc

SEQ ID NO: 197190 - DNA, 23 bp, Mus musculus
tgtgtagataacagaaaagagtg

SEQ ID NO: 197191 - DNA, 21 bp, Mus musculus
tatgtgtacatatgtatatgt

SEQ ID NO: 197192 - DNA, 22 bp, Mus musculus
ctgtgacactctctgtgtctgg

SEQ ID NO: 197193 - DNA, 23 bp, Mus musculus
ctgagagaagtgagagagatcct

SEQ ID NO: 197194 - DNA, 18 bp, Mus musculus
aaactgtgattgctttag

SEQ ID NO: 197195 - DNA, 23 bp, Mus musculus
tgagtctctgtttcattcagcca

SEQ ID NO: 197196 - DNA, 23 bp, Mus musculus
ctctgtgtgtgtctgagtgcctg

SEQ ID NO: 197197 - DNA, 23 bp, Mus musculus
tatctctctcactctatgtcttt

SEQ ID NO: 197198 - DNA, 22 bp, Mus musculus
tagtctgtgtgctagagatgtg

SEQ ID NO: 197199 - DNA, 23 bp, Mus musculus
catgtgtgggtcagtagcggcat

SEQ ID NO: 197200 - DNA, 23 bp, Mus musculus
ctgtctctttttgtctctatgtg

SEQ ID NO: 197201 - DNA, 19 bp, Mus musculus
ttgtatgtctatatgtata

SEQ ID NO: 197202 - DNA, 23 bp, Mus musculus
tcatccacagacagacagacaga

SEQ ID NO: 197203 - DNA, 20 bp, Mus musculus
tctgctctgggtggaacctg

SEQ ID NO: 197204 - DNA, 23 bp, Mus musculus
tagctgcctgaatgccagtcttc

SEQ ID NO: 197205 - DNA, 23 bp, Mus musculus
tgtgtgcatatttgttcgtgtgt

SEQ ID NO: 197206 - DNA, 22 bp, Mus musculus
gtgtgtgcatgagtgtgtgcgt

SEQ ID NO: 197207 - DNA, 18 bp, Mus musculus
tgtgtgtgcatgtgtatg

SEQ ID NO: 197208 - DNA, 23 bp, Mus musculus
ttctctgtgtcactctttgcctg

SEQ ID NO: 197209 - DNA, 23 bp, Mus musculus
atgcaatgaaattcagaatggtt

SEQ ID NO: 197210 - DNA, 23 bp, Mus musculus
ttctctgtgtcactctttgcctg

SEQ ID NO: 197211 - DNA, 23 bp, Mus musculus
atttggaatggtttcttattctc

SEQ ID NO: 197212 - DNA, 20 bp, Mus musculus
tcacagaactgagtgacttg

SEQ ID NO: 197213 - DNA, 22 bp, Mus musculus
tgtcaggctccgtgaatcccac

SEQ ID NO: 197214 - DNA, 23 bp, Mus musculus
ttctctgtgtcactctttgcctg

SEQ ID NO: 197215 - DNA, 23 bp, Mus musculus
atttggaatggtttcttattctc

SEQ ID NO: 197216 - DNA, 22 bp, Mus musculus
tgtcaggctccgtgaatcccac

SEQ ID NO: 197217 - DNA, 22 bp, Mus musculus
tgttttgtgaccaattatatgg

SEQ ID NO: 197218 - DNA, 23 bp, Mus musculus
tctttccacatgttgccagtctg

SEQ ID NO: 197219 - DNA, 23 bp, Mus musculus
ttctctgtgtcactctttgcctg

SEQ ID NO: 197220 - DNA, 22 bp, Mus musculus
tgcaatgaaatttagaatggtt

SEQ ID NO: 197221 - DNA, 23 bp, Mus musculus
ttctctgtgtcactctttgcctg

SEQ ID NO: 197222 - DNA, 22 bp, Mus musculus
tgttttgtgaccaattatatgg

SEQ ID NO: 197223 - DNA, 23 bp, Mus musculus
aggccagaggcaggatagcttta

SEQ ID NO: 197224 - DNA, 20 bp, Mus musculus
taagactcatctgtggggct

SEQ ID NO: 197225 - DNA, 22 bp, Mus musculus
atagtcctagttgtagagctat

SEQ ID NO: 197226 - DNA, 23 bp, Mus musculus
tctggctcagtctctctctcctc

SEQ ID NO: 197227 - DNA, 23 bp, Mus musculus
agtctctctgtctgggtttgtgc

SEQ ID NO: 197228 - DNA, 20 bp, Mus musculus
taatacattgcatatgacat

SEQ ID NO: 197229 - DNA, 18 bp, Mus musculus
ctgagacacacagtctgg

SEQ ID NO: 197230 - DNA, 18 bp, Mus musculus
cactgactactcttccag

SEQ ID NO: 197231 - DNA, 23 bp, Mus musculus
tctcagggtctgtctgacatttt

SEQ ID NO: 197232 - DNA, 21 bp, Mus musculus
tgacaatatttatatttctgt

SEQ ID NO: 197233 - DNA, 18 bp, Mus musculus
aaggagatttaatctgtt

SEQ ID NO: 197234 - DNA, 18 bp, Mus musculus
ttgtccaatatttaggct

SEQ ID NO: 197235 - DNA, 20 bp, Mus musculus
tcacagaactgagtgacttg

SEQ ID NO: 197236 - DNA, 23 bp, Mus musculus
tatgacactgagtaagcagtctg

SEQ ID NO: 197237 - DNA, 23 bp, Mus musculus
agacagtctcagactgtcacctt

SEQ ID NO: 197238 - DNA, 23 bp, Mus musculus
gagacaggaacttgaatgcagga

SEQ ID NO: 197239 - DNA, 21 bp, Mus musculus
tgacactcagaaggaaatgcc

SEQ ID NO: 197240 - DNA, 23 bp, Mus musculus
ttacactggctgctttcatgagt

SEQ ID NO: 197241 - DNA, 23 bp, Mus musculus
aagtcaggaggtggacctggaga

SEQ ID NO: 197242 - DNA, 21 bp, Mus musculus
tttagagcactgactgctctt

SEQ ID NO: 197243 - DNA, 22 bp, Mus musculus
tcagaaggtagagatcagctca

SEQ ID NO: 197244 - DNA, 23 bp, Mus musculus
aaaagagacagattttcttcttc

SEQ ID NO: 197245 - DNA, 23 bp, Mus musculus
tctgtgaagtgtgtgaggacatg

SEQ ID NO: 197246 - DNA, 18 bp, Mus musculus
ctcacaggtatctttgca

SEQ ID NO: 197247 - DNA, 21 bp, Mus musculus
tcagcctgtgtctgactcctg

SEQ ID NO: 197248 - DNA, 18 bp, Mus musculus
tgaagctgacatcagagc

SEQ ID NO: 197249 - DNA, 23 bp, Mus musculus
ctagcatgtgaaaagtgctacag

SEQ ID NO: 197250 - DNA, 21 bp, Mus musculus
tgcctggctgcctgtaggtct

SEQ ID NO: 197251 - DNA, 23 bp, Mus musculus
actggattcacagtcagtcgtga

SEQ ID NO: 197252 - DNA, 18 bp, Mus musculus
cagtgttgtgtgggtcct

SEQ ID NO: 197253 - DNA, 23 bp, Mus musculus
ctgttacagcaactgcatgagaa

SEQ ID NO: 197254 - DNA, 23 bp, Mus musculus
tctctaactgactgtgtgtcttg

SEQ ID NO: 197255 - DNA, 18 bp, Mus musculus
tagactagctggtcagga

SEQ ID NO: 197256 - DNA, 23 bp, Mus musculus
ttaagagcactcactgctcttcc

SEQ ID NO: 197257 - DNA, 23 bp, Mus musculus
catctgatagaagactgtgagca

SEQ ID NO: 197258 - DNA, 23 bp, Mus musculus
ctctcagtctctggctctcagac

SEQ ID NO: 197259 - DNA, 23 bp, Mus musculus
tttgtgaccaattgtatagtcat

SEQ ID NO: 197260 - DNA, 22 bp, Mus musculus
tgttttgtgaccaattatatgg

SEQ ID NO: 197261 - DNA, 22 bp, Mus musculus
tgttttgtgaccaattatatgg

SEQ ID NO: 197262 - DNA, 23 bp, Mus musculus
tagatgtatgattgcatgtgtta

SEQ ID NO: 197263 - DNA, 23 bp, Mus musculus
taatgtatgcatatttgtatgtt

SEQ ID NO: 197264 - DNA, 20 bp, Mus musculus
aaggagccatttgaaggagt

SEQ ID NO: 197265 - DNA, 23 bp, Mus musculus
attaatgactatttctatttctt

SEQ ID NO: 197266 - DNA, 23 bp, Mus musculus
aatgttaatctgattttgattta

SEQ ID NO: 197267 - DNA, 23 bp, Mus musculus
atttctctctgtctctgggagag

SEQ ID NO: 197268 - DNA, 23 bp, Mus musculus
acaccctctcagtgtggatgtaa

SEQ ID NO: 197269 - DNA, 22 bp, Mus musculus
tgttttgtgaccaattatatgg

SEQ ID NO: 197270 - DNA, 23 bp, Mus musculus
gaaagaactgaagtgaaaacagt

SEQ ID NO: 197271 - DNA, 21 bp, Mus musculus
tgtctcactctcagtttttgc

SEQ ID NO: 197272 - DNA, 23 bp, Mus musculus
actggctatctttttgtagaaga

SEQ ID NO: 197273 - DNA, 23 bp, Mus musculus
tacaaagagcaagtccaagtgga

SEQ ID NO: 197274 - DNA, 23 bp, Mus musculus
cactagtcacttacctcaatgct

SEQ ID NO: 197275 - DNA, 22 bp, Mus musculus
attgtgagaagtgagtcagctg

SEQ ID NO: 197276 - DNA, 23 bp, Mus musculus
ttgtagatagttgtaagccacca

SEQ ID NO: 197277 - DNA, 22 bp, Mus musculus
tctgtagtacagcttgaggtca

SEQ ID NO: 197278 - DNA, 18 bp, Mus musculus
aaggagcacacaaacttg

SEQ ID NO: 197279 - DNA, 23 bp, Mus musculus
cttaagtgatagtacatttttgt

SEQ ID NO: 197280 - DNA, 21 bp, Mus musculus
tgtggtagatgctagaaactt

SEQ ID NO: 197281 - DNA, 22 bp, Mus musculus
ttatatatctggaggaatttct

SEQ ID NO: 197282 - DNA, 23 bp, Mus musculus
tgagtctctatcacccagtgtca

SEQ ID NO: 197283 - DNA, 23 bp, Mus musculus
ctagattcatgttgatggtcttt

SEQ ID NO: 197284 - DNA, 19 bp, Mus musculus
tgattctttgtattattcc

SEQ ID NO: 197285 - DNA, 18 bp, Mus musculus
agcagtgtgggcacttgt

SEQ ID NO: 197286 - DNA, 23 bp, Mus musculus
tgaatgtctgtatgtattcatgt

SEQ ID NO: 197287 - DNA, 19 bp, Mus musculus
tgtgtatgtatgtatatac

SEQ ID NO: 197288 - DNA, 23 bp, Mus musculus
gcgtatgtatgtatgtgtgtgtg

SEQ ID NO: 197289 - DNA, 19 bp, Mus musculus
tatggctggggctggagag

SEQ ID NO: 197290 - DNA, 19 bp, Mus musculus
tgtgtgtgtgtgttcatgt

SEQ ID NO: 197291 - DNA, 22 bp, Mus musculus
ttggactgtagagatggctcag

SEQ ID NO: 197292 - DNA, 21 bp, Mus musculus
tagtgagaactgagtgagctg

SEQ ID NO: 197293 - DNA, 23 bp, Mus musculus
tggaattcactctgtagaccagg

SEQ ID NO: 197294 - DNA, 23 bp, Mus musculus
atatgtatgtatgtatgtatgta

SEQ ID NO: 197295 - DNA, 19 bp, Mus musculus
acagggtgcatgcctggta

SEQ ID NO: 197296 - DNA, 18 bp, Mus musculus
ctgtgatctgtctctgtc

SEQ ID NO: 197297 - DNA, 21 bp, Mus musculus
tttgcttcatatttatcgtga

SEQ ID NO: 197298 - DNA, 22 bp, Mus musculus
tttatgcatatttacttgttta

SEQ ID NO: 197299 - DNA, 22 bp, Mus musculus
tgttttgtgaccaattatatgg

SEQ ID NO: 197300 - DNA, 20 bp, Mus musculus
tcacagaactgagtgacttg

SEQ ID NO: 197301 - DNA, 23 bp, Mus musculus
ctgctactgtagtctgcacattc

SEQ ID NO: 197302 - DNA, 18 bp, Mus musculus
agactagtctctgaggtt

SEQ ID NO: 197303 - DNA, 21 bp, Mus musculus
ttgaggtttttaatgcttatg

SEQ ID NO: 197304 - DNA, 22 bp, Mus musculus
gggcagggctttgattgtgtct

SEQ ID NO: 197305 - DNA, 23 bp, Mus musculus
tagtgaagtctgactgctcacac

SEQ ID NO: 197306 - DNA, 23 bp, Mus musculus
tgtatgtatatatatatgtatgc

SEQ ID NO: 197307 - DNA, 22 bp, Mus musculus
tagttgaccttgagctctatta

SEQ ID NO: 197308 - DNA, 20 bp, Mus musculus
atgtatgtatgtatgtatgt

SEQ ID NO: 197309 - DNA, 19 bp, Mus musculus
tatataagtattccaaagc

SEQ ID NO: 197310 - DNA, 21 bp, Mus musculus
atgagagaacattctcaggcc

SEQ ID NO: 197311 - DNA, 22 bp, Mus musculus
ggtcaggctctgtcacagcctc

SEQ ID NO: 197312 - DNA, 22 bp, Mus musculus
cacagttgtgtaggatcaggag

SEQ ID NO: 197313 - DNA, 21 bp, Mus musculus
tccatggtggtctgataggat

SEQ ID NO: 197314 - DNA, 23 bp, Mus musculus
ctaggaccatatgaaaacagtgt

SEQ ID NO: 197315 - DNA, 22 bp, Mus musculus
tgttttgtgaccaattatatgg

SEQ ID NO: 197316 - DNA, 21 bp, Mus musculus
actagttattatgtagttttc

SEQ ID NO: 197317 - DNA, 22 bp, Mus musculus
catgaatagctacataaaggta

SEQ ID NO: 197318 - DNA, 23 bp, Mus musculus
taagatggaggctttgttttgtt

SEQ ID NO: 197319 - DNA, 22 bp, Mus musculus
tgttttgtgaccaattatatgg

SEQ ID NO: 197320 - DNA, 23 bp, Mus musculus
tcacatgtaatacatatgtgtgt

SEQ ID NO: 197321 - DNA, 23 bp, Mus musculus
cctgggtcacagtgtctgagtct

SEQ ID NO: 197322 - DNA, 23 bp, Mus musculus
tcactgtgtgtctgtgtgcaagg

SEQ ID NO: 197323 - DNA, 23 bp, Mus musculus
tcacacctgtagacagtcaacaa

SEQ ID NO: 197324 - DNA, 22 bp, Mus musculus
tgaatagatgccacactcacag

SEQ ID NO: 197325 - DNA, 23 bp, Mus musculus
tctgtggcactctgagcctctct

SEQ ID NO: 197326 - DNA, 23 bp, Mus musculus
actgtcagtcagactgatttctg

SEQ ID NO: 197327 - DNA, 23 bp, Mus musculus
tctgtgtctgtctgtctgtctgt

SEQ ID NO: 197328 - DNA, 22 bp, Mus musculus
aagcgtgtgcatgcatattcac

SEQ ID NO: 197329 - DNA, 21 bp, Mus musculus
tgtatgtgtgcatgtgcatgt

SEQ ID NO: 197330 - DNA, 23 bp, Mus musculus
tgtctctgtggcaaccatatgca

SEQ ID NO: 197331 - DNA, 23 bp, Mus musculus
tatgtgtgtatatatgtgtgtgt

SEQ ID NO: 197332 - DNA, 23 bp, Mus musculus
tatggttggttttctacattaat

SEQ ID NO: 197333 - DNA, 21 bp, Mus musculus
tatactgatcaatgtgctgtg

SEQ ID NO: 197334 - DNA, 22 bp, Mus musculus
tgagaggctctgtcagagtctg

SEQ ID NO: 197335 - DNA, 20 bp, Mus musculus
atgtatgtatagtagacata

SEQ ID NO: 197336 - DNA, 23 bp, Mus musculus
aataatgatgatgttgttgatga

SEQ ID NO: 197337 - DNA, 23 bp, Mus musculus
tgcaaatggattgatattatgag

SEQ ID NO: 197338 - DNA, 23 bp, Mus musculus
tgtgtgtatgtatacatgtgtat

SEQ ID NO: 197339 - DNA, 23 bp, Mus musculus
tgtgtatgtgcatgtgcatatgt

SEQ ID NO: 197340 - DNA, 22 bp, Mus musculus
catcagtcactcattctctctg

SEQ ID NO: 197341 - DNA, 23 bp, Mus musculus
tgtgcctgtgtgtgtgcctgtgt

SEQ ID NO: 197342 - DNA, 23 bp, Mus musculus
gagaggctctgacagtgtctgac

SEQ ID NO: 197343 - DNA, 22 bp, Mus musculus
tgtgagccagtgggtgacctca

SEQ ID NO: 197344 - DNA, 23 bp, Mus musculus
gagtgaagagacagagaacatcc

SEQ ID NO: 197345 - DNA, 23 bp, Mus musculus
tgtgtgcctctcagtgactgtgg

SEQ ID NO: 197346 - DNA, 22 bp, Mus musculus
tgacagagaggacagtgggggc

SEQ ID NO: 197347 - DNA, 19 bp, Mus musculus
tgagaggatggaagtgtgg

SEQ ID NO: 197348 - DNA, 23 bp, Mus musculus
cagcctctctctctctaaaggct

SEQ ID NO: 197349 - DNA, 23 bp, Mus musculus
tcactctgactgtcttcacattg

SEQ ID NO: 197350 - DNA, 23 bp, Mus musculus
tggttatatatagttattggttc

SEQ ID NO: 197351 - DNA, 23 bp, Mus musculus
tgtgtgtgcctgtgtatatgtgc

SEQ ID NO: 197352 - DNA, 22 bp, Mus musculus
tcacaagatgtatttttcttta

SEQ ID NO: 197353 - DNA, 19 bp, Mus musculus
tgtctgtctgtctctcttt

SEQ ID NO: 197354 - DNA, 23 bp, Mus musculus
tctgtgtctgtgcatgtgcatgt

SEQ ID NO: 197355 - DNA, 23 bp, Mus musculus
gtcagtcacactccttaggatct

SEQ ID NO: 197356 - DNA, 22 bp, Mus musculus
accctgtcagcatctctctctg

SEQ ID NO: 197357 - DNA, 23 bp, Mus musculus
tgtgtgtgtgtgtgtgcatgcat

SEQ ID NO: 197358 - DNA, 22 bp, Mus musculus
ctggctctgtgtctgcctctta

SEQ ID NO: 197359 - DNA, 21 bp, Mus musculus
taggagcagacatgaagcgcc

SEQ ID NO: 197360 - DNA, 23 bp, Mus musculus
tctgactctgccattcatttgcc

SEQ ID NO: 197361 - DNA, 20 bp, Mus musculus
tgagagctcagagagtgctg

SEQ ID NO: 197362 - DNA, 22 bp, Mus musculus
tgtgctcctgaacaacagccag

SEQ ID NO: 197363 - DNA, 22 bp, Mus musculus
tctcagagtctcagttcatggg

SEQ ID NO: 197364 - DNA, 23 bp, Mus musculus
atgtatatatgcatatatgtgtg

SEQ ID NO: 197365 - DNA, 22 bp, Mus musculus
atgtatgtatatattatgatgt

SEQ ID NO: 197366 - DNA, 23 bp, Mus musculus
gtctctggcactgtgtgaccatg

SEQ ID NO: 197367 - DNA, 20 bp, Mus musculus
atattctgtctcattcttca

SEQ ID NO: 197368 - DNA, 21 bp, Mus musculus
agatggtagtgagtggcagtg

SEQ ID NO: 197369 - DNA, 23 bp, Mus musculus
tgtctgtctgtctgtcttcatgc

SEQ ID NO: 197370 - DNA, 20 bp, Mus musculus
tgtgaagatctcggcatggt

SEQ ID NO: 197371 - DNA, 23 bp, Mus musculus
tctaataaaccttgttagagagc

SEQ ID NO: 197372 - DNA, 23 bp, Mus musculus
tctctcacagtgtttattgtgag

SEQ ID NO: 197373 - DNA, 23 bp, Mus musculus
atatatatgcatatgtgtgtgta

SEQ ID NO: 197374 - DNA, 21 bp, Mus musculus
tgaaggtgcatccttgttctg

SEQ ID NO: 197375 - DNA, 23 bp, Mus musculus
agactcacagagtctgcttctgc

SEQ ID NO: 197376 - DNA, 23 bp, Mus musculus
tatatatgtatatgtgcatatgt

SEQ ID NO: 197377 - DNA, 23 bp, Mus musculus
agtatgtatgtatgtatgtatgt

SEQ ID NO: 197378 - DNA, 22 bp, Mus musculus
ctgcctgcctgcctggctgcct

SEQ ID NO: 197379 - DNA, 22 bp, Mus musculus
ttcagtgagtgtgtcatagcag

SEQ ID NO: 197380 - DNA, 22 bp, Mus musculus
agagacagtagacacagtcctg

SEQ ID NO: 197381 - DNA, 21 bp, Mus musculus
atgtgacttgagagtgaccac

SEQ ID NO: 197382 - DNA, 20 bp, Mus musculus
tatctgcatgtgcatctgtg

SEQ ID NO: 197383 - DNA, 23 bp, Mus musculus
tggaacagtgaagttgttgtgga

SEQ ID NO: 197384 - DNA, 23 bp, Mus musculus
cacagtgtggtctctcctggctt

SEQ ID NO: 197385 - DNA, 23 bp, Mus musculus
actgggtctctctgtggcagttg

SEQ ID NO: 197386 - DNA, 23 bp, Mus musculus
ctgagcctctctccctggctctc

SEQ ID NO: 197387 - DNA, 20 bp, Mus musculus
tttaagtgcgtgtgtattga

SEQ ID NO: 197388 - DNA, 23 bp, Mus musculus
cacacttctctgtgtgtttatgt

SEQ ID NO: 197389 - DNA, 21 bp, Mus musculus
tgtgtgtgtgtgtatatacat

SEQ ID NO: 197390 - DNA, 23 bp, Mus musculus
tgagagagtatatgtatatgtgt

SEQ ID NO: 197391 - DNA, 23 bp, Mus musculus
tgacagtagagagaggtgagcca

SEQ ID NO: 197392 - DNA, 23 bp, Mus musculus
tactcttggtcagtgtatggttt

SEQ ID NO: 197393 - DNA, 19 bp, Mus musculus
tatggatatgtaatgatat

SEQ ID NO: 197394 - DNA, 23 bp, Mus musculus
atatttatccattatatatctat

SEQ ID NO: 197395 - DNA, 23 bp, Mus musculus
tgtacatgtgtatatgtacatgt

SEQ ID NO: 197396 - DNA, 21 bp, Mus musculus
ctgtctgcatgttgtgtcatt

SEQ ID NO: 197397 - DNA, 21 bp, Mus musculus
tccaggccctgtgtgagaggc

SEQ ID NO: 197398 - DNA, 23 bp, Mus musculus
agacttggagcagacaccctcgc

SEQ ID NO: 197399 - DNA, 23 bp, Mus musculus
aatctgtctcagtgtctgtctct

SEQ ID NO: 197400 - DNA, 23 bp, Mus musculus
tctcagtcttcagatgtcacaca

SEQ ID NO: 197401 - DNA, 20 bp, Mus musculus
cactgtcactgacaccctct

SEQ ID NO: 197402 - DNA, 23 bp, Mus musculus
cctctcagggtcactaaaggcca

SEQ ID NO: 197403 - DNA, 22 bp, Mus musculus
ggaaatgtaaggaacactgacg

SEQ ID NO: 197404 - DNA, 23 bp, Mus musculus
ttttacaaacgggtttaatttac

SEQ ID NO: 197405 - DNA, 23 bp, Mus musculus
gacagtagtgtgggtgcagctct

SEQ ID NO: 197406 - DNA, 21 bp, Mus musculus
tgtgtccctgtgtctctggct

SEQ ID NO: 197407 - DNA, 23 bp, Mus musculus
cagagactgcagagtgtgtccag

SEQ ID NO: 197408 - DNA, 18 bp, Mus musculus
aatggagatgagcctgga

SEQ ID NO: 197409 - DNA, 23 bp, Mus musculus
agaactaagccagagttatacag

SEQ ID NO: 197410 - DNA, 23 bp, Mus musculus
tctgtctctctgtgtctctgtct

SEQ ID NO: 197411 - DNA, 19 bp, Mus musculus
ccctgtcacagtccccctg

SEQ ID NO: 197412 - DNA, 23 bp, Mus musculus
tgttgctctctcactgtggctga

SEQ ID NO: 197413 - DNA, 20 bp, Mus musculus
catgacagacgctgtggagt

SEQ ID NO: 197414 - DNA, 23 bp, Mus musculus
tgaacttcgcacagtcagacaga

SEQ ID NO: 197415 - DNA, 23 bp, Mus musculus
cacagtgccaggcactgcgctca

SEQ ID NO: 197416 - DNA, 20 bp, Mus musculus
gcctgtctgtgtctgactct

SEQ ID NO: 197417 - DNA, 23 bp, Mus musculus
tctgtctgtctgtgtctcagaag

SEQ ID NO: 197418 - DNA, 18 bp, Mus musculus
acacacacacatatgtag

SEQ ID NO: 197419 - DNA, 23 bp, Mus musculus
tgtgtgtgtctgtctctctctgt

SEQ ID NO: 197420 - DNA, 22 bp, Mus musculus
gtcagaactggggctggagaga

SEQ ID NO: 197421 - DNA, 23 bp, Mus musculus
atatctatgtgtatgcatatagt

SEQ ID NO: 197422 - DNA, 22 bp, Mus musculus
taagtgtatatatatctatatg

SEQ ID NO: 197423 - DNA, 18 bp, Mus musculus
atcagtcaagggccctgg

SEQ ID NO: 197424 - DNA, 21 bp, Mus musculus
tgtatatatacatatgtgtgt

SEQ ID NO: 197425 - DNA, 23 bp, Mus musculus
gactggtacacagtgatagtcaa

SEQ ID NO: 197426 - DNA, 22 bp, Mus musculus
tcagacaagtggcattcttaca

SEQ ID NO: 197427 - DNA, 23 bp, Mus musculus
cttctgtgacactcacacttttt

SEQ ID NO: 197428 - DNA, 23 bp, Mus musculus
gaggactgactgctcttccagag

SEQ ID NO: 197429 - DNA, 23 bp, Mus musculus
atatgtctgtatatgtatgtgta

SEQ ID NO: 197430 - DNA, 23 bp, Mus musculus
gtctctgtgtgtgtctctgtgtg

SEQ ID NO: 197431 - DNA, 22 bp, Mus musculus
gcctgtctgtctgcctgtctgt

SEQ ID NO: 197432 - DNA, 21 bp, Mus musculus
agaagaagaaagacagtgaga

SEQ ID NO: 197433 - DNA, 23 bp, Mus musculus
cacagacagagtcaagaactggt

SEQ ID NO: 197434 - DNA, 23 bp, Mus musculus
tgtgtgtctgtgtgtgtctctct

SEQ ID NO: 197435 - DNA, 23 bp, Mus musculus
ctgagacagacactctgtcccag

SEQ ID NO: 197436 - DNA, 23 bp, Mus musculus
gtctgtgtcagtgactgttctag

SEQ ID NO: 197437 - DNA, 23 bp, Mus musculus
ctcacactggctcagactggctc

SEQ ID NO: 197438 - DNA, 18 bp, Mus musculus
tgagggagagagaggggg

SEQ ID NO: 197439 - DNA, 23 bp, Mus musculus
tctcagtcattatctctctctca

SEQ ID NO: 197440 - DNA, 22 bp, Mus musculus
tgttttgtgaccaattatatgg

SEQ ID NO: 197441 - DNA, 23 bp, Mus musculus
atgtgtcttgttgaaattctaca

SEQ ID NO: 197442 - DNA, 20 bp, Mus musculus
atatgacactggagggtcgg

SEQ ID NO: 197443 - DNA, 20 bp, Mus musculus
tcatacagccaggactttac

SEQ ID NO: 197444 - DNA, 23 bp, Mus musculus
ctgtgtgtgtgtctctgtctgtg

SEQ ID NO: 197445 - DNA, 23 bp, Mus musculus
ttcctgagacctaatcctgagag

SEQ ID NO: 197446 - DNA, 23 bp, Mus musculus
gtttatactgattttgatgatct

SEQ ID NO: 197447 - DNA, 23 bp, Mus musculus
tctcatgaatttgttcagaacta

SEQ ID NO: 197448 - DNA, 21 bp, Mus musculus
aaggagctcccattgctggac

SEQ ID NO: 197449 - DNA, 23 bp, Mus musculus
tctcactaaatctctctgctaca

SEQ ID NO: 197450 - DNA, 22 bp, Mus musculus
tgttttgtgaccaattatatgg

SEQ ID NO: 197451 - DNA, 18 bp, Mus musculus
tattactgaaatcgttta

SEQ ID NO: 197452 - DNA, 23 bp, Mus musculus
aattatgatttctcagtgtcggt

SEQ ID NO: 197453 - DNA, 22 bp, Mus musculus
tgttttgtgaccaattatatgg

SEQ ID NO: 197454 - DNA, 22 bp, Mus musculus
tgttttgtgaccaattatatgg

SEQ ID NO: 197455 - DNA, 21 bp, Mus musculus
ctggctcgttccctgtttcac

SEQ ID NO: 197456 - DNA, 23 bp, Mus musculus
tgtatgtatgtgcatatgtgcat

SEQ ID NO: 197457 - DNA, 23 bp, Mus musculus
gtatgcatgcatgtgtatatgta

SEQ ID NO: 197458 - DNA, 23 bp, Mus musculus
tatagtgcatttgcttgatccat

SEQ ID NO: 197459 - DNA, 22 bp, Mus musculus
cacatgtgtgtatgttcatgta

SEQ ID NO: 197460 - DNA, 23 bp, Mus musculus
atgtatgtgagtatgagcatgtg

SEQ ID NO: 197461 - DNA, 21 bp, Mus musculus
atgtatgtatgcatgtccatg

SEQ ID NO: 197462 - DNA, 23 bp, Mus musculus
tctgtcagtctgtctgtccatct

SEQ ID NO: 197463 - DNA, 21 bp, Mus musculus
actgcttctacaatgaaattt

SEQ ID NO: 197464 - DNA, 23 bp, Mus musculus
ctgtgtgtctctctctgtgtgta

SEQ ID NO: 197465 - DNA, 23 bp, Mus musculus
agaaagatcaccaggtgctgggt

SEQ ID NO: 197466 - DNA, 19 bp, Mus musculus
gtatatgtgtggataccat

SEQ ID NO: 197467 - DNA, 22 bp, Mus musculus
ttgttgttgttgttggggactg

SEQ ID NO: 197468 - DNA, 23 bp, Mus musculus
ggcttgtacttgcctttgatgat

SEQ ID NO: 197469 - DNA, 23 bp, Mus musculus
gagagatgatttggagctcactg

SEQ ID NO: 197470 - DNA, 23 bp, Mus musculus
ggaaagcacagagtcagcagtga

SEQ ID NO: 197471 - DNA, 22 bp, Mus musculus
tgttttgtgaccaattatatgg

SEQ ID NO: 197472 - DNA, 23 bp, Mus musculus
gagagaagagactgagaagtctg

SEQ ID NO: 197473 - DNA, 23 bp, Mus musculus
gagaatctctcagtctatgtatg

SEQ ID NO: 197474 - DNA, 23 bp, Mus musculus
tacatctctctgtgtgtgtctat

SEQ ID NO: 197475 - DNA, 23 bp, Mus musculus
tgactctctgtgtgacagtttcc

SEQ ID NO: 197476 - DNA, 18 bp, Mus musculus
cctgggttttgtgctgct

SEQ ID NO: 197477 - DNA, 21 bp, Mus musculus
acatgaatatgtatatggtgt

SEQ ID NO: 197478 - DNA, 23 bp, Mus musculus
tgatgtataagaatatgtatatg

SEQ ID NO: 197479 - DNA, 23 bp, Mus musculus
gcctcagaggctctctgtttctc

SEQ ID NO: 197480 - DNA, 23 bp, Mus musculus
aaaaagcactgactgctcttcca

SEQ ID NO: 197481 - DNA, 23 bp, Mus musculus
gtctgtctgcctgcctgtctgtg

SEQ ID NO: 197482 - DNA, 22 bp, Mus musculus
tatgaccaattatattgtcaat

SEQ ID NO: 197483 - DNA, 18 bp, Mus musculus
ctacacacttacagagag

SEQ ID NO: 197484 - DNA, 23 bp, Mus musculus
tgaggaatgaggttggtgtatga

SEQ ID NO: 197485 - DNA, 23 bp, Mus musculus
tatctctctatatatatgtatgt

SEQ ID NO: 197486 - DNA, 22 bp, Mus musculus
tgctgaagatatatctttgtat

SEQ ID NO: 197487 - DNA, 21 bp, Mus musculus
agagatatacctcagtaggtg

SEQ ID NO: 197488 - DNA, 22 bp, Mus musculus
tgttttgtgaccaattatatgg

SEQ ID NO: 197489 - DNA, 18 bp, Mus musculus
gtgtgtcactgagggtgg

SEQ ID NO: 197490 - DNA, 21 bp, Mus musculus
actgagcttttgaaatgacac

SEQ ID NO: 197491 - DNA, 22 bp, Mus musculus
ctcagtgtctctctgtcactgt

SEQ ID NO: 197492 - DNA, 23 bp, Mus musculus
agttttcatccttctctctcagt

SEQ ID NO: 197493 - DNA, 23 bp, Mus musculus
ttatctcacagctattgttaatt

SEQ ID NO: 197494 - DNA, 22 bp, Mus musculus
aatattgtggaatagctagatc

SEQ ID NO: 197495 - DNA, 23 bp, Mus musculus
gtgtctctctgtcgctgtgttct

SEQ ID NO: 197496 - DNA, 23 bp, Mus musculus
atatgtatgctttctgtatgtat

SEQ ID NO: 197497 - DNA, 23 bp, Mus musculus
atgtttctacttgtatatgtgta

SEQ ID NO: 197498 - DNA, 23 bp, Mus musculus
tctgtctctgtgtgtgatgtcag

SEQ ID NO: 197499 - DNA, 20 bp, Mus musculus
tgtgtgtatgtatatgtgtg

SEQ ID NO: 197500 - DNA, 23 bp, Mus musculus
tgtctgtctgtctgtctgggagc

SEQ ID NO: 197501 - DNA, 19 bp, Mus musculus
ataggtacagacaatggaa

SEQ ID NO: 197502 - DNA, 23 bp, Mus musculus
ccagactgacagtagcctgtgag

SEQ ID NO: 197503 - DNA, 23 bp, Mus musculus
atagttgtagtactttaaagtct

SEQ ID NO: 197504 - DNA, 23 bp, Mus musculus
ctgttcagagtatagagtgttga

SEQ ID NO: 197505 - DNA, 19 bp, Mus musculus
tctgtctgcctatctatct

SEQ ID NO: 197506 - DNA, 20 bp, Mus musculus
tatagtgggtagattgtggg

SEQ ID NO: 197507 - DNA, 18 bp, Mus musculus
taggttctctaagaaagc

SEQ ID NO: 197508 - DNA, 20 bp, Mus musculus
ttaagagcactgactgctct

SEQ ID NO: 197509 - DNA, 23 bp, Mus musculus
agtttctgagaggttggcctcac

SEQ ID NO: 197510 - DNA, 23 bp, Mus musculus
gggtagaacctgcagaaaaagag

SEQ ID NO: 197511 - DNA, 21 bp, Mus musculus
actgagtactcagtgaggagt

SEQ ID NO: 197512 - DNA, 23 bp, Mus musculus
tctctctgtctctatctgtctct

SEQ ID NO: 197513 - DNA, 22 bp, Mus musculus
tagcaccatttgtagaggtcag

SEQ ID NO: 197514 - DNA, 23 bp, Mus musculus
agaaatcaaattcagattgacag

SEQ ID NO: 197515 - DNA, 23 bp, Mus musculus
cacaaggtacagcagctgggtgt

SEQ ID NO: 197516 - DNA, 20 bp, Mus musculus
gaaagatcagggtcagcagc

SEQ ID NO: 197517 - DNA, 23 bp, Mus musculus
tctgtctgtctgtctgtctgtct

SEQ ID NO: 197518 - DNA, 23 bp, Mus musculus
aggctgtctctgactctgttacc

SEQ ID NO: 197519 - DNA, 23 bp, Mus musculus
aaagtcatgtagtgtgtgtgtgt

SEQ ID NO: 197520 - DNA, 22 bp, Mus musculus
tgttttgtgaccaattatatgg

SEQ ID NO: 197521 - DNA, 23 bp, Mus musculus
tcttcactccttactctcagtca

SEQ ID NO: 197522 - DNA, 22 bp, Mus musculus
tatatgtgtgtatatgtatatg

SEQ ID NO: 197523 - DNA, 21 bp, Mus musculus
tatgtgtatatgtatatgtgt

SEQ ID NO: 197524 - DNA, 23 bp, Mus musculus
gtgtgcatgttagtgtgtgtgta

SEQ ID NO: 197525 - DNA, 23 bp, Mus musculus
gcgtgtgcatgtgcatgtgtgtg

SEQ ID NO: 197526 - DNA, 18 bp, Mus musculus
actgtgcatgcatataca

SEQ ID NO: 197527 - DNA, 23 bp, Mus musculus
gtatatgtgtgtgcttgtgcatg

SEQ ID NO: 197528 - DNA, 20 bp, Mus musculus
tgtgtgtgtgtgtccctctg

SEQ ID NO: 197529 - DNA, 23 bp, Mus musculus
tttagtgtatgtatgtatgtatg

SEQ ID NO: 197530 - DNA, 23 bp, Mus musculus
tgcatgcatgcatgtatgggtga

SEQ ID NO: 197531 - DNA, 23 bp, Mus musculus
tgtttggtattcaagctgtcatg

SEQ ID NO: 197532 - DNA, 22 bp, Mus musculus
ttgatctttaccagccctgact

SEQ ID NO: 197533 - DNA, 23 bp, Mus musculus
tcagtcagtcagtcagttctggc

SEQ ID NO: 197534 - DNA, 21 bp, Mus musculus
ttgactctgaagtcttactca

SEQ ID NO: 197535 - DNA, 23 bp, Mus musculus
taagagcactgactgctcttcca

SEQ ID NO: 197536 - DNA, 23 bp, Mus musculus
gtctgtctgtctgtctgtgtgtg

SEQ ID NO: 197537 - DNA, 18 bp, Mus musculus
attgtacagatgggcttc

SEQ ID NO: 197538 - DNA, 23 bp, Mus musculus
aatgcactgacactgtctgtctg

SEQ ID NO: 197539 - DNA, 23 bp, Mus musculus
gcccagtctctctcactctgcct

SEQ ID NO: 197540 - DNA, 20 bp, Mus musculus
atgtagtatatatatttata

SEQ ID NO: 197541 - DNA, 20 bp, Mus musculus
ataagacattagaaagtagc

SEQ ID NO: 197542 - DNA, 19 bp, Mus musculus
tatgtatgtatgtatgtat

SEQ ID NO: 197543 - DNA, 21 bp, Mus musculus
tattgtgtgtgggtatgtatg

SEQ ID NO: 197544 - DNA, 23 bp, Mus musculus
ccaacacttgtcattgctgggtt

SEQ ID NO: 197545 - DNA, 18 bp, Mus musculus
cagctctgagagacagac

SEQ ID NO: 197546 - DNA, 22 bp, Mus musculus
tggctgggactatattgagaga

SEQ ID NO: 197547 - DNA, 20 bp, Mus musculus
atacatgtgtgcatgtgtgt

SEQ ID NO: 197548 - DNA, 23 bp, Mus musculus
tgtctgtctgtctgtctgtctgt

SEQ ID NO: 197549 - DNA, 23 bp, Mus musculus
atgattctccttatgtataagtg

SEQ ID NO: 197550 - DNA, 19 bp, Mus musculus
atgtacaagtgcatgtgtg

SEQ ID NO: 197551 - DNA, 20 bp, Mus musculus
acatggttttgtttctgctt

SEQ ID NO: 197552 - DNA, 21 bp, Mus musculus
ttcagctgacagtcatctagc

SEQ ID NO: 197553 - DNA, 23 bp, Mus musculus
agcagtgtcacctgtctgtctct

SEQ ID NO: 197554 - DNA, 23 bp, Mus musculus
gtctctaagtctgtctcatttgt

SEQ ID NO: 197555 - DNA, 23 bp, Mus musculus
aactgtgtctctgagtcacatct

SEQ ID NO: 197556 - DNA, 23 bp, Mus musculus
aacactggctccagacaggcagt

SEQ ID NO: 197557 - DNA, 23 bp, Mus musculus
ttgtctgtctgtctatctgcctg

SEQ ID NO: 197558 - DNA, 23 bp, Mus musculus
aagcactgactgctcttccagag

SEQ ID NO: 197559 - DNA, 23 bp, Mus musculus
tgcctgcctgactgcctgcatgt

SEQ ID NO: 197560 - DNA, 23 bp, Mus musculus
gtgatctgataggataacatggg

SEQ ID NO: 197561 - DNA, 23 bp, Mus musculus
gtatgtatgcatggatgtgtatt

SEQ ID NO: 197562 - DNA, 19 bp, Mus musculus
aatgtatgtgagtttatgc

SEQ ID NO: 197563 - DNA, 20 bp, Mus musculus
tatttgcttgtgtaaaagtt

SEQ ID NO: 197564 - DNA, 23 bp, Mus musculus
tgtaggttgatgtgtgtgacagc

SEQ ID NO: 197565 - DNA, 23 bp, Mus musculus
cctctctatcagtcagctattac

SEQ ID NO: 197566 - DNA, 23 bp, Mus musculus
gtctttctgcttctgaaagaggt

SEQ ID NO: 197567 - DNA, 22 bp, Mus musculus
tgttttgtgaccaattatatgg

SEQ ID NO: 197568 - DNA, 23 bp, Mus musculus
atatctggtaatagtctgtactt

SEQ ID NO: 197569 - DNA, 23 bp, Mus musculus
taatcctaaatattccatagtga

SEQ ID NO: 197570 - DNA, 23 bp, Mus musculus
acagatgtcactctgtgagggaa

SEQ ID NO: 197571 - DNA, 21 bp, Mus musculus
agttcgattctcagcaaccac

SEQ ID NO: 197572 - DNA, 23 bp, Mus musculus
ctatatgtctatatgagtatgtc

SEQ ID NO: 197573 - DNA, 21 bp, Mus musculus
tatatacacacacacatacat

SEQ ID NO: 197574 - DNA, 23 bp, Mus musculus
ctgtatgagcaagctctgtctct

SEQ ID NO: 197575 - DNA, 23 bp, Mus musculus
agcatcacaccgtttctagtgtg

SEQ ID NO: 197576 - DNA, 22 bp, Mus musculus
ctatgtatgcatgtatgtatgt

SEQ ID NO: 197577 - DNA, 23 bp, Mus musculus
aggggagctagtttgacctcagt

SEQ ID NO: 197578 - DNA, 23 bp, Mus musculus
tattatgatgatgatgatgatga

SEQ ID NO: 197579 - DNA, 23 bp, Mus musculus
tatctcagcttgctttgaagaga

SEQ ID NO: 197580 - DNA, 23 bp, Mus musculus
tcttagccacttttcagagagct

SEQ ID NO: 197581 - DNA, 18 bp, Mus musculus
atatgtatatatgtatgt

SEQ ID NO: 197582 - DNA, 23 bp, Mus musculus
tgtgtgcatgtatgtatgtatgt

SEQ ID NO: 197583 - DNA, 23 bp, Mus musculus
aatgtatgcatatgtgtatgtat

SEQ ID NO: 197584 - DNA, 23 bp, Mus musculus
gtgagtgtgtatgtgcatctgtt

SEQ ID NO: 197585 - DNA, 18 bp, Mus musculus
aatgtaggtgtgccacag

SEQ ID NO: 197586 - DNA, 23 bp, Mus musculus
gtgtacgtctttgtgtgagtgat

SEQ ID NO: 197587 - DNA, 22 bp, Mus musculus
tgttttgtgaccaattatatgg

SEQ ID NO: 197588 - DNA, 23 bp, Mus musculus
acatatatgtgcatgtatatgta

SEQ ID NO: 197589 - DNA, 22 bp, Mus musculus
tatgtctatatatacatatgtg

SEQ ID NO: 197590 - DNA, 23 bp, Mus musculus
tgtgtgtgtgtgtgtatctatac

SEQ ID NO: 197591 - DNA, 23 bp, Mus musculus
ctgaacagtgacagctaacattg

SEQ ID NO: 197592 - DNA, 23 bp, Mus musculus
tgtgtgtgtgtatgtgtataggt

SEQ ID NO: 197593 - DNA, 18 bp, Mus musculus
atcaatatatatgatgta

SEQ ID NO: 197594 - DNA, 18 bp, Mus musculus
agtgtttaatacataagc

SEQ ID NO: 197595 - DNA, 23 bp, Mus musculus
tctaaatcacagtgagctatgtg

SEQ ID NO: 197596 - DNA, 23 bp, Mus musculus
tctctctgtgtgttattctacac

SEQ ID NO: 197597 - DNA, 22 bp, Mus musculus
tctgctacactcagaggctgag

SEQ ID NO: 197598 - DNA, 23 bp, Mus musculus
ctgctgtcagtctgtctgtgctt

SEQ ID NO: 197599 - DNA, 22 bp, Mus musculus
tgttttgtgaccaattatatgg

SEQ ID NO: 197600 - DNA, 20 bp, Mus musculus
ctggtaggtggttgttttgt

SEQ ID NO: 197601 - DNA, 23 bp, Mus musculus
ctctctgtgtctgtctctgtcat

SEQ ID NO: 197602 - DNA, 22 bp, Mus musculus
tgttttgtgaccaattatatgg

SEQ ID NO: 197603 - DNA, 22 bp, Mus musculus
atatgaatatgtgtatgtgtgt

SEQ ID NO: 197604 - DNA, 23 bp, Mus musculus
tgcacatatatagtctgtattta

SEQ ID NO: 197605 - DNA, 22 bp, Mus musculus
tgttttgtgaccaattatatgg

SEQ ID NO: 197606 - DNA, 21 bp, Mus musculus
agagttgagacacaaacaggt

SEQ ID NO: 197607 - DNA, 23 bp, Mus musculus
tctggctgccttcttcatgagag

SEQ ID NO: 197608 - DNA, 23 bp, Mus musculus
agtatgtatgtatatatgtgtgt

SEQ ID NO: 197609 - DNA, 23 bp, Mus musculus
tatatgcaccatgtgcatgcagt

SEQ ID NO: 197610 - DNA, 23 bp, Mus musculus
tcattcactctctcttacttgcc

SEQ ID NO: 197611 - DNA, 22 bp, Mus musculus
gcccagtgtctctctctccctg

SEQ ID NO: 197612 - DNA, 18 bp, Mus musculus
tatttacaatgacctgtg

SEQ ID NO: 197613 - DNA, 23 bp, Mus musculus
tttaagagctggttcttgtattg

SEQ ID NO: 197614 - DNA, 23 bp, Mus musculus
tagagagatgactcagagcactg

SEQ ID NO: 197615 - DNA, 18 bp, Mus musculus
agaggtcctgagttcaat

SEQ ID NO: 197616 - DNA, 23 bp, Mus musculus
aactgcttgtggtacagttgagt

SEQ ID NO: 197617 - DNA, 23 bp, Mus musculus
actttcactgtgagaacactggc

SEQ ID NO: 197618 - DNA, 20 bp, Mus musculus
tggagagatgatggctcagg

SEQ ID NO: 197619 - DNA, 23 bp, Mus musculus
acatacaagtgactcagcacatg

SEQ ID NO: 197620 - DNA, 22 bp, Mus musculus
agtgctagtatctattaagcat

SEQ ID NO: 197621 - DNA, 20 bp, Mus musculus
tcagcccatccattatctgt

SEQ ID NO: 197622 - DNA, 23 bp, Mus musculus
tgtttctctgtgtagccttggct

SEQ ID NO: 197623 - DNA, 19 bp, Mus musculus
aaatacatttactaatggt

SEQ ID NO: 197624 - DNA, 23 bp, Mus musculus
tgtccggctgaaattgatcatct

SEQ ID NO: 197625 - DNA, 18 bp, Mus musculus
tcaaagagcatccggatt

SEQ ID NO: 197626 - DNA, 23 bp, Mus musculus
agagaacatactgtgttctgtgg

SEQ ID NO: 197627 - DNA, 23 bp, Mus musculus
aggaaagatggtagagattcagt

SEQ ID NO: 197628 - DNA, 23 bp, Mus musculus
tgaagagttgtgatgttgatgtt

SEQ ID NO: 197629 - DNA, 22 bp, Mus musculus
tgtgcatatatgtatatatgta

SEQ ID NO: 197630 - DNA, 19 bp, Mus musculus
tctgagatgagagtgagca

SEQ ID NO: 197631 - DNA, 23 bp, Mus musculus
actggtcttagtgtcttcttcct

SEQ ID NO: 197632 - DNA, 19 bp, Mus musculus
atatgtgtgtgtgtgtatg

SEQ ID NO: 197633 - DNA, 23 bp, Mus musculus
agtcccattgcctgtgttgtaca

SEQ ID NO: 197634 - DNA, 19 bp, Mus musculus
agaggctgtgacaggggca

SEQ ID NO: 197635 - DNA, 23 bp, Mus musculus
tgtgtgtcacagtgtctgactcc

SEQ ID NO: 197636 - DNA, 23 bp, Mus musculus
taagagcactgactgctcttcca

SEQ ID NO: 197637 - DNA, 23 bp, Mus musculus
agggtcttgatgggcttctctac

SEQ ID NO: 197638 - DNA, 19 bp, Mus musculus
gtgggagtcagaggccttg

SEQ ID NO: 197639 - DNA, 19 bp, Mus musculus
acgtatatatacacgtgtg

SEQ ID NO: 197640 - DNA, 18 bp, Mus musculus
cacaaccacatgctggct

SEQ ID NO: 197641 - DNA, 23 bp, Mus musculus
ttcatgtgtatatgtatatatgt

SEQ ID NO: 197642 - DNA, 19 bp, Mus musculus
atatatgtatatgtatatg

SEQ ID NO: 197643 - DNA, 23 bp, Mus musculus
tgtctctggctgttcttattgga

SEQ ID NO: 197644 - DNA, 23 bp, Mus musculus
tctgcctgcctgcctgcctgcct

SEQ ID NO: 197645 - DNA, 22 bp, Mus musculus
tgttttgtgaccaattatatgg

SEQ ID NO: 197646 - DNA, 23 bp, Mus musculus
gagttacagacagttgttagtgg

SEQ ID NO: 197647 - DNA, 23 bp, Mus musculus
acacaccagagagtctgctctgt

SEQ ID NO: 197648 - DNA, 22 bp, Mus musculus
tctcaagtacatcactttccat

SEQ ID NO: 197649 - DNA, 23 bp, Mus musculus
atgtatgtatgtatgtatgtatc

SEQ ID NO: 197650 - DNA, 20 bp, Mus musculus
atattgctatacatgctcat

SEQ ID NO: 197651 - DNA, 21 bp, Mus musculus
aggaagtgtgtcatgttgggt

SEQ ID NO: 197652 - DNA, 23 bp, Mus musculus
taagccaggcccagtgtcactct

SEQ ID NO: 197653 - DNA, 23 bp, Mus musculus
gtgtgagtgtgcatgttcatgtg

SEQ ID NO: 197654 - DNA, 23 bp, Mus musculus
ccgagggtctctctcttgctctc

SEQ ID NO: 197655 - DNA, 19 bp, Mus musculus
attccctatttcttccttt

SEQ ID NO: 197656 - DNA, 23 bp, Mus musculus
gagagtgagaagagtcagaggtg

SEQ ID NO: 197657 - DNA, 23 bp, Mus musculus
gtgccatgttcttcagatgctct

SEQ ID NO: 197658 - DNA, 20 bp, Mus musculus
atgcatggatacaacagtaa

SEQ ID NO: 197659 - DNA, 23 bp, Mus musculus
gtatgtatgtatgtatgtatgtg

SEQ ID NO: 197660 - DNA, 21 bp, Mus musculus
tctctagagacagatgcagga

SEQ ID NO: 197661 - DNA, 22 bp, Mus musculus
tattgaggcttgttttgtgact

SEQ ID NO: 197662 - DNA, 22 bp, Mus musculus
tttatgtactaggatgtgttct

SEQ ID NO: 197663 - DNA, 23 bp, Mus musculus
tatgtatctatatatgtgtgtgt

SEQ ID NO: 197664 - DNA, 23 bp, Mus musculus
tatactttatatgtatatgtgtg

SEQ ID NO: 197665 - DNA, 22 bp, Mus musculus
tgtgtatctatgtatatatcta

SEQ ID NO: 197666 - DNA, 18 bp, Mus musculus
atatctatgtatatatct

SEQ ID NO: 197667 - DNA, 23 bp, Mus musculus
agtccatggttatctgacaggat

SEQ ID NO: 197668 - DNA, 22 bp, Mus musculus
tgttttgtgaccaattatatgg

SEQ ID NO: 197669 - DNA, 20 bp, Mus musculus
ttctgctgaagatgtttttc

SEQ ID NO: 197670 - DNA, 18 bp, Mus musculus
atcagagaaaaatttgtc

SEQ ID NO: 197671 - DNA, 23 bp, Mus musculus
ttgcactctcatttatatgtgtt

SEQ ID NO: 197672 - DNA, 19 bp, Mus musculus
catggtggtctgataggat

SEQ ID NO: 197673 - DNA, 22 bp, Mus musculus
tgttttgtgaccaattatatgg

SEQ ID NO: 197674 - DNA, 18 bp, Mus musculus
tgagcattctgactctct

SEQ ID NO: 197675 - DNA, 22 bp, Mus musculus
atgtgtgcataagtgtgcatgt

SEQ ID NO: 197676 - DNA, 23 bp, Mus musculus
atgtgtatgtgcatctgtatgtg

SEQ ID NO: 197677 - DNA, 22 bp, Mus musculus
tctctctgtctctatgtctctg

SEQ ID NO: 197678 - DNA, 20 bp, Mus musculus
atgtgtccttcttaatggtt

SEQ ID NO: 197679 - DNA, 23 bp, Mus musculus
aacagaacagtcagtggacagtt

SEQ ID NO: 197680 - DNA, 22 bp, Mus musculus
tgtcatgatctgtaatggctaa

SEQ ID NO: 197681 - DNA, 21 bp, Mus musculus
cactcagtatgtgaatgtcta

SEQ ID NO: 197682 - DNA, 23 bp, Mus musculus
atttgtgtgtgtgtgtatcaggt

SEQ ID NO: 197683 - DNA, 21 bp, Mus musculus
aagagatgtgtgcagtttggt

SEQ ID NO: 197684 - DNA, 20 bp, Mus musculus
tgtgtgtgtgcatgtgcatg

SEQ ID NO: 197685 - DNA, 23 bp, Mus musculus
atgtgtgtctgtgtataaggtat

SEQ ID NO: 197686 - DNA, 23 bp, Mus musculus
agcacattagtattctgtaagga

SEQ ID NO: 197687 - DNA, 23 bp, Mus musculus
atggaggaactcatatggaaatt

SEQ ID NO: 197688 - DNA, 20 bp, Mus musculus
tataaagtatgtttccagtt

SEQ ID NO: 197689 - DNA, 23 bp, Mus musculus
tgacaggaacaagatgacatgag

SEQ ID NO: 197690 - DNA, 21 bp, Mus musculus
atggatgacagaggaatgatg

SEQ ID NO: 197691 - DNA, 22 bp, Mus musculus
tgttttgtgaccaattatatgg

SEQ ID NO: 197692 - DNA, 19 bp, Mus musculus
ctgtcagactctgccagtg

SEQ ID NO: 197693 - DNA, 23 bp, Mus musculus
tttgagtcgagctgtttggttat

SEQ ID NO: 197694 - DNA, 21 bp, Mus musculus
gacttgaattggtgctcaact

SEQ ID NO: 197695 - DNA, 23 bp, Mus musculus
ttataactttgagtcaatcgagt

SEQ ID NO: 197696 - DNA, 22 bp, Mus musculus
ctttcggaatgctactgtttgt

SEQ ID NO: 197697 - DNA, 21 bp, Mus musculus
aaaagaacctgcagtgtcagc

SEQ ID NO: 197698 - DNA, 18 bp, Mus musculus
ttttgtgaagtagctttg

SEQ ID NO: 197699 - DNA, 23 bp, Mus musculus
tgtgtgtacatatacatatgtgt

SEQ ID NO: 197700 - DNA, 23 bp, Mus musculus
tttcaggagttgggtctcttctt

SEQ ID NO: 197701 - DNA, 23 bp, Mus musculus
cagactcagactgtgagacttgt

SEQ ID NO: 197702 - DNA, 23 bp, Mus musculus
tagtgcatggtgatctgatagga

SEQ ID NO: 197703 - DNA, 22 bp, Mus musculus
tgttttgtgacctattatgtgg

SEQ ID NO: 197704 - DNA, 23 bp, Mus musculus
tagtgcatggtgatctgatagga

SEQ ID NO: 197705 - DNA, 22 bp, Mus musculus
tgttttgtgacctattatgtgg

SEQ ID NO: 197706 - DNA, 21 bp, Mus musculus
ttgagacagggactcctcagc

SEQ ID NO: 197707 - DNA, 21 bp, Mus musculus
gtcagagaacacagtgaagac

SEQ ID NO: 197708 - DNA, 22 bp, Mus musculus
gatatgatatgtgtgtgcatat

SEQ ID NO: 197709 - DNA, 23 bp, Mus musculus
ctgtctgtctgcctgcctgcctg

SEQ ID NO: 197710 - DNA, 21 bp, Mus musculus
tcagaggacaacatatcctgg

SEQ ID NO: 197711 - DNA, 22 bp, Mus musculus
agtgcgtgtgtgtttgtatata

SEQ ID NO: 197712 - DNA, 22 bp, Mus musculus
tgttttgtgaccaattatatgg

SEQ ID NO: 197713 - DNA, 23 bp, Mus musculus
ctgtgcaaatgtatatgtatatg

SEQ ID NO: 197714 - DNA, 23 bp, Mus musculus
agaaaagagtgttctcagatgct

SEQ ID NO: 197715 - DNA, 22 bp, Mus musculus
tgttttgtgaccaattatatgg

SEQ ID NO: 197716 - DNA, 23 bp, Mus musculus
acaatgaatttgtaattgcctga

SEQ ID NO: 197717 - DNA, 21 bp, Mus musculus
agtgcatatttatttttgttc

SEQ ID NO: 197718 - DNA, 23 bp, Mus musculus
actcaggatgataatttctagtt

SEQ ID NO: 197719 - DNA, 19 bp, Mus musculus
tgtttgtttgttttcctga

SEQ ID NO: 197720 - DNA, 23 bp, Mus musculus
tgagaggctctgtcagtgcctga

SEQ ID NO: 197721 - DNA, 23 bp, Mus musculus
acatattgtacatatgtatacat

SEQ ID NO: 197722 - DNA, 22 bp, Mus musculus
tgttttgtgaccaattatatgg

SEQ ID NO: 197723 - DNA, 23 bp, Mus musculus
atgtagaatgtaaaggtgtatga

SEQ ID NO: 197724 - DNA, 23 bp, Mus musculus
acattaacacacggtttcatcac

SEQ ID NO: 197725 - DNA, 23 bp, Mus musculus
tatgtgtatgtatatgtgtgtgt

SEQ ID NO: 197726 - DNA, 20 bp, Mus musculus
tatgtgtgtatatatgtgtg

SEQ ID NO: 197727 - DNA, 21 bp, Mus musculus
tccatggtggtctgataggat

SEQ ID NO: 197728 - DNA, 22 bp, Mus musculus
tgttttgtgaccaattatatgg

SEQ ID NO: 197729 - DNA, 23 bp, Mus musculus
gtgtctctgactgtcctggaact

SEQ ID NO: 197730 - DNA, 23 bp, Mus musculus
tatgtatgtacatatgtatgtat

SEQ ID NO: 197731 - DNA, 22 bp, Mus musculus
tgttttgtgaccaattatatgg

SEQ ID NO: 197732 - DNA, 23 bp, Mus musculus
caccaggagcttcaggaaagtgt

SEQ ID NO: 197733 - DNA, 23 bp, Mus musculus
atcttcctgaagctcctctgtgt

SEQ ID NO: 197734 - DNA, 18 bp, Mus musculus
tgcatatatatatatatg

SEQ ID NO: 197735 - DNA, 23 bp, Mus musculus
gaacagtcttctcactgtctctg

SEQ ID NO: 197736 - DNA, 21 bp, Mus musculus
tccatggtggtctgataggat

SEQ ID NO: 197737 - DNA, 22 bp, Mus musculus
tgttttgtgaccaattatatgg

SEQ ID NO: 197738 - DNA, 23 bp, Mus musculus
tatgtgtgtatatatattcagta

SEQ ID NO: 197739 - DNA, 20 bp, Mus musculus
tttagaactgagatagcttt

SEQ ID NO: 197740 - DNA, 21 bp, Mus musculus
tatatagtttgcgaatgttgt

SEQ ID NO: 197741 - DNA, 23 bp, Mus musculus
aaatgtgtgtgcatgttcagaga

SEQ ID NO: 197742 - DNA, 18 bp, Mus musculus
attcctcacagtccagat

SEQ ID NO: 197743 - DNA, 22 bp, Mus musculus
ttgtgtgtgtatgtatatgtgt

SEQ ID NO: 197744 - DNA, 23 bp, Mus musculus
tatatgcatgtttatgtaacaca

SEQ ID NO: 197745 - DNA, 23 bp, Mus musculus
gtatatatgtatatgtattgagt

SEQ ID NO: 197746 - DNA, 23 bp, Mus musculus
tcagtgagaggttggagagaagg

SEQ ID NO: 197747 - DNA, 23 bp, Mus musculus
tgtctgtctgtctgtcagctgga

SEQ ID NO: 197748 - DNA, 20 bp, Mus musculus
tctggatttcttaagcctat

SEQ ID NO: 197749 - DNA, 19 bp, Mus musculus
tggttctcagcattcctga

SEQ ID NO: 197750 - DNA, 21 bp, Mus musculus
tttccacgtgaatgttggctt

SEQ ID NO: 197751 - DNA, 23 bp, Mus musculus
aactgtgggttcttacaggcact

SEQ ID NO: 197752 - DNA, 19 bp, Mus musculus
taaggacaagagttatatt

SEQ ID NO: 197753 - DNA, 22 bp, Mus musculus
tctgtacatgctctggcagagt

SEQ ID NO: 197754 - DNA, 22 bp, Mus musculus
aaggacagttgtgagcctccag

SEQ ID NO: 197755 - DNA, 23 bp, Mus musculus
taaagagtcagcgagaaatgaca

SEQ ID NO: 197756 - DNA, 23 bp, Mus musculus
tcattacatggatcagtgcccat

SEQ ID NO: 197757 - DNA, 19 bp, Mus musculus
cgttctcagtgtctttgct

SEQ ID NO: 197758 - DNA, 22 bp, Mus musculus
tcagactggatcaggagtctga

SEQ ID NO: 197759 - DNA, 21 bp, Mus musculus
tctgcctcacactctctgttc

SEQ ID NO: 197760 - DNA, 20 bp, Mus musculus
tgtgtgtatgtctctcagag

SEQ ID NO: 197761 - DNA, 21 bp, Mus musculus
ctggctcattcagttctgact

SEQ ID NO: 197762 - DNA, 22 bp, Mus musculus
tgtgtctcagactgtctgaccc

SEQ ID NO: 197763 - DNA, 23 bp, Mus musculus
tctcagtctgtctatgttgtccc

SEQ ID NO: 197764 - DNA, 23 bp, Mus musculus
tgagcgtctgactctcctcagga

SEQ ID NO: 197765 - DNA, 23 bp, Mus musculus
gtttttgacagagtttttcattt

SEQ ID NO: 197766 - DNA, 21 bp, Mus musculus
tatatgcatatactttctgta

SEQ ID NO: 197767 - DNA, 18 bp, Mus musculus
tatgtatgcatgtatatg

SEQ ID NO: 197768 - DNA, 23 bp, Mus musculus
atatatgtgtatgtatatgtgtg

SEQ ID NO: 197769 - DNA, 23 bp, Mus musculus
aatgtctctctgtgtgtactctt

SEQ ID NO: 197770 - DNA, 23 bp, Mus musculus
attctgacacttactgtctgggt

SEQ ID NO: 197771 - DNA, 23 bp, Mus musculus
actcagtgtctctgggtctctgt

SEQ ID NO: 197772 - DNA, 21 bp, Mus musculus
gaatgaacatgggctggagag

SEQ ID NO: 197773 - DNA, 23 bp, Mus musculus
gtctctctgtatctgtctgtctg

SEQ ID NO: 197774 - DNA, 18 bp, Mus musculus
agattgcgttgtatgcag

SEQ ID NO: 197775 - DNA, 21 bp, Mus musculus
tttactgtataacatgatgca

SEQ ID NO: 197776 - DNA, 23 bp, Mus musculus
cactgaacactcacagttgcttt

SEQ ID NO: 197777 - DNA, 21 bp, Mus musculus
atagtatgtatgtgtgtctgt

SEQ ID NO: 197778 - DNA, 23 bp, Mus musculus
ttcgtgaagtctgtgagcacacc

SEQ ID NO: 197779 - DNA, 22 bp, Mus musculus
acagggcctgggattcttctca

SEQ ID NO: 197780 - DNA, 20 bp, Mus musculus
acagaggtgagagagaacac

SEQ ID NO: 197781 - DNA, 21 bp, Mus musculus
tagacaaaggttctgctcagt

SEQ ID NO: 197782 - DNA, 20 bp, Mus musculus
cagctgcagtagagaaaatg

SEQ ID NO: 197783 - DNA, 21 bp, Mus musculus
tgtctgtatatatacatgtgt

SEQ ID NO: 197784 - DNA, 23 bp, Mus musculus
agcgctgactgctcttccagagg

SEQ ID NO: 197785 - DNA, 19 bp, Mus musculus
atagatatacaacctgtat

SEQ ID NO: 197786 - DNA, 20 bp, Mus musculus
aagggtgctctttgttatgt

SEQ ID NO: 197787 - DNA, 23 bp, Mus musculus
tatctatctctatctatattggt

SEQ ID NO: 197788 - DNA, 23 bp, Mus musculus
ggtatagacataggtatagatat

SEQ ID NO: 197789 - DNA, 21 bp, Mus musculus
agagaaatatgtttgaaaaat

SEQ ID NO: 197790 - DNA, 22 bp, Mus musculus
ttgaccttattttcaagtatga

SEQ ID NO: 197791 - DNA, 18 bp, Mus musculus
tgacagaagacactgagc

SEQ ID NO: 197792 - DNA, 20 bp, Mus musculus
aatgagcttcctgaaagcat

SEQ ID NO: 197793 - DNA, 21 bp, Mus musculus
taatgaacttccagtgctgtt

SEQ ID NO: 197794 - DNA, 18 bp, Mus musculus
ttaggtattatatacatg

SEQ ID NO: 197795 - DNA, 23 bp, Mus musculus
gtatgtgtgtgcatatgcatgtg

SEQ ID NO: 197796 - DNA, 23 bp, Mus musculus
gtgtcactctgtctggtactgct

SEQ ID NO: 197797 - DNA, 22 bp, Mus musculus
atatgtatacacacatatatgt

SEQ ID NO: 197798 - DNA, 23 bp, Mus musculus
actcgttatgtctctgaatcaga

SEQ ID NO: 197799 - DNA, 23 bp, Mus musculus
agaagacagaagacactgagaac

SEQ ID NO: 197800 - DNA, 22 bp, Mus musculus
gctctgcctttatcttgtctat

SEQ ID NO: 197801 - DNA, 23 bp, Mus musculus
tttcagaattgaaaagaaaagaa

SEQ ID NO: 197802 - DNA, 22 bp, Mus musculus
tgttttgtgaccaattatatgg

SEQ ID NO: 197803 - DNA, 23 bp, Mus musculus
tatgcatattatatgtatatcat

SEQ ID NO: 197804 - DNA, 22 bp, Mus musculus
atgtgcatatatgtggtatgca

SEQ ID NO: 197805 - DNA, 20 bp, Mus musculus
tcaccaacaactggagcatg

SEQ ID NO: 197806 - DNA, 23 bp, Mus musculus
agtctgtctgtgtgtgcctgcct

SEQ ID NO: 197807 - DNA, 22 bp, Mus musculus
catactgtctgactctgggtct

SEQ ID NO: 197808 - DNA, 19 bp, Mus musculus
agagctgttgctcatctat

SEQ ID NO: 197809 - DNA, 23 bp, Mus musculus
gtgtatgtttggatgttgtatgt

SEQ ID NO: 197810 - DNA, 21 bp, Mus musculus
ataatgaagattatcaattgt

SEQ ID NO: 197811 - DNA, 23 bp, Mus musculus
tctcagttgtgtgtgtggtcatg

SEQ ID NO: 197812 - DNA, 22 bp, Mus musculus
tttctgtaccaatacatctagt

SEQ ID NO: 197813 - DNA, 23 bp, Mus musculus
tagactaaagattttcttgatct

SEQ ID NO: 197814 - DNA, 23 bp, Mus musculus
cacatgctgtctcagtctctgag

SEQ ID NO: 197815 - DNA, 23 bp, Mus musculus
aagagttgtgtcttagcagttga

SEQ ID NO: 197816 - DNA, 23 bp, Mus musculus
tcaatatttttgtatctgttggg

SEQ ID NO: 197817 - DNA, 23 bp, Mus musculus
taaaggcacatattcaaatgttt

SEQ ID NO: 197818 - DNA, 21 bp, Mus musculus
agctgctatatattttcagtc

SEQ ID NO: 197819 - DNA, 18 bp, Mus musculus
tatcacatatgctgatca

SEQ ID NO: 197820 - DNA, 22 bp, Mus musculus
tgttttgtgaccaattatatgg

SEQ ID NO: 197821 - DNA, 22 bp, Mus musculus
tgttttgtgaccaattatatgg

SEQ ID NO: 197822 - DNA, 23 bp, Mus musculus
tgtatatgtatatgtatacatat

SEQ ID NO: 197823 - DNA, 23 bp, Mus musculus
tgtgtatgcgtatgcatatgtat

SEQ ID NO: 197824 - DNA, 23 bp, Mus musculus
caatatttttgtatctgttgagg

SEQ ID NO: 197825 - DNA, 23 bp, Mus musculus
tttgtgtccaattatatggtcaa

SEQ ID NO: 197826 - DNA, 23 bp, Mus musculus
cactgtctctctcagtgatttct

SEQ ID NO: 197827 - DNA, 22 bp, Mus musculus
atgaaactgagttgttttctaa

SEQ ID NO: 197828 - DNA, 23 bp, Mus musculus
tgtatgtgtatgtgtatatgtat

SEQ ID NO: 197829 - DNA, 22 bp, Mus musculus
acacatacattgtttctgttta

SEQ ID NO: 197830 - DNA, 20 bp, Mus musculus
tatagcatatatgtatatag

SEQ ID NO: 197831 - DNA, 23 bp, Mus musculus
gtgactctctggctcactcttat

SEQ ID NO: 197832 - DNA, 22 bp, Mus musculus
tctatagttagatatatttaga

SEQ ID NO: 197833 - DNA, 21 bp, Mus musculus
gatttgatggacattccattt

SEQ ID NO: 197834 - DNA, 23 bp, Mus musculus
agtgtgccagtgtctccctctct

SEQ ID NO: 197835 - DNA, 21 bp, Mus musculus
gtctccagcttttggtctttt

SEQ ID NO: 197836 - DNA, 23 bp, Mus musculus
tggcttataaccatctgtaatga

SEQ ID NO: 197837 - DNA, 19 bp, Mus musculus
ggtctctctgtctctctgt

SEQ ID NO: 197838 - DNA, 22 bp, Mus musculus
atgagcttcttggttgtataat

SEQ ID NO: 197839 - DNA, 21 bp, Mus musculus
tcttgagactcagagttcaca

SEQ ID NO: 197840 - DNA, 23 bp, Mus musculus
ttgtttgtcgttctgaatactta

SEQ ID NO: 197841 - DNA, 23 bp, Mus musculus
tatatacatatgtatacatatgt

SEQ ID NO: 197842 - DNA, 23 bp, Mus musculus
tcagtctctgtaagtctatgtga

SEQ ID NO: 197843 - DNA, 23 bp, Mus musculus
agggacagcatcctctcactctc

SEQ ID NO: 197844 - DNA, 22 bp, Mus musculus
tatgtgtatatgtatgtgtgtg

SEQ ID NO: 197845 - DNA, 23 bp, Mus musculus
tatgtgtgtgtatgtatacacat

SEQ ID NO: 197846 - DNA, 21 bp, Mus musculus
atatgtacatatgaatatatg

SEQ ID NO: 197847 - DNA, 20 bp, Mus musculus
agcaaagagcaagggcagtg

SEQ ID NO: 197848 - DNA, 23 bp, Mus musculus
tgtgttctgtctcagtgagtttg

SEQ ID NO: 197849 - DNA, 22 bp, Mus musculus
tgttttgtgaccaattatatgg

SEQ ID NO: 197850 - DNA, 23 bp, Mus musculus
aagagcactgactgctcttccag

SEQ ID NO: 197851 - DNA, 23 bp, Mus musculus
agtttctctgtgtagccttggct

SEQ ID NO: 197852 - DNA, 23 bp, Mus musculus
tcatctacccattgagatgactg

SEQ ID NO: 197853 - DNA, 22 bp, Mus musculus
ctgtctctctcagtgtgtacag

SEQ ID NO: 197854 - DNA, 20 bp, Mus musculus
ggaattcattgggtcaggga

SEQ ID NO: 197855 - DNA, 18 bp, Mus musculus
atatatgtatgtatatat

SEQ ID NO: 197856 - DNA, 23 bp, Mus musculus
tgtcactctctaagtctctgctt

SEQ ID NO: 197857 - DNA, 23 bp, Mus musculus
tcacccagtctcagtctctgtgg

SEQ ID NO: 197858 - DNA, 21 bp, Mus musculus
ctcacttcacagtcactgaga

SEQ ID NO: 197859 - DNA, 18 bp, Mus musculus
ttcagatgtgtgatatct

SEQ ID NO: 197860 - DNA, 21 bp, Mus musculus
tgacatcagagacagtggaca

SEQ ID NO: 197861 - DNA, 18 bp, Mus musculus
tatgtatacattaatgta

SEQ ID NO: 197862 - DNA, 19 bp, Mus musculus
tctctctgtctataagttg

SEQ ID NO: 197863 - DNA, 22 bp, Mus musculus
tgttttgtgaccaattatatgg

SEQ ID NO: 197864 - DNA, 23 bp, Mus musculus
tcctctttaaggtcttctacctg

SEQ ID NO: 197865 - DNA, 22 bp, Mus musculus
agactctcagactcttagatga

SEQ ID NO: 197866 - DNA, 22 bp, Mus musculus
ttatctgcattaactactgtat

SEQ ID NO: 197867 - DNA, 23 bp, Mus musculus
ttgaaattgtagctagttttgtt

SEQ ID NO: 197868 - DNA, 22 bp, Mus musculus
tgtgtctctggttagtttctgt

SEQ ID NO: 197869 - DNA, 21 bp, Mus musculus
gaatctgtccattgatgagag

SEQ ID NO: 197870 - DNA, 21 bp, Mus musculus
aatctagtagttctattcaga

SEQ ID NO: 197871 - DNA, 22 bp, Mus musculus
tcactcagtccagccctgtcag

SEQ ID NO: 197872 - DNA, 21 bp, Mus musculus
tagagagatgagtgagtgcag

SEQ ID NO: 197873 - DNA, 19 bp, Mus musculus
gcgtgtgtgtatatatgta

SEQ ID NO: 197874 - DNA, 23 bp, Mus musculus
gtgagatcatcgtgaattgtcta

SEQ ID NO: 197875 - DNA, 23 bp, Mus musculus
gtgtgcatgacatctctctgtgt

SEQ ID NO: 197876 - DNA, 23 bp, Mus musculus
tgtatgctgggtagagtgggggt

SEQ ID NO: 197877 - DNA, 23 bp, Mus musculus
ctgttctctgtgtgcaagcatgg

SEQ ID NO: 197878 - DNA, 23 bp, Mus musculus
tctgtctgtctgtctcaacctgg

SEQ ID NO: 197879 - DNA, 22 bp, Mus musculus
acagacatcactgtgttcacag

SEQ ID NO: 197880 - DNA, 18 bp, Mus musculus
gtatgtatgtatgtatgt

SEQ ID NO: 197881 - DNA, 22 bp, Mus musculus
attagcttcaagtggaggttct

SEQ ID NO: 197882 - DNA, 23 bp, Mus musculus
tcactgtctgtctgtgcctgtgg

SEQ ID NO: 197883 - DNA, 21 bp, Mus musculus
tgacagtgtcccagtctggag

SEQ ID NO: 197884 - DNA, 22 bp, Mus musculus
tccctgagtgacactgtctctg

SEQ ID NO: 197885 - DNA, 22 bp, Mus musculus
agtgacaggacagagagaggtg

SEQ ID NO: 197886 - DNA, 23 bp, Mus musculus
ctatatggatatgatgtcaaacc

SEQ ID NO: 197887 - DNA, 23 bp, Mus musculus
tagtccgttctgatcagatagga

SEQ ID NO: 197888 - DNA, 19 bp, Mus musculus
tgttttgtaaccaattata

SEQ ID NO: 197889 - DNA, 23 bp, Mus musculus
aaatcacagagtacatgttaagt

SEQ ID NO: 197890 - DNA, 22 bp, Mus musculus
tgttttgtgaccaattatatgg

SEQ ID NO: 197891 - DNA, 20 bp, Mus musculus
tatatgagtgtacatatgtg

SEQ ID NO: 197892 - DNA, 20 bp, Mus musculus
tgctgagtggtatttgtttg

SEQ ID NO: 197893 - DNA, 23 bp, Mus musculus
gtatgtatgtatgtatgtgtgtg

SEQ ID NO: 197894 - DNA, 20 bp, Mus musculus
tatgtatgtatgtatgtatg

SEQ ID NO: 197895 - DNA, 23 bp, Mus musculus
agtcaaatgctttgttatctgtt

SEQ ID NO: 197896 - DNA, 19 bp, Mus musculus
atgtatgtatatgtatttc

SEQ ID NO: 197897 - DNA, 22 bp, Mus musculus
tgttttgtgaccaattatatgg

SEQ ID NO: 197898 - DNA, 22 bp, Mus musculus
tgttttgtgaccaattatatgg

SEQ ID NO: 197899 - DNA, 23 bp, Mus musculus
tgtatgtatgtatatgtgtatgt

SEQ ID NO: 197900 - DNA, 23 bp, Mus musculus
tgagatttcaagatgttaacttg

SEQ ID NO: 197901 - DNA, 22 bp, Mus musculus
tatcaagttaatttcttcatgt

SEQ ID NO: 197902 - DNA, 21 bp, Mus musculus
taatgtatatgtatatgtgtg

SEQ ID NO: 197903 - DNA, 22 bp, Mus musculus
tgttttgtgaccaattatatgg

SEQ ID NO: 197904 - DNA, 23 bp, Mus musculus
tcatgtatatatgtatacatgta

SEQ ID NO: 197905 - DNA, 22 bp, Mus musculus
attttgtacatctgtatgtgtc

SEQ ID NO: 197906 - DNA, 21 bp, Mus musculus
tattgtgagtgcaatgcaaat

SEQ ID NO: 197907 - DNA, 20 bp, Mus musculus
ttatgtattatatattatgt

SEQ ID NO: 197908 - DNA, 23 bp, Mus musculus
tttctctgtcactatgatttctg

SEQ ID NO: 197909 - DNA, 22 bp, Mus musculus
ctatgcatatagtatgtcaaga

SEQ ID NO: 197910 - DNA, 22 bp, Mus musculus
aatgataaagacaaatgtcata

SEQ ID NO: 197911 - DNA, 23 bp, Mus musculus
atacatgcgtgtgtgaatgtgtg

SEQ ID NO: 197912 - DNA, 23 bp, Mus musculus
tatgtgtatgtgcatgtgcttgt

SEQ ID NO: 197913 - DNA, 23 bp, Mus musculus
atgtgagtgtatgtacatgtgtg

SEQ ID NO: 197914 - DNA, 20 bp, Mus musculus
gtgtctgtctgtcaattccc

SEQ ID NO: 197915 - DNA, 23 bp, Mus musculus
caccgtctgtctctctcttcctg

SEQ ID NO: 197916 - DNA, 23 bp, Mus musculus
agatgacctggtacaggtccatg

SEQ ID NO: 197917 - DNA, 23 bp, Mus musculus
gggcttgctgtctcagtctctgt

SEQ ID NO: 197918 - DNA, 23 bp, Mus musculus
actcacacactgaaacaggagtg

SEQ ID NO: 197919 - DNA, 23 bp, Mus musculus
tatctctctgtgtgtatatagag

SEQ ID NO: 197920 - DNA, 23 bp, Mus musculus
tgtgtctcctggcaattgagggt

SEQ ID NO: 197921 - DNA, 23 bp, Mus musculus
tatgtgtgtgcatatgcatgtgt

SEQ ID NO: 197922 - DNA, 23 bp, Mus musculus
cacactgagaagtaagcaaaaca

SEQ ID NO: 197923 - DNA, 21 bp, Mus musculus
tgttaagttctttcagtgtcc

SEQ ID NO: 197924 - DNA, 22 bp, Mus musculus
tgttttgtgaccaattatatgg

SEQ ID NO: 197925 - DNA, 22 bp, Mus musculus
tccttcagcatctgcatgtgct

SEQ ID NO: 197926 - DNA, 22 bp, Mus musculus
tgttttgtgaccaattatatgg

SEQ ID NO: 197927 - DNA, 21 bp, Mus musculus
gcatgagaggcataaatcaga

SEQ ID NO: 197928 - DNA, 22 bp, Mus musculus
aacaaagattgctttcctttcc

SEQ ID NO: 197929 - DNA, 23 bp, Mus musculus
gtctgtctgtctgtctgtctgtc

SEQ ID NO: 197930 - DNA, 23 bp, Mus musculus
tgtctgagtcactatctcagtgc

SEQ ID NO: 197931 - DNA, 23 bp, Mus musculus
tcacttgctctttcactcactct

SEQ ID NO: 197932 - DNA, 19 bp, Mus musculus
atgactgagaactgttccc

SEQ ID NO: 197933 - DNA, 23 bp, Mus musculus
aaagacaggctagtattgactat

SEQ ID NO: 197934 - DNA, 21 bp, Mus musculus
agtggagttacaaagtgctat

SEQ ID NO: 197935 - DNA, 22 bp, Mus musculus
atgatgtatttttcattattga

SEQ ID NO: 197936 - DNA, 22 bp, Mus musculus
tgttttgtgaccaattatatgg

SEQ ID NO: 197937 - DNA, 23 bp, Mus musculus
attgatcctctgggactctggga

SEQ ID NO: 197938 - DNA, 20 bp, Mus musculus
tcccaggatcagagttacag

SEQ ID NO: 197939 - DNA, 22 bp, Mus musculus
agacacacagatatacacacac

SEQ ID NO: 197940 - DNA, 21 bp, Mus musculus
tgtgcatgtatgtatgtatgt

SEQ ID NO: 197941 - DNA, 23 bp, Mus musculus
tgtcacccagactctctgtcctt

SEQ ID NO: 197942 - DNA, 18 bp, Mus musculus
ctctgctttaatcacaga

SEQ ID NO: 197943 - DNA, 23 bp, Mus musculus
tcttgtgagaattcagtgaggtc

SEQ ID NO: 197944 - DNA, 20 bp, Mus musculus
agcctccctgaaacttctgt

SEQ ID NO: 197945 - DNA, 19 bp, Mus musculus
agtacactcagtttccact

SEQ ID NO: 197946 - DNA, 23 bp, Mus musculus
acactttgtctctctgaaatgca

SEQ ID NO: 197947 - DNA, 20 bp, Mus musculus
tgtctctctgttaggtcagg

SEQ ID NO: 197948 - DNA, 23 bp, Mus musculus
actgactccctgtgaccctggca

SEQ ID NO: 197949 - DNA, 22 bp, Mus musculus
tgttttgtgaccaattatatgg

SEQ ID NO: 197950 - DNA, 22 bp, Mus musculus
ggaagagcagtcagtgctctta

SEQ ID NO: 197951 - DNA, 23 bp, Mus musculus
atacacacacgtatatatatgta

SEQ ID NO: 197952 - DNA, 23 bp, Mus musculus
tgtgtatgtgtatataagtgtgt

SEQ ID NO: 197953 - DNA, 22 bp, Mus musculus
tgtatgtgtgcatgtgcatgtg

SEQ ID NO: 197954 - DNA, 23 bp, Mus musculus
gtgtctgtctgtctgtctgtctg

SEQ ID NO: 197955 - DNA, 23 bp, Mus musculus
ttctctgtttagtttttgtctga

SEQ ID NO: 197956 - DNA, 23 bp, Mus musculus
tatgtgagggtcattatgtgatt

SEQ ID NO: 197957 - DNA, 22 bp, Mus musculus
tctgaatcttgatcattctcct

SEQ ID NO: 197958 - DNA, 21 bp, Mus musculus
tattcgtccaagctcattcct

SEQ ID NO: 197959 - DNA, 23 bp, Mus musculus
aagaacacagatgctggtctgga

SEQ ID NO: 197960 - DNA, 20 bp, Mus musculus
aagagcactgactgctcttc

SEQ ID NO: 197961 - DNA, 21 bp, Mus musculus
tggctggcttcctgattccca

SEQ ID NO: 197962 - DNA, 23 bp, Mus musculus
tgtctgtctttgtctctgtctca

SEQ ID NO: 197963 - DNA, 22 bp, Mus musculus
atatatatgtacacacacacac

SEQ ID NO: 197964 - DNA, 23 bp, Mus musculus
acacacacacatgtatatgatct

SEQ ID NO: 197965 - DNA, 22 bp, Mus musculus
tgacaatttgctttgtgtgagt

SEQ ID NO: 197966 - DNA, 20 bp, Mus musculus
agactgaagagatggctcag

SEQ ID NO: 197967 - DNA, 23 bp, Mus musculus
aaagcactgactgctcttccaga

SEQ ID NO: 197968 - DNA, 23 bp, Mus musculus
cagtcagcagactgaactggggt

SEQ ID NO: 197969 - DNA, 20 bp, Mus musculus
accctcagaggtcatgactg

SEQ ID NO: 197970 - DNA, 19 bp, Mus musculus
aagagcgctgactgctctt

SEQ ID NO: 197971 - DNA, 18 bp, Mus musculus
cagaggtcctgagttcaa

SEQ ID NO: 197972 - DNA, 23 bp, Mus musculus
aggcagaactctgtgagctcaag

SEQ ID NO: 197973 - DNA, 23 bp, Mus musculus
tctacagagtaaaacctgtctcc

SEQ ID NO: 197974 - DNA, 19 bp, Mus musculus
gacagatgtcagcctcgag

SEQ ID NO: 197975 - DNA, 19 bp, Mus musculus
agagacatctacctcgttt

SEQ ID NO: 197976 - DNA, 21 bp, Mus musculus
atcctgaatgctgtccaggca

SEQ ID NO: 197977 - DNA, 23 bp, Mus musculus
tctgtcagcctgtgtcactgaaa

SEQ ID NO: 197978 - DNA, 23 bp, Mus musculus
ttgaagctgagtctttgggtgct

SEQ ID NO: 197979 - DNA, 21 bp, Mus musculus
agagtgggacattatggggct

SEQ ID NO: 197980 - DNA, 21 bp, Mus musculus
tccatggtggtctgataggat

SEQ ID NO: 197981 - DNA, 22 bp, Mus musculus
tgttttgtgaccaattatatgg

SEQ ID NO: 197982 - DNA, 23 bp, Mus musculus
tcagtggctctgtggctctgcct

SEQ ID NO: 197983 - DNA, 20 bp, Mus musculus
tgtgtgtgtgtttgtacacc

SEQ ID NO: 197984 - DNA, 22 bp, Mus musculus
tgtgtatttgtatgtgtatatg

SEQ ID NO: 197985 - DNA, 23 bp, Mus musculus
ctgctgtaactccaactccatgt

SEQ ID NO: 197986 - DNA, 23 bp, Mus musculus
taggttttcaatttgtatgtgta

SEQ ID NO: 197987 - DNA, 19 bp, Mus musculus
tgacgcagagcaaagggaa

SEQ ID NO: 197988 - DNA, 21 bp, Mus musculus
agtatctgtgtgtggttatga

SEQ ID NO: 197989 - DNA, 23 bp, Mus musculus
tcaggtcagtgtgcagacagagg

SEQ ID NO: 197990 - DNA, 22 bp, Mus musculus
tccttttgcagctgtctcttga

SEQ ID NO: 197991 - DNA, 22 bp, Mus musculus
tgtgtggagtgtattgttttct

SEQ ID NO: 197992 - DNA, 22 bp, Mus musculus
gaccctgcctcactgaggctct

SEQ ID NO: 197993 - DNA, 20 bp, Mus musculus
aagagcactgactgctcttc

SEQ ID NO: 197994 - DNA, 23 bp, Mus musculus
tcactcacactggctgacttaat

SEQ ID NO: 197995 - DNA, 23 bp, Mus musculus
ccagcatgacagaagtgtgtgtg

SEQ ID NO: 197996 - DNA, 23 bp, Mus musculus
acacctgtcagtctctgtcctga

SEQ ID NO: 197997 - DNA, 23 bp, Mus musculus
gtcactcacactggctgacttaa

SEQ ID NO: 197998 - DNA, 23 bp, Mus musculus
atgagacacagacactgtacgtc

SEQ ID NO: 197999 - DNA, 23 bp, Mus musculus
ctgtctgtatgtctgtgtgtctt

SEQ ID NO: 198000 - DNA, 21 bp, Mus musculus
tgggtgggtgcctcttagcca

SEQ ID NO: 198001 - DNA, 18 bp, Mus musculus
aataaggaggacccagcc

SEQ ID NO: 198002 - DNA, 23 bp, Mus musculus
cagtcagcctctctcaatctgca

SEQ ID NO: 198003 - DNA, 21 bp, Mus musculus
agagtgggcattgagttggtg

SEQ ID NO: 198004 - DNA, 22 bp, Mus musculus
actaacctacaatgtgtgtgtg

SEQ ID NO: 198005 - DNA, 23 bp, Mus musculus
agagtgcacacacacactctgac

SEQ ID NO: 198006 - DNA, 22 bp, Mus musculus
atatgtctatgtctgtctgtct

SEQ ID NO: 198007 - DNA, 23 bp, Mus musculus
taataatctttctagaagccaaa

SEQ ID NO: 198008 - DNA, 23 bp, Mus musculus
cagtgggtcagtgagtcagtgga

SEQ ID NO: 198009 - DNA, 23 bp, Mus musculus
acataccttatgaagatgataat

SEQ ID NO: 198010 - DNA, 23 bp, Mus musculus
ctgtgtctctgtttagtttctgt

SEQ ID NO: 198011 - DNA, 23 bp, Mus musculus
aggatctgtccattgatgagagt

SEQ ID NO: 198012 - DNA, 20 bp, Mus musculus
ggatttgtgtttgtcttgat

SEQ ID NO: 198013 - DNA, 18 bp, Mus musculus
attctggctatcactttg

SEQ ID NO: 198014 - DNA, 23 bp, Mus musculus
tgtctctgcatctgcttcagtaa

SEQ ID NO: 198015 - DNA, 22 bp, Mus musculus
tgttttgtgaccaattatatgg

SEQ ID NO: 198016 - DNA, 23 bp, Mus musculus
ctgtgtctctgtttagtttctgt

SEQ ID NO: 198017 - DNA, 22 bp, Mus musculus
atctatccattgatgacagtgg

SEQ ID NO: 198018 - DNA, 23 bp, Mus musculus
ctgtgtctctgtttagtttctgt

SEQ ID NO: 198019 - DNA, 22 bp, Mus musculus
atctatccattgatgacagtgg

SEQ ID NO: 198020 - DNA, 23 bp, Mus musculus
tgtgagaagaaagagaccaactt

SEQ ID NO: 198021 - DNA, 21 bp, Mus musculus
atgtatgtatgtatgtatgta

SEQ ID NO: 198022 - DNA, 23 bp, Mus musculus
aatgtatatatgtatgtatgtat

SEQ ID NO: 198023 - DNA, 23 bp, Mus musculus
tcagccatttgtattgagaattc

SEQ ID NO: 198024 - DNA, 22 bp, Mus musculus
tgttttgtgaccaattatatgg

SEQ ID NO: 198025 - DNA, 19 bp, Mus musculus
cattgtttagatgtgtgtt

SEQ ID NO: 198026 - DNA, 20 bp, Mus musculus
tttctggatatatatacata

SEQ ID NO: 198027 - DNA, 23 bp, Mus musculus
tagtgcatggtgatctgatagga

SEQ ID NO: 198028 - DNA, 22 bp, Mus musculus
tgttttgtgacctattatgtgg

SEQ ID NO: 198029 - DNA, 23 bp, Mus musculus
actgagaatactattctattcca

SEQ ID NO: 198030 - DNA, 22 bp, Mus musculus
agcagttaatgctgctgtgtga

SEQ ID NO: 198031 - DNA, 23 bp, Mus musculus
ttttgtgaccaattatatgctca

SEQ ID NO: 198032 - DNA, 23 bp, Mus musculus
atggtggtctgataggatgtatg

SEQ ID NO: 198033 - DNA, 23 bp, Mus musculus
agatgaggttttcttgttgtctt

SEQ ID NO: 198034 - DNA, 23 bp, Mus musculus
atgtatgtgtgtatgtatatgcc

SEQ ID NO: 198035 - DNA, 22 bp, Mus musculus
ttatcactgttagatatttggc

SEQ ID NO: 198036 - DNA, 21 bp, Mus musculus
tctctgtgtctgtcttcctgt

SEQ ID NO: 198037 - DNA, 23 bp, Mus musculus
tcagaagggagtgtgcacaggtg

SEQ ID NO: 198038 - DNA, 22 bp, Mus musculus
tttctgtccctgctacacacac

SEQ ID NO: 198039 - DNA, 23 bp, Mus musculus
aacagtgacaggaattgcatgtg

SEQ ID NO: 198040 - DNA, 21 bp, Mus musculus
tttatggtcaattttatggtc

SEQ ID NO: 198041 - DNA, 19 bp, Mus musculus
agaacattcacataaatga

SEQ ID NO: 198042 - DNA, 22 bp, Mus musculus
tttcttgtatgtgattgatgtt

SEQ ID NO: 198043 - DNA, 21 bp, Mus musculus
atcacagtacagtgtgtgcag

SEQ ID NO: 198044 - DNA, 23 bp, Mus musculus
tctgtgaggccatactgtatcag

SEQ ID NO: 198045 - DNA, 21 bp, Mus musculus
ctttcagtcagtctgtctgtc

SEQ ID NO: 198046 - DNA, 23 bp, Mus musculus
ctatctctctgtctgtatatgtt

SEQ ID NO: 198047 - DNA, 22 bp, Mus musculus
gctgactgcattacttcacttg

SEQ ID NO: 198048 - DNA, 21 bp, Mus musculus
tatgacaaattattttgtggt

SEQ ID NO: 198049 - DNA, 18 bp, Mus musculus
ctctgcttctcagaagta

SEQ ID NO: 198050 - DNA, 22 bp, Mus musculus
tgttttgtgaccaattatatgg

SEQ ID NO: 198051 - DNA, 23 bp, Mus musculus
ttatgtgcatatgtatatatgta

SEQ ID NO: 198052 - DNA, 22 bp, Mus musculus
tttttggttgataatattatga

SEQ ID NO: 198053 - DNA, 23 bp, Mus musculus
tctctctcactgagtgattgcct

SEQ ID NO: 198054 - DNA, 23 bp, Mus musculus
aacactgactgctcttccagagg

SEQ ID NO: 198055 - DNA, 23 bp, Mus musculus
actctgtctatgtctgtgcctgc

SEQ ID NO: 198056 - DNA, 20 bp, Mus musculus
taccacaggggctggagaga

SEQ ID NO: 198057 - DNA, 21 bp, Mus musculus
taaatctgtgtagccaattgt

SEQ ID NO: 198058 - DNA, 23 bp, Mus musculus
tgactttgggtgtcttctggcca

SEQ ID NO: 198059 - DNA, 23 bp, Mus musculus
tccctgagaagacacactggaca

SEQ ID NO: 198060 - DNA, 23 bp, Mus musculus
ttttttcttcttctagaattttg

SEQ ID NO: 198061 - DNA, 23 bp, Mus musculus
gtggaacacagtatatgtctgtc

SEQ ID NO: 198062 - DNA, 23 bp, Mus musculus
atatacactatgtaaatgtgtgt

SEQ ID NO: 198063 - DNA, 23 bp, Mus musculus
aaacatatatgtaaatgtgtatc

SEQ ID NO: 198064 - DNA, 23 bp, Mus musculus
tctcaccgtgatgctctctgtct

SEQ ID NO: 198065 - DNA, 23 bp, Mus musculus
ttgcaggtaaagttgtttgggca

SEQ ID NO: 198066 - DNA, 22 bp, Mus musculus
ggacacactgtgacatactgca

SEQ ID NO: 198067 - DNA, 23 bp, Mus musculus
gtgagtgagtgagtgagtgagtg

SEQ ID NO: 198068 - DNA, 20 bp, Mus musculus
cactggagaagagtacctgc

SEQ ID NO: 198069 - DNA, 18 bp, Mus musculus
tctgtgtgtgtgtgtgtg

SEQ ID NO: 198070 - DNA, 18 bp, Mus musculus
tcgacactacagtgaatg

SEQ ID NO: 198071 - DNA, 23 bp, Mus musculus
tggactgtgaggattcagtgtgg

SEQ ID NO: 198072 - DNA, 22 bp, Mus musculus
atgtatgtatgtgtgtatgtac

SEQ ID NO: 198073 - DNA, 23 bp, Mus musculus
atgcatgtgtgtgtgggtatgtt

SEQ ID NO: 198074 - DNA, 23 bp, Mus musculus
gtgtatatgtgtgtgcatgtgtg

SEQ ID NO: 198075 - DNA, 23 bp, Mus musculus
tgactctgtgtctctgctgtctg

SEQ ID NO: 198076 - DNA, 19 bp, Mus musculus
cagtccatggttcactggg

SEQ ID NO: 198077 - DNA, 23 bp, Mus musculus
catgttgctctgtaactctgagc

SEQ ID NO: 198078 - DNA, 23 bp, Mus musculus
ttgtcagtcattttgtcacagca

SEQ ID NO: 198079 - DNA, 23 bp, Mus musculus
gctttgtgtgatgtgtctgaggt

SEQ ID NO: 198080 - DNA, 20 bp, Mus musculus
atgtgtatatgtatatgtgt

SEQ ID NO: 198081 - DNA, 20 bp, Mus musculus
atgtgtatatgtatatgtgt

SEQ ID NO: 198082 - DNA, 18 bp, Mus musculus
tgtgcacatgtctacata

SEQ ID NO: 198083 - DNA, 19 bp, Mus musculus
tatacacacacacacatat

SEQ ID NO: 198084 - DNA, 22 bp, Mus musculus
tttgcaagaattttattgagta

SEQ ID NO: 198085 - DNA, 21 bp, Mus musculus
ctctgcctctctctggccctc

SEQ ID NO: 198086 - DNA, 22 bp, Mus musculus
tgttttgtgaccaattatatgg

SEQ ID NO: 198087 - DNA, 23 bp, Mus musculus
agtgaagacaatgggtattgtgt

SEQ ID NO: 198088 - DNA, 23 bp, Mus musculus
ctgcctctctgtaactttctctc

SEQ ID NO: 198089 - DNA, 22 bp, Mus musculus
gtcagtgtctcacactctgcta

SEQ ID NO: 198090 - DNA, 22 bp, Mus musculus
tgttttgtgaccaattatatgg

SEQ ID NO: 198091 - DNA, 20 bp, Mus musculus
ctctgcatgcttgagtcagg

SEQ ID NO: 198092 - DNA, 22 bp, Mus musculus
tgagattgctgtcagagataag

SEQ ID NO: 198093 - DNA, 22 bp, Mus musculus
ttctctcatattcttatagtgt

SEQ ID NO: 198094 - DNA, 23 bp, Mus musculus
ctgactcagagcagccttcagtc

SEQ ID NO: 198095 - DNA, 23 bp, Mus musculus
ctgactgctcttccagaggtcct

SEQ ID NO: 198096 - DNA, 20 bp, Mus musculus
tccaccacagcatctggctc

SEQ ID NO: 198097 - DNA, 19 bp, Mus musculus
taggatgtagaagcaggaa

SEQ ID NO: 198098 - DNA, 23 bp, Mus musculus
atatgtctgtctgtctgtgcttg

SEQ ID NO: 198099 - DNA, 22 bp, Mus musculus
atcacattgccagggatttcca

SEQ ID NO: 198100 - DNA, 22 bp, Mus musculus
ttcacagtggctaagttccgcc

SEQ ID NO: 198101 - DNA, 20 bp, Mus musculus
gtgcctactgagctgaaaca

SEQ ID NO: 198102 - DNA, 22 bp, Mus musculus
tggctcagttcagcaggaacag

SEQ ID NO: 198103 - DNA, 20 bp, Mus musculus
acacacacacatatgtatgt

SEQ ID NO: 198104 - DNA, 19 bp, Mus musculus
tatatgtgtgtatatgtat

SEQ ID NO: 198105 - DNA, 23 bp, Mus musculus
agacgtgtgtgtgtgtgtgtgtg

SEQ ID NO: 198106 - DNA, 23 bp, Mus musculus
atactctcttgagccagttcaga

SEQ ID NO: 198107 - DNA, 21 bp, Mus musculus
tgtcagtcaggagagagggcg

SEQ ID NO: 198108 - DNA, 23 bp, Mus musculus
cctctgtcactgaatttcttgtc

SEQ ID NO: 198109 - DNA, 21 bp, Mus musculus
gactgctaagtttctagtgca

SEQ ID NO: 198110 - DNA, 19 bp, Mus musculus
tgtaagaattgggaagtgt

SEQ ID NO: 198111 - DNA, 23 bp, Mus musculus
tctcaggatgtttctctcagtta

SEQ ID NO: 198112 - DNA, 23 bp, Mus musculus
tttttgtgtttaaagctgtgtgc

SEQ ID NO: 198113 - DNA, 23 bp, Mus musculus
tgctacttgtcgctgagtgatag

SEQ ID NO: 198114 - DNA, 22 bp, Mus musculus
ctcagatggttgagtgcactaa

SEQ ID NO: 198115 - DNA, 22 bp, Mus musculus
tgtcagatgagtgtgacctcaa

SEQ ID NO: 198116 - DNA, 21 bp, Mus musculus
tccatggtggtctgataggat

SEQ ID NO: 198117 - DNA, 22 bp, Mus musculus
tgttttgtgaccaattatatgg

SEQ ID NO: 198118 - DNA, 22 bp, Mus musculus
tatatgtatgtatatatgtatg

SEQ ID NO: 198119 - DNA, 23 bp, Mus musculus
tattgcacttctcagggcctgct

SEQ ID NO: 198120 - DNA, 22 bp, Mus musculus
tgttttgtgaccaattatatgg

SEQ ID NO: 198121 - DNA, 23 bp, Mus musculus
actgagagagtgacaggctgagt

SEQ ID NO: 198122 - DNA, 23 bp, Mus musculus
aagagcactgtctgctcttccag

SEQ ID NO: 198123 - DNA, 18 bp, Mus musculus
tccgtggtgatctgatag

SEQ ID NO: 198124 - DNA, 22 bp, Mus musculus
ttttgtgtccgattatatggcc

SEQ ID NO: 198125 - DNA, 23 bp, Mus musculus
tatatgtatatatatgtatgtgt

SEQ ID NO: 198126 - DNA, 22 bp, Mus musculus
tgttttgtgaccaattatatgg

SEQ ID NO: 198127 - DNA, 19 bp, Mus musculus
gttctgactagatatgtct

SEQ ID NO: 198128 - DNA, 22 bp, Mus musculus
gagagagcagccagtgctctca

SEQ ID NO: 198129 - DNA, 19 bp, Mus musculus
ttacatcctgaggcactga

SEQ ID NO: 198130 - DNA, 23 bp, Mus musculus
gtggtttagagtcacacaaatct

SEQ ID NO: 198131 - DNA, 23 bp, Mus musculus
tctctctgactctgagtaagggg

SEQ ID NO: 198132 - DNA, 21 bp, Mus musculus
tttatagagtggagccttagg

SEQ ID NO: 198133 - DNA, 22 bp, Mus musculus
aatactgtcggataatgataac

SEQ ID NO: 198134 - DNA, 20 bp, Mus musculus
atgcagatgtaaatgcatgt

SEQ ID NO: 198135 - DNA, 23 bp, Mus musculus
tgtatatgtgcatatgtttttcc

SEQ ID NO: 198136 - DNA, 23 bp, Mus musculus
tgcatgtatgtattcatgtatgt

SEQ ID NO: 198137 - DNA, 23 bp, Mus musculus
cactgccatttatttctgcatca

SEQ ID NO: 198138 - DNA, 20 bp, Mus musculus
attctctttcatctacggat

SEQ ID NO: 198139 - DNA, 22 bp, Mus musculus
atcaatgctgaagagagtggcc

SEQ ID NO: 198140 - DNA, 23 bp, Mus musculus
attttcagacgaatgttctctgt

SEQ ID NO: 198141 - DNA, 23 bp, Mus musculus
atgtgtgtatatatatgtgtgtg

SEQ ID NO: 198142 - DNA, 23 bp, Mus musculus
atatgtgtgtatgtatatatgtg

SEQ ID NO: 198143 - DNA, 19 bp, Mus musculus
gacagaggacagagagcac

SEQ ID NO: 198144 - DNA, 23 bp, Mus musculus
caccgcaggttttgttactgttg

SEQ ID NO: 198145 - DNA, 23 bp, Mus musculus
tgtatatgtgtttgcatgtgtat

SEQ ID NO: 198146 - DNA, 23 bp, Mus musculus
atatgtgtgtgaatgtatatgtg

SEQ ID NO: 198147 - DNA, 20 bp, Mus musculus
tctgcctgttgtttcgttct

SEQ ID NO: 198148 - DNA, 23 bp, Mus musculus
gatctcagcgtctgttttcatct

SEQ ID NO: 198149 - DNA, 23 bp, Mus musculus
tctcagaagaaagacagctgtgc

SEQ ID NO: 198150 - DNA, 23 bp, Mus musculus
aacttcatcctcggtctctctct

SEQ ID NO: 198151 - DNA, 20 bp, Mus musculus
tgggagtgggacccatcagt

SEQ ID NO: 198152 - DNA, 23 bp, Mus musculus
acagaaaactgactccaaagctt

SEQ ID NO: 198153 - DNA, 23 bp, Mus musculus
gagctgtgtgtgtgtctgccacc

SEQ ID NO: 198154 - DNA, 23 bp, Mus musculus
tgccagtgtcagtgatgctgcat

SEQ ID NO: 198155 - DNA, 23 bp, Mus musculus
agtactctcttacactctgcctc

SEQ ID NO: 198156 - DNA, 23 bp, Mus musculus
agatgtctactgtacacaaagct

SEQ ID NO: 198157 - DNA, 21 bp, Mus musculus
tcaggaggtcctagtcagtgc

SEQ ID NO: 198158 - DNA, 22 bp, Mus musculus
agggtctgaagtctgcctgcag

SEQ ID NO: 198159 - DNA, 23 bp, Mus musculus
gacctgatcctgtgtctgtgtca

SEQ ID NO: 198160 - DNA, 23 bp, Mus musculus
tatgtgtgtgtatatgtatatat

SEQ ID NO: 198161 - DNA, 22 bp, Mus musculus
actgactgctcttccagaggtc

SEQ ID NO: 198162 - DNA, 18 bp, Mus musculus
caaggtggtctaggtcct

SEQ ID NO: 198163 - DNA, 23 bp, Mus musculus
atgtatgtatgtatgtatgtgcc

SEQ ID NO: 198164 - DNA, 22 bp, Mus musculus
ggtatgtgcatggacaccacat

SEQ ID NO: 198165 - DNA, 23 bp, Mus musculus
tgcctgggtccctgcctgcctgt

SEQ ID NO: 198166 - DNA, 18 bp, Mus musculus
cctgtgaggtcaggatgt

SEQ ID NO: 198167 - DNA, 23 bp, Mus musculus
acagcaaattatttgagcttttg

SEQ ID NO: 198168 - DNA, 19 bp, Mus musculus
tgggatcttgctgtatcct

SEQ ID NO: 198169 - DNA, 23 bp, Mus musculus
tagtccatggtgatctgatagga

SEQ ID NO: 198170 - DNA, 22 bp, Mus musculus
ttgttttgtgaccaattatgtg

SEQ ID NO: 198171 - DNA, 23 bp, Mus musculus
agcagcaaagacagtcacactgc

SEQ ID NO: 198172 - DNA, 20 bp, Mus musculus
cagactgggaaaaacctctg

SEQ ID NO: 198173 - DNA, 22 bp, Mus musculus
agtctcactgattcttataagg

SEQ ID NO: 198174 - DNA, 22 bp, Mus musculus
ccctagtgttgactttcagtgc

SEQ ID NO: 198175 - DNA, 23 bp, Mus musculus
ctatctctctaatgtagaagacg

SEQ ID NO: 198176 - DNA, 19 bp, Mus musculus
tatcagtgtgtgtgtgaat

SEQ ID NO: 198177 - DNA, 20 bp, Mus musculus
aaattgtgtgtttatgtatc

SEQ ID NO: 198178 - DNA, 23 bp, Mus musculus
tccctctgtcactggctgcctct

SEQ ID NO: 198179 - DNA, 19 bp, Mus musculus
tgtatatatatatatgtgt

SEQ ID NO: 198180 - DNA, 21 bp, Mus musculus
tgtgtgtatatgtgtttgtgc

SEQ ID NO: 198181 - DNA, 23 bp, Mus musculus
tatatatgtgtatatgtttgtgt

SEQ ID NO: 198182 - DNA, 20 bp, Mus musculus
tatgcatatatgtatgtatg

SEQ ID NO: 198183 - DNA, 23 bp, Mus musculus
tgcatatgtatatatacatgtgt

SEQ ID NO: 198184 - DNA, 21 bp, Mus musculus
taagtttatatagctgtttgt

SEQ ID NO: 198185 - DNA, 23 bp, Mus musculus
acagacactgtgtgcttcttgta

SEQ ID NO: 198186 - DNA, 18 bp, Mus musculus
gcagttctctccctctct

SEQ ID NO: 198187 - DNA, 23 bp, Mus musculus
ttccacagagcacatgatcagga

SEQ ID NO: 198188 - DNA, 20 bp, Mus musculus
aagagcactgactgctcttc

SEQ ID NO: 198189 - DNA, 23 bp, Mus musculus
attgtgggcaggctttgaggttt

SEQ ID NO: 198190 - DNA, 22 bp, Mus musculus
tccctgactcagtctctgcctg

SEQ ID NO: 198191 - DNA, 18 bp, Mus musculus
tgtgtctgtgtgtgcaca

SEQ ID NO: 198192 - DNA, 22 bp, Mus musculus
gtgtgtctgtgtgtctcagcac

SEQ ID NO: 198193 - DNA, 23 bp, Mus musculus
ttcagtagagtatttgctgttcc

SEQ ID NO: 198194 - DNA, 21 bp, Mus musculus
tgacagtgtctctcactgagc

SEQ ID NO: 198195 - DNA, 23 bp, Mus musculus
tcgttctctgcctggctctctca

SEQ ID NO: 198196 - DNA, 19 bp, Mus musculus
agtcactcagtgtgtctgt

SEQ ID NO: 198197 - DNA, 21 bp, Mus musculus
attggtccatctggagctgtt

SEQ ID NO: 198198 - DNA, 23 bp, Mus musculus
ttgtgtatgtgtttatgtgcata

SEQ ID NO: 198199 - DNA, 23 bp, Mus musculus
atatgtatgtgtatatatgtgta

SEQ ID NO: 198200 - DNA, 23 bp, Mus musculus
gtctgtctgtctgtctgtctgtc

SEQ ID NO: 198201 - DNA, 23 bp, Mus musculus
cagactctgaatctagaaacagc

SEQ ID NO: 198202 - DNA, 22 bp, Mus musculus
tagtagtatttgaactttgcgt

SEQ ID NO: 198203 - DNA, 19 bp, Mus musculus
tgtaggcagtttgagttga

SEQ ID NO: 198204 - DNA, 23 bp, Mus musculus
acttctctcaactttggtttgct

SEQ ID NO: 198205 - DNA, 18 bp, Mus musculus
tctgggtgtgtctggggc

SEQ ID NO: 198206 - DNA, 22 bp, Mus musculus
aggtttgaccttgtttactgag

SEQ ID NO: 198207 - DNA, 23 bp, Mus musculus
gtgtgactgtgtgtgagtgtgtg

SEQ ID NO: 198208 - DNA, 23 bp, Mus musculus
gggagctgcagtgtttctttttt

SEQ ID NO: 198209 - DNA, 23 bp, Mus musculus
taaaaagcagatgatggagatgt

SEQ ID NO: 198210 - DNA, 22 bp, Mus musculus
tgttttgtgaccaattatatgg

SEQ ID NO: 198211 - DNA, 23 bp, Mus musculus
atatgtatatatgtatagatgat

SEQ ID NO: 198212 - DNA, 21 bp, Mus musculus
tacaccttatatatacaccta

SEQ ID NO: 198213 - DNA, 22 bp, Mus musculus
tctaaagttctacattgtcagc

SEQ ID NO: 198214 - DNA, 23 bp, Mus musculus
tgtgcctctgagtctcactctcc

SEQ ID NO: 198215 - DNA, 23 bp, Mus musculus
acagtctctgcctctaaatagcc

SEQ ID NO: 198216 - DNA, 23 bp, Mus musculus
tatgtgtgaatatgttgatgtgt

SEQ ID NO: 198217 - DNA, 20 bp, Mus musculus
accaagcagagagaaatgag

SEQ ID NO: 198218 - DNA, 21 bp, Mus musculus
taagagcactgactgctcttc

SEQ ID NO: 198219 - DNA, 20 bp, Mus musculus
tgagaaatgtttgcgtttgg

SEQ ID NO: 198220 - DNA, 22 bp, Mus musculus
acagaagttccagagccccagt

SEQ ID NO: 198221 - DNA, 22 bp, Mus musculus
ctcagtgccctttgtctttccc

SEQ ID NO: 198222 - DNA, 23 bp, Mus musculus
aggtgagagtggtgggtgagcag

SEQ ID NO: 198223 - DNA, 23 bp, Mus musculus
agacagaacacactgtgcctggc

SEQ ID NO: 198224 - DNA, 19 bp, Mus musculus
ctgccagtgtgtcagtgcc

SEQ ID NO: 198225 - DNA, 22 bp, Mus musculus
tctctcgctcgctcgctggctc

SEQ ID NO: 198226 - DNA, 19 bp, Mus musculus
aatgcaatggttggtctgt

SEQ ID NO: 198227 - DNA, 18 bp, Mus musculus
agagttgtcttggggctg

SEQ ID NO: 198228 - DNA, 23 bp, Mus musculus
tgagtttgcacactcactctggc

SEQ ID NO: 198229 - DNA, 23 bp, Mus musculus
tgctactctctgagtctctttgt

SEQ ID NO: 198230 - DNA, 19 bp, Mus musculus
tgaggctctttctctcagg

SEQ ID NO: 198231 - DNA, 18 bp, Mus musculus
tacacatatatgtgtaca

SEQ ID NO: 198232 - DNA, 23 bp, Mus musculus
taagtatatatgtatgtgtgtgt

SEQ ID NO: 198233 - DNA, 18 bp, Mus musculus
agaccccggctctagttc

SEQ ID NO: 198234 - DNA, 23 bp, Mus musculus
tctgactcagagtctcggcccgt

SEQ ID NO: 198235 - DNA, 23 bp, Mus musculus
ggtctgtctgtccctctgtcccc

SEQ ID NO: 198236 - DNA, 21 bp, Mus musculus
tgtgtatatatgtatatgtat

SEQ ID NO: 198237 - DNA, 23 bp, Mus musculus
tagtgtatatatgcatgtgtgtg

SEQ ID NO: 198238 - DNA, 22 bp, Mus musculus
catgtgtgtgtgtgcatgtgca

SEQ ID NO: 198239 - DNA, 18 bp, Mus musculus
caggactgtgaaaccaga

SEQ ID NO: 198240 - DNA, 23 bp, Mus musculus
tcaggaaggctctgaggctcaca

SEQ ID NO: 198241 - DNA, 23 bp, Mus musculus
cctcacactctgcgtctgttgag

SEQ ID NO: 198242 - DNA, 22 bp, Mus musculus
tgtatctggaagtccaggactt

SEQ ID NO: 198243 - DNA, 19 bp, Mus musculus
acagccaggctagtctggg

SEQ ID NO: 198244 - DNA, 23 bp, Mus musculus
gggtgtctctgtgagtctgaggc

SEQ ID NO: 198245 - DNA, 23 bp, Mus musculus
acggtctacagagtgagcagagt

SEQ ID NO: 198246 - DNA, 20 bp, Mus musculus
tggcagcgagttaaggatgt

SEQ ID NO: 198247 - DNA, 21 bp, Mus musculus
tttggttttattcaattttgt

SEQ ID NO: 198248 - DNA, 23 bp, Mus musculus
ctgtgtgttcatgtgcatgtgta

SEQ ID NO: 198249 - DNA, 22 bp, Mus musculus
aaaatcactggagagacggctc

SEQ ID NO: 198250 - DNA, 22 bp, Mus musculus
tggtgtgtatctgcacttggga

SEQ ID NO: 198251 - DNA, 23 bp, Mus musculus
gtgtgtgtgcctctgtgtgtgtg

SEQ ID NO: 198252 - DNA, 23 bp, Mus musculus
atgtatgcagtggtacacatgtg

SEQ ID NO: 198253 - DNA, 18 bp, Mus musculus
tattttgtgaccaattat

SEQ ID NO: 198254 - DNA, 23 bp, Mus musculus
ctaagtcagaagtttgtcaccac

SEQ ID NO: 198255 - DNA, 23 bp, Mus musculus
caactcctgcatgttgtcctctg

SEQ ID NO: 198256 - DNA, 22 bp, Mus musculus
tgttttgtgaccaattatatgg

SEQ ID NO: 198257 - DNA, 23 bp, Mus musculus
tgagtgtgtctgtgtgtatatac

SEQ ID NO: 198258 - DNA, 22 bp, Mus musculus
tgactgggtctgagtcagcatc

SEQ ID NO: 198259 - DNA, 19 bp, Mus musculus
actaatgttacatatatgt

SEQ ID NO: 198260 - DNA, 21 bp, Mus musculus
tagtttcttcaaatgctgcag

SEQ ID NO: 198261 - DNA, 22 bp, Mus musculus
tgttttgtgaccaattatatgg

SEQ ID NO: 198262 - DNA, 23 bp, Mus musculus
tatatgtgcttttatgtatacga

SEQ ID NO: 198263 - DNA, 22 bp, Mus musculus
gaaaggatgaagacagtaagga

SEQ ID NO: 198264 - DNA, 23 bp, Mus musculus
taagtctgatatcttttcttgca

SEQ ID NO: 198265 - DNA, 19 bp, Mus musculus
atgtatgtatgtatgtatg

SEQ ID NO: 198266 - DNA, 23 bp, Mus musculus
gcttgagaggagttttctctgcc

SEQ ID NO: 198267 - DNA, 23 bp, Mus musculus
aggagagagagcacagtttgaga

SEQ ID NO: 198268 - DNA, 21 bp, Mus musculus
tgtgtatatatatatgtgtgt

SEQ ID NO: 198269 - DNA, 23 bp, Mus musculus
ctgtctgtctctttgtctgtctg

SEQ ID NO: 198270 - DNA, 21 bp, Mus musculus
tgtctgtgtgtgtgtatgggg

SEQ ID NO: 198271 - DNA, 20 bp, Mus musculus
tagcacctccacatgcacaa

SEQ ID NO: 198272 - DNA, 23 bp, Mus musculus
acagtgtttggtaaatttgtgca

SEQ ID NO: 198273 - DNA, 23 bp, Mus musculus
atatgtgtatatggatatatgtg

SEQ ID NO: 198274 - DNA, 21 bp, Mus musculus
catgtgtgtatatgtatatag

SEQ ID NO: 198275 - DNA, 23 bp, Mus musculus
agtttcattaccgagctgagtct

SEQ ID NO: 198276 - DNA, 21 bp, Mus musculus
attctgcataccatttcgctc

SEQ ID NO: 198277 - DNA, 19 bp, Mus musculus
tatgcagaattgtgggttc

SEQ ID NO: 198278 - DNA, 22 bp, Mus musculus
atatgtgtgtgtatatatattc

SEQ ID NO: 198279 - DNA, 23 bp, Mus musculus
tgcaagtactcagaccaatgtgt

SEQ ID NO: 198280 - DNA, 23 bp, Mus musculus
gtgtgtgagtgtctgtgtttgta

SEQ ID NO: 198281 - DNA, 23 bp, Mus musculus
tgctgtgtgaagacagtgaggtc

SEQ ID NO: 198282 - DNA, 23 bp, Mus musculus
atgtatgtatgtatgtatgtgta

SEQ ID NO: 198283 - DNA, 23 bp, Mus musculus
tatgcatgcgtgcatgtgtgtgt

SEQ ID NO: 198284 - DNA, 20 bp, Mus musculus
tcagaagatacttcaagtag

SEQ ID NO: 198285 - DNA, 23 bp, Mus musculus
gtatgtatgtatgtatgtgtgtg

SEQ ID NO: 198286 - DNA, 22 bp, Mus musculus
tgttttgtgaccaattatatgg

SEQ ID NO: 198287 - DNA, 22 bp, Mus musculus
ttttgcacttgacaatgaatgt

SEQ ID NO: 198288 - DNA, 23 bp, Mus musculus
tacatatgtgtatatgtatatat

SEQ ID NO: 198289 - DNA, 23 bp, Mus musculus
tgtgcacataggtatgcatgcag

SEQ ID NO: 198290 - DNA, 23 bp, Mus musculus
agattctgcaagagcaagtggta

SEQ ID NO: 198291 - DNA, 18 bp, Mus musculus
tctgcatcatatacttac

SEQ ID NO: 198292 - DNA, 21 bp, Mus musculus
aggattgtaatgaactttcca

SEQ ID NO: 198293 - DNA, 19 bp, Mus musculus
ttagatcatgatatttggt

SEQ ID NO: 198294 - DNA, 23 bp, Mus musculus
acacacacgtatatatacacata

SEQ ID NO: 198295 - DNA, 23 bp, Mus musculus
tgacactgtggtagtgttttaaa

SEQ ID NO: 198296 - DNA, 23 bp, Mus musculus
acacaccagagtgatctatgtgt

SEQ ID NO: 198297 - DNA, 23 bp, Mus musculus
taacattttggatggtttacaca

SEQ ID NO: 198298 - DNA, 23 bp, Mus musculus
cagttttgtgatagtgaattctg

SEQ ID NO: 198299 - DNA, 23 bp, Mus musculus
tttgtgtccaattatatggttaa

SEQ ID NO: 198300 - DNA, 22 bp, Mus musculus
tgttttgtgaccaattatatgg

SEQ ID NO: 198301 - DNA, 20 bp, Mus musculus
agctttgcagatggatgtgt

SEQ ID NO: 198302 - DNA, 23 bp, Mus musculus
ggaagacagaaaaaagtatgtaa

SEQ ID NO: 198303 - DNA, 20 bp, Mus musculus
agcagttccaaattagtggt

SEQ ID NO: 198304 - DNA, 22 bp, Mus musculus
tttggcacttttactctttgac

SEQ ID NO: 198305 - DNA, 23 bp, Mus musculus
tgtagtgttgcagactgtctagt

SEQ ID NO: 198306 - DNA, 23 bp, Mus musculus
tctctggctctcagtgaccctag

SEQ ID NO: 198307 - DNA, 20 bp, Mus musculus
ttcagaggattcttgtctca

SEQ ID NO: 198308 - DNA, 23 bp, Mus musculus
gtatgtatgtatgtatgtatatt

SEQ ID NO: 198309 - DNA, 21 bp, Mus musculus
tgtgtgtgtatatccatctat

SEQ ID NO: 198310 - DNA, 23 bp, Mus musculus
aaatcacagggactttgctgtca

SEQ ID NO: 198311 - DNA, 22 bp, Mus musculus
agcttcaaaatgaatggagaat

SEQ ID NO: 198312 - DNA, 22 bp, Mus musculus
aagcaagtagagagagaggaga

SEQ ID NO: 198313 - DNA, 20 bp, Mus musculus
tatctgtgtatatatgttgt

SEQ ID NO: 198314 - DNA, 22 bp, Mus musculus
tgttttgtgaccaattatatgg

SEQ ID NO: 198315 - DNA, 21 bp, Mus musculus
ttatatgaagtcaagcattgt

SEQ ID NO: 198316 - DNA, 23 bp, Mus musculus
agagagggcacacacacacacac

SEQ ID NO: 198317 - DNA, 23 bp, Mus musculus
caactgtggatttgcaatgtata

SEQ ID NO: 198318 - DNA, 22 bp, Mus musculus
tttgatgtatatatgtatatat

SEQ ID NO: 198319 - DNA, 23 bp, Mus musculus
tagtttgtccattgaggatttat

SEQ ID NO: 198320 - DNA, 21 bp, Mus musculus
aacatcactatggggttggag

SEQ ID NO: 198321 - DNA, 22 bp, Mus musculus
tgttttgtgaccaattatatgg

SEQ ID NO: 198322 - DNA, 23 bp, Mus musculus
tgtctgtctgtctgcctgtctgc

SEQ ID NO: 198323 - DNA, 23 bp, Mus musculus
tggcagtgagtcttcctgatcaa

SEQ ID NO: 198324 - DNA, 19 bp, Mus musculus
ttgtatgtgtatatgttct

SEQ ID NO: 198325 - DNA, 23 bp, Mus musculus
tgttctttctccactgtctctct

SEQ ID NO: 198326 - DNA, 23 bp, Mus musculus
attgacagtggatgacttctggg

SEQ ID NO: 198327 - DNA, 23 bp, Mus musculus
tccctgactgaatagagtaagct

SEQ ID NO: 198328 - DNA, 22 bp, Mus musculus
tctgtgtgtgtgtgtgtggcag

SEQ ID NO: 198329 - DNA, 23 bp, Mus musculus
cacacacatacagcaatctttat

SEQ ID NO: 198330 - DNA, 23 bp, Mus musculus
agcttgacagatgaaagtctgga

SEQ ID NO: 198331 - DNA, 22 bp, Mus musculus
cacgctcagtctctcaatccca

SEQ ID NO: 198332 - DNA, 18 bp, Mus musculus
ttctgctgctgctgcagt

SEQ ID NO: 198333 - DNA, 19 bp, Mus musculus
ctctgagcacagtgagcac

SEQ ID NO: 198334 - DNA, 23 bp, Mus musculus
tgggtctctctgtgactttggag

SEQ ID NO: 198335 - DNA, 21 bp, Mus musculus
tgagaggtctaagtgtgcagg

SEQ ID NO: 198336 - DNA, 23 bp, Mus musculus
ttgggttttcatttctatgtgtt

SEQ ID NO: 198337 - DNA, 20 bp, Mus musculus
attgactgacttttaggttc

SEQ ID NO: 198338 - DNA, 23 bp, Mus musculus
ggcgcagtctcactctctctgcc

SEQ ID NO: 198339 - DNA, 20 bp, Mus musculus
acagatgagacacagctcaa

SEQ ID NO: 198340 - DNA, 23 bp, Mus musculus
ttatggagctgatggcattgagt

SEQ ID NO: 198341 - DNA, 21 bp, Mus musculus
atgctgcatacagattctgtc

SEQ ID NO: 198342 - DNA, 23 bp, Mus musculus
tttctctgtgtagccatggctgt

SEQ ID NO: 198343 - DNA, 19 bp, Mus musculus
gagagatgatggctcagca

SEQ ID NO: 198344 - DNA, 20 bp, Mus musculus
gaagcaggtccagctgctca

SEQ ID NO: 198345 - DNA, 21 bp, Mus musculus
agaggcaggtagagcagagag

SEQ ID NO: 198346 - DNA, 19 bp, Mus musculus
cacacaagagccactcctg

SEQ ID NO: 198347 - DNA, 22 bp, Mus musculus
acatctctctgtctctgagcag

SEQ ID NO: 198348 - DNA, 23 bp, Mus musculus
cttctgttctgtctgtctctgct

SEQ ID NO: 198349 - DNA, 23 bp, Mus musculus
gcatgtgcatgtgcatgtgtgtg

SEQ ID NO: 198350 - DNA, 23 bp, Mus musculus
tcagtgggtattatagaggtttg

SEQ ID NO: 198351 - DNA, 20 bp, Mus musculus
tgagtggagagagagagctg

SEQ ID NO: 198352 - DNA, 23 bp, Mus musculus
gtgtgtctctctctgtgtcctgc

SEQ ID NO: 198353 - DNA, 21 bp, Mus musculus
agtggttttaccctatggtag

SEQ ID NO: 198354 - DNA, 23 bp, Mus musculus
taccacagggtagaaccacggac

SEQ ID NO: 198355 - DNA, 23 bp, Mus musculus
tatgtatatgtatgtatatgtat

SEQ ID NO: 198356 - DNA, 23 bp, Mus musculus
tcaccctccagtctctcttttgt

SEQ ID NO: 198357 - DNA, 22 bp, Mus musculus
ttgctgctgatgttatgtgtgt

SEQ ID NO: 198358 - DNA, 20 bp, Mus musculus
atgtgcttggtcacgatgga

SEQ ID NO: 198359 - DNA, 21 bp, Mus musculus
tatgtatatatgtatatatgt

SEQ ID NO: 198360 - DNA, 23 bp, Mus musculus
cttctacagtattatgtttccat

SEQ ID NO: 198361 - DNA, 23 bp, Mus musculus
acaggcacacatacagccagatg

SEQ ID NO: 198362 - DNA, 22 bp, Mus musculus
tgttttgtgaccaattatatgg

SEQ ID NO: 198363 - DNA, 21 bp, Mus musculus
tatgcacatatctgtgtgtgt

SEQ ID NO: 198364 - DNA, 23 bp, Mus musculus
cttttctagaactttctctcttt

SEQ ID NO: 198365 - DNA, 23 bp, Mus musculus
ctcaatggttttctagctgaaag

SEQ ID NO: 198366 - DNA, 22 bp, Mus musculus
tggcctgtctgtctgtctgaga

SEQ ID NO: 198367 - DNA, 23 bp, Mus musculus
tctgtgaccctgtgattctggga

SEQ ID NO: 198368 - DNA, 23 bp, Mus musculus
agattctgggtgtgtcagagctc

SEQ ID NO: 198369 - DNA, 23 bp, Mus musculus
agtgtgcatatgtgtgcacatgt

SEQ ID NO: 198370 - DNA, 21 bp, Mus musculus
atgtgtgtatgtgtatatgtg

SEQ ID NO: 198371 - DNA, 23 bp, Mus musculus
accaagtgtactgtatatgttgt

SEQ ID NO: 198372 - DNA, 23 bp, Mus musculus
tttgttggtgatgttctggtttg

SEQ ID NO: 198373 - DNA, 23 bp, Mus musculus
tgaaactctctcttatagaccag

SEQ ID NO: 198374 - DNA, 23 bp, Mus musculus
tgtactatgaacacactgggact

SEQ ID NO: 198375 - DNA, 22 bp, Mus musculus
acactgggacccagtttccagt

SEQ ID NO: 198376 - DNA, 23 bp, Mus musculus
cagttctctctctgtgagcctgg

SEQ ID NO: 198377 - DNA, 23 bp, Mus musculus
tgcctgcctgcctgcctgcgtgt

SEQ ID NO: 198378 - DNA, 21 bp, Mus musculus
atatggaatgtacaaatgtgt

SEQ ID NO: 198379 - DNA, 21 bp, Mus musculus
agagatgtctgtgaggagaac

SEQ ID NO: 198380 - DNA, 23 bp, Mus musculus
gtctctctgtgtccatgtgcaat

SEQ ID NO: 198381 - DNA, 23 bp, Mus musculus
tgctcacagtagagagtgtcctg

SEQ ID NO: 198382 - DNA, 22 bp, Mus musculus
gtgtgcatatgtatatgtgtgt

SEQ ID NO: 198383 - DNA, 23 bp, Mus musculus
cagttgagagtgtgcactgatct

SEQ ID NO: 198384 - DNA, 23 bp, Mus musculus
atgaatgcatgtatgtatatatg

SEQ ID NO: 198385 - DNA, 23 bp, Mus musculus
gtatgtatatatgaatgtgtgtg

SEQ ID NO: 198386 - DNA, 20 bp, Mus musculus
gtctgtgtgtctgtctgtat

SEQ ID NO: 198387 - DNA, 23 bp, Mus musculus
cgtgcgtgcgtgcgtgcgtgcgt

SEQ ID NO: 198388 - DNA, 23 bp, Mus musculus
ctctctctctccctgtgagccag

SEQ ID NO: 198389 - DNA, 23 bp, Mus musculus
aatcagtggctcacacagtctct

SEQ ID NO: 198390 - DNA, 23 bp, Mus musculus
cagggtctctctgagccagtgct

SEQ ID NO: 198391 - DNA, 23 bp, Mus musculus
tctctctctctctctgatgtagc

SEQ ID NO: 198392 - DNA, 18 bp, Mus musculus
atgcagcaggggatgatg

SEQ ID NO: 198393 - DNA, 19 bp, Mus musculus
actgcagttactaacagct

SEQ ID NO: 198394 - DNA, 23 bp, Mus musculus
tggttgtgttaggaagtgtgtcg

SEQ ID NO: 198395 - DNA, 23 bp, Mus musculus
ggaatctgtctgcagagactggc

SEQ ID NO: 198396 - DNA, 22 bp, Mus musculus
ttcagtactgtggagattggaa

SEQ ID NO: 198397 - DNA, 22 bp, Mus musculus
agcgtcagtctctatcctctgt

SEQ ID NO: 198398 - DNA, 23 bp, Mus musculus
attctgagactcacagtgggtgt

SEQ ID NO: 198399 - DNA, 23 bp, Mus musculus
acactggagtgtgtgtagagttt

SEQ ID NO: 198400 - DNA, 23 bp, Mus musculus
gacacagtctcagtcacataccc

SEQ ID NO: 198401 - DNA, 23 bp, Mus musculus
tttgtgacagcagcttttatctt

SEQ ID NO: 198402 - DNA, 21 bp, Mus musculus
ttttcagggttctctggagga

SEQ ID NO: 198403 - DNA, 23 bp, Mus musculus
tgtgtgtatgtgtgtgtatatgt

SEQ ID NO: 198404 - DNA, 23 bp, Mus musculus
tgtgtgtctgtctgcctcagtgt

SEQ ID NO: 198405 - DNA, 23 bp, Mus musculus
tgcaatgttaagaaaaaatgtgc

SEQ ID NO: 198406 - DNA, 23 bp, Mus musculus
tgtcttcatagggtcctcttgag

SEQ ID NO: 198407 - DNA, 19 bp, Mus musculus
tgtaacaccaactccagag

SEQ ID NO: 198408 - DNA, 19 bp, Mus musculus
cacagccttgtgccactgc

SEQ ID NO: 198409 - DNA, 22 bp, Mus musculus
atttgtattctagaagaagatg

SEQ ID NO: 198410 - DNA, 23 bp, Mus musculus
tgtgtgaatatgtacatgtgtga

SEQ ID NO: 198411 - DNA, 23 bp, Mus musculus
agtgatatgtatagtgtatgcat

SEQ ID NO: 198412 - DNA, 22 bp, Mus musculus
tgttttgtgaccaattatatgg

SEQ ID NO: 198413 - DNA, 23 bp, Mus musculus
ctgtaacaggttttggatgtgaa

SEQ ID NO: 198414 - DNA, 20 bp, Mus musculus
ctaacacctagaccaggtgg

SEQ ID NO: 198415 - DNA, 23 bp, Mus musculus
agtgcatgcgtgcgtgcctgcgt

SEQ ID NO: 198416 - DNA, 23 bp, Mus musculus
gtgtgtatatatctatgtgtgtg

SEQ ID NO: 198417 - DNA, 23 bp, Mus musculus
agttagttcttaggatctgagag

SEQ ID NO: 198418 - DNA, 23 bp, Mus musculus
tgtatgtgcatgtgcttgtatgt

SEQ ID NO: 198419 - DNA, 23 bp, Mus musculus
tgagtgaatgtgtgtatgtctat

SEQ ID NO: 198420 - DNA, 23 bp, Mus musculus
ttgttcatgatctaagcactact

SEQ ID NO: 198421 - DNA, 23 bp, Mus musculus
agtgtgcatatgcatgtgcatgt

SEQ ID NO: 198422 - DNA, 19 bp, Mus musculus
tgtgtacatatgtttatat

SEQ ID NO: 198423 - DNA, 23 bp, Mus musculus
atgtgtgtatgtatatgtgtgtg

SEQ ID NO: 198424 - DNA, 23 bp, Mus musculus
tctgtctgtctgtatgcatgtga

SEQ ID NO: 198425 - DNA, 19 bp, Mus musculus
atgtatgtatgtatgtgtg

SEQ ID NO: 198426 - DNA, 23 bp, Mus musculus
tatgtgtgtgtgcttgtgcatat

SEQ ID NO: 198427 - DNA, 23 bp, Mus musculus
gtgtgtgtgtgcttgtacatgtg

SEQ ID NO: 198428 - DNA, 23 bp, Mus musculus
atgtatgtatgtatgtatgtatg

SEQ ID NO: 198429 - DNA, 21 bp, Mus musculus
ttgtattatgtttgtatgctc

SEQ ID NO: 198430 - DNA, 23 bp, Mus musculus
agaattttctgattatgctgatg

SEQ ID NO: 198431 - DNA, 23 bp, Mus musculus
agatcactgactgctcttccaga

SEQ ID NO: 198432 - DNA, 18 bp, Mus musculus
agagcaaagagtcagtca

SEQ ID NO: 198433 - DNA, 20 bp, Mus musculus
tctgtgtgaggtgatggagc

SEQ ID NO: 198434 - DNA, 23 bp, Mus musculus
tctttggttgttcatttctggat

SEQ ID NO: 198435 - DNA, 19 bp, Mus musculus
gacatactctatagagtgt

SEQ ID NO: 198436 - DNA, 23 bp, Mus musculus
cttcagtgcctggctgtgtccct

SEQ ID NO: 198437 - DNA, 22 bp, Mus musculus
aggcatgatgtgcaaggcatga

SEQ ID NO: 198438 - DNA, 18 bp, Mus musculus
tgatgacttgctaagagg

SEQ ID NO: 198439 - DNA, 21 bp, Mus musculus
acacaggaagctttcatgtac

SEQ ID NO: 198440 - DNA, 23 bp, Mus musculus
agagagaagtctgtctggaggtt

SEQ ID NO: 198441 - DNA, 23 bp, Mus musculus
ctcactgtctgtcaggctggttt

SEQ ID NO: 198442 - DNA, 23 bp, Mus musculus
ttcatgtatgtatgtatgtatgt

SEQ ID NO: 198443 - DNA, 23 bp, Mus musculus
tttgagtcaggagagactggcct

SEQ ID NO: 198444 - DNA, 23 bp, Mus musculus
gagaagtgagactggtcaacatc

SEQ ID NO: 198445 - DNA, 23 bp, Mus musculus
atgaaagaggaaatccttctggt

SEQ ID NO: 198446 - DNA, 21 bp, Mus musculus
ttctttcagaccatctactga

SEQ ID NO: 198447 - DNA, 23 bp, Mus musculus
atgtatgagtatttaatgtgtga

SEQ ID NO: 198448 - DNA, 23 bp, Mus musculus
aagtcagtgtctctctctctccc

SEQ ID NO: 198449 - DNA, 18 bp, Mus musculus
tagaacaggtttggctct

SEQ ID NO: 198450 - DNA, 22 bp, Mus musculus
ctcatctgtgtgtgtgtctctg

SEQ ID NO: 198451 - DNA, 23 bp, Mus musculus
atgagcatgtggatgtggagaac

SEQ ID NO: 198452 - DNA, 22 bp, Mus musculus
tcatccaccatttgctttctga

SEQ ID NO: 198453 - DNA, 21 bp, Mus musculus
ctgttgagccatctctccagc

SEQ ID NO: 198454 - DNA, 23 bp, Mus musculus
agtatgtgtgcatgtgcttgtct

SEQ ID NO: 198455 - DNA, 23 bp, Mus musculus
ttggagacactgaatcgacattc

SEQ ID NO: 198456 - DNA, 23 bp, Mus musculus
gtgtagctgtacatgtgtgtgct

SEQ ID NO: 198457 - DNA, 22 bp, Mus musculus
tacagatgtgtgcacatatgta

SEQ ID NO: 198458 - DNA, 23 bp, Mus musculus
gccagactctctcgctcacacag

SEQ ID NO: 198459 - DNA, 23 bp, Mus musculus
tcacaggcgcctatgttctgtag

SEQ ID NO: 198460 - DNA, 20 bp, Mus musculus
ggttctgacattctatttag

SEQ ID NO: 198461 - DNA, 23 bp, Mus musculus
accagcaatgaagagtgctatgt

SEQ ID NO: 198462 - DNA, 23 bp, Mus musculus
tgtgtgtgtctgtataatgtgtc

SEQ ID NO: 198463 - DNA, 22 bp, Mus musculus
tatgtgtgcatgtataatatat

SEQ ID NO: 198464 - DNA, 23 bp, Mus musculus
atgcatatgtatatgtgtatgtg

SEQ ID NO: 198465 - DNA, 23 bp, Mus musculus
gtgtgtgtgtctgtctgtctgtc

SEQ ID NO: 198466 - DNA, 19 bp, Mus musculus
aacgacagggactggagag

SEQ ID NO: 198467 - DNA, 23 bp, Mus musculus
ctgtgtgcatatgtatacgtgtt

SEQ ID NO: 198468 - DNA, 23 bp, Mus musculus
gtgtgcctgtgtctgtgtatgtg

SEQ ID NO: 198469 - DNA, 23 bp, Mus musculus
tcagagtggatcatgagcctgtg

SEQ ID NO: 198470 - DNA, 23 bp, Mus musculus
ttctgagtctctgggtgcctgtc

SEQ ID NO: 198471 - DNA, 23 bp, Mus musculus
ctgcagcactccctggaagcaga

SEQ ID NO: 198472 - DNA, 23 bp, Mus musculus
tgtgactcccagatctactcttc

SEQ ID NO: 198473 - DNA, 23 bp, Mus musculus
tatagaattgatcgctctctcag

SEQ ID NO: 198474 - DNA, 23 bp, Mus musculus
atatgtctctgctttggttctga

SEQ ID NO: 198475 - DNA, 22 bp, Mus musculus
gagccacactcactcagtttct

SEQ ID NO: 198476 - DNA, 23 bp, Mus musculus
gacccactgtctctttatctgtc

SEQ ID NO: 198477 - DNA, 18 bp, Mus musculus
aaggatcagtgaaggaat

SEQ ID NO: 198478 - DNA, 23 bp, Mus musculus
atgtgtatgtgcatgtgtatgta

SEQ ID NO: 198479 - DNA, 19 bp, Mus musculus
tggggctgactttgtgaat

SEQ ID NO: 198480 - DNA, 22 bp, Mus musculus
ttgctgtctttcctcagtgata

SEQ ID NO: 198481 - DNA, 22 bp, Mus musculus
aggcactgtgtctaatctctgt

SEQ ID NO: 198482 - DNA, 23 bp, Mus musculus
actctgtgtctatctctgtcttc

SEQ ID NO: 198483 - DNA, 23 bp, Mus musculus
tagactgagtcagaattgagcag

SEQ ID NO: 198484 - DNA, 23 bp, Mus musculus
gttctgacagcttctctcagtct

SEQ ID NO: 198485 - DNA, 19 bp, Mus musculus
aggaatatatatatgtgta

SEQ ID NO: 198486 - DNA, 22 bp, Mus musculus
tgtgagcatgtatatgtgcttg

SEQ ID NO: 198487 - DNA, 23 bp, Mus musculus
gctctgtccctcactctcagcat

SEQ ID NO: 198488 - DNA, 19 bp, Mus musculus
tgacagcaccgagtgagaa

SEQ ID NO: 198489 - DNA, 23 bp, Mus musculus
gatgacagtggccagagagagac

SEQ ID NO: 198490 - DNA, 23 bp, Mus musculus
atgaaggcacacagtcagtcagt

SEQ ID NO: 198491 - DNA, 23 bp, Mus musculus
tgatctcagtttgttcatgtgtg

SEQ ID NO: 198492 - DNA, 20 bp, Mus musculus
tggctggtttcgtgtgtcaa

SEQ ID NO: 198493 - DNA, 21 bp, Mus musculus
ttgacacaagctagtcagcag

SEQ ID NO: 198494 - DNA, 22 bp, Mus musculus
tggaatgaaaataagtttgctg

SEQ ID NO: 198495 - DNA, 20 bp, Mus musculus
tgtggggtgtgtgtgtgtgt

SEQ ID NO: 198496 - DNA, 20 bp, Mus musculus
ttgtggcaggctatgtgtgt

SEQ ID NO: 198497 - DNA, 23 bp, Mus musculus
tgtatgtatgtatatatgtatgc

SEQ ID NO: 198498 - DNA, 23 bp, Mus musculus
tggcagggtgtgtgtgtgtatgt

SEQ ID NO: 198499 - DNA, 23 bp, Mus musculus
ttgttctcgctctctgtctctct

SEQ ID NO: 198500 - DNA, 23 bp, Mus musculus
tgccactgccagacttctgcagc

SEQ ID NO: 198501 - DNA, 23 bp, Mus musculus
ctgactgctcttccagaggtcct

SEQ ID NO: 198502 - DNA, 23 bp, Mus musculus
catggtggctcacaaccgtctgt

SEQ ID NO: 198503 - DNA, 20 bp, Mus musculus
cagagggatatgtgtgtgca

SEQ ID NO: 198504 - DNA, 18 bp, Mus musculus
tgtatcgatctatctcag

SEQ ID NO: 198505 - DNA, 23 bp, Mus musculus
ctgagagtctctgtcagtgcctg

SEQ ID NO: 198506 - DNA, 19 bp, Mus musculus
atagcactgactgctcttc

SEQ ID NO: 198507 - DNA, 23 bp, Mus musculus
agtctctgtttgtcactgtttct

SEQ ID NO: 198508 - DNA, 23 bp, Mus musculus
cttgactgcttaggtctttgttg

SEQ ID NO: 198509 - DNA, 23 bp, Mus musculus
tgtatgtgtgtattgtatatgtg

SEQ ID NO: 198510 - DNA, 23 bp, Mus musculus
atatgtgtatgtatatgtgtatg

SEQ ID NO: 198511 - DNA, 23 bp, Mus musculus
ctgacactgcaagtagatgtgtt

SEQ ID NO: 198512 - DNA, 23 bp, Mus musculus
gggtctctgagtctgtgtcagtc

SEQ ID NO: 198513 - DNA, 22 bp, Mus musculus
tctcagagaacagttatgctag

SEQ ID NO: 198514 - DNA, 23 bp, Mus musculus
tttgtctatttctctctgctctt

SEQ ID NO: 198515 - DNA, 23 bp, Mus musculus
gatcacactcactctgattctgt

SEQ ID NO: 198516 - DNA, 23 bp, Mus musculus
actcactgtctgcttgccttctc

SEQ ID NO: 198517 - DNA, 23 bp, Mus musculus
tggtaagcagacagagttatgtg

SEQ ID NO: 198518 - DNA, 22 bp, Mus musculus
ctgtcactggagagatggcact

SEQ ID NO: 198519 - DNA, 23 bp, Mus musculus
tagagcactgactgctcttgcag

SEQ ID NO: 198520 - DNA, 22 bp, Mus musculus
cagtctcacactgtctgtctcc

SEQ ID NO: 198521 - DNA, 18 bp, Mus musculus
ctcaggctgtgtgagctg

SEQ ID NO: 198522 - DNA, 18 bp, Mus musculus
gacagagtgtggcactgg

SEQ ID NO: 198523 - DNA, 23 bp, Mus musculus
actctgtatcgctctgagtctca

SEQ ID NO: 198524 - DNA, 23 bp, Mus musculus
tgtctggctgcatgagtggaggc

SEQ ID NO: 198525 - DNA, 23 bp, Mus musculus
acatatacatacacacatacata

SEQ ID NO: 198526 - DNA, 18 bp, Mus musculus
gaggcaacactaggccta

SEQ ID NO: 198527 - DNA, 21 bp, Mus musculus
tagtatgtgtgtgtgtatata

SEQ ID NO: 198528 - DNA, 19 bp, Mus musculus
tgtgtgtgcacatgcatgt

SEQ ID NO: 198529 - DNA, 20 bp, Mus musculus
atcacagaatttatacatat

SEQ ID NO: 198530 - DNA, 20 bp, Mus musculus
tgtctgtgtgtgtgtatgca

SEQ ID NO: 198531 - DNA, 20 bp, Mus musculus
gctgtggaagttggttgtgt

SEQ ID NO: 198532 - DNA, 23 bp, Mus musculus
tgcctctgtgtctcagttcctca

SEQ ID NO: 198533 - DNA, 23 bp, Mus musculus
ttgttttagttttagtttgcaaa

SEQ ID NO: 198534 - DNA, 22 bp, Mus musculus
agacagagcctcactgtgtcac

SEQ ID NO: 198535 - DNA, 23 bp, Mus musculus
tatgactgtatatgtatgttata

SEQ ID NO: 198536 - DNA, 23 bp, Mus musculus
atatgactgtatatgtgtgtgta

SEQ ID NO: 198537 - DNA, 19 bp, Mus musculus
tgcgtgtctgtctgtctgt

SEQ ID NO: 198538 - DNA, 18 bp, Mus musculus
agtgaagtgtcccagggg

SEQ ID NO: 198539 - DNA, 23 bp, Mus musculus
ggttatcttcttccaccaggagt

SEQ ID NO: 198540 - DNA, 19 bp, Mus musculus
acagaagagaggaagctgg

SEQ ID NO: 198541 - DNA, 23 bp, Mus musculus
gtgtttgagaagagagactgggc

SEQ ID NO: 198542 - DNA, 21 bp, Mus musculus
gctctgtctctctgtctctgc

SEQ ID NO: 198543 - DNA, 22 bp, Mus musculus
tgtctgtctgtctgtctgtctg

SEQ ID NO: 198544 - DNA, 23 bp, Mus musculus
ggtctgtcagtctgtcatcgtcc

SEQ ID NO: 198545 - DNA, 22 bp, Mus musculus
ttgtatgtatgcatgtgtgtgc

SEQ ID NO: 198546 - DNA, 23 bp, Mus musculus
tcttgctcctctgtatcactctg

SEQ ID NO: 198547 - DNA, 21 bp, Mus musculus
atgtatgtgtgcatgtgcttg

SEQ ID NO: 198548 - DNA, 23 bp, Mus musculus
ctgtctgtctgtctgcctgtctg

SEQ ID NO: 198549 - DNA, 23 bp, Mus musculus
tgcctgcctgcctgcctgtcagt

SEQ ID NO: 198550 - DNA, 23 bp, Mus musculus
tgactctctcagaggctcacgtg

SEQ ID NO: 198551 - DNA, 22 bp, Mus musculus
tgcaacttagtatcactcatgt

SEQ ID NO: 198552 - DNA, 23 bp, Mus musculus
cagtgtgtctgtctgtccttctg

SEQ ID NO: 198553 - DNA, 23 bp, Mus musculus
tgcctgcctgcctgcctgcctgc

SEQ ID NO: 198554 - DNA, 23 bp, Mus musculus
ctctcgctcactcgctcgctgtg

SEQ ID NO: 198555 - DNA, 23 bp, Mus musculus
catgtgtgtgcatgtgtatgtgc

SEQ ID NO: 198556 - DNA, 21 bp, Mus musculus
atggatagatggatgtgtgtg

SEQ ID NO: 198557 - DNA, 22 bp, Mus musculus
aaacctggctccctgtctgcca

SEQ ID NO: 198558 - DNA, 23 bp, Mus musculus
caacggtctgtctgtctctctgt

SEQ ID NO: 198559 - DNA, 22 bp, Mus musculus
cagacaggagtgtgagctcaga

SEQ ID NO: 198560 - DNA, 23 bp, Mus musculus
gtgtgtgtgtgtgtgtgtctaag

SEQ ID NO: 198561 - DNA, 20 bp, Mus musculus
tatgggcctctaattcacca

SEQ ID NO: 198562 - DNA, 23 bp, Mus musculus
tgtctgcctgtctgcctgcctgc

SEQ ID NO: 198563 - DNA, 19 bp, Mus musculus
atctccctgctcaggtggc

SEQ ID NO: 198564 - DNA, 22 bp, Mus musculus
aacttccacaacagtgtgagca

SEQ ID NO: 198565 - DNA, 23 bp, Mus musculus
gtacatgcaaatagagtattcat

SEQ ID NO: 198566 - DNA, 20 bp, Mus musculus
tgtagctgtacagatgattg

SEQ ID NO: 198567 - DNA, 22 bp, Mus musculus
tgttcactatggctctgttcac

SEQ ID NO: 198568 - DNA, 18 bp, Mus musculus
actgaagactgagtgcag

SEQ ID NO: 198569 - DNA, 22 bp, Mus musculus
tctacaggacagcctgcagtgt

SEQ ID NO: 198570 - DNA, 23 bp, Mus musculus
tggaagagcaattggtgctctta

SEQ ID NO: 198571 - DNA, 23 bp, Mus musculus
tggctcagtggttaagagcactg

SEQ ID NO: 198572 - DNA, 20 bp, Mus musculus
cctgagggattctgacactt

SEQ ID NO: 198573 - DNA, 21 bp, Mus musculus
tctgactttatctctcacttt

SEQ ID NO: 198574 - DNA, 23 bp, Mus musculus
ctgctgggtctgtctctctgcct

SEQ ID NO: 198575 - DNA, 23 bp, Mus musculus
tgaaaatgcagctgtacctctca

SEQ ID NO: 198576 - DNA, 23 bp, Mus musculus
tctctgtctcacacccagtcctg

SEQ ID NO: 198577 - DNA, 23 bp, Mus musculus
tcacactcagtcagtatttagtc

SEQ ID NO: 198578 - DNA, 23 bp, Mus musculus
tggttctgtctgaaatcttgatg

SEQ ID NO: 198579 - DNA, 23 bp, Mus musculus
tggctatctgtgtctatgtgtct

SEQ ID NO: 198580 - DNA, 22 bp, Mus musculus
gtgcctgcctgtgtgggtgtgt

SEQ ID NO: 198581 - DNA, 23 bp, Mus musculus
tcctgtctctccctgtgagtctc

SEQ ID NO: 198582 - DNA, 19 bp, Mus musculus
atgtcagagagcttagttg

SEQ ID NO: 198583 - DNA, 20 bp, Mus musculus
tcacagactcagaatgcaga

SEQ ID NO: 198584 - DNA, 23 bp, Mus musculus
tgtctgtgactgtctgcctctcc

SEQ ID NO: 198585 - DNA, 20 bp, Mus musculus
tgagggtgcagagctagtgt

SEQ ID NO: 198586 - DNA, 23 bp, Mus musculus
tctctgtctgtgtctgtctgtct

SEQ ID NO: 198587 - DNA, 23 bp, Mus musculus
aagaacactgactgctcttccag

SEQ ID NO: 198588 - DNA, 23 bp, Mus musculus
cctctctctgtgtgttatttcca

SEQ ID NO: 198589 - DNA, 23 bp, Mus musculus
tctcacactgtgaaaagtggttg

SEQ ID NO: 198590 - DNA, 23 bp, Mus musculus
tgtgtatgttatgtgtatatata

SEQ ID NO: 198591 - DNA, 23 bp, Mus musculus
agacagcagacagcgtggagtct

SEQ ID NO: 198592 - DNA, 20 bp, Mus musculus
cactggtgtgtgtgtgtgtc

SEQ ID NO: 198593 - DNA, 23 bp, Mus musculus
tggcagaacacagtgagcagtgt

SEQ ID NO: 198594 - DNA, 23 bp, Mus musculus
aggaatgagtgctttgtggtact

SEQ ID NO: 198595 - DNA, 22 bp, Mus musculus
atccgtgtagttggcttttggt

SEQ ID NO: 198596 - DNA, 19 bp, Mus musculus
agcatctcgctgtgcagtc

SEQ ID NO: 198597 - DNA, 23 bp, Mus musculus
tgtctctggcactcagtgcctgt

SEQ ID NO: 198598 - DNA, 23 bp, Mus musculus
tcagtgtgtgtttctgttctctg

SEQ ID NO: 198599 - DNA, 23 bp, Mus musculus
acacatctctgggtgtgtctgcg

SEQ ID NO: 198600 - DNA, 23 bp, Mus musculus
ctgcctcacactcttgtcttcct

SEQ ID NO: 198601 - DNA, 23 bp, Mus musculus
tccctctctgtgtcactatgtct

SEQ ID NO: 198602 - DNA, 18 bp, Mus musculus
tctgcctggttctcagct

SEQ ID NO: 198603 - DNA, 22 bp, Mus musculus
cgtcacttgtgaagcagcgtgt

SEQ ID NO: 198604 - DNA, 23 bp, Mus musculus
tgtgtgtatgtatatatgtgtgt

SEQ ID NO: 198605 - DNA, 23 bp, Mus musculus
tgtgtgtatgtatgtatttatgt

SEQ ID NO: 198606 - DNA, 20 bp, Mus musculus
ctgtcagcctgagaggacac

SEQ ID NO: 198607 - DNA, 23 bp, Mus musculus
ctgtgtgacactgtcagcctgag

SEQ ID NO: 198608 - DNA, 23 bp, Mus musculus
cctctctgtgtccctgtcttgtg

SEQ ID NO: 198609 - DNA, 19 bp, Mus musculus
tgtcattatcagggtgcat

SEQ ID NO: 198610 - DNA, 22 bp, Mus musculus
tgtgacagtagactgagagctg

SEQ ID NO: 198611 - DNA, 23 bp, Mus musculus
tctccctctctctggcacactgg

SEQ ID NO: 198612 - DNA, 23 bp, Mus musculus
tgtgtacatgtgcatgtgtatgc

SEQ ID NO: 198613 - DNA, 23 bp, Mus musculus
atttgttctgatgcttcacagac

SEQ ID NO: 198614 - DNA, 23 bp, Mus musculus
ttacagtctgactgactgcgcca

SEQ ID NO: 198615 - DNA, 20 bp, Mus musculus
acccagtgagcaactgtagt

SEQ ID NO: 198616 - DNA, 23 bp, Mus musculus
cagggtctctcactggctcagaa

SEQ ID NO: 198617 - DNA, 21 bp, Mus musculus
tagtgaggtagcttgttgtat

SEQ ID NO: 198618 - DNA, 23 bp, Mus musculus
ctgtctgtctgtctgtctgtctg

SEQ ID NO: 198619 - DNA, 19 bp, Mus musculus
acagggatagctagaagag

SEQ ID NO: 198620 - DNA, 23 bp, Mus musculus
atatgtgcgtgtgcatgtgcatg

SEQ ID NO: 198621 - DNA, 22 bp, Mus musculus
tgtgtatgcttatgtttgtgta

SEQ ID NO: 198622 - DNA, 22 bp, Mus musculus
ttgtgtatatgtttgcatatgt

SEQ ID NO: 198623 - DNA, 23 bp, Mus musculus
ccagtgtcagtctgtctgtctga

SEQ ID NO: 198624 - DNA, 23 bp, Mus musculus
atctcaaacagcttttgctaatc

SEQ ID NO: 198625 - DNA, 23 bp, Mus musculus
tgtatatgtgtgtatgtatatgt

SEQ ID NO: 198626 - DNA, 19 bp, Mus musculus
tgcatgtatgtatttatgt

SEQ ID NO: 198627 - DNA, 22 bp, Mus musculus
tgtgtgcatgtatatgtctgtg

SEQ ID NO: 198628 - DNA, 21 bp, Mus musculus
ttaagagcactgactgctctt

SEQ ID NO: 198629 - DNA, 23 bp, Mus musculus
tgtctgtgaccctgtgttctctc

SEQ ID NO: 198630 - DNA, 23 bp, Mus musculus
gaagagcctatctcaaaatgatg

SEQ ID NO: 198631 - DNA, 21 bp, Mus musculus
agatttgaacctctgcctgag

SEQ ID NO: 198632 - DNA, 23 bp, Mus musculus
ctcaggctgtgactgtctctcag

SEQ ID NO: 198633 - DNA, 23 bp, Mus musculus
ctgtgtggctcacttgtcatctt

SEQ ID NO: 198634 - DNA, 23 bp, Mus musculus
agaagtctgtcagtcactgattc

SEQ ID NO: 198635 - DNA, 23 bp, Mus musculus
ctgtctgtctctgcctcccaagt

SEQ ID NO: 198636 - DNA, 23 bp, Mus musculus
tcacactcaaaggctcacttgat

SEQ ID NO: 198637 - DNA, 23 bp, Mus musculus
acccagatgtgggcactgagtgt

SEQ ID NO: 198638 - DNA, 23 bp, Mus musculus
aggtgagactccagtgtctctgt

SEQ ID NO: 198639 - DNA, 23 bp, Mus musculus
gtctctgtctgtcagtgtctctg

SEQ ID NO: 198640 - DNA, 23 bp, Mus musculus
cagcctccctcactctgtgattc

SEQ ID NO: 198641 - DNA, 23 bp, Mus musculus
tgtttgtgcatgtgcatgtatgt

SEQ ID NO: 198642 - DNA, 23 bp, Mus musculus
atgtgtgtatatgtatatgtgtg

SEQ ID NO: 198643 - DNA, 22 bp, Mus musculus
tgtatgtatatatgtatatgtg

SEQ ID NO: 198644 - DNA, 23 bp, Mus musculus
tatgtatttgcatgtgtatgtgt

SEQ ID NO: 198645 - DNA, 21 bp, Mus musculus
tggtaatgaagagatagcagt

SEQ ID NO: 198646 - DNA, 21 bp, Mus musculus
caagagagattttgttcttgt

SEQ ID NO: 198647 - DNA, 20 bp, Mus musculus
ggtagcctgtgaggagggga

SEQ ID NO: 198648 - DNA, 23 bp, Mus musculus
tgacctaatttctgtgtgtgtga

SEQ ID NO: 198649 - DNA, 21 bp, Mus musculus
tcccacagatatatccgctag

SEQ ID NO: 198650 - DNA, 23 bp, Mus musculus
tgagtgactgtagactgtgttga

SEQ ID NO: 198651 - DNA, 19 bp, Mus musculus
ctcagaagggtctgaggtc

SEQ ID NO: 198652 - DNA, 23 bp, Mus musculus
gactggctcagtgggtctctgtc

SEQ ID NO: 198653 - DNA, 23 bp, Mus musculus
tgtgactctgtctctgcctccca

SEQ ID NO: 198654 - DNA, 23 bp, Mus musculus
attccagatgcttgtcatgggtt

SEQ ID NO: 198655 - DNA, 20 bp, Mus musculus
tgtcttgctctattagtggc

SEQ ID NO: 198656 - DNA, 21 bp, Mus musculus
tacacactagagagacaggac

SEQ ID NO: 198657 - DNA, 23 bp, Mus musculus
tagtccatggtgatctgatagga

SEQ ID NO: 198658 - DNA, 18 bp, Mus musculus
tatctgtgtgtgtgtgtg

SEQ ID NO: 198659 - DNA, 23 bp, Mus musculus
cagactgtctgtgtgtgtgcctg

SEQ ID NO: 198660 - DNA, 23 bp, Mus musculus
atgtgtgagcctctgcatggtaa

SEQ ID NO: 198661 - DNA, 23 bp, Mus musculus
tgtgtgtgcctctctctgtgtgt

SEQ ID NO: 198662 - DNA, 23 bp, Mus musculus
gagcagagtgatgacagtgctca

SEQ ID NO: 198663 - DNA, 22 bp, Mus musculus
tgtgaagagccagctgtgtact

SEQ ID NO: 198664 - DNA, 22 bp, Mus musculus
ctgtctgtctgtctgtcactac

SEQ ID NO: 198665 - DNA, 23 bp, Mus musculus
atctgtcactgtctgagtgttca

SEQ ID NO: 198666 - DNA, 23 bp, Mus musculus
tctgagtcagcagagagtggcct

SEQ ID NO: 198667 - DNA, 20 bp, Mus musculus
agactgaggtttgttgtgtg

SEQ ID NO: 198668 - DNA, 21 bp, Mus musculus
tggtgagttcagtgacagcag

SEQ ID NO: 198669 - DNA, 20 bp, Mus musculus
ctcagactcagacactgagc

SEQ ID NO: 198670 - DNA, 22 bp, Mus musculus
tgttttgtgaccaattatatgg

SEQ ID NO: 198671 - DNA, 23 bp, Mus musculus
atgtatgtatgtatgtggtgcca

SEQ ID NO: 198672 - DNA, 23 bp, Mus musculus
tgtatgtgtgcatgtgtatgtgc

SEQ ID NO: 198673 - DNA, 23 bp, Mus musculus
tgtatgtgagcatgcatgtgtgt

SEQ ID NO: 198674 - DNA, 20 bp, Mus musculus
tgtgcacagatgcatgttgt

SEQ ID NO: 198675 - DNA, 23 bp, Mus musculus
agagagtgtttttgttgttctaa

SEQ ID NO: 198676 - DNA, 23 bp, Mus musculus
tcctcactgtagtcagagtggag

SEQ ID NO: 198677 - DNA, 22 bp, Mus musculus
ctaagcgattcacaggagagtg

SEQ ID NO: 198678 - DNA, 18 bp, Mus musculus
acagtgaagattgagacc

SEQ ID NO: 198679 - DNA, 23 bp, Mus musculus
cccagtctctgtctgtgtagcag

SEQ ID NO: 198680 - DNA, 23 bp, Mus musculus
atcaatgagtgcataccatgtgt

SEQ ID NO: 198681 - DNA, 23 bp, Mus musculus
aatgtggaaatactatatgacat

SEQ ID NO: 198682 - DNA, 22 bp, Mus musculus
tttgtgcaccaattatatggtc

SEQ ID NO: 198683 - DNA, 22 bp, Mus musculus
tgttttgtgaccaattatatgg

SEQ ID NO: 198684 - DNA, 23 bp, Mus musculus
atgcctccatcagattgtcttgt

SEQ ID NO: 198685 - DNA, 23 bp, Mus musculus
tttgtgtatgtttacatgtgtgt

SEQ ID NO: 198686 - DNA, 23 bp, Mus musculus
tgcaggagcatgtgcatgtggat

SEQ ID NO: 198687 - DNA, 18 bp, Mus musculus
agagggaggacagtgagc

SEQ ID NO: 198688 - DNA, 23 bp, Mus musculus
agtgcacatgtatgtgtgtgtgt

SEQ ID NO: 198689 - DNA, 23 bp, Mus musculus
actcactgtcagtctgatatggg

SEQ ID NO: 198690 - DNA, 21 bp, Mus musculus
taggttgagtatcagtttcta

SEQ ID NO: 198691 - DNA, 19 bp, Mus musculus
aggaagttggatgctaact

SEQ ID NO: 198692 - DNA, 22 bp, Mus musculus
ttatatctgcattccatgcttt

SEQ ID NO: 198693 - DNA, 23 bp, Mus musculus
ttgagagctctcagtgcaatgtg

SEQ ID NO: 198694 - DNA, 23 bp, Mus musculus
tgtatgtatgtatgtatgtattt

SEQ ID NO: 198695 - DNA, 19 bp, Mus musculus
cagcttattttttgagaca

SEQ ID NO: 198696 - DNA, 23 bp, Mus musculus
tcccactctcactgcctgtgttc

SEQ ID NO: 198697 - DNA, 23 bp, Mus musculus
ttacactgtgcttgtttagcctg

SEQ ID NO: 198698 - DNA, 23 bp, Mus musculus
tctgtctgagtctgtctctcatt

SEQ ID NO: 198699 - DNA, 19 bp, Mus musculus
tgaaagcattttctgaaag

SEQ ID NO: 198700 - DNA, 23 bp, Mus musculus
ttggtggctcagtgtctgagtct

SEQ ID NO: 198701 - DNA, 22 bp, Mus musculus
tatgtatatatgtgtgtgtatg

SEQ ID NO: 198702 - DNA, 23 bp, Mus musculus
atgtatatgtatacatgtgtgtg

SEQ ID NO: 198703 - DNA, 22 bp, Mus musculus
tatatgtgcgtgtgtgtatgta

SEQ ID NO: 198704 - DNA, 23 bp, Mus musculus
aagactgcacagcctggactatc

SEQ ID NO: 198705 - DNA, 22 bp, Mus musculus
tgtttgtttttcaagagttttt

SEQ ID NO: 198706 - DNA, 23 bp, Mus musculus
cactgcagccattgctgctgctg

SEQ ID NO: 198707 - DNA, 21 bp, Mus musculus
ctctcacagtatcagatgagt

SEQ ID NO: 198708 - DNA, 21 bp, Mus musculus
tggcagtgtctgtccttctct

SEQ ID NO: 198709 - DNA, 23 bp, Mus musculus
atttgatgtcactcagacacaca

SEQ ID NO: 198710 - DNA, 23 bp, Mus musculus
gcgtgcatatcatatgtgtgtgt

SEQ ID NO: 198711 - DNA, 23 bp, Mus musculus
acactggctggctgtttgcctgg

SEQ ID NO: 198712 - DNA, 23 bp, Mus musculus
tatgtgtatatgtatgtatgtgt

SEQ ID NO: 198713 - DNA, 23 bp, Mus musculus
atatgtacatgtgtatgtgtatg

SEQ ID NO: 198714 - DNA, 22 bp, Mus musculus
aatactatatatgtatatgtgt

SEQ ID NO: 198715 - DNA, 22 bp, Mus musculus
agagaacagtgtctgggacagc

SEQ ID NO: 198716 - DNA, 23 bp, Mus musculus
atggagtgtgtggtatacgtgac

SEQ ID NO: 198717 - DNA, 21 bp, Mus musculus
tgagtgaagagtctgtgcatt

SEQ ID NO: 198718 - DNA, 19 bp, Mus musculus
attgcacccgctccctcac

SEQ ID NO: 198719 - DNA, 23 bp, Mus musculus
tgtgtgtgtgcatgtgcatgcgc

SEQ ID NO: 198720 - DNA, 23 bp, Mus musculus
gtgtgtatgtctgtgtgtgcttg

SEQ ID NO: 198721 - DNA, 20 bp, Mus musculus
cagcctgagtctctcccact

SEQ ID NO: 198722 - DNA, 23 bp, Mus musculus
ttaattctctgatgtaaagatgt

SEQ ID NO: 198723 - DNA, 23 bp, Mus musculus
aatctttaccatctcaaaagaaa

SEQ ID NO: 198724 - DNA, 22 bp, Mus musculus
ctgtctctctctctctcgggca

SEQ ID NO: 198725 - DNA, 23 bp, Mus musculus
gtatgccagtagaattcagtttc

SEQ ID NO: 198726 - DNA, 22 bp, Mus musculus
agttgtcattgtgacaggctgg

SEQ ID NO: 198727 - DNA, 21 bp, Mus musculus
tatgtgaatatatattcacac

SEQ ID NO: 198728 - DNA, 23 bp, Mus musculus
gtatgtatgtatgtatgtatgta

SEQ ID NO: 198729 - DNA, 18 bp, Mus musculus
tgggtctgacttttctct

SEQ ID NO: 198730 - DNA, 21 bp, Mus musculus
tctgtgtttctgtgagtggga

SEQ ID NO: 198731 - DNA, 19 bp, Mus musculus
acgcacacacatatgcatg

SEQ ID NO: 198732 - DNA, 23 bp, Mus musculus
ccctgtgggtctcacactcccac

SEQ ID NO: 198733 - DNA, 23 bp, Mus musculus
ttttttctcttaatctttatgtt

SEQ ID NO: 198734 - DNA, 20 bp, Mus musculus
aaaaagaaaaagagcaggag

SEQ ID NO: 198735 - DNA, 22 bp, Mus musculus
tggctgagtggttaagagccct

SEQ ID NO: 198736 - DNA, 21 bp, Mus musculus
actcaccctgcttatgtgctc

SEQ ID NO: 198737 - DNA, 23 bp, Mus musculus
ctgcagttctttgtctagggtga

SEQ ID NO: 198738 - DNA, 20 bp, Mus musculus
tggccagccttgatcctgac

SEQ ID NO: 198739 - DNA, 23 bp, Mus musculus
tcagtctctctgtggctcagttt

SEQ ID NO: 198740 - DNA, 21 bp, Mus musculus
acatgtgtatatatcattatg

SEQ ID NO: 198741 - DNA, 23 bp, Mus musculus
gtatgtatgtgtgcatgtgtatg

SEQ ID NO: 198742 - DNA, 20 bp, Mus musculus
tgtcagtagttatgctccag

SEQ ID NO: 198743 - DNA, 23 bp, Mus musculus
caggtgtctctctcagtttcagt

SEQ ID NO: 198744 - DNA, 23 bp, Mus musculus
tctgtctgtctgtctgtgtgcct

SEQ ID NO: 198745 - DNA, 21 bp, Mus musculus
catgaggctattgtctgtgct

SEQ ID NO: 198746 - DNA, 18 bp, Mus musculus
atgtaaatatatatgtgt

SEQ ID NO: 198747 - DNA, 19 bp, Mus musculus
atgtgtgtaaatgtgtatg

SEQ ID NO: 198748 - DNA, 23 bp, Mus musculus
tttgattgacaggtttgtttagg

SEQ ID NO: 198749 - DNA, 23 bp, Mus musculus
tgtctgtctgtctgcctgcctca

SEQ ID NO: 198750 - DNA, 23 bp, Mus musculus
tgaatggatgtatgtatgtatgg

SEQ ID NO: 198751 - DNA, 23 bp, Mus musculus
atatatgcatgtatacatatgca

SEQ ID NO: 198752 - DNA, 23 bp, Mus musculus
tgagagcagtgcgtcctgtctca

SEQ ID NO: 198753 - DNA, 23 bp, Mus musculus
tatgtgagtgttttgcctgtgtg

SEQ ID NO: 198754 - DNA, 20 bp, Mus musculus
atatgtatatatgtatatat

SEQ ID NO: 198755 - DNA, 21 bp, Mus musculus
atgacacccacagtcacacag

SEQ ID NO: 198756 - DNA, 19 bp, Mus musculus
tgtggtgacttctgtctgt

SEQ ID NO: 198757 - DNA, 23 bp, Mus musculus
tctctcagtcacatttgggacac

SEQ ID NO: 198758 - DNA, 23 bp, Mus musculus
tgtctctcagtcacatttgggac

SEQ ID NO: 198759 - DNA, 23 bp, Mus musculus
tctctcagtcacatttgggacac

SEQ ID NO: 198760 - DNA, 23 bp, Mus musculus
tctctcagtcacatttgggacac

SEQ ID NO: 198761 - DNA, 22 bp, Mus musculus
gcacatctgtctttatgtctat

SEQ ID NO: 198762 - DNA, 23 bp, Mus musculus
tacatatgtgcatatgaaatata

SEQ ID NO: 198763 - DNA, 20 bp, Mus musculus
tatagtgtgtgtatacacat

SEQ ID NO: 198764 - DNA, 21 bp, Mus musculus
actgctatatagtatgtgtgt

SEQ ID NO: 198765 - DNA, 23 bp, Mus musculus
tgctatatagtatgtgtgtgtgt

SEQ ID NO: 198766 - DNA, 18 bp, Mus musculus
atagtatacacataccat

SEQ ID NO: 198767 - DNA, 19 bp, Mus musculus
tagtgtatacacataccat

SEQ ID NO: 198768 - DNA, 19 bp, Mus musculus
tatgtgtgtgatacatgta

SEQ ID NO: 198769 - DNA, 19 bp, Mus musculus
tgttttactgtaagtttcc

SEQ ID NO: 198770 - DNA, 23 bp, Mus musculus
tgaacctcactgtgtgagtcaca

SEQ ID NO: 198771 - DNA, 23 bp, Mus musculus
atctctccctgtgactctcctct

SEQ ID NO: 198772 - DNA, 21 bp, Mus musculus
acagacacatgaagagatagc

SEQ ID NO: 198773 - DNA, 23 bp, Mus musculus
cggctgactctgtttctgtgtcc

SEQ ID NO: 198774 - DNA, 23 bp, Mus musculus
tctgcgtgacacactctgttcag

SEQ ID NO: 198775 - DNA, 23 bp, Mus musculus
acaacaatgaagaaacagagcag

SEQ ID NO: 198776 - DNA, 18 bp, Mus musculus
tcactggctgtctctcag

SEQ ID NO: 198777 - DNA, 23 bp, Mus musculus
gtggctctcacagtgacacaggc

SEQ ID NO: 198778 - DNA, 23 bp, Mus musculus
gcagtgtcactgggacagaaccg

SEQ ID NO: 198779 - DNA, 23 bp, Mus musculus
tgagggtgggctttgagtttcag

SEQ ID NO: 198780 - DNA, 22 bp, Mus musculus
aaacatcaggggctggagagat

SEQ ID NO: 198781 - DNA, 23 bp, Mus musculus
tgtctgtctgtctgtctgtctgc

SEQ ID NO: 198782 - DNA, 23 bp, Mus musculus
ggtttctctgtgtctctggctgt

SEQ ID NO: 198783 - DNA, 19 bp, Mus musculus
cagaggtaataagttctat

SEQ ID NO: 198784 - DNA, 23 bp, Mus musculus
aaagtgacaggttcagatcagag

SEQ ID NO: 198785 - DNA, 20 bp, Mus musculus
agatgatggagttagagtga

SEQ ID NO: 198786 - DNA, 23 bp, Mus musculus
acactgtgtctctcacagctact

SEQ ID NO: 198787 - DNA, 23 bp, Mus musculus
ctagttcatgattgtttgattct

SEQ ID NO: 198788 - DNA, 19 bp, Mus musculus
tgagacccatctttcctgc

SEQ ID NO: 198789 - DNA, 22 bp, Mus musculus
ctggctggctggctggctggct

SEQ ID NO: 198790 - DNA, 23 bp, Mus musculus
gagactctgtgactctgtctccg

SEQ ID NO: 198791 - DNA, 19 bp, Mus musculus
tcaggtgtaagctactgct

SEQ ID NO: 198792 - DNA, 23 bp, Mus musculus
tgcctgcctgcctgcctgcctgc

SEQ ID NO: 198793 - DNA, 23 bp, Mus musculus
acctacaggggctagagagatgg

SEQ ID NO: 198794 - DNA, 23 bp, Mus musculus
ctatgtgcatgagcaagtgcatg

SEQ ID NO: 198795 - DNA, 23 bp, Mus musculus
tatggaaagaaacgaagactgag

SEQ ID NO: 198796 - DNA, 23 bp, Mus musculus
gagtctcactctcactccttcgc

SEQ ID NO: 198797 - DNA, 23 bp, Mus musculus
tgggactgagtaactgctagatc

SEQ ID NO: 198798 - DNA, 23 bp, Mus musculus
ctgtctgactggctctctacaga

SEQ ID NO: 198799 - DNA, 23 bp, Mus musculus
caagatttcagacagaaccaaga

SEQ ID NO: 198800 - DNA, 23 bp, Mus musculus
ggtctgtctgtctgtctgtctgt

SEQ ID NO: 198801 - DNA, 21 bp, Mus musculus
cagtggctctgagatcccagt

SEQ ID NO: 198802 - DNA, 23 bp, Mus musculus
tcacagatctgtctgaggagaca

SEQ ID NO: 198803 - DNA, 22 bp, Mus musculus
tgtgtgtgcaggcatgtgtatg

SEQ ID NO: 198804 - DNA, 23 bp, Mus musculus
agtgtgtgcaagtgtatgtgcag

SEQ ID NO: 198805 - DNA, 22 bp, Mus musculus
atatagctgcttttgtatcctt

SEQ ID NO: 198806 - DNA, 18 bp, Mus musculus
tatacatacatatgtgtg

SEQ ID NO: 198807 - DNA, 22 bp, Mus musculus
gtttcaggggtctctgtgtgtc

SEQ ID NO: 198808 - DNA, 23 bp, Mus musculus
agggtctctgtgtggcctcatgg

SEQ ID NO: 198809 - DNA, 23 bp, Mus musculus
ttgagacatgagccctgtctcct

SEQ ID NO: 198810 - DNA, 23 bp, Mus musculus
gtgcatgtttatatgtatgtatg

SEQ ID NO: 198811 - DNA, 23 bp, Mus musculus
gttctgactgtgtgagctgtgtg

SEQ ID NO: 198812 - DNA, 23 bp, Mus musculus
attatgtgtaactgtatatgtga

SEQ ID NO: 198813 - DNA, 23 bp, Mus musculus
ttgcagtgtcttctagctgtgtg

SEQ ID NO: 198814 - DNA, 19 bp, Mus musculus
cagtctctgtgactctggg

SEQ ID NO: 198815 - DNA, 21 bp, Mus musculus
cacagtgggtttgcactctct

SEQ ID NO: 198816 - DNA, 23 bp, Mus musculus
tgtgtgtgtcagtgtgtgtgtat

SEQ ID NO: 198817 - DNA, 23 bp, Mus musculus
gacagtgtctctcactgagcctg

SEQ ID NO: 198818 - DNA, 23 bp, Mus musculus
cactccctgagttctgcagcatc

SEQ ID NO: 198819 - DNA, 21 bp, Mus musculus
agctgtgtgaccttcagcaag

SEQ ID NO: 198820 - DNA, 23 bp, Mus musculus
ttgaggtctgtgtgcaggggagt

SEQ ID NO: 198821 - DNA, 23 bp, Mus musculus
ccctccctggctgcctgatagac

SEQ ID NO: 198822 - DNA, 18 bp, Mus musculus
ctctctctgtattccgtg

SEQ ID NO: 198823 - DNA, 19 bp, Mus musculus
acaggatggaagtcagggc

SEQ ID NO: 198824 - DNA, 23 bp, Mus musculus
cacagctttctctgtctctctct

SEQ ID NO: 198825 - DNA, 23 bp, Mus musculus
acagtgtccctcagtggctgaat

SEQ ID NO: 198826 - DNA, 23 bp, Mus musculus
ttcagtctctagtcagagtgctc

SEQ ID NO: 198827 - DNA, 23 bp, Mus musculus
tctgtctgtgctgtatttgagtg

SEQ ID NO: 198828 - DNA, 23 bp, Mus musculus
atgtgtgtgtgcttgtgcatgtg

SEQ ID NO: 198829 - DNA, 23 bp, Mus musculus
atgacaggggctggagagatggt

SEQ ID NO: 198830 - DNA, 20 bp, Mus musculus
aagagcactgactgctcttc

SEQ ID NO: 198831 - DNA, 22 bp, Mus musculus
tgtgatacatatatgtatacat

SEQ ID NO: 198832 - DNA, 23 bp, Mus musculus
gtatgtatgcatgtgtgtatgta

SEQ ID NO: 198833 - DNA, 23 bp, Mus musculus
aacagagtagacttgacaaatgt

SEQ ID NO: 198834 - DNA, 23 bp, Mus musculus
agtctgtctgtctgtctgtctgt

SEQ ID NO: 198835 - DNA, 21 bp, Mus musculus
gctcatcagagcataggtgtg

SEQ ID NO: 198836 - DNA, 23 bp, Mus musculus
agtcccagagtctgtctgacaca

SEQ ID NO: 198837 - DNA, 21 bp, Mus musculus
taggtgtggctctgttggagt

SEQ ID NO: 198838 - DNA, 23 bp, Mus musculus
ttgtggttgataaagtgacagga

SEQ ID NO: 198839 - DNA, 18 bp, Mus musculus
tgcttagggttgcagtct

SEQ ID NO: 198840 - DNA, 23 bp, Mus musculus
tgaccacacaggctgtgtccctg

SEQ ID NO: 198841 - DNA, 19 bp, Mus musculus
gtgagcacacagtgtggtg

SEQ ID NO: 198842 - DNA, 23 bp, Mus musculus
ctgtctctctgtgtctgtctgtt

SEQ ID NO: 198843 - DNA, 22 bp, Mus musculus
tcactgtgcacactaggaggtg

SEQ ID NO: 198844 - DNA, 23 bp, Mus musculus
tgagtgcttctctctgtctatga

SEQ ID NO: 198845 - DNA, 23 bp, Mus musculus
tctctgtgtctgtgtgtcatctc

SEQ ID NO: 198846 - DNA, 20 bp, Mus musculus
tagctgtaggctgtagcaca

SEQ ID NO: 198847 - DNA, 20 bp, Mus musculus
agtctgggtggctttcatca

SEQ ID NO: 198848 - DNA, 23 bp, Mus musculus
cagtctgtctgtctctgtctctg

SEQ ID NO: 198849 - DNA, 23 bp, Mus musculus
tgtctgtatctgtgtctgtctgg

SEQ ID NO: 198850 - DNA, 21 bp, Mus musculus
atgaggttgttctgtccttga

SEQ ID NO: 198851 - DNA, 23 bp, Mus musculus
aagagcactgactgctcttccag

SEQ ID NO: 198852 - DNA, 23 bp, Mus musculus
cctaaagctctgtcacttgtcag

SEQ ID NO: 198853 - DNA, 23 bp, Mus musculus
tctgtctgtctgtccgtctgtct

SEQ ID NO: 198854 - DNA, 23 bp, Mus musculus
tctgtctgtctgtctgtctgtgt

SEQ ID NO: 198855 - DNA, 23 bp, Mus musculus
tacctgtgtcttcatcatgacat

SEQ ID NO: 198856 - DNA, 22 bp, Mus musculus
agacagagtgcagtcactggag

SEQ ID NO: 198857 - DNA, 23 bp, Mus musculus
tatgtgtgcatatgcatgtgtat

SEQ ID NO: 198858 - DNA, 23 bp, Mus musculus
atatgtgtgtatatatgtgtgtg

SEQ ID NO: 198859 - DNA, 22 bp, Mus musculus
atatgtgtatatgtatgtatgt

SEQ ID NO: 198860 - DNA, 23 bp, Mus musculus
atgtatttatgtatgtatatgta

SEQ ID NO: 198861 - DNA, 19 bp, Mus musculus
gtatatatgtatgtgtgtg

SEQ ID NO: 198862 - DNA, 18 bp, Mus musculus
tatgtgtgtgtatgtata

SEQ ID NO: 198863 - DNA, 23 bp, Mus musculus
tctttgtctcagtgtatgtgtgt

SEQ ID NO: 198864 - DNA, 23 bp, Mus musculus
aatactcagtgactggctctgtc

SEQ ID NO: 198865 - DNA, 23 bp, Mus musculus
ctatacagcctgaagtgttggct

SEQ ID NO: 198866 - DNA, 22 bp, Mus musculus
tgagacagatgactcagagctc

SEQ ID NO: 198867 - DNA, 23 bp, Mus musculus
tgtatatgtatacacacatatgt

SEQ ID NO: 198868 - DNA, 23 bp, Mus musculus
agtagtgtctgtctgtctgtctg

SEQ ID NO: 198869 - DNA, 23 bp, Mus musculus
ttctgcatctgcttctgcttgtc

SEQ ID NO: 198870 - DNA, 23 bp, Mus musculus
tcagccagtctctgtccctgtga

SEQ ID NO: 198871 - DNA, 23 bp, Mus musculus
aagttcatatcctgtccttcagg

SEQ ID NO: 198872 - DNA, 23 bp, Mus musculus
aaaatgtttgatttggataccaa

SEQ ID NO: 198873 - DNA, 23 bp, Mus musculus
ctctaacaccagtcactttcact

SEQ ID NO: 198874 - DNA, 23 bp, Mus musculus
gtgtgtgtatgtatgtatatatg

SEQ ID NO: 198875 - DNA, 19 bp, Mus musculus
tcacaaccatctgtacagc

SEQ ID NO: 198876 - DNA, 23 bp, Mus musculus
tttcactgtggctcagttctggt

SEQ ID NO: 198877 - DNA, 23 bp, Mus musculus
tcactctctgtgacttagtgact

SEQ ID NO: 198878 - DNA, 21 bp, Mus musculus
accagatgcaggcctcgtgca

SEQ ID NO: 198879 - DNA, 23 bp, Mus musculus
ggtgggtgggtctgtctgtctgt

SEQ ID NO: 198880 - DNA, 23 bp, Mus musculus
tggatgaatgaatgaatgaatcc

SEQ ID NO: 198881 - DNA, 23 bp, Mus musculus
actgcacccagagtgtgccgagt

SEQ ID NO: 198882 - DNA, 21 bp, Mus musculus
cctgcctctgtctctgtctca

SEQ ID NO: 198883 - DNA, 18 bp, Mus musculus
tgtatatatctatgtacg

SEQ ID NO: 198884 - DNA, 23 bp, Mus musculus
taaccttgttgatgtcatttttt

SEQ ID NO: 198885 - DNA, 23 bp, Mus musculus
tgtatatgcatatgtatgtgtat

SEQ ID NO: 198886 - DNA, 23 bp, Mus musculus
atgcacatgtatgtgtatatgta

SEQ ID NO: 198887 - DNA, 23 bp, Mus musculus
ctgcctcagtcaccctctgacac

SEQ ID NO: 198888 - DNA, 22 bp, Mus musculus
gtgctcagttctgtcttcctag

SEQ ID NO: 198889 - DNA, 22 bp, Mus musculus
ttgagagctgtgggtagagtgt

SEQ ID NO: 198890 - DNA, 23 bp, Mus musculus
atatctctgttgcaaatatgtgt

SEQ ID NO: 198891 - DNA, 19 bp, Mus musculus
tgtatatatgtatgagagt

SEQ ID NO: 198892 - DNA, 23 bp, Mus musculus
tcagagggtctcactctgagtgt

SEQ ID NO: 198893 - DNA, 22 bp, Mus musculus
agattctggcagtattagaaga

SEQ ID NO: 198894 - DNA, 23 bp, Mus musculus
tgtctgtctgtttctaataagtc

SEQ ID NO: 198895 - DNA, 22 bp, Mus musculus
tgaggaagtaggttggattgta

SEQ ID NO: 198896 - DNA, 23 bp, Mus musculus
cttacatgttgtgattttcttgt

SEQ ID NO: 198897 - DNA, 23 bp, Mus musculus
ttcagagaagacactctgcttat

SEQ ID NO: 198898 - DNA, 18 bp, Mus musculus
aggttttattttctgaaa

SEQ ID NO: 198899 - DNA, 23 bp, Mus musculus
actcccattctctgtctgttact

SEQ ID NO: 198900 - DNA, 22 bp, Mus musculus
aagctgagaacagagaacgttc

SEQ ID NO: 198901 - DNA, 23 bp, Mus musculus
aataggcaatgtcactctgattc

SEQ ID NO: 198902 - DNA, 21 bp, Mus musculus
tgcatctatgtgtctgtgtgt

SEQ ID NO: 198903 - DNA, 18 bp, Mus musculus
aagctgcagttggccatt

SEQ ID NO: 198904 - DNA, 23 bp, Mus musculus
tgtgtatgcatatgtatagtacg

SEQ ID NO: 198905 - DNA, 20 bp, Mus musculus
tgtgactgtcctgacgagca

SEQ ID NO: 198906 - DNA, 23 bp, Mus musculus
tgtatatgtatatgtatatgtat

SEQ ID NO: 198907 - DNA, 23 bp, Mus musculus
tcacagtggctgtagaaagtgta

SEQ ID NO: 198908 - DNA, 21 bp, Mus musculus
tctgcatatatatgtatatgt

SEQ ID NO: 198909 - DNA, 23 bp, Mus musculus
tatatgcatatatgtgtgtgtga

SEQ ID NO: 198910 - DNA, 23 bp, Mus musculus
ctgtctgtctgtctctatttttg

SEQ ID NO: 198911 - DNA, 23 bp, Mus musculus
tatatatgtgtgtgtatgtgtgt

SEQ ID NO: 198912 - DNA, 23 bp, Mus musculus
tgtgcatatgtatagacatgtgt

SEQ ID NO: 198913 - DNA, 23 bp, Mus musculus
tgcttgtgtgtatgtatgtatac

SEQ ID NO: 198914 - DNA, 23 bp, Mus musculus
gtctgtctctgtgtgcctgtctg

SEQ ID NO: 198915 - DNA, 18 bp, Mus musculus
tatgtgtgtgtgtgtatg

SEQ ID NO: 198916 - DNA, 23 bp, Mus musculus
attgatgaatgagtatcaaattg

SEQ ID NO: 198917 - DNA, 23 bp, Mus musculus
attctcagtgctgatattgtggt

SEQ ID NO: 198918 - DNA, 23 bp, Mus musculus
ccaatagatgactgtgagcattc

SEQ ID NO: 198919 - DNA, 21 bp, Mus musculus
tttgccaggcactgtgggtag

SEQ ID NO: 198920 - DNA, 18 bp, Mus musculus
ctgaataagtctctctct

SEQ ID NO: 198921 - DNA, 23 bp, Mus musculus
tatattatatgtgtatatgtata

SEQ ID NO: 198922 - DNA, 23 bp, Mus musculus
aatacatcatgtatatgtatatg

SEQ ID NO: 198923 - DNA, 23 bp, Mus musculus
tatgtaaatatatacatatgtgt

SEQ ID NO: 198924 - DNA, 23 bp, Mus musculus
atctgcatcagaaatgactctga

SEQ ID NO: 198925 - DNA, 20 bp, Mus musculus
atatacaatgtgtatatgta

SEQ ID NO: 198926 - DNA, 23 bp, Mus musculus
atgtatgtatgtatgtatgtatg

SEQ ID NO: 198927 - DNA, 23 bp, Mus musculus
taagtgacagatgacagagagga

SEQ ID NO: 198928 - DNA, 23 bp, Mus musculus
gaaataggaggtctcactgaata

SEQ ID NO: 198929 - DNA, 23 bp, Mus musculus
aaatgttttctgtggaaggccat

SEQ ID NO: 198930 - DNA, 23 bp, Mus musculus
gtctgagtctgtgggtcttcatt

SEQ ID NO: 198931 - DNA, 23 bp, Mus musculus
tgcgtgcgtgcgtgcgtgcgtgc

SEQ ID NO: 198932 - DNA, 22 bp, Mus musculus
ttggcttttgattccaatgtct

SEQ ID NO: 198933 - DNA, 23 bp, Mus musculus
tgtgtctctggctgtcttggact

SEQ ID NO: 198934 - DNA, 21 bp, Mus musculus
taagagcactgactgctcttc

SEQ ID NO: 198935 - DNA, 20 bp, Mus musculus
ctggtggctctctctctctc

SEQ ID NO: 198936 - DNA, 23 bp, Mus musculus
gtctgtgcatctgcatctgtgtc

SEQ ID NO: 198937 - DNA, 22 bp, Mus musculus
tgggctctgcttgacttctggg

SEQ ID NO: 198938 - DNA, 20 bp, Mus musculus
cttgagcctggcacagattt

SEQ ID NO: 198939 - DNA, 23 bp, Mus musculus
tctccctgtctgtctgcctgtca

SEQ ID NO: 198940 - DNA, 21 bp, Mus musculus
caagatatgtgggagctggag

SEQ ID NO: 198941 - DNA, 22 bp, Mus musculus
cctctcagcgtcacctcatgct

SEQ ID NO: 198942 - DNA, 23 bp, Mus musculus
tgtctgcctgtctcactgttgcc

SEQ ID NO: 198943 - DNA, 23 bp, Mus musculus
atcacagtacagagtcagcacag

SEQ ID NO: 198944 - DNA, 21 bp, Mus musculus
tttgaccatgtttgttatttg

SEQ ID NO: 198945 - DNA, 18 bp, Mus musculus
accacatggtggtaacca

SEQ ID NO: 198946 - DNA, 23 bp, Mus musculus
tcaaccaggttttcatttctgag

SEQ ID NO: 198947 - DNA, 23 bp, Mus musculus
ctgtctgtctgtctgtgcagcag

SEQ ID NO: 198948 - DNA, 22 bp, Mus musculus
atagatggttgtgaactgggat

SEQ ID NO: 198949 - DNA, 23 bp, Mus musculus
aaatcttagagttgggagaggct

SEQ ID NO: 198950 - DNA, 22 bp, Mus musculus
tctgtggggtatgtgtgagtga

SEQ ID NO: 198951 - DNA, 23 bp, Mus musculus
tgcgaggctgcctggctgccagg

SEQ ID NO: 198952 - DNA, 23 bp, Mus musculus
gcctcacactgactatggcctat

SEQ ID NO: 198953 - DNA, 21 bp, Mus musculus
agtgtgtgtgcttgttgtgtg

SEQ ID NO: 198954 - DNA, 22 bp, Mus musculus
gtcttcctgcctgtctgtctgg

SEQ ID NO: 198955 - DNA, 23 bp, Mus musculus
tgaggtagaaggaagtactgact

SEQ ID NO: 198956 - DNA, 21 bp, Mus musculus
tagcatgtatgtatgtatgta

SEQ ID NO: 198957 - DNA, 22 bp, Mus musculus
tgtatgtatgtgtgtatgatgt

SEQ ID NO: 198958 - DNA, 23 bp, Mus musculus
tagcatgtatgtatgtatgtatg

SEQ ID NO: 198959 - DNA, 23 bp, Mus musculus
agtgctgactgctcttccagagg

SEQ ID NO: 198960 - DNA, 19 bp, Mus musculus
tcacccactgaccctcagt

SEQ ID NO: 198961 - DNA, 23 bp, Mus musculus
tatatgtatgtgtatgtatatga

SEQ ID NO: 198962 - DNA, 21 bp, Mus musculus
atatgtgtgtgtatatatata

SEQ ID NO: 198963 - DNA, 23 bp, Mus musculus
tatgtgtgtgtgtatgtatatat

SEQ ID NO: 198964 - DNA, 23 bp, Mus musculus
gtctctctgtctctcactcacac

SEQ ID NO: 198965 - DNA, 21 bp, Mus musculus
ttgtgtgtggctgtgcatgta

SEQ ID NO: 198966 - DNA, 23 bp, Mus musculus
tatatgtgcatgtgtataggtat

SEQ ID NO: 198967 - DNA, 21 bp, Mus musculus
atgtgtatatatgtacatgta

SEQ ID NO: 198968 - DNA, 23 bp, Mus musculus
gtgtacatatatgtgtgtgtata

SEQ ID NO: 198969 - DNA, 23 bp, Mus musculus
atgtttgcatgtatgtatgtatg

SEQ ID NO: 198970 - DNA, 21 bp, Mus musculus
attcaccacatgcatctatga

SEQ ID NO: 198971 - DNA, 20 bp, Mus musculus
atatgtatatatgtgtatgt

SEQ ID NO: 198972 - DNA, 23 bp, Mus musculus
agacttcacactgtctgtcactc

SEQ ID NO: 198973 - DNA, 23 bp, Mus musculus
tctgtctctctcacatatgactt

SEQ ID NO: 198974 - DNA, 22 bp, Mus musculus
agagttgaggattggttgggtt

SEQ ID NO: 198975 - DNA, 23 bp, Mus musculus
tctcatcctctcacactctctac

SEQ ID NO: 198976 - DNA, 23 bp, Mus musculus
gtatgtgaatggtgaatgtgagt

SEQ ID NO: 198977 - DNA, 21 bp, Mus musculus
taagacttcgaggattgcatg

SEQ ID NO: 198978 - DNA, 19 bp, Mus musculus
tatgtatgtatgtatgtgt

SEQ ID NO: 198979 - DNA, 21 bp, Mus musculus
acaggatcattatttctgaca

SEQ ID NO: 198980 - DNA, 23 bp, Mus musculus
ttggtcaggctgagaaaacagcc

SEQ ID NO: 198981 - DNA, 22 bp, Mus musculus
tgtctctgtgtgtatatgtgtg

SEQ ID NO: 198982 - DNA, 19 bp, Mus musculus
acacactctgtctctgtgg

SEQ ID NO: 198983 - DNA, 22 bp, Mus musculus
tctgtatctgtgaggtatatgt

SEQ ID NO: 198984 - DNA, 23 bp, Mus musculus
tgtatgtgtatatatatgtatgt

SEQ ID NO: 198985 - DNA, 23 bp, Mus musculus
gagcagtgagttgactgaggtgg

SEQ ID NO: 198986 - DNA, 23 bp, Mus musculus
acatgtatgtgtgtatatgtgtg

SEQ ID NO: 198987 - DNA, 23 bp, Mus musculus
tatgtgtatatatatgtgtgtgt

SEQ ID NO: 198988 - DNA, 21 bp, Mus musculus
ctctagcactgtctgtctgat

SEQ ID NO: 198989 - DNA, 22 bp, Mus musculus
agggtctcagtgaatctagagc

SEQ ID NO: 198990 - DNA, 23 bp, Mus musculus
agtgcatatatatgtgtgtgtat

SEQ ID NO: 198991 - DNA, 21 bp, Mus musculus
agacacacacacatacatgta

SEQ ID NO: 198992 - DNA, 21 bp, Mus musculus
agacagagatagggatagcct

SEQ ID NO: 198993 - DNA, 23 bp, Mus musculus
cccactgctagtgtttggtattg

SEQ ID NO: 198994 - DNA, 20 bp, Mus musculus
tgtgtacctgtgtgcatgtg

SEQ ID NO: 198995 - DNA, 23 bp, Mus musculus
acagttggtggctcagtgtctgg

SEQ ID NO: 198996 - DNA, 20 bp, Mus musculus
actgactgctcttccagagg

SEQ ID NO: 198997 - DNA, 22 bp, Mus musculus
atcatgaggggatagatgtcaa

SEQ ID NO: 198998 - DNA, 22 bp, Mus musculus
atattccttcaggttttctatc

SEQ ID NO: 198999 - DNA, 23 bp, Mus musculus
gggtcactcagtgcctcagcctg

SEQ ID NO: 199000 - DNA, 23 bp, Mus musculus
ccctgctagagttctgtgtctgt

SEQ ID NO: 199001 - DNA, 23 bp, Mus musculus
ctgtctgcctgagtgggtgtgca

SEQ ID NO: 199002 - DNA, 21 bp, Mus musculus
tgtctctctgagtatgctctg

SEQ ID NO: 199003 - DNA, 23 bp, Mus musculus
gctgtgtggttgacttgtgaaac

SEQ ID NO: 199004 - DNA, 19 bp, Mus musculus
ccaggcccactgtctgtct

SEQ ID NO: 199005 - DNA, 23 bp, Mus musculus
ctctctggctctgtgtcctggtg

SEQ ID NO: 199006 - DNA, 21 bp, Mus musculus
tctgtgtcaatagctttagca

SEQ ID NO: 199007 - DNA, 23 bp, Mus musculus
tctgtcacactgtctgtgtcatg

SEQ ID NO: 199008 - DNA, 23 bp, Mus musculus
aaaggcagtgtggaaagctggat

SEQ ID NO: 199009 - DNA, 19 bp, Mus musculus
cacacccagactcagtgtc

SEQ ID NO: 199010 - DNA, 19 bp, Mus musculus
aaaacaagaaggactggag

SEQ ID NO: 199011 - DNA, 18 bp, Mus musculus
tgagctagaacatttgcc

SEQ ID NO: 199012 - DNA, 22 bp, Mus musculus
ctgggtgtgtcagagcttctgg

SEQ ID NO: 199013 - DNA, 20 bp, Mus musculus
agctgcctctgagaccctga

SEQ ID NO: 199014 - DNA, 23 bp, Mus musculus
tgactagacagaagagagccagc

SEQ ID NO: 199015 - DNA, 23 bp, Mus musculus
catgtgtgtgcatatgcatgtat

SEQ ID NO: 199016 - DNA, 22 bp, Mus musculus
ataggatgttcgttgatttgtt

SEQ ID NO: 199017 - DNA, 20 bp, Mus musculus
tcagtggttaagagcactga

SEQ ID NO: 199018 - DNA, 22 bp, Mus musculus
agcctcagttttgtttttgaga

SEQ ID NO: 199019 - DNA, 23 bp, Mus musculus
tgtctctgcctccctgagtgctg

SEQ ID NO: 199020 - DNA, 21 bp, Mus musculus
tgtctgcctgtctgcctgcat

SEQ ID NO: 199021 - DNA, 22 bp, Mus musculus
acgtggagttccttgatccact

SEQ ID NO: 199022 - DNA, 23 bp, Mus musculus
taagagcactgactgctcttcca

SEQ ID NO: 199023 - DNA, 21 bp, Mus musculus
ttttagcaaccagttggtgtg

SEQ ID NO: 199024 - DNA, 23 bp, Mus musculus
taagacagtctctctctgtcccc

SEQ ID NO: 199025 - DNA, 20 bp, Mus musculus
acagctggggtatacttggg

SEQ ID NO: 199026 - DNA, 23 bp, Mus musculus
tttctgtcattctcactcaccca

SEQ ID NO: 199027 - DNA, 22 bp, Mus musculus
atggctgaggctttcttaagtg

SEQ ID NO: 199028 - DNA, 23 bp, Mus musculus
tggtgctcagtctctgtctctaa

SEQ ID NO: 199029 - DNA, 22 bp, Mus musculus
tgtatatagtatgcatatctat

SEQ ID NO: 199030 - DNA, 23 bp, Mus musculus
ggctgactctcactgtctgcctg

SEQ ID NO: 199031 - DNA, 23 bp, Mus musculus
tttatctgcaactccatcttgtt

SEQ ID NO: 199032 - DNA, 23 bp, Mus musculus
tgagacactagactgagtagcta

SEQ ID NO: 199033 - DNA, 23 bp, Mus musculus
gagatctgtgtgtctctctctcc

SEQ ID NO: 199034 - DNA, 23 bp, Mus musculus
gatgagaagacattttgttcatc

SEQ ID NO: 199035 - DNA, 21 bp, Mus musculus
ttttacgaccagatcttgttc

SEQ ID NO: 199036 - DNA, 19 bp, Mus musculus
aggctagaagtgaggaatg

SEQ ID NO: 199037 - DNA, 23 bp, Mus musculus
tcactgtcatatactctctctct

SEQ ID NO: 199038 - DNA, 23 bp, Mus musculus
gtctctgtgtgtatatgttttat

SEQ ID NO: 199039 - DNA, 23 bp, Mus musculus
tatacacacacatatacatacac

SEQ ID NO: 199040 - DNA, 22 bp, Mus musculus
tattttctcatgtttggttgtt

SEQ ID NO: 199041 - DNA, 21 bp, Mus musculus
tttcagttgagacagtttcag

SEQ ID NO: 199042 - DNA, 19 bp, Mus musculus
acacacatagacacacaca

SEQ ID NO: 199043 - DNA, 23 bp, Mus musculus
atgtgtatatatgtatgtgtgag

SEQ ID NO: 199044 - DNA, 23 bp, Mus musculus
tgtctctcactctttcagctgct

SEQ ID NO: 199045 - DNA, 22 bp, Mus musculus
gtatgtgtgtatctgtgtgggc

SEQ ID NO: 199046 - DNA, 21 bp, Mus musculus
attctgtgagctatgattgtc

SEQ ID NO: 199047 - DNA, 23 bp, Mus musculus
tatgtgtgtatatatgtatgtag

SEQ ID NO: 199048 - DNA, 22 bp, Mus musculus
atatgtatgtatgtatgtatgt

SEQ ID NO: 199049 - DNA, 23 bp, Mus musculus
tctgtgtgaacatttgtttttca

SEQ ID NO: 199050 - DNA, 23 bp, Mus musculus
tcacctgcaagaacatctgtttg

SEQ ID NO: 199051 - DNA, 22 bp, Mus musculus
tgttttgtgaccaattatatgg

SEQ ID NO: 199052 - DNA, 21 bp, Mus musculus
tttagactttctggtctgaga

SEQ ID NO: 199053 - DNA, 23 bp, Mus musculus
attattagaccaaaacatttggt

SEQ ID NO: 199054 - DNA, 23 bp, Mus musculus
tttctactcattttgtttttaac

SEQ ID NO: 199055 - DNA, 21 bp, Mus musculus
tgtatgtatatatgtatatgt

SEQ ID NO: 199056 - DNA, 23 bp, Mus musculus
tatgtgtatatatatatgtgtgt

SEQ ID NO: 199057 - DNA, 23 bp, Mus musculus
tgaatgtacatgtataagcatgt

SEQ ID NO: 199058 - DNA, 23 bp, Mus musculus
tcttggatcttatttgctgtttc

SEQ ID NO: 199059 - DNA, 23 bp, Mus musculus
tctctcagtgcctgtgtcaggaa

SEQ ID NO: 199060 - DNA, 19 bp, Mus musculus
aagttcttggctgtactga

SEQ ID NO: 199061 - DNA, 22 bp, Mus musculus
tgttttgtgaccaattatatgg

SEQ ID NO: 199062 - DNA, 19 bp, Mus musculus
attggtaaaattttgtgta

SEQ ID NO: 199063 - DNA, 22 bp, Mus musculus
taagtgtatatgtatgtgtgtg

SEQ ID NO: 199064 - DNA, 22 bp, Mus musculus
ttggacctagaaaaatgtttct

SEQ ID NO: 199065 - DNA, 23 bp, Mus musculus
aggctagagagatgactatgctt

SEQ ID NO: 199066 - DNA, 23 bp, Mus musculus
gtttgtgtctggttgtgttccac

SEQ ID NO: 199067 - DNA, 23 bp, Mus musculus
cacatgtctcagtctcatattgg

SEQ ID NO: 199068 - DNA, 22 bp, Mus musculus
tgttttgtgaccaattatatgg

SEQ ID NO: 199069 - DNA, 20 bp, Mus musculus
acattttggtatggcagact

SEQ ID NO: 199070 - DNA, 20 bp, Mus musculus
acacattatgtttatatgta

SEQ ID NO: 199071 - DNA, 23 bp, Mus musculus
acgtatgtatgcatgtgtgagga

SEQ ID NO: 199072 - DNA, 22 bp, Mus musculus
tttttgcatatgatttgtatat

SEQ ID NO: 199073 - DNA, 23 bp, Mus musculus
tgagcctctgagactgtgagatt

SEQ ID NO: 199074 - DNA, 22 bp, Mus musculus
tatcttgctttttctagggtgt

SEQ ID NO: 199075 - DNA, 22 bp, Mus musculus
ttcctggaaagataatgtgtga

SEQ ID NO: 199076 - DNA, 22 bp, Mus musculus
tgttttgtgaccaattatatgg

SEQ ID NO: 199077 - DNA, 18 bp, Mus musculus
caggctcactgtcactct

SEQ ID NO: 199078 - DNA, 23 bp, Mus musculus
tatgtgtatgtacatatgtgtgt

SEQ ID NO: 199079 - DNA, 22 bp, Mus musculus
tgtgtctatctgtgtgtctgtg

SEQ ID NO: 199080 - DNA, 23 bp, Mus musculus
ctctgtagtacagcttgaggtca

SEQ ID NO: 199081 - DNA, 21 bp, Mus musculus
agtatatgatatggatatgta

SEQ ID NO: 199082 - DNA, 23 bp, Mus musculus
gaattgtctactacaggttatct

SEQ ID NO: 199083 - DNA, 21 bp, Mus musculus
agaattgagtagatggtgtta

SEQ ID NO: 199084 - DNA, 22 bp, Mus musculus
tgttttgtgaccaattatatgg

SEQ ID NO: 199085 - DNA, 23 bp, Mus musculus
ctatgtctgtctcatattcaggc

SEQ ID NO: 199086 - DNA, 23 bp, Mus musculus
atgtgctttaacttgagaatcta

SEQ ID NO: 199087 - DNA, 19 bp, Mus musculus
acaactaaatggtaagtgg

SEQ ID NO: 199088 - DNA, 22 bp, Mus musculus
tgttttgtgaccaattatatgg

SEQ ID NO: 199089 - DNA, 18 bp, Mus musculus
atggaaaagttcaggctt

SEQ ID NO: 199090 - DNA, 21 bp, Mus musculus
tgccttggtcatggtgtctgt

SEQ ID NO: 199091 - DNA, 22 bp, Mus musculus
ttcctctttccttcatttgctt

SEQ ID NO: 199092 - DNA, 23 bp, Mus musculus
aatgattgtgaagtagagggggt

SEQ ID NO: 199093 - DNA, 23 bp, Mus musculus
tacatgggactgcttttgataag

SEQ ID NO: 199094 - DNA, 23 bp, Mus musculus
cacagacactagacactgtcatc

SEQ ID NO: 199095 - DNA, 23 bp, Mus musculus
tctgatgcagagtgaaggctgct

SEQ ID NO: 199096 - DNA, 19 bp, Mus musculus
atggcactacatctttttt

SEQ ID NO: 199097 - DNA, 23 bp, Mus musculus
ttgtacatatgaatgaaaaactg

SEQ ID NO: 199098 - DNA, 23 bp, Mus musculus
ggtctctcactgtggctctggat

SEQ ID NO: 199099 - DNA, 23 bp, Mus musculus
tccctctgactctctctacccct

SEQ ID NO: 199100 - DNA, 23 bp, Mus musculus
ggtgggtctgtctgtctgtctct

SEQ ID NO: 199101 - DNA, 19 bp, Mus musculus
atgtagaatcaggaatgtc

SEQ ID NO: 199102 - DNA, 23 bp, Mus musculus
tgctcaaccttgttggtcagcac

SEQ ID NO: 199103 - DNA, 19 bp, Mus musculus
aggaagtagaattaggagt

SEQ ID NO: 199104 - DNA, 23 bp, Mus musculus
ttaagagcactgactgctcttcc

SEQ ID NO: 199105 - DNA, 23 bp, Mus musculus
actcaagcctgtgacctctgtac

SEQ ID NO: 199106 - DNA, 21 bp, Mus musculus
tgaatcagggagtccttgtct

SEQ ID NO: 199107 - DNA, 23 bp, Mus musculus
cagtgggtctctgtgtgtgcaca

SEQ ID NO: 199108 - DNA, 19 bp, Mus musculus
tttagaaggtagagtcagc

SEQ ID NO: 199109 - DNA, 23 bp, Mus musculus
tatgtgtatgtatatatatgtat

SEQ ID NO: 199110 - DNA, 22 bp, Mus musculus
agtcagagcagagacagtgaca

SEQ ID NO: 199111 - DNA, 20 bp, Mus musculus
aaagctcatttctggggctg

SEQ ID NO: 199112 - DNA, 23 bp, Mus musculus
tgtaaacatcctactccctcttc

SEQ ID NO: 199113 - DNA, 22 bp, Mus musculus
agagacagacagattttggttt

SEQ ID NO: 199114 - DNA, 20 bp, Mus musculus
agggtttctctgtatagttc

SEQ ID NO: 199115 - DNA, 23 bp, Mus musculus
tgcctgcctgactgcctgcctgt

SEQ ID NO: 199116 - DNA, 23 bp, Mus musculus
agagacagcagtgagtgagcagt

SEQ ID NO: 199117 - DNA, 23 bp, Mus musculus
atctgccttctgtgtgtgtgaga

SEQ ID NO: 199118 - DNA, 23 bp, Mus musculus
gctctgccactgtttctctgtgc

SEQ ID NO: 199119 - DNA, 19 bp, Mus musculus
agagcactgactgctcttc

SEQ ID NO: 199120 - DNA, 21 bp, Mus musculus
gtgtcgatcaggttgtctctc

SEQ ID NO: 199121 - DNA, 22 bp, Mus musculus
gtactctctcagtatgtgttat

SEQ ID NO: 199122 - DNA, 20 bp, Mus musculus
tgtgactgaggaatggaaga

SEQ ID NO: 199123 - DNA, 21 bp, Mus musculus
gactgtagtcagagagcacat

SEQ ID NO: 199124 - DNA, 23 bp, Mus musculus
attgactctggcagtgtctctgg

SEQ ID NO: 199125 - DNA, 18 bp, Mus musculus
tggctcagtgggtaagat

SEQ ID NO: 199126 - DNA, 22 bp, Mus musculus
ctgagaactgagacaggagaac

SEQ ID NO: 199127 - DNA, 23 bp, Mus musculus
tgtggttctctgggtctctgctt

SEQ ID NO: 199128 - DNA, 18 bp, Mus musculus
tctgtctgttactctgtg

SEQ ID NO: 199129 - DNA, 18 bp, Mus musculus
ttaggaaggttgagaatc

SEQ ID NO: 199130 - DNA, 19 bp, Mus musculus
tcaatgtcctgtctctctt

SEQ ID NO: 199131 - DNA, 23 bp, Mus musculus
acttactattgctgccattgagt

SEQ ID NO: 199132 - DNA, 20 bp, Mus musculus
atagcaggaatgtattgccc

SEQ ID NO: 199133 - DNA, 20 bp, Mus musculus
tgtctgtatgtatatatgta

SEQ ID NO: 199134 - DNA, 21 bp, Mus musculus
tatatgcatgtgtatatgtat

SEQ ID NO: 199135 - DNA, 23 bp, Mus musculus
tgtctgtctgtctgtccagtagg

SEQ ID NO: 199136 - DNA, 21 bp, Mus musculus
cagggacaatgttttattttt

SEQ ID NO: 199137 - DNA, 23 bp, Mus musculus
tatgtgtgtatatatatgtgtgt

SEQ ID NO: 199138 - DNA, 19 bp, Mus musculus
aactccttggttgattatg

SEQ ID NO: 199139 - DNA, 23 bp, Mus musculus
ttctgacaggctgtgtgtctgca

SEQ ID NO: 199140 - DNA, 18 bp, Mus musculus
ggaagaagcagctctgat

SEQ ID NO: 199141 - DNA, 20 bp, Mus musculus
tgtctctgtgtctcccggtc

SEQ ID NO: 199142 - DNA, 23 bp, Mus musculus
atgtatgtatgtatgtatgtgtg

SEQ ID NO: 199143 - DNA, 20 bp, Mus musculus
tgtccagactataactgtcc

SEQ ID NO: 199144 - DNA, 22 bp, Mus musculus
gtgtgcgtgtgtgcgtgcgtgc

SEQ ID NO: 199145 - DNA, 20 bp, Mus musculus
tgagtgcgtgcgtacttacg

SEQ ID NO: 199146 - DNA, 23 bp, Mus musculus
gagatttgacagaacacaagctg

SEQ ID NO: 199147 - DNA, 23 bp, Mus musculus
ttgctggtgactgtcttcttcct

SEQ ID NO: 199148 - DNA, 23 bp, Mus musculus
agtcactgggttttgtgtaccag

SEQ ID NO: 199149 - DNA, 20 bp, Mus musculus
ttcttagctctgactgctgt

SEQ ID NO: 199150 - DNA, 23 bp, Mus musculus
gcgtgtcacactgtggctctcta

SEQ ID NO: 199151 - DNA, 18 bp, Mus musculus
gcatagttctttgcaact

SEQ ID NO: 199152 - DNA, 23 bp, Mus musculus
ttcagttcagagtctggagacaa

SEQ ID NO: 199153 - DNA, 23 bp, Mus musculus
atgtgcatcatatatgtatagat

SEQ ID NO: 199154 - DNA, 22 bp, Mus musculus
actgcatgtatgtatgtatgta

SEQ ID NO: 199155 - DNA, 23 bp, Mus musculus
taaagaggacatggaagaaggga

SEQ ID NO: 199156 - DNA, 21 bp, Mus musculus
tgctctcttttgctctcactc

SEQ ID NO: 199157 - DNA, 19 bp, Mus musculus
acccagagttcagatggct

SEQ ID NO: 199158 - DNA, 20 bp, Mus musculus
tggcttgatgttggaagttc

SEQ ID NO: 199159 - DNA, 23 bp, Mus musculus
agaccactgactgctcttccaga

SEQ ID NO: 199160 - DNA, 23 bp, Mus musculus
tgtctctgtgtgtgtctgtatgt

SEQ ID NO: 199161 - DNA, 23 bp, Mus musculus
tgtgtgtacctacagaggacaaa

SEQ ID NO: 199162 - DNA, 23 bp, Mus musculus
catgcagtgacactgtgtgtgtg

SEQ ID NO: 199163 - DNA, 23 bp, Mus musculus
tgtatgtgtgtatatacatatgt

SEQ ID NO: 199164 - DNA, 20 bp, Mus musculus
tatgtatgtacctatgtatg

SEQ ID NO: 199165 - DNA, 20 bp, Mus musculus
atgtatctatgcatctgtct

SEQ ID NO: 199166 - DNA, 20 bp, Mus musculus
tgaagatggttgactctgtc

SEQ ID NO: 199167 - DNA, 18 bp, Mus musculus
tcaggtagctgtctctgt

SEQ ID NO: 199168 - DNA, 20 bp, Mus musculus
aggctgctggtgctgctgct

SEQ ID NO: 199169 - DNA, 23 bp, Mus musculus
cacactggctgtgtctgtggttg

SEQ ID NO: 199170 - DNA, 21 bp, Mus musculus
taagatgcaggagaagatgtg

SEQ ID NO: 199171 - DNA, 22 bp, Mus musculus
tgttttgtgaccaattatatgg

SEQ ID NO: 199172 - DNA, 23 bp, Mus musculus
atgtgtatatatatgtatgtgtg

SEQ ID NO: 199173 - DNA, 18 bp, Mus musculus
gatgccactgagaatgag

SEQ ID NO: 199174 - DNA, 20 bp, Mus musculus
agatggttctattgtttggt

SEQ ID NO: 199175 - DNA, 23 bp, Mus musculus
tctctgtctctcagtctgtctct

SEQ ID NO: 199176 - DNA, 18 bp, Mus musculus
aatggtcatgttgtcaat

SEQ ID NO: 199177 - DNA, 23 bp, Mus musculus
cagttttctctctgtcattctgc

SEQ ID NO: 199178 - DNA, 21 bp, Mus musculus
atagtttttaaagtcaggtct

SEQ ID NO: 199179 - DNA, 23 bp, Mus musculus
actgacactgtgtaatttgctgt

SEQ ID NO: 199180 - DNA, 23 bp, Mus musculus
acagcgcaacatagtgcttctct

SEQ ID NO: 199181 - DNA, 21 bp, Mus musculus
atgaatgcatagatgtttgtg

SEQ ID NO: 199182 - DNA, 22 bp, Mus musculus
tatgtgtatatgtatatatgtg

SEQ ID NO: 199183 - DNA, 21 bp, Mus musculus
tatgcatatatgtatatgtgt

SEQ ID NO: 199184 - DNA, 23 bp, Mus musculus
tgtgtgtatgtatatatgtgtgt

SEQ ID NO: 199185 - DNA, 23 bp, Mus musculus
caatatatctatatgtatagcta

SEQ ID NO: 199186 - DNA, 23 bp, Mus musculus
aagggacagtagtgagtgacccc

SEQ ID NO: 199187 - DNA, 18 bp, Mus musculus
atttgaggcaggttctgg

SEQ ID NO: 199188 - DNA, 22 bp, Mus musculus
agaagacaggcaggtgaggatg

SEQ ID NO: 199189 - DNA, 22 bp, Mus musculus
tgactgtagtttctgtggtcac

SEQ ID NO: 199190 - DNA, 19 bp, Mus musculus
atgcagccaattagctggc

SEQ ID NO: 199191 - DNA, 23 bp, Mus musculus
tgctctcgctctcactctctagt

SEQ ID NO: 199192 - DNA, 19 bp, Mus musculus
tggctcagtggttaagagc

SEQ ID NO: 199193 - DNA, 21 bp, Mus musculus
tctgagcttgttagattgtgt

SEQ ID NO: 199194 - DNA, 23 bp, Mus musculus
ctgacccactgtgggtgtgttct

SEQ ID NO: 199195 - DNA, 22 bp, Mus musculus
tatacacacacatatatatgta

SEQ ID NO: 199196 - DNA, 23 bp, Mus musculus
aagagcactgactgctcttccag

SEQ ID NO: 199197 - DNA, 18 bp, Mus musculus
tgtatgtatgtatatatg

SEQ ID NO: 199198 - DNA, 23 bp, Mus musculus
tgcctgcctgcctgcctgcctgc

SEQ ID NO: 199199 - DNA, 23 bp, Mus musculus
gatgagacagacatgggtgtagg

SEQ ID NO: 199200 - DNA, 23 bp, Mus musculus
ctcaccctgtgtctggctctctc

SEQ ID NO: 199201 - DNA, 23 bp, Mus musculus
ctgctctctctctgtgtgtgtgt

SEQ ID NO: 199202 - DNA, 23 bp, Mus musculus
tatttgagtgtttgttcatgagt

SEQ ID NO: 199203 - DNA, 22 bp, Mus musculus
tatgtgaccatcacagtgggaa

SEQ ID NO: 199204 - DNA, 23 bp, Mus musculus
aaagagaggcagacaggcaggct

SEQ ID NO: 199205 - DNA, 23 bp, Mus musculus
tgtgtctgtctgactctttgtac

SEQ ID NO: 199206 - DNA, 23 bp, Mus musculus
tgtcgctgtctctgtctgcctct

SEQ ID NO: 199207 - DNA, 23 bp, Mus musculus
tgctggcactgtgtttggtttgt

SEQ ID NO: 199208 - DNA, 23 bp, Mus musculus
agttcatctctctctctctcagc

SEQ ID NO: 199209 - DNA, 23 bp, Mus musculus
ctctggatttctctctgtgtgtc

SEQ ID NO: 199210 - DNA, 23 bp, Mus musculus
tctctctgtctgtcagtgccaca

SEQ ID NO: 199211 - DNA, 23 bp, Mus musculus
atgggaagggtgtgacgtatggt

SEQ ID NO: 199212 - DNA, 23 bp, Mus musculus
atgatgatgatgctgctgctgct

SEQ ID NO: 199213 - DNA, 19 bp, Mus musculus
gcactgctgtgtgtgcaca

SEQ ID NO: 199214 - DNA, 19 bp, Mus musculus
aacagagccttctaggtgg

SEQ ID NO: 199215 - DNA, 23 bp, Mus musculus
tggcagagtccctgtatgcctgg

SEQ ID NO: 199216 - DNA, 22 bp, Mus musculus
gaggctgctagatgaattcaga

SEQ ID NO: 199217 - DNA, 23 bp, Mus musculus
ccctggctctgcttcttgtaagg

SEQ ID NO: 199218 - DNA, 21 bp, Mus musculus
acaccctgctcatgctgctgg

SEQ ID NO: 199219 - DNA, 23 bp, Mus musculus
tagtgtgtgtgcatatgcatgtg

SEQ ID NO: 199220 - DNA, 19 bp, Mus musculus
acacatgatattgaaggct

SEQ ID NO: 199221 - DNA, 23 bp, Mus musculus
ctctgtggtcagatgtgtgtcag

SEQ ID NO: 199222 - DNA, 22 bp, Mus musculus
atatgtgtgtatatatatgtat

SEQ ID NO: 199223 - DNA, 21 bp, Mus musculus
ttcaattctcagcaaccacat

SEQ ID NO: 199224 - DNA, 23 bp, Mus musculus
acttgacactgtgtcacactgtg

SEQ ID NO: 199225 - DNA, 23 bp, Mus musculus
ctgagtatctcactggctcttgt

SEQ ID NO: 199226 - DNA, 23 bp, Mus musculus
gaccctctctggctgacttcaga

SEQ ID NO: 199227 - DNA, 23 bp, Mus musculus
tgtgtggctgtctgtgtgtctgt

SEQ ID NO: 199228 - DNA, 23 bp, Mus musculus
acaactgctggcaaattatggca

SEQ ID NO: 199229 - DNA, 23 bp, Mus musculus
ctgtgtgtctgtctctctgtctg

SEQ ID NO: 199230 - DNA, 22 bp, Mus musculus
gactgttgtctgtctgtctgtc

SEQ ID NO: 199231 - DNA, 22 bp, Mus musculus
tgtgtgtgtgcatatgcatgtg

SEQ ID NO: 199232 - DNA, 23 bp, Mus musculus
tcagtggattaaagtctggatct

SEQ ID NO: 199233 - DNA, 22 bp, Mus musculus
catgtgtatgtatgtatatgca

SEQ ID NO: 199234 - DNA, 23 bp, Mus musculus
tgtatgtatgtatgtatgtgcat

SEQ ID NO: 199235 - DNA, 23 bp, Mus musculus
tgtgtgcatgtatgttcatgcat

SEQ ID NO: 199236 - DNA, 22 bp, Mus musculus
tattctgactcactgtctcagg

SEQ ID NO: 199237 - DNA, 19 bp, Mus musculus
taggttcaatttccagtaa

SEQ ID NO: 199238 - DNA, 20 bp, Mus musculus
tgtcacttagctgtgtgaag

SEQ ID NO: 199239 - DNA, 23 bp, Mus musculus
gtctgtgtctgtgtgagtttatg

SEQ ID NO: 199240 - DNA, 23 bp, Mus musculus
aacattcaacctgtcggtgagtt

SEQ ID NO: 199241 - DNA, 22 bp, Mus musculus
accatcgaccgttgagtggacc

SEQ ID NO: 199242 - DNA, 23 bp, Mus musculus
aaaagcactgactgctcttccag

SEQ ID NO: 199243 - DNA, 22 bp, Mus musculus
atgacacctgagagtgtgcaga

SEQ ID NO: 199244 - DNA, 22 bp, Mus musculus
ttatgtcaagtttgaggaacac

SEQ ID NO: 199245 - DNA, 23 bp, Mus musculus
agcaccagagggtctcttgtcag

SEQ ID NO: 199246 - DNA, 21 bp, Mus musculus
tgcatgtgtgcatgtgcgtgc

SEQ ID NO: 199247 - DNA, 21 bp, Mus musculus
tatgtgcatatgcatgtttat

SEQ ID NO: 199248 - DNA, 23 bp, Mus musculus
tatttgtatgcttatgtatgtgt

SEQ ID NO: 199249 - DNA, 22 bp, Mus musculus
taagtggactgaaatatttggc

SEQ ID NO: 199250 - DNA, 21 bp, Mus musculus
ttctgtctgtattagcagtgc

SEQ ID NO: 199251 - DNA, 23 bp, Mus musculus
gactccctctgtgactgatgtcg

SEQ ID NO: 199252 - DNA, 23 bp, Mus musculus
tgtctgtctgtctgtcttcactg

SEQ ID NO: 199253 - DNA, 23 bp, Mus musculus
actcagacactcacacactggga

SEQ ID NO: 199254 - DNA, 23 bp, Mus musculus
tagctcaccctgctttgatctgg

SEQ ID NO: 199255 - DNA, 18 bp, Mus musculus
aggagcttagtatgatgt

SEQ ID NO: 199256 - DNA, 22 bp, Mus musculus
tgtctgtctgtctgtcttttat

SEQ ID NO: 199257 - DNA, 22 bp, Mus musculus
agtgctggctgtgtatgttgta

SEQ ID NO: 199258 - DNA, 23 bp, Mus musculus
cagtcaggatgagttttgttttt

SEQ ID NO: 199259 - DNA, 23 bp, Mus musculus
caatgtcaccaagtggctgagat

SEQ ID NO: 199260 - DNA, 23 bp, Mus musculus
tgaatctctctgcttctcattcc

SEQ ID NO: 199261 - DNA, 21 bp, Mus musculus
cagtgctttcaagttcccact

SEQ ID NO: 199262 - DNA, 23 bp, Mus musculus
gttgctgagagtgagctaatcaa

SEQ ID NO: 199263 - DNA, 23 bp, Mus musculus
ttatagaatgtattgatgtctga

SEQ ID NO: 199264 - DNA, 22 bp, Mus musculus
acgagagtatacatggtgaggg

SEQ ID NO: 199265 - DNA, 23 bp, Mus musculus
atatgtatgtataaatgtatgaa

SEQ ID NO: 199266 - DNA, 23 bp, Mus musculus
aatgtatatatgtatgtatgtat

SEQ ID NO: 199267 - DNA, 19 bp, Mus musculus
tgtgtctatgtatgtatat

SEQ ID NO: 199268 - DNA, 23 bp, Mus musculus
tatatgtgtatgtgtatctgtgt

SEQ ID NO: 199269 - DNA, 22 bp, Mus musculus
agagatgagagagtccacactt

SEQ ID NO: 199270 - DNA, 23 bp, Mus musculus
actctgtctctgtttagcttctg

SEQ ID NO: 199271 - DNA, 21 bp, Mus musculus
atctgtccattgatgagagtg

SEQ ID NO: 199272 - DNA, 19 bp, Mus musculus
catcagctctgacaaactg

SEQ ID NO: 199273 - DNA, 23 bp, Mus musculus
gtcagagaacagagtgtgctgat

SEQ ID NO: 199274 - DNA, 23 bp, Mus musculus
tgtatacatggttctgtctctga

SEQ ID NO: 199275 - DNA, 21 bp, Mus musculus
aactgttgtcagcagattggt

SEQ ID NO: 199276 - DNA, 23 bp, Mus musculus
agtctatttttatagatgatgaa

SEQ ID NO: 199277 - DNA, 23 bp, Mus musculus
tctatatggatatctatagtgaa

SEQ ID NO: 199278 - DNA, 18 bp, Mus musculus
ttagatgtaggttggaaa

SEQ ID NO: 199279 - DNA, 23 bp, Mus musculus
tatatgtgcatatgcatgtatat

SEQ ID NO: 199280 - DNA, 23 bp, Mus musculus
tatatgtatgtgtatatgtatgt

SEQ ID NO: 199281 - DNA, 23 bp, Mus musculus
tcagattcttgatgatcctgatt

SEQ ID NO: 199282 - DNA, 23 bp, Mus musculus
agtcacccagtgtctggctctca

SEQ ID NO: 199283 - DNA, 19 bp, Mus musculus
tctgtggagctcagtttac

SEQ ID NO: 199284 - DNA, 20 bp, Mus musculus
gtatgtgtatgtatgtgtat

SEQ ID NO: 199285 - DNA, 23 bp, Mus musculus
tcaatgagttggtatgtagttta

SEQ ID NO: 199286 - DNA, 23 bp, Mus musculus
acttcagactgacttattgtaga

SEQ ID NO: 199287 - DNA, 20 bp, Mus musculus
atgtgtatatatgtatatgt

SEQ ID NO: 199288 - DNA, 22 bp, Mus musculus
tatgtgtacatgtatgtgtgtg

SEQ ID NO: 199289 - DNA, 23 bp, Mus musculus
gtcacagtttggtcttagagtct

SEQ ID NO: 199290 - DNA, 23 bp, Mus musculus
tgcctgtgtgcctgtgtgcctgt

SEQ ID NO: 199291 - DNA, 21 bp, Mus musculus
ttttagtacttttagttttca

SEQ ID NO: 199292 - DNA, 18 bp, Mus musculus
actgaagactgagaggag

SEQ ID NO: 199293 - DNA, 20 bp, Mus musculus
tcacagtgtagcttcctcct

SEQ ID NO: 199294 - DNA, 20 bp, Mus musculus
aatatacaagatacactagt

SEQ ID NO: 199295 - DNA, 19 bp, Mus musculus
gtgagccagtcactcacac

SEQ ID NO: 199296 - DNA, 18 bp, Mus musculus
acagtcactttcactctg

SEQ ID NO: 199297 - DNA, 20 bp, Mus musculus
atgaggtaatatgtatttgt

SEQ ID NO: 199298 - DNA, 23 bp, Mus musculus
actgtgtctctgtttagcttctg

SEQ ID NO: 199299 - DNA, 21 bp, Mus musculus
atctgtccattgatgagagtg

SEQ ID NO: 199300 - DNA, 18 bp, Mus musculus
atggtggtctgataggaa

SEQ ID NO: 199301 - DNA, 22 bp, Mus musculus
tgttttgtgaccaattatatgg

SEQ ID NO: 199302 - DNA, 23 bp, Mus musculus
tttttgtctctggaagacttgtg

SEQ ID NO: 199303 - DNA, 23 bp, Mus musculus
gggtctctctctctctctctgac

SEQ ID NO: 199304 - DNA, 22 bp, Mus musculus
agtgaatttttaaacagctcat

SEQ ID NO: 199305 - DNA, 23 bp, Mus musculus
tgtctctctgtctgtgcgtgtta

SEQ ID NO: 199306 - DNA, 23 bp, Mus musculus
tgtgtgtgcatatgcatgtgtat

SEQ ID NO: 199307 - DNA, 23 bp, Mus musculus
tgtgtatgcatatgtatacgtat

SEQ ID NO: 199308 - DNA, 23 bp, Mus musculus
ttgcagcactcattgcttgagta

SEQ ID NO: 199309 - DNA, 23 bp, Mus musculus
tgaagtgctgtgtgtcctgtaag

SEQ ID NO: 199310 - DNA, 23 bp, Mus musculus
tagcagaatgaaccttgttttgt

SEQ ID NO: 199311 - DNA, 19 bp, Mus musculus
agacagggtttctctgtgt

SEQ ID NO: 199312 - DNA, 23 bp, Mus musculus
ataggtagagtagtgtaaatgat

SEQ ID NO: 199313 - DNA, 23 bp, Mus musculus
agagatgtgactgaggaatggga

SEQ ID NO: 199314 - DNA, 19 bp, Mus musculus
aggatgtaggtagtaaagt

SEQ ID NO: 199315 - DNA, 23 bp, Mus musculus
ttctctgtgaggtaatcaactgg

SEQ ID NO: 199316 - DNA, 23 bp, Mus musculus
tgtgtgtgtgtgtgtgtgcaatg

SEQ ID NO: 199317 - DNA, 22 bp, Mus musculus
taggtcgtcataaaggactttt

SEQ ID NO: 199318 - DNA, 19 bp, Mus musculus
gtgtcagtgtcacctggac

SEQ ID NO: 199319 - DNA, 23 bp, Mus musculus
caaatgtctttgcattggctttc

SEQ ID NO: 199320 - DNA, 22 bp, Mus musculus
ttgttagtggaagtgatatgtt

SEQ ID NO: 199321 - DNA, 23 bp, Mus musculus
tatgtatgtatgtatatatgtat

SEQ ID NO: 199322 - DNA, 21 bp, Mus musculus
atgtagatggacataccatat

SEQ ID NO: 199323 - DNA, 21 bp, Mus musculus
tggtatgttgtctgcaagctg

SEQ ID NO: 199324 - DNA, 22 bp, Mus musculus
tgtgtgcatgtatgtttatgtg

SEQ ID NO: 199325 - DNA, 22 bp, Mus musculus
gattcccattgtcctgtagagt

SEQ ID NO: 199326 - DNA, 22 bp, Mus musculus
aggaaactacagaagtttgtgc

SEQ ID NO: 199327 - DNA, 23 bp, Mus musculus
gttttcttcatgtcaatggttct

SEQ ID NO: 199328 - DNA, 23 bp, Mus musculus
tcttcagtggatagttgtcaggg

SEQ ID NO: 199329 - DNA, 21 bp, Mus musculus
tatagtacatgtacatgcaca

SEQ ID NO: 199330 - DNA, 23 bp, Mus musculus
tggtctcagcatgttgtatctat

SEQ ID NO: 199331 - DNA, 23 bp, Mus musculus
ttctgtcactttctgactgtgtt

SEQ ID NO: 199332 - DNA, 22 bp, Mus musculus
tgttttgtgaccaattatatgg

SEQ ID NO: 199333 - DNA, 19 bp, Mus musculus
tgtatatatgtatatgtgt

SEQ ID NO: 199334 - DNA, 22 bp, Mus musculus
accaactctgaaagatattttt

SEQ ID NO: 199335 - DNA, 23 bp, Mus musculus
agtatatcttatagtaattggat

SEQ ID NO: 199336 - DNA, 18 bp, Mus musculus
cagcagcattaactgctg

SEQ ID NO: 199337 - DNA, 21 bp, Mus musculus
tgtatgtgtgtgcatgtggta

SEQ ID NO: 199338 - DNA, 23 bp, Mus musculus
accattgtctcttttctgatgga

SEQ ID NO: 199339 - DNA, 23 bp, Mus musculus
atctctgtgtatgatgtatgctt

SEQ ID NO: 199340 - DNA, 19 bp, Mus musculus
cacagccatacatatgcat

SEQ ID NO: 199341 - DNA, 22 bp, Mus musculus
tgttttgtgaccaattatatgg

SEQ ID NO: 199342 - DNA, 22 bp, Mus musculus
tgttttgtgaccaattatatgg

SEQ ID NO: 199343 - DNA, 23 bp, Mus musculus
cttaacagagatcagagatagct

SEQ ID NO: 199344 - DNA, 21 bp, Mus musculus
tgtgtgtgcatatgcacacag

SEQ ID NO: 199345 - DNA, 21 bp, Mus musculus
atctgtgtgtgcatgtgcacg

SEQ ID NO: 199346 - DNA, 23 bp, Mus musculus
ttagtgtgtggtgatctgatagg

SEQ ID NO: 199347 - DNA, 22 bp, Mus musculus
tgttttgtgaccaattatatgg

SEQ ID NO: 199348 - DNA, 23 bp, Mus musculus
atggatggcagtgtgtgggtaaa

SEQ ID NO: 199349 - DNA, 23 bp, Mus musculus
gtcaagctccatttgaaataaca

SEQ ID NO: 199350 - DNA, 22 bp, Mus musculus
tctctgacattctgtgtctgag

SEQ ID NO: 199351 - DNA, 23 bp, Mus musculus
gtcactgctttagtatttgggag

SEQ ID NO: 199352 - DNA, 23 bp, Mus musculus
tgtgtctggctgtctgttcctct

SEQ ID NO: 199353 - DNA, 18 bp, Mus musculus
atctatatatatgtgaat

SEQ ID NO: 199354 - DNA, 23 bp, Mus musculus
tgcaccatgtacatacagtactg

SEQ ID NO: 199355 - DNA, 19 bp, Mus musculus
ctcagagttcagagtggcc

SEQ ID NO: 199356 - DNA, 18 bp, Mus musculus
cacagggctcttggtgcc

SEQ ID NO: 199357 - DNA, 23 bp, Mus musculus
acacagtactgggaagagatact

SEQ ID NO: 199358 - DNA, 19 bp, Mus musculus
attctctgtggctgtgtta

SEQ ID NO: 199359 - DNA, 23 bp, Mus musculus
gaggcaggagtattgtggctttg

SEQ ID NO: 199360 - DNA, 21 bp, Mus musculus
tatatatctccagcaaaacac

SEQ ID NO: 199361 - DNA, 23 bp, Mus musculus
agccctgagtgtctgtctctctc

SEQ ID NO: 199362 - DNA, 22 bp, Mus musculus
tatacagaatttctttatgaca

SEQ ID NO: 199363 - DNA, 23 bp, Mus musculus
tctctctgagtctcagtttctcc

SEQ ID NO: 199364 - DNA, 23 bp, Mus musculus
cagtgtctctgtgtgagagtgct

SEQ ID NO: 199365 - DNA, 19 bp, Mus musculus
tgagacatggtttctctgt

SEQ ID NO: 199366 - DNA, 22 bp, Mus musculus
gcttgtgactcccttagttctg

SEQ ID NO: 199367 - DNA, 21 bp, Mus musculus
cttctctgcctctcagggcct

SEQ ID NO: 199368 - DNA, 22 bp, Mus musculus
tgatgaccttgaactcttgatc

SEQ ID NO: 199369 - DNA, 23 bp, Mus musculus
gtatgtatgtatgtacgtgtgtg

SEQ ID NO: 199370 - DNA, 22 bp, Mus musculus
tctgcctgcctgcctgccagcc

SEQ ID NO: 199371 - DNA, 23 bp, Mus musculus
attcattgtagcagttctcttac

SEQ ID NO: 199372 - DNA, 23 bp, Mus musculus
tgcctctgtgtgactcagagcct

SEQ ID NO: 199373 - DNA, 18 bp, Mus musculus
ggcaagaagtctgctgag

SEQ ID NO: 199374 - DNA, 23 bp, Mus musculus
tgagacagactctcttactgaaa

SEQ ID NO: 199375 - DNA, 19 bp, Mus musculus
tttctctggcttctataca

SEQ ID NO: 199376 - DNA, 23 bp, Mus musculus
gacaccctcactctgtcctagta

SEQ ID NO: 199377 - DNA, 23 bp, Mus musculus
actagcgacatgtgagtgtgcac

SEQ ID NO: 199378 - DNA, 23 bp, Mus musculus
tgtgtacatgtatgtatgtatgt

SEQ ID NO: 199379 - DNA, 23 bp, Mus musculus
tatgaatgaatgcatgtgtatgg

SEQ ID NO: 199380 - DNA, 19 bp, Mus musculus
agaggttctaagttcaatt

SEQ ID NO: 199381 - DNA, 18 bp, Mus musculus
tggtgcactctcttctgt

SEQ ID NO: 199382 - DNA, 23 bp, Mus musculus
cttacagatgtctgcactatgga

SEQ ID NO: 199383 - DNA, 22 bp, Mus musculus
tctggctcaccatctcctggga

SEQ ID NO: 199384 - DNA, 18 bp, Mus musculus
agccttgctgtgtgcctg

SEQ ID NO: 199385 - DNA, 23 bp, Mus musculus
actcactcactcagctaagccag

SEQ ID NO: 199386 - DNA, 23 bp, Mus musculus
acacagggaacacactgaccact

SEQ ID NO: 199387 - DNA, 23 bp, Mus musculus
gatacatgtggctactgtcacac

SEQ ID NO: 199388 - DNA, 21 bp, Mus musculus
cacagatatgtgtgtgtctgt

SEQ ID NO: 199389 - DNA, 19 bp, Mus musculus
tgtatgcatgcatgtgtgt

SEQ ID NO: 199390 - DNA, 19 bp, Mus musculus
tgacagagatgacaggcct

SEQ ID NO: 199391 - DNA, 18 bp, Mus musculus
ggacagggactcctcagc

SEQ ID NO: 199392 - DNA, 22 bp, Mus musculus
tctctcttgctctcagtgtcct

SEQ ID NO: 199393 - DNA, 23 bp, Mus musculus
cagtcactgtccctgtgagcctg

SEQ ID NO: 199394 - DNA, 19 bp, Mus musculus
acagcagctgagttacaga

SEQ ID NO: 199395 - DNA, 23 bp, Mus musculus
tctggcagtcagtctgtgtctgt

SEQ ID NO: 199396 - DNA, 22 bp, Mus musculus
agactgaagactgacagcagca

SEQ ID NO: 199397 - DNA, 23 bp, Mus musculus
tctctccctctctgactgctttc

SEQ ID NO: 199398 - DNA, 23 bp, Mus musculus
tggatctcttgtcagtttgttct

SEQ ID NO: 199399 - DNA, 21 bp, Mus musculus
tacagaatcaggtctgcatcc

SEQ ID NO: 199400 - DNA, 23 bp, Mus musculus
tgtctgtctgtctgtctgtgggt

SEQ ID NO: 199401 - DNA, 19 bp, Mus musculus
acacaggtagaatcagaca

SEQ ID NO: 199402 - DNA, 23 bp, Mus musculus
acactctggctgtgacagtccca

SEQ ID NO: 199403 - DNA, 23 bp, Mus musculus
gacactgaagaaggaagctctct

SEQ ID NO: 199404 - DNA, 22 bp, Mus musculus
ctgaggctctgactctgccaaa

SEQ ID NO: 199405 - DNA, 20 bp, Mus musculus
tggctcagtggttaggagca

SEQ ID NO: 199406 - DNA, 23 bp, Mus musculus
tgcatctgcaactgcttgtgata

SEQ ID NO: 199407 - DNA, 22 bp, Mus musculus
tatctatatagatatgtgtgtg

SEQ ID NO: 199408 - DNA, 23 bp, Mus musculus
tactaagttctgtgtctgtgtga

SEQ ID NO: 199409 - DNA, 23 bp, Mus musculus
atgtatatgaatgtatttatcta

SEQ ID NO: 199410 - DNA, 23 bp, Mus musculus
aatcactgcctgctttgaacagg

SEQ ID NO: 199411 - DNA, 23 bp, Mus musculus
ttgttggcacagcctgtatagtg

SEQ ID NO: 199412 - DNA, 23 bp, Mus musculus
tgtatgcagtgtgtgtgtgtgtg

SEQ ID NO: 199413 - DNA, 23 bp, Mus musculus
ttatgtgcatatgtatgtatatg

SEQ ID NO: 199414 - DNA, 23 bp, Mus musculus
tcatgagtgtgcatattttaaca

SEQ ID NO: 199415 - DNA, 21 bp, Mus musculus
tcaggtattttgtcacagtga

SEQ ID NO: 199416 - DNA, 23 bp, Mus musculus
tgtatgtatatatatgtatgtgt

SEQ ID NO: 199417 - DNA, 22 bp, Mus musculus
tgttttgtgaccaattatatgg

SEQ ID NO: 199418 - DNA, 19 bp, Mus musculus
atctgtgtgtatatgtaca

SEQ ID NO: 199419 - DNA, 22 bp, Mus musculus
tctctgggtctctgtctgttca

SEQ ID NO: 199420 - DNA, 23 bp, Mus musculus
tctgtgtttgtctatgacatatg

SEQ ID NO: 199421 - DNA, 18 bp, Mus musculus
atagacagccagcttagg

SEQ ID NO: 199422 - DNA, 23 bp, Mus musculus
ttctgtctggctgtgtgtctcta

SEQ ID NO: 199423 - DNA, 23 bp, Mus musculus
ttgacacaggaagtaaatatctg

SEQ ID NO: 199424 - DNA, 23 bp, Mus musculus
tgtcagacagattttgtactgcc

SEQ ID NO: 199425 - DNA, 23 bp, Mus musculus
tttaaactggttgttttctctgc

SEQ ID NO: 199426 - DNA, 23 bp, Mus musculus
tcattttttgtactggtatggct

SEQ ID NO: 199427 - DNA, 22 bp, Mus musculus
taaaaacaggaacatgaaatga

SEQ ID NO: 199428 - DNA, 22 bp, Mus musculus
gaggattgaagtcagaacctca

SEQ ID NO: 199429 - DNA, 23 bp, Mus musculus
agcacttgactgactgagttatc

SEQ ID NO: 199430 - DNA, 18 bp, Mus musculus
tctgtgtgtctgtgtgtg

SEQ ID NO: 199431 - DNA, 22 bp, Mus musculus
gtgtgaatgtttctgtgtgtat

SEQ ID NO: 199432 - DNA, 22 bp, Mus musculus
tcagtgtgatcatctgaccctt

SEQ ID NO: 199433 - DNA, 22 bp, Mus musculus
aggagtgtaaagaagtgtgatc

SEQ ID NO: 199434 - DNA, 22 bp, Mus musculus
aaagaacttggacagagcatca

SEQ ID NO: 199435 - DNA, 20 bp, Mus musculus
aaagatgtgatcttgttgtt

SEQ ID NO: 199436 - DNA, 23 bp, Mus musculus
ataaaagcacatcttcttgagag

SEQ ID NO: 199437 - DNA, 23 bp, Mus musculus
tagtccatggtgatttgatagga

SEQ ID NO: 199438 - DNA, 23 bp, Mus musculus
ttgaggaagcttttatttttgtt

SEQ ID NO: 199439 - DNA, 23 bp, Mus musculus
agtagtagctacagtgtaagtga

SEQ ID NO: 199440 - DNA, 22 bp, Mus musculus
tgttttgtgaccaattatatgg

SEQ ID NO: 199441 - DNA, 20 bp, Mus musculus
tgtgtctttgactatatccc

SEQ ID NO: 199442 - DNA, 23 bp, Mus musculus
tgagacactgcctccctcaaaga

SEQ ID NO: 199443 - DNA, 22 bp, Mus musculus
gtacaacattgttcagaggggt

SEQ ID NO: 199444 - DNA, 21 bp, Mus musculus
gacagacagacagacagacag

SEQ ID NO: 199445 - DNA, 19 bp, Mus musculus
ctctgccagtcactgctca

SEQ ID NO: 199446 - DNA, 22 bp, Mus musculus
ttcttgtatgtgtgcatgtgtt

SEQ ID NO: 199447 - DNA, 23 bp, Mus musculus
gtaatcttgtatgtgtgtgtata

SEQ ID NO: 199448 - DNA, 18 bp, Mus musculus
tatacatatgattgcata

SEQ ID NO: 199449 - DNA, 22 bp, Mus musculus
tgttttgtgaccaattatatgg

SEQ ID NO: 199450 - DNA, 23 bp, Mus musculus
tgtatgtatgtgtatatgtatac

SEQ ID NO: 199451 - DNA, 23 bp, Mus musculus
tgtatgtatatatatgtgtgtgt

SEQ ID NO: 199452 - DNA, 23 bp, Mus musculus
tagtgcatggtgatctgatagga

SEQ ID NO: 199453 - DNA, 21 bp, Mus musculus
tgttttgtgaccaattatgtg

SEQ ID NO: 199454 - DNA, 23 bp, Mus musculus
gtgtttctatatgtatgtgtgtg

SEQ ID NO: 199455 - DNA, 22 bp, Mus musculus
agagtgtgtgtgctatggtggt

SEQ ID NO: 199456 - DNA, 23 bp, Mus musculus
tgcgtgcgtgcgtgcgtgcgtgc

SEQ ID NO: 199457 - DNA, 23 bp, Mus musculus
aggtgacagtactgtctcagaac

SEQ ID NO: 199458 - DNA, 23 bp, Mus musculus
tctgtctgtctgtctgtctgtct

SEQ ID NO: 199459 - DNA, 18 bp, Mus musculus
ctgtttagttagggtccc

SEQ ID NO: 199460 - DNA, 19 bp, Mus musculus
agtagtcactggttgcctt

SEQ ID NO: 199461 - DNA, 20 bp, Mus musculus
atcctttgtctaattcatga

SEQ ID NO: 199462 - DNA, 22 bp, Mus musculus
atgagtggtataggtcctgctt

SEQ ID NO: 199463 - DNA, 22 bp, Mus musculus
ttcagagcgttgtaaccttctt

SEQ ID NO: 199464 - DNA, 23 bp, Mus musculus
ttctagctcctttccaaaattgt

SEQ ID NO: 199465 - DNA, 23 bp, Mus musculus
tgtgcgtgtgcatgtgcatgtgc

SEQ ID NO: 199466 - DNA, 23 bp, Mus musculus
gtgtgtccctctgcctctgtgtc

SEQ ID NO: 199467 - DNA, 23 bp, Mus musculus
aacaaggactagatctgctgatg

SEQ ID NO: 199468 - DNA, 18 bp, Mus musculus
agtcaggctgtctgtgtt

SEQ ID NO: 199469 - DNA, 23 bp, Mus musculus
atagtctcacaagagagagagct

SEQ ID NO: 199470 - DNA, 23 bp, Mus musculus
tcttgctagtatatgcaatggtg

SEQ ID NO: 199471 - DNA, 22 bp, Mus musculus
tgttttgtgaccaattatatgg

SEQ ID NO: 199472 - DNA, 23 bp, Mus musculus
aaggctgtgtcaatggtctttgt
